United States Patent 7,655,785 (BIOINFORMATICALLY DETECTABLE GROUP OF NOVEL REGULATORY OLIGONUCLEOTIDES AND USES THEREOF) - sequence listing, part 9

SEQ ID NO: 322946 - RNA, 19 nt, Homo sapiens
gcuuagagacaaaacauug

SEQ ID NO: 322947 - RNA, 22 nt, Homo sapiens
gcuuugcaauggcauugaccau

SEQ ID NO: 322948 - RNA, 21 nt, Homo sapiens
gcuuuuucggaagucuuuggc

SEQ ID NO: 322949 - RNA, 18 nt, Homo sapiens
ggaaaacuuuucuaagua

SEQ ID NO: 322950 - RNA, 22 nt, Homo sapiens
ggaaagauguaauauuaucuaa

SEQ ID NO: 322951 - RNA, 22 nt, Homo sapiens
ggaaagcuagguguggguguac

SEQ ID NO: 322952 - RNA, 22 nt, Homo sapiens
ggaaaguccuucuguaggcucc

SEQ ID NO: 322953 - RNA, 22 nt, Homo sapiens
ggaagacaguguggugauuccu

SEQ ID NO: 322954 - RNA, 22 nt, Homo sapiens
ggaagguaauuggguaaugaga

SEQ ID NO: 322955 - RNA, 22 nt, Homo sapiens
ggaaugcuaaaauaggaugcug

SEQ ID NO: 322956 - RNA, 22 nt, Homo sapiens
ggaauuaaggcaauugaaagcu

SEQ ID NO: 322957 - RNA, 21 nt, Homo sapiens
ggaauuuagggaaugauuuag

SEQ ID NO: 322958 - RNA, 22 nt, Homo sapiens
ggacuagaggugaaaagaagac

SEQ ID NO: 322959 - RNA, 23 nt, Homo sapiens
ggacuguaagggauauaaagguu

SEQ ID NO: 322960 - RNA, 22 nt, Homo sapiens
ggacuguaauaccaugaggaca

SEQ ID NO: 322961 - RNA, 22 nt, Homo sapiens
ggacugucagggcuauuaguca

SEQ ID NO: 322962 - RNA, 22 nt, Homo sapiens
ggagaguaauuagacugaaaga

SEQ ID NO: 322963 - RNA, 22 nt, Homo sapiens
ggagagugacauauuucuaggc

SEQ ID NO: 322964 - RNA, 22 nt, Homo sapiens
ggagauaauccagggagggacu

SEQ ID NO: 322965 - RNA, 22 nt, Homo sapiens
ggagauguuuaaccuuuuaucu

SEQ ID NO: 322966 - RNA, 22 nt, Homo sapiens
ggagcucaucuagcauagaggu

SEQ ID NO: 322967 - RNA, 22 nt, Homo sapiens
ggagcugugauuugaguccaga

SEQ ID NO: 322968 - RNA, 22 nt, Homo sapiens
ggagguagguuugugauuugua

SEQ ID NO: 322969 - RNA, 22 nt, Homo sapiens
ggagucugauguucuaaggcag

SEQ ID NO: 322970 - RNA, 23 nt, Homo sapiens
ggaguguaaugacucgaucucgg

SEQ ID NO: 322971 - RNA, 22 nt, Homo sapiens
ggaguguaauggcgccaucuca

SEQ ID NO: 322972 - RNA, 22 nt, Homo sapiens
augaggugaggucaguaaggua

SEQ ID NO: 322973 - RNA, 22 nt, Homo sapiens
augaggugaguaaauaaaugaa

SEQ ID NO: 322974 - RNA, 22 nt, Homo sapiens
augaggugggagaaucacuuga

SEQ ID NO: 322975 - RNA, 22 nt, Homo sapiens
augagucacuuauuauuggggu

SEQ ID NO: 322976 - RNA, 22 nt, Homo sapiens
augauaaguuauuagaagaaga

SEQ ID NO: 322977 - RNA, 22 nt, Homo sapiens
augauagguuuagguuuagaca

SEQ ID NO: 322978 - RNA, 22 nt, Homo sapiens
augauauggucacccuuaugaa

SEQ ID NO: 322979 - RNA, 22 nt, Homo sapiens
augaucaucugaaagcuuuuac

SEQ ID NO: 322980 - RNA, 22 nt, Homo sapiens
augaucauggaagugcacccau

SEQ ID NO: 322981 - RNA, 22 nt, Homo sapiens
augauccagugaguuucaguuc

SEQ ID NO: 322982 - RNA, 22 nt, Homo sapiens
augauggagguagauuguccau

SEQ ID NO: 322983 - RNA, 22 nt, Homo sapiens
augauguaggccauggguuucu

SEQ ID NO: 322984 - RNA, 22 nt, Homo sapiens
augaugucauuuuaauuucuaa

SEQ ID NO: 322985 - RNA, 22 nt, Homo sapiens
augauguguguuuaagaugucu

SEQ ID NO: 322986 - RNA, 22 nt, Homo sapiens
augauucugaucuagagcuugg

SEQ ID NO: 322987 - RNA, 22 nt, Homo sapiens
augauugugaauaugugguuuu

SEQ ID NO: 322988 - RNA, 22 nt, Homo sapiens
augauuguucucacucaagaga

SEQ ID NO: 322989 - RNA, 22 nt, Homo sapiens
augcaaacaucugaagagacau

SEQ ID NO: 322990 - RNA, 22 nt, Homo sapiens
augcaaaucuuaaguaugugug

SEQ ID NO: 322991 - RNA, 22 nt, Homo sapiens
augcaacugcacuccagccugg

SEQ ID NO: 322992 - RNA, 22 nt, Homo sapiens
augcaaggaugguuagauauau

SEQ ID NO: 322993 - RNA, 22 nt, Homo sapiens
augcacuguauaggaucuugcg

SEQ ID NO: 322994 - RNA, 22 nt, Homo sapiens
augcagagaaaucuaaaauaug

SEQ ID NO: 322995 - RNA, 22 nt, Homo sapiens
augcagugugcaacagauuaag

SEQ ID NO: 322996 - RNA, 22 nt, Homo sapiens
augcauaugucuuuauaguggc

SEQ ID NO: 322997 - RNA, 22 nt, Homo sapiens
augcauggagucuuucacaagu

SEQ ID NO: 322998 - RNA, 22 nt, Homo sapiens
augcauggucugaagucaaccu

SEQ ID NO: 322999 - RNA, 22 nt, Homo sapiens
augccacagaaauaaccaaaau

SEQ ID NO: 323000 - RNA, 22 nt, Homo sapiens
augccacugcacucuagccugg

SEQ ID NO: 323001 - RNA, 22 nt, Homo sapiens
augccacugcacuucagcuugg

SEQ ID NO: 323002 - RNA, 22 nt, Homo sapiens
augccacugcgcucuagccugg

SEQ ID NO: 323003 - RNA, 22 nt, Homo sapiens
augccacuguuuaugucacuua

SEQ ID NO: 323004 - RNA, 22 nt, Homo sapiens
augccaguguccagaguggguu

SEQ ID NO: 323005 - RNA, 22 nt, Homo sapiens
augccauugcacuccagccugg

SEQ ID NO: 323006 - RNA, 22 nt, Homo sapiens
augcccauuuguuuucugaaag

SEQ ID NO: 323007 - RNA, 22 nt, Homo sapiens
augcuacugaccccuacuuaca

SEQ ID NO: 323008 - RNA, 22 nt, Homo sapiens
augcuguuuugaauucucuaga

SEQ ID NO: 323009 - RNA, 21 nt, Homo sapiens
auggaaagacugccucuucaa

SEQ ID NO: 323010 - RNA, 22 nt, Homo sapiens
auggaacugaagugcugcccuu

SEQ ID NO: 323011 - RNA, 22 nt, Homo sapiens
auggaagaaacgauuuucugga

SEQ ID NO: 323012 - RNA, 22 nt, Homo sapiens
auggaagucucuguuaaguuuc

SEQ ID NO: 323013 - RNA, 22 nt, Homo sapiens
auggaaugguugggucauaagg

SEQ ID NO: 323014 - RNA, 22 nt, Homo sapiens
auggacagaaaaaaauagaugu

SEQ ID NO: 323015 - RNA, 22 nt, Homo sapiens
auggacucauugaauuaagucc

SEQ ID NO: 323016 - RNA, 22 nt, Homo sapiens
auggagagaauuauucucucag

SEQ ID NO: 323017 - RNA, 22 nt, Homo sapiens
auggaggccuacagaauuuugg

SEQ ID NO: 323018 - RNA, 22 nt, Homo sapiens
auggagugagaauggagguucc

SEQ ID NO: 323019 - RNA, 22 nt, Homo sapiens
auggaguuuacuuaguguaaua

SEQ ID NO: 323020 - RNA, 22 nt, Homo sapiens
auggauagucucacucacauac

SEQ ID NO: 323021 - RNA, 22 nt, Homo sapiens
auggaucauauucuugaggagg

SEQ ID NO: 323022 - RNA, 22 nt, Homo sapiens
auggcaaaaaaugcaauuacuu

SEQ ID NO: 323023 - RNA, 22 nt, Homo sapiens
auggcaaaauguuccuaguggu

SEQ ID NO: 323024 - RNA, 22 nt, Homo sapiens
auggcaauguaagucagaaaaa

SEQ ID NO: 323025 - RNA, 22 nt, Homo sapiens
auggcacuaaugggaguuuacu

SEQ ID NO: 323026 - RNA, 22 nt, Homo sapiens
auggcacuacugggaaugucuu

SEQ ID NO: 323027 - RNA, 22 nt, Homo sapiens
auggcacuccagccugggcaac

SEQ ID NO: 323028 - RNA, 22 nt, Homo sapiens
auggcacugaagcguauugaca

SEQ ID NO: 323029 - RNA, 22 nt, Homo sapiens
auggcagcaccccacucuacug

SEQ ID NO: 323030 - RNA, 22 nt, Homo sapiens
auggcagcccucuuuauccaug

SEQ ID NO: 323031 - RNA, 22 nt, Homo sapiens
auggcagugagucucuaguauu

SEQ ID NO: 323032 - RNA, 22 nt, Homo sapiens
auggcaguuucacucugggauu

SEQ ID NO: 323033 - RNA, 22 nt, Homo sapiens
auggcauggugaagucuuugga

SEQ ID NO: 323034 - RNA, 22 nt, Homo sapiens
auggcauugaagaguugucccu

SEQ ID NO: 323035 - RNA, 22 nt, Homo sapiens
auggccauuacuaagaauguuu

SEQ ID NO: 323036 - RNA, 22 nt, Homo sapiens
auggcccccuguuugugaacau

SEQ ID NO: 323037 - RNA, 22 nt, Homo sapiens
auggcguggagauauggucagc

SEQ ID NO: 323038 - RNA, 22 nt, Homo sapiens
auggcguguggcuuggaggcug

SEQ ID NO: 323039 - RNA, 22 nt, Homo sapiens
auggcucaauucuuucccugaa

SEQ ID NO: 323040 - RNA, 22 nt, Homo sapiens
auggcucuggauagaaugcagg

SEQ ID NO: 323041 - RNA, 22 nt, Homo sapiens
auggcugagugauuucaaacag

SEQ ID NO: 323042 - RNA, 22 nt, Homo sapiens
auggcuguuccugggaguucua

SEQ ID NO: 323043 - RNA, 22 nt, Homo sapiens
auggcuuuguguucagagcuga

SEQ ID NO: 323044 - RNA, 22 nt, Homo sapiens
auggcuuuuauuguguugaggu

SEQ ID NO: 323045 - RNA, 22 nt, Homo sapiens
auggcuuuugcccuaaauggau

SEQ ID NO: 323046 - RNA, 22 nt, Homo sapiens
augggaaaaucagaaggccugg

SEQ ID NO: 323047 - RNA, 22 nt, Homo sapiens
guagcaugcaauauuauagaga

SEQ ID NO: 323048 - RNA, 22 nt, Homo sapiens
guauacacccugugauauuauu

SEQ ID NO: 323049 - RNA, 22 nt, Homo sapiens
guauacaugucaaaacucacau

SEQ ID NO: 323050 - RNA, 22 nt, Homo sapiens
guauacuucugaaaauagcuau

SEQ ID NO: 323051 - RNA, 22 nt, Homo sapiens
guauaugccucaguuauagcac

SEQ ID NO: 323052 - RNA, 22 nt, Homo sapiens
guaucacacuuauugaccugca

SEQ ID NO: 323053 - RNA, 18 nt, Homo sapiens
guauuccagccugaguga

SEQ ID NO: 323054 - RNA, 22 nt, Homo sapiens
guauugacuaucaaucaugugc

SEQ ID NO: 323055 - RNA, 22 nt, Homo sapiens
gucaagagaacuuucuaucacu

SEQ ID NO: 323056 - RNA, 22 nt, Homo sapiens
gucacagaaaaagauaugccaa

SEQ ID NO: 323057 - RNA, 22 nt, Homo sapiens
gucacaguggccagugauguuc

SEQ ID NO: 323058 - RNA, 22 nt, Homo sapiens
gucaccagcuguguuagccccu

SEQ ID NO: 323059 - RNA, 22 nt, Homo sapiens
gucacugggugcugcgccuguc

SEQ ID NO: 323060 - RNA, 22 nt, Homo sapiens
gucacugucuacuguaauagcc

SEQ ID NO: 323061 - RNA, 22 nt, Homo sapiens
auguaguagcagaaaauauuuu

SEQ ID NO: 323062 - RNA, 22 nt, Homo sapiens
auguauggcagguuugggguuu

SEQ ID NO: 323063 - RNA, 22 nt, Homo sapiens
auguccauggaaucuguagcaa

SEQ ID NO: 323064 - RNA, 22 nt, Homo sapiens
augugaaugugaucggauaguc

SEQ ID NO: 323065 - RNA, 22 nt, Homo sapiens
augugacagugguuuuaagcgu

SEQ ID NO: 323066 - RNA, 22 nt, Homo sapiens
augugacugauggagaauaugu

SEQ ID NO: 323067 - RNA, 22 nt, Homo sapiens
augugacuugugaaaaguucag

SEQ ID NO: 323068 - RNA, 22 nt, Homo sapiens
augugcaaagcacuguucagca

SEQ ID NO: 323069 - RNA, 22 nt, Homo sapiens
augugcaaaguuaagaucccag

SEQ ID NO: 323070 - RNA, 22 nt, Homo sapiens
augugcaauggugucaccacau

SEQ ID NO: 323071 - RNA, 22 nt, Homo sapiens
augugcaauguguacguagccc

SEQ ID NO: 323072 - RNA, 22 nt, Homo sapiens
augugcacaugcuuacauguga

SEQ ID NO: 323073 - RNA, 22 nt, Homo sapiens
augugcagauguuacaaauugu

SEQ ID NO: 323074 - RNA, 22 nt, Homo sapiens
augugccauucucauggcgcuu

SEQ ID NO: 323075 - RNA, 22 nt, Homo sapiens
augugcuuauagguguauguuu

SEQ ID NO: 323076 - RNA, 22 nt, Homo sapiens
augugcuuuuuaaacagaugcu

SEQ ID NO: 323077 - RNA, 22 nt, Homo sapiens
auguggaaagcagcaugauaug

SEQ ID NO: 323078 - RNA, 22 nt, Homo sapiens
auguggcuuuccuagaucuuag

SEQ ID NO: 323079 - RNA, 22 nt, Homo sapiens
auguggcuuuucaacuguguga

SEQ ID NO: 323080 - RNA, 22 nt, Homo sapiens
augugguaguuauagugauaag

SEQ ID NO: 323081 - RNA, 23 nt, Homo sapiens
augugugcuuggagagcaggaug

SEQ ID NO: 323082 - RNA, 22 nt, Homo sapiens
auguuaagauggaacaugggaa

SEQ ID NO: 323083 - RNA, 22 nt, Homo sapiens
auguuguaguaugagucaaaau

SEQ ID NO: 323084 - RNA, 22 nt, Homo sapiens
auuaaauguuggacguauacau

SEQ ID NO: 323085 - RNA, 22 nt, Homo sapiens
auuaagugaaugaaguuguucc

SEQ ID NO: 323086 - RNA, 22 nt, Homo sapiens
auuaagugcuugccagugcugg

SEQ ID NO: 323087 - RNA, 22 nt, Homo sapiens
auuaaguugugccugaaaacuu

SEQ ID NO: 323088 - RNA, 22 nt, Homo sapiens
auuaaucaggcaaugcuugcua

SEQ ID NO: 323089 - RNA, 22 nt, Homo sapiens
auuacacuuucuauucaaugag

SEQ ID NO: 323090 - RNA, 20 nt, Homo sapiens
auuagacuugccuuauccuu

SEQ ID NO: 323091 - RNA, 22 nt, Homo sapiens
auuagguacugugguuuccaga

SEQ ID NO: 323092 - RNA, 22 nt, Homo sapiens
auuagguauuuucuggacaggg

SEQ ID NO: 323093 - RNA, 22 nt, Homo sapiens
auuagguuggugcaaaaguaau

SEQ ID NO: 323094 - RNA, 22 nt, Homo sapiens
auuauaguguauacuugaaauu

SEQ ID NO: 323095 - RNA, 22 nt, Homo sapiens
auuauaugucaucacagacacc

SEQ ID NO: 323096 - RNA, 22 nt, Homo sapiens
auuauuagucggccagcuguua

SEQ ID NO: 323097 - RNA, 22 nt, Homo sapiens
auuauugacucauagaaaggau

SEQ ID NO: 323098 - RNA, 22 nt, Homo sapiens
auucaccauggaccaggggccu

SEQ ID NO: 323099 - RNA, 22 nt, Homo sapiens
auucaccauggcuaccaagggu

SEQ ID NO: 323100 - RNA, 22 nt, Homo sapiens
auucaucagggauauugguuga

SEQ ID NO: 323101 - RNA, 22 nt, Homo sapiens
auuccagauggaguugaggguu

SEQ ID NO: 323102 - RNA, 22 nt, Homo sapiens
auuccauuuguguggaauggcu

SEQ ID NO: 323103 - RNA, 22 nt, Homo sapiens
auugaacaugccauauguacca

SEQ ID NO: 323104 - RNA, 22 nt, Homo sapiens
auugaacuuacuaucuaaacua

SEQ ID NO: 323105 - RNA, 22 nt, Homo sapiens
auugaacuuuugucacugacau

SEQ ID NO: 323106 - RNA, 22 nt, Homo sapiens
auugacacugauuuuucuuuaa

SEQ ID NO: 323107 - RNA, 18 nt, Homo sapiens
auugagcaugacagaccu

SEQ ID NO: 323108 - RNA, 22 nt, Homo sapiens
auugagucauuucaaauccaag

SEQ ID NO: 323109 - RNA, 22 nt, Homo sapiens
auugcaaugggaaacuaugaaa

SEQ ID NO: 323110 - RNA, 19 nt, Homo sapiens
auugcacuccaaccugggu

SEQ ID NO: 323111 - RNA, 22 nt, Homo sapiens
auugcacuccagccuggccaac

SEQ ID NO: 323112 - RNA, 22 nt, Homo sapiens
auugcacuccagccuggccgag

SEQ ID NO: 323113 - RNA, 21 nt, Homo sapiens
auugcacuccagccugggcga

SEQ ID NO: 323114 - RNA, 22 nt, Homo sapiens
auugcacuccagccugggggac

SEQ ID NO: 323115 - RNA, 22 nt, Homo sapiens
auugcacuccagccuugacaca

SEQ ID NO: 323116 - RNA, 22 nt, Homo sapiens
auugcacuccagucucaccagg

SEQ ID NO: 323117 - RNA, 18 nt, Homo sapiens
auugcacuccugccuggg

SEQ ID NO: 323118 - RNA, 22 nt, Homo sapiens
auugcacucuagccuuggcgac

SEQ ID NO: 323119 - RNA, 22 nt, Homo sapiens
auugcacugcagccugggcaac

SEQ ID NO: 323120 - RNA, 23 nt, Homo sapiens
auugcagaaucacagagguagug

SEQ ID NO: 323121 - RNA, 22 nt, Homo sapiens
auugcaguuagaacagaagucu

SEQ ID NO: 323122 - RNA, 22 nt, Homo sapiens
auugccuaugauugagguacua

SEQ ID NO: 323123 - RNA, 22 nt, Homo sapiens
auugccucaauuccaagacugc

SEQ ID NO: 323124 - RNA, 22 nt, Homo sapiens
auugcucaaaucaguacuugag

SEQ ID NO: 323125 - RNA, 22 nt, Homo sapiens
auugcucagucagggagcucgg

SEQ ID NO: 323126 - RNA, 22 nt, Homo sapiens
auugcucuuagaaauauuucuu

SEQ ID NO: 323127 - RNA, 22 nt, Homo sapiens
auugcuucugauuuuaaaugag

SEQ ID NO: 323128 - RNA, 22 nt, Homo sapiens
auugcuuuuacugggagcuuug

SEQ ID NO: 323129 - RNA, 22 nt, Homo sapiens
auuggauagucuuuaucuguug

SEQ ID NO: 323130 - RNA, 22 nt, Homo sapiens
auuggcaagauagcauaugagg

SEQ ID NO: 323131 - RNA, 22 nt, Homo sapiens
auuggcaauguacauaucuugc

SEQ ID NO: 323132 - RNA, 22 nt, Homo sapiens
auuggcagaaaucuuuauagua

SEQ ID NO: 323133 - RNA, 22 nt, Homo sapiens
auuggcuuuugaaagucugcga

SEQ ID NO: 323134 - RNA, 22 nt, Homo sapiens
auuggucuauuaaaccuaaguu

SEQ ID NO: 323135 - RNA, 22 nt, Homo sapiens
auuguaauuuuagagaaagugg

SEQ ID NO: 323136 - RNA, 22 nt, Homo sapiens
auuguacuccagccugggcaaa

SEQ ID NO: 323137 - RNA, 22 nt, Homo sapiens
auuguacuuaagccugggugaa

SEQ ID NO: 323138 - RNA, 22 nt, Homo sapiens
auuguguagucuuacugcuugc

SEQ ID NO: 323139 - RNA, 22 nt, Homo sapiens
auugugucuuguagagagauau

SEQ ID NO: 323140 - RNA, 22 nt, Homo sapiens
auagugcugcaaucaacauaca

SEQ ID NO: 323141 - RNA, 22 nt, Homo sapiens
auagugcuggaauaaauauacg

SEQ ID NO: 323142 - RNA, 22 nt, Homo sapiens
auauaugcacacgugugcauau

SEQ ID NO: 323143 - RNA, 22 nt, Homo sapiens
auaucaacaucgugucauuagu

SEQ ID NO: 323144 - RNA, 22 nt, Homo sapiens
auaucaaggccauuuucuaaau

SEQ ID NO: 323145 - RNA, 22 nt, Homo sapiens
auaucacaggaaaggaagauac

SEQ ID NO: 323146 - RNA, 17 nt, Homo sapiens
auaugaauuuuggagau

SEQ ID NO: 323147 - RNA, 22 nt, Homo sapiens
auaugcacuauacacacguaua

SEQ ID NO: 323148 - RNA, 20 nt, Homo sapiens
auaugcauguguuuucacuu

SEQ ID NO: 323149 - RNA, 21 nt, Homo sapiens
auauggaacuggugacguguu

SEQ ID NO: 323150 - RNA, 22 nt, Homo sapiens
auauggcauucagaacuguaua

SEQ ID NO: 323151 - RNA, 19 nt, Homo sapiens
auaugggguuugaacugug

SEQ ID NO: 323152 - RNA, 22 nt, Homo sapiens
auauggguuuuauauuaggcuc

SEQ ID NO: 323153 - RNA, 22 nt, Homo sapiens
auauggucccuguucucaagga

SEQ ID NO: 323154 - RNA, 22 nt, Homo sapiens
auauuacuggccauaucgcagg

SEQ ID NO: 323155 - RNA, 21 nt, Homo sapiens
auauuacuguuagaggacugc

SEQ ID NO: 323156 - RNA, 22 nt, Homo sapiens
auauuagcacuaaugucacgau

SEQ ID NO: 323157 - RNA, 18 nt, Homo sapiens
auauugccuucagacuag

SEQ ID NO: 323158 - RNA, 22 nt, Homo sapiens
auauugcuuagugaugaagucu

SEQ ID NO: 323159 - RNA, 22 nt, Homo sapiens
auauugcuugaggccaggaggu

SEQ ID NO: 323160 - RNA, 22 nt, Homo sapiens
auauuggacugugcuaguuaga

SEQ ID NO: 323161 - RNA, 22 nt, Homo sapiens
auauuguacugcuacugguucu

SEQ ID NO: 323162 - RNA, 22 nt, Homo sapiens
aucaaagccaugcucaguuuuc

SEQ ID NO: 323163 - RNA, 22 nt, Homo sapiens
aucaaaguaggcauauguuuuu

SEQ ID NO: 323164 - RNA, 22 nt, Homo sapiens
aucaagccaaagaaaguccuug

SEQ ID NO: 323165 - RNA, 22 nt, Homo sapiens
aucaagcuacacccuuuggaaa

SEQ ID NO: 323166 - RNA, 22 nt, Homo sapiens
aucaagcugcuuguuugaaucu

SEQ ID NO: 323167 - RNA, 22 nt, Homo sapiens
aucaaguaguuauacguaaagg

SEQ ID NO: 323168 - RNA, 22 nt, Homo sapiens
aucacagaacuuugagcagaga

SEQ ID NO: 323169 - RNA, 22 nt, Homo sapiens
aucacagauauggguuuaaauc

SEQ ID NO: 323170 - RNA, 22 nt, Homo sapiens
aucacagcccuccucuuggaug

SEQ ID NO: 323171 - RNA, 22 nt, Homo sapiens
aucacagugagcauaugucuau

SEQ ID NO: 323172 - RNA, 22 nt, Homo sapiens
aucacaguuauaacauccuuuu

SEQ ID NO: 323173 - RNA, 22 nt, Homo sapiens
aucacaguuuuaccauuuggua

SEQ ID NO: 323174 - RNA, 22 nt, Homo sapiens
aucacauuuauaguggcacgca

SEQ ID NO: 323175 - RNA, 19 nt, Homo sapiens
aucaccauuauuuggaaca

SEQ ID NO: 323176 - RNA, 22 nt, Homo sapiens
aucaccuggaggugaucacuug

SEQ ID NO: 323177 - RNA, 22 nt, Homo sapiens
aucaccuggaguagcccguccc

SEQ ID NO: 323178 - RNA, 22 nt, Homo sapiens
aucacuggccuuuuuaaaugcu

SEQ ID NO: 323179 - RNA, 22 nt, Homo sapiens
aucacugggagcagccauuaau

SEQ ID NO: 323180 - RNA, 22 nt, Homo sapiens
aucacuguuuugaugcucggac

SEQ ID NO: 323181 - RNA, 22 nt, Homo sapiens
aucacuuugcucuccagugugg

SEQ ID NO: 323182 - RNA, 22 nt, Homo sapiens
aucagaaucucuagaggacugu

SEQ ID NO: 323183 - RNA, 22 nt, Homo sapiens
aucagaaucucuagugggacca

SEQ ID NO: 323184 - RNA, 22 nt, Homo sapiens
aucagaguggguuuuaaaagug

SEQ ID NO: 323185 - RNA, 22 nt, Homo sapiens
aucaggaaccuuuuuggugugu

SEQ ID NO: 323186 - RNA, 22 nt, Homo sapiens
aucagucacugcguuuuuggga

SEQ ID NO: 323187 - RNA, 22 nt, Homo sapiens
aucagucuguuggaauaucgcu

SEQ ID NO: 323188 - RNA, 22 nt, Homo sapiens
gacuagggaccaugagcaaucc

SEQ ID NO: 323189 - RNA, 22 nt, Homo sapiens
gacuauaucaggaauggggauu

SEQ ID NO: 323190 - RNA, 18 nt, Homo sapiens
gacuccauuucagccaga

SEQ ID NO: 323191 - RNA, 22 nt, Homo sapiens
gacugcagugcagcuguuaggc

SEQ ID NO: 323192 - RNA, 22 nt, Homo sapiens
gacuggccuauaauggcgaauu

SEQ ID NO: 323193 - RNA, 22 nt, Homo sapiens
gacuggguuaguuugaaagacu

SEQ ID NO: 323194 - RNA, 20 nt, Homo sapiens
gacuucagaagcuucagagu

SEQ ID NO: 323195 - RNA, 20 nt, Homo sapiens
gacuugagagugggagagua

SEQ ID NO: 323196 - RNA, 22 nt, Homo sapiens
gacuuugguagaggaaaaaucu

SEQ ID NO: 323197 - RNA, 22 nt, Homo sapiens
gagaacauacggcauuugguuu

SEQ ID NO: 323198 - RNA, 22 nt, Homo sapiens
gagaaccuccagcaagguagua

SEQ ID NO: 323199 - RNA, 22 nt, Homo sapiens
gagaacuggcgugaacugcacg

SEQ ID NO: 323200 - RNA, 22 nt, Homo sapiens
gagaacuggcugauucaaggac

SEQ ID NO: 323201 - RNA, 22 nt, Homo sapiens
gagaaguaaauuuauuugcaaa

SEQ ID NO: 323202 - RNA, 21 nt, Homo sapiens
gagaaucuuuucagggcaaac

SEQ ID NO: 323203 - RNA, 22 nt, Homo sapiens
gagaaugaugauuuccaauuuc

SEQ ID NO: 323204 - RNA, 23 nt, Homo sapiens
gagaccagcuucagaaagcacga

SEQ ID NO: 323205 - RNA, 22 nt, Homo sapiens
gagaccauuuacugccuacuua

SEQ ID NO: 323206 - RNA, 22 nt, Homo sapiens
gagacggagucucgcucuguca

SEQ ID NO: 323207 - RNA, 22 nt, Homo sapiens
gagacugagucucacucuguca

SEQ ID NO: 323208 - RNA, 22 nt, Homo sapiens
gagacugagucuugcucugucg

SEQ ID NO: 323209 - RNA, 22 nt, Homo sapiens
gagagaguacuugauauaauuu

SEQ ID NO: 323210 - RNA, 22 nt, Homo sapiens
gagagcaugugcuggcaucagu

SEQ ID NO: 323211 - RNA, 22 nt, Homo sapiens
gagagucacagugaauguggca

SEQ ID NO: 323212 - RNA, 22 nt, Homo sapiens
gagauaauagcuauaggaucuu

SEQ ID NO: 323213 - RNA, 22 nt, Homo sapiens
gagauaauuugaaucauggggg

SEQ ID NO: 323214 - RNA, 22 nt, Homo sapiens
gagauaggauucacuuucaugu

SEQ ID NO: 323215 - RNA, 22 nt, Homo sapiens
gagauauuuagaaauguguucu

SEQ ID NO: 323216 - RNA, 22 nt, Homo sapiens
gagaucauucugauccagaguc

SEQ ID NO: 323217 - RNA, 22 nt, Homo sapiens
gagaugaucaugugguuuuguc

SEQ ID NO: 323218 - RNA, 22 nt, Homo sapiens
gagauguagucuugcccuguca

SEQ ID NO: 323219 - RNA, 22 nt, Homo sapiens
gagaugugguucaaggguguuu

SEQ ID NO: 323220 - RNA, 22 nt, Homo sapiens
gagcacauguggagagucuggg

SEQ ID NO: 323221 - RNA, 22 nt, Homo sapiens
gagcaguugagagugcuggcca

SEQ ID NO: 323222 - RNA, 22 nt, Homo sapiens
gagcuacacugauucauuuguu

SEQ ID NO: 323223 - RNA, 22 nt, Homo sapiens
gagcuaguagauuuuaaauauu

SEQ ID NO: 323224 - RNA, 22 nt, Homo sapiens
gagcucauuaaaguaggaccua

SEQ ID NO: 323225 - RNA, 22 nt, Homo sapiens
gagcuguuuuucacuagaccaa

SEQ ID NO: 323226 - RNA, 22 nt, Homo sapiens
gaggagauauucugcuggaugg

SEQ ID NO: 323227 - RNA, 22 nt, Homo sapiens
gaggcacucuguacaaaucugc

SEQ ID NO: 323228 - RNA, 22 nt, Homo sapiens
gaggcagucuguccauucucag

SEQ ID NO: 323229 - RNA, 22 nt, Homo sapiens
gagggcacugcuuuccuuucaa

SEQ ID NO: 323230 - RNA, 22 nt, Homo sapiens
gagguaaguggauuaugagguc

SEQ ID NO: 323231 - RNA, 22 nt, Homo sapiens
gagguagagaguuuugauucug

SEQ ID NO: 323232 - RNA, 22 nt, Homo sapiens
gagguaggggccuuaaagaugc

SEQ ID NO: 323233 - RNA, 22 nt, Homo sapiens
gaggucaggacauuuuugcuuu

SEQ ID NO: 323234 - RNA, 22 nt, Homo sapiens
augacaagagccuucuuuccuu

SEQ ID NO: 323235 - RNA, 22 nt, Homo sapiens
augacaaugaaucccuguuuca

SEQ ID NO: 323236 - RNA, 22 nt, Homo sapiens
augacacugcagagauguccca

SEQ ID NO: 323237 - RNA, 23 nt, Homo sapiens
augacacuguccuugaccauuuc

SEQ ID NO: 323238 - RNA, 22 nt, Homo sapiens
augacagcaucugugaaguugu

SEQ ID NO: 323239 - RNA, 22 nt, Homo sapiens
augacauugaugcucuggcugg

SEQ ID NO: 323240 - RNA, 22 nt, Homo sapiens
augaccaaugggcagagcuaga

SEQ ID NO: 323241 - RNA, 22 nt, Homo sapiens
augacuaaaggguuuauguuga

SEQ ID NO: 323242 - RNA, 22 nt, Homo sapiens
augacucagaucuguuccuggu

SEQ ID NO: 323243 - RNA, 17 nt, Homo sapiens
augacuucuucagugug

SEQ ID NO: 323244 - RNA, 22 nt, Homo sapiens
augacuuuucugaaaaccacca

SEQ ID NO: 323245 - RNA, 22 nt, Homo sapiens
augagaaugaagccuggcgugu

SEQ ID NO: 323246 - RNA, 22 nt, Homo sapiens
augagaaugauucuguuauggu

SEQ ID NO: 323247 - RNA, 22 nt, Homo sapiens
augagauauguuaaaaguuaaa

SEQ ID NO: 323248 - RNA, 22 nt, Homo sapiens
augagaugauaggcguucuaac

SEQ ID NO: 323249 - RNA, 22 nt, Homo sapiens
augagauuauguaaagagacca

SEQ ID NO: 323250 - RNA, 22 nt, Homo sapiens
augagauuguuuguacuccaca

SEQ ID NO: 323251 - RNA, 22 nt, Homo sapiens
augagcagaagagauacacugu

SEQ ID NO: 323252 - RNA, 22 nt, Homo sapiens
augagcucauugggugacuggg

SEQ ID NO: 323253 - RNA, 22 nt, Homo sapiens
augaggagauauuaaauaccau

SEQ ID NO: 323254 - RNA, 22 nt, Homo sapiens
augagggaagcucacgugucca

SEQ ID NO: 323255 - RNA, 22 nt, Homo sapiens
augaggugauuucuguucgggu

SEQ ID NO: 323256 - RNA, 21 nt, Homo sapiens
augagguguacuguggugaaa

SEQ ID NO: 323257 - RNA, 22 nt, Homo sapiens
augagguguuuauuguauccug

SEQ ID NO: 323258 - RNA, 18 nt, Homo sapiens
augagucauuguggaaau

SEQ ID NO: 323259 - RNA, 22 nt, Homo sapiens
augauaacagccaggcacggug

SEQ ID NO: 323260 - RNA, 22 nt, Homo sapiens
augauagucuugagaagcauuu

SEQ ID NO: 323261 - RNA, 22 nt, Homo sapiens
augauaucuuguuuuucaugca

SEQ ID NO: 323262 - RNA, 22 nt, Homo sapiens
augaucauggaaguuuuccugu

SEQ ID NO: 323263 - RNA, 22 nt, Homo sapiens
augaucuguuuggugaucuugu

SEQ ID NO: 323264 - RNA, 22 nt, Homo sapiens
augaugcaguacuuugggaaca

SEQ ID NO: 323265 - RNA, 22 nt, Homo sapiens
augauggaggccgugauggacg

SEQ ID NO: 323266 - RNA, 22 nt, Homo sapiens
augauguccacagggguguuca

SEQ ID NO: 323267 - RNA, 19 nt, Homo sapiens
augauugucuauggaggaa

SEQ ID NO: 323268 - RNA, 22 nt, Homo sapiens
augcaagacaccacgugagaau

SEQ ID NO: 323269 - RNA, 22 nt, Homo sapiens
augcaagacaccgauuagcuuu

SEQ ID NO: 323270 - RNA, 19 nt, Homo sapiens
augcaaugucacaggcugc

SEQ ID NO: 323271 - RNA, 22 nt, Homo sapiens
augcaauucuagauugauagua

SEQ ID NO: 323272 - RNA, 22 nt, Homo sapiens
augcacaucagcuccagggacc

SEQ ID NO: 323273 - RNA, 22 nt, Homo sapiens
augcacuguuuucuugaugaga

SEQ ID NO: 323274 - RNA, 22 nt, Homo sapiens
augcagaucacauuuuucuguc

SEQ ID NO: 323275 - RNA, 22 nt, Homo sapiens
augcagguguuuugcacugagu

SEQ ID NO: 323276 - RNA, 22 nt, Homo sapiens
augcauagcaucugcaaauguu

SEQ ID NO: 323277 - RNA, 22 nt, Homo sapiens
gcaccguggaguauggggagga

SEQ ID NO: 323278 - RNA, 22 nt, Homo sapiens
gcacgugcucauuugaggucuu

SEQ ID NO: 323279 - RNA, 17 nt, Homo sapiens
gcacuggcguaucccac

SEQ ID NO: 323280 - RNA, 22 nt, Homo sapiens
gcagaauugguuucuucuaagg

SEQ ID NO: 323281 - RNA, 22 nt, Homo sapiens
gcagagaaacaggucuaaggag

SEQ ID NO: 323282 - RNA, 22 nt, Homo sapiens
gcagcagugcccuggauggaaa

SEQ ID NO: 323283 - RNA, 22 nt, Homo sapiens
gcaggaauuucucugcagaccc

SEQ ID NO: 323284 - RNA, 22 nt, Homo sapiens
gcaguacacuguugguaggaau

SEQ ID NO: 323285 - RNA, 22 nt, Homo sapiens
gcaguagugcgaucucagcuca

SEQ ID NO: 323286 - RNA, 22 nt, Homo sapiens
gcaguagugugaucuuggcuca

SEQ ID NO: 323287 - RNA, 22 nt, Homo sapiens
gcagugcaugacgguauauaua

SEQ ID NO: 323288 - RNA, 22 nt, Homo sapiens
gcagugcuggagcccccgugug

SEQ ID NO: 323289 - RNA, 22 nt, Homo sapiens
gcaguggugugugccagccuag

SEQ ID NO: 323290 - RNA, 20 nt, Homo sapiens
gcaguguucugaccugaauc

SEQ ID NO: 323291 - RNA, 22 nt, Homo sapiens
gcaguguuggggccggaggcug

SEQ ID NO: 323292 - RNA, 22 nt, Homo sapiens
gcaguguugugauccaggucuu

SEQ ID NO: 323293 - RNA, 22 nt, Homo sapiens
gcaucacagggagacaggccuc

SEQ ID NO: 323294 - RNA, 19 nt, Homo sapiens
gcaucauuaguugcuuuuc

SEQ ID NO: 323295 - RNA, 22 nt, Homo sapiens
gcaugacaaugauugcucuuca

SEQ ID NO: 323296 - RNA, 20 nt, Homo sapiens
gcaugagucuuuauaguaga

SEQ ID NO: 323297 - RNA, 22 nt, Homo sapiens
gcaugcacuguauuuaaguauc

SEQ ID NO: 323298 - RNA, 22 nt, Homo sapiens
gcaugcauuuuccuaacuagaa

SEQ ID NO: 323299 - RNA, 22 nt, Homo sapiens
gcauggagcauacauuucuguu

SEQ ID NO: 323300 - RNA, 22 nt, Homo sapiens
gcauggccuuuaaaugucacag

SEQ ID NO: 323301 - RNA, 22 nt, Homo sapiens
gcaugguacuggaugguaguau

SEQ ID NO: 323302 - RNA, 22 nt, Homo sapiens
gccagugugaugugaucauggc

SEQ ID NO: 323303 - RNA, 22 nt, Homo sapiens
gccauugcacuccagcuugggc

SEQ ID NO: 323304 - RNA, 22 nt, Homo sapiens
gcccagcguucagggaggggcu

SEQ ID NO: 323305 - RNA, 22 nt, Homo sapiens
gccccugagacuugccucgggc

SEQ ID NO: 323306 - RNA, 22 nt, Homo sapiens
gcccuguguuuggguaugguca

SEQ ID NO: 323307 - RNA, 22 nt, Homo sapiens
gcccuguugcccaggcuggagu

SEQ ID NO: 323308 - RNA, 17 nt, Homo sapiens
gcccuuugugccucuuc

SEQ ID NO: 323309 - RNA, 22 nt, Homo sapiens
gccuagagacuugguaucuugc

SEQ ID NO: 323310 - RNA, 22 nt, Homo sapiens
gccugagaggauaugauccccu

SEQ ID NO: 323311 - RNA, 22 nt, Homo sapiens
gcgugguguuagaaugagaagu

SEQ ID NO: 323312 - RNA, 22 nt, Homo sapiens
gcucaaguaauggcaguuuugc

SEQ ID NO: 323313 - RNA, 22 nt, Homo sapiens
gcucguccccuccugacucugc

SEQ ID NO: 323314 - RNA, 22 nt, Homo sapiens
gcugacagugguuauacuuaga

SEQ ID NO: 323315 - RNA, 22 nt, Homo sapiens
gcugagaucucuugccugaacu

SEQ ID NO: 323316 - RNA, 22 nt, Homo sapiens
gcugagcuaugccauauaugcc

SEQ ID NO: 323317 - RNA, 22 nt, Homo sapiens
gcugagguucaagaagguuaaa

SEQ ID NO: 323318 - RNA, 22 nt, Homo sapiens
gcugauggugcaguucuagccu

SEQ ID NO: 323319 - RNA, 17 nt, Homo sapiens
gcugcauucauguagaa

SEQ ID NO: 323320 - RNA, 22 nt, Homo sapiens
gcugcuguuucucuuucagcau

SEQ ID NO: 323321 - RNA, 22 nt, Homo sapiens
gcugcuuuugaugacaaaaaca

SEQ ID NO: 323322 - RNA, 22 nt, Homo sapiens
gcuggaauuaacauagaugugc

SEQ ID NO: 323323 - RNA, 22 nt, Homo sapiens
gcuggcaagaugcugaugcaac

SEQ ID NO: 323324 - RNA, 21 nt, Homo sapiens
gcugguaaucacuuugccaaa

SEQ ID NO: 323325 - RNA, 22 nt, Homo sapiens
gcugguguucaggcccucaguc

SEQ ID NO: 323326 - RNA, 22 nt, Homo sapiens
gcuguaguugaggauuuuaaga

SEQ ID NO: 323327 - RNA, 22 nt, Homo sapiens
gcuguauugacuuuguaucaua

SEQ ID NO: 323328 - RNA, 22 nt, Homo sapiens
acugcacuccggccucgugaca

SEQ ID NO: 323329 - RNA, 22 nt, Homo sapiens
acugcacucuagccccugcgac

SEQ ID NO: 323330 - RNA, 22 nt, Homo sapiens
acugcacucuagccuuggcaac

SEQ ID NO: 323331 - RNA, 22 nt, Homo sapiens
acugcacucuagcuugggugac

SEQ ID NO: 323332 - RNA, 22 nt, Homo sapiens
acugcacuucagccuuggggac

SEQ ID NO: 323333 - RNA, 22 nt, Homo sapiens
acugcauuugucugucucaauu

SEQ ID NO: 323334 - RNA, 22 nt, Homo sapiens
acuggaguuuguucaagaaaua

SEQ ID NO: 323335 - RNA, 22 nt, Homo sapiens
acugggauauuauugguaauau

SEQ ID NO: 323336 - RNA, 20 nt, Homo sapiens
acugggcuaccgaaguaagg

SEQ ID NO: 323337 - RNA, 22 nt, Homo sapiens
acuguacuccagccugggcaac

SEQ ID NO: 323338 - RNA, 19 nt, Homo sapiens
acuguacuccagucugggc

SEQ ID NO: 323339 - RNA, 22 nt, Homo sapiens
acuguacuccauccugggugac

SEQ ID NO: 323340 - RNA, 22 nt, Homo sapiens
acuguauagauggaguugauuu

SEQ ID NO: 323341 - RNA, 21 nt, Homo sapiens
acuuucuguggcaguccauuc

SEQ ID NO: 323342 - RNA, 17 nt, Homo sapiens
acuuuuugaggaggcau

SEQ ID NO: 323343 - RNA, 22 nt, Homo sapiens
acuuuuugauggggagaacauu

SEQ ID NO: 323344 - RNA, 22 nt, Homo sapiens
agaaauguuuauucaaacccgu

SEQ ID NO: 323345 - RNA, 22 nt, Homo sapiens
agaacacugaguucagggucag

SEQ ID NO: 323346 - RNA, 22 nt, Homo sapiens
agaaccaaucccacauggauac

SEQ ID NO: 323347 - RNA, 20 nt, Homo sapiens
agaaccuguaguguagaggg

SEQ ID NO: 323348 - RNA, 22 nt, Homo sapiens
agaagaacauagggugacugaa

SEQ ID NO: 323349 - RNA, 20 nt, Homo sapiens
agaagcauugcucucuucag

SEQ ID NO: 323350 - RNA, 22 nt, Homo sapiens
agaagugcuggguucaggcugg

SEQ ID NO: 323351 - RNA, 22 nt, Homo sapiens
agaauguuuuagaccaauacaa

SEQ ID NO: 323352 - RNA, 21 nt, Homo sapiens
agacacuuggaagguuuuaga

SEQ ID NO: 323353 - RNA, 22 nt, Homo sapiens
agacagcuggaguaucauagcu

SEQ ID NO: 323354 - RNA, 22 nt, Homo sapiens
agacagcugggaaauggagugu

SEQ ID NO: 323355 - RNA, 22 nt, Homo sapiens
agacccuguauguguuuaguuu

SEQ ID NO: 323356 - RNA, 21 nt, Homo sapiens
agagaacugaaacaugugacu

SEQ ID NO: 323357 - RNA, 22 nt, Homo sapiens
agagaacugauucagggaaaau

SEQ ID NO: 323358 - RNA, 22 nt, Homo sapiens
agagaacugauuggaugugggc

SEQ ID NO: 323359 - RNA, 22 nt, Homo sapiens
agagaacuggcuucaccauucu

SEQ ID NO: 323360 - RNA, 22 nt, Homo sapiens
agagagcuuuugguugcccuaa

SEQ ID NO: 323361 - RNA, 22 nt, Homo sapiens
agagagguggguggagccccca

SEQ ID NO: 323362 - RNA, 22 nt, Homo sapiens
agagauaauuagguuaaaugag

SEQ ID NO: 323363 - RNA, 22 nt, Homo sapiens
agagauacauucugagaagugc

SEQ ID NO: 323364 - RNA, 22 nt, Homo sapiens
agagaucacugaaucacggggg

SEQ ID NO: 323365 - RNA, 20 nt, Homo sapiens
agagcaaagccgcaccccua

SEQ ID NO: 323366 - RNA, 22 nt, Homo sapiens
agcugauggucuuguaugaugu

SEQ ID NO: 323367 - RNA, 22 nt, Homo sapiens
agcugcauucguaucauauugu

SEQ ID NO: 323368 - RNA, 22 nt, Homo sapiens
agcugcauuuacuuuugcacaa

SEQ ID NO: 323369 - RNA, 22 nt, Homo sapiens
agcugccagucuuguaaggccu

SEQ ID NO: 323370 - RNA, 17 nt, Homo sapiens
agcuggaauuacgggag

SEQ ID NO: 323371 - RNA, 22 nt, Homo sapiens
agcuggacuugauaaaugaaua

SEQ ID NO: 323372 - RNA, 22 nt, Homo sapiens
agcuggauguauguuaagugaa

SEQ ID NO: 323373 - RNA, 22 nt, Homo sapiens
agcuggcuguagcugcaagucu

SEQ ID NO: 323374 - RNA, 22 nt, Homo sapiens
agcugguauuuugucgaggacu

SEQ ID NO: 323375 - RNA, 22 nt, Homo sapiens
agcuggucuacguguguaugag

SEQ ID NO: 323376 - RNA, 22 nt, Homo sapiens
agcuggucugauacuuaccucc

SEQ ID NO: 323377 - RNA, 22 nt, Homo sapiens
agcugguucuuugccuuguaga

SEQ ID NO: 323378 - RNA, 22 nt, Homo sapiens
agcugguuuauuucuauauccu

SEQ ID NO: 323379 - RNA, 20 nt, Homo sapiens
agcuguuguuaaaaaggagg

SEQ ID NO: 323380 - RNA, 22 nt, Homo sapiens
agcuguuguuaauuaacucauu

SEQ ID NO: 323381 - RNA, 22 nt, Homo sapiens
agcuucacaaugcagagggcag

SEQ ID NO: 323382 - RNA, 22 nt, Homo sapiens
agcuucauuguuaugaauguca

SEQ ID NO: 323383 - RNA, 22 nt, Homo sapiens
agcuugugauucuccaucaugu

SEQ ID NO: 323384 - RNA, 22 nt, Homo sapiens
agcuuguguuugucugccuggg

SEQ ID NO: 323385 - RNA, 22 nt, Homo sapiens
agcuuguguuuuucuaaguauc

SEQ ID NO: 323386 - RNA, 22 nt, Homo sapiens
agcuuuggauaccugcuguucc

SEQ ID NO: 323387 - RNA, 22 nt, Homo sapiens
agcuuuuugggcagcuauugac

SEQ ID NO: 323388 - RNA, 22 nt, Homo sapiens
aggaagacauauagaacuaaaa

SEQ ID NO: 323389 - RNA, 22 nt, Homo sapiens
aggaccccucaucagcaccagu

SEQ ID NO: 323390 - RNA, 19 nt, Homo sapiens
aggacuaaagacuagaagu

SEQ ID NO: 323391 - RNA, 22 nt, Homo sapiens
aggagaauugguucuucuugau

SEQ ID NO: 323392 - RNA, 22 nt, Homo sapiens
aggagcacaggacuuugauuau

SEQ ID NO: 323393 - RNA, 22 nt, Homo sapiens
aggagguaggaauugugcuagg

SEQ ID NO: 323394 - RNA, 22 nt, Homo sapiens
aggaguguguauuaaugaaauu

SEQ ID NO: 323395 - RNA, 22 nt, Homo sapiens
aggcaaaugccagcaaucacac

SEQ ID NO: 323396 - RNA, 22 nt, Homo sapiens
aggcaagaaugcuuguuucacc

SEQ ID NO: 323397 - RNA, 22 nt, Homo sapiens
aggcaagcaucuugcucccuuc

SEQ ID NO: 323398 - RNA, 22 nt, Homo sapiens
aggcaguuucagugagagguga

SEQ ID NO: 323399 - RNA, 22 nt, Homo sapiens
aggcaugaaauacaugcauuga

SEQ ID NO: 323400 - RNA, 22 nt, Homo sapiens
aggcauggagacuaaaauuaua

SEQ ID NO: 323401 - RNA, 22 nt, Homo sapiens
aggcauguggcucuguucugac

SEQ ID NO: 323402 - RNA, 22 nt, Homo sapiens
aggcaugugugcagacugucug

SEQ ID NO: 323403 - RNA, 19 nt, Homo sapiens
aggcauugugcucaucugu

SEQ ID NO: 323404 - RNA, 22 nt, Homo sapiens
aggcuguguggauaauauuggg

SEQ ID NO: 323405 - RNA, 21 nt, Homo sapiens
aggcuguuguuuugggaugga

SEQ ID NO: 323406 - RNA, 22 nt, Homo sapiens
agggccuuuguagauguacuca

SEQ ID NO: 323407 - RNA, 22 nt, Homo sapiens
agggcuuuugagcugagauggu

SEQ ID NO: 323408 - RNA, 22 nt, Homo sapiens
agguaagaugugacuugguguu

SEQ ID NO: 323409 - RNA, 20 nt, Homo sapiens
agguagauagaugauagaua

SEQ ID NO: 323410 - RNA, 22 nt, Homo sapiens
agguagcauagcgggaauauca

SEQ ID NO: 323411 - RNA, 22 nt, Homo sapiens
agguagugugaugcuccuguuu

SEQ ID NO: 323412 - RNA, 22 nt, Homo sapiens
agguauguaugucuguacagcg

SEQ ID NO: 323413 - RNA, 21 nt, Homo sapiens
aggucaguaagaaugcagcac

SEQ ID NO: 323414 - RNA, 22 nt, Homo sapiens
agguccacuuacuacuccuguu

SEQ ID NO: 323415 - RNA, 22 nt, Homo sapiens
aggugaauggauaaacuguggg

SEQ ID NO: 323416 - RNA, 22 nt, Homo sapiens
agguucccuuuuggccugggau

SEQ ID NO: 323417 - RNA, 22 nt, Homo sapiens
aguaaagccagaccuguuaauu

SEQ ID NO: 323418 - RNA, 22 nt, Homo sapiens
aguaaagcuacucacugugggc

SEQ ID NO: 323419 - RNA, 22 nt, Homo sapiens
aguaacauuucuaguagagagu

SEQ ID NO: 323420 - RNA, 22 nt, Homo sapiens
aguacaauguugaguagaagug

SEQ ID NO: 323421 - RNA, 22 nt, Homo sapiens
aguacacuguuaaaaagaagug

SEQ ID NO: 323422 - RNA, 22 nt, Homo sapiens
aguacacuguugaacagaagug

SEQ ID NO: 323423 - RNA, 22 nt, Homo sapiens
aguaccauuacucacuuauuuu

SEQ ID NO: 323424 - RNA, 23 nt, Homo sapiens
aguacuguaguaauugaggggaa

SEQ ID NO: 323425 - RNA, 17 nt, Homo sapiens
aguacugucccauccuu

SEQ ID NO: 323426 - RNA, 21 nt, Homo sapiens
aguagcacugugucuuacaaa

SEQ ID NO: 323427 - RNA, 22 nt, Homo sapiens
aguauguagugcaaucagucag

SEQ ID NO: 323428 - RNA, 22 nt, Homo sapiens
agucaagaaucucagcaucuuu

SEQ ID NO: 323429 - RNA, 22 nt, Homo sapiens
agucacagccuuuuacuuuaga

SEQ ID NO: 323430 - RNA, 17 nt, Homo sapiens
agucaguaguuuguauu

SEQ ID NO: 323431 - RNA, 22 nt, Homo sapiens
aguccaguguuaugaucaguag

SEQ ID NO: 323432 - RNA, 22 nt, Homo sapiens
agucgguguuacugacagaaug

SEQ ID NO: 323433 - RNA, 23 nt, Homo sapiens
agucuguguuuacaggcucucug

SEQ ID NO: 323434 - RNA, 22 nt, Homo sapiens
agugaaaugucaccuuuuagga

SEQ ID NO: 323435 - RNA, 22 nt, Homo sapiens
agugaacacagcuucuuugguu

SEQ ID NO: 323436 - RNA, 22 nt, Homo sapiens
agugaauuguucaacaggagga

SEQ ID NO: 323437 - RNA, 22 nt, Homo sapiens
agugauuuuaacuuccagcaau

SEQ ID NO: 323438 - RNA, 22 nt, Homo sapiens
agugcaaggacauuuagguugu

SEQ ID NO: 323439 - RNA, 22 nt, Homo sapiens
agugcacugcccgcuuccuguc

SEQ ID NO: 323440 - RNA, 22 nt, Homo sapiens
agugcaguggcucaaaaugccu

SEQ ID NO: 323441 - RNA, 22 nt, Homo sapiens
agugcaguugucacgugccuuc

SEQ ID NO: 323442 - RNA, 22 nt, Homo sapiens
agugcauugcaucucugcuuca

SEQ ID NO: 323443 - RNA, 22 nt, Homo sapiens
agugccacugcacucuagccug

SEQ ID NO: 323444 - RNA, 22 nt, Homo sapiens
aguggaaucuguuauacuaacu

SEQ ID NO: 323445 - RNA, 22 nt, Homo sapiens
aguggaguguaaagcgucuuuu

SEQ ID NO: 323446 - RNA, 22 nt, Homo sapiens
aguggauuuuauuugacaacua

SEQ ID NO: 323447 - RNA, 22 nt, Homo sapiens
aguggcaaugugauguccugaa

SEQ ID NO: 323448 - RNA, 22 nt, Homo sapiens
aguggcacuauucucagaguca

SEQ ID NO: 323449 - RNA, 19 nt, Homo sapiens
agugggcuagaaaucaggg

SEQ ID NO: 323450 - RNA, 22 nt, Homo sapiens
agugguauaauauuauuuugaa

SEQ ID NO: 323451 - RNA, 23 nt, Homo sapiens
aguggucuccugggcccagcugu

SEQ ID NO: 323452 - RNA, 22 nt, Homo sapiens
agugguuuuaaguagagcauac

SEQ ID NO: 323453 - RNA, 22 nt, Homo sapiens
agugucaggagacagguagcug

SEQ ID NO: 323454 - RNA, 22 nt, Homo sapiens
aguguuuuuaacaagaaagggu

SEQ ID NO: 323455 - RNA, 22 nt, Homo sapiens
aguguuuuuaucaugaaagggu

SEQ ID NO: 323456 - RNA, 22 nt, Homo sapiens
aguuaguguugugauaaaucca

SEQ ID NO: 323457 - RNA, 22 nt, Homo sapiens
aguucaaugcucuuucuacuau

SEQ ID NO: 323458 - RNA, 22 nt, Homo sapiens
cuggucaugggggcacccucug

SEQ ID NO: 323459 - RNA, 21 nt, Homo sapiens
cugguccccuuuauguaugug

SEQ ID NO: 323460 - RNA, 22 nt, Homo sapiens
cuggugauugguuucauucagu

SEQ ID NO: 323461 - RNA, 21 nt, Homo sapiens
cugguguuagcacuucuuccc

SEQ ID NO: 323462 - RNA, 22 nt, Homo sapiens
cugguuuguaaaguuccugaga

SEQ ID NO: 323463 - RNA, 22 nt, Homo sapiens
cuguaagcauuauaaagagaua

SEQ ID NO: 323464 - RNA, 22 nt, Homo sapiens
cugucaucauuucuaugugcca

SEQ ID NO: 323465 - RNA, 22 nt, Homo sapiens
cugugcaugcgcggagcugaaa

SEQ ID NO: 323466 - RNA, 22 nt, Homo sapiens
cugugcauucuuaaaucaggaa

SEQ ID NO: 323467 - RNA, 20 nt, Homo sapiens
cugugguagggaccaggaau

SEQ ID NO: 323468 - RNA, 22 nt, Homo sapiens
cuguugguguuuaaucacugca

SEQ ID NO: 323469 - RNA, 22 nt, Homo sapiens
cuuaagcauugacuuuggacag

SEQ ID NO: 323470 - RNA, 22 nt, Homo sapiens
cuuaaugcuacggcucuguguu

SEQ ID NO: 323471 - RNA, 22 nt, Homo sapiens
cuuacagucuaucagccacaac

SEQ ID NO: 323472 - RNA, 18 nt, Homo sapiens
cuuagguagcucauucca

SEQ ID NO: 323473 - RNA, 22 nt, Homo sapiens
cuucaugggagaaccacaggua

SEQ ID NO: 323474 - RNA, 22 nt, Homo sapiens
cuucaugucuucaauggggggg

SEQ ID NO: 323475 - RNA, 22 nt, Homo sapiens
cuuccauauucuaggacaggcu

SEQ ID NO: 323476 - RNA, 22 nt, Homo sapiens
cuucuugagacuuaggcuuugg

SEQ ID NO: 323477 - RNA, 22 nt, Homo sapiens
cuugaauguaaauaauguacag

SEQ ID NO: 323478 - RNA, 22 nt, Homo sapiens
cuugacaucugucaguuccuca

SEQ ID NO: 323479 - RNA, 22 nt, Homo sapiens
cuugcacauuacagaucugcau

SEQ ID NO: 323480 - RNA, 22 nt, Homo sapiens
cuugcacuagugcagaggcgcu

SEQ ID NO: 323481 - RNA, 22 nt, Homo sapiens
cuugcacuguuguaagggacuu

SEQ ID NO: 323482 - RNA, 22 nt, Homo sapiens
cuugcauagaguuauugcccuu

SEQ ID NO: 323483 - RNA, 22 nt, Homo sapiens
cuugccuuugucuucaaaggcu

SEQ ID NO: 323484 - RNA, 22 nt, Homo sapiens
cuuggcacugcucacccuccuu

SEQ ID NO: 323485 - RNA, 22 nt, Homo sapiens
cuuggcaugaagaauaauuuuu

SEQ ID NO: 323486 - RNA, 18 nt, Homo sapiens
cuuggcgaugccaacaua

SEQ ID NO: 323487 - RNA, 22 nt, Homo sapiens
cuuggcuugguaucaaauaacc

SEQ ID NO: 323488 - RNA, 22 nt, Homo sapiens
cuugggauauguguuacucugu

SEQ ID NO: 323489 - RNA, 22 nt, Homo sapiens
cuuguacacuguuggugggaau

SEQ ID NO: 323490 - RNA, 22 nt, Homo sapiens
cuuguggugcuuuuacgugggc

SEQ ID NO: 323491 - RNA, 22 nt, Homo sapiens
cuuguguuacauauuuaagaga

SEQ ID NO: 323492 - RNA, 22 nt, Homo sapiens
cuuguucuccuaagaugaaugc

SEQ ID NO: 323493 - RNA, 22 nt, Homo sapiens
cuuuagcaauugauuaugccau

SEQ ID NO: 323494 - RNA, 22 nt, Homo sapiens
cuuucucagugagacccgagau

SEQ ID NO: 323495 - RNA, 18 nt, Homo sapiens
cuuugcagcuuccagagg

SEQ ID NO: 323496 - RNA, 22 nt, Homo sapiens
cuuugcguugaacaaagccaua

SEQ ID NO: 323497 - RNA, 22 nt, Homo sapiens
cuuuggauggaaccucucuuuc

SEQ ID NO: 323498 - RNA, 23 nt, Homo sapiens
cuuuggucucugguugacuucag

SEQ ID NO: 323499 - RNA, 22 nt, Homo sapiens
cuuuggugagggauaaauuuca

SEQ ID NO: 323500 - RNA, 20 nt, Homo sapiens
cuuuggugagucaacuccuu

SEQ ID NO: 323501 - RNA, 22 nt, Homo sapiens
cuuugguugugcucuccacuuu

SEQ ID NO: 323502 - RNA, 22 nt, Homo sapiens
cuuuuacacugguggugggaau

SEQ ID NO: 323503 - RNA, 22 nt, Homo sapiens
cuuuuacacuguuggcaggauu

SEQ ID NO: 323504 - RNA, 20 nt, Homo sapiens
cuuuuagcagcagcaagaga

SEQ ID NO: 323505 - RNA, 22 nt, Homo sapiens
cuuuugugauuccucaguuacu

SEQ ID NO: 323506 - RNA, 21 nt, Homo sapiens
cuuuuuacucguucauaugca

SEQ ID NO: 323507 - RNA, 22 nt, Homo sapiens
cuuuuugcaaauacaacucuga

SEQ ID NO: 323508 - RNA, 22 nt, Homo sapiens
cuuuuugcuagagucuaggguc

SEQ ID NO: 323509 - RNA, 22 nt, Homo sapiens
gaaaauccauccccagggagua

SEQ ID NO: 323510 - RNA, 22 nt, Homo sapiens
gaaacugcauuucuaacaagcu

SEQ ID NO: 323511 - RNA, 22 nt, Homo sapiens
gaaagauuuuaacugggagacu

SEQ ID NO: 323512 - RNA, 22 nt, Homo sapiens
gaaaguaauuaacgauuguugc

SEQ ID NO: 323513 - RNA, 22 nt, Homo sapiens
gaaagugcugcuugacugggau

SEQ ID NO: 323514 - RNA, 21 nt, Homo sapiens
gaaauacugccuuaggagcug

SEQ ID NO: 323515 - RNA, 22 nt, Homo sapiens
gaaaugcucauuuuggauccuu

SEQ ID NO: 323516 - RNA, 22 nt, Homo sapiens
gaaauggaucagagcaagcuuu

SEQ ID NO: 323517 - RNA, 23 nt, Homo sapiens
gaaauguaagugaugccccacag

SEQ ID NO: 323518 - RNA, 22 nt, Homo sapiens
gaaauguauuaaugaguugaaa

SEQ ID NO: 323519 - RNA, 22 nt, Homo sapiens
gaaaugucugagauguggcuca

SEQ ID NO: 323520 - RNA, 23 nt, Homo sapiens
gaaaugucuuagugaaauugcuu

SEQ ID NO: 323521 - RNA, 22 nt, Homo sapiens
gaaauguugauagugggcauug

SEQ ID NO: 323522 - RNA, 22 nt, Homo sapiens
gaacccuggaggcggagguugc

SEQ ID NO: 323523 - RNA, 20 nt, Homo sapiens
gaacugguguauguuuaacu

SEQ ID NO: 323524 - RNA, 22 nt, Homo sapiens
gaacuuucuacauuaccucuuu

SEQ ID NO: 323525 - RNA, 22 nt, Homo sapiens
gaagaaguacaagacaaauuuu

SEQ ID NO: 323526 - RNA, 18 nt, Homo sapiens
gaagaaguaggcauggca

SEQ ID NO: 323527 - RNA, 22 nt, Homo sapiens
gaagauaucuaguaccauuguc

SEQ ID NO: 323528 - RNA, 22 nt, Homo sapiens
gaagcagcauucugguuuuugg

SEQ ID NO: 323529 - RNA, 22 nt, Homo sapiens
gaauaaacuagagaggacugag

SEQ ID NO: 323530 - RNA, 22 nt, Homo sapiens
gaaucccuugcauuaucccuuu

SEQ ID NO: 323531 - RNA, 22 nt, Homo sapiens
gaaugcagcagugacagggcug

SEQ ID NO: 323532 - RNA, 20 nt, Homo sapiens
gaaugguuucgggguucuug

SEQ ID NO: 323533 - RNA, 22 nt, Homo sapiens
gaauguuuacuuuguuuaauac

SEQ ID NO: 323534 - RNA, 22 nt, Homo sapiens
gacaccugguguggaacuggag

SEQ ID NO: 323535 - RNA, 22 nt, Homo sapiens
gacacugucuucugcucuuaaa

SEQ ID NO: 323536 - RNA, 22 nt, Homo sapiens
gacagacacaauugauccauga

SEQ ID NO: 323537 - RNA, 22 nt, Homo sapiens
gacagagcaagacccuauuuaa

SEQ ID NO: 323538 - RNA, 22 nt, Homo sapiens
gacagugagaugucaugugaaa

SEQ ID NO: 323539 - RNA, 18 nt, Homo sapiens
gacagugugaagauuccu

SEQ ID NO: 323540 - RNA, 18 nt, Homo sapiens
gacaguguggcgauuccu

SEQ ID NO: 323541 - RNA, 18 nt, Homo sapiens
gacaguguggugauuccu

SEQ ID NO: 323542 - RNA, 22 nt, Homo sapiens
gacauagagccuugacuucauu

SEQ ID NO: 323543 - RNA, 20 nt, Homo sapiens
gacauggaggaggauuauua

SEQ ID NO: 323544 - RNA, 21 nt, Homo sapiens
gacauggcgauacuccgucuc

SEQ ID NO: 323545 - RNA, 22 nt, Homo sapiens
gacauguuuacaguguugagag

SEQ ID NO: 323546 - RNA, 22 nt, Homo sapiens
gacauguuucucucuguuuacu

SEQ ID NO: 323547 - RNA, 22 nt, Homo sapiens
gacauguuuucaagauuuauaa

SEQ ID NO: 323548 - RNA, 22 nt, Homo sapiens
gacauguuuucauguauuugga

SEQ ID NO: 323549 - RNA, 22 nt, Homo sapiens
gacccuuagaaugugaucuuau

SEQ ID NO: 323550 - RNA, 22 nt, Homo sapiens
gaccuggugguccacccgccuu

SEQ ID NO: 323551 - RNA, 22 nt, Homo sapiens
auacaguaaugucuuaggcugu

SEQ ID NO: 323552 - RNA, 22 nt, Homo sapiens
auacaguaucuucuggcaagca

SEQ ID NO: 323553 - RNA, 22 nt, Homo sapiens
auacaguauggagggcccagcu

SEQ ID NO: 323554 - RNA, 22 nt, Homo sapiens
auacagugaauacuuacagugu

SEQ ID NO: 323555 - RNA, 22 nt, Homo sapiens
auacaguugccauuucuugugc

SEQ ID NO: 323556 - RNA, 22 nt, Homo sapiens
auacaucugccauguuggugug

SEQ ID NO: 323557 - RNA, 22 nt, Homo sapiens
auacaugugccaugcuggugug

SEQ ID NO: 323558 - RNA, 22 nt, Homo sapiens
auacaugugccauguugguaug

SEQ ID NO: 323559 - RNA, 22 nt, Homo sapiens
auacaugugucauguugguuug

SEQ ID NO: 323560 - RNA, 22 nt, Homo sapiens
auacuggcuuuccaauugugau

SEQ ID NO: 323561 - RNA, 22 nt, Homo sapiens
auacuguacugaaguacccauu

SEQ ID NO: 323562 - RNA, 21 nt, Homo sapiens
auacuugagacuggguaauuu

SEQ ID NO: 323563 - RNA, 20 nt, Homo sapiens
auagaagacuagugcagcag

SEQ ID NO: 323564 - RNA, 22 nt, Homo sapiens
gugacagucaaagacaugacuu

SEQ ID NO: 323565 - RNA, 22 nt, Homo sapiens
gugacauuuuuacugaugagag

SEQ ID NO: 323566 - RNA, 22 nt, Homo sapiens
gugaccauuugacauauccuug

SEQ ID NO: 323567 - RNA, 22 nt, Homo sapiens
gugaccucauuacggggccugc

SEQ ID NO: 323568 - RNA, 22 nt, Homo sapiens
gugacugcauauaaguguaugu

SEQ ID NO: 323569 - RNA, 22 nt, Homo sapiens
gugagaauauuuuaaauacuaa

SEQ ID NO: 323570 - RNA, 22 nt, Homo sapiens
gugagaaucaaacuacauaaau

SEQ ID NO: 323571 - RNA, 22 nt, Homo sapiens
gugagaauugacacccuugucu

SEQ ID NO: 323572 - RNA, 22 nt, Homo sapiens
gugagacugaguuucgcucuug

SEQ ID NO: 323573 - RNA, 22 nt, Homo sapiens
gugagaugauggguauguuaau

SEQ ID NO: 323574 - RNA, 22 nt, Homo sapiens
gugagcacugaaagaaggcaag

SEQ ID NO: 323575 - RNA, 22 nt, Homo sapiens
gugagcauaggaggcuucuguu

SEQ ID NO: 323576 - RNA, 22 nt, Homo sapiens
gugagcauauuaguauugcacu

SEQ ID NO: 323577 - RNA, 22 nt, Homo sapiens
gugagcauucaaggaaggagcu

SEQ ID NO: 323578 - RNA, 22 nt, Homo sapiens
gugagcuccucucuauguguca

SEQ ID NO: 323579 - RNA, 21 nt, Homo sapiens
gugaggucauugggcuuucug

SEQ ID NO: 323580 - RNA, 22 nt, Homo sapiens
gugaggucguagucauaggcaa

SEQ ID NO: 323581 - RNA, 17 nt, Homo sapiens
gugagguggguaguauc

SEQ ID NO: 323582 - RNA, 22 nt, Homo sapiens
gugauagaucugggauucagaa

SEQ ID NO: 323583 - RNA, 22 nt, Homo sapiens
gugauaucacuguaucacucca

SEQ ID NO: 323584 - RNA, 22 nt, Homo sapiens
gugauguguuucaacagcuccu

SEQ ID NO: 323585 - RNA, 22 nt, Homo sapiens
gugauuauccacgucuuuguga

SEQ ID NO: 323586 - RNA, 22 nt, Homo sapiens
gugauugcauuaugaauauuau

SEQ ID NO: 323587 - RNA, 22 nt, Homo sapiens
gugcaacaucccuccauaauuu

SEQ ID NO: 323588 - RNA, 22 nt, Homo sapiens
gugcaacaugccuggcuaauuu

SEQ ID NO: 323589 - RNA, 22 nt, Homo sapiens
gugcaagagugacugcaguuuu

SEQ ID NO: 323590 - RNA, 22 nt, Homo sapiens
gugcaagagugauugcaguuuu

SEQ ID NO: 323591 - RNA, 22 nt, Homo sapiens
gugcacaaaucuuaaauguaca

SEQ ID NO: 323592 - RNA, 22 nt, Homo sapiens
gugcacaacgugcagguuuguu

SEQ ID NO: 323593 - RNA, 22 nt, Homo sapiens
gugcacaacguguagguuuguu

SEQ ID NO: 323594 - RNA, 22 nt, Homo sapiens
gugcacaucgugcagguuuguu

SEQ ID NO: 323595 - RNA, 22 nt, Homo sapiens
gugcacaugguagguauugagu

SEQ ID NO: 323596 - RNA, 23 nt, Homo sapiens
gugcaguggcgagauuucggcuc

SEQ ID NO: 323597 - RNA, 22 nt, Homo sapiens
gugcaguuugaaaguagaaaca

SEQ ID NO: 323598 - RNA, 23 nt, Homo sapiens
gugcaugagucuuuauaguagca

SEQ ID NO: 323599 - RNA, 22 nt, Homo sapiens
gugcaugcaucuuuauaguagc

SEQ ID NO: 323600 - RNA, 22 nt, Homo sapiens
gugccacugcaccuggccuaag

SEQ ID NO: 323601 - RNA, 23 nt, Homo sapiens
gugccuucugagccuagucucca

SEQ ID NO: 323602 - RNA, 22 nt, Homo sapiens
gugcgggaggcgcgccuaggug

SEQ ID NO: 323603 - RNA, 22 nt, Homo sapiens
gugcuuuguuguggcaguggca

SEQ ID NO: 323604 - RNA, 22 nt, Homo sapiens
guggaaaauuauugcuguuuuu

SEQ ID NO: 323605 - RNA, 20 nt, Homo sapiens
guggaagauaaguagccuga

SEQ ID NO: 323606 - RNA, 22 nt, Homo sapiens
guggaagauaguguguuaaugu

SEQ ID NO: 323607 - RNA, 22 nt, Homo sapiens
guggaagcacaggccuccugga

SEQ ID NO: 323608 - RNA, 22 nt, Homo sapiens
guggaaggucaugaauguucuu

SEQ ID NO: 323609 - RNA, 22 nt, Homo sapiens
guggaagucuuugguauuggua

SEQ ID NO: 323610 - RNA, 22 nt, Homo sapiens
guggaagugucuggggccaggg

SEQ ID NO: 323611 - RNA, 22 nt, Homo sapiens
guggaauauaaagcaucgugua

SEQ ID NO: 323612 - RNA, 22 nt, Homo sapiens
guggaaugauaucucauugugg

SEQ ID NO: 323613 - RNA, 22 nt, Homo sapiens
guggacagagacuaaauguugu

SEQ ID NO: 323614 - RNA, 22 nt, Homo sapiens
guggagcuguguggccuugggc

SEQ ID NO: 323615 - RNA, 22 nt, Homo sapiens
guggaggagaaagaagcauuuc

SEQ ID NO: 323616 - RNA, 22 nt, Homo sapiens
guggaguaugaaaacugacuuu

SEQ ID NO: 323617 - RNA, 22 nt, Homo sapiens
guggcacgaugaucugggcuca

SEQ ID NO: 323618 - RNA, 22 nt, Homo sapiens
guggcauuucccaaaguauucu

SEQ ID NO: 323619 - RNA, 22 nt, Homo sapiens
guggcuuguaggggucaaggga

SEQ ID NO: 323620 - RNA, 22 nt, Homo sapiens
gugggcaagucacuucaguucu

SEQ ID NO: 323621 - RNA, 22 nt, Homo sapiens
gugggguagcaggcuccuaucu

SEQ ID NO: 323622 - RNA, 22 nt, Homo sapiens
gugggguaggguaggacucaac

SEQ ID NO: 323623 - RNA, 22 nt, Homo sapiens
gugggguaggugacuugaugag

SEQ ID NO: 323624 - RNA, 22 nt, Homo sapiens
gugguaaaauggcauagagcua

SEQ ID NO: 323625 - RNA, 22 nt, Homo sapiens
gugguagaaauguagaugcuag

SEQ ID NO: 323626 - RNA, 19 nt, Homo sapiens
gugguauuaccuuuugauu

SEQ ID NO: 323627 - RNA, 22 nt, Homo sapiens
gugguucuagaauugaguaucc

SEQ ID NO: 323628 - RNA, 21 nt, Homo sapiens
gugguucuagagaaacagaau

SEQ ID NO: 323629 - RNA, 22 nt, Homo sapiens
gugguuguuggaguggcaauuu

SEQ ID NO: 323630 - RNA, 22 nt, Homo sapiens
gugguuuuacaaagagaaagau

SEQ ID NO: 323631 - RNA, 22 nt, Homo sapiens
gugguuuuuagauuucuacagu

SEQ ID NO: 323632 - RNA, 22 nt, Homo sapiens
guguaaaucaaucuguugucuu

SEQ ID NO: 323633 - RNA, 18 nt, Homo sapiens
guguauggauggaggcca

SEQ ID NO: 323634 - RNA, 22 nt, Homo sapiens
guguaugugagaaugcucaugu

SEQ ID NO: 323635 - RNA, 22 nt, Homo sapiens
guguauguuguccauggaugcg

SEQ ID NO: 323636 - RNA, 22 nt, Homo sapiens
gugucccagugugcauacaggu

SEQ ID NO: 323637 - RNA, 22 nt, Homo sapiens
gugucucagcccagaccuauuu

SEQ ID NO: 323638 - RNA, 22 nt, Homo sapiens
gugucuccugccuucaugcagc

SEQ ID NO: 323639 - RNA, 22 nt, Homo sapiens
gugugacagcuauagacaugau

SEQ ID NO: 323640 - RNA, 22 nt, Homo sapiens
gugugacuagucaugccugaau

SEQ ID NO: 323641 - RNA, 22 nt, Homo sapiens
gugugauuguuaauuuuaggug

SEQ ID NO: 323642 - RNA, 22 nt, Homo sapiens
gugugcaacuuucauuaauauu

SEQ ID NO: 323643 - RNA, 22 nt, Homo sapiens
gugugcauaugucuuuauagua

SEQ ID NO: 323644 - RNA, 22 nt, Homo sapiens
guguggaacucaauacaacgca

SEQ ID NO: 323645 - RNA, 22 nt, Homo sapiens
gugugucuugaccaggaucgga

SEQ ID NO: 323646 - RNA, 22 nt, Homo sapiens
guguuauggagccaaacuacua

SEQ ID NO: 323647 - RNA, 22 nt, Homo sapiens
guguuugauugcaaauaaucua

SEQ ID NO: 323648 - RNA, 22 nt, Homo sapiens
guuaaagacauccacauaggag

SEQ ID NO: 323649 - RNA, 22 nt, Homo sapiens
guuaagaaguguaacuuaaguu

SEQ ID NO: 323650 - RNA, 22 nt, Homo sapiens
guuauccugucuuuacauacaa

SEQ ID NO: 323651 - RNA, 22 nt, Homo sapiens
guuaugcagcaauugauaaucu

SEQ ID NO: 323652 - RNA, 22 nt, Homo sapiens
guuauguuaaauuguuguaugc

SEQ ID NO: 323653 - RNA, 22 nt, Homo sapiens
guuauguuaguuacaaggcuag

SEQ ID NO: 323654 - RNA, 21 nt, Homo sapiens
guucaagugauccuccugucu

SEQ ID NO: 323655 - RNA, 22 nt, Homo sapiens
guucacaguuaggacaacugcu

SEQ ID NO: 323656 - RNA, 22 nt, Homo sapiens
ugcgccauugaacuccaggcug

SEQ ID NO: 323657 - RNA, 22 nt, Homo sapiens
ugcuacccuucgucucucuggu

SEQ ID NO: 323658 - RNA, 22 nt, Homo sapiens
ugcuauagcuauaucaucuccu

SEQ ID NO: 323659 - RNA, 22 nt, Homo sapiens
ugcuaucauugauuagugaugu

SEQ ID NO: 323660 - RNA, 18 nt, Homo sapiens
ugcuaugagauuauuuua

SEQ ID NO: 323661 - RNA, 21 nt, Homo sapiens
ugcucaugaguaaugcaguga

SEQ ID NO: 323662 - RNA, 22 nt, Homo sapiens
ugcugcacuuauggcucugagg

SEQ ID NO: 323663 - RNA, 22 nt, Homo sapiens
ugcugguauuuggaccagccug

SEQ ID NO: 323664 - RNA, 22 nt, Homo sapiens
ugcugguguuuaggaauaagaa

SEQ ID NO: 323665 - RNA, 21 nt, Homo sapiens
ugcuuacugaauguuaauuuc

SEQ ID NO: 323666 - RNA, 22 nt, Homo sapiens
ugcuucauuggccaccaggaag

SEQ ID NO: 323667 - RNA, 22 nt, Homo sapiens
uggaaaguacuugaguuuguau

SEQ ID NO: 323668 - RNA, 22 nt, Homo sapiens
uggaaauuaacagggauugucc

SEQ ID NO: 323669 - RNA, 20 nt, Homo sapiens
uggaaauuaaccuuucaggu

SEQ ID NO: 323670 - RNA, 22 nt, Homo sapiens
uggaaauuaagucuuuccugag

SEQ ID NO: 323671 - RNA, 19 nt, Homo sapiens
uggaacauaaaaguugguu

SEQ ID NO: 323672 - RNA, 22 nt, Homo sapiens
uggaagacucaagguggugaau

SEQ ID NO: 323673 - RNA, 22 nt, Homo sapiens
uggaagcaugcaaucugugggg

SEQ ID NO: 323674 - RNA, 22 nt, Homo sapiens
uggaagccuagauucuuuucuu

SEQ ID NO: 323675 - RNA, 22 nt, Homo sapiens
uggaaguagauagauuguguca

SEQ ID NO: 323676 - RNA, 22 nt, Homo sapiens
uggaagucuucauuauguauag

SEQ ID NO: 323677 - RNA, 22 nt, Homo sapiens
uggaagugucugugcccagcuc

SEQ ID NO: 323678 - RNA, 22 nt, Homo sapiens
uggaauacuauucugugcugga

SEQ ID NO: 323679 - RNA, 22 nt, Homo sapiens
uggaauaucaugagaguuuguu

SEQ ID NO: 323680 - RNA, 22 nt, Homo sapiens
uggaauaugagacgggguuguc

SEQ ID NO: 323681 - RNA, 22 nt, Homo sapiens
uggaaucaucaacgaaugaaau

SEQ ID NO: 323682 - RNA, 22 nt, Homo sapiens
uggaaucuagagaaaugcaaac

SEQ ID NO: 323683 - RNA, 21 nt, Homo sapiens
uggaaucuauuauuccaguuu

SEQ ID NO: 323684 - RNA, 21 nt, Homo sapiens
uggaaugaauggccaacaugg

SEQ ID NO: 323685 - RNA, 22 nt, Homo sapiens
uggaauggagagagggugcacg

SEQ ID NO: 323686 - RNA, 22 nt, Homo sapiens
uggaaugguuggugugauuuua

SEQ ID NO: 323687 - RNA, 22 nt, Homo sapiens
uggaauguagcguugacacgag

SEQ ID NO: 323688 - RNA, 22 nt, Homo sapiens
uggaauguauaucguuuuuugu

SEQ ID NO: 323689 - RNA, 22 nt, Homo sapiens
uggaaugucagcuacaagaggg

SEQ ID NO: 323690 - RNA, 22 nt, Homo sapiens
uggaaugucuauguuuuugauu

SEQ ID NO: 323691 - RNA, 22 nt, Homo sapiens
uggaauguggacucuuaugggg

SEQ ID NO: 323692 - RNA, 22 nt, Homo sapiens
uggaauuuagguugauaguaua

SEQ ID NO: 323693 - RNA, 22 nt, Homo sapiens
uggacacuggagauucgucagu

SEQ ID NO: 323694 - RNA, 21 nt, Homo sapiens
uggaccccuacuucucaccau

SEQ ID NO: 323695 - RNA, 22 nt, Homo sapiens
uggacugagauuucagcugcca

SEQ ID NO: 323696 - RNA, 22 nt, Homo sapiens
uggacuguaaauuggggacucu

SEQ ID NO: 323697 - RNA, 22 nt, Homo sapiens
uggagaacauucauuugcaaga

SEQ ID NO: 323698 - RNA, 22 nt, Homo sapiens
uggagacaaagauagaaaagca

SEQ ID NO: 323699 - RNA, 22 nt, Homo sapiens
uggagagcaaagaauuuguuag

SEQ ID NO: 323700 - RNA, 22 nt, Homo sapiens
uggagagugauaaguaaaugga

SEQ ID NO: 323701 - RNA, 22 nt, Homo sapiens
uggagcccuaaacuucuaauau

SEQ ID NO: 323702 - RNA, 22 nt, Homo sapiens
uggagcccuaguuccucauaac

SEQ ID NO: 323703 - RNA, 22 nt, Homo sapiens
uggagguagacauugggaagag

SEQ ID NO: 323704 - RNA, 22 nt, Homo sapiens
uggagguaggacgaagaacucu

SEQ ID NO: 323705 - RNA, 22 nt, Homo sapiens
uggaggucauuggaucaugggg

SEQ ID NO: 323706 - RNA, 22 nt, Homo sapiens
uggagucuugaugauuuucaaa

SEQ ID NO: 323707 - RNA, 20 nt, Homo sapiens
uggagugaagguucuggacc

SEQ ID NO: 323708 - RNA, 22 nt, Homo sapiens
uggaguguguuaacuuuacaag

SEQ ID NO: 323709 - RNA, 20 nt, Homo sapiens
uggaguuguggcaguuugga

SEQ ID NO: 323710 - RNA, 22 nt, Homo sapiens
uggauguacagucaguauuugu

SEQ ID NO: 323711 - RNA, 22 nt, Homo sapiens
uggauuuuaauuauucugucau

SEQ ID NO: 323712 - RNA, 22 nt, Homo sapiens
uggcaaaaaaccgcaguugccu

SEQ ID NO: 323713 - RNA, 22 nt, Homo sapiens
uggcaaaucagaggcauggaca

SEQ ID NO: 323714 - RNA, 22 nt, Homo sapiens
uggcaaauuccaaaguuaauuc

SEQ ID NO: 323715 - RNA, 22 nt, Homo sapiens
uggcaacaucuggggacauguu

SEQ ID NO: 323716 - RNA, 22 nt, Homo sapiens
uggcaagaaccacaauuacuuu

SEQ ID NO: 323717 - RNA, 22 nt, Homo sapiens
uggcaagaagagcaugagacca

SEQ ID NO: 323718 - RNA, 22 nt, Homo sapiens
uggcaagaaggauuuauuccuu

SEQ ID NO: 323719 - RNA, 22 nt, Homo sapiens
uggcaagaccccaucucuacaa

SEQ ID NO: 323720 - RNA, 22 nt, Homo sapiens
uggcaagagauaugugucuaua

SEQ ID NO: 323721 - RNA, 20 nt, Homo sapiens
uggcaagauggcagaauaga

SEQ ID NO: 323722 - RNA, 21 nt, Homo sapiens
uuuuugguggucauggauaga

SEQ ID NO: 323723 - RNA, 22 nt, Homo sapiens
uuuuugguugguaggcuauuaa

SEQ ID NO: 323724 - RNA, 22 nt, Homo sapiens
uuuuuugguaauugaacaauga

SEQ ID NO: 323725 - RNA, 22 nt, Homo sapiens
uacauacuguaugguucuguuu

SEQ ID NO: 323726 - RNA, 22 nt, Homo sapiens
uacauguauccauuguuuuugg

SEQ ID NO: 323727 - RNA, 22 nt, Homo sapiens
uacaugugcaggucuguggggg

SEQ ID NO: 323728 - RNA, 22 nt, Homo sapiens
uaccaaaguuucggccucuguu

SEQ ID NO: 323729 - RNA, 22 nt, Homo sapiens
uaccaaguauuuucacaugaac

SEQ ID NO: 323730 - RNA, 22 nt, Homo sapiens
uaccauguaucugggaugcuuu

SEQ ID NO: 323731 - RNA, 19 nt, Homo sapiens
uacccagaagcagcauugu

SEQ ID NO: 323732 - RNA, 22 nt, Homo sapiens
uaccugagcccucugcugaguu

SEQ ID NO: 323733 - RNA, 22 nt, Homo sapiens
uaccugagucuagagucuagaa

SEQ ID NO: 323734 - RNA, 22 nt, Homo sapiens
uacuacagccugagcgacugag

SEQ ID NO: 323735 - RNA, 22 nt, Homo sapiens
uacuacuuucugacaucuuuaa

SEQ ID NO: 323736 - RNA, 22 nt, Homo sapiens
uacuagaaccuuauucagagug

SEQ ID NO: 323737 - RNA, 19 nt, Homo sapiens
uacugcaccucaaccuggg

SEQ ID NO: 323738 - RNA, 22 nt, Homo sapiens
uacugcacuccagccucgguga

SEQ ID NO: 323739 - RNA, 22 nt, Homo sapiens
uacugcacuccagccugggaga

SEQ ID NO: 323740 - RNA, 22 nt, Homo sapiens
uacugcacuccagcuuaggaga

SEQ ID NO: 323741 - RNA, 23 nt, Homo sapiens
uacugcauccuccgccucuaggg

SEQ ID NO: 323742 - RNA, 22 nt, Homo sapiens
uacugcauucuccgccuccggg

SEQ ID NO: 323743 - RNA, 21 nt, Homo sapiens
uacuggagauacagucugcaa

SEQ ID NO: 323744 - RNA, 22 nt, Homo sapiens
uacuggccuugaacucuggugu

SEQ ID NO: 323745 - RNA, 19 nt, Homo sapiens
uacuggcucgggaauuuuc

SEQ ID NO: 323746 - RNA, 22 nt, Homo sapiens
uacuuuguagagugugagaauu

SEQ ID NO: 323747 - RNA, 22 nt, Homo sapiens
uacuuuguuauagcagcaggaa

SEQ ID NO: 323748 - RNA, 22 nt, Homo sapiens
uagaaaguagggaagguaggau

SEQ ID NO: 323749 - RNA, 22 nt, Homo sapiens
uagaacaauugcuggauccgaa

SEQ ID NO: 323750 - RNA, 22 nt, Homo sapiens
uagaaguaggcuacgugucugg

SEQ ID NO: 323751 - RNA, 22 nt, Homo sapiens
uagaauggaaggcauguuugcc

SEQ ID NO: 323752 - RNA, 22 nt, Homo sapiens
uagaauguaacaguuaaaagca

SEQ ID NO: 323753 - RNA, 22 nt, Homo sapiens
uagaaugucagcuucuugaggg

SEQ ID NO: 323754 - RNA, 22 nt, Homo sapiens
uagacaacugaaacacugugca

SEQ ID NO: 323755 - RNA, 22 nt, Homo sapiens
uagaccaauuggcauauaguaa

SEQ ID NO: 323756 - RNA, 22 nt, Homo sapiens
uagacuguaagauccaggagag

SEQ ID NO: 323757 - RNA, 22 nt, Homo sapiens
uagagcaaugacucuggaaacc

SEQ ID NO: 323758 - RNA, 22 nt, Homo sapiens
uagagcacagugauuagaccua

SEQ ID NO: 323759 - RNA, 22 nt, Homo sapiens
uagagccauugcagauguuuga

SEQ ID NO: 323760 - RNA, 22 nt, Homo sapiens
uagagcuaguuuuuaaucuaac

SEQ ID NO: 323761 - RNA, 22 nt, Homo sapiens
uagagcuugacacuuuccaugg

SEQ ID NO: 323762 - RNA, 22 nt, Homo sapiens
uagagguagccuacuacacacc

SEQ ID NO: 323763 - RNA, 22 nt, Homo sapiens
uagagguaggucuucgagucuc

SEQ ID NO: 323764 - RNA, 22 nt, Homo sapiens
uagagguauaccaaaaaggcau

SEQ ID NO: 323765 - RNA, 22 nt, Homo sapiens
uagagguauuaacaguagaaga

SEQ ID NO: 323766 - RNA, 23 nt, Homo sapiens
uagaucaucaaguuuacugugcu

SEQ ID NO: 323767 - RNA, 22 nt, Homo sapiens
uagauuaucauucauacaggga

SEQ ID NO: 323768 - RNA, 22 nt, Homo sapiens
uagauuauuccuuugaauggcc

SEQ ID NO: 323769 - RNA, 22 nt, Homo sapiens
uagauuguuuaaguggcacaca

SEQ ID NO: 323770 - RNA, 20 nt, Homo sapiens
uagcacacauguagaauagu

SEQ ID NO: 323771 - RNA, 19 nt, Homo sapiens
uagcacagggucccagacu

SEQ ID NO: 323772 - RNA, 22 nt, Homo sapiens
uagcacagugucauucuaggua

SEQ ID NO: 323773 - RNA, 22 nt, Homo sapiens
uagcaccaggguugacugaccu

SEQ ID NO: 323774 - RNA, 22 nt, Homo sapiens
uagcacccucuccuaguccugc

SEQ ID NO: 323775 - RNA, 22 nt, Homo sapiens
uagcacuaucuauugcaugcaa

SEQ ID NO: 323776 - RNA, 22 nt, Homo sapiens
uagcacugucuugcaccugugc

SEQ ID NO: 323777 - RNA, 22 nt, Homo sapiens
uagcagcauaaauggacuaaga

SEQ ID NO: 323778 - RNA, 22 nt, Homo sapiens
uagcagcaucucuggcuucuac

SEQ ID NO: 323779 - RNA, 22 nt, Homo sapiens
uagcagcauuuuuguagaguau

SEQ ID NO: 323780 - RNA, 22 nt, Homo sapiens
uagcagcuuuauugagguaaau

SEQ ID NO: 323781 - RNA, 22 nt, Homo sapiens
uagcaggaaaggggucagaucu

SEQ ID NO: 323782 - RNA, 22 nt, Homo sapiens
uagcaguaccccaguauccugg

SEQ ID NO: 323783 - RNA, 22 nt, Homo sapiens
uagcaguagacagacuuuggcu

SEQ ID NO: 323784 - RNA, 22 nt, Homo sapiens
uagcagucaagauagucauuau

SEQ ID NO: 323785 - RNA, 22 nt, Homo sapiens
uagcagugucuagguaggccau

SEQ ID NO: 323786 - RNA, 22 nt, Homo sapiens
uagccgggugugguggaacucc

SEQ ID NO: 323787 - RNA, 22 nt, Homo sapiens
uagcuaaauucagcucuaggua

SEQ ID NO: 323788 - RNA, 22 nt, Homo sapiens
uagcuccacagcuauauauaau

SEQ ID NO: 323789 - RNA, 22 nt, Homo sapiens
uagcugcacuuacaagugagaa

SEQ ID NO: 323790 - RNA, 22 nt, Homo sapiens
uagcugcugcuaggcuaaggau

SEQ ID NO: 323791 - RNA, 22 nt, Homo sapiens
uaggcaauguacauaucggccc

SEQ ID NO: 323792 - RNA, 22 nt, Homo sapiens
uaggcacuguguuuguaggagu

SEQ ID NO: 323793 - RNA, 22 nt, Homo sapiens
uaggcaguuuuccuuucacagu

SEQ ID NO: 323794 - RNA, 22 nt, Homo sapiens
uaggcauuuuucugauaaacua

SEQ ID NO: 323795 - RNA, 22 nt, Homo sapiens
uagggagugucuucauuuugua

SEQ ID NO: 323796 - RNA, 22 nt, Homo sapiens
uagggcaaggaacaguuaaaaa

SEQ ID NO: 323797 - RNA, 19 nt, Homo sapiens
uagguacauucaagucucc

SEQ ID NO: 323798 - RNA, 22 nt, Homo sapiens
uagguagauuuaaagauuuucu

SEQ ID NO: 323799 - RNA, 22 nt, Homo sapiens
uagguaggaaguguuguuuuua

SEQ ID NO: 323800 - RNA, 22 nt, Homo sapiens
uagguaggacguaguccuuuug

SEQ ID NO: 323801 - RNA, 22 nt, Homo sapiens
uagguagguggaaaaguaauug

SEQ ID NO: 323802 - RNA, 22 nt, Homo sapiens
uagguagugugugcaugagagg

SEQ ID NO: 323803 - RNA, 22 nt, Homo sapiens
uaggucaguuuuggcuuggcuu

SEQ ID NO: 323804 - RNA, 22 nt, Homo sapiens
uaggugaauguaguaagguguu

SEQ ID NO: 323805 - RNA, 22 nt, Homo sapiens
uaggugcacaguaaauauaugu

SEQ ID NO: 323806 - RNA, 22 nt, Homo sapiens
uagguucucaggaaugagcuuc

SEQ ID NO: 323807 - RNA, 22 nt, Homo sapiens
uagguugucaucagucuccacu

SEQ ID NO: 323808 - RNA, 22 nt, Homo sapiens
uagguugucucuucacucugau

SEQ ID NO: 323809 - RNA, 22 nt, Homo sapiens
uaguaaacauaguucuuuugcu

SEQ ID NO: 323810 - RNA, 22 nt, Homo sapiens
uaguacuggcauguauuuccca

SEQ ID NO: 323811 - RNA, 22 nt, Homo sapiens
uaguagcauaccuaaguauacu

SEQ ID NO: 323812 - RNA, 22 nt, Homo sapiens
uaguauguuuauagcauugagu

SEQ ID NO: 323813 - RNA, 22 nt, Homo sapiens
uagugacauugcugggaaugcu

SEQ ID NO: 323814 - RNA, 22 nt, Homo sapiens
uagugcaguggcuccaucucag

SEQ ID NO: 323815 - RNA, 22 nt, Homo sapiens
uaguucguguuugaacuagauc

SEQ ID NO: 323816 - RNA, 22 nt, Homo sapiens
ugucuuuguuaguuguccuagu

SEQ ID NO: 323817 - RNA, 22 nt, Homo sapiens
ugugaacagcagcugggcuuug

SEQ ID NO: 323818 - RNA, 22 nt, Homo sapiens
ugugaacagcuccaaaugugga

SEQ ID NO: 323819 - RNA, 22 nt, Homo sapiens
ugugaagauggacuaauauagu

SEQ ID NO: 323820 - RNA, 22 nt, Homo sapiens
ugugaaugauggagugucgaau

SEQ ID NO: 323821 - RNA, 22 nt, Homo sapiens
ugugacagguauccuguguucu

SEQ ID NO: 323822 - RNA, 21 nt, Homo sapiens
ugugacuguugcauuugucgu

SEQ ID NO: 323823 - RNA, 22 nt, Homo sapiens
ugugagacugacagggcagggu

SEQ ID NO: 323824 - RNA, 22 nt, Homo sapiens
ugugagacugguucugaaccca

SEQ ID NO: 323825 - RNA, 22 nt, Homo sapiens
ugugauaguugcuguucugggc

SEQ ID NO: 323826 - RNA, 22 nt, Homo sapiens
ugugaucaaccugcagggcugg

SEQ ID NO: 323827 - RNA, 22 nt, Homo sapiens
ugugaucaugguauuaaucugc

SEQ ID NO: 323828 - RNA, 22 nt, Homo sapiens
ugugaugaagaguccaagaaca

SEQ ID NO: 323829 - RNA, 18 nt, Homo sapiens
ugugauggauauguuaau

SEQ ID NO: 323830 - RNA, 22 nt, Homo sapiens
ugugaugguuuggaagcuucuu

SEQ ID NO: 323831 - RNA, 22 nt, Homo sapiens
ugugauugauauauuuacagaa

SEQ ID NO: 323832 - RNA, 22 nt, Homo sapiens
ugugcaaaaguaauugcgguuu

SEQ ID NO: 323833 - RNA, 22 nt, Homo sapiens
ugugcaaucuuccauuuuuagg

SEQ ID NO: 323834 - RNA, 22 nt, Homo sapiens
ugugcacaacaugcagguuugu

SEQ ID NO: 323835 - RNA, 23 nt, Homo sapiens
ugugcacauuuacauauauacac

SEQ ID NO: 323836 - RNA, 22 nt, Homo sapiens
ugugcaugacagcauacaaacg

SEQ ID NO: 323837 - RNA, 22 nt, Homo sapiens
ugugccacuccagcucuagcuu

SEQ ID NO: 323838 - RNA, 22 nt, Homo sapiens
ugugccacugcacucuggccug

SEQ ID NO: 323839 - RNA, 22 nt, Homo sapiens
ugugccuacugauagagccaag

SEQ ID NO: 323840 - RNA, 22 nt, Homo sapiens
ugugccuucuaagaaggagucu

SEQ ID NO: 323841 - RNA, 22 nt, Homo sapiens
ugugcgugugccuguaagaauu

SEQ ID NO: 323842 - RNA, 22 nt, Homo sapiens
ugugcuugaaauucaguuuuga

SEQ ID NO: 323843 - RNA, 22 nt, Homo sapiens
ugugcuugcuucuucuccuagu

SEQ ID NO: 323844 - RNA, 22 nt, Homo sapiens
ugugcuuguaaaggccagagca

SEQ ID NO: 323845 - RNA, 21 nt, Homo sapiens
uguggcaauggccucacagau

SEQ ID NO: 323846 - RNA, 22 nt, Homo sapiens
uguggcagugcuuuaugaaacc

SEQ ID NO: 323847 - RNA, 22 nt, Homo sapiens
uguggcugguggcaccuuuucc

SEQ ID NO: 323848 - RNA, 18 nt, Homo sapiens
uguggcuguuuuccaaua

SEQ ID NO: 323849 - RNA, 22 nt, Homo sapiens
uguggcuucuuugguucaguau

SEQ ID NO: 323850 - RNA, 22 nt, Homo sapiens
uguggcuuuacagcaugguuca

SEQ ID NO: 323851 - RNA, 22 nt, Homo sapiens
ugugguagugcuuaccugcagu

SEQ ID NO: 323852 - RNA, 22 nt, Homo sapiens
ugugguuuuauaaacgugaccu

SEQ ID NO: 323853 - RNA, 22 nt, Homo sapiens
uguguaauaccuuugacuauau

SEQ ID NO: 323854 - RNA, 22 nt, Homo sapiens
uguguacaucucuacacacaug

SEQ ID NO: 323855 - RNA, 22 nt, Homo sapiens
uguguagagaaauauuacuuau

SEQ ID NO: 323856 - RNA, 22 nt, Homo sapiens
uguguuuuuauguaaaauggaa

SEQ ID NO: 323857 - RNA, 22 nt, Homo sapiens
uguuaagauguguuuuguggcu

SEQ ID NO: 323858 - RNA, 22 nt, Homo sapiens
uguuacagcagaauugauugca

SEQ ID NO: 323859 - RNA, 22 nt, Homo sapiens
uguuacaguguaggccuugggu

SEQ ID NO: 323860 - RNA, 22 nt, Homo sapiens
uguuaucauuacguucuuaguu

SEQ ID NO: 323861 - RNA, 22 nt, Homo sapiens
uguuauuuuguguuagggcaca

SEQ ID NO: 323862 - RNA, 22 nt, Homo sapiens
uguucacaguguuucuuugaga

SEQ ID NO: 323863 - RNA, 22 nt, Homo sapiens
uguucaugaguucucauuuuua

SEQ ID NO: 323864 - RNA, 22 nt, Homo sapiens
uguucuggagaggcaggccaca

SEQ ID NO: 323865 - RNA, 22 nt, Homo sapiens
uguucuggagaguuuagucugg

SEQ ID NO: 323866 - RNA, 22 nt, Homo sapiens
uguucuugagccuuuagaccua

SEQ ID NO: 323867 - RNA, 19 nt, Homo sapiens
uguugcacauaucaauaug

SEQ ID NO: 323868 - RNA, 22 nt, Homo sapiens
uguugcacuccagccuagguga

SEQ ID NO: 323869 - RNA, 22 nt, Homo sapiens
uguuugcuuaacguggagccag

SEQ ID NO: 323870 - RNA, 22 nt, Homo sapiens
uguuuuggaggccagaagucca

SEQ ID NO: 323871 - RNA, 22 nt, Homo sapiens
uguuuugguugucccuggccag

SEQ ID NO: 323872 - RNA, 21 nt, Homo sapiens
uguuuuugcuguguaucucuc

SEQ ID NO: 323873 - RNA, 22 nt, Homo sapiens
uuaaaagcuaucuccaagguca

SEQ ID NO: 323874 - RNA, 22 nt, Homo sapiens
uuaaagccauaccugagagagu

SEQ ID NO: 323875 - RNA, 22 nt, Homo sapiens
uuaaaguaauugaaauggccuu

SEQ ID NO: 323876 - RNA, 22 nt, Homo sapiens
uuaaagugcacacgggucaggc

SEQ ID NO: 323877 - RNA, 22 nt, Homo sapiens
uuaaagugcuguuuuugccggg

SEQ ID NO: 323878 - RNA, 22 nt, Homo sapiens
uuaaaguguuugcagacaggug

SEQ ID NO: 323879 - RNA, 22 nt, Homo sapiens
uuaaaugcucacauaaagguag

SEQ ID NO: 323880 - RNA, 22 nt, Homo sapiens
uuaacagcacuacguggggauc

SEQ ID NO: 323881 - RNA, 22 nt, Homo sapiens
uuaagacaccaaucauuggauu

SEQ ID NO: 323882 - RNA, 23 nt, Homo sapiens
uuaagcaacggcugcuuuucaga

SEQ ID NO: 323883 - RNA, 22 nt, Homo sapiens
uuaagccacucaagagauagag

SEQ ID NO: 323884 - RNA, 22 nt, Homo sapiens
uuaagcugaauuuaagcuucgg

SEQ ID NO: 323885 - RNA, 22 nt, Homo sapiens
uuaaggcagugcaucuggaguu

SEQ ID NO: 323886 - RNA, 22 nt, Homo sapiens
uuaaggcagugucuaugccagu

SEQ ID NO: 323887 - RNA, 22 nt, Homo sapiens
uuaaggcauucuuugucuucau

SEQ ID NO: 323888 - RNA, 22 nt, Homo sapiens
uuaaggccccgcccauucaggc

SEQ ID NO: 323889 - RNA, 22 nt, Homo sapiens
uuaaguaaucagagaagagaac

SEQ ID NO: 323890 - RNA, 22 nt, Homo sapiens
uuaaguacuucccuguuggaca

SEQ ID NO: 323891 - RNA, 20 nt, Homo sapiens
uuaagugcuuucugcuuaga

SEQ ID NO: 323892 - RNA, 21 nt, Homo sapiens
uuaagugcuuuguaugcacua

SEQ ID NO: 323893 - RNA, 22 nt, Homo sapiens
uuaagugguagguggugcccaa

SEQ ID NO: 323894 - RNA, 22 nt, Homo sapiens
uuaaguguaaguggugugggac

SEQ ID NO: 323895 - RNA, 19 nt, Homo sapiens
uuaagugugauaucucagu

SEQ ID NO: 323896 - RNA, 22 nt, Homo sapiens
uuaauagugacucauuuuccac

SEQ ID NO: 323897 - RNA, 22 nt, Homo sapiens
uuaaucaggccguuuccuaaga

SEQ ID NO: 323898 - RNA, 22 nt, Homo sapiens
uuaaugaacuuuauuuuguaga

SEQ ID NO: 323899 - RNA, 22 nt, Homo sapiens
uuaauuguaucuauagauguca

SEQ ID NO: 323900 - RNA, 22 nt, Homo sapiens
uuacaaccucagcagugcaaag

SEQ ID NO: 323901 - RNA, 22 nt, Homo sapiens
ucauaguacuuuguuuugaaaa

SEQ ID NO: 323902 - RNA, 22 nt, Homo sapiens
ucauauugguuaaaauaguggg

SEQ ID NO: 323903 - RNA, 23 nt, Homo sapiens
ucaucacagcauuuccugguauu

SEQ ID NO: 323904 - RNA, 22 nt, Homo sapiens
ucaucaggcucauucaagcuga

SEQ ID NO: 323905 - RNA, 22 nt, Homo sapiens
ucaucagugcuugcaaauuauu

SEQ ID NO: 323906 - RNA, 22 nt, Homo sapiens
ucaugacacagcauacugacuu

SEQ ID NO: 323907 - RNA, 22 nt, Homo sapiens
ucaugagacacacuggaaagga

SEQ ID NO: 323908 - RNA, 22 nt, Homo sapiens
ucauggcacugaugagaguuuc

SEQ ID NO: 323909 - RNA, 22 nt, Homo sapiens
ucauggcuuuuauuauguugag

SEQ ID NO: 323910 - RNA, 19 nt, Homo sapiens
ucauggcuuuuucagcugu

SEQ ID NO: 323911 - RNA, 22 nt, Homo sapiens
ucauggguuuugguccaagcaa

SEQ ID NO: 323912 - RNA, 22 nt, Homo sapiens
ucauguauuaucauuagugggu

SEQ ID NO: 323913 - RNA, 22 nt, Homo sapiens
ucaugugaggauaacaauagug

SEQ ID NO: 323914 - RNA, 19 nt, Homo sapiens
ucaugugcauacauuuggg

SEQ ID NO: 323915 - RNA, 22 nt, Homo sapiens
ucauguguugcacugaggaccu

SEQ ID NO: 323916 - RNA, 22 nt, Homo sapiens
ucauugcaaucucugccucccg

SEQ ID NO: 323917 - RNA, 22 nt, Homo sapiens
ucauugcauguuaauuaaacag

SEQ ID NO: 323918 - RNA, 22 nt, Homo sapiens
ucauuggauggaaugcucugua

SEQ ID NO: 323919 - RNA, 22 nt, Homo sapiens
ucauugguagcucauggaaccg

SEQ ID NO: 323920 - RNA, 22 nt, Homo sapiens
uccaagaugcuggcagcuacag

SEQ ID NO: 323921 - RNA, 22 nt, Homo sapiens
uccacaauggagaagaguauga

SEQ ID NO: 323922 - RNA, 22 nt, Homo sapiens
uccacaguggugaggugcagca

SEQ ID NO: 323923 - RNA, 18 nt, Homo sapiens
uccacgugcuuuccagau

SEQ ID NO: 323924 - RNA, 22 nt, Homo sapiens
uccacugagcuagaccacuugg

SEQ ID NO: 323925 - RNA, 22 nt, Homo sapiens
uccagguuuggcuuuauaacuu

SEQ ID NO: 323926 - RNA, 22 nt, Homo sapiens
uccaguagaauuuuauucaaca

SEQ ID NO: 323927 - RNA, 22 nt, Homo sapiens
uccaguggacagacauaccaug

SEQ ID NO: 323928 - RNA, 22 nt, Homo sapiens
uccaguguuccucagucacccc

SEQ ID NO: 323929 - RNA, 22 nt, Homo sapiens
uccaguuauccuguggggagga

SEQ ID NO: 323930 - RNA, 22 nt, Homo sapiens
uccauggagacacauuuuauau

SEQ ID NO: 323931 - RNA, 20 nt, Homo sapiens
ucccaguaggagaaggaagg

SEQ ID NO: 323932 - RNA, 22 nt, Homo sapiens
ucccagugaaaccccaccuuca

SEQ ID NO: 323933 - RNA, 22 nt, Homo sapiens
uccccgaggcuggagugcagug

SEQ ID NO: 323934 - RNA, 22 nt, Homo sapiens
uccccugauaccaaccaccaug

SEQ ID NO: 323935 - RNA, 22 nt, Homo sapiens
ucccuacuggggcacugccuag

SEQ ID NO: 323936 - RNA, 18 nt, Homo sapiens
ucccucagaauuauagaa

SEQ ID NO: 323937 - RNA, 22 nt, Homo sapiens
ucccugaacacauguugagaag

SEQ ID NO: 323938 - RNA, 22 nt, Homo sapiens
ucccugaaucucagguucugua

SEQ ID NO: 323939 - RNA, 18 nt, Homo sapiens
ucccugacucaaauucuu

SEQ ID NO: 323940 - RNA, 22 nt, Homo sapiens
ucccugagguccuggauuauug

SEQ ID NO: 323941 - RNA, 17 nt, Homo sapiens
ucccuguuuuuucaguc

SEQ ID NO: 323942 - RNA, 22 nt, Homo sapiens
ucccuugguaauucuguuccuu

SEQ ID NO: 323943 - RNA, 22 nt, Homo sapiens
ucccuuucuggaguuucccaag

SEQ ID NO: 323944 - RNA, 18 nt, Homo sapiens
ucccuuuguagaugaccc

SEQ ID NO: 323945 - RNA, 19 nt, Homo sapiens
ucccuuuguagguaaccug

SEQ ID NO: 323946 - RNA, 19 nt, Homo sapiens
ucccuuuguauggacauac

SEQ ID NO: 323947 - RNA, 22 nt, Homo sapiens
uccugagacucacaggcucccc

SEQ ID NO: 323948 - RNA, 22 nt, Homo sapiens
uccugagagcagacccucuaua

SEQ ID NO: 323949 - RNA, 22 nt, Homo sapiens
uccugagucagcauccguuugu

SEQ ID NO: 323950 - RNA, 22 nt, Homo sapiens
uccuugaaacaggaagaauuca

SEQ ID NO: 323951 - RNA, 22 nt, Homo sapiens
uccuugagccucccagacucag

SEQ ID NO: 323952 - RNA, 22 nt, Homo sapiens
uccuugagccuuaaauuauaaa

SEQ ID NO: 323953 - RNA, 19 nt, Homo sapiens
uccuugauugcaccacugc

SEQ ID NO: 323954 - RNA, 21 nt, Homo sapiens
uccuuggugaugcccugcagu

SEQ ID NO: 323955 - RNA, 22 nt, Homo sapiens
uccuugguugauccugugcaga

SEQ ID NO: 323956 - RNA, 23 nt, Homo sapiens
uccuugguuggcgcccuaugugu

SEQ ID NO: 323957 - RNA, 22 nt, Homo sapiens
uccuuuaguuaauaaagacaag

SEQ ID NO: 323958 - RNA, 22 nt, Homo sapiens
uccuuuggguagcuguucagau

SEQ ID NO: 323959 - RNA, 22 nt, Homo sapiens
ucgcaccauugcacuccagcca

SEQ ID NO: 323960 - RNA, 23 nt, Homo sapiens
ucgcagcauucaauaccaggcag

SEQ ID NO: 323961 - RNA, 22 nt, Homo sapiens
ucuaaaacuagauugugaugau

SEQ ID NO: 323962 - RNA, 22 nt, Homo sapiens
ucuaaagcauccagauugcuuc

SEQ ID NO: 323963 - RNA, 22 nt, Homo sapiens
ucuaaaguacuacuacuguugg

SEQ ID NO: 323964 - RNA, 22 nt, Homo sapiens
ucuacagccaguucaggaagaa

SEQ ID NO: 323965 - RNA, 22 nt, Homo sapiens
ucuauguuuuugcuaguagugu

SEQ ID NO: 323966 - RNA, 22 nt, Homo sapiens
ucuauugguaggggcugaggca

SEQ ID NO: 323967 - RNA, 22 nt, Homo sapiens
ucucaaguaacugggacaauaa

SEQ ID NO: 323968 - RNA, 22 nt, Homo sapiens
ucucaauggguuguagacaaag

SEQ ID NO: 323969 - RNA, 18 nt, Homo sapiens
ucucacagcaaucuguca

SEQ ID NO: 323970 - RNA, 22 nt, Homo sapiens
ucucacagccauuucucccucu

SEQ ID NO: 323971 - RNA, 22 nt, Homo sapiens
ucucagagccuaggguuuuuca

SEQ ID NO: 323972 - RNA, 22 nt, Homo sapiens
ucucagcacagucagggcgccu

SEQ ID NO: 323973 - RNA, 22 nt, Homo sapiens
ucucaguggcacccccaacacc

SEQ ID NO: 323974 - RNA, 22 nt, Homo sapiens
ucucagugugguaaaaguuuuu

SEQ ID NO: 323975 - RNA, 20 nt, Homo sapiens
ucucauagagguagagaaua

SEQ ID NO: 323976 - RNA, 22 nt, Homo sapiens
ucucauggagguagagaguaaa

SEQ ID NO: 323977 - RNA, 22 nt, Homo sapiens
ucucauggagucaggagcagaa

SEQ ID NO: 323978 - RNA, 21 nt, Homo sapiens
ucucauuacugaugagccaga

SEQ ID NO: 323979 - RNA, 22 nt, Homo sapiens
ucuccauugaaauggacauaau

SEQ ID NO: 323980 - RNA, 20 nt, Homo sapiens
ucucccaaacagcaggcccu

SEQ ID NO: 323981 - RNA, 22 nt, Homo sapiens
ucucccauccguacacggauug

SEQ ID NO: 323982 - RNA, 22 nt, Homo sapiens
ucucugaaacucuugacauccu

SEQ ID NO: 323983 - RNA, 22 nt, Homo sapiens
ucucugacacugaccccaaaaa

SEQ ID NO: 323984 - RNA, 22 nt, Homo sapiens
ucucugagaccacuccaaacuc

SEQ ID NO: 323985 - RNA, 22 nt, Homo sapiens
ucucuguuugucuguuacuggu

SEQ ID NO: 323986 - RNA, 22 nt, Homo sapiens
ucucuuggcggaaguugcagug

SEQ ID NO: 323987 - RNA, 22 nt, Homo sapiens
ucugacagugugaauauugacu

SEQ ID NO: 323988 - RNA, 22 nt, Homo sapiens
ucugagguuacugcuuuguaga

SEQ ID NO: 323989 - RNA, 22 nt, Homo sapiens
ucugccacugucauugugugau

SEQ ID NO: 323990 - RNA, 22 nt, Homo sapiens
ucugccuuuucaugugggaugg

SEQ ID NO: 323991 - RNA, 23 nt, Homo sapiens
ucugcggguguggacccuagugc

SEQ ID NO: 323992 - RNA, 22 nt, Homo sapiens
ucuggagugugaaguggauaug

SEQ ID NO: 323993 - RNA, 20 nt, Homo sapiens
ucuggccccuccaaaucuca

SEQ ID NO: 323994 - RNA, 22 nt, Homo sapiens
uuacaagaugucuguccaacac

SEQ ID NO: 323995 - RNA, 22 nt, Homo sapiens
uuacagauggauggcagcuggc

SEQ ID NO: 323996 - RNA, 17 nt, Homo sapiens
uuacaggugcugagagu

SEQ ID NO: 323997 - RNA, 22 nt, Homo sapiens
uuacagguggagaaguaaggcu

SEQ ID NO: 323998 - RNA, 19 nt, Homo sapiens
uuacagugugcccuuuuag

SEQ ID NO: 323999 - RNA, 19 nt, Homo sapiens
uuacauccauugcauuuca

SEQ ID NO: 324000 - RNA, 22 nt, Homo sapiens
uuaccagagaagacgaggggga

SEQ ID NO: 324001 - RNA, 22 nt, Homo sapiens
uuaccagucugauaaacagaaa

SEQ ID NO: 324002 - RNA, 22 nt, Homo sapiens
uuacccuuuaacccuuuaaagu

SEQ ID NO: 324003 - RNA, 22 nt, Homo sapiens
uuaccucuguggcucucggacu

SEQ ID NO: 324004 - RNA, 22 nt, Homo sapiens
uuaccuugcacugagucugaaa

SEQ ID NO: 324005 - RNA, 22 nt, Homo sapiens
uuacugcuuaagugauucaaca

SEQ ID NO: 324006 - RNA, 22 nt, Homo sapiens
uuagaacuagaggaguuugagu

SEQ ID NO: 324007 - RNA, 17 nt, Homo sapiens
uuagacagacauccugc

SEQ ID NO: 324008 - RNA, 19 nt, Homo sapiens
uuagagaucaucugcuuca

SEQ ID NO: 324009 - RNA, 22 nt, Homo sapiens
uuagauaguacugaaugguucu

SEQ ID NO: 324010 - RNA, 22 nt, Homo sapiens
uuagauuauugguguuuugcaa

SEQ ID NO: 324011 - RNA, 22 nt, Homo sapiens
uuagcagcaugaaaauggacug

SEQ ID NO: 324012 - RNA, 21 nt, Homo sapiens
uuagcauccauguucaucaac

SEQ ID NO: 324013 - RNA, 22 nt, Homo sapiens
uuagcucaguuggugagagcgu

SEQ ID NO: 324014 - RNA, 22 nt, Homo sapiens
uuaggagacuggauaucucuuu

SEQ ID NO: 324015 - RNA, 22 nt, Homo sapiens
uuaggcaaugcucucaaauuug

SEQ ID NO: 324016 - RNA, 22 nt, Homo sapiens
uuaggcucuuuaucaguuaacu

SEQ ID NO: 324017 - RNA, 22 nt, Homo sapiens
uuaggcucuuugaggugcccag

SEQ ID NO: 324018 - RNA, 22 nt, Homo sapiens
uuaggcuuuauugaaaacaaua

SEQ ID NO: 324019 - RNA, 22 nt, Homo sapiens
uuagggaggcucaggacaagag

SEQ ID NO: 324020 - RNA, 22 nt, Homo sapiens
uuagguaggugcuuuuuucaca

SEQ ID NO: 324021 - RNA, 22 nt, Homo sapiens
uuaggugguacacagccccagu

SEQ ID NO: 324022 - RNA, 22 nt, Homo sapiens
uuaguagcacagaguaucagca

SEQ ID NO: 324023 - RNA, 22 nt, Homo sapiens
uuaguaguuugaguggggguua

SEQ ID NO: 324024 - RNA, 22 nt, Homo sapiens
uuaguaguuugauaggaauagc

SEQ ID NO: 324025 - RNA, 20 nt, Homo sapiens
uuaguucauuuagaagguuu

SEQ ID NO: 324026 - RNA, 22 nt, Homo sapiens
uuauaaacaugaagauuugggg

SEQ ID NO: 324027 - RNA, 22 nt, Homo sapiens
uuauacuacuauaaagagguag

SEQ ID NO: 324028 - RNA, 22 nt, Homo sapiens
uuauagcuaacaucugugaaaa

SEQ ID NO: 324029 - RNA, 19 nt, Homo sapiens
uuauauaguuucugaggcu

SEQ ID NO: 324030 - RNA, 22 nt, Homo sapiens
uuauauguuucuuagggacaga

SEQ ID NO: 324031 - RNA, 22 nt, Homo sapiens
uuaucacauugacugauuugca

SEQ ID NO: 324032 - RNA, 22 nt, Homo sapiens
uuaucagcagcaugaaaauaga

SEQ ID NO: 324033 - RNA, 22 nt, Homo sapiens
uuaucagcagugcgaaaacaga

SEQ ID NO: 324034 - RNA, 22 nt, Homo sapiens
uuaucucaguguuuguaaacaa

SEQ ID NO: 324035 - RNA, 22 nt, Homo sapiens
uuaugacaggcucaggagcccc

SEQ ID NO: 324036 - RNA, 22 nt, Homo sapiens
uuaugacauugacaguuuuuag

SEQ ID NO: 324037 - RNA, 17 nt, Homo sapiens
uuaugagacuucuuagc

SEQ ID NO: 324038 - RNA, 22 nt, Homo sapiens
uuaugccagugauuauaagggc

SEQ ID NO: 324039 - RNA, 22 nt, Homo sapiens
uuaugcuguuuucuggagauuu

SEQ ID NO: 324040 - RNA, 23 nt, Homo sapiens
uuauggcuuuuauuauguugagg

SEQ ID NO: 324041 - RNA, 22 nt, Homo sapiens
uuaugguuuucucucacgcagg

SEQ ID NO: 324042 - RNA, 22 nt, Homo sapiens
uuaugugccuuuuugccauuca

SEQ ID NO: 324043 - RNA, 22 nt, Homo sapiens
uuauuagguuagugcaaaaguu

SEQ ID NO: 324044 - RNA, 22 nt, Homo sapiens
uuauucagcaccugcuguguuc

SEQ ID NO: 324045 - RNA, 22 nt, Homo sapiens
uuauucauuaauugcuaagguu

SEQ ID NO: 324046 - RNA, 22 nt, Homo sapiens
uuauucugucuuuggucucaau

SEQ ID NO: 324047 - RNA, 16 nt, Homo sapiens
uuauugcauucuucuc

SEQ ID NO: 324048 - RNA, 17 nt, Homo sapiens
uuauugcuauaagcuga

SEQ ID NO: 324049 - RNA, 22 nt, Homo sapiens
uuauugcuccagaggcugauuu

SEQ ID NO: 324050 - RNA, 22 nt, Homo sapiens
uucaaaggauuuagauuagcua

SEQ ID NO: 324051 - RNA, 22 nt, Homo sapiens
uucaaaguuggaggacaaacug

SEQ ID NO: 324052 - RNA, 22 nt, Homo sapiens
uucaaaucuucguuuugccaua

SEQ ID NO: 324053 - RNA, 22 nt, Homo sapiens
uucaacagugauggccuuugua

SEQ ID NO: 324054 - RNA, 22 nt, Homo sapiens
uucaagcugggcaaauaagggg

SEQ ID NO: 324055 - RNA, 22 nt, Homo sapiens
uucaaguagguaggaccacagg

SEQ ID NO: 324056 - RNA, 22 nt, Homo sapiens
uucaagucaaggaaagaggucu

SEQ ID NO: 324057 - RNA, 22 nt, Homo sapiens
uucaagucaauuuuugaaugac

SEQ ID NO: 324058 - RNA, 22 nt, Homo sapiens
uucaagucuuggcuuugccacc

SEQ ID NO: 324059 - RNA, 22 nt, Homo sapiens
uucacacuagccacucugguag

SEQ ID NO: 324060 - RNA, 22 nt, Homo sapiens
uucacagacaacuggucccuua

SEQ ID NO: 324061 - RNA, 22 nt, Homo sapiens
uucacagaguuauuuuuaugcu

SEQ ID NO: 324062 - RNA, 22 nt, Homo sapiens
uucacagucacccuucuccaug

SEQ ID NO: 324063 - RNA, 22 nt, Homo sapiens
uucacagugugaucuaugggca

SEQ ID NO: 324064 - RNA, 22 nt, Homo sapiens
uucacaguguguacaccagggg

SEQ ID NO: 324065 - RNA, 22 nt, Homo sapiens
uucacaugacagggugaagcau

SEQ ID NO: 324066 - RNA, 22 nt, Homo sapiens
uucaccggggaccccuggcugu

SEQ ID NO: 324067 - RNA, 23 nt, Homo sapiens
uucaccguguuggccaggcuggu

SEQ ID NO: 324068 - RNA, 23 nt, Homo sapiens
uucaccugguuauuaauagccuc

SEQ ID NO: 324069 - RNA, 22 nt, Homo sapiens
uucaccuguagcaugcccuugg

SEQ ID NO: 324070 - RNA, 22 nt, Homo sapiens
uucaccuugcccacagcagucu

SEQ ID NO: 324071 - RNA, 22 nt, Homo sapiens
uucacugggugugguggcucac

SEQ ID NO: 324072 - RNA, 22 nt, Homo sapiens
uucacuguagcuuggauguuua

SEQ ID NO: 324073 - RNA, 22 nt, Homo sapiens
uucacuguuaagcaguuaaacu

SEQ ID NO: 324074 - RNA, 22 nt, Homo sapiens
uucagagcauugguuuuuugaa

SEQ ID NO: 324075 - RNA, 22 nt, Homo sapiens
uucagagugguaugaagugaug

SEQ ID NO: 324076 - RNA, 22 nt, Homo sapiens
uucagaugcacacuguagucua

SEQ ID NO: 324077 - RNA, 22 nt, Homo sapiens
uucagcacaguguggaucauuc

SEQ ID NO: 324078 - RNA, 22 nt, Homo sapiens
uucagcacugaaaauaugucau

SEQ ID NO: 324079 - RNA, 22 nt, Homo sapiens
uucagcaguggccaguggaaau

SEQ ID NO: 324080 - RNA, 22 nt, Homo sapiens
uucagcuacuuggaaacagcaa

SEQ ID NO: 324081 - RNA, 22 nt, Homo sapiens
uucagggacuuuagacaagaga

SEQ ID NO: 324082 - RNA, 22 nt, Homo sapiens
uucagguaauuaugguuugucu

SEQ ID NO: 324083 - RNA, 22 nt, Homo sapiens
uucaguauugcaccuggagucc

SEQ ID NO: 324084 - RNA, 22 nt, Homo sapiens
uucagugguuauuugugagauu

SEQ ID NO: 324085 - RNA, 22 nt, Homo sapiens
uucaguucugcacugaucuuag

SEQ ID NO: 324086 - RNA, 19 nt, Homo sapiens
uucauacagugagagcagc

SEQ ID NO: 324087 - RNA, 22 nt, Homo sapiens
gaaccagcagacuuugacaggu

SEQ ID NO: 324088 - RNA, 22 nt, Homo sapiens
gaagaacuaggugagaucuaga

SEQ ID NO: 324089 - RNA, 22 nt, Homo sapiens
gaagacauuuacaugggagacc

SEQ ID NO: 324090 - RNA, 22 nt, Homo sapiens
gaagauguugcuuaccuuggag

SEQ ID NO: 324091 - RNA, 22 nt, Homo sapiens
gaagcgaggugauuagcagaca

SEQ ID NO: 324092 - RNA, 22 nt, Homo sapiens
gaagguacgcuuaggaaaugau

SEQ ID NO: 324093 - RNA, 22 nt, Homo sapiens
gaagguaguuuauagauguggu

SEQ ID NO: 324094 - RNA, 22 nt, Homo sapiens
gaagguauauucuguuaaugcu

SEQ ID NO: 324095 - RNA, 22 nt, Homo sapiens
gaaguaauaaauggauucuuaa

SEQ ID NO: 324096 - RNA, 23 nt, Homo sapiens
gaaguauagcaugcacauggaaa

SEQ ID NO: 324097 - RNA, 22 nt, Homo sapiens
gaagugcuuuuggacuaacagu

SEQ ID NO: 324098 - RNA, 19 nt, Homo sapiens
gaaguguuguccuccagua

SEQ ID NO: 324099 - RNA, 22 nt, Homo sapiens
gaauacuguccaagagugaugg

SEQ ID NO: 324100 - RNA, 22 nt, Homo sapiens
gaaucaauugaucuaugugucu

SEQ ID NO: 324101 - RNA, 22 nt, Homo sapiens
gaaucacaguuauuagagcagc

SEQ ID NO: 324102 - RNA, 22 nt, Homo sapiens
gaaugaauguuuauccuuagau

SEQ ID NO: 324103 - RNA, 22 nt, Homo sapiens
gaaugcaugaggggaucagaug

SEQ ID NO: 324104 - RNA, 22 nt, Homo sapiens
gaaugcuaagcaugugggaguu

SEQ ID NO: 324105 - RNA, 22 nt, Homo sapiens
gaaugcuaaguuuccucccugu

SEQ ID NO: 324106 - RNA, 22 nt, Homo sapiens
gaauggaacugacuauagcuga

SEQ ID NO: 324107 - RNA, 22 nt, Homo sapiens
gaaugguuuacaaguguaaucu

SEQ ID NO: 324108 - RNA, 22 nt, Homo sapiens
gaaugugcuguuggcugggcgu

SEQ ID NO: 324109 - RNA, 18 nt, Homo sapiens
gacaguguggcaauuccu

SEQ ID NO: 324110 - RNA, 22 nt, Homo sapiens
gacaguguggcgauuccucaag

SEQ ID NO: 324111 - RNA, 20 nt, Homo sapiens
gacauagagacucucaaaaa

SEQ ID NO: 324112 - RNA, 17 nt, Homo sapiens
gacauaggaaaaggaga

SEQ ID NO: 324113 - RNA, 19 nt, Homo sapiens
gacaugagauuuggugggg

SEQ ID NO: 324114 - RNA, 22 nt, Homo sapiens
gacauguaaggcucucucuguu

SEQ ID NO: 324115 - RNA, 20 nt, Homo sapiens
gacauguugguuugcugcac

SEQ ID NO: 324116 - RNA, 22 nt, Homo sapiens
gaccacagacuggaaagagggc

SEQ ID NO: 324117 - RNA, 22 nt, Homo sapiens
gacccauagaagcgagcuugug

SEQ ID NO: 324118 - RNA, 22 nt, Homo sapiens
gaccugagagguacauguauuu

SEQ ID NO: 324119 - RNA, 22 nt, Homo sapiens
gacucagucuuggauuuuuaau

SEQ ID NO: 324120 - RNA, 22 nt, Homo sapiens
gacucuguagacaaucacaucu

SEQ ID NO: 324121 - RNA, 22 nt, Homo sapiens
gacugacgaccgcucuaccugc

SEQ ID NO: 324122 - RNA, 22 nt, Homo sapiens
gacugcauuugccccaucgaau

SEQ ID NO: 324123 - RNA, 22 nt, Homo sapiens
gacuggagcuguaugugguuac

SEQ ID NO: 324124 - RNA, 22 nt, Homo sapiens
gacuggcuguuuucuuuauuau

SEQ ID NO: 324125 - RNA, 16 nt, Homo sapiens
gacugggcugaggaau

SEQ ID NO: 324126 - RNA, 22 nt, Homo sapiens
gacuugaagaaucuaagggagg

SEQ ID NO: 324127 - RNA, 18 nt, Homo sapiens
gacuuggaguuuacagug

SEQ ID NO: 324128 - RNA, 22 nt, Homo sapiens
gagaacaguguuguauuuuuuc

SEQ ID NO: 324129 - RNA, 22 nt, Homo sapiens
gagaaccauuuggagaaaaagu

SEQ ID NO: 324130 - RNA, 22 nt, Homo sapiens
gagaacugagauaagugauauu

SEQ ID NO: 324131 - RNA, 22 nt, Homo sapiens
gagaagugcgucguuugaugau

SEQ ID NO: 324132 - RNA, 21 nt, Homo sapiens
gagaaucaucauggcugcaua

SEQ ID NO: 324133 - RNA, 22 nt, Homo sapiens
gagacagugucagccauugaaa

SEQ ID NO: 324134 - RNA, 22 nt, Homo sapiens
gagacauguuugccaauaauuu

SEQ ID NO: 324135 - RNA, 22 nt, Homo sapiens
gagacucuuagauuggaaaucu

SEQ ID NO: 324136 - RNA, 22 nt, Homo sapiens
gagacugagucuugcuuuguca

SEQ ID NO: 324137 - RNA, 22 nt, Homo sapiens
gagaggucguauaugauuucug

SEQ ID NO: 324138 - RNA, 22 nt, Homo sapiens
gagauaaauaggucacaguucu

SEQ ID NO: 324139 - RNA, 22 nt, Homo sapiens
gagauacacccagugcagaggc

SEQ ID NO: 324140 - RNA, 22 nt, Homo sapiens
gagauacuugguuucuguuucu

SEQ ID NO: 324141 - RNA, 22 nt, Homo sapiens
gagauagguauuucauuuaccc

SEQ ID NO: 324142 - RNA, 22 nt, Homo sapiens
gagauauguuggcagcugguau

SEQ ID NO: 324143 - RNA, 22 nt, Homo sapiens
gagauauucugguuuacuaaau

SEQ ID NO: 324144 - RNA, 22 nt, Homo sapiens
gagaucaguuaaugaagugagc

SEQ ID NO: 324145 - RNA, 22 nt, Homo sapiens
gagaugaaaucuugcucuguca

SEQ ID NO: 324146 - RNA, 22 nt, Homo sapiens
gagaugauuugccccauguauu

SEQ ID NO: 324147 - RNA, 22 nt, Homo sapiens
gagauggagacuuggccuuaaa

SEQ ID NO: 324148 - RNA, 22 nt, Homo sapiens
gagaugguguuccacugccagu

SEQ ID NO: 324149 - RNA, 22 nt, Homo sapiens
gagaugugugugauuauauaau

SEQ ID NO: 324150 - RNA, 20 nt, Homo sapiens
gagauguugaucagggcuau

SEQ ID NO: 324151 - RNA, 22 nt, Homo sapiens
gagauuaacauuugaggagcug

SEQ ID NO: 324152 - RNA, 22 nt, Homo sapiens
gagauuaauacacaucaaaugc

SEQ ID NO: 324153 - RNA, 22 nt, Homo sapiens
gagauucaucuagguccagaga

SEQ ID NO: 324154 - RNA, 22 nt, Homo sapiens
gagauucuucaauauuuauucu

SEQ ID NO: 324155 - RNA, 22 nt, Homo sapiens
gagauugucaugauuacauugu

SEQ ID NO: 324156 - RNA, 22 nt, Homo sapiens
gagcaaugagcugccugcugag

SEQ ID NO: 324157 - RNA, 22 nt, Homo sapiens
gagcacccuuuguugauugcaa

SEQ ID NO: 324158 - RNA, 22 nt, Homo sapiens
gagcagacaugaggaccgcugg

SEQ ID NO: 324159 - RNA, 22 nt, Homo sapiens
gagcaucaauggcaugugggaa

SEQ ID NO: 324160 - RNA, 22 nt, Homo sapiens
gagcaucaguggccucaucuca

SEQ ID NO: 324161 - RNA, 22 nt, Homo sapiens
gagcaucauggggccaaagcgc

SEQ ID NO: 324162 - RNA, 22 nt, Homo sapiens
gagcaucauucaacaaaagucu

SEQ ID NO: 324163 - RNA, 22 nt, Homo sapiens
gagcuagaauauuuuguauagu

SEQ ID NO: 324164 - RNA, 22 nt, Homo sapiens
gagcugaaguuuccauuuguac

SEQ ID NO: 324165 - RNA, 20 nt, Homo sapiens
gagcugguguacugccgggc

SEQ ID NO: 324166 - RNA, 22 nt, Homo sapiens
gagcuuguagugugaaugguau

SEQ ID NO: 324167 - RNA, 22 nt, Homo sapiens
gagcuuguggucuucguguuau

SEQ ID NO: 324168 - RNA, 22 nt, Homo sapiens
gaggcaaguggccaccgagucu

SEQ ID NO: 324169 - RNA, 22 nt, Homo sapiens
gaggcagucugacccuuagcag

SEQ ID NO: 324170 - RNA, 22 nt, Homo sapiens
gaggcauugaaauauugcuuau

SEQ ID NO: 324171 - RNA, 22 nt, Homo sapiens
gaggcauugaagauauggaagu

SEQ ID NO: 324172 - RNA, 22 nt, Homo sapiens
gagguaagagaauaaacaguuu

SEQ ID NO: 324173 - RNA, 22 nt, Homo sapiens
gagguaaguaagaauggcaagc

SEQ ID NO: 324174 - RNA, 22 nt, Homo sapiens
gagguagagacuauguauuaga

SEQ ID NO: 324175 - RNA, 22 nt, Homo sapiens
gagguagguacaauugccacca

SEQ ID NO: 324176 - RNA, 22 nt, Homo sapiens
gagguagguuugguuacaaaag

SEQ ID NO: 324177 - RNA, 22 nt, Homo sapiens
gagguaugauugacauauaaaa

SEQ ID NO: 324178 - RNA, 22 nt, Homo sapiens
gagguauggauaucuggagagg

SEQ ID NO: 324179 - RNA, 22 nt, Homo sapiens
gagguaugugggcagacauuua

SEQ ID NO: 324180 - RNA, 22 nt, Homo sapiens
ucuggccccucccaaaucucau

SEQ ID NO: 324181 - RNA, 16 nt, Homo sapiens
ucuggcucuacaguuc

SEQ ID NO: 324182 - RNA, 22 nt, Homo sapiens
ucuggcuugugaacugucuucu

SEQ ID NO: 324183 - RNA, 22 nt, Homo sapiens
ucuggcuuugugaguugccaga

SEQ ID NO: 324184 - RNA, 20 nt, Homo sapiens
ucuggguuuuggccacgccc

SEQ ID NO: 324185 - RNA, 22 nt, Homo sapiens
ucuggugugcucuggacuugca

SEQ ID NO: 324186 - RNA, 22 nt, Homo sapiens
ucuguaacauccaccuucuggg

SEQ ID NO: 324187 - RNA, 22 nt, Homo sapiens
ucuguacuccuugaguagugcu

SEQ ID NO: 324188 - RNA, 22 nt, Homo sapiens
ucuguacuuccguaccuaaagu

SEQ ID NO: 324189 - RNA, 22 nt, Homo sapiens
ucuguaguuaacagcuucagcu

SEQ ID NO: 324190 - RNA, 22 nt, Homo sapiens
ucugugaaaucauuuccuguaa

SEQ ID NO: 324191 - RNA, 22 nt, Homo sapiens
ucugugcauuacacuuuucuca

SEQ ID NO: 324192 - RNA, 22 nt, Homo sapiens
ucugugcauuguaggauguuua

SEQ ID NO: 324193 - RNA, 22 nt, Homo sapiens
ucugugguucaggcuggagugc

SEQ ID NO: 324194 - RNA, 22 nt, Homo sapiens
ucuugcacaaauuauuuuaacu

SEQ ID NO: 324195 - RNA, 22 nt, Homo sapiens
ucuugcauuuuuaaauagugcu

SEQ ID NO: 324196 - RNA, 22 nt, Homo sapiens
ucuugcuuuugcagagcuucuc

SEQ ID NO: 324197 - RNA, 20 nt, Homo sapiens
ucuugggaauguagccuagg

SEQ ID NO: 324198 - RNA, 22 nt, Homo sapiens
ucuugggugaguuugugaauaa

SEQ ID NO: 324199 - RNA, 21 nt, Homo sapiens
ucuuggguugaauucucccag

SEQ ID NO: 324200 - RNA, 22 nt, Homo sapiens
ucuuggguuguuggcuucuccu

SEQ ID NO: 324201 - RNA, 22 nt, Homo sapiens
ucuuggguuugccuugcugcug

SEQ ID NO: 324202 - RNA, 22 nt, Homo sapiens
ucuugguugaaaauucauaaua

SEQ ID NO: 324203 - RNA, 22 nt, Homo sapiens
ucuuuagugacaguugugcaag

SEQ ID NO: 324204 - RNA, 19 nt, Homo sapiens
ucuuugaggcaucgcccuc

SEQ ID NO: 324205 - RNA, 22 nt, Homo sapiens
ucuuugaguggagcgaggcaga

SEQ ID NO: 324206 - RNA, 22 nt, Homo sapiens
ucuuugauaagauccagaagaa

SEQ ID NO: 324207 - RNA, 22 nt, Homo sapiens
ucuuugauuaugcagauggguu

SEQ ID NO: 324208 - RNA, 22 nt, Homo sapiens
ucuuugauuuuguuacuaagac

SEQ ID NO: 324209 - RNA, 18 nt, Homo sapiens
ucuuuggcugaacuguag

SEQ ID NO: 324210 - RNA, 22 nt, Homo sapiens
ucuuugggauauucugaaaggg

SEQ ID NO: 324211 - RNA, 22 nt, Homo sapiens
ucuuugguaauggaugucugau

SEQ ID NO: 324212 - RNA, 19 nt, Homo sapiens
ucuuugguacgugcuuuga

SEQ ID NO: 324213 - RNA, 21 nt, Homo sapiens
ucuuuggucaccaguuuucau

SEQ ID NO: 324214 - RNA, 22 nt, Homo sapiens
ucuuuggucagaaagauuacac

SEQ ID NO: 324215 - RNA, 22 nt, Homo sapiens
ucuuuggucaucaugggaagca

SEQ ID NO: 324216 - RNA, 22 nt, Homo sapiens
ucuuuggucuacuuucauaugu

SEQ ID NO: 324217 - RNA, 22 nt, Homo sapiens
ucuuuggugaauggucauccag

SEQ ID NO: 324218 - RNA, 22 nt, Homo sapiens
ucuuuguucaggagccaacucc

SEQ ID NO: 324219 - RNA, 22 nt, Homo sapiens
ucuuuguugcauaggcuuguuc

SEQ ID NO: 324220 - RNA, 22 nt, Homo sapiens
ucuuuguuuucugauccugaag

SEQ ID NO: 324221 - RNA, 22 nt, Homo sapiens
ucuuuuguaaaaugaggaggug

SEQ ID NO: 324222 - RNA, 22 nt, Homo sapiens
ugaaacacacauugcccuuuau

SEQ ID NO: 324223 - RNA, 22 nt, Homo sapiens
ugaaacacaccuccucuccauc

SEQ ID NO: 324224 - RNA, 20 nt, Homo sapiens
ugaaacacauggacuggggu

SEQ ID NO: 324225 - RNA, 22 nt, Homo sapiens
ugaaagacugaagaauaggcau

SEQ ID NO: 324226 - RNA, 22 nt, Homo sapiens
ugaaagcuacaggaaaguauuu

SEQ ID NO: 324227 - RNA, 22 nt, Homo sapiens
ugaaagcuacagucuccuagga

SEQ ID NO: 324228 - RNA, 22 nt, Homo sapiens
ugaaaucuaaaauguuccaaga

SEQ ID NO: 324229 - RNA, 20 nt, Homo sapiens
ugaaaucuucacuaagucuc

SEQ ID NO: 324230 - RNA, 22 nt, Homo sapiens
ugaaaugaucaguuugguuacu

SEQ ID NO: 324231 - RNA, 22 nt, Homo sapiens
ugaaaugcuaauucguagcuaa

SEQ ID NO: 324232 - RNA, 22 nt, Homo sapiens
ugaaaugucuuuaggaggcuuc

SEQ ID NO: 324233 - RNA, 22 nt, Homo sapiens
ugaaauguugggugauggaauc

SEQ ID NO: 324234 - RNA, 22 nt, Homo sapiens
ugaaauuguuugcaaggauagg

SEQ ID NO: 324235 - RNA, 22 nt, Homo sapiens
ugaacacuggauaaggagucag

SEQ ID NO: 324236 - RNA, 22 nt, Homo sapiens
ugaacagagaaacacuggccau

SEQ ID NO: 324237 - RNA, 16 nt, Homo sapiens
ugaacagagaggauuc

SEQ ID NO: 324238 - RNA, 22 nt, Homo sapiens
ugaacagcacguuuauucagaa

SEQ ID NO: 324239 - RNA, 22 nt, Homo sapiens
ugaacagucaucucucuuguau

SEQ ID NO: 324240 - RNA, 22 nt, Homo sapiens
ugaacugagacuagacuuguuc

SEQ ID NO: 324241 - RNA, 20 nt, Homo sapiens
ugaacugguuacuuucuguc

SEQ ID NO: 324242 - RNA, 22 nt, Homo sapiens
ugaacuguaagguauaggugau

SEQ ID NO: 324243 - RNA, 22 nt, Homo sapiens
ugaagacucaauuauuaugaac

SEQ ID NO: 324244 - RNA, 20 nt, Homo sapiens
ugaaggaggucauuuauacc

SEQ ID NO: 324245 - RNA, 22 nt, Homo sapiens
ugaaggcaggagggagaaaagu

SEQ ID NO: 324246 - RNA, 19 nt, Homo sapiens
ugaaguauagggcuucuga

SEQ ID NO: 324247 - RNA, 22 nt, Homo sapiens
ugaagugaagacucacagaagg

SEQ ID NO: 324248 - RNA, 22 nt, Homo sapiens
ugaagugaagcaguaguguggg

SEQ ID NO: 324249 - RNA, 22 nt, Homo sapiens
ugaagugcugugggccaggcgu

SEQ ID NO: 324250 - RNA, 22 nt, Homo sapiens
ugaaguguuuuuucaggcaugu

SEQ ID NO: 324251 - RNA, 22 nt, Homo sapiens
ugaauauguuaauuagcaucau

SEQ ID NO: 324252 - RNA, 22 nt, Homo sapiens
ugaaucauuucuugucuucagu

SEQ ID NO: 324253 - RNA, 22 nt, Homo sapiens
ugaaugauuuuaaaagccucuc

SEQ ID NO: 324254 - RNA, 22 nt, Homo sapiens
ugaaugcauggggccaagaagg

SEQ ID NO: 324255 - RNA, 22 nt, Homo sapiens
ugaaugcuaaaggaaaacagua

SEQ ID NO: 324256 - RNA, 21 nt, Homo sapiens
ugaaugcuuuaaauauuagaa

SEQ ID NO: 324257 - RNA, 22 nt, Homo sapiens
ugaaugugauggguuucaugug

SEQ ID NO: 324258 - RNA, 22 nt, Homo sapiens
ugaauguuguugguugagauau

SEQ ID NO: 324259 - RNA, 22 nt, Homo sapiens
ugaauguuugcagcuuauacca

SEQ ID NO: 324260 - RNA, 22 nt, Homo sapiens
ugaauguuugcuuacuuccaua

SEQ ID NO: 324261 - RNA, 22 nt, Homo sapiens
ugaauugucucucacuggguuc

SEQ ID NO: 324262 - RNA, 22 nt, Homo sapiens
ugaauuguuuacgagaugugag

SEQ ID NO: 324263 - RNA, 22 nt, Homo sapiens
ugacaacugauuaacuccuuua

SEQ ID NO: 324264 - RNA, 22 nt, Homo sapiens
ugacaagcucccucugcaccuu

SEQ ID NO: 324265 - RNA, 20 nt, Homo sapiens
ugacaagugagaauuauggg

SEQ ID NO: 324266 - RNA, 22 nt, Homo sapiens
ugacacauguagacaucuggug

SEQ ID NO: 324267 - RNA, 18 nt, Homo sapiens
ugacagcacaugugggga

SEQ ID NO: 324268 - RNA, 22 nt, Homo sapiens
ugacagcuguugaggcauuuau

SEQ ID NO: 324269 - RNA, 22 nt, Homo sapiens
ugacaggagauuaugugauguu

SEQ ID NO: 324270 - RNA, 22 nt, Homo sapiens
ugacagucaccaggacccacag

SEQ ID NO: 324271 - RNA, 23 nt, Homo sapiens
ugacagugcuugaaauugcucuu

SEQ ID NO: 324272 - RNA, 22 nt, Homo sapiens
ugacaguguccuccuccugaga

SEQ ID NO: 324273 - RNA, 22 nt, Homo sapiens
gaguaaaugucacuguugcugu

SEQ ID NO: 324274 - RNA, 22 nt, Homo sapiens
gaguaacauugacaacuucaug

SEQ ID NO: 324275 - RNA, 22 nt, Homo sapiens
gaguagaacugguuaucuaaua

SEQ ID NO: 324276 - RNA, 22 nt, Homo sapiens
gaguagugcugcaguaaacaua

SEQ ID NO: 324277 - RNA, 22 nt, Homo sapiens
gaguagugcuguaauaaacaua

SEQ ID NO: 324278 - RNA, 22 nt, Homo sapiens
gaguauguauaugagugugucu

SEQ ID NO: 324279 - RNA, 22 nt, Homo sapiens
gagucagugucuugcucuguca

SEQ ID NO: 324280 - RNA, 22 nt, Homo sapiens
gagugcaauggcaugaucuggg

SEQ ID NO: 324281 - RNA, 22 nt, Homo sapiens
gagugcaauggcgcgaucuggg

SEQ ID NO: 324282 - RNA, 22 nt, Homo sapiens
gagugcaauggugccaucucgg

SEQ ID NO: 324283 - RNA, 22 nt, Homo sapiens
gagugcaauggugcuaucucgg

SEQ ID NO: 324284 - RNA, 22 nt, Homo sapiens
gagugcauugguggucaggugu

SEQ ID NO: 324285 - RNA, 22 nt, Homo sapiens
gaguucaaaucucagcucuguu

SEQ ID NO: 324286 - RNA, 22 nt, Homo sapiens
gaguucauaucuaugagugugc

SEQ ID NO: 324287 - RNA, 22 nt, Homo sapiens
gaguuccuuugagccugagagg

SEQ ID NO: 324288 - RNA, 19 nt, Homo sapiens
gaguugggguuuacuguaa

SEQ ID NO: 324289 - RNA, 22 nt, Homo sapiens
gauaaagauagcaauagggaca

SEQ ID NO: 324290 - RNA, 22 nt, Homo sapiens
gauacuguauccuaaaagcuuu

SEQ ID NO: 324291 - RNA, 21 nt, Homo sapiens
gauaucuuuauucccaagagc

SEQ ID NO: 324292 - RNA, 22 nt, Homo sapiens
gauaucuuuuguauggugagcu

SEQ ID NO: 324293 - RNA, 22 nt, Homo sapiens
gauaugaguagucgcauugaug

SEQ ID NO: 324294 - RNA, 22 nt, Homo sapiens
gauauguaguaguugaaaaaga

SEQ ID NO: 324295 - RNA, 22 nt, Homo sapiens
gauaugucuauuagcuugauug

SEQ ID NO: 324296 - RNA, 22 nt, Homo sapiens
gaucacaguuccucacgggcau

SEQ ID NO: 324297 - RNA, 22 nt, Homo sapiens
gaucacauggccauuucuagcu

SEQ ID NO: 324298 - RNA, 22 nt, Homo sapiens
gaucacuuugaugccaggaacu

SEQ ID NO: 324299 - RNA, 22 nt, Homo sapiens
gaucccauuggcugccaugugg

SEQ ID NO: 324300 - RNA, 22 nt, Homo sapiens
gaucuggagguuuuccucauga

SEQ ID NO: 324301 - RNA, 19 nt, Homo sapiens
gaucuguugaucaaugugu

SEQ ID NO: 324302 - RNA, 22 nt, Homo sapiens
gaugacagcugacucccuugcu

SEQ ID NO: 324303 - RNA, 22 nt, Homo sapiens
gaugacagugaguaaccccaac

SEQ ID NO: 324304 - RNA, 22 nt, Homo sapiens
gaugagaucauaaguguggagc

SEQ ID NO: 324305 - RNA, 22 nt, Homo sapiens
gaugccuuuuuguccucaguua

SEQ ID NO: 324306 - RNA, 22 nt, Homo sapiens
gauggcagugcagccccuggcu

SEQ ID NO: 324307 - RNA, 22 nt, Homo sapiens
gauggcauuucuggaucugaca

SEQ ID NO: 324308 - RNA, 22 nt, Homo sapiens
gaugguuuuuuaagaagagccu

SEQ ID NO: 324309 - RNA, 22 nt, Homo sapiens
gauuauagaaguaauggguuua

SEQ ID NO: 324310 - RNA, 22 nt, Homo sapiens
gauuccacuuucaaauucaaau

SEQ ID NO: 324311 - RNA, 22 nt, Homo sapiens
gauuuguauuaaaagugugacg

SEQ ID NO: 324312 - RNA, 22 nt, Homo sapiens
gauuuguuggccugugagcuag

SEQ ID NO: 324313 - RNA, 22 nt, Homo sapiens
gauuuugguuagggaaggauac

SEQ ID NO: 324314 - RNA, 22 nt, Homo sapiens
gauuuuuggggaagccucuuau

SEQ ID NO: 324315 - RNA, 22 nt, Homo sapiens
gcaaaguguuuuuaggaagucu

SEQ ID NO: 324316 - RNA, 20 nt, Homo sapiens
gcaacauggccagagugaau

SEQ ID NO: 324317 - RNA, 22 nt, Homo sapiens
gcaagaauggaacaggagagcc

SEQ ID NO: 324318 - RNA, 22 nt, Homo sapiens
gcaagacaugucuaagguuuaa

SEQ ID NO: 324319 - RNA, 22 nt, Homo sapiens
gcaaggaugagugcccaugaga

SEQ ID NO: 324320 - RNA, 21 nt, Homo sapiens
gcaaguacuaucaucauuauc

SEQ ID NO: 324321 - RNA, 22 nt, Homo sapiens
gcacacguagaagcaugcauca

SEQ ID NO: 324322 - RNA, 22 nt, Homo sapiens
gcacacuuacacgaaccuagau

SEQ ID NO: 324323 - RNA, 22 nt, Homo sapiens
gcacagaugaggagaggucuca

SEQ ID NO: 324324 - RNA, 22 nt, Homo sapiens
gcacaggguuacauucuaaggu

SEQ ID NO: 324325 - RNA, 22 nt, Homo sapiens
gcacauggccccaucgugccga

SEQ ID NO: 324326 - RNA, 22 nt, Homo sapiens
gcaccaugguagaauaauggua

SEQ ID NO: 324327 - RNA, 22 nt, Homo sapiens
gcaccauugacaagaaauaggu

SEQ ID NO: 324328 - RNA, 19 nt, Homo sapiens
gcagagaugugguagcuug

SEQ ID NO: 324329 - RNA, 23 nt, Homo sapiens
gcagcaaugucacagggguccgg

SEQ ID NO: 324330 - RNA, 20 nt, Homo sapiens
gcagcaccauauuucuaaga

SEQ ID NO: 324331 - RNA, 22 nt, Homo sapiens
gcaggcaugacauuucacucuu

SEQ ID NO: 324332 - RNA, 17 nt, Homo sapiens
gcaguacuuaguaagga

SEQ ID NO: 324333 - RNA, 22 nt, Homo sapiens
gcagucacagggagauggugac

SEQ ID NO: 324334 - RNA, 22 nt, Homo sapiens
gcagugacaugugccaguuuau

SEQ ID NO: 324335 - RNA, 16 nt, Homo sapiens
gcaguguguuuaauag

SEQ ID NO: 324336 - RNA, 22 nt, Homo sapiens
gcaguguucaaaucaugcccau

SEQ ID NO: 324337 - RNA, 20 nt, Homo sapiens
gcaguguucacuguauuccu

SEQ ID NO: 324338 - RNA, 22 nt, Homo sapiens
gcaguguucugggcaggaagaa

SEQ ID NO: 324339 - RNA, 22 nt, Homo sapiens
gcaucacagcuccugugcuggc

SEQ ID NO: 324340 - RNA, 22 nt, Homo sapiens
gcaugauuuuauaucuauguaa

SEQ ID NO: 324341 - RNA, 22 nt, Homo sapiens
gcauggaaggcgcuuugugacu

SEQ ID NO: 324342 - RNA, 22 nt, Homo sapiens
gcauggagaaggggacugauuc

SEQ ID NO: 324343 - RNA, 22 nt, Homo sapiens
gcauggaguggaaauucuuggg

SEQ ID NO: 324344 - RNA, 22 nt, Homo sapiens
gcaugguaguaaccuacauuug

SEQ ID NO: 324345 - RNA, 22 nt, Homo sapiens
gccaagaagugucuaagcagga

SEQ ID NO: 324346 - RNA, 22 nt, Homo sapiens
gccaagauugguuuaauauucc

SEQ ID NO: 324347 - RNA, 22 nt, Homo sapiens
gccaagauuuaauucaucaguu

SEQ ID NO: 324348 - RNA, 22 nt, Homo sapiens
gccauugcacuccagccucggg

SEQ ID NO: 324349 - RNA, 22 nt, Homo sapiens
gccauugcacuccagccugagc

SEQ ID NO: 324350 - RNA, 22 nt, Homo sapiens
gccauugcacuccgcccugggc

SEQ ID NO: 324351 - RNA, 22 nt, Homo sapiens
gcccaguagcaguacaucccuu

SEQ ID NO: 324352 - RNA, 22 nt, Homo sapiens
gcccugauacauucuucugccu

SEQ ID NO: 324353 - RNA, 22 nt, Homo sapiens
gccuagggacaaaccguccgac

SEQ ID NO: 324354 - RNA, 22 nt, Homo sapiens
gcuaaaugcaugaggcgaugug

SEQ ID NO: 324355 - RNA, 22 nt, Homo sapiens
gcuaggagaucugcugcucucu

SEQ ID NO: 324356 - RNA, 22 nt, Homo sapiens
gcucaguuuccucagcugcaaa

SEQ ID NO: 324357 - RNA, 22 nt, Homo sapiens
gcugacacugggcuauagaucu

SEQ ID NO: 324358 - RNA, 17 nt, Homo sapiens
gcugauguuugcauuuu

SEQ ID NO: 324359 - RNA, 22 nt, Homo sapiens
gcugcacuuuaaggcauccccu

SEQ ID NO: 324360 - RNA, 22 nt, Homo sapiens
gcugcguguagaguucucacug

SEQ ID NO: 324361 - RNA, 22 nt, Homo sapiens
gcugcuguaccagaugugguua

SEQ ID NO: 324362 - RNA, 22 nt, Homo sapiens
gcuggcuuucuccugaucucag

SEQ ID NO: 324363 - RNA, 22 nt, Homo sapiens
gcuggucugccguaguaggugc

SEQ ID NO: 324364 - RNA, 22 nt, Homo sapiens
gcugucuggagucuguucaaug

SEQ ID NO: 324365 - RNA, 22 nt, Homo sapiens
uucauaguuuauacugauauuu

SEQ ID NO: 324366 - RNA, 22 nt, Homo sapiens
uucaucacagucuccgaugccc

SEQ ID NO: 324367 - RNA, 22 nt, Homo sapiens
uucaucaguugagcugguugcu

SEQ ID NO: 324368 - RNA, 22 nt, Homo sapiens
uucauggaguugagaaggcuaa

SEQ ID NO: 324369 - RNA, 22 nt, Homo sapiens
uucauguaauauauuucaggcc

SEQ ID NO: 324370 - RNA, 22 nt, Homo sapiens
uucaugugagucuguauuaacu

SEQ ID NO: 324371 - RNA, 22 nt, Homo sapiens
uuccacaauggcugaacuaguu

SEQ ID NO: 324372 - RNA, 22 nt, Homo sapiens
uuccacaaugguugaacuaguu

SEQ ID NO: 324373 - RNA, 22 nt, Homo sapiens
uuccacaggguugaacuaguuu

SEQ ID NO: 324374 - RNA, 22 nt, Homo sapiens
uuccagaugggaguucuauucu

SEQ ID NO: 324375 - RNA, 22 nt, Homo sapiens
uuccaguaauagcacagcauug

SEQ ID NO: 324376 - RNA, 22 nt, Homo sapiens
uuccaguguuugacucaccuuu

SEQ ID NO: 324377 - RNA, 22 nt, Homo sapiens
uuccaguuauuauaccucuuaa

SEQ ID NO: 324378 - RNA, 22 nt, Homo sapiens
uuccauagucauagugcugaug

SEQ ID NO: 324379 - RNA, 22 nt, Homo sapiens
uuccaugugggcuugucaagua

SEQ ID NO: 324380 - RNA, 22 nt, Homo sapiens
uuccauuuguucggugucgcca

SEQ ID NO: 324381 - RNA, 22 nt, Homo sapiens
uucccagagccugggagugagg

SEQ ID NO: 324382 - RNA, 22 nt, Homo sapiens
uucccagugccaggcacuggga

SEQ ID NO: 324383 - RNA, 22 nt, Homo sapiens
uucccagugguuagcucugguc

SEQ ID NO: 324384 - RNA, 22 nt, Homo sapiens
uucccucagaaacacacagccc

SEQ ID NO: 324385 - RNA, 22 nt, Homo sapiens
uucccugaaauauucacuuuca

SEQ ID NO: 324386 - RNA, 22 nt, Homo sapiens
uucccugaguaucuuaccaugg

SEQ ID NO: 324387 - RNA, 22 nt, Homo sapiens
uucccugugggaguaggaaagu

SEQ ID NO: 324388 - RNA, 23 nt, Homo sapiens
uucccuuagaagaaggggagaaa

SEQ ID NO: 324389 - RNA, 22 nt, Homo sapiens
uucccuuucugccuugaaucuu

SEQ ID NO: 324390 - RNA, 22 nt, Homo sapiens
uucccuuugaaacuaaacuugc

SEQ ID NO: 324391 - RNA, 22 nt, Homo sapiens
uucccuuugugcauaggauuug

SEQ ID NO: 324392 - RNA, 22 nt, Homo sapiens
uucccuuuguuaaauuggaaga

SEQ ID NO: 324393 - RNA, 22 nt, Homo sapiens
uuccugagccuuguaucuagua

SEQ ID NO: 324394 - RNA, 22 nt, Homo sapiens
uuccugugacuguguggcaccc

SEQ ID NO: 324395 - RNA, 22 nt, Homo sapiens
uuccuucaugcuugaaggguau

SEQ ID NO: 324396 - RNA, 22 nt, Homo sapiens
uucgcagcucaguucaacuagg

SEQ ID NO: 324397 - RNA, 22 nt, Homo sapiens
uucuacaugggucgucggugag

SEQ ID NO: 324398 - RNA, 21 nt, Homo sapiens
uucuacuccggcguuguuuuu

SEQ ID NO: 324399 - RNA, 22 nt, Homo sapiens
uucuagcaauggcagagugucu

SEQ ID NO: 324400 - RNA, 22 nt, Homo sapiens
uucuaugguuuuuaugguguua

SEQ ID NO: 324401 - RNA, 22 nt, Homo sapiens
uucucaauggaugugggaccag

SEQ ID NO: 324402 - RNA, 22 nt, Homo sapiens
uucucaauggcaacuuguugcu

SEQ ID NO: 324403 - RNA, 22 nt, Homo sapiens
uucucaguaauuccagauuuuu

SEQ ID NO: 324404 - RNA, 19 nt, Homo sapiens
uucucugguuguacuaccc

SEQ ID NO: 324405 - RNA, 22 nt, Homo sapiens
uucugacuggugugagauggua

SEQ ID NO: 324406 - RNA, 22 nt, Homo sapiens
uucuggaaaucagcagagggug

SEQ ID NO: 324407 - RNA, 22 nt, Homo sapiens
uucuggccuccauuuuucuccu

SEQ ID NO: 324408 - RNA, 22 nt, Homo sapiens
uucuggcuuauaaacgugacuu

SEQ ID NO: 324409 - RNA, 22 nt, Homo sapiens
uucugguuaauacuugcaaaaa

SEQ ID NO: 324410 - RNA, 22 nt, Homo sapiens
uucugugguugaaaggagagau

SEQ ID NO: 324411 - RNA, 22 nt, Homo sapiens
uucugugguuucauuuaccugu

SEQ ID NO: 324412 - RNA, 22 nt, Homo sapiens
uucuguguuuaggucacggcua

SEQ ID NO: 324413 - RNA, 22 nt, Homo sapiens
uucuuagucauguaauagucca

SEQ ID NO: 324414 - RNA, 22 nt, Homo sapiens
uucuucaggcauucccagaagc

SEQ ID NO: 324415 - RNA, 22 nt, Homo sapiens
uucuucaguuacaacaaggggg

SEQ ID NO: 324416 - RNA, 22 nt, Homo sapiens
uucuucugguuaugaaauuuga

SEQ ID NO: 324417 - RNA, 20 nt, Homo sapiens
uucuugaguuaacaaguuac

SEQ ID NO: 324418 - RNA, 22 nt, Homo sapiens
uucuugcacugaucccauaagc

SEQ ID NO: 324419 - RNA, 18 nt, Homo sapiens
uucuuguguugauauuuu

SEQ ID NO: 324420 - RNA, 21 nt, Homo sapiens
uucuuugcucaguguuagagu

SEQ ID NO: 324421 - RNA, 22 nt, Homo sapiens
uucuuuggauaaaguuuuaugc

SEQ ID NO: 324422 - RNA, 19 nt, Homo sapiens
uucuuuguugugggggcug

SEQ ID NO: 324423 - RNA, 22 nt, Homo sapiens
uugaaagaugaacuggauugga

SEQ ID NO: 324424 - RNA, 22 nt, Homo sapiens
uugaaagcuaucucaaaucgcu

SEQ ID NO: 324425 - RNA, 22 nt, Homo sapiens
uugaaaguguucacaaugguau

SEQ ID NO: 324426 - RNA, 22 nt, Homo sapiens
uugaacugguaguuggaaaucu

SEQ ID NO: 324427 - RNA, 22 nt, Homo sapiens
uugaagacuauaugauucuuca

SEQ ID NO: 324428 - RNA, 22 nt, Homo sapiens
uugaagagaaccgcggcuuauu

SEQ ID NO: 324429 - RNA, 22 nt, Homo sapiens
uugaaggaggugcucacucucg

SEQ ID NO: 324430 - RNA, 22 nt, Homo sapiens
uugaagguaauugguuuuauga

SEQ ID NO: 324431 - RNA, 22 nt, Homo sapiens
uugaagguagaaguucucaauu

SEQ ID NO: 324432 - RNA, 22 nt, Homo sapiens
uugaauggaauguuggaacuau

SEQ ID NO: 324433 - RNA, 22 nt, Homo sapiens
uugaauguacuuguucucacua

SEQ ID NO: 324434 - RNA, 22 nt, Homo sapiens
uugacacuaauuauuauaggug

SEQ ID NO: 324435 - RNA, 22 nt, Homo sapiens
uugacaggaugcucagggccca

SEQ ID NO: 324436 - RNA, 20 nt, Homo sapiens
uugacaguggguuguuaaag

SEQ ID NO: 324437 - RNA, 22 nt, Homo sapiens
uugacauaguuucugaaauaga

SEQ ID NO: 324438 - RNA, 22 nt, Homo sapiens
uugaccaaagaagagucauugc

SEQ ID NO: 324439 - RNA, 22 nt, Homo sapiens
uugaccucaucacuucccaaag

SEQ ID NO: 324440 - RNA, 22 nt, Homo sapiens
uugagaaucuuucgaauguucu

SEQ ID NO: 324441 - RNA, 21 nt, Homo sapiens
uugagacggagucucacucug

SEQ ID NO: 324442 - RNA, 22 nt, Homo sapiens
uugagacggagucuugcucuuu

SEQ ID NO: 324443 - RNA, 22 nt, Homo sapiens
uugagacugaacauuuguguac

SEQ ID NO: 324444 - RNA, 22 nt, Homo sapiens
uugagagaaaaaauuuauuggu

SEQ ID NO: 324445 - RNA, 22 nt, Homo sapiens
uugagauaggaacucacuaugc

SEQ ID NO: 324446 - RNA, 22 nt, Homo sapiens
uugagauagggucuaccucugu

SEQ ID NO: 324447 - RNA, 22 nt, Homo sapiens
uugagauaucuuggccuuugca

SEQ ID NO: 324448 - RNA, 22 nt, Homo sapiens
uugagauggaaucucgcuuugu

SEQ ID NO: 324449 - RNA, 22 nt, Homo sapiens
uugagauggagcuucacucuug

SEQ ID NO: 324450 - RNA, 22 nt, Homo sapiens
uugagauggagucucacucuug

SEQ ID NO: 324451 - RNA, 22 nt, Homo sapiens
uugagauggagucucgcucuuu

SEQ ID NO: 324452 - RNA, 22 nt, Homo sapiens
uugagauggagucuugcgcugu

SEQ ID NO: 324453 - RNA, 22 nt, Homo sapiens
uugagauggagucuugcucuug

SEQ ID NO: 324454 - RNA, 22 nt, Homo sapiens
uugagauggaguuucacucucg

SEQ ID NO: 324455 - RNA, 22 nt, Homo sapiens
uugagauggaguuucacucuug

SEQ ID NO: 324456 - RNA, 22 nt, Homo sapiens
uugagauggaguuucgcucuuu

SEQ ID NO: 324457 - RNA, 22 nt, Homo sapiens
uggcaagauuguuccgguuugg

SEQ ID NO: 324458 - RNA, 18 nt, Homo sapiens
uggcaaguuuaguagcac

SEQ ID NO: 324459 - RNA, 22 nt, Homo sapiens
uggcaaguuucaauccgaggga

SEQ ID NO: 324460 - RNA, 18 nt, Homo sapiens
uggcaauaugguucuacc

SEQ ID NO: 324461 - RNA, 19 nt, Homo sapiens
uggcaaugucagcagagau

SEQ ID NO: 324462 - RNA, 19 nt, Homo sapiens
uggcacauguauacauaug

SEQ ID NO: 324463 - RNA, 22 nt, Homo sapiens
uggcaccauccaggugucucua

SEQ ID NO: 324464 - RNA, 22 nt, Homo sapiens
uggcacuggagauacauuaaua

SEQ ID NO: 324465 - RNA, 22 nt, Homo sapiens
uggcagacaaauuugagcauau

SEQ ID NO: 324466 - RNA, 22 nt, Homo sapiens
uggcagauagaaaugugguuaa

SEQ ID NO: 324467 - RNA, 22 nt, Homo sapiens
uggcagaugagccgcgcuccaa

SEQ ID NO: 324468 - RNA, 22 nt, Homo sapiens
uggcagaugggugagcuggaga

SEQ ID NO: 324469 - RNA, 22 nt, Homo sapiens
uggcagcgugaauguggcugaa

SEQ ID NO: 324470 - RNA, 22 nt, Homo sapiens
uggcaguuuugauguggagaga

SEQ ID NO: 324471 - RNA, 22 nt, Homo sapiens
uggcauaugguauuugauaucu

SEQ ID NO: 324472 - RNA, 22 nt, Homo sapiens
uggcaucuguucuacacauaaa

SEQ ID NO: 324473 - RNA, 22 nt, Homo sapiens
uggcaugaagaccccauccuuu

SEQ ID NO: 324474 - RNA, 22 nt, Homo sapiens
uggcauggaaagcuuuucauac

SEQ ID NO: 324475 - RNA, 22 nt, Homo sapiens
uggcauggaacuacuuugaaac

SEQ ID NO: 324476 - RNA, 22 nt, Homo sapiens
uggcauggggcagaacauuaca

SEQ ID NO: 324477 - RNA, 22 nt, Homo sapiens
uggcaugggguaguagcgcugg

SEQ ID NO: 324478 - RNA, 22 nt, Homo sapiens
uggcauguaaugcagaaguugc

SEQ ID NO: 324479 - RNA, 22 nt, Homo sapiens
uggcauguagucugggaccugg

SEQ ID NO: 324480 - RNA, 22 nt, Homo sapiens
uggcaugucguuuuucauagga

SEQ ID NO: 324481 - RNA, 22 nt, Homo sapiens
uggcaugugugaagugcccagc

SEQ ID NO: 324482 - RNA, 22 nt, Homo sapiens
uggcauguuggguguugacucc

SEQ ID NO: 324483 - RNA, 22 nt, Homo sapiens
uggcauuuugugugaauuagaa

SEQ ID NO: 324484 - RNA, 23 nt, Homo sapiens
uggccaagauaaucucaguuuuc

SEQ ID NO: 324485 - RNA, 22 nt, Homo sapiens
uggcccccucccaaaucucaua

SEQ ID NO: 324486 - RNA, 22 nt, Homo sapiens
uggcggagacauggacuucaga

SEQ ID NO: 324487 - RNA, 20 nt, Homo sapiens
uggcuaaaugaaugauagca

SEQ ID NO: 324488 - RNA, 22 nt, Homo sapiens
uggcuaaguuaaucaaggagau

SEQ ID NO: 324489 - RNA, 22 nt, Homo sapiens
uggcucuuucuagacuuaauua

SEQ ID NO: 324490 - RNA, 22 nt, Homo sapiens
uggcuguuuauuucaccuggau

SEQ ID NO: 324491 - RNA, 22 nt, Homo sapiens
uggcuguuuauuucaccugggu

SEQ ID NO: 324492 - RNA, 21 nt, Homo sapiens
uggcuguuuucaugcuagaac

SEQ ID NO: 324493 - RNA, 21 nt, Homo sapiens
uggcuuauuugaaucuggcuu

SEQ ID NO: 324494 - RNA, 22 nt, Homo sapiens
uggcuuucuggggcuucuguuc

SEQ ID NO: 324495 - RNA, 22 nt, Homo sapiens
ugggaaacauccagcacauacu

SEQ ID NO: 324496 - RNA, 22 nt, Homo sapiens
ugggaagaagguuuacuugcca

SEQ ID NO: 324497 - RNA, 22 nt, Homo sapiens
ugggaagagggagcgauuuugg

SEQ ID NO: 324498 - RNA, 22 nt, Homo sapiens
ugggaagaugcugcuucuuccu

SEQ ID NO: 324499 - RNA, 19 nt, Homo sapiens
ugggaauguaaauuaguuc

SEQ ID NO: 324500 - RNA, 22 nt, Homo sapiens
ugggaucauuaugcauagugua

SEQ ID NO: 324501 - RNA, 22 nt, Homo sapiens
ugggaugaaaauagcuucuucc

SEQ ID NO: 324502 - RNA, 22 nt, Homo sapiens
ugggaugauguuaaacguacuc

SEQ ID NO: 324503 - RNA, 23 nt, Homo sapiens
ugggauguuuuuggaaacuucug

SEQ ID NO: 324504 - RNA, 22 nt, Homo sapiens
ugggcaguauggucauuuucgu

SEQ ID NO: 324505 - RNA, 22 nt, Homo sapiens
ugggcagugggacagcuuugug

SEQ ID NO: 324506 - RNA, 21 nt, Homo sapiens
ugggccccuuccuuacaucau

SEQ ID NO: 324507 - RNA, 22 nt, Homo sapiens
ugggccgcugcaggaugguccc

SEQ ID NO: 324508 - RNA, 22 nt, Homo sapiens
ugggguaggccugguuaugugc

SEQ ID NO: 324509 - RNA, 22 nt, Homo sapiens
uggguaggcccucauuggacag

SEQ ID NO: 324510 - RNA, 22 nt, Homo sapiens
uggguaguuuuucagcucuugc

SEQ ID NO: 324511 - RNA, 22 nt, Homo sapiens
ugguaagaaaaccauuauuagc

SEQ ID NO: 324512 - RNA, 22 nt, Homo sapiens
ugguaagaggcccugaguuugu

SEQ ID NO: 324513 - RNA, 22 nt, Homo sapiens
ugguaaguuuaacaugcauccc

SEQ ID NO: 324514 - RNA, 22 nt, Homo sapiens
ugguaauguaauuuggagaagg

SEQ ID NO: 324515 - RNA, 22 nt, Homo sapiens
ugguagguuuauaaagaauuua

SEQ ID NO: 324516 - RNA, 22 nt, Homo sapiens
ugguauguaugauuaacaugga

SEQ ID NO: 324517 - RNA, 22 nt, Homo sapiens
uggucaccugaauuaugcaugu

SEQ ID NO: 324518 - RNA, 22 nt, Homo sapiens
uggucagaaaauuacuugauau

SEQ ID NO: 324519 - RNA, 22 nt, Homo sapiens
uggucagaugcugaguggaucu

SEQ ID NO: 324520 - RNA, 19 nt, Homo sapiens
uggucaguucugggagcug

SEQ ID NO: 324521 - RNA, 21 nt, Homo sapiens
uggucaguuuucucacuagga

SEQ ID NO: 324522 - RNA, 22 nt, Homo sapiens
uggucaugaggugaggcuucuc

SEQ ID NO: 324523 - RNA, 22 nt, Homo sapiens
uggucauggggcagcugacacu

SEQ ID NO: 324524 - RNA, 19 nt, Homo sapiens
uggucccccgcaaucucau

SEQ ID NO: 324525 - RNA, 22 nt, Homo sapiens
ugguccuuuccauuggagacac

SEQ ID NO: 324526 - RNA, 22 nt, Homo sapiens
uggucguggagucccuggcuuc

SEQ ID NO: 324527 - RNA, 22 nt, Homo sapiens
uggucuucuggccuccagaacc

SEQ ID NO: 324528 - RNA, 22 nt, Homo sapiens
uggugagaaacuagauauuuuu

SEQ ID NO: 324529 - RNA, 22 nt, Homo sapiens
uggugcuuaaauaaggcuuuca

SEQ ID NO: 324530 - RNA, 22 nt, Homo sapiens
uggugcuugaugaggguggagc

SEQ ID NO: 324531 - RNA, 22 nt, Homo sapiens
ugguggcuuuucguagguucac

SEQ ID NO: 324532 - RNA, 20 nt, Homo sapiens
uggugguuuuaugugguuua

SEQ ID NO: 324533 - RNA, 22 nt, Homo sapiens
ugguguuugagaagcugauguc

SEQ ID NO: 324534 - RNA, 22 nt, Homo sapiens
ugguuaucacuuuccuuccauc

SEQ ID NO: 324535 - RNA, 22 nt, Homo sapiens
ugguucaguugcacaggcuguu

SEQ ID NO: 324536 - RNA, 22 nt, Homo sapiens
ugguugaucccaucacccaggu

SEQ ID NO: 324537 - RNA, 22 nt, Homo sapiens
uguaaacucaguauguuuuacu

SEQ ID NO: 324538 - RNA, 20 nt, Homo sapiens
uguaaaggagauugcagcug

SEQ ID NO: 324539 - RNA, 22 nt, Homo sapiens
uguaagcagcagagacuauccu

SEQ ID NO: 324540 - RNA, 22 nt, Homo sapiens
uguaagcauugggcaugcaguc

SEQ ID NO: 324541 - RNA, 22 nt, Homo sapiens
uguaaugaucaaaucagaguaa

SEQ ID NO: 324542 - RNA, 22 nt, Homo sapiens
uguaauuuaaaugauccuugga

SEQ ID NO: 324543 - RNA, 22 nt, Homo sapiens
uguacaaaacaagaugggggua

SEQ ID NO: 324544 - RNA, 22 nt, Homo sapiens
uguacaugggacaggaggagag

SEQ ID NO: 324545 - RNA, 22 nt, Homo sapiens
uguacuucaagauuaugguuua

SEQ ID NO: 324546 - RNA, 22 nt, Homo sapiens
uguagcaaauaaaagucuggau

SEQ ID NO: 324547 - RNA, 21 nt, Homo sapiens
uguagcagcauaauuuauaau

SEQ ID NO: 324548 - RNA, 23 nt, Homo sapiens
uguauacacccugugcaucuggg

SEQ ID NO: 324549 - RNA, 22 nt, Homo sapiens
guucacaguucagccuguaaca

SEQ ID NO: 324550 - RNA, 22 nt, Homo sapiens
guucaucagggauacuggccuu

SEQ ID NO: 324551 - RNA, 22 nt, Homo sapiens
guugagcaagcuuuggagccua

SEQ ID NO: 324552 - RNA, 22 nt, Homo sapiens
guugcaaaguaauugugguuuu

SEQ ID NO: 324553 - RNA, 22 nt, Homo sapiens
guugcagcacacaggcugucag

SEQ ID NO: 324554 - RNA, 22 nt, Homo sapiens
guugccuaggcuggcgugcagu

SEQ ID NO: 324555 - RNA, 22 nt, Homo sapiens
guuggaauguauugcuacuucu

SEQ ID NO: 324556 - RNA, 22 nt, Homo sapiens
guuggcuuuuuaaggaaauugc

SEQ ID NO: 324557 - RNA, 22 nt, Homo sapiens
guuuacagucgacuugggaaua

SEQ ID NO: 324558 - RNA, 22 nt, Homo sapiens
guuuaggaaugagaauauuuag

SEQ ID NO: 324559 - RNA, 22 nt, Homo sapiens
guuugccuuuuagauaggaaug

SEQ ID NO: 324560 - RNA, 22 nt, Homo sapiens
guuuggauauuaggcaagagua

SEQ ID NO: 324561 - RNA, 22 nt, Homo sapiens
guuuguaacucuagugacuaga

SEQ ID NO: 324562 - RNA, 22 nt, Homo sapiens
guuugugcuccuaugagaaucu

SEQ ID NO: 324563 - RNA, 21 nt, Homo sapiens
uaaaacuguaacuuuguccug

SEQ ID NO: 324564 - RNA, 22 nt, Homo sapiens
uaaaccuagcauuuugcauaug

SEQ ID NO: 324565 - RNA, 22 nt, Homo sapiens
uaaacugcuugaaaugguguca

SEQ ID NO: 324566 - RNA, 22 nt, Homo sapiens
uaaacugucuugcaguuacaug

SEQ ID NO: 324567 - RNA, 22 nt, Homo sapiens
uaaagccagugauuaugucucu

SEQ ID NO: 324568 - RNA, 22 nt, Homo sapiens
uaaagccauugucaaguuugua

SEQ ID NO: 324569 - RNA, 22 nt, Homo sapiens
uaaagccuagaacuuucagccc

SEQ ID NO: 324570 - RNA, 22 nt, Homo sapiens
uaaagcgaggucuccuacaaga

SEQ ID NO: 324571 - RNA, 21 nt, Homo sapiens
uaaagcuagaaccuuagcuuu

SEQ ID NO: 324572 - RNA, 21 nt, Homo sapiens
uaaagcuuagcuauaguggcu

SEQ ID NO: 324573 - RNA, 21 nt, Homo sapiens
uaaaggcuccaauuauacccc

SEQ ID NO: 324574 - RNA, 22 nt, Homo sapiens
uaaaguucuuuuaugggccggg

SEQ ID NO: 324575 - RNA, 22 nt, Homo sapiens
uaaauggauaaaugaauaccua

SEQ ID NO: 324576 - RNA, 22 nt, Homo sapiens
uaacaacauucuaacugacggc

SEQ ID NO: 324577 - RNA, 22 nt, Homo sapiens
uaacaaugucuuaugggcuuaa

SEQ ID NO: 324578 - RNA, 22 nt, Homo sapiens
uaacacagagcuccuaaucccu

SEQ ID NO: 324579 - RNA, 19 nt, Homo sapiens
uaacacaguuguguuugag

SEQ ID NO: 324580 - RNA, 22 nt, Homo sapiens
uaacaccuugcucugucaauaa

SEQ ID NO: 324581 - RNA, 22 nt, Homo sapiens
uaacaguauauuuaccaaaccu

SEQ ID NO: 324582 - RNA, 22 nt, Homo sapiens
uaacagucaagguuugaccagg

SEQ ID NO: 324583 - RNA, 23 nt, Homo sapiens
uaacauugcaugauuaccugcau

SEQ ID NO: 324584 - RNA, 22 nt, Homo sapiens
uaacauuguugauuauacuaag

SEQ ID NO: 324585 - RNA, 22 nt, Homo sapiens
uaacuaaagagaagucaauguc

SEQ ID NO: 324586 - RNA, 22 nt, Homo sapiens
uaacuacuucugcuucagagua

SEQ ID NO: 324587 - RNA, 22 nt, Homo sapiens
uaacuauagagaauguugagua

SEQ ID NO: 324588 - RNA, 22 nt, Homo sapiens
uaacugcaaccuccgccucccg

SEQ ID NO: 324589 - RNA, 18 nt, Homo sapiens
uaacuggugugagauggu

SEQ ID NO: 324590 - RNA, 22 nt, Homo sapiens
uaacugucucaggccaugggcg

SEQ ID NO: 324591 - RNA, 22 nt, Homo sapiens
uaacuguggaaaugacuuuaaa

SEQ ID NO: 324592 - RNA, 20 nt, Homo sapiens
uaacuguggcuucuuuuggc

SEQ ID NO: 324593 - RNA, 22 nt, Homo sapiens
uaagacacuuaaaauguuacau

SEQ ID NO: 324594 - RNA, 22 nt, Homo sapiens
uaagacuguguaauuuaugaag

SEQ ID NO: 324595 - RNA, 22 nt, Homo sapiens
uaagccaccgugccuggccuaa

SEQ ID NO: 324596 - RNA, 22 nt, Homo sapiens
uaagcuauagugaauaaauugc

SEQ ID NO: 324597 - RNA, 22 nt, Homo sapiens
uaaggaacucugauaucuggaa

SEQ ID NO: 324598 - RNA, 22 nt, Homo sapiens
uaaggcacccuucugaguagag

SEQ ID NO: 324599 - RNA, 22 nt, Homo sapiens
uaaggcacucuucugugugccu

SEQ ID NO: 324600 - RNA, 22 nt, Homo sapiens
uaaggcccggccuuuccaagca

SEQ ID NO: 324601 - RNA, 22 nt, Homo sapiens
uaaggcccgugaguuucauauc

SEQ ID NO: 324602 - RNA, 22 nt, Homo sapiens
uaaggcucuuguuauuuugagg

SEQ ID NO: 324603 - RNA, 22 nt, Homo sapiens
uaagggcaugcugcaugagagu

SEQ ID NO: 324604 - RNA, 22 nt, Homo sapiens
uaaguaaaugaaagguugauuu

SEQ ID NO: 324605 - RNA, 22 nt, Homo sapiens
uaaguaauugugguuucugcca

SEQ ID NO: 324606 - RNA, 22 nt, Homo sapiens
uaaguaguccugauuuaaccuu

SEQ ID NO: 324607 - RNA, 22 nt, Homo sapiens
uaaguaguguugagacaaguuu

SEQ ID NO: 324608 - RNA, 22 nt, Homo sapiens
uaaguauuaggccccaggcugg

SEQ ID NO: 324609 - RNA, 22 nt, Homo sapiens
uaaguauuuuaauuccuggcau

SEQ ID NO: 324610 - RNA, 22 nt, Homo sapiens
uaagugaauguuggcuacugaa

SEQ ID NO: 324611 - RNA, 22 nt, Homo sapiens
uaagugcuguguuguuaccuaa

SEQ ID NO: 324612 - RNA, 22 nt, Homo sapiens
uaagugcuugacuuugauguuu

SEQ ID NO: 324613 - RNA, 20 nt, Homo sapiens
uaagugcuugagacuucuga

SEQ ID NO: 324614 - RNA, 22 nt, Homo sapiens
uaaguuagugugagaauuuugc

SEQ ID NO: 324615 - RNA, 23 nt, Homo sapiens
uaaguucaucucuaauaggugga

SEQ ID NO: 324616 - RNA, 22 nt, Homo sapiens
uaaguuguagaacguuuucuua

SEQ ID NO: 324617 - RNA, 22 nt, Homo sapiens
uaauaauguuaggcuuacucaa

SEQ ID NO: 324618 - RNA, 22 nt, Homo sapiens
uaauacauucaaggugguaguu

SEQ ID NO: 324619 - RNA, 22 nt, Homo sapiens
uaauagagucauuauuauuguu

SEQ ID NO: 324620 - RNA, 22 nt, Homo sapiens
uaauagcaguguuacuaggacu

SEQ ID NO: 324621 - RNA, 22 nt, Homo sapiens
uaaucucagcugagcugagauu

SEQ ID NO: 324622 - RNA, 22 nt, Homo sapiens
uaaugcacauuuauuuuaccuu

SEQ ID NO: 324623 - RNA, 22 nt, Homo sapiens
uaaugcacucgaaucauggaau

SEQ ID NO: 324624 - RNA, 22 nt, Homo sapiens
uaaugugaauagugcuguaaug

SEQ ID NO: 324625 - RNA, 22 nt, Homo sapiens
uacaaagcuuugaugugucuuu

SEQ ID NO: 324626 - RNA, 22 nt, Homo sapiens
uacaagcaggaaaugguauaug

SEQ ID NO: 324627 - RNA, 22 nt, Homo sapiens
uacaagcuaaaauggaagauca

SEQ ID NO: 324628 - RNA, 22 nt, Homo sapiens
uacaagguaucagugaccguaa

SEQ ID NO: 324629 - RNA, 22 nt, Homo sapiens
uacacacguguguauauauaca

SEQ ID NO: 324630 - RNA, 22 nt, Homo sapiens
uacaccugaguuugugguuuuc

SEQ ID NO: 324631 - RNA, 22 nt, Homo sapiens
uacaggaaugucagguugcugu

SEQ ID NO: 324632 - RNA, 20 nt, Homo sapiens
uacaggacugagaaucugug

SEQ ID NO: 324633 - RNA, 22 nt, Homo sapiens
uacaggacuucucagaguuauu

SEQ ID NO: 324634 - RNA, 22 nt, Homo sapiens
uacagguauagauguguguucu

SEQ ID NO: 324635 - RNA, 22 nt, Homo sapiens
uacaguaauguuaaucuuugug

SEQ ID NO: 324636 - RNA, 22 nt, Homo sapiens
uacagucauaaugccuagugac

SEQ ID NO: 324637 - RNA, 22 nt, Homo sapiens
uacaguccaugcauuauccucc

SEQ ID NO: 324638 - RNA, 20 nt, Homo sapiens
uacauaguaaacugagagca

SEQ ID NO: 324639 - RNA, 22 nt, Homo sapiens
uacauaguagauauaggguuua

SEQ ID NO: 324640 - RNA, 19 nt, Homo sapiens
uacauaguauuuaguggca

SEQ ID NO: 324641 - RNA, 22 nt, Homo sapiens
uguauagaucugauucaucucc

SEQ ID NO: 324642 - RNA, 22 nt, Homo sapiens
uguauaggcaaauuuccucaug

SEQ ID NO: 324643 - RNA, 22 nt, Homo sapiens
uguauaguugagucaaguuuca

SEQ ID NO: 324644 - RNA, 22 nt, Homo sapiens
uguaugagagugaaagcauuuc

SEQ ID NO: 324645 - RNA, 22 nt, Homo sapiens
uguaugcuuuugagagauauuu

SEQ ID NO: 324646 - RNA, 22 nt, Homo sapiens
uguauguaaagacaggauaaca

SEQ ID NO: 324647 - RNA, 22 nt, Homo sapiens
uguauguuguaagacuuagacc

SEQ ID NO: 324648 - RNA, 22 nt, Homo sapiens
uguauuuguuguuaaauggaga

SEQ ID NO: 324649 - RNA, 22 nt, Homo sapiens
ugucaaagagacaucugcacuc

SEQ ID NO: 324650 - RNA, 22 nt, Homo sapiens
ugucaacauuuaucaaguuauu

SEQ ID NO: 324651 - RNA, 22 nt, Homo sapiens
ugucaagaaaucaaggugugag

SEQ ID NO: 324652 - RNA, 22 nt, Homo sapiens
ugucaagaugguuugauguugu

SEQ ID NO: 324653 - RNA, 22 nt, Homo sapiens
ugucacuuugccuucuggacuu

SEQ ID NO: 324654 - RNA, 23 nt, Homo sapiens
ugucaucaagaugaggucacacu

SEQ ID NO: 324655 - RNA, 22 nt, Homo sapiens
ugucaucauuggaaucugccuc

SEQ ID NO: 324656 - RNA, 22 nt, Homo sapiens
ugucaucuagguauuaagcccc

SEQ ID NO: 324657 - RNA, 22 nt, Homo sapiens
ugucaugguagcaaggacgagg

SEQ ID NO: 324658 - RNA, 22 nt, Homo sapiens
ugucaugucuuuguguaucaau

SEQ ID NO: 324659 - RNA, 22 nt, Homo sapiens
ugucauguugguguacugcacc

SEQ ID NO: 324660 - RNA, 22 nt, Homo sapiens
uguccugcagagguguuugccu

SEQ ID NO: 324661 - RNA, 22 nt, Homo sapiens
ugucuacugaugauguaguuaa

SEQ ID NO: 324662 - RNA, 22 nt, Homo sapiens
ugucuagaaaagccugccuucu

SEQ ID NO: 324663 - RNA, 22 nt, Homo sapiens
ugucuagaucugaauguaauug

SEQ ID NO: 324664 - RNA, 22 nt, Homo sapiens
ugucugagacuguuuuacuuuc

SEQ ID NO: 324665 - RNA, 18 nt, Homo sapiens
ugucuuagagcuugaccc

SEQ ID NO: 324666 - RNA, 22 nt, Homo sapiens
ugucuuggagaauccuggguuu

SEQ ID NO: 324667 - RNA, 22 nt, Homo sapiens
ugugaaacacgaaagucuaaaa

SEQ ID NO: 324668 - RNA, 22 nt, Homo sapiens
ugugaacacagaggcuauggca

SEQ ID NO: 324669 - RNA, 19 nt, Homo sapiens
ugugaacaucacagagugu

SEQ ID NO: 324670 - RNA, 21 nt, Homo sapiens
ugugaacauguuggguggcau

SEQ ID NO: 324671 - RNA, 22 nt, Homo sapiens
ugugaacugagcauuaacuaca

SEQ ID NO: 324672 - RNA, 22 nt, Homo sapiens
ugugaauggugcuuccuagaug

SEQ ID NO: 324673 - RNA, 22 nt, Homo sapiens
ugugaauguaaccuuauuugga

SEQ ID NO: 324674 - RNA, 22 nt, Homo sapiens
ugugaauguaagaaaauccaac

SEQ ID NO: 324675 - RNA, 23 nt, Homo sapiens
ugugacacuuccgucaguucauu

SEQ ID NO: 324676 - RNA, 22 nt, Homo sapiens
ugugacagcacagcaucucuuu

SEQ ID NO: 324677 - RNA, 22 nt, Homo sapiens
ugugacagcacgguucaacugc

SEQ ID NO: 324678 - RNA, 18 nt, Homo sapiens
ugugacauugagcauguc

SEQ ID NO: 324679 - RNA, 22 nt, Homo sapiens
ugugaccaaaaucaacauaccu

SEQ ID NO: 324680 - RNA, 22 nt, Homo sapiens
ugugacucugcauuuuggguuc

SEQ ID NO: 324681 - RNA, 19 nt, Homo sapiens
ugugacugguugucucgcu

SEQ ID NO: 324682 - RNA, 19 nt, Homo sapiens
ugugagcauuagcauuuag

SEQ ID NO: 324683 - RNA, 22 nt, Homo sapiens
ugugaguguguacuaguuauca

SEQ ID NO: 324684 - RNA, 22 nt, Homo sapiens
ugugauaguuggcuaaagcagu

SEQ ID NO: 324685 - RNA, 22 nt, Homo sapiens
ugugauguggagggcagaucca

SEQ ID NO: 324686 - RNA, 20 nt, Homo sapiens
ugugauuauuuaguugcaug

SEQ ID NO: 324687 - RNA, 22 nt, Homo sapiens
ugugcaaauguuaaacuaacuu

SEQ ID NO: 324688 - RNA, 22 nt, Homo sapiens
ugugcaaggcucucaaccugug

SEQ ID NO: 324689 - RNA, 18 nt, Homo sapiens
ugugcaauauuaaccacc

SEQ ID NO: 324690 - RNA, 22 nt, Homo sapiens
ugugcaaucagcuucauuacau

SEQ ID NO: 324691 - RNA, 22 nt, Homo sapiens
ugugcacaaugugcagguuugu

SEQ ID NO: 324692 - RNA, 22 nt, Homo sapiens
ugugcacaugauauaucacaua

SEQ ID NO: 324693 - RNA, 22 nt, Homo sapiens
ugugcacuggaccuugucuucu

SEQ ID NO: 324694 - RNA, 22 nt, Homo sapiens
ugugcaguuuuagcguauuuua

SEQ ID NO: 324695 - RNA, 22 nt, Homo sapiens
ugugccaaaucccauaauaaau

SEQ ID NO: 324696 - RNA, 22 nt, Homo sapiens
ugugccacugcacucccgccug

SEQ ID NO: 324697 - RNA, 22 nt, Homo sapiens
ugugccacugcacuucagccug

SEQ ID NO: 324698 - RNA, 22 nt, Homo sapiens
ugugccuaguaauguguccaga

SEQ ID NO: 324699 - RNA, 22 nt, Homo sapiens
ugugcgcaucggggccugcuuc

SEQ ID NO: 324700 - RNA, 22 nt, Homo sapiens
ugugcuaauacauacagugcua

SEQ ID NO: 324701 - RNA, 22 nt, Homo sapiens
ugugcucaucucagucaacugu

SEQ ID NO: 324702 - RNA, 22 nt, Homo sapiens
uguggaaauaaaagaaagguua

SEQ ID NO: 324703 - RNA, 22 nt, Homo sapiens
uguggaaauggugcuacgaaca

SEQ ID NO: 324704 - RNA, 22 nt, Homo sapiens
uguggaaauuguuguauuuaau

SEQ ID NO: 324705 - RNA, 22 nt, Homo sapiens
uguggaguguaugugacagaga

SEQ ID NO: 324706 - RNA, 20 nt, Homo sapiens
uguggcacuguaucucucag

SEQ ID NO: 324707 - RNA, 22 nt, Homo sapiens
uguggcauugaauaaccuugga

SEQ ID NO: 324708 - RNA, 22 nt, Homo sapiens
uguggccuuuguuucaguuggg

SEQ ID NO: 324709 - RNA, 22 nt, Homo sapiens
ugugggaggugcuaauguaaau

SEQ ID NO: 324710 - RNA, 19 nt, Homo sapiens
uguggucauccugggacga

SEQ ID NO: 324711 - RNA, 22 nt, Homo sapiens
ugugguuuuaguaaaacuaugu

SEQ ID NO: 324712 - RNA, 22 nt, Homo sapiens
ugugguuuuuuucuccaauagg

SEQ ID NO: 324713 - RNA, 22 nt, Homo sapiens
uguguaaauacaagugcuugaa

SEQ ID NO: 324714 - RNA, 22 nt, Homo sapiens
uguguacugcagaguauucugu

SEQ ID NO: 324715 - RNA, 22 nt, Homo sapiens
uguguauaucacugcaugagug

SEQ ID NO: 324716 - RNA, 22 nt, Homo sapiens
ugugucuccugaaaauucacau

SEQ ID NO: 324717 - RNA, 22 nt, Homo sapiens
uguuaacauggucucagucugu

SEQ ID NO: 324718 - RNA, 22 nt, Homo sapiens
uguuaguuguucauguuaagag

SEQ ID NO: 324719 - RNA, 22 nt, Homo sapiens
uguuauguuguuugagaaaguc

SEQ ID NO: 324720 - RNA, 22 nt, Homo sapiens
uguuauugagguuacuuauaag

SEQ ID NO: 324721 - RNA, 22 nt, Homo sapiens
uguucaauucccaccuaugagu

SEQ ID NO: 324722 - RNA, 22 nt, Homo sapiens
uguucuggagccgguucaaaug

SEQ ID NO: 324723 - RNA, 22 nt, Homo sapiens
uguugcacuccagccugggcaa

SEQ ID NO: 324724 - RNA, 22 nt, Homo sapiens
uguugcacucuagccugggcaa

SEQ ID NO: 324725 - RNA, 22 nt, Homo sapiens
uguuggacuuacuuggcagauu

SEQ ID NO: 324726 - RNA, 22 nt, Homo sapiens
uguuucuacugucucuguagua

SEQ ID NO: 324727 - RNA, 22 nt, Homo sapiens
uguuugguggucucuucacaug

SEQ ID NO: 324728 - RNA, 22 nt, Homo sapiens
uguuuguuugugauacgguaca

SEQ ID NO: 324729 - RNA, 22 nt, Homo sapiens
uguuuuggagguccucacuaga

SEQ ID NO: 324730 - RNA, 22 nt, Homo sapiens
uuaaagcuggcguuacaguuug

SEQ ID NO: 324731 - RNA, 22 nt, Homo sapiens
uuaaaggcaugguuagacaugg

SEQ ID NO: 324732 - RNA, 22 nt, Homo sapiens
uuaaagugaucauaaggauagu

SEQ ID NO: 324733 - RNA, 22 nt, Homo sapiens
uacaucagccugaaagagcucg

SEQ ID NO: 324734 - RNA, 19 nt, Homo sapiens
uacaugcagcaggcacgca

SEQ ID NO: 324735 - RNA, 22 nt, Homo sapiens
uacaugcaugggcaugugugca

SEQ ID NO: 324736 - RNA, 16 nt, Homo sapiens
uacauuuguuacaugg

SEQ ID NO: 324737 - RNA, 22 nt, Homo sapiens
uaccagugaauuccaggggcua

SEQ ID NO: 324738 - RNA, 22 nt, Homo sapiens
uaccucagccaaugcccagaag

SEQ ID NO: 324739 - RNA, 22 nt, Homo sapiens
uaccugagaaagaaagcccucg

SEQ ID NO: 324740 - RNA, 22 nt, Homo sapiens
uacguuaucagguaugcaagag

SEQ ID NO: 324741 - RNA, 22 nt, Homo sapiens
uacuagaggaauugcuauaacu

SEQ ID NO: 324742 - RNA, 22 nt, Homo sapiens
uacuagaggcgggguuucgcca

SEQ ID NO: 324743 - RNA, 23 nt, Homo sapiens
uacuaguaagcguguucuuugca

SEQ ID NO: 324744 - RNA, 22 nt, Homo sapiens
uacuauugcaucggugauuagg

SEQ ID NO: 324745 - RNA, 22 nt, Homo sapiens
uacucugcagagaugcauaaca

SEQ ID NO: 324746 - RNA, 22 nt, Homo sapiens
uacugcacauaugaagguuccc

SEQ ID NO: 324747 - RNA, 22 nt, Homo sapiens
uacugcacuccacccuggguga

SEQ ID NO: 324748 - RNA, 22 nt, Homo sapiens
uacugcacuccagccugccaac

SEQ ID NO: 324749 - RNA, 22 nt, Homo sapiens
uacugcacuccagccuugccaa

SEQ ID NO: 324750 - RNA, 22 nt, Homo sapiens
uacugcacucuagccuggguga

SEQ ID NO: 324751 - RNA, 22 nt, Homo sapiens
uacugcacuggaggccucagau

SEQ ID NO: 324752 - RNA, 22 nt, Homo sapiens
uacugcagucagacuccugggc

SEQ ID NO: 324753 - RNA, 22 nt, Homo sapiens
uacugcaucgaaaugcuuuuau

SEQ ID NO: 324754 - RNA, 22 nt, Homo sapiens
uacuguacugcaguucugcaaa

SEQ ID NO: 324755 - RNA, 20 nt, Homo sapiens
uagaaaguagaguggugguu

SEQ ID NO: 324756 - RNA, 22 nt, Homo sapiens
uagaacauuccaggugauguug

SEQ ID NO: 324757 - RNA, 22 nt, Homo sapiens
uagaauggaagguugagaagaa

SEQ ID NO: 324758 - RNA, 22 nt, Homo sapiens
uagaauguaaauuccaagggca

SEQ ID NO: 324759 - RNA, 22 nt, Homo sapiens
uagacacuagauaugugacuga

SEQ ID NO: 324760 - RNA, 22 nt, Homo sapiens
uagacccauuguucagagagug

SEQ ID NO: 324761 - RNA, 20 nt, Homo sapiens
uagagagauauggggguucc

SEQ ID NO: 324762 - RNA, 22 nt, Homo sapiens
uagagagcuguuugaaagcagg

SEQ ID NO: 324763 - RNA, 22 nt, Homo sapiens
uagagcacaagguagauuucua

SEQ ID NO: 324764 - RNA, 22 nt, Homo sapiens
uagaggaaggauuggaaacgca

SEQ ID NO: 324765 - RNA, 21 nt, Homo sapiens
uagauacuguauuaaaccuag

SEQ ID NO: 324766 - RNA, 22 nt, Homo sapiens
uagauaguaaagccauuagcuu

SEQ ID NO: 324767 - RNA, 22 nt, Homo sapiens
uagauaguuaugauuugaugau

SEQ ID NO: 324768 - RNA, 22 nt, Homo sapiens
uagaucaacuuugguaagagaa

SEQ ID NO: 324769 - RNA, 22 nt, Homo sapiens
uagaucauauacuugccaugac

SEQ ID NO: 324770 - RNA, 21 nt, Homo sapiens
uagaugguguucuagagagaa

SEQ ID NO: 324771 - RNA, 22 nt, Homo sapiens
uagauuaucuguaugugcucuu

SEQ ID NO: 324772 - RNA, 23 nt, Homo sapiens
uagcaacaguuggaggugaggua

SEQ ID NO: 324773 - RNA, 22 nt, Homo sapiens
uagcaccugugcacaccaggca

SEQ ID NO: 324774 - RNA, 22 nt, Homo sapiens
uagcagaauauaccucuuacuu

SEQ ID NO: 324775 - RNA, 22 nt, Homo sapiens
uagcagcaccccacucuacugg

SEQ ID NO: 324776 - RNA, 20 nt, Homo sapiens
uagcagcagacagagggagg

SEQ ID NO: 324777 - RNA, 22 nt, Homo sapiens
uagcagcagugguguauuuaga

SEQ ID NO: 324778 - RNA, 22 nt, Homo sapiens
uagcagguggugaccacauuuu

SEQ ID NO: 324779 - RNA, 20 nt, Homo sapiens
uagcaggugucaggugauau

SEQ ID NO: 324780 - RNA, 22 nt, Homo sapiens
uagcagguguuccacaaauauu

SEQ ID NO: 324781 - RNA, 22 nt, Homo sapiens
uagcaguaaagaaugugauguu

SEQ ID NO: 324782 - RNA, 22 nt, Homo sapiens
uagcaguaagaaacugacauug

SEQ ID NO: 324783 - RNA, 22 nt, Homo sapiens
uagcaguauacguacugggucc

SEQ ID NO: 324784 - RNA, 22 nt, Homo sapiens
uagcagugugaaaacagacuaa

SEQ ID NO: 324785 - RNA, 22 nt, Homo sapiens
uagcaguuguuguuacuuguau

SEQ ID NO: 324786 - RNA, 22 nt, Homo sapiens
uagcauggaggcggccauagug

SEQ ID NO: 324787 - RNA, 22 nt, Homo sapiens
uagcaugucagucgccacacgu

SEQ ID NO: 324788 - RNA, 22 nt, Homo sapiens
uagcuccagugggguuacugcu

SEQ ID NO: 324789 - RNA, 22 nt, Homo sapiens
uagcugagacuacaguaggugc

SEQ ID NO: 324790 - RNA, 22 nt, Homo sapiens
uagcugaucuuuuaaagaauga

SEQ ID NO: 324791 - RNA, 22 nt, Homo sapiens
uagcugcaaaauauagacuucu

SEQ ID NO: 324792 - RNA, 21 nt, Homo sapiens
uagcugcacccaggccuccuu

SEQ ID NO: 324793 - RNA, 22 nt, Homo sapiens
uagcuggaguuuuuguuauagg

SEQ ID NO: 324794 - RNA, 22 nt, Homo sapiens
uagcugguucuccaggagcuag

SEQ ID NO: 324795 - RNA, 22 nt, Homo sapiens
uaggacuuuucuugagagugac

SEQ ID NO: 324796 - RNA, 20 nt, Homo sapiens
uaggagcaaugagaguagaa

SEQ ID NO: 324797 - RNA, 22 nt, Homo sapiens
uaggagcauaggauuguuugag

SEQ ID NO: 324798 - RNA, 22 nt, Homo sapiens
uaggagugugaacccuaugaac

SEQ ID NO: 324799 - RNA, 22 nt, Homo sapiens
uaggcaaaugcaagaguagaac

SEQ ID NO: 324800 - RNA, 22 nt, Homo sapiens
uaggcaauggagauagaggaug

SEQ ID NO: 324801 - RNA, 22 nt, Homo sapiens
uaggcaauguggcgaaacucug

SEQ ID NO: 324802 - RNA, 22 nt, Homo sapiens
uaggcaguguucucacuuguaa

SEQ ID NO: 324803 - RNA, 22 nt, Homo sapiens
uaggcgagauguguguuucaug

SEQ ID NO: 324804 - RNA, 22 nt, Homo sapiens
uagggaguguccuuucgggaaa

SEQ ID NO: 324805 - RNA, 22 nt, Homo sapiens
uagggcuuuccggccugucaga

SEQ ID NO: 324806 - RNA, 22 nt, Homo sapiens
uaggggcacacuucgguuagca

SEQ ID NO: 324807 - RNA, 22 nt, Homo sapiens
uaggguaguaauaguuguuuca

SEQ ID NO: 324808 - RNA, 22 nt, Homo sapiens
uagguaagauguuaacagcuga

SEQ ID NO: 324809 - RNA, 22 nt, Homo sapiens
uagguaaguaauauacagauga

SEQ ID NO: 324810 - RNA, 22 nt, Homo sapiens
uagguagaacccagaaaucuga

SEQ ID NO: 324811 - RNA, 22 nt, Homo sapiens
uagguagaaucuugaagccauu

SEQ ID NO: 324812 - RNA, 22 nt, Homo sapiens
uagguaggauagucuuuauuuu

SEQ ID NO: 324813 - RNA, 22 nt, Homo sapiens
uagguaggugucauaauccaug

SEQ ID NO: 324814 - RNA, 22 nt, Homo sapiens
uagguaguuagcauacuacaca

SEQ ID NO: 324815 - RNA, 22 nt, Homo sapiens
uaggucuuuuaugaaauauauu

SEQ ID NO: 324816 - RNA, 22 nt, Homo sapiens
uaggugaaugcuggaagaaaug

SEQ ID NO: 324817 - RNA, 22 nt, Homo sapiens
uaggugauccauuuguauuuua

SEQ ID NO: 324818 - RNA, 19 nt, Homo sapiens
uaggugguuuuccccucac

SEQ ID NO: 324819 - RNA, 22 nt, Homo sapiens
uagguuaucucaaguguaauuu

SEQ ID NO: 324820 - RNA, 20 nt, Homo sapiens
uagguuuucacagaauugcc

SEQ ID NO: 324821 - RNA, 22 nt, Homo sapiens
uaguaaacaccucagguaauuc

SEQ ID NO: 324822 - RNA, 22 nt, Homo sapiens
uaguaaacauuuuucuaucauu

SEQ ID NO: 324823 - RNA, 18 nt, Homo sapiens
uaguacuguucucaugau

SEQ ID NO: 324824 - RNA, 22 nt, Homo sapiens
uaguaucacaagguguacaccc

SEQ ID NO: 324825 - RNA, 22 nt, Homo sapiens
uuaaauacagcaugguguuucu

SEQ ID NO: 324826 - RNA, 22 nt, Homo sapiens
uuaaaugcuagaauuuucuuug

SEQ ID NO: 324827 - RNA, 22 nt, Homo sapiens
uuaaaugucuguagaugugcug

SEQ ID NO: 324828 - RNA, 22 nt, Homo sapiens
uuaacacugccauugauacugu

SEQ ID NO: 324829 - RNA, 22 nt, Homo sapiens
uuaacagucacuuagcucauuu

SEQ ID NO: 324830 - RNA, 22 nt, Homo sapiens
uuaagaagugauuuuccucauu

SEQ ID NO: 324831 - RNA, 22 nt, Homo sapiens
uuaagaugcauuuugaaguuaa

SEQ ID NO: 324832 - RNA, 22 nt, Homo sapiens
uuaagccaggugugguggcaca

SEQ ID NO: 324833 - RNA, 22 nt, Homo sapiens
uuaaggcuuuaaguaaacacag

SEQ ID NO: 324834 - RNA, 19 nt, Homo sapiens
uuaagguacuuagaugugu

SEQ ID NO: 324835 - RNA, 23 nt, Homo sapiens
uuaaggugaugucuuugugccuc

SEQ ID NO: 324836 - RNA, 22 nt, Homo sapiens
uuaagguuuuuguagcaaggau

SEQ ID NO: 324837 - RNA, 22 nt, Homo sapiens
uuaaguagcugggcaugguggu

SEQ ID NO: 324838 - RNA, 22 nt, Homo sapiens
uuaaguuaggcuucagcagucu

SEQ ID NO: 324839 - RNA, 22 nt, Homo sapiens
uuaauagcaaagaguuuagacu

SEQ ID NO: 324840 - RNA, 22 nt, Homo sapiens
uuaaucucaggaguuugggacc

SEQ ID NO: 324841 - RNA, 22 nt, Homo sapiens
uuaaugacaucauaggugaagu

SEQ ID NO: 324842 - RNA, 21 nt, Homo sapiens
uuaaugcuaugcagaaaaucu

SEQ ID NO: 324843 - RNA, 22 nt, Homo sapiens
uuaaugcuuggggaguaguucu

SEQ ID NO: 324844 - RNA, 22 nt, Homo sapiens
uuaauggagaguuucauuggug

SEQ ID NO: 324845 - RNA, 22 nt, Homo sapiens
uuaauuguccauuauucuguuc

SEQ ID NO: 324846 - RNA, 22 nt, Homo sapiens
uuacaacugucuuacugguuau

SEQ ID NO: 324847 - RNA, 21 nt, Homo sapiens
uuacaauggcuccuugaaggu

SEQ ID NO: 324848 - RNA, 22 nt, Homo sapiens
uuacacaguugguaggggcaga

SEQ ID NO: 324849 - RNA, 22 nt, Homo sapiens
uuacaggacuaagcagcuuugc

SEQ ID NO: 324850 - RNA, 22 nt, Homo sapiens
uuacagucaaguuacauuucuc

SEQ ID NO: 324851 - RNA, 22 nt, Homo sapiens
uuacagucuuaggcagugcuuu

SEQ ID NO: 324852 - RNA, 20 nt, Homo sapiens
uuacagugggaccuuccuga

SEQ ID NO: 324853 - RNA, 22 nt, Homo sapiens
uuacaguggugaccuuguauug

SEQ ID NO: 324854 - RNA, 21 nt, Homo sapiens
uuacaguugguugugaggugg

SEQ ID NO: 324855 - RNA, 22 nt, Homo sapiens
uuacaguugugagccaccaugc

SEQ ID NO: 324856 - RNA, 22 nt, Homo sapiens
uuacaucaucacauuaguuugc

SEQ ID NO: 324857 - RNA, 22 nt, Homo sapiens
uuaccacagugccugucuaaug

SEQ ID NO: 324858 - RNA, 22 nt, Homo sapiens
uuaccagucugauuccuguuag

SEQ ID NO: 324859 - RNA, 22 nt, Homo sapiens
uuaccucagaccugcucugugu

SEQ ID NO: 324860 - RNA, 22 nt, Homo sapiens
uuacuacucucuaugaccaguu

SEQ ID NO: 324861 - RNA, 22 nt, Homo sapiens
uuacuagaacauuuagggaacu

SEQ ID NO: 324862 - RNA, 22 nt, Homo sapiens
uuagaacaguguuugccucgcu

SEQ ID NO: 324863 - RNA, 22 nt, Homo sapiens
uuagagguaggauuucaccaug

SEQ ID NO: 324864 - RNA, 22 nt, Homo sapiens
uuagaguguagcaggaagaggc

SEQ ID NO: 324865 - RNA, 22 nt, Homo sapiens
uuagaugguucaccaugaguag

SEQ ID NO: 324866 - RNA, 18 nt, Homo sapiens
uuagaugguuuuaaaacu

SEQ ID NO: 324867 - RNA, 22 nt, Homo sapiens
uuagcacauuuccagcacaugg

SEQ ID NO: 324868 - RNA, 22 nt, Homo sapiens
uuagcagcaugagaauggacua

SEQ ID NO: 324869 - RNA, 20 nt, Homo sapiens
uuagcagcaugauuuauaau

SEQ ID NO: 324870 - RNA, 22 nt, Homo sapiens
uuagcaugucuacuaauuugcu

SEQ ID NO: 324871 - RNA, 22 nt, Homo sapiens
uuagccggguguguuggcgggc

SEQ ID NO: 324872 - RNA, 22 nt, Homo sapiens
uuaggcuaguugauauaguuug

SEQ ID NO: 324873 - RNA, 19 nt, Homo sapiens
uuagguacuggauaugccc

SEQ ID NO: 324874 - RNA, 22 nt, Homo sapiens
uuagguagucucugucagaggg

SEQ ID NO: 324875 - RNA, 22 nt, Homo sapiens
uuaguagagacgagcguuccac

SEQ ID NO: 324876 - RNA, 22 nt, Homo sapiens
uuagugcaaacucuucaaugcu

SEQ ID NO: 324877 - RNA, 21 nt, Homo sapiens
uuagugcucaguuugacaaaa

SEQ ID NO: 324878 - RNA, 22 nt, Homo sapiens
uuagugcugaguggaauguucu

SEQ ID NO: 324879 - RNA, 22 nt, Homo sapiens
uuagugcuuacgaugagcuaag

SEQ ID NO: 324880 - RNA, 22 nt, Homo sapiens
uuauaacagagacuccugugcu

SEQ ID NO: 324881 - RNA, 20 nt, Homo sapiens
uuauagcuacaucuugacug

SEQ ID NO: 324882 - RNA, 21 nt, Homo sapiens
uuauaguggcaugauuuauaa

SEQ ID NO: 324883 - RNA, 22 nt, Homo sapiens
uuaucaaacccuaggagguggu

SEQ ID NO: 324884 - RNA, 22 nt, Homo sapiens
uuaucagcagcaugaaacugga

SEQ ID NO: 324885 - RNA, 21 nt, Homo sapiens
uuaucccagugucucugcagg

SEQ ID NO: 324886 - RNA, 22 nt, Homo sapiens
uuauccugucaguaaauauuuu

SEQ ID NO: 324887 - RNA, 22 nt, Homo sapiens
uuaucucagugaacugagugga

SEQ ID NO: 324888 - RNA, 22 nt, Homo sapiens
uuaugaaguagguuaagagcag

SEQ ID NO: 324889 - RNA, 22 nt, Homo sapiens
uuauggcaaugccccacuccua

SEQ ID NO: 324890 - RNA, 22 nt, Homo sapiens
uuaugguacaugugcacaaugu

SEQ ID NO: 324891 - RNA, 22 nt, Homo sapiens
uuauguaaaucaaucuggaauc

SEQ ID NO: 324892 - RNA, 22 nt, Homo sapiens
uuauuagcacccuaccaugugg

SEQ ID NO: 324893 - RNA, 22 nt, Homo sapiens
uuauuagguuaaccuauagcua

SEQ ID NO: 324894 - RNA, 22 nt, Homo sapiens
uuauuguccaaguuucccuuug

SEQ ID NO: 324895 - RNA, 22 nt, Homo sapiens
uuauuugguuauuguaauuggg

SEQ ID NO: 324896 - RNA, 22 nt, Homo sapiens
uuauuugguugcugacuuggaa

SEQ ID NO: 324897 - RNA, 22 nt, Homo sapiens
uucaaaaccucugcuuaagccc

SEQ ID NO: 324898 - RNA, 22 nt, Homo sapiens
uucaaaggauagauuaagauca

SEQ ID NO: 324899 - RNA, 23 nt, Homo sapiens
uucaaaggaugcuuuauggaauu

SEQ ID NO: 324900 - RNA, 22 nt, Homo sapiens
uucaaaguaaaaauguguucac

SEQ ID NO: 324901 - RNA, 22 nt, Homo sapiens
uucaaaguaaagggauggagac

SEQ ID NO: 324902 - RNA, 22 nt, Homo sapiens
uucaaaucuuuggcucccacua

SEQ ID NO: 324903 - RNA, 22 nt, Homo sapiens
uucaacugcuucagccucccaa

SEQ ID NO: 324904 - RNA, 22 nt, Homo sapiens
uucaaguaagaaagacaucagg

SEQ ID NO: 324905 - RNA, 22 nt, Homo sapiens
uucaaguaguucucaugccuca

SEQ ID NO: 324906 - RNA, 22 nt, Homo sapiens
uucaagugguucagaagucuga

SEQ ID NO: 324907 - RNA, 22 nt, Homo sapiens
uucaauacuguugauccuuaug

SEQ ID NO: 324908 - RNA, 22 nt, Homo sapiens
uucacagcuuaauaaggcucag

SEQ ID NO: 324909 - RNA, 20 nt, Homo sapiens
uucacaggcagcuucuuucu

SEQ ID NO: 324910 - RNA, 22 nt, Homo sapiens
uucaccuugggucccacuugcu

SEQ ID NO: 324911 - RNA, 22 nt, Homo sapiens
uucacugagccagacuaagaca

SEQ ID NO: 324912 - RNA, 22 nt, Homo sapiens
uucacugcacuccagccugagc

SEQ ID NO: 324913 - RNA, 22 nt, Homo sapiens
uucacugcauuucagccugggc

SEQ ID NO: 324914 - RNA, 22 nt, Homo sapiens
uucacugugugacccugggcca

SEQ ID NO: 324915 - RNA, 22 nt, Homo sapiens
uucagaguggacagaaauuaag

SEQ ID NO: 324916 - RNA, 22 nt, Homo sapiens
uucagaucaucccagcuccacu

SEQ ID NO: 324917 - RNA, 22 nt, Homo sapiens
uagucccauaugauuuagugaa

SEQ ID NO: 324918 - RNA, 22 nt, Homo sapiens
uagugaaugucacuggcuguug

SEQ ID NO: 324919 - RNA, 22 nt, Homo sapiens
uagugaauguuggcuauuaaua

SEQ ID NO: 324920 - RNA, 22 nt, Homo sapiens
uagugcugugauaaacauauau

SEQ ID NO: 324921 - RNA, 22 nt, Homo sapiens
uaguugcauuggcugcuaugcu

SEQ ID NO: 324922 - RNA, 22 nt, Homo sapiens
uaguuguugcagguaggaugua

SEQ ID NO: 324923 - RNA, 22 nt, Homo sapiens
uauaacaaugcaagaauggccu

SEQ ID NO: 324924 - RNA, 20 nt, Homo sapiens
uauaacaguuuggacccagu

SEQ ID NO: 324925 - RNA, 23 nt, Homo sapiens
uauaacuuuuaauuuacuggccu

SEQ ID NO: 324926 - RNA, 22 nt, Homo sapiens
uauacagcaaguuacugugcug

SEQ ID NO: 324927 - RNA, 22 nt, Homo sapiens
uauacaugugccauguuggugu

SEQ ID NO: 324928 - RNA, 22 nt, Homo sapiens
uauaccacugauuuuauucuga

SEQ ID NO: 324929 - RNA, 20 nt, Homo sapiens
uauagcaauuuuuuucuccu

SEQ ID NO: 324930 - RNA, 22 nt, Homo sapiens
uauagcauuuugauccuguaga

SEQ ID NO: 324931 - RNA, 22 nt, Homo sapiens
uauagcuaugggauguauuugc

SEQ ID NO: 324932 - RNA, 22 nt, Homo sapiens
uauagcuugauuauggugaugg

SEQ ID NO: 324933 - RNA, 22 nt, Homo sapiens
uauaugcuaaacaagggguggg

SEQ ID NO: 324934 - RNA, 22 nt, Homo sapiens
uauaugucuucuuguaauuggc

SEQ ID NO: 324935 - RNA, 22 nt, Homo sapiens
uauaugucuuuguuauguugag

SEQ ID NO: 324936 - RNA, 22 nt, Homo sapiens
uauauguuuucauaaggcuaga

SEQ ID NO: 324937 - RNA, 22 nt, Homo sapiens
uaucaagaugacaaacuuugcu

SEQ ID NO: 324938 - RNA, 23 nt, Homo sapiens
uaucacacuuucucugugccaca

SEQ ID NO: 324939 - RNA, 20 nt, Homo sapiens
uaucacaggucagaaacccu

SEQ ID NO: 324940 - RNA, 22 nt, Homo sapiens
uaucacagguggacugcacacc

SEQ ID NO: 324941 - RNA, 22 nt, Homo sapiens
uaucacaguugcauauuuaagg

SEQ ID NO: 324942 - RNA, 21 nt, Homo sapiens
uaucacauuggugauuaaguu

SEQ ID NO: 324943 - RNA, 22 nt, Homo sapiens
uaucaccuugguagucuugggg

SEQ ID NO: 324944 - RNA, 22 nt, Homo sapiens
uaucagcacaguggguucaugg

SEQ ID NO: 324945 - RNA, 22 nt, Homo sapiens
uaucauaguuuggacuuucauu

SEQ ID NO: 324946 - RNA, 22 nt, Homo sapiens
uaucaucauuggcaggugagaa

SEQ ID NO: 324947 - RNA, 21 nt, Homo sapiens
uauccacuugcaacagagaag

SEQ ID NO: 324948 - RNA, 21 nt, Homo sapiens
uaucccagucacaucuaccca

SEQ ID NO: 324949 - RNA, 20 nt, Homo sapiens
uaugaaacaguguagagcaa

SEQ ID NO: 324950 - RNA, 22 nt, Homo sapiens
uaugaaagcuacuucucacaau

SEQ ID NO: 324951 - RNA, 22 nt, Homo sapiens
uaugaauuuuauccaggauaua

SEQ ID NO: 324952 - RNA, 20 nt, Homo sapiens
uaugacaaagccuagugagu

SEQ ID NO: 324953 - RNA, 22 nt, Homo sapiens
uaugacucagaaggcacacaca

SEQ ID NO: 324954 - RNA, 22 nt, Homo sapiens
uaugacuuuugaauacagaugg

SEQ ID NO: 324955 - RNA, 22 nt, Homo sapiens
uaugagcacauauguaucuaug

SEQ ID NO: 324956 - RNA, 19 nt, Homo sapiens
uaugagcuaugacaugcau

SEQ ID NO: 324957 - RNA, 22 nt, Homo sapiens
uaugaugcuguuuagaaucucu

SEQ ID NO: 324958 - RNA, 22 nt, Homo sapiens
uaugauuuuugggagaggucaa

SEQ ID NO: 324959 - RNA, 22 nt, Homo sapiens
uaugcccauuuaaauugaacaa

SEQ ID NO: 324960 - RNA, 22 nt, Homo sapiens
uaugccuuuugguucaagcaac

SEQ ID NO: 324961 - RNA, 19 nt, Homo sapiens
uaugcuagagagggaagcu

SEQ ID NO: 324962 - RNA, 22 nt, Homo sapiens
uaugcuguuucugauuuaggga

SEQ ID NO: 324963 - RNA, 22 nt, Homo sapiens
uaugcuuguuuauuuaagaaac

SEQ ID NO: 324964 - RNA, 22 nt, Homo sapiens
uauggcauguauguguggcgca

SEQ ID NO: 324965 - RNA, 22 nt, Homo sapiens
uauggcauuguuggugaugaua

SEQ ID NO: 324966 - RNA, 21 nt, Homo sapiens
uauggcuuagucaguguuucc

SEQ ID NO: 324967 - RNA, 22 nt, Homo sapiens
uauggguguuauugcaugggag

SEQ ID NO: 324968 - RNA, 19 nt, Homo sapiens
uauguaguuuucucaauau

SEQ ID NO: 324969 - RNA, 22 nt, Homo sapiens
uaugucaugggguuuuugagau

SEQ ID NO: 324970 - RNA, 22 nt, Homo sapiens
uaugucuuuugcuugcaaauag

SEQ ID NO: 324971 - RNA, 22 nt, Homo sapiens
uaugugcuuuguuaaacagaug

SEQ ID NO: 324972 - RNA, 22 nt, Homo sapiens
uauuacauccauaggcucugcu

SEQ ID NO: 324973 - RNA, 22 nt, Homo sapiens
uauuacuguuauuccuaucaaa

SEQ ID NO: 324974 - RNA, 22 nt, Homo sapiens
uauuacuugucugugucucaau

SEQ ID NO: 324975 - RNA, 22 nt, Homo sapiens
uauuagguuggugcaaaaguua

SEQ ID NO: 324976 - RNA, 22 nt, Homo sapiens
uauuagguuggugcaacaguaa

SEQ ID NO: 324977 - RNA, 22 nt, Homo sapiens
uauuauagugauaggucuacug

SEQ ID NO: 324978 - RNA, 18 nt, Homo sapiens
uauuccucuuccucuauc

SEQ ID NO: 324979 - RNA, 22 nt, Homo sapiens
uauuccuuuugcauuuccacau

SEQ ID NO: 324980 - RNA, 22 nt, Homo sapiens
uauugaacuggaucagaaggcc

SEQ ID NO: 324981 - RNA, 22 nt, Homo sapiens
uauugaauuugagcugucucuu

SEQ ID NO: 324982 - RNA, 22 nt, Homo sapiens
uauugacuugagaagggauuag

SEQ ID NO: 324983 - RNA, 22 nt, Homo sapiens
uauugcaaauggugaucccagg

SEQ ID NO: 324984 - RNA, 22 nt, Homo sapiens
uauugcaauuggggaaacuggg

SEQ ID NO: 324985 - RNA, 22 nt, Homo sapiens
uauugcacuccucaugcauuug

SEQ ID NO: 324986 - RNA, 22 nt, Homo sapiens
uauugcagaaugugaguuggca

SEQ ID NO: 324987 - RNA, 22 nt, Homo sapiens
uauugcagauacccaggaaguu

SEQ ID NO: 324988 - RNA, 20 nt, Homo sapiens
uauugccuaaauaccagaau

SEQ ID NO: 324989 - RNA, 22 nt, Homo sapiens
uauugcuccuaauaucacggug

SEQ ID NO: 324990 - RNA, 22 nt, Homo sapiens
uauugcugaugcugaagggaag

SEQ ID NO: 324991 - RNA, 22 nt, Homo sapiens
uauugcuuaugaugcugaauua

SEQ ID NO: 324992 - RNA, 22 nt, Homo sapiens
uauugcuuuuaacccaaucucu

SEQ ID NO: 324993 - RNA, 22 nt, Homo sapiens
uauugcuuuugauucaaggcag

SEQ ID NO: 324994 - RNA, 22 nt, Homo sapiens
uauugucaccaucccuguuuua

SEQ ID NO: 324995 - RNA, 22 nt, Homo sapiens
uauuuggauagucuggaaaaaa

SEQ ID NO: 324996 - RNA, 22 nt, Homo sapiens
uauuugguagcuauuuugcagu

SEQ ID NO: 324997 - RNA, 22 nt, Homo sapiens
uauuugguuggugcaaaaguaa

SEQ ID NO: 324998 - RNA, 22 nt, Homo sapiens
ucaaaaucucuuagcugugucu

SEQ ID NO: 324999 - RNA, 22 nt, Homo sapiens
ucaaacugcuugaggccauuua

SEQ ID NO: 325000 - RNA, 22 nt, Homo sapiens
ucaaaguaaagccucaggaugg

SEQ ID NO: 325001 - RNA, 22 nt, Homo sapiens
ucaaaguauucuucugagaacc

SEQ ID NO: 325002 - RNA, 18 nt, Homo sapiens
ucaaauacuuugggcagu

SEQ ID NO: 325003 - RNA, 22 nt, Homo sapiens
ucaaaugauucacccaccuuug

SEQ ID NO: 325004 - RNA, 22 nt, Homo sapiens
ucaaaugauucagaagccaccu

SEQ ID NO: 325005 - RNA, 22 nt, Homo sapiens
ucaaaugguccacgugaacauu

SEQ ID NO: 325006 - RNA, 21 nt, Homo sapiens
ucaaauugaaauuaggucauu

SEQ ID NO: 325007 - RNA, 22 nt, Homo sapiens
ucaacugcuugagaucacaaau

SEQ ID NO: 325008 - RNA, 22 nt, Homo sapiens
ucaagcaauucuccugccucag

SEQ ID NO: 325009 - RNA, 22 nt, Homo sapiens
uucagcuaccugggaugcugaa

SEQ ID NO: 325010 - RNA, 22 nt, Homo sapiens
uucaggcuccgugccagcuccg

SEQ ID NO: 325011 - RNA, 22 nt, Homo sapiens
uucaggguggagaguaugaggu

SEQ ID NO: 325012 - RNA, 22 nt, Homo sapiens
uucaguacuucaaaaucuuuaa

SEQ ID NO: 325013 - RNA, 22 nt, Homo sapiens
uucaguagucuccauagaaccg

SEQ ID NO: 325014 - RNA, 18 nt, Homo sapiens
uucagugaauucuuuuga

SEQ ID NO: 325015 - RNA, 20 nt, Homo sapiens
uucagugcagguaacaaucc

SEQ ID NO: 325016 - RNA, 22 nt, Homo sapiens
uucagugccuggaagucgugcu

SEQ ID NO: 325017 - RNA, 22 nt, Homo sapiens
uucaguggacuuaguagugcuu

SEQ ID NO: 325018 - RNA, 22 nt, Homo sapiens
uucaguugcaucaguugaccag

SEQ ID NO: 325019 - RNA, 22 nt, Homo sapiens
uucauaguaacaguaacuaugg

SEQ ID NO: 325020 - RNA, 18 nt, Homo sapiens
uucauaguagcaugauuu

SEQ ID NO: 325021 - RNA, 22 nt, Homo sapiens
uucauagugaaaaauucaaagu

SEQ ID NO: 325022 - RNA, 22 nt, Homo sapiens
uucauaguguuuccuuccagug

SEQ ID NO: 325023 - RNA, 21 nt, Homo sapiens
uucauaugcacugagugccca

SEQ ID NO: 325024 - RNA, 18 nt, Homo sapiens
uucauauguugaaccaga

SEQ ID NO: 325025 - RNA, 22 nt, Homo sapiens
uucaucagcuguagaugucaug

SEQ ID NO: 325026 - RNA, 22 nt, Homo sapiens
uucaucagggguauuggccaau

SEQ ID NO: 325027 - RNA, 18 nt, Homo sapiens
uucaucaguccucagcug

SEQ ID NO: 325028 - RNA, 22 nt, Homo sapiens
uucauccccuccaaaucucaug

SEQ ID NO: 325029 - RNA, 22 nt, Homo sapiens
uucaucuggcaauucagagauu

SEQ ID NO: 325030 - RNA, 21 nt, Homo sapiens
uucaucuggccguauuccagg

SEQ ID NO: 325031 - RNA, 22 nt, Homo sapiens
uucauggaauauugaccauuuu

SEQ ID NO: 325032 - RNA, 22 nt, Homo sapiens
uucauggaguuuaaauuguagu

SEQ ID NO: 325033 - RNA, 22 nt, Homo sapiens
uucauggaugcauuugaggggu

SEQ ID NO: 325034 - RNA, 22 nt, Homo sapiens
uucauguaauauuucacagcuu

SEQ ID NO: 325035 - RNA, 22 nt, Homo sapiens
uucauguagucaucauccugcu

SEQ ID NO: 325036 - RNA, 22 nt, Homo sapiens
uucauugaaugauuuuuagaag

SEQ ID NO: 325037 - RNA, 22 nt, Homo sapiens
uuccaauguuccguguugcagu

SEQ ID NO: 325038 - RNA, 22 nt, Homo sapiens
uuccacaaugguugaacuaauu

SEQ ID NO: 325039 - RNA, 22 nt, Homo sapiens
uuccacaaugguugaacuagcu

SEQ ID NO: 325040 - RNA, 22 nt, Homo sapiens
uuccacagggauuugcauugau

SEQ ID NO: 325041 - RNA, 22 nt, Homo sapiens
uuccacuuuuuccuugugcucc

SEQ ID NO: 325042 - RNA, 22 nt, Homo sapiens
uuccagagucaccuuucugucg

SEQ ID NO: 325043 - RNA, 22 nt, Homo sapiens
uuccauaggcuagaucaaccag

SEQ ID NO: 325044 - RNA, 22 nt, Homo sapiens
uuccaugagaugcaucaaagcu

SEQ ID NO: 325045 - RNA, 22 nt, Homo sapiens
uuccauguaguugagcaguuuu

SEQ ID NO: 325046 - RNA, 22 nt, Homo sapiens
uuccauguugauacgugaaguu

SEQ ID NO: 325047 - RNA, 22 nt, Homo sapiens
uucccaguggaacauguaguca

SEQ ID NO: 325048 - RNA, 22 nt, Homo sapiens
uuccccgugaaacuuucucauu

SEQ ID NO: 325049 - RNA, 22 nt, Homo sapiens
uucccgggguggaaugcaguga

SEQ ID NO: 325050 - RNA, 22 nt, Homo sapiens
uucccuguaucuucugccaugu

SEQ ID NO: 325051 - RNA, 22 nt, Homo sapiens
uucccuuugaauuggaaaggug

SEQ ID NO: 325052 - RNA, 22 nt, Homo sapiens
uuccuguagcgauuuuaguaau

SEQ ID NO: 325053 - RNA, 22 nt, Homo sapiens
uuccugucuuccaagagagauu

SEQ ID NO: 325054 - RNA, 22 nt, Homo sapiens
uuccuuaguuauuugguccccu

SEQ ID NO: 325055 - RNA, 22 nt, Homo sapiens
uuccuugagaaaguacaaggcu

SEQ ID NO: 325056 - RNA, 22 nt, Homo sapiens
uuccuugagucuuuuuccugag

SEQ ID NO: 325057 - RNA, 22 nt, Homo sapiens
uuccuugguucagggaaggucc

SEQ ID NO: 325058 - RNA, 22 nt, Homo sapiens
uuccuuguagcaaaugcgauga

SEQ ID NO: 325059 - RNA, 22 nt, Homo sapiens
uuccuuguuuauuuacaggagg

SEQ ID NO: 325060 - RNA, 23 nt, Homo sapiens
uucggcaaaugcccuuuaggcag

SEQ ID NO: 325061 - RNA, 22 nt, Homo sapiens
uucguuuguaauccuuacagca

SEQ ID NO: 325062 - RNA, 22 nt, Homo sapiens
uucuaaacaucuuacaaugcau

SEQ ID NO: 325063 - RNA, 22 nt, Homo sapiens
uucuaaguaauuuugcaugccu

SEQ ID NO: 325064 - RNA, 23 nt, Homo sapiens
uucuaucaggcccaggagcccug

SEQ ID NO: 325065 - RNA, 22 nt, Homo sapiens
uucuaugguuaccaggcuaguc

SEQ ID NO: 325066 - RNA, 22 nt, Homo sapiens
uucucacaguacagggagcucu

SEQ ID NO: 325067 - RNA, 22 nt, Homo sapiens
uucucagugcuaucuuuuaugc

SEQ ID NO: 325068 - RNA, 22 nt, Homo sapiens
uucucugggacauaggucgggu

SEQ ID NO: 325069 - RNA, 22 nt, Homo sapiens
uucugcacaucgaucacaagau

SEQ ID NO: 325070 - RNA, 22 nt, Homo sapiens
uucuggcuaugggauacuaaau

SEQ ID NO: 325071 - RNA, 22 nt, Homo sapiens
uucuggcucaggucaacacuuc

SEQ ID NO: 325072 - RNA, 22 nt, Homo sapiens
uucugugguagaaaucucaaau

SEQ ID NO: 325073 - RNA, 22 nt, Homo sapiens
uucuuagguuaaggcugagaga

SEQ ID NO: 325074 - RNA, 21 nt, Homo sapiens
uucuucaggcagaaggauuau

SEQ ID NO: 325075 - RNA, 22 nt, Homo sapiens
uucuugcugaauugugcccuuc

SEQ ID NO: 325076 - RNA, 22 nt, Homo sapiens
uucuugguugcucacacccauc

SEQ ID NO: 325077 - RNA, 22 nt, Homo sapiens
uucuugguuggcaaccaacagu

SEQ ID NO: 325078 - RNA, 22 nt, Homo sapiens
uucuuugcaugaucucaaaguc

SEQ ID NO: 325079 - RNA, 22 nt, Homo sapiens
uucuuugguacaagggccgacc

SEQ ID NO: 325080 - RNA, 23 nt, Homo sapiens
uugaaaagucaguagccucugau

SEQ ID NO: 325081 - RNA, 22 nt, Homo sapiens
uugaaagacagaggggcaaguu

SEQ ID NO: 325082 - RNA, 22 nt, Homo sapiens
uugaaagucuaggcuuacagua

SEQ ID NO: 325083 - RNA, 22 nt, Homo sapiens
uugaaauguuuagaaguuugga

SEQ ID NO: 325084 - RNA, 22 nt, Homo sapiens
uugaacuagaaccugcaaauuu

SEQ ID NO: 325085 - RNA, 22 nt, Homo sapiens
uugaagacuaauuuagauaaug

SEQ ID NO: 325086 - RNA, 22 nt, Homo sapiens
uugaaggaacgcuguucccuug

SEQ ID NO: 325087 - RNA, 22 nt, Homo sapiens
uugaaguagcauuucaugucua

SEQ ID NO: 325088 - RNA, 22 nt, Homo sapiens
uugaagugaagaacaauaucac

SEQ ID NO: 325089 - RNA, 22 nt, Homo sapiens
uugaaguguguauacauugugg

SEQ ID NO: 325090 - RNA, 22 nt, Homo sapiens
uugaauagugacuuugauucug

SEQ ID NO: 325091 - RNA, 22 nt, Homo sapiens
uugaauguaugcuggguuuacu

SEQ ID NO: 325092 - RNA, 22 nt, Homo sapiens
uugaaugucuauuaaguuguuu

SEQ ID NO: 325093 - RNA, 22 nt, Homo sapiens
uugacacuuuguaagaaagggg

SEQ ID NO: 325094 - RNA, 22 nt, Homo sapiens
uugacauaaucauuucacagug

SEQ ID NO: 325095 - RNA, 22 nt, Homo sapiens
uugacauauuugugcuuaagaa

SEQ ID NO: 325096 - RNA, 22 nt, Homo sapiens
uugacauugcuguaguguccag

SEQ ID NO: 325097 - RNA, 22 nt, Homo sapiens
uugacuacaccaugccaggaac

SEQ ID NO: 325098 - RNA, 22 nt, Homo sapiens
uugagacugagucucgcccugu

SEQ ID NO: 325099 - RNA, 22 nt, Homo sapiens
uugagauacauaauuaugaaug

SEQ ID NO: 325100 - RNA, 22 nt, Homo sapiens
uugagauauccauaaaugggaa

SEQ ID NO: 325101 - RNA, 22 nt, Homo sapiens
ugaccucugauagcaguaggug

SEQ ID NO: 325102 - RNA, 22 nt, Homo sapiens
ugacuaaaacugaguuucauua

SEQ ID NO: 325103 - RNA, 22 nt, Homo sapiens
ugacuacaaccuccaccucccg

SEQ ID NO: 325104 - RNA, 22 nt, Homo sapiens
ugacuacacacaauuugucaag

SEQ ID NO: 325105 - RNA, 22 nt, Homo sapiens
ugacuagacuugcaagguugca

SEQ ID NO: 325106 - RNA, 22 nt, Homo sapiens
ugacuaggaggcuggaggauga

SEQ ID NO: 325107 - RNA, 22 nt, Homo sapiens
ugacuagugcccuuugcugccu

SEQ ID NO: 325108 - RNA, 22 nt, Homo sapiens
ugacucaguuguuagucuucau

SEQ ID NO: 325109 - RNA, 22 nt, Homo sapiens
ugacucaguuucucagguagua

SEQ ID NO: 325110 - RNA, 22 nt, Homo sapiens
ugacuccagagacugugcuguc

SEQ ID NO: 325111 - RNA, 22 nt, Homo sapiens
ugacuggagaccucaguagggu

SEQ ID NO: 325112 - RNA, 22 nt, Homo sapiens
ugacuggagucuugcucugucg

SEQ ID NO: 325113 - RNA, 22 nt, Homo sapiens
ugacugguguuuaaugagucaa

SEQ ID NO: 325114 - RNA, 22 nt, Homo sapiens
ugacuugaucacccccuaaggg

SEQ ID NO: 325115 - RNA, 22 nt, Homo sapiens
ugagaacauuccucuuccuggc

SEQ ID NO: 325116 - RNA, 19 nt, Homo sapiens
ugagaaccucuacagaguc

SEQ ID NO: 325117 - RNA, 22 nt, Homo sapiens
ugagaacuaaugaagaauuuau

SEQ ID NO: 325118 - RNA, 22 nt, Homo sapiens
ugagaacuguuuugguuugggu

SEQ ID NO: 325119 - RNA, 22 nt, Homo sapiens
ugagaagaugaacuccuugguc

SEQ ID NO: 325120 - RNA, 22 nt, Homo sapiens
ugagaagcauaccagugucugu

SEQ ID NO: 325121 - RNA, 22 nt, Homo sapiens
ugagaagugacgcagcaggguu

SEQ ID NO: 325122 - RNA, 22 nt, Homo sapiens
ugagaauauuuuccaugucuca

SEQ ID NO: 325123 - RNA, 22 nt, Homo sapiens
ugagacaaucucaucucaguga

SEQ ID NO: 325124 - RNA, 22 nt, Homo sapiens
ugagacacugaauccggccuga

SEQ ID NO: 325125 - RNA, 22 nt, Homo sapiens
ugagacauacuuacaggggaug

SEQ ID NO: 325126 - RNA, 22 nt, Homo sapiens
ugagacauauuauacugcuuuu

SEQ ID NO: 325127 - RNA, 22 nt, Homo sapiens
ugagacaucacaaaauccucaa

SEQ ID NO: 325128 - RNA, 22 nt, Homo sapiens
ugagacgaagucuugcucuguu

SEQ ID NO: 325129 - RNA, 22 nt, Homo sapiens
ugagacggagucucgcucucua

SEQ ID NO: 325130 - RNA, 22 nt, Homo sapiens
ugagacggaguuucacucuugu

SEQ ID NO: 325131 - RNA, 22 nt, Homo sapiens
ugagacugagucucgcucuauu

SEQ ID NO: 325132 - RNA, 22 nt, Homo sapiens
ugagacugagucuugcucuauu

SEQ ID NO: 325133 - RNA, 22 nt, Homo sapiens
ugagacugaguuucacuuuugu

SEQ ID NO: 325134 - RNA, 22 nt, Homo sapiens
ugagacugaguuucgcucuugu

SEQ ID NO: 325135 - RNA, 22 nt, Homo sapiens
ugagacugaguuuugcucguug

SEQ ID NO: 325136 - RNA, 22 nt, Homo sapiens
ugagacugaguuuugcucuugu

SEQ ID NO: 325137 - RNA, 22 nt, Homo sapiens
ugagacuguuuuggggaacuuc

SEQ ID NO: 325138 - RNA, 22 nt, Homo sapiens
ugagagacauuuguuguagagu

SEQ ID NO: 325139 - RNA, 22 nt, Homo sapiens
ugagagcuuuuuugccugguga

SEQ ID NO: 325140 - RNA, 22 nt, Homo sapiens
ugagaguauaaauugaugcagc

SEQ ID NO: 325141 - RNA, 22 nt, Homo sapiens
ugagagucauacaaauaaaaau

SEQ ID NO: 325142 - RNA, 22 nt, Homo sapiens
ugagaucaaggugggcccuggg

SEQ ID NO: 325143 - RNA, 18 nt, Homo sapiens
ugagaucagcaucaaggg

SEQ ID NO: 325144 - RNA, 22 nt, Homo sapiens
ugagaucaugucauuugcacuc

SEQ ID NO: 325145 - RNA, 19 nt, Homo sapiens
ugagauccacugaagauuc

SEQ ID NO: 325146 - RNA, 22 nt, Homo sapiens
ugagaucgaguaucgcugucac

SEQ ID NO: 325147 - RNA, 22 nt, Homo sapiens
ugagaucgaguuucgcucuugu

SEQ ID NO: 325148 - RNA, 22 nt, Homo sapiens
ugagaucuuggaggcuuuguga

SEQ ID NO: 325149 - RNA, 22 nt, Homo sapiens
ugagaugaacuugauuguuuua

SEQ ID NO: 325150 - RNA, 19 nt, Homo sapiens
ugagaugaagacagggguu

SEQ ID NO: 325151 - RNA, 22 nt, Homo sapiens
ugagaugaagucucacucuguc

SEQ ID NO: 325152 - RNA, 22 nt, Homo sapiens
ugagaugaggucucacucuguu

SEQ ID NO: 325153 - RNA, 22 nt, Homo sapiens
ugagaugauagauauguuaauu

SEQ ID NO: 325154 - RNA, 22 nt, Homo sapiens
ugagaugauaucuuauuguaau

SEQ ID NO: 325155 - RNA, 22 nt, Homo sapiens
ugagaugaugggauaagagggc

SEQ ID NO: 325156 - RNA, 22 nt, Homo sapiens
ugagaugcauauucuggcuccu

SEQ ID NO: 325157 - RNA, 22 nt, Homo sapiens
ugagauggaguuucgcccuugu

SEQ ID NO: 325158 - RNA, 22 nt, Homo sapiens
ugagauggcugaauucagaaua

SEQ ID NO: 325159 - RNA, 22 nt, Homo sapiens
ugagauggcuuuauugcugaau

SEQ ID NO: 325160 - RNA, 22 nt, Homo sapiens
ugagauggguucugguccccug

SEQ ID NO: 325161 - RNA, 22 nt, Homo sapiens
ugagaugguaaauuuuuguugu

SEQ ID NO: 325162 - RNA, 22 nt, Homo sapiens
ugagauguagauauggauuaga

SEQ ID NO: 325163 - RNA, 23 nt, Homo sapiens
ugagaugucugauugcgaggguc

SEQ ID NO: 325164 - RNA, 22 nt, Homo sapiens
ugagaugugaagaucacaugaa

SEQ ID NO: 325165 - RNA, 22 nt, Homo sapiens
ugagauguggcuagagagguug

SEQ ID NO: 325166 - RNA, 22 nt, Homo sapiens
ugagauguuccaaugacuauua

SEQ ID NO: 325167 - RNA, 22 nt, Homo sapiens
ugagauguugcucugaaacaag

SEQ ID NO: 325168 - RNA, 21 nt, Homo sapiens
ugagauuaaguuguuuagaag

SEQ ID NO: 325169 - RNA, 22 nt, Homo sapiens
ugagauuaaucuuuaaguaaga

SEQ ID NO: 325170 - RNA, 22 nt, Homo sapiens
ugagauuacguucggcccacuu

SEQ ID NO: 325171 - RNA, 22 nt, Homo sapiens
ugagauuauauuucuuaacaga

SEQ ID NO: 325172 - RNA, 22 nt, Homo sapiens
ugagauuguaucugcaaugugu

SEQ ID NO: 325173 - RNA, 22 nt, Homo sapiens
ugagcaacauuucaaaacucca

SEQ ID NO: 325174 - RNA, 22 nt, Homo sapiens
ugagcagugagugugcugcagg

SEQ ID NO: 325175 - RNA, 22 nt, Homo sapiens
ugagcauauugugauaccuaaa

SEQ ID NO: 325176 - RNA, 22 nt, Homo sapiens
ugagcaucucuaaaaggagcaa

SEQ ID NO: 325177 - RNA, 22 nt, Homo sapiens
ugagccaaugauuugaauagag

SEQ ID NO: 325178 - RNA, 22 nt, Homo sapiens
ugagccaugguuagcuucucau

SEQ ID NO: 325179 - RNA, 22 nt, Homo sapiens
ugagcuagggccuggaauaggg

SEQ ID NO: 325180 - RNA, 22 nt, Homo sapiens
ugagcucaugcauucuugagga

SEQ ID NO: 325181 - RNA, 22 nt, Homo sapiens
ugagcugagacaauaaguuuuu

SEQ ID NO: 325182 - RNA, 22 nt, Homo sapiens
ugagcugagaucgugccauugu

SEQ ID NO: 325183 - RNA, 22 nt, Homo sapiens
ugagcuguuugaagaagcauuu

SEQ ID NO: 325184 - RNA, 22 nt, Homo sapiens
ugaggaacuagcuacccuaaua

SEQ ID NO: 325185 - RNA, 22 nt, Homo sapiens
ugaggaaugaccccgugugguc

SEQ ID NO: 325186 - RNA, 22 nt, Homo sapiens
ugaggaguauguucuguagacc

SEQ ID NO: 325187 - RNA, 22 nt, Homo sapiens
ugaggaguguauuucauucgcu

SEQ ID NO: 325188 - RNA, 22 nt, Homo sapiens
ugaggcuaggauaggcugauuc

SEQ ID NO: 325189 - RNA, 22 nt, Homo sapiens
ugagguaaaacaaggauuggau

SEQ ID NO: 325190 - RNA, 22 nt, Homo sapiens
ugagguaacaaacuaugaguua

SEQ ID NO: 325191 - RNA, 22 nt, Homo sapiens
ugagguaauagauaauauuuuu

SEQ ID NO: 325192 - RNA, 22 nt, Homo sapiens
ugagguaugacuuauuauucuu

SEQ ID NO: 325193 - RNA, 22 nt, Homo sapiens
ugagguauuuuguuaugcagcc

SEQ ID NO: 325194 - RNA, 22 nt, Homo sapiens
ugaggucauguucugucagguu

SEQ ID NO: 325195 - RNA, 22 nt, Homo sapiens
ugagguugaaggacauuuuuau

SEQ ID NO: 325196 - RNA, 22 nt, Homo sapiens
ugagguuggguaauuuaugaag

SEQ ID NO: 325197 - RNA, 22 nt, Homo sapiens
ugaguaauguugaucuuugaua

SEQ ID NO: 325198 - RNA, 22 nt, Homo sapiens
ugaguagaacaucaagucauac

SEQ ID NO: 325199 - RNA, 22 nt, Homo sapiens
ugaguagugccacaauaagcau

SEQ ID NO: 325200 - RNA, 22 nt, Homo sapiens
ugaguaugaguucaggaaaggc

SEQ ID NO: 325201 - RNA, 22 nt, Homo sapiens
ugagucaauggaggcucagagc

SEQ ID NO: 325202 - RNA, 22 nt, Homo sapiens
ugagucuguucucacauugcua

SEQ ID NO: 325203 - RNA, 21 nt, Homo sapiens
ugagugcugagugaggguuga

SEQ ID NO: 325204 - RNA, 17 nt, Homo sapiens
ugaguuaaucuuugugc

SEQ ID NO: 325205 - RNA, 22 nt, Homo sapiens
ugaguucaugcuuguaguucua

SEQ ID NO: 325206 - RNA, 22 nt, Homo sapiens
ugaguuccuugugugaccuugc

SEQ ID NO: 325207 - RNA, 22 nt, Homo sapiens
ugaguuccuuucccaguccagu

SEQ ID NO: 325208 - RNA, 22 nt, Homo sapiens
ugauaacauuucuucugguaca

SEQ ID NO: 325209 - RNA, 22 nt, Homo sapiens
ugauaagugaaagugcucuauc

SEQ ID NO: 325210 - RNA, 22 nt, Homo sapiens
ugauaggagauuuucaucugua

SEQ ID NO: 325211 - RNA, 22 nt, Homo sapiens
ugauagucauucaauuuagcca

SEQ ID NO: 325212 - RNA, 22 nt, Homo sapiens
ugauaugaaguucaaaccaggu

SEQ ID NO: 325213 - RNA, 21 nt, Homo sapiens
ugauaugguagaagagagaca

SEQ ID NO: 325214 - RNA, 22 nt, Homo sapiens
ugauauguaugugaccuagaaa

SEQ ID NO: 325215 - RNA, 22 nt, Homo sapiens
ugauaugucacuugaucauggu

SEQ ID NO: 325216 - RNA, 20 nt, Homo sapiens
ugauauuucuggaaguggag

SEQ ID NO: 325217 - RNA, 22 nt, Homo sapiens
ugaucaaagugcuggaauuaca

SEQ ID NO: 325218 - RNA, 22 nt, Homo sapiens
ugaucuguccaccucagcuucc

SEQ ID NO: 325219 - RNA, 22 nt, Homo sapiens
ugaugacauugucacagucuga

SEQ ID NO: 325220 - RNA, 22 nt, Homo sapiens
ugaugcugaguggcuauuugaa

SEQ ID NO: 325221 - RNA, 22 nt, Homo sapiens
ugauggcauuuggaguugggac

SEQ ID NO: 325222 - RNA, 22 nt, Homo sapiens
ugaugguccauaguucauggua

SEQ ID NO: 325223 - RNA, 22 nt, Homo sapiens
ugaugguguuaccaucuuuacu

SEQ ID NO: 325224 - RNA, 22 nt, Homo sapiens
ugaugguuuuauaagggagagu

SEQ ID NO: 325225 - RNA, 22 nt, Homo sapiens
ugauguauuauuaagaccuggc

SEQ ID NO: 325226 - RNA, 23 nt, Homo sapiens
ugauguccacuuagggucuaggu

SEQ ID NO: 325227 - RNA, 22 nt, Homo sapiens
ugauguugaauuguucagcguc

SEQ ID NO: 325228 - RNA, 22 nt, Homo sapiens
ugauuagagagcuggguguccu

SEQ ID NO: 325229 - RNA, 22 nt, Homo sapiens
ugauuagagcccaagcuuugaa

SEQ ID NO: 325230 - RNA, 18 nt, Homo sapiens
ugauugacuuauuuaggu

SEQ ID NO: 325231 - RNA, 22 nt, Homo sapiens
ugauuuguuucaggaguuuucu

SEQ ID NO: 325232 - RNA, 19 nt, Homo sapiens
ugcaaagucuuuuccuauu

SEQ ID NO: 325233 - RNA, 22 nt, Homo sapiens
ugcaaaugcugcuauuucucuu

SEQ ID NO: 325234 - RNA, 22 nt, Homo sapiens
ugcaaauguuaggugucauuau

SEQ ID NO: 325235 - RNA, 22 nt, Homo sapiens
ugcaaauguuauuuugguuucu

SEQ ID NO: 325236 - RNA, 22 nt, Homo sapiens
ugcaacacauugccccugcucu

SEQ ID NO: 325237 - RNA, 21 nt, Homo sapiens
ugcaagaaucaggaagcugcc

SEQ ID NO: 325238 - RNA, 22 nt, Homo sapiens
ugcaagucaucuguccuucaga

SEQ ID NO: 325239 - RNA, 22 nt, Homo sapiens
ugcaaguggauuuuuccccaga

SEQ ID NO: 325240 - RNA, 22 nt, Homo sapiens
ugcaauauccucuacuauaggu

SEQ ID NO: 325241 - RNA, 22 nt, Homo sapiens
ugcaaucaucgcuguuggccac

SEQ ID NO: 325242 - RNA, 17 nt, Homo sapiens
ugcaauuuaagcuagau

SEQ ID NO: 325243 - RNA, 22 nt, Homo sapiens
ugcaccacugcacugccugggu

SEQ ID NO: 325244 - RNA, 22 nt, Homo sapiens
ugcaccacugcacuucagccug

SEQ ID NO: 325245 - RNA, 22 nt, Homo sapiens
ugcaccauuacacuccaggcug

SEQ ID NO: 325246 - RNA, 22 nt, Homo sapiens
ugcacugucuugucgcauagca

SEQ ID NO: 325247 - RNA, 22 nt, Homo sapiens
ugcagaaucccuucagauccga

SEQ ID NO: 325248 - RNA, 16 nt, Homo sapiens
ugcagaguaggugaau

SEQ ID NO: 325249 - RNA, 22 nt, Homo sapiens
ugcagagucuguccugccugcc

SEQ ID NO: 325250 - RNA, 17 nt, Homo sapiens
ugcagcacacugauggg

SEQ ID NO: 325251 - RNA, 20 nt, Homo sapiens
ugcagcacugggaaugcagu

SEQ ID NO: 325252 - RNA, 22 nt, Homo sapiens
ugcaggauguucaguaauuucc

SEQ ID NO: 325253 - RNA, 22 nt, Homo sapiens
ugcagguaggcaguaucauuua

SEQ ID NO: 325254 - RNA, 22 nt, Homo sapiens
ugcaguacugucagacuucuua

SEQ ID NO: 325255 - RNA, 22 nt, Homo sapiens
ugcagugcaugacuguguuaug

SEQ ID NO: 325256 - RNA, 22 nt, Homo sapiens
ugcauacugaaauauuuuagag

SEQ ID NO: 325257 - RNA, 22 nt, Homo sapiens
ugcauagaauguucuguaaaua

SEQ ID NO: 325258 - RNA, 17 nt, Homo sapiens
ugcauaggcaggcucag

SEQ ID NO: 325259 - RNA, 17 nt, Homo sapiens
ugcauagugggaggaga

SEQ ID NO: 325260 - RNA, 22 nt, Homo sapiens
ugcauaugucuuuauagcagca

SEQ ID NO: 325261 - RNA, 22 nt, Homo sapiens
ugcauccauucuagacucaucu

SEQ ID NO: 325262 - RNA, 22 nt, Homo sapiens
ugcauggagauauacaguuuuu

SEQ ID NO: 325263 - RNA, 22 nt, Homo sapiens
ugcauggauguuugaacacacu

SEQ ID NO: 325264 - RNA, 20 nt, Homo sapiens
ugcauguccucacuuacuug

SEQ ID NO: 325265 - RNA, 22 nt, Homo sapiens
ugcauguucuuacucauacaug

SEQ ID NO: 325266 - RNA, 21 nt, Homo sapiens
ugcauuggagaauguuucuca

SEQ ID NO: 325267 - RNA, 21 nt, Homo sapiens
ugcauugucuugaguuuaaau

SEQ ID NO: 325268 - RNA, 22 nt, Homo sapiens
ugcauuguuccgaauguguccu

SEQ ID NO: 325269 - RNA, 22 nt, Homo sapiens
ugcauuguuuagaaacacuggg

SEQ ID NO: 325270 - RNA, 22 nt, Homo sapiens
ugccaacaugccuggcuguuuu

SEQ ID NO: 325271 - RNA, 22 nt, Homo sapiens
ugccaacugguuucuuuuaguu

SEQ ID NO: 325272 - RNA, 20 nt, Homo sapiens
ugccaagaugacuauagcuc

SEQ ID NO: 325273 - RNA, 22 nt, Homo sapiens
ugccagaugugcccucuccacc

SEQ ID NO: 325274 - RNA, 22 nt, Homo sapiens
ugccaguauuuuauugaagauu

SEQ ID NO: 325275 - RNA, 20 nt, Homo sapiens
ugccagugugucaauuuaua

SEQ ID NO: 325276 - RNA, 22 nt, Homo sapiens
ugccaguguugccuuucacuag

SEQ ID NO: 325277 - RNA, 22 nt, Homo sapiens
ugccauagagacucaacagccu

SEQ ID NO: 325278 - RNA, 22 nt, Homo sapiens
ugcccuuugucagaugaguagg

SEQ ID NO: 325279 - RNA, 22 nt, Homo sapiens
ugccuacugaauuuaccuggcu

SEQ ID NO: 325280 - RNA, 22 nt, Homo sapiens
ugccuacuuugcaucugucagg

SEQ ID NO: 325281 - RNA, 22 nt, Homo sapiens
ugccuaggcuggaaugcagugg

SEQ ID NO: 325282 - RNA, 22 nt, Homo sapiens
ugccuaggcuggaguguagugg

SEQ ID NO: 325283 - RNA, 22 nt, Homo sapiens
ugccuaguggccuuaugaguau

SEQ ID NO: 325284 - RNA, 22 nt, Homo sapiens
ugccugagccagguuuuaggag

SEQ ID NO: 325285 - RNA, 22 nt, Homo sapiens
ugccugcugucuaauauauucu

SEQ ID NO: 325286 - RNA, 22 nt, Homo sapiens
uugacuuagacauucaguugga

SEQ ID NO: 325287 - RNA, 22 nt, Homo sapiens
uugacuuuuaggaggaaaauga

SEQ ID NO: 325288 - RNA, 22 nt, Homo sapiens
uugacuuuuauucacucugcua

SEQ ID NO: 325289 - RNA, 22 nt, Homo sapiens
uugagaagugucuguucauguc

SEQ ID NO: 325290 - RNA, 22 nt, Homo sapiens
uugagacgaagucucacucuug

SEQ ID NO: 325291 - RNA, 22 nt, Homo sapiens
uugagagagaacauuuguuaca

SEQ ID NO: 325292 - RNA, 22 nt, Homo sapiens
uugagauagaauaggaauggga

SEQ ID NO: 325293 - RNA, 22 nt, Homo sapiens
uugagaucaugcuacugcacuc

SEQ ID NO: 325294 - RNA, 22 nt, Homo sapiens
uugagaugaagucuugcucucu

SEQ ID NO: 325295 - RNA, 22 nt, Homo sapiens
uugagaugaaguuuugcucuuu

SEQ ID NO: 325296 - RNA, 22 nt, Homo sapiens
uugagauggagucucacucuuu

SEQ ID NO: 325297 - RNA, 22 nt, Homo sapiens
uugagauggagucucacugugu

SEQ ID NO: 325298 - RNA, 22 nt, Homo sapiens
uugagauggagucucgcucugu

SEQ ID NO: 325299 - RNA, 22 nt, Homo sapiens
uugagauggagucucguucugu

SEQ ID NO: 325300 - RNA, 22 nt, Homo sapiens
uugagcaauccuccugccaugu

SEQ ID NO: 325301 - RNA, 22 nt, Homo sapiens
uugagcacugucugugugcagu

SEQ ID NO: 325302 - RNA, 22 nt, Homo sapiens
uugagccaaggauugucuuucc

SEQ ID NO: 325303 - RNA, 22 nt, Homo sapiens
uugagcccuggagguggaggcu

SEQ ID NO: 325304 - RNA, 21 nt, Homo sapiens
uugagcuuuuaguacagacag

SEQ ID NO: 325305 - RNA, 22 nt, Homo sapiens
uugagggaaacauucacaucau

SEQ ID NO: 325306 - RNA, 22 nt, Homo sapiens
uugagggagccuguuagucccg

SEQ ID NO: 325307 - RNA, 22 nt, Homo sapiens
uugagggcugaauaccaaucag

SEQ ID NO: 325308 - RNA, 22 nt, Homo sapiens
uugagguaguacuuauuauugg

SEQ ID NO: 325309 - RNA, 22 nt, Homo sapiens
uugagguauaaagguagguugu

SEQ ID NO: 325310 - RNA, 20 nt, Homo sapiens
uugaggucaggaguuuggga

SEQ ID NO: 325311 - RNA, 22 nt, Homo sapiens
uugaguaguaagaagaugauag

SEQ ID NO: 325312 - RNA, 22 nt, Homo sapiens
uugaguauuugcagucugaaca

SEQ ID NO: 325313 - RNA, 22 nt, Homo sapiens
uugagugaaggcuguguucuug

SEQ ID NO: 325314 - RNA, 22 nt, Homo sapiens
uugauagacaucugaguuguug

SEQ ID NO: 325315 - RNA, 22 nt, Homo sapiens
uugauaugguauaagauuucau

SEQ ID NO: 325316 - RNA, 22 nt, Homo sapiens
uugauauuacucaguaacagau

SEQ ID NO: 325317 - RNA, 22 nt, Homo sapiens
uugauauucugagaagcugaag

SEQ ID NO: 325318 - RNA, 22 nt, Homo sapiens
uugauccucugagaaucuaucg

SEQ ID NO: 325319 - RNA, 22 nt, Homo sapiens
uugauguguuuccaggauuugu

SEQ ID NO: 325320 - RNA, 22 nt, Homo sapiens
uugauuagauccaguugauuga

SEQ ID NO: 325321 - RNA, 20 nt, Homo sapiens
uugauucccucuaaacucgc

SEQ ID NO: 325322 - RNA, 22 nt, Homo sapiens
uugcaaacaucuuguuucacau

SEQ ID NO: 325323 - RNA, 21 nt, Homo sapiens
uugcaaaugcugcugccugau

SEQ ID NO: 325324 - RNA, 22 nt, Homo sapiens
uugcaacauguauucuggugau

SEQ ID NO: 325325 - RNA, 22 nt, Homo sapiens
uugcaacuuagaaaaaucauuu

SEQ ID NO: 325326 - RNA, 22 nt, Homo sapiens
uugcacaauccugugagugagu

SEQ ID NO: 325327 - RNA, 22 nt, Homo sapiens
uugcacagucuagcuccaccuu

SEQ ID NO: 325328 - RNA, 22 nt, Homo sapiens
uugcacauggcaggugcucaau

SEQ ID NO: 325329 - RNA, 22 nt, Homo sapiens
uugcacauggcuggggaggccu

SEQ ID NO: 325330 - RNA, 22 nt, Homo sapiens
uugcacauugauuuuguaucuu

SEQ ID NO: 325331 - RNA, 22 nt, Homo sapiens
uugcacauugcaccuuuuguau

SEQ ID NO: 325332 - RNA, 22 nt, Homo sapiens
uugcaccacugcacuccacccu

SEQ ID NO: 325333 - RNA, 22 nt, Homo sapiens
uugcaccuuaugucuguucucu

SEQ ID NO: 325334 - RNA, 22 nt, Homo sapiens
uugcacuauaggaaaauguguc

SEQ ID NO: 325335 - RNA, 22 nt, Homo sapiens
uugcacuccggccuggguaaca

SEQ ID NO: 325336 - RNA, 22 nt, Homo sapiens
uugcacucuccagccucggcaa

SEQ ID NO: 325337 - RNA, 22 nt, Homo sapiens
uugcacuucauguaggccaaag

SEQ ID NO: 325338 - RNA, 22 nt, Homo sapiens
uugcagagaaauuucugguuua

SEQ ID NO: 325339 - RNA, 22 nt, Homo sapiens
uugcagcaaauaggaaugagga

SEQ ID NO: 325340 - RNA, 22 nt, Homo sapiens
uugcagcauucugguuccuggu

SEQ ID NO: 325341 - RNA, 22 nt, Homo sapiens
uugcauaaguugaaccagccuu

SEQ ID NO: 325342 - RNA, 22 nt, Homo sapiens
uugcauagacaauauuaaucuu

SEQ ID NO: 325343 - RNA, 22 nt, Homo sapiens
uugcauauguugaaccaagcgu

SEQ ID NO: 325344 - RNA, 19 nt, Homo sapiens
uugcauauguugaaccagg

SEQ ID NO: 325345 - RNA, 22 nt, Homo sapiens
uugcaucagcaggcauaauugg

SEQ ID NO: 325346 - RNA, 22 nt, Homo sapiens
uugcaucagcuccugauguacu

SEQ ID NO: 325347 - RNA, 18 nt, Homo sapiens
uugcaucauuuuguuguu

SEQ ID NO: 325348 - RNA, 22 nt, Homo sapiens
uugcaugggagcugggugaagc

SEQ ID NO: 325349 - RNA, 22 nt, Homo sapiens
uugcaugucauaacugauggaa

SEQ ID NO: 325350 - RNA, 22 nt, Homo sapiens
uugcauuuucuaggagggcaaa

SEQ ID NO: 325351 - RNA, 22 nt, Homo sapiens
uugccaacauggugaacuccca

SEQ ID NO: 325352 - RNA, 22 nt, Homo sapiens
uugccauggaguagaauugaag

SEQ ID NO: 325353 - RNA, 22 nt, Homo sapiens
uugccuaggcuggagugcagua

SEQ ID NO: 325354 - RNA, 22 nt, Homo sapiens
uugccuauucacucugaugaua

SEQ ID NO: 325355 - RNA, 22 nt, Homo sapiens
uugcuagagaugagggaugugu

SEQ ID NO: 325356 - RNA, 22 nt, Homo sapiens
uugcugagucuuucuagguugc

SEQ ID NO: 325357 - RNA, 20 nt, Homo sapiens
uugcugguguuagaggaggc

SEQ ID NO: 325358 - RNA, 22 nt, Homo sapiens
uugcugguuuucauaugagcag

SEQ ID NO: 325359 - RNA, 22 nt, Homo sapiens
uugcuuagagccaaucuugauu

SEQ ID NO: 325360 - RNA, 22 nt, Homo sapiens
uugcuuaggcuggagugcagug

SEQ ID NO: 325361 - RNA, 22 nt, Homo sapiens
uugcuuagucaugaaucacuga

SEQ ID NO: 325362 - RNA, 22 nt, Homo sapiens
uugcuucauucaacauugaggg

SEQ ID NO: 325363 - RNA, 22 nt, Homo sapiens
uugcuuuguugucuggggaaua

SEQ ID NO: 325364 - RNA, 22 nt, Homo sapiens
uuggaaaaauccaccuugaucu

SEQ ID NO: 325365 - RNA, 22 nt, Homo sapiens
uuggaaacgucaccuuuuccuu

SEQ ID NO: 325366 - RNA, 22 nt, Homo sapiens
uuggaagacauucugucugcua

SEQ ID NO: 325367 - RNA, 22 nt, Homo sapiens
uuggaagagaagggagauaaac

SEQ ID NO: 325368 - RNA, 22 nt, Homo sapiens
uuggaaggcugaauggccucuc

SEQ ID NO: 325369 - RNA, 22 nt, Homo sapiens
uuggaaguguguauguauagcu

SEQ ID NO: 325370 - RNA, 22 nt, Homo sapiens
uuggaauacucaaaagguuggg

SEQ ID NO: 325371 - RNA, 22 nt, Homo sapiens
uuggaauguauggcaucuugcg

SEQ ID NO: 325372 - RNA, 22 nt, Homo sapiens
uuggaauuaagagauauuuucu

SEQ ID NO: 325373 - RNA, 22 nt, Homo sapiens
uuggacuucuaacugacaugga

SEQ ID NO: 325374 - RNA, 22 nt, Homo sapiens
uuggacuuuuauucugcaggca

SEQ ID NO: 325375 - RNA, 22 nt, Homo sapiens
uuggaguguucugguccgggcu

SEQ ID NO: 325376 - RNA, 22 nt, Homo sapiens
uuggaugauaaagaagccuaag

SEQ ID NO: 325377 - RNA, 22 nt, Homo sapiens
uuggauuuuaacaaacuaggug

SEQ ID NO: 325378 - RNA, 22 nt, Homo sapiens
uuggcaaaugucacaaaucagg

SEQ ID NO: 325379 - RNA, 22 nt, Homo sapiens
augaugcugcaguuguugccaa

SEQ ID NO: 325380 - RNA, 22 nt, Homo sapiens
augauuuuuguaucgccugaug

SEQ ID NO: 325381 - RNA, 22 nt, Homo sapiens
augcaaacagcuaucuggcugg

SEQ ID NO: 325382 - RNA, 20 nt, Homo sapiens
augcaaacccugcuuugugg

SEQ ID NO: 325383 - RNA, 22 nt, Homo sapiens
augcaagcacacaagaggaaau

SEQ ID NO: 325384 - RNA, 22 nt, Homo sapiens
augcacaguccagcccaugugg

SEQ ID NO: 325385 - RNA, 22 nt, Homo sapiens
augcacauggcuaacuuuuuuc

SEQ ID NO: 325386 - RNA, 22 nt, Homo sapiens
augcacuguuguuauuggauaa

SEQ ID NO: 325387 - RNA, 22 nt, Homo sapiens
augcacuuggcaggaugauucc

SEQ ID NO: 325388 - RNA, 22 nt, Homo sapiens
augcagagucccagccccuagc

SEQ ID NO: 325389 - RNA, 22 nt, Homo sapiens
augcagauauuuuugugguugc

SEQ ID NO: 325390 - RNA, 22 nt, Homo sapiens
augcauagugggaugcucugug

SEQ ID NO: 325391 - RNA, 18 nt, Homo sapiens
augcauauuuuaaguugu

SEQ ID NO: 325392 - RNA, 22 nt, Homo sapiens
augcaugucaaauuuguagguu

SEQ ID NO: 325393 - RNA, 22 nt, Homo sapiens
augccaagaugagcacgcgucu

SEQ ID NO: 325394 - RNA, 22 nt, Homo sapiens
augccacugcacuccaaccugg

SEQ ID NO: 325395 - RNA, 22 nt, Homo sapiens
augccacugcauaagguuuuca

SEQ ID NO: 325396 - RNA, 22 nt, Homo sapiens
augccacuguccuccugccuag

SEQ ID NO: 325397 - RNA, 22 nt, Homo sapiens
augccagggagaauuguucaag

SEQ ID NO: 325398 - RNA, 22 nt, Homo sapiens
augcuacauucuacaauuaggc

SEQ ID NO: 325399 - RNA, 22 nt, Homo sapiens
augcuaugugugacuucuuaug

SEQ ID NO: 325400 - RNA, 19 nt, Homo sapiens
augcugguguugcucaaac

SEQ ID NO: 325401 - RNA, 22 nt, Homo sapiens
augcuuguguuggggcagugga

SEQ ID NO: 325402 - RNA, 22 nt, Homo sapiens
auggaaacauaagaguauagau

SEQ ID NO: 325403 - RNA, 22 nt, Homo sapiens
auggaaaugaagggcuggcccu

SEQ ID NO: 325404 - RNA, 22 nt, Homo sapiens
auggaacauuauagauguaaaa

SEQ ID NO: 325405 - RNA, 20 nt, Homo sapiens
auggaacugugagccaauua

SEQ ID NO: 325406 - RNA, 22 nt, Homo sapiens
auggaagcauaguauucuauug

SEQ ID NO: 325407 - RNA, 22 nt, Homo sapiens
auggaaucauccuccugggagc

SEQ ID NO: 325408 - RNA, 22 nt, Homo sapiens
auggaaugccauuuauaaugga

SEQ ID NO: 325409 - RNA, 22 nt, Homo sapiens
auggaauguauagucauguagg

SEQ ID NO: 325410 - RNA, 22 nt, Homo sapiens
auggaauguggaaugguaagua

SEQ ID NO: 325411 - RNA, 21 nt, Homo sapiens
auggacaugguuaggcuuugu

SEQ ID NO: 325412 - RNA, 22 nt, Homo sapiens
auggacauuaaagcgauguaga

SEQ ID NO: 325413 - RNA, 22 nt, Homo sapiens
auggagaugaacuuggguaaag

SEQ ID NO: 325414 - RNA, 22 nt, Homo sapiens
auggagaugaauaucaucuguu

SEQ ID NO: 325415 - RNA, 22 nt, Homo sapiens
auggagaugugcgaacugagua

SEQ ID NO: 325416 - RNA, 22 nt, Homo sapiens
auggagcaaaacagauuuggga

SEQ ID NO: 325417 - RNA, 22 nt, Homo sapiens
auggaguuugaacaauuuccug

SEQ ID NO: 325418 - RNA, 22 nt, Homo sapiens
auggauauugccuaggguagua

SEQ ID NO: 325419 - RNA, 22 nt, Homo sapiens
auggauuuugaacuugagaguu

SEQ ID NO: 325420 - RNA, 22 nt, Homo sapiens
auggauuuuggggccagaggca

SEQ ID NO: 325421 - RNA, 22 nt, Homo sapiens
auggcaauaauagcuaccauuu

SEQ ID NO: 325422 - RNA, 22 nt, Homo sapiens
auggcaaugcgauggugacuga

SEQ ID NO: 325423 - RNA, 22 nt, Homo sapiens
auggcacagacucuuggucaag

SEQ ID NO: 325424 - RNA, 22 nt, Homo sapiens
auggcacuaaguucaacacuua

SEQ ID NO: 325425 - RNA, 22 nt, Homo sapiens
auggcacugauggaaguaccuu

SEQ ID NO: 325426 - RNA, 22 nt, Homo sapiens
auggcacuguguauuuuucugu

SEQ ID NO: 325427 - RNA, 22 nt, Homo sapiens
auggcacuuuggacugcuagau

SEQ ID NO: 325428 - RNA, 18 nt, Homo sapiens
auggcagaacaauuuaca

SEQ ID NO: 325429 - RNA, 22 nt, Homo sapiens
auggcaguguaugauuauauua

SEQ ID NO: 325430 - RNA, 22 nt, Homo sapiens
auggcaucgucaccuuuucagu

SEQ ID NO: 325431 - RNA, 22 nt, Homo sapiens
auggcauggugcaggguuuaag

SEQ ID NO: 325432 - RNA, 22 nt, Homo sapiens
auggcccugggaaaggaggcau

SEQ ID NO: 325433 - RNA, 23 nt, Homo sapiens
auggcccuggugggagugucuuu

SEQ ID NO: 325434 - RNA, 22 nt, Homo sapiens
auggccugaugcaccuguccca

SEQ ID NO: 325435 - RNA, 22 nt, Homo sapiens
auggcucuguuuuuuaugcucu

SEQ ID NO: 325436 - RNA, 22 nt, Homo sapiens
auggcucuuauuauuuugaggu

SEQ ID NO: 325437 - RNA, 22 nt, Homo sapiens
auggcuguuuaagaguuucauu

SEQ ID NO: 325438 - RNA, 22 nt, Homo sapiens
auggcuugugggaacuuuuaaa

SEQ ID NO: 325439 - RNA, 22 nt, Homo sapiens
auggcuuguuaugcauuaguac

SEQ ID NO: 325440 - RNA, 22 nt, Homo sapiens
auggcuuugggcugcucugccc

SEQ ID NO: 325441 - RNA, 22 nt, Homo sapiens
auggcuuuggucucccagugau

SEQ ID NO: 325442 - RNA, 22 nt, Homo sapiens
augggacugggugccguggagc

SEQ ID NO: 325443 - RNA, 22 nt, Homo sapiens
augggcacugauguauucugug

SEQ ID NO: 325444 - RNA, 17 nt, Homo sapiens
augggguuguagcccca

SEQ ID NO: 325445 - RNA, 22 nt, Homo sapiens
augguacuggggucccggaguu

SEQ ID NO: 325446 - RNA, 21 nt, Homo sapiens
augguacugucucuggagaua

SEQ ID NO: 325447 - RNA, 22 nt, Homo sapiens
augguaguagaugugugguuuu

SEQ ID NO: 325448 - RNA, 20 nt, Homo sapiens
augguaguagcaccuuuaca

SEQ ID NO: 325449 - RNA, 22 nt, Homo sapiens
augguguccuguuuccccagga

SEQ ID NO: 325450 - RNA, 22 nt, Homo sapiens
augguuuauuuguaagcagagu

SEQ ID NO: 325451 - RNA, 22 nt, Homo sapiens
auguaaacuacagauuuugggu

SEQ ID NO: 325452 - RNA, 22 nt, Homo sapiens
auguaacugggacacaagccuc

SEQ ID NO: 325453 - RNA, 22 nt, Homo sapiens
auguaagugugcucaaauguua

SEQ ID NO: 325454 - RNA, 22 nt, Homo sapiens
auguauggaguuuaggggaugg

SEQ ID NO: 325455 - RNA, 22 nt, Homo sapiens
augucaacauagacaguagagu

SEQ ID NO: 325456 - RNA, 22 nt, Homo sapiens
augucaaggugggugauaguuu

SEQ ID NO: 325457 - RNA, 22 nt, Homo sapiens
augucugguagccaccuggagg

SEQ ID NO: 325458 - RNA, 22 nt, Homo sapiens
augucuguuugcugagcccggc

SEQ ID NO: 325459 - RNA, 22 nt, Homo sapiens
augugaacugaauuaauucaca

SEQ ID NO: 325460 - RNA, 17 nt, Homo sapiens
augugaauguucaaaua

SEQ ID NO: 325461 - RNA, 22 nt, Homo sapiens
augugacuggaucauggggacg

SEQ ID NO: 325462 - RNA, 18 nt, Homo sapiens
augugcaauuuuguauuu

SEQ ID NO: 325463 - RNA, 22 nt, Homo sapiens
augugcacaacgugcagguuug

SEQ ID NO: 325464 - RNA, 20 nt, Homo sapiens
augugcuaauauuaauaugu

SEQ ID NO: 325465 - RNA, 22 nt, Homo sapiens
augugcuaguaucaaacgagac

SEQ ID NO: 325466 - RNA, 18 nt, Homo sapiens
auguggcuuuugaaggcu

SEQ ID NO: 325467 - RNA, 23 nt, Homo sapiens
augugguuuuagguguugaacug

SEQ ID NO: 325468 - RNA, 22 nt, Homo sapiens
auguguaaagcuuuucuuuguu

SEQ ID NO: 325469 - RNA, 22 nt, Homo sapiens
augugugcuugugacacagccu

SEQ ID NO: 325470 - RNA, 22 nt, Homo sapiens
auguguucaucacagcacaauu

SEQ ID NO: 325471 - RNA, 22 nt, Homo sapiens
auguugcaguuuaauuauccua

SEQ ID NO: 325472 - RNA, 22 nt, Homo sapiens
auuaaguaaugguuccaauaau

SEQ ID NO: 325473 - RNA, 22 nt, Homo sapiens
cauggcacuguaugaaaugugc

SEQ ID NO: 325474 - RNA, 22 nt, Homo sapiens
cauggccuuuggaaugugucua

SEQ ID NO: 325475 - RNA, 22 nt, Homo sapiens
cauggcucuuguuuacucccag

SEQ ID NO: 325476 - RNA, 23 nt, Homo sapiens
cauggcuguuaacacuguuugag

SEQ ID NO: 325477 - RNA, 22 nt, Homo sapiens
cauggcuuucacaguaaagccu

SEQ ID NO: 325478 - RNA, 21 nt, Homo sapiens
caugucacugcacucuagccu

SEQ ID NO: 325479 - RNA, 22 nt, Homo sapiens
caugucuuuuauucugugugau

SEQ ID NO: 325480 - RNA, 22 nt, Homo sapiens
caugugcaugcuuucuuaugug

SEQ ID NO: 325481 - RNA, 22 nt, Homo sapiens
cauugcaaugaggucuugcagu

SEQ ID NO: 325482 - RNA, 22 nt, Homo sapiens
cauugcacuccaccuuggguaa

SEQ ID NO: 325483 - RNA, 22 nt, Homo sapiens
cauugcacuccagcucugggcg

SEQ ID NO: 325484 - RNA, 20 nt, Homo sapiens
cauugcacuccagcuugggc

SEQ ID NO: 325485 - RNA, 22 nt, Homo sapiens
cauugcacuccauccuuggcaa

SEQ ID NO: 325486 - RNA, 22 nt, Homo sapiens
cauugcacucuagccucggcaa

SEQ ID NO: 325487 - RNA, 22 nt, Homo sapiens
cauugcacugcauucugggcaa

SEQ ID NO: 325488 - RNA, 22 nt, Homo sapiens
cauugcauuuucuuuguaccuu

SEQ ID NO: 325489 - RNA, 20 nt, Homo sapiens
cauugcccuccagccugggc

SEQ ID NO: 325490 - RNA, 22 nt, Homo sapiens
cauugguuuuucaggaguauau

SEQ ID NO: 325491 - RNA, 22 nt, Homo sapiens
cauuguacauaaguauggagua

SEQ ID NO: 325492 - RNA, 22 nt, Homo sapiens
cauuuugcaguuucugucucca

SEQ ID NO: 325493 - RNA, 22 nt, Homo sapiens
cauuuugguuaaauagguagcu

SEQ ID NO: 325494 - RNA, 22 nt, Homo sapiens
ccaaggaauacccucccuuuuu

SEQ ID NO: 325495 - RNA, 22 nt, Homo sapiens
ccacaaccucaacagcaucuau

SEQ ID NO: 325496 - RNA, 22 nt, Homo sapiens
ccacaaccuccauauccugggu

SEQ ID NO: 325497 - RNA, 23 nt, Homo sapiens
ccacacuguuuagaauggcauca

SEQ ID NO: 325498 - RNA, 22 nt, Homo sapiens
ccacauuaccuugcuugcucca

SEQ ID NO: 325499 - RNA, 22 nt, Homo sapiens
ccacccuuccauucuuccucuu

SEQ ID NO: 325500 - RNA, 20 nt, Homo sapiens
ccagcaucauuagauucugg

SEQ ID NO: 325501 - RNA, 22 nt, Homo sapiens
ccaggguugagacccacugacu

SEQ ID NO: 325502 - RNA, 22 nt, Homo sapiens
ccaguauugaacacaaugaaag

SEQ ID NO: 325503 - RNA, 22 nt, Homo sapiens
ccagugcauggaucccaggggg

SEQ ID NO: 325504 - RNA, 22 nt, Homo sapiens
ccagugguucccuguggccuga

SEQ ID NO: 325505 - RNA, 21 nt, Homo sapiens
ccagugguuggaaacuauggg

SEQ ID NO: 325506 - RNA, 19 nt, Homo sapiens
ccaguguugccagagcuga

SEQ ID NO: 325507 - RNA, 22 nt, Homo sapiens
ccaguguuuuugaauuccagga

SEQ ID NO: 325508 - RNA, 22 nt, Homo sapiens
ccaguuuucaagauaaugguuu

SEQ ID NO: 325509 - RNA, 17 nt, Homo sapiens
ccaguuuucccucagug

SEQ ID NO: 325510 - RNA, 22 nt, Homo sapiens
ccaguuuucucacuguugcagu

SEQ ID NO: 325511 - RNA, 22 nt, Homo sapiens
ccaucacaggccucagugggaa

SEQ ID NO: 325512 - RNA, 19 nt, Homo sapiens
ccauggcaaugaucugaug

SEQ ID NO: 325513 - RNA, 22 nt, Homo sapiens
ccauugcacuccagccucggca

SEQ ID NO: 325514 - RNA, 22 nt, Homo sapiens
ccauugcacucuggccuaggug

SEQ ID NO: 325515 - RNA, 22 nt, Homo sapiens
ccauuucacucuuccugaagga

SEQ ID NO: 325516 - RNA, 22 nt, Homo sapiens
ccauuugguuauguaucgaaac

SEQ ID NO: 325517 - RNA, 22 nt, Homo sapiens
cccagcguucggcauggcugag

SEQ ID NO: 325518 - RNA, 21 nt, Homo sapiens
cccagguucucugaggguaga

SEQ ID NO: 325519 - RNA, 22 nt, Homo sapiens
cccaguguuuauuuugagccaa

SEQ ID NO: 325520 - RNA, 22 nt, Homo sapiens
cccaguuuugcuucucaugagg

SEQ ID NO: 325521 - RNA, 22 nt, Homo sapiens
ccccauguucucucugcagcuc

SEQ ID NO: 325522 - RNA, 22 nt, Homo sapiens
ccccauuugaacuccuucaacu

SEQ ID NO: 325523 - RNA, 22 nt, Homo sapiens
ccccugaaacucacucauuauc

SEQ ID NO: 325524 - RNA, 20 nt, Homo sapiens
ccccuggaguggggcugcuu

SEQ ID NO: 325525 - RNA, 19 nt, Homo sapiens
ccccuguggauaccgaggg

SEQ ID NO: 325526 - RNA, 22 nt, Homo sapiens
cccugacauucggagauguagu

SEQ ID NO: 325527 - RNA, 22 nt, Homo sapiens
cccuggacacacacuuuuauuc

SEQ ID NO: 325528 - RNA, 22 nt, Homo sapiens
cccuggacauucaucauuaugu

SEQ ID NO: 325529 - RNA, 22 nt, Homo sapiens
ccugagacuugagggggcuucu

SEQ ID NO: 325530 - RNA, 22 nt, Homo sapiens
ccugucuugauuaaauuacuua

SEQ ID NO: 325531 - RNA, 22 nt, Homo sapiens
ccuucauccuccagcaggcuag

SEQ ID NO: 325532 - RNA, 21 nt, Homo sapiens
ccuugagaacaucaauuugcu

SEQ ID NO: 325533 - RNA, 22 nt, Homo sapiens
ccuugguggccacaagacauug

SEQ ID NO: 325534 - RNA, 22 nt, Homo sapiens
ccuuuguuuaguugaauuguau

SEQ ID NO: 325535 - RNA, 22 nt, Homo sapiens
cgaguguaguaggccauaugaa

SEQ ID NO: 325536 - RNA, 22 nt, Homo sapiens
cgccgggggaugggcaccagcg

SEQ ID NO: 325537 - RNA, 22 nt, Homo sapiens
cggaaugaaaauguccuucagu

SEQ ID NO: 325538 - RNA, 22 nt, Homo sapiens
cggucacagugauucaaggguc

SEQ ID NO: 325539 - RNA, 22 nt, Homo sapiens
cggugcaauucuccugucucag

SEQ ID NO: 325540 - RNA, 22 nt, Homo sapiens
cgugaggaaaacagaggguguu

SEQ ID NO: 325541 - RNA, 22 nt, Homo sapiens
cuaaaacuuucugagugcagca

SEQ ID NO: 325542 - RNA, 22 nt, Homo sapiens
cuaaagauagugacaugauuug

SEQ ID NO: 325543 - RNA, 18 nt, Homo sapiens
cuaagacacuuggcagag

SEQ ID NO: 325544 - RNA, 22 nt, Homo sapiens
cuaagcaccuuaguggggaauc

SEQ ID NO: 325545 - RNA, 21 nt, Homo sapiens
cuaaggaaagcuaugaacccu

SEQ ID NO: 325546 - RNA, 22 nt, Homo sapiens
cuaaggaaggacugaaaggaca

SEQ ID NO: 325547 - RNA, 22 nt, Homo sapiens
cuaauacaguuguccaagcugg

SEQ ID NO: 325548 - RNA, 22 nt, Homo sapiens
cuaaucugugcauagaagaggc

SEQ ID NO: 325549 - RNA, 22 nt, Homo sapiens
cuacagaguaucuaaagaggua

SEQ ID NO: 325550 - RNA, 22 nt, Homo sapiens
cuacagcagcccaguccccgaa

SEQ ID NO: 325551 - RNA, 22 nt, Homo sapiens
cuacagugggucuguaguccuu

SEQ ID NO: 325552 - RNA, 22 nt, Homo sapiens
cuacuauguagagauauugaau

SEQ ID NO: 325553 - RNA, 22 nt, Homo sapiens
cuagaagcauauucagaacaga

SEQ ID NO: 325554 - RNA, 22 nt, Homo sapiens
cuagaauguauaaaaccaagcu

SEQ ID NO: 325555 - RNA, 22 nt, Homo sapiens
cuagaggcacagccuaggcacu

SEQ ID NO: 325556 - RNA, 22 nt, Homo sapiens
cuagcccagugcuccuggauca

SEQ ID NO: 325557 - RNA, 22 nt, Homo sapiens
cuagcccugagauaaaugucau

SEQ ID NO: 325558 - RNA, 22 nt, Homo sapiens
cuagccuggagugcaguggugc

SEQ ID NO: 325559 - RNA, 22 nt, Homo sapiens
cuagcuccauauaaagcaggau

SEQ ID NO: 325560 - RNA, 22 nt, Homo sapiens
cuagcuuuuuaugacaaucuug

SEQ ID NO: 325561 - RNA, 22 nt, Homo sapiens
cuaggcacgccugggucuccag

SEQ ID NO: 325562 - RNA, 22 nt, Homo sapiens
cuagguucucaaaccagcguca

SEQ ID NO: 325563 - RNA, 22 nt, Homo sapiens
cuauauacugccugcugauuag

SEQ ID NO: 325564 - RNA, 22 nt, Homo sapiens
cuauggcucugucuuuuaaguu

SEQ ID NO: 325565 - RNA, 22 nt, Homo sapiens
cuauggcuguaugacgugcaug

SEQ ID NO: 325566 - RNA, 22 nt, Homo sapiens
cuauggugauagaaaucagaau

SEQ ID NO: 325567 - RNA, 20 nt, Homo sapiens
gagaacugagaugcguuuga

SEQ ID NO: 325568 - RNA, 22 nt, Homo sapiens
gagacugagucucgcucugccg

SEQ ID NO: 325569 - RNA, 22 nt, Homo sapiens
gagagcauuaagccaucaucau

SEQ ID NO: 325570 - RNA, 22 nt, Homo sapiens
gagagcuaggccacuggggcuu

SEQ ID NO: 325571 - RNA, 22 nt, Homo sapiens
gagagugcuuggcaucugcuga

SEQ ID NO: 325572 - RNA, 22 nt, Homo sapiens
gagagugugucagaggcugcga

SEQ ID NO: 325573 - RNA, 22 nt, Homo sapiens
gagauaacuacuggauuaaguu

SEQ ID NO: 325574 - RNA, 21 nt, Homo sapiens
gagauagguaccgaagcuuag

SEQ ID NO: 325575 - RNA, 22 nt, Homo sapiens
gagaucaucuaaucuggccucu

SEQ ID NO: 325576 - RNA, 22 nt, Homo sapiens
gagaucauguacuagaacaccu

SEQ ID NO: 325577 - RNA, 22 nt, Homo sapiens
gagaucauuaugucagggguca

SEQ ID NO: 325578 - RNA, 22 nt, Homo sapiens
gagaugaagugucaauaaggau

SEQ ID NO: 325579 - RNA, 22 nt, Homo sapiens
gagaugaugagauguucacagu

SEQ ID NO: 325580 - RNA, 22 nt, Homo sapiens
gagauggaguuucacuucgcuc

SEQ ID NO: 325581 - RNA, 22 nt, Homo sapiens
gagaugucuauuucagagaugu

SEQ ID NO: 325582 - RNA, 22 nt, Homo sapiens
gagauguuuuguuaucaaagga

SEQ ID NO: 325583 - RNA, 22 nt, Homo sapiens
gagauuuucagcuugacuggga

SEQ ID NO: 325584 - RNA, 22 nt, Homo sapiens
gagcaaugauugagccacugua

SEQ ID NO: 325585 - RNA, 21 nt, Homo sapiens
gagcacauuguccucuaacgc

SEQ ID NO: 325586 - RNA, 22 nt, Homo sapiens
gagcacugaauacugugguggu

SEQ ID NO: 325587 - RNA, 20 nt, Homo sapiens
gagcaucacaggccucugcu

SEQ ID NO: 325588 - RNA, 22 nt, Homo sapiens
gagcccauuucacuuguccagc

SEQ ID NO: 325589 - RNA, 22 nt, Homo sapiens
gagcuacauggauagucugcau

SEQ ID NO: 325590 - RNA, 22 nt, Homo sapiens
gagcuagguuuugaauccagac

SEQ ID NO: 325591 - RNA, 22 nt, Homo sapiens
gagcuagugcuuaugcaccacu

SEQ ID NO: 325592 - RNA, 22 nt, Homo sapiens
gagcucaccuuaccucuggagc

SEQ ID NO: 325593 - RNA, 20 nt, Homo sapiens
gagcucaucuucuuuaccac

SEQ ID NO: 325594 - RNA, 22 nt, Homo sapiens
gagcuccuccccuuggcuuuca

SEQ ID NO: 325595 - RNA, 22 nt, Homo sapiens
gagcugaucuuuauguaaauuc

SEQ ID NO: 325596 - RNA, 22 nt, Homo sapiens
gagcugccuugccuaugcaaga

SEQ ID NO: 325597 - RNA, 22 nt, Homo sapiens
gagcuggacuucuuaccuuuuc

SEQ ID NO: 325598 - RNA, 22 nt, Homo sapiens
gagcugguccuuuaaggaugca

SEQ ID NO: 325599 - RNA, 22 nt, Homo sapiens
gaggaaguaauuuuaggccugu

SEQ ID NO: 325600 - RNA, 22 nt, Homo sapiens
gaggagucagacugugcaaggu

SEQ ID NO: 325601 - RNA, 22 nt, Homo sapiens
gaggcaauaugagggaggcuuc

SEQ ID NO: 325602 - RNA, 22 nt, Homo sapiens
gaggcagucugucccuuagcag

SEQ ID NO: 325603 - RNA, 22 nt, Homo sapiens
gaggcaguguguccguucucgg

SEQ ID NO: 325604 - RNA, 22 nt, Homo sapiens
gaggcuagauggggaugugucc

SEQ ID NO: 325605 - RNA, 22 nt, Homo sapiens
gagguaagaugauucguguccu

SEQ ID NO: 325606 - RNA, 22 nt, Homo sapiens
gagguaggaggauugcuuaagg

SEQ ID NO: 325607 - RNA, 22 nt, Homo sapiens
gagguauaauugacaagcaaaa

SEQ ID NO: 325608 - RNA, 22 nt, Homo sapiens
gagguauagaacaccuuucaag

SEQ ID NO: 325609 - RNA, 22 nt, Homo sapiens
gaggucaugucgggccccagga

SEQ ID NO: 325610 - RNA, 22 nt, Homo sapiens
gagguggauacauuaaauaaug

SEQ ID NO: 325611 - RNA, 22 nt, Homo sapiens
gagguggugguggaggcauagc

SEQ ID NO: 325612 - RNA, 22 nt, Homo sapiens
gagguugggaugagggauacag

SEQ ID NO: 325613 - RNA, 23 nt, Homo sapiens
gaguacauuaaaagcccagacug

SEQ ID NO: 325614 - RNA, 22 nt, Homo sapiens
gaguagugcugcaauaaacaua

SEQ ID NO: 325615 - RNA, 21 nt, Homo sapiens
gagugcaaauaaagagagggc

SEQ ID NO: 325616 - RNA, 22 nt, Homo sapiens
gagugcaauggcagaucuccgc

SEQ ID NO: 325617 - RNA, 22 nt, Homo sapiens
gagugcugagcccacuuccuug

SEQ ID NO: 325618 - RNA, 22 nt, Homo sapiens
gauaauucuagcagauacaggc

SEQ ID NO: 325619 - RNA, 22 nt, Homo sapiens
gauagcauucaauuaucuguug

SEQ ID NO: 325620 - RNA, 22 nt, Homo sapiens
gauauguucuuucacguuggug

SEQ ID NO: 325621 - RNA, 19 nt, Homo sapiens
gauauguugagcacccuuu

SEQ ID NO: 325622 - RNA, 22 nt, Homo sapiens
gauauuacuuccaauauugcaa

SEQ ID NO: 325623 - RNA, 22 nt, Homo sapiens
gaucacauguguacucaaugug

SEQ ID NO: 325624 - RNA, 22 nt, Homo sapiens
gaucacauuguuucauacauau

SEQ ID NO: 325625 - RNA, 22 nt, Homo sapiens
gaucugagaaagugucauaaca

SEQ ID NO: 325626 - RNA, 22 nt, Homo sapiens
gaucugugugauuggaugcauu

SEQ ID NO: 325627 - RNA, 22 nt, Homo sapiens
gaucuguguuuguaugcauaag

SEQ ID NO: 325628 - RNA, 22 nt, Homo sapiens
gaugaaacaucuuuggaaacug

SEQ ID NO: 325629 - RNA, 22 nt, Homo sapiens
gaugaacugucuuacuacucac

SEQ ID NO: 325630 - RNA, 22 nt, Homo sapiens
gaugacuaagaauuuuauaauu

SEQ ID NO: 325631 - RNA, 22 nt, Homo sapiens
gaugaggcuagagacaugugua

SEQ ID NO: 325632 - RNA, 22 nt, Homo sapiens
gaugagguagaagacucagcaa

SEQ ID NO: 325633 - RNA, 22 nt, Homo sapiens
gaugauauuugagucauuagaa

SEQ ID NO: 325634 - RNA, 19 nt, Homo sapiens
gaugcaaugcacugagguc

SEQ ID NO: 325635 - RNA, 22 nt, Homo sapiens
gaugcagcuaggauuugugaca

SEQ ID NO: 325636 - RNA, 22 nt, Homo sapiens
gauggaauuaaaaucagaauca

SEQ ID NO: 325637 - RNA, 22 nt, Homo sapiens
gauggaguugacuaagacaaca

SEQ ID NO: 325638 - RNA, 22 nt, Homo sapiens
gauggaguugucgccugggcug

SEQ ID NO: 325639 - RNA, 22 nt, Homo sapiens
gauggcaucugagaguguuaga

SEQ ID NO: 325640 - RNA, 22 nt, Homo sapiens
gaugguuuuucuccgauuuaua

SEQ ID NO: 325641 - RNA, 22 nt, Homo sapiens
gaugugaaaucauaguuucuag

SEQ ID NO: 325642 - RNA, 22 nt, Homo sapiens
gauguguugggaagauuucaag

SEQ ID NO: 325643 - RNA, 22 nt, Homo sapiens
gauuccauugcgaauuuucaga

SEQ ID NO: 325644 - RNA, 22 nt, Homo sapiens
gauuccauuuguggcuauuuac

SEQ ID NO: 325645 - RNA, 22 nt, Homo sapiens
gauugguugaaaguagaauacu

SEQ ID NO: 325646 - RNA, 22 nt, Homo sapiens
gauuucaucuuuagaggaagga

SEQ ID NO: 325647 - RNA, 22 nt, Homo sapiens
gauuugguguucuggcucaaga

SEQ ID NO: 325648 - RNA, 22 nt, Homo sapiens
gauuuuccaguggcccugauca

SEQ ID NO: 325649 - RNA, 21 nt, Homo sapiens
gcaaacauccuuugaugccag

SEQ ID NO: 325650 - RNA, 20 nt, Homo sapiens
gcaaaguuuagcucccacua

SEQ ID NO: 325651 - RNA, 22 nt, Homo sapiens
gcaaaugcuaugccauuuuaua

SEQ ID NO: 325652 - RNA, 20 nt, Homo sapiens
gcaaauggaucccacaagcc

SEQ ID NO: 325653 - RNA, 22 nt, Homo sapiens
gcaagaguauuucaaggaagau

SEQ ID NO: 325654 - RNA, 22 nt, Homo sapiens
gcaaugcugucugugcacagau

SEQ ID NO: 325655 - RNA, 22 nt, Homo sapiens
gcacaaugccugacgaguccug

SEQ ID NO: 325656 - RNA, 22 nt, Homo sapiens
gcacaguaggugguaggacuuu

SEQ ID NO: 325657 - RNA, 22 nt, Homo sapiens
gcacagucaacacuuauucacc

SEQ ID NO: 325658 - RNA, 22 nt, Homo sapiens
gcacaguuaaagggucauguga

SEQ ID NO: 325659 - RNA, 22 nt, Homo sapiens
gcaccccuuaccgggcuggguu

SEQ ID NO: 325660 - RNA, 22 nt, Homo sapiens
aacuggcauauucugguugcgg

SEQ ID NO: 325661 - RNA, 22 nt, Homo sapiens
aacugggcaagcauuacauggu

SEQ ID NO: 325662 - RNA, 22 nt, Homo sapiens
aacugguauuucccaugaauuu

SEQ ID NO: 325663 - RNA, 22 nt, Homo sapiens
aacuggucuuuggaggaggagg

SEQ ID NO: 325664 - RNA, 19 nt, Homo sapiens
aacuggugugagaugguau

SEQ ID NO: 325665 - RNA, 20 nt, Homo sapiens
aagacacuguccccacugga

SEQ ID NO: 325666 - RNA, 22 nt, Homo sapiens
aagacuguaauccaucuugagu

SEQ ID NO: 325667 - RNA, 22 nt, Homo sapiens
aagagaacugacaguaccuggg

SEQ ID NO: 325668 - RNA, 22 nt, Homo sapiens
aagagcauuauuuaguaauuuc

SEQ ID NO: 325669 - RNA, 18 nt, Homo sapiens
aagagcucagcacagguu

SEQ ID NO: 325670 - RNA, 22 nt, Homo sapiens
aagaggcuguaggauaaugccu

SEQ ID NO: 325671 - RNA, 22 nt, Homo sapiens
aagagguagaagcuugccuucu

SEQ ID NO: 325672 - RNA, 22 nt, Homo sapiens
aagagguaggaaauggucauuu

SEQ ID NO: 325673 - RNA, 23 nt, Homo sapiens
aagagguaugacuaugaagugga

SEQ ID NO: 325674 - RNA, 22 nt, Homo sapiens
aagaguaguaguggcacucucu

SEQ ID NO: 325675 - RNA, 22 nt, Homo sapiens
aagagugcucgugggacucagc

SEQ ID NO: 325676 - RNA, 22 nt, Homo sapiens
aagaucauucagggaaggcuga

SEQ ID NO: 325677 - RNA, 19 nt, Homo sapiens
aagaugauguuugggcuaa

SEQ ID NO: 325678 - RNA, 22 nt, Homo sapiens
aagaugguauuucauuaguuuu

SEQ ID NO: 325679 - RNA, 22 nt, Homo sapiens
aagcacccuuugucuggacaug

SEQ ID NO: 325680 - RNA, 22 nt, Homo sapiens
aagcaccguugccuccccugca

SEQ ID NO: 325681 - RNA, 22 nt, Homo sapiens
aagcagacauguucauuuugaa

SEQ ID NO: 325682 - RNA, 20 nt, Homo sapiens
aagcagacauuuggaugaaa

SEQ ID NO: 325683 - RNA, 22 nt, Homo sapiens
aagcagauguguugaaaguacu

SEQ ID NO: 325684 - RNA, 22 nt, Homo sapiens
aagcaucacuggaggcagccau

SEQ ID NO: 325685 - RNA, 22 nt, Homo sapiens
aagcaugguuuccaggggucac

SEQ ID NO: 325686 - RNA, 22 nt, Homo sapiens
aagccacuguaccugucucuua

SEQ ID NO: 325687 - RNA, 22 nt, Homo sapiens
aagcccauuguaaguugaggag

SEQ ID NO: 325688 - RNA, 22 nt, Homo sapiens
aagcuguugguggauguaccau

SEQ ID NO: 325689 - RNA, 22 nt, Homo sapiens
aaggaacuggaauauuuugaac

SEQ ID NO: 325690 - RNA, 23 nt, Homo sapiens
aaggacacugaacacuucccagc

SEQ ID NO: 325691 - RNA, 22 nt, Homo sapiens
aaggagcagagagcccuguuuc

SEQ ID NO: 325692 - RNA, 22 nt, Homo sapiens
aaggaguagaggaauagcaaug

SEQ ID NO: 325693 - RNA, 22 nt, Homo sapiens
aaggauuguaacaccaagguua

SEQ ID NO: 325694 - RNA, 22 nt, Homo sapiens
aaggcaacgugaguuguugauu

SEQ ID NO: 325695 - RNA, 22 nt, Homo sapiens
aaggcacugaacuuaaauucug

SEQ ID NO: 325696 - RNA, 22 nt, Homo sapiens
aaggcaugcaaagaacauuuua

SEQ ID NO: 325697 - RNA, 22 nt, Homo sapiens
aaggcaugcugaguccuaaaag

SEQ ID NO: 325698 - RNA, 22 nt, Homo sapiens
aaggcuguucauuuagcacagu

SEQ ID NO: 325699 - RNA, 22 nt, Homo sapiens
aagggaaugcgcugccuguguu

SEQ ID NO: 325700 - RNA, 22 nt, Homo sapiens
aagguacuggaaagaggaaugg

SEQ ID NO: 325701 - RNA, 22 nt, Homo sapiens
aagguagcugagugaagugguu

SEQ ID NO: 325702 - RNA, 22 nt, Homo sapiens
aagguauuuuugucuauaucuu

SEQ ID NO: 325703 - RNA, 22 nt, Homo sapiens
aaggucauugugguuuuugcca

SEQ ID NO: 325704 - RNA, 22 nt, Homo sapiens
aaggugcucucuuauguagaaa

SEQ ID NO: 325705 - RNA, 18 nt, Homo sapiens
aaggugcuucuguucuga

SEQ ID NO: 325706 - RNA, 22 nt, Homo sapiens
aaggugguuuucucuuggaguc

SEQ ID NO: 325707 - RNA, 22 nt, Homo sapiens
aaguaaauauccgguaguccca

SEQ ID NO: 325708 - RNA, 22 nt, Homo sapiens
aaguaaaucuuaugucagggag

SEQ ID NO: 325709 - RNA, 22 nt, Homo sapiens
aaguaauugagguuuuugcugu

SEQ ID NO: 325710 - RNA, 18 nt, Homo sapiens
aaguauagagagcccuua

SEQ ID NO: 325711 - RNA, 22 nt, Homo sapiens
aaguauagcuaugauaaacauu

SEQ ID NO: 325712 - RNA, 22 nt, Homo sapiens
aaguauuaagacuaagaggcuu

SEQ ID NO: 325713 - RNA, 22 nt, Homo sapiens
aaguauuagcuaauugugcuua

SEQ ID NO: 325714 - RNA, 22 nt, Homo sapiens
aagucaaggagagaggcgucag

SEQ ID NO: 325715 - RNA, 22 nt, Homo sapiens
aagucaugaagaggaaaggaca

SEQ ID NO: 325716 - RNA, 22 nt, Homo sapiens
aaguccaugaagucuugugggu

SEQ ID NO: 325717 - RNA, 22 nt, Homo sapiens
aagugacauugugcccauuuga

SEQ ID NO: 325718 - RNA, 22 nt, Homo sapiens
aagugcuuacagggaacaugau

SEQ ID NO: 325719 - RNA, 22 nt, Homo sapiens
aagugcuuuguacagggguuga

SEQ ID NO: 325720 - RNA, 22 nt, Homo sapiens
aagugucagaguugcuaaugac

SEQ ID NO: 325721 - RNA, 22 nt, Homo sapiens
aagugucuuaccgggagggagu

SEQ ID NO: 325722 - RNA, 23 nt, Homo sapiens
aaguucaugcucaucuguuacac

SEQ ID NO: 325723 - RNA, 22 nt, Homo sapiens
aaguugcuuuagguaagucaau

SEQ ID NO: 325724 - RNA, 22 nt, Homo sapiens
aauaaagcagcuuuuugggacu

SEQ ID NO: 325725 - RNA, 20 nt, Homo sapiens
aauaacagccccagggaggu

SEQ ID NO: 325726 - RNA, 22 nt, Homo sapiens
aauaagcauaguaccugauagg

SEQ ID NO: 325727 - RNA, 19 nt, Homo sapiens
aauaaugccagaugucugu

SEQ ID NO: 325728 - RNA, 22 nt, Homo sapiens
aauagcuguccuuagaagugug

SEQ ID NO: 325729 - RNA, 22 nt, Homo sapiens
aauauagcuauguacaugucca

SEQ ID NO: 325730 - RNA, 22 nt, Homo sapiens
aauaucacaggguguacacuca

SEQ ID NO: 325731 - RNA, 22 nt, Homo sapiens
aauaucuguguauagauggggg

SEQ ID NO: 325732 - RNA, 22 nt, Homo sapiens
aaucacagccagcuuccgcuau

SEQ ID NO: 325733 - RNA, 22 nt, Homo sapiens
aaucacaguguucuugugaggg

SEQ ID NO: 325734 - RNA, 21 nt, Homo sapiens
aaucacaguuguucugccuuc

SEQ ID NO: 325735 - RNA, 22 nt, Homo sapiens
aaucacauuaaugcucccucag

SEQ ID NO: 325736 - RNA, 21 nt, Homo sapiens
aaucacugucuguuuccccuu

SEQ ID NO: 325737 - RNA, 22 nt, Homo sapiens
aaucagagcccucugagcuuca

SEQ ID NO: 325738 - RNA, 17 nt, Homo sapiens
aaucagauuucugagga

SEQ ID NO: 325739 - RNA, 22 nt, Homo sapiens
aaucauauugucugccaagagg

SEQ ID NO: 325740 - RNA, 22 nt, Homo sapiens
aaucauggaguauuuguccuug

SEQ ID NO: 325741 - RNA, 22 nt, Homo sapiens
aauccauuugccgucuauccau

SEQ ID NO: 325742 - RNA, 22 nt, Homo sapiens
aaucccauuucucuguguuuuu

SEQ ID NO: 325743 - RNA, 22 nt, Homo sapiens
aaucccuuuguccagucucuuu

SEQ ID NO: 325744 - RNA, 22 nt, Homo sapiens
aaucgcuuuugguaggcaagga

SEQ ID NO: 325745 - RNA, 22 nt, Homo sapiens
aaucucagcauuuugggcugag

SEQ ID NO: 325746 - RNA, 22 nt, Homo sapiens
aaucugauguuaucagcuuaag

SEQ ID NO: 325747 - RNA, 22 nt, Homo sapiens
aaucuguagaaggugcacauuc

SEQ ID NO: 325748 - RNA, 22 nt, Homo sapiens
aaucugucaguuuuguguuaau

SEQ ID NO: 325749 - RNA, 22 nt, Homo sapiens
aaucugucuagacaaggagucu

SEQ ID NO: 325750 - RNA, 22 nt, Homo sapiens
aaugauauguuauguuuagguu

SEQ ID NO: 325751 - RNA, 22 nt, Homo sapiens
aaugcacuccagccugggcgac

SEQ ID NO: 325752 - RNA, 22 nt, Homo sapiens
aaugcuguucuuugcuuaaguu

SEQ ID NO: 325753 - RNA, 22 nt, Homo sapiens
aauggcaagagccacagaggcg

SEQ ID NO: 325754 - RNA, 22 nt, Homo sapiens
agccaguuuggcuaauuuuggc

SEQ ID NO: 325755 - RNA, 23 nt, Homo sapiens
agccugguuucccugcuucuccc

SEQ ID NO: 325756 - RNA, 22 nt, Homo sapiens
agccuguagugagcugugauug

SEQ ID NO: 325757 - RNA, 21 nt, Homo sapiens
agccugugggucauaguugcc

SEQ ID NO: 325758 - RNA, 22 nt, Homo sapiens
agccuucauucugacaguagga

SEQ ID NO: 325759 - RNA, 22 nt, Homo sapiens
agcgccacugcacuccagccug

SEQ ID NO: 325760 - RNA, 22 nt, Homo sapiens
agcgccauugcacuccagccuu

SEQ ID NO: 325761 - RNA, 22 nt, Homo sapiens
agcuacaucuugcucugggaug

SEQ ID NO: 325762 - RNA, 22 nt, Homo sapiens
agcuaguggucauucaauccuu

SEQ ID NO: 325763 - RNA, 22 nt, Homo sapiens
agcucauugcuguccuggagga

SEQ ID NO: 325764 - RNA, 22 nt, Homo sapiens
agcuccuuucugcagguagguu

SEQ ID NO: 325765 - RNA, 22 nt, Homo sapiens
agcugcaaagggagagaugauu

SEQ ID NO: 325766 - RNA, 22 nt, Homo sapiens
agcugcacgugguaaauguaaa

SEQ ID NO: 325767 - RNA, 22 nt, Homo sapiens
agcugcacugguauaggagaaa

SEQ ID NO: 325768 - RNA, 20 nt, Homo sapiens
agcugcagauauaaauccgc

SEQ ID NO: 325769 - RNA, 22 nt, Homo sapiens
agcuggaauuuaagguagauag

SEQ ID NO: 325770 - RNA, 22 nt, Homo sapiens
agcuggauuguuuaccuggggc

SEQ ID NO: 325771 - RNA, 23 nt, Homo sapiens
agcugguacuagaggcuugcgcc

SEQ ID NO: 325772 - RNA, 22 nt, Homo sapiens
agcugguauuuguuagggaguu

SEQ ID NO: 325773 - RNA, 22 nt, Homo sapiens
agcugguuuaauaugcugucug

SEQ ID NO: 325774 - RNA, 22 nt, Homo sapiens
agcugguuuauuucucacaaca

SEQ ID NO: 325775 - RNA, 21 nt, Homo sapiens
agcugguuucuucuuacuccu

SEQ ID NO: 325776 - RNA, 22 nt, Homo sapiens
agcuguaguuuauucauguuaa

SEQ ID NO: 325777 - RNA, 19 nt, Homo sapiens
agcuguguugccugugaga

SEQ ID NO: 325778 - RNA, 22 nt, Homo sapiens
agcuugucuuauacuacuucau

SEQ ID NO: 325779 - RNA, 22 nt, Homo sapiens
agcuugugauuuagagugagag

SEQ ID NO: 325780 - RNA, 22 nt, Homo sapiens
agcuugugcuguaugaagggcc

SEQ ID NO: 325781 - RNA, 22 nt, Homo sapiens
agcuuguggugaauacugcuag

SEQ ID NO: 325782 - RNA, 21 nt, Homo sapiens
agcuuguguguaucacagugu

SEQ ID NO: 325783 - RNA, 22 nt, Homo sapiens
agcuuguuuucccauaacuaga

SEQ ID NO: 325784 - RNA, 22 nt, Homo sapiens
aggaaaucuuagcugaggggau

SEQ ID NO: 325785 - RNA, 22 nt, Homo sapiens
aggaacuguaacuaugucucug

SEQ ID NO: 325786 - RNA, 23 nt, Homo sapiens
aggaauggaaaaccaaguaucau

SEQ ID NO: 325787 - RNA, 22 nt, Homo sapiens
aggaauggaaacuuuugauggu

SEQ ID NO: 325788 - RNA, 22 nt, Homo sapiens
aggaauuuaauguaugauaaua

SEQ ID NO: 325789 - RNA, 20 nt, Homo sapiens
aggacuacagaggguaggau

SEQ ID NO: 325790 - RNA, 22 nt, Homo sapiens
aggagcacuggccuuggaguca

SEQ ID NO: 325791 - RNA, 21 nt, Homo sapiens
aggagcauucaugacgagguu

SEQ ID NO: 325792 - RNA, 22 nt, Homo sapiens
aggagguagggugugaaacagc

SEQ ID NO: 325793 - RNA, 22 nt, Homo sapiens
aggauaguaaugauagagaggc

SEQ ID NO: 325794 - RNA, 22 nt, Homo sapiens
aggaucauugacuauuauaagg

SEQ ID NO: 325795 - RNA, 16 nt, Homo sapiens
aggcaagaauugaggu

SEQ ID NO: 325796 - RNA, 21 nt, Homo sapiens
aggcaagauuacuuacgagca

SEQ ID NO: 325797 - RNA, 21 nt, Homo sapiens
aggcaagguguuauuauugaa

SEQ ID NO: 325798 - RNA, 22 nt, Homo sapiens
aggcaaugugagaguuuauuca

SEQ ID NO: 325799 - RNA, 22 nt, Homo sapiens
aggcaggugaaagauaguuuua

SEQ ID NO: 325800 - RNA, 22 nt, Homo sapiens
aggcagucucugccggcugagg

SEQ ID NO: 325801 - RNA, 22 nt, Homo sapiens
aggcagucugaguuuugaaagg

SEQ ID NO: 325802 - RNA, 22 nt, Homo sapiens
aggcaugauggcuccagaucau

SEQ ID NO: 325803 - RNA, 22 nt, Homo sapiens
aggcaugauuguauuuugcucu

SEQ ID NO: 325804 - RNA, 22 nt, Homo sapiens
aggcuuuuggagaacacugcac

SEQ ID NO: 325805 - RNA, 22 nt, Homo sapiens
aggcuuuuggagguggcuuucu

SEQ ID NO: 325806 - RNA, 22 nt, Homo sapiens
agggaagugugcuaugcauuua

SEQ ID NO: 325807 - RNA, 22 nt, Homo sapiens
agggcaagacuuguuaagaaca

SEQ ID NO: 325808 - RNA, 22 nt, Homo sapiens
agguaagucucuaauuaugaau

SEQ ID NO: 325809 - RNA, 22 nt, Homo sapiens
agguaauuuuaucauuauguga

SEQ ID NO: 325810 - RNA, 22 nt, Homo sapiens
agguacuugagauucugaacug

SEQ ID NO: 325811 - RNA, 22 nt, Homo sapiens
agguauuuucaacuuagaaugg

SEQ ID NO: 325812 - RNA, 22 nt, Homo sapiens
aggucaccucaggaaauacuga

SEQ ID NO: 325813 - RNA, 22 nt, Homo sapiens
agguccauuauuuucauucaug

SEQ ID NO: 325814 - RNA, 22 nt, Homo sapiens
aggugcacucagaaaacagaua

SEQ ID NO: 325815 - RNA, 22 nt, Homo sapiens
aggugcucuuccuguaggucac

SEQ ID NO: 325816 - RNA, 22 nt, Homo sapiens
aggugcugagcagagaauccug

SEQ ID NO: 325817 - RNA, 22 nt, Homo sapiens
aggugguauuuaaaauuauuug

SEQ ID NO: 325818 - RNA, 22 nt, Homo sapiens
aggugguguuggguuccagccc

SEQ ID NO: 325819 - RNA, 22 nt, Homo sapiens
aggugguuuugaugagcaggua

SEQ ID NO: 325820 - RNA, 22 nt, Homo sapiens
aggugguuuuucaacacacacu

SEQ ID NO: 325821 - RNA, 22 nt, Homo sapiens
agguuaccuggugauuuugucu

SEQ ID NO: 325822 - RNA, 22 nt, Homo sapiens
aguaccacgugaugccauuuuc

SEQ ID NO: 325823 - RNA, 22 nt, Homo sapiens
aguagcauuggggggcauccuc

SEQ ID NO: 325824 - RNA, 22 nt, Homo sapiens
aguaucacaggcaaaacagaau

SEQ ID NO: 325825 - RNA, 20 nt, Homo sapiens
aguauucacuuuuuucaugg

SEQ ID NO: 325826 - RNA, 22 nt, Homo sapiens
agucacagguucuugggauuag

SEQ ID NO: 325827 - RNA, 23 nt, Homo sapiens
agucaguaugcuccuuggauccc

SEQ ID NO: 325828 - RNA, 22 nt, Homo sapiens
agucagucuguccugugcugag

SEQ ID NO: 325829 - RNA, 22 nt, Homo sapiens
agucagugucuguaaggagaac

SEQ ID NO: 325830 - RNA, 22 nt, Homo sapiens
agucauuguugagaugguguca

SEQ ID NO: 325831 - RNA, 22 nt, Homo sapiens
aguccagguuuuguaauggcaa

SEQ ID NO: 325832 - RNA, 22 nt, Homo sapiens
agugaaaucugaagaaggucau

SEQ ID NO: 325833 - RNA, 19 nt, Homo sapiens
agugagccaagauccuacc

SEQ ID NO: 325834 - RNA, 22 nt, Homo sapiens
agugagcuguuuuuacuuucug

SEQ ID NO: 325835 - RNA, 22 nt, Homo sapiens
agugauauguuugccuugaggg

SEQ ID NO: 325836 - RNA, 22 nt, Homo sapiens
agugaucauuugaauugaugau

SEQ ID NO: 325837 - RNA, 22 nt, Homo sapiens
agugcaaagccgagguuucuug

SEQ ID NO: 325838 - RNA, 22 nt, Homo sapiens
agugcaauggugccaucauagc

SEQ ID NO: 325839 - RNA, 22 nt, Homo sapiens
agugcaguggugccaucauaac

SEQ ID NO: 325840 - RNA, 22 nt, Homo sapiens
agugcauaugucuuuuuggaag

SEQ ID NO: 325841 - RNA, 22 nt, Homo sapiens
agugccuacuauguagaugcug

SEQ ID NO: 325842 - RNA, 23 nt, Homo sapiens
agugccuaguauauaggaggcgc

SEQ ID NO: 325843 - RNA, 22 nt, Homo sapiens
aguggaauuaagaaacugaauu

SEQ ID NO: 325844 - RNA, 22 nt, Homo sapiens
aguggcuuuuuaguggcagaug

SEQ ID NO: 325845 - RNA, 22 nt, Homo sapiens
agugggccccuagaggugaggu

SEQ ID NO: 325846 - RNA, 22 nt, Homo sapiens
agugguguugccuguugaccua

SEQ ID NO: 325847 - RNA, 22 nt, Homo sapiens
aguguuuuucaugggauacuuu

SEQ ID NO: 325848 - RNA, 22 nt, Homo sapiens
aguucaauggguuuucacucau

SEQ ID NO: 325849 - RNA, 22 nt, Homo sapiens
aguuggugauugauugggucug

SEQ ID NO: 325850 - RNA, 22 nt, Homo sapiens
auaaacagcuuauccucuauuc

SEQ ID NO: 325851 - RNA, 19 nt, Homo sapiens
auaaacuagaacugucccc

SEQ ID NO: 325852 - RNA, 22 nt, Homo sapiens
auaaagacacuuggcaugauuu

SEQ ID NO: 325853 - RNA, 22 nt, Homo sapiens
auaaagcuauuccucucuuuuu

SEQ ID NO: 325854 - RNA, 22 nt, Homo sapiens
auaaaugcaaugguauuuuuga

SEQ ID NO: 325855 - RNA, 22 nt, Homo sapiens
auaaaugccuguuguuuuaagc

SEQ ID NO: 325856 - RNA, 22 nt, Homo sapiens
auaaauucauuuaagcuccuua

SEQ ID NO: 325857 - RNA, 22 nt, Homo sapiens
auaacagcugcaaggcaaaagc

SEQ ID NO: 325858 - RNA, 22 nt, Homo sapiens
auaagaagugaaccagacgucu

SEQ ID NO: 325859 - RNA, 22 nt, Homo sapiens
auaagugcuuguugaauaauag

SEQ ID NO: 325860 - RNA, 22 nt, Homo sapiens
auaauaccugccacauuugaau

SEQ ID NO: 325861 - RNA, 22 nt, Homo sapiens
auaauacuuuuauuuugaggaa

SEQ ID NO: 325862 - RNA, 22 nt, Homo sapiens
auaauagguugauugacauugc

SEQ ID NO: 325863 - RNA, 22 nt, Homo sapiens
auaaugacuuccaguuccacuc

SEQ ID NO: 325864 - RNA, 23 nt, Homo sapiens
auaaugcaaguggugguaaucug

SEQ ID NO: 325865 - RNA, 22 nt, Homo sapiens
auacacauuccugggccucacc

SEQ ID NO: 325866 - RNA, 22 nt, Homo sapiens
auacacuggagcaaaccuggag

SEQ ID NO: 325867 - RNA, 22 nt, Homo sapiens
auacagugaauaucuggggcag

SEQ ID NO: 325868 - RNA, 22 nt, Homo sapiens
auacaguguauguauaguacau

SEQ ID NO: 325869 - RNA, 22 nt, Homo sapiens
auacaguguucugggaagaagu

SEQ ID NO: 325870 - RNA, 22 nt, Homo sapiens
auacaugugcaggucagguuac

SEQ ID NO: 325871 - RNA, 22 nt, Homo sapiens
auacaugugugagcgaagaugu

SEQ ID NO: 325872 - RNA, 22 nt, Homo sapiens
auacauguucaagggcauauau

SEQ ID NO: 325873 - RNA, 22 nt, Homo sapiens
auacauguuucauguuggugug

SEQ ID NO: 325874 - RNA, 20 nt, Homo sapiens
auaccacagacuggguaguu

SEQ ID NO: 325875 - RNA, 22 nt, Homo sapiens
auacugguuuuugucaugugga

SEQ ID NO: 325876 - RNA, 22 nt, Homo sapiens
auacuguauaggauuguagccu

SEQ ID NO: 325877 - RNA, 22 nt, Homo sapiens
auacuguuucugaacuuugauu

SEQ ID NO: 325878 - RNA, 22 nt, Homo sapiens
auagaagcuauguauaggggcc

SEQ ID NO: 325879 - RNA, 22 nt, Homo sapiens
auagaagcugccaacguuucag

SEQ ID NO: 325880 - RNA, 22 nt, Homo sapiens
auagaauguauuaguaaauuug

SEQ ID NO: 325881 - RNA, 22 nt, Homo sapiens
auagaauguuugcgccagguga

SEQ ID NO: 325882 - RNA, 22 nt, Homo sapiens
auagacugaguggcuuaaacca

SEQ ID NO: 325883 - RNA, 22 nt, Homo sapiens
auagagcuaccauagaauccag

SEQ ID NO: 325884 - RNA, 23 nt, Homo sapiens
auagagcuaggaugcagacagau

SEQ ID NO: 325885 - RNA, 22 nt, Homo sapiens
auagaucuauuuauguaucccu

SEQ ID NO: 325886 - RNA, 22 nt, Homo sapiens
auagcaaugcaagaauggcuua

SEQ ID NO: 325887 - RNA, 22 nt, Homo sapiens
auagcaaugccccauucccagu

SEQ ID NO: 325888 - RNA, 22 nt, Homo sapiens
auagcaauuugggaaucagacu

SEQ ID NO: 325889 - RNA, 22 nt, Homo sapiens
auagcacaugugcaaauggcug

SEQ ID NO: 325890 - RNA, 22 nt, Homo sapiens
auagcacugguuuuucuugguu

SEQ ID NO: 325891 - RNA, 22 nt, Homo sapiens
auagcagaauuuggucaagucu

SEQ ID NO: 325892 - RNA, 20 nt, Homo sapiens
auagcagcaugauuuauagu

SEQ ID NO: 325893 - RNA, 22 nt, Homo sapiens
auagcagcuugucagggcagac

SEQ ID NO: 325894 - RNA, 22 nt, Homo sapiens
auagcagugccccaaacuccug

SEQ ID NO: 325895 - RNA, 22 nt, Homo sapiens
auagcagugugaaaauguacua

SEQ ID NO: 325896 - RNA, 22 nt, Homo sapiens
auagcaucauuucuugaaaaga

SEQ ID NO: 325897 - RNA, 22 nt, Homo sapiens
auagcuguugaauggaauauuc

SEQ ID NO: 325898 - RNA, 22 nt, Homo sapiens
auaguauaguugaggauggcau

SEQ ID NO: 325899 - RNA, 22 nt, Homo sapiens
auagucaaaucucauuaccccc

SEQ ID NO: 325900 - RNA, 22 nt, Homo sapiens
auagugcugcaaaaaacauacg

SEQ ID NO: 325901 - RNA, 22 nt, Homo sapiens
auagugcugcaagaaacauacg

SEQ ID NO: 325902 - RNA, 22 nt, Homo sapiens
auagugcugcaauaaacauaca

SEQ ID NO: 325903 - RNA, 22 nt, Homo sapiens
auagugcugcaauaaccauggg

SEQ ID NO: 325904 - RNA, 22 nt, Homo sapiens
auagugcugcacuaaacauaca

SEQ ID NO: 325905 - RNA, 22 nt, Homo sapiens
auagugcugcagucaauguacg

SEQ ID NO: 325906 - RNA, 22 nt, Homo sapiens
auagugcugcauuaaacauacg

SEQ ID NO: 325907 - RNA, 22 nt, Homo sapiens
auagugcugccauaaacauacg

SEQ ID NO: 325908 - RNA, 22 nt, Homo sapiens
auagugcuguauuaaacauacg

SEQ ID NO: 325909 - RNA, 19 nt, Homo sapiens
auauaacauccaggagcag

SEQ ID NO: 325910 - RNA, 22 nt, Homo sapiens
auauagcucuggcuggaugacu

SEQ ID NO: 325911 - RNA, 22 nt, Homo sapiens
auauaugcuaagugcuaauaaa

SEQ ID NO: 325912 - RNA, 22 nt, Homo sapiens
auaucacucccaauaucgcagg

SEQ ID NO: 325913 - RNA, 22 nt, Homo sapiens
auaucccaguguguaaacacug

SEQ ID NO: 325914 - RNA, 22 nt, Homo sapiens
auaugcaaauccauagagacag

SEQ ID NO: 325915 - RNA, 22 nt, Homo sapiens
auaugcacaguggaguacuauu

SEQ ID NO: 325916 - RNA, 22 nt, Homo sapiens
auaugcauacccucaccaacua

SEQ ID NO: 325917 - RNA, 22 nt, Homo sapiens
auaugguacuuaugcucaaacu

SEQ ID NO: 325918 - RNA, 22 nt, Homo sapiens
auauguaguuucagaaguggaa

SEQ ID NO: 325919 - RNA, 22 nt, Homo sapiens
auauguauuuuaacguguaagg

SEQ ID NO: 325920 - RNA, 22 nt, Homo sapiens
auauguucucauucauaugugg

SEQ ID NO: 325921 - RNA, 22 nt, Homo sapiens
auauuacuggcuauaucgcaag

SEQ ID NO: 325922 - RNA, 22 nt, Homo sapiens
auauucacuauaugcagaacca

SEQ ID NO: 325923 - RNA, 18 nt, Homo sapiens
auauugcauuggauggau

SEQ ID NO: 325924 - RNA, 22 nt, Homo sapiens
auauuguuggcugcuggcugau

SEQ ID NO: 325925 - RNA, 22 nt, Homo sapiens
aucaaagcagcauggcccaguc

SEQ ID NO: 325926 - RNA, 22 nt, Homo sapiens
aucaaaguaucucaauauggua

SEQ ID NO: 325927 - RNA, 22 nt, Homo sapiens
aucaaagugaaauauuaguuau

SEQ ID NO: 325928 - RNA, 22 nt, Homo sapiens
aucaaauugucauuuuaaggau

SEQ ID NO: 325929 - RNA, 22 nt, Homo sapiens
aucaagcuggcauauguaguuc

SEQ ID NO: 325930 - RNA, 22 nt, Homo sapiens
aucacaauuguacguaggagcc

SEQ ID NO: 325931 - RNA, 22 nt, Homo sapiens
aucacacucaccuucuguccuu

SEQ ID NO: 325932 - RNA, 22 nt, Homo sapiens
aucacagaguuaaaacuuucuu

SEQ ID NO: 325933 - RNA, 22 nt, Homo sapiens
aucacaguggcucacaagagcc

SEQ ID NO: 325934 - RNA, 22 nt, Homo sapiens
aucacauggccuagccuaaccu

SEQ ID NO: 325935 - RNA, 19 nt, Homo sapiens
aucaccagucuuuccacug

SEQ ID NO: 325936 - RNA, 22 nt, Homo sapiens
aucaccugagcaguauacacug

SEQ ID NO: 325937 - RNA, 22 nt, Homo sapiens
aucaccuuucccuuucugaauc

SEQ ID NO: 325938 - RNA, 22 nt, Homo sapiens
aucacugggauggaacugcuga

SEQ ID NO: 325939 - RNA, 22 nt, Homo sapiens
aucacuggucaugagagaagua

SEQ ID NO: 325940 - RNA, 22 nt, Homo sapiens
gucagggagucucuaucagugg

SEQ ID NO: 325941 - RNA, 22 nt, Homo sapiens
gucagguaccugaaagcagcca

SEQ ID NO: 325942 - RNA, 22 nt, Homo sapiens
gucagguauguuccaaaggcgg

SEQ ID NO: 325943 - RNA, 22 nt, Homo sapiens
gucagugauugauuuaaagacg

SEQ ID NO: 325944 - RNA, 22 nt, Homo sapiens
gucagugccugucccaggcuuu

SEQ ID NO: 325945 - RNA, 22 nt, Homo sapiens
gucaucaucaguccucugugca

SEQ ID NO: 325946 - RNA, 22 nt, Homo sapiens
gucauggaacaacuuaaaguca

SEQ ID NO: 325947 - RNA, 22 nt, Homo sapiens
gucauggacaguuugcuaauug

SEQ ID NO: 325948 - RNA, 22 nt, Homo sapiens
gucauugagucagggaguaucu

SEQ ID NO: 325949 - RNA, 22 nt, Homo sapiens
gucauugcacuccagccuggac

SEQ ID NO: 325950 - RNA, 18 nt, Homo sapiens
guccauuuguugguacac

SEQ ID NO: 325951 - RNA, 22 nt, Homo sapiens
gucccugcgauugugggauccu

SEQ ID NO: 325952 - RNA, 22 nt, Homo sapiens
gucguggagcucacagugugcc

SEQ ID NO: 325953 - RNA, 22 nt, Homo sapiens
gucuaguuuuaauacauuaaga

SEQ ID NO: 325954 - RNA, 22 nt, Homo sapiens
gucuaugagucccugaauuuaa

SEQ ID NO: 325955 - RNA, 22 nt, Homo sapiens
gucucacaggcaugaugccagc

SEQ ID NO: 325956 - RNA, 22 nt, Homo sapiens
gucucccaaccccugugcccag

SEQ ID NO: 325957 - RNA, 22 nt, Homo sapiens
gucuccgagccguguggagccg

SEQ ID NO: 325958 - RNA, 22 nt, Homo sapiens
gucuggagacuugggucaucaa

SEQ ID NO: 325959 - RNA, 22 nt, Homo sapiens
gucuggcaauggcagacuggca

SEQ ID NO: 325960 - RNA, 22 nt, Homo sapiens
gucugugcauuaauacgugcug

SEQ ID NO: 325961 - RNA, 22 nt, Homo sapiens
gucugugguuccuaugucaccu

SEQ ID NO: 325962 - RNA, 21 nt, Homo sapiens
gucuuacagccagaugccucu

SEQ ID NO: 325963 - RNA, 22 nt, Homo sapiens
gucuuuaguugaaacauguggu

SEQ ID NO: 325964 - RNA, 22 nt, Homo sapiens
gucuuugaugucuaugugcuuc

SEQ ID NO: 325965 - RNA, 22 nt, Homo sapiens
gucuuugcauguauguucauga

SEQ ID NO: 325966 - RNA, 22 nt, Homo sapiens
gucuuuguuuugauuuaccaga

SEQ ID NO: 325967 - RNA, 22 nt, Homo sapiens
gugaaaagaugagcaccauaca

SEQ ID NO: 325968 - RNA, 22 nt, Homo sapiens
gugaaacuggguggugagagac

SEQ ID NO: 325969 - RNA, 22 nt, Homo sapiens
gugaaagacagcauuaauggcu

SEQ ID NO: 325970 - RNA, 22 nt, Homo sapiens
gugaaagacauauaugguuuga

SEQ ID NO: 325971 - RNA, 22 nt, Homo sapiens
gugaaaugaaacgcuaugucuu

SEQ ID NO: 325972 - RNA, 22 nt, Homo sapiens
gugaacaagcaaaggcaggagg

SEQ ID NO: 325973 - RNA, 22 nt, Homo sapiens
gugaacagcagaugagugagug

SEQ ID NO: 325974 - RNA, 22 nt, Homo sapiens
gugaauagggaauaaugggauc

SEQ ID NO: 325975 - RNA, 22 nt, Homo sapiens
gugacacagcaagacuccgucu

SEQ ID NO: 325976 - RNA, 22 nt, Homo sapiens
gugacaucagcuccagguauaa

SEQ ID NO: 325977 - RNA, 22 nt, Homo sapiens
gugacauuauuucagcuacaug

SEQ ID NO: 325978 - RNA, 22 nt, Homo sapiens
gugagaagaaaaauauggcugu

SEQ ID NO: 325979 - RNA, 22 nt, Homo sapiens
gugagacugguucugaacccag

SEQ ID NO: 325980 - RNA, 16 nt, Homo sapiens
gugagagaugacaaac

SEQ ID NO: 325981 - RNA, 22 nt, Homo sapiens
gugagauaaugucucauugugg

SEQ ID NO: 325982 - RNA, 22 nt, Homo sapiens
gugagaugaggucucacucugu

SEQ ID NO: 325983 - RNA, 22 nt, Homo sapiens
gugagaugguaucucauugugg

SEQ ID NO: 325984 - RNA, 22 nt, Homo sapiens
gugagaugugacuucugccucu

SEQ ID NO: 325985 - RNA, 22 nt, Homo sapiens
gugagauuaguucuggaccugg

SEQ ID NO: 325986 - RNA, 19 nt, Homo sapiens
gugagcaaugcauugcacu

SEQ ID NO: 325987 - RNA, 19 nt, Homo sapiens
gugagcacagacaauacaa

SEQ ID NO: 325988 - RNA, 22 nt, Homo sapiens
gugagcauaacaacagaguuua

SEQ ID NO: 325989 - RNA, 22 nt, Homo sapiens
gugagcauuacucaugggauca

SEQ ID NO: 325990 - RNA, 22 nt, Homo sapiens
gugagccaugauuuuaccacug

SEQ ID NO: 325991 - RNA, 22 nt, Homo sapiens
gugaggaaggaaaccugcuagc

SEQ ID NO: 325992 - RNA, 22 nt, Homo sapiens
gugagggagcuggaauauuuau

SEQ ID NO: 325993 - RNA, 22 nt, Homo sapiens
gugaggucagggcuguggacag

SEQ ID NO: 325994 - RNA, 22 nt, Homo sapiens
gugagguguuaaccaaccugug

SEQ ID NO: 325995 - RNA, 20 nt, Homo sapiens
gugagucauuaguaaccaaa

SEQ ID NO: 325996 - RNA, 22 nt, Homo sapiens
gugauacugcuuauuaauuuaa

SEQ ID NO: 325997 - RNA, 22 nt, Homo sapiens
gugaucaugauccugaagcauu

SEQ ID NO: 325998 - RNA, 23 nt, Homo sapiens
gugaucauuguuguggguugaau

SEQ ID NO: 325999 - RNA, 22 nt, Homo sapiens
gugaugacauucagagaugaag

SEQ ID NO: 326000 - RNA, 22 nt, Homo sapiens
gugauugucuaaucaagauaca

SEQ ID NO: 326001 - RNA, 21 nt, Homo sapiens
gugcaaacaucauagaaugua

SEQ ID NO: 326002 - RNA, 22 nt, Homo sapiens
gugcaaacuccaggucucuuca

SEQ ID NO: 326003 - RNA, 22 nt, Homo sapiens
gugcaaaucucugaguaucuuu

SEQ ID NO: 326004 - RNA, 22 nt, Homo sapiens
gugcaaccaucaccacugacuc

SEQ ID NO: 326005 - RNA, 18 nt, Homo sapiens
gugcaaugaauagcagag

SEQ ID NO: 326006 - RNA, 22 nt, Homo sapiens
gugcaaugucaggagaugcagc

SEQ ID NO: 326007 - RNA, 22 nt, Homo sapiens
gugcacaacaugcagguuuguu

SEQ ID NO: 326008 - RNA, 22 nt, Homo sapiens
gugcacaucuguguuccagcua

SEQ ID NO: 326009 - RNA, 22 nt, Homo sapiens
gugcacaugcgugcgcacauau

SEQ ID NO: 326010 - RNA, 21 nt, Homo sapiens
gugcagaugccacagucacuc

SEQ ID NO: 326011 - RNA, 22 nt, Homo sapiens
gugcauacucuggagacauugu

SEQ ID NO: 326012 - RNA, 22 nt, Homo sapiens
gugcauauaaguuguuucuagu

SEQ ID NO: 326013 - RNA, 22 nt, Homo sapiens
gugcauaucugugguuggcuga

SEQ ID NO: 326014 - RNA, 22 nt, Homo sapiens
gugcauguccacuaguccauau

SEQ ID NO: 326015 - RNA, 22 nt, Homo sapiens
gugcaugucugugacgacccug

SEQ ID NO: 326016 - RNA, 22 nt, Homo sapiens
gugccacaguguuaagggauuc

SEQ ID NO: 326017 - RNA, 22 nt, Homo sapiens
gugcgguauuagcaagccaaca

SEQ ID NO: 326018 - RNA, 22 nt, Homo sapiens
gugcuauguuauccagcaagau

SEQ ID NO: 326019 - RNA, 22 nt, Homo sapiens
gugcucauuuagagagaagcac

SEQ ID NO: 326020 - RNA, 22 nt, Homo sapiens
gugcuuauccccauucuggagg

SEQ ID NO: 326021 - RNA, 22 nt, Homo sapiens
gugcuuguguuaauauguagcu

SEQ ID NO: 326022 - RNA, 22 nt, Homo sapiens
guggaaaacauaugcuuguuga

SEQ ID NO: 326023 - RNA, 22 nt, Homo sapiens
guggaagguaaugcagcuuacu

SEQ ID NO: 326024 - RNA, 22 nt, Homo sapiens
guggaaugcaguguugauucaa

SEQ ID NO: 326025 - RNA, 22 nt, Homo sapiens
guggaauuauagagacaucuug

SEQ ID NO: 326026 - RNA, 22 nt, Homo sapiens
guggacaugaauuuuggaggca

SEQ ID NO: 326027 - RNA, 22 nt, Homo sapiens
guggacggagguugcagugagc

SEQ ID NO: 326028 - RNA, 22 nt, Homo sapiens
guggaggacuggauaaagaaaa

SEQ ID NO: 326029 - RNA, 22 nt, Homo sapiens
guggaucacuugaggucaagag

SEQ ID NO: 326030 - RNA, 22 nt, Homo sapiens
guggaucacuugagguuagaag

SEQ ID NO: 326031 - RNA, 22 nt, Homo sapiens
guggcaaagaugccuucuccaa

SEQ ID NO: 326032 - RNA, 22 nt, Homo sapiens
guggcaaguguuccaagaggcg

SEQ ID NO: 326033 - RNA, 22 nt, Homo sapiens
uagauuauuggcugauuugauc

SEQ ID NO: 326034 - RNA, 22 nt, Homo sapiens
uagauuguaauaugcagaaugg

SEQ ID NO: 326035 - RNA, 22 nt, Homo sapiens
uagcaaaucaauggaauugaag

SEQ ID NO: 326036 - RNA, 21 nt, Homo sapiens
uagcaaauugcuauuaaggca

SEQ ID NO: 326037 - RNA, 22 nt, Homo sapiens
uagcaagaugaauuugugcaaa

SEQ ID NO: 326038 - RNA, 22 nt, Homo sapiens
uagcaaguguuuaagcacuuuu

SEQ ID NO: 326039 - RNA, 22 nt, Homo sapiens
uagcacagggaauugguucucu

SEQ ID NO: 326040 - RNA, 17 nt, Homo sapiens
uagcacagugccuggua

SEQ ID NO: 326041 - RNA, 20 nt, Homo sapiens
uagcacaucuggcuguagag

SEQ ID NO: 326042 - RNA, 22 nt, Homo sapiens
uagcacaucuucuuggccugca

SEQ ID NO: 326043 - RNA, 22 nt, Homo sapiens
uagcacaugucagguaauuugc

SEQ ID NO: 326044 - RNA, 22 nt, Homo sapiens
uagcaccaaacauauacucagu

SEQ ID NO: 326045 - RNA, 22 nt, Homo sapiens
uagcaccucuuuggccuuucgu

SEQ ID NO: 326046 - RNA, 19 nt, Homo sapiens
uagcacuacagaguuuagc

SEQ ID NO: 326047 - RNA, 22 nt, Homo sapiens
uagcacuauguuaucacauacu

SEQ ID NO: 326048 - RNA, 22 nt, Homo sapiens
uagcacuauuuauugaaaagga

SEQ ID NO: 326049 - RNA, 23 nt, Homo sapiens
uagcacuuuuuacauauggacau

SEQ ID NO: 326050 - RNA, 22 nt, Homo sapiens
uagcagaauaacuugccagccu

SEQ ID NO: 326051 - RNA, 22 nt, Homo sapiens
uagcagcaaagcaggaucugcu

SEQ ID NO: 326052 - RNA, 19 nt, Homo sapiens
uagcagcaugauuuauaau

SEQ ID NO: 326053 - RNA, 22 nt, Homo sapiens
uagcaguauggagcgaggccca

SEQ ID NO: 326054 - RNA, 22 nt, Homo sapiens
uagcaguauugaaagaugaggg

SEQ ID NO: 326055 - RNA, 22 nt, Homo sapiens
uagcagugugaaaacggacuaa

SEQ ID NO: 326056 - RNA, 21 nt, Homo sapiens
uagcauacauuuugcaucuua

SEQ ID NO: 326057 - RNA, 22 nt, Homo sapiens
uagcaucagauuccauauucua

SEQ ID NO: 326058 - RNA, 22 nt, Homo sapiens
uagcauccuucucuaaacagga

SEQ ID NO: 326059 - RNA, 22 nt, Homo sapiens
uagcauggagucaugcacggcu

SEQ ID NO: 326060 - RNA, 22 nt, Homo sapiens
uagcccagugagguugauuugg

SEQ ID NO: 326061 - RNA, 20 nt, Homo sapiens
uagccggguguugugucaug

SEQ ID NO: 326062 - RNA, 22 nt, Homo sapiens
uagccucacaaagugcuuaaga

SEQ ID NO: 326063 - RNA, 21 nt, Homo sapiens
uagcuacacugugauucaugg

SEQ ID NO: 326064 - RNA, 19 nt, Homo sapiens
uagcuagauuggguacuua

SEQ ID NO: 326065 - RNA, 22 nt, Homo sapiens
uagcucagcccagcuaagcuca

SEQ ID NO: 326066 - RNA, 17 nt, Homo sapiens
uagcucuauuucuagcc

SEQ ID NO: 326067 - RNA, 22 nt, Homo sapiens
uagcugcccagcacgaaguugg

SEQ ID NO: 326068 - RNA, 22 nt, Homo sapiens
uagcuggaauuacuugcaccug

SEQ ID NO: 326069 - RNA, 22 nt, Homo sapiens
uagcuucuccauagcuccaugu

SEQ ID NO: 326070 - RNA, 18 nt, Homo sapiens
uaggaacauugauuggag

SEQ ID NO: 326071 - RNA, 22 nt, Homo sapiens
uaggacacagaccuggauggaa

SEQ ID NO: 326072 - RNA, 22 nt, Homo sapiens
uaggacacucucuccaccagua

SEQ ID NO: 326073 - RNA, 22 nt, Homo sapiens
uaggacauugcccuuguggaga

SEQ ID NO: 326074 - RNA, 19 nt, Homo sapiens
uaggacccugguggccccc

SEQ ID NO: 326075 - RNA, 22 nt, Homo sapiens
uaggagcacaaaccccauugug

SEQ ID NO: 326076 - RNA, 22 nt, Homo sapiens
uaggagcacaaacccuacugug

SEQ ID NO: 326077 - RNA, 22 nt, Homo sapiens
uaggagcacagcagcauguggg

SEQ ID NO: 326078 - RNA, 22 nt, Homo sapiens
uaggcaaguugcccaaucucuc

SEQ ID NO: 326079 - RNA, 22 nt, Homo sapiens
uaggcacacaucuacuacaaau

SEQ ID NO: 326080 - RNA, 22 nt, Homo sapiens
uaggcacugagaauaugaggau

SEQ ID NO: 326081 - RNA, 22 nt, Homo sapiens
uaggcagccagcuguggauuga

SEQ ID NO: 326082 - RNA, 22 nt, Homo sapiens
uaggcaguggagaaauaaacag

SEQ ID NO: 326083 - RNA, 22 nt, Homo sapiens
uaggccuuuuucagauggguag

SEQ ID NO: 326084 - RNA, 22 nt, Homo sapiens
uaggcuuuucugggaugugggc

SEQ ID NO: 326085 - RNA, 22 nt, Homo sapiens
uaggcuuuuggacccugucucu

SEQ ID NO: 326086 - RNA, 19 nt, Homo sapiens
uagggcacgaggcagaguc

SEQ ID NO: 326087 - RNA, 22 nt, Homo sapiens
uagggcauuuagaggcuauuaa

SEQ ID NO: 326088 - RNA, 22 nt, Homo sapiens
uagggcuugugaucagguguag

SEQ ID NO: 326089 - RNA, 22 nt, Homo sapiens
uagggcuuuuccaagcugccac

SEQ ID NO: 326090 - RNA, 22 nt, Homo sapiens
uagguaguuacacagcaaugua

SEQ ID NO: 326091 - RNA, 22 nt, Homo sapiens
uaggugguuugaaauacucaag

SEQ ID NO: 326092 - RNA, 22 nt, Homo sapiens
uagguuguucuauuaucuuaca

SEQ ID NO: 326093 - RNA, 22 nt, Homo sapiens
uaguaaacagcucugccacaau

SEQ ID NO: 326094 - RNA, 22 nt, Homo sapiens
uaguaucacauggucuuaauua

SEQ ID NO: 326095 - RNA, 22 nt, Homo sapiens
uagucacacacucaacuuuuca

SEQ ID NO: 326096 - RNA, 20 nt, Homo sapiens
uagucaugagauucuccaag

SEQ ID NO: 326097 - RNA, 22 nt, Homo sapiens
uaguccauuuucaugcugcuau

SEQ ID NO: 326098 - RNA, 22 nt, Homo sapiens
uagugcugagauugagaagccc

SEQ ID NO: 326099 - RNA, 21 nt, Homo sapiens
uagugcugaggcaguauggga

SEQ ID NO: 326100 - RNA, 22 nt, Homo sapiens
uagugcuguaauucuaaugaaa

SEQ ID NO: 326101 - RNA, 22 nt, Homo sapiens
uagugcugugauauuuuuggcc

SEQ ID NO: 326102 - RNA, 22 nt, Homo sapiens
uagugcugugauuaacauaaug

SEQ ID NO: 326103 - RNA, 22 nt, Homo sapiens
uaguggauguucagagauuuga

SEQ ID NO: 326104 - RNA, 22 nt, Homo sapiens
uagugguaguagcaguaauauu

SEQ ID NO: 326105 - RNA, 22 nt, Homo sapiens
uaguguuuuucauuggcagagg

SEQ ID NO: 326106 - RNA, 22 nt, Homo sapiens
uaguuaguagacucugauuauu

SEQ ID NO: 326107 - RNA, 22 nt, Homo sapiens
uaguuauggaguaauuuuaagc

SEQ ID NO: 326108 - RNA, 22 nt, Homo sapiens
uaguucauuauguguugcucag

SEQ ID NO: 326109 - RNA, 22 nt, Homo sapiens
uaguucauuuuucuugcuuaga

SEQ ID NO: 326110 - RNA, 22 nt, Homo sapiens
uauaacacccacauauagucuu

SEQ ID NO: 326111 - RNA, 22 nt, Homo sapiens
uauaaccauuucuucucucuuc

SEQ ID NO: 326112 - RNA, 22 nt, Homo sapiens
uauaagacuagcagcugaauug

SEQ ID NO: 326113 - RNA, 22 nt, Homo sapiens
uauacaugugggcaucaggaga

SEQ ID NO: 326114 - RNA, 22 nt, Homo sapiens
uauacugucuuuguaugccuag

SEQ ID NO: 326115 - RNA, 22 nt, Homo sapiens
uauacuguuuucuauaguggcu

SEQ ID NO: 326116 - RNA, 21 nt, Homo sapiens
uauaguaguaugauuuacaau

SEQ ID NO: 326117 - RNA, 22 nt, Homo sapiens
uauauaagcugaugagccacaa

SEQ ID NO: 326118 - RNA, 22 nt, Homo sapiens
uauaucuagagcggaccaggcu

SEQ ID NO: 326119 - RNA, 21 nt, Homo sapiens
uauaugacuuacuauugccuc

SEQ ID NO: 326120 - RNA, 22 nt, Homo sapiens
uauaugcacucagguguaugug

SEQ ID NO: 326121 - RNA, 22 nt, Homo sapiens
uauaugcucugggauccugaaa

SEQ ID NO: 326122 - RNA, 22 nt, Homo sapiens
uauauguucuugcacuggaaag

SEQ ID NO: 326123 - RNA, 22 nt, Homo sapiens
uaucaagauggauaaggauaga

SEQ ID NO: 326124 - RNA, 19 nt, Homo sapiens
uaucaaguaugcacuguac

SEQ ID NO: 326125 - RNA, 22 nt, Homo sapiens
uaucaaucuagggaaacuccaa

SEQ ID NO: 326126 - RNA, 22 nt, Homo sapiens
uaucacagcauugucuauaaua

SEQ ID NO: 326127 - RNA, 22 nt, Homo sapiens
ucacaggguguuauuagaauua

SEQ ID NO: 326128 - RNA, 22 nt, Homo sapiens
ucacaguaaauccagaagaaau

SEQ ID NO: 326129 - RNA, 22 nt, Homo sapiens
ucacaguagccccucccaucau

SEQ ID NO: 326130 - RNA, 22 nt, Homo sapiens
ucacagucggugacuucuugcu

SEQ ID NO: 326131 - RNA, 22 nt, Homo sapiens
ucacaguguuaaaccuuucuuu

SEQ ID NO: 326132 - RNA, 22 nt, Homo sapiens
ucacaugaagauuuuaguauac

SEQ ID NO: 326133 - RNA, 21 nt, Homo sapiens
ucacauggccagaguaggaac

SEQ ID NO: 326134 - RNA, 18 nt, Homo sapiens
ucacauggccgagagaga

SEQ ID NO: 326135 - RNA, 22 nt, Homo sapiens
ucacaugugaagauugggagua

SEQ ID NO: 326136 - RNA, 22 nt, Homo sapiens
ucacaugugcguuuuggcaugu

SEQ ID NO: 326137 - RNA, 22 nt, Homo sapiens
ucacauguguaaauugguguaa

SEQ ID NO: 326138 - RNA, 22 nt, Homo sapiens
ucacauuguauauguaccuauc

SEQ ID NO: 326139 - RNA, 22 nt, Homo sapiens
ucacauuguguagccugcucac

SEQ ID NO: 326140 - RNA, 22 nt, Homo sapiens
ucaccaguaauaaagagccugc

SEQ ID NO: 326141 - RNA, 22 nt, Homo sapiens
ucaccaguacuccaaauugagg

SEQ ID NO: 326142 - RNA, 16 nt, Homo sapiens
ucaccccuagagaucc

SEQ ID NO: 326143 - RNA, 22 nt, Homo sapiens
ucaccggcagacguggccugau

SEQ ID NO: 326144 - RNA, 22 nt, Homo sapiens
ucaccuggagaagauggaucau

SEQ ID NO: 326145 - RNA, 22 nt, Homo sapiens
ucaccuggagacaugaagacug

SEQ ID NO: 326146 - RNA, 22 nt, Homo sapiens
ucaccuggggaucuuguuuaca

SEQ ID NO: 326147 - RNA, 21 nt, Homo sapiens
ucaccuguugcgaugaagcug

SEQ ID NO: 326148 - RNA, 22 nt, Homo sapiens
ucaccuuacuugcuucugaacu

SEQ ID NO: 326149 - RNA, 18 nt, Homo sapiens
ucaccuugcuuuuagaac

SEQ ID NO: 326150 - RNA, 18 nt, Homo sapiens
ucacggggagcagcagcc

SEQ ID NO: 326151 - RNA, 19 nt, Homo sapiens
ucacgugcagcagccacac

SEQ ID NO: 326152 - RNA, 22 nt, Homo sapiens
ucacuaaagaaaauggcaugga

SEQ ID NO: 326153 - RNA, 22 nt, Homo sapiens
ucacuagggagaaacugaggcu

SEQ ID NO: 326154 - RNA, 22 nt, Homo sapiens
ucacuagggaucacuuuacccg

SEQ ID NO: 326155 - RNA, 22 nt, Homo sapiens
ucacucagaccuggugauaugc

SEQ ID NO: 326156 - RNA, 22 nt, Homo sapiens
ucacugaaaccgccuccaccuc

SEQ ID NO: 326157 - RNA, 22 nt, Homo sapiens
ucacugaaaccuccaccucucg

SEQ ID NO: 326158 - RNA, 22 nt, Homo sapiens
ucacugaaaccuccgccuucug

SEQ ID NO: 326159 - RNA, 22 nt, Homo sapiens
ucacugagaaugauguuucuga

SEQ ID NO: 326160 - RNA, 22 nt, Homo sapiens
ucacugagcacaggagaugugc

SEQ ID NO: 326161 - RNA, 20 nt, Homo sapiens
ucacugaguaucuacgauua

SEQ ID NO: 326162 - RNA, 22 nt, Homo sapiens
ucacugcgaccuccaccuccug

SEQ ID NO: 326163 - RNA, 22 nt, Homo sapiens
ucacugugcaugaaggaugcug

SEQ ID NO: 326164 - RNA, 22 nt, Homo sapiens
ucacuguggaacucaaaaagcu

SEQ ID NO: 326165 - RNA, 22 nt, Homo sapiens
ucacugugguuuugaugugcau

SEQ ID NO: 326166 - RNA, 22 nt, Homo sapiens
ucacugugugucucuguaucug

SEQ ID NO: 326167 - RNA, 22 nt, Homo sapiens
ucacuguugaugggcaugcagg

SEQ ID NO: 326168 - RNA, 22 nt, Homo sapiens
ucacuugguggcaaaguuuaug

SEQ ID NO: 326169 - RNA, 21 nt, Homo sapiens
ucagaagcucccagggaggac

SEQ ID NO: 326170 - RNA, 22 nt, Homo sapiens
ucagaauguaacuuuaguugga

SEQ ID NO: 326171 - RNA, 22 nt, Homo sapiens
ucagacacuguggccuuuggac

SEQ ID NO: 326172 - RNA, 22 nt, Homo sapiens
ucagagucuagaucacucacug

SEQ ID NO: 326173 - RNA, 22 nt, Homo sapiens
ucagagugcagggaguagcagc

SEQ ID NO: 326174 - RNA, 22 nt, Homo sapiens
ucagauacuggugacaugaaug

SEQ ID NO: 326175 - RNA, 22 nt, Homo sapiens
ucagaugaucugguaagaacuu

SEQ ID NO: 326176 - RNA, 22 nt, Homo sapiens
ucagaugaugucccuguucuaa

SEQ ID NO: 326177 - RNA, 22 nt, Homo sapiens
ucagaugauucuguuguugugu

SEQ ID NO: 326178 - RNA, 22 nt, Homo sapiens
ucagauguuugagaaguauacu

SEQ ID NO: 326179 - RNA, 22 nt, Homo sapiens
ucagauuggugcaaaaguaauu

SEQ ID NO: 326180 - RNA, 22 nt, Homo sapiens
ucagcaaugaccuaagcaaaua

SEQ ID NO: 326181 - RNA, 22 nt, Homo sapiens
ucagcaaugcugcacucuacug

SEQ ID NO: 326182 - RNA, 22 nt, Homo sapiens
ucagcaucacgugggcucccgu

SEQ ID NO: 326183 - RNA, 22 nt, Homo sapiens
ucaggcaugcagcaaugcagug

SEQ ID NO: 326184 - RNA, 21 nt, Homo sapiens
ucagggaccugcuguacugau

SEQ ID NO: 326185 - RNA, 23 nt, Homo sapiens
ucagguaguuucagaggaccuug

SEQ ID NO: 326186 - RNA, 22 nt, Homo sapiens
ucagguaguuugugggagauga

SEQ ID NO: 326187 - RNA, 22 nt, Homo sapiens
ucagguaucucuauagcaaugu

SEQ ID NO: 326188 - RNA, 22 nt, Homo sapiens
ucagguaucuucauagcaaugc

SEQ ID NO: 326189 - RNA, 22 nt, Homo sapiens
ucagguaugucuuuaacagcag

SEQ ID NO: 326190 - RNA, 22 nt, Homo sapiens
ucaggugcagagaagaaauggg

SEQ ID NO: 326191 - RNA, 22 nt, Homo sapiens
ucaguacuuuggagcucacaua

SEQ ID NO: 326192 - RNA, 19 nt, Homo sapiens
ucaguagugcacauaagcc

SEQ ID NO: 326193 - RNA, 22 nt, Homo sapiens
ucaguaguuccaguggguauuu

SEQ ID NO: 326194 - RNA, 22 nt, Homo sapiens
ucaguaguuuuuuuacuaggug

SEQ ID NO: 326195 - RNA, 20 nt, Homo sapiens
ucaguauauuguuuccacag

SEQ ID NO: 326196 - RNA, 18 nt, Homo sapiens
ucagucacugccuggcuu

SEQ ID NO: 326197 - RNA, 22 nt, Homo sapiens
ucagucauucaauuguugaaug

SEQ ID NO: 326198 - RNA, 22 nt, Homo sapiens
ucagucuuuuuuuggcaagcau

SEQ ID NO: 326199 - RNA, 22 nt, Homo sapiens
ucagugaauguuggccacuacu

SEQ ID NO: 326200 - RNA, 17 nt, Homo sapiens
ucagugcauuuaagaga

SEQ ID NO: 326201 - RNA, 22 nt, Homo sapiens
ucagugccauugccauaugagu

SEQ ID NO: 326202 - RNA, 21 nt, Homo sapiens
ucagugcugugggcaaggugc

SEQ ID NO: 326203 - RNA, 22 nt, Homo sapiens
ucagugcuuggcacagagagcu

SEQ ID NO: 326204 - RNA, 22 nt, Homo sapiens
ucagugcuuuuuguugucauca

SEQ ID NO: 326205 - RNA, 22 nt, Homo sapiens
ucaguggacuuagucuuucccc

SEQ ID NO: 326206 - RNA, 22 nt, Homo sapiens
ucaguggagagcuuccaggauu

SEQ ID NO: 326207 - RNA, 22 nt, Homo sapiens
ucagugucaucuggguuguuug

SEQ ID NO: 326208 - RNA, 22 nt, Homo sapiens
ucagugucugugauggagaggu

SEQ ID NO: 326209 - RNA, 22 nt, Homo sapiens
ucagugucugugcaccgcugga

SEQ ID NO: 326210 - RNA, 22 nt, Homo sapiens
ucaguuaaugcugccugcugga

SEQ ID NO: 326211 - RNA, 22 nt, Homo sapiens
ucauaaaguuguuuuaauggga

SEQ ID NO: 326212 - RNA, 22 nt, Homo sapiens
ucauacuguuaaaugguuuagu

SEQ ID NO: 326213 - RNA, 19 nt, Homo sapiens
ucauagucuaagaugagaa

SEQ ID NO: 326214 - RNA, 22 nt, Homo sapiens
ucauaucauuagaucuacugua

SEQ ID NO: 326215 - RNA, 22 nt, Homo sapiens
ucauauguaugugcaauuuugu

SEQ ID NO: 326216 - RNA, 21 nt, Homo sapiens
ucaucaagcuguagacaugau

SEQ ID NO: 326217 - RNA, 22 nt, Homo sapiens
ucaucagaaucccuuagggaug

SEQ ID NO: 326218 - RNA, 22 nt, Homo sapiens
ucaugacacuggcaggagcuaa

SEQ ID NO: 326219 - RNA, 22 nt, Homo sapiens
ucaugaccaugguauagaccac

SEQ ID NO: 326220 - RNA, 20 nt, Homo sapiens
ucaugccacugcgcuccagc

SEQ ID NO: 326221 - RNA, 22 nt, Homo sapiens
uguuuguuugagauggagucuc

SEQ ID NO: 326222 - RNA, 22 nt, Homo sapiens
uguuuuggaguggacuuugcau

SEQ ID NO: 326223 - RNA, 22 nt, Homo sapiens
uguuuuguuagcacucugggaa

SEQ ID NO: 326224 - RNA, 22 nt, Homo sapiens
uuaaaaguauaggccuggcaua

SEQ ID NO: 326225 - RNA, 22 nt, Homo sapiens
uuaaaccugucuucucacuaau

SEQ ID NO: 326226 - RNA, 22 nt, Homo sapiens
uuaaacugcuugaauuggguuu

SEQ ID NO: 326227 - RNA, 22 nt, Homo sapiens
uuaaaugcauagaauguguagu

SEQ ID NO: 326228 - RNA, 21 nt, Homo sapiens
uuaacagacaagugucuuccc

SEQ ID NO: 326229 - RNA, 22 nt, Homo sapiens
uuaacagcacaugcugucccuu

SEQ ID NO: 326230 - RNA, 22 nt, Homo sapiens
uuaagcuaguuuauucaggaaa

SEQ ID NO: 326231 - RNA, 22 nt, Homo sapiens
uuaaggaaggagucuuaaaugg

SEQ ID NO: 326232 - RNA, 22 nt, Homo sapiens
uuaaggcuuucccuauguaaaa

SEQ ID NO: 326233 - RNA, 22 nt, Homo sapiens
uuaagggaggagcuucaagaug

SEQ ID NO: 326234 - RNA, 21 nt, Homo sapiens
uuaaguaauuacccaacucuc

SEQ ID NO: 326235 - RNA, 22 nt, Homo sapiens
uuaagugcucaguuacucaguu

SEQ ID NO: 326236 - RNA, 23 nt, Homo sapiens
uuaagugcuuuucugaaacucuu

SEQ ID NO: 326237 - RNA, 22 nt, Homo sapiens
uuaauacucuucuaaguagucc

SEQ ID NO: 326238 - RNA, 22 nt, Homo sapiens
uuaauacugcuuaacuuuagga

SEQ ID NO: 326239 - RNA, 22 nt, Homo sapiens
uuaauccugccuuauuucagua

SEQ ID NO: 326240 - RNA, 22 nt, Homo sapiens
uuaaucuguucucuguauucua

SEQ ID NO: 326241 - RNA, 22 nt, Homo sapiens
uuaauguaucuaucacaucaca

SEQ ID NO: 326242 - RNA, 22 nt, Homo sapiens
uuaauuguccaaguucaucucu

SEQ ID NO: 326243 - RNA, 22 nt, Homo sapiens
uuacaaguggcaucucucugga

SEQ ID NO: 326244 - RNA, 22 nt, Homo sapiens
uuacagcugcuccccaucacuc

SEQ ID NO: 326245 - RNA, 22 nt, Homo sapiens
uuacaguauugcaaggacuagg

SEQ ID NO: 326246 - RNA, 22 nt, Homo sapiens
uuacagucucaagagugcugca

SEQ ID NO: 326247 - RNA, 22 nt, Homo sapiens
uuacagugguugcuauugugaa

SEQ ID NO: 326248 - RNA, 22 nt, Homo sapiens
uuacaguucugguggagaggua

SEQ ID NO: 326249 - RNA, 22 nt, Homo sapiens
uuacaugagacugucgcuaguu

SEQ ID NO: 326250 - RNA, 22 nt, Homo sapiens
uuacauguggugugaagaagag

SEQ ID NO: 326251 - RNA, 22 nt, Homo sapiens
uuacauguuuauggggguacau

SEQ ID NO: 326252 - RNA, 22 nt, Homo sapiens
uuacauugcuucaaauucagug

SEQ ID NO: 326253 - RNA, 22 nt, Homo sapiens
uuaccuuuuuaagacagguuag

SEQ ID NO: 326254 - RNA, 22 nt, Homo sapiens
uuacuguauagaaucaucuuga

SEQ ID NO: 326255 - RNA, 22 nt, Homo sapiens
uuacuugagauggggugucacu

SEQ ID NO: 326256 - RNA, 22 nt, Homo sapiens
uuagaaaguagaaaagcugguu

SEQ ID NO: 326257 - RNA, 22 nt, Homo sapiens
uuagaacagugcucaccacaaa

SEQ ID NO: 326258 - RNA, 22 nt, Homo sapiens
uuagaauggaaaugcgagguua

SEQ ID NO: 326259 - RNA, 17 nt, Homo sapiens
uuagagguagacucauu

SEQ ID NO: 326260 - RNA, 18 nt, Homo sapiens
uuagagugcauuacuuug

SEQ ID NO: 326261 - RNA, 22 nt, Homo sapiens
uuagauaguacuuagggaaaua

SEQ ID NO: 326262 - RNA, 23 nt, Homo sapiens
uuagaucuuuaaggaaucuccac

SEQ ID NO: 326263 - RNA, 22 nt, Homo sapiens
uuagaugaagucacagaaccca

SEQ ID NO: 326264 - RNA, 22 nt, Homo sapiens
uuagaugaaugucucuuaaaca

SEQ ID NO: 326265 - RNA, 22 nt, Homo sapiens
uuagauuauugagcauccacug

SEQ ID NO: 326266 - RNA, 22 nt, Homo sapiens
uuagcacaguucauucauguua

SEQ ID NO: 326267 - RNA, 22 nt, Homo sapiens
uuagcacuaauucguuggggca

SEQ ID NO: 326268 - RNA, 22 nt, Homo sapiens
uuagcagcucuggugacaaggu

SEQ ID NO: 326269 - RNA, 22 nt, Homo sapiens
uuagcagugugaaaaaagacua

SEQ ID NO: 326270 - RNA, 22 nt, Homo sapiens
uuagcccaucuugaggaaagua

SEQ ID NO: 326271 - RNA, 21 nt, Homo sapiens
uuagccuguaagcacuuugca

SEQ ID NO: 326272 - RNA, 16 nt, Homo sapiens
uuaggcagugugauac

SEQ ID NO: 326273 - RNA, 22 nt, Homo sapiens
uuaggcaguuuauugauuuuca

SEQ ID NO: 326274 - RNA, 22 nt, Homo sapiens
uuagguagaauugauuaaguuu

SEQ ID NO: 326275 - RNA, 23 nt, Homo sapiens
uuaguaaacucaaugacaccaca

SEQ ID NO: 326276 - RNA, 22 nt, Homo sapiens
uuaguaucauccuucugcauuc

SEQ ID NO: 326277 - RNA, 22 nt, Homo sapiens
uuagucaaguguacugugaaug

SEQ ID NO: 326278 - RNA, 22 nt, Homo sapiens
uuagugaaugcaccacuucuga

SEQ ID NO: 326279 - RNA, 22 nt, Homo sapiens
uuaguuuaucagugguuucuga

SEQ ID NO: 326280 - RNA, 22 nt, Homo sapiens
uuauaacucugcagccugguau

SEQ ID NO: 326281 - RNA, 20 nt, Homo sapiens
uuauaacuuuuguucugggg

SEQ ID NO: 326282 - RNA, 22 nt, Homo sapiens
uuauagacacguuguaacaaac

SEQ ID NO: 326283 - RNA, 22 nt, Homo sapiens
uuauagcacuaagaagguaaua

SEQ ID NO: 326284 - RNA, 22 nt, Homo sapiens
uuauagcagugcccaacuccug

SEQ ID NO: 326285 - RNA, 22 nt, Homo sapiens
uuauaugcuaaacaaggggugg

SEQ ID NO: 326286 - RNA, 22 nt, Homo sapiens
uuauauguuacucccucuagca

SEQ ID NO: 326287 - RNA, 22 nt, Homo sapiens
uuauauguuucuguuuggaggc

SEQ ID NO: 326288 - RNA, 22 nt, Homo sapiens
uuaucccacuuucuguuccugu

SEQ ID NO: 326289 - RNA, 22 nt, Homo sapiens
uuaugcagcaaagugcuugaaa

SEQ ID NO: 326290 - RNA, 22 nt, Homo sapiens
uuaugcuuauugguguacggua

SEQ ID NO: 326291 - RNA, 22 nt, Homo sapiens
uuauggauuuauauucuguagu

SEQ ID NO: 326292 - RNA, 22 nt, Homo sapiens
uuaugguuuuucugugagaugg

SEQ ID NO: 326293 - RNA, 22 nt, Homo sapiens
uuaugucauuuuuggauguuaa

SEQ ID NO: 326294 - RNA, 22 nt, Homo sapiens
uuaugucuuugagcaaugcugu

SEQ ID NO: 326295 - RNA, 22 nt, Homo sapiens
uuauguguuuaauguuucugaa

SEQ ID NO: 326296 - RNA, 22 nt, Homo sapiens
uuauuagguugguggaaaagua

SEQ ID NO: 326297 - RNA, 22 nt, Homo sapiens
uuauuauguuggugcaaaggua

SEQ ID NO: 326298 - RNA, 22 nt, Homo sapiens
uuauucauuaacagggaccaaa

SEQ ID NO: 326299 - RNA, 22 nt, Homo sapiens
uuauugcuaaaucaugaccaca

SEQ ID NO: 326300 - RNA, 22 nt, Homo sapiens
uuauugcuuuugugcaggugag

SEQ ID NO: 326301 - RNA, 23 nt, Homo sapiens
uucaaauguucucugguugucag

SEQ ID NO: 326302 - RNA, 22 nt, Homo sapiens
uucaagaauuaaaguggcuuuu

SEQ ID NO: 326303 - RNA, 22 nt, Homo sapiens
uucaagauggccccagugagcc

SEQ ID NO: 326304 - RNA, 22 nt, Homo sapiens
uucaaggacuaaggauuuuugg

SEQ ID NO: 326305 - RNA, 22 nt, Homo sapiens
uucaagugaacaaaaugaggag

SEQ ID NO: 326306 - RNA, 20 nt, Homo sapiens
uucaagugauucucaugccu

SEQ ID NO: 326307 - RNA, 22 nt, Homo sapiens
uucaauaugucauuggcaggca

SEQ ID NO: 326308 - RNA, 19 nt, Homo sapiens
uucaaugcagcauugccac

SEQ ID NO: 326309 - RNA, 21 nt, Homo sapiens
uucacaagggaaguagggggc

SEQ ID NO: 326310 - RNA, 22 nt, Homo sapiens
uucacacugggccuacucugug

SEQ ID NO: 326311 - RNA, 22 nt, Homo sapiens
uucacaguggugggagacguca

SEQ ID NO: 326312 - RNA, 22 nt, Homo sapiens
uucacaugguugccuuuugauc

SEQ ID NO: 326313 - RNA, 22 nt, Homo sapiens
uucaccaguuuugucacgaaug

SEQ ID NO: 326314 - RNA, 19 nt, Homo sapiens
uuugaauauaaugcagcua

SEQ ID NO: 326315 - RNA, 22 nt, Homo sapiens
uuugaauguaaugagcaggaag

SEQ ID NO: 326316 - RNA, 22 nt, Homo sapiens
uuugacaaugugugcuuguauu

SEQ ID NO: 326317 - RNA, 22 nt, Homo sapiens
uuugacacugggagugugggug

SEQ ID NO: 326318 - RNA, 22 nt, Homo sapiens
uuugacuaccaggaauguucuu

SEQ ID NO: 326319 - RNA, 22 nt, Homo sapiens
uuugacuguggagucgaugcuu

SEQ ID NO: 326320 - RNA, 22 nt, Homo sapiens
uuugagcaggcuaaucaauaua

SEQ ID NO: 326321 - RNA, 22 nt, Homo sapiens
uuugagguguauggcaaguuga

SEQ ID NO: 326322 - RNA, 22 nt, Homo sapiens
uuugagugugauaucgauugga

SEQ ID NO: 326323 - RNA, 22 nt, Homo sapiens
uuugauguugagacuauaaagc

SEQ ID NO: 326324 - RNA, 22 nt, Homo sapiens
uuugauguugauacuaccuuca

SEQ ID NO: 326325 - RNA, 22 nt, Homo sapiens
uuugcacauauuugggcaaaag

SEQ ID NO: 326326 - RNA, 22 nt, Homo sapiens
uuugcacuucugagugugacau

SEQ ID NO: 326327 - RNA, 22 nt, Homo sapiens
uuugcacuugaaaacacucuca

SEQ ID NO: 326328 - RNA, 22 nt, Homo sapiens
uuugcacuuuaauauaauguga

SEQ ID NO: 326329 - RNA, 21 nt, Homo sapiens
uuugcacuuugcaaaucccua

SEQ ID NO: 326330 - RNA, 22 nt, Homo sapiens
uuugcacuuuuguaauaugguu

SEQ ID NO: 326331 - RNA, 22 nt, Homo sapiens
uuugcauaauaagauuagggug

SEQ ID NO: 326332 - RNA, 22 nt, Homo sapiens
uuugcaucuuagaaaguucucc

SEQ ID NO: 326333 - RNA, 19 nt, Homo sapiens
uuugccuaggcacauggcc

SEQ ID NO: 326334 - RNA, 22 nt, Homo sapiens
uuugcuugaggucuagcuaccc

SEQ ID NO: 326335 - RNA, 22 nt, Homo sapiens
uuugcuuguguaaaaaucugga

SEQ ID NO: 326336 - RNA, 22 nt, Homo sapiens
uuuggacuucuagccuccagag

SEQ ID NO: 326337 - RNA, 22 nt, Homo sapiens
uuuggcaacguuggaucccuca

SEQ ID NO: 326338 - RNA, 22 nt, Homo sapiens
uuuggcaauaaacuccccuaac

SEQ ID NO: 326339 - RNA, 22 nt, Homo sapiens
uuuggcacuauagguaaauuug

SEQ ID NO: 326340 - RNA, 20 nt, Homo sapiens
uuuggcacugagugguauaa

SEQ ID NO: 326341 - RNA, 22 nt, Homo sapiens
uuuggcacuguaaauuucucuu

SEQ ID NO: 326342 - RNA, 22 nt, Homo sapiens
uuuggcagaugacccucaaguu

SEQ ID NO: 326343 - RNA, 22 nt, Homo sapiens
uuuggcaguuauuuacucagug

SEQ ID NO: 326344 - RNA, 21 nt, Homo sapiens
uuuggcauuaugucaccagag

SEQ ID NO: 326345 - RNA, 21 nt, Homo sapiens
uuuggcuucucugcugcagcc

SEQ ID NO: 326346 - RNA, 22 nt, Homo sapiens
uuugggaaaugaaguugguaga

SEQ ID NO: 326347 - RNA, 22 nt, Homo sapiens
uuugggcuuuuaaucuagagca

SEQ ID NO: 326348 - RNA, 22 nt, Homo sapiens
uuugguaauguuucauugcaga

SEQ ID NO: 326349 - RNA, 18 nt, Homo sapiens
uuugguccuuuauaaaca

SEQ ID NO: 326350 - RNA, 22 nt, Homo sapiens
uuugguuuuuguuaucacucau

SEQ ID NO: 326351 - RNA, 22 nt, Homo sapiens
uuuguaauaccugaggcugggu

SEQ ID NO: 326352 - RNA, 22 nt, Homo sapiens
uuuguacacgugggugaauugu

SEQ ID NO: 326353 - RNA, 22 nt, Homo sapiens
uuuguacuccuuggccagcuuc

SEQ ID NO: 326354 - RNA, 22 nt, Homo sapiens
uuuguacuugaagaaucuuuau

SEQ ID NO: 326355 - RNA, 18 nt, Homo sapiens
uuuguacuuuuucuaaug

SEQ ID NO: 326356 - RNA, 22 nt, Homo sapiens
uuuguagcucacucugagcuga

SEQ ID NO: 326357 - RNA, 22 nt, Homo sapiens
uuugucauagcagcaggaaugg

SEQ ID NO: 326358 - RNA, 22 nt, Homo sapiens
uuugucuccuaagacucugugg

SEQ ID NO: 326359 - RNA, 22 nt, Homo sapiens
uuugugaggugauggauauguc

SEQ ID NO: 326360 - RNA, 22 nt, Homo sapiens
uuugugagguggauagauugca

SEQ ID NO: 326361 - RNA, 22 nt, Homo sapiens
uuugugcaugaagagggggugc

SEQ ID NO: 326362 - RNA, 22 nt, Homo sapiens
uuugugcuauguuauauauucu

SEQ ID NO: 326363 - RNA, 21 nt, Homo sapiens
uuugugguuacugugugagcu

SEQ ID NO: 326364 - RNA, 22 nt, Homo sapiens
uuugugucccucuaaaauuuau

SEQ ID NO: 326365 - RNA, 23 nt, Homo sapiens
uuugugucccucuagaauucaug

SEQ ID NO: 326366 - RNA, 22 nt, Homo sapiens
uuuguucaccucaaggauggga

SEQ ID NO: 326367 - RNA, 22 nt, Homo sapiens
uuuuaagcuacaagagacauau

SEQ ID NO: 326368 - RNA, 22 nt, Homo sapiens
uuuuacacaucaccgcucgugu

SEQ ID NO: 326369 - RNA, 22 nt, Homo sapiens
uuuuacacuucgguugugugca

SEQ ID NO: 326370 - RNA, 22 nt, Homo sapiens
uuuuacagaggagguugcugau

SEQ ID NO: 326371 - RNA, 22 nt, Homo sapiens
uuuuagcaaagagacugguggc

SEQ ID NO: 326372 - RNA, 22 nt, Homo sapiens
uuuuagcagccaugacaaagau

SEQ ID NO: 326373 - RNA, 22 nt, Homo sapiens
uuuuaguggaauauuuacaguu

SEQ ID NO: 326374 - RNA, 22 nt, Homo sapiens
uuuuaguggacaaagguauuua

SEQ ID NO: 326375 - RNA, 22 nt, Homo sapiens
uuuuaguugcucagguauucuc

SEQ ID NO: 326376 - RNA, 22 nt, Homo sapiens
uuuucaguggccauaguggaga

SEQ ID NO: 326377 - RNA, 23 nt, Homo sapiens
uuuugcaauaagucacuggaaua

SEQ ID NO: 326378 - RNA, 21 nt, Homo sapiens
uuuugcacacuaugcagcuuu

SEQ ID NO: 326379 - RNA, 22 nt, Homo sapiens
uuuugcacuagaaccagagguu

SEQ ID NO: 326380 - RNA, 22 nt, Homo sapiens
uuuugcacuguuuuaucugaca

SEQ ID NO: 326381 - RNA, 22 nt, Homo sapiens
uuuugcaggcauuggaaguuua

SEQ ID NO: 326382 - RNA, 22 nt, Homo sapiens
uuuugcuugugaauagccacau

SEQ ID NO: 326383 - RNA, 19 nt, Homo sapiens
uuuuggaaaugugaacagc

SEQ ID NO: 326384 - RNA, 17 nt, Homo sapiens
uuuuggauuagaaaucc

SEQ ID NO: 326385 - RNA, 22 nt, Homo sapiens
uuuuggcucugucuguaucuuu

SEQ ID NO: 326386 - RNA, 20 nt, Homo sapiens
uuuuggcuuaaagcagucug

SEQ ID NO: 326387 - RNA, 22 nt, Homo sapiens
uuuugguauacacaaggguccu

SEQ ID NO: 326388 - RNA, 22 nt, Homo sapiens
uuuugguauaugcaggggucuu

SEQ ID NO: 326389 - RNA, 22 nt, Homo sapiens
uuuuguacgccuguguccauca

SEQ ID NO: 326390 - RNA, 18 nt, Homo sapiens
uuuuugaggcacagggga

SEQ ID NO: 326391 - RNA, 22 nt, Homo sapiens
uuuuugauuaauggguagacca

SEQ ID NO: 326392 - RNA, 22 nt, Homo sapiens
uuuuuuaguuagcugggcauga

SEQ ID NO: 326393 - RNA, 22 nt, Homo sapiens
uuuuuugcuguaugcaaacauc

SEQ ID NO: 326394 - RNA, 22 nt, Homo sapiens
aaaagcuuagaugggcuuguau

SEQ ID NO: 326395 - RNA, 22 nt, Homo sapiens
aaaaggcuagcuaguaacagaa

SEQ ID NO: 326396 - RNA, 22 nt, Homo sapiens
aaaccacagugugcugcugggg

SEQ ID NO: 326397 - RNA, 22 nt, Homo sapiens
aaagaagucagccuguccuuug

SEQ ID NO: 326398 - RNA, 22 nt, Homo sapiens
aaagagaucuaugggcacuaug

SEQ ID NO: 326399 - RNA, 22 nt, Homo sapiens
aaagaguucagguagauuucaa

SEQ ID NO: 326400 - RNA, 22 nt, Homo sapiens
aaaggcacuagaaguuaccuuu

SEQ ID NO: 326401 - RNA, 22 nt, Homo sapiens
aaaggcacugugacuuuauagg

SEQ ID NO: 326402 - RNA, 22 nt, Homo sapiens
aaaggcaucauuaguaccaagu

SEQ ID NO: 326403 - RNA, 22 nt, Homo sapiens
aaagggcacugugcuuuggcaa

SEQ ID NO: 326404 - RNA, 22 nt, Homo sapiens
aaaguaauugcaguuuuugcaa

SEQ ID NO: 326405 - RNA, 22 nt, Homo sapiens
aaaguaguagcaguuucugcca

SEQ ID NO: 326406 - RNA, 22 nt, Homo sapiens
aaagucuguuuugucagagacu

SEQ ID NO: 326407 - RNA, 22 nt, Homo sapiens
aaagugaauguaucccguaagu

SEQ ID NO: 326408 - RNA, 22 nt, Homo sapiens
aaagugccugacucauaguuag

SEQ ID NO: 326409 - RNA, 22 nt, Homo sapiens
aaagugccuucuauuuuaguga

SEQ ID NO: 326410 - RNA, 22 nt, Homo sapiens
aaagugcugagaguucuaacuu

SEQ ID NO: 326411 - RNA, 22 nt, Homo sapiens
aaaguggugggauuccaggcau

SEQ ID NO: 326412 - RNA, 22 nt, Homo sapiens
aaaguggugugaguauguaucu

SEQ ID NO: 326413 - RNA, 22 nt, Homo sapiens
aaaguguguuuccaaccugugg

SEQ ID NO: 326414 - RNA, 22 nt, Homo sapiens
aaaguucugcguuagggcuaaa

SEQ ID NO: 326415 - RNA, 22 nt, Homo sapiens
aaauaguagcugaaugagggaa

SEQ ID NO: 326416 - RNA, 22 nt, Homo sapiens
aaaucccuugcucucucagacc

SEQ ID NO: 326417 - RNA, 22 nt, Homo sapiens
aaaugcacaaagauuuugcacu

SEQ ID NO: 326418 - RNA, 22 nt, Homo sapiens
aaaugcagauucugcuuagguu

SEQ ID NO: 326419 - RNA, 22 nt, Homo sapiens
aaaugcagucuuuguucugggc

SEQ ID NO: 326420 - RNA, 22 nt, Homo sapiens
aaaugcauaucaagauugcccu

SEQ ID NO: 326421 - RNA, 22 nt, Homo sapiens
aaaugcaugaauaagcucgugu

SEQ ID NO: 326422 - RNA, 22 nt, Homo sapiens
aaaugcucuguggguaguaaug

SEQ ID NO: 326423 - RNA, 22 nt, Homo sapiens
aaaugcugucugugagccucau

SEQ ID NO: 326424 - RNA, 19 nt, Homo sapiens
aaaugugcacuguuuucca

SEQ ID NO: 326425 - RNA, 22 nt, Homo sapiens
aaauucauuucagcucugggua

SEQ ID NO: 326426 - RNA, 22 nt, Homo sapiens
aaauugcaaugcgaggcagagg

SEQ ID NO: 326427 - RNA, 22 nt, Homo sapiens
aaauuguccuacugguuugagu

SEQ ID NO: 326428 - RNA, 22 nt, Homo sapiens
aacaccauucucuguaacaaga

SEQ ID NO: 326429 - RNA, 22 nt, Homo sapiens
aacacuggcugcucgaguucuc

SEQ ID NO: 326430 - RNA, 22 nt, Homo sapiens
aacagaauccucuuuuccuggg

SEQ ID NO: 326431 - RNA, 22 nt, Homo sapiens
aacagagcuggugacuccaggu

SEQ ID NO: 326432 - RNA, 22 nt, Homo sapiens
aacagauugcugagccccaccc

SEQ ID NO: 326433 - RNA, 20 nt, Homo sapiens
aacagcacugucugaagcuu

SEQ ID NO: 326434 - RNA, 22 nt, Homo sapiens
aacagcuaguaccaauccacua

SEQ ID NO: 326435 - RNA, 22 nt, Homo sapiens
aacagugccugucauuuaguag

SEQ ID NO: 326436 - RNA, 21 nt, Homo sapiens
aacagugcuuaguagauguuc

SEQ ID NO: 326437 - RNA, 20 nt, Homo sapiens
aacaguguguaaguuuccuu

SEQ ID NO: 326438 - RNA, 22 nt, Homo sapiens
aacauagucaugggguaauguu

SEQ ID NO: 326439 - RNA, 22 nt, Homo sapiens
aacauguuuagcagauaccugu

SEQ ID NO: 326440 - RNA, 22 nt, Homo sapiens
aacccugacacaagcagaauuu

SEQ ID NO: 326441 - RNA, 22 nt, Homo sapiens
aaccuguggauuuugguaucug

SEQ ID NO: 326442 - RNA, 22 nt, Homo sapiens
aacuacaucucuuugaggcagg

SEQ ID NO: 326443 - RNA, 22 nt, Homo sapiens
aacucugucuccuucaaguuca

SEQ ID NO: 326444 - RNA, 22 nt, Homo sapiens
aacugcacauauuuguaugggu

SEQ ID NO: 326445 - RNA, 22 nt, Homo sapiens
aacugcuguuuggguacuggug

SEQ ID NO: 326446 - RNA, 22 nt, Homo sapiens
aacuggcauagccagacuucuc

SEQ ID NO: 326447 - RNA, 19 nt, Homo sapiens
aacuggugugagaugauau

SEQ ID NO: 326448 - RNA, 21 nt, Homo sapiens
aacuggugugagaugguaugu

SEQ ID NO: 326449 - RNA, 22 nt, Homo sapiens
aacuugcacuugauugagagcu

SEQ ID NO: 326450 - RNA, 21 nt, Homo sapiens
aagaaagcuggacuugccgcu

SEQ ID NO: 326451 - RNA, 22 nt, Homo sapiens
aagagcgcugauaacauguuug

SEQ ID NO: 326452 - RNA, 20 nt, Homo sapiens
aagagcucaccagaauaucu

SEQ ID NO: 326453 - RNA, 22 nt, Homo sapiens
aagagcucauccauaguuguca

SEQ ID NO: 326454 - RNA, 22 nt, Homo sapiens
aagagguagucugucccuuagc

SEQ ID NO: 326455 - RNA, 22 nt, Homo sapiens
aagaguuaguaaaauuuccucu

SEQ ID NO: 326456 - RNA, 22 nt, Homo sapiens
aagauauguuaguuauaaacuc

SEQ ID NO: 326457 - RNA, 22 nt, Homo sapiens
aagaugcagaagcccagauguu

SEQ ID NO: 326458 - RNA, 22 nt, Homo sapiens
aagaugcagucauacuggagga

SEQ ID NO: 326459 - RNA, 22 nt, Homo sapiens
aagaugcagucauacuggagua

SEQ ID NO: 326460 - RNA, 22 nt, Homo sapiens
aagcaaacaucagcuugguuaa

SEQ ID NO: 326461 - RNA, 22 nt, Homo sapiens
aagcaacacaucugccccgguu

SEQ ID NO: 326462 - RNA, 21 nt, Homo sapiens
aagcacauugaguguguguga

SEQ ID NO: 326463 - RNA, 22 nt, Homo sapiens
aagcaccaauaggagauuuguc

SEQ ID NO: 326464 - RNA, 22 nt, Homo sapiens
aagcacccagccucacgccugc

SEQ ID NO: 326465 - RNA, 22 nt, Homo sapiens
aagcaggugucugugucuguaa

SEQ ID NO: 326466 - RNA, 22 nt, Homo sapiens
aagcaguguggacuaaugggaa

SEQ ID NO: 326467 - RNA, 22 nt, Homo sapiens
aagcauccagcauggaacugaa

SEQ ID NO: 326468 - RNA, 22 nt, Homo sapiens
ggaguuuaagucuugugcaucu

SEQ ID NO: 326469 - RNA, 22 nt, Homo sapiens
ggauacaucuggacagccgaau

SEQ ID NO: 326470 - RNA, 23 nt, Homo sapiens
ggauggaaaguuuugagggccac

SEQ ID NO: 326471 - RNA, 22 nt, Homo sapiens
ggauggcauuucuuuagcuuuu

SEQ ID NO: 326472 - RNA, 22 nt, Homo sapiens
ggauugugauaauuguugcaaa

SEQ ID NO: 326473 - RNA, 22 nt, Homo sapiens
ggcaaaauggccagugggucac

SEQ ID NO: 326474 - RNA, 22 nt, Homo sapiens
ggcaacaugaugaaaugccauc

SEQ ID NO: 326475 - RNA, 22 nt, Homo sapiens
ggcaagaggagauucugcuccc

SEQ ID NO: 326476 - RNA, 22 nt, Homo sapiens
ggcaaggauuagauucuccccu

SEQ ID NO: 326477 - RNA, 22 nt, Homo sapiens
ggcaagugggagggaguguuuc

SEQ ID NO: 326478 - RNA, 22 nt, Homo sapiens
ggcaaguucuaaugauuagaau

SEQ ID NO: 326479 - RNA, 22 nt, Homo sapiens
ggcaaguugcuauucuuuaaug

SEQ ID NO: 326480 - RNA, 22 nt, Homo sapiens
ggcaaugaggcggaccagcagg

SEQ ID NO: 326481 - RNA, 22 nt, Homo sapiens
ggcaaugucagcuaaugaugga

SEQ ID NO: 326482 - RNA, 22 nt, Homo sapiens
ggcaccauuuuacuccuucccu

SEQ ID NO: 326483 - RNA, 19 nt, Homo sapiens
ggcaccuuuuccaaaaaug

SEQ ID NO: 326484 - RNA, 22 nt, Homo sapiens
ggcacgguggcucacaccugua

SEQ ID NO: 326485 - RNA, 22 nt, Homo sapiens
ggcacugugaugugagggggua

SEQ ID NO: 326486 - RNA, 22 nt, Homo sapiens
ggcagaauugcugaggaugcua

SEQ ID NO: 326487 - RNA, 22 nt, Homo sapiens
ggcagcauugccuuugcaguga

SEQ ID NO: 326488 - RNA, 22 nt, Homo sapiens
ggcagcucaggccccgcgcuga

SEQ ID NO: 326489 - RNA, 22 nt, Homo sapiens
ggcagcuguguccuucguaagg

SEQ ID NO: 326490 - RNA, 22 nt, Homo sapiens
ggcaguuucucaggcaggggua

SEQ ID NO: 326491 - RNA, 22 nt, Homo sapiens
ggcaugaaguagcccacaggca

SEQ ID NO: 326492 - RNA, 22 nt, Homo sapiens
ggcaugaugcgcacgccuguag

SEQ ID NO: 326493 - RNA, 22 nt, Homo sapiens
ggcauguuuaguagaauguggu

SEQ ID NO: 326494 - RNA, 22 nt, Homo sapiens
ggcauugugaacauuucccugc

SEQ ID NO: 326495 - RNA, 22 nt, Homo sapiens
ggcauugugauccaccagccuu

SEQ ID NO: 326496 - RNA, 22 nt, Homo sapiens
ggccagaugcaguggcucacac

SEQ ID NO: 326497 - RNA, 22 nt, Homo sapiens
ggccggguggccauggcugccc

SEQ ID NO: 326498 - RNA, 22 nt, Homo sapiens
ggcuagagacaaguugcugaga

SEQ ID NO: 326499 - RNA, 22 nt, Homo sapiens
ggcucagugggguccugguucu

SEQ ID NO: 326500 - RNA, 22 nt, Homo sapiens
ggcucguguuuucuguccaguu

SEQ ID NO: 326501 - RNA, 22 nt, Homo sapiens
ggcucuguugcuaccaauuaag

SEQ ID NO: 326502 - RNA, 22 nt, Homo sapiens
ggcuguguguuaaaauaggcuu

SEQ ID NO: 326503 - RNA, 22 nt, Homo sapiens
gggaaaaugucuauugaaugaa

SEQ ID NO: 326504 - RNA, 22 nt, Homo sapiens
gggaacauggaaauucugcucu

SEQ ID NO: 326505 - RNA, 22 nt, Homo sapiens
gggaagauauaggcugggcacc

SEQ ID NO: 326506 - RNA, 22 nt, Homo sapiens
gggaagugugguuucuuuacag

SEQ ID NO: 326507 - RNA, 22 nt, Homo sapiens
gggaauggaagacauuaugaug

SEQ ID NO: 326508 - RNA, 22 nt, Homo sapiens
gggaauguagcaaaucugcaau

SEQ ID NO: 326509 - RNA, 22 nt, Homo sapiens
gggagcacaagaaauguuucau

SEQ ID NO: 326510 - RNA, 22 nt, Homo sapiens
gggagguagguauuagcuuuuc

SEQ ID NO: 326511 - RNA, 22 nt, Homo sapiens
gggaugaagaagaauaguucgu

SEQ ID NO: 326512 - RNA, 18 nt, Homo sapiens
gggcaaguugccuggcuu

SEQ ID NO: 326513 - RNA, 22 nt, Homo sapiens
gggcauguggacuuguauguuu

SEQ ID NO: 326514 - RNA, 22 nt, Homo sapiens
ggggcauugugucuggguuccu

SEQ ID NO: 326515 - RNA, 22 nt, Homo sapiens
gggguaggcuacacugaguucc

SEQ ID NO: 326516 - RNA, 22 nt, Homo sapiens
gggguauguaagugagugagug

SEQ ID NO: 326517 - RNA, 22 nt, Homo sapiens
ggggucaucagagaaucuaccc

SEQ ID NO: 326518 - RNA, 22 nt, Homo sapiens
ggguaaaucucuuuucauggcu

SEQ ID NO: 326519 - RNA, 22 nt, Homo sapiens
ggguucaaaucuuggcucuuac

SEQ ID NO: 326520 - RNA, 22 nt, Homo sapiens
gguaggcacuggugggaagaga

SEQ ID NO: 326521 - RNA, 22 nt, Homo sapiens
ggucacauugcuagcauggguu

SEQ ID NO: 326522 - RNA, 19 nt, Homo sapiens
ggucagcaaagucuagcug

SEQ ID NO: 326523 - RNA, 22 nt, Homo sapiens
ggucccccuccacucucgcaaa

SEQ ID NO: 326524 - RNA, 19 nt, Homo sapiens
ggucccucucaagucauuc

SEQ ID NO: 326525 - RNA, 22 nt, Homo sapiens
ggugagaaaaacauagucucag

SEQ ID NO: 326526 - RNA, 19 nt, Homo sapiens
ggugagaaauuaugggucu

SEQ ID NO: 326527 - RNA, 22 nt, Homo sapiens
ggugagauaucugcugauguuu

SEQ ID NO: 326528 - RNA, 22 nt, Homo sapiens
ggugagcacagaaugcccugag

SEQ ID NO: 326529 - RNA, 22 nt, Homo sapiens
ggugaguggugcuuaaguucag

SEQ ID NO: 326530 - RNA, 19 nt, Homo sapiens
ggugcuugaauauuccucc

SEQ ID NO: 326531 - RNA, 22 nt, Homo sapiens
ggugcuugaggaacggaggcug

SEQ ID NO: 326532 - RNA, 22 nt, Homo sapiens
gguggucuuccccuggaguucg

SEQ ID NO: 326533 - RNA, 22 nt, Homo sapiens
gguggugguauuucagaaaaug

SEQ ID NO: 326534 - RNA, 22 nt, Homo sapiens
ggugucaguuggccccuacugg

SEQ ID NO: 326535 - RNA, 22 nt, Homo sapiens
ggugucuuguuuaauacucauu

SEQ ID NO: 326536 - RNA, 22 nt, Homo sapiens
gguguguaaauuacuuaucucu

SEQ ID NO: 326537 - RNA, 22 nt, Homo sapiens
guaaaguaaagcacaucaaggu

SEQ ID NO: 326538 - RNA, 22 nt, Homo sapiens
guaaauguccugcuacagagug

SEQ ID NO: 326539 - RNA, 22 nt, Homo sapiens
guaacucugucacuuacuaguu

SEQ ID NO: 326540 - RNA, 22 nt, Homo sapiens
guaacugguuuucuucccucuc

SEQ ID NO: 326541 - RNA, 22 nt, Homo sapiens
guaagguuguauuucaagaaac

SEQ ID NO: 326542 - RNA, 22 nt, Homo sapiens
guaagugauagaauuaggauuc

SEQ ID NO: 326543 - RNA, 23 nt, Homo sapiens
guaauacuagucauaguagcagg

SEQ ID NO: 326544 - RNA, 22 nt, Homo sapiens
guaauagucucaaacuccugga

SEQ ID NO: 326545 - RNA, 22 nt, Homo sapiens
guaaucuguaguaaagcaccau

SEQ ID NO: 326546 - RNA, 22 nt, Homo sapiens
guaaugaacuugaaagccuguu

SEQ ID NO: 326547 - RNA, 22 nt, Homo sapiens
guacauagucacacauauacau

SEQ ID NO: 326548 - RNA, 22 nt, Homo sapiens
guacaugcauacaugcacaucu

SEQ ID NO: 326549 - RNA, 22 nt, Homo sapiens
guacaugcaugcaugggugugc

SEQ ID NO: 326550 - RNA, 22 nt, Homo sapiens
guacuuuguuauaacccacagg

SEQ ID NO: 326551 - RNA, 22 nt, Homo sapiens
guagaaaguuugcugucacaug

SEQ ID NO: 326552 - RNA, 22 nt, Homo sapiens
guagcagaacauguuccuugua

SEQ ID NO: 326553 - RNA, 22 nt, Homo sapiens
guaggcacuggcucagcuuauc

SEQ ID NO: 326554 - RNA, 22 nt, Homo sapiens
guaguaccauuaggauauuucu

SEQ ID NO: 326555 - RNA, 23 nt, Homo sapiens
guaguuugaugcaauccacuugu

SEQ ID NO: 326556 - RNA, 22 nt, Homo sapiens
guauacaguugacccuugaacc

SEQ ID NO: 326557 - RNA, 22 nt, Homo sapiens
guaucauugccuaaugcucuca

SEQ ID NO: 326558 - RNA, 21 nt, Homo sapiens
guauggcauugauuaguuacu

SEQ ID NO: 326559 - RNA, 22 nt, Homo sapiens
guaugguugaagugacaagcca

SEQ ID NO: 326560 - RNA, 22 nt, Homo sapiens
cagagcaaugcuuuugcuuuga

SEQ ID NO: 326561 - RNA, 22 nt, Homo sapiens
cagagguaagcaagucagcauu

SEQ ID NO: 326562 - RNA, 22 nt, Homo sapiens
cagaucaucuugagcuuaggaa

SEQ ID NO: 326563 - RNA, 22 nt, Homo sapiens
cagaugguggucccacagccca

SEQ ID NO: 326564 - RNA, 22 nt, Homo sapiens
cagauguaguauuuuagugaaa

SEQ ID NO: 326565 - RNA, 20 nt, Homo sapiens
cagcaaccugcucucuuccu

SEQ ID NO: 326566 - RNA, 22 nt, Homo sapiens
cagcacauagcaguugcucagu

SEQ ID NO: 326567 - RNA, 22 nt, Homo sapiens
cagcaucauucaucugggguaa

SEQ ID NO: 326568 - RNA, 22 nt, Homo sapiens
cagccggguggcuccuagggua

SEQ ID NO: 326569 - RNA, 22 nt, Homo sapiens
cagcgaggucugcgucacauug

SEQ ID NO: 326570 - RNA, 22 nt, Homo sapiens
cagcugaugucgaaugcacucu

SEQ ID NO: 326571 - RNA, 22 nt, Homo sapiens
cagcuguguuauaaacuaccau

SEQ ID NO: 326572 - RNA, 22 nt, Homo sapiens
cagcuguuguuccagucuuuua

SEQ ID NO: 326573 - RNA, 22 nt, Homo sapiens
caggaaugugaggguucccugc

SEQ ID NO: 326574 - RNA, 22 nt, Homo sapiens
caggcacgcuugggagacacac

SEQ ID NO: 326575 - RNA, 22 nt, Homo sapiens
caggcagucuggggguguaucc

SEQ ID NO: 326576 - RNA, 21 nt, Homo sapiens
cagguagugucugaagccaga

SEQ ID NO: 326577 - RNA, 22 nt, Homo sapiens
caggucaucugaguuuaguucu

SEQ ID NO: 326578 - RNA, 22 nt, Homo sapiens
caggugaaugccucuccuucug

SEQ ID NO: 326579 - RNA, 22 nt, Homo sapiens
caggugguauuugguuuucugu

SEQ ID NO: 326580 - RNA, 22 nt, Homo sapiens
cagucacugggauuauggucau

SEQ ID NO: 326581 - RNA, 22 nt, Homo sapiens
cagugauaggugguuguuggca

SEQ ID NO: 326582 - RNA, 22 nt, Homo sapiens
cagugcacugggauuauaagug

SEQ ID NO: 326583 - RNA, 22 nt, Homo sapiens
cagugcauaggaucuaaaauuu

SEQ ID NO: 326584 - RNA, 23 nt, Homo sapiens
cagugcauuguggcauucagcau

SEQ ID NO: 326585 - RNA, 22 nt, Homo sapiens
cagugguuuuuagcuugcuggg

SEQ ID NO: 326586 - RNA, 21 nt, Homo sapiens
cauaaugcuacuuauuuuaug

SEQ ID NO: 326587 - RNA, 22 nt, Homo sapiens
cauacaugugcuugucuuaugc

SEQ ID NO: 326588 - RNA, 18 nt, Homo sapiens
cauagcacuucagcacau

SEQ ID NO: 326589 - RNA, 22 nt, Homo sapiens
cauauaguaguacuguuagguu

SEQ ID NO: 326590 - RNA, 22 nt, Homo sapiens
caucaaaguggagggaaggacc

SEQ ID NO: 326591 - RNA, 21 nt, Homo sapiens
caucaaauugucauggugggu

SEQ ID NO: 326592 - RNA, 23 nt, Homo sapiens
caucacagagccuuccuugacuc

SEQ ID NO: 326593 - RNA, 22 nt, Homo sapiens
caucagcaauguaugaggguuc

SEQ ID NO: 326594 - RNA, 19 nt, Homo sapiens
caucccugagcugaagugg

SEQ ID NO: 326595 - RNA, 22 nt, Homo sapiens
caucgcacuccagccugggcaa

SEQ ID NO: 326596 - RNA, 22 nt, Homo sapiens
caucucauugaauugcugagca

SEQ ID NO: 326597 - RNA, 22 nt, Homo sapiens
caugaaagacugaggaauugga

SEQ ID NO: 326598 - RNA, 22 nt, Homo sapiens
caugcauuggucuauuauguga

SEQ ID NO: 326599 - RNA, 22 nt, Homo sapiens
caugccauugcucuccugggug

SEQ ID NO: 326600 - RNA, 22 nt, Homo sapiens
cauggcacugagcagguaugca

SEQ ID NO: 326601 - RNA, 22 nt, Homo sapiens
cauggcauuugcagaguugaaa

SEQ ID NO: 326602 - RNA, 22 nt, Homo sapiens
cauggcuacugcagauguaggg

SEQ ID NO: 326603 - RNA, 22 nt, Homo sapiens
cauggcuuuaagcaacaccaag

SEQ ID NO: 326604 - RNA, 22 nt, Homo sapiens
cauggcuuuuauaacaagaaau

SEQ ID NO: 326605 - RNA, 22 nt, Homo sapiens
caugggacugucuuggcuauac

SEQ ID NO: 326606 - RNA, 22 nt, Homo sapiens
cauggucaccuuccaaguuauu

SEQ ID NO: 326607 - RNA, 22 nt, Homo sapiens
cauguaacaucccgcuguagga

SEQ ID NO: 326608 - RNA, 22 nt, Homo sapiens
cauguauagauuccauaguggu

SEQ ID NO: 326609 - RNA, 22 nt, Homo sapiens
cauugcaauccagccugggcaa

SEQ ID NO: 326610 - RNA, 22 nt, Homo sapiens
cauugcacacauuuaccuaugu

SEQ ID NO: 326611 - RNA, 22 nt, Homo sapiens
cauugcacuccagccucggcaa

SEQ ID NO: 326612 - RNA, 22 nt, Homo sapiens
cauugcacuccagccugaggga

SEQ ID NO: 326613 - RNA, 22 nt, Homo sapiens
cauugcacuccagccugcacga

SEQ ID NO: 326614 - RNA, 20 nt, Homo sapiens
cauugcacuccagccugcug

SEQ ID NO: 326615 - RNA, 22 nt, Homo sapiens
cauugcacuccagcuugggcaa

SEQ ID NO: 326616 - RNA, 22 nt, Homo sapiens
cauugcacuccagcuugggcga

SEQ ID NO: 326617 - RNA, 22 nt, Homo sapiens
cauugcacuccagucugggcaa

SEQ ID NO: 326618 - RNA, 22 nt, Homo sapiens
cauugcacuccaucuugggcaa

SEQ ID NO: 326619 - RNA, 22 nt, Homo sapiens
cauugcacucugcauuccaguc

SEQ ID NO: 326620 - RNA, 22 nt, Homo sapiens
cauugcucuuacagagugagua

SEQ ID NO: 326621 - RNA, 22 nt, Homo sapiens
cauuggugauuagugaaugaac

SEQ ID NO: 326622 - RNA, 22 nt, Homo sapiens
cauugguuaguuaacuuuaaga

SEQ ID NO: 326623 - RNA, 22 nt, Homo sapiens
cauugguuccaguuuguccuua

SEQ ID NO: 326624 - RNA, 22 nt, Homo sapiens
cauugguuuauagauggggaaa

SEQ ID NO: 326625 - RNA, 22 nt, Homo sapiens
cauuugguggcuacagaguaac

SEQ ID NO: 326626 - RNA, 22 nt, Homo sapiens
ccaaaucucauguugaaaugug

SEQ ID NO: 326627 - RNA, 22 nt, Homo sapiens
ccaagccucaguuucccucugu

SEQ ID NO: 326628 - RNA, 19 nt, Homo sapiens
ccacaaugguugaacuaga

SEQ ID NO: 326629 - RNA, 22 nt, Homo sapiens
ccacaguagucuugggaugggc

SEQ ID NO: 326630 - RNA, 22 nt, Homo sapiens
ccacaguggauuaaaguuacug

SEQ ID NO: 326631 - RNA, 22 nt, Homo sapiens
ccacaguugaaauuuugacugu

SEQ ID NO: 326632 - RNA, 22 nt, Homo sapiens
ccacauuggaaaggaucccccc

SEQ ID NO: 326633 - RNA, 22 nt, Homo sapiens
ccacccuggagaauuugagguc

SEQ ID NO: 326634 - RNA, 22 nt, Homo sapiens
ccacugugguaucugauacugg

SEQ ID NO: 326635 - RNA, 22 nt, Homo sapiens
ccagcaccauuuauuaaauagg

SEQ ID NO: 326636 - RNA, 22 nt, Homo sapiens
ccaggguuccacgccuggcugu

SEQ ID NO: 326637 - RNA, 18 nt, Homo sapiens
ccagugcaaggaaagccc

SEQ ID NO: 326638 - RNA, 22 nt, Homo sapiens
ccagugcugugcaguguaugag

SEQ ID NO: 326639 - RNA, 20 nt, Homo sapiens
ccaguguuauuuauguucua

SEQ ID NO: 326640 - RNA, 22 nt, Homo sapiens
ccaguguuuggauuagggaugc

SEQ ID NO: 326641 - RNA, 22 nt, Homo sapiens
ccaguuuuuggcaaugaugaau

SEQ ID NO: 326642 - RNA, 22 nt, Homo sapiens
ccaucccuuucugagcaguucc

SEQ ID NO: 326643 - RNA, 22 nt, Homo sapiens
ccauggcaauggucagucuauu

SEQ ID NO: 326644 - RNA, 22 nt, Homo sapiens
cccagugaagagaaccuuacga

SEQ ID NO: 326645 - RNA, 18 nt, Homo sapiens
cccagugacuuauggccu

SEQ ID NO: 326646 - RNA, 22 nt, Homo sapiens
ccccagugguugcaacagcaga

SEQ ID NO: 326647 - RNA, 22 nt, Homo sapiens
ccccaguguguaaaggccuugc

SEQ ID NO: 326648 - RNA, 22 nt, Homo sapiens
ccccguuacagccucagugccu

SEQ ID NO: 326649 - RNA, 17 nt, Homo sapiens
ccccugagcgaugcagu

SEQ ID NO: 326650 - RNA, 22 nt, Homo sapiens
ccccuguaucucagcgucuuca

SEQ ID NO: 326651 - RNA, 18 nt, Homo sapiens
cccgggugggcuguuccc

SEQ ID NO: 326652 - RNA, 17 nt, Homo sapiens
cccuaguagcugggacu

SEQ ID NO: 326653 - RNA, 20 nt, Homo sapiens
aagcauggguuuuaggguca

SEQ ID NO: 326654 - RNA, 22 nt, Homo sapiens
aagcugcauuuucuagaugcuu

SEQ ID NO: 326655 - RNA, 22 nt, Homo sapiens
aagcugccaggcaugguggcug

SEQ ID NO: 326656 - RNA, 22 nt, Homo sapiens
aagcuggauuuaguguggagca

SEQ ID NO: 326657 - RNA, 22 nt, Homo sapiens
aagcuggauuucgcauccuguu

SEQ ID NO: 326658 - RNA, 22 nt, Homo sapiens
aaggagcaguggacggguccua

SEQ ID NO: 326659 - RNA, 22 nt, Homo sapiens
aaggagcuuaagugacuuguac

SEQ ID NO: 326660 - RNA, 22 nt, Homo sapiens
aaggaguagacaacauggcgcc

SEQ ID NO: 326661 - RNA, 22 nt, Homo sapiens
aaggaguauugaaugaccaagu

SEQ ID NO: 326662 - RNA, 22 nt, Homo sapiens
aaggcaagagaaaauuucgagu

SEQ ID NO: 326663 - RNA, 22 nt, Homo sapiens
aaggcaagauacugguugcuga

SEQ ID NO: 326664 - RNA, 22 nt, Homo sapiens
aaggcagucacuaaauagugag

SEQ ID NO: 326665 - RNA, 22 nt, Homo sapiens
aaggcauggugacuauuuaggc

SEQ ID NO: 326666 - RNA, 22 nt, Homo sapiens
aaggcuuuuugcugacguccuu

SEQ ID NO: 326667 - RNA, 22 nt, Homo sapiens
aagggaauguuguagcugguuu

SEQ ID NO: 326668 - RNA, 22 nt, Homo sapiens
aagggaauguuguggcugguug

SEQ ID NO: 326669 - RNA, 22 nt, Homo sapiens
aagguagguuccaaaauaccua

SEQ ID NO: 326670 - RNA, 17 nt, Homo sapiens
aaggugcuucgaccucc

SEQ ID NO: 326671 - RNA, 22 nt, Homo sapiens
aagguggaguugacaauuuuca

SEQ ID NO: 326672 - RNA, 22 nt, Homo sapiens
aagguggugucagagagcuuau

SEQ ID NO: 326673 - RNA, 22 nt, Homo sapiens
aagguucuugcuugcaugacug

SEQ ID NO: 326674 - RNA, 22 nt, Homo sapiens
aagguuguauuuaauauacugu

SEQ ID NO: 326675 - RNA, 22 nt, Homo sapiens
aaguaaacauugagagacaaga

SEQ ID NO: 326676 - RNA, 22 nt, Homo sapiens
aaguaaacauuuuguacaauaa

SEQ ID NO: 326677 - RNA, 22 nt, Homo sapiens
aaguaagcauccaauaaauguu

SEQ ID NO: 326678 - RNA, 22 nt, Homo sapiens
aaguaauggaguuauuuuauga

SEQ ID NO: 326679 - RNA, 19 nt, Homo sapiens
aaguaguugugacagaugc

SEQ ID NO: 326680 - RNA, 22 nt, Homo sapiens
aaguaucaggaauaguuauugg

SEQ ID NO: 326681 - RNA, 23 nt, Homo sapiens
aagucauggaaucaaaugaggug

SEQ ID NO: 326682 - RNA, 22 nt, Homo sapiens
aagugaaugaugugaaguguaa

SEQ ID NO: 326683 - RNA, 22 nt, Homo sapiens
aagugaauguuugguagcagug

SEQ ID NO: 326684 - RNA, 22 nt, Homo sapiens
aagugaguaauacgucaguugu

SEQ ID NO: 326685 - RNA, 22 nt, Homo sapiens
aagugagugacaaaaacugggc

SEQ ID NO: 326686 - RNA, 20 nt, Homo sapiens
aagugaguguuaaacugaac

SEQ ID NO: 326687 - RNA, 22 nt, Homo sapiens
aagugcaaauucccaggcucug

SEQ ID NO: 326688 - RNA, 20 nt, Homo sapiens
aagugcaucguugugucugc

SEQ ID NO: 326689 - RNA, 22 nt, Homo sapiens
aagugcauguauuaguguaguc

SEQ ID NO: 326690 - RNA, 22 nt, Homo sapiens
aagugccauguggaugggcccu

SEQ ID NO: 326691 - RNA, 20 nt, Homo sapiens
aagugcuauuucuuuugugg

SEQ ID NO: 326692 - RNA, 22 nt, Homo sapiens
aagugcucuugaaacugucuua

SEQ ID NO: 326693 - RNA, 22 nt, Homo sapiens
aagugcuguaugggagccuagg

SEQ ID NO: 326694 - RNA, 22 nt, Homo sapiens
aagugcuuaggauagugugugg

SEQ ID NO: 326695 - RNA, 22 nt, Homo sapiens
aagugcuuuacacaugcaugau

SEQ ID NO: 326696 - RNA, 22 nt, Homo sapiens
aaguggcauugaggaaaaaaau

SEQ ID NO: 326697 - RNA, 17 nt, Homo sapiens
aaguggcuuguucacca

SEQ ID NO: 326698 - RNA, 22 nt, Homo sapiens
aaguguaaguuaauguuuaggu

SEQ ID NO: 326699 - RNA, 22 nt, Homo sapiens
aaguuaauguuuaagacuccua

SEQ ID NO: 326700 - RNA, 22 nt, Homo sapiens
aaguuguaguuagagaguugcu

SEQ ID NO: 326701 - RNA, 21 nt, Homo sapiens
aauaaagcaaccuuaugccau

SEQ ID NO: 326702 - RNA, 22 nt, Homo sapiens
aauaaagcuuugagcuuugcug

SEQ ID NO: 326703 - RNA, 21 nt, Homo sapiens
aauacucuagguuaagagagc

SEQ ID NO: 326704 - RNA, 22 nt, Homo sapiens
aauacugagaugugagguacua

SEQ ID NO: 326705 - RNA, 22 nt, Homo sapiens
aauacuggcacugaagaccaug

SEQ ID NO: 326706 - RNA, 22 nt, Homo sapiens
aauagagucaggguuucaccau

SEQ ID NO: 326707 - RNA, 22 nt, Homo sapiens
aauaguggcuuggacuaaauau

SEQ ID NO: 326708 - RNA, 23 nt, Homo sapiens
aauaucacaguggguguacaccc

SEQ ID NO: 326709 - RNA, 22 nt, Homo sapiens
aauauguccuugaaauggugcu

SEQ ID NO: 326710 - RNA, 22 nt, Homo sapiens
aaucaacauuguuuuaagucaa

SEQ ID NO: 326711 - RNA, 22 nt, Homo sapiens
aaucacaggucuuggcugcaug

SEQ ID NO: 326712 - RNA, 22 nt, Homo sapiens
aaucacaguuaguaagggagaa

SEQ ID NO: 326713 - RNA, 22 nt, Homo sapiens
aauccaugugcuuuaccauuuu

SEQ ID NO: 326714 - RNA, 22 nt, Homo sapiens
aaucccuggacuuucggaggcu

SEQ ID NO: 326715 - RNA, 22 nt, Homo sapiens
aauccugucuugccauccaaua

SEQ ID NO: 326716 - RNA, 22 nt, Homo sapiens
aaucucaacacuuugggaggcu

SEQ ID NO: 326717 - RNA, 22 nt, Homo sapiens
aaucucagagauaucugugucc

SEQ ID NO: 326718 - RNA, 22 nt, Homo sapiens
aaugacagccagauucuucucu

SEQ ID NO: 326719 - RNA, 22 nt, Homo sapiens
aaugacagugcuaaagaacccu

SEQ ID NO: 326720 - RNA, 22 nt, Homo sapiens
aaugacccugauuggcaaguug

SEQ ID NO: 326721 - RNA, 17 nt, Homo sapiens
aaugagacauuucugcu

SEQ ID NO: 326722 - RNA, 22 nt, Homo sapiens
aaugcacauauauuuccuuauu

SEQ ID NO: 326723 - RNA, 22 nt, Homo sapiens
aauggcaaauguuuucuguuga

SEQ ID NO: 326724 - RNA, 22 nt, Homo sapiens
aauggcacaagacaugaagaag

SEQ ID NO: 326725 - RNA, 22 nt, Homo sapiens
aauggcacuuuauaaauguuaa

SEQ ID NO: 326726 - RNA, 22 nt, Homo sapiens
aauggcaucuagaguggugaau

SEQ ID NO: 326727 - RNA, 22 nt, Homo sapiens
aauggcucuuuaggcaauagau

SEQ ID NO: 326728 - RNA, 22 nt, Homo sapiens
aauggcuucuuauugugguuca

SEQ ID NO: 326729 - RNA, 18 nt, Homo sapiens
aaugggacuacaaagcca

SEQ ID NO: 326730 - RNA, 22 nt, Homo sapiens
aaugggacugacgccucccaga

SEQ ID NO: 326731 - RNA, 22 nt, Homo sapiens
aauggguaguacugugguaaca

SEQ ID NO: 326732 - RNA, 22 nt, Homo sapiens
aaugucacugugguccuccagu

SEQ ID NO: 326733 - RNA, 22 nt, Homo sapiens
aaugugcuucuggcugugguca

SEQ ID NO: 326734 - RNA, 22 nt, Homo sapiens
aaugugcuuugaaaagagcuga

SEQ ID NO: 326735 - RNA, 22 nt, Homo sapiens
aauucugugagauggugcagau

SEQ ID NO: 326736 - RNA, 22 nt, Homo sapiens
aauugaaugauaugggacauuu

SEQ ID NO: 326737 - RNA, 22 nt, Homo sapiens
aauugaaugcagaugccaggga

SEQ ID NO: 326738 - RNA, 22 nt, Homo sapiens
aauugcaccaucuagaucaaga

SEQ ID NO: 326739 - RNA, 22 nt, Homo sapiens
aauugcaucuguucuuugccag

SEQ ID NO: 326740 - RNA, 22 nt, Homo sapiens
aauugcauugaauuuguagcuu

SEQ ID NO: 326741 - RNA, 22 nt, Homo sapiens
aauugccucaagugaucauggc

SEQ ID NO: 326742 - RNA, 22 nt, Homo sapiens
aauugcuucuguauuuuggaca

SEQ ID NO: 326743 - RNA, 23 nt, Homo sapiens
aauugcuuuugaggacuuaguug

SEQ ID NO: 326744 - RNA, 22 nt, Homo sapiens
acaaaguauggaauguuggugu

SEQ ID NO: 326745 - RNA, 22 nt, Homo sapiens
cccucauucauucauccuaugu

SEQ ID NO: 326746 - RNA, 22 nt, Homo sapiens
cccuugcacuucagagcugcau

SEQ ID NO: 326747 - RNA, 22 nt, Homo sapiens
ccggguguuuuguucucucaga

SEQ ID NO: 326748 - RNA, 19 nt, Homo sapiens
ccucaaguacuaauauguu

SEQ ID NO: 326749 - RNA, 21 nt, Homo sapiens
ccuccauuuguauucuugccc

SEQ ID NO: 326750 - RNA, 22 nt, Homo sapiens
ccuccauuugugucaggaaguc

SEQ ID NO: 326751 - RNA, 21 nt, Homo sapiens
ccugaagaagugaccucugag

SEQ ID NO: 326752 - RNA, 21 nt, Homo sapiens
ccugaguacaacccacuccac

SEQ ID NO: 326753 - RNA, 21 nt, Homo sapiens
ccugaugaccucugagaguua

SEQ ID NO: 326754 - RNA, 22 nt, Homo sapiens
ccugaugacuaaugguuuugag

SEQ ID NO: 326755 - RNA, 22 nt, Homo sapiens
ccuggcacugggccccguggcu

SEQ ID NO: 326756 - RNA, 22 nt, Homo sapiens
ccuucacaggcacugguucaga

SEQ ID NO: 326757 - RNA, 22 nt, Homo sapiens
ccuucuuuuguaaggcugaaua

SEQ ID NO: 326758 - RNA, 22 nt, Homo sapiens
ccuugcacuucccaagugaggc

SEQ ID NO: 326759 - RNA, 22 nt, Homo sapiens
ccuuggcacuacugacauugua

SEQ ID NO: 326760 - RNA, 22 nt, Homo sapiens
ccuugguaauguguuuuauucu

SEQ ID NO: 326761 - RNA, 21 nt, Homo sapiens
ccuugguuaucuucccauuca

SEQ ID NO: 326762 - RNA, 19 nt, Homo sapiens
ccuuugguuuccaugacau

SEQ ID NO: 326763 - RNA, 22 nt, Homo sapiens
ccuuuguggggcgguggguaau

SEQ ID NO: 326764 - RNA, 20 nt, Homo sapiens
cguugcacuccagccugggc

SEQ ID NO: 326765 - RNA, 22 nt, Homo sapiens
cuaacuaugucucaggaugucc

SEQ ID NO: 326766 - RNA, 17 nt, Homo sapiens
cuaaggcaagagucugc

SEQ ID NO: 326767 - RNA, 22 nt, Homo sapiens
cuaaggcaguagccugaauaau

SEQ ID NO: 326768 - RNA, 22 nt, Homo sapiens
cuaagggaggaagcugugcagg

SEQ ID NO: 326769 - RNA, 22 nt, Homo sapiens
cuaagugaacugucacugagaa

SEQ ID NO: 326770 - RNA, 22 nt, Homo sapiens
cuaauccugugguagcacucaa

SEQ ID NO: 326771 - RNA, 22 nt, Homo sapiens
cuacagcacugagcugugugca

SEQ ID NO: 326772 - RNA, 22 nt, Homo sapiens
cuacagguaugaaagggaguau

SEQ ID NO: 326773 - RNA, 22 nt, Homo sapiens
cuacaguucucaggaguuggcc

SEQ ID NO: 326774 - RNA, 22 nt, Homo sapiens
cuacauuguagguauucaaacu

SEQ ID NO: 326775 - RNA, 22 nt, Homo sapiens
cuacugacacuacugcaaucau

SEQ ID NO: 326776 - RNA, 22 nt, Homo sapiens
cuacugcacaucaucugaguua

SEQ ID NO: 326777 - RNA, 22 nt, Homo sapiens
cuagaacuagaacugcuggggu

SEQ ID NO: 326778 - RNA, 22 nt, Homo sapiens
cuagagagaagcugugugaccu

SEQ ID NO: 326779 - RNA, 22 nt, Homo sapiens
cuagaguguaguuuucuuagga

SEQ ID NO: 326780 - RNA, 22 nt, Homo sapiens
cuagauuauccaacuuauuagc

SEQ ID NO: 326781 - RNA, 22 nt, Homo sapiens
cuagcagacacuuccagagagu

SEQ ID NO: 326782 - RNA, 22 nt, Homo sapiens
cuagcagcauaagaaucaccaa

SEQ ID NO: 326783 - RNA, 22 nt, Homo sapiens
cuagcaggcaagauaagauuca

SEQ ID NO: 326784 - RNA, 22 nt, Homo sapiens
cuaggcuguagagaaguucagu

SEQ ID NO: 326785 - RNA, 22 nt, Homo sapiens
cuaguaaugucugucuuaugga

SEQ ID NO: 326786 - RNA, 19 nt, Homo sapiens
cuaguaccacuucuucuga

SEQ ID NO: 326787 - RNA, 22 nt, Homo sapiens
cuaucucauugguuuuugaaag

SEQ ID NO: 326788 - RNA, 22 nt, Homo sapiens
cuaugagucugcagaucuauua

SEQ ID NO: 326789 - RNA, 22 nt, Homo sapiens
cuaugcauuuuggaggagggaa

SEQ ID NO: 326790 - RNA, 22 nt, Homo sapiens
cuaugcuuucugggcccugggu

SEQ ID NO: 326791 - RNA, 22 nt, Homo sapiens
cuauggauuuacuguauagggu

SEQ ID NO: 326792 - RNA, 22 nt, Homo sapiens
cuauuagguuggugcaaaagua

SEQ ID NO: 326793 - RNA, 22 nt, Homo sapiens
cuauucacaggcaauauguaca

SEQ ID NO: 326794 - RNA, 22 nt, Homo sapiens
cuauuugguuggugaaaaaagu

SEQ ID NO: 326795 - RNA, 22 nt, Homo sapiens
cucaaagugcugggacuggcug

SEQ ID NO: 326796 - RNA, 19 nt, Homo sapiens
cucaaagugguauuuggag

SEQ ID NO: 326797 - RNA, 22 nt, Homo sapiens
cucaaaguguggucuguggguu

SEQ ID NO: 326798 - RNA, 22 nt, Homo sapiens
cucaaguacaugggauuacagg

SEQ ID NO: 326799 - RNA, 22 nt, Homo sapiens
cucaauuuggaauugucaguaa

SEQ ID NO: 326800 - RNA, 22 nt, Homo sapiens
cucacaguucuaaaggcaagaa

SEQ ID NO: 326801 - RNA, 20 nt, Homo sapiens
cucaccagguguaggcugag

SEQ ID NO: 326802 - RNA, 22 nt, Homo sapiens
cucacggcccugcgcacuggca

SEQ ID NO: 326803 - RNA, 17 nt, Homo sapiens
cucacugagaacagcua

SEQ ID NO: 326804 - RNA, 22 nt, Homo sapiens
cucacuggguguaaaacaugua

SEQ ID NO: 326805 - RNA, 22 nt, Homo sapiens
cucaguagaaaauacauggacu

SEQ ID NO: 326806 - RNA, 22 nt, Homo sapiens
cucagugucuggcacacagaaa

SEQ ID NO: 326807 - RNA, 22 nt, Homo sapiens
cucaguguuaaggccaccucug

SEQ ID NO: 326808 - RNA, 22 nt, Homo sapiens
cucaguguuucagcugcucaga

SEQ ID NO: 326809 - RNA, 22 nt, Homo sapiens
cucauggagauagagaauagaa

SEQ ID NO: 326810 - RNA, 22 nt, Homo sapiens
cuccaggugagguuaagggacu

SEQ ID NO: 326811 - RNA, 22 nt, Homo sapiens
cuccagugcaaagucaugauca

SEQ ID NO: 326812 - RNA, 22 nt, Homo sapiens
cuccauagucuucgaagaauga

SEQ ID NO: 326813 - RNA, 23 nt, Homo sapiens
cuccaugagccguccagggccug

SEQ ID NO: 326814 - RNA, 22 nt, Homo sapiens
cuccauuuaucugaaauuuuau

SEQ ID NO: 326815 - RNA, 22 nt, Homo sapiens
cucccagagccaguuauaggcu

SEQ ID NO: 326816 - RNA, 20 nt, Homo sapiens
cuccuucauuccuuuggacc

SEQ ID NO: 326817 - RNA, 22 nt, Homo sapiens
cucucaguugucuaauuaguuu

SEQ ID NO: 326818 - RNA, 17 nt, Homo sapiens
cucucugguuuaaagca

SEQ ID NO: 326819 - RNA, 22 nt, Homo sapiens
cucugagccugagguuccuacu

SEQ ID NO: 326820 - RNA, 22 nt, Homo sapiens
cucuuugaguuccuccuggugu

SEQ ID NO: 326821 - RNA, 22 nt, Homo sapiens
cugaaaguuauucaggggcaag

SEQ ID NO: 326822 - RNA, 22 nt, Homo sapiens
cugaaaucagccaguuaguuuc

SEQ ID NO: 326823 - RNA, 22 nt, Homo sapiens
cugaaucauugcauuaucaagg

SEQ ID NO: 326824 - RNA, 22 nt, Homo sapiens
cugaaucauugguuaugaguac

SEQ ID NO: 326825 - RNA, 22 nt, Homo sapiens
cugaauguucuggauggaagag

SEQ ID NO: 326826 - RNA, 22 nt, Homo sapiens
cugacuaguuuuaaugcagauu

SEQ ID NO: 326827 - RNA, 22 nt, Homo sapiens
cugacugaggaucaguucauca

SEQ ID NO: 326828 - RNA, 22 nt, Homo sapiens
cugagaaugaugauuuccaguu

SEQ ID NO: 326829 - RNA, 22 nt, Homo sapiens
cugagacuggugauuuaugaag

SEQ ID NO: 326830 - RNA, 22 nt, Homo sapiens
cugagagaggagcuaaaacugc

SEQ ID NO: 326831 - RNA, 22 nt, Homo sapiens
cugagauggagucucgcauugu

SEQ ID NO: 326832 - RNA, 22 nt, Homo sapiens
cugagcaaaguucuauuuaugg

SEQ ID NO: 326833 - RNA, 22 nt, Homo sapiens
cugagcacugagauccucuagc

SEQ ID NO: 326834 - RNA, 22 nt, Homo sapiens
cugagcaugacaucaugugacu

SEQ ID NO: 326835 - RNA, 22 nt, Homo sapiens
cugagcccauucuggggagaag

SEQ ID NO: 326836 - RNA, 22 nt, Homo sapiens
cugagcuagaccacuuggcucc

SEQ ID NO: 326837 - RNA, 22 nt, Homo sapiens
cugagcucauuucuuuugcuac

SEQ ID NO: 326838 - RNA, 22 nt, Homo sapiens
guaugguuuauagggaaauugu

SEQ ID NO: 326839 - RNA, 22 nt, Homo sapiens
guaugugacuggaacaguagga

SEQ ID NO: 326840 - RNA, 22 nt, Homo sapiens
guauugacauuuuuaaggaacu

SEQ ID NO: 326841 - RNA, 22 nt, Homo sapiens
guauuguacuacaagcucuuua

SEQ ID NO: 326842 - RNA, 22 nt, Homo sapiens
guauuugauuauagcaugcuua

SEQ ID NO: 326843 - RNA, 22 nt, Homo sapiens
guauuuguugcagcagcacuau

SEQ ID NO: 326844 - RNA, 22 nt, Homo sapiens
gucaaagucuauuggcuaauuc

SEQ ID NO: 326845 - RNA, 22 nt, Homo sapiens
gucaaagugauuguaauuaggu

SEQ ID NO: 326846 - RNA, 22 nt, Homo sapiens
gucaaaugcacagaaccauuaa

SEQ ID NO: 326847 - RNA, 22 nt, Homo sapiens
gucaacauauuaauuauguucu

SEQ ID NO: 326848 - RNA, 22 nt, Homo sapiens
gucaagauuuguaggacagaga

SEQ ID NO: 326849 - RNA, 22 nt, Homo sapiens
gucacagcuggcauugucugca

SEQ ID NO: 326850 - RNA, 22 nt, Homo sapiens
gucacaguguuuguucauccca

SEQ ID NO: 326851 - RNA, 22 nt, Homo sapiens
gucacauugaugcccauggugg

SEQ ID NO: 326852 - RNA, 22 nt, Homo sapiens
gucacugagcagaaggaagcga

SEQ ID NO: 326853 - RNA, 20 nt, Homo sapiens
gucacuggcccagggcuugu

SEQ ID NO: 326854 - RNA, 22 nt, Homo sapiens
gucacugugacggcaguuacau

SEQ ID NO: 326855 - RNA, 22 nt, Homo sapiens
gucacuguggagaagaaagugg

SEQ ID NO: 326856 - RNA, 22 nt, Homo sapiens
gucacuguuuccuauuauauuu

SEQ ID NO: 326857 - RNA, 22 nt, Homo sapiens
gucagcuuguccagagacucug

SEQ ID NO: 326858 - RNA, 22 nt, Homo sapiens
gucaguggauacugucucuguc

SEQ ID NO: 326859 - RNA, 22 nt, Homo sapiens
gucauccaggcuggagugaagc

SEQ ID NO: 326860 - RNA, 22 nt, Homo sapiens
gucaugggguacuacacauggg

SEQ ID NO: 326861 - RNA, 22 nt, Homo sapiens
gucauggguuaaagguggauac

SEQ ID NO: 326862 - RNA, 22 nt, Homo sapiens
gucaugucuugaaauucaguuu

SEQ ID NO: 326863 - RNA, 22 nt, Homo sapiens
gucauugucaauugacaauugu

SEQ ID NO: 326864 - RNA, 22 nt, Homo sapiens
guccaaauccaugggauguaca

SEQ ID NO: 326865 - RNA, 22 nt, Homo sapiens
guccaguuguuuucugagguug

SEQ ID NO: 326866 - RNA, 20 nt, Homo sapiens
guccauuugcugccauugcu

SEQ ID NO: 326867 - RNA, 22 nt, Homo sapiens
gucccaguggaaccuccaagcu

SEQ ID NO: 326868 - RNA, 22 nt, Homo sapiens
gucuagaacuucugaccuuagg

SEQ ID NO: 326869 - RNA, 22 nt, Homo sapiens
gucucauugcaguuagaccugu

SEQ ID NO: 326870 - RNA, 22 nt, Homo sapiens
gucuccggauguuguuuuuggg

SEQ ID NO: 326871 - RNA, 22 nt, Homo sapiens
gucucugguugcuuuuguacca

SEQ ID NO: 326872 - RNA, 22 nt, Homo sapiens
gucucuugguuuagagcauuua

SEQ ID NO: 326873 - RNA, 22 nt, Homo sapiens
gucucuuguuaucauuucugag

SEQ ID NO: 326874 - RNA, 22 nt, Homo sapiens
gucuggcacagggaaaguacaa

SEQ ID NO: 326875 - RNA, 22 nt, Homo sapiens
gucuggcuuaucucacuuacca

SEQ ID NO: 326876 - RNA, 22 nt, Homo sapiens
gucuggguuuguuuguacuugc

SEQ ID NO: 326877 - RNA, 22 nt, Homo sapiens
gucuguuugauccagaucaaaa

SEQ ID NO: 326878 - RNA, 20 nt, Homo sapiens
gucuugcuccguugcccagg

SEQ ID NO: 326879 - RNA, 22 nt, Homo sapiens
gucuuggagacauugccauuga

SEQ ID NO: 326880 - RNA, 17 nt, Homo sapiens
gucuuugguugaguuua

SEQ ID NO: 326881 - RNA, 22 nt, Homo sapiens
gucuuuguuuggucuguaucag

SEQ ID NO: 326882 - RNA, 22 nt, Homo sapiens
gugaaauguguagaggaucugg

SEQ ID NO: 326883 - RNA, 15 nt, Homo sapiens
gugaaauguuucaga

SEQ ID NO: 326884 - RNA, 22 nt, Homo sapiens
gugaacagaaccugggaucgaa

SEQ ID NO: 326885 - RNA, 22 nt, Homo sapiens
gugaaguuuuugugaggccuaa

SEQ ID NO: 326886 - RNA, 22 nt, Homo sapiens
gugaaucuguuuucuucuguuc

SEQ ID NO: 326887 - RNA, 22 nt, Homo sapiens
gugaaugaaugggugaauacau

SEQ ID NO: 326888 - RNA, 22 nt, Homo sapiens
gugaaugcauuaagaaggggga

SEQ ID NO: 326889 - RNA, 22 nt, Homo sapiens
gugaauguaaagucaugugacu

SEQ ID NO: 326890 - RNA, 22 nt, Homo sapiens
gugaauguuuucuuacauggua

SEQ ID NO: 326891 - RNA, 22 nt, Homo sapiens
gugacacuggagcuggcacaau

SEQ ID NO: 326892 - RNA, 22 nt, Homo sapiens
gugacagaguaagacccuguau

SEQ ID NO: 326893 - RNA, 22 nt, Homo sapiens
gugacaguggagacuuacuuca

SEQ ID NO: 326894 - RNA, 22 nt, Homo sapiens
gugaccagaugggcaggggugu

SEQ ID NO: 326895 - RNA, 22 nt, Homo sapiens
gugacugggaguggugaagaua

SEQ ID NO: 326896 - RNA, 22 nt, Homo sapiens
gugagaacugugucuuauaaac

SEQ ID NO: 326897 - RNA, 22 nt, Homo sapiens
gugagaggaggcagcuuuuaca

SEQ ID NO: 326898 - RNA, 22 nt, Homo sapiens
gugagauggaguuggugucuuu

SEQ ID NO: 326899 - RNA, 22 nt, Homo sapiens
gugagcagagaucgcgugauug

SEQ ID NO: 326900 - RNA, 22 nt, Homo sapiens
gugagcuaagcaaauaugagcc

SEQ ID NO: 326901 - RNA, 22 nt, Homo sapiens
gugagcuccucuucugcugcag

SEQ ID NO: 326902 - RNA, 21 nt, Homo sapiens
gugaggaguuacuggcuuuga

SEQ ID NO: 326903 - RNA, 22 nt, Homo sapiens
gugaggcacugcugcuuuccag

SEQ ID NO: 326904 - RNA, 22 nt, Homo sapiens
gugaggcugguccugccuccca

SEQ ID NO: 326905 - RNA, 22 nt, Homo sapiens
gugagggaugugaaaaagguca

SEQ ID NO: 326906 - RNA, 22 nt, Homo sapiens
gugagguaagaguugcuuugcu

SEQ ID NO: 326907 - RNA, 22 nt, Homo sapiens
gugagguacgugucaagaacca

SEQ ID NO: 326908 - RNA, 22 nt, Homo sapiens
gugagguagagcaugugaaaga

SEQ ID NO: 326909 - RNA, 22 nt, Homo sapiens
gugagguauacugggaucacua

SEQ ID NO: 326910 - RNA, 17 nt, Homo sapiens
gugagguauccucaaaa

SEQ ID NO: 326911 - RNA, 22 nt, Homo sapiens
gugagucaaucugagggguuca

SEQ ID NO: 326912 - RNA, 22 nt, Homo sapiens
gugagucagucuguguagggcu

SEQ ID NO: 326913 - RNA, 22 nt, Homo sapiens
gugagucaugucccaucugauu

SEQ ID NO: 326914 - RNA, 22 nt, Homo sapiens
gugauagguugucacugucacu

SEQ ID NO: 326915 - RNA, 22 nt, Homo sapiens
gugauaucuuacaauucucuuu

SEQ ID NO: 326916 - RNA, 21 nt, Homo sapiens
gugaucaugucacugcacucc

SEQ ID NO: 326917 - RNA, 22 nt, Homo sapiens
gugauugugaaaacauuaagaa

SEQ ID NO: 326918 - RNA, 22 nt, Homo sapiens
gugcaaugaguguggcaaagcc

SEQ ID NO: 326919 - RNA, 22 nt, Homo sapiens
gugcaauguuaauuacuugacu

SEQ ID NO: 326920 - RNA, 22 nt, Homo sapiens
gugcacaacaugcaguuuuguu

SEQ ID NO: 326921 - RNA, 22 nt, Homo sapiens
gugcacaacgugcaggcuuguu

SEQ ID NO: 326922 - RNA, 22 nt, Homo sapiens
gugcacaaugugcagguuuguu

SEQ ID NO: 326923 - RNA, 21 nt, Homo sapiens
gugcacaguaguguuuaauag

SEQ ID NO: 326924 - RNA, 22 nt, Homo sapiens
gugcauacgucuuuauaguagc

SEQ ID NO: 326925 - RNA, 19 nt, Homo sapiens
gugcauaguuauuaaagag

SEQ ID NO: 326926 - RNA, 22 nt, Homo sapiens
gugcauaugcaugugcaugcac

SEQ ID NO: 326927 - RNA, 22 nt, Homo sapiens
gugccuucuagcuaugguuggc

SEQ ID NO: 326928 - RNA, 22 nt, Homo sapiens
gugccuuuucugagcaaugagc

SEQ ID NO: 326929 - RNA, 16 nt, Homo sapiens
gugcuguguuguuagg

SEQ ID NO: 326930 - RNA, 22 nt, Homo sapiens
gugcuuguauuuaaaucaugug

SEQ ID NO: 326931 - RNA, 22 nt, Homo sapiens
acaaaguguuuucugaaggccu

SEQ ID NO: 326932 - RNA, 17 nt, Homo sapiens
acaaauugccagcuagg

SEQ ID NO: 326933 - RNA, 22 nt, Homo sapiens
acaagugaauacaggauucucu

SEQ ID NO: 326934 - RNA, 22 nt, Homo sapiens
acaauggaauggaguggaaagu

SEQ ID NO: 326935 - RNA, 22 nt, Homo sapiens
acacagucaaauccacuuggcu

SEQ ID NO: 326936 - RNA, 22 nt, Homo sapiens
acacaguguuuauugugguuag

SEQ ID NO: 326937 - RNA, 22 nt, Homo sapiens
acacaugugaaaaaaauguuac

SEQ ID NO: 326938 - RNA, 22 nt, Homo sapiens
acacaugugcguagacucuuua

SEQ ID NO: 326939 - RNA, 22 nt, Homo sapiens
acaccauugcauuccagccugg

SEQ ID NO: 326940 - RNA, 22 nt, Homo sapiens
acaccuguggucccaguaacuu

SEQ ID NO: 326941 - RNA, 22 nt, Homo sapiens
acacgugcagauuuauauaaau

SEQ ID NO: 326942 - RNA, 22 nt, Homo sapiens
acacugucugaugaaaguaguu

SEQ ID NO: 326943 - RNA, 22 nt, Homo sapiens
acacuguuuuaguuauuauagc

SEQ ID NO: 326944 - RNA, 22 nt, Homo sapiens
acacuuucuagacaagggaaua

SEQ ID NO: 326945 - RNA, 22 nt, Homo sapiens
acagaacugggcuugcuuuugg

SEQ ID NO: 326946 - RNA, 22 nt, Homo sapiens
acagaauucucagaacugggag

SEQ ID NO: 326947 - RNA, 22 nt, Homo sapiens
acagagcaaugagcuacggucu

SEQ ID NO: 326948 - RNA, 19 nt, Homo sapiens
acagauagaauguucuaca

SEQ ID NO: 326949 - RNA, 22 nt, Homo sapiens
acagauagacauauauagcuca

SEQ ID NO: 326950 - RNA, 20 nt, Homo sapiens
acagcauagccuuuuaaagc

SEQ ID NO: 326951 - RNA, 19 nt, Homo sapiens
acagcugguuuugguuucu

SEQ ID NO: 326952 - RNA, 22 nt, Homo sapiens
acaguacucugcucuuuugauu

SEQ ID NO: 326953 - RNA, 22 nt, Homo sapiens
acaguacuguuguuugcugcca

SEQ ID NO: 326954 - RNA, 22 nt, Homo sapiens
acaguagaaaacaauggauuug

SEQ ID NO: 326955 - RNA, 21 nt, Homo sapiens
acaguaguaauaguguagcca

SEQ ID NO: 326956 - RNA, 22 nt, Homo sapiens
acaguagugggcuacagaauca

SEQ ID NO: 326957 - RNA, 19 nt, Homo sapiens
acaguauugugcacagguu

SEQ ID NO: 326958 - RNA, 18 nt, Homo sapiens
acagugcuggcaugagau

SEQ ID NO: 326959 - RNA, 19 nt, Homo sapiens
acagugcuuugucagaagc

SEQ ID NO: 326960 - RNA, 22 nt, Homo sapiens
acaguggugcgaucucggcuca

SEQ ID NO: 326961 - RNA, 22 nt, Homo sapiens
acaguguacaauagccuuuuaa

SEQ ID NO: 326962 - RNA, 17 nt, Homo sapiens
acagugucuaugaaaug

SEQ ID NO: 326963 - RNA, 22 nt, Homo sapiens
acauagaguaguggugaggaug

SEQ ID NO: 326964 - RNA, 22 nt, Homo sapiens
acauauaaggagacuagggcau

SEQ ID NO: 326965 - RNA, 22 nt, Homo sapiens
acauaugaguacaugugccaug

SEQ ID NO: 326966 - RNA, 22 nt, Homo sapiens
acaugcauggcaugcauuguac

SEQ ID NO: 326967 - RNA, 22 nt, Homo sapiens
acauggcuuaugaauuuggaga

SEQ ID NO: 326968 - RNA, 22 nt, Homo sapiens
acaugguacugauuuacgaaau

SEQ ID NO: 326969 - RNA, 21 nt, Homo sapiens
acauguacacauguaugcaca

SEQ ID NO: 326970 - RNA, 23 nt, Homo sapiens
acauguauagacuuuuuuuccuu

SEQ ID NO: 326971 - RNA, 22 nt, Homo sapiens
acauguauauaaugcauagcga

SEQ ID NO: 326972 - RNA, 19 nt, Homo sapiens
acauugcauuuguaggcuu

SEQ ID NO: 326973 - RNA, 22 nt, Homo sapiens
accagucucagguaugucuuua

SEQ ID NO: 326974 - RNA, 17 nt, Homo sapiens
accagugcaugugcuuu

SEQ ID NO: 326975 - RNA, 22 nt, Homo sapiens
accaucuagauuuguguaggua

SEQ ID NO: 326976 - RNA, 22 nt, Homo sapiens
accauugcacuccuuucugggc

SEQ ID NO: 326977 - RNA, 22 nt, Homo sapiens
acccaguguucagacuaccugu

SEQ ID NO: 326978 - RNA, 22 nt, Homo sapiens
acccaguguugggcagaacugu

SEQ ID NO: 326979 - RNA, 22 nt, Homo sapiens
accccgagacugccaagaaucc

SEQ ID NO: 326980 - RNA, 22 nt, Homo sapiens
accccugagaucgaaucaugcu

SEQ ID NO: 326981 - RNA, 22 nt, Homo sapiens
acccgcccagguguggccggga

SEQ ID NO: 326982 - RNA, 21 nt, Homo sapiens
acccucuaguuuucaacaggc

SEQ ID NO: 326983 - RNA, 22 nt, Homo sapiens
acccugaagccaugaguggaac

SEQ ID NO: 326984 - RNA, 22 nt, Homo sapiens
acccugacacgauucuucacuu

SEQ ID NO: 326985 - RNA, 22 nt, Homo sapiens
acccuguaacauacaagugguu

SEQ ID NO: 326986 - RNA, 22 nt, Homo sapiens
acccuguaggugcuggcagaga

SEQ ID NO: 326987 - RNA, 22 nt, Homo sapiens
acccugucacucccaucaauuu

SEQ ID NO: 326988 - RNA, 18 nt, Homo sapiens
acccuucagcacugggcc

SEQ ID NO: 326989 - RNA, 22 nt, Homo sapiens
acccuuuagguuggaugaggau

SEQ ID NO: 326990 - RNA, 22 nt, Homo sapiens
accugagauuacaggugcuggc

SEQ ID NO: 326991 - RNA, 21 nt, Homo sapiens
accugauguuucaguuggagu

SEQ ID NO: 326992 - RNA, 22 nt, Homo sapiens
accugggugcugaugggcuuua

SEQ ID NO: 326993 - RNA, 22 nt, Homo sapiens
acuacaugugaugucaguauau

SEQ ID NO: 326994 - RNA, 22 nt, Homo sapiens
acucagagaacauucccagucu

SEQ ID NO: 326995 - RNA, 22 nt, Homo sapiens
acuccauuucauuuuagcucuu

SEQ ID NO: 326996 - RNA, 22 nt, Homo sapiens
acugagaucuuuaaauaaauaa

SEQ ID NO: 326997 - RNA, 22 nt, Homo sapiens
acugagccuuuaaaugacuuca

SEQ ID NO: 326998 - RNA, 22 nt, Homo sapiens
acugagucauugaggcccucuc

SEQ ID NO: 326999 - RNA, 22 nt, Homo sapiens
acugagucauugggugcccaga

SEQ ID NO: 327000 - RNA, 22 nt, Homo sapiens
acugcacuccagccuaggcgac

SEQ ID NO: 327001 - RNA, 22 nt, Homo sapiens
acugcacuccagccuccugggu

SEQ ID NO: 327002 - RNA, 22 nt, Homo sapiens
acugcacuccagccucgcaaca

SEQ ID NO: 327003 - RNA, 22 nt, Homo sapiens
acugcacuccagccucgugaca

SEQ ID NO: 327004 - RNA, 22 nt, Homo sapiens
acugcacuccagccugagccug

SEQ ID NO: 327005 - RNA, 22 nt, Homo sapiens
acugcacuccagccugcccaac

SEQ ID NO: 327006 - RNA, 22 nt, Homo sapiens
acugcacuccagccuggacgac

SEQ ID NO: 327007 - RNA, 22 nt, Homo sapiens
acugcacuccagccuggcggac

SEQ ID NO: 327008 - RNA, 22 nt, Homo sapiens
acugcacuccagccuucgugac

SEQ ID NO: 327009 - RNA, 22 nt, Homo sapiens
acugcacuccagccuugugaca

SEQ ID NO: 327010 - RNA, 22 nt, Homo sapiens
acugcacucuagcauggguaau

SEQ ID NO: 327011 - RNA, 22 nt, Homo sapiens
acugcacugcagccuggccaac

SEQ ID NO: 327012 - RNA, 22 nt, Homo sapiens
acugcacugucaaccuccuggg

SEQ ID NO: 327013 - RNA, 22 nt, Homo sapiens
acugcacuucagccuuggcuac

SEQ ID NO: 327014 - RNA, 22 nt, Homo sapiens
acugcauuugguaaagucaaga

SEQ ID NO: 327015 - RNA, 22 nt, Homo sapiens
acuggacuuaaugaugaauugu

SEQ ID NO: 327016 - RNA, 22 nt, Homo sapiens
acuggcuguuaggaauuaccuc

SEQ ID NO: 327017 - RNA, 22 nt, Homo sapiens
acuggcuuauuucacuuagcau

SEQ ID NO: 327018 - RNA, 22 nt, Homo sapiens
acuguacucuacccugggcaac

SEQ ID NO: 327019 - RNA, 22 nt, Homo sapiens
acuuugcuuaucccaggcacug

SEQ ID NO: 327020 - RNA, 22 nt, Homo sapiens
acuuugguuaucauacuuucag

SEQ ID NO: 327021 - RNA, 22 nt, Homo sapiens
acuuuguguuacccagcaagga

SEQ ID NO: 327022 - RNA, 22 nt, Homo sapiens
acuuuguuauggcaacccuaag

SEQ ID NO: 327023 - RNA, 23 nt, Homo sapiens
agaaaugucuauucagggucccu

SEQ ID NO: 327024 - RNA, 22 nt, Homo sapiens
cugaggguagaaggaucacuug

SEQ ID NO: 327025 - RNA, 22 nt, Homo sapiens
cugagguacugggggccaggau

SEQ ID NO: 327026 - RNA, 22 nt, Homo sapiens
cugagguauuuaggugaaagaa

SEQ ID NO: 327027 - RNA, 22 nt, Homo sapiens
cugauaguucucuuuagaguuu

SEQ ID NO: 327028 - RNA, 22 nt, Homo sapiens
cugaucuguagcagccaccaca

SEQ ID NO: 327029 - RNA, 22 nt, Homo sapiens
cugauugugcagagguguaauu

SEQ ID NO: 327030 - RNA, 22 nt, Homo sapiens
cugcaagaaucguaguauuuga

SEQ ID NO: 327031 - RNA, 22 nt, Homo sapiens
cugcaagaugcauaggaauuuu

SEQ ID NO: 327032 - RNA, 22 nt, Homo sapiens
cugcaauggagaaagugagacu

SEQ ID NO: 327033 - RNA, 20 nt, Homo sapiens
cugcacauccacucuacuuc

SEQ ID NO: 327034 - RNA, 22 nt, Homo sapiens
cugcauuagucuguuuaguguu

SEQ ID NO: 327035 - RNA, 22 nt, Homo sapiens
cugcccuuucuauaugauguaa

SEQ ID NO: 327036 - RNA, 22 nt, Homo sapiens
cuggaaacaucuuaggaaugca

SEQ ID NO: 327037 - RNA, 22 nt, Homo sapiens
cuggaaagaaacccuuaauucu

SEQ ID NO: 327038 - RNA, 18 nt, Homo sapiens
cuggaaggcuacuacagu

SEQ ID NO: 327039 - RNA, 22 nt, Homo sapiens
cuggaauuacaggguugagcua

SEQ ID NO: 327040 - RNA, 22 nt, Homo sapiens
cuggacguugaggcugcaguga

SEQ ID NO: 327041 - RNA, 22 nt, Homo sapiens
cuggaggccugaacauaaaugg

SEQ ID NO: 327042 - RNA, 22 nt, Homo sapiens
cuggaguaugaaccauguauca

SEQ ID NO: 327043 - RNA, 22 nt, Homo sapiens
cuggauauguugcaacauuucc

SEQ ID NO: 327044 - RNA, 22 nt, Homo sapiens
cuggcaaauaguagagccagga

SEQ ID NO: 327045 - RNA, 22 nt, Homo sapiens
cuggcagucugccucuucacug

SEQ ID NO: 327046 - RNA, 22 nt, Homo sapiens
cuggcagugcuuguuauccugg

SEQ ID NO: 327047 - RNA, 22 nt, Homo sapiens
cuggcuaagugcuugagugugc

SEQ ID NO: 327048 - RNA, 22 nt, Homo sapiens
cuggcugagugguaaguagagg

SEQ ID NO: 327049 - RNA, 22 nt, Homo sapiens
cugggauggaggagaauuagag

SEQ ID NO: 327050 - RNA, 22 nt, Homo sapiens
cugggcaaugcggcuggauaga

SEQ ID NO: 327051 - RNA, 22 nt, Homo sapiens
cugguaugugugacugcauuga

SEQ ID NO: 327052 - RNA, 22 nt, Homo sapiens
cuggucaagagcaaaggccagg

SEQ ID NO: 327053 - RNA, 22 nt, Homo sapiens
cuguaaaguaagagguaaguua

SEQ ID NO: 327054 - RNA, 22 nt, Homo sapiens
cuguaaaguucucauuguagcc

SEQ ID NO: 327055 - RNA, 22 nt, Homo sapiens
cuguagacauuaggccugcacu

SEQ ID NO: 327056 - RNA, 22 nt, Homo sapiens
cuguauguuucuaugaauguga

SEQ ID NO: 327057 - RNA, 22 nt, Homo sapiens
cugucuaugagccaggaagcca

SEQ ID NO: 327058 - RNA, 22 nt, Homo sapiens
cugucuggaggccugcaaauaa

SEQ ID NO: 327059 - RNA, 22 nt, Homo sapiens
cugugacugcagggcauauuug

SEQ ID NO: 327060 - RNA, 22 nt, Homo sapiens
cugugaucuuuuuucauguggu

SEQ ID NO: 327061 - RNA, 22 nt, Homo sapiens
cugugauuauauaguuaaggua

SEQ ID NO: 327062 - RNA, 22 nt, Homo sapiens
cugugcaaacaagugaaccccu

SEQ ID NO: 327063 - RNA, 22 nt, Homo sapiens
cugugccaagcuugcgaugugc

SEQ ID NO: 327064 - RNA, 22 nt, Homo sapiens
cugugcuaggcaaugugguaga

SEQ ID NO: 327065 - RNA, 22 nt, Homo sapiens
cuguggguuuuacuguuuuacu

SEQ ID NO: 327066 - RNA, 22 nt, Homo sapiens
cugugguauuauuagaaauauc

SEQ ID NO: 327067 - RNA, 23 nt, Homo sapiens
cuguggugaggcccuagaaucug

SEQ ID NO: 327068 - RNA, 22 nt, Homo sapiens
cugugguuuaaggaauuuugac

SEQ ID NO: 327069 - RNA, 22 nt, Homo sapiens
cuguuauguucuagagggugca

SEQ ID NO: 327070 - RNA, 22 nt, Homo sapiens
cuguugcaguuauggcugcagg

SEQ ID NO: 327071 - RNA, 22 nt, Homo sapiens
cuguuugaggguuugcuuucag

SEQ ID NO: 327072 - RNA, 22 nt, Homo sapiens
cuguuugguaaggaugccucag

SEQ ID NO: 327073 - RNA, 22 nt, Homo sapiens
cuuaaguaguuguggaaugaau

SEQ ID NO: 327074 - RNA, 20 nt, Homo sapiens
cuuaaugcagcauuucucag

SEQ ID NO: 327075 - RNA, 22 nt, Homo sapiens
cuuagguaggugccagguuuuu

SEQ ID NO: 327076 - RNA, 19 nt, Homo sapiens
cuuaggugaccaguuccca

SEQ ID NO: 327077 - RNA, 22 nt, Homo sapiens
cuuagguuaugauaaauuuagu

SEQ ID NO: 327078 - RNA, 20 nt, Homo sapiens
cuuaucaguggcaaguauaa

SEQ ID NO: 327079 - RNA, 22 nt, Homo sapiens
cuucaaaguuggcuaggagaca

SEQ ID NO: 327080 - RNA, 17 nt, Homo sapiens
cuucaaauaauuucccc

SEQ ID NO: 327081 - RNA, 22 nt, Homo sapiens
cuucaagucuuuggauaauuag

SEQ ID NO: 327082 - RNA, 22 nt, Homo sapiens
cuucaaguguggccaccugacc

SEQ ID NO: 327083 - RNA, 22 nt, Homo sapiens
cuucacggugccuacuuguguc

SEQ ID NO: 327084 - RNA, 22 nt, Homo sapiens
caaaggcuuccacugcauccuu

SEQ ID NO: 327085 - RNA, 22 nt, Homo sapiens
caaagucuucaguugauucuga

SEQ ID NO: 327086 - RNA, 22 nt, Homo sapiens
caaagugcuggccgggcgcagu

SEQ ID NO: 327087 - RNA, 22 nt, Homo sapiens
caaauccucaccucaucaugaa

SEQ ID NO: 327088 - RNA, 22 nt, Homo sapiens
caaauugcuuguggaggauaau

SEQ ID NO: 327089 - RNA, 22 nt, Homo sapiens
caacagucagcccauccacaga

SEQ ID NO: 327090 - RNA, 19 nt, Homo sapiens
caacccugcagagaaagga

SEQ ID NO: 327091 - RNA, 22 nt, Homo sapiens
caagacuguccaacauauuggg

SEQ ID NO: 327092 - RNA, 22 nt, Homo sapiens
caagaucauuuaugcuaaaauu

SEQ ID NO: 327093 - RNA, 22 nt, Homo sapiens
caaguacugggcuauggauauu

SEQ ID NO: 327094 - RNA, 22 nt, Homo sapiens
caagugcuacagagaaaucuuu

SEQ ID NO: 327095 - RNA, 22 nt, Homo sapiens
caagugcucuaggauccugagu

SEQ ID NO: 327096 - RNA, 22 nt, Homo sapiens
caaguguuggcuuguauacaaa

SEQ ID NO: 327097 - RNA, 22 nt, Homo sapiens
caaucugucuuuuagggggcca

SEQ ID NO: 327098 - RNA, 22 nt, Homo sapiens
caaugcauuauucucccacuuc

SEQ ID NO: 327099 - RNA, 21 nt, Homo sapiens
caauggcacaaucucugcuca

SEQ ID NO: 327100 - RNA, 22 nt, Homo sapiens
cacaaugucuaagauguuucua

SEQ ID NO: 327101 - RNA, 22 nt, Homo sapiens
cacacugucuucaauggguggu

SEQ ID NO: 327102 - RNA, 22 nt, Homo sapiens
cacagagugagacccugucucu

SEQ ID NO: 327103 - RNA, 22 nt, Homo sapiens
cacagcacaggcaugaguguca

SEQ ID NO: 327104 - RNA, 22 nt, Homo sapiens
cacauagucccugcuaaucuuc

SEQ ID NO: 327105 - RNA, 22 nt, Homo sapiens
caccaaccucaguagcaucugu

SEQ ID NO: 327106 - RNA, 23 nt, Homo sapiens
caccaguagaaugugugggaggg

SEQ ID NO: 327107 - RNA, 19 nt, Homo sapiens
caccagugcaugcuacuau

SEQ ID NO: 327108 - RNA, 22 nt, Homo sapiens
cacccagucaucuuggguuuuu

SEQ ID NO: 327109 - RNA, 22 nt, Homo sapiens
cacgugcuuucuuuucauuuag

SEQ ID NO: 327110 - RNA, 22 nt, Homo sapiens
cacuagagaauagguaguucug

SEQ ID NO: 327111 - RNA, 22 nt, Homo sapiens
cacugcacuccagucugacgac

SEQ ID NO: 327112 - RNA, 21 nt, Homo sapiens
cacugcacuugccuucugggu

SEQ ID NO: 327113 - RNA, 22 nt, Homo sapiens
cacugcaguaaauugcgucggu

SEQ ID NO: 327114 - RNA, 22 nt, Homo sapiens
cacugcauccuccaccuccugg

SEQ ID NO: 327115 - RNA, 22 nt, Homo sapiens
cacugcauuacucaugagcaug

SEQ ID NO: 327116 - RNA, 22 nt, Homo sapiens
cacugcgacguccgccucccgg

SEQ ID NO: 327117 - RNA, 22 nt, Homo sapiens
cacugggccaucacuuaauauu

SEQ ID NO: 327118 - RNA, 22 nt, Homo sapiens
cacugggugagauccauguuua

SEQ ID NO: 327119 - RNA, 21 nt, Homo sapiens
cacugguguugcuauaucaaa

SEQ ID NO: 327120 - RNA, 18 nt, Homo sapiens
cacuuggcuuugccccuc

SEQ ID NO: 327121 - RNA, 22 nt, Homo sapiens
cagacaugucuuguggccgugg

SEQ ID NO: 327122 - RNA, 21 nt, Homo sapiens
cagagaucaucucuguuuuaa

SEQ ID NO: 327123 - RNA, 19 nt, Homo sapiens
ucucacagcucuacuaugu

SEQ ID NO: 327124 - RNA, 22 nt, Homo sapiens
ucucagcggacaggccggccag

SEQ ID NO: 327125 - RNA, 22 nt, Homo sapiens
ucucagugaaauaaauuauuuu

SEQ ID NO: 327126 - RNA, 22 nt, Homo sapiens
ucucagugaauguggaaaaagc

SEQ ID NO: 327127 - RNA, 22 nt, Homo sapiens
ucucagugaauugguuuugucu

SEQ ID NO: 327128 - RNA, 22 nt, Homo sapiens
ucucaguggcuuccucacuuuu

SEQ ID NO: 327129 - RNA, 22 nt, Homo sapiens
ucucaguuuucaagcugucgau

SEQ ID NO: 327130 - RNA, 21 nt, Homo sapiens
ucucauagaguuucacuuucu

SEQ ID NO: 327131 - RNA, 20 nt, Homo sapiens
ucucauggagguagagaaua

SEQ ID NO: 327132 - RNA, 22 nt, Homo sapiens
ucucauggcucacccugcauag

SEQ ID NO: 327133 - RNA, 22 nt, Homo sapiens
ucucauuggucugagucaccug

SEQ ID NO: 327134 - RNA, 21 nt, Homo sapiens
ucucauugugguuuuaauugg

SEQ ID NO: 327135 - RNA, 22 nt, Homo sapiens
ucuccauuuguaaggguuucuc

SEQ ID NO: 327136 - RNA, 22 nt, Homo sapiens
ucuccggguggcggcgaaggga

SEQ ID NO: 327137 - RNA, 22 nt, Homo sapiens
ucucuagagagccugguguuca

SEQ ID NO: 327138 - RNA, 22 nt, Homo sapiens
ucucugauuauugcauuucauu

SEQ ID NO: 327139 - RNA, 19 nt, Homo sapiens
ucucugguguuggagggga

SEQ ID NO: 327140 - RNA, 22 nt, Homo sapiens
ucucugguuuguggaaucuuag

SEQ ID NO: 327141 - RNA, 22 nt, Homo sapiens
ucucuguuuagagccagcaauu

SEQ ID NO: 327142 - RNA, 22 nt, Homo sapiens
ucucuguuuauuuuugguguau

SEQ ID NO: 327143 - RNA, 22 nt, Homo sapiens
ucucuugguugaacaguuugga

SEQ ID NO: 327144 - RNA, 22 nt, Homo sapiens
ucugacacagugauuaguaaau

SEQ ID NO: 327145 - RNA, 22 nt, Homo sapiens
ucugacucuggagucucagguu

SEQ ID NO: 327146 - RNA, 22 nt, Homo sapiens
ucugagacuguuucuaacaagc

SEQ ID NO: 327147 - RNA, 22 nt, Homo sapiens
ucugagaugagacuuugaauuu

SEQ ID NO: 327148 - RNA, 22 nt, Homo sapiens
ucugagcaauaaacaacauauu

SEQ ID NO: 327149 - RNA, 22 nt, Homo sapiens
ucugagguaggugcauggauac

SEQ ID NO: 327150 - RNA, 22 nt, Homo sapiens
ucugagguuaaauuuuauaguu

SEQ ID NO: 327151 - RNA, 22 nt, Homo sapiens
ucugaguggcagaaugagcuga

SEQ ID NO: 327152 - RNA, 22 nt, Homo sapiens
ucugcauaucaugcagaacuau

SEQ ID NO: 327153 - RNA, 22 nt, Homo sapiens
ucugccuacugagcacacagug

SEQ ID NO: 327154 - RNA, 22 nt, Homo sapiens
ucuggaauguaaaguuuauggg

SEQ ID NO: 327155 - RNA, 23 nt, Homo sapiens
ucuggaucauucguagugccagc

SEQ ID NO: 327156 - RNA, 22 nt, Homo sapiens
ucuggcaagagccgagggcagu

SEQ ID NO: 327157 - RNA, 22 nt, Homo sapiens
ucuggccuacaucauuuuuccg

SEQ ID NO: 327158 - RNA, 22 nt, Homo sapiens
ucuggccuccuaugagaaucga

SEQ ID NO: 327159 - RNA, 22 nt, Homo sapiens
ucuggcuccaaagucuauuuuu

SEQ ID NO: 327160 - RNA, 22 nt, Homo sapiens
ucuggcuccacacuuuauuaac

SEQ ID NO: 327161 - RNA, 22 nt, Homo sapiens
ucuggcuuauuucacuuagcau

SEQ ID NO: 327162 - RNA, 18 nt, Homo sapiens
ucuggcuucuuuguucca

SEQ ID NO: 327163 - RNA, 23 nt, Homo sapiens
ucuggcuuugggaugcucaaggg

SEQ ID NO: 327164 - RNA, 22 nt, Homo sapiens
ucugggguuuccacuuuuacuu

SEQ ID NO: 327165 - RNA, 22 nt, Homo sapiens
ucugguggugaugagagacagu

SEQ ID NO: 327166 - RNA, 22 nt, Homo sapiens
ucugguguuauucauguaguuu

SEQ ID NO: 327167 - RNA, 22 nt, Homo sapiens
ucuguacugccaaguuucuuua

SEQ ID NO: 327168 - RNA, 22 nt, Homo sapiens
ucugucacugaaucccugucac

SEQ ID NO: 327169 - RNA, 19 nt, Homo sapiens
ucugucacuggggguauuc

SEQ ID NO: 327170 - RNA, 22 nt, Homo sapiens
ucugucuuguccucacccuaga

SEQ ID NO: 327171 - RNA, 22 nt, Homo sapiens
ucugucuuugccuaaguuuguc

SEQ ID NO: 327172 - RNA, 22 nt, Homo sapiens
ucugucuuugucaggaccagag

SEQ ID NO: 327173 - RNA, 22 nt, Homo sapiens
ucugugaaugaacacuugaaaa

SEQ ID NO: 327174 - RNA, 22 nt, Homo sapiens
ucugugaaugugaccuuauuug

SEQ ID NO: 327175 - RNA, 22 nt, Homo sapiens
ucugugguaagaaacgcauguc

SEQ ID NO: 327176 - RNA, 22 nt, Homo sapiens
ucuguggucagcauccgccacu

SEQ ID NO: 327177 - RNA, 22 nt, Homo sapiens
ucuguggugggcuccacccagu

SEQ ID NO: 327178 - RNA, 18 nt, Homo sapiens
ucugugguguaaauacgu

SEQ ID NO: 327179 - RNA, 22 nt, Homo sapiens
ucuguguugaugcucauuaauu

SEQ ID NO: 327180 - RNA, 22 nt, Homo sapiens
ucuguguuuagacccaggguag

SEQ ID NO: 327181 - RNA, 22 nt, Homo sapiens
ucuguguuugguuggcaauuuc

SEQ ID NO: 327182 - RNA, 22 nt, Homo sapiens
ucuguuguuaucauaauauuga

SEQ ID NO: 327183 - RNA, 22 nt, Homo sapiens
ucuuaguuugggguggggauag

SEQ ID NO: 327184 - RNA, 22 nt, Homo sapiens
ucuucaugcuugaaauaauagc

SEQ ID NO: 327185 - RNA, 19 nt, Homo sapiens
ucuugcacaugugaacuca

SEQ ID NO: 327186 - RNA, 22 nt, Homo sapiens
ucuugcaguucccaaauucaca

SEQ ID NO: 327187 - RNA, 22 nt, Homo sapiens
ucuugccacuucauccccuuuc

SEQ ID NO: 327188 - RNA, 22 nt, Homo sapiens
ucuugguuuauugauggagagg

SEQ ID NO: 327189 - RNA, 19 nt, Homo sapiens
ucuuugcuuuucuaagagg

SEQ ID NO: 327190 - RNA, 22 nt, Homo sapiens
ucuuuggaggcgaucuguuuga

SEQ ID NO: 327191 - RNA, 22 nt, Homo sapiens
ucuuuggauggaaauuggaguc

SEQ ID NO: 327192 - RNA, 22 nt, Homo sapiens
ucuuuggcugugaagaauaaug

SEQ ID NO: 327193 - RNA, 22 nt, Homo sapiens
ucuuuggguagauauguagcug

SEQ ID NO: 327194 - RNA, 22 nt, Homo sapiens
ucuuuggguguauuucacagcc

SEQ ID NO: 327195 - RNA, 22 nt, Homo sapiens
ucuuugguaggaguaggaggcc

SEQ ID NO: 327196 - RNA, 22 nt, Homo sapiens
ucuuugguucuguuuauguaau

SEQ ID NO: 327197 - RNA, 22 nt, Homo sapiens
ucuuuguguaggucaaucuggc

SEQ ID NO: 327198 - RNA, 22 nt, Homo sapiens
ucuuuguuggaguccaaggaua

SEQ ID NO: 327199 - RNA, 22 nt, Homo sapiens
ucuuuugggccucuugucagac

SEQ ID NO: 327200 - RNA, 22 nt, Homo sapiens
ucuuuuggguauggagccauca

SEQ ID NO: 327201 - RNA, 22 nt, Homo sapiens
ucuuuugguuucuagaggccgc

SEQ ID NO: 327202 - RNA, 22 nt, Homo sapiens
ucuuuuugagucaguuucggua

SEQ ID NO: 327203 - RNA, 22 nt, Homo sapiens
ugaaaagucuaagauuaagguu

SEQ ID NO: 327204 - RNA, 22 nt, Homo sapiens
ugaaacacacagagaagggaga

SEQ ID NO: 327205 - RNA, 22 nt, Homo sapiens
ugaaagacugaaagcuuuucuu

SEQ ID NO: 327206 - RNA, 21 nt, Homo sapiens
ugaaaugcaugugcacauuaa

SEQ ID NO: 327207 - RNA, 22 nt, Homo sapiens
ugaaaugccuuuaaugaauuua

SEQ ID NO: 327208 - RNA, 22 nt, Homo sapiens
ugaaaugcugucuaggggaaau

SEQ ID NO: 327209 - RNA, 22 nt, Homo sapiens
ugaaauggugcggucugcagca

SEQ ID NO: 327210 - RNA, 22 nt, Homo sapiens
ugaaauguaaguugucuagucu

SEQ ID NO: 327211 - RNA, 22 nt, Homo sapiens
ugaaauguguuaucugggccug

SEQ ID NO: 327212 - RNA, 22 nt, Homo sapiens
ugaaauguuaaacaaguggcuc

SEQ ID NO: 327213 - RNA, 21 nt, Homo sapiens
ugaacacuggacugagugucc

SEQ ID NO: 327214 - RNA, 22 nt, Homo sapiens
ugaacucauccuuucuuauggc

SEQ ID NO: 327215 - RNA, 22 nt, Homo sapiens
caaagugcugaaagaggccagg

SEQ ID NO: 327216 - RNA, 22 nt, Homo sapiens
caaagugcuggaauuggccggg

SEQ ID NO: 327217 - RNA, 22 nt, Homo sapiens
caaagugcugggacuggccggg

SEQ ID NO: 327218 - RNA, 22 nt, Homo sapiens
caaagugcugggaugggccagg

SEQ ID NO: 327219 - RNA, 19 nt, Homo sapiens
caaaguguucuucuuugcc

SEQ ID NO: 327220 - RNA, 22 nt, Homo sapiens
caaauacuuucauguugucuug

SEQ ID NO: 327221 - RNA, 22 nt, Homo sapiens
caaaugcuucuauggacugucu

SEQ ID NO: 327222 - RNA, 22 nt, Homo sapiens
caaauugcuugucuguagugga

SEQ ID NO: 327223 - RNA, 22 nt, Homo sapiens
caagaggcuguguauaaagcca

SEQ ID NO: 327224 - RNA, 22 nt, Homo sapiens
caaggcacagccccuacuuccu

SEQ ID NO: 327225 - RNA, 22 nt, Homo sapiens
caauacuguguugaauaagagu

SEQ ID NO: 327226 - RNA, 21 nt, Homo sapiens
caauggcacgaucuuggcuca

SEQ ID NO: 327227 - RNA, 22 nt, Homo sapiens
caauggcacuauuggaaaaggu

SEQ ID NO: 327228 - RNA, 22 nt, Homo sapiens
caaugguuuuuuaguauaagua

SEQ ID NO: 327229 - RNA, 22 nt, Homo sapiens
cacacugucuucauuacuguag

SEQ ID NO: 327230 - RNA, 22 nt, Homo sapiens
cacacuguuuuccauggggguu

SEQ ID NO: 327231 - RNA, 22 nt, Homo sapiens
cacagcgacuuccgccuaccgg

SEQ ID NO: 327232 - RNA, 22 nt, Homo sapiens
cacagcuaacaacuguuucuuc

SEQ ID NO: 327233 - RNA, 22 nt, Homo sapiens
cacagggcuaacauuuuugccc

SEQ ID NO: 327234 - RNA, 23 nt, Homo sapiens
cacagggugaacaccccuaaucc

SEQ ID NO: 327235 - RNA, 22 nt, Homo sapiens
cacaguagaauagagcacuagg

SEQ ID NO: 327236 - RNA, 22 nt, Homo sapiens
cacagugaacaauauccucugu

SEQ ID NO: 327237 - RNA, 22 nt, Homo sapiens
cacagugaacugguggguuuuu

SEQ ID NO: 327238 - RNA, 22 nt, Homo sapiens
cacauugaauuucugaugacaa

SEQ ID NO: 327239 - RNA, 22 nt, Homo sapiens
caccacagccauuauugucccc

SEQ ID NO: 327240 - RNA, 22 nt, Homo sapiens
caccagcuggcauugaauaccu

SEQ ID NO: 327241 - RNA, 22 nt, Homo sapiens
caccagguggcugaggccauga

SEQ ID NO: 327242 - RNA, 22 nt, Homo sapiens
caccaguuuuucagugauucaa

SEQ ID NO: 327243 - RNA, 22 nt, Homo sapiens
cacccaguaagcaugaggcccu

SEQ ID NO: 327244 - RNA, 22 nt, Homo sapiens
cacccuugcagggacagcuuug

SEQ ID NO: 327245 - RNA, 22 nt, Homo sapiens
caccgagguuggagugcagugg

SEQ ID NO: 327246 - RNA, 22 nt, Homo sapiens
caccuagacuggagugcagugg

SEQ ID NO: 327247 - RNA, 22 nt, Homo sapiens
caccuguacauggcaguguccu

SEQ ID NO: 327248 - RNA, 22 nt, Homo sapiens
caccuguagucccagcugaggc

SEQ ID NO: 327249 - RNA, 22 nt, Homo sapiens
cacuaggcuggagugcaguggc

SEQ ID NO: 327250 - RNA, 22 nt, Homo sapiens
cacucaguuugugguacuuugu

SEQ ID NO: 327251 - RNA, 22 nt, Homo sapiens
cacugaaugugagguuggggag

SEQ ID NO: 327252 - RNA, 18 nt, Homo sapiens
cacugagcccuucacucu

SEQ ID NO: 327253 - RNA, 22 nt, Homo sapiens
cacugcacuccagucuggcgac

SEQ ID NO: 327254 - RNA, 22 nt, Homo sapiens
cacugcacuccaguuuggauga

SEQ ID NO: 327255 - RNA, 22 nt, Homo sapiens
cacugcacucuucuucugggca

SEQ ID NO: 327256 - RNA, 22 nt, Homo sapiens
cacugcaguggaagauuaagaa

SEQ ID NO: 327257 - RNA, 22 nt, Homo sapiens
cacugcauccuugaccuucugg

SEQ ID NO: 327258 - RNA, 22 nt, Homo sapiens
cacugggugccauauguuugcu

SEQ ID NO: 327259 - RNA, 22 nt, Homo sapiens
cacuggguuagaacaugcuccu

SEQ ID NO: 327260 - RNA, 21 nt, Homo sapiens
cacuggguucaggcuugugga

SEQ ID NO: 327261 - RNA, 22 nt, Homo sapiens
cacuggucucauggcaugagag

SEQ ID NO: 327262 - RNA, 22 nt, Homo sapiens
cacugugcaaccuccaccuccc

SEQ ID NO: 327263 - RNA, 22 nt, Homo sapiens
cacuguggauggaacuauguga

SEQ ID NO: 327264 - RNA, 22 nt, Homo sapiens
cagagagcuugcccuuguauau

SEQ ID NO: 327265 - RNA, 22 nt, Homo sapiens
cagagguauugcaaaagccuag

SEQ ID NO: 327266 - RNA, 22 nt, Homo sapiens
cagauacucauggaacuggguu

SEQ ID NO: 327267 - RNA, 22 nt, Homo sapiens
cagauacuccuggucucaggag

SEQ ID NO: 327268 - RNA, 22 nt, Homo sapiens
cagcacauuacaaguacuuggu

SEQ ID NO: 327269 - RNA, 22 nt, Homo sapiens
cagcaguuguuucggauuggga

SEQ ID NO: 327270 - RNA, 22 nt, Homo sapiens
cagcccguaaucccagcacuuu

SEQ ID NO: 327271 - RNA, 23 nt, Homo sapiens
cagcuucauugaacauaacuccu

SEQ ID NO: 327272 - RNA, 22 nt, Homo sapiens
caggcauagucuugaguuuuau

SEQ ID NO: 327273 - RNA, 22 nt, Homo sapiens
cagggcauuggcugguaccugg

SEQ ID NO: 327274 - RNA, 22 nt, Homo sapiens
cagguacuucugggcugagcag

SEQ ID NO: 327275 - RNA, 19 nt, Homo sapiens
cagguagugugcugacaug

SEQ ID NO: 327276 - RNA, 22 nt, Homo sapiens
cagguaguguguagcacagcag

SEQ ID NO: 327277 - RNA, 22 nt, Homo sapiens
caguaaauaucugagcgagguc

SEQ ID NO: 327278 - RNA, 22 nt, Homo sapiens
caguacaauguggaaaaggagu

SEQ ID NO: 327279 - RNA, 22 nt, Homo sapiens
caguaguagccccuuagaugga

SEQ ID NO: 327280 - RNA, 18 nt, Homo sapiens
cagugcaauacaggagag

SEQ ID NO: 327281 - RNA, 23 nt, Homo sapiens
cagugcaugacuguauaugcaaa

SEQ ID NO: 327282 - RNA, 22 nt, Homo sapiens
cagugcaugacuguauauuauc

SEQ ID NO: 327283 - RNA, 22 nt, Homo sapiens
caguggaugaacaagaagugau

SEQ ID NO: 327284 - RNA, 22 nt, Homo sapiens
caguggaugauguuuucugugg

SEQ ID NO: 327285 - RNA, 23 nt, Homo sapiens
cagugguguuagagaaaucuuuu

SEQ ID NO: 327286 - RNA, 22 nt, Homo sapiens
cagugguuuucaacccugguug

SEQ ID NO: 327287 - RNA, 22 nt, Homo sapiens
caguguuuuuaacaggugcccg

SEQ ID NO: 327288 - RNA, 22 nt, Homo sapiens
cauaaaucuuguugaauagcac

SEQ ID NO: 327289 - RNA, 22 nt, Homo sapiens
cauaaugcuaagagcugccccu

SEQ ID NO: 327290 - RNA, 22 nt, Homo sapiens
cauagcacugagcucuacccuc

SEQ ID NO: 327291 - RNA, 22 nt, Homo sapiens
cauaguacuugcauaguacuau

SEQ ID NO: 327292 - RNA, 22 nt, Homo sapiens
cauauucacuuuacagagcugu

SEQ ID NO: 327293 - RNA, 22 nt, Homo sapiens
caucacaguacuaaucgucaua

SEQ ID NO: 327294 - RNA, 20 nt, Homo sapiens
caucaccuggcaggauuugu

SEQ ID NO: 327295 - RNA, 22 nt, Homo sapiens
caucagagugagauauaagauc

SEQ ID NO: 327296 - RNA, 22 nt, Homo sapiens
caucauugcacccuauagagaa

SEQ ID NO: 327297 - RNA, 23 nt, Homo sapiens
caugaacuaguuugcagccauga

SEQ ID NO: 327298 - RNA, 22 nt, Homo sapiens
caugauauugcagaauguuggu

SEQ ID NO: 327299 - RNA, 22 nt, Homo sapiens
caugcagcacacaugucugugc

SEQ ID NO: 327300 - RNA, 22 nt, Homo sapiens
caugccacugcacuccaaccug

SEQ ID NO: 327301 - RNA, 22 nt, Homo sapiens
cauggagcuaggcuugaucccu

SEQ ID NO: 327302 - RNA, 22 nt, Homo sapiens
cauggauuuuuuugaauggcag

SEQ ID NO: 327303 - RNA, 22 nt, Homo sapiens
cauggcacagagaauguguucu

SEQ ID NO: 327304 - RNA, 22 nt, Homo sapiens
cauggcacauauauaucuaggu

SEQ ID NO: 327305 - RNA, 22 nt, Homo sapiens
cauggcacuggugggagugucu

SEQ ID NO: 327306 - RNA, 22 nt, Homo sapiens
cauggcaucuguguggccucca

SEQ ID NO: 327307 - RNA, 22 nt, Homo sapiens
gucagaaucucagaugacaacg

SEQ ID NO: 327308 - RNA, 22 nt, Homo sapiens
gucaggugcuuacgcggagauc

SEQ ID NO: 327309 - RNA, 22 nt, Homo sapiens
gucaguggagaaaaggacaugu

SEQ ID NO: 327310 - RNA, 22 nt, Homo sapiens
gucaguucuugugguugcauuc

SEQ ID NO: 327311 - RNA, 21 nt, Homo sapiens
gucauaugucucugauuagug

SEQ ID NO: 327312 - RNA, 22 nt, Homo sapiens
gucauggaggaugaauggccaa

SEQ ID NO: 327313 - RNA, 22 nt, Homo sapiens
gucauguuuaacuucuugagga

SEQ ID NO: 327314 - RNA, 22 nt, Homo sapiens
gucauugaaguggaaucaucca

SEQ ID NO: 327315 - RNA, 21 nt, Homo sapiens
guccaaaacaguguccaaugc

SEQ ID NO: 327316 - RNA, 22 nt, Homo sapiens
guccaagacuaggaguuggcag

SEQ ID NO: 327317 - RNA, 22 nt, Homo sapiens
guccagagaagucauuacuuca

SEQ ID NO: 327318 - RNA, 22 nt, Homo sapiens
guccaguacucuuuccugaaaa

SEQ ID NO: 327319 - RNA, 22 nt, Homo sapiens
gucccagagauauugugucuuu

SEQ ID NO: 327320 - RNA, 22 nt, Homo sapiens
guccugaagaccuuccucugga

SEQ ID NO: 327321 - RNA, 22 nt, Homo sapiens
guccuggagaagcguggaccgg

SEQ ID NO: 327322 - RNA, 22 nt, Homo sapiens
gucucccagccuacauauuucu

SEQ ID NO: 327323 - RNA, 22 nt, Homo sapiens
gucucccagccuacaucuuucu

SEQ ID NO: 327324 - RNA, 22 nt, Homo sapiens
gucuggcuccugucuaaucacu

SEQ ID NO: 327325 - RNA, 21 nt, Homo sapiens
gucugguguuuuaaugaggac

SEQ ID NO: 327326 - RNA, 22 nt, Homo sapiens
gucugguuccugggagauuucu

SEQ ID NO: 327327 - RNA, 22 nt, Homo sapiens
gucugguugacagcauguggcc

SEQ ID NO: 327328 - RNA, 22 nt, Homo sapiens
gucugguuuuuuauauccucac

SEQ ID NO: 327329 - RNA, 20 nt, Homo sapiens
gucugucuccgaguagaauu

SEQ ID NO: 327330 - RNA, 22 nt, Homo sapiens
gucugucuuuugucuuugaaau

SEQ ID NO: 327331 - RNA, 22 nt, Homo sapiens
gucuuccagccuccaucuuucu

SEQ ID NO: 327332 - RNA, 22 nt, Homo sapiens
gucuugcacuuaccuaagaacu

SEQ ID NO: 327333 - RNA, 22 nt, Homo sapiens
gucuuggagaacucagcuuggc

SEQ ID NO: 327334 - RNA, 22 nt, Homo sapiens
gucuuggcaugugcagcuggga

SEQ ID NO: 327335 - RNA, 20 nt, Homo sapiens
gucuuguagcucaaguuauu

SEQ ID NO: 327336 - RNA, 22 nt, Homo sapiens
gucuuugagauaggguuauuuu

SEQ ID NO: 327337 - RNA, 22 nt, Homo sapiens
gucuuuguuauuaugaaucaac

SEQ ID NO: 327338 - RNA, 22 nt, Homo sapiens
gugaauugagagaacuguguua

SEQ ID NO: 327339 - RNA, 22 nt, Homo sapiens
gugaccaaagauagcucaaguu

SEQ ID NO: 327340 - RNA, 22 nt, Homo sapiens
gugaccucuguugcugucacua

SEQ ID NO: 327341 - RNA, 22 nt, Homo sapiens
gugacugcauccauccaggcuu

SEQ ID NO: 327342 - RNA, 20 nt, Homo sapiens
gugagaacaugugguauuug

SEQ ID NO: 327343 - RNA, 18 nt, Homo sapiens
gugagaaugacuguucug

SEQ ID NO: 327344 - RNA, 22 nt, Homo sapiens
gugagaccaauguacuaccuuc

SEQ ID NO: 327345 - RNA, 22 nt, Homo sapiens
gugagacugguccugaacccag

SEQ ID NO: 327346 - RNA, 22 nt, Homo sapiens
gugagagaaugacuauguguuu

SEQ ID NO: 327347 - RNA, 22 nt, Homo sapiens
gugagauacuagagauauagug

SEQ ID NO: 327348 - RNA, 22 nt, Homo sapiens
gugagauaucuagacuagggaa

SEQ ID NO: 327349 - RNA, 22 nt, Homo sapiens
gugagauccucucuuauauggg

SEQ ID NO: 327350 - RNA, 22 nt, Homo sapiens
gugagauggagucuugcuuugu

SEQ ID NO: 327351 - RNA, 22 nt, Homo sapiens
gugagcaauugauacuugaagu

SEQ ID NO: 327352 - RNA, 22 nt, Homo sapiens
gugagcaguguccuugggggca

SEQ ID NO: 327353 - RNA, 22 nt, Homo sapiens
gugaggcuuuuccuguuagacu

SEQ ID NO: 327354 - RNA, 22 nt, Homo sapiens
gugagguugaaaauaauggaaa

SEQ ID NO: 327355 - RNA, 22 nt, Homo sapiens
gugaguaaagguucauugaauu

SEQ ID NO: 327356 - RNA, 22 nt, Homo sapiens
gugaguggacgugaccaauaaa

SEQ ID NO: 327357 - RNA, 22 nt, Homo sapiens
gugauauguuaggaucuaaguc

SEQ ID NO: 327358 - RNA, 22 nt, Homo sapiens
gugaucauuguauugggguuau

SEQ ID NO: 327359 - RNA, 22 nt, Homo sapiens
gugaucucagcucacuggaacc

SEQ ID NO: 327360 - RNA, 22 nt, Homo sapiens
gugaugcaguacguagaggaga

SEQ ID NO: 327361 - RNA, 20 nt, Homo sapiens
gugauuggucacugguuguu

SEQ ID NO: 327362 - RNA, 22 nt, Homo sapiens
gugauuuaguagaugcuaguua

SEQ ID NO: 327363 - RNA, 22 nt, Homo sapiens
gugcaaauuccagcucaacucc

SEQ ID NO: 327364 - RNA, 22 nt, Homo sapiens
gugcaaguguaauacagcuagg

SEQ ID NO: 327365 - RNA, 22 nt, Homo sapiens
gugcaauucacuguuaugucug

SEQ ID NO: 327366 - RNA, 22 nt, Homo sapiens
gugcacaacgugcagguuaguu

SEQ ID NO: 327367 - RNA, 22 nt, Homo sapiens
gugcacaaucgugcauuccuug

SEQ ID NO: 327368 - RNA, 22 nt, Homo sapiens
gugcacauauggugcauaagug

SEQ ID NO: 327369 - RNA, 22 nt, Homo sapiens
gugcacauuguuuaugucuguu

SEQ ID NO: 327370 - RNA, 22 nt, Homo sapiens
gugcaguuuacaguuacccagu

SEQ ID NO: 327371 - RNA, 18 nt, Homo sapiens
gugcauagccauggcagc

SEQ ID NO: 327372 - RNA, 22 nt, Homo sapiens
gugcaugucuaugcgagucuaa

SEQ ID NO: 327373 - RNA, 22 nt, Homo sapiens
gugcuaggugcuaggaagauag

SEQ ID NO: 327374 - RNA, 22 nt, Homo sapiens
guggaaaaguaguugcgguuuu

SEQ ID NO: 327375 - RNA, 22 nt, Homo sapiens
guggaaagaacacaaaauuagg

SEQ ID NO: 327376 - RNA, 21 nt, Homo sapiens
guggaaauggaauuuacuaau

SEQ ID NO: 327377 - RNA, 22 nt, Homo sapiens
guggaagaaaucagguuauuug

SEQ ID NO: 327378 - RNA, 20 nt, Homo sapiens
guggaaguagaaacauaugu

SEQ ID NO: 327379 - RNA, 22 nt, Homo sapiens
guggaauacuaugaugguggau

SEQ ID NO: 327380 - RNA, 22 nt, Homo sapiens
guggaaucuagagaggcaguag

SEQ ID NO: 327381 - RNA, 22 nt, Homo sapiens
guggagacaaaggcugagugag

SEQ ID NO: 327382 - RNA, 22 nt, Homo sapiens
guggcaaggaaaugcugcucac

SEQ ID NO: 327383 - RNA, 22 nt, Homo sapiens
guggcagaaaagagaagcaaug

SEQ ID NO: 327384 - RNA, 22 nt, Homo sapiens
gugggaugaucgcuugagccca

SEQ ID NO: 327385 - RNA, 22 nt, Homo sapiens
gugggguaggaggaguacuucc

SEQ ID NO: 327386 - RNA, 22 nt, Homo sapiens
guggggucaucucauuugugga

SEQ ID NO: 327387 - RNA, 22 nt, Homo sapiens
gugguacuaucuuugguuucag

SEQ ID NO: 327388 - RNA, 22 nt, Homo sapiens
gugguuuuaauauucagucuag

SEQ ID NO: 327389 - RNA, 22 nt, Homo sapiens
gugguuuucaacuccaccugca

SEQ ID NO: 327390 - RNA, 20 nt, Homo sapiens
guguaagagcaagcuuccua

SEQ ID NO: 327391 - RNA, 22 nt, Homo sapiens
guguauguuucucccugucccu

SEQ ID NO: 327392 - RNA, 22 nt, Homo sapiens
guguauucaucuggcugaggua

SEQ ID NO: 327393 - RNA, 22 nt, Homo sapiens
gugucacagcuuccaucucggu

SEQ ID NO: 327394 - RNA, 22 nt, Homo sapiens
gugucacuguauaauauuuauu

SEQ ID NO: 327395 - RNA, 22 nt, Homo sapiens
gugucaguggggagugaucuuc

SEQ ID NO: 327396 - RNA, 22 nt, Homo sapiens
gugucaugaagguuuuaugcag

SEQ ID NO: 327397 - RNA, 22 nt, Homo sapiens
gugucuccuguggagcuaugua

SEQ ID NO: 327398 - RNA, 22 nt, Homo sapiens
gugugcaaauguguaccuacau

SEQ ID NO: 327399 - RNA, 22 nt, Homo sapiens
uuuuugugguauauugcaacaa

SEQ ID NO: 327400 - RNA, 23 nt, Homo sapiens
uuuuuguguuucauggaaauagg

SEQ ID NO: 327401 - RNA, 22 nt, Homo sapiens
ugucuuugguucaggcaaggag

SEQ ID NO: 327402 - RNA, 21 nt, Homo sapiens
ugugaaaucuaggcagagguu

SEQ ID NO: 327403 - RNA, 22 nt, Homo sapiens
ugugaacagaauuagucaccua

SEQ ID NO: 327404 - RNA, 22 nt, Homo sapiens
ugugaagaaagucauugguagc

SEQ ID NO: 327405 - RNA, 19 nt, Homo sapiens
ugugaagaaaugcugcaag

SEQ ID NO: 327406 - RNA, 17 nt, Homo sapiens
ugugacccugggcuacc

SEQ ID NO: 327407 - RNA, 21 nt, Homo sapiens
ugugaccucugucucugaguc

SEQ ID NO: 327408 - RNA, 19 nt, Homo sapiens
ugugacugggccagccuag

SEQ ID NO: 327409 - RNA, 22 nt, Homo sapiens
ugugacugguugucccgcuuuc

SEQ ID NO: 327410 - RNA, 22 nt, Homo sapiens
ugugagaucucagaauugaacu

SEQ ID NO: 327411 - RNA, 22 nt, Homo sapiens
ugugauagagaaugguggagaa

SEQ ID NO: 327412 - RNA, 17 nt, Homo sapiens
ugugaucaucacccuug

SEQ ID NO: 327413 - RNA, 22 nt, Homo sapiens
ugugaugaaggcauagggaugu

SEQ ID NO: 327414 - RNA, 22 nt, Homo sapiens
ugugaugcagggccugggccuc

SEQ ID NO: 327415 - RNA, 22 nt, Homo sapiens
ugugauggaguuucauggacug

SEQ ID NO: 327416 - RNA, 22 nt, Homo sapiens
ugugaugguuuagcauuuucuu

SEQ ID NO: 327417 - RNA, 22 nt, Homo sapiens
ugugcacaacgugcagguuugu

SEQ ID NO: 327418 - RNA, 22 nt, Homo sapiens
ugugcacaaugugcagguuuga

SEQ ID NO: 327419 - RNA, 22 nt, Homo sapiens
ugugcacauaacauuuuuuuag

SEQ ID NO: 327420 - RNA, 22 nt, Homo sapiens
ugugcacauugugcagguugau

SEQ ID NO: 327421 - RNA, 22 nt, Homo sapiens
ugugcaccucuucacacaggga

SEQ ID NO: 327422 - RNA, 22 nt, Homo sapiens
ugugcaguuuugagugaauuuc

SEQ ID NO: 327423 - RNA, 22 nt, Homo sapiens
ugugcaugaaauuuaccuuuaa

SEQ ID NO: 327424 - RNA, 22 nt, Homo sapiens
ugugccacugcacuccugccug

SEQ ID NO: 327425 - RNA, 22 nt, Homo sapiens
ugugccugagguuaacauuguu

SEQ ID NO: 327426 - RNA, 22 nt, Homo sapiens
ugugcguguaagagaucuaggu

SEQ ID NO: 327427 - RNA, 22 nt, Homo sapiens
ugugcugaucgggcacgguguc

SEQ ID NO: 327428 - RNA, 22 nt, Homo sapiens
uguggcaaagucuugugaauau

SEQ ID NO: 327429 - RNA, 22 nt, Homo sapiens
uguggcacuguguccagagaaa

SEQ ID NO: 327430 - RNA, 22 nt, Homo sapiens
uguggccccuagcuacuagaga

SEQ ID NO: 327431 - RNA, 22 nt, Homo sapiens
uguggcucuucuguucuccacu

SEQ ID NO: 327432 - RNA, 22 nt, Homo sapiens
uguggcuuuguaaccauggguc

SEQ ID NO: 327433 - RNA, 22 nt, Homo sapiens
ugugguuuuucacauuuagaga

SEQ ID NO: 327434 - RNA, 22 nt, Homo sapiens
uguguaaauauauacacacgug

SEQ ID NO: 327435 - RNA, 22 nt, Homo sapiens
uguguaauacucuaaugaugca

SEQ ID NO: 327436 - RNA, 22 nt, Homo sapiens
ugugucacugcacuccagcgug

SEQ ID NO: 327437 - RNA, 22 nt, Homo sapiens
ugugucuugaauuuuguaugua

SEQ ID NO: 327438 - RNA, 22 nt, Homo sapiens
ugugucuuguuuauagcuuucu

SEQ ID NO: 327439 - RNA, 22 nt, Homo sapiens
ugugucuuguuuuuucccaggc

SEQ ID NO: 327440 - RNA, 22 nt, Homo sapiens
uguguuugauaaguccauaguu

SEQ ID NO: 327441 - RNA, 21 nt, Homo sapiens
uguuaacaugcagauuacugg

SEQ ID NO: 327442 - RNA, 22 nt, Homo sapiens
uguuacacugugcacuaaauuu

SEQ ID NO: 327443 - RNA, 22 nt, Homo sapiens
uguuacagcagaauugaaagag

SEQ ID NO: 327444 - RNA, 22 nt, Homo sapiens
uguuacagcagcacaaaaugga

SEQ ID NO: 327445 - RNA, 22 nt, Homo sapiens
uguuacagugacuaauguuuua

SEQ ID NO: 327446 - RNA, 22 nt, Homo sapiens
uguuagguuggugcaaaaguga

SEQ ID NO: 327447 - RNA, 22 nt, Homo sapiens
uguuaugaagaugccugguaca

SEQ ID NO: 327448 - RNA, 22 nt, Homo sapiens
uguucuugaguugggaguacaa

SEQ ID NO: 327449 - RNA, 20 nt, Homo sapiens
uguugcacucuagccugggu

SEQ ID NO: 327450 - RNA, 22 nt, Homo sapiens
uguugccacuguuauuaaccua

SEQ ID NO: 327451 - RNA, 22 nt, Homo sapiens
uguugcuuaagccacccagucu

SEQ ID NO: 327452 - RNA, 22 nt, Homo sapiens
uguuuguuugauaugggauaaa

SEQ ID NO: 327453 - RNA, 22 nt, Homo sapiens
uuaaaggcauguacacuagagu

SEQ ID NO: 327454 - RNA, 22 nt, Homo sapiens
uuaaaguauaguuccucugguu

SEQ ID NO: 327455 - RNA, 22 nt, Homo sapiens
uuaaaguguuuucaaaauguca

SEQ ID NO: 327456 - RNA, 20 nt, Homo sapiens
uuaaaucuagugcagacuca

SEQ ID NO: 327457 - RNA, 22 nt, Homo sapiens
uuaaaugcacauacuugagaaa

SEQ ID NO: 327458 - RNA, 22 nt, Homo sapiens
uuaacagugucaaucuguagua

SEQ ID NO: 327459 - RNA, 22 nt, Homo sapiens
uuaacaguugcaugagacugag

SEQ ID NO: 327460 - RNA, 22 nt, Homo sapiens
uuaagagcauggugccagguug

SEQ ID NO: 327461 - RNA, 22 nt, Homo sapiens
uuaagcaaagguaacaugagaa

SEQ ID NO: 327462 - RNA, 22 nt, Homo sapiens
uuaagcaguaguuaaggagagg

SEQ ID NO: 327463 - RNA, 22 nt, Homo sapiens
uuaagcaguggauuagaauuuu

SEQ ID NO: 327464 - RNA, 22 nt, Homo sapiens
uuaaggaaagcauuuaauucag

SEQ ID NO: 327465 - RNA, 18 nt, Homo sapiens
uuaaggcaggacuuuaag

SEQ ID NO: 327466 - RNA, 22 nt, Homo sapiens
uuaaggguuuuagaauuuucca

SEQ ID NO: 327467 - RNA, 22 nt, Homo sapiens
uuaagguaugugggcauuuugu

SEQ ID NO: 327468 - RNA, 22 nt, Homo sapiens
uuaaggugaaguucucagaugc

SEQ ID NO: 327469 - RNA, 22 nt, Homo sapiens
uuaaguagaugaaugugaaugu

SEQ ID NO: 327470 - RNA, 19 nt, Homo sapiens
uuaaguaguuagagggucu

SEQ ID NO: 327471 - RNA, 22 nt, Homo sapiens
uuaagucacacuagacaacuga

SEQ ID NO: 327472 - RNA, 22 nt, Homo sapiens
uuaagugaauuaucuaacaugu

SEQ ID NO: 327473 - RNA, 22 nt, Homo sapiens
uuaaucacagugucuuccuuca

SEQ ID NO: 327474 - RNA, 22 nt, Homo sapiens
uuaaucugucuaugauuuuggu

SEQ ID NO: 327475 - RNA, 22 nt, Homo sapiens
uuaaugcuuuugggauauuucu

SEQ ID NO: 327476 - RNA, 22 nt, Homo sapiens
uuaauguaauugauugauugac

SEQ ID NO: 327477 - RNA, 22 nt, Homo sapiens
uuaaugugaaucaggaugcauu

SEQ ID NO: 327478 - RNA, 22 nt, Homo sapiens
uuacacaguaggucccuaguaa

SEQ ID NO: 327479 - RNA, 22 nt, Homo sapiens
uuacaccuguaauccagcacuu

SEQ ID NO: 327480 - RNA, 22 nt, Homo sapiens
uuacagcagugccccacuccca

SEQ ID NO: 327481 - RNA, 22 nt, Homo sapiens
uuacagcugggugugucuggua

SEQ ID NO: 327482 - RNA, 22 nt, Homo sapiens
uuacaguagaugaggguauaau

SEQ ID NO: 327483 - RNA, 22 nt, Homo sapiens
uuguucccuucuggcuuuuaug

SEQ ID NO: 327484 - RNA, 22 nt, Homo sapiens
uuguuuuggagaugagcuaaaa

SEQ ID NO: 327485 - RNA, 22 nt, Homo sapiens
uuuaaagcuaaaauauguuuau

SEQ ID NO: 327486 - RNA, 22 nt, Homo sapiens
uuuacugucuucagucccucug

SEQ ID NO: 327487 - RNA, 21 nt, Homo sapiens
uuuacuguggacccauugcuu

SEQ ID NO: 327488 - RNA, 22 nt, Homo sapiens
uuuacugugggguuucuuagag

SEQ ID NO: 327489 - RNA, 22 nt, Homo sapiens
uuuagcaauggagggugacuuu

SEQ ID NO: 327490 - RNA, 22 nt, Homo sapiens
uuuagcucauucaauuucaguc

SEQ ID NO: 327491 - RNA, 21 nt, Homo sapiens
uuuagguagcuuuucugggag

SEQ ID NO: 327492 - RNA, 22 nt, Homo sapiens
uuuagguauuugguauagcagu

SEQ ID NO: 327493 - RNA, 22 nt, Homo sapiens
uuuagguuacauauaauccaaa

SEQ ID NO: 327494 - RNA, 22 nt, Homo sapiens
uuuauggagagauauuuauggu

SEQ ID NO: 327495 - RNA, 22 nt, Homo sapiens
uuuauguggagcacuugacaca

SEQ ID NO: 327496 - RNA, 18 nt, Homo sapiens
uuucaagucuuaggugac

SEQ ID NO: 327497 - RNA, 23 nt, Homo sapiens
uuucacagaaggauuguagggcc

SEQ ID NO: 327498 - RNA, 22 nt, Homo sapiens
uuucacagagggcuucuuucua

SEQ ID NO: 327499 - RNA, 22 nt, Homo sapiens
uuucaggcagggagcuucagug

SEQ ID NO: 327500 - RNA, 22 nt, Homo sapiens
uuucaucagccagggucagucu

SEQ ID NO: 327501 - RNA, 22 nt, Homo sapiens
uuucauggcgaggcuucauggg

SEQ ID NO: 327502 - RNA, 23 nt, Homo sapiens
uuucauggggauuuacucauucc

SEQ ID NO: 327503 - RNA, 19 nt, Homo sapiens
uuucauguuuuuggugaga

SEQ ID NO: 327504 - RNA, 22 nt, Homo sapiens
uuuccacauggacuuaccuucg

SEQ ID NO: 327505 - RNA, 19 nt, Homo sapiens
uuuccaguaaucuuaugug

SEQ ID NO: 327506 - RNA, 22 nt, Homo sapiens
uuuccaguuggaagaaggggga

SEQ ID NO: 327507 - RNA, 22 nt, Homo sapiens
uuuccaguuguucuagaaagcu

SEQ ID NO: 327508 - RNA, 19 nt, Homo sapiens
uuucccugcagaccuacua

SEQ ID NO: 327509 - RNA, 22 nt, Homo sapiens
uuucccuuacuuaaacuuacuc

SEQ ID NO: 327510 - RNA, 22 nt, Homo sapiens
uuuccuggagaaucuuaacaaa

SEQ ID NO: 327511 - RNA, 22 nt, Homo sapiens
uuucuacagugaacgauuucua

SEQ ID NO: 327512 - RNA, 22 nt, Homo sapiens
uuucucaguguuucaggguagg

SEQ ID NO: 327513 - RNA, 22 nt, Homo sapiens
uuucugaggccucaccagaagc

SEQ ID NO: 327514 - RNA, 22 nt, Homo sapiens
uuugaagcuaaggugcuugguu

SEQ ID NO: 327515 - RNA, 22 nt, Homo sapiens
uuugaagugugaugccuugaug

SEQ ID NO: 327516 - RNA, 22 nt, Homo sapiens
uuugacuagaguguuuuacaac

SEQ ID NO: 327517 - RNA, 22 nt, Homo sapiens
uuugagaaugcuaccagagaag

SEQ ID NO: 327518 - RNA, 22 nt, Homo sapiens
uuugagauaucuuccaucagua

SEQ ID NO: 327519 - RNA, 22 nt, Homo sapiens
uuugagaucuuuagaaucaggc

SEQ ID NO: 327520 - RNA, 22 nt, Homo sapiens
uuugagcauggaaauggcauga

SEQ ID NO: 327521 - RNA, 22 nt, Homo sapiens
uuugaguaggcuuauauuuugg

SEQ ID NO: 327522 - RNA, 22 nt, Homo sapiens
uuugauacuggguguggacaaa

SEQ ID NO: 327523 - RNA, 22 nt, Homo sapiens
uuugauugguguaccugaaagu

SEQ ID NO: 327524 - RNA, 22 nt, Homo sapiens
uuugcaagaugaaaaaguucua

SEQ ID NO: 327525 - RNA, 22 nt, Homo sapiens
uuugcaauguugugauggugaa

SEQ ID NO: 327526 - RNA, 22 nt, Homo sapiens
uuugcaccuuccuaguggcuga

SEQ ID NO: 327527 - RNA, 22 nt, Homo sapiens
uuugcacucaguaagugggagc

SEQ ID NO: 327528 - RNA, 20 nt, Homo sapiens
uuugcagaaucuaagaagag

SEQ ID NO: 327529 - RNA, 22 nt, Homo sapiens
uuugcagugucagcuucugugu

SEQ ID NO: 327530 - RNA, 19 nt, Homo sapiens
uuugcauagugagaauaua

SEQ ID NO: 327531 - RNA, 22 nt, Homo sapiens
uuugccaauauuuuacugagga

SEQ ID NO: 327532 - RNA, 22 nt, Homo sapiens
uuugccaauauuuuauugagga

SEQ ID NO: 327533 - RNA, 22 nt, Homo sapiens
uuugccaaucagaggcaucuug

SEQ ID NO: 327534 - RNA, 23 nt, Homo sapiens
uuugccacuuauuagcugggagg

SEQ ID NO: 327535 - RNA, 22 nt, Homo sapiens
uuugccuuugugauauggucua

SEQ ID NO: 327536 - RNA, 22 nt, Homo sapiens
uuugcugagucugacuucaugg

SEQ ID NO: 327537 - RNA, 22 nt, Homo sapiens
uuuggaagaugccacuguauca

SEQ ID NO: 327538 - RNA, 22 nt, Homo sapiens
uuuggauagugugguccuuuua

SEQ ID NO: 327539 - RNA, 22 nt, Homo sapiens
uuuggcauauuuuaagcugguu

SEQ ID NO: 327540 - RNA, 22 nt, Homo sapiens
uuuggcuauguuguaucuuucc

SEQ ID NO: 327541 - RNA, 22 nt, Homo sapiens
uuuggcuuaagauugacugcaa

SEQ ID NO: 327542 - RNA, 22 nt, Homo sapiens
uuuggcuuuuguaauaacugcc

SEQ ID NO: 327543 - RNA, 22 nt, Homo sapiens
uuuggcuuuugugauacguaau

SEQ ID NO: 327544 - RNA, 22 nt, Homo sapiens
uuugggccauggcuuuuccacg

SEQ ID NO: 327545 - RNA, 22 nt, Homo sapiens
uuugggccucugauuucuuugg

SEQ ID NO: 327546 - RNA, 22 nt, Homo sapiens
uuuggucagcugcgggucagcu

SEQ ID NO: 327547 - RNA, 22 nt, Homo sapiens
uuugguccaguguucagguccu

SEQ ID NO: 327548 - RNA, 22 nt, Homo sapiens
uuugguuauauauauacacucu

SEQ ID NO: 327549 - RNA, 22 nt, Homo sapiens
uuugguuauuugaaacuagcau

SEQ ID NO: 327550 - RNA, 22 nt, Homo sapiens
uuugguugccucuaugagccug

SEQ ID NO: 327551 - RNA, 22 nt, Homo sapiens
uuuguaagaugcauagauugca

SEQ ID NO: 327552 - RNA, 23 nt, Homo sapiens
uuuguacuaugucaguuuagaua

SEQ ID NO: 327553 - RNA, 22 nt, Homo sapiens
uuuguauguuggagauuggaga

SEQ ID NO: 327554 - RNA, 21 nt, Homo sapiens
uuuguccaccuguguucacca

SEQ ID NO: 327555 - RNA, 22 nt, Homo sapiens
uuugugcuccuaugagaaucua

SEQ ID NO: 327556 - RNA, 22 nt, Homo sapiens
uuugugcuccugugagaaucua

SEQ ID NO: 327557 - RNA, 22 nt, Homo sapiens
uuugugcugcaauuaauuuccc

SEQ ID NO: 327558 - RNA, 22 nt, Homo sapiens
uuuguggaaugcccuuauuuau

SEQ ID NO: 327559 - RNA, 22 nt, Homo sapiens
uuuguguccccacccaaaucuc

SEQ ID NO: 327560 - RNA, 22 nt, Homo sapiens
uuuguucuucguuccugagcca

SEQ ID NO: 327561 - RNA, 20 nt, Homo sapiens
uuuuagcacuuguuauggug

SEQ ID NO: 327562 - RNA, 22 nt, Homo sapiens
uuuuagcuuuucccaggacucc

SEQ ID NO: 327563 - RNA, 22 nt, Homo sapiens
uuuuaugggcuauuugcauuag

SEQ ID NO: 327564 - RNA, 22 nt, Homo sapiens
uuuuauguuuguucccugccaa

SEQ ID NO: 327565 - RNA, 22 nt, Homo sapiens
ucaugggagcccccaucaugag

SEQ ID NO: 327566 - RNA, 22 nt, Homo sapiens
ucauggggugcuuugcuagauu

SEQ ID NO: 327567 - RNA, 23 nt, Homo sapiens
ucaugguagcaccaacaauaacu

SEQ ID NO: 327568 - RNA, 22 nt, Homo sapiens
ucauguaauuuugugucuauga

SEQ ID NO: 327569 - RNA, 22 nt, Homo sapiens
ucaugugagcaaguugggcuca

SEQ ID NO: 327570 - RNA, 22 nt, Homo sapiens
ucaugugagcacagagcaagau

SEQ ID NO: 327571 - RNA, 22 nt, Homo sapiens
ucauuagagacagggugucacu

SEQ ID NO: 327572 - RNA, 22 nt, Homo sapiens
ucauuagucaccuagccagcuu

SEQ ID NO: 327573 - RNA, 22 nt, Homo sapiens
ucauucauucuucaguggguac

SEQ ID NO: 327574 - RNA, 22 nt, Homo sapiens
ucauucauuugcucacuccaca

SEQ ID NO: 327575 - RNA, 22 nt, Homo sapiens
ucauucuuucuguggaggggcu

SEQ ID NO: 327576 - RNA, 22 nt, Homo sapiens
ucauugcacucccagacacccu

SEQ ID NO: 327577 - RNA, 22 nt, Homo sapiens
ucauuggcuaagcuuguuacac

SEQ ID NO: 327578 - RNA, 21 nt, Homo sapiens
ucauugggugcagcccacccu

SEQ ID NO: 327579 - RNA, 22 nt, Homo sapiens
ucauugguagcuugaaggggau

SEQ ID NO: 327580 - RNA, 22 nt, Homo sapiens
ucauugguucuggguguuguug

SEQ ID NO: 327581 - RNA, 22 nt, Homo sapiens
ucauugguugcguaauuugauu

SEQ ID NO: 327582 - RNA, 22 nt, Homo sapiens
uccacagugguggaauuguuca

SEQ ID NO: 327583 - RNA, 22 nt, Homo sapiens
uccacagugguugaacuaguaa

SEQ ID NO: 327584 - RNA, 22 nt, Homo sapiens
uccacagugguugaacuaguuu

SEQ ID NO: 327585 - RNA, 19 nt, Homo sapiens
uccaccgcgugcaccucua

SEQ ID NO: 327586 - RNA, 22 nt, Homo sapiens
uccacguggucuaucuguccuu

SEQ ID NO: 327587 - RNA, 22 nt, Homo sapiens
uccacuuuugugcugaauugga

SEQ ID NO: 327588 - RNA, 21 nt, Homo sapiens
uccagcuuugagaguuguggu

SEQ ID NO: 327589 - RNA, 22 nt, Homo sapiens
uccagguuucaugcucuuuauu

SEQ ID NO: 327590 - RNA, 22 nt, Homo sapiens
uccagugugcaggcaaguuuga

SEQ ID NO: 327591 - RNA, 22 nt, Homo sapiens
uccaguuguuauuuuuauaaag

SEQ ID NO: 327592 - RNA, 18 nt, Homo sapiens
uccaguuuucccagcauc

SEQ ID NO: 327593 - RNA, 22 nt, Homo sapiens
uccauaguugcacucuggagcc

SEQ ID NO: 327594 - RNA, 19 nt, Homo sapiens
uccaugagcccacagugau

SEQ ID NO: 327595 - RNA, 22 nt, Homo sapiens
uccaugaggcuacaguaaucuc

SEQ ID NO: 327596 - RNA, 22 nt, Homo sapiens
ucccaagaugagaugggggcug

SEQ ID NO: 327597 - RNA, 23 nt, Homo sapiens
ucccaagauggaccagaccaagg

SEQ ID NO: 327598 - RNA, 22 nt, Homo sapiens
ucccaguggucuugaaacaggg

SEQ ID NO: 327599 - RNA, 17 nt, Homo sapiens
ucccauguuucuucuac

SEQ ID NO: 327600 - RNA, 19 nt, Homo sapiens
uccccgggucuagugcagc

SEQ ID NO: 327601 - RNA, 22 nt, Homo sapiens
uccccgucacacgcaggcuuac

SEQ ID NO: 327602 - RNA, 22 nt, Homo sapiens
uccccugagucaccugcuucuc

SEQ ID NO: 327603 - RNA, 22 nt, Homo sapiens
uccccuuuguaagauggaaacg

SEQ ID NO: 327604 - RNA, 20 nt, Homo sapiens
ucccuaagagccuuuccuuc

SEQ ID NO: 327605 - RNA, 22 nt, Homo sapiens
ucccuagacuccugccuuucag

SEQ ID NO: 327606 - RNA, 22 nt, Homo sapiens
ucccugagugauugaaaauaaa

SEQ ID NO: 327607 - RNA, 22 nt, Homo sapiens
ucccuggacagccuugccuggg

SEQ ID NO: 327608 - RNA, 22 nt, Homo sapiens
ucccuguagugccuagaucaga

SEQ ID NO: 327609 - RNA, 22 nt, Homo sapiens
ucccuguguccugggggcaccu

SEQ ID NO: 327610 - RNA, 22 nt, Homo sapiens
ucccuguguuccuuuugaauug

SEQ ID NO: 327611 - RNA, 22 nt, Homo sapiens
ucccuuaaugaugaacaaugag

SEQ ID NO: 327612 - RNA, 22 nt, Homo sapiens
ucccuuuguccaacggauccac

SEQ ID NO: 327613 - RNA, 22 nt, Homo sapiens
uccucauggagaaccucugcua

SEQ ID NO: 327614 - RNA, 21 nt, Homo sapiens
uccugagagaggaguaacucu

SEQ ID NO: 327615 - RNA, 20 nt, Homo sapiens
uccugagauucccaguucuc

SEQ ID NO: 327616 - RNA, 22 nt, Homo sapiens
uccugcauucauccugguguug

SEQ ID NO: 327617 - RNA, 22 nt, Homo sapiens
uuggcaaguuucugucagcaaa

SEQ ID NO: 327618 - RNA, 22 nt, Homo sapiens
uuggcauuuauucuaaggucaa

SEQ ID NO: 327619 - RNA, 22 nt, Homo sapiens
uuggcauuuuuagucaugggaa

SEQ ID NO: 327620 - RNA, 22 nt, Homo sapiens
uuggccauaugacuugcuuugg

SEQ ID NO: 327621 - RNA, 23 nt, Homo sapiens
uuggccuccuugugucuagggcu

SEQ ID NO: 327622 - RNA, 22 nt, Homo sapiens
uuggcuacagauuaugaauuuc

SEQ ID NO: 327623 - RNA, 22 nt, Homo sapiens
uuggcuuggagaguugaaaugu

SEQ ID NO: 327624 - RNA, 22 nt, Homo sapiens
uugggauaaucacaaaguaaaa

SEQ ID NO: 327625 - RNA, 17 nt, Homo sapiens
uugggcaagguagguga

SEQ ID NO: 327626 - RNA, 22 nt, Homo sapiens
uugggcauugcuauaaauucuu

SEQ ID NO: 327627 - RNA, 22 nt, Homo sapiens
uuggggcacggccucuguugcc

SEQ ID NO: 327628 - RNA, 22 nt, Homo sapiens
uugguaaucccuagugucuaga

SEQ ID NO: 327629 - RNA, 22 nt, Homo sapiens
uugguauguaauuuauauugua

SEQ ID NO: 327630 - RNA, 22 nt, Homo sapiens
uuggucaaaucugaugggagaa

SEQ ID NO: 327631 - RNA, 21 nt, Homo sapiens
uugguccacaugucauaguua

SEQ ID NO: 327632 - RNA, 22 nt, Homo sapiens
uuggucugcucugauguuuucu

SEQ ID NO: 327633 - RNA, 22 nt, Homo sapiens
uuggucuucuaauguaccuguu

SEQ ID NO: 327634 - RNA, 21 nt, Homo sapiens
uuggucuucucugugauucuu

SEQ ID NO: 327635 - RNA, 22 nt, Homo sapiens
uugguucaguuuaacgaguaau

SEQ ID NO: 327636 - RNA, 22 nt, Homo sapiens
uugguuuccuuccugcuuaacu

SEQ ID NO: 327637 - RNA, 22 nt, Homo sapiens
uuguaacaguucugcgagcagc

SEQ ID NO: 327638 - RNA, 22 nt, Homo sapiens
uuguaacaugcuuucacuucag

SEQ ID NO: 327639 - RNA, 22 nt, Homo sapiens
uuguacuagaaaauuauucuuu

SEQ ID NO: 327640 - RNA, 22 nt, Homo sapiens
uuguacuucagacaugccaaag

SEQ ID NO: 327641 - RNA, 22 nt, Homo sapiens
uuguagcaaauguguaaacaaa

SEQ ID NO: 327642 - RNA, 22 nt, Homo sapiens
uuguauaggcucaguaagaauc

SEQ ID NO: 327643 - RNA, 22 nt, Homo sapiens
uuguauaguucuauguguuuug

SEQ ID NO: 327644 - RNA, 22 nt, Homo sapiens
uuguauguuucugugcacauga

SEQ ID NO: 327645 - RNA, 22 nt, Homo sapiens
uugucaguguucacucaaagcu

SEQ ID NO: 327646 - RNA, 22 nt, Homo sapiens
uuguccccacccaaaugucauc

SEQ ID NO: 327647 - RNA, 22 nt, Homo sapiens
uuguccuccacauuugaucagu

SEQ ID NO: 327648 - RNA, 22 nt, Homo sapiens
uugucucacuggaguuuaguaa

SEQ ID NO: 327649 - RNA, 19 nt, Homo sapiens
uugucuuagaguugucauu

SEQ ID NO: 327650 - RNA, 22 nt, Homo sapiens
uugugaaaaaccucucguggaa

SEQ ID NO: 327651 - RNA, 22 nt, Homo sapiens
uugugaaaucuaggcagagguu

SEQ ID NO: 327652 - RNA, 22 nt, Homo sapiens
uugugaagaugugaagcaagca

SEQ ID NO: 327653 - RNA, 22 nt, Homo sapiens
uugugaauggugccacaauaaa

SEQ ID NO: 327654 - RNA, 22 nt, Homo sapiens
uugugacacagcugggccuaua

SEQ ID NO: 327655 - RNA, 22 nt, Homo sapiens
uugugaguggugccgcaauaaa

SEQ ID NO: 327656 - RNA, 22 nt, Homo sapiens
uugugcaaaguugugguuucug

SEQ ID NO: 327657 - RNA, 22 nt, Homo sapiens
uugugccacugaagcccuccag

SEQ ID NO: 327658 - RNA, 22 nt, Homo sapiens
uugugcuccagagacgggcucg

SEQ ID NO: 327659 - RNA, 22 nt, Homo sapiens
uugugcuuaauaaaaaguggua

SEQ ID NO: 327660 - RNA, 22 nt, Homo sapiens
uugugcuugcuguguucuaugc

SEQ ID NO: 327661 - RNA, 22 nt, Homo sapiens
uugugguaggcauguaagauga

SEQ ID NO: 327662 - RNA, 22 nt, Homo sapiens
uugugguuauagagucucccug

SEQ ID NO: 327663 - RNA, 22 nt, Homo sapiens
uuguguacuacaguaugccaca

SEQ ID NO: 327664 - RNA, 22 nt, Homo sapiens
uugugucccugcccaaaucuca

SEQ ID NO: 327665 - RNA, 22 nt, Homo sapiens
uugugucccugcggcugaggag

SEQ ID NO: 327666 - RNA, 22 nt, Homo sapiens
uuguguuugaugcugacacgca

SEQ ID NO: 327667 - RNA, 22 nt, Homo sapiens
uuguguuuuuaguagggaaggg

SEQ ID NO: 327668 - RNA, 22 nt, Homo sapiens
uuguuaugggguggcuugaaag

SEQ ID NO: 327669 - RNA, 22 nt, Homo sapiens
uuguucaggagguuggggaugc

SEQ ID NO: 327670 - RNA, 22 nt, Homo sapiens
uuguuugguugaguauggaagu

SEQ ID NO: 327671 - RNA, 22 nt, Homo sapiens
uuuaaagcuccaagcaugucug

SEQ ID NO: 327672 - RNA, 22 nt, Homo sapiens
uuuaaguguuuguuccugaaaa

SEQ ID NO: 327673 - RNA, 22 nt, Homo sapiens
uuuaauacugcaucuuuacucu

SEQ ID NO: 327674 - RNA, 22 nt, Homo sapiens
uuuaaugcgucucugaguuuug

SEQ ID NO: 327675 - RNA, 22 nt, Homo sapiens
uuuaaugcugcccagucauggg

SEQ ID NO: 327676 - RNA, 22 nt, Homo sapiens
uuuaauguuacaguauugguau

SEQ ID NO: 327677 - RNA, 22 nt, Homo sapiens
uuuacaguuuucuaggcuacca

SEQ ID NO: 327678 - RNA, 22 nt, Homo sapiens
uuuacccugaggaaucuauuuu

SEQ ID NO: 327679 - RNA, 22 nt, Homo sapiens
uuuagcaauucauuuugugucu

SEQ ID NO: 327680 - RNA, 22 nt, Homo sapiens
uuuagcacugugauugacaaaa

SEQ ID NO: 327681 - RNA, 22 nt, Homo sapiens
uuuagguagucaaagguuaguc

SEQ ID NO: 327682 - RNA, 22 nt, Homo sapiens
uuuaguucauuaaggaaucucc

SEQ ID NO: 327683 - RNA, 22 nt, Homo sapiens
uuuaucaggccuuuggaaaaau

SEQ ID NO: 327684 - RNA, 22 nt, Homo sapiens
uuuauccagccucuagcaaggu

SEQ ID NO: 327685 - RNA, 22 nt, Homo sapiens
uuuaucuguuuaaaacuguuca

SEQ ID NO: 327686 - RNA, 22 nt, Homo sapiens
uuuaugagguagagugguuuau

SEQ ID NO: 327687 - RNA, 22 nt, Homo sapiens
uuuaugcuacauguguuggaaa

SEQ ID NO: 327688 - RNA, 22 nt, Homo sapiens
uuuauucggcuaggagcuucgg

SEQ ID NO: 327689 - RNA, 22 nt, Homo sapiens
uuucaacaggucuggggugguc

SEQ ID NO: 327690 - RNA, 19 nt, Homo sapiens
uuucaauguaaggauggag

SEQ ID NO: 327691 - RNA, 22 nt, Homo sapiens
uuucacagcaauugccuauugu

SEQ ID NO: 327692 - RNA, 22 nt, Homo sapiens
uuucacaguguucucccccaga

SEQ ID NO: 327693 - RNA, 22 nt, Homo sapiens
uuucagcguggggugcugaaga

SEQ ID NO: 327694 - RNA, 23 nt, Homo sapiens
uuucaggcaggugaaagaccagc

SEQ ID NO: 327695 - RNA, 18 nt, Homo sapiens
uuucaggguggacaugag

SEQ ID NO: 327696 - RNA, 22 nt, Homo sapiens
uuucagguauuuaagggccguu

SEQ ID NO: 327697 - RNA, 15 nt, Homo sapiens
uuucaguacagauuc

SEQ ID NO: 327698 - RNA, 22 nt, Homo sapiens
uuucaguguggcaggcauagcu

SEQ ID NO: 327699 - RNA, 22 nt, Homo sapiens
uuucauagaucaugcuuuugga

SEQ ID NO: 327700 - RNA, 22 nt, Homo sapiens
uuucauagccuucuaaugaguu

SEQ ID NO: 327701 - RNA, 22 nt, Homo sapiens
uuucauaguuugcauagggcau

SEQ ID NO: 327702 - RNA, 22 nt, Homo sapiens
uuucauccggcuguguauuaug

SEQ ID NO: 327703 - RNA, 22 nt, Homo sapiens
uuucuauguugaccagucuaga

SEQ ID NO: 327704 - RNA, 17 nt, Homo sapiens
uuucucagcccucuucu

SEQ ID NO: 327705 - RNA, 20 nt, Homo sapiens
uuucuccccuauaaaucuca

SEQ ID NO: 327706 - RNA, 22 nt, Homo sapiens
uuucugcuugagagaauugcug

SEQ ID NO: 327707 - RNA, 22 nt, Homo sapiens
uuucugguuaauuucuaagagc

SEQ ID NO: 327708 - RNA, 22 nt, Homo sapiens
uuucuuggagcucuuagggucg

SEQ ID NO: 327709 - RNA, 22 nt, Homo sapiens
ucugacaaugaacaaucuauag

SEQ ID NO: 327710 - RNA, 22 nt, Homo sapiens
ucugacagugagagaaaucuga

SEQ ID NO: 327711 - RNA, 22 nt, Homo sapiens
ucugagcaugcaucuugccugg

SEQ ID NO: 327712 - RNA, 22 nt, Homo sapiens
ucugagucaucacaaaugaugc

SEQ ID NO: 327713 - RNA, 21 nt, Homo sapiens
ucugagucauucaguggccug

SEQ ID NO: 327714 - RNA, 22 nt, Homo sapiens
ucugccuacugguuggaggaac

SEQ ID NO: 327715 - RNA, 22 nt, Homo sapiens
ucuggauuuuugaggcaauaua

SEQ ID NO: 327716 - RNA, 22 nt, Homo sapiens
ucuggcaagauauccauugcuu

SEQ ID NO: 327717 - RNA, 22 nt, Homo sapiens
ucuggcauuuucucugcuugca

SEQ ID NO: 327718 - RNA, 22 nt, Homo sapiens
ucuggccuagaacaauuaauua

SEQ ID NO: 327719 - RNA, 15 nt, Homo sapiens
ucuggcucugucacu

SEQ ID NO: 327720 - RNA, 22 nt, Homo sapiens
ucuggcuucugacuuaggggac

SEQ ID NO: 327721 - RNA, 22 nt, Homo sapiens
ucuggcuuuagcaugugggaag

SEQ ID NO: 327722 - RNA, 17 nt, Homo sapiens
ucuggcuuucacaccug

SEQ ID NO: 327723 - RNA, 22 nt, Homo sapiens
ucugggguuagucaaagguaug

SEQ ID NO: 327724 - RNA, 22 nt, Homo sapiens
ucuggguuuuguaccgugcucg

SEQ ID NO: 327725 - RNA, 22 nt, Homo sapiens
ucuggucccugcacauauuuuc

SEQ ID NO: 327726 - RNA, 22 nt, Homo sapiens
ucugucaaaucuuauguuguag

SEQ ID NO: 327727 - RNA, 22 nt, Homo sapiens
ucugugcauggcagaggaauga

SEQ ID NO: 327728 - RNA, 22 nt, Homo sapiens
ucugugcauuguaacaacuaaa

SEQ ID NO: 327729 - RNA, 22 nt, Homo sapiens
ucugugcauuuucuuuuagacu

SEQ ID NO: 327730 - RNA, 22 nt, Homo sapiens
ucugugcugagaguugaaaguu

SEQ ID NO: 327731 - RNA, 22 nt, Homo sapiens
ucugugcuugucauaugcuuug

SEQ ID NO: 327732 - RNA, 22 nt, Homo sapiens
ucuguggucagaguccuuggcc

SEQ ID NO: 327733 - RNA, 22 nt, Homo sapiens
ucugugguucaaaccagcaacu

SEQ ID NO: 327734 - RNA, 21 nt, Homo sapiens
ucuguguugaucucacuggga

SEQ ID NO: 327735 - RNA, 22 nt, Homo sapiens
ucuguguuugaucaagauugua

SEQ ID NO: 327736 - RNA, 22 nt, Homo sapiens
ucuguugguucuuugaggagga

SEQ ID NO: 327737 - RNA, 22 nt, Homo sapiens
ucuuaguuggaaugggauaagg

SEQ ID NO: 327738 - RNA, 22 nt, Homo sapiens
ucuucagucauauuggccugga

SEQ ID NO: 327739 - RNA, 22 nt, Homo sapiens
ucuucuagcggaacccucuugu

SEQ ID NO: 327740 - RNA, 22 nt, Homo sapiens
ucuugaacuucauaggucuaga

SEQ ID NO: 327741 - RNA, 22 nt, Homo sapiens
ucuugcaccuacaugcuuuguc

SEQ ID NO: 327742 - RNA, 22 nt, Homo sapiens
ucuugcuuguuguucccuucau

SEQ ID NO: 327743 - RNA, 22 nt, Homo sapiens
ucuuggguuuguccuucuccua

SEQ ID NO: 327744 - RNA, 22 nt, Homo sapiens
ucuugguaaugucacauuuccu

SEQ ID NO: 327745 - RNA, 22 nt, Homo sapiens
ucuugguuaggggaaauaggca

SEQ ID NO: 327746 - RNA, 20 nt, Homo sapiens
ucuugguuggaggucuuuua

SEQ ID NO: 327747 - RNA, 23 nt, Homo sapiens
ucuuguacuuugagugagcaugg

SEQ ID NO: 327748 - RNA, 20 nt, Homo sapiens
ucuuucgguuaccaggcagu

SEQ ID NO: 327749 - RNA, 22 nt, Homo sapiens
ucuuugauguucugaaagaugg

SEQ ID NO: 327750 - RNA, 22 nt, Homo sapiens
ucuuuggagacaaccccagucu

SEQ ID NO: 327751 - RNA, 22 nt, Homo sapiens
ucuuugguagaagcuauuuuau

SEQ ID NO: 327752 - RNA, 22 nt, Homo sapiens
ucuuugguuagguuuaguugau

SEQ ID NO: 327753 - RNA, 22 nt, Homo sapiens
ucuuugguugcacugcaggugu

SEQ ID NO: 327754 - RNA, 22 nt, Homo sapiens
ucuuuguguucaggagccacgu

SEQ ID NO: 327755 - RNA, 22 nt, Homo sapiens
ucuuuguuagaacccucuccuu

SEQ ID NO: 327756 - RNA, 22 nt, Homo sapiens
ucuuuuguucuauucaggccuu

SEQ ID NO: 327757 - RNA, 20 nt, Homo sapiens
ucuuuuuguggccccagagu

SEQ ID NO: 327758 - RNA, 22 nt, Homo sapiens
ugaaacauacacucugaugggg

SEQ ID NO: 327759 - RNA, 22 nt, Homo sapiens
ugaaacugcagugggcuuggca

SEQ ID NO: 327760 - RNA, 22 nt, Homo sapiens
ugaaagacacagaaguugccca

SEQ ID NO: 327761 - RNA, 22 nt, Homo sapiens
ugaaauacuuuggcucuuuguu

SEQ ID NO: 327762 - RNA, 22 nt, Homo sapiens
ugaaaugcagaacuuuaggucu

SEQ ID NO: 327763 - RNA, 22 nt, Homo sapiens
ugaaaugccuugagauuuugac

SEQ ID NO: 327764 - RNA, 22 nt, Homo sapiens
ugaaauggaaagaguguagacu

SEQ ID NO: 327765 - RNA, 22 nt, Homo sapiens
ugaaauggaagaagucccuuuu

SEQ ID NO: 327766 - RNA, 22 nt, Homo sapiens
ugaacagcaccuccuagaguug

SEQ ID NO: 327767 - RNA, 21 nt, Homo sapiens
ugaaccccugcucucaagaaa

SEQ ID NO: 327768 - RNA, 22 nt, Homo sapiens
ugaagacucaguuugagggaca

SEQ ID NO: 327769 - RNA, 22 nt, Homo sapiens
ugaaggacauucuaugguagau

SEQ ID NO: 327770 - RNA, 22 nt, Homo sapiens
ugaaguaauguuuuauucuauu

SEQ ID NO: 327771 - RNA, 22 nt, Homo sapiens
ugaauacagcacacccaugggu

SEQ ID NO: 327772 - RNA, 18 nt, Homo sapiens
ugaauacagcguugggaa

SEQ ID NO: 327773 - RNA, 21 nt, Homo sapiens
ugaauacugcugcucccuuug

SEQ ID NO: 327774 - RNA, 22 nt, Homo sapiens
ugaauacugugcaaaggauuug

SEQ ID NO: 327775 - RNA, 22 nt, Homo sapiens
ugaauagaaguggcaggaguag

SEQ ID NO: 327776 - RNA, 22 nt, Homo sapiens
ugaaugguaaagaaaagcacug

SEQ ID NO: 327777 - RNA, 22 nt, Homo sapiens
ugaauguaacuaaaggacuuuu

SEQ ID NO: 327778 - RNA, 22 nt, Homo sapiens
ugaauguauuuauuaccauuca

SEQ ID NO: 327779 - RNA, 22 nt, Homo sapiens
ugaauguccugacgcugcaguu

SEQ ID NO: 327780 - RNA, 21 nt, Homo sapiens
ugaaugucuaggcagaaguuu

SEQ ID NO: 327781 - RNA, 22 nt, Homo sapiens
ugaauuguuucauucuuuacau

SEQ ID NO: 327782 - RNA, 22 nt, Homo sapiens
ugacaagacuacauaucccauu

SEQ ID NO: 327783 - RNA, 22 nt, Homo sapiens
ugacaagaguagagagggugcc

SEQ ID NO: 327784 - RNA, 20 nt, Homo sapiens
ugacaaggugcaaagaauca

SEQ ID NO: 327785 - RNA, 21 nt, Homo sapiens
ugacagaaaauugaguuugcu

SEQ ID NO: 327786 - RNA, 22 nt, Homo sapiens
ugacagagaagcauugaguuca

SEQ ID NO: 327787 - RNA, 22 nt, Homo sapiens
ugacaggucuaauuuacugaca

SEQ ID NO: 327788 - RNA, 22 nt, Homo sapiens
ugacagguugauaggugcagca

SEQ ID NO: 327789 - RNA, 22 nt, Homo sapiens
ugacaguaucuacagcuucuua

SEQ ID NO: 327790 - RNA, 22 nt, Homo sapiens
ugacagugaacagguuaccacu

SEQ ID NO: 327791 - RNA, 22 nt, Homo sapiens
ugacagugaauaagucucuuaa

SEQ ID NO: 327792 - RNA, 18 nt, Homo sapiens
ugacaucauuuagaaagg

SEQ ID NO: 327793 - RNA, 19 nt, Homo sapiens
ugacaugaaacccaagauc

SEQ ID NO: 327794 - RNA, 22 nt, Homo sapiens
ugacaugaugagcaauaauggc

SEQ ID NO: 327795 - RNA, 22 nt, Homo sapiens
ugacaugauuguauauuuagaa

SEQ ID NO: 327796 - RNA, 22 nt, Homo sapiens
ugacauggagggugcggcugca

SEQ ID NO: 327797 - RNA, 22 nt, Homo sapiens
ugacauguagagaacuucucau

SEQ ID NO: 327798 - RNA, 22 nt, Homo sapiens
ugacauuacagucacuugcugu

SEQ ID NO: 327799 - RNA, 22 nt, Homo sapiens
ugaccacagaaagugagggagc

SEQ ID NO: 327800 - RNA, 22 nt, Homo sapiens
ugacccauagaaauguggauaa

SEQ ID NO: 327801 - RNA, 22 nt, Homo sapiens
ugacccuguggcagcgucuaag

SEQ ID NO: 327802 - RNA, 22 nt, Homo sapiens
ugaagacucauacuugaaucag

SEQ ID NO: 327803 - RNA, 22 nt, Homo sapiens
ugaagaucauacugguggaggg

SEQ ID NO: 327804 - RNA, 22 nt, Homo sapiens
ugaagaucuuaggagcugaggg

SEQ ID NO: 327805 - RNA, 22 nt, Homo sapiens
ugaagcuuguuucuguaccuuu

SEQ ID NO: 327806 - RNA, 22 nt, Homo sapiens
ugaaggacauaaggcagaguga

SEQ ID NO: 327807 - RNA, 22 nt, Homo sapiens
ugaaggaguauggauaagucgu

SEQ ID NO: 327808 - RNA, 21 nt, Homo sapiens
ugaaguagcauaggaugucaa

SEQ ID NO: 327809 - RNA, 22 nt, Homo sapiens
ugaagugaaugguaaguaugcc

SEQ ID NO: 327810 - RNA, 21 nt, Homo sapiens
ugaaguguaaccgugcagggc

SEQ ID NO: 327811 - RNA, 22 nt, Homo sapiens
ugaauagaaguuuacuccuuuu

SEQ ID NO: 327812 - RNA, 22 nt, Homo sapiens
ugaauaggcaguuaaguuuaug

SEQ ID NO: 327813 - RNA, 22 nt, Homo sapiens
ugaauaguaauguguuuggucu

SEQ ID NO: 327814 - RNA, 22 nt, Homo sapiens
ugaauagugucacaauaaacau

SEQ ID NO: 327815 - RNA, 22 nt, Homo sapiens
ugaauaguuugacagaacucuu

SEQ ID NO: 327816 - RNA, 22 nt, Homo sapiens
ugaauauguuaaauaauguucu

SEQ ID NO: 327817 - RNA, 21 nt, Homo sapiens
ugaauauuuggguugugucca

SEQ ID NO: 327818 - RNA, 22 nt, Homo sapiens
ugaaucaugcugcuauaaagac

SEQ ID NO: 327819 - RNA, 22 nt, Homo sapiens
ugaaugccauucuguguuagcu

SEQ ID NO: 327820 - RNA, 22 nt, Homo sapiens
ugaauguaagaugucugcuggu

SEQ ID NO: 327821 - RNA, 22 nt, Homo sapiens
ugaauguacacgcguacuuguu

SEQ ID NO: 327822 - RNA, 22 nt, Homo sapiens
ugaauucuguccaaaauaacug

SEQ ID NO: 327823 - RNA, 22 nt, Homo sapiens
ugacaaguaaacagucagcacc

SEQ ID NO: 327824 - RNA, 22 nt, Homo sapiens
ugacaagugauuaaggcauauu

SEQ ID NO: 327825 - RNA, 22 nt, Homo sapiens
ugacacagcaagauggaaccau

SEQ ID NO: 327826 - RNA, 22 nt, Homo sapiens
ugacacagugggggauccuuuu

SEQ ID NO: 327827 - RNA, 19 nt, Homo sapiens
ugacacuguuggugggagg

SEQ ID NO: 327828 - RNA, 22 nt, Homo sapiens
ugacacuugcccuuagaaacau

SEQ ID NO: 327829 - RNA, 22 nt, Homo sapiens
ugacagagcaggacuucaucuc

SEQ ID NO: 327830 - RNA, 22 nt, Homo sapiens
ugacagaggucuuuuaauagcu

SEQ ID NO: 327831 - RNA, 22 nt, Homo sapiens
ugacagcaucaggauuggagag

SEQ ID NO: 327832 - RNA, 22 nt, Homo sapiens
ugacagcugaggcccagaguac

SEQ ID NO: 327833 - RNA, 22 nt, Homo sapiens
ugacaggauggagaucgguauu

SEQ ID NO: 327834 - RNA, 23 nt, Homo sapiens
ugacagucucccgauggcuaggc

SEQ ID NO: 327835 - RNA, 22 nt, Homo sapiens
ugacaguguccucauucccaac

SEQ ID NO: 327836 - RNA, 22 nt, Homo sapiens
ugacauggagagagaagccuuu

SEQ ID NO: 327837 - RNA, 22 nt, Homo sapiens
ugacauggugcucuuucaggca

SEQ ID NO: 327838 - RNA, 22 nt, Homo sapiens
ugacauguauaucuuacgcuau

SEQ ID NO: 327839 - RNA, 22 nt, Homo sapiens
ugacauguugcauuauauuucc

SEQ ID NO: 327840 - RNA, 22 nt, Homo sapiens
ugaccaaugacauugaagagcu

SEQ ID NO: 327841 - RNA, 17 nt, Homo sapiens
ugaccacugauucuacu

SEQ ID NO: 327842 - RNA, 19 nt, Homo sapiens
ugaccagggacagaaacca

SEQ ID NO: 327843 - RNA, 22 nt, Homo sapiens
ugacggaggacaccugcggaau

SEQ ID NO: 327844 - RNA, 22 nt, Homo sapiens
ugacggaggcauuggaagcuug

SEQ ID NO: 327845 - RNA, 22 nt, Homo sapiens
ugacuacauaaguaaucucaaa

SEQ ID NO: 327846 - RNA, 21 nt, Homo sapiens
ugacuagauuccagauuggcc

SEQ ID NO: 327847 - RNA, 22 nt, Homo sapiens
ugacuaggggcccuggcuucuu

SEQ ID NO: 327848 - RNA, 22 nt, Homo sapiens
ugacuagucauaggcauggggg

SEQ ID NO: 327849 - RNA, 22 nt, Homo sapiens
ugacuauaggauaacaugcauu

SEQ ID NO: 327850 - RNA, 22 nt, Homo sapiens
ugacucagauagguguguauuc

SEQ ID NO: 327851 - RNA, 22 nt, Homo sapiens
ugacuuaugcaacucugaugug

SEQ ID NO: 327852 - RNA, 22 nt, Homo sapiens
ugacuucagacugaaaugauuc

SEQ ID NO: 327853 - RNA, 22 nt, Homo sapiens
ugagaacagauggcuuuauuau

SEQ ID NO: 327854 - RNA, 16 nt, Homo sapiens
ugagaacaugugauau

SEQ ID NO: 327855 - RNA, 19 nt, Homo sapiens
ugagaacaugugguauuug

SEQ ID NO: 327856 - RNA, 22 nt, Homo sapiens
ugagaacggauacuaagggcug

SEQ ID NO: 327857 - RNA, 22 nt, Homo sapiens
ugagaacuuauggugauuuuuu

SEQ ID NO: 327858 - RNA, 22 nt, Homo sapiens
ugagaacuuugucuuuuacucu

SEQ ID NO: 327859 - RNA, 19 nt, Homo sapiens
ugagaauguuaccaggucc

SEQ ID NO: 327860 - RNA, 21 nt, Homo sapiens
ugagacaauccuggucaauau

SEQ ID NO: 327861 - RNA, 22 nt, Homo sapiens
ugagacacuucccagaucccuu

SEQ ID NO: 327862 - RNA, 23 nt, Homo sapiens
ugagacauuggaaaguuaggcag

SEQ ID NO: 327863 - RNA, 22 nt, Homo sapiens
ugagaccaacagauuccaguuc

SEQ ID NO: 327864 - RNA, 22 nt, Homo sapiens
ugagaccuuucauuucucagug

SEQ ID NO: 327865 - RNA, 22 nt, Homo sapiens
ugagacggagucucgcucuguu

SEQ ID NO: 327866 - RNA, 22 nt, Homo sapiens
ugagacggagucuugcucuguc

SEQ ID NO: 327867 - RNA, 22 nt, Homo sapiens
ugagacugagucucgcucuugu

SEQ ID NO: 327868 - RNA, 22 nt, Homo sapiens
ugagacugagucuugcucuugu

SEQ ID NO: 327869 - RNA, 22 nt, Homo sapiens
ugagacugauaggacauuuucu

SEQ ID NO: 327870 - RNA, 22 nt, Homo sapiens
ugagagaugaacuauucuugaa

SEQ ID NO: 327871 - RNA, 22 nt, Homo sapiens
ugagauaaggaaauugaggcuc

SEQ ID NO: 327872 - RNA, 22 nt, Homo sapiens
ugagauaaucaugugguuuuug

SEQ ID NO: 327873 - RNA, 22 nt, Homo sapiens
ugagauaauuuacuuguugagg

SEQ ID NO: 327874 - RNA, 22 nt, Homo sapiens
ugagauagggucucacucuguc

SEQ ID NO: 327875 - RNA, 22 nt, Homo sapiens
ugagauaguacuuuuuuaaagg

SEQ ID NO: 327876 - RNA, 22 nt, Homo sapiens
ugagauaguuguagauguacau

SEQ ID NO: 327877 - RNA, 22 nt, Homo sapiens
ugagauauugggaguaauguca

SEQ ID NO: 327878 - RNA, 22 nt, Homo sapiens
ugagaucaacugagucagagca

SEQ ID NO: 327879 - RNA, 22 nt, Homo sapiens
ugagaucagugaagaaguguuu

SEQ ID NO: 327880 - RNA, 22 nt, Homo sapiens
ugagaucaugccacugcacuuc

SEQ ID NO: 327881 - RNA, 22 nt, Homo sapiens
ugagauccugugacuacacuga

SEQ ID NO: 327882 - RNA, 22 nt, Homo sapiens
ugagaucuguaaagucugacau

SEQ ID NO: 327883 - RNA, 22 nt, Homo sapiens
ugagaucuucgcucuucacaga

SEQ ID NO: 327884 - RNA, 22 nt, Homo sapiens
ugagaugaagcuagaagaaugg

SEQ ID NO: 327885 - RNA, 22 nt, Homo sapiens
ugagaugagaaucaguucuaau

SEQ ID NO: 327886 - RNA, 22 nt, Homo sapiens
ugagaugaggucucgcucuguc

SEQ ID NO: 327887 - RNA, 22 nt, Homo sapiens
ugagaugaguugcuggcucuga

SEQ ID NO: 327888 - RNA, 22 nt, Homo sapiens
ugagaugaucaaaguauaggcu

SEQ ID NO: 327889 - RNA, 22 nt, Homo sapiens
ugagauggaguuucgcuuuugu

SEQ ID NO: 327890 - RNA, 21 nt, Homo sapiens
ugagaugugaccagggcauca

SEQ ID NO: 327891 - RNA, 19 nt, Homo sapiens
ugagauuguaugaggagau

SEQ ID NO: 327892 - RNA, 22 nt, Homo sapiens
ugagcaaaauuuuggacauaga

SEQ ID NO: 327893 - RNA, 22 nt, Homo sapiens
ugagcaagaucuuuauaauuag

SEQ ID NO: 327894 - RNA, 21 nt, Homo sapiens
gugugcuugaauucagcuguc

SEQ ID NO: 327895 - RNA, 23 nt, Homo sapiens
gugugguaggcuauaccaucuag

SEQ ID NO: 327896 - RNA, 22 nt, Homo sapiens
guguuaaucucaaguacucuca

SEQ ID NO: 327897 - RNA, 22 nt, Homo sapiens
guguuauugagaaauagggugu

SEQ ID NO: 327898 - RNA, 22 nt, Homo sapiens
guguugcacauucuguggaugu

SEQ ID NO: 327899 - RNA, 22 nt, Homo sapiens
guuauguuauguuauguuaugu

SEQ ID NO: 327900 - RNA, 22 nt, Homo sapiens
guucaaggaauguuggcuucuc

SEQ ID NO: 327901 - RNA, 22 nt, Homo sapiens
guucaagugauagcugggauua

SEQ ID NO: 327902 - RNA, 20 nt, Homo sapiens
guucacaggcuuccuuucag

SEQ ID NO: 327903 - RNA, 22 nt, Homo sapiens
guucacaguuucuaaucccagc

SEQ ID NO: 327904 - RNA, 22 nt, Homo sapiens
guucagguauucuggaacagag

SEQ ID NO: 327905 - RNA, 22 nt, Homo sapiens
guucagucacgugcccaaguuc

SEQ ID NO: 327906 - RNA, 22 nt, Homo sapiens
guucaguuugcugaugcguuga

SEQ ID NO: 327907 - RNA, 22 nt, Homo sapiens
guucaguuuuaaagggaaauug

SEQ ID NO: 327908 - RNA, 22 nt, Homo sapiens
guucaguuuugaaauguuaauu

SEQ ID NO: 327909 - RNA, 22 nt, Homo sapiens
guucaucagggauauuggcuua

SEQ ID NO: 327910 - RNA, 22 nt, Homo sapiens
guucccaguugaaaugauuagu

SEQ ID NO: 327911 - RNA, 18 nt, Homo sapiens
guugagcuuuuccuuuag

SEQ ID NO: 327912 - RNA, 22 nt, Homo sapiens
guugcucaggccggagugcagu

SEQ ID NO: 327913 - RNA, 22 nt, Homo sapiens
guugcucaggcugaagugcagu

SEQ ID NO: 327914 - RNA, 22 nt, Homo sapiens
guuggaauuaaaaggcaaguau

SEQ ID NO: 327915 - RNA, 22 nt, Homo sapiens
guugguauuacagaaauuaguu

SEQ ID NO: 327916 - RNA, 22 nt, Homo sapiens
guuggucaaugugauuaggcca

SEQ ID NO: 327917 - RNA, 22 nt, Homo sapiens
guuggugaccugaagagaguaa

SEQ ID NO: 327918 - RNA, 22 nt, Homo sapiens
guuguggagucuucuguucugg

SEQ ID NO: 327919 - RNA, 22 nt, Homo sapiens
guuuaacugguacuucaagucu

SEQ ID NO: 327920 - RNA, 22 nt, Homo sapiens
guuugugcuccuaugagaaccu

SEQ ID NO: 327921 - RNA, 22 nt, Homo sapiens
guuugugguuaaagccuuucau

SEQ ID NO: 327922 - RNA, 22 nt, Homo sapiens
guuuugguuauauggaucaguu

SEQ ID NO: 327923 - RNA, 22 nt, Homo sapiens
uaaacugcuugaggguaaguac

SEQ ID NO: 327924 - RNA, 22 nt, Homo sapiens
uaaacugucuuuggagcuuugc

SEQ ID NO: 327925 - RNA, 22 nt, Homo sapiens
uaaagauaaggcucgcuuggau

SEQ ID NO: 327926 - RNA, 22 nt, Homo sapiens
uaaagcacaaguaaagaauacu

SEQ ID NO: 327927 - RNA, 22 nt, Homo sapiens
uaaagcacuuuuuucugcaugg

SEQ ID NO: 327928 - RNA, 22 nt, Homo sapiens
uaaagcauguaauuagguuaga

SEQ ID NO: 327929 - RNA, 22 nt, Homo sapiens
uaaagugaggauggcaguaggu

SEQ ID NO: 327930 - RNA, 22 nt, Homo sapiens
uaaaguguuuguuauuaaaggu

SEQ ID NO: 327931 - RNA, 22 nt, Homo sapiens
uaaaugacugucaguagaugaa

SEQ ID NO: 327932 - RNA, 22 nt, Homo sapiens
uaaaugcucuuuaaaagugcuu

SEQ ID NO: 327933 - RNA, 22 nt, Homo sapiens
uaaaugcuuaauugaaugugga

SEQ ID NO: 327934 - RNA, 22 nt, Homo sapiens
uaaauugcauaaguacaaauga

SEQ ID NO: 327935 - RNA, 22 nt, Homo sapiens
uaacagcauuugugucuaguag

SEQ ID NO: 327936 - RNA, 22 nt, Homo sapiens
uaacauugcuggacuaccugcu

SEQ ID NO: 327937 - RNA, 22 nt, Homo sapiens
uaacugcaaccucugccugcug

SEQ ID NO: 327938 - RNA, 22 nt, Homo sapiens
uaacugccuacugugcaaauau

SEQ ID NO: 327939 - RNA, 20 nt, Homo sapiens
uaagacaugguccacaugcc

SEQ ID NO: 327940 - RNA, 22 nt, Homo sapiens
uaagacucuggacucuaauguu

SEQ ID NO: 327941 - RNA, 22 nt, Homo sapiens
uaagacugccccagacagcaag

SEQ ID NO: 327942 - RNA, 22 nt, Homo sapiens
uaagagagcuccaucuuuuccu

SEQ ID NO: 327943 - RNA, 22 nt, Homo sapiens
uaagaugaaggcucaccuagaa

SEQ ID NO: 327944 - RNA, 16 nt, Homo sapiens
uaagccccacgugcau

SEQ ID NO: 327945 - RNA, 22 nt, Homo sapiens
uaaggaaccagaaguggguagc

SEQ ID NO: 327946 - RNA, 22 nt, Homo sapiens
uaaggaaggcugugugcuuuua

SEQ ID NO: 327947 - RNA, 22 nt, Homo sapiens
uaaggcaaaccuuggcugcagu

SEQ ID NO: 327948 - RNA, 22 nt, Homo sapiens
uaaggcaaucagucaugguguu

SEQ ID NO: 327949 - RNA, 22 nt, Homo sapiens
uaaggcacauaggccuggaaac

SEQ ID NO: 327950 - RNA, 22 nt, Homo sapiens
uaaggcacuacuuuaggcuuuc

SEQ ID NO: 327951 - RNA, 18 nt, Homo sapiens
uaaggcacuauaggcauu

SEQ ID NO: 327952 - RNA, 22 nt, Homo sapiens
uaagggacauguguugccuaag

SEQ ID NO: 327953 - RNA, 22 nt, Homo sapiens
uaagguccuuaaauguguaacc

SEQ ID NO: 327954 - RNA, 22 nt, Homo sapiens
uaaguaauugugguuuuugcca

SEQ ID NO: 327955 - RNA, 22 nt, Homo sapiens
uaaguacugucagaauuggacu

SEQ ID NO: 327956 - RNA, 22 nt, Homo sapiens
uaaguagaggaaucauuuugug

SEQ ID NO: 327957 - RNA, 22 nt, Homo sapiens
uaaguauuaugugcugcauuuu

SEQ ID NO: 327958 - RNA, 22 nt, Homo sapiens
uaagugaaggaaguguguuuac

SEQ ID NO: 327959 - RNA, 22 nt, Homo sapiens
uaagugaauuucacuacugagu

SEQ ID NO: 327960 - RNA, 22 nt, Homo sapiens
uaagugcaacauaaguguuaaa

SEQ ID NO: 327961 - RNA, 20 nt, Homo sapiens
uaagugcauaggauauuucu

SEQ ID NO: 327962 - RNA, 22 nt, Homo sapiens
uaaguguaaugucugaaguuug

SEQ ID NO: 327963 - RNA, 22 nt, Homo sapiens
uaaguucauucaugaaacuuag

SEQ ID NO: 327964 - RNA, 22 nt, Homo sapiens
uaaguugcagguugugauucca

SEQ ID NO: 327965 - RNA, 18 nt, Homo sapiens
uaauaacugugaccuuga

SEQ ID NO: 327966 - RNA, 22 nt, Homo sapiens
uaauacuagugaauagcaggau

SEQ ID NO: 327967 - RNA, 22 nt, Homo sapiens
uaauacugcugugcuugaguug

SEQ ID NO: 327968 - RNA, 22 nt, Homo sapiens
uaauacuguaauggugguuccg

SEQ ID NO: 327969 - RNA, 22 nt, Homo sapiens
uaauacuugucauaaaggcauu

SEQ ID NO: 327970 - RNA, 22 nt, Homo sapiens
uaauauguauacagacagauac

SEQ ID NO: 327971 - RNA, 22 nt, Homo sapiens
uaauccuagcacuuuggaagac

SEQ ID NO: 327972 - RNA, 22 nt, Homo sapiens
uaaugcucauuagcaggccaau

SEQ ID NO: 327973 - RNA, 22 nt, Homo sapiens
uaaugcuguggucugguuuaaa

SEQ ID NO: 327974 - RNA, 22 nt, Homo sapiens
uaaugcuugguuguuuggaaaa

SEQ ID NO: 327975 - RNA, 22 nt, Homo sapiens
uaauucacauaaagcacuuaga

SEQ ID NO: 327976 - RNA, 22 nt, Homo sapiens
uaauugaaugcagacaccaggg

SEQ ID NO: 327977 - RNA, 22 nt, Homo sapiens
uaauuggaucucaaaaaagugu

SEQ ID NO: 327978 - RNA, 22 nt, Homo sapiens
uacaaagugggaaacgaagguu

SEQ ID NO: 327979 - RNA, 16 nt, Homo sapiens
uacaacagugaguaug

SEQ ID NO: 327980 - RNA, 22 nt, Homo sapiens
uacaaguaauaagggaagaauu

SEQ ID NO: 327981 - RNA, 22 nt, Homo sapiens
uacacgugcacaacgugcacgu

SEQ ID NO: 327982 - RNA, 22 nt, Homo sapiens
cuaaaggaaucugagccccuga

SEQ ID NO: 327983 - RNA, 22 nt, Homo sapiens
cuaaaguauugagugguaaaga

SEQ ID NO: 327984 - RNA, 22 nt, Homo sapiens
cuaaagugcugagauuauaggu

SEQ ID NO: 327985 - RNA, 22 nt, Homo sapiens
cuaaagugcuuaaaaucucauu

SEQ ID NO: 327986 - RNA, 22 nt, Homo sapiens
ugagcacuguacuuuaucaggu

SEQ ID NO: 327987 - RNA, 22 nt, Homo sapiens
ugagcauuguguuugacuguga

SEQ ID NO: 327988 - RNA, 22 nt, Homo sapiens
ugagccaaguucacaccauugc

SEQ ID NO: 327989 - RNA, 22 nt, Homo sapiens
ugagcuacuacacccagcuugg

SEQ ID NO: 327990 - RNA, 20 nt, Homo sapiens
ugagcucaugacauuuuucu

SEQ ID NO: 327991 - RNA, 22 nt, Homo sapiens
ugagcugagaaaugcagcagcu

SEQ ID NO: 327992 - RNA, 22 nt, Homo sapiens
ugaggaucucuaggaauuuauc

SEQ ID NO: 327993 - RNA, 17 nt, Homo sapiens
ugaggcacuaguaucac

SEQ ID NO: 327994 - RNA, 22 nt, Homo sapiens
ugaggcacucccuagcggggug

SEQ ID NO: 327995 - RNA, 22 nt, Homo sapiens
ugagggaugccugguuuguuuu

SEQ ID NO: 327996 - RNA, 22 nt, Homo sapiens
ugaggucauucaugugggcgca

SEQ ID NO: 327997 - RNA, 20 nt, Homo sapiens
ugaggucugagaaagaauga

SEQ ID NO: 327998 - RNA, 22 nt, Homo sapiens
ugaggucuuuauuuagugcuca

SEQ ID NO: 327999 - RNA, 22 nt, Homo sapiens
ugaggugagggguuaggugcua

SEQ ID NO: 328000 - RNA, 22 nt, Homo sapiens
ugaggugaggguaucaaaugcu

SEQ ID NO: 328001 - RNA, 22 nt, Homo sapiens
ugagguguauugggggaaauuc

SEQ ID NO: 328002 - RNA, 22 nt, Homo sapiens
ugagguugguauuacugucucu

SEQ ID NO: 328003 - RNA, 22 nt, Homo sapiens
ugagguuguccacuauaaucca

SEQ ID NO: 328004 - RNA, 22 nt, Homo sapiens
ugaguagaacuccuggagaugu

SEQ ID NO: 328005 - RNA, 22 nt, Homo sapiens
ugaguagauccaagacuguccu

SEQ ID NO: 328006 - RNA, 22 nt, Homo sapiens
ugaguagcuaagacgauaggca

SEQ ID NO: 328007 - RNA, 22 nt, Homo sapiens
ugaguaggauugguauuucuuc

SEQ ID NO: 328008 - RNA, 23 nt, Homo sapiens
ugaguaggcaguuuuccccucac

SEQ ID NO: 328009 - RNA, 23 nt, Homo sapiens
ugaguagguccacguaugugagu

SEQ ID NO: 328010 - RNA, 22 nt, Homo sapiens
ugaguagucuagaguggaaugu

SEQ ID NO: 328011 - RNA, 22 nt, Homo sapiens
ugaguagugcugcaauaaacau

SEQ ID NO: 328012 - RNA, 22 nt, Homo sapiens
ugaguauagaucaguucaagug

SEQ ID NO: 328013 - RNA, 19 nt, Homo sapiens
ugaguaucuuuacacaucu

SEQ ID NO: 328014 - RNA, 22 nt, Homo sapiens
ugaguauguuuaaugugacaau

SEQ ID NO: 328015 - RNA, 22 nt, Homo sapiens
ugagucauguaauaaugcugcu

SEQ ID NO: 328016 - RNA, 22 nt, Homo sapiens
ugagucuguuccaaagaaauaa

SEQ ID NO: 328017 - RNA, 22 nt, Homo sapiens
ugagugaacgcugagaccaaau

SEQ ID NO: 328018 - RNA, 22 nt, Homo sapiens
ugagugaaugugaaggcuaggg

SEQ ID NO: 328019 - RNA, 22 nt, Homo sapiens
ugagugaggcugggcagucccu

SEQ ID NO: 328020 - RNA, 22 nt, Homo sapiens
ugagugccuggagggcagggac

SEQ ID NO: 328021 - RNA, 22 nt, Homo sapiens
ugaguguccaaguaaggugaaa

SEQ ID NO: 328022 - RNA, 22 nt, Homo sapiens
ugaguguccaccccuuucacag

SEQ ID NO: 328023 - RNA, 22 nt, Homo sapiens
ugagugugaggaagaauuagaa

SEQ ID NO: 328024 - RNA, 22 nt, Homo sapiens
ugaguuaggagaguguggcucu

SEQ ID NO: 328025 - RNA, 22 nt, Homo sapiens
ugaguuagguaauaauaaauau

SEQ ID NO: 328026 - RNA, 22 nt, Homo sapiens
ugaguuagguguuuuaaauaua

SEQ ID NO: 328027 - RNA, 22 nt, Homo sapiens
ugaguucaauuguauuuuauua

SEQ ID NO: 328028 - RNA, 18 nt, Homo sapiens
ugaguucauuagacuucc

SEQ ID NO: 328029 - RNA, 22 nt, Homo sapiens
ugaguuguagcuauaguuucuu

SEQ ID NO: 328030 - RNA, 22 nt, Homo sapiens
ugaguuuaucuaaagaccuggg

SEQ ID NO: 328031 - RNA, 22 nt, Homo sapiens
ugauaauguuaggcuuuauuca

SEQ ID NO: 328032 - RNA, 22 nt, Homo sapiens
ugauaauuuugucagguuuugg

SEQ ID NO: 328033 - RNA, 22 nt, Homo sapiens
ugauaguguccugugccacauu

SEQ ID NO: 328034 - RNA, 22 nt, Homo sapiens
ugauauauugaaugaugaaaca

SEQ ID NO: 328035 - RNA, 18 nt, Homo sapiens
ugauaucaucacaauuga

SEQ ID NO: 328036 - RNA, 22 nt, Homo sapiens
ugauaucucuugccuccaaaug

SEQ ID NO: 328037 - RNA, 22 nt, Homo sapiens
ugauauguaacuacuccuuaua

SEQ ID NO: 328038 - RNA, 22 nt, Homo sapiens
ugauauguggauucagcucaaa

SEQ ID NO: 328039 - RNA, 17 nt, Homo sapiens
ugauauuuucccagaua

SEQ ID NO: 328040 - RNA, 20 nt, Homo sapiens
ugauauuuucugagcaggaa

SEQ ID NO: 328041 - RNA, 22 nt, Homo sapiens
ugaucucauuagcaccuuuagc

SEQ ID NO: 328042 - RNA, 22 nt, Homo sapiens
ugaugaugaaugaucuuuuaca

SEQ ID NO: 328043 - RNA, 21 nt, Homo sapiens
ugaugcuuuucuuaaccuugc

SEQ ID NO: 328044 - RNA, 22 nt, Homo sapiens
ugauggcacagugaguuccagg

SEQ ID NO: 328045 - RNA, 20 nt, Homo sapiens
ugauguccaggcagagguuu

SEQ ID NO: 328046 - RNA, 22 nt, Homo sapiens
ugaugucuugagauggagcuua

SEQ ID NO: 328047 - RNA, 22 nt, Homo sapiens
ugauguugacuguaggcagaga

SEQ ID NO: 328048 - RNA, 20 nt, Homo sapiens
ugauuaguccacuuggcucu

SEQ ID NO: 328049 - RNA, 22 nt, Homo sapiens
ugauugcacaccugcacucaag

SEQ ID NO: 328050 - RNA, 22 nt, Homo sapiens
ugauugucucuccugccccauc

SEQ ID NO: 328051 - RNA, 22 nt, Homo sapiens
ugauuugucugcaggaauagug

SEQ ID NO: 328052 - RNA, 22 nt, Homo sapiens
ugauuuguuuagugccaaguuu

SEQ ID NO: 328053 - RNA, 22 nt, Homo sapiens
ugcaaagaaauuuuggugacca

SEQ ID NO: 328054 - RNA, 22 nt, Homo sapiens
ugcaaaguccucauucuuaccc

SEQ ID NO: 328055 - RNA, 22 nt, Homo sapiens
ugcaaagucgaaacugcaguuu

SEQ ID NO: 328056 - RNA, 22 nt, Homo sapiens
ugcaaaucuuguguaguuguga

SEQ ID NO: 328057 - RNA, 18 nt, Homo sapiens
ugcaauggagaugcagcc

SEQ ID NO: 328058 - RNA, 22 nt, Homo sapiens
ugcaccaauucuaaacaguucu

SEQ ID NO: 328059 - RNA, 18 nt, Homo sapiens
ugcaccaguuuacacuuc

SEQ ID NO: 328060 - RNA, 22 nt, Homo sapiens
ugcaccaucuugcuucuguggu

SEQ ID NO: 328061 - RNA, 22 nt, Homo sapiens
ugcacuguggucugagagacag

SEQ ID NO: 328062 - RNA, 23 nt, Homo sapiens
ugcagcacacugaugggucuuga

SEQ ID NO: 328063 - RNA, 22 nt, Homo sapiens
ugcagcacaguagguuugcaau

SEQ ID NO: 328064 - RNA, 22 nt, Homo sapiens
ugcagcacuguucacaauagcc

SEQ ID NO: 328065 - RNA, 22 nt, Homo sapiens
ugcagcauguaggcacguuauu

SEQ ID NO: 328066 - RNA, 18 nt, Homo sapiens
ugcagcuuugugauuggc

SEQ ID NO: 328067 - RNA, 22 nt, Homo sapiens
ugcaguacauucagcauccucu

SEQ ID NO: 328068 - RNA, 22 nt, Homo sapiens
ugcaguagugugaucuuggcuc

SEQ ID NO: 328069 - RNA, 22 nt, Homo sapiens
ugcagugucaauaauaauuagu

SEQ ID NO: 328070 - RNA, 22 nt, Homo sapiens
ugcagugugaaagagccugaca

SEQ ID NO: 328071 - RNA, 22 nt, Homo sapiens
ugcaguuuaggaacugguaaca

SEQ ID NO: 328072 - RNA, 21 nt, Homo sapiens
ugcauacuucucagaugauua

SEQ ID NO: 328073 - RNA, 22 nt, Homo sapiens
ugcauagcaaaauaggauuaga

SEQ ID NO: 328074 - RNA, 22 nt, Homo sapiens
ugcauaggcuaaaauccuggcc

SEQ ID NO: 328075 - RNA, 22 nt, Homo sapiens
ugcauauucuaggauuuuguau

SEQ ID NO: 328076 - RNA, 22 nt, Homo sapiens
ugacugaguaguauuccacuau

SEQ ID NO: 328077 - RNA, 23 nt, Homo sapiens
ugacuggagacuguugauccuuu

SEQ ID NO: 328078 - RNA, 22 nt, Homo sapiens
ugacuucauuuuuggccaugag

SEQ ID NO: 328079 - RNA, 22 nt, Homo sapiens
ugacuugaacuucuaugucacc

SEQ ID NO: 328080 - RNA, 22 nt, Homo sapiens
ugacuugaaguuaccauaugca

SEQ ID NO: 328081 - RNA, 20 nt, Homo sapiens
ugacuuguccgagguccccc

SEQ ID NO: 328082 - RNA, 21 nt, Homo sapiens
ugagaacaacaggucaagcag

SEQ ID NO: 328083 - RNA, 16 nt, Homo sapiens
ugagaacaugcagcau

SEQ ID NO: 328084 - RNA, 16 nt, Homo sapiens
ugagaacaugggguau

SEQ ID NO: 328085 - RNA, 16 nt, Homo sapiens
ugagaacaugugacau

SEQ ID NO: 328086 - RNA, 20 nt, Homo sapiens
ugagaacauguggcauuugg

SEQ ID NO: 328087 - RNA, 17 nt, Homo sapiens
ugagaacaugugguauu

SEQ ID NO: 328088 - RNA, 18 nt, Homo sapiens
ugagaacauguguacaca

SEQ ID NO: 328089 - RNA, 22 nt, Homo sapiens
ugagaacuaaaaugugguauau

SEQ ID NO: 328090 - RNA, 22 nt, Homo sapiens
ugagaacucaugaaucuuucca

SEQ ID NO: 328091 - RNA, 22 nt, Homo sapiens
ugagaagacaucagcuuucgga

SEQ ID NO: 328092 - RNA, 22 nt, Homo sapiens
ugagaagacaucuuugcuuugu

SEQ ID NO: 328093 - RNA, 22 nt, Homo sapiens
ugagaagugauauagaaguuaa

SEQ ID NO: 328094 - RNA, 22 nt, Homo sapiens
ugagaauauuugaagauguuag

SEQ ID NO: 328095 - RNA, 22 nt, Homo sapiens
ugagaaugacugggcaugcugc

SEQ ID NO: 328096 - RNA, 22 nt, Homo sapiens
ugagacaaaguuguuggauguu

SEQ ID NO: 328097 - RNA, 22 nt, Homo sapiens
ugagacaucucuccugagacag

SEQ ID NO: 328098 - RNA, 22 nt, Homo sapiens
ugagacaugugaacuguaguuc

SEQ ID NO: 328099 - RNA, 22 nt, Homo sapiens
ugagacggagucucgcuguguc

SEQ ID NO: 328100 - RNA, 22 nt, Homo sapiens
ugagacggagucuugcccuguc

SEQ ID NO: 328101 - RNA, 22 nt, Homo sapiens
ugagacggaguuucgcucuugu

SEQ ID NO: 328102 - RNA, 22 nt, Homo sapiens
ugagacugaaauuaggaaacug

SEQ ID NO: 328103 - RNA, 22 nt, Homo sapiens
ugagacugagucucccucuguc

SEQ ID NO: 328104 - RNA, 22 nt, Homo sapiens
ugagacugaguuucucucuugu

SEQ ID NO: 328105 - RNA, 22 nt, Homo sapiens
ugagagacagacauuaucuuau

SEQ ID NO: 328106 - RNA, 22 nt, Homo sapiens
ugagagacaguuucgucggagg

SEQ ID NO: 328107 - RNA, 22 nt, Homo sapiens
ugagagaugauaaaauguuugu

SEQ ID NO: 328108 - RNA, 19 nt, Homo sapiens
ugagagcacaacugaacaa

SEQ ID NO: 328109 - RNA, 22 nt, Homo sapiens
ugagagcugcauucuugaaagc

SEQ ID NO: 328110 - RNA, 22 nt, Homo sapiens
ugagaggugaauggcaggcuca

SEQ ID NO: 328111 - RNA, 22 nt, Homo sapiens
ugagaggugauaaagcaagggu

SEQ ID NO: 328112 - RNA, 22 nt, Homo sapiens
ugagagucacugaccugguaua

SEQ ID NO: 328113 - RNA, 22 nt, Homo sapiens
ugagauaaagcauguacugugu

SEQ ID NO: 328114 - RNA, 21 nt, Homo sapiens
ugagauaauauguuucugaug

SEQ ID NO: 328115 - RNA, 22 nt, Homo sapiens
ugagauaaugcaugugaagauc

SEQ ID NO: 328116 - RNA, 18 nt, Homo sapiens
ugagauacuagaauaggu

SEQ ID NO: 328117 - RNA, 22 nt, Homo sapiens
ugagauagaaaacauaggagaa

SEQ ID NO: 328118 - RNA, 22 nt, Homo sapiens
ugagauaggaucuugcucuguu

SEQ ID NO: 328119 - RNA, 22 nt, Homo sapiens
ugagaucacgccacugcacucc

SEQ ID NO: 328120 - RNA, 22 nt, Homo sapiens
ugagaucagaaggauuucucug

SEQ ID NO: 328121 - RNA, 22 nt, Homo sapiens
ugagaucaguuguuauaauucu

SEQ ID NO: 328122 - RNA, 22 nt, Homo sapiens
ugagaucgagucucgcucuguc

SEQ ID NO: 328123 - RNA, 22 nt, Homo sapiens
ugagaucugucuuuauaguauu

SEQ ID NO: 328124 - RNA, 22 nt, Homo sapiens
ugagaugaagucuugcucuguu

SEQ ID NO: 328125 - RNA, 22 nt, Homo sapiens
ugagaugaagugauguaaaaca

SEQ ID NO: 328126 - RNA, 22 nt, Homo sapiens
ugagaugagggcugcacucaaa

SEQ ID NO: 328127 - RNA, 21 nt, Homo sapiens
ugagaugauccugcaugcaug

SEQ ID NO: 328128 - RNA, 20 nt, Homo sapiens
ugagaugcauugggauguuu

SEQ ID NO: 328129 - RNA, 22 nt, Homo sapiens
ugagaugcuccucuugcaaagc

SEQ ID NO: 328130 - RNA, 22 nt, Homo sapiens
ugagaugcucgccggccagcau

SEQ ID NO: 328131 - RNA, 22 nt, Homo sapiens
ugagauggagucuugucgccua

SEQ ID NO: 328132 - RNA, 22 nt, Homo sapiens
ugagauggaguuucacuuuugu

SEQ ID NO: 328133 - RNA, 22 nt, Homo sapiens
ugagauguuuguuucagugccu

SEQ ID NO: 328134 - RNA, 23 nt, Homo sapiens
ugagauuauaaucuuuuacuucu

SEQ ID NO: 328135 - RNA, 21 nt, Homo sapiens
ugagauuauauuaacauggua

SEQ ID NO: 328136 - RNA, 22 nt, Homo sapiens
ugagauuaucguaauguaucuc

SEQ ID NO: 328137 - RNA, 22 nt, Homo sapiens
ugagauucucugauuguagguc

SEQ ID NO: 328138 - RNA, 22 nt, Homo sapiens
ugagauuguuagaucaaauggu

SEQ ID NO: 328139 - RNA, 22 nt, Homo sapiens
ugagauuguucuaugucugguu

SEQ ID NO: 328140 - RNA, 22 nt, Homo sapiens
ugagcaauaaaguuacacaguu

SEQ ID NO: 328141 - RNA, 23 nt, Homo sapiens
ugagcaauauucuacuauugagu

SEQ ID NO: 328142 - RNA, 22 nt, Homo sapiens
ugagcacagagccugggguggc

SEQ ID NO: 328143 - RNA, 22 nt, Homo sapiens
ugagcacaggugcgcgguuacu

SEQ ID NO: 328144 - RNA, 22 nt, Homo sapiens
ugagcagaaguuuugauuggcg

SEQ ID NO: 328145 - RNA, 22 nt, Homo sapiens
ugagcagagaagugcccugcgc

SEQ ID NO: 328146 - RNA, 22 nt, Homo sapiens
ugagcagagggagaaguaaauu

SEQ ID NO: 328147 - RNA, 22 nt, Homo sapiens
ugagcagugaguguggugcagg

SEQ ID NO: 328148 - RNA, 22 nt, Homo sapiens
ugagcauuguuuggacuuggau

SEQ ID NO: 328149 - RNA, 20 nt, Homo sapiens
ugagccccuggacucaagcg

SEQ ID NO: 328150 - RNA, 22 nt, Homo sapiens
ugagcuaggauccugucacugu

SEQ ID NO: 328151 - RNA, 22 nt, Homo sapiens
uugagauggaguuuugcucuug

SEQ ID NO: 328152 - RNA, 19 nt, Homo sapiens
uugagaugugaacucacac

SEQ ID NO: 328153 - RNA, 22 nt, Homo sapiens
uugagauuuuccucaaauauuu

SEQ ID NO: 328154 - RNA, 22 nt, Homo sapiens
uugagcaacauagugagacugu

SEQ ID NO: 328155 - RNA, 22 nt, Homo sapiens
uugagcaccaugccuggccaug

SEQ ID NO: 328156 - RNA, 19 nt, Homo sapiens
uugagcacugccggaguua

SEQ ID NO: 328157 - RNA, 22 nt, Homo sapiens
uugagcauugguauagguuuua

SEQ ID NO: 328158 - RNA, 22 nt, Homo sapiens
uugagcuauguacagaugcugu

SEQ ID NO: 328159 - RNA, 22 nt, Homo sapiens
uugagcuuuuuacuuguccaau

SEQ ID NO: 328160 - RNA, 22 nt, Homo sapiens
uugaggaagugguuccccagag

SEQ ID NO: 328161 - RNA, 22 nt, Homo sapiens
uugaggaggcagucucuccauu

SEQ ID NO: 328162 - RNA, 22 nt, Homo sapiens
uugaggaggcagucuucccauu

SEQ ID NO: 328163 - RNA, 16 nt, Homo sapiens
uugaggcaugucucag

SEQ ID NO: 328164 - RNA, 22 nt, Homo sapiens
uugagggagcauuuguuuugag

SEQ ID NO: 328165 - RNA, 22 nt, Homo sapiens
uugagguauuuugucaacugua

SEQ ID NO: 328166 - RNA, 22 nt, Homo sapiens
uugaggucuucaggaucaggcu

SEQ ID NO: 328167 - RNA, 22 nt, Homo sapiens
uugaggucuuugagcaaacgca

SEQ ID NO: 328168 - RNA, 22 nt, Homo sapiens
uugaggugaagggcagagcagc

SEQ ID NO: 328169 - RNA, 20 nt, Homo sapiens
uugaggugugaggggcagag

SEQ ID NO: 328170 - RNA, 20 nt, Homo sapiens
ggaauguuaaucuccaugau

SEQ ID NO: 328171 - RNA, 22 nt, Homo sapiens
ggacagaaaggguucaccaaac

SEQ ID NO: 328172 - RNA, 22 nt, Homo sapiens
ggacaucauuaccauggaccca

SEQ ID NO: 328173 - RNA, 22 nt, Homo sapiens
ggacauguauauauaugugugu

SEQ ID NO: 328174 - RNA, 22 nt, Homo sapiens
ggacuagaucucccggcuucua

SEQ ID NO: 328175 - RNA, 22 nt, Homo sapiens
ggacuaggagcuaggaagaucu

SEQ ID NO: 328176 - RNA, 22 nt, Homo sapiens
ggacugagaggacuacagugua

SEQ ID NO: 328177 - RNA, 22 nt, Homo sapiens
ggagaucuuguuaaaguacaga

SEQ ID NO: 328178 - RNA, 22 nt, Homo sapiens
ggagaucuuuaggaguuggacu

SEQ ID NO: 328179 - RNA, 22 nt, Homo sapiens
ggagaucuuuguuaucuuuuga

SEQ ID NO: 328180 - RNA, 22 nt, Homo sapiens
ggagggugagaucaauuuggga

SEQ ID NO: 328181 - RNA, 22 nt, Homo sapiens
ggagguaauaaguuccagugua

SEQ ID NO: 328182 - RNA, 20 nt, Homo sapiens
ggagguguugauuuuucuuu

SEQ ID NO: 328183 - RNA, 20 nt, Homo sapiens
ggagguuguauaaguacauc

SEQ ID NO: 328184 - RNA, 22 nt, Homo sapiens
ggaguaggaaggaaauguuaaa

SEQ ID NO: 328185 - RNA, 22 nt, Homo sapiens
ggaguaugaaacccacuccaau

SEQ ID NO: 328186 - RNA, 22 nt, Homo sapiens
ggagucugaacuggacaaugac

SEQ ID NO: 328187 - RNA, 22 nt, Homo sapiens
ggagucugacuuauaggaaccu

SEQ ID NO: 328188 - RNA, 22 nt, Homo sapiens
ggagucuugcuauguugccaag

SEQ ID NO: 328189 - RNA, 23 nt, Homo sapiens
ggaguguauuggcacgaucucag

SEQ ID NO: 328190 - RNA, 22 nt, Homo sapiens
ggaguucaucaggugaggggua

SEQ ID NO: 328191 - RNA, 22 nt, Homo sapiens
ggauaacagccaggucaaacaa

SEQ ID NO: 328192 - RNA, 22 nt, Homo sapiens
ggauuagagauguuauuaagag

SEQ ID NO: 328193 - RNA, 21 nt, Homo sapiens
ggauucaucccucaugaauuu

SEQ ID NO: 328194 - RNA, 22 nt, Homo sapiens
ggauugcuuaagaaguuucauu

SEQ ID NO: 328195 - RNA, 22 nt, Homo sapiens
ggcaaagagacaugcaucgggg

SEQ ID NO: 328196 - RNA, 22 nt, Homo sapiens
ggcaacauggugaaacucuguc

SEQ ID NO: 328197 - RNA, 21 nt, Homo sapiens
ggcaagaaacacaaucaagua

SEQ ID NO: 328198 - RNA, 22 nt, Homo sapiens
ggcaagaagagaguuuaaacau

SEQ ID NO: 328199 - RNA, 17 nt, Homo sapiens
ggcaagaaguggaacuc

SEQ ID NO: 328200 - RNA, 22 nt, Homo sapiens
ggcaaggauguuuuucuggcaa

SEQ ID NO: 328201 - RNA, 22 nt, Homo sapiens
ggcaaggugaugaaugucuaca

SEQ ID NO: 328202 - RNA, 22 nt, Homo sapiens
ggcaaggugcuacagacaguga

SEQ ID NO: 328203 - RNA, 19 nt, Homo sapiens
ggcaauacuuucuuguugg

SEQ ID NO: 328204 - RNA, 22 nt, Homo sapiens
ggcacaaugucagcucacugca

SEQ ID NO: 328205 - RNA, 22 nt, Homo sapiens
ggcacuguggcucaagccugua

SEQ ID NO: 328206 - RNA, 22 nt, Homo sapiens
ggcagaucauuggccucaguuu

SEQ ID NO: 328207 - RNA, 22 nt, Homo sapiens
ggcagcaugggugccuuuguga

SEQ ID NO: 328208 - RNA, 22 nt, Homo sapiens
ggcagcgugcacuuucgccacu

SEQ ID NO: 328209 - RNA, 17 nt, Homo sapiens
ggcaggaauuaauguca

SEQ ID NO: 328210 - RNA, 17 nt, Homo sapiens
ggcaggauccaggaucc

SEQ ID NO: 328211 - RNA, 22 nt, Homo sapiens
ggcaguggaagugccaguuucu

SEQ ID NO: 328212 - RNA, 22 nt, Homo sapiens
ggcaguuuggcaguuucauaaa

SEQ ID NO: 328213 - RNA, 22 nt, Homo sapiens
ggcaguuuguuugugaggucca

SEQ ID NO: 328214 - RNA, 22 nt, Homo sapiens
ggcccugagacaggaaaaagcu

SEQ ID NO: 328215 - RNA, 22 nt, Homo sapiens
ggcuagagaauagugccacuaa

SEQ ID NO: 328216 - RNA, 21 nt, Homo sapiens
ggcucuguggucucagguuuc

SEQ ID NO: 328217 - RNA, 22 nt, Homo sapiens
ggcuuuggucacacaggggcaa

SEQ ID NO: 328218 - RNA, 22 nt, Homo sapiens
gggaaauguaaagucauaagau

SEQ ID NO: 328219 - RNA, 22 nt, Homo sapiens
gggaagaaggagugguuuacuc

SEQ ID NO: 328220 - RNA, 22 nt, Homo sapiens
gggagguaggaguuauuauuuu

SEQ ID NO: 328221 - RNA, 22 nt, Homo sapiens
gggaggucauuguaaggucuua

SEQ ID NO: 328222 - RNA, 22 nt, Homo sapiens
gggaguguguaggacccagugu

SEQ ID NO: 328223 - RNA, 22 nt, Homo sapiens
gggaugaagcccuaggguuggu

SEQ ID NO: 328224 - RNA, 22 nt, Homo sapiens
gggaugauuaugguucacuaca

SEQ ID NO: 328225 - RNA, 23 nt, Homo sapiens
gggauuguaaaauaugagggcag

SEQ ID NO: 328226 - RNA, 22 nt, Homo sapiens
gggcaacauugaguacccugaa

SEQ ID NO: 328227 - RNA, 20 nt, Homo sapiens
gggcaaguaugugggaaguc

SEQ ID NO: 328228 - RNA, 22 nt, Homo sapiens
gggcacgugugugcugugcuca

SEQ ID NO: 328229 - RNA, 16 nt, Homo sapiens
gggcaugugaagccua

SEQ ID NO: 328230 - RNA, 22 nt, Homo sapiens
ggggcaaaaugccacgagucuc

SEQ ID NO: 328231 - RNA, 22 nt, Homo sapiens
ggggucauuaaauuccgcuggu

SEQ ID NO: 328232 - RNA, 22 nt, Homo sapiens
gggucaguuuugagaaagcgug

SEQ ID NO: 328233 - RNA, 22 nt, Homo sapiens
ggguucccuucuggcucagggu

SEQ ID NO: 328234 - RNA, 22 nt, Homo sapiens
gguaaacauacugcugucuucu

SEQ ID NO: 328235 - RNA, 22 nt, Homo sapiens
gguaaguuuggggcuaauuugu

SEQ ID NO: 328236 - RNA, 22 nt, Homo sapiens
gguagacaucgugcucugugau

SEQ ID NO: 328237 - RNA, 22 nt, Homo sapiens
gguauguuuagaccauuuacau

SEQ ID NO: 328238 - RNA, 22 nt, Homo sapiens
gguauuuaaaguaccugucugc

SEQ ID NO: 328239 - RNA, 22 nt, Homo sapiens
ggugagaaagggauuccuguuc

SEQ ID NO: 328240 - RNA, 22 nt, Homo sapiens
ggugagguaggaaaaguuagga

SEQ ID NO: 328241 - RNA, 22 nt, Homo sapiens
ggugagguaguaagguacaaua

SEQ ID NO: 328242 - RNA, 22 nt, Homo sapiens
ggugaucauugucucuaguaug

SEQ ID NO: 328243 - RNA, 20 nt, Homo sapiens
ugagcucaauuguugcaagu

SEQ ID NO: 328244 - RNA, 22 nt, Homo sapiens
ugagcucagcuaguugaggugu

SEQ ID NO: 328245 - RNA, 22 nt, Homo sapiens
ugagcugagaucuuaccacugc

SEQ ID NO: 328246 - RNA, 22 nt, Homo sapiens
ugagcugagauuaagcugcugc

SEQ ID NO: 328247 - RNA, 22 nt, Homo sapiens
ugagcugguacuaauauuauca

SEQ ID NO: 328248 - RNA, 20 nt, Homo sapiens
ugagcuuguaaacacuguuu

SEQ ID NO: 328249 - RNA, 18 nt, Homo sapiens
ugaggaaaggguuugcua

SEQ ID NO: 328250 - RNA, 22 nt, Homo sapiens
ugaggaauguguguuaaagaua

SEQ ID NO: 328251 - RNA, 22 nt, Homo sapiens
ugaggagugaacuauuucugau

SEQ ID NO: 328252 - RNA, 22 nt, Homo sapiens
ugaggcaagauacugauuucau

SEQ ID NO: 328253 - RNA, 22 nt, Homo sapiens
ugaggcaaggcugaaugaaggc

SEQ ID NO: 328254 - RNA, 22 nt, Homo sapiens
ugaggcuagucagaucagauga

SEQ ID NO: 328255 - RNA, 17 nt, Homo sapiens
ugagggaugccugguuc

SEQ ID NO: 328256 - RNA, 22 nt, Homo sapiens
ugagggaugcguacccuaugcc

SEQ ID NO: 328257 - RNA, 22 nt, Homo sapiens
ugagguaaugcuguagcuguga

SEQ ID NO: 328258 - RNA, 22 nt, Homo sapiens
ugagguagaaugauucuaauau

SEQ ID NO: 328259 - RNA, 22 nt, Homo sapiens
ugagguagaggugaacuugacc

SEQ ID NO: 328260 - RNA, 22 nt, Homo sapiens
ugagguagguaccauuaucacu

SEQ ID NO: 328261 - RNA, 22 nt, Homo sapiens
ugagguaggugaagaaugcacg

SEQ ID NO: 328262 - RNA, 19 nt, Homo sapiens
ugagguauuuguugggaga

SEQ ID NO: 328263 - RNA, 22 nt, Homo sapiens
ugaggugaaguaauauucuaag

SEQ ID NO: 328264 - RNA, 22 nt, Homo sapiens
uugguccauuacauugaugaca

SEQ ID NO: 328265 - RNA, 22 nt, Homo sapiens
uugguccccuucaaccagcugu

SEQ ID NO: 328266 - RNA, 19 nt, Homo sapiens
uuggucccuuuggguucuu

SEQ ID NO: 328267 - RNA, 23 nt, Homo sapiens
uuggucucccaaaguguugagau

SEQ ID NO: 328268 - RNA, 20 nt, Homo sapiens
uuggugaccuacagaugugg

SEQ ID NO: 328269 - RNA, 22 nt, Homo sapiens
uugguuccuuagccuaggacua

SEQ ID NO: 328270 - RNA, 22 nt, Homo sapiens
uuguaaacaucuguacauugcu

SEQ ID NO: 328271 - RNA, 22 nt, Homo sapiens
uuguaaaguucucucccgaaaa

SEQ ID NO: 328272 - RNA, 22 nt, Homo sapiens
uuguaaaguucuuaggaagcuc

SEQ ID NO: 328273 - RNA, 23 nt, Homo sapiens
uuguaacuggagaguaacauucc

SEQ ID NO: 328274 - RNA, 22 nt, Homo sapiens
uuguaagaaucuagcucuuuau

SEQ ID NO: 328275 - RNA, 22 nt, Homo sapiens
uuguaauguuaccaaauggugu

SEQ ID NO: 328276 - RNA, 20 nt, Homo sapiens
uuguacuccugggcucaagc

SEQ ID NO: 328277 - RNA, 22 nt, Homo sapiens
uuguaguagcauuauuuauaau

SEQ ID NO: 328278 - RNA, 22 nt, Homo sapiens
uuguaguguuuauucugucaac

SEQ ID NO: 328279 - RNA, 21 nt, Homo sapiens
uuguaugguugaacuugauac

SEQ ID NO: 328280 - RNA, 22 nt, Homo sapiens
uuguaugucuucauuugaaaaa

SEQ ID NO: 328281 - RNA, 22 nt, Homo sapiens
uuguauguugaaugaugguaua

SEQ ID NO: 328282 - RNA, 22 nt, Homo sapiens
uuguauguuguuugucagagaa

SEQ ID NO: 328283 - RNA, 22 nt, Homo sapiens
uugucaacaugaaacuguguuu

SEQ ID NO: 328284 - RNA, 22 nt, Homo sapiens
uugucacccucucuuggugucu

SEQ ID NO: 328285 - RNA, 19 nt, Homo sapiens
uuguccccucuaaaucuca

SEQ ID NO: 328286 - RNA, 22 nt, Homo sapiens
uuguccccuuccaaaucucaug

SEQ ID NO: 328287 - RNA, 22 nt, Homo sapiens
uugucuagugaauacauuaaug

SEQ ID NO: 328288 - RNA, 22 nt, Homo sapiens
uugugaauggugccgcgauaaa

SEQ ID NO: 328289 - RNA, 22 nt, Homo sapiens
uugugagggagcuaagaugagu

SEQ ID NO: 328290 - RNA, 22 nt, Homo sapiens
uugugauugagugauccuuguu

SEQ ID NO: 328291 - RNA, 21 nt, Homo sapiens
uugugccaaacccuggaggga

SEQ ID NO: 328292 - RNA, 22 nt, Homo sapiens
uugugccauucuucugccucag

SEQ ID NO: 328293 - RNA, 22 nt, Homo sapiens
uugugccccuucucagucgggc

SEQ ID NO: 328294 - RNA, 18 nt, Homo sapiens
uugugccugagaaggugg

SEQ ID NO: 328295 - RNA, 22 nt, Homo sapiens
uugugccugguacauggagaaa

SEQ ID NO: 328296 - RNA, 22 nt, Homo sapiens
uugugcuccuaugagaaucuaa

SEQ ID NO: 328297 - RNA, 22 nt, Homo sapiens
uugugcuuaaugaguguaaggu

SEQ ID NO: 328298 - RNA, 22 nt, Homo sapiens
uugugcuuuuuaaauagcuucc

SEQ ID NO: 328299 - RNA, 18 nt, Homo sapiens
uuguggccccuacaaauu

SEQ ID NO: 328300 - RNA, 22 nt, Homo sapiens
uuguggcuuaucucauuuagcg

SEQ ID NO: 328301 - RNA, 19 nt, Homo sapiens
uugugggaggacagagggg

SEQ ID NO: 328302 - RNA, 22 nt, Homo sapiens
uugugguaggaugaagagauga

SEQ ID NO: 328303 - RNA, 22 nt, Homo sapiens
uugugguuuuagcacuguggau

SEQ ID NO: 328304 - RNA, 22 nt, Homo sapiens
uuguguccccacucaaauuaca

SEQ ID NO: 328305 - RNA, 22 nt, Homo sapiens
uuguuaagaugcagauucugga

SEQ ID NO: 328306 - RNA, 22 nt, Homo sapiens
uuguuauguuaaacuacugaaa

SEQ ID NO: 328307 - RNA, 17 nt, Homo sapiens
uuguucccauuaaaaag

SEQ ID NO: 328308 - RNA, 22 nt, Homo sapiens
uuuaaacugucuuggguuugga

SEQ ID NO: 328309 - RNA, 22 nt, Homo sapiens
uuuaaaguuagaaggaaagggc

SEQ ID NO: 328310 - RNA, 23 nt, Homo sapiens
uuuaagcuucauguccuaacauc

SEQ ID NO: 328311 - RNA, 22 nt, Homo sapiens
uuuaaggcacuucaugguuuca

SEQ ID NO: 328312 - RNA, 22 nt, Homo sapiens
uuuaaggcaggucuggugguga

SEQ ID NO: 328313 - RNA, 22 nt, Homo sapiens
uuuaaggcaugccuguacaugc

SEQ ID NO: 328314 - RNA, 22 nt, Homo sapiens
uuuaagguauguggugaaaauu

SEQ ID NO: 328315 - RNA, 22 nt, Homo sapiens
uuuaaugcaucccaaaauguag

SEQ ID NO: 328316 - RNA, 18 nt, Homo sapiens
uuuacaguagaaggacuu

SEQ ID NO: 328317 - RNA, 22 nt, Homo sapiens
uuuacagucucauagguggaag

SEQ ID NO: 328318 - RNA, 22 nt, Homo sapiens
uuuagcaaagcaauuuacacca

SEQ ID NO: 328319 - RNA, 22 nt, Homo sapiens
uuuagcaaugcuguggggaagu

SEQ ID NO: 328320 - RNA, 22 nt, Homo sapiens
uuuagcagcaaagagccaugcu

SEQ ID NO: 328321 - RNA, 22 nt, Homo sapiens
uuuagcagcaaagagcuguguu

SEQ ID NO: 328322 - RNA, 22 nt, Homo sapiens
uuuaggcaugcaguucuauuua

SEQ ID NO: 328323 - RNA, 22 nt, Homo sapiens
uuuagguaauauuaaguagcug

SEQ ID NO: 328324 - RNA, 23 nt, Homo sapiens
uuuaguccccuaugagcuggugu

SEQ ID NO: 328325 - RNA, 22 nt, Homo sapiens
uuuaugguuuucugggagauug

SEQ ID NO: 328326 - RNA, 22 nt, Homo sapiens
uuucaacuaauuuuuuggugag

SEQ ID NO: 328327 - RNA, 22 nt, Homo sapiens
uuucaccguguuggccaggcug

SEQ ID NO: 328328 - RNA, 22 nt, Homo sapiens
uuucacuagccagcccuuuauu

SEQ ID NO: 328329 - RNA, 22 nt, Homo sapiens
uuucagagucaucugcccaagu

SEQ ID NO: 328330 - RNA, 17 nt, Homo sapiens
uuucagaguggaagugu

SEQ ID NO: 328331 - RNA, 22 nt, Homo sapiens
uuucaggcaagggugacccuga

SEQ ID NO: 328332 - RNA, 23 nt, Homo sapiens
uuucaguaguuguauccuguugc

SEQ ID NO: 328333 - RNA, 22 nt, Homo sapiens
uuucauagccuuugucgucuga

SEQ ID NO: 328334 - RNA, 22 nt, Homo sapiens
uuucaucaagcacagaguagau

SEQ ID NO: 328335 - RNA, 22 nt, Homo sapiens
uuucauggaauauagucauuuu

SEQ ID NO: 328336 - RNA, 22 nt, Homo sapiens
uuucauggacgcaaugccuuuu

SEQ ID NO: 328337 - RNA, 22 nt, Homo sapiens
uuucauguuuuucugugaggca

SEQ ID NO: 328338 - RNA, 22 nt, Homo sapiens
uuuccaagaugcuuacuuucuc

SEQ ID NO: 328339 - RNA, 22 nt, Homo sapiens
uuuccagguggccaacauuuua

SEQ ID NO: 328340 - RNA, 22 nt, Homo sapiens
uuuccaguuuggaggaugcauu

SEQ ID NO: 328341 - RNA, 22 nt, Homo sapiens
uuucccagugguacaguuuaua

SEQ ID NO: 328342 - RNA, 22 nt, Homo sapiens
uuucccauuguucugcucugug

SEQ ID NO: 328343 - RNA, 22 nt, Homo sapiens
uuucccuuuagcuuagugauuu

SEQ ID NO: 328344 - RNA, 16 nt, Homo sapiens
uuucccuuugguguuu

SEQ ID NO: 328345 - RNA, 21 nt, Homo sapiens
uuuccuggagcguauggcuuc

SEQ ID NO: 328346 - RNA, 22 nt, Homo sapiens
uuuccuguaggaaggaaauaga

SEQ ID NO: 328347 - RNA, 22 nt, Homo sapiens
uuucuacagggcuugccaggua

SEQ ID NO: 328348 - RNA, 16 nt, Homo sapiens
uuucuauguuuuacua

SEQ ID NO: 328349 - RNA, 22 nt, Homo sapiens
uuucugagaccaaaacuuguaa

SEQ ID NO: 328350 - RNA, 21 nt, Homo sapiens
uuucugggggagcauggcagg

SEQ ID NO: 328351 - RNA, 22 nt, Homo sapiens
uuucugggggugcugauggaaa

SEQ ID NO: 328352 - RNA, 22 nt, Homo sapiens
uuugaaguguggcacugaguuu

SEQ ID NO: 328353 - RNA, 22 nt, Homo sapiens
uuugaaugcaacaaaugcggga

SEQ ID NO: 328354 - RNA, 20 nt, Homo sapiens
uuugaauguaaagcauguca

SEQ ID NO: 328355 - RNA, 22 nt, Homo sapiens
uuugagcauguaguuuaacccu

SEQ ID NO: 328356 - RNA, 22 nt, Homo sapiens
uuugagcuugacucagcuggag

SEQ ID NO: 328357 - RNA, 23 nt, Homo sapiens
uuugagugugauaaacacuguca

SEQ ID NO: 328358 - RNA, 22 nt, Homo sapiens
guagcaucauuugcaauuucau

SEQ ID NO: 328359 - RNA, 22 nt, Homo sapiens
guagugcaguuugagaaucagu

SEQ ID NO: 328360 - RNA, 22 nt, Homo sapiens
guaguggcaugaucuuggcuca

SEQ ID NO: 328361 - RNA, 22 nt, Homo sapiens
guauaaguugacucaaucuuug

SEQ ID NO: 328362 - RNA, 22 nt, Homo sapiens
guaucauuggcauguaaccaga

SEQ ID NO: 328363 - RNA, 22 nt, Homo sapiens
guauccugaaguucucagcacu

SEQ ID NO: 328364 - RNA, 22 nt, Homo sapiens
guaugacacaggaagcuuaacc

SEQ ID NO: 328365 - RNA, 22 nt, Homo sapiens
guaugcaagugauaugacauau

SEQ ID NO: 328366 - RNA, 22 nt, Homo sapiens
guaugcacauauguguauguau

SEQ ID NO: 328367 - RNA, 22 nt, Homo sapiens
guauggaagucaguuuguuggc

SEQ ID NO: 328368 - RNA, 22 nt, Homo sapiens
guauggcauuuguggauuggcc

SEQ ID NO: 328369 - RNA, 22 nt, Homo sapiens
guauggguuuuguuucuucugg

SEQ ID NO: 328370 - RNA, 22 nt, Homo sapiens
guauuagguuggggcaaaagua

SEQ ID NO: 328371 - RNA, 22 nt, Homo sapiens
guauugaguaaauguuuauugg

SEQ ID NO: 328372 - RNA, 22 nt, Homo sapiens
guauugcuugagcccaggaguu

SEQ ID NO: 328373 - RNA, 22 nt, Homo sapiens
gucaaguaaauguuaugguuau

SEQ ID NO: 328374 - RNA, 22 nt, Homo sapiens
gucaauguaucuagcuguauua

SEQ ID NO: 328375 - RNA, 22 nt, Homo sapiens
gucacagaggcuaagaccccac

SEQ ID NO: 328376 - RNA, 22 nt, Homo sapiens
gucacugagaagguuaguuugu

SEQ ID NO: 328377 - RNA, 22 nt, Homo sapiens
gucagagcacugaguugugggc

SEQ ID NO: 328378 - RNA, 22 nt, Homo sapiens
gucagaugcagauuccaguucu

SEQ ID NO: 328379 - RNA, 22 nt, Homo sapiens
gucagcaaaguucuccugcaga

SEQ ID NO: 328380 - RNA, 22 nt, Homo sapiens
gucagcuuuuccuuacuuuagg

SEQ ID NO: 328381 - RNA, 22 nt, Homo sapiens
gucaggaccucgguggcauucu

SEQ ID NO: 328382 - RNA, 22 nt, Homo sapiens
gucaggcaccgauacaguuuuu

SEQ ID NO: 328383 - RNA, 22 nt, Homo sapiens
gucagggagggauagaugauua

SEQ ID NO: 328384 - RNA, 22 nt, Homo sapiens
gucagugcuuuaguucaggaug

SEQ ID NO: 328385 - RNA, 22 nt, Homo sapiens
gucagugucuuaacagagauua

SEQ ID NO: 328386 - RNA, 22 nt, Homo sapiens
gucagugucuuugcagcucaga

SEQ ID NO: 328387 - RNA, 22 nt, Homo sapiens
gucagugugauaucugcagggg

SEQ ID NO: 328388 - RNA, 22 nt, Homo sapiens
gucaguuucacucagcuggaac

SEQ ID NO: 328389 - RNA, 22 nt, Homo sapiens
gucaguuugguuaaucauucca

SEQ ID NO: 328390 - RNA, 22 nt, Homo sapiens
gucauauaggguuuaccuguau

SEQ ID NO: 328391 - RNA, 22 nt, Homo sapiens
gucauaugcucggaaaauguua

SEQ ID NO: 328392 - RNA, 22 nt, Homo sapiens
gucauggacaaggugugagcca

SEQ ID NO: 328393 - RNA, 22 nt, Homo sapiens
gucauggagggacauaacuaac

SEQ ID NO: 328394 - RNA, 22 nt, Homo sapiens
gucauuguguggacauggagaa

SEQ ID NO: 328395 - RNA, 22 nt, Homo sapiens
guccaguguuggagguuuuacc

SEQ ID NO: 328396 - RNA, 22 nt, Homo sapiens
guccauuuguuuccagagcacu

SEQ ID NO: 328397 - RNA, 22 nt, Homo sapiens
gucccugaggaacauccagggc

SEQ ID NO: 328398 - RNA, 22 nt, Homo sapiens
gucccugugucuuuauguggcc

SEQ ID NO: 328399 - RNA, 22 nt, Homo sapiens
guccuguuuuuaagguucauag

SEQ ID NO: 328400 - RNA, 22 nt, Homo sapiens
guccuugaggcuuugacugugg

SEQ ID NO: 328401 - RNA, 22 nt, Homo sapiens
gucguggagucucuggcuugua

SEQ ID NO: 328402 - RNA, 22 nt, Homo sapiens
gucuaugguucaggguggagug

SEQ ID NO: 328403 - RNA, 22 nt, Homo sapiens
gucucacagcuagcugcuuuau

SEQ ID NO: 328404 - RNA, 18 nt, Homo sapiens
gucucacaugguggaagc

SEQ ID NO: 328405 - RNA, 22 nt, Homo sapiens
gucugcaugucauaugauagua

SEQ ID NO: 328406 - RNA, 22 nt, Homo sapiens
gucuggcuccuucuacuacaug

SEQ ID NO: 328407 - RNA, 22 nt, Homo sapiens
gucuguuuggggaccuguggcc

SEQ ID NO: 328408 - RNA, 22 nt, Homo sapiens
gucuugaaggcugaguaccugu

SEQ ID NO: 328409 - RNA, 22 nt, Homo sapiens
gucuuugcuuuuaaccagaggu

SEQ ID NO: 328410 - RNA, 22 nt, Homo sapiens
gucuuuggaaaaaaugucuguu

SEQ ID NO: 328411 - RNA, 22 nt, Homo sapiens
gucuuuggaaagacaaaguuca

SEQ ID NO: 328412 - RNA, 22 nt, Homo sapiens
gucuuuugcuagccagagagcu

SEQ ID NO: 328413 - RNA, 22 nt, Homo sapiens
gugaaagauuaaaccagugugu

SEQ ID NO: 328414 - RNA, 22 nt, Homo sapiens
gugaaauacauaaucccaagug

SEQ ID NO: 328415 - RNA, 22 nt, Homo sapiens
gugaaauauuuaacguccaggu

SEQ ID NO: 328416 - RNA, 17 nt, Homo sapiens
gugaaaucaucauuuuu

SEQ ID NO: 328417 - RNA, 22 nt, Homo sapiens
gugaaaugaaucuggaaauauu

SEQ ID NO: 328418 - RNA, 22 nt, Homo sapiens
gugaacuguuugaggaagagaa

SEQ ID NO: 328419 - RNA, 22 nt, Homo sapiens
gugaagaucccuguccuguucc

SEQ ID NO: 328420 - RNA, 22 nt, Homo sapiens
gugaagaugugcaucagaucca

SEQ ID NO: 328421 - RNA, 22 nt, Homo sapiens
gugaagugugaccucagcaucu

SEQ ID NO: 328422 - RNA, 22 nt, Homo sapiens
gugaaguuuuuugcugagaguc

SEQ ID NO: 328423 - RNA, 22 nt, Homo sapiens
gugaaucauaugccagucaugc

SEQ ID NO: 328424 - RNA, 20 nt, Homo sapiens
gugacacucguuaaccucug

SEQ ID NO: 328425 - RNA, 22 nt, Homo sapiens
ugcaguguucuuuagaggaaau

SEQ ID NO: 328426 - RNA, 22 nt, Homo sapiens
ugcauaauuccuugcaccagaa

SEQ ID NO: 328427 - RNA, 22 nt, Homo sapiens
ugcauagcauauauuguagagu

SEQ ID NO: 328428 - RNA, 19 nt, Homo sapiens
ugcauaggguuacauacuc

SEQ ID NO: 328429 - RNA, 22 nt, Homo sapiens
ugcauauguucaaaguauucug

SEQ ID NO: 328430 - RNA, 18 nt, Homo sapiens
ugcauauguugaaccagc

SEQ ID NO: 328431 - RNA, 22 nt, Homo sapiens
ugcauauguugaaccagccuug

SEQ ID NO: 328432 - RNA, 22 nt, Homo sapiens
ugcauauguugagaugcauauu

SEQ ID NO: 328433 - RNA, 22 nt, Homo sapiens
ugcauauucgaguuauuuuggg

SEQ ID NO: 328434 - RNA, 21 nt, Homo sapiens
ugcauauuggaacuuucucuc

SEQ ID NO: 328435 - RNA, 21 nt, Homo sapiens
ugcauggagaacacugagggu

SEQ ID NO: 328436 - RNA, 22 nt, Homo sapiens
ugcauggaggagcuccccgcag

SEQ ID NO: 328437 - RNA, 22 nt, Homo sapiens
ugcauuguuuuugguucccagg

SEQ ID NO: 328438 - RNA, 19 nt, Homo sapiens
ugccaagaaagucagcuua

SEQ ID NO: 328439 - RNA, 20 nt, Homo sapiens
ugccaagaaaugaggguauu

SEQ ID NO: 328440 - RNA, 22 nt, Homo sapiens
ugccaagauuucaggaauuaag

SEQ ID NO: 328441 - RNA, 22 nt, Homo sapiens
ugccagaugcuggugugagggg

SEQ ID NO: 328442 - RNA, 22 nt, Homo sapiens
ugccaguauuuuguugaggauu

SEQ ID NO: 328443 - RNA, 22 nt, Homo sapiens
ugccaguguuuuguugaagauu

SEQ ID NO: 328444 - RNA, 22 nt, Homo sapiens
ugccaugaagaucccugaaaug

SEQ ID NO: 328445 - RNA, 22 nt, Homo sapiens
ugccaugucauagguuaagccu

SEQ ID NO: 328446 - RNA, 22 nt, Homo sapiens
ugccauugcacuccagccuggg

SEQ ID NO: 328447 - RNA, 22 nt, Homo sapiens
ugccuaggcuggagugcagugg

SEQ ID NO: 328448 - RNA, 20 nt, Homo sapiens
ugccugacacucuuugcuuc

SEQ ID NO: 328449 - RNA, 22 nt, Homo sapiens
ugccuucuguuaaacgaggaug

SEQ ID NO: 328450 - RNA, 16 nt, Homo sapiens
ugccuucuucuguauu

SEQ ID NO: 328451 - RNA, 21 nt, Homo sapiens
ugccuuuguaguaggugucuu

SEQ ID NO: 328452 - RNA, 22 nt, Homo sapiens
ucagaucaugcuuaugauggga

SEQ ID NO: 328453 - RNA, 22 nt, Homo sapiens
ucagaucauuaagguagguuua

SEQ ID NO: 328454 - RNA, 22 nt, Homo sapiens
ucagauguuuuguuuaucugcu

SEQ ID NO: 328455 - RNA, 22 nt, Homo sapiens
ucagcagucacuccuaugacaa

SEQ ID NO: 328456 - RNA, 22 nt, Homo sapiens
ucagcagugccccacucuacug

SEQ ID NO: 328457 - RNA, 22 nt, Homo sapiens
ucaggcacucagcuuagagucu

SEQ ID NO: 328458 - RNA, 20 nt, Homo sapiens
ucaggcuccgcauuaacuua

SEQ ID NO: 328459 - RNA, 21 nt, Homo sapiens
ucaggcuuuuugagugccaau

SEQ ID NO: 328460 - RNA, 22 nt, Homo sapiens
ucagggacuuacaaaccagaag

SEQ ID NO: 328461 - RNA, 20 nt, Homo sapiens
ucagguagggcuucaacauu

SEQ ID NO: 328462 - RNA, 22 nt, Homo sapiens
ucagguauuuauagcaaugcaa

SEQ ID NO: 328463 - RNA, 22 nt, Homo sapiens
ucagguauuucuuuuagcugug

SEQ ID NO: 328464 - RNA, 22 nt, Homo sapiens
ucagguauuuuaucacaugaag

SEQ ID NO: 328465 - RNA, 22 nt, Homo sapiens
ucaggugcaguggcucugaccu

SEQ ID NO: 328466 - RNA, 22 nt, Homo sapiens
ucagguugcuaaguauaauauu

SEQ ID NO: 328467 - RNA, 22 nt, Homo sapiens
ucaguaaaugcuguucucuuuu

SEQ ID NO: 328468 - RNA, 23 nt, Homo sapiens
ucaguacuccacuuucaauagug

SEQ ID NO: 328469 - RNA, 22 nt, Homo sapiens
ucaguagcaugaaaacagacua

SEQ ID NO: 328470 - RNA, 22 nt, Homo sapiens
ucaguaguaaauggauuuggaa

SEQ ID NO: 328471 - RNA, 22 nt, Homo sapiens
ucaguauaugaaucuggggcag

SEQ ID NO: 328472 - RNA, 22 nt, Homo sapiens
ucagucauugauggaguagguc

SEQ ID NO: 328473 - RNA, 22 nt, Homo sapiens
ucagugaacgaggaggagggug

SEQ ID NO: 328474 - RNA, 22 nt, Homo sapiens
ucagugaauauauaacagcgau

SEQ ID NO: 328475 - RNA, 22 nt, Homo sapiens
ucagugauugguuauuuuaggc

SEQ ID NO: 328476 - RNA, 21 nt, Homo sapiens
ucagugcaauucuauggggaa

SEQ ID NO: 328477 - RNA, 22 nt, Homo sapiens
ucagugcaggaauuuccuuaga

SEQ ID NO: 328478 - RNA, 19 nt, Homo sapiens
ucagugcuauguaauguag

SEQ ID NO: 328479 - RNA, 22 nt, Homo sapiens
ucaguggagccucacucugugg

SEQ ID NO: 328480 - RNA, 22 nt, Homo sapiens
ucaguggauuauuaaagucacc

SEQ ID NO: 328481 - RNA, 22 nt, Homo sapiens
ucaguguuuggaaucucaauuu

SEQ ID NO: 328482 - RNA, 22 nt, Homo sapiens
ucaguucauggaggugucugcu

SEQ ID NO: 328483 - RNA, 22 nt, Homo sapiens
ucauacaggccaccagggaagu

SEQ ID NO: 328484 - RNA, 22 nt, Homo sapiens
ucauacuguugugaaacaaaac

SEQ ID NO: 328485 - RNA, 22 nt, Homo sapiens
ucauaggucacuguaaccucgu

SEQ ID NO: 328486 - RNA, 22 nt, Homo sapiens
ucauaguagucacuuaauaaau

SEQ ID NO: 328487 - RNA, 22 nt, Homo sapiens
ucauaugucauaguaugaucuu

SEQ ID NO: 328488 - RNA, 22 nt, Homo sapiens
ucauauugcgguucauugacuu

SEQ ID NO: 328489 - RNA, 16 nt, Homo sapiens
ucaucacagucucugg

SEQ ID NO: 328490 - RNA, 21 nt, Homo sapiens
ucaucagucaaagacaauggu

SEQ ID NO: 328491 - RNA, 22 nt, Homo sapiens
ucaucaguggggaugugguuga

SEQ ID NO: 328492 - RNA, 22 nt, Homo sapiens
ucauccauacaguuagcaaagg

SEQ ID NO: 328493 - RNA, 22 nt, Homo sapiens
ucaucuggcgaaugugaagagu

SEQ ID NO: 328494 - RNA, 23 nt, Homo sapiens
ucaugaggccauucaaauccauu

SEQ ID NO: 328495 - RNA, 20 nt, Homo sapiens
uugagaucuguaucugguuu

SEQ ID NO: 328496 - RNA, 22 nt, Homo sapiens
uugagauggagucucacuccuu

SEQ ID NO: 328497 - RNA, 22 nt, Homo sapiens
uugagauggagucucacucugc

SEQ ID NO: 328498 - RNA, 22 nt, Homo sapiens
uugagauggagucucacucuuc

SEQ ID NO: 328499 - RNA, 22 nt, Homo sapiens
uugagauggagucucgcugugu

SEQ ID NO: 328500 - RNA, 22 nt, Homo sapiens
uugagauggagucuugcucucu

SEQ ID NO: 328501 - RNA, 22 nt, Homo sapiens
uugagauggagucuuguucucu

SEQ ID NO: 328502 - RNA, 22 nt, Homo sapiens
uugagauggagucuuguucuuu

SEQ ID NO: 328503 - RNA, 22 nt, Homo sapiens
uugagauggaguguugcucugu

SEQ ID NO: 328504 - RNA, 22 nt, Homo sapiens
uugagauggaguucauuuuugu

SEQ ID NO: 328505 - RNA, 22 nt, Homo sapiens
uugagauggaguuucaauauug

SEQ ID NO: 328506 - RNA, 22 nt, Homo sapiens
uugagauggauagacauagcau

SEQ ID NO: 328507 - RNA, 22 nt, Homo sapiens
uugagauguaguuucacuccug

SEQ ID NO: 328508 - RNA, 22 nt, Homo sapiens
uugagauuauuguguuccuuua

SEQ ID NO: 328509 - RNA, 21 nt, Homo sapiens
uugagcaacuaggguuauagg

SEQ ID NO: 328510 - RNA, 22 nt, Homo sapiens
uugagcaaugaacgauucaggg

SEQ ID NO: 328511 - RNA, 22 nt, Homo sapiens
uugagcccuggaggcagaggcu

SEQ ID NO: 328512 - RNA, 22 nt, Homo sapiens
uugagcucuuccagccuggagc

SEQ ID NO: 328513 - RNA, 22 nt, Homo sapiens
uugaggaaugucauuuguguuu

SEQ ID NO: 328514 - RNA, 22 nt, Homo sapiens
uugaggacugcuaagcauuuga

SEQ ID NO: 328515 - RNA, 22 nt, Homo sapiens
uugaggacugguugaaagcuuu

SEQ ID NO: 328516 - RNA, 22 nt, Homo sapiens
uugaggaggcagucugcccauu

SEQ ID NO: 328517 - RNA, 22 nt, Homo sapiens
uugaggaggcagucuguccguu

SEQ ID NO: 328518 - RNA, 22 nt, Homo sapiens
uugaggaguacugauuagguau

SEQ ID NO: 328519 - RNA, 22 nt, Homo sapiens
uugagggaggccucaguuuaca

SEQ ID NO: 328520 - RNA, 22 nt, Homo sapiens
uugaggguggcauauauugauu

SEQ ID NO: 328521 - RNA, 22 nt, Homo sapiens
uugagguaauaaacagccauuc

SEQ ID NO: 328522 - RNA, 22 nt, Homo sapiens
uugagguagcuuugauggaggu

SEQ ID NO: 328523 - RNA, 22 nt, Homo sapiens
uugaggucagagguucgagacc

SEQ ID NO: 328524 - RNA, 22 nt, Homo sapiens
uugaguagauaccuaggaauag

SEQ ID NO: 328525 - RNA, 22 nt, Homo sapiens
uugaguaguaagugguucaccg

SEQ ID NO: 328526 - RNA, 22 nt, Homo sapiens
uugaguagugugaugcaugucu

SEQ ID NO: 328527 - RNA, 22 nt, Homo sapiens
uugaguccccacacuggguccc

SEQ ID NO: 328528 - RNA, 22 nt, Homo sapiens
uugaguuuaucuaaagaccugg

SEQ ID NO: 328529 - RNA, 22 nt, Homo sapiens
uugaguuugaguauucuaaagc

SEQ ID NO: 328530 - RNA, 22 nt, Homo sapiens
uugauaacauucugcauccuau

SEQ ID NO: 328531 - RNA, 22 nt, Homo sapiens
uugauaauguuaacuuugguca

SEQ ID NO: 328532 - RNA, 22 nt, Homo sapiens
uugauacuagagucuuucugac

SEQ ID NO: 328533 - RNA, 22 nt, Homo sapiens
uugauagacacauauccaugug

SEQ ID NO: 328534 - RNA, 22 nt, Homo sapiens
uugauagaucagggauuugauu

SEQ ID NO: 328535 - RNA, 22 nt, Homo sapiens
uugauaguaccauugggaaauu

SEQ ID NO: 328536 - RNA, 22 nt, Homo sapiens
uugauaguguccucuuuggcag

SEQ ID NO: 328537 - RNA, 22 nt, Homo sapiens
uugauauucuuucuggauccca

SEQ ID NO: 328538 - RNA, 22 nt, Homo sapiens
uugaucugugucccugcccaau

SEQ ID NO: 328539 - RNA, 22 nt, Homo sapiens
uugauguccaucucuagguaaa

SEQ ID NO: 328540 - RNA, 22 nt, Homo sapiens
uugauuuguagaaugccccaac

SEQ ID NO: 328541 - RNA, 23 nt, Homo sapiens
uugcaaagccugaaacucuucag

SEQ ID NO: 328542 - RNA, 22 nt, Homo sapiens
uugcaaggugcagcuuaugcaa

SEQ ID NO: 328543 - RNA, 20 nt, Homo sapiens
uugcacagagaaggaggcag

SEQ ID NO: 328544 - RNA, 22 nt, Homo sapiens
uugcacagugcuuucuuugccc

SEQ ID NO: 328545 - RNA, 22 nt, Homo sapiens
auuaagugcuugcagaagucca

SEQ ID NO: 328546 - RNA, 22 nt, Homo sapiens
auuacuuugcaccaaccuaaua

SEQ ID NO: 328547 - RNA, 22 nt, Homo sapiens
auuagguagugagaugcugcug

SEQ ID NO: 328548 - RNA, 22 nt, Homo sapiens
auuagguuaggcaaacuucugu

SEQ ID NO: 328549 - RNA, 22 nt, Homo sapiens
auuagguuagugcaaaaguaau

SEQ ID NO: 328550 - RNA, 22 nt, Homo sapiens
auuagguuggugcaaaacuuuc

SEQ ID NO: 328551 - RNA, 22 nt, Homo sapiens
auuagguuguugcaaaaguaau

SEQ ID NO: 328552 - RNA, 22 nt, Homo sapiens
auuagugaaugugaugucuuga

SEQ ID NO: 328553 - RNA, 22 nt, Homo sapiens
auuauauguguaugugcauacc

SEQ ID NO: 328554 - RNA, 22 nt, Homo sapiens
auucaaagugcauguucccacu

SEQ ID NO: 328555 - RNA, 22 nt, Homo sapiens
auucaaggagucuucgucccaa

SEQ ID NO: 328556 - RNA, 23 nt, Homo sapiens
auucaaguagugagagugguuau

SEQ ID NO: 328557 - RNA, 22 nt, Homo sapiens
auucaagucaucucuccgcauu

SEQ ID NO: 328558 - RNA, 22 nt, Homo sapiens
auucaagugaugcagcuguuuu

SEQ ID NO: 328559 - RNA, 22 nt, Homo sapiens
auucacuuuuauagacaggucu

SEQ ID NO: 328560 - RNA, 22 nt, Homo sapiens
auuccacagccgauaccaugac

SEQ ID NO: 328561 - RNA, 22 nt, Homo sapiens
auuccacaguuaacacagaccg

SEQ ID NO: 328562 - RNA, 22 nt, Homo sapiens
auuccacuuacaugaaguaccu

SEQ ID NO: 328563 - RNA, 22 nt, Homo sapiens
auuccacuuccacuaguuucuc

SEQ ID NO: 328564 - RNA, 22 nt, Homo sapiens
auuccaguggguuuacauccca

SEQ ID NO: 328565 - RNA, 22 nt, Homo sapiens
auucuugcuugaacuuggugca

SEQ ID NO: 328566 - RNA, 22 nt, Homo sapiens
auugaacacagaguagcuuucc

SEQ ID NO: 328567 - RNA, 23 nt, Homo sapiens
auugaacacuuucauaugugagg

SEQ ID NO: 328568 - RNA, 22 nt, Homo sapiens
auugacuugauauauagcugau

SEQ ID NO: 328569 - RNA, 22 nt, Homo sapiens
auugagcaauuccuaugugcuu

SEQ ID NO: 328570 - RNA, 21 nt, Homo sapiens
auugagcacaugaaacauggc

SEQ ID NO: 328571 - RNA, 22 nt, Homo sapiens
auugagcacugacucugugcca

SEQ ID NO: 328572 - RNA, 22 nt, Homo sapiens
auugagguauaauugcuaugca

SEQ ID NO: 328573 - RNA, 22 nt, Homo sapiens
auugauagaucauaugguaggu

SEQ ID NO: 328574 - RNA, 22 nt, Homo sapiens
auugcaacaguguugagaggug

SEQ ID NO: 328575 - RNA, 22 nt, Homo sapiens
auugcacaaagagggaaacuga

SEQ ID NO: 328576 - RNA, 22 nt, Homo sapiens
auugcacuccacccugggcaac

SEQ ID NO: 328577 - RNA, 22 nt, Homo sapiens
auugcacuccagcccugcugac

SEQ ID NO: 328578 - RNA, 22 nt, Homo sapiens
auugcacuccagccugagcaaa

SEQ ID NO: 328579 - RNA, 22 nt, Homo sapiens
auugcacuccagccuggaugac

SEQ ID NO: 328580 - RNA, 22 nt, Homo sapiens
auugcacuccagccuggcagca

SEQ ID NO: 328581 - RNA, 22 nt, Homo sapiens
auugcacuccagccugggcagc

SEQ ID NO: 328582 - RNA, 22 nt, Homo sapiens
auugcacuccagccuggggaac

SEQ ID NO: 328583 - RNA, 22 nt, Homo sapiens
auugcacuccagccugggugac

SEQ ID NO: 328584 - RNA, 22 nt, Homo sapiens
auugcacuccagccuggugaca

SEQ ID NO: 328585 - RNA, 22 nt, Homo sapiens
auugcacuccagccuugugaca

SEQ ID NO: 328586 - RNA, 22 nt, Homo sapiens
auugcacuccagucugggcaac

SEQ ID NO: 328587 - RNA, 22 nt, Homo sapiens
auugcacuccauccuaggugac

SEQ ID NO: 328588 - RNA, 22 nt, Homo sapiens
auugcacuggggguuagaauuu

SEQ ID NO: 328589 - RNA, 22 nt, Homo sapiens
auugcagcuugcagggugugua

SEQ ID NO: 328590 - RNA, 23 nt, Homo sapiens
auugcagucuugaacuccugggc

SEQ ID NO: 328591 - RNA, 22 nt, Homo sapiens
auugcaguuucaacuccagggc

SEQ ID NO: 328592 - RNA, 22 nt, Homo sapiens
auugcauaaacacauuucuuau

SEQ ID NO: 328593 - RNA, 22 nt, Homo sapiens
auugcccaggcuggagugcagu

SEQ ID NO: 328594 - RNA, 22 nt, Homo sapiens
auugcuaacugaaauaagacca

SEQ ID NO: 328595 - RNA, 22 nt, Homo sapiens
auugcugagacauugcuaaucu

SEQ ID NO: 328596 - RNA, 22 nt, Homo sapiens
auuggccaaugggacgucagca

SEQ ID NO: 328597 - RNA, 22 nt, Homo sapiens
auuggcuauuuggugagugauu

SEQ ID NO: 328598 - RNA, 22 nt, Homo sapiens
auuggucuugaaaccagagaga

SEQ ID NO: 328599 - RNA, 22 nt, Homo sapiens
auuguacauacaccggugugua

SEQ ID NO: 328600 - RNA, 22 nt, Homo sapiens
auuguaccccaauguacaauau

SEQ ID NO: 328601 - RNA, 22 nt, Homo sapiens
auuguacuccagccugggcagc

SEQ ID NO: 328602 - RNA, 22 nt, Homo sapiens
auuguacuccagccugggcuaa

SEQ ID NO: 328603 - RNA, 22 nt, Homo sapiens
auuguacuccagccugggcugc

SEQ ID NO: 328604 - RNA, 22 nt, Homo sapiens
auuguacuccagccugggugac

SEQ ID NO: 328605 - RNA, 22 nt, Homo sapiens
auuguacuccagccuguggagc

SEQ ID NO: 328606 - RNA, 22 nt, Homo sapiens
auuguacuccagccuuggggac

SEQ ID NO: 328607 - RNA, 22 nt, Homo sapiens
auuguacugccccccuguugcu

SEQ ID NO: 328608 - RNA, 22 nt, Homo sapiens
auuguacuuauugccagaauuu

SEQ ID NO: 328609 - RNA, 22 nt, Homo sapiens
auuguaguuugcuauggcaaua

SEQ ID NO: 328610 - RNA, 22 nt, Homo sapiens
auugucacuuaaaagugcaugu

SEQ ID NO: 328611 - RNA, 22 nt, Homo sapiens
auugucauuuauaacuguguag

SEQ ID NO: 328612 - RNA, 22 nt, Homo sapiens
auugugauggucaaaggaaaua

SEQ ID NO: 328613 - RNA, 22 nt, Homo sapiens
auuguguuugaaugaggcucca

SEQ ID NO: 328614 - RNA, 22 nt, Homo sapiens
auuuagcaauggagguagugua

SEQ ID NO: 328615 - RNA, 19 nt, Homo sapiens
auuuccuggagcuggucuc

SEQ ID NO: 328616 - RNA, 22 nt, Homo sapiens
auuugacacugagagccucagu

SEQ ID NO: 328617 - RNA, 22 nt, Homo sapiens
auuuggcaauuuugaagaugcc

SEQ ID NO: 328618 - RNA, 22 nt, Homo sapiens
auuuggcagugaagggaucaca

SEQ ID NO: 328619 - RNA, 20 nt, Homo sapiens
auuuggcauaguuuaagcaa

SEQ ID NO: 328620 - RNA, 22 nt, Homo sapiens
auuuggccuuuguaugcaguau

SEQ ID NO: 328621 - RNA, 22 nt, Homo sapiens
auuugggaaugugcauuauacu

SEQ ID NO: 328622 - RNA, 22 nt, Homo sapiens
auuugguaauauuuaaggacuu

SEQ ID NO: 328623 - RNA, 22 nt, Homo sapiens
auuugguagaguucgauaccug

SEQ ID NO: 328624 - RNA, 21 nt, Homo sapiens
auuugguggcugugugacacu

SEQ ID NO: 328625 - RNA, 22 nt, Homo sapiens
auuugguuauucaguuguucag

SEQ ID NO: 328626 - RNA, 21 nt, Homo sapiens
auuuuugcagagcugguagug

SEQ ID NO: 328627 - RNA, 22 nt, Homo sapiens
caaaagugauugcgguuuuugc

SEQ ID NO: 328628 - RNA, 22 nt, Homo sapiens
caaagcuauagcaccagaggga

SEQ ID NO: 328629 - RNA, 22 nt, Homo sapiens
caaaguaauuacgguuuuggcc

SEQ ID NO: 328630 - RNA, 22 nt, Homo sapiens
caaaguaauugugguuuugcca

SEQ ID NO: 328631 - RNA, 22 nt, Homo sapiens
caaaugacaucauuucauucaa

SEQ ID NO: 328632 - RNA, 20 nt, Homo sapiens
caaauugcuuucuugguuuu

SEQ ID NO: 328633 - RNA, 22 nt, Homo sapiens
caacacagugaaacccgucucu

SEQ ID NO: 328634 - RNA, 22 nt, Homo sapiens
caacaguaaagcauuuuuaagu

SEQ ID NO: 328635 - RNA, 22 nt, Homo sapiens
caacucuguaggauccaggugg

SEQ ID NO: 328636 - RNA, 22 nt, Homo sapiens
caagagaccugagugucauucu

SEQ ID NO: 328637 - RNA, 22 nt, Homo sapiens
caagagagcugaugguuuuaaa

SEQ ID NO: 328638 - RNA, 22 nt, Homo sapiens
cuauguaccuggaacuguauua

SEQ ID NO: 328639 - RNA, 22 nt, Homo sapiens
cuaugucuuucauauuuugggg

SEQ ID NO: 328640 - RNA, 22 nt, Homo sapiens
cucaaagugcuaagauuaggcu

SEQ ID NO: 328641 - RNA, 22 nt, Homo sapiens
cucaaagugcugggauuggcca

SEQ ID NO: 328642 - RNA, 20 nt, Homo sapiens
cucacagacagcuucuuucu

SEQ ID NO: 328643 - RNA, 18 nt, Homo sapiens
cucacaguaacuuuuaag

SEQ ID NO: 328644 - RNA, 22 nt, Homo sapiens
cucacagucucucccuaauuuu

SEQ ID NO: 328645 - RNA, 22 nt, Homo sapiens
cucacagugacacgaaccccca

SEQ ID NO: 328646 - RNA, 22 nt, Homo sapiens
cucacaugcucaccugguguuc

SEQ ID NO: 328647 - RNA, 22 nt, Homo sapiens
cucaggcacucugauuccagug

SEQ ID NO: 328648 - RNA, 20 nt, Homo sapiens
cucagguauuugaggcugca

SEQ ID NO: 328649 - RNA, 22 nt, Homo sapiens
cucagugaagggcaagaggcaa

SEQ ID NO: 328650 - RNA, 20 nt, Homo sapiens
cucagugcacccccauaaaa

SEQ ID NO: 328651 - RNA, 22 nt, Homo sapiens
cucaguggauuagauaaugcac

SEQ ID NO: 328652 - RNA, 22 nt, Homo sapiens
cucagugucuggggccccaggg

SEQ ID NO: 328653 - RNA, 22 nt, Homo sapiens
cucaguguucccauucuaccuu

SEQ ID NO: 328654 - RNA, 21 nt, Homo sapiens
cucauauugcuuuuccauggu

SEQ ID NO: 328655 - RNA, 22 nt, Homo sapiens
cucauggagaaccucugcuagg

SEQ ID NO: 328656 - RNA, 22 nt, Homo sapiens
cuccacgugaaugccaaguauu

SEQ ID NO: 328657 - RNA, 23 nt, Homo sapiens
cucccugaacaugacacaccaga

SEQ ID NO: 328658 - RNA, 22 nt, Homo sapiens
cucccuuugcugaauguuuuuc

SEQ ID NO: 328659 - RNA, 22 nt, Homo sapiens
cucgagagaaaaugcuucacug

SEQ ID NO: 328660 - RNA, 20 nt, Homo sapiens
cucuaguaauaaaguuuccc

SEQ ID NO: 328661 - RNA, 22 nt, Homo sapiens
cucucugagccccagacaccuu

SEQ ID NO: 328662 - RNA, 22 nt, Homo sapiens
cucugacagugguuagcacugu

SEQ ID NO: 328663 - RNA, 22 nt, Homo sapiens
cucugagguuauucguaauauu

SEQ ID NO: 328664 - RNA, 22 nt, Homo sapiens
cucugauggagauauacaagga

SEQ ID NO: 328665 - RNA, 22 nt, Homo sapiens
cucugcuuaaugucccacuuga

SEQ ID NO: 328666 - RNA, 22 nt, Homo sapiens
cucugguggaagcagggggcaa

SEQ ID NO: 328667 - RNA, 20 nt, Homo sapiens
cucugguugugaauugucuu

SEQ ID NO: 328668 - RNA, 21 nt, Homo sapiens
cucugguuugcauuggauuau

SEQ ID NO: 328669 - RNA, 22 nt, Homo sapiens
cucugguuuuucuuccauuaag

SEQ ID NO: 328670 - RNA, 22 nt, Homo sapiens
cucuuagauuagccauccuaau

SEQ ID NO: 328671 - RNA, 22 nt, Homo sapiens
cucuuuaguaagcaguugauga

SEQ ID NO: 328672 - RNA, 22 nt, Homo sapiens
cucuuugaggugagcugcccau

SEQ ID NO: 328673 - RNA, 22 nt, Homo sapiens
cucuuuggaugccuuaggguua

SEQ ID NO: 328674 - RNA, 19 nt, Homo sapiens
cugaaacacagagagggcu

SEQ ID NO: 328675 - RNA, 22 nt, Homo sapiens
cugaaagagcauguaacacagu

SEQ ID NO: 328676 - RNA, 22 nt, Homo sapiens
cugaaagagcauuugaaugggu

SEQ ID NO: 328677 - RNA, 22 nt, Homo sapiens
cugaaauggaaugugugcacag

SEQ ID NO: 328678 - RNA, 22 nt, Homo sapiens
cugaaauguccaucgacugaug

SEQ ID NO: 328679 - RNA, 22 nt, Homo sapiens
cugaauagucaacgauggacug

SEQ ID NO: 328680 - RNA, 22 nt, Homo sapiens
cugacacuucaaaacugccaau

SEQ ID NO: 328681 - RNA, 22 nt, Homo sapiens
cugacagaugacugccacugua

SEQ ID NO: 328682 - RNA, 22 nt, Homo sapiens
cugacaugcagccacugcaccu

SEQ ID NO: 328683 - RNA, 22 nt, Homo sapiens
cugacauuguugaucacagcca

SEQ ID NO: 328684 - RNA, 22 nt, Homo sapiens
cugaccuaugauuuggcucaaa

SEQ ID NO: 328685 - RNA, 17 nt, Homo sapiens
cugaccucauuguguac

SEQ ID NO: 328686 - RNA, 22 nt, Homo sapiens
cugagaacaucauucagauauu

SEQ ID NO: 328687 - RNA, 22 nt, Homo sapiens
cugagaagaaacagguaaggac

SEQ ID NO: 328688 - RNA, 22 nt, Homo sapiens
cugagacuggguaauguauaaa

SEQ ID NO: 328689 - RNA, 22 nt, Homo sapiens
cugagagugguauguuuaagug

SEQ ID NO: 328690 - RNA, 22 nt, Homo sapiens
cugagauaggacucugcuggcu

SEQ ID NO: 328691 - RNA, 18 nt, Homo sapiens
cugagcacugcuuuauga

SEQ ID NO: 328692 - RNA, 22 nt, Homo sapiens
cugagcuaugccuggaaaggca

SEQ ID NO: 328693 - RNA, 22 nt, Homo sapiens
cugaggauauucagccucugug

SEQ ID NO: 328694 - RNA, 22 nt, Homo sapiens
cugagguagcucaggguauugc

SEQ ID NO: 328695 - RNA, 22 nt, Homo sapiens
cugagguaggcccugagaauau

SEQ ID NO: 328696 - RNA, 22 nt, Homo sapiens
cugagguauaucccauuagaag

SEQ ID NO: 328697 - RNA, 20 nt, Homo sapiens
cugaggugggagaaucgcuu

SEQ ID NO: 328698 - RNA, 22 nt, Homo sapiens
cugaggugggaggauuacuuga

SEQ ID NO: 328699 - RNA, 22 nt, Homo sapiens
cugauaugaugggugauuuuca

SEQ ID NO: 328700 - RNA, 22 nt, Homo sapiens
cugauguagguggucugugauc

SEQ ID NO: 328701 - RNA, 22 nt, Homo sapiens
cugcaaauacuugugggauuuu

SEQ ID NO: 328702 - RNA, 19 nt, Homo sapiens
cugcacugagaaaaggagg

SEQ ID NO: 328703 - RNA, 22 nt, Homo sapiens
cugcagucaucugaagauuuug

SEQ ID NO: 328704 - RNA, 21 nt, Homo sapiens
cugcauccauuucugagugau

SEQ ID NO: 328705 - RNA, 22 nt, Homo sapiens
cugcauuggguuaugcauuuuu

SEQ ID NO: 328706 - RNA, 22 nt, Homo sapiens
cugcccguaauccucuccccag

SEQ ID NO: 328707 - RNA, 20 nt, Homo sapiens
cugcuccccuacaaaucuca

SEQ ID NO: 328708 - RNA, 22 nt, Homo sapiens
cuggaaagcaaagggugcauug

SEQ ID NO: 328709 - RNA, 22 nt, Homo sapiens
cuggaaggaaaaacaaccacag

SEQ ID NO: 328710 - RNA, 22 nt, Homo sapiens
cuggaaucuagaaaagguaagg

SEQ ID NO: 328711 - RNA, 22 nt, Homo sapiens
cuggaauguuccuaaagauuca

SEQ ID NO: 328712 - RNA, 22 nt, Homo sapiens
cuggagcauugguggauuuguu

SEQ ID NO: 328713 - RNA, 22 nt, Homo sapiens
cuggaguuugaggcugcaguga

SEQ ID NO: 328714 - RNA, 22 nt, Homo sapiens
cuggauggugagauaaagaaaa

SEQ ID NO: 328715 - RNA, 18 nt, Homo sapiens
cuggaugucgaguguguu

SEQ ID NO: 328716 - RNA, 22 nt, Homo sapiens
cuggcaaaaagagggcaauaau

SEQ ID NO: 328717 - RNA, 22 nt, Homo sapiens
cuggcaaauguuuucuguaaag

SEQ ID NO: 328718 - RNA, 22 nt, Homo sapiens
cuggcaagagugaaccagcugu

SEQ ID NO: 328719 - RNA, 22 nt, Homo sapiens
cuggcacagugucagaaacaca

SEQ ID NO: 328720 - RNA, 22 nt, Homo sapiens
cuggcaccauacacuguuguug

SEQ ID NO: 328721 - RNA, 22 nt, Homo sapiens
cuggcaguguuucuugugggcu

SEQ ID NO: 328722 - RNA, 22 nt, Homo sapiens
cuggcccaguucugcguuuugc

SEQ ID NO: 328723 - RNA, 22 nt, Homo sapiens
cuggcucauuucauuuagcaua

SEQ ID NO: 328724 - RNA, 22 nt, Homo sapiens
cuggcucugagguguuuagggc

SEQ ID NO: 328725 - RNA, 22 nt, Homo sapiens
cuggcucugggcuaaagaaaua

SEQ ID NO: 328726 - RNA, 22 nt, Homo sapiens
cuggcucuguuagaagaaccag

SEQ ID NO: 328727 - RNA, 22 nt, Homo sapiens
cugggaugauguaaauaggcua

SEQ ID NO: 328728 - RNA, 22 nt, Homo sapiens
cugggguaggacuggcuuuuga

SEQ ID NO: 328729 - RNA, 22 nt, Homo sapiens
cugggucaguuucugauuauug

SEQ ID NO: 328730 - RNA, 22 nt, Homo sapiens
cugguaguguuuauaaggguau

SEQ ID NO: 328731 - RNA, 22 nt, Homo sapiens
cuggucguuauuuaucuucuca

SEQ ID NO: 328732 - RNA, 22 nt, Homo sapiens
uuugaaaguaauuugguuggug

SEQ ID NO: 328733 - RNA, 22 nt, Homo sapiens
uuugaagcaauugugaauggga

SEQ ID NO: 328734 - RNA, 22 nt, Homo sapiens
uuugaauggaaguuuugugaaa

SEQ ID NO: 328735 - RNA, 22 nt, Homo sapiens
uuugacucacagccuggcugcc

SEQ ID NO: 328736 - RNA, 18 nt, Homo sapiens
uuugacugguguccuuau

SEQ ID NO: 328737 - RNA, 22 nt, Homo sapiens
uuugagcaugcagauugccagg

SEQ ID NO: 328738 - RNA, 22 nt, Homo sapiens
uuugagcuagagucucacucug

SEQ ID NO: 328739 - RNA, 22 nt, Homo sapiens
uuugaggaaaggcauaaguagg

SEQ ID NO: 328740 - RNA, 21 nt, Homo sapiens
uuugaucauuaaaagugaauc

SEQ ID NO: 328741 - RNA, 22 nt, Homo sapiens
uuugauguccaccucagcccac

SEQ ID NO: 328742 - RNA, 22 nt, Homo sapiens
uuugauuguacuaaaauuguac

SEQ ID NO: 328743 - RNA, 22 nt, Homo sapiens
uuugcacuggagauucaauggg

SEQ ID NO: 328744 - RNA, 22 nt, Homo sapiens
uuugcaguguaguuggccagca

SEQ ID NO: 328745 - RNA, 21 nt, Homo sapiens
uuugcauauguugaaccagcc

SEQ ID NO: 328746 - RNA, 22 nt, Homo sapiens
uuugcaugcuccuuaugagaau

SEQ ID NO: 328747 - RNA, 22 nt, Homo sapiens
uuugcuauagugaauagugcug

SEQ ID NO: 328748 - RNA, 22 nt, Homo sapiens
uuuggaaugaaacagcagagcc

SEQ ID NO: 328749 - RNA, 22 nt, Homo sapiens
uuuggcaauuugacuguauagg

SEQ ID NO: 328750 - RNA, 23 nt, Homo sapiens
uuuggcauuccagaaauuuucau

SEQ ID NO: 328751 - RNA, 22 nt, Homo sapiens
uuuggcauuuuacuacucaaau

SEQ ID NO: 328752 - RNA, 22 nt, Homo sapiens
uuuggccauguuggucaggcug

SEQ ID NO: 328753 - RNA, 18 nt, Homo sapiens
uuuggcuguucaugacuc

SEQ ID NO: 328754 - RNA, 22 nt, Homo sapiens
uuuggcuuugagaagcagugga

SEQ ID NO: 328755 - RNA, 22 nt, Homo sapiens
uuugggccaugcuucccgguca

SEQ ID NO: 328756 - RNA, 22 nt, Homo sapiens
uuugggccaugguuuguguaua

SEQ ID NO: 328757 - RNA, 22 nt, Homo sapiens
uuuggucuuuuauuuaaagcag

SEQ ID NO: 328758 - RNA, 22 nt, Homo sapiens
uuuggucuuuuguaaguuaucu

SEQ ID NO: 328759 - RNA, 22 nt, Homo sapiens
uuugguugucacaacuggggga

SEQ ID NO: 328760 - RNA, 22 nt, Homo sapiens
uuuguacacuguugguaggauu

SEQ ID NO: 328761 - RNA, 22 nt, Homo sapiens
uuuguacuaugguuuuucacua

SEQ ID NO: 328762 - RNA, 22 nt, Homo sapiens
uuuguacucccuuuagauaaaa

SEQ ID NO: 328763 - RNA, 22 nt, Homo sapiens
uuuguacuucauugguucuacu

SEQ ID NO: 328764 - RNA, 21 nt, Homo sapiens
uuuguaguagcaugauuuaua

SEQ ID NO: 328765 - RNA, 19 nt, Homo sapiens
uuuguauguuuccaguaau

SEQ ID NO: 328766 - RNA, 22 nt, Homo sapiens
uuugucaauaacuaccaacagg

SEQ ID NO: 328767 - RNA, 22 nt, Homo sapiens
uuugucacucuuggagguuguu

SEQ ID NO: 328768 - RNA, 22 nt, Homo sapiens
uuugucccuuugcaguggcaca

SEQ ID NO: 328769 - RNA, 22 nt, Homo sapiens
uuugugauugcacacucaagau

SEQ ID NO: 328770 - RNA, 22 nt, Homo sapiens
uuugugcaaacuaggauugcga

SEQ ID NO: 328771 - RNA, 18 nt, Homo sapiens
uuugugcuccacaaagga

SEQ ID NO: 328772 - RNA, 21 nt, Homo sapiens
uuuguguccccacccaaaucu

SEQ ID NO: 328773 - RNA, 23 nt, Homo sapiens
uuuguguccccacccaaaucuca

SEQ ID NO: 328774 - RNA, 22 nt, Homo sapiens
uuuguuugaagucgagacaacu

SEQ ID NO: 328775 - RNA, 22 nt, Homo sapiens
uuuuacacuguugguuggaaug

SEQ ID NO: 328776 - RNA, 22 nt, Homo sapiens
uuuuccagugggacucccauua

SEQ ID NO: 328777 - RNA, 19 nt, Homo sapiens
uuuuccccuuucuuaagac

SEQ ID NO: 328778 - RNA, 22 nt, Homo sapiens
uuuugcaauauguuccugaaua

SEQ ID NO: 328779 - RNA, 22 nt, Homo sapiens
uuuugcaggucaggggcagaga

SEQ ID NO: 328780 - RNA, 22 nt, Homo sapiens
uuuugcaguuacagagagugag

SEQ ID NO: 328781 - RNA, 22 nt, Homo sapiens
uuuugcauuggcugaggagugu

SEQ ID NO: 328782 - RNA, 22 nt, Homo sapiens
uuuugcucuucggaagagcuug

SEQ ID NO: 328783 - RNA, 22 nt, Homo sapiens
uuuuggcacuuugucugauucu

SEQ ID NO: 328784 - RNA, 22 nt, Homo sapiens
uuuuggcucuugguaggucaga

SEQ ID NO: 328785 - RNA, 22 nt, Homo sapiens
uuuugguauauacggggguccu

SEQ ID NO: 328786 - RNA, 22 nt, Homo sapiens
uuuugguucaauuaauuugcua

SEQ ID NO: 328787 - RNA, 22 nt, Homo sapiens
uuuugguuuuauccagggucuc

SEQ ID NO: 328788 - RNA, 19 nt, Homo sapiens
uuuuguacucugugacuug

SEQ ID NO: 328789 - RNA, 22 nt, Homo sapiens
uuuugugacuauuguaaauggg

SEQ ID NO: 328790 - RNA, 22 nt, Homo sapiens
uuuuuauggccaauccucagaa

SEQ ID NO: 328791 - RNA, 22 nt, Homo sapiens
uuuuucacuuaaguuaggcuca

SEQ ID NO: 328792 - RNA, 22 nt, Homo sapiens
uuuuugagaauuggugaaacac

SEQ ID NO: 328793 - RNA, 22 nt, Homo sapiens
uuuuugaguagcuggagagcag

SEQ ID NO: 328794 - RNA, 16 nt, Homo sapiens
uuuuugcagaaaugac

SEQ ID NO: 328795 - RNA, 21 nt, Homo sapiens
uuuuugggcuuucauaguguu

SEQ ID NO: 328796 - RNA, 22 nt, Homo sapiens
auagagguagacagaggggaaa

SEQ ID NO: 328797 - RNA, 22 nt, Homo sapiens
auagauucauuugaggagauuu

SEQ ID NO: 328798 - RNA, 20 nt, Homo sapiens
auagcaccagacagcccuag

SEQ ID NO: 328799 - RNA, 22 nt, Homo sapiens
auagcacuuaccacaggcugca

SEQ ID NO: 328800 - RNA, 22 nt, Homo sapiens
auagcagaagaagggacaauuc

SEQ ID NO: 328801 - RNA, 22 nt, Homo sapiens
auagcagcaccccacuaccuca

SEQ ID NO: 328802 - RNA, 20 nt, Homo sapiens
auagcagcaugauuuauaau

SEQ ID NO: 328803 - RNA, 22 nt, Homo sapiens
auagcaggagaauggucauggg

SEQ ID NO: 328804 - RNA, 22 nt, Homo sapiens
auagcagugugaaaacagacug

SEQ ID NO: 328805 - RNA, 22 nt, Homo sapiens
auagcagugugaaaauugacug

SEQ ID NO: 328806 - RNA, 22 nt, Homo sapiens
auagcccuuuucuaacuaugug

SEQ ID NO: 328807 - RNA, 22 nt, Homo sapiens
auagggcacgagaugugagccu

SEQ ID NO: 328808 - RNA, 22 nt, Homo sapiens
auagguauguaauacaaaugaa

SEQ ID NO: 328809 - RNA, 22 nt, Homo sapiens
auagugcagugaugaaccuagg

SEQ ID NO: 328810 - RNA, 22 nt, Homo sapiens
auagugcugcaacaaauauacg

SEQ ID NO: 328811 - RNA, 22 nt, Homo sapiens
auagugcugcaauaaacauacg

SEQ ID NO: 328812 - RNA, 22 nt, Homo sapiens
auagugcugcaaugaacauaca

SEQ ID NO: 328813 - RNA, 22 nt, Homo sapiens
auauaccuaggcuacaugguuu

SEQ ID NO: 328814 - RNA, 22 nt, Homo sapiens
auauagcaaugaaagagaugaa

SEQ ID NO: 328815 - RNA, 23 nt, Homo sapiens
auauaguagaugugcaguaacau

SEQ ID NO: 328816 - RNA, 22 nt, Homo sapiens
auauauguuuucugggaagaaa

SEQ ID NO: 328817 - RNA, 22 nt, Homo sapiens
auaucacagguguuuaccugau

SEQ ID NO: 328818 - RNA, 22 nt, Homo sapiens
auaucccagugaugauugauag

SEQ ID NO: 328819 - RNA, 22 nt, Homo sapiens
auaucugcauugccauuuaugu

SEQ ID NO: 328820 - RNA, 22 nt, Homo sapiens
auaugacugccagggcccaguc

SEQ ID NO: 328821 - RNA, 22 nt, Homo sapiens
auaugccacugaacuguaccca

SEQ ID NO: 328822 - RNA, 22 nt, Homo sapiens
auaugcuuauuagcaagaaaua

SEQ ID NO: 328823 - RNA, 22 nt, Homo sapiens
auaugguuuuuggaagcauauc

SEQ ID NO: 328824 - RNA, 17 nt, Homo sapiens
auaugucugcuggggga

SEQ ID NO: 328825 - RNA, 22 nt, Homo sapiens
auaugucuguuuagucuguaau

SEQ ID NO: 328826 - RNA, 21 nt, Homo sapiens
auaugugcuguggaagucagc

SEQ ID NO: 328827 - RNA, 22 nt, Homo sapiens
auauuacagagaggaccuggga

SEQ ID NO: 328828 - RNA, 22 nt, Homo sapiens
auauucaagugaggauggcuaa

SEQ ID NO: 328829 - RNA, 22 nt, Homo sapiens
auauucacagguaucagagauu

SEQ ID NO: 328830 - RNA, 22 nt, Homo sapiens
auauugacuuucucuuagauca

SEQ ID NO: 328831 - RNA, 22 nt, Homo sapiens
auauuggucuucaagaccugug

SEQ ID NO: 328832 - RNA, 22 nt, Homo sapiens
aucaaagugaauuaaugagaau

SEQ ID NO: 328833 - RNA, 22 nt, Homo sapiens
aucaaaguuucccagaaguugu

SEQ ID NO: 328834 - RNA, 22 nt, Homo sapiens
aucaaaucuccagaaccugucu

SEQ ID NO: 328835 - RNA, 22 nt, Homo sapiens
aucaaaugcuggcagagugccu

SEQ ID NO: 328836 - RNA, 22 nt, Homo sapiens
aucacacuguuauuuuaguuaa

SEQ ID NO: 328837 - RNA, 22 nt, Homo sapiens
aucacagcuacuccucugucuu

SEQ ID NO: 328838 - RNA, 22 nt, Homo sapiens
aucacagguacuauggcugaca

SEQ ID NO: 328839 - RNA, 22 nt, Homo sapiens
aucacaguggucagguauagau

SEQ ID NO: 328840 - RNA, 22 nt, Homo sapiens
aucacaguuaagaggugaugaa

SEQ ID NO: 328841 - RNA, 22 nt, Homo sapiens
aucacauggccagguaguaauc

SEQ ID NO: 328842 - RNA, 22 nt, Homo sapiens
aucacuagaucauagguaaaca

SEQ ID NO: 328843 - RNA, 20 nt, Homo sapiens
aucacuggagaaggaaaccu

SEQ ID NO: 328844 - RNA, 22 nt, Homo sapiens
aucacuguaaguuuacacuuug

SEQ ID NO: 328845 - RNA, 22 nt, Homo sapiens
aucacugugauuucuacugugc

SEQ ID NO: 328846 - RNA, 21 nt, Homo sapiens
aucagagacccaggcuuccuc

SEQ ID NO: 328847 - RNA, 19 nt, Homo sapiens
aucagcacaagugugcuuu

SEQ ID NO: 328848 - RNA, 22 nt, Homo sapiens
aucagcagcaugaaaagcaacu

SEQ ID NO: 328849 - RNA, 22 nt, Homo sapiens
aucagugcauaguauuuaauga

SEQ ID NO: 328850 - RNA, 22 nt, Homo sapiens
auccacauucauggaccagucc

SEQ ID NO: 328851 - RNA, 22 nt, Homo sapiens
auccauguggauaaauguguau

SEQ ID NO: 328852 - RNA, 22 nt, Homo sapiens
auccccuugcagugaccggggc

SEQ ID NO: 328853 - RNA, 22 nt, Homo sapiens
aucccugugauccaaucacuuc

SEQ ID NO: 328854 - RNA, 22 nt, Homo sapiens
aucccuuccuagcacuuggugu

SEQ ID NO: 328855 - RNA, 22 nt, Homo sapiens
aucccuugacguggagucucug

SEQ ID NO: 328856 - RNA, 22 nt, Homo sapiens
auccuacaguccauucuuugug

SEQ ID NO: 328857 - RNA, 22 nt, Homo sapiens
auccucaguggcuuaaguauag

SEQ ID NO: 328858 - RNA, 22 nt, Homo sapiens
auccugaugacacagugcugca

SEQ ID NO: 328859 - RNA, 22 nt, Homo sapiens
auccuugagaaaauaaaugacc

SEQ ID NO: 328860 - RNA, 22 nt, Homo sapiens
auccuuuagacuguccaguuga

SEQ ID NO: 328861 - RNA, 22 nt, Homo sapiens
aucgcaccauugcacuccagca

SEQ ID NO: 328862 - RNA, 22 nt, Homo sapiens
aucuaaucaucgcaaccuucaa

SEQ ID NO: 328863 - RNA, 22 nt, Homo sapiens
aucucagagaaaauuacuaaga

SEQ ID NO: 328864 - RNA, 22 nt, Homo sapiens
aucucaguucaggcuggccaca

SEQ ID NO: 328865 - RNA, 22 nt, Homo sapiens
aucucauggagguagagaguaa

SEQ ID NO: 328866 - RNA, 22 nt, Homo sapiens
aucuccaggugccagcugcgcc

SEQ ID NO: 328867 - RNA, 22 nt, Homo sapiens
aucugacuuuuaauuugaaaac

SEQ ID NO: 328868 - RNA, 22 nt, Homo sapiens
aucugauggagagcguguggcu

SEQ ID NO: 328869 - RNA, 22 nt, Homo sapiens
aucugcaaagcugggcugagac

SEQ ID NO: 328870 - RNA, 22 nt, Homo sapiens
aucugcaaauaaugaagauugg

SEQ ID NO: 328871 - RNA, 22 nt, Homo sapiens
aucugggguuggcaaaguuugg

SEQ ID NO: 328872 - RNA, 21 nt, Homo sapiens
aucugugagaccuuggggguu

SEQ ID NO: 328873 - RNA, 22 nt, Homo sapiens
aucugugguuguaugcauauua

SEQ ID NO: 328874 - RNA, 22 nt, Homo sapiens
aucuguguuuaaggucccagaa

SEQ ID NO: 328875 - RNA, 20 nt, Homo sapiens
aagcugaguguuuuuuuaau

SEQ ID NO: 328876 - RNA, 22 nt, Homo sapiens
aagcuggcauucaugagauuac

SEQ ID NO: 328877 - RNA, 22 nt, Homo sapiens
aagcuggcauucauucguucuu

SEQ ID NO: 328878 - RNA, 22 nt, Homo sapiens
aagcugguguugcugcucuguu

SEQ ID NO: 328879 - RNA, 22 nt, Homo sapiens
aagcuguuguucauccugaauu

SEQ ID NO: 328880 - RNA, 22 nt, Homo sapiens
aagcuuucaacuguuugccauu

SEQ ID NO: 328881 - RNA, 22 nt, Homo sapiens
aaggaaguaauuugguuuauag

SEQ ID NO: 328882 - RNA, 22 nt, Homo sapiens
aaggaauacuggugguugcuau

SEQ ID NO: 328883 - RNA, 22 nt, Homo sapiens
aaggaguagaauagaugcaccu

SEQ ID NO: 328884 - RNA, 22 nt, Homo sapiens
aaggagugugauucuucaguuu

SEQ ID NO: 328885 - RNA, 22 nt, Homo sapiens
aaggcaagaaaauggauucucc

SEQ ID NO: 328886 - RNA, 22 nt, Homo sapiens
aaggcaagaagagaaccaucgg

SEQ ID NO: 328887 - RNA, 22 nt, Homo sapiens
aaggcaagaaugcgugcuuuca

SEQ ID NO: 328888 - RNA, 22 nt, Homo sapiens
aaggcaagguggauaaugaagc

SEQ ID NO: 328889 - RNA, 22 nt, Homo sapiens
aaggcaguggcagaagauguca

SEQ ID NO: 328890 - RNA, 22 nt, Homo sapiens
aaggcagugugcacauaacacu

SEQ ID NO: 328891 - RNA, 22 nt, Homo sapiens
aaggcuguuguguaauaggauu

SEQ ID NO: 328892 - RNA, 22 nt, Homo sapiens
aagggaauguugugguugguuu

SEQ ID NO: 328893 - RNA, 23 nt, Homo sapiens
aagguaagcuagaaagauguaga

SEQ ID NO: 328894 - RNA, 22 nt, Homo sapiens
aagguauuucuaugggaauaga

SEQ ID NO: 328895 - RNA, 22 nt, Homo sapiens
aaggugcuguaagcauccaugu

SEQ ID NO: 328896 - RNA, 21 nt, Homo sapiens
aagguuuuuagugcuugacuu

SEQ ID NO: 328897 - RNA, 19 nt, Homo sapiens
aaguacuugucuuuugaag

SEQ ID NO: 328898 - RNA, 22 nt, Homo sapiens
aaguagcuggaugcaguggcac

SEQ ID NO: 328899 - RNA, 22 nt, Homo sapiens
aaguaguuaggaacauucucuc

SEQ ID NO: 328900 - RNA, 22 nt, Homo sapiens
aagucacugagacuuguggcug

SEQ ID NO: 328901 - RNA, 22 nt, Homo sapiens
aaguccccugacagaggggagg

SEQ ID NO: 328902 - RNA, 19 nt, Homo sapiens
aagugaaugcuuuguucac

SEQ ID NO: 328903 - RNA, 22 nt, Homo sapiens
aagugaccuaacaaugaaggcc

SEQ ID NO: 328904 - RNA, 22 nt, Homo sapiens
aagugacuagacuaugaaaccu

SEQ ID NO: 328905 - RNA, 22 nt, Homo sapiens
aagugauguuauugggugacuc

SEQ ID NO: 328906 - RNA, 22 nt, Homo sapiens
aagugcaaaucuguggcugaaa

SEQ ID NO: 328907 - RNA, 22 nt, Homo sapiens
aagugcucuugaaacugccuua

SEQ ID NO: 328908 - RNA, 22 nt, Homo sapiens
aagugcuggccuacucaaucga

SEQ ID NO: 328909 - RNA, 22 nt, Homo sapiens
aagugcugggauuggccgggca

SEQ ID NO: 328910 - RNA, 22 nt, Homo sapiens
aagugcuuccuuucagaggguu

SEQ ID NO: 328911 - RNA, 22 nt, Homo sapiens
aagugcuuuuuagauaugguuu

SEQ ID NO: 328912 - RNA, 22 nt, Homo sapiens
aagugguguuugggagcuggac

SEQ ID NO: 328913 - RNA, 22 nt, Homo sapiens
aagugguguuuguauuuaugca

SEQ ID NO: 328914 - RNA, 22 nt, Homo sapiens
aagugguucuaugaguuugcaa

SEQ ID NO: 328915 - RNA, 19 nt, Homo sapiens
aagugguuuaaacuuguau

SEQ ID NO: 328916 - RNA, 22 nt, Homo sapiens
aagugguuuuaaucuggugagu

SEQ ID NO: 328917 - RNA, 22 nt, Homo sapiens
aagugguuuuuacaaagacaga

SEQ ID NO: 328918 - RNA, 22 nt, Homo sapiens
aaguuguuggaguuccauuguu

SEQ ID NO: 328919 - RNA, 22 nt, Homo sapiens
aauaaagccugucucuuuagag

SEQ ID NO: 328920 - RNA, 22 nt, Homo sapiens
aauaaguugagaugaggucaua

SEQ ID NO: 328921 - RNA, 22 nt, Homo sapiens
aauaauggcaccaaagcacaag

SEQ ID NO: 328922 - RNA, 22 nt, Homo sapiens
aauaaugucacaggggguuagc

SEQ ID NO: 328923 - RNA, 22 nt, Homo sapiens
aauacugcuuugauguaagcua

SEQ ID NO: 328924 - RNA, 22 nt, Homo sapiens
aauacugugauaucgagcgauu

SEQ ID NO: 328925 - RNA, 22 nt, Homo sapiens
aauagcacuguagauggaggaa

SEQ ID NO: 328926 - RNA, 22 nt, Homo sapiens
aauagcuguuuuuaauuccugc

SEQ ID NO: 328927 - RNA, 22 nt, Homo sapiens
aauauguccaguguuuugggag

SEQ ID NO: 328928 - RNA, 19 nt, Homo sapiens
aauauugacaguggugucu

SEQ ID NO: 328929 - RNA, 22 nt, Homo sapiens
aauauugucaaaauggauucca

SEQ ID NO: 328930 - RNA, 22 nt, Homo sapiens
aaucacauugaaucugcuaccu

SEQ ID NO: 328931 - RNA, 22 nt, Homo sapiens
aaucacuuugcuacaaggcagu

SEQ ID NO: 328932 - RNA, 22 nt, Homo sapiens
aauccuguagauucuaauuccu

SEQ ID NO: 328933 - RNA, 23 nt, Homo sapiens
aaucugucuuuguuauagggguc

SEQ ID NO: 328934 - RNA, 22 nt, Homo sapiens
aaugaaguuagauguugagaag

SEQ ID NO: 328935 - RNA, 22 nt, Homo sapiens
aaugacuaagaugguacauuuu

SEQ ID NO: 328936 - RNA, 22 nt, Homo sapiens
aaugacugugauauuuuucuuc

SEQ ID NO: 328937 - RNA, 22 nt, Homo sapiens
aaugauacuguguacaagggca

SEQ ID NO: 328938 - RNA, 22 nt, Homo sapiens
aaugcacauaaaauccuccagg

SEQ ID NO: 328939 - RNA, 22 nt, Homo sapiens
aaugccaucagagaaaacucuu

SEQ ID NO: 328940 - RNA, 22 nt, Homo sapiens
aaugcuguguuauuucaugacc

SEQ ID NO: 328941 - RNA, 22 nt, Homo sapiens
aauggccacugaccuguguuga

SEQ ID NO: 328942 - RNA, 22 nt, Homo sapiens
aauggcucugauguuguuguga

SEQ ID NO: 328943 - RNA, 22 nt, Homo sapiens
aauggcucuguuggcccaagac

SEQ ID NO: 328944 - RNA, 22 nt, Homo sapiens
aauggcuuucagcuuuucccca

SEQ ID NO: 328945 - RNA, 19 nt, Homo sapiens
aauggcuuuuccuguuccc

SEQ ID NO: 328946 - RNA, 22 nt, Homo sapiens
aaugugcuuucuuucacacagu

SEQ ID NO: 328947 - RNA, 22 nt, Homo sapiens
aauuacuucuacaccaaccuaa

SEQ ID NO: 328948 - RNA, 22 nt, Homo sapiens
aauuaguugaaagucugcuuuu

SEQ ID NO: 328949 - RNA, 22 nt, Homo sapiens
aauucacuuguggcagauccuu

SEQ ID NO: 328950 - RNA, 22 nt, Homo sapiens
aauucuguauuguuuagggacu

SEQ ID NO: 328951 - RNA, 22 nt, Homo sapiens
aauugcaauggacaaugcagca

SEQ ID NO: 328952 - RNA, 22 nt, Homo sapiens
aauugcacuacugcacucccac

SEQ ID NO: 328953 - RNA, 22 nt, Homo sapiens
aauugcauaaaauucaacucug

SEQ ID NO: 328954 - RNA, 22 nt, Homo sapiens
aauuggcagugcucuugccaca

SEQ ID NO: 328955 - RNA, 22 nt, Homo sapiens
aauuggugaccaagggaaggac

SEQ ID NO: 328956 - RNA, 22 nt, Homo sapiens
acaaagcuagggaauccaucuu

SEQ ID NO: 328957 - RNA, 22 nt, Homo sapiens
acaaagugccuccuuuuagagu

SEQ ID NO: 328958 - RNA, 20 nt, Homo sapiens
acaaaugcauucugugacau

SEQ ID NO: 328959 - RNA, 22 nt, Homo sapiens
acaagacuucuuguauucuagu

SEQ ID NO: 328960 - RNA, 22 nt, Homo sapiens
acaagcacaaauuuaauccugu

SEQ ID NO: 328961 - RNA, 22 nt, Homo sapiens
acaauguauauuuuacuguagg

SEQ ID NO: 328962 - RNA, 23 nt, Homo sapiens
acacaguaaacuaaaagcuagcu

SEQ ID NO: 328963 - RNA, 22 nt, Homo sapiens
acacaguaaauauguauugaau

SEQ ID NO: 328964 - RNA, 22 nt, Homo sapiens
acacaguaaauauugucuccuc

SEQ ID NO: 328965 - RNA, 22 nt, Homo sapiens
acacagugucuguguauuuaaa

SEQ ID NO: 328966 - RNA, 22 nt, Homo sapiens
aagaugauguuguguuuucacu

SEQ ID NO: 328967 - RNA, 21 nt, Homo sapiens
aagcaugguguaucuuuccau

SEQ ID NO: 328968 - RNA, 22 nt, Homo sapiens
aagcuacuuuggugguuccuua

SEQ ID NO: 328969 - RNA, 21 nt, Homo sapiens
aucuugguauagucuuauugg

SEQ ID NO: 328970 - RNA, 22 nt, Homo sapiens
aucuuguccugagguuuuauug

SEQ ID NO: 328971 - RNA, 22 nt, Homo sapiens
aucuuguguugaauggugcaga

SEQ ID NO: 328972 - RNA, 22 nt, Homo sapiens
aucuuugauugaagggacccug

SEQ ID NO: 328973 - RNA, 22 nt, Homo sapiens
aucuuuggugaguucuuugguc

SEQ ID NO: 328974 - RNA, 22 nt, Homo sapiens
augaaaagcauaaacgcugaag

SEQ ID NO: 328975 - RNA, 22 nt, Homo sapiens
augaaacuggcuaauuuuugua

SEQ ID NO: 328976 - RNA, 22 nt, Homo sapiens
augaaagguauguuuucuguga

SEQ ID NO: 328977 - RNA, 22 nt, Homo sapiens
augaaauguaugagucuggguu

SEQ ID NO: 328978 - RNA, 19 nt, Homo sapiens
augaacucaucauuucuca

SEQ ID NO: 328979 - RNA, 18 nt, Homo sapiens
augaacucaucauuuuua

SEQ ID NO: 328980 - RNA, 18 nt, Homo sapiens
augaacucaucauuuuuu

SEQ ID NO: 328981 - RNA, 22 nt, Homo sapiens
augaacucaucauuuuuuaugg

SEQ ID NO: 328982 - RNA, 17 nt, Homo sapiens
augaagucaucauuuuu

SEQ ID NO: 328983 - RNA, 22 nt, Homo sapiens
augaagugcaugauaguugguu

SEQ ID NO: 328984 - RNA, 22 nt, Homo sapiens
augaaugcacugcggguggaug

SEQ ID NO: 328985 - RNA, 22 nt, Homo sapiens
augugcauaugaagcacagaca

SEQ ID NO: 328986 - RNA, 22 nt, Homo sapiens
augugccaauuaggauuccaag

SEQ ID NO: 328987 - RNA, 22 nt, Homo sapiens
augugcuagguacuguuuagca

SEQ ID NO: 328988 - RNA, 22 nt, Homo sapiens
augugcuuaaaaaugcagagaa

SEQ ID NO: 328989 - RNA, 22 nt, Homo sapiens
augugcuuuuggugagagauuu

SEQ ID NO: 328990 - RNA, 22 nt, Homo sapiens
auguggcauuucucauucauuu

SEQ ID NO: 328991 - RNA, 22 nt, Homo sapiens
auguguauuaccucgauuguga

SEQ ID NO: 328992 - RNA, 22 nt, Homo sapiens
augugugcuugauguaaaaagu

SEQ ID NO: 328993 - RNA, 18 nt, Homo sapiens
auguuauguuuguagaag

SEQ ID NO: 328994 - RNA, 22 nt, Homo sapiens
auguugcuugaaggcauuuugu

SEQ ID NO: 328995 - RNA, 22 nt, Homo sapiens
auguuugguagugaauauggua

SEQ ID NO: 328996 - RNA, 22 nt, Homo sapiens
auuaagagcacauguucugggu

SEQ ID NO: 328997 - RNA, 22 nt, Homo sapiens
auuaaguuaggauuuugagaua

SEQ ID NO: 328998 - RNA, 22 nt, Homo sapiens
auuaauguaauuaguaaaguug

SEQ ID NO: 328999 - RNA, 20 nt, Homo sapiens
auuagagcuacauggcuaca

SEQ ID NO: 329000 - RNA, 22 nt, Homo sapiens
auuauguuguauuuccuugcag

SEQ ID NO: 329001 - RNA, 22 nt, Homo sapiens
auuauuaguuguugaaugaagu

SEQ ID NO: 329002 - RNA, 22 nt, Homo sapiens
auucaaggacuggauugcggga

SEQ ID NO: 329003 - RNA, 22 nt, Homo sapiens
auucaagggauuucaggaggcu

SEQ ID NO: 329004 - RNA, 22 nt, Homo sapiens
auucaagugaugugauucuucu

SEQ ID NO: 329005 - RNA, 22 nt, Homo sapiens
auucacagcuuuaaaaggcgug

SEQ ID NO: 329006 - RNA, 22 nt, Homo sapiens
auucauagugcuaagguguauc

SEQ ID NO: 329007 - RNA, 20 nt, Homo sapiens
auucauggaggagcaauugg

SEQ ID NO: 329008 - RNA, 22 nt, Homo sapiens
auuccacuuauaugagguaucu

SEQ ID NO: 329009 - RNA, 21 nt, Homo sapiens
auuccacuuuuccuucaggga

SEQ ID NO: 329010 - RNA, 23 nt, Homo sapiens
auuccaguggcaauuggagaaac

SEQ ID NO: 329011 - RNA, 22 nt, Homo sapiens
auuccaguuguaagguuuuuca

SEQ ID NO: 329012 - RNA, 22 nt, Homo sapiens
auuccauaguacagugaugagu

SEQ ID NO: 329013 - RNA, 22 nt, Homo sapiens
auuccauagugucuguggcaga

SEQ ID NO: 329014 - RNA, 22 nt, Homo sapiens
auuccauuuguuaucacacccg

SEQ ID NO: 329015 - RNA, 22 nt, Homo sapiens
auucccuguagaauaaggaugg

SEQ ID NO: 329016 - RNA, 22 nt, Homo sapiens
auugaaugaaauggcagacacu

SEQ ID NO: 329017 - RNA, 22 nt, Homo sapiens
auugacaguuggccaguaagug

SEQ ID NO: 329018 - RNA, 19 nt, Homo sapiens
auugacauugggguguuca

SEQ ID NO: 329019 - RNA, 22 nt, Homo sapiens
auugaggcauguaccaaugguc

SEQ ID NO: 329020 - RNA, 22 nt, Homo sapiens
auugauaguuuaauaggaauug

SEQ ID NO: 329021 - RNA, 19 nt, Homo sapiens
auugauuaaguuugcuguc

SEQ ID NO: 329022 - RNA, 22 nt, Homo sapiens
auugcaacuuccgccuccuggg

SEQ ID NO: 329023 - RNA, 22 nt, Homo sapiens
auugcaauuaguccauagaguu

SEQ ID NO: 329024 - RNA, 22 nt, Homo sapiens
auugcacacagaaucaggguaa

SEQ ID NO: 329025 - RNA, 22 nt, Homo sapiens
auugcacuccagccccggggac

SEQ ID NO: 329026 - RNA, 22 nt, Homo sapiens
auugcacuccagcccgggugac

SEQ ID NO: 329027 - RNA, 22 nt, Homo sapiens
auugcacuccagccuagguaac

SEQ ID NO: 329028 - RNA, 22 nt, Homo sapiens
auugcacuccagccucggugac

SEQ ID NO: 329029 - RNA, 22 nt, Homo sapiens
auugcacuccagccuggcaaua

SEQ ID NO: 329030 - RNA, 22 nt, Homo sapiens
auugcacuccagccugggcaac

SEQ ID NO: 329031 - RNA, 22 nt, Homo sapiens
auugcacuccagccugggcgac

SEQ ID NO: 329032 - RNA, 22 nt, Homo sapiens
auugcacuccagccugggcuag

SEQ ID NO: 329033 - RNA, 22 nt, Homo sapiens
auugcacuccagccugggugag

SEQ ID NO: 329034 - RNA, 22 nt, Homo sapiens
auugcacuccagccuugggcaa

SEQ ID NO: 329035 - RNA, 22 nt, Homo sapiens
auugcacuccagcuuaggcgac

SEQ ID NO: 329036 - RNA, 22 nt, Homo sapiens
auugcacuccauccugggcaau

SEQ ID NO: 329037 - RNA, 22 nt, Homo sapiens
auugcacucuagccugggugac

SEQ ID NO: 329038 - RNA, 22 nt, Homo sapiens
auugcagaaaugacagagcgcc

SEQ ID NO: 329039 - RNA, 22 nt, Homo sapiens
auugcauugugaucuucccaga

SEQ ID NO: 329040 - RNA, 22 nt, Homo sapiens
auugcauuuucagguuggucug

SEQ ID NO: 329041 - RNA, 22 nt, Homo sapiens
auugcuuaagucccuguauuag

SEQ ID NO: 329042 - RNA, 22 nt, Homo sapiens
auugcuuacccuguauuagauc

SEQ ID NO: 329043 - RNA, 22 nt, Homo sapiens
auugcuuacuaaucaucuucag

SEQ ID NO: 329044 - RNA, 22 nt, Homo sapiens
auuggacagcauuucuagacuu

SEQ ID NO: 329045 - RNA, 22 nt, Homo sapiens
auuggcaauccauauauuuucu

SEQ ID NO: 329046 - RNA, 22 nt, Homo sapiens
auuggcauauccacgacaaugc

SEQ ID NO: 329047 - RNA, 22 nt, Homo sapiens
auuggguuaaaggauaugaaca

SEQ ID NO: 329048 - RNA, 22 nt, Homo sapiens
auuguacuccagccugggcaag

SEQ ID NO: 329049 - RNA, 21 nt, Homo sapiens
auuguauguaaaccaaaugag

SEQ ID NO: 329050 - RNA, 22 nt, Homo sapiens
auugucacccgggcaguaagca

SEQ ID NO: 329051 - RNA, 22 nt, Homo sapiens
auugucacugugcuccaccagu

SEQ ID NO: 329052 - RNA, 22 nt, Homo sapiens
auugucauuuucugagaaguaa

SEQ ID NO: 329053 - RNA, 22 nt, Homo sapiens
auugucccucuuaaucccagca

SEQ ID NO: 329054 - RNA, 22 nt, Homo sapiens
auugugcuaaaguaauaaguca

SEQ ID NO: 329055 - RNA, 22 nt, Homo sapiens
auuguuccccggucauuuuugu

SEQ ID NO: 329056 - RNA, 15 nt, Homo sapiens
auuucacuuagcaug

SEQ ID NO: 329057 - RNA, 22 nt, Homo sapiens
ugcgccauugcacuccagccug

SEQ ID NO: 329058 - RNA, 22 nt, Homo sapiens
ugcuauguaacacauuaccuuu

SEQ ID NO: 329059 - RNA, 23 nt, Homo sapiens
ugcuauguaagcauuuauuaaau

SEQ ID NO: 329060 - RNA, 16 nt, Homo sapiens
ugcuauguuggccagg

SEQ ID NO: 329061 - RNA, 22 nt, Homo sapiens
ugcucaccugcugcucaccucc

SEQ ID NO: 329062 - RNA, 22 nt, Homo sapiens
ugcucaguuuaaaacuuuugag

SEQ ID NO: 329063 - RNA, 22 nt, Homo sapiens
ugcugaguguuaccggacaccg

SEQ ID NO: 329064 - RNA, 19 nt, Homo sapiens
ugcugcauugugaccuugc

SEQ ID NO: 329065 - RNA, 22 nt, Homo sapiens
ugcugcuguuaucauuuuacca

SEQ ID NO: 329066 - RNA, 22 nt, Homo sapiens
ugcugcuguuguuguuacuagc

SEQ ID NO: 329067 - RNA, 22 nt, Homo sapiens
ugcuggcguuacucuccaucag

SEQ ID NO: 329068 - RNA, 22 nt, Homo sapiens
ugcuggugauucagauucaaau

SEQ ID NO: 329069 - RNA, 22 nt, Homo sapiens
ugcugguguggucuagccgcuu

SEQ ID NO: 329070 - RNA, 22 nt, Homo sapiens
ugcugguuuucaucaucagugg

SEQ ID NO: 329071 - RNA, 22 nt, Homo sapiens
ugcuguguugcuggcuuaaaga

SEQ ID NO: 329072 - RNA, 18 nt, Homo sapiens
ugcuuagucauuuucaau

SEQ ID NO: 329073 - RNA, 21 nt, Homo sapiens
ugcuuuggucauacuucuucc

SEQ ID NO: 329074 - RNA, 22 nt, Homo sapiens
ugcuuuguuauauggggauucu

SEQ ID NO: 329075 - RNA, 23 nt, Homo sapiens
uggaacugaauuucuuagcauuu

SEQ ID NO: 329076 - RNA, 19 nt, Homo sapiens
uggaacugauucaguucug

SEQ ID NO: 329077 - RNA, 22 nt, Homo sapiens
uggaagacaggcuguauuuuaa

SEQ ID NO: 329078 - RNA, 22 nt, Homo sapiens
uggaagauggaguuuuaucauu

SEQ ID NO: 329079 - RNA, 22 nt, Homo sapiens
uggaaggucauuguucauuuga

SEQ ID NO: 329080 - RNA, 23 nt, Homo sapiens
uggaaguauggaggaggcagaau

SEQ ID NO: 329081 - RNA, 22 nt, Homo sapiens
uggaagucauugagguguguua

SEQ ID NO: 329082 - RNA, 22 nt, Homo sapiens
uggaauacaugucgcugagcug

SEQ ID NO: 329083 - RNA, 22 nt, Homo sapiens
uggaaucuacuaaagcaaaauc

SEQ ID NO: 329084 - RNA, 20 nt, Homo sapiens
uggaaucuaggcggagguuu

SEQ ID NO: 329085 - RNA, 22 nt, Homo sapiens
uggaaugcuaagcaugugggag

SEQ ID NO: 329086 - RNA, 22 nt, Homo sapiens
uggaaugugaauaacuuccuuc

SEQ ID NO: 329087 - RNA, 21 nt, Homo sapiens
uggaauuaauggagagguguu

SEQ ID NO: 329088 - RNA, 22 nt, Homo sapiens
uggaauuaauuaaaauauacug

SEQ ID NO: 329089 - RNA, 22 nt, Homo sapiens
uggaauuuacuuauuuaggggc

SEQ ID NO: 329090 - RNA, 22 nt, Homo sapiens
uggacagaaacauguuuucagu

SEQ ID NO: 329091 - RNA, 22 nt, Homo sapiens
uggacagagagaccggcauuuu

SEQ ID NO: 329092 - RNA, 18 nt, Homo sapiens
uggacagugauuauccau

SEQ ID NO: 329093 - RNA, 21 nt, Homo sapiens
uggaccccuuccuugcaccau

SEQ ID NO: 329094 - RNA, 22 nt, Homo sapiens
uggaccccuucuccuauuaaaa

SEQ ID NO: 329095 - RNA, 21 nt, Homo sapiens
uggaccccuuucuuacaccgu

SEQ ID NO: 329096 - RNA, 22 nt, Homo sapiens
uggagagcaaaaucaauccaaa

SEQ ID NO: 329097 - RNA, 22 nt, Homo sapiens
uggagagucauuuauaguauuu

SEQ ID NO: 329098 - RNA, 22 nt, Homo sapiens
uggagagugagggccuccuuaa

SEQ ID NO: 329099 - RNA, 22 nt, Homo sapiens
uggagauguuuaaaauccacug

SEQ ID NO: 329100 - RNA, 22 nt, Homo sapiens
uggagggcuagucauuucuuuu

SEQ ID NO: 329101 - RNA, 21 nt, Homo sapiens
uggagugcaacacuagguaua

SEQ ID NO: 329102 - RNA, 22 nt, Homo sapiens
uggagugcaauggcaccaucuu

SEQ ID NO: 329103 - RNA, 22 nt, Homo sapiens
uggaguuugacaugccuuuggg

SEQ ID NO: 329104 - RNA, 20 nt, Homo sapiens
uggaguuugaguucuuggag

SEQ ID NO: 329105 - RNA, 22 nt, Homo sapiens
uggauaguucuucuacuagagu

SEQ ID NO: 329106 - RNA, 22 nt, Homo sapiens
uggauaguuuacugaagagugg

SEQ ID NO: 329107 - RNA, 22 nt, Homo sapiens
uggauauguuuauuacccugaa

SEQ ID NO: 329108 - RNA, 22 nt, Homo sapiens
uggaugaagagaugguaguugc

SEQ ID NO: 329109 - RNA, 22 nt, Homo sapiens
uggauugaaagcuuuaauauug

SEQ ID NO: 329110 - RNA, 21 nt, Homo sapiens
uggauugagaaccccaggagg

SEQ ID NO: 329111 - RNA, 22 nt, Homo sapiens
uggauugcaaaaucuuuuugag

SEQ ID NO: 329112 - RNA, 21 nt, Homo sapiens
uggauuguacacccuaucauu

SEQ ID NO: 329113 - RNA, 18 nt, Homo sapiens
uggauuguacuguguucu

SEQ ID NO: 329114 - RNA, 22 nt, Homo sapiens
uggauuguuucucuugguauga

SEQ ID NO: 329115 - RNA, 22 nt, Homo sapiens
uggcaaaaaaacgcaauuacgu

SEQ ID NO: 329116 - RNA, 22 nt, Homo sapiens
uggcaaaaaucacaaguaccuu

SEQ ID NO: 329117 - RNA, 22 nt, Homo sapiens
uggcaaauagcaauaggagggu

SEQ ID NO: 329118 - RNA, 22 nt, Homo sapiens
uggcaaaugaagucagcuguac

SEQ ID NO: 329119 - RNA, 21 nt, Homo sapiens
uggcaacauggauggauucug

SEQ ID NO: 329120 - RNA, 22 nt, Homo sapiens
uggcaagaaccacaguuacuuu

SEQ ID NO: 329121 - RNA, 22 nt, Homo sapiens
uggcaagaacgaaauguagggu

SEQ ID NO: 329122 - RNA, 22 nt, Homo sapiens
uggcaagaacugcaauugcuuu

SEQ ID NO: 329123 - RNA, 23 nt, Homo sapiens
uggcaagaauucuuaccgugugg

SEQ ID NO: 329124 - RNA, 23 nt, Homo sapiens
uggcaagauuuguauugccugga

SEQ ID NO: 329125 - RNA, 22 nt, Homo sapiens
uggcaagcuuuaauugacucuu

SEQ ID NO: 329126 - RNA, 20 nt, Homo sapiens
uggcaagugggaauuguggg

SEQ ID NO: 329127 - RNA, 22 nt, Homo sapiens
uggcaauguggaaugguccagg

SEQ ID NO: 329128 - RNA, 20 nt, Homo sapiens
uggcaccugacagauagcca

SEQ ID NO: 329129 - RNA, 22 nt, Homo sapiens
uggcacuaugugacaagguuuu

SEQ ID NO: 329130 - RNA, 21 nt, Homo sapiens
uggcacuauucacaauagcaa

SEQ ID NO: 329131 - RNA, 22 nt, Homo sapiens
uggcagauaggauacaggacua

SEQ ID NO: 329132 - RNA, 19 nt, Homo sapiens
uggcaugaaugugaacuaa

SEQ ID NO: 329133 - RNA, 17 nt, Homo sapiens
uggcaugaggguguggg

SEQ ID NO: 329134 - RNA, 22 nt, Homo sapiens
uggcaugauccuagauucaaca

SEQ ID NO: 329135 - RNA, 22 nt, Homo sapiens
uggcaugauguguucauugaaa

SEQ ID NO: 329136 - RNA, 22 nt, Homo sapiens
uggcauggucugcccaaguuuc

SEQ ID NO: 329137 - RNA, 22 nt, Homo sapiens
uggcaugucagguuucuggguu

SEQ ID NO: 329138 - RNA, 22 nt, Homo sapiens
uggcauguguuugaaugaguau

SEQ ID NO: 329139 - RNA, 20 nt, Homo sapiens
uggcauguugguaugcaccc

SEQ ID NO: 329140 - RNA, 23 nt, Homo sapiens
uggcauuuuuggcaaugccuucu

SEQ ID NO: 329141 - RNA, 18 nt, Homo sapiens
uggccaauggcaaacaga

SEQ ID NO: 329142 - RNA, 22 nt, Homo sapiens
uggccagugucggaggccagga

SEQ ID NO: 329143 - RNA, 22 nt, Homo sapiens
uggccagugucuauugguuucc

SEQ ID NO: 329144 - RNA, 22 nt, Homo sapiens
uggccuuuuccaagaacuacua

SEQ ID NO: 329145 - RNA, 22 nt, Homo sapiens
uggcgagaaaccauaugcuuuc

SEQ ID NO: 329146 - RNA, 22 nt, Homo sapiens
uggcuacuguacuugagcuauu

SEQ ID NO: 329147 - RNA, 23 nt, Homo sapiens
uggcuagacguccuuuccugaug

SEQ ID NO: 329148 - RNA, 22 nt, Homo sapiens
uggcucuguuuguuaacuagac

SEQ ID NO: 329149 - RNA, 22 nt, Homo sapiens
uggcuguuuauuucaccugggc

SEQ ID NO: 329150 - RNA, 22 nt, Homo sapiens
uuacugcauaauuccugggaag

SEQ ID NO: 329151 - RNA, 22 nt, Homo sapiens
uuacuguagugucauaucguau

SEQ ID NO: 329152 - RNA, 22 nt, Homo sapiens
uuacuugagaugaguuggacaa

SEQ ID NO: 329153 - RNA, 22 nt, Homo sapiens
uuagacaguggugcacugcacu

SEQ ID NO: 329154 - RNA, 22 nt, Homo sapiens
uuagaguacaggggaaucaagg

SEQ ID NO: 329155 - RNA, 20 nt, Homo sapiens
uuagaguaguaugauuuaua

SEQ ID NO: 329156 - RNA, 22 nt, Homo sapiens
uuagcaauugauucucauaagc

SEQ ID NO: 329157 - RNA, 22 nt, Homo sapiens
uuagcacaucuuucuauguaag

SEQ ID NO: 329158 - RNA, 22 nt, Homo sapiens
uuagcaccacacacuuuagagg

SEQ ID NO: 329159 - RNA, 22 nt, Homo sapiens
uuagcagcacaaaagcagacua

SEQ ID NO: 329160 - RNA, 22 nt, Homo sapiens
uuagcauccauaggagauuggu

SEQ ID NO: 329161 - RNA, 22 nt, Homo sapiens
uuaggcaggauaguuacauauu

SEQ ID NO: 329162 - RNA, 21 nt, Homo sapiens
uuaggcagugucagaggugag

SEQ ID NO: 329163 - RNA, 22 nt, Homo sapiens
uuagggaggacaguuacaacag

SEQ ID NO: 329164 - RNA, 22 nt, Homo sapiens
uuagguaauauauugcugcuuu

SEQ ID NO: 329165 - RNA, 22 nt, Homo sapiens
uuagguacuuuggagagauuca

SEQ ID NO: 329166 - RNA, 22 nt, Homo sapiens
uuagguauuaggaaauaugcuu

SEQ ID NO: 329167 - RNA, 22 nt, Homo sapiens
uuagguauuuuguuaugucagc

SEQ ID NO: 329168 - RNA, 22 nt, Homo sapiens
uuagguuguugccauugaaagu

SEQ ID NO: 329169 - RNA, 22 nt, Homo sapiens
uuaguaguagugcuguaauuuu

SEQ ID NO: 329170 - RNA, 22 nt, Homo sapiens
uuaguccacuggaacuguuaua

SEQ ID NO: 329171 - RNA, 22 nt, Homo sapiens
uuagugaaugggugugauuugu

SEQ ID NO: 329172 - RNA, 22 nt, Homo sapiens
uuaguggaugcugaauaaagaa

SEQ ID NO: 329173 - RNA, 22 nt, Homo sapiens
uuaguucccucauucuugacuu

SEQ ID NO: 329174 - RNA, 22 nt, Homo sapiens
uuauacacugugggaguguaaa

SEQ ID NO: 329175 - RNA, 22 nt, Homo sapiens
uuauacucgucugaaugauucu

SEQ ID NO: 329176 - RNA, 18 nt, Homo sapiens
uuauaugcauguguagga

SEQ ID NO: 329177 - RNA, 22 nt, Homo sapiens
uuauauguuagacauggugggu

SEQ ID NO: 329178 - RNA, 22 nt, Homo sapiens
uuauauguuuguacuuaggccu

SEQ ID NO: 329179 - RNA, 22 nt, Homo sapiens
uuaucauagugcaguuuucuga

SEQ ID NO: 329180 - RNA, 22 nt, Homo sapiens
uuaugcaucuuccacacucauu

SEQ ID NO: 329181 - RNA, 22 nt, Homo sapiens
uuaugcuugugugaauuuuccc

SEQ ID NO: 329182 - RNA, 22 nt, Homo sapiens
uuauggcuauugaugacaauug

SEQ ID NO: 329183 - RNA, 22 nt, Homo sapiens
uuaugucacuguucagucuccc

SEQ ID NO: 329184 - RNA, 22 nt, Homo sapiens
uuaugucuuuuguguucagcua

SEQ ID NO: 329185 - RNA, 22 nt, Homo sapiens
uuauuacuccuauuuuguagau

SEQ ID NO: 329186 - RNA, 22 nt, Homo sapiens
uuauuagagauauuugguuagg

SEQ ID NO: 329187 - RNA, 22 nt, Homo sapiens
uuauugaguaaaaagaaugguu

SEQ ID NO: 329188 - RNA, 22 nt, Homo sapiens
uuauugcacuccagccugggua

SEQ ID NO: 329189 - RNA, 20 nt, Homo sapiens
uuauugcggcaucauucaug

SEQ ID NO: 329190 - RNA, 22 nt, Homo sapiens
uuauugcucauuugggcauucu

SEQ ID NO: 329191 - RNA, 22 nt, Homo sapiens
uucaaaguguugguuuugggcu

SEQ ID NO: 329192 - RNA, 22 nt, Homo sapiens
uucaaauguucuuucaccaccc

SEQ ID NO: 329193 - RNA, 23 nt, Homo sapiens
uucaacagguagacccucccugc

SEQ ID NO: 329194 - RNA, 22 nt, Homo sapiens
uucaagauggcaccagugagug

SEQ ID NO: 329195 - RNA, 22 nt, Homo sapiens
uucaagcuauggugaucuuuuc

SEQ ID NO: 329196 - RNA, 22 nt, Homo sapiens
uucaagucaacaagcacuugag

SEQ ID NO: 329197 - RNA, 22 nt, Homo sapiens
uucaauuaauauuauacucuca

SEQ ID NO: 329198 - RNA, 22 nt, Homo sapiens
uucacaaugccuuguugauggu

SEQ ID NO: 329199 - RNA, 22 nt, Homo sapiens
uucacaauuaaaugugguuauu

SEQ ID NO: 329200 - RNA, 22 nt, Homo sapiens
uucacagaaaaaggcgaugagg

SEQ ID NO: 329201 - RNA, 22 nt, Homo sapiens
uucacagagagaacucaaacca

SEQ ID NO: 329202 - RNA, 22 nt, Homo sapiens
uucacagccgcaccccaucacu

SEQ ID NO: 329203 - RNA, 22 nt, Homo sapiens
uucacaguacucccuggaauua

SEQ ID NO: 329204 - RNA, 22 nt, Homo sapiens
uucacaguguuucucacgguua

SEQ ID NO: 329205 - RNA, 22 nt, Homo sapiens
uucaccuggguuggccaucauu

SEQ ID NO: 329206 - RNA, 22 nt, Homo sapiens
uucacugcaugaaaaggacagc

SEQ ID NO: 329207 - RNA, 20 nt, Homo sapiens
uucacugggcucucuguugg

SEQ ID NO: 329208 - RNA, 21 nt, Homo sapiens
uucacuggucuauuucccuuu

SEQ ID NO: 329209 - RNA, 22 nt, Homo sapiens
uucacuguagccucagccucuu

SEQ ID NO: 329210 - RNA, 22 nt, Homo sapiens
uucacugugcuuaaauucugcu

SEQ ID NO: 329211 - RNA, 22 nt, Homo sapiens
uucagacugggugaagagggua

SEQ ID NO: 329212 - RNA, 22 nt, Homo sapiens
uucagauugcauaccgaaagua

SEQ ID NO: 329213 - RNA, 22 nt, Homo sapiens
uucagcaaugacagccuauaua

SEQ ID NO: 329214 - RNA, 22 nt, Homo sapiens
uucaggcaccauggucauugau

SEQ ID NO: 329215 - RNA, 22 nt, Homo sapiens
uucaggcaccauugucauugau

SEQ ID NO: 329216 - RNA, 22 nt, Homo sapiens
uucagggcauuggaguuucuga

SEQ ID NO: 329217 - RNA, 22 nt, Homo sapiens
uucaguaaauguucuuacuaua

SEQ ID NO: 329218 - RNA, 22 nt, Homo sapiens
uucaguccauuuccuuggucac

SEQ ID NO: 329219 - RNA, 22 nt, Homo sapiens
uucaguggagaggcugaguggu

SEQ ID NO: 329220 - RNA, 22 nt, Homo sapiens
uucagugucauuaacacaguag

SEQ ID NO: 329221 - RNA, 21 nt, Homo sapiens
uucauaaggcuucucuccugu

SEQ ID NO: 329222 - RNA, 22 nt, Homo sapiens
uucauagaggacauuacuggag

SEQ ID NO: 329223 - RNA, 22 nt, Homo sapiens
uucauaguauuuuucuccaaau

SEQ ID NO: 329224 - RNA, 22 nt, Homo sapiens
uucauagucuaauuuuuuccac

SEQ ID NO: 329225 - RNA, 22 nt, Homo sapiens
uucauaguucuuuuagucauua

SEQ ID NO: 329226 - RNA, 22 nt, Homo sapiens
uucaucaggaauauugaccugu

SEQ ID NO: 329227 - RNA, 20 nt, Homo sapiens
uucaucaggauauuggucua

SEQ ID NO: 329228 - RNA, 22 nt, Homo sapiens
uucaucagggagaaauaauuuc

SEQ ID NO: 329229 - RNA, 23 nt, Homo sapiens
uucaucagggauauuggccugaa

SEQ ID NO: 329230 - RNA, 22 nt, Homo sapiens
uucaugcaucuguagugguuaa

SEQ ID NO: 329231 - RNA, 22 nt, Homo sapiens
uucauggaacaaguggguucaa

SEQ ID NO: 329232 - RNA, 22 nt, Homo sapiens
uucauggacucaauaguuucgc

SEQ ID NO: 329233 - RNA, 22 nt, Homo sapiens
uucauggugguacaaaagcaau

SEQ ID NO: 329234 - RNA, 22 nt, Homo sapiens
uucauguaauuccauaagguaa

SEQ ID NO: 329235 - RNA, 22 nt, Homo sapiens
uucaugucuuggcuguuagagu

SEQ ID NO: 329236 - RNA, 22 nt, Homo sapiens
uucauugcugcuuaucuccaga

SEQ ID NO: 329237 - RNA, 22 nt, Homo sapiens
uucauuggacuuguguucuuga

SEQ ID NO: 329238 - RNA, 22 nt, Homo sapiens
uuccaagugggaaacaaaaaug

SEQ ID NO: 329239 - RNA, 21 nt, Homo sapiens
uuccagugagccuagaugccu

SEQ ID NO: 329240 - RNA, 22 nt, Homo sapiens
uuccaguggacuacuucauccu

SEQ ID NO: 329241 - RNA, 22 nt, Homo sapiens
uuccagugggacgagaugugga

SEQ ID NO: 329242 - RNA, 22 nt, Homo sapiens
uuccauguaguugaacgguuuu

SEQ ID NO: 329243 - RNA, 22 nt, Homo sapiens
uucccaguaaacucuaucccuc

SEQ ID NO: 329244 - RNA, 22 nt, Homo sapiens
uucccaguuggggaaagcgacc

SEQ ID NO: 329245 - RNA, 22 nt, Homo sapiens
uucccguacugguguugccuau

SEQ ID NO: 329246 - RNA, 22 nt, Homo sapiens
uucccugugggcuggugcucca

SEQ ID NO: 329247 - RNA, 22 nt, Homo sapiens
uucccugugguauagaagccgu

SEQ ID NO: 329248 - RNA, 22 nt, Homo sapiens
uucccuuucugaaaaucucauu

SEQ ID NO: 329249 - RNA, 22 nt, Homo sapiens
uucccuuuuuucuaguagguag

SEQ ID NO: 329250 - RNA, 22 nt, Homo sapiens
uuccguguaguugagcaguuuu

SEQ ID NO: 329251 - RNA, 22 nt, Homo sapiens
uuccuacugcccauuaaaaugg

SEQ ID NO: 329252 - RNA, 22 nt, Homo sapiens
uuccuacugugcaaaguugcaa

SEQ ID NO: 329253 - RNA, 22 nt, Homo sapiens
uuccuacuguucaucaggaacc

SEQ ID NO: 329254 - RNA, 22 nt, Homo sapiens
uuccuaguccugagucucugcg

SEQ ID NO: 329255 - RNA, 19 nt, Homo sapiens
uuccuagugguugggaagu

SEQ ID NO: 329256 - RNA, 22 nt, Homo sapiens
uuccucuagacugucgguuucu

SEQ ID NO: 329257 - RNA, 19 nt, Homo sapiens
uuccugagaacaagggcuu

SEQ ID NO: 329258 - RNA, 22 nt, Homo sapiens
uuccugagagggcugggugcag

SEQ ID NO: 329259 - RNA, 22 nt, Homo sapiens
uuccuggaggggaaguguccaa

SEQ ID NO: 329260 - RNA, 20 nt, Homo sapiens
uuccuuaggcauuggaagaa

SEQ ID NO: 329261 - RNA, 22 nt, Homo sapiens
uuccuugaaacagucaagagaa

SEQ ID NO: 329262 - RNA, 22 nt, Homo sapiens
uuccuugugacuaguagugacc

SEQ ID NO: 329263 - RNA, 20 nt, Homo sapiens
uucuacagucacaggaagau

SEQ ID NO: 329264 - RNA, 22 nt, Homo sapiens
uucuacagugacugcagccaua

SEQ ID NO: 329265 - RNA, 22 nt, Homo sapiens
uucuagagagaagacuuaagcu

SEQ ID NO: 329266 - RNA, 22 nt, Homo sapiens
uucuauggucacagaugcuuga

SEQ ID NO: 329267 - RNA, 22 nt, Homo sapiens
uucuauguuugaaaaugccaaa

SEQ ID NO: 329268 - RNA, 22 nt, Homo sapiens
uucucaaggagccuucguaacu

SEQ ID NO: 329269 - RNA, 21 nt, Homo sapiens
uucucagaggcaggggauaaa

SEQ ID NO: 329270 - RNA, 22 nt, Homo sapiens
uucucaguuccuacuuugguga

SEQ ID NO: 329271 - RNA, 22 nt, Homo sapiens
uucucauggaacaucuguacug

SEQ ID NO: 329272 - RNA, 22 nt, Homo sapiens
uucucauggugauggcaaaauc

SEQ ID NO: 329273 - RNA, 22 nt, Homo sapiens
uucucgcuuuuuccaccuguau

SEQ ID NO: 329274 - RNA, 22 nt, Homo sapiens
uucucuaguuacuuuaauggag

SEQ ID NO: 329275 - RNA, 22 nt, Homo sapiens
uucucuggucagaggggagguu

SEQ ID NO: 329276 - RNA, 22 nt, Homo sapiens
uucugagguuauauucucucaa

SEQ ID NO: 329277 - RNA, 22 nt, Homo sapiens
uucugaguggcuuucaacacug

SEQ ID NO: 329278 - RNA, 22 nt, Homo sapiens
uucugccaaucaacccacaucc

SEQ ID NO: 329279 - RNA, 22 nt, Homo sapiens
uucuggccccucccaaucucau

SEQ ID NO: 329280 - RNA, 22 nt, Homo sapiens
uucuuagucaaguuguauuuca

SEQ ID NO: 329281 - RNA, 22 nt, Homo sapiens
uucuuaguggcaccacuuuuuu

SEQ ID NO: 329282 - RNA, 22 nt, Homo sapiens
uucuucaggccacaaaaauggu

SEQ ID NO: 329283 - RNA, 22 nt, Homo sapiens
uucuugcuguauccucacaugg

SEQ ID NO: 329284 - RNA, 22 nt, Homo sapiens
uucuugguguaguaguugaaaa

SEQ ID NO: 329285 - RNA, 22 nt, Homo sapiens
uucuugguuuaucgcuuuaaaa

SEQ ID NO: 329286 - RNA, 22 nt, Homo sapiens
uugaaagaaaggagacugaguu

SEQ ID NO: 329287 - RNA, 22 nt, Homo sapiens
uugaaagacaucaccuacugcu

SEQ ID NO: 329288 - RNA, 22 nt, Homo sapiens
uugaaaguaaacaucacaaaga

SEQ ID NO: 329289 - RNA, 22 nt, Homo sapiens
uugaaaucuuccacagcccaag

SEQ ID NO: 329290 - RNA, 22 nt, Homo sapiens
uugaacuguaagggucugugug

SEQ ID NO: 329291 - RNA, 22 nt, Homo sapiens
uugaagacuaaguuaucaggau

SEQ ID NO: 329292 - RNA, 22 nt, Homo sapiens
uugaagguaggaugugcuauca

SEQ ID NO: 329293 - RNA, 22 nt, Homo sapiens
uugaaguagaaagacgaaauuu

SEQ ID NO: 329294 - RNA, 22 nt, Homo sapiens
uugaaguagguaccguucaauu

SEQ ID NO: 329295 - RNA, 22 nt, Homo sapiens
uugaaguauagaguuuaagaac

SEQ ID NO: 329296 - RNA, 22 nt, Homo sapiens
uugaaguaugaccgcugagaau

SEQ ID NO: 329297 - RNA, 22 nt, Homo sapiens
uugaauagaaguguugaaagug

SEQ ID NO: 329298 - RNA, 22 nt, Homo sapiens
uugaauaggcucaugcuuauca

SEQ ID NO: 329299 - RNA, 22 nt, Homo sapiens
uugaaugaaaugaugucauuug

SEQ ID NO: 329300 - RNA, 23 nt, Homo sapiens
uugaauguuuccccucccaaauu

SEQ ID NO: 329301 - RNA, 22 nt, Homo sapiens
uugacaaugcacugugcuaagu

SEQ ID NO: 329302 - RNA, 22 nt, Homo sapiens
uugacauauguguguccacaua

SEQ ID NO: 329303 - RNA, 22 nt, Homo sapiens
uugacauguaaguacucuauag

SEQ ID NO: 329304 - RNA, 22 nt, Homo sapiens
uugaccuauguuucuucaucug

SEQ ID NO: 329305 - RNA, 22 nt, Homo sapiens
uugacguaggaggauguugaga

SEQ ID NO: 329306 - RNA, 22 nt, Homo sapiens
uugacugggccagacagagauc

SEQ ID NO: 329307 - RNA, 23 nt, Homo sapiens
uugacuguggguacaaugugaua

SEQ ID NO: 329308 - RNA, 22 nt, Homo sapiens
uugacuucagagcugauucaag

SEQ ID NO: 329309 - RNA, 21 nt, Homo sapiens
uugagaagaauuagcucuucc

SEQ ID NO: 329310 - RNA, 22 nt, Homo sapiens
uugagacggagucucacucugu

SEQ ID NO: 329311 - RNA, 22 nt, Homo sapiens
uugagacggaguuuugcucuug

SEQ ID NO: 329312 - RNA, 22 nt, Homo sapiens
uugagagaaaaggccaugccuu

SEQ ID NO: 329313 - RNA, 17 nt, Homo sapiens
uugagaguauaucuuac

SEQ ID NO: 329314 - RNA, 22 nt, Homo sapiens
uugagauaggagcuguuguucu

SEQ ID NO: 329315 - RNA, 22 nt, Homo sapiens
uugagaugauggauaugcuaau

SEQ ID NO: 329316 - RNA, 22 nt, Homo sapiens
uugagauggagccucacucugc

SEQ ID NO: 329317 - RNA, 22 nt, Homo sapiens
uugagauggagucucacgcauu

SEQ ID NO: 329318 - RNA, 22 nt, Homo sapiens
uugagauggagucucacucugu

SEQ ID NO: 329319 - RNA, 22 nt, Homo sapiens
uugagauggagucuugcacugu

SEQ ID NO: 329320 - RNA, 22 nt, Homo sapiens
uugagauggagucuugcucugu

SEQ ID NO: 329321 - RNA, 22 nt, Homo sapiens
uugagauggaguuucacucugu

SEQ ID NO: 329322 - RNA, 22 nt, Homo sapiens
uugagauggaguuucgcucuug

SEQ ID NO: 329323 - RNA, 22 nt, Homo sapiens
uugagauguaagauguuaauau

SEQ ID NO: 329324 - RNA, 22 nt, Homo sapiens
uugagauguauguauauaaugu

SEQ ID NO: 329325 - RNA, 22 nt, Homo sapiens
uugagcacaguagguuguggcu

SEQ ID NO: 329326 - RNA, 22 nt, Homo sapiens
uugagcaucauguuagcacuca

SEQ ID NO: 329327 - RNA, 22 nt, Homo sapiens
uugagcucaucaagauagagaa

SEQ ID NO: 329328 - RNA, 22 nt, Homo sapiens
uugaggaaugugauuucaaaua

SEQ ID NO: 329329 - RNA, 22 nt, Homo sapiens
uugaggcaaugaggagaagcug

SEQ ID NO: 329330 - RNA, 23 nt, Homo sapiens
uugaggcauguaccaucaauauc

SEQ ID NO: 329331 - RNA, 22 nt, Homo sapiens
uugaggccugauaacacacuga

SEQ ID NO: 329332 - RNA, 22 nt, Homo sapiens
uugaggcuuuugaccucaugug

SEQ ID NO: 329333 - RNA, 22 nt, Homo sapiens
uugagggaagccagaggucugc

SEQ ID NO: 329334 - RNA, 22 nt, Homo sapiens
aaaacgcauccucacaggucug

SEQ ID NO: 329335 - RNA, 22 nt, Homo sapiens
aaaaguucuuugagccuugaca

SEQ ID NO: 329336 - RNA, 18 nt, Homo sapiens
aaacugcuuccuuggccu

SEQ ID NO: 329337 - RNA, 22 nt, Homo sapiens
aaacugucuggaugcuugugga

SEQ ID NO: 329338 - RNA, 22 nt, Homo sapiens
aaacugucuucugacaguuucc

SEQ ID NO: 329339 - RNA, 22 nt, Homo sapiens
aaagcuaagguagcauuggaga

SEQ ID NO: 329340 - RNA, 22 nt, Homo sapiens
aaagcuacaggaccugcucauu

SEQ ID NO: 329341 - RNA, 22 nt, Homo sapiens
aaagcuaccagauucuguugga

SEQ ID NO: 329342 - RNA, 22 nt, Homo sapiens
aaaggaccacauauaugguggc

SEQ ID NO: 329343 - RNA, 22 nt, Homo sapiens
aaaggcacugaucuuauccagu

SEQ ID NO: 329344 - RNA, 22 nt, Homo sapiens
aaaggcaucugcucggcucccu

SEQ ID NO: 329345 - RNA, 19 nt, Homo sapiens
aaagguaguaaccucugau

SEQ ID NO: 329346 - RNA, 17 nt, Homo sapiens
aaaguccuuugcuaucu

SEQ ID NO: 329347 - RNA, 22 nt, Homo sapiens
aaagucuagaggaucaugugug

SEQ ID NO: 329348 - RNA, 22 nt, Homo sapiens
aaagucuguuacagcuauuucu

SEQ ID NO: 329349 - RNA, 22 nt, Homo sapiens
aaagugcacuuggaagagggcc

SEQ ID NO: 329350 - RNA, 22 nt, Homo sapiens
aaagugcaguauuugggcagaa

SEQ ID NO: 329351 - RNA, 22 nt, Homo sapiens
aaagugcaguauuugggcagga

SEQ ID NO: 329352 - RNA, 22 nt, Homo sapiens
aaagugcugagacagacuggga

SEQ ID NO: 329353 - RNA, 22 nt, Homo sapiens
aaagugcugagauuguaggcau

SEQ ID NO: 329354 - RNA, 22 nt, Homo sapiens
aaagugcugggaucacacugaa

SEQ ID NO: 329355 - RNA, 22 nt, Homo sapiens
aaagugcugggauuuuaggcau

SEQ ID NO: 329356 - RNA, 22 nt, Homo sapiens
aaagugcuucucuuuggugggu

SEQ ID NO: 329357 - RNA, 22 nt, Homo sapiens
aaaguguuucugcaguagguuu

SEQ ID NO: 329358 - RNA, 22 nt, Homo sapiens
aaaguucuugcugaaggauuau

SEQ ID NO: 329359 - RNA, 15 nt, Homo sapiens
aaauaugucaguucu

SEQ ID NO: 329360 - RNA, 22 nt, Homo sapiens
aaaugacuuuuuaugcagagua

SEQ ID NO: 329361 - RNA, 22 nt, Homo sapiens
aaaugcaccacucuggugcagg

SEQ ID NO: 329362 - RNA, 22 nt, Homo sapiens
aaaugcaguugguggggauaug

SEQ ID NO: 329363 - RNA, 18 nt, Homo sapiens
aaaugcucuucuggaaua

SEQ ID NO: 329364 - RNA, 22 nt, Homo sapiens
aaaugcucuuuaugaaguugga

SEQ ID NO: 329365 - RNA, 20 nt, Homo sapiens
aaaugcuguaauguuuggga

SEQ ID NO: 329366 - RNA, 22 nt, Homo sapiens
aaaugcuguuccaggaccuauc

SEQ ID NO: 329367 - RNA, 22 nt, Homo sapiens
aaauggcaccggcucuucccuc

SEQ ID NO: 329368 - RNA, 22 nt, Homo sapiens
aaauggcuuugaggguaggaca

SEQ ID NO: 329369 - RNA, 22 nt, Homo sapiens
aaaugguguuaguagaucuuua

SEQ ID NO: 329370 - RNA, 22 nt, Homo sapiens
aacaccauuuuucugcagccuu

SEQ ID NO: 329371 - RNA, 22 nt, Homo sapiens
uugagggagcacagauucuuau

SEQ ID NO: 329372 - RNA, 22 nt, Homo sapiens
uugagggaggcagggcuugucu

SEQ ID NO: 329373 - RNA, 22 nt, Homo sapiens
uugagguaggaggagcuuggau

SEQ ID NO: 329374 - RNA, 22 nt, Homo sapiens
uugagguauugauaaaacauuu

SEQ ID NO: 329375 - RNA, 22 nt, Homo sapiens
uugaggugaauuugcaggaugc

SEQ ID NO: 329376 - RNA, 22 nt, Homo sapiens
uugagguguauuguacagcaca

SEQ ID NO: 329377 - RNA, 22 nt, Homo sapiens
uugaguaguaaggauauuaucu

SEQ ID NO: 329378 - RNA, 21 nt, Homo sapiens
uugaguugaagcaaggaggga

SEQ ID NO: 329379 - RNA, 22 nt, Homo sapiens
uugauagguuuuauguauaguu

SEQ ID NO: 329380 - RNA, 22 nt, Homo sapiens
uugauaugaauggcuguuugug

SEQ ID NO: 329381 - RNA, 22 nt, Homo sapiens
uugauaugcuugucaguccauu

SEQ ID NO: 329382 - RNA, 22 nt, Homo sapiens
uugauauggcugcuuaccauaa

SEQ ID NO: 329383 - RNA, 22 nt, Homo sapiens
uugauauguuguuagauucagu

SEQ ID NO: 329384 - RNA, 22 nt, Homo sapiens
uugaucaucagcuuugucaucu

SEQ ID NO: 329385 - RNA, 22 nt, Homo sapiens
uugaucuggagagaggcccgug

SEQ ID NO: 329386 - RNA, 22 nt, Homo sapiens
uugaugauguuucugccuugcc

SEQ ID NO: 329387 - RNA, 22 nt, Homo sapiens
uugcaaagaccucuucacuucc

SEQ ID NO: 329388 - RNA, 22 nt, Homo sapiens
uugcaaaguugccaaggaagga

SEQ ID NO: 329389 - RNA, 22 nt, Homo sapiens
uugcaagauguuaacauuggag

SEQ ID NO: 329390 - RNA, 22 nt, Homo sapiens
uugcaagugccguaacuaccaa

SEQ ID NO: 329391 - RNA, 22 nt, Homo sapiens
uugcaaguggagcuuccagggc

SEQ ID NO: 329392 - RNA, 22 nt, Homo sapiens
uugcacaguguguacagcacca

SEQ ID NO: 329393 - RNA, 22 nt, Homo sapiens
uugcacauugauuuuguauccu

SEQ ID NO: 329394 - RNA, 22 nt, Homo sapiens
uugcacuccagcucgggugaca

SEQ ID NO: 329395 - RNA, 18 nt, Homo sapiens
uugcacuccugccugggu

SEQ ID NO: 329396 - RNA, 22 nt, Homo sapiens
uugcacugagauuuugcuuaca

SEQ ID NO: 329397 - RNA, 22 nt, Homo sapiens
uugcacuuccgccugggugaca

SEQ ID NO: 329398 - RNA, 20 nt, Homo sapiens
uugcagagcccaacccugga

SEQ ID NO: 329399 - RNA, 22 nt, Homo sapiens
uugcagagucaguuauuuugcc

SEQ ID NO: 329400 - RNA, 22 nt, Homo sapiens
uugcagcaaagagggaggggca

SEQ ID NO: 329401 - RNA, 22 nt, Homo sapiens
uugcauaagugcauucugugau

SEQ ID NO: 329402 - RNA, 23 nt, Homo sapiens
uugcauagacauccucauagauu

SEQ ID NO: 329403 - RNA, 19 nt, Homo sapiens
uugcauauguugaaccagc

SEQ ID NO: 329404 - RNA, 22 nt, Homo sapiens
uugcaugguggaacuuggagcu

SEQ ID NO: 329405 - RNA, 22 nt, Homo sapiens
uugccuaggcuggagugcagug

SEQ ID NO: 329406 - RNA, 21 nt, Homo sapiens
uugccugacacuggaagaaau

SEQ ID NO: 329407 - RNA, 22 nt, Homo sapiens
uugccugagaagccaagaauaa

SEQ ID NO: 329408 - RNA, 22 nt, Homo sapiens
uugccuuuguuggaaacaagug

SEQ ID NO: 329409 - RNA, 22 nt, Homo sapiens
uugcgcuuuuccuauguugccc

SEQ ID NO: 329410 - RNA, 22 nt, Homo sapiens
uugcuacuuggauguacaugug

SEQ ID NO: 329411 - RNA, 22 nt, Homo sapiens
uugcuagaugaaaaugguaccu

SEQ ID NO: 329412 - RNA, 22 nt, Homo sapiens
uugcucaccugagaagaauaga

SEQ ID NO: 329413 - RNA, 22 nt, Homo sapiens
uugcuccccaggaaaggaagca

SEQ ID NO: 329414 - RNA, 22 nt, Homo sapiens
uugcuccucugccaggaccugu

SEQ ID NO: 329415 - RNA, 22 nt, Homo sapiens
uuggaaaccucugcagguguuu

SEQ ID NO: 329416 - RNA, 22 nt, Homo sapiens
uuggaaaugguaaaggguuaau

SEQ ID NO: 329417 - RNA, 20 nt, Homo sapiens
uuggaaaugugaauugggag

SEQ ID NO: 329418 - RNA, 22 nt, Homo sapiens
uuggaaggcuccuaaugaaugg

SEQ ID NO: 329419 - RNA, 22 nt, Homo sapiens
uuggaauuuuaaaauaggcaac

SEQ ID NO: 329420 - RNA, 22 nt, Homo sapiens
uuggaauuuuacuucuguaaga

SEQ ID NO: 329421 - RNA, 22 nt, Homo sapiens
uuggacucccuccccagcuuca

SEQ ID NO: 329422 - RNA, 22 nt, Homo sapiens
uuggacugagaguuccaccauu

SEQ ID NO: 329423 - RNA, 22 nt, Homo sapiens
uuggacugugagguuucguggg

SEQ ID NO: 329424 - RNA, 22 nt, Homo sapiens
uuggagagagaggacucccggc

SEQ ID NO: 329425 - RNA, 22 nt, Homo sapiens
uuggagagugauauucagaugc

SEQ ID NO: 329426 - RNA, 22 nt, Homo sapiens
uuggagugugcucauaacugcu

SEQ ID NO: 329427 - RNA, 22 nt, Homo sapiens
uuggagugugucuuauuccauu

SEQ ID NO: 329428 - RNA, 22 nt, Homo sapiens
uuggauauucaguuuuuccauc

SEQ ID NO: 329429 - RNA, 22 nt, Homo sapiens
uuggauccauccugucuucucu

SEQ ID NO: 329430 - RNA, 22 nt, Homo sapiens
uuggauuauaaacugagauuug

SEQ ID NO: 329431 - RNA, 22 nt, Homo sapiens
uuggcaaagaggaaugccacuu

SEQ ID NO: 329432 - RNA, 22 nt, Homo sapiens
uuggcaagaaccuucuuccaag

SEQ ID NO: 329433 - RNA, 22 nt, Homo sapiens
uuggcacugagcaagaacaggg

SEQ ID NO: 329434 - RNA, 22 nt, Homo sapiens
uuggcacugggaaaaugaccac

SEQ ID NO: 329435 - RNA, 22 nt, Homo sapiens
uuggcacuugauaauauucugg

SEQ ID NO: 329436 - RNA, 20 nt, Homo sapiens
uuggcagagucuuuagggua

SEQ ID NO: 329437 - RNA, 22 nt, Homo sapiens
uuggcagugguucugacggacc

SEQ ID NO: 329438 - RNA, 22 nt, Homo sapiens
uuggccccuuucauccacagcu

SEQ ID NO: 329439 - RNA, 22 nt, Homo sapiens
uuggcccugcugaccauucccu

SEQ ID NO: 329440 - RNA, 22 nt, Homo sapiens
uuggccuccuggucauauccag

SEQ ID NO: 329441 - RNA, 22 nt, Homo sapiens
uugggagugucucuggacugca

SEQ ID NO: 329442 - RNA, 22 nt, Homo sapiens
uugggcaauaggaagcaggugg

SEQ ID NO: 329443 - RNA, 21 nt, Homo sapiens
uuggggaauggagagguuuuc

SEQ ID NO: 329444 - RNA, 22 nt, Homo sapiens
uugguaaaaugaccacagacau

SEQ ID NO: 329445 - RNA, 22 nt, Homo sapiens
uugguaagguggaugaugaaua

SEQ ID NO: 329446 - RNA, 22 nt, Homo sapiens
uugguaaugggcugguauaacc

SEQ ID NO: 329447 - RNA, 22 nt, Homo sapiens
uuggucagcucaauggagaggg

SEQ ID NO: 329448 - RNA, 22 nt, Homo sapiens
uuggucaggagccucccucuuu

SEQ ID NO: 329449 - RNA, 22 nt, Homo sapiens
uugguccccacuccccugccaa

SEQ ID NO: 329450 - RNA, 22 nt, Homo sapiens
uugguuaucaucauuucagcaa

SEQ ID NO: 329451 - RNA, 22 nt, Homo sapiens
uuguaaagaucauaugcuguuc

SEQ ID NO: 329452 - RNA, 22 nt, Homo sapiens
uuguaaagucugucucagucag

SEQ ID NO: 329453 - RNA, 22 nt, Homo sapiens
uuguaaucaacacaucauuggg

SEQ ID NO: 329454 - RNA, 22 nt, Homo sapiens
uuguaauguuaggguguccaug

SEQ ID NO: 329455 - RNA, 22 nt, Homo sapiens
uuguacaggaguguaagcuuca

SEQ ID NO: 329456 - RNA, 22 nt, Homo sapiens
uuguaccacagggcaugaagug

SEQ ID NO: 329457 - RNA, 22 nt, Homo sapiens
uuguacuagucauauuuugaaa

SEQ ID NO: 329458 - RNA, 22 nt, Homo sapiens
uuguauacucuauuuuagcagu

SEQ ID NO: 329459 - RNA, 22 nt, Homo sapiens
uuguauugucuugaugaguuga

SEQ ID NO: 329460 - RNA, 22 nt, Homo sapiens
uugucauggucuugauccauua

SEQ ID NO: 329461 - RNA, 22 nt, Homo sapiens
uugucaugguuaauuuuaugua

SEQ ID NO: 329462 - RNA, 22 nt, Homo sapiens
uuguccuggagguucuugcaag

SEQ ID NO: 329463 - RNA, 18 nt, Homo sapiens
aaaaagugcucaggccua

SEQ ID NO: 329464 - RNA, 22 nt, Homo sapiens
aaaagucuguagugaaagguga

SEQ ID NO: 329465 - RNA, 22 nt, Homo sapiens
aaaagugguguuguuucuaaau

SEQ ID NO: 329466 - RNA, 18 nt, Homo sapiens
aaacagugucucuuucug

SEQ ID NO: 329467 - RNA, 22 nt, Homo sapiens
aaaccaccauuacuuuugcacc

SEQ ID NO: 329468 - RNA, 22 nt, Homo sapiens
aaacgugcagagaucaauagca

SEQ ID NO: 329469 - RNA, 22 nt, Homo sapiens
aaacucuguagcagagacagau

SEQ ID NO: 329470 - RNA, 20 nt, Homo sapiens
aaacucugucuucuuuauca

SEQ ID NO: 329471 - RNA, 22 nt, Homo sapiens
aaacugccuuccuuguaggugc

SEQ ID NO: 329472 - RNA, 23 nt, Homo sapiens
aaagacuagucaggugcaguggu

SEQ ID NO: 329473 - RNA, 22 nt, Homo sapiens
aaagagcugagaccugguggag

SEQ ID NO: 329474 - RNA, 22 nt, Homo sapiens
aaagcacuggagucaucaucua

SEQ ID NO: 329475 - RNA, 22 nt, Homo sapiens
aaagcagcaggugguuuucaau

SEQ ID NO: 329476 - RNA, 22 nt, Homo sapiens
aaagcuagagaagcugcuguca

SEQ ID NO: 329477 - RNA, 22 nt, Homo sapiens
aaaggauucuaauggaaaugcu

SEQ ID NO: 329478 - RNA, 22 nt, Homo sapiens
aaaggcuucggaucagaaggua

SEQ ID NO: 329479 - RNA, 22 nt, Homo sapiens
aaagggcuguuucuugacuugg

SEQ ID NO: 329480 - RNA, 19 nt, Homo sapiens
aaaguacucugaugccucu

SEQ ID NO: 329481 - RNA, 22 nt, Homo sapiens
aaagucacuggagaaggaauau

SEQ ID NO: 329482 - RNA, 18 nt, Homo sapiens
aaagugaugucauucuuu

SEQ ID NO: 329483 - RNA, 22 nt, Homo sapiens
aaagugauugcgguuuuugcca

SEQ ID NO: 329484 - RNA, 22 nt, Homo sapiens
aaagugcugggauuggccgggc

SEQ ID NO: 329485 - RNA, 22 nt, Homo sapiens
aaagugcugggauuggcugggc

SEQ ID NO: 329486 - RNA, 22 nt, Homo sapiens
aaagugcuuccuuuuugagggu

SEQ ID NO: 329487 - RNA, 22 nt, Homo sapiens
aaagugguuuuucagacuuuga

SEQ ID NO: 329488 - RNA, 22 nt, Homo sapiens
aaagugucuguuccuagcauga

SEQ ID NO: 329489 - RNA, 22 nt, Homo sapiens
aaauaacugucagguucuggaa

SEQ ID NO: 329490 - RNA, 22 nt, Homo sapiens
aaaugcacagaaaggaugugga

SEQ ID NO: 329491 - RNA, 21 nt, Homo sapiens
aaaugcacauuacugcuggug

SEQ ID NO: 329492 - RNA, 22 nt, Homo sapiens
aaaugcacgcuacccagcuaga

SEQ ID NO: 329493 - RNA, 22 nt, Homo sapiens
aaaugcagauuccuaggcccca

SEQ ID NO: 329494 - RNA, 22 nt, Homo sapiens
aaaugcaucauuaggugauuuu

SEQ ID NO: 329495 - RNA, 22 nt, Homo sapiens
aaaugcaugaggugggaagaaa

SEQ ID NO: 329496 - RNA, 22 nt, Homo sapiens
aaaugcauggacagcuggucuu

SEQ ID NO: 329497 - RNA, 22 nt, Homo sapiens
aaaugcauugagggaaaaggca

SEQ ID NO: 329498 - RNA, 22 nt, Homo sapiens
aaaugccucccauucuacugac

SEQ ID NO: 329499 - RNA, 22 nt, Homo sapiens
aaaugcugcuuuggccucuucu

SEQ ID NO: 329500 - RNA, 22 nt, Homo sapiens
aaaugcugucaaauuguguucu

SEQ ID NO: 329501 - RNA, 22 nt, Homo sapiens
aaaugcuucuauguggcauguu

SEQ ID NO: 329502 - RNA, 22 nt, Homo sapiens
aaaugcuuucuuggaccauuug

SEQ ID NO: 329503 - RNA, 22 nt, Homo sapiens
aaauggcuuuuugggcaaggug

SEQ ID NO: 329504 - RNA, 22 nt, Homo sapiens
aaaugucauggaguguuucccc

SEQ ID NO: 329505 - RNA, 21 nt, Homo sapiens
aaaugugcuuuaguacccuca

SEQ ID NO: 329506 - RNA, 22 nt, Homo sapiens
aaauucaucaaaugguuuguau

SEQ ID NO: 329507 - RNA, 22 nt, Homo sapiens
aaauucaugucaccucuaggua

SEQ ID NO: 329508 - RNA, 22 nt, Homo sapiens
aaauugcaguuaggaugauggu

SEQ ID NO: 329509 - RNA, 22 nt, Homo sapiens
aaauuguccuauugguuuaagc

SEQ ID NO: 329510 - RNA, 22 nt, Homo sapiens
aacagaccuagauaguauaguc

SEQ ID NO: 329511 - RNA, 22 nt, Homo sapiens
aacagacugucacauaaaauug

SEQ ID NO: 329512 - RNA, 22 nt, Homo sapiens
aacaggcuccuaggggugcacc

SEQ ID NO: 329513 - RNA, 22 nt, Homo sapiens
aacaguaucuaacgagugauga

SEQ ID NO: 329514 - RNA, 22 nt, Homo sapiens
aacagugcauucagggauauau

SEQ ID NO: 329515 - RNA, 22 nt, Homo sapiens
aacagugcuucauucacacauu

SEQ ID NO: 329516 - RNA, 22 nt, Homo sapiens
aacaguguuuuggguuuucugg

SEQ ID NO: 329517 - RNA, 22 nt, Homo sapiens
aacaucaaccaugaggguugga

SEQ ID NO: 329518 - RNA, 22 nt, Homo sapiens
aacugcacuaggacagguuuuu

SEQ ID NO: 329519 - RNA, 22 nt, Homo sapiens
aacuggcacuacaucaagagcu

SEQ ID NO: 329520 - RNA, 22 nt, Homo sapiens
aacuggcauaugaacuuguucu

SEQ ID NO: 329521 - RNA, 22 nt, Homo sapiens
acugcacuccagccugaugaaa

SEQ ID NO: 329522 - RNA, 22 nt, Homo sapiens
acugcacuccagccugcugaca

SEQ ID NO: 329523 - RNA, 22 nt, Homo sapiens
acugcacuccagccugugagac

SEQ ID NO: 329524 - RNA, 22 nt, Homo sapiens
acugcacuccagccuguugaca

SEQ ID NO: 329525 - RNA, 22 nt, Homo sapiens
acugcacuccagccuuggcaac

SEQ ID NO: 329526 - RNA, 22 nt, Homo sapiens
acugcacuccagcuuuggugac

SEQ ID NO: 329527 - RNA, 20 nt, Homo sapiens
acugcacuccagucucuggg

SEQ ID NO: 329528 - RNA, 22 nt, Homo sapiens
acugcacuccaguuugggcagc

SEQ ID NO: 329529 - RNA, 22 nt, Homo sapiens
acugcacuccaucuuagguggc

SEQ ID NO: 329530 - RNA, 22 nt, Homo sapiens
acugcacuccggccuggcaaca

SEQ ID NO: 329531 - RNA, 22 nt, Homo sapiens
acugcacuccuccuugggugac

SEQ ID NO: 329532 - RNA, 22 nt, Homo sapiens
acugcacuucaaccucauugac

SEQ ID NO: 329533 - RNA, 22 nt, Homo sapiens
acugcacuucagccuguugaca

SEQ ID NO: 329534 - RNA, 22 nt, Homo sapiens
acugcacuucagccuugugaca

SEQ ID NO: 329535 - RNA, 20 nt, Homo sapiens
acugcauuuaguccucagga

SEQ ID NO: 329536 - RNA, 22 nt, Homo sapiens
acugcauuugucccuuuugaac

SEQ ID NO: 329537 - RNA, 22 nt, Homo sapiens
acugccuaaugacuuauguuuu

SEQ ID NO: 329538 - RNA, 22 nt, Homo sapiens
acuggcaauggcagaaauaguu

SEQ ID NO: 329539 - RNA, 22 nt, Homo sapiens
acuggcauagggcgggcacagu

SEQ ID NO: 329540 - RNA, 22 nt, Homo sapiens
acuggcuuaaggaugggccacu

SEQ ID NO: 329541 - RNA, 22 nt, Homo sapiens
acuggcuuuugagaaaaacacu

SEQ ID NO: 329542 - RNA, 22 nt, Homo sapiens
acuggguuaauuugaagguuga

SEQ ID NO: 329543 - RNA, 22 nt, Homo sapiens
acugguuguuuaacugaauuga

SEQ ID NO: 329544 - RNA, 22 nt, Homo sapiens
acuguguguuugucuagcacag

SEQ ID NO: 329545 - RNA, 22 nt, Homo sapiens
acuuaguauggggcuuuugaga

SEQ ID NO: 329546 - RNA, 20 nt, Homo sapiens
acuuuuugaugaggucguuu

SEQ ID NO: 329547 - RNA, 22 nt, Homo sapiens
acuuuuugaugaggucguuugu

SEQ ID NO: 329548 - RNA, 22 nt, Homo sapiens
acuuuuugcaaccauuuggacc

SEQ ID NO: 329549 - RNA, 22 nt, Homo sapiens
agaaacauucucuugccuccuu

SEQ ID NO: 329550 - RNA, 22 nt, Homo sapiens
agaaauguuuacucacccccuu

SEQ ID NO: 329551 - RNA, 22 nt, Homo sapiens
agaauaauguccccccaaggga

SEQ ID NO: 329552 - RNA, 19 nt, Homo sapiens
agaaucuaaauuauuucug

SEQ ID NO: 329553 - RNA, 22 nt, Homo sapiens
agaauguauauucuguaguugu

SEQ ID NO: 329554 - RNA, 22 nt, Homo sapiens
agaaugucagcuggauucagcu

SEQ ID NO: 329555 - RNA, 22 nt, Homo sapiens
agaaugugaacaucuugaaagu

SEQ ID NO: 329556 - RNA, 22 nt, Homo sapiens
agaaugugaccuuauuuggaga

SEQ ID NO: 329557 - RNA, 22 nt, Homo sapiens
agacaguauuggcaaagugugu

SEQ ID NO: 329558 - RNA, 22 nt, Homo sapiens
agacaguguguguauauauggu

SEQ ID NO: 329559 - RNA, 22 nt, Homo sapiens
agaccacuuuagagauuguuca

SEQ ID NO: 329560 - RNA, 22 nt, Homo sapiens
agacuagagcagagcccucucu

SEQ ID NO: 329561 - RNA, 22 nt, Homo sapiens
agagauaaagauuuuaauuuug

SEQ ID NO: 329562 - RNA, 22 nt, Homo sapiens
agagauaguuuccaacucauac

SEQ ID NO: 329563 - RNA, 22 nt, Homo sapiens
agagaucaauaugaaggaaaug

SEQ ID NO: 329564 - RNA, 20 nt, Homo sapiens
agagaucaguaauucaucaa

SEQ ID NO: 329565 - RNA, 22 nt, Homo sapiens
agagaugaagauggggcucccg

SEQ ID NO: 329566 - RNA, 22 nt, Homo sapiens
agagcaaugggugaauauuaaa

SEQ ID NO: 329567 - RNA, 22 nt, Homo sapiens
agagcacuguggguccaaauau

SEQ ID NO: 329568 - RNA, 22 nt, Homo sapiens
agagccacacucuccuaacuca

SEQ ID NO: 329569 - RNA, 22 nt, Homo sapiens
agaggaguacuacuccaagucu

SEQ ID NO: 329570 - RNA, 22 nt, Homo sapiens
agaggucuuaucaaacaugcuu

SEQ ID NO: 329571 - RNA, 20 nt, Homo sapiens
agagguuuugauagguucug

SEQ ID NO: 329572 - RNA, 22 nt, Homo sapiens
agagguuuugcacugguucuuu

SEQ ID NO: 329573 - RNA, 22 nt, Homo sapiens
agaguacaggcaaguuagucau

SEQ ID NO: 329574 - RNA, 22 nt, Homo sapiens
agaguaguaggaugaauggacu

SEQ ID NO: 329575 - RNA, 22 nt, Homo sapiens
agaguaguuuauuaugcuaagg

SEQ ID NO: 329576 - RNA, 22 nt, Homo sapiens
agaguaguuucuauauucuuca

SEQ ID NO: 329577 - RNA, 22 nt, Homo sapiens
agaguauacaugugagugagau

SEQ ID NO: 329578 - RNA, 22 nt, Homo sapiens
agaguauagcaacuuaguaaaa

SEQ ID NO: 329579 - RNA, 22 nt, Homo sapiens
agagucacaugaggcccuucau

SEQ ID NO: 329580 - RNA, 23 nt, Homo sapiens
agagugcaauggugccaucucgg

SEQ ID NO: 329581 - RNA, 22 nt, Homo sapiens
agagugcuaaggaaguaauuua

SEQ ID NO: 329582 - RNA, 22 nt, Homo sapiens
agagugcuauagauuagauuuc

SEQ ID NO: 329583 - RNA, 22 nt, Homo sapiens
agauacauuggauaaugguggg

SEQ ID NO: 329584 - RNA, 22 nt, Homo sapiens
agauaugucugcuauuugcugu

SEQ ID NO: 329585 - RNA, 22 nt, Homo sapiens
agauauuuguuaggucugucag

SEQ ID NO: 329586 - RNA, 22 nt, Homo sapiens
agaugauguuuacugagcauca

SEQ ID NO: 329587 - RNA, 22 nt, Homo sapiens
agaugcuguuaucaacuguagc

SEQ ID NO: 329588 - RNA, 22 nt, Homo sapiens
agauggucuucauaaguuuuaa

SEQ ID NO: 329589 - RNA, 22 nt, Homo sapiens
agauucauccaaguuguugcau

SEQ ID NO: 329590 - RNA, 22 nt, Homo sapiens
agcaacauuguucauaauagcu

SEQ ID NO: 329591 - RNA, 22 nt, Homo sapiens
agcaaccagaggagaugaggcu

SEQ ID NO: 329592 - RNA, 22 nt, Homo sapiens
agcacauuaguaucuaagaaca

SEQ ID NO: 329593 - RNA, 17 nt, Homo sapiens
agcaccacacucucuug

SEQ ID NO: 329594 - RNA, 22 nt, Homo sapiens
agcaccacauacuacagagaua

SEQ ID NO: 329595 - RNA, 22 nt, Homo sapiens
agcaccagaaucugaguuauuc

SEQ ID NO: 329596 - RNA, 22 nt, Homo sapiens
agcaccauuuauugaaaagaca

SEQ ID NO: 329597 - RNA, 22 nt, Homo sapiens
agcaccauuucucuaaagcacu

SEQ ID NO: 329598 - RNA, 22 nt, Homo sapiens
agcagagcauauucauucgggg

SEQ ID NO: 329599 - RNA, 21 nt, Homo sapiens
agcagaguggcagcucuuuug

SEQ ID NO: 329600 - RNA, 22 nt, Homo sapiens
agcagcaauuuuguaugguuua

SEQ ID NO: 329601 - RNA, 22 nt, Homo sapiens
agcagcacaucccuuucuggcc

SEQ ID NO: 329602 - RNA, 22 nt, Homo sapiens
agcagcauuccaaaaaucugcu

SEQ ID NO: 329603 - RNA, 20 nt, Homo sapiens
agcagccacagauuccucag

SEQ ID NO: 329604 - RNA, 17 nt, Homo sapiens
agcagcccauaucccca

SEQ ID NO: 329605 - RNA, 22 nt, Homo sapiens
agcagcgacacccuguggugag

SEQ ID NO: 329606 - RNA, 22 nt, Homo sapiens
agcagcuuugaucugaaugauu

SEQ ID NO: 329607 - RNA, 22 nt, Homo sapiens
agcagcuuugcauggccuguga

SEQ ID NO: 329608 - RNA, 22 nt, Homo sapiens
agcaggauuguuacaauaguaa

SEQ ID NO: 329609 - RNA, 22 nt, Homo sapiens
agcagguauucgggucaugggg

SEQ ID NO: 329610 - RNA, 22 nt, Homo sapiens
agcaguacauaaaaagcauccu

SEQ ID NO: 329611 - RNA, 22 nt, Homo sapiens
agcaguagaauuccugcaucac

SEQ ID NO: 329612 - RNA, 20 nt, Homo sapiens
agcaucagugguaguguugc

SEQ ID NO: 329613 - RNA, 22 nt, Homo sapiens
agcaucaugcaguugcuauuca

SEQ ID NO: 329614 - RNA, 22 nt, Homo sapiens
agccaguauuuccacagagugg

SEQ ID NO: 329615 - RNA, 22 nt, Homo sapiens
gcacugagagaagccccaagua

SEQ ID NO: 329616 - RNA, 22 nt, Homo sapiens
gcagaguauagagggcugggcc

SEQ ID NO: 329617 - RNA, 22 nt, Homo sapiens
gcagaucuucgcgguaaguguu

SEQ ID NO: 329618 - RNA, 22 nt, Homo sapiens
gcagcaguggcaguuaauauuu

SEQ ID NO: 329619 - RNA, 22 nt, Homo sapiens
gcaggauuggagccucucugaa

SEQ ID NO: 329620 - RNA, 22 nt, Homo sapiens
gcaguacuuuauguccuaauua

SEQ ID NO: 329621 - RNA, 22 nt, Homo sapiens
gcaguauuguugaaauguccau

SEQ ID NO: 329622 - RNA, 22 nt, Homo sapiens
gcagucaucugaaggcuuaacu

SEQ ID NO: 329623 - RNA, 22 nt, Homo sapiens
gcagugugauguuuuaaucuau

SEQ ID NO: 329624 - RNA, 22 nt, Homo sapiens
gcaguucuguaguugaaauuua

SEQ ID NO: 329625 - RNA, 22 nt, Homo sapiens
gcauaaagcuaauaagacgaag

SEQ ID NO: 329626 - RNA, 17 nt, Homo sapiens
gcauauguugaaccagu

SEQ ID NO: 329627 - RNA, 22 nt, Homo sapiens
gcauggauguugauggcugcug

SEQ ID NO: 329628 - RNA, 22 nt, Homo sapiens
gcauguaguagauguugaauaa

SEQ ID NO: 329629 - RNA, 22 nt, Homo sapiens
gcauugcacuuggcauagacug

SEQ ID NO: 329630 - RNA, 22 nt, Homo sapiens
gccaaaaugcugggauuacagg

SEQ ID NO: 329631 - RNA, 22 nt, Homo sapiens
gccaacauggcgcuccauucuu

SEQ ID NO: 329632 - RNA, 22 nt, Homo sapiens
gccaagaucugaauaauuaaga

SEQ ID NO: 329633 - RNA, 22 nt, Homo sapiens
gccaagaugcugcccacagaca

SEQ ID NO: 329634 - RNA, 20 nt, Homo sapiens
gccacaguuaagcuucugcc

SEQ ID NO: 329635 - RNA, 19 nt, Homo sapiens
gccaccuggugcguguucu

SEQ ID NO: 329636 - RNA, 22 nt, Homo sapiens
gccaguguuuuauugagaauuu

SEQ ID NO: 329637 - RNA, 22 nt, Homo sapiens
gccauggaggauuuauagaggc

SEQ ID NO: 329638 - RNA, 22 nt, Homo sapiens
gccauugcacuccagccuagcg

SEQ ID NO: 329639 - RNA, 22 nt, Homo sapiens
gccauugcacuccagccuaggc

SEQ ID NO: 329640 - RNA, 22 nt, Homo sapiens
gcccauuguuccuaggcuacaa

SEQ ID NO: 329641 - RNA, 22 nt, Homo sapiens
gccccaguacaggcuccuuaga

SEQ ID NO: 329642 - RNA, 22 nt, Homo sapiens
gcccuuugugucuggcuggggu

SEQ ID NO: 329643 - RNA, 22 nt, Homo sapiens
gccgagagauuuggaaugggga

SEQ ID NO: 329644 - RNA, 22 nt, Homo sapiens
gccucaguuguggccagggauu

SEQ ID NO: 329645 - RNA, 22 nt, Homo sapiens
gccuguagaagaguagaugacc

SEQ ID NO: 329646 - RNA, 22 nt, Homo sapiens
gcuaaggcaggagcauugcuug

SEQ ID NO: 329647 - RNA, 22 nt, Homo sapiens
gcuacugucuaucugugcuucu

SEQ ID NO: 329648 - RNA, 19 nt, Homo sapiens
gcucaccuugcugcuccag

SEQ ID NO: 329649 - RNA, 22 nt, Homo sapiens
gcucaugagacaagcaggagua

SEQ ID NO: 329650 - RNA, 22 nt, Homo sapiens
gcuccauuuuccauuucucuaa

SEQ ID NO: 329651 - RNA, 22 nt, Homo sapiens
gcucugguuacaaaggcaaauu

SEQ ID NO: 329652 - RNA, 22 nt, Homo sapiens
gcucuuuugggguaauucugag

SEQ ID NO: 329653 - RNA, 22 nt, Homo sapiens
gcugagacauugguuuucuccu

SEQ ID NO: 329654 - RNA, 19 nt, Homo sapiens
gcugauguuacauucuugc

SEQ ID NO: 329655 - RNA, 22 nt, Homo sapiens
gcugauguugaccuugaucacc

SEQ ID NO: 329656 - RNA, 22 nt, Homo sapiens
gcugcuguggcagauuggauuc

SEQ ID NO: 329657 - RNA, 22 nt, Homo sapiens
gcuggauguuucaauacaaaua

SEQ ID NO: 329658 - RNA, 22 nt, Homo sapiens
gcuggcaaaugguuauaaggcc

SEQ ID NO: 329659 - RNA, 22 nt, Homo sapiens
gcuggguucagagugggcugcg

SEQ ID NO: 329660 - RNA, 22 nt, Homo sapiens
gcugguauuacaggcaugagcc

SEQ ID NO: 329661 - RNA, 22 nt, Homo sapiens
gcugguguugugaaucaggccg

SEQ ID NO: 329662 - RNA, 22 nt, Homo sapiens
gcuguguucucgaggcggggga

SEQ ID NO: 329663 - RNA, 22 nt, Homo sapiens
gcuguugguaaaaaggacauga

SEQ ID NO: 329664 - RNA, 18 nt, Homo sapiens
gcuguugucagagcacau

SEQ ID NO: 329665 - RNA, 22 nt, Homo sapiens
gcuuggugugcaagugguacua

SEQ ID NO: 329666 - RNA, 19 nt, Homo sapiens
gcuuguccacgugagauaa

SEQ ID NO: 329667 - RNA, 22 nt, Homo sapiens
gcuuuggauaaaugucaguuua

SEQ ID NO: 329668 - RNA, 19 nt, Homo sapiens
gcuuuguggggaaggagcc

SEQ ID NO: 329669 - RNA, 22 nt, Homo sapiens
gcuuuguugauggugagucugu

SEQ ID NO: 329670 - RNA, 21 nt, Homo sapiens
ggaaaguuaaggaaauacccc

SEQ ID NO: 329671 - RNA, 22 nt, Homo sapiens
ggaaauguaaacaauggggcua

SEQ ID NO: 329672 - RNA, 22 nt, Homo sapiens
ggaaauguuggugucaugaguu

SEQ ID NO: 329673 - RNA, 22 nt, Homo sapiens
ggaagacuuagaguagcaucag

SEQ ID NO: 329674 - RNA, 17 nt, Homo sapiens
ggaagccuuugguuuaa

SEQ ID NO: 329675 - RNA, 22 nt, Homo sapiens
ggaauaguauaaauaccacaaa

SEQ ID NO: 329676 - RNA, 22 nt, Homo sapiens
ggaauguaguaauuugguuagu

SEQ ID NO: 329677 - RNA, 21 nt, Homo sapiens
ggaauguugccagcagccaga

SEQ ID NO: 329678 - RNA, 22 nt, Homo sapiens
ggacaaaguauuuucaaaugua

SEQ ID NO: 329679 - RNA, 22 nt, Homo sapiens
ggacaagagacugggacacuga

SEQ ID NO: 329680 - RNA, 22 nt, Homo sapiens
ggacaagaucuuccaccauuca

SEQ ID NO: 329681 - RNA, 22 nt, Homo sapiens
ggacacaucaugugaccaaggu

SEQ ID NO: 329682 - RNA, 22 nt, Homo sapiens
ggacagugaaugccacuccucc

SEQ ID NO: 329683 - RNA, 22 nt, Homo sapiens
ggacuagggacauggggagcug

SEQ ID NO: 329684 - RNA, 19 nt, Homo sapiens
ggacugucauggaguaguu

SEQ ID NO: 329685 - RNA, 22 nt, Homo sapiens
ggagaauugcuuggacccggga

SEQ ID NO: 329686 - RNA, 22 nt, Homo sapiens
ggagaugauuaugaaucacuua

SEQ ID NO: 329687 - RNA, 20 nt, Homo sapiens
ggagguguuggauuucuagu

SEQ ID NO: 329688 - RNA, 22 nt, Homo sapiens
ggaguaaaagaguaggaggaau

SEQ ID NO: 329689 - RNA, 22 nt, Homo sapiens
ggaguguaguggcuccaucucg

SEQ ID NO: 329690 - RNA, 22 nt, Homo sapiens
ggaucacagccagcucccagaa

SEQ ID NO: 329691 - RNA, 22 nt, Homo sapiens
ggaucauaugauagcucaauuu

SEQ ID NO: 329692 - RNA, 22 nt, Homo sapiens
ggaucgauuccaaauguagauc

SEQ ID NO: 329693 - RNA, 22 nt, Homo sapiens
ggaugcauuuuugguugucaca

SEQ ID NO: 329694 - RNA, 22 nt, Homo sapiens
ggcaaaaucgcaauuacuuuug

SEQ ID NO: 329695 - RNA, 22 nt, Homo sapiens
ggcaaaugaagauggagaggcu

SEQ ID NO: 329696 - RNA, 22 nt, Homo sapiens
ggcaacaaagacauuucaacau

SEQ ID NO: 329697 - RNA, 22 nt, Homo sapiens
ggcaacaauuccuacuucuuuu

SEQ ID NO: 329698 - RNA, 22 nt, Homo sapiens
ggcaagaaccacaauuacuuuu

SEQ ID NO: 329699 - RNA, 22 nt, Homo sapiens
ggcaagaacuucacucacuuuu

SEQ ID NO: 329700 - RNA, 20 nt, Homo sapiens
ggcaagacccaaagugugug

SEQ ID NO: 329701 - RNA, 19 nt, Homo sapiens
ggcaagaguuguucugugu

SEQ ID NO: 329702 - RNA, 22 nt, Homo sapiens
ggcaagauagauaucaguguca

SEQ ID NO: 329703 - RNA, 23 nt, Homo sapiens
ggcaagaucucagcucacugcaa

SEQ ID NO: 329704 - RNA, 22 nt, Homo sapiens
ggcaagaucuuggcucacugaa

SEQ ID NO: 329705 - RNA, 22 nt, Homo sapiens
ggcaagugucagcagcaacacc

SEQ ID NO: 329706 - RNA, 22 nt, Homo sapiens
ggcaauauauucugaauucagu

SEQ ID NO: 329707 - RNA, 22 nt, Homo sapiens
ggcacaguuaagugcuaccuaa

SEQ ID NO: 329708 - RNA, 22 nt, Homo sapiens
ggcaccacagacgccaggcgug

SEQ ID NO: 329709 - RNA, 22 nt, Homo sapiens
guggcagagucagagggaaaug

SEQ ID NO: 329710 - RNA, 22 nt, Homo sapiens
guggcaguuuuaaauaugaaaa

SEQ ID NO: 329711 - RNA, 22 nt, Homo sapiens
guggcaugaaagcagauaccac

SEQ ID NO: 329712 - RNA, 22 nt, Homo sapiens
guggcaugaaagcaucugugau

SEQ ID NO: 329713 - RNA, 21 nt, Homo sapiens
guggccuuuggagcaugucag

SEQ ID NO: 329714 - RNA, 23 nt, Homo sapiens
guggccuuuggccaguccgaguc

SEQ ID NO: 329715 - RNA, 22 nt, Homo sapiens
guggcuuuauuuagaagcaggg

SEQ ID NO: 329716 - RNA, 22 nt, Homo sapiens
gugggagugucccguuuuucca

SEQ ID NO: 329717 - RNA, 22 nt, Homo sapiens
gugggauaauuuuuggugcugu

SEQ ID NO: 329718 - RNA, 22 nt, Homo sapiens
gugggauggaaaugggcuucag

SEQ ID NO: 329719 - RNA, 20 nt, Homo sapiens
gugggcaaauccuuuccucu

SEQ ID NO: 329720 - RNA, 22 nt, Homo sapiens
gugggcucguucguguuagaca

SEQ ID NO: 329721 - RNA, 22 nt, Homo sapiens
gugggguaggcaauuccuagug

SEQ ID NO: 329722 - RNA, 22 nt, Homo sapiens
gugguagaaaguaccaaacuag

SEQ ID NO: 329723 - RNA, 22 nt, Homo sapiens
gugguaggaaagugcaaaugua

SEQ ID NO: 329724 - RNA, 22 nt, Homo sapiens
gugguguccugcaccuauaguc

SEQ ID NO: 329725 - RNA, 22 nt, Homo sapiens
gugguguuugagcugccaggga

SEQ ID NO: 329726 - RNA, 22 nt, Homo sapiens
gugguucuagagggacagaaug

SEQ ID NO: 329727 - RNA, 22 nt, Homo sapiens
gugguuuuuaaaguaccugugg

SEQ ID NO: 329728 - RNA, 22 nt, Homo sapiens
gugguuuuuuucugccuuauag

SEQ ID NO: 329729 - RNA, 22 nt, Homo sapiens
guguaaaugagugcugaaggag

SEQ ID NO: 329730 - RNA, 22 nt, Homo sapiens
guguaauaaucguggacuaugu

SEQ ID NO: 329731 - RNA, 22 nt, Homo sapiens
guguauacauagaauuguguau

SEQ ID NO: 329732 - RNA, 21 nt, Homo sapiens
gugucacagacaugacagaug

SEQ ID NO: 329733 - RNA, 22 nt, Homo sapiens
guguccucgaguacacaucagg

SEQ ID NO: 329734 - RNA, 18 nt, Homo sapiens
gugucugguuaugggagu

SEQ ID NO: 329735 - RNA, 22 nt, Homo sapiens
gugugaacaucauagaguguau

SEQ ID NO: 329736 - RNA, 22 nt, Homo sapiens
gugugacugcucuauuagggcg

SEQ ID NO: 329737 - RNA, 22 nt, Homo sapiens
gugugauuauuucaauugaugc

SEQ ID NO: 329738 - RNA, 20 nt, Homo sapiens
gugugcauuucagauuuugg

SEQ ID NO: 329739 - RNA, 22 nt, Homo sapiens
guguggcaggugggggcucaga

SEQ ID NO: 329740 - RNA, 22 nt, Homo sapiens
gugugguaggauugguuacuca

SEQ ID NO: 329741 - RNA, 22 nt, Homo sapiens
guguguaaauggcagugagcuc

SEQ ID NO: 329742 - RNA, 22 nt, Homo sapiens
guguucaaacccaggucugucu

SEQ ID NO: 329743 - RNA, 22 nt, Homo sapiens
guguucaaagcugauugagauu

SEQ ID NO: 329744 - RNA, 22 nt, Homo sapiens
guguucaaauucugacagagag

SEQ ID NO: 329745 - RNA, 22 nt, Homo sapiens
guguucauggaauuugcaauug

SEQ ID NO: 329746 - RNA, 22 nt, Homo sapiens
guguuugguugauagagccacu

SEQ ID NO: 329747 - RNA, 20 nt, Homo sapiens
guuaaggcagcauuacucuu

SEQ ID NO: 329748 - RNA, 22 nt, Homo sapiens
guuacagucuuguguaagguua

SEQ ID NO: 329749 - RNA, 22 nt, Homo sapiens
guuacugucuuccugauugcuu

SEQ ID NO: 329750 - RNA, 22 nt, Homo sapiens
guuauggaguauaugugaacug

SEQ ID NO: 329751 - RNA, 22 nt, Homo sapiens
guucaaguuuucucuugugggu

SEQ ID NO: 329752 - RNA, 22 nt, Homo sapiens
guucacucuggagaauauugac

SEQ ID NO: 329753 - RNA, 22 nt, Homo sapiens
guucaucaggcuuucucuagag

SEQ ID NO: 329754 - RNA, 22 nt, Homo sapiens
guucaucagggacacugguuug

SEQ ID NO: 329755 - RNA, 22 nt, Homo sapiens
guucaucagggauacuggccug

SEQ ID NO: 329756 - RNA, 22 nt, Homo sapiens
guucaucagggauacuggcuua

SEQ ID NO: 329757 - RNA, 20 nt, Homo sapiens
guucauguaauuaguucagg

SEQ ID NO: 329758 - RNA, 17 nt, Homo sapiens
guucccaguggcauuug

SEQ ID NO: 329759 - RNA, 20 nt, Homo sapiens
guucccuguaggugugcgga

SEQ ID NO: 329760 - RNA, 22 nt, Homo sapiens
guucuggagauaaagccaaggu

SEQ ID NO: 329761 - RNA, 19 nt, Homo sapiens
guugacacuggcucuucag

SEQ ID NO: 329762 - RNA, 22 nt, Homo sapiens
guugaggcaggagaauuacuug

SEQ ID NO: 329763 - RNA, 17 nt, Homo sapiens
guugaguuugagucaag

SEQ ID NO: 329764 - RNA, 22 nt, Homo sapiens
guugauguugcagucuugagga

SEQ ID NO: 329765 - RNA, 22 nt, Homo sapiens
guugcccuuagcacuucagccu

SEQ ID NO: 329766 - RNA, 22 nt, Homo sapiens
guugccuaggcuggagugcagu

SEQ ID NO: 329767 - RNA, 22 nt, Homo sapiens
guuguacuaccucucguauuag

SEQ ID NO: 329768 - RNA, 22 nt, Homo sapiens
guugugcuuaagccuauugauu

SEQ ID NO: 329769 - RNA, 22 nt, Homo sapiens
guuugcacuccuaugagaaucu

SEQ ID NO: 329770 - RNA, 22 nt, Homo sapiens
guuugcagaucaugaagaaccc

SEQ ID NO: 329771 - RNA, 22 nt, Homo sapiens
guuuggauuuucuaauuucugu

SEQ ID NO: 329772 - RNA, 22 nt, Homo sapiens
guuugguugcauggaaaauuua

SEQ ID NO: 329773 - RNA, 22 nt, Homo sapiens
uaaaagucaucacaacuggagu

SEQ ID NO: 329774 - RNA, 22 nt, Homo sapiens
uaaagagcuuuugaggugucau

SEQ ID NO: 329775 - RNA, 22 nt, Homo sapiens
uaaagcuagaauuguuccagca

SEQ ID NO: 329776 - RNA, 22 nt, Homo sapiens
uaaagcuauuauaguuauguuu

SEQ ID NO: 329777 - RNA, 22 nt, Homo sapiens
uaaagcuuagauccaugguggc

SEQ ID NO: 329778 - RNA, 22 nt, Homo sapiens
uaaagcuuggauuuaggcuaau

SEQ ID NO: 329779 - RNA, 22 nt, Homo sapiens
uaaagugcugagaugaggcugg

SEQ ID NO: 329780 - RNA, 22 nt, Homo sapiens
uaaaguuauugccccucaguua

SEQ ID NO: 329781 - RNA, 20 nt, Homo sapiens
uaaaugccucaugcuuuauu

SEQ ID NO: 329782 - RNA, 22 nt, Homo sapiens
uaaauggauauugccaucuccu

SEQ ID NO: 329783 - RNA, 21 nt, Homo sapiens
uaaaugucauacaaagcaaug

SEQ ID NO: 329784 - RNA, 22 nt, Homo sapiens
uaacaagagagucagucagucc

SEQ ID NO: 329785 - RNA, 22 nt, Homo sapiens
uaacaggcaaggucacaccuug

SEQ ID NO: 329786 - RNA, 22 nt, Homo sapiens
uaacaggcuacucuugcauugc

SEQ ID NO: 329787 - RNA, 18 nt, Homo sapiens
uaacagucucucaggauc

SEQ ID NO: 329788 - RNA, 22 nt, Homo sapiens
uaacaguguauuccuuuggaca

SEQ ID NO: 329789 - RNA, 22 nt, Homo sapiens
uaacauagucauauacuugcuu

SEQ ID NO: 329790 - RNA, 23 nt, Homo sapiens
uaacauguuuuuaagggaagcuu

SEQ ID NO: 329791 - RNA, 22 nt, Homo sapiens
uaacccacgcagaauggacaag

SEQ ID NO: 329792 - RNA, 22 nt, Homo sapiens
uaacccuuacaacuacacucgu

SEQ ID NO: 329793 - RNA, 22 nt, Homo sapiens
uaacuaguggaauuugauuuca

SEQ ID NO: 329794 - RNA, 22 nt, Homo sapiens
uaacucugccuagugacauggu

SEQ ID NO: 329795 - RNA, 18 nt, Homo sapiens
uaacugugggaacuaacu

SEQ ID NO: 329796 - RNA, 22 nt, Homo sapiens
uaacuucaucauaagucaagaa

SEQ ID NO: 329797 - RNA, 22 nt, Homo sapiens
uaagacuuuuugggaauauaga

SEQ ID NO: 329798 - RNA, 19 nt, Homo sapiens
uaagaugaagcugucuggg

SEQ ID NO: 329799 - RNA, 20 nt, Homo sapiens
uaagccacacagucuaaggu

SEQ ID NO: 329800 - RNA, 22 nt, Homo sapiens
uaaggauuuuggugauuacacu

SEQ ID NO: 329801 - RNA, 22 nt, Homo sapiens
uaaggcaaguuuuuaguggaca

SEQ ID NO: 329802 - RNA, 22 nt, Homo sapiens
uaaggcauuuuuuugaguugca

SEQ ID NO: 329803 - RNA, 22 nt, Homo sapiens
uaucacaguaaaucugggugca

SEQ ID NO: 329804 - RNA, 22 nt, Homo sapiens
uaucacagugcuggaguauucc

SEQ ID NO: 329805 - RNA, 20 nt, Homo sapiens
uaucacauggggagaaaccu

SEQ ID NO: 329806 - RNA, 22 nt, Homo sapiens
uaucaccacccugggaaacaua

SEQ ID NO: 329807 - RNA, 22 nt, Homo sapiens
uaucaccauguccguuuuaaaa

SEQ ID NO: 329808 - RNA, 22 nt, Homo sapiens
uaucaccuugcaguggaugcua

SEQ ID NO: 329809 - RNA, 22 nt, Homo sapiens
uaucagauugcugccaucugcu

SEQ ID NO: 329810 - RNA, 22 nt, Homo sapiens
uaucaguauggauucauggauu

SEQ ID NO: 329811 - RNA, 22 nt, Homo sapiens
uaucagugaaucuuauuuugcc

SEQ ID NO: 329812 - RNA, 21 nt, Homo sapiens
uaucauggugaaacccugucu

SEQ ID NO: 329813 - RNA, 22 nt, Homo sapiens
uaucaugucuguguguaccuag

SEQ ID NO: 329814 - RNA, 22 nt, Homo sapiens
uaucauugccucaaucuguauu

SEQ ID NO: 329815 - RNA, 22 nt, Homo sapiens
uaucauuguguuauuucuucca

SEQ ID NO: 329816 - RNA, 22 nt, Homo sapiens
uaucccaguggauguaccccau

SEQ ID NO: 329817 - RNA, 22 nt, Homo sapiens
uaucuacauguagguauguaug

SEQ ID NO: 329818 - RNA, 23 nt, Homo sapiens
uaucucaaugcacagagaggaaa

SEQ ID NO: 329819 - RNA, 22 nt, Homo sapiens
uaucucagagaaucagauuuac

SEQ ID NO: 329820 - RNA, 18 nt, Homo sapiens
uaucucauuucuuagguc

SEQ ID NO: 329821 - RNA, 22 nt, Homo sapiens
uaucucuuuucauguguaaaug

SEQ ID NO: 329822 - RNA, 22 nt, Homo sapiens
uaucugguuuuguuacagguuc

SEQ ID NO: 329823 - RNA, 22 nt, Homo sapiens
uaucuuggaguuugacaaccaa

SEQ ID NO: 329824 - RNA, 22 nt, Homo sapiens
uaugaaacucuaagauucacau

SEQ ID NO: 329825 - RNA, 22 nt, Homo sapiens
uaugaacacuuuugggaggcau

SEQ ID NO: 329826 - RNA, 23 nt, Homo sapiens
uaugacagaggaagggggagcug

SEQ ID NO: 329827 - RNA, 20 nt, Homo sapiens
uaugagacugggagaaguuc

SEQ ID NO: 329828 - RNA, 22 nt, Homo sapiens
uaugcacuaggcacuguguuug

SEQ ID NO: 329829 - RNA, 22 nt, Homo sapiens
uaugcacuauagcauauguggu

SEQ ID NO: 329830 - RNA, 22 nt, Homo sapiens
uaugccuuugaccauuuuguga

SEQ ID NO: 329831 - RNA, 19 nt, Homo sapiens
uaugcuauuuauuagaagu

SEQ ID NO: 329832 - RNA, 22 nt, Homo sapiens
uauggauguuaagguucacagc

SEQ ID NO: 329833 - RNA, 22 nt, Homo sapiens
uauggauuuucagauucuuauc

SEQ ID NO: 329834 - RNA, 22 nt, Homo sapiens
uauggcacuaguacuggaaagc

SEQ ID NO: 329835 - RNA, 22 nt, Homo sapiens
uauggccacugucuuugaguca

SEQ ID NO: 329836 - RNA, 22 nt, Homo sapiens
uauggcugcuuucacacuacaa

SEQ ID NO: 329837 - RNA, 22 nt, Homo sapiens
uauggcugugacuuaucuuguu

SEQ ID NO: 329838 - RNA, 22 nt, Homo sapiens
uauggcuucuuuaaauugaggu

SEQ ID NO: 329839 - RNA, 22 nt, Homo sapiens
uauggcuuuguucaacagccuc

SEQ ID NO: 329840 - RNA, 22 nt, Homo sapiens
uauggcuuuuaacugucguaug

SEQ ID NO: 329841 - RNA, 22 nt, Homo sapiens
uauggcuuuuauuauguuguag

SEQ ID NO: 329842 - RNA, 22 nt, Homo sapiens
uaugucacagguuuuggugaaa

SEQ ID NO: 329843 - RNA, 22 nt, Homo sapiens
uaugucauggguaaagugcccu

SEQ ID NO: 329844 - RNA, 20 nt, Homo sapiens
uauuacagaguaauggugga

SEQ ID NO: 329845 - RNA, 22 nt, Homo sapiens
uauuacugucaauaucacagaa

SEQ ID NO: 329846 - RNA, 22 nt, Homo sapiens
uauuagguuggggcaaaaguaa

SEQ ID NO: 329847 - RNA, 22 nt, Homo sapiens
uauuagugccuaagucuuaggg

SEQ ID NO: 329848 - RNA, 22 nt, Homo sapiens
uauuaguuguaugauucccaag

SEQ ID NO: 329849 - RNA, 22 nt, Homo sapiens
uauuaugcacuuuauaaaaauu

SEQ ID NO: 329850 - RNA, 22 nt, Homo sapiens
uauucacuguaucauugauggg

SEQ ID NO: 329851 - RNA, 22 nt, Homo sapiens
uauuccauuugggucaggauga

SEQ ID NO: 329852 - RNA, 22 nt, Homo sapiens
uauugacuugaugagggagggu

SEQ ID NO: 329853 - RNA, 22 nt, Homo sapiens
uauugacuuuuuuguuaggagg

SEQ ID NO: 329854 - RNA, 20 nt, Homo sapiens
uauugcacuccagucugggc

SEQ ID NO: 329855 - RNA, 22 nt, Homo sapiens
uauugcacuuuuccauaggagu

SEQ ID NO: 329856 - RNA, 22 nt, Homo sapiens
uauugcuaaauucuuuuccuag

SEQ ID NO: 329857 - RNA, 22 nt, Homo sapiens
uauugcucaugcauuuaauuuc

SEQ ID NO: 329858 - RNA, 18 nt, Homo sapiens
uauugcuugguuuggaga

SEQ ID NO: 329859 - RNA, 22 nt, Homo sapiens
uauuguacauauccucccuuca

SEQ ID NO: 329860 - RNA, 22 nt, Homo sapiens
uauuguacauguuauagauuuu

SEQ ID NO: 329861 - RNA, 22 nt, Homo sapiens
uauugugcauguugaauaacua

SEQ ID NO: 329862 - RNA, 22 nt, Homo sapiens
uauuucaguugugcagguaguu

SEQ ID NO: 329863 - RNA, 22 nt, Homo sapiens
uauuucccuuaacuuuccugca

SEQ ID NO: 329864 - RNA, 22 nt, Homo sapiens
uauuugauuaacaagagccuaa

SEQ ID NO: 329865 - RNA, 22 nt, Homo sapiens
uauuugcacucccaucauggug

SEQ ID NO: 329866 - RNA, 22 nt, Homo sapiens
uauuuguccccuccaaaaguca

SEQ ID NO: 329867 - RNA, 22 nt, Homo sapiens
ucaaagacacacaaggagaagg

SEQ ID NO: 329868 - RNA, 22 nt, Homo sapiens
ucaaagugagcuccuucucacu

SEQ ID NO: 329869 - RNA, 22 nt, Homo sapiens
ucaaaugauucuccugccucag

SEQ ID NO: 329870 - RNA, 22 nt, Homo sapiens
ucaaaugcacguagagaaaaua

SEQ ID NO: 329871 - RNA, 22 nt, Homo sapiens
ucaaaugcuguauuguaguaau

SEQ ID NO: 329872 - RNA, 22 nt, Homo sapiens
ucaaauguuuguuuaaggcuua

SEQ ID NO: 329873 - RNA, 20 nt, Homo sapiens
ucaaauucuuggccuccagc

SEQ ID NO: 329874 - RNA, 22 nt, Homo sapiens
ucaacagugggcacuguaaaug

SEQ ID NO: 329875 - RNA, 22 nt, Homo sapiens
ucaacauugcugucaggcaucu

SEQ ID NO: 329876 - RNA, 22 nt, Homo sapiens
ucaacguauuuauauagcagag

SEQ ID NO: 329877 - RNA, 22 nt, Homo sapiens
ucaaggcacauuugacauuuuc

SEQ ID NO: 329878 - RNA, 22 nt, Homo sapiens
ucaaggcaguggccuuccuucu

SEQ ID NO: 329879 - RNA, 22 nt, Homo sapiens
ucaaguacuuugcauagugccg

SEQ ID NO: 329880 - RNA, 23 nt, Homo sapiens
ucaagugaugguggccacaaggg

SEQ ID NO: 329881 - RNA, 22 nt, Homo sapiens
ucaaugcaaccuccaccucugg

SEQ ID NO: 329882 - RNA, 18 nt, Homo sapiens
ucaauguggauguucuuu

SEQ ID NO: 329883 - RNA, 22 nt, Homo sapiens
ucacaaagcuuggccugcuucu

SEQ ID NO: 329884 - RNA, 22 nt, Homo sapiens
ucacaagugagaggaauuagau

SEQ ID NO: 329885 - RNA, 22 nt, Homo sapiens
ucacaaguguauagacaugucc

SEQ ID NO: 329886 - RNA, 22 nt, Homo sapiens
ucacaauguaaaugaggguugg

SEQ ID NO: 329887 - RNA, 22 nt, Homo sapiens
ucacaccauucuucuacuucag

SEQ ID NO: 329888 - RNA, 22 nt, Homo sapiens
ucacacucucaccaacauuugg

SEQ ID NO: 329889 - RNA, 19 nt, Homo sapiens
ucacacuguggcuucuuua

SEQ ID NO: 329890 - RNA, 23 nt, Homo sapiens
ucacacuuaagagaaaugcagcu

SEQ ID NO: 329891 - RNA, 22 nt, Homo sapiens
ucacagacugagccaaauagag

SEQ ID NO: 329892 - RNA, 22 nt, Homo sapiens
ucacagaggagaagaccuuuaa

SEQ ID NO: 329893 - RNA, 22 nt, Homo sapiens
ucacagauaaauaaagaugauu

SEQ ID NO: 329894 - RNA, 22 nt, Homo sapiens
ucacagaugaggcgagaggcag

SEQ ID NO: 329895 - RNA, 22 nt, Homo sapiens
ucacagcuaaaaugaaaguagu

SEQ ID NO: 329896 - RNA, 22 nt, Homo sapiens
augaaugcuuuuggauguaucu

SEQ ID NO: 329897 - RNA, 21 nt, Homo sapiens
augaauguaaagaauguggga

SEQ ID NO: 329898 - RNA, 22 nt, Homo sapiens
augaauguaaagaaugugggaa

SEQ ID NO: 329899 - RNA, 22 nt, Homo sapiens
augacagagauaugugaauuuu

SEQ ID NO: 329900 - RNA, 22 nt, Homo sapiens
augacagugagugagcucucac

SEQ ID NO: 329901 - RNA, 22 nt, Homo sapiens
augacaguguggauuauuguaa

SEQ ID NO: 329902 - RNA, 22 nt, Homo sapiens
augacauagaagcaauccccua

SEQ ID NO: 329903 - RNA, 22 nt, Homo sapiens
augacauugaaaagcaagugga

SEQ ID NO: 329904 - RNA, 22 nt, Homo sapiens
augaccagagagugcgcagggu

SEQ ID NO: 329905 - RNA, 19 nt, Homo sapiens
augaccauuuccauaguau

SEQ ID NO: 329906 - RNA, 22 nt, Homo sapiens
augacuggauaauggacacaca

SEQ ID NO: 329907 - RNA, 19 nt, Homo sapiens
augagaacagacuccauuu

SEQ ID NO: 329908 - RNA, 22 nt, Homo sapiens
augagaacugucaaugagagcu

SEQ ID NO: 329909 - RNA, 22 nt, Homo sapiens
augagaaucauuucagcuugua

SEQ ID NO: 329910 - RNA, 22 nt, Homo sapiens
augagacuagaagagaauaaua

SEQ ID NO: 329911 - RNA, 22 nt, Homo sapiens
augagacuguucuuccucauug

SEQ ID NO: 329912 - RNA, 22 nt, Homo sapiens
augagauauuuuauaagaucau

SEQ ID NO: 329913 - RNA, 22 nt, Homo sapiens
augagaucugugaacaccuguc

SEQ ID NO: 329914 - RNA, 21 nt, Homo sapiens
augagauguuagacuuuagac

SEQ ID NO: 329915 - RNA, 22 nt, Homo sapiens
augagcaaagagaugagacccu

SEQ ID NO: 329916 - RNA, 22 nt, Homo sapiens
augagcacuuguuuugggcaca

SEQ ID NO: 329917 - RNA, 22 nt, Homo sapiens
augagcaucaccagaaucaaua

SEQ ID NO: 329918 - RNA, 22 nt, Homo sapiens
augagcuccucaaggucagaga

SEQ ID NO: 329919 - RNA, 22 nt, Homo sapiens
augagcuguuuggaagacacuu

SEQ ID NO: 329920 - RNA, 22 nt, Homo sapiens
augaggcaggaaaggcguaucu

SEQ ID NO: 329921 - RNA, 22 nt, Homo sapiens
augaggcuauaauuuuuaugua

SEQ ID NO: 329922 - RNA, 22 nt, Homo sapiens
augagggagggcaccugaccuu

SEQ ID NO: 329923 - RNA, 22 nt, Homo sapiens
augagggagggguggugccgca

SEQ ID NO: 329924 - RNA, 22 nt, Homo sapiens
augaguaguugcuaaauauuga

SEQ ID NO: 329925 - RNA, 19 nt, Homo sapiens
augagucugcaagaaccag

SEQ ID NO: 329926 - RNA, 22 nt, Homo sapiens
augaucacuguggaaauucagc

SEQ ID NO: 329927 - RNA, 22 nt, Homo sapiens
augcaaacaucauagaguguac

SEQ ID NO: 329928 - RNA, 22 nt, Homo sapiens
augcaacuugaaauuuuccgga

SEQ ID NO: 329929 - RNA, 22 nt, Homo sapiens
augcacauauguacugcccuau

SEQ ID NO: 329930 - RNA, 22 nt, Homo sapiens
augcacaugcgaaaacuugugu

SEQ ID NO: 329931 - RNA, 22 nt, Homo sapiens
augcagcugaggguaguggagc

SEQ ID NO: 329932 - RNA, 22 nt, Homo sapiens
augcauauuccugggccucacu

SEQ ID NO: 329933 - RNA, 22 nt, Homo sapiens
augcauauuuuaccuagaagag

SEQ ID NO: 329934 - RNA, 22 nt, Homo sapiens
augccaagagacaaagggaauc

SEQ ID NO: 329935 - RNA, 22 nt, Homo sapiens
augccacugcacuucagccugc

SEQ ID NO: 329936 - RNA, 22 nt, Homo sapiens
augccauugcacuccagccuag

SEQ ID NO: 329937 - RNA, 19 nt, Homo sapiens
augccuggagaugguuaua

SEQ ID NO: 329938 - RNA, 22 nt, Homo sapiens
augcuggugcuagaaacuggaa

SEQ ID NO: 329939 - RNA, 22 nt, Homo sapiens
augcuggugguucacaugcgca

SEQ ID NO: 329940 - RNA, 22 nt, Homo sapiens
augcuguuuuguagcucccucu

SEQ ID NO: 329941 - RNA, 22 nt, Homo sapiens
augcuuguugcagccugagccu

SEQ ID NO: 329942 - RNA, 22 nt, Homo sapiens
auggaaagcuguuccuacacaa

SEQ ID NO: 329943 - RNA, 22 nt, Homo sapiens
auggaagcugauuagauaguac

SEQ ID NO: 329944 - RNA, 22 nt, Homo sapiens
auggaaggagaauggucuuuga

SEQ ID NO: 329945 - RNA, 22 nt, Homo sapiens
auggaauggcacuuugaagauu

SEQ ID NO: 329946 - RNA, 22 nt, Homo sapiens
auggacagacacuggccuucug

SEQ ID NO: 329947 - RNA, 22 nt, Homo sapiens
auggacuuuuuguucagugucu

SEQ ID NO: 329948 - RNA, 22 nt, Homo sapiens
auggaggaggaagcugaaacaa

SEQ ID NO: 329949 - RNA, 22 nt, Homo sapiens
auggaguguggaacugggaauc

SEQ ID NO: 329950 - RNA, 19 nt, Homo sapiens
auggauacauuuucugcua

SEQ ID NO: 329951 - RNA, 22 nt, Homo sapiens
auggauguucuagggaugugau

SEQ ID NO: 329952 - RNA, 22 nt, Homo sapiens
auggauuuguaguacaugguug

SEQ ID NO: 329953 - RNA, 22 nt, Homo sapiens
auggcagugucuagggguguuu

SEQ ID NO: 329954 - RNA, 20 nt, Homo sapiens
auggcccugcugggaguguc

SEQ ID NO: 329955 - RNA, 22 nt, Homo sapiens
auggccgggugcgguggcucac

SEQ ID NO: 329956 - RNA, 22 nt, Homo sapiens
auggccuuguauaccuggcaaa

SEQ ID NO: 329957 - RNA, 22 nt, Homo sapiens
auggccuuuacaauuugguaug

SEQ ID NO: 329958 - RNA, 22 nt, Homo sapiens
auggccuuucuggcacauuucc

SEQ ID NO: 329959 - RNA, 22 nt, Homo sapiens
auggccuuuuuaucucaccaag

SEQ ID NO: 329960 - RNA, 22 nt, Homo sapiens
auggcucaguguguaucuauca

SEQ ID NO: 329961 - RNA, 22 nt, Homo sapiens
auggcucuuauuauuugaggua

SEQ ID NO: 329962 - RNA, 22 nt, Homo sapiens
auggcuucuuacucuucugcau

SEQ ID NO: 329963 - RNA, 22 nt, Homo sapiens
auggcuucuucuaaaagugggg

SEQ ID NO: 329964 - RNA, 22 nt, Homo sapiens
auggcuugugacccaugcuuca

SEQ ID NO: 329965 - RNA, 22 nt, Homo sapiens
auggcuuuaagagugucugaau

SEQ ID NO: 329966 - RNA, 22 nt, Homo sapiens
auggcuuuugaccugguaggau

SEQ ID NO: 329967 - RNA, 22 nt, Homo sapiens
auggcuuuuuaaaucauguugu

SEQ ID NO: 329968 - RNA, 22 nt, Homo sapiens
augggguaggcuugcuguagua

SEQ ID NO: 329969 - RNA, 22 nt, Homo sapiens
augggguaggcuuugcugcagu

SEQ ID NO: 329970 - RNA, 22 nt, Homo sapiens
augguaagcugaaaauaucgaa

SEQ ID NO: 329971 - RNA, 22 nt, Homo sapiens
augguacucucuugucugcaaa

SEQ ID NO: 329972 - RNA, 22 nt, Homo sapiens
augguaucauuacuguuuuauu

SEQ ID NO: 329973 - RNA, 22 nt, Homo sapiens
aagcuccauuucugccaugaga

SEQ ID NO: 329974 - RNA, 22 nt, Homo sapiens
aggaaucuaagguaucagguua

SEQ ID NO: 329975 - RNA, 18 nt, Homo sapiens
aggaaugguaauacuuca

SEQ ID NO: 329976 - RNA, 22 nt, Homo sapiens
aggaaugucaaugguaguuuaa

SEQ ID NO: 329977 - RNA, 22 nt, Homo sapiens
aggaauguuaguacuucuuagu

SEQ ID NO: 329978 - RNA, 22 nt, Homo sapiens
aggacacugagcaugggagguu

SEQ ID NO: 329979 - RNA, 22 nt, Homo sapiens
aggaccaugguauugcuuuggg

SEQ ID NO: 329980 - RNA, 22 nt, Homo sapiens
aggagaugaagcuuuaucuaaa

SEQ ID NO: 329981 - RNA, 22 nt, Homo sapiens
aggagcacaauggucaugugga

SEQ ID NO: 329982 - RNA, 18 nt, Homo sapiens
aggagcauagugcuauga

SEQ ID NO: 329983 - RNA, 21 nt, Homo sapiens
aggagcauucucuugcuuugu

SEQ ID NO: 329984 - RNA, 21 nt, Homo sapiens
aggagcauuguugugguggag

SEQ ID NO: 329985 - RNA, 22 nt, Homo sapiens
aggagguagaacauugccauuu

SEQ ID NO: 329986 - RNA, 22 nt, Homo sapiens
aggagguugguaccaucuguuu

SEQ ID NO: 329987 - RNA, 22 nt, Homo sapiens
aggcaacaugguaaaacccugu

SEQ ID NO: 329988 - RNA, 21 nt, Homo sapiens
aggcaagacuuuuagguuugu

SEQ ID NO: 329989 - RNA, 22 nt, Homo sapiens
aggcaagugggagacagcauuu

SEQ ID NO: 329990 - RNA, 22 nt, Homo sapiens
aggcacacaacccuggaccuga

SEQ ID NO: 329991 - RNA, 22 nt, Homo sapiens
aggcagaugagguccucagcug

SEQ ID NO: 329992 - RNA, 22 nt, Homo sapiens
aggcaugaguucagaggguaug

SEQ ID NO: 329993 - RNA, 22 nt, Homo sapiens
aggcaugguggcacauacaugu

SEQ ID NO: 329994 - RNA, 23 nt, Homo sapiens
aggccaguuuuuccugcuugcug

SEQ ID NO: 329995 - RNA, 22 nt, Homo sapiens
agggagcaaaguggucuuucuc

SEQ ID NO: 329996 - RNA, 22 nt, Homo sapiens
agggcacuguagguccugccuc

SEQ ID NO: 329997 - RNA, 22 nt, Homo sapiens
agggcuuaucuguguagaguuc

SEQ ID NO: 329998 - RNA, 22 nt, Homo sapiens
agggcuuguuuaacuaucauua

SEQ ID NO: 329999 - RNA, 22 nt, Homo sapiens
agguaauagcacaugauaccuu

SEQ ID NO: 330000 - RNA, 22 nt, Homo sapiens
agguagaguguuuuguucuucu

SEQ ID NO: 330001 - RNA, 22 nt, Homo sapiens
agguagguugagaugggcauca

SEQ ID NO: 330002 - RNA, 22 nt, Homo sapiens
agguauauuggacagauguaaa

SEQ ID NO: 330003 - RNA, 22 nt, Homo sapiens
agguauguauguaugggagaaa

SEQ ID NO: 330004 - RNA, 21 nt, Homo sapiens
aggucaugaagauguucuaau

SEQ ID NO: 330005 - RNA, 22 nt, Homo sapiens
aggugcaugcuucacuggauau

SEQ ID NO: 330006 - RNA, 22 nt, Homo sapiens
aggugguuuuaggcagagacau

SEQ ID NO: 330007 - RNA, 21 nt, Homo sapiens
aggugucuuggguucccuggc

SEQ ID NO: 330008 - RNA, 21 nt, Homo sapiens
agguuguguuuccucuuacuu

SEQ ID NO: 330009 - RNA, 22 nt, Homo sapiens
aguaaagcaucagcuagaugug

SEQ ID NO: 330010 - RNA, 22 nt, Homo sapiens
aguaaauuucugugcuuucaua

SEQ ID NO: 330011 - RNA, 22 nt, Homo sapiens
aguaacacaccugcauggugug

SEQ ID NO: 330012 - RNA, 22 nt, Homo sapiens
aguaagauggcaacucuccaca

SEQ ID NO: 330013 - RNA, 22 nt, Homo sapiens
aguaaucaucugagggcagaaa

SEQ ID NO: 330014 - RNA, 22 nt, Homo sapiens
aguacugucugguuaccugaca

SEQ ID NO: 330015 - RNA, 22 nt, Homo sapiens
aguaucaucuuguuggccaggc

SEQ ID NO: 330016 - RNA, 22 nt, Homo sapiens
aguauguuuugaaaccaagaag

SEQ ID NO: 330017 - RNA, 22 nt, Homo sapiens
aguauugcuaauaagagauuug

SEQ ID NO: 330018 - RNA, 22 nt, Homo sapiens
aguauuuguuggaauaccuguu

SEQ ID NO: 330019 - RNA, 22 nt, Homo sapiens
agucaaaugcuuauguauaaag

SEQ ID NO: 330020 - RNA, 22 nt, Homo sapiens
agucaagauggcaagguaaggc

SEQ ID NO: 330021 - RNA, 22 nt, Homo sapiens
agucaaguuuuuucagagaaua

SEQ ID NO: 330022 - RNA, 22 nt, Homo sapiens
agucagauuggcauuuguuggg

SEQ ID NO: 330023 - RNA, 20 nt, Homo sapiens
agucaguuuauuuucucucu

SEQ ID NO: 330024 - RNA, 22 nt, Homo sapiens
agucauaggagagauaucacug

SEQ ID NO: 330025 - RNA, 22 nt, Homo sapiens
agucauggcagaaggcaccucu

SEQ ID NO: 330026 - RNA, 19 nt, Homo sapiens
agucaugugaggacccuug

SEQ ID NO: 330027 - RNA, 22 nt, Homo sapiens
agugacuagaauaugaauuuua

SEQ ID NO: 330028 - RNA, 17 nt, Homo sapiens
agugagaucauggcuua

SEQ ID NO: 330029 - RNA, 21 nt, Homo sapiens
agugagucauuuggaaagcaa

SEQ ID NO: 330030 - RNA, 22 nt, Homo sapiens
agugauggagccaggauuuaau

SEQ ID NO: 330031 - RNA, 19 nt, Homo sapiens
agugcaauugccuuugugc

SEQ ID NO: 330032 - RNA, 22 nt, Homo sapiens
agugcacuccagccugggcaac

SEQ ID NO: 330033 - RNA, 22 nt, Homo sapiens
agugcaguggcacaaucuuggc

SEQ ID NO: 330034 - RNA, 22 nt, Homo sapiens
agugcaguggcauggucauaac

SEQ ID NO: 330035 - RNA, 22 nt, Homo sapiens
agugcauugagacuugugaguu

SEQ ID NO: 330036 - RNA, 22 nt, Homo sapiens
agugcauuuguucugugucagg

SEQ ID NO: 330037 - RNA, 22 nt, Homo sapiens
agugccaaaucgagggcucuga

SEQ ID NO: 330038 - RNA, 22 nt, Homo sapiens
aguggcacaauuuugacucccc

SEQ ID NO: 330039 - RNA, 22 nt, Homo sapiens
aguggguguuccauuggauaaa

SEQ ID NO: 330040 - RNA, 19 nt, Homo sapiens
aguggguguuuucuguuug

SEQ ID NO: 330041 - RNA, 22 nt, Homo sapiens
aguguuuuuacaagcacucugg

SEQ ID NO: 330042 - RNA, 22 nt, Homo sapiens
auaaaccuacauuuucacuucu

SEQ ID NO: 330043 - RNA, 17 nt, Homo sapiens
auaaacucaucauuuuu

SEQ ID NO: 330044 - RNA, 22 nt, Homo sapiens
auaaagcaagucucuggccuca

SEQ ID NO: 330045 - RNA, 22 nt, Homo sapiens
auaaaguucugcuggcauauau

SEQ ID NO: 330046 - RNA, 22 nt, Homo sapiens
auaaauaguaguugugguggcc

SEQ ID NO: 330047 - RNA, 19 nt, Homo sapiens
auaaaugccuacaagggug

SEQ ID NO: 330048 - RNA, 22 nt, Homo sapiens
auaaaugcuuccagucauuaaa

SEQ ID NO: 330049 - RNA, 20 nt, Homo sapiens
auaaauguauagguguacau

SEQ ID NO: 330050 - RNA, 22 nt, Homo sapiens
auaaggcagcugcuaaaaggca

SEQ ID NO: 330051 - RNA, 22 nt, Homo sapiens
auaaguaguaaagcagugacua

SEQ ID NO: 330052 - RNA, 22 nt, Homo sapiens
auaaguauuuggacuuuacugu

SEQ ID NO: 330053 - RNA, 22 nt, Homo sapiens
auaagucaauggaacagauuaa

SEQ ID NO: 330054 - RNA, 22 nt, Homo sapiens
auaauaguguuuagauuuggga

SEQ ID NO: 330055 - RNA, 22 nt, Homo sapiens
auaauguuugauugagcagaua

SEQ ID NO: 330056 - RNA, 22 nt, Homo sapiens
auacaagcaguccaacuccaua

SEQ ID NO: 330057 - RNA, 21 nt, Homo sapiens
auuugcacugagcuccugugc

SEQ ID NO: 330058 - RNA, 20 nt, Homo sapiens
auuugcauuauggagcaccc

SEQ ID NO: 330059 - RNA, 22 nt, Homo sapiens
auuuggcaguauaaugcuuugg

SEQ ID NO: 330060 - RNA, 22 nt, Homo sapiens
auuugguugggugcgguggcuu

SEQ ID NO: 330061 - RNA, 22 nt, Homo sapiens
auuugucaauacacuucuucca

SEQ ID NO: 330062 - RNA, 22 nt, Homo sapiens
auuugucacuauguggcuaaua

SEQ ID NO: 330063 - RNA, 22 nt, Homo sapiens
auuuugguuacauaguugagcu

SEQ ID NO: 330064 - RNA, 22 nt, Homo sapiens
caaaagugguucuuauccuuuu

SEQ ID NO: 330065 - RNA, 22 nt, Homo sapiens
caaagucuauucuacccuuacc

SEQ ID NO: 330066 - RNA, 22 nt, Homo sapiens
caaagucuucucauuaugucuu

SEQ ID NO: 330067 - RNA, 22 nt, Homo sapiens
caaagugguuuauacaugauug

SEQ ID NO: 330068 - RNA, 22 nt, Homo sapiens
caacacuguuuauuggauagcc

SEQ ID NO: 330069 - RNA, 22 nt, Homo sapiens
caacugguuuuauacaguuuag

SEQ ID NO: 330070 - RNA, 22 nt, Homo sapiens
caagggguggaaaugguagugu

SEQ ID NO: 330071 - RNA, 22 nt, Homo sapiens
caaggugcugagacaggagccc

SEQ ID NO: 330072 - RNA, 22 nt, Homo sapiens
caagugaauaguugcucucaga

SEQ ID NO: 330073 - RNA, 21 nt, Homo sapiens
caagugaugcuucugcuuuaa

SEQ ID NO: 330074 - RNA, 22 nt, Homo sapiens
caagugcuugaugaaugaucaa

SEQ ID NO: 330075 - RNA, 23 nt, Homo sapiens
caauacugaccucacguuaauag

SEQ ID NO: 330076 - RNA, 22 nt, Homo sapiens
caaugcagcuuuuggagagaaa

SEQ ID NO: 330077 - RNA, 22 nt, Homo sapiens
caauggcaaugaaauagugaga

SEQ ID NO: 330078 - RNA, 22 nt, Homo sapiens
caauugcacucuuagguguaca

SEQ ID NO: 330079 - RNA, 22 nt, Homo sapiens
cacaaugucugguaggccacuu

SEQ ID NO: 330080 - RNA, 22 nt, Homo sapiens
cacaccuacuagggccgugggc

SEQ ID NO: 330081 - RNA, 22 nt, Homo sapiens
auggucccuguuccaugcuccu

SEQ ID NO: 330082 - RNA, 22 nt, Homo sapiens
auggucuuuguuucuaauucug

SEQ ID NO: 330083 - RNA, 22 nt, Homo sapiens
auggucuuuucccuggauuaua

SEQ ID NO: 330084 - RNA, 22 nt, Homo sapiens
augguguauugauuauugcugu

SEQ ID NO: 330085 - RNA, 22 nt, Homo sapiens
augguugguuaaaucuguguau

SEQ ID NO: 330086 - RNA, 22 nt, Homo sapiens
auguaacacagugcggcugggc

SEQ ID NO: 330087 - RNA, 21 nt, Homo sapiens
auguaacugggaaugugagag

SEQ ID NO: 330088 - RNA, 20 nt, Homo sapiens
auguaauguaugauauguac

SEQ ID NO: 330089 - RNA, 22 nt, Homo sapiens
auguagauaucaagaggcauau

SEQ ID NO: 330090 - RNA, 22 nt, Homo sapiens
auguaguaugaagaagaugcuu

SEQ ID NO: 330091 - RNA, 22 nt, Homo sapiens
auguaguauuaaugagagauaa

SEQ ID NO: 330092 - RNA, 22 nt, Homo sapiens
augucaaagaggaaaacuggau

SEQ ID NO: 330093 - RNA, 22 nt, Homo sapiens
augucaaggugaagaaagauca

SEQ ID NO: 330094 - RNA, 22 nt, Homo sapiens
augucuggcagaagacuucuca

SEQ ID NO: 330095 - RNA, 22 nt, Homo sapiens
augugacugauguaaucagaca

SEQ ID NO: 330096 - RNA, 22 nt, Homo sapiens
augugcaacugcuggaacaguc

SEQ ID NO: 330097 - RNA, 22 nt, Homo sapiens
augugcaagaucauuaaagcuc

SEQ ID NO: 330098 - RNA, 22 nt, Homo sapiens
augugcacauucugguaaauau

SEQ ID NO: 330099 - RNA, 21 nt, Homo sapiens
augugcacuaugucauuuaau

SEQ ID NO: 330100 - RNA, 20 nt, Homo sapiens
augugcaguguggcaaccaa

SEQ ID NO: 330101 - RNA, 22 nt, Homo sapiens
auguaugagaguuccagcugau

SEQ ID NO: 330102 - RNA, 22 nt, Homo sapiens
augucacagguccuagccaagu

SEQ ID NO: 330103 - RNA, 20 nt, Homo sapiens
augucaggaagggagucagg

SEQ ID NO: 330104 - RNA, 22 nt, Homo sapiens
augucauagaagccugugaacc

SEQ ID NO: 330105 - RNA, 22 nt, Homo sapiens
augucauagauaaggaagugga

SEQ ID NO: 330106 - RNA, 22 nt, Homo sapiens
auguccaugagcacauguauca

SEQ ID NO: 330107 - RNA, 22 nt, Homo sapiens
auguccuaaucuccuguucuua

SEQ ID NO: 330108 - RNA, 22 nt, Homo sapiens
auguccuggacccagacaaagc

SEQ ID NO: 330109 - RNA, 22 nt, Homo sapiens
augucuagagcaagagaugcug

SEQ ID NO: 330110 - RNA, 22 nt, Homo sapiens
augucuagagugauacugaagc

SEQ ID NO: 330111 - RNA, 22 nt, Homo sapiens
augucuuucauagagacccaga

SEQ ID NO: 330112 - RNA, 22 nt, Homo sapiens
augugaacaucauagaaugcac

SEQ ID NO: 330113 - RNA, 22 nt, Homo sapiens
augugacagcaacccccagccc

SEQ ID NO: 330114 - RNA, 22 nt, Homo sapiens
augugcaaauuuccaaacucuu

SEQ ID NO: 330115 - RNA, 22 nt, Homo sapiens
augugcaugcuguucugccaga

SEQ ID NO: 330116 - RNA, 22 nt, Homo sapiens
augugcuugagggaaaucaguu

SEQ ID NO: 330117 - RNA, 22 nt, Homo sapiens
auguggaaauguauaugugucu

SEQ ID NO: 330118 - RNA, 22 nt, Homo sapiens
auguggcacuugacuuucucgc

SEQ ID NO: 330119 - RNA, 22 nt, Homo sapiens
augugggaggacuuggcuguug

SEQ ID NO: 330120 - RNA, 22 nt, Homo sapiens
auguggugguagccaggacagg

SEQ ID NO: 330121 - RNA, 19 nt, Homo sapiens
augugguuagcaugacugc

SEQ ID NO: 330122 - RNA, 22 nt, Homo sapiens
augugugaaucccagaaccugu

SEQ ID NO: 330123 - RNA, 22 nt, Homo sapiens
auguuuagagagggugucaaau

SEQ ID NO: 330124 - RNA, 22 nt, Homo sapiens
auguuugguaagaauauuguua

SEQ ID NO: 330125 - RNA, 22 nt, Homo sapiens
auuaacaucuagaguuuuggug

SEQ ID NO: 330126 - RNA, 22 nt, Homo sapiens
auuaaggaguggguucauggug

SEQ ID NO: 330127 - RNA, 23 nt, Homo sapiens
auuaagguuacuacaguaugagg

SEQ ID NO: 330128 - RNA, 22 nt, Homo sapiens
auuacauagucaaggugucuca

SEQ ID NO: 330129 - RNA, 22 nt, Homo sapiens
auuacaugucuauccaugaaca

SEQ ID NO: 330130 - RNA, 22 nt, Homo sapiens
auuagguaauauaaucauggca

SEQ ID NO: 330131 - RNA, 22 nt, Homo sapiens
auuagguauuuguccuaaauau

SEQ ID NO: 330132 - RNA, 22 nt, Homo sapiens
auuaucacaguuuugcauaugg

SEQ ID NO: 330133 - RNA, 22 nt, Homo sapiens
auucaacuaauuauugaagaug

SEQ ID NO: 330134 - RNA, 20 nt, Homo sapiens
auucaaguaugccuugagaa

SEQ ID NO: 330135 - RNA, 22 nt, Homo sapiens
auucacagggggagaaggguau

SEQ ID NO: 330136 - RNA, 22 nt, Homo sapiens
auucagaggggcagcugucuug

SEQ ID NO: 330137 - RNA, 22 nt, Homo sapiens
auucaucagggauauuggucug

SEQ ID NO: 330138 - RNA, 22 nt, Homo sapiens
auuccacuuagugacucauuug

SEQ ID NO: 330139 - RNA, 20 nt, Homo sapiens
auuccacuuguuugagguac

SEQ ID NO: 330140 - RNA, 22 nt, Homo sapiens
auuccaguuugugagaagcugu

SEQ ID NO: 330141 - RNA, 22 nt, Homo sapiens
auucccuuagcugccucagccu

SEQ ID NO: 330142 - RNA, 22 nt, Homo sapiens
auucccuuggucaacggaugca

SEQ ID NO: 330143 - RNA, 22 nt, Homo sapiens
auuccuuaggcccuuugguuag

SEQ ID NO: 330144 - RNA, 18 nt, Homo sapiens
auucuacaggccuuuuga

SEQ ID NO: 330145 - RNA, 22 nt, Homo sapiens
auucuauaguccuaggauuggg

SEQ ID NO: 330146 - RNA, 20 nt, Homo sapiens
auugaacucaguauucugaa

SEQ ID NO: 330147 - RNA, 22 nt, Homo sapiens
auugaacuguuggagagguuuu

SEQ ID NO: 330148 - RNA, 20 nt, Homo sapiens
auugaagacuccggggcaga

SEQ ID NO: 330149 - RNA, 22 nt, Homo sapiens
auugaaucuaaaaugagucucu

SEQ ID NO: 330150 - RNA, 22 nt, Homo sapiens
auugaauuugguuugcuaagaa

SEQ ID NO: 330151 - RNA, 22 nt, Homo sapiens
auugagacaaauuuguaugcag

SEQ ID NO: 330152 - RNA, 22 nt, Homo sapiens
auugagcaaggucuccuaguau

SEQ ID NO: 330153 - RNA, 22 nt, Homo sapiens
auugagcuuuuuaaaauauagu

SEQ ID NO: 330154 - RNA, 23 nt, Homo sapiens
auugauagugccuuugugcuaau

SEQ ID NO: 330155 - RNA, 22 nt, Homo sapiens
auugcaaagcguagacucuaaa

SEQ ID NO: 330156 - RNA, 22 nt, Homo sapiens
auugcaaucuccgccuccgggg

SEQ ID NO: 330157 - RNA, 22 nt, Homo sapiens
auugcacaccagucugggcaaa

SEQ ID NO: 330158 - RNA, 22 nt, Homo sapiens
auugcacaucugcacuacagcc

SEQ ID NO: 330159 - RNA, 23 nt, Homo sapiens
auugcacuccagccuaccugggc

SEQ ID NO: 330160 - RNA, 22 nt, Homo sapiens
auugcacuccagccuaggcaac

SEQ ID NO: 330161 - RNA, 22 nt, Homo sapiens
auugcacuccagccuagucaac

SEQ ID NO: 330162 - RNA, 22 nt, Homo sapiens
auugcacuccagccugcggaac

SEQ ID NO: 330163 - RNA, 22 nt, Homo sapiens
auugcacuccagccuuggggau

SEQ ID NO: 330164 - RNA, 22 nt, Homo sapiens
auugcacuccagcuugggugac

SEQ ID NO: 330165 - RNA, 22 nt, Homo sapiens
auugcacuccggccugggugac

SEQ ID NO: 330166 - RNA, 22 nt, Homo sapiens
auugcacucuaaccuaggugac

SEQ ID NO: 330167 - RNA, 22 nt, Homo sapiens
auugcacucugaucugcacucc

SEQ ID NO: 330168 - RNA, 22 nt, Homo sapiens
auugcagauucgcuuuguguug

SEQ ID NO: 330169 - RNA, 22 nt, Homo sapiens
auugcagcccacccugggugau

SEQ ID NO: 330170 - RNA, 19 nt, Homo sapiens
auugcaguguaaaacuauu

SEQ ID NO: 330171 - RNA, 21 nt, Homo sapiens
auugcccaaaguggaggggaa

SEQ ID NO: 330172 - RNA, 22 nt, Homo sapiens
auugcccauaaggauauuguca

SEQ ID NO: 330173 - RNA, 22 nt, Homo sapiens
auugcucacacaaagccuguuu

SEQ ID NO: 330174 - RNA, 22 nt, Homo sapiens
auuggcaauagcuuucuuacua

SEQ ID NO: 330175 - RNA, 22 nt, Homo sapiens
auuggcaauggcaaagcagagu

SEQ ID NO: 330176 - RNA, 22 nt, Homo sapiens
auuggcuuuauacauaagaaua

SEQ ID NO: 330177 - RNA, 22 nt, Homo sapiens
auuggggaaugguggcuuuagu

SEQ ID NO: 330178 - RNA, 22 nt, Homo sapiens
auuggugaccugcggcaguaug

SEQ ID NO: 330179 - RNA, 22 nt, Homo sapiens
auuguacuagguccuagggcuu

SEQ ID NO: 330180 - RNA, 20 nt, Homo sapiens
auuguccuugauuacacaga

SEQ ID NO: 330181 - RNA, 22 nt, Homo sapiens
auuguucuuacaugcugucauc

SEQ ID NO: 330182 - RNA, 22 nt, Homo sapiens
auuguucuuguguccuuuuccu

SEQ ID NO: 330183 - RNA, 22 nt, Homo sapiens
auuuaacuggucuaggggccca

SEQ ID NO: 330184 - RNA, 22 nt, Homo sapiens
auuuccuguaggggcuugcgaa

SEQ ID NO: 330185 - RNA, 19 nt, Homo sapiens
auuugaucaucaggcacag

SEQ ID NO: 330186 - RNA, 22 nt, Homo sapiens
auuuggcaacguagggaggcau

SEQ ID NO: 330187 - RNA, 22 nt, Homo sapiens
auuuggcauagaguaucauucu

SEQ ID NO: 330188 - RNA, 21 nt, Homo sapiens
auuugguguuagaaauaaauu

SEQ ID NO: 330189 - RNA, 22 nt, Homo sapiens
auuugguuauggucauggacac

SEQ ID NO: 330190 - RNA, 22 nt, Homo sapiens
auuugucacuuaacagccauua

SEQ ID NO: 330191 - RNA, 22 nt, Homo sapiens
auuuugcauugcuguaaaggaa

SEQ ID NO: 330192 - RNA, 22 nt, Homo sapiens
auuuuuggauauagggaaggau

SEQ ID NO: 330193 - RNA, 22 nt, Homo sapiens
auuuuugguuucaccugcacgc

SEQ ID NO: 330194 - RNA, 22 nt, Homo sapiens
cuuccaaguggggcacgugcca

SEQ ID NO: 330195 - RNA, 22 nt, Homo sapiens
cuuccaguggcagccgggcaug

SEQ ID NO: 330196 - RNA, 22 nt, Homo sapiens
cuuccauaguauuuuuacaaaa

SEQ ID NO: 330197 - RNA, 22 nt, Homo sapiens
cuucugauugaaaauggaguag

SEQ ID NO: 330198 - RNA, 21 nt, Homo sapiens
cuucuuggggcagggcagggu

SEQ ID NO: 330199 - RNA, 22 nt, Homo sapiens
cuugaacaaagagauuccauua

SEQ ID NO: 330200 - RNA, 22 nt, Homo sapiens
cuugacacugcaguuuuccugg

SEQ ID NO: 330201 - RNA, 22 nt, Homo sapiens
cuugacacugucacucaggcca

SEQ ID NO: 330202 - RNA, 22 nt, Homo sapiens
cuugaccaauauggugaaaccc

SEQ ID NO: 330203 - RNA, 22 nt, Homo sapiens
cuugagcuugagauccuuucug

SEQ ID NO: 330204 - RNA, 22 nt, Homo sapiens
cuugcacuccacuguucuccug

SEQ ID NO: 330205 - RNA, 22 nt, Homo sapiens
cuuggcacgugauagguguuga

SEQ ID NO: 330206 - RNA, 22 nt, Homo sapiens
cuuggcacucuguggaguuagg

SEQ ID NO: 330207 - RNA, 22 nt, Homo sapiens
cuuggcauugccccuggaauuu

SEQ ID NO: 330208 - RNA, 22 nt, Homo sapiens
cuuggcuccgacuccccuccaa

SEQ ID NO: 330209 - RNA, 22 nt, Homo sapiens
cuuggcuucuuuauguggcuau

SEQ ID NO: 330210 - RNA, 22 nt, Homo sapiens
cuuggcuuguuguccccugcuc

SEQ ID NO: 330211 - RNA, 19 nt, Homo sapiens
cuuguacucggcgcaguug

SEQ ID NO: 330212 - RNA, 21 nt, Homo sapiens
cuugucuugcuuagaauagac

SEQ ID NO: 330213 - RNA, 17 nt, Homo sapiens
cuuguugugguaguuug

SEQ ID NO: 330214 - RNA, 22 nt, Homo sapiens
cuuuacaguuggacucacgagg

SEQ ID NO: 330215 - RNA, 22 nt, Homo sapiens
cuuuaguuaaaauugggguugu

SEQ ID NO: 330216 - RNA, 22 nt, Homo sapiens
cuuuaugagguuggauggaucu

SEQ ID NO: 330217 - RNA, 21 nt, Homo sapiens
cuuuaugcuguguuagaaaag

SEQ ID NO: 330218 - RNA, 22 nt, Homo sapiens
cuuucugaggagaauagagaac

SEQ ID NO: 330219 - RNA, 22 nt, Homo sapiens
cuuugaugagaaaauacuuugu

SEQ ID NO: 330220 - RNA, 22 nt, Homo sapiens
cuuugcacaucucugcuuuccc

SEQ ID NO: 330221 - RNA, 22 nt, Homo sapiens
cuuuggcaaugucauuuucaau

SEQ ID NO: 330222 - RNA, 22 nt, Homo sapiens
cuuuggcauuagccuguauaga

SEQ ID NO: 330223 - RNA, 22 nt, Homo sapiens
cuuuggguauucucccuugggg

SEQ ID NO: 330224 - RNA, 22 nt, Homo sapiens
cuuuggucaauugcugugggga

SEQ ID NO: 330225 - RNA, 22 nt, Homo sapiens
cuuugguggagucuuuagguuc

SEQ ID NO: 330226 - RNA, 22 nt, Homo sapiens
guggaaaucucugugugacuua

SEQ ID NO: 330227 - RNA, 22 nt, Homo sapiens
guggaagaccagacuuuccaac

SEQ ID NO: 330228 - RNA, 22 nt, Homo sapiens
guggaaguguaaaagcucuugg

SEQ ID NO: 330229 - RNA, 22 nt, Homo sapiens
guggaaguuaagugacuuucug

SEQ ID NO: 330230 - RNA, 22 nt, Homo sapiens
guggaaugaaaacucucucaca

SEQ ID NO: 330231 - RNA, 22 nt, Homo sapiens
guggaauggaaugauuguguau

SEQ ID NO: 330232 - RNA, 17 nt, Homo sapiens
guggaaugucaugucaa

SEQ ID NO: 330233 - RNA, 22 nt, Homo sapiens
guggacugggagagauaguucc

SEQ ID NO: 330234 - RNA, 22 nt, Homo sapiens
guggagucaucacucagagugg

SEQ ID NO: 330235 - RNA, 18 nt, Homo sapiens
guggagugucuuccugga

SEQ ID NO: 330236 - RNA, 22 nt, Homo sapiens
guggcaaacucagcaugcccca

SEQ ID NO: 330237 - RNA, 22 nt, Homo sapiens
guggcaagaauguacaaaaggu

SEQ ID NO: 330238 - RNA, 22 nt, Homo sapiens
guggcacaauuaaguagcuauu

SEQ ID NO: 330239 - RNA, 22 nt, Homo sapiens
guggcagaacagguaggguucu

SEQ ID NO: 330240 - RNA, 22 nt, Homo sapiens
guggcagcacauauagguuguu

SEQ ID NO: 330241 - RNA, 22 nt, Homo sapiens
guggcagugugaggauccugcu

SEQ ID NO: 330242 - RNA, 22 nt, Homo sapiens
guggcuauucaccuuuaugaaa

SEQ ID NO: 330243 - RNA, 22 nt, Homo sapiens
gugggaagcuggaacucccucc

SEQ ID NO: 330244 - RNA, 22 nt, Homo sapiens
gugggaugaucacaguucacug

SEQ ID NO: 330245 - RNA, 22 nt, Homo sapiens
guggguaaaucucuggggcucu

SEQ ID NO: 330246 - RNA, 22 nt, Homo sapiens
guggucagaaaucucaguggca

SEQ ID NO: 330247 - RNA, 22 nt, Homo sapiens
gugguucuaaaccuuuuuuggu

SEQ ID NO: 330248 - RNA, 22 nt, Homo sapiens
guguaaaacaauuagaggauuu

SEQ ID NO: 330249 - RNA, 22 nt, Homo sapiens
guguaaaucugcugugaacauu

SEQ ID NO: 330250 - RNA, 22 nt, Homo sapiens
guguaauacacacauauaugca

SEQ ID NO: 330251 - RNA, 22 nt, Homo sapiens
guguagagaaaaguaccauuuu

SEQ ID NO: 330252 - RNA, 22 nt, Homo sapiens
guguagagaaauagccugaagg

SEQ ID NO: 330253 - RNA, 22 nt, Homo sapiens
guguauauccuauuaguucugu

SEQ ID NO: 330254 - RNA, 22 nt, Homo sapiens
guguaugguaggaugacggagu

SEQ ID NO: 330255 - RNA, 22 nt, Homo sapiens
guguaugguuguuguagagaga

SEQ ID NO: 330256 - RNA, 22 nt, Homo sapiens
gugucacugugaggauauugua

SEQ ID NO: 330257 - RNA, 22 nt, Homo sapiens
gugucacuguugagaaguccac

SEQ ID NO: 330258 - RNA, 22 nt, Homo sapiens
gugucaugagggggacaggaag

SEQ ID NO: 330259 - RNA, 22 nt, Homo sapiens
gugugauggcgcacacagggug

SEQ ID NO: 330260 - RNA, 22 nt, Homo sapiens
gugugauguaaagaacugggga

SEQ ID NO: 330261 - RNA, 22 nt, Homo sapiens
gugugcaauuuugugggaggca

SEQ ID NO: 330262 - RNA, 22 nt, Homo sapiens
gugugcacaaucuggcaugugc

SEQ ID NO: 330263 - RNA, 19 nt, Homo sapiens
gugugcauaucacagagca

SEQ ID NO: 330264 - RNA, 22 nt, Homo sapiens
gugugcauggagggggcaguga

SEQ ID NO: 330265 - RNA, 22 nt, Homo sapiens
gugugcaugucuuuuuaguagg

SEQ ID NO: 330266 - RNA, 23 nt, Homo sapiens
guuaagugaauguguacucuauu

SEQ ID NO: 330267 - RNA, 22 nt, Homo sapiens
guuaaugcuggaauaaguuaag

SEQ ID NO: 330268 - RNA, 22 nt, Homo sapiens
guuagaugaagaccaagggcaa

SEQ ID NO: 330269 - RNA, 22 nt, Homo sapiens
guuagguagaaguuuacuuuga

SEQ ID NO: 330270 - RNA, 18 nt, Homo sapiens
guuagguaguaugaugcu

SEQ ID NO: 330271 - RNA, 22 nt, Homo sapiens
guuagugcuuauuaaauaguau

SEQ ID NO: 330272 - RNA, 22 nt, Homo sapiens
guuauguaucuugauugggugg

SEQ ID NO: 330273 - RNA, 22 nt, Homo sapiens
guuauguguuuccuuaauugcu

SEQ ID NO: 330274 - RNA, 22 nt, Homo sapiens
guuauugcucucgaagacucuc

SEQ ID NO: 330275 - RNA, 22 nt, Homo sapiens
guuauuguccauuuauuuagca

SEQ ID NO: 330276 - RNA, 22 nt, Homo sapiens
guucaagugauucuacugccuc

SEQ ID NO: 330277 - RNA, 22 nt, Homo sapiens
guucacacuugcaaccccagca

SEQ ID NO: 330278 - RNA, 22 nt, Homo sapiens
guucacagugguugccuuccag

SEQ ID NO: 330279 - RNA, 22 nt, Homo sapiens
guucaguaguucauucauuuau

SEQ ID NO: 330280 - RNA, 23 nt, Homo sapiens
guucaucagggauauuggccuga

SEQ ID NO: 330281 - RNA, 22 nt, Homo sapiens
guuccuuguagaugcuggauau

SEQ ID NO: 330282 - RNA, 22 nt, Homo sapiens
guugacuaggagcuacuacuac

SEQ ID NO: 330283 - RNA, 22 nt, Homo sapiens
guugcaauugauguaugucuga

SEQ ID NO: 330284 - RNA, 22 nt, Homo sapiens
guugcaugucugggaggccagc

SEQ ID NO: 330285 - RNA, 22 nt, Homo sapiens
guugccuaggcuggucuugaac

SEQ ID NO: 330286 - RNA, 22 nt, Homo sapiens
guugcucaggcuggagugcagu

SEQ ID NO: 330287 - RNA, 22 nt, Homo sapiens
agcucuuguuaguauuagcagu

SEQ ID NO: 330288 - RNA, 16 nt, Homo sapiens
agcuggaauuacaggc

SEQ ID NO: 330289 - RNA, 22 nt, Homo sapiens
agcugguaugaaaaucucccca

SEQ ID NO: 330290 - RNA, 22 nt, Homo sapiens
agcugguauuuugucaaggaua

SEQ ID NO: 330291 - RNA, 22 nt, Homo sapiens
agcuggucucaggugcccugcu

SEQ ID NO: 330292 - RNA, 22 nt, Homo sapiens
agcuguaguuugguggauguaa

SEQ ID NO: 330293 - RNA, 22 nt, Homo sapiens
agcugugucuucuuaaagauuu

SEQ ID NO: 330294 - RNA, 22 nt, Homo sapiens
agcuguuguuuuaagauacuaa

SEQ ID NO: 330295 - RNA, 22 nt, Homo sapiens
agcuucauucugaauagguuga

SEQ ID NO: 330296 - RNA, 22 nt, Homo sapiens
agcuuguuuuauagaaagucaa

SEQ ID NO: 330297 - RNA, 19 nt, Homo sapiens
agcuuuggcuaacuuucuc

SEQ ID NO: 330298 - RNA, 22 nt, Homo sapiens
aggaaauguuggucccauuucu

SEQ ID NO: 330299 - RNA, 22 nt, Homo sapiens
aggaagacugaaauugcuguuc

SEQ ID NO: 330300 - RNA, 22 nt, Homo sapiens
aggaagguaaacuaacuugccu

SEQ ID NO: 330301 - RNA, 22 nt, Homo sapiens
aggaaugcuaaguuuuccuccu

SEQ ID NO: 330302 - RNA, 22 nt, Homo sapiens
aggacacugauagucuuuggca

SEQ ID NO: 330303 - RNA, 22 nt, Homo sapiens
aggacacugauguaugcugugg

SEQ ID NO: 330304 - RNA, 22 nt, Homo sapiens
aggaccauuguguagcagacau

SEQ ID NO: 330305 - RNA, 21 nt, Homo sapiens
aggagauguuuguccuuuuag

SEQ ID NO: 330306 - RNA, 20 nt, Homo sapiens
aggagcauuuacauuggcuc

SEQ ID NO: 330307 - RNA, 22 nt, Homo sapiens
aggagguagucugucccuuagc

SEQ ID NO: 330308 - RNA, 22 nt, Homo sapiens
aggauacugguaugggcugaau

SEQ ID NO: 330309 - RNA, 21 nt, Homo sapiens
aggauaguagauuaaauauuu

SEQ ID NO: 330310 - RNA, 22 nt, Homo sapiens
aggauuagagacuucucuaccu

SEQ ID NO: 330311 - RNA, 21 nt, Homo sapiens
aggcaaaugaagcagccgcuc

SEQ ID NO: 330312 - RNA, 22 nt, Homo sapiens
aggcaagagugacuacgugaaa

SEQ ID NO: 330313 - RNA, 22 nt, Homo sapiens
aggcaaguugcucaaaugcaaa

SEQ ID NO: 330314 - RNA, 22 nt, Homo sapiens
aggcacgguggcucacaccugu

SEQ ID NO: 330315 - RNA, 22 nt, Homo sapiens
aggcacggugucucaugccugu

SEQ ID NO: 330316 - RNA, 22 nt, Homo sapiens
aggcagcuguuauauacugagu

SEQ ID NO: 330317 - RNA, 22 nt, Homo sapiens
cuuugguuaauaggauauggca

SEQ ID NO: 330318 - RNA, 22 nt, Homo sapiens
cuuugguuuacuuggugcuagu

SEQ ID NO: 330319 - RNA, 21 nt, Homo sapiens
cuuugguuucugacuugcaua

SEQ ID NO: 330320 - RNA, 22 nt, Homo sapiens
cuuuguggggucuuuccucaaa

SEQ ID NO: 330321 - RNA, 22 nt, Homo sapiens
cuuuguguggacauuucaggca

SEQ ID NO: 330322 - RNA, 22 nt, Homo sapiens
cuuugugugggccaagggcugg

SEQ ID NO: 330323 - RNA, 22 nt, Homo sapiens
cuuuuacacugcuggugggaau

SEQ ID NO: 330324 - RNA, 22 nt, Homo sapiens
cuuuugcugggucagcgguggu

SEQ ID NO: 330325 - RNA, 22 nt, Homo sapiens
cuuuuggcuuaagauugucuug

SEQ ID NO: 330326 - RNA, 22 nt, Homo sapiens
cuuuuggucuaucagagaagca

SEQ ID NO: 330327 - RNA, 22 nt, Homo sapiens
cuuuuugcugcagcaauacugg

SEQ ID NO: 330328 - RNA, 22 nt, Homo sapiens
gaaagacuuucugcuguggaua

SEQ ID NO: 330329 - RNA, 22 nt, Homo sapiens
gaaagauuuccugagcuagaaa

SEQ ID NO: 330330 - RNA, 22 nt, Homo sapiens
gaaagugcugcaaggccaugca

SEQ ID NO: 330331 - RNA, 18 nt, Homo sapiens
gaaaugccucuugcuuac

SEQ ID NO: 330332 - RNA, 22 nt, Homo sapiens
gaaauguuuuucaugugggcaa

SEQ ID NO: 330333 - RNA, 22 nt, Homo sapiens
gaacuguuucuggugaaagagu

SEQ ID NO: 330334 - RNA, 22 nt, Homo sapiens
gaacuuguguugcuucacaugu

SEQ ID NO: 330335 - RNA, 22 nt, Homo sapiens
gaagagacagguucccacaaaa

SEQ ID NO: 330336 - RNA, 22 nt, Homo sapiens
gaagcauugauccacaggcgug

SEQ ID NO: 330337 - RNA, 22 nt, Homo sapiens
gaaggagcuuaucugccauuuc

SEQ ID NO: 330338 - RNA, 22 nt, Homo sapiens
gaaggcaugcugcauggccaga

SEQ ID NO: 330339 - RNA, 23 nt, Homo sapiens
gaaguaauaaauggauucuuaac

SEQ ID NO: 330340 - RNA, 22 nt, Homo sapiens
gaagugcaguggcacagucaug

SEQ ID NO: 330341 - RNA, 17 nt, Homo sapiens
gaaguguuucuucauga

SEQ ID NO: 330342 - RNA, 22 nt, Homo sapiens
gaauagugcugcaagaaacaua

SEQ ID NO: 330343 - RNA, 22 nt, Homo sapiens
gaauagugcugcaguaaacaua

SEQ ID NO: 330344 - RNA, 22 nt, Homo sapiens
gaauagugcugcgauaaacaua

SEQ ID NO: 330345 - RNA, 22 nt, Homo sapiens
gaaucacagauuaugaguaucu

SEQ ID NO: 330346 - RNA, 22 nt, Homo sapiens
gaaucauuguuucuaaguuugu

SEQ ID NO: 330347 - RNA, 22 nt, Homo sapiens
gaaugauacuguuaacgaaaga

SEQ ID NO: 330348 - RNA, 22 nt, Homo sapiens
gaaugcuaaguuuccucccuau

SEQ ID NO: 330349 - RNA, 22 nt, Homo sapiens
gaaugucuuauugcucguugua

SEQ ID NO: 330350 - RNA, 22 nt, Homo sapiens
gaauucugucgcuuacuagaug

SEQ ID NO: 330351 - RNA, 22 nt, Homo sapiens
gaauugcacaaaaacugcuugu

SEQ ID NO: 330352 - RNA, 22 nt, Homo sapiens
gaauuguacugcaaucagggga

SEQ ID NO: 330353 - RNA, 22 nt, Homo sapiens
gacaagagaacacugcuauauu

SEQ ID NO: 330354 - RNA, 22 nt, Homo sapiens
gacaaguuugauuuauuccaag

SEQ ID NO: 330355 - RNA, 22 nt, Homo sapiens
gacaguuucucaggcuuccuua

SEQ ID NO: 330356 - RNA, 22 nt, Homo sapiens
gacauguuuuuuaagguuuaug

SEQ ID NO: 330357 - RNA, 22 nt, Homo sapiens
gaccaaagaggcaggcauuaga

SEQ ID NO: 330358 - RNA, 21 nt, Homo sapiens
gaccacagcagggaaugucag

SEQ ID NO: 330359 - RNA, 22 nt, Homo sapiens
gacuacaacuucuauuauucag

SEQ ID NO: 330360 - RNA, 22 nt, Homo sapiens
gacuagagagccaaccgucagg

SEQ ID NO: 330361 - RNA, 22 nt, Homo sapiens
gacuaggagagcagcugcccau

SEQ ID NO: 330362 - RNA, 22 nt, Homo sapiens
gacuagugcccucagaccuaga

SEQ ID NO: 330363 - RNA, 22 nt, Homo sapiens
gacuauguuaccuuacacauca

SEQ ID NO: 330364 - RNA, 22 nt, Homo sapiens
gacucagaacuaaggguguuuc

SEQ ID NO: 330365 - RNA, 18 nt, Homo sapiens
gacucaguuucuaaggca

SEQ ID NO: 330366 - RNA, 19 nt, Homo sapiens
gacuccagaguugugugcu

SEQ ID NO: 330367 - RNA, 22 nt, Homo sapiens
gacugaggaagcgcucucuccu

SEQ ID NO: 330368 - RNA, 22 nt, Homo sapiens
gacugaguaagcagaagcaauu

SEQ ID NO: 330369 - RNA, 22 nt, Homo sapiens
gacuggccauugauacagaggu

SEQ ID NO: 330370 - RNA, 22 nt, Homo sapiens
gacuuagaauuuuugccugcua

SEQ ID NO: 330371 - RNA, 22 nt, Homo sapiens
gagaacagaagcauuccuaauu

SEQ ID NO: 330372 - RNA, 22 nt, Homo sapiens
gagaacauuaauaguuaauuuu

SEQ ID NO: 330373 - RNA, 22 nt, Homo sapiens
gagaacauuuaagccacucagg

SEQ ID NO: 330374 - RNA, 22 nt, Homo sapiens
gagaacugacauuaucguguau

SEQ ID NO: 330375 - RNA, 22 nt, Homo sapiens
gagaacugagugugcuggcgga

SEQ ID NO: 330376 - RNA, 22 nt, Homo sapiens
gagaaugaacagacugccucuu

SEQ ID NO: 330377 - RNA, 22 nt, Homo sapiens
gagaaugagaggggaaggccac

SEQ ID NO: 330378 - RNA, 22 nt, Homo sapiens
gagaaugagauuaugguuacau

SEQ ID NO: 330379 - RNA, 20 nt, Homo sapiens
gagaccugagauucacucaa

SEQ ID NO: 330380 - RNA, 22 nt, Homo sapiens
gagacggagucacgcccuguca

SEQ ID NO: 330381 - RNA, 22 nt, Homo sapiens
uacuagaggaaaacuugaagac

SEQ ID NO: 330382 - RNA, 22 nt, Homo sapiens
uacuagaguagugcagagggga

SEQ ID NO: 330383 - RNA, 22 nt, Homo sapiens
uacucaguaagugcuggcugcu

SEQ ID NO: 330384 - RNA, 19 nt, Homo sapiens
uacugcacuccagucuggg

SEQ ID NO: 330385 - RNA, 20 nt, Homo sapiens
uacugcacuccauccugggu

SEQ ID NO: 330386 - RNA, 18 nt, Homo sapiens
uacugcacucuccagccu

SEQ ID NO: 330387 - RNA, 20 nt, Homo sapiens
uacugcacuuuccucauggu

SEQ ID NO: 330388 - RNA, 22 nt, Homo sapiens
uacugcaucuacuuagagccag

SEQ ID NO: 330389 - RNA, 22 nt, Homo sapiens
uacugcauuccaaucugggcga

SEQ ID NO: 330390 - RNA, 22 nt, Homo sapiens
uacugcugucagugccaaguag

SEQ ID NO: 330391 - RNA, 22 nt, Homo sapiens
uacugcuuaaaagucaauuacu

SEQ ID NO: 330392 - RNA, 22 nt, Homo sapiens
uacugcuuaagggcaugggccc

SEQ ID NO: 330393 - RNA, 22 nt, Homo sapiens
uacugguuuuauauauuucucc

SEQ ID NO: 330394 - RNA, 22 nt, Homo sapiens
uacugguuuuggugggcaggug

SEQ ID NO: 330395 - RNA, 22 nt, Homo sapiens
uacuguguaguuagaccucaga

SEQ ID NO: 330396 - RNA, 22 nt, Homo sapiens
uacuucauucuugaccuugcau

SEQ ID NO: 330397 - RNA, 22 nt, Homo sapiens
uagaaagcaugaccuucagaua

SEQ ID NO: 330398 - RNA, 22 nt, Homo sapiens
uagaagcacuaucccuccuagu

SEQ ID NO: 330399 - RNA, 18 nt, Homo sapiens
uagaauauaggucauucu

SEQ ID NO: 330400 - RNA, 22 nt, Homo sapiens
uagaaucuaacucgcaugaaaa

SEQ ID NO: 330401 - RNA, 22 nt, Homo sapiens
uagacacugcauauuuuuuuaa

SEQ ID NO: 330402 - RNA, 20 nt, Homo sapiens
uagacagcuagauuagauag

SEQ ID NO: 330403 - RNA, 21 nt, Homo sapiens
uagagcaacacacgcccucuc

SEQ ID NO: 330404 - RNA, 22 nt, Homo sapiens
uagaggaaugaauuuggccaga

SEQ ID NO: 330405 - RNA, 22 nt, Homo sapiens
uagaguguaaaccacauaguga

SEQ ID NO: 330406 - RNA, 22 nt, Homo sapiens
uagaguguuuuguuaggcagca

SEQ ID NO: 330407 - RNA, 21 nt, Homo sapiens
uagauaguugguucugaaucu

SEQ ID NO: 330408 - RNA, 22 nt, Homo sapiens
uagaucacucaggcaauaaaag

SEQ ID NO: 330409 - RNA, 20 nt, Homo sapiens
aggcauguugguuugcgugu

SEQ ID NO: 330410 - RNA, 22 nt, Homo sapiens
aggccaguuuuuggagggaaac

SEQ ID NO: 330411 - RNA, 22 nt, Homo sapiens
aggcuagaaucuuccaucuugg

SEQ ID NO: 330412 - RNA, 22 nt, Homo sapiens
aggcugguauuuacaaaagcuc

SEQ ID NO: 330413 - RNA, 22 nt, Homo sapiens
agggcaguguuaggacugucug

SEQ ID NO: 330414 - RNA, 22 nt, Homo sapiens
agguaaacauggggacugcuac

SEQ ID NO: 330415 - RNA, 20 nt, Homo sapiens
agguacacugacaugccuuc

SEQ ID NO: 330416 - RNA, 22 nt, Homo sapiens
agguaguguuauuugcagcuga

SEQ ID NO: 330417 - RNA, 20 nt, Homo sapiens
agguaguuauacaaaugugu

SEQ ID NO: 330418 - RNA, 22 nt, Homo sapiens
agguauuuuuuauccuccagca

SEQ ID NO: 330419 - RNA, 22 nt, Homo sapiens
aggucccauguccucccugacc

SEQ ID NO: 330420 - RNA, 22 nt, Homo sapiens
aggugaaugcucacauucuaau

SEQ ID NO: 330421 - RNA, 22 nt, Homo sapiens
aggugcaauggugguuuugugg

SEQ ID NO: 330422 - RNA, 22 nt, Homo sapiens
aggugcugacaggauagguuuc

SEQ ID NO: 330423 - RNA, 22 nt, Homo sapiens
aggugcuugaaucuaugagcuc

SEQ ID NO: 330424 - RNA, 22 nt, Homo sapiens
agguguuguugaggagauuuca

SEQ ID NO: 330425 - RNA, 22 nt, Homo sapiens
agguuaucccgcauuauuuggu

SEQ ID NO: 330426 - RNA, 22 nt, Homo sapiens
agguuguguuugugauuagaua

SEQ ID NO: 330427 - RNA, 22 nt, Homo sapiens
aguaaacuucagaguucuuccu

SEQ ID NO: 330428 - RNA, 22 nt, Homo sapiens
aguaacaggauccaaagaaugu

SEQ ID NO: 330429 - RNA, 22 nt, Homo sapiens
aguacaucuggcuggauagaua

SEQ ID NO: 330430 - RNA, 22 nt, Homo sapiens
aguacugucagcaggguguuga

SEQ ID NO: 330431 - RNA, 22 nt, Homo sapiens
aguaucaagccacacaugguca

SEQ ID NO: 330432 - RNA, 22 nt, Homo sapiens
agucaacaucaugaaguggaaa

SEQ ID NO: 330433 - RNA, 22 nt, Homo sapiens
agucaagaugagauuugggugg

SEQ ID NO: 330434 - RNA, 22 nt, Homo sapiens
agucacagugaccuugucugac

SEQ ID NO: 330435 - RNA, 22 nt, Homo sapiens
agucaguguguauugauggcac

SEQ ID NO: 330436 - RNA, 21 nt, Homo sapiens
agucauaggaguacauaaugc

SEQ ID NO: 330437 - RNA, 22 nt, Homo sapiens
agucugguguucucacacuagu

SEQ ID NO: 330438 - RNA, 22 nt, Homo sapiens
agugaacaaagaagugcagaua

SEQ ID NO: 330439 - RNA, 22 nt, Homo sapiens
agugaauguuggaaaguuauuu

SEQ ID NO: 330440 - RNA, 22 nt, Homo sapiens
agugacaugggaucaaaucuga

SEQ ID NO: 330441 - RNA, 22 nt, Homo sapiens
agugagcugcagucuggggucc

SEQ ID NO: 330442 - RNA, 22 nt, Homo sapiens
agugcaauggcgugaucuuggc

SEQ ID NO: 330443 - RNA, 22 nt, Homo sapiens
agugcagugguuaggagccagg

SEQ ID NO: 330444 - RNA, 22 nt, Homo sapiens
agugcauuugcaucucaauaua

SEQ ID NO: 330445 - RNA, 22 nt, Homo sapiens
agugcuuaauagauguccagca

SEQ ID NO: 330446 - RNA, 22 nt, Homo sapiens
aguggauguuguggccugggag

SEQ ID NO: 330447 - RNA, 22 nt, Homo sapiens
aguggauuuuagacugagauuu

SEQ ID NO: 330448 - RNA, 22 nt, Homo sapiens
aguggugucugaguggccaggg

SEQ ID NO: 330449 - RNA, 20 nt, Homo sapiens
agugguuuucaaauaugucu

SEQ ID NO: 330450 - RNA, 22 nt, Homo sapiens
agugguuuuggaauggaauuca

SEQ ID NO: 330451 - RNA, 19 nt, Homo sapiens
agugucauggucauuauuu

SEQ ID NO: 330452 - RNA, 22 nt, Homo sapiens
aguucaaaucgagccuggccau

SEQ ID NO: 330453 - RNA, 21 nt, Homo sapiens
aguucacauggcuccuguguu

SEQ ID NO: 330454 - RNA, 22 nt, Homo sapiens
aguuccuacuggcuguaaagaa

SEQ ID NO: 330455 - RNA, 22 nt, Homo sapiens
aguugcaagucuugaguaaaga

SEQ ID NO: 330456 - RNA, 22 nt, Homo sapiens
aguuuuugcugauagcaugcuu

SEQ ID NO: 330457 - RNA, 22 nt, Homo sapiens
auaaagguaauaauaguugcau

SEQ ID NO: 330458 - RNA, 22 nt, Homo sapiens
auaaaguguuuaguauaggcaa

SEQ ID NO: 330459 - RNA, 22 nt, Homo sapiens
auaaaugcuuagaucuguauau

SEQ ID NO: 330460 - RNA, 22 nt, Homo sapiens
auaacauccuuucuuaucguug

SEQ ID NO: 330461 - RNA, 22 nt, Homo sapiens
auaacauggaguuugucauuua

SEQ ID NO: 330462 - RNA, 18 nt, Homo sapiens
auaaccuggugcuuucaa

SEQ ID NO: 330463 - RNA, 22 nt, Homo sapiens
auaaggcugguauagacauuca

SEQ ID NO: 330464 - RNA, 22 nt, Homo sapiens
auaagugagugauucaguguua

SEQ ID NO: 330465 - RNA, 22 nt, Homo sapiens
auaauacugggaagaugagcau

SEQ ID NO: 330466 - RNA, 22 nt, Homo sapiens
auaauagguaguaauggauuga

SEQ ID NO: 330467 - RNA, 22 nt, Homo sapiens
auaauugcaacacagggcuuug

SEQ ID NO: 330468 - RNA, 22 nt, Homo sapiens
auaauugcuaagugaagauggu

SEQ ID NO: 330469 - RNA, 22 nt, Homo sapiens
auacaaggaaugaagagauuug

SEQ ID NO: 330470 - RNA, 22 nt, Homo sapiens
auacaagugccauguuggugug

SEQ ID NO: 330471 - RNA, 22 nt, Homo sapiens
auacacgugcagaacaugcagg

SEQ ID NO: 330472 - RNA, 22 nt, Homo sapiens
auacagacacagucagaggggu

SEQ ID NO: 330473 - RNA, 22 nt, Homo sapiens
auacagcuaaaauauuaaguua

SEQ ID NO: 330474 - RNA, 22 nt, Homo sapiens
auacagucuguuagauuuccuc

SEQ ID NO: 330475 - RNA, 22 nt, Homo sapiens
gauuguguucauaggcauguua

SEQ ID NO: 330476 - RNA, 22 nt, Homo sapiens
gauuugagagaggguguuuaua

SEQ ID NO: 330477 - RNA, 22 nt, Homo sapiens
gcaaaaaguagugcugguuagg

SEQ ID NO: 330478 - RNA, 22 nt, Homo sapiens
gcaaaauugagaagggaauaua

SEQ ID NO: 330479 - RNA, 22 nt, Homo sapiens
gcaaagaaugcagauuugccuc

SEQ ID NO: 330480 - RNA, 22 nt, Homo sapiens
gcaaaguaauuguuguuuuugc

SEQ ID NO: 330481 - RNA, 23 nt, Homo sapiens
gcaaauaucguagagugucccug

SEQ ID NO: 330482 - RNA, 22 nt, Homo sapiens
gcaaaucuuauguccucacauu

SEQ ID NO: 330483 - RNA, 22 nt, Homo sapiens
gcaaaugcuacaccauuuugua

SEQ ID NO: 330484 - RNA, 22 nt, Homo sapiens
gcaagaaugagaaggauuaauu

SEQ ID NO: 330485 - RNA, 22 nt, Homo sapiens
gcaagagguaucuuauuuuccc

SEQ ID NO: 330486 - RNA, 20 nt, Homo sapiens
gcaagcaugaagaguagaga

SEQ ID NO: 330487 - RNA, 22 nt, Homo sapiens
gcacaguggcucccgucuauaa

SEQ ID NO: 330488 - RNA, 22 nt, Homo sapiens
gcacauauguaaauagcugccu

SEQ ID NO: 330489 - RNA, 22 nt, Homo sapiens
gcaccacugcacucucagcuug

SEQ ID NO: 330490 - RNA, 22 nt, Homo sapiens
gcacgugcacccacaugcacgu

SEQ ID NO: 330491 - RNA, 22 nt, Homo sapiens
gcacugggccacauuuauuuuc

SEQ ID NO: 330492 - RNA, 22 nt, Homo sapiens
gcagaucucuucauuucucuua

SEQ ID NO: 330493 - RNA, 22 nt, Homo sapiens
gcagcacaugacuguauguaua

SEQ ID NO: 330494 - RNA, 22 nt, Homo sapiens
gcagcacauggcagaacauauu

SEQ ID NO: 330495 - RNA, 22 nt, Homo sapiens
gcagcagugugggcugaaccua

SEQ ID NO: 330496 - RNA, 22 nt, Homo sapiens
gcagcaucaaaucacacaagau

SEQ ID NO: 330497 - RNA, 22 nt, Homo sapiens
gcaggaaucuugagaaggauuc

SEQ ID NO: 330498 - RNA, 22 nt, Homo sapiens
gcagguaguuucugacuuuuac

SEQ ID NO: 330499 - RNA, 22 nt, Homo sapiens
gcagguguuaugcaaacaacug

SEQ ID NO: 330500 - RNA, 22 nt, Homo sapiens
uagaucauauucagugcuuacu

SEQ ID NO: 330501 - RNA, 22 nt, Homo sapiens
uagaugauucacuuuacuucca

SEQ ID NO: 330502 - RNA, 22 nt, Homo sapiens
uagauuauccggcugggacaau

SEQ ID NO: 330503 - RNA, 22 nt, Homo sapiens
uagauucaucuguuccuuuuga

SEQ ID NO: 330504 - RNA, 22 nt, Homo sapiens
uagauucauuuuagcaaaaguu

SEQ ID NO: 330505 - RNA, 22 nt, Homo sapiens
uagcaacauucagcucagguac

SEQ ID NO: 330506 - RNA, 22 nt, Homo sapiens
uagcaccacaaucaagauacag

SEQ ID NO: 330507 - RNA, 22 nt, Homo sapiens
uagcaccuuagcauuucuagug

SEQ ID NO: 330508 - RNA, 22 nt, Homo sapiens
uagcacuauuuuucacuauccu

SEQ ID NO: 330509 - RNA, 22 nt, Homo sapiens
uagcagccaggaagggcuggcu

SEQ ID NO: 330510 - RNA, 22 nt, Homo sapiens
uagcaggaaaccuguguugagg

SEQ ID NO: 330511 - RNA, 22 nt, Homo sapiens
uagcaguauaugagagcuauug

SEQ ID NO: 330512 - RNA, 22 nt, Homo sapiens
uagcaguaucccaccaucuggu

SEQ ID NO: 330513 - RNA, 22 nt, Homo sapiens
uagcagucuguuaaaacuuuua

SEQ ID NO: 330514 - RNA, 22 nt, Homo sapiens
uagcaguucauuguugugugaa

SEQ ID NO: 330515 - RNA, 22 nt, Homo sapiens
uagcauaauuuguagaaaauca

SEQ ID NO: 330516 - RNA, 22 nt, Homo sapiens
uagcaucaauucauguuaugau

SEQ ID NO: 330517 - RNA, 22 nt, Homo sapiens
uagcuaguauuuugcugaggau

SEQ ID NO: 330518 - RNA, 21 nt, Homo sapiens
uagcucagugguguugccaua

SEQ ID NO: 330519 - RNA, 18 nt, Homo sapiens
uagcucuuguugguccau

SEQ ID NO: 330520 - RNA, 22 nt, Homo sapiens
uagcuguuggugggaagucaga

SEQ ID NO: 330521 - RNA, 17 nt, Homo sapiens
uagcuucacauuaggaa

SEQ ID NO: 330522 - RNA, 23 nt, Homo sapiens
uagcuucucccagaccugcuccc

SEQ ID NO: 330523 - RNA, 22 nt, Homo sapiens
uaggaaguacaucucagaaucu

SEQ ID NO: 330524 - RNA, 22 nt, Homo sapiens
uaggaaguuuucuugcugggcc

SEQ ID NO: 330525 - RNA, 22 nt, Homo sapiens
uaggacaaugguacagcagaaa

SEQ ID NO: 330526 - RNA, 22 nt, Homo sapiens
uaggacuuuuugguaggcggga

SEQ ID NO: 330527 - RNA, 22 nt, Homo sapiens
uagggaguuuuggggugcagaa

SEQ ID NO: 330528 - RNA, 22 nt, Homo sapiens
uagggcuuuaguuugcuugugu

SEQ ID NO: 330529 - RNA, 22 nt, Homo sapiens
uagguagaacuuuagacccugu

SEQ ID NO: 330530 - RNA, 22 nt, Homo sapiens
uagguuaugauccaucuuggcu

SEQ ID NO: 330531 - RNA, 22 nt, Homo sapiens
uagguuauucauucaucauuua

SEQ ID NO: 330532 - RNA, 22 nt, Homo sapiens
uagguucuccacagguucucca

SEQ ID NO: 330533 - RNA, 22 nt, Homo sapiens
uagguugucuguucacucugau

SEQ ID NO: 330534 - RNA, 22 nt, Homo sapiens
uagguugucuucccagaguuuu

SEQ ID NO: 330535 - RNA, 22 nt, Homo sapiens
uaguagagauggggcacaugcc

SEQ ID NO: 330536 - RNA, 22 nt, Homo sapiens
uaguagugucccugacuaucac

SEQ ID NO: 330537 - RNA, 22 nt, Homo sapiens
uaguaguuuuguguauaauaau

SEQ ID NO: 330538 - RNA, 22 nt, Homo sapiens
uagucaaaucugaaggaaauuu

SEQ ID NO: 330539 - RNA, 22 nt, Homo sapiens
uagucagcaauguucauguucu

SEQ ID NO: 330540 - RNA, 22 nt, Homo sapiens
uagugcuagaugacuuugccau

SEQ ID NO: 330541 - RNA, 18 nt, Homo sapiens
uagugcuguucucaugau

SEQ ID NO: 330542 - RNA, 22 nt, Homo sapiens
uauaaaguaauuucuaggggcu

SEQ ID NO: 330543 - RNA, 22 nt, Homo sapiens
uauagcaaugccccacuccuga

SEQ ID NO: 330544 - RNA, 22 nt, Homo sapiens
uauagcacaucuguguguacau

SEQ ID NO: 330545 - RNA, 22 nt, Homo sapiens
uauagcacugaaagaggugauu

SEQ ID NO: 330546 - RNA, 22 nt, Homo sapiens
uauagcacugcaauauuucccu

SEQ ID NO: 330547 - RNA, 21 nt, Homo sapiens
uauagcagcacgauuuauaau

SEQ ID NO: 330548 - RNA, 22 nt, Homo sapiens
uauagcagugaguauugacuaa

SEQ ID NO: 330549 - RNA, 22 nt, Homo sapiens
uauagcagugugagaacagacu

SEQ ID NO: 330550 - RNA, 22 nt, Homo sapiens
uauagcuauuguuaauggaacu

SEQ ID NO: 330551 - RNA, 22 nt, Homo sapiens
uauagcuugaaggaauggucau

SEQ ID NO: 330552 - RNA, 22 nt, Homo sapiens
uauaucacaugcacucauuuuc

SEQ ID NO: 330553 - RNA, 22 nt, Homo sapiens
uauauguucugugucccuuucg

SEQ ID NO: 330554 - RNA, 22 nt, Homo sapiens
uaucaaacccaaggaggggguu

SEQ ID NO: 330555 - RNA, 22 nt, Homo sapiens
uaucaaggccacucauuuuaug

SEQ ID NO: 330556 - RNA, 22 nt, Homo sapiens
uaucacaaacuuagcaguuuaa

SEQ ID NO: 330557 - RNA, 22 nt, Homo sapiens
uaucacacaucaugguaaaucu

SEQ ID NO: 330558 - RNA, 22 nt, Homo sapiens
uaucacacgccuugcuucauuu

SEQ ID NO: 330559 - RNA, 22 nt, Homo sapiens
uaucacacuguuggauuugauu

SEQ ID NO: 330560 - RNA, 22 nt, Homo sapiens
uaucacagaggguauccuagag

SEQ ID NO: 330561 - RNA, 22 nt, Homo sapiens
uaucacagauucuccaggguuu

SEQ ID NO: 330562 - RNA, 22 nt, Homo sapiens
uaucacaguagaacucuuucca

SEQ ID NO: 330563 - RNA, 22 nt, Homo sapiens
uaucacaguaucuagcacagug

SEQ ID NO: 330564 - RNA, 22 nt, Homo sapiens
uaucacuuugauaguuuaaaug

SEQ ID NO: 330565 - RNA, 22 nt, Homo sapiens
uaucagaguuacacugaagacu

SEQ ID NO: 330566 - RNA, 22 nt, Homo sapiens
uaucagcagagucauacuucaa

SEQ ID NO: 330567 - RNA, 22 nt, Homo sapiens
uaucagcagcaggggcugcaga

SEQ ID NO: 330568 - RNA, 22 nt, Homo sapiens
ggagugugauucaguauaauau

SEQ ID NO: 330569 - RNA, 22 nt, Homo sapiens
ggaguguguaggagaaagguaa

SEQ ID NO: 330570 - RNA, 22 nt, Homo sapiens
ggaguguuccauuugucacauu

SEQ ID NO: 330571 - RNA, 22 nt, Homo sapiens
ggauacauuuuuccuccucuuc

SEQ ID NO: 330572 - RNA, 22 nt, Homo sapiens
ggauaucauuauuucuagggcu

SEQ ID NO: 330573 - RNA, 22 nt, Homo sapiens
ggaucacuugagaccaggaguu

SEQ ID NO: 330574 - RNA, 23 nt, Homo sapiens
ggauucaucuguuuguucgcugu

SEQ ID NO: 330575 - RNA, 22 nt, Homo sapiens
ggcaaaauauugucugguauag

SEQ ID NO: 330576 - RNA, 22 nt, Homo sapiens
ggcaaagaugaccauuacuuuu

SEQ ID NO: 330577 - RNA, 22 nt, Homo sapiens
ggcaagaaaaugcaauuacugu

SEQ ID NO: 330578 - RNA, 22 nt, Homo sapiens
ggcaagaaccucaauuaccuuu

SEQ ID NO: 330579 - RNA, 22 nt, Homo sapiens
ggcaagaagaacuauaacuuuu

SEQ ID NO: 330580 - RNA, 21 nt, Homo sapiens
ggcaagagaauacaacauaaa

SEQ ID NO: 330581 - RNA, 22 nt, Homo sapiens
ggcaagcucaggccucaggugu

SEQ ID NO: 330582 - RNA, 22 nt, Homo sapiens
ggcaaggaggggcacuuucacu

SEQ ID NO: 330583 - RNA, 22 nt, Homo sapiens
ggcacuguugccggccugaauu

SEQ ID NO: 330584 - RNA, 22 nt, Homo sapiens
ggcagagucuugcaucuuuaga

SEQ ID NO: 330585 - RNA, 22 nt, Homo sapiens
ggcagaguggacauuuaaaugu

SEQ ID NO: 330586 - RNA, 22 nt, Homo sapiens
ggcagguaaggagugggagccu

SEQ ID NO: 330587 - RNA, 23 nt, Homo sapiens
ggcagguuggucuaggucuauuc

SEQ ID NO: 330588 - RNA, 22 nt, Homo sapiens
ggcaguguaauaauuuauuaau

SEQ ID NO: 330589 - RNA, 22 nt, Homo sapiens
uauggcauuauuuugauagaca

SEQ ID NO: 330590 - RNA, 22 nt, Homo sapiens
uauggcauuuuguaagggcuug

SEQ ID NO: 330591 - RNA, 22 nt, Homo sapiens
uauggcccuuaaguauugguug

SEQ ID NO: 330592 - RNA, 22 nt, Homo sapiens
uauggccugcguccagugguau

SEQ ID NO: 330593 - RNA, 22 nt, Homo sapiens
uauggccuuuuuaaugauauug

SEQ ID NO: 330594 - RNA, 22 nt, Homo sapiens
uauggcuucuauaaggaagcuu

SEQ ID NO: 330595 - RNA, 22 nt, Homo sapiens
uauggcuucuuauucuuucccg

SEQ ID NO: 330596 - RNA, 22 nt, Homo sapiens
uauggcuuuguuaacauuuucu

SEQ ID NO: 330597 - RNA, 22 nt, Homo sapiens
uauggguuuauuucuggucuca

SEQ ID NO: 330598 - RNA, 21 nt, Homo sapiens
uaugguuucuaauucugcagg

SEQ ID NO: 330599 - RNA, 22 nt, Homo sapiens
uaugguuuuaagguuaaggacu

SEQ ID NO: 330600 - RNA, 20 nt, Homo sapiens
uaugguuuuagguauagcau

SEQ ID NO: 330601 - RNA, 22 nt, Homo sapiens
uaugucuggaguuacugagcug

SEQ ID NO: 330602 - RNA, 22 nt, Homo sapiens
uaugugcacaugcccuggugac

SEQ ID NO: 330603 - RNA, 22 nt, Homo sapiens
uauguuaucaaaaagcuaagga

SEQ ID NO: 330604 - RNA, 18 nt, Homo sapiens
uauuaagcuagauauuau

SEQ ID NO: 330605 - RNA, 22 nt, Homo sapiens
uauuauuguccuucuauaccca

SEQ ID NO: 330606 - RNA, 20 nt, Homo sapiens
uauucacucuccagucuugc

SEQ ID NO: 330607 - RNA, 22 nt, Homo sapiens
uauuccacucuguuggagguaa

SEQ ID NO: 330608 - RNA, 22 nt, Homo sapiens
uauuccacuuacaugagguauc

SEQ ID NO: 330609 - RNA, 22 nt, Homo sapiens
uauugaauuuuuaagcccuuug

SEQ ID NO: 330610 - RNA, 22 nt, Homo sapiens
uauugacauuacagugggucuu

SEQ ID NO: 330611 - RNA, 22 nt, Homo sapiens
uauugauuaauugugauuaggc

SEQ ID NO: 330612 - RNA, 22 nt, Homo sapiens
uauugcaacagaagaaagaguc

SEQ ID NO: 330613 - RNA, 22 nt, Homo sapiens
uauugcacaugaggagacauug

SEQ ID NO: 330614 - RNA, 22 nt, Homo sapiens
uauugcacgccagccugagcaa

SEQ ID NO: 330615 - RNA, 22 nt, Homo sapiens
uauugcauauuauucuaguggc

SEQ ID NO: 330616 - RNA, 22 nt, Homo sapiens
uauugcauguugagcaguaccu

SEQ ID NO: 330617 - RNA, 22 nt, Homo sapiens
uauugccucuuuuguaaaagug

SEQ ID NO: 330618 - RNA, 22 nt, Homo sapiens
uauugcuacuuugccuuccaaa

SEQ ID NO: 330619 - RNA, 22 nt, Homo sapiens
uauugcuuuacucucuuauccu

SEQ ID NO: 330620 - RNA, 22 nt, Homo sapiens
uauugguugcuaauuggcgcca

SEQ ID NO: 330621 - RNA, 22 nt, Homo sapiens
uauuuggugaaugaaugcaugu

SEQ ID NO: 330622 - RNA, 22 nt, Homo sapiens
uauuugguuacuugaauagcua

SEQ ID NO: 330623 - RNA, 22 nt, Homo sapiens
uauuugguuauaugaguaaguu

SEQ ID NO: 330624 - RNA, 22 nt, Homo sapiens
ucaaaaccucagagaguagagc

SEQ ID NO: 330625 - RNA, 22 nt, Homo sapiens
ucaaacacuccauaucgcgauu

SEQ ID NO: 330626 - RNA, 22 nt, Homo sapiens
ucaaacugucagguugaccaga

SEQ ID NO: 330627 - RNA, 22 nt, Homo sapiens
ucaaagucuucucaaguaacau

SEQ ID NO: 330628 - RNA, 22 nt, Homo sapiens
ucaaagugcuauggcucagguu

SEQ ID NO: 330629 - RNA, 22 nt, Homo sapiens
ucaaaucaucuuuuccaaagcu

SEQ ID NO: 330630 - RNA, 22 nt, Homo sapiens
ucaaaugaucugcccgccuugg

SEQ ID NO: 330631 - RNA, 17 nt, Homo sapiens
ucaaaugcucccaguga

SEQ ID NO: 330632 - RNA, 22 nt, Homo sapiens
ucaaauguucccuguacuggcc

SEQ ID NO: 330633 - RNA, 22 nt, Homo sapiens
ucaacaggucaauugcauagaa

SEQ ID NO: 330634 - RNA, 22 nt, Homo sapiens
ucaagcaauucgccugucucag

SEQ ID NO: 330635 - RNA, 21 nt, Homo sapiens
ucaaggaguauacguaugcca

SEQ ID NO: 330636 - RNA, 22 nt, Homo sapiens
ucaaguacuuauuugauaauua

SEQ ID NO: 330637 - RNA, 22 nt, Homo sapiens
ucaagugauucuugugccuuag

SEQ ID NO: 330638 - RNA, 22 nt, Homo sapiens
ucaagugcauugauucaguauu

SEQ ID NO: 330639 - RNA, 22 nt, Homo sapiens
ucaaugaaugaugguugguaug

SEQ ID NO: 330640 - RNA, 22 nt, Homo sapiens
ucaaugcaugugacaaagagua

SEQ ID NO: 330641 - RNA, 22 nt, Homo sapiens
ucaauugcaucaacaguguaca

SEQ ID NO: 330642 - RNA, 22 nt, Homo sapiens
ucaauugcuuaugaagauacau

SEQ ID NO: 330643 - RNA, 20 nt, Homo sapiens
ucacaagccaagaucacguc

SEQ ID NO: 330644 - RNA, 22 nt, Homo sapiens
ucacaaggcaggaaugaaaggg

SEQ ID NO: 330645 - RNA, 21 nt, Homo sapiens
ucacaaugaacagcagcagaa

SEQ ID NO: 330646 - RNA, 22 nt, Homo sapiens
ucacaauggagacucgggcgga

SEQ ID NO: 330647 - RNA, 22 nt, Homo sapiens
ucacaauucacuacaggcuuga

SEQ ID NO: 330648 - RNA, 22 nt, Homo sapiens
ucacacuguuuugauuauuaua

SEQ ID NO: 330649 - RNA, 22 nt, Homo sapiens
ucacagacauugaggggaccuu

SEQ ID NO: 330650 - RNA, 22 nt, Homo sapiens
ucacaguaucaugggggacaga

SEQ ID NO: 330651 - RNA, 20 nt, Homo sapiens
ucacagucacacauaauccu

SEQ ID NO: 330652 - RNA, 22 nt, Homo sapiens
ucacagucacugucacguugaa

SEQ ID NO: 330653 - RNA, 22 nt, Homo sapiens
ucacagugaguggaguggggug

SEQ ID NO: 330654 - RNA, 22 nt, Homo sapiens
ucacaguuggccuggccuuuua

SEQ ID NO: 330655 - RNA, 22 nt, Homo sapiens
ucacauggaaaaguccaguaaa

SEQ ID NO: 330656 - RNA, 22 nt, Homo sapiens
ucacauuaagcuguuauuucuu

SEQ ID NO: 330657 - RNA, 22 nt, Homo sapiens
ucacauuguacaaacagguaag

SEQ ID NO: 330658 - RNA, 19 nt, Homo sapiens
ucaccaguacacaauacaa

SEQ ID NO: 330659 - RNA, 22 nt, Homo sapiens
ucacccacacaggagacaggga

SEQ ID NO: 330660 - RNA, 20 nt, Homo sapiens
ucacccugacaucugcccag

SEQ ID NO: 330661 - RNA, 22 nt, Homo sapiens
augggauaguaucaguggaaua

SEQ ID NO: 330662 - RNA, 22 nt, Homo sapiens
augggcaaauguuggaaauucc

SEQ ID NO: 330663 - RNA, 22 nt, Homo sapiens
augggguagguagcucggggaa

SEQ ID NO: 330664 - RNA, 22 nt, Homo sapiens
augggugaguaugaguugacuu

SEQ ID NO: 330665 - RNA, 22 nt, Homo sapiens
augguagacucucgggucaugg

SEQ ID NO: 330666 - RNA, 22 nt, Homo sapiens
augguauuuaacagucuuucua

SEQ ID NO: 330667 - RNA, 22 nt, Homo sapiens
augguauuuugugauaccuugu

SEQ ID NO: 330668 - RNA, 22 nt, Homo sapiens
auggucuuuauuguguugagug

SEQ ID NO: 330669 - RNA, 22 nt, Homo sapiens
auggucuuuuuguuaugagaga

SEQ ID NO: 330670 - RNA, 22 nt, Homo sapiens
auggugugugaauuaaauguua

SEQ ID NO: 330671 - RNA, 22 nt, Homo sapiens
augguuuuacugcaaaauggga

SEQ ID NO: 330672 - RNA, 22 nt, Homo sapiens
auguaaacagaugugcagcuug

SEQ ID NO: 330673 - RNA, 22 nt, Homo sapiens
auguaacuaucugagccauggg

SEQ ID NO: 330674 - RNA, 17 nt, Homo sapiens
auguaauccucaucucu

SEQ ID NO: 330675 - RNA, 21 nt, Homo sapiens
auguaaugaagaagccacugg

SEQ ID NO: 330676 - RNA, 22 nt, Homo sapiens
auguaauguuaaauugcuaauu

SEQ ID NO: 330677 - RNA, 22 nt, Homo sapiens
auguaauugagguuuuugccau

SEQ ID NO: 330678 - RNA, 22 nt, Homo sapiens
ucagaguaguuccuggcagaaa

SEQ ID NO: 330679 - RNA, 22 nt, Homo sapiens
ucagaguggagucugcagccuu

SEQ ID NO: 330680 - RNA, 22 nt, Homo sapiens
ucagagugguuguaccauuuga

SEQ ID NO: 330681 - RNA, 22 nt, Homo sapiens
ucagcacauucaaggccugccu

SEQ ID NO: 330682 - RNA, 22 nt, Homo sapiens
ucagcagugagagaccucaccc

SEQ ID NO: 330683 - RNA, 22 nt, Homo sapiens
ucagcaucacaggcagugagug

SEQ ID NO: 330684 - RNA, 21 nt, Homo sapiens
ucaggaccucuaguuagccag

SEQ ID NO: 330685 - RNA, 22 nt, Homo sapiens
ucaggcuuuucccagagugaug

SEQ ID NO: 330686 - RNA, 22 nt, Homo sapiens
ucagguagcauuuuggaaacag

SEQ ID NO: 330687 - RNA, 22 nt, Homo sapiens
ucagguagcuagauuaugugag

SEQ ID NO: 330688 - RNA, 22 nt, Homo sapiens
ucagguagugccaugauugauu

SEQ ID NO: 330689 - RNA, 22 nt, Homo sapiens
ucagguccuuacugugcucccu

SEQ ID NO: 330690 - RNA, 22 nt, Homo sapiens
ucaguaccugagagugggcaga

SEQ ID NO: 330691 - RNA, 23 nt, Homo sapiens
ucaguacucuauaagugccagcu

SEQ ID NO: 330692 - RNA, 22 nt, Homo sapiens
ucagucauguuuaccagacgua

SEQ ID NO: 330693 - RNA, 22 nt, Homo sapiens
ucagucauucacucacucggac

SEQ ID NO: 330694 - RNA, 22 nt, Homo sapiens
ucagucuuuuaccauuaaguau

SEQ ID NO: 330695 - RNA, 23 nt, Homo sapiens
ucagugaaggaacaacuaaauag

SEQ ID NO: 330696 - RNA, 22 nt, Homo sapiens
ucagugacugcugcuuguauac

SEQ ID NO: 330697 - RNA, 22 nt, Homo sapiens
ucagugacuggguauuaaauca

SEQ ID NO: 330698 - RNA, 22 nt, Homo sapiens
ucagugauugcuuucauggaaa

SEQ ID NO: 330699 - RNA, 20 nt, Homo sapiens
ucagugcagauuguccaagu

SEQ ID NO: 330700 - RNA, 22 nt, Homo sapiens
ucagugcuguuugcccucguuu

SEQ ID NO: 330701 - RNA, 22 nt, Homo sapiens
ucaguggagcuacaauucuggg

SEQ ID NO: 330702 - RNA, 23 nt, Homo sapiens
ucagugucuggauccugcucagu

SEQ ID NO: 330703 - RNA, 22 nt, Homo sapiens
ucaguguuuuauccuccagagc

SEQ ID NO: 330704 - RNA, 22 nt, Homo sapiens
ucaguuuagguguaacggccac

SEQ ID NO: 330705 - RNA, 21 nt, Homo sapiens
ucauaagcucaacaucuguag

SEQ ID NO: 330706 - RNA, 22 nt, Homo sapiens
ucauacuguccaauucuagugg

SEQ ID NO: 330707 - RNA, 22 nt, Homo sapiens
ucauagucuaagguucuuuugc

SEQ ID NO: 330708 - RNA, 22 nt, Homo sapiens
ucaucagaguuuacaagcucag

SEQ ID NO: 330709 - RNA, 22 nt, Homo sapiens
ucaucaggaaacuuaugcagug

SEQ ID NO: 330710 - RNA, 22 nt, Homo sapiens
ucaucagguaugucagcggagu

SEQ ID NO: 330711 - RNA, 20 nt, Homo sapiens
ucaucaguuggugcucgcug

SEQ ID NO: 330712 - RNA, 22 nt, Homo sapiens
ucaucaguuuuuuauaugugau

SEQ ID NO: 330713 - RNA, 22 nt, Homo sapiens
ucaugaaguaguuaacugguug

SEQ ID NO: 330714 - RNA, 22 nt, Homo sapiens
ucaugguuuuauaacccucuug

SEQ ID NO: 330715 - RNA, 22 nt, Homo sapiens
ucaugucuuguuguauuuauuu

SEQ ID NO: 330716 - RNA, 22 nt, Homo sapiens
ucauugagacuuguuuuguggc

SEQ ID NO: 330717 - RNA, 22 nt, Homo sapiens
ucauugcacuucuuuaguugca

SEQ ID NO: 330718 - RNA, 18 nt, Homo sapiens
ucauuggugagcaccucc

SEQ ID NO: 330719 - RNA, 22 nt, Homo sapiens
ucauuguccaacuucuuucagu

SEQ ID NO: 330720 - RNA, 22 nt, Homo sapiens
uccaauguaaucaucauugaau

SEQ ID NO: 330721 - RNA, 22 nt, Homo sapiens
uccacaauggcugaacuagauu

SEQ ID NO: 330722 - RNA, 19 nt, Homo sapiens
uccacagugguugaacuag

SEQ ID NO: 330723 - RNA, 20 nt, Homo sapiens
uccacugagcgucacggcag

SEQ ID NO: 330724 - RNA, 22 nt, Homo sapiens
uccagcuuuuucuaauucugug

SEQ ID NO: 330725 - RNA, 22 nt, Homo sapiens
uccaguacaggucucucauuuc

SEQ ID NO: 330726 - RNA, 22 nt, Homo sapiens
uccaguuuggaggcuugaugug

SEQ ID NO: 330727 - RNA, 22 nt, Homo sapiens
uccaguuuucuuuccuagggcu

SEQ ID NO: 330728 - RNA, 20 nt, Homo sapiens
uccaguuuuggagacauucu

SEQ ID NO: 330729 - RNA, 22 nt, Homo sapiens
uccauagacauuuuaagguagu

SEQ ID NO: 330730 - RNA, 22 nt, Homo sapiens
uccauguagaugcuauguuguc

SEQ ID NO: 330731 - RNA, 22 nt, Homo sapiens
uccauugucuagauguaacaca

SEQ ID NO: 330732 - RNA, 19 nt, Homo sapiens
ucccaagaugcucauacau

SEQ ID NO: 330733 - RNA, 19 nt, Homo sapiens
ucccaauguuuccaggcag

SEQ ID NO: 330734 - RNA, 16 nt, Homo sapiens
ucccaccauugcuugu

SEQ ID NO: 330735 - RNA, 22 nt, Homo sapiens
ucccagugcuaugcaaaagccu

SEQ ID NO: 330736 - RNA, 22 nt, Homo sapiens
ucccaguuuuucugaauaguca

SEQ ID NO: 330737 - RNA, 23 nt, Homo sapiens
uccccgggagcaccagcuuguug

SEQ ID NO: 330738 - RNA, 22 nt, Homo sapiens
uccccugagaacuugcuagaaa

SEQ ID NO: 330739 - RNA, 22 nt, Homo sapiens
ucccgaggacaucugggggcaa

SEQ ID NO: 330740 - RNA, 22 nt, Homo sapiens
ucccugaaaauuagcauuuuaa

SEQ ID NO: 330741 - RNA, 22 nt, Homo sapiens
ucccugaaagcugagauuggaa

SEQ ID NO: 330742 - RNA, 22 nt, Homo sapiens
ucccugacagucacagagcuac

SEQ ID NO: 330743 - RNA, 22 nt, Homo sapiens
ucccugagcaaaguuuucugua

SEQ ID NO: 330744 - RNA, 22 nt, Homo sapiens
ucccuggagcaagagaagaagg

SEQ ID NO: 330745 - RNA, 19 nt, Homo sapiens
ucccuguagaccacagugc

SEQ ID NO: 330746 - RNA, 22 nt, Homo sapiens
ucccuugagccuggcuucucac

SEQ ID NO: 330747 - RNA, 22 nt, Homo sapiens
uccgaguguuagagagcugugu

SEQ ID NO: 330748 - RNA, 22 nt, Homo sapiens
uccuacaugcaguacauucaaa

SEQ ID NO: 330749 - RNA, 22 nt, Homo sapiens
uccucaguggauuggauggugc

SEQ ID NO: 330750 - RNA, 22 nt, Homo sapiens
uccugagaauagaguugcaugu

SEQ ID NO: 330751 - RNA, 22 nt, Homo sapiens
uccugauacgguugcaguucuc

SEQ ID NO: 330752 - RNA, 22 nt, Homo sapiens
uccugcauucugaaauacaagu

SEQ ID NO: 330753 - RNA, 22 nt, Homo sapiens
uccuucaguccaguggguuuug

SEQ ID NO: 330754 - RNA, 22 nt, Homo sapiens
uccuugagccugggaguuauag

SEQ ID NO: 330755 - RNA, 22 nt, Homo sapiens
auuucacugagacaugugccca

SEQ ID NO: 330756 - RNA, 22 nt, Homo sapiens
auuucacuucgcaugguguccg

SEQ ID NO: 330757 - RNA, 22 nt, Homo sapiens
auuuggguaaugagugcaaggg

SEQ ID NO: 330758 - RNA, 22 nt, Homo sapiens
auuuggguuuuacaucaggcua

SEQ ID NO: 330759 - RNA, 22 nt, Homo sapiens
auuuguccugccuuuuccuccu

SEQ ID NO: 330760 - RNA, 18 nt, Homo sapiens
auuuuugcaguccacaug

SEQ ID NO: 330761 - RNA, 22 nt, Homo sapiens
auuuuugguugguaggcuauua

SEQ ID NO: 330762 - RNA, 22 nt, Homo sapiens
auuuuugguugucagcacuagg

SEQ ID NO: 330763 - RNA, 22 nt, Homo sapiens
caaagcacuuggcuuggaagau

SEQ ID NO: 330764 - RNA, 22 nt, Homo sapiens
caaaggcuguuauaggccagga

SEQ ID NO: 330765 - RNA, 22 nt, Homo sapiens
caaaggcuucugaaacugcaga

SEQ ID NO: 330766 - RNA, 22 nt, Homo sapiens
caaaggugcuuuccagguccaa

SEQ ID NO: 330767 - RNA, 22 nt, Homo sapiens
caaaguaauugcuguuuugcca

SEQ ID NO: 330768 - RNA, 22 nt, Homo sapiens
agagcaaugacaugcuaugugg

SEQ ID NO: 330769 - RNA, 22 nt, Homo sapiens
agagcaccauuuagcaagguga

SEQ ID NO: 330770 - RNA, 18 nt, Homo sapiens
agagcacugaguuuuaga

SEQ ID NO: 330771 - RNA, 22 nt, Homo sapiens
agagcacugcugcaggguucug

SEQ ID NO: 330772 - RNA, 22 nt, Homo sapiens
agagcauugaguuaaugguuca

SEQ ID NO: 330773 - RNA, 18 nt, Homo sapiens
agagcuaugaacauaugc

SEQ ID NO: 330774 - RNA, 22 nt, Homo sapiens
agagguaagcaguggcaagugc

SEQ ID NO: 330775 - RNA, 22 nt, Homo sapiens
agagguuuugcccucgagauaa

SEQ ID NO: 330776 - RNA, 22 nt, Homo sapiens
agagugcuuuauuagauguagc

SEQ ID NO: 330777 - RNA, 22 nt, Homo sapiens
agauacaucuaugugucugugu

SEQ ID NO: 330778 - RNA, 22 nt, Homo sapiens
agaucacucagguuucucccug

SEQ ID NO: 330779 - RNA, 18 nt, Homo sapiens
agaugcaugcucacuaca

SEQ ID NO: 330780 - RNA, 22 nt, Homo sapiens
agaugccuaugaagagaaauua

SEQ ID NO: 330781 - RNA, 22 nt, Homo sapiens
agaugccucauguucuagguuc

SEQ ID NO: 330782 - RNA, 22 nt, Homo sapiens
agauggugauaaaugugguacc

SEQ ID NO: 330783 - RNA, 18 nt, Homo sapiens
agaugguguugcuucugu

SEQ ID NO: 330784 - RNA, 22 nt, Homo sapiens
agaugguguuuucucaccagau

SEQ ID NO: 330785 - RNA, 22 nt, Homo sapiens
agauguuguucaucugauuguu

SEQ ID NO: 330786 - RNA, 22 nt, Homo sapiens
agcaaaucuaugaauguauauu

SEQ ID NO: 330787 - RNA, 22 nt, Homo sapiens
agcaacauagugagacccccau

SEQ ID NO: 330788 - RNA, 22 nt, Homo sapiens
agcaacaucagcagcaggaaaa

SEQ ID NO: 330789 - RNA, 22 nt, Homo sapiens
agcaacauugagacugcaguug

SEQ ID NO: 330790 - RNA, 22 nt, Homo sapiens
agcaacauuuuugaccuuucuu

SEQ ID NO: 330791 - RNA, 22 nt, Homo sapiens
agcaagaaugaacucucccaga

SEQ ID NO: 330792 - RNA, 22 nt, Homo sapiens
agcaagacauggcuuccaaaug

SEQ ID NO: 330793 - RNA, 22 nt, Homo sapiens
agcaagaugaaguugagcuagg

SEQ ID NO: 330794 - RNA, 22 nt, Homo sapiens
agcacagccuuguguuuucuug

SEQ ID NO: 330795 - RNA, 22 nt, Homo sapiens
agcaccaauaacaguuucuagc

SEQ ID NO: 330796 - RNA, 22 nt, Homo sapiens
agcaccaauaaucagaguucuu

SEQ ID NO: 330797 - RNA, 22 nt, Homo sapiens
agcaccacaauuuccugccuaa

SEQ ID NO: 330798 - RNA, 22 nt, Homo sapiens
agcaccaccguugcucuauccc

SEQ ID NO: 330799 - RNA, 22 nt, Homo sapiens
agcaccauugcacuccagccug

SEQ ID NO: 330800 - RNA, 19 nt, Homo sapiens
agcagaacaaauguguggg

SEQ ID NO: 330801 - RNA, 22 nt, Homo sapiens
agcagcaugaggggacuucugc

SEQ ID NO: 330802 - RNA, 22 nt, Homo sapiens
agcagcauuaguggaaucuugu

SEQ ID NO: 330803 - RNA, 22 nt, Homo sapiens
agcagcuuugcauggccugugg

SEQ ID NO: 330804 - RNA, 22 nt, Homo sapiens
agcaggucuuaacuugugaggu

SEQ ID NO: 330805 - RNA, 22 nt, Homo sapiens
agcagguguggcuuauccugaa

SEQ ID NO: 330806 - RNA, 22 nt, Homo sapiens
agcaguagugaaaguagacuua

SEQ ID NO: 330807 - RNA, 22 nt, Homo sapiens
agcauagugccuugaaaacaau

SEQ ID NO: 330808 - RNA, 22 nt, Homo sapiens
agcaucacguagacuuuaccau

SEQ ID NO: 330809 - RNA, 22 nt, Homo sapiens
agcaucauguuuucgagguuca

SEQ ID NO: 330810 - RNA, 22 nt, Homo sapiens
agcauggucacuuugggcccca

SEQ ID NO: 330811 - RNA, 20 nt, Homo sapiens
agcauugguuagaacaguag

SEQ ID NO: 330812 - RNA, 19 nt, Homo sapiens
agccaguuuucccagcacc

SEQ ID NO: 330813 - RNA, 22 nt, Homo sapiens
agccgguguccacgaagaagag

SEQ ID NO: 330814 - RNA, 22 nt, Homo sapiens
agccuagagagccacuuugaga

SEQ ID NO: 330815 - RNA, 23 nt, Homo sapiens
agccuguugccuaggcagcucau

SEQ ID NO: 330816 - RNA, 22 nt, Homo sapiens
agcuaaaucucauguugaauug

SEQ ID NO: 330817 - RNA, 22 nt, Homo sapiens
agcuagcauucauaguuugagg

SEQ ID NO: 330818 - RNA, 22 nt, Homo sapiens
agcucacagccuagcacuguga

SEQ ID NO: 330819 - RNA, 21 nt, Homo sapiens
agcuccacucguucccaaagc

SEQ ID NO: 330820 - RNA, 22 nt, Homo sapiens
agcuccaugauaguaugucugu

SEQ ID NO: 330821 - RNA, 22 nt, Homo sapiens
agcuccuacuguuacaucauug

SEQ ID NO: 330822 - RNA, 22 nt, Homo sapiens
agcugaguguuccaagagcgag

SEQ ID NO: 330823 - RNA, 22 nt, Homo sapiens
cuaagugaguauaauuuuaaga

SEQ ID NO: 330824 - RNA, 22 nt, Homo sapiens
cuaaucuagccuuauaaguauu

SEQ ID NO: 330825 - RNA, 22 nt, Homo sapiens
cuaaugcagucaggagaaggaa

SEQ ID NO: 330826 - RNA, 22 nt, Homo sapiens
cuacaguagagaggauguagaa

SEQ ID NO: 330827 - RNA, 22 nt, Homo sapiens
cuacaguaugaaaccuuuacuc

SEQ ID NO: 330828 - RNA, 23 nt, Homo sapiens
cuacagugccugucucuuuggcc

SEQ ID NO: 330829 - RNA, 22 nt, Homo sapiens
cuacaguuauguuuuaaaugug

SEQ ID NO: 330830 - RNA, 22 nt, Homo sapiens
cuacaguucuuaauuaaguagu

SEQ ID NO: 330831 - RNA, 22 nt, Homo sapiens
cuaccuggguggcucaugacuu

SEQ ID NO: 330832 - RNA, 22 nt, Homo sapiens
cuacugauuaaaagaacagguc

SEQ ID NO: 330833 - RNA, 22 nt, Homo sapiens
cuagacacugacguuccuccga

SEQ ID NO: 330834 - RNA, 22 nt, Homo sapiens
cuagaguacuuaccacagcaug

SEQ ID NO: 330835 - RNA, 22 nt, Homo sapiens
cuagauuguuuccauaaugaca

SEQ ID NO: 330836 - RNA, 22 nt, Homo sapiens
cuagcugcacuuccugcuacug

SEQ ID NO: 330837 - RNA, 22 nt, Homo sapiens
cuaggaaguauguguuauugcu

SEQ ID NO: 330838 - RNA, 22 nt, Homo sapiens
cuaggcuuuucuuggauccagg

SEQ ID NO: 330839 - RNA, 22 nt, Homo sapiens
cuagguagcuuuucugucaugu

SEQ ID NO: 330840 - RNA, 18 nt, Homo sapiens
cuaguguuucuugaauca

SEQ ID NO: 330841 - RNA, 22 nt, Homo sapiens
cuauaacagugugguuuggaga

SEQ ID NO: 330842 - RNA, 22 nt, Homo sapiens
cuauaguauaguuugaagucag

SEQ ID NO: 330843 - RNA, 22 nt, Homo sapiens
cuaucucaggcccaggcccuug

SEQ ID NO: 330844 - RNA, 19 nt, Homo sapiens
cuaugaccaugugauuuuu

SEQ ID NO: 330845 - RNA, 18 nt, Homo sapiens
cuaugccacuuuauauca

SEQ ID NO: 330846 - RNA, 22 nt, Homo sapiens
cuauggcucugguuauggcugu

SEQ ID NO: 330847 - RNA, 22 nt, Homo sapiens
cuauggcuguagucccugugua

SEQ ID NO: 330848 - RNA, 22 nt, Homo sapiens
cuauuagguuggugcaaaaguc

SEQ ID NO: 330849 - RNA, 22 nt, Homo sapiens
cucaaagucaagggaaagcagg

SEQ ID NO: 330850 - RNA, 22 nt, Homo sapiens
cucaaaugguccagcuaguggu

SEQ ID NO: 330851 - RNA, 22 nt, Homo sapiens
cucaccuugugauccacccacc

SEQ ID NO: 330852 - RNA, 22 nt, Homo sapiens
cucacugucaacauguauuugg

SEQ ID NO: 330853 - RNA, 22 nt, Homo sapiens
cucacugugguguccuuaggua

SEQ ID NO: 330854 - RNA, 22 nt, Homo sapiens
cucagauacuugggagguugag

SEQ ID NO: 330855 - RNA, 22 nt, Homo sapiens
cucagcaguggauuuaccacca

SEQ ID NO: 330856 - RNA, 22 nt, Homo sapiens
cucagcuacuugggaagcugag

SEQ ID NO: 330857 - RNA, 22 nt, Homo sapiens
cucaggguacuucuccuuugcu

SEQ ID NO: 330858 - RNA, 22 nt, Homo sapiens
cucagucuaugauacuuugcua

SEQ ID NO: 330859 - RNA, 22 nt, Homo sapiens
cucaugcugucuucugggguaa

SEQ ID NO: 330860 - RNA, 22 nt, Homo sapiens
cucauggaauacuucacagcca

SEQ ID NO: 330861 - RNA, 22 nt, Homo sapiens
cucauggagaacaucugcuagg

SEQ ID NO: 330862 - RNA, 19 nt, Homo sapiens
cucauggagaaggagaaua

SEQ ID NO: 330863 - RNA, 22 nt, Homo sapiens
cucauggauggucuggcagcca

SEQ ID NO: 330864 - RNA, 22 nt, Homo sapiens
cucauugcaaucucugccuccc

SEQ ID NO: 330865 - RNA, 22 nt, Homo sapiens
cuccacugagcaggugggaggc

SEQ ID NO: 330866 - RNA, 22 nt, Homo sapiens
cuccaggugucauccaccuccu

SEQ ID NO: 330867 - RNA, 22 nt, Homo sapiens
cuccauuuggaacagauguccu

SEQ ID NO: 330868 - RNA, 22 nt, Homo sapiens
cucccacccucauuuuuaggca

SEQ ID NO: 330869 - RNA, 22 nt, Homo sapiens
cucccauugcaaacaacagaag

SEQ ID NO: 330870 - RNA, 20 nt, Homo sapiens
cucccugacaaauguggaaa

SEQ ID NO: 330871 - RNA, 22 nt, Homo sapiens
cuccuggugauuggagugugaa

SEQ ID NO: 330872 - RNA, 21 nt, Homo sapiens
cucucugcuuaugaauaguga

SEQ ID NO: 330873 - RNA, 22 nt, Homo sapiens
cucucuguuugucuguuauugg

SEQ ID NO: 330874 - RNA, 15 nt, Homo sapiens
cucugguuuuucuuc

SEQ ID NO: 330875 - RNA, 22 nt, Homo sapiens
cucuuacaguguguggugaaag

SEQ ID NO: 330876 - RNA, 22 nt, Homo sapiens
cucuuggguagauuuugcagag

SEQ ID NO: 330877 - RNA, 19 nt, Homo sapiens
cucuuuggugucucuucuu

SEQ ID NO: 330878 - RNA, 22 nt, Homo sapiens
cugaaaagcaucugcauagcug

SEQ ID NO: 330879 - RNA, 22 nt, Homo sapiens
cugaagugcuugccacauaaaa

SEQ ID NO: 330880 - RNA, 22 nt, Homo sapiens
cugaauguuuucuucuauucug

SEQ ID NO: 330881 - RNA, 22 nt, Homo sapiens
cugacaagauucaucacucagu

SEQ ID NO: 330882 - RNA, 22 nt, Homo sapiens
cugacucagacacauguauaug

SEQ ID NO: 330883 - RNA, 22 nt, Homo sapiens
cugagauaauuucuagguguca

SEQ ID NO: 330884 - RNA, 22 nt, Homo sapiens
cugagaucaagucuugcucugu

SEQ ID NO: 330885 - RNA, 22 nt, Homo sapiens
cugagaucguggggcugcuguc

SEQ ID NO: 330886 - RNA, 22 nt, Homo sapiens
cugagaucugaaccaggagugu

SEQ ID NO: 330887 - RNA, 22 nt, Homo sapiens
cugagauuuuuagauccuggcg

SEQ ID NO: 330888 - RNA, 22 nt, Homo sapiens
cugagcaaaaugaagacacgau

SEQ ID NO: 330889 - RNA, 22 nt, Homo sapiens
cugagcaaagaagugauaauga

SEQ ID NO: 330890 - RNA, 22 nt, Homo sapiens
cugagcaucauggcagaaucuu

SEQ ID NO: 330891 - RNA, 22 nt, Homo sapiens
cugaggucugaauccagguauc

SEQ ID NO: 330892 - RNA, 22 nt, Homo sapiens
cugaggugauauauacauauuu

SEQ ID NO: 330893 - RNA, 22 nt, Homo sapiens
cugaggugggaggauuggcuug

SEQ ID NO: 330894 - RNA, 22 nt, Homo sapiens
cugaggugggaguuuuucucau

SEQ ID NO: 330895 - RNA, 22 nt, Homo sapiens
cugagguuaggaguuugagacc

SEQ ID NO: 330896 - RNA, 18 nt, Homo sapiens
cugagucauuccuggguc

SEQ ID NO: 330897 - RNA, 22 nt, Homo sapiens
cugauaaguuuuucuuuauaag

SEQ ID NO: 330898 - RNA, 22 nt, Homo sapiens
cugauacugagaccuuggguua

SEQ ID NO: 330899 - RNA, 22 nt, Homo sapiens
cugaucuggaggugucugggga

SEQ ID NO: 330900 - RNA, 22 nt, Homo sapiens
cugaugaaguauuuguucugga

SEQ ID NO: 330901 - RNA, 22 nt, Homo sapiens
cugauuguuugccucuaaaauc

SEQ ID NO: 330902 - RNA, 22 nt, Homo sapiens
cugauuuguccccagccucaug

SEQ ID NO: 330903 - RNA, 21 nt, Homo sapiens
cugcaaaugcugcugccugau

SEQ ID NO: 330904 - RNA, 20 nt, Homo sapiens
cugcaaaugcugcugcugau

SEQ ID NO: 330905 - RNA, 22 nt, Homo sapiens
cugcagguaggggcagcuuugg

SEQ ID NO: 330906 - RNA, 22 nt, Homo sapiens
cugccacugacaccucaaggac

SEQ ID NO: 330907 - RNA, 22 nt, Homo sapiens
cugccuaaagaaaaagacguug

SEQ ID NO: 330908 - RNA, 22 nt, Homo sapiens
cugcuggucuuuaaggucuagg

SEQ ID NO: 330909 - RNA, 22 nt, Homo sapiens
cugcuguuguuaacuuuuggag

SEQ ID NO: 330910 - RNA, 22 nt, Homo sapiens
cuggaaagaaucaggcuaaacu

SEQ ID NO: 330911 - RNA, 22 nt, Homo sapiens
cuggaaagcaaguccauugcuc

SEQ ID NO: 330912 - RNA, 22 nt, Homo sapiens
cuggaagaaaaucacgccaucu

SEQ ID NO: 330913 - RNA, 22 nt, Homo sapiens
cuggaaucuauggauaacaucg

SEQ ID NO: 330914 - RNA, 22 nt, Homo sapiens
cuggaauucaaaaucugaauuu

SEQ ID NO: 330915 - RNA, 22 nt, Homo sapiens
uaguuuaucuucuggauggaca

SEQ ID NO: 330916 - RNA, 22 nt, Homo sapiens
uauaagguuaggaaaaauuucu

SEQ ID NO: 330917 - RNA, 22 nt, Homo sapiens
uauacacgugugcauauauaca

SEQ ID NO: 330918 - RNA, 22 nt, Homo sapiens
uauacaguaggcacucaguggc

SEQ ID NO: 330919 - RNA, 22 nt, Homo sapiens
uauagcaaugugccacucucug

SEQ ID NO: 330920 - RNA, 22 nt, Homo sapiens
uauagcacugagaauguaauuc

SEQ ID NO: 330921 - RNA, 17 nt, Homo sapiens
uauagcacuucucacau

SEQ ID NO: 330922 - RNA, 21 nt, Homo sapiens
uauagcagcacgauuuauagu

SEQ ID NO: 330923 - RNA, 22 nt, Homo sapiens
uauagcagccugaacaaaguaa

SEQ ID NO: 330924 - RNA, 22 nt, Homo sapiens
uauagcuuaaaguuuagauccu

SEQ ID NO: 330925 - RNA, 22 nt, Homo sapiens
uauagcuuuuuagggaauuugg

SEQ ID NO: 330926 - RNA, 22 nt, Homo sapiens
uauaguuuuuccugggaggaaa

SEQ ID NO: 330927 - RNA, 22 nt, Homo sapiens
uauaugcaacauaguguaugug

SEQ ID NO: 330928 - RNA, 22 nt, Homo sapiens
uauaugucugagacugggggau

SEQ ID NO: 330929 - RNA, 22 nt, Homo sapiens
uaucaacaggguggccagugua

SEQ ID NO: 330930 - RNA, 22 nt, Homo sapiens
uaucaaguuggaagagaaguaa

SEQ ID NO: 330931 - RNA, 22 nt, Homo sapiens
uaucacagcaaggacccauuau

SEQ ID NO: 330932 - RNA, 22 nt, Homo sapiens
uaucacagcgggguguacaccc

SEQ ID NO: 330933 - RNA, 22 nt, Homo sapiens
uaucacaggucaggaaccuugu

SEQ ID NO: 330934 - RNA, 22 nt, Homo sapiens
uaucacaggucaggaaucuugc

SEQ ID NO: 330935 - RNA, 20 nt, Homo sapiens
uaucacaguucaggaacucu

SEQ ID NO: 330936 - RNA, 22 nt, Homo sapiens
uaucaccuugagagaccuuauc

SEQ ID NO: 330937 - RNA, 22 nt, Homo sapiens
uaucaccuugcaggagcuauga

SEQ ID NO: 330938 - RNA, 22 nt, Homo sapiens
uaucacuguuguuuguuuaagg

SEQ ID NO: 330939 - RNA, 21 nt, Homo sapiens
uaucagagacauugagaggca

SEQ ID NO: 330940 - RNA, 22 nt, Homo sapiens
uauccuagugggguuucaguca

SEQ ID NO: 330941 - RNA, 22 nt, Homo sapiens
uaucguaguguuggaaaacaag

SEQ ID NO: 330942 - RNA, 22 nt, Homo sapiens
uaucucagaguguacaagauua

SEQ ID NO: 330943 - RNA, 22 nt, Homo sapiens
uaucucaguguacaggaugaua

SEQ ID NO: 330944 - RNA, 20 nt, Homo sapiens
uaucucaguuuguccuaaac

SEQ ID NO: 330945 - RNA, 22 nt, Homo sapiens
uaucucuguggguagugcugaa

SEQ ID NO: 330946 - RNA, 22 nt, Homo sapiens
uaucugcacauacacuuauagc

SEQ ID NO: 330947 - RNA, 22 nt, Homo sapiens
uaucugcacuucugucuagguc

SEQ ID NO: 330948 - RNA, 22 nt, Homo sapiens
uaucugcaucccauuuuuauca

SEQ ID NO: 330949 - RNA, 22 nt, Homo sapiens
uaugaagccaggauuuauuauu

SEQ ID NO: 330950 - RNA, 20 nt, Homo sapiens
uaugacacugucauaaaaau

SEQ ID NO: 330951 - RNA, 22 nt, Homo sapiens
uaugacauaguccuuaacccuc

SEQ ID NO: 330952 - RNA, 22 nt, Homo sapiens
uaugacugagacuuaaauugug

SEQ ID NO: 330953 - RNA, 22 nt, Homo sapiens
uaugacuguuugcucauucagg

SEQ ID NO: 330954 - RNA, 22 nt, Homo sapiens
uaugacuuguuuucuggucugc

SEQ ID NO: 330955 - RNA, 22 nt, Homo sapiens
uaugagagcugguagguagaga

SEQ ID NO: 330956 - RNA, 19 nt, Homo sapiens
uaugcaacuuauagugcug

SEQ ID NO: 330957 - RNA, 22 nt, Homo sapiens
uaugcacacguguccaugugca

SEQ ID NO: 330958 - RNA, 22 nt, Homo sapiens
uaugcacuauggaaguagcuca

SEQ ID NO: 330959 - RNA, 22 nt, Homo sapiens
uaugccuuucucacuaagcuua

SEQ ID NO: 330960 - RNA, 22 nt, Homo sapiens
uaugccuuuuggcucaagaaac

SEQ ID NO: 330961 - RNA, 22 nt, Homo sapiens
uaugcuuauaaacauuugucag

SEQ ID NO: 330962 - RNA, 22 nt, Homo sapiens
uaugcuuauuaaaacagugugu

SEQ ID NO: 330963 - RNA, 22 nt, Homo sapiens
uauggaaaucuuaccuuauggu

SEQ ID NO: 330964 - RNA, 22 nt, Homo sapiens
uauggauauuacuccacaaaga

SEQ ID NO: 330965 - RNA, 22 nt, Homo sapiens
uauggauuucauuagacuugag

SEQ ID NO: 330966 - RNA, 21 nt, Homo sapiens
uauggauuugccuauucugga

SEQ ID NO: 330967 - RNA, 22 nt, Homo sapiens
uauggccccuacaugugcaaaa

SEQ ID NO: 330968 - RNA, 22 nt, Homo sapiens
uauggcuacuacgaauaaugcu

SEQ ID NO: 330969 - RNA, 22 nt, Homo sapiens
uauggcuuucuacuugaguucu

SEQ ID NO: 330970 - RNA, 22 nt, Homo sapiens
uaugggcuuuguuuuguacuag

SEQ ID NO: 330971 - RNA, 22 nt, Homo sapiens
uauggguuuuucauaaauaggu

SEQ ID NO: 330972 - RNA, 22 nt, Homo sapiens
uauggucuuugagaggugacug

SEQ ID NO: 330973 - RNA, 22 nt, Homo sapiens
uaugguuuucucuuacguguug

SEQ ID NO: 330974 - RNA, 17 nt, Homo sapiens
uauguaguacuuauaaa

SEQ ID NO: 330975 - RNA, 22 nt, Homo sapiens
uaugucuucuuuagagaaaugu

SEQ ID NO: 330976 - RNA, 22 nt, Homo sapiens
uaugugcaaauuaauugcuaga

SEQ ID NO: 330977 - RNA, 22 nt, Homo sapiens
uauuaagcuaguugucagugcu

SEQ ID NO: 330978 - RNA, 22 nt, Homo sapiens
uauuacacuuuagugucuucca

SEQ ID NO: 330979 - RNA, 22 nt, Homo sapiens
uauuacagaccauaucgccggg

SEQ ID NO: 330980 - RNA, 22 nt, Homo sapiens
uauuagguuggugcaaaaguaa

SEQ ID NO: 330981 - RNA, 22 nt, Homo sapiens
uauuaguuuucuguggauuaca

SEQ ID NO: 330982 - RNA, 22 nt, Homo sapiens
uauucaagccaaauucaagcca

SEQ ID NO: 330983 - RNA, 22 nt, Homo sapiens
uauucacaggugugggacaaag

SEQ ID NO: 330984 - RNA, 22 nt, Homo sapiens
uauuccacaauaugauuuuuaa

SEQ ID NO: 330985 - RNA, 22 nt, Homo sapiens
uauuccagcccuggugagccag

SEQ ID NO: 330986 - RNA, 22 nt, Homo sapiens
uauuccauuugugaaaggaagu

SEQ ID NO: 330987 - RNA, 22 nt, Homo sapiens
uauuccucuuuguugagguuau

SEQ ID NO: 330988 - RNA, 22 nt, Homo sapiens
uauugaacgugggauauugaag

SEQ ID NO: 330989 - RNA, 17 nt, Homo sapiens
uauugaccuuuguaugu

SEQ ID NO: 330990 - RNA, 22 nt, Homo sapiens
uauugauuuucaguguucagcu

SEQ ID NO: 330991 - RNA, 22 nt, Homo sapiens
uauugcaauuggcagagugcua

SEQ ID NO: 330992 - RNA, 23 nt, Homo sapiens
uauugcacuaugguaacccuuuu

SEQ ID NO: 330993 - RNA, 22 nt, Homo sapiens
uauugcacuccagccuuggcaa

SEQ ID NO: 330994 - RNA, 22 nt, Homo sapiens
uauugcagugagauccaucugg

SEQ ID NO: 330995 - RNA, 22 nt, Homo sapiens
uauugcauuugagguugguuga

SEQ ID NO: 330996 - RNA, 22 nt, Homo sapiens
uauugccucagugacuuugggg

SEQ ID NO: 330997 - RNA, 22 nt, Homo sapiens
uauugccugucuccaaaaauca

SEQ ID NO: 330998 - RNA, 22 nt, Homo sapiens
uauugcugaaaaugcuaaugau

SEQ ID NO: 330999 - RNA, 22 nt, Homo sapiens
uauugcuggauguauuacaugu

SEQ ID NO: 331000 - RNA, 22 nt, Homo sapiens
uauugcuggcacauaguagguc

SEQ ID NO: 331001 - RNA, 22 nt, Homo sapiens
uauugcuggcucugucuucauu

SEQ ID NO: 331002 - RNA, 22 nt, Homo sapiens
uauugucacuaaaggaagcugg

SEQ ID NO: 331003 - RNA, 22 nt, Homo sapiens
uauuguccaauaggauguuccu

SEQ ID NO: 331004 - RNA, 22 nt, Homo sapiens
uauuguuaaagauguuaaugau

SEQ ID NO: 331005 - RNA, 22 nt, Homo sapiens
uauuguuuuucccaggagucua

SEQ ID NO: 331006 - RNA, 22 nt, Homo sapiens
uauuugauugacuuuagcagga

SEQ ID NO: 331007 - RNA, 22 nt, Homo sapiens
uggcaauaauucagugugggcu

SEQ ID NO: 331008 - RNA, 22 nt, Homo sapiens
uggcaccugacuccgagaugca

SEQ ID NO: 331009 - RNA, 22 nt, Homo sapiens
uggcagcgugaaagacuuuuuc

SEQ ID NO: 331010 - RNA, 22 nt, Homo sapiens
ucaaagugacaaaguugcagca

SEQ ID NO: 331011 - RNA, 21 nt, Homo sapiens
ucaaaguguucuuuuguugaa

SEQ ID NO: 331012 - RNA, 22 nt, Homo sapiens
ucaaaugcucuuugcagagagg

SEQ ID NO: 331013 - RNA, 22 nt, Homo sapiens
ucaaauuccaagucuagguagg

SEQ ID NO: 331014 - RNA, 22 nt, Homo sapiens
ucaacacaguuaaauggggaaa

SEQ ID NO: 331015 - RNA, 22 nt, Homo sapiens
ucaacagugauggaaaguuaua

SEQ ID NO: 331016 - RNA, 22 nt, Homo sapiens
ucaagaccucacauagaggaga

SEQ ID NO: 331017 - RNA, 22 nt, Homo sapiens
ucaagcaauucuccucucagcc

SEQ ID NO: 331018 - RNA, 22 nt, Homo sapiens
ucaagcaauucugcugccucag

SEQ ID NO: 331019 - RNA, 18 nt, Homo sapiens
ucaagcaauugucaugcc

SEQ ID NO: 331020 - RNA, 19 nt, Homo sapiens
ucaagcuauucuccugccu

SEQ ID NO: 331021 - RNA, 18 nt, Homo sapiens
ucaagcuauugucaugcc

SEQ ID NO: 331022 - RNA, 20 nt, Homo sapiens
ucaaggcacgaauaaaaguu

SEQ ID NO: 331023 - RNA, 20 nt, Homo sapiens
ucaaggcaggaacuguacau

SEQ ID NO: 331024 - RNA, 22 nt, Homo sapiens
ucaagguacguugccucagauu

SEQ ID NO: 331025 - RNA, 22 nt, Homo sapiens
ucaaguaauacucccaucuugg

SEQ ID NO: 331026 - RNA, 22 nt, Homo sapiens
ucaaguacugccuugcucuggc

SEQ ID NO: 331027 - RNA, 22 nt, Homo sapiens
ucaauguaucuccaagaauuga

SEQ ID NO: 331028 - RNA, 22 nt, Homo sapiens
ucacacugcaucuguuggaauu

SEQ ID NO: 331029 - RNA, 22 nt, Homo sapiens
ucacagaugcuugacccauuuc

SEQ ID NO: 331030 - RNA, 19 nt, Homo sapiens
ucacaggguugacuugagg

SEQ ID NO: 331031 - RNA, 18 nt, Homo sapiens
ucacagguaauuaggauu

SEQ ID NO: 331032 - RNA, 22 nt, Homo sapiens
ucacaguauggggggugguuau

SEQ ID NO: 331033 - RNA, 22 nt, Homo sapiens
ucacaguccuguuuaggagagg

SEQ ID NO: 331034 - RNA, 22 nt, Homo sapiens
ucacagugcaggaucaguuaau

SEQ ID NO: 331035 - RNA, 17 nt, Homo sapiens
ucacaguguuaggauga

SEQ ID NO: 331036 - RNA, 23 nt, Homo sapiens
ucacaguuacuuuugcaucaacc

SEQ ID NO: 331037 - RNA, 20 nt, Homo sapiens
ucacauccucucccaacaug

SEQ ID NO: 331038 - RNA, 22 nt, Homo sapiens
ucacaucucagguuucuugaca

SEQ ID NO: 331039 - RNA, 22 nt, Homo sapiens
ucacauggaggugauaguugaa

SEQ ID NO: 331040 - RNA, 22 nt, Homo sapiens
ucacauggauuaacucauuuau

SEQ ID NO: 331041 - RNA, 22 nt, Homo sapiens
ucacaugucagccguggggaag

SEQ ID NO: 331042 - RNA, 22 nt, Homo sapiens
ucacauguguaugagcuuugau

SEQ ID NO: 331043 - RNA, 22 nt, Homo sapiens
ucacauuguuauguaaauguuu

SEQ ID NO: 331044 - RNA, 22 nt, Homo sapiens
ucaccaccugcugaucauagag

SEQ ID NO: 331045 - RNA, 22 nt, Homo sapiens
ucaccaccugcugauuguagag

SEQ ID NO: 331046 - RNA, 22 nt, Homo sapiens
ucaccggagguggguugaccag

SEQ ID NO: 331047 - RNA, 22 nt, Homo sapiens
ucaccuggagagcuugcuaaua

SEQ ID NO: 331048 - RNA, 18 nt, Homo sapiens
ucaccuugugagagagag

SEQ ID NO: 331049 - RNA, 22 nt, Homo sapiens
ucacuagaucaagggagagaaa

SEQ ID NO: 331050 - RNA, 22 nt, Homo sapiens
ucacuauagaaaacagugugga

SEQ ID NO: 331051 - RNA, 21 nt, Homo sapiens
ucacugagguuaaauaggguu

SEQ ID NO: 331052 - RNA, 22 nt, Homo sapiens
ucacuggacagaaauaaaggug

SEQ ID NO: 331053 - RNA, 22 nt, Homo sapiens
ucacuggcaaauauauccguug

SEQ ID NO: 331054 - RNA, 22 nt, Homo sapiens
ucacugggagaccaaagccauc

SEQ ID NO: 331055 - RNA, 22 nt, Homo sapiens
ucacugggagcauuugagccuu

SEQ ID NO: 331056 - RNA, 22 nt, Homo sapiens
ucacugugguuggaaggcuuaa

SEQ ID NO: 331057 - RNA, 18 nt, Homo sapiens
ucacugugugucuugggu

SEQ ID NO: 331058 - RNA, 22 nt, Homo sapiens
ucacuuggccgcagccuucucu

SEQ ID NO: 331059 - RNA, 22 nt, Homo sapiens
ucacuuuguuuuuggauaaguu

SEQ ID NO: 331060 - RNA, 22 nt, Homo sapiens
ucagacacugagcaaacgacua

SEQ ID NO: 331061 - RNA, 22 nt, Homo sapiens
ucagaccauuucauuacagacu

SEQ ID NO: 331062 - RNA, 22 nt, Homo sapiens
ucagaguagcugucugaggugc

SEQ ID NO: 331063 - RNA, 18 nt, Homo sapiens
ucagagugcagacuauac

SEQ ID NO: 331064 - RNA, 22 nt, Homo sapiens
ucagaguggccucucuugaaga

SEQ ID NO: 331065 - RNA, 22 nt, Homo sapiens
ucagaucuucagcaggggcccc

SEQ ID NO: 331066 - RNA, 22 nt, Homo sapiens
ucagaugauuccguugacgaga

SEQ ID NO: 331067 - RNA, 22 nt, Homo sapiens
ucagauguuucuuuaacgcaug

SEQ ID NO: 331068 - RNA, 22 nt, Homo sapiens
ucagauugaugcauacuuaaau

SEQ ID NO: 331069 - RNA, 22 nt, Homo sapiens
ucagcaccauguaacaauugau

SEQ ID NO: 331070 - RNA, 19 nt, Homo sapiens
ucagcaguaaucaacuuca

SEQ ID NO: 331071 - RNA, 22 nt, Homo sapiens
ucagcaguggacagaaugguag

SEQ ID NO: 331072 - RNA, 22 nt, Homo sapiens
ucagcagugugaaaauggacua

SEQ ID NO: 331073 - RNA, 21 nt, Homo sapiens
ucagcucaucacugccuggag

SEQ ID NO: 331074 - RNA, 22 nt, Homo sapiens
ucaggcaccuuccucuuaucug

SEQ ID NO: 331075 - RNA, 22 nt, Homo sapiens
ucaggcacuaguaagaaaaagg

SEQ ID NO: 331076 - RNA, 22 nt, Homo sapiens
ucagggacgcuugacacaagcc

SEQ ID NO: 331077 - RNA, 22 nt, Homo sapiens
ucaggguacuuguggccaaagu

SEQ ID NO: 331078 - RNA, 20 nt, Homo sapiens
ucagguagaucuuugagguc

SEQ ID NO: 331079 - RNA, 23 nt, Homo sapiens
ucagguaggccuagaguauucuu

SEQ ID NO: 331080 - RNA, 22 nt, Homo sapiens
ucaggugcaguggcucaugcuu

SEQ ID NO: 331081 - RNA, 22 nt, Homo sapiens
ucaggugccuuggcuaauuguu

SEQ ID NO: 331082 - RNA, 22 nt, Homo sapiens
ucaguaaauguuaggacauuuc

SEQ ID NO: 331083 - RNA, 22 nt, Homo sapiens
ucaguagcauugcuuauacagu

SEQ ID NO: 331084 - RNA, 23 nt, Homo sapiens
ucaguagucauugggaaagugug

SEQ ID NO: 331085 - RNA, 22 nt, Homo sapiens
ucaguccccucgcugagucuac

SEQ ID NO: 331086 - RNA, 22 nt, Homo sapiens
ucagugaauacauguacucaug

SEQ ID NO: 331087 - RNA, 22 nt, Homo sapiens
ucagugcaggaaucucuagcca

SEQ ID NO: 331088 - RNA, 22 nt, Homo sapiens
ucagugccucaguuuuuaaaga

SEQ ID NO: 331089 - RNA, 22 nt, Homo sapiens
ucagugcuguaccaucuaagga

SEQ ID NO: 331090 - RNA, 22 nt, Homo sapiens
ucaguggauuuaaccugaauca

SEQ ID NO: 331091 - RNA, 22 nt, Homo sapiens
ucagugguuaaaagauucuaga

SEQ ID NO: 331092 - RNA, 22 nt, Homo sapiens
ucagugucugcauucuuauugu

SEQ ID NO: 331093 - RNA, 21 nt, Homo sapiens
ucaguuacugagagagaagug

SEQ ID NO: 331094 - RNA, 22 nt, Homo sapiens
ucauacaguaguccucacuugu

SEQ ID NO: 331095 - RNA, 22 nt, Homo sapiens
ucauagaucaaguaauaagaca

SEQ ID NO: 331096 - RNA, 18 nt, Homo sapiens
ucauagaucaugacagug

SEQ ID NO: 331097 - RNA, 20 nt, Homo sapiens
ucauagggugguggcagugg

SEQ ID NO: 331098 - RNA, 22 nt, Homo sapiens
cuggagauuaaccaauugccau

SEQ ID NO: 331099 - RNA, 22 nt, Homo sapiens
cuggagcaaaggugacucuugu

SEQ ID NO: 331100 - RNA, 22 nt, Homo sapiens
cuggagucugacugacacaagg

SEQ ID NO: 331101 - RNA, 22 nt, Homo sapiens
cuggauagagauugaugaugcu

SEQ ID NO: 331102 - RNA, 20 nt, Homo sapiens
cuggaucaucaguaaaguua

SEQ ID NO: 331103 - RNA, 22 nt, Homo sapiens
cuggauguaaaugaaacuacag

SEQ ID NO: 331104 - RNA, 20 nt, Homo sapiens
cuggaugucgaggcagaggu

SEQ ID NO: 331105 - RNA, 22 nt, Homo sapiens
cuggcacccuugcuuaggaaga

SEQ ID NO: 331106 - RNA, 22 nt, Homo sapiens
cuggcaucuaaauacuugaugu

SEQ ID NO: 331107 - RNA, 22 nt, Homo sapiens
cuggccagagacauucauuaaa

SEQ ID NO: 331108 - RNA, 22 nt, Homo sapiens
cugggaugugacuguugccccc

SEQ ID NO: 331109 - RNA, 22 nt, Homo sapiens
cuggugagaugucuuuccucuu

SEQ ID NO: 331110 - RNA, 22 nt, Homo sapiens
cuggugugugacuuuucauuau

SEQ ID NO: 331111 - RNA, 22 nt, Homo sapiens
cugguuguucuggaugggcagg

SEQ ID NO: 331112 - RNA, 22 nt, Homo sapiens
cuguaaagaucacagagcuggu

SEQ ID NO: 331113 - RNA, 22 nt, Homo sapiens
cuguaacagaauaaauuuguuu

SEQ ID NO: 331114 - RNA, 22 nt, Homo sapiens
cuguacucaucccauaugcacu

SEQ ID NO: 331115 - RNA, 22 nt, Homo sapiens
cuguaguuagcagaugaugaau

SEQ ID NO: 331116 - RNA, 22 nt, Homo sapiens
cugucacuggggcacauguccc

SEQ ID NO: 331117 - RNA, 22 nt, Homo sapiens
cugucagugggaguucaggcuu

SEQ ID NO: 331118 - RNA, 22 nt, Homo sapiens
cuguccugcagagucagaauga

SEQ ID NO: 331119 - RNA, 22 nt, Homo sapiens
cugucuguuucaaaagugguua

SEQ ID NO: 331120 - RNA, 22 nt, Homo sapiens
cugugaacaugggagaaauggc

SEQ ID NO: 331121 - RNA, 22 nt, Homo sapiens
cugugaagaaagucauugguag

SEQ ID NO: 331122 - RNA, 22 nt, Homo sapiens
cugugauagguuagucaugaau

SEQ ID NO: 331123 - RNA, 17 nt, Homo sapiens
cugugaugaucuugucu

SEQ ID NO: 331124 - RNA, 22 nt, Homo sapiens
cugugcaaguuauaggccaggu

SEQ ID NO: 331125 - RNA, 22 nt, Homo sapiens
cugugcauaucuuggacugugu

SEQ ID NO: 331126 - RNA, 22 nt, Homo sapiens
cugugcauuggaugucucccug

SEQ ID NO: 331127 - RNA, 19 nt, Homo sapiens
cugugcauuucuguggaag

SEQ ID NO: 331128 - RNA, 22 nt, Homo sapiens
cugugcuugauuauaugagugu

SEQ ID NO: 331129 - RNA, 19 nt, Homo sapiens
cuguggucauuauuuugcu

SEQ ID NO: 331130 - RNA, 22 nt, Homo sapiens
cugugguguaacucuuggggcg

SEQ ID NO: 331131 - RNA, 22 nt, Homo sapiens
cugugguuacguucuuugugcu

SEQ ID NO: 331132 - RNA, 22 nt, Homo sapiens
cuguucaggaggcauuuggugg

SEQ ID NO: 331133 - RNA, 22 nt, Homo sapiens
cuguugguuaaauuccaugcag

SEQ ID NO: 331134 - RNA, 22 nt, Homo sapiens
cuuaacagugguauugaugacc

SEQ ID NO: 331135 - RNA, 18 nt, Homo sapiens
cuuaacauugggaugaua

SEQ ID NO: 331136 - RNA, 21 nt, Homo sapiens
cuuaagccacuaaguuuugga

SEQ ID NO: 331137 - RNA, 22 nt, Homo sapiens
cuuaaggccagauaauuucuau

SEQ ID NO: 331138 - RNA, 22 nt, Homo sapiens
cuuagcaaugucguguacucac

SEQ ID NO: 331139 - RNA, 22 nt, Homo sapiens
cuucaaguuggaagggaccuaa

SEQ ID NO: 331140 - RNA, 20 nt, Homo sapiens
cuucacagaaguggaaucau

SEQ ID NO: 331141 - RNA, 22 nt, Homo sapiens
cuucaccaguuuggcagucuca

SEQ ID NO: 331142 - RNA, 22 nt, Homo sapiens
cuucacuggagucccuggauuc

SEQ ID NO: 331143 - RNA, 22 nt, Homo sapiens
cuucaguucuguaaggacagca

SEQ ID NO: 331144 - RNA, 22 nt, Homo sapiens
cuucaucugguuugugaacuuu

SEQ ID NO: 331145 - RNA, 18 nt, Homo sapiens
cuucauugcuguuuugcu

SEQ ID NO: 331146 - RNA, 20 nt, Homo sapiens
cuuccaguggccccaucuuu

SEQ ID NO: 331147 - RNA, 22 nt, Homo sapiens
cuuccugaguccugggcucaca

SEQ ID NO: 331148 - RNA, 22 nt, Homo sapiens
cuucuguuaguucugauaacuu

SEQ ID NO: 331149 - RNA, 20 nt, Homo sapiens
cuugaagacuaugcugcuga

SEQ ID NO: 331150 - RNA, 22 nt, Homo sapiens
cuugacaaugcuucaggcugaa

SEQ ID NO: 331151 - RNA, 22 nt, Homo sapiens
cuugagcauauucuauauuaaa

SEQ ID NO: 331152 - RNA, 22 nt, Homo sapiens
cuugauagugguaaucauuuuu

SEQ ID NO: 331153 - RNA, 22 nt, Homo sapiens
cuugcacuugaaauuccaguuu

SEQ ID NO: 331154 - RNA, 22 nt, Homo sapiens
cuugcagaggcccuggggagag

SEQ ID NO: 331155 - RNA, 22 nt, Homo sapiens
cuugcauuuuggagaaugcuga

SEQ ID NO: 331156 - RNA, 19 nt, Homo sapiens
cuugccccauucauccucu

SEQ ID NO: 331157 - RNA, 22 nt, Homo sapiens
cuuggacaccucaugcccaccu

SEQ ID NO: 331158 - RNA, 22 nt, Homo sapiens
cuuggcauuguguugauagaag

SEQ ID NO: 331159 - RNA, 22 nt, Homo sapiens
cuuggcuagucaaaccuccccg

SEQ ID NO: 331160 - RNA, 22 nt, Homo sapiens
cuuggguaagucauuaaaauua

SEQ ID NO: 331161 - RNA, 18 nt, Homo sapiens
cuugucaaaucuuuccuc

SEQ ID NO: 331162 - RNA, 22 nt, Homo sapiens
cuugugcaugaccccagguggg

SEQ ID NO: 331163 - RNA, 22 nt, Homo sapiens
cuuuacacauccuaaccagugu

SEQ ID NO: 331164 - RNA, 22 nt, Homo sapiens
cuuuaguugucuccucaagggu

SEQ ID NO: 331165 - RNA, 22 nt, Homo sapiens
cuuucacacuguuggugggaau

SEQ ID NO: 331166 - RNA, 22 nt, Homo sapiens
cuuuccauuguuggagcauaaa

SEQ ID NO: 331167 - RNA, 22 nt, Homo sapiens
cuuugauuauaaaaggguguuu

SEQ ID NO: 331168 - RNA, 22 nt, Homo sapiens
cuuugcaaauggccuuuccaag

SEQ ID NO: 331169 - RNA, 21 nt, Homo sapiens
cuuugcacugcuccucagcuc

SEQ ID NO: 331170 - RNA, 22 nt, Homo sapiens
cuuugcuaauccaacccucauc

SEQ ID NO: 331171 - RNA, 22 nt, Homo sapiens
cuuuggagaaaaguucuugggc

SEQ ID NO: 331172 - RNA, 22 nt, Homo sapiens
cuuuggucaaaauaaguaaguu

SEQ ID NO: 331173 - RNA, 22 nt, Homo sapiens
cuuuggucaauugcugcgggga

SEQ ID NO: 331174 - RNA, 18 nt, Homo sapiens
cuuugguccccgcacccu

SEQ ID NO: 331175 - RNA, 22 nt, Homo sapiens
cuuuggugauagauaccccaua

SEQ ID NO: 331176 - RNA, 22 nt, Homo sapiens
cuuugguguauuuucagagacc

SEQ ID NO: 331177 - RNA, 23 nt, Homo sapiens
cuuuguccccacccaaaucucau

SEQ ID NO: 331178 - RNA, 20 nt, Homo sapiens
cuuuguccuccugcugugcu

SEQ ID NO: 331179 - RNA, 22 nt, Homo sapiens
cuuuguccuucaagguguguca

SEQ ID NO: 331180 - RNA, 22 nt, Homo sapiens
cuuuuacacuguuagugggaau

SEQ ID NO: 331181 - RNA, 23 nt, Homo sapiens
cuuuugcaaugugaucuugccac

SEQ ID NO: 331182 - RNA, 21 nt, Homo sapiens
cuuuugcacuccagccugggu

SEQ ID NO: 331183 - RNA, 22 nt, Homo sapiens
cuuuuggcuuagaauugucuug

SEQ ID NO: 331184 - RNA, 22 nt, Homo sapiens
cuuuuggugguucugaugcagg

SEQ ID NO: 331185 - RNA, 22 nt, Homo sapiens
cuuuugugauucuucaguuacu

SEQ ID NO: 331186 - RNA, 22 nt, Homo sapiens
cuuuugugauucuucaguugcu

SEQ ID NO: 331187 - RNA, 22 nt, Homo sapiens
cuuuuugguagagcaggugugc

SEQ ID NO: 331188 - RNA, 22 nt, Homo sapiens
gaaaacugcuucucuggguuuc

SEQ ID NO: 331189 - RNA, 22 nt, Homo sapiens
gaaaugcucagggguuuuccag

SEQ ID NO: 331190 - RNA, 22 nt, Homo sapiens
gaacacaucuuugguuagagga

SEQ ID NO: 331191 - RNA, 21 nt, Homo sapiens
ugucuagaccucauccuacag

SEQ ID NO: 331192 - RNA, 22 nt, Homo sapiens
ugucucaguuucuguggguuag

SEQ ID NO: 331193 - RNA, 22 nt, Homo sapiens
ugucucccuucccauuaggaag

SEQ ID NO: 331194 - RNA, 21 nt, Homo sapiens
ugucugagagaggagaucuac

SEQ ID NO: 331195 - RNA, 22 nt, Homo sapiens
ugucuggaaggguggccuccug

SEQ ID NO: 331196 - RNA, 22 nt, Homo sapiens
ugucuuagagauaaagaaugaa

SEQ ID NO: 331197 - RNA, 22 nt, Homo sapiens
ugucuuggacuugaaucucauu

SEQ ID NO: 331198 - RNA, 22 nt, Homo sapiens
uuuugcacauugauuugguauc

SEQ ID NO: 331199 - RNA, 22 nt, Homo sapiens
uuuugcaccauccuaauaguau

SEQ ID NO: 331200 - RNA, 22 nt, Homo sapiens
uuuugcucuucauagguccugu

SEQ ID NO: 331201 - RNA, 22 nt, Homo sapiens
uuuugcucuugguaaugaaaga

SEQ ID NO: 331202 - RNA, 18 nt, Homo sapiens
uuuugcuuaacugcgcca

SEQ ID NO: 331203 - RNA, 20 nt, Homo sapiens
uuuuggacuaaaggcauccc

SEQ ID NO: 331204 - RNA, 22 nt, Homo sapiens
uuuuggacuucaauuugacacu

SEQ ID NO: 331205 - RNA, 22 nt, Homo sapiens
uuuuggacuugcuccccugucc

SEQ ID NO: 331206 - RNA, 21 nt, Homo sapiens
uuuuggucauucaggaagaaa

SEQ ID NO: 331207 - RNA, 22 nt, Homo sapiens
uuuugguguauuguauaaggua

SEQ ID NO: 331208 - RNA, 22 nt, Homo sapiens
uuuugguuaggauggguggcau

SEQ ID NO: 331209 - RNA, 21 nt, Homo sapiens
uuuugugcaugugcagccugc

SEQ ID NO: 331210 - RNA, 22 nt, Homo sapiens
uuuuugagguauaguguggcua

SEQ ID NO: 331211 - RNA, 22 nt, Homo sapiens
uuuuuggauaaugguacaugua

SEQ ID NO: 331212 - RNA, 22 nt, Homo sapiens
uggcuuuucauccugggacauu

SEQ ID NO: 331213 - RNA, 22 nt, Homo sapiens
uggcuuuuccuugaaucugccu

SEQ ID NO: 331214 - RNA, 22 nt, Homo sapiens
ugggaaauguagccuagcugug

SEQ ID NO: 331215 - RNA, 22 nt, Homo sapiens
ugggaacaugaagguuaaagag

SEQ ID NO: 331216 - RNA, 18 nt, Homo sapiens
ugggaagaaauucuucuc

SEQ ID NO: 331217 - RNA, 22 nt, Homo sapiens
ugggaagcugcugaacuacagu

SEQ ID NO: 331218 - RNA, 22 nt, Homo sapiens
ugggagcauugcauuagaagcc

SEQ ID NO: 331219 - RNA, 22 nt, Homo sapiens
ugggagugugcacaauuucagc

SEQ ID NO: 331220 - RNA, 22 nt, Homo sapiens
ugggaugaugcuugagaauauc

SEQ ID NO: 331221 - RNA, 22 nt, Homo sapiens
ugggcaaauugugagggaggua

SEQ ID NO: 331222 - RNA, 22 nt, Homo sapiens
ugggcauggaguggccuuaugu

SEQ ID NO: 331223 - RNA, 22 nt, Homo sapiens
ugggguagaauagaauugauau

SEQ ID NO: 331224 - RNA, 22 nt, Homo sapiens
ugggguaggcuguauacucugu

SEQ ID NO: 331225 - RNA, 22 nt, Homo sapiens
uggguaaaucucuguucagggc

SEQ ID NO: 331226 - RNA, 23 nt, Homo sapiens
uggguucauucuugaagucagug

SEQ ID NO: 331227 - RNA, 23 nt, Homo sapiens
uggguucccuaagcgcaugcugc

SEQ ID NO: 331228 - RNA, 22 nt, Homo sapiens
ugguaaaaugucauuuaccaga

SEQ ID NO: 331229 - RNA, 22 nt, Homo sapiens
ugguaagaucugugagccaggc

SEQ ID NO: 331230 - RNA, 22 nt, Homo sapiens
ugguacuucaugcucacagaua

SEQ ID NO: 331231 - RNA, 17 nt, Homo sapiens
ugguagguuuuucuggc

SEQ ID NO: 331232 - RNA, 22 nt, Homo sapiens
ugguauguuuauaaguauagga

SEQ ID NO: 331233 - RNA, 20 nt, Homo sapiens
uggucaccuucaggagguuc

SEQ ID NO: 331234 - RNA, 22 nt, Homo sapiens
uggucaccuucuugcucugucu

SEQ ID NO: 331235 - RNA, 22 nt, Homo sapiens
uggucaguugaguccuugccaa

SEQ ID NO: 331236 - RNA, 22 nt, Homo sapiens
uggucaguugugccucaauucc

SEQ ID NO: 331237 - RNA, 22 nt, Homo sapiens
ugguccaguucugugauauugc

SEQ ID NO: 331238 - RNA, 22 nt, Homo sapiens
ugguccccaauacuucuauaga

SEQ ID NO: 331239 - RNA, 23 nt, Homo sapiens
uggucccguguucuggcuuuagg

SEQ ID NO: 331240 - RNA, 22 nt, Homo sapiens
ugguccucugcuuccagaauuc

SEQ ID NO: 331241 - RNA, 22 nt, Homo sapiens
uggucuccuuuguacccugggc

SEQ ID NO: 331242 - RNA, 22 nt, Homo sapiens
uggucucuuugcuuuagucauc

SEQ ID NO: 331243 - RNA, 22 nt, Homo sapiens
uggucuuuucaacaaaugguau

SEQ ID NO: 331244 - RNA, 22 nt, Homo sapiens
uggugagaaaugagaugcuuuu

SEQ ID NO: 331245 - RNA, 22 nt, Homo sapiens
uggugcaaauguaauugugguu

SEQ ID NO: 331246 - RNA, 22 nt, Homo sapiens
uggugcccuguccuucuguggc

SEQ ID NO: 331247 - RNA, 22 nt, Homo sapiens
uggugccgugguccuggggcca

SEQ ID NO: 331248 - RNA, 22 nt, Homo sapiens
ugguguccugucucugcgcuug

SEQ ID NO: 331249 - RNA, 22 nt, Homo sapiens
ugguuagucuguguguauauau

SEQ ID NO: 331250 - RNA, 22 nt, Homo sapiens
ugguuguuuuaaaugucgucug

SEQ ID NO: 331251 - RNA, 23 nt, Homo sapiens
ugguuuguaagagauggacugga

SEQ ID NO: 331252 - RNA, 23 nt, Homo sapiens
uguaaaagcauuugucagccugg

SEQ ID NO: 331253 - RNA, 22 nt, Homo sapiens
uguaaaccauauauguauguag

SEQ ID NO: 331254 - RNA, 22 nt, Homo sapiens
uguaaaucuuucacaguugaug

SEQ ID NO: 331255 - RNA, 22 nt, Homo sapiens
uguaacacacacuguuuacucc

SEQ ID NO: 331256 - RNA, 22 nt, Homo sapiens
uguaacaggaggaaaaugugaa

SEQ ID NO: 331257 - RNA, 20 nt, Homo sapiens
uguaaucuaaguuuuaagcc

SEQ ID NO: 331258 - RNA, 22 nt, Homo sapiens
uguacaaauuucugugguggug

SEQ ID NO: 331259 - RNA, 22 nt, Homo sapiens
uguacacauaugugggguacau

SEQ ID NO: 331260 - RNA, 22 nt, Homo sapiens
uguacuagaaauuaaggcaggg

SEQ ID NO: 331261 - RNA, 22 nt, Homo sapiens
uguagauaucuaucaggucaau

SEQ ID NO: 331262 - RNA, 22 nt, Homo sapiens
uguagauauucuuucaguuuuu

SEQ ID NO: 331263 - RNA, 22 nt, Homo sapiens
uguagcaaaucgauacuauugg

SEQ ID NO: 331264 - RNA, 21 nt, Homo sapiens
uguagcagcaugauuuauaau

SEQ ID NO: 331265 - RNA, 22 nt, Homo sapiens
uguagucauuugaaggaugucc

SEQ ID NO: 331266 - RNA, 22 nt, Homo sapiens
uguauaacucacauugaaguuu

SEQ ID NO: 331267 - RNA, 22 nt, Homo sapiens
uguaugucuucuuuagauaagu

SEQ ID NO: 331268 - RNA, 16 nt, Homo sapiens
uguauugcuaaaaaga

SEQ ID NO: 331269 - RNA, 20 nt, Homo sapiens
ugucaaggaauucccaaauc

SEQ ID NO: 331270 - RNA, 22 nt, Homo sapiens
ugucaauauguaauaacugaau

SEQ ID NO: 331271 - RNA, 22 nt, Homo sapiens
ugucacauccaagaaggugcag

SEQ ID NO: 331272 - RNA, 22 nt, Homo sapiens
ugucacccuuuauccauuuccu

SEQ ID NO: 331273 - RNA, 22 nt, Homo sapiens
ugucacguugcuuuucuguugu

SEQ ID NO: 331274 - RNA, 22 nt, Homo sapiens
ugucacugugaguuugacugcu

SEQ ID NO: 331275 - RNA, 18 nt, Homo sapiens
ugucagaguggauuguaa

SEQ ID NO: 331276 - RNA, 22 nt, Homo sapiens
ugucaggaggguccagagaaaa

SEQ ID NO: 331277 - RNA, 22 nt, Homo sapiens
ugucaggaugcuccuuuuggcu

SEQ ID NO: 331278 - RNA, 22 nt, Homo sapiens
ugucagggaggcucggccgcac

SEQ ID NO: 331279 - RNA, 22 nt, Homo sapiens
ugucaguggacugugaaaggca

SEQ ID NO: 331280 - RNA, 22 nt, Homo sapiens
ugucaguguacuguaagaauua

SEQ ID NO: 331281 - RNA, 21 nt, Homo sapiens
ugucaguuuccagaguucaac

SEQ ID NO: 331282 - RNA, 22 nt, Homo sapiens
ugucaguuucccuccucuuccu

SEQ ID NO: 331283 - RNA, 19 nt, Homo sapiens
ugucaucaucuuuucuugc

SEQ ID NO: 331284 - RNA, 22 nt, Homo sapiens
ugucaucauuugagagaagaaa

SEQ ID NO: 331285 - RNA, 22 nt, Homo sapiens
ugucaucuagguuuuaagccuu

SEQ ID NO: 331286 - RNA, 22 nt, Homo sapiens
ugucaugagucuccuccaucuu

SEQ ID NO: 331287 - RNA, 21 nt, Homo sapiens
ugucaugcagagacccuggag

SEQ ID NO: 331288 - RNA, 22 nt, Homo sapiens
ugucauggugcucugggcccug

SEQ ID NO: 331289 - RNA, 22 nt, Homo sapiens
ugucauguaaagaguaaauggu

SEQ ID NO: 331290 - RNA, 22 nt, Homo sapiens
ugucauguuucuacugaccaaa

SEQ ID NO: 331291 - RNA, 22 nt, Homo sapiens
ugucauuguggugcagauauaa

SEQ ID NO: 331292 - RNA, 22 nt, Homo sapiens
uguccaaauugaaucaucuggu

SEQ ID NO: 331293 - RNA, 21 nt, Homo sapiens
uguccagcuuuuggaauauaa

SEQ ID NO: 331294 - RNA, 18 nt, Homo sapiens
ugucccuuugcuguucau

SEQ ID NO: 331295 - RNA, 22 nt, Homo sapiens
uguccguuuuguuucaggcuca

SEQ ID NO: 331296 - RNA, 22 nt, Homo sapiens
uguccuagagggaugucacccc

SEQ ID NO: 331297 - RNA, 22 nt, Homo sapiens
uguccugaagcuuuguuaugua

SEQ ID NO: 331298 - RNA, 22 nt, Homo sapiens
uguccuggugaugcccaaauuc

SEQ ID NO: 331299 - RNA, 22 nt, Homo sapiens
ugucuaaagaauggcagacuca

SEQ ID NO: 331300 - RNA, 22 nt, Homo sapiens
ugucucaguucccuucucugga

SEQ ID NO: 331301 - RNA, 22 nt, Homo sapiens
ugucuguuugcgaaauugcuuc

SEQ ID NO: 331302 - RNA, 21 nt, Homo sapiens
ugucuuggagccagacgccag

SEQ ID NO: 331303 - RNA, 22 nt, Homo sapiens
ugucuuggaugaggauuaacag

SEQ ID NO: 331304 - RNA, 22 nt, Homo sapiens
uuguccuugagauaguuugcug

SEQ ID NO: 331305 - RNA, 22 nt, Homo sapiens
uugucuccuagacgaccaggcg

SEQ ID NO: 331306 - RNA, 22 nt, Homo sapiens
uugugaagaaaccagaaaaguu

SEQ ID NO: 331307 - RNA, 22 nt, Homo sapiens
uugugaauggaguagcaggauc

SEQ ID NO: 331308 - RNA, 22 nt, Homo sapiens
uugugaucauugucaaauagug

SEQ ID NO: 331309 - RNA, 22 nt, Homo sapiens
uugugcauguauauuaguucac

SEQ ID NO: 331310 - RNA, 22 nt, Homo sapiens
uugugcuccugugagaaucuag

SEQ ID NO: 331311 - RNA, 16 nt, Homo sapiens
uuguggcuuuugcaca

SEQ ID NO: 331312 - RNA, 22 nt, Homo sapiens
uugugguugacuaaauuuguaa

SEQ ID NO: 331313 - RNA, 22 nt, Homo sapiens
uugugucaaauggcaauuagca

SEQ ID NO: 331314 - RNA, 22 nt, Homo sapiens
uuggcaacauagugagaccccc

SEQ ID NO: 331315 - RNA, 22 nt, Homo sapiens
uuggcaauucagauucuuuuau

SEQ ID NO: 331316 - RNA, 22 nt, Homo sapiens
uuggcaauugcuaugauuugaa

SEQ ID NO: 331317 - RNA, 22 nt, Homo sapiens
uuggcagaaaaggucggggguu

SEQ ID NO: 331318 - RNA, 22 nt, Homo sapiens
uuggcagaauguuagaaacuua

SEQ ID NO: 331319 - RNA, 22 nt, Homo sapiens
uuggcagaguuaauuuguugag

SEQ ID NO: 331320 - RNA, 19 nt, Homo sapiens
uuggcagaguugcccccua

SEQ ID NO: 331321 - RNA, 22 nt, Homo sapiens
uuggcagcacgcaguccagagg

SEQ ID NO: 331322 - RNA, 22 nt, Homo sapiens
uuggcagcuguggaaucugggc

SEQ ID NO: 331323 - RNA, 22 nt, Homo sapiens
uuggcagugcccgaugcugggg

SEQ ID NO: 331324 - RNA, 23 nt, Homo sapiens
uuggcaucugggacacaagcuga

SEQ ID NO: 331325 - RNA, 22 nt, Homo sapiens
uuggcauugaguuucaaaucau

SEQ ID NO: 331326 - RNA, 20 nt, Homo sapiens
uuggcauuuagacaagaguu

SEQ ID NO: 331327 - RNA, 22 nt, Homo sapiens
uuggccauggagcacuuuucua

SEQ ID NO: 331328 - RNA, 22 nt, Homo sapiens
uuggccccuccaaaucucaugu

SEQ ID NO: 331329 - RNA, 19 nt, Homo sapiens
uuggcccugguucucuucu

SEQ ID NO: 331330 - RNA, 22 nt, Homo sapiens
uuggccuuucucuaaauacuuu

SEQ ID NO: 331331 - RNA, 22 nt, Homo sapiens
uuggcuguguuuauaugcugga

SEQ ID NO: 331332 - RNA, 22 nt, Homo sapiens
uuggcuucuggacuauugugca

SEQ ID NO: 331333 - RNA, 22 nt, Homo sapiens
uugggaaugcuaaaccucuauu

SEQ ID NO: 331334 - RNA, 22 nt, Homo sapiens
uugggacuggaaggaguaaggg

SEQ ID NO: 331335 - RNA, 22 nt, Homo sapiens
uugggauggaaauuuguacccc

SEQ ID NO: 331336 - RNA, 23 nt, Homo sapiens
uugggcaaaucacuaacgucucc

SEQ ID NO: 331337 - RNA, 22 nt, Homo sapiens
uuggguaguauagaagcaacaa

SEQ ID NO: 331338 - RNA, 22 nt, Homo sapiens
uuggucacugacauguuugaaa

SEQ ID NO: 331339 - RNA, 22 nt, Homo sapiens
uuggucaggcuaaucucgaacg

SEQ ID NO: 331340 - RNA, 22 nt, Homo sapiens
uuggucaggcuagaguguggug

SEQ ID NO: 331341 - RNA, 22 nt, Homo sapiens
uugguucucuuagccaucuuaa

SEQ ID NO: 331342 - RNA, 22 nt, Homo sapiens
uugguucucuuuauaugcugga

SEQ ID NO: 331343 - RNA, 22 nt, Homo sapiens
uuguaacaguuuauugacucga

SEQ ID NO: 331344 - RNA, 22 nt, Homo sapiens
uuguacuauuuuuaucagugau

SEQ ID NO: 331345 - RNA, 22 nt, Homo sapiens
uuguacuuuuaguagagacggg

SEQ ID NO: 331346 - RNA, 22 nt, Homo sapiens
uuguagaucuucaguugcuaca

SEQ ID NO: 331347 - RNA, 22 nt, Homo sapiens
uuguauguaaccauuuggcaaa

SEQ ID NO: 331348 - RNA, 22 nt, Homo sapiens
uuguauguuuguucuuucagau

SEQ ID NO: 331349 - RNA, 22 nt, Homo sapiens
uugucaaacucauucuccaucc

SEQ ID NO: 331350 - RNA, 22 nt, Homo sapiens
uugucaaugggugagugcagag

SEQ ID NO: 331351 - RNA, 22 nt, Homo sapiens
uugucacuauaaauaagcauuu

SEQ ID NO: 331352 - RNA, 22 nt, Homo sapiens
uugucauuuucagaguguuacg

SEQ ID NO: 331353 - RNA, 22 nt, Homo sapiens
uuguccaagucccauuuguuga

SEQ ID NO: 331354 - RNA, 22 nt, Homo sapiens
uuguccucuccaaaucucaugu

SEQ ID NO: 331355 - RNA, 22 nt, Homo sapiens
uuguccuugagauaguuugcag

SEQ ID NO: 331356 - RNA, 21 nt, Homo sapiens
uugucuagagaaauauaucuc

SEQ ID NO: 331357 - RNA, 22 nt, Homo sapiens
uugucuugcagcuuaggcauca

SEQ ID NO: 331358 - RNA, 22 nt, Homo sapiens
uugugaauggugccucaguaaa

SEQ ID NO: 331359 - RNA, 22 nt, Homo sapiens
uugugaauggugcugcaguaaa

SEQ ID NO: 331360 - RNA, 22 nt, Homo sapiens
uugugcaaaaguaauugcgguu

SEQ ID NO: 331361 - RNA, 22 nt, Homo sapiens
uugugcaugaugcauacauggu

SEQ ID NO: 331362 - RNA, 22 nt, Homo sapiens
uugugcuucaucaccuagcaga

SEQ ID NO: 331363 - RNA, 22 nt, Homo sapiens
uugugcuuguaacuacauucag

SEQ ID NO: 331364 - RNA, 22 nt, Homo sapiens
uugugcuuuacuuacuaccaga

SEQ ID NO: 331365 - RNA, 22 nt, Homo sapiens
uugugcuuuugagcugagauga

SEQ ID NO: 331366 - RNA, 22 nt, Homo sapiens
uugugguaggaguugccauguu

SEQ ID NO: 331367 - RNA, 22 nt, Homo sapiens
uugugguagugaaugagucuca

SEQ ID NO: 331368 - RNA, 22 nt, Homo sapiens
uugugguugauacacguaggaa

SEQ ID NO: 331369 - RNA, 22 nt, Homo sapiens
uugugguugaugaagacugucu

SEQ ID NO: 331370 - RNA, 22 nt, Homo sapiens
uugugguuuuaucuaccuuugg

SEQ ID NO: 331371 - RNA, 22 nt, Homo sapiens
uugugguuuucagcuuauauau

SEQ ID NO: 331372 - RNA, 22 nt, Homo sapiens
uugugguuuuuaaaacuaggug

SEQ ID NO: 331373 - RNA, 22 nt, Homo sapiens
uuguguaguaccucucacauug

SEQ ID NO: 331374 - RNA, 19 nt, Homo sapiens
uuguguccccacaaaauuc

SEQ ID NO: 331375 - RNA, 22 nt, Homo sapiens
uuguguccccacccaaaucuca

SEQ ID NO: 331376 - RNA, 22 nt, Homo sapiens
uugugucccuacccaaaucuca

SEQ ID NO: 331377 - RNA, 22 nt, Homo sapiens
uuguuauguaucucaagauaaa

SEQ ID NO: 331378 - RNA, 22 nt, Homo sapiens
uuguuauguuggucaguaaugu

SEQ ID NO: 331379 - RNA, 23 nt, Homo sapiens
uuguucccuuccacucagucucc

SEQ ID NO: 331380 - RNA, 22 nt, Homo sapiens
uuguugcacugcuuuccuggcc

SEQ ID NO: 331381 - RNA, 22 nt, Homo sapiens
uuuaaagcaugacgagaagaag

SEQ ID NO: 331382 - RNA, 22 nt, Homo sapiens
uuuaacauuggaugagaucguc

SEQ ID NO: 331383 - RNA, 20 nt, Homo sapiens
uuuaagacaugcugaauuga

SEQ ID NO: 331384 - RNA, 22 nt, Homo sapiens
uuuacagucuuuugugugaguc

SEQ ID NO: 331385 - RNA, 22 nt, Homo sapiens
uuuauagucaggaacuugagga

SEQ ID NO: 331386 - RNA, 22 nt, Homo sapiens
uuuauugcucuaaaguugccau

SEQ ID NO: 331387 - RNA, 22 nt, Homo sapiens
uuucaagugcugucuuagcugu

SEQ ID NO: 331388 - RNA, 19 nt, Homo sapiens
uuucacacucgccuacuuc

SEQ ID NO: 331389 - RNA, 22 nt, Homo sapiens
uuucacagcugucuuccgucuc

SEQ ID NO: 331390 - RNA, 23 nt, Homo sapiens
uuucacaguagcuggaucagccu

SEQ ID NO: 331391 - RNA, 21 nt, Homo sapiens
uuucacugugaguuuuucugu

SEQ ID NO: 331392 - RNA, 20 nt, Homo sapiens
uuucaguacuuucuacuggc

SEQ ID NO: 331393 - RNA, 22 nt, Homo sapiens
uuucaguagagacacgguuuug

SEQ ID NO: 331394 - RNA, 22 nt, Homo sapiens
uuucauggagaaucuucuuacu

SEQ ID NO: 331395 - RNA, 22 nt, Homo sapiens
uuucauggaggauuugcuucuu

SEQ ID NO: 331396 - RNA, 22 nt, Homo sapiens
uuucauggaggcauuuuagauu

SEQ ID NO: 331397 - RNA, 18 nt, Homo sapiens
uuucauugagugugauau

SEQ ID NO: 331398 - RNA, 22 nt, Homo sapiens
uuuccaguuggaaagccuguuu

SEQ ID NO: 331399 - RNA, 22 nt, Homo sapiens
uuuccauguuggugaaaugagg

SEQ ID NO: 331400 - RNA, 22 nt, Homo sapiens
uuucccugaaggcucugaaguc

SEQ ID NO: 331401 - RNA, 22 nt, Homo sapiens
uuucccuuugcuuugucagcca

SEQ ID NO: 331402 - RNA, 22 nt, Homo sapiens
uuuccuguagggggcaaggccu

SEQ ID NO: 331403 - RNA, 22 nt, Homo sapiens
uuucgugucuggucugugaugg

SEQ ID NO: 331404 - RNA, 22 nt, Homo sapiens
uuucugugguccucuugaaggu

SEQ ID NO: 331405 - RNA, 23 nt, Homo sapiens
uuucuugggcaugcuaugucagu

SEQ ID NO: 331406 - RNA, 22 nt, Homo sapiens
uuucuugguuguauuuagacuu

SEQ ID NO: 331407 - RNA, 22 nt, Homo sapiens
gcuguauuguugaaggaaaugu

SEQ ID NO: 331408 - RNA, 22 nt, Homo sapiens
gcuguguguuaucagaaauugc

SEQ ID NO: 331409 - RNA, 16 nt, Homo sapiens
gcuguuguuuuguccu

SEQ ID NO: 331410 - RNA, 22 nt, Homo sapiens
gcuucauggaggcugggcgcag

SEQ ID NO: 331411 - RNA, 19 nt, Homo sapiens
gcuucuugaggacgaugac

SEQ ID NO: 331412 - RNA, 22 nt, Homo sapiens
gcuuuggcauguagauguaugg

SEQ ID NO: 331413 - RNA, 22 nt, Homo sapiens
gcuuuguuaaaacacagccaca

SEQ ID NO: 331414 - RNA, 22 nt, Homo sapiens
gcuuuuggaggaacuuaagauu

SEQ ID NO: 331415 - RNA, 23 nt, Homo sapiens
ggaaacauccagucuuucaccau

SEQ ID NO: 331416 - RNA, 22 nt, Homo sapiens
ggaaagacaccuuacuauguua

SEQ ID NO: 331417 - RNA, 22 nt, Homo sapiens
ggaaagacuauuguaaaggaug

SEQ ID NO: 331418 - RNA, 22 nt, Homo sapiens
ggaaaguaacccauucucuuac

SEQ ID NO: 331419 - RNA, 19 nt, Homo sapiens
ggaaaugucuauuaagauc

SEQ ID NO: 331420 - RNA, 22 nt, Homo sapiens
ggaagagugaauuaucuugacu

SEQ ID NO: 331421 - RNA, 18 nt, Homo sapiens
ggaagauuggcuaugugc

SEQ ID NO: 331422 - RNA, 18 nt, Homo sapiens
ggaagccuauuuaguaac

SEQ ID NO: 331423 - RNA, 22 nt, Homo sapiens
ggaagccugcacucgggcaggg

SEQ ID NO: 331424 - RNA, 22 nt, Homo sapiens
ggaagccuggaaaaaauuguga

SEQ ID NO: 331425 - RNA, 22 nt, Homo sapiens
ggaagguaauuggcuaaugaga

SEQ ID NO: 331426 - RNA, 22 nt, Homo sapiens
ggaaggucaaagggaaagcaga

SEQ ID NO: 331427 - RNA, 22 nt, Homo sapiens
ggaagugcuguguggaagucug

SEQ ID NO: 331428 - RNA, 22 nt, Homo sapiens
ggaauauaaaaagccccagaau

SEQ ID NO: 331429 - RNA, 22 nt, Homo sapiens
ggaaucugaaccaugggaaugg

SEQ ID NO: 331430 - RNA, 23 nt, Homo sapiens
ggaaugaaaccugguuaugauau

SEQ ID NO: 331431 - RNA, 17 nt, Homo sapiens
ggaaugaauuccagccc

SEQ ID NO: 331432 - RNA, 22 nt, Homo sapiens
ggaaugagaaauauuacacaau

SEQ ID NO: 331433 - RNA, 19 nt, Homo sapiens
ggaaugcaccaguccuugc

SEQ ID NO: 331434 - RNA, 22 nt, Homo sapiens
ggaaugcagugagcauuagaua

SEQ ID NO: 331435 - RNA, 22 nt, Homo sapiens
ggaauggaacaaagucuugaaa

SEQ ID NO: 331436 - RNA, 22 nt, Homo sapiens
ggaaugggauuugaagucuggc

SEQ ID NO: 331437 - RNA, 22 nt, Homo sapiens
ggagaugaaaugagcuacuuaa

SEQ ID NO: 331438 - RNA, 22 nt, Homo sapiens
ggagaugugccugcucugcucu

SEQ ID NO: 331439 - RNA, 22 nt, Homo sapiens
ggagcaaugccucauucucacu

SEQ ID NO: 331440 - RNA, 22 nt, Homo sapiens
ggaggcuaguaaaaagguagaa

SEQ ID NO: 331441 - RNA, 22 nt, Homo sapiens
ggagguagucuuucccuuauca

SEQ ID NO: 331442 - RNA, 22 nt, Homo sapiens
ggaguaggcuguccggcaccca

SEQ ID NO: 331443 - RNA, 22 nt, Homo sapiens
ggagucugauuuuuauguugcu

SEQ ID NO: 331444 - RNA, 22 nt, Homo sapiens
ggagugcuguuguuacacaagg

SEQ ID NO: 331445 - RNA, 22 nt, Homo sapiens
ggagugucagaaacaguguccu

SEQ ID NO: 331446 - RNA, 22 nt, Homo sapiens
ggagugucccaaucucagcuca

SEQ ID NO: 331447 - RNA, 22 nt, Homo sapiens
ggagugucugugcuggucaaag

SEQ ID NO: 331448 - RNA, 22 nt, Homo sapiens
ggagugugauuguucucuguua

SEQ ID NO: 331449 - RNA, 22 nt, Homo sapiens
gaggucuuacauuuuaauauuu

SEQ ID NO: 331450 - RNA, 22 nt, Homo sapiens
gaggugaaggucucaauaaaua

SEQ ID NO: 331451 - RNA, 22 nt, Homo sapiens
gagguguaaggacaacagagac

SEQ ID NO: 331452 - RNA, 22 nt, Homo sapiens
gagguguagucaugccaagauc

SEQ ID NO: 331453 - RNA, 22 nt, Homo sapiens
gaguaaaugucaaguacuuagg

SEQ ID NO: 331454 - RNA, 22 nt, Homo sapiens
gaguaaauguccuagcuucuug

SEQ ID NO: 331455 - RNA, 22 nt, Homo sapiens
gaguauuuuacaucguguaauu

SEQ ID NO: 331456 - RNA, 22 nt, Homo sapiens
gagugcaagguuuuucugagug

SEQ ID NO: 331457 - RNA, 23 nt, Homo sapiens
gagugcaaugacaugaucucgga

SEQ ID NO: 331458 - RNA, 22 nt, Homo sapiens
gagugcaucguggccauuuuaa

SEQ ID NO: 331459 - RNA, 22 nt, Homo sapiens
gagugcuguuagcccuggguuu

SEQ ID NO: 331460 - RNA, 23 nt, Homo sapiens
gaguggagacucauugauuuccu

SEQ ID NO: 331461 - RNA, 22 nt, Homo sapiens
gagugguucuauauguaauugg

SEQ ID NO: 331462 - RNA, 22 nt, Homo sapiens
gaguuacauuguaauugccgag

SEQ ID NO: 331463 - RNA, 22 nt, Homo sapiens
gaguuagguugucaaugucuua

SEQ ID NO: 331464 - RNA, 22 nt, Homo sapiens
gaguucaauuuccagcuguucu

SEQ ID NO: 331465 - RNA, 22 nt, Homo sapiens
gaguucauuuugaaaccuugau

SEQ ID NO: 331466 - RNA, 22 nt, Homo sapiens
gaguuuguaaacuauucacuaa

SEQ ID NO: 331467 - RNA, 22 nt, Homo sapiens
gauaaaucuuggcuagucuaag

SEQ ID NO: 331468 - RNA, 22 nt, Homo sapiens
gauacaccauuuucuagcuauu

SEQ ID NO: 331469 - RNA, 22 nt, Homo sapiens
gauacuggcuuuauagaaugau

SEQ ID NO: 331470 - RNA, 22 nt, Homo sapiens
gauagugaaccaagggguaauu

SEQ ID NO: 331471 - RNA, 22 nt, Homo sapiens
gauauguacagcucucuaggau

SEQ ID NO: 331472 - RNA, 22 nt, Homo sapiens
gauauguuagggggagaaguua

SEQ ID NO: 331473 - RNA, 22 nt, Homo sapiens
gaucaauuggcugaagacacgu

SEQ ID NO: 331474 - RNA, 22 nt, Homo sapiens
gaugacacugggucaaaucuca

SEQ ID NO: 331475 - RNA, 22 nt, Homo sapiens
gaugaucaugaccuacagaugg

SEQ ID NO: 331476 - RNA, 22 nt, Homo sapiens
gaugaugcuagguguuagggcu

SEQ ID NO: 331477 - RNA, 22 nt, Homo sapiens
gaugcaaauuaagcuugggaca

SEQ ID NO: 331478 - RNA, 22 nt, Homo sapiens
gaugcaguaagaaugcauagcg

SEQ ID NO: 331479 - RNA, 22 nt, Homo sapiens
gauggauuuuaagugaaugaaa

SEQ ID NO: 331480 - RNA, 22 nt, Homo sapiens
gauggcacuuaagagcaagagc

SEQ ID NO: 331481 - RNA, 22 nt, Homo sapiens
gauggcauuucuggaucugccc

SEQ ID NO: 331482 - RNA, 22 nt, Homo sapiens
gauggcucugcaggugagggua

SEQ ID NO: 331483 - RNA, 22 nt, Homo sapiens
gauguuguuuagccuuugaugu

SEQ ID NO: 331484 - RNA, 22 nt, Homo sapiens
gauuccacuuucugucucuaug

SEQ ID NO: 331485 - RNA, 22 nt, Homo sapiens
gauugcaauuuaggugagagag

SEQ ID NO: 331486 - RNA, 21 nt, Homo sapiens
gcaaaggaauugccuaagcuu

SEQ ID NO: 331487 - RNA, 21 nt, Homo sapiens
gcaaaguggcuaccuugcucc

SEQ ID NO: 331488 - RNA, 22 nt, Homo sapiens
gcaagaaucugggaguaaaauu

SEQ ID NO: 331489 - RNA, 22 nt, Homo sapiens
gcaauacugacagcauuaguuu

SEQ ID NO: 331490 - RNA, 22 nt, Homo sapiens
gcaauggaaucccuugaucaau

SEQ ID NO: 331491 - RNA, 22 nt, Homo sapiens
gcaauguuacugaauguguuuu

SEQ ID NO: 331492 - RNA, 22 nt, Homo sapiens
gcacaguguuacuugauauauu

SEQ ID NO: 331493 - RNA, 22 nt, Homo sapiens
gcacauggccacuaggaauaaa

SEQ ID NO: 331494 - RNA, 22 nt, Homo sapiens
gcacccugucaaaauggaccaa

SEQ ID NO: 331495 - RNA, 22 nt, Homo sapiens
aauggcagaugaaauugucauu

SEQ ID NO: 331496 - RNA, 22 nt, Homo sapiens
aauggcaucuacguuaaauguc

SEQ ID NO: 331497 - RNA, 20 nt, Homo sapiens
aauggcauguuggacaacug

SEQ ID NO: 331498 - RNA, 22 nt, Homo sapiens
aauggcauugguccuuuuggau

SEQ ID NO: 331499 - RNA, 22 nt, Homo sapiens
aauggcauuugccagggcaaag

SEQ ID NO: 331500 - RNA, 22 nt, Homo sapiens
aauggccuuuuucauuauacug

SEQ ID NO: 331501 - RNA, 22 nt, Homo sapiens
aauggcuuuuaauauccauaau

SEQ ID NO: 331502 - RNA, 22 nt, Homo sapiens
aaugguguuuccguuaagcuga

SEQ ID NO: 331503 - RNA, 22 nt, Homo sapiens
aaugugcacuauuagggugaua

SEQ ID NO: 331504 - RNA, 22 nt, Homo sapiens
aauguguuuugaaaucaggaag

SEQ ID NO: 331505 - RNA, 22 nt, Homo sapiens
aauuaguaaccuaauuccaucu

SEQ ID NO: 331506 - RNA, 22 nt, Homo sapiens
aauuaguugucgugagaguggu

SEQ ID NO: 331507 - RNA, 22 nt, Homo sapiens
aauucacuucuuuuaggcaggg

SEQ ID NO: 331508 - RNA, 22 nt, Homo sapiens
aauugaaucaugugggcagacu

SEQ ID NO: 331509 - RNA, 22 nt, Homo sapiens
aauugcauaugcaguagaucua

SEQ ID NO: 331510 - RNA, 22 nt, Homo sapiens
aauuguacucccauaauucccu

SEQ ID NO: 331511 - RNA, 22 nt, Homo sapiens
aauuguacucccaucauuccua

SEQ ID NO: 331512 - RNA, 22 nt, Homo sapiens
aauuugucaccucucucccuuu

SEQ ID NO: 331513 - RNA, 21 nt, Homo sapiens
acaaagcuggagggagacugc

SEQ ID NO: 331514 - RNA, 16 nt, Homo sapiens
acaaagcuggcuaucu

SEQ ID NO: 331515 - RNA, 22 nt, Homo sapiens
acaaaguaggcagugggcugga

SEQ ID NO: 331516 - RNA, 22 nt, Homo sapiens
acaacaguuuuaucaccccaga

SEQ ID NO: 331517 - RNA, 22 nt, Homo sapiens
acaagcacaaaugcauagaugg

SEQ ID NO: 331518 - RNA, 22 nt, Homo sapiens
acaagugcuuuuccuggagaca

SEQ ID NO: 331519 - RNA, 22 nt, Homo sapiens
acacaaugguaaguguuugugu

SEQ ID NO: 331520 - RNA, 22 nt, Homo sapiens
acacaguaagcacaguguagau

SEQ ID NO: 331521 - RNA, 22 nt, Homo sapiens
acaccaguacuuuauacaagca

SEQ ID NO: 331522 - RNA, 22 nt, Homo sapiens
acacgugcguauauguacguau

SEQ ID NO: 331523 - RNA, 22 nt, Homo sapiens
acacuauugagguuuguuugca

SEQ ID NO: 331524 - RNA, 22 nt, Homo sapiens
acacuguacuuauguuuugcag

SEQ ID NO: 331525 - RNA, 22 nt, Homo sapiens
acacuguagcugagggcaugcg

SEQ ID NO: 331526 - RNA, 22 nt, Homo sapiens
acacugucucuugcugaccaug

SEQ ID NO: 331527 - RNA, 22 nt, Homo sapiens
acacuugcuugcaauagccucc

SEQ ID NO: 331528 - RNA, 22 nt, Homo sapiens
acacuuucuggagcugcacaua

SEQ ID NO: 331529 - RNA, 22 nt, Homo sapiens
acagauagcacuaagggaucug

SEQ ID NO: 331530 - RNA, 22 nt, Homo sapiens
acagauugcugggccccagccc

SEQ ID NO: 331531 - RNA, 22 nt, Homo sapiens
acagguacaagggauuaggaug

SEQ ID NO: 331532 - RNA, 22 nt, Homo sapiens
acaguacaugauaaauaaggua

SEQ ID NO: 331533 - RNA, 22 nt, Homo sapiens
acaguauaaugcuguagggaga

SEQ ID NO: 331534 - RNA, 22 nt, Homo sapiens
acaguaugcuuuaaacuuuguu

SEQ ID NO: 331535 - RNA, 23 nt, Homo sapiens
acaguauguggauguggcuaagu

SEQ ID NO: 331536 - RNA, 22 nt, Homo sapiens
acagucacaauuuguaccuuuu

SEQ ID NO: 331537 - RNA, 22 nt, Homo sapiens
acagugacagaaagcugauuau

SEQ ID NO: 331538 - RNA, 18 nt, Homo sapiens
acagugcugucacugcuu

SEQ ID NO: 331539 - RNA, 22 nt, Homo sapiens
acaguggaauguaggguuugag

SEQ ID NO: 331540 - RNA, 22 nt, Homo sapiens
acaguguagugacugccaacuu

SEQ ID NO: 331541 - RNA, 18 nt, Homo sapiens
acagugucauggcucaau

SEQ ID NO: 331542 - RNA, 18 nt, Homo sapiens
acaguguguaaggguucu

SEQ ID NO: 331543 - RNA, 22 nt, Homo sapiens
acaguguguguguucaccuaga

SEQ ID NO: 331544 - RNA, 22 nt, Homo sapiens
acauaaagaagcaggacauugu

SEQ ID NO: 331545 - RNA, 22 nt, Homo sapiens
acauacacuagggauguggugu

SEQ ID NO: 331546 - RNA, 22 nt, Homo sapiens
acauagaguagcuaccuguaga

SEQ ID NO: 331547 - RNA, 22 nt, Homo sapiens
acaucacuguuugauugauuga

SEQ ID NO: 331548 - RNA, 21 nt, Homo sapiens
acaucagaguugugaagguag

SEQ ID NO: 331549 - RNA, 18 nt, Homo sapiens
acaucccaugcuggggug

SEQ ID NO: 331550 - RNA, 22 nt, Homo sapiens
acaucccuuucccacccuucac

SEQ ID NO: 331551 - RNA, 22 nt, Homo sapiens
acaugacauugggguggggaua

SEQ ID NO: 331552 - RNA, 17 nt, Homo sapiens
acaugagacuggauucu

SEQ ID NO: 331553 - RNA, 22 nt, Homo sapiens
acaugagacuggguuuguaggg

SEQ ID NO: 331554 - RNA, 22 nt, Homo sapiens
acaugcauccaugugaagagac

SEQ ID NO: 331555 - RNA, 22 nt, Homo sapiens
acauguaauugauuuuguguua

SEQ ID NO: 331556 - RNA, 22 nt, Homo sapiens
acauugcagauguguuuaaugu

SEQ ID NO: 331557 - RNA, 22 nt, Homo sapiens
acauugcauauggcacccucuu

SEQ ID NO: 331558 - RNA, 22 nt, Homo sapiens
accaugcaguccaauaugcaca

SEQ ID NO: 331559 - RNA, 22 nt, Homo sapiens
accauugcacuccagccugggc

SEQ ID NO: 331560 - RNA, 22 nt, Homo sapiens
acccagaagucauucaggaaca

SEQ ID NO: 331561 - RNA, 22 nt, Homo sapiens
acccagaguuccuugucuuuca

SEQ ID NO: 331562 - RNA, 22 nt, Homo sapiens
acccaguagccagauguagcug

SEQ ID NO: 331563 - RNA, 17 nt, Homo sapiens
accccuaccucagaagc

SEQ ID NO: 331564 - RNA, 22 nt, Homo sapiens
acccuggagagugcuguaguaa

SEQ ID NO: 331565 - RNA, 22 nt, Homo sapiens
acccuguugagcaacuggccau

SEQ ID NO: 331566 - RNA, 22 nt, Homo sapiens
acccuguugguggaucagauug

SEQ ID NO: 331567 - RNA, 22 nt, Homo sapiens
acccuguugucagaauguggau

SEQ ID NO: 331568 - RNA, 22 nt, Homo sapiens
acccuuugucaaucaguacuaa

SEQ ID NO: 331569 - RNA, 16 nt, Homo sapiens
accuguacagcaugug

SEQ ID NO: 331570 - RNA, 18 nt, Homo sapiens
accuucauuccuuugccu

SEQ ID NO: 331571 - RNA, 22 nt, Homo sapiens
accuugcacugagccgagauug

SEQ ID NO: 331572 - RNA, 22 nt, Homo sapiens
accuuguagcaaaccuaacaua

SEQ ID NO: 331573 - RNA, 20 nt, Homo sapiens
acuaaaucucauuuuaugca

SEQ ID NO: 331574 - RNA, 22 nt, Homo sapiens
acuacugucagacugccacuga

SEQ ID NO: 331575 - RNA, 22 nt, Homo sapiens
acuacuucuaaguuuuggaaga

SEQ ID NO: 331576 - RNA, 22 nt, Homo sapiens
acuaugagacgaaugcaucagu

SEQ ID NO: 331577 - RNA, 22 nt, Homo sapiens
acucacagcaaccuccgccucc

SEQ ID NO: 331578 - RNA, 22 nt, Homo sapiens
acucauugcucauaccuuaucu

SEQ ID NO: 331579 - RNA, 22 nt, Homo sapiens
acucuguauaaacauugcugua

SEQ ID NO: 331580 - RNA, 18 nt, Homo sapiens
acucuguauguggagugg

SEQ ID NO: 331581 - RNA, 22 nt, Homo sapiens
acucuguugucuggccuuccug

SEQ ID NO: 331582 - RNA, 22 nt, Homo sapiens
acugaaucaucagguguguuug

SEQ ID NO: 331583 - RNA, 22 nt, Homo sapiens
acugaauguaaacacggagugu

SEQ ID NO: 331584 - RNA, 21 nt, Homo sapiens
acugagagaucuggggcacau

SEQ ID NO: 331585 - RNA, 21 nt, Homo sapiens
acugauguuugaaauucgcug

SEQ ID NO: 331586 - RNA, 22 nt, Homo sapiens
acugcaaugucgaauagagaug

SEQ ID NO: 331587 - RNA, 22 nt, Homo sapiens
acugcacuccaccuugggcaac

SEQ ID NO: 331588 - RNA, 22 nt, Homo sapiens
acugcacuccagcccgggugac

SEQ ID NO: 331589 - RNA, 23 nt, Homo sapiens
ggcacggaauucaaagaggcauu

SEQ ID NO: 331590 - RNA, 22 nt, Homo sapiens
ggcacgguggcucacgccugua

SEQ ID NO: 331591 - RNA, 19 nt, Homo sapiens
ggcacugugugagugagga

SEQ ID NO: 331592 - RNA, 22 nt, Homo sapiens
ggcagacuguggaguucuuucu

SEQ ID NO: 331593 - RNA, 22 nt, Homo sapiens
ggcagcacaauuuucugaugga

SEQ ID NO: 331594 - RNA, 22 nt, Homo sapiens
ggcaguguuauuauauuuuugg

SEQ ID NO: 331595 - RNA, 22 nt, Homo sapiens
ggcaguuuguucuugcuccuuu

SEQ ID NO: 331596 - RNA, 21 nt, Homo sapiens
ggcaugaauggaaaagugaga

SEQ ID NO: 331597 - RNA, 22 nt, Homo sapiens
ggcauguaauuauucaaagugg

SEQ ID NO: 331598 - RNA, 22 nt, Homo sapiens
ggccugaugaaauguuagagua

SEQ ID NO: 331599 - RNA, 22 nt, Homo sapiens
ggccuguaggguauugguaggg

SEQ ID NO: 331600 - RNA, 22 nt, Homo sapiens
ggcuacauuguuacaauuagua

SEQ ID NO: 331601 - RNA, 22 nt, Homo sapiens
ggcuagaauagggauagaccuu

SEQ ID NO: 331602 - RNA, 22 nt, Homo sapiens
ggcuauagauaugugaacacuu

SEQ ID NO: 331603 - RNA, 19 nt, Homo sapiens
ggcucagucaacugacugu

SEQ ID NO: 331604 - RNA, 22 nt, Homo sapiens
ggcucaguugcaaaucaguuca

SEQ ID NO: 331605 - RNA, 22 nt, Homo sapiens
ggcugguuuucaguuacugagu

SEQ ID NO: 331606 - RNA, 22 nt, Homo sapiens
gggaacaugagaaugugaauga

SEQ ID NO: 331607 - RNA, 22 nt, Homo sapiens
gggaagugugcagaguucucuu

SEQ ID NO: 331608 - RNA, 20 nt, Homo sapiens
gggaaugcaaauucucaucc

SEQ ID NO: 331609 - RNA, 22 nt, Homo sapiens
gggagcaaaaaugaugcccaag

SEQ ID NO: 331610 - RNA, 19 nt, Homo sapiens
gggaggaugcgucuucagg

SEQ ID NO: 331611 - RNA, 22 nt, Homo sapiens
gggagguuguauguaugcgggg

SEQ ID NO: 331612 - RNA, 22 nt, Homo sapiens
gggagugugcacacaugguaua

SEQ ID NO: 331613 - RNA, 22 nt, Homo sapiens
gggaugaaguugauguagaaag

SEQ ID NO: 331614 - RNA, 22 nt, Homo sapiens
gggauguaaaagugggcacauu

SEQ ID NO: 331615 - RNA, 22 nt, Homo sapiens
gggauguuuuauacugagccug

SEQ ID NO: 331616 - RNA, 22 nt, Homo sapiens
gggauuauugugauuucauguu

SEQ ID NO: 331617 - RNA, 22 nt, Homo sapiens
gggauuguaauacugaguuggu

SEQ ID NO: 331618 - RNA, 22 nt, Homo sapiens
gggcaaaacuguacugccaagg

SEQ ID NO: 331619 - RNA, 21 nt, Homo sapiens
gggcaaaucuuuauccuaagc

SEQ ID NO: 331620 - RNA, 22 nt, Homo sapiens
gggcaaauuauguaucucucag

SEQ ID NO: 331621 - RNA, 22 nt, Homo sapiens
gggcauugugggcagagggcag

SEQ ID NO: 331622 - RNA, 22 nt, Homo sapiens
gggccagaugcauuuguuauuu

SEQ ID NO: 331623 - RNA, 22 nt, Homo sapiens
ggggaguguggacaucacccug

SEQ ID NO: 331624 - RNA, 22 nt, Homo sapiens
ggguaggcaagcggaugucaga

SEQ ID NO: 331625 - RNA, 17 nt, Homo sapiens
gggucaccuugcaggua

SEQ ID NO: 331626 - RNA, 22 nt, Homo sapiens
gguaaaucuucacuaagacuga

SEQ ID NO: 331627 - RNA, 22 nt, Homo sapiens
ggucaacaucaucaugguaagu

SEQ ID NO: 331628 - RNA, 22 nt, Homo sapiens
ggucauagagaauucaccagga

SEQ ID NO: 331629 - RNA, 22 nt, Homo sapiens
ggucauagagcaagcaaacagc

SEQ ID NO: 331630 - RNA, 22 nt, Homo sapiens
ggucauggauaagauccagaag

SEQ ID NO: 331631 - RNA, 22 nt, Homo sapiens
ggucauggauugucuuuucuug

SEQ ID NO: 331632 - RNA, 22 nt, Homo sapiens
ggugacagugguuaaaauuugu

SEQ ID NO: 331633 - RNA, 22 nt, Homo sapiens
ggugacugguuuaucuggcagu

SEQ ID NO: 331634 - RNA, 22 nt, Homo sapiens
ggugagauguucagacgaacug

SEQ ID NO: 331635 - RNA, 22 nt, Homo sapiens
gguggcaaaucugaguggcgcu

SEQ ID NO: 331636 - RNA, 22 nt, Homo sapiens
gguuagaaacagguccucagga

SEQ ID NO: 331637 - RNA, 22 nt, Homo sapiens
guaaacuuccccucaugaauga

SEQ ID NO: 331638 - RNA, 18 nt, Homo sapiens
guaaauguaucuauugcc

SEQ ID NO: 331639 - RNA, 22 nt, Homo sapiens
guaaauguccccugugauauug

SEQ ID NO: 331640 - RNA, 22 nt, Homo sapiens
guaacacaugcugcucucuggu

SEQ ID NO: 331641 - RNA, 22 nt, Homo sapiens
guaagagaauggguuacuuucc

SEQ ID NO: 331642 - RNA, 22 nt, Homo sapiens
guaauaacuguggaaaaagguu

SEQ ID NO: 331643 - RNA, 22 nt, Homo sapiens
guaaucucagcuacucgggaga

SEQ ID NO: 331644 - RNA, 22 nt, Homo sapiens
guaaucucagcuacuugggagg

SEQ ID NO: 331645 - RNA, 22 nt, Homo sapiens
guaaucucagcuucuugggagg

SEQ ID NO: 331646 - RNA, 19 nt, Homo sapiens
guaaucucaguacuuuggu

SEQ ID NO: 331647 - RNA, 22 nt, Homo sapiens
guaaugcacucccaaagaucca

SEQ ID NO: 331648 - RNA, 17 nt, Homo sapiens
guacacuucuucuguga

SEQ ID NO: 331649 - RNA, 22 nt, Homo sapiens
guacaggcagcaaacaccauaa

SEQ ID NO: 331650 - RNA, 22 nt, Homo sapiens
guacaguucucuuuguugucag

SEQ ID NO: 331651 - RNA, 22 nt, Homo sapiens
guacauggaaugaaauucaaaa

SEQ ID NO: 331652 - RNA, 22 nt, Homo sapiens
guagaaagcauuucagauuugc

SEQ ID NO: 331653 - RNA, 22 nt, Homo sapiens
guagaagcacaggugaguuggu

SEQ ID NO: 331654 - RNA, 22 nt, Homo sapiens
guagaauguauguauaacgcaa

SEQ ID NO: 331655 - RNA, 22 nt, Homo sapiens
guagaugcauggauuuacuucu

SEQ ID NO: 331656 - RNA, 22 nt, Homo sapiens
guagcaccagugcucuucucaa

SEQ ID NO: 331657 - RNA, 22 nt, Homo sapiens
guagggcaggcugagaaauaua

SEQ ID NO: 331658 - RNA, 22 nt, Homo sapiens
guagguaaguacuucuggugag

SEQ ID NO: 331659 - RNA, 22 nt, Homo sapiens
guaguuuaucagaaagaauagg

SEQ ID NO: 331660 - RNA, 22 nt, Homo sapiens
guauaggcuuucaccacgccau

SEQ ID NO: 331661 - RNA, 22 nt, Homo sapiens
guauaguaguacaaaaguuuuu

SEQ ID NO: 331662 - RNA, 22 nt, Homo sapiens
guaucccuugcuaucugaaucu

SEQ ID NO: 331663 - RNA, 22 nt, Homo sapiens
guaucucaguucucgugauuag

SEQ ID NO: 331664 - RNA, 22 nt, Homo sapiens
guaugaaaaucggagauugggu

SEQ ID NO: 331665 - RNA, 22 nt, Homo sapiens
guaugauacuguaacagugggu

SEQ ID NO: 331666 - RNA, 22 nt, Homo sapiens
guaugucuuuauagcagugugg

SEQ ID NO: 331667 - RNA, 22 nt, Homo sapiens
guauuagaugguauuugaagau

SEQ ID NO: 331668 - RNA, 22 nt, Homo sapiens
guauuaguuaucuacugcugug

SEQ ID NO: 331669 - RNA, 19 nt, Homo sapiens
guauuugacuuucuuguuu

SEQ ID NO: 331670 - RNA, 22 nt, Homo sapiens
guauuuuguuagggugugguau

SEQ ID NO: 331671 - RNA, 19 nt, Homo sapiens
gucaaagucgguauucaaa

SEQ ID NO: 331672 - RNA, 22 nt, Homo sapiens
gucaaggaauuuauccauuucu

SEQ ID NO: 331673 - RNA, 22 nt, Homo sapiens
gucaagugaagaccugacucuu

SEQ ID NO: 331674 - RNA, 22 nt, Homo sapiens
gucaagugaagcagugggagua

SEQ ID NO: 331675 - RNA, 22 nt, Homo sapiens
gucacagcacuuuuaguaagug

SEQ ID NO: 331676 - RNA, 22 nt, Homo sapiens
gucaccauugagucauuuccuc

SEQ ID NO: 331677 - RNA, 22 nt, Homo sapiens
gucacugacaagagagaagaac

SEQ ID NO: 331678 - RNA, 22 nt, Homo sapiens
gucacugagauugguauuaaug

SEQ ID NO: 331679 - RNA, 22 nt, Homo sapiens
gucacugagcaauagaaaguuu

SEQ ID NO: 331680 - RNA, 22 nt, Homo sapiens
gucacugccugaggcugaugca

SEQ ID NO: 331681 - RNA, 22 nt, Homo sapiens
gucagcaaagaggaauaguuug

SEQ ID NO: 331682 - RNA, 22 nt, Homo sapiens
gucagcaucaccaugucuauga

SEQ ID NO: 331683 - RNA, 22 nt, Homo sapiens
uaaggcuugcuucagucuugaa

SEQ ID NO: 331684 - RNA, 22 nt, Homo sapiens
uaaggcuuugguagguuugguc

SEQ ID NO: 331685 - RNA, 22 nt, Homo sapiens
uaagggcacuaaucccauuuau

SEQ ID NO: 331686 - RNA, 22 nt, Homo sapiens
uaagguuuuugauaugcugcug

SEQ ID NO: 331687 - RNA, 22 nt, Homo sapiens
uaaguaauugcagcaauuugcc

SEQ ID NO: 331688 - RNA, 22 nt, Homo sapiens
uaaguaauuguuaauagggaag

SEQ ID NO: 331689 - RNA, 22 nt, Homo sapiens
uaaguaauuuguauuuuaccca

SEQ ID NO: 331690 - RNA, 22 nt, Homo sapiens
uaaguacuuuacagacauuauc

SEQ ID NO: 331691 - RNA, 22 nt, Homo sapiens
uaaguauagguaacagaagcaa

SEQ ID NO: 331692 - RNA, 22 nt, Homo sapiens
uaaguaucaguuuagcuaugau

SEQ ID NO: 331693 - RNA, 22 nt, Homo sapiens
uaagucuuuuuggaguuuauaa

SEQ ID NO: 331694 - RNA, 22 nt, Homo sapiens
uaagugaugucuuuuugugugc

SEQ ID NO: 331695 - RNA, 22 nt, Homo sapiens
uaagugcaugauuacaugcaua

SEQ ID NO: 331696 - RNA, 20 nt, Homo sapiens
uaagugcuugaugaaugaac

SEQ ID NO: 331697 - RNA, 18 nt, Homo sapiens
uaagugcuuuaaacacau

SEQ ID NO: 331698 - RNA, 20 nt, Homo sapiens
uaagugcuuuauauugauua

SEQ ID NO: 331699 - RNA, 22 nt, Homo sapiens
uaagugguguucauucuuuuga

SEQ ID NO: 331700 - RNA, 20 nt, Homo sapiens
uaaguuguauuugucaugaa

SEQ ID NO: 331701 - RNA, 21 nt, Homo sapiens
uaauaaugucucagacaccua

SEQ ID NO: 331702 - RNA, 22 nt, Homo sapiens
uaauagcucggauaaacaugau

SEQ ID NO: 331703 - RNA, 22 nt, Homo sapiens
uaauaguguuaaugcuagagcu

SEQ ID NO: 331704 - RNA, 22 nt, Homo sapiens
uaauaguuucagaaguuguuuu

SEQ ID NO: 331705 - RNA, 22 nt, Homo sapiens
uaauaugugguugcuugggcac

SEQ ID NO: 331706 - RNA, 22 nt, Homo sapiens
uaauccuggcacuuugggaggc

SEQ ID NO: 331707 - RNA, 22 nt, Homo sapiens
uaaugcauacagaagguguuuu

SEQ ID NO: 331708 - RNA, 22 nt, Homo sapiens
uaaugcuccauggguuauuaaa

SEQ ID NO: 331709 - RNA, 22 nt, Homo sapiens
uaaugguuuugcaccaucccuc

SEQ ID NO: 331710 - RNA, 22 nt, Homo sapiens
uaauucuguauguaucagaguu

SEQ ID NO: 331711 - RNA, 22 nt, Homo sapiens
uacaaagcuuucugcaaaucau

SEQ ID NO: 331712 - RNA, 22 nt, Homo sapiens
uacaaaguaacaguuccuguau

SEQ ID NO: 331713 - RNA, 22 nt, Homo sapiens
uacaaaucuagguuuguuacug

SEQ ID NO: 331714 - RNA, 22 nt, Homo sapiens
uacaacacugguucgacaugug

SEQ ID NO: 331715 - RNA, 22 nt, Homo sapiens
uacaagcacaggcagcaggcug

SEQ ID NO: 331716 - RNA, 22 nt, Homo sapiens
uacaaguauuuuuauuagugcc

SEQ ID NO: 331717 - RNA, 22 nt, Homo sapiens
uacaaguggguuugugcaggag

SEQ ID NO: 331718 - RNA, 22 nt, Homo sapiens
uacaauagugacaaaucagcau

SEQ ID NO: 331719 - RNA, 16 nt, Homo sapiens
uacaauguagaaaaca

SEQ ID NO: 331720 - RNA, 22 nt, Homo sapiens
uacaccugcacucuagccuggg

SEQ ID NO: 331721 - RNA, 22 nt, Homo sapiens
uacagaauucugucccuugagu

SEQ ID NO: 331722 - RNA, 22 nt, Homo sapiens
uacagaauugcagguguggcag

SEQ ID NO: 331723 - RNA, 22 nt, Homo sapiens
uacagaucaguuauuuuguaga

SEQ ID NO: 331724 - RNA, 22 nt, Homo sapiens
uacagcacaggugcagguguug

SEQ ID NO: 331725 - RNA, 23 nt, Homo sapiens
uacagcugcagaaucaggcuaag

SEQ ID NO: 331726 - RNA, 22 nt, Homo sapiens
uacaguacacagguaccaagcu

SEQ ID NO: 331727 - RNA, 22 nt, Homo sapiens
uacaguagagaucagcaaacua

SEQ ID NO: 331728 - RNA, 22 nt, Homo sapiens
uacagucuggaggccuguguug

SEQ ID NO: 331729 - RNA, 22 nt, Homo sapiens
uacaguggaaguuaaccccauu

SEQ ID NO: 331730 - RNA, 22 nt, Homo sapiens
uacagugggcacuggcgcccug

SEQ ID NO: 331731 - RNA, 22 nt, Homo sapiens
uacauacuucacagacuuuaaa

SEQ ID NO: 331732 - RNA, 22 nt, Homo sapiens
uacauaguuacuuccauuucca

SEQ ID NO: 331733 - RNA, 22 nt, Homo sapiens
uacauccauccugcugggcagu

SEQ ID NO: 331734 - RNA, 22 nt, Homo sapiens
uacaugugccauguugguuugc

SEQ ID NO: 331735 - RNA, 22 nt, Homo sapiens
uacauugcacuuuauuagauac

SEQ ID NO: 331736 - RNA, 22 nt, Homo sapiens
uaccacccuuuuuccagaagcc

SEQ ID NO: 331737 - RNA, 22 nt, Homo sapiens
uaccacugccgagaaaacagau

SEQ ID NO: 331738 - RNA, 22 nt, Homo sapiens
uaccauguauguuucuccauug

SEQ ID NO: 331739 - RNA, 22 nt, Homo sapiens
uacccuuuaguauaaaaucaga

SEQ ID NO: 331740 - RNA, 22 nt, Homo sapiens
uaccuaguguugacuucucuuc

SEQ ID NO: 331741 - RNA, 22 nt, Homo sapiens
uaccucaguucaauaacagaua

SEQ ID NO: 331742 - RNA, 22 nt, Homo sapiens
uaccugagacaacuuugaggaa

SEQ ID NO: 331743 - RNA, 22 nt, Homo sapiens
uaccuguagacuacagcuucag

SEQ ID NO: 331744 - RNA, 18 nt, Homo sapiens
uacuaguaaggcuucuga

SEQ ID NO: 331745 - RNA, 22 nt, Homo sapiens
uacuaguaagggugguuuggcu

SEQ ID NO: 331746 - RNA, 22 nt, Homo sapiens
uacucaguagacacucauaugu

SEQ ID NO: 331747 - RNA, 22 nt, Homo sapiens
uacucaguagucuguugcuguc

SEQ ID NO: 331748 - RNA, 22 nt, Homo sapiens
uacucagugacugguggaucaa

SEQ ID NO: 331749 - RNA, 22 nt, Homo sapiens
uacuccccuuguucugugagcu

SEQ ID NO: 331750 - RNA, 22 nt, Homo sapiens
uacugagagaggaauauugaaa

SEQ ID NO: 331751 - RNA, 20 nt, Homo sapiens
uacugcacuccaaccuaggc

SEQ ID NO: 331752 - RNA, 22 nt, Homo sapiens
uacugcacuccaaccugagaga

SEQ ID NO: 331753 - RNA, 22 nt, Homo sapiens
uacugcacuccagccuggguga

SEQ ID NO: 331754 - RNA, 22 nt, Homo sapiens
uacugcacuccaggcucaccug

SEQ ID NO: 331755 - RNA, 22 nt, Homo sapiens
uacugcacuugaccuccugggc

SEQ ID NO: 331756 - RNA, 22 nt, Homo sapiens
uacugcauuucacuguuaaaga

SEQ ID NO: 331757 - RNA, 22 nt, Homo sapiens
uacuggccccaaaguagguagu

SEQ ID NO: 331758 - RNA, 22 nt, Homo sapiens
uacuggguguucugagaaaaua

SEQ ID NO: 331759 - RNA, 22 nt, Homo sapiens
uacuuuguagauuguuuccuuu

SEQ ID NO: 331760 - RNA, 22 nt, Homo sapiens
uagaaugaaacaagcugugccu

SEQ ID NO: 331761 - RNA, 22 nt, Homo sapiens
uagaauguaacuuccaugucau

SEQ ID NO: 331762 - RNA, 22 nt, Homo sapiens
uagaauguauaauauuuuacuu

SEQ ID NO: 331763 - RNA, 23 nt, Homo sapiens
uagaauguuuuuccauguuucuu

SEQ ID NO: 331764 - RNA, 21 nt, Homo sapiens
uagagagcaauaccuccagag

SEQ ID NO: 331765 - RNA, 22 nt, Homo sapiens
uagagauaucaauuucauggug

SEQ ID NO: 331766 - RNA, 22 nt, Homo sapiens
uagagcacauuaucauuuccaa

SEQ ID NO: 331767 - RNA, 22 nt, Homo sapiens
uagagguagagugacuucccca

SEQ ID NO: 331768 - RNA, 22 nt, Homo sapiens
uagagguagguguaugaacuag

SEQ ID NO: 331769 - RNA, 22 nt, Homo sapiens
uagagguauguauaguauucuu

SEQ ID NO: 331770 - RNA, 22 nt, Homo sapiens
uagagguucuaagauucucaga

SEQ ID NO: 331771 - RNA, 19 nt, Homo sapiens
uagagguuuaagaaaagaa

SEQ ID NO: 331772 - RNA, 22 nt, Homo sapiens
uagagugcugucaaagacuugu

SEQ ID NO: 331773 - RNA, 22 nt, Homo sapiens
uagauaauuagaggguuuuaag

SEQ ID NO: 331774 - RNA, 22 nt, Homo sapiens
uagaucaauuaauuguuacuug

SEQ ID NO: 331775 - RNA, 20 nt, Homo sapiens
uagaugcauuuagauucauu

SEQ ID NO: 331776 - RNA, 22 nt, Homo sapiens
uagauuaucccugauuugucca

SEQ ID NO: 331777 - RNA, 22 nt, Homo sapiens
gcagcagugcccuggauggaaa

SEQ ID NO: 331778 - RNA, 22 nt, Homo sapiens
gcagcaucaaaucacacaagau

SEQ ID NO: 331779 - RNA, 22 nt, Homo sapiens
gcagucaucugaaggcuuaacu

SEQ ID NO: 331780 - RNA, 23 nt, Homo sapiens
gcagucauuuggaaaagguugaa

SEQ ID NO: 331781 - RNA, 22 nt, Homo sapiens
gcauaaagcuaauaagacgaag

SEQ ID NO: 331782 - RNA, 20 nt, Homo sapiens
gcauaugucuuuauagcaga

SEQ ID NO: 331783 - RNA, 22 nt, Homo sapiens
gcauauuuuaaaguguaaccug

SEQ ID NO: 331784 - RNA, 22 nt, Homo sapiens
gcaugaugaauaauaucacaag

SEQ ID NO: 331785 - RNA, 22 nt, Homo sapiens
gcauggagcauacauuucuguu

SEQ ID NO: 331786 - RNA, 22 nt, Homo sapiens
gcauggauguugauggcugcug

SEQ ID NO: 331787 - RNA, 22 nt, Homo sapiens
gcaugguacuggaugguaguau

SEQ ID NO: 331788 - RNA, 22 nt, Homo sapiens
gcaugugaauguguaagaaaau

SEQ ID NO: 331789 - RNA, 22 nt, Homo sapiens
gccaaaaugcugggauuacagg

SEQ ID NO: 331790 - RNA, 22 nt, Homo sapiens
gccaacauggcgcuccauucuu

SEQ ID NO: 331791 - RNA, 22 nt, Homo sapiens
gccauugcacuacagccuaggc

SEQ ID NO: 331792 - RNA, 22 nt, Homo sapiens
gccauugcacuccagccuagcg

SEQ ID NO: 331793 - RNA, 22 nt, Homo sapiens
gccauugcacucuagccuaggu

SEQ ID NO: 331794 - RNA, 22 nt, Homo sapiens
gcccuguugcccugaauacaua

SEQ ID NO: 331795 - RNA, 17 nt, Homo sapiens
gcccuuugugccucuuc

SEQ ID NO: 331796 - RNA, 22 nt, Homo sapiens
gcccuuugugucuggcuggggu

SEQ ID NO: 331797 - RNA, 22 nt, Homo sapiens
gccucaguuguggccagggauu

SEQ ID NO: 331798 - RNA, 22 nt, Homo sapiens
gccuguagaagaguagaugacc

SEQ ID NO: 331799 - RNA, 20 nt, Homo sapiens
gcuaaggcacgggaauuacu

SEQ ID NO: 331800 - RNA, 22 nt, Homo sapiens
gcuaggagaucugcugcucucu

SEQ ID NO: 331801 - RNA, 19 nt, Homo sapiens
gcucaccuugcugcuccag

SEQ ID NO: 331802 - RNA, 22 nt, Homo sapiens
gcucaguuuccucagcugcaaa

SEQ ID NO: 331803 - RNA, 22 nt, Homo sapiens
gcugagacauugguuuucuccu

SEQ ID NO: 331804 - RNA, 22 nt, Homo sapiens
gcugaguaguauuucauuguau

SEQ ID NO: 331805 - RNA, 22 nt, Homo sapiens
gcugauguugaccuugaucacc

SEQ ID NO: 331806 - RNA, 17 nt, Homo sapiens
gcugauguuugcauuuu

SEQ ID NO: 331807 - RNA, 22 nt, Homo sapiens
gcuggugacuuuaaguugaagc

SEQ ID NO: 331808 - RNA, 22 nt, Homo sapiens
gcugucuggagucuguucaaug

SEQ ID NO: 331809 - RNA, 20 nt, Homo sapiens
gcugugcuuaauacacuuuc

SEQ ID NO: 331810 - RNA, 16 nt, Homo sapiens
gcuguuguuuuguccu

SEQ ID NO: 331811 - RNA, 19 nt, Homo sapiens
gcuuguccacgugagauaa

SEQ ID NO: 331812 - RNA, 22 nt, Homo sapiens
ggaaagacuauuguaaaggaug

SEQ ID NO: 331813 - RNA, 22 nt, Homo sapiens
ggaaagaucagcuaaauguaag

SEQ ID NO: 331814 - RNA, 22 nt, Homo sapiens
ggaaaucaucauucucgguaua

SEQ ID NO: 331815 - RNA, 22 nt, Homo sapiens
ggaaauguuggugucaugaguu

SEQ ID NO: 331816 - RNA, 22 nt, Homo sapiens
ggaagacuuagaguagcaucag

SEQ ID NO: 331817 - RNA, 22 nt, Homo sapiens
ggaagccuggaaaaaauuguga

SEQ ID NO: 331818 - RNA, 23 nt, Homo sapiens
ggaaugaaaccugguuaugauau

SEQ ID NO: 331819 - RNA, 22 nt, Homo sapiens
ggaaugagaaauauuacacaau

SEQ ID NO: 331820 - RNA, 19 nt, Homo sapiens
ggaaugcaccaguccuugc

SEQ ID NO: 331821 - RNA, 22 nt, Homo sapiens
ggaauggaacaaagucuugaaa

SEQ ID NO: 331822 - RNA, 20 nt, Homo sapiens
ggaauguuaaucuccaugau

SEQ ID NO: 331823 - RNA, 22 nt, Homo sapiens
ggacaagagacugggacacuga

SEQ ID NO: 331824 - RNA, 22 nt, Homo sapiens
ggacagaaaggguucaccaaac

SEQ ID NO: 331825 - RNA, 22 nt, Homo sapiens
ggacuguaauaccaugaggaca

SEQ ID NO: 331826 - RNA, 19 nt, Homo sapiens
ggacugucauggaguaguu

SEQ ID NO: 331827 - RNA, 22 nt, Homo sapiens
ggagagugacauauuucuaggc

SEQ ID NO: 331828 - RNA, 22 nt, Homo sapiens
ggagaucuuuaggaguuggacu

SEQ ID NO: 331829 - RNA, 22 nt, Homo sapiens
ggagauguuuaaccuuuuaucu

SEQ ID NO: 331830 - RNA, 22 nt, Homo sapiens
ggagguaauaaguuccagugua

SEQ ID NO: 331831 - RNA, 22 nt, Homo sapiens
ggaguaaaagaguaggaggaau

SEQ ID NO: 331832 - RNA, 23 nt, Homo sapiens
ggaguguaaauuauuucaaccau

SEQ ID NO: 331833 - RNA, 22 nt, Homo sapiens
ggagugucugugcuggucaaag

SEQ ID NO: 331834 - RNA, 22 nt, Homo sapiens
ggaguuuaagucuugugcaucu

SEQ ID NO: 331835 - RNA, 22 nt, Homo sapiens
ggaugcauuuuugguugucaca

SEQ ID NO: 331836 - RNA, 22 nt, Homo sapiens
ggauggcauuucuuuagcuuuu

SEQ ID NO: 331837 - RNA, 22 nt, Homo sapiens
ggcaaaauauugucugguauag

SEQ ID NO: 331838 - RNA, 22 nt, Homo sapiens
ggcaacauggugaaacucuguc

SEQ ID NO: 331839 - RNA, 22 nt, Homo sapiens
ggcaagaucuuggcucacugaa

SEQ ID NO: 331840 - RNA, 22 nt, Homo sapiens
ggcacaguuaagugcuaccuaa

SEQ ID NO: 331841 - RNA, 22 nt, Homo sapiens
ggcaugauguauuugagguuug

SEQ ID NO: 331842 - RNA, 22 nt, Homo sapiens
ggccuguaaacuagagacccug

SEQ ID NO: 331843 - RNA, 22 nt, Homo sapiens
ggcuagaauagggauagaccuu

SEQ ID NO: 331844 - RNA, 22 nt, Homo sapiens
ggcuagagagcucagggauaug

SEQ ID NO: 331845 - RNA, 21 nt, Homo sapiens
ggcucuguggucucagguuuc

SEQ ID NO: 331846 - RNA, 22 nt, Homo sapiens
gggaagauauaggcugggcacc

SEQ ID NO: 331847 - RNA, 22 nt, Homo sapiens
gggaagguaaucauuacuugau

SEQ ID NO: 331848 - RNA, 22 nt, Homo sapiens
gggaauguagcaaaucugcaau

SEQ ID NO: 331849 - RNA, 22 nt, Homo sapiens
gggaugaagcccuaggguuggu

SEQ ID NO: 331850 - RNA, 20 nt, Homo sapiens
gggaugugagguacacucuu

SEQ ID NO: 331851 - RNA, 22 nt, Homo sapiens
gggcagaugucuggacaccuca

SEQ ID NO: 331852 - RNA, 22 nt, Homo sapiens
gggcaugauggugcacacaugu

SEQ ID NO: 331853 - RNA, 22 nt, Homo sapiens
gggccagaugcauuuguuauuu

SEQ ID NO: 331854 - RNA, 23 nt, Homo sapiens
gggcuagaugagagcuuccuggg

SEQ ID NO: 331855 - RNA, 22 nt, Homo sapiens
gggugguuuuaucucuucccuu

SEQ ID NO: 331856 - RNA, 22 nt, Homo sapiens
ggguucccuucuggcucagggu

SEQ ID NO: 331857 - RNA, 22 nt, Homo sapiens
ggucaacaucaucaugguaagu

SEQ ID NO: 331858 - RNA, 22 nt, Homo sapiens
ggucacauugcuagcauggguu

SEQ ID NO: 331859 - RNA, 22 nt, Homo sapiens
ggucacccugaugcuggugguc

SEQ ID NO: 331860 - RNA, 19 nt, Homo sapiens
ggucagcaaagucuagcug

SEQ ID NO: 331861 - RNA, 22 nt, Homo sapiens
ggugagaaagggauuccuguuc

SEQ ID NO: 331862 - RNA, 23 nt, Homo sapiens
ggugaggaguacagagucuucau

SEQ ID NO: 331863 - RNA, 19 nt, Homo sapiens
ggugcuugaauauuccucc

SEQ ID NO: 331864 - RNA, 22 nt, Homo sapiens
gguggugguauuucagaaaaug

SEQ ID NO: 331865 - RNA, 22 nt, Homo sapiens
uacacgugcacaacgugcacgu

SEQ ID NO: 331866 - RNA, 20 nt, Homo sapiens
uacacguguagcauucucua

SEQ ID NO: 331867 - RNA, 22 nt, Homo sapiens
uacagaauugcagguguggcag

SEQ ID NO: 331868 - RNA, 22 nt, Homo sapiens
uacagaguagaagauuugcaga

SEQ ID NO: 331869 - RNA, 22 nt, Homo sapiens
uacagaguauccauuugaguuc

SEQ ID NO: 331870 - RNA, 22 nt, Homo sapiens
uacaguacacagguaccaagcu

SEQ ID NO: 331871 - RNA, 22 nt, Homo sapiens
uacagucauaaugccuagugac

SEQ ID NO: 331872 - RNA, 22 nt, Homo sapiens
uacagucuggaggccuguguug

SEQ ID NO: 331873 - RNA, 22 nt, Homo sapiens
uacagugcauagaggcaugaua

SEQ ID NO: 331874 - RNA, 19 nt, Homo sapiens
uacaugcagcaggcacgca

SEQ ID NO: 331875 - RNA, 22 nt, Homo sapiens
uacaugugcacaacgugcaggu

SEQ ID NO: 331876 - RNA, 22 nt, Homo sapiens
uacaugugcaggucuguggggg

SEQ ID NO: 331877 - RNA, 22 nt, Homo sapiens
uacccugaaggaaaguauguuu

SEQ ID NO: 331878 - RNA, 21 nt, Homo sapiens
uaccuacugcaugccaggcac

SEQ ID NO: 331879 - RNA, 22 nt, Homo sapiens
uaccucuguaaguaaagauuca

SEQ ID NO: 331880 - RNA, 22 nt, Homo sapiens
uacguguauuguuuucacaaga

SEQ ID NO: 331881 - RNA, 22 nt, Homo sapiens
uacucaguagacacucauaugu

SEQ ID NO: 331882 - RNA, 22 nt, Homo sapiens
uacugcacuccagccugggaga

SEQ ID NO: 331883 - RNA, 22 nt, Homo sapiens
uacugcacucuagccuggguga

SEQ ID NO: 331884 - RNA, 22 nt, Homo sapiens
uacugcagucagacuccugggc

SEQ ID NO: 331885 - RNA, 22 nt, Homo sapiens
uacugcaguugcagcuugagga

SEQ ID NO: 331886 - RNA, 22 nt, Homo sapiens
uacugcuuaaaagucaauuacu

SEQ ID NO: 331887 - RNA, 22 nt, Homo sapiens
uacugcuuaagggcaugggccc

SEQ ID NO: 331888 - RNA, 22 nt, Homo sapiens
uacuggguguucugagaaaaua

SEQ ID NO: 331889 - RNA, 22 nt, Homo sapiens
uacuguacugcaguucugcaaa

SEQ ID NO: 331890 - RNA, 22 nt, Homo sapiens
uacuuuguagauuguuuccuuu

SEQ ID NO: 331891 - RNA, 22 nt, Homo sapiens
uagaaaguagggaagguaggau

SEQ ID NO: 331892 - RNA, 22 nt, Homo sapiens
uagaagcuacucuucuuguggc

SEQ ID NO: 331893 - RNA, 18 nt, Homo sapiens
uagaauauaggucauucu

SEQ ID NO: 331894 - RNA, 22 nt, Homo sapiens
uagaaugucagcuucuugaggg

SEQ ID NO: 331895 - RNA, 23 nt, Homo sapiens
uagaauguuuuuccauguuucuu

SEQ ID NO: 331896 - RNA, 22 nt, Homo sapiens
uagacaacugaaacacugugca

SEQ ID NO: 331897 - RNA, 22 nt, Homo sapiens
uagacacugcauauuuuuuuaa

SEQ ID NO: 331898 - RNA, 20 nt, Homo sapiens
uagacagcuagauuagauag

SEQ ID NO: 331899 - RNA, 20 nt, Homo sapiens
uagagagauauggggguucc

SEQ ID NO: 331900 - RNA, 21 nt, Homo sapiens
uagagcuuggcacagaguaga

SEQ ID NO: 331901 - RNA, 22 nt, Homo sapiens
uagagugcugucaaagacuugu

SEQ ID NO: 331902 - RNA, 22 nt, Homo sapiens
uagauaauuagaggguuuuaag

SEQ ID NO: 331903 - RNA, 22 nt, Homo sapiens
uagaucaacuuugguaagagaa

SEQ ID NO: 331904 - RNA, 20 nt, Homo sapiens
uagaugcauuuagauucauu

SEQ ID NO: 331905 - RNA, 20 nt, Homo sapiens
uagcacacauguagaauagu

SEQ ID NO: 331906 - RNA, 22 nt, Homo sapiens
uagcacccucuccuaguccugc

SEQ ID NO: 331907 - RNA, 22 nt, Homo sapiens
uagcaccuuagcauuucuagug

SEQ ID NO: 331908 - RNA, 22 nt, Homo sapiens
uagcagaauaacuugccagccu

SEQ ID NO: 331909 - RNA, 22 nt, Homo sapiens
uagcagcaaagcaggaucugcu

SEQ ID NO: 331910 - RNA, 22 nt, Homo sapiens
uagcagcaccccacucuacugg

SEQ ID NO: 331911 - RNA, 22 nt, Homo sapiens
uagcaggaaaccuguguugagg

SEQ ID NO: 331912 - RNA, 22 nt, Homo sapiens
uagcauggaggcggccauagug

SEQ ID NO: 331913 - RNA, 22 nt, Homo sapiens
uagcauggagucaugcacggcu

SEQ ID NO: 331914 - RNA, 22 nt, Homo sapiens
uagcuggaauuacuugcaccug

SEQ ID NO: 331915 - RNA, 17 nt, Homo sapiens
uagcuucacauuaggaa

SEQ ID NO: 331916 - RNA, 23 nt, Homo sapiens
uagcuucucccagaccugcuccc

SEQ ID NO: 331917 - RNA, 22 nt, Homo sapiens
uaggaaguacaucucagaaucu

SEQ ID NO: 331918 - RNA, 22 nt, Homo sapiens
uaggacauugcccuuguggaga

SEQ ID NO: 331919 - RNA, 20 nt, Homo sapiens
uaggagcaaugagaguagaa

SEQ ID NO: 331920 - RNA, 22 nt, Homo sapiens
uaggcaauguggcgaaacucug

SEQ ID NO: 331921 - RNA, 22 nt, Homo sapiens
uaggcauuuuucugauaaacua

SEQ ID NO: 331922 - RNA, 22 nt, Homo sapiens
uaggccuuuuucagauggguag

SEQ ID NO: 331923 - RNA, 22 nt, Homo sapiens
uaggcuuuuggacccugucucu

SEQ ID NO: 331924 - RNA, 22 nt, Homo sapiens
uagggagugucuucauuuugua

SEQ ID NO: 331925 - RNA, 22 nt, Homo sapiens
uagggaguuuuggggugcagaa

SEQ ID NO: 331926 - RNA, 22 nt, Homo sapiens
uagguagaaucuugaagccauu

SEQ ID NO: 331927 - RNA, 22 nt, Homo sapiens
uagguagugugugcaugagagg

SEQ ID NO: 331928 - RNA, 22 nt, Homo sapiens
uagguaguuagcauacuacaca

SEQ ID NO: 331929 - RNA, 22 nt, Homo sapiens
uaggucaguuuuggcuuggcuu

SEQ ID NO: 331930 - RNA, 22 nt, Homo sapiens
uagguuauucauucaucauuua

SEQ ID NO: 331931 - RNA, 22 nt, Homo sapiens
uaguaaacauuuuucuaucauu

SEQ ID NO: 331932 - RNA, 22 nt, Homo sapiens
uaguaacacauugaacgaucgc

SEQ ID NO: 331933 - RNA, 22 nt, Homo sapiens
uaguaucacauggucuuaauua

SEQ ID NO: 331934 - RNA, 22 nt, Homo sapiens
uagucagcaauguucauguucu

SEQ ID NO: 331935 - RNA, 22 nt, Homo sapiens
uaguccauuuucaugcugcuau

SEQ ID NO: 331936 - RNA, 22 nt, Homo sapiens
uagugcugugauauuuuuggcc

SEQ ID NO: 331937 - RNA, 20 nt, Homo sapiens
uaguggaaaucagguccucu

SEQ ID NO: 331938 - RNA, 22 nt, Homo sapiens
uauaaaguaauuucuaggggcu

SEQ ID NO: 331939 - RNA, 22 nt, Homo sapiens
uauacagcaaguuacugugcug

SEQ ID NO: 331940 - RNA, 22 nt, Homo sapiens
uauacaugugggcaucaggaga

SEQ ID NO: 331941 - RNA, 22 nt, Homo sapiens
uauagcaaugccccacuccuga

SEQ ID NO: 331942 - RNA, 17 nt, Homo sapiens
uauagcacuucucacau

SEQ ID NO: 331943 - RNA, 21 nt, Homo sapiens
uauaguaguaugauuuacaau

SEQ ID NO: 331944 - RNA, 22 nt, Homo sapiens
uauauguuuucauaaggcuaga

SEQ ID NO: 331945 - RNA, 22 nt, Homo sapiens
uaucaagauggauaaggauaga

SEQ ID NO: 331946 - RNA, 22 nt, Homo sapiens
uaucacacuggaagaaguuaag

SEQ ID NO: 331947 - RNA, 22 nt, Homo sapiens
uaucacaguaaaucugggugca

SEQ ID NO: 331948 - RNA, 22 nt, Homo sapiens
uaucacaguaucuagcacagug

SEQ ID NO: 331949 - RNA, 20 nt, Homo sapiens
uaucacauggggagaaaccu

SEQ ID NO: 331950 - RNA, 21 nt, Homo sapiens
uaucagagacauugagaggca

SEQ ID NO: 331951 - RNA, 22 nt, Homo sapiens
uaucagugaaucuuauuuugcc

SEQ ID NO: 331952 - RNA, 22 nt, Homo sapiens
uaucauaguuuggacuuucauu

SEQ ID NO: 331953 - RNA, 22 nt, Homo sapiens
uaucauggaaagauguugaaau

SEQ ID NO: 331954 - RNA, 22 nt, Homo sapiens
uaucaugggggguguacacucc

SEQ ID NO: 331955 - RNA, 21 nt, Homo sapiens
uauccacuugcaacagagaag

SEQ ID NO: 331956 - RNA, 23 nt, Homo sapiens
uaucccuugccuuaugaugugag

SEQ ID NO: 331957 - RNA, 23 nt, Homo sapiens
uaucucaaugcacagagaggaaa

SEQ ID NO: 331958 - RNA, 22 nt, Homo sapiens
uaucucagagaaucagauuuac

SEQ ID NO: 331959 - RNA, 22 nt, Homo sapiens
uaucucagaguguacaagauua

SEQ ID NO: 331960 - RNA, 22 nt, Homo sapiens
uaucucuuuucauguguaaaug

SEQ ID NO: 331961 - RNA, 22 nt, Homo sapiens
uaucugcacuucugucuagguc

SEQ ID NO: 331962 - RNA, 22 nt, Homo sapiens
uaugaaagcuacuucucacaau

SEQ ID NO: 331963 - RNA, 22 nt, Homo sapiens
uaugagacugguuaauuuuugu

SEQ ID NO: 331964 - RNA, 22 nt, Homo sapiens
uaugagguagguaugacuauca

SEQ ID NO: 331965 - RNA, 22 nt, Homo sapiens
uaugaucauuauguuauugcag

SEQ ID NO: 331966 - RNA, 19 nt, Homo sapiens
uaugcaacuuauagugcug

SEQ ID NO: 331967 - RNA, 22 nt, Homo sapiens
uaugcacuaggcacuguguuug

SEQ ID NO: 331968 - RNA, 22 nt, Homo sapiens
uaugcacuauagcauauguggu

SEQ ID NO: 331969 - RNA, 22 nt, Homo sapiens
uaugcuuauuaaaacagugugu

SEQ ID NO: 331970 - RNA, 22 nt, Homo sapiens
uauggauguuaagguucacagc

SEQ ID NO: 331971 - RNA, 22 nt, Homo sapiens
uauggauucuagcucaguaggu

SEQ ID NO: 331972 - RNA, 22 nt, Homo sapiens
uauggauuucauuagacuugag

SEQ ID NO: 331973 - RNA, 22 nt, Homo sapiens
uauggauuuuuuugacaagagc

SEQ ID NO: 331974 - RNA, 22 nt, Homo sapiens
uauggccccuacaugugcaaaa

SEQ ID NO: 331975 - RNA, 22 nt, Homo sapiens
uauggcccuuaaguauugguug

SEQ ID NO: 331976 - RNA, 22 nt, Homo sapiens
uauggccugaauuagaaaagug

SEQ ID NO: 331977 - RNA, 22 nt, Homo sapiens
uauggccugcguccagugguau

SEQ ID NO: 331978 - RNA, 22 nt, Homo sapiens
uauggcuucuauaaggaagcuu

SEQ ID NO: 331979 - RNA, 22 nt, Homo sapiens
uauggcuuuuauuauguuguag

SEQ ID NO: 331980 - RNA, 22 nt, Homo sapiens
uaugugcuuuguuaaacagaug

SEQ ID NO: 331981 - RNA, 22 nt, Homo sapiens
uaugugguuaauaggaauuugu

SEQ ID NO: 331982 - RNA, 22 nt, Homo sapiens
uauuacuugucugugucucaau

SEQ ID NO: 331983 - RNA, 22 nt, Homo sapiens
uauuagguuggugcaaaaguaa

SEQ ID NO: 331984 - RNA, 22 nt, Homo sapiens
uauuaguuguaugauucccaag

SEQ ID NO: 331985 - RNA, 22 nt, Homo sapiens
uauugaacgugggauauugaag

SEQ ID NO: 331986 - RNA, 22 nt, Homo sapiens
uauugaauuuuuaagcccuuug

SEQ ID NO: 331987 - RNA, 22 nt, Homo sapiens
uauugauuuucaguguucagcu

SEQ ID NO: 331988 - RNA, 22 nt, Homo sapiens
uauugcaacagaagaaagaguc

SEQ ID NO: 331989 - RNA, 22 nt, Homo sapiens
uauugcagugagauccaucugg

SEQ ID NO: 331990 - RNA, 22 nt, Homo sapiens
uauugcuugaggaaaugguaau

SEQ ID NO: 331991 - RNA, 22 nt, Homo sapiens
uauugcuuuuaacccaaucucu

SEQ ID NO: 331992 - RNA, 22 nt, Homo sapiens
uauugcuuuugauucaaggcag

SEQ ID NO: 331993 - RNA, 22 nt, Homo sapiens
uauuugauugacuuuagcagga

SEQ ID NO: 331994 - RNA, 22 nt, Homo sapiens
uauuugcacucccaucauggug

SEQ ID NO: 331995 - RNA, 22 nt, Homo sapiens
uauuugguagcuauuuugcagu

SEQ ID NO: 331996 - RNA, 22 nt, Homo sapiens
uauuuguccccuccaaaaguca

SEQ ID NO: 331997 - RNA, 20 nt, Homo sapiens
ucaaaguaugcucugcacua

SEQ ID NO: 331998 - RNA, 22 nt, Homo sapiens
ucaaagugagcuccuucucacu

SEQ ID NO: 331999 - RNA, 22 nt, Homo sapiens
ucaaaugcacguagagaaaaua

SEQ ID NO: 332000 - RNA, 22 nt, Homo sapiens
ucaaauguucccuguacuggcc

SEQ ID NO: 332001 - RNA, 22 nt, Homo sapiens
ucaaauguuuguuuaaggcuua

SEQ ID NO: 332002 - RNA, 22 nt, Homo sapiens
ucaaauuccaagucuagguagg

SEQ ID NO: 332003 - RNA, 22 nt, Homo sapiens
ucaacugcuugagaucacaaau

SEQ ID NO: 332004 - RNA, 21 nt, Homo sapiens
ucaaggaguauacguaugcca

SEQ ID NO: 332005 - RNA, 22 nt, Homo sapiens
ucaagguacguugccucagauu

SEQ ID NO: 332006 - RNA, 22 nt, Homo sapiens
ucaagugauucuugugccuuag

SEQ ID NO: 332007 - RNA, 18 nt, Homo sapiens
ucaauguggauguucuuu

SEQ ID NO: 332008 - RNA, 22 nt, Homo sapiens
ucacaagugagaggaauuagau

SEQ ID NO: 332009 - RNA, 22 nt, Homo sapiens
ucacaccauucuucuacuucag

SEQ ID NO: 332010 - RNA, 22 nt, Homo sapiens
ucacacugcaucuguuggaauu

SEQ ID NO: 332011 - RNA, 22 nt, Homo sapiens
ucacagccuaguuuuauacauu

SEQ ID NO: 332012 - RNA, 22 nt, Homo sapiens
ucacaguaacuuuguugcuuuu

SEQ ID NO: 332013 - RNA, 22 nt, Homo sapiens
ucacaguagggaacugacaaag

SEQ ID NO: 332014 - RNA, 22 nt, Homo sapiens
ucacaguaucaugggggacaga

SEQ ID NO: 332015 - RNA, 22 nt, Homo sapiens
ucacaguauucaugaacaugga

SEQ ID NO: 332016 - RNA, 20 nt, Homo sapiens
ucacagucacacauaauccu

SEQ ID NO: 332017 - RNA, 22 nt, Homo sapiens
ucacaguccuguuuaggagagg

SEQ ID NO: 332018 - RNA, 22 nt, Homo sapiens
ucacagucggugacuucuugcu

SEQ ID NO: 332019 - RNA, 22 nt, Homo sapiens
ucacauagcauaaugucugcaa

SEQ ID NO: 332020 - RNA, 22 nt, Homo sapiens
ucacaugaagauuuuaguauac

SEQ ID NO: 332021 - RNA, 22 nt, Homo sapiens
ucacaugcacaucucuggaacc

SEQ ID NO: 332022 - RNA, 22 nt, Homo sapiens
ucacauggaggugauaguugaa

SEQ ID NO: 332023 - RNA, 22 nt, Homo sapiens
ucacauggauuaacucauuuau

SEQ ID NO: 332024 - RNA, 22 nt, Homo sapiens
ucacaugugaagauugggagua

SEQ ID NO: 332025 - RNA, 22 nt, Homo sapiens
ucacauucaauuguaauccccg

SEQ ID NO: 332026 - RNA, 22 nt, Homo sapiens
ucacauuguguagccugcucac

SEQ ID NO: 332027 - RNA, 22 nt, Homo sapiens
ucaccaguaauaaagagccugc

SEQ ID NO: 332028 - RNA, 22 nt, Homo sapiens
ucaccuggagagcuugcuaaua

SEQ ID NO: 332029 - RNA, 22 nt, Homo sapiens
ucaccuggggaucuuguuuaca

SEQ ID NO: 332030 - RNA, 21 nt, Homo sapiens
ucaccuguugcgaugaagcug

SEQ ID NO: 332031 - RNA, 23 nt, Homo sapiens
ucacggagaccugcaagaccaau

SEQ ID NO: 332032 - RNA, 23 nt, Homo sapiens
ucacuagaguccuggaguuugag

SEQ ID NO: 332033 - RNA, 22 nt, Homo sapiens
ucacuagaucaagggagagaaa

SEQ ID NO: 332034 - RNA, 22 nt, Homo sapiens
ucacuaggcuggagugcagugg

SEQ ID NO: 332035 - RNA, 22 nt, Homo sapiens
ucacugaaaccgccuccaccuc

SEQ ID NO: 332036 - RNA, 22 nt, Homo sapiens
ucacugaaacuguccuggguua

SEQ ID NO: 332037 - RNA, 20 nt, Homo sapiens
ucacugagugguccacagua

SEQ ID NO: 332038 - RNA, 22 nt, Homo sapiens
ucacugcacuccagccuuuaug

SEQ ID NO: 332039 - RNA, 22 nt, Homo sapiens
ucacugcacucuccgccuugcg

SEQ ID NO: 332040 - RNA, 19 nt, Homo sapiens
ucacuggacagcacacuca

SEQ ID NO: 332041 - RNA, 21 nt, Homo sapiens
uggaaguguacaauuauaccc

SEQ ID NO: 332042 - RNA, 22 nt, Homo sapiens
uggaaguuaaauuaguugauga

SEQ ID NO: 332043 - RNA, 20 nt, Homo sapiens
uggaaugcagccuccuucug

SEQ ID NO: 332044 - RNA, 22 nt, Homo sapiens
uggaaugcuaagcaugugggag

SEQ ID NO: 332045 - RNA, 22 nt, Homo sapiens
uggaaugcucuccccacggacu

SEQ ID NO: 332046 - RNA, 22 nt, Homo sapiens
uggaaugguaucuuguuggggu

SEQ ID NO: 332047 - RNA, 22 nt, Homo sapiens
uggaaugucuauguuuuugauu

SEQ ID NO: 332048 - RNA, 22 nt, Homo sapiens
uggaauuuacuuauuuaggggc

SEQ ID NO: 332049 - RNA, 21 nt, Homo sapiens
uggaccccuuccuugcaccau

SEQ ID NO: 332050 - RNA, 22 nt, Homo sapiens
uggacuguaaauuggggacucu

SEQ ID NO: 332051 - RNA, 22 nt, Homo sapiens
uggacuguaauuuuauaggcau

SEQ ID NO: 332052 - RNA, 22 nt, Homo sapiens
uggagagugauaaguaaaugga

SEQ ID NO: 332053 - RNA, 22 nt, Homo sapiens
uggagcccuaguuccucauaac

SEQ ID NO: 332054 - RNA, 22 nt, Homo sapiens
uggaggacugcagaacugaggc

SEQ ID NO: 332055 - RNA, 22 nt, Homo sapiens
uggagggcuagucauuucuuuu

SEQ ID NO: 332056 - RNA, 22 nt, Homo sapiens
uggaguaggccuaagaaugaca

SEQ ID NO: 332057 - RNA, 20 nt, Homo sapiens
uggagugcuguguugagaag

SEQ ID NO: 332058 - RNA, 22 nt, Homo sapiens
uggaguguaaauuaguucagcc

SEQ ID NO: 332059 - RNA, 22 nt, Homo sapiens
uggagugucaguuuccagaguu

SEQ ID NO: 332060 - RNA, 22 nt, Homo sapiens
uggauugagaagcuguggcuca

SEQ ID NO: 332061 - RNA, 22 nt, Homo sapiens
uggcaaaauauuuugguuucug

SEQ ID NO: 332062 - RNA, 22 nt, Homo sapiens
uggcaaaauggaauauguuggg

SEQ ID NO: 332063 - RNA, 22 nt, Homo sapiens
uggcaaauagcaauaggagggu

SEQ ID NO: 332064 - RNA, 22 nt, Homo sapiens
uggcaagaaccacaguuacuuu

SEQ ID NO: 332065 - RNA, 22 nt, Homo sapiens
uggcaagaacgaaauguagggu

SEQ ID NO: 332066 - RNA, 20 nt, Homo sapiens
uggcaagauggcagaauaga

SEQ ID NO: 332067 - RNA, 22 nt, Homo sapiens
uggcaagcuuuaauugacucuu

SEQ ID NO: 332068 - RNA, 22 nt, Homo sapiens
uggcaccugacuccgagaugca

SEQ ID NO: 332069 - RNA, 22 nt, Homo sapiens
uggcacuggagauacauuaaua

SEQ ID NO: 332070 - RNA, 22 nt, Homo sapiens
uggcagauagaaaugugguuaa

SEQ ID NO: 332071 - RNA, 22 nt, Homo sapiens
uggcaggugcacuggcuuugaa

SEQ ID NO: 332072 - RNA, 22 nt, Homo sapiens
uggcaguuuacaaaugccauga

SEQ ID NO: 332073 - RNA, 22 nt, Homo sapiens
uggcaguuuacagcuuuaggag

SEQ ID NO: 332074 - RNA, 22 nt, Homo sapiens
uggcaguuuuaugugguucaac

SEQ ID NO: 332075 - RNA, 22 nt, Homo sapiens
uggcauauaaagauguguucaa

SEQ ID NO: 332076 - RNA, 22 nt, Homo sapiens
uggcaugauauauauucguuug

SEQ ID NO: 332077 - RNA, 22 nt, Homo sapiens
uggcauggaaagcuuuucauac

SEQ ID NO: 332078 - RNA, 22 nt, Homo sapiens
uggcauuuugugugaauuagaa

SEQ ID NO: 332079 - RNA, 23 nt, Homo sapiens
uggcauuuuuggcaaugccuucu

SEQ ID NO: 332080 - RNA, 22 nt, Homo sapiens
uggccuguaacccucucauagg

SEQ ID NO: 332081 - RNA, 22 nt, Homo sapiens
uggcgagaaaccauaugcuuuc

SEQ ID NO: 332082 - RNA, 22 nt, Homo sapiens
uggcggagacauggacuucaga

SEQ ID NO: 332083 - RNA, 22 nt, Homo sapiens
uggcuacagaaaguacuaguga

SEQ ID NO: 332084 - RNA, 22 nt, Homo sapiens
uggcuagauauccagaguucug

SEQ ID NO: 332085 - RNA, 22 nt, Homo sapiens
uggcucauuucuaaacccagcu

SEQ ID NO: 332086 - RNA, 22 nt, Homo sapiens
uggcucuguuuguuaacuagac

SEQ ID NO: 332087 - RNA, 22 nt, Homo sapiens
uggcuguuuauuucaccugggu

SEQ ID NO: 332088 - RNA, 20 nt, Homo sapiens
uggcuucuuaauugcaggca

SEQ ID NO: 332089 - RNA, 22 nt, Homo sapiens
uggcuuuuauuauguugaggua

SEQ ID NO: 332090 - RNA, 22 nt, Homo sapiens
ugggaaauguagccuagcugug

SEQ ID NO: 332091 - RNA, 20 nt, Homo sapiens
ugggaacaugugguauaugg

SEQ ID NO: 332092 - RNA, 22 nt, Homo sapiens
ugggaagcugcauuuuaacaag

SEQ ID NO: 332093 - RNA, 22 nt, Homo sapiens
ugggaaugaaauuacauagcuu

SEQ ID NO: 332094 - RNA, 22 nt, Homo sapiens
ugggaccccuacucuuuccaca

SEQ ID NO: 332095 - RNA, 22 nt, Homo sapiens
ugggagcauugcauuagaagcc

SEQ ID NO: 332096 - RNA, 22 nt, Homo sapiens
ugggcagugggacagcuuugug

SEQ ID NO: 332097 - RNA, 22 nt, Homo sapiens
ugggguaggccugguuaugugc

SEQ ID NO: 332098 - RNA, 22 nt, Homo sapiens
ugggguaggcuguauacucugu

SEQ ID NO: 332099 - RNA, 22 nt, Homo sapiens
uggguagaugaauccauuccaa

SEQ ID NO: 332100 - RNA, 22 nt, Homo sapiens
ugggugugaccgcucaaggggg

SEQ ID NO: 332101 - RNA, 22 nt, Homo sapiens
ugguaaaaugucauuuaccaga

SEQ ID NO: 332102 - RNA, 22 nt, Homo sapiens
ugguaagaucugugagccaggc

SEQ ID NO: 332103 - RNA, 22 nt, Homo sapiens
uggucaccuucuugcucugucu

SEQ ID NO: 332104 - RNA, 22 nt, Homo sapiens
uggucaguugugccucaauucc

SEQ ID NO: 332105 - RNA, 22 nt, Homo sapiens
uggucauggggcagcugacacu

SEQ ID NO: 332106 - RNA, 22 nt, Homo sapiens
ugguccaguucugugauauugc

SEQ ID NO: 332107 - RNA, 21 nt, Homo sapiens
uggucccuucagaucggauuu

SEQ ID NO: 332108 - RNA, 22 nt, Homo sapiens
uggugcaaugaagugaucucaa

SEQ ID NO: 332109 - RNA, 22 nt, Homo sapiens
ugguggcuuuucguagguucac

SEQ ID NO: 332110 - RNA, 23 nt, Homo sapiens
ugguuuguaagagauggacugga

SEQ ID NO: 332111 - RNA, 22 nt, Homo sapiens
uguaaugaucaaaucagaguaa

SEQ ID NO: 332112 - RNA, 22 nt, Homo sapiens
uguagacaccaaagacagcaua

SEQ ID NO: 332113 - RNA, 21 nt, Homo sapiens
uguagcagcaugauucauagu

SEQ ID NO: 332114 - RNA, 22 nt, Homo sapiens
uguauagaucugauucaucucc

SEQ ID NO: 332115 - RNA, 22 nt, Homo sapiens
uguauauguuuguacauauguc

SEQ ID NO: 332116 - RNA, 22 nt, Homo sapiens
uguauguugggucaaaguacau

SEQ ID NO: 332117 - RNA, 22 nt, Homo sapiens
ugucaagaaaucaaggugugag

SEQ ID NO: 332118 - RNA, 22 nt, Homo sapiens
ugucacccuuuauccauuuccu

SEQ ID NO: 332119 - RNA, 22 nt, Homo sapiens
ugucacugugcagucaugcauu

SEQ ID NO: 332120 - RNA, 22 nt, Homo sapiens
ugucagaaucuagaggcugcua

SEQ ID NO: 332121 - RNA, 22 nt, Homo sapiens
ugucaggaggguccagagaaaa

SEQ ID NO: 332122 - RNA, 22 nt, Homo sapiens
ugucaguggucuggaugcagcc

SEQ ID NO: 332123 - RNA, 22 nt, Homo sapiens
ugucauggauucugagucuggg

SEQ ID NO: 332124 - RNA, 22 nt, Homo sapiens
ugucaugucuuuguguaucaau

SEQ ID NO: 332125 - RNA, 22 nt, Homo sapiens
ugucauguugguguacugcacc

SEQ ID NO: 332126 - RNA, 22 nt, Homo sapiens
uguccaaaucagagguaccaaa

SEQ ID NO: 332127 - RNA, 20 nt, Homo sapiens
ugucccaaccccauggguuc

SEQ ID NO: 332128 - RNA, 18 nt, Homo sapiens
ugucccuuugcuguucau

SEQ ID NO: 332129 - RNA, 22 nt, Homo sapiens
uucaaguaguucucaugccuca

SEQ ID NO: 332130 - RNA, 22 nt, Homo sapiens
uucaagucaacaagcacuugag

SEQ ID NO: 332131 - RNA, 22 nt, Homo sapiens
uucaagugaacaaaaugaggag

SEQ ID NO: 332132 - RNA, 22 nt, Homo sapiens
uucaauacuguugauccuuaug

SEQ ID NO: 332133 - RNA, 22 nt, Homo sapiens
uucaauuaauauuauacucuca

SEQ ID NO: 332134 - RNA, 22 nt, Homo sapiens
uucacagucacccuucuccaug

SEQ ID NO: 332135 - RNA, 22 nt, Homo sapiens
uucacaugguugccuuuugauc

SEQ ID NO: 332136 - RNA, 22 nt, Homo sapiens
uucaccagggaagucucaacuc

SEQ ID NO: 332137 - RNA, 22 nt, Homo sapiens
uucacccugguuguagauggac

SEQ ID NO: 332138 - RNA, 22 nt, Homo sapiens
uucacugagccagacuaagaca

SEQ ID NO: 332139 - RNA, 22 nt, Homo sapiens
uucacuguagcuuggauguuua

SEQ ID NO: 332140 - RNA, 22 nt, Homo sapiens
uucacugugugacccugggcca

SEQ ID NO: 332141 - RNA, 22 nt, Homo sapiens
uucacuguuaagcaguuaaacu

SEQ ID NO: 332142 - RNA, 22 nt, Homo sapiens
uucagacugggugaagagggua

SEQ ID NO: 332143 - RNA, 22 nt, Homo sapiens
uucagagagggagggauaccua

SEQ ID NO: 332144 - RNA, 22 nt, Homo sapiens
uucagaugcacacuguagucua

SEQ ID NO: 332145 - RNA, 20 nt, Homo sapiens
uucagcaaaggaaugggagu

SEQ ID NO: 332146 - RNA, 22 nt, Homo sapiens
uucagcacugaaaauaugucau

SEQ ID NO: 332147 - RNA, 22 nt, Homo sapiens
uucaggcaccauugucauugau

SEQ ID NO: 332148 - RNA, 22 nt, Homo sapiens
uucaggcuccugugagaaucua

SEQ ID NO: 332149 - RNA, 22 nt, Homo sapiens
uucagggcauuggaguuucuga

SEQ ID NO: 332150 - RNA, 22 nt, Homo sapiens
uucaguggacuuaguagugcuu

SEQ ID NO: 332151 - RNA, 22 nt, Homo sapiens
uucagugucauuaacacaguag

SEQ ID NO: 332152 - RNA, 18 nt, Homo sapiens
uucaguuuguaucugggg

SEQ ID NO: 332153 - RNA, 22 nt, Homo sapiens
uucaucaguuauauuggccuga

SEQ ID NO: 332154 - RNA, 22 nt, Homo sapiens
uucauggaguuuaaauuguagu

SEQ ID NO: 332155 - RNA, 22 nt, Homo sapiens
uucauggguuaauuuguucgau

SEQ ID NO: 332156 - RNA, 22 nt, Homo sapiens
uucauguaauauuucacagcuu

SEQ ID NO: 332157 - RNA, 22 nt, Homo sapiens
uucauguaauuccauaagguaa

SEQ ID NO: 332158 - RNA, 22 nt, Homo sapiens
uuccacaggguugaacuaguuu

SEQ ID NO: 332159 - RNA, 20 nt, Homo sapiens
uuccagcacauuagggaagc

SEQ ID NO: 332160 - RNA, 22 nt, Homo sapiens
uuccagcugggggcaacucugc

SEQ ID NO: 332161 - RNA, 21 nt, Homo sapiens
uuccagugagccuagaugccu

SEQ ID NO: 332162 - RNA, 22 nt, Homo sapiens
uuccaguguuugacucaccuuu

SEQ ID NO: 332163 - RNA, 22 nt, Homo sapiens
uuccaugagaugcaucaaagcu

SEQ ID NO: 332164 - RNA, 22 nt, Homo sapiens
uucccagagagggacuucuaau

SEQ ID NO: 332165 - RNA, 22 nt, Homo sapiens
uucccaguaaacucuaucccuc

SEQ ID NO: 332166 - RNA, 22 nt, Homo sapiens
uucccucagaaacacacagccc

SEQ ID NO: 332167 - RNA, 22 nt, Homo sapiens
uucccugugggaguaggaaagu

SEQ ID NO: 332168 - RNA, 22 nt, Homo sapiens
uucccuuugaauuggaaaggug

SEQ ID NO: 332169 - RNA, 22 nt, Homo sapiens
uucccuuuuuucuaguagguag

SEQ ID NO: 332170 - RNA, 22 nt, Homo sapiens
uuccuacugcccauuaaaaugg

SEQ ID NO: 332171 - RNA, 22 nt, Homo sapiens
uuccugagagggcugggugcag

SEQ ID NO: 332172 - RNA, 22 nt, Homo sapiens
uuccugagccuuguaucuagua

SEQ ID NO: 332173 - RNA, 22 nt, Homo sapiens
uuccuugagaaaguacaaggcu

SEQ ID NO: 332174 - RNA, 22 nt, Homo sapiens
uuccuuguuuauuuacaggagg

SEQ ID NO: 332175 - RNA, 22 nt, Homo sapiens
uucgagagaaaaggcauauaug

SEQ ID NO: 332176 - RNA, 22 nt, Homo sapiens
uucuacaggcuguucaagaagc

SEQ ID NO: 332177 - RNA, 22 nt, Homo sapiens
uucuacagugacugcagccaua

SEQ ID NO: 332178 - RNA, 22 nt, Homo sapiens
uucuagcaauggcagagugucu

SEQ ID NO: 332179 - RNA, 22 nt, Homo sapiens
uucuauguuugaaaaugccaaa

SEQ ID NO: 332180 - RNA, 22 nt, Homo sapiens
uucuauugguaauauuuucugu

SEQ ID NO: 332181 - RNA, 22 nt, Homo sapiens
uucucagcccccugacagucag

SEQ ID NO: 332182 - RNA, 21 nt, Homo sapiens
uucucaggguguguccuaccc

SEQ ID NO: 332183 - RNA, 22 nt, Homo sapiens
uucucuggucagaggggagguu

SEQ ID NO: 332184 - RNA, 22 nt, Homo sapiens
uucucuguggauugggugagag

SEQ ID NO: 332185 - RNA, 22 nt, Homo sapiens
uucugauggaguaguccacaga

SEQ ID NO: 332186 - RNA, 22 nt, Homo sapiens
uucuggccccucccaaucucau

SEQ ID NO: 332187 - RNA, 22 nt, Homo sapiens
uucuggccuccauuuuucuccu

SEQ ID NO: 332188 - RNA, 22 nt, Homo sapiens
uucugugcuuguggaugaagug

SEQ ID NO: 332189 - RNA, 22 nt, Homo sapiens
uucugugguuucauuuaccugu

SEQ ID NO: 332190 - RNA, 22 nt, Homo sapiens
uucuucaggccacaaaaauggu

SEQ ID NO: 332191 - RNA, 22 nt, Homo sapiens
uucuucaguuacaacaaggggg

SEQ ID NO: 332192 - RNA, 22 nt, Homo sapiens
uucuugcacugaucccauaagc

SEQ ID NO: 332193 - RNA, 22 nt, Homo sapiens
uucuugcugaauugugcccuuc

SEQ ID NO: 332194 - RNA, 22 nt, Homo sapiens
uucuuuggauaaaguuuuaugc

SEQ ID NO: 332195 - RNA, 22 nt, Homo sapiens
uugaaagacagaggggcaaguu

SEQ ID NO: 332196 - RNA, 22 nt, Homo sapiens
uugaaagcuaucucaaaucgcu

SEQ ID NO: 332197 - RNA, 22 nt, Homo sapiens
uugaaguguguauacauugugg

SEQ ID NO: 332198 - RNA, 22 nt, Homo sapiens
uugaauaggcucaugcuuauca

SEQ ID NO: 332199 - RNA, 22 nt, Homo sapiens
uugaauaguggugaaaguuuga

SEQ ID NO: 332200 - RNA, 18 nt, Homo sapiens
uugaauaguguccaaucu

SEQ ID NO: 332201 - RNA, 22 nt, Homo sapiens
uugacaggaugcucagggccca

SEQ ID NO: 332202 - RNA, 22 nt, Homo sapiens
uugacauauuugugcuuaagaa

SEQ ID NO: 332203 - RNA, 23 nt, Homo sapiens
uugacuguggguacaaugugaua

SEQ ID NO: 332204 - RNA, 22 nt, Homo sapiens
uugacugugguaauggaagcug

SEQ ID NO: 332205 - RNA, 22 nt, Homo sapiens
uugacuucagagcugauucaag

SEQ ID NO: 332206 - RNA, 22 nt, Homo sapiens
uugagaagugucuguucauguc

SEQ ID NO: 332207 - RNA, 22 nt, Homo sapiens
uugagagaaaaaauuuauuggu

SEQ ID NO: 332208 - RNA, 22 nt, Homo sapiens
uugagagcugaugaaagauaaa

SEQ ID NO: 332209 - RNA, 22 nt, Homo sapiens
uugagauaggaacucacuaugc

SEQ ID NO: 332210 - RNA, 22 nt, Homo sapiens
uugagaucaugcuacugcacuc

SEQ ID NO: 332211 - RNA, 22 nt, Homo sapiens
uugagauggagucucacuccuu

SEQ ID NO: 332212 - RNA, 22 nt, Homo sapiens
uugagauggagucucacucugc

SEQ ID NO: 332213 - RNA, 22 nt, Homo sapiens
uugagauggagucucacucuuu

SEQ ID NO: 332214 - RNA, 22 nt, Homo sapiens
uugagauggagucucgcugugu

SEQ ID NO: 332215 - RNA, 22 nt, Homo sapiens
uugagauguauguauauaaugu

SEQ ID NO: 332216 - RNA, 19 nt, Homo sapiens
uugagaugugaacucacac

SEQ ID NO: 332217 - RNA, 22 nt, Homo sapiens
aggugcucuuccuguaggucac

SEQ ID NO: 332218 - RNA, 22 nt, Homo sapiens
aggugguuuugaugagcaggua

SEQ ID NO: 332219 - RNA, 21 nt, Homo sapiens
aggugucuuggguucccuggc

SEQ ID NO: 332220 - RNA, 22 nt, Homo sapiens
aguaaucaucugagggcagaaa

SEQ ID NO: 332221 - RNA, 22 nt, Homo sapiens
agucaaaugcuuauguauaaag

SEQ ID NO: 332222 - RNA, 22 nt, Homo sapiens
agucacagugaccuugucugac

SEQ ID NO: 332223 - RNA, 22 nt, Homo sapiens
agucauggcagaaggcaccucu

SEQ ID NO: 332224 - RNA, 22 nt, Homo sapiens
aguccagguuuuguaauggcaa

SEQ ID NO: 332225 - RNA, 22 nt, Homo sapiens
agugaaaucugaagaaggucau

SEQ ID NO: 332226 - RNA, 22 nt, Homo sapiens
agugaacaaagaagugcagaua

SEQ ID NO: 332227 - RNA, 17 nt, Homo sapiens
agugagaucauggcuua

SEQ ID NO: 332228 - RNA, 22 nt, Homo sapiens
agugauggagccaggauuuaau

SEQ ID NO: 332229 - RNA, 22 nt, Homo sapiens
agugcaaugauccggugcuggg

SEQ ID NO: 332230 - RNA, 22 nt, Homo sapiens
agugcaguggcacaaucuuggc

SEQ ID NO: 332231 - RNA, 22 nt, Homo sapiens
agugccauggcugcuagauggc

SEQ ID NO: 332232 - RNA, 22 nt, Homo sapiens
aguggaaucuguuauacuaacu

SEQ ID NO: 332233 - RNA, 22 nt, Homo sapiens
aguggauguuguggccugggag

SEQ ID NO: 332234 - RNA, 22 nt, Homo sapiens
agugggccccuagaggugaggu

SEQ ID NO: 332235 - RNA, 19 nt, Homo sapiens
agugucauggucauuauuu

SEQ ID NO: 332236 - RNA, 22 nt, Homo sapiens
aguguuuuucaugggauacuuu

SEQ ID NO: 332237 - RNA, 22 nt, Homo sapiens
aguucaaaucgagccuggccau

SEQ ID NO: 332238 - RNA, 22 nt, Homo sapiens
auaaacugucaguggagaguaa

SEQ ID NO: 332239 - RNA, 22 nt, Homo sapiens
auaaagcaagucucuggccuca

SEQ ID NO: 332240 - RNA, 20 nt, Homo sapiens
uggaggucaucugucacuac

SEQ ID NO: 332241 - RNA, 22 nt, Homo sapiens
uggagugcaauggcaccaucuu

SEQ ID NO: 332242 - RNA, 22 nt, Homo sapiens
uggagugcgagggugaaacuuu

SEQ ID NO: 332243 - RNA, 22 nt, Homo sapiens
uggagugcgugucugaguuuuu

SEQ ID NO: 332244 - RNA, 22 nt, Homo sapiens
uggaguguguugcagaugaagg

SEQ ID NO: 332245 - RNA, 22 nt, Homo sapiens
uggaguguuggggcaggaucuc

SEQ ID NO: 332246 - RNA, 22 nt, Homo sapiens
uggauaguuuacugaagagugg

SEQ ID NO: 332247 - RNA, 22 nt, Homo sapiens
uggauauguuuauuacccugaa

SEQ ID NO: 332248 - RNA, 21 nt, Homo sapiens
uggcaaaaugggcaguggguu

SEQ ID NO: 332249 - RNA, 22 nt, Homo sapiens
uggcaacaucuggggacauguu

SEQ ID NO: 332250 - RNA, 22 nt, Homo sapiens
uggcaagcaggacuaaagcacc

SEQ ID NO: 332251 - RNA, 19 nt, Homo sapiens
uggcaaugucagcagagau

SEQ ID NO: 332252 - RNA, 22 nt, Homo sapiens
uggcagaugcucuuggugccca

SEQ ID NO: 332253 - RNA, 22 nt, Homo sapiens
uggcagaugggugagcuggaga

SEQ ID NO: 332254 - RNA, 22 nt, Homo sapiens
uggcagauggugacaccauuag

SEQ ID NO: 332255 - RNA, 22 nt, Homo sapiens
uggcagcgugaauguggcugaa

SEQ ID NO: 332256 - RNA, 22 nt, Homo sapiens
uggcaguuucacauggcucaac

SEQ ID NO: 332257 - RNA, 22 nt, Homo sapiens
uggcaguuucauaugguucaac

SEQ ID NO: 332258 - RNA, 17 nt, Homo sapiens
uauguaguacuuauaaa

SEQ ID NO: 332259 - RNA, 19 nt, Homo sapiens
uauguaguuuucucaauau

SEQ ID NO: 332260 - RNA, 18 nt, Homo sapiens
uauuaagcuagauauuau

SEQ ID NO: 332261 - RNA, 22 nt, Homo sapiens
uauuagguuggugcaacaguaa

SEQ ID NO: 332262 - RNA, 20 nt, Homo sapiens
uauucacucuccagucuugc

SEQ ID NO: 332263 - RNA, 18 nt, Homo sapiens
uauuccucuuccucuauc

SEQ ID NO: 332264 - RNA, 22 nt, Homo sapiens
uauugaauuugagcugucucuu

SEQ ID NO: 332265 - RNA, 22 nt, Homo sapiens
uauugauuaauugugauuaggc

SEQ ID NO: 332266 - RNA, 22 nt, Homo sapiens
uauugcaauuggcagagugcua

SEQ ID NO: 332267 - RNA, 20 nt, Homo sapiens
uauugcacuccagucugggc

SEQ ID NO: 332268 - RNA, 22 nt, Homo sapiens
uauugucaccaucccuguuuua

SEQ ID NO: 332269 - RNA, 22 nt, Homo sapiens
uauuguuaaagauguuaaugau

SEQ ID NO: 332270 - RNA, 22 nt, Homo sapiens
uauuguuuuucccaggagucua

SEQ ID NO: 332271 - RNA, 22 nt, Homo sapiens
uauuucccuuaacuuuccugca

SEQ ID NO: 332272 - RNA, 22 nt, Homo sapiens
uauuugauuaacaagagccuaa

SEQ ID NO: 332273 - RNA, 22 nt, Homo sapiens
ucaaacauccccaccagggacu

SEQ ID NO: 332274 - RNA, 21 nt, Homo sapiens
ucaaaguguucuuuuguugaa

SEQ ID NO: 332275 - RNA, 22 nt, Homo sapiens
ucaaaugauucagaagccaccu

SEQ ID NO: 332276 - RNA, 22 nt, Homo sapiens
ucaacagugggcacuguaaaug

SEQ ID NO: 332277 - RNA, 22 nt, Homo sapiens
ucaaggcaguggccuuccuucu

SEQ ID NO: 332278 - RNA, 22 nt, Homo sapiens
ucaaguaguaacuaacugugac

SEQ ID NO: 332279 - RNA, 22 nt, Homo sapiens
ucaaugaaugaugguugguaug

SEQ ID NO: 332280 - RNA, 22 nt, Homo sapiens
ucaaugggcuacacauugagug

SEQ ID NO: 332281 - RNA, 22 nt, Homo sapiens
ucacaaagcuuggccugcuucu

SEQ ID NO: 332282 - RNA, 22 nt, Homo sapiens
ucacacucucaccaacauuugg

SEQ ID NO: 332283 - RNA, 22 nt, Homo sapiens
ucacacugucuugguuacucuu

SEQ ID NO: 332284 - RNA, 22 nt, Homo sapiens
ucacacuguuuugauuauuaua

SEQ ID NO: 332285 - RNA, 22 nt, Homo sapiens
ucacagacugagccaaauagag

SEQ ID NO: 332286 - RNA, 22 nt, Homo sapiens
ucacagaggagaagaccuuuaa

SEQ ID NO: 332287 - RNA, 22 nt, Homo sapiens
ucacagauaaauaaagaugauu

SEQ ID NO: 332288 - RNA, 22 nt, Homo sapiens
ucacagaugaggcgagaggcag

SEQ ID NO: 332289 - RNA, 22 nt, Homo sapiens
ucacaguagccccucccaucau

SEQ ID NO: 332290 - RNA, 22 nt, Homo sapiens
ucacagucugcgugaugagaca

SEQ ID NO: 332291 - RNA, 22 nt, Homo sapiens
ucacagugaguggaguggggug

SEQ ID NO: 332292 - RNA, 22 nt, Homo sapiens
ucacagugcaggaucaguuaau

SEQ ID NO: 332293 - RNA, 22 nt, Homo sapiens
ucacauagcugaguaaaaugga

SEQ ID NO: 332294 - RNA, 22 nt, Homo sapiens
ucacaucucagguuucuugaca

SEQ ID NO: 332295 - RNA, 22 nt, Homo sapiens
ucacauggaaaaguccaguaaa

SEQ ID NO: 332296 - RNA, 22 nt, Homo sapiens
ucacaugucagccguggggaag

SEQ ID NO: 332297 - RNA, 22 nt, Homo sapiens
ucacaugugcguuuuggcaugu

SEQ ID NO: 332298 - RNA, 22 nt, Homo sapiens
ucaccaccugcugaucauagag

SEQ ID NO: 332299 - RNA, 22 nt, Homo sapiens
ucaccaguacuccaaauugagg

SEQ ID NO: 332300 - RNA, 22 nt, Homo sapiens
ucacccugacaugcggccgaac

SEQ ID NO: 332301 - RNA, 22 nt, Homo sapiens
ucacccuguguuuugcguuugc

SEQ ID NO: 332302 - RNA, 22 nt, Homo sapiens
ucaccuggagaagauggaucau

SEQ ID NO: 332303 - RNA, 18 nt, Homo sapiens
ucaccuugaugcuggguc

SEQ ID NO: 332304 - RNA, 22 nt, Homo sapiens
ucacucagaccuggugauaugc

SEQ ID NO: 332305 - RNA, 22 nt, Homo sapiens
ucacugaaaccacugccuccug

SEQ ID NO: 332306 - RNA, 22 nt, Homo sapiens
ucacugaaaccuccaccucucg

SEQ ID NO: 332307 - RNA, 22 nt, Homo sapiens
ucacugaaaccuccgccuucug

SEQ ID NO: 332308 - RNA, 22 nt, Homo sapiens
ucacugagaaugauguuucuga

SEQ ID NO: 332309 - RNA, 22 nt, Homo sapiens
ucacugagcacaggagaugugc

SEQ ID NO: 332310 - RNA, 22 nt, Homo sapiens
ucacugagcuagaucacuugac

SEQ ID NO: 332311 - RNA, 22 nt, Homo sapiens
ucacugaggucugagcuuuaug

SEQ ID NO: 332312 - RNA, 20 nt, Homo sapiens
ucacugaguaucuacgauua

SEQ ID NO: 332313 - RNA, 22 nt, Homo sapiens
ucacuggaggagaggaagugga

SEQ ID NO: 332314 - RNA, 22 nt, Homo sapiens
ucacuguggaacucaaaaagcu

SEQ ID NO: 332315 - RNA, 22 nt, Homo sapiens
ucacuugguggcaaaguuuaug

SEQ ID NO: 332316 - RNA, 22 nt, Homo sapiens
ucacuuuguauagcgacuggcu

SEQ ID NO: 332317 - RNA, 22 nt, Homo sapiens
ucagacacugcccuccaccugu

SEQ ID NO: 332318 - RNA, 22 nt, Homo sapiens
ucagaguguuuuccaacuuggu

SEQ ID NO: 332319 - RNA, 22 nt, Homo sapiens
ucagaucuucagcaggggcccc

SEQ ID NO: 332320 - RNA, 22 nt, Homo sapiens
ucagcagucacuccuaugacaa

SEQ ID NO: 332321 - RNA, 21 nt, Homo sapiens
ucagcucaucacugccuggag

SEQ ID NO: 332322 - RNA, 22 nt, Homo sapiens
ucagggacgcuugacacaagcc

SEQ ID NO: 332323 - RNA, 22 nt, Homo sapiens
ucaggguacuuguggccaaagu

SEQ ID NO: 332324 - RNA, 22 nt, Homo sapiens
ucagguagcauuuuggaaacag

SEQ ID NO: 332325 - RNA, 23 nt, Homo sapiens
ucagguaggccuagaguauucuu

SEQ ID NO: 332326 - RNA, 20 nt, Homo sapiens
ucagguagggcuucaacauu

SEQ ID NO: 332327 - RNA, 22 nt, Homo sapiens
ucagguaguuugugggagauga

SEQ ID NO: 332328 - RNA, 22 nt, Homo sapiens
ucagguaucucuauagcaaugu

SEQ ID NO: 332329 - RNA, 22 nt, Homo sapiens
ucagguaucuucauagcaaugc

SEQ ID NO: 332330 - RNA, 19 nt, Homo sapiens
ucaguagugcacauaagcc

SEQ ID NO: 332331 - RNA, 22 nt, Homo sapiens
ucagucauucaauuguugaaug

SEQ ID NO: 332332 - RNA, 22 nt, Homo sapiens
ucagugaauguuggccacuacu

SEQ ID NO: 332333 - RNA, 22 nt, Homo sapiens
ucagugauugcuuucauggaaa

SEQ ID NO: 332334 - RNA, 20 nt, Homo sapiens
ucagugcagauuguccaagu

SEQ ID NO: 332335 - RNA, 21 nt, Homo sapiens
ucagugcugugggcaaggugc

SEQ ID NO: 332336 - RNA, 22 nt, Homo sapiens
ucaguggauuauuaaagucacc

SEQ ID NO: 332337 - RNA, 22 nt, Homo sapiens
ucaguucauggaggugucugcu

SEQ ID NO: 332338 - RNA, 20 nt, Homo sapiens
ucauagcuuuuuccacuuua

SEQ ID NO: 332339 - RNA, 22 nt, Homo sapiens
acugcacuccagccugccgaca

SEQ ID NO: 332340 - RNA, 22 nt, Homo sapiens
acugcacuccagccugcugaca

SEQ ID NO: 332341 - RNA, 22 nt, Homo sapiens
acugcacuccagccuggacgac

SEQ ID NO: 332342 - RNA, 20 nt, Homo sapiens
acugcacuccagucucuggg

SEQ ID NO: 332343 - RNA, 22 nt, Homo sapiens
acugcacuccaguuccgggcaa

SEQ ID NO: 332344 - RNA, 22 nt, Homo sapiens
acugcacucccgcccgggugac

SEQ ID NO: 332345 - RNA, 22 nt, Homo sapiens
acugcacugcagccuggccaac

SEQ ID NO: 332346 - RNA, 22 nt, Homo sapiens
acuggauguuagggauuuuauu

SEQ ID NO: 332347 - RNA, 22 nt, Homo sapiens
acuggcucugcuuuacaaacag

SEQ ID NO: 332348 - RNA, 22 nt, Homo sapiens
acuggcuuaaggaugggccacu

SEQ ID NO: 332349 - RNA, 22 nt, Homo sapiens
acuggcuuauuucacuuagcau

SEQ ID NO: 332350 - RNA, 22 nt, Homo sapiens
acuguacuccauccugggugac

SEQ ID NO: 332351 - RNA, 22 nt, Homo sapiens
acuguauagauggaguugauuu

SEQ ID NO: 332352 - RNA, 22 nt, Homo sapiens
acugugcuguuuuaauuauuga

SEQ ID NO: 332353 - RNA, 22 nt, Homo sapiens
acuuugguuuauagaauuuagg

SEQ ID NO: 332354 - RNA, 21 nt, Homo sapiens
agaaaaucuuaugggaaacau

SEQ ID NO: 332355 - RNA, 22 nt, Homo sapiens
agaaauguuuauucaaacccgu

SEQ ID NO: 332356 - RNA, 22 nt, Homo sapiens
agaauaauguccccccaaggga

SEQ ID NO: 332357 - RNA, 22 nt, Homo sapiens
agaaugauccuucucagaggca

SEQ ID NO: 332358 - RNA, 22 nt, Homo sapiens
agaauguaacucuaugaaggca

SEQ ID NO: 332359 - RNA, 22 nt, Homo sapiens
agaaugucagcuggauucagcu

SEQ ID NO: 332360 - RNA, 22 nt, Homo sapiens
agaaugugaacaucuugaaagu

SEQ ID NO: 332361 - RNA, 22 nt, Homo sapiens
agaauucugucauguuuauauu

SEQ ID NO: 332362 - RNA, 22 nt, Homo sapiens
agacaagauggcuugagguuca

SEQ ID NO: 332363 - RNA, 22 nt, Homo sapiens
agacacugaaauguauugaaga

SEQ ID NO: 332364 - RNA, 20 nt, Homo sapiens
agacagcugcagcccacauc

SEQ ID NO: 332365 - RNA, 22 nt, Homo sapiens
agacaguguguguauauauggu

SEQ ID NO: 332366 - RNA, 22 nt, Homo sapiens
agagaacugauuggaguugggc

SEQ ID NO: 332367 - RNA, 22 nt, Homo sapiens
agagaacuguuuacacguuaau

SEQ ID NO: 332368 - RNA, 22 nt, Homo sapiens
agagagcuuuaacuacccauuu

SEQ ID NO: 332369 - RNA, 22 nt, Homo sapiens
agagaucaacugaauuacugga

SEQ ID NO: 332370 - RNA, 22 nt, Homo sapiens
agagaugauuaacauuuuggua

SEQ ID NO: 332371 - RNA, 22 nt, Homo sapiens
agagcacugcugcaggguucug

SEQ ID NO: 332372 - RNA, 22 nt, Homo sapiens
agaggaguacuacuccaagucu

SEQ ID NO: 332373 - RNA, 22 nt, Homo sapiens
agaggucuuaucaaacaugcuu

SEQ ID NO: 332374 - RNA, 23 nt, Homo sapiens
agagguuuaaucaggcaguugcu

SEQ ID NO: 332375 - RNA, 22 nt, Homo sapiens
agagguuuugcccucgagauaa

SEQ ID NO: 332376 - RNA, 21 nt, Homo sapiens
agagucaucucuaucuguacc

SEQ ID NO: 332377 - RNA, 22 nt, Homo sapiens
agagugcuauagauuagauuuc

SEQ ID NO: 332378 - RNA, 22 nt, Homo sapiens
agaucauaugcaguaaugaacu

SEQ ID NO: 332379 - RNA, 22 nt, Homo sapiens
agaugcauugguggcauauuca

SEQ ID NO: 332380 - RNA, 22 nt, Homo sapiens
agaugccucauguucuagguuc

SEQ ID NO: 332381 - RNA, 22 nt, Homo sapiens
agauggugauaaaugugguacc

SEQ ID NO: 332382 - RNA, 22 nt, Homo sapiens
agauucauccaaguuguugcau

SEQ ID NO: 332383 - RNA, 22 nt, Homo sapiens
agcaagaaugaacucucccaga

SEQ ID NO: 332384 - RNA, 22 nt, Homo sapiens
agcaagacauggcuuccaaaug

SEQ ID NO: 332385 - RNA, 22 nt, Homo sapiens
agcaccaugggcugaguaagug

SEQ ID NO: 332386 - RNA, 22 nt, Homo sapiens
agcaccguucaaacccagguua

SEQ ID NO: 332387 - RNA, 22 nt, Homo sapiens
agcagcaugaggggacuucugc

SEQ ID NO: 332388 - RNA, 21 nt, Homo sapiens
agcagcuuugguugaagcaga

SEQ ID NO: 332389 - RNA, 22 nt, Homo sapiens
agcaguagugaaaguagacuua

SEQ ID NO: 332390 - RNA, 22 nt, Homo sapiens
agcagugucauuuucuggugag

SEQ ID NO: 332391 - RNA, 20 nt, Homo sapiens
agcaucauugcaauuuguca

SEQ ID NO: 332392 - RNA, 17 nt, Homo sapiens
agcauguguuugagauu

SEQ ID NO: 332393 - RNA, 22 nt, Homo sapiens
agcccauguggcugaggcuucu

SEQ ID NO: 332394 - RNA, 22 nt, Homo sapiens
agccuguagugagcugugauug

SEQ ID NO: 332395 - RNA, 22 nt, Homo sapiens
agcggcuguuccccuggucuau

SEQ ID NO: 332396 - RNA, 22 nt, Homo sapiens
agcuaaaucucauguugaauug

SEQ ID NO: 332397 - RNA, 21 nt, Homo sapiens
agcuaaauuggaaauuucugu

SEQ ID NO: 332398 - RNA, 22 nt, Homo sapiens
agcuagcauucauaguuugagg

SEQ ID NO: 332399 - RNA, 22 nt, Homo sapiens
agcucauugcuguccuggagga

SEQ ID NO: 332400 - RNA, 20 nt, Homo sapiens
agcuccauuccugaaggcug

SEQ ID NO: 332401 - RNA, 22 nt, Homo sapiens
agcuccauuguaaucaccuggu

SEQ ID NO: 332402 - RNA, 22 nt, Homo sapiens
agcuccuuucugcaggcagguc

SEQ ID NO: 332403 - RNA, 22 nt, Homo sapiens
agcugcaaagggagagaugauu

SEQ ID NO: 332404 - RNA, 22 nt, Homo sapiens
agcugcauucguaucauauugu

SEQ ID NO: 332405 - RNA, 22 nt, Homo sapiens
agcugcauuuacuuuugcacaa

SEQ ID NO: 332406 - RNA, 22 nt, Homo sapiens
agcuggauuguuuaccuggggc

SEQ ID NO: 332407 - RNA, 22 nt, Homo sapiens
aggaagacugaaauugcuguuc

SEQ ID NO: 332408 - RNA, 22 nt, Homo sapiens
aggaagcuagcauuuguucagu

SEQ ID NO: 332409 - RNA, 22 nt, Homo sapiens
aggaagguaaacuaacuugccu

SEQ ID NO: 332410 - RNA, 22 nt, Homo sapiens
aggaccauuguguagcagacau

SEQ ID NO: 332411 - RNA, 22 nt, Homo sapiens
aggagguaggaauugugcuagg

SEQ ID NO: 332412 - RNA, 22 nt, Homo sapiens
aggaucauugacuauuauaagg

SEQ ID NO: 332413 - RNA, 22 nt, Homo sapiens
aggcacgguggcucacaccugu

SEQ ID NO: 332414 - RNA, 22 nt, Homo sapiens
aggcagucugaguuuugaaagg

SEQ ID NO: 332415 - RNA, 22 nt, Homo sapiens
aggcaugauggcuccagaucau

SEQ ID NO: 332416 - RNA, 22 nt, Homo sapiens
aggccaguuuuuggagggaaac

SEQ ID NO: 332417 - RNA, 22 nt, Homo sapiens
aggcuuuauuacagggucucag

SEQ ID NO: 332418 - RNA, 22 nt, Homo sapiens
agggaagugugcuaugcauuua

SEQ ID NO: 332419 - RNA, 22 nt, Homo sapiens
agggagcaaaguggucuuucuc

SEQ ID NO: 332420 - RNA, 22 nt, Homo sapiens
agggcaguguuaggacugucug

SEQ ID NO: 332421 - RNA, 22 nt, Homo sapiens
agguagugugaugcuccuguuu

SEQ ID NO: 332422 - RNA, 21 nt, Homo sapiens
aggucaguaagaaugcagcac

SEQ ID NO: 332423 - RNA, 21 nt, Homo sapiens
aggucaugaagauguucuaau

SEQ ID NO: 332424 - RNA, 22 nt, Homo sapiens
agguccauuauuuucauucaug

SEQ ID NO: 332425 - RNA, 22 nt, Homo sapiens
aggugcacucagaaaacagaua

SEQ ID NO: 332426 - RNA, 22 nt, Homo sapiens
ugucugagacuguuuuacuuuc

SEQ ID NO: 332427 - RNA, 16 nt, Homo sapiens
ugucuguuugggcaca

SEQ ID NO: 332428 - RNA, 22 nt, Homo sapiens
ugucuuggagaauccuggguuu

SEQ ID NO: 332429 - RNA, 22 nt, Homo sapiens
ugucuuguagacaauguauagu

SEQ ID NO: 332430 - RNA, 22 nt, Homo sapiens
ugugaaauguuaucccgucgug

SEQ ID NO: 332431 - RNA, 22 nt, Homo sapiens
ugugaaugaagaaugcuaaccu

SEQ ID NO: 332432 - RNA, 22 nt, Homo sapiens
ugugaaugauggagugucgaau

SEQ ID NO: 332433 - RNA, 22 nt, Homo sapiens
ugugacagcacgguucaacugc

SEQ ID NO: 332434 - RNA, 22 nt, Homo sapiens
ugugacaguuaguuugguguua

SEQ ID NO: 332435 - RNA, 19 nt, Homo sapiens
ugugacugguugucucgcu

SEQ ID NO: 332436 - RNA, 21 nt, Homo sapiens
ugugacuguugcauuugucgu

SEQ ID NO: 332437 - RNA, 19 nt, Homo sapiens
ugugagcauuagcauuuag

SEQ ID NO: 332438 - RNA, 19 nt, Homo sapiens
ugugauaguugaaccugcc

SEQ ID NO: 332439 - RNA, 20 nt, Homo sapiens
ugugauuauuuaguugcaug

SEQ ID NO: 332440 - RNA, 22 nt, Homo sapiens
ugugauugauauauuuacagaa

SEQ ID NO: 332441 - RNA, 22 nt, Homo sapiens
ugugcaaauguuaaacuaacuu

SEQ ID NO: 332442 - RNA, 22 nt, Homo sapiens
ugugcaaauuagcacaacccga

SEQ ID NO: 332443 - RNA, 18 nt, Homo sapiens
ugugcaauauuaaccacc

SEQ ID NO: 332444 - RNA, 22 nt, Homo sapiens
ugugcaaucagcuucauuacau

SEQ ID NO: 332445 - RNA, 22 nt, Homo sapiens
ugugcacaaccugcagguuugu

SEQ ID NO: 332446 - RNA, 22 nt, Homo sapiens
ugugcacaaugugcagguuuga

SEQ ID NO: 332447 - RNA, 23 nt, Homo sapiens
uugcauagacauccucauagauu

SEQ ID NO: 332448 - RNA, 22 nt, Homo sapiens
uugcauagaccgaugucuugga

SEQ ID NO: 332449 - RNA, 22 nt, Homo sapiens
uugcaucagcaggcauaauugg

SEQ ID NO: 332450 - RNA, 22 nt, Homo sapiens
uugcaugggagcugggugaggc

SEQ ID NO: 332451 - RNA, 22 nt, Homo sapiens
uugccugagaagccaagaauaa

SEQ ID NO: 332452 - RNA, 22 nt, Homo sapiens
uugccuuuguuggaaacaagug

SEQ ID NO: 332453 - RNA, 22 nt, Homo sapiens
uugcucaggcuggaguacaaug

SEQ ID NO: 332454 - RNA, 22 nt, Homo sapiens
uuggaaacauuuaugguaacag

SEQ ID NO: 332455 - RNA, 22 nt, Homo sapiens
uuggaaauauguuaagugucau

SEQ ID NO: 332456 - RNA, 22 nt, Homo sapiens
uuggaagacauucugucugcua

SEQ ID NO: 332457 - RNA, 22 nt, Homo sapiens
uuggaauacuuguuaaagucca

SEQ ID NO: 332458 - RNA, 22 nt, Homo sapiens
uuggaauauaaccuguuucuaa

SEQ ID NO: 332459 - RNA, 22 nt, Homo sapiens
uuggaauuuauuuggaugggag

SEQ ID NO: 332460 - RNA, 19 nt, Homo sapiens
uuggaauuuuagaguuuga

SEQ ID NO: 332461 - RNA, 22 nt, Homo sapiens
uuggacaagauugcagagaauu

SEQ ID NO: 332462 - RNA, 22 nt, Homo sapiens
uuggacuaagaacuuaaaauaa

SEQ ID NO: 332463 - RNA, 22 nt, Homo sapiens
uuggacugagaguuccaccauu

SEQ ID NO: 332464 - RNA, 22 nt, Homo sapiens
uuggagagugauauucagaugc

SEQ ID NO: 332465 - RNA, 22 nt, Homo sapiens
uuggagcacuggggcacugaca

SEQ ID NO: 332466 - RNA, 22 nt, Homo sapiens
uuggaguguucugguccgggcu

SEQ ID NO: 332467 - RNA, 22 nt, Homo sapiens
uuggaugauaaagaagccuaag

SEQ ID NO: 332468 - RNA, 22 nt, Homo sapiens
uuggcaaagaggaaugccacuu

SEQ ID NO: 332469 - RNA, 22 nt, Homo sapiens
uuggcaaauagguuuuauugca

SEQ ID NO: 332470 - RNA, 22 nt, Homo sapiens
uuggcaagcuguuaauuauaaa

SEQ ID NO: 332471 - RNA, 21 nt, Homo sapiens
uuggcacucuucucuccuuau

SEQ ID NO: 332472 - RNA, 22 nt, Homo sapiens
uuggcacugggaaaaugaccac

SEQ ID NO: 332473 - RNA, 20 nt, Homo sapiens
uuggcagagucuuuagggua

SEQ ID NO: 332474 - RNA, 22 nt, Homo sapiens
uuggcagcuguggaaucugggc

SEQ ID NO: 332475 - RNA, 22 nt, Homo sapiens
uuggcaguaucuacuacagcua

SEQ ID NO: 332476 - RNA, 22 nt, Homo sapiens
uuggcauagaggcucucaagcu

SEQ ID NO: 332477 - RNA, 22 nt, Homo sapiens
uuggccccuccaaaucucaugu

SEQ ID NO: 332478 - RNA, 23 nt, Homo sapiens
uuggccuccuugugucuagggcu

SEQ ID NO: 332479 - RNA, 22 nt, Homo sapiens
uuggcgacugcugcuaaucagg

SEQ ID NO: 332480 - RNA, 22 nt, Homo sapiens
uuggcuauagauacauggauua

SEQ ID NO: 332481 - RNA, 22 nt, Homo sapiens
uuggcuguguuuauaugcugga

SEQ ID NO: 332482 - RNA, 22 nt, Homo sapiens
uuggcuucuggacuauugugca

SEQ ID NO: 332483 - RNA, 22 nt, Homo sapiens
uuggcuuuuaugcagcuuaggu

SEQ ID NO: 332484 - RNA, 22 nt, Homo sapiens
uugggagugucucuggacugca

SEQ ID NO: 332485 - RNA, 22 nt, Homo sapiens
uugguauguguuucauacucaa

SEQ ID NO: 332486 - RNA, 22 nt, Homo sapiens
uuggucaggcuaaucucgaacg

SEQ ID NO: 332487 - RNA, 22 nt, Homo sapiens
uuguaaaguucuuaggaagcuc

SEQ ID NO: 332488 - RNA, 22 nt, Homo sapiens
uuguacuagucauauuuugaaa

SEQ ID NO: 332489 - RNA, 22 nt, Homo sapiens
uuguacuauuuuuaucagugau

SEQ ID NO: 332490 - RNA, 22 nt, Homo sapiens
uuguauccaucuuucaggcaac

SEQ ID NO: 332491 - RNA, 22 nt, Homo sapiens
uugucaaacucauucuccaucc

SEQ ID NO: 332492 - RNA, 22 nt, Homo sapiens
uugucaacaugaaacuguguuu

SEQ ID NO: 332493 - RNA, 22 nt, Homo sapiens
uugucacauggggcggcugccc

SEQ ID NO: 332494 - RNA, 22 nt, Homo sapiens
uugucccauggggucuuccuuu

SEQ ID NO: 332495 - RNA, 23 nt, Homo sapiens
uuguccccuccaaagcucauguu

SEQ ID NO: 332496 - RNA, 19 nt, Homo sapiens
uuguccccucuaaaucuca

SEQ ID NO: 332497 - RNA, 22 nt, Homo sapiens
uuguccuccacauuugaucagu

SEQ ID NO: 332498 - RNA, 22 nt, Homo sapiens
uuguccucuccaaaucucaugu

SEQ ID NO: 332499 - RNA, 22 nt, Homo sapiens
uuguccuggagguucuugcaag

SEQ ID NO: 332500 - RNA, 22 nt, Homo sapiens
uugucuagugaauacauuaaug

SEQ ID NO: 332501 - RNA, 22 nt, Homo sapiens
uugucuugcagcuuaggcauca

SEQ ID NO: 332502 - RNA, 22 nt, Homo sapiens
uugugaaaucuaggcagagguu

SEQ ID NO: 332503 - RNA, 22 nt, Homo sapiens
uugugaagaugugaagcaagca

SEQ ID NO: 332504 - RNA, 22 nt, Homo sapiens
uugugaauggugccacaauaaa

SEQ ID NO: 332505 - RNA, 22 nt, Homo sapiens
uugugccauucuucugccucag

SEQ ID NO: 332506 - RNA, 22 nt, Homo sapiens
uugugguuuuagcacuguggau

SEQ ID NO: 332507 - RNA, 21 nt, Homo sapiens
auguaacugggaaugugagag

SEQ ID NO: 332508 - RNA, 22 nt, Homo sapiens
augucacagguccuagccaagu

SEQ ID NO: 332509 - RNA, 22 nt, Homo sapiens
augucauagaagccugugaacc

SEQ ID NO: 332510 - RNA, 22 nt, Homo sapiens
auguccaugagcacauguauca

SEQ ID NO: 332511 - RNA, 22 nt, Homo sapiens
augugacugauggagaauaugu

SEQ ID NO: 332512 - RNA, 22 nt, Homo sapiens
augugcaauggugucaccacau

SEQ ID NO: 332513 - RNA, 22 nt, Homo sapiens
augugcacaugcuuacauguga

SEQ ID NO: 332514 - RNA, 20 nt, Homo sapiens
augugcuaauauuaauaugu

SEQ ID NO: 332515 - RNA, 22 nt, Homo sapiens
augugcuuauagguguauguuu

SEQ ID NO: 332516 - RNA, 22 nt, Homo sapiens
augugcuuuuggugagagauuu

SEQ ID NO: 332517 - RNA, 22 nt, Homo sapiens
auguggaaauguauaugugucu

SEQ ID NO: 332518 - RNA, 22 nt, Homo sapiens
augugggaggaauguguuucca

SEQ ID NO: 332519 - RNA, 22 nt, Homo sapiens
auguggugguagccaggacagg

SEQ ID NO: 332520 - RNA, 22 nt, Homo sapiens
auguguaaagcuuuucuuuguu

SEQ ID NO: 332521 - RNA, 23 nt, Homo sapiens
augugugcuuggagagcaggaug

SEQ ID NO: 332522 - RNA, 18 nt, Homo sapiens
auguuauguuuguagaag

SEQ ID NO: 332523 - RNA, 22 nt, Homo sapiens
auguuuagagagggugucaaau

SEQ ID NO: 332524 - RNA, 22 nt, Homo sapiens
auuaaauguuggacguauacau

SEQ ID NO: 332525 - RNA, 22 nt, Homo sapiens
auuaagugcuugcagaagucca

SEQ ID NO: 332526 - RNA, 22 nt, Homo sapiens
auuaagugcuugccagugcugg

SEQ ID NO: 332527 - RNA, 22 nt, Homo sapiens
auuagguaauauaaucauggca

SEQ ID NO: 332528 - RNA, 22 nt, Homo sapiens
auuauauguguaugugcauacc

SEQ ID NO: 332529 - RNA, 22 nt, Homo sapiens
auuauuagucggccagcuguua

SEQ ID NO: 332530 - RNA, 22 nt, Homo sapiens
auucaagugaugcagcuguuuu

SEQ ID NO: 332531 - RNA, 22 nt, Homo sapiens
auucacugugcuuggccaaauu

SEQ ID NO: 332532 - RNA, 20 nt, Homo sapiens
auucauggugguacguuguc

SEQ ID NO: 332533 - RNA, 22 nt, Homo sapiens
auuccacuuauaugagguaucu

SEQ ID NO: 332534 - RNA, 21 nt, Homo sapiens
auuccacuuuuccuucaggga

SEQ ID NO: 332535 - RNA, 22 nt, Homo sapiens
auuccagguggcgccauucaca

SEQ ID NO: 332536 - RNA, 22 nt, Homo sapiens
auucccuuagcugccucagccu

SEQ ID NO: 332537 - RNA, 22 nt, Homo sapiens
auugaacacagaguagcuuucc

SEQ ID NO: 332538 - RNA, 22 nt, Homo sapiens
auugaauuugguuugcuaagaa

SEQ ID NO: 332539 - RNA, 16 nt, Homo sapiens
auugacaguggguguu

SEQ ID NO: 332540 - RNA, 23 nt, Homo sapiens
auugauagugccuuugugcuaau

SEQ ID NO: 332541 - RNA, 21 nt, Homo sapiens
auugcacaauauacccaugua

SEQ ID NO: 332542 - RNA, 22 nt, Homo sapiens
auugcacaccagucugggcaaa

SEQ ID NO: 332543 - RNA, 22 nt, Homo sapiens
auugcacuccagccuagucaac

SEQ ID NO: 332544 - RNA, 22 nt, Homo sapiens
auugcacuccagccugagcaaa

SEQ ID NO: 332545 - RNA, 22 nt, Homo sapiens
auugcacuccagccuggccgag

SEQ ID NO: 332546 - RNA, 22 nt, Homo sapiens
auugcacuccagccugggcagc

SEQ ID NO: 332547 - RNA, 22 nt, Homo sapiens
auugcacuccagccugggggac

SEQ ID NO: 332548 - RNA, 22 nt, Homo sapiens
auugcacuccauccuaggugac

SEQ ID NO: 332549 - RNA, 22 nt, Homo sapiens
auugcacucuaaccuaggugac

SEQ ID NO: 332550 - RNA, 22 nt, Homo sapiens
auugcacuggggguuagaauuu

SEQ ID NO: 332551 - RNA, 22 nt, Homo sapiens
auugcagauucgcuuuguguug

SEQ ID NO: 332552 - RNA, 22 nt, Homo sapiens
auugcauuuucagguuggucug

SEQ ID NO: 332553 - RNA, 18 nt, Homo sapiens
auugcccucauggggcuu

SEQ ID NO: 332554 - RNA, 22 nt, Homo sapiens
auugcuuaagucccuguauuag

SEQ ID NO: 332555 - RNA, 22 nt, Homo sapiens
auuggcaauggcaaagcagagu

SEQ ID NO: 332556 - RNA, 22 nt, Homo sapiens
auuggccaaugggacgucagca

SEQ ID NO: 332557 - RNA, 22 nt, Homo sapiens
auuggucuauuaaaccuaaguu

SEQ ID NO: 332558 - RNA, 22 nt, Homo sapiens
auuguacuccagccugggcgac

SEQ ID NO: 332559 - RNA, 22 nt, Homo sapiens
auuguacuccagccugggcuaa

SEQ ID NO: 332560 - RNA, 22 nt, Homo sapiens
auuguacucuagccucugggca

SEQ ID NO: 332561 - RNA, 22 nt, Homo sapiens
auuguacuuauugccagaauuu

SEQ ID NO: 332562 - RNA, 22 nt, Homo sapiens
auugucacccgggcaguaagca

SEQ ID NO: 332563 - RNA, 22 nt, Homo sapiens
auuguguuugaaugaggcucca

SEQ ID NO: 332564 - RNA, 22 nt, Homo sapiens
auuguuccccggucauuuuugu

SEQ ID NO: 332565 - RNA, 22 nt, Homo sapiens
auuguucuuacaugcugucauc

SEQ ID NO: 332566 - RNA, 22 nt, Homo sapiens
auuuaugguuaauauaggaagu

SEQ ID NO: 332567 - RNA, 15 nt, Homo sapiens
auuucacuuagcaug

SEQ ID NO: 332568 - RNA, 21 nt, Homo sapiens
auuugcacugagcuccugugc

SEQ ID NO: 332569 - RNA, 20 nt, Homo sapiens
auuugcauuauggagcaccc

SEQ ID NO: 332570 - RNA, 22 nt, Homo sapiens
auuuggcauagaguaucauucu

SEQ ID NO: 332571 - RNA, 20 nt, Homo sapiens
auuuggcauaguuuaagcaa

SEQ ID NO: 332572 - RNA, 22 nt, Homo sapiens
auuuggccuuuguaugcaguau

SEQ ID NO: 332573 - RNA, 22 nt, Homo sapiens
auuuguccugccuuuuccuccu

SEQ ID NO: 332574 - RNA, 22 nt, Homo sapiens
caaaagugguucuuauccuuuu

SEQ ID NO: 332575 - RNA, 22 nt, Homo sapiens
caaaggcuucugaaacugcaga

SEQ ID NO: 332576 - RNA, 22 nt, Homo sapiens
caaaguaauuacgguuuuggcc

SEQ ID NO: 332577 - RNA, 22 nt, Homo sapiens
caaaguaauugugguuuugcca

SEQ ID NO: 332578 - RNA, 22 nt, Homo sapiens
caaagucuauucuacccuuacc

SEQ ID NO: 332579 - RNA, 22 nt, Homo sapiens
caaagugcuggaauuggccggg

SEQ ID NO: 332580 - RNA, 22 nt, Homo sapiens
caaagugcugggacuggccggg

SEQ ID NO: 332581 - RNA, 22 nt, Homo sapiens
caaaugcuucuauggacugucu

SEQ ID NO: 332582 - RNA, 22 nt, Homo sapiens
caaauugcuugucuguagugga

SEQ ID NO: 332583 - RNA, 22 nt, Homo sapiens
caagacuguccaacauauuggg

SEQ ID NO: 332584 - RNA, 22 nt, Homo sapiens
caaguacugggcuauggauauu

SEQ ID NO: 332585 - RNA, 22 nt, Homo sapiens
caagugaauaguugcucucaga

SEQ ID NO: 332586 - RNA, 22 nt, Homo sapiens
caaugugcuuggggcacaugag

SEQ ID NO: 332587 - RNA, 22 nt, Homo sapiens
cacaccuaccucauuauggaca

SEQ ID NO: 332588 - RNA, 22 nt, Homo sapiens
cacacugucuucaauggguggu

SEQ ID NO: 332589 - RNA, 22 nt, Homo sapiens
cacagaauucauuggauuaccu

SEQ ID NO: 332590 - RNA, 22 nt, Homo sapiens
cacaggaagaggcacggucccu

SEQ ID NO: 332591 - RNA, 22 nt, Homo sapiens
cacaggccugucucuuucuaac

SEQ ID NO: 332592 - RNA, 22 nt, Homo sapiens
cacagucuugcaauauugagau

SEQ ID NO: 332593 - RNA, 22 nt, Homo sapiens
cacaguguuacugguaugaagu

SEQ ID NO: 332594 - RNA, 22 nt, Homo sapiens
uugugucccuacccaaaucuca

SEQ ID NO: 332595 - RNA, 22 nt, Homo sapiens
uugugucccugcccaaaucuca

SEQ ID NO: 332596 - RNA, 23 nt, Homo sapiens
uuguucccuuccacucagucucc

SEQ ID NO: 332597 - RNA, 22 nt, Homo sapiens
uuuaaaguuagaaggaaagggc

SEQ ID NO: 332598 - RNA, 23 nt, Homo sapiens
uuuaagcuucauguccuaacauc

SEQ ID NO: 332599 - RNA, 18 nt, Homo sapiens
uuuacaguagaaggacuu

SEQ ID NO: 332600 - RNA, 22 nt, Homo sapiens
uuuacugugggguuucuuagag

SEQ ID NO: 332601 - RNA, 22 nt, Homo sapiens
uuuagcacugugauugacaaaa

SEQ ID NO: 332602 - RNA, 22 nt, Homo sapiens
uuuagcucauucaauuucaguc

SEQ ID NO: 332603 - RNA, 22 nt, Homo sapiens
uuuaguacugcuuuaugugugu

SEQ ID NO: 332604 - RNA, 23 nt, Homo sapiens
uuuaguccccuaugagcuggugu

SEQ ID NO: 332605 - RNA, 22 nt, Homo sapiens
uuuaucuguuuaaaacuguuca

SEQ ID NO: 332606 - RNA, 22 nt, Homo sapiens
uuuaugucuguacaucgggcgg

SEQ ID NO: 332607 - RNA, 22 nt, Homo sapiens
uuucaacaggucuggggugguc

SEQ ID NO: 332608 - RNA, 18 nt, Homo sapiens
uuucaagucuuaggugac

SEQ ID NO: 332609 - RNA, 22 nt, Homo sapiens
uuucacagcugucuuccgucuc

SEQ ID NO: 332610 - RNA, 23 nt, Homo sapiens
uuucacaguagcuggaucagccu

SEQ ID NO: 332611 - RNA, 22 nt, Homo sapiens
uuucauagaucaugcuuuugga

SEQ ID NO: 332612 - RNA, 22 nt, Homo sapiens
uuucaucaagcacagaguagau

SEQ ID NO: 332613 - RNA, 22 nt, Homo sapiens
uuucauggacgcaaugccuuuu

SEQ ID NO: 332614 - RNA, 22 nt, Homo sapiens
uuucauggaggauuugcuucuu

SEQ ID NO: 332615 - RNA, 23 nt, Homo sapiens
uuucauggggauuuacucauucc

SEQ ID NO: 332616 - RNA, 22 nt, Homo sapiens
uuuccauguuggugaaaugagg

SEQ ID NO: 332617 - RNA, 22 nt, Homo sapiens
uuucccagugguacaguuuaua

SEQ ID NO: 332618 - RNA, 22 nt, Homo sapiens
uuucccuuacuuaaacuuacuc

SEQ ID NO: 332619 - RNA, 22 nt, Homo sapiens
uuuccuguagggggcaaggccu

SEQ ID NO: 332620 - RNA, 20 nt, Homo sapiens
uuucuccccuauaaaucuca

SEQ ID NO: 332621 - RNA, 22 nt, Homo sapiens
uuucugugguccucuugaaggu

SEQ ID NO: 332622 - RNA, 23 nt, Homo sapiens
uuucuugggcaugcuaugucagu

SEQ ID NO: 332623 - RNA, 22 nt, Homo sapiens
uuugaaguguggcacugaguuu

SEQ ID NO: 332624 - RNA, 22 nt, Homo sapiens
cacaguugccuaucuccugaag

SEQ ID NO: 332625 - RNA, 22 nt, Homo sapiens
caccacauuccauugaucaggc

SEQ ID NO: 332626 - RNA, 21 nt, Homo sapiens
cacugguguugcuauaucaaa

SEQ ID NO: 332627 - RNA, 22 nt, Homo sapiens
cacuuugguucaccugaguuuc

SEQ ID NO: 332628 - RNA, 22 nt, Homo sapiens
cagagagcuugcccuuguauau

SEQ ID NO: 332629 - RNA, 22 nt, Homo sapiens
cagaguuaguagccuuugacaa

SEQ ID NO: 332630 - RNA, 22 nt, Homo sapiens
cagauacuggaguccugaaguu

SEQ ID NO: 332631 - RNA, 22 nt, Homo sapiens
cagauaguuguagauaugcagc

SEQ ID NO: 332632 - RNA, 22 nt, Homo sapiens
cagauggucuuaaggcagccuu

SEQ ID NO: 332633 - RNA, 22 nt, Homo sapiens
cagcaaaucauccuauuugagc

SEQ ID NO: 332634 - RNA, 22 nt, Homo sapiens
cagcaagucucuaagaguucau

SEQ ID NO: 332635 - RNA, 22 nt, Homo sapiens
cagcacauuacaaguacuuggu

SEQ ID NO: 332636 - RNA, 22 nt, Homo sapiens
cagcgaggucugcgucacauug

SEQ ID NO: 332637 - RNA, 22 nt, Homo sapiens
cagcuaguaauuuauugaagau

SEQ ID NO: 332638 - RNA, 20 nt, Homo sapiens
cagcuagugguaggagucgg

SEQ ID NO: 332639 - RNA, 22 nt, Homo sapiens
cagcucauugcagucucgaccu

SEQ ID NO: 332640 - RNA, 22 nt, Homo sapiens
cagcuggugcugcaccaguggg

SEQ ID NO: 332641 - RNA, 22 nt, Homo sapiens
cagcuguuguuaugucugcagg

SEQ ID NO: 332642 - RNA, 23 nt, Homo sapiens
cagcuucauugaacauaacuccu

SEQ ID NO: 332643 - RNA, 22 nt, Homo sapiens
caggcauagucuugaguuuuau

SEQ ID NO: 332644 - RNA, 22 nt, Homo sapiens
caggcauuguccaugcugaagg

SEQ ID NO: 332645 - RNA, 22 nt, Homo sapiens
cagggaauguuauuuaauagca

SEQ ID NO: 332646 - RNA, 22 nt, Homo sapiens
cagggcauugucuucuuaguac

SEQ ID NO: 332647 - RNA, 22 nt, Homo sapiens
cagguacaugcaugugugugca

SEQ ID NO: 332648 - RNA, 22 nt, Homo sapiens
cagguacuucugggcugagcag

SEQ ID NO: 332649 - RNA, 22 nt, Homo sapiens
cagguaguguguagcacagcag

SEQ ID NO: 332650 - RNA, 23 nt, Homo sapiens
cagguaguucuuuauaguagugu

SEQ ID NO: 332651 - RNA, 19 nt, Homo sapiens
caguaucauugcacauagu

SEQ ID NO: 332652 - RNA, 22 nt, Homo sapiens
caguccuaugauaaccauuuac

SEQ ID NO: 332653 - RNA, 22 nt, Homo sapiens
cagugcaaagccucugcccaga

SEQ ID NO: 332654 - RNA, 23 nt, Homo sapiens
cagugcauuguggcauucagcau

SEQ ID NO: 332655 - RNA, 22 nt, Homo sapiens
caguggaugaacaagaagugau

SEQ ID NO: 332656 - RNA, 22 nt, Homo sapiens
gcuguguugugcccagcaucau

SEQ ID NO: 332657 - RNA, 18 nt, Homo sapiens
gcuguugucagagcacau

SEQ ID NO: 332658 - RNA, 22 nt, Homo sapiens
gcuguugugaacuauacaucua

SEQ ID NO: 332659 - RNA, 22 nt, Homo sapiens
ggaaagcuagguguggguguac

SEQ ID NO: 332660 - RNA, 22 nt, Homo sapiens
ggaaaucucugaggcucccuuc

SEQ ID NO: 332661 - RNA, 20 nt, Homo sapiens
ggaagagugacacaagguau

SEQ ID NO: 332662 - RNA, 20 nt, Homo sapiens
ggaauagucuacacucugac

SEQ ID NO: 332663 - RNA, 17 nt, Homo sapiens
ggaaugaauuccagccc

SEQ ID NO: 332664 - RNA, 22 nt, Homo sapiens
ggacaaaguauuuucaaaugua

SEQ ID NO: 332665 - RNA, 22 nt, Homo sapiens
ggacaagaucuuccaccauuca

SEQ ID NO: 332666 - RNA, 22 nt, Homo sapiens
ggacauguauauauaugugugu

SEQ ID NO: 332667 - RNA, 22 nt, Homo sapiens
ggacuaggagcuaggaagaucu

SEQ ID NO: 332668 - RNA, 22 nt, Homo sapiens
ggacuagggacauggggagcug

SEQ ID NO: 332669 - RNA, 22 nt, Homo sapiens
ggagaucacucuuuguagcgug

SEQ ID NO: 332670 - RNA, 22 nt, Homo sapiens
ggagaucuuuguuaucuuuuga

SEQ ID NO: 332671 - RNA, 22 nt, Homo sapiens
ggagucugaacuggacaaugac

SEQ ID NO: 332672 - RNA, 22 nt, Homo sapiens
ggagucugauuuuuauguugcu

SEQ ID NO: 332673 - RNA, 22 nt, Homo sapiens
ggaguguaguggcuccaucucg

SEQ ID NO: 332674 - RNA, 22 nt, Homo sapiens
ggagugugauuguucucuguua

SEQ ID NO: 332675 - RNA, 22 nt, Homo sapiens
ggauacaucuggacagccgaau

SEQ ID NO: 332676 - RNA, 23 nt, Homo sapiens
ggauggaaaguuuugagggccac

SEQ ID NO: 332677 - RNA, 22 nt, Homo sapiens
ggauugugauaauuguugcaaa

SEQ ID NO: 332678 - RNA, 22 nt, Homo sapiens
ggcaaaucugcaauuacuuuug

SEQ ID NO: 332679 - RNA, 21 nt, Homo sapiens
ggcaagagaauacaacauaaa

SEQ ID NO: 332680 - RNA, 22 nt, Homo sapiens
ggcaagaggagauucugcuccc

SEQ ID NO: 332681 - RNA, 19 nt, Homo sapiens
ggcaagaguuguucugugu

SEQ ID NO: 332682 - RNA, 22 nt, Homo sapiens
ggcaagcucaggccucaggugu

SEQ ID NO: 332683 - RNA, 22 nt, Homo sapiens
ggcaaguugcuauucuuuaaug

SEQ ID NO: 332684 - RNA, 22 nt, Homo sapiens
ggcacgguggcucacaccugua

SEQ ID NO: 332685 - RNA, 22 nt, Homo sapiens
ggcacgguggcucacgccugua

SEQ ID NO: 332686 - RNA, 22 nt, Homo sapiens
ggcagagucuugcaucuuuaga

SEQ ID NO: 332687 - RNA, 22 nt, Homo sapiens
ggcagcgugcacuuucgccacu

SEQ ID NO: 332688 - RNA, 22 nt, Homo sapiens
ggcagcucaggccccgcgcuga

SEQ ID NO: 332689 - RNA, 22 nt, Homo sapiens
ggcagcuguguccuucguaagg

SEQ ID NO: 332690 - RNA, 17 nt, Homo sapiens
ggcaggauccaggaucc

SEQ ID NO: 332691 - RNA, 22 nt, Homo sapiens
ggcccaguugcgggugguaccg

SEQ ID NO: 332692 - RNA, 22 nt, Homo sapiens
ggcccugagacaggaaaaagcu

SEQ ID NO: 332693 - RNA, 22 nt, Homo sapiens
ggcgccauugcacuccagccug

SEQ ID NO: 332694 - RNA, 22 nt, Homo sapiens
ggcuagauauucacauauggcu

SEQ ID NO: 332695 - RNA, 22 nt, Homo sapiens
ggcuagaugcuagagauaucau

SEQ ID NO: 332696 - RNA, 22 nt, Homo sapiens
ggcucguguuuucuguccaguu

SEQ ID NO: 332697 - RNA, 22 nt, Homo sapiens
ggcuuggaggaaugugagggcu

SEQ ID NO: 332698 - RNA, 22 nt, Homo sapiens
gggaaaaugucuauugaaugaa

SEQ ID NO: 332699 - RNA, 20 nt, Homo sapiens
gggaaugcaaauucucaucc

SEQ ID NO: 332700 - RNA, 22 nt, Homo sapiens
gggagcacaagaaauguuucau

SEQ ID NO: 332701 - RNA, 19 nt, Homo sapiens
gggaggaugcgucuucagg

SEQ ID NO: 332702 - RNA, 22 nt, Homo sapiens
gucacaggaaacuaauaugcgc

SEQ ID NO: 332703 - RNA, 22 nt, Homo sapiens
gucacauugaugcccauggugg

SEQ ID NO: 332704 - RNA, 22 nt, Homo sapiens
gucacggaauguaaguggaagu

SEQ ID NO: 332705 - RNA, 22 nt, Homo sapiens
gucacuggcugucuuguaugau

SEQ ID NO: 332706 - RNA, 22 nt, Homo sapiens
gucacugugacggcaguuacau

SEQ ID NO: 332707 - RNA, 22 nt, Homo sapiens
gucagcaaagaggaauaguuug

SEQ ID NO: 332708 - RNA, 22 nt, Homo sapiens
gucagugcuuuaguucaggaug

SEQ ID NO: 332709 - RNA, 22 nt, Homo sapiens
gucauguuuaacuucuugagga

SEQ ID NO: 332710 - RNA, 22 nt, Homo sapiens
gucauucauucagcaagcacug

SEQ ID NO: 332711 - RNA, 22 nt, Homo sapiens
gucuaugagucccugaauuuaa

SEQ ID NO: 332712 - RNA, 22 nt, Homo sapiens
gucucacagcuagcugcuuuau

SEQ ID NO: 332713 - RNA, 22 nt, Homo sapiens
gucucccagccuacaucuuucu

SEQ ID NO: 332714 - RNA, 22 nt, Homo sapiens
gucuggagacuugggucaucaa

SEQ ID NO: 332715 - RNA, 22 nt, Homo sapiens
gucuggcacagggaaaguacaa

SEQ ID NO: 332716 - RNA, 22 nt, Homo sapiens
gucuggcuccuucuacuacaug

SEQ ID NO: 332717 - RNA, 22 nt, Homo sapiens
gucuggguuuguuuguacuugc

SEQ ID NO: 332718 - RNA, 22 nt, Homo sapiens
gucugguuccugggagauuucu

SEQ ID NO: 332719 - RNA, 22 nt, Homo sapiens
gucugguugacagcauguggcc

SEQ ID NO: 332720 - RNA, 22 nt, Homo sapiens
gucugguuggaguaguuuucag

SEQ ID NO: 332721 - RNA, 21 nt, Homo sapiens
gucuuacagccagaugccucu

SEQ ID NO: 332722 - RNA, 22 nt, Homo sapiens
gucuuggagaacucagcuuggc

SEQ ID NO: 332723 - RNA, 22 nt, Homo sapiens
gucuuugagauaggguuauuuu

SEQ ID NO: 332724 - RNA, 22 nt, Homo sapiens
gucuuugcuuuuaaccagaggu

SEQ ID NO: 332725 - RNA, 22 nt, Homo sapiens
gucuuuguuuggucuguaucag

SEQ ID NO: 332726 - RNA, 22 nt, Homo sapiens
gucuuuguuuugauuuaccaga

SEQ ID NO: 332727 - RNA, 22 nt, Homo sapiens
gugaaagcaucugacugugcca

SEQ ID NO: 332728 - RNA, 22 nt, Homo sapiens
gugaaauguguagaggaucugg

SEQ ID NO: 332729 - RNA, 22 nt, Homo sapiens
gugaacaagcaaaggcaggagg

SEQ ID NO: 332730 - RNA, 22 nt, Homo sapiens
gugaagugugaccucagcaucu

SEQ ID NO: 332731 - RNA, 22 nt, Homo sapiens
gugaaugcauuaagaaggggga

SEQ ID NO: 332732 - RNA, 22 nt, Homo sapiens
gugacacuggagcuggcacaau

SEQ ID NO: 332733 - RNA, 22 nt, Homo sapiens
gugaccucuguugcugucacua

SEQ ID NO: 332734 - RNA, 22 nt, Homo sapiens
gugagacugguucugaacccag

SEQ ID NO: 332735 - RNA, 22 nt, Homo sapiens
gugagaugaggucucacucugu

SEQ ID NO: 332736 - RNA, 22 nt, Homo sapiens
gugagauggaguuggugucuuu

SEQ ID NO: 332737 - RNA, 22 nt, Homo sapiens
gugagaugguaucucauugugg

SEQ ID NO: 332738 - RNA, 22 nt, Homo sapiens
gugagcaaacuuaccuaagguu

SEQ ID NO: 332739 - RNA, 19 nt, Homo sapiens
gugagcaaugcauugcacu

SEQ ID NO: 332740 - RNA, 22 nt, Homo sapiens
gugagcaauugauacuugaagu

SEQ ID NO: 332741 - RNA, 22 nt, Homo sapiens
gugagcauaggaggcuucuguu

SEQ ID NO: 332742 - RNA, 22 nt, Homo sapiens
gugagccaugauuuuaccacug

SEQ ID NO: 332743 - RNA, 22 nt, Homo sapiens
gugagggaugugaaaaagguca

SEQ ID NO: 332744 - RNA, 22 nt, Homo sapiens
gugagguagagcaugugaaaga

SEQ ID NO: 332745 - RNA, 17 nt, Homo sapiens
gugagguggguaguauc

SEQ ID NO: 332746 - RNA, 22 nt, Homo sapiens
gugaggugguacaauauuaacu

SEQ ID NO: 332747 - RNA, 22 nt, Homo sapiens
gugauaucuuacaauucucuuu

SEQ ID NO: 332748 - RNA, 22 nt, Homo sapiens
gugaucuucauggaaggugaaa

SEQ ID NO: 332749 - RNA, 22 nt, Homo sapiens
gugaugguccagggaaucucuu

SEQ ID NO: 332750 - RNA, 22 nt, Homo sapiens
gugcaacaugccuggcuaauuu

SEQ ID NO: 332751 - RNA, 22 nt, Homo sapiens
gugcaagagugauugcaguuuu

SEQ ID NO: 332752 - RNA, 18 nt, Homo sapiens
gugcaaugaauagcagag

SEQ ID NO: 332753 - RNA, 22 nt, Homo sapiens
gugcaaugagaaggggcucugg

SEQ ID NO: 332754 - RNA, 22 nt, Homo sapiens
gugcaauguuaauuacuugacu

SEQ ID NO: 332755 - RNA, 22 nt, Homo sapiens
gugcacaacaugcagguuuguu

SEQ ID NO: 332756 - RNA, 22 nt, Homo sapiens
gugcacaacgugcagguuuguu

SEQ ID NO: 332757 - RNA, 22 nt, Homo sapiens
gugcacaucgugcagguuuguu

SEQ ID NO: 332758 - RNA, 22 nt, Homo sapiens
gugcagugugauccuuccguau

SEQ ID NO: 332759 - RNA, 22 nt, Homo sapiens
gugcauguccacuaguccauau

SEQ ID NO: 332760 - RNA, 22 nt, Homo sapiens
gugccacaguguuaagggauuc

SEQ ID NO: 332761 - RNA, 22 nt, Homo sapiens
gugccacugcaccuggccuaag

SEQ ID NO: 332762 - RNA, 22 nt, Homo sapiens
gugcccacugucuguccuguag

SEQ ID NO: 332763 - RNA, 23 nt, Homo sapiens
gugccuucugagccuagucucca

SEQ ID NO: 332764 - RNA, 22 nt, Homo sapiens
gugcuaggugcuaggaagauag

SEQ ID NO: 332765 - RNA, 22 nt, Homo sapiens
guggaagaaaucagguuauuug

SEQ ID NO: 332766 - RNA, 20 nt, Homo sapiens
guggaagauaaguagccuga

SEQ ID NO: 332767 - RNA, 22 nt, Homo sapiens
guggaaugaaaacucucucaca

SEQ ID NO: 332768 - RNA, 22 nt, Homo sapiens
guggaaugcaguguugauucaa

SEQ ID NO: 332769 - RNA, 22 nt, Homo sapiens
guggaauggaaugauuguguau

SEQ ID NO: 332770 - RNA, 17 nt, Homo sapiens
guggaaugucaugucaa

SEQ ID NO: 332771 - RNA, 22 nt, Homo sapiens
guggaucacuugaggucaagag

SEQ ID NO: 332772 - RNA, 22 nt, Homo sapiens
guggcaaagaugccuucuccaa

SEQ ID NO: 332773 - RNA, 22 nt, Homo sapiens
guggcagaacagguaggguucu

SEQ ID NO: 332774 - RNA, 22 nt, Homo sapiens
guggcagcacauauagguuguu

SEQ ID NO: 332775 - RNA, 22 nt, Homo sapiens
guggcaugaaagcaucugugau

SEQ ID NO: 332776 - RNA, 23 nt, Homo sapiens
guggccuuuggccaguccgaguc

SEQ ID NO: 332777 - RNA, 22 nt, Homo sapiens
guggcuauucaccuuuaugaaa

SEQ ID NO: 332778 - RNA, 22 nt, Homo sapiens
guggcuuguaggggucaaggga

SEQ ID NO: 332779 - RNA, 22 nt, Homo sapiens
guggcuuuaaguacgauugagg

SEQ ID NO: 332780 - RNA, 22 nt, Homo sapiens
gugggauggaaaugggcuucag

SEQ ID NO: 332781 - RNA, 22 nt, Homo sapiens
gugguuuuuagauuucuacagu

SEQ ID NO: 332782 - RNA, 22 nt, Homo sapiens
gugucacuguugagaaguccac

SEQ ID NO: 332783 - RNA, 18 nt, Homo sapiens
gugucugguuaugggagu

SEQ ID NO: 332784 - RNA, 22 nt, Homo sapiens
gugugauguaaagaacugggga

SEQ ID NO: 332785 - RNA, 22 nt, Homo sapiens
gugugauuauuucaauugaugc

SEQ ID NO: 332786 - RNA, 22 nt, Homo sapiens
gugugcaaauguguaccuacau

SEQ ID NO: 332787 - RNA, 20 nt, Homo sapiens
gugugcauuucagauuuugg

SEQ ID NO: 332788 - RNA, 21 nt, Homo sapiens
gugugcuugaauucagcuguc

SEQ ID NO: 332789 - RNA, 22 nt, Homo sapiens
guguggaacucaauacaacgca

SEQ ID NO: 332790 - RNA, 22 nt, Homo sapiens
guguucauggaauuugcaauug

SEQ ID NO: 332791 - RNA, 22 nt, Homo sapiens
guguugcacauucuguggaugu

SEQ ID NO: 332792 - RNA, 22 nt, Homo sapiens
guuaagggaagccuggguaaga

SEQ ID NO: 332793 - RNA, 22 nt, Homo sapiens
guuaaugcuggaauaaguuaag

SEQ ID NO: 332794 - RNA, 22 nt, Homo sapiens
guuaugacacucuuuuuaucau

SEQ ID NO: 332795 - RNA, 22 nt, Homo sapiens
guucaagugauagcugggauua

SEQ ID NO: 332796 - RNA, 22 nt, Homo sapiens
guucuggagauaaagccaaggu

SEQ ID NO: 332797 - RNA, 18 nt, Homo sapiens
guugagcuuuuccuuuag

SEQ ID NO: 332798 - RNA, 22 nt, Homo sapiens
guugcaaaguaauugugguuuu

SEQ ID NO: 332799 - RNA, 22 nt, Homo sapiens
guuguauaggcauggggagaau

SEQ ID NO: 332800 - RNA, 22 nt, Homo sapiens
guuugcauagugcugggagggg

SEQ ID NO: 332801 - RNA, 22 nt, Homo sapiens
guuuguaacucuagugacuaga

SEQ ID NO: 332802 - RNA, 17 nt, Homo sapiens
uaaagccagucaaguca

SEQ ID NO: 332803 - RNA, 22 nt, Homo sapiens
uaaagcuacagagcggaaaauu

SEQ ID NO: 332804 - RNA, 21 nt, Homo sapiens
uaaagcuuagcuauaguggcu

SEQ ID NO: 332805 - RNA, 22 nt, Homo sapiens
uaaaugcuuaauugaaugugga

SEQ ID NO: 332806 - RNA, 22 nt, Homo sapiens
uaacacagagcuccuaaucccu

SEQ ID NO: 332807 - RNA, 18 nt, Homo sapiens
uaacagucucucaggauc

SEQ ID NO: 332808 - RNA, 23 nt, Homo sapiens
uaacauugcaugauuaccugcau

SEQ ID NO: 332809 - RNA, 22 nt, Homo sapiens
uaacuccauuuggacucaguau

SEQ ID NO: 332810 - RNA, 18 nt, Homo sapiens
uaacuggugugagauggu

SEQ ID NO: 332811 - RNA, 22 nt, Homo sapiens
uaagaauucuguccgguauacu

SEQ ID NO: 332812 - RNA, 18 nt, Homo sapiens
uaaggcacuauaggcauu

SEQ ID NO: 332813 - RNA, 22 nt, Homo sapiens
uaagggcacuaaucccauuuau

SEQ ID NO: 332814 - RNA, 22 nt, Homo sapiens
uaaguaauuguuaauagggaag

SEQ ID NO: 332815 - RNA, 22 nt, Homo sapiens
uaaguacuuuacagacauuauc

SEQ ID NO: 332816 - RNA, 22 nt, Homo sapiens
uaaguaguauaagguuuuuuga

SEQ ID NO: 332817 - RNA, 22 nt, Homo sapiens
uaaguagugugcauguauguau

SEQ ID NO: 332818 - RNA, 22 nt, Homo sapiens
uaaguauuaugugcugcauuuu

SEQ ID NO: 332819 - RNA, 22 nt, Homo sapiens
uaagugaauuucacuacugagu

SEQ ID NO: 332820 - RNA, 22 nt, Homo sapiens
uaaguuagugugagaauuuugc

SEQ ID NO: 332821 - RNA, 22 nt, Homo sapiens
uaaguucauucaugaaacuuag

SEQ ID NO: 332822 - RNA, 22 nt, Homo sapiens
uaauaauguuaggcuuacucaa

SEQ ID NO: 332823 - RNA, 22 nt, Homo sapiens
uaauacugcugugcuugaguug

SEQ ID NO: 332824 - RNA, 22 nt, Homo sapiens
uaauaugugguugcuugggcac

SEQ ID NO: 332825 - RNA, 22 nt, Homo sapiens
uaaugcacauuuauuuuaccuu

SEQ ID NO: 332826 - RNA, 22 nt, Homo sapiens
uaauugaaugcagacaccaggg

SEQ ID NO: 332827 - RNA, 22 nt, Homo sapiens
uaauuggaucucaaaaaagugu

SEQ ID NO: 332828 - RNA, 21 nt, Homo sapiens
uacaagcuguagcacaugcca

SEQ ID NO: 332829 - RNA, 22 nt, Homo sapiens
uacaauagugacaaaucagcau

SEQ ID NO: 332830 - RNA, 22 nt, Homo sapiens
uacaccaauuuaaucaaaagca

SEQ ID NO: 332831 - RNA, 22 nt, Homo sapiens
uacagcacugugcauagugguu

SEQ ID NO: 332832 - RNA, 22 nt, Homo sapiens
uacagcuaugugcaugcaugcu

SEQ ID NO: 332833 - RNA, 23 nt, Homo sapiens
uacagcugcagaaucaggcuaag

SEQ ID NO: 332834 - RNA, 22 nt, Homo sapiens
uacaggaaugucagguugcugu

SEQ ID NO: 332835 - RNA, 22 nt, Homo sapiens
uacaggacuucucagaguuauu

SEQ ID NO: 332836 - RNA, 22 nt, Homo sapiens
uacaggauagacaauuuauuaa

SEQ ID NO: 332837 - RNA, 22 nt, Homo sapiens
uacagguauagauguguguucu

SEQ ID NO: 332838 - RNA, 22 nt, Homo sapiens
uacagguaugugucuauauaca

SEQ ID NO: 332839 - RNA, 22 nt, Homo sapiens
uacaguccaugcauuauccucc

SEQ ID NO: 332840 - RNA, 22 nt, Homo sapiens
uacauaguaagcacuaugccaa

SEQ ID NO: 332841 - RNA, 22 nt, Homo sapiens
uacaugcaugggcaugugugca

SEQ ID NO: 332842 - RNA, 19 nt, Homo sapiens
uacccagaagcagcauugu

SEQ ID NO: 332843 - RNA, 22 nt, Homo sapiens
uacccuuuaguauaaaaucaga

SEQ ID NO: 332844 - RNA, 22 nt, Homo sapiens
uaccugagaaagaaagcccucg

SEQ ID NO: 332845 - RNA, 22 nt, Homo sapiens
uaccugagacaacuuugaggaa

SEQ ID NO: 332846 - RNA, 23 nt, Homo sapiens
uaccugagacuggguaauuaaua

SEQ ID NO: 332847 - RNA, 22 nt, Homo sapiens
uaccugagucuagagucuagaa

SEQ ID NO: 332848 - RNA, 22 nt, Homo sapiens
uacgccuguaauaucagcauuu

SEQ ID NO: 332849 - RNA, 22 nt, Homo sapiens
uacucugcaguaauuccagccc

SEQ ID NO: 332850 - RNA, 22 nt, Homo sapiens
uacugcauuucacuguuaaaga

SEQ ID NO: 332851 - RNA, 22 nt, Homo sapiens
uagaaagcaugaccuucagaua

SEQ ID NO: 332852 - RNA, 22 nt, Homo sapiens
uagaauguaacuuccaugucau

SEQ ID NO: 332853 - RNA, 21 nt, Homo sapiens
uagagagcaauaccuccagag

SEQ ID NO: 332854 - RNA, 22 nt, Homo sapiens
uagagcuagggacucgcaaugu

SEQ ID NO: 332855 - RNA, 22 nt, Homo sapiens
uagagcuugacacuuuccaugg

SEQ ID NO: 332856 - RNA, 21 nt, Homo sapiens
uagauaguugguucugaaucu

SEQ ID NO: 332857 - RNA, 22 nt, Homo sapiens
uagaucaauuaauuguuacuug

SEQ ID NO: 332858 - RNA, 22 nt, Homo sapiens
uagaucauauacuugccaugac

SEQ ID NO: 332859 - RNA, 23 nt, Homo sapiens
uagaucaucaaguuuacugugcu

SEQ ID NO: 332860 - RNA, 22 nt, Homo sapiens
uagauuguuuaaguggcacaca

SEQ ID NO: 332861 - RNA, 21 nt, Homo sapiens
uagcaaauugcuauuaaggca

SEQ ID NO: 332862 - RNA, 22 nt, Homo sapiens
uagcacaugucagguaauuugc

SEQ ID NO: 332863 - RNA, 22 nt, Homo sapiens
uagcaccaggguugacugaccu

SEQ ID NO: 332864 - RNA, 22 nt, Homo sapiens
uagcaccucuuuggccuuucgu

SEQ ID NO: 332865 - RNA, 22 nt, Homo sapiens
uagcagcaucucuggcuucuac

SEQ ID NO: 332866 - RNA, 20 nt, Homo sapiens
uagcaggugucaggugauau

SEQ ID NO: 332867 - RNA, 22 nt, Homo sapiens
uagcagucucagaaugcauggu

SEQ ID NO: 332868 - RNA, 22 nt, Homo sapiens
uagccucacaaagugcuuaaga

SEQ ID NO: 332869 - RNA, 22 nt, Homo sapiens
uagcuaaauucagcucuaggua

SEQ ID NO: 332870 - RNA, 22 nt, Homo sapiens
uagcugaucuuuuaaagaauga

SEQ ID NO: 332871 - RNA, 22 nt, Homo sapiens
uagcuggaguuuuuguuauagg

SEQ ID NO: 332872 - RNA, 22 nt, Homo sapiens
uagcugguucuccaggagcuag

SEQ ID NO: 332873 - RNA, 22 nt, Homo sapiens
uagcuucuccauagcuccaugu

SEQ ID NO: 332874 - RNA, 18 nt, Homo sapiens
uaggaacauugauuggag

SEQ ID NO: 332875 - RNA, 22 nt, Homo sapiens
uaggcaguguucucacuuguaa

SEQ ID NO: 332876 - RNA, 22 nt, Homo sapiens
uagggaguguccuuucgggaaa

SEQ ID NO: 332877 - RNA, 22 nt, Homo sapiens
uagguaagauguuaacagcuga

SEQ ID NO: 332878 - RNA, 22 nt, Homo sapiens
uaggugcacaguaaauauaugu

SEQ ID NO: 332879 - RNA, 22 nt, Homo sapiens
uaguagcaccucucaugagcuu

SEQ ID NO: 332880 - RNA, 22 nt, Homo sapiens
uaguaguuuuguguauaauaau

SEQ ID NO: 332881 - RNA, 22 nt, Homo sapiens
uaguauguuuauagcauugagu

SEQ ID NO: 332882 - RNA, 22 nt, Homo sapiens
uagucacacacucaacuuuuca

SEQ ID NO: 332883 - RNA, 22 nt, Homo sapiens
uagugcugugauuaacauaaug

SEQ ID NO: 332884 - RNA, 22 nt, Homo sapiens
uaguucauuuuucuugcuuaga

SEQ ID NO: 332885 - RNA, 22 nt, Homo sapiens
uaguugcauuggcugcuaugcu

SEQ ID NO: 332886 - RNA, 23 nt, Homo sapiens
uauaacuuuuaauuuacuggccu

SEQ ID NO: 332887 - RNA, 22 nt, Homo sapiens
uauaccacugauuuuauucuga

SEQ ID NO: 332888 - RNA, 22 nt, Homo sapiens
uauauguucugugucccuuucg

SEQ ID NO: 332889 - RNA, 22 nt, Homo sapiens
uaucaagaugacaaacuuugcu

SEQ ID NO: 332890 - RNA, 22 nt, Homo sapiens
uaucacacuguuggauuugauu

SEQ ID NO: 332891 - RNA, 22 nt, Homo sapiens
uaucacagcauugucuauaaua

SEQ ID NO: 332892 - RNA, 22 nt, Homo sapiens
uaucacaguagaacucuuucca

SEQ ID NO: 332893 - RNA, 21 nt, Homo sapiens
uaucacaguagaauaggaucu

SEQ ID NO: 332894 - RNA, 22 nt, Homo sapiens
uaucaccuugguagucuugggg

SEQ ID NO: 332895 - RNA, 22 nt, Homo sapiens
uaucaguauggauucauggauu

SEQ ID NO: 332896 - RNA, 22 nt, Homo sapiens
uaucaucauuggcaggugagaa

SEQ ID NO: 332897 - RNA, 22 nt, Homo sapiens
uauccuguagcucauccaccgc

SEQ ID NO: 332898 - RNA, 22 nt, Homo sapiens
uaucucagaugagacuuguaac

SEQ ID NO: 332899 - RNA, 18 nt, Homo sapiens
uaucucauuucuuagguc

SEQ ID NO: 332900 - RNA, 22 nt, Homo sapiens
uaucucuguggguagugcugaa

SEQ ID NO: 332901 - RNA, 22 nt, Homo sapiens
uaucugguuauugcugcugauu

SEQ ID NO: 332902 - RNA, 22 nt, Homo sapiens
uaucuuggaguuugacaaccaa

SEQ ID NO: 332903 - RNA, 20 nt, Homo sapiens
uaugaaacaguguagagcaa

SEQ ID NO: 332904 - RNA, 22 nt, Homo sapiens
uaugaacacuuuugggaggcau

SEQ ID NO: 332905 - RNA, 20 nt, Homo sapiens
uaugacaaagccuagugagu

SEQ ID NO: 332906 - RNA, 22 nt, Homo sapiens
uaugacucagaaggcacacaca

SEQ ID NO: 332907 - RNA, 22 nt, Homo sapiens
uaugagagcugguagguagaga

SEQ ID NO: 332908 - RNA, 22 nt, Homo sapiens
uaugcacaugcaugcuugaaua

SEQ ID NO: 332909 - RNA, 22 nt, Homo sapiens
uaugcacaugugccugggugug

SEQ ID NO: 332910 - RNA, 22 nt, Homo sapiens
uaugcccauuuaaauugaacaa

SEQ ID NO: 332911 - RNA, 21 nt, Homo sapiens
uauggauuugccuauucugga

SEQ ID NO: 332912 - RNA, 17 nt, Homo sapiens
uauggcuauguuuagau

SEQ ID NO: 332913 - RNA, 22 nt, Homo sapiens
uauggcucuauuuccuugucua

SEQ ID NO: 332914 - RNA, 22 nt, Homo sapiens
uauggcuuuguuaacauuuucu

SEQ ID NO: 332915 - RNA, 22 nt, Homo sapiens
uauggcuuuguucaacagccuc

SEQ ID NO: 332916 - RNA, 22 nt, Homo sapiens
uauggguauuuuauacauaacc

SEQ ID NO: 332917 - RNA, 22 nt, Homo sapiens
uaugguuuuaagguuaaggacu

SEQ ID NO: 332918 - RNA, 20 nt, Homo sapiens
uaugguuuuagguauagcau

SEQ ID NO: 332919 - RNA, 22 nt, Homo sapiens
uaugguuuucucuuacguguug

SEQ ID NO: 332920 - RNA, 22 nt, Homo sapiens
uaugucacagguuuuggugaaa

SEQ ID NO: 332921 - RNA, 22 nt, Homo sapiens
uauguuaucaaaaagcuaagga

SEQ ID NO: 332922 - RNA, 22 nt, Homo sapiens
uauuaagcuaguugucagugcu

SEQ ID NO: 332923 - RNA, 22 nt, Homo sapiens
uauuacugucaauaucacagaa

SEQ ID NO: 332924 - RNA, 22 nt, Homo sapiens
uauuaguuuucuguggauuaca

SEQ ID NO: 332925 - RNA, 22 nt, Homo sapiens
uauucacaggugugggacaaag

SEQ ID NO: 332926 - RNA, 22 nt, Homo sapiens
uauuccacuggcacugcauuug

SEQ ID NO: 332927 - RNA, 22 nt, Homo sapiens
uauuccagcccuggugagccag

SEQ ID NO: 332928 - RNA, 22 nt, Homo sapiens
uauugcaaauggugaucccagg

SEQ ID NO: 332929 - RNA, 22 nt, Homo sapiens
uauugcaauuggggaaacuggg

SEQ ID NO: 332930 - RNA, 22 nt, Homo sapiens
uauugcacuuuuccauaggagu

SEQ ID NO: 332931 - RNA, 18 nt, Homo sapiens
uauugcuugguuuggaga

SEQ ID NO: 332932 - RNA, 22 nt, Homo sapiens
uauuguacauguuauagauuuu

SEQ ID NO: 332933 - RNA, 22 nt, Homo sapiens
ucaaacugucagguugaccaga

SEQ ID NO: 332934 - RNA, 22 nt, Homo sapiens
ucaaagacacacaaggagaagg

SEQ ID NO: 332935 - RNA, 22 nt, Homo sapiens
ucaaaugauucuccugccucag

SEQ ID NO: 332936 - RNA, 20 nt, Homo sapiens
ucaaauucuuggccuccagc

SEQ ID NO: 332937 - RNA, 22 nt, Homo sapiens
ucaacaggucaauugcauagaa

SEQ ID NO: 332938 - RNA, 19 nt, Homo sapiens
ucaagcuauucuccugccu

SEQ ID NO: 332939 - RNA, 22 nt, Homo sapiens
ucaaggcacauuugacauuuuc

SEQ ID NO: 332940 - RNA, 22 nt, Homo sapiens
ucaaggcacuagcugagcugca

SEQ ID NO: 332941 - RNA, 22 nt, Homo sapiens
ucaaugcaugugacaaagagua

SEQ ID NO: 332942 - RNA, 22 nt, Homo sapiens
ucacaaguguauagacaugucc

SEQ ID NO: 332943 - RNA, 23 nt, Homo sapiens
ucacacuuaagagaaaugcagcu

SEQ ID NO: 332944 - RNA, 22 nt, Homo sapiens
ucacagcuaaaaugaaaguagu

SEQ ID NO: 332945 - RNA, 22 nt, Homo sapiens
ucacaguagagcuucuuucaga

SEQ ID NO: 332946 - RNA, 22 nt, Homo sapiens
ucacagucaaaguaaucauaga

SEQ ID NO: 332947 - RNA, 22 nt, Homo sapiens
ucacagucuccucuagggaggg

SEQ ID NO: 332948 - RNA, 22 nt, Homo sapiens
ucacaguguuaaaccuuucuuu

SEQ ID NO: 332949 - RNA, 17 nt, Homo sapiens
ucacaguguuaggauga

SEQ ID NO: 332950 - RNA, 22 nt, Homo sapiens
ucacaguugauugaaacacagc

SEQ ID NO: 332951 - RNA, 22 nt, Homo sapiens
ucacauaguuuucgggaccuug

SEQ ID NO: 332952 - RNA, 22 nt, Homo sapiens
ucacauggcagagaagaagcuc

SEQ ID NO: 332953 - RNA, 22 nt, Homo sapiens
ucacaugggugcaauauaauca

SEQ ID NO: 332954 - RNA, 22 nt, Homo sapiens
ucacaugugacauauauauuug

SEQ ID NO: 332955 - RNA, 22 nt, Homo sapiens
ucacauguguaaauugguguaa

SEQ ID NO: 332956 - RNA, 22 nt, Homo sapiens
ucacauguguaugagcuuugau

SEQ ID NO: 332957 - RNA, 22 nt, Homo sapiens
ucacauuguauauguaccuauc

SEQ ID NO: 332958 - RNA, 16 nt, Homo sapiens
ucaccccuagagaucc

SEQ ID NO: 332959 - RNA, 20 nt, Homo sapiens
ucacccugacaucugcccag

SEQ ID NO: 332960 - RNA, 22 nt, Homo sapiens
ucaccuggagacaugaagacug

SEQ ID NO: 332961 - RNA, 22 nt, Homo sapiens
ucaccuggggcacagcugaaga

SEQ ID NO: 332962 - RNA, 21 nt, Homo sapiens
ucaccuguagcugcauguucu

SEQ ID NO: 332963 - RNA, 22 nt, Homo sapiens
ucacgugguucauaaggcagaa

SEQ ID NO: 332964 - RNA, 21 nt, Homo sapiens
ucacugagcaucaugguuuca

SEQ ID NO: 332965 - RNA, 21 nt, Homo sapiens
ucacugagguuaaauaggguu

SEQ ID NO: 332966 - RNA, 22 nt, Homo sapiens
ucacuggagguuccugaaguuc

SEQ ID NO: 332967 - RNA, 22 nt, Homo sapiens
ucacugggagaccaaagccauc

SEQ ID NO: 332968 - RNA, 22 nt, Homo sapiens
ucacugugagaguuuauccugu

SEQ ID NO: 332969 - RNA, 22 nt, Homo sapiens
ucagaacugauacuagaacuuu

SEQ ID NO: 332970 - RNA, 21 nt, Homo sapiens
ucagaagcucccagggaggac

SEQ ID NO: 332971 - RNA, 22 nt, Homo sapiens
ucagaauguaacuuuaguugga

SEQ ID NO: 332972 - RNA, 22 nt, Homo sapiens
ucagagucuagaucacucacug

SEQ ID NO: 332973 - RNA, 22 nt, Homo sapiens
ucagagugcagggaguagcagc

SEQ ID NO: 332974 - RNA, 22 nt, Homo sapiens
ucagaguggccucucuugaaga

SEQ ID NO: 332975 - RNA, 22 nt, Homo sapiens
ucagaugcauccauaccccacu

SEQ ID NO: 332976 - RNA, 19 nt, Homo sapiens
ucagaugcauuagggguua

SEQ ID NO: 332977 - RNA, 19 nt, Homo sapiens
ucagcaguaaucaacuuca

SEQ ID NO: 332978 - RNA, 22 nt, Homo sapiens
ucaggcaugcagcaaugcagug

SEQ ID NO: 332979 - RNA, 22 nt, Homo sapiens
ucagggacuuacaaaccagaag

SEQ ID NO: 332980 - RNA, 22 nt, Homo sapiens
ucagguaaucuauuugucuuuu

SEQ ID NO: 332981 - RNA, 20 nt, Homo sapiens
ucagguagaucuuugagguc

SEQ ID NO: 332982 - RNA, 22 nt, Homo sapiens
ucagguugcuaaguauaauauu

SEQ ID NO: 332983 - RNA, 22 nt, Homo sapiens
ucaguaaucuuagcugugcaga

SEQ ID NO: 332984 - RNA, 22 nt, Homo sapiens
ucaguagcaugaaaacagacua

SEQ ID NO: 332985 - RNA, 22 nt, Homo sapiens
ucaguauaugaaucuggggcag

SEQ ID NO: 332986 - RNA, 22 nt, Homo sapiens
ucagucuuuuaccauuaaguau

SEQ ID NO: 332987 - RNA, 20 nt, Homo sapiens
ucagugauugguuuaguuau

SEQ ID NO: 332988 - RNA, 21 nt, Homo sapiens
ucagugcaauucuauggggaa

SEQ ID NO: 332989 - RNA, 22 nt, Homo sapiens
ucagugccauugccauaugagu

SEQ ID NO: 332990 - RNA, 22 nt, Homo sapiens
ucagugcuguaccaucuaagga

SEQ ID NO: 332991 - RNA, 22 nt, Homo sapiens
ucagugucaucuggguuguuug

SEQ ID NO: 332992 - RNA, 22 nt, Homo sapiens
ucagugucugugcaccgcugga

SEQ ID NO: 332993 - RNA, 22 nt, Homo sapiens
ucaguguuuggaaucucaauuu

SEQ ID NO: 332994 - RNA, 22 nt, Homo sapiens
ucauacaguaguccucacuugu

SEQ ID NO: 332995 - RNA, 22 nt, Homo sapiens
ucauagaucaaguaauaagaca

SEQ ID NO: 332996 - RNA, 18 nt, Homo sapiens
ucauagaucaugacagug

SEQ ID NO: 332997 - RNA, 20 nt, Homo sapiens
ucauagggugguggcagugg

SEQ ID NO: 332998 - RNA, 21 nt, Homo sapiens
ucauauguaucuuugugccuc

SEQ ID NO: 332999 - RNA, 22 nt, Homo sapiens
ucaucagaaucccuuagggaug

SEQ ID NO: 333000 - RNA, 22 nt, Homo sapiens
ucaucaggaaacuuaugcagug

SEQ ID NO: 333001 - RNA, 21 nt, Homo sapiens
ucaucagucaaagacaauggu

SEQ ID NO: 333002 - RNA, 22 nt, Homo sapiens
ucaucagugcuugcaaauuauu

SEQ ID NO: 333003 - RNA, 22 nt, Homo sapiens
ucaucaguuuuuuauaugugau

SEQ ID NO: 333004 - RNA, 19 nt, Homo sapiens
ucauggcuuuuucagcugu

SEQ ID NO: 333005 - RNA, 22 nt, Homo sapiens
ucaugguuuuauaacccucuug

SEQ ID NO: 333006 - RNA, 23 nt, Homo sapiens
ucauguauucccuguaaugggua

SEQ ID NO: 333007 - RNA, 22 nt, Homo sapiens
ucaugugaggauaacaauagug

SEQ ID NO: 333008 - RNA, 19 nt, Homo sapiens
ucaugugcauacauuuggg

SEQ ID NO: 333009 - RNA, 22 nt, Homo sapiens
uccaauguaaucaucauugaau

SEQ ID NO: 333010 - RNA, 19 nt, Homo sapiens
uccacagugguugaacuag

SEQ ID NO: 333011 - RNA, 21 nt, Homo sapiens
uccagcuuugagaguuguggu

SEQ ID NO: 333012 - RNA, 22 nt, Homo sapiens
uccagugcauucagacacuugg

SEQ ID NO: 333013 - RNA, 22 nt, Homo sapiens
uccagugugcaggcaaguuuga

SEQ ID NO: 333014 - RNA, 20 nt, Homo sapiens
uccaguuuuggagacauucu

SEQ ID NO: 333015 - RNA, 22 nt, Homo sapiens
uccauguagaugcuauguuguc

SEQ ID NO: 333016 - RNA, 22 nt, Homo sapiens
uccaugugaaaaggucgugaua

SEQ ID NO: 333017 - RNA, 22 nt, Homo sapiens
uccaugugaaaucuaugaggac

SEQ ID NO: 333018 - RNA, 22 nt, Homo sapiens
ucccaagaugagaugggggcug

SEQ ID NO: 333019 - RNA, 19 nt, Homo sapiens
ucccaagaugcucauacau

SEQ ID NO: 333020 - RNA, 22 nt, Homo sapiens
ucccagaaacgcauauguucau

SEQ ID NO: 333021 - RNA, 22 nt, Homo sapiens
ucccagugcuaugcaaaagccu

SEQ ID NO: 333022 - RNA, 22 nt, Homo sapiens
ucccaguguguagcuugucucu

SEQ ID NO: 333023 - RNA, 22 nt, Homo sapiens
uccccgagcccaggcugugacu

SEQ ID NO: 333024 - RNA, 22 nt, Homo sapiens
ucccgaggacaucugggggcaa

SEQ ID NO: 333025 - RNA, 22 nt, Homo sapiens
ucccuacuggggcacugccuag

SEQ ID NO: 333026 - RNA, 22 nt, Homo sapiens
ucccuacugggguacugccuag

SEQ ID NO: 333027 - RNA, 22 nt, Homo sapiens
ucccuagagaagugauuuuuga

SEQ ID NO: 333028 - RNA, 18 nt, Homo sapiens
ucccucagaauuauagaa

SEQ ID NO: 333029 - RNA, 22 nt, Homo sapiens
ucccugagcaaaguuuucugua

SEQ ID NO: 333030 - RNA, 22 nt, Homo sapiens
ucccuguuguuucauaauuuua

SEQ ID NO: 333031 - RNA, 22 nt, Homo sapiens
ucccuuaaugaugaacaaugag

SEQ ID NO: 333032 - RNA, 22 nt, Homo sapiens
ucccuuagccaaauccccagcc

SEQ ID NO: 333033 - RNA, 22 nt, Homo sapiens
ucccuuucuggaguuucccaag

SEQ ID NO: 333034 - RNA, 22 nt, Homo sapiens
uccucugaacuccagacccaua

SEQ ID NO: 333035 - RNA, 22 nt, Homo sapiens
uccugcauucauccugguguug

SEQ ID NO: 333036 - RNA, 22 nt, Homo sapiens
uccuggcuccacuguuuauucc

SEQ ID NO: 333037 - RNA, 22 nt, Homo sapiens
uccuugagaggacagagccaua

SEQ ID NO: 333038 - RNA, 22 nt, Homo sapiens
uccuuugguggagucuuuaggg

SEQ ID NO: 333039 - RNA, 22 nt, Homo sapiens
uccuuuguuacaguuggcucug

SEQ ID NO: 333040 - RNA, 18 nt, Homo sapiens
uccuuuugggguaggaga

SEQ ID NO: 333041 - RNA, 22 nt, Homo sapiens
ucgcugggaagacugaaguguc

SEQ ID NO: 333042 - RNA, 23 nt, Homo sapiens
ucgguccccuuggcugcccucgg

SEQ ID NO: 333043 - RNA, 22 nt, Homo sapiens
ucuacagccaguucaggaagaa

SEQ ID NO: 333044 - RNA, 22 nt, Homo sapiens
ucuauggaguuugaaugagaaa

SEQ ID NO: 333045 - RNA, 22 nt, Homo sapiens
ucuauggauaaaaugcccucau

SEQ ID NO: 333046 - RNA, 22 nt, Homo sapiens
ucucaauggguuguagacaaag

SEQ ID NO: 333047 - RNA, 22 nt, Homo sapiens
ucucaauuugauuacauucaua

SEQ ID NO: 333048 - RNA, 22 nt, Homo sapiens
ucucacagaguugaacuuucuu

SEQ ID NO: 333049 - RNA, 22 nt, Homo sapiens
ucucacagccauuucucccucu

SEQ ID NO: 333050 - RNA, 22 nt, Homo sapiens
ucucauggagucaggagcagaa

SEQ ID NO: 333051 - RNA, 21 nt, Homo sapiens
ucucauuacugaugagccaga

SEQ ID NO: 333052 - RNA, 23 nt, Homo sapiens
ucucauuccuugaaaauaaugac

SEQ ID NO: 333053 - RNA, 22 nt, Homo sapiens
ucucauuggucugagucaccug

SEQ ID NO: 333054 - RNA, 22 nt, Homo sapiens
ucucccauccguacacggauug

SEQ ID NO: 333055 - RNA, 22 nt, Homo sapiens
ucucugagaccacuccaaacuc

SEQ ID NO: 333056 - RNA, 22 nt, Homo sapiens
ucucugauuaaacaagauagug

SEQ ID NO: 333057 - RNA, 22 nt, Homo sapiens
ucucuugguugaacaguuugga

SEQ ID NO: 333058 - RNA, 22 nt, Homo sapiens
ucugaaucguucccaugcagga

SEQ ID NO: 333059 - RNA, 22 nt, Homo sapiens
ucugacacagugauuaguaaau

SEQ ID NO: 333060 - RNA, 22 nt, Homo sapiens
ucugagacuguuucuaacaagc

SEQ ID NO: 333061 - RNA, 22 nt, Homo sapiens
ucugagaucaugucugugcugu

SEQ ID NO: 333062 - RNA, 22 nt, Homo sapiens
ucugagguuacugcuuuguaga

SEQ ID NO: 333063 - RNA, 22 nt, Homo sapiens
ucugauggaguugccagggaga

SEQ ID NO: 333064 - RNA, 23 nt, Homo sapiens
ucugauguuauaaaauucuuugg

SEQ ID NO: 333065 - RNA, 22 nt, Homo sapiens
ucugcaagucuaaacuagccau

SEQ ID NO: 333066 - RNA, 22 nt, Homo sapiens
ucuggaauguaaaguuuauggg

SEQ ID NO: 333067 - RNA, 21 nt, Homo sapiens
ucuggcccccucaaaucucau

SEQ ID NO: 333068 - RNA, 22 nt, Homo sapiens
ucuggccccucucaaaucucau

SEQ ID NO: 333069 - RNA, 22 nt, Homo sapiens
ucuggcuugugaacugucuucu

SEQ ID NO: 333070 - RNA, 21 nt, Homo sapiens
ucuggcuuucauuccccuucu

SEQ ID NO: 333071 - RNA, 22 nt, Homo sapiens
ucuggcuuugugaguugccaga

SEQ ID NO: 333072 - RNA, 22 nt, Homo sapiens
ucugguguuauucauguaguuu

SEQ ID NO: 333073 - RNA, 19 nt, Homo sapiens
ucugucacuggggguauuc

SEQ ID NO: 333074 - RNA, 22 nt, Homo sapiens
ucugucuuugucaggaccagag

SEQ ID NO: 333075 - RNA, 22 nt, Homo sapiens
ucugugcggucuguguuaugaa

SEQ ID NO: 333076 - RNA, 19 nt, Homo sapiens
ucugugcuugucccccugu

SEQ ID NO: 333077 - RNA, 22 nt, Homo sapiens
ucugugguuguugcauggaaug

SEQ ID NO: 333078 - RNA, 21 nt, Homo sapiens
ucuguguugaucucacuggga

SEQ ID NO: 333079 - RNA, 22 nt, Homo sapiens
ucuguguuugguuggcaauuuc

SEQ ID NO: 333080 - RNA, 22 nt, Homo sapiens
ucuugaacuucugcacacucag

SEQ ID NO: 333081 - RNA, 22 nt, Homo sapiens
ucuugcacaaauuauuuuaacu

SEQ ID NO: 333082 - RNA, 22 nt, Homo sapiens
ucuugcauuuuuaaauagugcu

SEQ ID NO: 333083 - RNA, 22 nt, Homo sapiens
ucuugcuuguuguucccuucau

SEQ ID NO: 333084 - RNA, 22 nt, Homo sapiens
ucuugcuuuugcagagcuucuc

SEQ ID NO: 333085 - RNA, 22 nt, Homo sapiens
ucuuggccaugaauggcaaggc

SEQ ID NO: 333086 - RNA, 21 nt, Homo sapiens
ucuuggguugaauucucccag

SEQ ID NO: 333087 - RNA, 22 nt, Homo sapiens
ucuuggguuugccuugcugcug

SEQ ID NO: 333088 - RNA, 17 nt, Homo sapiens
ucuugugguucuugaau

SEQ ID NO: 333089 - RNA, 22 nt, Homo sapiens
ucuuucacuuagcaugauguuu

SEQ ID NO: 333090 - RNA, 22 nt, Homo sapiens
ucuuugauuaugcagauggguu

SEQ ID NO: 333091 - RNA, 22 nt, Homo sapiens
ucuuuguguaggucaaucuggc

SEQ ID NO: 333092 - RNA, 22 nt, Homo sapiens
ucuuuguguucaggagccacgu

SEQ ID NO: 333093 - RNA, 22 nt, Homo sapiens
uugacuuuuaggaggaaaauga

SEQ ID NO: 333094 - RNA, 22 nt, Homo sapiens
uugagacggagucuugcucuuu

SEQ ID NO: 333095 - RNA, 22 nt, Homo sapiens
uugagacggaguuuugcucuug

SEQ ID NO: 333096 - RNA, 22 nt, Homo sapiens
uugagagaaaaggccaugccuu

SEQ ID NO: 333097 - RNA, 17 nt, Homo sapiens
uugagaguauaucuuac

SEQ ID NO: 333098 - RNA, 22 nt, Homo sapiens
uugagaugauggauaugcuaau

SEQ ID NO: 333099 - RNA, 22 nt, Homo sapiens
uugagauggagcuucacucuug

SEQ ID NO: 333100 - RNA, 22 nt, Homo sapiens
uugagauggagucucacucuug

SEQ ID NO: 333101 - RNA, 22 nt, Homo sapiens
uugagauggagucucgcacugu

SEQ ID NO: 333102 - RNA, 22 nt, Homo sapiens
uugagauggagucucgcucuuu

SEQ ID NO: 333103 - RNA, 22 nt, Homo sapiens
uugagauggagucuuguucucu

SEQ ID NO: 333104 - RNA, 22 nt, Homo sapiens
uugagauggaguuucaauauug

SEQ ID NO: 333105 - RNA, 22 nt, Homo sapiens
uugagauggaguuucacucucg

SEQ ID NO: 333106 - RNA, 22 nt, Homo sapiens
uugagauggaguuucgcucuug

SEQ ID NO: 333107 - RNA, 22 nt, Homo sapiens
uugagcaauccuccugccaugu

SEQ ID NO: 333108 - RNA, 22 nt, Homo sapiens
uugagcaaugaacgauucaggg

SEQ ID NO: 333109 - RNA, 22 nt, Homo sapiens
uuuacagucuuuugugugaguc

SEQ ID NO: 333110 - RNA, 22 nt, Homo sapiens
uuuagguaauauuaaguagcug

SEQ ID NO: 333111 - RNA, 22 nt, Homo sapiens
uuuauccagccucuagcaaggu

SEQ ID NO: 333112 - RNA, 23 nt, Homo sapiens
uuucacagaaggauuguagggcc

SEQ ID NO: 333113 - RNA, 22 nt, Homo sapiens
uuucacagagggcuucuuucua

SEQ ID NO: 333114 - RNA, 22 nt, Homo sapiens
uuucacaguguucucccccaga

SEQ ID NO: 333115 - RNA, 23 nt, Homo sapiens
uuucaggcaggugaaagaccagc

SEQ ID NO: 333116 - RNA, 22 nt, Homo sapiens
uuucauggaauauagucauuuu

SEQ ID NO: 333117 - RNA, 22 nt, Homo sapiens
uuucauggaggcauuuuagauu

SEQ ID NO: 333118 - RNA, 19 nt, Homo sapiens
uuucauguuuuuggugaga

SEQ ID NO: 333119 - RNA, 22 nt, Homo sapiens
uuuccacauggacuuaccuucg

SEQ ID NO: 333120 - RNA, 22 nt, Homo sapiens
uuuccaguuggaaagccuguuu

SEQ ID NO: 333121 - RNA, 22 nt, Homo sapiens
uuuccaguuguucuagaaagcu

SEQ ID NO: 333122 - RNA, 22 nt, Homo sapiens
uuucccuuugcuuugucagcca

SEQ ID NO: 333123 - RNA, 22 nt, Homo sapiens
uuuccuggagaaucuuaacaaa

SEQ ID NO: 333124 - RNA, 21 nt, Homo sapiens
uuuccuggagcguauggcuuc

SEQ ID NO: 333125 - RNA, 22 nt, Homo sapiens
uuucuacagggcuugccaggua

SEQ ID NO: 333126 - RNA, 22 nt, Homo sapiens
uuucugagaccaaaacuuguaa

SEQ ID NO: 333127 - RNA, 22 nt, Homo sapiens
uuucugaggccucaccagaagc

SEQ ID NO: 333128 - RNA, 22 nt, Homo sapiens
uuucuugguuguauuuagacuu

SEQ ID NO: 333129 - RNA, 22 nt, Homo sapiens
uuugaagugugaugccuugaug

SEQ ID NO: 333130 - RNA, 22 nt, Homo sapiens
uuugaaugcaacaaaugcggga

SEQ ID NO: 333131 - RNA, 22 nt, Homo sapiens
uuugacacugggagugugggug

SEQ ID NO: 333132 - RNA, 22 nt, Homo sapiens
uuugagaaugcuaccagagaag

SEQ ID NO: 333133 - RNA, 22 nt, Homo sapiens
uuugagguguauggcaaguuga

SEQ ID NO: 333134 - RNA, 22 nt, Homo sapiens
uuugcaauguugugauggugaa

SEQ ID NO: 333135 - RNA, 22 nt, Homo sapiens
uuugcacuggagauucaauggg

SEQ ID NO: 333136 - RNA, 23 nt, Homo sapiens
uuugcacuugcuccuucuauggc

SEQ ID NO: 333137 - RNA, 22 nt, Homo sapiens
uuugcacuuuuguaauaugguu

SEQ ID NO: 333138 - RNA, 22 nt, Homo sapiens
uuugcaguuuauuccuggggcu

SEQ ID NO: 333139 - RNA, 22 nt, Homo sapiens
uuugcaucuuagaaaguucucc

SEQ ID NO: 333140 - RNA, 22 nt, Homo sapiens
uuugcuuguguaaaaaucugga

SEQ ID NO: 333141 - RNA, 22 nt, Homo sapiens
uuuggcaaagaucaacauguua

SEQ ID NO: 333142 - RNA, 22 nt, Homo sapiens
uuuggcaacguuggaucccuca

SEQ ID NO: 333143 - RNA, 20 nt, Homo sapiens
uuuggcacugagugguauaa

SEQ ID NO: 333144 - RNA, 22 nt, Homo sapiens
uuuggcacuguaaauuucucuu

SEQ ID NO: 333145 - RNA, 22 nt, Homo sapiens
uuuggcauauuuuaagcugguu

SEQ ID NO: 333146 - RNA, 22 nt, Homo sapiens
uuuggcuuugagaagcagugga

SEQ ID NO: 333147 - RNA, 22 nt, Homo sapiens
uuuggcuuuugugauacguaau

SEQ ID NO: 333148 - RNA, 22 nt, Homo sapiens
uuugggcuuuuaaucuagagca

SEQ ID NO: 333149 - RNA, 22 nt, Homo sapiens
uuugguccaguguucagguccu

SEQ ID NO: 333150 - RNA, 22 nt, Homo sapiens
uuuggucccaaugugauaaggu

SEQ ID NO: 333151 - RNA, 22 nt, Homo sapiens
uuuguacacuguugguaggauu

SEQ ID NO: 333152 - RNA, 22 nt, Homo sapiens
uuuguacacuguuggugguuau

SEQ ID NO: 333153 - RNA, 22 nt, Homo sapiens
uuuguacuugaagaaucuuuau

SEQ ID NO: 333154 - RNA, 22 nt, Homo sapiens
uuuguauguuggagauuggaga

SEQ ID NO: 333155 - RNA, 19 nt, Homo sapiens
uuuguccugcccuuucuca

SEQ ID NO: 333156 - RNA, 22 nt, Homo sapiens
uuugugauugcacacucaagau

SEQ ID NO: 333157 - RNA, 22 nt, Homo sapiens
uuugugcuccuaugagaaucua

SEQ ID NO: 333158 - RNA, 22 nt, Homo sapiens
uuugugcuccugugagaaucua

SEQ ID NO: 333159 - RNA, 22 nt, Homo sapiens
uuuguggaaugcccuuauuuau

SEQ ID NO: 333160 - RNA, 23 nt, Homo sapiens
uuuguguccccacccaaaucuca

SEQ ID NO: 333161 - RNA, 16 nt, Homo sapiens
uuugugugugacgaga

SEQ ID NO: 333162 - RNA, 22 nt, Homo sapiens
uuugugugugauuauaaaaggu

SEQ ID NO: 333163 - RNA, 22 nt, Homo sapiens
uuuguucuucguuccugagcca

SEQ ID NO: 333164 - RNA, 20 nt, Homo sapiens
uuuuagcacuuguuauggug

SEQ ID NO: 333165 - RNA, 22 nt, Homo sapiens
uuuuauguuuguucccugccaa

SEQ ID NO: 333166 - RNA, 22 nt, Homo sapiens
uuuucaguggccauaguggaga

SEQ ID NO: 333167 - RNA, 22 nt, Homo sapiens
uuuucaguuuuccagguagccg

SEQ ID NO: 333168 - RNA, 22 nt, Homo sapiens
uuuuccagugggacucccauua

SEQ ID NO: 333169 - RNA, 22 nt, Homo sapiens
uuuugcaauauguuccugaaua

SEQ ID NO: 333170 - RNA, 21 nt, Homo sapiens
uuuugcacacuaugcagcuuu

SEQ ID NO: 333171 - RNA, 22 nt, Homo sapiens
uuuugcacauugauuugguauc

SEQ ID NO: 333172 - RNA, 22 nt, Homo sapiens
uuuugcucuucauagguccugu

SEQ ID NO: 333173 - RNA, 22 nt, Homo sapiens
uuuugcucuucggaagagcuug

SEQ ID NO: 333174 - RNA, 19 nt, Homo sapiens
uuuugcucuuuauaccuau

SEQ ID NO: 333175 - RNA, 22 nt, Homo sapiens
uuuugugacuauuguaaauggg

SEQ ID NO: 333176 - RNA, 22 nt, Homo sapiens
uuuuugagaauuggugaaacac

SEQ ID NO: 333177 - RNA, 22 nt, Homo sapiens
uuuuuuaguuagcugggcauga

SEQ ID NO: 333178 - RNA, 22 nt, Homo sapiens
uugugcuuguaacuacauucag

SEQ ID NO: 333179 - RNA, 22 nt, Homo sapiens
uugugcuuuugagcugagauga

SEQ ID NO: 333180 - RNA, 22 nt, Homo sapiens
uugugcuuuuuaaauagcuucc

SEQ ID NO: 333181 - RNA, 16 nt, Homo sapiens
uuguggcuuuugcaca

SEQ ID NO: 333182 - RNA, 22 nt, Homo sapiens
uugugguaggaguugccauguu

SEQ ID NO: 333183 - RNA, 22 nt, Homo sapiens
uugugguuauagagucucccug

SEQ ID NO: 333184 - RNA, 22 nt, Homo sapiens
uugugguugacuaaauuuguaa

SEQ ID NO: 333185 - RNA, 22 nt, Homo sapiens
uugugguugauacacguaggaa

SEQ ID NO: 333186 - RNA, 22 nt, Homo sapiens
uuguguacuacaguaugccaca

SEQ ID NO: 333187 - RNA, 22 nt, Homo sapiens
uuguucccuucuggcuuuuaug

SEQ ID NO: 333188 - RNA, 22 nt, Homo sapiens
uuuaaagcaugacgagaagaag

SEQ ID NO: 333189 - RNA, 22 nt, Homo sapiens
uuuaaggcaugccuguacaugc

SEQ ID NO: 333190 - RNA, 22 nt, Homo sapiens
uuuaagguauguggugaaaauu

SEQ ID NO: 333191 - RNA, 22 nt, Homo sapiens
uuuaaguguuuguuccugaaaa

SEQ ID NO: 333192 - RNA, 22 nt, Homo sapiens
agcucuuguuaguauuagcagu

SEQ ID NO: 333193 - RNA, 22 nt, Homo sapiens
agcugauuuuaaguccuugucc

SEQ ID NO: 333194 - RNA, 22 nt, Homo sapiens
agcuggcuguggagaaaccccu

SEQ ID NO: 333195 - RNA, 22 nt, Homo sapiens
agcuggucucaggugcccugcu

SEQ ID NO: 333196 - RNA, 22 nt, Homo sapiens
agcugguuuauuucucacaaca

SEQ ID NO: 333197 - RNA, 19 nt, Homo sapiens
agcuguguugccugugaga

SEQ ID NO: 333198 - RNA, 22 nt, Homo sapiens
agcuguuguacacuuuaccuuu

SEQ ID NO: 333199 - RNA, 22 nt, Homo sapiens
agcuucauuguuaugaauguca

SEQ ID NO: 333200 - RNA, 20 nt, Homo sapiens
agcuugguuuggaugaucac

SEQ ID NO: 333201 - RNA, 21 nt, Homo sapiens
agcuuguguguaucacagugu

SEQ ID NO: 333202 - RNA, 22 nt, Homo sapiens
agcuuguguuugucugccuggg

SEQ ID NO: 333203 - RNA, 22 nt, Homo sapiens
agcuuuggauaccugcuguucc

SEQ ID NO: 333204 - RNA, 22 nt, Homo sapiens
aggaaaucuuagcugaggggau

SEQ ID NO: 333205 - RNA, 21 nt, Homo sapiens
aggaagacuaugaucaauugg

SEQ ID NO: 333206 - RNA, 22 nt, Homo sapiens
aggaagugucuucuuuuaggca

SEQ ID NO: 333207 - RNA, 22 nt, Homo sapiens
aggaagugugcaauuaauuucu

SEQ ID NO: 333208 - RNA, 22 nt, Homo sapiens
aggaaucuaagguaucagguua

SEQ ID NO: 333209 - RNA, 22 nt, Homo sapiens
aggaauggaaacuuuugauggu

SEQ ID NO: 333210 - RNA, 18 nt, Homo sapiens
aggaaugguaauacuuca

SEQ ID NO: 333211 - RNA, 19 nt, Homo sapiens
aggacuaaagacuagaagu

SEQ ID NO: 333212 - RNA, 20 nt, Homo sapiens
aggacuacagaggguaggau

SEQ ID NO: 333213 - RNA, 22 nt, Homo sapiens
aggagcacaggacuuugauuau

SEQ ID NO: 333214 - RNA, 21 nt, Homo sapiens
aggagcauucucuugcuuugu

SEQ ID NO: 333215 - RNA, 21 nt, Homo sapiens
aggagcauuguugugguggag

SEQ ID NO: 333216 - RNA, 22 nt, Homo sapiens
aggagguugguaccaucuguuu

SEQ ID NO: 333217 - RNA, 22 nt, Homo sapiens
aggcaaaugccagcaaucacac

SEQ ID NO: 333218 - RNA, 22 nt, Homo sapiens
aggcaagaaugcuuguuucacc

SEQ ID NO: 333219 - RNA, 21 nt, Homo sapiens
aggcaagacuuuuagguuugu

SEQ ID NO: 333220 - RNA, 21 nt, Homo sapiens
aggcaagguguuauuauugaa

SEQ ID NO: 333221 - RNA, 22 nt, Homo sapiens
aggcaaugugagaguuuauuca

SEQ ID NO: 333222 - RNA, 22 nt, Homo sapiens
aggcacacaacccuggaccuga

SEQ ID NO: 333223 - RNA, 19 nt, Homo sapiens
aggcauugugcucaucugu

SEQ ID NO: 333224 - RNA, 22 nt, Homo sapiens
aggcuagaaucuuccaucuugg

SEQ ID NO: 333225 - RNA, 22 nt, Homo sapiens
agggaauguaaguuuuaugaga

SEQ ID NO: 333226 - RNA, 22 nt, Homo sapiens
aggguuuuuauuuauguggcau

SEQ ID NO: 333227 - RNA, 22 nt, Homo sapiens
agguauguaugucuguacagcg

SEQ ID NO: 333228 - RNA, 22 nt, Homo sapiens
aggucaccucaggaaauacuga

SEQ ID NO: 333229 - RNA, 22 nt, Homo sapiens
agguccacuuacuacuccuguu

SEQ ID NO: 333230 - RNA, 22 nt, Homo sapiens
agguuaacaucuauuuuggaug

SEQ ID NO: 333231 - RNA, 22 nt, Homo sapiens
aguaacacaccugcauggugug

SEQ ID NO: 333232 - RNA, 22 nt, Homo sapiens
aguacacuguuaaaaagaagug

SEQ ID NO: 333233 - RNA, 22 nt, Homo sapiens
aguacaucuggcuggauagaua

SEQ ID NO: 333234 - RNA, 21 nt, Homo sapiens
aguagcacugugucuuacaaa

SEQ ID NO: 333235 - RNA, 22 nt, Homo sapiens
aguagcauuggggggcauccuc

SEQ ID NO: 333236 - RNA, 16 nt, Homo sapiens
aguaguuuuacagauu

SEQ ID NO: 333237 - RNA, 22 nt, Homo sapiens
aguauguuuugaaaccaagaag

SEQ ID NO: 333238 - RNA, 22 nt, Homo sapiens
agucaacaucaugaaguggaaa

SEQ ID NO: 333239 - RNA, 22 nt, Homo sapiens
agucacagguucuugggauuag

SEQ ID NO: 333240 - RNA, 22 nt, Homo sapiens
agucagucuguccugugcugag

SEQ ID NO: 333241 - RNA, 22 nt, Homo sapiens
agucagugucuguaaggagaac

SEQ ID NO: 333242 - RNA, 22 nt, Homo sapiens
agucaugggagagaugugaucg

SEQ ID NO: 333243 - RNA, 22 nt, Homo sapiens
agugacaugggaucaaaucuga

SEQ ID NO: 333244 - RNA, 22 nt, Homo sapiens
agugagcuggagaaaagaaacu

SEQ ID NO: 333245 - RNA, 22 nt, Homo sapiens
agugagcuguuuuuacuuucug

SEQ ID NO: 333246 - RNA, 21 nt, Homo sapiens
agugagucauuuggaaagcaa

SEQ ID NO: 333247 - RNA, 22 nt, Homo sapiens
agugauauguuugccuugaggg

SEQ ID NO: 333248 - RNA, 22 nt, Homo sapiens
agugcaaagccgagguuucuug

SEQ ID NO: 333249 - RNA, 22 nt, Homo sapiens
agugcaauaaggauguagaacu

SEQ ID NO: 333250 - RNA, 22 nt, Homo sapiens
agugcaguggcauggucauaac

SEQ ID NO: 333251 - RNA, 22 nt, Homo sapiens
agugcauaugucuuuuuggaag

SEQ ID NO: 333252 - RNA, 22 nt, Homo sapiens
agugcauuuguucugugucagg

SEQ ID NO: 333253 - RNA, 22 nt, Homo sapiens
agugccacugcacucuagccug

SEQ ID NO: 333254 - RNA, 22 nt, Homo sapiens
agugcuuaauagauguccagca

SEQ ID NO: 333255 - RNA, 22 nt, Homo sapiens
aguggcuuuuuaguggcagaug

SEQ ID NO: 333256 - RNA, 20 nt, Homo sapiens
agugguuuucaaauaugucu

SEQ ID NO: 333257 - RNA, 22 nt, Homo sapiens
aguucaaugcucuuucuacuau

SEQ ID NO: 333258 - RNA, 22 nt, Homo sapiens
auaaaagcaggucuaggucagg

SEQ ID NO: 333259 - RNA, 22 nt, Homo sapiens
auaaacagcuuauccucuauuc

SEQ ID NO: 333260 - RNA, 18 nt, Homo sapiens
auaaacucaucauuuuua

SEQ ID NO: 333261 - RNA, 22 nt, Homo sapiens
auaaagccaggagacguaauug

SEQ ID NO: 333262 - RNA, 22 nt, Homo sapiens
auaaauaguaguugugguggcc

SEQ ID NO: 333263 - RNA, 22 nt, Homo sapiens
auaaaugcauugagaacugcug

SEQ ID NO: 333264 - RNA, 22 nt, Homo sapiens
auaaaugcuuccagucauuaaa

SEQ ID NO: 333265 - RNA, 22 nt, Homo sapiens
auaacagcauuauugcauacgu

SEQ ID NO: 333266 - RNA, 18 nt, Homo sapiens
auaaccuggugcuuucaa

SEQ ID NO: 333267 - RNA, 22 nt, Homo sapiens
auaagaagugaaccagacgucu

SEQ ID NO: 333268 - RNA, 22 nt, Homo sapiens
auaagaucauuugcuaagaggg

SEQ ID NO: 333269 - RNA, 22 nt, Homo sapiens
auaauaccugccacauuugaau

SEQ ID NO: 333270 - RNA, 22 nt, Homo sapiens
auaauacuuuuauuuugaggaa

SEQ ID NO: 333271 - RNA, 22 nt, Homo sapiens
auaauagcugaucauuuagaag

SEQ ID NO: 333272 - RNA, 22 nt, Homo sapiens
auaauagguugauugacauugc

SEQ ID NO: 333273 - RNA, 22 nt, Homo sapiens
auaauaucagguugugaugaug

SEQ ID NO: 333274 - RNA, 22 nt, Homo sapiens
auaauguuuauccagaggaguu

SEQ ID NO: 333275 - RNA, 22 nt, Homo sapiens
auacaagugccauguuggugug

SEQ ID NO: 333276 - RNA, 22 nt, Homo sapiens
auacaguaaugucuuaggcugu

SEQ ID NO: 333277 - RNA, 22 nt, Homo sapiens
auacaguaucuucuggcaagca

SEQ ID NO: 333278 - RNA, 22 nt, Homo sapiens
auagaagcuauguauaggggcc

SEQ ID NO: 333279 - RNA, 22 nt, Homo sapiens
auagaaucaucugugcacuagu

SEQ ID NO: 333280 - RNA, 22 nt, Homo sapiens
ugaacagucaucucucuuguau

SEQ ID NO: 333281 - RNA, 22 nt, Homo sapiens
ugaagacucaauuauuaugaac

SEQ ID NO: 333282 - RNA, 22 nt, Homo sapiens
ugaagacucaguuugagggaca

SEQ ID NO: 333283 - RNA, 22 nt, Homo sapiens
ugaagagucuaaaucugucuuc

SEQ ID NO: 333284 - RNA, 20 nt, Homo sapiens
ugaaggaggucauuuauacc

SEQ ID NO: 333285 - RNA, 22 nt, Homo sapiens
ugaaguaauguuuuauucuauu

SEQ ID NO: 333286 - RNA, 22 nt, Homo sapiens
ugaagugaagacucacagaagg

SEQ ID NO: 333287 - RNA, 22 nt, Homo sapiens
ugaaguguuuuuucaggcaugu

SEQ ID NO: 333288 - RNA, 22 nt, Homo sapiens
ugaaugauuuuaaaagccucuc

SEQ ID NO: 333289 - RNA, 22 nt, Homo sapiens
ugaauggauccaauucuuagua

SEQ ID NO: 333290 - RNA, 22 nt, Homo sapiens
ugaauguaagaugucugcuggu

SEQ ID NO: 333291 - RNA, 22 nt, Homo sapiens
ugaauucuguccaaaauaacug

SEQ ID NO: 333292 - RNA, 22 nt, Homo sapiens
ugacaagauauggucuuaucaa

SEQ ID NO: 333293 - RNA, 22 nt, Homo sapiens
ugacaagugauuaaggcauauu

SEQ ID NO: 333294 - RNA, 22 nt, Homo sapiens
ugacacagcaagauggaaccau

SEQ ID NO: 333295 - RNA, 22 nt, Homo sapiens
ugacacagugggggauccuuuu

SEQ ID NO: 333296 - RNA, 22 nt, Homo sapiens
ugacacauguagacaucuggug

SEQ ID NO: 333297 - RNA, 17 nt, Homo sapiens
ugacagaaacuuguugu

SEQ ID NO: 333298 - RNA, 22 nt, Homo sapiens
ugacagagaagcauugaguuca

SEQ ID NO: 333299 - RNA, 22 nt, Homo sapiens
ugacagaggucuuuuaauagcu

SEQ ID NO: 333300 - RNA, 22 nt, Homo sapiens
ugacagcaucaggauuggagag

SEQ ID NO: 333301 - RNA, 22 nt, Homo sapiens
ugacaggauggagaucgguauu

SEQ ID NO: 333302 - RNA, 22 nt, Homo sapiens
ugacagugaacagguuaccacu

SEQ ID NO: 333303 - RNA, 18 nt, Homo sapiens
ugacaguuucuuuauauu

SEQ ID NO: 333304 - RNA, 22 nt, Homo sapiens
ugacaugaugagcaauaauggc

SEQ ID NO: 333305 - RNA, 22 nt, Homo sapiens
ugacaugauguuccuacacugu

SEQ ID NO: 333306 - RNA, 22 nt, Homo sapiens
ugacauguauaucuuacgcuau

SEQ ID NO: 333307 - RNA, 22 nt, Homo sapiens
ugacauuacagucacuugcugu

SEQ ID NO: 333308 - RNA, 18 nt, Homo sapiens
ugacauugagcugagaaa

SEQ ID NO: 333309 - RNA, 22 nt, Homo sapiens
ugaccaaugacauugaagagcu

SEQ ID NO: 333310 - RNA, 22 nt, Homo sapiens
ugacuacaaccuccaccucccg

SEQ ID NO: 333311 - RNA, 22 nt, Homo sapiens
ugacuacaccacacgguuaagg

SEQ ID NO: 333312 - RNA, 22 nt, Homo sapiens
ugacuagagggcuuuuguguag

SEQ ID NO: 333313 - RNA, 22 nt, Homo sapiens
ugacuauaggauaacaugcauu

SEQ ID NO: 333314 - RNA, 22 nt, Homo sapiens
ugacuggagaccucaguagggu

SEQ ID NO: 333315 - RNA, 21 nt, Homo sapiens
ugagaacaacaggucaagcag

SEQ ID NO: 333316 - RNA, 22 nt, Homo sapiens
ugagaacagauggcuuuauuau

SEQ ID NO: 333317 - RNA, 22 nt, Homo sapiens
ugagaacauggagaacccccca

SEQ ID NO: 333318 - RNA, 16 nt, Homo sapiens
ugagaacaugggguau

SEQ ID NO: 333319 - RNA, 20 nt, Homo sapiens
ugagaacaugugguauuugg

SEQ ID NO: 333320 - RNA, 22 nt, Homo sapiens
ugagaacauuccucuuccuggc

SEQ ID NO: 333321 - RNA, 22 nt, Homo sapiens
ugagaacuaaaaugugguauau

SEQ ID NO: 333322 - RNA, 22 nt, Homo sapiens
ugagaacugguagcacuuguga

SEQ ID NO: 333323 - RNA, 22 nt, Homo sapiens
ugagaagcauaccagugucugu

SEQ ID NO: 333324 - RNA, 22 nt, Homo sapiens
ugagaauauuuuccaugucuca

SEQ ID NO: 333325 - RNA, 19 nt, Homo sapiens
ugagaauguuaccaggucc

SEQ ID NO: 333326 - RNA, 23 nt, Homo sapiens
ugagacauuggaaaguuaggcag

SEQ ID NO: 333327 - RNA, 22 nt, Homo sapiens
ugagacugagucucccucuguc

SEQ ID NO: 333328 - RNA, 22 nt, Homo sapiens
ugagacugaguuuugcucguug

SEQ ID NO: 333329 - RNA, 22 nt, Homo sapiens
ugagagacagacauuaucuuau

SEQ ID NO: 333330 - RNA, 22 nt, Homo sapiens
ugagagaugaacuauucuugaa

SEQ ID NO: 333331 - RNA, 22 nt, Homo sapiens
ugagagcuuugaugcacuguuu

SEQ ID NO: 333332 - RNA, 22 nt, Homo sapiens
ugagaggugaauggcaggcuca

SEQ ID NO: 333333 - RNA, 22 nt, Homo sapiens
ugagaucaacugagucagagca

SEQ ID NO: 333334 - RNA, 22 nt, Homo sapiens
ugagaucaagauguuagggacu

SEQ ID NO: 333335 - RNA, 22 nt, Homo sapiens
ugagaucaaggugggcccuggg

SEQ ID NO: 333336 - RNA, 22 nt, Homo sapiens
ugagaucaagguuaauauaauc

SEQ ID NO: 333337 - RNA, 22 nt, Homo sapiens
ugagaucacgccacugcacucc

SEQ ID NO: 333338 - RNA, 22 nt, Homo sapiens
ugagaucagugaagaaguguuu

SEQ ID NO: 333339 - RNA, 22 nt, Homo sapiens
ugagaugaguugcgcucugucg

SEQ ID NO: 333340 - RNA, 22 nt, Homo sapiens
ugagaugaugggauaagagggc

SEQ ID NO: 333341 - RNA, 22 nt, Homo sapiens
ugagauggaguuucgcuuuugu

SEQ ID NO: 333342 - RNA, 22 nt, Homo sapiens
ugagauggaucuuggauuugaa

SEQ ID NO: 333343 - RNA, 22 nt, Homo sapiens
ugagauggcuuuauugcugaau

SEQ ID NO: 333344 - RNA, 23 nt, Homo sapiens
ugagaugucugauugcgaggguc

SEQ ID NO: 333345 - RNA, 22 nt, Homo sapiens
ugagauguguccagaucuaguu

SEQ ID NO: 333346 - RNA, 22 nt, Homo sapiens
ugagauuaucguaauguaucuc

SEQ ID NO: 333347 - RNA, 23 nt, Homo sapiens
ugagcaauauucuacuauugagu

SEQ ID NO: 333348 - RNA, 22 nt, Homo sapiens
ugagcauauugugauaccuaaa

SEQ ID NO: 333349 - RNA, 22 nt, Homo sapiens
ugagccaaugauuugaauagag

SEQ ID NO: 333350 - RNA, 22 nt, Homo sapiens
ugagcugagaaaugcagcagcu

SEQ ID NO: 333351 - RNA, 22 nt, Homo sapiens
ugagcugagaucaugcuauugu

SEQ ID NO: 333352 - RNA, 22 nt, Homo sapiens
ugagcugguacuaauauuauca

SEQ ID NO: 333353 - RNA, 22 nt, Homo sapiens
ugaggaaugaccccgugugguc

SEQ ID NO: 333354 - RNA, 22 nt, Homo sapiens
ugaggacugagaggcacugugg

SEQ ID NO: 333355 - RNA, 22 nt, Homo sapiens
ccauugaacaugaaggaaugug

SEQ ID NO: 333356 - RNA, 23 nt, Homo sapiens
ccauugcacuccagccucaguga

SEQ ID NO: 333357 - RNA, 22 nt, Homo sapiens
ccauuucacucuuccugaagga

SEQ ID NO: 333358 - RNA, 22 nt, Homo sapiens
ccccagugguugcaacagcaga

SEQ ID NO: 333359 - RNA, 22 nt, Homo sapiens
ccccaguguguaaaggccuugc

SEQ ID NO: 333360 - RNA, 18 nt, Homo sapiens
cccgggugggcuguuccc

SEQ ID NO: 333361 - RNA, 21 nt, Homo sapiens
cccugguguuuggaguuugag

SEQ ID NO: 333362 - RNA, 22 nt, Homo sapiens
cccuugcacuucagagcugcau

SEQ ID NO: 333363 - RNA, 22 nt, Homo sapiens
ccuccauuugugucaggaaguc

SEQ ID NO: 333364 - RNA, 22 nt, Homo sapiens
ccugagacgaauggagugaaca

SEQ ID NO: 333365 - RNA, 22 nt, Homo sapiens
ccuggcacugggccccguggcu

SEQ ID NO: 333366 - RNA, 22 nt, Homo sapiens
ccugguguuuugauggucgggu

SEQ ID NO: 333367 - RNA, 23 nt, Homo sapiens
ccuguagaaugucugugauacuu

SEQ ID NO: 333368 - RNA, 22 nt, Homo sapiens
ccuucauccuccagcaggcuag

SEQ ID NO: 333369 - RNA, 22 nt, Homo sapiens
ccuuggcacuuugccacagugc

SEQ ID NO: 333370 - RNA, 22 nt, Homo sapiens
ccuugguggccacaagacauug

SEQ ID NO: 333371 - RNA, 22 nt, Homo sapiens
cgcaguguuugugucccugggu

SEQ ID NO: 333372 - RNA, 22 nt, Homo sapiens
cggcaguggguaagccaagcuu

SEQ ID NO: 333373 - RNA, 22 nt, Homo sapiens
cggucacagugauucaaggguc

SEQ ID NO: 333374 - RNA, 22 nt, Homo sapiens
cuaaaguucuucugagagaaca

SEQ ID NO: 333375 - RNA, 18 nt, Homo sapiens
cuaauacuauucaacaag

SEQ ID NO: 333376 - RNA, 22 nt, Homo sapiens
cuaaucugugcauagaagaggc

SEQ ID NO: 333377 - RNA, 22 nt, Homo sapiens
cuaauucuggccaaagggauaa

SEQ ID NO: 333378 - RNA, 22 nt, Homo sapiens
cuacacaugcaggcucccugcc

SEQ ID NO: 333379 - RNA, 22 nt, Homo sapiens
cuagaauguauaaaaccaagcu

SEQ ID NO: 333380 - RNA, 22 nt, Homo sapiens
cuagagagaagcugugugaccu

SEQ ID NO: 333381 - RNA, 22 nt, Homo sapiens
cuagaggcacagccuaggcacu

SEQ ID NO: 333382 - RNA, 22 nt, Homo sapiens
cuagauuguuuccauaaugaca

SEQ ID NO: 333383 - RNA, 22 nt, Homo sapiens
cuagcagcaugagaauggacca

SEQ ID NO: 333384 - RNA, 22 nt, Homo sapiens
cuagcccugagauaaaugucau

SEQ ID NO: 333385 - RNA, 22 nt, Homo sapiens
cuauaguauaguuugaagucag

SEQ ID NO: 333386 - RNA, 18 nt, Homo sapiens
cuaugccacuuuauauca

SEQ ID NO: 333387 - RNA, 22 nt, Homo sapiens
cuaugcuucuuaaauuaguuau

SEQ ID NO: 333388 - RNA, 22 nt, Homo sapiens
cuaugguuucucaaacuccuga

SEQ ID NO: 333389 - RNA, 22 nt, Homo sapiens
cuaugucuuucauauuuugggg

SEQ ID NO: 333390 - RNA, 22 nt, Homo sapiens
cucaaguacaugggauuacagg

SEQ ID NO: 333391 - RNA, 22 nt, Homo sapiens
cucacagucagaagggacuugc

SEQ ID NO: 333392 - RNA, 22 nt, Homo sapiens
cucacagugacacgaaccccca

SEQ ID NO: 333393 - RNA, 22 nt, Homo sapiens
cucacaguucuaaaggcaagaa

SEQ ID NO: 333394 - RNA, 22 nt, Homo sapiens
cucaggguacuucuccuuugcu

SEQ ID NO: 333395 - RNA, 22 nt, Homo sapiens
cucagugucuggcacacagaaa

SEQ ID NO: 333396 - RNA, 22 nt, Homo sapiens
cucauugcaaucuccaccuccc

SEQ ID NO: 333397 - RNA, 22 nt, Homo sapiens
cuccacugagcaggugggaggc

SEQ ID NO: 333398 - RNA, 22 nt, Homo sapiens
cuccccuuuaguuucuuaauaa

SEQ ID NO: 333399 - RNA, 22 nt, Homo sapiens
cucucugagccccagacaccuu

SEQ ID NO: 333400 - RNA, 22 nt, Homo sapiens
cucugcuuaaugucccacuuga

SEQ ID NO: 333401 - RNA, 22 nt, Homo sapiens
cucuuugaugugaaccgugguu

SEQ ID NO: 333402 - RNA, 22 nt, Homo sapiens
cugaaagguauacgcuuguuau

SEQ ID NO: 333403 - RNA, 22 nt, Homo sapiens
cugaauguccaggcagagguuu

SEQ ID NO: 333404 - RNA, 22 nt, Homo sapiens
cugacaagauucaucacucagu

SEQ ID NO: 333405 - RNA, 22 nt, Homo sapiens
cugacaagugaucacagcagca

SEQ ID NO: 333406 - RNA, 22 nt, Homo sapiens
cugagagaugagaccucucacu

SEQ ID NO: 333407 - RNA, 22 nt, Homo sapiens
cugagcaaaguucuauuuaugg

SEQ ID NO: 333408 - RNA, 22 nt, Homo sapiens
cugagcaagucauuuuguuaaa

SEQ ID NO: 333409 - RNA, 22 nt, Homo sapiens
cugaggacaucagggaagcauc

SEQ ID NO: 333410 - RNA, 22 nt, Homo sapiens
cugaggauauucagccucugug

SEQ ID NO: 333411 - RNA, 22 nt, Homo sapiens
cugagguauuuaggugaaagaa

SEQ ID NO: 333412 - RNA, 22 nt, Homo sapiens
cugaggugggaggauuggcuug

SEQ ID NO: 333413 - RNA, 22 nt, Homo sapiens
cugagugcaagugauccuccca

SEQ ID NO: 333414 - RNA, 22 nt, Homo sapiens
cugaucuggaggugucugggga

SEQ ID NO: 333415 - RNA, 22 nt, Homo sapiens
cugauuguagagccccagggcu

SEQ ID NO: 333416 - RNA, 22 nt, Homo sapiens
cugauugugcagagguguaauu

SEQ ID NO: 333417 - RNA, 20 nt, Homo sapiens
cugcaaaugcugcugcugau

SEQ ID NO: 333418 - RNA, 22 nt, Homo sapiens
cugcaagaaucguaguauuuga

SEQ ID NO: 333419 - RNA, 19 nt, Homo sapiens
cugcacugagaaaaggagg

SEQ ID NO: 333420 - RNA, 22 nt, Homo sapiens
cugcagaucuuggggcuugcca

SEQ ID NO: 333421 - RNA, 22 nt, Homo sapiens
cugccacugacaccucaaggac

SEQ ID NO: 333422 - RNA, 22 nt, Homo sapiens
cugccugagaaaauggagggca

SEQ ID NO: 333423 - RNA, 22 nt, Homo sapiens
cugcuauauugguucaggcuug

SEQ ID NO: 333424 - RNA, 18 nt, Homo sapiens
cuggaaggcuacuacagu

SEQ ID NO: 333425 - RNA, 22 nt, Homo sapiens
cuggagcauugguggauuuguu

SEQ ID NO: 333426 - RNA, 22 nt, Homo sapiens
cuggauggugagauaaagaaaa

SEQ ID NO: 333427 - RNA, 22 nt, Homo sapiens
cuggauguaaaugaaacuacag

SEQ ID NO: 333428 - RNA, 22 nt, Homo sapiens
cuggcucugagguguuuagggc

SEQ ID NO: 333429 - RNA, 22 nt, Homo sapiens
cuggcucuguuagaagaaccag

SEQ ID NO: 333430 - RNA, 22 nt, Homo sapiens
cugggguaggacuggcuuuuga

SEQ ID NO: 333431 - RNA, 22 nt, Homo sapiens
cugguuguucuggaugggcagg

SEQ ID NO: 333432 - RNA, 22 nt, Homo sapiens
cuguaacagaauaaauuuguuu

SEQ ID NO: 333433 - RNA, 22 nt, Homo sapiens
cuguagcuuuuauaugcuuagc

SEQ ID NO: 333434 - RNA, 22 nt, Homo sapiens
cuguaugugagaaauaauaagu

SEQ ID NO: 333435 - RNA, 22 nt, Homo sapiens
cugugcacaucuggcggcccga

SEQ ID NO: 333436 - RNA, 22 nt, Homo sapiens
cugugcauguaugcgugaguuc

SEQ ID NO: 333437 - RNA, 22 nt, Homo sapiens
cugugguguaacucuuggggcg

SEQ ID NO: 333438 - RNA, 22 nt, Homo sapiens
cugugguugagcuuugccauga

SEQ ID NO: 333439 - RNA, 22 nt, Homo sapiens
cuguuugaggguuugcuuucag

SEQ ID NO: 333440 - RNA, 18 nt, Homo sapiens
cuuagguagcucauucca

SEQ ID NO: 333441 - RNA, 22 nt, Homo sapiens
cuuccagcuggguucagucagu

SEQ ID NO: 333442 - RNA, 22 nt, Homo sapiens
ugagucaugcuggagucauggc

SEQ ID NO: 333443 - RNA, 22 nt, Homo sapiens
ugagugaaagaagcacuaagga

SEQ ID NO: 333444 - RNA, 22 nt, Homo sapiens
ugagugaaggggcucuguugug

SEQ ID NO: 333445 - RNA, 22 nt, Homo sapiens
ugagugaggcugggcagucccu

SEQ ID NO: 333446 - RNA, 22 nt, Homo sapiens
ugaguguccaccccuuucacag

SEQ ID NO: 333447 - RNA, 22 nt, Homo sapiens
ugaguuaaucucuacgauagaa

SEQ ID NO: 333448 - RNA, 22 nt, Homo sapiens
ugauaacauuucuucugguaca

SEQ ID NO: 333449 - RNA, 22 nt, Homo sapiens
ugauaacugaucuggauuugua

SEQ ID NO: 333450 - RNA, 22 nt, Homo sapiens
ugauagucauucaauuuagcca

SEQ ID NO: 333451 - RNA, 22 nt, Homo sapiens
ugauaucugaucauccuugaua

SEQ ID NO: 333452 - RNA, 22 nt, Homo sapiens
ugauaugaaucaaucacucuuc

SEQ ID NO: 333453 - RNA, 21 nt, Homo sapiens
ugauaugguuuggauaugugu

SEQ ID NO: 333454 - RNA, 22 nt, Homo sapiens
ugauaugucacuugaucauggu

SEQ ID NO: 333455 - RNA, 20 nt, Homo sapiens
ugauauuuucugagcaggaa

SEQ ID NO: 333456 - RNA, 22 nt, Homo sapiens
ugauauuuuugauccuuaaguu

SEQ ID NO: 333457 - RNA, 22 nt, Homo sapiens
ugaugcugaguggcuauuugaa

SEQ ID NO: 333458 - RNA, 22 nt, Homo sapiens
ugaugguuuuauuaauaggacc

SEQ ID NO: 333459 - RNA, 22 nt, Homo sapiens
ugauugcacaccugcacucaag

SEQ ID NO: 333460 - RNA, 19 nt, Homo sapiens
ugauuguaagcuuggugag

SEQ ID NO: 333461 - RNA, 22 nt, Homo sapiens
ugauuugucucucagcccuacu

SEQ ID NO: 333462 - RNA, 21 nt, Homo sapiens
ugcaagaaucaggaagcugcc

SEQ ID NO: 333463 - RNA, 22 nt, Homo sapiens
ugcaagaugauuucaauugaua

SEQ ID NO: 333464 - RNA, 20 nt, Homo sapiens
ugcaaguugccuuuggaggc

SEQ ID NO: 333465 - RNA, 22 nt, Homo sapiens
ugcaccacacuccauccugggc

SEQ ID NO: 333466 - RNA, 22 nt, Homo sapiens
ugcaccacugcacuccacccug

SEQ ID NO: 333467 - RNA, 22 nt, Homo sapiens
ugcaccacugcacuccaggcug

SEQ ID NO: 333468 - RNA, 22 nt, Homo sapiens
ugcaccauugucaccuggguga

SEQ ID NO: 333469 - RNA, 22 nt, Homo sapiens
ugcacugucuugucgcauagca

SEQ ID NO: 333470 - RNA, 20 nt, Homo sapiens
ugcagcacgggcccuuucca

SEQ ID NO: 333471 - RNA, 22 nt, Homo sapiens
ugcagcauugcacuccagccug

SEQ ID NO: 333472 - RNA, 22 nt, Homo sapiens
ugcagcucagcugcggaguuuu

SEQ ID NO: 333473 - RNA, 22 nt, Homo sapiens
ugcaguacuuugaaauauacug

SEQ ID NO: 333474 - RNA, 23 nt, Homo sapiens
ugcaguagugagaucuaggcuca

SEQ ID NO: 333475 - RNA, 21 nt, Homo sapiens
ugcagugugguugcccugcug

SEQ ID NO: 333476 - RNA, 22 nt, Homo sapiens
ugcaguguucuuuagaggaaau

SEQ ID NO: 333477 - RNA, 22 nt, Homo sapiens
ugcauacacaagcauacaugua

SEQ ID NO: 333478 - RNA, 22 nt, Homo sapiens
ugcauagaauguucuguaaaua

SEQ ID NO: 333479 - RNA, 22 nt, Homo sapiens
ugcauaggcuaaaauccuggcc

SEQ ID NO: 333480 - RNA, 22 nt, Homo sapiens
ugcauauucgaguuauuuuggg

SEQ ID NO: 333481 - RNA, 22 nt, Homo sapiens
ugcaugaugcugagauuuggga

SEQ ID NO: 333482 - RNA, 21 nt, Homo sapiens
ugcauggagaacacugagggu

SEQ ID NO: 333483 - RNA, 21 nt, Homo sapiens
ugcauuggagaauguuucuca

SEQ ID NO: 333484 - RNA, 19 nt, Homo sapiens
ugcauugucugggaaaugg

SEQ ID NO: 333485 - RNA, 21 nt, Homo sapiens
ugcauugucuugaguuuaaau

SEQ ID NO: 333486 - RNA, 22 nt, Homo sapiens
ugcauuguggaucuaaaugcau

SEQ ID NO: 333487 - RNA, 22 nt, Homo sapiens
ugcauuguuccgaauguguccu

SEQ ID NO: 333488 - RNA, 22 nt, Homo sapiens
ugccaaggagucagucccuaga

SEQ ID NO: 333489 - RNA, 22 nt, Homo sapiens
ugccaguuuuuacauuuccugu

SEQ ID NO: 333490 - RNA, 22 nt, Homo sapiens
ugccauagcaaugguaagcuga

SEQ ID NO: 333491 - RNA, 22 nt, Homo sapiens
ugcccuguaucccacuguuuca

SEQ ID NO: 333492 - RNA, 22 nt, Homo sapiens
ugccuacugaauuuaccuggcu

SEQ ID NO: 333493 - RNA, 23 nt, Homo sapiens
ugccuagaugcugcccugggaca

SEQ ID NO: 333494 - RNA, 22 nt, Homo sapiens
ugccuaguggaaggagagcaaa

SEQ ID NO: 333495 - RNA, 22 nt, Homo sapiens
ugccuaguggccuuaugaguau

SEQ ID NO: 333496 - RNA, 22 nt, Homo sapiens
ugccuggagagcuccuacauau

SEQ ID NO: 333497 - RNA, 22 nt, Homo sapiens
ugccuuauuccaacugagcucu

SEQ ID NO: 333498 - RNA, 22 nt, Homo sapiens
ugcgccauugaacuccaggcug

SEQ ID NO: 333499 - RNA, 22 nt, Homo sapiens
ugcgccauugcacuccagccug

SEQ ID NO: 333500 - RNA, 21 nt, Homo sapiens
ugcuauguuguccaggcuggc

SEQ ID NO: 333501 - RNA, 22 nt, Homo sapiens
ugcucaguuuaaaacuuuugag

SEQ ID NO: 333502 - RNA, 22 nt, Homo sapiens
ugcugcaaacaggcaucugugg

SEQ ID NO: 333503 - RNA, 22 nt, Homo sapiens
ugcugcauuggggauuaaguuu

SEQ ID NO: 333504 - RNA, 19 nt, Homo sapiens
ugcugcauugugaccuugc

SEQ ID NO: 333505 - RNA, 22 nt, Homo sapiens
ugcugcuguuguuguuacuagc

SEQ ID NO: 333506 - RNA, 22 nt, Homo sapiens
ugcuggugauuaaauccugaag

SEQ ID NO: 333507 - RNA, 18 nt, Homo sapiens
ugcuuagucauuuucaau

SEQ ID NO: 333508 - RNA, 22 nt, Homo sapiens
ugcuuuguugaaaaucauuugg

SEQ ID NO: 333509 - RNA, 22 nt, Homo sapiens
uggaaaguacugagguccaccu

SEQ ID NO: 333510 - RNA, 22 nt, Homo sapiens
uggaagacauugggugaagggu

SEQ ID NO: 333511 - RNA, 22 nt, Homo sapiens
uggaaguaaccaugaauggaau

SEQ ID NO: 333512 - RNA, 22 nt, Homo sapiens
uggaaguaaucaugagguagca

SEQ ID NO: 333513 - RNA, 22 nt, Homo sapiens
uggaauacuauucugugcugga

SEQ ID NO: 333514 - RNA, 21 nt, Homo sapiens
uggaaucuauuauuccaguuu

SEQ ID NO: 333515 - RNA, 20 nt, Homo sapiens
uggaaucugaagaucucagu

SEQ ID NO: 333516 - RNA, 22 nt, Homo sapiens
uggaauguauaucguuuuuugu

SEQ ID NO: 333517 - RNA, 22 nt, Homo sapiens
uggaauguuauggcuuuaaucu

SEQ ID NO: 333518 - RNA, 22 nt, Homo sapiens
uggaauuaauuaaaauauacug

SEQ ID NO: 333519 - RNA, 22 nt, Homo sapiens
uggacuguaagugccuugagua

SEQ ID NO: 333520 - RNA, 22 nt, Homo sapiens
uggagagcaaagaauuuguuag

SEQ ID NO: 333521 - RNA, 22 nt, Homo sapiens
uggagagugagggccuccuuaa

SEQ ID NO: 333522 - RNA, 22 nt, Homo sapiens
uggaguauuauguaauuucaau

SEQ ID NO: 333523 - RNA, 21 nt, Homo sapiens
uggagugaagaguuuauugac

SEQ ID NO: 333524 - RNA, 22 nt, Homo sapiens
uggagugauaugguuauauggg

SEQ ID NO: 333525 - RNA, 22 nt, Homo sapiens
uggaguguaauuagccaucagu

SEQ ID NO: 333526 - RNA, 22 nt, Homo sapiens
uggaguguagcggcaccuauua

SEQ ID NO: 333527 - RNA, 22 nt, Homo sapiens
uggaguguguuaacuuuacaag

SEQ ID NO: 333528 - RNA, 16 nt, Homo sapiens
uggaguguuuguuaga

SEQ ID NO: 333529 - RNA, 22 nt, Homo sapiens
ugagauggaguuucgcucuugu

SEQ ID NO: 333530 - RNA, 22 nt, Homo sapiens
ugagauggguaauuaaauggug

SEQ ID NO: 333531 - RNA, 22 nt, Homo sapiens
ugagaugguaaauuuuuguugu

SEQ ID NO: 333532 - RNA, 22 nt, Homo sapiens
ugagauguaaucucgcucuguc

SEQ ID NO: 333533 - RNA, 22 nt, Homo sapiens
ugagcaaaauuuuggacauaga

SEQ ID NO: 333534 - RNA, 22 nt, Homo sapiens
ugagcacaggugcgcgguuacu

SEQ ID NO: 333535 - RNA, 22 nt, Homo sapiens
ugagcagaaagcugcaaggucg

SEQ ID NO: 333536 - RNA, 22 nt, Homo sapiens
ugagcagaaguuuugauuggcg

SEQ ID NO: 333537 - RNA, 22 nt, Homo sapiens
ugagcagaguuguuucuccuga

SEQ ID NO: 333538 - RNA, 22 nt, Homo sapiens
ugagccaugguuagcuucucau

SEQ ID NO: 333539 - RNA, 22 nt, Homo sapiens
ugagcuagggccuggaauaggg

SEQ ID NO: 333540 - RNA, 22 nt, Homo sapiens
ugagcucaugcauucuugagga

SEQ ID NO: 333541 - RNA, 20 nt, Homo sapiens
ugagcuuguaaacacuguuu

SEQ ID NO: 333542 - RNA, 18 nt, Homo sapiens
ugaggaaaggguuugcua

SEQ ID NO: 333543 - RNA, 22 nt, Homo sapiens
ugaggcaaggcugaaugaaggc

SEQ ID NO: 333544 - RNA, 22 nt, Homo sapiens
ugaggcuaggauaggcugauuc

SEQ ID NO: 333545 - RNA, 22 nt, Homo sapiens
ugagguaacagaagcgagcauu

SEQ ID NO: 333546 - RNA, 20 nt, Homo sapiens
ugaggucaggaguuacagac

SEQ ID NO: 333547 - RNA, 21 nt, Homo sapiens
ugaggucaugaugcugcuucc

SEQ ID NO: 333548 - RNA, 22 nt, Homo sapiens
ugaggucauguucugucagguu

SEQ ID NO: 333549 - RNA, 22 nt, Homo sapiens
ugaggucauucaugugggcgca

SEQ ID NO: 333550 - RNA, 22 nt, Homo sapiens
ugaggugaaguaauauucuaag

SEQ ID NO: 333551 - RNA, 22 nt, Homo sapiens
ugagguuggggucagggcuagc

SEQ ID NO: 333552 - RNA, 22 nt, Homo sapiens
ugagguugguauuacugucucu

SEQ ID NO: 333553 - RNA, 22 nt, Homo sapiens
ugaguagucuagaguggaaugu

SEQ ID NO: 333554 - RNA, 22 nt, Homo sapiens
ugaguagugccacaauaagcau

SEQ ID NO: 333555 - RNA, 22 nt, Homo sapiens
ugaguagugcugcaauaaacau

SEQ ID NO: 333556 - RNA, 22 nt, Homo sapiens
ugaguauguuuaaugugacaau

SEQ ID NO: 333557 - RNA, 22 nt, Homo sapiens
ugagucagucucacucugcugc

SEQ ID NO: 333558 - RNA, 22 nt, Homo sapiens
uggaguuugacaugccuuuggg

SEQ ID NO: 333559 - RNA, 22 nt, Homo sapiens
uggauagaaauguacuguuuuc

SEQ ID NO: 333560 - RNA, 22 nt, Homo sapiens
uggauccaucacgccucuuccc

SEQ ID NO: 333561 - RNA, 22 nt, Homo sapiens
uggauggagaggcuugugaugc

SEQ ID NO: 333562 - RNA, 22 nt, Homo sapiens
uggauuguuucucuugguauga

SEQ ID NO: 333563 - RNA, 22 nt, Homo sapiens
uggauuuuaauuauucugucau

SEQ ID NO: 333564 - RNA, 22 nt, Homo sapiens
uggcaaaaaaacgcaauuacgu

SEQ ID NO: 333565 - RNA, 22 nt, Homo sapiens
uggcaaaaaaccgcaguugccu

SEQ ID NO: 333566 - RNA, 22 nt, Homo sapiens
uggcaaaucagaggcauggaca

SEQ ID NO: 333567 - RNA, 21 nt, Homo sapiens
uggcaacauggauggauucug

SEQ ID NO: 333568 - RNA, 22 nt, Homo sapiens
uggcaacuugcaaccucauucu

SEQ ID NO: 333569 - RNA, 22 nt, Homo sapiens
uggcaagagggaugcaagguuu

SEQ ID NO: 333570 - RNA, 22 nt, Homo sapiens
uggcaagauuguuccgguuugg

SEQ ID NO: 333571 - RNA, 22 nt, Homo sapiens
uggcaaguuucaauccgaggga

SEQ ID NO: 333572 - RNA, 20 nt, Homo sapiens
uggcaccugacagauagcca

SEQ ID NO: 333573 - RNA, 22 nt, Homo sapiens
uggcagaugagccgcgcuccaa

SEQ ID NO: 333574 - RNA, 22 nt, Homo sapiens
uggcagcugcuucaugggaugc

SEQ ID NO: 333575 - RNA, 22 nt, Homo sapiens
uggcaguuuugauguggagaga

SEQ ID NO: 333576 - RNA, 22 nt, Homo sapiens
uggcaguuuuugccuucaauac

SEQ ID NO: 333577 - RNA, 22 nt, Homo sapiens
uggcauaugguauuugauaucu

SEQ ID NO: 333578 - RNA, 19 nt, Homo sapiens
uggcaugaaugugaacuaa

SEQ ID NO: 333579 - RNA, 22 nt, Homo sapiens
uggcaugauguguucauugaaa

SEQ ID NO: 333580 - RNA, 22 nt, Homo sapiens
uggcauggaacuacuuugaaac

SEQ ID NO: 333581 - RNA, 22 nt, Homo sapiens
uggcaugggguaguagcgcugg

SEQ ID NO: 333582 - RNA, 22 nt, Homo sapiens
uggcauggucugcccaaguuuc

SEQ ID NO: 333583 - RNA, 22 nt, Homo sapiens
uggcauuuuguuuuagaauuag

SEQ ID NO: 333584 - RNA, 22 nt, Homo sapiens
uggcuacugacugaugauuaua

SEQ ID NO: 333585 - RNA, 22 nt, Homo sapiens
uggcuacuguacuugagcuauu

SEQ ID NO: 333586 - RNA, 22 nt, Homo sapiens
uggcuagaccugcauaacagcu

SEQ ID NO: 333587 - RNA, 22 nt, Homo sapiens
uggcuguuuauuucacaugggu

SEQ ID NO: 333588 - RNA, 22 nt, Homo sapiens
uggcuuuucauccugggacauu

SEQ ID NO: 333589 - RNA, 20 nt, Homo sapiens
ugggaaauguccaggacaua

SEQ ID NO: 333590 - RNA, 22 nt, Homo sapiens
ugggagugugcacaauuucagc

SEQ ID NO: 333591 - RNA, 22 nt, Homo sapiens
ugggaugaugcuugagaauauc

SEQ ID NO: 333592 - RNA, 22 nt, Homo sapiens
ugggcaaaugcuuuuuagucaa

SEQ ID NO: 333593 - RNA, 22 nt, Homo sapiens
ugggcaguauggucauuuucgu

SEQ ID NO: 333594 - RNA, 22 nt, Homo sapiens
ugggcuagaugcuuugggguca

SEQ ID NO: 333595 - RNA, 22 nt, Homo sapiens
uggggcaaugaacauuuuugca

SEQ ID NO: 333596 - RNA, 22 nt, Homo sapiens
uggguaguuuuucagcucuugc

SEQ ID NO: 333597 - RNA, 23 nt, Homo sapiens
ugggucaguuuuucugacaucau

SEQ ID NO: 333598 - RNA, 22 nt, Homo sapiens
uggucagaugcugaguggaucu

SEQ ID NO: 333599 - RNA, 20 nt, Homo sapiens
ugguccccugagucuggcuu

SEQ ID NO: 333600 - RNA, 22 nt, Homo sapiens
uggugagaaacuagauauuuuu

SEQ ID NO: 333601 - RNA, 22 nt, Homo sapiens
ugguucaguugcacaggcuguu

SEQ ID NO: 333602 - RNA, 22 nt, Homo sapiens
uguaaaccauauauguauguag

SEQ ID NO: 333603 - RNA, 22 nt, Homo sapiens
uguaaagaaagcuguuguugua

SEQ ID NO: 333604 - RNA, 22 nt, Homo sapiens
uguaacacacacuguuuacucc

SEQ ID NO: 333605 - RNA, 20 nt, Homo sapiens
uguaaucuaaguuuuaagcc

SEQ ID NO: 333606 - RNA, 22 nt, Homo sapiens
uguagucauuugaaggaugucc

SEQ ID NO: 333607 - RNA, 22 nt, Homo sapiens
uguauacauauguauguuuugu

SEQ ID NO: 333608 - RNA, 22 nt, Homo sapiens
uguauacugucuaauauguugu

SEQ ID NO: 333609 - RNA, 21 nt, Homo sapiens
uguauauguuuauacacacac

SEQ ID NO: 333610 - RNA, 22 nt, Homo sapiens
uguaugagagugaaagcauuuc

SEQ ID NO: 333611 - RNA, 22 nt, Homo sapiens
uguaugcuuuugagagauauuu

SEQ ID NO: 333612 - RNA, 22 nt, Homo sapiens
uguaugucuucuuuagauaagu

SEQ ID NO: 333613 - RNA, 22 nt, Homo sapiens
uguauguuuaaggccaguggaa

SEQ ID NO: 333614 - RNA, 22 nt, Homo sapiens
uguauuuguuguuaaauggaga

SEQ ID NO: 333615 - RNA, 22 nt, Homo sapiens
ugucaaaugcagugauauuuga

SEQ ID NO: 333616 - RNA, 22 nt, Homo sapiens
ugucaaauucuggguuaaaaca

SEQ ID NO: 333617 - RNA, 22 nt, Homo sapiens
ugucacagagauuuugguaugu

SEQ ID NO: 333618 - RNA, 22 nt, Homo sapiens
ugucaggagcaaugauaaauuu

SEQ ID NO: 333619 - RNA, 22 nt, Homo sapiens
ugucaguuucaguguuagccuu

SEQ ID NO: 333620 - RNA, 22 nt, Homo sapiens
ugucaguuucccuccucuuccu

SEQ ID NO: 333621 - RNA, 22 nt, Homo sapiens
ugucaucuagguauuaagcccc

SEQ ID NO: 333622 - RNA, 22 nt, Homo sapiens
uguccaaauugaaucaucuggu

SEQ ID NO: 333623 - RNA, 22 nt, Homo sapiens
auucaccauggaccaggggccu

SEQ ID NO: 333624 - RNA, 22 nt, Homo sapiens
auuccacaguuaacacagaccg

SEQ ID NO: 333625 - RNA, 23 nt, Homo sapiens
auuccaguggcaauuggagaaac

SEQ ID NO: 333626 - RNA, 22 nt, Homo sapiens
auugacacugauuuuucuuuaa

SEQ ID NO: 333627 - RNA, 22 nt, Homo sapiens
auugcaacaguguugagaggug

SEQ ID NO: 333628 - RNA, 22 nt, Homo sapiens
auugcaacuuccgccuccuggg

SEQ ID NO: 333629 - RNA, 22 nt, Homo sapiens
auugcaauuaguccauagaguu

SEQ ID NO: 333630 - RNA, 22 nt, Homo sapiens
auugcacaaagagggaaacuga

SEQ ID NO: 333631 - RNA, 22 nt, Homo sapiens
auugcacuccagccccggggac

SEQ ID NO: 333632 - RNA, 22 nt, Homo sapiens
auugcacuccagcccugcugac

SEQ ID NO: 333633 - RNA, 22 nt, Homo sapiens
auugcacuccagccucggugac

SEQ ID NO: 333634 - RNA, 22 nt, Homo sapiens
auugcacuccagccugcggaac

SEQ ID NO: 333635 - RNA, 22 nt, Homo sapiens
auugcacuccagccugggcaac

SEQ ID NO: 333636 - RNA, 21 nt, Homo sapiens
auugcacuccagccugggcga

SEQ ID NO: 333637 - RNA, 22 nt, Homo sapiens
auugcacuccagccugggcgac

SEQ ID NO: 333638 - RNA, 22 nt, Homo sapiens
auugcacuccagccuugacaca

SEQ ID NO: 333639 - RNA, 22 nt, Homo sapiens
auugcacuccagucucaccagg

SEQ ID NO: 333640 - RNA, 22 nt, Homo sapiens
auugcacuccagucugggcaac

SEQ ID NO: 333641 - RNA, 18 nt, Homo sapiens
auugcacuccugccuggg

SEQ ID NO: 333642 - RNA, 22 nt, Homo sapiens
auugcagaaaugacagagcgcc

SEQ ID NO: 333643 - RNA, 23 nt, Homo sapiens
auugcagaaucacagagguagug

SEQ ID NO: 333644 - RNA, 22 nt, Homo sapiens
auugcagcccacccugggugau

SEQ ID NO: 333645 - RNA, 23 nt, Homo sapiens
auugcagucuugaacuccugggc

SEQ ID NO: 333646 - RNA, 22 nt, Homo sapiens
auugccacaucucagaggcaga

SEQ ID NO: 333647 - RNA, 22 nt, Homo sapiens
auugccucaauuccaagacugc

SEQ ID NO: 333648 - RNA, 22 nt, Homo sapiens
auugcucaaaucaguacuugag

SEQ ID NO: 333649 - RNA, 22 nt, Homo sapiens
auugcucuuagaaauauuucuu

SEQ ID NO: 333650 - RNA, 22 nt, Homo sapiens
auuggacagcauuucuagacuu

SEQ ID NO: 333651 - RNA, 22 nt, Homo sapiens
auuggcuuuauacauaagaaua

SEQ ID NO: 333652 - RNA, 22 nt, Homo sapiens
auuggggaaugguggcuuuagu

SEQ ID NO: 333653 - RNA, 22 nt, Homo sapiens
auuggucuugaaaccagagaga

SEQ ID NO: 333654 - RNA, 22 nt, Homo sapiens
auuguacuccagccugggcaag

SEQ ID NO: 333655 - RNA, 22 nt, Homo sapiens
auugucccucuuaaucccagca

SEQ ID NO: 333656 - RNA, 22 nt, Homo sapiens
auuguccuacuaggguuccagu

SEQ ID NO: 333657 - RNA, 20 nt, Homo sapiens
auuguccuugauuacacaga

SEQ ID NO: 333658 - RNA, 22 nt, Homo sapiens
auugugauggucaaaggaaaua

SEQ ID NO: 333659 - RNA, 22 nt, Homo sapiens
auuguucuuguguccuuuuccu

SEQ ID NO: 333660 - RNA, 22 nt, Homo sapiens
auuuagcaauggagguagugua

SEQ ID NO: 333661 - RNA, 22 nt, Homo sapiens
auuucacuucgcaugguguccg

SEQ ID NO: 333662 - RNA, 22 nt, Homo sapiens
auuuggcaacguagggaggcau

SEQ ID NO: 333663 - RNA, 22 nt, Homo sapiens
auuugguuauggucauggacac

SEQ ID NO: 333664 - RNA, 22 nt, Homo sapiens
caaaagugauugcgguuuuugc

SEQ ID NO: 333665 - RNA, 22 nt, Homo sapiens
caaaggcuguuauaggccagga

SEQ ID NO: 333666 - RNA, 22 nt, Homo sapiens
caaagucuucucauuaugucuu

SEQ ID NO: 333667 - RNA, 22 nt, Homo sapiens
caaagugcugggaugggccagg

SEQ ID NO: 333668 - RNA, 19 nt, Homo sapiens
caaaguguucuucuuugcc

SEQ ID NO: 333669 - RNA, 22 nt, Homo sapiens
caaauacuuucauguugucuug

SEQ ID NO: 333670 - RNA, 22 nt, Homo sapiens
caacaguaaagcauuuuuaagu

SEQ ID NO: 333671 - RNA, 22 nt, Homo sapiens
caacauccaccuccuggguuca

SEQ ID NO: 333672 - RNA, 22 nt, Homo sapiens
caagagagcugaugguuuuaaa

SEQ ID NO: 333673 - RNA, 22 nt, Homo sapiens
caaguguuggcuuguauacaaa

SEQ ID NO: 333674 - RNA, 19 nt, Homo sapiens
caauacuucuuggcauaca

SEQ ID NO: 333675 - RNA, 22 nt, Homo sapiens
caaucugucuuuuagggggcca

SEQ ID NO: 333676 - RNA, 22 nt, Homo sapiens
caauggcacgaucucgucucac

SEQ ID NO: 333677 - RNA, 21 nt, Homo sapiens
caauggcacgaucuuggcuca

SEQ ID NO: 333678 - RNA, 22 nt, Homo sapiens
caauggcacuauuggaaaaggu

SEQ ID NO: 333679 - RNA, 22 nt, Homo sapiens
cacagagugagacccugucucu

SEQ ID NO: 333680 - RNA, 22 nt, Homo sapiens
cacagggcuaacauuuuugccc

SEQ ID NO: 333681 - RNA, 22 nt, Homo sapiens
cacagugaacugguggguuuuu

SEQ ID NO: 333682 - RNA, 22 nt, Homo sapiens
caccaaccucaguagcaucugu

SEQ ID NO: 333683 - RNA, 22 nt, Homo sapiens
caccacuacaccccaggcuggg

SEQ ID NO: 333684 - RNA, 23 nt, Homo sapiens
caccaguauaauuagcuuuuaaa

SEQ ID NO: 333685 - RNA, 22 nt, Homo sapiens
caccgagguuggagugcagugg

SEQ ID NO: 333686 - RNA, 19 nt, Homo sapiens
caccgccugcccccugcug

SEQ ID NO: 333687 - RNA, 22 nt, Homo sapiens
caccuguagucccagcugaggc

SEQ ID NO: 333688 - RNA, 22 nt, Homo sapiens
caccuugugauccacccgccuu

SEQ ID NO: 333689 - RNA, 22 nt, Homo sapiens
cacuaccucuacaggcagcugg

SEQ ID NO: 333690 - RNA, 22 nt, Homo sapiens
cacugcaauuacuuuugcacca

SEQ ID NO: 333691 - RNA, 22 nt, Homo sapiens
cacugcacuccagcuugugggc

SEQ ID NO: 333692 - RNA, 22 nt, Homo sapiens
cacugcacuccagucccgucuc

SEQ ID NO: 333693 - RNA, 22 nt, Homo sapiens
cacugcauccuccaccuccugg

SEQ ID NO: 333694 - RNA, 23 nt, Homo sapiens
cacugggcagcagguguucccag

SEQ ID NO: 333695 - RNA, 22 nt, Homo sapiens
cacugggugagauccauguuua

SEQ ID NO: 333696 - RNA, 22 nt, Homo sapiens
cacuggucagugaaacaguauu

SEQ ID NO: 333697 - RNA, 22 nt, Homo sapiens
cacuggucucauggcaugagag

SEQ ID NO: 333698 - RNA, 22 nt, Homo sapiens
cacuguggauggaacuauguga

SEQ ID NO: 333699 - RNA, 22 nt, Homo sapiens
cagaaguauugguaugcucugu

SEQ ID NO: 333700 - RNA, 22 nt, Homo sapiens
cagacaugucuuguggccgugg

SEQ ID NO: 333701 - RNA, 22 nt, Homo sapiens
cagagaacauucagagcuguag

SEQ ID NO: 333702 - RNA, 21 nt, Homo sapiens
cagagaucaucucuguuuuaa

SEQ ID NO: 333703 - RNA, 20 nt, Homo sapiens
cagagcaaagcaguccuggc

SEQ ID NO: 333704 - RNA, 22 nt, Homo sapiens
cagagguaagcaagucagcauu

SEQ ID NO: 333705 - RNA, 22 nt, Homo sapiens
cagagucaagcucuuguuccau

SEQ ID NO: 333706 - RNA, 22 nt, Homo sapiens
cagagugcauguuuagaugagu

SEQ ID NO: 333707 - RNA, 22 nt, Homo sapiens
cagaugcaugaccugggcuugg

SEQ ID NO: 333708 - RNA, 22 nt, Homo sapiens
cagcacauagcaguugcucagu

SEQ ID NO: 333709 - RNA, 22 nt, Homo sapiens
cagcccuacacagacugacuca

SEQ ID NO: 333710 - RNA, 22 nt, Homo sapiens
uggagacugaucccucuuuccu

SEQ ID NO: 333711 - RNA, 22 nt, Homo sapiens
uggagagucauuuauaguauuu

SEQ ID NO: 333712 - RNA, 22 nt, Homo sapiens
uggagguagggccuaggaaucu

SEQ ID NO: 333713 - RNA, 22 nt, Homo sapiens
uggaggucauuggaucaugggg

SEQ ID NO: 333714 - RNA, 19 nt, Homo sapiens
uggagucaucaugcugcua

SEQ ID NO: 333715 - RNA, 21 nt, Homo sapiens
uggagugcaacacuagguaua

SEQ ID NO: 333716 - RNA, 22 nt, Homo sapiens
uggagugcaauggugagaucuu

SEQ ID NO: 333717 - RNA, 22 nt, Homo sapiens
uggaguguagaagccagccucc

SEQ ID NO: 333718 - RNA, 20 nt, Homo sapiens
uggaguuugaguucuuggag

SEQ ID NO: 333719 - RNA, 22 nt, Homo sapiens
uggauagauacuauccaggacu

SEQ ID NO: 333720 - RNA, 22 nt, Homo sapiens
uggauguacagucaguauuugu

SEQ ID NO: 333721 - RNA, 21 nt, Homo sapiens
uggauuguacacccuaucauu

SEQ ID NO: 333722 - RNA, 18 nt, Homo sapiens
uggauuguacuguguucu

SEQ ID NO: 333723 - RNA, 22 nt, Homo sapiens
uggcaaaaaucacaaguaccuu

SEQ ID NO: 333724 - RNA, 22 nt, Homo sapiens
uggcaagaagagcaugagacca

SEQ ID NO: 333725 - RNA, 22 nt, Homo sapiens
uggcaagaccccaucucuacaa

SEQ ID NO: 333726 - RNA, 22 nt, Homo sapiens
uggcaagagcaaaauguacagu

SEQ ID NO: 333727 - RNA, 22 nt, Homo sapiens
uggcacaaugacccuugugggc

SEQ ID NO: 333728 - RNA, 19 nt, Homo sapiens
uggcacauguauacuuaug

SEQ ID NO: 333729 - RNA, 22 nt, Homo sapiens
uggcaucuguucuacacauaaa

SEQ ID NO: 333730 - RNA, 22 nt, Homo sapiens
uggcaugaagaccccauccuuu

SEQ ID NO: 333731 - RNA, 22 nt, Homo sapiens
uggcauggggcagaacauuaca

SEQ ID NO: 333732 - RNA, 22 nt, Homo sapiens
uggcauguguuugaaugaguau

SEQ ID NO: 333733 - RNA, 22 nt, Homo sapiens
uggcccccucccaaaucucaua

SEQ ID NO: 333734 - RNA, 23 nt, Homo sapiens
uggcuagacguccuuuccugaug

SEQ ID NO: 333735 - RNA, 22 nt, Homo sapiens
uggcuguuguuacuaacaguuc

SEQ ID NO: 333736 - RNA, 22 nt, Homo sapiens
uggcuguuuauuucaccuggau

SEQ ID NO: 333737 - RNA, 22 nt, Homo sapiens
uggcuuuguaagguuucauuuu

SEQ ID NO: 333738 - RNA, 22 nt, Homo sapiens
uggcuuuuguuauuuggaagcu

SEQ ID NO: 333739 - RNA, 22 nt, Homo sapiens
ugggaaacauccagcacauacu

SEQ ID NO: 333740 - RNA, 22 nt, Homo sapiens
ugggaacaugaagguuaaagag

SEQ ID NO: 333741 - RNA, 22 nt, Homo sapiens
ugggaagcugcugaacuacagu

SEQ ID NO: 333742 - RNA, 23 nt, Homo sapiens
ugggauguuuuuggaaacuucug

SEQ ID NO: 333743 - RNA, 22 nt, Homo sapiens
ugggcaagagagcaugacccug

SEQ ID NO: 333744 - RNA, 22 nt, Homo sapiens
uggggugugagggagaaagaaa

SEQ ID NO: 333745 - RNA, 22 nt, Homo sapiens
uggguaaaucucuguucagggc

SEQ ID NO: 333746 - RNA, 22 nt, Homo sapiens
uggguagagaaucaggaucuua

SEQ ID NO: 333747 - RNA, 22 nt, Homo sapiens
uggguagagcacugggggcgag

SEQ ID NO: 333748 - RNA, 22 nt, Homo sapiens
uggguccccuacucuuuccaca

SEQ ID NO: 333749 - RNA, 23 nt, Homo sapiens
uggguucauucuugaagucagug

SEQ ID NO: 333750 - RNA, 22 nt, Homo sapiens
ugguaauguaauuuggagaagg

SEQ ID NO: 333751 - RNA, 22 nt, Homo sapiens
ugguauuuaauauaugagaguu

SEQ ID NO: 333752 - RNA, 21 nt, Homo sapiens
uggucaguuuucucacuagga

SEQ ID NO: 333753 - RNA, 22 nt, Homo sapiens
uggucauggaaauagaaugcac

SEQ ID NO: 333754 - RNA, 21 nt, Homo sapiens
uggucccauaagauuacaaug

SEQ ID NO: 333755 - RNA, 22 nt, Homo sapiens
ugguuaucacuuuccuuccauc

SEQ ID NO: 333756 - RNA, 23 nt, Homo sapiens
uguaaagcuaugaauuauucuuu

SEQ ID NO: 333757 - RNA, 20 nt, Homo sapiens
uguaaaggagauugcagcug

SEQ ID NO: 333758 - RNA, 22 nt, Homo sapiens
uguaacaguaguuacuauucuu

SEQ ID NO: 333759 - RNA, 22 nt, Homo sapiens
uguaauguuucaucauuauuaa

SEQ ID NO: 333760 - RNA, 22 nt, Homo sapiens
uguaauuuaaaugauccuugga

SEQ ID NO: 333761 - RNA, 22 nt, Homo sapiens
uguacaugggacaggaggagag

SEQ ID NO: 333762 - RNA, 22 nt, Homo sapiens
uguagucauuuggaguccagcu

SEQ ID NO: 333763 - RNA, 22 nt, Homo sapiens
uguaguuugaaagcucccucug

SEQ ID NO: 333764 - RNA, 22 nt, Homo sapiens
uguauaacucacauugaaguuu

SEQ ID NO: 333765 - RNA, 22 nt, Homo sapiens
uguauguugauguuauauucug

SEQ ID NO: 333766 - RNA, 16 nt, Homo sapiens
uguauugcuaaaaaga

SEQ ID NO: 333767 - RNA, 22 nt, Homo sapiens
ugucaacauuuaucaaguuauu

SEQ ID NO: 333768 - RNA, 22 nt, Homo sapiens
ugucaagaugguuugauguugu

SEQ ID NO: 333769 - RNA, 20 nt, Homo sapiens
ugucaaggaauucccaaauc

SEQ ID NO: 333770 - RNA, 22 nt, Homo sapiens
ugucacauccaagaaggugcag

SEQ ID NO: 333771 - RNA, 22 nt, Homo sapiens
ugucacugugaguuugacugcu

SEQ ID NO: 333772 - RNA, 22 nt, Homo sapiens
ugucaggaguuuuagaaucuua

SEQ ID NO: 333773 - RNA, 22 nt, Homo sapiens
ugucauguagaaauuguccauu

SEQ ID NO: 333774 - RNA, 20 nt, Homo sapiens
ugucauuaagcacugugcca

SEQ ID NO: 333775 - RNA, 22 nt, Homo sapiens
ugucauucaggaaauucuaagu

SEQ ID NO: 333776 - RNA, 16 nt, Homo sapiens
uguccaaauaaauaca

SEQ ID NO: 333777 - RNA, 22 nt, Homo sapiens
ugucuacugaugauguaguuaa

SEQ ID NO: 333778 - RNA, 20 nt, Homo sapiens
ugucuauggggguucucugc

SEQ ID NO: 333779 - RNA, 22 nt, Homo sapiens
ugucuggaguccauagaagugu

SEQ ID NO: 333780 - RNA, 22 nt, Homo sapiens
ugucuguuugcgaaauugcuuc

SEQ ID NO: 333781 - RNA, 21 nt, Homo sapiens
ugucuuggagccagacgccag

SEQ ID NO: 333782 - RNA, 22 nt, Homo sapiens
ugugaaacacgaaagucuaaaa

SEQ ID NO: 333783 - RNA, 22 nt, Homo sapiens
ugugaaaucagauagccuuuuu

SEQ ID NO: 333784 - RNA, 22 nt, Homo sapiens
ugugaacugagcauuaacuaca

SEQ ID NO: 333785 - RNA, 22 nt, Homo sapiens
ugugaagaaagucauugguagc

SEQ ID NO: 333786 - RNA, 22 nt, Homo sapiens
ugugacagguagguaauuuuug

SEQ ID NO: 333787 - RNA, 22 nt, Homo sapiens
ugugaccaaaaucaacauaccu

SEQ ID NO: 333788 - RNA, 17 nt, Homo sapiens
ugugacccugggcuacc

SEQ ID NO: 333789 - RNA, 19 nt, Homo sapiens
ugugacugggccagccuag

SEQ ID NO: 333790 - RNA, 22 nt, Homo sapiens
ugugagaaaugcagaaucucag

SEQ ID NO: 333791 - RNA, 22 nt, Homo sapiens
ugugaucauuucaggaauuuug

SEQ ID NO: 333792 - RNA, 17 nt, Homo sapiens
ugugauugaagucaucc

SEQ ID NO: 333793 - RNA, 22 nt, Homo sapiens
ugugcaaaaacaauugcgguuu

SEQ ID NO: 333794 - RNA, 22 nt, Homo sapiens
ugugcaaucuuccauuuuuagg

SEQ ID NO: 333795 - RNA, 22 nt, Homo sapiens
ugugcaauucgauggagcucau

SEQ ID NO: 333796 - RNA, 22 nt, Homo sapiens
ugugcacaaugugcagguuugu

SEQ ID NO: 333797 - RNA, 22 nt, Homo sapiens
ugugccuucuaagaaggagucu

SEQ ID NO: 333798 - RNA, 22 nt, Homo sapiens
ugugcgcaucggggccugcuuc

SEQ ID NO: 333799 - RNA, 22 nt, Homo sapiens
ugugcguguaagagaucuaggu

SEQ ID NO: 333800 - RNA, 22 nt, Homo sapiens
ugugcuugaaauucaguuuuga

SEQ ID NO: 333801 - RNA, 22 nt, Homo sapiens
uguggaaauggugcuacgaaca

SEQ ID NO: 333802 - RNA, 22 nt, Homo sapiens
uguggccccuagcuacuagaga

SEQ ID NO: 333803 - RNA, 22 nt, Homo sapiens
uguggcucuucuguucuccacu

SEQ ID NO: 333804 - RNA, 22 nt, Homo sapiens
ugugguauuagguguaguaucu

SEQ ID NO: 333805 - RNA, 23 nt, Homo sapiens
ugugguauuauuccauuuauagg

SEQ ID NO: 333806 - RNA, 22 nt, Homo sapiens
uguguaaauaugauagaggaau

SEQ ID NO: 333807 - RNA, 22 nt, Homo sapiens
uguguaauacucuaaugaugca

SEQ ID NO: 333808 - RNA, 22 nt, Homo sapiens
uguguacaucucuacacacaug

SEQ ID NO: 333809 - RNA, 22 nt, Homo sapiens
uguguagagaaauauuacuuau

SEQ ID NO: 333810 - RNA, 22 nt, Homo sapiens
ugugucacugcacuccagcgug

SEQ ID NO: 333811 - RNA, 22 nt, Homo sapiens
ugugucuugagagucucgagaa

SEQ ID NO: 333812 - RNA, 22 nt, Homo sapiens
ugugucuuuuaucacacaaugu

SEQ ID NO: 333813 - RNA, 22 nt, Homo sapiens
uguguuuuuauguaaaauggaa

SEQ ID NO: 333814 - RNA, 22 nt, Homo sapiens
uguuaacauggucucagucugu

SEQ ID NO: 333815 - RNA, 22 nt, Homo sapiens
uguuacagcagcacaaaaugga

SEQ ID NO: 333816 - RNA, 22 nt, Homo sapiens
uguuauugagguuacuuauaag

SEQ ID NO: 333817 - RNA, 22 nt, Homo sapiens
uguucuugagccuuuagaccua

SEQ ID NO: 333818 - RNA, 22 nt, Homo sapiens
uguucuugaguugggaguacaa

SEQ ID NO: 333819 - RNA, 22 nt, Homo sapiens
uguugcacacacugaaauacac

SEQ ID NO: 333820 - RNA, 22 nt, Homo sapiens
uguugcaccugccuugcuuuag

SEQ ID NO: 333821 - RNA, 20 nt, Homo sapiens
uguugcacucuagccugggu

SEQ ID NO: 333822 - RNA, 22 nt, Homo sapiens
uguugcauuugucaaggucaag

SEQ ID NO: 333823 - RNA, 22 nt, Homo sapiens
uguuugcuguguggaguagcag

SEQ ID NO: 333824 - RNA, 22 nt, Homo sapiens
uguuugguggucucuucacaug

SEQ ID NO: 333825 - RNA, 22 nt, Homo sapiens
uguuuugguugucccuggccag

SEQ ID NO: 333826 - RNA, 22 nt, Homo sapiens
uuaaaaguauaggccuggcaua

SEQ ID NO: 333827 - RNA, 22 nt, Homo sapiens
uuaaacugcuugaauuggguuu

SEQ ID NO: 333828 - RNA, 22 nt, Homo sapiens
uuaaaggcaugguuagacaugg

SEQ ID NO: 333829 - RNA, 22 nt, Homo sapiens
uuaaaguguuugcagacaggug

SEQ ID NO: 333830 - RNA, 22 nt, Homo sapiens
uuaaaugucuguagaugugcug

SEQ ID NO: 333831 - RNA, 22 nt, Homo sapiens
uuaacacugccauugauacugu

SEQ ID NO: 333832 - RNA, 22 nt, Homo sapiens
uuaagcaguaguuaaggagagg

SEQ ID NO: 333833 - RNA, 22 nt, Homo sapiens
uuaaggcauucuuugucuucau

SEQ ID NO: 333834 - RNA, 22 nt, Homo sapiens
uuaaggcuuucccuauguaaaa

SEQ ID NO: 333835 - RNA, 19 nt, Homo sapiens
uuaagguacuuagaugugu

SEQ ID NO: 333836 - RNA, 22 nt, Homo sapiens
uuaagugguagguggugcccaa

SEQ ID NO: 333837 - RNA, 22 nt, Homo sapiens
uuaaucugucuaugauuuuggu

SEQ ID NO: 333838 - RNA, 21 nt, Homo sapiens
uuaaugcuaugcagaaaaucu

SEQ ID NO: 333839 - RNA, 22 nt, Homo sapiens
uuaaugcuuuugggauauuucu

SEQ ID NO: 333840 - RNA, 22 nt, Homo sapiens
uuaaugugaaucaggaugcauu

SEQ ID NO: 333841 - RNA, 22 nt, Homo sapiens
uuaauuguaucuauagauguca

SEQ ID NO: 333842 - RNA, 22 nt, Homo sapiens
uuacaacugucuuacugguuau

SEQ ID NO: 333843 - RNA, 22 nt, Homo sapiens
uuacauguggugugaagaagag

SEQ ID NO: 333844 - RNA, 22 nt, Homo sapiens
uuacuguagugucauaucguau

SEQ ID NO: 333845 - RNA, 22 nt, Homo sapiens
uuagaacagugcucaccacaaa

SEQ ID NO: 333846 - RNA, 22 nt, Homo sapiens
uuagacaguggugcacugcacu

SEQ ID NO: 333847 - RNA, 17 nt, Homo sapiens
uuagagguagacucauu

SEQ ID NO: 333848 - RNA, 22 nt, Homo sapiens
uuagcacaguucauucauguua

SEQ ID NO: 333849 - RNA, 22 nt, Homo sapiens
uuagcacaucuuucuauguaag

SEQ ID NO: 333850 - RNA, 22 nt, Homo sapiens
uuagcacauuuccagcacaugg

SEQ ID NO: 333851 - RNA, 22 nt, Homo sapiens
uuagcaccacacacuuuagagg

SEQ ID NO: 333852 - RNA, 22 nt, Homo sapiens
uuaggcuaguuucuuaaacucu

SEQ ID NO: 333853 - RNA, 22 nt, Homo sapiens
uuaggcucuuuaucaguuaacu

SEQ ID NO: 333854 - RNA, 22 nt, Homo sapiens
uuaguaguagcugcaugucagu

SEQ ID NO: 333855 - RNA, 22 nt, Homo sapiens
uuagugaaugcaccacuucuga

SEQ ID NO: 333856 - RNA, 22 nt, Homo sapiens
uuaguggaugcugaauaaagaa

SEQ ID NO: 333857 - RNA, 22 nt, Homo sapiens
uuaguucauugugacuggacuc

SEQ ID NO: 333858 - RNA, 22 nt, Homo sapiens
uuauacucgucugaaugauucu

SEQ ID NO: 333859 - RNA, 22 nt, Homo sapiens
uuaucauagugcaguuuucuga

SEQ ID NO: 333860 - RNA, 22 nt, Homo sapiens
uuauccucuagacauagguuua

SEQ ID NO: 333861 - RNA, 22 nt, Homo sapiens
uuauccugucaguaaauauuuu

SEQ ID NO: 333862 - RNA, 22 nt, Homo sapiens
uuaugacaggcucaggagcccc

SEQ ID NO: 333863 - RNA, 23 nt, Homo sapiens
uuauggcuuuuauuauguugagg

SEQ ID NO: 333864 - RNA, 22 nt, Homo sapiens
uuaugucuuuuguguucagcua

SEQ ID NO: 333865 - RNA, 22 nt, Homo sapiens
uuauuagagauauuugguuagg

SEQ ID NO: 333866 - RNA, 22 nt, Homo sapiens
uuauuguccaaguuucccuuug

SEQ ID NO: 333867 - RNA, 22 nt, Homo sapiens
uuauuugguugcugacuuggaa

SEQ ID NO: 333868 - RNA, 22 nt, Homo sapiens
uucaaaguaaaaauguguucac

SEQ ID NO: 333869 - RNA, 22 nt, Homo sapiens
uucaaaguaaagggauggagac

SEQ ID NO: 333870 - RNA, 23 nt, Homo sapiens
uucaacagguagacccucccugc

SEQ ID NO: 333871 - RNA, 22 nt, Homo sapiens
uucaacugcuucagccucccaa

SEQ ID NO: 333872 - RNA, 22 nt, Homo sapiens
uucaagaauuaaaguggcuuuu

SEQ ID NO: 333873 - RNA, 22 nt, Homo sapiens
uucaagcuauggugaucuuuuc

SEQ ID NO: 333874 - RNA, 22 nt, Homo sapiens
uucaagucaaggaaagaggucu

SEQ ID NO: 333875 - RNA, 22 nt, Homo sapiens
uucaagucuuggcuuugccacc

SEQ ID NO: 333876 - RNA, 20 nt, Homo sapiens
uucaagugauucucaugccu

SEQ ID NO: 333877 - RNA, 22 nt, Homo sapiens
uucaauaugucauuggcaggca

SEQ ID NO: 333878 - RNA, 22 nt, Homo sapiens
uucacagccgcaccccaucacu

SEQ ID NO: 333879 - RNA, 22 nt, Homo sapiens
uucacagcuuaauaaggcucag

SEQ ID NO: 333880 - RNA, 22 nt, Homo sapiens
uucacaguacucccuggaauua

SEQ ID NO: 333881 - RNA, 22 nt, Homo sapiens
uucacaguguuucucacgguua

SEQ ID NO: 333882 - RNA, 23 nt, Homo sapiens
uucaccugguuauuaauagccuc

SEQ ID NO: 333883 - RNA, 22 nt, Homo sapiens
uucacugugaauaaaggcuccc

SEQ ID NO: 333884 - RNA, 22 nt, Homo sapiens
cagcuguguuauaaacuaccau

SEQ ID NO: 333885 - RNA, 22 nt, Homo sapiens
caggcagucuggcucccaagug

SEQ ID NO: 333886 - RNA, 20 nt, Homo sapiens
cagggcaaugaggagguaaa

SEQ ID NO: 333887 - RNA, 22 nt, Homo sapiens
caggguccccuaccuuuugaug

SEQ ID NO: 333888 - RNA, 21 nt, Homo sapiens
cagguagugucugaagccaga

SEQ ID NO: 333889 - RNA, 19 nt, Homo sapiens
cagguagugugcugacaug

SEQ ID NO: 333890 - RNA, 22 nt, Homo sapiens
caggugcauuggcugacaccug

SEQ ID NO: 333891 - RNA, 22 nt, Homo sapiens
cagucacagugacaggaugugg

SEQ ID NO: 333892 - RNA, 22 nt, Homo sapiens
cagugcaaccuccaucucucgg

SEQ ID NO: 333893 - RNA, 22 nt, Homo sapiens
cagugcauagaugugccacauu

SEQ ID NO: 333894 - RNA, 22 nt, Homo sapiens
cagugcauccauguucagcagu

SEQ ID NO: 333895 - RNA, 22 nt, Homo sapiens
caguggaugauguuuucugugg

SEQ ID NO: 333896 - RNA, 22 nt, Homo sapiens
caguggauuggauggauaaugc

SEQ ID NO: 333897 - RNA, 23 nt, Homo sapiens
cagugguguuagagaaaucuuuu

SEQ ID NO: 333898 - RNA, 22 nt, Homo sapiens
caguucaugguaggcaccauag

SEQ ID NO: 333899 - RNA, 22 nt, Homo sapiens
cauacagcuaguaaguguaaga

SEQ ID NO: 333900 - RNA, 19 nt, Homo sapiens
caucacagagucuuccauu

SEQ ID NO: 333901 - RNA, 22 nt, Homo sapiens
caucacaugcuuauuuuccuca

SEQ ID NO: 333902 - RNA, 21 nt, Homo sapiens
caucacauuacucaaaguccu

SEQ ID NO: 333903 - RNA, 22 nt, Homo sapiens
caucagauugagaucaucuaag

SEQ ID NO: 333904 - RNA, 21 nt, Homo sapiens
cauccccugccauuguggucu

SEQ ID NO: 333905 - RNA, 19 nt, Homo sapiens
caucccugagcugaagugg

SEQ ID NO: 333906 - RNA, 22 nt, Homo sapiens
caugccacugcacuccaaccug

SEQ ID NO: 333907 - RNA, 22 nt, Homo sapiens
caugucuuuuauucugugugau

SEQ ID NO: 333908 - RNA, 19 nt, Homo sapiens
caugugcacuacuggcuuc

SEQ ID NO: 333909 - RNA, 22 nt, Homo sapiens
cauuaagcuacuuagaaggugc

SEQ ID NO: 333910 - RNA, 22 nt, Homo sapiens
cauugcacuccagccuaggcaa

SEQ ID NO: 333911 - RNA, 22 nt, Homo sapiens
cauugcacuccagccucggcaa

SEQ ID NO: 333912 - RNA, 22 nt, Homo sapiens
cauugcacuccagccugaggga

SEQ ID NO: 333913 - RNA, 22 nt, Homo sapiens
cauugcacuccagccugccugg

SEQ ID NO: 333914 - RNA, 22 nt, Homo sapiens
cauugcacuccagcuugggcaa

SEQ ID NO: 333915 - RNA, 22 nt, Homo sapiens
cauugcacuccagucugggcaa

SEQ ID NO: 333916 - RNA, 22 nt, Homo sapiens
cauugcacuccaucuugggcaa

SEQ ID NO: 333917 - RNA, 22 nt, Homo sapiens
cauugcacugcagcccgggcaa

SEQ ID NO: 333918 - RNA, 22 nt, Homo sapiens
cauugcagauccuucaaaugac

SEQ ID NO: 333919 - RNA, 22 nt, Homo sapiens
cauugucccucaaugucuauga

SEQ ID NO: 333920 - RNA, 22 nt, Homo sapiens
cauuugcacugagacucagcuu

SEQ ID NO: 333921 - RNA, 22 nt, Homo sapiens
ccaagugcuuaaaauuucauuu

SEQ ID NO: 333922 - RNA, 22 nt, Homo sapiens
ccacaaccuccauauccugggu

SEQ ID NO: 333923 - RNA, 19 nt, Homo sapiens
ccacaaugguugaacuaga

SEQ ID NO: 333924 - RNA, 22 nt, Homo sapiens
ccacaguagucuugggaugggc

SEQ ID NO: 333925 - RNA, 22 nt, Homo sapiens
ccacagucuaugcaacaagguc

SEQ ID NO: 333926 - RNA, 22 nt, Homo sapiens
ccacugggcuagguguuuugga

SEQ ID NO: 333927 - RNA, 22 nt, Homo sapiens
ccaggguugagacccacugacu

SEQ ID NO: 333928 - RNA, 22 nt, Homo sapiens
ccagucuuggugucuguagcac

SEQ ID NO: 333929 - RNA, 18 nt, Homo sapiens
ccagugcaaggaaagccc

SEQ ID NO: 333930 - RNA, 22 nt, Homo sapiens
ccagugguucccuguggccuga

SEQ ID NO: 333931 - RNA, 21 nt, Homo sapiens
ccagugguuggaaacuauggg

SEQ ID NO: 333932 - RNA, 22 nt, Homo sapiens
ccagugucugacagacacggcg

SEQ ID NO: 333933 - RNA, 22 nt, Homo sapiens
ccaguuuuuggcaaugaugaau

SEQ ID NO: 333934 - RNA, 22 nt, Homo sapiens
ccauugcacuccauccugggca

SEQ ID NO: 333935 - RNA, 22 nt, Homo sapiens
cccacaguggccucauauccuu

SEQ ID NO: 333936 - RNA, 22 nt, Homo sapiens
cccaguagagauugccgaauug

SEQ ID NO: 333937 - RNA, 22 nt, Homo sapiens
cccagugaagagaaccuuacga

SEQ ID NO: 333938 - RNA, 18 nt, Homo sapiens
cccagugacuuauggccu

SEQ ID NO: 333939 - RNA, 22 nt, Homo sapiens
cccaguguuacgugacagccug

SEQ ID NO: 333940 - RNA, 22 nt, Homo sapiens
ccccggguggauguacauguga

SEQ ID NO: 333941 - RNA, 22 nt, Homo sapiens
ccccuguaucucagcgucuuca

SEQ ID NO: 333942 - RNA, 22 nt, Homo sapiens
cccugaagaaagccuaggacau

SEQ ID NO: 333943 - RNA, 22 nt, Homo sapiens
cccuguguuguucaaggaucug

SEQ ID NO: 333944 - RNA, 22 nt, Homo sapiens
ccucauggagaacaucugcuag

SEQ ID NO: 333945 - RNA, 22 nt, Homo sapiens
ccucauggagaaccucugcuag

SEQ ID NO: 333946 - RNA, 22 nt, Homo sapiens
ccugagacuugagggggcuucu

SEQ ID NO: 333947 - RNA, 21 nt, Homo sapiens
ccugauguucacuuggccuuc

SEQ ID NO: 333948 - RNA, 22 nt, Homo sapiens
ccugcauaguucaccgcugaua

SEQ ID NO: 333949 - RNA, 22 nt, Homo sapiens
ccuggaagaaaggugcuaaaua

SEQ ID NO: 333950 - RNA, 22 nt, Homo sapiens
ccuggcacugagcaguguucua

SEQ ID NO: 333951 - RNA, 22 nt, Homo sapiens
ccuucauugcaucuuuaagaga

SEQ ID NO: 333952 - RNA, 22 nt, Homo sapiens
ccuuuguggggcgguggguaau

SEQ ID NO: 333953 - RNA, 22 nt, Homo sapiens
cguugcacuccagccugggcaa

SEQ ID NO: 333954 - RNA, 16 nt, Homo sapiens
cuaaaaugucuacuug

SEQ ID NO: 333955 - RNA, 22 nt, Homo sapiens
cuaaaguauugagugguaaaga

SEQ ID NO: 333956 - RNA, 19 nt, Homo sapiens
cuaaaugggucccuagugg

SEQ ID NO: 333957 - RNA, 22 nt, Homo sapiens
cuaagauugucuuaguguguug

SEQ ID NO: 333958 - RNA, 21 nt, Homo sapiens
cuaaggaaagcuaugaacccu

SEQ ID NO: 333959 - RNA, 22 nt, Homo sapiens
cuacagaguaucuaaagaggua

SEQ ID NO: 333960 - RNA, 22 nt, Homo sapiens
cuacaguguauuuauggagggu

SEQ ID NO: 333961 - RNA, 22 nt, Homo sapiens
cuacaguucucaggaguuggcc

SEQ ID NO: 333962 - RNA, 22 nt, Homo sapiens
cuagacacugacguuccuccga

SEQ ID NO: 333963 - RNA, 22 nt, Homo sapiens
cuagauuauccaacuuauuagc

SEQ ID NO: 333964 - RNA, 22 nt, Homo sapiens
cuagcagacacuuccagagagu

SEQ ID NO: 333965 - RNA, 22 nt, Homo sapiens
cuagcugcacuuccugcuacug

SEQ ID NO: 333966 - RNA, 22 nt, Homo sapiens
cuaucucauugguuuuugaaag

SEQ ID NO: 333967 - RNA, 22 nt, Homo sapiens
cuaugcuuucugggcccugggu

SEQ ID NO: 333968 - RNA, 22 nt, Homo sapiens
cuauggcagccacggccuggag

SEQ ID NO: 333969 - RNA, 22 nt, Homo sapiens
cuaugguaggggcuggaggaag

SEQ ID NO: 333970 - RNA, 22 nt, Homo sapiens
cuaugguuucuccauaucauca

SEQ ID NO: 333971 - RNA, 22 nt, Homo sapiens
uucacugugcuuaaauucugcu

SEQ ID NO: 333972 - RNA, 22 nt, Homo sapiens
uucagcaaugacagccuauaua

SEQ ID NO: 333973 - RNA, 19 nt, Homo sapiens
uucagcagugucugcucuu

SEQ ID NO: 333974 - RNA, 22 nt, Homo sapiens
uucagugagacgaaaacaacaa

SEQ ID NO: 333975 - RNA, 22 nt, Homo sapiens
uucaguggguggaugaauauga

SEQ ID NO: 333976 - RNA, 22 nt, Homo sapiens
uucauagucacauucgaugucu

SEQ ID NO: 333977 - RNA, 22 nt, Homo sapiens
uucauagucuaugcaaguaaga

SEQ ID NO: 333978 - RNA, 22 nt, Homo sapiens
uucauaguucuuuuagucauua

SEQ ID NO: 333979 - RNA, 21 nt, Homo sapiens
uucaucuggccguauuccagg

SEQ ID NO: 333980 - RNA, 22 nt, Homo sapiens
uucaugugagucuguauuaacu

SEQ ID NO: 333981 - RNA, 23 nt, Homo sapiens
uuccaccauugacuaguuacaua

SEQ ID NO: 333982 - RNA, 22 nt, Homo sapiens
uuccagagucaccuuucugucg

SEQ ID NO: 333983 - RNA, 22 nt, Homo sapiens
uuccaguggacuacuucauccu

SEQ ID NO: 333984 - RNA, 22 nt, Homo sapiens
uuccaguggaguaaauggacaa

SEQ ID NO: 333985 - RNA, 22 nt, Homo sapiens
uucccagucaaacgaaggacuu

SEQ ID NO: 333986 - RNA, 20 nt, Homo sapiens
uucccucagccuugagggua

SEQ ID NO: 333987 - RNA, 22 nt, Homo sapiens
uucccuuucugaaaaucucauu

SEQ ID NO: 333988 - RNA, 22 nt, Homo sapiens
uucccuuuguuaaauuggaaga

SEQ ID NO: 333989 - RNA, 22 nt, Homo sapiens
uuccugaggccuccccagaagc

SEQ ID NO: 333990 - RNA, 22 nt, Homo sapiens
uuccugucuuccaagagagauu

SEQ ID NO: 333991 - RNA, 22 nt, Homo sapiens
uuccuucaugcuugaaggguau

SEQ ID NO: 333992 - RNA, 22 nt, Homo sapiens
uuccuugagaaaggcacaaguu

SEQ ID NO: 333993 - RNA, 20 nt, Homo sapiens
uucuacagucacaggaagau

SEQ ID NO: 333994 - RNA, 23 nt, Homo sapiens
uucuaucaggcccaggagcccug

SEQ ID NO: 333995 - RNA, 22 nt, Homo sapiens
uucucaguuccuacuuugguga

SEQ ID NO: 333996 - RNA, 22 nt, Homo sapiens
uucuccugguggacccuaaacg

SEQ ID NO: 333997 - RNA, 22 nt, Homo sapiens
uucugagguuauauucucucaa

SEQ ID NO: 333998 - RNA, 22 nt, Homo sapiens
uucugaguggcuuucaacacug

SEQ ID NO: 333999 - RNA, 22 nt, Homo sapiens
uucuggcucaggucaacacuuc

SEQ ID NO: 334000 - RNA, 22 nt, Homo sapiens
uucugguuaauacuugcaaaaa

SEQ ID NO: 334001 - RNA, 22 nt, Homo sapiens
uucugugguagaaaucucaaau

SEQ ID NO: 334002 - RNA, 22 nt, Homo sapiens
uucuuuaguucacuugcuccag

SEQ ID NO: 334003 - RNA, 22 nt, Homo sapiens
uucuuugcaugaucucaaaguc

SEQ ID NO: 334004 - RNA, 21 nt, Homo sapiens
uucuuugcucaguguuagagu

SEQ ID NO: 334005 - RNA, 22 nt, Homo sapiens
uugaaagcuaucagagauucca

SEQ ID NO: 334006 - RNA, 22 nt, Homo sapiens
uugaagacuaaguuaucaggau

SEQ ID NO: 334007 - RNA, 22 nt, Homo sapiens
uugaagguaauugguuuuauga

SEQ ID NO: 334008 - RNA, 22 nt, Homo sapiens
uugaauguacuuguucucacua

SEQ ID NO: 334009 - RNA, 22 nt, Homo sapiens
uugaauguguugggaagcccuu

SEQ ID NO: 334010 - RNA, 23 nt, Homo sapiens
uugaauguuuccccucccaaauu

SEQ ID NO: 334011 - RNA, 22 nt, Homo sapiens
uugacaaguuguccaguaugag

SEQ ID NO: 334012 - RNA, 22 nt, Homo sapiens
uugacacuuuguaagaaagggg

SEQ ID NO: 334013 - RNA, 22 nt, Homo sapiens
uugaccuggagaguacuuugac

SEQ ID NO: 334014 - RNA, 22 nt, Homo sapiens
uugacgagaguaguagucuacc

SEQ ID NO: 334015 - RNA, 22 nt, Homo sapiens
uugacuacaccaugccaggaac

SEQ ID NO: 334016 - RNA, 22 nt, Homo sapiens
uugagaaucuuucgaauguucu

SEQ ID NO: 334017 - RNA, 22 nt, Homo sapiens
uugagacugaacauuuguguac

SEQ ID NO: 334018 - RNA, 22 nt, Homo sapiens
uugagacugagucucgcccugu

SEQ ID NO: 334019 - RNA, 22 nt, Homo sapiens
uugagauggagucucacgcauu

SEQ ID NO: 334020 - RNA, 22 nt, Homo sapiens
uugagauggagucucacugugu

SEQ ID NO: 334021 - RNA, 22 nt, Homo sapiens
uugagauggagucucgcucugu

SEQ ID NO: 334022 - RNA, 22 nt, Homo sapiens
uugagauggagucuuguucuuu

SEQ ID NO: 334023 - RNA, 22 nt, Homo sapiens
uugagauggaguuucacucugu

SEQ ID NO: 334024 - RNA, 22 nt, Homo sapiens
uugagauggaguuucgcucuuu

SEQ ID NO: 334025 - RNA, 21 nt, Homo sapiens
uugagcaacuaggguuauagg

SEQ ID NO: 334026 - RNA, 22 nt, Homo sapiens
uugagcucaucuucagggguga

SEQ ID NO: 334027 - RNA, 22 nt, Homo sapiens
uugagcucuuccagccuggagc

SEQ ID NO: 334028 - RNA, 22 nt, Homo sapiens
uugaggaaugugauuucaaaua

SEQ ID NO: 334029 - RNA, 22 nt, Homo sapiens
uugaggaggcagucucuccauu

SEQ ID NO: 334030 - RNA, 22 nt, Homo sapiens
uugaggaggcagucugcccauu

SEQ ID NO: 334031 - RNA, 22 nt, Homo sapiens
uugaggaggcagucuguccguu

SEQ ID NO: 334032 - RNA, 22 nt, Homo sapiens
uugaggaggcagucuucccauu

SEQ ID NO: 334033 - RNA, 22 nt, Homo sapiens
uugaggaguacugauuagguau

SEQ ID NO: 334034 - RNA, 22 nt, Homo sapiens
uugaggccugauaacacacuga

SEQ ID NO: 334035 - RNA, 22 nt, Homo sapiens
uugagguuggaggccuugccug

SEQ ID NO: 334036 - RNA, 22 nt, Homo sapiens
uugaguuugaguauucuaaagc

SEQ ID NO: 334037 - RNA, 22 nt, Homo sapiens
uugauaauguuaacuuugguca

SEQ ID NO: 334038 - RNA, 22 nt, Homo sapiens
uugauagacaucugaguuguug

SEQ ID NO: 334039 - RNA, 22 nt, Homo sapiens
uugauaguaccauugggaaauu

SEQ ID NO: 334040 - RNA, 22 nt, Homo sapiens
uugauaugacuaucuuuuaugu

SEQ ID NO: 334041 - RNA, 19 nt, Homo sapiens
uugauaugauuaggagcac

SEQ ID NO: 334042 - RNA, 22 nt, Homo sapiens
uugcaaacaucuuguuucacau

SEQ ID NO: 334043 - RNA, 22 nt, Homo sapiens
uugcaaaguugccaaggaagga

SEQ ID NO: 334044 - RNA, 18 nt, Homo sapiens
uugcaaauucuucccugu

SEQ ID NO: 334045 - RNA, 22 nt, Homo sapiens
uugcaacauguauucuggugau

SEQ ID NO: 334046 - RNA, 22 nt, Homo sapiens
uugcaacauuguaaguuuauau

SEQ ID NO: 334047 - RNA, 22 nt, Homo sapiens
ucauucauuugcucacuccaca

SEQ ID NO: 334048 - RNA, 22 nt, Homo sapiens
ucauugcacuccagccugggug

SEQ ID NO: 334049 - RNA, 22 nt, Homo sapiens
ucauugcacucccagacacccu

SEQ ID NO: 334050 - RNA, 22 nt, Homo sapiens
ucauugcauuccagcccaagca

SEQ ID NO: 334051 - RNA, 21 nt, Homo sapiens
ucauugggugcagcccacccu

SEQ ID NO: 334052 - RNA, 22 nt, Homo sapiens
uccaaaucucuggcacugggau

SEQ ID NO: 334053 - RNA, 22 nt, Homo sapiens
uccacaauggcugaacuagauu

SEQ ID NO: 334054 - RNA, 22 nt, Homo sapiens
uccacaguaaggacccugccuu

SEQ ID NO: 334055 - RNA, 18 nt, Homo sapiens
uccacgugcuuuccagau

SEQ ID NO: 334056 - RNA, 22 nt, Homo sapiens
uccaguguuccucagucacccc

SEQ ID NO: 334057 - RNA, 22 nt, Homo sapiens
uccaguguuucuuccacuauuu

SEQ ID NO: 334058 - RNA, 22 nt, Homo sapiens
uccaguuauccuguggggagga

SEQ ID NO: 334059 - RNA, 18 nt, Homo sapiens
uccaguuuucccagcauc

SEQ ID NO: 334060 - RNA, 22 nt, Homo sapiens
uccaugaggcuacaguaaucuc

SEQ ID NO: 334061 - RNA, 23 nt, Homo sapiens
ucccaagauggaccagaccaagg

SEQ ID NO: 334062 - RNA, 22 nt, Homo sapiens
uccccgaggcuggagugcagug

SEQ ID NO: 334063 - RNA, 20 nt, Homo sapiens
ucccucaaacuuuuccacug

SEQ ID NO: 334064 - RNA, 22 nt, Homo sapiens
ucccugaacacauguugagaag

SEQ ID NO: 334065 - RNA, 22 nt, Homo sapiens
ucccugacagucacagagcuac

SEQ ID NO: 334066 - RNA, 19 nt, Homo sapiens
ucccugagucuuagcuuga

SEQ ID NO: 334067 - RNA, 22 nt, Homo sapiens
ucccugagugauugaaaauaaa

SEQ ID NO: 334068 - RNA, 22 nt, Homo sapiens
ucccugguguuaguuuguucuu

SEQ ID NO: 334069 - RNA, 22 nt, Homo sapiens
ucccuugagccuggcuucucac

SEQ ID NO: 334070 - RNA, 22 nt, Homo sapiens
uccuugagccucccagacucag

SEQ ID NO: 334071 - RNA, 22 nt, Homo sapiens
uccuugagucugaacuuuggau

SEQ ID NO: 334072 - RNA, 19 nt, Homo sapiens
uccuugauugcaccacugc

SEQ ID NO: 334073 - RNA, 22 nt, Homo sapiens
uccuuggucaaaaagaaagugu

SEQ ID NO: 334074 - RNA, 22 nt, Homo sapiens
uccuuggugacauuucuugucu

SEQ ID NO: 334075 - RNA, 23 nt, Homo sapiens
uccuugguuggcgcccuaugugu

SEQ ID NO: 334076 - RNA, 22 nt, Homo sapiens
ucgcaccauugcacuccagcca

SEQ ID NO: 334077 - RNA, 19 nt, Homo sapiens
ucgcgccauucuccugccu

SEQ ID NO: 334078 - RNA, 17 nt, Homo sapiens
ucuaauaauaugcauuu

SEQ ID NO: 334079 - RNA, 18 nt, Homo sapiens
ucuagacacugugucuau

SEQ ID NO: 334080 - RNA, 22 nt, Homo sapiens
ucucacaggguuauugaggggg

SEQ ID NO: 334081 - RNA, 22 nt, Homo sapiens
ucucagcacaaacaaaauugcu

SEQ ID NO: 334082 - RNA, 22 nt, Homo sapiens
ucucagcacagucagggcgccu

SEQ ID NO: 334083 - RNA, 22 nt, Homo sapiens
ucucagugaauguggaaaaagc

SEQ ID NO: 334084 - RNA, 22 nt, Homo sapiens
ucucagugaauugguuuugucu

SEQ ID NO: 334085 - RNA, 22 nt, Homo sapiens
ucucaguguuaucuaucugccu

SEQ ID NO: 334086 - RNA, 19 nt, Homo sapiens
ucucaguguuggucaggug

SEQ ID NO: 334087 - RNA, 21 nt, Homo sapiens
ucucauagaguuucacuuucu

SEQ ID NO: 334088 - RNA, 22 nt, Homo sapiens
ucucaugaagauagagaauaga

SEQ ID NO: 334089 - RNA, 22 nt, Homo sapiens
ucucauggagguagagaguaaa

SEQ ID NO: 334090 - RNA, 22 nt, Homo sapiens
ucucauugauucuggggugaug

SEQ ID NO: 334091 - RNA, 22 nt, Homo sapiens
ucucugagaaaaguuucuccca

SEQ ID NO: 334092 - RNA, 22 nt, Homo sapiens
ucucuguuugucuguuacuggu

SEQ ID NO: 334093 - RNA, 22 nt, Homo sapiens
ucugacucuggagucucagguu

SEQ ID NO: 334094 - RNA, 22 nt, Homo sapiens
ucugagcaugcaucuugccugg

SEQ ID NO: 334095 - RNA, 22 nt, Homo sapiens
ucugccacugucauugugugau

SEQ ID NO: 334096 - RNA, 22 nt, Homo sapiens
ucuggcacucagaggccuugcu

SEQ ID NO: 334097 - RNA, 20 nt, Homo sapiens
ucuggccccuccaaaucuca

SEQ ID NO: 334098 - RNA, 22 nt, Homo sapiens
ucuggccccucccaaaucucau

SEQ ID NO: 334099 - RNA, 17 nt, Homo sapiens
ucuggcuuucacaccug

SEQ ID NO: 334100 - RNA, 23 nt, Homo sapiens
ucuggcuuugggaugcucaaggg

SEQ ID NO: 334101 - RNA, 22 nt, Homo sapiens
ucugggguuuccacuuuuacuu

SEQ ID NO: 334102 - RNA, 22 nt, Homo sapiens
ucuguacuuccguaccuaaagu

SEQ ID NO: 334103 - RNA, 22 nt, Homo sapiens
ucugucacugguggacgaucac

SEQ ID NO: 334104 - RNA, 22 nt, Homo sapiens
ucugucuugugguuugagugcc

SEQ ID NO: 334105 - RNA, 22 nt, Homo sapiens
ucugucuuugccuaaguuuguc

SEQ ID NO: 334106 - RNA, 22 nt, Homo sapiens
ucugugcauuguaacaacuaaa

SEQ ID NO: 334107 - RNA, 22 nt, Homo sapiens
ucugugcauuuucuuuuagacu

SEQ ID NO: 334108 - RNA, 18 nt, Homo sapiens
ucugugguguaaauacgu

SEQ ID NO: 334109 - RNA, 22 nt, Homo sapiens
ucugugguucaaaccagcaacu

SEQ ID NO: 334110 - RNA, 22 nt, Homo sapiens
ucuguguuugaucaagauugua

SEQ ID NO: 334111 - RNA, 22 nt, Homo sapiens
ucuguuguuaucauaauauuga

SEQ ID NO: 334112 - RNA, 22 nt, Homo sapiens
ucuuagugcggcugcugcagcc

SEQ ID NO: 334113 - RNA, 22 nt, Homo sapiens
ucuugaacuucauaggucuaga

SEQ ID NO: 334114 - RNA, 22 nt, Homo sapiens
ucuuggcaaagaauuuuuggcu

SEQ ID NO: 334115 - RNA, 22 nt, Homo sapiens
ucuuuaguuaagggacauuuua

SEQ ID NO: 334116 - RNA, 22 nt, Homo sapiens
ucuuugauaagauccagaagaa

SEQ ID NO: 334117 - RNA, 23 nt, Homo sapiens
ucuuuggcucuaauauaccuugu

SEQ ID NO: 334118 - RNA, 19 nt, Homo sapiens
ucuuugguacgugcuuuga

SEQ ID NO: 334119 - RNA, 22 nt, Homo sapiens
ucuuugguauugugaauagugu

SEQ ID NO: 334120 - RNA, 21 nt, Homo sapiens
ucuuuggucaccaguuuucau

SEQ ID NO: 334121 - RNA, 22 nt, Homo sapiens
ucuuugguuguuuagggugcau

SEQ ID NO: 334122 - RNA, 22 nt, Homo sapiens
ucuuuguuagaacccucuccuu

SEQ ID NO: 334123 - RNA, 22 nt, Homo sapiens
ucuuuugguuucuagaggccgc

SEQ ID NO: 334124 - RNA, 22 nt, Homo sapiens
ugaaaaguuguugaaggcuuca

SEQ ID NO: 334125 - RNA, 18 nt, Homo sapiens
ugaaacacauuuuuuccu

SEQ ID NO: 334126 - RNA, 22 nt, Homo sapiens
ugauccuguccuuaugauguua

SEQ ID NO: 334127 - RNA, 22 nt, Homo sapiens
ugaucuguccaccucagcuucc

SEQ ID NO: 334128 - RNA, 22 nt, Homo sapiens
ugaucugucucggguuaucagu

SEQ ID NO: 334129 - RNA, 22 nt, Homo sapiens
ugauggcauuuggaguugggac

SEQ ID NO: 334130 - RNA, 22 nt, Homo sapiens
ugaugugucaucugagagagug

SEQ ID NO: 334131 - RNA, 22 nt, Homo sapiens
ugauguguuuuguaguucaacu

SEQ ID NO: 334132 - RNA, 22 nt, Homo sapiens
ugauguugacuguaggcagaga

SEQ ID NO: 334133 - RNA, 22 nt, Homo sapiens
ugcaaauguuaggugucauuau

SEQ ID NO: 334134 - RNA, 22 nt, Homo sapiens
ugcaaauuauugggccccaacu

SEQ ID NO: 334135 - RNA, 19 nt, Homo sapiens
ugcaaauucuaaaaacuga

SEQ ID NO: 334136 - RNA, 22 nt, Homo sapiens
ugcaaguggauuuuuccccaga

SEQ ID NO: 334137 - RNA, 22 nt, Homo sapiens
ugcaaugugaaauaagcacauc

SEQ ID NO: 334138 - RNA, 17 nt, Homo sapiens
ugcaauuuaagcuagau

SEQ ID NO: 334139 - RNA, 22 nt, Homo sapiens
ugcacaaccucacccccgcucu

SEQ ID NO: 334140 - RNA, 22 nt, Homo sapiens
ugcaccacugcacuccagcuug

SEQ ID NO: 334141 - RNA, 22 nt, Homo sapiens
ugcagaaucccuucagauccga

SEQ ID NO: 334142 - RNA, 22 nt, Homo sapiens
ugcagauucguuuugaggggua

SEQ ID NO: 334143 - RNA, 19 nt, Homo sapiens
ugcagcaauguaaaagaca

SEQ ID NO: 334144 - RNA, 22 nt, Homo sapiens
ugcagcacugaacuucugggcu

SEQ ID NO: 334145 - RNA, 18 nt, Homo sapiens
ugcagcuuugugauuggc

SEQ ID NO: 334146 - RNA, 22 nt, Homo sapiens
ugcagguacuugacaacuuggg

SEQ ID NO: 334147 - RNA, 22 nt, Homo sapiens
ugcaguacauucagcauccucu

SEQ ID NO: 334148 - RNA, 22 nt, Homo sapiens
ugcauaucuucuuuugagaaau

SEQ ID NO: 334149 - RNA, 22 nt, Homo sapiens
ugcauaugucuuuauagcagca

SEQ ID NO: 334150 - RNA, 22 nt, Homo sapiens
ugcauauguugaaccagccuug

SEQ ID NO: 334151 - RNA, 22 nt, Homo sapiens
ugcaucaggcugcuuauuacaa

SEQ ID NO: 334152 - RNA, 22 nt, Homo sapiens
ugcauguucuuacucauacaug

SEQ ID NO: 334153 - RNA, 22 nt, Homo sapiens
ugcauuaguaaguaauuuuaau

SEQ ID NO: 334154 - RNA, 22 nt, Homo sapiens
ugccauagagauuuguggaacu

SEQ ID NO: 334155 - RNA, 22 nt, Homo sapiens
ugccauugcacuccagccuggg

SEQ ID NO: 334156 - RNA, 22 nt, Homo sapiens
ugccuuuguucuggaaugggaa

SEQ ID NO: 334157 - RNA, 21 nt, Homo sapiens
ugcuacugucacuuccuuugu

SEQ ID NO: 334158 - RNA, 22 nt, Homo sapiens
ugcuagaugaaguuugaguuuu

SEQ ID NO: 334159 - RNA, 22 nt, Homo sapiens
ugcuaugucagccaggcugguc

SEQ ID NO: 334160 - RNA, 22 nt, Homo sapiens
ugcuggcguuacucuccaucag

SEQ ID NO: 334161 - RNA, 22 nt, Homo sapiens
ugcuggugauucagauucaaau

SEQ ID NO: 334162 - RNA, 22 nt, Homo sapiens
ugcugguggucccauaugauua

SEQ ID NO: 334163 - RNA, 22 nt, Homo sapiens
ugcugguguuuaggaauaagaa

SEQ ID NO: 334164 - RNA, 22 nt, Homo sapiens
ugcugguuuucaucaucagugg

SEQ ID NO: 334165 - RNA, 19 nt, Homo sapiens
ugcuuaguuuuauguguaa

SEQ ID NO: 334166 - RNA, 22 nt, Homo sapiens
ugcuucauuggccaccaggaag

SEQ ID NO: 334167 - RNA, 22 nt, Homo sapiens
uggaaaauuaggggagguuaua

SEQ ID NO: 334168 - RNA, 20 nt, Homo sapiens
uggaaaguaagucaugauau

SEQ ID NO: 334169 - RNA, 22 nt, Homo sapiens
uggaaaguaguucuaaucuaag

SEQ ID NO: 334170 - RNA, 22 nt, Homo sapiens
uggaacacaucuaaggaagcag

SEQ ID NO: 334171 - RNA, 19 nt, Homo sapiens
uggaacugauucaguucug

SEQ ID NO: 334172 - RNA, 22 nt, Homo sapiens
uggaagacauuuuggaccuugg

SEQ ID NO: 334173 - RNA, 22 nt, Homo sapiens
uggaagcaugcaaucugugggg

SEQ ID NO: 334174 - RNA, 20 nt, Homo sapiens
uggaagccuggugcuaucuu

SEQ ID NO: 334175 - RNA, 22 nt, Homo sapiens
uggaaguauagauaauugaaag

SEQ ID NO: 334176 - RNA, 22 nt, Homo sapiens
uggaagucauugagguguguua

SEQ ID NO: 334177 - RNA, 22 nt, Homo sapiens
uggaauaucaugagaguuuguu

SEQ ID NO: 334178 - RNA, 22 nt, Homo sapiens
uggaaucuagagaaaugcaaac

SEQ ID NO: 334179 - RNA, 22 nt, Homo sapiens
uggaaucuuaggugaaggcuuu

SEQ ID NO: 334180 - RNA, 19 nt, Homo sapiens
uggaaugaaauguuagggg

SEQ ID NO: 334181 - RNA, 21 nt, Homo sapiens
uggaaugaauggccaacaugg

SEQ ID NO: 334182 - RNA, 22 nt, Homo sapiens
uggaauggagagagggugcacg

SEQ ID NO: 334183 - RNA, 22 nt, Homo sapiens
uggaaugguuggugugauuuua

SEQ ID NO: 334184 - RNA, 22 nt, Homo sapiens
uggaauguagcguugacacgag

SEQ ID NO: 334185 - RNA, 22 nt, Homo sapiens
uggaaugucagcuacaagaggg

SEQ ID NO: 334186 - RNA, 17 nt, Homo sapiens
uggaaugucuaagccug

SEQ ID NO: 334187 - RNA, 22 nt, Homo sapiens
uggaaugugaauaacuuccuuc

SEQ ID NO: 334188 - RNA, 21 nt, Homo sapiens
uggaauguucugacuucaggg

SEQ ID NO: 334189 - RNA, 22 nt, Homo sapiens
uggaauguuuaucaaaacagua

SEQ ID NO: 334190 - RNA, 22 nt, Homo sapiens
uggaauuuagguugauaguaua

SEQ ID NO: 334191 - RNA, 22 nt, Homo sapiens
uggacaagauagguucuauauu

SEQ ID NO: 334192 - RNA, 22 nt, Homo sapiens
uggacaugaagggcacaggagg

SEQ ID NO: 334193 - RNA, 22 nt, Homo sapiens
uggacuguaauagagaacagaa

SEQ ID NO: 334194 - RNA, 22 nt, Homo sapiens
uggagaacauucauuugcaaga

SEQ ID NO: 334195 - RNA, 22 nt, Homo sapiens
uggagaacugaugucuccaaga

SEQ ID NO: 334196 - RNA, 22 nt, Homo sapiens
uggagcaaaguugaggccaagc

SEQ ID NO: 334197 - RNA, 22 nt, Homo sapiens
uggagguaggacgaagaacucu

SEQ ID NO: 334198 - RNA, 22 nt, Homo sapiens
aauaaagccugucucuuuagag

SEQ ID NO: 334199 - RNA, 22 nt, Homo sapiens
aauaaagcuuugagcuuugcug

SEQ ID NO: 334200 - RNA, 19 nt, Homo sapiens
aauaaugccagaugucugu

SEQ ID NO: 334201 - RNA, 22 nt, Homo sapiens
aauaauggcaccaaagcacaag

SEQ ID NO: 334202 - RNA, 22 nt, Homo sapiens
aauagcacugcuaugguuugaa

SEQ ID NO: 334203 - RNA, 22 nt, Homo sapiens
aauagcuguccuuagaagugug

SEQ ID NO: 334204 - RNA, 23 nt, Homo sapiens
aauaucacaguggguguacaccc

SEQ ID NO: 334205 - RNA, 16 nt, Homo sapiens
aauccauuggcccugc

SEQ ID NO: 334206 - RNA, 22 nt, Homo sapiens
aauccauuugccgucuauccau

SEQ ID NO: 334207 - RNA, 22 nt, Homo sapiens
aaucucagagauaucugugucc

SEQ ID NO: 334208 - RNA, 22 nt, Homo sapiens
aaucugggguuguuuggggagu

SEQ ID NO: 334209 - RNA, 22 nt, Homo sapiens
aaucugucaguuuuguguuaau

SEQ ID NO: 334210 - RNA, 22 nt, Homo sapiens
aaugaaguuagauguugagaag

SEQ ID NO: 334211 - RNA, 22 nt, Homo sapiens
aaugaucaauguuugaggugau

SEQ ID NO: 334212 - RNA, 22 nt, Homo sapiens
aaugccuagugugugacaggug

SEQ ID NO: 334213 - RNA, 22 nt, Homo sapiens
aauggcaagagccacagaggcg

SEQ ID NO: 334214 - RNA, 22 nt, Homo sapiens
ugccaagauuucaggaauuaag

SEQ ID NO: 334215 - RNA, 22 nt, Homo sapiens
ugccagaugcuggugugagggg

SEQ ID NO: 334216 - RNA, 22 nt, Homo sapiens
ugccuagucuauugagagucuu

SEQ ID NO: 334217 - RNA, 22 nt, Homo sapiens
ugccuaguguguugagaguuuu

SEQ ID NO: 334218 - RNA, 22 nt, Homo sapiens
ugccugcugucuaauauauucu

SEQ ID NO: 334219 - RNA, 21 nt, Homo sapiens
ugccuuuguaguaggugucuu

SEQ ID NO: 334220 - RNA, 22 nt, Homo sapiens
ugcgccauugcauuccagccug

SEQ ID NO: 334221 - RNA, 22 nt, Homo sapiens
ugcuaugucuucucucacagag

SEQ ID NO: 334222 - RNA, 18 nt, Homo sapiens
ugcuccccugggugagca

SEQ ID NO: 334223 - RNA, 22 nt, Homo sapiens
ugcuggugucaucaaggcuuug

SEQ ID NO: 334224 - RNA, 22 nt, Homo sapiens
uggaagguaaguuuugagcauu

SEQ ID NO: 334225 - RNA, 22 nt, Homo sapiens
uggaagugaacaaccaaggcag

SEQ ID NO: 334226 - RNA, 22 nt, Homo sapiens
uggaagugucugugcccagcuc

SEQ ID NO: 334227 - RNA, 22 nt, Homo sapiens
uggaauguaacuugaaacuuuu

SEQ ID NO: 334228 - RNA, 18 nt, Homo sapiens
uggaauguuuggguuaau

SEQ ID NO: 334229 - RNA, 22 nt, Homo sapiens
uggacaagugcccuccaccuca

SEQ ID NO: 334230 - RNA, 21 nt, Homo sapiens
uggaccccuuccagucaucau

SEQ ID NO: 334231 - RNA, 22 nt, Homo sapiens
uggagacaaagauagaaaagca

SEQ ID NO: 334232 - RNA, 22 nt, Homo sapiens
uaugcuuauaaacauuugucag

SEQ ID NO: 334233 - RNA, 22 nt, Homo sapiens
uauggauuuuggaauauguggg

SEQ ID NO: 334234 - RNA, 22 nt, Homo sapiens
uauggcuacuacgaauaaugcu

SEQ ID NO: 334235 - RNA, 22 nt, Homo sapiens
uauggcuucuuuaaauugaggu

SEQ ID NO: 334236 - RNA, 22 nt, Homo sapiens
uauggcuuucuacuugaguucu

SEQ ID NO: 334237 - RNA, 21 nt, Homo sapiens
uaugguuucuaauucugcagg

SEQ ID NO: 334238 - RNA, 22 nt, Homo sapiens
uacagucacauuccugaccaua

SEQ ID NO: 334239 - RNA, 22 nt, Homo sapiens
uacagugcuuuuugguggagaa

SEQ ID NO: 334240 - RNA, 22 nt, Homo sapiens
uacaguguuuugguauuccaca

SEQ ID NO: 334241 - RNA, 22 nt, Homo sapiens
uacauacuucacagacuuuaaa

SEQ ID NO: 334242 - RNA, 22 nt, Homo sapiens
uacauguauccauuguuuuugg

SEQ ID NO: 334243 - RNA, 22 nt, Homo sapiens
uacaugugccauguugguuugc

SEQ ID NO: 334244 - RNA, 22 nt, Homo sapiens
uacauugcacuuuauuagauac

SEQ ID NO: 334245 - RNA, 22 nt, Homo sapiens
uaccacagucauuacacuugua

SEQ ID NO: 334246 - RNA, 22 nt, Homo sapiens
uaccagcauuucucuuuaagua

SEQ ID NO: 334247 - RNA, 22 nt, Homo sapiens
uacccaguaacaaguauuuugg

SEQ ID NO: 334248 - RNA, 22 nt, Homo sapiens
uacuccccuuguucugugagcu

SEQ ID NO: 334249 - RNA, 22 nt, Homo sapiens
uacugcacuccacccuggguga

SEQ ID NO: 334250 - RNA, 18 nt, Homo sapiens
uacugcacucuccagccu

SEQ ID NO: 334251 - RNA, 20 nt, Homo sapiens
uagaaaguagaguggugguu

SEQ ID NO: 334252 - RNA, 22 nt, Homo sapiens
uagaaguaggcuacgugucugg

SEQ ID NO: 334253 - RNA, 22 nt, Homo sapiens
uagaaugaaacaagcugugccu

SEQ ID NO: 334254 - RNA, 22 nt, Homo sapiens
uagaauggaagguugagaagaa

SEQ ID NO: 334255 - RNA, 22 nt, Homo sapiens
uagaauguauaauauuuuacuu

SEQ ID NO: 334256 - RNA, 22 nt, Homo sapiens
uagagcaaugacucuggaaacc

SEQ ID NO: 334257 - RNA, 22 nt, Homo sapiens
uagagcuacagcccucacuguc

SEQ ID NO: 334258 - RNA, 22 nt, Homo sapiens
uagauaguuaugauuugaugau

SEQ ID NO: 334259 - RNA, 22 nt, Homo sapiens
uagaugauucacuuuacuucca

SEQ ID NO: 334260 - RNA, 22 nt, Homo sapiens
uagauuguaauaugcagaaugg

SEQ ID NO: 334261 - RNA, 22 nt, Homo sapiens
uagcaaaucaauggaauugaag

SEQ ID NO: 334262 - RNA, 22 nt, Homo sapiens
uagcacagugucauucuaggua

SEQ ID NO: 334263 - RNA, 22 nt, Homo sapiens
uagcaccugugcacaccaggca

SEQ ID NO: 334264 - RNA, 20 nt, Homo sapiens
uagcagcagacagagggagg

SEQ ID NO: 334265 - RNA, 22 nt, Homo sapiens
uagcagccaggaagggcuggcu

SEQ ID NO: 334266 - RNA, 22 nt, Homo sapiens
uagcaggaaaggggucagaucu

SEQ ID NO: 334267 - RNA, 22 nt, Homo sapiens
uagcagguguuccacaaauauu

SEQ ID NO: 334268 - RNA, 22 nt, Homo sapiens
uagcaguaaagaaugugauguu

SEQ ID NO: 334269 - RNA, 22 nt, Homo sapiens
uagcaguaagaaacugacauug

SEQ ID NO: 334270 - RNA, 22 nt, Homo sapiens
uagcaguauugaaagaugaggg

SEQ ID NO: 334271 - RNA, 22 nt, Homo sapiens
uagcauaauuuguagaaaauca

SEQ ID NO: 334272 - RNA, 20 nt, Homo sapiens
uagccggguguugugucaug

SEQ ID NO: 334273 - RNA, 21 nt, Homo sapiens
uagcuacacugugauucaugg

SEQ ID NO: 334274 - RNA, 19 nt, Homo sapiens
uagcuagauuggguacuua

SEQ ID NO: 334275 - RNA, 22 nt, Homo sapiens
uagcucagcccagcuaagcuca

SEQ ID NO: 334276 - RNA, 21 nt, Homo sapiens
uagcucagugguguugccaua

SEQ ID NO: 334277 - RNA, 22 nt, Homo sapiens
uagcugauguuugucuaguagc

SEQ ID NO: 334278 - RNA, 22 nt, Homo sapiens
uagcugcacuuacaagugagaa

SEQ ID NO: 334279 - RNA, 22 nt, Homo sapiens
uagcugcauccugugcacucaa

SEQ ID NO: 334280 - RNA, 22 nt, Homo sapiens
uaggaaguuucuugauuacuua

SEQ ID NO: 334281 - RNA, 22 nt, Homo sapiens
uaggaaguuuucuugcugggcc

SEQ ID NO: 334282 - RNA, 22 nt, Homo sapiens
uaggacuuuucuugagagugac

SEQ ID NO: 334283 - RNA, 22 nt, Homo sapiens
uaggacuuuuugguaggcggga

SEQ ID NO: 334284 - RNA, 22 nt, Homo sapiens
uaggagcacaaacccuacugug

SEQ ID NO: 334285 - RNA, 22 nt, Homo sapiens
uaggagcacagcagcauguggg

SEQ ID NO: 334286 - RNA, 22 nt, Homo sapiens
uaggagcauaggauuguuugag

SEQ ID NO: 334287 - RNA, 22 nt, Homo sapiens
uaggaucauuuuauguugccca

SEQ ID NO: 334288 - RNA, 22 nt, Homo sapiens
uaggcaauggagauagaggaug

SEQ ID NO: 334289 - RNA, 22 nt, Homo sapiens
uaggcaguggagaaauaaacag

SEQ ID NO: 334290 - RNA, 19 nt, Homo sapiens
uagggcacgaggcagaguc

SEQ ID NO: 334291 - RNA, 22 nt, Homo sapiens
uaggguaguaauaguuguuuca

SEQ ID NO: 334292 - RNA, 22 nt, Homo sapiens
uagguaaguaauauacagauga

SEQ ID NO: 334293 - RNA, 22 nt, Homo sapiens
uagguaaguaugugugaugggg

SEQ ID NO: 334294 - RNA, 22 nt, Homo sapiens
uaggucuuuuaugaaauauauu

SEQ ID NO: 334295 - RNA, 22 nt, Homo sapiens
uaggugauccauuuguauuuua

SEQ ID NO: 334296 - RNA, 20 nt, Homo sapiens
uagguuuucacagaauugcc

SEQ ID NO: 334297 - RNA, 22 nt, Homo sapiens
uaguaaacaccucagguaauuc

SEQ ID NO: 334298 - RNA, 18 nt, Homo sapiens
uaguacuguucucaugau

SEQ ID NO: 334299 - RNA, 22 nt, Homo sapiens
uagugcaguggcuccaucucag

SEQ ID NO: 334300 - RNA, 22 nt, Homo sapiens
uagugcugagauugagaagccc

SEQ ID NO: 334301 - RNA, 22 nt, Homo sapiens
uagugcugugauaaacauauau

SEQ ID NO: 334302 - RNA, 18 nt, Homo sapiens
uagugcuguucucaugau

SEQ ID NO: 334303 - RNA, 20 nt, Homo sapiens
uaguggcaugcaccuguagc

SEQ ID NO: 334304 - RNA, 22 nt, Homo sapiens
uaguggucccccagucccagcu

SEQ ID NO: 334305 - RNA, 22 nt, Homo sapiens
uauaugcauugugggguacuga

SEQ ID NO: 334306 - RNA, 22 nt, Homo sapiens
uaucacaaacuuagcaguuuaa

SEQ ID NO: 334307 - RNA, 22 nt, Homo sapiens
uaucacacaucaugguaaaucu

SEQ ID NO: 334308 - RNA, 23 nt, Homo sapiens
uaucacacuuucucugugccaca

SEQ ID NO: 334309 - RNA, 22 nt, Homo sapiens
uaucacagaggguauccuagag

SEQ ID NO: 334310 - RNA, 22 nt, Homo sapiens
uaucacagauucuccaggguuu

SEQ ID NO: 334311 - RNA, 20 nt, Homo sapiens
uaucacaggucagaaacccu

SEQ ID NO: 334312 - RNA, 22 nt, Homo sapiens
uaucaccauguccguuuuaaaa

SEQ ID NO: 334313 - RNA, 22 nt, Homo sapiens
uaucacuuugauaguuuaaaug

SEQ ID NO: 334314 - RNA, 22 nt, Homo sapiens
uaucagcacaguggguucaugg

SEQ ID NO: 334315 - RNA, 22 nt, Homo sapiens
uaucagcagagucauacuucaa

SEQ ID NO: 334316 - RNA, 22 nt, Homo sapiens
uaucaucauguuuuugcugugu

SEQ ID NO: 334317 - RNA, 22 nt, Homo sapiens
uaucuacauguagguauguaug

SEQ ID NO: 334318 - RNA, 22 nt, Homo sapiens
uaugaauuuuauccaggauaua

SEQ ID NO: 334319 - RNA, 22 nt, Homo sapiens
uaugacuuuggaaaaauuacuu

SEQ ID NO: 334320 - RNA, 22 nt, Homo sapiens
uaugagacugugagugagaaau

SEQ ID NO: 334321 - RNA, 22 nt, Homo sapiens
uaugagcaaaaugaggguuagu

SEQ ID NO: 334322 - RNA, 22 nt, Homo sapiens
uaugcacacacguguuuaugug

SEQ ID NO: 334323 - RNA, 22 nt, Homo sapiens
uaugcacacguguccaugugca

SEQ ID NO: 334324 - RNA, 19 nt, Homo sapiens
uaugcuauuuauuagaagu

SEQ ID NO: 334325 - RNA, 22 nt, Homo sapiens
auaaagcuauuccucucuuuuu

SEQ ID NO: 334326 - RNA, 22 nt, Homo sapiens
auaaaguagaggugaggugcau

SEQ ID NO: 334327 - RNA, 22 nt, Homo sapiens
auaaaguucugcuggcauauau

SEQ ID NO: 334328 - RNA, 22 nt, Homo sapiens
auaaaugcuuagaucuguauau

SEQ ID NO: 334329 - RNA, 22 nt, Homo sapiens
auaacagcugcaaggcaaaagc

SEQ ID NO: 334330 - RNA, 22 nt, Homo sapiens
auaagaugaaggaagccauauc

SEQ ID NO: 334331 - RNA, 22 nt, Homo sapiens
auaaggcugguauagacauuca

SEQ ID NO: 334332 - RNA, 22 nt, Homo sapiens
auaaguauuuggacuuuacugu

SEQ ID NO: 334333 - RNA, 22 nt, Homo sapiens
auaagugcuuguugaauaauag

SEQ ID NO: 334334 - RNA, 22 nt, Homo sapiens
auaauacugggaagaugagcau

SEQ ID NO: 334335 - RNA, 22 nt, Homo sapiens
auacaagcaguccaacuccaua

SEQ ID NO: 334336 - RNA, 22 nt, Homo sapiens
auacagucuguuagauuuccuc

SEQ ID NO: 334337 - RNA, 22 nt, Homo sapiens
auacagugaauaucuggggcag

SEQ ID NO: 334338 - RNA, 22 nt, Homo sapiens
auacaguguauguauaguacau

SEQ ID NO: 334339 - RNA, 22 nt, Homo sapiens
auacaguugccauuucuugugc

SEQ ID NO: 334340 - RNA, 22 nt, Homo sapiens
auacauguucaagggcauauau

SEQ ID NO: 334341 - RNA, 22 nt, Homo sapiens
auaccugguagucuugcuacac

SEQ ID NO: 334342 - RNA, 22 nt, Homo sapiens
auacuagucaagaauguaugag

SEQ ID NO: 334343 - RNA, 22 nt, Homo sapiens
auacuaugagauaauaaagacu

SEQ ID NO: 334344 - RNA, 22 nt, Homo sapiens
auacugguuuuugucaugugga

SEQ ID NO: 334345 - RNA, 22 nt, Homo sapiens
auagaguuagaaagaaauguuu

SEQ ID NO: 334346 - RNA, 21 nt, Homo sapiens
auagcacaucagauuuuauua

SEQ ID NO: 334347 - RNA, 22 nt, Homo sapiens
auagcacaugugcaaauggcug

SEQ ID NO: 334348 - RNA, 22 nt, Homo sapiens
auagcagaauuuggucaagucu

SEQ ID NO: 334349 - RNA, 22 nt, Homo sapiens
auagcauaucccacaugucaga

SEQ ID NO: 334350 - RNA, 22 nt, Homo sapiens
auaguacuauugcaguguuaua

SEQ ID NO: 334351 - RNA, 22 nt, Homo sapiens
auagugcugcaauaaacauaca

SEQ ID NO: 334352 - RNA, 22 nt, Homo sapiens
auagugcuguauuaaacauacg

SEQ ID NO: 334353 - RNA, 22 nt, Homo sapiens
auauaguguuuuuugguacgcu

SEQ ID NO: 334354 - RNA, 22 nt, Homo sapiens
auauaugcacacgugugcauau

SEQ ID NO: 334355 - RNA, 22 nt, Homo sapiens
auaucccaguguguaaacacug

SEQ ID NO: 334356 - RNA, 19 nt, Homo sapiens
auaugggguuugaacugug

SEQ ID NO: 334357 - RNA, 22 nt, Homo sapiens
auaugguacuuaugcucaaacu

SEQ ID NO: 334358 - RNA, 22 nt, Homo sapiens
auaugguuuuuggaagcauauc

SEQ ID NO: 334359 - RNA, 22 nt, Homo sapiens
auauguaguauggaaacauugu

SEQ ID NO: 334360 - RNA, 22 nt, Homo sapiens
auaugucuguuuagucuguaau

SEQ ID NO: 334361 - RNA, 22 nt, Homo sapiens
auaugucuuaguuaccuugggc

SEQ ID NO: 334362 - RNA, 22 nt, Homo sapiens
auauguucucauucauaugugg

SEQ ID NO: 334363 - RNA, 22 nt, Homo sapiens
auauuacuggcuauaucgcaag

SEQ ID NO: 334364 - RNA, 18 nt, Homo sapiens
auauugccuucagacuag

SEQ ID NO: 334365 - RNA, 22 nt, Homo sapiens
auauugguuaaauauuauguga

SEQ ID NO: 334366 - RNA, 22 nt, Homo sapiens
auauuguuggcugcuggcugau

SEQ ID NO: 334367 - RNA, 19 nt, Homo sapiens
aucaaacugcucuuugagg

SEQ ID NO: 334368 - RNA, 22 nt, Homo sapiens
aucaaaguaggcauauguuuuu

SEQ ID NO: 334369 - RNA, 22 nt, Homo sapiens
aucaaaucuccagaaccugucu

SEQ ID NO: 334370 - RNA, 22 nt, Homo sapiens
aucaagccaaagaaaguccuug

SEQ ID NO: 334371 - RNA, 22 nt, Homo sapiens
aucacagaacuuugagcagaga

SEQ ID NO: 334372 - RNA, 22 nt, Homo sapiens
aucacagagucacgggcaacuu

SEQ ID NO: 334373 - RNA, 22 nt, Homo sapiens
aucacagauauggguuuaaauc

SEQ ID NO: 334374 - RNA, 22 nt, Homo sapiens
aucacagugagcauaugucuau

SEQ ID NO: 334375 - RNA, 22 nt, Homo sapiens
aucaccauguguacauuagacc

SEQ ID NO: 334376 - RNA, 22 nt, Homo sapiens
aucacuggccuuuuuaaaugcu

SEQ ID NO: 334377 - RNA, 22 nt, Homo sapiens
aucagcagcaugaaaacaggcu

SEQ ID NO: 334378 - RNA, 22 nt, Homo sapiens
aucagcagcaugaaaagcaacu

SEQ ID NO: 334379 - RNA, 22 nt, Homo sapiens
aucagcauucccaaaugaugug

SEQ ID NO: 334380 - RNA, 22 nt, Homo sapiens
aucagucacugcguuuuuggga

SEQ ID NO: 334381 - RNA, 22 nt, Homo sapiens
aucagugauugauuuaaagacg

SEQ ID NO: 334382 - RNA, 22 nt, Homo sapiens
auccccugcacggggugucauu

SEQ ID NO: 334383 - RNA, 22 nt, Homo sapiens
auccccuugcagugaccggggc

SEQ ID NO: 334384 - RNA, 22 nt, Homo sapiens
aucgcaccauugcacuccagca

SEQ ID NO: 334385 - RNA, 22 nt, Homo sapiens
aucuacagccagucugguuugu

SEQ ID NO: 334386 - RNA, 16 nt, Homo sapiens
aucucagaccugcuga

SEQ ID NO: 334387 - RNA, 22 nt, Homo sapiens
aucucagagaaaauuacuaaga

SEQ ID NO: 334388 - RNA, 22 nt, Homo sapiens
aucucugagauguucugauuuu

SEQ ID NO: 334389 - RNA, 22 nt, Homo sapiens
uuauaacucugcagccugguau

SEQ ID NO: 334390 - RNA, 22 nt, Homo sapiens
uuauagacacguuguaacaaac

SEQ ID NO: 334391 - RNA, 22 nt, Homo sapiens
uuauauguuagacauggugggu

SEQ ID NO: 334392 - RNA, 17 nt, Homo sapiens
uuaugagacuucuuagc

SEQ ID NO: 334393 - RNA, 22 nt, Homo sapiens
uuaugcuguuuucuggagauuu

SEQ ID NO: 334394 - RNA, 22 nt, Homo sapiens
uuaugcuuauugguguacggua

SEQ ID NO: 334395 - RNA, 22 nt, Homo sapiens
uuauggccauucuuguaggagu

SEQ ID NO: 334396 - RNA, 22 nt, Homo sapiens
uuauggcucuuggggaaguaga

SEQ ID NO: 334397 - RNA, 22 nt, Homo sapiens
uuauggcuuugcgguguuagca

SEQ ID NO: 334398 - RNA, 22 nt, Homo sapiens
uuaugucacuguucagucuccc

SEQ ID NO: 334399 - RNA, 22 nt, Homo sapiens
uuauguguuuaauguuucugaa

SEQ ID NO: 334400 - RNA, 22 nt, Homo sapiens
uuauuugguuauuguaauuggg

SEQ ID NO: 334401 - RNA, 22 nt, Homo sapiens
uucaaaggauuuagauuagcua

SEQ ID NO: 334402 - RNA, 22 nt, Homo sapiens
uucaaaguguugguuuugggcu

SEQ ID NO: 334403 - RNA, 22 nt, Homo sapiens
uucaagugguucagaagucuga

SEQ ID NO: 334404 - RNA, 22 nt, Homo sapiens
uucacaaugccuuguugauggu

SEQ ID NO: 334405 - RNA, 22 nt, Homo sapiens
uucacacugggccuacucugug

SEQ ID NO: 334406 - RNA, 22 nt, Homo sapiens
uucacagacaacuggucccuua

SEQ ID NO: 334407 - RNA, 22 nt, Homo sapiens
uucacagugugaucuaugggca

SEQ ID NO: 334408 - RNA, 16 nt, Homo sapiens
uucacauggcagcagg

SEQ ID NO: 334409 - RNA, 22 nt, Homo sapiens
uucaccuggguuggccaucauu

SEQ ID NO: 334410 - RNA, 20 nt, Homo sapiens
uucacugggcucucuguugg

SEQ ID NO: 334411 - RNA, 22 nt, Homo sapiens
uucagcaggccaggcccugacu

SEQ ID NO: 334412 - RNA, 22 nt, Homo sapiens
uucagcaguggccaguggaaau

SEQ ID NO: 334413 - RNA, 22 nt, Homo sapiens
uucagggacuuuagacaagaga

SEQ ID NO: 334414 - RNA, 22 nt, Homo sapiens
uucaguccauuuccuuggucac

SEQ ID NO: 334415 - RNA, 18 nt, Homo sapiens
uucauaguagcaugauuu

SEQ ID NO: 334416 - RNA, 22 nt, Homo sapiens
uucauagucuaauuuuuuccac

SEQ ID NO: 334417 - RNA, 23 nt, Homo sapiens
uucaucagggauauuggccugaa

SEQ ID NO: 334418 - RNA, 22 nt, Homo sapiens
uucauggaugcauuugaggggu

SEQ ID NO: 334419 - RNA, 20 nt, Homo sapiens
uucaugggagcaaagaggcc

SEQ ID NO: 334420 - RNA, 22 nt, Homo sapiens
uucauguaaucaaggcagcuaa

SEQ ID NO: 334421 - RNA, 22 nt, Homo sapiens
uucaugucuuggcuguuagagu

SEQ ID NO: 334422 - RNA, 22 nt, Homo sapiens
uuccaauguuccguguugcagu

SEQ ID NO: 334423 - RNA, 22 nt, Homo sapiens
uuccacagggauuugcauugau

SEQ ID NO: 334424 - RNA, 22 nt, Homo sapiens
uuccaggugggcgugggccugg

SEQ ID NO: 334425 - RNA, 22 nt, Homo sapiens
uucccagagaaaaggguuucuu

SEQ ID NO: 334426 - RNA, 22 nt, Homo sapiens
uucccagagccugggagugagg

SEQ ID NO: 334427 - RNA, 22 nt, Homo sapiens
uucccuagaacacauggaggga

SEQ ID NO: 334428 - RNA, 22 nt, Homo sapiens
uucccugaaauauucacuuuca

SEQ ID NO: 334429 - RNA, 22 nt, Homo sapiens
uucccuguaucuucugccaugu

SEQ ID NO: 334430 - RNA, 22 nt, Homo sapiens
uucccugugugcagaugggugu

SEQ ID NO: 334431 - RNA, 22 nt, Homo sapiens
uucccuuucugccuugaaucuu

SEQ ID NO: 334432 - RNA, 22 nt, Homo sapiens
uuccuugaaacagucaagagaa

SEQ ID NO: 334433 - RNA, 22 nt, Homo sapiens
uuccuugguucagggaaggucc

SEQ ID NO: 334434 - RNA, 22 nt, Homo sapiens
uucucagugaaguuuagaacau

SEQ ID NO: 334435 - RNA, 22 nt, Homo sapiens
uucucagugcuaucuuuuaugc

SEQ ID NO: 334436 - RNA, 22 nt, Homo sapiens
uucucaguucgguggcagugcu

SEQ ID NO: 334437 - RNA, 22 nt, Homo sapiens
uucucugggacauaggucgggu

SEQ ID NO: 334438 - RNA, 22 nt, Homo sapiens
uucugcuugaucuaguguguug

SEQ ID NO: 334439 - RNA, 22 nt, Homo sapiens
uucuggcuuuuaaagaaauguu

SEQ ID NO: 334440 - RNA, 22 nt, Homo sapiens
uucuguguuuaggucacggcua

SEQ ID NO: 334441 - RNA, 22 nt, Homo sapiens
uucuuaguggcaccacuuuuuu

SEQ ID NO: 334442 - RNA, 21 nt, Homo sapiens
uucuucaggcagaaggauuau

SEQ ID NO: 334443 - RNA, 22 nt, Homo sapiens
uucuugcacuuggcccucauua

SEQ ID NO: 334444 - RNA, 22 nt, Homo sapiens
uucuugcuguauccucacaugg

SEQ ID NO: 334445 - RNA, 22 nt, Homo sapiens
uucuuuggaaacaguacuaauu

SEQ ID NO: 334446 - RNA, 22 nt, Homo sapiens
uugaaagaugaacuggauugga

SEQ ID NO: 334447 - RNA, 22 nt, Homo sapiens
uugaaaguaaacaucacaaaga

SEQ ID NO: 334448 - RNA, 22 nt, Homo sapiens
uugaaagucauuucuucuaagu

SEQ ID NO: 334449 - RNA, 22 nt, Homo sapiens
uugaaauguguaagcuccgaaa

SEQ ID NO: 334450 - RNA, 22 nt, Homo sapiens
uugaacuguaagggucugugug

SEQ ID NO: 334451 - RNA, 22 nt, Homo sapiens
uugaaggaggugcucacucucg

SEQ ID NO: 334452 - RNA, 22 nt, Homo sapiens
uugaaguagaaagacgaaauuu

SEQ ID NO: 334453 - RNA, 22 nt, Homo sapiens
uugaaguaguacuuuauuauag

SEQ ID NO: 334454 - RNA, 22 nt, Homo sapiens
uugaauagaagguuuuuuguuc

SEQ ID NO: 334455 - RNA, 22 nt, Homo sapiens
uugaauagcauguuuagugcau

SEQ ID NO: 334456 - RNA, 22 nt, Homo sapiens
uugaauagugacuuugauucug

SEQ ID NO: 334457 - RNA, 22 nt, Homo sapiens
uugaaugaaaugaugucauuug

SEQ ID NO: 334458 - RNA, 22 nt, Homo sapiens
uugaauguaugcuggguuuacu

SEQ ID NO: 334459 - RNA, 22 nt, Homo sapiens
uugaaugucuauuaaguuguuu

SEQ ID NO: 334460 - RNA, 22 nt, Homo sapiens
uugacaaugcacugugcuaagu

SEQ ID NO: 334461 - RNA, 22 nt, Homo sapiens
uugacagaccuuggucauaucc

SEQ ID NO: 334462 - RNA, 20 nt, Homo sapiens
uugacagagggaaaguugcu

SEQ ID NO: 334463 - RNA, 20 nt, Homo sapiens
uugacaguggguuguuaaag

SEQ ID NO: 334464 - RNA, 22 nt, Homo sapiens
uugacauaguuucugaaauaga

SEQ ID NO: 334465 - RNA, 22 nt, Homo sapiens
uugagagagaacauuuguuaca

SEQ ID NO: 334466 - RNA, 22 nt, Homo sapiens
uugagauggagccucacucugc

SEQ ID NO: 334467 - RNA, 22 nt, Homo sapiens
uugagauggagucucacucugu

SEQ ID NO: 334468 - RNA, 22 nt, Homo sapiens
uugagauggagucucacucuuc

SEQ ID NO: 334469 - RNA, 22 nt, Homo sapiens
uugagauggagucucguucugu

SEQ ID NO: 334470 - RNA, 22 nt, Homo sapiens
uugagauggaguucauuuuugu

SEQ ID NO: 334471 - RNA, 22 nt, Homo sapiens
uugagauggaguuucacucuug

SEQ ID NO: 334472 - RNA, 22 nt, Homo sapiens
uugagauguaagauguuaauau

SEQ ID NO: 334473 - RNA, 22 nt, Homo sapiens
uugagauguaguuucacuccug

SEQ ID NO: 334474 - RNA, 22 nt, Homo sapiens
uugagauuuuccucaaauauuu

SEQ ID NO: 334475 - RNA, 22 nt, Homo sapiens
uugagcaaaacauuaauauuag

SEQ ID NO: 334476 - RNA, 22 nt, Homo sapiens
ucauaguacuuuguuuugaaaa

SEQ ID NO: 334477 - RNA, 22 nt, Homo sapiens
ucauagucuaagguucuuuugc

SEQ ID NO: 334478 - RNA, 16 nt, Homo sapiens
ucaucacagucucugg

SEQ ID NO: 334479 - RNA, 22 nt, Homo sapiens
ucaucagguaugucagcggagu

SEQ ID NO: 334480 - RNA, 22 nt, Homo sapiens
ucauggcuuuuauuauguugag

SEQ ID NO: 334481 - RNA, 22 nt, Homo sapiens
ucauggggugagcuacaggcac

SEQ ID NO: 334482 - RNA, 22 nt, Homo sapiens
ucaugugagcacagagcaagau

SEQ ID NO: 334483 - RNA, 22 nt, Homo sapiens
ucauuagagacagggugucacu

SEQ ID NO: 334484 - RNA, 22 nt, Homo sapiens
uggcauauaauauagaagacua

SEQ ID NO: 334485 - RNA, 17 nt, Homo sapiens
uggcaugaggguguggg

SEQ ID NO: 334486 - RNA, 22 nt, Homo sapiens
uggcauggaguggauggcccca

SEQ ID NO: 334487 - RNA, 22 nt, Homo sapiens
uggcauguaaugcagaaguugc

SEQ ID NO: 334488 - RNA, 22 nt, Homo sapiens
uggcauguagucugggaccugg

SEQ ID NO: 334489 - RNA, 22 nt, Homo sapiens
uggcaugucguuuuucauagga

SEQ ID NO: 334490 - RNA, 22 nt, Homo sapiens
uggcauuuucucuguucuuaga

SEQ ID NO: 334491 - RNA, 23 nt, Homo sapiens
uggccaagauaaucucaguuuuc

SEQ ID NO: 334492 - RNA, 22 nt, Homo sapiens
uggccaguguuuuuccugggcu

SEQ ID NO: 334493 - RNA, 22 nt, Homo sapiens
uggccuguaacgcugucucagc

SEQ ID NO: 334494 - RNA, 22 nt, Homo sapiens
uggcgagaugcucgugugcaga

SEQ ID NO: 334495 - RNA, 20 nt, Homo sapiens
uggcuaaaugaaugauagca

SEQ ID NO: 334496 - RNA, 18 nt, Homo sapiens
uggcuacugaacuagaug

SEQ ID NO: 334497 - RNA, 21 nt, Homo sapiens
uggcuauuucuguggcauaca

SEQ ID NO: 334498 - RNA, 22 nt, Homo sapiens
uggcuguguccucucccaaauc

SEQ ID NO: 334499 - RNA, 22 nt, Homo sapiens
uggcuguuuauuucaccugggc

SEQ ID NO: 334500 - RNA, 22 nt, Homo sapiens
uggcuguuuauuucacgugggu

SEQ ID NO: 334501 - RNA, 22 nt, Homo sapiens
uggcuuuuccuugaaucugccu

SEQ ID NO: 334502 - RNA, 18 nt, Homo sapiens
ugggaagaaauucuucuc

SEQ ID NO: 334503 - RNA, 22 nt, Homo sapiens
ugggaagaagguuuacuugcca

SEQ ID NO: 334504 - RNA, 22 nt, Homo sapiens
ugggaucauucaaugacgaaau

SEQ ID NO: 334505 - RNA, 22 nt, Homo sapiens
ugggaucgucaagugaggcucg

SEQ ID NO: 334506 - RNA, 22 nt, Homo sapiens
ugggaugaugaaaaggcuuucu

SEQ ID NO: 334507 - RNA, 22 nt, Homo sapiens
ugggcaaaacuaagagcugugg

SEQ ID NO: 334508 - RNA, 22 nt, Homo sapiens
ugggcaaauugugagggaggua

SEQ ID NO: 334509 - RNA, 22 nt, Homo sapiens
ugggcaagugacuuggcuucuc

SEQ ID NO: 334510 - RNA, 22 nt, Homo sapiens
uggguaaaucuguuuggggcuc

SEQ ID NO: 334511 - RNA, 22 nt, Homo sapiens
uggguaauggagaaauaaaucu

SEQ ID NO: 334512 - RNA, 22 nt, Homo sapiens
uggguagauaucauaguugccc

SEQ ID NO: 334513 - RNA, 19 nt, Homo sapiens
uggguaguuuucuggcugg

SEQ ID NO: 334514 - RNA, 22 nt, Homo sapiens
ugguagugugagucuaaauugg

SEQ ID NO: 334515 - RNA, 22 nt, Homo sapiens
uggucagaaaauuacuugauau

SEQ ID NO: 334516 - RNA, 19 nt, Homo sapiens
uggucaguucugggagcug

SEQ ID NO: 334517 - RNA, 22 nt, Homo sapiens
uggucaguugaguccuugccaa

SEQ ID NO: 334518 - RNA, 22 nt, Homo sapiens
uggucccucugaaaauugggug

SEQ ID NO: 334519 - RNA, 22 nt, Homo sapiens
uggucuggagagucccgcccag

SEQ ID NO: 334520 - RNA, 22 nt, Homo sapiens
uggugagaaaagaugucuuugu

SEQ ID NO: 334521 - RNA, 22 nt, Homo sapiens
uggugagaaaugagaugcuuuu

SEQ ID NO: 334522 - RNA, 22 nt, Homo sapiens
uggugccgugguccuggggcca

SEQ ID NO: 334523 - RNA, 20 nt, Homo sapiens
uggugucuuggaaagagcuc

SEQ ID NO: 334524 - RNA, 22 nt, Homo sapiens
ugguuguuuuaaaugucgucug

SEQ ID NO: 334525 - RNA, 22 nt, Homo sapiens
uguaaacauguauguguuuaug

SEQ ID NO: 334526 - RNA, 20 nt, Homo sapiens
uguaacaaucuggauguugc

SEQ ID NO: 334527 - RNA, 20 nt, Homo sapiens
uguacacaguguacccacau

SEQ ID NO: 334528 - RNA, 19 nt, Homo sapiens
uguaccagcaagucuuuuc

SEQ ID NO: 334529 - RNA, 22 nt, Homo sapiens
uguacuagaaauuaaggcaggg

SEQ ID NO: 334530 - RNA, 22 nt, Homo sapiens
uguagacagcacguaguugagu

SEQ ID NO: 334531 - RNA, 22 nt, Homo sapiens
uguagcagccauaaacacagug

SEQ ID NO: 334532 - RNA, 22 nt, Homo sapiens
uguagcuuuugagauuuauauu

SEQ ID NO: 334533 - RNA, 22 nt, Homo sapiens
uguagguguacauacaugguua

SEQ ID NO: 334534 - RNA, 23 nt, Homo sapiens
uguauacacccugugcaucuggg

SEQ ID NO: 334535 - RNA, 21 nt, Homo sapiens
uguauacauauguuaggugca

SEQ ID NO: 334536 - RNA, 22 nt, Homo sapiens
uguaugucugcucuuuggaacu

SEQ ID NO: 334537 - RNA, 21 nt, Homo sapiens
ugucaagugggaaaacaugua

SEQ ID NO: 334538 - RNA, 22 nt, Homo sapiens
ugucaaguugugguucaauuuu

SEQ ID NO: 334539 - RNA, 22 nt, Homo sapiens
ugucagaaucugagacgacaac

SEQ ID NO: 334540 - RNA, 22 nt, Homo sapiens
ugucagcacaacucagguuccu

SEQ ID NO: 334541 - RNA, 22 nt, Homo sapiens
ugucaguggacugugaaaggca

SEQ ID NO: 334542 - RNA, 22 nt, Homo sapiens
ugucauacaguaacaugguugg

SEQ ID NO: 334543 - RNA, 22 nt, Homo sapiens
ugucaucauuccaucagggcuu

SEQ ID NO: 334544 - RNA, 22 nt, Homo sapiens
ugucaucuagguuuuaagccuu

SEQ ID NO: 334545 - RNA, 22 nt, Homo sapiens
ugucaugaaauauguuuuucua

SEQ ID NO: 334546 - RNA, 22 nt, Homo sapiens
ugucauggugcucugggcccug

SEQ ID NO: 334547 - RNA, 22 nt, Homo sapiens
ugucaugguguuaauuuuccug

SEQ ID NO: 334548 - RNA, 22 nt, Homo sapiens
ugucaugucaacuauggaauuu

SEQ ID NO: 334549 - RNA, 22 nt, Homo sapiens
ugucccugagccuggauuccug

SEQ ID NO: 334550 - RNA, 22 nt, Homo sapiens
uguccuggugaugcccaaauuc

SEQ ID NO: 334551 - RNA, 22 nt, Homo sapiens
ugucuaaagaauggcagacuca

SEQ ID NO: 334552 - RNA, 22 nt, Homo sapiens
ugucucaguuacggcaauucca

SEQ ID NO: 334553 - RNA, 22 nt, Homo sapiens
ugugccacugcacucccgccug

SEQ ID NO: 334554 - RNA, 22 nt, Homo sapiens
ugugccacugcacuccugggug

SEQ ID NO: 334555 - RNA, 22 nt, Homo sapiens
ugugcgugugccuguaagaauu

SEQ ID NO: 334556 - RNA, 22 nt, Homo sapiens
ugugcuauguuauucacauggg

SEQ ID NO: 334557 - RNA, 22 nt, Homo sapiens
ugugcuuguaaaggccagagca

SEQ ID NO: 334558 - RNA, 22 nt, Homo sapiens
uguggcaaagucuugugaauau

SEQ ID NO: 334559 - RNA, 20 nt, Homo sapiens
uguggcacuguaucucucag

SEQ ID NO: 334560 - RNA, 22 nt, Homo sapiens
uguggcauugaauaaccuugga

SEQ ID NO: 334561 - RNA, 22 nt, Homo sapiens
uguggccuuuguuucaguuggg

SEQ ID NO: 334562 - RNA, 22 nt, Homo sapiens
ugugggaggugcuaauguaaau

SEQ ID NO: 334563 - RNA, 19 nt, Homo sapiens
uguggucauccugggacga

SEQ ID NO: 334564 - RNA, 22 nt, Homo sapiens
ugugguuuuuuucuccaauagg

SEQ ID NO: 334565 - RNA, 22 nt, Homo sapiens
ugugucuuguuuauagcuuucu

SEQ ID NO: 334566 - RNA, 22 nt, Homo sapiens
ugugucuuguuuuuucccaggc

SEQ ID NO: 334567 - RNA, 22 nt, Homo sapiens
uguguuugauaaguccauaguu

SEQ ID NO: 334568 - RNA, 22 nt, Homo sapiens
uguuacacugugcacuaaauuu

SEQ ID NO: 334569 - RNA, 22 nt, Homo sapiens
uguuagguuggugcaaaaguga

SEQ ID NO: 334570 - RNA, 22 nt, Homo sapiens
uguucacaguguuucuuugaga

SEQ ID NO: 334571 - RNA, 22 nt, Homo sapiens
uguucauggauccaguggcuuc

SEQ ID NO: 334572 - RNA, 22 nt, Homo sapiens
uguugcacuccagccugggcaa

SEQ ID NO: 334573 - RNA, 22 nt, Homo sapiens
uguugcacuccauccugggcga

SEQ ID NO: 334574 - RNA, 22 nt, Homo sapiens
uguugcacucuagccugggcaa

SEQ ID NO: 334575 - RNA, 22 nt, Homo sapiens
uguugcacugguaauguacuga

SEQ ID NO: 334576 - RNA, 22 nt, Homo sapiens
uguuuaguuaagacauagaauu

SEQ ID NO: 334577 - RNA, 22 nt, Homo sapiens
uguuugcuguuuucuccaauga

SEQ ID NO: 334578 - RNA, 22 nt, Homo sapiens
uguuuuggaguggacuuugcau

SEQ ID NO: 334579 - RNA, 22 nt, Homo sapiens
uuaaagcgacucucaugccuca

SEQ ID NO: 334580 - RNA, 22 nt, Homo sapiens
uuaaagcuggcguuacaguuug

SEQ ID NO: 334581 - RNA, 22 nt, Homo sapiens
uuaaauacagcaugguguuucu

SEQ ID NO: 334582 - RNA, 22 nt, Homo sapiens
uuaaaugcacauacuugagaaa

SEQ ID NO: 334583 - RNA, 22 nt, Homo sapiens
uuaacagugucaaucuguagua

SEQ ID NO: 334584 - RNA, 22 nt, Homo sapiens
uuaagcaaagguaacaugagaa

SEQ ID NO: 334585 - RNA, 23 nt, Homo sapiens
uuaagcaacggcugcuuuucaga

SEQ ID NO: 334586 - RNA, 22 nt, Homo sapiens
uuaaggaaagcauuuaauucag

SEQ ID NO: 334587 - RNA, 22 nt, Homo sapiens
uuaaggccccgcccauucaggc

SEQ ID NO: 334588 - RNA, 22 nt, Homo sapiens
uuaaguaaucagagaagagaac

SEQ ID NO: 334589 - RNA, 22 nt, Homo sapiens
uuaauacucuucuaaguagucc

SEQ ID NO: 334590 - RNA, 22 nt, Homo sapiens
uuaaucaggccguuuccuaaga

SEQ ID NO: 334591 - RNA, 22 nt, Homo sapiens
uuaaugaacuuuauuuuguaga

SEQ ID NO: 334592 - RNA, 22 nt, Homo sapiens
uuacaaccucagcagugcaaag

SEQ ID NO: 334593 - RNA, 22 nt, Homo sapiens
uuacaagaugucuguccaacac

SEQ ID NO: 334594 - RNA, 21 nt, Homo sapiens
uuacaauggcuccuugaaggu

SEQ ID NO: 334595 - RNA, 22 nt, Homo sapiens
uuacacaguugguaggggcaga

SEQ ID NO: 334596 - RNA, 22 nt, Homo sapiens
uuacagcagugccccacuccca

SEQ ID NO: 334597 - RNA, 22 nt, Homo sapiens
uuacaguaugaguaagaguucu

SEQ ID NO: 334598 - RNA, 22 nt, Homo sapiens
uuacaucaucacauuaguuugc

SEQ ID NO: 334599 - RNA, 22 nt, Homo sapiens
uuacaugucuugguaagguuag

SEQ ID NO: 334600 - RNA, 22 nt, Homo sapiens
uuaccucuguggcucucggacu

SEQ ID NO: 334601 - RNA, 22 nt, Homo sapiens
uuaccuuuuuaagacagguuag

SEQ ID NO: 334602 - RNA, 20 nt, Homo sapiens
uuacuccuuaaugagguuuu

SEQ ID NO: 334603 - RNA, 22 nt, Homo sapiens
uuagaaaguagaaaagcugguu

SEQ ID NO: 334604 - RNA, 22 nt, Homo sapiens
uuagaacaguguuugccucgcu

SEQ ID NO: 334605 - RNA, 22 nt, Homo sapiens
uuagauaguacugaaugguucu

SEQ ID NO: 334606 - RNA, 22 nt, Homo sapiens
uuagcacugagaauggcuugcu

SEQ ID NO: 334607 - RNA, 22 nt, Homo sapiens
uuagcacuugggaguauuuauu

SEQ ID NO: 334608 - RNA, 22 nt, Homo sapiens
uuagcaugucuacuaauuugcu

SEQ ID NO: 334609 - RNA, 21 nt, Homo sapiens
uuagccuguaagcacuuugca

SEQ ID NO: 334610 - RNA, 22 nt, Homo sapiens
uuaggcaggauaguuacauauu

SEQ ID NO: 334611 - RNA, 22 nt, Homo sapiens
uuaggcucuuugaggugcccag

SEQ ID NO: 334612 - RNA, 22 nt, Homo sapiens
uuaggcuuuauugaaaacaaua

SEQ ID NO: 334613 - RNA, 22 nt, Homo sapiens
uuagggaggacaguuacaacag

SEQ ID NO: 334614 - RNA, 22 nt, Homo sapiens
uuagggaggcucaggacaagag

SEQ ID NO: 334615 - RNA, 22 nt, Homo sapiens
uuagguauuuuguuaugucagc

SEQ ID NO: 334616 - RNA, 22 nt, Homo sapiens
uuaguaguaguuugcauuuacc

SEQ ID NO: 334617 - RNA, 22 nt, Homo sapiens
uuaguaucauccuucugcauuc

SEQ ID NO: 334618 - RNA, 22 nt, Homo sapiens
uuagucaaguguacugugaaug

SEQ ID NO: 334619 - RNA, 22 nt, Homo sapiens
aucuggcguuuacuuccuuccu

SEQ ID NO: 334620 - RNA, 22 nt, Homo sapiens
aucugggguuggcaaaguuugg

SEQ ID NO: 334621 - RNA, 22 nt, Homo sapiens
aucuugcauuugcuaaaaugca

SEQ ID NO: 334622 - RNA, 22 nt, Homo sapiens
aucuuuggucaucacagcuaga

SEQ ID NO: 334623 - RNA, 22 nt, Homo sapiens
augaaagguauguuuucuguga

SEQ ID NO: 334624 - RNA, 22 nt, Homo sapiens
augaaagucaauccccaagugu

SEQ ID NO: 334625 - RNA, 22 nt, Homo sapiens
augaaauugcuaucgcaguacu

SEQ ID NO: 334626 - RNA, 22 nt, Homo sapiens
augaacacuccaauuguacucc

SEQ ID NO: 334627 - RNA, 18 nt, Homo sapiens
augaacucaucaguucuu

SEQ ID NO: 334628 - RNA, 22 nt, Homo sapiens
augaacucaucauuuuuauggc

SEQ ID NO: 334629 - RNA, 23 nt, Homo sapiens
augaacucaucauuuuuuauggc

SEQ ID NO: 334630 - RNA, 22 nt, Homo sapiens
augaagcuagcugauugcugau

SEQ ID NO: 334631 - RNA, 18 nt, Homo sapiens
augaagucaucacuuuua

SEQ ID NO: 334632 - RNA, 17 nt, Homo sapiens
augaagucaucauuuuu

SEQ ID NO: 334633 - RNA, 22 nt, Homo sapiens
augaaguuagcucauuucuuuu

SEQ ID NO: 334634 - RNA, 21 nt, Homo sapiens
augaauguaaagaauguggga

SEQ ID NO: 334635 - RNA, 23 nt, Homo sapiens
augaauguaaggaguguaagaaa

SEQ ID NO: 334636 - RNA, 20 nt, Homo sapiens
augaauguccuugauggcau

SEQ ID NO: 334637 - RNA, 22 nt, Homo sapiens
augacagagauaugugaauuuu

SEQ ID NO: 334638 - RNA, 22 nt, Homo sapiens
augacaguguggauuauuguaa

SEQ ID NO: 334639 - RNA, 22 nt, Homo sapiens
augaccaaugggcagagcuaga

SEQ ID NO: 334640 - RNA, 18 nt, Homo sapiens
augacucuggguguuccu

SEQ ID NO: 334641 - RNA, 22 nt, Homo sapiens
augacugagacuaacuuacuuu

SEQ ID NO: 334642 - RNA, 22 nt, Homo sapiens
augagaaucauuucagcuugua

SEQ ID NO: 334643 - RNA, 22 nt, Homo sapiens
augagcaaagagaugagacccu

SEQ ID NO: 334644 - RNA, 19 nt, Homo sapiens
augagcaauaguuuuaauc

SEQ ID NO: 334645 - RNA, 22 nt, Homo sapiens
augagcagaagagauacacugu

SEQ ID NO: 334646 - RNA, 22 nt, Homo sapiens
augagcuccucaaggucagaga

SEQ ID NO: 334647 - RNA, 22 nt, Homo sapiens
augagcugauuuccuuaccaua

SEQ ID NO: 334648 - RNA, 22 nt, Homo sapiens
augaggagauauuaaauaccau

SEQ ID NO: 334649 - RNA, 22 nt, Homo sapiens
augaggagguaugauuuucuga

SEQ ID NO: 334650 - RNA, 22 nt, Homo sapiens
augaggugauaucuggaaauua

SEQ ID NO: 334651 - RNA, 22 nt, Homo sapiens
augaggugcagaggaaaugagu

SEQ ID NO: 334652 - RNA, 22 nt, Homo sapiens
augaggugggcggcuuggaaga

SEQ ID NO: 334653 - RNA, 22 nt, Homo sapiens
augagguguuuauuguauccug

SEQ ID NO: 334654 - RNA, 22 nt, Homo sapiens
augaguauguucuguauuuuca

SEQ ID NO: 334655 - RNA, 22 nt, Homo sapiens
augauacuggcuucauagaaug

SEQ ID NO: 334656 - RNA, 22 nt, Homo sapiens
augauaucuuguuuuucaugca

SEQ ID NO: 334657 - RNA, 22 nt, Homo sapiens
augauaugagaaaggaucaaca

SEQ ID NO: 334658 - RNA, 22 nt, Homo sapiens
augaucacuguggaaauucagc

SEQ ID NO: 334659 - RNA, 22 nt, Homo sapiens
augaugcaguacuuugggaaca

SEQ ID NO: 334660 - RNA, 22 nt, Homo sapiens
augauguguguuuaagaugucu

SEQ ID NO: 334661 - RNA, 22 nt, Homo sapiens
augauugaccaucugcugggcu

SEQ ID NO: 334662 - RNA, 22 nt, Homo sapiens
augauugugaauaugugguuuu

SEQ ID NO: 334663 - RNA, 22 nt, Homo sapiens
augcaagcacacaagaggaaau

SEQ ID NO: 334664 - RNA, 22 nt, Homo sapiens
augcaauggaaaggacaauuac

SEQ ID NO: 334665 - RNA, 22 nt, Homo sapiens
augcacauggcuaacuuuuuuc

SEQ ID NO: 334666 - RNA, 22 nt, Homo sapiens
augcagacacaaguuauaguaa

SEQ ID NO: 334667 - RNA, 22 nt, Homo sapiens
augcauaugucuuuauaguggc

SEQ ID NO: 334668 - RNA, 22 nt, Homo sapiens
augcauauuuuaccuagaagag

SEQ ID NO: 334669 - RNA, 22 nt, Homo sapiens
augccaagagacaaagggaauc

SEQ ID NO: 334670 - RNA, 19 nt, Homo sapiens
augccacagugaggucaga

SEQ ID NO: 334671 - RNA, 22 nt, Homo sapiens
augccacuucucuaagucaugu

SEQ ID NO: 334672 - RNA, 22 nt, Homo sapiens
augccauugcacuccagccuag

SEQ ID NO: 334673 - RNA, 22 nt, Homo sapiens
augcccauuuguuuucugaaag

SEQ ID NO: 334674 - RNA, 19 nt, Homo sapiens
augccuggagaugguuaua

SEQ ID NO: 334675 - RNA, 22 nt, Homo sapiens
augcuacugaccccuacuuaca

SEQ ID NO: 334676 - RNA, 22 nt, Homo sapiens
auggaaacauaagaguauagau

SEQ ID NO: 334677 - RNA, 22 nt, Homo sapiens
auggaagaaacgauuuucugga

SEQ ID NO: 334678 - RNA, 22 nt, Homo sapiens
auggaagaaaguuggguucuug

SEQ ID NO: 334679 - RNA, 22 nt, Homo sapiens
auggaagaauugucggggaugu

SEQ ID NO: 334680 - RNA, 22 nt, Homo sapiens
auggaauguaaguuauguuugc

SEQ ID NO: 334681 - RNA, 21 nt, Homo sapiens
auggacaugguuaggcuuugu

SEQ ID NO: 334682 - RNA, 22 nt, Homo sapiens
auggagagaauuauucucucag

SEQ ID NO: 334683 - RNA, 22 nt, Homo sapiens
auggagcaaaacagauuuggga

SEQ ID NO: 334684 - RNA, 22 nt, Homo sapiens
auggaguguggaacugggaauc

SEQ ID NO: 334685 - RNA, 22 nt, Homo sapiens
auggauuuuaggauacaguuga

SEQ ID NO: 334686 - RNA, 22 nt, Homo sapiens
auggcaaugcgauggugacuga

SEQ ID NO: 334687 - RNA, 22 nt, Homo sapiens
auggcaauguaagucagaaaaa

SEQ ID NO: 334688 - RNA, 22 nt, Homo sapiens
auggcacucaaucaaguugaga

SEQ ID NO: 334689 - RNA, 22 nt, Homo sapiens
auggcacuccagccugggcaac

SEQ ID NO: 334690 - RNA, 22 nt, Homo sapiens
auggcacugccuggcuucaugg

SEQ ID NO: 334691 - RNA, 22 nt, Homo sapiens
auggcagcaccccacucuacug

SEQ ID NO: 334692 - RNA, 22 nt, Homo sapiens
auggcagcccucuuuauccaug

SEQ ID NO: 334693 - RNA, 22 nt, Homo sapiens
auggcagugagucucuaguauu

SEQ ID NO: 334694 - RNA, 22 nt, Homo sapiens
auggcaucgucaccuuuucagu

SEQ ID NO: 334695 - RNA, 22 nt, Homo sapiens
auggcuauuccauaggcagagc

SEQ ID NO: 334696 - RNA, 22 nt, Homo sapiens
auggcuugugacccaugcuuca

SEQ ID NO: 334697 - RNA, 22 nt, Homo sapiens
auggcuuuaagagugucugaau

SEQ ID NO: 334698 - RNA, 22 nt, Homo sapiens
auggcuuugggcugcucugccc

SEQ ID NO: 334699 - RNA, 22 nt, Homo sapiens
auggcuuuucacagaggguucu

SEQ ID NO: 334700 - RNA, 22 nt, Homo sapiens
augggcacugauguauucugug

SEQ ID NO: 334701 - RNA, 22 nt, Homo sapiens
augggucuccugaauacagcac

SEQ ID NO: 334702 - RNA, 22 nt, Homo sapiens
augguaagcugaaaauaucgaa

SEQ ID NO: 334703 - RNA, 22 nt, Homo sapiens
augguauuuugugauaccuugu

SEQ ID NO: 334704 - RNA, 22 nt, Homo sapiens
auggugugugaauuaaauguua

SEQ ID NO: 334705 - RNA, 22 nt, Homo sapiens
auguaaacagaugugcagcuug

SEQ ID NO: 334706 - RNA, 22 nt, Homo sapiens
uugagcaaugucacugaggcuu

SEQ ID NO: 334707 - RNA, 19 nt, Homo sapiens
uugagcacugccggaguua

SEQ ID NO: 334708 - RNA, 22 nt, Homo sapiens
uugagcccuggaggcagaggcu

SEQ ID NO: 334709 - RNA, 22 nt, Homo sapiens
uugaggcuuuugaccucaugug

SEQ ID NO: 334710 - RNA, 22 nt, Homo sapiens
uugagggcugaauaccaaucag

SEQ ID NO: 334711 - RNA, 22 nt, Homo sapiens
uugaggucagagguucgagacc

SEQ ID NO: 334712 - RNA, 22 nt, Homo sapiens
uugaguauuggacugguaucuu

SEQ ID NO: 334713 - RNA, 22 nt, Homo sapiens
uugauagacacauauccaugug

SEQ ID NO: 334714 - RNA, 22 nt, Homo sapiens
uugauauguuguuagauucagu

SEQ ID NO: 334715 - RNA, 22 nt, Homo sapiens
uugauauuacucaguaacagau

SEQ ID NO: 334716 - RNA, 22 nt, Homo sapiens
uugaucaauagaauacaacaga

SEQ ID NO: 334717 - RNA, 22 nt, Homo sapiens
uugaucugugucccugcccaau

SEQ ID NO: 334718 - RNA, 22 nt, Homo sapiens
uugauuuguagaaugccccaac

SEQ ID NO: 334719 - RNA, 22 nt, Homo sapiens
uugcaagauguuaacauuggag

SEQ ID NO: 334720 - RNA, 22 nt, Homo sapiens
uugcaaggugcucgaagggcuc

SEQ ID NO: 334721 - RNA, 22 nt, Homo sapiens
uugcacaauggaauuuaucuuu

SEQ ID NO: 334722 - RNA, 20 nt, Homo sapiens
uugcacagagaaggaggcag

SEQ ID NO: 334723 - RNA, 22 nt, Homo sapiens
uugcacagucuagcuccaccuu

SEQ ID NO: 334724 - RNA, 22 nt, Homo sapiens
uugcacuccauccuggguugac

SEQ ID NO: 334725 - RNA, 22 nt, Homo sapiens
uugcacuugcugaggagugauu

SEQ ID NO: 334726 - RNA, 20 nt, Homo sapiens
uugcagagcccaacccugga

SEQ ID NO: 334727 - RNA, 22 nt, Homo sapiens
uugcagagccccugcaaggguc

SEQ ID NO: 334728 - RNA, 22 nt, Homo sapiens
uugcagagucaguuauuuugcc

SEQ ID NO: 334729 - RNA, 22 nt, Homo sapiens
uugcagcaaagagggaggggca

SEQ ID NO: 334730 - RNA, 22 nt, Homo sapiens
uugcaguagucugaaagcaaua

SEQ ID NO: 334731 - RNA, 22 nt, Homo sapiens
uugcagugugacgacuauauuu

SEQ ID NO: 334732 - RNA, 22 nt, Homo sapiens
uugcauagacaauauuaaucuu

SEQ ID NO: 334733 - RNA, 22 nt, Homo sapiens
uuugaauggaaguuuugugaaa

SEQ ID NO: 334734 - RNA, 22 nt, Homo sapiens
uuugacaaugugugcuuguauu

SEQ ID NO: 334735 - RNA, 22 nt, Homo sapiens
uuugagcaggcuaaucaauaua

SEQ ID NO: 334736 - RNA, 22 nt, Homo sapiens
uuugauguccaccucagcccac

SEQ ID NO: 334737 - RNA, 22 nt, Homo sapiens
uuugcacauauuugggcaaaag

SEQ ID NO: 334738 - RNA, 20 nt, Homo sapiens
uuugcagaaucuaagaagag

SEQ ID NO: 334739 - RNA, 22 nt, Homo sapiens
uuugcaugcuccuuaugagaau

SEQ ID NO: 334740 - RNA, 22 nt, Homo sapiens
uuugccaauauuuuauugagga

SEQ ID NO: 334741 - RNA, 22 nt, Homo sapiens
uuugccacugcaggcuguuuaa

SEQ ID NO: 334742 - RNA, 22 nt, Homo sapiens
uuugccuuugugauauggucua

SEQ ID NO: 334743 - RNA, 22 nt, Homo sapiens
uuugcugagucauuccaugcug

SEQ ID NO: 334744 - RNA, 22 nt, Homo sapiens
uuugcugagucugacuucaugg

SEQ ID NO: 334745 - RNA, 22 nt, Homo sapiens
uuugcuucacuguuuggcaaaa

SEQ ID NO: 334746 - RNA, 22 nt, Homo sapiens
uuuggcaauuugacuguauagg

SEQ ID NO: 334747 - RNA, 22 nt, Homo sapiens
uuuggcaguuauuuacucagug

SEQ ID NO: 334748 - RNA, 23 nt, Homo sapiens
uuuggcauuccagaaauuuucau

SEQ ID NO: 334749 - RNA, 22 nt, Homo sapiens
uuuguacucccuuuagauaaaa

SEQ ID NO: 334750 - RNA, 22 nt, Homo sapiens
uuugucacucuuggagguuguu

SEQ ID NO: 334751 - RNA, 22 nt, Homo sapiens
uuuguccccgcccagaucucau

SEQ ID NO: 334752 - RNA, 22 nt, Homo sapiens
uuugucccucucaccaacgggg

SEQ ID NO: 334753 - RNA, 22 nt, Homo sapiens
uuugugcuccucucaguaugug

SEQ ID NO: 334754 - RNA, 22 nt, Homo sapiens
uuuguggaaugcucauguguag

SEQ ID NO: 334755 - RNA, 22 nt, Homo sapiens
uuuuacacuguugguuggaaug

SEQ ID NO: 334756 - RNA, 22 nt, Homo sapiens
uuuuacacuucgguugugugca

SEQ ID NO: 334757 - RNA, 22 nt, Homo sapiens
uuuuacagaggagguugcugau

SEQ ID NO: 334758 - RNA, 22 nt, Homo sapiens
uuuugcaccauccuaauaguau

SEQ ID NO: 334759 - RNA, 22 nt, Homo sapiens
uuuugcacuagaaccagagguu

SEQ ID NO: 334760 - RNA, 22 nt, Homo sapiens
uuuugcucuugguaaugaaaga

SEQ ID NO: 334761 - RNA, 22 nt, Homo sapiens
uuuugggggugauucacacagu

SEQ ID NO: 334762 - RNA, 22 nt, Homo sapiens
uuuugguaaugaacuuaggaag

SEQ ID NO: 334763 - RNA, 22 nt, Homo sapiens
uuuuguacgccuguguccauca

SEQ ID NO: 334764 - RNA, 22 nt, Homo sapiens
uuuuugagguauaguguggcua

SEQ ID NO: 334765 - RNA, 22 nt, Homo sapiens
uuuuugaguagcuggagagcag

SEQ ID NO: 334766 - RNA, 16 nt, Homo sapiens
uuuuugcagaaaugac

SEQ ID NO: 334767 - RNA, 22 nt, Homo sapiens
uuuuuugcuguaugcaaacauc

SEQ ID NO: 334768 - RNA, 22 nt, Homo sapiens
cagugguuuucaacccugguug

SEQ ID NO: 334769 - RNA, 22 nt, Homo sapiens
cagugguuuuuagcuugcuggg

SEQ ID NO: 334770 - RNA, 22 nt, Homo sapiens
cauaaaucuuguugaauagcac

SEQ ID NO: 334771 - RNA, 22 nt, Homo sapiens
cauaaugcuaagagcugccccu

SEQ ID NO: 334772 - RNA, 22 nt, Homo sapiens
cauacaagcuacaaucacaaag

SEQ ID NO: 334773 - RNA, 22 nt, Homo sapiens
cauaguacuugcauaguacuau

SEQ ID NO: 334774 - RNA, 22 nt, Homo sapiens
cauaugguuuuauguucuucau

SEQ ID NO: 334775 - RNA, 22 nt, Homo sapiens
cauauucacuuuacagagcugu

SEQ ID NO: 334776 - RNA, 22 nt, Homo sapiens
caucacacuuggauguaagaca

SEQ ID NO: 334777 - RNA, 23 nt, Homo sapiens
caucacauagaggaaagaggaca

SEQ ID NO: 334778 - RNA, 20 nt, Homo sapiens
caucaccuggcaggauuugu

SEQ ID NO: 334779 - RNA, 22 nt, Homo sapiens
caucucauugaauugcugagca

SEQ ID NO: 334780 - RNA, 22 nt, Homo sapiens
caugaaagacugaggaauugga

SEQ ID NO: 334781 - RNA, 22 nt, Homo sapiens
caugacacuggcauguuucuuu

SEQ ID NO: 334782 - RNA, 22 nt, Homo sapiens
caugcagcacacaugucugugc

SEQ ID NO: 334783 - RNA, 22 nt, Homo sapiens
caugcauagccauucauucguu

SEQ ID NO: 334784 - RNA, 22 nt, Homo sapiens
caugcauuggucuauuauguga

SEQ ID NO: 334785 - RNA, 22 nt, Homo sapiens
cauggcacuggugggagugucu

SEQ ID NO: 334786 - RNA, 22 nt, Homo sapiens
cauggcauuucaagauuuacca

SEQ ID NO: 334787 - RNA, 22 nt, Homo sapiens
cauggcccugggcugggcgaac

SEQ ID NO: 334788 - RNA, 22 nt, Homo sapiens
cauggccuuuggaaugugucua

SEQ ID NO: 334789 - RNA, 22 nt, Homo sapiens
cauggcuacugcagauguaggg

SEQ ID NO: 334790 - RNA, 22 nt, Homo sapiens
cauggcucuuguuuacucccag

SEQ ID NO: 334791 - RNA, 22 nt, Homo sapiens
cauggcuuguauaagauucuca

SEQ ID NO: 334792 - RNA, 22 nt, Homo sapiens
cauggcuuuuauaacaagaaau

SEQ ID NO: 334793 - RNA, 22 nt, Homo sapiens
caugguguuaggcacugggaau

SEQ ID NO: 334794 - RNA, 22 nt, Homo sapiens
cauuccacauguaggacaauuu

SEQ ID NO: 334795 - RNA, 20 nt, Homo sapiens
cauuccacuuuccugucagu

SEQ ID NO: 334796 - RNA, 22 nt, Homo sapiens
cauugcacuccagcccuggcaa

SEQ ID NO: 334797 - RNA, 22 nt, Homo sapiens
cauugcacuccagccuagccaa

SEQ ID NO: 334798 - RNA, 22 nt, Homo sapiens
cauugcacuccagccugaccaa

SEQ ID NO: 334799 - RNA, 22 nt, Homo sapiens
cauugcacuccagccugcugac

SEQ ID NO: 334800 - RNA, 22 nt, Homo sapiens
cauugcacuccagccuggcaac

SEQ ID NO: 334801 - RNA, 20 nt, Homo sapiens
cauugcacuccagcuugggc

SEQ ID NO: 334802 - RNA, 22 nt, Homo sapiens
cauugcacuccagcuugggcga

SEQ ID NO: 334803 - RNA, 22 nt, Homo sapiens
cauugcacucuagccucggcaa

SEQ ID NO: 334804 - RNA, 22 nt, Homo sapiens
cauugcaguaagagugggcucu

SEQ ID NO: 334805 - RNA, 22 nt, Homo sapiens
cauugcaugccagccugggcaa

SEQ ID NO: 334806 - RNA, 22 nt, Homo sapiens
cauugcuuuuggugguuuagac

SEQ ID NO: 334807 - RNA, 22 nt, Homo sapiens
cauugguuccaguuuguccuua

SEQ ID NO: 334808 - RNA, 22 nt, Homo sapiens
cauugguuggacaguucucucu

SEQ ID NO: 334809 - RNA, 22 nt, Homo sapiens
ccaaguguuuucauuguuccau

SEQ ID NO: 334810 - RNA, 22 nt, Homo sapiens
ccacaaccucaacagcaucuau

SEQ ID NO: 334811 - RNA, 22 nt, Homo sapiens
ccacaguggauuaaaguuacug

SEQ ID NO: 334812 - RNA, 22 nt, Homo sapiens
ccaccuguacuuaagucacuuu

SEQ ID NO: 334813 - RNA, 22 nt, Homo sapiens
ccacugcacuccagcccggcaa

SEQ ID NO: 334814 - RNA, 22 nt, Homo sapiens
ccagaguugccucagguuucug

SEQ ID NO: 334815 - RNA, 22 nt, Homo sapiens
ccagccgggugcaguggcucac

SEQ ID NO: 334816 - RNA, 22 nt, Homo sapiens
ccaggguuccacgccuggcugu

SEQ ID NO: 334817 - RNA, 22 nt, Homo sapiens
ccagugcugugcaguguaugag

SEQ ID NO: 334818 - RNA, 22 nt, Homo sapiens
ccaguguucuggaaggcugagu

SEQ ID NO: 334819 - RNA, 22 nt, Homo sapiens
ccaguuuucccagcaccauuaa

SEQ ID NO: 334820 - RNA, 22 nt, Homo sapiens
ccaguuuuucauuuauacuagu

SEQ ID NO: 334821 - RNA, 22 nt, Homo sapiens
ccauggcuauucuguaaggguu

SEQ ID NO: 334822 - RNA, 22 nt, Homo sapiens
ccauggcuucugcauucuguca

SEQ ID NO: 334823 - RNA, 22 nt, Homo sapiens
gugcuuguauuuaaaucaugug

SEQ ID NO: 334824 - RNA, 22 nt, Homo sapiens
gugcuuguguuaauauguagcu

SEQ ID NO: 334825 - RNA, 22 nt, Homo sapiens
guggaagaccagacuuuccaac

SEQ ID NO: 334826 - RNA, 20 nt, Homo sapiens
guggaaguagaaacauaugu

SEQ ID NO: 334827 - RNA, 22 nt, Homo sapiens
guggaagucuuugguauuggua

SEQ ID NO: 334828 - RNA, 22 nt, Homo sapiens
guggaagugucuggggccaggg

SEQ ID NO: 334829 - RNA, 22 nt, Homo sapiens
guggaaugauaucucauugugg

SEQ ID NO: 334830 - RNA, 22 nt, Homo sapiens
guggaguacugagggucacuua

SEQ ID NO: 334831 - RNA, 18 nt, Homo sapiens
guggagugucuuccugga

SEQ ID NO: 334832 - RNA, 22 nt, Homo sapiens
guggcaagaugacuacucacug

SEQ ID NO: 334833 - RNA, 22 nt, Homo sapiens
guggcacgaugaucugggcuca

SEQ ID NO: 334834 - RNA, 22 nt, Homo sapiens
guggcagugugaggauccugcu

SEQ ID NO: 334835 - RNA, 22 nt, Homo sapiens
guggcauuucccaaaguauucu

SEQ ID NO: 334836 - RNA, 22 nt, Homo sapiens
guggcuauuguucccugguugc

SEQ ID NO: 334837 - RNA, 22 nt, Homo sapiens
guggguaaaucucuggggcucu

SEQ ID NO: 334838 - RNA, 22 nt, Homo sapiens
gugguaaaauggcauagagcua

SEQ ID NO: 334839 - RNA, 22 nt, Homo sapiens
guggucagaaaucucaguggca

SEQ ID NO: 334840 - RNA, 22 nt, Homo sapiens
gugguucuagaauugaguaucc

SEQ ID NO: 334841 - RNA, 22 nt, Homo sapiens
gugguuuuaauauucagucuag

SEQ ID NO: 334842 - RNA, 22 nt, Homo sapiens
gugguuuuacaaagagaaagau

SEQ ID NO: 334843 - RNA, 22 nt, Homo sapiens
gugguuuuaucccagaaauuaa

SEQ ID NO: 334844 - RNA, 22 nt, Homo sapiens
gugguuuuuuucugccuuauag

SEQ ID NO: 334845 - RNA, 22 nt, Homo sapiens
guguagagaaaaguaccauuuu

SEQ ID NO: 334846 - RNA, 22 nt, Homo sapiens
guguauguuguccauggaugcg

SEQ ID NO: 334847 - RNA, 22 nt, Homo sapiens
gugucacagcuuccaucucggu

SEQ ID NO: 334848 - RNA, 22 nt, Homo sapiens
guguccuaugaaacaggaucca

SEQ ID NO: 334849 - RNA, 22 nt, Homo sapiens
gugucuccuguggagcuaugua

SEQ ID NO: 334850 - RNA, 22 nt, Homo sapiens
gugugacagcuauagacaugau

SEQ ID NO: 334851 - RNA, 22 nt, Homo sapiens
gugugcauggagggggcaguga

SEQ ID NO: 334852 - RNA, 21 nt, Homo sapiens
gugugcuugagugaugggauu

SEQ ID NO: 334853 - RNA, 22 nt, Homo sapiens
guguuauugagaaauagggugu

SEQ ID NO: 334854 - RNA, 22 nt, Homo sapiens
guuaagaaguguaacuuaaguu

SEQ ID NO: 334855 - RNA, 22 nt, Homo sapiens
guuacagucuuguguaagguua

SEQ ID NO: 334856 - RNA, 22 nt, Homo sapiens
guuaggcagugugguauagcag

SEQ ID NO: 334857 - RNA, 22 nt, Homo sapiens
guuauguuaaauuguuguaugc

SEQ ID NO: 334858 - RNA, 22 nt, Homo sapiens
guuauugcucucgaagacucuc

SEQ ID NO: 334859 - RNA, 22 nt, Homo sapiens
guucaagugauucuacugccuc

SEQ ID NO: 334860 - RNA, 22 nt, Homo sapiens
guucaaguuuucucuugugggu

SEQ ID NO: 334861 - RNA, 22 nt, Homo sapiens
guucacacuugcaaccccagca

SEQ ID NO: 334862 - RNA, 22 nt, Homo sapiens
guucacaguuaggacaacugcu

SEQ ID NO: 334863 - RNA, 22 nt, Homo sapiens
guucacaguuucuaaucccagc

SEQ ID NO: 334864 - RNA, 22 nt, Homo sapiens
guucaucagggauacuggcuua

SEQ ID NO: 334865 - RNA, 22 nt, Homo sapiens
guucaucagggauauuggccug

SEQ ID NO: 334866 - RNA, 22 nt, Homo sapiens
guugcaugucugggaggccagc

SEQ ID NO: 334867 - RNA, 22 nt, Homo sapiens
guugcucaggcugaagugcagu

SEQ ID NO: 334868 - RNA, 22 nt, Homo sapiens
guuggcuguuucccccaaguga

SEQ ID NO: 334869 - RNA, 22 nt, Homo sapiens
guuggguaauggggcgcaccgu

SEQ ID NO: 334870 - RNA, 22 nt, Homo sapiens
guuuaacugguacuucaagucu

SEQ ID NO: 334871 - RNA, 22 nt, Homo sapiens
guuuacagucgacuugggaaua

SEQ ID NO: 334872 - RNA, 22 nt, Homo sapiens
guuugcacuccuaugagaaucu

SEQ ID NO: 334873 - RNA, 22 nt, Homo sapiens
guuugugguuaaagccuuucau

SEQ ID NO: 334874 - RNA, 22 nt, Homo sapiens
uaaaagucaucacaacuggagu

SEQ ID NO: 334875 - RNA, 22 nt, Homo sapiens
uaaaccacguuuacauuugaga

SEQ ID NO: 334876 - RNA, 22 nt, Homo sapiens
uaaacugucuuuggagcuuugc

SEQ ID NO: 334877 - RNA, 22 nt, Homo sapiens
uaaagccagugauuaugucucu

SEQ ID NO: 334878 - RNA, 22 nt, Homo sapiens
uaaagcuagaauuguuccagca

SEQ ID NO: 334879 - RNA, 21 nt, Homo sapiens
uaaaggcuccaauuauacccc

SEQ ID NO: 334880 - RNA, 22 nt, Homo sapiens
uaaaguucuuuuaugggccggg

SEQ ID NO: 334881 - RNA, 22 nt, Homo sapiens
uaaaugacugucaguagaugaa

SEQ ID NO: 334882 - RNA, 22 nt, Homo sapiens
uaaauggauaaaugaauaccua

SEQ ID NO: 334883 - RNA, 22 nt, Homo sapiens
uaacaccuugcucugucaauaa

SEQ ID NO: 334884 - RNA, 22 nt, Homo sapiens
uaacagcauuugugucuaguag

SEQ ID NO: 334885 - RNA, 22 nt, Homo sapiens
uaacaguguauuuacuacuucc

SEQ ID NO: 334886 - RNA, 21 nt, Homo sapiens
uaacccugaaggagcucugga

SEQ ID NO: 334887 - RNA, 22 nt, Homo sapiens
uaacuguggaaaugacuuuaaa

SEQ ID NO: 334888 - RNA, 20 nt, Homo sapiens
uaagcauaguugucaggguc

SEQ ID NO: 334889 - RNA, 22 nt, Homo sapiens
uaaggauuuuggugauuacacu

SEQ ID NO: 334890 - RNA, 22 nt, Homo sapiens
uaaggcuagcaagaugagaaua

SEQ ID NO: 334891 - RNA, 22 nt, Homo sapiens
uaagggcaugcugcaugagagu

SEQ ID NO: 334892 - RNA, 22 nt, Homo sapiens
uaaguaguuucuggauauucuc

SEQ ID NO: 334893 - RNA, 22 nt, Homo sapiens
uaagucuuuuuggaguuuauaa

SEQ ID NO: 334894 - RNA, 22 nt, Homo sapiens
uaagugguguucauucuuuuga

SEQ ID NO: 334895 - RNA, 22 nt, Homo sapiens
uaaguugcagguugugauucca

SEQ ID NO: 334896 - RNA, 22 nt, Homo sapiens
uaauagagucauuauuauuguu

SEQ ID NO: 334897 - RNA, 22 nt, Homo sapiens
uaauagcaguguuacuaggacu

SEQ ID NO: 334898 - RNA, 22 nt, Homo sapiens
uaauauguuuugaaaucaggaa

SEQ ID NO: 334899 - RNA, 22 nt, Homo sapiens
uaaucucagcuacucaggaggc

SEQ ID NO: 334900 - RNA, 22 nt, Homo sapiens
uaaugcacuuuccuccaaggcu

SEQ ID NO: 334901 - RNA, 22 nt, Homo sapiens
uaaugcuugguuguuuggaaaa

SEQ ID NO: 334902 - RNA, 22 nt, Homo sapiens
uaauucuguauguaucagaguu

SEQ ID NO: 334903 - RNA, 22 nt, Homo sapiens
uacaaagcuuucugcaaaucau

SEQ ID NO: 334904 - RNA, 22 nt, Homo sapiens
uacaaagcuuugaugugucuuu

SEQ ID NO: 334905 - RNA, 22 nt, Homo sapiens
uacaagcacaggcagcaggcug

SEQ ID NO: 334906 - RNA, 22 nt, Homo sapiens
uacaaguaauaagggaagaauu

SEQ ID NO: 334907 - RNA, 22 nt, Homo sapiens
uacacagucaaaaauuuccagg

SEQ ID NO: 334908 - RNA, 22 nt, Homo sapiens
uacagaauucugucccuugagu

SEQ ID NO: 334909 - RNA, 19 nt, Homo sapiens
uacaggacugagcugaggu

SEQ ID NO: 334910 - RNA, 22 nt, Homo sapiens
gggaaugaagagaaccuuccca

SEQ ID NO: 334911 - RNA, 22 nt, Homo sapiens
gggaauggaagacauuaugaug

SEQ ID NO: 334912 - RNA, 22 nt, Homo sapiens
gggagcaaaaaugaugcccaag

SEQ ID NO: 334913 - RNA, 22 nt, Homo sapiens
gggagugucuaaccuguuaaca

SEQ ID NO: 334914 - RNA, 22 nt, Homo sapiens
gggcaaaacuguacugccaagg

SEQ ID NO: 334915 - RNA, 21 nt, Homo sapiens
gggcaaaucuuuauccuaagc

SEQ ID NO: 334916 - RNA, 22 nt, Homo sapiens
gggcauaucacuugaggucagg

SEQ ID NO: 334917 - RNA, 22 nt, Homo sapiens
ggggcauugugacauaucucug

SEQ ID NO: 334918 - RNA, 22 nt, Homo sapiens
gggggagugugguacccagcau

SEQ ID NO: 334919 - RNA, 22 nt, Homo sapiens
ggguaaaucucuuuucauggcu

SEQ ID NO: 334920 - RNA, 22 nt, Homo sapiens
gguacagcuaguuaaacauuug

SEQ ID NO: 334921 - RNA, 22 nt, Homo sapiens
gguauguuuagaccauuuacau

SEQ ID NO: 334922 - RNA, 22 nt, Homo sapiens
ggucccccuccacucucgcaaa

SEQ ID NO: 334923 - RNA, 19 nt, Homo sapiens
ggucccucucaagucauuc

SEQ ID NO: 334924 - RNA, 22 nt, Homo sapiens
ggucugguguugaaauucuuca

SEQ ID NO: 334925 - RNA, 22 nt, Homo sapiens
ggugacagugguuaaaauuugu

SEQ ID NO: 334926 - RNA, 22 nt, Homo sapiens
ggugaggaaaguugaguuucua

SEQ ID NO: 334927 - RNA, 22 nt, Homo sapiens
gguggcaaaucugaguggcgcu

SEQ ID NO: 334928 - RNA, 22 nt, Homo sapiens
gguggcuuuuugugauggcuga

SEQ ID NO: 334929 - RNA, 22 nt, Homo sapiens
guaaauaccaguuucuggaaca

SEQ ID NO: 334930 - RNA, 22 nt, Homo sapiens
guaacacucuaaagggaugcac

SEQ ID NO: 334931 - RNA, 22 nt, Homo sapiens
guaacagucucaacaguggucu

SEQ ID NO: 334932 - RNA, 22 nt, Homo sapiens
guaagugauagaauuaggauuc

SEQ ID NO: 334933 - RNA, 22 nt, Homo sapiens
guaagugguagagcugggcuau

SEQ ID NO: 334934 - RNA, 23 nt, Homo sapiens
guaauacuagucauaguagcagg

SEQ ID NO: 334935 - RNA, 19 nt, Homo sapiens
guaaucucaguacuuuggu

SEQ ID NO: 334936 - RNA, 22 nt, Homo sapiens
guacacauacauauaugugugu

SEQ ID NO: 334937 - RNA, 22 nt, Homo sapiens
guacaugcauacaugcacaucu

SEQ ID NO: 334938 - RNA, 22 nt, Homo sapiens
guacaugugcacagugugcagg

SEQ ID NO: 334939 - RNA, 22 nt, Homo sapiens
guagaucucaacacuggaagua

SEQ ID NO: 334940 - RNA, 22 nt, Homo sapiens
guauacaugucaaaacucacau

SEQ ID NO: 334941 - RNA, 22 nt, Homo sapiens
guauaugccucaguuauagcac

SEQ ID NO: 334942 - RNA, 22 nt, Homo sapiens
guaucauuggcauguaaccaga

SEQ ID NO: 334943 - RNA, 22 nt, Homo sapiens
guaugacacaggaagcuuaacc

SEQ ID NO: 334944 - RNA, 22 nt, Homo sapiens
guaugcacauauguguauguau

SEQ ID NO: 334945 - RNA, 22 nt, Homo sapiens
guauggcauuuguggauuggcc

SEQ ID NO: 334946 - RNA, 22 nt, Homo sapiens
guauugccugugugccagccac

SEQ ID NO: 334947 - RNA, 22 nt, Homo sapiens
guauuugauuauagcaugcuua

SEQ ID NO: 334948 - RNA, 22 nt, Homo sapiens
guauuuguugcagcagcacuau

SEQ ID NO: 334949 - RNA, 22 nt, Homo sapiens
gucaagugaagcagugggagua

SEQ ID NO: 334950 - RNA, 22 nt, Homo sapiens
gucaaguguuuucaaggcuucc

SEQ ID NO: 334951 - RNA, 22 nt, Homo sapiens
gucacaguguuuguucauccca

SEQ ID NO: 334952 - RNA, 22 nt, Homo sapiens
gucacugagcagaaggaagcga

SEQ ID NO: 334953 - RNA, 22 nt, Homo sapiens
gucacugccugaggcugaugca

SEQ ID NO: 334954 - RNA, 22 nt, Homo sapiens
gucacuguggagaagaaagugg

SEQ ID NO: 334955 - RNA, 22 nt, Homo sapiens
gucagagcacugaguugugggc

SEQ ID NO: 334956 - RNA, 22 nt, Homo sapiens
gucagcaucaccaugucuauga

SEQ ID NO: 334957 - RNA, 22 nt, Homo sapiens
gucagggagggauagaugauua

SEQ ID NO: 334958 - RNA, 22 nt, Homo sapiens
gucaguucuugugguugcauuc

SEQ ID NO: 334959 - RNA, 22 nt, Homo sapiens
gucaucaucaguccucugugca

SEQ ID NO: 334960 - RNA, 22 nt, Homo sapiens
gucauugcacuccagccuggac

SEQ ID NO: 334961 - RNA, 22 nt, Homo sapiens
guccagagaagucauuacuuca

SEQ ID NO: 334962 - RNA, 22 nt, Homo sapiens
gucccugcgauugugggauccu

SEQ ID NO: 334963 - RNA, 22 nt, Homo sapiens
gucucacaggcaugaugccagc

SEQ ID NO: 334964 - RNA, 22 nt, Homo sapiens
gucucuugguuuagagcauuua

SEQ ID NO: 334965 - RNA, 22 nt, Homo sapiens
gucucuuguuaucauuucugag

SEQ ID NO: 334966 - RNA, 22 nt, Homo sapiens
gucugguuuuuuauauccucac

SEQ ID NO: 334967 - RNA, 20 nt, Homo sapiens
gucugucuccgaguagaauu

SEQ ID NO: 334968 - RNA, 22 nt, Homo sapiens
gucugucuuuugucuuugaaau

SEQ ID NO: 334969 - RNA, 20 nt, Homo sapiens
gucuugcuccguugcccagg

SEQ ID NO: 334970 - RNA, 22 nt, Homo sapiens
gugaaguuuuugugaggccuaa

SEQ ID NO: 334971 - RNA, 20 nt, Homo sapiens
gugaauacauuugguuucau

SEQ ID NO: 334972 - RNA, 22 nt, Homo sapiens
gugaccaaagauagcucaaguu

SEQ ID NO: 334973 - RNA, 22 nt, Homo sapiens
gugagaauauuuuaaauacuaa

SEQ ID NO: 334974 - RNA, 22 nt, Homo sapiens
gugagagaaugacuauguguuu

SEQ ID NO: 334975 - RNA, 22 nt, Homo sapiens
gugagaggaggcagcuuuuaca

SEQ ID NO: 334976 - RNA, 22 nt, Homo sapiens
gugagcauauuaguauugcacu

SEQ ID NO: 334977 - RNA, 22 nt, Homo sapiens
gugagcuccucuucugcugcag

SEQ ID NO: 334978 - RNA, 22 nt, Homo sapiens
gugaggaaggaaaccugcuagc

SEQ ID NO: 334979 - RNA, 21 nt, Homo sapiens
gugaggaguuacuggcuuuga

SEQ ID NO: 334980 - RNA, 22 nt, Homo sapiens
gugagguauacugggaucacua

SEQ ID NO: 334981 - RNA, 22 nt, Homo sapiens
gugaguuauuauuuauguaaac

SEQ ID NO: 334982 - RNA, 22 nt, Homo sapiens
gugauagaucugggauucagaa

SEQ ID NO: 334983 - RNA, 22 nt, Homo sapiens
gugauugcauuaugaauauuau

SEQ ID NO: 334984 - RNA, 22 nt, Homo sapiens
gugcaaguguaauacagcuagg

SEQ ID NO: 334985 - RNA, 22 nt, Homo sapiens
gugcaaugucaggagaugcagc

SEQ ID NO: 334986 - RNA, 22 nt, Homo sapiens
gugcacaacaugcaguuuuguu

SEQ ID NO: 334987 - RNA, 22 nt, Homo sapiens
gugcacaacgugcaaguuuguu

SEQ ID NO: 334988 - RNA, 22 nt, Homo sapiens
gugcacaacgugcaggcuuguu

SEQ ID NO: 334989 - RNA, 22 nt, Homo sapiens
gugcacaaugugcagguuuguu

SEQ ID NO: 334990 - RNA, 21 nt, Homo sapiens
gugcagacacacauauaggcu

SEQ ID NO: 334991 - RNA, 21 nt, Homo sapiens
gugcagaugccacagucacuc

SEQ ID NO: 334992 - RNA, 22 nt, Homo sapiens
gugcauacgucuuuauaguagc

SEQ ID NO: 334993 - RNA, 22 nt, Homo sapiens
gugccacugcacuccggccugg

SEQ ID NO: 334994 - RNA, 22 nt, Homo sapiens
gugccuuuucugagcaaugagc

SEQ ID NO: 334995 - RNA, 22 nt, Homo sapiens
gugcuauguuauccagcaagau

SEQ ID NO: 334996 - RNA, 21 nt, Homo sapiens
gugcuuguagccucacuucug

SEQ ID NO: 334997 - RNA, 22 nt, Homo sapiens
gcaagauuguguggcugaagua

SEQ ID NO: 334998 - RNA, 20 nt, Homo sapiens
gcaagcaugaagaguagaga

SEQ ID NO: 334999 - RNA, 22 nt, Homo sapiens
gcaauggaaucccuugaucaau

SEQ ID NO: 335000 - RNA, 22 nt, Homo sapiens
gcacugagagaagccccaagua

SEQ ID NO: 335001 - RNA, 22 nt, Homo sapiens
gcagaauugguuucuucuaagg

SEQ ID NO: 335002 - RNA, 22 nt, Homo sapiens
gcagaucuucgcgguaaguguu

SEQ ID NO: 335003 - RNA, 22 nt, Homo sapiens
gcagcacauggcagaacauauu

SEQ ID NO: 335004 - RNA, 22 nt, Homo sapiens
gcagugaugugaucauagcuca

SEQ ID NO: 335005 - RNA, 22 nt, Homo sapiens
gcaguggugugugccagccuag

SEQ ID NO: 335006 - RNA, 22 nt, Homo sapiens
gcaguguucugggcaggaagaa

SEQ ID NO: 335007 - RNA, 17 nt, Homo sapiens
gcauaugucgaaccagc

SEQ ID NO: 335008 - RNA, 22 nt, Homo sapiens
gcauaugucuuuauagcagcau

SEQ ID NO: 335009 - RNA, 17 nt, Homo sapiens
gcauauguugaaccagu

SEQ ID NO: 335010 - RNA, 20 nt, Homo sapiens
gcaugagucuuuauaguaga

SEQ ID NO: 335011 - RNA, 22 nt, Homo sapiens
gcauggagaaggggacugauuc

SEQ ID NO: 335012 - RNA, 22 nt, Homo sapiens
gcauggaguggaaauucuuggg

SEQ ID NO: 335013 - RNA, 22 nt, Homo sapiens
gcauugcacuuggcauagacug

SEQ ID NO: 335014 - RNA, 22 nt, Homo sapiens
gccaagauuuaauucaucaguu

SEQ ID NO: 335015 - RNA, 22 nt, Homo sapiens
gccaguguuuuauugagaauuu

SEQ ID NO: 335016 - RNA, 22 nt, Homo sapiens
gccauagucauagauggcaggg

SEQ ID NO: 335017 - RNA, 22 nt, Homo sapiens
gccauggaggauuuauagaggc

SEQ ID NO: 335018 - RNA, 22 nt, Homo sapiens
gccauugcacuccagccucggg

SEQ ID NO: 335019 - RNA, 22 nt, Homo sapiens
gccauugcacuccagccugagc

SEQ ID NO: 335020 - RNA, 22 nt, Homo sapiens
gccauugcacuccagcuugggc

SEQ ID NO: 335021 - RNA, 22 nt, Homo sapiens
gccauugcacuccgcccugggc

SEQ ID NO: 335022 - RNA, 22 nt, Homo sapiens
gccauugcacucuagccugagc

SEQ ID NO: 335023 - RNA, 22 nt, Homo sapiens
gcccacuguuaaauuuguuuua

SEQ ID NO: 335024 - RNA, 22 nt, Homo sapiens
gcccagauguuuggggucaugg

SEQ ID NO: 335025 - RNA, 22 nt, Homo sapiens
gccccgggugaugcagccguca

SEQ ID NO: 335026 - RNA, 22 nt, Homo sapiens
gcccuguguuuggguaugguca

SEQ ID NO: 335027 - RNA, 22 nt, Homo sapiens
gccuuuggugacaggcaugugu

SEQ ID NO: 335028 - RNA, 22 nt, Homo sapiens
gcuaaggcagggcaaucauuug

SEQ ID NO: 335029 - RNA, 22 nt, Homo sapiens
gcuacugucuaucugugcuucu

SEQ ID NO: 335030 - RNA, 23 nt, Homo sapiens
gcuaggagagaugaaacacaggu

SEQ ID NO: 335031 - RNA, 22 nt, Homo sapiens
gcugacacugggcuauagaucu

SEQ ID NO: 335032 - RNA, 22 nt, Homo sapiens
gcuggcaagaugcugaugcaac

SEQ ID NO: 335033 - RNA, 22 nt, Homo sapiens
gcuggguugccagguuacuuaa

SEQ ID NO: 335034 - RNA, 22 nt, Homo sapiens
gcuggugaaggcugaaaagugg

SEQ ID NO: 335035 - RNA, 22 nt, Homo sapiens
gcuguauugacuuuguaucaua

SEQ ID NO: 335036 - RNA, 22 nt, Homo sapiens
gcuguauuguugaaggaaaugu

SEQ ID NO: 335037 - RNA, 22 nt, Homo sapiens
gcugugauucuguguagauagu

SEQ ID NO: 335038 - RNA, 22 nt, Homo sapiens
gcuguugguaaaaaggacauga

SEQ ID NO: 335039 - RNA, 22 nt, Homo sapiens
gcuguuugccgccaucgcagac

SEQ ID NO: 335040 - RNA, 19 nt, Homo sapiens
gcuuagagacaaaacauug

SEQ ID NO: 335041 - RNA, 19 nt, Homo sapiens
gcuucuugaggacgaugac

SEQ ID NO: 335042 - RNA, 22 nt, Homo sapiens
gcuuguguuuacuguaguuacu

SEQ ID NO: 335043 - RNA, 22 nt, Homo sapiens
gcuuugcaauggcauugaccau

SEQ ID NO: 335044 - RNA, 22 nt, Homo sapiens
gcuuuuggaggaacuuaagauu

SEQ ID NO: 335045 - RNA, 21 nt, Homo sapiens
gcuuuuucggaagucuuuggc

SEQ ID NO: 335046 - RNA, 18 nt, Homo sapiens
ggaaaacuuuucuaagua

SEQ ID NO: 335047 - RNA, 22 nt, Homo sapiens
ggaaagauguaauauuaucuaa

SEQ ID NO: 335048 - RNA, 22 nt, Homo sapiens
ggaaaguccuucuguaggcucc

SEQ ID NO: 335049 - RNA, 21 nt, Homo sapiens
ggaaaguuaaggaaauacccc

SEQ ID NO: 335050 - RNA, 19 nt, Homo sapiens
ggaaaugucuauuaagauc

SEQ ID NO: 335051 - RNA, 23 nt, Homo sapiens
ggaaauguuuaagggguugggag

SEQ ID NO: 335052 - RNA, 22 nt, Homo sapiens
ggaagaauaaugggccuuagag

SEQ ID NO: 335053 - RNA, 22 nt, Homo sapiens
ggaagaauauuaggggauuucg

SEQ ID NO: 335054 - RNA, 22 nt, Homo sapiens
ggaagagugaauuaucuugacu

SEQ ID NO: 335055 - RNA, 22 nt, Homo sapiens
ggaagguaauuggcuaaugaga

SEQ ID NO: 335056 - RNA, 22 nt, Homo sapiens
ggaaugcagugagcauuagaua

SEQ ID NO: 335057 - RNA, 22 nt, Homo sapiens
ggaaugggauuugaagucuggc

SEQ ID NO: 335058 - RNA, 21 nt, Homo sapiens
ggaauguugccagcagccaga

SEQ ID NO: 335059 - RNA, 22 nt, Homo sapiens
ggaauuaaggcaauugaaagcu

SEQ ID NO: 335060 - RNA, 22 nt, Homo sapiens
ggacaguagugcuuucuaucau

SEQ ID NO: 335061 - RNA, 22 nt, Homo sapiens
ggacauuaacugcaagauagau

SEQ ID NO: 335062 - RNA, 22 nt, Homo sapiens
ggagaucauuuccuauuugaag

SEQ ID NO: 335063 - RNA, 22 nt, Homo sapiens
ggagaucuuguuaaaguacaga

SEQ ID NO: 335064 - RNA, 22 nt, Homo sapiens
ggagaugugccugcucugcucu

SEQ ID NO: 335065 - RNA, 22 nt, Homo sapiens
ggagcugugauuugaguccaga

SEQ ID NO: 335066 - RNA, 22 nt, Homo sapiens
ggagggugagaucaauuuggga

SEQ ID NO: 335067 - RNA, 22 nt, Homo sapiens
ggagucugacuuauaggaaccu

SEQ ID NO: 335068 - RNA, 22 nt, Homo sapiens
ggagucugauguucuaaggcag

SEQ ID NO: 335069 - RNA, 22 nt, Homo sapiens
ggagugucagaaacaguguccu

SEQ ID NO: 335070 - RNA, 22 nt, Homo sapiens
ggaguguguaggagaaagguaa

SEQ ID NO: 335071 - RNA, 22 nt, Homo sapiens
ggcaacaauuccuacuucuuuu

SEQ ID NO: 335072 - RNA, 22 nt, Homo sapiens
ggcaaggugcuacagacaguga

SEQ ID NO: 335073 - RNA, 21 nt, Homo sapiens
ggcaagugugagguuuggggu

SEQ ID NO: 335074 - RNA, 22 nt, Homo sapiens
ggcagaauugcugaggaugcua

SEQ ID NO: 335075 - RNA, 22 nt, Homo sapiens
ggcagaguggacauuuaaaugu

SEQ ID NO: 335076 - RNA, 22 nt, Homo sapiens
ggcagguaaggagugggagccu

SEQ ID NO: 335077 - RNA, 22 nt, Homo sapiens
ggcaguuucucaggcaggggua

SEQ ID NO: 335078 - RNA, 22 nt, Homo sapiens
ggccggguggccauggcugccc

SEQ ID NO: 335079 - RNA, 22 nt, Homo sapiens
ggcgguguccuccaagugcuuc

SEQ ID NO: 335080 - RNA, 22 nt, Homo sapiens
ggcucagugggguccugguucu

SEQ ID NO: 335081 - RNA, 22 nt, Homo sapiens
ggcucaguugcaaaucaguuca

SEQ ID NO: 335082 - RNA, 18 nt, Homo sapiens
ggcugguguuuuaguaua

SEQ ID NO: 335083 - RNA, 22 nt, Homo sapiens
gggaagugugguuucuuuacag

SEQ ID NO: 335084 - RNA, 22 nt, Homo sapiens
agaacuguccauucagcaugaa

SEQ ID NO: 335085 - RNA, 22 nt, Homo sapiens
agaauacugucuauucauggua

SEQ ID NO: 335086 - RNA, 22 nt, Homo sapiens
agaaugucaguauuggcuaaaa

SEQ ID NO: 335087 - RNA, 22 nt, Homo sapiens
agaaugugaccuuauuuggaga

SEQ ID NO: 335088 - RNA, 22 nt, Homo sapiens
agacagcuggaguaucauagcu

SEQ ID NO: 335089 - RNA, 22 nt, Homo sapiens
agacaucauuugauggugggag

SEQ ID NO: 335090 - RNA, 22 nt, Homo sapiens
agaccacuuuagagauuguuca

SEQ ID NO: 335091 - RNA, 22 nt, Homo sapiens
agagaacuggcuucaccauucu

SEQ ID NO: 335092 - RNA, 22 nt, Homo sapiens
agagaccuguaaaguucaggca

SEQ ID NO: 335093 - RNA, 22 nt, Homo sapiens
agagagguggguggagccccca

SEQ ID NO: 335094 - RNA, 22 nt, Homo sapiens
agagauaauuagguuaaaugag

SEQ ID NO: 335095 - RNA, 22 nt, Homo sapiens
agagaucaauaugaaggaaaug

SEQ ID NO: 335096 - RNA, 22 nt, Homo sapiens
agagaucacugaaucacggggg

SEQ ID NO: 335097 - RNA, 22 nt, Homo sapiens
agagauccucauuuuauagaca

SEQ ID NO: 335098 - RNA, 22 nt, Homo sapiens
agagauuauccuggcuucucug

SEQ ID NO: 335099 - RNA, 22 nt, Homo sapiens
agagcaccauuuagcaagguga

SEQ ID NO: 335100 - RNA, 22 nt, Homo sapiens
agaguacaggcaaguuagucau

SEQ ID NO: 335101 - RNA, 22 nt, Homo sapiens
agaguacugacguuugcaaauu

SEQ ID NO: 335102 - RNA, 22 nt, Homo sapiens
agaguauagcaacuuaguaaaa

SEQ ID NO: 335103 - RNA, 19 nt, Homo sapiens
agaguauuguuacuucucu

SEQ ID NO: 335104 - RNA, 20 nt, Homo sapiens
agagugcuggacugaggagc

SEQ ID NO: 335105 - RNA, 20 nt, Homo sapiens
agagugcugucuguccugag

SEQ ID NO: 335106 - RNA, 22 nt, Homo sapiens
agaugcauuuuuauuggaauac

SEQ ID NO: 335107 - RNA, 22 nt, Homo sapiens
agaugcuguuaucaacuguagc

SEQ ID NO: 335108 - RNA, 22 nt, Homo sapiens
agauggauuuuguagccccagc

SEQ ID NO: 335109 - RNA, 22 nt, Homo sapiens
agaugguguuuucucaccagau

SEQ ID NO: 335110 - RNA, 22 nt, Homo sapiens
uaugaaucuggcuacuccaggg

SEQ ID NO: 335111 - RNA, 22 nt, Homo sapiens
uaugagcacauauguaucuaug

SEQ ID NO: 335112 - RNA, 22 nt, Homo sapiens
uaugcacacucucccaggaggg

SEQ ID NO: 335113 - RNA, 22 nt, Homo sapiens
uaugcagacauuguuccaacca

SEQ ID NO: 335114 - RNA, 23 nt, Homo sapiens
uaugccuguuucaaacaaacuuu

SEQ ID NO: 335115 - RNA, 22 nt, Homo sapiens
uauggauuugcauuccccaugu

SEQ ID NO: 335116 - RNA, 22 nt, Homo sapiens
uauggcaaugcauaggaaggaa

SEQ ID NO: 335117 - RNA, 21 nt, Homo sapiens
uauggcuuagucaguguuucc

SEQ ID NO: 335118 - RNA, 22 nt, Homo sapiens
uauggcuucuuauucuuucccg

SEQ ID NO: 335119 - RNA, 22 nt, Homo sapiens
uauggcuuuuaacugucguaug

SEQ ID NO: 335120 - RNA, 22 nt, Homo sapiens
uauggcuuuucacuuaaguccu

SEQ ID NO: 335121 - RNA, 22 nt, Homo sapiens
uaugucaugggguuuuugagau

SEQ ID NO: 335122 - RNA, 22 nt, Homo sapiens
uaugucuggaguuacugagcug

SEQ ID NO: 335123 - RNA, 22 nt, Homo sapiens
uaugucuucuuuagagaaaugu

SEQ ID NO: 335124 - RNA, 22 nt, Homo sapiens
uaugucuuuugcuugcaaauag

SEQ ID NO: 335125 - RNA, 22 nt, Homo sapiens
uaugugcaaauuaauugcuaga

SEQ ID NO: 335126 - RNA, 22 nt, Homo sapiens
uaugugcacaugcccuggugac

SEQ ID NO: 335127 - RNA, 22 nt, Homo sapiens
uauuagguuggggcaaaaguaa

SEQ ID NO: 335128 - RNA, 22 nt, Homo sapiens
uauuagguuggugcaaaaguua

SEQ ID NO: 335129 - RNA, 22 nt, Homo sapiens
uauuauagugauaggucuacug

SEQ ID NO: 335130 - RNA, 22 nt, Homo sapiens
uauuaugcacuuuauaaaaauu

SEQ ID NO: 335131 - RNA, 22 nt, Homo sapiens
uauucacuguaucauugauggg

SEQ ID NO: 335132 - RNA, 22 nt, Homo sapiens
uauuccauuugugaaaggaagu

SEQ ID NO: 335133 - RNA, 22 nt, Homo sapiens
uauugaacuggaucagaaggcc

SEQ ID NO: 335134 - RNA, 22 nt, Homo sapiens
uauugcacuccucaugcauuug

SEQ ID NO: 335135 - RNA, 22 nt, Homo sapiens
uauugcagaaugugaguuggca

SEQ ID NO: 335136 - RNA, 22 nt, Homo sapiens
uauugcuaaaacucaugguugc

SEQ ID NO: 335137 - RNA, 22 nt, Homo sapiens
uauugcuuaugaugcugaauua

SEQ ID NO: 335138 - RNA, 22 nt, Homo sapiens
uauugcuuuacucucuuauccu

SEQ ID NO: 335139 - RNA, 22 nt, Homo sapiens
uauuucaguugcguuucccgag

SEQ ID NO: 335140 - RNA, 22 nt, Homo sapiens
uauuucaguugugcagguaguu

SEQ ID NO: 335141 - RNA, 22 nt, Homo sapiens
uauuuggauagucuggaaaaaa

SEQ ID NO: 335142 - RNA, 22 nt, Homo sapiens
uauuugguuggugcaaaaguaa

SEQ ID NO: 335143 - RNA, 22 nt, Homo sapiens
ucaaaguaaagccucaggaugg

SEQ ID NO: 335144 - RNA, 22 nt, Homo sapiens
ucaaaguauucuucugagaacc

SEQ ID NO: 335145 - RNA, 22 nt, Homo sapiens
ucaaaugaucugcccgccuugg

SEQ ID NO: 335146 - RNA, 22 nt, Homo sapiens
ucaaaugauucacccaccuuug

SEQ ID NO: 335147 - RNA, 22 nt, Homo sapiens
ucaacacaguuaaauggggaaa

SEQ ID NO: 335148 - RNA, 22 nt, Homo sapiens
ucaacauugcugucaggcaucu

SEQ ID NO: 335149 - RNA, 22 nt, Homo sapiens
ucaagcaauucuccucucagcc

SEQ ID NO: 335150 - RNA, 20 nt, Homo sapiens
ucaaggcacgaauaaaaguu

SEQ ID NO: 335151 - RNA, 20 nt, Homo sapiens
ucaaggcaggaacuguacau

SEQ ID NO: 335152 - RNA, 23 nt, Homo sapiens
ucaagugaugguggccacaaggg

SEQ ID NO: 335153 - RNA, 22 nt, Homo sapiens
ucaaugcaaccuccaccucugg

SEQ ID NO: 335154 - RNA, 22 nt, Homo sapiens
ucaauguaucuccaagaauuga

SEQ ID NO: 335155 - RNA, 16 nt, Homo sapiens
ucacaaacucuagcag

SEQ ID NO: 335156 - RNA, 21 nt, Homo sapiens
ucacaaugaacagcagcagaa

SEQ ID NO: 335157 - RNA, 22 nt, Homo sapiens
ucacaauggcugaacuaauuua

SEQ ID NO: 335158 - RNA, 22 nt, Homo sapiens
ucacaauucacuacaggcuuga

SEQ ID NO: 335159 - RNA, 22 nt, Homo sapiens
ucacaauucucaauuugugaaa

SEQ ID NO: 335160 - RNA, 22 nt, Homo sapiens
ucacacgugaacucaucacaga

SEQ ID NO: 335161 - RNA, 22 nt, Homo sapiens
ucacacugaaacuaggguguga

SEQ ID NO: 335162 - RNA, 22 nt, Homo sapiens
ucacagaugcuugacccauuuc

SEQ ID NO: 335163 - RNA, 22 nt, Homo sapiens
ucacagcggucgaacuaauuug

SEQ ID NO: 335164 - RNA, 22 nt, Homo sapiens
ucacaggguguuauuagaauua

SEQ ID NO: 335165 - RNA, 19 nt, Homo sapiens
ucacaggguugacuugagg

SEQ ID NO: 335166 - RNA, 22 nt, Homo sapiens
ucacaguagcaaauguuagaaa

SEQ ID NO: 335167 - RNA, 22 nt, Homo sapiens
ucacagucacugucacguugaa

SEQ ID NO: 335168 - RNA, 23 nt, Homo sapiens
ucacaguggcugcuuaauuguga

SEQ ID NO: 335169 - RNA, 22 nt, Homo sapiens
ucacaguucagcauggcugagg

SEQ ID NO: 335170 - RNA, 22 nt, Homo sapiens
ucacaugaauugucuuguucca

SEQ ID NO: 335171 - RNA, 22 nt, Homo sapiens
ucacauuguacaaacagguaag

SEQ ID NO: 335172 - RNA, 22 nt, Homo sapiens
ucacauuguuauguaaauguuu

SEQ ID NO: 335173 - RNA, 19 nt, Homo sapiens
ucaccaguacacaauacaa

SEQ ID NO: 335174 - RNA, 22 nt, Homo sapiens
ucacccacacaggagacaggga

SEQ ID NO: 335175 - RNA, 19 nt, Homo sapiens
ucaccuugcccugcacaca

SEQ ID NO: 335176 - RNA, 18 nt, Homo sapiens
ucaccuugugagagagag

SEQ ID NO: 335177 - RNA, 22 nt, Homo sapiens
ucacuuggccgcagccuucucu

SEQ ID NO: 335178 - RNA, 22 nt, Homo sapiens
ucagaacugaacaaaccagucu

SEQ ID NO: 335179 - RNA, 22 nt, Homo sapiens
ucagaguggagucugcagccuu

SEQ ID NO: 335180 - RNA, 22 nt, Homo sapiens
ucagaucaugcuuaugauggga

SEQ ID NO: 335181 - RNA, 22 nt, Homo sapiens
ucagaugaucugguaagaacuu

SEQ ID NO: 335182 - RNA, 22 nt, Homo sapiens
ucagauguuuuguuuaucugcu

SEQ ID NO: 335183 - RNA, 22 nt, Homo sapiens
ucagcagugagagaccucaccc

SEQ ID NO: 335184 - RNA, 22 nt, Homo sapiens
ucagcagugccccacucuacug

SEQ ID NO: 335185 - RNA, 21 nt, Homo sapiens
ucagggaccugcuguacugau

SEQ ID NO: 335186 - RNA, 22 nt, Homo sapiens
ucaggucauuccaggagggcca

SEQ ID NO: 335187 - RNA, 22 nt, Homo sapiens
ucaggugcagagaagaaauggg

SEQ ID NO: 335188 - RNA, 22 nt, Homo sapiens
ucaggugcaguggcucaugcuu

SEQ ID NO: 335189 - RNA, 22 nt, Homo sapiens
ucaggugcaguggcucugaccu

SEQ ID NO: 335190 - RNA, 22 nt, Homo sapiens
ucaguacuuuggagcucacaua

SEQ ID NO: 335191 - RNA, 22 nt, Homo sapiens
ucagugaauacauguacucaug

SEQ ID NO: 335192 - RNA, 22 nt, Homo sapiens
ucagugaauauauaacagcgau

SEQ ID NO: 335193 - RNA, 22 nt, Homo sapiens
ucagugccucaguuuuuaaaga

SEQ ID NO: 335194 - RNA, 19 nt, Homo sapiens
ucagugcuauguaauguag

SEQ ID NO: 335195 - RNA, 22 nt, Homo sapiens
ucagugcuuuuuguugucauca

SEQ ID NO: 335196 - RNA, 22 nt, Homo sapiens
ucaguggagcuacaauucuggg

SEQ ID NO: 335197 - RNA, 22 nt, Homo sapiens
agcaacauugagacugcaguug

SEQ ID NO: 335198 - RNA, 22 nt, Homo sapiens
agcaacauuguucauaauagcu

SEQ ID NO: 335199 - RNA, 22 nt, Homo sapiens
agcaauaugacauugcuacauc

SEQ ID NO: 335200 - RNA, 22 nt, Homo sapiens
agcacagugguuaaguuucuua

SEQ ID NO: 335201 - RNA, 23 nt, Homo sapiens
agcaccaccccaggucacaagug

SEQ ID NO: 335202 - RNA, 22 nt, Homo sapiens
agcaccagaaucugaguuauuc

SEQ ID NO: 335203 - RNA, 22 nt, Homo sapiens
agcagagcauauucauucgggg

SEQ ID NO: 335204 - RNA, 22 nt, Homo sapiens
agcagcucaugccuuugggagg

SEQ ID NO: 335205 - RNA, 22 nt, Homo sapiens
agcagguguggcuuauccugaa

SEQ ID NO: 335206 - RNA, 16 nt, Homo sapiens
agcagguguuagguga

SEQ ID NO: 335207 - RNA, 22 nt, Homo sapiens
agcaguacauaaaaagcauccu

SEQ ID NO: 335208 - RNA, 22 nt, Homo sapiens
agcaguagaauuccugcaucac

SEQ ID NO: 335209 - RNA, 20 nt, Homo sapiens
agcaucguuguguuauagcc

SEQ ID NO: 335210 - RNA, 22 nt, Homo sapiens
agccaguauuuccacagagugg

SEQ ID NO: 335211 - RNA, 19 nt, Homo sapiens
agccaguuuucccagcacc

SEQ ID NO: 335212 - RNA, 22 nt, Homo sapiens
agccuguguugaauuauagaaa

SEQ ID NO: 335213 - RNA, 23 nt, Homo sapiens
agcuagagaggcuggggauacag

SEQ ID NO: 335214 - RNA, 22 nt, Homo sapiens
agcucacagccuagcacuguga

SEQ ID NO: 335215 - RNA, 18 nt, Homo sapiens
agcucaguguuugcuuac

SEQ ID NO: 335216 - RNA, 22 nt, Homo sapiens
agcuccuacuguuacaucauug

SEQ ID NO: 335217 - RNA, 22 nt, Homo sapiens
agcugcaauguuuaguauaaua

SEQ ID NO: 335218 - RNA, 22 nt, Homo sapiens
agcugcacaaauggaugugagg

SEQ ID NO: 335219 - RNA, 22 nt, Homo sapiens
agcugcacugguauaggagaaa

SEQ ID NO: 335220 - RNA, 22 nt, Homo sapiens
agcuggauguauguuaagugaa

SEQ ID NO: 335221 - RNA, 22 nt, Homo sapiens
agcuggauguggaugacccugu

SEQ ID NO: 335222 - RNA, 22 nt, Homo sapiens
agcuggcuguagcugcaagucu

SEQ ID NO: 335223 - RNA, 22 nt, Homo sapiens
agcuguguugucugaagucaga

SEQ ID NO: 335224 - RNA, 22 nt, Homo sapiens
agcuuaugcuuggaagagauga

SEQ ID NO: 335225 - RNA, 22 nt, Homo sapiens
aggaaugcuaaguuuuccuccu

SEQ ID NO: 335226 - RNA, 23 nt, Homo sapiens
aggaauggaaaaccaaguaucau

SEQ ID NO: 335227 - RNA, 22 nt, Homo sapiens
aggaauuuaauguaugauaaua

SEQ ID NO: 335228 - RNA, 22 nt, Homo sapiens
aggacacugagcaugggagguu

SEQ ID NO: 335229 - RNA, 22 nt, Homo sapiens
aggacacugauguaugcugugg

SEQ ID NO: 335230 - RNA, 22 nt, Homo sapiens
aggagaugaagcuuuaucuaaa

SEQ ID NO: 335231 - RNA, 21 nt, Homo sapiens
aggagauguuuguccuuuuag

SEQ ID NO: 335232 - RNA, 22 nt, Homo sapiens
aggagcacaauggucaugugga

SEQ ID NO: 335233 - RNA, 18 nt, Homo sapiens
aggagcauagugcuauga

SEQ ID NO: 335234 - RNA, 22 nt, Homo sapiens
aggagcuuuggggaaaacagau

SEQ ID NO: 335235 - RNA, 22 nt, Homo sapiens
aggaguguguauuaaugaaauu

SEQ ID NO: 335236 - RNA, 21 nt, Homo sapiens
aggauaguagauuaaauauuu

SEQ ID NO: 335237 - RNA, 22 nt, Homo sapiens
aggcacggugucucaugccugu

SEQ ID NO: 335238 - RNA, 22 nt, Homo sapiens
aggcagaugagguccucagcug

SEQ ID NO: 335239 - RNA, 22 nt, Homo sapiens
aggcagcuguuauauacugagu

SEQ ID NO: 335240 - RNA, 22 nt, Homo sapiens
aggcaugaaauacaugcauuga

SEQ ID NO: 335241 - RNA, 22 nt, Homo sapiens
aggcaugauuguauuuugcucu

SEQ ID NO: 335242 - RNA, 22 nt, Homo sapiens
aggcauguggcucuguucugac

SEQ ID NO: 335243 - RNA, 22 nt, Homo sapiens
aggcaugugugcagacugucug

SEQ ID NO: 335244 - RNA, 20 nt, Homo sapiens
aggcauguugguuugcgugu

SEQ ID NO: 335245 - RNA, 22 nt, Homo sapiens
aggcuguguggauaauauuggg

SEQ ID NO: 335246 - RNA, 22 nt, Homo sapiens
aggcuuuuggagguggcuuucu

SEQ ID NO: 335247 - RNA, 22 nt, Homo sapiens
agggcacuguagguccugccuc

SEQ ID NO: 335248 - RNA, 22 nt, Homo sapiens
agggcuuguuuaacuaucauua

SEQ ID NO: 335249 - RNA, 22 nt, Homo sapiens
agggcuuuugagcugagauggu

SEQ ID NO: 335250 - RNA, 22 nt, Homo sapiens
agguacuuucccaaccauacug

SEQ ID NO: 335251 - RNA, 22 nt, Homo sapiens
agguagcauagcgggaauauca

SEQ ID NO: 335252 - RNA, 22 nt, Homo sapiens
agguauguauguaugggagaaa

SEQ ID NO: 335253 - RNA, 22 nt, Homo sapiens
agguauuuuuuauccuccagca

SEQ ID NO: 335254 - RNA, 22 nt, Homo sapiens
agguccauugguauuauagcau

SEQ ID NO: 335255 - RNA, 22 nt, Homo sapiens
aggugaauggauaaacuguggg

SEQ ID NO: 335256 - RNA, 22 nt, Homo sapiens
aggugcaauggugguuuugugg

SEQ ID NO: 335257 - RNA, 21 nt, Homo sapiens
agguuguguuuccucuuacuu

SEQ ID NO: 335258 - RNA, 22 nt, Homo sapiens
aguaaauuucugugcuuucaua

SEQ ID NO: 335259 - RNA, 22 nt, Homo sapiens
aguacaauguugaguagaagug

SEQ ID NO: 335260 - RNA, 22 nt, Homo sapiens
aguacacuguugaacagaagug

SEQ ID NO: 335261 - RNA, 22 nt, Homo sapiens
aguagcacaugccacccugucu

SEQ ID NO: 335262 - RNA, 22 nt, Homo sapiens
aguauguagugcaaucagucag

SEQ ID NO: 335263 - RNA, 22 nt, Homo sapiens
aguauugcuaauaagagauuug

SEQ ID NO: 335264 - RNA, 22 nt, Homo sapiens
aguauuuguuggaauaccuguu

SEQ ID NO: 335265 - RNA, 22 nt, Homo sapiens
agucaagaaucucagcaucuuu

SEQ ID NO: 335266 - RNA, 22 nt, Homo sapiens
agucaaggaggccuuucagaug

SEQ ID NO: 335267 - RNA, 22 nt, Homo sapiens
agucacagccuuuuacuuuaga

SEQ ID NO: 335268 - RNA, 22 nt, Homo sapiens
agucaguguguauugauggcac

SEQ ID NO: 335269 - RNA, 20 nt, Homo sapiens
agucaguuuauuuucucucu

SEQ ID NO: 335270 - RNA, 22 nt, Homo sapiens
agucugguguucucacacuagu

SEQ ID NO: 335271 - RNA, 22 nt, Homo sapiens
agugaaaugucaccuuuuagga

SEQ ID NO: 335272 - RNA, 22 nt, Homo sapiens
agugaauguuggaaaguuauuu

SEQ ID NO: 335273 - RNA, 22 nt, Homo sapiens
agugagcugcagucuggggucc

SEQ ID NO: 335274 - RNA, 22 nt, Homo sapiens
agugcaauggcgugaucuuggc

SEQ ID NO: 335275 - RNA, 22 nt, Homo sapiens
agugcacucuuuccucucuuac

SEQ ID NO: 335276 - RNA, 22 nt, Homo sapiens
agugcaguugucacgugccuuc

SEQ ID NO: 335277 - RNA, 22 nt, Homo sapiens
agugcauugagacuugugaguu

SEQ ID NO: 335278 - RNA, 22 nt, Homo sapiens
aguggaguguaaagcgucuuuu

SEQ ID NO: 335279 - RNA, 19 nt, Homo sapiens
aguggguguuuucuguuug

SEQ ID NO: 335280 - RNA, 22 nt, Homo sapiens
agugucaggagacagguagcug

SEQ ID NO: 335281 - RNA, 21 nt, Homo sapiens
aguucacauggcuccuguguu

SEQ ID NO: 335282 - RNA, 22 nt, Homo sapiens
aguugcaagucuugaguaaaga

SEQ ID NO: 335283 - RNA, 22 nt, Homo sapiens
aguuggugauugauugggucug

SEQ ID NO: 335284 - RNA, 22 nt, Homo sapiens
ucagugucugugauggagaggu

SEQ ID NO: 335285 - RNA, 22 nt, Homo sapiens
ucauacaggccaccagggaagu

SEQ ID NO: 335286 - RNA, 22 nt, Homo sapiens
ucauauugguuaaaauaguggg

SEQ ID NO: 335287 - RNA, 21 nt, Homo sapiens
ucaucaagcuguagacaugau

SEQ ID NO: 335288 - RNA, 23 nt, Homo sapiens
ucaucacagcauuuccugguauu

SEQ ID NO: 335289 - RNA, 22 nt, Homo sapiens
ucaugaccaugguauagaccac

SEQ ID NO: 335290 - RNA, 21 nt, Homo sapiens
ucaugccacugcacuuuagcc

SEQ ID NO: 335291 - RNA, 20 nt, Homo sapiens
ucaugccacugcgcuccagc

SEQ ID NO: 335292 - RNA, 22 nt, Homo sapiens
ucauugcaaucucugccucccg

SEQ ID NO: 335293 - RNA, 22 nt, Homo sapiens
ucauugcacuucuuuaguugca

SEQ ID NO: 335294 - RNA, 22 nt, Homo sapiens
uccacaauggagaagaguauga

SEQ ID NO: 335295 - RNA, 22 nt, Homo sapiens
uccacaguggugaggugcagca

SEQ ID NO: 335296 - RNA, 22 nt, Homo sapiens
uccagguacucagggggcugag

SEQ ID NO: 335297 - RNA, 22 nt, Homo sapiens
uccaguuuuguuaacauauggu

SEQ ID NO: 335298 - RNA, 20 nt, Homo sapiens
ucccaguaggagaaggaagg

SEQ ID NO: 335299 - RNA, 22 nt, Homo sapiens
ucccaguggucuugaaacaggg

SEQ ID NO: 335300 - RNA, 22 nt, Homo sapiens
uccccugagaccccucagcacu

SEQ ID NO: 335301 - RNA, 22 nt, Homo sapiens
uccccugagucaccugcuucuc

SEQ ID NO: 335302 - RNA, 22 nt, Homo sapiens
uccccuuuguaagauggaaacg

SEQ ID NO: 335303 - RNA, 22 nt, Homo sapiens
ucccugaguaucuaauguguuu

SEQ ID NO: 335304 - RNA, 22 nt, Homo sapiens
ucccuggagcaagagaagaagg

SEQ ID NO: 335305 - RNA, 22 nt, Homo sapiens
ucccuguagugccuagaucaga

SEQ ID NO: 335306 - RNA, 22 nt, Homo sapiens
ucccuguuaggcacagauuuau

SEQ ID NO: 335307 - RNA, 22 nt, Homo sapiens
uccucaguggauuggauggugc

SEQ ID NO: 335308 - RNA, 22 nt, Homo sapiens
uccugagagcagacccucuaua

SEQ ID NO: 335309 - RNA, 22 nt, Homo sapiens
uccuguaaucccagcuaccaga

SEQ ID NO: 335310 - RNA, 22 nt, Homo sapiens
uccuuggucauggaagagacag

SEQ ID NO: 335311 - RNA, 21 nt, Homo sapiens
uccuuggugaugcccugcagu

SEQ ID NO: 335312 - RNA, 22 nt, Homo sapiens
uccuugguugauccugugcaga

SEQ ID NO: 335313 - RNA, 20 nt, Homo sapiens
ucgcaccacuauacuccagc

SEQ ID NO: 335314 - RNA, 22 nt, Homo sapiens
ucgcagcacgagcaugcaaggu

SEQ ID NO: 335315 - RNA, 23 nt, Homo sapiens
ucgcagcauucaauaccaggcag

SEQ ID NO: 335316 - RNA, 22 nt, Homo sapiens
ucgcugggaaccagagguaaag

SEQ ID NO: 335317 - RNA, 22 nt, Homo sapiens
ucgugcugugucaucuuguggc

SEQ ID NO: 335318 - RNA, 22 nt, Homo sapiens
ucguucuugucaguuuauaaag

SEQ ID NO: 335319 - RNA, 22 nt, Homo sapiens
ucuaaagcauccagauugcuuc

SEQ ID NO: 335320 - RNA, 22 nt, Homo sapiens
ucuaagaauucauuuauaagcc

SEQ ID NO: 335321 - RNA, 22 nt, Homo sapiens
ucuagccuaugaagcuugucca

SEQ ID NO: 335322 - RNA, 22 nt, Homo sapiens
ucucacagaguugaauguuucu

SEQ ID NO: 335323 - RNA, 18 nt, Homo sapiens
ucucacagcaaucuguca

SEQ ID NO: 335324 - RNA, 22 nt, Homo sapiens
ucucagagccuaggguuuuuca

SEQ ID NO: 335325 - RNA, 22 nt, Homo sapiens
ucucagcggacaggccggccag

SEQ ID NO: 335326 - RNA, 22 nt, Homo sapiens
ucucaugaagguggagaguagg

SEQ ID NO: 335327 - RNA, 20 nt, Homo sapiens
ucucauggagggaaagagca

SEQ ID NO: 335328 - RNA, 20 nt, Homo sapiens
ucucauggagguagagaaua

SEQ ID NO: 335329 - RNA, 20 nt, Homo sapiens
ucucccaaacagcaggcccu

SEQ ID NO: 335330 - RNA, 22 nt, Homo sapiens
ucucccauccaugaacuucugu

SEQ ID NO: 335331 - RNA, 22 nt, Homo sapiens
ucucugauuauugcauuucauu

SEQ ID NO: 335332 - RNA, 19 nt, Homo sapiens
ucucugguguuggagggga

SEQ ID NO: 335333 - RNA, 22 nt, Homo sapiens
ucucuguuuagagccagcaauu

SEQ ID NO: 335334 - RNA, 22 nt, Homo sapiens
ucucuguuuauuuuugguguau

SEQ ID NO: 335335 - RNA, 22 nt, Homo sapiens
ucucuuggcggaaguugcagug

SEQ ID NO: 335336 - RNA, 22 nt, Homo sapiens
ucucuuggugacuuaaaauguu

SEQ ID NO: 335337 - RNA, 22 nt, Homo sapiens
ucugacagugugaauauugacu

SEQ ID NO: 335338 - RNA, 22 nt, Homo sapiens
ucugagcaauagauguggauau

SEQ ID NO: 335339 - RNA, 22 nt, Homo sapiens
ucugagguuaaauuuuauaguu

SEQ ID NO: 335340 - RNA, 20 nt, Homo sapiens
ucugauugcaacugcaugag

SEQ ID NO: 335341 - RNA, 22 nt, Homo sapiens
ucuggagugugaaguggauaug

SEQ ID NO: 335342 - RNA, 22 nt, Homo sapiens
ucuggcacugaugugggaugcu

SEQ ID NO: 335343 - RNA, 21 nt, Homo sapiens
ucuggccccuccaaaucucau

SEQ ID NO: 335344 - RNA, 22 nt, Homo sapiens
ucuggccuacaaguaauuuuau

SEQ ID NO: 335345 - RNA, 22 nt, Homo sapiens
ucuggccuagaacaauuaauua

SEQ ID NO: 335346 - RNA, 22 nt, Homo sapiens
ucuggccuccuaugagaaucga

SEQ ID NO: 335347 - RNA, 22 nt, Homo sapiens
ucuggcuucugacuuaggggac

SEQ ID NO: 335348 - RNA, 18 nt, Homo sapiens
ucuggcuucuuuguucca

SEQ ID NO: 335349 - RNA, 22 nt, Homo sapiens
ucuggcuuuagcaugugggaag

SEQ ID NO: 335350 - RNA, 22 nt, Homo sapiens
ucuggcuuucuuuacuuaaugu

SEQ ID NO: 335351 - RNA, 22 nt, Homo sapiens
ucugggguuagucaaagguaug

SEQ ID NO: 335352 - RNA, 22 nt, Homo sapiens
ucuggguuuuuacaauguuuac

SEQ ID NO: 335353 - RNA, 22 nt, Homo sapiens
ucuggugugcucuggacuugca

SEQ ID NO: 335354 - RNA, 22 nt, Homo sapiens
ucugguguuacugagccuccca

SEQ ID NO: 335355 - RNA, 22 nt, Homo sapiens
ucuguaacauccaccuucuggg

SEQ ID NO: 335356 - RNA, 19 nt, Homo sapiens
ucuguaguuagggcuacag

SEQ ID NO: 335357 - RNA, 22 nt, Homo sapiens
ucugucacugaaucccugucac

SEQ ID NO: 335358 - RNA, 22 nt, Homo sapiens
ucugucuuguccucacccuaga

SEQ ID NO: 335359 - RNA, 22 nt, Homo sapiens
ucugugaaaucauuuccuguaa

SEQ ID NO: 335360 - RNA, 22 nt, Homo sapiens
ucugugaaugugaccuuauuug

SEQ ID NO: 335361 - RNA, 22 nt, Homo sapiens
ucugugcauuguaggauguuua

SEQ ID NO: 335362 - RNA, 22 nt, Homo sapiens
ucugugcuugucauaugcuuug

SEQ ID NO: 335363 - RNA, 22 nt, Homo sapiens
ucuguggucagaguccuuggcc

SEQ ID NO: 335364 - RNA, 22 nt, Homo sapiens
ucuguguugaucacacugggag

SEQ ID NO: 335365 - RNA, 22 nt, Homo sapiens
ucuguguugaugcucauuaauu

SEQ ID NO: 335366 - RNA, 22 nt, Homo sapiens
ucuucagucauauuggccugga

SEQ ID NO: 335367 - RNA, 22 nt, Homo sapiens
ucuucaugcuugaaauaauagc

SEQ ID NO: 335368 - RNA, 22 nt, Homo sapiens
ucuugcaccuacaugcuuuguc

SEQ ID NO: 335369 - RNA, 22 nt, Homo sapiens
ucuuggcauggcugaagauucc

SEQ ID NO: 335370 - RNA, 22 nt, Homo sapiens
ucuuggguggauucauucuuuc

SEQ ID NO: 335371 - RNA, 19 nt, Homo sapiens
auaaacuagaacugucccc

SEQ ID NO: 335372 - RNA, 22 nt, Homo sapiens
auaaagccaugagcuugagaug

SEQ ID NO: 335373 - RNA, 19 nt, Homo sapiens
auaaaugccuacaagggug

SEQ ID NO: 335374 - RNA, 20 nt, Homo sapiens
auaaauguauagguguacau

SEQ ID NO: 335375 - RNA, 22 nt, Homo sapiens
auaacauggaguuugucauuua

SEQ ID NO: 335376 - RNA, 22 nt, Homo sapiens
auaacucuguuuuuuucaugca

SEQ ID NO: 335377 - RNA, 22 nt, Homo sapiens
auaagaguaguacauaugagac

SEQ ID NO: 335378 - RNA, 22 nt, Homo sapiens
auaaggcagcugcuaaaaggca

SEQ ID NO: 335379 - RNA, 22 nt, Homo sapiens
auaagguuagcucugagaaagu

SEQ ID NO: 335380 - RNA, 22 nt, Homo sapiens
auaaguagaaugauggucaaaa

SEQ ID NO: 335381 - RNA, 22 nt, Homo sapiens
auaauagguaguaauggauuga

SEQ ID NO: 335382 - RNA, 22 nt, Homo sapiens
auaaucaugucugaaaccuuug

SEQ ID NO: 335383 - RNA, 22 nt, Homo sapiens
auacagguauacaaugcauaau

SEQ ID NO: 335384 - RNA, 22 nt, Homo sapiens
auacaguguucugggaagaagu

SEQ ID NO: 335385 - RNA, 22 nt, Homo sapiens
auacaugugcaggucagguuac

SEQ ID NO: 335386 - RNA, 22 nt, Homo sapiens
auacaugugugagcgaagaugu

SEQ ID NO: 335387 - RNA, 20 nt, Homo sapiens
auacccaguagcacaacagc

SEQ ID NO: 335388 - RNA, 22 nt, Homo sapiens
auacuguuucugaacuuugauu

SEQ ID NO: 335389 - RNA, 22 nt, Homo sapiens
auagaagcugccaacguuucag

SEQ ID NO: 335390 - RNA, 22 nt, Homo sapiens
auagaauguauuaguaaauuug

SEQ ID NO: 335391 - RNA, 22 nt, Homo sapiens
auagacugaguggcuuaaacca

SEQ ID NO: 335392 - RNA, 22 nt, Homo sapiens
auagcaagaugauugauccauu

SEQ ID NO: 335393 - RNA, 22 nt, Homo sapiens
auagcacauggcauccucucuu

SEQ ID NO: 335394 - RNA, 22 nt, Homo sapiens
auaggagcagaaaccguauuuu

SEQ ID NO: 335395 - RNA, 22 nt, Homo sapiens
auagguagcauagcaggaauau

SEQ ID NO: 335396 - RNA, 22 nt, Homo sapiens
auagucaguagucucauaauga

SEQ ID NO: 335397 - RNA, 22 nt, Homo sapiens
auagugcugcaaaaaacauacg

SEQ ID NO: 335398 - RNA, 22 nt, Homo sapiens
auagugcugcaauaaacauacg

SEQ ID NO: 335399 - RNA, 22 nt, Homo sapiens
auagugcugcaauaaccauggg

SEQ ID NO: 335400 - RNA, 22 nt, Homo sapiens
auagugcugcaauuaacauaca

SEQ ID NO: 335401 - RNA, 19 nt, Homo sapiens
auaguguaggaaaacagcu

SEQ ID NO: 335402 - RNA, 23 nt, Homo sapiens
auauaguagaugugcaguaacau

SEQ ID NO: 335403 - RNA, 22 nt, Homo sapiens
auauauguuuucugggaagaaa

SEQ ID NO: 335404 - RNA, 22 nt, Homo sapiens
auaucaacaucgugucauuagu

SEQ ID NO: 335405 - RNA, 22 nt, Homo sapiens
auaucaaggccauuuucuaaau

SEQ ID NO: 335406 - RNA, 17 nt, Homo sapiens
auaugaauuuuggagau

SEQ ID NO: 335407 - RNA, 22 nt, Homo sapiens
auaugcacaguggaguacuauu

SEQ ID NO: 335408 - RNA, 20 nt, Homo sapiens
auaugcagacacauacauac

SEQ ID NO: 335409 - RNA, 22 nt, Homo sapiens
auaugcauguacccacacaggc

SEQ ID NO: 335410 - RNA, 22 nt, Homo sapiens
auauggguuuuauauuaggcuc

SEQ ID NO: 335411 - RNA, 22 nt, Homo sapiens
auaugucuauuauuagggcagg

SEQ ID NO: 335412 - RNA, 22 nt, Homo sapiens
auauuacagagaggaccuggga

SEQ ID NO: 335413 - RNA, 22 nt, Homo sapiens
auauucaagugaggauggcuaa

SEQ ID NO: 335414 - RNA, 22 nt, Homo sapiens
aucaaagccaugcucaguuuuc

SEQ ID NO: 335415 - RNA, 22 nt, Homo sapiens
aucaaagugaaauauuaguuau

SEQ ID NO: 335416 - RNA, 22 nt, Homo sapiens
aucaaagugaauuaaugagaau

SEQ ID NO: 335417 - RNA, 22 nt, Homo sapiens
aucaaguaaucugaguaagagu

SEQ ID NO: 335418 - RNA, 22 nt, Homo sapiens
aucacacuguuauuuuaguuaa

SEQ ID NO: 335419 - RNA, 22 nt, Homo sapiens
aucacagaguuaaaacuuucuu

SEQ ID NO: 335420 - RNA, 22 nt, Homo sapiens
aucacagcuacuccucugucuu

SEQ ID NO: 335421 - RNA, 22 nt, Homo sapiens
aucacaguggcucacaagagcc

SEQ ID NO: 335422 - RNA, 22 nt, Homo sapiens
aucacaguuaagaggugaugaa

SEQ ID NO: 335423 - RNA, 22 nt, Homo sapiens
aucacuguaaguuuacacuuug

SEQ ID NO: 335424 - RNA, 22 nt, Homo sapiens
aucacuguccacucaucuuucu

SEQ ID NO: 335425 - RNA, 22 nt, Homo sapiens
aucacuuucuauuucugugcca

SEQ ID NO: 335426 - RNA, 22 nt, Homo sapiens
aucagaaucucuugagaguguu

SEQ ID NO: 335427 - RNA, 22 nt, Homo sapiens
aucagagugaauaaugacaaaa

SEQ ID NO: 335428 - RNA, 22 nt, Homo sapiens
aucagugcauguuuguugagcu

SEQ ID NO: 335429 - RNA, 22 nt, Homo sapiens
aucauaucauuggugaacagug

SEQ ID NO: 335430 - RNA, 22 nt, Homo sapiens
aucauccagccccagaagggag

SEQ ID NO: 335431 - RNA, 22 nt, Homo sapiens
aucauccugucaggagcuguga

SEQ ID NO: 335432 - RNA, 22 nt, Homo sapiens
aucauguaguaagacacauuua

SEQ ID NO: 335433 - RNA, 22 nt, Homo sapiens
auccaagagacugaugacuucc

SEQ ID NO: 335434 - RNA, 22 nt, Homo sapiens
auccacagugucaauguuguga

SEQ ID NO: 335435 - RNA, 22 nt, Homo sapiens
auccaucagacggcaggcguug

SEQ ID NO: 335436 - RNA, 22 nt, Homo sapiens
auccauguggauaaauguguau

SEQ ID NO: 335437 - RNA, 22 nt, Homo sapiens
aucccuguaacuagcagccccu

SEQ ID NO: 335438 - RNA, 22 nt, Homo sapiens
aucccugugauccaaucacuuc

SEQ ID NO: 335439 - RNA, 22 nt, Homo sapiens
aucccuguguccagcaccugug

SEQ ID NO: 335440 - RNA, 22 nt, Homo sapiens
auccucaguggcuuaaguauag

SEQ ID NO: 335441 - RNA, 22 nt, Homo sapiens
auccucugagaucuaggcagag

SEQ ID NO: 335442 - RNA, 22 nt, Homo sapiens
auccugaagcuuuacugaauuc

SEQ ID NO: 335443 - RNA, 22 nt, Homo sapiens
auccugagacuuugcugaaguu

SEQ ID NO: 335444 - RNA, 22 nt, Homo sapiens
auccuuuagacuguccaguuga

SEQ ID NO: 335445 - RNA, 21 nt, Homo sapiens
aucucacuugaauguaaaagc

SEQ ID NO: 335446 - RNA, 22 nt, Homo sapiens
aucucauggagguagagaguaa

SEQ ID NO: 335447 - RNA, 22 nt, Homo sapiens
aucugcauuagggugaagaccu

SEQ ID NO: 335448 - RNA, 22 nt, Homo sapiens
aucugugaaugaaguuauuuug

SEQ ID NO: 335449 - RNA, 22 nt, Homo sapiens
aucugugguuguaugcauauua

SEQ ID NO: 335450 - RNA, 22 nt, Homo sapiens
aucuuugauuguagguacaaug

SEQ ID NO: 335451 - RNA, 22 nt, Homo sapiens
aucuuuggugaguucuuugguc

SEQ ID NO: 335452 - RNA, 22 nt, Homo sapiens
aucuuuggugcaugauacuuug

SEQ ID NO: 335453 - RNA, 22 nt, Homo sapiens
augaaacuggagcgccuggagg

SEQ ID NO: 335454 - RNA, 23 nt, Homo sapiens
augaaagcccuugcaaaugcugg

SEQ ID NO: 335455 - RNA, 22 nt, Homo sapiens
augaaaguguguggaaacuuga

SEQ ID NO: 335456 - RNA, 22 nt, Homo sapiens
augaaaucuuuccugugaggau

SEQ ID NO: 335457 - RNA, 22 nt, Homo sapiens
augaaaugcauguuaaguccgu

SEQ ID NO: 335458 - RNA, 22 nt, Homo sapiens
ucuuggguuguuggcuucuccu

SEQ ID NO: 335459 - RNA, 22 nt, Homo sapiens
ucuugguaaugucacauuuccu

SEQ ID NO: 335460 - RNA, 21 nt, Homo sapiens
ucuugguauguauuuaggagg

SEQ ID NO: 335461 - RNA, 22 nt, Homo sapiens
ucuugguugaaaauucauaaua

SEQ ID NO: 335462 - RNA, 22 nt, Homo sapiens
ucuuuagugacaguugugcaag

SEQ ID NO: 335463 - RNA, 22 nt, Homo sapiens
ucuuugauguucugaaagaugg

SEQ ID NO: 335464 - RNA, 22 nt, Homo sapiens
ucuuugauuuuguuacuaagac

SEQ ID NO: 335465 - RNA, 22 nt, Homo sapiens
ucuuugccuaacccaaggucau

SEQ ID NO: 335466 - RNA, 22 nt, Homo sapiens
ucuuuggauggaaauuggaguc

SEQ ID NO: 335467 - RNA, 22 nt, Homo sapiens
ucuuuggcugugaagaauaaug

SEQ ID NO: 335468 - RNA, 22 nt, Homo sapiens
ucuuugguaugugcaugugcuu

SEQ ID NO: 335469 - RNA, 22 nt, Homo sapiens
ucuuuggucagaaagauuacac

SEQ ID NO: 335470 - RNA, 22 nt, Homo sapiens
ucuuugguucuguuuauguaau

SEQ ID NO: 335471 - RNA, 22 nt, Homo sapiens
ucuuuguuggaguccaaggaua

SEQ ID NO: 335472 - RNA, 22 nt, Homo sapiens
ugaaacacacagagaagggaga

SEQ ID NO: 335473 - RNA, 22 nt, Homo sapiens
ugaaacacacauugcccuuuau

SEQ ID NO: 335474 - RNA, 22 nt, Homo sapiens
ugaaacauacacucugaugggg

SEQ ID NO: 335475 - RNA, 22 nt, Homo sapiens
ugaaacugcagugggcuuggca

SEQ ID NO: 335476 - RNA, 22 nt, Homo sapiens
ugaaagguuuaauucugugaga

SEQ ID NO: 335477 - RNA, 22 nt, Homo sapiens
ugaaaucuuugaugguggcauu

SEQ ID NO: 335478 - RNA, 22 nt, Homo sapiens
ugaaaugcugucuaggggaaau

SEQ ID NO: 335479 - RNA, 22 nt, Homo sapiens
ugaaauggaaagaguguagacu

SEQ ID NO: 335480 - RNA, 22 nt, Homo sapiens
ugaaauguugggugauggaauc

SEQ ID NO: 335481 - RNA, 22 nt, Homo sapiens
ugaacacuggauaaggagucag

SEQ ID NO: 335482 - RNA, 22 nt, Homo sapiens
ugaacagcaccuccuagaguug

SEQ ID NO: 335483 - RNA, 22 nt, Homo sapiens
ugaacagcacguuuauucagaa

SEQ ID NO: 335484 - RNA, 22 nt, Homo sapiens
ugaacugagacuagacuuguuc

SEQ ID NO: 335485 - RNA, 22 nt, Homo sapiens
ugaaggaguauggauaagucgu

SEQ ID NO: 335486 - RNA, 22 nt, Homo sapiens
ugaaggcaggagggagaaaagu

SEQ ID NO: 335487 - RNA, 22 nt, Homo sapiens
ugaagugaaugguaaguaugcc

SEQ ID NO: 335488 - RNA, 22 nt, Homo sapiens
ugaagugggaaaugaguauuaa

SEQ ID NO: 335489 - RNA, 22 nt, Homo sapiens
ugaauacugugcaaaggauuug

SEQ ID NO: 335490 - RNA, 22 nt, Homo sapiens
ugaauacuucaaaaaaauagcu

SEQ ID NO: 335491 - RNA, 22 nt, Homo sapiens
ugaauacuucguucaaagauaa

SEQ ID NO: 335492 - RNA, 22 nt, Homo sapiens
ugaauagagcugcaguggacau

SEQ ID NO: 335493 - RNA, 22 nt, Homo sapiens
ugaauagugucacaauaaacau

SEQ ID NO: 335494 - RNA, 22 nt, Homo sapiens
ugaaucaugcugcuauaaagac

SEQ ID NO: 335495 - RNA, 22 nt, Homo sapiens
ugaaugcaucuagaaauuuauu

SEQ ID NO: 335496 - RNA, 22 nt, Homo sapiens
ugaaugguuuuuagagaacaau

SEQ ID NO: 335497 - RNA, 22 nt, Homo sapiens
ugaauguccauugauguuuuga

SEQ ID NO: 335498 - RNA, 22 nt, Homo sapiens
ugaaugugauggguuucaugug

SEQ ID NO: 335499 - RNA, 22 nt, Homo sapiens
ugaauuguuucauucuuuacau

SEQ ID NO: 335500 - RNA, 22 nt, Homo sapiens
ugacaagagaccccuccgcagg

SEQ ID NO: 335501 - RNA, 21 nt, Homo sapiens
ugacagaaaauugaguuugcu

SEQ ID NO: 335502 - RNA, 22 nt, Homo sapiens
ugacagcugaggcccagaguac

SEQ ID NO: 335503 - RNA, 22 nt, Homo sapiens
ugacagcuguugaggcauuuau

SEQ ID NO: 335504 - RNA, 22 nt, Homo sapiens
ugacaguaaacagucuugauua

SEQ ID NO: 335505 - RNA, 23 nt, Homo sapiens
ugacagucucccgauggcuaggc

SEQ ID NO: 335506 - RNA, 22 nt, Homo sapiens
ugacaguguccuccuccugaga

SEQ ID NO: 335507 - RNA, 22 nt, Homo sapiens
ugacaucugcuugugcccagga

SEQ ID NO: 335508 - RNA, 22 nt, Homo sapiens
ugacaugagauuugggaggggc

SEQ ID NO: 335509 - RNA, 22 nt, Homo sapiens
ugacaugauuguauauuuagaa

SEQ ID NO: 335510 - RNA, 21 nt, Homo sapiens
ugacauguugguuugcugcac

SEQ ID NO: 335511 - RNA, 21 nt, Homo sapiens
ugacauuauuucaugucagua

SEQ ID NO: 335512 - RNA, 19 nt, Homo sapiens
ugaccagggacagaaacca

SEQ ID NO: 335513 - RNA, 22 nt, Homo sapiens
ugacuaaaacugaguuucauua

SEQ ID NO: 335514 - RNA, 22 nt, Homo sapiens
ugacuacacacaauuugucaag

SEQ ID NO: 335515 - RNA, 22 nt, Homo sapiens
ugacuaggaggcuggaggauga

SEQ ID NO: 335516 - RNA, 22 nt, Homo sapiens
ugacuaggggcccuggcuucuu

SEQ ID NO: 335517 - RNA, 22 nt, Homo sapiens
ugacuaguuuugcuguuguuau

SEQ ID NO: 335518 - RNA, 22 nt, Homo sapiens
ugacucaagagccugacucauc

SEQ ID NO: 335519 - RNA, 22 nt, Homo sapiens
ugacucaguuucucagguagua

SEQ ID NO: 335520 - RNA, 22 nt, Homo sapiens
ugacugguguuuaaugagucaa

SEQ ID NO: 335521 - RNA, 22 nt, Homo sapiens
ugacugucuagauagagcuugg

SEQ ID NO: 335522 - RNA, 22 nt, Homo sapiens
ugacugugcagcuccaucaggg

SEQ ID NO: 335523 - RNA, 22 nt, Homo sapiens
ugagaacagcagcuugggacac

SEQ ID NO: 335524 - RNA, 22 nt, Homo sapiens
ugagaacaugcacuugagguug

SEQ ID NO: 335525 - RNA, 16 nt, Homo sapiens
ugagaacaugugacau

SEQ ID NO: 335526 - RNA, 22 nt, Homo sapiens
ugagaacaugugauauuuggug

SEQ ID NO: 335527 - RNA, 19 nt, Homo sapiens
ugagaacaugugguauuug

SEQ ID NO: 335528 - RNA, 22 nt, Homo sapiens
ugagaagaugaacuccuugguc

SEQ ID NO: 335529 - RNA, 22 nt, Homo sapiens
ugagaaugaugauugguaaacc

SEQ ID NO: 335530 - RNA, 22 nt, Homo sapiens
ugagacaaaguuguuggauguu

SEQ ID NO: 335531 - RNA, 22 nt, Homo sapiens
ugagacauacuuacaggggaug

SEQ ID NO: 335532 - RNA, 22 nt, Homo sapiens
ugagacaugugaacuguaguuc

SEQ ID NO: 335533 - RNA, 22 nt, Homo sapiens
ugagacugguaauguguagggc

SEQ ID NO: 335534 - RNA, 22 nt, Homo sapiens
ugagacugguuaauugauaaag

SEQ ID NO: 335535 - RNA, 22 nt, Homo sapiens
ugagagucacugaccugguaua

SEQ ID NO: 335536 - RNA, 22 nt, Homo sapiens
ugagaucacuaagagguaaugg

SEQ ID NO: 335537 - RNA, 22 nt, Homo sapiens
ugagaucaguuguuauaauucu

SEQ ID NO: 335538 - RNA, 22 nt, Homo sapiens
ugagaucaugccacugcacuuc

SEQ ID NO: 335539 - RNA, 19 nt, Homo sapiens
ugagauccacugaagauuc

SEQ ID NO: 335540 - RNA, 22 nt, Homo sapiens
ugagauccaugcuauuugggcu

SEQ ID NO: 335541 - RNA, 22 nt, Homo sapiens
ugagauccugagaguugggacu

SEQ ID NO: 335542 - RNA, 22 nt, Homo sapiens
ugagauccugugacuacacuga

SEQ ID NO: 335543 - RNA, 23 nt, Homo sapiens
ugagaucuacagaucucagaucu

SEQ ID NO: 335544 - RNA, 22 nt, Homo sapiens
ugagaucuguaaagucugacau

SEQ ID NO: 335545 - RNA, 22 nt, Homo sapiens
augaacucaucaucuagguuuu

SEQ ID NO: 335546 - RNA, 22 nt, Homo sapiens
augaagaucucugccuuguguc

SEQ ID NO: 335547 - RNA, 22 nt, Homo sapiens
augaagauguugccuuuuuaau

SEQ ID NO: 335548 - RNA, 20 nt, Homo sapiens
augaaggcaggugugaguuu

SEQ ID NO: 335549 - RNA, 22 nt, Homo sapiens
augaauguaaagaaugugggaa

SEQ ID NO: 335550 - RNA, 22 nt, Homo sapiens
augaaugucuuauuuugagaaa

SEQ ID NO: 335551 - RNA, 22 nt, Homo sapiens
augacaagagccuucuuuccuu

SEQ ID NO: 335552 - RNA, 22 nt, Homo sapiens
augacaagaguguucagggaga

SEQ ID NO: 335553 - RNA, 22 nt, Homo sapiens
augacagcaucugugaaguugu

SEQ ID NO: 335554 - RNA, 22 nt, Homo sapiens
augacauugaaaagcaagugga

SEQ ID NO: 335555 - RNA, 18 nt, Homo sapiens
augaccugcggguuauau

SEQ ID NO: 335556 - RNA, 22 nt, Homo sapiens
augacucagaucuguuccuggu

SEQ ID NO: 335557 - RNA, 22 nt, Homo sapiens
augagaaugaagccuggcgugu

SEQ ID NO: 335558 - RNA, 22 nt, Homo sapiens
augagaaugauucuguuauggu

SEQ ID NO: 335559 - RNA, 22 nt, Homo sapiens
augagcuaggacagaaugucag

SEQ ID NO: 335560 - RNA, 22 nt, Homo sapiens
augaggcaggaaaggcguaucu

SEQ ID NO: 335561 - RNA, 22 nt, Homo sapiens
augagggagggguggugccgca

SEQ ID NO: 335562 - RNA, 22 nt, Homo sapiens
augauagucuugagaagcauuu

SEQ ID NO: 335563 - RNA, 22 nt, Homo sapiens
augauauggguugucaguugua

SEQ ID NO: 335564 - RNA, 22 nt, Homo sapiens
augauauguuuguagcuaucuc

SEQ ID NO: 335565 - RNA, 22 nt, Homo sapiens
augauauuauucuagcccagag

SEQ ID NO: 335566 - RNA, 22 nt, Homo sapiens
augaucaucugaaagcuuuuac

SEQ ID NO: 335567 - RNA, 19 nt, Homo sapiens
augauugucuauggaggaa

SEQ ID NO: 335568 - RNA, 22 nt, Homo sapiens
augauuguucucacucaagaga

SEQ ID NO: 335569 - RNA, 22 nt, Homo sapiens
augcaaacaucauagaguguac

SEQ ID NO: 335570 - RNA, 22 nt, Homo sapiens
augcaaacaucugaagagacau

SEQ ID NO: 335571 - RNA, 20 nt, Homo sapiens
augcaaacccugcuuugugg

SEQ ID NO: 335572 - RNA, 19 nt, Homo sapiens
augcaaugucacaggcugc

SEQ ID NO: 335573 - RNA, 22 nt, Homo sapiens
augcacaguccagcccaugugg

SEQ ID NO: 335574 - RNA, 22 nt, Homo sapiens
augcacuguuuucuugaugaga

SEQ ID NO: 335575 - RNA, 22 nt, Homo sapiens
augcagauauuuuugugguugc

SEQ ID NO: 335576 - RNA, 22 nt, Homo sapiens
augcagaucacauuuuucuguc

SEQ ID NO: 335577 - RNA, 22 nt, Homo sapiens
augcagugugcaacagauuaag

SEQ ID NO: 335578 - RNA, 22 nt, Homo sapiens
augcauauuccugggccucacu

SEQ ID NO: 335579 - RNA, 22 nt, Homo sapiens
augcaugucaaauuuguagguu

SEQ ID NO: 335580 - RNA, 22 nt, Homo sapiens
augccaagaugagcacgcgucu

SEQ ID NO: 335581 - RNA, 22 nt, Homo sapiens
augccacagaaauaaccaaaau

SEQ ID NO: 335582 - RNA, 22 nt, Homo sapiens
augccacugcacuccaaccugg

SEQ ID NO: 335583 - RNA, 22 nt, Homo sapiens
augccacugcacuucagccugc

SEQ ID NO: 335584 - RNA, 22 nt, Homo sapiens
augccacugcacuucagcuugg

SEQ ID NO: 335585 - RNA, 22 nt, Homo sapiens
augccacugcauaagguuuuca

SEQ ID NO: 335586 - RNA, 22 nt, Homo sapiens
augccacuguacucuagccuag

SEQ ID NO: 335587 - RNA, 22 nt, Homo sapiens
augcuacauucuacaauuaggc

SEQ ID NO: 335588 - RNA, 21 nt, Homo sapiens
auggaaagacugccucuucaa

SEQ ID NO: 335589 - RNA, 22 nt, Homo sapiens
auggaaagcuguuccuacacaa

SEQ ID NO: 335590 - RNA, 22 nt, Homo sapiens
auggaaggagaauggucuuuga

SEQ ID NO: 335591 - RNA, 22 nt, Homo sapiens
auggaaugguugggucauaagg

SEQ ID NO: 335592 - RNA, 22 nt, Homo sapiens
auggaauguauagucauguagg

SEQ ID NO: 335593 - RNA, 22 nt, Homo sapiens
auggagugagaauggagguucc

SEQ ID NO: 335594 - RNA, 22 nt, Homo sapiens
auggaguguaauauugagagcu

SEQ ID NO: 335595 - RNA, 22 nt, Homo sapiens
auggcccaguuugcuaucccua

SEQ ID NO: 335596 - RNA, 20 nt, Homo sapiens
auggcccugcugggaguguc

SEQ ID NO: 335597 - RNA, 22 nt, Homo sapiens
auggcccuguguggagcugcug

SEQ ID NO: 335598 - RNA, 22 nt, Homo sapiens
auggccugaugcaccuguccca

SEQ ID NO: 335599 - RNA, 22 nt, Homo sapiens
auggccuuguauaccuggcaaa

SEQ ID NO: 335600 - RNA, 22 nt, Homo sapiens
auggccuuuuuaucucaccaag

SEQ ID NO: 335601 - RNA, 22 nt, Homo sapiens
auggcguguggcuuggaggcug

SEQ ID NO: 335602 - RNA, 22 nt, Homo sapiens
auggcucaauucuuucccugaa

SEQ ID NO: 335603 - RNA, 22 nt, Homo sapiens
auggcuguuuaagaguuucauu

SEQ ID NO: 335604 - RNA, 22 nt, Homo sapiens
auggcuguuucugcaaugucua

SEQ ID NO: 335605 - RNA, 22 nt, Homo sapiens
auggcuucuuacucuucugcau

SEQ ID NO: 335606 - RNA, 22 nt, Homo sapiens
auggcuuuuauuguguugaggu

SEQ ID NO: 335607 - RNA, 22 nt, Homo sapiens
auggcuuuugaccugguaggau

SEQ ID NO: 335608 - RNA, 22 nt, Homo sapiens
augggaaaaucagaaggccugg

SEQ ID NO: 335609 - RNA, 22 nt, Homo sapiens
augggugaguaugaguugacuu

SEQ ID NO: 335610 - RNA, 22 nt, Homo sapiens
augguauggaaggucuggagga

SEQ ID NO: 335611 - RNA, 22 nt, Homo sapiens
augguauuuaacagucuuucua

SEQ ID NO: 335612 - RNA, 21 nt, Homo sapiens
auggugagaaaguagugucaa

SEQ ID NO: 335613 - RNA, 22 nt, Homo sapiens
augguuuauuuguaagcagagu

SEQ ID NO: 335614 - RNA, 22 nt, Homo sapiens
augguuuuacugcaaaauggga

SEQ ID NO: 335615 - RNA, 22 nt, Homo sapiens
auguaacuaucugagccauggg

SEQ ID NO: 335616 - RNA, 22 nt, Homo sapiens
augucacugcacuccugccugg

SEQ ID NO: 335617 - RNA, 17 nt, Homo sapiens
augugaauguucaaaua

SEQ ID NO: 335618 - RNA, 22 nt, Homo sapiens
augugacugauguaaucagaca

SEQ ID NO: 335619 - RNA, 18 nt, Homo sapiens
augugcaauuuuguauuu

SEQ ID NO: 335620 - RNA, 22 nt, Homo sapiens
augugcaugcuguucugccaga

SEQ ID NO: 335621 - RNA, 22 nt, Homo sapiens
augugcuugagggaaaucaguu

SEQ ID NO: 335622 - RNA, 22 nt, Homo sapiens
auguggcuuuccuagaucuuag

SEQ ID NO: 335623 - RNA, 22 nt, Homo sapiens
augugugcuugauguaaaaagu

SEQ ID NO: 335624 - RNA, 22 nt, Homo sapiens
augugugcuugugacacagccu

SEQ ID NO: 335625 - RNA, 22 nt, Homo sapiens
auguuaagauggaacaugggaa

SEQ ID NO: 335626 - RNA, 20 nt, Homo sapiens
auguucuggaggacagaagc

SEQ ID NO: 335627 - RNA, 22 nt, Homo sapiens
auuaaguuaggauuuugagaua

SEQ ID NO: 335628 - RNA, 22 nt, Homo sapiens
auuaauguaauuaguaaaguug

SEQ ID NO: 335629 - RNA, 22 nt, Homo sapiens
auuauuaguuguugaaugaagu

SEQ ID NO: 335630 - RNA, 22 nt, Homo sapiens
auucaaagugcauguucccacu

SEQ ID NO: 335631 - RNA, 22 nt, Homo sapiens
auucacagcuuuaaaaggcgug

SEQ ID NO: 335632 - RNA, 22 nt, Homo sapiens
ugagauggaguuucacuuuugu

SEQ ID NO: 335633 - RNA, 22 nt, Homo sapiens
ugagauggcugaauucagaaua

SEQ ID NO: 335634 - RNA, 22 nt, Homo sapiens
ugagauggguucugguccccug

SEQ ID NO: 335635 - RNA, 21 nt, Homo sapiens
ugagaugugaccagggcauca

SEQ ID NO: 335636 - RNA, 22 nt, Homo sapiens
ugagauguggcuagagagguug

SEQ ID NO: 335637 - RNA, 22 nt, Homo sapiens
ugagaugugugcauucaacuca

SEQ ID NO: 335638 - RNA, 22 nt, Homo sapiens
ugagauguuuguuucagugccu

SEQ ID NO: 335639 - RNA, 22 nt, Homo sapiens
ugagcaagaucuuuauaauuag

SEQ ID NO: 335640 - RNA, 22 nt, Homo sapiens
ugagcaauaaaguuacacaguu

SEQ ID NO: 335641 - RNA, 22 nt, Homo sapiens
ugagcacauuuacaucaguucc

SEQ ID NO: 335642 - RNA, 22 nt, Homo sapiens
ugagcagagggagaaguaaauu

SEQ ID NO: 335643 - RNA, 22 nt, Homo sapiens
ugagcagugaguguggugcagg

SEQ ID NO: 335644 - RNA, 22 nt, Homo sapiens
ugagcuagagaguuuaguguca

SEQ ID NO: 335645 - RNA, 22 nt, Homo sapiens
ugagcuccuucauaaaaaggca

SEQ ID NO: 335646 - RNA, 22 nt, Homo sapiens
ugagcugagacaauaaguuuuu

SEQ ID NO: 335647 - RNA, 22 nt, Homo sapiens
ugagcugagaucacacuacugu

SEQ ID NO: 335648 - RNA, 22 nt, Homo sapiens
ugaggaauguguguuaaagaua

SEQ ID NO: 335649 - RNA, 22 nt, Homo sapiens
ugaggagugaacuauuucugau

SEQ ID NO: 335650 - RNA, 22 nt, Homo sapiens
ugaggaguguauuucauucgcu

SEQ ID NO: 335651 - RNA, 22 nt, Homo sapiens
ugaggcuagucagaucagauga

SEQ ID NO: 335652 - RNA, 22 nt, Homo sapiens
ugaggguauagccagcccuuag

SEQ ID NO: 335653 - RNA, 22 nt, Homo sapiens
ugagguaacaaacuaugaguua

SEQ ID NO: 335654 - RNA, 22 nt, Homo sapiens
ugaggugagggguuaggugcua

SEQ ID NO: 335655 - RNA, 22 nt, Homo sapiens
ugaggugaggguaucaaaugcu

SEQ ID NO: 335656 - RNA, 22 nt, Homo sapiens
ugagguguauugggggaaauuc

SEQ ID NO: 335657 - RNA, 22 nt, Homo sapiens
ugagguuauuuguucaagaagu

SEQ ID NO: 335658 - RNA, 22 nt, Homo sapiens
ugagguuguccacuauaaucca

SEQ ID NO: 335659 - RNA, 22 nt, Homo sapiens
ugaguagaacuagucuagagcu

SEQ ID NO: 335660 - RNA, 21 nt, Homo sapiens
ugaguagcuagaacuaggggc

SEQ ID NO: 335661 - RNA, 22 nt, Homo sapiens
ugaguaguauucuaugguaugu

SEQ ID NO: 335662 - RNA, 22 nt, Homo sapiens
ugaguagucagugggcaggaag

SEQ ID NO: 335663 - RNA, 22 nt, Homo sapiens
ugaguauguuuagaaguaaagg

SEQ ID NO: 335664 - RNA, 22 nt, Homo sapiens
ugagucuguucucacauugcua

SEQ ID NO: 335665 - RNA, 22 nt, Homo sapiens
ugaguguccaaguaaggugaaa

SEQ ID NO: 335666 - RNA, 22 nt, Homo sapiens
ugaguuaggagaguguggcucu

SEQ ID NO: 335667 - RNA, 23 nt, Homo sapiens
ugauaacagcauaugaagauucu

SEQ ID NO: 335668 - RNA, 22 nt, Homo sapiens
ugauaagaaauuguucauguag

SEQ ID NO: 335669 - RNA, 22 nt, Homo sapiens
ugauacuggcuucauagaauga

SEQ ID NO: 335670 - RNA, 22 nt, Homo sapiens
ugauaugaaagggaaauaagug

SEQ ID NO: 335671 - RNA, 22 nt, Homo sapiens
ugauaugaaguucaaaccaggu

SEQ ID NO: 335672 - RNA, 22 nt, Homo sapiens
ugauauguguaaacaauguaua

SEQ ID NO: 335673 - RNA, 21 nt, Homo sapiens
ugaucacaugaaaaccaugca

SEQ ID NO: 335674 - RNA, 22 nt, Homo sapiens
ugaucugucacuuaucacauuu

SEQ ID NO: 335675 - RNA, 22 nt, Homo sapiens
ugaucuguguaacauaggaguc

SEQ ID NO: 335676 - RNA, 22 nt, Homo sapiens
ugaugcugaugccugccagaag

SEQ ID NO: 335677 - RNA, 22 nt, Homo sapiens
ugauguugaauuguucagcguc

SEQ ID NO: 335678 - RNA, 22 nt, Homo sapiens
ugauuguucuguccccaggggc

SEQ ID NO: 335679 - RNA, 22 nt, Homo sapiens
ugcaaagucgaaacugcaguuu

SEQ ID NO: 335680 - RNA, 19 nt, Homo sapiens
ugcaaagucuuuuccuauu

SEQ ID NO: 335681 - RNA, 22 nt, Homo sapiens
ugcaaauguuaguaacaccacu

SEQ ID NO: 335682 - RNA, 22 nt, Homo sapiens
ugcaagaaucagccuaucauua

SEQ ID NO: 335683 - RNA, 22 nt, Homo sapiens
ugcaauuuaaugugucccaauu

SEQ ID NO: 335684 - RNA, 22 nt, Homo sapiens
ugcaccacugcaccccagucug

SEQ ID NO: 335685 - RNA, 22 nt, Homo sapiens
ugcaccacuguacuccagucug

SEQ ID NO: 335686 - RNA, 22 nt, Homo sapiens
ugcagagucuguccugccugcc

SEQ ID NO: 335687 - RNA, 20 nt, Homo sapiens
ugcagauucaaccaacugug

SEQ ID NO: 335688 - RNA, 22 nt, Homo sapiens
ugcagcacaguagguuugcaau

SEQ ID NO: 335689 - RNA, 20 nt, Homo sapiens
ugcagcacugggaaugcagu

SEQ ID NO: 335690 - RNA, 22 nt, Homo sapiens
ugcagugugauuuucuggcuga

SEQ ID NO: 335691 - RNA, 22 nt, Homo sapiens
ugcaguuuaggaacugguaaca

SEQ ID NO: 335692 - RNA, 22 nt, Homo sapiens
ugcauaauuccuugcaccagaa

SEQ ID NO: 335693 - RNA, 19 nt, Homo sapiens
ugcauaggguuacauacuc

SEQ ID NO: 335694 - RNA, 23 nt, Homo sapiens
ugcauaguacccaauacuuuauc

SEQ ID NO: 335695 - RNA, 22 nt, Homo sapiens
ugcauggagcucucuuuggacu

SEQ ID NO: 335696 - RNA, 22 nt, Homo sapiens
ugcauuaucagauguuugcuuu

SEQ ID NO: 335697 - RNA, 22 nt, Homo sapiens
ugcauuguaggauguuuagcag

SEQ ID NO: 335698 - RNA, 21 nt, Homo sapiens
ugcauuguugcugagagcagg

SEQ ID NO: 335699 - RNA, 22 nt, Homo sapiens
ugccaacaugccuggcuguuuu

SEQ ID NO: 335700 - RNA, 22 nt, Homo sapiens
ugccaagaacauuuucuguuuu

SEQ ID NO: 335701 - RNA, 22 nt, Homo sapiens
cuuuugugauucuucaguugcu

SEQ ID NO: 335702 - RNA, 22 nt, Homo sapiens
cuuuuguggaucuucuguugcu

SEQ ID NO: 335703 - RNA, 22 nt, Homo sapiens
cuuuuugcaaauacaacucuga

SEQ ID NO: 335704 - RNA, 22 nt, Homo sapiens
gaaagauuuccugagcuagaaa

SEQ ID NO: 335705 - RNA, 22 nt, Homo sapiens
gaaagguaggaacagggugcag

SEQ ID NO: 335706 - RNA, 22 nt, Homo sapiens
gaaaguaauuaacgauuguugc

SEQ ID NO: 335707 - RNA, 22 nt, Homo sapiens
gaaauggaucagagcaagcuuu

SEQ ID NO: 335708 - RNA, 22 nt, Homo sapiens
gaaauguauuaaugaguugaaa

SEQ ID NO: 335709 - RNA, 22 nt, Homo sapiens
uugcagcauucugguuccuggu

SEQ ID NO: 335710 - RNA, 22 nt, Homo sapiens
uugcauaaguugaaccagccuu

SEQ ID NO: 335711 - RNA, 22 nt, Homo sapiens
uugcauguacguacagagagag

SEQ ID NO: 335712 - RNA, 22 nt, Homo sapiens
uugccacuucucuugccccauu

SEQ ID NO: 335713 - RNA, 22 nt, Homo sapiens
uugccuaggcuggagugcagug

SEQ ID NO: 335714 - RNA, 22 nt, Homo sapiens
uugccuauucacucugaugaua

SEQ ID NO: 335715 - RNA, 22 nt, Homo sapiens
uugcuagucucuguuucaggau

SEQ ID NO: 335716 - RNA, 22 nt, Homo sapiens
uugcuuaggcuggagugcagug

SEQ ID NO: 335717 - RNA, 22 nt, Homo sapiens
uugcuuuguuacugcaguuucc

SEQ ID NO: 335718 - RNA, 22 nt, Homo sapiens
uuggaaauguguuugcauucag

SEQ ID NO: 335719 - RNA, 22 nt, Homo sapiens
uuggaagacaaugcugauucuc

SEQ ID NO: 335720 - RNA, 22 nt, Homo sapiens
uuggaagagaagggagauaaac

SEQ ID NO: 335721 - RNA, 22 nt, Homo sapiens
uuggaauuuuaaaauaggcaac

SEQ ID NO: 335722 - RNA, 22 nt, Homo sapiens
uuggaauuuuacuucuguaaga

SEQ ID NO: 335723 - RNA, 22 nt, Homo sapiens
uuggagagucacuaguuagugc

SEQ ID NO: 335724 - RNA, 22 nt, Homo sapiens
uuggagugugagagcagccugg

SEQ ID NO: 335725 - RNA, 22 nt, Homo sapiens
uuggcaaagugucuggcauuua

SEQ ID NO: 335726 - RNA, 22 nt, Homo sapiens
uuggcacuugauaauauucugg

SEQ ID NO: 335727 - RNA, 22 nt, Homo sapiens
uuggcagaauguuagaaacuua

SEQ ID NO: 335728 - RNA, 22 nt, Homo sapiens
uuggcagugguucugacggacc

SEQ ID NO: 335729 - RNA, 22 nt, Homo sapiens
uuggcauugccaaacugucaac

SEQ ID NO: 335730 - RNA, 22 nt, Homo sapiens
uuggccauaugacuugcuuugg

SEQ ID NO: 335731 - RNA, 22 nt, Homo sapiens
uuggcuacagauuaugaauuuc

SEQ ID NO: 335732 - RNA, 22 nt, Homo sapiens
uuggcuguguuucccuacaaau

SEQ ID NO: 335733 - RNA, 22 nt, Homo sapiens
uugggaauguccuaauaucucg

SEQ ID NO: 335734 - RNA, 22 nt, Homo sapiens
uugggcauugcuauaaauucuu

SEQ ID NO: 335735 - RNA, 22 nt, Homo sapiens
uugggcuuuuagguccuuaaca

SEQ ID NO: 335736 - RNA, 21 nt, Homo sapiens
uuggggaauggagagguuuuc

SEQ ID NO: 335737 - RNA, 22 nt, Homo sapiens
uuggggcacggccucuguugcc

SEQ ID NO: 335738 - RNA, 22 nt, Homo sapiens
uuggguaguauagaagcaacaa

SEQ ID NO: 335739 - RNA, 22 nt, Homo sapiens
uuggucaucucccuccuuuuag

SEQ ID NO: 335740 - RNA, 21 nt, Homo sapiens
uuggucuucucugugauucuu

SEQ ID NO: 335741 - RNA, 22 nt, Homo sapiens
uuguaaacaucuguacauugcu

SEQ ID NO: 335742 - RNA, 22 nt, Homo sapiens
uuguaaagaucauaugcuguuc

SEQ ID NO: 335743 - RNA, 22 nt, Homo sapiens
uuguaaagucugucucagucag

SEQ ID NO: 335744 - RNA, 22 nt, Homo sapiens
uuguaacaugcuuucacuucag

SEQ ID NO: 335745 - RNA, 22 nt, Homo sapiens
uuguacaggaguguaagcuuca

SEQ ID NO: 335746 - RNA, 22 nt, Homo sapiens
uuguacuccagccugggugaca

SEQ ID NO: 335747 - RNA, 22 nt, Homo sapiens
uuguaguagcauuauuuauaau

SEQ ID NO: 335748 - RNA, 22 nt, Homo sapiens
uuguccaagucccauuuguuga

SEQ ID NO: 335749 - RNA, 22 nt, Homo sapiens
uuguccccaucugcugccagaa

SEQ ID NO: 335750 - RNA, 22 nt, Homo sapiens
uugugaauggugccgcgauaaa

SEQ ID NO: 335751 - RNA, 22 nt, Homo sapiens
uugugauugagugauccuuguu

SEQ ID NO: 335752 - RNA, 22 nt, Homo sapiens
uugugccugguacauggagaaa

SEQ ID NO: 335753 - RNA, 22 nt, Homo sapiens
uugugcuuaaugaguguaaggu

SEQ ID NO: 335754 - RNA, 22 nt, Homo sapiens
uuguggcuuaucucauuuagcg

SEQ ID NO: 335755 - RNA, 19 nt, Homo sapiens
uugugggaggacagagggg

SEQ ID NO: 335756 - RNA, 22 nt, Homo sapiens
uugugguuuuaucuaccuuugg

SEQ ID NO: 335757 - RNA, 22 nt, Homo sapiens
uugugguuuucagcuuauauau

SEQ ID NO: 335758 - RNA, 22 nt, Homo sapiens
uugugucaaauggcaauuagca

SEQ ID NO: 335759 - RNA, 19 nt, Homo sapiens
uuguguccccacaaaauuc

SEQ ID NO: 335760 - RNA, 22 nt, Homo sapiens
uugugucccugcggcugaggag

SEQ ID NO: 335761 - RNA, 22 nt, Homo sapiens
uuguguuugaugcugacacgca

SEQ ID NO: 335762 - RNA, 22 nt, Homo sapiens
uuguuaagaugcagauucugga

SEQ ID NO: 335763 - RNA, 22 nt, Homo sapiens
uuuaacauuggaugagaucguc

SEQ ID NO: 335764 - RNA, 22 nt, Homo sapiens
uuuaauacugcaucuuuacucu

SEQ ID NO: 335765 - RNA, 22 nt, Homo sapiens
uuuaaugcugcccagucauggg

SEQ ID NO: 335766 - RNA, 22 nt, Homo sapiens
uuuacagucucauagguggaag

SEQ ID NO: 335767 - RNA, 22 nt, Homo sapiens
uuuagcaaugcuguggggaagu

SEQ ID NO: 335768 - RNA, 22 nt, Homo sapiens
uuuagguuacauauaauccaaa

SEQ ID NO: 335769 - RNA, 22 nt, Homo sapiens
uuuauugcucuaaaguugccau

SEQ ID NO: 335770 - RNA, 22 nt, Homo sapiens
uuucacagcaauugccuauugu

SEQ ID NO: 335771 - RNA, 22 nt, Homo sapiens
uuucagcguggggugcugaaga

SEQ ID NO: 335772 - RNA, 22 nt, Homo sapiens
uuucaggcagggagcuucagug

SEQ ID NO: 335773 - RNA, 18 nt, Homo sapiens
uuucauugagugugauau

SEQ ID NO: 335774 - RNA, 22 nt, Homo sapiens
uuuccagguggccaacauuuua

SEQ ID NO: 335775 - RNA, 19 nt, Homo sapiens
uuucccugcagaccuacua

SEQ ID NO: 335776 - RNA, 17 nt, Homo sapiens
uuucucagcccucuucu

SEQ ID NO: 335777 - RNA, 22 nt, Homo sapiens
uuucucaguguuucaggguagg

SEQ ID NO: 335778 - RNA, 22 nt, Homo sapiens
uuucugcuugagagaauugcug

SEQ ID NO: 335779 - RNA, 22 nt, Homo sapiens
uuucuuggagcucuuagggucg

SEQ ID NO: 335780 - RNA, 22 nt, Homo sapiens
uuugaaaguaauuugguuggug

SEQ ID NO: 335781 - RNA, 22 nt, Homo sapiens
uuugaaccauuugaagaaugau

SEQ ID NO: 335782 - RNA, 22 nt, Homo sapiens
uuugaagcaauugugaauggga

SEQ ID NO: 335783 - RNA, 19 nt, Homo sapiens
uuugaauauaaugcagcua

SEQ ID NO: 335784 - RNA, 20 nt, Homo sapiens
uuugaauguaaagcauguca

SEQ ID NO: 335785 - RNA, 22 nt, Homo sapiens
uuugagcuagagucucacucug

SEQ ID NO: 335786 - RNA, 22 nt, Homo sapiens
uuugaggaaaggcauaaguagg

SEQ ID NO: 335787 - RNA, 22 nt, Homo sapiens
uuugaguaggcuuauauuuugg

SEQ ID NO: 335788 - RNA, 21 nt, Homo sapiens
uuugaucauuaaaagugaauc

SEQ ID NO: 335789 - RNA, 22 nt, Homo sapiens
uuugauugguguaccugaaagu

SEQ ID NO: 335790 - RNA, 22 nt, Homo sapiens
uuugcaauagguuguggggagg

SEQ ID NO: 335791 - RNA, 21 nt, Homo sapiens
uuugcacuuugcaaaucccua

SEQ ID NO: 335792 - RNA, 22 nt, Homo sapiens
uuugcaguguaguuggccagca

SEQ ID NO: 335793 - RNA, 21 nt, Homo sapiens
uuugcauauguugaaccagcc

SEQ ID NO: 335794 - RNA, 22 nt, Homo sapiens
uuugcauauguugaaccagccu

SEQ ID NO: 335795 - RNA, 23 nt, Homo sapiens
uuugccacuuauuagcugggagg

SEQ ID NO: 335796 - RNA, 22 nt, Homo sapiens
gaacccuggaggcggagguugc

SEQ ID NO: 335797 - RNA, 22 nt, Homo sapiens
gaacuguuucuggugaaagagu

SEQ ID NO: 335798 - RNA, 18 nt, Homo sapiens
gaagaaguaggcauggca

SEQ ID NO: 335799 - RNA, 22 nt, Homo sapiens
gaaggcaugcugcauggccaga

SEQ ID NO: 335800 - RNA, 19 nt, Homo sapiens
gaaguguuguccuccagua

SEQ ID NO: 335801 - RNA, 22 nt, Homo sapiens
gaauagugcugcaauaaacaua

SEQ ID NO: 335802 - RNA, 22 nt, Homo sapiens
gaauucugucgcuuacuagaug

SEQ ID NO: 335803 - RNA, 22 nt, Homo sapiens
gacacuggguguuuguuggcgu

SEQ ID NO: 335804 - RNA, 22 nt, Homo sapiens
gacagugagaugucaugugaaa

SEQ ID NO: 335805 - RNA, 18 nt, Homo sapiens
gacagugugaagauuccu

SEQ ID NO: 335806 - RNA, 18 nt, Homo sapiens
gacaguguggcgauuccu

SEQ ID NO: 335807 - RNA, 22 nt, Homo sapiens
gacaguguggcgauuccucaag

SEQ ID NO: 335808 - RNA, 22 nt, Homo sapiens
gacaguuuggugaggaagacga

SEQ ID NO: 335809 - RNA, 21 nt, Homo sapiens
gacauggcgauacuccgucuc

SEQ ID NO: 335810 - RNA, 20 nt, Homo sapiens
gacauguugguuugcugcac

SEQ ID NO: 335811 - RNA, 22 nt, Homo sapiens
gaccugagagguacauguauuu

SEQ ID NO: 335812 - RNA, 22 nt, Homo sapiens
gaccuuguagaaucucaugauu

SEQ ID NO: 335813 - RNA, 17 nt, Homo sapiens
gacgaucaucaggaggc

SEQ ID NO: 335814 - RNA, 22 nt, Homo sapiens
gacguagagaaaugugaaaugg

SEQ ID NO: 335815 - RNA, 16 nt, Homo sapiens
gacuaauacaaaggaa

SEQ ID NO: 335816 - RNA, 22 nt, Homo sapiens
gacuaggagagcagcugcccau

SEQ ID NO: 335817 - RNA, 22 nt, Homo sapiens
gacugaguaagcagaagcaauu

SEQ ID NO: 335818 - RNA, 22 nt, Homo sapiens
gacugcauuugccccaucgaau

SEQ ID NO: 335819 - RNA, 16 nt, Homo sapiens
gacugggcugaggaau

SEQ ID NO: 335820 - RNA, 22 nt, Homo sapiens
gacuuugguaaacucgguggca

SEQ ID NO: 335821 - RNA, 22 nt, Homo sapiens
gagaacaguguuguauuuuuuc

SEQ ID NO: 335822 - RNA, 22 nt, Homo sapiens
gagaacauacggcauuugguuu

SEQ ID NO: 335823 - RNA, 22 nt, Homo sapiens
gagaaguaaauuuauuugcaaa

SEQ ID NO: 335824 - RNA, 22 nt, Homo sapiens
gagacagugucagccauugaaa

SEQ ID NO: 335825 - RNA, 22 nt, Homo sapiens
gagacauguuugcuuaucugag

SEQ ID NO: 335826 - RNA, 20 nt, Homo sapiens
gagaccugagauucacucaa

SEQ ID NO: 335827 - RNA, 22 nt, Homo sapiens
gagacggagucucgcucugucg

SEQ ID NO: 335828 - RNA, 22 nt, Homo sapiens
gagacggagucuugcucuguug

SEQ ID NO: 335829 - RNA, 22 nt, Homo sapiens
gagacugagucucacucuguca

SEQ ID NO: 335830 - RNA, 22 nt, Homo sapiens
gagagcaugugcuggcaucagu

SEQ ID NO: 335831 - RNA, 22 nt, Homo sapiens
gagagcuaggccacuggggcuu

SEQ ID NO: 335832 - RNA, 22 nt, Homo sapiens
gagagugcuuggcaucugcuga

SEQ ID NO: 335833 - RNA, 22 nt, Homo sapiens
gagaucaaguauucuccacuaa

SEQ ID NO: 335834 - RNA, 22 nt, Homo sapiens
gagaucaaugggauggaauuga

SEQ ID NO: 335835 - RNA, 22 nt, Homo sapiens
gagaucauguacuagaacaccu

SEQ ID NO: 335836 - RNA, 22 nt, Homo sapiens
gagaugaaaucuugcucuguca

SEQ ID NO: 335837 - RNA, 22 nt, Homo sapiens
gagauggagacuuggccuuaaa

SEQ ID NO: 335838 - RNA, 22 nt, Homo sapiens
gagauggagucuuuuucuguca

SEQ ID NO: 335839 - RNA, 22 nt, Homo sapiens
gagaugguguuccacugccagu

SEQ ID NO: 335840 - RNA, 22 nt, Homo sapiens
gagauguuuuguuaucaaagga

SEQ ID NO: 335841 - RNA, 22 nt, Homo sapiens
gagcaaugauugagccacugua

SEQ ID NO: 335842 - RNA, 22 nt, Homo sapiens
gagcacccuuuguugauugcaa

SEQ ID NO: 335843 - RNA, 18 nt, Homo sapiens
gagcaccuuuuuugcaga

SEQ ID NO: 335844 - RNA, 22 nt, Homo sapiens
gagcacugaauacugugguggu

SEQ ID NO: 335845 - RNA, 22 nt, Homo sapiens
gagccggugugauggggcuucu

SEQ ID NO: 335846 - RNA, 20 nt, Homo sapiens
gagcucaucuucuuuaccac

SEQ ID NO: 335847 - RNA, 22 nt, Homo sapiens
gagcucauuaaaguaggaccua

SEQ ID NO: 335848 - RNA, 22 nt, Homo sapiens
gaggaaguuuacaaagcaucug

SEQ ID NO: 335849 - RNA, 22 nt, Homo sapiens
gaggagauauucugcuggaugg

SEQ ID NO: 335850 - RNA, 22 nt, Homo sapiens
gaggcaauaugagggaggcuuc

SEQ ID NO: 335851 - RNA, 22 nt, Homo sapiens
gaggcagucuguccauucucag

SEQ ID NO: 335852 - RNA, 22 nt, Homo sapiens
gagguaagaaagucaguccuuc

SEQ ID NO: 335853 - RNA, 22 nt, Homo sapiens
gagguagguacaauugccacca

SEQ ID NO: 335854 - RNA, 22 nt, Homo sapiens
gagguauggauaucuggagagg

SEQ ID NO: 335855 - RNA, 22 nt, Homo sapiens
gaggucuuacauuuuaauauuu

SEQ ID NO: 335856 - RNA, 22 nt, Homo sapiens
gagguggauacauuaaauaaug

SEQ ID NO: 335857 - RNA, 22 nt, Homo sapiens
gaggugguagguucacagcagc

SEQ ID NO: 335858 - RNA, 22 nt, Homo sapiens
gagguugggaugagggauacag

SEQ ID NO: 335859 - RNA, 22 nt, Homo sapiens
gaguaucuuuaaggugguuugg

SEQ ID NO: 335860 - RNA, 21 nt, Homo sapiens
gagugcaaauaaagagagggc

SEQ ID NO: 335861 - RNA, 22 nt, Homo sapiens
gagugcaauggcagaucuccgc

SEQ ID NO: 335862 - RNA, 22 nt, Homo sapiens
gagugcugagcccacuuccuug

SEQ ID NO: 335863 - RNA, 22 nt, Homo sapiens
gagugcuguuagcccuggguuu

SEQ ID NO: 335864 - RNA, 21 nt, Homo sapiens
gaguggcuuuuguuucaccag

SEQ ID NO: 335865 - RNA, 22 nt, Homo sapiens
gaguucaaaucucagcucuguu

SEQ ID NO: 335866 - RNA, 22 nt, Homo sapiens
gauacuggcuuuauagaaugau

SEQ ID NO: 335867 - RNA, 22 nt, Homo sapiens
gauauguacagcucucuaggau

SEQ ID NO: 335868 - RNA, 22 nt, Homo sapiens
gauauguguaucuauguacaug

SEQ ID NO: 335869 - RNA, 22 nt, Homo sapiens
gaucacaguuccucacgggcau

SEQ ID NO: 335870 - RNA, 22 nt, Homo sapiens
gaucacauggccauuucuagcu

SEQ ID NO: 335871 - RNA, 22 nt, Homo sapiens
gaucucaguggauacugugaug

SEQ ID NO: 335872 - RNA, 22 nt, Homo sapiens
gauggaauuaaaaucagaauca

SEQ ID NO: 335873 - RNA, 22 nt, Homo sapiens
gauggaguaauguaaucuugag

SEQ ID NO: 335874 - RNA, 22 nt, Homo sapiens
gauggaguugacuaagacaaca

SEQ ID NO: 335875 - RNA, 22 nt, Homo sapiens
gauggauuuuaagugaaugaaa

SEQ ID NO: 335876 - RNA, 22 nt, Homo sapiens
gauggcacuaagccauguagga

SEQ ID NO: 335877 - RNA, 22 nt, Homo sapiens
gauggcaugugcugccaccaag

SEQ ID NO: 335878 - RNA, 22 nt, Homo sapiens
gauggguuuuuugaagacagca

SEQ ID NO: 335879 - RNA, 22 nt, Homo sapiens
gauuuguuggccugugagcuag

SEQ ID NO: 335880 - RNA, 22 nt, Homo sapiens
gcaaaauugagaagggaauaua

SEQ ID NO: 335881 - RNA, 22 nt, Homo sapiens
gcaacugguuucaguuuuucag

SEQ ID NO: 335882 - RNA, 22 nt, Homo sapiens
gcaagacaugucuaagguuuaa

SEQ ID NO: 335883 - RNA, 22 nt, Homo sapiens
uuugcuuaguaaauguagaaaa

SEQ ID NO: 335884 - RNA, 22 nt, Homo sapiens
uuuggaagaugccacuguauca

SEQ ID NO: 335885 - RNA, 20 nt, Homo sapiens
uuuggcaauaggguuuuugu

SEQ ID NO: 335886 - RNA, 22 nt, Homo sapiens
uuuggcacuauagguaaauuug

SEQ ID NO: 335887 - RNA, 22 nt, Homo sapiens
uuuggcagaugacccucaaguu

SEQ ID NO: 335888 - RNA, 22 nt, Homo sapiens
uuuggcauuuuacuacucaaau

SEQ ID NO: 335889 - RNA, 22 nt, Homo sapiens
uuuggccauguuggucaggcug

SEQ ID NO: 335890 - RNA, 18 nt, Homo sapiens
uuuggcuguucaugacuc

SEQ ID NO: 335891 - RNA, 22 nt, Homo sapiens
uuugggaaugaguuuaucauuu

SEQ ID NO: 335892 - RNA, 22 nt, Homo sapiens
uuugggaaugguuugucuccca

SEQ ID NO: 335893 - RNA, 22 nt, Homo sapiens
uuugggccauggcuuuuccacg

SEQ ID NO: 335894 - RNA, 22 nt, Homo sapiens
uuugggccaugguuuguguaua

SEQ ID NO: 335895 - RNA, 22 nt, Homo sapiens
uuuggucacugccgccgccagc

SEQ ID NO: 335896 - RNA, 22 nt, Homo sapiens
uuugguccuccuacagggcagg

SEQ ID NO: 335897 - RNA, 18 nt, Homo sapiens
uuugguccuuuauaaaca

SEQ ID NO: 335898 - RNA, 22 nt, Homo sapiens
uuuggucuuuuguaaguuaucu

SEQ ID NO: 335899 - RNA, 22 nt, Homo sapiens
uuuguacuucauugguucuacu

SEQ ID NO: 335900 - RNA, 22 nt, Homo sapiens
uuuguacuugaaacccagggcc

SEQ ID NO: 335901 - RNA, 22 nt, Homo sapiens
uuuguacuugguguucuggaaa

SEQ ID NO: 335902 - RNA, 22 nt, Homo sapiens
uuugucaauaacuaccaacagg

SEQ ID NO: 335903 - RNA, 22 nt, Homo sapiens
uuugucacccugaauguaagau

SEQ ID NO: 335904 - RNA, 22 nt, Homo sapiens
uuugucauagcagcaggaaugg

SEQ ID NO: 335905 - RNA, 22 nt, Homo sapiens
uuugucccccguaguucauaua

SEQ ID NO: 335906 - RNA, 22 nt, Homo sapiens
uuugugacucauggucuagugc

SEQ ID NO: 335907 - RNA, 22 nt, Homo sapiens
uuugugaggugauggauauguc

SEQ ID NO: 335908 - RNA, 22 nt, Homo sapiens
uuugugagguggauagauugca

SEQ ID NO: 335909 - RNA, 22 nt, Homo sapiens
uuugugcuauguuauauauucu

SEQ ID NO: 335910 - RNA, 18 nt, Homo sapiens
uuugugcuccacaaagga

SEQ ID NO: 335911 - RNA, 22 nt, Homo sapiens
uuugugcugcaauuaauuuccc

SEQ ID NO: 335912 - RNA, 21 nt, Homo sapiens
uuugugguuacugugugagcu

SEQ ID NO: 335913 - RNA, 22 nt, Homo sapiens
uuuguguccccacccacaucuc

SEQ ID NO: 335914 - RNA, 22 nt, Homo sapiens
uuuguuugaagucgagacaacu

SEQ ID NO: 335915 - RNA, 22 nt, Homo sapiens
uuuuaacagccaggggacggcc

SEQ ID NO: 335916 - RNA, 20 nt, Homo sapiens
uuuuagcuuuuauugaaagc

SEQ ID NO: 335917 - RNA, 22 nt, Homo sapiens
uuuucacggugucccagagagu

SEQ ID NO: 335918 - RNA, 20 nt, Homo sapiens
uuuugcacuccuacuaaggu

SEQ ID NO: 335919 - RNA, 22 nt, Homo sapiens
uuuugcacuguuuuaucugaca

SEQ ID NO: 335920 - RNA, 22 nt, Homo sapiens
uuuugcaguuacagagagugag

SEQ ID NO: 335921 - RNA, 22 nt, Homo sapiens
uuuugcuccuggcaaacucaua

SEQ ID NO: 335922 - RNA, 19 nt, Homo sapiens
uuuuggaaaugugaacagc

SEQ ID NO: 335923 - RNA, 17 nt, Homo sapiens
uuuuggauuagaaaucc

SEQ ID NO: 335924 - RNA, 22 nt, Homo sapiens
uuuuggcuagaaauauaccucc

SEQ ID NO: 335925 - RNA, 22 nt, Homo sapiens
uuuuggcucuugguaggucaga

SEQ ID NO: 335926 - RNA, 22 nt, Homo sapiens
uuuuggcuuaaagagaauguau

SEQ ID NO: 335927 - RNA, 22 nt, Homo sapiens
uuuugguuaggauggguggcau

SEQ ID NO: 335928 - RNA, 22 nt, Homo sapiens
uuuugguucaauuaauuugcua

SEQ ID NO: 335929 - RNA, 22 nt, Homo sapiens
uuuugucccaugggcuguuccc

SEQ ID NO: 335930 - RNA, 18 nt, Homo sapiens
uuuuugaggcacagggga

SEQ ID NO: 335931 - RNA, 22 nt, Homo sapiens
gggaguagagaguuucucugac

SEQ ID NO: 335932 - RNA, 22 nt, Homo sapiens
gggagugugcacacaugguaua

SEQ ID NO: 335933 - RNA, 22 nt, Homo sapiens
gggaucaacuuauacuaaaauu

SEQ ID NO: 335934 - RNA, 22 nt, Homo sapiens
gggauguuuuauacugagccug

SEQ ID NO: 335935 - RNA, 22 nt, Homo sapiens
gggcaguauggucauuuucaca

SEQ ID NO: 335936 - RNA, 22 nt, Homo sapiens
gggcaugaugucuuaugccuau

SEQ ID NO: 335937 - RNA, 22 nt, Homo sapiens
ggggaauguuaaagaauuugca

SEQ ID NO: 335938 - RNA, 22 nt, Homo sapiens
ggggucaucagagaaucuaccc

SEQ ID NO: 335939 - RNA, 22 nt, Homo sapiens
ggguaggcaagcggaugucaga

SEQ ID NO: 335940 - RNA, 22 nt, Homo sapiens
gguauuauuugccuuuuacuga

SEQ ID NO: 335941 - RNA, 22 nt, Homo sapiens
gguauuuaaaguaccugucugc

SEQ ID NO: 335942 - RNA, 19 nt, Homo sapiens
ggucacagggguuacaagg

SEQ ID NO: 335943 - RNA, 22 nt, Homo sapiens
ggucacauuggacuaucaaguu

SEQ ID NO: 335944 - RNA, 22 nt, Homo sapiens
ggucaguguuaucaccgaagga

SEQ ID NO: 335945 - RNA, 22 nt, Homo sapiens
ggugacugguuuaucuggcagu

SEQ ID NO: 335946 - RNA, 22 nt, Homo sapiens
ggugagaaaaacauagucucag

SEQ ID NO: 335947 - RNA, 21 nt, Homo sapiens
ggugagaaaggagacauagac

SEQ ID NO: 335948 - RNA, 22 nt, Homo sapiens
ggugagguaggaaaaguuagga

SEQ ID NO: 335949 - RNA, 22 nt, Homo sapiens
ggugcuugaggaacggaggcug

SEQ ID NO: 335950 - RNA, 20 nt, Homo sapiens
guaaacucucagcauagaug

SEQ ID NO: 335951 - RNA, 22 nt, Homo sapiens
guaaaugcagaugcaugaccuu

SEQ ID NO: 335952 - RNA, 22 nt, Homo sapiens
guaaggaguaguguaacagugc

SEQ ID NO: 335953 - RNA, 22 nt, Homo sapiens
guaauacuuuugggauauuaga

SEQ ID NO: 335954 - RNA, 22 nt, Homo sapiens
guaaucucagcuacucgggaga

SEQ ID NO: 335955 - RNA, 22 nt, Homo sapiens
guaaugcacucccaaagaucca

SEQ ID NO: 335956 - RNA, 22 nt, Homo sapiens
guacaaguaagaaaauugccca

SEQ ID NO: 335957 - RNA, 22 nt, Homo sapiens
guacacaacaugcagguuuguu

SEQ ID NO: 335958 - RNA, 22 nt, Homo sapiens
guacaguauaguaauaggauuu

SEQ ID NO: 335959 - RNA, 22 nt, Homo sapiens
guacaguuuagugcuuugagaa

SEQ ID NO: 335960 - RNA, 22 nt, Homo sapiens
guacauagucacacauauacau

SEQ ID NO: 335961 - RNA, 22 nt, Homo sapiens
guacaugcauaguuuauuucug

SEQ ID NO: 335962 - RNA, 22 nt, Homo sapiens
guacauguaugcaugcaugcau

SEQ ID NO: 335963 - RNA, 22 nt, Homo sapiens
guagaaaguuugcugucacaug

SEQ ID NO: 335964 - RNA, 22 nt, Homo sapiens
guagcaccagugcucuucucaa

SEQ ID NO: 335965 - RNA, 22 nt, Homo sapiens
guagcagcaauuuacuccauac

SEQ ID NO: 335966 - RNA, 22 nt, Homo sapiens
guaguggcaugaucuuggcuca

SEQ ID NO: 335967 - RNA, 22 nt, Homo sapiens
guaucaugaaguuucuucauuu

SEQ ID NO: 335968 - RNA, 22 nt, Homo sapiens
guauccugaaguucucagcacu

SEQ ID NO: 335969 - RNA, 22 nt, Homo sapiens
guaugguacuuuaugguuagug

SEQ ID NO: 335970 - RNA, 22 nt, Homo sapiens
guaugucuugucuauggcugcu

SEQ ID NO: 335971 - RNA, 19 nt, Homo sapiens
guauuugacuuucuuguuu

SEQ ID NO: 335972 - RNA, 22 nt, Homo sapiens
gucaaggaauuuauccauuucu

SEQ ID NO: 335973 - RNA, 22 nt, Homo sapiens
gucaagugaagaccugacucuu

SEQ ID NO: 335974 - RNA, 22 nt, Homo sapiens
gucacagaaaaagauaugccaa

SEQ ID NO: 335975 - RNA, 22 nt, Homo sapiens
uguccaguguuccucagaagaa

SEQ ID NO: 335976 - RNA, 19 nt, Homo sapiens
ugucccagccauagaggca

SEQ ID NO: 335977 - RNA, 22 nt, Homo sapiens
ugucccaguuggguauugaauu

SEQ ID NO: 335978 - RNA, 22 nt, Homo sapiens
ugucccguuuucgaggcugcag

SEQ ID NO: 335979 - RNA, 19 nt, Homo sapiens
uguccuagaggaguucaca

SEQ ID NO: 335980 - RNA, 22 nt, Homo sapiens
ugucucccuucccauuaggaag

SEQ ID NO: 335981 - RNA, 22 nt, Homo sapiens
ugucuuugguucaggcaaggag

SEQ ID NO: 335982 - RNA, 22 nt, Homo sapiens
ugucuuuguuaguuguccuagu

SEQ ID NO: 335983 - RNA, 21 nt, Homo sapiens
ugugaaaucuaggcagagguu

SEQ ID NO: 335984 - RNA, 19 nt, Homo sapiens
ugugaacaucacagagugu

SEQ ID NO: 335985 - RNA, 22 nt, Homo sapiens
ugugaagaugagaugacgcccu

SEQ ID NO: 335986 - RNA, 22 nt, Homo sapiens
ugugaagauggacuaauauagu

SEQ ID NO: 335987 - RNA, 22 nt, Homo sapiens
ugugaauggugcugcaaugaac

SEQ ID NO: 335988 - RNA, 22 nt, Homo sapiens
ugugacaaauuuaguggacugu

SEQ ID NO: 335989 - RNA, 22 nt, Homo sapiens
ugugacagcacagcaucucuuu

SEQ ID NO: 335990 - RNA, 22 nt, Homo sapiens
ugugacagguauccuguguucu

SEQ ID NO: 335991 - RNA, 22 nt, Homo sapiens
ugugacaguguuacauuucaug

SEQ ID NO: 335992 - RNA, 22 nt, Homo sapiens
ugugaucaugguauuaaucugc

SEQ ID NO: 335993 - RNA, 22 nt, Homo sapiens
ugugaugguuuagcauuuucuu

SEQ ID NO: 335994 - RNA, 22 nt, Homo sapiens
ugugaugugaugagaaguuccu

SEQ ID NO: 335995 - RNA, 22 nt, Homo sapiens
ugugauuauuuaaauaggacag

SEQ ID NO: 335996 - RNA, 22 nt, Homo sapiens
ugugauuauuuauagacaguca

SEQ ID NO: 335997 - RNA, 22 nt, Homo sapiens
ugugcaaaaguaauugcgguuu

SEQ ID NO: 335998 - RNA, 22 nt, Homo sapiens
ugugcacaacaugcagguuugu

SEQ ID NO: 335999 - RNA, 22 nt, Homo sapiens
ugugcacuggaccuugucuucu

SEQ ID NO: 336000 - RNA, 22 nt, Homo sapiens
ugugcauauaaguguguauaua

SEQ ID NO: 336001 - RNA, 22 nt, Homo sapiens
ugugccacuccagcucuagcuu

SEQ ID NO: 336002 - RNA, 22 nt, Homo sapiens
ugugccacuccaggaggcuguu

SEQ ID NO: 336003 - RNA, 22 nt, Homo sapiens
ugugccacugcacuccugccug

SEQ ID NO: 336004 - RNA, 22 nt, Homo sapiens
ugugccuacugauagagccaag

SEQ ID NO: 336005 - RNA, 22 nt, Homo sapiens
ugugcugaucgggcacgguguc

SEQ ID NO: 336006 - RNA, 22 nt, Homo sapiens
uguggaaauaaaagaaagguua

SEQ ID NO: 336007 - RNA, 22 nt, Homo sapiens
uguggaguguaugugacagaga

SEQ ID NO: 336008 - RNA, 22 nt, Homo sapiens
uguggcacuguguccagagaaa

SEQ ID NO: 336009 - RNA, 22 nt, Homo sapiens
uguggcugguggcaccuuuucc

SEQ ID NO: 336010 - RNA, 18 nt, Homo sapiens
uguggcuguuuuccaaua

SEQ ID NO: 336011 - RNA, 22 nt, Homo sapiens
uguggcuuuguaaccauggguc

SEQ ID NO: 336012 - RNA, 22 nt, Homo sapiens
ugugguagugcuuaccugcagu

SEQ ID NO: 336013 - RNA, 22 nt, Homo sapiens
uguguaaagcuuguuccagaaa

SEQ ID NO: 336014 - RNA, 22 nt, Homo sapiens
uguguaaauacaagugcuugaa

SEQ ID NO: 336015 - RNA, 22 nt, Homo sapiens
uguguaaauauauacacacgug

SEQ ID NO: 336016 - RNA, 22 nt, Homo sapiens
ugugucuugaauuuuguaugua

SEQ ID NO: 336017 - RNA, 21 nt, Homo sapiens
uguuaacaugcagauuacugg

SEQ ID NO: 336018 - RNA, 22 nt, Homo sapiens
uguuacagcagaauugaaagag

SEQ ID NO: 336019 - RNA, 22 nt, Homo sapiens
uguuauguauggagugauccca

SEQ ID NO: 336020 - RNA, 22 nt, Homo sapiens
uguucuggagaggcaggccaca

SEQ ID NO: 336021 - RNA, 22 nt, Homo sapiens
uguugcacuccagccuagguga

SEQ ID NO: 336022 - RNA, 19 nt, Homo sapiens
uguugcacuccagcuuggg

SEQ ID NO: 336023 - RNA, 22 nt, Homo sapiens
uguugguuaaaucagguuuuaa

SEQ ID NO: 336024 - RNA, 22 nt, Homo sapiens
uguuuguuugagauggagucuc

SEQ ID NO: 336025 - RNA, 21 nt, Homo sapiens
uguuuuugcuguguaucucuc

SEQ ID NO: 336026 - RNA, 22 nt, Homo sapiens
uuaaagugaucauaaggauagu

SEQ ID NO: 336027 - RNA, 20 nt, Homo sapiens
uuaaaucuagugcagacuca

SEQ ID NO: 336028 - RNA, 22 nt, Homo sapiens
uuaaaugcauagaauguguagu

SEQ ID NO: 336029 - RNA, 22 nt, Homo sapiens
uuaaaugcuagaauuuucuuug

SEQ ID NO: 336030 - RNA, 22 nt, Homo sapiens
uuaaaugcucacauaaagguag

SEQ ID NO: 336031 - RNA, 21 nt, Homo sapiens
uuaacagacaagugucuuccc

SEQ ID NO: 336032 - RNA, 22 nt, Homo sapiens
uuaagacaccaaucauuggauu

SEQ ID NO: 336033 - RNA, 22 nt, Homo sapiens
uuaagaugcauuuugaaguuaa

SEQ ID NO: 336034 - RNA, 22 nt, Homo sapiens
uuaagccaggugugguggcaca

SEQ ID NO: 336035 - RNA, 22 nt, Homo sapiens
uuaagcucauuuccauucuaca

SEQ ID NO: 336036 - RNA, 22 nt, Homo sapiens
uuaaggccugaagcucauaaag

SEQ ID NO: 336037 - RNA, 22 nt, Homo sapiens
uuaaggcuuuaaguaaacacag

SEQ ID NO: 336038 - RNA, 22 nt, Homo sapiens
uuaagggaggagcuucaagaug

SEQ ID NO: 336039 - RNA, 22 nt, Homo sapiens
uuaagugaauuaucuaacaugu

SEQ ID NO: 336040 - RNA, 19 nt, Homo sapiens
uuaagugugauaucucagu

SEQ ID NO: 336041 - RNA, 22 nt, Homo sapiens
uuaaguuaggcuucagcagucu

SEQ ID NO: 336042 - RNA, 22 nt, Homo sapiens
uuaaucuguucucuguauucua

SEQ ID NO: 336043 - RNA, 22 nt, Homo sapiens
uuaauuguccaaguucaucucu

SEQ ID NO: 336044 - RNA, 22 nt, Homo sapiens
uuacaaguggcaucucucugga

SEQ ID NO: 336045 - RNA, 22 nt, Homo sapiens
uuacacguaauaguaagccugg

SEQ ID NO: 336046 - RNA, 22 nt, Homo sapiens
uuacaggacuaagcagcuuugc

SEQ ID NO: 336047 - RNA, 22 nt, Homo sapiens
uuacagucaaguuacauuucuc

SEQ ID NO: 336048 - RNA, 22 nt, Homo sapiens
uuacaguucugguggagaggua

SEQ ID NO: 336049 - RNA, 21 nt, Homo sapiens
uuacaguugguugugaggugg

SEQ ID NO: 336050 - RNA, 22 nt, Homo sapiens
uuaccuugcacugagucugaaa

SEQ ID NO: 336051 - RNA, 22 nt, Homo sapiens
uuagacacacauacauuuaucu

SEQ ID NO: 336052 - RNA, 22 nt, Homo sapiens
uuagagcacugaucugcucuuu

SEQ ID NO: 336053 - RNA, 22 nt, Homo sapiens
uuagaguacaggggaaucaagg

SEQ ID NO: 336054 - RNA, 18 nt, Homo sapiens
uuagagugcauuacuuug

SEQ ID NO: 336055 - RNA, 22 nt, Homo sapiens
uuagaguguagcaggaagaggc

SEQ ID NO: 336056 - RNA, 23 nt, Homo sapiens
uuagaucuuuaaggaaucuccac

SEQ ID NO: 336057 - RNA, 22 nt, Homo sapiens
uuagcagcaugaaaauggacug

SEQ ID NO: 336058 - RNA, 22 nt, Homo sapiens
uuagcccaucuugaggaaagua

SEQ ID NO: 336059 - RNA, 21 nt, Homo sapiens
uuaggcagugucagaggugag

SEQ ID NO: 336060 - RNA, 22 nt, Homo sapiens
uuaggcuuuucagacacuucau

SEQ ID NO: 336061 - RNA, 22 nt, Homo sapiens
uuagguaauauauugcugcuuu

SEQ ID NO: 336062 - RNA, 22 nt, Homo sapiens
uuagguagucucugucagaggg

SEQ ID NO: 336063 - RNA, 23 nt, Homo sapiens
uuaguaaacucaaugacaccaca

SEQ ID NO: 336064 - RNA, 20 nt, Homo sapiens
uuaguucauuuagaagguuu

SEQ ID NO: 336065 - RNA, 22 nt, Homo sapiens
uuauacuacuauaaagagguag

SEQ ID NO: 336066 - RNA, 18 nt, Homo sapiens
uuauacuccccaggcaau

SEQ ID NO: 336067 - RNA, 22 nt, Homo sapiens
uuauagcuaacaucugugaaaa

SEQ ID NO: 336068 - RNA, 22 nt, Homo sapiens
uuauaggcaggugguguagaug

SEQ ID NO: 336069 - RNA, 22 nt, Homo sapiens
uuauagguuucuacaggacuau

SEQ ID NO: 336070 - RNA, 21 nt, Homo sapiens
uuauaguggcaugauuuauaa

SEQ ID NO: 336071 - RNA, 22 nt, Homo sapiens
uuaucccacuuucuguuccugu

SEQ ID NO: 336072 - RNA, 22 nt, Homo sapiens
uuaucucagugaacugagugga

SEQ ID NO: 336073 - RNA, 22 nt, Homo sapiens
uuaugaaguagguuaagagcag

SEQ ID NO: 336074 - RNA, 22 nt, Homo sapiens
uuaugacuuucagcuaggggau

SEQ ID NO: 336075 - RNA, 22 nt, Homo sapiens
uuauggcaaugccccacuccua

SEQ ID NO: 336076 - RNA, 22 nt, Homo sapiens
uuaugguacaugugcacaaugu

SEQ ID NO: 336077 - RNA, 22 nt, Homo sapiens
uuaugucuuugagcaaugcugu

SEQ ID NO: 336078 - RNA, 22 nt, Homo sapiens
uuauuauguuggugcaaaggua

SEQ ID NO: 336079 - RNA, 17 nt, Homo sapiens
uuauugcuauaagcuga

SEQ ID NO: 336080 - RNA, 22 nt, Homo sapiens
uucaaaaccucugcuuaagccc

SEQ ID NO: 336081 - RNA, 22 nt, Homo sapiens
uucaaaguuggaggacaaacug

SEQ ID NO: 336082 - RNA, 22 nt, Homo sapiens
uucaagauggcaccagugagug

SEQ ID NO: 336083 - RNA, 22 nt, Homo sapiens
uucaagauggccccagugagcc

SEQ ID NO: 336084 - RNA, 22 nt, Homo sapiens
uucaaguaagaaagacaucagg

SEQ ID NO: 336085 - RNA, 22 nt, Homo sapiens
uucaaguagguaggaccacagg

SEQ ID NO: 336086 - RNA, 22 nt, Homo sapiens
uucaaguguucaggagcuacag

SEQ ID NO: 336087 - RNA, 22 nt, Homo sapiens
uucacagagagaacucaaacca

SEQ ID NO: 336088 - RNA, 22 nt, Homo sapiens
uucacagaguuauuuuuaugcu

SEQ ID NO: 336089 - RNA, 20 nt, Homo sapiens
uucacaggcagcuucuuucu

SEQ ID NO: 336090 - RNA, 22 nt, Homo sapiens
uucacaguggugggagacguca

SEQ ID NO: 336091 - RNA, 22 nt, Homo sapiens
uucacaguguguacaccagggg

SEQ ID NO: 336092 - RNA, 22 nt, Homo sapiens
uucacaugacagggugaagcau

SEQ ID NO: 336093 - RNA, 22 nt, Homo sapiens
uucaccuugcccacagcagucu

SEQ ID NO: 336094 - RNA, 22 nt, Homo sapiens
uucacuggagcccaggaguugg

SEQ ID NO: 336095 - RNA, 22 nt, Homo sapiens
uucacuguaaaaugaagagggu

SEQ ID NO: 336096 - RNA, 22 nt, Homo sapiens
uucacuguagccucagccucuu

SEQ ID NO: 336097 - RNA, 22 nt, Homo sapiens
uucacugugaacucauauucag

SEQ ID NO: 336098 - RNA, 22 nt, Homo sapiens
uucaggcaccauggucauugau

SEQ ID NO: 336099 - RNA, 22 nt, Homo sapiens
uucaggcuccgugccagcuccg

SEQ ID NO: 336100 - RNA, 22 nt, Homo sapiens
uucagguucauuugcugcuauu

SEQ ID NO: 336101 - RNA, 22 nt, Homo sapiens
uucauacaguggcugcacucca

SEQ ID NO: 336102 - RNA, 22 nt, Homo sapiens
uucauagaggacauuacuggag

SEQ ID NO: 336103 - RNA, 22 nt, Homo sapiens
uucauaguguuuccuuccagug

SEQ ID NO: 336104 - RNA, 22 nt, Homo sapiens
uucauaguuuauacugauauuu

SEQ ID NO: 336105 - RNA, 22 nt, Homo sapiens
uucaucaggaauauugaccugu

SEQ ID NO: 336106 - RNA, 22 nt, Homo sapiens
uucauggacucaauaguuucgc

SEQ ID NO: 336107 - RNA, 22 nt, Homo sapiens
uucauggagccauccuuugauc

SEQ ID NO: 336108 - RNA, 22 nt, Homo sapiens
uucauggauggaaaugauuuug

SEQ ID NO: 336109 - RNA, 22 nt, Homo sapiens
uucauguaauauauuucaggcc

SEQ ID NO: 336110 - RNA, 22 nt, Homo sapiens
uuccaagugggaaacaaaaaug

SEQ ID NO: 336111 - RNA, 22 nt, Homo sapiens
uuccagaugggaguucuauucu

SEQ ID NO: 336112 - RNA, 22 nt, Homo sapiens
uuccagugggacgagaugugga

SEQ ID NO: 336113 - RNA, 22 nt, Homo sapiens
uuccaguguguucauccucaga

SEQ ID NO: 336114 - RNA, 22 nt, Homo sapiens
uucccugaaguguuacucuaga

SEQ ID NO: 336115 - RNA, 22 nt, Homo sapiens
uucccugagcaucuguugagcc

SEQ ID NO: 336116 - RNA, 22 nt, Homo sapiens
uucccugugggcuggugcucca

SEQ ID NO: 336117 - RNA, 22 nt, Homo sapiens
uucccuuucuuaaagaguuagg

SEQ ID NO: 336118 - RNA, 22 nt, Homo sapiens
uucccuuugaaacuaaacuugc

SEQ ID NO: 336119 - RNA, 22 nt, Homo sapiens
uucccuuugugcauaggauuug

SEQ ID NO: 336120 - RNA, 22 nt, Homo sapiens
uuccugugacccccaagcccac

SEQ ID NO: 336121 - RNA, 22 nt, Homo sapiens
uuccugugacuguguggcaccc

SEQ ID NO: 336122 - RNA, 20 nt, Homo sapiens
uuccuuaggcauuggaagaa

SEQ ID NO: 336123 - RNA, 22 nt, Homo sapiens
uucucaaggagccuucguaacu

SEQ ID NO: 336124 - RNA, 22 nt, Homo sapiens
uucucaauggaugugggaccag

SEQ ID NO: 336125 - RNA, 22 nt, Homo sapiens
uucucaauggcaacuuguugcu

SEQ ID NO: 336126 - RNA, 22 nt, Homo sapiens
uucucacaguacagggagcucu

SEQ ID NO: 336127 - RNA, 21 nt, Homo sapiens
uucucagaggcaggggauaaa

SEQ ID NO: 336128 - RNA, 17 nt, Homo sapiens
uucucaguucugaucuc

SEQ ID NO: 336129 - RNA, 22 nt, Homo sapiens
uucucauggaacaucuguacug

SEQ ID NO: 336130 - RNA, 22 nt, Homo sapiens
uucucuaguuacuuuaauggag

SEQ ID NO: 336131 - RNA, 23 nt, Homo sapiens
uucugccacugaaaaugccucag

SEQ ID NO: 336132 - RNA, 22 nt, Homo sapiens
uucuggaaaucagcagagggug

SEQ ID NO: 336133 - RNA, 22 nt, Homo sapiens
uucuggcucgauucucugaccg

SEQ ID NO: 336134 - RNA, 22 nt, Homo sapiens
uucugugguugaaaggagagau

SEQ ID NO: 336135 - RNA, 19 nt, Homo sapiens
uucuuuguugugggggcug

SEQ ID NO: 336136 - RNA, 22 nt, Homo sapiens
uugaaagaaaggagacugaguu

SEQ ID NO: 336137 - RNA, 22 nt, Homo sapiens
uugaaagacaucaccuacugcu

SEQ ID NO: 336138 - RNA, 22 nt, Homo sapiens
uugaaagucauggcacaggcaa

SEQ ID NO: 336139 - RNA, 22 nt, Homo sapiens
uugaagacuaauuuagauaaug

SEQ ID NO: 336140 - RNA, 22 nt, Homo sapiens
uugaagacuaccuaccauacuu

SEQ ID NO: 336141 - RNA, 19 nt, Homo sapiens
uugaaggccgccuugcaga

SEQ ID NO: 336142 - RNA, 22 nt, Homo sapiens
uugaagguagaaguucucaauu

SEQ ID NO: 336143 - RNA, 22 nt, Homo sapiens
uugaagguaggaugugcuauca

SEQ ID NO: 336144 - RNA, 22 nt, Homo sapiens
uugaaguagcauuucaugucua

SEQ ID NO: 336145 - RNA, 22 nt, Homo sapiens
uugaagugaagaacaauaucac

SEQ ID NO: 336146 - RNA, 18 nt, Homo sapiens
uugaaugcgucccagaga

SEQ ID NO: 336147 - RNA, 22 nt, Homo sapiens
uugacaaggagccauugcaucu

SEQ ID NO: 336148 - RNA, 22 nt, Homo sapiens
uugacaaggagugggguugaga

SEQ ID NO: 336149 - RNA, 22 nt, Homo sapiens
uugacauauguguguccacaua

SEQ ID NO: 336150 - RNA, 22 nt, Homo sapiens
uugacauguaaguacucuauag

SEQ ID NO: 336151 - RNA, 22 nt, Homo sapiens
uugaccaaagaagagucauugc

SEQ ID NO: 336152 - RNA, 22 nt, Homo sapiens
uugacuccagagugaguaaaug

SEQ ID NO: 336153 - RNA, 22 nt, Homo sapiens
uugacugggccagacagagauc

SEQ ID NO: 336154 - RNA, 22 nt, Homo sapiens
uugacuuagacauucaguugga

SEQ ID NO: 336155 - RNA, 22 nt, Homo sapiens
uugagcacugucugugugcagu

SEQ ID NO: 336156 - RNA, 22 nt, Homo sapiens
uugagcucuucuagcaauucua

SEQ ID NO: 336157 - RNA, 20 nt, Homo sapiens
uugaggucaggaguuuggga

SEQ ID NO: 336158 - RNA, 22 nt, Homo sapiens
uugagugaaggcuguguucuug

SEQ ID NO: 336159 - RNA, 22 nt, Homo sapiens
uugaguuuaucuaaagaccugg

SEQ ID NO: 336160 - RNA, 22 nt, Homo sapiens
uugauagaucagggauuugauu

SEQ ID NO: 336161 - RNA, 22 nt, Homo sapiens
uugauaguuuuaaaauuaaucu

SEQ ID NO: 336162 - RNA, 22 nt, Homo sapiens
uugauauguggaauauuuaucu

SEQ ID NO: 336163 - RNA, 22 nt, Homo sapiens
uugauauuaaguacugaagugg

SEQ ID NO: 336164 - RNA, 22 nt, Homo sapiens
uugaucaaaucugagugagaau

SEQ ID NO: 336165 - RNA, 22 nt, Homo sapiens
uugaucaucagcuuugucaucu

SEQ ID NO: 336166 - RNA, 22 nt, Homo sapiens
uugauuagugacuggcuacacg

SEQ ID NO: 336167 - RNA, 22 nt, Homo sapiens
uugcaaguggagcuuccagggc

SEQ ID NO: 336168 - RNA, 22 nt, Homo sapiens
uugcaaugugaugugauuugga

SEQ ID NO: 336169 - RNA, 22 nt, Homo sapiens
uugcacaauccugugagugagu

SEQ ID NO: 336170 - RNA, 22 nt, Homo sapiens
uugcacagugcuuucuuugccc

SEQ ID NO: 336171 - RNA, 22 nt, Homo sapiens
uugcacaguguguacagcacca

SEQ ID NO: 336172 - RNA, 22 nt, Homo sapiens
uugcacauggcaggugcucaau

SEQ ID NO: 336173 - RNA, 22 nt, Homo sapiens
uugcacauggcuggggaggccu

SEQ ID NO: 336174 - RNA, 22 nt, Homo sapiens
uugcacauugcaccuuuuguau

SEQ ID NO: 336175 - RNA, 22 nt, Homo sapiens
uugcacauuuuuucuggcagaa

SEQ ID NO: 336176 - RNA, 22 nt, Homo sapiens
uugcacucuccagccucggcaa

SEQ ID NO: 336177 - RNA, 22 nt, Homo sapiens
uugcacugagauuuugcuuaca

SEQ ID NO: 336178 - RNA, 22 nt, Homo sapiens
uugcagcaaauaggaaugagga

SEQ ID NO: 336179 - RNA, 22 nt, Homo sapiens
uugcauauguugaaccaagcgu

SEQ ID NO: 336180 - RNA, 22 nt, Homo sapiens
uugcaugguuuuuaucugaaau

SEQ ID NO: 336181 - RNA, 22 nt, Homo sapiens
uugcaugucauaacugauggaa

SEQ ID NO: 336182 - RNA, 22 nt, Homo sapiens
uugcauuagugugguacauuug

SEQ ID NO: 336183 - RNA, 23 nt, Homo sapiens
uugcauugcccuccauaguacuc

SEQ ID NO: 336184 - RNA, 22 nt, Homo sapiens
uugcauuuucuaggagggcaaa

SEQ ID NO: 336185 - RNA, 22 nt, Homo sapiens
uugcccuuuagguaacuauaua

SEQ ID NO: 336186 - RNA, 22 nt, Homo sapiens
uugccuaggcuggagugcagua

SEQ ID NO: 336187 - RNA, 22 nt, Homo sapiens
uugccuaggcuggaguucagug

SEQ ID NO: 336188 - RNA, 21 nt, Homo sapiens
uugccugacacuggaagaaau

SEQ ID NO: 336189 - RNA, 22 nt, Homo sapiens
uugcuaguguuugguugauggu

SEQ ID NO: 336190 - RNA, 22 nt, Homo sapiens
uugcucaggcuagaguucagcu

SEQ ID NO: 336191 - RNA, 22 nt, Homo sapiens
uugcugagucuuucuagguugc

SEQ ID NO: 336192 - RNA, 22 nt, Homo sapiens
uugcuucuuucgucuggcccca

SEQ ID NO: 336193 - RNA, 22 nt, Homo sapiens
uuggaagauuacuuaguuuucu

SEQ ID NO: 336194 - RNA, 22 nt, Homo sapiens
uuggaaggcugaauggccucuc

SEQ ID NO: 336195 - RNA, 22 nt, Homo sapiens
uuggaaugcacacugagccugc

SEQ ID NO: 336196 - RNA, 22 nt, Homo sapiens
uuggaauuagacaagugguggu

SEQ ID NO: 336197 - RNA, 22 nt, Homo sapiens
uuggacuucucaaggcaauaaa

SEQ ID NO: 336198 - RNA, 22 nt, Homo sapiens
uuggacuuuuauucugcaggca

SEQ ID NO: 336199 - RNA, 22 nt, Homo sapiens
uuggagagaaaggcaguuccug

SEQ ID NO: 336200 - RNA, 22 nt, Homo sapiens
uuggagagagaggacucccggc

SEQ ID NO: 336201 - RNA, 22 nt, Homo sapiens
uuggagugugcucauaacugcu

SEQ ID NO: 336202 - RNA, 22 nt, Homo sapiens
uuggcaaguuucugucagcaaa

SEQ ID NO: 336203 - RNA, 22 nt, Homo sapiens
uuggcacugagcaagaacaggg

SEQ ID NO: 336204 - RNA, 22 nt, Homo sapiens
uuggcagugcccgaugcugggg

SEQ ID NO: 336205 - RNA, 22 nt, Homo sapiens
uuggcauaguugcacuuacuag

SEQ ID NO: 336206 - RNA, 22 nt, Homo sapiens
uuggcauuuauucuaaggucaa

SEQ ID NO: 336207 - RNA, 22 nt, Homo sapiens
uuggccauggagcacuuuucua

SEQ ID NO: 336208 - RNA, 21 nt, Homo sapiens
uuggccuggaggccugaaugu

SEQ ID NO: 336209 - RNA, 22 nt, Homo sapiens
uuggcuguguuccucaaggagu

SEQ ID NO: 336210 - RNA, 22 nt, Homo sapiens
uugggcaauaggaagcaggugg

SEQ ID NO: 336211 - RNA, 22 nt, Homo sapiens
uuggguccucugguccuugguu

SEQ ID NO: 336212 - RNA, 22 nt, Homo sapiens
uugguaaugggcugguauaacc

SEQ ID NO: 336213 - RNA, 22 nt, Homo sapiens
uugguccccacuccccugccaa

SEQ ID NO: 336214 - RNA, 22 nt, Homo sapiens
uuggucucaucaagagcagcuu

SEQ ID NO: 336215 - RNA, 22 nt, Homo sapiens
uugguuuccuuccugcuuaacu

SEQ ID NO: 336216 - RNA, 22 nt, Homo sapiens
uuguauguuguuugucagagaa

SEQ ID NO: 336217 - RNA, 22 nt, Homo sapiens
uugucauggucuugauccauua

SEQ ID NO: 336218 - RNA, 21 nt, Homo sapiens
uuguccccacccaaaucucau

SEQ ID NO: 336219 - RNA, 22 nt, Homo sapiens
uuguccccuuccaaaucucaug

SEQ ID NO: 336220 - RNA, 21 nt, Homo sapiens
uugucuagagaaauauaucuc

SEQ ID NO: 336221 - RNA, 22 nt, Homo sapiens
uugugaaaaaccucucguggaa

SEQ ID NO: 336222 - RNA, 22 nt, Homo sapiens
uugugaagaaaccagaaaaguu

SEQ ID NO: 336223 - RNA, 22 nt, Homo sapiens
uugugcauaucagagguuugcu

SEQ ID NO: 336224 - RNA, 22 nt, Homo sapiens
uugugcauguauauuaguucac

SEQ ID NO: 336225 - RNA, 22 nt, Homo sapiens
uugugcuucaucaccuagcaga

SEQ ID NO: 336226 - RNA, 22 nt, Homo sapiens
uugugcuugauuugccuagcug

SEQ ID NO: 336227 - RNA, 22 nt, Homo sapiens
uugugcuugcuguguucuaugc

SEQ ID NO: 336228 - RNA, 22 nt, Homo sapiens
aaaaggcuagcuaguaacagaa

SEQ ID NO: 336229 - RNA, 18 nt, Homo sapiens
aaacagugucucuuucug

SEQ ID NO: 336230 - RNA, 22 nt, Homo sapiens
aaacugcuuuccaugguggcug

SEQ ID NO: 336231 - RNA, 22 nt, Homo sapiens
aaacuugucuaauuauaagcau

SEQ ID NO: 336232 - RNA, 22 nt, Homo sapiens
aaagcuaagguagcauuggaga

SEQ ID NO: 336233 - RNA, 22 nt, Homo sapiens
aaagggcacugugcuuuggcaa

SEQ ID NO: 336234 - RNA, 22 nt, Homo sapiens
aaagggcuugaauacucuuuuu

SEQ ID NO: 336235 - RNA, 22 nt, Homo sapiens
aaaguacucaguucaguuccgu

SEQ ID NO: 336236 - RNA, 17 nt, Homo sapiens
aaaguccuuugcuaucu

SEQ ID NO: 336237 - RNA, 22 nt, Homo sapiens
aaagugcaguacuucguauauu

SEQ ID NO: 336238 - RNA, 22 nt, Homo sapiens
aaagugccuucuauuuuaguga

SEQ ID NO: 336239 - RNA, 22 nt, Homo sapiens
aaagugcugagaguucuaacuu

SEQ ID NO: 336240 - RNA, 22 nt, Homo sapiens
aaagugcugggauuggcugggc

SEQ ID NO: 336241 - RNA, 22 nt, Homo sapiens
aaaguggacuaagugaauauga

SEQ ID NO: 336242 - RNA, 22 nt, Homo sapiens
aaauaguagcugaaugagggaa

SEQ ID NO: 336243 - RNA, 22 nt, Homo sapiens
aaaugcacagaaaggaugugga

SEQ ID NO: 336244 - RNA, 22 nt, Homo sapiens
aaaugcaccacucuggugcagg

SEQ ID NO: 336245 - RNA, 22 nt, Homo sapiens
aaaugcagauuccuaggcccca

SEQ ID NO: 336246 - RNA, 22 nt, Homo sapiens
aaaugcagcacucaagugggaa

SEQ ID NO: 336247 - RNA, 22 nt, Homo sapiens
aaaugcaucauuaggugauuuu

SEQ ID NO: 336248 - RNA, 22 nt, Homo sapiens
aaaugcaugaggugggaagaaa

SEQ ID NO: 336249 - RNA, 22 nt, Homo sapiens
aaauucaucaaaugguuuguau

SEQ ID NO: 336250 - RNA, 22 nt, Homo sapiens
aaauucauuucagcucugggua

SEQ ID NO: 336251 - RNA, 22 nt, Homo sapiens
aacacuaucugccuuacaggga

SEQ ID NO: 336252 - RNA, 22 nt, Homo sapiens
aacagaccuagauaguauaguc

SEQ ID NO: 336253 - RNA, 22 nt, Homo sapiens
aacagcacacccgcugcuucca

SEQ ID NO: 336254 - RNA, 22 nt, Homo sapiens
aacagucuccaguuguauccau

SEQ ID NO: 336255 - RNA, 22 nt, Homo sapiens
aacccugacacaagcagaauuu

SEQ ID NO: 336256 - RNA, 22 nt, Homo sapiens
auagacacugaaaucccugcca

SEQ ID NO: 336257 - RNA, 22 nt, Homo sapiens
auagaccuggagaguagauaua

SEQ ID NO: 336258 - RNA, 22 nt, Homo sapiens
auagagugcuucaucaguagua

SEQ ID NO: 336259 - RNA, 22 nt, Homo sapiens
auagaucauugucauuuuagau

SEQ ID NO: 336260 - RNA, 22 nt, Homo sapiens
auagcaauuugggaaucagacu

SEQ ID NO: 336261 - RNA, 22 nt, Homo sapiens
auagcacacuauagcuucaaac

SEQ ID NO: 336262 - RNA, 22 nt, Homo sapiens
auagcacaguguguguacacca

SEQ ID NO: 336263 - RNA, 22 nt, Homo sapiens
auagcagaagaagggacaauuc

SEQ ID NO: 336264 - RNA, 22 nt, Homo sapiens
auagcagacauuucaaggcagg

SEQ ID NO: 336265 - RNA, 22 nt, Homo sapiens
auagcaggagaauggucauggg

SEQ ID NO: 336266 - RNA, 22 nt, Homo sapiens
auagcagugugaaaauguacua

SEQ ID NO: 336267 - RNA, 22 nt, Homo sapiens
auaggagcacaaacuauuguga

SEQ ID NO: 336268 - RNA, 22 nt, Homo sapiens
auaggagcacgaacucuagugu

SEQ ID NO: 336269 - RNA, 22 nt, Homo sapiens
auagggcacgagaugugagccu

SEQ ID NO: 336270 - RNA, 22 nt, Homo sapiens
auagguuuucacuguagauucu

SEQ ID NO: 336271 - RNA, 22 nt, Homo sapiens
auagugcagugaugaaccuagg

SEQ ID NO: 336272 - RNA, 22 nt, Homo sapiens
auagugcugccauaaacauacg

SEQ ID NO: 336273 - RNA, 22 nt, Homo sapiens
auaucacaaacaagucuguacu

SEQ ID NO: 336274 - RNA, 22 nt, Homo sapiens
auaugcacuauacacacguaua

SEQ ID NO: 336275 - RNA, 20 nt, Homo sapiens
auaugcauguguuuucacuu

SEQ ID NO: 336276 - RNA, 22 nt, Homo sapiens
auaugcuuauuagcaagaaaua

SEQ ID NO: 336277 - RNA, 22 nt, Homo sapiens
auauggcauucagaacuguaua

SEQ ID NO: 336278 - RNA, 22 nt, Homo sapiens
auaugugacuucaugcaaggcu

SEQ ID NO: 336279 - RNA, 21 nt, Homo sapiens
auauuacuguuagaggacugc

SEQ ID NO: 336280 - RNA, 22 nt, Homo sapiens
aucaaauugucauuuuaaggau

SEQ ID NO: 336281 - RNA, 22 nt, Homo sapiens
aucaaguacuguacugaaagug

SEQ ID NO: 336282 - RNA, 22 nt, Homo sapiens
aucacagcccuccucuuggaug

SEQ ID NO: 336283 - RNA, 23 nt, Homo sapiens
aucacuguuaacaauuucuuccu

SEQ ID NO: 336284 - RNA, 22 nt, Homo sapiens
aucacuuugcucuccagugugg

SEQ ID NO: 336285 - RNA, 22 nt, Homo sapiens
aucagaaucucuagaggacugu

SEQ ID NO: 336286 - RNA, 22 nt, Homo sapiens
aucagaaucucuagugggacca

SEQ ID NO: 336287 - RNA, 22 nt, Homo sapiens
aucagagccugugugcccugaa

SEQ ID NO: 336288 - RNA, 22 nt, Homo sapiens
aucagaguugucagggagcuuu

SEQ ID NO: 336289 - RNA, 19 nt, Homo sapiens
aucagcacaagugugcuuu

SEQ ID NO: 336290 - RNA, 22 nt, Homo sapiens
aucagcagcaugaaaacggacu

SEQ ID NO: 336291 - RNA, 22 nt, Homo sapiens
aucaggaaccuuuuuggugugu

SEQ ID NO: 336292 - RNA, 22 nt, Homo sapiens
aucagugaaagugaaaucuccg

SEQ ID NO: 336293 - RNA, 22 nt, Homo sapiens
aucagugagugguuagugaaug

SEQ ID NO: 336294 - RNA, 22 nt, Homo sapiens
aucauaucaucugcaaacaaag

SEQ ID NO: 336295 - RNA, 22 nt, Homo sapiens
aucauauccuagauauaacuuc

SEQ ID NO: 336296 - RNA, 22 nt, Homo sapiens
aucaugucuucccagugauucu

SEQ ID NO: 336297 - RNA, 22 nt, Homo sapiens
auccacaugcaguuggaaacag

SEQ ID NO: 336298 - RNA, 22 nt, Homo sapiens
auccaguuuuaggagauuucua

SEQ ID NO: 336299 - RNA, 22 nt, Homo sapiens
aucccugagccugacucucaga

SEQ ID NO: 336300 - RNA, 22 nt, Homo sapiens
aucccuuccuagcacuuggugu

SEQ ID NO: 336301 - RNA, 22 nt, Homo sapiens
auccuguagagaugagggugga

SEQ ID NO: 336302 - RNA, 22 nt, Homo sapiens
aucuccaggugccagcugcgcc

SEQ ID NO: 336303 - RNA, 22 nt, Homo sapiens
aucuguguuuaaggucccagaa

SEQ ID NO: 336304 - RNA, 22 nt, Homo sapiens
aucuuguguugaauggugcaga

SEQ ID NO: 336305 - RNA, 22 nt, Homo sapiens
aucuuuaguggcuguuuucaga

SEQ ID NO: 336306 - RNA, 22 nt, Homo sapiens
aucuuugauugaagggacccug

SEQ ID NO: 336307 - RNA, 22 nt, Homo sapiens
augaaaagcauaaacgcugaag

SEQ ID NO: 336308 - RNA, 22 nt, Homo sapiens
augaaagugauaaaugucucua

SEQ ID NO: 336309 - RNA, 22 nt, Homo sapiens
augaaaucacugugaugcccua

SEQ ID NO: 336310 - RNA, 22 nt, Homo sapiens
augaaauguaugagucuggguu

SEQ ID NO: 336311 - RNA, 22 nt, Homo sapiens
augaacagagccuugagaaccu

SEQ ID NO: 336312 - RNA, 19 nt, Homo sapiens
augaacucaucauuucuca

SEQ ID NO: 336313 - RNA, 17 nt, Homo sapiens
augaacucaucguucuu

SEQ ID NO: 336314 - RNA, 22 nt, Homo sapiens
augaagaucaugaagacggcuu

SEQ ID NO: 336315 - RNA, 22 nt, Homo sapiens
augaaguauuaggacacauuua

SEQ ID NO: 336316 - RNA, 22 nt, Homo sapiens
augaagucguuacuaccaauug

SEQ ID NO: 336317 - RNA, 22 nt, Homo sapiens
augaaugcagcacuguuuuucu

SEQ ID NO: 336318 - RNA, 23 nt, Homo sapiens
augaauguaaagaaugugggaag

SEQ ID NO: 336319 - RNA, 22 nt, Homo sapiens
augacaguaugacuccaaaagu

SEQ ID NO: 336320 - RNA, 22 nt, Homo sapiens
augaccaugauccuugccgacc

SEQ ID NO: 336321 - RNA, 22 nt, Homo sapiens
augacccugaccuaagccaauc

SEQ ID NO: 336322 - RNA, 21 nt, Homo sapiens
augacccuggguguccuuucc

SEQ ID NO: 336323 - RNA, 20 nt, Homo sapiens
augaccuauggugguauaag

SEQ ID NO: 336324 - RNA, 22 nt, Homo sapiens
augaccuuggggaaccaugucu

SEQ ID NO: 336325 - RNA, 22 nt, Homo sapiens
augacuggauaauggacacaca

SEQ ID NO: 336326 - RNA, 22 nt, Homo sapiens
augagaacauaucaagugauug

SEQ ID NO: 336327 - RNA, 22 nt, Homo sapiens
augagacuagaagagaauaaua

SEQ ID NO: 336328 - RNA, 22 nt, Homo sapiens
augagacuguucuuccucauug

SEQ ID NO: 336329 - RNA, 22 nt, Homo sapiens
augagaugaggaauggcccucc

SEQ ID NO: 336330 - RNA, 22 nt, Homo sapiens
augagaugcaagauuagauggg

SEQ ID NO: 336331 - RNA, 22 nt, Homo sapiens
augagauuauguaaagagacca

SEQ ID NO: 336332 - RNA, 22 nt, Homo sapiens
augagauucuuagagaagucug

SEQ ID NO: 336333 - RNA, 22 nt, Homo sapiens
augagauuguuuguacuccaca

SEQ ID NO: 336334 - RNA, 22 nt, Homo sapiens
augagauuguuugugugaaaua

SEQ ID NO: 336335 - RNA, 22 nt, Homo sapiens
augagcagaugcuccugccucu

SEQ ID NO: 336336 - RNA, 22 nt, Homo sapiens
augaggaaggagccuuugucug

SEQ ID NO: 336337 - RNA, 22 nt, Homo sapiens
augagguauccaagcccagaaa

SEQ ID NO: 336338 - RNA, 22 nt, Homo sapiens
augaggugaguaaauaaaugaa

SEQ ID NO: 336339 - RNA, 22 nt, Homo sapiens
augaggugggagaaucacuuga

SEQ ID NO: 336340 - RNA, 20 nt, Homo sapiens
augagguguaugacacugaa

SEQ ID NO: 336341 - RNA, 22 nt, Homo sapiens
augaguaguugcuaaauauuga

SEQ ID NO: 336342 - RNA, 22 nt, Homo sapiens
augaguaugagaauacauuaag

SEQ ID NO: 336343 - RNA, 18 nt, Homo sapiens
augagucauuguggaaau

SEQ ID NO: 336344 - RNA, 22 nt, Homo sapiens
cugcagguaggggcagcuuugg

SEQ ID NO: 336345 - RNA, 21 nt, Homo sapiens
cugcauccauuucugagugau

SEQ ID NO: 336346 - RNA, 22 nt, Homo sapiens
cugcccguaauccucuccccag

SEQ ID NO: 336347 - RNA, 22 nt, Homo sapiens
cugcccuuucuauaugauguaa

SEQ ID NO: 336348 - RNA, 20 nt, Homo sapiens
cugcuccccuacaaaucuca

SEQ ID NO: 336349 - RNA, 22 nt, Homo sapiens
cuggaauucaaaaucugaauuu

SEQ ID NO: 336350 - RNA, 22 nt, Homo sapiens
cuggagcaaaggugacucuugu

SEQ ID NO: 336351 - RNA, 22 nt, Homo sapiens
cuggaggccugaacauaaaugg

SEQ ID NO: 336352 - RNA, 22 nt, Homo sapiens
cuggcaaaaagagggcaauaau

SEQ ID NO: 336353 - RNA, 22 nt, Homo sapiens
cuggcaaauaguagagccagga

SEQ ID NO: 336354 - RNA, 19 nt, Homo sapiens
cuggcaaaugcuuuggcca

SEQ ID NO: 336355 - RNA, 22 nt, Homo sapiens
cuggcaguguuucuugugggcu

SEQ ID NO: 336356 - RNA, 22 nt, Homo sapiens
cugggaugauguaaauaggcua

SEQ ID NO: 336357 - RNA, 22 nt, Homo sapiens
cugguaugcuucauaugcaaac

SEQ ID NO: 336358 - RNA, 21 nt, Homo sapiens
cugguguuagcacuucuuccc

SEQ ID NO: 336359 - RNA, 22 nt, Homo sapiens
cugguuuguaaaguuccugaga

SEQ ID NO: 336360 - RNA, 22 nt, Homo sapiens
cuguaaggcacuaagcauaugu

SEQ ID NO: 336361 - RNA, 22 nt, Homo sapiens
cugucacuggggcacauguccc

SEQ ID NO: 336362 - RNA, 22 nt, Homo sapiens
cugucuggaggccugcaaauaa

SEQ ID NO: 336363 - RNA, 22 nt, Homo sapiens
cugugaagaaagucauugguag

SEQ ID NO: 336364 - RNA, 22 nt, Homo sapiens
cugugcauaucuuggacugugu

SEQ ID NO: 336365 - RNA, 22 nt, Homo sapiens
cugugcauaugacuuuauugga

SEQ ID NO: 336366 - RNA, 22 nt, Homo sapiens
cugugcaugcgcggagcugaaa

SEQ ID NO: 336367 - RNA, 22 nt, Homo sapiens
cuguucaaauuguuugugaagu

SEQ ID NO: 336368 - RNA, 22 nt, Homo sapiens
cuuaaggccagauaauuucuau

SEQ ID NO: 336369 - RNA, 17 nt, Homo sapiens
cuucaaauaauuucccc

SEQ ID NO: 336370 - RNA, 22 nt, Homo sapiens
cuucaaguaauucugauggcua

SEQ ID NO: 336371 - RNA, 18 nt, Homo sapiens
cuucauugcuguuuugcu

SEQ ID NO: 336372 - RNA, 22 nt, Homo sapiens
cuucuugcuguguccucacaug

SEQ ID NO: 336373 - RNA, 22 nt, Homo sapiens
cuugaccuauggaucuguuuuu

SEQ ID NO: 336374 - RNA, 22 nt, Homo sapiens
cuugcacuagugcagaggcgcu

SEQ ID NO: 336375 - RNA, 22 nt, Homo sapiens
cuugcacuugaaauuccaguuu

SEQ ID NO: 336376 - RNA, 22 nt, Homo sapiens
cuugccuaaucugcaugauuuu

SEQ ID NO: 336377 - RNA, 22 nt, Homo sapiens
cuuggcuccgacuccccuccaa

SEQ ID NO: 336378 - RNA, 22 nt, Homo sapiens
cuuggcuugguaucaaauaacc

SEQ ID NO: 336379 - RNA, 22 nt, Homo sapiens
cuuguacacuguuggugggaau

SEQ ID NO: 336380 - RNA, 22 nt, Homo sapiens
cuugucuugcacacgguugcca

SEQ ID NO: 336381 - RNA, 22 nt, Homo sapiens
cuuguggugcuuuuacgugggc

SEQ ID NO: 336382 - RNA, 22 nt, Homo sapiens
cuuguucuccuaagaugaaugc

SEQ ID NO: 336383 - RNA, 22 nt, Homo sapiens
gaugguuuucaccugcaugcuu

SEQ ID NO: 336384 - RNA, 22 nt, Homo sapiens
gauuauagaaguaauggguuua

SEQ ID NO: 336385 - RNA, 22 nt, Homo sapiens
gauuccacuuucaaauucaaau

SEQ ID NO: 336386 - RNA, 22 nt, Homo sapiens
gauuccauugcgaauuuucaga

SEQ ID NO: 336387 - RNA, 22 nt, Homo sapiens
gauuugagagaggguguuuaua

SEQ ID NO: 336388 - RNA, 22 nt, Homo sapiens
gauuuuccaguggcccugauca

SEQ ID NO: 336389 - RNA, 22 nt, Homo sapiens
gcaaaaaguagugcugguuagg

SEQ ID NO: 336390 - RNA, 22 nt, Homo sapiens
gcaaaugcuaugccauuuuaua

SEQ ID NO: 336391 - RNA, 22 nt, Homo sapiens
gcaagugucugagguuuuguau

SEQ ID NO: 336392 - RNA, 22 nt, Homo sapiens
gcaaugcugucugugcacagau

SEQ ID NO: 336393 - RNA, 22 nt, Homo sapiens
gcaauguuacugaauguguuuu

SEQ ID NO: 336394 - RNA, 22 nt, Homo sapiens
gcacagaugaggagaggucuca

SEQ ID NO: 336395 - RNA, 22 nt, Homo sapiens
gcacaguguuacuugauauauu

SEQ ID NO: 336396 - RNA, 22 nt, Homo sapiens
gcacauauguaaauagcugccu

SEQ ID NO: 336397 - RNA, 22 nt, Homo sapiens
gcaccacugcacucucagcuug

SEQ ID NO: 336398 - RNA, 22 nt, Homo sapiens
gcacccugucaaaauggaccaa

SEQ ID NO: 336399 - RNA, 22 nt, Homo sapiens
gcacgugcacccacaugcacgu

SEQ ID NO: 336400 - RNA, 22 nt, Homo sapiens
gcacugggccacauuuauuuuc

SEQ ID NO: 336401 - RNA, 19 nt, Homo sapiens
gcagagaugugguagcuug

SEQ ID NO: 336402 - RNA, 22 nt, Homo sapiens
gcagcauuaccaagacauggca

SEQ ID NO: 336403 - RNA, 22 nt, Homo sapiens
gcaggcaugacauuucacucuu

SEQ ID NO: 336404 - RNA, 22 nt, Homo sapiens
gcaguagugcgaucucagcuca

SEQ ID NO: 336405 - RNA, 22 nt, Homo sapiens
gcagugugauguuuuaaucuau

SEQ ID NO: 336406 - RNA, 22 nt, Homo sapiens
gcaguucuguaguugaaauuua

SEQ ID NO: 336407 - RNA, 20 nt, Homo sapiens
gcauaugucuuuauggcagc

SEQ ID NO: 336408 - RNA, 22 nt, Homo sapiens
gcauauguuuggguguguauau

SEQ ID NO: 336409 - RNA, 22 nt, Homo sapiens
gcaucacagcuccugugcuggc

SEQ ID NO: 336410 - RNA, 22 nt, Homo sapiens
gcaugcacaugugaaaaaauga

SEQ ID NO: 336411 - RNA, 22 nt, Homo sapiens
gcauggccuuuaaaugucacag

SEQ ID NO: 336412 - RNA, 20 nt, Homo sapiens
gccacaguuaagcuucugcc

SEQ ID NO: 336413 - RNA, 22 nt, Homo sapiens
gccauugcacuccagccuaggc

SEQ ID NO: 336414 - RNA, 22 nt, Homo sapiens
gccauugcacuccagccuaggu

SEQ ID NO: 336415 - RNA, 22 nt, Homo sapiens
gcccugagauucuuggauucug

SEQ ID NO: 336416 - RNA, 22 nt, Homo sapiens
gcccugauacauucuucugccu

SEQ ID NO: 336417 - RNA, 22 nt, Homo sapiens
gcccuguugcccaggcuggagu

SEQ ID NO: 336418 - RNA, 22 nt, Homo sapiens
gcgcagugggcugugccaucca

SEQ ID NO: 336419 - RNA, 22 nt, Homo sapiens
gcggguguuuuacccuugcaga

SEQ ID NO: 336420 - RNA, 22 nt, Homo sapiens
gcuaaaugcaugaggcgaugug

SEQ ID NO: 336421 - RNA, 22 nt, Homo sapiens
gcuaaggcaggagcauugcuug

SEQ ID NO: 336422 - RNA, 22 nt, Homo sapiens
gcuaugguuuuuagcuccauca

SEQ ID NO: 336423 - RNA, 22 nt, Homo sapiens
gcucaugagacaagcaggagua

SEQ ID NO: 336424 - RNA, 22 nt, Homo sapiens
gcugacagugguuauacuuaga

SEQ ID NO: 336425 - RNA, 22 nt, Homo sapiens
gcugagguucaagaagguuaaa

SEQ ID NO: 336426 - RNA, 22 nt, Homo sapiens
gcugcuguuucucuuucagcau

SEQ ID NO: 336427 - RNA, 22 nt, Homo sapiens
gcuggaauuaacauagaugugc

SEQ ID NO: 336428 - RNA, 22 nt, Homo sapiens
gcuggcuuucuccugaucucag

SEQ ID NO: 336429 - RNA, 22 nt, Homo sapiens
gcuggucugccguaguaggugc

SEQ ID NO: 336430 - RNA, 22 nt, Homo sapiens
gcuguaguugaggauuuuaaga

SEQ ID NO: 336431 - RNA, 22 nt, Homo sapiens
gcugugguuuaguagaaagaag

SEQ ID NO: 336432 - RNA, 22 nt, Homo sapiens
gcuugguccccacccaaaucgc

SEQ ID NO: 336433 - RNA, 19 nt, Homo sapiens
gcuuuguggggaaggagcc

SEQ ID NO: 336434 - RNA, 22 nt, Homo sapiens
gcuuuguugauggugagucugu

SEQ ID NO: 336435 - RNA, 23 nt, Homo sapiens
ggaaacauccagucuuucaccau

SEQ ID NO: 336436 - RNA, 22 nt, Homo sapiens
gagcuacacugauucauuuguu

SEQ ID NO: 336437 - RNA, 22 nt, Homo sapiens
gagcuacauggauagucugcau

SEQ ID NO: 336438 - RNA, 22 nt, Homo sapiens
gagcuagguuuugaauccagac

SEQ ID NO: 336439 - RNA, 22 nt, Homo sapiens
gaggaucucuugagcccagaag

SEQ ID NO: 336440 - RNA, 22 nt, Homo sapiens
gaggcauugaaauauugcuuau

SEQ ID NO: 336441 - RNA, 22 nt, Homo sapiens
gagguaaguggauuaugagguc

SEQ ID NO: 336442 - RNA, 22 nt, Homo sapiens
gagguaugugggcagacauuua

SEQ ID NO: 336443 - RNA, 22 nt, Homo sapiens
gaggucauguggcaggcagcca

SEQ ID NO: 336444 - RNA, 22 nt, Homo sapiens
gaggugaaggucucaauaaaua

SEQ ID NO: 336445 - RNA, 22 nt, Homo sapiens
gagguggugguggaggcauagc

SEQ ID NO: 336446 - RNA, 22 nt, Homo sapiens
gagguuuuagugagucccacug

SEQ ID NO: 336447 - RNA, 22 nt, Homo sapiens
gaguaaaugucaaguacuuagg

SEQ ID NO: 336448 - RNA, 22 nt, Homo sapiens
gaguaaauguccuagcuucuug

SEQ ID NO: 336449 - RNA, 22 nt, Homo sapiens
gaguagaacugguuaucuaaua

SEQ ID NO: 336450 - RNA, 22 nt, Homo sapiens
gaguagugcugcaauaaacaua

SEQ ID NO: 336451 - RNA, 22 nt, Homo sapiens
gaguagugcuguaauaaacaua

SEQ ID NO: 336452 - RNA, 22 nt, Homo sapiens
gagucuauucaauguaguuaga

SEQ ID NO: 336453 - RNA, 22 nt, Homo sapiens
gagugcaauggcaugaucuggg

SEQ ID NO: 336454 - RNA, 22 nt, Homo sapiens
gagugcaauggcgcgaucucgg

SEQ ID NO: 336455 - RNA, 22 nt, Homo sapiens
gagugcaauggugccaucucgg

SEQ ID NO: 336456 - RNA, 22 nt, Homo sapiens
gagugcaauggugcuaucucgg

SEQ ID NO: 336457 - RNA, 22 nt, Homo sapiens
gagugcauugguggucaggugu

SEQ ID NO: 336458 - RNA, 22 nt, Homo sapiens
gagugguucuauauguaauugg

SEQ ID NO: 336459 - RNA, 22 nt, Homo sapiens
gaguucauaucuaugagugugc

SEQ ID NO: 336460 - RNA, 22 nt, Homo sapiens
gauauguaguaguugaaaaaga

SEQ ID NO: 336461 - RNA, 22 nt, Homo sapiens
gaucacaugggagaaugagagu

SEQ ID NO: 336462 - RNA, 22 nt, Homo sapiens
gaucacauuguuucauacauau

SEQ ID NO: 336463 - RNA, 22 nt, Homo sapiens
gaucuggagguuuuccucauga

SEQ ID NO: 336464 - RNA, 22 nt, Homo sapiens
gaucugugugauuggaugcauu

SEQ ID NO: 336465 - RNA, 22 nt, Homo sapiens
gaucuguuuuccuauuguuugu

SEQ ID NO: 336466 - RNA, 22 nt, Homo sapiens
gaugaaacaucuuuggaaacug

SEQ ID NO: 336467 - RNA, 22 nt, Homo sapiens
gaugacacugggucaaaucuca

SEQ ID NO: 336468 - RNA, 22 nt, Homo sapiens
gaugacagcugacucccuugcu

SEQ ID NO: 336469 - RNA, 22 nt, Homo sapiens
gaugaucaugaccuacagaugg

SEQ ID NO: 336470 - RNA, 22 nt, Homo sapiens
gaugaugcuagguguuagggcu

SEQ ID NO: 336471 - RNA, 22 nt, Homo sapiens
gauggaguugucgccugggcug

SEQ ID NO: 336472 - RNA, 22 nt, Homo sapiens
gauggcagugcagccccuggcu

SEQ ID NO: 336473 - RNA, 22 nt, Homo sapiens
aaaagucuguagugaaagguga

SEQ ID NO: 336474 - RNA, 20 nt, Homo sapiens
aaacucugucuucuuuauca

SEQ ID NO: 336475 - RNA, 18 nt, Homo sapiens
aaacugcuuccuuggccu

SEQ ID NO: 336476 - RNA, 22 nt, Homo sapiens
aaacugucuucugacaguuucc

SEQ ID NO: 336477 - RNA, 22 nt, Homo sapiens
aaagagaucuaugggcacuaug

SEQ ID NO: 336478 - RNA, 20 nt, Homo sapiens
aaaguaggcuaauaccaaaa

SEQ ID NO: 336479 - RNA, 18 nt, Homo sapiens
aaagugaugucauucuuu

SEQ ID NO: 336480 - RNA, 22 nt, Homo sapiens
aaagugcaguauuugggcagaa

SEQ ID NO: 336481 - RNA, 22 nt, Homo sapiens
aaagugcuaggauuaccugggg

SEQ ID NO: 336482 - RNA, 22 nt, Homo sapiens
aaagugcuuccuuuuugagggu

SEQ ID NO: 336483 - RNA, 15 nt, Homo sapiens
aaauaugucaguucu

SEQ ID NO: 336484 - RNA, 22 nt, Homo sapiens
aaauccaucucuuggggcauug

SEQ ID NO: 336485 - RNA, 22 nt, Homo sapiens
aaauccauuuguucagcuaugc

SEQ ID NO: 336486 - RNA, 22 nt, Homo sapiens
aaaugcacaaagauuuugcacu

SEQ ID NO: 336487 - RNA, 22 nt, Homo sapiens
aaaugcagauucugcuuagguu

SEQ ID NO: 336488 - RNA, 22 nt, Homo sapiens
aaaugcccuaaaauggagcauc

SEQ ID NO: 336489 - RNA, 22 nt, Homo sapiens
aaaugcugucugugagccucau

SEQ ID NO: 336490 - RNA, 19 nt, Homo sapiens
aaaugugcacuguuuucca

SEQ ID NO: 336491 - RNA, 21 nt, Homo sapiens
aaaugugcuuuaguacccuca

SEQ ID NO: 336492 - RNA, 18 nt, Homo sapiens
aaauucugucccuucuuc

SEQ ID NO: 336493 - RNA, 22 nt, Homo sapiens
aaauuguccuauugguuuaagc

SEQ ID NO: 336494 - RNA, 22 nt, Homo sapiens
aacaccaucccuuugaugcuuu

SEQ ID NO: 336495 - RNA, 22 nt, Homo sapiens
aacaccauucucuguaacaaga

SEQ ID NO: 336496 - RNA, 22 nt, Homo sapiens
aacaccauuuuucugcagccuu

SEQ ID NO: 336497 - RNA, 22 nt, Homo sapiens
aacaccuugcagggauuaugac

SEQ ID NO: 336498 - RNA, 22 nt, Homo sapiens
aacacuguuuccagucaugauc

SEQ ID NO: 336499 - RNA, 22 nt, Homo sapiens
aacagagcuggugacuccaggu

SEQ ID NO: 336500 - RNA, 22 nt, Homo sapiens
aacaggguggugccugguccau

SEQ ID NO: 336501 - RNA, 22 nt, Homo sapiens
aacaguaucuaacgagugauga

SEQ ID NO: 336502 - RNA, 22 nt, Homo sapiens
aacagugcauuccuguccauau

SEQ ID NO: 336503 - RNA, 22 nt, Homo sapiens
aacagugccugucauuuaguag

SEQ ID NO: 336504 - RNA, 22 nt, Homo sapiens
aacauagucaugggguaauguu

SEQ ID NO: 336505 - RNA, 22 nt, Homo sapiens
aaccuguaaccauaugaucagu

SEQ ID NO: 336506 - RNA, 22 nt, Homo sapiens
aaccuguggauuuugguaucug

SEQ ID NO: 336507 - RNA, 22 nt, Homo sapiens
aacuaugucaaauaaaaugagg

SEQ ID NO: 336508 - RNA, 22 nt, Homo sapiens
aacuggcauguuuuaaggcuua

SEQ ID NO: 336509 - RNA, 22 nt, Homo sapiens
aacuggccuggcgugcagaggg

SEQ ID NO: 336510 - RNA, 19 nt, Homo sapiens
aacuggugugagaugguau

SEQ ID NO: 336511 - RNA, 21 nt, Homo sapiens
aacuggugugagaugguaugu

SEQ ID NO: 336512 - RNA, 22 nt, Homo sapiens
aagacuguaauccaucuugagu

SEQ ID NO: 336513 - RNA, 22 nt, Homo sapiens
aagagagccagcugguauauuu

SEQ ID NO: 336514 - RNA, 22 nt, Homo sapiens
aagagcauuauuuaguaauuuc

SEQ ID NO: 336515 - RNA, 22 nt, Homo sapiens
aagagguagucugucccuuagc

SEQ ID NO: 336516 - RNA, 22 nt, Homo sapiens
aagagugcucgugggacucagc

SEQ ID NO: 336517 - RNA, 22 nt, Homo sapiens
aagauauguuaguuauaaacuc

SEQ ID NO: 336518 - RNA, 22 nt, Homo sapiens
aagaugguauuucauuaguuuu

SEQ ID NO: 336519 - RNA, 22 nt, Homo sapiens
aagcaggugaugagugggugug

SEQ ID NO: 336520 - RNA, 22 nt, Homo sapiens
aagcugcauuuucuagaugcuu

SEQ ID NO: 336521 - RNA, 22 nt, Homo sapiens
aagcuggagugcaguggugcga

SEQ ID NO: 336522 - RNA, 22 nt, Homo sapiens
aagcuggcuuucauugagugcu

SEQ ID NO: 336523 - RNA, 22 nt, Homo sapiens
aagcugguuuuauaucugugag

SEQ ID NO: 336524 - RNA, 22 nt, Homo sapiens
aaggagcagagagcccuguuuc

SEQ ID NO: 336525 - RNA, 22 nt, Homo sapiens
aaggagcuaagagaucauacau

SEQ ID NO: 336526 - RNA, 22 nt, Homo sapiens
aaggagugugauucuucaguuu

SEQ ID NO: 336527 - RNA, 22 nt, Homo sapiens
aaggcaagaaaauggauucucc

SEQ ID NO: 336528 - RNA, 22 nt, Homo sapiens
aaggcaagauacugguugcuga

SEQ ID NO: 336529 - RNA, 22 nt, Homo sapiens
aaggcagucacuaaauagugag

SEQ ID NO: 336530 - RNA, 22 nt, Homo sapiens
aaggcaugcaaagaacauuuua

SEQ ID NO: 336531 - RNA, 22 nt, Homo sapiens
aaggcucuuucaacguaaauua

SEQ ID NO: 336532 - RNA, 22 nt, Homo sapiens
aagggaauguugugguugguuu

SEQ ID NO: 336533 - RNA, 22 nt, Homo sapiens
aagguagcugagugaagugguu

SEQ ID NO: 336534 - RNA, 22 nt, Homo sapiens
aagguauuuuugucuauaucuu

SEQ ID NO: 336535 - RNA, 22 nt, Homo sapiens
aaggugcuguaagcauccaugu

SEQ ID NO: 336536 - RNA, 22 nt, Homo sapiens
aaguacuguuuaaauugcagaa

SEQ ID NO: 336537 - RNA, 22 nt, Homo sapiens
aaguauuagugaggauauggaa

SEQ ID NO: 336538 - RNA, 19 nt, Homo sapiens
aagugaaugcuuuguucac

SEQ ID NO: 336539 - RNA, 22 nt, Homo sapiens
aagugcuuaggauagugugugg

SEQ ID NO: 336540 - RNA, 22 nt, Homo sapiens
aagugcuuccuuucagaggguu

SEQ ID NO: 336541 - RNA, 22 nt, Homo sapiens
aagugguuuuaaucuggugagu

SEQ ID NO: 336542 - RNA, 22 nt, Homo sapiens
aaguuaauguuuaagacuccua

SEQ ID NO: 336543 - RNA, 23 nt, Homo sapiens
aaguucaugcucaucuguuacac

SEQ ID NO: 336544 - RNA, 22 nt, Homo sapiens
aaguuguaguuagagaguugcu

SEQ ID NO: 336545 - RNA, 22 nt, Homo sapiens
uugcaagaaaugcagauucuca

SEQ ID NO: 336546 - RNA, 22 nt, Homo sapiens
uugcacagugguuuagagccug

SEQ ID NO: 336547 - RNA, 22 nt, Homo sapiens
uugcaccuuaugucuguucucu

SEQ ID NO: 336548 - RNA, 22 nt, Homo sapiens
uugcaccuugaagccaauagca

SEQ ID NO: 336549 - RNA, 22 nt, Homo sapiens
uugcacuccagccuggaugaca

SEQ ID NO: 336550 - RNA, 22 nt, Homo sapiens
uugcacuccagcucgggugaca

SEQ ID NO: 336551 - RNA, 22 nt, Homo sapiens
uugcacuccagcucuaggugac

SEQ ID NO: 336552 - RNA, 22 nt, Homo sapiens
uugcacuccggccuggguaaca

SEQ ID NO: 336553 - RNA, 22 nt, Homo sapiens
uugcagagaaauuucugguuua

SEQ ID NO: 336554 - RNA, 22 nt, Homo sapiens
uugcagagccccacacugggcu

SEQ ID NO: 336555 - RNA, 22 nt, Homo sapiens
uugcagcaacauggaugaaacu

SEQ ID NO: 336556 - RNA, 22 nt, Homo sapiens
aauggcaucuacguuaaauguc

SEQ ID NO: 336557 - RNA, 22 nt, Homo sapiens
aauggcaucuagaguggugaau

SEQ ID NO: 336558 - RNA, 22 nt, Homo sapiens
aauggcucuuccuggaguugug

SEQ ID NO: 336559 - RNA, 22 nt, Homo sapiens
aauggcucuuuaggcaauagau

SEQ ID NO: 336560 - RNA, 19 nt, Homo sapiens
aauggcuuuuccuguuccc

SEQ ID NO: 336561 - RNA, 18 nt, Homo sapiens
aaugggacuacaaagcca

SEQ ID NO: 336562 - RNA, 22 nt, Homo sapiens
aaugguuuuaucagcguccaaa

SEQ ID NO: 336563 - RNA, 22 nt, Homo sapiens
aaugucacugugguccuccagu

SEQ ID NO: 336564 - RNA, 22 nt, Homo sapiens
aaugugcacuauuagggugaua

SEQ ID NO: 336565 - RNA, 22 nt, Homo sapiens
aauuacucgugucuuuacugcu

SEQ ID NO: 336566 - RNA, 22 nt, Homo sapiens
aauuaguugaaagucugcuuuu

SEQ ID NO: 336567 - RNA, 22 nt, Homo sapiens
aauugaaugcagaugccaggga

SEQ ID NO: 336568 - RNA, 22 nt, Homo sapiens
aauugcaccaucuagaucaaga

SEQ ID NO: 336569 - RNA, 22 nt, Homo sapiens
aauugcuucuguauuuuggaca

SEQ ID NO: 336570 - RNA, 22 nt, Homo sapiens
aauuguacucccaucauuccua

SEQ ID NO: 336571 - RNA, 22 nt, Homo sapiens
acaaaguauggaauguuggugu

SEQ ID NO: 336572 - RNA, 22 nt, Homo sapiens
acaaaguguuuucugaaggccu

SEQ ID NO: 336573 - RNA, 22 nt, Homo sapiens
acaagcacaaaugcauagaugg

SEQ ID NO: 336574 - RNA, 22 nt, Homo sapiens
acacauacacauaugguguaua

SEQ ID NO: 336575 - RNA, 22 nt, Homo sapiens
acaccaugucuguuucugguuu

SEQ ID NO: 336576 - RNA, 22 nt, Homo sapiens
acacucuaguguucuuaaucag

SEQ ID NO: 336577 - RNA, 22 nt, Homo sapiens
acacucucucauuacuuguuug

SEQ ID NO: 336578 - RNA, 22 nt, Homo sapiens
acacuguagcugagggcaugcg

SEQ ID NO: 336579 - RNA, 23 nt, Homo sapiens
acacuugcugaguaaaucaaaua

SEQ ID NO: 336580 - RNA, 22 nt, Homo sapiens
acacuugcuugcaauagccucc

SEQ ID NO: 336581 - RNA, 22 nt, Homo sapiens
acacuuucuggagcugcacaua

SEQ ID NO: 336582 - RNA, 22 nt, Homo sapiens
acagcacugccaagugacccau

SEQ ID NO: 336583 - RNA, 20 nt, Homo sapiens
acagcacugguuucaagcaa

SEQ ID NO: 336584 - RNA, 19 nt, Homo sapiens
acagcugguuuugguuucu

SEQ ID NO: 336585 - RNA, 22 nt, Homo sapiens
acagguacaagggauuaggaug

SEQ ID NO: 336586 - RNA, 20 nt, Homo sapiens
acaguagaagggauuucaaa

SEQ ID NO: 336587 - RNA, 21 nt, Homo sapiens
acaguaguaauaguguagcca

SEQ ID NO: 336588 - RNA, 19 nt, Homo sapiens
acaguauugugcacagguu

SEQ ID NO: 336589 - RNA, 22 nt, Homo sapiens
acagucacaauuuguaccuuuu

SEQ ID NO: 336590 - RNA, 22 nt, Homo sapiens
acagugcuguuguguuuucacg

SEQ ID NO: 336591 - RNA, 22 nt, Homo sapiens
acaguggugcgaucucggcuca

SEQ ID NO: 336592 - RNA, 23 nt, Homo sapiens
acaguggugugaucuuggcucag

SEQ ID NO: 336593 - RNA, 22 nt, Homo sapiens
acaguguagugacugccaacuu

SEQ ID NO: 336594 - RNA, 22 nt, Homo sapiens
acagugucugacacguaggaag

SEQ ID NO: 336595 - RNA, 18 nt, Homo sapiens
acaguguguaaggguucu

SEQ ID NO: 336596 - RNA, 22 nt, Homo sapiens
acauaaagaagcaggacauugu

SEQ ID NO: 336597 - RNA, 22 nt, Homo sapiens
acauaguagacacugaaaauau

SEQ ID NO: 336598 - RNA, 22 nt, Homo sapiens
acaucauugggggcuacaggug

SEQ ID NO: 336599 - RNA, 22 nt, Homo sapiens
accaugcaguccaauaugcaca

SEQ ID NO: 336600 - RNA, 22 nt, Homo sapiens
accauugcacuccagcccaggc

SEQ ID NO: 336601 - RNA, 22 nt, Homo sapiens
acccaguaacauaugggaggga

SEQ ID NO: 336602 - RNA, 23 nt, Homo sapiens
accccuacaggcuuguguccugc

SEQ ID NO: 336603 - RNA, 22 nt, Homo sapiens
acccgugcugaauauguaggug

SEQ ID NO: 336604 - RNA, 22 nt, Homo sapiens
acccucagaccaguuucccugg

SEQ ID NO: 336605 - RNA, 22 nt, Homo sapiens
acccuggauucguggccuugaa

SEQ ID NO: 336606 - RNA, 22 nt, Homo sapiens
acccuguaacauacaagugguu

SEQ ID NO: 336607 - RNA, 18 nt, Homo sapiens
acccuucagcacugggcc

SEQ ID NO: 336608 - RNA, 22 nt, Homo sapiens
acccuugaguguguuucaggca

SEQ ID NO: 336609 - RNA, 22 nt, Homo sapiens
acccuuugucaaucaguacuaa

SEQ ID NO: 336610 - RNA, 22 nt, Homo sapiens
accuguagcagacuuaauauuu

SEQ ID NO: 336611 - RNA, 23 nt, Homo sapiens
accugugguuauuuuacucuucc

SEQ ID NO: 336612 - RNA, 22 nt, Homo sapiens
accuucauuguugccaugucca

SEQ ID NO: 336613 - RNA, 22 nt, Homo sapiens
accuugcacugagccgagauug

SEQ ID NO: 336614 - RNA, 22 nt, Homo sapiens
accuuguagcaaaccuaacaua

SEQ ID NO: 336615 - RNA, 22 nt, Homo sapiens
acgcagcacauucacagcuaug

SEQ ID NO: 336616 - RNA, 22 nt, Homo sapiens
acgugguaguacaguauuuuaa

SEQ ID NO: 336617 - RNA, 22 nt, Homo sapiens
acuaaggcacaauuuucucaua

SEQ ID NO: 336618 - RNA, 22 nt, Homo sapiens
acucacagcaaccuccgccucc

SEQ ID NO: 336619 - RNA, 18 nt, Homo sapiens
acucuguauguggagugg

SEQ ID NO: 336620 - RNA, 22 nt, Homo sapiens
acugagacugagaauguuucuu

SEQ ID NO: 336621 - RNA, 23 nt, Homo sapiens
acugagcaauguuuacauacuug

SEQ ID NO: 336622 - RNA, 22 nt, Homo sapiens
acugagccuuuaaaugacuuca

SEQ ID NO: 336623 - RNA, 22 nt, Homo sapiens
acugcacuccacccuuggcagc

SEQ ID NO: 336624 - RNA, 18 nt, Homo sapiens
acugcacuccaccuuggg

SEQ ID NO: 336625 - RNA, 22 nt, Homo sapiens
acugcacuccagccugagccug

SEQ ID NO: 336626 - RNA, 22 nt, Homo sapiens
acugcacuccagccugcccaac

SEQ ID NO: 336627 - RNA, 22 nt, Homo sapiens
cuucuguuaguucugauaacuu

SEQ ID NO: 336628 - RNA, 20 nt, Homo sapiens
cuugaagacuaugcugcuga

SEQ ID NO: 336629 - RNA, 22 nt, Homo sapiens
cuugaauguaaauaauguacag

SEQ ID NO: 336630 - RNA, 22 nt, Homo sapiens
cuugaccaauauggugaaaccc

SEQ ID NO: 336631 - RNA, 22 nt, Homo sapiens
cuugcacuguuguaagggacuu

SEQ ID NO: 336632 - RNA, 22 nt, Homo sapiens
cuugcagaggcccuggggagag

SEQ ID NO: 336633 - RNA, 21 nt, Homo sapiens
cuugucuugcuuagaauagac

SEQ ID NO: 336634 - RNA, 17 nt, Homo sapiens
cuuguugugguaguuug

SEQ ID NO: 336635 - RNA, 22 nt, Homo sapiens
cuuuaugagguuggauggaucu

SEQ ID NO: 336636 - RNA, 22 nt, Homo sapiens
cuuuccauuguuggagcauaaa

SEQ ID NO: 336637 - RNA, 22 nt, Homo sapiens
cuuugcacaucucugcuuuccc

SEQ ID NO: 336638 - RNA, 22 nt, Homo sapiens
cuuugggaccgcgguuuauacu

SEQ ID NO: 336639 - RNA, 21 nt, Homo sapiens
cuuugguagaguuuuuagggu

SEQ ID NO: 336640 - RNA, 23 nt, Homo sapiens
cuuugguaggaaauuugaauuau

SEQ ID NO: 336641 - RNA, 22 nt, Homo sapiens
cuuuggugauagauaccccaua

SEQ ID NO: 336642 - RNA, 22 nt, Homo sapiens
cuuugguguauuuucagagacc

SEQ ID NO: 336643 - RNA, 23 nt, Homo sapiens
cuuuguacagcuugacuacuggg

SEQ ID NO: 336644 - RNA, 20 nt, Homo sapiens
cuuuguccuccugcugugcu

SEQ ID NO: 336645 - RNA, 22 nt, Homo sapiens
cuuuguccuucaagguguguca

SEQ ID NO: 336646 - RNA, 22 nt, Homo sapiens
cuuuuggugguucugaugcagg

SEQ ID NO: 336647 - RNA, 22 nt, Homo sapiens
cuuuugugauuccucaguuacu

SEQ ID NO: 336648 - RNA, 22 nt, Homo sapiens
gaaaacugcuucucuggguuuc

SEQ ID NO: 336649 - RNA, 22 nt, Homo sapiens
gaaagugcugcuugacugggau

SEQ ID NO: 336650 - RNA, 22 nt, Homo sapiens
gaaaguguugagauuacaggca

SEQ ID NO: 336651 - RNA, 22 nt, Homo sapiens
gaaaucucuacuauuuugaucu

SEQ ID NO: 336652 - RNA, 22 nt, Homo sapiens
gaaaugcucagggguuuuccag

SEQ ID NO: 336653 - RNA, 22 nt, Homo sapiens
gaaaugcucauuuuggauccuu

SEQ ID NO: 336654 - RNA, 22 nt, Homo sapiens
gaaauguuuuucaugugggcaa

SEQ ID NO: 336655 - RNA, 22 nt, Homo sapiens
gaagacauuugcugcacguccu

SEQ ID NO: 336656 - RNA, 22 nt, Homo sapiens
gaagaucacacuguagaucuau

SEQ ID NO: 336657 - RNA, 23 nt, Homo sapiens
gaaguauagcaugcacauggaaa

SEQ ID NO: 336658 - RNA, 22 nt, Homo sapiens
gaagugcaguggcacagucaug

SEQ ID NO: 336659 - RNA, 22 nt, Homo sapiens
gaauagugcugcgauaaacaua

SEQ ID NO: 336660 - RNA, 22 nt, Homo sapiens
gaaucacugugguaucccaugc

SEQ ID NO: 336661 - RNA, 22 nt, Homo sapiens
gaaucccuugcauuaucccuuu

SEQ ID NO: 336662 - RNA, 22 nt, Homo sapiens
gaaugcuaagcaugugggaguu

SEQ ID NO: 336663 - RNA, 21 nt, Homo sapiens
gaauggcaccauuagcauaua

SEQ ID NO: 336664 - RNA, 20 nt, Homo sapiens
gacaaaccuagaugguacag

SEQ ID NO: 336665 - RNA, 22 nt, Homo sapiens
ucuuuguugcauaggcuuguuc

SEQ ID NO: 336666 - RNA, 22 nt, Homo sapiens
ucuuuuguaaaaugaggaggug

SEQ ID NO: 336667 - RNA, 22 nt, Homo sapiens
ugaaaagucuaagauuaagguu

SEQ ID NO: 336668 - RNA, 22 nt, Homo sapiens
ugaaagcuacaggaaaguauuu

SEQ ID NO: 336669 - RNA, 22 nt, Homo sapiens
ugaaaguuauauugugaaauuc

SEQ ID NO: 336670 - RNA, 22 nt, Homo sapiens
ugaaauacuuuggcucuuuguu

SEQ ID NO: 336671 - RNA, 22 nt, Homo sapiens
ugaaaugauuauaugguguuug

SEQ ID NO: 336672 - RNA, 22 nt, Homo sapiens
ugaaauuuuuuauucguuggcu

SEQ ID NO: 336673 - RNA, 20 nt, Homo sapiens
ugaacugguuacuuucuguc

SEQ ID NO: 336674 - RNA, 22 nt, Homo sapiens
ugaaggccgggcaugguggcuc

SEQ ID NO: 336675 - RNA, 22 nt, Homo sapiens
ugaagggcauuguuuugccaaa

SEQ ID NO: 336676 - RNA, 22 nt, Homo sapiens
ugaauacagcacacccaugggu

SEQ ID NO: 336677 - RNA, 22 nt, Homo sapiens
ugaauagaaguggcaggaguag

SEQ ID NO: 336678 - RNA, 22 nt, Homo sapiens
ugaauauguuucuaaaagugca

SEQ ID NO: 336679 - RNA, 22 nt, Homo sapiens
ugaaugguaaagaaaagcacug

SEQ ID NO: 336680 - RNA, 22 nt, Homo sapiens
ugaaugguaauuuaguaggcac

SEQ ID NO: 336681 - RNA, 22 nt, Homo sapiens
ugaauguauuuauuaccauuca

SEQ ID NO: 336682 - RNA, 22 nt, Homo sapiens
ugaauguccugacgcugcaguu

SEQ ID NO: 336683 - RNA, 22 nt, Homo sapiens
ugaauguuguugguugagauau

SEQ ID NO: 336684 - RNA, 22 nt, Homo sapiens
ugaauguuugcagcuuauacca

SEQ ID NO: 336685 - RNA, 22 nt, Homo sapiens
ugacaagaaagcgucuucuuuu

SEQ ID NO: 336686 - RNA, 22 nt, Homo sapiens
ugacaagaacuuuccauaguaa

SEQ ID NO: 336687 - RNA, 22 nt, Homo sapiens
ugacaagacuacauaucccauu

SEQ ID NO: 336688 - RNA, 22 nt, Homo sapiens
ugacaagaguagagagggugcc

SEQ ID NO: 336689 - RNA, 19 nt, Homo sapiens
ugacacuguuggugggagg

SEQ ID NO: 336690 - RNA, 22 nt, Homo sapiens
ugacagcugaagauguugaacc

SEQ ID NO: 336691 - RNA, 22 nt, Homo sapiens
ugacagucaccaggacccacag

SEQ ID NO: 336692 - RNA, 22 nt, Homo sapiens
ugacaugaagaaaaacagauuu

SEQ ID NO: 336693 - RNA, 22 nt, Homo sapiens
ugacaugaagucucccucuguu

SEQ ID NO: 336694 - RNA, 22 nt, Homo sapiens
ugacauguauuagcucagugcu

SEQ ID NO: 336695 - RNA, 22 nt, Homo sapiens
ugacauguccaggugguccugu

SEQ ID NO: 336696 - RNA, 22 nt, Homo sapiens
ugaccacagaaagugagggagc

SEQ ID NO: 336697 - RNA, 22 nt, Homo sapiens
ugacccauagaaauguggauaa

SEQ ID NO: 336698 - RNA, 22 nt, Homo sapiens
ugacuccagagacugugcuguc

SEQ ID NO: 336699 - RNA, 22 nt, Homo sapiens
ugacuggaacuuuagugagucu

SEQ ID NO: 336700 - RNA, 23 nt, Homo sapiens
ugacuggagacuguugauccuuu

SEQ ID NO: 336701 - RNA, 20 nt, Homo sapiens
ugacuggauacccuuuggcu

SEQ ID NO: 336702 - RNA, 22 nt, Homo sapiens
ugacuugaaguuaccauaugca

SEQ ID NO: 336703 - RNA, 16 nt, Homo sapiens
ugagaacaugcagcau

SEQ ID NO: 336704 - RNA, 16 nt, Homo sapiens
ugagaacaugugauau

SEQ ID NO: 336705 - RNA, 20 nt, Homo sapiens
ugagaacauguggcauuugg

SEQ ID NO: 336706 - RNA, 17 nt, Homo sapiens
ugagaacaugugguauu

SEQ ID NO: 336707 - RNA, 18 nt, Homo sapiens
ugagaacauguguacaca

SEQ ID NO: 336708 - RNA, 22 nt, Homo sapiens
ugagaacuguuuugguuugggu

SEQ ID NO: 336709 - RNA, 22 nt, Homo sapiens
ugagaagugacgcagcaggguu

SEQ ID NO: 336710 - RNA, 22 nt, Homo sapiens
ugagacaaucucaucucaguga

SEQ ID NO: 336711 - RNA, 22 nt, Homo sapiens
ugagacacuucccagaucccuu

SEQ ID NO: 336712 - RNA, 22 nt, Homo sapiens
ugagaccaacagauuccaguuc

SEQ ID NO: 336713 - RNA, 22 nt, Homo sapiens
ugagacggagucuugcucuguc

SEQ ID NO: 336714 - RNA, 22 nt, Homo sapiens
ugagacugaguuucucucuugu

SEQ ID NO: 336715 - RNA, 22 nt, Homo sapiens
ugagacuguuuuggggaacuuc

SEQ ID NO: 336716 - RNA, 22 nt, Homo sapiens
ugagagaugauaaaauguuugu

SEQ ID NO: 336717 - RNA, 19 nt, Homo sapiens
ugagagcacaacugaacaa

SEQ ID NO: 336718 - RNA, 22 nt, Homo sapiens
ugagauaacuaaaaacauuuug

SEQ ID NO: 336719 - RNA, 22 nt, Homo sapiens
ugagauaaucaugugguuuuug

SEQ ID NO: 336720 - RNA, 22 nt, Homo sapiens
ugagauaauuuacuuguugagg

SEQ ID NO: 336721 - RNA, 20 nt, Homo sapiens
ugagaucaggauuaaggcua

SEQ ID NO: 336722 - RNA, 22 nt, Homo sapiens
ugagauggaguuucgcccuugu

SEQ ID NO: 336723 - RNA, 19 nt, Homo sapiens
gaguugggguuuacuguaa

SEQ ID NO: 336724 - RNA, 22 nt, Homo sapiens
gauaucuuuuguauggugagcu

SEQ ID NO: 336725 - RNA, 22 nt, Homo sapiens
gauaugugauaagaguuaucuu

SEQ ID NO: 336726 - RNA, 22 nt, Homo sapiens
gauauuacuuccaauauugcaa

SEQ ID NO: 336727 - RNA, 22 nt, Homo sapiens
gaucagauggcuguuggugugu

SEQ ID NO: 336728 - RNA, 22 nt, Homo sapiens
gaucccauuggcugccaugugg

SEQ ID NO: 336729 - RNA, 22 nt, Homo sapiens
gaugagcuaaguucucacagca

SEQ ID NO: 336730 - RNA, 22 nt, Homo sapiens
gaugauauuugagucauuagaa

SEQ ID NO: 336731 - RNA, 22 nt, Homo sapiens
gaugaucucuggugguaaagac

SEQ ID NO: 336732 - RNA, 22 nt, Homo sapiens
gaugcaaauuaagcuugggaca

SEQ ID NO: 336733 - RNA, 22 nt, Homo sapiens
gauuccacuuacuuagcauucc

SEQ ID NO: 336734 - RNA, 22 nt, Homo sapiens
gauuucacuuucuggaugugca

SEQ ID NO: 336735 - RNA, 22 nt, Homo sapiens
gauuuguauuaaaagugugacg

SEQ ID NO: 336736 - RNA, 21 nt, Homo sapiens
gcaaaguggcuaccuugcucc

SEQ ID NO: 336737 - RNA, 22 nt, Homo sapiens
gcaaaguguuuuuaggaagucu

SEQ ID NO: 336738 - RNA, 20 nt, Homo sapiens
gcaacauggccagagugaau

SEQ ID NO: 336739 - RNA, 22 nt, Homo sapiens
gcacacguagaagcaugcauca

SEQ ID NO: 336740 - RNA, 22 nt, Homo sapiens
gcacagucaacacuuauucacc

SEQ ID NO: 336741 - RNA, 22 nt, Homo sapiens
gcaccccuuaccgggcuggguu

SEQ ID NO: 336742 - RNA, 22 nt, Homo sapiens
gcagagaaacaggucuaaggag

SEQ ID NO: 336743 - RNA, 20 nt, Homo sapiens
gcagcaccauauuucuaaga

SEQ ID NO: 336744 - RNA, 22 nt, Homo sapiens
gcaggaaucuugagaaggauuc

SEQ ID NO: 336745 - RNA, 22 nt, Homo sapiens
gcagguaguuucugacuuuuac

SEQ ID NO: 336746 - RNA, 22 nt, Homo sapiens
gcaguacacuguugguaggaau

SEQ ID NO: 336747 - RNA, 20 nt, Homo sapiens
gcaguacuuuuaguucuaag

SEQ ID NO: 336748 - RNA, 22 nt, Homo sapiens
gcaguguucaaaucaugcccau

SEQ ID NO: 336749 - RNA, 22 nt, Homo sapiens
gcaguguugugauccaggucuu

SEQ ID NO: 336750 - RNA, 17 nt, Homo sapiens
gcauauguugaaccagc

SEQ ID NO: 336751 - RNA, 22 nt, Homo sapiens
gcaucacagggagacaggccuc

SEQ ID NO: 336752 - RNA, 18 nt, Homo sapiens
gccaacauguaaacaggu

SEQ ID NO: 336753 - RNA, 22 nt, Homo sapiens
gccauugcacuccagccucggc

SEQ ID NO: 336754 - RNA, 22 nt, Homo sapiens
gcccuguaguauaguuugaagu

SEQ ID NO: 336755 - RNA, 22 nt, Homo sapiens
gccuagagaguuaucaggcugu

SEQ ID NO: 336756 - RNA, 22 nt, Homo sapiens
gcguugcacuccagccugggua

SEQ ID NO: 336757 - RNA, 22 nt, Homo sapiens
gcuaggagauccacugcucucu

SEQ ID NO: 336758 - RNA, 22 nt, Homo sapiens
gcucaugggcagugugauuguu

SEQ ID NO: 336759 - RNA, 22 nt, Homo sapiens
gcugaaauguuuaauuugggag

SEQ ID NO: 336760 - RNA, 22 nt, Homo sapiens
gcugauggugcaguucuagccu

SEQ ID NO: 336761 - RNA, 17 nt, Homo sapiens
gcugcauucauguagaa

SEQ ID NO: 336762 - RNA, 22 nt, Homo sapiens
gcuguguguuaucagaaauugc

SEQ ID NO: 336763 - RNA, 22 nt, Homo sapiens
gcuguguucucgaggcggggga

SEQ ID NO: 336764 - RNA, 18 nt, Homo sapiens
aaaaagugcucaggccua

SEQ ID NO: 336765 - RNA, 22 nt, Homo sapiens
aaaaugcugauauugggcccca

SEQ ID NO: 336766 - RNA, 22 nt, Homo sapiens
aaacccauauaccagcugugcu

SEQ ID NO: 336767 - RNA, 22 nt, Homo sapiens
aaagcacugaauaaauuugcuu

SEQ ID NO: 336768 - RNA, 22 nt, Homo sapiens
aaaggcaucugcucggcucccu

SEQ ID NO: 336769 - RNA, 20 nt, Homo sapiens
aaaggcugugagaacgagau

SEQ ID NO: 336770 - RNA, 22 nt, Homo sapiens
aaagggcuuuguaaacuucaag

SEQ ID NO: 336771 - RNA, 22 nt, Homo sapiens
aaaguaauugcaguuuuugcaa

SEQ ID NO: 336772 - RNA, 22 nt, Homo sapiens
aaagucuguuacagcuauuucu

SEQ ID NO: 336773 - RNA, 22 nt, Homo sapiens
aaagucuguuuugucagagacu

SEQ ID NO: 336774 - RNA, 22 nt, Homo sapiens
aaagugaauguaucccguaagu

SEQ ID NO: 336775 - RNA, 22 nt, Homo sapiens
aaagugcaguauuugggcagga

SEQ ID NO: 336776 - RNA, 22 nt, Homo sapiens
auugcuaacugaaauaagacca

SEQ ID NO: 336777 - RNA, 22 nt, Homo sapiens
auuggcuauuuggugagugauu

SEQ ID NO: 336778 - RNA, 22 nt, Homo sapiens
auuggguuaaaggauaugaaca

SEQ ID NO: 336779 - RNA, 22 nt, Homo sapiens
auuguacauacaccggugugua

SEQ ID NO: 336780 - RNA, 22 nt, Homo sapiens
auuguacuccagccugggcaaa

SEQ ID NO: 336781 - RNA, 22 nt, Homo sapiens
auuguaguuugcuauggcaaua

SEQ ID NO: 336782 - RNA, 21 nt, Homo sapiens
auuguauguaaaccaaaugag

SEQ ID NO: 336783 - RNA, 22 nt, Homo sapiens
auugugauugcugcuaggccua

SEQ ID NO: 336784 - RNA, 22 nt, Homo sapiens
auuucacugagacaugugccca

SEQ ID NO: 336785 - RNA, 22 nt, Homo sapiens
auuugacacugagagccucagu

SEQ ID NO: 336786 - RNA, 21 nt, Homo sapiens
auuugguggcugugugacacu

SEQ ID NO: 336787 - RNA, 22 nt, Homo sapiens
auuugucacuauguggcuaaua

SEQ ID NO: 336788 - RNA, 22 nt, Homo sapiens
auuuugcauugcuguaaaggaa

SEQ ID NO: 336789 - RNA, 22 nt, Homo sapiens
caaagcacuuggcuuggaagau

SEQ ID NO: 336790 - RNA, 22 nt, Homo sapiens
caaaguaauugcuguuuugcca

SEQ ID NO: 336791 - RNA, 22 nt, Homo sapiens
caaagugcuggccgggcgcagu

SEQ ID NO: 336792 - RNA, 22 nt, Homo sapiens
caaagugguuuauacaugauug

SEQ ID NO: 336793 - RNA, 22 nt, Homo sapiens
caaaugaucugcuggccucagc

SEQ ID NO: 336794 - RNA, 19 nt, Homo sapiens
caacccugcagagaaagga

SEQ ID NO: 336795 - RNA, 22 nt, Homo sapiens
caagaggcuguguauaaagcca

SEQ ID NO: 336796 - RNA, 22 nt, Homo sapiens
caagaucauuuaugcuaaaauu

SEQ ID NO: 336797 - RNA, 22 nt, Homo sapiens
caaggaauucucaauagaguua

SEQ ID NO: 336798 - RNA, 22 nt, Homo sapiens
caagugcuacagagaaaucuuu

SEQ ID NO: 336799 - RNA, 22 nt, Homo sapiens
caagugcuugaugaaugaucaa

SEQ ID NO: 336800 - RNA, 22 nt, Homo sapiens
caaguguuuccuuaaauacuug

SEQ ID NO: 336801 - RNA, 22 nt, Homo sapiens
caauacuguguugaauaagagu

SEQ ID NO: 336802 - RNA, 22 nt, Homo sapiens
caaugcagcuuuuggagagaaa

SEQ ID NO: 336803 - RNA, 22 nt, Homo sapiens
caauggcaaugaaauagugaga

SEQ ID NO: 336804 - RNA, 22 nt, Homo sapiens
caaugguuuuuuaguauaagua

SEQ ID NO: 336805 - RNA, 22 nt, Homo sapiens
caauugcacucuuagguguaca

SEQ ID NO: 336806 - RNA, 22 nt, Homo sapiens
cacacuguuuuccauggggguu

SEQ ID NO: 336807 - RNA, 22 nt, Homo sapiens
cacagcgacuuccgccuaccgg

SEQ ID NO: 336808 - RNA, 22 nt, Homo sapiens
cacaguagaauagagcacuagg

SEQ ID NO: 336809 - RNA, 22 nt, Homo sapiens
cacaguguuccagcuauuugaa

SEQ ID NO: 336810 - RNA, 22 nt, Homo sapiens
cacauagcuagucaguagugaa

SEQ ID NO: 336811 - RNA, 22 nt, Homo sapiens
cacccaguaagcaugaggcccu

SEQ ID NO: 336812 - RNA, 22 nt, Homo sapiens
cacccagucaucuuggguuuuu

SEQ ID NO: 336813 - RNA, 22 nt, Homo sapiens
caccugagcgggaugcucgccu

SEQ ID NO: 336814 - RNA, 22 nt, Homo sapiens
cacuagagaauagguaguucug

SEQ ID NO: 336815 - RNA, 22 nt, Homo sapiens
cacuaggcuggagugcaguggc

SEQ ID NO: 336816 - RNA, 22 nt, Homo sapiens
cacugcacuccagccuaagagg

SEQ ID NO: 336817 - RNA, 22 nt, Homo sapiens
cacugcacuccagucugacgac

SEQ ID NO: 336818 - RNA, 22 nt, Homo sapiens
cacugcauccuccaccugccag

SEQ ID NO: 336819 - RNA, 22 nt, Homo sapiens
cacugcauccucugccuggcgg

SEQ ID NO: 336820 - RNA, 22 nt, Homo sapiens
cacugggccaucacuuaauauu

SEQ ID NO: 336821 - RNA, 17 nt, Homo sapiens
cacugggugcaagagga

SEQ ID NO: 336822 - RNA, 22 nt, Homo sapiens
cacuggguuagaacaugcuccu

SEQ ID NO: 336823 - RNA, 21 nt, Homo sapiens
cacuggguucaggcuugugga

SEQ ID NO: 336824 - RNA, 22 nt, Homo sapiens
cagagaucaugcaacugcucgc

SEQ ID NO: 336825 - RNA, 22 nt, Homo sapiens
cagauacuccuggucucaggag

SEQ ID NO: 336826 - RNA, 22 nt, Homo sapiens
cagauacuggccuggagcugug

SEQ ID NO: 336827 - RNA, 22 nt, Homo sapiens
cagcccguaaucccagcacuuu

SEQ ID NO: 336828 - RNA, 22 nt, Homo sapiens
caggaaugugaggguucccugc

SEQ ID NO: 336829 - RNA, 22 nt, Homo sapiens
caggaccucuugccuggaagcc

SEQ ID NO: 336830 - RNA, 22 nt, Homo sapiens
caggcaacauggcgaaacucug

SEQ ID NO: 336831 - RNA, 22 nt, Homo sapiens
caggcacgcuugggagacacac

SEQ ID NO: 336832 - RNA, 22 nt, Homo sapiens
caggcagugggagacaaaacug

SEQ ID NO: 336833 - RNA, 22 nt, Homo sapiens
cagguaagaugcuuucucuuau

SEQ ID NO: 336834 - RNA, 22 nt, Homo sapiens
cagguacauuuuaaagggcuca

SEQ ID NO: 336835 - RNA, 22 nt, Homo sapiens
caggugguauuugguuuucugu

SEQ ID NO: 336836 - RNA, 22 nt, Homo sapiens
caguacaauguggaaaaggagu

SEQ ID NO: 336837 - RNA, 22 nt, Homo sapiens
cagucacugggauuauggucau

SEQ ID NO: 336838 - RNA, 22 nt, Homo sapiens
cagugaauuucaggucaagagu

SEQ ID NO: 336839 - RNA, 20 nt, Homo sapiens
cagugcacuuucccacuggu

SEQ ID NO: 336840 - RNA, 20 nt, Homo sapiens
cagugcauugcuucugauuu

SEQ ID NO: 336841 - RNA, 22 nt, Homo sapiens
cagugcuuuaucaaguccucca

SEQ ID NO: 336842 - RNA, 22 nt, Homo sapiens
caguggacuaaauggggaauau

SEQ ID NO: 336843 - RNA, 22 nt, Homo sapiens
cagugguuuucucaguucagca

SEQ ID NO: 336844 - RNA, 22 nt, Homo sapiens
cagugucugcauuuggaacuca

SEQ ID NO: 336845 - RNA, 22 nt, Homo sapiens
caguugcacuagccccguuuca

SEQ ID NO: 336846 - RNA, 22 nt, Homo sapiens
caguuguuuuaugacauaagau

SEQ ID NO: 336847 - RNA, 22 nt, Homo sapiens
caucaaaguggagggaaggacc

SEQ ID NO: 336848 - RNA, 21 nt, Homo sapiens
caucaaauugucauggugggu

SEQ ID NO: 336849 - RNA, 22 nt, Homo sapiens
caucacaucugcaugguaagua

SEQ ID NO: 336850 - RNA, 22 nt, Homo sapiens
caucccauucgaggggcacagc

SEQ ID NO: 336851 - RNA, 22 nt, Homo sapiens
caucccugaaccccagaaaucu

SEQ ID NO: 336852 - RNA, 22 nt, Homo sapiens
caugaaagugagaaacuccugg

SEQ ID NO: 336853 - RNA, 22 nt, Homo sapiens
caugaacacugugcggcuuccu

SEQ ID NO: 336854 - RNA, 23 nt, Homo sapiens
caugaacuaguuugcagccauga

SEQ ID NO: 336855 - RNA, 22 nt, Homo sapiens
caugauauugcagaauguuggu

SEQ ID NO: 336856 - RNA, 22 nt, Homo sapiens
caugccauugcucuccugggug

SEQ ID NO: 336857 - RNA, 22 nt, Homo sapiens
cauggcacaucuuuucugacua

SEQ ID NO: 336858 - RNA, 22 nt, Homo sapiens
cauggcacugagcagguaugca

SEQ ID NO: 336859 - RNA, 22 nt, Homo sapiens
cauggcacuguaugaaaugugc

SEQ ID NO: 336860 - RNA, 22 nt, Homo sapiens
cauggcaucuguguggccucca

SEQ ID NO: 336861 - RNA, 19 nt, Homo sapiens
cauggcuuauaauuuuaau

SEQ ID NO: 336862 - RNA, 22 nt, Homo sapiens
caugguacugccacagaagagu

SEQ ID NO: 336863 - RNA, 22 nt, Homo sapiens
caugucuuuuaaacauucaacu

SEQ ID NO: 336864 - RNA, 22 nt, Homo sapiens
gaaucauuguuucuaaguuugu

SEQ ID NO: 336865 - RNA, 22 nt, Homo sapiens
gaaugauacuguuaacgaaaga

SEQ ID NO: 336866 - RNA, 22 nt, Homo sapiens
gaaugcaugaggggaucagaug

SEQ ID NO: 336867 - RNA, 22 nt, Homo sapiens
gaauggaacugacuauagcuga

SEQ ID NO: 336868 - RNA, 20 nt, Homo sapiens
gaaugguuucgggguucuug

SEQ ID NO: 336869 - RNA, 22 nt, Homo sapiens
gaauguuuacuuuguuuaauac

SEQ ID NO: 336870 - RNA, 22 nt, Homo sapiens
gacaccauuucaguacuagguu

SEQ ID NO: 336871 - RNA, 22 nt, Homo sapiens
gacaccugguguggaacuggag

SEQ ID NO: 336872 - RNA, 22 nt, Homo sapiens
gacagacacaauugauccauga

SEQ ID NO: 336873 - RNA, 22 nt, Homo sapiens
gacauagcuagauaaccucaug

SEQ ID NO: 336874 - RNA, 22 nt, Homo sapiens
gacauguuuuuuaagguuuaug

SEQ ID NO: 336875 - RNA, 22 nt, Homo sapiens
gaccaaagaggcaggcauuaga

SEQ ID NO: 336876 - RNA, 22 nt, Homo sapiens
gacuauguuaccuuacacauca

SEQ ID NO: 336877 - RNA, 22 nt, Homo sapiens
gacucuguagacaaucacaucu

SEQ ID NO: 336878 - RNA, 22 nt, Homo sapiens
gacuggagcuguaugugguuac

SEQ ID NO: 336879 - RNA, 22 nt, Homo sapiens
gacuggguuaguuugaaagacu

SEQ ID NO: 336880 - RNA, 22 nt, Homo sapiens
gagaacagaagcauuccuaauu

SEQ ID NO: 336881 - RNA, 22 nt, Homo sapiens
gagaacagagauaauuuuacuu

SEQ ID NO: 336882 - RNA, 22 nt, Homo sapiens
gagaacuggcugauucaaggac

SEQ ID NO: 336883 - RNA, 22 nt, Homo sapiens
gagaaugagauuaugguuacau

SEQ ID NO: 336884 - RNA, 22 nt, Homo sapiens
gagacggagucucgcucuguca

SEQ ID NO: 336885 - RNA, 22 nt, Homo sapiens
gagacugagucuugcucuguca

SEQ ID NO: 336886 - RNA, 22 nt, Homo sapiens
gagagucacagugaauguggca

SEQ ID NO: 336887 - RNA, 22 nt, Homo sapiens
gagagugcuuuggguguaggcc

SEQ ID NO: 336888 - RNA, 22 nt, Homo sapiens
gagagugugucagaggcugcga

SEQ ID NO: 336889 - RNA, 22 nt, Homo sapiens
gagauauucugguuuacuaaau

SEQ ID NO: 336890 - RNA, 22 nt, Homo sapiens
gagaucauugugggccaagcug

SEQ ID NO: 336891 - RNA, 22 nt, Homo sapiens
gagaugaagugucaauaaggau

SEQ ID NO: 336892 - RNA, 20 nt, Homo sapiens
gagauguugaucagggcuau

SEQ ID NO: 336893 - RNA, 22 nt, Homo sapiens
gagauguuuguuucacugucac

SEQ ID NO: 336894 - RNA, 22 nt, Homo sapiens
gagauuaacauuugaggagcug

SEQ ID NO: 336895 - RNA, 22 nt, Homo sapiens
gagauuaauacacaucaaaugc

SEQ ID NO: 336896 - RNA, 22 nt, Homo sapiens
gagauuauuuaaaaggugauuu

SEQ ID NO: 336897 - RNA, 22 nt, Homo sapiens
gagauucaucuagguccagaga

SEQ ID NO: 336898 - RNA, 22 nt, Homo sapiens
gagauucuucaauauuuauucu

SEQ ID NO: 336899 - RNA, 22 nt, Homo sapiens
gagauuuucagcuugacuggga

SEQ ID NO: 336900 - RNA, 22 nt, Homo sapiens
gagcaaugagcugccugcugag

SEQ ID NO: 336901 - RNA, 22 nt, Homo sapiens
gagcacauguggagagucuggg

SEQ ID NO: 336902 - RNA, 22 nt, Homo sapiens
gagcaccagucccugucagugc

SEQ ID NO: 336903 - RNA, 22 nt, Homo sapiens
gagcccauuucacuuguccagc

SEQ ID NO: 336904 - RNA, 22 nt, Homo sapiens
gagcuagggucaugcuacugca

SEQ ID NO: 336905 - RNA, 21 nt, Homo sapiens
gagcuaggugaggcuguaaug

SEQ ID NO: 336906 - RNA, 22 nt, Homo sapiens
gagcuccuccccuuggcuuuca

SEQ ID NO: 336907 - RNA, 22 nt, Homo sapiens
gagcugaaguuuccauuuguac

SEQ ID NO: 336908 - RNA, 22 nt, Homo sapiens
gagcugaucuuuauguaaauuc

SEQ ID NO: 336909 - RNA, 22 nt, Homo sapiens
gagcuggacuucuuaccuuuuc

SEQ ID NO: 336910 - RNA, 22 nt, Homo sapiens
gagcugguccuuuaaggaugca

SEQ ID NO: 336911 - RNA, 22 nt, Homo sapiens
gagcuguuuuucacuagaccaa

SEQ ID NO: 336912 - RNA, 22 nt, Homo sapiens
gagcuuggguuaaaguugccuu

SEQ ID NO: 336913 - RNA, 22 nt, Homo sapiens
gaggaaguaauuuuaggccugu

SEQ ID NO: 336914 - RNA, 22 nt, Homo sapiens
gaggagucagacugugcaaggu

SEQ ID NO: 336915 - RNA, 22 nt, Homo sapiens
gaggcaaugugcccggcccaca

SEQ ID NO: 336916 - RNA, 22 nt, Homo sapiens
gaggcaguguguccguucucgg

SEQ ID NO: 336917 - RNA, 22 nt, Homo sapiens
gaggcggugugaugucacaugc

SEQ ID NO: 336918 - RNA, 22 nt, Homo sapiens
gaggguguuguguugcuuaaua

SEQ ID NO: 336919 - RNA, 22 nt, Homo sapiens
gagguaaguaagaauggcaagc

SEQ ID NO: 336920 - RNA, 22 nt, Homo sapiens
gagguagagacuauguauuaga

SEQ ID NO: 336921 - RNA, 22 nt, Homo sapiens
gagguagagaguuuugauucug

SEQ ID NO: 336922 - RNA, 22 nt, Homo sapiens
gaguaaaugucacuguugcugu

SEQ ID NO: 336923 - RNA, 23 nt, Homo sapiens
gaguacauuaaaagcccagacug

SEQ ID NO: 336924 - RNA, 22 nt, Homo sapiens
gagugcaaagguccugaggugg

SEQ ID NO: 336925 - RNA, 23 nt, Homo sapiens
gagugcaaugacaugaucucgga

SEQ ID NO: 336926 - RNA, 22 nt, Homo sapiens
gagugcauaugggccuguguca

SEQ ID NO: 336927 - RNA, 23 nt, Homo sapiens
gaguggagacucauugauuuccu

SEQ ID NO: 336928 - RNA, 22 nt, Homo sapiens
gaguuuguaaacuauucacuaa

SEQ ID NO: 336929 - RNA, 22 nt, Homo sapiens
gauaaagauagcaauagggaca

SEQ ID NO: 336930 - RNA, 22 nt, Homo sapiens
gauaaaguauuggguacuaugc

SEQ ID NO: 336931 - RNA, 22 nt, Homo sapiens
gauacuguauccuaaaagcuuu

SEQ ID NO: 336932 - RNA, 22 nt, Homo sapiens
gauauguaaaaauuauaucuga

SEQ ID NO: 336933 - RNA, 22 nt, Homo sapiens
gauauguguuuuagucaggguu

SEQ ID NO: 336934 - RNA, 22 nt, Homo sapiens
gaucagagugaaccuuguuaug

SEQ ID NO: 336935 - RNA, 22 nt, Homo sapiens
gaucuguguuuguaugcauaag

SEQ ID NO: 336936 - RNA, 22 nt, Homo sapiens
gaucuguuguuuggaaguauca

SEQ ID NO: 336937 - RNA, 22 nt, Homo sapiens
gaucuguuucaauugucuuagu

SEQ ID NO: 336938 - RNA, 22 nt, Homo sapiens
gaugaacugucuuacuacucac

SEQ ID NO: 336939 - RNA, 22 nt, Homo sapiens
gaugaggcuagagacaugugua

SEQ ID NO: 336940 - RNA, 22 nt, Homo sapiens
gaugccuuuuuguccucaguua

SEQ ID NO: 336941 - RNA, 22 nt, Homo sapiens
gaugguuuuucuccgauuuaua

SEQ ID NO: 336942 - RNA, 22 nt, Homo sapiens
gaugguuuuuuaagaagagccu

SEQ ID NO: 336943 - RNA, 22 nt, Homo sapiens
gauguguuuguuucuggaggag

SEQ ID NO: 336944 - RNA, 21 nt, Homo sapiens
gcaaacauccuuugaugccag

SEQ ID NO: 336945 - RNA, 22 nt, Homo sapiens
gcaagagguaucuuauuuuccc

SEQ ID NO: 336946 - RNA, 22 nt, Homo sapiens
gcaagaguauuucaaggaagau

SEQ ID NO: 336947 - RNA, 21 nt, Homo sapiens
gcaaguacuaucaucauuauc

SEQ ID NO: 336948 - RNA, 22 nt, Homo sapiens
gcacaggguuacauucuaaggu

SEQ ID NO: 336949 - RNA, 22 nt, Homo sapiens
gcacaguaggugguaggacuuu

SEQ ID NO: 336950 - RNA, 22 nt, Homo sapiens
gcacaguggcucccgucuauaa

SEQ ID NO: 336951 - RNA, 22 nt, Homo sapiens
gcagaauugacucuguuuuuuc

SEQ ID NO: 336952 - RNA, 22 nt, Homo sapiens
gugcauaucugugguuggcuga

SEQ ID NO: 336953 - RNA, 22 nt, Homo sapiens
gugcauaugcaugugcaugcac

SEQ ID NO: 336954 - RNA, 22 nt, Homo sapiens
gugccuucuagcuaugguuggc

SEQ ID NO: 336955 - RNA, 16 nt, Homo sapiens
gugcuguguuguuagg

SEQ ID NO: 336956 - RNA, 22 nt, Homo sapiens
guggaaaucucugugugacuua

SEQ ID NO: 336957 - RNA, 22 nt, Homo sapiens
guggaaggucaugaauguucuu

SEQ ID NO: 336958 - RNA, 22 nt, Homo sapiens
guggaauuauagagacaucuug

SEQ ID NO: 336959 - RNA, 22 nt, Homo sapiens
guggagacaaaggcugagugag

SEQ ID NO: 336960 - RNA, 22 nt, Homo sapiens
guggagucaucacucagagugg

SEQ ID NO: 336961 - RNA, 22 nt, Homo sapiens
guggcaaacucagcaugcccca

SEQ ID NO: 336962 - RNA, 22 nt, Homo sapiens
guggcagaaaagagaagcaaug

SEQ ID NO: 336963 - RNA, 22 nt, Homo sapiens
guggcagagucagagggaaaug

SEQ ID NO: 336964 - RNA, 22 nt, Homo sapiens
guggcuuuauuuagaagcaggg

SEQ ID NO: 336965 - RNA, 22 nt, Homo sapiens
gugggaagcuggaacucccucc

SEQ ID NO: 336966 - RNA, 22 nt, Homo sapiens
gugggguaggguaggacucaac

SEQ ID NO: 336967 - RNA, 22 nt, Homo sapiens
guggggucaucucauuugugga

SEQ ID NO: 336968 - RNA, 19 nt, Homo sapiens
gugguauuaccuuuugauu

SEQ ID NO: 336969 - RNA, 22 nt, Homo sapiens
gugguucuaaaccuuuuuuggu

SEQ ID NO: 336970 - RNA, 22 nt, Homo sapiens
gugguuuucaacuccaccugca

SEQ ID NO: 336971 - RNA, 22 nt, Homo sapiens
gugguuuuuaaaguaccugugg

SEQ ID NO: 336972 - RNA, 22 nt, Homo sapiens
guguaaaacaauuagaggauuu

SEQ ID NO: 336973 - RNA, 22 nt, Homo sapiens
guguaaaucugcugugaacauu

SEQ ID NO: 336974 - RNA, 20 nt, Homo sapiens
guguaagagcaagcuuccua

SEQ ID NO: 336975 - RNA, 22 nt, Homo sapiens
guguagagaaauagccugaagg

SEQ ID NO: 336976 - RNA, 21 nt, Homo sapiens
gugucacagacaugacagaug

SEQ ID NO: 336977 - RNA, 22 nt, Homo sapiens
gugucaugagggggacaggaag

SEQ ID NO: 336978 - RNA, 22 nt, Homo sapiens
gugucccagugugcauacaggu

SEQ ID NO: 336979 - RNA, 22 nt, Homo sapiens
guguccucgaguacacaucagg

SEQ ID NO: 336980 - RNA, 22 nt, Homo sapiens
gugucucagcccagaccuauuu

SEQ ID NO: 336981 - RNA, 22 nt, Homo sapiens
gugugcaauuuugugggaggca

SEQ ID NO: 336982 - RNA, 22 nt, Homo sapiens
guguggcaggugggggcucaga

SEQ ID NO: 336983 - RNA, 22 nt, Homo sapiens
guguuugauugcaaauaaucua

SEQ ID NO: 336984 - RNA, 22 nt, Homo sapiens
guuaugcagcaauugauaaucu

SEQ ID NO: 336985 - RNA, 22 nt, Homo sapiens
guuauguuaguuacaaggcuag

SEQ ID NO: 336986 - RNA, 22 nt, Homo sapiens
guuauguuauguuauguuaugu

SEQ ID NO: 336987 - RNA, 22 nt, Homo sapiens
guuauuaguugauauuaaguuc

SEQ ID NO: 336988 - RNA, 22 nt, Homo sapiens
guucaaggaauguuggcuucuc

SEQ ID NO: 336989 - RNA, 22 nt, Homo sapiens
guucacagugguugccuuccag

SEQ ID NO: 336990 - RNA, 22 nt, Homo sapiens
guucaucaggaauauuggccua

SEQ ID NO: 336991 - RNA, 22 nt, Homo sapiens
guugaucuauguugcuggcagu

SEQ ID NO: 336992 - RNA, 22 nt, Homo sapiens
guuuggauuuucuaauuucugu

SEQ ID NO: 336993 - RNA, 22 nt, Homo sapiens
guuuggcucuuguuucugucaa

SEQ ID NO: 336994 - RNA, 22 nt, Homo sapiens
uaaacugucuugcaguuacaug

SEQ ID NO: 336995 - RNA, 22 nt, Homo sapiens
uaaagauaaggcucgcuuggau

SEQ ID NO: 336996 - RNA, 22 nt, Homo sapiens
uaaagccauugucaaguuugua

SEQ ID NO: 336997 - RNA, 22 nt, Homo sapiens
uaaagcuacaguauaugguauu

SEQ ID NO: 336998 - RNA, 20 nt, Homo sapiens
uaaagcugcucagggggcuc

SEQ ID NO: 336999 - RNA, 22 nt, Homo sapiens
uaaagcuuagauccaugguggc

SEQ ID NO: 337000 - RNA, 22 nt, Homo sapiens
uaaagcuuggauuuaggcuaau

SEQ ID NO: 337001 - RNA, 22 nt, Homo sapiens
uaaagugaggauggcaguaggu

SEQ ID NO: 337002 - RNA, 22 nt, Homo sapiens
uaaagugcugagaugaggcugg

SEQ ID NO: 337003 - RNA, 22 nt, Homo sapiens
uaaaguuauugccccucaguua

SEQ ID NO: 337004 - RNA, 22 nt, Homo sapiens
uaaaugcucuuuaaaagugcuu

SEQ ID NO: 337005 - RNA, 22 nt, Homo sapiens
uaacaacauucuaacugacggc

SEQ ID NO: 337006 - RNA, 22 nt, Homo sapiens
uaacacccuucuccagguacau

SEQ ID NO: 337007 - RNA, 22 nt, Homo sapiens
uaacagucuccucaagguguug

SEQ ID NO: 337008 - RNA, 22 nt, Homo sapiens
uaacauagucauauacuugcuu

SEQ ID NO: 337009 - RNA, 22 nt, Homo sapiens
uaacuaguagauggcugacaua

SEQ ID NO: 337010 - RNA, 22 nt, Homo sapiens
uaacuaguggaauuugauuuca

SEQ ID NO: 337011 - RNA, 22 nt, Homo sapiens
uaacugcaaccuccgccucccg

SEQ ID NO: 337012 - RNA, 22 nt, Homo sapiens
uaagacacauguguucccaggc

SEQ ID NO: 337013 - RNA, 20 nt, Homo sapiens
uaagacaugguccacaugcc

SEQ ID NO: 337014 - RNA, 22 nt, Homo sapiens
uaagacugccccagacagcaag

SEQ ID NO: 337015 - RNA, 22 nt, Homo sapiens
uaaggaaggcugugugcuuuua

SEQ ID NO: 337016 - RNA, 22 nt, Homo sapiens
uaagguguagacuggucacaag

SEQ ID NO: 337017 - RNA, 22 nt, Homo sapiens
uaagguuuuugauaugcugcug

SEQ ID NO: 337018 - RNA, 22 nt, Homo sapiens
uaaguauagguaacagaagcaa

SEQ ID NO: 337019 - RNA, 22 nt, Homo sapiens
uaaguaucaguuuagcuaugau

SEQ ID NO: 337020 - RNA, 22 nt, Homo sapiens
uaaguauuaggccccaggcugg

SEQ ID NO: 337021 - RNA, 22 nt, Homo sapiens
uaaguauuuuaauuccuggcau

SEQ ID NO: 337022 - RNA, 22 nt, Homo sapiens
uaagugacuuugagauuccuca

SEQ ID NO: 337023 - RNA, 22 nt, Homo sapiens
uaagugcaacauaaguguuaaa

SEQ ID NO: 337024 - RNA, 22 nt, Homo sapiens
uaagugcaugauuacaugcaua

SEQ ID NO: 337025 - RNA, 20 nt, Homo sapiens
uaaguuguauuugucaugaa

SEQ ID NO: 337026 - RNA, 22 nt, Homo sapiens
uaauacauucaaggugguaguu

SEQ ID NO: 337027 - RNA, 22 nt, Homo sapiens
uaauacuugucauaaaggcauu

SEQ ID NO: 337028 - RNA, 22 nt, Homo sapiens
uaauagcucggauaaacaugau

SEQ ID NO: 337029 - RNA, 22 nt, Homo sapiens
uaauaguguuaaugcuagagcu

SEQ ID NO: 337030 - RNA, 22 nt, Homo sapiens
uaauauguauacagacagauac

SEQ ID NO: 337031 - RNA, 22 nt, Homo sapiens
uaaucucagcugagcugagauu

SEQ ID NO: 337032 - RNA, 22 nt, Homo sapiens
uaaugcacucgaaucauggaau

SEQ ID NO: 337033 - RNA, 22 nt, Homo sapiens
uaaugcuguggucugguuuaaa

SEQ ID NO: 337034 - RNA, 22 nt, Homo sapiens
uaauucugacaacaguggcguu

SEQ ID NO: 337035 - RNA, 22 nt, Homo sapiens
uacaaagcuacucgagggcagg

SEQ ID NO: 337036 - RNA, 22 nt, Homo sapiens
uacaaaguaacaguuccuguau

SEQ ID NO: 337037 - RNA, 16 nt, Homo sapiens
uacaacagugaguaug

SEQ ID NO: 337038 - RNA, 22 nt, Homo sapiens
uacaagguaucagugaccguaa

SEQ ID NO: 337039 - RNA, 22 nt, Homo sapiens
uacaccauuugauucuuuaagc

SEQ ID NO: 337040 - RNA, 22 nt, Homo sapiens
ucuggguuuuguaccgugcucg

SEQ ID NO: 337041 - RNA, 22 nt, Homo sapiens
ucuggguuuuuccauugccggu

SEQ ID NO: 337042 - RNA, 22 nt, Homo sapiens
ucugguggugaugagagacagu

SEQ ID NO: 337043 - RNA, 22 nt, Homo sapiens
ucugugaaugaacacuugaaaa

SEQ ID NO: 337044 - RNA, 22 nt, Homo sapiens
ucugugcauggcagaggaauga

SEQ ID NO: 337045 - RNA, 22 nt, Homo sapiens
ucuguggugggcuccacccagu

SEQ ID NO: 337046 - RNA, 22 nt, Homo sapiens
ucuguguuuagacccaggguag

SEQ ID NO: 337047 - RNA, 22 nt, Homo sapiens
ucuuaggauacugaagucgguu

SEQ ID NO: 337048 - RNA, 22 nt, Homo sapiens
ucuuauuuggggaaaggguccu

SEQ ID NO: 337049 - RNA, 22 nt, Homo sapiens
ucuucuagcggaacccucuugu

SEQ ID NO: 337050 - RNA, 17 nt, Homo sapiens
ucuucuguuacuguggc

SEQ ID NO: 337051 - RNA, 20 nt, Homo sapiens
ucuugaacuuagucaacagg

SEQ ID NO: 337052 - RNA, 22 nt, Homo sapiens
ucuugcaauuuccuuaguggug

SEQ ID NO: 337053 - RNA, 22 nt, Homo sapiens
ucuugccacuucauccccuuuc

SEQ ID NO: 337054 - RNA, 22 nt, Homo sapiens
ucuuggguuuguccuucuccua

SEQ ID NO: 337055 - RNA, 22 nt, Homo sapiens
ucuugucacugcauccccagcu

SEQ ID NO: 337056 - RNA, 22 nt, Homo sapiens
ucuuuagguguuauaguucaag

SEQ ID NO: 337057 - RNA, 22 nt, Homo sapiens
ucuuugaguuauugugcagacu

SEQ ID NO: 337058 - RNA, 22 nt, Homo sapiens
ucuuuggguguauuucacagcc

SEQ ID NO: 337059 - RNA, 22 nt, Homo sapiens
ucuuuguucaggagccaacucc

SEQ ID NO: 337060 - RNA, 22 nt, Homo sapiens
ucuuuguuuucugauccugaag

SEQ ID NO: 337061 - RNA, 22 nt, Homo sapiens
ugaaacacaccuccucuccauc

SEQ ID NO: 337062 - RNA, 20 nt, Homo sapiens
ugaaacacauggacuggggu

SEQ ID NO: 337063 - RNA, 22 nt, Homo sapiens
ugaaagcuacagucuccuagga

SEQ ID NO: 337064 - RNA, 20 nt, Homo sapiens
ugaaaucuucacuaagucuc

SEQ ID NO: 337065 - RNA, 22 nt, Homo sapiens
ugaaaugguuaugugaggagau

SEQ ID NO: 337066 - RNA, 22 nt, Homo sapiens
ugaacacaucuccugguaccug

SEQ ID NO: 337067 - RNA, 21 nt, Homo sapiens
ugaacacuggacugagugucc

SEQ ID NO: 337068 - RNA, 22 nt, Homo sapiens
ugaacagcuaucuugucagugu

SEQ ID NO: 337069 - RNA, 22 nt, Homo sapiens
ugaagcuaacuugauugugaug

SEQ ID NO: 337070 - RNA, 22 nt, Homo sapiens
ugaagcuaggauuaauuuucau

SEQ ID NO: 337071 - RNA, 22 nt, Homo sapiens
ugaagcuaugacuauugagcau

SEQ ID NO: 337072 - RNA, 18 nt, Homo sapiens
ugaauacagcguugggaa

SEQ ID NO: 337073 - RNA, 22 nt, Homo sapiens
ugaauagacacuaaagacugua

SEQ ID NO: 337074 - RNA, 22 nt, Homo sapiens
ugaauaguuugacagaacucuu

SEQ ID NO: 337075 - RNA, 22 nt, Homo sapiens
ugaauauguuaaauaauguucu

SEQ ID NO: 337076 - RNA, 21 nt, Homo sapiens
ugaauauuuggguugugucca

SEQ ID NO: 337077 - RNA, 19 nt, Homo sapiens
ugaaugacaucuaaagucc

SEQ ID NO: 337078 - RNA, 22 nt, Homo sapiens
ugaaugcaucauguagggcuca

SEQ ID NO: 337079 - RNA, 22 nt, Homo sapiens
ugaaugcauggggccaagaagg

SEQ ID NO: 337080 - RNA, 22 nt, Homo sapiens
ugaauguucuuaaaacccuugu

SEQ ID NO: 337081 - RNA, 22 nt, Homo sapiens
ugaauucaucucacagaguuaa

SEQ ID NO: 337082 - RNA, 23 nt, Homo sapiens
ugacaagagcgagacuuggucuc

SEQ ID NO: 337083 - RNA, 20 nt, Homo sapiens
ugacaaggugcaaagaauca

SEQ ID NO: 337084 - RNA, 18 nt, Homo sapiens
ugacaaugcuaguccugg

SEQ ID NO: 337085 - RNA, 18 nt, Homo sapiens
ugacagcacaugugggga

SEQ ID NO: 337086 - RNA, 22 nt, Homo sapiens
ugacaggagauuaugugauguu

SEQ ID NO: 337087 - RNA, 22 nt, Homo sapiens
ugacaggucuaauuuacugaca

SEQ ID NO: 337088 - RNA, 22 nt, Homo sapiens
ugacagugaauaagucucuuaa

SEQ ID NO: 337089 - RNA, 22 nt, Homo sapiens
ugacaguguccucauucccaac

SEQ ID NO: 337090 - RNA, 22 nt, Homo sapiens
ugacagugugagacuuugucuc

SEQ ID NO: 337091 - RNA, 20 nt, Homo sapiens
ugacaguuaagggauagaag

SEQ ID NO: 337092 - RNA, 22 nt, Homo sapiens
ugacauagcuauuaagugaugc

SEQ ID NO: 337093 - RNA, 19 nt, Homo sapiens
ugacaugaaacccaagauc

SEQ ID NO: 337094 - RNA, 22 nt, Homo sapiens
ugacaugaaggcaccucugucc

SEQ ID NO: 337095 - RNA, 22 nt, Homo sapiens
ugacccuguggcagcgucuaag

SEQ ID NO: 337096 - RNA, 22 nt, Homo sapiens
ugaccuagaacucuaaugccug

SEQ ID NO: 337097 - RNA, 22 nt, Homo sapiens
ugacuacagauuugcugccaga

SEQ ID NO: 337098 - RNA, 22 nt, Homo sapiens
ugacuacaggucaggaagcugu

SEQ ID NO: 337099 - RNA, 22 nt, Homo sapiens
ugacuacauaaguaaucucaaa

SEQ ID NO: 337100 - RNA, 22 nt, Homo sapiens
ugacuagggacauucuuccacg

SEQ ID NO: 337101 - RNA, 21 nt, Homo sapiens
ugacuagggauaugugccacu

SEQ ID NO: 337102 - RNA, 22 nt, Homo sapiens
ugacuuaugcaacucugaugug

SEQ ID NO: 337103 - RNA, 22 nt, Homo sapiens
ugacuucauuuuuggccaugag

SEQ ID NO: 337104 - RNA, 22 nt, Homo sapiens
ugagaacuagagaacaagguga

SEQ ID NO: 337105 - RNA, 22 nt, Homo sapiens
ugagaaugacugggcaugcugc

SEQ ID NO: 337106 - RNA, 22 nt, Homo sapiens
ugagaccugaucuugguacugc

SEQ ID NO: 337107 - RNA, 22 nt, Homo sapiens
ugagaccuuucauuucucagug

SEQ ID NO: 337108 - RNA, 22 nt, Homo sapiens
ugagacgucuucucuucuucaa

SEQ ID NO: 337109 - RNA, 22 nt, Homo sapiens
ugagacugaaauuaggaaacug

SEQ ID NO: 337110 - RNA, 22 nt, Homo sapiens
ugagacugaguuucacuuuugu

SEQ ID NO: 337111 - RNA, 22 nt, Homo sapiens
ugagacugauaggacauuuucu

SEQ ID NO: 337112 - RNA, 22 nt, Homo sapiens
ugagagacaguuucgucggagg

SEQ ID NO: 337113 - RNA, 22 nt, Homo sapiens
ugagagacaguuuguuaaaauu

SEQ ID NO: 337114 - RNA, 22 nt, Homo sapiens
ugagagacauuuguuguagagu

SEQ ID NO: 337115 - RNA, 22 nt, Homo sapiens
ugagaguauaaauugaugcagc

SEQ ID NO: 337116 - RNA, 22 nt, Homo sapiens
ugagaucagaaggauuucucug

SEQ ID NO: 337117 - RNA, 22 nt, Homo sapiens
ugagaucauguguggaccccag

SEQ ID NO: 337118 - RNA, 20 nt, Homo sapiens
ugagauccacgugaaguaug

SEQ ID NO: 337119 - RNA, 22 nt, Homo sapiens
ugagaugaagucucacucuguc

SEQ ID NO: 337120 - RNA, 22 nt, Homo sapiens
ugagaugaggucucacucuguu

SEQ ID NO: 337121 - RNA, 22 nt, Homo sapiens
ugagaugagucucgcucuguca

SEQ ID NO: 337122 - RNA, 22 nt, Homo sapiens
ugagauggagucuugucgccua

SEQ ID NO: 337123 - RNA, 22 nt, Homo sapiens
ugagauguagauauggauuaga

SEQ ID NO: 337124 - RNA, 22 nt, Homo sapiens
ugagaugugaagaucacaugaa

SEQ ID NO: 337125 - RNA, 22 nt, Homo sapiens
ugagauguuccaaugacuauua

SEQ ID NO: 337126 - RNA, 22 nt, Homo sapiens
ugagauguugcucugaaacaag

SEQ ID NO: 337127 - RNA, 22 nt, Homo sapiens
ugagauguuuagauuguugucu

SEQ ID NO: 337128 - RNA, 22 nt, Homo sapiens
uguccuagagggaugucacccc

SEQ ID NO: 337129 - RNA, 22 nt, Homo sapiens
uguccuguaggaggcagaacaa

SEQ ID NO: 337130 - RNA, 22 nt, Homo sapiens
ugucucaguucccuucucugga

SEQ ID NO: 337131 - RNA, 22 nt, Homo sapiens
ugucuuagagauaaagaaugaa

SEQ ID NO: 337132 - RNA, 22 nt, Homo sapiens
ugucuuguagacugaaggcuuc

SEQ ID NO: 337133 - RNA, 20 nt, Homo sapiens
ugugaacuguagauagucuu

SEQ ID NO: 337134 - RNA, 19 nt, Homo sapiens
ugugaagaaaugcugcaag

SEQ ID NO: 337135 - RNA, 22 nt, Homo sapiens
ugugaauguaaccuuauuugga

SEQ ID NO: 337136 - RNA, 18 nt, Homo sapiens
ugugacauugagcauguc

SEQ ID NO: 337137 - RNA, 21 nt, Homo sapiens
ugugaccucugucucugaguc

SEQ ID NO: 337138 - RNA, 22 nt, Homo sapiens
ugugagaucucagaauugaacu

SEQ ID NO: 337139 - RNA, 22 nt, Homo sapiens
ugugagcuauggaguuguagag

SEQ ID NO: 337140 - RNA, 22 nt, Homo sapiens
ugugauaguuggcuaaagcagu

SEQ ID NO: 337141 - RNA, 22 nt, Homo sapiens
ugugaucaugugugccuuaguc

SEQ ID NO: 337142 - RNA, 22 nt, Homo sapiens
ugugaugaagaguccaagaaca

SEQ ID NO: 337143 - RNA, 22 nt, Homo sapiens
ugugcaaggcucucaaccugug

SEQ ID NO: 337144 - RNA, 22 nt, Homo sapiens
ugugcacaacgugcagguuugu

SEQ ID NO: 337145 - RNA, 22 nt, Homo sapiens
ugugcacaauguacagguuagu

SEQ ID NO: 337146 - RNA, 22 nt, Homo sapiens
ugugcacaugauauaucacaua

SEQ ID NO: 337147 - RNA, 22 nt, Homo sapiens
ugugcacauugugcagguugau

SEQ ID NO: 337148 - RNA, 23 nt, Homo sapiens
ugugcacauuuacauauauacac

SEQ ID NO: 337149 - RNA, 22 nt, Homo sapiens
ugugcaguuuuagcguauuuua

SEQ ID NO: 337150 - RNA, 22 nt, Homo sapiens
ugugcauagugugugcggggcg

SEQ ID NO: 337151 - RNA, 22 nt, Homo sapiens
ugugcauaugucuuuauaguag

SEQ ID NO: 337152 - RNA, 22 nt, Homo sapiens
ugugccacuccaaccuggguga

SEQ ID NO: 337153 - RNA, 22 nt, Homo sapiens
ugugccacugcacuucagccug

SEQ ID NO: 337154 - RNA, 22 nt, Homo sapiens
ugugccuaguaauguguccaga

SEQ ID NO: 337155 - RNA, 22 nt, Homo sapiens
ugugcuugcuucuucuccuagu

SEQ ID NO: 337156 - RNA, 22 nt, Homo sapiens
uguggaaauuguuguauuuaau

SEQ ID NO: 337157 - RNA, 22 nt, Homo sapiens
uguggcagugcuuuaugaaacc

SEQ ID NO: 337158 - RNA, 22 nt, Homo sapiens
uguggcuucuuugguucaguau

SEQ ID NO: 337159 - RNA, 22 nt, Homo sapiens
uguggcuuuacagcaugguuca

SEQ ID NO: 337160 - RNA, 22 nt, Homo sapiens
uguggucaucacuugaagguaa

SEQ ID NO: 337161 - RNA, 22 nt, Homo sapiens
ugugguccucugaaggcuuuuc

SEQ ID NO: 337162 - RNA, 22 nt, Homo sapiens
uguguaauaccuuugacuauau

SEQ ID NO: 337163 - RNA, 22 nt, Homo sapiens
uguuacagcagaauugauugca

SEQ ID NO: 337164 - RNA, 22 nt, Homo sapiens
uguuacaguguaggccuugggu

SEQ ID NO: 337165 - RNA, 22 nt, Homo sapiens
uguuauguucuacuuuuaggug

SEQ ID NO: 337166 - RNA, 22 nt, Homo sapiens
uguucaauucccaccuaugagu

SEQ ID NO: 337167 - RNA, 22 nt, Homo sapiens
uguucuggagccgguucaaaug

SEQ ID NO: 337168 - RNA, 19 nt, Homo sapiens
uguugcacauaucaauaug

SEQ ID NO: 337169 - RNA, 22 nt, Homo sapiens
uguugcacuccagccuggguga

SEQ ID NO: 337170 - RNA, 22 nt, Homo sapiens
uguuggcauugcugcugacccu

SEQ ID NO: 337171 - RNA, 22 nt, Homo sapiens
uguuucuacugucucuguagua

SEQ ID NO: 337172 - RNA, 22 nt, Homo sapiens
uguuuuguuagcacucugggaa

SEQ ID NO: 337173 - RNA, 22 nt, Homo sapiens
uuaaagccauaccugagagagu

SEQ ID NO: 337174 - RNA, 22 nt, Homo sapiens
uuaaaggcauguacacuagagu

SEQ ID NO: 337175 - RNA, 22 nt, Homo sapiens
uuaaaguguuuucaaaauguca

SEQ ID NO: 337176 - RNA, 22 nt, Homo sapiens
uuaagaagugauuuuccucauu

SEQ ID NO: 337177 - RNA, 22 nt, Homo sapiens
uuaagccacucaagagauagag

SEQ ID NO: 337178 - RNA, 22 nt, Homo sapiens
uuaagcuaguuuauucaggaaa

SEQ ID NO: 337179 - RNA, 22 nt, Homo sapiens
uuaaggaaggagucuuaaaugg

SEQ ID NO: 337180 - RNA, 18 nt, Homo sapiens
uuaaggcaggacuuuaag

SEQ ID NO: 337181 - RNA, 22 nt, Homo sapiens
uuaaggcagugcaucuggaguu

SEQ ID NO: 337182 - RNA, 22 nt, Homo sapiens
uuaaggcagugucuaugccagu

SEQ ID NO: 337183 - RNA, 22 nt, Homo sapiens
uuaaggguuuuagaauuuucca

SEQ ID NO: 337184 - RNA, 22 nt, Homo sapiens
uuaauacugcuuaacuuuagga

SEQ ID NO: 337185 - RNA, 22 nt, Homo sapiens
uuaauagcaaagaguuuagacu

SEQ ID NO: 337186 - RNA, 22 nt, Homo sapiens
uuacagauggauggcagcuggc

SEQ ID NO: 337187 - RNA, 22 nt, Homo sapiens
uuacagauggcacacucaaggg

SEQ ID NO: 337188 - RNA, 22 nt, Homo sapiens
uuacagucucaagagugcugca

SEQ ID NO: 337189 - RNA, 22 nt, Homo sapiens
uuacagucuuaggcagugcuuu

SEQ ID NO: 337190 - RNA, 22 nt, Homo sapiens
uuacaguugugagccaccaugc

SEQ ID NO: 337191 - RNA, 22 nt, Homo sapiens
uuacaugcaugacaaggugcca

SEQ ID NO: 337192 - RNA, 22 nt, Homo sapiens
uuaccacagugccugucuaaug

SEQ ID NO: 337193 - RNA, 22 nt, Homo sapiens
uuaccucagaccugcucugugu

SEQ ID NO: 337194 - RNA, 22 nt, Homo sapiens
uuagaacuagaggaguuugagu

SEQ ID NO: 337195 - RNA, 17 nt, Homo sapiens
uuagacagacauccugc

SEQ ID NO: 337196 - RNA, 22 nt, Homo sapiens
uuagauguuuagaagugggcca

SEQ ID NO: 337197 - RNA, 22 nt, Homo sapiens
uuagcaauugauucucauaagc

SEQ ID NO: 337198 - RNA, 22 nt, Homo sapiens
uuagcagcaugagaauggacua

SEQ ID NO: 337199 - RNA, 22 nt, Homo sapiens
uuaggaucacagaaaauccucu

SEQ ID NO: 337200 - RNA, 22 nt, Homo sapiens
uuagguagaauugauuaaguuu

SEQ ID NO: 337201 - RNA, 22 nt, Homo sapiens
uuagugaaugggugugauuugu

SEQ ID NO: 337202 - RNA, 22 nt, Homo sapiens
uuaguuuaucagugguuucuga

SEQ ID NO: 337203 - RNA, 19 nt, Homo sapiens
uuauacuguauuguuuagg

SEQ ID NO: 337204 - RNA, 22 nt, Homo sapiens
uuauauguuucuuagggacaga

SEQ ID NO: 337205 - RNA, 22 nt, Homo sapiens
uuaucacauugacugauuugca

SEQ ID NO: 337206 - RNA, 22 nt, Homo sapiens
uuaucucaguguuuguaaacaa

SEQ ID NO: 337207 - RNA, 22 nt, Homo sapiens
uuaugccagugauuauaagggc

SEQ ID NO: 337208 - RNA, 22 nt, Homo sapiens
uuaugcuugugugaauuuuccc

SEQ ID NO: 337209 - RNA, 22 nt, Homo sapiens
uuauggcuauugaugacaauug

SEQ ID NO: 337210 - RNA, 22 nt, Homo sapiens
uuaugguuuucucucacgcagg

SEQ ID NO: 337211 - RNA, 22 nt, Homo sapiens
uuauguaggcuauagcucugca

SEQ ID NO: 337212 - RNA, 22 nt, Homo sapiens
uuauuacuccuauuuuguagau

SEQ ID NO: 337213 - RNA, 22 nt, Homo sapiens
uuauugcuaaaucaugaccaca

SEQ ID NO: 337214 - RNA, 23 nt, Homo sapiens
uucaaaggaugcuuuauggaauu

SEQ ID NO: 337215 - RNA, 22 nt, Homo sapiens
uucaaggacuaaggauuuuugg

SEQ ID NO: 337216 - RNA, 18 nt, Homo sapiens
acagugucuuacaccugu

SEQ ID NO: 337217 - RNA, 22 nt, Homo sapiens
acaguuaugugagggccaccag

SEQ ID NO: 337218 - RNA, 22 nt, Homo sapiens
acauagaguaguggugaggaug

SEQ ID NO: 337219 - RNA, 22 nt, Homo sapiens
acaucccaugccuggguacucc

SEQ ID NO: 337220 - RNA, 22 nt, Homo sapiens
acaugacauugggguggggaua

SEQ ID NO: 337221 - RNA, 22 nt, Homo sapiens
acaugcauccaugugaagagac

SEQ ID NO: 337222 - RNA, 22 nt, Homo sapiens
acauguauauaaugcauagcga

SEQ ID NO: 337223 - RNA, 22 nt, Homo sapiens
acauugcucuuaccaaguuugu

SEQ ID NO: 337224 - RNA, 22 nt, Homo sapiens
accacaggguaaaguuagauau

SEQ ID NO: 337225 - RNA, 22 nt, Homo sapiens
accaccacucccgcauucuaaa

SEQ ID NO: 337226 - RNA, 17 nt, Homo sapiens
accagugcaugugcuuu

SEQ ID NO: 337227 - RNA, 22 nt, Homo sapiens
acccagaagucauucaggaaca

SEQ ID NO: 337228 - RNA, 22 nt, Homo sapiens
acccagaauucagucuuaggcc

SEQ ID NO: 337229 - RNA, 22 nt, Homo sapiens
acccaguguucaacauucacau

SEQ ID NO: 337230 - RNA, 21 nt, Homo sapiens
acccccacaccuccuuaguuc

SEQ ID NO: 337231 - RNA, 22 nt, Homo sapiens
acccucaagggacugacagaau

SEQ ID NO: 337232 - RNA, 20 nt, Homo sapiens
acccucuaggaugauuucuu

SEQ ID NO: 337233 - RNA, 21 nt, Homo sapiens
acccucuaguuuucaacaggc

SEQ ID NO: 337234 - RNA, 22 nt, Homo sapiens
acccuggaguaguaggaaucug

SEQ ID NO: 337235 - RNA, 22 nt, Homo sapiens
acccuguaggugcuggcagaga

SEQ ID NO: 337236 - RNA, 22 nt, Homo sapiens
acccuguaguuagaaacuuuca

SEQ ID NO: 337237 - RNA, 22 nt, Homo sapiens
accuggcacuuagcaaaucuga

SEQ ID NO: 337238 - RNA, 22 nt, Homo sapiens
acuacuucuaaguuuuggaaga

SEQ ID NO: 337239 - RNA, 19 nt, Homo sapiens
acuaggccuacaaagcuau

SEQ ID NO: 337240 - RNA, 22 nt, Homo sapiens
acuauacugaagcaaauuaaca

SEQ ID NO: 337241 - RNA, 22 nt, Homo sapiens
acucagagugggccccuagaua

SEQ ID NO: 337242 - RNA, 22 nt, Homo sapiens
acugaauguaaacacggagugu

SEQ ID NO: 337243 - RNA, 22 nt, Homo sapiens
acugacaugaucaggcauguuc

SEQ ID NO: 337244 - RNA, 21 nt, Homo sapiens
acugagagaucuggggcacau

SEQ ID NO: 337245 - RNA, 22 nt, Homo sapiens
acugagucauugaggcccucuc

SEQ ID NO: 337246 - RNA, 22 nt, Homo sapiens
acugcacuccaaccuuggugac

SEQ ID NO: 337247 - RNA, 22 nt, Homo sapiens
acugcacuccagccuaggcgac

SEQ ID NO: 337248 - RNA, 22 nt, Homo sapiens
acugcacuccagccuggaccac

SEQ ID NO: 337249 - RNA, 22 nt, Homo sapiens
acugcacuccagccuggacgaa

SEQ ID NO: 337250 - RNA, 22 nt, Homo sapiens
acugcacuccagccuugcgaca

SEQ ID NO: 337251 - RNA, 20 nt, Homo sapiens
acugcacuccaggcugccca

SEQ ID NO: 337252 - RNA, 22 nt, Homo sapiens
acugcacucuagcuugggugac

SEQ ID NO: 337253 - RNA, 20 nt, Homo sapiens
acugcacuucagccugcugg

SEQ ID NO: 337254 - RNA, 22 nt, Homo sapiens
acugcacuucagccuuggcuac

SEQ ID NO: 337255 - RNA, 22 nt, Homo sapiens
acugcauaaauauguguaauau

SEQ ID NO: 337256 - RNA, 20 nt, Homo sapiens
acugcauuuaguccucagga

SEQ ID NO: 337257 - RNA, 22 nt, Homo sapiens
acugcauuugucugucucaauu

SEQ ID NO: 337258 - RNA, 22 nt, Homo sapiens
acuggcaauggcagaaauaguu

SEQ ID NO: 337259 - RNA, 22 nt, Homo sapiens
acuugacacuuauauuacucac

SEQ ID NO: 337260 - RNA, 21 nt, Homo sapiens
acuuucuguggcaguccauuc

SEQ ID NO: 337261 - RNA, 22 nt, Homo sapiens
acuuuguguuacccagcaagga

SEQ ID NO: 337262 - RNA, 22 nt, Homo sapiens
acuuuguuauggcaacccuaag

SEQ ID NO: 337263 - RNA, 22 nt, Homo sapiens
agaaaugcagcaugaggcggca

SEQ ID NO: 337264 - RNA, 23 nt, Homo sapiens
agaaaugucuauucagggucccu

SEQ ID NO: 337265 - RNA, 20 nt, Homo sapiens
agaagcauugcucucuucag

SEQ ID NO: 337266 - RNA, 22 nt, Homo sapiens
agaauguuuuagaccaauacaa

SEQ ID NO: 337267 - RNA, 22 nt, Homo sapiens
agacagcugggaaauggagugu

SEQ ID NO: 337268 - RNA, 22 nt, Homo sapiens
agagaacugauuggaugugggc

SEQ ID NO: 337269 - RNA, 22 nt, Homo sapiens
agagacauugcuccaacucacc

SEQ ID NO: 337270 - RNA, 22 nt, Homo sapiens
agagaugaagauggggcucccg

SEQ ID NO: 337271 - RNA, 20 nt, Homo sapiens
agagcaaagccgcaccccua

SEQ ID NO: 337272 - RNA, 18 nt, Homo sapiens
agagcuaugaacauaugc

SEQ ID NO: 337273 - RNA, 22 nt, Homo sapiens
agagguagaagauaggcuacag

SEQ ID NO: 337274 - RNA, 22 nt, Homo sapiens
agaguaguaggaugaauggacu

SEQ ID NO: 337275 - RNA, 22 nt, Homo sapiens
agagugcaauggcaccaucucg

SEQ ID NO: 337276 - RNA, 22 nt, Homo sapiens
agagugcuaaggaaguaauuua

SEQ ID NO: 337277 - RNA, 22 nt, Homo sapiens
agagugcuuuauuagauguagc

SEQ ID NO: 337278 - RNA, 22 nt, Homo sapiens
agauauguuauugauguuaaug

SEQ ID NO: 337279 - RNA, 22 nt, Homo sapiens
agaucacucagguuucucccug

SEQ ID NO: 337280 - RNA, 22 nt, Homo sapiens
agaugauguuuacugagcauca

SEQ ID NO: 337281 - RNA, 23 nt, Homo sapiens
agaugcauucuuguaggauauau

SEQ ID NO: 337282 - RNA, 22 nt, Homo sapiens
agaugccuaugaagagaaauua

SEQ ID NO: 337283 - RNA, 22 nt, Homo sapiens
agcaacaucagcagcaggaaaa

SEQ ID NO: 337284 - RNA, 22 nt, Homo sapiens
agcaagaugaaguugagcuagg

SEQ ID NO: 337285 - RNA, 22 nt, Homo sapiens
agcacagccuuguguuuucuug

SEQ ID NO: 337286 - RNA, 22 nt, Homo sapiens
agcaccacauacuacagagaua

SEQ ID NO: 337287 - RNA, 22 nt, Homo sapiens
agcagagcaguggauuuuguga

SEQ ID NO: 337288 - RNA, 21 nt, Homo sapiens
agcagaguggcagcucuuuug

SEQ ID NO: 337289 - RNA, 22 nt, Homo sapiens
agcagauguuuagugagcgccu

SEQ ID NO: 337290 - RNA, 22 nt, Homo sapiens
agcagcuuugaucugaaugauu

SEQ ID NO: 337291 - RNA, 22 nt, Homo sapiens
agcaggacaauaugggaucagg

SEQ ID NO: 337292 - RNA, 22 nt, Homo sapiens
agcagguauucgggucaugggg

SEQ ID NO: 337293 - RNA, 22 nt, Homo sapiens
agcagguguccacaauguuugc

SEQ ID NO: 337294 - RNA, 22 nt, Homo sapiens
agcaucagugauuuuguugaag

SEQ ID NO: 337295 - RNA, 22 nt, Homo sapiens
agcaucauguuuucgagguuca

SEQ ID NO: 337296 - RNA, 23 nt, Homo sapiens
agcccugugacucgaacgaggag

SEQ ID NO: 337297 - RNA, 22 nt, Homo sapiens
agcccugugauuacuuuuauaa

SEQ ID NO: 337298 - RNA, 22 nt, Homo sapiens
agcgccacugcacuccagccug

SEQ ID NO: 337299 - RNA, 22 nt, Homo sapiens
agcuacaucuugcucugggaug

SEQ ID NO: 337300 - RNA, 22 nt, Homo sapiens
agcuacuguuagucuaguuagg

SEQ ID NO: 337301 - RNA, 22 nt, Homo sapiens
agcuaguggucauucaauccuu

SEQ ID NO: 337302 - RNA, 22 nt, Homo sapiens
agcuagugugauucuuuggggu

SEQ ID NO: 337303 - RNA, 22 nt, Homo sapiens
agcucauugcaaccuccgccuc

SEQ ID NO: 337304 - RNA, 22 nt, Homo sapiens
uugugcaaaguugugguuucug

SEQ ID NO: 337305 - RNA, 20 nt, Homo sapiens
uugugcauugggccauuggg

SEQ ID NO: 337306 - RNA, 22 nt, Homo sapiens
uugugggaggugauuagaucau

SEQ ID NO: 337307 - RNA, 22 nt, Homo sapiens
uugugguugaugaagacugucu

SEQ ID NO: 337308 - RNA, 22 nt, Homo sapiens
uugugguuuuuaaaacuaggug

SEQ ID NO: 337309 - RNA, 22 nt, Homo sapiens
uuguguccccacccaaaucuca

SEQ ID NO: 337310 - RNA, 22 nt, Homo sapiens
uuguguuuuuaguagggaaggg

SEQ ID NO: 337311 - RNA, 17 nt, Homo sapiens
uuguucccauuaaaaag

SEQ ID NO: 337312 - RNA, 22 nt, Homo sapiens
uuguuuuggagaugagcuaaaa

SEQ ID NO: 337313 - RNA, 22 nt, Homo sapiens
uuuaaggcaggucuggugguga

SEQ ID NO: 337314 - RNA, 22 nt, Homo sapiens
uuuaaugcaucccaaaauguag

SEQ ID NO: 337315 - RNA, 22 nt, Homo sapiens
uuuaauguuacaguauugguau

SEQ ID NO: 337316 - RNA, 22 nt, Homo sapiens
uuuacaguuuucuaggcuacca

SEQ ID NO: 337317 - RNA, 22 nt, Homo sapiens
uuuagcaauucauuuugugucu

SEQ ID NO: 337318 - RNA, 23 nt, Homo sapiens
uuuauacguugucauuuaucagg

SEQ ID NO: 337319 - RNA, 22 nt, Homo sapiens
uuuaucaggccuuuggaaaaau

SEQ ID NO: 337320 - RNA, 22 nt, Homo sapiens
uuucaacuaauuuuuuggugag

SEQ ID NO: 337321 - RNA, 22 nt, Homo sapiens
uuucaagugcugucuuagcugu

SEQ ID NO: 337322 - RNA, 21 nt, Homo sapiens
uuucacugugaguuuuucugu

SEQ ID NO: 337323 - RNA, 22 nt, Homo sapiens
uuucagagucaucugcccaagu

SEQ ID NO: 337324 - RNA, 22 nt, Homo sapiens
uuucaggcaagggugacccuga

SEQ ID NO: 337325 - RNA, 22 nt, Homo sapiens
uuucaguguggcaggcauagcu

SEQ ID NO: 337326 - RNA, 22 nt, Homo sapiens
uuucauagccuuugucgucuga

SEQ ID NO: 337327 - RNA, 22 nt, Homo sapiens
uuucauaguuugcauagggcau

SEQ ID NO: 337328 - RNA, 22 nt, Homo sapiens
uuucauggagaaucuucuuacu

SEQ ID NO: 337329 - RNA, 22 nt, Homo sapiens
uuucauggcaguuuggggccug

SEQ ID NO: 337330 - RNA, 22 nt, Homo sapiens
uuucauggcgaggcuucauggg

SEQ ID NO: 337331 - RNA, 22 nt, Homo sapiens
uuucccauuguucugcucugug

SEQ ID NO: 337332 - RNA, 22 nt, Homo sapiens
uuucuacagugaacgauuucua

SEQ ID NO: 337333 - RNA, 22 nt, Homo sapiens
uuucuauguugaccagucuaga

SEQ ID NO: 337334 - RNA, 21 nt, Homo sapiens
uuucugggggagcauggcagg

SEQ ID NO: 337335 - RNA, 18 nt, Homo sapiens
uuugacugguguccuuau

SEQ ID NO: 337336 - RNA, 22 nt, Homo sapiens
uuugacuuuuagaauaugaguu

SEQ ID NO: 337337 - RNA, 22 nt, Homo sapiens
uuugaguuugaggugcugauga

SEQ ID NO: 337338 - RNA, 22 nt, Homo sapiens
uuugcaccuuccuaguggcuga

SEQ ID NO: 337339 - RNA, 22 nt, Homo sapiens
uuugcacucaguaagugggagc

SEQ ID NO: 337340 - RNA, 22 nt, Homo sapiens
uuugcacuucugagugugacau

SEQ ID NO: 337341 - RNA, 22 nt, Homo sapiens
uuugcacuugaaaacacucuca

SEQ ID NO: 337342 - RNA, 22 nt, Homo sapiens
uuugcacuuuaauauaauguga

SEQ ID NO: 337343 - RNA, 22 nt, Homo sapiens
uuugcauaauaagauuagggug

SEQ ID NO: 337344 - RNA, 19 nt, Homo sapiens
uuugcauagugagaauaua

SEQ ID NO: 337345 - RNA, 22 nt, Homo sapiens
uuugccaauauuuuacugagga

SEQ ID NO: 337346 - RNA, 19 nt, Homo sapiens
uuugccuaggcacauggcc

SEQ ID NO: 337347 - RNA, 22 nt, Homo sapiens
uuugcuauagugaauagugcug

SEQ ID NO: 337348 - RNA, 22 nt, Homo sapiens
uuuggcaauaaacuccccuaac

SEQ ID NO: 337349 - RNA, 22 nt, Homo sapiens
uuuggcagaaaacuaaaaggua

SEQ ID NO: 337350 - RNA, 22 nt, Homo sapiens
uuuggcccugagggauggcaua

SEQ ID NO: 337351 - RNA, 22 nt, Homo sapiens
uuuggcuuuuguaauaacugcc

SEQ ID NO: 337352 - RNA, 22 nt, Homo sapiens
uuugggccaugcuucccgguca

SEQ ID NO: 337353 - RNA, 22 nt, Homo sapiens
uuugggccucugauuucuuugg

SEQ ID NO: 337354 - RNA, 22 nt, Homo sapiens
uuuguacacgugggugaauugu

SEQ ID NO: 337355 - RNA, 22 nt, Homo sapiens
uuuguacuaugguuuuucacua

SEQ ID NO: 337356 - RNA, 18 nt, Homo sapiens
uuuguacuuuuucuaaug

SEQ ID NO: 337357 - RNA, 21 nt, Homo sapiens
uuuguaguagcaugauuuaua

SEQ ID NO: 337358 - RNA, 23 nt, Homo sapiens
uuuguaguagcaugauuuauaau

SEQ ID NO: 337359 - RNA, 22 nt, Homo sapiens
uuugucccuuugcaguggcaca

SEQ ID NO: 337360 - RNA, 22 nt, Homo sapiens
uuuguccugccaugguuuauuu

SEQ ID NO: 337361 - RNA, 22 nt, Homo sapiens
uuugucuccuaagacucugugg

SEQ ID NO: 337362 - RNA, 22 nt, Homo sapiens
uuugugcuccuguugagaaucu

SEQ ID NO: 337363 - RNA, 22 nt, Homo sapiens
uuuguguggccuuggccuggca

SEQ ID NO: 337364 - RNA, 22 nt, Homo sapiens
uuuguucaccucaaggauggga

SEQ ID NO: 337365 - RNA, 22 nt, Homo sapiens
uuuuaagcuacaagagacauau

SEQ ID NO: 337366 - RNA, 22 nt, Homo sapiens
uuuuagcagccaugacaaagau

SEQ ID NO: 337367 - RNA, 22 nt, Homo sapiens
uuuuaguggaauauuuacaguu

SEQ ID NO: 337368 - RNA, 22 nt, Homo sapiens
uuuuaugggcuauuugcauuag

SEQ ID NO: 337369 - RNA, 22 nt, Homo sapiens
uuuugcauuggcugaggagugu

SEQ ID NO: 337370 - RNA, 22 nt, Homo sapiens
uuuuucacuuaaguuaggcuca

SEQ ID NO: 337371 - RNA, 22 nt, Homo sapiens
uuuuugaguaaauauaaauugu

SEQ ID NO: 337372 - RNA, 21 nt, Homo sapiens
uuuuugggcuuucauaguguu

SEQ ID NO: 337373 - RNA, 22 nt, Homo sapiens
uuuuugugguauauugcaacaa

SEQ ID NO: 337374 - RNA, 22 nt, Homo sapiens
acaaagcuagggaauccaucuu

SEQ ID NO: 337375 - RNA, 22 nt, Homo sapiens
acaagugaauacaggauucucu

SEQ ID NO: 337376 - RNA, 22 nt, Homo sapiens
acaagugcuuuuccuggagaca

SEQ ID NO: 337377 - RNA, 23 nt, Homo sapiens
acacaguaaacuaaaagcuagcu

SEQ ID NO: 337378 - RNA, 22 nt, Homo sapiens
acacaguaaauauguauugaau

SEQ ID NO: 337379 - RNA, 22 nt, Homo sapiens
acacaguaaauauugucuccuc

SEQ ID NO: 337380 - RNA, 22 nt, Homo sapiens
acacaguguuuauugugguuag

SEQ ID NO: 337381 - RNA, 22 nt, Homo sapiens
acaccaguacuuuauacaagca

SEQ ID NO: 337382 - RNA, 22 nt, Homo sapiens
acaccaucuccuuauuucucuu

SEQ ID NO: 337383 - RNA, 20 nt, Homo sapiens
acacuggcuuugagauuuag

SEQ ID NO: 337384 - RNA, 22 nt, Homo sapiens
acagaauucucagaacugggag

SEQ ID NO: 337385 - RNA, 22 nt, Homo sapiens
acagguacacagaauauccaga

SEQ ID NO: 337386 - RNA, 18 nt, Homo sapiens
acagugcugucacugcuu

SEQ ID NO: 337387 - RNA, 22 nt, Homo sapiens
acagugcugucugcuuuggcua

SEQ ID NO: 337388 - RNA, 22 nt, Homo sapiens
acagugcuguggucaugggucu

SEQ ID NO: 337389 - RNA, 22 nt, Homo sapiens
acagugcuuucaauguucagua

SEQ ID NO: 337390 - RNA, 22 nt, Homo sapiens
acagugucaugucguguucccc

SEQ ID NO: 337391 - RNA, 22 nt, Homo sapiens
acauguaauugauuuuguguua

SEQ ID NO: 337392 - RNA, 22 nt, Homo sapiens
acauugcagauguguuuaaugu

SEQ ID NO: 337393 - RNA, 22 nt, Homo sapiens
acauugcauauggcacccucuu

SEQ ID NO: 337394 - RNA, 22 nt, Homo sapiens
accaguuuuuuauacaucuucu

SEQ ID NO: 337395 - RNA, 22 nt, Homo sapiens
accauugcacuccagccugggc

SEQ ID NO: 337396 - RNA, 22 nt, Homo sapiens
acccacuagaugccaguggcac

SEQ ID NO: 337397 - RNA, 22 nt, Homo sapiens
acccaguagucauucaggagca

SEQ ID NO: 337398 - RNA, 22 nt, Homo sapiens
acccaguguucagacuaccugu

SEQ ID NO: 337399 - RNA, 22 nt, Homo sapiens
acccugacacgauucuucacuu

SEQ ID NO: 337400 - RNA, 22 nt, Homo sapiens
acccugucaaaauagaccaauc

SEQ ID NO: 337401 - RNA, 22 nt, Homo sapiens
acccugucagcuggccugggca

SEQ ID NO: 337402 - RNA, 22 nt, Homo sapiens
acccuguugagcaacuggccau

SEQ ID NO: 337403 - RNA, 22 nt, Homo sapiens
acccuguugucagaauguggau

SEQ ID NO: 337404 - RNA, 23 nt, Homo sapiens
accugauguuucuguggggagcc

SEQ ID NO: 337405 - RNA, 22 nt, Homo sapiens
accuguauaacaagugggaaau

SEQ ID NO: 337406 - RNA, 22 nt, Homo sapiens
accugugguuacagucugucuc

SEQ ID NO: 337407 - RNA, 22 nt, Homo sapiens
acuagaugauuauguuccauug

SEQ ID NO: 337408 - RNA, 22 nt, Homo sapiens
acuaugagacgaaugcaucagu

SEQ ID NO: 337409 - RNA, 22 nt, Homo sapiens
acucagagaacauucccagucu

SEQ ID NO: 337410 - RNA, 22 nt, Homo sapiens
acucagagagaacugucauuug

SEQ ID NO: 337411 - RNA, 22 nt, Homo sapiens
acucagagauuagcacauguuu

SEQ ID NO: 337412 - RNA, 22 nt, Homo sapiens
acuccauuucauuuuagcucuu

SEQ ID NO: 337413 - RNA, 22 nt, Homo sapiens
acucuguugucuggccuuccug

SEQ ID NO: 337414 - RNA, 23 nt, Homo sapiens
acugcaauuacguuugcaccaac

SEQ ID NO: 337415 - RNA, 22 nt, Homo sapiens
acugcacuccagccucggcaau

SEQ ID NO: 337416 - RNA, 22 nt, Homo sapiens
acugcacuccagccucggugac

SEQ ID NO: 337417 - RNA, 22 nt, Homo sapiens
acugcacuccagccugcuggau

SEQ ID NO: 337418 - RNA, 22 nt, Homo sapiens
acugcacuccagccugcuggca

SEQ ID NO: 337419 - RNA, 22 nt, Homo sapiens
acugcacuccagccugcugggu

SEQ ID NO: 337420 - RNA, 22 nt, Homo sapiens
acugcacuccagccuuggccac

SEQ ID NO: 337421 - RNA, 22 nt, Homo sapiens
acugcacuccagcuuuggugac

SEQ ID NO: 337422 - RNA, 19 nt, Homo sapiens
acugcacuccuccuugggu

SEQ ID NO: 337423 - RNA, 22 nt, Homo sapiens
acugcacuccuccuugggugac

SEQ ID NO: 337424 - RNA, 22 nt, Homo sapiens
acugcacucuagcauggguaau

SEQ ID NO: 337425 - RNA, 22 nt, Homo sapiens
acugcacucuagccccugcgac

SEQ ID NO: 337426 - RNA, 22 nt, Homo sapiens
acugcacuucagccuuggggac

SEQ ID NO: 337427 - RNA, 18 nt, Homo sapiens
acuggaauuaaacuuuuu

SEQ ID NO: 337428 - RNA, 22 nt, Homo sapiens
acuggcuuuugagaaaaacacu

SEQ ID NO: 337429 - RNA, 20 nt, Homo sapiens
acugggcuaccgaaguaagg

SEQ ID NO: 337430 - RNA, 22 nt, Homo sapiens
acuguacuccagccugggugac

SEQ ID NO: 337431 - RNA, 22 nt, Homo sapiens
acuucauucucuggaucagaau

SEQ ID NO: 337432 - RNA, 22 nt, Homo sapiens
acuuggcaaaguuuuaaacagc

SEQ ID NO: 337433 - RNA, 22 nt, Homo sapiens
acuuuuugauggggagaacauu

SEQ ID NO: 337434 - RNA, 22 nt, Homo sapiens
agaacccuuugaaauguguuug

SEQ ID NO: 337435 - RNA, 22 nt, Homo sapiens
gugcacauuguuuaugucuguu

SEQ ID NO: 337436 - RNA, 22 nt, Homo sapiens
gugcacuguagaacccuuuguu

SEQ ID NO: 337437 - RNA, 22 nt, Homo sapiens
gugcagaugucuuuauaguagc

SEQ ID NO: 337438 - RNA, 22 nt, Homo sapiens
gugcaguuuacaguuacccagu

SEQ ID NO: 337439 - RNA, 22 nt, Homo sapiens
gugcauacucuggagacauugu

SEQ ID NO: 337440 - RNA, 23 nt, Homo sapiens
gugcaugagucuuuauaguagca

SEQ ID NO: 337441 - RNA, 22 nt, Homo sapiens
gugcuuauccccauucuggagg

SEQ ID NO: 337442 - RNA, 22 nt, Homo sapiens
gugcuuuguuguggcaguggca

SEQ ID NO: 337443 - RNA, 22 nt, Homo sapiens
guggaaaauuauugcuguuuuu

SEQ ID NO: 337444 - RNA, 22 nt, Homo sapiens
guggaagauaguguguuaaugu

SEQ ID NO: 337445 - RNA, 22 nt, Homo sapiens
guggaagguaaugcagcuuacu

SEQ ID NO: 337446 - RNA, 22 nt, Homo sapiens
guggacugggagagauaguucc

SEQ ID NO: 337447 - RNA, 22 nt, Homo sapiens
guggagcuguguggccuugggc

SEQ ID NO: 337448 - RNA, 22 nt, Homo sapiens
guggaggacuggauaaagaaaa

SEQ ID NO: 337449 - RNA, 22 nt, Homo sapiens
guggcacaauuaaguagcuauu

SEQ ID NO: 337450 - RNA, 22 nt, Homo sapiens
guggcaguuuuaaauaugaaaa

SEQ ID NO: 337451 - RNA, 21 nt, Homo sapiens
guggccuuuggagcaugucag

SEQ ID NO: 337452 - RNA, 22 nt, Homo sapiens
guggcuaaagauuuggaaucug

SEQ ID NO: 337453 - RNA, 22 nt, Homo sapiens
gugguaggaaagugcaaaugua

SEQ ID NO: 337454 - RNA, 22 nt, Homo sapiens
gugguucuagagggacagaaug

SEQ ID NO: 337455 - RNA, 22 nt, Homo sapiens
guguaaaugagugcugaaggag

SEQ ID NO: 337456 - RNA, 22 nt, Homo sapiens
guguaauaaucguggacuaugu

SEQ ID NO: 337457 - RNA, 22 nt, Homo sapiens
gugucaaggaugccugucaggc

SEQ ID NO: 337458 - RNA, 22 nt, Homo sapiens
gugugauuguuaauuuuaggug

SEQ ID NO: 337459 - RNA, 22 nt, Homo sapiens
gugugcaacuuucauuaauauu

SEQ ID NO: 337460 - RNA, 22 nt, Homo sapiens
gugugcacaaucuggcaugugc

SEQ ID NO: 337461 - RNA, 19 nt, Homo sapiens
gugugcauaucacagagca

SEQ ID NO: 337462 - RNA, 22 nt, Homo sapiens
gugugcauaugucuuuauagua

SEQ ID NO: 337463 - RNA, 22 nt, Homo sapiens
gugugcaugucuuuuuaguagg

SEQ ID NO: 337464 - RNA, 22 nt, Homo sapiens
gugugguaggauugguuacuca

SEQ ID NO: 337465 - RNA, 22 nt, Homo sapiens
guguuaaucucaaguacucuca

SEQ ID NO: 337466 - RNA, 22 nt, Homo sapiens
guguucaaauucugacagagag

SEQ ID NO: 337467 - RNA, 22 nt, Homo sapiens
guuaaagacauccacauaggag

SEQ ID NO: 337468 - RNA, 22 nt, Homo sapiens
guuauguaucuugauugggugg

SEQ ID NO: 337469 - RNA, 22 nt, Homo sapiens
guuauuguccauuuauuuagca

SEQ ID NO: 337470 - RNA, 20 nt, Homo sapiens
guucacagagguuaugauua

SEQ ID NO: 337471 - RNA, 20 nt, Homo sapiens
guucacaggcuuccuuucag

SEQ ID NO: 337472 - RNA, 22 nt, Homo sapiens
guucacaguucagccuguaaca

SEQ ID NO: 337473 - RNA, 22 nt, Homo sapiens
guucucacuggacugugaaaau

SEQ ID NO: 337474 - RNA, 22 nt, Homo sapiens
guucucacuggugcugguaagu

SEQ ID NO: 337475 - RNA, 22 nt, Homo sapiens
guugagcaagcuuuggagccua

SEQ ID NO: 337476 - RNA, 22 nt, Homo sapiens
guugcccuuagcacuucagccu

SEQ ID NO: 337477 - RNA, 22 nt, Homo sapiens
guuggaauguauugcuacuucu

SEQ ID NO: 337478 - RNA, 22 nt, Homo sapiens
guugggcccauagacugccagu

SEQ ID NO: 337479 - RNA, 22 nt, Homo sapiens
guuggugaccugaagagaguaa

SEQ ID NO: 337480 - RNA, 22 nt, Homo sapiens
guuuaggaaugagaauauuuag

SEQ ID NO: 337481 - RNA, 21 nt, Homo sapiens
uaaaacuguaacuuuguccug

SEQ ID NO: 337482 - RNA, 22 nt, Homo sapiens
uaaacacucacuucauagccau

SEQ ID NO: 337483 - RNA, 22 nt, Homo sapiens
uaaaccuagcauuuugcauaug

SEQ ID NO: 337484 - RNA, 22 nt, Homo sapiens
uaaagagcuuuugaggugucau

SEQ ID NO: 337485 - RNA, 22 nt, Homo sapiens
uaaagcauguaauuagguuaga

SEQ ID NO: 337486 - RNA, 16 nt, Homo sapiens
uaaagcuaaucacuuu

SEQ ID NO: 337487 - RNA, 22 nt, Homo sapiens
uaaagcuagagcuggaguggca

SEQ ID NO: 337488 - RNA, 22 nt, Homo sapiens
uaaagcuauuauaguuauguuu

SEQ ID NO: 337489 - RNA, 18 nt, Homo sapiens
uaaaggcacuguguuguu

SEQ ID NO: 337490 - RNA, 22 nt, Homo sapiens
uaaaugcuugagaugauggaua

SEQ ID NO: 337491 - RNA, 22 nt, Homo sapiens
uaaauggauauugccaucuccu

SEQ ID NO: 337492 - RNA, 22 nt, Homo sapiens
uaacagcucuacagcugcucuu

SEQ ID NO: 337493 - RNA, 22 nt, Homo sapiens
uaacaguguauuccuuuggaca

SEQ ID NO: 337494 - RNA, 22 nt, Homo sapiens
uaacauucacaugcugcaaaaa

SEQ ID NO: 337495 - RNA, 22 nt, Homo sapiens
uaacccugaggggcuuggggac

SEQ ID NO: 337496 - RNA, 22 nt, Homo sapiens
uaacuaaagagaagucaauguc

SEQ ID NO: 337497 - RNA, 22 nt, Homo sapiens
uaacuacuucugcuucagagua

SEQ ID NO: 337498 - RNA, 22 nt, Homo sapiens
uaacuauagagaauguugagua

SEQ ID NO: 337499 - RNA, 22 nt, Homo sapiens
uaacucugccuagugacauggu

SEQ ID NO: 337500 - RNA, 18 nt, Homo sapiens
uaacugugggaacuaacu

SEQ ID NO: 337501 - RNA, 22 nt, Homo sapiens
uaacuucaucauaagucaagaa

SEQ ID NO: 337502 - RNA, 23 nt, Homo sapiens
uaagacacuaacuuuaugcuuug

SEQ ID NO: 337503 - RNA, 22 nt, Homo sapiens
uaagacacuuaaaauguuacau

SEQ ID NO: 337504 - RNA, 22 nt, Homo sapiens
uaagagagcuccaucuuuuccu

SEQ ID NO: 337505 - RNA, 22 nt, Homo sapiens
uaagcaguaaaugaagucuugc

SEQ ID NO: 337506 - RNA, 21 nt, Homo sapiens
uaagcuaaacauucaguuaac

SEQ ID NO: 337507 - RNA, 22 nt, Homo sapiens
uaagcucauuccagccaugucc

SEQ ID NO: 337508 - RNA, 22 nt, Homo sapiens
uaaggcacuacuuuaggcuuuc

SEQ ID NO: 337509 - RNA, 22 nt, Homo sapiens
uaaggcauuuuuuugaguugca

SEQ ID NO: 337510 - RNA, 22 nt, Homo sapiens
uaaggcuugcuucagucuugaa

SEQ ID NO: 337511 - RNA, 22 nt, Homo sapiens
uaaggcuuuuguucagcguggg

SEQ ID NO: 337512 - RNA, 22 nt, Homo sapiens
uaaguaaaugaaagguugauuu

SEQ ID NO: 337513 - RNA, 22 nt, Homo sapiens
uaaguaauugugguuucugcca

SEQ ID NO: 337514 - RNA, 22 nt, Homo sapiens
uaaguacugucagaauuggacu

SEQ ID NO: 337515 - RNA, 19 nt, Homo sapiens
uaaguagaugacugaugcu

SEQ ID NO: 337516 - RNA, 22 nt, Homo sapiens
uaagugaaggaaguguguuuac

SEQ ID NO: 337517 - RNA, 22 nt, Homo sapiens
uaagugaauauggacaguuagc

SEQ ID NO: 337518 - RNA, 20 nt, Homo sapiens
uaagugcauaggauauuucu

SEQ ID NO: 337519 - RNA, 22 nt, Homo sapiens
uaagugcuguguuguuaccuaa

SEQ ID NO: 337520 - RNA, 22 nt, Homo sapiens
uaaguggaagaugucaaucaua

SEQ ID NO: 337521 - RNA, 23 nt, Homo sapiens
uaaguucaucucuaauaggugga

SEQ ID NO: 337522 - RNA, 22 nt, Homo sapiens
aaagugcugagacagacuggga

SEQ ID NO: 337523 - RNA, 22 nt, Homo sapiens
aaagugguuuuucagacuuuga

SEQ ID NO: 337524 - RNA, 22 nt, Homo sapiens
aaaguguguuuccaaccugugg

SEQ ID NO: 337525 - RNA, 22 nt, Homo sapiens
aaaucccuugcucucucagacc

SEQ ID NO: 337526 - RNA, 22 nt, Homo sapiens
aaaugcacgcuacccagcuaga

SEQ ID NO: 337527 - RNA, 22 nt, Homo sapiens
aaaugcaguugguggggauaug

SEQ ID NO: 337528 - RNA, 22 nt, Homo sapiens
aaaugcuucuauguggcauguu

SEQ ID NO: 337529 - RNA, 22 nt, Homo sapiens
aaauggcaccggcucuucccuc

SEQ ID NO: 337530 - RNA, 22 nt, Homo sapiens
aaauucaugucaccucuaggua

SEQ ID NO: 337531 - RNA, 22 nt, Homo sapiens
aaauugcaaugcgaggcagagg

SEQ ID NO: 337532 - RNA, 22 nt, Homo sapiens
aaauugcauugagcugcuuauu

SEQ ID NO: 337533 - RNA, 22 nt, Homo sapiens
aacagaauccucuuuuccuggg

SEQ ID NO: 337534 - RNA, 22 nt, Homo sapiens
aacagucaauugcugaugaccu

SEQ ID NO: 337535 - RNA, 22 nt, Homo sapiens
aacagugcuucauucacacauu

SEQ ID NO: 337536 - RNA, 22 nt, Homo sapiens
aaccuacauucuuaacuguugc

SEQ ID NO: 337537 - RNA, 22 nt, Homo sapiens
aacucugucuccuucaaguuca

SEQ ID NO: 337538 - RNA, 22 nt, Homo sapiens
aacuggccuccuugggaaauua

SEQ ID NO: 337539 - RNA, 22 nt, Homo sapiens
aacuggccugagaugaaaagug

SEQ ID NO: 337540 - RNA, 20 nt, Homo sapiens
aagacacuguccccacugga

SEQ ID NO: 337541 - RNA, 22 nt, Homo sapiens
aagagccgcaagggugaagggu

SEQ ID NO: 337542 - RNA, 22 nt, Homo sapiens
aagauaguaaacauuuucugcu

SEQ ID NO: 337543 - RNA, 22 nt, Homo sapiens
aagaucaucauagagggcauga

SEQ ID NO: 337544 - RNA, 22 nt, Homo sapiens
aagaugauguucuuuuucuuag

SEQ ID NO: 337545 - RNA, 21 nt, Homo sapiens
aagcacauugaguguguguga

SEQ ID NO: 337546 - RNA, 22 nt, Homo sapiens
aagcaccaauaggagauuuguc

SEQ ID NO: 337547 - RNA, 22 nt, Homo sapiens
aagcaggugucugugucuguaa

SEQ ID NO: 337548 - RNA, 22 nt, Homo sapiens
aagcuaguguuccagugaacag

SEQ ID NO: 337549 - RNA, 22 nt, Homo sapiens
aagcucauugagaucuauggcu

SEQ ID NO: 337550 - RNA, 22 nt, Homo sapiens
aagcugccaggcaugguggcug

SEQ ID NO: 337551 - RNA, 22 nt, Homo sapiens
aagcuggagugcaguggugcaa

SEQ ID NO: 337552 - RNA, 22 nt, Homo sapiens
aagcuggauuucgcauccuguu

SEQ ID NO: 337553 - RNA, 22 nt, Homo sapiens
aagcuggcauucauucguucuu

SEQ ID NO: 337554 - RNA, 22 nt, Homo sapiens
aagcugguguugcugcucuguu

SEQ ID NO: 337555 - RNA, 22 nt, Homo sapiens
aagcuuucaacuguuugccauu

SEQ ID NO: 337556 - RNA, 22 nt, Homo sapiens
aaggaauucaaauuuucucugg

SEQ ID NO: 337557 - RNA, 22 nt, Homo sapiens
aaggagcuuaagugacuuguac

SEQ ID NO: 337558 - RNA, 22 nt, Homo sapiens
aaggcaacgugaguuguugauu

SEQ ID NO: 337559 - RNA, 22 nt, Homo sapiens
aagggagcugcauaaucuugug

SEQ ID NO: 337560 - RNA, 23 nt, Homo sapiens
aagguaagcuagaaagauguaga

SEQ ID NO: 337561 - RNA, 22 nt, Homo sapiens
aaggugcucucuuauguagaaa

SEQ ID NO: 337562 - RNA, 21 nt, Homo sapiens
aaggugguggugauugagaug

SEQ ID NO: 337563 - RNA, 22 nt, Homo sapiens
aagguggugucagagagcuuau

SEQ ID NO: 337564 - RNA, 22 nt, Homo sapiens
aaggugguuuucucuuggaguc

SEQ ID NO: 337565 - RNA, 21 nt, Homo sapiens
aagguuuuuagugcuugacuu

SEQ ID NO: 337566 - RNA, 22 nt, Homo sapiens
aaguaaauauccgguaguccca

SEQ ID NO: 337567 - RNA, 22 nt, Homo sapiens
aaguaaaucuuaugucagggag

SEQ ID NO: 337568 - RNA, 22 nt, Homo sapiens
aaguagcagaggcaagacuuga

SEQ ID NO: 337569 - RNA, 22 nt, Homo sapiens
aaguagugcuugugcucaucuc

SEQ ID NO: 337570 - RNA, 22 nt, Homo sapiens
aaguaucaggaauaguuauugg

SEQ ID NO: 337571 - RNA, 22 nt, Homo sapiens
aaguauuaagacuaagaggcuu

SEQ ID NO: 337572 - RNA, 22 nt, Homo sapiens
aagucaugaagaggaaaggaca

SEQ ID NO: 337573 - RNA, 22 nt, Homo sapiens
aagugacauugugcccauuuga

SEQ ID NO: 337574 - RNA, 22 nt, Homo sapiens
aagugcaaaucuguggcugaaa

SEQ ID NO: 337575 - RNA, 22 nt, Homo sapiens
aagugcucuugugggaagagag

SEQ ID NO: 337576 - RNA, 22 nt, Homo sapiens
aagugcuuacagggaacaugau

SEQ ID NO: 337577 - RNA, 22 nt, Homo sapiens
aagugcuuuuuagauaugguuu

SEQ ID NO: 337578 - RNA, 22 nt, Homo sapiens
aaguggcauugaggaaaaaaau

SEQ ID NO: 337579 - RNA, 22 nt, Homo sapiens
aagugguguuugggagcuggac

SEQ ID NO: 337580 - RNA, 21 nt, Homo sapiens
aauaaagcaaccuuaugccau

SEQ ID NO: 337581 - RNA, 22 nt, Homo sapiens
aauaaagcagcuuuuugggacu

SEQ ID NO: 337582 - RNA, 22 nt, Homo sapiens
aauaaagcugaauccuuccuga

SEQ ID NO: 337583 - RNA, 22 nt, Homo sapiens
aauaaagucugaagugugcuua

SEQ ID NO: 337584 - RNA, 22 nt, Homo sapiens
aauaagcugagagaauucuaca

SEQ ID NO: 337585 - RNA, 22 nt, Homo sapiens
aauaaugucacaggggguuagc

SEQ ID NO: 337586 - RNA, 22 nt, Homo sapiens
aauacuuccaaaucuagucauu

SEQ ID NO: 337587 - RNA, 22 nt, Homo sapiens
aauagcuguuuuuaauuccugc

SEQ ID NO: 337588 - RNA, 22 nt, Homo sapiens
aauagugcugcaaaaacauacg

SEQ ID NO: 337589 - RNA, 22 nt, Homo sapiens
aauaucacaguggguguacacc

SEQ ID NO: 337590 - RNA, 22 nt, Homo sapiens
aauaugguuuuaugaagcaauu

SEQ ID NO: 337591 - RNA, 22 nt, Homo sapiens
aaucacaguguucuugugaggg

SEQ ID NO: 337592 - RNA, 22 nt, Homo sapiens
aaucacauuaaugcucccucag

SEQ ID NO: 337593 - RNA, 22 nt, Homo sapiens
aaucacauugaaucugcuaccu

SEQ ID NO: 337594 - RNA, 22 nt, Homo sapiens
aaucacuuugcuacaaggcagu

SEQ ID NO: 337595 - RNA, 22 nt, Homo sapiens
aaucacuuuggcaccaaccuaa

SEQ ID NO: 337596 - RNA, 22 nt, Homo sapiens
aaucauauugucugccaagagg

SEQ ID NO: 337597 - RNA, 22 nt, Homo sapiens
aaucccuggacuuucggaggcu

SEQ ID NO: 337598 - RNA, 22 nt, Homo sapiens
aaucucagcauuuugggcugag

SEQ ID NO: 337599 - RNA, 22 nt, Homo sapiens
aaucuguagaaggugcacauuc

SEQ ID NO: 337600 - RNA, 22 nt, Homo sapiens
aaugacacugagcaucuuucau

SEQ ID NO: 337601 - RNA, 22 nt, Homo sapiens
aaugacagugcuaaagaacccu

SEQ ID NO: 337602 - RNA, 20 nt, Homo sapiens
aauggcauguuggacaacug

SEQ ID NO: 337603 - RNA, 22 nt, Homo sapiens
aauggcuuucagcuuuucccca

SEQ ID NO: 337604 - RNA, 22 nt, Homo sapiens
aaugugcacuuggagccuugcu

SEQ ID NO: 337605 - RNA, 22 nt, Homo sapiens
aauuacuucuacaccaaccuaa

SEQ ID NO: 337606 - RNA, 22 nt, Homo sapiens
aauucuguauuguuuagggacu

SEQ ID NO: 337607 - RNA, 22 nt, Homo sapiens
aauucugugagauggugcagau

SEQ ID NO: 337608 - RNA, 23 nt, Homo sapiens
aauugcuuuugaggacuuaguug

SEQ ID NO: 337609 - RNA, 18 nt, Homo sapiens
uaauaacugugaccuuga

SEQ ID NO: 337610 - RNA, 22 nt, Homo sapiens
uaauaguuggcacuggagaaag

SEQ ID NO: 337611 - RNA, 22 nt, Homo sapiens
uaauccuagcacuuuggaagac

SEQ ID NO: 337612 - RNA, 22 nt, Homo sapiens
uaaugugaauagugcuguaaug

SEQ ID NO: 337613 - RNA, 22 nt, Homo sapiens
uaaugugcuucucuaccauagg

SEQ ID NO: 337614 - RNA, 22 nt, Homo sapiens
uacaacacugguucgacaugug

SEQ ID NO: 337615 - RNA, 22 nt, Homo sapiens
uacaagcaggaaaugguauaug

SEQ ID NO: 337616 - RNA, 22 nt, Homo sapiens
uacaaguauuuuuauuagugcc

SEQ ID NO: 337617 - RNA, 21 nt, Homo sapiens
uacaaugcacaggagagccuc

SEQ ID NO: 337618 - RNA, 22 nt, Homo sapiens
uacacaugugaguucuuuucua

SEQ ID NO: 337619 - RNA, 18 nt, Homo sapiens
uacagaacuggaguagaa

SEQ ID NO: 337620 - RNA, 22 nt, Homo sapiens
uacagaauauuucugcccugag

SEQ ID NO: 337621 - RNA, 22 nt, Homo sapiens
uacagcacaggugcagguguug

SEQ ID NO: 337622 - RNA, 22 nt, Homo sapiens
uacaggugcucuacagacagga

SEQ ID NO: 337623 - RNA, 19 nt, Homo sapiens
uacaguacacaacaccuuu

SEQ ID NO: 337624 - RNA, 22 nt, Homo sapiens
uacaguauuaugagugauugaa

SEQ ID NO: 337625 - RNA, 22 nt, Homo sapiens
uacagucuagaggagaaucagg

SEQ ID NO: 337626 - RNA, 22 nt, Homo sapiens
uacagugcuugguaucuaguaa

SEQ ID NO: 337627 - RNA, 22 nt, Homo sapiens
uacauguauacaggguuuacuu

SEQ ID NO: 337628 - RNA, 22 nt, Homo sapiens
uaccaccauuguaguuuggaaa

SEQ ID NO: 337629 - RNA, 22 nt, Homo sapiens
uaccacugccgagaaaacagau

SEQ ID NO: 337630 - RNA, 22 nt, Homo sapiens
uacguuaucagguaugcaagag

SEQ ID NO: 337631 - RNA, 22 nt, Homo sapiens
uacugagagaggaauauugaaa

SEQ ID NO: 337632 - RNA, 22 nt, Homo sapiens
uacugcacuccagccugccaac

SEQ ID NO: 337633 - RNA, 22 nt, Homo sapiens
uacugcacuccagccuggguga

SEQ ID NO: 337634 - RNA, 22 nt, Homo sapiens
uacugcacuccagccuugccaa

SEQ ID NO: 337635 - RNA, 22 nt, Homo sapiens
uacugcacuugaccuccugggc

SEQ ID NO: 337636 - RNA, 22 nt, Homo sapiens
uacugcaucuacuuagagccag

SEQ ID NO: 337637 - RNA, 19 nt, Homo sapiens
uacuggcucgggaauuuuc

SEQ ID NO: 337638 - RNA, 22 nt, Homo sapiens
uacuguguaguuagaccucaga

SEQ ID NO: 337639 - RNA, 22 nt, Homo sapiens
uacuuaguagcuuauccugugg

SEQ ID NO: 337640 - RNA, 22 nt, Homo sapiens
uagaagcugagaauguccucag

SEQ ID NO: 337641 - RNA, 22 nt, Homo sapiens
uagagagcuguuugaaagcagg

SEQ ID NO: 337642 - RNA, 21 nt, Homo sapiens
uagagcaacacacgcccucuc

SEQ ID NO: 337643 - RNA, 22 nt, Homo sapiens
uagagcuaguugcucacugcuu

SEQ ID NO: 337644 - RNA, 22 nt, Homo sapiens
uagagcuaguuuuuaaucuaac

SEQ ID NO: 337645 - RNA, 22 nt, Homo sapiens
uagaggaaggauuggaaacgca

SEQ ID NO: 337646 - RNA, 22 nt, Homo sapiens
uagaggaaugaauuuggccaga

SEQ ID NO: 337647 - RNA, 22 nt, Homo sapiens
uagagguagccuacuacacacc

SEQ ID NO: 337648 - RNA, 22 nt, Homo sapiens
uagagguagguguaugaacuag

SEQ ID NO: 337649 - RNA, 22 nt, Homo sapiens
uagauuaucuguaugugcucuu

SEQ ID NO: 337650 - RNA, 22 nt, Homo sapiens
uagauucauuuuagcaaaaguu

SEQ ID NO: 337651 - RNA, 22 nt, Homo sapiens
uagcaccaaacauauacucagu

SEQ ID NO: 337652 - RNA, 22 nt, Homo sapiens
uagcaccacaaucaagauacag

SEQ ID NO: 337653 - RNA, 18 nt, Homo sapiens
uagcagacaucauugggg

SEQ ID NO: 337654 - RNA, 21 nt, Homo sapiens
uagcagcguuguugcaaaugu

SEQ ID NO: 337655 - RNA, 22 nt, Homo sapiens
uagcagguggugaccacauuuu

SEQ ID NO: 337656 - RNA, 22 nt, Homo sapiens
uagcauccuucucuaaacagga

SEQ ID NO: 337657 - RNA, 22 nt, Homo sapiens
uagcccagugagguugauuugg

SEQ ID NO: 337658 - RNA, 22 nt, Homo sapiens
uagccuguggugaauguuucug

SEQ ID NO: 337659 - RNA, 22 nt, Homo sapiens
uagcugagacuacaguaggugc

SEQ ID NO: 337660 - RNA, 22 nt, Homo sapiens
uagcugcaaaauauagacuucu

SEQ ID NO: 337661 - RNA, 21 nt, Homo sapiens
uagcugcacccaggccuccuu

SEQ ID NO: 337662 - RNA, 22 nt, Homo sapiens
uaggcaaguugcccaaucucuc

SEQ ID NO: 337663 - RNA, 22 nt, Homo sapiens
uaggcaauguacauaucggccc

SEQ ID NO: 337664 - RNA, 22 nt, Homo sapiens
uaggcaguuuuccuuucacagu

SEQ ID NO: 337665 - RNA, 22 nt, Homo sapiens
uaggccuuuuuaugucaauauc

SEQ ID NO: 337666 - RNA, 22 nt, Homo sapiens
uaggggcacacuucgguuagca

SEQ ID NO: 337667 - RNA, 22 nt, Homo sapiens
uaggucuuuuagcauaggagcu

SEQ ID NO: 337668 - RNA, 22 nt, Homo sapiens
uaggugguuugaaauacucaag

SEQ ID NO: 337669 - RNA, 19 nt, Homo sapiens
uaggugguuuuccccucac

SEQ ID NO: 337670 - RNA, 22 nt, Homo sapiens
uaguacuggcauguauuuccca

SEQ ID NO: 337671 - RNA, 22 nt, Homo sapiens
uaguagcauaccuaaguauacu

SEQ ID NO: 337672 - RNA, 22 nt, Homo sapiens
uagucaaaucugaaggaaauuu

SEQ ID NO: 337673 - RNA, 21 nt, Homo sapiens
uagugcugaggcaguauggga

SEQ ID NO: 337674 - RNA, 22 nt, Homo sapiens
uagugcuguaauucuaaugaaa

SEQ ID NO: 337675 - RNA, 22 nt, Homo sapiens
uaguugcauucaggauaugacg

SEQ ID NO: 337676 - RNA, 22 nt, Homo sapiens
uaguuuaucuucuggauggaca

SEQ ID NO: 337677 - RNA, 20 nt, Homo sapiens
uauagcaauuuuuuucuccu

SEQ ID NO: 337678 - RNA, 22 nt, Homo sapiens
uauagcacaucuguguguacau

SEQ ID NO: 337679 - RNA, 22 nt, Homo sapiens
uauagcacugcaauauuucccu

SEQ ID NO: 337680 - RNA, 22 nt, Homo sapiens
uauagcuuaaaguuuagauccu

SEQ ID NO: 337681 - RNA, 22 nt, Homo sapiens
uauagcuuuuuagggaauuugg

SEQ ID NO: 337682 - RNA, 22 nt, Homo sapiens
uauaguguuuucaaaaguaugu

SEQ ID NO: 337683 - RNA, 23 nt, Homo sapiens
uauaugugucuaggagcuauggu

SEQ ID NO: 337684 - RNA, 22 nt, Homo sapiens
uauauguucuugcacuggaaag

SEQ ID NO: 337685 - RNA, 22 nt, Homo sapiens
uaucacacgccuugcuucauuu

SEQ ID NO: 337686 - RNA, 22 nt, Homo sapiens
uaucacagcgggguguacaccc

SEQ ID NO: 337687 - RNA, 22 nt, Homo sapiens
uaucacaggucaggaaucuugc

SEQ ID NO: 337688 - RNA, 20 nt, Homo sapiens
uaucacaguucaggaacucu

SEQ ID NO: 337689 - RNA, 22 nt, Homo sapiens
uaucaccacccugggaaacaua

SEQ ID NO: 337690 - RNA, 22 nt, Homo sapiens
uaucagcgugcaaaucuuugga

SEQ ID NO: 337691 - RNA, 22 nt, Homo sapiens
uaucauggggacugcagccuag

SEQ ID NO: 337692 - RNA, 22 nt, Homo sapiens
uaucccaauguaauaucacaaa

SEQ ID NO: 337693 - RNA, 22 nt, Homo sapiens
uaucccuguggacuucccaaca

SEQ ID NO: 337694 - RNA, 22 nt, Homo sapiens
uaugaagccaggauuuauuauu

SEQ ID NO: 337695 - RNA, 22 nt, Homo sapiens
uaugaaucugagagaucuggaa

SEQ ID NO: 337696 - RNA, 18 nt, Homo sapiens
cagugcaauacaggagag

SEQ ID NO: 337697 - RNA, 22 nt, Homo sapiens
cagugcauaggaucuaaaauuu

SEQ ID NO: 337698 - RNA, 22 nt, Homo sapiens
cagugcauguggcacucuccag

SEQ ID NO: 337699 - RNA, 22 nt, Homo sapiens
cagugcuuguuauuguucuauu

SEQ ID NO: 337700 - RNA, 22 nt, Homo sapiens
cauaaagauggaggaggccagg

SEQ ID NO: 337701 - RNA, 22 nt, Homo sapiens
cauacaguaggcacuauuugua

SEQ ID NO: 337702 - RNA, 22 nt, Homo sapiens
cauacaugugcuugucuuaugc

SEQ ID NO: 337703 - RNA, 22 nt, Homo sapiens
cauauaguaggugcucuguguu

SEQ ID NO: 337704 - RNA, 22 nt, Homo sapiens
caucacauucugagauacugag

SEQ ID NO: 337705 - RNA, 22 nt, Homo sapiens
caucacuuugccuccgucucua

SEQ ID NO: 337706 - RNA, 22 nt, Homo sapiens
cauccccugcaccaaccuuuac

SEQ ID NO: 337707 - RNA, 22 nt, Homo sapiens
caucccugucgucaagucucug

SEQ ID NO: 337708 - RNA, 22 nt, Homo sapiens
caucgcacuccagccugggcaa

SEQ ID NO: 337709 - RNA, 22 nt, Homo sapiens
caugacacauguuuaccuaugu

SEQ ID NO: 337710 - RNA, 22 nt, Homo sapiens
cauggcccuggguccauaggaa

SEQ ID NO: 337711 - RNA, 22 nt, Homo sapiens
cauggcucuuugcugcuaaagu

SEQ ID NO: 337712 - RNA, 22 nt, Homo sapiens
cauggcuuuaagcaacaccaag

SEQ ID NO: 337713 - RNA, 22 nt, Homo sapiens
cauggcuuuauuuucagcuucu

SEQ ID NO: 337714 - RNA, 22 nt, Homo sapiens
cauggcuuucacaguaaagccu

SEQ ID NO: 337715 - RNA, 21 nt, Homo sapiens
caugucacugcacucuagccu

SEQ ID NO: 337716 - RNA, 22 nt, Homo sapiens
caugucacuuccucucugaugg

SEQ ID NO: 337717 - RNA, 22 nt, Homo sapiens
cauuccacuggauaaacaaggu

SEQ ID NO: 337718 - RNA, 22 nt, Homo sapiens
cauugcaaugaggucuugcagu

SEQ ID NO: 337719 - RNA, 20 nt, Homo sapiens
cauugcacuccagccugcug

SEQ ID NO: 337720 - RNA, 22 nt, Homo sapiens
cauugcacuccagccuggccaa

SEQ ID NO: 337721 - RNA, 22 nt, Homo sapiens
cauugcacuccagccuuggcaa

SEQ ID NO: 337722 - RNA, 22 nt, Homo sapiens
cauugcacuccagcucugggcg

SEQ ID NO: 337723 - RNA, 22 nt, Homo sapiens
cauugcccuccagccugggcaa

SEQ ID NO: 337724 - RNA, 22 nt, Homo sapiens
cauugcuaaaagucauauauaa

SEQ ID NO: 337725 - RNA, 19 nt, Homo sapiens
cauuggacuugcuuuugcc

SEQ ID NO: 337726 - RNA, 22 nt, Homo sapiens
cauuguacauaaguauggagua

SEQ ID NO: 337727 - RNA, 22 nt, Homo sapiens
ccaaggcacugauucuguacuc

SEQ ID NO: 337728 - RNA, 22 nt, Homo sapiens
ccaaguguucucauuguucaau

SEQ ID NO: 337729 - RNA, 22 nt, Homo sapiens
ccacauuaccuugcuugcucca

SEQ ID NO: 337730 - RNA, 22 nt, Homo sapiens
ccacugugguaucugauacugg

SEQ ID NO: 337731 - RNA, 20 nt, Homo sapiens
ccagcaucauuagauucugg

SEQ ID NO: 337732 - RNA, 22 nt, Homo sapiens
ccagguuucuagaauaauuccu

SEQ ID NO: 337733 - RNA, 22 nt, Homo sapiens
ccaguuuucaagauaaugguuu

SEQ ID NO: 337734 - RNA, 22 nt, Homo sapiens
ccaguuuucucacuguugcagu

SEQ ID NO: 337735 - RNA, 22 nt, Homo sapiens
ccaucacaggccucagugggaa

SEQ ID NO: 337736 - RNA, 21 nt, Homo sapiens
ccauggcaaugguaaacugac

SEQ ID NO: 337737 - RNA, 21 nt, Homo sapiens
ccaugggacggaaugaauaca

SEQ ID NO: 337738 - RNA, 22 nt, Homo sapiens
ccauugcacuccagccucggca

SEQ ID NO: 337739 - RNA, 22 nt, Homo sapiens
cccagaguucuuaaauacugag

SEQ ID NO: 337740 - RNA, 21 nt, Homo sapiens
cccagguucucugaggguaga

SEQ ID NO: 337741 - RNA, 22 nt, Homo sapiens
ggaaaguaacccauucucuuac

SEQ ID NO: 337742 - RNA, 22 nt, Homo sapiens
ggaagccugcacucgggcaggg

SEQ ID NO: 337743 - RNA, 22 nt, Homo sapiens
ggaagguaauugucagcucaua

SEQ ID NO: 337744 - RNA, 22 nt, Homo sapiens
ggaaggucaaagggaaagcaga

SEQ ID NO: 337745 - RNA, 22 nt, Homo sapiens
ggaaucugaaccaugggaaugg

SEQ ID NO: 337746 - RNA, 22 nt, Homo sapiens
ggaaugcuaaaauaggaugcug

SEQ ID NO: 337747 - RNA, 22 nt, Homo sapiens
ggaauguaguaauuugguuagu

SEQ ID NO: 337748 - RNA, 22 nt, Homo sapiens
ggaaugugugucaugcuuuugc

SEQ ID NO: 337749 - RNA, 21 nt, Homo sapiens
ggaauuuagggaaugauuuag

SEQ ID NO: 337750 - RNA, 22 nt, Homo sapiens
ggagagcuaggcagagguuugu

SEQ ID NO: 337751 - RNA, 22 nt, Homo sapiens
ggagauccucugcgggcaaaga

SEQ ID NO: 337752 - RNA, 22 nt, Homo sapiens
ggagaugauuaugaaucacuua

SEQ ID NO: 337753 - RNA, 22 nt, Homo sapiens
ggagcucaucuagcauagaggu

SEQ ID NO: 337754 - RNA, 22 nt, Homo sapiens
ggagguagguuugugauuugua

SEQ ID NO: 337755 - RNA, 16 nt, Homo sapiens
ggaggucaucugggaa

SEQ ID NO: 337756 - RNA, 22 nt, Homo sapiens
ggagugucccaaucucagcuca

SEQ ID NO: 337757 - RNA, 22 nt, Homo sapiens
ggaucacagagcuugggaaagg

SEQ ID NO: 337758 - RNA, 21 nt, Homo sapiens
ggauucaucccucaugaauuu

SEQ ID NO: 337759 - RNA, 22 nt, Homo sapiens
ggcaaaaucgcaauuacuuuug

SEQ ID NO: 337760 - RNA, 22 nt, Homo sapiens
ggcaaaauggccagugggucac

SEQ ID NO: 337761 - RNA, 22 nt, Homo sapiens
ggcaaagagacaugcaucgggg

SEQ ID NO: 337762 - RNA, 22 nt, Homo sapiens
ggcaacaaagacauuucaacau

SEQ ID NO: 337763 - RNA, 21 nt, Homo sapiens
ggcaagaaacacaaucaagua

SEQ ID NO: 337764 - RNA, 17 nt, Homo sapiens
ggcaagaaguggaacuc

SEQ ID NO: 337765 - RNA, 20 nt, Homo sapiens
ggcaagguagcauuucuucu

SEQ ID NO: 337766 - RNA, 22 nt, Homo sapiens
ggcaaugaggcggaccagcagg

SEQ ID NO: 337767 - RNA, 22 nt, Homo sapiens
ggcaaugucagcuaaugaugga

SEQ ID NO: 337768 - RNA, 19 nt, Homo sapiens
ggcacugugugagugagga

SEQ ID NO: 337769 - RNA, 22 nt, Homo sapiens
ggcagcacaauuuucugaugga

SEQ ID NO: 337770 - RNA, 22 nt, Homo sapiens
ggcaguggaagugccaguuucu

SEQ ID NO: 337771 - RNA, 21 nt, Homo sapiens
ggcaugaauggaaaagugaga

SEQ ID NO: 337772 - RNA, 22 nt, Homo sapiens
ggcaugguggugugugccuaua

SEQ ID NO: 337773 - RNA, 22 nt, Homo sapiens
ggcauguaauuauucaaagugg

SEQ ID NO: 337774 - RNA, 22 nt, Homo sapiens
ggcauguuuaguagaauguggu

SEQ ID NO: 337775 - RNA, 21 nt, Homo sapiens
ggcauugugcccuugcucuag

SEQ ID NO: 337776 - RNA, 22 nt, Homo sapiens
ggccuguaggguauugguaggg

SEQ ID NO: 337777 - RNA, 22 nt, Homo sapiens
ggcuuuggucacacaggggcaa

SEQ ID NO: 337778 - RNA, 22 nt, Homo sapiens
gggaaauguaaagucauaagau

SEQ ID NO: 337779 - RNA, 22 nt, Homo sapiens
gggaagaaggagugguuuacuc

SEQ ID NO: 337780 - RNA, 22 nt, Homo sapiens
gggaggucauuguucaaugcug

SEQ ID NO: 337781 - RNA, 22 nt, Homo sapiens
gggaguguguaggacccagugu

SEQ ID NO: 337782 - RNA, 22 nt, Homo sapiens
gggaugaaguugauguagaaag

SEQ ID NO: 337783 - RNA, 22 nt, Homo sapiens
gggaugauuaugguucacuaca

SEQ ID NO: 337784 - RNA, 22 nt, Homo sapiens
gggauguaugauauauguuggu

SEQ ID NO: 337785 - RNA, 20 nt, Homo sapiens
gggcaaguaugugggaaguc

SEQ ID NO: 337786 - RNA, 22 nt, Homo sapiens
gggcgagaaucggcugcucagc

SEQ ID NO: 337787 - RNA, 22 nt, Homo sapiens
ggggaguguggacaucacccug

SEQ ID NO: 337788 - RNA, 22 nt, Homo sapiens
ggggcaaaaugccacgagucuc

SEQ ID NO: 337789 - RNA, 22 nt, Homo sapiens
gggguaggcuacacugaguucc

SEQ ID NO: 337790 - RNA, 22 nt, Homo sapiens
ggggucauuaaauuccgcuggu

SEQ ID NO: 337791 - RNA, 17 nt, Homo sapiens
gggucaccuugcaggua

SEQ ID NO: 337792 - RNA, 22 nt, Homo sapiens
gggucaguuuugagaaagcgug

SEQ ID NO: 337793 - RNA, 22 nt, Homo sapiens
gguaacaguggggcuaugcuua

SEQ ID NO: 337794 - RNA, 22 nt, Homo sapiens
ggucauggauaagauccagaag

SEQ ID NO: 337795 - RNA, 22 nt, Homo sapiens
ggucuagagagagggguggacu

SEQ ID NO: 337796 - RNA, 22 nt, Homo sapiens
ggugagauaucugcugauguuu

SEQ ID NO: 337797 - RNA, 22 nt, Homo sapiens
ggugagcacagaaugcccugag

SEQ ID NO: 337798 - RNA, 22 nt, Homo sapiens
ggugagguaguaagguacaaua

SEQ ID NO: 337799 - RNA, 22 nt, Homo sapiens
ggugcagcacaccaacauggca

SEQ ID NO: 337800 - RNA, 22 nt, Homo sapiens
guaaacuuccccucaugaauga

SEQ ID NO: 337801 - RNA, 22 nt, Homo sapiens
guaaaguaaagcacaucaaggu

SEQ ID NO: 337802 - RNA, 22 nt, Homo sapiens
guaauaccuuccccugcuggag

SEQ ID NO: 337803 - RNA, 22 nt, Homo sapiens
guaaucucagcuacucaggagg

SEQ ID NO: 337804 - RNA, 22 nt, Homo sapiens
guaaucucagcuacucgggagg

SEQ ID NO: 337805 - RNA, 22 nt, Homo sapiens
guacaguucucuuuguugucag

SEQ ID NO: 337806 - RNA, 22 nt, Homo sapiens
guagcagaacauguuccuugua

SEQ ID NO: 337807 - RNA, 22 nt, Homo sapiens
guaggcacugaguguuuuacag

SEQ ID NO: 337808 - RNA, 22 nt, Homo sapiens
guaucaucauguuggccaggcu

SEQ ID NO: 337809 - RNA, 22 nt, Homo sapiens
guaugaaaaucggagauugggu

SEQ ID NO: 337810 - RNA, 21 nt, Homo sapiens
guauggcauugauuaguuacu

SEQ ID NO: 337811 - RNA, 22 nt, Homo sapiens
guaugguugaagugacaagcca

SEQ ID NO: 337812 - RNA, 22 nt, Homo sapiens
guaugucuuuauagcagugugg

SEQ ID NO: 337813 - RNA, 22 nt, Homo sapiens
guauuagaugguauuugaagau

SEQ ID NO: 337814 - RNA, 22 nt, Homo sapiens
guauuguacuacaagcucuuua

SEQ ID NO: 337815 - RNA, 22 nt, Homo sapiens
gucaagagaacuuucuaucacu

SEQ ID NO: 337816 - RNA, 22 nt, Homo sapiens
gucaagauuuguaggacagaga

SEQ ID NO: 337817 - RNA, 22 nt, Homo sapiens
gucacagcacuuuuaguaagug

SEQ ID NO: 337818 - RNA, 22 nt, Homo sapiens
gucacugggugcugcgccuguc

SEQ ID NO: 337819 - RNA, 22 nt, Homo sapiens
gucacuguuuccuauuauauuu

SEQ ID NO: 337820 - RNA, 22 nt, Homo sapiens
gucaggugcuuacgcggagauc

SEQ ID NO: 337821 - RNA, 22 nt, Homo sapiens
gucagugccugucccaggcuuu

SEQ ID NO: 337822 - RNA, 21 nt, Homo sapiens
gucauaugucucugauuagug

SEQ ID NO: 337823 - RNA, 22 nt, Homo sapiens
gucaugggguacuacacauggg

SEQ ID NO: 337824 - RNA, 22 nt, Homo sapiens
gucauggguuaaagguggauac

SEQ ID NO: 337825 - RNA, 22 nt, Homo sapiens
gucaugucuugaaauucaguuu

SEQ ID NO: 337826 - RNA, 22 nt, Homo sapiens
guccaaagugggagaggugggg

SEQ ID NO: 337827 - RNA, 22 nt, Homo sapiens
gucuaugguucaggguggagug

SEQ ID NO: 337828 - RNA, 22 nt, Homo sapiens
gucuggcaauggcagacuggca

SEQ ID NO: 337829 - RNA, 23 nt, Homo sapiens
gucuggucccugguuggaaacca

SEQ ID NO: 337830 - RNA, 22 nt, Homo sapiens
gucuguuuggggaccuguggcc

SEQ ID NO: 337831 - RNA, 22 nt, Homo sapiens
gucuugaaggcugaguaccugu

SEQ ID NO: 337832 - RNA, 20 nt, Homo sapiens
gucuuguagcucaaguuauu

SEQ ID NO: 337833 - RNA, 22 nt, Homo sapiens
gucuuuaguugaaacauguggu

SEQ ID NO: 337834 - RNA, 22 nt, Homo sapiens
gucuuugaugucuaugugcuuc

SEQ ID NO: 337835 - RNA, 22 nt, Homo sapiens
gucuuuguuauuaugaaucaac

SEQ ID NO: 337836 - RNA, 22 nt, Homo sapiens
gucuuuugcuagccagagagcu

SEQ ID NO: 337837 - RNA, 22 nt, Homo sapiens
gugaaagacauauaugguuuga

SEQ ID NO: 337838 - RNA, 22 nt, Homo sapiens
gugaaaugaaucuggaaauauu

SEQ ID NO: 337839 - RNA, 22 nt, Homo sapiens
gugaacagaaccugggaucgaa

SEQ ID NO: 337840 - RNA, 22 nt, Homo sapiens
gugaacagcagaugagugagug

SEQ ID NO: 337841 - RNA, 22 nt, Homo sapiens
gugaauguaaagucaugugacu

SEQ ID NO: 337842 - RNA, 22 nt, Homo sapiens
gugacagucaaagacaugacuu

SEQ ID NO: 337843 - RNA, 22 nt, Homo sapiens
gugaccagaugggcaggggugu

SEQ ID NO: 337844 - RNA, 22 nt, Homo sapiens
gugaccucauuacggggccugc

SEQ ID NO: 337845 - RNA, 22 nt, Homo sapiens
gugacuacaggccacaguuugg

SEQ ID NO: 337846 - RNA, 22 nt, Homo sapiens
gugagaaucaaacuacauaaau

SEQ ID NO: 337847 - RNA, 18 nt, Homo sapiens
gugagaaugacuguucug

SEQ ID NO: 337848 - RNA, 22 nt, Homo sapiens
gugagacugaguuucgcucuug

SEQ ID NO: 337849 - RNA, 22 nt, Homo sapiens
gugagcacugaaagaaggcaag

SEQ ID NO: 337850 - RNA, 22 nt, Homo sapiens
gugagcauaacaacagaguuua

SEQ ID NO: 337851 - RNA, 22 nt, Homo sapiens
gugagcauuacucaugggauca

SEQ ID NO: 337852 - RNA, 22 nt, Homo sapiens
gugagucagucuguguagggcu

SEQ ID NO: 337853 - RNA, 22 nt, Homo sapiens
gugauauguuaggaucuaaguc

SEQ ID NO: 337854 - RNA, 22 nt, Homo sapiens
gugauugugaaaacauuaagaa

SEQ ID NO: 337855 - RNA, 22 nt, Homo sapiens
gugauuguuaaacugccucucu

SEQ ID NO: 337856 - RNA, 22 nt, Homo sapiens
gugcaaacuccaggucucuuca

SEQ ID NO: 337857 - RNA, 22 nt, Homo sapiens
gugcaacaucccuccauaauuu

SEQ ID NO: 337858 - RNA, 22 nt, Homo sapiens
gugcaauucacuguuaugucug

SEQ ID NO: 337859 - RNA, 22 nt, Homo sapiens
gugcacaaaucuuaaauguaca

SEQ ID NO: 337860 - RNA, 22 nt, Homo sapiens
gugcacaacgugcagguuaguu

SEQ ID NO: 337861 - RNA, 22 nt, Homo sapiens
gugcacaugcgugcgcacauau

SEQ ID NO: 337862 - RNA, 22 nt, Homo sapiens
auucacuguggguccuuuggau

SEQ ID NO: 337863 - RNA, 22 nt, Homo sapiens
auuccagauggaguugaggguu

SEQ ID NO: 337864 - RNA, 22 nt, Homo sapiens
auucccuguagaauaaggaugg

SEQ ID NO: 337865 - RNA, 18 nt, Homo sapiens
auucuacaggccuuuuga

SEQ ID NO: 337866 - RNA, 22 nt, Homo sapiens
auucuugcuugaacuuggugca

SEQ ID NO: 337867 - RNA, 22 nt, Homo sapiens
auugaacacuucugugugccag

SEQ ID NO: 337868 - RNA, 22 nt, Homo sapiens
auugaacuuuugucacugacau

SEQ ID NO: 337869 - RNA, 22 nt, Homo sapiens
auugacaguuggccaguaagug

SEQ ID NO: 337870 - RNA, 22 nt, Homo sapiens
auugaguaaaugaaaauugccu

SEQ ID NO: 337871 - RNA, 22 nt, Homo sapiens
auugcaaagcguagacucuaaa

SEQ ID NO: 337872 - RNA, 22 nt, Homo sapiens
auugcacacagaaucaggguaa

SEQ ID NO: 337873 - RNA, 22 nt, Homo sapiens
auugcacuccagcccgggugac

SEQ ID NO: 337874 - RNA, 22 nt, Homo sapiens
auugcacuccagccuaggcaac

SEQ ID NO: 337875 - RNA, 22 nt, Homo sapiens
auugcacuccagccuggaugac

SEQ ID NO: 337876 - RNA, 22 nt, Homo sapiens
auugcacuccagccuggccaac

SEQ ID NO: 337877 - RNA, 22 nt, Homo sapiens
auugcacuccagccugggugac

SEQ ID NO: 337878 - RNA, 22 nt, Homo sapiens
auugcacuccagccugggugag

SEQ ID NO: 337879 - RNA, 22 nt, Homo sapiens
auugcacuccagccuggugaca

SEQ ID NO: 337880 - RNA, 22 nt, Homo sapiens
auugcacuccagcuuaggcgac

SEQ ID NO: 337881 - RNA, 22 nt, Homo sapiens
auugcacuccggccugggugac

SEQ ID NO: 337882 - RNA, 22 nt, Homo sapiens
auugcacucuagccugggugac

SEQ ID NO: 337883 - RNA, 22 nt, Homo sapiens
auugcacucuagccuuggcgac

SEQ ID NO: 337884 - RNA, 22 nt, Homo sapiens
auugcacucugaucugcacucc

SEQ ID NO: 337885 - RNA, 22 nt, Homo sapiens
auugcacugcagccugggcaac

SEQ ID NO: 337886 - RNA, 19 nt, Homo sapiens
auugcaguguaaaacuauu

SEQ ID NO: 337887 - RNA, 22 nt, Homo sapiens
auugcauugugaucuucccaga

SEQ ID NO: 337888 - RNA, 22 nt, Homo sapiens
auugcuuacccuguauuagauc

SEQ ID NO: 337889 - RNA, 22 nt, Homo sapiens
auugcuuuuacugggagcuuug

SEQ ID NO: 337890 - RNA, 22 nt, Homo sapiens
auuggcaagauagcauaugagg

SEQ ID NO: 337891 - RNA, 22 nt, Homo sapiens
auuggccccguuuuaaauguca

SEQ ID NO: 337892 - RNA, 18 nt, Homo sapiens
auuguaagauguauggga

SEQ ID NO: 337893 - RNA, 22 nt, Homo sapiens
auuguaauuuuagagaaagugg

SEQ ID NO: 337894 - RNA, 22 nt, Homo sapiens
auuguacuagguccuagggcuu

SEQ ID NO: 337895 - RNA, 22 nt, Homo sapiens
auuguacuccagccuaggcaac

SEQ ID NO: 337896 - RNA, 22 nt, Homo sapiens
auuguacuccagccugggcagc

SEQ ID NO: 337897 - RNA, 22 nt, Homo sapiens
auuguacuccagccugggcugc

SEQ ID NO: 337898 - RNA, 22 nt, Homo sapiens
auuguacuccagccuguggagc

SEQ ID NO: 337899 - RNA, 22 nt, Homo sapiens
auuguacugccccccuguugcu

SEQ ID NO: 337900 - RNA, 22 nt, Homo sapiens
auugucacuuaaaagugcaugu

SEQ ID NO: 337901 - RNA, 22 nt, Homo sapiens
auuuggcaauuuugaagaugcc

SEQ ID NO: 337902 - RNA, 22 nt, Homo sapiens
auuugggaaugugcauuauacu

SEQ ID NO: 337903 - RNA, 22 nt, Homo sapiens
auuugucaauacacuucuucca

SEQ ID NO: 337904 - RNA, 22 nt, Homo sapiens
auuugucacuuaacagccauua

SEQ ID NO: 337905 - RNA, 22 nt, Homo sapiens
caaaggcuuccacugcauccuu

SEQ ID NO: 337906 - RNA, 22 nt, Homo sapiens
caaagucuucaguugauucuga

SEQ ID NO: 337907 - RNA, 22 nt, Homo sapiens
caaagugcugaaagaggccagg

SEQ ID NO: 337908 - RNA, 22 nt, Homo sapiens
caaauugcuuguggaggauaau

SEQ ID NO: 337909 - RNA, 22 nt, Homo sapiens
caacacagugaaacccgucucu

SEQ ID NO: 337910 - RNA, 22 nt, Homo sapiens
cacaaaguagauuagucuucca

SEQ ID NO: 337911 - RNA, 22 nt, Homo sapiens
cacaaugucuaagauguuucua

SEQ ID NO: 337912 - RNA, 22 nt, Homo sapiens
cacagcuaacaacuguuucuuc

SEQ ID NO: 337913 - RNA, 22 nt, Homo sapiens
cacagcuagucaaugguagaca

SEQ ID NO: 337914 - RNA, 23 nt, Homo sapiens
cacagggugaacaccccuaaucc

SEQ ID NO: 337915 - RNA, 22 nt, Homo sapiens
cacagucugggcuuguuuguac

SEQ ID NO: 337916 - RNA, 22 nt, Homo sapiens
cacagugaacaauauccucugu

SEQ ID NO: 337917 - RNA, 22 nt, Homo sapiens
cacaguguucauagccaucagg

SEQ ID NO: 337918 - RNA, 22 nt, Homo sapiens
cacauguuuuagcauggcuguu

SEQ ID NO: 337919 - RNA, 22 nt, Homo sapiens
cacauugaauuucugaugacaa

SEQ ID NO: 337920 - RNA, 22 nt, Homo sapiens
caccacagccauuauugucccc

SEQ ID NO: 337921 - RNA, 22 nt, Homo sapiens
caccagcuggcauugaauaccu

SEQ ID NO: 337922 - RNA, 22 nt, Homo sapiens
caccauguguucagaaggauug

SEQ ID NO: 337923 - RNA, 22 nt, Homo sapiens
cacugcacuccagucuggcgac

SEQ ID NO: 337924 - RNA, 22 nt, Homo sapiens
cacugcacucuucuucugggca

SEQ ID NO: 337925 - RNA, 21 nt, Homo sapiens
cacugcacuugccuucugggu

SEQ ID NO: 337926 - RNA, 22 nt, Homo sapiens
cacugcauggucuagcuggguu

SEQ ID NO: 337927 - RNA, 22 nt, Homo sapiens
cacugcauuacucaugagcaug

SEQ ID NO: 337928 - RNA, 22 nt, Homo sapiens
cacugcauucuccaccucccag

SEQ ID NO: 337929 - RNA, 22 nt, Homo sapiens
cacugggugccauauguuugcu

SEQ ID NO: 337930 - RNA, 18 nt, Homo sapiens
cacuuggcuuugccccuc

SEQ ID NO: 337931 - RNA, 22 nt, Homo sapiens
cagagaacugaguuauuuucuu

SEQ ID NO: 337932 - RNA, 22 nt, Homo sapiens
cagagaaugucuuuuuuaacca

SEQ ID NO: 337933 - RNA, 22 nt, Homo sapiens
cagagguauugcaaaagccuag

SEQ ID NO: 337934 - RNA, 22 nt, Homo sapiens
cagaucaucuugagcuuaggaa

SEQ ID NO: 337935 - RNA, 22 nt, Homo sapiens
cagcagguuuuuaucaguuaag

SEQ ID NO: 337936 - RNA, 22 nt, Homo sapiens
cagcaucauucaucugggguaa

SEQ ID NO: 337937 - RNA, 22 nt, Homo sapiens
cagccgggugagguggcuuguu

SEQ ID NO: 337938 - RNA, 22 nt, Homo sapiens
cagccggguggcuccuagggua

SEQ ID NO: 337939 - RNA, 22 nt, Homo sapiens
cagcuaaauuguuaaauccaag

SEQ ID NO: 337940 - RNA, 20 nt, Homo sapiens
cagcuaccugggaaauuugg

SEQ ID NO: 337941 - RNA, 23 nt, Homo sapiens
cagcucauuuggguccccuuguc

SEQ ID NO: 337942 - RNA, 23 nt, Homo sapiens
cagcuggugauuuuaaguugaag

SEQ ID NO: 337943 - RNA, 22 nt, Homo sapiens
cagcuguuguuccagucuuuua

SEQ ID NO: 337944 - RNA, 22 nt, Homo sapiens
caggcagucuggggguguaucc

SEQ ID NO: 337945 - RNA, 22 nt, Homo sapiens
cagggcaugugggucuauuggc

SEQ ID NO: 337946 - RNA, 22 nt, Homo sapiens
cagggcauuggcugguaccugg

SEQ ID NO: 337947 - RNA, 22 nt, Homo sapiens
caguacaauguugauuagaagu

SEQ ID NO: 337948 - RNA, 22 nt, Homo sapiens
cagugauaggugguuguuggca

SEQ ID NO: 337949 - RNA, 22 nt, Homo sapiens
augagaugaauaccgacgaugu

SEQ ID NO: 337950 - RNA, 22 nt, Homo sapiens
augagcuaauauggguaaguug

SEQ ID NO: 337951 - RNA, 22 nt, Homo sapiens
augaggaagucaggcccagggg

SEQ ID NO: 337952 - RNA, 22 nt, Homo sapiens
augaggcacugcgcccuacuga

SEQ ID NO: 337953 - RNA, 22 nt, Homo sapiens
augagggcggacgcccuggaga

SEQ ID NO: 337954 - RNA, 22 nt, Homo sapiens
augaguuccuuccuugccuagg

SEQ ID NO: 337955 - RNA, 15 nt, Homo sapiens
augaguuuuauggag

SEQ ID NO: 337956 - RNA, 22 nt, Homo sapiens
augcaaacagcuaucuggcugg

SEQ ID NO: 337957 - RNA, 22 nt, Homo sapiens
augcaacugcacuccagccugg

SEQ ID NO: 337958 - RNA, 22 nt, Homo sapiens
augcaaggaugguuagauauau

SEQ ID NO: 337959 - RNA, 22 nt, Homo sapiens
augcacuguauaggaucuugcg

SEQ ID NO: 337960 - RNA, 22 nt, Homo sapiens
augcagagucccagccccuagc

SEQ ID NO: 337961 - RNA, 22 nt, Homo sapiens
augcagguguuuugcacugagu

SEQ ID NO: 337962 - RNA, 20 nt, Homo sapiens
augccacugagcagugguga

SEQ ID NO: 337963 - RNA, 22 nt, Homo sapiens
augccacugcacuucagccugg

SEQ ID NO: 337964 - RNA, 22 nt, Homo sapiens
augccacugcgcucuagccugg

SEQ ID NO: 337965 - RNA, 22 nt, Homo sapiens
augccacuguccuccugccuag

SEQ ID NO: 337966 - RNA, 22 nt, Homo sapiens
augccacuguuuaugucacuua

SEQ ID NO: 337967 - RNA, 22 nt, Homo sapiens
augccagggagaauuguucaag

SEQ ID NO: 337968 - RNA, 22 nt, Homo sapiens
augccucugacaauuggauucu

SEQ ID NO: 337969 - RNA, 22 nt, Homo sapiens
augcuuguguuggggcagugga

SEQ ID NO: 337970 - RNA, 22 nt, Homo sapiens
auggaagcauaguauucuauug

SEQ ID NO: 337971 - RNA, 22 nt, Homo sapiens
auggaagcugauuagauaguac

SEQ ID NO: 337972 - RNA, 22 nt, Homo sapiens
auggaaugccauuuauaaugga

SEQ ID NO: 337973 - RNA, 22 nt, Homo sapiens
auggaauguggaaugguaagua

SEQ ID NO: 337974 - RNA, 22 nt, Homo sapiens
auggagaugaauaucaucuguu

SEQ ID NO: 337975 - RNA, 22 nt, Homo sapiens
auggaguuugaacaauuuccug

SEQ ID NO: 337976 - RNA, 22 nt, Homo sapiens
auggauguucuagggaugugau

SEQ ID NO: 337977 - RNA, 22 nt, Homo sapiens
auggcaaaaaaugcaauuacuu

SEQ ID NO: 337978 - RNA, 22 nt, Homo sapiens
auggcaaaauguuccuaguggu

SEQ ID NO: 337979 - RNA, 22 nt, Homo sapiens
auggcacuguguauuuuucugu

SEQ ID NO: 337980 - RNA, 18 nt, Homo sapiens
auggcagaacaauuuaca

SEQ ID NO: 337981 - RNA, 22 nt, Homo sapiens
auggcagagucagaaagucagg

SEQ ID NO: 337982 - RNA, 22 nt, Homo sapiens
auggcagcugacacuuccgucu

SEQ ID NO: 337983 - RNA, 22 nt, Homo sapiens
auggcagcugguuuuacccuag

SEQ ID NO: 337984 - RNA, 22 nt, Homo sapiens
auggcaguuucagcuauaguuu

SEQ ID NO: 337985 - RNA, 22 nt, Homo sapiens
auggcauggugaagucuuugga

SEQ ID NO: 337986 - RNA, 22 nt, Homo sapiens
auggcccugggaaaggaggcau

SEQ ID NO: 337987 - RNA, 23 nt, Homo sapiens
auggcccuggugggagugucuuu

SEQ ID NO: 337988 - RNA, 22 nt, Homo sapiens
auggccuaugaccguuauguug

SEQ ID NO: 337989 - RNA, 22 nt, Homo sapiens
auggccuuuacaauuugguaug

SEQ ID NO: 337990 - RNA, 22 nt, Homo sapiens
auggcucuguuuuuuaugcucu

SEQ ID NO: 337991 - RNA, 22 nt, Homo sapiens
auggcugagugauuucaaacag

SEQ ID NO: 337992 - RNA, 22 nt, Homo sapiens
auggcugugaaaugguaggugg

SEQ ID NO: 337993 - RNA, 22 nt, Homo sapiens
auggcugugagaucgacuuauu

SEQ ID NO: 337994 - RNA, 22 nt, Homo sapiens
auggcuguuccugggaguucua

SEQ ID NO: 337995 - RNA, 22 nt, Homo sapiens
auggcuguuuuuuauguuacag

SEQ ID NO: 337996 - RNA, 22 nt, Homo sapiens
auggcuucuucuaaaagugggg

SEQ ID NO: 337997 - RNA, 22 nt, Homo sapiens
auggcuugugggaacuuuuaaa

SEQ ID NO: 337998 - RNA, 22 nt, Homo sapiens
auggcuuuggucucccagugau

SEQ ID NO: 337999 - RNA, 22 nt, Homo sapiens
auggcuuuguguucagagcuga

SEQ ID NO: 338000 - RNA, 22 nt, Homo sapiens
auggcuuuuccugucuugcaug

SEQ ID NO: 338001 - RNA, 22 nt, Homo sapiens
auggcuuuugcccuaaauggau

SEQ ID NO: 338002 - RNA, 22 nt, Homo sapiens
auggcuuuuuucuugggcacuc

SEQ ID NO: 338003 - RNA, 22 nt, Homo sapiens
augggagugugguuagagaccu

SEQ ID NO: 338004 - RNA, 22 nt, Homo sapiens
augggauaguaucaguggaaua

SEQ ID NO: 338005 - RNA, 22 nt, Homo sapiens
auggucccuguuccaugcuccu

SEQ ID NO: 338006 - RNA, 22 nt, Homo sapiens
augguugguuaaaucuguguau

SEQ ID NO: 338007 - RNA, 22 nt, Homo sapiens
augguuugugcuccuauaagaa

SEQ ID NO: 338008 - RNA, 22 nt, Homo sapiens
auguaaacauuuggucuaaauu

SEQ ID NO: 338009 - RNA, 22 nt, Homo sapiens
auguaacugggacacaagccuc

SEQ ID NO: 338010 - RNA, 22 nt, Homo sapiens
auguaauugagguuuuugccau

SEQ ID NO: 338011 - RNA, 22 nt, Homo sapiens
augucaaggugaagaaagauca

SEQ ID NO: 338012 - RNA, 22 nt, Homo sapiens
augucaaggugggugauaguuu

SEQ ID NO: 338013 - RNA, 22 nt, Homo sapiens
augucuagagugauacugaagc

SEQ ID NO: 338014 - RNA, 22 nt, Homo sapiens
augucugguagccaccuggagg

SEQ ID NO: 338015 - RNA, 22 nt, Homo sapiens
augugaacugaauuaauucaca

SEQ ID NO: 338016 - RNA, 22 nt, Homo sapiens
augugacagugguuuuaagcgu

SEQ ID NO: 338017 - RNA, 22 nt, Homo sapiens
augugacuggaucauggggacg

SEQ ID NO: 338018 - RNA, 22 nt, Homo sapiens
augugccaauuaggauuccaag

SEQ ID NO: 338019 - RNA, 22 nt, Homo sapiens
augugccauucucauggcgcuu

SEQ ID NO: 338020 - RNA, 22 nt, Homo sapiens
augugcuaguaucaaacgagac

SEQ ID NO: 338021 - RNA, 22 nt, Homo sapiens
augugcuuuuuaaacagaugcu

SEQ ID NO: 338022 - RNA, 22 nt, Homo sapiens
auguggcacuugacuuucucgc

SEQ ID NO: 338023 - RNA, 18 nt, Homo sapiens
auguggcuuuugaaggcu

SEQ ID NO: 338024 - RNA, 22 nt, Homo sapiens
augugggaggacuuggcuguug

SEQ ID NO: 338025 - RNA, 22 nt, Homo sapiens
auguguauuaccucgauuguga

SEQ ID NO: 338026 - RNA, 22 nt, Homo sapiens
auuaagugaaugaaguuguucc

SEQ ID NO: 338027 - RNA, 22 nt, Homo sapiens
auuaaucaggcaaugcuugcua

SEQ ID NO: 338028 - RNA, 20 nt, Homo sapiens
auuagagcuacauggcuaca

SEQ ID NO: 338029 - RNA, 22 nt, Homo sapiens
auuagguuaggcaaacuucugu

SEQ ID NO: 338030 - RNA, 22 nt, Homo sapiens
auuauaguguauacuugaaauu

SEQ ID NO: 338031 - RNA, 22 nt, Homo sapiens
auuauaugucaucacagacacc

SEQ ID NO: 338032 - RNA, 22 nt, Homo sapiens
auuauugacucauagaaaggau

SEQ ID NO: 338033 - RNA, 22 nt, Homo sapiens
auucaaggacuggauugcggga

SEQ ID NO: 338034 - RNA, 22 nt, Homo sapiens
auucaagugaugugauucuucu

SEQ ID NO: 338035 - RNA, 22 nt, Homo sapiens
auucacuguggcuuucucugau

SEQ ID NO: 338036 - RNA, 21 nt, Homo sapiens
agacacuuggaagguuuuaga

SEQ ID NO: 338037 - RNA, 22 nt, Homo sapiens
agacaguauuggcaaagugugu

SEQ ID NO: 338038 - RNA, 22 nt, Homo sapiens
agacccuguauguguuuaguuu

SEQ ID NO: 338039 - RNA, 21 nt, Homo sapiens
agagaacugaaacaugugacu

SEQ ID NO: 338040 - RNA, 22 nt, Homo sapiens
agagaacugauucagggaaaau

SEQ ID NO: 338041 - RNA, 19 nt, Homo sapiens
agagacucauuguagcauu

SEQ ID NO: 338042 - RNA, 22 nt, Homo sapiens
agagagcuuuugguugcccuaa

SEQ ID NO: 338043 - RNA, 20 nt, Homo sapiens
agagaucaguaauucaucaa

SEQ ID NO: 338044 - RNA, 22 nt, Homo sapiens
agagaucauuuuguuucaaauc

SEQ ID NO: 338045 - RNA, 22 nt, Homo sapiens
agagcaaugggugaauauuaaa

SEQ ID NO: 338046 - RNA, 22 nt, Homo sapiens
agagcuaguauuuacggagcau

SEQ ID NO: 338047 - RNA, 22 nt, Homo sapiens
agagcuguguuuuaacuuuuua

SEQ ID NO: 338048 - RNA, 22 nt, Homo sapiens
agaguaguuuauuaugcuaagg

SEQ ID NO: 338049 - RNA, 22 nt, Homo sapiens
agagugaagcuuuuuauauucu

SEQ ID NO: 338050 - RNA, 22 nt, Homo sapiens
agagugcaaagguuggggcugg

SEQ ID NO: 338051 - RNA, 23 nt, Homo sapiens
agagugcaauggugccaucucgg

SEQ ID NO: 338052 - RNA, 22 nt, Homo sapiens
agauacaucuaugugucugugu

SEQ ID NO: 338053 - RNA, 22 nt, Homo sapiens
agauacauuggauaaugguggg

SEQ ID NO: 338054 - RNA, 22 nt, Homo sapiens
agauaugucugcuauuugcugu

SEQ ID NO: 338055 - RNA, 22 nt, Homo sapiens
agaugauguuucuggcacauga

SEQ ID NO: 338056 - RNA, 22 nt, Homo sapiens
agcaaaucuaugaauguauauu

SEQ ID NO: 338057 - RNA, 22 nt, Homo sapiens
agcacagugaaugguuuacuca

SEQ ID NO: 338058 - RNA, 22 nt, Homo sapiens
agcacauuaguaucuaagaaca

SEQ ID NO: 338059 - RNA, 22 nt, Homo sapiens
agcaccaauaacaguuucuagc

SEQ ID NO: 338060 - RNA, 22 nt, Homo sapiens
agcagcacaucccuuucuggcc

SEQ ID NO: 338061 - RNA, 22 nt, Homo sapiens
agcaggauuguuacaauaguaa

SEQ ID NO: 338062 - RNA, 22 nt, Homo sapiens
agcagguauuuaagaaacucag

SEQ ID NO: 338063 - RNA, 22 nt, Homo sapiens
agcaggucuuaacuugugaggu

SEQ ID NO: 338064 - RNA, 20 nt, Homo sapiens
agcaucacagagccgggugu

SEQ ID NO: 338065 - RNA, 22 nt, Homo sapiens
agcaucacaugggcugcuuggg

SEQ ID NO: 338066 - RNA, 22 nt, Homo sapiens
agcaugacauauuguagagaaa

SEQ ID NO: 338067 - RNA, 22 nt, Homo sapiens
agcauuacaugguacagagaag

SEQ ID NO: 338068 - RNA, 22 nt, Homo sapiens
agccaagacucuguuccccuug

SEQ ID NO: 338069 - RNA, 21 nt, Homo sapiens
agccaguguuccuuguggcuc

SEQ ID NO: 338070 - RNA, 22 nt, Homo sapiens
agcccagagacuguguaaauuu

SEQ ID NO: 338071 - RNA, 21 nt, Homo sapiens
agccugugggucauaguugcc

SEQ ID NO: 338072 - RNA, 22 nt, Homo sapiens
agcgccauugcacuccagccuu

SEQ ID NO: 338073 - RNA, 22 nt, Homo sapiens
agcuaguguucaccagagguca

SEQ ID NO: 338074 - RNA, 21 nt, Homo sapiens
agcuccacucguucccaaagc

SEQ ID NO: 338075 - RNA, 22 nt, Homo sapiens
agcuccaugauaguaugucugu

SEQ ID NO: 338076 - RNA, 22 nt, Homo sapiens
agcuccuuugcuuuuuccagga

SEQ ID NO: 338077 - RNA, 22 nt, Homo sapiens
agcugaguguuccaagagcgag

SEQ ID NO: 338078 - RNA, 20 nt, Homo sapiens
agcugcagauauaaauccgc

SEQ ID NO: 338079 - RNA, 22 nt, Homo sapiens
agcugccagucuuguaaggccu

SEQ ID NO: 338080 - RNA, 21 nt, Homo sapiens
agcugguuuccacagugugcu

SEQ ID NO: 338081 - RNA, 22 nt, Homo sapiens
agcugugucuucuuaaagauuu

SEQ ID NO: 338082 - RNA, 22 nt, Homo sapiens
agcuuguccuccacccacacug

SEQ ID NO: 338083 - RNA, 22 nt, Homo sapiens
agcuugugauucuccaucaugu

SEQ ID NO: 338084 - RNA, 22 nt, Homo sapiens
agcuuguuuucccauaacuaga

SEQ ID NO: 338085 - RNA, 22 nt, Homo sapiens
agcuuuuugggcagcuauugac

SEQ ID NO: 338086 - RNA, 22 nt, Homo sapiens
aggaacuguaacuaugucucug

SEQ ID NO: 338087 - RNA, 22 nt, Homo sapiens
aggaaugucaaugguaguuuaa

SEQ ID NO: 338088 - RNA, 22 nt, Homo sapiens
aggagcacuggccuuggaguca

SEQ ID NO: 338089 - RNA, 20 nt, Homo sapiens
aggagcauuuacauuggcuc

SEQ ID NO: 338090 - RNA, 23 nt, Homo sapiens
aggagcuuagaaguugccauugc

SEQ ID NO: 338091 - RNA, 22 nt, Homo sapiens
aggauacugguaugggcugaau

SEQ ID NO: 338092 - RNA, 22 nt, Homo sapiens
aggcaacaugguaaaacccugu

SEQ ID NO: 338093 - RNA, 22 nt, Homo sapiens
aggcaagagugacuacgugaaa

SEQ ID NO: 338094 - RNA, 22 nt, Homo sapiens
aggcaugaguucagaggguaug

SEQ ID NO: 338095 - RNA, 22 nt, Homo sapiens
aggcauggagacuaaaauuaua

SEQ ID NO: 338096 - RNA, 22 nt, Homo sapiens
aggcaugguggcacauacaugu

SEQ ID NO: 338097 - RNA, 22 nt, Homo sapiens
agggccuuuguagauguacuca

SEQ ID NO: 338098 - RNA, 22 nt, Homo sapiens
agggcuuaucuguguagaguuc

SEQ ID NO: 338099 - RNA, 20 nt, Homo sapiens
agguagauagaugauagaua

SEQ ID NO: 338100 - RNA, 22 nt, Homo sapiens
aggugcaugcuucacuggauau

SEQ ID NO: 338101 - RNA, 20 nt, Homo sapiens
agguuauuauaauuagaaga

SEQ ID NO: 338102 - RNA, 22 nt, Homo sapiens
agguuguugcaugcuccuuagg

SEQ ID NO: 338103 - RNA, 22 nt, Homo sapiens
agguuuucagccccagccuagg

SEQ ID NO: 338104 - RNA, 22 nt, Homo sapiens
aguaacaggauccaaagaaugu

SEQ ID NO: 338105 - RNA, 22 nt, Homo sapiens
aguaucaucuuguuggccaggc

SEQ ID NO: 338106 - RNA, 20 nt, Homo sapiens
aguauucacuuuuuucaugg

SEQ ID NO: 338107 - RNA, 22 nt, Homo sapiens
agucacaugcauuuucuucaau

SEQ ID NO: 338108 - RNA, 22 nt, Homo sapiens
agucacaugccagcacacccag

SEQ ID NO: 338109 - RNA, 22 nt, Homo sapiens
agucagauuggcauuuguuggg

SEQ ID NO: 338110 - RNA, 22 nt, Homo sapiens
agucagugcauaagaaugaagu

SEQ ID NO: 338111 - RNA, 22 nt, Homo sapiens
agucauagaguuugcccuucuc

SEQ ID NO: 338112 - RNA, 21 nt, Homo sapiens
agucauaggaguacauaaugc

SEQ ID NO: 338113 - RNA, 22 nt, Homo sapiens
agucauggaucacaguagccuc

SEQ ID NO: 338114 - RNA, 23 nt, Homo sapiens
agucuguguuuacaggcucucug

SEQ ID NO: 338115 - RNA, 22 nt, Homo sapiens
agugcaauggugccaucauagc

SEQ ID NO: 338116 - RNA, 19 nt, Homo sapiens
agugcaauugccuuugugc

SEQ ID NO: 338117 - RNA, 22 nt, Homo sapiens
agugcacuccagccugggcaac

SEQ ID NO: 338118 - RNA, 22 nt, Homo sapiens
agugcaguggugccaucauaac

SEQ ID NO: 338119 - RNA, 22 nt, Homo sapiens
agugcagugguuaggagccagg

SEQ ID NO: 338120 - RNA, 22 nt, Homo sapiens
aguggaauuaagaaacugaauu

SEQ ID NO: 338121 - RNA, 22 nt, Homo sapiens
aguggguguuccauuggauaaa

SEQ ID NO: 338122 - RNA, 22 nt, Homo sapiens
agugguuuuaaguagagcauac

SEQ ID NO: 338123 - RNA, 22 nt, Homo sapiens
aguguuuuuaacaagaaagggu

SEQ ID NO: 338124 - RNA, 22 nt, Homo sapiens
aguguuuuuaucaugaaagggu

SEQ ID NO: 338125 - RNA, 22 nt, Homo sapiens
aguuaguguugugauaaaucca

SEQ ID NO: 338126 - RNA, 22 nt, Homo sapiens
auaaagacacuuggcaugauuu

SEQ ID NO: 338127 - RNA, 22 nt, Homo sapiens
auaaaugcaaugguauuuuuga

SEQ ID NO: 338128 - RNA, 22 nt, Homo sapiens
auaaaugccuguuguuuuaagc

SEQ ID NO: 338129 - RNA, 22 nt, Homo sapiens
auaauaccugccucagagaguu

SEQ ID NO: 338130 - RNA, 22 nt, Homo sapiens
auacacauuccugggccucacc

SEQ ID NO: 338131 - RNA, 22 nt, Homo sapiens
auacacguguauauguguaucu

SEQ ID NO: 338132 - RNA, 22 nt, Homo sapiens
auacagugaauacuuacagugu

SEQ ID NO: 338133 - RNA, 22 nt, Homo sapiens
auacccugucgugagucagaga

SEQ ID NO: 338134 - RNA, 22 nt, Homo sapiens
auacuguuuuacaucauugccu

SEQ ID NO: 338135 - RNA, 22 nt, Homo sapiens
auagcaaugccccauucccagu

SEQ ID NO: 338136 - RNA, 20 nt, Homo sapiens
auagcaccagacagcccuag

SEQ ID NO: 338137 - RNA, 21 nt, Homo sapiens
auagcacuucacuugguuaga

SEQ ID NO: 338138 - RNA, 22 nt, Homo sapiens
auagcagcagcuaguagugaua

SEQ ID NO: 338139 - RNA, 22 nt, Homo sapiens
auagcaucauuucuugaaaaga

SEQ ID NO: 338140 - RNA, 22 nt, Homo sapiens
auagcccauuuguugguccugg

SEQ ID NO: 338141 - RNA, 22 nt, Homo sapiens
auagugcugcaagaaacauacg

SEQ ID NO: 338142 - RNA, 22 nt, Homo sapiens
auagugcugcaauaaacauaug

SEQ ID NO: 338143 - RNA, 22 nt, Homo sapiens
auagugcugcacuaaacauaca

SEQ ID NO: 338144 - RNA, 22 nt, Homo sapiens
auagugcugcagucaauguacg

SEQ ID NO: 338145 - RNA, 22 nt, Homo sapiens
auagugcugcauuaaacauacg

SEQ ID NO: 338146 - RNA, 19 nt, Homo sapiens
auauaacauccaggagcag

SEQ ID NO: 338147 - RNA, 22 nt, Homo sapiens
auauaugcuaagugcuaauaaa

SEQ ID NO: 338148 - RNA, 22 nt, Homo sapiens
auaucagugucuuacuguuuuu

SEQ ID NO: 338149 - RNA, 22 nt, Homo sapiens
auauccuggagcauuuuugcaa

SEQ ID NO: 338150 - RNA, 22 nt, Homo sapiens
auauggcuaugugagcauacca

SEQ ID NO: 338151 - RNA, 22 nt, Homo sapiens
auauggcuuuuauuauguugag

SEQ ID NO: 338152 - RNA, 22 nt, Homo sapiens
auauggucccuguucucaagga

SEQ ID NO: 338153 - RNA, 22 nt, Homo sapiens
auauguaguuucagaaguggaa

SEQ ID NO: 338154 - RNA, 17 nt, Homo sapiens
auaugucugcuggggga

SEQ ID NO: 338155 - RNA, 21 nt, Homo sapiens
auaugugcuguggaagucagc

SEQ ID NO: 338156 - RNA, 22 nt, Homo sapiens
auauuacuggccauaucgcagg

SEQ ID NO: 338157 - RNA, 22 nt, Homo sapiens
auauucacagguaucagagauu

SEQ ID NO: 338158 - RNA, 18 nt, Homo sapiens
auauugcauuggauggau

SEQ ID NO: 338159 - RNA, 22 nt, Homo sapiens
auauuugguuaccugugggucu

SEQ ID NO: 338160 - RNA, 22 nt, Homo sapiens
aucaaacugcaaggcagcagca

SEQ ID NO: 338161 - RNA, 20 nt, Homo sapiens
aucaaagacuuagaggggga

SEQ ID NO: 338162 - RNA, 22 nt, Homo sapiens
aucaaaguuucccagaaguugu

SEQ ID NO: 338163 - RNA, 22 nt, Homo sapiens
aucaaguaguuauacguaaagg

SEQ ID NO: 338164 - RNA, 22 nt, Homo sapiens
aucacaggcaaaauuccuucuc

SEQ ID NO: 338165 - RNA, 22 nt, Homo sapiens
aucacagguacuauggcugaca

SEQ ID NO: 338166 - RNA, 22 nt, Homo sapiens
aucacagugaaaacagucaauu

SEQ ID NO: 338167 - RNA, 22 nt, Homo sapiens
aucacaguuuuaccauuuggua

SEQ ID NO: 338168 - RNA, 22 nt, Homo sapiens
aucacauggccuagccuaaccu

SEQ ID NO: 338169 - RNA, 22 nt, Homo sapiens
aucacauuuauaguggcacgca

SEQ ID NO: 338170 - RNA, 22 nt, Homo sapiens
aucaccuggaggugaucacuug

SEQ ID NO: 338171 - RNA, 22 nt, Homo sapiens
aucacugggagcagccauuaau

SEQ ID NO: 338172 - RNA, 22 nt, Homo sapiens
aucacugugauuucuacugugc

SEQ ID NO: 338173 - RNA, 22 nt, Homo sapiens
aucacuguuuugaugcucggac

SEQ ID NO: 338174 - RNA, 20 nt, Homo sapiens
aucagagccggugaaagggc

SEQ ID NO: 338175 - RNA, 22 nt, Homo sapiens
aucagagugaaacaugggagau

SEQ ID NO: 338176 - RNA, 22 nt, Homo sapiens
aucagaguggguuuuaaaagug

SEQ ID NO: 338177 - RNA, 22 nt, Homo sapiens
aucagauuccacauuuuaucag

SEQ ID NO: 338178 - RNA, 22 nt, Homo sapiens
aucagcaguguaaaaacggacu

SEQ ID NO: 338179 - RNA, 22 nt, Homo sapiens
aucauacuguuuugauuacugu

SEQ ID NO: 338180 - RNA, 22 nt, Homo sapiens
aucaucacaguuguguguaaug

SEQ ID NO: 338181 - RNA, 22 nt, Homo sapiens
aucauguuuauguguaggauau

SEQ ID NO: 338182 - RNA, 22 nt, Homo sapiens
aucccagaaacucggguuucuc

SEQ ID NO: 338183 - RNA, 22 nt, Homo sapiens
aucccugugacgagcaucccua

SEQ ID NO: 338184 - RNA, 22 nt, Homo sapiens
aucccuugacguggagucucug

SEQ ID NO: 338185 - RNA, 22 nt, Homo sapiens
auccucugagagaguuucauaa

SEQ ID NO: 338186 - RNA, 22 nt, Homo sapiens
auccuugagaaaauaaaugacc

SEQ ID NO: 338187 - RNA, 22 nt, Homo sapiens
aucgcacuccauccugggcaac

SEQ ID NO: 338188 - RNA, 22 nt, Homo sapiens
aucgcgccauuguacuccagcc

SEQ ID NO: 338189 - RNA, 22 nt, Homo sapiens
aucucaaugcuuuuguaggcca

SEQ ID NO: 338190 - RNA, 22 nt, Homo sapiens
aucugacuuuuaauuugaaaac

SEQ ID NO: 338191 - RNA, 22 nt, Homo sapiens
aucugcaaauaaugaagauugg

SEQ ID NO: 338192 - RNA, 22 nt, Homo sapiens
aucuggguccguucugcuucuc

SEQ ID NO: 338193 - RNA, 22 nt, Homo sapiens
aucugguguuuccuucacauug

SEQ ID NO: 338194 - RNA, 22 nt, Homo sapiens
aucuugggugggaacugagaau

SEQ ID NO: 338195 - RNA, 21 nt, Homo sapiens
aucuugguauagucuuauugg

SEQ ID NO: 338196 - RNA, 22 nt, Homo sapiens
aucuuugauuagacugauggau

SEQ ID NO: 338197 - RNA, 22 nt, Homo sapiens
aucuuuggauacuugauauagu

SEQ ID NO: 338198 - RNA, 22 nt, Homo sapiens
augaaacuggcuaauuuuugua

SEQ ID NO: 338199 - RNA, 22 nt, Homo sapiens
augaaagguugucuuaagccau

SEQ ID NO: 338200 - RNA, 22 nt, Homo sapiens
augaauacagcuaugcgugcau

SEQ ID NO: 338201 - RNA, 22 nt, Homo sapiens
augaauacugcugcaaugaaca

SEQ ID NO: 338202 - RNA, 22 nt, Homo sapiens
augaauucaucugguuuuggga

SEQ ID NO: 338203 - RNA, 22 nt, Homo sapiens
augaccagagagugcgcagggu

SEQ ID NO: 338204 - RNA, 22 nt, Homo sapiens
augaccagagguaugauguuug

SEQ ID NO: 338205 - RNA, 22 nt, Homo sapiens
augacuaaaggguuuauguuga

SEQ ID NO: 338206 - RNA, 22 nt, Homo sapiens
augacuuuucugaaaaccacca

SEQ ID NO: 338207 - RNA, 22 nt, Homo sapiens
augagaauguaaguuaaugaaa

SEQ ID NO: 338208 - RNA, 22 nt, Homo sapiens
augagagcugacuuuaaggcaa

SEQ ID NO: 338209 - RNA, 22 nt, Homo sapiens
augagauacuacaaaugaguuu

SEQ ID NO: 338210 - RNA, 22 nt, Homo sapiens
aaaagagcugagagguauucuu

SEQ ID NO: 338211 - RNA, 22 nt, Homo sapiens
aaaagcuuagaugggcuuguau

SEQ ID NO: 338212 - RNA, 22 nt, Homo sapiens
aaaaguucuuugagccuugaca

SEQ ID NO: 338213 - RNA, 22 nt, Homo sapiens
aaacaccacgcggucccucgga

SEQ ID NO: 338214 - RNA, 15 nt, Homo sapiens
aaacccugucucaag

SEQ ID NO: 338215 - RNA, 22 nt, Homo sapiens
aaagaagucagccuguccuuug

SEQ ID NO: 338216 - RNA, 22 nt, Homo sapiens
aaagagcugagaccugguggag

SEQ ID NO: 338217 - RNA, 22 nt, Homo sapiens
aaagcugucaaggcaggaggcu

SEQ ID NO: 338218 - RNA, 22 nt, Homo sapiens
aaaggcaucauuaguaccaagu

SEQ ID NO: 338219 - RNA, 22 nt, Homo sapiens
aaaggcuucggaucagaaggua

SEQ ID NO: 338220 - RNA, 22 nt, Homo sapiens
aaagucacuggagaaggaauau

SEQ ID NO: 338221 - RNA, 22 nt, Homo sapiens
aaagugauguccaggcuuucag

SEQ ID NO: 338222 - RNA, 22 nt, Homo sapiens
aaagugcacuuggaagagggcc

SEQ ID NO: 338223 - RNA, 22 nt, Homo sapiens
aaagugccugacucauaguuag

SEQ ID NO: 338224 - RNA, 22 nt, Homo sapiens
aaagugcugggaucacacugaa

SEQ ID NO: 338225 - RNA, 22 nt, Homo sapiens
aaagugucuguuccuagcauga

SEQ ID NO: 338226 - RNA, 19 nt, Homo sapiens
aaaguucuucccuuuggag

SEQ ID NO: 338227 - RNA, 22 nt, Homo sapiens
aaaguucuugcugaaggauuau

SEQ ID NO: 338228 - RNA, 22 nt, Homo sapiens
aaaugacuuuuuaugcagagua

SEQ ID NO: 338229 - RNA, 21 nt, Homo sapiens
aaaugcacauuacugcuggug

SEQ ID NO: 338230 - RNA, 22 nt, Homo sapiens
aaaugcagucuuuguucugggc

SEQ ID NO: 338231 - RNA, 22 nt, Homo sapiens
aaaugcauugagggaaaaggca

SEQ ID NO: 338232 - RNA, 22 nt, Homo sapiens
aaaugccucccauucuacugac

SEQ ID NO: 338233 - RNA, 22 nt, Homo sapiens
aaaugcuuucuuggaccauuug

SEQ ID NO: 338234 - RNA, 22 nt, Homo sapiens
aaauggcacaguaagggcauuu

SEQ ID NO: 338235 - RNA, 22 nt, Homo sapiens
aaaugguguuaguagaucuuua

SEQ ID NO: 338236 - RNA, 22 nt, Homo sapiens
aaaugucauggaguguuucccc

SEQ ID NO: 338237 - RNA, 22 nt, Homo sapiens
aaauugcacaaguggugauuug

SEQ ID NO: 338238 - RNA, 22 nt, Homo sapiens
aaauugcaguuaggaugauggu

SEQ ID NO: 338239 - RNA, 23 nt, Homo sapiens
aaauuugccuauuauuccuaugg

SEQ ID NO: 338240 - RNA, 22 nt, Homo sapiens
aacacggcccgcagagcaagcu

SEQ ID NO: 338241 - RNA, 22 nt, Homo sapiens
aacagacugucacauaaaauug

SEQ ID NO: 338242 - RNA, 22 nt, Homo sapiens
aacagauugcugagccccaccc

SEQ ID NO: 338243 - RNA, 20 nt, Homo sapiens
aacaguguguaaguuuccuu

SEQ ID NO: 338244 - RNA, 22 nt, Homo sapiens
aaccacauggcucaguggacau

SEQ ID NO: 338245 - RNA, 22 nt, Homo sapiens
aacucacauucuuucuugguac

SEQ ID NO: 338246 - RNA, 22 nt, Homo sapiens
aacuccauuuuagacccuagau

SEQ ID NO: 338247 - RNA, 22 nt, Homo sapiens
aagagcauuggauggggagauu

SEQ ID NO: 338248 - RNA, 22 nt, Homo sapiens
aagagugucuuugugcuggccc

SEQ ID NO: 338249 - RNA, 22 nt, Homo sapiens
aagaguuaguaaaauuuccucu

SEQ ID NO: 338250 - RNA, 22 nt, Homo sapiens
aagaucauucagggaaggcuga

SEQ ID NO: 338251 - RNA, 22 nt, Homo sapiens
aagaugcagucauacuggagga

SEQ ID NO: 338252 - RNA, 21 nt, Homo sapiens
aagcaugguguaucuuuccau

SEQ ID NO: 338253 - RNA, 22 nt, Homo sapiens
aagcaugguuuccaggggucac

SEQ ID NO: 338254 - RNA, 22 nt, Homo sapiens
aagcuacauuuuauuuauguca

SEQ ID NO: 338255 - RNA, 22 nt, Homo sapiens
aagcugccuugugaaggcauuc

SEQ ID NO: 338256 - RNA, 22 nt, Homo sapiens
aagcuggauuuaguguggagca

SEQ ID NO: 338257 - RNA, 22 nt, Homo sapiens
aagcuguguguaagcucucaca

SEQ ID NO: 338258 - RNA, 22 nt, Homo sapiens
aaggaguagaggaauagcaaug

SEQ ID NO: 338259 - RNA, 22 nt, Homo sapiens
aaggcaagagaaaauuucgagu

SEQ ID NO: 338260 - RNA, 22 nt, Homo sapiens
aaggcaguggcagaagauguca

SEQ ID NO: 338261 - RNA, 22 nt, Homo sapiens
aaggcauucucaaacuaguucu

SEQ ID NO: 338262 - RNA, 22 nt, Homo sapiens
aaggcuagagaagaagggcauc

SEQ ID NO: 338263 - RNA, 20 nt, Homo sapiens
aaggcuuucgaguuccaggg

SEQ ID NO: 338264 - RNA, 22 nt, Homo sapiens
aagguagguuccaaaauaccua

SEQ ID NO: 338265 - RNA, 17 nt, Homo sapiens
aaggugcuucgaccucc

SEQ ID NO: 338266 - RNA, 22 nt, Homo sapiens
aagguggaguugacaauuuuca

SEQ ID NO: 338267 - RNA, 22 nt, Homo sapiens
aagguuguauuuaauauacugu

SEQ ID NO: 338268 - RNA, 22 nt, Homo sapiens
aaguaauugagguuuuugcugu

SEQ ID NO: 338269 - RNA, 22 nt, Homo sapiens
aaguagcuggaugcaguggcac

SEQ ID NO: 338270 - RNA, 22 nt, Homo sapiens
aaguaguuaggaacauucucuc

SEQ ID NO: 338271 - RNA, 22 nt, Homo sapiens
aaguauagcuaugauaaacauu

SEQ ID NO: 338272 - RNA, 22 nt, Homo sapiens
aaguauuagcuaauugugcuua

SEQ ID NO: 338273 - RNA, 23 nt, Homo sapiens
aagucauggaaucaaaugaggug

SEQ ID NO: 338274 - RNA, 22 nt, Homo sapiens
aaguccaugaagucuugugggu

SEQ ID NO: 338275 - RNA, 22 nt, Homo sapiens
aagugacuagacuaugaaaccu

SEQ ID NO: 338276 - RNA, 22 nt, Homo sapiens
aagugcaaauucccaggcucug

SEQ ID NO: 338277 - RNA, 22 nt, Homo sapiens
aagugcccuauuuggcccuuga

SEQ ID NO: 338278 - RNA, 22 nt, Homo sapiens
aagugcuguccuaccuuuggga

SEQ ID NO: 338279 - RNA, 22 nt, Homo sapiens
aagugcuucuuuccucgagaag

SEQ ID NO: 338280 - RNA, 22 nt, Homo sapiens
aagugcuuuacacaugcaugau

SEQ ID NO: 338281 - RNA, 23 nt, Homo sapiens
aagugguuuugaacccggacccu

SEQ ID NO: 338282 - RNA, 22 nt, Homo sapiens
aaguguaaguuaauguuuaggu

SEQ ID NO: 338283 - RNA, 22 nt, Homo sapiens
aagugucuuaccgggagggagu

SEQ ID NO: 338284 - RNA, 22 nt, Homo sapiens
aaguugcuuuagguaagucaau

SEQ ID NO: 338285 - RNA, 22 nt, Homo sapiens
aauaaagcaggguccuugcacu

SEQ ID NO: 338286 - RNA, 22 nt, Homo sapiens
aauaaaguaggaggugaggaaa

SEQ ID NO: 338287 - RNA, 22 nt, Homo sapiens
aauacucaguccuggugaggcu

SEQ ID NO: 338288 - RNA, 22 nt, Homo sapiens
aauacugaaaguauuuucaaau

SEQ ID NO: 338289 - RNA, 22 nt, Homo sapiens
aauauagcuauguacaugucca

SEQ ID NO: 338290 - RNA, 22 nt, Homo sapiens
aauauugucaaaauggauucca

SEQ ID NO: 338291 - RNA, 22 nt, Homo sapiens
aaucacacuugauguugagcaa

SEQ ID NO: 338292 - RNA, 22 nt, Homo sapiens
aaucacagccagcuuccgcuau

SEQ ID NO: 338293 - RNA, 22 nt, Homo sapiens
aaucaccaugcacuacagccuu

SEQ ID NO: 338294 - RNA, 22 nt, Homo sapiens
aaucagagcccucugagcuuca

SEQ ID NO: 338295 - RNA, 22 nt, Homo sapiens
aaucccugagcuagacacaaag

SEQ ID NO: 338296 - RNA, 22 nt, Homo sapiens
aauccuguagauucuaauuccu

SEQ ID NO: 338297 - RNA, 22 nt, Homo sapiens
aaugacagccagauucuucucu

SEQ ID NO: 338298 - RNA, 22 nt, Homo sapiens
aaugacugugauauuuuucuuc

SEQ ID NO: 338299 - RNA, 22 nt, Homo sapiens
aaugcaagauguuaauuauagg

SEQ ID NO: 338300 - RNA, 22 nt, Homo sapiens
aaugcacauauauuuccuuauu

SEQ ID NO: 338301 - RNA, 22 nt, Homo sapiens
aaugcacuccagccugggcgac

SEQ ID NO: 338302 - RNA, 22 nt, Homo sapiens
aaugcuaucuggaacauuguug

SEQ ID NO: 338303 - RNA, 22 nt, Homo sapiens
aauggcaaauguuuucuguuga

SEQ ID NO: 338304 - RNA, 22 nt, Homo sapiens
aauggcaguagauggaugggua

SEQ ID NO: 338305 - RNA, 22 nt, Homo sapiens
aaugucaucuucaguuguacag

SEQ ID NO: 338306 - RNA, 22 nt, Homo sapiens
aauuacauggcaauugggaaau

SEQ ID NO: 338307 - RNA, 22 nt, Homo sapiens
aauuaguaaccuaauuccaucu

SEQ ID NO: 338308 - RNA, 22 nt, Homo sapiens
aauugaaucaugugggcagacu

SEQ ID NO: 338309 - RNA, 22 nt, Homo sapiens
aauugaaugauaugggacauuu

SEQ ID NO: 338310 - RNA, 22 nt, Homo sapiens
aauugcuuuuauuuagggccag

SEQ ID NO: 338311 - RNA, 22 nt, Homo sapiens
aauugugcuuguaggccaggca

SEQ ID NO: 338312 - RNA, 22 nt, Homo sapiens
acaaagugccuccuuuuagagu

SEQ ID NO: 338313 - RNA, 20 nt, Homo sapiens
acaaaugcauucugugacau

SEQ ID NO: 338314 - RNA, 17 nt, Homo sapiens
acaaauugccagcuagg

SEQ ID NO: 338315 - RNA, 22 nt, Homo sapiens
acaauguauauuuuacuguagg

SEQ ID NO: 338316 - RNA, 22 nt, Homo sapiens
acacaaugguaaguguuugugu

SEQ ID NO: 338317 - RNA, 22 nt, Homo sapiens
acacacgugcauguaugcguau

SEQ ID NO: 338318 - RNA, 22 nt, Homo sapiens
acacagugucuguguauuuaaa

SEQ ID NO: 338319 - RNA, 22 nt, Homo sapiens
acacaugugcguagacucuuua

SEQ ID NO: 338320 - RNA, 22 nt, Homo sapiens
acacauuagcaagugcuguuau

SEQ ID NO: 338321 - RNA, 22 nt, Homo sapiens
acacuggguaacauaucuguua

SEQ ID NO: 338322 - RNA, 22 nt, Homo sapiens
acacugucugaugaaaguaguu

SEQ ID NO: 338323 - RNA, 22 nt, Homo sapiens
acacuuucuagacaagggaaua

SEQ ID NO: 338324 - RNA, 22 nt, Homo sapiens
acaguaaugggccccuuuuccu

SEQ ID NO: 338325 - RNA, 22 nt, Homo sapiens
acaguacucugcucuuuugauu

SEQ ID NO: 338326 - RNA, 22 nt, Homo sapiens
acaguacuguuguuugcugcca

SEQ ID NO: 338327 - RNA, 22 nt, Homo sapiens
acagucauagcagccuuuguua

SEQ ID NO: 338328 - RNA, 22 nt, Homo sapiens
acagucuggagaaugggugcuc

SEQ ID NO: 338329 - RNA, 22 nt, Homo sapiens
acagugcuuggcacacaguaau

SEQ ID NO: 338330 - RNA, 19 nt, Homo sapiens
acagugcuuugucagaagc

SEQ ID NO: 338331 - RNA, 17 nt, Homo sapiens
acagugucuaugaaaug

SEQ ID NO: 338332 - RNA, 19 nt, Homo sapiens
acagugucucuauaaugau

SEQ ID NO: 338333 - RNA, 22 nt, Homo sapiens
acaguguuccuuuguugugacu

SEQ ID NO: 338334 - RNA, 22 nt, Homo sapiens
acauauaaggagacuagggcau

SEQ ID NO: 338335 - RNA, 22 nt, Homo sapiens
acaucacuguuugauugauuga

SEQ ID NO: 338336 - RNA, 22 nt, Homo sapiens
acaugcaucauuaggugguuua

SEQ ID NO: 338337 - RNA, 22 nt, Homo sapiens
acaugcauggcaugcauuguac

SEQ ID NO: 338338 - RNA, 22 nt, Homo sapiens
acauggcuuaugaauuuggaga

SEQ ID NO: 338339 - RNA, 21 nt, Homo sapiens
acauguacacauguaugcaca

SEQ ID NO: 338340 - RNA, 23 nt, Homo sapiens
acauguauagacuuuuuuuccuu

SEQ ID NO: 338341 - RNA, 18 nt, Homo sapiens
acauucagcuugaagaua

SEQ ID NO: 338342 - RNA, 19 nt, Homo sapiens
acauugcauuuguaggcuu

SEQ ID NO: 338343 - RNA, 19 nt, Homo sapiens
accagauugcauucuugga

SEQ ID NO: 338344 - RNA, 22 nt, Homo sapiens
acccaguagccagauguagcug

SEQ ID NO: 338345 - RNA, 22 nt, Homo sapiens
acccaguguugggcagaacugu

SEQ ID NO: 338346 - RNA, 22 nt, Homo sapiens
accccgagacugccaagaaucc

SEQ ID NO: 338347 - RNA, 17 nt, Homo sapiens
accccuaccucagaagc

SEQ ID NO: 338348 - RNA, 22 nt, Homo sapiens
acccgcccagguguggccggga

SEQ ID NO: 338349 - RNA, 22 nt, Homo sapiens
acccgggaggcaggagucauag

SEQ ID NO: 338350 - RNA, 22 nt, Homo sapiens
acccuggagagugcuguaguaa

SEQ ID NO: 338351 - RNA, 22 nt, Homo sapiens
acccuggaggucuacagugcag

SEQ ID NO: 338352 - RNA, 22 nt, Homo sapiens
acccuguaggacuauucuaauc

SEQ ID NO: 338353 - RNA, 22 nt, Homo sapiens
acccugucacucccaucaauuu

SEQ ID NO: 338354 - RNA, 22 nt, Homo sapiens
acccugucauccacauggugcu

SEQ ID NO: 338355 - RNA, 22 nt, Homo sapiens
acccuguugguggaucagauug

SEQ ID NO: 338356 - RNA, 22 nt, Homo sapiens
acccuuaagcacuaguucagcu

SEQ ID NO: 338357 - RNA, 22 nt, Homo sapiens
accucagcccggggaaguugag

SEQ ID NO: 338358 - RNA, 22 nt, Homo sapiens
accugagauuacaggugcuggc

SEQ ID NO: 338359 - RNA, 22 nt, Homo sapiens
accuggacacuuugggcuccuc

SEQ ID NO: 338360 - RNA, 22 nt, Homo sapiens
acggcaguguggugcggucagg

SEQ ID NO: 338361 - RNA, 22 nt, Homo sapiens
acgugcaugcacacacaugcgc

SEQ ID NO: 338362 - RNA, 22 nt, Homo sapiens
acuacauaugacaucuucuuua

SEQ ID NO: 338363 - RNA, 22 nt, Homo sapiens
acugcacuccagcccgggugac

SEQ ID NO: 338364 - RNA, 22 nt, Homo sapiens
acugcacuccagccuccugggu

SEQ ID NO: 338365 - RNA, 22 nt, Homo sapiens
acugcacuccagccuggcggac

SEQ ID NO: 338366 - RNA, 22 nt, Homo sapiens
acugcacuccagccugugcgua

SEQ ID NO: 338367 - RNA, 22 nt, Homo sapiens
acugcacuccagccuuggcaac

SEQ ID NO: 338368 - RNA, 22 nt, Homo sapiens
acugcacuccagccuuggcggc

SEQ ID NO: 338369 - RNA, 22 nt, Homo sapiens
acugcacuccagcuugggugac

SEQ ID NO: 338370 - RNA, 22 nt, Homo sapiens
acugcacuccggccuggcaaca

SEQ ID NO: 338371 - RNA, 22 nt, Homo sapiens
acugcacucuagccuuggcaac

SEQ ID NO: 338372 - RNA, 22 nt, Homo sapiens
acuggacuuaaugaugaauugu

SEQ ID NO: 338373 - RNA, 22 nt, Homo sapiens
acugggauauuauugguaauau

SEQ ID NO: 338374 - RNA, 22 nt, Homo sapiens
acugggucaaaguagaaaacua

SEQ ID NO: 338375 - RNA, 22 nt, Homo sapiens
acugguuguuuaacugaauuga

SEQ ID NO: 338376 - RNA, 22 nt, Homo sapiens
acuguacuacagccugggugac

SEQ ID NO: 338377 - RNA, 22 nt, Homo sapiens
acuuuuguuauacagugugaua

SEQ ID NO: 338378 - RNA, 22 nt, Homo sapiens
agaaacauucucuugccuccuu

SEQ ID NO: 338379 - RNA, 22 nt, Homo sapiens
agaaagugcuucccuuugguga

SEQ ID NO: 338380 - RNA, 22 nt, Homo sapiens
agaauguauauucuguaguugu

SEQ ID NO: 338381 - RNA, 22 nt, Homo sapiens
caugugcaugagcacauacgug

SEQ ID NO: 338382 - RNA, 22 nt, Homo sapiens
caugugcaugcuuucuuaugug

SEQ ID NO: 338383 - RNA, 22 nt, Homo sapiens
cauugcaauccagccugggcaa

SEQ ID NO: 338384 - RNA, 19 nt, Homo sapiens
cauugcacuccacccuggg

SEQ ID NO: 338385 - RNA, 22 nt, Homo sapiens
cauugcacuccauccuuggcaa

SEQ ID NO: 338386 - RNA, 22 nt, Homo sapiens
cauugcacucuagucuggguga

SEQ ID NO: 338387 - RNA, 22 nt, Homo sapiens
cauugcacugcauucugggcaa

SEQ ID NO: 338388 - RNA, 20 nt, Homo sapiens
cauugcccuccagccugggc

SEQ ID NO: 338389 - RNA, 22 nt, Homo sapiens
cauugcucuuacagagugagua

SEQ ID NO: 338390 - RNA, 22 nt, Homo sapiens
ccaaggaauacccucccuuuuu

SEQ ID NO: 338391 - RNA, 23 nt, Homo sapiens
ccacaaugguugaacuagauuac

SEQ ID NO: 338392 - RNA, 22 nt, Homo sapiens
ccacacugucuuggugggaaac

SEQ ID NO: 338393 - RNA, 22 nt, Homo sapiens
ccacccuuccacacccugggua

SEQ ID NO: 338394 - RNA, 22 nt, Homo sapiens
ccacugggcaguuuauuaucag

SEQ ID NO: 338395 - RNA, 22 nt, Homo sapiens
ccacuguuuaaauggcugagga

SEQ ID NO: 338396 - RNA, 22 nt, Homo sapiens
ccagaauucucauuggaaggaa

SEQ ID NO: 338397 - RNA, 22 nt, Homo sapiens
ccaggguugcuuuagauucuga

SEQ ID NO: 338398 - RNA, 22 nt, Homo sapiens
ccagugguugggccggagacgg

SEQ ID NO: 338399 - RNA, 19 nt, Homo sapiens
ccaguguugccagagcuga

SEQ ID NO: 338400 - RNA, 22 nt, Homo sapiens
ccaguguuuggauuagggaugc

SEQ ID NO: 338401 - RNA, 22 nt, Homo sapiens
ccaguguuuuugaauuccagga

SEQ ID NO: 338402 - RNA, 17 nt, Homo sapiens
ccaguuuucccucagug

SEQ ID NO: 338403 - RNA, 22 nt, Homo sapiens
ccaucacacugugauuauuauc

SEQ ID NO: 338404 - RNA, 22 nt, Homo sapiens
ccaucacgugcaguggccccac

SEQ ID NO: 338405 - RNA, 22 nt, Homo sapiens
ccaucccuuucugagcaguucc

SEQ ID NO: 338406 - RNA, 19 nt, Homo sapiens
ccauggcaaugaucugaug

SEQ ID NO: 338407 - RNA, 22 nt, Homo sapiens
ccauugcacuccagccuaggca

SEQ ID NO: 338408 - RNA, 22 nt, Homo sapiens
ccauugcacucuggccuaggug

SEQ ID NO: 338409 - RNA, 22 nt, Homo sapiens
ccauugcacuucagccuaggug

SEQ ID NO: 338410 - RNA, 22 nt, Homo sapiens
cccagagacagaaugauaaacu

SEQ ID NO: 338411 - RNA, 22 nt, Homo sapiens
cccaguguuuauuuugagccaa

SEQ ID NO: 338412 - RNA, 22 nt, Homo sapiens
ccccugaaacucacucauuauc

SEQ ID NO: 338413 - RNA, 17 nt, Homo sapiens
ccccugagcgaugcagu

SEQ ID NO: 338414 - RNA, 22 nt, Homo sapiens
ccccuguaaacuggcuucccug

SEQ ID NO: 338415 - RNA, 22 nt, Homo sapiens
cccugacauucggagauguagu

SEQ ID NO: 338416 - RNA, 22 nt, Homo sapiens
ccuaggcacugggguccagccc

SEQ ID NO: 338417 - RNA, 22 nt, Homo sapiens
ccucauggagaacuucugcuag

SEQ ID NO: 338418 - RNA, 22 nt, Homo sapiens
ccucauugcuaucccaggcuga

SEQ ID NO: 338419 - RNA, 22 nt, Homo sapiens
ccugagacugauugacucacaa

SEQ ID NO: 338420 - RNA, 22 nt, Homo sapiens
ccugucuugaagagauccuccu

SEQ ID NO: 338421 - RNA, 22 nt, Homo sapiens
ccugugguuaaccagcuagaug

SEQ ID NO: 338422 - RNA, 22 nt, Homo sapiens
ccuguguuaugguuucuaaugu

SEQ ID NO: 338423 - RNA, 22 nt, Homo sapiens
ccuucauucauuaauuuagccc

SEQ ID NO: 338424 - RNA, 22 nt, Homo sapiens
ccuucuuuuguaaggcugaaua

SEQ ID NO: 338425 - RNA, 22 nt, Homo sapiens
ccuuggcaauggcuggggcuga

SEQ ID NO: 338426 - RNA, 22 nt, Homo sapiens
ccuuggcacuacugacauugua

SEQ ID NO: 338427 - RNA, 22 nt, Homo sapiens
cgcccuguagcuagcuagaggu

SEQ ID NO: 338428 - RNA, 22 nt, Homo sapiens
cuaaagugcugagauuauaggu

SEQ ID NO: 338429 - RNA, 22 nt, Homo sapiens
cuaaaugucucuacuaaguuua

SEQ ID NO: 338430 - RNA, 22 nt, Homo sapiens
cuaacuaugucucaggaugucc

SEQ ID NO: 338431 - RNA, 22 nt, Homo sapiens
cuaaggcaguagccugaauaau

SEQ ID NO: 338432 - RNA, 22 nt, Homo sapiens
cuaagggaggaagcugugcagg

SEQ ID NO: 338433 - RNA, 20 nt, Homo sapiens
cuaaucaucccagaagaaau

SEQ ID NO: 338434 - RNA, 22 nt, Homo sapiens
cuacaguuauguuuuaaaugug

SEQ ID NO: 338435 - RNA, 22 nt, Homo sapiens
cuacaguucuuaauuaaguagu

SEQ ID NO: 338436 - RNA, 22 nt, Homo sapiens
cuaccuggguggcucaugacuu

SEQ ID NO: 338437 - RNA, 22 nt, Homo sapiens
cuacuauguagagauauugaau

SEQ ID NO: 338438 - RNA, 22 nt, Homo sapiens
cuagaguacuuaccacagcaug

SEQ ID NO: 338439 - RNA, 22 nt, Homo sapiens
cuagcaggcaagauaagauuca

SEQ ID NO: 338440 - RNA, 22 nt, Homo sapiens
cuagcccagugcuccuggauca

SEQ ID NO: 338441 - RNA, 22 nt, Homo sapiens
cuagccuggagugcaguggugc

SEQ ID NO: 338442 - RNA, 22 nt, Homo sapiens
cuagcuuuugauguaaagugag

SEQ ID NO: 338443 - RNA, 22 nt, Homo sapiens
cuaggaaguauguguuauugcu

SEQ ID NO: 338444 - RNA, 18 nt, Homo sapiens
cuaguguuucuugaauca

SEQ ID NO: 338445 - RNA, 22 nt, Homo sapiens
cuaugcauuuuggaggagggaa

SEQ ID NO: 338446 - RNA, 22 nt, Homo sapiens
cuauuagguuggugcaaaaguc

SEQ ID NO: 338447 - RNA, 22 nt, Homo sapiens
cucaaagugcugggacuggcug

SEQ ID NO: 338448 - RNA, 22 nt, Homo sapiens
cucaaguaauccucccgccuug

SEQ ID NO: 338449 - RNA, 22 nt, Homo sapiens
cucaaguagugguuuucauuga

SEQ ID NO: 338450 - RNA, 20 nt, Homo sapiens
cucacagacagcuucuuucu

SEQ ID NO: 338451 - RNA, 18 nt, Homo sapiens
cucacaguaacuuuuaag

SEQ ID NO: 338452 - RNA, 22 nt, Homo sapiens
cucacugucaacauguauuugg

SEQ ID NO: 338453 - RNA, 22 nt, Homo sapiens
cucacugugguguccuuaggua

SEQ ID NO: 338454 - RNA, 22 nt, Homo sapiens
cucagcaguggauuuaccacca

SEQ ID NO: 338455 - RNA, 22 nt, Homo sapiens
cucagcuacuugagaggcuuag

SEQ ID NO: 338456 - RNA, 20 nt, Homo sapiens
cucagguauuugaggcugca

SEQ ID NO: 338457 - RNA, 22 nt, Homo sapiens
cucauggagauagagaauagaa

SEQ ID NO: 338458 - RNA, 22 nt, Homo sapiens
cucucuguuugucuguuauugg

SEQ ID NO: 338459 - RNA, 22 nt, Homo sapiens
cucugacagugguuagcacugu

SEQ ID NO: 338460 - RNA, 22 nt, Homo sapiens
cucugauggagauauacaagga

SEQ ID NO: 338461 - RNA, 22 nt, Homo sapiens
cucugguggaagcagggggcaa

SEQ ID NO: 338462 - RNA, 22 nt, Homo sapiens
cucuuacaguguguggugaaag

SEQ ID NO: 338463 - RNA, 22 nt, Homo sapiens
cucuuugaguuccuccuggugu

SEQ ID NO: 338464 - RNA, 22 nt, Homo sapiens
cucuuugcuucuggcaucauug

SEQ ID NO: 338465 - RNA, 22 nt, Homo sapiens
cugaaagagcauuugaaugggu

SEQ ID NO: 338466 - RNA, 22 nt, Homo sapiens
cugaaggcagguagaauagaga

SEQ ID NO: 338467 - RNA, 22 nt, Homo sapiens
cugaaucauugcauuaucaagg

SEQ ID NO: 338468 - RNA, 22 nt, Homo sapiens
cugaauguucuauagaagccgc

SEQ ID NO: 338469 - RNA, 22 nt, Homo sapiens
cugaauguuucacucugaaaug

SEQ ID NO: 338470 - RNA, 22 nt, Homo sapiens
cugacagucucauugauuugcu

SEQ ID NO: 338471 - RNA, 22 nt, Homo sapiens
cugacaucuucaagugaggaga

SEQ ID NO: 338472 - RNA, 22 nt, Homo sapiens
cugacucagacacauguauaug

SEQ ID NO: 338473 - RNA, 22 nt, Homo sapiens
cugacugugcaugcccagcccc

SEQ ID NO: 338474 - RNA, 22 nt, Homo sapiens
cugacuuauguggacuauuuca

SEQ ID NO: 338475 - RNA, 22 nt, Homo sapiens
cugagacacucuuaucugcaua

SEQ ID NO: 338476 - RNA, 22 nt, Homo sapiens
cugaggcacggcgaccuuaagu

SEQ ID NO: 338477 - RNA, 22 nt, Homo sapiens
cugagguacugggggccaggau

SEQ ID NO: 338478 - RNA, 22 nt, Homo sapiens
cugagguauaucccauuagaag

SEQ ID NO: 338479 - RNA, 22 nt, Homo sapiens
cugaggugauauauacauauuu

SEQ ID NO: 338480 - RNA, 22 nt, Homo sapiens
cugaggugggagaaucacauaa

SEQ ID NO: 338481 - RNA, 20 nt, Homo sapiens
cugaggugggagaaucgcuu

SEQ ID NO: 338482 - RNA, 22 nt, Homo sapiens
cugaggugggaguuuuucucau

SEQ ID NO: 338483 - RNA, 20 nt, Homo sapiens
cugagguugggguccuuccc

SEQ ID NO: 338484 - RNA, 22 nt, Homo sapiens
cugauaguucucuuuagaguuu

SEQ ID NO: 338485 - RNA, 22 nt, Homo sapiens
cugauauuuuaaaauuggcugg

SEQ ID NO: 338486 - RNA, 22 nt, Homo sapiens
cugaucuguagcagccaccaca

SEQ ID NO: 338487 - RNA, 22 nt, Homo sapiens
cugaugaaguauuuguucugga

SEQ ID NO: 338488 - RNA, 22 nt, Homo sapiens
cugaugguuuuacacaagggca

SEQ ID NO: 338489 - RNA, 22 nt, Homo sapiens
cugauuguucuugcugggccuu

SEQ ID NO: 338490 - RNA, 22 nt, Homo sapiens
cugauuuguccccagccucaug

SEQ ID NO: 338491 - RNA, 22 nt, Homo sapiens
cugcaaauacuugugggauuuu

SEQ ID NO: 338492 - RNA, 22 nt, Homo sapiens
cugcaauguuugaaauggcaaa

SEQ ID NO: 338493 - RNA, 22 nt, Homo sapiens
cugcagucaucugaagauuuug

SEQ ID NO: 338494 - RNA, 22 nt, Homo sapiens
cugcauaaucaucucucugcau

SEQ ID NO: 338495 - RNA, 22 nt, Homo sapiens
cugcauuggguuaugcauuuuu

SEQ ID NO: 338496 - RNA, 22 nt, Homo sapiens
cugcauuugaugacguauggug

SEQ ID NO: 338497 - RNA, 22 nt, Homo sapiens
cuggaauguuccuaaagauuca

SEQ ID NO: 338498 - RNA, 22 nt, Homo sapiens
cuggaauuacaggguugagcua

SEQ ID NO: 338499 - RNA, 22 nt, Homo sapiens
cuggacaaaucuggaaagaacc

SEQ ID NO: 338500 - RNA, 22 nt, Homo sapiens
cuggacguugaggcugcaguga

SEQ ID NO: 338501 - RNA, 20 nt, Homo sapiens
cuggaucaucaguaaaguua

SEQ ID NO: 338502 - RNA, 20 nt, Homo sapiens
cuggaugucgaggcagaggu

SEQ ID NO: 338503 - RNA, 22 nt, Homo sapiens
cuggcacagugucagaaacaca

SEQ ID NO: 338504 - RNA, 22 nt, Homo sapiens
cuggcccaguucugcguuuugc

SEQ ID NO: 338505 - RNA, 22 nt, Homo sapiens
cuggcugagugguaaguagagg

SEQ ID NO: 338506 - RNA, 22 nt, Homo sapiens
cuggugauugguuucauucagu

SEQ ID NO: 338507 - RNA, 22 nt, Homo sapiens
cuggugugugacuuuucauuau

SEQ ID NO: 338508 - RNA, 22 nt, Homo sapiens
cuguaaagaucacagagcuggu

SEQ ID NO: 338509 - RNA, 22 nt, Homo sapiens
cuguauguuucuaugaauguga

SEQ ID NO: 338510 - RNA, 22 nt, Homo sapiens
cugucacaguuuuggaggccag

SEQ ID NO: 338511 - RNA, 19 nt, Homo sapiens
cugucacugaggaagacug

SEQ ID NO: 338512 - RNA, 22 nt, Homo sapiens
cuguccugcagagucagaauga

SEQ ID NO: 338513 - RNA, 22 nt, Homo sapiens
cugucuagagggcacaugaugc

SEQ ID NO: 338514 - RNA, 22 nt, Homo sapiens
cugugauuauauaguuaaggua

SEQ ID NO: 338515 - RNA, 22 nt, Homo sapiens
cugugccaagcuugcgaugugc

SEQ ID NO: 338516 - RNA, 19 nt, Homo sapiens
cuguggucauuauuuugcu

SEQ ID NO: 338517 - RNA, 22 nt, Homo sapiens
cuguuuguuuaggguacucaga

SEQ ID NO: 338518 - RNA, 22 nt, Homo sapiens
cuucaagucuuuggauaauuag

SEQ ID NO: 338519 - RNA, 20 nt, Homo sapiens
cuucacagaaguggaaucau

SEQ ID NO: 338520 - RNA, 22 nt, Homo sapiens
cuucaccaguuuggcagucuca

SEQ ID NO: 338521 - RNA, 22 nt, Homo sapiens
cuucagcaauauauccccuggg

SEQ ID NO: 338522 - RNA, 22 nt, Homo sapiens
cuucaugggagaaccacaggua

SEQ ID NO: 338523 - RNA, 20 nt, Homo sapiens
cuuccaguggccccaucuuu

SEQ ID NO: 338524 - RNA, 22 nt, Homo sapiens
cuucucagugcucaucuuauuu

SEQ ID NO: 338525 - RNA, 22 nt, Homo sapiens
cuucugauugaaaauggaguag

SEQ ID NO: 338526 - RNA, 22 nt, Homo sapiens
cuuggacaccucaugcccaccu

SEQ ID NO: 338527 - RNA, 22 nt, Homo sapiens
cuuggcacucuguggaguuagg

SEQ ID NO: 338528 - RNA, 22 nt, Homo sapiens
cuuggcuagucaaaccuccccg

SEQ ID NO: 338529 - RNA, 22 nt, Homo sapiens
cuuguacuacuuaggaucugga

SEQ ID NO: 338530 - RNA, 22 nt, Homo sapiens
cuuguguuacauauuuaagaga

SEQ ID NO: 338531 - RNA, 22 nt, Homo sapiens
cuuguuguggaggggagugcag

SEQ ID NO: 338532 - RNA, 22 nt, Homo sapiens
cuuucucagugagacccgagau

SEQ ID NO: 338533 - RNA, 22 nt, Homo sapiens
cuuugcaaaacauugagaccuc

SEQ ID NO: 338534 - RNA, 20 nt, Homo sapiens
cuuuggcaaugagaacaggg

SEQ ID NO: 338535 - RNA, 22 nt, Homo sapiens
cuuugguugugcucuccacuuu

SEQ ID NO: 338536 - RNA, 22 nt, Homo sapiens
cuuuguaugucaugacaacugu

SEQ ID NO: 338537 - RNA, 22 nt, Homo sapiens
cuuugugcccuucugcccauca

SEQ ID NO: 338538 - RNA, 22 nt, Homo sapiens
cuuuguggggucuuuccucaaa

SEQ ID NO: 338539 - RNA, 22 nt, Homo sapiens
cuuuuacacugcuggugggaau

SEQ ID NO: 338540 - RNA, 22 nt, Homo sapiens
gaaagacuuucugcuguggaua

SEQ ID NO: 338541 - RNA, 23 nt, Homo sapiens
gaaauguaagugaugccccacag

SEQ ID NO: 338542 - RNA, 22 nt, Homo sapiens
gaaaugucugagauguggcuca

SEQ ID NO: 338543 - RNA, 23 nt, Homo sapiens
gaaaugucuuagugaaauugcuu

SEQ ID NO: 338544 - RNA, 22 nt, Homo sapiens
gaaccagcagacuuugacaggu

SEQ ID NO: 338545 - RNA, 22 nt, Homo sapiens
gaacugggguuggguugcgaua

SEQ ID NO: 338546 - RNA, 22 nt, Homo sapiens
gaacuguaaagaaauucuaagg

SEQ ID NO: 338547 - RNA, 22 nt, Homo sapiens
gaagaaguacaagacaaauuuu

SEQ ID NO: 338548 - RNA, 22 nt, Homo sapiens
gaagacauuuacaugggagacc

SEQ ID NO: 338549 - RNA, 22 nt, Homo sapiens
gaagauguugcuuaccuuggag

SEQ ID NO: 338550 - RNA, 22 nt, Homo sapiens
gaagcgaggugauuagcagaca

SEQ ID NO: 338551 - RNA, 22 nt, Homo sapiens
gaaggcacugugugccacccug

SEQ ID NO: 338552 - RNA, 22 nt, Homo sapiens
gaaggugcuuggugaaugcauu

SEQ ID NO: 338553 - RNA, 22 nt, Homo sapiens
gaauagugcugcaagaaacaua

SEQ ID NO: 338554 - RNA, 22 nt, Homo sapiens
gaauagugcugcaguaaacaua

SEQ ID NO: 338555 - RNA, 22 nt, Homo sapiens
gaaucaauugaucuaugugucu

SEQ ID NO: 338556 - RNA, 22 nt, Homo sapiens
gaaucacaguuauuagagcagc

SEQ ID NO: 338557 - RNA, 22 nt, Homo sapiens
gguuagaaacagguccucagga

SEQ ID NO: 338558 - RNA, 22 nt, Homo sapiens
guaaagacacaugcacacguau

SEQ ID NO: 338559 - RNA, 18 nt, Homo sapiens
guaaauguaucuauugcc

SEQ ID NO: 338560 - RNA, 22 nt, Homo sapiens
guaaucuguaguaaagcaccau

SEQ ID NO: 338561 - RNA, 22 nt, Homo sapiens
guacaguaguaaaagugaauga

SEQ ID NO: 338562 - RNA, 22 nt, Homo sapiens
guacaguuuucaguguucacug

SEQ ID NO: 338563 - RNA, 22 nt, Homo sapiens
guaccugggugacaggauuauu

SEQ ID NO: 338564 - RNA, 22 nt, Homo sapiens
guacuuuguuauaacccacagg

SEQ ID NO: 338565 - RNA, 22 nt, Homo sapiens
guagaaagcauuucagauuugc

SEQ ID NO: 338566 - RNA, 22 nt, Homo sapiens
guagaauguauacaguauacag

SEQ ID NO: 338567 - RNA, 22 nt, Homo sapiens
guagaauguauguauaacgcaa

SEQ ID NO: 338568 - RNA, 22 nt, Homo sapiens
guagagagaaauacaaagcugu

SEQ ID NO: 338569 - RNA, 22 nt, Homo sapiens
guauaggcuuucaccacgccau

SEQ ID NO: 338570 - RNA, 22 nt, Homo sapiens
guaucauugccuaaugcucuca

SEQ ID NO: 338571 - RNA, 22 nt, Homo sapiens
guaugaguuuucugaugugugg

SEQ ID NO: 338572 - RNA, 22 nt, Homo sapiens
guauggaagucaguuuguuggc

SEQ ID NO: 338573 - RNA, 22 nt, Homo sapiens
guaugugacuggaacaguagga

SEQ ID NO: 338574 - RNA, 22 nt, Homo sapiens
guauugacuaucaaucaugugc

SEQ ID NO: 338575 - RNA, 22 nt, Homo sapiens
guauugaguaaauguuuauugg

SEQ ID NO: 338576 - RNA, 22 nt, Homo sapiens
guauuuuguuagggugugguau

SEQ ID NO: 338577 - RNA, 22 nt, Homo sapiens
gucaauguaucuagcuguauua

SEQ ID NO: 338578 - RNA, 22 nt, Homo sapiens
gucacagcuggcauugucugca

SEQ ID NO: 338579 - RNA, 22 nt, Homo sapiens
gucacaguggccagugauguuc

SEQ ID NO: 338580 - RNA, 22 nt, Homo sapiens
gucacugagaagguuaguuugu

SEQ ID NO: 338581 - RNA, 22 nt, Homo sapiens
gucacugucuacuguaauagcc

SEQ ID NO: 338582 - RNA, 22 nt, Homo sapiens
gucacugugaggaggggccagg

SEQ ID NO: 338583 - RNA, 22 nt, Homo sapiens
gucagcaaaguucuccugcaga

SEQ ID NO: 338584 - RNA, 22 nt, Homo sapiens
gucaggcaccgauacaguuuuu

SEQ ID NO: 338585 - RNA, 22 nt, Homo sapiens
gucaguggauacugucucuguc

SEQ ID NO: 338586 - RNA, 22 nt, Homo sapiens
gucagugucuuaacagagauua

SEQ ID NO: 338587 - RNA, 22 nt, Homo sapiens
gucaguuucacucagcuggaac

SEQ ID NO: 338588 - RNA, 18 nt, Homo sapiens
gucauagaaugaugguuc

SEQ ID NO: 338589 - RNA, 22 nt, Homo sapiens
gucauaugcucggaaaauguua

SEQ ID NO: 338590 - RNA, 22 nt, Homo sapiens
gucauccaggcuggagugaagc

SEQ ID NO: 338591 - RNA, 22 nt, Homo sapiens
gucauggaacaacuuaaaguca

SEQ ID NO: 338592 - RNA, 22 nt, Homo sapiens
gucauggaggaugaauggccaa

SEQ ID NO: 338593 - RNA, 21 nt, Homo sapiens
guccaaaacaguguccaaugc

SEQ ID NO: 338594 - RNA, 22 nt, Homo sapiens
guccauuuguuuccagagcacu

SEQ ID NO: 338595 - RNA, 22 nt, Homo sapiens
gucccagagauauugugucuuu

SEQ ID NO: 338596 - RNA, 22 nt, Homo sapiens
guccuguuuuuaagguucauag

SEQ ID NO: 338597 - RNA, 18 nt, Homo sapiens
gucucacaugguggaagc

SEQ ID NO: 338598 - RNA, 22 nt, Homo sapiens
gucucccaaccccugugcccag

SEQ ID NO: 338599 - RNA, 22 nt, Homo sapiens
gucuccgagccguguggagccg

SEQ ID NO: 338600 - RNA, 22 nt, Homo sapiens
gucucugagaugucaacaccua

SEQ ID NO: 338601 - RNA, 22 nt, Homo sapiens
gucucugguugcuuuuguacca

SEQ ID NO: 338602 - RNA, 22 nt, Homo sapiens
gucuggcuccugucuaaucacu

SEQ ID NO: 338603 - RNA, 22 nt, Homo sapiens
gucugugguuccuaugucaccu

SEQ ID NO: 338604 - RNA, 22 nt, Homo sapiens
gucuguuugauccagaucaaaa

SEQ ID NO: 338605 - RNA, 22 nt, Homo sapiens
gucuuggagacauugccauuga

SEQ ID NO: 338606 - RNA, 22 nt, Homo sapiens
gugaaagacagcauuaauggcu

SEQ ID NO: 338607 - RNA, 22 nt, Homo sapiens
gugaaagauuaaaccagugugu

SEQ ID NO: 338608 - RNA, 22 nt, Homo sapiens
gugaaaugaaacgcuaugucuu

SEQ ID NO: 338609 - RNA, 15 nt, Homo sapiens
gugaaauguuucaga

SEQ ID NO: 338610 - RNA, 22 nt, Homo sapiens
gugaagaugugcaucagaucca

SEQ ID NO: 338611 - RNA, 22 nt, Homo sapiens
gugaaugaaugggugaauacau

SEQ ID NO: 338612 - RNA, 22 nt, Homo sapiens
gugaauguuuucuuacauggua

SEQ ID NO: 338613 - RNA, 22 nt, Homo sapiens
gugacacagcaagacuccgucu

SEQ ID NO: 338614 - RNA, 22 nt, Homo sapiens
gugacuaagauucuuugauaug

SEQ ID NO: 338615 - RNA, 22 nt, Homo sapiens
gugacugcauccauccaggcuu

SEQ ID NO: 338616 - RNA, 22 nt, Homo sapiens
gugagaccaauguacuaccuuc

SEQ ID NO: 338617 - RNA, 22 nt, Homo sapiens
gugagacugguccugaacccag

SEQ ID NO: 338618 - RNA, 22 nt, Homo sapiens
gugagauacuagagauauagug

SEQ ID NO: 338619 - RNA, 22 nt, Homo sapiens
gugagaugugacuucugccucu

SEQ ID NO: 338620 - RNA, 19 nt, Homo sapiens
gugagcacagacaauacaa

SEQ ID NO: 338621 - RNA, 22 nt, Homo sapiens
gugagcuccucucuauguguca

SEQ ID NO: 338622 - RNA, 22 nt, Homo sapiens
gugaggcacugcugcuuuccag

SEQ ID NO: 338623 - RNA, 22 nt, Homo sapiens
gugagguaagaguugcuuugcu

SEQ ID NO: 338624 - RNA, 22 nt, Homo sapiens
gugagguguuaaccaaccugug

SEQ ID NO: 338625 - RNA, 22 nt, Homo sapiens
gugagucaaucugagggguuca

SEQ ID NO: 338626 - RNA, 22 nt, Homo sapiens
gugaucucagcucacuggaacc

SEQ ID NO: 338627 - RNA, 22 nt, Homo sapiens
gugaucucauuuggaauuagag

SEQ ID NO: 338628 - RNA, 22 nt, Homo sapiens
gugaucuuucaggcuugaccau

SEQ ID NO: 338629 - RNA, 22 nt, Homo sapiens
gugaugguaguuuguauuucug

SEQ ID NO: 338630 - RNA, 22 nt, Homo sapiens
gugauuauccacgucuuuguga

SEQ ID NO: 338631 - RNA, 20 nt, Homo sapiens
gugauuggucacugguuguu

SEQ ID NO: 338632 - RNA, 22 nt, Homo sapiens
gugauugucuaaucaagauaca

SEQ ID NO: 338633 - RNA, 21 nt, Homo sapiens
gugcaaacaucauagaaugua

SEQ ID NO: 338634 - RNA, 22 nt, Homo sapiens
gugcaaauguuauugagguuuu

SEQ ID NO: 338635 - RNA, 22 nt, Homo sapiens
gugcaagagugacugcaguuuu

SEQ ID NO: 338636 - RNA, 22 nt, Homo sapiens
gugcaaugaguguggcaaagcc

SEQ ID NO: 338637 - RNA, 22 nt, Homo sapiens
gugcacaacguguagguuuguu

SEQ ID NO: 338638 - RNA, 22 nt, Homo sapiens
gugcacaaucgugcauuccuug

SEQ ID NO: 338639 - RNA, 21 nt, Homo sapiens
gugcacaguaguguuuaauag

SEQ ID NO: 338640 - RNA, 23 nt, Homo sapiens
gugcaguggcgagauuucggcuc

SEQ ID NO: 338641 - RNA, 22 nt, Homo sapiens
gugcaguguuugcauggaauca

SEQ ID NO: 338642 - RNA, 18 nt, Homo sapiens
gugcauagccauggcagc

SEQ ID NO: 338643 - RNA, 19 nt, Homo sapiens
gugcauaguuauuaaagag

SEQ ID NO: 338644 - RNA, 22 nt, Homo sapiens
gugcauauaaguuguuucuagu

SEQ ID NO: 338645 - RNA, 22 nt, Homo sapiens
ucacugggagcauuugagccuu

SEQ ID NO: 338646 - RNA, 20 nt, Homo sapiens
ucacuggguucuugaagucu

SEQ ID NO: 338647 - RNA, 22 nt, Homo sapiens
ucacuuggugaacacauuaugu

SEQ ID NO: 338648 - RNA, 22 nt, Homo sapiens
ucagaaccuccuagcaguguuc

SEQ ID NO: 338649 - RNA, 22 nt, Homo sapiens
ucagacacuguggccuuuggac

SEQ ID NO: 338650 - RNA, 22 nt, Homo sapiens
ucagagcaaagacacuuuauca

SEQ ID NO: 338651 - RNA, 22 nt, Homo sapiens
ucagauacuggugacaugaaug

SEQ ID NO: 338652 - RNA, 22 nt, Homo sapiens
ucagauguuugagaaguauacu

SEQ ID NO: 338653 - RNA, 22 nt, Homo sapiens
ucagcaaugaccuaagcaaaua

SEQ ID NO: 338654 - RNA, 22 nt, Homo sapiens
ucagcaaugcugcacucuacug

SEQ ID NO: 338655 - RNA, 22 nt, Homo sapiens
ucagcacauucaaggccugccu

SEQ ID NO: 338656 - RNA, 22 nt, Homo sapiens
ucagcaccauguaacaauugau

SEQ ID NO: 338657 - RNA, 22 nt, Homo sapiens
ucaggcaccuuccucuuaucug

SEQ ID NO: 338658 - RNA, 20 nt, Homo sapiens
ucaggcuccgcauuaacuua

SEQ ID NO: 338659 - RNA, 22 nt, Homo sapiens
ucaggcuuuucccagagugaug

SEQ ID NO: 338660 - RNA, 21 nt, Homo sapiens
ucaggcuuuuugagugccaau

SEQ ID NO: 338661 - RNA, 22 nt, Homo sapiens
ucagguagcuagauuaugugag

SEQ ID NO: 338662 - RNA, 22 nt, Homo sapiens
ucagguagugccaugauugauu

SEQ ID NO: 338663 - RNA, 23 nt, Homo sapiens
ucagguaguuucagaggaccuug

SEQ ID NO: 338664 - RNA, 22 nt, Homo sapiens
ucagguauuuuaucacaugaag

SEQ ID NO: 338665 - RNA, 22 nt, Homo sapiens
ucaguaaauguuaggacauuuc

SEQ ID NO: 338666 - RNA, 23 nt, Homo sapiens
ucaguagucauugggaaagugug

SEQ ID NO: 338667 - RNA, 18 nt, Homo sapiens
ucagucacugccuggcuu

SEQ ID NO: 338668 - RNA, 22 nt, Homo sapiens
ucagucauucacucacucggac

SEQ ID NO: 338669 - RNA, 22 nt, Homo sapiens
ucagugauugguuauuuuaggc

SEQ ID NO: 338670 - RNA, 22 nt, Homo sapiens
ucagugguuaaaagauucuaga

SEQ ID NO: 338671 - RNA, 22 nt, Homo sapiens
ucagugucugcauucuuauugu

SEQ ID NO: 338672 - RNA, 23 nt, Homo sapiens
ucagugucuggauccugcucagu

SEQ ID NO: 338673 - RNA, 22 nt, Homo sapiens
ucauaaaguuguuuuaauggga

SEQ ID NO: 338674 - RNA, 22 nt, Homo sapiens
ucauacuguccaauucuagugg

SEQ ID NO: 338675 - RNA, 22 nt, Homo sapiens
ucauaguagucacuuaauaaau

SEQ ID NO: 338676 - RNA, 16 nt, Homo sapiens
ucauaguaucucuucu

SEQ ID NO: 338677 - RNA, 22 nt, Homo sapiens
ucauaucauuagaucuacugua

SEQ ID NO: 338678 - RNA, 22 nt, Homo sapiens
ucauauguaugugcaauuuugu

SEQ ID NO: 338679 - RNA, 22 nt, Homo sapiens
ucauaugucauaguaugaucuu

SEQ ID NO: 338680 - RNA, 22 nt, Homo sapiens
ucaugacacuggcaggagcuaa

SEQ ID NO: 338681 - RNA, 23 nt, Homo sapiens
ucaugaggccauucaaauccauu

SEQ ID NO: 338682 - RNA, 22 nt, Homo sapiens
ucaugcaaugcaaggggaaauu

SEQ ID NO: 338683 - RNA, 22 nt, Homo sapiens
ucauggggugcuuugcuagauu

SEQ ID NO: 338684 - RNA, 22 nt, Homo sapiens
ucauguauuaucauuagugggu

SEQ ID NO: 338685 - RNA, 22 nt, Homo sapiens
ucaugucuuguuguauuuauuu

SEQ ID NO: 338686 - RNA, 22 nt, Homo sapiens
ucauucacucccuugaaguuag

SEQ ID NO: 338687 - RNA, 22 nt, Homo sapiens
ucauugcauguuaauuaaacag

SEQ ID NO: 338688 - RNA, 22 nt, Homo sapiens
uccagaguggugaugcuggggc

SEQ ID NO: 338689 - RNA, 22 nt, Homo sapiens
uccaguguuauaauaugcgucu

SEQ ID NO: 338690 - RNA, 22 nt, Homo sapiens
uccaguuuucuuuccuagggcu

SEQ ID NO: 338691 - RNA, 22 nt, Homo sapiens
uccauagacauuuuaagguagu

SEQ ID NO: 338692 - RNA, 22 nt, Homo sapiens
uccaugagaauaguuaggcucu

SEQ ID NO: 338693 - RNA, 19 nt, Homo sapiens
uccaugagcccacagugau

SEQ ID NO: 338694 - RNA, 22 nt, Homo sapiens
ucccacugucuucucgugcucg

SEQ ID NO: 338695 - RNA, 22 nt, Homo sapiens
ucccagugaaaccccaccuuca

SEQ ID NO: 338696 - RNA, 20 nt, Homo sapiens
ucccuaagagccuuuccuuc

SEQ ID NO: 338697 - RNA, 22 nt, Homo sapiens
ucccuagacuccugccuuucag

SEQ ID NO: 338698 - RNA, 22 nt, Homo sapiens
ucccugacagggucugagcuuu

SEQ ID NO: 338699 - RNA, 22 nt, Homo sapiens
ucccugagguccuggauuauug

SEQ ID NO: 338700 - RNA, 19 nt, Homo sapiens
ucccuguagaccacagugc

SEQ ID NO: 338701 - RNA, 17 nt, Homo sapiens
ucccuguuuuuucaguc

SEQ ID NO: 338702 - RNA, 22 nt, Homo sapiens
ucccuugguaauucuguuccuu

SEQ ID NO: 338703 - RNA, 18 nt, Homo sapiens
ucccuuuguagaugaccc

SEQ ID NO: 338704 - RNA, 22 nt, Homo sapiens
uccugagucagcauccguuugu

SEQ ID NO: 338705 - RNA, 22 nt, Homo sapiens
uccugauacgguugcaguucuc

SEQ ID NO: 338706 - RNA, 22 nt, Homo sapiens
uccuucauuugucaacucuagu

SEQ ID NO: 338707 - RNA, 22 nt, Homo sapiens
uccuugagucuuugcucagaug

SEQ ID NO: 338708 - RNA, 22 nt, Homo sapiens
uccuuuggcuaacuuucuaagu

SEQ ID NO: 338709 - RNA, 22 nt, Homo sapiens
uccuuuggucaguauucuuuug

SEQ ID NO: 338710 - RNA, 22 nt, Homo sapiens
uccuuugguuauaggcaccucu

SEQ ID NO: 338711 - RNA, 22 nt, Homo sapiens
ucgugccacugcacuccagccu

SEQ ID NO: 338712 - RNA, 22 nt, Homo sapiens
ucguggccugugaguccucccc

SEQ ID NO: 338713 - RNA, 22 nt, Homo sapiens
ucuaaaacuagauugugaugau

SEQ ID NO: 338714 - RNA, 22 nt, Homo sapiens
ucuaaggcaccuagagucauca

SEQ ID NO: 338715 - RNA, 22 nt, Homo sapiens
ucuaguaaugagaggcaggaga

SEQ ID NO: 338716 - RNA, 22 nt, Homo sapiens
ucucacauuucacagggauggg

SEQ ID NO: 338717 - RNA, 22 nt, Homo sapiens
ucucaguggcuuccucacuuuu

SEQ ID NO: 338718 - RNA, 22 nt, Homo sapiens
ucucagugugguaaaaguuuuu

SEQ ID NO: 338719 - RNA, 22 nt, Homo sapiens
ucucauggcucacccugcauag

SEQ ID NO: 338720 - RNA, 22 nt, Homo sapiens
ucuccauugaaauggacauaau

SEQ ID NO: 338721 - RNA, 17 nt, Homo sapiens
ucucccaucccuuucuc

SEQ ID NO: 338722 - RNA, 22 nt, Homo sapiens
ucugacaaugaacaaucuauag

SEQ ID NO: 338723 - RNA, 19 nt, Homo sapiens
ucugacagccccagucaac

SEQ ID NO: 338724 - RNA, 22 nt, Homo sapiens
ucugagaugagacuuugaauuu

SEQ ID NO: 338725 - RNA, 22 nt, Homo sapiens
ucugagguaggugcauggauac

SEQ ID NO: 338726 - RNA, 22 nt, Homo sapiens
ucugccuuuucaugugggaugg

SEQ ID NO: 338727 - RNA, 23 nt, Homo sapiens
ucugcggguguggacccuagugc

SEQ ID NO: 338728 - RNA, 22 nt, Homo sapiens
ucuggauuuuugaggcaauaua

SEQ ID NO: 338729 - RNA, 20 nt, Homo sapiens
ucuggccccucuaaaucuca

SEQ ID NO: 338730 - RNA, 22 nt, Homo sapiens
ucuggccuacaucauuuuuccg

SEQ ID NO: 338731 - RNA, 22 nt, Homo sapiens
ucuggcuuauuucacuuagcau

SEQ ID NO: 338732 - RNA, 22 nt, Homo sapiens
ucuggcuuuuaacaucuauaaa

SEQ ID NO: 338733 - RNA, 23 nt, Homo sapiens
ugagauuauaaucuuuuacuucu

SEQ ID NO: 338734 - RNA, 22 nt, Homo sapiens
ugagauuaucuugaucuugaaa

SEQ ID NO: 338735 - RNA, 22 nt, Homo sapiens
ugagcaagaaauagaaacagau

SEQ ID NO: 338736 - RNA, 22 nt, Homo sapiens
ugagcacagcgugugggagagc

SEQ ID NO: 338737 - RNA, 22 nt, Homo sapiens
ugagcagagaagugcccugcgc

SEQ ID NO: 338738 - RNA, 22 nt, Homo sapiens
ugagccaaguucacaccauugc

SEQ ID NO: 338739 - RNA, 22 nt, Homo sapiens
ugagccauggcaccuugucuaa

SEQ ID NO: 338740 - RNA, 20 nt, Homo sapiens
ugagccccuggacucaagcg

SEQ ID NO: 338741 - RNA, 22 nt, Homo sapiens
ugagcucaguauuucauaaaca

SEQ ID NO: 338742 - RNA, 22 nt, Homo sapiens
ugagcugagaucgugccauugu

SEQ ID NO: 338743 - RNA, 22 nt, Homo sapiens
ugaggaguauguucuguagacc

SEQ ID NO: 338744 - RNA, 22 nt, Homo sapiens
ugagguaggugaagaaugcacg

SEQ ID NO: 338745 - RNA, 22 nt, Homo sapiens
ugaguagcuaagacgauaggca

SEQ ID NO: 338746 - RNA, 19 nt, Homo sapiens
ugaguaucuuuacacaucu

SEQ ID NO: 338747 - RNA, 23 nt, Homo sapiens
ugagucacuuugcuggggucucu

SEQ ID NO: 338748 - RNA, 22 nt, Homo sapiens
ugagucgagauugcgccacugu

SEQ ID NO: 338749 - RNA, 22 nt, Homo sapiens
ugagugaacgcugagaccaaau

SEQ ID NO: 338750 - RNA, 22 nt, Homo sapiens
ugagugaaugugaaggcuaggg

SEQ ID NO: 338751 - RNA, 22 nt, Homo sapiens
ugagugagguucuacucuguga

SEQ ID NO: 338752 - RNA, 21 nt, Homo sapiens
ugagugcugagugaggguuga

SEQ ID NO: 338753 - RNA, 22 nt, Homo sapiens
ugaguuaauuuuuguaucaugu

SEQ ID NO: 338754 - RNA, 22 nt, Homo sapiens
ugaguucaauguuaaugaagca

SEQ ID NO: 338755 - RNA, 22 nt, Homo sapiens
ugaguuuaucuaaagaccuggg

SEQ ID NO: 338756 - RNA, 17 nt, Homo sapiens
ugauaagugugagguga

SEQ ID NO: 338757 - RNA, 22 nt, Homo sapiens
ugauaugucccucgacaucagg

SEQ ID NO: 338758 - RNA, 22 nt, Homo sapiens
ugauauguggauucagcucaaa

SEQ ID NO: 338759 - RNA, 22 nt, Homo sapiens
ugauauguggcuauugagauug

SEQ ID NO: 338760 - RNA, 22 nt, Homo sapiens
ugauauguuagaaucuugcaag

SEQ ID NO: 338761 - RNA, 22 nt, Homo sapiens
ugaucaaagugcuggaauuaca

SEQ ID NO: 338762 - RNA, 22 nt, Homo sapiens
ugaucucagcucacugguugaa

SEQ ID NO: 338763 - RNA, 22 nt, Homo sapiens
ugauggcaauggcauucauuuu

SEQ ID NO: 338764 - RNA, 22 nt, Homo sapiens
ugauggcauuucauguuuguaa

SEQ ID NO: 338765 - RNA, 22 nt, Homo sapiens
ugauggccuguucuccauaugu

SEQ ID NO: 338766 - RNA, 22 nt, Homo sapiens
ugaugguguuaccaucuuuacu

SEQ ID NO: 338767 - RNA, 22 nt, Homo sapiens
ugaugucuugcaggcacgagau

SEQ ID NO: 338768 - RNA, 22 nt, Homo sapiens
ugcaaaugucaaggguuagugu

SEQ ID NO: 338769 - RNA, 22 nt, Homo sapiens
ugcaacacauugccccugcucu

SEQ ID NO: 338770 - RNA, 22 nt, Homo sapiens
ugcaaccauuguuaagugugca

SEQ ID NO: 338771 - RNA, 22 nt, Homo sapiens
ugcaagacugcaguuacuuuug

SEQ ID NO: 338772 - RNA, 22 nt, Homo sapiens
ugcaagaggagacuguacucag

SEQ ID NO: 338773 - RNA, 18 nt, Homo sapiens
ugcaauggagaugcagcc

SEQ ID NO: 338774 - RNA, 22 nt, Homo sapiens
ugcaccacuacacuccaggcug

SEQ ID NO: 338775 - RNA, 22 nt, Homo sapiens
ugcaccacugcacuucagccug

SEQ ID NO: 338776 - RNA, 18 nt, Homo sapiens
ugcaccaguuuacacuuc

SEQ ID NO: 338777 - RNA, 22 nt, Homo sapiens
ugcaccauugcauacuuaauua

SEQ ID NO: 338778 - RNA, 16 nt, Homo sapiens
ugcagaguaggugaau

SEQ ID NO: 338779 - RNA, 22 nt, Homo sapiens
ugcagcauguaggcacguuauu

SEQ ID NO: 338780 - RNA, 22 nt, Homo sapiens
ugcagcucaaauuccuaacaag

SEQ ID NO: 338781 - RNA, 22 nt, Homo sapiens
ugcaggauguucaguaauuucc

SEQ ID NO: 338782 - RNA, 22 nt, Homo sapiens
ugcaguacugucagacuucuua

SEQ ID NO: 338783 - RNA, 22 nt, Homo sapiens
ugcaguagugugaucuuggcuc

SEQ ID NO: 338784 - RNA, 22 nt, Homo sapiens
ugcauaugcagcauuuaugauu

SEQ ID NO: 338785 - RNA, 22 nt, Homo sapiens
ugcauauguauacaugugccau

SEQ ID NO: 338786 - RNA, 22 nt, Homo sapiens
ugcauaugucuuuauaguagca

SEQ ID NO: 338787 - RNA, 22 nt, Homo sapiens
ugcauauguucaaaguauucug

SEQ ID NO: 338788 - RNA, 18 nt, Homo sapiens
ugcauauguugaaccagc

SEQ ID NO: 338789 - RNA, 22 nt, Homo sapiens
ugcauauguugaaccaggcuug

SEQ ID NO: 338790 - RNA, 22 nt, Homo sapiens
ugcauauguugagaugcauauu

SEQ ID NO: 338791 - RNA, 22 nt, Homo sapiens
ugcauauucuaggauuuuguau

SEQ ID NO: 338792 - RNA, 21 nt, Homo sapiens
ugcauauuggaacuuucucuc

SEQ ID NO: 338793 - RNA, 22 nt, Homo sapiens
ugcauccauucuagacucaucu

SEQ ID NO: 338794 - RNA, 22 nt, Homo sapiens
ugccaaaaugggcuuuauaccg

SEQ ID NO: 338795 - RNA, 19 nt, Homo sapiens
ugccaagaaagucagcuua

SEQ ID NO: 338796 - RNA, 20 nt, Homo sapiens
ugccaagaaaugaggguauu

SEQ ID NO: 338797 - RNA, 20 nt, Homo sapiens
ugccaagaugacuauagcuc

SEQ ID NO: 338798 - RNA, 22 nt, Homo sapiens
ugccaguauuuuauuaagaauu

SEQ ID NO: 338799 - RNA, 22 nt, Homo sapiens
ugccaguguuuuguugaagauu

SEQ ID NO: 338800 - RNA, 22 nt, Homo sapiens
ugccuagaaacacuauuucucc

SEQ ID NO: 338801 - RNA, 20 nt, Homo sapiens
ugccugacacucuuugcuuc

SEQ ID NO: 338802 - RNA, 22 nt, Homo sapiens
ugccugagccagguuuuaggag

SEQ ID NO: 338803 - RNA, 22 nt, Homo sapiens
ugccugagcccagcccuguagu

SEQ ID NO: 338804 - RNA, 22 nt, Homo sapiens
ugcuagaagaucacacacauca

SEQ ID NO: 338805 - RNA, 22 nt, Homo sapiens
ugcuagagaaauauauuugggg

SEQ ID NO: 338806 - RNA, 22 nt, Homo sapiens
ugcuaucauugauuagugaugu

SEQ ID NO: 338807 - RNA, 16 nt, Homo sapiens
ugcuauguuggccagg

SEQ ID NO: 338808 - RNA, 22 nt, Homo sapiens
ugcugcaaacaugagaggaagu

SEQ ID NO: 338809 - RNA, 20 nt, Homo sapiens
ugcugcacuuaagcaugggc

SEQ ID NO: 338810 - RNA, 22 nt, Homo sapiens
ugcugcacuuauggcucugagg

SEQ ID NO: 338811 - RNA, 22 nt, Homo sapiens
ugcugguguggucuagccgcuu

SEQ ID NO: 338812 - RNA, 22 nt, Homo sapiens
ugcuguguugcuggcuuaaaga

SEQ ID NO: 338813 - RNA, 22 nt, Homo sapiens
ugcuguuguuugaugaaguaau

SEQ ID NO: 338814 - RNA, 22 nt, Homo sapiens
ugcuuaguuguauguuccacau

SEQ ID NO: 338815 - RNA, 22 nt, Homo sapiens
uggaaaguacuugaguuuguau

SEQ ID NO: 338816 - RNA, 22 nt, Homo sapiens
uggaaaguccaagccaaccggg

SEQ ID NO: 338817 - RNA, 22 nt, Homo sapiens
uggaaauuaagucuuuccugag

SEQ ID NO: 338818 - RNA, 23 nt, Homo sapiens
uggaacugaauuucuuagcauuu

SEQ ID NO: 338819 - RNA, 22 nt, Homo sapiens
uggaacugauauugauggaaaa

SEQ ID NO: 338820 - RNA, 22 nt, Homo sapiens
uggaagccuagauucuuuucuu

SEQ ID NO: 338821 - RNA, 22 nt, Homo sapiens
uugagcaacauagugagacugu

SEQ ID NO: 338822 - RNA, 22 nt, Homo sapiens
uugagcacaggaguuugagacc

SEQ ID NO: 338823 - RNA, 22 nt, Homo sapiens
uugagcacaggaguuuugagac

SEQ ID NO: 338824 - RNA, 22 nt, Homo sapiens
uugagcaccaugccuggccaug

SEQ ID NO: 338825 - RNA, 22 nt, Homo sapiens
uugagccaaggauugucuuucc

SEQ ID NO: 338826 - RNA, 22 nt, Homo sapiens
uugagcucaucaagauagagaa

SEQ ID NO: 338827 - RNA, 22 nt, Homo sapiens
uugagcuccucucaaccuaagg

SEQ ID NO: 338828 - RNA, 22 nt, Homo sapiens
uugagcuuuuuacuuguccaau

SEQ ID NO: 338829 - RNA, 22 nt, Homo sapiens
uugaggaagugguuccccagag

SEQ ID NO: 338830 - RNA, 22 nt, Homo sapiens
uugaggaaugucauuuguguuu

SEQ ID NO: 338831 - RNA, 22 nt, Homo sapiens
uugaggacugagacagaccaag

SEQ ID NO: 338832 - RNA, 22 nt, Homo sapiens
uugaggacuggaacacaggucu

SEQ ID NO: 338833 - RNA, 23 nt, Homo sapiens
uugaggcauguaccaucaauauc

SEQ ID NO: 338834 - RNA, 22 nt, Homo sapiens
uugagggagcauuuguuuugag

SEQ ID NO: 338835 - RNA, 22 nt, Homo sapiens
uugagguaggaggagcuuggau

SEQ ID NO: 338836 - RNA, 22 nt, Homo sapiens
uugauaguguccucuuuggcag

SEQ ID NO: 338837 - RNA, 22 nt, Homo sapiens
uugauaugguauaagauuucau

SEQ ID NO: 338838 - RNA, 22 nt, Homo sapiens
uugauauucugagaagcugaag

SEQ ID NO: 338839 - RNA, 22 nt, Homo sapiens
uugauuagauccaguugauuga

SEQ ID NO: 338840 - RNA, 21 nt, Homo sapiens
uugcaaaugcugcugccugau

SEQ ID NO: 338841 - RNA, 22 nt, Homo sapiens
uugcaagugccguaacuaccaa

SEQ ID NO: 338842 - RNA, 22 nt, Homo sapiens
uugcacauugauuuuguauccu

SEQ ID NO: 338843 - RNA, 22 nt, Homo sapiens
uugcacauugauuuuguaucuu

SEQ ID NO: 338844 - RNA, 22 nt, Homo sapiens
uugcaccacugcacuccacccu

SEQ ID NO: 338845 - RNA, 22 nt, Homo sapiens
uugcacuccagccugggugaca

SEQ ID NO: 338846 - RNA, 18 nt, Homo sapiens
uugcacuccugccugggu

SEQ ID NO: 338847 - RNA, 22 nt, Homo sapiens
uugcacucuagccugggugaca

SEQ ID NO: 338848 - RNA, 22 nt, Homo sapiens
uugcacuguaauuuauuuaugu

SEQ ID NO: 338849 - RNA, 22 nt, Homo sapiens
uugcacuuccgccugggugaca

SEQ ID NO: 338850 - RNA, 22 nt, Homo sapiens
uugcauaagugcauucugugau

SEQ ID NO: 338851 - RNA, 22 nt, Homo sapiens
uugcauaauaagagggauacgu

SEQ ID NO: 338852 - RNA, 22 nt, Homo sapiens
uugcauaauaagauuggggggg

SEQ ID NO: 338853 - RNA, 22 nt, Homo sapiens
uugcauauucucugaggcagga

SEQ ID NO: 338854 - RNA, 22 nt, Homo sapiens
uugcaugucugcuucuccuccu

SEQ ID NO: 338855 - RNA, 22 nt, Homo sapiens
uugcauugacacaugaagcuca

SEQ ID NO: 338856 - RNA, 22 nt, Homo sapiens
uugccauagugcugccagauau

SEQ ID NO: 338857 - RNA, 22 nt, Homo sapiens
uugcuaagucaagagaaaugau

SEQ ID NO: 338858 - RNA, 22 nt, Homo sapiens
uugcuacauugauugccucuuu

SEQ ID NO: 338859 - RNA, 22 nt, Homo sapiens
uugcuccccaggaaaggaagca

SEQ ID NO: 338860 - RNA, 22 nt, Homo sapiens
uugcuccucugccaggaccugu

SEQ ID NO: 338861 - RNA, 22 nt, Homo sapiens
uugcuuagucaugaaucacuga

SEQ ID NO: 338862 - RNA, 22 nt, Homo sapiens
uugcuucauucaacauugaggg

SEQ ID NO: 338863 - RNA, 22 nt, Homo sapiens
uuggaaaguuguuguaguuauu

SEQ ID NO: 338864 - RNA, 22 nt, Homo sapiens
uuggaaggcuccuaaugaaugg

SEQ ID NO: 338865 - RNA, 22 nt, Homo sapiens
uuggaagguaaucaaaaguucu

SEQ ID NO: 338866 - RNA, 22 nt, Homo sapiens
uuggaaugcaacagaaggauaa

SEQ ID NO: 338867 - RNA, 22 nt, Homo sapiens
uuggaauuaaccuggugcugga

SEQ ID NO: 338868 - RNA, 22 nt, Homo sapiens
uuggaauuaagagauauuuucu

SEQ ID NO: 338869 - RNA, 22 nt, Homo sapiens
uuggacuacagauuacuucauc

SEQ ID NO: 338870 - RNA, 22 nt, Homo sapiens
uuggagugugucuuauuccauu

SEQ ID NO: 338871 - RNA, 22 nt, Homo sapiens
uuggauauucaguuuuuccauc

SEQ ID NO: 338872 - RNA, 22 nt, Homo sapiens
uuggauuuuaacaaacuaggug

SEQ ID NO: 338873 - RNA, 22 nt, Homo sapiens
uuggcaaaugucacaaaucagg

SEQ ID NO: 338874 - RNA, 22 nt, Homo sapiens
uuggcagaaaaggucggggguu

SEQ ID NO: 338875 - RNA, 22 nt, Homo sapiens
uuggcagaguuaauuuguugag

SEQ ID NO: 338876 - RNA, 19 nt, Homo sapiens
uuggcagaguugcccccua

SEQ ID NO: 338877 - RNA, 22 nt, Homo sapiens
uuggcagcauuccagccaagca

SEQ ID NO: 338878 - RNA, 22 nt, Homo sapiens
uuggcagucugaggcacagacu

SEQ ID NO: 338879 - RNA, 22 nt, Homo sapiens
uuggcauuguggauggaaucau

SEQ ID NO: 338880 - RNA, 22 nt, Homo sapiens
uuggccccucccaaauuucaug

SEQ ID NO: 338881 - RNA, 22 nt, Homo sapiens
uuggccccuuucauccacagcu

SEQ ID NO: 338882 - RNA, 22 nt, Homo sapiens
uuggccuuucucuaaauacuuu

SEQ ID NO: 338883 - RNA, 22 nt, Homo sapiens
uuggcuuggagaguugaaaugu

SEQ ID NO: 338884 - RNA, 22 nt, Homo sapiens
uuggcuuguaaaaugaaaagcu

SEQ ID NO: 338885 - RNA, 22 nt, Homo sapiens
uugggauaaucacaaaguaaaa

SEQ ID NO: 338886 - RNA, 22 nt, Homo sapiens
uugggauggaaauuuguacccc

SEQ ID NO: 338887 - RNA, 22 nt, Homo sapiens
uugggauggaacuuuucaguga

SEQ ID NO: 338888 - RNA, 22 nt, Homo sapiens
uugggccacuuuaguuuccuua

SEQ ID NO: 338889 - RNA, 22 nt, Homo sapiens
uugguaccccugguguacuaau

SEQ ID NO: 338890 - RNA, 21 nt, Homo sapiens
uugguccacaugucauaguua

SEQ ID NO: 338891 - RNA, 22 nt, Homo sapiens
uugguccccuucaaccagcugu

SEQ ID NO: 338892 - RNA, 22 nt, Homo sapiens
uugguccucccaugcucaagag

SEQ ID NO: 338893 - RNA, 22 nt, Homo sapiens
uuggucuucuaauguaccuguu

SEQ ID NO: 338894 - RNA, 22 nt, Homo sapiens
uugguuccuuagccuaggacua

SEQ ID NO: 338895 - RNA, 22 nt, Homo sapiens
uugguucucuuagccaucuuaa

SEQ ID NO: 338896 - RNA, 22 nt, Homo sapiens
uuguaaaguucucucccgaaaa

SEQ ID NO: 338897 - RNA, 22 nt, Homo sapiens
uuguaacaguuuauugacucga

SEQ ID NO: 338898 - RNA, 22 nt, Homo sapiens
uuguacuagaaaauuauucuuu

SEQ ID NO: 338899 - RNA, 22 nt, Homo sapiens
uuguacuucagacaugccaaag

SEQ ID NO: 338900 - RNA, 22 nt, Homo sapiens
uuguacuuuuaguagagacggg

SEQ ID NO: 338901 - RNA, 22 nt, Homo sapiens
uuguauacucuauuuuagcagu

SEQ ID NO: 338902 - RNA, 22 nt, Homo sapiens
uuguauguuucugugcacauga

SEQ ID NO: 338903 - RNA, 22 nt, Homo sapiens
uugucacugcacuccagucugg

SEQ ID NO: 338904 - RNA, 22 nt, Homo sapiens
uugucauuuucagaguguuacg

SEQ ID NO: 338905 - RNA, 16 nt, Homo sapiens
uugucccuucccaaau

SEQ ID NO: 338906 - RNA, 19 nt, Homo sapiens
uugucuuagaguugucauu

SEQ ID NO: 338907 - RNA, 22 nt, Homo sapiens
uugugaauggugccucaguaaa

SEQ ID NO: 338908 - RNA, 22 nt, Homo sapiens
uugugagggagcuaagaugagu

SEQ ID NO: 338909 - RNA, 22 nt, Homo sapiens
aacccugagucaugagucuaga

SEQ ID NO: 338910 - RNA, 22 nt, Homo sapiens
aaccuauaguauugaaaucaag

SEQ ID NO: 338911 - RNA, 22 nt, Homo sapiens
aacugcauuuucugauugugug

SEQ ID NO: 338912 - RNA, 22 nt, Homo sapiens
aacugggcaagcauuacauggu

SEQ ID NO: 338913 - RNA, 19 nt, Homo sapiens
aacuggugugagaugauau

SEQ ID NO: 338914 - RNA, 22 nt, Homo sapiens
aagaccuaugcaggaagaaaug

SEQ ID NO: 338915 - RNA, 22 nt, Homo sapiens
aagagaacugacaguaccuggg

SEQ ID NO: 338916 - RNA, 18 nt, Homo sapiens
aagagcucagcacagguu

SEQ ID NO: 338917 - RNA, 22 nt, Homo sapiens
aagaggccuaggaaucuguauu

SEQ ID NO: 338918 - RNA, 23 nt, Homo sapiens
aagagguaugacuaugaagugga

SEQ ID NO: 338919 - RNA, 22 nt, Homo sapiens
aagaugauguuguguuuucacu

SEQ ID NO: 338920 - RNA, 19 nt, Homo sapiens
aagaugauguuugggcuaa

SEQ ID NO: 338921 - RNA, 22 nt, Homo sapiens
aagaugcagucauacuggagua

SEQ ID NO: 338922 - RNA, 22 nt, Homo sapiens
aagcacaauuucaccuucuugu

SEQ ID NO: 338923 - RNA, 22 nt, Homo sapiens
aagcacccagccucacgccugc

SEQ ID NO: 338924 - RNA, 22 nt, Homo sapiens
aagcacccuuugucuggacaug

SEQ ID NO: 338925 - RNA, 22 nt, Homo sapiens
aagcagauguguugaaaguacu

SEQ ID NO: 338926 - RNA, 22 nt, Homo sapiens
aagcaggugugggaggaaaugg

SEQ ID NO: 338927 - RNA, 22 nt, Homo sapiens
aagccacuguaccugucucuua

SEQ ID NO: 338928 - RNA, 22 nt, Homo sapiens
aagcccauuguaaguugaggag

SEQ ID NO: 338929 - RNA, 20 nt, Homo sapiens
aagcugaguguuuuuuuaau

SEQ ID NO: 338930 - RNA, 22 nt, Homo sapiens
aagcugccuugcugaggagaaa

SEQ ID NO: 338931 - RNA, 22 nt, Homo sapiens
aagcugguguguauuauucacu

SEQ ID NO: 338932 - RNA, 22 nt, Homo sapiens
aaggaagcuagcaggaauuggu

SEQ ID NO: 338933 - RNA, 22 nt, Homo sapiens
aaggaaguaauuugguuuauag

SEQ ID NO: 338934 - RNA, 22 nt, Homo sapiens
aaggaguaucuguuuucucacc

SEQ ID NO: 338935 - RNA, 22 nt, Homo sapiens
aaggcaagaagagaaccaucgg

SEQ ID NO: 338936 - RNA, 22 nt, Homo sapiens
aaggcaagguggauaaugaagc

SEQ ID NO: 338937 - RNA, 22 nt, Homo sapiens
aaggcagugugcacauaacacu

SEQ ID NO: 338938 - RNA, 22 nt, Homo sapiens
aaggcuauuugagaaugugugu

SEQ ID NO: 338939 - RNA, 22 nt, Homo sapiens
aaguaagcauccaauaaauguu

SEQ ID NO: 338940 - RNA, 22 nt, Homo sapiens
aaguaauggaguuauuuuauga

SEQ ID NO: 338941 - RNA, 22 nt, Homo sapiens
aaguauguaucaagucauacuu

SEQ ID NO: 338942 - RNA, 22 nt, Homo sapiens
aaguccccugacagaggggagg

SEQ ID NO: 338943 - RNA, 22 nt, Homo sapiens
aagugagaugcaguggaguucc

SEQ ID NO: 338944 - RNA, 20 nt, Homo sapiens
aagugaguguuaaacugaac

SEQ ID NO: 338945 - RNA, 20 nt, Homo sapiens
aagugcaucguugugucugc

SEQ ID NO: 338946 - RNA, 22 nt, Homo sapiens
aagugcauguauuaguguaguc

SEQ ID NO: 338947 - RNA, 22 nt, Homo sapiens
aagugccauguggaugggcccu

SEQ ID NO: 338948 - RNA, 22 nt, Homo sapiens
aagugcuguaugggagccuagg

SEQ ID NO: 338949 - RNA, 22 nt, Homo sapiens
aagugcuucagaagacaauauu

SEQ ID NO: 338950 - RNA, 20 nt, Homo sapiens
aagugcuuccuuuuagaggg

SEQ ID NO: 338951 - RNA, 22 nt, Homo sapiens
aaguggaauguuuguggcacaa

SEQ ID NO: 338952 - RNA, 17 nt, Homo sapiens
aaguggcuuguucacca

SEQ ID NO: 338953 - RNA, 19 nt, Homo sapiens
aagugguuuaaacuuguau

SEQ ID NO: 338954 - RNA, 22 nt, Homo sapiens
aagugguuuuuacaaagacaga

SEQ ID NO: 338955 - RNA, 22 nt, Homo sapiens
aauaaagcauggcuacuccaua

SEQ ID NO: 338956 - RNA, 20 nt, Homo sapiens
aauaacagccccagggaggu

SEQ ID NO: 338957 - RNA, 22 nt, Homo sapiens
aauaagaaguggaagggaccgg

SEQ ID NO: 338958 - RNA, 22 nt, Homo sapiens
aaucacaggucuuggcugcaug

SEQ ID NO: 338959 - RNA, 22 nt, Homo sapiens
aaucacuaugccaugaaguaca

SEQ ID NO: 338960 - RNA, 22 nt, Homo sapiens
aaucccuuuguccagucucuuu

SEQ ID NO: 338961 - RNA, 22 nt, Homo sapiens
aauccugucuugccauccaaua

SEQ ID NO: 338962 - RNA, 20 nt, Homo sapiens
aaucuacuugcccauuuagc

SEQ ID NO: 338963 - RNA, 22 nt, Homo sapiens
aaucugucuuuuguuauugagg

SEQ ID NO: 338964 - RNA, 22 nt, Homo sapiens
aaugacucugccuaaauuucac

SEQ ID NO: 338965 - RNA, 22 nt, Homo sapiens
aaugauauguuauguuuagguu

SEQ ID NO: 338966 - RNA, 22 nt, Homo sapiens
aaugcacauaaaauccuccagg

SEQ ID NO: 338967 - RNA, 22 nt, Homo sapiens
aaugcauaauuuguaugaggua

SEQ ID NO: 338968 - RNA, 22 nt, Homo sapiens
aauggcuucuuauugugguuca

SEQ ID NO: 338969 - RNA, 22 nt, Homo sapiens
aauggcuuuuaauauccauaau

SEQ ID NO: 338970 - RNA, 22 nt, Homo sapiens
aaugguguuuccguuaagcuga

SEQ ID NO: 338971 - RNA, 22 nt, Homo sapiens
aaugugccuacuggagcuugca

SEQ ID NO: 338972 - RNA, 22 nt, Homo sapiens
aaugugcuguucagaggagucc

SEQ ID NO: 338973 - RNA, 22 nt, Homo sapiens
aauuguacucccauaauucccu

SEQ ID NO: 338974 - RNA, 22 nt, Homo sapiens
aauuugucaccucucucccuuu

SEQ ID NO: 338975 - RNA, 22 nt, Homo sapiens
acaaaguaggcagugggcugga

SEQ ID NO: 338976 - RNA, 22 nt, Homo sapiens
acaagcacaaauuuaauccugu

SEQ ID NO: 338977 - RNA, 22 nt, Homo sapiens
acaauggaauggaguggaaagu

SEQ ID NO: 338978 - RNA, 22 nt, Homo sapiens
acacaguaagcacaguguagau

SEQ ID NO: 338979 - RNA, 22 nt, Homo sapiens
acacaugugaaaaaaauguuac

SEQ ID NO: 338980 - RNA, 22 nt, Homo sapiens
acacauuggcaauucuggagca

SEQ ID NO: 338981 - RNA, 22 nt, Homo sapiens
acaccuguggucccaguaacuu

SEQ ID NO: 338982 - RNA, 20 nt, Homo sapiens
acacugugcuaaggauuuuc

SEQ ID NO: 338983 - RNA, 22 nt, Homo sapiens
acagaacugggcuugcuuuugg

SEQ ID NO: 338984 - RNA, 19 nt, Homo sapiens
acagauagaauguucuaca

SEQ ID NO: 338985 - RNA, 22 nt, Homo sapiens
acagauagacauauauagcuca

SEQ ID NO: 338986 - RNA, 22 nt, Homo sapiens
acagaucagagauauuuagguu

SEQ ID NO: 338987 - RNA, 20 nt, Homo sapiens
acagcauagccuuuuaaagc

SEQ ID NO: 338988 - RNA, 22 nt, Homo sapiens
acaggagugggauuugaguccu

SEQ ID NO: 338989 - RNA, 22 nt, Homo sapiens
acaguacaugauaaauaaggua

SEQ ID NO: 338990 - RNA, 22 nt, Homo sapiens
acaguacuuuuggauuugugaa

SEQ ID NO: 338991 - RNA, 22 nt, Homo sapiens
acaguagugggcuacagaauca

SEQ ID NO: 338992 - RNA, 23 nt, Homo sapiens
acaguauguggauguggcuaagu

SEQ ID NO: 338993 - RNA, 20 nt, Homo sapiens
acaguauguuuggaugcaua

SEQ ID NO: 338994 - RNA, 18 nt, Homo sapiens
acagugcuggcaugagau

SEQ ID NO: 338995 - RNA, 22 nt, Homo sapiens
acagugcuuuuguuccucuccu

SEQ ID NO: 338996 - RNA, 18 nt, Homo sapiens
acagugucauggcucaau

SEQ ID NO: 338997 - RNA, 22 nt, Homo sapiens
augauauggucacccuuaugaa

SEQ ID NO: 338998 - RNA, 22 nt, Homo sapiens
augaucacaccacugcacucca

SEQ ID NO: 338999 - RNA, 22 nt, Homo sapiens
augaucuguagaacuaguccuu

SEQ ID NO: 339000 - RNA, 22 nt, Homo sapiens
augauucugaucuagagcuugg

SEQ ID NO: 339001 - RNA, 22 nt, Homo sapiens
augauuuuuguaucgccugaug

SEQ ID NO: 339002 - RNA, 22 nt, Homo sapiens
augcaagacaccacgugagaau

SEQ ID NO: 339003 - RNA, 22 nt, Homo sapiens
augcaauucuagauugauagua

SEQ ID NO: 339004 - RNA, 22 nt, Homo sapiens
augcacaugcgaaaacuugugu

SEQ ID NO: 339005 - RNA, 22 nt, Homo sapiens
augcacuguuguuauuggauaa

SEQ ID NO: 339006 - RNA, 22 nt, Homo sapiens
augcagagaaaucuaaaauaug

SEQ ID NO: 339007 - RNA, 22 nt, Homo sapiens
augcauagcaucugcaaauguu

SEQ ID NO: 339008 - RNA, 18 nt, Homo sapiens
augcauauuuuaaguugu

SEQ ID NO: 339009 - RNA, 22 nt, Homo sapiens
augccacugcacucuagccugg

SEQ ID NO: 339010 - RNA, 22 nt, Homo sapiens
augccauugcacuccagccugg

SEQ ID NO: 339011 - RNA, 22 nt, Homo sapiens
augcuggugguucacaugcgca

SEQ ID NO: 339012 - RNA, 22 nt, Homo sapiens
auggaagacuccucuuugggua

SEQ ID NO: 339013 - RNA, 22 nt, Homo sapiens
auggaaggagaggaaugaauga

SEQ ID NO: 339014 - RNA, 22 nt, Homo sapiens
auggaauggcacuuugaagauu

SEQ ID NO: 339015 - RNA, 22 nt, Homo sapiens
auggagguguggggagugaguu

SEQ ID NO: 339016 - RNA, 22 nt, Homo sapiens
auggaguguucugaauccuuug

SEQ ID NO: 339017 - RNA, 22 nt, Homo sapiens
auggauagucucacucacauac

SEQ ID NO: 339018 - RNA, 22 nt, Homo sapiens
auggauuuuggggccagaggca

SEQ ID NO: 339019 - RNA, 22 nt, Homo sapiens
auggcacagacucuuggucaag

SEQ ID NO: 339020 - RNA, 22 nt, Homo sapiens
auggcacagaguagaugcucaa

SEQ ID NO: 339021 - RNA, 22 nt, Homo sapiens
auggcacuaaguucaacacuua

SEQ ID NO: 339022 - RNA, 22 nt, Homo sapiens
auggcagaaucaagccgacagc

SEQ ID NO: 339023 - RNA, 22 nt, Homo sapiens
auggcaguguaugauuauauua

SEQ ID NO: 339024 - RNA, 22 nt, Homo sapiens
auggcaguuuauucuaaaucaa

SEQ ID NO: 339025 - RNA, 22 nt, Homo sapiens
auggcauggugcaggguuuaag

SEQ ID NO: 339026 - RNA, 22 nt, Homo sapiens
auggccauuacuaagaauguuu

SEQ ID NO: 339027 - RNA, 22 nt, Homo sapiens
auggcccccuguuugugaacau

SEQ ID NO: 339028 - RNA, 22 nt, Homo sapiens
auggcccugaguucaauauauu

SEQ ID NO: 339029 - RNA, 22 nt, Homo sapiens
auggcucuggauagaaugcagg

SEQ ID NO: 339030 - RNA, 22 nt, Homo sapiens
auggcucuguuccaugugucuu

SEQ ID NO: 339031 - RNA, 22 nt, Homo sapiens
auggcuuguuaugcauuaguac

SEQ ID NO: 339032 - RNA, 22 nt, Homo sapiens
auggcuuucaggacguggcgag

SEQ ID NO: 339033 - RNA, 22 nt, Homo sapiens
auggcuuuuuaaaucauguugu

SEQ ID NO: 339034 - RNA, 21 nt, Homo sapiens
augggacuaacugaugggucu

SEQ ID NO: 339035 - RNA, 22 nt, Homo sapiens
augggacugggugccguggagc

SEQ ID NO: 339036 - RNA, 22 nt, Homo sapiens
augggguagguagcucggggaa

SEQ ID NO: 339037 - RNA, 22 nt, Homo sapiens
augucauagauaaggaagugga

SEQ ID NO: 339038 - RNA, 22 nt, Homo sapiens
auguccauggaaucuguagcaa

SEQ ID NO: 339039 - RNA, 22 nt, Homo sapiens
augucuagagcaagagaugcug

SEQ ID NO: 339040 - RNA, 22 nt, Homo sapiens
augucuguuugcugagcccggc

SEQ ID NO: 339041 - RNA, 22 nt, Homo sapiens
augucuuucauagagacccaga

SEQ ID NO: 339042 - RNA, 22 nt, Homo sapiens
augugcaaagcacuguucagca

SEQ ID NO: 339043 - RNA, 22 nt, Homo sapiens
augugcaaaguuaagaucccag

SEQ ID NO: 339044 - RNA, 22 nt, Homo sapiens
augugcaauguguacguagccc

SEQ ID NO: 339045 - RNA, 22 nt, Homo sapiens
augugcagauguuacaaauugu

SEQ ID NO: 339046 - RNA, 20 nt, Homo sapiens
augugcaguguggcaaccaa

SEQ ID NO: 339047 - RNA, 22 nt, Homo sapiens
augugcauaugaagcacagaca

SEQ ID NO: 339048 - RNA, 22 nt, Homo sapiens
auguggaaagcagcaugauaug

SEQ ID NO: 339049 - RNA, 22 nt, Homo sapiens
auguggcauuucucauucauuu

SEQ ID NO: 339050 - RNA, 22 nt, Homo sapiens
auguggcuuuucaacuguguga

SEQ ID NO: 339051 - RNA, 22 nt, Homo sapiens
augugucaaaucuaggccaaag

SEQ ID NO: 339052 - RNA, 22 nt, Homo sapiens
auguuauguuaaugauaaugga

SEQ ID NO: 339053 - RNA, 22 nt, Homo sapiens
auguugcaguuuaauuauccua

SEQ ID NO: 339054 - RNA, 22 nt, Homo sapiens
auuaaggaguggguucauggug

SEQ ID NO: 339055 - RNA, 22 nt, Homo sapiens
auuaaguaaugguuccaauaau

SEQ ID NO: 339056 - RNA, 22 nt, Homo sapiens
auuaaguugugccugaaaacuu

SEQ ID NO: 339057 - RNA, 22 nt, Homo sapiens
auuacaugucuauccaugaaca

SEQ ID NO: 339058 - RNA, 22 nt, Homo sapiens
auuacuuugcaccaaccuaaua

SEQ ID NO: 339059 - RNA, 22 nt, Homo sapiens
auuauguuguauuuccuugcag

SEQ ID NO: 339060 - RNA, 23 nt, Homo sapiens
auucaaguagugagagugguuau

SEQ ID NO: 339061 - RNA, 20 nt, Homo sapiens
auucaaguaugccuugagaa

SEQ ID NO: 339062 - RNA, 22 nt, Homo sapiens
auucacagggggagaaggguau

SEQ ID NO: 339063 - RNA, 22 nt, Homo sapiens
auucacuuuuauagacaggucu

SEQ ID NO: 339064 - RNA, 22 nt, Homo sapiens
auuccacagccgauaccaugac

SEQ ID NO: 339065 - RNA, 22 nt, Homo sapiens
auuccauagugucuguggcaga

SEQ ID NO: 339066 - RNA, 22 nt, Homo sapiens
auugaacaugccauauguacca

SEQ ID NO: 339067 - RNA, 22 nt, Homo sapiens
auugauaguuuaauaggaauug

SEQ ID NO: 339068 - RNA, 19 nt, Homo sapiens
auugauuaaguuugcuguc

SEQ ID NO: 339069 - RNA, 18 nt, Homo sapiens
auugcacaccagccuggg

SEQ ID NO: 339070 - RNA, 22 nt, Homo sapiens
auugcacaucugcacuacagcc

SEQ ID NO: 339071 - RNA, 19 nt, Homo sapiens
auugcacuccaaccugggu

SEQ ID NO: 339072 - RNA, 22 nt, Homo sapiens
auugcacuccacccugggcaac

SEQ ID NO: 339073 - RNA, 23 nt, Homo sapiens
auugcacuccagccuaccugggc

SEQ ID NO: 339074 - RNA, 22 nt, Homo sapiens
auugcacuccagccuagguaac

SEQ ID NO: 339075 - RNA, 22 nt, Homo sapiens
auugcacuccagccuggcaaua

SEQ ID NO: 339076 - RNA, 22 nt, Homo sapiens
auugcacuccagccuggcagca

SEQ ID NO: 339077 - RNA, 22 nt, Homo sapiens
auugcacuccagccugggcuag

SEQ ID NO: 339078 - RNA, 22 nt, Homo sapiens
auugcacuccagccuggggaac

SEQ ID NO: 339079 - RNA, 22 nt, Homo sapiens
auugcacuccagccuugggcaa

SEQ ID NO: 339080 - RNA, 22 nt, Homo sapiens
auugcacuccagccuuggggau

SEQ ID NO: 339081 - RNA, 22 nt, Homo sapiens
auugcacuccagccuugugaca

SEQ ID NO: 339082 - RNA, 22 nt, Homo sapiens
auugcacuccagcuugggugac

SEQ ID NO: 339083 - RNA, 22 nt, Homo sapiens
auugcacuccauccugggcaau

SEQ ID NO: 339084 - RNA, 22 nt, Homo sapiens
auugcauaaacacauuucuuau

SEQ ID NO: 339085 - RNA, 22 nt, Homo sapiens
cuuuaguugucuccucaagggu

SEQ ID NO: 339086 - RNA, 22 nt, Homo sapiens
cuuucacacuguuggugggaau

SEQ ID NO: 339087 - RNA, 22 nt, Homo sapiens
cuuucugaggagaauagagaac

SEQ ID NO: 339088 - RNA, 21 nt, Homo sapiens
cuuugcacugcuccucagcuc

SEQ ID NO: 339089 - RNA, 18 nt, Homo sapiens
cuuugcagcuuccagagg

SEQ ID NO: 339090 - RNA, 20 nt, Homo sapiens
cuuuggugagucaacuccuu

SEQ ID NO: 339091 - RNA, 23 nt, Homo sapiens
cuuuguccccacccaaaucucau

SEQ ID NO: 339092 - RNA, 22 nt, Homo sapiens
cuuuuacacugguggugggaau

SEQ ID NO: 339093 - RNA, 22 nt, Homo sapiens
cuuuuacacuguuggcaggauu

SEQ ID NO: 339094 - RNA, 22 nt, Homo sapiens
cuuuuacacuguuggugggaau

SEQ ID NO: 339095 - RNA, 20 nt, Homo sapiens
cuuuuagcagcagcaagaga

SEQ ID NO: 339096 - RNA, 21 nt, Homo sapiens
cuuuugcacuccagccugggu

SEQ ID NO: 339097 - RNA, 22 nt, Homo sapiens
cuuuuggucuaucagagaagca

SEQ ID NO: 339098 - RNA, 22 nt, Homo sapiens
cuuuuggugugaagaagcucuu

SEQ ID NO: 339099 - RNA, 22 nt, Homo sapiens
cuuuuugcugcagcaauacugg

SEQ ID NO: 339100 - RNA, 20 nt, Homo sapiens
gaaacaucuauccucuccuu

SEQ ID NO: 339101 - RNA, 22 nt, Homo sapiens
gaaagugcugcaaggccaugca

SEQ ID NO: 339102 - RNA, 22 nt, Homo sapiens
gaaauguugauagugggcauug

SEQ ID NO: 339103 - RNA, 22 nt, Homo sapiens
gaacuggcuuagugaaacuucc

SEQ ID NO: 339104 - RNA, 22 nt, Homo sapiens
gaacuuguguugcuucacaugu

SEQ ID NO: 339105 - RNA, 22 nt, Homo sapiens
gaagaacuaggugagaucuaga

SEQ ID NO: 339106 - RNA, 22 nt, Homo sapiens
gaagauucaaccaaaccagaac

SEQ ID NO: 339107 - RNA, 22 nt, Homo sapiens
gaagcagcauucugguuuuugg

SEQ ID NO: 339108 - RNA, 22 nt, Homo sapiens
gaagguaguuuauagauguggu

SEQ ID NO: 339109 - RNA, 22 nt, Homo sapiens
gaaguaauaaauggauucuuaa

SEQ ID NO: 339110 - RNA, 23 nt, Homo sapiens
gaaguaauaaauggauucuuaac

SEQ ID NO: 339111 - RNA, 22 nt, Homo sapiens
gaauaaacuagagaggacugag

SEQ ID NO: 339112 - RNA, 22 nt, Homo sapiens
gaauacugacuauuucaucugg

SEQ ID NO: 339113 - RNA, 22 nt, Homo sapiens
gaauacuguccaagagugaugg

SEQ ID NO: 339114 - RNA, 22 nt, Homo sapiens
gaauagugcugcaaugaacaua

SEQ ID NO: 339115 - RNA, 22 nt, Homo sapiens
gaaucacagauuaugaguaucu

SEQ ID NO: 339116 - RNA, 22 nt, Homo sapiens
gaaucauuggguugauucaaga

SEQ ID NO: 339117 - RNA, 22 nt, Homo sapiens
gaaugaauguuuauccuuagau

SEQ ID NO: 339118 - RNA, 22 nt, Homo sapiens
gaaugcuaccagcaucuagugg

SEQ ID NO: 339119 - RNA, 22 nt, Homo sapiens
gaaugucuuauugcucguugua

SEQ ID NO: 339120 - RNA, 22 nt, Homo sapiens
gaauuguacugcaaucagggga

SEQ ID NO: 339121 - RNA, 22 nt, Homo sapiens
gacagugugauacuuagucuca

SEQ ID NO: 339122 - RNA, 22 nt, Homo sapiens
gaccuaggaggauugcuugagc

SEQ ID NO: 339123 - RNA, 18 nt, Homo sapiens
gacuccauuucagccaga

SEQ ID NO: 339124 - RNA, 22 nt, Homo sapiens
gagaacugagauaagugauauu

SEQ ID NO: 339125 - RNA, 22 nt, Homo sapiens
gagaagugcgucguuugaugau

SEQ ID NO: 339126 - RNA, 22 nt, Homo sapiens
gagaaugaacagacugccucuu

SEQ ID NO: 339127 - RNA, 22 nt, Homo sapiens
gagacugagucuugcucugucg

SEQ ID NO: 339128 - RNA, 22 nt, Homo sapiens
gagacugagucuugcuuuguca

SEQ ID NO: 339129 - RNA, 22 nt, Homo sapiens
gagagugaaguuugcuaccugu

SEQ ID NO: 339130 - RNA, 22 nt, Homo sapiens
gagauaaauaggucacaguucu

SEQ ID NO: 339131 - RNA, 22 nt, Homo sapiens
gagauacacccagugcagaggc

SEQ ID NO: 339132 - RNA, 22 nt, Homo sapiens
gagaugucuauuucagagaugu

SEQ ID NO: 339133 - RNA, 22 nt, Homo sapiens
gagaugugguucaaggguguuu

SEQ ID NO: 339134 - RNA, 22 nt, Homo sapiens
gagauuauuagauguucugcuu

SEQ ID NO: 339135 - RNA, 22 nt, Homo sapiens
ugaaauacuuaauuucuccaug

SEQ ID NO: 339136 - RNA, 22 nt, Homo sapiens
ugaaauaguuaaguugccuagu

SEQ ID NO: 339137 - RNA, 22 nt, Homo sapiens
ugaaaucauguaguuauugcaa

SEQ ID NO: 339138 - RNA, 22 nt, Homo sapiens
ugaaaucuaaaauguuccaaga

SEQ ID NO: 339139 - RNA, 22 nt, Homo sapiens
ugaaaugaucaguuugguuacu

SEQ ID NO: 339140 - RNA, 22 nt, Homo sapiens
ugaaaugcagaacuuuaggucu

SEQ ID NO: 339141 - RNA, 22 nt, Homo sapiens
ugaaaugccuuuaaugaauuua

SEQ ID NO: 339142 - RNA, 22 nt, Homo sapiens
ugaaauggugcggucugcagca

SEQ ID NO: 339143 - RNA, 22 nt, Homo sapiens
ugaaauguaaguugucuagucu

SEQ ID NO: 339144 - RNA, 22 nt, Homo sapiens
ugaaauguuaaacaaguggcuc

SEQ ID NO: 339145 - RNA, 22 nt, Homo sapiens
ugaaauuauucuuaccaaggug

SEQ ID NO: 339146 - RNA, 22 nt, Homo sapiens
ugaacacagccugccucugcca

SEQ ID NO: 339147 - RNA, 22 nt, Homo sapiens
ugaggcaagauacugauuucau

SEQ ID NO: 339148 - RNA, 22 nt, Homo sapiens
ugagguaaaacaaggauuggau

SEQ ID NO: 339149 - RNA, 22 nt, Homo sapiens
ugagguaauagauaauauuuuu

SEQ ID NO: 339150 - RNA, 22 nt, Homo sapiens
ugaggugagauggcuaccccaa

SEQ ID NO: 339151 - RNA, 22 nt, Homo sapiens
ugaguagagaauucagcuaagg

SEQ ID NO: 339152 - RNA, 22 nt, Homo sapiens
ugaguaugaguucaggaaaggc

SEQ ID NO: 339153 - RNA, 22 nt, Homo sapiens
ugagucuguuccaaagaaauaa

SEQ ID NO: 339154 - RNA, 22 nt, Homo sapiens
ugagugccuggagggcagggac

SEQ ID NO: 339155 - RNA, 22 nt, Homo sapiens
ugagugugaggaagaauuagaa

SEQ ID NO: 339156 - RNA, 22 nt, Homo sapiens
ugaguucuuccuaucucugccu

SEQ ID NO: 339157 - RNA, 22 nt, Homo sapiens
ugaguucuuuguagauucugug

SEQ ID NO: 339158 - RNA, 22 nt, Homo sapiens
ugauaagugagauagcaaguga

SEQ ID NO: 339159 - RNA, 22 nt, Homo sapiens
ugauauauugaaugaugaaaca

SEQ ID NO: 339160 - RNA, 22 nt, Homo sapiens
ugauauguaugugaccuagaaa

SEQ ID NO: 339161 - RNA, 17 nt, Homo sapiens
ugauauuuucccagaua

SEQ ID NO: 339162 - RNA, 22 nt, Homo sapiens
cuauuugcauucagaggcaugu

SEQ ID NO: 339163 - RNA, 21 nt, Homo sapiens
cucaaaguacugauauuacag

SEQ ID NO: 339164 - RNA, 22 nt, Homo sapiens
cucaaagucaagggaaagcagg

SEQ ID NO: 339165 - RNA, 18 nt, Homo sapiens
cucaaccucaugcagggc

SEQ ID NO: 339166 - RNA, 18 nt, Homo sapiens
cucacacccuaaucagga

SEQ ID NO: 339167 - RNA, 22 nt, Homo sapiens
cucaguagaaaauacauggacu

SEQ ID NO: 339168 - RNA, 22 nt, Homo sapiens
cucagucuaugauacuuugcua

SEQ ID NO: 339169 - RNA, 22 nt, Homo sapiens
cucaguguucccauucuaccuu

SEQ ID NO: 339170 - RNA, 22 nt, Homo sapiens
cucaguguuucagcugcucaga

SEQ ID NO: 339171 - RNA, 22 nt, Homo sapiens
cucaguuuugccuuguuuaagg

SEQ ID NO: 339172 - RNA, 22 nt, Homo sapiens
cuccaggugagguuaagggacu

SEQ ID NO: 339173 - RNA, 22 nt, Homo sapiens
cuccaguuucagaaucccaugu

SEQ ID NO: 339174 - RNA, 22 nt, Homo sapiens
cuccauuuaguccuuuuagaag

SEQ ID NO: 339175 - RNA, 22 nt, Homo sapiens
cuccauuuaucugaaauuuuau

SEQ ID NO: 339176 - RNA, 22 nt, Homo sapiens
cucccagagccaguuauaggcu

SEQ ID NO: 339177 - RNA, 22 nt, Homo sapiens
cucccuuugcugaauguuuuuc

SEQ ID NO: 339178 - RNA, 22 nt, Homo sapiens
cucugguuaaggcugaacuaua

SEQ ID NO: 339179 - RNA, 22 nt, Homo sapiens
cucuuagauuagccauccuaau

SEQ ID NO: 339180 - RNA, 22 nt, Homo sapiens
cucuuugaggugagcugcccau

SEQ ID NO: 339181 - RNA, 22 nt, Homo sapiens
cugaaaagcaucugcauagcug

SEQ ID NO: 339182 - RNA, 19 nt, Homo sapiens
cugaaacacagagagggcu

SEQ ID NO: 339183 - RNA, 22 nt, Homo sapiens
cugaauguuuucuucuauucug

SEQ ID NO: 339184 - RNA, 22 nt, Homo sapiens
cugagaucaugggucagguggu

SEQ ID NO: 339185 - RNA, 22 nt, Homo sapiens
cugaggguagaaggaucacuug

SEQ ID NO: 339186 - RNA, 22 nt, Homo sapiens
cugaggucugaauccagguauc

SEQ ID NO: 339187 - RNA, 22 nt, Homo sapiens
cugagguuaggaguuugagacc

SEQ ID NO: 339188 - RNA, 22 nt, Homo sapiens
cugauaaguuuuucuuuauaag

SEQ ID NO: 339189 - RNA, 22 nt, Homo sapiens
cugauugucuauuuaguucacu

SEQ ID NO: 339190 - RNA, 22 nt, Homo sapiens
cugcacugagacccucuuugcu

SEQ ID NO: 339191 - RNA, 22 nt, Homo sapiens
cugcaguaaccacuguaggugu

SEQ ID NO: 339192 - RNA, 22 nt, Homo sapiens
cugcauuagucuguuuaguguu

SEQ ID NO: 339193 - RNA, 18 nt, Homo sapiens
cugccagugugcucuccg

SEQ ID NO: 339194 - RNA, 22 nt, Homo sapiens
cuggaaagcaaguccauugcuc

SEQ ID NO: 339195 - RNA, 22 nt, Homo sapiens
cuggaagaaaaucacgccaucu

SEQ ID NO: 339196 - RNA, 22 nt, Homo sapiens
cuggaguuugaggcugcaguga

SEQ ID NO: 339197 - RNA, 22 nt, Homo sapiens
cuggauagagauugaugaugcu

SEQ ID NO: 339198 - RNA, 18 nt, Homo sapiens
cuggaugucgaguguguu

SEQ ID NO: 339199 - RNA, 22 nt, Homo sapiens
cuggcaaauguuuucuguaaag

SEQ ID NO: 339200 - RNA, 22 nt, Homo sapiens
cuggcaagaggauaaaguccua

SEQ ID NO: 339201 - RNA, 22 nt, Homo sapiens
cuggccagagacauucauuaaa

SEQ ID NO: 339202 - RNA, 22 nt, Homo sapiens
cuggcucugggcuaaagaaaua

SEQ ID NO: 339203 - RNA, 22 nt, Homo sapiens
cugggauggaggagaauuagag

SEQ ID NO: 339204 - RNA, 22 nt, Homo sapiens
cugguuguuacaaagagccugg

SEQ ID NO: 339205 - RNA, 22 nt, Homo sapiens
cuguaaaguucucauuguagcc

SEQ ID NO: 339206 - RNA, 22 nt, Homo sapiens
cugucacugggaggggcagcag

SEQ ID NO: 339207 - RNA, 22 nt, Homo sapiens
cugucuguuucaaaagugguua

SEQ ID NO: 339208 - RNA, 22 nt, Homo sapiens
cugugaucuuuuuucauguggu

SEQ ID NO: 339209 - RNA, 17 nt, Homo sapiens
cugugaugaucuugucu

SEQ ID NO: 339210 - RNA, 22 nt, Homo sapiens
cugugcuugauuauaugagugu

SEQ ID NO: 339211 - RNA, 23 nt, Homo sapiens
cuguggauaugaguuguaaaugg

SEQ ID NO: 339212 - RNA, 22 nt, Homo sapiens
cuguugcaguuauggcugcagg

SEQ ID NO: 339213 - RNA, 22 nt, Homo sapiens
cuguuugguaaggaugccucag

SEQ ID NO: 339214 - RNA, 22 nt, Homo sapiens
cuuaacagugguauugaugacc

SEQ ID NO: 339215 - RNA, 22 nt, Homo sapiens
cuuaaguaguuguggaaugaau

SEQ ID NO: 339216 - RNA, 22 nt, Homo sapiens
cuuacagucuaucagccacaac

SEQ ID NO: 339217 - RNA, 22 nt, Homo sapiens
cuuagcaaugucguguacucac

SEQ ID NO: 339218 - RNA, 22 nt, Homo sapiens
cuucaaaguuggcuaggagaca

SEQ ID NO: 339219 - RNA, 22 nt, Homo sapiens
cuucacuggagucccuggauuc

SEQ ID NO: 339220 - RNA, 22 nt, Homo sapiens
cuucacuuuguuaaacuccaau

SEQ ID NO: 339221 - RNA, 22 nt, Homo sapiens
cuuccugaguccugggcucaca

SEQ ID NO: 339222 - RNA, 22 nt, Homo sapiens
cuucuugagggccugcugggaa

SEQ ID NO: 339223 - RNA, 22 nt, Homo sapiens
cuugagcaaacaaaggugguag

SEQ ID NO: 339224 - RNA, 22 nt, Homo sapiens
cuugcacucagaagauucaguu

SEQ ID NO: 339225 - RNA, 22 nt, Homo sapiens
cuugcacuccacuguucuccug

SEQ ID NO: 339226 - RNA, 22 nt, Homo sapiens
cuugcauagaguuauugcccuu

SEQ ID NO: 339227 - RNA, 22 nt, Homo sapiens
cuugcauuuuggagaaugcuga

SEQ ID NO: 339228 - RNA, 19 nt, Homo sapiens
cuugccccauucauccucu

SEQ ID NO: 339229 - RNA, 22 nt, Homo sapiens
cuuggcacgugauagguguuga

SEQ ID NO: 339230 - RNA, 22 nt, Homo sapiens
cuuggcacugcucacccuccuu

SEQ ID NO: 339231 - RNA, 22 nt, Homo sapiens
cuugggccccacccaaaucuua

SEQ ID NO: 339232 - RNA, 22 nt, Homo sapiens
cuuggguaagucauuaaaauua

SEQ ID NO: 339233 - RNA, 22 nt, Homo sapiens
cuugguuacauuuuccuagaaa

SEQ ID NO: 339234 - RNA, 19 nt, Homo sapiens
cuuguacucggcgcaguug

SEQ ID NO: 339235 - RNA, 18 nt, Homo sapiens
cuugucaaaucuuuccuc

SEQ ID NO: 339236 - RNA, 22 nt, Homo sapiens
cuuuacaguuggacucacgagg

SEQ ID NO: 339237 - RNA, 22 nt, Homo sapiens
cuuuggcacuuccuaagugcca

SEQ ID NO: 339238 - RNA, 22 nt, Homo sapiens
cuuuggucaauugcugugggga

SEQ ID NO: 339239 - RNA, 23 nt, Homo sapiens
cuuuugcaaugugaucuugccac

SEQ ID NO: 339240 - RNA, 22 nt, Homo sapiens
cuuuugugauucuucaguuacu

SEQ ID NO: 339241 - RNA, 22 nt, Homo sapiens
cccaguuuugcuucucaugagg

SEQ ID NO: 339242 - RNA, 22 nt, Homo sapiens
ccccagguuucaauaaagccca

SEQ ID NO: 339243 - RNA, 17 nt, Homo sapiens
cccuaguagcugggacu

SEQ ID NO: 339244 - RNA, 23 nt, Homo sapiens
cccucagaagugcagggagagaa

SEQ ID NO: 339245 - RNA, 22 nt, Homo sapiens
cccuguguuuagcugaagguuu

SEQ ID NO: 339246 - RNA, 22 nt, Homo sapiens
cccuucauucaaggguugugag

SEQ ID NO: 339247 - RNA, 20 nt, Homo sapiens
ccuaguguucuuaggcugca

SEQ ID NO: 339248 - RNA, 19 nt, Homo sapiens
ccucaaguacuaauauguu

SEQ ID NO: 339249 - RNA, 21 nt, Homo sapiens
ccuccauuuguauucuugccc

SEQ ID NO: 339250 - RNA, 22 nt, Homo sapiens
ccucuuuguugagacuucacca

SEQ ID NO: 339251 - RNA, 21 nt, Homo sapiens
ccugaagaagugaccucugag

SEQ ID NO: 339252 - RNA, 22 nt, Homo sapiens
ccugagguagaguuuauauuga

SEQ ID NO: 339253 - RNA, 22 nt, Homo sapiens
ccugcauugucaaggccaagcc

SEQ ID NO: 339254 - RNA, 19 nt, Homo sapiens
ccugcuguucuuuugcacc

SEQ ID NO: 339255 - RNA, 22 nt, Homo sapiens
ccuggcaagagacugaagauag

SEQ ID NO: 339256 - RNA, 22 nt, Homo sapiens
ccuucacaggcacugguucaga

SEQ ID NO: 339257 - RNA, 22 nt, Homo sapiens
ccuuuguuuaguugaauuguau

SEQ ID NO: 339258 - RNA, 22 nt, Homo sapiens
cgccugagcugaggaagcugca

SEQ ID NO: 339259 - RNA, 22 nt, Homo sapiens
cgcuggugaucuagacccccaa

SEQ ID NO: 339260 - RNA, 22 nt, Homo sapiens
cgcuggugucuaagcgacagcu

SEQ ID NO: 339261 - RNA, 22 nt, Homo sapiens
cgugaggaaaacagaggguguu

SEQ ID NO: 339262 - RNA, 20 nt, Homo sapiens
cguugcacuccagccugggc

SEQ ID NO: 339263 - RNA, 22 nt, Homo sapiens
cuaaaacuuucugagugcagca

SEQ ID NO: 339264 - RNA, 22 nt, Homo sapiens
cuaaaugcacugucaaaggaag

SEQ ID NO: 339265 - RNA, 18 nt, Homo sapiens
cuaagacacuuggcagag

SEQ ID NO: 339266 - RNA, 17 nt, Homo sapiens
cuaaggcaagagucugc

SEQ ID NO: 339267 - RNA, 22 nt, Homo sapiens
cuaagugaguauaauuuuaaga

SEQ ID NO: 339268 - RNA, 22 nt, Homo sapiens
cuacagcacugagcugugugca

SEQ ID NO: 339269 - RNA, 22 nt, Homo sapiens
cuacagcagcccaguccccgaa

SEQ ID NO: 339270 - RNA, 22 nt, Homo sapiens
cuacagguaugaaagggaguau

SEQ ID NO: 339271 - RNA, 22 nt, Homo sapiens
cuacagugggucuguaguccuu

SEQ ID NO: 339272 - RNA, 22 nt, Homo sapiens
cuacugcacaucaucugaguua

SEQ ID NO: 339273 - RNA, 22 nt, Homo sapiens
cuagaagguaagagcuggaugc

SEQ ID NO: 339274 - RNA, 22 nt, Homo sapiens
cuagcacauaguuauucacuca

SEQ ID NO: 339275 - RNA, 22 nt, Homo sapiens
cuagcacauuuaucuuuauaca

SEQ ID NO: 339276 - RNA, 22 nt, Homo sapiens
cuagcagaacaauacaauucgg

SEQ ID NO: 339277 - RNA, 22 nt, Homo sapiens
cuagcagacaggcugggagcag

SEQ ID NO: 339278 - RNA, 22 nt, Homo sapiens
cuagcagacaugggcugaacca

SEQ ID NO: 339279 - RNA, 22 nt, Homo sapiens
cuauaacagugugguuuggaga

SEQ ID NO: 339280 - RNA, 22 nt, Homo sapiens
cuauauacugccugcugauuag

SEQ ID NO: 339281 - RNA, 21 nt, Homo sapiens
cuaucucaguguuuacauuug

SEQ ID NO: 339282 - RNA, 22 nt, Homo sapiens
cuaugagucugcagaucuauua

SEQ ID NO: 339283 - RNA, 22 nt, Homo sapiens
cuauggcucugguuauggcugu

SEQ ID NO: 339284 - RNA, 22 nt, Homo sapiens
cuauuagguuggugcaaaagua

SEQ ID NO: 339285 - RNA, 22 nt, Homo sapiens
cuauucacaauggugaagauau

SEQ ID NO: 339286 - RNA, 22 nt, Homo sapiens
cuauuugguuggugaaaaaagu

SEQ ID NO: 339287 - RNA, 22 nt, Homo sapiens
cucaaagugcugggauuggcca

SEQ ID NO: 339288 - RNA, 22 nt, Homo sapiens
cucacagucucucccuaauuuu

SEQ ID NO: 339289 - RNA, 22 nt, Homo sapiens
cucacggcccugcgcacuggca

SEQ ID NO: 339290 - RNA, 22 nt, Homo sapiens
cucagagcacaguuuaugacag

SEQ ID NO: 339291 - RNA, 22 nt, Homo sapiens
cucaggcacucugauuccagug

SEQ ID NO: 339292 - RNA, 20 nt, Homo sapiens
cucagugcacccccauaaaa

SEQ ID NO: 339293 - RNA, 22 nt, Homo sapiens
cuccauagucuucgaagaauga

SEQ ID NO: 339294 - RNA, 22 nt, Homo sapiens
cuccauuuggaacagauguccu

SEQ ID NO: 339295 - RNA, 22 nt, Homo sapiens
cucccacccucauuuuuaggca

SEQ ID NO: 339296 - RNA, 20 nt, Homo sapiens
cucccugacaaauguggaaa

SEQ ID NO: 339297 - RNA, 22 nt, Homo sapiens
cuccuggugauuggagugugaa

SEQ ID NO: 339298 - RNA, 22 nt, Homo sapiens
cuccuguagccccaucaucuuu

SEQ ID NO: 339299 - RNA, 22 nt, Homo sapiens
cucucugagccauggcugcccu

SEQ ID NO: 339300 - RNA, 22 nt, Homo sapiens
cucugagguuauucguaauauu

SEQ ID NO: 339301 - RNA, 22 nt, Homo sapiens
cucuuuuguuccuaguuugauc

SEQ ID NO: 339302 - RNA, 22 nt, Homo sapiens
cucuuuuguuuagcugagaggg

SEQ ID NO: 339303 - RNA, 22 nt, Homo sapiens
cugaaagagcauguaacacagu

SEQ ID NO: 339304 - RNA, 22 nt, Homo sapiens
cugaaaguuauucaggggcaag

SEQ ID NO: 339305 - RNA, 22 nt, Homo sapiens
cugaaauggaaugugugcacag

SEQ ID NO: 339306 - RNA, 22 nt, Homo sapiens
cugaauagagcacacugauggg

SEQ ID NO: 339307 - RNA, 22 nt, Homo sapiens
cugaaucauugguuaugaguac

SEQ ID NO: 339308 - RNA, 20 nt, Homo sapiens
cugaaugucaaggcagaggu

SEQ ID NO: 339309 - RNA, 22 nt, Homo sapiens
cugaauguucuggauggaagag

SEQ ID NO: 339310 - RNA, 22 nt, Homo sapiens
cugacaugcagccacugcaccu

SEQ ID NO: 339311 - RNA, 22 nt, Homo sapiens
cugacuaguuuuaaugcagauu

SEQ ID NO: 339312 - RNA, 22 nt, Homo sapiens
cugagacuggguaauguauaaa

SEQ ID NO: 339313 - RNA, 22 nt, Homo sapiens
cugagacuggugauuuaugaag

SEQ ID NO: 339314 - RNA, 22 nt, Homo sapiens
cugagagaggagcuaaaacugc

SEQ ID NO: 339315 - RNA, 22 nt, Homo sapiens
cugagaguugaugaaauauggu

SEQ ID NO: 339316 - RNA, 22 nt, Homo sapiens
cugagaucugaaccaggagugu

SEQ ID NO: 339317 - RNA, 22 nt, Homo sapiens
cugagauggagucucgcauugu

SEQ ID NO: 339318 - RNA, 22 nt, Homo sapiens
cugagauuuuuagauccuggcg

SEQ ID NO: 339319 - RNA, 22 nt, Homo sapiens
cugagcaaaaugaagacacgau

SEQ ID NO: 339320 - RNA, 22 nt, Homo sapiens
cugagcaaagaagugauaauga

SEQ ID NO: 339321 - RNA, 22 nt, Homo sapiens
cugagcaauauagugagaucuu

SEQ ID NO: 339322 - RNA, 22 nt, Homo sapiens
cugagcacugagauccucuagc

SEQ ID NO: 339323 - RNA, 22 nt, Homo sapiens
cugaggaaguucuuuaacaguu

SEQ ID NO: 339324 - RNA, 22 nt, Homo sapiens
cugagguaggcccugagaauau

SEQ ID NO: 339325 - RNA, 22 nt, Homo sapiens
cugagguaggugaucagugcuu

SEQ ID NO: 339326 - RNA, 22 nt, Homo sapiens
cugauaugaugggugauuuuca

SEQ ID NO: 339327 - RNA, 22 nt, Homo sapiens
cugauugucaucaauauuauua

SEQ ID NO: 339328 - RNA, 22 nt, Homo sapiens
cugauuguuugccucuaaaauc

SEQ ID NO: 339329 - RNA, 21 nt, Homo sapiens
cugcaaaugcugcugccugau

SEQ ID NO: 339330 - RNA, 22 nt, Homo sapiens
cugcaauggagaaagugagacu

SEQ ID NO: 339331 - RNA, 22 nt, Homo sapiens
gacaagagaacacugcuauauu

SEQ ID NO: 339332 - RNA, 22 nt, Homo sapiens
gacacagugaagucucuacuug

SEQ ID NO: 339333 - RNA, 22 nt, Homo sapiens
gacagguuuucuguuucugaaa

SEQ ID NO: 339334 - RNA, 18 nt, Homo sapiens
gacaguguggcaauuccu

SEQ ID NO: 339335 - RNA, 20 nt, Homo sapiens
gacaugacuaggagauagcc

SEQ ID NO: 339336 - RNA, 22 nt, Homo sapiens
gacauguaaggcucucucuguu

SEQ ID NO: 339337 - RNA, 22 nt, Homo sapiens
gacauguuucucucuguuuacu

SEQ ID NO: 339338 - RNA, 22 nt, Homo sapiens
gacauguuuucaagauuuauaa

SEQ ID NO: 339339 - RNA, 22 nt, Homo sapiens
gacauguuuucauguauuugga

SEQ ID NO: 339340 - RNA, 22 nt, Homo sapiens
gacuauaucaggaauggggauu

SEQ ID NO: 339341 - RNA, 22 nt, Homo sapiens
gacuuugguagaggaaaaaucu

SEQ ID NO: 339342 - RNA, 22 nt, Homo sapiens
gagaacuaaugauguacuaggc

SEQ ID NO: 339343 - RNA, 22 nt, Homo sapiens
gagaacugacauuaucguguau

SEQ ID NO: 339344 - RNA, 22 nt, Homo sapiens
gagaacuggcgugaacugcacg

SEQ ID NO: 339345 - RNA, 22 nt, Homo sapiens
gagaaugagaggggaaggccac

SEQ ID NO: 339346 - RNA, 23 nt, Homo sapiens
gagaccagcuucagaaagcacga

SEQ ID NO: 339347 - RNA, 22 nt, Homo sapiens
gagaccauuuacugccuacuua

SEQ ID NO: 339348 - RNA, 22 nt, Homo sapiens
gagacuaaagagcuugcccugg

SEQ ID NO: 339349 - RNA, 22 nt, Homo sapiens
gagagcauuaagccaucaucau

SEQ ID NO: 339350 - RNA, 21 nt, Homo sapiens
gagaggauucgccagccucuu

SEQ ID NO: 339351 - RNA, 22 nt, Homo sapiens
gagauauuuagaaauguguucu

SEQ ID NO: 339352 - RNA, 22 nt, Homo sapiens
gagaucaguuaaugaagugagc

SEQ ID NO: 339353 - RNA, 22 nt, Homo sapiens
gagaugaucaugugguuuuguc

SEQ ID NO: 339354 - RNA, 22 nt, Homo sapiens
gagauggaguuucacuucgcuc

SEQ ID NO: 339355 - RNA, 22 nt, Homo sapiens
gagaugugugugauuauauaau

SEQ ID NO: 339356 - RNA, 22 nt, Homo sapiens
gagauugucaugauuacauugu

SEQ ID NO: 339357 - RNA, 22 nt, Homo sapiens
gagcaaaaguauguauugguua

SEQ ID NO: 339358 - RNA, 22 nt, Homo sapiens
gagccuguaggaggagaggugg

SEQ ID NO: 339359 - RNA, 22 nt, Homo sapiens
gagcucaccuuaccucuggagc

SEQ ID NO: 339360 - RNA, 22 nt, Homo sapiens
gagcucauuguugcuaaagaga

SEQ ID NO: 339361 - RNA, 22 nt, Homo sapiens
gagcucguuuuugcugacucuu

SEQ ID NO: 339362 - RNA, 22 nt, Homo sapiens
gagcugaauugcugccauuugc

SEQ ID NO: 339363 - RNA, 22 nt, Homo sapiens
gagcugaucuuuucugauucca

SEQ ID NO: 339364 - RNA, 20 nt, Homo sapiens
gagcugguguacugccgggc

SEQ ID NO: 339365 - RNA, 22 nt, Homo sapiens
gaggcauuauucccaucuuaca

SEQ ID NO: 339366 - RNA, 22 nt, Homo sapiens
gagguaagagaauaaacaguuu

SEQ ID NO: 339367 - RNA, 22 nt, Homo sapiens
gagguaagaguuuuccauuucu

SEQ ID NO: 339368 - RNA, 22 nt, Homo sapiens
gagguaagaugauucguguccu

SEQ ID NO: 339369 - RNA, 22 nt, Homo sapiens
gagguaggaauaaacauuugaa

SEQ ID NO: 339370 - RNA, 22 nt, Homo sapiens
gagguaggggccuuaaagaugc

SEQ ID NO: 339371 - RNA, 22 nt, Homo sapiens
gagguagggucccacuauguug

SEQ ID NO: 339372 - RNA, 17 nt, Homo sapiens
gagguaguuuacuuuca

SEQ ID NO: 339373 - RNA, 22 nt, Homo sapiens
gagguguagucaugccaagauc

SEQ ID NO: 339374 - RNA, 22 nt, Homo sapiens
gaguauuuuacaucguguaauu

SEQ ID NO: 339375 - RNA, 22 nt, Homo sapiens
gagugcaagguuuuucugagug

SEQ ID NO: 339376 - RNA, 22 nt, Homo sapiens
gagugcaauggcaagaucuugg

SEQ ID NO: 339377 - RNA, 22 nt, Homo sapiens
gagugcaauggcaccgucucgg

SEQ ID NO: 339378 - RNA, 22 nt, Homo sapiens
gagugcaauggcaugaucuugg

SEQ ID NO: 339379 - RNA, 22 nt, Homo sapiens
gagugcaauggcgcgaucuggg

SEQ ID NO: 339380 - RNA, 17 nt, Homo sapiens
agucaguaguuuguauu

SEQ ID NO: 339381 - RNA, 21 nt, Homo sapiens
agucauaggaguacauaaugc

SEQ ID NO: 339382 - RNA, 22 nt, Homo sapiens
aguccagguuuuguaauggcaa

SEQ ID NO: 339383 - RNA, 22 nt, Homo sapiens
agucugguguucucacacuagu

SEQ ID NO: 339384 - RNA, 22 nt, Homo sapiens
agugaauguuggaaaguuauuu

SEQ ID NO: 339385 - RNA, 22 nt, Homo sapiens
agugcaauggugccaucauagc

SEQ ID NO: 339386 - RNA, 22 nt, Homo sapiens
agugcauuuguucugugucagg

SEQ ID NO: 339387 - RNA, 22 nt, Homo sapiens
agugccauggcugcuagauggc

SEQ ID NO: 339388 - RNA, 22 nt, Homo sapiens
aguggaaucuguuauacuaacu

SEQ ID NO: 339389 - RNA, 22 nt, Homo sapiens
agugguuuuaaguagagcauac

SEQ ID NO: 339390 - RNA, 22 nt, Homo sapiens
auaaacagcuuauccucuauuc

SEQ ID NO: 339391 - RNA, 22 nt, Homo sapiens
auaaagcuauuccucucuuuuu

SEQ ID NO: 339392 - RNA, 22 nt, Homo sapiens
auaaagguaagcacuauccuga

SEQ ID NO: 339393 - RNA, 22 nt, Homo sapiens
auaaaguguuuaguauaggcaa

SEQ ID NO: 339394 - RNA, 22 nt, Homo sapiens
auaaauaguaguugugguggcc

SEQ ID NO: 339395 - RNA, 22 nt, Homo sapiens
auaaaugcauugagaacugcug

SEQ ID NO: 339396 - RNA, 20 nt, Homo sapiens
auaaauguauagguguacau

SEQ ID NO: 339397 - RNA, 22 nt, Homo sapiens
auaaauucauuuaagcuccuua

SEQ ID NO: 339398 - RNA, 18 nt, Homo sapiens
auaaccuggugcuuucaa

SEQ ID NO: 339399 - RNA, 22 nt, Homo sapiens
auaagaagugaaccagacgucu

SEQ ID NO: 339400 - RNA, 22 nt, Homo sapiens
auaagauaguggaagugggauu

SEQ ID NO: 339401 - RNA, 22 nt, Homo sapiens
auaagucaauggaacagauuaa

SEQ ID NO: 339402 - RNA, 19 nt, Homo sapiens
auaagugaaucacgggggc

SEQ ID NO: 339403 - RNA, 22 nt, Homo sapiens
auaauacuuuuauuuugaggaa

SEQ ID NO: 339404 - RNA, 23 nt, Homo sapiens
auaaugcaaguggugguaaucug

SEQ ID NO: 339405 - RNA, 22 nt, Homo sapiens
auacacgugccauguuggugug

SEQ ID NO: 339406 - RNA, 22 nt, Homo sapiens
auacacguguauauguguaucu

SEQ ID NO: 339407 - RNA, 22 nt, Homo sapiens
auacagguauacaaugcauaau

SEQ ID NO: 339408 - RNA, 22 nt, Homo sapiens
auacaguauggagggcccagcu

SEQ ID NO: 339409 - RNA, 22 nt, Homo sapiens
auacuguacugaaguacccauu

SEQ ID NO: 339410 - RNA, 20 nt, Homo sapiens
auagaagacuagugcagcag

SEQ ID NO: 339411 - RNA, 22 nt, Homo sapiens
auagaaucaucugugcacuagu

SEQ ID NO: 339412 - RNA, 22 nt, Homo sapiens
auagauucauuugaggagauuu

SEQ ID NO: 339413 - RNA, 22 nt, Homo sapiens
auagcaauuugggaaucagacu

SEQ ID NO: 339414 - RNA, 22 nt, Homo sapiens
auagcagaacagugucucacug

SEQ ID NO: 339415 - RNA, 22 nt, Homo sapiens
auagcagaccaccucucccacu

SEQ ID NO: 339416 - RNA, 22 nt, Homo sapiens
auagcagugugaaaacagacua

SEQ ID NO: 339417 - RNA, 22 nt, Homo sapiens
auagcauaucccacaugucaga

SEQ ID NO: 339418 - RNA, 22 nt, Homo sapiens
auagcugcucaggcuuuccuca

SEQ ID NO: 339419 - RNA, 22 nt, Homo sapiens
uuggcagucugaggcacagacu

SEQ ID NO: 339420 - RNA, 23 nt, Homo sapiens
uuggcaucugggacacaagcuga

SEQ ID NO: 339421 - RNA, 22 nt, Homo sapiens
uugggacuggaaggaguaaggg

SEQ ID NO: 339422 - RNA, 22 nt, Homo sapiens
uuggucaggcuaaucucgaacg

SEQ ID NO: 339423 - RNA, 23 nt, Homo sapiens
uuggucucccaaaguguugagau

SEQ ID NO: 339424 - RNA, 22 nt, Homo sapiens
uuguacccuuucuaugaggcca

SEQ ID NO: 339425 - RNA, 22 nt, Homo sapiens
uuguacucucaccguaucccag

SEQ ID NO: 339426 - RNA, 22 nt, Homo sapiens
aggaccccucaucagcaccagu

SEQ ID NO: 339427 - RNA, 19 nt, Homo sapiens
aggacuaaagacuagaagu

SEQ ID NO: 339428 - RNA, 22 nt, Homo sapiens
aggagcacaauggucaugugga

SEQ ID NO: 339429 - RNA, 22 nt, Homo sapiens
aggagcacuggccuuggaguca

SEQ ID NO: 339430 - RNA, 22 nt, Homo sapiens
aggagcuuuggggaaaacagau

SEQ ID NO: 339431 - RNA, 21 nt, Homo sapiens
aggcaagacuuuuagguuugu

SEQ ID NO: 339432 - RNA, 21 nt, Homo sapiens
aggcaagauuacuuacgagca

SEQ ID NO: 339433 - RNA, 21 nt, Homo sapiens
aggcaagguguuauuauugaa

SEQ ID NO: 339434 - RNA, 22 nt, Homo sapiens
aggcacgguggcucacaccugu

SEQ ID NO: 339435 - RNA, 22 nt, Homo sapiens
aggcugguauuuacaaaagcuc

SEQ ID NO: 339436 - RNA, 22 nt, Homo sapiens
aggcuuuauuacagggucucag

SEQ ID NO: 339437 - RNA, 22 nt, Homo sapiens
aggcuuuuguuuuggucucagg

SEQ ID NO: 339438 - RNA, 22 nt, Homo sapiens
agguaagaugugacuugguguu

SEQ ID NO: 339439 - RNA, 22 nt, Homo sapiens
agguagucuuuuccuauuguca

SEQ ID NO: 339440 - RNA, 22 nt, Homo sapiens
aggucaccucaggaaauacuga

SEQ ID NO: 339441 - RNA, 21 nt, Homo sapiens
aggucaguaagaaugcagcac

SEQ ID NO: 339442 - RNA, 21 nt, Homo sapiens
aggucaugaagauguucuaau

SEQ ID NO: 339443 - RNA, 22 nt, Homo sapiens
aggugaaugcucacauucuaau

SEQ ID NO: 339444 - RNA, 22 nt, Homo sapiens
aggugcucuuccuguaggucac

SEQ ID NO: 339445 - RNA, 22 nt, Homo sapiens
aggugcugacaggauagguuuc

SEQ ID NO: 339446 - RNA, 22 nt, Homo sapiens
aggugguauuuaaaauuauuug

SEQ ID NO: 339447 - RNA, 22 nt, Homo sapiens
aggugguguuggguuccagccc

SEQ ID NO: 339448 - RNA, 22 nt, Homo sapiens
agguuguguuugugauuagaua

SEQ ID NO: 339449 - RNA, 22 nt, Homo sapiens
aguaacaggauccaaagaaugu

SEQ ID NO: 339450 - RNA, 22 nt, Homo sapiens
aguacaauguugaguagaagug

SEQ ID NO: 339451 - RNA, 22 nt, Homo sapiens
aguacacuguuaaaaagaagug

SEQ ID NO: 339452 - RNA, 23 nt, Homo sapiens
aguacuguaguaauugaggggaa

SEQ ID NO: 339453 - RNA, 22 nt, Homo sapiens
aguaucaagccacacaugguca

SEQ ID NO: 339454 - RNA, 22 nt, Homo sapiens
aguauugcuaauaagagauuug

SEQ ID NO: 339455 - RNA, 22 nt, Homo sapiens
agucaagauggcaagguaaggc

SEQ ID NO: 339456 - RNA, 22 nt, Homo sapiens
agucacagccuuuuacuuuaga

SEQ ID NO: 339457 - RNA, 22 nt, Homo sapiens
agucauggaucacaguagccuc

SEQ ID NO: 339458 - RNA, 19 nt, Homo sapiens
agucaugugaggacccuug

SEQ ID NO: 339459 - RNA, 22 nt, Homo sapiens
aguccauuugaugaugauucca

SEQ ID NO: 339460 - RNA, 22 nt, Homo sapiens
agugacaugggaucaaaucuga

SEQ ID NO: 339461 - RNA, 22 nt, Homo sapiens
agugcaauggcgugaucuuggc

SEQ ID NO: 339462 - RNA, 23 nt, Homo sapiens
aguggucuccugggcccagcugu

SEQ ID NO: 339463 - RNA, 22 nt, Homo sapiens
agugucaggagacagguagcug

SEQ ID NO: 339464 - RNA, 22 nt, Homo sapiens
aguugcaagucuugaguaaaga

SEQ ID NO: 339465 - RNA, 19 nt, Homo sapiens
auaaacuagaacugucccc

SEQ ID NO: 339466 - RNA, 22 nt, Homo sapiens
auaaaguagaggugaggugcau

SEQ ID NO: 339467 - RNA, 22 nt, Homo sapiens
auaaaugcuuagaucuguauau

SEQ ID NO: 339468 - RNA, 22 nt, Homo sapiens
auaaaugcuuccagucauuaaa

SEQ ID NO: 339469 - RNA, 22 nt, Homo sapiens
auaacagcauuauugcauacgu

SEQ ID NO: 339470 - RNA, 22 nt, Homo sapiens
auacaagcaguccaacuccaua

SEQ ID NO: 339471 - RNA, 22 nt, Homo sapiens
auacacgugccuuguuggugua

SEQ ID NO: 339472 - RNA, 22 nt, Homo sapiens
auacaguaucuucuggcaagca

SEQ ID NO: 339473 - RNA, 22 nt, Homo sapiens
auacccauacauauuggugacu

SEQ ID NO: 339474 - RNA, 22 nt, Homo sapiens
auacuaugagauaauaaagacu

SEQ ID NO: 339475 - RNA, 22 nt, Homo sapiens
auacuccugucucagcugagau

SEQ ID NO: 339476 - RNA, 22 nt, Homo sapiens
auagcaaugccccaauccuugg

SEQ ID NO: 339477 - RNA, 22 nt, Homo sapiens
auagcacaguguguguacacca

SEQ ID NO: 339478 - RNA, 22 nt, Homo sapiens
auagcacaugugcaaauggcug

SEQ ID NO: 339479 - RNA, 22 nt, Homo sapiens
auagcagaauuuggucaagucu

SEQ ID NO: 339480 - RNA, 22 nt, Homo sapiens
auagcagugccccaaacuccug

SEQ ID NO: 339481 - RNA, 22 nt, Homo sapiens
auagcuguccuuacuagcuagg

SEQ ID NO: 339482 - RNA, 21 nt, Homo sapiens
auagugcuagagaguagcagg

SEQ ID NO: 339483 - RNA, 22 nt, Homo sapiens
auagugcugcaacaaauauacg

SEQ ID NO: 339484 - RNA, 22 nt, Homo sapiens
auagugcugcaauaaacauaug

SEQ ID NO: 339485 - RNA, 22 nt, Homo sapiens
auagugcugcagucaauguacg

SEQ ID NO: 339486 - RNA, 22 nt, Homo sapiens
auagugcugcauuaaacauacg

SEQ ID NO: 339487 - RNA, 22 nt, Homo sapiens
auagugcuggaauaaauauacg

SEQ ID NO: 339488 - RNA, 22 nt, Homo sapiens
auagugcugugaugaacauaca

SEQ ID NO: 339489 - RNA, 19 nt, Homo sapiens
auaguguaggaaaacagcu

SEQ ID NO: 339490 - RNA, 19 nt, Homo sapiens
auauaacauccaggagcag

SEQ ID NO: 339491 - RNA, 22 nt, Homo sapiens
auauagcucuggcuggaugacu

SEQ ID NO: 339492 - RNA, 22 nt, Homo sapiens
auauaugcacacgugugcauau

SEQ ID NO: 339493 - RNA, 22 nt, Homo sapiens
auaucaagugacuggaguucca

SEQ ID NO: 339494 - RNA, 22 nt, Homo sapiens
auaucacucccaauaucgcagg

SEQ ID NO: 339495 - RNA, 22 nt, Homo sapiens
auaucccaguguguaaacacug

SEQ ID NO: 339496 - RNA, 20 nt, Homo sapiens
auaugcagacacauacauac

SEQ ID NO: 339497 - RNA, 22 nt, Homo sapiens
auaugcauacccucaccaacua

SEQ ID NO: 339498 - RNA, 22 nt, Homo sapiens
auaugcuuauuagcaagaaaua

SEQ ID NO: 339499 - RNA, 19 nt, Homo sapiens
auaugggguuugaacugug

SEQ ID NO: 339500 - RNA, 22 nt, Homo sapiens
auauguaguauggaaacauugu

SEQ ID NO: 339501 - RNA, 22 nt, Homo sapiens
auauguauuuuaacguguaagg

SEQ ID NO: 339502 - RNA, 22 nt, Homo sapiens
auaugucuauuauuagggcagg

SEQ ID NO: 339503 - RNA, 17 nt, Homo sapiens
auaugucugcuggggga

SEQ ID NO: 339504 - RNA, 22 nt, Homo sapiens
auaugugacuucaugcaaggcu

SEQ ID NO: 339505 - RNA, 18 nt, Homo sapiens
auauugccuucagacuag

SEQ ID NO: 339506 - RNA, 22 nt, Homo sapiens
auauuggucuucaagaccugug

SEQ ID NO: 339507 - RNA, 20 nt, Homo sapiens
aucaaagacuuagaggggga

SEQ ID NO: 339508 - RNA, 22 nt, Homo sapiens
aucaaagugaauuaaugagaau

SEQ ID NO: 339509 - RNA, 22 nt, Homo sapiens
aucacaggcaaaauuccuucuc

SEQ ID NO: 339510 - RNA, 22 nt, Homo sapiens
aucacaggucaaaucauuauuu

SEQ ID NO: 339511 - RNA, 22 nt, Homo sapiens
aucacaguuauaacauccuuuu

SEQ ID NO: 339512 - RNA, 22 nt, Homo sapiens
agcuguuguuaauuaacucauu

SEQ ID NO: 339513 - RNA, 20 nt, Homo sapiens
agcuguuguuaugagguuua

SEQ ID NO: 339514 - RNA, 22 nt, Homo sapiens
agcuguuuuugugggcauguga

SEQ ID NO: 339515 - RNA, 22 nt, Homo sapiens
aggaaucuaagguaucagguua

SEQ ID NO: 339516 - RNA, 22 nt, Homo sapiens
aggaaugucaaugguaguuuaa

SEQ ID NO: 339517 - RNA, 22 nt, Homo sapiens
uugucaacaugaaacuguguuu

SEQ ID NO: 339518 - RNA, 22 nt, Homo sapiens
uugucacauggggcggcugccc

SEQ ID NO: 339519 - RNA, 22 nt, Homo sapiens
uugucacccucucuuggugucu

SEQ ID NO: 339520 - RNA, 23 nt, Homo sapiens
uuguccccuccaaagcucauguu

SEQ ID NO: 339521 - RNA, 19 nt, Homo sapiens
uuguccccucuaaaucuca

SEQ ID NO: 339522 - RNA, 22 nt, Homo sapiens
uuguccccuuccaaaucucaug

SEQ ID NO: 339523 - RNA, 22 nt, Homo sapiens
uugugaagaaaccagaaaaguu

SEQ ID NO: 339524 - RNA, 22 nt, Homo sapiens
uugugaagaugugaagcaagca

SEQ ID NO: 339525 - RNA, 22 nt, Homo sapiens
uugugaucauugucaaauagug

SEQ ID NO: 339526 - RNA, 22 nt, Homo sapiens
uugugccauucuucugccucag

SEQ ID NO: 339527 - RNA, 22 nt, Homo sapiens
uugugcuucaucaccuagcaga

SEQ ID NO: 339528 - RNA, 19 nt, Homo sapiens
uugugggaggacagagggg

SEQ ID NO: 339529 - RNA, 22 nt, Homo sapiens
uugugggaggugauuagaucau

SEQ ID NO: 339530 - RNA, 22 nt, Homo sapiens
uuguguacuacaguaugccaca

SEQ ID NO: 339531 - RNA, 22 nt, Homo sapiens
uuguuauguaucucaagauaaa

SEQ ID NO: 339532 - RNA, 22 nt, Homo sapiens
uuguuuagagacuggaauuaaa

SEQ ID NO: 339533 - RNA, 22 nt, Homo sapiens
uuuaaagcacggaguuuguggc

SEQ ID NO: 339534 - RNA, 18 nt, Homo sapiens
uuuacaguagaaggacuu

SEQ ID NO: 339535 - RNA, 22 nt, Homo sapiens
uuuacagucuuuugugugaguc

SEQ ID NO: 339536 - RNA, 22 nt, Homo sapiens
uuuacugugggguuucuuagag

SEQ ID NO: 339537 - RNA, 22 nt, Homo sapiens
uuuauccagccucuagcaaggu

SEQ ID NO: 339538 - RNA, 22 nt, Homo sapiens
uuuaugcuacauguguuggaaa

SEQ ID NO: 339539 - RNA, 22 nt, Homo sapiens
uuuauggagagauauuuauggu

SEQ ID NO: 339540 - RNA, 22 nt, Homo sapiens
uuuaugguuuucugggagauug

SEQ ID NO: 339541 - RNA, 22 nt, Homo sapiens
uuuaugucuguacaucgggcgg

SEQ ID NO: 339542 - RNA, 22 nt, Homo sapiens
uuucaggcagggagcuucagug

SEQ ID NO: 339543 - RNA, 16 nt, Homo sapiens
uuucaucaguuuuaau

SEQ ID NO: 339544 - RNA, 23 nt, Homo sapiens
uuucauggggauuuacucauucc

SEQ ID NO: 339545 - RNA, 22 nt, Homo sapiens
uuucauguuuuucugugaggca

SEQ ID NO: 339546 - RNA, 22 nt, Homo sapiens
uuucugugguccucuugaaggu

SEQ ID NO: 339547 - RNA, 22 nt, Homo sapiens
uuugacacugggagugugggug

SEQ ID NO: 339548 - RNA, 22 nt, Homo sapiens
uuugagaucuuuagaaucaggc

SEQ ID NO: 339549 - RNA, 22 nt, Homo sapiens
uuugagcaagaggugacauuau

SEQ ID NO: 339550 - RNA, 22 nt, Homo sapiens
uuugaguaggcuuauauuuugg

SEQ ID NO: 339551 - RNA, 22 nt, Homo sapiens
uuugauguccaccucagcccac

SEQ ID NO: 339552 - RNA, 22 nt, Homo sapiens
uuugcacauauuugggcaaaag

SEQ ID NO: 339553 - RNA, 22 nt, Homo sapiens
uuugcacuggagauucaauggg

SEQ ID NO: 339554 - RNA, 22 nt, Homo sapiens
uuugcaguguaguuggccagca

SEQ ID NO: 339555 - RNA, 22 nt, Homo sapiens
uuugccaauauuuuacugagga

SEQ ID NO: 339556 - RNA, 22 nt, Homo sapiens
uuugcuugaggucuagcuaccc

SEQ ID NO: 339557 - RNA, 22 nt, Homo sapiens
uuugcuuguguaaaaaucugga

SEQ ID NO: 339558 - RNA, 22 nt, Homo sapiens
uuuggccauguuggucaggcug

SEQ ID NO: 339559 - RNA, 22 nt, Homo sapiens
uuugggccaugcuucccgguca

SEQ ID NO: 339560 - RNA, 22 nt, Homo sapiens
uuuggguuaguuuuccaaucuu

SEQ ID NO: 339561 - RNA, 22 nt, Homo sapiens
uuuggucacugccgccgccagc

SEQ ID NO: 339562 - RNA, 18 nt, Homo sapiens
uuugguccuuuauaaaca

SEQ ID NO: 339563 - RNA, 22 nt, Homo sapiens
uuugguguauaaaaaugcuagu

SEQ ID NO: 339564 - RNA, 22 nt, Homo sapiens
uuuguacacuguuggugguuau

SEQ ID NO: 339565 - RNA, 22 nt, Homo sapiens
uuuguacuaugguuuuucacua

SEQ ID NO: 339566 - RNA, 22 nt, Homo sapiens
uuuguacuugaagaaucuuuau

SEQ ID NO: 339567 - RNA, 22 nt, Homo sapiens
uuugucacucuuggagguuguu

SEQ ID NO: 339568 - RNA, 22 nt, Homo sapiens
uuuguccccgcccagaucucau

SEQ ID NO: 339569 - RNA, 19 nt, Homo sapiens
uuuguccugcccuuucuca

SEQ ID NO: 339570 - RNA, 22 nt, Homo sapiens
uuugugcuccucucaguaugug

SEQ ID NO: 339571 - RNA, 22 nt, Homo sapiens
uuugugugugauuauaaaaggu

SEQ ID NO: 339572 - RNA, 22 nt, Homo sapiens
uuuguucaccucaaggauggga

SEQ ID NO: 339573 - RNA, 22 nt, Homo sapiens
uuuuacacuucgguugugugca

SEQ ID NO: 339574 - RNA, 22 nt, Homo sapiens
uuuucaguggccauaguggaga

SEQ ID NO: 339575 - RNA, 22 nt, Homo sapiens
uuuugcacuagaaccagagguu

SEQ ID NO: 339576 - RNA, 17 nt, Homo sapiens
uuuuggauuagaaaucc

SEQ ID NO: 339577 - RNA, 22 nt, Homo sapiens
uuuuggcuagaaauauaccucc

SEQ ID NO: 339578 - RNA, 22 nt, Homo sapiens
uuuuugaguagcuggagagcag

SEQ ID NO: 339579 - RNA, 22 nt, Homo sapiens
aucacugggauggaacugcuga

SEQ ID NO: 339580 - RNA, 22 nt, Homo sapiens
aucacugggcaagauaucauga

SEQ ID NO: 339581 - RNA, 22 nt, Homo sapiens
aucacuguuuugaugcucggac

SEQ ID NO: 339582 - RNA, 16 nt, Homo sapiens
aucacuugcuucuuuu

SEQ ID NO: 339583 - RNA, 22 nt, Homo sapiens
aucagaaucucuagugggacca

SEQ ID NO: 339584 - RNA, 23 nt, Homo sapiens
aucagauaguuguagguaugugg

SEQ ID NO: 339585 - RNA, 22 nt, Homo sapiens
aucagcagcaugaaaagcaacu

SEQ ID NO: 339586 - RNA, 22 nt, Homo sapiens
aucaggaaccuuuuuggugugu

SEQ ID NO: 339587 - RNA, 18 nt, Homo sapiens
aucagggugaagagagga

SEQ ID NO: 339588 - RNA, 22 nt, Homo sapiens
aucauaucauuggugaacagug

SEQ ID NO: 339589 - RNA, 22 nt, Homo sapiens
auccaagagacugaugacuucc

SEQ ID NO: 339590 - RNA, 22 nt, Homo sapiens
auccagaugggcuuaauguaau

SEQ ID NO: 339591 - RNA, 22 nt, Homo sapiens
auccauguggauaaauguguau

SEQ ID NO: 339592 - RNA, 22 nt, Homo sapiens
aucccugagaacuuuuaauguu

SEQ ID NO: 339593 - RNA, 22 nt, Homo sapiens
aucccugagccugacucucaga

SEQ ID NO: 339594 - RNA, 22 nt, Homo sapiens
aucccuuccuagcacuuggugu

SEQ ID NO: 339595 - RNA, 22 nt, Homo sapiens
aucccuuucugauacuuucccu

SEQ ID NO: 339596 - RNA, 21 nt, Homo sapiens
auccuucuuuuucaaccugug

SEQ ID NO: 339597 - RNA, 22 nt, Homo sapiens
aucgcaauguuuagaauuuugu

SEQ ID NO: 339598 - RNA, 22 nt, Homo sapiens
aucuagagaggcagucuggccg

SEQ ID NO: 339599 - RNA, 21 nt, Homo sapiens
aucucacuugaauguaaaagc

SEQ ID NO: 339600 - RNA, 22 nt, Homo sapiens
aucucaguuaauuccaucuuuc

SEQ ID NO: 339601 - RNA, 22 nt, Homo sapiens
aucuccaggugccagcugcgcc

SEQ ID NO: 339602 - RNA, 22 nt, Homo sapiens
aucuguagauucagcacaagcu

SEQ ID NO: 339603 - RNA, 22 nt, Homo sapiens
aucugugaaugaaguuauuuug

SEQ ID NO: 339604 - RNA, 22 nt, Homo sapiens
aucuguguuuaaggucccagaa

SEQ ID NO: 339605 - RNA, 22 nt, Homo sapiens
augaaaagcauaaacgcugaag

SEQ ID NO: 339606 - RNA, 22 nt, Homo sapiens
augaaagugauaaaugucucua

SEQ ID NO: 339607 - RNA, 22 nt, Homo sapiens
augaagcuagcugauugcugau

SEQ ID NO: 339608 - RNA, 22 nt, Homo sapiens
augaauacugcugcaaugaaca

SEQ ID NO: 339609 - RNA, 22 nt, Homo sapiens
augagagcuaacuguggguaca

SEQ ID NO: 339610 - RNA, 22 nt, Homo sapiens
augagagcugacuuuaaggcaa

SEQ ID NO: 339611 - RNA, 22 nt, Homo sapiens
augagaucaaauuuaagcuguu

SEQ ID NO: 339612 - RNA, 22 nt, Homo sapiens
augagaucugugaacaccuguc

SEQ ID NO: 339613 - RNA, 22 nt, Homo sapiens
augagcagaagagauacacugu

SEQ ID NO: 339614 - RNA, 22 nt, Homo sapiens
augaggcaggaaaggcguaucu

SEQ ID NO: 339615 - RNA, 22 nt, Homo sapiens
augagggaagcucacgugucca

SEQ ID NO: 339616 - RNA, 22 nt, Homo sapiens
augagggcggacgcccuggaga

SEQ ID NO: 339617 - RNA, 20 nt, Homo sapiens
augagguguaugacacugaa

SEQ ID NO: 339618 - RNA, 19 nt, Homo sapiens
augagucugcaagaaccag

SEQ ID NO: 339619 - RNA, 22 nt, Homo sapiens
augauagucuugagaagcauuu

SEQ ID NO: 339620 - RNA, 22 nt, Homo sapiens
augaucacuguggaaauucagc

SEQ ID NO: 339621 - RNA, 22 nt, Homo sapiens
augaucaucugaaagcuuuuac

SEQ ID NO: 339622 - RNA, 22 nt, Homo sapiens
augaugaaguaagugcuuagga

SEQ ID NO: 339623 - RNA, 22 nt, Homo sapiens
augauguguguuuaagaugucu

SEQ ID NO: 339624 - RNA, 22 nt, Homo sapiens
augauucugaucuagagcuugg

SEQ ID NO: 339625 - RNA, 19 nt, Homo sapiens
augauugucuauggaggaa

SEQ ID NO: 339626 - RNA, 22 nt, Homo sapiens
augcaauucuagauugauagua

SEQ ID NO: 339627 - RNA, 22 nt, Homo sapiens
augcagugugcaacagauuaag

SEQ ID NO: 339628 - RNA, 19 nt, Homo sapiens
augccuggagaugguuaua

SEQ ID NO: 339629 - RNA, 22 nt, Homo sapiens
augcuacauucuacaauuaggc

SEQ ID NO: 339630 - RNA, 22 nt, Homo sapiens
augcuacuggauuuguauaaau

SEQ ID NO: 339631 - RNA, 22 nt, Homo sapiens
augcuuguguuggggcagugga

SEQ ID NO: 339632 - RNA, 22 nt, Homo sapiens
auggaagaaaguuggguucuug

SEQ ID NO: 339633 - RNA, 22 nt, Homo sapiens
auggagagaauuauucucucag

SEQ ID NO: 339634 - RNA, 22 nt, Homo sapiens
auggagugagaauggagguucc

SEQ ID NO: 339635 - RNA, 22 nt, Homo sapiens
auggcagcugacacuuccgucu

SEQ ID NO: 339636 - RNA, 22 nt, Homo sapiens
auggcaucgucaccuuuucagu

SEQ ID NO: 339637 - RNA, 20 nt, Homo sapiens
auggcccugcugggaguguc

SEQ ID NO: 339638 - RNA, 22 nt, Homo sapiens
auggccuuucuggcacauuucc

SEQ ID NO: 339639 - RNA, 22 nt, Homo sapiens
auggcucaguguguaucuauca

SEQ ID NO: 339640 - RNA, 22 nt, Homo sapiens
auggcuuaagacaaccuuucau

SEQ ID NO: 339641 - RNA, 22 nt, Homo sapiens
auggcuuuaagagugucugaau

SEQ ID NO: 339642 - RNA, 22 nt, Homo sapiens
auggcuuuggucucccagugau

SEQ ID NO: 339643 - RNA, 22 nt, Homo sapiens
auggcuuuuauuguguugaggu

SEQ ID NO: 339644 - RNA, 22 nt, Homo sapiens
auggcuuuucacagaggguucu

SEQ ID NO: 339645 - RNA, 21 nt, Homo sapiens
augggguagaagagaaggcuu

SEQ ID NO: 339646 - RNA, 22 nt, Homo sapiens
augggguaggcuugcuguagua

SEQ ID NO: 339647 - RNA, 22 nt, Homo sapiens
augggugaguaugaguugacuu

SEQ ID NO: 339648 - RNA, 21 nt, Homo sapiens
augguacugucucuggagaua

SEQ ID NO: 339649 - RNA, 22 nt, Homo sapiens
auggucuuuauuguguugagug

SEQ ID NO: 339650 - RNA, 17 nt, Homo sapiens
auguaauccucaucucu

SEQ ID NO: 339651 - RNA, 22 nt, Homo sapiens
auguaauguuaaauugcuaauu

SEQ ID NO: 339652 - RNA, 22 nt, Homo sapiens
auguauggcagguuugggguuu

SEQ ID NO: 339653 - RNA, 22 nt, Homo sapiens
augucaaggugaagaaagauca

SEQ ID NO: 339654 - RNA, 20 nt, Homo sapiens
augucagaguguggguacgg

SEQ ID NO: 339655 - RNA, 22 nt, Homo sapiens
augucuguuugcugagcccggc

SEQ ID NO: 339656 - RNA, 22 nt, Homo sapiens
augucuuucauagagacccaga

SEQ ID NO: 339657 - RNA, 22 nt, Homo sapiens
augugaacugaauuaauucaca

SEQ ID NO: 339658 - RNA, 22 nt, Homo sapiens
augugacuggaucauggggacg

SEQ ID NO: 339659 - RNA, 22 nt, Homo sapiens
augugcaaagcacuguucagca

SEQ ID NO: 339660 - RNA, 22 nt, Homo sapiens
augugcaauggugucaccacau

SEQ ID NO: 339661 - RNA, 22 nt, Homo sapiens
augugcacaugcuuacauguga

SEQ ID NO: 339662 - RNA, 22 nt, Homo sapiens
augugcaugcuguucugccaga

SEQ ID NO: 339663 - RNA, 22 nt, Homo sapiens
auguggcacuugacuuucucgc

SEQ ID NO: 339664 - RNA, 22 nt, Homo sapiens
auguggcauuucucauucauuu

SEQ ID NO: 339665 - RNA, 22 nt, Homo sapiens
augugugaaucccagaaccugu

SEQ ID NO: 339666 - RNA, 22 nt, Homo sapiens
uuuccuggagaaucuuaacaaa

SEQ ID NO: 339667 - RNA, 22 nt, Homo sapiens
uuucuacagugaacgauuucua

SEQ ID NO: 339668 - RNA, 16 nt, Homo sapiens
uuucuauguuuuacua

SEQ ID NO: 339669 - RNA, 22 nt, Homo sapiens
uuucugaggccucaccagaagc

SEQ ID NO: 339670 - RNA, 22 nt, Homo sapiens
uuucugcuugagagaauugcug

SEQ ID NO: 339671 - RNA, 22 nt, Homo sapiens
uuugacaaugugugcuuguauu

SEQ ID NO: 339672 - RNA, 22 nt, Homo sapiens
uuugagauaucuuccaucagua

SEQ ID NO: 339673 - RNA, 22 nt, Homo sapiens
uuugagcauuagggcaaaggca

SEQ ID NO: 339674 - RNA, 22 nt, Homo sapiens
uuugagcuagagucucacucug

SEQ ID NO: 339675 - RNA, 21 nt, Homo sapiens
uuugaucauuaaaagugaauc

SEQ ID NO: 339676 - RNA, 22 nt, Homo sapiens
uuugauugguguaccugaaagu

SEQ ID NO: 339677 - RNA, 20 nt, Homo sapiens
uuugcagaaucuaagaagag

SEQ ID NO: 339678 - RNA, 22 nt, Homo sapiens
uuugcagagacuuguuaggaau

SEQ ID NO: 339679 - RNA, 22 nt, Homo sapiens
uuugcauaauaagauuagggug

SEQ ID NO: 339680 - RNA, 19 nt, Homo sapiens
uuugcauagugagaauaua

SEQ ID NO: 339681 - RNA, 21 nt, Homo sapiens
uuugcauauguugaaccagcc

SEQ ID NO: 339682 - RNA, 22 nt, Homo sapiens
uuugcaugcuccuuaugagaau

SEQ ID NO: 339683 - RNA, 22 nt, Homo sapiens
uuuggcagaaaacaagaaucug

SEQ ID NO: 339684 - RNA, 22 nt, Homo sapiens
uuugguaguuuguugggaccca

SEQ ID NO: 339685 - RNA, 22 nt, Homo sapiens
uuugguugcauucacauauuuc

SEQ ID NO: 339686 - RNA, 22 nt, Homo sapiens
uuuguacacuguugguaggauu

SEQ ID NO: 339687 - RNA, 22 nt, Homo sapiens
uuuguacuugaaacccagggcc

SEQ ID NO: 339688 - RNA, 22 nt, Homo sapiens
uuuguagcuacaaagugagaug

SEQ ID NO: 339689 - RNA, 22 nt, Homo sapiens
uuuguagcucacucugagcuga

SEQ ID NO: 339690 - RNA, 21 nt, Homo sapiens
uuuguaguagcaugauuuaua

SEQ ID NO: 339691 - RNA, 22 nt, Homo sapiens
uuugugagguggauagauugca

SEQ ID NO: 339692 - RNA, 22 nt, Homo sapiens
uuugugauugcacacucaagau

SEQ ID NO: 339693 - RNA, 18 nt, Homo sapiens
uuugugcuccacaaagga

SEQ ID NO: 339694 - RNA, 22 nt, Homo sapiens
uuuguuugaagucgagacaacu

SEQ ID NO: 339695 - RNA, 20 nt, Homo sapiens
uuuuagcacuuguuauggug

SEQ ID NO: 339696 - RNA, 22 nt, Homo sapiens
uuuugcaccauccuaauaguau

SEQ ID NO: 339697 - RNA, 22 nt, Homo sapiens
uuuugcauuggcugaggagugu

SEQ ID NO: 339698 - RNA, 22 nt, Homo sapiens
uuuugcucuucggaagagcuug

SEQ ID NO: 339699 - RNA, 18 nt, Homo sapiens
uuuugcuuaacugcgcca

SEQ ID NO: 339700 - RNA, 22 nt, Homo sapiens
uuuugguguauuguauaaggua

SEQ ID NO: 339701 - RNA, 22 nt, Homo sapiens
uuuugugacuauuguaaauggg

SEQ ID NO: 339702 - RNA, 18 nt, Homo sapiens
uuuuugaggcacagggga

SEQ ID NO: 339703 - RNA, 22 nt, Homo sapiens
uuuuugauuaauggguagacca

SEQ ID NO: 339704 - RNA, 22 nt, Homo sapiens
uuuuugugguauauugcaacaa

SEQ ID NO: 339705 - RNA, 22 nt, Homo sapiens
uuuuuuaguuagcugggcauga

SEQ ID NO: 339706 - RNA, 22 nt, Homo sapiens
ccaaguguuuucauuguuccau

SEQ ID NO: 339707 - RNA, 22 nt, Homo sapiens
ccacaguagucuugggaugggc

SEQ ID NO: 339708 - RNA, 22 nt, Homo sapiens
ccacugugguaucugauacugg

SEQ ID NO: 339709 - RNA, 22 nt, Homo sapiens
ccaggguugcuuuagauucuga

SEQ ID NO: 339710 - RNA, 23 nt, Homo sapiens
ccaguauuuauguaaggaagugu

SEQ ID NO: 339711 - RNA, 22 nt, Homo sapiens
ccagugaacugcaagguuuuuc

SEQ ID NO: 339712 - RNA, 22 nt, Homo sapiens
ccagugauuguauggugaaggu

SEQ ID NO: 339713 - RNA, 22 nt, Homo sapiens
ccagugcugugcaguguaugag

SEQ ID NO: 339714 - RNA, 19 nt, Homo sapiens
ccaguguucugauugcacu

SEQ ID NO: 339715 - RNA, 22 nt, Homo sapiens
ccaguucaaugauauggaaacu

SEQ ID NO: 339716 - RNA, 22 nt, Homo sapiens
ccaguuuucaagauaaugguuu

SEQ ID NO: 339717 - RNA, 22 nt, Homo sapiens
ccaguuuucucacuguugcagu

SEQ ID NO: 339718 - RNA, 22 nt, Homo sapiens
ccauggcaauggucagucuauu

SEQ ID NO: 339719 - RNA, 22 nt, Homo sapiens
cccaguaaucuugccaguuuuc

SEQ ID NO: 339720 - RNA, 22 nt, Homo sapiens
cccagugaagagaaccuuacga

SEQ ID NO: 339721 - RNA, 22 nt, Homo sapiens
cccaguguguuguggauauuua

SEQ ID NO: 339722 - RNA, 22 nt, Homo sapiens
cccaguguuacgugacagccug

SEQ ID NO: 339723 - RNA, 22 nt, Homo sapiens
ccccagguuucaauaaagccca

SEQ ID NO: 339724 - RNA, 22 nt, Homo sapiens
ccccauguucucucugcagcuc

SEQ ID NO: 339725 - RNA, 22 nt, Homo sapiens
cccucgagaaaccaucugcuga

SEQ ID NO: 339726 - RNA, 22 nt, Homo sapiens
cccugagagcagggucuuucuc

SEQ ID NO: 339727 - RNA, 22 nt, Homo sapiens
ccgugcacggaaaggcauauuu

SEQ ID NO: 339728 - RNA, 22 nt, Homo sapiens
ccucauggagaaccucugcuag

SEQ ID NO: 339729 - RNA, 22 nt, Homo sapiens
ccugagguagaguuuauauuga

SEQ ID NO: 339730 - RNA, 22 nt, Homo sapiens
ccugaugacuaaugguuuugag

SEQ ID NO: 339731 - RNA, 22 nt, Homo sapiens
ccuggaagaaaggugcuaaaua

SEQ ID NO: 339732 - RNA, 22 nt, Homo sapiens
ccuguguuaugguuucuaaugu

SEQ ID NO: 339733 - RNA, 22 nt, Homo sapiens
ccuucauucauuaauuuagccc

SEQ ID NO: 339734 - RNA, 22 nt, Homo sapiens
ccuucuuuuguaaggcugaaua

SEQ ID NO: 339735 - RNA, 22 nt, Homo sapiens
ccuuggcacuuugccacagugc

SEQ ID NO: 339736 - RNA, 22 nt, Homo sapiens
ccuugguaauguguuuuauucu

SEQ ID NO: 339737 - RNA, 22 nt, Homo sapiens
cgcuggugucuaagcgacagcu

SEQ ID NO: 339738 - RNA, 22 nt, Homo sapiens
cgugaggaaaacagaggguguu

SEQ ID NO: 339739 - RNA, 22 nt, Homo sapiens
cguugcacuccagccugggcaa

SEQ ID NO: 339740 - RNA, 16 nt, Homo sapiens
cuaaaaugucuacuug

SEQ ID NO: 339741 - RNA, 22 nt, Homo sapiens
cuaaagugcuuaaaaucucauu

SEQ ID NO: 339742 - RNA, 17 nt, Homo sapiens
cuaaggcaagagucugc

SEQ ID NO: 339743 - RNA, 18 nt, Homo sapiens
cuaauacuauucaacaag

SEQ ID NO: 339744 - RNA, 22 nt, Homo sapiens
cuacagcagcccaguccccgaa

SEQ ID NO: 339745 - RNA, 22 nt, Homo sapiens
cuagaagcauauucagaacaga

SEQ ID NO: 339746 - RNA, 22 nt, Homo sapiens
cuagcagacacuuccagagagu

SEQ ID NO: 339747 - RNA, 22 nt, Homo sapiens
cuagcccugagauaaaugucau

SEQ ID NO: 339748 - RNA, 22 nt, Homo sapiens
cuaggcuguagagaaguucagu

SEQ ID NO: 339749 - RNA, 22 nt, Homo sapiens
cuagguucucaaaccagcguca

SEQ ID NO: 339750 - RNA, 22 nt, Homo sapiens
cuauuagguuggugcaaaagua

SEQ ID NO: 339751 - RNA, 22 nt, Homo sapiens
cuauuagguuggugcaaaaguc

SEQ ID NO: 339752 - RNA, 21 nt, Homo sapiens
cucaaaguacugauauuacag

SEQ ID NO: 339753 - RNA, 22 nt, Homo sapiens
cucaaagugcugggauuggcca

SEQ ID NO: 339754 - RNA, 22 nt, Homo sapiens
cucaaguacaugggauuacagg

SEQ ID NO: 339755 - RNA, 22 nt, Homo sapiens
cucacaguucuaaaggcaagaa

SEQ ID NO: 339756 - RNA, 22 nt, Homo sapiens
cucaccuugugauccuccugcc

SEQ ID NO: 339757 - RNA, 22 nt, Homo sapiens
cucacugucaacauguauuugg

SEQ ID NO: 339758 - RNA, 22 nt, Homo sapiens
cucagauacuugggagguugag

SEQ ID NO: 339759 - RNA, 22 nt, Homo sapiens
cucagucuaugauacuuugcua

SEQ ID NO: 339760 - RNA, 22 nt, Homo sapiens
cucagugaagggcaagaggcaa

SEQ ID NO: 339761 - RNA, 22 nt, Homo sapiens
cucagugguugauuuauuuauc

SEQ ID NO: 339762 - RNA, 22 nt, Homo sapiens
cucaguguucccauucuaccuu

SEQ ID NO: 339763 - RNA, 21 nt, Homo sapiens
cucauauugcuuuuccauggu

SEQ ID NO: 339764 - RNA, 22 nt, Homo sapiens
cucauugcaaucuccaccuccc

SEQ ID NO: 339765 - RNA, 22 nt, Homo sapiens
cuccaggugucauccaccuccu

SEQ ID NO: 339766 - RNA, 22 nt, Homo sapiens
cuccauuuaguccuuuuagaag

SEQ ID NO: 339767 - RNA, 20 nt, Homo sapiens
cucccugacaaauguggaaa

SEQ ID NO: 339768 - RNA, 22 nt, Homo sapiens
cucccugagccagggcuuugac

SEQ ID NO: 339769 - RNA, 22 nt, Homo sapiens
cucucaguugucuaauuaguuu

SEQ ID NO: 339770 - RNA, 22 nt, Homo sapiens
cucuuuaguaagcaguugauga

SEQ ID NO: 339771 - RNA, 22 nt, Homo sapiens
cugaaauggaaugugugcacag

SEQ ID NO: 339772 - RNA, 22 nt, Homo sapiens
cugacagucucauugauuugcu

SEQ ID NO: 339773 - RNA, 22 nt, Homo sapiens
cugacauuguugaucacagcca

SEQ ID NO: 339774 - RNA, 22 nt, Homo sapiens
cugacucagacacauguauaug

SEQ ID NO: 339775 - RNA, 22 nt, Homo sapiens
cugacugaggaucaguucauca

SEQ ID NO: 339776 - RNA, 22 nt, Homo sapiens
cugagaucaagucuugcucugu

SEQ ID NO: 339777 - RNA, 18 nt, Homo sapiens
cugagcacugcuuuauga

SEQ ID NO: 339778 - RNA, 22 nt, Homo sapiens
cugaggacaucagggaagcauc

SEQ ID NO: 339779 - RNA, 22 nt, Homo sapiens
cugaggauauucagccucugug

SEQ ID NO: 339780 - RNA, 22 nt, Homo sapiens
cugaggguagaaggaucacuug

SEQ ID NO: 339781 - RNA, 20 nt, Homo sapiens
cugagguacgaggguuaaau

SEQ ID NO: 339782 - RNA, 22 nt, Homo sapiens
aagugcuuuuuagauaugguuu

SEQ ID NO: 339783 - RNA, 17 nt, Homo sapiens
aaguggcuuguucacca

SEQ ID NO: 339784 - RNA, 22 nt, Homo sapiens
aauaaguugagaugaggucaua

SEQ ID NO: 339785 - RNA, 22 nt, Homo sapiens
aauaauggcaccaaagcacaag

SEQ ID NO: 339786 - RNA, 22 nt, Homo sapiens
aauacuggcacugaagaccaug

SEQ ID NO: 339787 - RNA, 22 nt, Homo sapiens
aauacugugauaucgagcgauu

SEQ ID NO: 339788 - RNA, 22 nt, Homo sapiens
aauaguggcuuggacuaaauau

SEQ ID NO: 339789 - RNA, 22 nt, Homo sapiens
aauaugucuugaaauuggguaa

SEQ ID NO: 339790 - RNA, 22 nt, Homo sapiens
aaucacaggucuuggcugcaug

SEQ ID NO: 339791 - RNA, 21 nt, Homo sapiens
aaucacaguuguucugccuuc

SEQ ID NO: 339792 - RNA, 22 nt, Homo sapiens
aaucacauuaaugcucccucag

SEQ ID NO: 339793 - RNA, 22 nt, Homo sapiens
aaucacuaugccaugaaguaca

SEQ ID NO: 339794 - RNA, 22 nt, Homo sapiens
aaucacuuuggcaccaaccuaa

SEQ ID NO: 339795 - RNA, 22 nt, Homo sapiens
aaucauauugucugccaagagg

SEQ ID NO: 339796 - RNA, 22 nt, Homo sapiens
aauccugucuugccauccaaua

SEQ ID NO: 339797 - RNA, 22 nt, Homo sapiens
aaucucagagauaucugugucc

SEQ ID NO: 339798 - RNA, 22 nt, Homo sapiens
aaucucagcauuuugggcugag

SEQ ID NO: 339799 - RNA, 22 nt, Homo sapiens
aaucuguagaaggugcacauuc

SEQ ID NO: 339800 - RNA, 22 nt, Homo sapiens
aaugacucugccuaaauuucac

SEQ ID NO: 339801 - RNA, 22 nt, Homo sapiens
aaugguguuuccguuaagcuga

SEQ ID NO: 339802 - RNA, 22 nt, Homo sapiens
aaugugcacuauuagggugaua

SEQ ID NO: 339803 - RNA, 22 nt, Homo sapiens
aaugugcacuuggagccuugcu

SEQ ID NO: 339804 - RNA, 22 nt, Homo sapiens
aaugugcuuucuuucacacagu

SEQ ID NO: 339805 - RNA, 23 nt, Homo sapiens
aauugcacauuccuugcuggcag

SEQ ID NO: 339806 - RNA, 22 nt, Homo sapiens
aauugcaccaucuagaucaaga

SEQ ID NO: 339807 - RNA, 22 nt, Homo sapiens
aauugcacuggaaguaacugag

SEQ ID NO: 339808 - RNA, 22 nt, Homo sapiens
aauuggugaccaagggaaggac

SEQ ID NO: 339809 - RNA, 22 nt, Homo sapiens
acaaagugccuccuuuuagagu

SEQ ID NO: 339810 - RNA, 22 nt, Homo sapiens
acaagacuucuuguauucuagu

SEQ ID NO: 339811 - RNA, 22 nt, Homo sapiens
acacaguaagcacaguguagau

SEQ ID NO: 339812 - RNA, 22 nt, Homo sapiens
acacaugugaaaaaaauguuac

SEQ ID NO: 339813 - RNA, 22 nt, Homo sapiens
acacaugugcguagacucuuua

SEQ ID NO: 339814 - RNA, 22 nt, Homo sapiens
acaccaguacuuuauacaagca

SEQ ID NO: 339815 - RNA, 22 nt, Homo sapiens
acacuggaguuaaaggugauuu

SEQ ID NO: 339816 - RNA, 22 nt, Homo sapiens
acacuguauccuucuguccuuu

SEQ ID NO: 339817 - RNA, 20 nt, Homo sapiens
acacugugcuaaggauuuuc

SEQ ID NO: 339818 - RNA, 22 nt, Homo sapiens
acacuuucuagacaagggaaua

SEQ ID NO: 339819 - RNA, 19 nt, Homo sapiens
acagauagaauguucuaca

SEQ ID NO: 339820 - RNA, 22 nt, Homo sapiens
acaguauaaugcuguagggaga

SEQ ID NO: 339821 - RNA, 19 nt, Homo sapiens
acaguauugugcacagguu

SEQ ID NO: 339822 - RNA, 22 nt, Homo sapiens
acagugcuguuguguuuucacg

SEQ ID NO: 339823 - RNA, 22 nt, Homo sapiens
acagugcuuggcacacaguaau

SEQ ID NO: 339824 - RNA, 23 nt, Homo sapiens
acaguggugugaucuuggcucag

SEQ ID NO: 339825 - RNA, 22 nt, Homo sapiens
acagugucaugucguguucccc

SEQ ID NO: 339826 - RNA, 18 nt, Homo sapiens
acagugucuuacaccugu

SEQ ID NO: 339827 - RNA, 22 nt, Homo sapiens
acauagaguaguggugaggaug

SEQ ID NO: 339828 - RNA, 22 nt, Homo sapiens
acaucccuugcucggggccccu

SEQ ID NO: 339829 - RNA, 22 nt, Homo sapiens
acaugcauccaugugaagagac

SEQ ID NO: 339830 - RNA, 23 nt, Homo sapiens
acauguauagacuuuuuuuccuu

SEQ ID NO: 339831 - RNA, 22 nt, Homo sapiens
acauugcauauggcacccucuu

SEQ ID NO: 339832 - RNA, 21 nt, Homo sapiens
acccccacaccuccuuaguuc

SEQ ID NO: 339833 - RNA, 22 nt, Homo sapiens
acccugucacucccaucaauuu

SEQ ID NO: 339834 - RNA, 22 nt, Homo sapiens
acccuuuagguuggaugaggau

SEQ ID NO: 339835 - RNA, 22 nt, Homo sapiens
accugagacuaggcauuuuaua

SEQ ID NO: 339836 - RNA, 22 nt, Homo sapiens
ugacauggaagauguucaugau

SEQ ID NO: 339837 - RNA, 22 nt, Homo sapiens
ugaccagaaaacaaauuaguuu

SEQ ID NO: 339838 - RNA, 22 nt, Homo sapiens
ugacccauagaaauguggauaa

SEQ ID NO: 339839 - RNA, 22 nt, Homo sapiens
ugacuaaaacugaguuucauua

SEQ ID NO: 339840 - RNA, 22 nt, Homo sapiens
ugacuagacuugcaagguugca

SEQ ID NO: 339841 - RNA, 22 nt, Homo sapiens
ugacuauaggauaacaugcauu

SEQ ID NO: 339842 - RNA, 22 nt, Homo sapiens
ugacuauugauuuagacgugcu

SEQ ID NO: 339843 - RNA, 22 nt, Homo sapiens
ugacucaguuucucagguagua

SEQ ID NO: 339844 - RNA, 22 nt, Homo sapiens
ugacuccagagacugugcuguc

SEQ ID NO: 339845 - RNA, 22 nt, Homo sapiens
ugacuggaacuuuagugagucu

SEQ ID NO: 339846 - RNA, 22 nt, Homo sapiens
ugacugucuagauagagcuugg

SEQ ID NO: 339847 - RNA, 22 nt, Homo sapiens
ugacugugcagcuccaucaggg

SEQ ID NO: 339848 - RNA, 22 nt, Homo sapiens
ugagaacaugcacuugagguug

SEQ ID NO: 339849 - RNA, 22 nt, Homo sapiens
ugagaagacaucagcuuucgga

SEQ ID NO: 339850 - RNA, 22 nt, Homo sapiens
ugagaagacaucuuugcuuugu

SEQ ID NO: 339851 - RNA, 22 nt, Homo sapiens
ugagaagugauauagaaguuaa

SEQ ID NO: 339852 - RNA, 22 nt, Homo sapiens
ugagaaugacugggcaugcugc

SEQ ID NO: 339853 - RNA, 19 nt, Homo sapiens
ugagaauguuaccaggucc

SEQ ID NO: 339854 - RNA, 22 nt, Homo sapiens
ugagacggagucucacucuguu

SEQ ID NO: 339855 - RNA, 22 nt, Homo sapiens
ugagacugauaggacauuuucu

SEQ ID NO: 339856 - RNA, 22 nt, Homo sapiens
ugagacugguuaauugauaaag

SEQ ID NO: 339857 - RNA, 22 nt, Homo sapiens
ugagagcugcauucuugaaagc

SEQ ID NO: 339858 - RNA, 22 nt, Homo sapiens
ugagaucacgccacugcacucc

SEQ ID NO: 339859 - RNA, 22 nt, Homo sapiens
ugagaucagaaggauuucucug

SEQ ID NO: 339860 - RNA, 18 nt, Homo sapiens
ugagaucagcaucaaggg

SEQ ID NO: 339861 - RNA, 22 nt, Homo sapiens
ugagaucuguaaagucugacau

SEQ ID NO: 339862 - RNA, 22 nt, Homo sapiens
ugagaugaaagcagaaagacuu

SEQ ID NO: 339863 - RNA, 22 nt, Homo sapiens
ugagaugaacuugauuguuuua

SEQ ID NO: 339864 - RNA, 19 nt, Homo sapiens
ugagaugaagacagggguu

SEQ ID NO: 339865 - RNA, 22 nt, Homo sapiens
ugagaugaagugauguaaaaca

SEQ ID NO: 339866 - RNA, 22 nt, Homo sapiens
ugagaugagaaucaguucuaau

SEQ ID NO: 339867 - RNA, 22 nt, Homo sapiens
ugagaugagggcugcacucaaa

SEQ ID NO: 339868 - RNA, 22 nt, Homo sapiens
ugagaugaguugcgcucugucg

SEQ ID NO: 339869 - RNA, 22 nt, Homo sapiens
ugagaugauagauauguuaauu

SEQ ID NO: 339870 - RNA, 21 nt, Homo sapiens
agagucaucucuaucuguacc

SEQ ID NO: 339871 - RNA, 22 nt, Homo sapiens
agagugcaaagguuggggcugg

SEQ ID NO: 339872 - RNA, 20 nt, Homo sapiens
agagugcugucuguccugag

SEQ ID NO: 339873 - RNA, 22 nt, Homo sapiens
agauaugucugcuauuugcugu

SEQ ID NO: 339874 - RNA, 20 nt, Homo sapiens
agaugcaugcacauaaacac

SEQ ID NO: 339875 - RNA, 18 nt, Homo sapiens
agaugguguugcuucugu

SEQ ID NO: 339876 - RNA, 22 nt, Homo sapiens
agcacagugaaugguuuacuca

SEQ ID NO: 339877 - RNA, 22 nt, Homo sapiens
agcacagugguuaaguuucuua

SEQ ID NO: 339878 - RNA, 22 nt, Homo sapiens
agcaccaccguugcucuauccc

SEQ ID NO: 339879 - RNA, 22 nt, Homo sapiens
agcaccauuucucuaaagcacu

SEQ ID NO: 339880 - RNA, 22 nt, Homo sapiens
agcagagcauauucauucgggg

SEQ ID NO: 339881 - RNA, 22 nt, Homo sapiens
agcagcauuaguggaaucuugu

SEQ ID NO: 339882 - RNA, 22 nt, Homo sapiens
agcagguguccacaauguuugc

SEQ ID NO: 339883 - RNA, 22 nt, Homo sapiens
agcagugugagaauggacuaau

SEQ ID NO: 339884 - RNA, 20 nt, Homo sapiens
agcaucauugcaauuuguca

SEQ ID NO: 339885 - RNA, 22 nt, Homo sapiens
agccauacaacguaugcaugua

SEQ ID NO: 339886 - RNA, 17 nt, Homo sapiens
agccccauuagcuaguu

SEQ ID NO: 339887 - RNA, 22 nt, Homo sapiens
agccccauuuguugaaaagacg

SEQ ID NO: 339888 - RNA, 23 nt, Homo sapiens
agccugguuucccugcuucuccc

SEQ ID NO: 339889 - RNA, 22 nt, Homo sapiens
agccuguguugaauuauagaaa

SEQ ID NO: 339890 - RNA, 22 nt, Homo sapiens
agcuaguguucaccagagguca

SEQ ID NO: 339891 - RNA, 22 nt, Homo sapiens
agcugcaauguuuaguauaaua

SEQ ID NO: 339892 - RNA, 16 nt, Homo sapiens
agcuggaauuacaggc

SEQ ID NO: 339893 - RNA, 20 nt, Homo sapiens
agcuggguguguuggugcau

SEQ ID NO: 339894 - RNA, 22 nt, Homo sapiens
agcuguaguuuauucauguuaa

SEQ ID NO: 339895 - RNA, 19 nt, Homo sapiens
agcuguguugccugugaga

SEQ ID NO: 339896 - RNA, 22 nt, Homo sapiens
agcuugugauucuccaucaugu

SEQ ID NO: 339897 - RNA, 21 nt, Homo sapiens
agcuuguguguaucacagugu

SEQ ID NO: 339898 - RNA, 22 nt, Homo sapiens
agcuuguuuuauagaaagucaa

SEQ ID NO: 339899 - RNA, 22 nt, Homo sapiens
agcuuguuuucccauaacuaga

SEQ ID NO: 339900 - RNA, 23 nt, Homo sapiens
aggaauggaaaaccaaguaucau

SEQ ID NO: 339901 - RNA, 21 nt, Homo sapiens
aggagcauuguugugguggag

SEQ ID NO: 339902 - RNA, 23 nt, Homo sapiens
aggagcuuagaaguugccauugc

SEQ ID NO: 339903 - RNA, 22 nt, Homo sapiens
aggaguguguauuaaugaaauu

SEQ ID NO: 339904 - RNA, 22 nt, Homo sapiens
aggcaagaaugcuuguuucacc

SEQ ID NO: 339905 - RNA, 22 nt, Homo sapiens
aggcacacaacccuggaccuga

SEQ ID NO: 339906 - RNA, 22 nt, Homo sapiens
aggcaggugaaagauaguuuua

SEQ ID NO: 339907 - RNA, 23 nt, Homo sapiens
aggccaguuuuuccugcuugcug

SEQ ID NO: 339908 - RNA, 22 nt, Homo sapiens
agggaauguaaguuuuaugaga

SEQ ID NO: 339909 - RNA, 22 nt, Homo sapiens
agggagcaaaguggucuuucuc

SEQ ID NO: 339910 - RNA, 22 nt, Homo sapiens
agggcacuguagguccugccuc

SEQ ID NO: 339911 - RNA, 22 nt, Homo sapiens
agggcaguguuaggacugucug

SEQ ID NO: 339912 - RNA, 20 nt, Homo sapiens
agguagauagaugauagaua

SEQ ID NO: 339913 - RNA, 22 nt, Homo sapiens
aggugcuugagggaagaaauua

SEQ ID NO: 339914 - RNA, 20 nt, Homo sapiens
agguucaaaucccaaucaug

SEQ ID NO: 339915 - RNA, 22 nt, Homo sapiens
aguaaacuucagaguucuuccu

SEQ ID NO: 339916 - RNA, 22 nt, Homo sapiens
aguacugucugguuaccugaca

SEQ ID NO: 339917 - RNA, 22 nt, Homo sapiens
agucaagaugagauuugggugg

SEQ ID NO: 339918 - RNA, 22 nt, Homo sapiens
agucacagguucuugggauuag

SEQ ID NO: 339919 - RNA, 22 nt, Homo sapiens
agucacaugcauuuucuucaau

SEQ ID NO: 339920 - RNA, 22 nt, Homo sapiens
agucagauuggcauuuguuggg

SEQ ID NO: 339921 - RNA, 22 nt, Homo sapiens
ugccaagaacauuuucuguuuu

SEQ ID NO: 339922 - RNA, 22 nt, Homo sapiens
ugccagagacguagggaauauu

SEQ ID NO: 339923 - RNA, 22 nt, Homo sapiens
ugccagaugcuggugugagggg

SEQ ID NO: 339924 - RNA, 22 nt, Homo sapiens
ugccagaugugcccucuccacc

SEQ ID NO: 339925 - RNA, 22 nt, Homo sapiens
ugccaggaugaggucaauguuu

SEQ ID NO: 339926 - RNA, 22 nt, Homo sapiens
ugccaguguuuuguugaagauu

SEQ ID NO: 339927 - RNA, 22 nt, Homo sapiens
ugccauagcaaugguaagcuga

SEQ ID NO: 339928 - RNA, 22 nt, Homo sapiens
ugccuaguggaaggagagcaaa

SEQ ID NO: 339929 - RNA, 22 nt, Homo sapiens
ugccugagcccagcccuguagu

SEQ ID NO: 339930 - RNA, 22 nt, Homo sapiens
ugcucaguuuaaaacuuuugag

SEQ ID NO: 339931 - RNA, 22 nt, Homo sapiens
ugcuggugauucagauucaaau

SEQ ID NO: 339932 - RNA, 22 nt, Homo sapiens
ugcuggugucaucaaggcuuug

SEQ ID NO: 339933 - RNA, 22 nt, Homo sapiens
ugcuguuguuugaugaaguaau

SEQ ID NO: 339934 - RNA, 22 nt, Homo sapiens
uggaaaguacugagguccaccu

SEQ ID NO: 339935 - RNA, 22 nt, Homo sapiens
uggaaauuaacagggauugucc

SEQ ID NO: 339936 - RNA, 22 nt, Homo sapiens
uggaaauuaagucuuuccugag

SEQ ID NO: 339937 - RNA, 20 nt, Homo sapiens
uggaacuuaauugauggaca

SEQ ID NO: 339938 - RNA, 22 nt, Homo sapiens
uggaagacacauaccugauaac

SEQ ID NO: 339939 - RNA, 22 nt, Homo sapiens
uggaagacucuagucucuugag

SEQ ID NO: 339940 - RNA, 22 nt, Homo sapiens
uggaagucaugcugcaagaaca

SEQ ID NO: 339941 - RNA, 21 nt, Homo sapiens
uggaaucuauagaggcaguag

SEQ ID NO: 339942 - RNA, 22 nt, Homo sapiens
uggaauguauaucguuuuuugu

SEQ ID NO: 339943 - RNA, 22 nt, Homo sapiens
uggaaugucuauguuuuugauu

SEQ ID NO: 339944 - RNA, 22 nt, Homo sapiens
uggaauguggacucuuaugggg

SEQ ID NO: 339945 - RNA, 22 nt, Homo sapiens
uggaauguuauggcuuuaaucu

SEQ ID NO: 339946 - RNA, 22 nt, Homo sapiens
uggaauguuuaucaaaacagua

SEQ ID NO: 339947 - RNA, 21 nt, Homo sapiens
uggaauuaauggagagguguu

SEQ ID NO: 339948 - RNA, 22 nt, Homo sapiens
uggacacugguggauauggaau

SEQ ID NO: 339949 - RNA, 22 nt, Homo sapiens
uggaccccugcucgggagcccu

SEQ ID NO: 339950 - RNA, 19 nt, Homo sapiens
uggaccccuuccuuacacc

SEQ ID NO: 339951 - RNA, 21 nt, Homo sapiens
uggaccccuuccuugcaccau

SEQ ID NO: 339952 - RNA, 22 nt, Homo sapiens
uggacuguaaauuggggacucu

SEQ ID NO: 339953 - RNA, 22 nt, Homo sapiens
uggacuguaauuuuauaggcau

SEQ ID NO: 339954 - RNA, 22 nt, Homo sapiens
uggagagcaaagaauuuguuag

SEQ ID NO: 339955 - RNA, 19 nt, Homo sapiens
uggagucaucaugcugcua

SEQ ID NO: 339956 - RNA, 22 nt, Homo sapiens
uggagucuugcucuguugccca

SEQ ID NO: 339957 - RNA, 20 nt, Homo sapiens
uggaguuguggcaguuugga

SEQ ID NO: 339958 - RNA, 22 nt, Homo sapiens
cugugcaaguuauaggccaggu

SEQ ID NO: 339959 - RNA, 22 nt, Homo sapiens
cugugcacaucuggcggcccga

SEQ ID NO: 339960 - RNA, 22 nt, Homo sapiens
cugugcauggauuuuaagauug

SEQ ID NO: 339961 - RNA, 22 nt, Homo sapiens
cuguuaacauguuguggauaau

SEQ ID NO: 339962 - RNA, 22 nt, Homo sapiens
cuguugguguuuaaucacugca

SEQ ID NO: 339963 - RNA, 20 nt, Homo sapiens
cuucacagaaguggaaucau

SEQ ID NO: 339964 - RNA, 22 nt, Homo sapiens
cuucacuggagucccuggauuc

SEQ ID NO: 339965 - RNA, 22 nt, Homo sapiens
cuuccaaguggggcacgugcca

SEQ ID NO: 339966 - RNA, 22 nt, Homo sapiens
cuucucagugcucaucuuauuu

SEQ ID NO: 339967 - RNA, 22 nt, Homo sapiens
cuucugauugaaaauggaguag

SEQ ID NO: 339968 - RNA, 22 nt, Homo sapiens
cuugggcagugugcauguguau

SEQ ID NO: 339969 - RNA, 22 nt, Homo sapiens
cuuugcaaauggccuuuccaag

SEQ ID NO: 339970 - RNA, 22 nt, Homo sapiens
cuuuggcaaugucauuuucaau

SEQ ID NO: 339971 - RNA, 22 nt, Homo sapiens
cuuuggcacuuccuaagugcca

SEQ ID NO: 339972 - RNA, 22 nt, Homo sapiens
cuuuggguauucucccuugggg

SEQ ID NO: 339973 - RNA, 22 nt, Homo sapiens
cuuugguuaauaggauauggca

SEQ ID NO: 339974 - RNA, 19 nt, Homo sapiens
cuuugguugagcguguugg

SEQ ID NO: 339975 - RNA, 21 nt, Homo sapiens
cuuuugcacuccagccugggu

SEQ ID NO: 339976 - RNA, 22 nt, Homo sapiens
cuuuugugauucuucaguuacu

SEQ ID NO: 339977 - RNA, 22 nt, Homo sapiens
gaaaacugcuucucuggguuuc

SEQ ID NO: 339978 - RNA, 22 nt, Homo sapiens
gaaagacuuucugcuguggaua

SEQ ID NO: 339979 - RNA, 22 nt, Homo sapiens
gaaaugcucagggguuuuccag

SEQ ID NO: 339980 - RNA, 22 nt, Homo sapiens
gaaaugcucauuuuggauccuu

SEQ ID NO: 339981 - RNA, 22 nt, Homo sapiens
gaagaacuaggugagaucuaga

SEQ ID NO: 339982 - RNA, 22 nt, Homo sapiens
gaagaaguacaagacaaauuuu

SEQ ID NO: 339983 - RNA, 22 nt, Homo sapiens
gaaggcacugugugccacccug

SEQ ID NO: 339984 - RNA, 22 nt, Homo sapiens
gaaggugcuuggugaaugcauu

SEQ ID NO: 339985 - RNA, 22 nt, Homo sapiens
gaauagugcugcaagaaacaua

SEQ ID NO: 339986 - RNA, 22 nt, Homo sapiens
gaauagugcugcaauaaacaua

SEQ ID NO: 339987 - RNA, 22 nt, Homo sapiens
gaauagugcugcaaugaacaua

SEQ ID NO: 339988 - RNA, 22 nt, Homo sapiens
gaauagugcugcgauaaacaua

SEQ ID NO: 339989 - RNA, 22 nt, Homo sapiens
gaaucauuggguugauucaaga

SEQ ID NO: 339990 - RNA, 22 nt, Homo sapiens
gaaugaauguuuauccuuagau

SEQ ID NO: 339991 - RNA, 22 nt, Homo sapiens
gaaugauacuguuaacgaaaga

SEQ ID NO: 339992 - RNA, 22 nt, Homo sapiens
gaaugcaugaggggaucagaug

SEQ ID NO: 339993 - RNA, 22 nt, Homo sapiens
gaaugcuaagcaugugggaauu

SEQ ID NO: 339994 - RNA, 22 nt, Homo sapiens
gacacugucuucugcucuuaaa

SEQ ID NO: 339995 - RNA, 22 nt, Homo sapiens
gacagugugauacuuagucuca

SEQ ID NO: 339996 - RNA, 20 nt, Homo sapiens
gacauagagacucucaaaaa

SEQ ID NO: 339997 - RNA, 22 nt, Homo sapiens
gacauagagccuugacuucauu

SEQ ID NO: 339998 - RNA, 22 nt, Homo sapiens
gacaucauuaugagauuuaaac

SEQ ID NO: 339999 - RNA, 22 nt, Homo sapiens
gacauguuuucauguauuugga

SEQ ID NO: 340000 - RNA, 22 nt, Homo sapiens
gacauuaucagguuuguuuucu

SEQ ID NO: 340001 - RNA, 22 nt, Homo sapiens
gaccuggugguccacccgccuu

SEQ ID NO: 340002 - RNA, 17 nt, Homo sapiens
gacgaucaucaggaggc

SEQ ID NO: 340003 - RNA, 22 nt, Homo sapiens
gacuggauagauaaaguuaguu

SEQ ID NO: 340004 - RNA, 22 nt, Homo sapiens
gagaacuggcugauucaaggac

SEQ ID NO: 340005 - RNA, 21 nt, Homo sapiens
gagaaucaucauggcugcaua

SEQ ID NO: 340006 - RNA, 21 nt, Homo sapiens
gagaaucuuuucagggcaaac

SEQ ID NO: 340007 - RNA, 22 nt, Homo sapiens
gagacagugucagccauugaaa

SEQ ID NO: 340008 - RNA, 22 nt, Homo sapiens
gagagcauuaagccaucaucau

SEQ ID NO: 340009 - RNA, 21 nt, Homo sapiens
gagaggauucgccagccucuu

SEQ ID NO: 340010 - RNA, 22 nt, Homo sapiens
gagauacacccagugcagaggc

SEQ ID NO: 340011 - RNA, 22 nt, Homo sapiens
gagauauuuagaaauguguucu

SEQ ID NO: 340012 - RNA, 22 nt, Homo sapiens
gagaucuuuaagaacuacugcu

SEQ ID NO: 340013 - RNA, 22 nt, Homo sapiens
gagaugaaguuaaggaucuuua

SEQ ID NO: 340014 - RNA, 22 nt, Homo sapiens
gagauggagucuuuuucuguca

SEQ ID NO: 340015 - RNA, 22 nt, Homo sapiens
gagauguaagaauuuauuuguu

SEQ ID NO: 340016 - RNA, 22 nt, Homo sapiens
gagaugugguucaaggguguuu

SEQ ID NO: 340017 - RNA, 22 nt, Homo sapiens
gagauuaacauuugaggagcug

SEQ ID NO: 340018 - RNA, 22 nt, Homo sapiens
gagauuauuuaaaaggugauuu

SEQ ID NO: 340019 - RNA, 22 nt, Homo sapiens
gagcacugaauacugugguggu

SEQ ID NO: 340020 - RNA, 22 nt, Homo sapiens
gagcaucauggggccaaagcgc

SEQ ID NO: 340021 - RNA, 22 nt, Homo sapiens
gagccuguaggaggagaggugg

SEQ ID NO: 340022 - RNA, 22 nt, Homo sapiens
gagcucaccuuaccucuggagc

SEQ ID NO: 340023 - RNA, 22 nt, Homo sapiens
gagcuccuccccuuggcuuuca

SEQ ID NO: 340024 - RNA, 22 nt, Homo sapiens
gagcuggacuucuuaccuuuuc

SEQ ID NO: 340025 - RNA, 22 nt, Homo sapiens
gagcugguccuuuaaggaugca

SEQ ID NO: 340026 - RNA, 22 nt, Homo sapiens
gagcuguugguuugaaagaauu

SEQ ID NO: 340027 - RNA, 22 nt, Homo sapiens
gaggcaauaugagggaggcuuc

SEQ ID NO: 340028 - RNA, 22 nt, Homo sapiens
gaggcuagauggggaugugucc

SEQ ID NO: 340029 - RNA, 22 nt, Homo sapiens
gagggcacugcuuuccuuucaa

SEQ ID NO: 340030 - RNA, 22 nt, Homo sapiens
gaggucaugucgggccccagga

SEQ ID NO: 340031 - RNA, 22 nt, Homo sapiens
aggaauuuaauguaugauaaua

SEQ ID NO: 340032 - RNA, 22 nt, Homo sapiens
aggacacugauguaugcugugg

SEQ ID NO: 340033 - RNA, 20 nt, Homo sapiens
aggagcauuuacauuggcuc

SEQ ID NO: 340034 - RNA, 22 nt, Homo sapiens
aggcaaugugagaguuuauuca

SEQ ID NO: 340035 - RNA, 22 nt, Homo sapiens
aggcaugaguucagaggguaug

SEQ ID NO: 340036 - RNA, 22 nt, Homo sapiens
aggcaugguggcacauacaugu

SEQ ID NO: 340037 - RNA, 22 nt, Homo sapiens
aggcaugugugcagacugucug

SEQ ID NO: 340038 - RNA, 22 nt, Homo sapiens
aggcauugugcaucgaugauuu

SEQ ID NO: 340039 - RNA, 22 nt, Homo sapiens
aggcuguguggauaauauuggg

SEQ ID NO: 340040 - RNA, 22 nt, Homo sapiens
agggaagugugcuaugcauuua

SEQ ID NO: 340041 - RNA, 22 nt, Homo sapiens
agggcuuuugagcugagauggu

SEQ ID NO: 340042 - RNA, 22 nt, Homo sapiens
agguaagucucuaauuaugaau

SEQ ID NO: 340043 - RNA, 22 nt, Homo sapiens
agguauauuggacagauguaaa

SEQ ID NO: 340044 - RNA, 22 nt, Homo sapiens
aggucccauguccucccugacc

SEQ ID NO: 340045 - RNA, 22 nt, Homo sapiens
aggugcaugcuucacuggauau

SEQ ID NO: 340046 - RNA, 21 nt, Homo sapiens
aggugucuuggguucccuggc

SEQ ID NO: 340047 - RNA, 22 nt, Homo sapiens
aguaaauuucugugcuuucaua

SEQ ID NO: 340048 - RNA, 17 nt, Homo sapiens
aguacugucccauccuu

SEQ ID NO: 340049 - RNA, 16 nt, Homo sapiens
aguaguuuuacagauu

SEQ ID NO: 340050 - RNA, 20 nt, Homo sapiens
aguauucacuuuuuucaugg

SEQ ID NO: 340051 - RNA, 22 nt, Homo sapiens
agucaagaaucucagcaucuuu

SEQ ID NO: 340052 - RNA, 22 nt, Homo sapiens
agucaguggaguaaauguaauu

SEQ ID NO: 340053 - RNA, 22 nt, Homo sapiens
agucaguguguauugauggcac

SEQ ID NO: 340054 - RNA, 22 nt, Homo sapiens
agucauaggagagauaucacug

SEQ ID NO: 340055 - RNA, 22 nt, Homo sapiens
agucaugggagagaugugaucg

SEQ ID NO: 340056 - RNA, 17 nt, Homo sapiens
agugagaucauggcuua

SEQ ID NO: 340057 - RNA, 19 nt, Homo sapiens
agugagccaagauccuacc

SEQ ID NO: 340058 - RNA, 22 nt, Homo sapiens
agugauguggaguuuggaugga

SEQ ID NO: 340059 - RNA, 22 nt, Homo sapiens
agugauuuuaacuuccagcaau

SEQ ID NO: 340060 - RNA, 22 nt, Homo sapiens
agugcaaagccgagguuucuug

SEQ ID NO: 340061 - RNA, 22 nt, Homo sapiens
agugcaauaaggauguagaacu

SEQ ID NO: 340062 - RNA, 22 nt, Homo sapiens
agugcaguugucacgugccuuc

SEQ ID NO: 340063 - RNA, 22 nt, Homo sapiens
agugcauugcaucucugcuuca

SEQ ID NO: 340064 - RNA, 22 nt, Homo sapiens
aguggaauuaagaaacugaauu

SEQ ID NO: 340065 - RNA, 22 nt, Homo sapiens
aguggcacaauuuugacucccc

SEQ ID NO: 340066 - RNA, 19 nt, Homo sapiens
aguggguguuuucuguuug

SEQ ID NO: 340067 - RNA, 22 nt, Homo sapiens
aguucaaaucgagccuggccau

SEQ ID NO: 340068 - RNA, 21 nt, Homo sapiens
aguucacauggcuccuguguu

SEQ ID NO: 340069 - RNA, 22 nt, Homo sapiens
auaaaccuacauuuucacuucu

SEQ ID NO: 340070 - RNA, 18 nt, Homo sapiens
auaaacucaucauuuuua

SEQ ID NO: 340071 - RNA, 22 nt, Homo sapiens
auaaagacacuuggcaugauuu

SEQ ID NO: 340072 - RNA, 22 nt, Homo sapiens
auaaagccaugagcuugagaug

SEQ ID NO: 340073 - RNA, 19 nt, Homo sapiens
auaaaugccuacaagggug

SEQ ID NO: 340074 - RNA, 22 nt, Homo sapiens
auaaaugccuguuguuuuaagc

SEQ ID NO: 340075 - RNA, 22 nt, Homo sapiens
auaacagcugcaaggcaaaagc

SEQ ID NO: 340076 - RNA, 22 nt, Homo sapiens
auaacucuguuuuuuucaugca

SEQ ID NO: 340077 - RNA, 22 nt, Homo sapiens
auaagaguaguacauaugagac

SEQ ID NO: 340078 - RNA, 22 nt, Homo sapiens
auaaggcugguauagacauuca

SEQ ID NO: 340079 - RNA, 22 nt, Homo sapiens
auaauaccugccacauuugaau

SEQ ID NO: 340080 - RNA, 19 nt, Homo sapiens
auacacguguauacauaca

SEQ ID NO: 340081 - RNA, 22 nt, Homo sapiens
auacacuagggcuccugcagaa

SEQ ID NO: 340082 - RNA, 22 nt, Homo sapiens
auacagugaauacuuacagugu

SEQ ID NO: 340083 - RNA, 22 nt, Homo sapiens
auacagugaauaucuggggcag

SEQ ID NO: 340084 - RNA, 22 nt, Homo sapiens
auacaguguauguauaguacau

SEQ ID NO: 340085 - RNA, 22 nt, Homo sapiens
auacauguucaagggcauauau

SEQ ID NO: 340086 - RNA, 22 nt, Homo sapiens
auacccucugggugguuaguug

SEQ ID NO: 340087 - RNA, 22 nt, Homo sapiens
auagaagcuauguauaggggcc

SEQ ID NO: 340088 - RNA, 22 nt, Homo sapiens
auagaagcugccaacguuucag

SEQ ID NO: 340089 - RNA, 22 nt, Homo sapiens
auagaauguauuaguaaauuug

SEQ ID NO: 340090 - RNA, 20 nt, Homo sapiens
auagaccauugguagguagg

SEQ ID NO: 340091 - RNA, 22 nt, Homo sapiens
auagcaggagaauggucauggg

SEQ ID NO: 340092 - RNA, 22 nt, Homo sapiens
auagcagugugaaaacagacug

SEQ ID NO: 340093 - RNA, 22 nt, Homo sapiens
auagcagugugaaaauggacua

SEQ ID NO: 340094 - RNA, 22 nt, Homo sapiens
auagcauagucagcuucgcuga

SEQ ID NO: 340095 - RNA, 20 nt, Homo sapiens
auagcauugauggacucaaa

SEQ ID NO: 340096 - RNA, 22 nt, Homo sapiens
auagcccuuuucuaacuaugug

SEQ ID NO: 340097 - RNA, 22 nt, Homo sapiens
auagcucuugcuuacccacugu

SEQ ID NO: 340098 - RNA, 22 nt, Homo sapiens
auagguagcauagcaggaauau

SEQ ID NO: 340099 - RNA, 22 nt, Homo sapiens
auagugaacuuugugagaacaa

SEQ ID NO: 340100 - RNA, 22 nt, Homo sapiens
auagugcagugaugaaccuagg

SEQ ID NO: 340101 - RNA, 22 nt, Homo sapiens
auagugcuauggcagaccuuga

SEQ ID NO: 340102 - RNA, 22 nt, Homo sapiens
auagugcugcaauaaacauaca

SEQ ID NO: 340103 - RNA, 22 nt, Homo sapiens
auagugcugcaauaaccauggg

SEQ ID NO: 340104 - RNA, 22 nt, Homo sapiens
auagugcugcaaucaacauaca

SEQ ID NO: 340105 - RNA, 22 nt, Homo sapiens
auagugcugcacuaaacauaca

SEQ ID NO: 340106 - RNA, 22 nt, Homo sapiens
auagugcuguauuaaacauacg

SEQ ID NO: 340107 - RNA, 22 nt, Homo sapiens
auauagcaaugaaagagaugaa

SEQ ID NO: 340108 - RNA, 22 nt, Homo sapiens
auauaugcuaagugcuaauaaa

SEQ ID NO: 340109 - RNA, 22 nt, Homo sapiens
auauccuggagcauuuuugcaa

SEQ ID NO: 340110 - RNA, 17 nt, Homo sapiens
auaugaauuuuggagau

SEQ ID NO: 340111 - RNA, 22 nt, Homo sapiens
auaugcacgugcauacacacuu

SEQ ID NO: 340112 - RNA, 22 nt, Homo sapiens
auaugcauacauguaugcagga

SEQ ID NO: 340113 - RNA, 22 nt, Homo sapiens
auaugcauguacccacacaggc

SEQ ID NO: 340114 - RNA, 22 nt, Homo sapiens
auauggcuaugugagcauacca

SEQ ID NO: 340115 - RNA, 22 nt, Homo sapiens
auauggguuuuauauuaggcuc

SEQ ID NO: 340116 - RNA, 22 nt, Homo sapiens
aucaaaguaggcauauguuuuu

SEQ ID NO: 340117 - RNA, 22 nt, Homo sapiens
aucaaaguaucucaauauggua

SEQ ID NO: 340118 - RNA, 22 nt, Homo sapiens
aucaaauugucauuuuaaggau

SEQ ID NO: 340119 - RNA, 22 nt, Homo sapiens
cugaaggcagguagaauagaga

SEQ ID NO: 340120 - RNA, 20 nt, Homo sapiens
cugaaugucaaggcagaggu

SEQ ID NO: 340121 - RNA, 22 nt, Homo sapiens
cugacugugcaugcccagcccc

SEQ ID NO: 340122 - RNA, 22 nt, Homo sapiens
cugacuuuagaacccaaaaagu

SEQ ID NO: 340123 - RNA, 22 nt, Homo sapiens
cugagacacucuuaucugcaua

SEQ ID NO: 340124 - RNA, 22 nt, Homo sapiens
cugagagaugagaccucucacu

SEQ ID NO: 340125 - RNA, 22 nt, Homo sapiens
cugagaguugaugaaauauggu

SEQ ID NO: 340126 - RNA, 22 nt, Homo sapiens
cugagaucguggggcugcuguc

SEQ ID NO: 340127 - RNA, 22 nt, Homo sapiens
cugagauggagucucgcauugu

SEQ ID NO: 340128 - RNA, 22 nt, Homo sapiens
cugagcacugagauccucuagc

SEQ ID NO: 340129 - RNA, 22 nt, Homo sapiens
cugagcccauucuggggagaag

SEQ ID NO: 340130 - RNA, 22 nt, Homo sapiens
cugaggcacggcgaccuuaagu

SEQ ID NO: 340131 - RNA, 22 nt, Homo sapiens
cugagguaggcccugagaauau

SEQ ID NO: 340132 - RNA, 20 nt, Homo sapiens
cugaggugggagaaucgcuu

SEQ ID NO: 340133 - RNA, 22 nt, Homo sapiens
cugaggugggaggauuggcuug

SEQ ID NO: 340134 - RNA, 22 nt, Homo sapiens
cugaggugggaguuuuucucau

SEQ ID NO: 340135 - RNA, 20 nt, Homo sapiens
cugagguugggguccuuccc

SEQ ID NO: 340136 - RNA, 22 nt, Homo sapiens
cugauaaguuuuucuuuauaag

SEQ ID NO: 340137 - RNA, 22 nt, Homo sapiens
cugaucuaugaacacaggauau

SEQ ID NO: 340138 - RNA, 22 nt, Homo sapiens
cugauuguuugccucuaaaauc

SEQ ID NO: 340139 - RNA, 22 nt, Homo sapiens
cugcaagaaucguaguauuuga

SEQ ID NO: 340140 - RNA, 22 nt, Homo sapiens
cugcacugagacccucuuugcu

SEQ ID NO: 340141 - RNA, 22 nt, Homo sapiens
cugcauuggguuaugcauuuuu

SEQ ID NO: 340142 - RNA, 22 nt, Homo sapiens
cugcccuuucuauaugauguaa

SEQ ID NO: 340143 - RNA, 22 nt, Homo sapiens
cugccugagaaaauggagggca

SEQ ID NO: 340144 - RNA, 22 nt, Homo sapiens
cuggaagaaaaucacgccaucu

SEQ ID NO: 340145 - RNA, 18 nt, Homo sapiens
cuggaaggcuacuacagu

SEQ ID NO: 340146 - RNA, 22 nt, Homo sapiens
cuggaauguuccuaaagauuca

SEQ ID NO: 340147 - RNA, 22 nt, Homo sapiens
cuggaauucaaaaucugaauuu

SEQ ID NO: 340148 - RNA, 22 nt, Homo sapiens
cuggauagagauugaugaugcu

SEQ ID NO: 340149 - RNA, 22 nt, Homo sapiens
cuggcagugcuuguuauccugg

SEQ ID NO: 340150 - RNA, 22 nt, Homo sapiens
cuggugagaugucuuuccucuu

SEQ ID NO: 340151 - RNA, 22 nt, Homo sapiens
cuguaauguaaugagacuacau

SEQ ID NO: 340152 - RNA, 22 nt, Homo sapiens
cuguacucaucccauaugcacu

SEQ ID NO: 340153 - RNA, 22 nt, Homo sapiens
cugucacaguuuuggaggccag

SEQ ID NO: 340154 - RNA, 22 nt, Homo sapiens
cuguccugcagagucagaauga

SEQ ID NO: 340155 - RNA, 22 nt, Homo sapiens
cugugaagaaagucauugguag

SEQ ID NO: 340156 - RNA, 22 nt, Homo sapiens
cugugcauuggaugucucccug

SEQ ID NO: 340157 - RNA, 22 nt, Homo sapiens
cugugguuacguucuuugugcu

SEQ ID NO: 340158 - RNA, 22 nt, Homo sapiens
cugugguugagcuuugccauga

SEQ ID NO: 340159 - RNA, 22 nt, Homo sapiens
cuuacagucuaucagccacaac

SEQ ID NO: 340160 - RNA, 22 nt, Homo sapiens
cuucaaaguuggcuaggagaca

SEQ ID NO: 340161 - RNA, 22 nt, Homo sapiens
cuucacuuuguuaaacuccaau

SEQ ID NO: 340162 - RNA, 22 nt, Homo sapiens
cuucaucugguuugugaacuuu

SEQ ID NO: 340163 - RNA, 22 nt, Homo sapiens
cuucaugagacuuuuggaaggc

SEQ ID NO: 340164 - RNA, 22 nt, Homo sapiens
cuucaugggagaaccacaggua

SEQ ID NO: 340165 - RNA, 22 nt, Homo sapiens
cuuccagcuggguucagucagu

SEQ ID NO: 340166 - RNA, 20 nt, Homo sapiens
cuuccaguggccccaucuuu

SEQ ID NO: 340167 - RNA, 22 nt, Homo sapiens
cuuccauaguuacacccaggga

SEQ ID NO: 340168 - RNA, 22 nt, Homo sapiens
cuucuguuaguucugauaacuu

SEQ ID NO: 340169 - RNA, 22 nt, Homo sapiens
cuucuugagacuuaggcuuugg

SEQ ID NO: 340170 - RNA, 22 nt, Homo sapiens
cuugauagugguaaucauuuuu

SEQ ID NO: 340171 - RNA, 22 nt, Homo sapiens
cuugcacuagugcagaggcgcu

SEQ ID NO: 340172 - RNA, 22 nt, Homo sapiens
cuugcauuuuggagaaugcuga

SEQ ID NO: 340173 - RNA, 22 nt, Homo sapiens
cuugccuuugucuucaaaggcu

SEQ ID NO: 340174 - RNA, 22 nt, Homo sapiens
cuuggcacgugauagguguuga

SEQ ID NO: 340175 - RNA, 22 nt, Homo sapiens
cuuggcauuguguugauagaag

SEQ ID NO: 340176 - RNA, 18 nt, Homo sapiens
cuuggcgaugccaacaua

SEQ ID NO: 340177 - RNA, 22 nt, Homo sapiens
cuuggcuucuuuauguggcuau

SEQ ID NO: 340178 - RNA, 20 nt, Homo sapiens
cuuggcuuucuugguguuaa

SEQ ID NO: 340179 - RNA, 21 nt, Homo sapiens
cuugucuugcuuagaauagac

SEQ ID NO: 340180 - RNA, 22 nt, Homo sapiens
cuuuaguuaaaauugggguugu

SEQ ID NO: 340181 - RNA, 22 nt, Homo sapiens
cuuuaguugucuccucaagggu

SEQ ID NO: 340182 - RNA, 22 nt, Homo sapiens
cuuucucagugagacccgagau

SEQ ID NO: 340183 - RNA, 22 nt, Homo sapiens
cuuuggagaaaaguucuugggc

SEQ ID NO: 340184 - RNA, 23 nt, Homo sapiens
cuuuugcaaugugaucuugccac

SEQ ID NO: 340185 - RNA, 22 nt, Homo sapiens
cuuuugugauuccucaguuacu

SEQ ID NO: 340186 - RNA, 22 nt, Homo sapiens
gaaagugcugcuugacugggau

SEQ ID NO: 340187 - RNA, 21 nt, Homo sapiens
gaaauacugccuuaggagcug

SEQ ID NO: 340188 - RNA, 22 nt, Homo sapiens
gaaccagcagacuuugacaggu

SEQ ID NO: 340189 - RNA, 22 nt, Homo sapiens
gaacuuguguugcuucacaugu

SEQ ID NO: 340190 - RNA, 22 nt, Homo sapiens
gaacuuucuacauuaccucuuu

SEQ ID NO: 340191 - RNA, 18 nt, Homo sapiens
gaagaaguaggcauggca

SEQ ID NO: 340192 - RNA, 22 nt, Homo sapiens
gaauaaacuagagaggacugag

SEQ ID NO: 340193 - RNA, 22 nt, Homo sapiens
gaauagugcugcaguaaacaua

SEQ ID NO: 340194 - RNA, 22 nt, Homo sapiens
gaaucauuguuucuaaguuugu

SEQ ID NO: 340195 - RNA, 22 nt, Homo sapiens
gaaugcuaccagcaucuagugg

SEQ ID NO: 340196 - RNA, 22 nt, Homo sapiens
gaauggaacugacuauagcuga

SEQ ID NO: 340197 - RNA, 22 nt, Homo sapiens
gacacagugaagucucuacuug

SEQ ID NO: 340198 - RNA, 22 nt, Homo sapiens
gacagugagaugucaugugaaa

SEQ ID NO: 340199 - RNA, 18 nt, Homo sapiens
gacaguguggcaauuccu

SEQ ID NO: 340200 - RNA, 22 nt, Homo sapiens
gacaguguggcgauuccucaag

SEQ ID NO: 340201 - RNA, 22 nt, Homo sapiens
gacauguuuacaguguugagag

SEQ ID NO: 340202 - RNA, 22 nt, Homo sapiens
gacauguuucucucuguuuacu

SEQ ID NO: 340203 - RNA, 22 nt, Homo sapiens
gaccacagacuggaaagagggc

SEQ ID NO: 340204 - RNA, 21 nt, Homo sapiens
gaccacagcagggaaugucag

SEQ ID NO: 340205 - RNA, 22 nt, Homo sapiens
gaccacauuccacacaggcuuu

SEQ ID NO: 340206 - RNA, 22 nt, Homo sapiens
gacucuguagacaaucacaucu

SEQ ID NO: 340207 - RNA, 16 nt, Homo sapiens
gugagagaugacaaac

SEQ ID NO: 340208 - RNA, 22 nt, Homo sapiens
gugagaggaggcagcuuuuaca

SEQ ID NO: 340209 - RNA, 22 nt, Homo sapiens
gugaggcacugcugcuuuccag

SEQ ID NO: 340210 - RNA, 22 nt, Homo sapiens
gugagggaugugaaaaagguca

SEQ ID NO: 340211 - RNA, 22 nt, Homo sapiens
gugaggucagggcuguggacag

SEQ ID NO: 340212 - RNA, 17 nt, Homo sapiens
gugagguggguaguauc

SEQ ID NO: 340213 - RNA, 22 nt, Homo sapiens
gugagguguuaaccaaccugug

SEQ ID NO: 340214 - RNA, 22 nt, Homo sapiens
gugagucaugucccaucugauu

SEQ ID NO: 340215 - RNA, 22 nt, Homo sapiens
gugaguggacgugaccaauaaa

SEQ ID NO: 340216 - RNA, 22 nt, Homo sapiens
gugaugcaguacguagaggaga

SEQ ID NO: 340217 - RNA, 22 nt, Homo sapiens
gugauuauuaugcacugcaugc

SEQ ID NO: 340218 - RNA, 22 nt, Homo sapiens
gugauuuaguagaugcuaguua

SEQ ID NO: 340219 - RNA, 22 nt, Homo sapiens
gugcaaaucucugaguaucuuu

SEQ ID NO: 340220 - RNA, 22 nt, Homo sapiens
gugcaaugagaaggggcucugg

SEQ ID NO: 340221 - RNA, 22 nt, Homo sapiens
gugcacaacaugcagguuuguu

SEQ ID NO: 340222 - RNA, 22 nt, Homo sapiens
gugcacauauggugcauaagug

SEQ ID NO: 340223 - RNA, 22 nt, Homo sapiens
gugcacaugguagguauugagu

SEQ ID NO: 340224 - RNA, 21 nt, Homo sapiens
gugcagaugccacagucacuc

SEQ ID NO: 340225 - RNA, 22 nt, Homo sapiens
gugcaguguuugcauggaauca

SEQ ID NO: 340226 - RNA, 18 nt, Homo sapiens
gugcauagccauggcagc

SEQ ID NO: 340227 - RNA, 22 nt, Homo sapiens
gugcaugucuaugcgagucuaa

SEQ ID NO: 340228 - RNA, 22 nt, Homo sapiens
gugccuagugcuauugugcccu

SEQ ID NO: 340229 - RNA, 21 nt, Homo sapiens
gugcuuguagccucacuucug

SEQ ID NO: 340230 - RNA, 22 nt, Homo sapiens
gugcuuuguuguggcaguggca

SEQ ID NO: 340231 - RNA, 21 nt, Homo sapiens
guggaaauggaauuuacuaau

SEQ ID NO: 340232 - RNA, 20 nt, Homo sapiens
guggaagauaaguagccuga

SEQ ID NO: 340233 - RNA, 22 nt, Homo sapiens
guggaaggucaugaauguucuu

SEQ ID NO: 340234 - RNA, 20 nt, Homo sapiens
guggaaguagaaacauaugu

SEQ ID NO: 340235 - RNA, 22 nt, Homo sapiens
guggaaugauaucucauugugg

SEQ ID NO: 340236 - RNA, 17 nt, Homo sapiens
guggaaugucaugucaa

SEQ ID NO: 340237 - RNA, 22 nt, Homo sapiens
guggagacaaaggcugagugag

SEQ ID NO: 340238 - RNA, 22 nt, Homo sapiens
guggaguaugaaaacugacuuu

SEQ ID NO: 340239 - RNA, 22 nt, Homo sapiens
guggagucaucacucagagugg

SEQ ID NO: 340240 - RNA, 22 nt, Homo sapiens
guggaucacuugaggucaagag

SEQ ID NO: 340241 - RNA, 22 nt, Homo sapiens
guggcaaacucagcaugcccca

SEQ ID NO: 340242 - RNA, 22 nt, Homo sapiens
guggcacaauuaaguagcuauu

SEQ ID NO: 340243 - RNA, 22 nt, Homo sapiens
guggcuagaaugaagguagcug

SEQ ID NO: 340244 - RNA, 22 nt, Homo sapiens
guguaaaucugcugugaacauu

SEQ ID NO: 340245 - RNA, 22 nt, Homo sapiens
guguaugguaggaugacggagu

SEQ ID NO: 340246 - RNA, 22 nt, Homo sapiens
gugucacagcuuccaucucggu

SEQ ID NO: 340247 - RNA, 22 nt, Homo sapiens
gugucacuguugagaaguccac

SEQ ID NO: 340248 - RNA, 22 nt, Homo sapiens
gugugauuguuaauuuuaggug

SEQ ID NO: 340249 - RNA, 22 nt, Homo sapiens
gugugcacaaucuggcaugugc

SEQ ID NO: 340250 - RNA, 19 nt, Homo sapiens
gugugcauaucacagagca

SEQ ID NO: 340251 - RNA, 21 nt, Homo sapiens
gugugcuugagugaugggauu

SEQ ID NO: 340252 - RNA, 22 nt, Homo sapiens
gugugguauuauaacuagguau

SEQ ID NO: 340253 - RNA, 22 nt, Homo sapiens
guguuauggagccaaacuacua

SEQ ID NO: 340254 - RNA, 22 nt, Homo sapiens
guuaagaaguguaacuuaaguu

SEQ ID NO: 340255 - RNA, 23 nt, Homo sapiens
guuaagugaauguguacucuauu

SEQ ID NO: 340256 - RNA, 22 nt, Homo sapiens
guuacugucuuccugauugcuu

SEQ ID NO: 340257 - RNA, 22 nt, Homo sapiens
guucaagugauucuacugccuc

SEQ ID NO: 340258 - RNA, 22 nt, Homo sapiens
guucacaguuucuaaucccagc

SEQ ID NO: 340259 - RNA, 22 nt, Homo sapiens
guucaucaggaauauuggccua

SEQ ID NO: 340260 - RNA, 22 nt, Homo sapiens
guucaucaggcuuucucuagag

SEQ ID NO: 340261 - RNA, 22 nt, Homo sapiens
guucaucagggacacugguuug

SEQ ID NO: 340262 - RNA, 22 nt, Homo sapiens
guucaucagggauacuggccuu

SEQ ID NO: 340263 - RNA, 22 nt, Homo sapiens
guucaucagggauacuggcuua

SEQ ID NO: 340264 - RNA, 22 nt, Homo sapiens
guugauguugcagucuugagga

SEQ ID NO: 340265 - RNA, 22 nt, Homo sapiens
guugcccuuagcacuucagccu

SEQ ID NO: 340266 - RNA, 17 nt, Homo sapiens
guuuggguacuggguaa

SEQ ID NO: 340267 - RNA, 22 nt, Homo sapiens
uaaacacucacuucauagccau

SEQ ID NO: 340268 - RNA, 22 nt, Homo sapiens
uaaagcacuuuuuucugcaugg

SEQ ID NO: 340269 - RNA, 22 nt, Homo sapiens
uaaagcauguaauuagguuaga

SEQ ID NO: 340270 - RNA, 18 nt, Homo sapiens
uaaaggcacuguguuguu

SEQ ID NO: 340271 - RNA, 22 nt, Homo sapiens
uaaagugaggauggcaguaggu

SEQ ID NO: 340272 - RNA, 20 nt, Homo sapiens
uaaaugccucaugcuuuauu

SEQ ID NO: 340273 - RNA, 22 nt, Homo sapiens
uaaauggauaaaugaauaccua

SEQ ID NO: 340274 - RNA, 22 nt, Homo sapiens
uaacaccuuugauagcacuuuu

SEQ ID NO: 340275 - RNA, 22 nt, Homo sapiens
uaacauagucauauacuugcuu

SEQ ID NO: 340276 - RNA, 22 nt, Homo sapiens
uaacuaaagagaagucaauguc

SEQ ID NO: 340277 - RNA, 22 nt, Homo sapiens
uaagacacauguguucccaggc

SEQ ID NO: 340278 - RNA, 23 nt, Homo sapiens
uaagacacuaacuuuaugcuuug

SEQ ID NO: 340279 - RNA, 22 nt, Homo sapiens
uaagagagcuccaucuuuuccu

SEQ ID NO: 340280 - RNA, 22 nt, Homo sapiens
uaagcaguguggauccaccuug

SEQ ID NO: 340281 - RNA, 22 nt, Homo sapiens
uaagccaccgugccuggccuaa

SEQ ID NO: 340282 - RNA, 22 nt, Homo sapiens
uaaggcauuuuuuugaguugca

SEQ ID NO: 340283 - RNA, 22 nt, Homo sapiens
uaaggcuaggaauucucugaag

SEQ ID NO: 340284 - RNA, 22 nt, Homo sapiens
uaaggcuuugcuggacucaguc

SEQ ID NO: 340285 - RNA, 22 nt, Homo sapiens
uaaggcuuugguagguuugguc

SEQ ID NO: 340286 - RNA, 22 nt, Homo sapiens
uaagggcaugcugcaugagagu

SEQ ID NO: 340287 - RNA, 22 nt, Homo sapiens
uaaguaauugcagcaauuugcc

SEQ ID NO: 340288 - RNA, 22 nt, Homo sapiens
uaaguaauuguuaauagggaag

SEQ ID NO: 340289 - RNA, 22 nt, Homo sapiens
uaaguauuuuaauuccuggcau

SEQ ID NO: 340290 - RNA, 22 nt, Homo sapiens
uaagugaauguuggcuacugaa

SEQ ID NO: 340291 - RNA, 20 nt, Homo sapiens
uaagugcauaggauauuucu

SEQ ID NO: 340292 - RNA, 22 nt, Homo sapiens
uaagugcaugauuacaugcaua

SEQ ID NO: 340293 - RNA, 22 nt, Homo sapiens
uaaguguaaugucugaaguuug

SEQ ID NO: 340294 - RNA, 22 nt, Homo sapiens
uaaguucauucaugaaacuuag

SEQ ID NO: 340295 - RNA, 19 nt, Homo sapiens
ugacaugaaacccaagauc

SEQ ID NO: 340296 - RNA, 23 nt, Homo sapiens
ugacugaguauauguuuggugcu

SEQ ID NO: 340297 - RNA, 22 nt, Homo sapiens
ugacuggagaccucaguagggu

SEQ ID NO: 340298 - RNA, 18 nt, Homo sapiens
ugacuguccagguggacc

SEQ ID NO: 340299 - RNA, 23 nt, Homo sapiens
ugacuuguccagugauaguucgu

SEQ ID NO: 340300 - RNA, 22 nt, Homo sapiens
ugagaacagauggcuuuauuau

SEQ ID NO: 340301 - RNA, 22 nt, Homo sapiens
ugagaacauggagaacccccca

SEQ ID NO: 340302 - RNA, 17 nt, Homo sapiens
ugagaacaugugguauu

SEQ ID NO: 340303 - RNA, 18 nt, Homo sapiens
ugagaacauguguacaca

SEQ ID NO: 340304 - RNA, 19 nt, Homo sapiens
ugagaaccucuacagaguc

SEQ ID NO: 340305 - RNA, 22 nt, Homo sapiens
ugagaaccucugugugcccacu

SEQ ID NO: 340306 - RNA, 22 nt, Homo sapiens
ugagaagaugaacuccuugguc

SEQ ID NO: 340307 - RNA, 22 nt, Homo sapiens
ugagaagugacgcagcaggguu

SEQ ID NO: 340308 - RNA, 22 nt, Homo sapiens
ugagaaugcagaaucucgugca

SEQ ID NO: 340309 - RNA, 22 nt, Homo sapiens
ugagacaaucucaucucaguga

SEQ ID NO: 340310 - RNA, 22 nt, Homo sapiens
ugagagacaguuuguuaaaauu

SEQ ID NO: 340311 - RNA, 22 nt, Homo sapiens
ugagagucauacaaauaaaaau

SEQ ID NO: 340312 - RNA, 18 nt, Homo sapiens
ugagauacuagaauaggu

SEQ ID NO: 340313 - RNA, 22 nt, Homo sapiens
ugagaucacuaagagguaaugg

SEQ ID NO: 340314 - RNA, 22 nt, Homo sapiens
ugagaucaguuguuauaauucu

SEQ ID NO: 340315 - RNA, 22 nt, Homo sapiens
ugagaucaugccacugcacuuc

SEQ ID NO: 340316 - RNA, 22 nt, Homo sapiens
ugagaucaugucauuugcacuc

SEQ ID NO: 340317 - RNA, 22 nt, Homo sapiens
ugagaugagagaaugcuugccu

SEQ ID NO: 340318 - RNA, 22 nt, Homo sapiens
ugagaugagggaagccuaggca

SEQ ID NO: 340319 - RNA, 22 nt, Homo sapiens
ugagaugaggucucacucuguu

SEQ ID NO: 340320 - RNA, 22 nt, Homo sapiens
ugagaugagucucgcucuguca

SEQ ID NO: 340321 - RNA, 22 nt, Homo sapiens
ugagaugcuuguaaauucauuu

SEQ ID NO: 340322 - RNA, 22 nt, Homo sapiens
ugagauggaguuucgcucuugu

SEQ ID NO: 340323 - RNA, 22 nt, Homo sapiens
ugagauggaguuucgcuuuugu

SEQ ID NO: 340324 - RNA, 22 nt, Homo sapiens
ugagaugguaaauuuuuguugu

SEQ ID NO: 340325 - RNA, 19 nt, Homo sapiens
ugagauuguaugaggagau

SEQ ID NO: 340326 - RNA, 22 nt, Homo sapiens
ugagcaacauuucaaaacucca

SEQ ID NO: 340327 - RNA, 22 nt, Homo sapiens
ugagcacauuuacaucaguucc

SEQ ID NO: 340328 - RNA, 22 nt, Homo sapiens
ugagcagaaguuuugauuggcg

SEQ ID NO: 340329 - RNA, 22 nt, Homo sapiens
ugagcagagaagugcccugcgc

SEQ ID NO: 340330 - RNA, 22 nt, Homo sapiens
ugagcagugagugugcugcagg

SEQ ID NO: 340331 - RNA, 22 nt, Homo sapiens
ugagcaucucuaaaaggagcaa

SEQ ID NO: 340332 - RNA, 22 nt, Homo sapiens
ugagccaugguuagcuucucau

SEQ ID NO: 340333 - RNA, 22 nt, Homo sapiens
ugagcuaggaucacaccugcau

SEQ ID NO: 340334 - RNA, 22 nt, Homo sapiens
ugagcuagggccuggaauaggg

SEQ ID NO: 340335 - RNA, 20 nt, Homo sapiens
ugagcucaugacauuuuucu

SEQ ID NO: 340336 - RNA, 22 nt, Homo sapiens
ugagcugagacaauaaguuuuu

SEQ ID NO: 340337 - RNA, 20 nt, Homo sapiens
ugagcuuguaaacacuguuu

SEQ ID NO: 340338 - RNA, 22 nt, Homo sapiens
ugaggauaguguugaaggcagg

SEQ ID NO: 340339 - RNA, 22 nt, Homo sapiens
ugaggcaaggcugaaugaaggc

SEQ ID NO: 340340 - RNA, 22 nt, Homo sapiens
ugaggcuaggauaggcugauuc

SEQ ID NO: 340341 - RNA, 22 nt, Homo sapiens
ugagggaugcguacccuaugcc

SEQ ID NO: 340342 - RNA, 22 nt, Homo sapiens
ugagguaggugaagaaugcacg

SEQ ID NO: 340343 - RNA, 22 nt, Homo sapiens
ugaggucauguucugucagguu

SEQ ID NO: 340344 - RNA, 22 nt, Homo sapiens
ugaggugagauggcuaccccaa

SEQ ID NO: 340345 - RNA, 22 nt, Homo sapiens
ugagguguuaacuuuacuuuua

SEQ ID NO: 340346 - RNA, 20 nt, Homo sapiens
ugaguagaggaguucuauca

SEQ ID NO: 340347 - RNA, 22 nt, Homo sapiens
ugagugaggcugggcagucccu

SEQ ID NO: 340348 - RNA, 22 nt, Homo sapiens
ugauaagugagauagcaaguga

SEQ ID NO: 340349 - RNA, 22 nt, Homo sapiens
ugauaauuuugucagguuuugg

SEQ ID NO: 340350 - RNA, 22 nt, Homo sapiens
ugauauauugaaugaugaaaca

SEQ ID NO: 340351 - RNA, 22 nt, Homo sapiens
ugauaugaaagggaaauaagug

SEQ ID NO: 340352 - RNA, 22 nt, Homo sapiens
ugauauguuagaaucuugcaag

SEQ ID NO: 340353 - RNA, 17 nt, Homo sapiens
ugauauuuucccagaua

SEQ ID NO: 340354 - RNA, 22 nt, Homo sapiens
ugauauuuuugauccuuaaguu

SEQ ID NO: 340355 - RNA, 22 nt, Homo sapiens
ugaugguuuuaaaaagaggagu

SEQ ID NO: 340356 - RNA, 22 nt, Homo sapiens
ugauuuguuuagugccaaguuu

SEQ ID NO: 340357 - RNA, 18 nt, Homo sapiens
ugcaaacauguguguguu

SEQ ID NO: 340358 - RNA, 19 nt, Homo sapiens
ugcaaagucagugaagggu

SEQ ID NO: 340359 - RNA, 19 nt, Homo sapiens
ugcaaagucuuuuccuauu

SEQ ID NO: 340360 - RNA, 22 nt, Homo sapiens
ugcaagacacuguccugggcau

SEQ ID NO: 340361 - RNA, 22 nt, Homo sapiens
ugcaaguaauuccagcuacuga

SEQ ID NO: 340362 - RNA, 22 nt, Homo sapiens
ugcaaucaucgcuguuggccac

SEQ ID NO: 340363 - RNA, 22 nt, Homo sapiens
ugcaccacuacacuccaggcug

SEQ ID NO: 340364 - RNA, 22 nt, Homo sapiens
ugcaccacugcacuucagccug

SEQ ID NO: 340365 - RNA, 18 nt, Homo sapiens
ugcaccaguuuacacuuc

SEQ ID NO: 340366 - RNA, 22 nt, Homo sapiens
ugcacuguggucugagagacag

SEQ ID NO: 340367 - RNA, 19 nt, Homo sapiens
ugcagcaauguaaaagaca

SEQ ID NO: 340368 - RNA, 23 nt, Homo sapiens
ugcagcacacugaugggucuuga

SEQ ID NO: 340369 - RNA, 22 nt, Homo sapiens
ugcagcacugaacuucugggcu

SEQ ID NO: 340370 - RNA, 22 nt, Homo sapiens
ugcaguacugucagacuucuua

SEQ ID NO: 340371 - RNA, 22 nt, Homo sapiens
ugcagugcaugacuguguuaug

SEQ ID NO: 340372 - RNA, 21 nt, Homo sapiens
ugcagugugguugcccugcug

SEQ ID NO: 340373 - RNA, 22 nt, Homo sapiens
ugcaguuuaggaacugguaaca

SEQ ID NO: 340374 - RNA, 22 nt, Homo sapiens
ugcauagaauguucuguaaaua

SEQ ID NO: 340375 - RNA, 22 nt, Homo sapiens
ugcauauguucaaaguauucug

SEQ ID NO: 340376 - RNA, 22 nt, Homo sapiens
ugcauauucgaguuauuuuggg

SEQ ID NO: 340377 - RNA, 22 nt, Homo sapiens
ugcauccauucuagacucaucu

SEQ ID NO: 340378 - RNA, 22 nt, Homo sapiens
ugccaacugguuucuuuuaguu

SEQ ID NO: 340379 - RNA, 22 nt, Homo sapiens
ugccaguauuuuauugagcauu

SEQ ID NO: 340380 - RNA, 22 nt, Homo sapiens
ugcccguaauuccagcacuuug

SEQ ID NO: 340381 - RNA, 18 nt, Homo sapiens
ugccuacugggcucaagc

SEQ ID NO: 340382 - RNA, 21 nt, Homo sapiens
ugcgauccucaauccucuguu

SEQ ID NO: 340383 - RNA, 22 nt, Homo sapiens
ugcuagaagaucacacacauca

SEQ ID NO: 340384 - RNA, 20 nt, Homo sapiens
uucagcaaaggaaugggagu

SEQ ID NO: 340385 - RNA, 22 nt, Homo sapiens
uucagcaguggccaguggaaau

SEQ ID NO: 340386 - RNA, 22 nt, Homo sapiens
uucaggcaccauugucauugau

SEQ ID NO: 340387 - RNA, 22 nt, Homo sapiens
uucagggacuuuagacaagaga

SEQ ID NO: 340388 - RNA, 22 nt, Homo sapiens
uucaguggacuuaguagugcuu

SEQ ID NO: 340389 - RNA, 22 nt, Homo sapiens
uucagugucauuaacacaguag

SEQ ID NO: 340390 - RNA, 22 nt, Homo sapiens
uucauagaggacauuacuggag

SEQ ID NO: 340391 - RNA, 22 nt, Homo sapiens
uucauagucacauucgaugucu

SEQ ID NO: 340392 - RNA, 18 nt, Homo sapiens
uucauauguugaaccaga

SEQ ID NO: 340393 - RNA, 22 nt, Homo sapiens
uucaucaguugagcugguugcu

SEQ ID NO: 340394 - RNA, 20 nt, Homo sapiens
uucaugggagcaaagaggcc

SEQ ID NO: 340395 - RNA, 22 nt, Homo sapiens
uucauguaauuccauaagguaa

SEQ ID NO: 340396 - RNA, 22 nt, Homo sapiens
uuccaauguuccguguugcagu

SEQ ID NO: 340397 - RNA, 22 nt, Homo sapiens
uuccagaugggaguucuauucu

SEQ ID NO: 340398 - RNA, 20 nt, Homo sapiens
uuccagcacauuagggaagc

SEQ ID NO: 340399 - RNA, 22 nt, Homo sapiens
uuccaguguuugacucaccuuu

SEQ ID NO: 340400 - RNA, 22 nt, Homo sapiens
uucccugaaauauucacuuuca

SEQ ID NO: 340401 - RNA, 22 nt, Homo sapiens
uucccugugguauagaagccgu

SEQ ID NO: 340402 - RNA, 22 nt, Homo sapiens
uuccuugagaaaguacaaggcu

SEQ ID NO: 340403 - RNA, 22 nt, Homo sapiens
uuccuugguucagggaaggucc

SEQ ID NO: 340404 - RNA, 22 nt, Homo sapiens
uuccuugugacuaguagugacc

SEQ ID NO: 340405 - RNA, 20 nt, Homo sapiens
uucuacagucacaggaagau

SEQ ID NO: 340406 - RNA, 23 nt, Homo sapiens
uucuaucaggcccaggagcccug

SEQ ID NO: 340407 - RNA, 22 nt, Homo sapiens
uucuauggucacagaugcuuga

SEQ ID NO: 340408 - RNA, 22 nt, Homo sapiens
uucuaugguuuuuaugguguua

SEQ ID NO: 340409 - RNA, 19 nt, Homo sapiens
uucucugguuguacuaccc

SEQ ID NO: 340410 - RNA, 22 nt, Homo sapiens
uucugacuggugugagauggua

SEQ ID NO: 340411 - RNA, 22 nt, Homo sapiens
uucugguuaauacuugcaaaaa

SEQ ID NO: 340412 - RNA, 22 nt, Homo sapiens
uucugugguugaaaggagagau

SEQ ID NO: 340413 - RNA, 22 nt, Homo sapiens
uucuuugcaugaucucaaaguc

SEQ ID NO: 340414 - RNA, 22 nt, Homo sapiens
uucuuuggauaaaguuuuaugc

SEQ ID NO: 340415 - RNA, 23 nt, Homo sapiens
uugaaaagucaguagccucugau

SEQ ID NO: 340416 - RNA, 22 nt, Homo sapiens
uugaaagucauggcacaggcaa

SEQ ID NO: 340417 - RNA, 22 nt, Homo sapiens
uugaaguguguauacauugugg

SEQ ID NO: 340418 - RNA, 22 nt, Homo sapiens
uugaauaggcucaugcuuauca

SEQ ID NO: 340419 - RNA, 22 nt, Homo sapiens
uugaauguacuuguucucacua

SEQ ID NO: 340420 - RNA, 22 nt, Homo sapiens
uugacauauguguguccacaua

SEQ ID NO: 340421 - RNA, 22 nt, Homo sapiens
uugacuccagagugaguaaaug

SEQ ID NO: 340422 - RNA, 22 nt, Homo sapiens
uugagacggagucucacucugu

SEQ ID NO: 340423 - RNA, 22 nt, Homo sapiens
uugagagaaaaaauuuauuggu

SEQ ID NO: 340424 - RNA, 22 nt, Homo sapiens
uugagauacauaauuaugaaug

SEQ ID NO: 340425 - RNA, 22 nt, Homo sapiens
uugagauauccauaaaugggaa

SEQ ID NO: 340426 - RNA, 22 nt, Homo sapiens
uugagaugauggauaugcuaau

SEQ ID NO: 340427 - RNA, 22 nt, Homo sapiens
uugagauggaaucucgcuuugu

SEQ ID NO: 340428 - RNA, 22 nt, Homo sapiens
uugagauggagccucacucugc

SEQ ID NO: 340429 - RNA, 22 nt, Homo sapiens
uugagauggagucucacucuug

SEQ ID NO: 340430 - RNA, 22 nt, Homo sapiens
uugagauggaguucauuuuugu

SEQ ID NO: 340431 - RNA, 22 nt, Homo sapiens
uugagauggaguuucacucucg

SEQ ID NO: 340432 - RNA, 22 nt, Homo sapiens
uugagauggaguuucacucuug

SEQ ID NO: 340433 - RNA, 22 nt, Homo sapiens
uugagauggaguuucgcucuuu

SEQ ID NO: 340434 - RNA, 19 nt, Homo sapiens
uugagaugugaacucacac

SEQ ID NO: 340435 - RNA, 22 nt, Homo sapiens
uugagauuuuccucaaauauuu

SEQ ID NO: 340436 - RNA, 22 nt, Homo sapiens
uugagcaaaacauuaauauuag

SEQ ID NO: 340437 - RNA, 22 nt, Homo sapiens
uugagcuagggagaucgagguc

SEQ ID NO: 340438 - RNA, 22 nt, Homo sapiens
uugagcucaucuucagggguga

SEQ ID NO: 340439 - RNA, 22 nt, Homo sapiens
uugaggcaaugaggagaagcug

SEQ ID NO: 340440 - RNA, 16 nt, Homo sapiens
uugaggcaugucucag

SEQ ID NO: 340441 - RNA, 22 nt, Homo sapiens
uugagggaagccagaggucugc

SEQ ID NO: 340442 - RNA, 22 nt, Homo sapiens
uugagggaggccucaguuuaca

SEQ ID NO: 340443 - RNA, 22 nt, Homo sapiens
uugagguaggaggagcuuggau

SEQ ID NO: 340444 - RNA, 22 nt, Homo sapiens
uugaggugaauuugcaggaugc

SEQ ID NO: 340445 - RNA, 22 nt, Homo sapiens
uugaguccccacacuggguccc

SEQ ID NO: 340446 - RNA, 22 nt, Homo sapiens
uugauaguuuuaaaauuaaucu

SEQ ID NO: 340447 - RNA, 22 nt, Homo sapiens
uugauauggcugcuuaccauaa

SEQ ID NO: 340448 - RNA, 22 nt, Homo sapiens
uugauauguguauagcaugugg

SEQ ID NO: 340449 - RNA, 22 nt, Homo sapiens
uugaugauguuucugccuugcc

SEQ ID NO: 340450 - RNA, 22 nt, Homo sapiens
uugauguaggcauucaaggcua

SEQ ID NO: 340451 - RNA, 23 nt, Homo sapiens
uugcaaagccugaaacucuucag

SEQ ID NO: 340452 - RNA, 18 nt, Homo sapiens
uugcaaauucuucccugu

SEQ ID NO: 340453 - RNA, 22 nt, Homo sapiens
uugcaacauuguaaguuuauau

SEQ ID NO: 340454 - RNA, 22 nt, Homo sapiens
uugcaacuuagaaaaaucauuu

SEQ ID NO: 340455 - RNA, 22 nt, Homo sapiens
uugcaagaaaucagagccuucc

SEQ ID NO: 340456 - RNA, 22 nt, Homo sapiens
uugcaagauguucaugggcugu

SEQ ID NO: 340457 - RNA, 22 nt, Homo sapiens
uugcaagugccguaacuaccaa

SEQ ID NO: 340458 - RNA, 22 nt, Homo sapiens
uugcacauggcaggugcucaau

SEQ ID NO: 340459 - RNA, 22 nt, Homo sapiens
uugcacauugauuuuguaucuu

SEQ ID NO: 340460 - RNA, 22 nt, Homo sapiens
uugcacuccagccuggaugaca

SEQ ID NO: 340461 - RNA, 22 nt, Homo sapiens
uugcacucuagccugggugaca

SEQ ID NO: 340462 - RNA, 20 nt, Homo sapiens
uugcagagcccaacccugga

SEQ ID NO: 340463 - RNA, 22 nt, Homo sapiens
uugcagcauucugguuccuggu

SEQ ID NO: 340464 - RNA, 18 nt, Homo sapiens
uugcauaguguauccaaa

SEQ ID NO: 340465 - RNA, 22 nt, Homo sapiens
uugcauuagugugguacauuug

SEQ ID NO: 340466 - RNA, 22 nt, Homo sapiens
uugcuggugguucgagcaacac

SEQ ID NO: 340467 - RNA, 20 nt, Homo sapiens
uugcugguguuagaggaggc

SEQ ID NO: 340468 - RNA, 22 nt, Homo sapiens
uuggaaagagguguuuaugacu

SEQ ID NO: 340469 - RNA, 20 nt, Homo sapiens
uuggaaaugugaauugggag

SEQ ID NO: 340470 - RNA, 22 nt, Homo sapiens
uuggaagacaaugcugauucuc

SEQ ID NO: 340471 - RNA, 22 nt, Homo sapiens
uuggaagauuacuuaguuuucu

SEQ ID NO: 340472 - RNA, 22 nt, Homo sapiens
uuggaaggcuccuaaugaaugg

SEQ ID NO: 340473 - RNA, 22 nt, Homo sapiens
uuggaauauaaccuguuucuaa

SEQ ID NO: 340474 - RNA, 22 nt, Homo sapiens
uuggaauauuauuauugggcag

SEQ ID NO: 340475 - RNA, 22 nt, Homo sapiens
uuggaaugcaacagaaggauaa

SEQ ID NO: 340476 - RNA, 22 nt, Homo sapiens
uuggaaugcacacugagccugc

SEQ ID NO: 340477 - RNA, 22 nt, Homo sapiens
uuggaaugugacugauaauauu

SEQ ID NO: 340478 - RNA, 22 nt, Homo sapiens
uuggacagaugguuacauuuuu

SEQ ID NO: 340479 - RNA, 18 nt, Homo sapiens
uuggacggagagucaaau

SEQ ID NO: 340480 - RNA, 22 nt, Homo sapiens
uuggacuucuaacugacaugga

SEQ ID NO: 340481 - RNA, 22 nt, Homo sapiens
uuggagucaucucuguacugua

SEQ ID NO: 340482 - RNA, 22 nt, Homo sapiens
uuggagugugagagcagccugg

SEQ ID NO: 340483 - RNA, 22 nt, Homo sapiens
uuggagugugcucauaacugcu

SEQ ID NO: 340484 - RNA, 22 nt, Homo sapiens
uuggaugauaaagaagccuaag

SEQ ID NO: 340485 - RNA, 22 nt, Homo sapiens
uuggcaagaaccuucuuccaag

SEQ ID NO: 340486 - RNA, 22 nt, Homo sapiens
uuggcacugagcaagaacaggg

SEQ ID NO: 340487 - RNA, 22 nt, Homo sapiens
uuggcauuguggauggaaucau

SEQ ID NO: 340488 - RNA, 22 nt, Homo sapiens
uuggcuguguuucccuacaaau

SEQ ID NO: 340489 - RNA, 22 nt, Homo sapiens
uugggccacuuuaguuuccuua

SEQ ID NO: 340490 - RNA, 22 nt, Homo sapiens
uugguaaaaugaccacagacau

SEQ ID NO: 340491 - RNA, 22 nt, Homo sapiens
uugguaguaaucccucacaaaa

SEQ ID NO: 340492 - RNA, 22 nt, Homo sapiens
uuguaaacaucuguacauugcu

SEQ ID NO: 340493 - RNA, 22 nt, Homo sapiens
uuguaagaaucuagcucuuuau

SEQ ID NO: 340494 - RNA, 22 nt, Homo sapiens
uuguaaucaacacaucauuggg

SEQ ID NO: 340495 - RNA, 22 nt, Homo sapiens
uuguauguuguuugucagagaa

SEQ ID NO: 340496 - RNA, 22 nt, Homo sapiens
uugucacccuacauaacaggga

SEQ ID NO: 340497 - RNA, 22 nt, Homo sapiens
uuguccccaucugcugccagaa

SEQ ID NO: 340498 - RNA, 22 nt, Homo sapiens
uuguccucuccaaaucucaugu

SEQ ID NO: 340499 - RNA, 22 nt, Homo sapiens
uugucucacuggaguuuaguaa

SEQ ID NO: 340500 - RNA, 22 nt, Homo sapiens
uugucuugcagcuuaggcauca

SEQ ID NO: 340501 - RNA, 22 nt, Homo sapiens
uugugcacauguacccuagaac

SEQ ID NO: 340502 - RNA, 21 nt, Homo sapiens
uugugccaaacccuggaggga

SEQ ID NO: 340503 - RNA, 22 nt, Homo sapiens
uugugccugguacauggagaaa

SEQ ID NO: 340504 - RNA, 22 nt, Homo sapiens
uugugcuugcuguguucuaugc

SEQ ID NO: 340505 - RNA, 22 nt, Homo sapiens
uugugcuuuugagcugagauga

SEQ ID NO: 340506 - RNA, 22 nt, Homo sapiens
uugugguugaugaagacugucu

SEQ ID NO: 340507 - RNA, 22 nt, Homo sapiens
uuguguaguaccucucacauug

SEQ ID NO: 340508 - RNA, 22 nt, Homo sapiens
uugugucccugcggcugaggag

SEQ ID NO: 340509 - RNA, 22 nt, Homo sapiens
uuguguuuuuaguagggaaggg

SEQ ID NO: 340510 - RNA, 22 nt, Homo sapiens
uuguugcacugcuuuccuggcc

SEQ ID NO: 340511 - RNA, 22 nt, Homo sapiens
uuuaacauuggaugagaucguc

SEQ ID NO: 340512 - RNA, 22 nt, Homo sapiens
uuuaauguuacaguauugguau

SEQ ID NO: 340513 - RNA, 22 nt, Homo sapiens
uuucaacaggucuggggugguc

SEQ ID NO: 340514 - RNA, 23 nt, Homo sapiens
uuucacagaaggauuguagggcc

SEQ ID NO: 340515 - RNA, 22 nt, Homo sapiens
uuucacagcaauugccuauugu

SEQ ID NO: 340516 - RNA, 22 nt, Homo sapiens
uuucacaguguucucccccaga

SEQ ID NO: 340517 - RNA, 20 nt, Homo sapiens
uuucaguacuuucuacuggc

SEQ ID NO: 340518 - RNA, 22 nt, Homo sapiens
uuucaucaagcacagaguagau

SEQ ID NO: 340519 - RNA, 22 nt, Homo sapiens
uuucauggacgcaaugccuuuu

SEQ ID NO: 340520 - RNA, 22 nt, Homo sapiens
uuucccugaaggcucugaaguc

SEQ ID NO: 340521 - RNA, 22 nt, Homo sapiens
uuucuacagggcuugccaggua

SEQ ID NO: 340522 - RNA, 22 nt, Homo sapiens
uuucuauguugaccagucuaga

SEQ ID NO: 340523 - RNA, 17 nt, Homo sapiens
uuucucagcccucuucu

SEQ ID NO: 340524 - RNA, 23 nt, Homo sapiens
uuucuugggcaugcuaugucagu

SEQ ID NO: 340525 - RNA, 22 nt, Homo sapiens
uuugaaaguaauuugguuggug

SEQ ID NO: 340526 - RNA, 22 nt, Homo sapiens
uuugaaccauuugaagaaugau

SEQ ID NO: 340527 - RNA, 22 nt, Homo sapiens
uuugaagcuaaggugcuugguu

SEQ ID NO: 340528 - RNA, 22 nt, Homo sapiens
uuugacuaccaggaauguucuu

SEQ ID NO: 340529 - RNA, 22 nt, Homo sapiens
uuugacuagaguguuuuacaac

SEQ ID NO: 340530 - RNA, 22 nt, Homo sapiens
uuugaggaaaggcauaaguagg

SEQ ID NO: 340531 - RNA, 22 nt, Homo sapiens
uuugagguguauggcaaguuga

SEQ ID NO: 340532 - RNA, 22 nt, Homo sapiens
uuugagugugauaucgauugga

SEQ ID NO: 340533 - RNA, 22 nt, Homo sapiens
uuugcaagaugaaaaaguucua

SEQ ID NO: 340534 - RNA, 22 nt, Homo sapiens
uuugcagugucagcuucugugu

SEQ ID NO: 340535 - RNA, 22 nt, Homo sapiens
uuugccaauauuuuauugagga

SEQ ID NO: 340536 - RNA, 22 nt, Homo sapiens
uuugcugagucugacuucaugg

SEQ ID NO: 340537 - RNA, 22 nt, Homo sapiens
uuugcuuaaaucuuaaucagau

SEQ ID NO: 340538 - RNA, 22 nt, Homo sapiens
uuuggcaacguuggaucccuca

SEQ ID NO: 340539 - RNA, 22 nt, Homo sapiens
uuugguuuuuguuaucacucau

SEQ ID NO: 340540 - RNA, 22 nt, Homo sapiens
uuuguaauccuauuccaaagga

SEQ ID NO: 340541 - RNA, 22 nt, Homo sapiens
uuuguacacgugggugaauugu

SEQ ID NO: 340542 - RNA, 20 nt, Homo sapiens
uuuguaucucuggguacugg

SEQ ID NO: 340543 - RNA, 22 nt, Homo sapiens
uuuguauguuggagauuggaga

SEQ ID NO: 340544 - RNA, 22 nt, Homo sapiens
uuugucaauaacuaccaacagg

SEQ ID NO: 340545 - RNA, 22 nt, Homo sapiens
uuugugaaugucauaagcucca

SEQ ID NO: 340546 - RNA, 22 nt, Homo sapiens
uuuguucuucguuccugagcca

SEQ ID NO: 340547 - RNA, 22 nt, Homo sapiens
uuuuaacagccaggggacggcc

SEQ ID NO: 340548 - RNA, 22 nt, Homo sapiens
uuuuacacuguugguuggaaug

SEQ ID NO: 340549 - RNA, 22 nt, Homo sapiens
uuuuaugggcuauuugcauuag

SEQ ID NO: 340550 - RNA, 21 nt, Homo sapiens
uuuugcacacuaugcagcuuu

SEQ ID NO: 340551 - RNA, 22 nt, Homo sapiens
uuuugcaggcauuggaaguuua

SEQ ID NO: 340552 - RNA, 22 nt, Homo sapiens
uuuugcuugugaauagccacau

SEQ ID NO: 340553 - RNA, 22 nt, Homo sapiens
uuuugcuuuuccucggucccac

SEQ ID NO: 340554 - RNA, 19 nt, Homo sapiens
uuuuggaaaugugaacagc

SEQ ID NO: 340555 - RNA, 22 nt, Homo sapiens
uuuuggcuuaaagagaauguau

SEQ ID NO: 340556 - RNA, 22 nt, Homo sapiens
uuuugguaaugaacuuaggaag

SEQ ID NO: 340557 - RNA, 22 nt, Homo sapiens
uuuuugagaauuggugaaacac

SEQ ID NO: 340558 - RNA, 22 nt, Homo sapiens
uuuuuugguaauugaacaauga

SEQ ID NO: 340559 - RNA, 22 nt, Homo sapiens
gggauguaugauauauguuggu

SEQ ID NO: 340560 - RNA, 22 nt, Homo sapiens
gggauguuuuauacugagccug

SEQ ID NO: 340561 - RNA, 23 nt, Homo sapiens
gggauuguaaaauaugagggcag

SEQ ID NO: 340562 - RNA, 22 nt, Homo sapiens
gggcaugaugucuuaugccuau

SEQ ID NO: 340563 - RNA, 22 nt, Homo sapiens
gggcgagaaucggcugcucagc

SEQ ID NO: 340564 - RNA, 23 nt, Homo sapiens
gggcuagaugagagcuuccuggg

SEQ ID NO: 340565 - RNA, 22 nt, Homo sapiens
gggguauguaagugagugagug

SEQ ID NO: 340566 - RNA, 15 nt, Homo sapiens
ggguccucucccaaa

SEQ ID NO: 340567 - RNA, 22 nt, Homo sapiens
gguauguaggucuacgguacaa

SEQ ID NO: 340568 - RNA, 22 nt, Homo sapiens
ggucagaaagacaggcauucag

SEQ ID NO: 340569 - RNA, 22 nt, Homo sapiens
ggucaggagaaugguaacugag

SEQ ID NO: 340570 - RNA, 22 nt, Homo sapiens
ggucauagagcaagcaaacagc

SEQ ID NO: 340571 - RNA, 22 nt, Homo sapiens
ggucauggauaagauccagaag

SEQ ID NO: 340572 - RNA, 22 nt, Homo sapiens
ggucugguguugaaauucuuca

SEQ ID NO: 340573 - RNA, 22 nt, Homo sapiens
gguguguaaauuacuuaucucu

SEQ ID NO: 340574 - RNA, 22 nt, Homo sapiens
ugagaagcauaccagugucugu

SEQ ID NO: 340575 - RNA, 22 nt, Homo sapiens
ugagaauauuugaagauguuag

SEQ ID NO: 340576 - RNA, 22 nt, Homo sapiens
ugagaauguagggcucucccag

SEQ ID NO: 340577 - RNA, 22 nt, Homo sapiens
ugagacacuucccagaucccuu

SEQ ID NO: 340578 - RNA, 22 nt, Homo sapiens
ugagaccaacagauuccaguuc

SEQ ID NO: 340579 - RNA, 22 nt, Homo sapiens
ugagaccugaucuugguacugc

SEQ ID NO: 340580 - RNA, 22 nt, Homo sapiens
ugagauaaagcauguacugugu

SEQ ID NO: 340581 - RNA, 22 nt, Homo sapiens
ugagauaauuuacuuguugagg

SEQ ID NO: 340582 - RNA, 22 nt, Homo sapiens
ugagauagggucucacucuguc

SEQ ID NO: 340583 - RNA, 22 nt, Homo sapiens
ugagauaguuguagauguacau

SEQ ID NO: 340584 - RNA, 22 nt, Homo sapiens
ugagauaucauuucacacccag

SEQ ID NO: 340585 - RNA, 22 nt, Homo sapiens
ugagauauugggaguaauguca

SEQ ID NO: 340586 - RNA, 22 nt, Homo sapiens
ugagaucaagguuaauauaauc

SEQ ID NO: 340587 - RNA, 22 nt, Homo sapiens
ugagaucugauaggccuggguu

SEQ ID NO: 340588 - RNA, 19 nt, Homo sapiens
ugagaucuuuacuggguuu

SEQ ID NO: 340589 - RNA, 22 nt, Homo sapiens
ugagaugaagcuagaagaaugg

SEQ ID NO: 340590 - RNA, 22 nt, Homo sapiens
ugagaugaagucuugcucuguu

SEQ ID NO: 340591 - RNA, 22 nt, Homo sapiens
ugagaugaguugcuggcucuga

SEQ ID NO: 340592 - RNA, 22 nt, Homo sapiens
ugagaugauuuaauggagccca

SEQ ID NO: 340593 - RNA, 21 nt, Homo sapiens
ugagaugcaaucaccagggag

SEQ ID NO: 340594 - RNA, 22 nt, Homo sapiens
ugagauggaguuucacuuuugu

SEQ ID NO: 340595 - RNA, 22 nt, Homo sapiens
ugagauguaaucucgcucuguc

SEQ ID NO: 340596 - RNA, 22 nt, Homo sapiens
ugagaugugaucaccugaaggg

SEQ ID NO: 340597 - RNA, 21 nt, Homo sapiens
ugagauuaaguuguuuagaag

SEQ ID NO: 340598 - RNA, 22 nt, Homo sapiens
ugagauuaucguaauguaucuc

SEQ ID NO: 340599 - RNA, 22 nt, Homo sapiens
ugagcaagaaauagaaacagau

SEQ ID NO: 340600 - RNA, 22 nt, Homo sapiens
ugagcagagggagaaguaaauu

SEQ ID NO: 340601 - RNA, 22 nt, Homo sapiens
ugagccauggcaccuugucuaa

SEQ ID NO: 340602 - RNA, 23 nt, Homo sapiens
ugagccaugggacuccaagggag

SEQ ID NO: 340603 - RNA, 22 nt, Homo sapiens
ugagcuaggauccugucacugu

SEQ ID NO: 340604 - RNA, 22 nt, Homo sapiens
uguauguuguaagacuuagacc

SEQ ID NO: 340605 - RNA, 16 nt, Homo sapiens
uguauugcuaaaaaga

SEQ ID NO: 340606 - RNA, 22 nt, Homo sapiens
ugucaaugggaauuuguuuuag

SEQ ID NO: 340607 - RNA, 23 nt, Homo sapiens
ugucaucaagaugaggucacacu

SEQ ID NO: 340608 - RNA, 22 nt, Homo sapiens
ugucaucauuccaucagggcuu

SEQ ID NO: 340609 - RNA, 22 nt, Homo sapiens
ugucauggggaaaauaacagac

SEQ ID NO: 340610 - RNA, 22 nt, Homo sapiens
ugucauucaggaaauucuaagu

SEQ ID NO: 340611 - RNA, 22 nt, Homo sapiens
uguccaaaucagagguaccaaa

SEQ ID NO: 340612 - RNA, 22 nt, Homo sapiens
uguccaaauugaaucaucuggu

SEQ ID NO: 340613 - RNA, 20 nt, Homo sapiens
ugucccaaccccauggguuc

SEQ ID NO: 340614 - RNA, 22 nt, Homo sapiens
ugucucaguucccuucucugga

SEQ ID NO: 340615 - RNA, 22 nt, Homo sapiens
ugucuuguagacaauguauagu

SEQ ID NO: 340616 - RNA, 22 nt, Homo sapiens
ugugaaacacgaaagucuaaaa

SEQ ID NO: 340617 - RNA, 22 nt, Homo sapiens
ugugaacagaauuagucaccua

SEQ ID NO: 340618 - RNA, 22 nt, Homo sapiens
ugugaacagcuccaaaugugga

SEQ ID NO: 340619 - RNA, 22 nt, Homo sapiens
ugugacacugaauggcagaacu

SEQ ID NO: 340620 - RNA, 23 nt, Homo sapiens
ugugacacuuccgucaguucauu

SEQ ID NO: 340621 - RNA, 22 nt, Homo sapiens
ugugagaaaugcagaaucucag

SEQ ID NO: 340622 - RNA, 17 nt, Homo sapiens
ugugaucaucacccuug

SEQ ID NO: 340623 - RNA, 18 nt, Homo sapiens
ugugcaauauuaaccacc

SEQ ID NO: 340624 - RNA, 22 nt, Homo sapiens
ugugcacaaccugcagguuugu

SEQ ID NO: 340625 - RNA, 22 nt, Homo sapiens
ugugcacaaugugcagguuuga

SEQ ID NO: 340626 - RNA, 22 nt, Homo sapiens
ugugcaugacagcauacaaacg

SEQ ID NO: 340627 - RNA, 22 nt, Homo sapiens
ugugccaaaucccauaauaaau

SEQ ID NO: 340628 - RNA, 22 nt, Homo sapiens
ugugccaaucauagggcuuggu

SEQ ID NO: 340629 - RNA, 22 nt, Homo sapiens
ugugccacuccaaccuggguga

SEQ ID NO: 340630 - RNA, 22 nt, Homo sapiens
ugugccacuccaggaggcuguu

SEQ ID NO: 340631 - RNA, 22 nt, Homo sapiens
ugugccacugcacucuggccug

SEQ ID NO: 340632 - RNA, 22 nt, Homo sapiens
ugugccuacugugggagcguca

SEQ ID NO: 340633 - RNA, 22 nt, Homo sapiens
ugugccugagguuaacauuguu

SEQ ID NO: 340634 - RNA, 22 nt, Homo sapiens
ugugcuugaauuuaguagcuua

SEQ ID NO: 340635 - RNA, 22 nt, Homo sapiens
uguggaaauaaaagaaagguua

SEQ ID NO: 340636 - RNA, 22 nt, Homo sapiens
uguggaaauggugcuacgaaca

SEQ ID NO: 340637 - RNA, 22 nt, Homo sapiens
uguggaaauuguuguauuuaau

SEQ ID NO: 340638 - RNA, 22 nt, Homo sapiens
uguggcauugaauaaccuugga

SEQ ID NO: 340639 - RNA, 18 nt, Homo sapiens
uguggcuguuuuccaaua

SEQ ID NO: 340640 - RNA, 22 nt, Homo sapiens
ugugucuugagagucucgagaa

SEQ ID NO: 340641 - RNA, 22 nt, Homo sapiens
ugugucuuuuaucacacaaugu

SEQ ID NO: 340642 - RNA, 21 nt, Homo sapiens
uguuaacaugcagauuacugg

SEQ ID NO: 340643 - RNA, 22 nt, Homo sapiens
uguuauguauggagugauccca

SEQ ID NO: 340644 - RNA, 22 nt, Homo sapiens
uguucauggauccaguggcuuc

SEQ ID NO: 340645 - RNA, 19 nt, Homo sapiens
uguugcacauaucaauaug

SEQ ID NO: 340646 - RNA, 18 nt, Homo sapiens
uguugguguucacucacu

SEQ ID NO: 340647 - RNA, 22 nt, Homo sapiens
uguuugguggucucuucacaug

SEQ ID NO: 340648 - RNA, 22 nt, Homo sapiens
uuaacacugccauugauacugu

SEQ ID NO: 340649 - RNA, 22 nt, Homo sapiens
uuaacagcacuacguggggauc

SEQ ID NO: 340650 - RNA, 22 nt, Homo sapiens
uuaagaagugauuuuccucauu

SEQ ID NO: 340651 - RNA, 22 nt, Homo sapiens
uuaagcaaagguaacaugagaa

SEQ ID NO: 340652 - RNA, 18 nt, Homo sapiens
uuaaggcaggacuuuaag

SEQ ID NO: 340653 - RNA, 22 nt, Homo sapiens
uuaaggcuccuguuggcuuuua

SEQ ID NO: 340654 - RNA, 21 nt, Homo sapiens
uuaaguaauuacccaacucuc

SEQ ID NO: 340655 - RNA, 22 nt, Homo sapiens
uuaaguagcugggcaugguggu

SEQ ID NO: 340656 - RNA, 22 nt, Homo sapiens
uuaauacugcuuaacuuuagga

SEQ ID NO: 340657 - RNA, 22 nt, Homo sapiens
uuaauagugacucauuuuccac

SEQ ID NO: 340658 - RNA, 22 nt, Homo sapiens
uuaauccugccuuauuucagua

SEQ ID NO: 340659 - RNA, 22 nt, Homo sapiens
uuaaugcuuggggaguaguucu

SEQ ID NO: 340660 - RNA, 22 nt, Homo sapiens
uuaauuguaucuauagauguca

SEQ ID NO: 340661 - RNA, 22 nt, Homo sapiens
uuacaaguggcaucucucugga

SEQ ID NO: 340662 - RNA, 22 nt, Homo sapiens
uuacagcagugccccacuccca

SEQ ID NO: 340663 - RNA, 22 nt, Homo sapiens
uuacagucaaguuacauuucuc

SEQ ID NO: 340664 - RNA, 22 nt, Homo sapiens
uuacagucucaagagugcugca

SEQ ID NO: 340665 - RNA, 19 nt, Homo sapiens
uuacagugugcccuuuuag

SEQ ID NO: 340666 - RNA, 22 nt, Homo sapiens
uuacaucaucacauuaguuugc

SEQ ID NO: 340667 - RNA, 22 nt, Homo sapiens
uuaccagucugauuccuguuag

SEQ ID NO: 340668 - RNA, 22 nt, Homo sapiens
uuaccaguggugcuguaaacuu

SEQ ID NO: 340669 - RNA, 22 nt, Homo sapiens
uuagacaguggugcacugcacu

SEQ ID NO: 340670 - RNA, 22 nt, Homo sapiens
uuagaugaagucacagaaccca

SEQ ID NO: 340671 - RNA, 22 nt, Homo sapiens
uuagcacaucuuucuauguaag

SEQ ID NO: 340672 - RNA, 22 nt, Homo sapiens
uuagccggguguguuggcgggc

SEQ ID NO: 340673 - RNA, 22 nt, Homo sapiens
uuaggcaguuuauugauuuuca

SEQ ID NO: 340674 - RNA, 22 nt, Homo sapiens
uuaggcucuuuaucaguuaacu

SEQ ID NO: 340675 - RNA, 22 nt, Homo sapiens
uuagggaggcucaggacaagag

SEQ ID NO: 340676 - RNA, 22 nt, Homo sapiens
uuagguuguugccauugaaagu

SEQ ID NO: 340677 - RNA, 22 nt, Homo sapiens
uuaguagcacagaguaucagca

SEQ ID NO: 340678 - RNA, 22 nt, Homo sapiens
uuagugcaaacucuucaaugcu

SEQ ID NO: 340679 - RNA, 22 nt, Homo sapiens
uuagugcuuacgaugagcuaag

SEQ ID NO: 340680 - RNA, 22 nt, Homo sapiens
uuaguucauugugacuggacuc

SEQ ID NO: 340681 - RNA, 22 nt, Homo sapiens
uuauacacugugggaguguaaa

SEQ ID NO: 340682 - RNA, 22 nt, Homo sapiens
uuauacuacuauaaagagguag

SEQ ID NO: 340683 - RNA, 21 nt, Homo sapiens
uuauaguggcaugauuuauaa

SEQ ID NO: 340684 - RNA, 22 nt, Homo sapiens
uuauaguuuuucaccuggagaa

SEQ ID NO: 340685 - RNA, 19 nt, Homo sapiens
uuauauaguuucugaggcu

SEQ ID NO: 340686 - RNA, 22 nt, Homo sapiens
uuauauguuagacauggugggu

SEQ ID NO: 340687 - RNA, 22 nt, Homo sapiens
uuaugcaucuuccacacucauu

SEQ ID NO: 340688 - RNA, 22 nt, Homo sapiens
uuauguaaaucaaucuggaauc

SEQ ID NO: 340689 - RNA, 22 nt, Homo sapiens
uuaugucauuuuuggauguuaa

SEQ ID NO: 340690 - RNA, 22 nt, Homo sapiens
uuauuagagauauuugguuagg

SEQ ID NO: 340691 - RNA, 22 nt, Homo sapiens
uggagagugauaaguaaaugga

SEQ ID NO: 340692 - RNA, 22 nt, Homo sapiens
uggagcaaaguugaggccaagc

SEQ ID NO: 340693 - RNA, 22 nt, Homo sapiens
uggagcccuaguuccucauaac

SEQ ID NO: 340694 - RNA, 22 nt, Homo sapiens
uggaggacugcagaacugaggc

SEQ ID NO: 340695 - RNA, 22 nt, Homo sapiens
uggaguauuauguaauuucaau

SEQ ID NO: 340696 - RNA, 22 nt, Homo sapiens
uggagucuugaugauuuucaaa

SEQ ID NO: 340697 - RNA, 21 nt, Homo sapiens
uggagugaagaguuuauugac

SEQ ID NO: 340698 - RNA, 20 nt, Homo sapiens
uggagugaagguucuggacc

SEQ ID NO: 340699 - RNA, 20 nt, Homo sapiens
uggaguuugaguucuuggag

SEQ ID NO: 340700 - RNA, 22 nt, Homo sapiens
uggauaguuuacugaagagugg

SEQ ID NO: 340701 - RNA, 18 nt, Homo sapiens
uggauaugaaauucugga

SEQ ID NO: 340702 - RNA, 22 nt, Homo sapiens
uggaugaagagaugguaguugc

SEQ ID NO: 340703 - RNA, 21 nt, Homo sapiens
uggauuguacacccuaucauu

SEQ ID NO: 340704 - RNA, 22 nt, Homo sapiens
uggcaaaugaaagaaagccagu

SEQ ID NO: 340705 - RNA, 22 nt, Homo sapiens
uggcaacaucuggggacauguu

SEQ ID NO: 340706 - RNA, 22 nt, Homo sapiens
uggcaacuugcaaccucauucu

SEQ ID NO: 340707 - RNA, 22 nt, Homo sapiens
uggcaccauccaggugucucua

SEQ ID NO: 340708 - RNA, 22 nt, Homo sapiens
uggcacuggagauacauuaaua

SEQ ID NO: 340709 - RNA, 22 nt, Homo sapiens
uggcagugggagauauuuuauu

SEQ ID NO: 340710 - RNA, 17 nt, Homo sapiens
uggcaugaggguguggg

SEQ ID NO: 340711 - RNA, 22 nt, Homo sapiens
uggcaugauccuagauucaaca

SEQ ID NO: 340712 - RNA, 23 nt, Homo sapiens
uggcauuuuaguuagcuucagug

SEQ ID NO: 340713 - RNA, 22 nt, Homo sapiens
uggccuguaacgcugucucagc

SEQ ID NO: 340714 - RNA, 22 nt, Homo sapiens
uggcucuuucuagacuuaauua

SEQ ID NO: 340715 - RNA, 22 nt, Homo sapiens
ugggaaauguagccuagcugug

SEQ ID NO: 340716 - RNA, 22 nt, Homo sapiens
ugggaagagggagcgauuuugg

SEQ ID NO: 340717 - RNA, 22 nt, Homo sapiens
ugggaaugaaauuacauagcuu

SEQ ID NO: 340718 - RNA, 22 nt, Homo sapiens
ugggagcauugcauuagaagcc

SEQ ID NO: 340719 - RNA, 22 nt, Homo sapiens
ugggaucaugagcaccgcuucc

SEQ ID NO: 340720 - RNA, 22 nt, Homo sapiens
ugggaugaugaaaaggcuuucu

SEQ ID NO: 340721 - RNA, 22 nt, Homo sapiens
ugggcaagugacuuggcuucuc

SEQ ID NO: 340722 - RNA, 22 nt, Homo sapiens
uggggugugagggagaaagaaa

SEQ ID NO: 340723 - RNA, 22 nt, Homo sapiens
uggguaaaucucuguucagggc

SEQ ID NO: 340724 - RNA, 22 nt, Homo sapiens
uggguagagaaucaggaucuua

SEQ ID NO: 340725 - RNA, 22 nt, Homo sapiens
ugguacuucaugcucacagaua

SEQ ID NO: 340726 - RNA, 22 nt, Homo sapiens
uggucaaaucugaugugagaaa

SEQ ID NO: 340727 - RNA, 22 nt, Homo sapiens
uggucaccugaauuaugcaugu

SEQ ID NO: 340728 - RNA, 20 nt, Homo sapiens
uggucaccuucaggagguuc

SEQ ID NO: 340729 - RNA, 22 nt, Homo sapiens
uggucagaugcugaguggaucu

SEQ ID NO: 340730 - RNA, 22 nt, Homo sapiens
ugguccaguucugugauauugc

SEQ ID NO: 340731 - RNA, 20 nt, Homo sapiens
ugguccccaccaaaucucau

SEQ ID NO: 340732 - RNA, 20 nt, Homo sapiens
ugguccccugagucuggcuu

SEQ ID NO: 340733 - RNA, 22 nt, Homo sapiens
uggucucuuugcuuuagucauc

SEQ ID NO: 340734 - RNA, 22 nt, Homo sapiens
uggucuuuucaacaaaugguau

SEQ ID NO: 340735 - RNA, 22 nt, Homo sapiens
uggugcaaugaagugaucucaa

SEQ ID NO: 340736 - RNA, 22 nt, Homo sapiens
uggugccgugguccuggggcca

SEQ ID NO: 340737 - RNA, 22 nt, Homo sapiens
uggugcuuaaauaaggcuuuca

SEQ ID NO: 340738 - RNA, 22 nt, Homo sapiens
ugguggcuuuucguagguucac

SEQ ID NO: 340739 - RNA, 23 nt, Homo sapiens
ugguuuguaagagauggacugga

SEQ ID NO: 340740 - RNA, 23 nt, Homo sapiens
uguaaagcuaugaauuauucuuu

SEQ ID NO: 340741 - RNA, 22 nt, Homo sapiens
uguagauauucuuucaguuuuu

SEQ ID NO: 340742 - RNA, 23 nt, Homo sapiens
uguauacacccugugcaucuggg

SEQ ID NO: 340743 - RNA, 22 nt, Homo sapiens
uguauacugucuaauauguugu

SEQ ID NO: 340744 - RNA, 22 nt, Homo sapiens
uguauguaauugaaguuaaguu

SEQ ID NO: 340745 - RNA, 22 nt, Homo sapiens
uuauuagguugguggaaaagua

SEQ ID NO: 340746 - RNA, 22 nt, Homo sapiens
uucaaaaccucugcuuaagccc

SEQ ID NO: 340747 - RNA, 22 nt, Homo sapiens
uucaaaguaaaaauguguucac

SEQ ID NO: 340748 - RNA, 22 nt, Homo sapiens
uucaaauguucuuucaccaccc

SEQ ID NO: 340749 - RNA, 22 nt, Homo sapiens
uucaagcuacaguggcaggguu

SEQ ID NO: 340750 - RNA, 22 nt, Homo sapiens
uucaagcuauggugaucuuuuc

SEQ ID NO: 340751 - RNA, 22 nt, Homo sapiens
uucaagucaauuuuugaaugac

SEQ ID NO: 340752 - RNA, 22 nt, Homo sapiens
uucaauaugucauuggcaggca

SEQ ID NO: 340753 - RNA, 22 nt, Homo sapiens
uucacaaugccuuguugauggu

SEQ ID NO: 340754 - RNA, 22 nt, Homo sapiens
uucacagacaacuggucccuua

SEQ ID NO: 340755 - RNA, 22 nt, Homo sapiens
uucacagccgcaccccaucacu

SEQ ID NO: 340756 - RNA, 22 nt, Homo sapiens
uucacaguguuucucacgguua

SEQ ID NO: 340757 - RNA, 22 nt, Homo sapiens
uucacaugacagggugaagcau

SEQ ID NO: 340758 - RNA, 22 nt, Homo sapiens
uucacccugguuguagauggac

SEQ ID NO: 340759 - RNA, 22 nt, Homo sapiens
uucacuguagccucagccucuu

SEQ ID NO: 340760 - RNA, 22 nt, Homo sapiens
uucacugugaauaaaggcuccc

SEQ ID NO: 340761 - RNA, 22 nt, Homo sapiens
uucacugugcuuaaauucugcu

SEQ ID NO: 340762 - RNA, 22 nt, Homo sapiens
uucacuguuaagcaguuaaacu

SEQ ID NO: 340763 - RNA, 19 nt, Homo sapiens
uucagcagugucugcucuu

SEQ ID NO: 340764 - RNA, 22 nt, Homo sapiens
uucagcuacuugggaggcugaa

SEQ ID NO: 340765 - RNA, 22 nt, Homo sapiens
uucaggcuccgugccagcuccg

SEQ ID NO: 340766 - RNA, 22 nt, Homo sapiens
uucaggcuuuuauuuacugaua

SEQ ID NO: 340767 - RNA, 22 nt, Homo sapiens
uucaguagucaaaagauaaggg

SEQ ID NO: 340768 - RNA, 22 nt, Homo sapiens
uucauaguaacaguaacuaugg

SEQ ID NO: 340769 - RNA, 18 nt, Homo sapiens
uucauaguagcaugauuu

SEQ ID NO: 340770 - RNA, 22 nt, Homo sapiens
uucaucagggagaaauaauuuc

SEQ ID NO: 340771 - RNA, 22 nt, Homo sapiens
uucaucuggcaauucagagauu

SEQ ID NO: 340772 - RNA, 22 nt, Homo sapiens
uucauggacucaauaguuucgc

SEQ ID NO: 340773 - RNA, 22 nt, Homo sapiens
uucauggagccauccuuugauc

SEQ ID NO: 340774 - RNA, 22 nt, Homo sapiens
uuccaggugggcgugggccugg

SEQ ID NO: 340775 - RNA, 21 nt, Homo sapiens
uuccagugagccuagaugccu

SEQ ID NO: 340776 - RNA, 22 nt, Homo sapiens
uuccaguggacuacuucauccu

SEQ ID NO: 340777 - RNA, 22 nt, Homo sapiens
uuccagugggacgagaugugga

SEQ ID NO: 340778 - RNA, 22 nt, Homo sapiens
uuccaguguguucauccucaga

SEQ ID NO: 340779 - RNA, 22 nt, Homo sapiens
uuccaugagaugcaucaaagcu

SEQ ID NO: 340780 - RNA, 22 nt, Homo sapiens
uucccagagccugggagugagg

SEQ ID NO: 340781 - RNA, 22 nt, Homo sapiens
uucccagucaaacgaaggacuu

SEQ ID NO: 340782 - RNA, 22 nt, Homo sapiens
uucccaguggaacauguaguca

SEQ ID NO: 340783 - RNA, 22 nt, Homo sapiens
uucccagugguuagcucugguc

SEQ ID NO: 340784 - RNA, 22 nt, Homo sapiens
aaaacgcauccucacaggucug

SEQ ID NO: 340785 - RNA, 22 nt, Homo sapiens
aaaaggcuagcuaguaacagaa

SEQ ID NO: 340786 - RNA, 22 nt, Homo sapiens
aaacaccacgcggucccucgga

SEQ ID NO: 340787 - RNA, 23 nt, Homo sapiens
aaagacuagucaggugcaguggu

SEQ ID NO: 340788 - RNA, 22 nt, Homo sapiens
aaagcacuggagucaucaucua

SEQ ID NO: 340789 - RNA, 22 nt, Homo sapiens
aaagggcacugugcuuuggcaa

SEQ ID NO: 340790 - RNA, 22 nt, Homo sapiens
aaaguaauugcaguuuuugcaa

SEQ ID NO: 340791 - RNA, 22 nt, Homo sapiens
aaaguacugggauuggccgggu

SEQ ID NO: 340792 - RNA, 20 nt, Homo sapiens
aaaguaggcuaauaccaaaa

SEQ ID NO: 340793 - RNA, 22 nt, Homo sapiens
aaagugaauguaucccguaagu

SEQ ID NO: 340794 - RNA, 22 nt, Homo sapiens
aaagugccugacucauaguuag

SEQ ID NO: 340795 - RNA, 22 nt, Homo sapiens
aaagugcugggauuuuaggcau

SEQ ID NO: 340796 - RNA, 22 nt, Homo sapiens
aaaguggugugaguauguaucu

SEQ ID NO: 340797 - RNA, 22 nt, Homo sapiens
aaauaacugucagguucuggaa

SEQ ID NO: 340798 - RNA, 22 nt, Homo sapiens
aaauccauuuguucagcuaugc

SEQ ID NO: 340799 - RNA, 22 nt, Homo sapiens
aaaugacuuuuuaugcagagua

SEQ ID NO: 340800 - RNA, 22 nt, Homo sapiens
aaaugccucccauucuacugac

SEQ ID NO: 340801 - RNA, 20 nt, Homo sapiens
aaaugcuguaauguuuggga

SEQ ID NO: 340802 - RNA, 22 nt, Homo sapiens
aucacaauuguacguaggagcc

SEQ ID NO: 340803 - RNA, 22 nt, Homo sapiens
aucacagaacuuugagcagaga

SEQ ID NO: 340804 - RNA, 22 nt, Homo sapiens
aucacauggccagguaguaauc

SEQ ID NO: 340805 - RNA, 22 nt, Homo sapiens
aucaccauguguacauuagacc

SEQ ID NO: 340806 - RNA, 22 nt, Homo sapiens
aucagauuccagaggcagcacc

SEQ ID NO: 340807 - RNA, 22 nt, Homo sapiens
aucaggcacacauuggaguuug

SEQ ID NO: 340808 - RNA, 22 nt, Homo sapiens
aucagugcauguuuguugagcu

SEQ ID NO: 340809 - RNA, 22 nt, Homo sapiens
aucaucacaguuguguguaaug

SEQ ID NO: 340810 - RNA, 22 nt, Homo sapiens
aucauggaguauuugcaagucu

SEQ ID NO: 340811 - RNA, 22 nt, Homo sapiens
aucauugcacaucacagccuca

SEQ ID NO: 340812 - RNA, 22 nt, Homo sapiens
auccaguuuuaggagauuucua

SEQ ID NO: 340813 - RNA, 22 nt, Homo sapiens
aucccuagaaaaaucagcacau

SEQ ID NO: 340814 - RNA, 22 nt, Homo sapiens
aucccuguaacuagcagccccu

SEQ ID NO: 340815 - RNA, 22 nt, Homo sapiens
aucccugugacgagcaucccua

SEQ ID NO: 340816 - RNA, 22 nt, Homo sapiens
aucccuguguccagcaccugug

SEQ ID NO: 340817 - RNA, 22 nt, Homo sapiens
aucccuugacguggagucucug

SEQ ID NO: 340818 - RNA, 22 nt, Homo sapiens
auccucugagagaguuucauaa

SEQ ID NO: 340819 - RNA, 22 nt, Homo sapiens
auccucugagaucuaggcagag

SEQ ID NO: 340820 - RNA, 22 nt, Homo sapiens
auccugaagcuuuacugaauuc

SEQ ID NO: 340821 - RNA, 22 nt, Homo sapiens
aucuaaaucucauaugggcaca

SEQ ID NO: 340822 - RNA, 22 nt, Homo sapiens
aucuacagccagucugguuugu

SEQ ID NO: 340823 - RNA, 20 nt, Homo sapiens
aucucugggcaaaggaaaau

SEQ ID NO: 340824 - RNA, 22 nt, Homo sapiens
aucugcaaagcugggcugagac

SEQ ID NO: 340825 - RNA, 22 nt, Homo sapiens
aucugcaaauaaugaagauugg

SEQ ID NO: 340826 - RNA, 22 nt, Homo sapiens
aucugcauucccauguuuauug

SEQ ID NO: 340827 - RNA, 22 nt, Homo sapiens
aucugguguauuggugcugggu

SEQ ID NO: 340828 - RNA, 22 nt, Homo sapiens
aucuuguguugaauggugcaga

SEQ ID NO: 340829 - RNA, 22 nt, Homo sapiens
augaaaacaugauuugccuguu

SEQ ID NO: 340830 - RNA, 22 nt, Homo sapiens
augaaaucuuuccugugaggau

SEQ ID NO: 340831 - RNA, 22 nt, Homo sapiens
augaaaugcauguuaaguccgu

SEQ ID NO: 340832 - RNA, 22 nt, Homo sapiens
augaaauguaugagucuggguu

SEQ ID NO: 340833 - RNA, 17 nt, Homo sapiens
augaacucaucauuuuu

SEQ ID NO: 340834 - RNA, 20 nt, Homo sapiens
augaaggcaggugugaguuu

SEQ ID NO: 340835 - RNA, 18 nt, Homo sapiens
augaagucaucacuuuua

SEQ ID NO: 340836 - RNA, 23 nt, Homo sapiens
augaauguaaagaaugugggaag

SEQ ID NO: 340837 - RNA, 23 nt, Homo sapiens
augaauguaaggaguguaagaaa

SEQ ID NO: 340838 - RNA, 22 nt, Homo sapiens
augacaagagccuucuuuccuu

SEQ ID NO: 340839 - RNA, 22 nt, Homo sapiens
augacagugagugagcucucac

SEQ ID NO: 340840 - RNA, 22 nt, Homo sapiens
augacugagacuaacuuacuuu

SEQ ID NO: 340841 - RNA, 22 nt, Homo sapiens
augagauaaaccaucucuuaag

SEQ ID NO: 340842 - RNA, 22 nt, Homo sapiens
augagauacuacaaaugaguuu

SEQ ID NO: 340843 - RNA, 22 nt, Homo sapiens
augagauauguuaaaaguuaaa

SEQ ID NO: 340844 - RNA, 22 nt, Homo sapiens
augagauauuuuauaagaucau

SEQ ID NO: 340845 - RNA, 22 nt, Homo sapiens
augagauuguuugugugaaaua

SEQ ID NO: 340846 - RNA, 22 nt, Homo sapiens
augagcaaagagaugagacccu

SEQ ID NO: 340847 - RNA, 22 nt, Homo sapiens
augagcugauuuccuuaccaua

SEQ ID NO: 340848 - RNA, 22 nt, Homo sapiens
augaggaaggagccuuugucug

SEQ ID NO: 340849 - RNA, 22 nt, Homo sapiens
augagggagggguggugccgca

SEQ ID NO: 340850 - RNA, 22 nt, Homo sapiens
augagguccuagccaacuuuuu

SEQ ID NO: 340851 - RNA, 22 nt, Homo sapiens
augaggugaguaaauaaaugaa

SEQ ID NO: 340852 - RNA, 22 nt, Homo sapiens
augaggugggagaaucacuuga

SEQ ID NO: 340853 - RNA, 22 nt, Homo sapiens
augaggugggcggcuuggaaga

SEQ ID NO: 340854 - RNA, 22 nt, Homo sapiens
augaguugaagcuacaagaggc

SEQ ID NO: 340855 - RNA, 15 nt, Homo sapiens
augaguuuuauggag

SEQ ID NO: 340856 - RNA, 22 nt, Homo sapiens
augauacugaguugaguucuca

SEQ ID NO: 340857 - RNA, 22 nt, Homo sapiens
augauugugaauaugugguuuu

SEQ ID NO: 340858 - RNA, 22 nt, Homo sapiens
augcaacugcacuccagccugg

SEQ ID NO: 340859 - RNA, 22 nt, Homo sapiens
augcaagacaccgauuagcuuu

SEQ ID NO: 340860 - RNA, 22 nt, Homo sapiens
augcacaugcgaaaacuugugu

SEQ ID NO: 340861 - RNA, 22 nt, Homo sapiens
augcagcugaggguaguggagc

SEQ ID NO: 340862 - RNA, 22 nt, Homo sapiens
augcauauuccugggccucacu

SEQ ID NO: 340863 - RNA, 22 nt, Homo sapiens
augcauggagucuuucacaagu

SEQ ID NO: 340864 - RNA, 22 nt, Homo sapiens
augccacagaaauaaccaaaau

SEQ ID NO: 340865 - RNA, 19 nt, Homo sapiens
augccacagugaggucaga

SEQ ID NO: 340866 - RNA, 22 nt, Homo sapiens
augccacugcacuucagccugg

SEQ ID NO: 340867 - RNA, 22 nt, Homo sapiens
augccauugcacuccagccuag

SEQ ID NO: 340868 - RNA, 22 nt, Homo sapiens
augccauugcacuccagccugg

SEQ ID NO: 340869 - RNA, 22 nt, Homo sapiens
augcuacugaccccuacuuaca

SEQ ID NO: 340870 - RNA, 22 nt, Homo sapiens
augcuguuuuguagcucccucu

SEQ ID NO: 340871 - RNA, 19 nt, Homo sapiens
auggaacugcuggagccac

SEQ ID NO: 340872 - RNA, 22 nt, Homo sapiens
auggaaggagaauggucuuuga

SEQ ID NO: 340873 - RNA, 22 nt, Homo sapiens
auggaaugccauuuauaaugga

SEQ ID NO: 340874 - RNA, 22 nt, Homo sapiens
auggaauguaaguuauguuugc

SEQ ID NO: 340875 - RNA, 22 nt, Homo sapiens
auggacagaaaaaaauagaugu

SEQ ID NO: 340876 - RNA, 22 nt, Homo sapiens
auggaggacaaugucaccuuca

SEQ ID NO: 340877 - RNA, 19 nt, Homo sapiens
auggauacauuuucugcua

SEQ ID NO: 340878 - RNA, 22 nt, Homo sapiens
auggauugucuccuugugccau

SEQ ID NO: 340879 - RNA, 22 nt, Homo sapiens
auggcaauguaagucagaaaaa

SEQ ID NO: 340880 - RNA, 22 nt, Homo sapiens
auggcacagaguagaugcucaa

SEQ ID NO: 340881 - RNA, 22 nt, Homo sapiens
auggcagcaccccacucuacug

SEQ ID NO: 340882 - RNA, 22 nt, Homo sapiens
auggcagcccucuuuauccaug

SEQ ID NO: 340883 - RNA, 22 nt, Homo sapiens
auggcaguuuauucuaaaucaa

SEQ ID NO: 340884 - RNA, 22 nt, Homo sapiens
auggcaguuucagcuauaguuu

SEQ ID NO: 340885 - RNA, 22 nt, Homo sapiens
auggcccaguuugcuaucccua

SEQ ID NO: 340886 - RNA, 22 nt, Homo sapiens
auggcccugcuaccacuuuucu

SEQ ID NO: 340887 - RNA, 22 nt, Homo sapiens
auggcuguuucugcaaugucua

SEQ ID NO: 340888 - RNA, 22 nt, Homo sapiens
auggcuuugggcugcucugccc

SEQ ID NO: 340889 - RNA, 22 nt, Homo sapiens
auggcuuuuuucuugggcacuc

SEQ ID NO: 340890 - RNA, 18 nt, Homo sapiens
uauugcuugguuuggaga

SEQ ID NO: 340891 - RNA, 22 nt, Homo sapiens
uauugucacuaaaggaagcugg

SEQ ID NO: 340892 - RNA, 22 nt, Homo sapiens
uauuucaguugugcagguaguu

SEQ ID NO: 340893 - RNA, 22 nt, Homo sapiens
uauuugauuaacaagagccuaa

SEQ ID NO: 340894 - RNA, 22 nt, Homo sapiens
uauuugcacucccaucauggug

SEQ ID NO: 340895 - RNA, 22 nt, Homo sapiens
uauuuggauagucuggaaaaaa

SEQ ID NO: 340896 - RNA, 22 nt, Homo sapiens
uauuugguuggugcaaaaguaa

SEQ ID NO: 340897 - RNA, 22 nt, Homo sapiens
ucaaacauccccaccagggacu

SEQ ID NO: 340898 - RNA, 20 nt, Homo sapiens
ucaaagacauggcugucaga

SEQ ID NO: 340899 - RNA, 22 nt, Homo sapiens
ucaaaucaucuuuuccaaagcu

SEQ ID NO: 340900 - RNA, 22 nt, Homo sapiens
ucaacacaguuaaauggggaaa

SEQ ID NO: 340901 - RNA, 22 nt, Homo sapiens
ucaacauugcugucaggcaucu

SEQ ID NO: 340902 - RNA, 21 nt, Homo sapiens
ucaacccuugcgucaccaagc

SEQ ID NO: 340903 - RNA, 22 nt, Homo sapiens
ucaaggcacuagcugagcugca

SEQ ID NO: 340904 - RNA, 22 nt, Homo sapiens
ucaauguaucuccaagaauuga

SEQ ID NO: 340905 - RNA, 22 nt, Homo sapiens
ucaauugcaucaacaguguaca

SEQ ID NO: 340906 - RNA, 22 nt, Homo sapiens
ucacaaagcuuggccugcuucu

SEQ ID NO: 340907 - RNA, 22 nt, Homo sapiens
ucacaagugagaggaauuagau

SEQ ID NO: 340908 - RNA, 22 nt, Homo sapiens
ucacaaguguauagacaugucc

SEQ ID NO: 340909 - RNA, 22 nt, Homo sapiens
ucacacucucaccaacauuugg

SEQ ID NO: 340910 - RNA, 22 nt, Homo sapiens
ucacacugaaacuaggguguga

SEQ ID NO: 340911 - RNA, 23 nt, Homo sapiens
ucacacuuaagagaaaugcagcu

SEQ ID NO: 340912 - RNA, 22 nt, Homo sapiens
ucacagaugaggcgagaggcag

SEQ ID NO: 340913 - RNA, 21 nt, Homo sapiens
ucacagccuaggaccugaaga

SEQ ID NO: 340914 - RNA, 22 nt, Homo sapiens
ucacaguaacuuuguugcuuuu

SEQ ID NO: 340915 - RNA, 22 nt, Homo sapiens
ucacaguagcaaauguuagaaa

SEQ ID NO: 340916 - RNA, 22 nt, Homo sapiens
uugaguccauucgaugcugauu

SEQ ID NO: 340917 - RNA, 22 nt, Homo sapiens
uugauaugacuaucuuuuaugu

SEQ ID NO: 340918 - RNA, 22 nt, Homo sapiens
uugauauguggaauauuuaucu

SEQ ID NO: 340919 - RNA, 22 nt, Homo sapiens
uugaucaaaucugagugagaau

SEQ ID NO: 340920 - RNA, 22 nt, Homo sapiens
uugauuagauccaguugauuga

SEQ ID NO: 340921 - RNA, 22 nt, Homo sapiens
uugauuuguagaaugccccaac

SEQ ID NO: 340922 - RNA, 21 nt, Homo sapiens
uugcaaaugcugcugccugau

SEQ ID NO: 340923 - RNA, 22 nt, Homo sapiens
uugcacagucuagcuccaccuu

SEQ ID NO: 340924 - RNA, 22 nt, Homo sapiens
uugcacagugguuuagagccug

SEQ ID NO: 340925 - RNA, 22 nt, Homo sapiens
uugcacaguguguacagcacca

SEQ ID NO: 340926 - RNA, 22 nt, Homo sapiens
uugcacauugauuuuguauccu

SEQ ID NO: 340927 - RNA, 22 nt, Homo sapiens
uugcaccuugaagccaauagca

SEQ ID NO: 340928 - RNA, 22 nt, Homo sapiens
uugcacuccagcucuaggugac

SEQ ID NO: 340929 - RNA, 18 nt, Homo sapiens
uugcacuccugccugggu

SEQ ID NO: 340930 - RNA, 22 nt, Homo sapiens
uugcacuguaauuuauuuaugu

SEQ ID NO: 340931 - RNA, 22 nt, Homo sapiens
uugcagagaaauuucugguuua

SEQ ID NO: 340932 - RNA, 22 nt, Homo sapiens
uugcauaagugcauucugugau

SEQ ID NO: 340933 - RNA, 22 nt, Homo sapiens
uugcauagacaauauuaaucuu

SEQ ID NO: 340934 - RNA, 22 nt, Homo sapiens
uugcauagaccgaugucuugga

SEQ ID NO: 340935 - RNA, 22 nt, Homo sapiens
uugcccuuuagguaacuauaua

SEQ ID NO: 340936 - RNA, 22 nt, Homo sapiens
uugcucaggcuagaguucagcu

SEQ ID NO: 340937 - RNA, 22 nt, Homo sapiens
uugcuuaggcuggagugcagug

SEQ ID NO: 340938 - RNA, 22 nt, Homo sapiens
uugcuuagucaugaaucacuga

SEQ ID NO: 340939 - RNA, 22 nt, Homo sapiens
uuggaagacauucugucugcua

SEQ ID NO: 340940 - RNA, 22 nt, Homo sapiens
uuggaaggcugaauggccucuc

SEQ ID NO: 340941 - RNA, 23 nt, Homo sapiens
uuggaaugagaccuaagaguuuu

SEQ ID NO: 340942 - RNA, 22 nt, Homo sapiens
uuggaauguauggcaucuugcg

SEQ ID NO: 340943 - RNA, 22 nt, Homo sapiens
uuggaauuuuacuucuguaaga

SEQ ID NO: 340944 - RNA, 22 nt, Homo sapiens
uuggagagagaggacucccggc

SEQ ID NO: 340945 - RNA, 22 nt, Homo sapiens
uuggauuauaaacugagauuug

SEQ ID NO: 340946 - RNA, 22 nt, Homo sapiens
uuggcaacauagugagaccccc

SEQ ID NO: 340947 - RNA, 22 nt, Homo sapiens
uuggcagaauguuagaaacuua

SEQ ID NO: 340948 - RNA, 22 nt, Homo sapiens
uuggcaguaucuacuacagcua

SEQ ID NO: 340949 - RNA, 22 nt, Homo sapiens
uuggcagugguucugacggacc

SEQ ID NO: 340950 - RNA, 22 nt, Homo sapiens
uuggcauugaguuucaaaucau

SEQ ID NO: 340951 - RNA, 22 nt, Homo sapiens
uuggccauaugacuugcuuugg

SEQ ID NO: 340952 - RNA, 22 nt, Homo sapiens
uuggcccugcugaccauucccu

SEQ ID NO: 340953 - RNA, 22 nt, Homo sapiens
uuggcuuaguugaccacagucu

SEQ ID NO: 340954 - RNA, 22 nt, Homo sapiens
uuggcuucuggacuauugugca

SEQ ID NO: 340955 - RNA, 22 nt, Homo sapiens
uuggcuuuuaugcagcuuaggu

SEQ ID NO: 340956 - RNA, 22 nt, Homo sapiens
uuggucaucucccuccuuuuag

SEQ ID NO: 340957 - RNA, 22 nt, Homo sapiens
uugguuaucaucauuucagcaa

SEQ ID NO: 340958 - RNA, 22 nt, Homo sapiens
gcuuguguuugcuccccagaau

SEQ ID NO: 340959 - RNA, 21 nt, Homo sapiens
gcuuuuucggaagucuuuggc

SEQ ID NO: 340960 - RNA, 22 nt, Homo sapiens
ggaaagcuagguguggguguac

SEQ ID NO: 340961 - RNA, 22 nt, Homo sapiens
ggaaguauaaacuuaguggagu

SEQ ID NO: 340962 - RNA, 23 nt, Homo sapiens
ggaaugaaaccugguuaugauau

SEQ ID NO: 340963 - RNA, 22 nt, Homo sapiens
ggaaugagaaauauuacacaau

SEQ ID NO: 340964 - RNA, 19 nt, Homo sapiens
ggaaugcaccaguccuugc

SEQ ID NO: 340965 - RNA, 22 nt, Homo sapiens
ggacagaaaggguucaccaaac

SEQ ID NO: 340966 - RNA, 22 nt, Homo sapiens
ggacugagaggacuacagugua

SEQ ID NO: 340967 - RNA, 23 nt, Homo sapiens
ggacuguaagggauauaaagguu

SEQ ID NO: 340968 - RNA, 22 nt, Homo sapiens
ggacuguacuccuggccagugu

SEQ ID NO: 340969 - RNA, 19 nt, Homo sapiens
ggacugucauggaguaguu

SEQ ID NO: 340970 - RNA, 22 nt, Homo sapiens
ggagaauugcuuggacccggga

SEQ ID NO: 340971 - RNA, 22 nt, Homo sapiens
ggagagcuaggcagagguuugu

SEQ ID NO: 340972 - RNA, 22 nt, Homo sapiens
ggagaucuuuaggaguuggacu

SEQ ID NO: 340973 - RNA, 22 nt, Homo sapiens
ggaguaggcuguccggcaccca

SEQ ID NO: 340974 - RNA, 22 nt, Homo sapiens
ggaucacagccagcucccagaa

SEQ ID NO: 340975 - RNA, 22 nt, Homo sapiens
ggaugcauucaacuuccaguuc

SEQ ID NO: 340976 - RNA, 22 nt, Homo sapiens
ggcaagaaaaugcaauuacugu

SEQ ID NO: 340977 - RNA, 22 nt, Homo sapiens
ggcaagaagagaguuuaaacau

SEQ ID NO: 340978 - RNA, 22 nt, Homo sapiens
ggcaagaggagauucugcuccc

SEQ ID NO: 340979 - RNA, 22 nt, Homo sapiens
ggcaagaucuuggcucacugaa

SEQ ID NO: 340980 - RNA, 22 nt, Homo sapiens
ggcaagugucagcagcaacacc

SEQ ID NO: 340981 - RNA, 22 nt, Homo sapiens
ggcacaauugcagcaauaaaca

SEQ ID NO: 340982 - RNA, 22 nt, Homo sapiens
ggcaccauuuuacuccuucccu

SEQ ID NO: 340983 - RNA, 22 nt, Homo sapiens
ggcagacuguggaguucuuucu

SEQ ID NO: 340984 - RNA, 17 nt, Homo sapiens
ggcaggauccaggaucc

SEQ ID NO: 340985 - RNA, 22 nt, Homo sapiens
ggccagaugcaguggcucacac

SEQ ID NO: 340986 - RNA, 22 nt, Homo sapiens
ggcuagaauagggauagaccuu

SEQ ID NO: 340987 - RNA, 22 nt, Homo sapiens
ggcucaguuuccuccgucugcu

SEQ ID NO: 340988 - RNA, 22 nt, Homo sapiens
ggcugguuuucaguuacugagu

SEQ ID NO: 340989 - RNA, 22 nt, Homo sapiens
gggaagugugguuucuuuacag

SEQ ID NO: 340990 - RNA, 22 nt, Homo sapiens
gggagugugcacacaugguaua

SEQ ID NO: 340991 - RNA, 22 nt, Homo sapiens
gggaguguguaggacccagugu

SEQ ID NO: 340992 - RNA, 22 nt, Homo sapiens
gggggagugugguacccagcau

SEQ ID NO: 340993 - RNA, 22 nt, Homo sapiens
gggguaggcuacacugaguucc

SEQ ID NO: 340994 - RNA, 22 nt, Homo sapiens
gggucauggaugugaagcuaga

SEQ ID NO: 340995 - RNA, 22 nt, Homo sapiens
gggugguuuuauuaucagugac

SEQ ID NO: 340996 - RNA, 22 nt, Homo sapiens
gguaggcacuggugggaagaga

SEQ ID NO: 340997 - RNA, 22 nt, Homo sapiens
gguauguagugugaaguaggga

SEQ ID NO: 340998 - RNA, 19 nt, Homo sapiens
ggucacagggguuacaagg

SEQ ID NO: 340999 - RNA, 22 nt, Homo sapiens
ggucagauggcagcugggccug

SEQ ID NO: 341000 - RNA, 19 nt, Homo sapiens
ggucagcaaagucuagcug

SEQ ID NO: 341001 - RNA, 22 nt, Homo sapiens
ggucaguguuaucaccgaagga

SEQ ID NO: 341002 - RNA, 22 nt, Homo sapiens
ggugagcacagaaugcccugag

SEQ ID NO: 341003 - RNA, 22 nt, Homo sapiens
gguggugguauuucagaaaaug

SEQ ID NO: 341004 - RNA, 22 nt, Homo sapiens
guaaaguaaagcacaucaaggu

SEQ ID NO: 341005 - RNA, 22 nt, Homo sapiens
guaaguauuaggugugagauuc

SEQ ID NO: 341006 - RNA, 22 nt, Homo sapiens
guaaucucagcuacuugggagc

SEQ ID NO: 341007 - RNA, 22 nt, Homo sapiens
guacaaguaagaaaauugccca

SEQ ID NO: 341008 - RNA, 22 nt, Homo sapiens
guacaagugcaguuucguuaca

SEQ ID NO: 341009 - RNA, 22 nt, Homo sapiens
guacacguggcuguguaggagu

SEQ ID NO: 341010 - RNA, 22 nt, Homo sapiens
guacaguuuucaguguucacug

SEQ ID NO: 341011 - RNA, 22 nt, Homo sapiens
guacauagucacacauauacau

SEQ ID NO: 341012 - RNA, 22 nt, Homo sapiens
guagaagcacaggugaguuggu

SEQ ID NO: 341013 - RNA, 22 nt, Homo sapiens
guagcaugcaauauuauagaga

SEQ ID NO: 341014 - RNA, 22 nt, Homo sapiens
guauacaugucaaaacucacau

SEQ ID NO: 341015 - RNA, 22 nt, Homo sapiens
guauuagguuggggcaaaagua

SEQ ID NO: 341016 - RNA, 22 nt, Homo sapiens
guauuagguuggugcaaaauaa

SEQ ID NO: 341017 - RNA, 22 nt, Homo sapiens
guauuuguugcagcagcacuau

SEQ ID NO: 341018 - RNA, 22 nt, Homo sapiens
gucaacauauuaauuauguucu

SEQ ID NO: 341019 - RNA, 22 nt, Homo sapiens
gucacagaaaaagauaugccaa

SEQ ID NO: 341020 - RNA, 22 nt, Homo sapiens
gucaccagcuguguuagccccu

SEQ ID NO: 341021 - RNA, 22 nt, Homo sapiens
gucacugggugcugcgccuguc

SEQ ID NO: 341022 - RNA, 22 nt, Homo sapiens
gucaguggauacugucucuguc

SEQ ID NO: 341023 - RNA, 22 nt, Homo sapiens
gucauugcacuccagccuggac

SEQ ID NO: 341024 - RNA, 18 nt, Homo sapiens
guccauuuguugguacac

SEQ ID NO: 341025 - RNA, 22 nt, Homo sapiens
guccauuuguuuccagagcacu

SEQ ID NO: 341026 - RNA, 22 nt, Homo sapiens
guccuggagaagcguggaccgg

SEQ ID NO: 341027 - RNA, 22 nt, Homo sapiens
gucucagugcgaaucucaaaga

SEQ ID NO: 341028 - RNA, 22 nt, Homo sapiens
gucucccagccuacauauuucu

SEQ ID NO: 341029 - RNA, 22 nt, Homo sapiens
gucucccagccuacaucuuucu

SEQ ID NO: 341030 - RNA, 22 nt, Homo sapiens
gucuccggcuguccuuugaggu

SEQ ID NO: 341031 - RNA, 22 nt, Homo sapiens
gucucugguugcuuuuguacca

SEQ ID NO: 341032 - RNA, 22 nt, Homo sapiens
gucugguuccugggagauuucu

SEQ ID NO: 341033 - RNA, 20 nt, Homo sapiens
gucugucuccgaguagaauu

SEQ ID NO: 341034 - RNA, 22 nt, Homo sapiens
gucugucuuuugucuuugaaau

SEQ ID NO: 341035 - RNA, 22 nt, Homo sapiens
gucugugguuccuaugucaccu

SEQ ID NO: 341036 - RNA, 22 nt, Homo sapiens
gucuuugaugucuaugugcuuc

SEQ ID NO: 341037 - RNA, 22 nt, Homo sapiens
gucuuugcauguauguucauga

SEQ ID NO: 341038 - RNA, 22 nt, Homo sapiens
gucuuugcuuuuaaccagaggu

SEQ ID NO: 341039 - RNA, 22 nt, Homo sapiens
gugaaagacauauaugguuuga

SEQ ID NO: 341040 - RNA, 22 nt, Homo sapiens
gugaacaagcaaaggcaggagg

SEQ ID NO: 341041 - RNA, 22 nt, Homo sapiens
gugaaucauaugccagucaugc

SEQ ID NO: 341042 - RNA, 22 nt, Homo sapiens
gugaaucuguuuucuucuguuc

SEQ ID NO: 341043 - RNA, 22 nt, Homo sapiens
gugacauuauuucagcuacaug

SEQ ID NO: 341044 - RNA, 22 nt, Homo sapiens
gugagaagaaaaauauggcugu

SEQ ID NO: 341045 - RNA, 18 nt, Homo sapiens
gugagaaugacuguucug

SEQ ID NO: 341046 - RNA, 22 nt, Homo sapiens
uccacagugguugaacuaguuu

SEQ ID NO: 341047 - RNA, 22 nt, Homo sapiens
uccagcuuuuucuaauucugug

SEQ ID NO: 341048 - RNA, 22 nt, Homo sapiens
uccagguuuggcuuuauaacuu

SEQ ID NO: 341049 - RNA, 22 nt, Homo sapiens
uccagguuuugugaguuuaaau

SEQ ID NO: 341050 - RNA, 22 nt, Homo sapiens
uccaguuguucucgaagcuccu

SEQ ID NO: 341051 - RNA, 20 nt, Homo sapiens
uccaguuuuggagacauucu

SEQ ID NO: 341052 - RNA, 22 nt, Homo sapiens
uccauagacauuuuaagguagu

SEQ ID NO: 341053 - RNA, 22 nt, Homo sapiens
uccaugagaauaguuaggcucu

SEQ ID NO: 341054 - RNA, 22 nt, Homo sapiens
uccauggagacacauuuuauau

SEQ ID NO: 341055 - RNA, 19 nt, Homo sapiens
ucccaauguuuccaggcag

SEQ ID NO: 341056 - RNA, 20 nt, Homo sapiens
ucccaguaggagaaggaagg

SEQ ID NO: 341057 - RNA, 22 nt, Homo sapiens
ucccaguauucauuuacagaag

SEQ ID NO: 341058 - RNA, 22 nt, Homo sapiens
uccccaguaggcaauuaacacc

SEQ ID NO: 341059 - RNA, 19 nt, Homo sapiens
uccccaguuuuccguucag

SEQ ID NO: 341060 - RNA, 22 nt, Homo sapiens
uccccugagucaccugcuucuc

SEQ ID NO: 341061 - RNA, 22 nt, Homo sapiens
ucccuacuggggcacugccuag

SEQ ID NO: 341062 - RNA, 18 nt, Homo sapiens
ucccucagaauuauagaa

SEQ ID NO: 341063 - RNA, 22 nt, Homo sapiens
ucccuggacagccuugccuggg

SEQ ID NO: 341064 - RNA, 22 nt, Homo sapiens
ucccuugguaauucuguuccuu

SEQ ID NO: 341065 - RNA, 19 nt, Homo sapiens
ucccuuuguagguaaccug

SEQ ID NO: 341066 - RNA, 19 nt, Homo sapiens
ucccuuuguauggacauac

SEQ ID NO: 341067 - RNA, 22 nt, Homo sapiens
uccucaguggauuggauggugc

SEQ ID NO: 341068 - RNA, 20 nt, Homo sapiens
uccugagauucccaguucuc

SEQ ID NO: 341069 - RNA, 22 nt, Homo sapiens
uccuugagucuuugcucagaug

SEQ ID NO: 341070 - RNA, 22 nt, Homo sapiens
uccuuuggguagcuguucagau

SEQ ID NO: 341071 - RNA, 22 nt, Homo sapiens
ucgcagcucacuggagccucga

SEQ ID NO: 341072 - RNA, 17 nt, Homo sapiens
ucuaauaauaugcauuu

SEQ ID NO: 341073 - RNA, 22 nt, Homo sapiens
ucuauguuuuugcuaguagugu

SEQ ID NO: 341074 - RNA, 22 nt, Homo sapiens
ucucaguggcacccccaacacc

SEQ ID NO: 341075 - RNA, 22 nt, Homo sapiens
ucucaguggugcuggcagggga

SEQ ID NO: 341076 - RNA, 22 nt, Homo sapiens
ucucaugaagauagagaauaga

SEQ ID NO: 341077 - RNA, 22 nt, Homo sapiens
ucucauggcucacccugcauag

SEQ ID NO: 341078 - RNA, 17 nt, Homo sapiens
ucucccaucccuuucuc

SEQ ID NO: 341079 - RNA, 22 nt, Homo sapiens
ucucuagagagccugguguuca

SEQ ID NO: 341080 - RNA, 22 nt, Homo sapiens
ucucugagaaaaguuucuccca

SEQ ID NO: 341081 - RNA, 19 nt, Homo sapiens
ucucugguguuggagggga

SEQ ID NO: 341082 - RNA, 22 nt, Homo sapiens
ucucuguuuagagccagcaauu

SEQ ID NO: 341083 - RNA, 22 nt, Homo sapiens
ucugacacuucugcagaauuga

SEQ ID NO: 341084 - RNA, 22 nt, Homo sapiens
ucugagcaauagauguggauau

SEQ ID NO: 341085 - RNA, 22 nt, Homo sapiens
ucugagguuaaauuuuauaguu

SEQ ID NO: 341086 - RNA, 22 nt, Homo sapiens
ucugccaaccacaaaauuuauu

SEQ ID NO: 341087 - RNA, 22 nt, Homo sapiens
ucuggaauguaaaguuuauggg

SEQ ID NO: 341088 - RNA, 22 nt, Homo sapiens
ucuggcacucagaggccuugcu

SEQ ID NO: 341089 - RNA, 17 nt, Homo sapiens
ucuggcuuucacaccug

SEQ ID NO: 341090 - RNA, 21 nt, Homo sapiens
ucuggcuuucauuccccuucu

SEQ ID NO: 341091 - RNA, 22 nt, Homo sapiens
ucugguguuauucauguaguuu

SEQ ID NO: 341092 - RNA, 19 nt, Homo sapiens
ucuguaguuagggcuacag

SEQ ID NO: 341093 - RNA, 19 nt, Homo sapiens
ucugucacuggggguauuc

SEQ ID NO: 341094 - RNA, 22 nt, Homo sapiens
ucugucuuguccucacccuaga

SEQ ID NO: 341095 - RNA, 22 nt, Homo sapiens
ucugucuugugguuugagugcc

SEQ ID NO: 341096 - RNA, 22 nt, Homo sapiens
ucugugaaugugaccuuauuug

SEQ ID NO: 341097 - RNA, 22 nt, Homo sapiens
ucugugcauuguaacaacuaaa

SEQ ID NO: 341098 - RNA, 22 nt, Homo sapiens
ucuguguuuagacccaggguag

SEQ ID NO: 341099 - RNA, 22 nt, Homo sapiens
ucuguuguuguuuuaagagaca

SEQ ID NO: 341100 - RNA, 22 nt, Homo sapiens
ucuucagucauauuggccugga

SEQ ID NO: 341101 - RNA, 22 nt, Homo sapiens
ucuugcacaaauuauuuuaacu

SEQ ID NO: 341102 - RNA, 23 nt, Homo sapiens
ucuuguacuuugagugagcaugg

SEQ ID NO: 341103 - RNA, 19 nt, Homo sapiens
ucuuuagucacauuuuuau

SEQ ID NO: 341104 - RNA, 22 nt, Homo sapiens
ucuuugauaagauccagaagaa

SEQ ID NO: 341105 - RNA, 22 nt, Homo sapiens
ucuuugauuuuguuacuaagac

SEQ ID NO: 341106 - RNA, 22 nt, Homo sapiens
ucuuuggucaucaugggaagca

SEQ ID NO: 341107 - RNA, 22 nt, Homo sapiens
ucuuuggucuacuuucauaugu

SEQ ID NO: 341108 - RNA, 22 nt, Homo sapiens
ucuuuugggccucuugucagac

SEQ ID NO: 341109 - RNA, 22 nt, Homo sapiens
ugaaacacacagagaagggaga

SEQ ID NO: 341110 - RNA, 22 nt, Homo sapiens
ugaaacacacauugcccuuuau

SEQ ID NO: 341111 - RNA, 20 nt, Homo sapiens
ugaaacacauggacuggggu

SEQ ID NO: 341112 - RNA, 18 nt, Homo sapiens
ugaaacacauuuuuuccu

SEQ ID NO: 341113 - RNA, 22 nt, Homo sapiens
ugaaagacugaagaauaggcau

SEQ ID NO: 341114 - RNA, 22 nt, Homo sapiens
ugaaagcuacaggaaaguauuu

SEQ ID NO: 341115 - RNA, 22 nt, Homo sapiens
ugaaagcuacagucuccuagga

SEQ ID NO: 341116 - RNA, 22 nt, Homo sapiens
ugaaaugccuuuaaugaauuua

SEQ ID NO: 341117 - RNA, 22 nt, Homo sapiens
ugaaauguaaguugucuagucu

SEQ ID NO: 341118 - RNA, 22 nt, Homo sapiens
ugaagacauuuuugggugugua

SEQ ID NO: 341119 - RNA, 22 nt, Homo sapiens
ugaagagucuaaaucugucuuc

SEQ ID NO: 341120 - RNA, 22 nt, Homo sapiens
ugaaggccgggcaugguggcuc

SEQ ID NO: 341121 - RNA, 22 nt, Homo sapiens
ugaaguaggcauaaguuaagcu

SEQ ID NO: 341122 - RNA, 22 nt, Homo sapiens
ugaauacugugcaaaggauuug

SEQ ID NO: 341123 - RNA, 22 nt, Homo sapiens
ugaauacuucguucaaagauaa

SEQ ID NO: 341124 - RNA, 22 nt, Homo sapiens
ugaauagacacuaaagacugua

SEQ ID NO: 341125 - RNA, 22 nt, Homo sapiens
ugaaugcaucauguagggcuca

SEQ ID NO: 341126 - RNA, 21 nt, Homo sapiens
ugaaugcuuuaaauauuagaa

SEQ ID NO: 341127 - RNA, 22 nt, Homo sapiens
ugaaugguuuuuagagaacaau

SEQ ID NO: 341128 - RNA, 22 nt, Homo sapiens
ugaauuguuuacgagaugugag

SEQ ID NO: 341129 - RNA, 22 nt, Homo sapiens
ugacaaguaaacagucagcacc

SEQ ID NO: 341130 - RNA, 22 nt, Homo sapiens
ugacacuugcccuuagaaacau

SEQ ID NO: 341131 - RNA, 18 nt, Homo sapiens
ugacagcacaugugggga

SEQ ID NO: 341132 - RNA, 22 nt, Homo sapiens
ugacaguaaacagucuugauua

SEQ ID NO: 341133 - RNA, 23 nt, Homo sapiens
ugacagucucccgauggcuaggc

SEQ ID NO: 341134 - RNA, 22 nt, Homo sapiens
ugacaguguccuccuccugaga

SEQ ID NO: 341135 - RNA, 22 nt, Homo sapiens
gucaucaucaguccucugugca

SEQ ID NO: 341136 - RNA, 22 nt, Homo sapiens
gucauccaggcuggagugaagc

SEQ ID NO: 341137 - RNA, 22 nt, Homo sapiens
gucaugggguacuacacauggg

SEQ ID NO: 341138 - RNA, 22 nt, Homo sapiens
gucaugucugcacauaguaaaa

SEQ ID NO: 341139 - RNA, 22 nt, Homo sapiens
gucccagagauauugugucuuu

SEQ ID NO: 341140 - RNA, 22 nt, Homo sapiens
gucccugaggaacauccagggc

SEQ ID NO: 341141 - RNA, 22 nt, Homo sapiens
guccugaagaccuuccucugga

SEQ ID NO: 341142 - RNA, 22 nt, Homo sapiens
gucuaugguucaggguggagug

SEQ ID NO: 341143 - RNA, 22 nt, Homo sapiens
gucucauugcaguuagaccugu

SEQ ID NO: 341144 - RNA, 22 nt, Homo sapiens
gucugguuuuuuauauccucac

SEQ ID NO: 341145 - RNA, 21 nt, Homo sapiens
gucuuacagccagaugccucu

SEQ ID NO: 341146 - RNA, 22 nt, Homo sapiens
gucuuccagccuccaucuuucu

SEQ ID NO: 341147 - RNA, 22 nt, Homo sapiens
gucuugcacuuaccuaagaacu

SEQ ID NO: 341148 - RNA, 22 nt, Homo sapiens
gucuuggagaacucagcuuggc

SEQ ID NO: 341149 - RNA, 20 nt, Homo sapiens
gucuuguagcucaaguuauu

SEQ ID NO: 341150 - RNA, 22 nt, Homo sapiens
gucuuugagauaggguuauuuu

SEQ ID NO: 341151 - RNA, 17 nt, Homo sapiens
gucuuugguugaguuua

SEQ ID NO: 341152 - RNA, 22 nt, Homo sapiens
gugaaagacagcauuaauggcu

SEQ ID NO: 341153 - RNA, 22 nt, Homo sapiens
gugaaauguguagaggaucugg

SEQ ID NO: 341154 - RNA, 22 nt, Homo sapiens
gugacacagcaagacuccgucu

SEQ ID NO: 341155 - RNA, 22 nt, Homo sapiens
gugacauuuuuacugaugagag

SEQ ID NO: 341156 - RNA, 20 nt, Homo sapiens
gugagaacaugugguauuug

SEQ ID NO: 341157 - RNA, 22 nt, Homo sapiens
gugagaaucaaacuacauaaau

SEQ ID NO: 341158 - RNA, 22 nt, Homo sapiens
gugagcuaagcaaauaugagcc

SEQ ID NO: 341159 - RNA, 22 nt, Homo sapiens
gugaggaaggaaaccugcuagc

SEQ ID NO: 341160 - RNA, 22 nt, Homo sapiens
gugaggcugguccugccuccca

SEQ ID NO: 341161 - RNA, 22 nt, Homo sapiens
gugaggugguacaauauuaacu

SEQ ID NO: 341162 - RNA, 22 nt, Homo sapiens
gugagucagucuguguagggcu

SEQ ID NO: 341163 - RNA, 22 nt, Homo sapiens
gugaucucagcucacuggaacc

SEQ ID NO: 341164 - RNA, 22 nt, Homo sapiens
gugcaaauguuauugagguuuu

SEQ ID NO: 341165 - RNA, 22 nt, Homo sapiens
acacugucucuugcugaccaug

SEQ ID NO: 341166 - RNA, 22 nt, Homo sapiens
acacuguugacauuuuguagug

SEQ ID NO: 341167 - RNA, 22 nt, Homo sapiens
acacuguuuuaguuauuauagc

SEQ ID NO: 341168 - RNA, 22 nt, Homo sapiens
acagaucagagauauuuagguu

SEQ ID NO: 341169 - RNA, 22 nt, Homo sapiens
acaguagcgcaaucucggcuca

SEQ ID NO: 341170 - RNA, 22 nt, Homo sapiens
acaguaugcuuuaaacuuuguu

SEQ ID NO: 341171 - RNA, 22 nt, Homo sapiens
acaguguguguguucaccuaga

SEQ ID NO: 341172 - RNA, 22 nt, Homo sapiens
acaguguuacuugauaguguau

SEQ ID NO: 341173 - RNA, 22 nt, Homo sapiens
acaucauugggggcuacaggug

SEQ ID NO: 341174 - RNA, 22 nt, Homo sapiens
acaugacauugggguggggaua

SEQ ID NO: 341175 - RNA, 22 nt, Homo sapiens
acaugcaucauuaggugguuua

SEQ ID NO: 341176 - RNA, 22 nt, Homo sapiens
acauggcacugcgggcuucuug

SEQ ID NO: 341177 - RNA, 18 nt, Homo sapiens
acauucagcuugaagaua

SEQ ID NO: 341178 - RNA, 22 nt, Homo sapiens
accaccauugcacugaacuuuc

SEQ ID NO: 341179 - RNA, 22 nt, Homo sapiens
accaguuuuuuauacaucuucu

SEQ ID NO: 341180 - RNA, 22 nt, Homo sapiens
accauugcacuccagccugggc

SEQ ID NO: 341181 - RNA, 22 nt, Homo sapiens
acccugacacgauucuucacuu

SEQ ID NO: 341182 - RNA, 22 nt, Homo sapiens
acccuggaguaguaggaaucug

SEQ ID NO: 341183 - RNA, 22 nt, Homo sapiens
acccuggauucguggccuugaa

SEQ ID NO: 341184 - RNA, 22 nt, Homo sapiens
acccugguagcuaugaagucuu

SEQ ID NO: 341185 - RNA, 22 nt, Homo sapiens
acccugucauccacauggugcu

SEQ ID NO: 341186 - RNA, 22 nt, Homo sapiens
acccuugaguguguuucaggca

SEQ ID NO: 341187 - RNA, 22 nt, Homo sapiens
accugcacagccgaacauagac

SEQ ID NO: 341188 - RNA, 22 nt, Homo sapiens
accuggacacuuugggcuccuc

SEQ ID NO: 341189 - RNA, 22 nt, Homo sapiens
accuggguguauguucaguuug

SEQ ID NO: 341190 - RNA, 23 nt, Homo sapiens
accugugguuauuuuacucuucc

SEQ ID NO: 341191 - RNA, 22 nt, Homo sapiens
accuugcacugagccgagauug

SEQ ID NO: 341192 - RNA, 22 nt, Homo sapiens
accuuguagcaaaccuaacaua

SEQ ID NO: 341193 - RNA, 20 nt, Homo sapiens
acuaaaucucauuuuaugca

SEQ ID NO: 341194 - RNA, 22 nt, Homo sapiens
acuauacugaagcaaauuaaca

SEQ ID NO: 341195 - RNA, 22 nt, Homo sapiens
acucagagaacauucccagucu

SEQ ID NO: 341196 - RNA, 22 nt, Homo sapiens
acugagccuuuaaaugacuuca

SEQ ID NO: 341197 - RNA, 19 nt, Homo sapiens
acugagcuaccugggggca

SEQ ID NO: 341198 - RNA, 22 nt, Homo sapiens
acugcacuccagccucaugaca

SEQ ID NO: 341199 - RNA, 22 nt, Homo sapiens
acugcacuccagccugaugaaa

SEQ ID NO: 341200 - RNA, 22 nt, Homo sapiens
acugcacuccagccuggacgac

SEQ ID NO: 341201 - RNA, 22 nt, Homo sapiens
acugcacuccagccuuggcggc

SEQ ID NO: 341202 - RNA, 22 nt, Homo sapiens
acugcacuccaguuugggcagc

SEQ ID NO: 341203 - RNA, 22 nt, Homo sapiens
acugcacucccgcccgggugac

SEQ ID NO: 341204 - RNA, 22 nt, Homo sapiens
acugcacuccuccuugggugac

SEQ ID NO: 341205 - RNA, 22 nt, Homo sapiens
acugcacuguccuagaguccuc

SEQ ID NO: 341206 - RNA, 22 nt, Homo sapiens
acuggacuuaaugaugaauugu

SEQ ID NO: 341207 - RNA, 22 nt, Homo sapiens
acuguacuccauccugggugac

SEQ ID NO: 341208 - RNA, 22 nt, Homo sapiens
acugugcuguuuuaauuauuga

SEQ ID NO: 341209 - RNA, 22 nt, Homo sapiens
acuuggcaaaguuuuaaacagc

SEQ ID NO: 341210 - RNA, 22 nt, Homo sapiens
acuuugcuuagagggcauuaaa

SEQ ID NO: 341211 - RNA, 22 nt, Homo sapiens
acuuuuugaugaggucguuugu

SEQ ID NO: 341212 - RNA, 22 nt, Homo sapiens
acuuuuugcaaccauuuggacc

SEQ ID NO: 341213 - RNA, 22 nt, Homo sapiens
agaaacacagguggaauugcuu

SEQ ID NO: 341214 - RNA, 22 nt, Homo sapiens
agaaacauucucuugccuccuu

SEQ ID NO: 341215 - RNA, 23 nt, Homo sapiens
agaaaugucuauucagggucccu

SEQ ID NO: 341216 - RNA, 22 nt, Homo sapiens
agacagcugguagcacuuccug

SEQ ID NO: 341217 - RNA, 22 nt, Homo sapiens
agagagguggguggagccccca

SEQ ID NO: 341218 - RNA, 22 nt, Homo sapiens
agagaugauuaacauuuuggua

SEQ ID NO: 341219 - RNA, 22 nt, Homo sapiens
agagugaagcuuuuuauauucu

SEQ ID NO: 341220 - RNA, 22 nt, Homo sapiens
agaugcauugguggcauauuca

SEQ ID NO: 341221 - RNA, 23 nt, Homo sapiens
agauggcauuucaguucuuuagg

SEQ ID NO: 341222 - RNA, 22 nt, Homo sapiens
agauggugauaaaugugguacc

SEQ ID NO: 341223 - RNA, 22 nt, Homo sapiens
agauguuguucaucugauuguu

SEQ ID NO: 341224 - RNA, 22 nt, Homo sapiens
agcaacauuuuugaccuuucuu

SEQ ID NO: 341225 - RNA, 22 nt, Homo sapiens
agcaauaugacauugcuacauc

SEQ ID NO: 341226 - RNA, 22 nt, Homo sapiens
agcacauuaguaucuaagaaca

SEQ ID NO: 341227 - RNA, 22 nt, Homo sapiens
agcagcacaucccuuucuggcc

SEQ ID NO: 341228 - RNA, 22 nt, Homo sapiens
agcagcaccaaacagacuaaga

SEQ ID NO: 341229 - RNA, 22 nt, Homo sapiens
agcagcaugcaaauggacuaau

SEQ ID NO: 341230 - RNA, 22 nt, Homo sapiens
agcagcauuccaaaaaucugcu

SEQ ID NO: 341231 - RNA, 22 nt, Homo sapiens
agcagcucaugccuuugggagg

SEQ ID NO: 341232 - RNA, 16 nt, Homo sapiens
agcagguguuagguga

SEQ ID NO: 341233 - RNA, 22 nt, Homo sapiens
agcagugugaaaauggacuaau

SEQ ID NO: 341234 - RNA, 19 nt, Homo sapiens
agcaguguggagauuucuc

SEQ ID NO: 341235 - RNA, 22 nt, Homo sapiens
agcauagugccuugaaaacaau

SEQ ID NO: 341236 - RNA, 22 nt, Homo sapiens
agcauggucacuuugggcccca

SEQ ID NO: 341237 - RNA, 22 nt, Homo sapiens
agccaguauuuccacagagugg

SEQ ID NO: 341238 - RNA, 21 nt, Homo sapiens
agccaguguuccuuguggcuc

SEQ ID NO: 341239 - RNA, 22 nt, Homo sapiens
agccuauccaauaucagugaga

SEQ ID NO: 341240 - RNA, 22 nt, Homo sapiens
agcucuuguuaguauuagcagu

SEQ ID NO: 341241 - RNA, 22 nt, Homo sapiens
agcugcauuuacuuuugcacaa

SEQ ID NO: 341242 - RNA, 22 nt, Homo sapiens
agcuggauuguuuaccuggggc

SEQ ID NO: 341243 - RNA, 22 nt, Homo sapiens
agcuggcuguagcugcaagucu

SEQ ID NO: 341244 - RNA, 22 nt, Homo sapiens
agcuguaguuugguggauguaa

SEQ ID NO: 341245 - RNA, 22 nt, Homo sapiens
agcugugucuucuuaaagauuu

SEQ ID NO: 341246 - RNA, 22 nt, Homo sapiens
agcuguguugucugaagucaga

SEQ ID NO: 341247 - RNA, 22 nt, Homo sapiens
aucaccuggaggugaucacuug

SEQ ID NO: 341248 - RNA, 22 nt, Homo sapiens
gugcaugcaucuuuauaguagc

SEQ ID NO: 341249 - RNA, 22 nt, Homo sapiens
gugccacugcacuccggccugg

SEQ ID NO: 341250 - RNA, 22 nt, Homo sapiens
guggaagaaaucagguuauuug

SEQ ID NO: 341251 - RNA, 22 nt, Homo sapiens
guggaagguaaugcagcuuacu

SEQ ID NO: 341252 - RNA, 22 nt, Homo sapiens
guggaagugucuggggccaggg

SEQ ID NO: 341253 - RNA, 22 nt, Homo sapiens
guggaaugaaaacucucucaca

SEQ ID NO: 341254 - RNA, 22 nt, Homo sapiens
guggaaugcaguguugauucaa

SEQ ID NO: 341255 - RNA, 22 nt, Homo sapiens
guggacagagacuaaauguugu

SEQ ID NO: 341256 - RNA, 22 nt, Homo sapiens
guggacaugaauuuuggaggca

SEQ ID NO: 341257 - RNA, 18 nt, Homo sapiens
guggagugucuuccugga

SEQ ID NO: 341258 - RNA, 22 nt, Homo sapiens
guggcaaggaaaugcugcucac

SEQ ID NO: 341259 - RNA, 22 nt, Homo sapiens
guggcagaaaagagaagcaaug

SEQ ID NO: 341260 - RNA, 22 nt, Homo sapiens
gugggaagcuggaacucccucc

SEQ ID NO: 341261 - RNA, 22 nt, Homo sapiens
gugggguaggguaggacucaac

SEQ ID NO: 341262 - RNA, 22 nt, Homo sapiens
guggguaaaucucuggggcucu

SEQ ID NO: 341263 - RNA, 22 nt, Homo sapiens
guguaacaacagcacuccacug

SEQ ID NO: 341264 - RNA, 20 nt, Homo sapiens
guguaagagcaagcuuccua

SEQ ID NO: 341265 - RNA, 22 nt, Homo sapiens
guguaauacacacauauaugca

SEQ ID NO: 341266 - RNA, 22 nt, Homo sapiens
gugucacugugaggauauugua

SEQ ID NO: 341267 - RNA, 22 nt, Homo sapiens
gugucaugagggggacaggaag

SEQ ID NO: 341268 - RNA, 22 nt, Homo sapiens
guguccucgaguacacaucagg

SEQ ID NO: 341269 - RNA, 22 nt, Homo sapiens
gugugaacaucauagaguguau

SEQ ID NO: 341270 - RNA, 22 nt, Homo sapiens
gugugacugcucuauuagggcg

SEQ ID NO: 341271 - RNA, 22 nt, Homo sapiens
gugugcauaugucuuuauagua

SEQ ID NO: 341272 - RNA, 20 nt, Homo sapiens
gugugcauuucagauuuugg

SEQ ID NO: 341273 - RNA, 21 nt, Homo sapiens
gugugcuugaauucagcuguc

SEQ ID NO: 341274 - RNA, 22 nt, Homo sapiens
guguuauugagaaauagggugu

SEQ ID NO: 341275 - RNA, 22 nt, Homo sapiens
guguucaaacccaggucugucu

SEQ ID NO: 341276 - RNA, 22 nt, Homo sapiens
guguugcacauucuguggaugu

SEQ ID NO: 341277 - RNA, 22 nt, Homo sapiens
guguuugguugauagagccacu

SEQ ID NO: 341278 - RNA, 22 nt, Homo sapiens
guuagugcuuauuaaauaguau

SEQ ID NO: 341279 - RNA, 22 nt, Homo sapiens
guuauguuauguuauguuaugu

SEQ ID NO: 341280 - RNA, 22 nt, Homo sapiens
guuauugcucucgaagacucuc

SEQ ID NO: 341281 - RNA, 22 nt, Homo sapiens
guucacaguuaggacaacugcu

SEQ ID NO: 341282 - RNA, 22 nt, Homo sapiens
guucaucagggauauuggcuua

SEQ ID NO: 341283 - RNA, 22 nt, Homo sapiens
guuccuuguagaugcuggauau

SEQ ID NO: 341284 - RNA, 22 nt, Homo sapiens
guucuggagauaaagccaaggu

SEQ ID NO: 341285 - RNA, 22 nt, Homo sapiens
guugagcaagcuuuggagccua

SEQ ID NO: 341286 - RNA, 22 nt, Homo sapiens
guugguuuccuguaacuggaca

SEQ ID NO: 341287 - RNA, 22 nt, Homo sapiens
guuuaacugguacuucaagucu

SEQ ID NO: 341288 - RNA, 22 nt, Homo sapiens
guuugugcuccuaugagaaucu

SEQ ID NO: 341289 - RNA, 22 nt, Homo sapiens
uaaagaugcugggaaggcuagg

SEQ ID NO: 341290 - RNA, 22 nt, Homo sapiens
uaaagcuacaguauaugguauu

SEQ ID NO: 341291 - RNA, 22 nt, Homo sapiens
uaaagcuuagauccaugguggc

SEQ ID NO: 341292 - RNA, 22 nt, Homo sapiens
uaaaugacugucaguagaugaa

SEQ ID NO: 341293 - RNA, 22 nt, Homo sapiens
uaaauugcauaaguacaaauga

SEQ ID NO: 341294 - RNA, 22 nt, Homo sapiens
uaacaggcuacucuugcauugc

SEQ ID NO: 341295 - RNA, 22 nt, Homo sapiens
uaacaguauaugugguaucuau

SEQ ID NO: 341296 - RNA, 22 nt, Homo sapiens
uaacaguauauuuaccaaaccu

SEQ ID NO: 341297 - RNA, 22 nt, Homo sapiens
uaacaguguauuuacuacuucc

SEQ ID NO: 341298 - RNA, 21 nt, Homo sapiens
uaagacugccaguagggcugu

SEQ ID NO: 341299 - RNA, 22 nt, Homo sapiens
uaagacuuuuugggaauauaga

SEQ ID NO: 341300 - RNA, 21 nt, Homo sapiens
uaagcuaaacauucaguuaac

SEQ ID NO: 341301 - RNA, 22 nt, Homo sapiens
uaaggcuagcaagaugagaaua

SEQ ID NO: 341302 - RNA, 22 nt, Homo sapiens
uaaggcuucuuggaauacugca

SEQ ID NO: 341303 - RNA, 22 nt, Homo sapiens
uaaggcuuugucuuaggacuuu

SEQ ID NO: 341304 - RNA, 22 nt, Homo sapiens
uaaggcuuuuguucagcguggg

SEQ ID NO: 341305 - RNA, 22 nt, Homo sapiens
uaagggacgcccccuucucucu

SEQ ID NO: 341306 - RNA, 22 nt, Homo sapiens
uaagguuuuugauaugcugcug

SEQ ID NO: 341307 - RNA, 22 nt, Homo sapiens
uaaguaaaugaaagguugauuu

SEQ ID NO: 341308 - RNA, 22 nt, Homo sapiens
uaaguaauugugguuucugcca

SEQ ID NO: 341309 - RNA, 22 nt, Homo sapiens
uaaguaauuuguauuuuaccca

SEQ ID NO: 341310 - RNA, 22 nt, Homo sapiens
uaaguauuaggccccaggcugg

SEQ ID NO: 341311 - RNA, 22 nt, Homo sapiens
uaagucuuuuuggaguuuauaa

SEQ ID NO: 341312 - RNA, 22 nt, Homo sapiens
uaagugaaggaaguguguuuac

SEQ ID NO: 341313 - RNA, 22 nt, Homo sapiens
uaagugaauuugacagguaaug

SEQ ID NO: 341314 - RNA, 22 nt, Homo sapiens
uaaguggugcauuguuaaaugg

SEQ ID NO: 341315 - RNA, 22 nt, Homo sapiens
uaagugguguucauucuuuuga

SEQ ID NO: 341316 - RNA, 22 nt, Homo sapiens
uaauacuugucauaaaggcauu

SEQ ID NO: 341317 - RNA, 22 nt, Homo sapiens
uaauagcaguguuacuaggacu

SEQ ID NO: 341318 - RNA, 22 nt, Homo sapiens
uaaugcaucagugguaguucuu

SEQ ID NO: 341319 - RNA, 22 nt, Homo sapiens
uaaugcauguaaugggcugaua

SEQ ID NO: 341320 - RNA, 22 nt, Homo sapiens
uaaugugcuucucuaccauagg

SEQ ID NO: 341321 - RNA, 22 nt, Homo sapiens
uacaaaguaacaguuccuguau

SEQ ID NO: 341322 - RNA, 21 nt, Homo sapiens
uacaaugcacaggagagccuc

SEQ ID NO: 341323 - RNA, 16 nt, Homo sapiens
uacaauguagaaaaca

SEQ ID NO: 341324 - RNA, 22 nt, Homo sapiens
uacacacguguguauauauaca

SEQ ID NO: 341325 - RNA, 22 nt, Homo sapiens
uacacagucaaaaauuuccagg

SEQ ID NO: 341326 - RNA, 22 nt, Homo sapiens
uacaccugcacucuagccuggg

SEQ ID NO: 341327 - RNA, 20 nt, Homo sapiens
uacacguaugagcacaugug

SEQ ID NO: 341328 - RNA, 22 nt, Homo sapiens
uacagaauucugucccuugagu

SEQ ID NO: 341329 - RNA, 22 nt, Homo sapiens
uacagaguauccauuugaguuc

SEQ ID NO: 341330 - RNA, 22 nt, Homo sapiens
uacagucauaaugccuagugac

SEQ ID NO: 341331 - RNA, 22 nt, Homo sapiens
uacauaguagauauaggguuua

SEQ ID NO: 341332 - RNA, 22 nt, Homo sapiens
uaccaguaaugguucuagagga

SEQ ID NO: 341333 - RNA, 22 nt, Homo sapiens
uaccuguagacuacagcuucag

SEQ ID NO: 341334 - RNA, 19 nt, Homo sapiens
uacugcaccucaaccuggg

SEQ ID NO: 341335 - RNA, 22 nt, Homo sapiens
uagauucaucuguuccuuuuga

SEQ ID NO: 341336 - RNA, 22 nt, Homo sapiens
uagauucauuuuagcaaaaguu

SEQ ID NO: 341337 - RNA, 21 nt, Homo sapiens
uagcaaauugcuauuaaggca

SEQ ID NO: 341338 - RNA, 22 nt, Homo sapiens
uagcaaguguuuaagcacuuuu

SEQ ID NO: 341339 - RNA, 22 nt, Homo sapiens
uagcagaauaacuugccagccu

SEQ ID NO: 341340 - RNA, 22 nt, Homo sapiens
uagcaggaaaggggucagaucu

SEQ ID NO: 341341 - RNA, 22 nt, Homo sapiens
uagcaguaucccaccaucuggu

SEQ ID NO: 341342 - RNA, 21 nt, Homo sapiens
uagcauacauuuugcaucuua

SEQ ID NO: 341343 - RNA, 22 nt, Homo sapiens
uagcauggaggcggccauagug

SEQ ID NO: 341344 - RNA, 22 nt, Homo sapiens
uagcuccacagcuauauauaau

SEQ ID NO: 341345 - RNA, 17 nt, Homo sapiens
uagcucuauuucuagcc

SEQ ID NO: 341346 - RNA, 23 nt, Homo sapiens
uagcuucucccagaccugcuccc

SEQ ID NO: 341347 - RNA, 22 nt, Homo sapiens
uaggaaguuucuugauuacuua

SEQ ID NO: 341348 - RNA, 22 nt, Homo sapiens
uaggagcacagcagcauguggg

SEQ ID NO: 341349 - RNA, 22 nt, Homo sapiens
uaggcaguguucucacuuguaa

SEQ ID NO: 341350 - RNA, 22 nt, Homo sapiens
uaggcuuuuggacccugucucu

SEQ ID NO: 341351 - RNA, 22 nt, Homo sapiens
uagggcaaggaacaguuaaaaa

SEQ ID NO: 341352 - RNA, 22 nt, Homo sapiens
uaggugguuugaaauacucaag

SEQ ID NO: 341353 - RNA, 22 nt, Homo sapiens
uaguccauuuucaugcugcuau

SEQ ID NO: 341354 - RNA, 21 nt, Homo sapiens
uagugcugaggcaguauggga

SEQ ID NO: 341355 - RNA, 22 nt, Homo sapiens
uagugcugugauauuuuuggcc

SEQ ID NO: 341356 - RNA, 22 nt, Homo sapiens
uauacaugugccauguuggugu

SEQ ID NO: 341357 - RNA, 22 nt, Homo sapiens
uauaugcaacauaguguaugug

SEQ ID NO: 341358 - RNA, 22 nt, Homo sapiens
uauaugcauugugggguacuga

SEQ ID NO: 341359 - RNA, 22 nt, Homo sapiens
uauaugcuaaacaagggguggg

SEQ ID NO: 341360 - RNA, 22 nt, Homo sapiens
uauaugucuuuguuauguugag

SEQ ID NO: 341361 - RNA, 22 nt, Homo sapiens
uauauguucugugucccuuucg

SEQ ID NO: 341362 - RNA, 19 nt, Homo sapiens
uaucaaguaugcacuguac

SEQ ID NO: 341363 - RNA, 22 nt, Homo sapiens
uaucacaaacuuagcaguuuaa

SEQ ID NO: 341364 - RNA, 22 nt, Homo sapiens
uaucacacuggaagaaguuaag

SEQ ID NO: 341365 - RNA, 22 nt, Homo sapiens
uaucacagauauuaugggccaa

SEQ ID NO: 341366 - RNA, 22 nt, Homo sapiens
uaucacagcauugucuauaaua

SEQ ID NO: 341367 - RNA, 22 nt, Homo sapiens
uaucacagugcuggaguauucc

SEQ ID NO: 341368 - RNA, 20 nt, Homo sapiens
uaucacauggggagaaaccu

SEQ ID NO: 341369 - RNA, 22 nt, Homo sapiens
uaucagcacaguggguucaugg

SEQ ID NO: 341370 - RNA, 22 nt, Homo sapiens
uaucagcgugcaaaucuuugga

SEQ ID NO: 341371 - RNA, 22 nt, Homo sapiens
uaucauaguuuggacuuucauu

SEQ ID NO: 341372 - RNA, 22 nt, Homo sapiens
uaucauugccucaaucuguauu

SEQ ID NO: 341373 - RNA, 22 nt, Homo sapiens
uaucauuguguuauuucuucca

SEQ ID NO: 341374 - RNA, 23 nt, Homo sapiens
uaucccuugccuuaugaugugag

SEQ ID NO: 341375 - RNA, 22 nt, Homo sapiens
uauccuguagcucauccaccgc

SEQ ID NO: 341376 - RNA, 22 nt, Homo sapiens
uaucuacauguagguauguaug

SEQ ID NO: 341377 - RNA, 22 nt, Homo sapiens
uaucucaguguacaggaugaua

SEQ ID NO: 341378 - RNA, 22 nt, Homo sapiens
uaucucuguggguagugcugaa

SEQ ID NO: 341379 - RNA, 22 nt, Homo sapiens
uaugaaagcuacuucucacaau

SEQ ID NO: 341380 - RNA, 20 nt, Homo sapiens
uaugacacugucauaaaaau

SEQ ID NO: 341381 - RNA, 22 nt, Homo sapiens
uaugaccuuguccccucucgcc

SEQ ID NO: 341382 - RNA, 22 nt, Homo sapiens
uaugacugagacuuaaauugug

SEQ ID NO: 341383 - RNA, 19 nt, Homo sapiens
uaugagcuaugacaugcau

SEQ ID NO: 341384 - RNA, 19 nt, Homo sapiens
uaugcuagagagggaagcu

SEQ ID NO: 341385 - RNA, 22 nt, Homo sapiens
uaugcuuauuaaaacagugugu

SEQ ID NO: 341386 - RNA, 21 nt, Homo sapiens
uauggauuugccuauucugga

SEQ ID NO: 341387 - RNA, 22 nt, Homo sapiens
uauggauuugccuauucuguau

SEQ ID NO: 341388 - RNA, 22 nt, Homo sapiens
uauggcauuauuuugauagaca

SEQ ID NO: 341389 - RNA, 22 nt, Homo sapiens
uaugucuucuuuagagaaaugu

SEQ ID NO: 341390 - RNA, 22 nt, Homo sapiens
uaugugguuaauaggaauuugu

SEQ ID NO: 341391 - RNA, 22 nt, Homo sapiens
uauguuaucaaaaagcuaagga

SEQ ID NO: 341392 - RNA, 22 nt, Homo sapiens
uauuacauccauaggcucugcu

SEQ ID NO: 341393 - RNA, 22 nt, Homo sapiens
uauuagguuggugcaaaaguua

SEQ ID NO: 341394 - RNA, 22 nt, Homo sapiens
uauuaugcacuuuauaaaaauu

SEQ ID NO: 341395 - RNA, 22 nt, Homo sapiens
uauucacaggugugggacaaag

SEQ ID NO: 341396 - RNA, 22 nt, Homo sapiens
uauugacuugagaagggauuag

SEQ ID NO: 341397 - RNA, 22 nt, Homo sapiens
uauugcacgccagccugagcaa

SEQ ID NO: 341398 - RNA, 22 nt, Homo sapiens
uauugcacuccagccuuggcaa

SEQ ID NO: 341399 - RNA, 22 nt, Homo sapiens
uauugccuugccuacuuuucca

SEQ ID NO: 341400 - RNA, 22 nt, Homo sapiens
uauugcuuaugaugcugaauua

SEQ ID NO: 341401 - RNA, 22 nt, Homo sapiens
auaggcaagaugagguuuuuau

SEQ ID NO: 341402 - RNA, 22 nt, Homo sapiens
auagggcacgagaugugagccu

SEQ ID NO: 341403 - RNA, 22 nt, Homo sapiens
auagugcugcaagaaacauacg

SEQ ID NO: 341404 - RNA, 22 nt, Homo sapiens
auagugcugcaauaaacacacg

SEQ ID NO: 341405 - RNA, 22 nt, Homo sapiens
auagugcugccauaaacauacg

SEQ ID NO: 341406 - RNA, 22 nt, Homo sapiens
auaucacaaacaagucuguacu

SEQ ID NO: 341407 - RNA, 22 nt, Homo sapiens
auaugcaaauccauagagacag

SEQ ID NO: 341408 - RNA, 20 nt, Homo sapiens
auaugcauguguuuucacuu

SEQ ID NO: 341409 - RNA, 22 nt, Homo sapiens
auaugguguuugcuauucagcu

SEQ ID NO: 341410 - RNA, 22 nt, Homo sapiens
auauguaguuucagaaguggaa

SEQ ID NO: 341411 - RNA, 22 nt, Homo sapiens
auaugucuuaguuaccuugggc

SEQ ID NO: 341412 - RNA, 22 nt, Homo sapiens
auauuagguuggugcaaaagua

SEQ ID NO: 341413 - RNA, 22 nt, Homo sapiens
auauucacagguaucagagauu

SEQ ID NO: 341414 - RNA, 18 nt, Homo sapiens
auauugcauuggauggau

SEQ ID NO: 341415 - RNA, 22 nt, Homo sapiens
auauugguuaaauauuauguga

SEQ ID NO: 341416 - RNA, 22 nt, Homo sapiens
aucaaagccaugcucaguuuuc

SEQ ID NO: 341417 - RNA, 22 nt, Homo sapiens
aucaaaguuucccagaaguugu

SEQ ID NO: 341418 - RNA, 22 nt, Homo sapiens
aucaaaugcuggcagagugccu

SEQ ID NO: 341419 - RNA, 22 nt, Homo sapiens
aucaagcuacacccuuuggaaa

SEQ ID NO: 341420 - RNA, 22 nt, Homo sapiens
aucacagauauggguuuaaauc

SEQ ID NO: 341421 - RNA, 22 nt, Homo sapiens
aucaccugagcaguauacacug

SEQ ID NO: 341422 - RNA, 22 nt, Homo sapiens
aucaccuuucccuuucugaauc

SEQ ID NO: 341423 - RNA, 22 nt, Homo sapiens
aucacuggucaugagagaagua

SEQ ID NO: 341424 - RNA, 22 nt, Homo sapiens
aucacuguaaguuuacacuuug

SEQ ID NO: 341425 - RNA, 22 nt, Homo sapiens
aucacuguccacucaucuuucu

SEQ ID NO: 341426 - RNA, 22 nt, Homo sapiens
aucacuuucuauuucugugcca

SEQ ID NO: 341427 - RNA, 22 nt, Homo sapiens
aucagaguggguuuuaaaagug

SEQ ID NO: 341428 - RNA, 22 nt, Homo sapiens
aucagauaccuguugggaaaug

SEQ ID NO: 341429 - RNA, 22 nt, Homo sapiens
aucagauuccacauuuuaucag

SEQ ID NO: 341430 - RNA, 22 nt, Homo sapiens
aucagugcagugggaacuagaa

SEQ ID NO: 341431 - RNA, 22 nt, Homo sapiens
aucauaucaucugcaaacaaag

SEQ ID NO: 341432 - RNA, 22 nt, Homo sapiens
aucauccugucaggagcuguga

SEQ ID NO: 341433 - RNA, 22 nt, Homo sapiens
aucauguuuauguguaggauau

SEQ ID NO: 341434 - RNA, 22 nt, Homo sapiens
auccacauucauggaccagucc

SEQ ID NO: 341435 - RNA, 22 nt, Homo sapiens
aucgcaccauugcacuccagca

SEQ ID NO: 341436 - RNA, 22 nt, Homo sapiens
aucuacuugcugggucucugga

SEQ ID NO: 341437 - RNA, 22 nt, Homo sapiens
aucucaguucaggcuggccaca

SEQ ID NO: 341438 - RNA, 22 nt, Homo sapiens
aucucauggagguagagaguaa

SEQ ID NO: 341439 - RNA, 22 nt, Homo sapiens
aucucuugccagucagaauggu

SEQ ID NO: 341440 - RNA, 22 nt, Homo sapiens
aucugcauuagggugaagaccu

SEQ ID NO: 341441 - RNA, 21 nt, Homo sapiens
aucugugagaccuuggggguu

SEQ ID NO: 341442 - RNA, 22 nt, Homo sapiens
aucuuggauuaccugggugggu

SEQ ID NO: 341443 - RNA, 22 nt, Homo sapiens
aucuuugauugaagggacccug

SEQ ID NO: 341444 - RNA, 22 nt, Homo sapiens
augaaagguauguuuucuguga

SEQ ID NO: 341445 - RNA, 22 nt, Homo sapiens
augaaagucaauccccaagugu

SEQ ID NO: 341446 - RNA, 22 nt, Homo sapiens
augaaaguguguggaaacuuga

SEQ ID NO: 341447 - RNA, 22 nt, Homo sapiens
augaaaucacugugaugcccua

SEQ ID NO: 341448 - RNA, 22 nt, Homo sapiens
augaacagagccuugagaaccu

SEQ ID NO: 341449 - RNA, 22 nt, Homo sapiens
ugucuggaaggguggccuccug

SEQ ID NO: 341450 - RNA, 22 nt, Homo sapiens
ugucuuggagaauccuggguuu

SEQ ID NO: 341451 - RNA, 22 nt, Homo sapiens
ugucuuggaugaggauuaacag

SEQ ID NO: 341452 - RNA, 22 nt, Homo sapiens
ugugaaaucagauagccuuuuu

SEQ ID NO: 341453 - RNA, 22 nt, Homo sapiens
ugugaacacagaggcuauggca

SEQ ID NO: 341454 - RNA, 22 nt, Homo sapiens
ugugaagaaagucauugguagc

SEQ ID NO: 341455 - RNA, 19 nt, Homo sapiens
ugugaagaaaugcugcaag

SEQ ID NO: 341456 - RNA, 22 nt, Homo sapiens
ugugaagauggacuaauauagu

SEQ ID NO: 341457 - RNA, 22 nt, Homo sapiens
ugugagacugacagggcagggu

SEQ ID NO: 341458 - RNA, 20 nt, Homo sapiens
ugugagacugguuuugaacu

SEQ ID NO: 341459 - RNA, 22 nt, Homo sapiens
ugugagcuauggaguuguagag

SEQ ID NO: 341460 - RNA, 22 nt, Homo sapiens
ugugaucaugcuccaggcgaga

SEQ ID NO: 341461 - RNA, 22 nt, Homo sapiens
ugugaugugaugagaaguuccu

SEQ ID NO: 341462 - RNA, 22 nt, Homo sapiens
ugugauguggagggcagaucca

SEQ ID NO: 341463 - RNA, 22 nt, Homo sapiens
ugugauuauuuauagacaguca

SEQ ID NO: 341464 - RNA, 22 nt, Homo sapiens
ugugcaaauuagcacaacccga

SEQ ID NO: 341465 - RNA, 22 nt, Homo sapiens
ugugcaaggcucucaaccugug

SEQ ID NO: 341466 - RNA, 22 nt, Homo sapiens
ugugcacaacaugcagguuugu

SEQ ID NO: 341467 - RNA, 22 nt, Homo sapiens
ugugcacaacgugcagguuugu

SEQ ID NO: 341468 - RNA, 22 nt, Homo sapiens
ugugcacauaacauuuuuuuag

SEQ ID NO: 341469 - RNA, 22 nt, Homo sapiens
ugugcacaugauauaucacaua

SEQ ID NO: 341470 - RNA, 22 nt, Homo sapiens
ugugcacauugugcagguugau

SEQ ID NO: 341471 - RNA, 22 nt, Homo sapiens
ugugccuucuaagaaggagucu

SEQ ID NO: 341472 - RNA, 22 nt, Homo sapiens
ugugcucaucucagucaacugu

SEQ ID NO: 341473 - RNA, 22 nt, Homo sapiens
ugugcuugcuucuucuccuagu

SEQ ID NO: 341474 - RNA, 22 nt, Homo sapiens
uguggcucuucuguucuccacu

SEQ ID NO: 341475 - RNA, 22 nt, Homo sapiens
uguguaaagcuuguuccagaaa

SEQ ID NO: 341476 - RNA, 22 nt, Homo sapiens
uguguaaauaugauagaggaau

SEQ ID NO: 341477 - RNA, 22 nt, Homo sapiens
uguguacaucucuacacacaug

SEQ ID NO: 341478 - RNA, 22 nt, Homo sapiens
ugugucacugcacuccagccug

SEQ ID NO: 341479 - RNA, 22 nt, Homo sapiens
uguuaagaugucaauuuuccac

SEQ ID NO: 341480 - RNA, 22 nt, Homo sapiens
uguuacaguguaggccuugggu

SEQ ID NO: 341481 - RNA, 22 nt, Homo sapiens
uguucuggagaguuuagucugg

SEQ ID NO: 341482 - RNA, 22 nt, Homo sapiens
uguucuugagccuuuagaccua

SEQ ID NO: 341483 - RNA, 22 nt, Homo sapiens
uguucuugaguugggaguacaa

SEQ ID NO: 341484 - RNA, 19 nt, Homo sapiens
uguugcacuccagcuuggg

SEQ ID NO: 341485 - RNA, 22 nt, Homo sapiens
uuaaagugaucauaaggauagu

SEQ ID NO: 341486 - RNA, 22 nt, Homo sapiens
uuaaauacagcaugguguuucu

SEQ ID NO: 341487 - RNA, 22 nt, Homo sapiens
uuaagaugcauuuugaaguuaa

SEQ ID NO: 341488 - RNA, 22 nt, Homo sapiens
uuaaggaaggagucuuaaaugg

SEQ ID NO: 341489 - RNA, 19 nt, Homo sapiens
uuaagguacuuagaugugu

SEQ ID NO: 341490 - RNA, 22 nt, Homo sapiens
uuaagucacacuagacaacuga

SEQ ID NO: 341491 - RNA, 22 nt, Homo sapiens
uuaauacucuucuaaguagucc

SEQ ID NO: 341492 - RNA, 22 nt, Homo sapiens
uuaaucacagcugaacucaaac

SEQ ID NO: 341493 - RNA, 19 nt, Homo sapiens
uuacacaaccuaguggggc

SEQ ID NO: 341494 - RNA, 22 nt, Homo sapiens
uuacacguaauaucacggugug

SEQ ID NO: 341495 - RNA, 22 nt, Homo sapiens
uuacagauggcacacucaaggg

SEQ ID NO: 341496 - RNA, 22 nt, Homo sapiens
uuacaguagaugaggguauaau

SEQ ID NO: 341497 - RNA, 22 nt, Homo sapiens
uuacaguaugaguaagaguucu

SEQ ID NO: 341498 - RNA, 22 nt, Homo sapiens
uuacaguauugcaaggacuagg

SEQ ID NO: 341499 - RNA, 22 nt, Homo sapiens
uuacaugagacugucgcuaguu

SEQ ID NO: 341500 - RNA, 22 nt, Homo sapiens
uuacauguuguggguuguggcc

SEQ ID NO: 341501 - RNA, 22 nt, Homo sapiens
uuaccagucuagggcucaguuu

SEQ ID NO: 341502 - RNA, 22 nt, Homo sapiens
uuaccagucugauaaacagaaa

SEQ ID NO: 341503 - RNA, 22 nt, Homo sapiens
uuagaacaguguuugccucgcu

SEQ ID NO: 341504 - RNA, 22 nt, Homo sapiens
uuagacacacauacauuuaucu

SEQ ID NO: 341505 - RNA, 22 nt, Homo sapiens
uuagauaguacugaaugguucu

SEQ ID NO: 341506 - RNA, 22 nt, Homo sapiens
uuagcagcucuaauaacugcua

SEQ ID NO: 341507 - RNA, 22 nt, Homo sapiens
uuagguuguuucuggucuuagg

SEQ ID NO: 341508 - RNA, 22 nt, Homo sapiens
uuagucaaguguacugugaaug

SEQ ID NO: 341509 - RNA, 20 nt, Homo sapiens
uuagucuccucugcccuguc

SEQ ID NO: 341510 - RNA, 20 nt, Homo sapiens
uuaguucauuuagaagguuu

SEQ ID NO: 341511 - RNA, 22 nt, Homo sapiens
uuaguucccucauucuugacuu

SEQ ID NO: 341512 - RNA, 22 nt, Homo sapiens
uuauagcagugcaggaacagac

SEQ ID NO: 341513 - RNA, 22 nt, Homo sapiens
uuaucaaacccuaggagguggu

SEQ ID NO: 341514 - RNA, 22 nt, Homo sapiens
uuaugucuuugagcaaugcugu

SEQ ID NO: 341515 - RNA, 22 nt, Homo sapiens
uuauuagguuagugcaaaaguu

SEQ ID NO: 341516 - RNA, 22 nt, Homo sapiens
uuauucauuaauugcuaagguu

SEQ ID NO: 341517 - RNA, 16 nt, Homo sapiens
uuauugcauucuucuc

SEQ ID NO: 341518 - RNA, 22 nt, Homo sapiens
uucaaaggauagauuaagauca

SEQ ID NO: 341519 - RNA, 22 nt, Homo sapiens
uucaaaucuucguuuugccaua

SEQ ID NO: 341520 - RNA, 23 nt, Homo sapiens
uucaacagguagacccucccugc

SEQ ID NO: 341521 - RNA, 22 nt, Homo sapiens
uucaagaauuaaaguggcuuuu

SEQ ID NO: 341522 - RNA, 22 nt, Homo sapiens
uucaagauggcaccagugagug

SEQ ID NO: 341523 - RNA, 22 nt, Homo sapiens
uucaagucaacaagcacuugag

SEQ ID NO: 341524 - RNA, 22 nt, Homo sapiens
uucaagucaaggaaagaggucu

SEQ ID NO: 341525 - RNA, 22 nt, Homo sapiens
uucacagaguuauuuuuaugcu

SEQ ID NO: 341526 - RNA, 20 nt, Homo sapiens
uucacaggcagcuucuuucu

SEQ ID NO: 341527 - RNA, 22 nt, Homo sapiens
uucacaguacucccuggaauua

SEQ ID NO: 341528 - RNA, 22 nt, Homo sapiens
uucacagucacccuucuccaug

SEQ ID NO: 341529 - RNA, 22 nt, Homo sapiens
uucacaguguguacaccagggg

SEQ ID NO: 341530 - RNA, 22 nt, Homo sapiens
uucaccuggaguucaggauaag

SEQ ID NO: 341531 - RNA, 22 nt, Homo sapiens
uucaccuguagcaugcccuugg

SEQ ID NO: 341532 - RNA, 22 nt, Homo sapiens
uucacugcaugaaaaggacagc

SEQ ID NO: 341533 - RNA, 22 nt, Homo sapiens
uucacuggagcccaggaguugg

SEQ ID NO: 341534 - RNA, 22 nt, Homo sapiens
uucacuguagcuuggauguuua

SEQ ID NO: 341535 - RNA, 22 nt, Homo sapiens
uucacugugugacccugggcca

SEQ ID NO: 341536 - RNA, 22 nt, Homo sapiens
gaggugaaggucucaauaaaua

SEQ ID NO: 341537 - RNA, 22 nt, Homo sapiens
gaggugauaucucauugugguu

SEQ ID NO: 341538 - RNA, 22 nt, Homo sapiens
gaggugguagguucacagcagc

SEQ ID NO: 341539 - RNA, 22 nt, Homo sapiens
gagguugggaugagggauacag

SEQ ID NO: 341540 - RNA, 22 nt, Homo sapiens
gaguaaaugucacuguugcugu

SEQ ID NO: 341541 - RNA, 22 nt, Homo sapiens
gaguauauuugcacuguuaugu

SEQ ID NO: 341542 - RNA, 22 nt, Homo sapiens
gagugcaauggcagaucuccgc

SEQ ID NO: 341543 - RNA, 22 nt, Homo sapiens
gagugcaauggugcuaucucgg

SEQ ID NO: 341544 - RNA, 18 nt, Homo sapiens
gaguggugcuucccuugu

SEQ ID NO: 341545 - RNA, 22 nt, Homo sapiens
gaguuacauuguaauugccgag

SEQ ID NO: 341546 - RNA, 22 nt, Homo sapiens
gauaaaguauuggguacuaugc

SEQ ID NO: 341547 - RNA, 22 nt, Homo sapiens
gauaacagauaaugucaguuau

SEQ ID NO: 341548 - RNA, 22 nt, Homo sapiens
gauacuggcuuuauagaaugau

SEQ ID NO: 341549 - RNA, 22 nt, Homo sapiens
gauagcagccauucuuuuuauu

SEQ ID NO: 341550 - RNA, 22 nt, Homo sapiens
gauauguugaguagaguuuuug

SEQ ID NO: 341551 - RNA, 22 nt, Homo sapiens
gauauguuucuucaauaccuag

SEQ ID NO: 341552 - RNA, 22 nt, Homo sapiens
gaucacauggccauuucuagcu

SEQ ID NO: 341553 - RNA, 22 nt, Homo sapiens
uggauagauacuauccaggacu

SEQ ID NO: 341554 - RNA, 22 nt, Homo sapiens
uggauguacagucaguauuugu

SEQ ID NO: 341555 - RNA, 22 nt, Homo sapiens
uggauugaaagcuuuaauauug

SEQ ID NO: 341556 - RNA, 22 nt, Homo sapiens
uggauuuuaauuauucugucau

SEQ ID NO: 341557 - RNA, 22 nt, Homo sapiens
uggcaaaucagaggcauggaca

SEQ ID NO: 341558 - RNA, 21 nt, Homo sapiens
uggcaacgaggugugcauuau

SEQ ID NO: 341559 - RNA, 22 nt, Homo sapiens
uggcaagagcaaaauguacagu

SEQ ID NO: 341560 - RNA, 22 nt, Homo sapiens
uggcaagagcugcauucaucug

SEQ ID NO: 341561 - RNA, 22 nt, Homo sapiens
uggcaauguggaaugguccagg

SEQ ID NO: 341562 - RNA, 22 nt, Homo sapiens
uggcagauaggauacaggacua

SEQ ID NO: 341563 - RNA, 22 nt, Homo sapiens
uggcaguuuuaugugguucaac

SEQ ID NO: 341564 - RNA, 19 nt, Homo sapiens
uggcaugaaugugaacuaa

SEQ ID NO: 341565 - RNA, 22 nt, Homo sapiens
uggcaugggguaguagcgcugg

SEQ ID NO: 341566 - RNA, 22 nt, Homo sapiens
uggccuuuuccaagaacuacua

SEQ ID NO: 341567 - RNA, 22 nt, Homo sapiens
uggcuguguccucucccaaauc

SEQ ID NO: 341568 - RNA, 22 nt, Homo sapiens
uggcuguuuauuucacaugggu

SEQ ID NO: 341569 - RNA, 20 nt, Homo sapiens
ugggaacaugugguauaugg

SEQ ID NO: 341570 - RNA, 18 nt, Homo sapiens
ugggaagaaauucuucuc

SEQ ID NO: 341571 - RNA, 22 nt, Homo sapiens
ugggaagaugcugcuucuuccu

SEQ ID NO: 341572 - RNA, 22 nt, Homo sapiens
ugggaugaauacaaugggauca

SEQ ID NO: 341573 - RNA, 22 nt, Homo sapiens
ugggaugaugcuugagaauauc

SEQ ID NO: 341574 - RNA, 22 nt, Homo sapiens
ugggguagaauagaauugauau

SEQ ID NO: 341575 - RNA, 22 nt, Homo sapiens
uggguagaugaauccauuccaa

SEQ ID NO: 341576 - RNA, 23 nt, Homo sapiens
uggguucauucuugaagucagug

SEQ ID NO: 341577 - RNA, 22 nt, Homo sapiens
ugguaaaaugucauuuaccaga

SEQ ID NO: 341578 - RNA, 22 nt, Homo sapiens
ugguagguuuauaaagaauuua

SEQ ID NO: 341579 - RNA, 22 nt, Homo sapiens
uggucaguugaguccuugccaa

SEQ ID NO: 341580 - RNA, 21 nt, Homo sapiens
uggucccauaagauuauaaug

SEQ ID NO: 341581 - RNA, 23 nt, Homo sapiens
uggucccguguucuggcuuuagg

SEQ ID NO: 341582 - RNA, 15 nt, Homo sapiens
uggugguguugagac

SEQ ID NO: 341583 - RNA, 22 nt, Homo sapiens
ugguuagucuguguguauauau

SEQ ID NO: 341584 - RNA, 20 nt, Homo sapiens
uguaacaaucuggauguugc

SEQ ID NO: 341585 - RNA, 22 nt, Homo sapiens
uguaugagagugaaagcauuuc

SEQ ID NO: 341586 - RNA, 22 nt, Homo sapiens
uguauguaaagacaggauaaca

SEQ ID NO: 341587 - RNA, 22 nt, Homo sapiens
ugucaaaugcagugauauuuga

SEQ ID NO: 341588 - RNA, 22 nt, Homo sapiens
ugucacagagauuuugguaugu

SEQ ID NO: 341589 - RNA, 22 nt, Homo sapiens
ugucacuuugccuucuggacuu

SEQ ID NO: 341590 - RNA, 22 nt, Homo sapiens
ugucagcacaacucagguuccu

SEQ ID NO: 341591 - RNA, 22 nt, Homo sapiens
ugucaggagcaaugauaaauuu

SEQ ID NO: 341592 - RNA, 22 nt, Homo sapiens
ugucauagauugcuuggaaaaa

SEQ ID NO: 341593 - RNA, 22 nt, Homo sapiens
ugucaucauuggaaucugccuc

SEQ ID NO: 341594 - RNA, 22 nt, Homo sapiens
ugucauguaaagaguaaauggu

SEQ ID NO: 341595 - RNA, 22 nt, Homo sapiens
ugucauguagaaauuguccauu

SEQ ID NO: 341596 - RNA, 22 nt, Homo sapiens
ugucaugucuuuguguaucaau

SEQ ID NO: 341597 - RNA, 22 nt, Homo sapiens
ugucaugugagggaacuuguuc

SEQ ID NO: 341598 - RNA, 22 nt, Homo sapiens
ugucauguuucuacugaccaaa

SEQ ID NO: 341599 - RNA, 16 nt, Homo sapiens
uguccaaauaaauaca

SEQ ID NO: 341600 - RNA, 22 nt, Homo sapiens
uguccuggugaugcccaaauuc

SEQ ID NO: 341601 - RNA, 22 nt, Homo sapiens
ugucucagugauuggcuuucug

SEQ ID NO: 341602 - RNA, 21 nt, Homo sapiens
ugucugagagaggagaucuac

SEQ ID NO: 341603 - RNA, 22 nt, Homo sapiens
cugaggugauauauacauauuu

SEQ ID NO: 341604 - RNA, 22 nt, Homo sapiens
cugaucuggaggugucugggga

SEQ ID NO: 341605 - RNA, 22 nt, Homo sapiens
cuggaaagcaaagggugcauug

SEQ ID NO: 341606 - RNA, 22 nt, Homo sapiens
cuggaaaguagacaaucuaaaa

SEQ ID NO: 341607 - RNA, 22 nt, Homo sapiens
cuggaaggaaaaacaaccacag

SEQ ID NO: 341608 - RNA, 22 nt, Homo sapiens
cuggaauauuagcuggucuuaa

SEQ ID NO: 341609 - RNA, 22 nt, Homo sapiens
cuggagauauuggaagaaagaa

SEQ ID NO: 341610 - RNA, 22 nt, Homo sapiens
cuggagaucuugacauugaagu

SEQ ID NO: 341611 - RNA, 22 nt, Homo sapiens
cuggaggccugaacauaaaugg

SEQ ID NO: 341612 - RNA, 22 nt, Homo sapiens
cuggcagucugccucuucacug

SEQ ID NO: 341613 - RNA, 22 nt, Homo sapiens
cugucacuggggcacauguccc

SEQ ID NO: 341614 - RNA, 22 nt, Homo sapiens
cugucuguuucaaaagugguua

SEQ ID NO: 341615 - RNA, 22 nt, Homo sapiens
cugugacugcagggcauauuug

SEQ ID NO: 341616 - RNA, 17 nt, Homo sapiens
cugugaugaucuugucu

SEQ ID NO: 341617 - RNA, 22 nt, Homo sapiens
caugucuuuuaaacauucaacu

SEQ ID NO: 341618 - RNA, 22 nt, Homo sapiens
caugucuuuuauucugugugau

SEQ ID NO: 341619 - RNA, 22 nt, Homo sapiens
cauugcacuccagcccuggcaa

SEQ ID NO: 341620 - RNA, 22 nt, Homo sapiens
cauugcacuccagccugaggga

SEQ ID NO: 341621 - RNA, 20 nt, Homo sapiens
cauugcacuccagccugcug

SEQ ID NO: 341622 - RNA, 22 nt, Homo sapiens
cauugcacuccagucugggcaa

SEQ ID NO: 341623 - RNA, 22 nt, Homo sapiens
cauugcacugcuucuugggugu

SEQ ID NO: 341624 - RNA, 22 nt, Homo sapiens
cauugcaugccagccugggcaa

SEQ ID NO: 341625 - RNA, 22 nt, Homo sapiens
cauugucccucaaugucuauga

SEQ ID NO: 341626 - RNA, 22 nt, Homo sapiens
cauuugguggcuacagaguaac

SEQ ID NO: 341627 - RNA, 22 nt, Homo sapiens
ccaagugcuuaaaauuucauuu

SEQ ID NO: 341628 - RNA, 22 nt, Homo sapiens
acaguggugcgaucucggcuca

SEQ ID NO: 341629 - RNA, 22 nt, Homo sapiens
acaguguagugacugccaacuu

SEQ ID NO: 341630 - RNA, 22 nt, Homo sapiens
acauaaagaagcaggacauugu

SEQ ID NO: 341631 - RNA, 22 nt, Homo sapiens
acauacacuagggauguggugu

SEQ ID NO: 341632 - RNA, 22 nt, Homo sapiens
acauauaaggagacuagggcau

SEQ ID NO: 341633 - RNA, 22 nt, Homo sapiens
acaugcauauguuggaagaaag

SEQ ID NO: 341634 - RNA, 22 nt, Homo sapiens
acaugccucccugguccgcugu

SEQ ID NO: 341635 - RNA, 21 nt, Homo sapiens
acauguacacauguaugcaca

SEQ ID NO: 341636 - RNA, 22 nt, Homo sapiens
acauguauauaaugcauagcga

SEQ ID NO: 341637 - RNA, 22 nt, Homo sapiens
acauucagcuguuguuucaaug

SEQ ID NO: 341638 - RNA, 22 nt, Homo sapiens
accacaggguaaaguuagauau

SEQ ID NO: 341639 - RNA, 22 nt, Homo sapiens
accacagugcuuccugcucacg

SEQ ID NO: 341640 - RNA, 22 nt, Homo sapiens
accaccacucccgcauucuaaa

SEQ ID NO: 341641 - RNA, 22 nt, Homo sapiens
accagucucagguaugucuuua

SEQ ID NO: 341642 - RNA, 22 nt, Homo sapiens
accaguguuuaccaaguagcau

SEQ ID NO: 341643 - RNA, 22 nt, Homo sapiens
acccaguagucauucaggagca

SEQ ID NO: 341644 - RNA, 22 nt, Homo sapiens
acccaguguugggcagaacugu

SEQ ID NO: 341645 - RNA, 23 nt, Homo sapiens
accccuacaggcuuguguccugc

SEQ ID NO: 341646 - RNA, 22 nt, Homo sapiens
acccgcccagguguggccggga

SEQ ID NO: 341647 - RNA, 22 nt, Homo sapiens
acccucaagggacugacagaau

SEQ ID NO: 341648 - RNA, 22 nt, Homo sapiens
acccuuugucaaucaguacuaa

SEQ ID NO: 341649 - RNA, 22 nt, Homo sapiens
accugguuuucucacaguggcu

SEQ ID NO: 341650 - RNA, 22 nt, Homo sapiens
acucacagcaaccuccgccucc

SEQ ID NO: 341651 - RNA, 22 nt, Homo sapiens
acucagagugggccccuagaua

SEQ ID NO: 341652 - RNA, 22 nt, Homo sapiens
acuccacuuucaccacagcgga

SEQ ID NO: 341653 - RNA, 22 nt, Homo sapiens
acugcaaugucgaauagagaug

SEQ ID NO: 341654 - RNA, 23 nt, Homo sapiens
acugcaauuacguuugcaccaac

SEQ ID NO: 341655 - RNA, 22 nt, Homo sapiens
acugcacuccaccuugggcaac

SEQ ID NO: 341656 - RNA, 22 nt, Homo sapiens
acugcacuccagccucggugac

SEQ ID NO: 341657 - RNA, 22 nt, Homo sapiens
acugcacuccagccuggacgaa

SEQ ID NO: 341658 - RNA, 22 nt, Homo sapiens
acugcacuccaucuuagguggc

SEQ ID NO: 341659 - RNA, 22 nt, Homo sapiens
acuggaguuuguucaagaaaua

SEQ ID NO: 341660 - RNA, 22 nt, Homo sapiens
acuggcuuuugagaaaaacacu

SEQ ID NO: 341661 - RNA, 22 nt, Homo sapiens
acugggucaaaguagaaaacua

SEQ ID NO: 341662 - RNA, 22 nt, Homo sapiens
acuggguuaauuugaagguuga

SEQ ID NO: 341663 - RNA, 22 nt, Homo sapiens
acuguguguuugucuagcacag

SEQ ID NO: 341664 - RNA, 22 nt, Homo sapiens
acuuuuguuauacagugugaua

SEQ ID NO: 341665 - RNA, 22 nt, Homo sapiens
acuuuuugauggggagaacauu

SEQ ID NO: 341666 - RNA, 22 nt, Homo sapiens
agaauguaacucuaugaaggca

SEQ ID NO: 341667 - RNA, 22 nt, Homo sapiens
agaauguauauucuguaguugu

SEQ ID NO: 341668 - RNA, 22 nt, Homo sapiens
agaaugucaguauuggcuaaaa

SEQ ID NO: 341669 - RNA, 22 nt, Homo sapiens
agacagcuggaguaucauagcu

SEQ ID NO: 341670 - RNA, 20 nt, Homo sapiens
agacaguguggagauuccuu

SEQ ID NO: 341671 - RNA, 22 nt, Homo sapiens
agagcaaugggugaauauuaaa

SEQ ID NO: 341672 - RNA, 18 nt, Homo sapiens
agagcuaugaacauaugc

SEQ ID NO: 341673 - RNA, 22 nt, Homo sapiens
agagguagaagauaggcuacag

SEQ ID NO: 341674 - RNA, 22 nt, Homo sapiens
agagguuuaauugauucacagu

SEQ ID NO: 341675 - RNA, 22 nt, Homo sapiens
agagugcaauggcaccaucucg

SEQ ID NO: 341676 - RNA, 23 nt, Homo sapiens
agagugcaauggugccaucucgg

SEQ ID NO: 341677 - RNA, 22 nt, Homo sapiens
agagugcuuuauuagauguagc

SEQ ID NO: 341678 - RNA, 22 nt, Homo sapiens
agaugauguuuacugagcauca

SEQ ID NO: 341679 - RNA, 22 nt, Homo sapiens
agaugguguuggcugaguguau

SEQ ID NO: 341680 - RNA, 22 nt, Homo sapiens
agaugguguuuucucaccagau

SEQ ID NO: 341681 - RNA, 22 nt, Homo sapiens
agcaagacauggcuuccaaaug

SEQ ID NO: 341682 - RNA, 22 nt, Homo sapiens
agcacagccuuguguuuucuug

SEQ ID NO: 341683 - RNA, 22 nt, Homo sapiens
agcaccacauacuacagagaua

SEQ ID NO: 341684 - RNA, 23 nt, Homo sapiens
agcaccaccccaggucacaagug

SEQ ID NO: 341685 - RNA, 19 nt, Homo sapiens
agcagaacaaauguguggg

SEQ ID NO: 341686 - RNA, 22 nt, Homo sapiens
agcagagcaguggauuuuguga

SEQ ID NO: 341687 - RNA, 22 nt, Homo sapiens
agcagcuuugaucugaaugauu

SEQ ID NO: 341688 - RNA, 21 nt, Homo sapiens
agcagcuuugguugaagcaga

SEQ ID NO: 341689 - RNA, 22 nt, Homo sapiens
agcaggacaauaugggaucagg

SEQ ID NO: 341690 - RNA, 22 nt, Homo sapiens
agcagguguggcuuauccugaa

SEQ ID NO: 341691 - RNA, 22 nt, Homo sapiens
agcagugugaaaugauuuaagg

SEQ ID NO: 341692 - RNA, 17 nt, Homo sapiens
agcauguguuugagauu

SEQ ID NO: 341693 - RNA, 22 nt, Homo sapiens
agcauuaguugugaagccuuua

SEQ ID NO: 341694 - RNA, 22 nt, Homo sapiens
agcccauguggcugaggcuucu

SEQ ID NO: 341695 - RNA, 21 nt, Homo sapiens
agccugugggucauaguugcc

SEQ ID NO: 341696 - RNA, 22 nt, Homo sapiens
agcuacuguuagucuaguuagg

SEQ ID NO: 341697 - RNA, 22 nt, Homo sapiens
agcuccaugauaguaugucugu

SEQ ID NO: 341698 - RNA, 20 nt, Homo sapiens
agcuccauuccugaaggcug

SEQ ID NO: 341699 - RNA, 22 nt, Homo sapiens
agcuccauuguaaucaccuggu

SEQ ID NO: 341700 - RNA, 22 nt, Homo sapiens
agcuccuuucugcaggcagguc

SEQ ID NO: 341701 - RNA, 22 nt, Homo sapiens
agcuccuuucugcagguagguu

SEQ ID NO: 341702 - RNA, 22 nt, Homo sapiens
agcugauuuuaaguccuugucc

SEQ ID NO: 341703 - RNA, 22 nt, Homo sapiens
agcugcaaagggagagaugauu

SEQ ID NO: 341704 - RNA, 20 nt, Homo sapiens
agcugcagauauaaauccgc

SEQ ID NO: 341705 - RNA, 17 nt, Homo sapiens
agcuggaauuacgggag

SEQ ID NO: 341706 - RNA, 22 nt, Homo sapiens
agcuggauguauguuaagugaa

SEQ ID NO: 341707 - RNA, 22 nt, Homo sapiens
agcugguuuaauaugcugucug

SEQ ID NO: 341708 - RNA, 22 nt, Homo sapiens
agcuguuguacacuuuaccuuu

SEQ ID NO: 341709 - RNA, 20 nt, Homo sapiens
agcuguuguuaaaaaggagg

SEQ ID NO: 341710 - RNA, 22 nt, Homo sapiens
agcuguuguuuuaagauacuaa

SEQ ID NO: 341711 - RNA, 22 nt, Homo sapiens
agcuuguguuuuucuaaguauc

SEQ ID NO: 341712 - RNA, 22 nt, Homo sapiens
aggaagguaaacuaacuugccu

SEQ ID NO: 341713 - RNA, 22 nt, Homo sapiens
aggaagugucuucuuuuaggca

SEQ ID NO: 341714 - RNA, 22 nt, Homo sapiens
aggaauggaaacuuuugauggu

SEQ ID NO: 341715 - RNA, 18 nt, Homo sapiens
aggaaugguaauacuuca

SEQ ID NO: 341716 - RNA, 22 nt, Homo sapiens
augggaaaaucagaaggccugg

SEQ ID NO: 341717 - RNA, 22 nt, Homo sapiens
augggagugugguuagagaccu

SEQ ID NO: 341718 - RNA, 22 nt, Homo sapiens
augggauaguaucaguggaaua

SEQ ID NO: 341719 - RNA, 21 nt, Homo sapiens
auggugagaaaguagugucaa

SEQ ID NO: 341720 - RNA, 22 nt, Homo sapiens
auguaacugggacacaagccuc

SEQ ID NO: 341721 - RNA, 20 nt, Homo sapiens
auguaauguaugauauguac

SEQ ID NO: 341722 - RNA, 22 nt, Homo sapiens
augucaaggugggugauaguuu

SEQ ID NO: 341723 - RNA, 20 nt, Homo sapiens
augucaggaagggagucagg

SEQ ID NO: 341724 - RNA, 21 nt, Homo sapiens
augucauggaugacuaauuca

SEQ ID NO: 341725 - RNA, 18 nt, Homo sapiens
augugcaauuuuguauuu

SEQ ID NO: 341726 - RNA, 22 nt, Homo sapiens
augugcacaacgugcagguuug

SEQ ID NO: 341727 - RNA, 21 nt, Homo sapiens
augugcacuaugucauuuaau

SEQ ID NO: 341728 - RNA, 22 nt, Homo sapiens
augugccauucucauggcgcuu

SEQ ID NO: 341729 - RNA, 22 nt, Homo sapiens
auguggcuuuccuagaucuuag

SEQ ID NO: 341730 - RNA, 22 nt, Homo sapiens
auguggcuuuucaacuguguga

SEQ ID NO: 341731 - RNA, 22 nt, Homo sapiens
augugggaggaauguguuucca

SEQ ID NO: 341732 - RNA, 22 nt, Homo sapiens
auguguauuaccucgauuguga

SEQ ID NO: 341733 - RNA, 22 nt, Homo sapiens
auguuauguucuucucuguaua

SEQ ID NO: 341734 - RNA, 22 nt, Homo sapiens
auguuuagagagggugucaaau

SEQ ID NO: 341735 - RNA, 22 nt, Homo sapiens
auguuugguaagaauauuguua

SEQ ID NO: 341736 - RNA, 22 nt, Homo sapiens
auuaaucaggcaaugcuugcua

SEQ ID NO: 341737 - RNA, 22 nt, Homo sapiens
auuacacuuucuauucaaugag

SEQ ID NO: 341738 - RNA, 22 nt, Homo sapiens
auuacuuugcaccaaccuaaua

SEQ ID NO: 341739 - RNA, 22 nt, Homo sapiens
auuagguauuuguccuaaauau

SEQ ID NO: 341740 - RNA, 22 nt, Homo sapiens
auuagguauuuucuggacaggg

SEQ ID NO: 341741 - RNA, 22 nt, Homo sapiens
auuagguuagugcaaaaguaau

SEQ ID NO: 341742 - RNA, 22 nt, Homo sapiens
auuagguuggugcaaaaguaau

SEQ ID NO: 341743 - RNA, 22 nt, Homo sapiens
auuagguuguugcaaaaguaau

SEQ ID NO: 341744 - RNA, 22 nt, Homo sapiens
auuauaguguauacuugaaauu

SEQ ID NO: 341745 - RNA, 22 nt, Homo sapiens
auucaagucaucucuccgcauu

SEQ ID NO: 341746 - RNA, 22 nt, Homo sapiens
auucacagcuuuaaaaggcgug

SEQ ID NO: 341747 - RNA, 22 nt, Homo sapiens
auugaaugaaauggcagacacu

SEQ ID NO: 341748 - RNA, 22 nt, Homo sapiens
auugacuugauauauagcugau

SEQ ID NO: 341749 - RNA, 22 nt, Homo sapiens
auugaguaaaugaaaauugccu

SEQ ID NO: 341750 - RNA, 19 nt, Homo sapiens
auugauuaaguuugcuguc

SEQ ID NO: 341751 - RNA, 22 nt, Homo sapiens
auugcaaagcguagacucuaaa

SEQ ID NO: 341752 - RNA, 22 nt, Homo sapiens
auugcacacagaaucaggguaa

SEQ ID NO: 341753 - RNA, 22 nt, Homo sapiens
auugcacaccagucugggcaaa

SEQ ID NO: 341754 - RNA, 22 nt, Homo sapiens
auugcacuccagccugggggac

SEQ ID NO: 341755 - RNA, 22 nt, Homo sapiens
auugcacuccagccugggugag

SEQ ID NO: 341756 - RNA, 23 nt, Homo sapiens
auugcagucuugaacuccugggc

SEQ ID NO: 341757 - RNA, 22 nt, Homo sapiens
auugccucaauuccaagacugc

SEQ ID NO: 341758 - RNA, 22 nt, Homo sapiens
auuucacuucgcaugguguccg

SEQ ID NO: 341759 - RNA, 19 nt, Homo sapiens
auuugaucaucaggcacag

SEQ ID NO: 341760 - RNA, 22 nt, Homo sapiens
auuuggcauagaguaucauucu

SEQ ID NO: 341761 - RNA, 22 nt, Homo sapiens
auuugggaaugugcauuauacu

SEQ ID NO: 341762 - RNA, 22 nt, Homo sapiens
auuuuugguugucagcacuagg

SEQ ID NO: 341763 - RNA, 22 nt, Homo sapiens
caaaggugcuuuccagguccaa

SEQ ID NO: 341764 - RNA, 22 nt, Homo sapiens
caaaguaauuacgguuuuggcc

SEQ ID NO: 341765 - RNA, 22 nt, Homo sapiens
caaagucuucaguugauucuga

SEQ ID NO: 341766 - RNA, 22 nt, Homo sapiens
caaagugcugggaugggccagg

SEQ ID NO: 341767 - RNA, 22 nt, Homo sapiens
caacaguaaagcauuuuuaagu

SEQ ID NO: 341768 - RNA, 22 nt, Homo sapiens
caagagagcugaugguuuuaaa

SEQ ID NO: 341769 - RNA, 22 nt, Homo sapiens
caagugcuuucuuggggauuua

SEQ ID NO: 341770 - RNA, 22 nt, Homo sapiens
caauacuguguugaauaagagu

SEQ ID NO: 341771 - RNA, 22 nt, Homo sapiens
caauggcaaugaaauagugaga

SEQ ID NO: 341772 - RNA, 22 nt, Homo sapiens
caauggcacgaucucgucucac

SEQ ID NO: 341773 - RNA, 21 nt, Homo sapiens
caauggcacgaucuuggcuca

SEQ ID NO: 341774 - RNA, 22 nt, Homo sapiens
cacaaugucuaagauguuucua

SEQ ID NO: 341775 - RNA, 22 nt, Homo sapiens
cacacugucuuucagaaugguu

SEQ ID NO: 341776 - RNA, 22 nt, Homo sapiens
cacacuguuuuccauggggguu

SEQ ID NO: 341777 - RNA, 22 nt, Homo sapiens
cacaguugccuaucuccugaag

SEQ ID NO: 341778 - RNA, 22 nt, Homo sapiens
cacauagucccugcuaaucuuc

SEQ ID NO: 341779 - RNA, 22 nt, Homo sapiens
cacauguuugcuacauuuuucu

SEQ ID NO: 341780 - RNA, 22 nt, Homo sapiens
cacauguuuuagcauggcuguu

SEQ ID NO: 341781 - RNA, 23 nt, Homo sapiens
caccaguauaauuagcuuuuaaa

SEQ ID NO: 341782 - RNA, 22 nt, Homo sapiens
caccuagacuggagugcagugg

SEQ ID NO: 341783 - RNA, 22 nt, Homo sapiens
caccuugugauccacccgccuu

SEQ ID NO: 341784 - RNA, 22 nt, Homo sapiens
cacugcacuccagucuggcgac

SEQ ID NO: 341785 - RNA, 21 nt, Homo sapiens
cacugcacuugccuucugggu

SEQ ID NO: 341786 - RNA, 22 nt, Homo sapiens
cacugcaguaaauugcgucggu

SEQ ID NO: 341787 - RNA, 21 nt, Homo sapiens
cacugcaucacaggacagcau

SEQ ID NO: 341788 - RNA, 22 nt, Homo sapiens
cacugcauccuccaccuccugg

SEQ ID NO: 341789 - RNA, 22 nt, Homo sapiens
cacugcauccucugccuggcgg

SEQ ID NO: 341790 - RNA, 22 nt, Homo sapiens
cacugcauuacucaugagcaug

SEQ ID NO: 341791 - RNA, 17 nt, Homo sapiens
cacugggugcaagagga

SEQ ID NO: 341792 - RNA, 21 nt, Homo sapiens
cacuggguucaggcuugugga

SEQ ID NO: 341793 - RNA, 22 nt, Homo sapiens
cacuuugguucaccugaguuuc

SEQ ID NO: 341794 - RNA, 22 nt, Homo sapiens
cagacaugucuuguggccgugg

SEQ ID NO: 341795 - RNA, 22 nt, Homo sapiens
cagagguauugcaaaagccuag

SEQ ID NO: 341796 - RNA, 22 nt, Homo sapiens
cagcucuuguuaaaacuaacua

SEQ ID NO: 341797 - RNA, 22 nt, Homo sapiens
cagcugcuuuggaaaauauuuu

SEQ ID NO: 341798 - RNA, 22 nt, Homo sapiens
cagcuggugcugcaccaguggg

SEQ ID NO: 341799 - RNA, 22 nt, Homo sapiens
cagcuguguuauaaacuaccau

SEQ ID NO: 341800 - RNA, 22 nt, Homo sapiens
cagcuguuguuaugucugcagg

SEQ ID NO: 341801 - RNA, 22 nt, Homo sapiens
caggcacgcuugggagacacac

SEQ ID NO: 341802 - RNA, 22 nt, Homo sapiens
caggcauuguccaugcugaagg

SEQ ID NO: 341803 - RNA, 22 nt, Homo sapiens
cagggaauguuauuuaauagca

SEQ ID NO: 341804 - RNA, 22 nt, Homo sapiens
acacaguaaauauugucuccuc

SEQ ID NO: 341805 - RNA, 22 nt, Homo sapiens
acacaugcuccacuguggccuc

SEQ ID NO: 341806 - RNA, 22 nt, Homo sapiens
acaccuguggucccaguaacuu

SEQ ID NO: 341807 - RNA, 22 nt, Homo sapiens
acacgugcagauuuauauaaau

SEQ ID NO: 341808 - RNA, 22 nt, Homo sapiens
acacgugcguauauguacguau

SEQ ID NO: 341809 - RNA, 22 nt, Homo sapiens
acacuggaggagagcuguugcu

SEQ ID NO: 341810 - RNA, 20 nt, Homo sapiens
acacuggaguaucaaggccc

SEQ ID NO: 341811 - RNA, 22 nt, Homo sapiens
acacuguagcugagggcaugcg

SEQ ID NO: 341812 - RNA, 22 nt, Homo sapiens
uucucauggaacaucuguacug

SEQ ID NO: 341813 - RNA, 22 nt, Homo sapiens
uucuccugguggacccuaaacg

SEQ ID NO: 341814 - RNA, 22 nt, Homo sapiens
uucucugggacauaggucgggu

SEQ ID NO: 341815 - RNA, 22 nt, Homo sapiens
uucugcacaucgaucacaagau

SEQ ID NO: 341816 - RNA, 22 nt, Homo sapiens
uucuggccccucccaaucucau

SEQ ID NO: 341817 - RNA, 22 nt, Homo sapiens
uugaaagaugaacuggauugga

SEQ ID NO: 341818 - RNA, 22 nt, Homo sapiens
uugaaagcuaucagagauucca

SEQ ID NO: 341819 - RNA, 22 nt, Homo sapiens
uugaagacuaaguuaucaggau

SEQ ID NO: 341820 - RNA, 22 nt, Homo sapiens
uugaaggaacgcuguucccuug

SEQ ID NO: 341821 - RNA, 22 nt, Homo sapiens
uugaaggaggugcucacucucg

SEQ ID NO: 341822 - RNA, 17 nt, Homo sapiens
uugaaugcauuacuugg

SEQ ID NO: 341823 - RNA, 23 nt, Homo sapiens
uugaauguuuccccucccaaauu

SEQ ID NO: 341824 - RNA, 22 nt, Homo sapiens
uugacaaguuguccaguaugag

SEQ ID NO: 341825 - RNA, 22 nt, Homo sapiens
uugacagaccuuggucauaucc

SEQ ID NO: 341826 - RNA, 22 nt, Homo sapiens
uugacaguggcuuaaauugguu

SEQ ID NO: 341827 - RNA, 20 nt, Homo sapiens
uugacaguggguuguuaaag

SEQ ID NO: 341828 - RNA, 22 nt, Homo sapiens
uugacauaguuucugaaauaga

SEQ ID NO: 341829 - RNA, 22 nt, Homo sapiens
uugagaaucuuucgaauguucu

SEQ ID NO: 341830 - RNA, 22 nt, Homo sapiens
uugagacgaagucucacucuug

SEQ ID NO: 341831 - RNA, 22 nt, Homo sapiens
uugagagagaacauuuguuaca

SEQ ID NO: 341832 - RNA, 22 nt, Homo sapiens
uugagauaggagcuguuguucu

SEQ ID NO: 341833 - RNA, 22 nt, Homo sapiens
uugagaucaugcuacugcacuc

SEQ ID NO: 341834 - RNA, 22 nt, Homo sapiens
uugagauggagcuucacucuug

SEQ ID NO: 341835 - RNA, 22 nt, Homo sapiens
uugagauggagucucacucuuu

SEQ ID NO: 341836 - RNA, 22 nt, Homo sapiens
uugagauggagucucgcugugu

SEQ ID NO: 341837 - RNA, 22 nt, Homo sapiens
uugagauggaguuucgcucuug

SEQ ID NO: 341838 - RNA, 22 nt, Homo sapiens
uugagcacaggaguuuugagac

SEQ ID NO: 341839 - RNA, 22 nt, Homo sapiens
uugagcacaguagguuguggcu

SEQ ID NO: 341840 - RNA, 22 nt, Homo sapiens
uugagcacauguguuaaggggu

SEQ ID NO: 341841 - RNA, 22 nt, Homo sapiens
uugagcaucauguuagcacuca

SEQ ID NO: 341842 - RNA, 22 nt, Homo sapiens
uugagcucuucuagcaauucua

SEQ ID NO: 341843 - RNA, 22 nt, Homo sapiens
uugaggaaugucauuuguguuu

SEQ ID NO: 341844 - RNA, 22 nt, Homo sapiens
uugaggaggcagucucuccauu

SEQ ID NO: 341845 - RNA, 22 nt, Homo sapiens
uugaggaggcagucuucccauu

SEQ ID NO: 341846 - RNA, 22 nt, Homo sapiens
uugagggagcauuuguuuugag

SEQ ID NO: 341847 - RNA, 22 nt, Homo sapiens
uugagggaggcagggcuugucu

SEQ ID NO: 341848 - RNA, 22 nt, Homo sapiens
uugaggguggcauauauugauu

SEQ ID NO: 341849 - RNA, 22 nt, Homo sapiens
uugaggugaagggcagagcagc

SEQ ID NO: 341850 - RNA, 22 nt, Homo sapiens
uugaggugggaggaucacuuga

SEQ ID NO: 341851 - RNA, 22 nt, Homo sapiens
uugagguggugucuugcucugu

SEQ ID NO: 341852 - RNA, 22 nt, Homo sapiens
uugaguuuaucuaaagaccugg

SEQ ID NO: 341853 - RNA, 22 nt, Homo sapiens
uugauaagaaaaauauaccaga

SEQ ID NO: 341854 - RNA, 22 nt, Homo sapiens
uugauaguccuguaucuauuuu

SEQ ID NO: 341855 - RNA, 22 nt, Homo sapiens
uugauauuaaguacugaagugg

SEQ ID NO: 341856 - RNA, 22 nt, Homo sapiens
uugauauuacucaguaacagau

SEQ ID NO: 341857 - RNA, 22 nt, Homo sapiens
uugauguccaucucuagguaaa

SEQ ID NO: 341858 - RNA, 22 nt, Homo sapiens
uugauguguuuccaggauuugu

SEQ ID NO: 341859 - RNA, 22 nt, Homo sapiens
uugcaaagaccucuucacuucc

SEQ ID NO: 341860 - RNA, 22 nt, Homo sapiens
uugcaaaguugccaaggaagga

SEQ ID NO: 341861 - RNA, 22 nt, Homo sapiens
uugcaaaucucuuguguuuggu

SEQ ID NO: 341862 - RNA, 22 nt, Homo sapiens
uugcaacauguauucuggugau

SEQ ID NO: 341863 - RNA, 22 nt, Homo sapiens
uugcaagaaaugcagauucuca

SEQ ID NO: 341864 - RNA, 22 nt, Homo sapiens
uugcacagugcuuucuuugccc

SEQ ID NO: 341865 - RNA, 22 nt, Homo sapiens
uugcacauuuuuucuggcagaa

SEQ ID NO: 341866 - RNA, 22 nt, Homo sapiens
uugcaccacugcguuccagccu

SEQ ID NO: 341867 - RNA, 22 nt, Homo sapiens
uugcacuccagccugggugaca

SEQ ID NO: 341868 - RNA, 22 nt, Homo sapiens
uugcacucuccagccucggcaa

SEQ ID NO: 341869 - RNA, 22 nt, Homo sapiens
uugcagagccccacacugggcu

SEQ ID NO: 341870 - RNA, 22 nt, Homo sapiens
uugcagcaaagagggaggggca

SEQ ID NO: 341871 - RNA, 22 nt, Homo sapiens
uugcagugugacgacuauauuu

SEQ ID NO: 341872 - RNA, 22 nt, Homo sapiens
uugcaugcuccuuaugagaauc

SEQ ID NO: 341873 - RNA, 22 nt, Homo sapiens
uugcugguuuucauaugagcag

SEQ ID NO: 341874 - RNA, 22 nt, Homo sapiens
uugcuucuuucgucuggcccca

SEQ ID NO: 341875 - RNA, 22 nt, Homo sapiens
uuggaaauauguuaagugucau

SEQ ID NO: 341876 - RNA, 22 nt, Homo sapiens
uuggaaaugguaaaggguuaau

SEQ ID NO: 341877 - RNA, 22 nt, Homo sapiens
uuggaagagaagggagauaaac

SEQ ID NO: 341878 - RNA, 22 nt, Homo sapiens
uuggaagguaaucaaaaguucu

SEQ ID NO: 341879 - RNA, 22 nt, Homo sapiens
uuggaauuaaccuggugcugga

SEQ ID NO: 341880 - RNA, 22 nt, Homo sapiens
uuggaauuagacaagugguggu

SEQ ID NO: 341881 - RNA, 22 nt, Homo sapiens
uuggacuucucaaggcaauaaa

SEQ ID NO: 341882 - RNA, 22 nt, Homo sapiens
uuggagagaaaggcaguuccug

SEQ ID NO: 341883 - RNA, 22 nt, Homo sapiens
uuggagagugauauucagaugc

SEQ ID NO: 341884 - RNA, 22 nt, Homo sapiens
uuggagcccuaacucucaguac

SEQ ID NO: 341885 - RNA, 22 nt, Homo sapiens
uuggagugugucuuauuccauu

SEQ ID NO: 341886 - RNA, 22 nt, Homo sapiens
uuggauuuuaacaaacuaggug

SEQ ID NO: 341887 - RNA, 22 nt, Homo sapiens
uuggcaaagaggaaugccacuu

SEQ ID NO: 341888 - RNA, 22 nt, Homo sapiens
uuggcaaagugucuggcauuua

SEQ ID NO: 341889 - RNA, 22 nt, Homo sapiens
uuggcaaauagguuuuauugca

SEQ ID NO: 341890 - RNA, 22 nt, Homo sapiens
uuggcaaguuucugucagcaaa

SEQ ID NO: 341891 - RNA, 22 nt, Homo sapiens
uuggcagcuguggaaucugggc

SEQ ID NO: 341892 - RNA, 22 nt, Homo sapiens
cuccauuuggaacagauguccu

SEQ ID NO: 341893 - RNA, 22 nt, Homo sapiens
cucccacccucauuuuuaggca

SEQ ID NO: 341894 - RNA, 22 nt, Homo sapiens
cucccagugacccaggaacagg

SEQ ID NO: 341895 - RNA, 22 nt, Homo sapiens
cuccccuuuaguuucuuaauaa

SEQ ID NO: 341896 - RNA, 22 nt, Homo sapiens
cucccuuugcugaauguuuuuc

SEQ ID NO: 341897 - RNA, 22 nt, Homo sapiens
cucucugagccccagacaccuu

SEQ ID NO: 341898 - RNA, 22 nt, Homo sapiens
cucugagccugagguuccuacu

SEQ ID NO: 341899 - RNA, 22 nt, Homo sapiens
cugaauguuucacucugaaaug

SEQ ID NO: 341900 - RNA, 22 nt, Homo sapiens
cugaccucugucaaagacaccc

SEQ ID NO: 341901 - RNA, 22 nt, Homo sapiens
cugacuaguuuuaaugcagauu

SEQ ID NO: 341902 - RNA, 22 nt, Homo sapiens
cugagaagaaacagguaaggac

SEQ ID NO: 341903 - RNA, 22 nt, Homo sapiens
cugagagaggagcuaaaacugc

SEQ ID NO: 341904 - RNA, 22 nt, Homo sapiens
cugagauaggacucugcuggcu

SEQ ID NO: 341905 - RNA, 22 nt, Homo sapiens
cugagcuaguagcauuguguca

SEQ ID NO: 341906 - RNA, 22 nt, Homo sapiens
cugagguauaucccauuagaag

SEQ ID NO: 341907 - RNA, 22 nt, Homo sapiens
cugaggugggagaaucacauaa

SEQ ID NO: 341908 - RNA, 22 nt, Homo sapiens
cugaucuguuauacuuuucuau

SEQ ID NO: 341909 - RNA, 22 nt, Homo sapiens
cugaugaaguauuuguucugga

SEQ ID NO: 341910 - RNA, 22 nt, Homo sapiens
cugauuguucuugcugggccuu

SEQ ID NO: 341911 - RNA, 22 nt, Homo sapiens
cugcaguaaacuuucccauuca

SEQ ID NO: 341912 - RNA, 22 nt, Homo sapiens
cugcauaaucaucucucugcau

SEQ ID NO: 341913 - RNA, 22 nt, Homo sapiens
cuggaaagaaucaggcuaaacu

SEQ ID NO: 341914 - RNA, 22 nt, Homo sapiens
cuggaauuacaggguugagcua

SEQ ID NO: 341915 - RNA, 22 nt, Homo sapiens
cuggagcaaaggugacucuugu

SEQ ID NO: 341916 - RNA, 22 nt, Homo sapiens
cuggagcauugguggauuuguu

SEQ ID NO: 341917 - RNA, 22 nt, Homo sapiens
cuggaguaugaaccauguauca

SEQ ID NO: 341918 - RNA, 22 nt, Homo sapiens
cuggcaguguuucuugugggcu

SEQ ID NO: 341919 - RNA, 22 nt, Homo sapiens
cuggcucugggcuaaagaaaua

SEQ ID NO: 341920 - RNA, 22 nt, Homo sapiens
cuguaaaguaagagguaaguua

SEQ ID NO: 341921 - RNA, 22 nt, Homo sapiens
cuguauguuucuaugaauguga

SEQ ID NO: 341922 - RNA, 22 nt, Homo sapiens
cugucaucauuucuaugugcca

SEQ ID NO: 341923 - RNA, 22 nt, Homo sapiens
cugugcaaagcgcucucggggu

SEQ ID NO: 341924 - RNA, 22 nt, Homo sapiens
cugugccaagcuugcgaugugc

SEQ ID NO: 341925 - RNA, 22 nt, Homo sapiens
cugugcuugauuauaugagugu

SEQ ID NO: 341926 - RNA, 20 nt, Homo sapiens
cugugguagggaccaggaau

SEQ ID NO: 341927 - RNA, 23 nt, Homo sapiens
cuguggugaggcccuagaaucug

SEQ ID NO: 341928 - RNA, 22 nt, Homo sapiens
cugugguguaacucuuggggcg

SEQ ID NO: 341929 - RNA, 22 nt, Homo sapiens
cuguuauguuugauggaugaau

SEQ ID NO: 341930 - RNA, 22 nt, Homo sapiens
cuguugguuaaauuccaugcag

SEQ ID NO: 341931 - RNA, 18 nt, Homo sapiens
cuuaacauugggaugaua

SEQ ID NO: 341932 - RNA, 22 nt, Homo sapiens
cuuccugaguccugggcucaca

SEQ ID NO: 341933 - RNA, 22 nt, Homo sapiens
cuugacacugguuuucugaaua

SEQ ID NO: 341934 - RNA, 22 nt, Homo sapiens
cuugagacauuguuuuccaagu

SEQ ID NO: 341935 - RNA, 22 nt, Homo sapiens
cuugagcuugagauccuuucug

SEQ ID NO: 341936 - RNA, 22 nt, Homo sapiens
cuugcacauuacagaucugcau

SEQ ID NO: 341937 - RNA, 22 nt, Homo sapiens
cuugcagagcccauggauguca

SEQ ID NO: 341938 - RNA, 22 nt, Homo sapiens
cuuggcauugccccuggaauuu

SEQ ID NO: 341939 - RNA, 22 nt, Homo sapiens
cuugucacuguuggcuuuagaa

SEQ ID NO: 341940 - RNA, 22 nt, Homo sapiens
cuugugauugcacggcugccug

SEQ ID NO: 341941 - RNA, 22 nt, Homo sapiens
cuuguuguggaggggagugcag

SEQ ID NO: 341942 - RNA, 22 nt, Homo sapiens
cuuucacacuguuggugggaau

SEQ ID NO: 341943 - RNA, 22 nt, Homo sapiens
cuuuccauuguuggagcauaaa

SEQ ID NO: 341944 - RNA, 22 nt, Homo sapiens
cuuugcacaucucugcuuuccc

SEQ ID NO: 341945 - RNA, 22 nt, Homo sapiens
cuuugguucuguuuauaugcug

SEQ ID NO: 341946 - RNA, 21 nt, Homo sapiens
cuuugguuucugacuugcaua

SEQ ID NO: 341947 - RNA, 23 nt, Homo sapiens
cuuuguacagcuugacuacuggg

SEQ ID NO: 341948 - RNA, 22 nt, Homo sapiens
cuuuuacacuguuagugggaau

SEQ ID NO: 341949 - RNA, 22 nt, Homo sapiens
gaaagauuuuaacugggagacu

SEQ ID NO: 341950 - RNA, 23 nt, Homo sapiens
gaaauguaagugaugccccacag

SEQ ID NO: 341951 - RNA, 22 nt, Homo sapiens
gaaauguauuaaugaguugaaa

SEQ ID NO: 341952 - RNA, 22 nt, Homo sapiens
gaagacauuuacaugggagacc

SEQ ID NO: 341953 - RNA, 22 nt, Homo sapiens
gaagaucacacuguagaucuau

SEQ ID NO: 341954 - RNA, 22 nt, Homo sapiens
gaagcauugauccacaggcgug

SEQ ID NO: 341955 - RNA, 22 nt, Homo sapiens
gaagguaguuuauagauguggu

SEQ ID NO: 341956 - RNA, 22 nt, Homo sapiens
gaagugcaguggcacagucaug

SEQ ID NO: 341957 - RNA, 22 nt, Homo sapiens
gaauacuguccaagagugaugg

SEQ ID NO: 341958 - RNA, 22 nt, Homo sapiens
gaauagugcugcagcaaacaua

SEQ ID NO: 341959 - RNA, 18 nt, Homo sapiens
gacaguguggcgauuccu

SEQ ID NO: 341960 - RNA, 20 nt, Homo sapiens
gacauaggcugguaucuggc

SEQ ID NO: 341961 - RNA, 20 nt, Homo sapiens
gacauguugguuugcugcac

SEQ ID NO: 341962 - RNA, 22 nt, Homo sapiens
gacuagaaauuauuuagugagc

SEQ ID NO: 341963 - RNA, 16 nt, Homo sapiens
gacugggcugaggaau

SEQ ID NO: 341964 - RNA, 22 nt, Homo sapiens
gagaacagagauaauuuuacuu

SEQ ID NO: 341965 - RNA, 22 nt, Homo sapiens
gagaacaguguuguauuuuuuc

SEQ ID NO: 341966 - RNA, 22 nt, Homo sapiens
gagaacauuuaagccacucagg

SEQ ID NO: 341967 - RNA, 22 nt, Homo sapiens
gagaacugagauaagugauauu

SEQ ID NO: 341968 - RNA, 22 nt, Homo sapiens
gagaaugagauuaugguuacau

SEQ ID NO: 341969 - RNA, 22 nt, Homo sapiens
gagacauguuugccaauaauuu

SEQ ID NO: 341970 - RNA, 22 nt, Homo sapiens
gagagcuaggccacuggggcuu

SEQ ID NO: 341971 - RNA, 23 nt, Homo sapiens
gagaucauucuggaauuagagug

SEQ ID NO: 341972 - RNA, 22 nt, Homo sapiens
gagauggagacuuggccuuaaa

SEQ ID NO: 341973 - RNA, 22 nt, Homo sapiens
gagaugguguuccacugccagu

SEQ ID NO: 341974 - RNA, 22 nt, Homo sapiens
gagauuuucagcuugacuggga

SEQ ID NO: 341975 - RNA, 21 nt, Homo sapiens
gagcuaggugaggcuguaaug

SEQ ID NO: 341976 - RNA, 22 nt, Homo sapiens
gagcucauuguugcuaaagaga

SEQ ID NO: 341977 - RNA, 22 nt, Homo sapiens
gagcuguuuuucacuagaccaa

SEQ ID NO: 341978 - RNA, 22 nt, Homo sapiens
gagguauggauaucuggagagg

SEQ ID NO: 341979 - RNA, 22 nt, Homo sapiens
cauugcacuccaccuuggguaa

SEQ ID NO: 341980 - RNA, 22 nt, Homo sapiens
cauugcacuccacuccugaaca

SEQ ID NO: 341981 - RNA, 22 nt, Homo sapiens
cauugcacuccagcccagguga

SEQ ID NO: 341982 - RNA, 22 nt, Homo sapiens
cauugcacuccagccucggcaa

SEQ ID NO: 341983 - RNA, 22 nt, Homo sapiens
cauugcacuccagccugaccaa

SEQ ID NO: 341984 - RNA, 22 nt, Homo sapiens
cauugcacuccagccugccugg

SEQ ID NO: 341985 - RNA, 22 nt, Homo sapiens
cauugcacuccagccuggccaa

SEQ ID NO: 341986 - RNA, 22 nt, Homo sapiens
cauugcacuccagccuuggcaa

SEQ ID NO: 341987 - RNA, 22 nt, Homo sapiens
cauugcacuccagcucugggcg

SEQ ID NO: 341988 - RNA, 20 nt, Homo sapiens
cauugcacuccagcuugggc

SEQ ID NO: 341989 - RNA, 22 nt, Homo sapiens
cauugcacuccagcuugggcga

SEQ ID NO: 341990 - RNA, 22 nt, Homo sapiens
cauugcacuccaucuugggcaa

SEQ ID NO: 341991 - RNA, 22 nt, Homo sapiens
cauugcacugcagcccgggcaa

SEQ ID NO: 341992 - RNA, 22 nt, Homo sapiens
cauugcacugcauucugggcaa

SEQ ID NO: 341993 - RNA, 22 nt, Homo sapiens
cauugcacuuagacaacuuuug

SEQ ID NO: 341994 - RNA, 22 nt, Homo sapiens
cauuggugauuagugaaugaac

SEQ ID NO: 341995 - RNA, 22 nt, Homo sapiens
cauuugcacugagacucagcuu

SEQ ID NO: 341996 - RNA, 22 nt, Homo sapiens
ccaaaguauuuucacugauauc

SEQ ID NO: 341997 - RNA, 22 nt, Homo sapiens
ccaaggaauacccucccuuuuu

SEQ ID NO: 341998 - RNA, 22 nt, Homo sapiens
ccaaguguucucauuguucaau

SEQ ID NO: 341999 - RNA, 23 nt, Homo sapiens
ccacacuguuuagaauggcauca

SEQ ID NO: 342000 - RNA, 22 nt, Homo sapiens
ccacagucuaugcaacaagguc

SEQ ID NO: 342001 - RNA, 22 nt, Homo sapiens
ccacauuggaaaggaucccccc

SEQ ID NO: 342002 - RNA, 22 nt, Homo sapiens
ccacccuuccauucuuccucuu

SEQ ID NO: 342003 - RNA, 22 nt, Homo sapiens
ccacugcacuccagcccggcaa

SEQ ID NO: 342004 - RNA, 22 nt, Homo sapiens
ccagccgggugcaguggcucac

SEQ ID NO: 342005 - RNA, 22 nt, Homo sapiens
ccagugcauggaucccaggggg

SEQ ID NO: 342006 - RNA, 19 nt, Homo sapiens
ccaguguugccagagcuga

SEQ ID NO: 342007 - RNA, 22 nt, Homo sapiens
ccaguuuucccagcaccauuaa

SEQ ID NO: 342008 - RNA, 22 nt, Homo sapiens
ccaguuuuucauuuauacuagu

SEQ ID NO: 342009 - RNA, 22 nt, Homo sapiens
ccaucccuuucugagcaguucc

SEQ ID NO: 342010 - RNA, 22 nt, Homo sapiens
ccauugcacuccagccucggca

SEQ ID NO: 342011 - RNA, 22 nt, Homo sapiens
ccauugcacuccauccugggca

SEQ ID NO: 342012 - RNA, 22 nt, Homo sapiens
ccauugcacucuggccuaggug

SEQ ID NO: 342013 - RNA, 22 nt, Homo sapiens
ccauuucacucuuccugaagga

SEQ ID NO: 342014 - RNA, 22 nt, Homo sapiens
cccacaguggccucauauccuu

SEQ ID NO: 342015 - RNA, 22 nt, Homo sapiens
cccagagacagaaugauaaacu

SEQ ID NO: 342016 - RNA, 21 nt, Homo sapiens
cccagguucucugaggguaga

SEQ ID NO: 342017 - RNA, 18 nt, Homo sapiens
cccagugacuuauggccu

SEQ ID NO: 342018 - RNA, 22 nt, Homo sapiens
cccaguuuugcuucucaugagg

SEQ ID NO: 342019 - RNA, 17 nt, Homo sapiens
ccccugagcgaugcagu

SEQ ID NO: 342020 - RNA, 22 nt, Homo sapiens
cccucauucauucauccuaugu

SEQ ID NO: 342021 - RNA, 22 nt, Homo sapiens
cccugacauucggagauguagu

SEQ ID NO: 342022 - RNA, 22 nt, Homo sapiens
cccugagaugcuguuaaucugu

SEQ ID NO: 342023 - RNA, 22 nt, Homo sapiens
ccucacaaccuuuauugaagag

SEQ ID NO: 342024 - RNA, 22 nt, Homo sapiens
ccucaguguuuaucauuauuuu

SEQ ID NO: 342025 - RNA, 22 nt, Homo sapiens
ccuccauuugugucaggaaguc

SEQ ID NO: 342026 - RNA, 22 nt, Homo sapiens
ccugagacgaauggagugaaca

SEQ ID NO: 342027 - RNA, 22 nt, Homo sapiens
ccuggguuacaggugugagcca

SEQ ID NO: 342028 - RNA, 22 nt, Homo sapiens
ccugucuugauuaaauuacuua

SEQ ID NO: 342029 - RNA, 22 nt, Homo sapiens
ccugugguuaaccagcuagaug

SEQ ID NO: 342030 - RNA, 18 nt, Homo sapiens
ccuuaguuauagagaguc

SEQ ID NO: 342031 - RNA, 22 nt, Homo sapiens
ccuucacaggcacugguucaga

SEQ ID NO: 342032 - RNA, 22 nt, Homo sapiens
ccuuggcaauggcuggggcuga

SEQ ID NO: 342033 - RNA, 22 nt, Homo sapiens
ccuuggcacuacugacauugua

SEQ ID NO: 342034 - RNA, 22 nt, Homo sapiens
cuaaaacuuucugagugcagca

SEQ ID NO: 342035 - RNA, 22 nt, Homo sapiens
cuaaagauagugacaugauuug

SEQ ID NO: 342036 - RNA, 21 nt, Homo sapiens
cuaaggaaagcuaugaacccu

SEQ ID NO: 342037 - RNA, 22 nt, Homo sapiens
cuaagggaggaagcugugcagg

SEQ ID NO: 342038 - RNA, 22 nt, Homo sapiens
cuaagugaguauaauuuuaaga

SEQ ID NO: 342039 - RNA, 22 nt, Homo sapiens
cuacaguuauguuuuaaaugug

SEQ ID NO: 342040 - RNA, 22 nt, Homo sapiens
cuacugcacaucaucugaguua

SEQ ID NO: 342041 - RNA, 22 nt, Homo sapiens
cuagagagaagcugugugaccu

SEQ ID NO: 342042 - RNA, 22 nt, Homo sapiens
cuagauuguuuccauaaugaca

SEQ ID NO: 342043 - RNA, 22 nt, Homo sapiens
cuagcacauaguuauucacuca

SEQ ID NO: 342044 - RNA, 19 nt, Homo sapiens
cuauugcacauagcugaag

SEQ ID NO: 342045 - RNA, 22 nt, Homo sapiens
cucaaagucaagggaaagcagg

SEQ ID NO: 342046 - RNA, 18 nt, Homo sapiens
cucacacccuaaucagga

SEQ ID NO: 342047 - RNA, 20 nt, Homo sapiens
cucaccagguguaggcugag

SEQ ID NO: 342048 - RNA, 17 nt, Homo sapiens
cucacugagaacagcua

SEQ ID NO: 342049 - RNA, 22 nt, Homo sapiens
cucacugggaccacucugaagu

SEQ ID NO: 342050 - RNA, 22 nt, Homo sapiens
cucacugugguguccuuaggua

SEQ ID NO: 342051 - RNA, 22 nt, Homo sapiens
cucaguagaaaauacauggacu

SEQ ID NO: 342052 - RNA, 22 nt, Homo sapiens
cucaguggauuagauaaugcac

SEQ ID NO: 342053 - RNA, 22 nt, Homo sapiens
cucagugucuggcacacagaaa

SEQ ID NO: 342054 - RNA, 22 nt, Homo sapiens
cucauggagaaccucugcuagg

SEQ ID NO: 342055 - RNA, 19 nt, Homo sapiens
cucauggagaaggagaaua

SEQ ID NO: 342056 - RNA, 22 nt, Homo sapiens
cucauggauggucuggcagcca

SEQ ID NO: 342057 - RNA, 22 nt, Homo sapiens
cuccacugagcaggugggaggc

SEQ ID NO: 342058 - RNA, 22 nt, Homo sapiens
cuccaggugagguuaagggacu

SEQ ID NO: 342059 - RNA, 22 nt, Homo sapiens
cuccauuuaucugaaauuuuau

SEQ ID NO: 342060 - RNA, 22 nt, Homo sapiens
auguguucaucacagcacaauu

SEQ ID NO: 342061 - RNA, 22 nt, Homo sapiens
auguuagcaucaauauucauca

SEQ ID NO: 342062 - RNA, 22 nt, Homo sapiens
auuaaguugugccugaaaacuu

SEQ ID NO: 342063 - RNA, 22 nt, Homo sapiens
auuaauguaauuaguaaaguug

SEQ ID NO: 342064 - RNA, 22 nt, Homo sapiens
gaggucauguggcaggcagcca

SEQ ID NO: 342065 - RNA, 22 nt, Homo sapiens
gaggucuuacauuuuaauauuu

SEQ ID NO: 342066 - RNA, 22 nt, Homo sapiens
gagguguagagauauaccugaa

SEQ ID NO: 342067 - RNA, 22 nt, Homo sapiens
gagugcaauggcgcgaucucgg

SEQ ID NO: 342068 - RNA, 22 nt, Homo sapiens
gaguucaaaucucagcucuguu

SEQ ID NO: 342069 - RNA, 22 nt, Homo sapiens
gaguucauuuugaaaccuugau

SEQ ID NO: 342070 - RNA, 22 nt, Homo sapiens
gaguuccuuugagccugagagg

SEQ ID NO: 342071 - RNA, 19 nt, Homo sapiens
gaguugggguuuacuguaa

SEQ ID NO: 342072 - RNA, 22 nt, Homo sapiens
gaguuuguacuaauuuguugua

SEQ ID NO: 342073 - RNA, 22 nt, Homo sapiens
gauacuguauccuaaaagcuuu

SEQ ID NO: 342074 - RNA, 22 nt, Homo sapiens
gauauguaaaaauuauaucuga

SEQ ID NO: 342075 - RNA, 22 nt, Homo sapiens
gauauguuagggggagaaguua

SEQ ID NO: 342076 - RNA, 22 nt, Homo sapiens
ugagcugagauuaagcugcugc

SEQ ID NO: 342077 - RNA, 22 nt, Homo sapiens
ugaggaaugaccccgugugguc

SEQ ID NO: 342078 - RNA, 22 nt, Homo sapiens
ugaggacugagaggcacugugg

SEQ ID NO: 342079 - RNA, 22 nt, Homo sapiens
ugaggagugaacuauuucugau

SEQ ID NO: 342080 - RNA, 22 nt, Homo sapiens
ugaggcuagucagaucagauga

SEQ ID NO: 342081 - RNA, 17 nt, Homo sapiens
ugagggaugccugguuc

SEQ ID NO: 342082 - RNA, 22 nt, Homo sapiens
ugagggaugccugguuuguuuu

SEQ ID NO: 342083 - RNA, 22 nt, Homo sapiens
ugagguaagauguucauuuuuc

SEQ ID NO: 342084 - RNA, 22 nt, Homo sapiens
ugagguagguaccauuaucacu

SEQ ID NO: 342085 - RNA, 20 nt, Homo sapiens
ugaggucaggaguuacagac

SEQ ID NO: 342086 - RNA, 22 nt, Homo sapiens
ugaggugaaguaauauucuaag

SEQ ID NO: 342087 - RNA, 22 nt, Homo sapiens
ugaggugagggguuaggugcua

SEQ ID NO: 342088 - RNA, 22 nt, Homo sapiens
ugaggugaggguaucaaaugcu

SEQ ID NO: 342089 - RNA, 22 nt, Homo sapiens
ugagguguuugugcaccaucug

SEQ ID NO: 342090 - RNA, 22 nt, Homo sapiens
ugagucauguaauaaugcugcu

SEQ ID NO: 342091 - RNA, 22 nt, Homo sapiens
ugagucuguuccaaagaaauaa

SEQ ID NO: 342092 - RNA, 22 nt, Homo sapiens
ugagugaacgcugagaccaaau

SEQ ID NO: 342093 - RNA, 22 nt, Homo sapiens
ugaguguccaccccuuucacag

SEQ ID NO: 342094 - RNA, 22 nt, Homo sapiens
ugaguuccuugugugaccuugc

SEQ ID NO: 342095 - RNA, 23 nt, Homo sapiens
ugauaacagcauaugaagauucu

SEQ ID NO: 342096 - RNA, 22 nt, Homo sapiens
ugauaagugaaagugcucuauc

SEQ ID NO: 342097 - RNA, 18 nt, Homo sapiens
ugauaucaucacaauuga

SEQ ID NO: 342098 - RNA, 20 nt, Homo sapiens
ugauauuucuggaaguggag

SEQ ID NO: 342099 - RNA, 22 nt, Homo sapiens
ugaucugucacuuaucacauuu

SEQ ID NO: 342100 - RNA, 22 nt, Homo sapiens
ugaucuguccaccucagcuucc

SEQ ID NO: 342101 - RNA, 22 nt, Homo sapiens
ugaucugucucggguuaucagu

SEQ ID NO: 342102 - RNA, 22 nt, Homo sapiens
ugaugcugaguggcuauuugaa

SEQ ID NO: 342103 - RNA, 22 nt, Homo sapiens
ugauggcacagugaguuccagg

SEQ ID NO: 342104 - RNA, 22 nt, Homo sapiens
ugauggcauuucauguuuguaa

SEQ ID NO: 342105 - RNA, 22 nt, Homo sapiens
ugauggcauuuggaguugggac

SEQ ID NO: 342106 - RNA, 22 nt, Homo sapiens
ugauggccuguucuccauaugu

SEQ ID NO: 342107 - RNA, 22 nt, Homo sapiens
ugaugguuuuauaagggagagu

SEQ ID NO: 342108 - RNA, 23 nt, Homo sapiens
ugauguccacuuagggucuaggu

SEQ ID NO: 342109 - RNA, 22 nt, Homo sapiens
ugauuggagaacaaacugcaua

SEQ ID NO: 342110 - RNA, 22 nt, Homo sapiens
ugauuggagaugaauuucguuu

SEQ ID NO: 342111 - RNA, 22 nt, Homo sapiens
ugcaaagaaauuuuggugacca

SEQ ID NO: 342112 - RNA, 22 nt, Homo sapiens
ugcaaaguccucauucuuaccc

SEQ ID NO: 342113 - RNA, 22 nt, Homo sapiens
ugcaaaucuuguguaguuguga

SEQ ID NO: 342114 - RNA, 22 nt, Homo sapiens
ugcaaauguuaguaacaccacu

SEQ ID NO: 342115 - RNA, 21 nt, Homo sapiens
ugcaagaaucaggaagcugcc

SEQ ID NO: 342116 - RNA, 22 nt, Homo sapiens
ugcaagauaggcaguuugcacu

SEQ ID NO: 342117 - RNA, 17 nt, Homo sapiens
ugcaauuuaagcuagau

SEQ ID NO: 342118 - RNA, 22 nt, Homo sapiens
ugcaauuuaaugugucccaauu

SEQ ID NO: 342119 - RNA, 22 nt, Homo sapiens
ugcacaguccagugcccacuga

SEQ ID NO: 342120 - RNA, 22 nt, Homo sapiens
ugcaccaauucuaaacaguucu

SEQ ID NO: 342121 - RNA, 22 nt, Homo sapiens
ugcaccacugcacuccaggcug

SEQ ID NO: 342122 - RNA, 22 nt, Homo sapiens
ugcagagucuguccugccugcc

SEQ ID NO: 342123 - RNA, 21 nt, Homo sapiens
ugcagccauucagcccuaugc

SEQ ID NO: 342124 - RNA, 22 nt, Homo sapiens
ugcagcucaaauuccuaacaag

SEQ ID NO: 342125 - RNA, 22 nt, Homo sapiens
ugcaguacauucagcauccucu

SEQ ID NO: 342126 - RNA, 22 nt, Homo sapiens
ugcagugucaauaauaauuagu

SEQ ID NO: 342127 - RNA, 22 nt, Homo sapiens
ugcagugugaaagagccugaca

SEQ ID NO: 342128 - RNA, 22 nt, Homo sapiens
ugcagugugauuuucuggcuga

SEQ ID NO: 342129 - RNA, 22 nt, Homo sapiens
ugcauaauuccuugcaccagaa

SEQ ID NO: 342130 - RNA, 22 nt, Homo sapiens
ugcauacacaagcauacaugua

SEQ ID NO: 342131 - RNA, 22 nt, Homo sapiens
ugcauauucaaggcaggccauu

SEQ ID NO: 342132 - RNA, 21 nt, Homo sapiens
ugcauauuggaacuuucucuc

SEQ ID NO: 342133 - RNA, 20 nt, Homo sapiens
ucucccaaacagcaggcccu

SEQ ID NO: 342134 - RNA, 22 nt, Homo sapiens
ucucuggauaucuacuuauguu

SEQ ID NO: 342135 - RNA, 22 nt, Homo sapiens
ucucuugguugaacaguuugga

SEQ ID NO: 342136 - RNA, 22 nt, Homo sapiens
ucugagaucaugucugugcugu

SEQ ID NO: 342137 - RNA, 22 nt, Homo sapiens
ucugauggaguugccagggaga

SEQ ID NO: 342138 - RNA, 22 nt, Homo sapiens
ucuggcuccaaagucuauuuuu

SEQ ID NO: 342139 - RNA, 22 nt, Homo sapiens
ucugggguuagucaaagguaug

SEQ ID NO: 342140 - RNA, 22 nt, Homo sapiens
ucuggguuuuuacaauguuuac

SEQ ID NO: 342141 - RNA, 22 nt, Homo sapiens
ucugguggugaugagagacagu

SEQ ID NO: 342142 - RNA, 22 nt, Homo sapiens
ucuguacugccaaguuucuuua

SEQ ID NO: 342143 - RNA, 22 nt, Homo sapiens
ucugucacugguggacgaucac

SEQ ID NO: 342144 - RNA, 22 nt, Homo sapiens
ucugugaaaucauuuccuguaa

SEQ ID NO: 342145 - RNA, 22 nt, Homo sapiens
ucugugcuugucauaugcuuug

SEQ ID NO: 342146 - RNA, 22 nt, Homo sapiens
ucugugguucaggcuggagugc

SEQ ID NO: 342147 - RNA, 21 nt, Homo sapiens
ucuguguugaucucacuggga

SEQ ID NO: 342148 - RNA, 22 nt, Homo sapiens
ucuguguuugguuggcaauuuc

SEQ ID NO: 342149 - RNA, 22 nt, Homo sapiens
ucuuaggugggccaucacccca

SEQ ID NO: 342150 - RNA, 22 nt, Homo sapiens
ucuucuagcggaacccucuugu

SEQ ID NO: 342151 - RNA, 17 nt, Homo sapiens
ucuucuguuacuguggc

SEQ ID NO: 342152 - RNA, 22 nt, Homo sapiens
ucuuuggguguauuucacagcc

SEQ ID NO: 342153 - RNA, 22 nt, Homo sapiens
ucuuugguuguuuagggugcau

SEQ ID NO: 342154 - RNA, 22 nt, Homo sapiens
ucuuuguuagaacccucuccuu

SEQ ID NO: 342155 - RNA, 22 nt, Homo sapiens
ucuuuguuggaguccaaggaua

SEQ ID NO: 342156 - RNA, 22 nt, Homo sapiens
ugaaaagucuaagauuaagguu

SEQ ID NO: 342157 - RNA, 22 nt, Homo sapiens
ugaaagacugaaagcuuuucuu

SEQ ID NO: 342158 - RNA, 22 nt, Homo sapiens
ugaaaguuauauugugaaauuc

SEQ ID NO: 342159 - RNA, 22 nt, Homo sapiens
ugaaauacuuuggcucuuuguu

SEQ ID NO: 342160 - RNA, 22 nt, Homo sapiens
ugaaaugaucaguuugguuacu

SEQ ID NO: 342161 - RNA, 22 nt, Homo sapiens
ugaaauuguuugcaaggauagg

SEQ ID NO: 342162 - RNA, 22 nt, Homo sapiens
ugaacacagccugccucugcca

SEQ ID NO: 342163 - RNA, 21 nt, Homo sapiens
ugaacacuggacugagugucc

SEQ ID NO: 342164 - RNA, 22 nt, Homo sapiens
ugaagacucaauuauuaugaac

SEQ ID NO: 342165 - RNA, 22 nt, Homo sapiens
ugaagggcauuguuuugccaaa

SEQ ID NO: 342166 - RNA, 21 nt, Homo sapiens
ugaaguagcauaggaugucaa

SEQ ID NO: 342167 - RNA, 22 nt, Homo sapiens
ugaagugaagacucacagaagg

SEQ ID NO: 342168 - RNA, 22 nt, Homo sapiens
ugaagugaaugguaaguaugcc

SEQ ID NO: 342169 - RNA, 22 nt, Homo sapiens
ugaauagugucacaauaaacau

SEQ ID NO: 342170 - RNA, 22 nt, Homo sapiens
ugaauaguuugacagaacucuu

SEQ ID NO: 342171 - RNA, 22 nt, Homo sapiens
ugaauauuugcuacucacucuu

SEQ ID NO: 342172 - RNA, 22 nt, Homo sapiens
ugaaugcaucuagaaauuuauu

SEQ ID NO: 342173 - RNA, 22 nt, Homo sapiens
ugaaugguaauuuaguaggcac

SEQ ID NO: 342174 - RNA, 22 nt, Homo sapiens
ugaauguccugacgcugcaguu

SEQ ID NO: 342175 - RNA, 22 nt, Homo sapiens
ugaauguuguugguugagauau

SEQ ID NO: 342176 - RNA, 22 nt, Homo sapiens
ugaauucaucucacagaguuaa

SEQ ID NO: 342177 - RNA, 22 nt, Homo sapiens
ugacaagaacuuuccauaguaa

SEQ ID NO: 342178 - RNA, 22 nt, Homo sapiens
ugacacagcaagauggaaccau

SEQ ID NO: 342179 - RNA, 21 nt, Homo sapiens
ugacagaaaauugaguuugcu

SEQ ID NO: 342180 - RNA, 18 nt, Homo sapiens
ugacaguuucuuuauauu

SEQ ID NO: 342181 - RNA, 22 nt, Homo sapiens
ugacauggagguggaggaagau

SEQ ID NO: 342182 - RNA, 21 nt, Homo sapiens
ugacauuauuucaugucagua

SEQ ID NO: 342183 - RNA, 22 nt, Homo sapiens
ugacauugggagugaagugaag

SEQ ID NO: 342184 - RNA, 22 nt, Homo sapiens
ugaccucugauagcaguaggug

SEQ ID NO: 342185 - RNA, 22 nt, Homo sapiens
ugacuacauaaguaaucucaaa

SEQ ID NO: 342186 - RNA, 22 nt, Homo sapiens
ugacuagagggcuuuuguguag

SEQ ID NO: 342187 - RNA, 21 nt, Homo sapiens
ugacuagauuccagauuggcc

SEQ ID NO: 342188 - RNA, 22 nt, Homo sapiens
ugacucaguuguuagucuucau

SEQ ID NO: 342189 - RNA, 22 nt, Homo sapiens
ugacuuaugcaacucugaugug

SEQ ID NO: 342190 - RNA, 22 nt, Homo sapiens
ugacuucagacugaaaugauuc

SEQ ID NO: 342191 - RNA, 22 nt, Homo sapiens
ugacuuuagaauuuuauccaga

SEQ ID NO: 342192 - RNA, 22 nt, Homo sapiens
uggaagaugggaccucaguuuu

SEQ ID NO: 342193 - RNA, 22 nt, Homo sapiens
uggaagauucuagaagauucca

SEQ ID NO: 342194 - RNA, 22 nt, Homo sapiens
uggaagcauagcagcgugugug

SEQ ID NO: 342195 - RNA, 22 nt, Homo sapiens
uggaaguauagauaauugaaag

SEQ ID NO: 342196 - RNA, 22 nt, Homo sapiens
uggaagugucugugcccagcuc

SEQ ID NO: 342197 - RNA, 22 nt, Homo sapiens
uggaaguuaaaugacucuuucu

SEQ ID NO: 342198 - RNA, 22 nt, Homo sapiens
uggaaguuaaauuaguugauga

SEQ ID NO: 342199 - RNA, 22 nt, Homo sapiens
uggaaucuacuaaagcaaaauc

SEQ ID NO: 342200 - RNA, 22 nt, Homo sapiens
uggaaucuagagaaaugcaaac

SEQ ID NO: 342201 - RNA, 21 nt, Homo sapiens
uggaaugaauggccaacaugg

SEQ ID NO: 342202 - RNA, 22 nt, Homo sapiens
uggaauggagagagggugcacg

SEQ ID NO: 342203 - RNA, 22 nt, Homo sapiens
uggaaugguaucuuguuggggu

SEQ ID NO: 342204 - RNA, 22 nt, Homo sapiens
uggaaugucuuuuccccaaagc

SEQ ID NO: 342205 - RNA, 22 nt, Homo sapiens
uggaauuaauccuccugguuuc

SEQ ID NO: 342206 - RNA, 22 nt, Homo sapiens
uggacagacaagguuauagauc

SEQ ID NO: 342207 - RNA, 22 nt, Homo sapiens
uccugagagcagacccucuaua

SEQ ID NO: 342208 - RNA, 22 nt, Homo sapiens
uccugcauucauccugguguug

SEQ ID NO: 342209 - RNA, 22 nt, Homo sapiens
uccuucacucuacaucuuuguu

SEQ ID NO: 342210 - RNA, 22 nt, Homo sapiens
uccuucaguccaguggguuuug

SEQ ID NO: 342211 - RNA, 22 nt, Homo sapiens
uccuuggucaaaaagaaagugu

SEQ ID NO: 342212 - RNA, 21 nt, Homo sapiens
uccuuggugaugcccugcagu

SEQ ID NO: 342213 - RNA, 22 nt, Homo sapiens
uccuugguugauccugugcaga

SEQ ID NO: 342214 - RNA, 22 nt, Homo sapiens
ucgcaccauugcacuccagcca

SEQ ID NO: 342215 - RNA, 22 nt, Homo sapiens
ucgcauuucccucuguagcuuc

SEQ ID NO: 342216 - RNA, 23 nt, Homo sapiens
ucgguccccuuggcugcccucgg

SEQ ID NO: 342217 - RNA, 22 nt, Homo sapiens
ucgugcaaacguaauugugguu

SEQ ID NO: 342218 - RNA, 22 nt, Homo sapiens
ucuaauguaaccugcaaauauu

SEQ ID NO: 342219 - RNA, 22 nt, Homo sapiens
ucuacagccaguucaggaagaa

SEQ ID NO: 342220 - RNA, 22 nt, Homo sapiens
ucuauggauaaaaugcccucau

SEQ ID NO: 342221 - RNA, 22 nt, Homo sapiens
ucuauugguaggggcugaggca

SEQ ID NO: 342222 - RNA, 22 nt, Homo sapiens
ucucaaguaacugggacaauaa

SEQ ID NO: 342223 - RNA, 22 nt, Homo sapiens
ucucagcacaaacaaaauugcu

SEQ ID NO: 342224 - RNA, 22 nt, Homo sapiens
ucucagcacagucagggcgccu

SEQ ID NO: 342225 - RNA, 22 nt, Homo sapiens
ucucagugaaauaaauuauuuu

SEQ ID NO: 342226 - RNA, 19 nt, Homo sapiens
ucucaguguuggucaggug

SEQ ID NO: 342227 - RNA, 20 nt, Homo sapiens
ucucauggagggaaagagca

SEQ ID NO: 342228 - RNA, 22 nt, Homo sapiens
ucucuguuugucuguuacuggu

SEQ ID NO: 342229 - RNA, 22 nt, Homo sapiens
ucugacacagugauuaguaaau

SEQ ID NO: 342230 - RNA, 22 nt, Homo sapiens
ucugacucuggagucucagguu

SEQ ID NO: 342231 - RNA, 22 nt, Homo sapiens
ucugagacuguuucuaacaagc

SEQ ID NO: 342232 - RNA, 22 nt, Homo sapiens
ucuggcuuuuaacaucuauaaa

SEQ ID NO: 342233 - RNA, 22 nt, Homo sapiens
ucugguguuacugagccuccca

SEQ ID NO: 342234 - RNA, 22 nt, Homo sapiens
ucugucacugaaucccugucac

SEQ ID NO: 342235 - RNA, 22 nt, Homo sapiens
ucugucuuugccuaaguuuguc

SEQ ID NO: 342236 - RNA, 22 nt, Homo sapiens
ucuguggucagaguccuuggcc

SEQ ID NO: 342237 - RNA, 22 nt, Homo sapiens
ucuguggugggcuccacccagu

SEQ ID NO: 342238 - RNA, 22 nt, Homo sapiens
ucuguguugaucacacugggag

SEQ ID NO: 342239 - RNA, 22 nt, Homo sapiens
ucuguugguucuuugaggagga

SEQ ID NO: 342240 - RNA, 22 nt, Homo sapiens
ucuugcuuguuguucccuucau

SEQ ID NO: 342241 - RNA, 22 nt, Homo sapiens
ucuuuaguaauuucuguaaggc

SEQ ID NO: 342242 - RNA, 22 nt, Homo sapiens
ucuuucacuuagcaugauguuu

SEQ ID NO: 342243 - RNA, 22 nt, Homo sapiens
ucuuugguaggaguaggaggcc

SEQ ID NO: 342244 - RNA, 22 nt, Homo sapiens
ucuuuggugaauggucauccag

SEQ ID NO: 342245 - RNA, 22 nt, Homo sapiens
ucuuugguucuguuuauguaau

SEQ ID NO: 342246 - RNA, 22 nt, Homo sapiens
ucuuuguugcauaggcuuguuc

SEQ ID NO: 342247 - RNA, 22 nt, Homo sapiens
ugaaauacuuaauuucuccaug

SEQ ID NO: 342248 - RNA, 22 nt, Homo sapiens
ugaaauaguuaaguugccuagu

SEQ ID NO: 342249 - RNA, 22 nt, Homo sapiens
ugaaaucuaaaauguuccaaga

SEQ ID NO: 342250 - RNA, 22 nt, Homo sapiens
ugaaaugauuauaugguguuug

SEQ ID NO: 342251 - RNA, 22 nt, Homo sapiens
ugaaaugcagaacuuuaggucu

SEQ ID NO: 342252 - RNA, 22 nt, Homo sapiens
ugaaaugucuuuaggaggcuuc

SEQ ID NO: 342253 - RNA, 22 nt, Homo sapiens
ugaaauguuaaacaaguggcuc

SEQ ID NO: 342254 - RNA, 22 nt, Homo sapiens
ugaaauguugggugauggaauc

SEQ ID NO: 342255 - RNA, 22 nt, Homo sapiens
ugaaauuuuuuauucguuggcu

SEQ ID NO: 342256 - RNA, 22 nt, Homo sapiens
ugaagaucuuaggagcugaggg

SEQ ID NO: 342257 - RNA, 20 nt, Homo sapiens
ugaaggaggucauuuauacc

SEQ ID NO: 342258 - RNA, 22 nt, Homo sapiens
ugaaguaauguuuuauucuauu

SEQ ID NO: 342259 - RNA, 22 nt, Homo sapiens
ugaauagaaguggcaggaguag

SEQ ID NO: 342260 - RNA, 22 nt, Homo sapiens
ugaauagagcugcaguggacau

SEQ ID NO: 342261 - RNA, 22 nt, Homo sapiens
ugaauauguuaaauaauguucu

SEQ ID NO: 342262 - RNA, 22 nt, Homo sapiens
ugaauguccauugauguuuuga

SEQ ID NO: 342263 - RNA, 22 nt, Homo sapiens
ugacaagggaaaugcaaaaugu

SEQ ID NO: 342264 - RNA, 22 nt, Homo sapiens
ugacacagugggggauccuuuu

SEQ ID NO: 342265 - RNA, 17 nt, Homo sapiens
ugacagaaacuuguugu

SEQ ID NO: 342266 - RNA, 22 nt, Homo sapiens
ugacagagcaggacuucaucuc

SEQ ID NO: 342267 - RNA, 22 nt, Homo sapiens
ugacagcuguugaggcauuuau

SEQ ID NO: 342268 - RNA, 22 nt, Homo sapiens
ugacaucaccaccuccgucauc

SEQ ID NO: 342269 - RNA, 18 nt, Homo sapiens
ugacaucauuuagaaagg

SEQ ID NO: 342270 - RNA, 22 nt, Homo sapiens
ugacucaagagccugacucauc

SEQ ID NO: 342271 - RNA, 20 nt, Homo sapiens
ugacuuguccgagguccccc

SEQ ID NO: 342272 - RNA, 21 nt, Homo sapiens
ugagaacaacaggucaagcag

SEQ ID NO: 342273 - RNA, 22 nt, Homo sapiens
ugagaacaugugauauuuggug

SEQ ID NO: 342274 - RNA, 20 nt, Homo sapiens
ugagaacauguggcauuugg

SEQ ID NO: 342275 - RNA, 19 nt, Homo sapiens
ugagaacaugugguauuug

SEQ ID NO: 342276 - RNA, 22 nt, Homo sapiens
ucaaaugcuguauuguaguaau

SEQ ID NO: 342277 - RNA, 22 nt, Homo sapiens
ucaacagugggcacuguaaaug

SEQ ID NO: 342278 - RNA, 22 nt, Homo sapiens
ucaacguauuuauauagcagag

SEQ ID NO: 342279 - RNA, 22 nt, Homo sapiens
ucaagaccucacauagaggaga

SEQ ID NO: 342280 - RNA, 20 nt, Homo sapiens
ucaaggcacgaauaaaaguu

SEQ ID NO: 342281 - RNA, 22 nt, Homo sapiens
ucaaggcaguggccuuccuucu

SEQ ID NO: 342282 - RNA, 23 nt, Homo sapiens
ucaagugaugguggccacaaggg

SEQ ID NO: 342283 - RNA, 18 nt, Homo sapiens
ucaauguggauguucuuu

SEQ ID NO: 342284 - RNA, 19 nt, Homo sapiens
ucaauucugucaauggcuu

SEQ ID NO: 342285 - RNA, 22 nt, Homo sapiens
ucacaagcuccugccuuugcuu

SEQ ID NO: 342286 - RNA, 22 nt, Homo sapiens
ucacacugaauuugaagcaaug

SEQ ID NO: 342287 - RNA, 19 nt, Homo sapiens
ucacacuguggcuucuuua

SEQ ID NO: 342288 - RNA, 22 nt, Homo sapiens
ucacagaggagaagaccuuuaa

SEQ ID NO: 342289 - RNA, 22 nt, Homo sapiens
ucacagaugcuugacccauuuc

SEQ ID NO: 342290 - RNA, 22 nt, Homo sapiens
ucacaggguguuauuagaauua

SEQ ID NO: 342291 - RNA, 22 nt, Homo sapiens
ucacaguaaauccagaagaaau

SEQ ID NO: 342292 - RNA, 20 nt, Homo sapiens
ucacagucacacauaauccu

SEQ ID NO: 342293 - RNA, 22 nt, Homo sapiens
ucacaguccuguuuaggagagg

SEQ ID NO: 342294 - RNA, 22 nt, Homo sapiens
ucacagucuccucuagggaggg

SEQ ID NO: 342295 - RNA, 22 nt, Homo sapiens
ucacagucugcgugaugagaca

SEQ ID NO: 342296 - RNA, 22 nt, Homo sapiens
ucacaguugauugaaacacagc

SEQ ID NO: 342297 - RNA, 20 nt, Homo sapiens
ucacauccucucccaacaug

SEQ ID NO: 342298 - RNA, 22 nt, Homo sapiens
ucacaugcacaucucuggaacc

SEQ ID NO: 342299 - RNA, 22 nt, Homo sapiens
ucaccaccuuccaggaccacug

SEQ ID NO: 342300 - RNA, 22 nt, Homo sapiens
ucaccuggggcacagcugaaga

SEQ ID NO: 342301 - RNA, 19 nt, Homo sapiens
ucacgugcagcagccacac

SEQ ID NO: 342302 - RNA, 22 nt, Homo sapiens
ucacgugcucuuguguguucug

SEQ ID NO: 342303 - RNA, 23 nt, Homo sapiens
ucacuagaguccuggaguuugag

SEQ ID NO: 342304 - RNA, 22 nt, Homo sapiens
ucacugaaaccuccgccuucug

SEQ ID NO: 342305 - RNA, 22 nt, Homo sapiens
ucacugagcacaggagaugugc

SEQ ID NO: 342306 - RNA, 22 nt, Homo sapiens
ucacugagcuagaucacuugac

SEQ ID NO: 342307 - RNA, 22 nt, Homo sapiens
ucacuggacucuagccugggug

SEQ ID NO: 342308 - RNA, 22 nt, Homo sapiens
ucacuggucuaaguggaggggg

SEQ ID NO: 342309 - RNA, 22 nt, Homo sapiens
ucacugugguuugggaaagugc

SEQ ID NO: 342310 - RNA, 22 nt, Homo sapiens
ucacuguguauguauaugcagg

SEQ ID NO: 342311 - RNA, 22 nt, Homo sapiens
ucacugugugucucuguaucug

SEQ ID NO: 342312 - RNA, 18 nt, Homo sapiens
ucacugugugucuugggu

SEQ ID NO: 342313 - RNA, 21 nt, Homo sapiens
ucagaagcucccagggaggac

SEQ ID NO: 342314 - RNA, 22 nt, Homo sapiens
ucagacacugcccuccaccugu

SEQ ID NO: 342315 - RNA, 22 nt, Homo sapiens
ucagagcaaagacacuuuauca

SEQ ID NO: 342316 - RNA, 22 nt, Homo sapiens
ucagagugcagggaguagcagc

SEQ ID NO: 342317 - RNA, 19 nt, Homo sapiens
ucagaucagcccaagggau

SEQ ID NO: 342318 - RNA, 22 nt, Homo sapiens
ucagaugauuccguugacgaga

SEQ ID NO: 342319 - RNA, 22 nt, Homo sapiens
ucagauguuuuguuuaucugcu

SEQ ID NO: 342320 - RNA, 22 nt, Homo sapiens
ucagcagugugaaaacaaacua

SEQ ID NO: 342321 - RNA, 22 nt, Homo sapiens
ucaggcacucagcuuagagucu

SEQ ID NO: 342322 - RNA, 22 nt, Homo sapiens
ucaggcaugcagcaaugcagug

SEQ ID NO: 342323 - RNA, 21 nt, Homo sapiens
ucaggcuuuuugagugccaau

SEQ ID NO: 342324 - RNA, 22 nt, Homo sapiens
ucagggacgcuugacacaagcc

SEQ ID NO: 342325 - RNA, 22 nt, Homo sapiens
ucagggacuuacaaaccagaag

SEQ ID NO: 342326 - RNA, 22 nt, Homo sapiens
ucaggguacuuguggccaaagu

SEQ ID NO: 342327 - RNA, 22 nt, Homo sapiens
ucagguaucucuauagcaaugu

SEQ ID NO: 342328 - RNA, 22 nt, Homo sapiens
ucagguccuuacugugcucccu

SEQ ID NO: 342329 - RNA, 22 nt, Homo sapiens
ucagguugcuaaguauaauauu

SEQ ID NO: 342330 - RNA, 23 nt, Homo sapiens
ucaguacuccacuuucaauagug

SEQ ID NO: 342331 - RNA, 22 nt, Homo sapiens
ucaguccccucgcugagucuac

SEQ ID NO: 342332 - RNA, 22 nt, Homo sapiens
ucagugacuggguauuaaauca

SEQ ID NO: 342333 - RNA, 22 nt, Homo sapiens
ucagugcaggaaucucuagcca

SEQ ID NO: 342334 - RNA, 22 nt, Homo sapiens
ucagugcuguaccaucuaagga

SEQ ID NO: 342335 - RNA, 22 nt, Homo sapiens
ucauacaguaguccucacuugu

SEQ ID NO: 342336 - RNA, 22 nt, Homo sapiens
ucauacuguugugaaacaaaac

SEQ ID NO: 342337 - RNA, 22 nt, Homo sapiens
ucauaguagucacuuaauaaau

SEQ ID NO: 342338 - RNA, 22 nt, Homo sapiens
ucauauugguuaaaauaguggg

SEQ ID NO: 342339 - RNA, 22 nt, Homo sapiens
ucaucaggaaacuuaugcagug

SEQ ID NO: 342340 - RNA, 22 nt, Homo sapiens
ucaucagguaugucagcggagu

SEQ ID NO: 342341 - RNA, 21 nt, Homo sapiens
ucaucagucaaagacaauggu

SEQ ID NO: 342342 - RNA, 20 nt, Homo sapiens
ucaucaguuggugcucgcug

SEQ ID NO: 342343 - RNA, 22 nt, Homo sapiens
ucauggcauuguuaaggguuuu

SEQ ID NO: 342344 - RNA, 22 nt, Homo sapiens
ucauggggugagcuacaggcac

SEQ ID NO: 342345 - RNA, 22 nt, Homo sapiens
ucauggggugcuuugcuagauu

SEQ ID NO: 342346 - RNA, 22 nt, Homo sapiens
ucauggguuuugguccaagcaa

SEQ ID NO: 342347 - RNA, 23 nt, Homo sapiens
ucauguauucccuguaaugggua

SEQ ID NO: 342348 - RNA, 22 nt, Homo sapiens
ucauguguugcacugaggaccu

SEQ ID NO: 342349 - RNA, 22 nt, Homo sapiens
ucauugcauguuaauuaaacag

SEQ ID NO: 342350 - RNA, 22 nt, Homo sapiens
ucauuggauggaaugcucugua

SEQ ID NO: 342351 - RNA, 19 nt, Homo sapiens
uccaugagcccacagugau

SEQ ID NO: 342352 - RNA, 22 nt, Homo sapiens
uccauugucuagauguaacaca

SEQ ID NO: 342353 - RNA, 22 nt, Homo sapiens
uccauuuguagguagugagaca

SEQ ID NO: 342354 - RNA, 22 nt, Homo sapiens
uccauuugucuauguuucuguu

SEQ ID NO: 342355 - RNA, 19 nt, Homo sapiens
ucccaagaugcucauacau

SEQ ID NO: 342356 - RNA, 23 nt, Homo sapiens
ucccaagauggaccagaccaagg

SEQ ID NO: 342357 - RNA, 17 nt, Homo sapiens
ucccauguuucuucuac

SEQ ID NO: 342358 - RNA, 22 nt, Homo sapiens
ucccugaaagcugagauuggaa

SEQ ID NO: 342359 - RNA, 22 nt, Homo sapiens
ucccugacagggucugagcuuu

SEQ ID NO: 342360 - RNA, 22 nt, Homo sapiens
ucccugacagucacagagcuac

SEQ ID NO: 342361 - RNA, 18 nt, Homo sapiens
ucccuuuguagaugaccc

SEQ ID NO: 342362 - RNA, 22 nt, Homo sapiens
ucccuuuguccaacggauccac

SEQ ID NO: 342363 - RNA, 18 nt, Homo sapiens
aaaaagugcucaggccua

SEQ ID NO: 342364 - RNA, 22 nt, Homo sapiens
aaaagugguguuguuucuaaau

SEQ ID NO: 342365 - RNA, 22 nt, Homo sapiens
aaaaguucuuugagccuugaca

SEQ ID NO: 342366 - RNA, 22 nt, Homo sapiens
aaaaugcugauauugggcccca

SEQ ID NO: 342367 - RNA, 22 nt, Homo sapiens
aaaccacagugugcugcugggg

SEQ ID NO: 342368 - RNA, 22 nt, Homo sapiens
aaagaagucagccuguccuuug

SEQ ID NO: 342369 - RNA, 22 nt, Homo sapiens
aaagaguucagguagauuucaa

SEQ ID NO: 342370 - RNA, 22 nt, Homo sapiens
aaagcuaagguagcauuggaga

SEQ ID NO: 342371 - RNA, 22 nt, Homo sapiens
aaagcugucaaggcaggaggcu

SEQ ID NO: 342372 - RNA, 19 nt, Homo sapiens
aaagguaguaaccucugau

SEQ ID NO: 342373 - RNA, 22 nt, Homo sapiens
aaagucacuggagaaggaauau

SEQ ID NO: 342374 - RNA, 22 nt, Homo sapiens
aaaguggugggauuccaggcau

SEQ ID NO: 342375 - RNA, 22 nt, Homo sapiens
aaagugguuuuucagacuuuga

SEQ ID NO: 342376 - RNA, 22 nt, Homo sapiens
aaaugcacaaagauuuugcacu

SEQ ID NO: 342377 - RNA, 22 nt, Homo sapiens
aaaugcaguugguggggauaug

SEQ ID NO: 342378 - RNA, 22 nt, Homo sapiens
aaaugcauaucaagauugcccu

SEQ ID NO: 342379 - RNA, 22 nt, Homo sapiens
aaaugcugcuuuggccucuucu

SEQ ID NO: 342380 - RNA, 22 nt, Homo sapiens
aaaugcuguuccaggaccuauc

SEQ ID NO: 342381 - RNA, 22 nt, Homo sapiens
aaauggcacaguaagggcauuu

SEQ ID NO: 342382 - RNA, 22 nt, Homo sapiens
aaaugucauggaguguuucccc

SEQ ID NO: 342383 - RNA, 22 nt, Homo sapiens
aaauucauuucagcucugggua

SEQ ID NO: 342384 - RNA, 22 nt, Homo sapiens
aacaccaucccuuugaugcuuu

SEQ ID NO: 342385 - RNA, 22 nt, Homo sapiens
aacagaccuagauaguauaguc

SEQ ID NO: 342386 - RNA, 22 nt, Homo sapiens
aacagagcuggugacuccaggu

SEQ ID NO: 342387 - RNA, 20 nt, Homo sapiens
aacagcacugucugaagcuu

SEQ ID NO: 342388 - RNA, 22 nt, Homo sapiens
aacuggugauccacccgccuca

SEQ ID NO: 342389 - RNA, 19 nt, Homo sapiens
aacuggugugagaugguau

SEQ ID NO: 342390 - RNA, 22 nt, Homo sapiens
aagagaugaagguccugacugu

SEQ ID NO: 342391 - RNA, 22 nt, Homo sapiens
aagagcauuauuuaguaauuuc

SEQ ID NO: 342392 - RNA, 18 nt, Homo sapiens
aagagcucagcacagguu

SEQ ID NO: 342393 - RNA, 22 nt, Homo sapiens
aagauagcuaagcuucuucuaa

SEQ ID NO: 342394 - RNA, 21 nt, Homo sapiens
aagcacauugaguguguguga

SEQ ID NO: 342395 - RNA, 22 nt, Homo sapiens
aagccacuguaccugucucuua

SEQ ID NO: 342396 - RNA, 22 nt, Homo sapiens
aagcucauugagaucuauggcu

SEQ ID NO: 342397 - RNA, 22 nt, Homo sapiens
aagcuccauuucugccaugaga

SEQ ID NO: 342398 - RNA, 22 nt, Homo sapiens
aagcuggagugcaguggugcga

SEQ ID NO: 342399 - RNA, 22 nt, Homo sapiens
aagcuggauuuaguguggagca

SEQ ID NO: 342400 - RNA, 22 nt, Homo sapiens
aagcuguguguaagcucucaca

SEQ ID NO: 342401 - RNA, 23 nt, Homo sapiens
aaggacacugaacacuucccagc

SEQ ID NO: 342402 - RNA, 22 nt, Homo sapiens
aaggaguagaauagaugcaccu

SEQ ID NO: 342403 - RNA, 22 nt, Homo sapiens
aaggcaagguggauaaugaagc

SEQ ID NO: 342404 - RNA, 22 nt, Homo sapiens
aaggcaguggcagaagauguca

SEQ ID NO: 342405 - RNA, 22 nt, Homo sapiens
aagggaauguuguggcugguug

SEQ ID NO: 342406 - RNA, 22 nt, Homo sapiens
aagggaauguuguggcugguuu

SEQ ID NO: 342407 - RNA, 22 nt, Homo sapiens
aagguauuuuugucuauaucuu

SEQ ID NO: 342408 - RNA, 22 nt, Homo sapiens
aagguuguauuuaauauacugu

SEQ ID NO: 342409 - RNA, 22 nt, Homo sapiens
aagucaugaagaggaaaggaca

SEQ ID NO: 342410 - RNA, 22 nt, Homo sapiens
aagucauggagaagguggaggu

SEQ ID NO: 342411 - RNA, 19 nt, Homo sapiens
aagugaaugcuuuguucac

SEQ ID NO: 342412 - RNA, 22 nt, Homo sapiens
aagugccauguggaugggcccu

SEQ ID NO: 342413 - RNA, 22 nt, Homo sapiens
aagugcccuauuuggcccuuga

SEQ ID NO: 342414 - RNA, 22 nt, Homo sapiens
aaguuaauguuuaagacuccua

SEQ ID NO: 342415 - RNA, 22 nt, Homo sapiens
aauaaagucugaagugugcuua

SEQ ID NO: 342416 - RNA, 20 nt, Homo sapiens
aauaacagccccagggaggu

SEQ ID NO: 342417 - RNA, 19 nt, Homo sapiens
aauaaugccagaugucugu

SEQ ID NO: 342418 - RNA, 22 nt, Homo sapiens
aauauagcuauguacaugucca

SEQ ID NO: 342419 - RNA, 22 nt, Homo sapiens
aauaucacaguggguguacacc

SEQ ID NO: 342420 - RNA, 22 nt, Homo sapiens
aaucaacauuguuuuaagucaa

SEQ ID NO: 342421 - RNA, 22 nt, Homo sapiens
aaucacaguguucuugugaggg

SEQ ID NO: 342422 - RNA, 22 nt, Homo sapiens
aaucacauugaaucugcuaccu

SEQ ID NO: 342423 - RNA, 22 nt, Homo sapiens
aaucagcacacugugcuuucca

SEQ ID NO: 342424 - RNA, 22 nt, Homo sapiens
aaucccuggacuuucggaggcu

SEQ ID NO: 342425 - RNA, 22 nt, Homo sapiens
aaugaaguuagauguugagaag

SEQ ID NO: 342426 - RNA, 22 nt, Homo sapiens
aaugacuaagaugguacauuuu

SEQ ID NO: 342427 - RNA, 22 nt, Homo sapiens
aaugaucaauguuugaggugau

SEQ ID NO: 342428 - RNA, 22 nt, Homo sapiens
aaugcacuccagccugggcgac

SEQ ID NO: 342429 - RNA, 22 nt, Homo sapiens
aauggcacuuuauaaauguuaa

SEQ ID NO: 342430 - RNA, 22 nt, Homo sapiens
aauggcaucuagaguggugaau

SEQ ID NO: 342431 - RNA, 22 nt, Homo sapiens
aauggcauugguccuuuuggau

SEQ ID NO: 342432 - RNA, 22 nt, Homo sapiens
aaugucacugugguccuccagu

SEQ ID NO: 342433 - RNA, 22 nt, Homo sapiens
aauucuguauuguuuagggacu

SEQ ID NO: 342434 - RNA, 22 nt, Homo sapiens
aauugcauugaauuuguagcuu

SEQ ID NO: 342435 - RNA, 22 nt, Homo sapiens
aauugcuucuguauuuuggaca

SEQ ID NO: 342436 - RNA, 22 nt, Homo sapiens
acaaagcuagggaauccaucuu

SEQ ID NO: 342437 - RNA, 22 nt, Homo sapiens
acaaaguauggaauguuggugu

SEQ ID NO: 342438 - RNA, 22 nt, Homo sapiens
acacaaugguaaguguuugugu

SEQ ID NO: 342439 - RNA, 23 nt, Homo sapiens
acacaguaaacuaaaagcuagcu

SEQ ID NO: 342440 - RNA, 22 nt, Homo sapiens
acacaguaaauauguauugaau

SEQ ID NO: 342441 - RNA, 22 nt, Homo sapiens
acacaguauaugacaaugcuuu

SEQ ID NO: 342442 - RNA, 22 nt, Homo sapiens
acacaguguuuauugugguuag

SEQ ID NO: 342443 - RNA, 22 nt, Homo sapiens
acacuguuuuguggagaaugua

SEQ ID NO: 342444 - RNA, 20 nt, Homo sapiens
acagcauagccuuuuaaagc

SEQ ID NO: 342445 - RNA, 22 nt, Homo sapiens
acaggugaaguauuacacuaag

SEQ ID NO: 342446 - RNA, 22 nt, Homo sapiens
acaguacaugauaaauaaggua

SEQ ID NO: 342447 - RNA, 22 nt, Homo sapiens
acaguagaaaacaauggauuug

SEQ ID NO: 342448 - RNA, 22 nt, Homo sapiens
acagugacagaaagcugauuau

SEQ ID NO: 342449 - RNA, 18 nt, Homo sapiens
acagugcugucacugcuu

SEQ ID NO: 342450 - RNA, 22 nt, Homo sapiens
acagugcuuucaauguucagua

SEQ ID NO: 342451 - RNA, 22 nt, Homo sapiens
acaguguacaauagccuuuuaa

SEQ ID NO: 342452 - RNA, 22 nt, Homo sapiens
acaguguuccuuuguugugacu

SEQ ID NO: 342453 - RNA, 22 nt, Homo sapiens
acaucacuguuugauugauuga

SEQ ID NO: 342454 - RNA, 22 nt, Homo sapiens
acaucaggcuugugaugauuac

SEQ ID NO: 342455 - RNA, 22 nt, Homo sapiens
acaucccuuucccacccuucac

SEQ ID NO: 342456 - RNA, 22 nt, Homo sapiens
acaucuguacaguggguguggu

SEQ ID NO: 342457 - RNA, 22 nt, Homo sapiens
accccauuugcacugagcccuu

SEQ ID NO: 342458 - RNA, 22 nt, Homo sapiens
acccgugcucacugccucugcc

SEQ ID NO: 342459 - RNA, 22 nt, Homo sapiens
acccucagaccaguuucccugg

SEQ ID NO: 342460 - RNA, 22 nt, Homo sapiens
acccugaagccaugaguggaac

SEQ ID NO: 342461 - RNA, 22 nt, Homo sapiens
acccuggagagugcuguaguaa

SEQ ID NO: 342462 - RNA, 22 nt, Homo sapiens
acccuggaggucuacagugcag

SEQ ID NO: 342463 - RNA, 19 nt, Homo sapiens
acccuguccccaccuuuac

SEQ ID NO: 342464 - RNA, 19 nt, Homo sapiens
accuguagaaaguacaaca

SEQ ID NO: 342465 - RNA, 23 nt, Homo sapiens
accuucauucauucagcugaagu

SEQ ID NO: 342466 - RNA, 22 nt, Homo sapiens
accuucauuguugccaugucca

SEQ ID NO: 342467 - RNA, 22 nt, Homo sapiens
acgugcaugcacacacaugcgc

SEQ ID NO: 342468 - RNA, 22 nt, Homo sapiens
acuacaugugaugucaguauau

SEQ ID NO: 342469 - RNA, 22 nt, Homo sapiens
acucagagauuagcacauguuu

SEQ ID NO: 342470 - RNA, 22 nt, Homo sapiens
acuccauuucauuuuagcucuu

SEQ ID NO: 342471 - RNA, 22 nt, Homo sapiens
acugagucauugggugcccaga

SEQ ID NO: 342472 - RNA, 22 nt, Homo sapiens
acugcacuccagcccaggugac

SEQ ID NO: 342473 - RNA, 22 nt, Homo sapiens
acugcacuccagccuaggcgac

SEQ ID NO: 342474 - RNA, 22 nt, Homo sapiens
acugcacuccagccucguggac

SEQ ID NO: 342475 - RNA, 22 nt, Homo sapiens
acugcacuccagccuuagugac

SEQ ID NO: 342476 - RNA, 22 nt, Homo sapiens
acugcacuccagccuucaggac

SEQ ID NO: 342477 - RNA, 22 nt, Homo sapiens
acugcacuccagccuuggagac

SEQ ID NO: 342478 - RNA, 22 nt, Homo sapiens
acugcacuccagcuugggugac

SEQ ID NO: 342479 - RNA, 22 nt, Homo sapiens
acugcacucuagcuugggugac

SEQ ID NO: 342480 - RNA, 22 nt, Homo sapiens
acugcacuucagccuugggaaa

SEQ ID NO: 342481 - RNA, 20 nt, Homo sapiens
acugggcuaccgaaguaagg

SEQ ID NO: 342482 - RNA, 22 nt, Homo sapiens
acuguacuacagccugggugac

SEQ ID NO: 342483 - RNA, 22 nt, Homo sapiens
acuguacuccagccugggugac

SEQ ID NO: 342484 - RNA, 17 nt, Homo sapiens
acuuuuugaggaggcau

SEQ ID NO: 342485 - RNA, 22 nt, Homo sapiens
agaacuguccauucagcaugaa

SEQ ID NO: 342486 - RNA, 22 nt, Homo sapiens
agaagaacauagggugacugaa

SEQ ID NO: 342487 - RNA, 22 nt, Homo sapiens
agaauaauguccccccaaggga

SEQ ID NO: 342488 - RNA, 22 nt, Homo sapiens
agaauacugucuauucauggua

SEQ ID NO: 342489 - RNA, 22 nt, Homo sapiens
agacacugaaauguauugaaga

SEQ ID NO: 342490 - RNA, 22 nt, Homo sapiens
agacaguguguguauauauggu

SEQ ID NO: 342491 - RNA, 22 nt, Homo sapiens
agacccuguauguguuuaguuu

SEQ ID NO: 342492 - RNA, 22 nt, Homo sapiens
agacuagacagaugaacagcac

SEQ ID NO: 342493 - RNA, 22 nt, Homo sapiens
agagaucaauaugaaggaaaug

SEQ ID NO: 342494 - RNA, 22 nt, Homo sapiens
agagauuauccuggcuucucug

SEQ ID NO: 342495 - RNA, 22 nt, Homo sapiens
agagcacuguggguccaaauau

SEQ ID NO: 342496 - RNA, 22 nt, Homo sapiens
agagcuguguuuuaacuuuuua

SEQ ID NO: 342497 - RNA, 22 nt, Homo sapiens
agagguguuaaagucucuuuua

SEQ ID NO: 342498 - RNA, 20 nt, Homo sapiens
agagguuuugauagguucug

SEQ ID NO: 342499 - RNA, 22 nt, Homo sapiens
agagguuuugcacugguucuuu

SEQ ID NO: 342500 - RNA, 22 nt, Homo sapiens
agaguacaggcaaguuagucau

SEQ ID NO: 342501 - RNA, 22 nt, Homo sapiens
agaguacugacguuugcaaauu

SEQ ID NO: 342502 - RNA, 22 nt, Homo sapiens
agagugcuauagauuagauuuc

SEQ ID NO: 342503 - RNA, 22 nt, Homo sapiens
agauauguuuaguuucaaaaug

SEQ ID NO: 342504 - RNA, 22 nt, Homo sapiens
agauauuuguuaggucugucag

SEQ ID NO: 342505 - RNA, 22 nt, Homo sapiens
agaucauaugcaguaaugaacu

SEQ ID NO: 342506 - RNA, 22 nt, Homo sapiens
agaugcauuuuuauuggaauac

SEQ ID NO: 342507 - RNA, 22 nt, Homo sapiens
agauggauuuuguagccccagc

SEQ ID NO: 342508 - RNA, 22 nt, Homo sapiens
agauggguuuucacauguuggc

SEQ ID NO: 342509 - RNA, 22 nt, Homo sapiens
agauggugugcuaggaaaugua

SEQ ID NO: 342510 - RNA, 23 nt, Homo sapiens
agcaaaugcucuagcacuccaac

SEQ ID NO: 342511 - RNA, 22 nt, Homo sapiens
agcacacuggguggcuuaaaca

SEQ ID NO: 342512 - RNA, 22 nt, Homo sapiens
agcacaguuaaaugaggcuucu

SEQ ID NO: 342513 - RNA, 22 nt, Homo sapiens
agcaccaugggcugaguaagug

SEQ ID NO: 342514 - RNA, 20 nt, Homo sapiens
agcagccacagauuccucag

SEQ ID NO: 342515 - RNA, 17 nt, Homo sapiens
agcagcccauaucccca

SEQ ID NO: 342516 - RNA, 22 nt, Homo sapiens
agcagcucaagacuuaaauuug

SEQ ID NO: 342517 - RNA, 22 nt, Homo sapiens
agcaggauuguuacaauaguaa

SEQ ID NO: 342518 - RNA, 22 nt, Homo sapiens
agcagguauucgggucaugggg

SEQ ID NO: 342519 - RNA, 22 nt, Homo sapiens
agcaggucuuaacuugugaggu

SEQ ID NO: 342520 - RNA, 20 nt, Homo sapiens
agcauugguuagaacaguag

SEQ ID NO: 342521 - RNA, 19 nt, Homo sapiens
agccaguuuucccagcacc

SEQ ID NO: 342522 - RNA, 22 nt, Homo sapiens
agcccuuagauggcuccuucca

SEQ ID NO: 342523 - RNA, 22 nt, Homo sapiens
agccuucauucugacaguagga

SEQ ID NO: 342524 - RNA, 22 nt, Homo sapiens
agcgccacugcacuccagccug

SEQ ID NO: 342525 - RNA, 22 nt, Homo sapiens
agcggcuguuccccuggucuau

SEQ ID NO: 342526 - RNA, 21 nt, Homo sapiens
agcuaaauuggaaauuucugu

SEQ ID NO: 342527 - RNA, 22 nt, Homo sapiens
agcuccaucuucagggguucag

SEQ ID NO: 342528 - RNA, 22 nt, Homo sapiens
agcuccuuugcuuuuuccagga

SEQ ID NO: 342529 - RNA, 22 nt, Homo sapiens
agcugcauucguaucauauugu

SEQ ID NO: 342530 - RNA, 22 nt, Homo sapiens
agcugccagucuuguaaggccu

SEQ ID NO: 342531 - RNA, 22 nt, Homo sapiens
agcuggcuguggagaaaccccu

SEQ ID NO: 342532 - RNA, 22 nt, Homo sapiens
agcugguauuuugucgaggacu

SEQ ID NO: 342533 - RNA, 22 nt, Homo sapiens
agcugguuuauuucucacaaca

SEQ ID NO: 342534 - RNA, 22 nt, Homo sapiens
agcuguuguucucagaggcuuu

SEQ ID NO: 342535 - RNA, 22 nt, Homo sapiens
aggaagugugcaauuaauuucu

SEQ ID NO: 342536 - RNA, 22 nt, Homo sapiens
aggaauguuaguacuucuuagu

SEQ ID NO: 342537 - RNA, 22 nt, Homo sapiens
aggacacugagcaugggagguu

SEQ ID NO: 342538 - RNA, 22 nt, Homo sapiens
aggagaucagccucccugcaac

SEQ ID NO: 342539 - RNA, 18 nt, Homo sapiens
aggagcauagugcuauga

SEQ ID NO: 342540 - RNA, 21 nt, Homo sapiens
aggagcauucaugacgagguu

SEQ ID NO: 342541 - RNA, 22 nt, Homo sapiens
aggcaagcaucuugcucccuuc

SEQ ID NO: 342542 - RNA, 22 nt, Homo sapiens
aggcacggugucucaugccugu

SEQ ID NO: 342543 - RNA, 22 nt, Homo sapiens
agguaauagcacaugauaccuu

SEQ ID NO: 342544 - RNA, 22 nt, Homo sapiens
agguagguugagaugggcauca

SEQ ID NO: 342545 - RNA, 22 nt, Homo sapiens
agguauuuucaacuuagaaugg

SEQ ID NO: 342546 - RNA, 22 nt, Homo sapiens
aggugcugagcagagaauccug

SEQ ID NO: 342547 - RNA, 18 nt, Homo sapiens
agguuauuucccaagacu

SEQ ID NO: 342548 - RNA, 22 nt, Homo sapiens
agguuguugcaugcuccuuagg

SEQ ID NO: 342549 - RNA, 22 nt, Homo sapiens
aguacugucagcaggguguuga

SEQ ID NO: 342550 - RNA, 22 nt, Homo sapiens
aguaucacaguggguguauacc

SEQ ID NO: 342551 - RNA, 22 nt, Homo sapiens
aguauguagugcaaucagucag

SEQ ID NO: 342552 - RNA, 22 nt, Homo sapiens
aguauuuguuggaauaccuguu

SEQ ID NO: 342553 - RNA, 22 nt, Homo sapiens
agucaaaugcuuauguauaaag

SEQ ID NO: 342554 - RNA, 22 nt, Homo sapiens
agucacagugaccuugucugac

SEQ ID NO: 342555 - RNA, 22 nt, Homo sapiens
agucagugucuguaaggagaac

SEQ ID NO: 342556 - RNA, 22 nt, Homo sapiens
agucauggcagaaggcaccucu

SEQ ID NO: 342557 - RNA, 22 nt, Homo sapiens
aguccaguguuaugaucaguag

SEQ ID NO: 342558 - RNA, 22 nt, Homo sapiens
agugaaaugucaccuuuuagga

SEQ ID NO: 342559 - RNA, 22 nt, Homo sapiens
agugaacaaagaagugcagaua

SEQ ID NO: 342560 - RNA, 22 nt, Homo sapiens
agugagcuggagaaaagaaacu

SEQ ID NO: 342561 - RNA, 22 nt, Homo sapiens
agugcacugcccgcuuccuguc

SEQ ID NO: 342562 - RNA, 22 nt, Homo sapiens
agugcaguggcacaaucuuggc

SEQ ID NO: 342563 - RNA, 22 nt, Homo sapiens
agugcauugagacuugugaguu

SEQ ID NO: 342564 - RNA, 22 nt, Homo sapiens
agugcauuugcaucucaauaua

SEQ ID NO: 342565 - RNA, 22 nt, Homo sapiens
agugccaaaucgagggcucuga

SEQ ID NO: 342566 - RNA, 22 nt, Homo sapiens
agugccacugcacucuagccug

SEQ ID NO: 342567 - RNA, 22 nt, Homo sapiens
aguggcaaugugauguccugaa

SEQ ID NO: 342568 - RNA, 22 nt, Homo sapiens
agugggccccuagaggugaggu

SEQ ID NO: 342569 - RNA, 22 nt, Homo sapiens
agugguuugaucacagcucacu

SEQ ID NO: 342570 - RNA, 22 nt, Homo sapiens
aguguuuuuaucaugaaagggu

SEQ ID NO: 342571 - RNA, 22 nt, Homo sapiens
auaaaagcaggucuaggucagg

SEQ ID NO: 342572 - RNA, 22 nt, Homo sapiens
auaaagcaagucucuggccuca

SEQ ID NO: 342573 - RNA, 22 nt, Homo sapiens
auaaaguucugcuggcauauau

SEQ ID NO: 342574 - RNA, 22 nt, Homo sapiens
auaaaugcaaugguauuuuuga

SEQ ID NO: 342575 - RNA, 22 nt, Homo sapiens
auaagaucauuugcuaagaggg

SEQ ID NO: 342576 - RNA, 22 nt, Homo sapiens
auaauagcugaucauuuagaag

SEQ ID NO: 342577 - RNA, 22 nt, Homo sapiens
auaauaguguuuagauuuggga

SEQ ID NO: 342578 - RNA, 22 nt, Homo sapiens
auaaugacuuccaguuccacuc

SEQ ID NO: 342579 - RNA, 22 nt, Homo sapiens
auaauguuugauugagcagaua

SEQ ID NO: 342580 - RNA, 18 nt, Homo sapiens
auacaagcagcagagauu

SEQ ID NO: 342581 - RNA, 22 nt, Homo sapiens
auacaaggaaugaagagauuug

SEQ ID NO: 342582 - RNA, 22 nt, Homo sapiens
auacacauuccugggccucacc

SEQ ID NO: 342583 - RNA, 22 nt, Homo sapiens
auacacgugcagaacaugcagg

SEQ ID NO: 342584 - RNA, 22 nt, Homo sapiens
auacacgugccauguugguaug

SEQ ID NO: 342585 - RNA, 22 nt, Homo sapiens
auacagcuaaaauauuaaguua

SEQ ID NO: 342586 - RNA, 22 nt, Homo sapiens
auacaguaaugucuuaggcugu

SEQ ID NO: 342587 - RNA, 22 nt, Homo sapiens
auacaucugccauguuggugug

SEQ ID NO: 342588 - RNA, 22 nt, Homo sapiens
auacaugugccauggugguuug

SEQ ID NO: 342589 - RNA, 22 nt, Homo sapiens
auacaugugccauguugguaug

SEQ ID NO: 342590 - RNA, 22 nt, Homo sapiens
auacuguauaggauuguagccu

SEQ ID NO: 342591 - RNA, 23 nt, Homo sapiens
auagagcuaggaugcagacagau

SEQ ID NO: 342592 - RNA, 21 nt, Homo sapiens
auagcacaucagauuuuauua

SEQ ID NO: 342593 - RNA, 21 nt, Homo sapiens
auagcacuucacuugguuaga

SEQ ID NO: 342594 - RNA, 22 nt, Homo sapiens
auagcagaagaagggacaauuc

SEQ ID NO: 342595 - RNA, 22 nt, Homo sapiens
auagcagugucccacuccuugg

SEQ ID NO: 342596 - RNA, 22 nt, Homo sapiens
auagcagugugagaaugaacua

SEQ ID NO: 342597 - RNA, 22 nt, Homo sapiens
auagcagugugaggacagacua

SEQ ID NO: 342598 - RNA, 22 nt, Homo sapiens
auagcaucauuucuugaaaaga

SEQ ID NO: 342599 - RNA, 22 nt, Homo sapiens
auagccucauucuucagaugag

SEQ ID NO: 342600 - RNA, 22 nt, Homo sapiens
auagucaguagucucauaauga

SEQ ID NO: 342601 - RNA, 22 nt, Homo sapiens
auagugcugcaaaaaacauacg

SEQ ID NO: 342602 - RNA, 22 nt, Homo sapiens
auagugcugcaauaaacauacg

SEQ ID NO: 342603 - RNA, 22 nt, Homo sapiens
auagugcugcaaugaacauaca

SEQ ID NO: 342604 - RNA, 22 nt, Homo sapiens
auagugcugcaauuaacauaca

SEQ ID NO: 342605 - RNA, 22 nt, Homo sapiens
auauaguguuuuuugguacgcu

SEQ ID NO: 342606 - RNA, 22 nt, Homo sapiens
auaucaacaucgugucauuagu

SEQ ID NO: 342607 - RNA, 22 nt, Homo sapiens
auaucaacaugguaggguuggu

SEQ ID NO: 342608 - RNA, 22 nt, Homo sapiens
auaucacaggaaaggaagauac

SEQ ID NO: 342609 - RNA, 22 nt, Homo sapiens
auaucagugucuuacuguuuuu

SEQ ID NO: 342610 - RNA, 22 nt, Homo sapiens
auauccaugccauagguuuuga

SEQ ID NO: 342611 - RNA, 22 nt, Homo sapiens
auaucugcauugccauuuaugu

SEQ ID NO: 342612 - RNA, 22 nt, Homo sapiens
auauggcauucagaacuguaua

SEQ ID NO: 342613 - RNA, 22 nt, Homo sapiens
auaugguacuuaugcucaaacu

SEQ ID NO: 342614 - RNA, 20 nt, Homo sapiens
auaugguugugagugauuuu

SEQ ID NO: 342615 - RNA, 22 nt, Homo sapiens
auaugucuguuuagucuguaau

SEQ ID NO: 342616 - RNA, 22 nt, Homo sapiens
auauguucucauucauaugugg

SEQ ID NO: 342617 - RNA, 22 nt, Homo sapiens
auauuagcacuaaugucacgau

SEQ ID NO: 342618 - RNA, 22 nt, Homo sapiens
auauuagguuggugccaaagua

SEQ ID NO: 342619 - RNA, 22 nt, Homo sapiens
auauucaagugaggauggcuaa

SEQ ID NO: 342620 - RNA, 22 nt, Homo sapiens
auauugacuuucucuuagauca

SEQ ID NO: 342621 - RNA, 22 nt, Homo sapiens
auauuggacugugcuaguuaga

SEQ ID NO: 342622 - RNA, 22 nt, Homo sapiens
aucaaagugaaauauuaguuau

SEQ ID NO: 342623 - RNA, 22 nt, Homo sapiens
aucaagcuugacuccuuaaagg

SEQ ID NO: 342624 - RNA, 22 nt, Homo sapiens
aucacagagucacgggcaacuu

SEQ ID NO: 342625 - RNA, 22 nt, Homo sapiens
aucacagaguuaaaacuuucuu

SEQ ID NO: 342626 - RNA, 22 nt, Homo sapiens
aucacagcccuccucuuggaug

SEQ ID NO: 342627 - RNA, 22 nt, Homo sapiens
aucacagcuacuccucugucuu

SEQ ID NO: 342628 - RNA, 22 nt, Homo sapiens
aucacagguacuauggcugaca

SEQ ID NO: 342629 - RNA, 22 nt, Homo sapiens
aucacaguuaagaggugaugaa

SEQ ID NO: 342630 - RNA, 22 nt, Homo sapiens
aucacauuuauaguggcacgca

SEQ ID NO: 342631 - RNA, 22 nt, Homo sapiens
aucaccuggaguagcccguccc

SEQ ID NO: 342632 - RNA, 22 nt, Homo sapiens
aucacuaugcaggugucucggg

SEQ ID NO: 342633 - RNA, 22 nt, Homo sapiens
aucacugugauuucuacugugc

SEQ ID NO: 342634 - RNA, 23 nt, Homo sapiens
aucacuguuaacaauuucuuccu

SEQ ID NO: 342635 - RNA, 22 nt, Homo sapiens
aucacuuugcucuccagugugg

SEQ ID NO: 342636 - RNA, 21 nt, Homo sapiens
aucagagacccaggcuuccuc

SEQ ID NO: 342637 - RNA, 22 nt, Homo sapiens
aucagagccugugugcccugaa

SEQ ID NO: 342638 - RNA, 22 nt, Homo sapiens
aucagcagcaugaaaacaggcu

SEQ ID NO: 342639 - RNA, 22 nt, Homo sapiens
aucauguaguaagacacauuua

SEQ ID NO: 342640 - RNA, 22 nt, Homo sapiens
aucaugucuucccagugauucu

SEQ ID NO: 342641 - RNA, 22 nt, Homo sapiens
auccacagugucaauguuguga

SEQ ID NO: 342642 - RNA, 22 nt, Homo sapiens
auccauugcucaagagaaguca

SEQ ID NO: 342643 - RNA, 22 nt, Homo sapiens
aucccagaaacucggguuucuc

SEQ ID NO: 342644 - RNA, 22 nt, Homo sapiens
aucccaguaaaaauggcuucua

SEQ ID NO: 342645 - RNA, 22 nt, Homo sapiens
aucccaguucagccucugacac

SEQ ID NO: 342646 - RNA, 22 nt, Homo sapiens
aucccugaggaauuucugcacu

SEQ ID NO: 342647 - RNA, 22 nt, Homo sapiens
auccucaguggcuuaaguauag

SEQ ID NO: 342648 - RNA, 22 nt, Homo sapiens
auccugagacuuugcugaaguu

SEQ ID NO: 342649 - RNA, 22 nt, Homo sapiens
auccugagacuuuucugaaguu

SEQ ID NO: 342650 - RNA, 22 nt, Homo sapiens
auccuuuagacuguccaguuga

SEQ ID NO: 342651 - RNA, 22 nt, Homo sapiens
aucgcgccauuguacuccagcc

SEQ ID NO: 342652 - RNA, 22 nt, Homo sapiens
aucuaaucaucgcaaccuucaa

SEQ ID NO: 342653 - RNA, 22 nt, Homo sapiens
aucucaguuaaugacccuaugc

SEQ ID NO: 342654 - RNA, 19 nt, Homo sapiens
aucuggaguuccuggggcu

SEQ ID NO: 342655 - RNA, 22 nt, Homo sapiens
aucugguguccucgugggaguc

SEQ ID NO: 342656 - RNA, 22 nt, Homo sapiens
aucuuuggugaguucuuugguc

SEQ ID NO: 342657 - RNA, 22 nt, Homo sapiens
augaaaucuuuggcagaucuua

SEQ ID NO: 342658 - RNA, 17 nt, Homo sapiens
augaagucaucauuuuu

SEQ ID NO: 342659 - RNA, 22 nt, Homo sapiens
augaaugucuuauuuugagaaa

SEQ ID NO: 342660 - RNA, 22 nt, Homo sapiens
augacacugcagagauguccca

SEQ ID NO: 342661 - RNA, 22 nt, Homo sapiens
augacagagauaugugaauuuu

SEQ ID NO: 342662 - RNA, 22 nt, Homo sapiens
augacaguaugacuccaaaagu

SEQ ID NO: 342663 - RNA, 22 nt, Homo sapiens
aagauaguaaacauuuucugcu

SEQ ID NO: 342664 - RNA, 22 nt, Homo sapiens
aagaugcagaagcccagauguu

SEQ ID NO: 342665 - RNA, 22 nt, Homo sapiens
aagaugcagucauacuggagga

SEQ ID NO: 342666 - RNA, 22 nt, Homo sapiens
aagcacaauuucaccuucuugu

SEQ ID NO: 342667 - RNA, 22 nt, Homo sapiens
aagcacccagccucacgccugc

SEQ ID NO: 342668 - RNA, 21 nt, Homo sapiens
aagcaugguguaucuuuccau

SEQ ID NO: 342669 - RNA, 20 nt, Homo sapiens
aagcugaguguuuuuuuaau

SEQ ID NO: 342670 - RNA, 22 nt, Homo sapiens
aagcugcauuuucuagaugcuu

SEQ ID NO: 342671 - RNA, 22 nt, Homo sapiens
aagcugccaggcaugguggcug

SEQ ID NO: 342672 - RNA, 22 nt, Homo sapiens
aagcugccuugugaaggcauuc

SEQ ID NO: 342673 - RNA, 22 nt, Homo sapiens
aagcuggagugcaguggugcaa

SEQ ID NO: 342674 - RNA, 22 nt, Homo sapiens
aagcuggauuucgcauccuguu

SEQ ID NO: 342675 - RNA, 22 nt, Homo sapiens
aagcugguuuuauaucugugag

SEQ ID NO: 342676 - RNA, 22 nt, Homo sapiens
aagcuguauuguguugcuauaa

SEQ ID NO: 342677 - RNA, 22 nt, Homo sapiens
aagcuuucaacuguuugccauu

SEQ ID NO: 342678 - RNA, 22 nt, Homo sapiens
aaggaagcuagcaggaauuggu

SEQ ID NO: 342679 - RNA, 22 nt, Homo sapiens
aaggaguagaggaauagcaaug

SEQ ID NO: 342680 - RNA, 22 nt, Homo sapiens
aaggaguguggugaucuugggc

SEQ ID NO: 342681 - RNA, 20 nt, Homo sapiens
aaggcuuucgaguuccaggg

SEQ ID NO: 342682 - RNA, 22 nt, Homo sapiens
aaggcuuuuugcugacguccuu

SEQ ID NO: 342683 - RNA, 22 nt, Homo sapiens
aagggaaugcuuccaguuugug

SEQ ID NO: 342684 - RNA, 23 nt, Homo sapiens
aagguaagcuagaaagauguaga

SEQ ID NO: 342685 - RNA, 18 nt, Homo sapiens
aaggugcuucuguucuga

SEQ ID NO: 342686 - RNA, 21 nt, Homo sapiens
aaggugguggugauugagaug

SEQ ID NO: 342687 - RNA, 22 nt, Homo sapiens
aagguucuugcuugcaugacug

SEQ ID NO: 342688 - RNA, 22 nt, Homo sapiens
aaguagcagaggcaagacuuga

SEQ ID NO: 342689 - RNA, 22 nt, Homo sapiens
aaguauguaucaagucauacuu

SEQ ID NO: 342690 - RNA, 22 nt, Homo sapiens
aagucaguuugggagaagcuau

SEQ ID NO: 342691 - RNA, 22 nt, Homo sapiens
aagucauggaggaguaugugag

SEQ ID NO: 342692 - RNA, 22 nt, Homo sapiens
aagugaaugaugugaaguguaa

SEQ ID NO: 342693 - RNA, 22 nt, Homo sapiens
aagugaguaauacgucaguugu

SEQ ID NO: 342694 - RNA, 20 nt, Homo sapiens
aagugcaucguugugucugc

SEQ ID NO: 342695 - RNA, 22 nt, Homo sapiens
aagugcuguaugggagccuagg

SEQ ID NO: 342696 - RNA, 22 nt, Homo sapiens
auggcaaugcgaugaugacuga

SEQ ID NO: 342697 - RNA, 22 nt, Homo sapiens
auggcacagacucuuggucaag

SEQ ID NO: 342698 - RNA, 22 nt, Homo sapiens
auggcacuacugggaaugucuu

SEQ ID NO: 342699 - RNA, 22 nt, Homo sapiens
auggcacugauggaaguaccuu

SEQ ID NO: 342700 - RNA, 22 nt, Homo sapiens
auggcagcugguuuuacccuag

SEQ ID NO: 342701 - RNA, 22 nt, Homo sapiens
auggcccccuguuugugaacau

SEQ ID NO: 342702 - RNA, 22 nt, Homo sapiens
auggccuuguauaccuggcaaa

SEQ ID NO: 342703 - RNA, 22 nt, Homo sapiens
auggcucuguuccaugugucuu

SEQ ID NO: 342704 - RNA, 22 nt, Homo sapiens
auggcucuuauuauuuugaggu

SEQ ID NO: 342705 - RNA, 22 nt, Homo sapiens
auggcuuucaggacguggcgag

SEQ ID NO: 342706 - RNA, 22 nt, Homo sapiens
auggcuuuguguucagagcuga

SEQ ID NO: 342707 - RNA, 22 nt, Homo sapiens
auggcuuuuccugucuugcaug

SEQ ID NO: 342708 - RNA, 22 nt, Homo sapiens
auggcuuuugaccugguaggau

SEQ ID NO: 342709 - RNA, 22 nt, Homo sapiens
augggcacugauguauucugug

SEQ ID NO: 342710 - RNA, 22 nt, Homo sapiens
auguaaacagaugugcagcuug

SEQ ID NO: 342711 - RNA, 22 nt, Homo sapiens
auguaaacauuuggucuaaauu

SEQ ID NO: 342712 - RNA, 22 nt, Homo sapiens
auguaaacuacagauuuugggu

SEQ ID NO: 342713 - RNA, 22 nt, Homo sapiens
auguagauaucaagaggcauau

SEQ ID NO: 342714 - RNA, 22 nt, Homo sapiens
auguaguagauauuuauggaaa

SEQ ID NO: 342715 - RNA, 22 nt, Homo sapiens
auguauacauagauacgugugu

SEQ ID NO: 342716 - RNA, 22 nt, Homo sapiens
auguauacaugcaggucacagg

SEQ ID NO: 342717 - RNA, 22 nt, Homo sapiens
auguaugagaguuccagcugau

SEQ ID NO: 342718 - RNA, 22 nt, Homo sapiens
augucaacauagacaguagagu

SEQ ID NO: 342719 - RNA, 22 nt, Homo sapiens
augucacagguccuagccaagu

SEQ ID NO: 342720 - RNA, 22 nt, Homo sapiens
augugacuuuuuccugugccuu

SEQ ID NO: 342721 - RNA, 22 nt, Homo sapiens
augugcaacugcuggaacaguc

SEQ ID NO: 342722 - RNA, 22 nt, Homo sapiens
augugcacauucugguaaauau

SEQ ID NO: 342723 - RNA, 22 nt, Homo sapiens
augugcagauguuacaaauugu

SEQ ID NO: 342724 - RNA, 22 nt, Homo sapiens
augugcauaugaagcacagaca

SEQ ID NO: 342725 - RNA, 22 nt, Homo sapiens
augugcuuauagguguauguuu

SEQ ID NO: 342726 - RNA, 22 nt, Homo sapiens
auguggaaagcagcaugauaug

SEQ ID NO: 342727 - RNA, 22 nt, Homo sapiens
augugggaggacuuggcuguug

SEQ ID NO: 342728 - RNA, 22 nt, Homo sapiens
auguggugguagccaggacagg

SEQ ID NO: 342729 - RNA, 19 nt, Homo sapiens
augugguuagcaugacugc

SEQ ID NO: 342730 - RNA, 22 nt, Homo sapiens
augugugcuugauguaaaaagu

SEQ ID NO: 342731 - RNA, 23 nt, Homo sapiens
augugugcuuggagagcaggaug

SEQ ID NO: 342732 - RNA, 22 nt, Homo sapiens
auguuagcaucuggcacuaugg

SEQ ID NO: 342733 - RNA, 20 nt, Homo sapiens
auguucuggaggacagaagc

SEQ ID NO: 342734 - RNA, 22 nt, Homo sapiens
auguugcaguuuaauuauccua

SEQ ID NO: 342735 - RNA, 22 nt, Homo sapiens
auguugcuugaaggcauuuugu

SEQ ID NO: 342736 - RNA, 22 nt, Homo sapiens
auuauauguguaugugcauacc

SEQ ID NO: 342737 - RNA, 22 nt, Homo sapiens
auuauuagucggccagcuguua

SEQ ID NO: 342738 - RNA, 22 nt, Homo sapiens
auucaucagggauacuggccug

SEQ ID NO: 342739 - RNA, 22 nt, Homo sapiens
auucaucagggauauuggucug

SEQ ID NO: 342740 - RNA, 22 nt, Homo sapiens
auuccacuuacaugaaguaccu

SEQ ID NO: 342741 - RNA, 22 nt, Homo sapiens
uucagagagggagggauaccua

SEQ ID NO: 342742 - RNA, 22 nt, Homo sapiens
uucagagugaggcucucggaac

SEQ ID NO: 342743 - RNA, 22 nt, Homo sapiens
uucaggcaccauggucauugau

SEQ ID NO: 342744 - RNA, 22 nt, Homo sapiens
uucaggcuccugugagaaucua

SEQ ID NO: 342745 - RNA, 22 nt, Homo sapiens
uucaguaaauguucuuacuaua

SEQ ID NO: 342746 - RNA, 22 nt, Homo sapiens
uucaguauugcaccuggagucc

SEQ ID NO: 342747 - RNA, 22 nt, Homo sapiens
uucaguccauuuccuuggucac

SEQ ID NO: 342748 - RNA, 22 nt, Homo sapiens
uucaguggguggaugaauauga

SEQ ID NO: 342749 - RNA, 22 nt, Homo sapiens
uucagugguuauuugugagauu

SEQ ID NO: 342750 - RNA, 22 nt, Homo sapiens
uucauagucuaauuuuuuccac

SEQ ID NO: 342751 - RNA, 22 nt, Homo sapiens
uucauagugaaaaauucaaagu

SEQ ID NO: 342752 - RNA, 22 nt, Homo sapiens
uucauaguucuuuuagucauua

SEQ ID NO: 342753 - RNA, 22 nt, Homo sapiens
uucauaguuuauacugauauuu

SEQ ID NO: 342754 - RNA, 23 nt, Homo sapiens
uucaucagggauauuggccugaa

SEQ ID NO: 342755 - RNA, 18 nt, Homo sapiens
uucaucaguccucagcug

SEQ ID NO: 342756 - RNA, 22 nt, Homo sapiens
uucauccccuccaaaucucaug

SEQ ID NO: 342757 - RNA, 22 nt, Homo sapiens
uucauggaacaaguggguucaa

SEQ ID NO: 342758 - RNA, 22 nt, Homo sapiens
uucauggaauauugaccauuuu

SEQ ID NO: 342759 - RNA, 22 nt, Homo sapiens
uucauggaugcauuugaggggu

SEQ ID NO: 342760 - RNA, 23 nt, Homo sapiens
uuccaccauugacuaguuacaua

SEQ ID NO: 342761 - RNA, 22 nt, Homo sapiens
uuccagagucaccuuucugucg

SEQ ID NO: 342762 - RNA, 22 nt, Homo sapiens
uuccaugugggcuugucaagua

SEQ ID NO: 342763 - RNA, 22 nt, Homo sapiens
uuccauuuguucggugucgcca

SEQ ID NO: 342764 - RNA, 22 nt, Homo sapiens
uucccaguuggggaaagcgacc

SEQ ID NO: 342765 - RNA, 22 nt, Homo sapiens
uucccuagaacacauggaggga

SEQ ID NO: 342766 - RNA, 22 nt, Homo sapiens
uucccugaguaucuuaccaugg

SEQ ID NO: 342767 - RNA, 22 nt, Homo sapiens
uucccugugggaguaggaaagu

SEQ ID NO: 342768 - RNA, 22 nt, Homo sapiens
uucccuugcaggaugaucugga

SEQ ID NO: 342769 - RNA, 22 nt, Homo sapiens
uucccuuucugccuugaaucuu

SEQ ID NO: 342770 - RNA, 22 nt, Homo sapiens
uuccuacuguucaucaggaacc

SEQ ID NO: 342771 - RNA, 19 nt, Homo sapiens
uuccugagaacaagggcuu

SEQ ID NO: 342772 - RNA, 22 nt, Homo sapiens
uuccuggaggggaaguguccaa

SEQ ID NO: 342773 - RNA, 22 nt, Homo sapiens
uuccugucuuccaagagagauu

SEQ ID NO: 342774 - RNA, 22 nt, Homo sapiens
uuccuuaguuauuugguccccu

SEQ ID NO: 342775 - RNA, 22 nt, Homo sapiens
uuccuuguagcaaaugcgauga

SEQ ID NO: 342776 - RNA, 22 nt, Homo sapiens
uucuaaacaucuuacaaugcau

SEQ ID NO: 342777 - RNA, 22 nt, Homo sapiens
uucuacagugacugcagccaua

SEQ ID NO: 342778 - RNA, 22 nt, Homo sapiens
uucuacaugggucgucggugag

SEQ ID NO: 342779 - RNA, 22 nt, Homo sapiens
uucucaaggagccuucguaacu

SEQ ID NO: 342780 - RNA, 22 nt, Homo sapiens
uucucaguaauuccagauuuuu

SEQ ID NO: 342781 - RNA, 22 nt, Homo sapiens
uucucagugcuaucuuuuaugc

SEQ ID NO: 342782 - RNA, 17 nt, Homo sapiens
uucucaguucugaucuc

SEQ ID NO: 342783 - RNA, 22 nt, Homo sapiens
uucugagguuauauucucucaa

SEQ ID NO: 342784 - RNA, 22 nt, Homo sapiens
uucugugcuuguggaugaagug

SEQ ID NO: 342785 - RNA, 22 nt, Homo sapiens
uucuguguuuaggucacggcua

SEQ ID NO: 342786 - RNA, 22 nt, Homo sapiens
uucuucaggcauucccagaagc

SEQ ID NO: 342787 - RNA, 22 nt, Homo sapiens
uucuucugguuaugaaauuuga

SEQ ID NO: 342788 - RNA, 22 nt, Homo sapiens
uucuugcacuuaacugacauuc

SEQ ID NO: 342789 - RNA, 22 nt, Homo sapiens
uucuugcugaauugugcccuuc

SEQ ID NO: 342790 - RNA, 22 nt, Homo sapiens
uucuugcuguauccucacaugg

SEQ ID NO: 342791 - RNA, 22 nt, Homo sapiens
uugaaaguaaacaucacaaaga

SEQ ID NO: 342792 - RNA, 22 nt, Homo sapiens
uugaaagucauuucuucuaagu

SEQ ID NO: 342793 - RNA, 22 nt, Homo sapiens
uugaaagucuaggcuuacagua

SEQ ID NO: 342794 - RNA, 22 nt, Homo sapiens
uugaaaguguucacaaugguau

SEQ ID NO: 342795 - RNA, 22 nt, Homo sapiens
uugaacuagaaccugcaaauuu

SEQ ID NO: 342796 - RNA, 19 nt, Homo sapiens
uugaaggccgccuugcaga

SEQ ID NO: 342797 - RNA, 22 nt, Homo sapiens
uugaaguagaaagacgaaauuu

SEQ ID NO: 342798 - RNA, 22 nt, Homo sapiens
uugaauagaagguuuuuuguuc

SEQ ID NO: 342799 - RNA, 18 nt, Homo sapiens
uugaauagagccaagcac

SEQ ID NO: 342800 - RNA, 22 nt, Homo sapiens
uugaauagugacuuugauucug

SEQ ID NO: 342801 - RNA, 22 nt, Homo sapiens
uugaaugaauggaaagaagggu

SEQ ID NO: 342802 - RNA, 18 nt, Homo sapiens
uugaaugcgucccagaga

SEQ ID NO: 342803 - RNA, 22 nt, Homo sapiens
uugaauguaugcuggguuuacu

SEQ ID NO: 342804 - RNA, 22 nt, Homo sapiens
uugacagagaaaagugugacuu

SEQ ID NO: 342805 - RNA, 22 nt, Homo sapiens
uugacaguugggcagggaaguu

SEQ ID NO: 342806 - RNA, 22 nt, Homo sapiens
uugacauugcuguaguguccag

SEQ ID NO: 342807 - RNA, 22 nt, Homo sapiens
uugaccccuucuaauagccuca

SEQ ID NO: 342808 - RNA, 22 nt, Homo sapiens
uugacugggccagacagagauc

SEQ ID NO: 342809 - RNA, 21 nt, Homo sapiens
uugagaagaauuagcucuucc

SEQ ID NO: 342810 - RNA, 21 nt, Homo sapiens
uugagacggagucucacucug

SEQ ID NO: 342811 - RNA, 22 nt, Homo sapiens
uugagagaaaaggccaugccuu

SEQ ID NO: 342812 - RNA, 22 nt, Homo sapiens
uugagauggagucucacgcauu

SEQ ID NO: 342813 - RNA, 22 nt, Homo sapiens
uugagauggagucucgcacugu

SEQ ID NO: 342814 - RNA, 22 nt, Homo sapiens
uugagauggagucucgcucugu

SEQ ID NO: 342815 - RNA, 22 nt, Homo sapiens
uugagauggagucucgcucuuu

SEQ ID NO: 342816 - RNA, 22 nt, Homo sapiens
uugagauggagucuugcacugu

SEQ ID NO: 342817 - RNA, 22 nt, Homo sapiens
uugagauguggcaguuuaugag

SEQ ID NO: 342818 - RNA, 22 nt, Homo sapiens
uugagcacugucugugugcagu

SEQ ID NO: 342819 - RNA, 22 nt, Homo sapiens
uugagcucaucaagauagagaa

SEQ ID NO: 342820 - RNA, 22 nt, Homo sapiens
uugagcucuuccagccuggagc

SEQ ID NO: 342821 - RNA, 22 nt, Homo sapiens
uugagcuuuuuacuuguccaau

SEQ ID NO: 342822 - RNA, 22 nt, Homo sapiens
uugaggaaugugauuucaaaua

SEQ ID NO: 342823 - RNA, 22 nt, Homo sapiens
uugaggacuggaacacaggucu

SEQ ID NO: 342824 - RNA, 23 nt, Homo sapiens
uugaggcauguaccaucaauauc

SEQ ID NO: 342825 - RNA, 22 nt, Homo sapiens
uugagggagcacagauucuuau

SEQ ID NO: 342826 - RNA, 20 nt, Homo sapiens
uugaguauugccagggaggc

SEQ ID NO: 342827 - RNA, 22 nt, Homo sapiens
uugagugaaggcuguguucuug

SEQ ID NO: 342828 - RNA, 18 nt, Homo sapiens
aaacagugucucuuucug

SEQ ID NO: 342829 - RNA, 22 nt, Homo sapiens
aaacuugucuaauuauaagcau

SEQ ID NO: 342830 - RNA, 22 nt, Homo sapiens
aaagagaucuaugggcacuaug

SEQ ID NO: 342831 - RNA, 22 nt, Homo sapiens
aaaggcuucggaucagaaggua

SEQ ID NO: 342832 - RNA, 22 nt, Homo sapiens
aaagucuagaggaucaugugug

SEQ ID NO: 342833 - RNA, 22 nt, Homo sapiens
aaaguucuguugauagugcuga

SEQ ID NO: 342834 - RNA, 22 nt, Homo sapiens
aaaguucuugcugaaggauuau

SEQ ID NO: 342835 - RNA, 15 nt, Homo sapiens
aaauaugucaguucu

SEQ ID NO: 342836 - RNA, 22 nt, Homo sapiens
aaaugcucuguggguaguaaug

SEQ ID NO: 342837 - RNA, 22 nt, Homo sapiens
aaaugcugucugugagccucau

SEQ ID NO: 342838 - RNA, 22 nt, Homo sapiens
aaaugcuuucuuggaccauuug

SEQ ID NO: 342839 - RNA, 22 nt, Homo sapiens
aaauggcuuuuugggcaaggug

SEQ ID NO: 342840 - RNA, 22 nt, Homo sapiens
aaauucaugucaccucuaggua

SEQ ID NO: 342841 - RNA, 22 nt, Homo sapiens
aacagauugcugagccccaccc

SEQ ID NO: 342842 - RNA, 22 nt, Homo sapiens
aacagugcuguuauaaauguac

SEQ ID NO: 342843 - RNA, 20 nt, Homo sapiens
aacaguguguaaguuuccuu

SEQ ID NO: 342844 - RNA, 22 nt, Homo sapiens
aacccugacacaagcagaauuu

SEQ ID NO: 342845 - RNA, 22 nt, Homo sapiens
aaccugaagaaaauauuugcug

SEQ ID NO: 342846 - RNA, 22 nt, Homo sapiens
aaccuguaaccauaugaucagu

SEQ ID NO: 342847 - RNA, 22 nt, Homo sapiens
aacugcacauauuuguaugggu

SEQ ID NO: 342848 - RNA, 19 nt, Homo sapiens
aacuggugugagaugauau

SEQ ID NO: 342849 - RNA, 22 nt, Homo sapiens
aagagagcuaugugcauaauua

SEQ ID NO: 342850 - RNA, 18 nt, Homo sapiens
uccauuuguaugggaugg

SEQ ID NO: 342851 - RNA, 22 nt, Homo sapiens
uccauuuguucagcuucaggaa

SEQ ID NO: 342852 - RNA, 22 nt, Homo sapiens
ucccaagaugagaugggggcug

SEQ ID NO: 342853 - RNA, 22 nt, Homo sapiens
ucccaguggucuugaaacaggg

SEQ ID NO: 342854 - RNA, 22 nt, Homo sapiens
ucccaguguguagcuugucucu

SEQ ID NO: 342855 - RNA, 22 nt, Homo sapiens
ucccauguagcuaggauuacag

SEQ ID NO: 342856 - RNA, 19 nt, Homo sapiens
uccccgggucuagugcagc

SEQ ID NO: 342857 - RNA, 20 nt, Homo sapiens
ucccuaagagccuuuccuuc

SEQ ID NO: 342858 - RNA, 22 nt, Homo sapiens
ucccuacugggguacugccuag

SEQ ID NO: 342859 - RNA, 22 nt, Homo sapiens
ucccuagagaagugauuuuuga

SEQ ID NO: 342860 - RNA, 22 nt, Homo sapiens
ucccugaaaaauuggcuuaaca

SEQ ID NO: 342861 - RNA, 22 nt, Homo sapiens
ucccugaaucucagguucugua

SEQ ID NO: 342862 - RNA, 18 nt, Homo sapiens
ucccugacucaaauucuu

SEQ ID NO: 342863 - RNA, 22 nt, Homo sapiens
ucccugagcaaaguuuucugua

SEQ ID NO: 342864 - RNA, 19 nt, Homo sapiens
ucccugagucuuagcuuga

SEQ ID NO: 342865 - RNA, 19 nt, Homo sapiens
ucccuguagaccacagugc

SEQ ID NO: 342866 - RNA, 22 nt, Homo sapiens
uccuacaugcaguacauucaaa

SEQ ID NO: 342867 - RNA, 22 nt, Homo sapiens
uccugagacugaggagcuuugg

SEQ ID NO: 342868 - RNA, 22 nt, Homo sapiens
uccuguaaucccagcuaccaga

SEQ ID NO: 342869 - RNA, 22 nt, Homo sapiens
uccuugagccucccagacucag

SEQ ID NO: 342870 - RNA, 23 nt, Homo sapiens
uccuugguuggcgcccuaugugu

SEQ ID NO: 342871 - RNA, 22 nt, Homo sapiens
uccuuuggucaguauucuuuug

SEQ ID NO: 342872 - RNA, 22 nt, Homo sapiens
ucguucuugucaguuuauaaag

SEQ ID NO: 342873 - RNA, 19 nt, Homo sapiens
ucuaaaucucuugauagac

SEQ ID NO: 342874 - RNA, 22 nt, Homo sapiens
ucuaugguuuauuuccaagugu

SEQ ID NO: 342875 - RNA, 22 nt, Homo sapiens
ucucacaccccucucauauacc

SEQ ID NO: 342876 - RNA, 22 nt, Homo sapiens
ucucacagaguugaauguuucu

SEQ ID NO: 342877 - RNA, 22 nt, Homo sapiens
ucucacauuucacagggauggg

SEQ ID NO: 342878 - RNA, 22 nt, Homo sapiens
ucucagugaauguggaaaaagc

SEQ ID NO: 342879 - RNA, 22 nt, Homo sapiens
ucucagugaauugguuuugucu

SEQ ID NO: 342880 - RNA, 22 nt, Homo sapiens
ucucagugacugcugggucccc

SEQ ID NO: 342881 - RNA, 22 nt, Homo sapiens
uagacacuagauaugugacuga

SEQ ID NO: 342882 - RNA, 20 nt, Homo sapiens
uagacagcuagauuagauag

SEQ ID NO: 342883 - RNA, 22 nt, Homo sapiens
uagagagcuguuugaaagcagg

SEQ ID NO: 342884 - RNA, 22 nt, Homo sapiens
uagagguauaccaaaaaggcau

SEQ ID NO: 342885 - RNA, 22 nt, Homo sapiens
uagagguucuaagauucucaga

SEQ ID NO: 342886 - RNA, 19 nt, Homo sapiens
uagagguuuaagaaaagaa

SEQ ID NO: 342887 - RNA, 22 nt, Homo sapiens
uagauuaucauucauacaggga

SEQ ID NO: 342888 - RNA, 22 nt, Homo sapiens
uagauuaucccugauuugucca

SEQ ID NO: 342889 - RNA, 20 nt, Homo sapiens
uagcacacauguagaauagu

SEQ ID NO: 342890 - RNA, 22 nt, Homo sapiens
uagcacaugucagguaauuugc

SEQ ID NO: 342891 - RNA, 22 nt, Homo sapiens
uagcaccaaacauauacucagu

SEQ ID NO: 342892 - RNA, 22 nt, Homo sapiens
uagcaccuuagcauuucuagug

SEQ ID NO: 342893 - RNA, 19 nt, Homo sapiens
uagcacuacagaguuuagc

SEQ ID NO: 342894 - RNA, 22 nt, Homo sapiens
uagcagcaaagcaggaucugcu

SEQ ID NO: 342895 - RNA, 22 nt, Homo sapiens
uagcagcaucucuggcuucuac

SEQ ID NO: 342896 - RNA, 22 nt, Homo sapiens
uagcagcauuuuuguagaguau

SEQ ID NO: 342897 - RNA, 22 nt, Homo sapiens
uagcagccaggaagggcuggcu

SEQ ID NO: 342898 - RNA, 22 nt, Homo sapiens
uagcaguagacagacuuuggcu

SEQ ID NO: 342899 - RNA, 22 nt, Homo sapiens
uagcaguauaugagagcuauug

SEQ ID NO: 342900 - RNA, 22 nt, Homo sapiens
uagcaugacacuuguugaaugc

SEQ ID NO: 342901 - RNA, 22 nt, Homo sapiens
uagcccagugagguugauuugg

SEQ ID NO: 342902 - RNA, 22 nt, Homo sapiens
uagccucacaaagugcuuaaga

SEQ ID NO: 342903 - RNA, 22 nt, Homo sapiens
uaggcacacaucuacuacaaau

SEQ ID NO: 342904 - RNA, 22 nt, Homo sapiens
uaggcuuuucugggaugugggc

SEQ ID NO: 342905 - RNA, 22 nt, Homo sapiens
uaggucuuuuaugaaauauauu

SEQ ID NO: 342906 - RNA, 22 nt, Homo sapiens
uagguucucaggaaugagcuuc

SEQ ID NO: 342907 - RNA, 22 nt, Homo sapiens
uagguugucuucccagaguuuu

SEQ ID NO: 342908 - RNA, 22 nt, Homo sapiens
uaguaacacauugaacgaucgc

SEQ ID NO: 342909 - RNA, 22 nt, Homo sapiens
uaguaucacaagguguacaccc

SEQ ID NO: 342910 - RNA, 22 nt, Homo sapiens
uaguaucauugaaacggcuugu

SEQ ID NO: 342911 - RNA, 22 nt, Homo sapiens
uaguuauggaguaauuuuaagc

SEQ ID NO: 342912 - RNA, 22 nt, Homo sapiens
uaguucauuauguguugcucag

SEQ ID NO: 342913 - RNA, 22 nt, Homo sapiens
uauaaugcacauucccaaaucu

SEQ ID NO: 342914 - RNA, 22 nt, Homo sapiens
uauacagcaaguuacugugcug

SEQ ID NO: 342915 - RNA, 22 nt, Homo sapiens
uauacuguuuucuauaguggcu

SEQ ID NO: 342916 - RNA, 22 nt, Homo sapiens
uauagcagccugaacaaaguaa

SEQ ID NO: 342917 - RNA, 22 nt, Homo sapiens
uauagcaguguaagaaucgagu

SEQ ID NO: 342918 - RNA, 22 nt, Homo sapiens
uauagcuuuuuagggaauuugg

SEQ ID NO: 342919 - RNA, 21 nt, Homo sapiens
uauaugacuuacuauugccuc

SEQ ID NO: 342920 - RNA, 22 nt, Homo sapiens
uauauguucuugcacuggaaag

SEQ ID NO: 342921 - RNA, 22 nt, Homo sapiens
uaucaaggccacucauuuuaug

SEQ ID NO: 342922 - RNA, 20 nt, Homo sapiens
uaucacaguucaggaacucu

SEQ ID NO: 342923 - RNA, 22 nt, Homo sapiens
uaucacuguuguuuguuuaagg

SEQ ID NO: 342924 - RNA, 22 nt, Homo sapiens
uaucccaauguaauaucacaaa

SEQ ID NO: 342925 - RNA, 21 nt, Homo sapiens
uaucccagucacaucuaccca

SEQ ID NO: 342926 - RNA, 22 nt, Homo sapiens
uaucccaguggauguaccccau

SEQ ID NO: 342927 - RNA, 22 nt, Homo sapiens
uaucccuguggacuucccaaca

SEQ ID NO: 342928 - RNA, 22 nt, Homo sapiens
uaucccuuagagcggggugguu

SEQ ID NO: 342929 - RNA, 20 nt, Homo sapiens
uaucuacuugcaaaugccau

SEQ ID NO: 342930 - RNA, 22 nt, Homo sapiens
uaucugcacuucugucuagguc

SEQ ID NO: 342931 - RNA, 22 nt, Homo sapiens
uaugaauuuuauccaggauaua

SEQ ID NO: 342932 - RNA, 22 nt, Homo sapiens
uaugaccuuggacaaguuacuu

SEQ ID NO: 342933 - RNA, 22 nt, Homo sapiens
uaugacucagaaggcacacaca

SEQ ID NO: 342934 - RNA, 22 nt, Homo sapiens
uaugacuuuugaauacagaugg

SEQ ID NO: 342935 - RNA, 22 nt, Homo sapiens
uaugccuuuuggcucaagaaac

SEQ ID NO: 342936 - RNA, 22 nt, Homo sapiens
uauggauguuaagguucacagc

SEQ ID NO: 342937 - RNA, 22 nt, Homo sapiens
uauggcucuguaauuuuagaug

SEQ ID NO: 342938 - RNA, 22 nt, Homo sapiens
uaugggauuucauuaagugucu

SEQ ID NO: 342939 - RNA, 22 nt, Homo sapiens
uauuacagaccauaucgccggg

SEQ ID NO: 342940 - RNA, 22 nt, Homo sapiens
uauuacugucaauaucacagaa

SEQ ID NO: 342941 - RNA, 22 nt, Homo sapiens
uauuagguuggggcaaaaguaa

SEQ ID NO: 342942 - RNA, 22 nt, Homo sapiens
uauuagguuggugcaacaguaa

SEQ ID NO: 342943 - RNA, 22 nt, Homo sapiens
gugaguuauuauuuauguaaac

SEQ ID NO: 342944 - RNA, 22 nt, Homo sapiens
gugauaucugagccugccccag

SEQ ID NO: 342945 - RNA, 22 nt, Homo sapiens
gugcaacaugccuggcuaauuu

SEQ ID NO: 342946 - RNA, 22 nt, Homo sapiens
gugcacaaucgugcauuccuug

SEQ ID NO: 342947 - RNA, 21 nt, Homo sapiens
gugcacaguaguguuuaauag

SEQ ID NO: 342948 - RNA, 22 nt, Homo sapiens
gugcauacucuggagacauugu

SEQ ID NO: 342949 - RNA, 19 nt, Homo sapiens
gugcauaguuauuaaagag

SEQ ID NO: 342950 - RNA, 22 nt, Homo sapiens
gugcauguccacuaguccauau

SEQ ID NO: 342951 - RNA, 22 nt, Homo sapiens
gugccacugcaccuggccuaag

SEQ ID NO: 342952 - RNA, 22 nt, Homo sapiens
gugcuauguuauccagcaagau

SEQ ID NO: 342953 - RNA, 22 nt, Homo sapiens
guggaaagaacacaaaauuagg

SEQ ID NO: 342954 - RNA, 22 nt, Homo sapiens
guggaaaucucugugugacuua

SEQ ID NO: 342955 - RNA, 22 nt, Homo sapiens
guggaagaccagacuuuccaac

SEQ ID NO: 342956 - RNA, 22 nt, Homo sapiens
guggaagauaguguguuaaugu

SEQ ID NO: 342957 - RNA, 22 nt, Homo sapiens
guggaauacuaugaugguggau

SEQ ID NO: 342958 - RNA, 22 nt, Homo sapiens
guggaauggaaugauuguguau

SEQ ID NO: 342959 - RNA, 22 nt, Homo sapiens
guggaguacugagggucacuua

SEQ ID NO: 342960 - RNA, 22 nt, Homo sapiens
guggcaaagaugccuucuccaa

SEQ ID NO: 342961 - RNA, 22 nt, Homo sapiens
guggcagugugaggauccugcu

SEQ ID NO: 342962 - RNA, 22 nt, Homo sapiens
guggcaguuuuaaauaugaaaa

SEQ ID NO: 342963 - RNA, 22 nt, Homo sapiens
guggcaugaaagcagauaccac

SEQ ID NO: 342964 - RNA, 22 nt, Homo sapiens
gugguaaaauggcauagagcua

SEQ ID NO: 342965 - RNA, 22 nt, Homo sapiens
ggaucacuugagaccaggaguu

SEQ ID NO: 342966 - RNA, 23 nt, Homo sapiens
ggauggaaaguuuugagggccac

SEQ ID NO: 342967 - RNA, 22 nt, Homo sapiens
ggcaacaugaugaaaugccauc

SEQ ID NO: 342968 - RNA, 23 nt, Homo sapiens
ggcaagaucucagcucacugcaa

SEQ ID NO: 342969 - RNA, 22 nt, Homo sapiens
ggcaccauggaaggacgggagc

SEQ ID NO: 342970 - RNA, 19 nt, Homo sapiens
ggcacugugugagugagga

SEQ ID NO: 342971 - RNA, 19 nt, Homo sapiens
ggcucagucaacugacugu

SEQ ID NO: 342972 - RNA, 22 nt, Homo sapiens
ggcucagugaucuguuucugua

SEQ ID NO: 342973 - RNA, 22 nt, Homo sapiens
ggcucaguugcaaaucaguuca

SEQ ID NO: 342974 - RNA, 22 nt, Homo sapiens
ggcuuggaggaaugugagggcu

SEQ ID NO: 342975 - RNA, 22 nt, Homo sapiens
ggcuuuggucacacaggggcaa

SEQ ID NO: 342976 - RNA, 22 nt, Homo sapiens
gggaauguagcaaaucugcaau

SEQ ID NO: 342977 - RNA, 22 nt, Homo sapiens
gggagcaaaaaugaugcccaag

SEQ ID NO: 342978 - RNA, 19 nt, Homo sapiens
gggaggaugcgucuucagg

SEQ ID NO: 342979 - RNA, 22 nt, Homo sapiens
gggagguaggaguuauuauuuu

SEQ ID NO: 342980 - RNA, 22 nt, Homo sapiens
gggaguagagaguuucucugac

SEQ ID NO: 342981 - RNA, 22 nt, Homo sapiens
gggaucaacuuauacuaaaauu

SEQ ID NO: 342982 - RNA, 22 nt, Homo sapiens
ggguaggcaagcggaugucaga

SEQ ID NO: 342983 - RNA, 17 nt, Homo sapiens
gggucaccuugcaggua

SEQ ID NO: 342984 - RNA, 22 nt, Homo sapiens
uacaagcaggaaaugguauaug

SEQ ID NO: 342985 - RNA, 22 nt, Homo sapiens
uacaagcuaaaauggaagauca

SEQ ID NO: 342986 - RNA, 22 nt, Homo sapiens
uacaauagugacaaaucagcau

SEQ ID NO: 342987 - RNA, 22 nt, Homo sapiens
uacacaugugaguucuuuucua

SEQ ID NO: 342988 - RNA, 20 nt, Homo sapiens
uacacguguagcauucucua

SEQ ID NO: 342989 - RNA, 22 nt, Homo sapiens
uacagaauauuucugcccugag

SEQ ID NO: 342990 - RNA, 22 nt, Homo sapiens
uacagcacugugcauagugguu

SEQ ID NO: 342991 - RNA, 22 nt, Homo sapiens
uacaggacuauagaacuuuccc

SEQ ID NO: 342992 - RNA, 22 nt, Homo sapiens
uacaggcaccuggcuaauuuuu

SEQ ID NO: 342993 - RNA, 22 nt, Homo sapiens
uacaguaauguuaaucuuugug

SEQ ID NO: 342994 - RNA, 22 nt, Homo sapiens
uacaguggcaugucaggugcuu

SEQ ID NO: 342995 - RNA, 19 nt, Homo sapiens
uacauaguauuuaguggca

SEQ ID NO: 342996 - RNA, 22 nt, Homo sapiens
uaccaaaguuucggccucuguu

SEQ ID NO: 342997 - RNA, 22 nt, Homo sapiens
uaccacugccgagaaaacagau

SEQ ID NO: 342998 - RNA, 22 nt, Homo sapiens
uaccuguagcucuucuaggcug

SEQ ID NO: 342999 - RNA, 22 nt, Homo sapiens
uacuagaggcgggguuucgcca

SEQ ID NO: 343000 - RNA, 22 nt, Homo sapiens
uacucagugacugguggaucaa

SEQ ID NO: 343001 - RNA, 22 nt, Homo sapiens
uacuccccuuguucugugagcu

SEQ ID NO: 343002 - RNA, 22 nt, Homo sapiens
uacugcacauaugaagguuccc

SEQ ID NO: 343003 - RNA, 22 nt, Homo sapiens
uacugcacuccaaccugagaga

SEQ ID NO: 343004 - RNA, 22 nt, Homo sapiens
uacugcaguugcagcuugagga

SEQ ID NO: 343005 - RNA, 23 nt, Homo sapiens
uacugcauccuccgccucuaggg

SEQ ID NO: 343006 - RNA, 22 nt, Homo sapiens
uacugcauuccaaucugggcga

SEQ ID NO: 343007 - RNA, 22 nt, Homo sapiens
uagaagcacuaucccuccuagu

SEQ ID NO: 343008 - RNA, 22 nt, Homo sapiens
uagaaugcauuagguugcccag

SEQ ID NO: 343009 - RNA, 22 nt, Homo sapiens
augacaguguggauuauuguaa

SEQ ID NO: 343010 - RNA, 19 nt, Homo sapiens
augacauuuggggguggac

SEQ ID NO: 343011 - RNA, 19 nt, Homo sapiens
augaccauuuccauaguau

SEQ ID NO: 343012 - RNA, 22 nt, Homo sapiens
augaccuuggggaaccaugucu

SEQ ID NO: 343013 - RNA, 19 nt, Homo sapiens
augagaacagacuccauuu

SEQ ID NO: 343014 - RNA, 22 nt, Homo sapiens
augagaaucauuucagcuugua

SEQ ID NO: 343015 - RNA, 22 nt, Homo sapiens
augagacuagaagagaauaaua

SEQ ID NO: 343016 - RNA, 22 nt, Homo sapiens
augagauucuuagagaagucug

SEQ ID NO: 343017 - RNA, 22 nt, Homo sapiens
augagcacuuguuuugggcaca

SEQ ID NO: 343018 - RNA, 20 nt, Homo sapiens
augagcucaucuugaaaacc

SEQ ID NO: 343019 - RNA, 22 nt, Homo sapiens
augaggaagucaggcccagggg

SEQ ID NO: 343020 - RNA, 22 nt, Homo sapiens
augaggcacugcgcccuacuga

SEQ ID NO: 343021 - RNA, 22 nt, Homo sapiens
augaggugauaucuggaaauua

SEQ ID NO: 343022 - RNA, 22 nt, Homo sapiens
augaggugauuucuguucgggu

SEQ ID NO: 343023 - RNA, 22 nt, Homo sapiens
augaggugcagaggaaaugagu

SEQ ID NO: 343024 - RNA, 22 nt, Homo sapiens
augaucuguagaacuaguccuu

SEQ ID NO: 343025 - RNA, 22 nt, Homo sapiens
augauggaggccgugauggacg

SEQ ID NO: 343026 - RNA, 22 nt, Homo sapiens
augcacaguccagcccaugugg

SEQ ID NO: 343027 - RNA, 22 nt, Homo sapiens
augcacuguuuucuugaugaga

SEQ ID NO: 343028 - RNA, 22 nt, Homo sapiens
augcacuuggcaggaugauucc

SEQ ID NO: 343029 - RNA, 22 nt, Homo sapiens
augcagagaaaucuaaaauaug

SEQ ID NO: 343030 - RNA, 22 nt, Homo sapiens
augcauaugucuuuauaguggc

SEQ ID NO: 343031 - RNA, 22 nt, Homo sapiens
augcauggucugaagucaaccu

SEQ ID NO: 343032 - RNA, 20 nt, Homo sapiens
augccacugagcagugguga

SEQ ID NO: 343033 - RNA, 22 nt, Homo sapiens
augccacugcacuucagccugc

SEQ ID NO: 343034 - RNA, 22 nt, Homo sapiens
augccacugcacuucagcuugg

SEQ ID NO: 343035 - RNA, 22 nt, Homo sapiens
augcuguuuugaauucucuaga

SEQ ID NO: 343036 - RNA, 22 nt, Homo sapiens
auggaaacauaagaguauagau

SEQ ID NO: 343037 - RNA, 22 nt, Homo sapiens
auggaaagcuguuccuacacaa

SEQ ID NO: 343038 - RNA, 22 nt, Homo sapiens
auggaacauuauagauguaaaa

SEQ ID NO: 343039 - RNA, 22 nt, Homo sapiens
auggaaggagaggaaugaauga

SEQ ID NO: 343040 - RNA, 22 nt, Homo sapiens
auggaaugguugggucauaagg

SEQ ID NO: 343041 - RNA, 22 nt, Homo sapiens
auggaggaggaagcugaaacaa

SEQ ID NO: 343042 - RNA, 22 nt, Homo sapiens
auggaguguggaacugggaauc

SEQ ID NO: 343043 - RNA, 22 nt, Homo sapiens
auggauauuuuuugaacauaga

SEQ ID NO: 343044 - RNA, 22 nt, Homo sapiens
auggaucauauucuugaggagg

SEQ ID NO: 343045 - RNA, 22 nt, Homo sapiens
auggauguucuagggaugugau

SEQ ID NO: 343046 - RNA, 22 nt, Homo sapiens
auggauuuugaacuugagaguu

SEQ ID NO: 343047 - RNA, 22 nt, Homo sapiens
auggauuuuggggccagaggca

SEQ ID NO: 343048 - RNA, 22 nt, Homo sapiens
auggcaaaaaaugcaauuacuu

SEQ ID NO: 343049 - RNA, 22 nt, Homo sapiens
auggcaauaauagcuaccauuu

SEQ ID NO: 343050 - RNA, 22 nt, Homo sapiens
auggcacugaagcguauugaca

SEQ ID NO: 343051 - RNA, 22 nt, Homo sapiens
auggcagugagucucuaguauu

SEQ ID NO: 343052 - RNA, 22 nt, Homo sapiens
auggcaguguaugauuauauua

SEQ ID NO: 343053 - RNA, 22 nt, Homo sapiens
auggcagugucuagggguguuu

SEQ ID NO: 343054 - RNA, 22 nt, Homo sapiens
auggcaguuucacucugggauu

SEQ ID NO: 343055 - RNA, 22 nt, Homo sapiens
auggcaguuuggucucugugcu

SEQ ID NO: 343056 - RNA, 22 nt, Homo sapiens
auggcccuguguggagcugcug

SEQ ID NO: 343057 - RNA, 22 nt, Homo sapiens
auggccuuuacaauuugguaug

SEQ ID NO: 343058 - RNA, 22 nt, Homo sapiens
auggcucaauucuuucccugaa

SEQ ID NO: 343059 - RNA, 22 nt, Homo sapiens
auggcucuggauagaaugcagg

SEQ ID NO: 343060 - RNA, 22 nt, Homo sapiens
auggcucuuauuauuugaggua

SEQ ID NO: 343061 - RNA, 22 nt, Homo sapiens
auggcuguuccugggaguucua

SEQ ID NO: 343062 - RNA, 22 nt, Homo sapiens
auggcuuuuuaaaucauguugu

SEQ ID NO: 343063 - RNA, 22 nt, Homo sapiens
augguaagcugaaaauaucgaa

SEQ ID NO: 343064 - RNA, 22 nt, Homo sapiens
auggucuuuucccuggauuaua

SEQ ID NO: 343065 - RNA, 22 nt, Homo sapiens
augguugguuaaaucuguguau

SEQ ID NO: 343066 - RNA, 22 nt, Homo sapiens
augguuugugcuccuauaagaa

SEQ ID NO: 343067 - RNA, 22 nt, Homo sapiens
auguaagugugcucaaauguua

SEQ ID NO: 343068 - RNA, 22 nt, Homo sapiens
auguaguagcagaaaauauuuu

SEQ ID NO: 343069 - RNA, 22 nt, Homo sapiens
augucaaagaggaaaacuggau

SEQ ID NO: 343070 - RNA, 22 nt, Homo sapiens
auguccuaaucuccuguucuua

SEQ ID NO: 343071 - RNA, 22 nt, Homo sapiens
augugacagcaacccccagccc

SEQ ID NO: 343072 - RNA, 22 nt, Homo sapiens
augugaugguuaauuuuaugug

SEQ ID NO: 343073 - RNA, 22 nt, Homo sapiens
augugcaaauuuccaaacucuu

SEQ ID NO: 343074 - RNA, 20 nt, Homo sapiens
augugcaguguggcaaccaa

SEQ ID NO: 343075 - RNA, 22 nt, Homo sapiens
augugccaauuaggauuccaag

SEQ ID NO: 343076 - RNA, 22 nt, Homo sapiens
augugugcuugugacacagccu

SEQ ID NO: 343077 - RNA, 22 nt, Homo sapiens
auguuauguuaaugauaaugga

SEQ ID NO: 343078 - RNA, 22 nt, Homo sapiens
auuaacaucuagaguuuuggug

SEQ ID NO: 343079 - RNA, 22 nt, Homo sapiens
auuaaguaaugguuccaauaau

SEQ ID NO: 343080 - RNA, 22 nt, Homo sapiens
auuauaugucaucacagacacc

SEQ ID NO: 343081 - RNA, 22 nt, Homo sapiens
auuaucacaguuuugcauaugg

SEQ ID NO: 343082 - RNA, 22 nt, Homo sapiens
auucacagggggagaaggguau

SEQ ID NO: 343083 - RNA, 22 nt, Homo sapiens
auuccacuuagugacucauuug

SEQ ID NO: 343084 - RNA, 22 nt, Homo sapiens
auuccacuuauaugagguaucu

SEQ ID NO: 343085 - RNA, 20 nt, Homo sapiens
auuccacuuauaugaggucc

SEQ ID NO: 343086 - RNA, 22 nt, Homo sapiens
auuccacuuccacuaguuucuc

SEQ ID NO: 343087 - RNA, 21 nt, Homo sapiens
auuccacuuuuccuucaggga

SEQ ID NO: 343088 - RNA, 22 nt, Homo sapiens
auuccagauggaguugaggguu

SEQ ID NO: 343089 - RNA, 22 nt, Homo sapiens
auuccauuuguguggaauggcu

SEQ ID NO: 343090 - RNA, 22 nt, Homo sapiens
auuccuuaggcccuuugguuag

SEQ ID NO: 343091 - RNA, 18 nt, Homo sapiens
auucuacaggccuuuuga

SEQ ID NO: 343092 - RNA, 22 nt, Homo sapiens
auucuauaguccuaggauuggg

SEQ ID NO: 343093 - RNA, 22 nt, Homo sapiens
auugaacaugccauauguacca

SEQ ID NO: 343094 - RNA, 22 nt, Homo sapiens
auugaauuugguuugcuaagaa

SEQ ID NO: 343095 - RNA, 22 nt, Homo sapiens
auugacacugauuuuucuuuaa

SEQ ID NO: 343096 - RNA, 22 nt, Homo sapiens
auugcacuccagccuggggaac

SEQ ID NO: 343097 - RNA, 22 nt, Homo sapiens
auugcacuccagccugggugac

SEQ ID NO: 343098 - RNA, 22 nt, Homo sapiens
auugcacuccagccuugggcaa

SEQ ID NO: 343099 - RNA, 22 nt, Homo sapiens
auugcacuccagccuuggggau

SEQ ID NO: 343100 - RNA, 22 nt, Homo sapiens
auugcacuccagucugggcaac

SEQ ID NO: 343101 - RNA, 22 nt, Homo sapiens
auugcacuccggccugggugac

SEQ ID NO: 343102 - RNA, 22 nt, Homo sapiens
auugcacucuagccugggugac

SEQ ID NO: 343103 - RNA, 22 nt, Homo sapiens
auugcacugcagccugggcaac

SEQ ID NO: 343104 - RNA, 23 nt, Homo sapiens
auugcagaaucacagagguagug

SEQ ID NO: 343105 - RNA, 20 nt, Homo sapiens
auugcagcaugauuuauaau

SEQ ID NO: 343106 - RNA, 19 nt, Homo sapiens
auugcaguguaaaacuauu

SEQ ID NO: 343107 - RNA, 22 nt, Homo sapiens
auuggcuuuauacauaagaaua

SEQ ID NO: 343108 - RNA, 22 nt, Homo sapiens
auuguacuccagccugggcgac

SEQ ID NO: 343109 - RNA, 22 nt, Homo sapiens
auuguacuccagccuuggggac

SEQ ID NO: 343110 - RNA, 22 nt, Homo sapiens
auugucacuuaaaagugcaugu

SEQ ID NO: 343111 - RNA, 20 nt, Homo sapiens
auuguccuugauuacacaga

SEQ ID NO: 343112 - RNA, 22 nt, Homo sapiens
auugugauggucaaaggaaaua

SEQ ID NO: 343113 - RNA, 22 nt, Homo sapiens
auuuagcaauggagguagugua

SEQ ID NO: 343114 - RNA, 21 nt, Homo sapiens
auuugcacugagcuccugugc

SEQ ID NO: 343115 - RNA, 21 nt, Homo sapiens
auuugguguuagaaauaaauu

SEQ ID NO: 343116 - RNA, 22 nt, Homo sapiens
auuuugcauugcuguaaaggaa

SEQ ID NO: 343117 - RNA, 22 nt, Homo sapiens
auuuuugguugguaggcuauua

SEQ ID NO: 343118 - RNA, 22 nt, Homo sapiens
caaaagugauugcgguuuuugc

SEQ ID NO: 343119 - RNA, 22 nt, Homo sapiens
caaaccuguaggggccaagagg

SEQ ID NO: 343120 - RNA, 22 nt, Homo sapiens
caaaggauucauuuccaggagu

SEQ ID NO: 343121 - RNA, 22 nt, Homo sapiens
caaaggcuucugaaacugcaga

SEQ ID NO: 343122 - RNA, 22 nt, Homo sapiens
caaagucuauucuacccuuacc

SEQ ID NO: 343123 - RNA, 22 nt, Homo sapiens
caaagugcuggccgggcgcagu

SEQ ID NO: 343124 - RNA, 22 nt, Homo sapiens
caaauugcuuguggaggauaau

SEQ ID NO: 343125 - RNA, 22 nt, Homo sapiens
caacacuguuuauuggauagcc

SEQ ID NO: 343126 - RNA, 22 nt, Homo sapiens
caaggaauucucaauagaguua

SEQ ID NO: 343127 - RNA, 22 nt, Homo sapiens
caagugaauaguugcucucaga

SEQ ID NO: 343128 - RNA, 21 nt, Homo sapiens
caagugaugcuucugcuuuaa

SEQ ID NO: 343129 - RNA, 21 nt, Homo sapiens
caauggcacaaucucugcuca

SEQ ID NO: 343130 - RNA, 22 nt, Homo sapiens
cacacugucuucauuacuguag

SEQ ID NO: 343131 - RNA, 22 nt, Homo sapiens
cacagaauucauuggauuaccu

SEQ ID NO: 343132 - RNA, 22 nt, Homo sapiens
cacagcuagucaaugguagaca

SEQ ID NO: 343133 - RNA, 22 nt, Homo sapiens
cacaggaagaggcacggucccu

SEQ ID NO: 343134 - RNA, 22 nt, Homo sapiens
cacagucugggcuuguuuguac

SEQ ID NO: 343135 - RNA, 22 nt, Homo sapiens
cacagugaacugguggguuuuu

SEQ ID NO: 343136 - RNA, 22 nt, Homo sapiens
cacaguguucauagccaucagg

SEQ ID NO: 343137 - RNA, 21 nt, Homo sapiens
cacauggaggcagagagugua

SEQ ID NO: 343138 - RNA, 19 nt, Homo sapiens
caccagugcaugcuacuau

SEQ ID NO: 343139 - RNA, 22 nt, Homo sapiens
caccugagcgggaugcucgccu

SEQ ID NO: 343140 - RNA, 22 nt, Homo sapiens
caccuguagucccagcugaggc

SEQ ID NO: 343141 - RNA, 22 nt, Homo sapiens
cacuaggcuggagugcaguggc

SEQ ID NO: 343142 - RNA, 22 nt, Homo sapiens
cacugcacuccagcuuugguga

SEQ ID NO: 343143 - RNA, 22 nt, Homo sapiens
cacugcacuccaguuucgguaa

SEQ ID NO: 343144 - RNA, 22 nt, Homo sapiens
cacuggucucauggcaugagag

SEQ ID NO: 343145 - RNA, 22 nt, Homo sapiens
cagacagugucccgagucccug

SEQ ID NO: 343146 - RNA, 22 nt, Homo sapiens
cagagaacauucagagcuguag

SEQ ID NO: 343147 - RNA, 20 nt, Homo sapiens
cagagcaaagcaguccuggc

SEQ ID NO: 343148 - RNA, 22 nt, Homo sapiens
cagauguaguauuuuagugaaa

SEQ ID NO: 343149 - RNA, 22 nt, Homo sapiens
cagcaaaucauccuauuugagc

SEQ ID NO: 343150 - RNA, 20 nt, Homo sapiens
cagcacgcacaugagacugu

SEQ ID NO: 343151 - RNA, 20 nt, Homo sapiens
cagcuaccugggaaauuugg

SEQ ID NO: 343152 - RNA, 22 nt, Homo sapiens
cagcucauugcagucucgaccu

SEQ ID NO: 343153 - RNA, 22 nt, Homo sapiens
caggaaugugaggguucccugc

SEQ ID NO: 343154 - RNA, 22 nt, Homo sapiens
caggcauuguauuguaaucccc

SEQ ID NO: 343155 - RNA, 22 nt, Homo sapiens
cagguaagaugcuuucucuuau

SEQ ID NO: 343156 - RNA, 22 nt, Homo sapiens
caggucaucugaguuuaguucu

SEQ ID NO: 343157 - RNA, 22 nt, Homo sapiens
caguaaauaucugagcgagguc

SEQ ID NO: 343158 - RNA, 22 nt, Homo sapiens
caguacaauguggaaaaggagu

SEQ ID NO: 343159 - RNA, 18 nt, Homo sapiens
cagugcaauacaggagag

SEQ ID NO: 343160 - RNA, 22 nt, Homo sapiens
cagugcaugacuguauauuauc

SEQ ID NO: 343161 - RNA, 22 nt, Homo sapiens
cagugcuuuaucaaguccucca

SEQ ID NO: 343162 - RNA, 22 nt, Homo sapiens
caguggauuggauggauaaugc

SEQ ID NO: 343163 - RNA, 22 nt, Homo sapiens
caguuguuuuaugacauaagau

SEQ ID NO: 343164 - RNA, 22 nt, Homo sapiens
cauaaaucuuguugaauagcac

SEQ ID NO: 343165 - RNA, 22 nt, Homo sapiens
caucaaaguggagggaaggacc

SEQ ID NO: 343166 - RNA, 22 nt, Homo sapiens
caucacagcaaguagggagugg

SEQ ID NO: 343167 - RNA, 22 nt, Homo sapiens
caucccugaaccccagaaaucu

SEQ ID NO: 343168 - RNA, 22 nt, Homo sapiens
caucgcacuccagccugggcaa

SEQ ID NO: 343169 - RNA, 19 nt, Homo sapiens
caugccacugcacuugagu

SEQ ID NO: 343170 - RNA, 22 nt, Homo sapiens
cauggcacugagcagguaugca

SEQ ID NO: 343171 - RNA, 22 nt, Homo sapiens
cauggcauuugcagaguugaaa

SEQ ID NO: 343172 - RNA, 22 nt, Homo sapiens
cauggcuuuauuuucagcuucu

SEQ ID NO: 343173 - RNA, 22 nt, Homo sapiens
caugguguuaggcacugggaau

SEQ ID NO: 343174 - RNA, 22 nt, Homo sapiens
cauguauagauuccauaguggu

SEQ ID NO: 343175 - RNA, 22 nt, Homo sapiens
caugucacuuccucucugaugg

SEQ ID NO: 343176 - RNA, 22 nt, Homo sapiens
ugcauggauguuugaacacacu

SEQ ID NO: 343177 - RNA, 20 nt, Homo sapiens
ugcauguccucacuuacuug

SEQ ID NO: 343178 - RNA, 22 nt, Homo sapiens
ugcauuaguaaguaauuuuaau

SEQ ID NO: 343179 - RNA, 22 nt, Homo sapiens
ugcauugcacuugcaugagaua

SEQ ID NO: 343180 - RNA, 22 nt, Homo sapiens
ugccaaaaugggcuuuauaccg

SEQ ID NO: 343181 - RNA, 22 nt, Homo sapiens
ugccaguauuuuauugaggauu

SEQ ID NO: 343182 - RNA, 22 nt, Homo sapiens
ugccauugcacuccagccuggg

SEQ ID NO: 343183 - RNA, 22 nt, Homo sapiens
ugccuacuuugcaucugucagg

SEQ ID NO: 343184 - RNA, 22 nt, Homo sapiens
ugccuaggcccaguccucagaa

SEQ ID NO: 343185 - RNA, 22 nt, Homo sapiens
ugccuggagagcuccuacauau

SEQ ID NO: 343186 - RNA, 22 nt, Homo sapiens
ugccuuuguucuggaaugggaa

SEQ ID NO: 343187 - RNA, 21 nt, Homo sapiens
ugcucaugaguaaugcaguga

SEQ ID NO: 343188 - RNA, 21 nt, Homo sapiens
ugcuccauuuucuagccugaa

SEQ ID NO: 343189 - RNA, 22 nt, Homo sapiens
ugcugcaaacaggcaucugugg

SEQ ID NO: 343190 - RNA, 22 nt, Homo sapiens
ugcugcuguuguuguuacuagc

SEQ ID NO: 343191 - RNA, 22 nt, Homo sapiens
ugcugguaguuuaugacuaauu

SEQ ID NO: 343192 - RNA, 22 nt, Homo sapiens
ugcuuagucuugcuuuagcuau

SEQ ID NO: 343193 - RNA, 22 nt, Homo sapiens
uggaaaguacuugaguuuguau

SEQ ID NO: 343194 - RNA, 22 nt, Homo sapiens
uggaaauaaaauagaguuugcc

SEQ ID NO: 343195 - RNA, 22 nt, Homo sapiens
uggaagacaggcuguauuuuaa

SEQ ID NO: 343196 - RNA, 22 nt, Homo sapiens
uggaagauggaguuuuaucauu

SEQ ID NO: 343197 - RNA, 22 nt, Homo sapiens
uggaagucuucauuauguauag

SEQ ID NO: 343198 - RNA, 22 nt, Homo sapiens
uggaagugaacaaccaaggcag

SEQ ID NO: 343199 - RNA, 21 nt, Homo sapiens
uggaaguguacaauuauaccc

SEQ ID NO: 343200 - RNA, 20 nt, Homo sapiens
uggaaucuaggcggagguuu

SEQ ID NO: 343201 - RNA, 22 nt, Homo sapiens
uggaaucuuaggugaaggcuuu

SEQ ID NO: 343202 - RNA, 22 nt, Homo sapiens
uggaauguaacuugaaacuuuu

SEQ ID NO: 343203 - RNA, 22 nt, Homo sapiens
uggaaugucagcuacaagaggg

SEQ ID NO: 343204 - RNA, 21 nt, Homo sapiens
uggaccccuacuucucaccau

SEQ ID NO: 343205 - RNA, 21 nt, Homo sapiens
uggaccccuuccagucaucau

SEQ ID NO: 343206 - RNA, 21 nt, Homo sapiens
uggaccccuuccuuacaucau

SEQ ID NO: 343207 - RNA, 22 nt, Homo sapiens
uggacuguaagugccuugagua

SEQ ID NO: 343208 - RNA, 22 nt, Homo sapiens
uggagacugaucccucuuuccu

SEQ ID NO: 343209 - RNA, 19 nt, Homo sapiens
ugugaacaucacagagugu

SEQ ID NO: 343210 - RNA, 22 nt, Homo sapiens
ugugaacauuuuguauauauua

SEQ ID NO: 343211 - RNA, 22 nt, Homo sapiens
ugugaagaugagaugacgcccu

SEQ ID NO: 343212 - RNA, 22 nt, Homo sapiens
ugugaaugauggagugucgaau

SEQ ID NO: 343213 - RNA, 22 nt, Homo sapiens
ugugacagcacagcaucucuuu

SEQ ID NO: 343214 - RNA, 22 nt, Homo sapiens
ugugacagguagguaauuuuug

SEQ ID NO: 343215 - RNA, 22 nt, Homo sapiens
ugugacuaguggugaaugacgc

SEQ ID NO: 343216 - RNA, 22 nt, Homo sapiens
ugugacucuggcacauggugag

SEQ ID NO: 343217 - RNA, 19 nt, Homo sapiens
ugugacugggccagccuag

SEQ ID NO: 343218 - RNA, 22 nt, Homo sapiens
ugugagacugguucugaaccca

SEQ ID NO: 343219 - RNA, 19 nt, Homo sapiens
ugugagcauuagcauuuag

SEQ ID NO: 343220 - RNA, 22 nt, Homo sapiens
ugugauaguugcuguucugggc

SEQ ID NO: 343221 - RNA, 22 nt, Homo sapiens
ugugaugauuugauaaacguau

SEQ ID NO: 343222 - RNA, 20 nt, Homo sapiens
ugugauuauuuaguugcaug

SEQ ID NO: 343223 - RNA, 17 nt, Homo sapiens
ugugauugaagucaucc

SEQ ID NO: 343224 - RNA, 22 nt, Homo sapiens
ugugcacaauguacagguuagu

SEQ ID NO: 343225 - RNA, 22 nt, Homo sapiens
ugugcacaaugugcagguuugu

SEQ ID NO: 343226 - RNA, 22 nt, Homo sapiens
ugugcaguuuuagcguauuuua

SEQ ID NO: 343227 - RNA, 22 nt, Homo sapiens
ugugcauaugucuuuauaguag

SEQ ID NO: 343228 - RNA, 22 nt, Homo sapiens
ugugccacugcacucccgccug

SEQ ID NO: 343229 - RNA, 22 nt, Homo sapiens
ugugccacugcacuccugccug

SEQ ID NO: 343230 - RNA, 22 nt, Homo sapiens
ugugccacugcacuucagccug

SEQ ID NO: 343231 - RNA, 22 nt, Homo sapiens
ugugccacuguucuguaaagug

SEQ ID NO: 343232 - RNA, 22 nt, Homo sapiens
ugugccuacugauagagccaag

SEQ ID NO: 343233 - RNA, 22 nt, Homo sapiens
ugugccuaguaauguguccaga

SEQ ID NO: 343234 - RNA, 22 nt, Homo sapiens
ugugcuugaaauucaguuuuga

SEQ ID NO: 343235 - RNA, 22 nt, Homo sapiens
uguggcaaagucuugugaauau

SEQ ID NO: 343236 - RNA, 22 nt, Homo sapiens
uguggcuuuguaaccauggguc

SEQ ID NO: 343237 - RNA, 22 nt, Homo sapiens
uguggcuuuuucuuggcugagg

SEQ ID NO: 343238 - RNA, 22 nt, Homo sapiens
ugugggaggugcuaauguaaau

SEQ ID NO: 343239 - RNA, 22 nt, Homo sapiens
ugugguuuuuuucuccaauagg

SEQ ID NO: 343240 - RNA, 22 nt, Homo sapiens
ugugucacugaggguuagugua

SEQ ID NO: 343241 - RNA, 22 nt, Homo sapiens
ugugucacugcacuccagcgug

SEQ ID NO: 343242 - RNA, 22 nt, Homo sapiens
ugugucuuguuuuuucccaggc

SEQ ID NO: 343243 - RNA, 22 nt, Homo sapiens
uguuaucauuacguucuuaguu

SEQ ID NO: 343244 - RNA, 22 nt, Homo sapiens
uguuauuuuguguuagggcaca

SEQ ID NO: 343245 - RNA, 22 nt, Homo sapiens
uguucaugaguucucauuuuua

SEQ ID NO: 343246 - RNA, 22 nt, Homo sapiens
uguuggcauugcugcugacccu

SEQ ID NO: 343247 - RNA, 22 nt, Homo sapiens
uguuuaguuaagacauagaauu

SEQ ID NO: 343248 - RNA, 22 nt, Homo sapiens
uguuuuggagguccucacuaga

SEQ ID NO: 343249 - RNA, 22 nt, Homo sapiens
uguuuuguuagcacucugggaa

SEQ ID NO: 343250 - RNA, 22 nt, Homo sapiens
uuaaaaguauaggccuggcaua

SEQ ID NO: 343251 - RNA, 22 nt, Homo sapiens
uuaaaggcauguacacuagagu

SEQ ID NO: 343252 - RNA, 22 nt, Homo sapiens
uuaaaguguuugcagacaggug

SEQ ID NO: 343253 - RNA, 20 nt, Homo sapiens
uuaaaucuagugcagacuca

SEQ ID NO: 343254 - RNA, 22 nt, Homo sapiens
uuaagcaguaguuaaggagagg

SEQ ID NO: 343255 - RNA, 22 nt, Homo sapiens
uuaagcaguggauuagaauuuu

SEQ ID NO: 343256 - RNA, 22 nt, Homo sapiens
uuaaggaaagcauuuaauucag

SEQ ID NO: 343257 - RNA, 22 nt, Homo sapiens
uuaaguagaugaaugugaaugu

SEQ ID NO: 343258 - RNA, 19 nt, Homo sapiens
uuaaguaguuagagggucu

SEQ ID NO: 343259 - RNA, 22 nt, Homo sapiens
uuaauguaauugauugauugac

SEQ ID NO: 343260 - RNA, 22 nt, Homo sapiens
uuacacaguugguaggggcaga

SEQ ID NO: 343261 - RNA, 22 nt, Homo sapiens
uuacaccuguaauccagcacuu

SEQ ID NO: 343262 - RNA, 22 nt, Homo sapiens
uuacacguaauaguaagccugg

SEQ ID NO: 343263 - RNA, 22 nt, Homo sapiens
uuacaggacuaagcagcuuugc

SEQ ID NO: 343264 - RNA, 22 nt, Homo sapiens
uuacaguugugagccaccaugc

SEQ ID NO: 343265 - RNA, 22 nt, Homo sapiens
uuagaaaguagaaaagcugguu

SEQ ID NO: 343266 - RNA, 22 nt, Homo sapiens
uuagaacagugcucaccacaaa

SEQ ID NO: 343267 - RNA, 19 nt, Homo sapiens
uuagagaucaucugcuuca

SEQ ID NO: 343268 - RNA, 20 nt, Homo sapiens
uuagaguaguaugauuuaua

SEQ ID NO: 343269 - RNA, 22 nt, Homo sapiens
uuagcacaguucauucauguua

SEQ ID NO: 343270 - RNA, 22 nt, Homo sapiens
uuagcagcaucccuggccugua

SEQ ID NO: 343271 - RNA, 22 nt, Homo sapiens
uuaggacacuguggguggguca

SEQ ID NO: 343272 - RNA, 22 nt, Homo sapiens
uuaggaucacagaaaauccucu

SEQ ID NO: 343273 - RNA, 22 nt, Homo sapiens
uuaggcuaguuucuuaaacucu

SEQ ID NO: 343274 - RNA, 22 nt, Homo sapiens
uuaggcuuuucagacacuucau

SEQ ID NO: 343275 - RNA, 22 nt, Homo sapiens
uuauaaacaugaagauuugggg

SEQ ID NO: 343276 - RNA, 20 nt, Homo sapiens
uuauaacuuuuguucugggg

SEQ ID NO: 343277 - RNA, 22 nt, Homo sapiens
uuauagguuucuacaggacuau

SEQ ID NO: 343278 - RNA, 22 nt, Homo sapiens
uuaucauagugcaguuuucuga

SEQ ID NO: 343279 - RNA, 22 nt, Homo sapiens
uuaugacaggcucaggagcccc

SEQ ID NO: 343280 - RNA, 22 nt, Homo sapiens
uuauggauuuauauucuguagu

SEQ ID NO: 343281 - RNA, 22 nt, Homo sapiens
uuaugucuuuuguguucagcua

SEQ ID NO: 343282 - RNA, 22 nt, Homo sapiens
uuauuauguuggugcaaaggua

SEQ ID NO: 343283 - RNA, 22 nt, Homo sapiens
uuauugcacuccagccugggua

SEQ ID NO: 343284 - RNA, 17 nt, Homo sapiens
uuauugcuauaagcuga

SEQ ID NO: 343285 - RNA, 22 nt, Homo sapiens
uucaaaguuggaggacaaacug

SEQ ID NO: 343286 - RNA, 23 nt, Homo sapiens
uucaaauguucucugguugucag

SEQ ID NO: 343287 - RNA, 22 nt, Homo sapiens
uucaagauggccccagugagcc

SEQ ID NO: 343288 - RNA, 22 nt, Homo sapiens
uucaagucuuggcuuugccacc

SEQ ID NO: 343289 - RNA, 22 nt, Homo sapiens
uucaagugaacaaaaugaggag

SEQ ID NO: 343290 - RNA, 22 nt, Homo sapiens
uucacacugggccuacucugug

SEQ ID NO: 343291 - RNA, 22 nt, Homo sapiens
uucacaugguugccuuuugauc

SEQ ID NO: 343292 - RNA, 22 nt, Homo sapiens
uucaccuugggucccacuugcu

SEQ ID NO: 343293 - RNA, 22 nt, Homo sapiens
uucacugcacuccagccugagc

SEQ ID NO: 343294 - RNA, 22 nt, Homo sapiens
uucacuguaaaaugaagagggu

SEQ ID NO: 343295 - RNA, 22 nt, Homo sapiens
uucagacugggugaagagggua

SEQ ID NO: 343296 - RNA, 22 nt, Homo sapiens
uucagaguggacagaaauuaag

SEQ ID NO: 343297 - RNA, 20 nt, Homo sapiens
uucccucagccuugagggua

SEQ ID NO: 343298 - RNA, 22 nt, Homo sapiens
uucccugaaguguuacucuaga

SEQ ID NO: 343299 - RNA, 22 nt, Homo sapiens
uuccuugaaacagucaagagaa

SEQ ID NO: 343300 - RNA, 22 nt, Homo sapiens
uuccuugagaaaggcacaaguu

SEQ ID NO: 343301 - RNA, 22 nt, Homo sapiens
uuccuugagucuuuuuccugag

SEQ ID NO: 343302 - RNA, 20 nt, Homo sapiens
uucuauggugaugaguccug

SEQ ID NO: 343303 - RNA, 22 nt, Homo sapiens
uucucagugaacuccagcuugu

SEQ ID NO: 343304 - RNA, 22 nt, Homo sapiens
uucucagugaaguuuagaacau

SEQ ID NO: 343305 - RNA, 22 nt, Homo sapiens
uucucaguucgguggcagugcu

SEQ ID NO: 343306 - RNA, 22 nt, Homo sapiens
uucucauggugauggcaaaauc

SEQ ID NO: 343307 - RNA, 22 nt, Homo sapiens
uucucuggucagaggggagguu

SEQ ID NO: 343308 - RNA, 22 nt, Homo sapiens
uucugccaaucaacccacaucc

SEQ ID NO: 343309 - RNA, 23 nt, Homo sapiens
uucugccacugaaaaugccucag

SEQ ID NO: 343310 - RNA, 22 nt, Homo sapiens
uucugugcugaaucaaagacug

SEQ ID NO: 343311 - RNA, 22 nt, Homo sapiens
uucuuagguuaaggcugagaga

SEQ ID NO: 343312 - RNA, 22 nt, Homo sapiens
uucuuagucauguaauagucca

SEQ ID NO: 343313 - RNA, 22 nt, Homo sapiens
uucuucaggccacaaaaauggu

SEQ ID NO: 343314 - RNA, 22 nt, Homo sapiens
uucuucaguuacaacaaggggg

SEQ ID NO: 343315 - RNA, 21 nt, Homo sapiens
uucuuugcucaguguuagagu

SEQ ID NO: 343316 - RNA, 22 nt, Homo sapiens
uugaaagaaaggagacugaguu

SEQ ID NO: 343317 - RNA, 22 nt, Homo sapiens
uugaaauguguaagcuccgaaa

SEQ ID NO: 343318 - RNA, 22 nt, Homo sapiens
uugaaguaguacuuuauuauag

SEQ ID NO: 343319 - RNA, 22 nt, Homo sapiens
uugaaguauagaguuuaagaac

SEQ ID NO: 343320 - RNA, 22 nt, Homo sapiens
uugaaguaugaccgcugagaau

SEQ ID NO: 343321 - RNA, 22 nt, Homo sapiens
uugaaugaaaugaugucauuug

SEQ ID NO: 343322 - RNA, 22 nt, Homo sapiens
uugaauggaauguuggaacuau

SEQ ID NO: 343323 - RNA, 20 nt, Homo sapiens
uugacagagggaaaguugcu

SEQ ID NO: 343324 - RNA, 22 nt, Homo sapiens
uugaccaaagaagagucauugc

SEQ ID NO: 343325 - RNA, 22 nt, Homo sapiens
uugagaagugucuguucauguc

SEQ ID NO: 343326 - RNA, 22 nt, Homo sapiens
uugagauagggucuaccucugu

SEQ ID NO: 343327 - RNA, 22 nt, Homo sapiens
uugagaucuacuacuguaggag

SEQ ID NO: 343328 - RNA, 22 nt, Homo sapiens
uugagauggagucucacuccuu

SEQ ID NO: 343329 - RNA, 22 nt, Homo sapiens
uugagauggagucucacucugc

SEQ ID NO: 343330 - RNA, 22 nt, Homo sapiens
uugagauggagucucacucugu

SEQ ID NO: 343331 - RNA, 22 nt, Homo sapiens
uugagauggagucucacucuuc

SEQ ID NO: 343332 - RNA, 22 nt, Homo sapiens
uugagauggaguuucaauauug

SEQ ID NO: 343333 - RNA, 22 nt, Homo sapiens
uugagauggaguuucacucugu

SEQ ID NO: 343334 - RNA, 22 nt, Homo sapiens
uugagauggauagacauagcau

SEQ ID NO: 343335 - RNA, 22 nt, Homo sapiens
uugagauggugccacuguacuc

SEQ ID NO: 343336 - RNA, 22 nt, Homo sapiens
uugagauguaguuucacuccug

SEQ ID NO: 343337 - RNA, 22 nt, Homo sapiens
uugagauguauguauauaaugu

SEQ ID NO: 343338 - RNA, 22 nt, Homo sapiens
uugagcaccaugccuggccaug

SEQ ID NO: 343339 - RNA, 22 nt, Homo sapiens
uugaggacugguugaaagcuuu

SEQ ID NO: 343340 - RNA, 22 nt, Homo sapiens
uugagggaaacauucacaucau

SEQ ID NO: 343341 - RNA, 22 nt, Homo sapiens
uugagggcugaauaccaaucag

SEQ ID NO: 343342 - RNA, 21 nt, Homo sapiens
uugagguaaaauccuauggga

SEQ ID NO: 343343 - RNA, 22 nt, Homo sapiens
uugagguguauuguacagcaca

SEQ ID NO: 343344 - RNA, 20 nt, Homo sapiens
uugaggugugaggggcagag

SEQ ID NO: 343345 - RNA, 22 nt, Homo sapiens
uugguuuccuuccugcuuaacu

SEQ ID NO: 343346 - RNA, 22 nt, Homo sapiens
uuguacaggaguguaagcuuca

SEQ ID NO: 343347 - RNA, 22 nt, Homo sapiens
uuguacuauuuuuaucagugau

SEQ ID NO: 343348 - RNA, 20 nt, Homo sapiens
uuguacuccugggcucaagc

SEQ ID NO: 343349 - RNA, 22 nt, Homo sapiens
uuguagaucuucaguugcuaca

SEQ ID NO: 343350 - RNA, 22 nt, Homo sapiens
uuguauccaucuuucaggcaac

SEQ ID NO: 343351 - RNA, 22 nt, Homo sapiens
uuguauguuucugugcacauga

SEQ ID NO: 343352 - RNA, 22 nt, Homo sapiens
uugucaaacucauucuccaucc

SEQ ID NO: 343353 - RNA, 22 nt, Homo sapiens
uugucacuauaaauaagcauuu

SEQ ID NO: 343354 - RNA, 22 nt, Homo sapiens
uuguccacugcuagccucugca

SEQ ID NO: 343355 - RNA, 22 nt, Homo sapiens
uuguccuccacauuugaucagu

SEQ ID NO: 343356 - RNA, 22 nt, Homo sapiens
uuguccuggagguucuugcaag

SEQ ID NO: 343357 - RNA, 22 nt, Homo sapiens
uugugaaaaaccucucguggaa

SEQ ID NO: 343358 - RNA, 22 nt, Homo sapiens
uugugaaaucuaggcagagguu

SEQ ID NO: 343359 - RNA, 22 nt, Homo sapiens
uugugagggagcuaagaugagu

SEQ ID NO: 343360 - RNA, 22 nt, Homo sapiens
uugugauugagugauccuuguu

SEQ ID NO: 343361 - RNA, 22 nt, Homo sapiens
uugugcaugaugcauacauggu

SEQ ID NO: 343362 - RNA, 22 nt, Homo sapiens
uugugccacugaagcccuccag

SEQ ID NO: 343363 - RNA, 22 nt, Homo sapiens
uugugcuugauuugccuagcug

SEQ ID NO: 343364 - RNA, 22 nt, Homo sapiens
uuguggcuuaucucauuuagcg

SEQ ID NO: 343365 - RNA, 22 nt, Homo sapiens
uugugguugauacacguaggaa

SEQ ID NO: 343366 - RNA, 22 nt, Homo sapiens
uugugucaaauggcaauuagca

SEQ ID NO: 343367 - RNA, 22 nt, Homo sapiens
uuguguuugaugcugacacgca

SEQ ID NO: 343368 - RNA, 22 nt, Homo sapiens
uuuaaagcuaaaauauguuuau

SEQ ID NO: 343369 - RNA, 22 nt, Homo sapiens
uuuaaaguuagaaggaaagggc

SEQ ID NO: 343370 - RNA, 22 nt, Homo sapiens
uuuacaguuuucuaggcuacca

SEQ ID NO: 343371 - RNA, 22 nt, Homo sapiens
uuuagcaauucauuuugugucu

SEQ ID NO: 343372 - RNA, 22 nt, Homo sapiens
uuucacagagggcuucuuucua

SEQ ID NO: 343373 - RNA, 22 nt, Homo sapiens
uuucacuagccagcccuuuauu

SEQ ID NO: 343374 - RNA, 22 nt, Homo sapiens
uuucagagucaucugcccaagu

SEQ ID NO: 343375 - RNA, 18 nt, Homo sapiens
uuucaggguggacaugag

SEQ ID NO: 343376 - RNA, 22 nt, Homo sapiens
uuucaguagagacacgguuuug

SEQ ID NO: 343377 - RNA, 22 nt, Homo sapiens
uuucauagccuucuaaugaguu

SEQ ID NO: 343378 - RNA, 22 nt, Homo sapiens
uuucaucagccagggucagucu

SEQ ID NO: 343379 - RNA, 22 nt, Homo sapiens
uuucauccggcuguguauuaug

SEQ ID NO: 343380 - RNA, 22 nt, Homo sapiens
uuucauggaauauagucauuuu

SEQ ID NO: 343381 - RNA, 22 nt, Homo sapiens
uuucauggagaaucuucuuacu

SEQ ID NO: 343382 - RNA, 22 nt, Homo sapiens
uuucauggaggauuugcuucuu

SEQ ID NO: 343383 - RNA, 22 nt, Homo sapiens
uuucauggcaguuuggggccug

SEQ ID NO: 343384 - RNA, 22 nt, Homo sapiens
uuucauggcgaggcuucauggg

SEQ ID NO: 343385 - RNA, 18 nt, Homo sapiens
uuucauugagugugauau

SEQ ID NO: 343386 - RNA, 22 nt, Homo sapiens
uuuccaagaugcuuacuuucuc

SEQ ID NO: 343387 - RNA, 22 nt, Homo sapiens
uuucccauuguucugcucugug

SEQ ID NO: 343388 - RNA, 19 nt, Homo sapiens
uuucccugcagaccuacua

SEQ ID NO: 343389 - RNA, 22 nt, Homo sapiens
uuucccuuuagcuuagugauuu

SEQ ID NO: 343390 - RNA, 22 nt, Homo sapiens
uacugcacuccagccucgguga

SEQ ID NO: 343391 - RNA, 22 nt, Homo sapiens
uacugcacuccagccugccaac

SEQ ID NO: 343392 - RNA, 22 nt, Homo sapiens
uacugcacuccagccuugccaa

SEQ ID NO: 343393 - RNA, 18 nt, Homo sapiens
uacugcacucuccagccu

SEQ ID NO: 343394 - RNA, 20 nt, Homo sapiens
uacugcacuuuccucauggu

SEQ ID NO: 343395 - RNA, 22 nt, Homo sapiens
uacugcaucgaaaugcuuuuau

SEQ ID NO: 343396 - RNA, 22 nt, Homo sapiens
uacugcuaccuccagcuucugg

SEQ ID NO: 343397 - RNA, 22 nt, Homo sapiens
uacuguacugcaguucugcaaa

SEQ ID NO: 343398 - RNA, 22 nt, Homo sapiens
uagaaagcaugaccuucagaua

SEQ ID NO: 343399 - RNA, 22 nt, Homo sapiens
uagaacaauugcuggauccgaa

SEQ ID NO: 343400 - RNA, 22 nt, Homo sapiens
uagaacauuccaggugauguug

SEQ ID NO: 343401 - RNA, 22 nt, Homo sapiens
uagaaguaggcuacgugucugg

SEQ ID NO: 343402 - RNA, 22 nt, Homo sapiens
uagaaugaaacaagcugugccu

SEQ ID NO: 343403 - RNA, 22 nt, Homo sapiens
uagaauggaagguugagaagaa

SEQ ID NO: 343404 - RNA, 23 nt, Homo sapiens
uagaauguuuuuccauguuucuu

SEQ ID NO: 343405 - RNA, 22 nt, Homo sapiens
uagacaacugaaacacugugca

SEQ ID NO: 343406 - RNA, 22 nt, Homo sapiens
uagacacugcauauuuuuuuaa

SEQ ID NO: 343407 - RNA, 22 nt, Homo sapiens
uagagcacagugauuagaccua

SEQ ID NO: 343408 - RNA, 22 nt, Homo sapiens
uagagcuaguugcucacugcuu

SEQ ID NO: 343409 - RNA, 20 nt, Homo sapiens
uagaugcauuuagauucauu

SEQ ID NO: 343410 - RNA, 19 nt, Homo sapiens
uagaugucuuugcauagau

SEQ ID NO: 343411 - RNA, 22 nt, Homo sapiens
ugagaugaucaaaguauaggcu

SEQ ID NO: 343412 - RNA, 21 nt, Homo sapiens
ugagaugauccugcaugcaug

SEQ ID NO: 343413 - RNA, 20 nt, Homo sapiens
ugagaugcauugggauguuu

SEQ ID NO: 343414 - RNA, 22 nt, Homo sapiens
ugagauggcugaauucagaaua

SEQ ID NO: 343415 - RNA, 22 nt, Homo sapiens
ugagauuguucuaugucugguu

SEQ ID NO: 343416 - RNA, 22 nt, Homo sapiens
ugagcacagagccugggguggc

SEQ ID NO: 343417 - RNA, 22 nt, Homo sapiens
ugagcauauugugauaccuaaa

SEQ ID NO: 343418 - RNA, 22 nt, Homo sapiens
ugagcauuguguuugacuguga

SEQ ID NO: 343419 - RNA, 22 nt, Homo sapiens
ugagcccauuguccugguuuau

SEQ ID NO: 343420 - RNA, 22 nt, Homo sapiens
ugagcuguuugaagaagcauuu

SEQ ID NO: 343421 - RNA, 22 nt, Homo sapiens
ugaggaauguguguuaaagaua

SEQ ID NO: 343422 - RNA, 22 nt, Homo sapiens
ugaggagugagaaauugguuuc

SEQ ID NO: 343423 - RNA, 22 nt, Homo sapiens
ugaggaguguauuucauucgcu

SEQ ID NO: 343424 - RNA, 22 nt, Homo sapiens
ugaggucuuuauuuagugcuca

SEQ ID NO: 343425 - RNA, 22 nt, Homo sapiens
ugagguuauuuguucaagaagu

SEQ ID NO: 343426 - RNA, 22 nt, Homo sapiens
ugaguagaacuccuggagaugu

SEQ ID NO: 343427 - RNA, 23 nt, Homo sapiens
ugaguagguccacguaugugagu

SEQ ID NO: 343428 - RNA, 22 nt, Homo sapiens
ugaguauguuuagaaguaaagg

SEQ ID NO: 343429 - RNA, 23 nt, Homo sapiens
ugagucacuuugcuggggucucu

SEQ ID NO: 343430 - RNA, 22 nt, Homo sapiens
ugagucauuuccuuaugcuacu

SEQ ID NO: 343431 - RNA, 22 nt, Homo sapiens
ugagucgagauugcgccacugu

SEQ ID NO: 343432 - RNA, 22 nt, Homo sapiens
ugagucuguucucacauugcua

SEQ ID NO: 343433 - RNA, 22 nt, Homo sapiens
ugagugaaggggcucuguugug

SEQ ID NO: 343434 - RNA, 22 nt, Homo sapiens
ugaguuaaucucuacgauagaa

SEQ ID NO: 343435 - RNA, 20 nt, Homo sapiens
ugaguuccuuguucagaagc

SEQ ID NO: 343436 - RNA, 22 nt, Homo sapiens
ugaguucuuuguagauucugug

SEQ ID NO: 343437 - RNA, 22 nt, Homo sapiens
ugauaacauugggggaagcuga

SEQ ID NO: 343438 - RNA, 22 nt, Homo sapiens
ugauaacauuucuucugguaca

SEQ ID NO: 343439 - RNA, 17 nt, Homo sapiens
ugauaagugugagguga

SEQ ID NO: 343440 - RNA, 22 nt, Homo sapiens
ugauacuggcuucauagaauga

SEQ ID NO: 343441 - RNA, 22 nt, Homo sapiens
ugauaggagauuuucaucugua

SEQ ID NO: 343442 - RNA, 22 nt, Homo sapiens
ugauaguugucagugggggacc

SEQ ID NO: 343443 - RNA, 22 nt, Homo sapiens
ugauaugaaguucaaaccaggu

SEQ ID NO: 343444 - RNA, 22 nt, Homo sapiens
ugauaugugaguauaugguuau

SEQ ID NO: 343445 - RNA, 20 nt, Homo sapiens
ugauauuuucugagcaggaa

SEQ ID NO: 343446 - RNA, 22 nt, Homo sapiens
ugauuugucugcaggaauagug

SEQ ID NO: 343447 - RNA, 22 nt, Homo sapiens
ugcaaucauuuggaggagaaga

SEQ ID NO: 343448 - RNA, 22 nt, Homo sapiens
ugcaaugugaaauaagcacauc

SEQ ID NO: 343449 - RNA, 22 nt, Homo sapiens
ugcaccacugcaccccagucug

SEQ ID NO: 343450 - RNA, 22 nt, Homo sapiens
ugcaccacugcacuccagcuug

SEQ ID NO: 343451 - RNA, 22 nt, Homo sapiens
ugcaccacuguacuccagucug

SEQ ID NO: 343452 - RNA, 17 nt, Homo sapiens
ugcagcacacugauggg

SEQ ID NO: 343453 - RNA, 22 nt, Homo sapiens
ugcagcacaguagguuugcaau

SEQ ID NO: 343454 - RNA, 22 nt, Homo sapiens
ugcauaggcuaaaauccuggcc

SEQ ID NO: 343455 - RNA, 23 nt, Homo sapiens
ugcauaguacccaauacuuuauc

SEQ ID NO: 343456 - RNA, 21 nt, Homo sapiens
ugcauaucucuaaugaccagu

SEQ ID NO: 343457 - RNA, 22 nt, Homo sapiens
ugcauauguauacaugugccau

SEQ ID NO: 343458 - RNA, 22 nt, Homo sapiens
ugcauauguugagaugcauauu

SEQ ID NO: 343459 - RNA, 21 nt, Homo sapiens
ugcauggagaacacugagggu

SEQ ID NO: 343460 - RNA, 21 nt, Homo sapiens
ugcaugguagucacaugauuc

SEQ ID NO: 343461 - RNA, 22 nt, Homo sapiens
ugcauuaucagauguuugcuuu

SEQ ID NO: 343462 - RNA, 22 nt, Homo sapiens
ugcauugccgugauuacugucu

SEQ ID NO: 343463 - RNA, 22 nt, Homo sapiens
ugccaacaugccuggcuguuuu

SEQ ID NO: 343464 - RNA, 22 nt, Homo sapiens
uagaagcugagaauguccucag

SEQ ID NO: 343465 - RNA, 22 nt, Homo sapiens
uagaauguaaauuccaagggca

SEQ ID NO: 343466 - RNA, 22 nt, Homo sapiens
uagaauguaacaguuaaaagca

SEQ ID NO: 343467 - RNA, 22 nt, Homo sapiens
uagaauguaacuuccaugucau

SEQ ID NO: 343468 - RNA, 22 nt, Homo sapiens
uagacccauuacguaguuucca

SEQ ID NO: 343469 - RNA, 22 nt, Homo sapiens
uagagauaucaauuucauggug

SEQ ID NO: 343470 - RNA, 22 nt, Homo sapiens
uagagccauugcagauguuuga

SEQ ID NO: 343471 - RNA, 22 nt, Homo sapiens
uagagcucaucuucuuuaaacu

SEQ ID NO: 343472 - RNA, 22 nt, Homo sapiens
uagaucacucaggcaauaaaag

SEQ ID NO: 343473 - RNA, 22 nt, Homo sapiens
uagaucauauucagugcuuacu

SEQ ID NO: 343474 - RNA, 22 nt, Homo sapiens
uagauuauuggcugauuugauc

SEQ ID NO: 343475 - RNA, 19 nt, Homo sapiens
uagcacagggucccagacu

SEQ ID NO: 343476 - RNA, 20 nt, Homo sapiens
uagcagcagacagagggagg

SEQ ID NO: 343477 - RNA, 22 nt, Homo sapiens
uagcauaauuuguagaaaauca

SEQ ID NO: 343478 - RNA, 22 nt, Homo sapiens
uagcauggagucaugcacggcu

SEQ ID NO: 343479 - RNA, 22 nt, Homo sapiens
uagcaugucagucgccacacgu

SEQ ID NO: 343480 - RNA, 22 nt, Homo sapiens
uagccgggugugguggaacucc

SEQ ID NO: 343481 - RNA, 20 nt, Homo sapiens
uagccggguguugugucaug

SEQ ID NO: 343482 - RNA, 22 nt, Homo sapiens
uagcugcugcuaggcuaaggau

SEQ ID NO: 343483 - RNA, 22 nt, Homo sapiens
uagcuggaauuacuugcaccug

SEQ ID NO: 343484 - RNA, 22 nt, Homo sapiens
uaggaaguacaucucagaaucu

SEQ ID NO: 343485 - RNA, 22 nt, Homo sapiens
uaggcaaaugcaagaguagaac

SEQ ID NO: 343486 - RNA, 22 nt, Homo sapiens
uaggucacugcucugugucuaa

SEQ ID NO: 343487 - RNA, 22 nt, Homo sapiens
uaggugaaugcuggaagaaaug

SEQ ID NO: 343488 - RNA, 19 nt, Homo sapiens
uaggugguuuuccccucac

SEQ ID NO: 343489 - RNA, 22 nt, Homo sapiens
uagguuauucauucaucauuua

SEQ ID NO: 343490 - RNA, 22 nt, Homo sapiens
uagguucuccacagguucucca

SEQ ID NO: 343491 - RNA, 20 nt, Homo sapiens
uagguuuucacagaauugcc

SEQ ID NO: 343492 - RNA, 22 nt, Homo sapiens
uaguagagauggggcacaugcc

SEQ ID NO: 343493 - RNA, 22 nt, Homo sapiens
uaguagcauaccuaaguauacu

SEQ ID NO: 343494 - RNA, 22 nt, Homo sapiens
uaguaucacauggucuuaauua

SEQ ID NO: 343495 - RNA, 22 nt, Homo sapiens
uagucaaaucugaaggaaauuu

SEQ ID NO: 343496 - RNA, 22 nt, Homo sapiens
uagucacacacucaacuuuuca

SEQ ID NO: 343497 - RNA, 22 nt, Homo sapiens
uagucagcaauguucauguucu

SEQ ID NO: 343498 - RNA, 20 nt, Homo sapiens
uagucaugagauucuccaag

SEQ ID NO: 343499 - RNA, 22 nt, Homo sapiens
uagucccauaugauuuagugaa

SEQ ID NO: 343500 - RNA, 22 nt, Homo sapiens
uagugcugagauugagaagccc

SEQ ID NO: 343501 - RNA, 22 nt, Homo sapiens
uauacacgugugcauauauaca

SEQ ID NO: 343502 - RNA, 22 nt, Homo sapiens
uauacaguaggcacucaguggc

SEQ ID NO: 343503 - RNA, 22 nt, Homo sapiens
uauacugucuuuguaugccuag

SEQ ID NO: 343504 - RNA, 20 nt, Homo sapiens
uauagcaauuuuuuucuccu

SEQ ID NO: 343505 - RNA, 21 nt, Homo sapiens
uauagcagcacgauuuauaau

SEQ ID NO: 343506 - RNA, 22 nt, Homo sapiens
uauagcuuaaaguuuagauccu

SEQ ID NO: 343507 - RNA, 22 nt, Homo sapiens
uauagcuugaaggaauggucau

SEQ ID NO: 343508 - RNA, 22 nt, Homo sapiens
uauagcuugauuauggugaugg

SEQ ID NO: 343509 - RNA, 21 nt, Homo sapiens
uauaguaguaugauuuacaau

SEQ ID NO: 343510 - RNA, 22 nt, Homo sapiens
uauaugcacucagguguaugug

SEQ ID NO: 343511 - RNA, 23 nt, Homo sapiens
uauaugugucuaggagcuauggu

SEQ ID NO: 343512 - RNA, 22 nt, Homo sapiens
uaucaacaggguggccagugua

SEQ ID NO: 343513 - RNA, 22 nt, Homo sapiens
uaucacacgccuugcuucauuu

SEQ ID NO: 343514 - RNA, 23 nt, Homo sapiens
uaucacacuuucucugugccaca

SEQ ID NO: 343515 - RNA, 20 nt, Homo sapiens
uaucacaggucagaaacccu

SEQ ID NO: 343516 - RNA, 22 nt, Homo sapiens
uaucacaguaaaucugggugca

SEQ ID NO: 343517 - RNA, 22 nt, Homo sapiens
uaucacaguugcauauuuaagg

SEQ ID NO: 343518 - RNA, 22 nt, Homo sapiens
uaucaccauguccguuuuaaaa

SEQ ID NO: 343519 - RNA, 22 nt, Homo sapiens
uaucacugucaggcccucauau

SEQ ID NO: 343520 - RNA, 22 nt, Homo sapiens
uaucacuuugauaguuuaaaug

SEQ ID NO: 343521 - RNA, 22 nt, Homo sapiens
uaucagauugcugccaucugcu

SEQ ID NO: 343522 - RNA, 22 nt, Homo sapiens
uaucaucauguuuuugcugugu

SEQ ID NO: 343523 - RNA, 22 nt, Homo sapiens
uaucaucauuggcaggugagaa

SEQ ID NO: 343524 - RNA, 22 nt, Homo sapiens
uaucucagagaaucagauuuac

SEQ ID NO: 343525 - RNA, 22 nt, Homo sapiens
uaucucagaguguacaagauua

SEQ ID NO: 343526 - RNA, 20 nt, Homo sapiens
uaucucaguuuguccuaaac

SEQ ID NO: 343527 - RNA, 23 nt, Homo sapiens
uaugacagaggaagggggagcug

SEQ ID NO: 343528 - RNA, 22 nt, Homo sapiens
uaugaugcuguuuagaaucucu

SEQ ID NO: 343529 - RNA, 22 nt, Homo sapiens
uaugcacaugcaugcuugaaua

SEQ ID NO: 343530 - RNA, 22 nt, Homo sapiens
uaugcacuauagcauauguggu

SEQ ID NO: 343531 - RNA, 22 nt, Homo sapiens
uaugccucuucauaaaguauga

SEQ ID NO: 343532 - RNA, 22 nt, Homo sapiens
uaugcuuauaaacauuugucag

SEQ ID NO: 343533 - RNA, 22 nt, Homo sapiens
uauggcauuguuggugaugaua

SEQ ID NO: 343534 - RNA, 22 nt, Homo sapiens
uauggcuucuauaaggaagcuu

SEQ ID NO: 343535 - RNA, 22 nt, Homo sapiens
uaugucuuuugcuugcaaauag

SEQ ID NO: 343536 - RNA, 22 nt, Homo sapiens
uaugugcacaugcccuggugac

SEQ ID NO: 343537 - RNA, 20 nt, Homo sapiens
uauuacagaguaauggugga

SEQ ID NO: 343538 - RNA, 22 nt, Homo sapiens
uauuagguuggugcaaaaguaa

SEQ ID NO: 343539 - RNA, 22 nt, Homo sapiens
uauuccacucuguuggagguaa

SEQ ID NO: 343540 - RNA, 22 nt, Homo sapiens
uauuccuuuugcauuuccacau

SEQ ID NO: 343541 - RNA, 22 nt, Homo sapiens
uauugacauuacagugggucuu

SEQ ID NO: 343542 - RNA, 22 nt, Homo sapiens
uauugcacuccucaugcauuug

SEQ ID NO: 343543 - RNA, 22 nt, Homo sapiens
uauugcagugagauccaucugg

SEQ ID NO: 343544 - RNA, 22 nt, Homo sapiens
uauugggcuucucagaauagag

SEQ ID NO: 343545 - RNA, 22 nt, Homo sapiens
uauuguacauguuauagauuuu

SEQ ID NO: 343546 - RNA, 22 nt, Homo sapiens
uauuuggugaaugaaugcaugu

SEQ ID NO: 343547 - RNA, 22 nt, Homo sapiens
ucaaaaucucuuagcugugucu

SEQ ID NO: 343548 - RNA, 22 nt, Homo sapiens
ucaaacacuccauaucgcgauu

SEQ ID NO: 343549 - RNA, 22 nt, Homo sapiens
ucaaacugucagguugaccaga

SEQ ID NO: 343550 - RNA, 18 nt, Homo sapiens
ucaaauacuuugggcagu

SEQ ID NO: 343551 - RNA, 22 nt, Homo sapiens
accugagauuacaggugcuggc

SEQ ID NO: 343552 - RNA, 23 nt, Homo sapiens
accugauguuucuguggggagcc

SEQ ID NO: 343553 - RNA, 22 nt, Homo sapiens
accugggugcugaugggcuuua

SEQ ID NO: 343554 - RNA, 22 nt, Homo sapiens
acucagagagaacugucauuug

SEQ ID NO: 343555 - RNA, 22 nt, Homo sapiens
acucugucuaguuguaaaauuu

SEQ ID NO: 343556 - RNA, 23 nt, Homo sapiens
acugagcaauguuuacauacuug

SEQ ID NO: 343557 - RNA, 21 nt, Homo sapiens
acugauguuugaaauucgcug

SEQ ID NO: 343558 - RNA, 22 nt, Homo sapiens
acugcacuccaaccuuggugac

SEQ ID NO: 343559 - RNA, 22 nt, Homo sapiens
acugcacuccagcccgggugac

SEQ ID NO: 343560 - RNA, 22 nt, Homo sapiens
acugcacuccagccugugagac

SEQ ID NO: 343561 - RNA, 22 nt, Homo sapiens
acugcacuccagccugugcgua

SEQ ID NO: 343562 - RNA, 22 nt, Homo sapiens
acugcacuucaaccucauugac

SEQ ID NO: 343563 - RNA, 22 nt, Homo sapiens
acugcacuucagccuuggcuac

SEQ ID NO: 343564 - RNA, 20 nt, Homo sapiens
acuggcacugguaggugugg

SEQ ID NO: 343565 - RNA, 22 nt, Homo sapiens
acugguguaugggaggucccaa

SEQ ID NO: 343566 - RNA, 22 nt, Homo sapiens
acuguauagauggaguugauuu

SEQ ID NO: 343567 - RNA, 22 nt, Homo sapiens
acuuugguuaucauacuuucag

SEQ ID NO: 343568 - RNA, 22 nt, Homo sapiens
acuuuguguuacccagcaagga

SEQ ID NO: 343569 - RNA, 22 nt, Homo sapiens
agaaagugcuucccuuugguga

SEQ ID NO: 343570 - RNA, 20 nt, Homo sapiens
agaagcauugcucucuucag

SEQ ID NO: 343571 - RNA, 19 nt, Homo sapiens
agaagugcauggucuagag

SEQ ID NO: 343572 - RNA, 22 nt, Homo sapiens
agaagugcuggguucaggcugg

SEQ ID NO: 343573 - RNA, 19 nt, Homo sapiens
agaaucuaaauuauuucug

SEQ ID NO: 343574 - RNA, 22 nt, Homo sapiens
agaaugugaacaucuugaaagu

SEQ ID NO: 343575 - RNA, 22 nt, Homo sapiens
agaaugugaccuuauuuggaga

SEQ ID NO: 343576 - RNA, 22 nt, Homo sapiens
agacacuguugaaaaggcccca

SEQ ID NO: 343577 - RNA, 22 nt, Homo sapiens
agacaucauuugauggugggag

SEQ ID NO: 343578 - RNA, 22 nt, Homo sapiens
agacuagagcagagcccucucu

SEQ ID NO: 343579 - RNA, 20 nt, Homo sapiens
agacuagggagcagaaagcc

SEQ ID NO: 343580 - RNA, 22 nt, Homo sapiens
agacucauuuuuaucgagcaug

SEQ ID NO: 343581 - RNA, 22 nt, Homo sapiens
agagaacugauucagggaaaau

SEQ ID NO: 343582 - RNA, 22 nt, Homo sapiens
agagacauugcuccaacucacc

SEQ ID NO: 343583 - RNA, 22 nt, Homo sapiens
agagagcuugggguguuaaauu

SEQ ID NO: 343584 - RNA, 22 nt, Homo sapiens
agagguaagaauaguaguugga

SEQ ID NO: 343585 - RNA, 22 nt, Homo sapiens
agaggucuuaucaaacaugcuu

SEQ ID NO: 343586 - RNA, 22 nt, Homo sapiens
agaguauagcaacuuaguaaaa

SEQ ID NO: 343587 - RNA, 22 nt, Homo sapiens
gugcaaauuccagcucaacucc

SEQ ID NO: 343588 - RNA, 22 nt, Homo sapiens
gugcacaacaugcaguuuuguu

SEQ ID NO: 343589 - RNA, 22 nt, Homo sapiens
gugcacaacguguagguuuguu

SEQ ID NO: 343590 - RNA, 22 nt, Homo sapiens
gugcacaucuguguuccagcua

SEQ ID NO: 343591 - RNA, 22 nt, Homo sapiens
gugcagaugucuuuauaguagc

SEQ ID NO: 343592 - RNA, 22 nt, Homo sapiens
gugccacaguguuaagggauuc

SEQ ID NO: 343593 - RNA, 22 nt, Homo sapiens
gugccuucuagcuaugguuggc

SEQ ID NO: 343594 - RNA, 22 nt, Homo sapiens
gugccuuuucugagcaaugagc

SEQ ID NO: 343595 - RNA, 16 nt, Homo sapiens
gugcuguguuguuagg

SEQ ID NO: 343596 - RNA, 22 nt, Homo sapiens
gugcuuguguuaauauguagcu

SEQ ID NO: 343597 - RNA, 22 nt, Homo sapiens
guggcauuucccaaaguauucu

SEQ ID NO: 343598 - RNA, 22 nt, Homo sapiens
guggcuaaagauuuggaaucug

SEQ ID NO: 343599 - RNA, 22 nt, Homo sapiens
gugggaugaucacaguucacug

SEQ ID NO: 343600 - RNA, 22 nt, Homo sapiens
gugggcaaagcuaguguguaga

SEQ ID NO: 343601 - RNA, 22 nt, Homo sapiens
gugggcucguucguguuagaca

SEQ ID NO: 343602 - RNA, 22 nt, Homo sapiens
guggucagaaaucucaguggca

SEQ ID NO: 343603 - RNA, 22 nt, Homo sapiens
gugguucuagaauugaguaucc

SEQ ID NO: 343604 - RNA, 18 nt, Homo sapiens
guguauggauggaggcca

SEQ ID NO: 343605 - RNA, 22 nt, Homo sapiens
guguauucaucuggcugaggua

SEQ ID NO: 343606 - RNA, 22 nt, Homo sapiens
gugucaguggggagugaucuuc

SEQ ID NO: 343607 - RNA, 22 nt, Homo sapiens
gugucaugggcauguccuuaac

SEQ ID NO: 343608 - RNA, 21 nt, Homo sapiens
gugucaugguugacuuuggca

SEQ ID NO: 343609 - RNA, 22 nt, Homo sapiens
gugucccagugugcauacaggu

SEQ ID NO: 343610 - RNA, 22 nt, Homo sapiens
gugugcaugucuuuuuaguagg

SEQ ID NO: 343611 - RNA, 22 nt, Homo sapiens
guguggcaggugggggcucaga

SEQ ID NO: 343612 - RNA, 22 nt, Homo sapiens
guguuauuuugcugggaaugau

SEQ ID NO: 343613 - RNA, 22 nt, Homo sapiens
guguucaaauucugacagagag

SEQ ID NO: 343614 - RNA, 22 nt, Homo sapiens
guuaaugcuggaauaaguuaag

SEQ ID NO: 343615 - RNA, 22 nt, Homo sapiens
guuaugcagcaauugauaaucu

SEQ ID NO: 343616 - RNA, 22 nt, Homo sapiens
guuauguuaaauuguuguaugc

SEQ ID NO: 343617 - RNA, 22 nt, Homo sapiens
guuauuaguugauauuaaguuc

SEQ ID NO: 343618 - RNA, 20 nt, Homo sapiens
guucacagagguuaugauua

SEQ ID NO: 343619 - RNA, 20 nt, Homo sapiens
guucacaggcuuccuuucag

SEQ ID NO: 343620 - RNA, 22 nt, Homo sapiens
guucacagugguugccuuccag

SEQ ID NO: 343621 - RNA, 22 nt, Homo sapiens
guucacaguucagccuguaaca

SEQ ID NO: 343622 - RNA, 23 nt, Homo sapiens
guucaucagggauauuggccuga

SEQ ID NO: 343623 - RNA, 22 nt, Homo sapiens
guugcacagucuuuccuggacu

SEQ ID NO: 343624 - RNA, 22 nt, Homo sapiens
uaaacugucuuuggagcuuugc

SEQ ID NO: 343625 - RNA, 21 nt, Homo sapiens
uaaagcuuagcuauaguggcu

SEQ ID NO: 343626 - RNA, 21 nt, Homo sapiens
uaaaggcuccaauuauacccc

SEQ ID NO: 343627 - RNA, 22 nt, Homo sapiens
uaaaugcuugagaugauggaua

SEQ ID NO: 343628 - RNA, 22 nt, Homo sapiens
uaacagcauuugugucuaguag

SEQ ID NO: 343629 - RNA, 22 nt, Homo sapiens
uaacagucuccucaagguguug

SEQ ID NO: 343630 - RNA, 22 nt, Homo sapiens
uaacaguguauuccuuuggaca

SEQ ID NO: 343631 - RNA, 22 nt, Homo sapiens
uaacccagugucugugaugggu

SEQ ID NO: 343632 - RNA, 22 nt, Homo sapiens
uaacuagaaaggagacaguugc

SEQ ID NO: 343633 - RNA, 22 nt, Homo sapiens
uaacucugccuagugacauggu

SEQ ID NO: 343634 - RNA, 22 nt, Homo sapiens
uaagaauucuguccgguauacu

SEQ ID NO: 343635 - RNA, 20 nt, Homo sapiens
uaagacaugguccacaugcc

SEQ ID NO: 343636 - RNA, 16 nt, Homo sapiens
uaagccccacgugcau

SEQ ID NO: 343637 - RNA, 22 nt, Homo sapiens
uaagcuauagugaauaaauugc

SEQ ID NO: 343638 - RNA, 22 nt, Homo sapiens
uaaggaaggcugugugcuuuua

SEQ ID NO: 343639 - RNA, 22 nt, Homo sapiens
uaaggcacuacuuuaggcuuuc

SEQ ID NO: 343640 - RNA, 22 nt, Homo sapiens
uaaggcuuaugguaaaguccug

SEQ ID NO: 343641 - RNA, 22 nt, Homo sapiens
uaaggcuugcuucagucuugaa

SEQ ID NO: 343642 - RNA, 22 nt, Homo sapiens
uaaguaauugugguuuuugcca

SEQ ID NO: 343643 - RNA, 22 nt, Homo sapiens
uaagugaauauggacaguuagc

SEQ ID NO: 343644 - RNA, 22 nt, Homo sapiens
uaauagagucauuauuauuguu

SEQ ID NO: 343645 - RNA, 22 nt, Homo sapiens
uaauaguuggcacuggagaaag

SEQ ID NO: 343646 - RNA, 22 nt, Homo sapiens
uaauaguuucagaaguuguuuu

SEQ ID NO: 343647 - RNA, 22 nt, Homo sapiens
uaauauguuuugaaaucaggaa

SEQ ID NO: 343648 - RNA, 22 nt, Homo sapiens
uaauccuggcacuuugggaggc

SEQ ID NO: 343649 - RNA, 22 nt, Homo sapiens
uaauccugucuugaccaucagg

SEQ ID NO: 343650 - RNA, 22 nt, Homo sapiens
uacaaagcuuucugcaaaucau

SEQ ID NO: 343651 - RNA, 22 nt, Homo sapiens
uacaaagugggaaacgaagguu

SEQ ID NO: 343652 - RNA, 22 nt, Homo sapiens
uacaaaucuagguuuguuacug

SEQ ID NO: 343653 - RNA, 22 nt, Homo sapiens
uacaacacugguucgacaugug

SEQ ID NO: 343654 - RNA, 21 nt, Homo sapiens
uacaagcuguagcacaugcca

SEQ ID NO: 343655 - RNA, 22 nt, Homo sapiens
uacagccacauaauguaugauu

SEQ ID NO: 343656 - RNA, 22 nt, Homo sapiens
uacagguaugugucuauauaca

SEQ ID NO: 343657 - RNA, 22 nt, Homo sapiens
uacagucuagaggagaaucagg

SEQ ID NO: 343658 - RNA, 22 nt, Homo sapiens
uacaguggugugaucucagcuc

SEQ ID NO: 343659 - RNA, 22 nt, Homo sapiens
uacaugcaugggcaugugugca

SEQ ID NO: 343660 - RNA, 22 nt, Homo sapiens
uaccacaggcuggguaaucuau

SEQ ID NO: 343661 - RNA, 22 nt, Homo sapiens
uaccagcauuucucuuuaagua

SEQ ID NO: 343662 - RNA, 22 nt, Homo sapiens
uacucacauucuguuucuugcu

SEQ ID NO: 343663 - RNA, 22 nt, Homo sapiens
uacucaguaagugcuggcugcu

SEQ ID NO: 343664 - RNA, 20 nt, Homo sapiens
uacugcacuccaaccuaggc

SEQ ID NO: 343665 - RNA, 22 nt, Homo sapiens
uacugcacuccacccuggguga

SEQ ID NO: 343666 - RNA, 22 nt, Homo sapiens
uacugcacuccagccugggaga

SEQ ID NO: 343667 - RNA, 22 nt, Homo sapiens
uacugcacuccagccuggguga

SEQ ID NO: 343668 - RNA, 22 nt, Homo sapiens
uacugcacuccaggcucaccug

SEQ ID NO: 343669 - RNA, 20 nt, Homo sapiens
uacugcacuccauccugggu

SEQ ID NO: 343670 - RNA, 22 nt, Homo sapiens
uacugcacuugaccuccugggc

SEQ ID NO: 343671 - RNA, 22 nt, Homo sapiens
uacugcauucuccgccuccggg

SEQ ID NO: 343672 - RNA, 21 nt, Homo sapiens
uacuggagauacagucugcaa

SEQ ID NO: 343673 - RNA, 22 nt, Homo sapiens
uacuuagagacaugcagcacug

SEQ ID NO: 343674 - RNA, 22 nt, Homo sapiens
aaaugcuucuauguggcauguu

SEQ ID NO: 343675 - RNA, 22 nt, Homo sapiens
aaauucaucaaaugguuuguau

SEQ ID NO: 343676 - RNA, 22 nt, Homo sapiens
aaauugcaguuaggaugauggu

SEQ ID NO: 343677 - RNA, 22 nt, Homo sapiens
aacagaauccucuuuuccuggg

SEQ ID NO: 343678 - RNA, 22 nt, Homo sapiens
aacagcuaguaccaauccacua

SEQ ID NO: 343679 - RNA, 22 nt, Homo sapiens
aacaguaucuaacgagugauga

SEQ ID NO: 343680 - RNA, 22 nt, Homo sapiens
aacagucaauugcugaugaccu

SEQ ID NO: 343681 - RNA, 22 nt, Homo sapiens
aacagugccugucauuuaguag

SEQ ID NO: 343682 - RNA, 22 nt, Homo sapiens
aacauguuuagcagauaccugu

SEQ ID NO: 343683 - RNA, 20 nt, Homo sapiens
aaccccuauagagaaaccau

SEQ ID NO: 343684 - RNA, 22 nt, Homo sapiens
aaccuacauucuuaacuguugc

SEQ ID NO: 343685 - RNA, 22 nt, Homo sapiens
aaccuucauuccuuucccugcc

SEQ ID NO: 343686 - RNA, 22 nt, Homo sapiens
aacuacaucucuuugaggcagg

SEQ ID NO: 343687 - RNA, 22 nt, Homo sapiens
aacuaugucaaauaaaaugagg

SEQ ID NO: 343688 - RNA, 22 nt, Homo sapiens
aacugcacuaggacagguuuuu

SEQ ID NO: 343689 - RNA, 22 nt, Homo sapiens
aacugggcaagcauuacauggu

SEQ ID NO: 343690 - RNA, 21 nt, Homo sapiens
aacuggugugagaugguaugu

SEQ ID NO: 343691 - RNA, 20 nt, Homo sapiens
aagacacuguccccacugga

SEQ ID NO: 343692 - RNA, 22 nt, Homo sapiens
aagacuguaauccaucuugagu

SEQ ID NO: 343693 - RNA, 22 nt, Homo sapiens
aagagagccagcugguauauuu

SEQ ID NO: 343694 - RNA, 20 nt, Homo sapiens
aagagcucaccagaauaucu

SEQ ID NO: 343695 - RNA, 22 nt, Homo sapiens
aagaugauguucuuuuucuuag

SEQ ID NO: 343696 - RNA, 22 nt, Homo sapiens
aagaugcagucauacuggagua

SEQ ID NO: 343697 - RNA, 22 nt, Homo sapiens
aagaugguauuucauuaguuuu

SEQ ID NO: 343698 - RNA, 22 nt, Homo sapiens
aagcaccaauaggagauuuguc

SEQ ID NO: 343699 - RNA, 22 nt, Homo sapiens
aagcaucauuuggaauuugaga

SEQ ID NO: 343700 - RNA, 22 nt, Homo sapiens
aagcuaccauuuguauauaaag

SEQ ID NO: 343701 - RNA, 22 nt, Homo sapiens
aaggaauacuggugguugcuau

SEQ ID NO: 343702 - RNA, 22 nt, Homo sapiens
aaggagcuuaagugacuuguac

SEQ ID NO: 343703 - RNA, 22 nt, Homo sapiens
aaggagugugauucuucaguuu

SEQ ID NO: 343704 - RNA, 22 nt, Homo sapiens
aaggcaagauacugguugcuga

SEQ ID NO: 343705 - RNA, 22 nt, Homo sapiens
aaggcaauuuguugugaggauu

SEQ ID NO: 343706 - RNA, 22 nt, Homo sapiens
aaggcagucacuaaauagugag

SEQ ID NO: 343707 - RNA, 22 nt, Homo sapiens
aaggcagugugcacauaacacu

SEQ ID NO: 343708 - RNA, 22 nt, Homo sapiens
aaggcauggugacuauuuaggc

SEQ ID NO: 343709 - RNA, 22 nt, Homo sapiens
aaggucauugugguuuuugcca

SEQ ID NO: 343710 - RNA, 22 nt, Homo sapiens
aaggugcucucuuauguagaaa

SEQ ID NO: 343711 - RNA, 21 nt, Homo sapiens
aagguuuuuagugcuugacuu

SEQ ID NO: 343712 - RNA, 22 nt, Homo sapiens
aaguaaacauugagagacaaga

SEQ ID NO: 343713 - RNA, 22 nt, Homo sapiens
aaguaagcauccaauaaauguu

SEQ ID NO: 343714 - RNA, 22 nt, Homo sapiens
aaguaucaggaauaguuauugg

SEQ ID NO: 343715 - RNA, 22 nt, Homo sapiens
aagugaaugugcuggaauagcu

SEQ ID NO: 343716 - RNA, 22 nt, Homo sapiens
aagugagaugcaguggaguucc

SEQ ID NO: 343717 - RNA, 22 nt, Homo sapiens
aagugcucuugaaacugccuua

SEQ ID NO: 343718 - RNA, 22 nt, Homo sapiens
aagugcuguccuaccuuuggga

SEQ ID NO: 343719 - RNA, 22 nt, Homo sapiens
aagugguguuuguauuuaugca

SEQ ID NO: 343720 - RNA, 22 nt, Homo sapiens
aaguguaugaaacaguccaugg

SEQ ID NO: 343721 - RNA, 22 nt, Homo sapiens
aagugucuuaccgggagggagu

SEQ ID NO: 343722 - RNA, 23 nt, Homo sapiens
aaguucaugcucaucuguuacac

SEQ ID NO: 343723 - RNA, 22 nt, Homo sapiens
aauacugaaaguauuuucaaau

SEQ ID NO: 343724 - RNA, 22 nt, Homo sapiens
aauacugagaugugagguacua

SEQ ID NO: 343725 - RNA, 22 nt, Homo sapiens
aauagcuguuuuuaauuccugc

SEQ ID NO: 343726 - RNA, 22 nt, Homo sapiens
aauaucuguguauagauggggg

SEQ ID NO: 343727 - RNA, 22 nt, Homo sapiens
aauaugguuuuaugaagcaauu

SEQ ID NO: 343728 - RNA, 22 nt, Homo sapiens
aaucacacuugauguugagcaa

SEQ ID NO: 343729 - RNA, 22 nt, Homo sapiens
aaucacguagcaguagggagaa

SEQ ID NO: 343730 - RNA, 22 nt, Homo sapiens
aaucacuuugcuacaaggcagu

SEQ ID NO: 343731 - RNA, 22 nt, Homo sapiens
aauccauuugccgucuauccau

SEQ ID NO: 343732 - RNA, 22 nt, Homo sapiens
aaucccuuuguccagucucuuu

SEQ ID NO: 343733 - RNA, 22 nt, Homo sapiens
aaucugucuuuuguuauugagg

SEQ ID NO: 343734 - RNA, 22 nt, Homo sapiens
aaugacugugauauuuuucuuc

SEQ ID NO: 343735 - RNA, 22 nt, Homo sapiens
aaugcacauaaaauccuccagg

SEQ ID NO: 343736 - RNA, 22 nt, Homo sapiens
aaugcaucuagaaaggugaauu

SEQ ID NO: 343737 - RNA, 22 nt, Homo sapiens
aaugccacugugccugccaagg

SEQ ID NO: 343738 - RNA, 22 nt, Homo sapiens
aaugccaucagagaaaacucuu

SEQ ID NO: 343739 - RNA, 22 nt, Homo sapiens
aaugucaucuucaguuguacag

SEQ ID NO: 343740 - RNA, 22 nt, Homo sapiens
aauuaguugaaagucugcuuuu

SEQ ID NO: 343741 - RNA, 22 nt, Homo sapiens
acaaaguaggcagugggcugga

SEQ ID NO: 343742 - RNA, 17 nt, Homo sapiens
acaaauugccagcuagg

SEQ ID NO: 343743 - RNA, 22 nt, Homo sapiens
acaacaguuuuaucaccccaga

SEQ ID NO: 343744 - RNA, 22 nt, Homo sapiens
acaagcacaaaugcauagaugg

SEQ ID NO: 343745 - RNA, 22 nt, Homo sapiens
acaauggaauggaguggaaagu

SEQ ID NO: 343746 - RNA, 22 nt, Homo sapiens
acaauguauauuuuacuguagg

SEQ ID NO: 343747 - RNA, 22 nt, Homo sapiens
acacacgugcauguaugcguau

SEQ ID NO: 343748 - RNA, 22 nt, Homo sapiens
acacagugucuguguauuuaaa

SEQ ID NO: 343749 - RNA, 22 nt, Homo sapiens
acacuggguaacauaucuguua

SEQ ID NO: 343750 - RNA, 22 nt, Homo sapiens
acacugucaugucucacaggca

SEQ ID NO: 343751 - RNA, 22 nt, Homo sapiens
acacuguccaguuaggcuacau

SEQ ID NO: 343752 - RNA, 22 nt, Homo sapiens
acacugucugaugaaaguaguu

SEQ ID NO: 343753 - RNA, 22 nt, Homo sapiens
acacuguuggugggaguguaaa

SEQ ID NO: 343754 - RNA, 22 nt, Homo sapiens
acacuuucuggagcugcacaua

SEQ ID NO: 343755 - RNA, 22 nt, Homo sapiens
acagcacugccaagugacccau

SEQ ID NO: 343756 - RNA, 20 nt, Homo sapiens
acagcacugguuucaagcaa

SEQ ID NO: 343757 - RNA, 22 nt, Homo sapiens
acaggagugggauuugaguccu

SEQ ID NO: 343758 - RNA, 22 nt, Homo sapiens
acaggguuauuguaauaaugua

SEQ ID NO: 343759 - RNA, 22 nt, Homo sapiens
acagucacaauuuguaccuuuu

SEQ ID NO: 343760 - RNA, 22 nt, Homo sapiens
acagugcuucugauaugaugcc

SEQ ID NO: 343761 - RNA, 22 nt, Homo sapiens
acagugcuuuuguuccucuccu

SEQ ID NO: 343762 - RNA, 22 nt, Homo sapiens
cagggcaugugggucuauuggc

SEQ ID NO: 343763 - RNA, 22 nt, Homo sapiens
caggugguauuugguuuucugu

SEQ ID NO: 343764 - RNA, 22 nt, Homo sapiens
caguagcaugccucagaaugag

SEQ ID NO: 343765 - RNA, 20 nt, Homo sapiens
cagucaugaagaacugugag

SEQ ID NO: 343766 - RNA, 22 nt, Homo sapiens
cagugcauguggcacucuccag

SEQ ID NO: 343767 - RNA, 22 nt, Homo sapiens
cagugguuuuuagcuugcuggg

SEQ ID NO: 343768 - RNA, 22 nt, Homo sapiens
cauaaagauggaggaggccagg

SEQ ID NO: 343769 - RNA, 22 nt, Homo sapiens
caucacacuuggauguaagaca

SEQ ID NO: 343770 - RNA, 22 nt, Homo sapiens
caucacaguacuaaucgucaua

SEQ ID NO: 343771 - RNA, 22 nt, Homo sapiens
caucacuuuuccuuuuacagau

SEQ ID NO: 343772 - RNA, 22 nt, Homo sapiens
caucagcaauguaugaggguuc

SEQ ID NO: 343773 - RNA, 22 nt, Homo sapiens
cauccccugcaccaaccuuuac

SEQ ID NO: 343774 - RNA, 22 nt, Homo sapiens
cauggccuuuggaaugugucua

SEQ ID NO: 343775 - RNA, 22 nt, Homo sapiens
cauggcuacugcagauguaggg

SEQ ID NO: 343776 - RNA, 22 nt, Homo sapiens
cauuaguugaagugcagggaga

SEQ ID NO: 343777 - RNA, 22 nt, Homo sapiens
cauugcaacuucugccucccag

SEQ ID NO: 343778 - RNA, 22 nt, Homo sapiens
cauugcacuccagccuagccaa

SEQ ID NO: 343779 - RNA, 22 nt, Homo sapiens
cauugcacuccagccugaguga

SEQ ID NO: 343780 - RNA, 22 nt, Homo sapiens
cauugcacuccagccugcugac

SEQ ID NO: 343781 - RNA, 22 nt, Homo sapiens
cauugcacuccagccuggcaac

SEQ ID NO: 343782 - RNA, 22 nt, Homo sapiens
cauugcacuccagcuugggcaa

SEQ ID NO: 343783 - RNA, 22 nt, Homo sapiens
cauugcacuccauccuuggcaa

SEQ ID NO: 343784 - RNA, 22 nt, Homo sapiens
cauugcacucuagccucggcaa

SEQ ID NO: 343785 - RNA, 22 nt, Homo sapiens
cauugcacucuagucuggguga

SEQ ID NO: 343786 - RNA, 22 nt, Homo sapiens
ccaagccucaguuucccucugu

SEQ ID NO: 343787 - RNA, 22 nt, Homo sapiens
ccaccuguacuuaagucacuuu

SEQ ID NO: 343788 - RNA, 22 nt, Homo sapiens
ccagaguuucugauucagcagg

SEQ ID NO: 343789 - RNA, 22 nt, Homo sapiens
ccagauguuuucauucagcaag

SEQ ID NO: 343790 - RNA, 22 nt, Homo sapiens
ccaggguuccacgccuggcugu

SEQ ID NO: 343791 - RNA, 22 nt, Homo sapiens
ccaguauugaacacaaugaaag

SEQ ID NO: 343792 - RNA, 22 nt, Homo sapiens
ccaguauuuuauugaggguuuu

SEQ ID NO: 343793 - RNA, 21 nt, Homo sapiens
ccagugguuggaaacuauggg

SEQ ID NO: 343794 - RNA, 17 nt, Homo sapiens
ccaguuuucccucagug

SEQ ID NO: 343795 - RNA, 22 nt, Homo sapiens
ccaugaacuagaauagaacaug

SEQ ID NO: 343796 - RNA, 19 nt, Homo sapiens
ccauggcaaugaucugaug

SEQ ID NO: 343797 - RNA, 21 nt, Homo sapiens
ccauggcaaugguaaacugac

SEQ ID NO: 343798 - RNA, 22 nt, Homo sapiens
ccauggcuucugcauucuguca

SEQ ID NO: 343799 - RNA, 22 nt, Homo sapiens
ccauugaacaugaaggaaugug

SEQ ID NO: 343800 - RNA, 22 nt, Homo sapiens
cccagaguucuuaaauacugag

SEQ ID NO: 343801 - RNA, 22 nt, Homo sapiens
cccagugugcugggugacagcu

SEQ ID NO: 343802 - RNA, 22 nt, Homo sapiens
cccauuguuaaguugaguaucu

SEQ ID NO: 343803 - RNA, 20 nt, Homo sapiens
ccccaguuuuucuauuagcu

SEQ ID NO: 343804 - RNA, 22 nt, Homo sapiens
ccccauuugaacuccuucaacu

SEQ ID NO: 343805 - RNA, 22 nt, Homo sapiens
ccccguuacagccucagugccu

SEQ ID NO: 343806 - RNA, 17 nt, Homo sapiens
cccuaguagcugggacu

SEQ ID NO: 343807 - RNA, 22 nt, Homo sapiens
cccugagaaaacuuuguccuua

SEQ ID NO: 343808 - RNA, 22 nt, Homo sapiens
cccugagaugugaauuucagag

SEQ ID NO: 343809 - RNA, 22 nt, Homo sapiens
ccucauggagaacaucugcuag

SEQ ID NO: 343810 - RNA, 21 nt, Homo sapiens
ccuccauuuguauucuugccc

SEQ ID NO: 343811 - RNA, 22 nt, Homo sapiens
ccugagacuugagggggcuucu

SEQ ID NO: 343812 - RNA, 19 nt, Homo sapiens
ccugcuguucuuuugcacc

SEQ ID NO: 343813 - RNA, 22 nt, Homo sapiens
ccuuuuugaguugccagaguuc

SEQ ID NO: 343814 - RNA, 22 nt, Homo sapiens
cggcaguggguaagccaagcuu

SEQ ID NO: 343815 - RNA, 20 nt, Homo sapiens
cguugcacuccagccugggc

SEQ ID NO: 343816 - RNA, 22 nt, Homo sapiens
cuaaaguucuucugagagaaca

SEQ ID NO: 343817 - RNA, 22 nt, Homo sapiens
cuaaaugucucuacuaaguuua

SEQ ID NO: 343818 - RNA, 22 nt, Homo sapiens
cuaacacagggcaagucaggcu

SEQ ID NO: 343819 - RNA, 22 nt, Homo sapiens
cuaacuaugucucaggaugucc

SEQ ID NO: 343820 - RNA, 22 nt, Homo sapiens
cuacaguagagaggauguagaa

SEQ ID NO: 343821 - RNA, 22 nt, Homo sapiens
cuacaguaugaaaccuuuacuc

SEQ ID NO: 343822 - RNA, 22 nt, Homo sapiens
cuagaauguauaaaaccaagcu

SEQ ID NO: 343823 - RNA, 22 nt, Homo sapiens
cuagauuauccaacuuauuagc

SEQ ID NO: 343824 - RNA, 22 nt, Homo sapiens
cuagcagaacaauacaauucgg

SEQ ID NO: 343825 - RNA, 22 nt, Homo sapiens
cuagcagacaugggcugaacca

SEQ ID NO: 343826 - RNA, 22 nt, Homo sapiens
cuagcuuuugauguaaagugag

SEQ ID NO: 343827 - RNA, 22 nt, Homo sapiens
cuaggugauccacugcucucuu

SEQ ID NO: 343828 - RNA, 22 nt, Homo sapiens
cuaggugcaugagccguacagu

SEQ ID NO: 343829 - RNA, 22 nt, Homo sapiens
cuagugcaguuccccugucuua

SEQ ID NO: 343830 - RNA, 22 nt, Homo sapiens
cuauaacagugugguuuggaga

SEQ ID NO: 343831 - RNA, 22 nt, Homo sapiens
cuaugcauuuuggaggagggaa

SEQ ID NO: 343832 - RNA, 22 nt, Homo sapiens
cuaugucuuucauauuuugggg

SEQ ID NO: 343833 - RNA, 22 nt, Homo sapiens
cuauucacaauggugaagauau

SEQ ID NO: 343834 - RNA, 20 nt, Homo sapiens
cuauugacauuuggggcuag

SEQ ID NO: 343835 - RNA, 22 nt, Homo sapiens
cucaauuuggaauugucaguaa

SEQ ID NO: 343836 - RNA, 22 nt, Homo sapiens
cucagcuacuugagaggcuuag

SEQ ID NO: 343837 - RNA, 22 nt, Homo sapiens
cucagggugguggacucuaaua

SEQ ID NO: 343838 - RNA, 20 nt, Homo sapiens
cucagguauuugaggcugca

SEQ ID NO: 343839 - RNA, 22 nt, Homo sapiens
cucagugucuggggccccaggg

SEQ ID NO: 343840 - RNA, 22 nt, Homo sapiens
cucaguguuucagcugcucaga

SEQ ID NO: 343841 - RNA, 22 nt, Homo sapiens
cucccauugcaaacaacagaag

SEQ ID NO: 343842 - RNA, 20 nt, Homo sapiens
cuccuucauuccuuuggacc

SEQ ID NO: 343843 - RNA, 22 nt, Homo sapiens
cucucaagaugcugggauuaca

SEQ ID NO: 343844 - RNA, 22 nt, Homo sapiens
cucucaguguggaggccagaaa

SEQ ID NO: 343845 - RNA, 21 nt, Homo sapiens
cucucugcuuaugaauaguga

SEQ ID NO: 343846 - RNA, 22 nt, Homo sapiens
cucugagguuauucguaauauu

SEQ ID NO: 343847 - RNA, 22 nt, Homo sapiens
cucuuugaguuccuccuggugu

SEQ ID NO: 343848 - RNA, 22 nt, Homo sapiens
cugaaagagcauguaacacagu

SEQ ID NO: 343849 - RNA, 22 nt, Homo sapiens
cugaaaguuauucaggggcaag

SEQ ID NO: 343850 - RNA, 20 nt, Homo sapiens
uggaccagagagguggggac

SEQ ID NO: 343851 - RNA, 22 nt, Homo sapiens
uggaccccuucuccuauuaaaa

SEQ ID NO: 343852 - RNA, 21 nt, Homo sapiens
uggaccccuuucuuacaccgu

SEQ ID NO: 343853 - RNA, 22 nt, Homo sapiens
uggagaacauucauuugcaaga

SEQ ID NO: 343854 - RNA, 22 nt, Homo sapiens
uggagagucauuuauaguauuu

SEQ ID NO: 343855 - RNA, 22 nt, Homo sapiens
uggagcccuaaacuucuaauau

SEQ ID NO: 343856 - RNA, 22 nt, Homo sapiens
uggagugaaaacacacuaaucu

SEQ ID NO: 343857 - RNA, 22 nt, Homo sapiens
uggagugcaauggugagaucuu

SEQ ID NO: 343858 - RNA, 20 nt, Homo sapiens
uggagugcuguguugagaag

SEQ ID NO: 343859 - RNA, 22 nt, Homo sapiens
uggaguuugacaugccuuuggg

SEQ ID NO: 343860 - RNA, 22 nt, Homo sapiens
uggauagaaauguacuguuuuc

SEQ ID NO: 343861 - RNA, 22 nt, Homo sapiens
uggauggagaggcuugugaugc

SEQ ID NO: 343862 - RNA, 22 nt, Homo sapiens
uggauggugauuggaucaugga

SEQ ID NO: 343863 - RNA, 18 nt, Homo sapiens
uggauuggaaaaguuccu

SEQ ID NO: 343864 - RNA, 22 nt, Homo sapiens
uggcaaaaaaccgcaguugccu

SEQ ID NO: 343865 - RNA, 22 nt, Homo sapiens
uggcaaauauuuuguuuuguaa

SEQ ID NO: 343866 - RNA, 22 nt, Homo sapiens
uggcaaaugugagaugagaacu

SEQ ID NO: 343867 - RNA, 21 nt, Homo sapiens
uggcaacauggauggauucug

SEQ ID NO: 343868 - RNA, 22 nt, Homo sapiens
uggcaagaacgaaauguagggu

SEQ ID NO: 343869 - RNA, 22 nt, Homo sapiens
uggcaagaaggauuuauuccuu

SEQ ID NO: 343870 - RNA, 19 nt, Homo sapiens
uggcacauguauacauaug

SEQ ID NO: 343871 - RNA, 22 nt, Homo sapiens
uggcagaugcucuuggugccca

SEQ ID NO: 343872 - RNA, 22 nt, Homo sapiens
uggcaguuuacaaaugccauga

SEQ ID NO: 343873 - RNA, 22 nt, Homo sapiens
uggcaguuucauaugguucaac

SEQ ID NO: 343874 - RNA, 22 nt, Homo sapiens
uggcauggggcagaacauuaca

SEQ ID NO: 343875 - RNA, 22 nt, Homo sapiens
uggcauuguccaauaaaauuuu

SEQ ID NO: 343876 - RNA, 22 nt, Homo sapiens
uggcauuuucucuguucuuaga

SEQ ID NO: 343877 - RNA, 22 nt, Homo sapiens
uggcauuuugugugaauuagaa

SEQ ID NO: 343878 - RNA, 22 nt, Homo sapiens
uggcuaaguuaaucaaggagau

SEQ ID NO: 343879 - RNA, 21 nt, Homo sapiens
uggcuguuuucaugcuagaac

SEQ ID NO: 343880 - RNA, 22 nt, Homo sapiens
uggcuuuguaagguuucauuuu

SEQ ID NO: 343881 - RNA, 22 nt, Homo sapiens
ugggaacaugaagguuaaagag

SEQ ID NO: 343882 - RNA, 22 nt, Homo sapiens
ugggaucauuaugcauagugua

SEQ ID NO: 343883 - RNA, 22 nt, Homo sapiens
ugggaucauucaaugacgaaau

SEQ ID NO: 343884 - RNA, 22 nt, Homo sapiens
ugggcaaauugugagggaggua

SEQ ID NO: 343885 - RNA, 22 nt, Homo sapiens
ugggcuagaugcuuugggguca

SEQ ID NO: 343886 - RNA, 23 nt, Homo sapiens
ugggucaguuuuucugacaucau

SEQ ID NO: 343887 - RNA, 22 nt, Homo sapiens
uggguccccuacucuuuccaca

SEQ ID NO: 343888 - RNA, 22 nt, Homo sapiens
ugggugaguaucuauuauucag

SEQ ID NO: 343889 - RNA, 22 nt, Homo sapiens
ugguauguaugauuaacaugga

SEQ ID NO: 343890 - RNA, 22 nt, Homo sapiens
ugguauuuaauauaugagaguu

SEQ ID NO: 343891 - RNA, 19 nt, Homo sapiens
uggucaguucugggagcug

SEQ ID NO: 343892 - RNA, 21 nt, Homo sapiens
uggucaguuuucucacuagga

SEQ ID NO: 343893 - RNA, 19 nt, Homo sapiens
uggucccccgcaaucucau

SEQ ID NO: 343894 - RNA, 22 nt, Homo sapiens
uggucuccuuuguacccugggc

SEQ ID NO: 343895 - RNA, 22 nt, Homo sapiens
ugguguccugucucugcgcuug

SEQ ID NO: 343896 - RNA, 22 nt, Homo sapiens
uguaaaucuuucacaguugaug

SEQ ID NO: 343897 - RNA, 16 nt, Homo sapiens
uguaaauguuuugcau

SEQ ID NO: 343898 - RNA, 22 nt, Homo sapiens
uguaauguuucaucauuauuaa

SEQ ID NO: 343899 - RNA, 22 nt, Homo sapiens
uguagcaaaucgauacuauugg

SEQ ID NO: 343900 - RNA, 22 nt, Homo sapiens
uguagucauuugaaggaugucc

SEQ ID NO: 343901 - RNA, 22 nt, Homo sapiens
uguauacauauguauguuuugu

SEQ ID NO: 343902 - RNA, 22 nt, Homo sapiens
uguauaggcaaauuuccucaug

SEQ ID NO: 343903 - RNA, 22 nt, Homo sapiens
uguaugucuucuuuagauaagu

SEQ ID NO: 343904 - RNA, 22 nt, Homo sapiens
ugucacaguuuguacuuuauag

SEQ ID NO: 343905 - RNA, 22 nt, Homo sapiens
ugucacauccaagaaggugcag

SEQ ID NO: 343906 - RNA, 22 nt, Homo sapiens
ugucagaaucuagaggcugcua

SEQ ID NO: 343907 - RNA, 22 nt, Homo sapiens
ugucaggaguuuuagaaucuua

SEQ ID NO: 343908 - RNA, 22 nt, Homo sapiens
ugucaguguacuguaagaauua

SEQ ID NO: 343909 - RNA, 22 nt, Homo sapiens
ugucaucauuugagagaagaaa

SEQ ID NO: 343910 - RNA, 22 nt, Homo sapiens
ugucauguauauaccacuucca

SEQ ID NO: 343911 - RNA, 22 nt, Homo sapiens
ugucaugucaacuauggaauuu

SEQ ID NO: 343912 - RNA, 22 nt, Homo sapiens
ugucauguugagaaacuuggau

SEQ ID NO: 343913 - RNA, 22 nt, Homo sapiens
ugucauguugguguacugcacc

SEQ ID NO: 343914 - RNA, 22 nt, Homo sapiens
ugucauuggacuucuuucaugg

SEQ ID NO: 343915 - RNA, 22 nt, Homo sapiens
ugucauuguggugcagauauaa

SEQ ID NO: 343916 - RNA, 22 nt, Homo sapiens
uguccuguaggaggcagaacaa

SEQ ID NO: 343917 - RNA, 22 nt, Homo sapiens
ugucuaguuuugaaguauagca

SEQ ID NO: 343918 - RNA, 21 nt, Homo sapiens
ugugaaaucuaggcagagguu

SEQ ID NO: 343919 - RNA, 22 nt, Homo sapiens
ugugaacagcagcugggcuuug

SEQ ID NO: 343920 - RNA, 18 nt, Homo sapiens
ugugacauugagcauguc

SEQ ID NO: 343921 - RNA, 22 nt, Homo sapiens
ugugaccaaaaucaacauaccu

SEQ ID NO: 343922 - RNA, 19 nt, Homo sapiens
ugugacugguugucucgcu

SEQ ID NO: 343923 - RNA, 22 nt, Homo sapiens
ugugagaucucagaauugaacu

SEQ ID NO: 343924 - RNA, 22 nt, Homo sapiens
ugugaguguguacuaguuauca

SEQ ID NO: 343925 - RNA, 19 nt, Homo sapiens
ugugauaguugaaccugcc

SEQ ID NO: 343926 - RNA, 22 nt, Homo sapiens
ugugcaaucagcuucauuacau

SEQ ID NO: 343927 - RNA, 23 nt, Homo sapiens
ugugcacauuuacauauauacac

SEQ ID NO: 343928 - RNA, 22 nt, Homo sapiens
ugugcaccucuucacacaggga

SEQ ID NO: 343929 - RNA, 22 nt, Homo sapiens
ugugccacuccagcucuagcuu

SEQ ID NO: 343930 - RNA, 22 nt, Homo sapiens
ugugccacugcacuccugggug

SEQ ID NO: 343931 - RNA, 22 nt, Homo sapiens
ugugccacugcacucugggcaa

SEQ ID NO: 343932 - RNA, 22 nt, Homo sapiens
ugugcuauguuauucacauggg

SEQ ID NO: 343933 - RNA, 22 nt, Homo sapiens
uguggaguguaugugacagaga

SEQ ID NO: 343934 - RNA, 22 nt, Homo sapiens
uguggcagugcuuuaugaaacc

SEQ ID NO: 343935 - RNA, 22 nt, Homo sapiens
ugugguauuagguguaguaucu

SEQ ID NO: 343936 - RNA, 22 nt, Homo sapiens
uguggucaucacuugaagguaa

SEQ ID NO: 343937 - RNA, 22 nt, Homo sapiens
aaaugcagcacucaagugggaa

SEQ ID NO: 343938 - RNA, 22 nt, Homo sapiens
aaaugcugucaaauuguguucu

SEQ ID NO: 343939 - RNA, 22 nt, Homo sapiens
aaauggauuaaguucacuugcu

SEQ ID NO: 343940 - RNA, 22 nt, Homo sapiens
aaaugguguuaguagaucuuua

SEQ ID NO: 343941 - RNA, 19 nt, Homo sapiens
aaaugugcacuguuuucca

SEQ ID NO: 343942 - RNA, 22 nt, Homo sapiens
aaauugcauugagcugcuuauu

SEQ ID NO: 343943 - RNA, 21 nt, Homo sapiens
aacacggugaaaucccgucuc

SEQ ID NO: 343944 - RNA, 22 nt, Homo sapiens
aacacuaucugccuuacaggga

SEQ ID NO: 343945 - RNA, 22 nt, Homo sapiens
aacacuguuuccagucaugauc

SEQ ID NO: 343946 - RNA, 22 nt, Homo sapiens
aacagacugucacauaaaauug

SEQ ID NO: 343947 - RNA, 22 nt, Homo sapiens
aacagcacacccgcugcuucca

SEQ ID NO: 343948 - RNA, 22 nt, Homo sapiens
aacagugcauucagggauauau

SEQ ID NO: 343949 - RNA, 22 nt, Homo sapiens
aacagugcauuccuguccauau

SEQ ID NO: 343950 - RNA, 22 nt, Homo sapiens
aacccugagucaugagucuaga

SEQ ID NO: 343951 - RNA, 22 nt, Homo sapiens
aaccuguggauuuugguaucug

SEQ ID NO: 343952 - RNA, 22 nt, Homo sapiens
aacucugucuccuucaaguuca

SEQ ID NO: 343953 - RNA, 22 nt, Homo sapiens
aacuggccuggcgugcagaggg

SEQ ID NO: 343954 - RNA, 22 nt, Homo sapiens
aagaggccuaggaaucuguauu

SEQ ID NO: 343955 - RNA, 22 nt, Homo sapiens
aagaguuaguaaaauuuccucu

SEQ ID NO: 343956 - RNA, 22 nt, Homo sapiens
aagauauguuaguuauaaacuc

SEQ ID NO: 343957 - RNA, 22 nt, Homo sapiens
aagcagacauguucauuuugaa

SEQ ID NO: 343958 - RNA, 22 nt, Homo sapiens
aagcagauguguugaaaguacu

SEQ ID NO: 343959 - RNA, 22 nt, Homo sapiens
aagccagugugacaggaaacuu

SEQ ID NO: 343960 - RNA, 22 nt, Homo sapiens
aagcugccuugcugaggagaaa

SEQ ID NO: 343961 - RNA, 22 nt, Homo sapiens
aagcugugucuugucagcuacc

SEQ ID NO: 343962 - RNA, 22 nt, Homo sapiens
aaggaauucaaauuuucucugg

SEQ ID NO: 343963 - RNA, 22 nt, Homo sapiens
aaggagcagagagcccuguuuc

SEQ ID NO: 343964 - RNA, 22 nt, Homo sapiens
aaggcauucucaaacuaguucu

SEQ ID NO: 343965 - RNA, 22 nt, Homo sapiens
aagggaaugcgcugccuguguu

SEQ ID NO: 343966 - RNA, 22 nt, Homo sapiens
aagggagcugcauaaucuugug

SEQ ID NO: 343967 - RNA, 22 nt, Homo sapiens
aagguagguuccaaaauaccua

SEQ ID NO: 343968 - RNA, 22 nt, Homo sapiens
aagguggugucagagagcuuau

SEQ ID NO: 343969 - RNA, 22 nt, Homo sapiens
aaggugguuuucucuuggaguc

SEQ ID NO: 343970 - RNA, 22 nt, Homo sapiens
aagguguagucucuggauaagc

SEQ ID NO: 343971 - RNA, 22 nt, Homo sapiens
aaguaaauauccgguaguccca

SEQ ID NO: 343972 - RNA, 22 nt, Homo sapiens
aaguaaaucuuaugucagggag

SEQ ID NO: 343973 - RNA, 22 nt, Homo sapiens
aaguaauggaguuauuuuauga

SEQ ID NO: 343974 - RNA, 22 nt, Homo sapiens
aaguaauugagguuuuugcugu

SEQ ID NO: 343975 - RNA, 19 nt, Homo sapiens
aaguacuugucuuuugaag

SEQ ID NO: 343976 - RNA, 19 nt, Homo sapiens
aaguaguugugacagaugc

SEQ ID NO: 343977 - RNA, 22 nt, Homo sapiens
aaguauuaagacuaagaggcuu

SEQ ID NO: 343978 - RNA, 22 nt, Homo sapiens
aagugcucuugugggaagagag

SEQ ID NO: 343979 - RNA, 22 nt, Homo sapiens
aagugcuggccuacucaaucga

SEQ ID NO: 343980 - RNA, 22 nt, Homo sapiens
aagugcugggauuggccgggca

SEQ ID NO: 343981 - RNA, 22 nt, Homo sapiens
aagugcuuacagggaacaugau

SEQ ID NO: 343982 - RNA, 22 nt, Homo sapiens
aagugcuuuacacaugcaugau

SEQ ID NO: 343983 - RNA, 22 nt, Homo sapiens
aagugguguuugggagcuggac

SEQ ID NO: 343984 - RNA, 22 nt, Homo sapiens
aaguugcuuuagguaagucaau

SEQ ID NO: 343985 - RNA, 22 nt, Homo sapiens
aaguugguguaugagacagaag

SEQ ID NO: 343986 - RNA, 22 nt, Homo sapiens
aaguuguuggaguuccauuguu

SEQ ID NO: 343987 - RNA, 22 nt, Homo sapiens
aauaagaaguggaagggaccgg

SEQ ID NO: 343988 - RNA, 22 nt, Homo sapiens
aauaaugucacaggggguuagc

SEQ ID NO: 343989 - RNA, 22 nt, Homo sapiens
aauagcacuguagauggaggaa

SEQ ID NO: 343990 - RNA, 22 nt, Homo sapiens
aauagcauugaaucuaccaauu

SEQ ID NO: 343991 - RNA, 22 nt, Homo sapiens
aauagcuguccuuagaagugug

SEQ ID NO: 343992 - RNA, 22 nt, Homo sapiens
aauagugcugcaaaaacauacg

SEQ ID NO: 343993 - RNA, 22 nt, Homo sapiens
aauaucacaggguguacacuca

SEQ ID NO: 343994 - RNA, 23 nt, Homo sapiens
aauaucacaguggguguacaccc

SEQ ID NO: 343995 - RNA, 22 nt, Homo sapiens
aauaugucugcuaauuguuucu

SEQ ID NO: 343996 - RNA, 19 nt, Homo sapiens
aauauugacaguggugucu

SEQ ID NO: 343997 - RNA, 22 nt, Homo sapiens
aaucacaguuaguaagggagaa

SEQ ID NO: 343998 - RNA, 21 nt, Homo sapiens
aaucacugucuguuuccccuu

SEQ ID NO: 343999 - RNA, 22 nt, Homo sapiens
aaucugucaguuuuguguuaau

SEQ ID NO: 344000 - RNA, 22 nt, Homo sapiens
aaugcaagauguuaauuauagg

SEQ ID NO: 344001 - RNA, 22 nt, Homo sapiens
aaugcuguguuauuucaugacc

SEQ ID NO: 344002 - RNA, 22 nt, Homo sapiens
aauggcacaagacaugaagaag

SEQ ID NO: 344003 - RNA, 22 nt, Homo sapiens
aauggcacaccuagcccuaacc

SEQ ID NO: 344004 - RNA, 22 nt, Homo sapiens
aauggcucuuccuggaguugug

SEQ ID NO: 344005 - RNA, 22 nt, Homo sapiens
aauuacuucuacaccaaccuaa

SEQ ID NO: 344006 - RNA, 22 nt, Homo sapiens
aauuaguuggcugccuaugauu

SEQ ID NO: 344007 - RNA, 22 nt, Homo sapiens
aauuaguuggcugggugcggug

SEQ ID NO: 344008 - RNA, 22 nt, Homo sapiens
aauucugugagauggugcagau

SEQ ID NO: 344009 - RNA, 22 nt, Homo sapiens
aauugcacuaagcauaguccag

SEQ ID NO: 344010 - RNA, 22 nt, Homo sapiens
aauugcacuacugcacucccac

SEQ ID NO: 344011 - RNA, 22 nt, Homo sapiens
aauugcaucuguucuuugccag

SEQ ID NO: 344012 - RNA, 23 nt, Homo sapiens
aauugcuuuugaggacuuaguug

SEQ ID NO: 344013 - RNA, 21 nt, Homo sapiens
acaaagcuggagggagacugc

SEQ ID NO: 344014 - RNA, 22 nt, Homo sapiens
acaaaguguuuucugaaggccu

SEQ ID NO: 344015 - RNA, 22 nt, Homo sapiens
acaagugaauacaggauucucu

SEQ ID NO: 344016 - RNA, 22 nt, Homo sapiens
aaaagucuguagugaaagguga

SEQ ID NO: 344017 - RNA, 22 nt, Homo sapiens
aaaccaccauuacuuuugcacc

SEQ ID NO: 344018 - RNA, 15 nt, Homo sapiens
aaacccugucucaag

SEQ ID NO: 344019 - RNA, 22 nt, Homo sapiens
aaacugaucugaaggccaggcu

SEQ ID NO: 344020 - RNA, 18 nt, Homo sapiens
aaacugcuuccuuggccu

SEQ ID NO: 344021 - RNA, 22 nt, Homo sapiens
aaagcuagagaagcugcuguca

SEQ ID NO: 344022 - RNA, 20 nt, Homo sapiens
aaaggcugugagaacgagau

SEQ ID NO: 344023 - RNA, 17 nt, Homo sapiens
aaaguccuuugcuaucu

SEQ ID NO: 344024 - RNA, 22 nt, Homo sapiens
aaagucuguuuugucagagacu

SEQ ID NO: 344025 - RNA, 22 nt, Homo sapiens
aaagugcaguacuucguauauu

SEQ ID NO: 344026 - RNA, 22 nt, Homo sapiens
aaagugcuuacuaaguugccaa

SEQ ID NO: 344027 - RNA, 22 nt, Homo sapiens
aaagugcuuccuuuuugagggu

SEQ ID NO: 344028 - RNA, 22 nt, Homo sapiens
aaaguggacuaagugaauauga

SEQ ID NO: 344029 - RNA, 19 nt, Homo sapiens
aaaguguuuuaaagaggau

SEQ ID NO: 344030 - RNA, 22 nt, Homo sapiens
aaaguucugcguuagggcuaaa

SEQ ID NO: 344031 - RNA, 22 nt, Homo sapiens
aaauaguagcugaaugagggaa

SEQ ID NO: 344032 - RNA, 22 nt, Homo sapiens
aaauccaucucuuggggcauug

SEQ ID NO: 344033 - RNA, 22 nt, Homo sapiens
aaaugcagauucugcuuagguu

SEQ ID NO: 344034 - RNA, 22 nt, Homo sapiens
uguguacugcagaguauucugu

SEQ ID NO: 344035 - RNA, 22 nt, Homo sapiens
ugugucuugcuggugccugcau

SEQ ID NO: 344036 - RNA, 22 nt, Homo sapiens
uguuagguuggugcaaaaguga

SEQ ID NO: 344037 - RNA, 22 nt, Homo sapiens
uguuauguuguuugagaaaguc

SEQ ID NO: 344038 - RNA, 22 nt, Homo sapiens
uuaaaggcaugguuagacaugg

SEQ ID NO: 344039 - RNA, 22 nt, Homo sapiens
uuaaaguaauugaaauggccuu

SEQ ID NO: 344040 - RNA, 22 nt, Homo sapiens
uuaacagcacaugcugucccuu

SEQ ID NO: 344041 - RNA, 22 nt, Homo sapiens
uuaaguaaucagagaagagaac

SEQ ID NO: 344042 - RNA, 22 nt, Homo sapiens
uuaaguguaaguggugugggac

SEQ ID NO: 344043 - RNA, 21 nt, Homo sapiens
uuaaugcuaugcagaaaaucu

SEQ ID NO: 344044 - RNA, 22 nt, Homo sapiens
uuaaugcuuuugggauauuucu

SEQ ID NO: 344045 - RNA, 22 nt, Homo sapiens
uuaaugugaaucaggaugcauu

SEQ ID NO: 344046 - RNA, 22 nt, Homo sapiens
uuaauucugucugcccucaucc

SEQ ID NO: 344047 - RNA, 21 nt, Homo sapiens
uuacaauggcuccuugaaggu

SEQ ID NO: 344048 - RNA, 22 nt, Homo sapiens
uuacacaguaggucccuaguaa

SEQ ID NO: 344049 - RNA, 22 nt, Homo sapiens
uuacagucuuaggcagugcuuu

SEQ ID NO: 344050 - RNA, 22 nt, Homo sapiens
uuacaugcaugacaaggugcca

SEQ ID NO: 344051 - RNA, 22 nt, Homo sapiens
uuacauugcuucaaauucagug

SEQ ID NO: 344052 - RNA, 22 nt, Homo sapiens
uuaggcaggauaguuacauauu

SEQ ID NO: 344053 - RNA, 21 nt, Homo sapiens
uuaggcagugucagaggugag

SEQ ID NO: 344054 - RNA, 22 nt, Homo sapiens
uuaggcuuuauugaaaacaaua

SEQ ID NO: 344055 - RNA, 22 nt, Homo sapiens
uuagggcaggcaugagagaacu

SEQ ID NO: 344056 - RNA, 22 nt, Homo sapiens
uuagguagaauugauuaaguuu

SEQ ID NO: 344057 - RNA, 22 nt, Homo sapiens
uuagugaaugggugugauuugu

SEQ ID NO: 344058 - RNA, 22 nt, Homo sapiens
uuauagcagugcccaacuccug

SEQ ID NO: 344059 - RNA, 22 nt, Homo sapiens
uuauagcuaacaucugugaaaa

SEQ ID NO: 344060 - RNA, 21 nt, Homo sapiens
uuaucccagugucucugcagg

SEQ ID NO: 344061 - RNA, 22 nt, Homo sapiens
uuaugaaguagguuaagagcag

SEQ ID NO: 344062 - RNA, 22 nt, Homo sapiens
uuauggccauucuuguaggagu

SEQ ID NO: 344063 - RNA, 22 nt, Homo sapiens
uuaugguuuuuagcagaguaau

SEQ ID NO: 344064 - RNA, 22 nt, Homo sapiens
uuaugguuuuucugugagaugg

SEQ ID NO: 344065 - RNA, 22 nt, Homo sapiens
uuauuagguuaaccuauagcua

SEQ ID NO: 344066 - RNA, 22 nt, Homo sapiens
uuauugaguaaaaagaaugguu

SEQ ID NO: 344067 - RNA, 22 nt, Homo sapiens
uuauuguccaaguuucccuuug

SEQ ID NO: 344068 - RNA, 22 nt, Homo sapiens
uuauuugguuauuguaauuggg

SEQ ID NO: 344069 - RNA, 23 nt, Homo sapiens
uucaaaggaugcuuuauggaauu

SEQ ID NO: 344070 - RNA, 22 nt, Homo sapiens
uucaaaguaaagggauggagac

SEQ ID NO: 344071 - RNA, 22 nt, Homo sapiens
uucaauacuguugauccuuaug

SEQ ID NO: 344072 - RNA, 22 nt, Homo sapiens
uucacagaaaaaggcgaugagg

SEQ ID NO: 344073 - RNA, 22 nt, Homo sapiens
uucacagagagaacucaaacca

SEQ ID NO: 344074 - RNA, 22 nt, Homo sapiens
uucacagcuuaauaaggcucag

SEQ ID NO: 344075 - RNA, 22 nt, Homo sapiens
uucacagugugaucuaugggca

SEQ ID NO: 344076 - RNA, 22 nt, Homo sapiens
uucaccagggaagucucaacuc

SEQ ID NO: 344077 - RNA, 22 nt, Homo sapiens
uucacugugaacucauauucag

SEQ ID NO: 344078 - RNA, 22 nt, Homo sapiens
uucagauugcauaccgaaagua

SEQ ID NO: 344079 - RNA, 22 nt, Homo sapiens
uucagcaggccaggcccugacu

SEQ ID NO: 344080 - RNA, 22 nt, Homo sapiens
uucaggguggagaguaugaggu

SEQ ID NO: 344081 - RNA, 22 nt, Homo sapiens
uucaguaguaaguuggaacucu

SEQ ID NO: 344082 - RNA, 22 nt, Homo sapiens
uucaguggagaggcugaguggu

SEQ ID NO: 344083 - RNA, 19 nt, Homo sapiens
uucauacagugagagcagc

SEQ ID NO: 344084 - RNA, 22 nt, Homo sapiens
uucauacaguggcugcacucca

SEQ ID NO: 344085 - RNA, 22 nt, Homo sapiens
uucauagucuaugcaaguaaga

SEQ ID NO: 344086 - RNA, 22 nt, Homo sapiens
uucauaguguuuccuuccagug

SEQ ID NO: 344087 - RNA, 21 nt, Homo sapiens
uucaucagccagaaaucaagc

SEQ ID NO: 344088 - RNA, 22 nt, Homo sapiens
uucaucagcuguagaugucaug

SEQ ID NO: 344089 - RNA, 22 nt, Homo sapiens
uucaucaggaauauugaccugu

SEQ ID NO: 344090 - RNA, 20 nt, Homo sapiens
uucaucaggauauuggucua

SEQ ID NO: 344091 - RNA, 22 nt, Homo sapiens
uucaucagggguauuggccaau

SEQ ID NO: 344092 - RNA, 21 nt, Homo sapiens
uucaucuggccguauuccagg

SEQ ID NO: 344093 - RNA, 22 nt, Homo sapiens
uucaugcaucuguagugguuaa

SEQ ID NO: 344094 - RNA, 22 nt, Homo sapiens
uucauggguuaauuuguucgau

SEQ ID NO: 344095 - RNA, 22 nt, Homo sapiens
uucauggugguacaaaagcaau

SEQ ID NO: 344096 - RNA, 22 nt, Homo sapiens
uucaugugagucuguauuaacu

SEQ ID NO: 344097 - RNA, 22 nt, Homo sapiens
uucauuggacuuguguucuuga

SEQ ID NO: 344098 - RNA, 22 nt, Homo sapiens
uuccaagugggaaacaaaaaug

SEQ ID NO: 344099 - RNA, 22 nt, Homo sapiens
uuccagcugggggcaacucugc

SEQ ID NO: 344100 - RNA, 22 nt, Homo sapiens
uuccaguaauagcacagcauug

SEQ ID NO: 344101 - RNA, 22 nt, Homo sapiens
uuccaguggaguaaauggacaa

SEQ ID NO: 344102 - RNA, 22 nt, Homo sapiens
uuccauugugucaucuuggugg

SEQ ID NO: 344103 - RNA, 22 nt, Homo sapiens
uucccagugccaggcacuggga

SEQ ID NO: 344104 - RNA, 22 nt, Homo sapiens
uucccugagcaucuguugagcc

SEQ ID NO: 344105 - RNA, 22 nt, Homo sapiens
uucccuguaucuucugccaugu

SEQ ID NO: 344106 - RNA, 22 nt, Homo sapiens
uucccugugggcuggugcucca

SEQ ID NO: 344107 - RNA, 22 nt, Homo sapiens
uuccuacugcccauuaaaaugg

SEQ ID NO: 344108 - RNA, 20 nt, Homo sapiens
uuccuuaggcauuggaagaa

SEQ ID NO: 344109 - RNA, 21 nt, Homo sapiens
uucuaaguaaauguuggacau

SEQ ID NO: 344110 - RNA, 22 nt, Homo sapiens
uucuacaggcuguucaagaagc

SEQ ID NO: 344111 - RNA, 22 nt, Homo sapiens
uucuacuucauuaggaggauug

SEQ ID NO: 344112 - RNA, 22 nt, Homo sapiens
uucuagcaauggcagagugucu

SEQ ID NO: 344113 - RNA, 22 nt, Homo sapiens
uucuagcacuuugggagacuga

SEQ ID NO: 344114 - RNA, 21 nt, Homo sapiens
uucuauggucagaauucaaua

SEQ ID NO: 344115 - RNA, 22 nt, Homo sapiens
uucuauugguaauauuuucugu

SEQ ID NO: 344116 - RNA, 22 nt, Homo sapiens
uucucaauggcaacuuguugcu

SEQ ID NO: 344117 - RNA, 22 nt, Homo sapiens
uucucacaguacagggagcucu

SEQ ID NO: 344118 - RNA, 22 nt, Homo sapiens
uucucagcccccugacagucag

SEQ ID NO: 344119 - RNA, 21 nt, Homo sapiens
uucucaggguguguccuaccc

SEQ ID NO: 344120 - RNA, 22 nt, Homo sapiens
uucucaguuccuacuuugguga

SEQ ID NO: 344121 - RNA, 22 nt, Homo sapiens
auuagugaaugugaugucuuga

SEQ ID NO: 344122 - RNA, 22 nt, Homo sapiens
auuauguuguauuuccuugcag

SEQ ID NO: 344123 - RNA, 22 nt, Homo sapiens
auucaaagugcauguucccacu

SEQ ID NO: 344124 - RNA, 23 nt, Homo sapiens
auucaaguagugagagugguuau

SEQ ID NO: 344125 - RNA, 22 nt, Homo sapiens
auucaagugaugcagcuguuuu

SEQ ID NO: 344126 - RNA, 22 nt, Homo sapiens
auucagaggggcagcugucuug

SEQ ID NO: 344127 - RNA, 22 nt, Homo sapiens
auucaucagggauauugguuga

SEQ ID NO: 344128 - RNA, 20 nt, Homo sapiens
auucauggugguacguuguc

SEQ ID NO: 344129 - RNA, 22 nt, Homo sapiens
auuccaguggguuuacauccca

SEQ ID NO: 344130 - RNA, 22 nt, Homo sapiens
auuccauuuguuaucacacccg

SEQ ID NO: 344131 - RNA, 23 nt, Homo sapiens
auugaacacuuucauaugugagg

SEQ ID NO: 344132 - RNA, 22 nt, Homo sapiens
auugagcaauuccuaugugcuu

SEQ ID NO: 344133 - RNA, 22 nt, Homo sapiens
auugaggcauguaccaaugguc

SEQ ID NO: 344134 - RNA, 22 nt, Homo sapiens
auugaguaaaaaauagugaugu

SEQ ID NO: 344135 - RNA, 21 nt, Homo sapiens
auugcacaauauacccaugua

SEQ ID NO: 344136 - RNA, 22 nt, Homo sapiens
auugcacuccagccuggccgag

SEQ ID NO: 344137 - RNA, 22 nt, Homo sapiens
auugcacuccauccugggcaau

SEQ ID NO: 344138 - RNA, 18 nt, Homo sapiens
auugcacuccugccuggg

SEQ ID NO: 344139 - RNA, 22 nt, Homo sapiens
auugcacucuagccuuggcgac

SEQ ID NO: 344140 - RNA, 22 nt, Homo sapiens
auugcagaaaugacagagcgcc

SEQ ID NO: 344141 - RNA, 22 nt, Homo sapiens
auugccacaucucagaggcaga

SEQ ID NO: 344142 - RNA, 22 nt, Homo sapiens
auugcccaggcuggagugcagu

SEQ ID NO: 344143 - RNA, 22 nt, Homo sapiens
auuggauagucuuuaucuguug

SEQ ID NO: 344144 - RNA, 22 nt, Homo sapiens
auuggcaauggcaaagcagagu

SEQ ID NO: 344145 - RNA, 22 nt, Homo sapiens
auuggcuuuugaaagucugcga

SEQ ID NO: 344146 - RNA, 22 nt, Homo sapiens
auuguacuagguccuagggcuu

SEQ ID NO: 344147 - RNA, 22 nt, Homo sapiens
auugucacccgggcaguaagca

SEQ ID NO: 344148 - RNA, 22 nt, Homo sapiens
auugucacugugcuccaccagu

SEQ ID NO: 344149 - RNA, 22 nt, Homo sapiens
auuguucuuacaugcugucauc

SEQ ID NO: 344150 - RNA, 22 nt, Homo sapiens
auuuaugguuaauauaggaagu

SEQ ID NO: 344151 - RNA, 22 nt, Homo sapiens
auuucuacuccuguguccagaa

SEQ ID NO: 344152 - RNA, 22 nt, Homo sapiens
auuugacacugagagccucagu

SEQ ID NO: 344153 - RNA, 22 nt, Homo sapiens
auuuggguuuuacaucaggcua

SEQ ID NO: 344154 - RNA, 22 nt, Homo sapiens
auuugucaauacacuucuucca

SEQ ID NO: 344155 - RNA, 22 nt, Homo sapiens
auuugucacuuaacagccauua

SEQ ID NO: 344156 - RNA, 22 nt, Homo sapiens
caaaagugguucuuauccuuuu

SEQ ID NO: 344157 - RNA, 22 nt, Homo sapiens
caaaugaucugcuggccucagc

SEQ ID NO: 344158 - RNA, 22 nt, Homo sapiens
caacucuguaggauccaggugg

SEQ ID NO: 344159 - RNA, 22 nt, Homo sapiens
caagacuguccaacauauuggg

SEQ ID NO: 344160 - RNA, 22 nt, Homo sapiens
caaggugcugagacaggagccc

SEQ ID NO: 344161 - RNA, 21 nt, Homo sapiens
caaugacacuguagcugugcu

SEQ ID NO: 344162 - RNA, 22 nt, Homo sapiens
caaugugcuuggggcacaugag

SEQ ID NO: 344163 - RNA, 22 nt, Homo sapiens
caauugcacucuuagguguaca

SEQ ID NO: 344164 - RNA, 22 nt, Homo sapiens
cacaaaguagauuagucuucca

SEQ ID NO: 344165 - RNA, 22 nt, Homo sapiens
cacagagugagacccugucucu

SEQ ID NO: 344166 - RNA, 22 nt, Homo sapiens
cacaggccugucucuuucuaac

SEQ ID NO: 344167 - RNA, 22 nt, Homo sapiens
cacagugaacaauauccucugu

SEQ ID NO: 344168 - RNA, 22 nt, Homo sapiens
cacauguucaggagcacuuaga

SEQ ID NO: 344169 - RNA, 22 nt, Homo sapiens
caccaggugcccagcacggcca

SEQ ID NO: 344170 - RNA, 22 nt, Homo sapiens
caccagguggcugaggccauga

SEQ ID NO: 344171 - RNA, 22 nt, Homo sapiens
caccgagguuggagugcagugg

SEQ ID NO: 344172 - RNA, 22 nt, Homo sapiens
cacugcacuccagccuaagagg

SEQ ID NO: 344173 - RNA, 22 nt, Homo sapiens
cacugcacuccaguuuggauga

SEQ ID NO: 344174 - RNA, 22 nt, Homo sapiens
cacugcacucuucuucugggca

SEQ ID NO: 344175 - RNA, 22 nt, Homo sapiens
cacugcaguguaauuaagguug

SEQ ID NO: 344176 - RNA, 22 nt, Homo sapiens
cacugcauccuccaccugccag

SEQ ID NO: 344177 - RNA, 22 nt, Homo sapiens
cacugcauggccacccauguua

SEQ ID NO: 344178 - RNA, 22 nt, Homo sapiens
cacugcauggucuagcuggguu

SEQ ID NO: 344179 - RNA, 22 nt, Homo sapiens
cacugcauuggaugguuccucc

SEQ ID NO: 344180 - RNA, 22 nt, Homo sapiens
cacugggugccauauguuugcu

SEQ ID NO: 344181 - RNA, 22 nt, Homo sapiens
cagagaacugaguuauuuucuu

SEQ ID NO: 344182 - RNA, 22 nt, Homo sapiens
cagagcaaugcuuuugcuuuga

SEQ ID NO: 344183 - RNA, 22 nt, Homo sapiens
cagauacuggaguccugaaguu

SEQ ID NO: 344184 - RNA, 22 nt, Homo sapiens
cagauaguuguagauaugcagc

SEQ ID NO: 344185 - RNA, 22 nt, Homo sapiens
cagaugcaugaccugggcuugg

SEQ ID NO: 344186 - RNA, 22 nt, Homo sapiens
cagcaagucucuaagaguucau

SEQ ID NO: 344187 - RNA, 22 nt, Homo sapiens
cagcaucauucaucugggguaa

SEQ ID NO: 344188 - RNA, 22 nt, Homo sapiens
cagccgggugagguggcuuguu

SEQ ID NO: 344189 - RNA, 22 nt, Homo sapiens
cagcuaguaauuuauugaagau

SEQ ID NO: 344190 - RNA, 23 nt, Homo sapiens
cagcucauuuggguccccuuguc

SEQ ID NO: 344191 - RNA, 22 nt, Homo sapiens
cagcuggugggagcuggguucc

SEQ ID NO: 344192 - RNA, 22 nt, Homo sapiens
cagcuguuguuccagucuuuua

SEQ ID NO: 344193 - RNA, 22 nt, Homo sapiens
caggcuuuuccacacauggguu

SEQ ID NO: 344194 - RNA, 19 nt, Homo sapiens
caguaucauugcacauagu

SEQ ID NO: 344195 - RNA, 20 nt, Homo sapiens
cagucauagacaucagaguc

SEQ ID NO: 344196 - RNA, 20 nt, Homo sapiens
cagugcacuuucccacuggu

SEQ ID NO: 344197 - RNA, 22 nt, Homo sapiens
caguggaugaacaagaagugau

SEQ ID NO: 344198 - RNA, 22 nt, Homo sapiens
caguguaugcuucuauuuuugg

SEQ ID NO: 344199 - RNA, 22 nt, Homo sapiens
caguucaugguaggcaccauag

SEQ ID NO: 344200 - RNA, 22 nt, Homo sapiens
cauacaugugcuugucuuaugc

SEQ ID NO: 344201 - RNA, 22 nt, Homo sapiens
caucacuguugguacaaguaau

SEQ ID NO: 344202 - RNA, 22 nt, Homo sapiens
caucccugucgucaagucucug

SEQ ID NO: 344203 - RNA, 22 nt, Homo sapiens
caugcacugaguccaccucugg

SEQ ID NO: 344204 - RNA, 22 nt, Homo sapiens
caugccacugcacgccauccug

SEQ ID NO: 344205 - RNA, 22 nt, Homo sapiens
cauggcacauauauaucuaggu

SEQ ID NO: 344206 - RNA, 22 nt, Homo sapiens
caugggacugucuuggcuauac

SEQ ID NO: 344207 - RNA, 22 nt, Homo sapiens
caugugcaugagcacauacgug

SEQ ID NO: 344208 - RNA, 22 nt, Homo sapiens
cauugcaauccagccugggcaa

SEQ ID NO: 344209 - RNA, 22 nt, Homo sapiens
cauugcacacauuuaccuaugu

SEQ ID NO: 344210 - RNA, 22 nt, Homo sapiens
gaucccauuggcugccaugugg

SEQ ID NO: 344211 - RNA, 22 nt, Homo sapiens
gaugagaugagcauuugaauug

SEQ ID NO: 344212 - RNA, 22 nt, Homo sapiens
gaugauauuugagucauuagaa

SEQ ID NO: 344213 - RNA, 22 nt, Homo sapiens
gaugcagcuaggauuugugaca

SEQ ID NO: 344214 - RNA, 22 nt, Homo sapiens
gauggaauuaaaaucagaauca

SEQ ID NO: 344215 - RNA, 22 nt, Homo sapiens
gaugguggucuacccuuucccu

SEQ ID NO: 344216 - RNA, 22 nt, Homo sapiens
gauuagaacagaagucagauua

SEQ ID NO: 344217 - RNA, 22 nt, Homo sapiens
gauuccauugcgaauuuucaga

SEQ ID NO: 344218 - RNA, 22 nt, Homo sapiens
gauuuguauuaaaagugugacg

SEQ ID NO: 344219 - RNA, 22 nt, Homo sapiens
gauuuuccaguggcccugauca

SEQ ID NO: 344220 - RNA, 23 nt, Homo sapiens
gcaaauaucguagagugucccug

SEQ ID NO: 344221 - RNA, 22 nt, Homo sapiens
gcaagacaugucuaagguuuaa

SEQ ID NO: 344222 - RNA, 22 nt, Homo sapiens
gcaaggacucccugggucauuc

SEQ ID NO: 344223 - RNA, 22 nt, Homo sapiens
gcaauguuacugaauguguuuu

SEQ ID NO: 344224 - RNA, 22 nt, Homo sapiens
gcacaggguuacauucuaaggu

SEQ ID NO: 344225 - RNA, 22 nt, Homo sapiens
gcacaguggcucccgucuauaa

SEQ ID NO: 344226 - RNA, 22 nt, Homo sapiens
gcacaguuaaagggucauguga

SEQ ID NO: 344227 - RNA, 22 nt, Homo sapiens
gcacauggccacuaggaauaaa

SEQ ID NO: 344228 - RNA, 22 nt, Homo sapiens
gcacgugcacccacaugcacgu

SEQ ID NO: 344229 - RNA, 22 nt, Homo sapiens
gcagaauugguuucuucuaagg

SEQ ID NO: 344230 - RNA, 22 nt, Homo sapiens
gcagagaaacaggucuaaggag

SEQ ID NO: 344231 - RNA, 22 nt, Homo sapiens
gcagcaucaaaucacacaagau

SEQ ID NO: 344232 - RNA, 22 nt, Homo sapiens
gcagguguuaugcaaacaacug

SEQ ID NO: 344233 - RNA, 19 nt, Homo sapiens
gcaguauugaaggccaguc

SEQ ID NO: 344234 - RNA, 22 nt, Homo sapiens
gcagugacaugugccaguuuau

SEQ ID NO: 344235 - RNA, 22 nt, Homo sapiens
gcagugugauguuuuaaucuau

SEQ ID NO: 344236 - RNA, 22 nt, Homo sapiens
gcaguguggguagagggcaaga

SEQ ID NO: 344237 - RNA, 20 nt, Homo sapiens
gcauaugucuuuauggcagc

SEQ ID NO: 344238 - RNA, 22 nt, Homo sapiens
gcaucacagcuccugugcuggc

SEQ ID NO: 344239 - RNA, 22 nt, Homo sapiens
gcaugguacuggaugguaguau

SEQ ID NO: 344240 - RNA, 20 nt, Homo sapiens
gccacaguuaagcuucugcc

SEQ ID NO: 344241 - RNA, 22 nt, Homo sapiens
gccaguauuuuauugagaauuu

SEQ ID NO: 344242 - RNA, 22 nt, Homo sapiens
gccaguauuuuguugagaauuu

SEQ ID NO: 344243 - RNA, 22 nt, Homo sapiens
gccauugcacuccagccucggg

SEQ ID NO: 344244 - RNA, 22 nt, Homo sapiens
gcccagcguucagggaggggcu

SEQ ID NO: 344245 - RNA, 22 nt, Homo sapiens
gccuagagaaguaaauauuauc

SEQ ID NO: 344246 - RNA, 22 nt, Homo sapiens
gccuagagaguuaucaggcugu

SEQ ID NO: 344247 - RNA, 22 nt, Homo sapiens
gcuaugguuuuuagcuccauca

SEQ ID NO: 344248 - RNA, 22 nt, Homo sapiens
gcugacacugggcuauagaucu

SEQ ID NO: 344249 - RNA, 17 nt, Homo sapiens
gcugcauucauguagaa

SEQ ID NO: 344250 - RNA, 22 nt, Homo sapiens
gcugcuguaccagaugugguua

SEQ ID NO: 344251 - RNA, 20 nt, Homo sapiens
gcugugcuuaauacacuuuc

SEQ ID NO: 344252 - RNA, 19 nt, Homo sapiens
gcuuguccacgugagauaa

SEQ ID NO: 344253 - RNA, 22 nt, Homo sapiens
gcuuguguauuaaaccuugcag

SEQ ID NO: 344254 - RNA, 22 nt, Homo sapiens
ggaaagacaccuuacuauguua

SEQ ID NO: 344255 - RNA, 22 nt, Homo sapiens
ggaaagaucagcuaaauguaag

SEQ ID NO: 344256 - RNA, 22 nt, Homo sapiens
ggaaaguccuucuguaggcucc

SEQ ID NO: 344257 - RNA, 22 nt, Homo sapiens
ggaagagugaauuaucuugacu

SEQ ID NO: 344258 - RNA, 22 nt, Homo sapiens
ggaaugcuaaaauaggaugcug

SEQ ID NO: 344259 - RNA, 22 nt, Homo sapiens
ggagaucacucuuuguagcgug

SEQ ID NO: 344260 - RNA, 22 nt, Homo sapiens
ggagauccucugcgggcaaaga

SEQ ID NO: 344261 - RNA, 22 nt, Homo sapiens
ggagcugugauuugaguccaga

SEQ ID NO: 344262 - RNA, 22 nt, Homo sapiens
ggaggcuaguaaaaagguagaa

SEQ ID NO: 344263 - RNA, 22 nt, Homo sapiens
ggaguaugaaacccacuccaau

SEQ ID NO: 344264 - RNA, 22 nt, Homo sapiens
ggagucuugcuauguugccaag

SEQ ID NO: 344265 - RNA, 23 nt, Homo sapiens
ggaguguauuggcacgaucucag

SEQ ID NO: 344266 - RNA, 22 nt, Homo sapiens
ggagugugauuguucucuguua

SEQ ID NO: 344267 - RNA, 22 nt, Homo sapiens
ggcacaaugucagcucacugca

SEQ ID NO: 344268 - RNA, 23 nt, Homo sapiens
ggcacggaauucaaagaggcauu

SEQ ID NO: 344269 - RNA, 22 nt, Homo sapiens
ggcacgguggcucacgccugua

SEQ ID NO: 344270 - RNA, 22 nt, Homo sapiens
ggcacugugaugugagggggua

SEQ ID NO: 344271 - RNA, 22 nt, Homo sapiens
ggcagcauugccuuugcaguga

SEQ ID NO: 344272 - RNA, 22 nt, Homo sapiens
ggcagcuguguccuucguaagg

SEQ ID NO: 344273 - RNA, 22 nt, Homo sapiens
ggcaguggaagugccaguuucu

SEQ ID NO: 344274 - RNA, 16 nt, Homo sapiens
ggcauguaauaagcaa

SEQ ID NO: 344275 - RNA, 22 nt, Homo sapiens
ggcauguaauuauucaaagugg

SEQ ID NO: 344276 - RNA, 22 nt, Homo sapiens
ggccagaugcgguggcucacac

SEQ ID NO: 344277 - RNA, 22 nt, Homo sapiens
ggcccugagacaggaaaaagcu

SEQ ID NO: 344278 - RNA, 22 nt, Homo sapiens
ggccggguggccauggcugccc

SEQ ID NO: 344279 - RNA, 22 nt, Homo sapiens
ggcucagugggguccugguucu

SEQ ID NO: 344280 - RNA, 22 nt, Homo sapiens
ggcucguguuuucuguccaguu

SEQ ID NO: 344281 - RNA, 18 nt, Homo sapiens
ggcugguguuuuaguaua

SEQ ID NO: 344282 - RNA, 22 nt, Homo sapiens
gggaagaaggagugguuuacuc

SEQ ID NO: 344283 - RNA, 22 nt, Homo sapiens
gggaagugugcagaguucucuu

SEQ ID NO: 344284 - RNA, 22 nt, Homo sapiens
gggaggucauuguaaggucuua

SEQ ID NO: 344285 - RNA, 22 nt, Homo sapiens
guaacucugucacuuacuaguu

SEQ ID NO: 344286 - RNA, 22 nt, Homo sapiens
guaauaccuuccccugcuggag

SEQ ID NO: 344287 - RNA, 22 nt, Homo sapiens
guaaucucagcuacucgggagg

SEQ ID NO: 344288 - RNA, 22 nt, Homo sapiens
guaaucucagcuacuugggagg

SEQ ID NO: 344289 - RNA, 22 nt, Homo sapiens
guaaucucagcuucuugggagg

SEQ ID NO: 344290 - RNA, 19 nt, Homo sapiens
guaaucucaguacuuuggu

SEQ ID NO: 344291 - RNA, 17 nt, Homo sapiens
guacacuucuucuguga

SEQ ID NO: 344292 - RNA, 22 nt, Homo sapiens
guacaguauaguaauaggauuu

SEQ ID NO: 344293 - RNA, 22 nt, Homo sapiens
guagaaagcauuucagauuugc

SEQ ID NO: 344294 - RNA, 22 nt, Homo sapiens
guagaauguauguauaacgcaa

SEQ ID NO: 344295 - RNA, 22 nt, Homo sapiens
guagaggaauggcuccaccaua

SEQ ID NO: 344296 - RNA, 22 nt, Homo sapiens
guaucccuugcuaucugaaucu

SEQ ID NO: 344297 - RNA, 22 nt, Homo sapiens
guaugacacaggaagcuuaacc

SEQ ID NO: 344298 - RNA, 22 nt, Homo sapiens
guaugucuugucuauggcugcu

SEQ ID NO: 344299 - RNA, 22 nt, Homo sapiens
guaugucuuuauagcagugugg

SEQ ID NO: 344300 - RNA, 22 nt, Homo sapiens
guauugacuaucaaucaugugc

SEQ ID NO: 344301 - RNA, 22 nt, Homo sapiens
guauuugguuauugcagccuga

SEQ ID NO: 344302 - RNA, 22 nt, Homo sapiens
gucaaagugauuguaauuaggu

SEQ ID NO: 344303 - RNA, 22 nt, Homo sapiens
gucaaaugcacagaaccauuaa

SEQ ID NO: 344304 - RNA, 22 nt, Homo sapiens
gucaaggaauuuauccauuucu

SEQ ID NO: 344305 - RNA, 22 nt, Homo sapiens
gucacagaggcuaagaccccac

SEQ ID NO: 344306 - RNA, 22 nt, Homo sapiens
gucacaggaaacuaauaugcgc

SEQ ID NO: 344307 - RNA, 22 nt, Homo sapiens
gucacugacaagagagaagaac

SEQ ID NO: 344308 - RNA, 22 nt, Homo sapiens
gucacugagaagguuaguuugu

SEQ ID NO: 344309 - RNA, 22 nt, Homo sapiens
gucacugucuacuguaauagcc

SEQ ID NO: 344310 - RNA, 22 nt, Homo sapiens
gucacuguggagaagaaagugg

SEQ ID NO: 344311 - RNA, 22 nt, Homo sapiens
gucagaaucucagaugacaacg

SEQ ID NO: 344312 - RNA, 22 nt, Homo sapiens
gucagcaucaccaugucuauga

SEQ ID NO: 344313 - RNA, 22 nt, Homo sapiens
gucagggagggauagaugauua

SEQ ID NO: 344314 - RNA, 22 nt, Homo sapiens
gucagguaccugaaagcagcca

SEQ ID NO: 344315 - RNA, 22 nt, Homo sapiens
gucagugcauguaaacauaaaa

SEQ ID NO: 344316 - RNA, 22 nt, Homo sapiens
gucaguggagaaaaggacaugu

SEQ ID NO: 344317 - RNA, 18 nt, Homo sapiens
gucauagaaugaugguuc

SEQ ID NO: 344318 - RNA, 22 nt, Homo sapiens
gucaugucuugaaauucaguuu

SEQ ID NO: 344319 - RNA, 22 nt, Homo sapiens
gucauugguucuguuuauguga

SEQ ID NO: 344320 - RNA, 22 nt, Homo sapiens
guccaaagugggagaggugggg

SEQ ID NO: 344321 - RNA, 22 nt, Homo sapiens
guccaagacuaggaguuggcag

SEQ ID NO: 344322 - RNA, 22 nt, Homo sapiens
guccaguguuggagguuuuacc

SEQ ID NO: 344323 - RNA, 22 nt, Homo sapiens
gucccaguggaaccuccaagcu

SEQ ID NO: 344324 - RNA, 22 nt, Homo sapiens
gucuagaacuucugaccuuagg

SEQ ID NO: 344325 - RNA, 22 nt, Homo sapiens
gucuggagacuugggucaucaa

SEQ ID NO: 344326 - RNA, 21 nt, Homo sapiens
gucugguguuuuaaugaggac

SEQ ID NO: 344327 - RNA, 22 nt, Homo sapiens
gucugguuggaguaguuuucag

SEQ ID NO: 344328 - RNA, 22 nt, Homo sapiens
gucuguuuggggaccuguggcc

SEQ ID NO: 344329 - RNA, 20 nt, Homo sapiens
gucuugcuccguugcccagg

SEQ ID NO: 344330 - RNA, 22 nt, Homo sapiens
gugaaaagaugagcaccauaca

SEQ ID NO: 344331 - RNA, 22 nt, Homo sapiens
gugaaagauuaaaccagugugu

SEQ ID NO: 344332 - RNA, 22 nt, Homo sapiens
gugaaaugaaucuggaaauauu

SEQ ID NO: 344333 - RNA, 22 nt, Homo sapiens
gugaauugagagaacuguguua

SEQ ID NO: 344334 - RNA, 22 nt, Homo sapiens
gugacagucaaagacaugacuu

SEQ ID NO: 344335 - RNA, 22 nt, Homo sapiens
gugacaucagcuccagguauaa

SEQ ID NO: 344336 - RNA, 22 nt, Homo sapiens
gugacugggaguggugaagaua

SEQ ID NO: 344337 - RNA, 22 nt, Homo sapiens
gugagaacugcuggggccacag

SEQ ID NO: 344338 - RNA, 22 nt, Homo sapiens
gugagaauugacacccuugucu

SEQ ID NO: 344339 - RNA, 22 nt, Homo sapiens
gugagauacuagagauauagug

SEQ ID NO: 344340 - RNA, 19 nt, Homo sapiens
gugagcacagacaauacaa

SEQ ID NO: 344341 - RNA, 22 nt, Homo sapiens
gugagcagagaucgcgugauug

SEQ ID NO: 344342 - RNA, 22 nt, Homo sapiens
gugagcauauuaguauugcacu

SEQ ID NO: 344343 - RNA, 22 nt, Homo sapiens
gugagcauucaaggaaggagcu

SEQ ID NO: 344344 - RNA, 22 nt, Homo sapiens
gugagguagagcaugugaaaga

SEQ ID NO: 344345 - RNA, 21 nt, Homo sapiens
gugaucaugucacugcacucc

SEQ ID NO: 344346 - RNA, 22 nt, Homo sapiens
gugauguguuucaacagcuccu

SEQ ID NO: 344347 - RNA, 22 nt, Homo sapiens
gugcaacaucccuccauaauuu

SEQ ID NO: 344348 - RNA, 22 nt, Homo sapiens
gugcaaccaucaccacugacuc

SEQ ID NO: 344349 - RNA, 22 nt, Homo sapiens
gugcacaaaucuuaaauguaca

SEQ ID NO: 344350 - RNA, 22 nt, Homo sapiens
gugcacaacgugcaggcuuguu

SEQ ID NO: 344351 - RNA, 22 nt, Homo sapiens
gugcacaacgugcagguuuguu

SEQ ID NO: 344352 - RNA, 22 nt, Homo sapiens
gugcacaaugugcagguuuguu

SEQ ID NO: 344353 - RNA, 22 nt, Homo sapiens
gugcacauuguuuaugucuguu

SEQ ID NO: 344354 - RNA, 23 nt, Homo sapiens
gugcaguggcgagauuucggcuc

SEQ ID NO: 344355 - RNA, 22 nt, Homo sapiens
gugcagugugauccuuccguau

SEQ ID NO: 344356 - RNA, 23 nt, Homo sapiens
gugcaugagucuuuauaguagca

SEQ ID NO: 344357 - RNA, 22 nt, Homo sapiens
ucacaguauggggggugguuau

SEQ ID NO: 344358 - RNA, 22 nt, Homo sapiens
ucacagucggugacuucuugcu

SEQ ID NO: 344359 - RNA, 22 nt, Homo sapiens
ucacagugcaggaucaguuaau

SEQ ID NO: 344360 - RNA, 23 nt, Homo sapiens
ucacaguggcugcuuaauuguga

SEQ ID NO: 344361 - RNA, 17 nt, Homo sapiens
ucacaguguuaggauga

SEQ ID NO: 344362 - RNA, 23 nt, Homo sapiens
ucacaguuacuuuugcaucaacc

SEQ ID NO: 344363 - RNA, 22 nt, Homo sapiens
ucacaugugcguuuuggcaugu

SEQ ID NO: 344364 - RNA, 22 nt, Homo sapiens
ucacauuguacaaacagguaag

SEQ ID NO: 344365 - RNA, 22 nt, Homo sapiens
ucaccuggagaagauggaucau

SEQ ID NO: 344366 - RNA, 22 nt, Homo sapiens
ucaccuggagccuucacauucu

SEQ ID NO: 344367 - RNA, 22 nt, Homo sapiens
ucacuaaagaaaauggcaugga

SEQ ID NO: 344368 - RNA, 22 nt, Homo sapiens
ucacuagggaucacuuuacccg

SEQ ID NO: 344369 - RNA, 22 nt, Homo sapiens
ucacugaaaccacugccuccug

SEQ ID NO: 344370 - RNA, 22 nt, Homo sapiens
ucacuggagauagcaaucuggu

SEQ ID NO: 344371 - RNA, 22 nt, Homo sapiens
ucacuggccaaauucuggguga

SEQ ID NO: 344372 - RNA, 22 nt, Homo sapiens
ucacugggagaccaaagccauc

SEQ ID NO: 344373 - RNA, 22 nt, Homo sapiens
ucacugugagaguuuauccugu

SEQ ID NO: 344374 - RNA, 22 nt, Homo sapiens
ucacuguggaacucaaaaagcu

SEQ ID NO: 344375 - RNA, 22 nt, Homo sapiens
ucacugugguuggaaggcuuaa

SEQ ID NO: 344376 - RNA, 22 nt, Homo sapiens
ucacuguugaugggcaugcagg

SEQ ID NO: 344377 - RNA, 22 nt, Homo sapiens
ucacuuggccgcagccuucucu

SEQ ID NO: 344378 - RNA, 22 nt, Homo sapiens
ucagaccauuucauuacagacu

SEQ ID NO: 344379 - RNA, 18 nt, Homo sapiens
ucagagugcagacuauac

SEQ ID NO: 344380 - RNA, 22 nt, Homo sapiens
ucagaucaugcuuaugauggga

SEQ ID NO: 344381 - RNA, 22 nt, Homo sapiens
ucagaugaucugguaagaacuu

SEQ ID NO: 344382 - RNA, 22 nt, Homo sapiens
ucagauuggugcaaaaguaauu

SEQ ID NO: 344383 - RNA, 22 nt, Homo sapiens
ucagcaucacaggcagugagug

SEQ ID NO: 344384 - RNA, 22 nt, Homo sapiens
ucaggcacuaguaagaaaaagg

SEQ ID NO: 344385 - RNA, 20 nt, Homo sapiens
ucaggcuccgcauuaacuua

SEQ ID NO: 344386 - RNA, 20 nt, Homo sapiens
ucagguagaucuuugagguc

SEQ ID NO: 344387 - RNA, 22 nt, Homo sapiens
ucagguaucuucauagcaaugc

SEQ ID NO: 344388 - RNA, 22 nt, Homo sapiens
ucagguauuuauagcaaugcaa

SEQ ID NO: 344389 - RNA, 22 nt, Homo sapiens
ucaggugcaguggcucugaccu

SEQ ID NO: 344390 - RNA, 22 nt, Homo sapiens
ucaguaaauguuaggacauuuc

SEQ ID NO: 344391 - RNA, 22 nt, Homo sapiens
ucaguaccugagagugggcaga

SEQ ID NO: 344392 - RNA, 22 nt, Homo sapiens
ucagucauucaauuguugaaug

SEQ ID NO: 344393 - RNA, 20 nt, Homo sapiens
ucagugcagauuguccaagu

SEQ ID NO: 344394 - RNA, 19 nt, Homo sapiens
ucagugcuauguaauguag

SEQ ID NO: 344395 - RNA, 22 nt, Homo sapiens
ucagugcuuggcacagagagcu

SEQ ID NO: 344396 - RNA, 22 nt, Homo sapiens
ucaguggauuauuaaagucacc

SEQ ID NO: 344397 - RNA, 22 nt, Homo sapiens
ucauacgucuccuugugccacc

SEQ ID NO: 344398 - RNA, 22 nt, Homo sapiens
ucauagaucaaguaauaagaca

SEQ ID NO: 344399 - RNA, 18 nt, Homo sapiens
ucauagaucaugacagug

SEQ ID NO: 344400 - RNA, 21 nt, Homo sapiens
ucaucaagcuguagacaugau

SEQ ID NO: 344401 - RNA, 22 nt, Homo sapiens
ucaucagugcuugcaaauuauu

SEQ ID NO: 344402 - RNA, 22 nt, Homo sapiens
ucaugaaguaguuaacugguug

SEQ ID NO: 344403 - RNA, 22 nt, Homo sapiens
ucaugaccaugguauagaccac

SEQ ID NO: 344404 - RNA, 22 nt, Homo sapiens
ucauugcacuccagccugggug

SEQ ID NO: 344405 - RNA, 21 nt, Homo sapiens
ucauugggugcagcccacccu

SEQ ID NO: 344406 - RNA, 22 nt, Homo sapiens
ucauugguagcuugaaggggau

SEQ ID NO: 344407 - RNA, 22 nt, Homo sapiens
ucauugguucuggguguuguug

SEQ ID NO: 344408 - RNA, 22 nt, Homo sapiens
ucauugguugcguaauuugauu

SEQ ID NO: 344409 - RNA, 22 nt, Homo sapiens
uccacaauggcugaacuagauu

SEQ ID NO: 344410 - RNA, 22 nt, Homo sapiens
uccacagugguggaauuguuca

SEQ ID NO: 344411 - RNA, 19 nt, Homo sapiens
uccacagugguugaacuag

SEQ ID NO: 344412 - RNA, 22 nt, Homo sapiens
uccacugagcuagaccacuugg

SEQ ID NO: 344413 - RNA, 22 nt, Homo sapiens
uccagaguggugaugcuggggc

SEQ ID NO: 344414 - RNA, 22 nt, Homo sapiens
uccagguuucaugcucuuuauu

SEQ ID NO: 344415 - RNA, 22 nt, Homo sapiens
uccagugugcaggcaaguuuga

SEQ ID NO: 344416 - RNA, 22 nt, Homo sapiens
uccaguguuccucagucacccc

SEQ ID NO: 344417 - RNA, 22 nt, Homo sapiens
uccaguguuucuuccacuauuu

SEQ ID NO: 344418 - RNA, 22 nt, Homo sapiens
uccaguuuuguuaacauauggu

SEQ ID NO: 344419 - RNA, 22 nt, Homo sapiens
uccaugaggcuacaguaaucuc

SEQ ID NO: 344420 - RNA, 22 nt, Homo sapiens
uccaugaguccauuagaaaaaa

SEQ ID NO: 344421 - RNA, 23 nt, Homo sapiens
uccccgggagcaccagcuuguug

SEQ ID NO: 344422 - RNA, 22 nt, Homo sapiens
uccccugagaccccucagcacu

SEQ ID NO: 344423 - RNA, 22 nt, Homo sapiens
ucccuagacuccugccuuucag

SEQ ID NO: 344424 - RNA, 22 nt, Homo sapiens
ucccugaaaauuagcauuuuaa

SEQ ID NO: 344425 - RNA, 22 nt, Homo sapiens
ucccugagguccuggauuauug

SEQ ID NO: 344426 - RNA, 22 nt, Homo sapiens
ucccugaguaucuaauguguuu

SEQ ID NO: 344427 - RNA, 22 nt, Homo sapiens
ucccugagugauugaaaauaaa

SEQ ID NO: 344428 - RNA, 22 nt, Homo sapiens
ucccuggagcaagagaagaagg

SEQ ID NO: 344429 - RNA, 22 nt, Homo sapiens
ucccuugagccuggcuucucac

SEQ ID NO: 344430 - RNA, 22 nt, Homo sapiens
ucccuuucuggaguuucccaag

SEQ ID NO: 344431 - RNA, 22 nt, Homo sapiens
uccugagaauagaguugcaugu

SEQ ID NO: 344432 - RNA, 22 nt, Homo sapiens
uccugagacucacaggcucccc

SEQ ID NO: 344433 - RNA, 21 nt, Homo sapiens
uccugagagaggaguaacucu

SEQ ID NO: 344434 - RNA, 22 nt, Homo sapiens
uccuuggugacauuucuugucu

SEQ ID NO: 344435 - RNA, 23 nt, Homo sapiens
ucgcagcauucaauaccaggcag

SEQ ID NO: 344436 - RNA, 22 nt, Homo sapiens
ucggcucagugcaagcucugcc

SEQ ID NO: 344437 - RNA, 22 nt, Homo sapiens
ucgugccacugcacuccagccu

SEQ ID NO: 344438 - RNA, 22 nt, Homo sapiens
ucgugcugugucaucuuguggc

SEQ ID NO: 344439 - RNA, 22 nt, Homo sapiens
ucuaaggcaccuagagucauca

SEQ ID NO: 344440 - RNA, 22 nt, Homo sapiens
ucuauggaguuugaaugagaaa

SEQ ID NO: 344441 - RNA, 22 nt, Homo sapiens
ucucacagccauuucucccucu

SEQ ID NO: 344442 - RNA, 22 nt, Homo sapiens
ucucagagccuaggguuuuuca

SEQ ID NO: 344443 - RNA, 22 nt, Homo sapiens
ucucaguggcuuccucacuuuu

SEQ ID NO: 344444 - RNA, 22 nt, Homo sapiens
ucucagugugguaaaaguuuuu

SEQ ID NO: 344445 - RNA, 23 nt, Homo sapiens
ucucauuccuugaaaauaaugac

SEQ ID NO: 344446 - RNA, 22 nt, Homo sapiens
ugagaugaugggauaagagggc

SEQ ID NO: 344447 - RNA, 22 nt, Homo sapiens
ugagaugcauauucuggcuccu

SEQ ID NO: 344448 - RNA, 22 nt, Homo sapiens
ugagauuauauuucuuaacaga

SEQ ID NO: 344449 - RNA, 20 nt, Homo sapiens
ugagauuggugugguauaag

SEQ ID NO: 344450 - RNA, 22 nt, Homo sapiens
ugagcacagcgugugggagagc

SEQ ID NO: 344451 - RNA, 22 nt, Homo sapiens
ugagcagaguuguuucuccuga

SEQ ID NO: 344452 - RNA, 22 nt, Homo sapiens
ugagcugagaucgugccauugu

SEQ ID NO: 344453 - RNA, 22 nt, Homo sapiens
ugagcugguacuaauauuauca

SEQ ID NO: 344454 - RNA, 18 nt, Homo sapiens
ugaggaaaggguuugcua

SEQ ID NO: 344455 - RNA, 22 nt, Homo sapiens
ugaggaguauguucuguagacc

SEQ ID NO: 344456 - RNA, 22 nt, Homo sapiens
ugagguaucauugcccaggcug

SEQ ID NO: 344457 - RNA, 23 nt, Homo sapiens
ugagguguuaagcagacuugucu

SEQ ID NO: 344458 - RNA, 22 nt, Homo sapiens
ugagguuggggucagggcuagc

SEQ ID NO: 344459 - RNA, 22 nt, Homo sapiens
ugagguuguccacuauaaucca

SEQ ID NO: 344460 - RNA, 22 nt, Homo sapiens
ugaguaauguugaucuuugaua

SEQ ID NO: 344461 - RNA, 22 nt, Homo sapiens
ugaguagauccaagacuguccu

SEQ ID NO: 344462 - RNA, 22 nt, Homo sapiens
ugaguaugaguucaggaaaggc

SEQ ID NO: 344463 - RNA, 22 nt, Homo sapiens
ugaguauguaggaugugucuua

SEQ ID NO: 344464 - RNA, 22 nt, Homo sapiens
ugagucagucucacucugcugc

SEQ ID NO: 344465 - RNA, 22 nt, Homo sapiens
ugagugaaagaagcacuaagga

SEQ ID NO: 344466 - RNA, 22 nt, Homo sapiens
ugagugaaugugaaggcuaggg

SEQ ID NO: 344467 - RNA, 22 nt, Homo sapiens
ugaguucaugcuuguaguucua

SEQ ID NO: 344468 - RNA, 22 nt, Homo sapiens
ugaguuccuuucccaguccagu

SEQ ID NO: 344469 - RNA, 22 nt, Homo sapiens
ugauaauguuaggcuuuauuca

SEQ ID NO: 344470 - RNA, 22 nt, Homo sapiens
ugauaggucagaugauauugaa

SEQ ID NO: 344471 - RNA, 22 nt, Homo sapiens
ugauaguguccugugccacauu

SEQ ID NO: 344472 - RNA, 22 nt, Homo sapiens
ugauauguagguggcaagcaua

SEQ ID NO: 344473 - RNA, 22 nt, Homo sapiens
ugauaugucacuugaucauggu

SEQ ID NO: 344474 - RNA, 22 nt, Homo sapiens
ugaucaaagugcuggaauuaca

SEQ ID NO: 344475 - RNA, 21 nt, Homo sapiens
ugaucacaugaaaaccaugca

SEQ ID NO: 344476 - RNA, 22 nt, Homo sapiens
ugauccuguccuuaugauguua

SEQ ID NO: 344477 - RNA, 22 nt, Homo sapiens
ugaucuuuuuaauguccauggg

SEQ ID NO: 344478 - RNA, 20 nt, Homo sapiens
ugaugcaaaucuuuaaaagu

SEQ ID NO: 344479 - RNA, 22 nt, Homo sapiens
ugaugcuaccuaaagcaaccau

SEQ ID NO: 344480 - RNA, 22 nt, Homo sapiens
ugaugcugaugccugccagaag

SEQ ID NO: 344481 - RNA, 21 nt, Homo sapiens
ugaugcuuuucuuaaccuugc

SEQ ID NO: 344482 - RNA, 22 nt, Homo sapiens
ugauguaggacauuauuauuuc

SEQ ID NO: 344483 - RNA, 22 nt, Homo sapiens
ugauguauuauuaagaccuggc

SEQ ID NO: 344484 - RNA, 20 nt, Homo sapiens
ugauguccaggcagagguuu

SEQ ID NO: 344485 - RNA, 22 nt, Homo sapiens
ugaugucuugcaggcacgagau

SEQ ID NO: 344486 - RNA, 22 nt, Homo sapiens
ugauguugacuguaggcagaga

SEQ ID NO: 344487 - RNA, 22 nt, Homo sapiens
ugcaaagucgaaacugcaguuu

SEQ ID NO: 344488 - RNA, 22 nt, Homo sapiens
ugcaaaugcugcuauuucucuu

SEQ ID NO: 344489 - RNA, 22 nt, Homo sapiens
ugcaaauguuaggugucauuau

SEQ ID NO: 344490 - RNA, 19 nt, Homo sapiens
ugcaaauucuaaaaacuga

SEQ ID NO: 344491 - RNA, 22 nt, Homo sapiens
ugcaagaugauuucaauugaua

SEQ ID NO: 344492 - RNA, 22 nt, Homo sapiens
ugcaauauccucuacuauaggu

SEQ ID NO: 344493 - RNA, 20 nt, Homo sapiens
ugcagcacugggaaugcagu

SEQ ID NO: 344494 - RNA, 18 nt, Homo sapiens
ugcagcaucaguacccag

SEQ ID NO: 344495 - RNA, 22 nt, Homo sapiens
ugcagcauugcacuccagccug

SEQ ID NO: 344496 - RNA, 22 nt, Homo sapiens
ugcaugcaucuuuuauaguagc

SEQ ID NO: 344497 - RNA, 22 nt, Homo sapiens
ugcauggagauauacaguuuuu

SEQ ID NO: 344498 - RNA, 22 nt, Homo sapiens
ugcauggucauacauggcaccc

SEQ ID NO: 344499 - RNA, 22 nt, Homo sapiens
ugcauguucuuacucauacaug

SEQ ID NO: 344500 - RNA, 20 nt, Homo sapiens
ugccaagaugacuauagcuc

SEQ ID NO: 344501 - RNA, 22 nt, Homo sapiens
ugccaguauuuuauugaagauu

SEQ ID NO: 344502 - RNA, 22 nt, Homo sapiens
ugccaguauuuuguugaagauu

SEQ ID NO: 344503 - RNA, 22 nt, Homo sapiens
ugccaguauuuuguugaggauu

SEQ ID NO: 344504 - RNA, 22 nt, Homo sapiens
ugcccuuugucagaugaguagg

SEQ ID NO: 344505 - RNA, 23 nt, Homo sapiens
ugccuagaugcugcccugggaca

SEQ ID NO: 344506 - RNA, 21 nt, Homo sapiens
ugccuuuguaguaggugucuu

SEQ ID NO: 344507 - RNA, 22 nt, Homo sapiens
ugcgccauugcacuccagccug

SEQ ID NO: 344508 - RNA, 22 nt, Homo sapiens
ugcgccauugcauuccagccug

SEQ ID NO: 344509 - RNA, 22 nt, Homo sapiens
ugcucaccugcugcucaccucc

SEQ ID NO: 344510 - RNA, 22 nt, Homo sapiens
ugcugcacuuauggcucugagg

SEQ ID NO: 344511 - RNA, 22 nt, Homo sapiens
ugcugcauuggggauuaaguuu

SEQ ID NO: 344512 - RNA, 22 nt, Homo sapiens
ugcuggugauuaaauccugaag

SEQ ID NO: 344513 - RNA, 22 nt, Homo sapiens
ugcuuaguguugacccucugcc

SEQ ID NO: 344514 - RNA, 21 nt, Homo sapiens
ugcuuuggucauacuucuucc

SEQ ID NO: 344515 - RNA, 22 nt, Homo sapiens
uggaaauaaaugugccaagauc

SEQ ID NO: 344516 - RNA, 19 nt, Homo sapiens
uggaacugauucaguucug

SEQ ID NO: 344517 - RNA, 23 nt, Homo sapiens
uggaagacuccucucuuggcugc

SEQ ID NO: 344518 - RNA, 22 nt, Homo sapiens
ggcagaucauuggccucaguuu

SEQ ID NO: 344519 - RNA, 22 nt, Homo sapiens
ggcagcucaggccccgcgcuga

SEQ ID NO: 344520 - RNA, 22 nt, Homo sapiens
ggcaguuuggcaguuucauaaa

SEQ ID NO: 344521 - RNA, 22 nt, Homo sapiens
ggcaugguggugugugccuaua

SEQ ID NO: 344522 - RNA, 22 nt, Homo sapiens
ggcauguauucuuauuauuccu

SEQ ID NO: 344523 - RNA, 22 nt, Homo sapiens
ggcccugauacaaguaaggucu

SEQ ID NO: 344524 - RNA, 22 nt, Homo sapiens
ggcuagagagcucagggauaug

SEQ ID NO: 344525 - RNA, 22 nt, Homo sapiens
gggaaugaagagaaccuuccca

SEQ ID NO: 344526 - RNA, 22 nt, Homo sapiens
gggaugaaguugauguagaaag

SEQ ID NO: 344527 - RNA, 22 nt, Homo sapiens
gggcaacauugaguacccugaa

SEQ ID NO: 344528 - RNA, 22 nt, Homo sapiens
gggcuagaauccgcgucucuug

SEQ ID NO: 344529 - RNA, 22 nt, Homo sapiens
ggguaaaucucuuuucauggcu

SEQ ID NO: 344530 - RNA, 22 nt, Homo sapiens
gguaacaguggggcuaugcuua

SEQ ID NO: 344531 - RNA, 19 nt, Homo sapiens
ggucauggagguuguguga

SEQ ID NO: 344532 - RNA, 22 nt, Homo sapiens
ggugagaaagggauuccuguuc

SEQ ID NO: 344533 - RNA, 22 nt, Homo sapiens
ggugaucauugucucuaguaug

SEQ ID NO: 344534 - RNA, 19 nt, Homo sapiens
ggugcuugaauauuccucc

SEQ ID NO: 344535 - RNA, 22 nt, Homo sapiens
gguggcuuuuugugauggcuga

SEQ ID NO: 344536 - RNA, 22 nt, Homo sapiens
gguuagaaacagguccucagga

SEQ ID NO: 344537 - RNA, 22 nt, Homo sapiens
guaaacuuccccucaugaauga

SEQ ID NO: 344538 - RNA, 22 nt, Homo sapiens
guaaagacacaugcacacguau

SEQ ID NO: 344539 - RNA, 22 nt, Homo sapiens
guaacacaugcugcucucuggu

SEQ ID NO: 344540 - RNA, 23 nt, Homo sapiens
guaauacuagucauaguagcagg

SEQ ID NO: 344541 - RNA, 22 nt, Homo sapiens
guaauacuuuugggauauuaga

SEQ ID NO: 344542 - RNA, 22 nt, Homo sapiens
guaaucucagcuacucaggagg

SEQ ID NO: 344543 - RNA, 22 nt, Homo sapiens
guaaucucagcuacuugggagu

SEQ ID NO: 344544 - RNA, 22 nt, Homo sapiens
guacacauacauauaugugugu

SEQ ID NO: 344545 - RNA, 22 nt, Homo sapiens
guacaguacugaaugaauguau

SEQ ID NO: 344546 - RNA, 22 nt, Homo sapiens
guacaguaguaaaagugaauga

SEQ ID NO: 344547 - RNA, 22 nt, Homo sapiens
guacagugcucacaaugagagc

SEQ ID NO: 344548 - RNA, 22 nt, Homo sapiens
guacaugcauacaugcacaucu

SEQ ID NO: 344549 - RNA, 22 nt, Homo sapiens
guacauggaaugaaauucaaaa

SEQ ID NO: 344550 - RNA, 22 nt, Homo sapiens
guacaugugcacagugugcagg

SEQ ID NO: 344551 - RNA, 22 nt, Homo sapiens
guacccuggaacaacccaauuu

SEQ ID NO: 344552 - RNA, 22 nt, Homo sapiens
guagaagcacagggccuguauu

SEQ ID NO: 344553 - RNA, 22 nt, Homo sapiens
guagaauguauacaguauacag

SEQ ID NO: 344554 - RNA, 22 nt, Homo sapiens
guagagagaaauacaaagcugu

SEQ ID NO: 344555 - RNA, 22 nt, Homo sapiens
guagcagaacauguuccuugua

SEQ ID NO: 344556 - RNA, 22 nt, Homo sapiens
guagugcaguuugagaaucagu

SEQ ID NO: 344557 - RNA, 22 nt, Homo sapiens
guauacaguugacccuugaacc

SEQ ID NO: 344558 - RNA, 22 nt, Homo sapiens
guaugaaaaucggagauugggu

SEQ ID NO: 344559 - RNA, 22 nt, Homo sapiens
guauugacauuuuuaaggaacu

SEQ ID NO: 344560 - RNA, 22 nt, Homo sapiens
guauugaguaaauguuuauugg

SEQ ID NO: 344561 - RNA, 22 nt, Homo sapiens
guauuuuguuagggugugguau

SEQ ID NO: 344562 - RNA, 22 nt, Homo sapiens
gucaagugaagcagugggagua

SEQ ID NO: 344563 - RNA, 22 nt, Homo sapiens
gucacagcuggcauugucugca

SEQ ID NO: 344564 - RNA, 22 nt, Homo sapiens
gucacaguguuuguucauccca

SEQ ID NO: 344565 - RNA, 22 nt, Homo sapiens
gucacugagcaauagaaaguuu

SEQ ID NO: 344566 - RNA, 22 nt, Homo sapiens
gucacugagcagaaggaagcga

SEQ ID NO: 344567 - RNA, 22 nt, Homo sapiens
gucacugccugaggcugaugca

SEQ ID NO: 344568 - RNA, 22 nt, Homo sapiens
gucacugugacggcaguuacau

SEQ ID NO: 344569 - RNA, 22 nt, Homo sapiens
gucagagcacugaguugugggc

SEQ ID NO: 344570 - RNA, 22 nt, Homo sapiens
gucagauaauuugcauccaucu

SEQ ID NO: 344571 - RNA, 22 nt, Homo sapiens
gucagugucuuaacagagauua

SEQ ID NO: 344572 - RNA, 22 nt, Homo sapiens
gucagugugauaucugcagggg

SEQ ID NO: 344573 - RNA, 22 nt, Homo sapiens
gucauauaggguuuaccuguau

SEQ ID NO: 344574 - RNA, 22 nt, Homo sapiens
gucaucaggacgggucaucugc

SEQ ID NO: 344575 - RNA, 20 nt, Homo sapiens
ugagaacaugugguauuugg

SEQ ID NO: 344576 - RNA, 22 nt, Homo sapiens
ugagaacugcagggagcugcau

SEQ ID NO: 344577 - RNA, 22 nt, Homo sapiens
ugagaacugguagcacuuguga

SEQ ID NO: 344578 - RNA, 22 nt, Homo sapiens
ugagacaaaguuguuggauguu

SEQ ID NO: 344579 - RNA, 22 nt, Homo sapiens
ugagacaucugagauuuuaagc

SEQ ID NO: 344580 - RNA, 22 nt, Homo sapiens
ugagagaugauaaaauguuugu

SEQ ID NO: 344581 - RNA, 19 nt, Homo sapiens
ugagagcacaacugaacaa

SEQ ID NO: 344582 - RNA, 22 nt, Homo sapiens
ugagagucacugaccugguaua

SEQ ID NO: 344583 - RNA, 22 nt, Homo sapiens
ugagauaacuaaaaacauuuug

SEQ ID NO: 344584 - RNA, 22 nt, Homo sapiens
ugagauaaugcaugugaagauc

SEQ ID NO: 344585 - RNA, 22 nt, Homo sapiens
ugagauaggaucuugcucuguu

SEQ ID NO: 344586 - RNA, 22 nt, Homo sapiens
ugagauccugugacuacacuga

SEQ ID NO: 344587 - RNA, 23 nt, Homo sapiens
ugagaucuacagaucucagaucu

SEQ ID NO: 344588 - RNA, 22 nt, Homo sapiens
ugagaucuucgcucuucacaga

SEQ ID NO: 344589 - RNA, 22 nt, Homo sapiens
ugagaugaagucucacucuguc

SEQ ID NO: 344590 - RNA, 22 nt, Homo sapiens
ugagaugaggucucgcucuguc

SEQ ID NO: 344591 - RNA, 22 nt, Homo sapiens
ugagaugaguucucgcucuguc

SEQ ID NO: 344592 - RNA, 22 nt, Homo sapiens
ugagaugauaucuuauuguaau

SEQ ID NO: 344593 - RNA, 22 nt, Homo sapiens
gagugcaauggcaagaucuugg

SEQ ID NO: 344594 - RNA, 22 nt, Homo sapiens
gagugcaauggugccaucucgg

SEQ ID NO: 344595 - RNA, 22 nt, Homo sapiens
gagugcauaugggccuguguca

SEQ ID NO: 344596 - RNA, 22 nt, Homo sapiens
gagugcuguuagcccuggguuu

SEQ ID NO: 344597 - RNA, 22 nt, Homo sapiens
gaguucaauuuccagcuguucu

SEQ ID NO: 344598 - RNA, 22 nt, Homo sapiens
gaguucauaucuaugagugugc

SEQ ID NO: 344599 - RNA, 22 nt, Homo sapiens
gaguugagagaguuguuauuuc

SEQ ID NO: 344600 - RNA, 22 nt, Homo sapiens
gauacaccauuuucuagcuauu

SEQ ID NO: 344601 - RNA, 22 nt, Homo sapiens
gauauguucuuucacguuggug

SEQ ID NO: 344602 - RNA, 19 nt, Homo sapiens
gauauguugagcacccuuu

SEQ ID NO: 344603 - RNA, 22 nt, Homo sapiens
gauauguuguuggauucgguua

SEQ ID NO: 344604 - RNA, 22 nt, Homo sapiens
gaucacauuguuucauacauau

SEQ ID NO: 344605 - RNA, 22 nt, Homo sapiens
gaucugugugauuggaugcauu

SEQ ID NO: 344606 - RNA, 22 nt, Homo sapiens
gaugagaucauaaguguggagc

SEQ ID NO: 344607 - RNA, 22 nt, Homo sapiens
gaugaggcuagagacaugugua

SEQ ID NO: 344608 - RNA, 22 nt, Homo sapiens
gauggcacuaagccauguagga

SEQ ID NO: 344609 - RNA, 22 nt, Homo sapiens
gauggguuuuuugaagacagca

SEQ ID NO: 344610 - RNA, 22 nt, Homo sapiens
gauuagcacuucaguuacagua

SEQ ID NO: 344611 - RNA, 22 nt, Homo sapiens
gauuccacuuacuuagcauucc

SEQ ID NO: 344612 - RNA, 22 nt, Homo sapiens
gauuccauuuguggcuauuuac

SEQ ID NO: 344613 - RNA, 22 nt, Homo sapiens
gauuggcauugcugcaccugag

SEQ ID NO: 344614 - RNA, 22 nt, Homo sapiens
gauugguugaaaguagaauacu

SEQ ID NO: 344615 - RNA, 22 nt, Homo sapiens
gauuucacuuucuggaugugca

SEQ ID NO: 344616 - RNA, 22 nt, Homo sapiens
gcacauauguaaauagcugccu

SEQ ID NO: 344617 - RNA, 22 nt, Homo sapiens
gcagaguauagagggcugggcc

SEQ ID NO: 344618 - RNA, 20 nt, Homo sapiens
gcagcaccauauuucuaaga

SEQ ID NO: 344619 - RNA, 22 nt, Homo sapiens
gcaggauuggagccucucugaa

SEQ ID NO: 344620 - RNA, 22 nt, Homo sapiens
gcaguacacuguugguaggaau

SEQ ID NO: 344621 - RNA, 22 nt, Homo sapiens
gcaguauuguugaaauguccau

SEQ ID NO: 344622 - RNA, 23 nt, Homo sapiens
gcagucauuuggaaaagguugaa

SEQ ID NO: 344623 - RNA, 22 nt, Homo sapiens
gcaguguucaaaucaugcccau

SEQ ID NO: 344624 - RNA, 22 nt, Homo sapiens
gcaguguugugauccaggucuu

SEQ ID NO: 344625 - RNA, 22 nt, Homo sapiens
gcauggagaaggggacugauuc

SEQ ID NO: 344626 - RNA, 22 nt, Homo sapiens
gcauggagcauacauuucuguu

SEQ ID NO: 344627 - RNA, 22 nt, Homo sapiens
gcauggaguggaaauucuuggg

SEQ ID NO: 344628 - RNA, 22 nt, Homo sapiens
gcauggccuuuaaaugucacag

SEQ ID NO: 344629 - RNA, 22 nt, Homo sapiens
gccaacauggcgcuccauucuu

SEQ ID NO: 344630 - RNA, 22 nt, Homo sapiens
gccaagauuuaauucaucaguu

SEQ ID NO: 344631 - RNA, 22 nt, Homo sapiens
gccagugugaugugaucauggc

SEQ ID NO: 344632 - RNA, 22 nt, Homo sapiens
gccaguguuuuauugagaauuu

SEQ ID NO: 344633 - RNA, 22 nt, Homo sapiens
gccauggaggauuuauagaggc

SEQ ID NO: 344634 - RNA, 22 nt, Homo sapiens
gccauugcacuacagccuaggc

SEQ ID NO: 344635 - RNA, 22 nt, Homo sapiens
gccauugcacuccagccugagc

SEQ ID NO: 344636 - RNA, 22 nt, Homo sapiens
gccuuuggugacaggcaugugu

SEQ ID NO: 344637 - RNA, 22 nt, Homo sapiens
gcguugcacuccagccugggua

SEQ ID NO: 344638 - RNA, 22 nt, Homo sapiens
gcugcuguuucucuuucagcau

SEQ ID NO: 344639 - RNA, 22 nt, Homo sapiens
gcugcuuuugaugacaaaaaca

SEQ ID NO: 344640 - RNA, 22 nt, Homo sapiens
gcuggcaagaugcugaugcaac

SEQ ID NO: 344641 - RNA, 22 nt, Homo sapiens
gcuggugaaggcugaaaagugg

SEQ ID NO: 344642 - RNA, 22 nt, Homo sapiens
gcugguguagagugcagaaagg

SEQ ID NO: 344643 - RNA, 22 nt, Homo sapiens
gcuguugcuauuauuccgagaa

SEQ ID NO: 344644 - RNA, 22 nt, Homo sapiens
gcuguugugaacuauacaucua

SEQ ID NO: 344645 - RNA, 22 nt, Homo sapiens
gcuuguguucaagucacccuua

SEQ ID NO: 344646 - RNA, 22 nt, Homo sapiens
gcuuuguugauggugagucugu

SEQ ID NO: 344647 - RNA, 23 nt, Homo sapiens
ggaaacauccagucuuucaccau

SEQ ID NO: 344648 - RNA, 22 nt, Homo sapiens
ggaaagauguaauauuaucuaa

SEQ ID NO: 344649 - RNA, 22 nt, Homo sapiens
ggaaaguaacccauucucuuac

SEQ ID NO: 344650 - RNA, 22 nt, Homo sapiens
ggaagaauaaugggccuuagag

SEQ ID NO: 344651 - RNA, 22 nt, Homo sapiens
ggaagaauauuaggggauuucg

SEQ ID NO: 344652 - RNA, 18 nt, Homo sapiens
ggaagauuggcuaugugc

SEQ ID NO: 344653 - RNA, 22 nt, Homo sapiens
ggaaucugaaccaugggaaugg

SEQ ID NO: 344654 - RNA, 22 nt, Homo sapiens
ggaaugcagugagcauuagaua

SEQ ID NO: 344655 - RNA, 22 nt, Homo sapiens
ggaauguuaaagacuacacuga

SEQ ID NO: 344656 - RNA, 20 nt, Homo sapiens
ggaauguuaaucuccaugau

SEQ ID NO: 344657 - RNA, 22 nt, Homo sapiens
ggaauuaaggcaauugaaagcu

SEQ ID NO: 344658 - RNA, 22 nt, Homo sapiens
ggacaaaguauuuucaaaugua

SEQ ID NO: 344659 - RNA, 22 nt, Homo sapiens
ggacaguagugcuuucuaucau

SEQ ID NO: 344660 - RNA, 22 nt, Homo sapiens
ggagaguaauuagacugaaaga

SEQ ID NO: 344661 - RNA, 22 nt, Homo sapiens
ggagauaauccagggagggacu

SEQ ID NO: 344662 - RNA, 22 nt, Homo sapiens
ggagaucuuguuaaaguacaga

SEQ ID NO: 344663 - RNA, 22 nt, Homo sapiens
ggagcucaucuagcauagaggu

SEQ ID NO: 344664 - RNA, 20 nt, Homo sapiens
ggagguuguauaaguacauc

SEQ ID NO: 344665 - RNA, 22 nt, Homo sapiens
ggagucugaacuggacaaugac

SEQ ID NO: 344666 - RNA, 22 nt, Homo sapiens
ggagucugauguucuaaggcag

SEQ ID NO: 344667 - RNA, 23 nt, Homo sapiens
ggaguguaaauuauuucaaccau

SEQ ID NO: 344668 - RNA, 23 nt, Homo sapiens
ggaguguaaugacucgaucucgg

SEQ ID NO: 344669 - RNA, 22 nt, Homo sapiens
ggaguguaguggcuccaucucg

SEQ ID NO: 344670 - RNA, 22 nt, Homo sapiens
ggaugcauuuuugguugucaca

SEQ ID NO: 344671 - RNA, 21 nt, Homo sapiens
ggauucaucccucaugaauuu

SEQ ID NO: 344672 - RNA, 22 nt, Homo sapiens
ggcaaagaugaccauuacuuuu

SEQ ID NO: 344673 - RNA, 22 nt, Homo sapiens
ggcaacaauuccuacuucuuuu

SEQ ID NO: 344674 - RNA, 22 nt, Homo sapiens
ggcaacauggugaaacucuguc

SEQ ID NO: 344675 - RNA, 21 nt, Homo sapiens
ggcaagaaacacaaucaagua

SEQ ID NO: 344676 - RNA, 17 nt, Homo sapiens
ggcaagaaguggaacuc

SEQ ID NO: 344677 - RNA, 22 nt, Homo sapiens
ggcaaggaggggcacuuucacu

SEQ ID NO: 344678 - RNA, 22 nt, Homo sapiens
ggcaaugucagcuaaugaugga

SEQ ID NO: 344679 - RNA, 22 nt, Homo sapiens
ggcacgguggcucacaccugua

SEQ ID NO: 344680 - RNA, 22 nt, Homo sapiens
cugcuguuguuaacuuuuggag

SEQ ID NO: 344681 - RNA, 22 nt, Homo sapiens
cuggaaugcagcuuuaggggcu

SEQ ID NO: 344682 - RNA, 22 nt, Homo sapiens
cuggaaugugagccccaaaaag

SEQ ID NO: 344683 - RNA, 22 nt, Homo sapiens
cuggaguaugauguuagcguug

SEQ ID NO: 344684 - RNA, 22 nt, Homo sapiens
cuggaguuugaggcugcaguga

SEQ ID NO: 344685 - RNA, 19 nt, Homo sapiens
cuggcaaaugcuuuggcca

SEQ ID NO: 344686 - RNA, 22 nt, Homo sapiens
cuggcaagaggauaaaguccua

SEQ ID NO: 344687 - RNA, 22 nt, Homo sapiens
cuggcacagugucagaaacaca

SEQ ID NO: 344688 - RNA, 22 nt, Homo sapiens
cugggaugugacuguugccccc

SEQ ID NO: 344689 - RNA, 22 nt, Homo sapiens
cugggcaaugcggcuggauaga

SEQ ID NO: 344690 - RNA, 21 nt, Homo sapiens
cugguguuagcacuucuuccc

SEQ ID NO: 344691 - RNA, 22 nt, Homo sapiens
cuguagcuuuuauaugcuuagc

SEQ ID NO: 344692 - RNA, 22 nt, Homo sapiens
cuguaugugagaaauaauaagu

SEQ ID NO: 344693 - RNA, 22 nt, Homo sapiens
cugucacugggaggggcagcag

SEQ ID NO: 344694 - RNA, 22 nt, Homo sapiens
cugucucagugaauugguuuua

SEQ ID NO: 344695 - RNA, 22 nt, Homo sapiens
cugugauagguuagucaugaau

SEQ ID NO: 344696 - RNA, 22 nt, Homo sapiens
cugugauuauauaguuaaggua

SEQ ID NO: 344697 - RNA, 22 nt, Homo sapiens
cugugcauucuuaaaucaggaa

SEQ ID NO: 344698 - RNA, 19 nt, Homo sapiens
cugugcauuucuguggaag

SEQ ID NO: 344699 - RNA, 22 nt, Homo sapiens
cuguggguuuuacuguuuuacu

SEQ ID NO: 344700 - RNA, 22 nt, Homo sapiens
cugugguauuauuagaaauauc

SEQ ID NO: 344701 - RNA, 22 nt, Homo sapiens
cuguguaguacuagauugagca

SEQ ID NO: 344702 - RNA, 22 nt, Homo sapiens
cuguuuguuuaggguacucaga

SEQ ID NO: 344703 - RNA, 22 nt, Homo sapiens
cuuaaguaguuguggaaugaau

SEQ ID NO: 344704 - RNA, 22 nt, Homo sapiens
cuucaaguguggccaccugacc

SEQ ID NO: 344705 - RNA, 18 nt, Homo sapiens
cuucauugcuguuuugcu

SEQ ID NO: 344706 - RNA, 22 nt, Homo sapiens
cuugaauguaaauaauguacag

SEQ ID NO: 344707 - RNA, 22 nt, Homo sapiens
cuugacacugucacucaggcca

SEQ ID NO: 344708 - RNA, 19 nt, Homo sapiens
cuugccccauucauccucu

SEQ ID NO: 344709 - RNA, 22 nt, Homo sapiens
cuuggcacugcucacccuccuu

SEQ ID NO: 344710 - RNA, 22 nt, Homo sapiens
cuuggguaagucauuaaaauua

SEQ ID NO: 344711 - RNA, 22 nt, Homo sapiens
cuugguacucugugucccagcu

SEQ ID NO: 344712 - RNA, 22 nt, Homo sapiens
cuugugcaugaccccagguggg

SEQ ID NO: 344713 - RNA, 22 nt, Homo sapiens
cuuuacaguuggacucacgagg

SEQ ID NO: 344714 - RNA, 21 nt, Homo sapiens
cuuuaugcuguguuagaaaag

SEQ ID NO: 344715 - RNA, 22 nt, Homo sapiens
cuuugauuauaaaaggguguuu

SEQ ID NO: 344716 - RNA, 21 nt, Homo sapiens
cuuugcacugcuccucagcuc

SEQ ID NO: 344717 - RNA, 20 nt, Homo sapiens
cuuuggcaaugagaacaggg

SEQ ID NO: 344718 - RNA, 22 nt, Homo sapiens
cuuugggaccgcgguuuauacu

SEQ ID NO: 344719 - RNA, 22 nt, Homo sapiens
cuuugguuuacuuggugcuagu

SEQ ID NO: 344720 - RNA, 22 nt, Homo sapiens
cuuuguaugucaugacaacugu

SEQ ID NO: 344721 - RNA, 23 nt, Homo sapiens
cuuuguccccacccaaaucucau

SEQ ID NO: 344722 - RNA, 22 nt, Homo sapiens
cuuuuacacuguuggcaggauu

SEQ ID NO: 344723 - RNA, 20 nt, Homo sapiens
cuuuuagcagcagcaagaga

SEQ ID NO: 344724 - RNA, 22 nt, Homo sapiens
cuuuuggugugaagaagcucuu

SEQ ID NO: 344725 - RNA, 22 nt, Homo sapiens
gaaagauuuccugagcuagaaa

SEQ ID NO: 344726 - RNA, 18 nt, Homo sapiens
gaaaugccucuugcuuac

SEQ ID NO: 344727 - RNA, 22 nt, Homo sapiens
gaaaugucugagauguggcuca

SEQ ID NO: 344728 - RNA, 23 nt, Homo sapiens
gaaaugucuuagugaaauugcuu

SEQ ID NO: 344729 - RNA, 22 nt, Homo sapiens
gaacccuggaggcggagguugc

SEQ ID NO: 344730 - RNA, 22 nt, Homo sapiens
gaacugggguuggguugcgaua

SEQ ID NO: 344731 - RNA, 22 nt, Homo sapiens
gaagauaucuaguaccauuguc

SEQ ID NO: 344732 - RNA, 22 nt, Homo sapiens
gaagauguugcuuaccuuggag

SEQ ID NO: 344733 - RNA, 22 nt, Homo sapiens
gaaguaauaaauggauucuuaa

SEQ ID NO: 344734 - RNA, 22 nt, Homo sapiens
gaagugcuuuuggacuaacagu

SEQ ID NO: 344735 - RNA, 22 nt, Homo sapiens
gaagugguaggauugcuuuuga

SEQ ID NO: 344736 - RNA, 22 nt, Homo sapiens
gaauacugacuauuucaucugg

SEQ ID NO: 344737 - RNA, 22 nt, Homo sapiens
gaaucaauugaucuaugugucu

SEQ ID NO: 344738 - RNA, 22 nt, Homo sapiens
gaauucugucgcuuacuagaug

SEQ ID NO: 344739 - RNA, 22 nt, Homo sapiens
gacaccugguguggaacuggag

SEQ ID NO: 344740 - RNA, 22 nt, Homo sapiens
gacuuagagauguuguauuugg

SEQ ID NO: 344741 - RNA, 22 nt, Homo sapiens
gacuucaucauacuaugugugg

SEQ ID NO: 344742 - RNA, 22 nt, Homo sapiens
gagaacagaagcauuccuaauu

SEQ ID NO: 344743 - RNA, 22 nt, Homo sapiens
gagaacauacggcauuugguuu

SEQ ID NO: 344744 - RNA, 22 nt, Homo sapiens
gagaaugaacagacugccucuu

SEQ ID NO: 344745 - RNA, 22 nt, Homo sapiens
gagaaugaugauuuccaauuuc

SEQ ID NO: 344746 - RNA, 22 nt, Homo sapiens
gagaccauuuacugccuacuua

SEQ ID NO: 344747 - RNA, 22 nt, Homo sapiens
gagacucuuagauuggaaaucu

SEQ ID NO: 344748 - RNA, 22 nt, Homo sapiens
gagacugagucucgcucugccg

SEQ ID NO: 344749 - RNA, 22 nt, Homo sapiens
gagagugcuuuggguguaggcc

SEQ ID NO: 344750 - RNA, 22 nt, Homo sapiens
gagauauuauuucccuuucaca

SEQ ID NO: 344751 - RNA, 22 nt, Homo sapiens
gagaucacuguuuauauucucu

SEQ ID NO: 344752 - RNA, 22 nt, Homo sapiens
gagaucauucugauccagaguc

SEQ ID NO: 344753 - RNA, 22 nt, Homo sapiens
gagaugaugagauguucacagu

SEQ ID NO: 344754 - RNA, 22 nt, Homo sapiens
gagauggaguuucacuucgcuc

SEQ ID NO: 344755 - RNA, 22 nt, Homo sapiens
gagauuaauacacaucaaaugc

SEQ ID NO: 344756 - RNA, 22 nt, Homo sapiens
gagcaaugauugagccacugua

SEQ ID NO: 344757 - RNA, 22 nt, Homo sapiens
gagcaccagucccugucagugc

SEQ ID NO: 344758 - RNA, 18 nt, Homo sapiens
gagcaccuuuuuugcaga

SEQ ID NO: 344759 - RNA, 22 nt, Homo sapiens
gagccauggagaaaacagcuau

SEQ ID NO: 344760 - RNA, 22 nt, Homo sapiens
gagcucauuaaaaauguagaau

SEQ ID NO: 344761 - RNA, 22 nt, Homo sapiens
gaggagauauucugcuggaugg

SEQ ID NO: 344762 - RNA, 22 nt, Homo sapiens
gagguaugugggcagacauuua

SEQ ID NO: 344763 - RNA, 22 nt, Homo sapiens
gaggucauucugugguacccag

SEQ ID NO: 344764 - RNA, 22 nt, Homo sapiens
gagguggauacauuaaauaaug

SEQ ID NO: 344765 - RNA, 22 nt, Homo sapiens
gaguaaauguccuagcuucuug

SEQ ID NO: 344766 - RNA, 22 nt, Homo sapiens
gagucagugucuugcucuguca

SEQ ID NO: 344767 - RNA, 21 nt, Homo sapiens
caugucacugcacucuagccu

SEQ ID NO: 344768 - RNA, 19 nt, Homo sapiens
caugugcacuacuggcuuc

SEQ ID NO: 344769 - RNA, 20 nt, Homo sapiens
cauuacacuccaaccugggu

SEQ ID NO: 344770 - RNA, 22 nt, Homo sapiens
cauugcaaugaggucuugcagu

SEQ ID NO: 344771 - RNA, 19 nt, Homo sapiens
cauugcacuccacccuggg

SEQ ID NO: 344772 - RNA, 22 nt, Homo sapiens
cauugcacuccagccuaggcaa

SEQ ID NO: 344773 - RNA, 22 nt, Homo sapiens
cauugcacuccagccugcacga

SEQ ID NO: 344774 - RNA, 22 nt, Homo sapiens
cauugcacuccagccuugguga

SEQ ID NO: 344775 - RNA, 22 nt, Homo sapiens
cauugcacuccaucccgggaaa

SEQ ID NO: 344776 - RNA, 16 nt, Homo sapiens
cauugcacucuagccu

SEQ ID NO: 344777 - RNA, 22 nt, Homo sapiens
cauugcacucuaucccgguggg

SEQ ID NO: 344778 - RNA, 22 nt, Homo sapiens
cauugcacucugcauuccaguc

SEQ ID NO: 344779 - RNA, 22 nt, Homo sapiens
cauugcaugcauauggcuuggu

SEQ ID NO: 344780 - RNA, 20 nt, Homo sapiens
cauugcccuccagccugggc

SEQ ID NO: 344781 - RNA, 22 nt, Homo sapiens
cauugcccuccagccugggcaa

SEQ ID NO: 344782 - RNA, 22 nt, Homo sapiens
cauuuugcaguuucugucucca

SEQ ID NO: 344783 - RNA, 22 nt, Homo sapiens
ccacacugucuuggugggaaac

SEQ ID NO: 344784 - RNA, 22 nt, Homo sapiens
ccacaguggauuaaaguuacug

SEQ ID NO: 344785 - RNA, 22 nt, Homo sapiens
ccacaguugaaauuuugacugu

SEQ ID NO: 344786 - RNA, 22 nt, Homo sapiens
ccagaguggagccuuugcgagg

SEQ ID NO: 344787 - RNA, 22 nt, Homo sapiens
ccagaguugccucagguuucug

SEQ ID NO: 344788 - RNA, 22 nt, Homo sapiens
ccagucuuggugucuguagcac

SEQ ID NO: 344789 - RNA, 21 nt, Homo sapiens
ccaguguaaugauagcaggca

SEQ ID NO: 344790 - RNA, 22 nt, Homo sapiens
ccagugucugacagacacggcg

SEQ ID NO: 344791 - RNA, 20 nt, Homo sapiens
ccaguguuauuuauguucua

SEQ ID NO: 344792 - RNA, 22 nt, Homo sapiens
ccaguguucuggaaggcugagu

SEQ ID NO: 344793 - RNA, 22 nt, Homo sapiens
ccaguuuuuggcaaugaugaau

SEQ ID NO: 344794 - RNA, 22 nt, Homo sapiens
ccaucacacugugauuauuauc

SEQ ID NO: 344795 - RNA, 20 nt, Homo sapiens
ccaucaguccucucuuguuc

SEQ ID NO: 344796 - RNA, 22 nt, Homo sapiens
ccauugcacuccagccuaggca

SEQ ID NO: 344797 - RNA, 22 nt, Homo sapiens
ccauugcacuucagccuaggug

SEQ ID NO: 344798 - RNA, 22 nt, Homo sapiens
cccagcguucggcauggcugag

SEQ ID NO: 344799 - RNA, 22 nt, Homo sapiens
cccagugguuacauaaggagua

SEQ ID NO: 344800 - RNA, 19 nt, Homo sapiens
cccagugucagagaagggu

SEQ ID NO: 344801 - RNA, 22 nt, Homo sapiens
cccaguguuuauuuugagccaa

SEQ ID NO: 344802 - RNA, 22 nt, Homo sapiens
ccccaguguguaaaggccuugc

SEQ ID NO: 344803 - RNA, 22 nt, Homo sapiens
cccugaagaaagccuaggacau

SEQ ID NO: 344804 - RNA, 19 nt, Homo sapiens
cccuggcacauggaaaaug

SEQ ID NO: 344805 - RNA, 21 nt, Homo sapiens
cccugguguuuggaguuugag

SEQ ID NO: 344806 - RNA, 22 nt, Homo sapiens
cccuguguuguucaaggaucug

SEQ ID NO: 344807 - RNA, 22 nt, Homo sapiens
ccucuguaguccugcaagagga

SEQ ID NO: 344808 - RNA, 22 nt, Homo sapiens
ccucuuuguugagacuucacca

SEQ ID NO: 344809 - RNA, 22 nt, Homo sapiens
ccuggcacugagcaguguucua

SEQ ID NO: 344810 - RNA, 22 nt, Homo sapiens
cgaggaguaucuuugugguguu

SEQ ID NO: 344811 - RNA, 21 nt, Homo sapiens
cgauaacagcccuuucccaaa

SEQ ID NO: 344812 - RNA, 22 nt, Homo sapiens
cgugaggaguauuuuuaggugc

SEQ ID NO: 344813 - RNA, 22 nt, Homo sapiens
cuaacacagagguuuauuucuc

SEQ ID NO: 344814 - RNA, 18 nt, Homo sapiens
cuaagacacuuggcagag

SEQ ID NO: 344815 - RNA, 22 nt, Homo sapiens
cuaaggaaggacugaaaggaca

SEQ ID NO: 344816 - RNA, 22 nt, Homo sapiens
cuaauccugugguagcacucaa

SEQ ID NO: 344817 - RNA, 22 nt, Homo sapiens
cuacagcacugagcugugugca

SEQ ID NO: 344818 - RNA, 22 nt, Homo sapiens
cuacaguucuuaauuaaguagu

SEQ ID NO: 344819 - RNA, 22 nt, Homo sapiens
cuagcagcaugagaauggacca

SEQ ID NO: 344820 - RNA, 22 nt, Homo sapiens
cuagccuggagugcaguggugc

SEQ ID NO: 344821 - RNA, 22 nt, Homo sapiens
cuagcugcacuuccugcuacug

SEQ ID NO: 344822 - RNA, 22 nt, Homo sapiens
cuagguuauacucugaaauggu

SEQ ID NO: 344823 - RNA, 22 nt, Homo sapiens
cuauggcucugucuuuuaaguu

SEQ ID NO: 344824 - RNA, 22 nt, Homo sapiens
cuauuagguuggggcgaaagua

SEQ ID NO: 344825 - RNA, 22 nt, Homo sapiens
cucaaaugguccagcuaguggu

SEQ ID NO: 344826 - RNA, 22 nt, Homo sapiens
cucaaguagugguuuucauuga

SEQ ID NO: 344827 - RNA, 22 nt, Homo sapiens
cucacaaccuuaugaagcauga

SEQ ID NO: 344828 - RNA, 20 nt, Homo sapiens
cucacagacagcuucuuucu

SEQ ID NO: 344829 - RNA, 20 nt, Homo sapiens
cucagauuauucugaagcaa

SEQ ID NO: 344830 - RNA, 22 nt, Homo sapiens
cucagcuacuugggaagcugag

SEQ ID NO: 344831 - RNA, 22 nt, Homo sapiens
cucaggcacucugauuccagug

SEQ ID NO: 344832 - RNA, 22 nt, Homo sapiens
cucaguguuaaggccaccucug

SEQ ID NO: 344833 - RNA, 22 nt, Homo sapiens
cucauggagaacaucugcuagg

SEQ ID NO: 344834 - RNA, 22 nt, Homo sapiens
cucauugcaaucucugccuccc

SEQ ID NO: 344835 - RNA, 23 nt, Homo sapiens
cucccugaacaugacacaccaga

SEQ ID NO: 344836 - RNA, 22 nt, Homo sapiens
cucucugagccauggcugcccu

SEQ ID NO: 344837 - RNA, 17 nt, Homo sapiens
cucucugguuuaaagca

SEQ ID NO: 344838 - RNA, 22 nt, Homo sapiens
cucugacagugguuagcacugu

SEQ ID NO: 344839 - RNA, 22 nt, Homo sapiens
cugaaaagcaucugcauagcug

SEQ ID NO: 344840 - RNA, 22 nt, Homo sapiens
cugacagaugacugccacugua

SEQ ID NO: 344841 - RNA, 22 nt, Homo sapiens
cugacauggggauccaccuuag

SEQ ID NO: 344842 - RNA, 22 nt, Homo sapiens
cugagaauguaaaugaagcuuu

SEQ ID NO: 344843 - RNA, 22 nt, Homo sapiens
cugagagugguauguuuaagug

SEQ ID NO: 344844 - RNA, 22 nt, Homo sapiens
cugagcuagaccacuuggcucc

SEQ ID NO: 344845 - RNA, 22 nt, Homo sapiens
cugaggucugaauccagguauc

SEQ ID NO: 344846 - RNA, 22 nt, Homo sapiens
cugaggugggaggauuacuuga

SEQ ID NO: 344847 - RNA, 22 nt, Homo sapiens
cugagguuaggaguuugagacc

SEQ ID NO: 344848 - RNA, 22 nt, Homo sapiens
cugagugcaagugauccuccca

SEQ ID NO: 344849 - RNA, 22 nt, Homo sapiens
cugauauuuuucuggcuugugu

SEQ ID NO: 344850 - RNA, 22 nt, Homo sapiens
cugauuguagagccccagggcu

SEQ ID NO: 344851 - RNA, 22 nt, Homo sapiens
cugauuuguccccagccucaug

SEQ ID NO: 344852 - RNA, 22 nt, Homo sapiens
cugcagucaucugaagauuuug

SEQ ID NO: 344853 - RNA, 21 nt, Homo sapiens
cugcauccauuucugagugau

SEQ ID NO: 344854 - RNA, 22 nt, Homo sapiens
uuuugucccaugggcuguuccc

SEQ ID NO: 344855 - RNA, 22 nt, Homo sapiens
uuuuucacuuaaguuaggcuca

SEQ ID NO: 344856 - RNA, 16 nt, Homo sapiens
uuuuugcagaaaugac

SEQ ID NO: 344857 - RNA, 20 nt, Homo sapiens
auuccacuuguuugagguac

SEQ ID NO: 344858 - RNA, 22 nt, Homo sapiens
auuccaguuugugagaagcugu

SEQ ID NO: 344859 - RNA, 22 nt, Homo sapiens
auucccuuagcugccucagccu

SEQ ID NO: 344860 - RNA, 22 nt, Homo sapiens
auucccuuggucaacggaugca

SEQ ID NO: 344861 - RNA, 21 nt, Homo sapiens
auugagcacaugaaacauggc

SEQ ID NO: 344862 - RNA, 22 nt, Homo sapiens
auugagucauuucaaauccaag

SEQ ID NO: 344863 - RNA, 18 nt, Homo sapiens
auugcacaccagccuggg

SEQ ID NO: 344864 - RNA, 19 nt, Homo sapiens
auugcacuccaaccugggu

SEQ ID NO: 344865 - RNA, 22 nt, Homo sapiens
auugcacuccagccugggcaac

SEQ ID NO: 344866 - RNA, 22 nt, Homo sapiens
auugcacuccagccugggcagc

SEQ ID NO: 344867 - RNA, 21 nt, Homo sapiens
auugcacuccagccugggcga

SEQ ID NO: 344868 - RNA, 22 nt, Homo sapiens
auugcacuccagccugggcuag

SEQ ID NO: 344869 - RNA, 22 nt, Homo sapiens
auugcucacacaaagccuguuu

SEQ ID NO: 344870 - RNA, 22 nt, Homo sapiens
auugcuuuuacugggagcuuug

SEQ ID NO: 344871 - RNA, 22 nt, Homo sapiens
auuguguagucuuacugcuugc

SEQ ID NO: 344872 - RNA, 22 nt, Homo sapiens
auuguguuugaaugaggcucca

SEQ ID NO: 344873 - RNA, 22 nt, Homo sapiens
auuucacugagacaugugccca

SEQ ID NO: 344874 - RNA, 15 nt, Homo sapiens
auuucacuuagcaug

SEQ ID NO: 344875 - RNA, 22 nt, Homo sapiens
auuuggguaaugagugcaaggg

SEQ ID NO: 344876 - RNA, 21 nt, Homo sapiens
auuugguggcugugugacacu

SEQ ID NO: 344877 - RNA, 22 nt, Homo sapiens
auuugucacuauguggcuaaua

SEQ ID NO: 344878 - RNA, 22 nt, Homo sapiens
auuuguccugccuuuuccuccu

SEQ ID NO: 344879 - RNA, 22 nt, Homo sapiens
auuuugguuacauaguugagcu

SEQ ID NO: 344880 - RNA, 18 nt, Homo sapiens
auuuuugcaguccacaug

SEQ ID NO: 344881 - RNA, 22 nt, Homo sapiens
auuuuugguuucaccugcacgc

SEQ ID NO: 344882 - RNA, 22 nt, Homo sapiens
caaaguaauugcuguuuugcca

SEQ ID NO: 344883 - RNA, 22 nt, Homo sapiens
caaaguaauugugguuuugcca

SEQ ID NO: 344884 - RNA, 22 nt, Homo sapiens
caaagucuucucauuaugucuu

SEQ ID NO: 344885 - RNA, 22 nt, Homo sapiens
caaagugguuuauacaugauug

SEQ ID NO: 344886 - RNA, 22 nt, Homo sapiens
caaauugcuugucuguagugga

SEQ ID NO: 344887 - RNA, 19 nt, Homo sapiens
caacccugcagagaaagga

SEQ ID NO: 344888 - RNA, 22 nt, Homo sapiens
caaguacugggcuauggauauu

SEQ ID NO: 344889 - RNA, 22 nt, Homo sapiens
caagugcuugaugaaugaucaa

SEQ ID NO: 344890 - RNA, 22 nt, Homo sapiens
caaguguuggcuuguauacaaa

SEQ ID NO: 344891 - RNA, 23 nt, Homo sapiens
caauacugaccucacguuaauag

SEQ ID NO: 344892 - RNA, 22 nt, Homo sapiens
caauacuguuaccugaaauagg

SEQ ID NO: 344893 - RNA, 19 nt, Homo sapiens
caauacuucuuggcauaca

SEQ ID NO: 344894 - RNA, 22 nt, Homo sapiens
caaugguacuagauaucuucag

SEQ ID NO: 344895 - RNA, 22 nt, Homo sapiens
cacaaugucugguaggccacuu

SEQ ID NO: 344896 - RNA, 22 nt, Homo sapiens
cacacugucuucaauggguggu

SEQ ID NO: 344897 - RNA, 22 nt, Homo sapiens
cacagcacaggcaugaguguca

SEQ ID NO: 344898 - RNA, 22 nt, Homo sapiens
cacagcgacuuccgccuaccgg

SEQ ID NO: 344899 - RNA, 22 nt, Homo sapiens
cacagggcuaacauuuuugccc

SEQ ID NO: 344900 - RNA, 22 nt, Homo sapiens
cacaguagaauagagcacuagg

SEQ ID NO: 344901 - RNA, 22 nt, Homo sapiens
cacagugaaugucaucauugcc

SEQ ID NO: 344902 - RNA, 22 nt, Homo sapiens
cacaguguuacugguaugaagu

SEQ ID NO: 344903 - RNA, 22 nt, Homo sapiens
cacaguguuccagcuauuugaa

SEQ ID NO: 344904 - RNA, 22 nt, Homo sapiens
caccagcuggcauugaauaccu

SEQ ID NO: 344905 - RNA, 22 nt, Homo sapiens
caccagguuggagugcaguggu

SEQ ID NO: 344906 - RNA, 22 nt, Homo sapiens
caccuguacauggcaguguccu

SEQ ID NO: 344907 - RNA, 22 nt, Homo sapiens
cacugaaugugagguuggggag

SEQ ID NO: 344908 - RNA, 22 nt, Homo sapiens
cacugcacuccagcuugugggc

SEQ ID NO: 344909 - RNA, 22 nt, Homo sapiens
cacugcacuccagucccgucuc

SEQ ID NO: 344910 - RNA, 22 nt, Homo sapiens
cacugcacuccagucugacgac

SEQ ID NO: 344911 - RNA, 22 nt, Homo sapiens
cacugcgacguccgccucccgg

SEQ ID NO: 344912 - RNA, 22 nt, Homo sapiens
cacuggcacuguguuuagaugg

SEQ ID NO: 344913 - RNA, 22 nt, Homo sapiens
cacugggugagauccauguuua

SEQ ID NO: 344914 - RNA, 22 nt, Homo sapiens
cacuggguuagaacaugcuccu

SEQ ID NO: 344915 - RNA, 22 nt, Homo sapiens
cacuguggauggaacuauguga

SEQ ID NO: 344916 - RNA, 22 nt, Homo sapiens
cagaaguauugguaugcucugu

SEQ ID NO: 344917 - RNA, 22 nt, Homo sapiens
cagagaaugucuuuuuuaacca

SEQ ID NO: 344918 - RNA, 22 nt, Homo sapiens
cagagagcuugcccuuguauau

SEQ ID NO: 344919 - RNA, 22 nt, Homo sapiens
cagauacuggccuggagcugug

SEQ ID NO: 344920 - RNA, 20 nt, Homo sapiens
cagcaaccugcucucuuccu

SEQ ID NO: 344921 - RNA, 22 nt, Homo sapiens
cagcacauagcaguugcucagu

SEQ ID NO: 344922 - RNA, 22 nt, Homo sapiens
cagccggguggcuccuagggua

SEQ ID NO: 344923 - RNA, 22 nt, Homo sapiens
cagcgaggucugcgucacauug

SEQ ID NO: 344924 - RNA, 22 nt, Homo sapiens
cagcuaaauuguuaaauccaag

SEQ ID NO: 344925 - RNA, 22 nt, Homo sapiens
cagcugaugucgaaugcacucu

SEQ ID NO: 344926 - RNA, 22 nt, Homo sapiens
caggcagucuggcucccaagug

SEQ ID NO: 344927 - RNA, 22 nt, Homo sapiens
caggcagucuggggguguaucc

SEQ ID NO: 344928 - RNA, 22 nt, Homo sapiens
cagguacauuuuaaagggcuca

SEQ ID NO: 344929 - RNA, 22 nt, Homo sapiens
cagugaauuucaggucaagagu

SEQ ID NO: 344930 - RNA, 23 nt, Homo sapiens
cagugguguuagagaaaucuuuu

SEQ ID NO: 344931 - RNA, 22 nt, Homo sapiens
cagugguuuucucaguucagca

SEQ ID NO: 344932 - RNA, 21 nt, Homo sapiens
cauaaugcuacuuauuuuaug

SEQ ID NO: 344933 - RNA, 22 nt, Homo sapiens
cauacaagcuacaaucacaaag

SEQ ID NO: 344934 - RNA, 18 nt, Homo sapiens
cauagcacuucagcacau

SEQ ID NO: 344935 - RNA, 22 nt, Homo sapiens
cauauucacuuuacagagcugu

SEQ ID NO: 344936 - RNA, 22 nt, Homo sapiens
caucacaugcuuauuuuccuca

SEQ ID NO: 344937 - RNA, 22 nt, Homo sapiens
caucacuuugccuccgucucua

SEQ ID NO: 344938 - RNA, 19 nt, Homo sapiens
caucccugagcugaagugg

SEQ ID NO: 344939 - RNA, 22 nt, Homo sapiens
caugccauugcucuccugggug

SEQ ID NO: 344940 - RNA, 22 nt, Homo sapiens
cauggcacaucuuuucugacua

SEQ ID NO: 344941 - RNA, 22 nt, Homo sapiens
cauggcccugggcugggcgaac

SEQ ID NO: 344942 - RNA, 22 nt, Homo sapiens
cauggcucuuguuuacucccag

SEQ ID NO: 344943 - RNA, 23 nt, Homo sapiens
cauggcuguuaacacuguuugag

SEQ ID NO: 344944 - RNA, 22 nt, Homo sapiens
uugagugaaugaaugauuaaau

SEQ ID NO: 344945 - RNA, 22 nt, Homo sapiens
uugaguuugaguauucuaaagc

SEQ ID NO: 344946 - RNA, 22 nt, Homo sapiens
uugaucaauagaauacaacaga

SEQ ID NO: 344947 - RNA, 22 nt, Homo sapiens
uugcaaaguuugccuccuguag

SEQ ID NO: 344948 - RNA, 22 nt, Homo sapiens
uugcacaauccugugagugagu

SEQ ID NO: 344949 - RNA, 20 nt, Homo sapiens
uugcacagagaaggaggcag

SEQ ID NO: 344950 - RNA, 22 nt, Homo sapiens
uugcacauggcuggggaggccu

SEQ ID NO: 344951 - RNA, 22 nt, Homo sapiens
uugcacauguugaaccagcaaa

SEQ ID NO: 344952 - RNA, 22 nt, Homo sapiens
uugcacauugcaccuuuuguau

SEQ ID NO: 344953 - RNA, 22 nt, Homo sapiens
uugcaccacugcacuccacccu

SEQ ID NO: 344954 - RNA, 22 nt, Homo sapiens
uugcagagucaguuauuuugcc

SEQ ID NO: 344955 - RNA, 22 nt, Homo sapiens
uugcagugguuucacuggcaaa

SEQ ID NO: 344956 - RNA, 23 nt, Homo sapiens
uugcauagacauccucauagauu

SEQ ID NO: 344957 - RNA, 22 nt, Homo sapiens
uugcaucagcaggcauaauugg

SEQ ID NO: 344958 - RNA, 22 nt, Homo sapiens
uugccugagaagccaagaauaa

SEQ ID NO: 344959 - RNA, 22 nt, Homo sapiens
uuggaaaccucugcagguguuu

SEQ ID NO: 344960 - RNA, 22 nt, Homo sapiens
uuggaaauguguuugcauucag

SEQ ID NO: 344961 - RNA, 22 nt, Homo sapiens
uuggaacuguucguauugaaau

SEQ ID NO: 344962 - RNA, 22 nt, Homo sapiens
uuggaauguacucuagccuaug

SEQ ID NO: 344963 - RNA, 22 nt, Homo sapiens
uuggaauuuuaaaauaggcaac

SEQ ID NO: 344964 - RNA, 22 nt, Homo sapiens
uuggaccacuugauuucugguc

SEQ ID NO: 344965 - RNA, 22 nt, Homo sapiens
uuggagagucacuaguuagugc

SEQ ID NO: 344966 - RNA, 22 nt, Homo sapiens
uuggcaaaugucacaaaucagg

SEQ ID NO: 344967 - RNA, 22 nt, Homo sapiens
uuggcaauucagauucuuuuau

SEQ ID NO: 344968 - RNA, 22 nt, Homo sapiens
uuggcagcauuccagccaagca

SEQ ID NO: 344969 - RNA, 22 nt, Homo sapiens
uuggcagugcccgaugcugggg

SEQ ID NO: 344970 - RNA, 22 nt, Homo sapiens
uuggcuuguaaaaugaaaagcu

SEQ ID NO: 344971 - RNA, 22 nt, Homo sapiens
uugggagugucucuggacugca

SEQ ID NO: 344972 - RNA, 22 nt, Homo sapiens
uugggauaaucacaaaguaaaa

SEQ ID NO: 344973 - RNA, 22 nt, Homo sapiens
uugggcuugagggugcccaguc

SEQ ID NO: 344974 - RNA, 22 nt, Homo sapiens
uugguucaguuuaacgaguaau

SEQ ID NO: 344975 - RNA, 22 nt, Homo sapiens
uugguucucuuagccaucuuaa

SEQ ID NO: 344976 - RNA, 19 nt, Homo sapiens
uugguugguuauuucuuac

SEQ ID NO: 344977 - RNA, 23 nt, Homo sapiens
uuguaacuggagaguaacauucc

SEQ ID NO: 344978 - RNA, 22 nt, Homo sapiens
uuguacuagaaaauuauucuuu

SEQ ID NO: 344979 - RNA, 22 nt, Homo sapiens
uuguacuagucauauuuugaaa

SEQ ID NO: 344980 - RNA, 22 nt, Homo sapiens
uuguacuccagccugggugaca

SEQ ID NO: 344981 - RNA, 22 nt, Homo sapiens
uuguagcaaauauauuuuggaa

SEQ ID NO: 344982 - RNA, 22 nt, Homo sapiens
uuguagcaaauguguaaacaaa

SEQ ID NO: 344983 - RNA, 22 nt, Homo sapiens
uuguauaggcucaguaagaauc

SEQ ID NO: 344984 - RNA, 22 nt, Homo sapiens
uuguauguaaccauuuggcaaa

SEQ ID NO: 344985 - RNA, 22 nt, Homo sapiens
uuguauugucuugaugaguuga

SEQ ID NO: 344986 - RNA, 22 nt, Homo sapiens
uugucaccucuaaaucucauau

SEQ ID NO: 344987 - RNA, 22 nt, Homo sapiens
uuguccaagucccauuuguuga

SEQ ID NO: 344988 - RNA, 22 nt, Homo sapiens
uugucccauggggucuuccuuu

SEQ ID NO: 344989 - RNA, 22 nt, Homo sapiens
uugugaguggugccgcaauaaa

SEQ ID NO: 344990 - RNA, 22 nt, Homo sapiens
uugugcuuguaacuacauucag

SEQ ID NO: 344991 - RNA, 19 nt, Homo sapiens
uuguguccccacaaaauuc

SEQ ID NO: 344992 - RNA, 22 nt, Homo sapiens
uuguguccccacucaaauuaca

SEQ ID NO: 344993 - RNA, 23 nt, Homo sapiens
uugugucccuacccaaaucucau

SEQ ID NO: 344994 - RNA, 22 nt, Homo sapiens
uuguuaagaugcagauucugga

SEQ ID NO: 344995 - RNA, 22 nt, Homo sapiens
uuguuauguuggucaguaaugu

SEQ ID NO: 344996 - RNA, 22 nt, Homo sapiens
uuuaauagcagggacuuccggg

SEQ ID NO: 344997 - RNA, 22 nt, Homo sapiens
uuuacagucucauagguggaag

SEQ ID NO: 344998 - RNA, 22 nt, Homo sapiens
uuuagcaaagcaauuuacacca

SEQ ID NO: 344999 - RNA, 22 nt, Homo sapiens
uuucacagcugucuuccgucuc

SEQ ID NO: 345000 - RNA, 23 nt, Homo sapiens
uuucacaguagcuggaucagccu

SEQ ID NO: 345001 - RNA, 21 nt, Homo sapiens
uuucacugugaguuuuucugu

SEQ ID NO: 345002 - RNA, 22 nt, Homo sapiens
uuucauagaucaugcuuuugga

SEQ ID NO: 345003 - RNA, 22 nt, Homo sapiens
uuucauagccuuugucgucuga

SEQ ID NO: 345004 - RNA, 22 nt, Homo sapiens
uuucauggaggcauuuuagauu

SEQ ID NO: 345005 - RNA, 16 nt, Homo sapiens
uuucccuuugguguuu

SEQ ID NO: 345006 - RNA, 22 nt, Homo sapiens
uuucgugucuggucugugaugg

SEQ ID NO: 345007 - RNA, 22 nt, Homo sapiens
uuucucaguguuucaggguagg

SEQ ID NO: 345008 - RNA, 22 nt, Homo sapiens
uuugacuuuuagaauaugaguu

SEQ ID NO: 345009 - RNA, 23 nt, Homo sapiens
uuugagugugauaaacacuguca

SEQ ID NO: 345010 - RNA, 22 nt, Homo sapiens
uuugaguuugaggugcugauga

SEQ ID NO: 345011 - RNA, 22 nt, Homo sapiens
uuugcuucacuguuuggcaaaa

SEQ ID NO: 345012 - RNA, 22 nt, Homo sapiens
uuuggcccugagggauggcaua

SEQ ID NO: 345013 - RNA, 19 nt, Homo sapiens
uuuguauguuuccaguaau

SEQ ID NO: 345014 - RNA, 22 nt, Homo sapiens
uuuguccugccaugguuuauuu

SEQ ID NO: 345015 - RNA, 22 nt, Homo sapiens
uuugugacuugcuucucagaau

SEQ ID NO: 345016 - RNA, 22 nt, Homo sapiens
uuuguguggccuuggccuggca

SEQ ID NO: 345017 - RNA, 20 nt, Homo sapiens
uuuuagcuuuuauugaaagc

SEQ ID NO: 345018 - RNA, 22 nt, Homo sapiens
uuuuagcuuuucccaggacucc

SEQ ID NO: 345019 - RNA, 22 nt, Homo sapiens
uuuuaguggacaaagguauuua

SEQ ID NO: 345020 - RNA, 22 nt, Homo sapiens
uuuucaguuuuccagguagccg

SEQ ID NO: 345021 - RNA, 22 nt, Homo sapiens
uuuuccagugggacucccauua

SEQ ID NO: 345022 - RNA, 22 nt, Homo sapiens
uuuugcaauauguuccugaaua

SEQ ID NO: 345023 - RNA, 22 nt, Homo sapiens
uuuugcacauugauuugguauc

SEQ ID NO: 345024 - RNA, 20 nt, Homo sapiens
uuuugcacuccuacuaaggu

SEQ ID NO: 345025 - RNA, 22 nt, Homo sapiens
uuuugcacuguuuuaucugaca

SEQ ID NO: 345026 - RNA, 22 nt, Homo sapiens
uuuugcaggucaggggcagaga

SEQ ID NO: 345027 - RNA, 22 nt, Homo sapiens
uuuugcaguuacagagagugag

SEQ ID NO: 345028 - RNA, 22 nt, Homo sapiens
uuuugcuccuggcaaacucaua

SEQ ID NO: 345029 - RNA, 22 nt, Homo sapiens
uuuugcucuugguaaugaaaga

SEQ ID NO: 345030 - RNA, 22 nt, Homo sapiens
uuuugggggugauucacacagu

SEQ ID NO: 345031 - RNA, 22 nt, Homo sapiens
augaauagaguuaauugaguac

SEQ ID NO: 345032 - RNA, 22 nt, Homo sapiens
augacauuccacagccguagag

SEQ ID NO: 345033 - RNA, 22 nt, Homo sapiens
augacauugaaaagcaagugga

SEQ ID NO: 345034 - RNA, 22 nt, Homo sapiens
augacauugaugcucuggcugg

SEQ ID NO: 345035 - RNA, 21 nt, Homo sapiens
augacccuggguguccuuucc

SEQ ID NO: 345036 - RNA, 22 nt, Homo sapiens
augaccuuguccucagugucau

SEQ ID NO: 345037 - RNA, 18 nt, Homo sapiens
augacucuggguguuccu

SEQ ID NO: 345038 - RNA, 22 nt, Homo sapiens
augacugucagggcagucauug

SEQ ID NO: 345039 - RNA, 22 nt, Homo sapiens
augagaaugaagccuggcgugu

SEQ ID NO: 345040 - RNA, 22 nt, Homo sapiens
augagaauguaaguuaaugaaa

SEQ ID NO: 345041 - RNA, 22 nt, Homo sapiens
augagaccagcagaaaaccugu

SEQ ID NO: 345042 - RNA, 22 nt, Homo sapiens
augagauuauguaaagagacca

SEQ ID NO: 345043 - RNA, 22 nt, Homo sapiens
augagauuguuuguacuccaca

SEQ ID NO: 345044 - RNA, 22 nt, Homo sapiens
augagcucauaaagagugauuu

SEQ ID NO: 345045 - RNA, 17 nt, Homo sapiens
augagcucaucauuuuu

SEQ ID NO: 345046 - RNA, 22 nt, Homo sapiens
augaggugaggucaguaaggua

SEQ ID NO: 345047 - RNA, 21 nt, Homo sapiens
augagguguacuguggugaaa

SEQ ID NO: 345048 - RNA, 22 nt, Homo sapiens
augagguguuuauuguauccug

SEQ ID NO: 345049 - RNA, 22 nt, Homo sapiens
augauacuguucuaagauuuuu

SEQ ID NO: 345050 - RNA, 22 nt, Homo sapiens
augauauggguugucaguugua

SEQ ID NO: 345051 - RNA, 22 nt, Homo sapiens
augauuguucucacucaagaga

SEQ ID NO: 345052 - RNA, 22 nt, Homo sapiens
augcaaacaucauagaguguac

SEQ ID NO: 345053 - RNA, 22 nt, Homo sapiens
augcaaaucuuaaguaugugug

SEQ ID NO: 345054 - RNA, 19 nt, Homo sapiens
augcaaugucacaggcugc

SEQ ID NO: 345055 - RNA, 22 nt, Homo sapiens
augcacauggcuaacuuuuuuc

SEQ ID NO: 345056 - RNA, 22 nt, Homo sapiens
augccacugcacuccaaccugg

SEQ ID NO: 345057 - RNA, 22 nt, Homo sapiens
augccacuucucuaagucaugu

SEQ ID NO: 345058 - RNA, 22 nt, Homo sapiens
augccucugacaauuggauucu

SEQ ID NO: 345059 - RNA, 21 nt, Homo sapiens
auggaaagacugccucuucaa

SEQ ID NO: 345060 - RNA, 22 nt, Homo sapiens
auggaaaugaagggcuggcccu

SEQ ID NO: 345061 - RNA, 22 nt, Homo sapiens
auggaagaaacgauuuucugga

SEQ ID NO: 345062 - RNA, 22 nt, Homo sapiens
auggaagaauugucggggaugu

SEQ ID NO: 345063 - RNA, 22 nt, Homo sapiens
auggaagacuccucuuugggua

SEQ ID NO: 345064 - RNA, 22 nt, Homo sapiens
auggaauggcacuuugaagauu

SEQ ID NO: 345065 - RNA, 22 nt, Homo sapiens
auggaauguauagucauguagg

SEQ ID NO: 345066 - RNA, 22 nt, Homo sapiens
auggaauguggaaugguaagua

SEQ ID NO: 345067 - RNA, 22 nt, Homo sapiens
auggacuuuuuguucagugucu

SEQ ID NO: 345068 - RNA, 22 nt, Homo sapiens
auggagaugugcgaacugagua

SEQ ID NO: 345069 - RNA, 22 nt, Homo sapiens
auggaggccuacagaauuuugg

SEQ ID NO: 345070 - RNA, 22 nt, Homo sapiens
auggauuuguaguacaugguug

SEQ ID NO: 345071 - RNA, 22 nt, Homo sapiens
auggauuuuaggauacaguuga

SEQ ID NO: 345072 - RNA, 22 nt, Homo sapiens
auggcaaaauguuccuaguggu

SEQ ID NO: 345073 - RNA, 22 nt, Homo sapiens
ucucaguguuaucuaucugccu

SEQ ID NO: 345074 - RNA, 20 nt, Homo sapiens
ucucauggagguagagaaua

SEQ ID NO: 345075 - RNA, 22 nt, Homo sapiens
ucuccaguuuccuucgucuauc

SEQ ID NO: 345076 - RNA, 22 nt, Homo sapiens
ucucccauccaugaacuucugu

SEQ ID NO: 345077 - RNA, 22 nt, Homo sapiens
ucucccauccguacacggauug

SEQ ID NO: 345078 - RNA, 22 nt, Homo sapiens
ucucugagaccacuccaaacuc

SEQ ID NO: 345079 - RNA, 22 nt, Homo sapiens
ucucugguuuucaaagcaguau

SEQ ID NO: 345080 - RNA, 22 nt, Homo sapiens
ucucuguuuauuuuugguguau

SEQ ID NO: 345081 - RNA, 22 nt, Homo sapiens
ucugacagugugaauauugacu

SEQ ID NO: 345082 - RNA, 22 nt, Homo sapiens
ucugagcaugcaucuugccugg

SEQ ID NO: 345083 - RNA, 22 nt, Homo sapiens
ucugcauauucuagggcaccaa

SEQ ID NO: 345084 - RNA, 22 nt, Homo sapiens
ucugccacugucauugugugau

SEQ ID NO: 345085 - RNA, 22 nt, Homo sapiens
ucuggcauuuucucugcuugca

SEQ ID NO: 345086 - RNA, 22 nt, Homo sapiens
ucuggcuugugaacugucuucu

SEQ ID NO: 345087 - RNA, 22 nt, Homo sapiens
ucuguacuccuugaguagugcu

SEQ ID NO: 345088 - RNA, 22 nt, Homo sapiens
ucuguacuuccguaccuaaagu

SEQ ID NO: 345089 - RNA, 22 nt, Homo sapiens
ucugucaaaucuuauguuguag

SEQ ID NO: 345090 - RNA, 22 nt, Homo sapiens
ucugugaaugaacacuugaaaa

SEQ ID NO: 345091 - RNA, 22 nt, Homo sapiens
ucugugcauuuucuuuuagacu

SEQ ID NO: 345092 - RNA, 22 nt, Homo sapiens
ucugugcugagaguugaaaguu

SEQ ID NO: 345093 - RNA, 19 nt, Homo sapiens
ucugugcuugucccccugu

SEQ ID NO: 345094 - RNA, 22 nt, Homo sapiens
ucugugguucaaaccagcaacu

SEQ ID NO: 345095 - RNA, 22 nt, Homo sapiens
ucuguguuugaucaagauugua

SEQ ID NO: 345096 - RNA, 22 nt, Homo sapiens
ucuucaugcuugaaauaauagc

SEQ ID NO: 345097 - RNA, 19 nt, Homo sapiens
ucuugcacaugugaacuca

SEQ ID NO: 345098 - RNA, 22 nt, Homo sapiens
ucuugccacuucauccccuuuc

SEQ ID NO: 345099 - RNA, 22 nt, Homo sapiens
ucuugcuuuugcagagcuucuc

SEQ ID NO: 345100 - RNA, 22 nt, Homo sapiens
ucuuggcauggcugaagauucc

SEQ ID NO: 345101 - RNA, 21 nt, Homo sapiens
ucuugguauguauuuaggagg

SEQ ID NO: 345102 - RNA, 22 nt, Homo sapiens
ucuuuagugacaguugugcaag

SEQ ID NO: 345103 - RNA, 22 nt, Homo sapiens
ucuuugauguucugaaagaugg

SEQ ID NO: 345104 - RNA, 22 nt, Homo sapiens
ucuuugauuaugcagauggguu

SEQ ID NO: 345105 - RNA, 19 nt, Homo sapiens
ucuuugcuuuucuaagagg

SEQ ID NO: 345106 - RNA, 22 nt, Homo sapiens
ucuuuggguagauauguagcug

SEQ ID NO: 345107 - RNA, 22 nt, Homo sapiens
ugaaacacaccuccucuccauc

SEQ ID NO: 345108 - RNA, 22 nt, Homo sapiens
ugaaacauacacucugaugggg

SEQ ID NO: 345109 - RNA, 22 nt, Homo sapiens
ugaaaguaauugcaguuuuuac

SEQ ID NO: 345110 - RNA, 22 nt, Homo sapiens
ugaaaucauguaguuauugcaa

SEQ ID NO: 345111 - RNA, 22 nt, Homo sapiens
ugaaaugcuaauucguagcuaa

SEQ ID NO: 345112 - RNA, 22 nt, Homo sapiens
ugaaaugcugucuaggggaaau

SEQ ID NO: 345113 - RNA, 22 nt, Homo sapiens
ugaacagcaccuccuagaguug

SEQ ID NO: 345114 - RNA, 22 nt, Homo sapiens
ugaagacucaguuugagggaca

SEQ ID NO: 345115 - RNA, 22 nt, Homo sapiens
ugaagacucauacuugaaucag

SEQ ID NO: 345116 - RNA, 22 nt, Homo sapiens
ugaaggaguauggauaagucgu

SEQ ID NO: 345117 - RNA, 22 nt, Homo sapiens
ugaaggcaggagggagaaaagu

SEQ ID NO: 345118 - RNA, 22 nt, Homo sapiens
ugaagugggaaaugaguauuaa

SEQ ID NO: 345119 - RNA, 22 nt, Homo sapiens
ugaauauguuucuaaaagugca

SEQ ID NO: 345120 - RNA, 21 nt, Homo sapiens
ugaauauuuggguugugucca

SEQ ID NO: 345121 - RNA, 22 nt, Homo sapiens
ugaaugcauggggccaagaagg

SEQ ID NO: 345122 - RNA, 23 nt, Homo sapiens
ugaauguaucgaaugugggaaag

SEQ ID NO: 345123 - RNA, 22 nt, Homo sapiens
ugaaugugauggguuucaugug

SEQ ID NO: 345124 - RNA, 22 nt, Homo sapiens
ugaauucuguccaaaauaacug

SEQ ID NO: 345125 - RNA, 22 nt, Homo sapiens
ugacagagaagcauugaguuca

SEQ ID NO: 345126 - RNA, 22 nt, Homo sapiens
ugacagaggucuuuuaauagcu

SEQ ID NO: 345127 - RNA, 20 nt, Homo sapiens
ugacaucagcaauguaauaa

SEQ ID NO: 345128 - RNA, 22 nt, Homo sapiens
ugacaugauuguauauuuagaa

SEQ ID NO: 345129 - RNA, 22 nt, Homo sapiens
uauuccauuugugaaaggaagu

SEQ ID NO: 345130 - RNA, 22 nt, Homo sapiens
uauugaacuggaucagaaggcc

SEQ ID NO: 345131 - RNA, 20 nt, Homo sapiens
uauugcacuccagucugggc

SEQ ID NO: 345132 - RNA, 22 nt, Homo sapiens
uauugccugucuccaaaaauca

SEQ ID NO: 345133 - RNA, 22 nt, Homo sapiens
uauugcucaugcauuuaauuuc

SEQ ID NO: 345134 - RNA, 22 nt, Homo sapiens
uauuugauugacuuuagcagga

SEQ ID NO: 345135 - RNA, 22 nt, Homo sapiens
uauuugguuacuugaauagcua

SEQ ID NO: 345136 - RNA, 22 nt, Homo sapiens
uauuugguuauaugaguaaguu

SEQ ID NO: 345137 - RNA, 22 nt, Homo sapiens
uauuuguccccuccaaaaguca

SEQ ID NO: 345138 - RNA, 22 nt, Homo sapiens
ucaaagacacacaaggagaagg

SEQ ID NO: 345139 - RNA, 21 nt, Homo sapiens
ucaaaguguucuuuuguugaa

SEQ ID NO: 345140 - RNA, 22 nt, Homo sapiens
ucaaaugguccacgugaacauu

SEQ ID NO: 345141 - RNA, 22 nt, Homo sapiens
ucaaauuccaagucuagguagg

SEQ ID NO: 345142 - RNA, 20 nt, Homo sapiens
ucaaauucuuggccuccagc

SEQ ID NO: 345143 - RNA, 22 nt, Homo sapiens
ucaacaggucaauugcauagaa

SEQ ID NO: 345144 - RNA, 22 nt, Homo sapiens
ucaacagugauggaaaguuaua

SEQ ID NO: 345145 - RNA, 18 nt, Homo sapiens
ucaagcaauugucaugcc

SEQ ID NO: 345146 - RNA, 20 nt, Homo sapiens
ucaaggcaggaacuguacau

SEQ ID NO: 345147 - RNA, 22 nt, Homo sapiens
ucaaguaauacucccaucuugg

SEQ ID NO: 345148 - RNA, 22 nt, Homo sapiens
ucaaguacugccuugcucuggc

SEQ ID NO: 345149 - RNA, 18 nt, Homo sapiens
ucacaaccacagugcugu

SEQ ID NO: 345150 - RNA, 20 nt, Homo sapiens
ucacaagccaagaucacguc

SEQ ID NO: 345151 - RNA, 22 nt, Homo sapiens
ucacaaggcaggaaugaaaggg

SEQ ID NO: 345152 - RNA, 22 nt, Homo sapiens
ucacaccauucuucuacuucag

SEQ ID NO: 345153 - RNA, 22 nt, Homo sapiens
ucacacggugaugauuccuaga

SEQ ID NO: 345154 - RNA, 22 nt, Homo sapiens
ucacacgugaacucaucacaga

SEQ ID NO: 345155 - RNA, 22 nt, Homo sapiens
ucacacugcaucuguuggaauu

SEQ ID NO: 345156 - RNA, 22 nt, Homo sapiens
ucacacugucuugguuacucuu

SEQ ID NO: 345157 - RNA, 22 nt, Homo sapiens
ucacacuguuuugauuauuaua

SEQ ID NO: 345158 - RNA, 19 nt, Homo sapiens
ucacaggguugacuugagg

SEQ ID NO: 345159 - RNA, 22 nt, Homo sapiens
ucacaguagggaacugacaaag

SEQ ID NO: 345160 - RNA, 22 nt, Homo sapiens
ucacaguaucaugggggacaga

SEQ ID NO: 345161 - RNA, 22 nt, Homo sapiens
ucacaguauucaugaacaugga

SEQ ID NO: 345162 - RNA, 22 nt, Homo sapiens
ucacagucaaaguaaucauaga

SEQ ID NO: 345163 - RNA, 22 nt, Homo sapiens
ucacaguguuaaaccuuucuuu

SEQ ID NO: 345164 - RNA, 22 nt, Homo sapiens
ucacauuguuauguaaauguuu

SEQ ID NO: 345165 - RNA, 22 nt, Homo sapiens
ucaccaccugcugaucauagag

SEQ ID NO: 345166 - RNA, 16 nt, Homo sapiens
ucaccccuagagaucc

SEQ ID NO: 345167 - RNA, 22 nt, Homo sapiens
ucaccuggagacaugaagacug

SEQ ID NO: 345168 - RNA, 22 nt, Homo sapiens
ucaccuguagcuaagaccuaau

SEQ ID NO: 345169 - RNA, 22 nt, Homo sapiens
ucaccuuacuugcuucugaacu

SEQ ID NO: 345170 - RNA, 22 nt, Homo sapiens
ucacuaggcuggagugcagugg

SEQ ID NO: 345171 - RNA, 22 nt, Homo sapiens
ucacugaggucugagcuuuaug

SEQ ID NO: 345172 - RNA, 22 nt, Homo sapiens
ucacugcgaccucugccucccg

SEQ ID NO: 345173 - RNA, 20 nt, Homo sapiens
ucacuggagcucauuugauu

SEQ ID NO: 345174 - RNA, 22 nt, Homo sapiens
ucacuggaggagaggaagugga

SEQ ID NO: 345175 - RNA, 20 nt, Homo sapiens
ucacugugaacuucuugagg

SEQ ID NO: 345176 - RNA, 22 nt, Homo sapiens
ucacugugcacauaugauaggu

SEQ ID NO: 345177 - RNA, 22 nt, Homo sapiens
ucacugugcaugaaggaugcug

SEQ ID NO: 345178 - RNA, 22 nt, Homo sapiens
ucacuuugacggccaacuucua

SEQ ID NO: 345179 - RNA, 22 nt, Homo sapiens
ucacuuuggguacuauggaaau

SEQ ID NO: 345180 - RNA, 22 nt, Homo sapiens
ucagacacugagcaaacgacua

SEQ ID NO: 345181 - RNA, 22 nt, Homo sapiens
ucagaguagagcgacuucuccu

SEQ ID NO: 345182 - RNA, 22 nt, Homo sapiens
ucagaguagcugucugaggugc

SEQ ID NO: 345183 - RNA, 22 nt, Homo sapiens
ucagagucuagaucacucacug

SEQ ID NO: 345184 - RNA, 22 nt, Homo sapiens
ucagaucacuggcgcuggcgga

SEQ ID NO: 345185 - RNA, 22 nt, Homo sapiens
ucagaucauuaagguagguuua

SEQ ID NO: 345186 - RNA, 22 nt, Homo sapiens
ucagaugauucuguuguugugu

SEQ ID NO: 345187 - RNA, 22 nt, Homo sapiens
ucagauugaugcauacuuaaau

SEQ ID NO: 345188 - RNA, 22 nt, Homo sapiens
ucagcacauucaaggccugccu

SEQ ID NO: 345189 - RNA, 22 nt, Homo sapiens
ucagcaucacgugggcucccgu

SEQ ID NO: 345190 - RNA, 22 nt, Homo sapiens
ucaggucauuccaggagggcca

SEQ ID NO: 345191 - RNA, 22 nt, Homo sapiens
ucaguagagacaggauuucacc

SEQ ID NO: 345192 - RNA, 22 nt, Homo sapiens
ucaguaguuuuuuuacuaggug

SEQ ID NO: 345193 - RNA, 22 nt, Homo sapiens
ucagugccauugccauaugagu

SEQ ID NO: 345194 - RNA, 22 nt, Homo sapiens
ucagugccucaguuuuuaaaga

SEQ ID NO: 345195 - RNA, 22 nt, Homo sapiens
ucagugucugugauggagaggu

SEQ ID NO: 345196 - RNA, 22 nt, Homo sapiens
ucaguguugauggcugcugacu

SEQ ID NO: 345197 - RNA, 22 nt, Homo sapiens
ucaguguuuggaaucucaauuu

SEQ ID NO: 345198 - RNA, 22 nt, Homo sapiens
ucaguucauggaggugucugcu

SEQ ID NO: 345199 - RNA, 22 nt, Homo sapiens
ucauacaggccaccagggaagu

SEQ ID NO: 345200 - RNA, 22 nt, Homo sapiens
ucauacuguuaaaugguuuagu

SEQ ID NO: 345201 - RNA, 19 nt, Homo sapiens
ucauagucuaagaugagaa

SEQ ID NO: 345202 - RNA, 22 nt, Homo sapiens
ucauagucuaagguucuuuugc

SEQ ID NO: 345203 - RNA, 22 nt, Homo sapiens
ucaucaguggggaugugguuga

SEQ ID NO: 345204 - RNA, 22 nt, Homo sapiens
ucaucucaguuucuugccguac

SEQ ID NO: 345205 - RNA, 22 nt, Homo sapiens
ucaugacacuggcaggagcuaa

SEQ ID NO: 345206 - RNA, 22 nt, Homo sapiens
ucauguaauuuugugucuauga

SEQ ID NO: 345207 - RNA, 22 nt, Homo sapiens
ucauuagagacagggugucacu

SEQ ID NO: 345208 - RNA, 22 nt, Homo sapiens
ucauuagagaucuuggggaaaa

SEQ ID NO: 345209 - RNA, 22 nt, Homo sapiens
uccaagaugcuggcagcuacag

SEQ ID NO: 345210 - RNA, 22 nt, Homo sapiens
uccaauguaaucaucauugaau

SEQ ID NO: 345211 - RNA, 22 nt, Homo sapiens
uccacaguaaggacccugccuu

SEQ ID NO: 345212 - RNA, 22 nt, Homo sapiens
uccacagugguugaacuaguaa

SEQ ID NO: 345213 - RNA, 22 nt, Homo sapiens
uccacuuuugugcugaauugga

SEQ ID NO: 345214 - RNA, 17 nt, Homo sapiens
uccagauuucaauugaa

SEQ ID NO: 345215 - RNA, 18 nt, Homo sapiens
uccaguuuucccagcauc

SEQ ID NO: 345216 - RNA, 22 nt, Homo sapiens
gugguguuugagcugccaggga

SEQ ID NO: 345217 - RNA, 21 nt, Homo sapiens
gugguucuagagaaacagaau

SEQ ID NO: 345218 - RNA, 22 nt, Homo sapiens
gugguucuagagggacagaaug

SEQ ID NO: 345219 - RNA, 22 nt, Homo sapiens
guguaaaacaauuagaggauuu

SEQ ID NO: 345220 - RNA, 22 nt, Homo sapiens
guguaaaugagugcugaaggag

SEQ ID NO: 345221 - RNA, 22 nt, Homo sapiens
guguauauccuauuaguucugu

SEQ ID NO: 345222 - RNA, 22 nt, Homo sapiens
guguaugguuguuguagagaga

SEQ ID NO: 345223 - RNA, 22 nt, Homo sapiens
guguauguuguccauggaugcg

SEQ ID NO: 345224 - RNA, 21 nt, Homo sapiens
gugucacagacaugacagaug

SEQ ID NO: 345225 - RNA, 22 nt, Homo sapiens
gugucucagcccagaccuauuu

SEQ ID NO: 345226 - RNA, 22 nt, Homo sapiens
gugucuccuguggagcuaugua

SEQ ID NO: 345227 - RNA, 22 nt, Homo sapiens
gugugacagcuauagacaugau

SEQ ID NO: 345228 - RNA, 22 nt, Homo sapiens
gugugacuagucaugccugaau

SEQ ID NO: 345229 - RNA, 22 nt, Homo sapiens
gugugauuauuucaauugaugc

SEQ ID NO: 345230 - RNA, 22 nt, Homo sapiens
gugugcaacuuucauuaauauu

SEQ ID NO: 345231 - RNA, 22 nt, Homo sapiens
guuaaagacauccacauaggag

SEQ ID NO: 345232 - RNA, 22 nt, Homo sapiens
guuacagucuuguguaagguua

SEQ ID NO: 345233 - RNA, 22 nt, Homo sapiens
guucacacuugcaaccccagca

SEQ ID NO: 345234 - RNA, 22 nt, Homo sapiens
guucaucagggauacuggccug

SEQ ID NO: 345235 - RNA, 22 nt, Homo sapiens
guucaucagggauauuggccug

SEQ ID NO: 345236 - RNA, 20 nt, Homo sapiens
guucauguaauuaguucagg

SEQ ID NO: 345237 - RNA, 22 nt, Homo sapiens
guucccaguugaaaugauuagu

SEQ ID NO: 345238 - RNA, 22 nt, Homo sapiens
guucucacuggacugugaaaau

SEQ ID NO: 345239 - RNA, 20 nt, Homo sapiens
guugaugcugaaguugcuua

SEQ ID NO: 345240 - RNA, 22 nt, Homo sapiens
guuggguaauggggcgcaccgu

SEQ ID NO: 345241 - RNA, 22 nt, Homo sapiens
guuugcacuccuaugagaaucu

SEQ ID NO: 345242 - RNA, 22 nt, Homo sapiens
guuugccuuuuagauaggaaug

SEQ ID NO: 345243 - RNA, 22 nt, Homo sapiens
guuuguaacucuagugacuaga

SEQ ID NO: 345244 - RNA, 21 nt, Homo sapiens
uaaaacuguaacuuuguccug

SEQ ID NO: 345245 - RNA, 22 nt, Homo sapiens
uaaaccuagcauuuugcauaug

SEQ ID NO: 345246 - RNA, 22 nt, Homo sapiens
uaaaguuauugccccucaguua

SEQ ID NO: 345247 - RNA, 21 nt, Homo sapiens
uaaaugucauacaaagcaaug

SEQ ID NO: 345248 - RNA, 22 nt, Homo sapiens
uaacaagagagucagucagucc

SEQ ID NO: 345249 - RNA, 22 nt, Homo sapiens
uaacaguggucugugguaucug

SEQ ID NO: 345250 - RNA, 22 nt, Homo sapiens
uaacauucacaugcugcaaaaa

SEQ ID NO: 345251 - RNA, 21 nt, Homo sapiens
uaacccugaaggagcucugga

SEQ ID NO: 345252 - RNA, 22 nt, Homo sapiens
uaacccuuacaacuacacucgu

SEQ ID NO: 345253 - RNA, 22 nt, Homo sapiens
uaacccuuaguaucuguggguu

SEQ ID NO: 345254 - RNA, 22 nt, Homo sapiens
uaacuacuucugcuucagagua

SEQ ID NO: 345255 - RNA, 22 nt, Homo sapiens
uaacuauagagaauguugagua

SEQ ID NO: 345256 - RNA, 22 nt, Homo sapiens
uaacuguggaaaugacuuuaaa

SEQ ID NO: 345257 - RNA, 20 nt, Homo sapiens
uaacuguggcuucuuuuggc

SEQ ID NO: 345258 - RNA, 22 nt, Homo sapiens
uaagacacuuaaaauguuacau

SEQ ID NO: 345259 - RNA, 22 nt, Homo sapiens
uaagacuguguaauuuaugaag

SEQ ID NO: 345260 - RNA, 22 nt, Homo sapiens
uaagagcuaggauuuuaaauca

SEQ ID NO: 345261 - RNA, 20 nt, Homo sapiens
uaagccacacagucuaaggu

SEQ ID NO: 345262 - RNA, 22 nt, Homo sapiens
uaaggcaaucagucaugguguu

SEQ ID NO: 345263 - RNA, 22 nt, Homo sapiens
uaaggcucuuguuauuuugagg

SEQ ID NO: 345264 - RNA, 22 nt, Homo sapiens
uaaggcuugaucuuggugagau

SEQ ID NO: 345265 - RNA, 22 nt, Homo sapiens
uaagggacauguguugccuaag

SEQ ID NO: 345266 - RNA, 22 nt, Homo sapiens
uaaguacuuuacagacauuauc

SEQ ID NO: 345267 - RNA, 22 nt, Homo sapiens
uaaguagaggaaucauuuugug

SEQ ID NO: 345268 - RNA, 22 nt, Homo sapiens
uaaguagcugggaguacaggca

SEQ ID NO: 345269 - RNA, 22 nt, Homo sapiens
uaaguauuaugugcugcauuuu

SEQ ID NO: 345270 - RNA, 22 nt, Homo sapiens
uaagugaauuucacuacugagu

SEQ ID NO: 345271 - RNA, 22 nt, Homo sapiens
uaaguugcagguugugauucca

SEQ ID NO: 345272 - RNA, 22 nt, Homo sapiens
uaauaauguuaggcuuacucaa

SEQ ID NO: 345273 - RNA, 22 nt, Homo sapiens
uaauacugcugugcuugaguug

SEQ ID NO: 345274 - RNA, 22 nt, Homo sapiens
uaauacuguaauggugguuccg

SEQ ID NO: 345275 - RNA, 22 nt, Homo sapiens
uaauauguauacagacagauac

SEQ ID NO: 345276 - RNA, 22 nt, Homo sapiens
uaauaugugguugcuugggcac

SEQ ID NO: 345277 - RNA, 22 nt, Homo sapiens
uaaugcauacagaagguguuuu

SEQ ID NO: 345278 - RNA, 22 nt, Homo sapiens
uaaugcaucaugguuggcaaac

SEQ ID NO: 345279 - RNA, 22 nt, Homo sapiens
uaaugcuugguuguuuggaaaa

SEQ ID NO: 345280 - RNA, 22 nt, Homo sapiens
uaauugcaguucuguguuauau

SEQ ID NO: 345281 - RNA, 22 nt, Homo sapiens
auugagcaaggucuccuaguau

SEQ ID NO: 345282 - RNA, 22 nt, Homo sapiens
auugagcuuuuuaaaauauagu

SEQ ID NO: 345283 - RNA, 22 nt, Homo sapiens
auugcaacuuccgccuccuggg

SEQ ID NO: 345284 - RNA, 22 nt, Homo sapiens
auugcacaaagagggaaacuga

SEQ ID NO: 345285 - RNA, 22 nt, Homo sapiens
auugcacaucugcacuacagcc

SEQ ID NO: 345286 - RNA, 22 nt, Homo sapiens
auugcacuccacccugggcaac

SEQ ID NO: 345287 - RNA, 22 nt, Homo sapiens
auugcacuccagccugggcgac

SEQ ID NO: 345288 - RNA, 22 nt, Homo sapiens
gaucacuuugaugccaggaacu

SEQ ID NO: 345289 - RNA, 22 nt, Homo sapiens
gaucuggagguuuuccucauga

SEQ ID NO: 345290 - RNA, 22 nt, Homo sapiens
gaucuggucuuugauuagacac

SEQ ID NO: 345291 - RNA, 22 nt, Homo sapiens
gauggauuuuaagugaaugaaa

SEQ ID NO: 345292 - RNA, 22 nt, Homo sapiens
gauggcauuucuggaucugaca

SEQ ID NO: 345293 - RNA, 22 nt, Homo sapiens
gaugguuuuuuaagaagagccu

SEQ ID NO: 345294 - RNA, 22 nt, Homo sapiens
gauguuguuuagccuuugaugu

SEQ ID NO: 345295 - RNA, 22 nt, Homo sapiens
gauuagugacguugagcacugu

SEQ ID NO: 345296 - RNA, 22 nt, Homo sapiens
gauuucaucuuuagaggaagga

SEQ ID NO: 345297 - RNA, 22 nt, Homo sapiens
gauuuugguuagggaaggauac

SEQ ID NO: 345298 - RNA, 22 nt, Homo sapiens
gcaaaauugagaagggaauaua

SEQ ID NO: 345299 - RNA, 22 nt, Homo sapiens
gcaagagguaucuuauuuuccc

SEQ ID NO: 345300 - RNA, 22 nt, Homo sapiens
gcacacguagaagcaugcauca

SEQ ID NO: 345301 - RNA, 22 nt, Homo sapiens
gcacaguaggugguaggacuuu

SEQ ID NO: 345302 - RNA, 22 nt, Homo sapiens
gcacaguguuacuugauauauu

SEQ ID NO: 345303 - RNA, 22 nt, Homo sapiens
gcaccacugcacucucagcuug

SEQ ID NO: 345304 - RNA, 22 nt, Homo sapiens
gcacccugucaaaauggaccaa

SEQ ID NO: 345305 - RNA, 22 nt, Homo sapiens
gcacugggccacauuuauuuuc

SEQ ID NO: 345306 - RNA, 19 nt, Homo sapiens
gcagagaugugguagcuug

SEQ ID NO: 345307 - RNA, 22 nt, Homo sapiens
gcagaucuucgcgguaaguguu

SEQ ID NO: 345308 - RNA, 23 nt, Homo sapiens
gcagcaaugucacagggguccgg

SEQ ID NO: 345309 - RNA, 20 nt, Homo sapiens
gcaguguucacuguauuccu

SEQ ID NO: 345310 - RNA, 22 nt, Homo sapiens
gcaguucuguaguugaaauuua

SEQ ID NO: 345311 - RNA, 22 nt, Homo sapiens
gcauauuuuaaaguguaaccug

SEQ ID NO: 345312 - RNA, 22 nt, Homo sapiens
gcaucacagggagacaggccuc

SEQ ID NO: 345313 - RNA, 19 nt, Homo sapiens
gcaucauuaguugcuuuuc

SEQ ID NO: 345314 - RNA, 20 nt, Homo sapiens
gcaugagucuuuauaguaga

SEQ ID NO: 345315 - RNA, 22 nt, Homo sapiens
gcaugugaauguguaagaaaau

SEQ ID NO: 345316 - RNA, 22 nt, Homo sapiens
gccaaaaugcugggauuacagg

SEQ ID NO: 345317 - RNA, 18 nt, Homo sapiens
gccaacauguaaacaggu

SEQ ID NO: 345318 - RNA, 21 nt, Homo sapiens
gccaguguggcaauuuuucaa

SEQ ID NO: 345319 - RNA, 22 nt, Homo sapiens
gccauagucauagauggcaggg

SEQ ID NO: 345320 - RNA, 22 nt, Homo sapiens
gccauugcacuccagccuagcg

SEQ ID NO: 345321 - RNA, 22 nt, Homo sapiens
gccauugcacuccagccuaggc

SEQ ID NO: 345322 - RNA, 22 nt, Homo sapiens
gccauugcacuccagccuaggu

SEQ ID NO: 345323 - RNA, 22 nt, Homo sapiens
gccauugcacuccagcuugggc

SEQ ID NO: 345324 - RNA, 22 nt, Homo sapiens
gccauugcacuccgcccugggc

SEQ ID NO: 345325 - RNA, 22 nt, Homo sapiens
gccauugcacucuagccuaggu

SEQ ID NO: 345326 - RNA, 22 nt, Homo sapiens
gccccaguacaggcuccuuaga

SEQ ID NO: 345327 - RNA, 22 nt, Homo sapiens
gccccugagacuugccucgggc

SEQ ID NO: 345328 - RNA, 22 nt, Homo sapiens
gcccugagauucuuggauucug

SEQ ID NO: 345329 - RNA, 22 nt, Homo sapiens
gcccuuugugucuggcuggggu

SEQ ID NO: 345330 - RNA, 22 nt, Homo sapiens
gccugagaggauaugauccccu

SEQ ID NO: 345331 - RNA, 22 nt, Homo sapiens
gccuguagaagaguagaugacc

SEQ ID NO: 345332 - RNA, 22 nt, Homo sapiens
gcgugguguuagaaugagaagu

SEQ ID NO: 345333 - RNA, 22 nt, Homo sapiens
gcugauguuggccucugggcuu

SEQ ID NO: 345334 - RNA, 22 nt, Homo sapiens
gcugcuguuuaguuucuccugg

SEQ ID NO: 345335 - RNA, 22 nt, Homo sapiens
gcuggcuuucuccugaucucag

SEQ ID NO: 345336 - RNA, 22 nt, Homo sapiens
gcuggguucagagugggcugcg

SEQ ID NO: 345337 - RNA, 22 nt, Homo sapiens
gcugguguucaggcccucaguc

SEQ ID NO: 345338 - RNA, 22 nt, Homo sapiens
gcugguguugugaaucaggccg

SEQ ID NO: 345339 - RNA, 22 nt, Homo sapiens
gcugugauucuguguagauagu

SEQ ID NO: 345340 - RNA, 22 nt, Homo sapiens
gcugugguuuaguagaaagaag

SEQ ID NO: 345341 - RNA, 22 nt, Homo sapiens
gcuguugguaaaaaggacauga

SEQ ID NO: 345342 - RNA, 18 nt, Homo sapiens
gcuguugucagagcacau

SEQ ID NO: 345343 - RNA, 19 nt, Homo sapiens
gcuucuugaggacgaugac

SEQ ID NO: 345344 - RNA, 22 nt, Homo sapiens
gcuuuggcauguagauguaugg

SEQ ID NO: 345345 - RNA, 22 nt, Homo sapiens
gcuuuguuaaaacacagccaca

SEQ ID NO: 345346 - RNA, 22 nt, Homo sapiens
gcuuuuggaggaacuuaagauu

SEQ ID NO: 345347 - RNA, 22 nt, Homo sapiens
ggaaagacuauuguaaaggaug

SEQ ID NO: 345348 - RNA, 22 nt, Homo sapiens
ggaaaucaucauucucgguaua

SEQ ID NO: 345349 - RNA, 22 nt, Homo sapiens
ggaaugggauuugaagucuggc

SEQ ID NO: 345350 - RNA, 22 nt, Homo sapiens
ggacagugaaugccacuccucc

SEQ ID NO: 345351 - RNA, 22 nt, Homo sapiens
ggagaugauuaugaaucacuua

SEQ ID NO: 345352 - RNA, 22 nt, Homo sapiens
ggagauuauugaaucaugaggg

SEQ ID NO: 345353 - RNA, 22 nt, Homo sapiens
ggagggugagaucaauuuggga

SEQ ID NO: 345354 - RNA, 22 nt, Homo sapiens
ggagguaauaaguuccagugua

SEQ ID NO: 345355 - RNA, 22 nt, Homo sapiens
ggaguaggaaggaaauguuaaa

SEQ ID NO: 345356 - RNA, 22 nt, Homo sapiens
ggagugucccaaucucagcuca

SEQ ID NO: 345357 - RNA, 22 nt, Homo sapiens
ggaucacagagcuugggaaagg

SEQ ID NO: 345358 - RNA, 22 nt, Homo sapiens
ggguucccuucuggcucagggu

SEQ ID NO: 345359 - RNA, 22 nt, Homo sapiens
ggucaacaucaucaugguaagu

SEQ ID NO: 345360 - RNA, 22 nt, Homo sapiens
ggucauguguccaggagguagc

SEQ ID NO: 345361 - RNA, 22 nt, Homo sapiens
ggugacugguuuaucuggcagu

SEQ ID NO: 345362 - RNA, 22 nt, Homo sapiens
ggugagaaaaacauagucucag

SEQ ID NO: 345363 - RNA, 19 nt, Homo sapiens
ggugagaaauuaugggucu

SEQ ID NO: 345364 - RNA, 22 nt, Homo sapiens
ggugagauguucagacgaacug

SEQ ID NO: 345365 - RNA, 22 nt, Homo sapiens
ggugaggaaaguugaguuucua

SEQ ID NO: 345366 - RNA, 23 nt, Homo sapiens
ggugaggaguacagagucuucau

SEQ ID NO: 345367 - RNA, 22 nt, Homo sapiens
ggugaguggugcuuaaguucag

SEQ ID NO: 345368 - RNA, 22 nt, Homo sapiens
gguggucuuccccuggaguucg

SEQ ID NO: 345369 - RNA, 22 nt, Homo sapiens
ggugucuuguuuaauacucauu

SEQ ID NO: 345370 - RNA, 22 nt, Homo sapiens
guaaauguccccugugauauug

SEQ ID NO: 345371 - RNA, 22 nt, Homo sapiens
guaaauguccugcuacagagug

SEQ ID NO: 345372 - RNA, 22 nt, Homo sapiens
guaacacucuaaagggaugcac

SEQ ID NO: 345373 - RNA, 20 nt, Homo sapiens
guaacagcacuuucccaaag

SEQ ID NO: 345374 - RNA, 22 nt, Homo sapiens
guaaguagcuuuagauauaaau

SEQ ID NO: 345375 - RNA, 22 nt, Homo sapiens
guaauagucucaaacuccugga

SEQ ID NO: 345376 - RNA, 22 nt, Homo sapiens
guaaucucaccuacuugggagg

SEQ ID NO: 345377 - RNA, 22 nt, Homo sapiens
guaaucucagcuacucgggaga

SEQ ID NO: 345378 - RNA, 22 nt, Homo sapiens
guagaaaguuugcugucacaug

SEQ ID NO: 345379 - RNA, 22 nt, Homo sapiens
guagcagaauaucagauaauuu

SEQ ID NO: 345380 - RNA, 18 nt, Homo sapiens
guaggucaguaccaagca

SEQ ID NO: 345381 - RNA, 22 nt, Homo sapiens
guauaguaguacaaaaguuuuu

SEQ ID NO: 345382 - RNA, 22 nt, Homo sapiens
guaugcaagugauaugacauau

SEQ ID NO: 345383 - RNA, 22 nt, Homo sapiens
guaugguacuuuaugguuagug

SEQ ID NO: 345384 - RNA, 22 nt, Homo sapiens
guauuagguuggugcaaaauug

SEQ ID NO: 345385 - RNA, 19 nt, Homo sapiens
gucaaagucgguauucaaa

SEQ ID NO: 345386 - RNA, 22 nt, Homo sapiens
gucaaagucuauuggcuaauuc

SEQ ID NO: 345387 - RNA, 22 nt, Homo sapiens
gucacagcacuuuuaguaagug

SEQ ID NO: 345388 - RNA, 22 nt, Homo sapiens
gucacaguggccagugauguuc

SEQ ID NO: 345389 - RNA, 22 nt, Homo sapiens
gucacauugaugcccauggugg

SEQ ID NO: 345390 - RNA, 22 nt, Homo sapiens
gucacggaauguaaguggaagu

SEQ ID NO: 345391 - RNA, 22 nt, Homo sapiens
gucacuggcugucuuguaugau

SEQ ID NO: 345392 - RNA, 22 nt, Homo sapiens
gucacugugaggaggggccagg

SEQ ID NO: 345393 - RNA, 22 nt, Homo sapiens
gucacuguuuccuauuauauuu

SEQ ID NO: 345394 - RNA, 22 nt, Homo sapiens
gucagcaaaguucuccugcaga

SEQ ID NO: 345395 - RNA, 22 nt, Homo sapiens
gucaggcaccgauacaguuuuu

SEQ ID NO: 345396 - RNA, 22 nt, Homo sapiens
gucagggagucucuaucagugg

SEQ ID NO: 345397 - RNA, 22 nt, Homo sapiens
gucagugucuuugcagcucaga

SEQ ID NO: 345398 - RNA, 21 nt, Homo sapiens
gucauaugucucugauuagug

SEQ ID NO: 345399 - RNA, 22 nt, Homo sapiens
gucaugcaggguucgccagccc

SEQ ID NO: 345400 - RNA, 22 nt, Homo sapiens
gucauugaaguggaaucaucca

SEQ ID NO: 345401 - RNA, 22 nt, Homo sapiens
guccagagaagucauuacuuca

SEQ ID NO: 345402 - RNA, 22 nt, Homo sapiens
guccaugagaugaauccacaca

SEQ ID NO: 345403 - RNA, 20 nt, Homo sapiens
guccauuugcugccauugcu

SEQ ID NO: 345404 - RNA, 22 nt, Homo sapiens
gucccugcgauugugggauccu

SEQ ID NO: 345405 - RNA, 22 nt, Homo sapiens
gucucacagcuagcugcuuuau

SEQ ID NO: 345406 - RNA, 22 nt, Homo sapiens
gucucacaggcaugaugccagc

SEQ ID NO: 345407 - RNA, 22 nt, Homo sapiens
gucucccaaccccugugcccag

SEQ ID NO: 345408 - RNA, 22 nt, Homo sapiens
gucugguugacagcauguggcc

SEQ ID NO: 345409 - RNA, 22 nt, Homo sapiens
gucuugaaggcugaguaccugu

SEQ ID NO: 345410 - RNA, 22 nt, Homo sapiens
gucuuggagacauugccauuga

SEQ ID NO: 345411 - RNA, 22 nt, Homo sapiens
gugaaauacauaaucccaagug

SEQ ID NO: 345412 - RNA, 22 nt, Homo sapiens
gugaaauauuuaacguccaggu

SEQ ID NO: 345413 - RNA, 17 nt, Homo sapiens
gugaaaucaucauuuuu

SEQ ID NO: 345414 - RNA, 22 nt, Homo sapiens
gugaaaugaaacgcuaugucuu

SEQ ID NO: 345415 - RNA, 22 nt, Homo sapiens
gugaaugaaugggugaauacau

SEQ ID NO: 345416 - RNA, 22 nt, Homo sapiens
gugacagaguaagacccuguau

SEQ ID NO: 345417 - RNA, 22 nt, Homo sapiens
gugaccagaugggcaggggugu

SEQ ID NO: 345418 - RNA, 22 nt, Homo sapiens
gugaccucuguugcugucacua

SEQ ID NO: 345419 - RNA, 22 nt, Homo sapiens
gugagaccaauguacuaccuuc

SEQ ID NO: 345420 - RNA, 22 nt, Homo sapiens
gugagagaaugacuauguguuu

SEQ ID NO: 345421 - RNA, 22 nt, Homo sapiens
gugagauuaccauuuaaaucag

SEQ ID NO: 345422 - RNA, 22 nt, Homo sapiens
gugagcacugaaagaaggcaag

SEQ ID NO: 345423 - RNA, 22 nt, Homo sapiens
gugagcaguguccuugggggca

SEQ ID NO: 345424 - RNA, 22 nt, Homo sapiens
gugagcuccucucuauguguca

SEQ ID NO: 345425 - RNA, 20 nt, Homo sapiens
gugagucauuaguaaccaaa

SEQ ID NO: 345426 - RNA, 20 nt, Homo sapiens
gacuugagagugggagagua

SEQ ID NO: 345427 - RNA, 18 nt, Homo sapiens
gacuuggaguuuacagug

SEQ ID NO: 345428 - RNA, 22 nt, Homo sapiens
gagaacauuaauaguuaauuuu

SEQ ID NO: 345429 - RNA, 22 nt, Homo sapiens
gagaaccauuuggagaaaaagu

SEQ ID NO: 345430 - RNA, 22 nt, Homo sapiens
gagaaugagaggggaaggccac

SEQ ID NO: 345431 - RNA, 22 nt, Homo sapiens
gagacauugacuuuguuccaga

SEQ ID NO: 345432 - RNA, 22 nt, Homo sapiens
gagacugagucucacucuguca

SEQ ID NO: 345433 - RNA, 22 nt, Homo sapiens
gagagaguacuugauauaauuu

SEQ ID NO: 345434 - RNA, 22 nt, Homo sapiens
gagagugaaguuugcuaccugu

SEQ ID NO: 345435 - RNA, 22 nt, Homo sapiens
gagaucaguuaaugaagugagc

SEQ ID NO: 345436 - RNA, 22 nt, Homo sapiens
gagaucauguacuagaacaccu

SEQ ID NO: 345437 - RNA, 22 nt, Homo sapiens
gagaugaaaucuugcucuguca

SEQ ID NO: 345438 - RNA, 22 nt, Homo sapiens
gagaugaagugucaauaaggau

SEQ ID NO: 345439 - RNA, 22 nt, Homo sapiens
gagauggugugcuguuggaagu

SEQ ID NO: 345440 - RNA, 20 nt, Homo sapiens
gagcucaucuucuuuaccac

SEQ ID NO: 345441 - RNA, 22 nt, Homo sapiens
gagcucauuaaaguaggaccua

SEQ ID NO: 345442 - RNA, 22 nt, Homo sapiens
gagcugaucuuuucugauucca

SEQ ID NO: 345443 - RNA, 22 nt, Homo sapiens
gagcugccuugccuaugcaaga

SEQ ID NO: 345444 - RNA, 22 nt, Homo sapiens
gaggagucagacugugcaaggu

SEQ ID NO: 345445 - RNA, 22 nt, Homo sapiens
gaggaucucuugagcccagaag

SEQ ID NO: 345446 - RNA, 22 nt, Homo sapiens
gaggcggugugaugucacaugc

SEQ ID NO: 345447 - RNA, 22 nt, Homo sapiens
gagguaggaauaaacauuugaa

SEQ ID NO: 345448 - RNA, 22 nt, Homo sapiens
gagguaggaggauugcuuaagg

SEQ ID NO: 345449 - RNA, 22 nt, Homo sapiens
gagguagggucccacuauguug

SEQ ID NO: 345450 - RNA, 22 nt, Homo sapiens
gaggucaggacauuuuugcuuu

SEQ ID NO: 345451 - RNA, 22 nt, Homo sapiens
gagguggugguggaggcauagc

SEQ ID NO: 345452 - RNA, 22 nt, Homo sapiens
gaguaaaugucaaguacuuagg

SEQ ID NO: 345453 - RNA, 22 nt, Homo sapiens
gaguagaacugguuaucuaaua

SEQ ID NO: 345454 - RNA, 23 nt, Homo sapiens
gagugcaaugacaugaucucgga

SEQ ID NO: 345455 - RNA, 22 nt, Homo sapiens
gagugcaauggcgcgaucuggg

SEQ ID NO: 345456 - RNA, 22 nt, Homo sapiens
gagugcugagcccacuuccuug

SEQ ID NO: 345457 - RNA, 22 nt, Homo sapiens
gaguggugguucugaaacuuuu

SEQ ID NO: 345458 - RNA, 22 nt, Homo sapiens
gagugguucuauauguaauugg

SEQ ID NO: 345459 - RNA, 22 nt, Homo sapiens
gauaaagauagcaauagggaca

SEQ ID NO: 345460 - RNA, 22 nt, Homo sapiens
gauagaccauccaggauguuug

SEQ ID NO: 345461 - RNA, 21 nt, Homo sapiens
gauaugacauggguaaaacca

SEQ ID NO: 345462 - RNA, 22 nt, Homo sapiens
gauauguaguaguugaaaaaga

SEQ ID NO: 345463 - RNA, 22 nt, Homo sapiens
gauauguucugagaaaugcauu

SEQ ID NO: 345464 - RNA, 22 nt, Homo sapiens
gauauugacuuauucuauguuu

SEQ ID NO: 345465 - RNA, 22 nt, Homo sapiens
gaucugagaaagugucauaaca

SEQ ID NO: 345466 - RNA, 22 nt, Homo sapiens
gaucuguguuuguaugcauaag

SEQ ID NO: 345467 - RNA, 22 nt, Homo sapiens
gaugacagugaguaaccccaac

SEQ ID NO: 345468 - RNA, 22 nt, Homo sapiens
gaugagguagaagacucagcaa

SEQ ID NO: 345469 - RNA, 19 nt, Homo sapiens
gaugcaaugcacugagguc

SEQ ID NO: 345470 - RNA, 22 nt, Homo sapiens
gauggaguugacuaagacaaca

SEQ ID NO: 345471 - RNA, 22 nt, Homo sapiens
gauggcucugcaggugagggua

SEQ ID NO: 345472 - RNA, 22 nt, Homo sapiens
gauuccacuuucaaauucaaau

SEQ ID NO: 345473 - RNA, 22 nt, Homo sapiens
gauuugguguucuggcucaaga

SEQ ID NO: 345474 - RNA, 21 nt, Homo sapiens
gcaaacauccuuugaugccag

SEQ ID NO: 345475 - RNA, 22 nt, Homo sapiens
gcaaaguguuuuccaacuuggu

SEQ ID NO: 345476 - RNA, 20 nt, Homo sapiens
gcaaauggaucccacaagcc

SEQ ID NO: 345477 - RNA, 22 nt, Homo sapiens
gcaacugguuucaguuuuucag

SEQ ID NO: 345478 - RNA, 22 nt, Homo sapiens
gcaagauguuaccauuagggaa

SEQ ID NO: 345479 - RNA, 22 nt, Homo sapiens
gcaagugucugagguuuuguau

SEQ ID NO: 345480 - RNA, 22 nt, Homo sapiens
gcaauacugacagcauuaguuu

SEQ ID NO: 345481 - RNA, 22 nt, Homo sapiens
gcaccaugguagaauaauggua

SEQ ID NO: 345482 - RNA, 22 nt, Homo sapiens
gcaccccuuaccgggcuggguu

SEQ ID NO: 345483 - RNA, 22 nt, Homo sapiens
gcacgugcucauuugaggucuu

SEQ ID NO: 345484 - RNA, 22 nt, Homo sapiens
gcacugagagaagccccaagua

SEQ ID NO: 345485 - RNA, 22 nt, Homo sapiens
gcagcauuaccaagacauggca

SEQ ID NO: 345486 - RNA, 22 nt, Homo sapiens
gcaggcaugacauuucacucuu

SEQ ID NO: 345487 - RNA, 22 nt, Homo sapiens
gcaugacaaugauugcucuuca

SEQ ID NO: 345488 - RNA, 22 nt, Homo sapiens
gcaugguaguaaccuacauuug

SEQ ID NO: 345489 - RNA, 22 nt, Homo sapiens
gcauugcacuuggcauagacug

SEQ ID NO: 345490 - RNA, 22 nt, Homo sapiens
gccaagaugcugcccacagaca

SEQ ID NO: 345491 - RNA, 22 nt, Homo sapiens
gccaguauuuuauugaggauuu

SEQ ID NO: 345492 - RNA, 22 nt, Homo sapiens
gccauggugucuuauuuuugug

SEQ ID NO: 345493 - RNA, 22 nt, Homo sapiens
gccauugcacuccagccucggc

SEQ ID NO: 345494 - RNA, 22 nt, Homo sapiens
gccauugcacucuagccugagc

SEQ ID NO: 345495 - RNA, 22 nt, Homo sapiens
gcccaguagcaguacaucccuu

SEQ ID NO: 345496 - RNA, 22 nt, Homo sapiens
gccccgggugaugcagccguca

SEQ ID NO: 345497 - RNA, 17 nt, Homo sapiens
gcccuuugugccucuuc

SEQ ID NO: 345498 - RNA, 22 nt, Homo sapiens
gccucaguuguggccagggauu

SEQ ID NO: 345499 - RNA, 22 nt, Homo sapiens
gcuagcauucaaaugugcagcc

SEQ ID NO: 345500 - RNA, 22 nt, Homo sapiens
gcuaggagauccacugcucucu

SEQ ID NO: 345501 - RNA, 22 nt, Homo sapiens
gcuaggagaucugcugcucucu

SEQ ID NO: 345502 - RNA, 22 nt, Homo sapiens
gcucaugggcagugugauuguu

SEQ ID NO: 345503 - RNA, 22 nt, Homo sapiens
gcucguccccuccugacucugc

SEQ ID NO: 345504 - RNA, 22 nt, Homo sapiens
gcugagcuaugccauauaugcc

SEQ ID NO: 345505 - RNA, 22 nt, Homo sapiens
gcugagguucaagaagguuaaa

SEQ ID NO: 345506 - RNA, 22 nt, Homo sapiens
gcugcguguagaguucucacug

SEQ ID NO: 345507 - RNA, 22 nt, Homo sapiens
gcugcuguuauucaucagaacu

SEQ ID NO: 345508 - RNA, 22 nt, Homo sapiens
gcugguauuacaggcaugagcc

SEQ ID NO: 345509 - RNA, 22 nt, Homo sapiens
gcuggugacuuuaaguugaagc

SEQ ID NO: 345510 - RNA, 19 nt, Homo sapiens
gcugguuguccacucucuc

SEQ ID NO: 345511 - RNA, 22 nt, Homo sapiens
gcugucaugagcaacacaugaa

SEQ ID NO: 345512 - RNA, 22 nt, Homo sapiens
gcuguguguuaucagaaauugc

SEQ ID NO: 345513 - RNA, 22 nt, Homo sapiens
gcuguguugugcccagcaucau

SEQ ID NO: 345514 - RNA, 18 nt, Homo sapiens
uaauaacugugaccuuga

SEQ ID NO: 345515 - RNA, 22 nt, Homo sapiens
uaauagcucggauaaacaugau

SEQ ID NO: 345516 - RNA, 22 nt, Homo sapiens
uaaucucagcuacucaggaggc

SEQ ID NO: 345517 - RNA, 21 nt, Homo sapiens
uaauggcaugaucucggcuca

SEQ ID NO: 345518 - RNA, 22 nt, Homo sapiens
uaaugugaauagugcuguaaug

SEQ ID NO: 345519 - RNA, 22 nt, Homo sapiens
uacacgugcacaacgugcacgu

SEQ ID NO: 345520 - RNA, 18 nt, Homo sapiens
uacagaacuggaguagaa

SEQ ID NO: 345521 - RNA, 22 nt, Homo sapiens
uacagaguagaagauuugcaga

SEQ ID NO: 345522 - RNA, 22 nt, Homo sapiens
uacagcacaggugcagguguug

SEQ ID NO: 345523 - RNA, 22 nt, Homo sapiens
uacagcuaugugcaugcaugcu

SEQ ID NO: 345524 - RNA, 22 nt, Homo sapiens
uacaguauuaugagugauugaa

SEQ ID NO: 345525 - RNA, 22 nt, Homo sapiens
uacagucacauuccugaccaua

SEQ ID NO: 345526 - RNA, 22 nt, Homo sapiens
uacaguguuuugguauuccaca

SEQ ID NO: 345527 - RNA, 22 nt, Homo sapiens
uacauacuucacagacuuuaaa

SEQ ID NO: 345528 - RNA, 22 nt, Homo sapiens
uacauguauguguuuauggcug

SEQ ID NO: 345529 - RNA, 22 nt, Homo sapiens
uaccaaguauuuucacaugaac

SEQ ID NO: 345530 - RNA, 22 nt, Homo sapiens
uaccacccuuuuuccagaagcc

SEQ ID NO: 345531 - RNA, 22 nt, Homo sapiens
uaccagugaauuccaggggcua

SEQ ID NO: 345532 - RNA, 22 nt, Homo sapiens
uacccucuggauacccuuguuc

SEQ ID NO: 345533 - RNA, 22 nt, Homo sapiens
uacuacuuucugacaucuuuaa

SEQ ID NO: 345534 - RNA, 22 nt, Homo sapiens
uacucaguagucuguugcuguc

SEQ ID NO: 345535 - RNA, 22 nt, Homo sapiens
uacucugcagagaugcauaaca

SEQ ID NO: 345536 - RNA, 22 nt, Homo sapiens
uacugcacuccagcuuaggaga

SEQ ID NO: 345537 - RNA, 19 nt, Homo sapiens
uacugcacuccagucuggg

SEQ ID NO: 345538 - RNA, 22 nt, Homo sapiens
uacugcacucuagccuggguga

SEQ ID NO: 345539 - RNA, 22 nt, Homo sapiens
uacugcacuggaggccucagau

SEQ ID NO: 345540 - RNA, 22 nt, Homo sapiens
uacuguguaguuagaccucaga

SEQ ID NO: 345541 - RNA, 21 nt, Homo sapiens
uacuugagacagggucuugcu

SEQ ID NO: 345542 - RNA, 22 nt, Homo sapiens
uacuuuguagagugugagaauu

SEQ ID NO: 345543 - RNA, 22 nt, Homo sapiens
uagaauguauaauauuuuacuu

SEQ ID NO: 345544 - RNA, 22 nt, Homo sapiens
uagaccaauuggcauauaguaa

SEQ ID NO: 345545 - RNA, 22 nt, Homo sapiens
uagagcuacagcccucacuguc

SEQ ID NO: 345546 - RNA, 21 nt, Homo sapiens
uagauaguugguucugaaucu

SEQ ID NO: 345547 - RNA, 22 nt, Homo sapiens
uagaucauauacuugccaugac

SEQ ID NO: 345548 - RNA, 21 nt, Homo sapiens
uagaugguguucuagagagaa

SEQ ID NO: 345549 - RNA, 22 nt, Homo sapiens
uagcaaaucaauggaauugaag

SEQ ID NO: 345550 - RNA, 22 nt, Homo sapiens
uagcacaucuucuuggccugca

SEQ ID NO: 345551 - RNA, 22 nt, Homo sapiens
uagcacuauuuuucacuauccu

SEQ ID NO: 345552 - RNA, 22 nt, Homo sapiens
uagcaggaaaccuguguugagg

SEQ ID NO: 345553 - RNA, 22 nt, Homo sapiens
uagcaguuguuguuacuuguau

SEQ ID NO: 345554 - RNA, 22 nt, Homo sapiens
uagcaucagauuccauauucua

SEQ ID NO: 345555 - RNA, 18 nt, Homo sapiens
uagcaugaugcugagugc

SEQ ID NO: 345556 - RNA, 22 nt, Homo sapiens
uagcuccagugggguuacugcu

SEQ ID NO: 345557 - RNA, 22 nt, Homo sapiens
uagcugagacuacaguaggugc

SEQ ID NO: 345558 - RNA, 22 nt, Homo sapiens
uagcugcauccugugcacucaa

SEQ ID NO: 345559 - RNA, 22 nt, Homo sapiens
uagcugcccagcacgaaguugg

SEQ ID NO: 345560 - RNA, 22 nt, Homo sapiens
uagcugcuguauguacacggau

SEQ ID NO: 345561 - RNA, 22 nt, Homo sapiens
uagcuucuccauagcuccaugu

SEQ ID NO: 345562 - RNA, 22 nt, Homo sapiens
uaggaaugaacgauuuauuggu

SEQ ID NO: 345563 - RNA, 22 nt, Homo sapiens
uaggacacaggacauauguaga

SEQ ID NO: 345564 - RNA, 19 nt, Homo sapiens
uagggcacgaggcagaguc

SEQ ID NO: 345565 - RNA, 22 nt, Homo sapiens
uagggcuugugaucagguguag

SEQ ID NO: 345566 - RNA, 22 nt, Homo sapiens
uagguaagauguuaacagcuga

SEQ ID NO: 345567 - RNA, 22 nt, Homo sapiens
uaggucccguuucagacugaga

SEQ ID NO: 345568 - RNA, 22 nt, Homo sapiens
uaggucuuuuagcauaggagcu

SEQ ID NO: 345569 - RNA, 22 nt, Homo sapiens
uaguaguuuuguguauaauaau

SEQ ID NO: 345570 - RNA, 22 nt, Homo sapiens
uagugcacuacuugugggaaug

SEQ ID NO: 345571 - RNA, 22 nt, Homo sapiens
uagugcuguaauucuaaugaaa

SEQ ID NO: 345572 - RNA, 22 nt, Homo sapiens
uagugcugugauaaacauauau

SEQ ID NO: 345573 - RNA, 22 nt, Homo sapiens
uagugcugugauuaacauaaug

SEQ ID NO: 345574 - RNA, 18 nt, Homo sapiens
uagugcuguucucaugau

SEQ ID NO: 345575 - RNA, 22 nt, Homo sapiens
uaguucauuuuucuugcuuaga

SEQ ID NO: 345576 - RNA, 22 nt, Homo sapiens
uauaacaaugcaagaauggccu

SEQ ID NO: 345577 - RNA, 22 nt, Homo sapiens
uauaagguuaggaaaaauuucu

SEQ ID NO: 345578 - RNA, 22 nt, Homo sapiens
uauacaugugggcaucaggaga

SEQ ID NO: 345579 - RNA, 22 nt, Homo sapiens
uauagcaaugugccacucucug

SEQ ID NO: 345580 - RNA, 21 nt, Homo sapiens
uauagcagcacgauuuauagu

SEQ ID NO: 345581 - RNA, 22 nt, Homo sapiens
uauagcagugaguauugacuaa

SEQ ID NO: 345582 - RNA, 22 nt, Homo sapiens
uauagcauuuugauccuguaga

SEQ ID NO: 345583 - RNA, 22 nt, Homo sapiens
uauauguuuucauaaggcuaga

SEQ ID NO: 345584 - RNA, 22 nt, Homo sapiens
uaucacacaucaugguaaaucu

SEQ ID NO: 345585 - RNA, 22 nt, Homo sapiens
uaucacacuguuggauuugauu

SEQ ID NO: 345586 - RNA, 22 nt, Homo sapiens
uaucacagcgggguguacaccc

SEQ ID NO: 345587 - RNA, 22 nt, Homo sapiens
uaucacaguagaacucuuucca

SEQ ID NO: 345588 - RNA, 21 nt, Homo sapiens
uaucacaguagaauaggaucu

SEQ ID NO: 345589 - RNA, 22 nt, Homo sapiens
uaucacaguaucuagcacagug

SEQ ID NO: 345590 - RNA, 21 nt, Homo sapiens
uaucagagacauugagaggca

SEQ ID NO: 345591 - RNA, 22 nt, Homo sapiens
uaucagcagagucauacuucaa

SEQ ID NO: 345592 - RNA, 22 nt, Homo sapiens
uaucugcacauacacuuauagc

SEQ ID NO: 345593 - RNA, 20 nt, Homo sapiens
uaugacaaagccuagugagu

SEQ ID NO: 345594 - RNA, 20 nt, Homo sapiens
uaugaccugucuuuucucuc

SEQ ID NO: 345595 - RNA, 22 nt, Homo sapiens
uaugacuguuugcucauucagg

SEQ ID NO: 345596 - RNA, 21 nt, Homo sapiens
uaugagucugcaagaaccaca

SEQ ID NO: 345597 - RNA, 22 nt, Homo sapiens
uaugauuuuugggagaggucaa

SEQ ID NO: 345598 - RNA, 22 nt, Homo sapiens
uaugcacacacguguuuaugug

SEQ ID NO: 345599 - RNA, 22 nt, Homo sapiens
uaugcagacauuguuccaacca

SEQ ID NO: 345600 - RNA, 22 nt, Homo sapiens
uauggaaaucuuaccuuauggu

SEQ ID NO: 345601 - RNA, 22 nt, Homo sapiens
uauggcuacuacgaauaaugcu

SEQ ID NO: 345602 - RNA, 22 nt, Homo sapiens
uaugugcaaauuaauugcuaga

SEQ ID NO: 345603 - RNA, 18 nt, Homo sapiens
uauuaagcuagauauuau

SEQ ID NO: 345604 - RNA, 22 nt, Homo sapiens
uauuccacaauaugauuuuuaa

SEQ ID NO: 345605 - RNA, 22 nt, Homo sapiens
uauugaacgugggauauugaag

SEQ ID NO: 345606 - RNA, 22 nt, Homo sapiens
uauugauuaauugugauuaggc

SEQ ID NO: 345607 - RNA, 22 nt, Homo sapiens
uauugcacaugaggagacauug

SEQ ID NO: 345608 - RNA, 23 nt, Homo sapiens
uauugcacuaugguaacccuuuu

SEQ ID NO: 345609 - RNA, 22 nt, Homo sapiens
uauugcacuuuuccauaggagu

SEQ ID NO: 345610 - RNA, 22 nt, Homo sapiens
uauugcuaaaacucaugguugc

SEQ ID NO: 345611 - RNA, 22 nt, Homo sapiens
uauugucaccaucccuguuuua

SEQ ID NO: 345612 - RNA, 22 nt, Homo sapiens
uauuguuaaagauguuaaugau

SEQ ID NO: 345613 - RNA, 22 nt, Homo sapiens
uauuugguagcuauuuugcagu

SEQ ID NO: 345614 - RNA, 20 nt, Homo sapiens
uauuugguuauuuccauggu

SEQ ID NO: 345615 - RNA, 22 nt, Homo sapiens
ucaaacugcuugaggccauuua

SEQ ID NO: 345616 - RNA, 22 nt, Homo sapiens
ucaaaguaaagccucaggaugg

SEQ ID NO: 345617 - RNA, 22 nt, Homo sapiens
ucaaagucuucucaaguaacau

SEQ ID NO: 345618 - RNA, 22 nt, Homo sapiens
ucaaagugacaaaguugcagca

SEQ ID NO: 345619 - RNA, 22 nt, Homo sapiens
ucaaaugauucacccaccuuug

SEQ ID NO: 345620 - RNA, 22 nt, Homo sapiens
ucaaaugauucagaagccaccu

SEQ ID NO: 345621 - RNA, 22 nt, Homo sapiens
ucaaaugcacguagagaaaaua

SEQ ID NO: 345622 - RNA, 22 nt, Homo sapiens
ucaacugcuugagaucacaaau

SEQ ID NO: 345623 - RNA, 18 nt, Homo sapiens
ucaagcuauugucaugcc

SEQ ID NO: 345624 - RNA, 22 nt, Homo sapiens
ucaaggcacauuugacauuuuc

SEQ ID NO: 345625 - RNA, 22 nt, Homo sapiens
ucaaugcaugugacaaagagua

SEQ ID NO: 345626 - RNA, 21 nt, Homo sapiens
ucacaaugaacagcagcagaa

SEQ ID NO: 345627 - RNA, 22 nt, Homo sapiens
ucacaauucucaauuugugaaa

SEQ ID NO: 345628 - RNA, 22 nt, Homo sapiens
ucacagacauugaggggaccuu

SEQ ID NO: 345629 - RNA, 22 nt, Homo sapiens
ucacagccuaguuuuauacauu

SEQ ID NO: 345630 - RNA, 22 nt, Homo sapiens
ucacaguagagcuucuuucaga

SEQ ID NO: 345631 - RNA, 22 nt, Homo sapiens
ucacaguagccccucccaucau

SEQ ID NO: 345632 - RNA, 22 nt, Homo sapiens
ucacagucacugucacguugaa

SEQ ID NO: 345633 - RNA, 22 nt, Homo sapiens
ucacaguucagcauggcugagg

SEQ ID NO: 345634 - RNA, 22 nt, Homo sapiens
ucacaguuggccuggccuuuua

SEQ ID NO: 345635 - RNA, 22 nt, Homo sapiens
ucacaucucagguuucuugaca

SEQ ID NO: 345636 - RNA, 22 nt, Homo sapiens
ucacaugugacauauauauuug

SEQ ID NO: 345637 - RNA, 22 nt, Homo sapiens
ucacauguguaaauugguguaa

SEQ ID NO: 345638 - RNA, 22 nt, Homo sapiens
ucacauuguguagccugcucac

SEQ ID NO: 345639 - RNA, 21 nt, Homo sapiens
ucaccuguagcugcauguucu

SEQ ID NO: 345640 - RNA, 21 nt, Homo sapiens
ucaccuguugcgaugaagcug

SEQ ID NO: 345641 - RNA, 23 nt, Homo sapiens
ucacggagaccugcaagaccaau

SEQ ID NO: 345642 - RNA, 22 nt, Homo sapiens
ucacuagaucaagggagagaaa

SEQ ID NO: 345643 - RNA, 22 nt, Homo sapiens
ucacugaaaccgccuccaccuc

SEQ ID NO: 345644 - RNA, 22 nt, Homo sapiens
ucacugaaaccuccaccucucg

SEQ ID NO: 345645 - RNA, 22 nt, Homo sapiens
ucacugaaacuguccuggguua

SEQ ID NO: 345646 - RNA, 22 nt, Homo sapiens
ucacugagaaugauguuucuga

SEQ ID NO: 345647 - RNA, 20 nt, Homo sapiens
ucacugagugguccacagua

SEQ ID NO: 345648 - RNA, 22 nt, Homo sapiens
ucacugcacuucaggcuuucuc

SEQ ID NO: 345649 - RNA, 22 nt, Homo sapiens
ucacuggacagaaauaaaggug

SEQ ID NO: 345650 - RNA, 22 nt, Homo sapiens
ucacuggagguuccugaaguuc

SEQ ID NO: 345651 - RNA, 22 nt, Homo sapiens
ucacugugguuuugaugugcau

SEQ ID NO: 345652 - RNA, 22 nt, Homo sapiens
ucacuugguggcaaaguuuaug

SEQ ID NO: 345653 - RNA, 22 nt, Homo sapiens
ucacuuuguuuuuggauaaguu

SEQ ID NO: 345654 - RNA, 22 nt, Homo sapiens
ucagaguagaaacacuuccaua

SEQ ID NO: 345655 - RNA, 22 nt, Homo sapiens
ucagauacuggugacaugaaug

SEQ ID NO: 345656 - RNA, 22 nt, Homo sapiens
ucagaucaguuccacaagaacu

SEQ ID NO: 345657 - RNA, 22 nt, Homo sapiens
ucagaucauauucuucgcugcu

SEQ ID NO: 345658 - RNA, 22 nt, Homo sapiens
ucagauguuugagaaguauacu

SEQ ID NO: 345659 - RNA, 20 nt, Homo sapiens
ucagcagucuggagcagagg

SEQ ID NO: 345660 - RNA, 22 nt, Homo sapiens
ucaggcaccuuccucuuaucug

SEQ ID NO: 345661 - RNA, 21 nt, Homo sapiens
ucagggaccugcuguacugau

SEQ ID NO: 345662 - RNA, 23 nt, Homo sapiens
ucagguaguuucagaggaccuug

SEQ ID NO: 345663 - RNA, 22 nt, Homo sapiens
ucaguaaaugcuguucucuuuu

SEQ ID NO: 345664 - RNA, 23 nt, Homo sapiens
ucaguagucauugggaaagugug

SEQ ID NO: 345665 - RNA, 18 nt, Homo sapiens
ucagucacugccuggcuu

SEQ ID NO: 345666 - RNA, 22 nt, Homo sapiens
ucagucuuuuaccauuaaguau

SEQ ID NO: 345667 - RNA, 22 nt, Homo sapiens
ucagucuuuuuuuggcaagcau

SEQ ID NO: 345668 - RNA, 22 nt, Homo sapiens
ucagugaauguuggccacuacu

SEQ ID NO: 345669 - RNA, 22 nt, Homo sapiens
ucagugauugcuuucauggaaa

SEQ ID NO: 345670 - RNA, 22 nt, Homo sapiens
ucagugauugguuauuuuaggc

SEQ ID NO: 345671 - RNA, 21 nt, Homo sapiens
ucagugcugugggcaaggugc

SEQ ID NO: 345672 - RNA, 22 nt, Homo sapiens
ucaguuaaugcugccugcugga

SEQ ID NO: 345673 - RNA, 20 nt, Homo sapiens
ucauacuguggaguaccagg

SEQ ID NO: 345674 - RNA, 22 nt, Homo sapiens
ucauaguacuuuguuuugaaaa

SEQ ID NO: 345675 - RNA, 22 nt, Homo sapiens
ucauaucauuagaucuacugua

SEQ ID NO: 345676 - RNA, 22 nt, Homo sapiens
ucaucaggcucauucaagcuga

SEQ ID NO: 345677 - RNA, 22 nt, Homo sapiens
ucaucuggcgaaugugaagagu

SEQ ID NO: 345678 - RNA, 22 nt, Homo sapiens
ucauggcacugaugagaguuuc

SEQ ID NO: 345679 - RNA, 22 nt, Homo sapiens
ucaugggagcccccaucaugag

SEQ ID NO: 345680 - RNA, 22 nt, Homo sapiens
ucaugguuuuauaacccucuug

SEQ ID NO: 345681 - RNA, 22 nt, Homo sapiens
ucauguauuaucauuagugggu

SEQ ID NO: 345682 - RNA, 22 nt, Homo sapiens
ucaugugagcacagagcaagau

SEQ ID NO: 345683 - RNA, 22 nt, Homo sapiens
ucauucuuucuguggaggggcu

SEQ ID NO: 345684 - RNA, 22 nt, Homo sapiens
ucauugcaaucucugccucccg

SEQ ID NO: 345685 - RNA, 22 nt, Homo sapiens
ucauugcauuccagcccaagca

SEQ ID NO: 345686 - RNA, 22 nt, Homo sapiens
ucauuggaugucugaaaugauu

SEQ ID NO: 345687 - RNA, 22 nt, Homo sapiens
ucauuguccaacuucuuucagu

SEQ ID NO: 345688 - RNA, 22 nt, Homo sapiens
uccacaauggagaagaguauga

SEQ ID NO: 345689 - RNA, 22 nt, Homo sapiens
uccacaguggugaggugcagca

SEQ ID NO: 345690 - RNA, 22 nt, Homo sapiens
ugcugcaaacaugagaggaagu

SEQ ID NO: 345691 - RNA, 22 nt, Homo sapiens
ugcugcaaucucggcacuuugg

SEQ ID NO: 345692 - RNA, 22 nt, Homo sapiens
ugcugcacaguucuuaagauua

SEQ ID NO: 345693 - RNA, 22 nt, Homo sapiens
ugcugcuguuaucauuuuacca

SEQ ID NO: 345694 - RNA, 22 nt, Homo sapiens
ugcugguggucccauaugauua

SEQ ID NO: 345695 - RNA, 22 nt, Homo sapiens
ugcugguguuuaggaauaagaa

SEQ ID NO: 345696 - RNA, 22 nt, Homo sapiens
ugcugguuuucaucaucagugg

SEQ ID NO: 345697 - RNA, 22 nt, Homo sapiens
ugcuguguugcuggcuuaaaga

SEQ ID NO: 345698 - RNA, 22 nt, Homo sapiens
uggaaaacaugcacauuggauu

SEQ ID NO: 345699 - RNA, 22 nt, Homo sapiens
uggaaaauuaggggagguuaua

SEQ ID NO: 345700 - RNA, 22 nt, Homo sapiens
uggaaaguaguucuaaucuaag

SEQ ID NO: 345701 - RNA, 22 nt, Homo sapiens
uggaaaguccaagccaaccggg

SEQ ID NO: 345702 - RNA, 20 nt, Homo sapiens
uggaaauuaaccuuucaggu

SEQ ID NO: 345703 - RNA, 22 nt, Homo sapiens
uggaacacauaaauagcauagu

SEQ ID NO: 345704 - RNA, 22 nt, Homo sapiens
uggaagacaaguguuagcaugg

SEQ ID NO: 345705 - RNA, 22 nt, Homo sapiens
uggaagacauugggugaagggu

SEQ ID NO: 345706 - RNA, 22 nt, Homo sapiens
uggaagacauuuuggaccuugg

SEQ ID NO: 345707 - RNA, 22 nt, Homo sapiens
uggaagcaugcaaucugugggg

SEQ ID NO: 345708 - RNA, 21 nt, Homo sapiens
uggaaucuauuauuccaguuu

SEQ ID NO: 345709 - RNA, 20 nt, Homo sapiens
uggaaucugaagaucucagu

SEQ ID NO: 345710 - RNA, 17 nt, Homo sapiens
uggaaugucuaagccug

SEQ ID NO: 345711 - RNA, 18 nt, Homo sapiens
uggaauguuuggguuaau

SEQ ID NO: 345712 - RNA, 22 nt, Homo sapiens
uggaauuaauuaaaauauacug

SEQ ID NO: 345713 - RNA, 22 nt, Homo sapiens
uggacuguaauagagaacagaa

SEQ ID NO: 345714 - RNA, 22 nt, Homo sapiens
uggagugagaacuucaaugaug

SEQ ID NO: 345715 - RNA, 22 nt, Homo sapiens
uggagugcaauggcaccaucuu

SEQ ID NO: 345716 - RNA, 22 nt, Homo sapiens
uggagugcgugucugaguuuuu

SEQ ID NO: 345717 - RNA, 22 nt, Homo sapiens
uggagugucaguuuccagaguu

SEQ ID NO: 345718 - RNA, 22 nt, Homo sapiens
uggauauguucuuuguguaagg

SEQ ID NO: 345719 - RNA, 22 nt, Homo sapiens
uggaucaugcgaggccuccccu

SEQ ID NO: 345720 - RNA, 22 nt, Homo sapiens
uggcaaaaaaacgcaauuacgu

SEQ ID NO: 345721 - RNA, 22 nt, Homo sapiens
uggcaaaaaucacaaguaccuu

SEQ ID NO: 345722 - RNA, 22 nt, Homo sapiens
uggcaaaauauuuugguuucug

SEQ ID NO: 345723 - RNA, 22 nt, Homo sapiens
uggcaaagugugacgugggggu

SEQ ID NO: 345724 - RNA, 22 nt, Homo sapiens
uggcaagaccccaucucuacaa

SEQ ID NO: 345725 - RNA, 22 nt, Homo sapiens
uggcagcugcuucaugggaugc

SEQ ID NO: 345726 - RNA, 22 nt, Homo sapiens
uggcaggugcacuggcuuugaa

SEQ ID NO: 345727 - RNA, 22 nt, Homo sapiens
uggcaguuucacauggcucaac

SEQ ID NO: 345728 - RNA, 22 nt, Homo sapiens
uggcaugcauuguggguaauua

SEQ ID NO: 345729 - RNA, 22 nt, Homo sapiens
uggccaagagcacagauauugg

SEQ ID NO: 345730 - RNA, 22 nt, Homo sapiens
uggcgagaugcucgugugcaga

SEQ ID NO: 345731 - RNA, 20 nt, Homo sapiens
ugggaaauguccaggacaua

SEQ ID NO: 345732 - RNA, 22 nt, Homo sapiens
ugggaucagcugggcucucugu

SEQ ID NO: 345733 - RNA, 22 nt, Homo sapiens
ugggcaagagagcaugacccug

SEQ ID NO: 345734 - RNA, 22 nt, Homo sapiens
ugggguaggccugguuaugugc

SEQ ID NO: 345735 - RNA, 22 nt, Homo sapiens
ugggguaggcuguauacucugu

SEQ ID NO: 345736 - RNA, 22 nt, Homo sapiens
uggguaaaucuguuuggggcuc

SEQ ID NO: 345737 - RNA, 22 nt, Homo sapiens
uggguaguguaaagcacuccag

SEQ ID NO: 345738 - RNA, 22 nt, Homo sapiens
ugguaguuucuguaucucacag

SEQ ID NO: 345739 - RNA, 22 nt, Homo sapiens
uggucaaaugccaaucuguagu

SEQ ID NO: 345740 - RNA, 22 nt, Homo sapiens
uggucaccuucuugcucugucu

SEQ ID NO: 345741 - RNA, 21 nt, Homo sapiens
uggucccauaagauuacaaug

SEQ ID NO: 345742 - RNA, 22 nt, Homo sapiens
uggugagaaacuagauauuuuu

SEQ ID NO: 345743 - RNA, 22 nt, Homo sapiens
uguaaaucuauuuuuaguguuu

SEQ ID NO: 345744 - RNA, 22 nt, Homo sapiens
uguaagcauuauauaauuguug

SEQ ID NO: 345745 - RNA, 22 nt, Homo sapiens
uguaauuuaaaugauccuugga

SEQ ID NO: 345746 - RNA, 22 nt, Homo sapiens
uguacaaaacaagaugggggua

SEQ ID NO: 345747 - RNA, 20 nt, Homo sapiens
uguacacaguguacccacau

SEQ ID NO: 345748 - RNA, 22 nt, Homo sapiens
uguacccuuagagagugaucga

SEQ ID NO: 345749 - RNA, 22 nt, Homo sapiens
uguagacagcacguaguugagu

SEQ ID NO: 345750 - RNA, 21 nt, Homo sapiens
uguagcagcauaauuuauaau

SEQ ID NO: 345751 - RNA, 21 nt, Homo sapiens
uguagcagcaugauucauagu

SEQ ID NO: 345752 - RNA, 21 nt, Homo sapiens
uguagcagcaugauuuauaau

SEQ ID NO: 345753 - RNA, 22 nt, Homo sapiens
uguagcagccauaaacacagug

SEQ ID NO: 345754 - RNA, 22 nt, Homo sapiens
uguagcuuuugagauuuauauu

SEQ ID NO: 345755 - RNA, 22 nt, Homo sapiens
uguagggagagggaguugcacc

SEQ ID NO: 345756 - RNA, 22 nt, Homo sapiens
uguagucauuuggaguccagcu

SEQ ID NO: 345757 - RNA, 21 nt, Homo sapiens
uguauacauggaagaaugguc

SEQ ID NO: 345758 - RNA, 22 nt, Homo sapiens
uguauauguuuguacauauguc

SEQ ID NO: 345759 - RNA, 22 nt, Homo sapiens
uguauuuguuguuaaauggaga

SEQ ID NO: 345760 - RNA, 22 nt, Homo sapiens
ugucaaagagacaucugcacuc

SEQ ID NO: 345761 - RNA, 22 nt, Homo sapiens
ugucaaauucuggguuaaaaca

SEQ ID NO: 345762 - RNA, 22 nt, Homo sapiens
ugucaaggaaugucauugguuu

SEQ ID NO: 345763 - RNA, 21 nt, Homo sapiens
ugucaagugggaaaacaugua

SEQ ID NO: 345764 - RNA, 22 nt, Homo sapiens
ugucaauauguaauaacugaau

SEQ ID NO: 345765 - RNA, 22 nt, Homo sapiens
ugucaccuugcucauccucgga

SEQ ID NO: 345766 - RNA, 22 nt, Homo sapiens
ugucagaaucugagacgacaac

SEQ ID NO: 345767 - RNA, 22 nt, Homo sapiens
ugucaggaggguccagagaaaa

SEQ ID NO: 345768 - RNA, 22 nt, Homo sapiens
ugucaguggucuggaugcagcc

SEQ ID NO: 345769 - RNA, 22 nt, Homo sapiens
ugucauauagaauguucuauga

SEQ ID NO: 345770 - RNA, 19 nt, Homo sapiens
ugucaucaucuuuucuugc

SEQ ID NO: 345771 - RNA, 22 nt, Homo sapiens
ugucauguggcuaacgauucau

SEQ ID NO: 345772 - RNA, 22 nt, Homo sapiens
uguccaguguuccucagaagaa

SEQ ID NO: 345773 - RNA, 22 nt, Homo sapiens
ugucccaguuggguauugaauu

SEQ ID NO: 345774 - RNA, 22 nt, Homo sapiens
ugucccugagccuggauuccug

SEQ ID NO: 345775 - RNA, 22 nt, Homo sapiens
uguccugcagagguguuugccu

SEQ ID NO: 345776 - RNA, 22 nt, Homo sapiens
ugucucccuucccauuaggaag

SEQ ID NO: 345777 - RNA, 22 nt, Homo sapiens
ugucuguuugcgaaauugcuuc

SEQ ID NO: 345778 - RNA, 18 nt, Homo sapiens
aaaaagugcucaggccua

SEQ ID NO: 345779 - RNA, 22 nt, Homo sapiens
aaaacgcauccucacaggucug

SEQ ID NO: 345780 - RNA, 22 nt, Homo sapiens
aaaagcauucagagugcugggc

SEQ ID NO: 345781 - RNA, 22 nt, Homo sapiens
aaacagucuucuccugagggac

SEQ ID NO: 345782 - RNA, 22 nt, Homo sapiens
aaacgugcagagaucaauagca

SEQ ID NO: 345783 - RNA, 22 nt, Homo sapiens
aaacugaucugaaggccaggcu

SEQ ID NO: 345784 - RNA, 18 nt, Homo sapiens
aaacugcuuccuuggccu

SEQ ID NO: 345785 - RNA, 22 nt, Homo sapiens
aaacuugucuaauuauaagcau

SEQ ID NO: 345786 - RNA, 22 nt, Homo sapiens
aaagaagucagccuguccuuug

SEQ ID NO: 345787 - RNA, 23 nt, Homo sapiens
aaagacuagucaggugcaguggu

SEQ ID NO: 345788 - RNA, 22 nt, Homo sapiens
aaagcagcaggugguuuucaau

SEQ ID NO: 345789 - RNA, 22 nt, Homo sapiens
aaagcuacaggaccugcucauu

SEQ ID NO: 345790 - RNA, 22 nt, Homo sapiens
aaagggcuugaauacucuuuuu

SEQ ID NO: 345791 - RNA, 19 nt, Homo sapiens
aaaguacucugaugccucu

SEQ ID NO: 345792 - RNA, 17 nt, Homo sapiens
aaaguccuuugcuaucu

SEQ ID NO: 345793 - RNA, 22 nt, Homo sapiens
aaagucuagaggaucaugugug

SEQ ID NO: 345794 - RNA, 22 nt, Homo sapiens
aaagucuguuuugucagagacu

SEQ ID NO: 345795 - RNA, 22 nt, Homo sapiens
aaagugauugcgguuuuugcca

SEQ ID NO: 345796 - RNA, 22 nt, Homo sapiens
aaagugccugacucauaguuag

SEQ ID NO: 345797 - RNA, 22 nt, Homo sapiens
aaagugcugggaucacacugaa

SEQ ID NO: 345798 - RNA, 22 nt, Homo sapiens
aaagugcugggauuggccgggc

SEQ ID NO: 345799 - RNA, 22 nt, Homo sapiens
aaagugcugggauuggcugggc

SEQ ID NO: 345800 - RNA, 22 nt, Homo sapiens
aaagugcuuccuuuuugagggu

SEQ ID NO: 345801 - RNA, 22 nt, Homo sapiens
aaaguguguuuccaaccugugg

SEQ ID NO: 345802 - RNA, 22 nt, Homo sapiens
aaaguguuucugcaguagguuu

SEQ ID NO: 345803 - RNA, 22 nt, Homo sapiens
aaaugcacgcuacccagcuaga

SEQ ID NO: 345804 - RNA, 22 nt, Homo sapiens
aaaugcauugagggaaaaggca

SEQ ID NO: 345805 - RNA, 22 nt, Homo sapiens
aaaugcugucaaauuguguucu

SEQ ID NO: 345806 - RNA, 22 nt, Homo sapiens
aaaugcuguuccaggaccuauc

SEQ ID NO: 345807 - RNA, 22 nt, Homo sapiens
aaauugcacaaguggugauuug

SEQ ID NO: 345808 - RNA, 22 nt, Homo sapiens
aacaccuugcagggauuaugac

SEQ ID NO: 345809 - RNA, 22 nt, Homo sapiens
aacagacugucacauaaaauug

SEQ ID NO: 345810 - RNA, 22 nt, Homo sapiens
aacaggcuccuaggggugcacc

SEQ ID NO: 345811 - RNA, 22 nt, Homo sapiens
aacaggguggugccugguccau

SEQ ID NO: 345812 - RNA, 22 nt, Homo sapiens
aacaguaucuaacgagugauga

SEQ ID NO: 345813 - RNA, 22 nt, Homo sapiens
aacagugcauucagggauauau

SEQ ID NO: 345814 - RNA, 22 nt, Homo sapiens
aacagugcauuccuguccauau

SEQ ID NO: 345815 - RNA, 22 nt, Homo sapiens
aacagugcuguuauaaauguac

SEQ ID NO: 345816 - RNA, 21 nt, Homo sapiens
aacagugcuuaguagauguuc

SEQ ID NO: 345817 - RNA, 22 nt, Homo sapiens
aacaguguuuuggguuuucugg

SEQ ID NO: 345818 - RNA, 22 nt, Homo sapiens
aacauguuuagcagauaccugu

SEQ ID NO: 345819 - RNA, 22 nt, Homo sapiens
aaccacauggcucaguggacau

SEQ ID NO: 345820 - RNA, 22 nt, Homo sapiens
aacuaugucaaauaaaaugagg

SEQ ID NO: 345821 - RNA, 22 nt, Homo sapiens
aacuccauuuuagacccuagau

SEQ ID NO: 345822 - RNA, 22 nt, Homo sapiens
aacuggcauagccagacuucuc

SEQ ID NO: 345823 - RNA, 19 nt, Homo sapiens
aacuggugugagaugauau

SEQ ID NO: 345824 - RNA, 22 nt, Homo sapiens
aagaccuaugcaggaagaaaug

SEQ ID NO: 345825 - RNA, 22 nt, Homo sapiens
aagagcauuauuuaguaauuuc

SEQ ID NO: 345826 - RNA, 22 nt, Homo sapiens
aagaggcuguaggauaaugccu

SEQ ID NO: 345827 - RNA, 22 nt, Homo sapiens
aagagguagaagcuugccuucu

SEQ ID NO: 345828 - RNA, 22 nt, Homo sapiens
aagagguagcagucacaaaaga

SEQ ID NO: 345829 - RNA, 22 nt, Homo sapiens
aagaucaucauagagggcauga

SEQ ID NO: 345830 - RNA, 21 nt, Homo sapiens
aagcacauugaguguguguga

SEQ ID NO: 345831 - RNA, 22 nt, Homo sapiens
aagcaucauuuggaauuugaga

SEQ ID NO: 345832 - RNA, 23 nt, Homo sapiens
aagcaugcacagcuguuuguggu

SEQ ID NO: 345833 - RNA, 22 nt, Homo sapiens
aagccacuguaccugucucuua

SEQ ID NO: 345834 - RNA, 22 nt, Homo sapiens
aagcuggauuuaguguggagca

SEQ ID NO: 345835 - RNA, 22 nt, Homo sapiens
aagcuggcauucauucguucuu

SEQ ID NO: 345836 - RNA, 22 nt, Homo sapiens
aagcuguauuguguugcuauaa

SEQ ID NO: 345837 - RNA, 22 nt, Homo sapiens
aaggaagcuagcaggaauuggu

SEQ ID NO: 345838 - RNA, 22 nt, Homo sapiens
aaggagcagagagcccuguuuc

SEQ ID NO: 345839 - RNA, 22 nt, Homo sapiens
aaggcaagaagagaaccaucgg

SEQ ID NO: 345840 - RNA, 22 nt, Homo sapiens
aaggcaagagaaaauuucgagu

SEQ ID NO: 345841 - RNA, 22 nt, Homo sapiens
aaggcaagguggauaaugaagc

SEQ ID NO: 345842 - RNA, 22 nt, Homo sapiens
aaggcagugugcacauaacacu

SEQ ID NO: 345843 - RNA, 22 nt, Homo sapiens
aaggcauggugacuauuuaggc

SEQ ID NO: 345844 - RNA, 22 nt, Homo sapiens
aaggcuuuuugcugacguccuu

SEQ ID NO: 345845 - RNA, 22 nt, Homo sapiens
aagguaguuagaaaauauaacu

SEQ ID NO: 345846 - RNA, 22 nt, Homo sapiens
aaggucauugugguuuuugcca

SEQ ID NO: 345847 - RNA, 22 nt, Homo sapiens
aaggugcucucuuauguagaaa

SEQ ID NO: 345848 - RNA, 22 nt, Homo sapiens
aagguggaguugacaauuuuca

SEQ ID NO: 345849 - RNA, 22 nt, Homo sapiens
aagguggugucagagagcuuau

SEQ ID NO: 345850 - RNA, 22 nt, Homo sapiens
aaguacuguuuaaauugcagaa

SEQ ID NO: 345851 - RNA, 23 nt, Homo sapiens
aagucauggaaucaaaugaggug

SEQ ID NO: 345852 - RNA, 22 nt, Homo sapiens
aaguccaugaagucuugugggu

SEQ ID NO: 345853 - RNA, 22 nt, Homo sapiens
aagugaaugugcuggaauagcu

SEQ ID NO: 345854 - RNA, 22 nt, Homo sapiens
aagugcugggauuggccgggca

SEQ ID NO: 345855 - RNA, 22 nt, Homo sapiens
aagugcuuccuuucagaggguu

SEQ ID NO: 345856 - RNA, 22 nt, Homo sapiens
aagugcuucuuuccucgagaag

SEQ ID NO: 345857 - RNA, 22 nt, Homo sapiens
aagugcuuuguacagggguuga

SEQ ID NO: 345858 - RNA, 22 nt, Homo sapiens
aagugcuuuuuagauaugguuu

SEQ ID NO: 345859 - RNA, 19 nt, Homo sapiens
aagugguuuaaacuuguau

SEQ ID NO: 345860 - RNA, 22 nt, Homo sapiens
aagugguuuuaaucuggugagu

SEQ ID NO: 345861 - RNA, 23 nt, Homo sapiens
aaguucaugcucaucuguuacac

SEQ ID NO: 345862 - RNA, 22 nt, Homo sapiens
aauaaaguaggaggugaggaaa

SEQ ID NO: 345863 - RNA, 22 nt, Homo sapiens
aauaaagucugaagugugcuua

SEQ ID NO: 345864 - RNA, 22 nt, Homo sapiens
aauacucuauaagggaagcugu

SEQ ID NO: 345865 - RNA, 22 nt, Homo sapiens
aauagcauugaaucuaccaauu

SEQ ID NO: 345866 - RNA, 22 nt, Homo sapiens
aauaucuguguauagauggggg

SEQ ID NO: 345867 - RNA, 22 nt, Homo sapiens
aaucacaggucuuggcugcaug

SEQ ID NO: 345868 - RNA, 22 nt, Homo sapiens
aaucacaguguucuugugaggg

SEQ ID NO: 345869 - RNA, 21 nt, Homo sapiens
aaucacaguuguucugccuuc

SEQ ID NO: 345870 - RNA, 22 nt, Homo sapiens
aaucagagcccucugagcuuca

SEQ ID NO: 345871 - RNA, 17 nt, Homo sapiens
aaucagauuucugagga

SEQ ID NO: 345872 - RNA, 22 nt, Homo sapiens
aaucagcacacugugcuuucca

SEQ ID NO: 345873 - RNA, 22 nt, Homo sapiens
aaucauggaguauuuguccuug

SEQ ID NO: 345874 - RNA, 22 nt, Homo sapiens
aaucgcuuuugguaggcaagga

SEQ ID NO: 345875 - RNA, 22 nt, Homo sapiens
aaucucagcauuuugggcugag

SEQ ID NO: 345876 - RNA, 22 nt, Homo sapiens
aaucugauguuaucagcuuaag

SEQ ID NO: 345877 - RNA, 22 nt, Homo sapiens
aaugacagccagauucuucucu

SEQ ID NO: 345878 - RNA, 22 nt, Homo sapiens
aaugacucugccuaaauuucac

SEQ ID NO: 345879 - RNA, 17 nt, Homo sapiens
aaugagacauuucugcu

SEQ ID NO: 345880 - RNA, 22 nt, Homo sapiens
aaugcacauaaaauccuccagg

SEQ ID NO: 345881 - RNA, 22 nt, Homo sapiens
aaugcacuccagccugggcgac

SEQ ID NO: 345882 - RNA, 22 nt, Homo sapiens
aauggcucugauguuguuguga

SEQ ID NO: 345883 - RNA, 22 nt, Homo sapiens
aauggcucuguuggcccaagac

SEQ ID NO: 345884 - RNA, 22 nt, Homo sapiens
aauggguaguacugugguaaca

SEQ ID NO: 345885 - RNA, 22 nt, Homo sapiens
aaugucaugaguccaaccagaa

SEQ ID NO: 345886 - RNA, 22 nt, Homo sapiens
aaugugcuguucagaggagucc

SEQ ID NO: 345887 - RNA, 22 nt, Homo sapiens
aauuacucgugucuuuacugcu

SEQ ID NO: 345888 - RNA, 22 nt, Homo sapiens
aauuaggcuagaauguuauuaa

SEQ ID NO: 345889 - RNA, 22 nt, Homo sapiens
aauuaguaaccuaauuccaucu

SEQ ID NO: 345890 - RNA, 22 nt, Homo sapiens
aauuaguugaaagucugcuuuu

SEQ ID NO: 345891 - RNA, 22 nt, Homo sapiens
aauuaguuggcugccuaugauu

SEQ ID NO: 345892 - RNA, 22 nt, Homo sapiens
aauuaguugucgugagaguggu

SEQ ID NO: 345893 - RNA, 22 nt, Homo sapiens
aauucugugagauggugcagau

SEQ ID NO: 345894 - RNA, 22 nt, Homo sapiens
aauugaaugcagaugccaggga

SEQ ID NO: 345895 - RNA, 22 nt, Homo sapiens
aauugccucaagugaucauggc

SEQ ID NO: 345896 - RNA, 22 nt, Homo sapiens
acaaagcgcuucucuuuagagu

SEQ ID NO: 345897 - RNA, 21 nt, Homo sapiens
acaaagcuggagggagacugc

SEQ ID NO: 345898 - RNA, 22 nt, Homo sapiens
acaaagugccuccuuuuagagu

SEQ ID NO: 345899 - RNA, 20 nt, Homo sapiens
acaaaugcauucugugacau

SEQ ID NO: 345900 - RNA, 22 nt, Homo sapiens
acaagacuucuuguauucuagu

SEQ ID NO: 345901 - RNA, 22 nt, Homo sapiens
acacaaugguaaguguuugugu

SEQ ID NO: 345902 - RNA, 22 nt, Homo sapiens
acacacgugcauguaugcguau

SEQ ID NO: 345903 - RNA, 22 nt, Homo sapiens
acacaguauaugacaaugcuuu

SEQ ID NO: 345904 - RNA, 22 nt, Homo sapiens
acacauacacauaugguguaua

SEQ ID NO: 345905 - RNA, 22 nt, Homo sapiens
acacaugugaaaaaaauguuac

SEQ ID NO: 345906 - RNA, 22 nt, Homo sapiens
acacauuagcaagugcuguuau

SEQ ID NO: 345907 - RNA, 22 nt, Homo sapiens
acaccaguacuuuauacaagca

SEQ ID NO: 345908 - RNA, 22 nt, Homo sapiens
acaccaugucuguuucugguuu

SEQ ID NO: 345909 - RNA, 22 nt, Homo sapiens
acaccuguggucccaguaacuu

SEQ ID NO: 345910 - RNA, 22 nt, Homo sapiens
acacugcugaguaaauaauuuu

SEQ ID NO: 345911 - RNA, 22 nt, Homo sapiens
acacuggaggagagcuguugcu

SEQ ID NO: 345912 - RNA, 22 nt, Homo sapiens
acacuguagcugagggcaugcg

SEQ ID NO: 345913 - RNA, 22 nt, Homo sapiens
acacugucaugucucacaggca

SEQ ID NO: 345914 - RNA, 22 nt, Homo sapiens
acacuguuuuaguuauuauagc

SEQ ID NO: 345915 - RNA, 23 nt, Homo sapiens
acacuugcugaguaaaucaaaua

SEQ ID NO: 345916 - RNA, 22 nt, Homo sapiens
acagcacugccaagugacccau

SEQ ID NO: 345917 - RNA, 22 nt, Homo sapiens
acaguagugggcuacagaauca

SEQ ID NO: 345918 - RNA, 22 nt, Homo sapiens
acagucauagcagccuuuguua

SEQ ID NO: 345919 - RNA, 22 nt, Homo sapiens
acagugcuuggcacacaguaau

SEQ ID NO: 345920 - RNA, 19 nt, Homo sapiens
acagugcuuugucagaagc

SEQ ID NO: 345921 - RNA, 22 nt, Homo sapiens
acaguggugcgaucucggcuca

SEQ ID NO: 345922 - RNA, 22 nt, Homo sapiens
acaguguguguguucaccuaga

SEQ ID NO: 345923 - RNA, 22 nt, Homo sapiens
acauacacuagggauguggugu

SEQ ID NO: 345924 - RNA, 22 nt, Homo sapiens
acauauaaggagacuagggcau

SEQ ID NO: 345925 - RNA, 22 nt, Homo sapiens
acaucccuugcucggggccccu

SEQ ID NO: 345926 - RNA, 17 nt, Homo sapiens
accagugcaugugcuuu

SEQ ID NO: 345927 - RNA, 22 nt, Homo sapiens
accauugcacuccagccuuggc

SEQ ID NO: 345928 - RNA, 22 nt, Homo sapiens
acccagaagucauucaggaaca

SEQ ID NO: 345929 - RNA, 22 nt, Homo sapiens
acccauacacacauauuuaugu

SEQ ID NO: 345930 - RNA, 22 nt, Homo sapiens
acccgggaggcaggagucauag

SEQ ID NO: 345931 - RNA, 22 nt, Homo sapiens
acccugucaaaauggaccaauc

SEQ ID NO: 345932 - RNA, 22 nt, Homo sapiens
acccugugagagaguuaauauu

SEQ ID NO: 345933 - RNA, 18 nt, Homo sapiens
acccuucagcacugggcc

SEQ ID NO: 345934 - RNA, 22 nt, Homo sapiens
acccuuugucaaucaguacuaa

SEQ ID NO: 345935 - RNA, 22 nt, Homo sapiens
accgggcugagcgcaggccccg

SEQ ID NO: 345936 - RNA, 22 nt, Homo sapiens
accugagacuaggcauuuuaua

SEQ ID NO: 345937 - RNA, 22 nt, Homo sapiens
accugcacagccgaacauagac

SEQ ID NO: 345938 - RNA, 19 nt, Homo sapiens
accuguagaaaguacaaca

SEQ ID NO: 345939 - RNA, 22 nt, Homo sapiens
accuuguaucuguuaggauugc

SEQ ID NO: 345940 - RNA, 19 nt, Homo sapiens
acuaggccuacaaagcuau

SEQ ID NO: 345941 - RNA, 22 nt, Homo sapiens
acugagaucuuuaaauaaauaa

SEQ ID NO: 345942 - RNA, 23 nt, Homo sapiens
acugagcaauguuuacauacuug

SEQ ID NO: 345943 - RNA, 18 nt, Homo sapiens
acugcacuccaccuuggg

SEQ ID NO: 345944 - RNA, 22 nt, Homo sapiens
acugcacuccagccuaggcgac

SEQ ID NO: 345945 - RNA, 22 nt, Homo sapiens
acugcacuccagccuccugggu

SEQ ID NO: 345946 - RNA, 22 nt, Homo sapiens
acugcacuccagccucgugaca

SEQ ID NO: 345947 - RNA, 22 nt, Homo sapiens
acugcacuccagccugagccug

SEQ ID NO: 345948 - RNA, 22 nt, Homo sapiens
acugcacuccagccuggcggac

SEQ ID NO: 345949 - RNA, 22 nt, Homo sapiens
acugcacuccagccuucaggac

SEQ ID NO: 345950 - RNA, 22 nt, Homo sapiens
acugcacuccagccuucgugac

SEQ ID NO: 345951 - RNA, 22 nt, Homo sapiens
acugcacuccagccuuggagac

SEQ ID NO: 345952 - RNA, 22 nt, Homo sapiens
acugcacuccagccuuggcggc

SEQ ID NO: 345953 - RNA, 22 nt, Homo sapiens
acugcacuccagcuccagggug

SEQ ID NO: 345954 - RNA, 22 nt, Homo sapiens
acugcacuccaguuugggcagc

SEQ ID NO: 345955 - RNA, 20 nt, Homo sapiens
acugcacuucagccugcugg

SEQ ID NO: 345956 - RNA, 22 nt, Homo sapiens
acugcacuucagccuugggaaa

SEQ ID NO: 345957 - RNA, 22 nt, Homo sapiens
acuggaguuuguucaagaaaua

SEQ ID NO: 345958 - RNA, 22 nt, Homo sapiens
acuggcauagggcgggcacagu

SEQ ID NO: 345959 - RNA, 22 nt, Homo sapiens
acuggcuuuugagaaaaacacu

SEQ ID NO: 345960 - RNA, 22 nt, Homo sapiens
acuuauuguggcugacccaaac

SEQ ID NO: 345961 - RNA, 21 nt, Homo sapiens
acuuucuguggcaguccauuc

SEQ ID NO: 345962 - RNA, 19 nt, Homo sapiens
acuuuggugauuagaggga

SEQ ID NO: 345963 - RNA, 22 nt, Homo sapiens
agaaagugcuucccuuugguga

SEQ ID NO: 345964 - RNA, 22 nt, Homo sapiens
agaauguauauucuguaguugu

SEQ ID NO: 345965 - RNA, 22 nt, Homo sapiens
agaauucugucauguuuauauu

SEQ ID NO: 345966 - RNA, 22 nt, Homo sapiens
agacacuguugaaaaggcccca

SEQ ID NO: 345967 - RNA, 22 nt, Homo sapiens
agacagcuggaguaucauagcu

SEQ ID NO: 345968 - RNA, 22 nt, Homo sapiens
agacaucauuugauggugggag

SEQ ID NO: 345969 - RNA, 22 nt, Homo sapiens
agacucauuuuuaucgagcaug

SEQ ID NO: 345970 - RNA, 22 nt, Homo sapiens
agagacauugcuccaacucacc

SEQ ID NO: 345971 - RNA, 22 nt, Homo sapiens
agagaccuguaaaguucaggca

SEQ ID NO: 345972 - RNA, 19 nt, Homo sapiens
agagacucauuguagcauu

SEQ ID NO: 345973 - RNA, 22 nt, Homo sapiens
agagagcuuuugguugcccuaa

SEQ ID NO: 345974 - RNA, 22 nt, Homo sapiens
agagauaauuagguuaaaugag

SEQ ID NO: 345975 - RNA, 22 nt, Homo sapiens
agagaucaacugaauuacugga

SEQ ID NO: 345976 - RNA, 22 nt, Homo sapiens
agagaucacugaaucacggggg

SEQ ID NO: 345977 - RNA, 20 nt, Homo sapiens
agagaucaguaauucaucaa

SEQ ID NO: 345978 - RNA, 22 nt, Homo sapiens
agagaugauuaacauuuuggua

SEQ ID NO: 345979 - RNA, 22 nt, Homo sapiens
agagcaaugacaugcuaugugg

SEQ ID NO: 345980 - RNA, 22 nt, Homo sapiens
agagcaccauuuagcaagguga

SEQ ID NO: 345981 - RNA, 22 nt, Homo sapiens
agagcacugcugcaggguucug

SEQ ID NO: 345982 - RNA, 22 nt, Homo sapiens
agagguauuggaaggaguguca

SEQ ID NO: 345983 - RNA, 22 nt, Homo sapiens
agagguguuaaagucucuuuua

SEQ ID NO: 345984 - RNA, 22 nt, Homo sapiens
agauauuuguuaggucugucag

SEQ ID NO: 345985 - RNA, 22 nt, Homo sapiens
agaucacaguaccguaaggcug

SEQ ID NO: 345986 - RNA, 22 nt, Homo sapiens
agaugccuaugaagagaaauua

SEQ ID NO: 345987 - RNA, 22 nt, Homo sapiens
agaugguguuuucucaccagau

SEQ ID NO: 345988 - RNA, 22 nt, Homo sapiens
agauguuguucaucugauuguu

SEQ ID NO: 345989 - RNA, 22 nt, Homo sapiens
agcaaaucuaugaauguauauu

SEQ ID NO: 345990 - RNA, 22 nt, Homo sapiens
agcaacauuuuugaccuuucuu

SEQ ID NO: 345991 - RNA, 22 nt, Homo sapiens
agcacauuaguaucuaagaaca

SEQ ID NO: 345992 - RNA, 22 nt, Homo sapiens
agcagagcauauucauucgggg

SEQ ID NO: 345993 - RNA, 22 nt, Homo sapiens
agcagcaauuuuguaugguuua

SEQ ID NO: 345994 - RNA, 22 nt, Homo sapiens
agcagcaucgggaaguuggcca

SEQ ID NO: 345995 - RNA, 22 nt, Homo sapiens
agcagguguccacaauguuugc

SEQ ID NO: 345996 - RNA, 22 nt, Homo sapiens
agcagugugaaaauggacuaau

SEQ ID NO: 345997 - RNA, 22 nt, Homo sapiens
agcagugugaaaugauuuaagg

SEQ ID NO: 345998 - RNA, 22 nt, Homo sapiens
agcaguguggccuuagacccgg

SEQ ID NO: 345999 - RNA, 22 nt, Homo sapiens
agcaucacacacuacagggaaa

SEQ ID NO: 346000 - RNA, 22 nt, Homo sapiens
agccaagacucuguuccccuug

SEQ ID NO: 346001 - RNA, 22 nt, Homo sapiens
agcccagagacuguguaaauuu

SEQ ID NO: 346002 - RNA, 22 nt, Homo sapiens
agcccauguggcugaggcuucu

SEQ ID NO: 346003 - RNA, 23 nt, Homo sapiens
agcccugugacucgaacgaggag

SEQ ID NO: 346004 - RNA, 23 nt, Homo sapiens
agccugguuucccugcuucuccc

SEQ ID NO: 346005 - RNA, 22 nt, Homo sapiens
agcgccacugcacuccagccug

SEQ ID NO: 346006 - RNA, 21 nt, Homo sapiens
agcuccacucguucccaaagc

SEQ ID NO: 346007 - RNA, 22 nt, Homo sapiens
agcuccaucuucagggguucag

SEQ ID NO: 346008 - RNA, 20 nt, Homo sapiens
agcuccauuccugaaggcug

SEQ ID NO: 346009 - RNA, 22 nt, Homo sapiens
agcuccuuugcuuuuuccagga

SEQ ID NO: 346010 - RNA, 22 nt, Homo sapiens
agcucuuguuaguauuagcagu

SEQ ID NO: 346011 - RNA, 17 nt, Homo sapiens
agcuggaauuacgggag

SEQ ID NO: 346012 - RNA, 22 nt, Homo sapiens
agcuggcuguggagaaaccccu

SEQ ID NO: 346013 - RNA, 22 nt, Homo sapiens
agcuggucucaggugcccugcu

SEQ ID NO: 346014 - RNA, 22 nt, Homo sapiens
agcuguaguuuauucauguuaa

SEQ ID NO: 346015 - RNA, 19 nt, Homo sapiens
agcuguguugccugugaga

SEQ ID NO: 346016 - RNA, 20 nt, Homo sapiens
agcuugguuuggaugaucac

SEQ ID NO: 346017 - RNA, 22 nt, Homo sapiens
agcuuguguuuuucuaaguauc

SEQ ID NO: 346018 - RNA, 22 nt, Homo sapiens
aggaagacauauagaacuaaaa

SEQ ID NO: 346019 - RNA, 23 nt, Homo sapiens
aggaauggaaaaccaaguaucau

SEQ ID NO: 346020 - RNA, 18 nt, Homo sapiens
aggaaugguaauacuuca

SEQ ID NO: 346021 - RNA, 22 nt, Homo sapiens
aggacacugagcaugggagguu

SEQ ID NO: 346022 - RNA, 22 nt, Homo sapiens
aggacacugauguaugcugugg

SEQ ID NO: 346023 - RNA, 22 nt, Homo sapiens
aggagaucagccucccugcaac

SEQ ID NO: 346024 - RNA, 22 nt, Homo sapiens
aggagcacuggccuuggaguca

SEQ ID NO: 346025 - RNA, 22 nt, Homo sapiens
aggaggauugcuuucaucuuuu

SEQ ID NO: 346026 - RNA, 22 nt, Homo sapiens
aggcaagagugacuacgugaaa

SEQ ID NO: 346027 - RNA, 22 nt, Homo sapiens
aggcaagugggagacagcauuu

SEQ ID NO: 346028 - RNA, 22 nt, Homo sapiens
aggcaaugugagaguuuauuca

SEQ ID NO: 346029 - RNA, 22 nt, Homo sapiens
aggcacacaacccuggaccuga

SEQ ID NO: 346030 - RNA, 22 nt, Homo sapiens
aggcaugaaauacaugcauuga

SEQ ID NO: 346031 - RNA, 22 nt, Homo sapiens
aggcaugaguucagaggguaug

SEQ ID NO: 346032 - RNA, 22 nt, Homo sapiens
aggcaugauggcuccagaucau

SEQ ID NO: 346033 - RNA, 23 nt, Homo sapiens
aggccaguuuuuccugcuugcug

SEQ ID NO: 346034 - RNA, 22 nt, Homo sapiens
aggcuagacuuugagaauuuuu

SEQ ID NO: 346035 - RNA, 22 nt, Homo sapiens
agggaagugugcuaugcauuua

SEQ ID NO: 346036 - RNA, 22 nt, Homo sapiens
agggcaagacuuguuaagaaca

SEQ ID NO: 346037 - RNA, 22 nt, Homo sapiens
agggccuuuguagauguacuca

SEQ ID NO: 346038 - RNA, 22 nt, Homo sapiens
agggcuuguuuaacuaucauua

SEQ ID NO: 346039 - RNA, 22 nt, Homo sapiens
agguaagaugugacuugguguu

SEQ ID NO: 346040 - RNA, 22 nt, Homo sapiens
agguaauuuucccagagggaaa

SEQ ID NO: 346041 - RNA, 22 nt, Homo sapiens
agguauuuucaacuuagaaugg

SEQ ID NO: 346042 - RNA, 21 nt, Homo sapiens
aggucaugaagauguucuaau

SEQ ID NO: 346043 - RNA, 22 nt, Homo sapiens
agguccauuauuuucauucaug

SEQ ID NO: 346044 - RNA, 22 nt, Homo sapiens
aggugaaugcucacauucuaau

SEQ ID NO: 346045 - RNA, 22 nt, Homo sapiens
aggugcugacaggauagguuuc

SEQ ID NO: 346046 - RNA, 22 nt, Homo sapiens
agguucccuuuuggccugggau

SEQ ID NO: 346047 - RNA, 22 nt, Homo sapiens
aguacacuguuaaaaagaagug

SEQ ID NO: 346048 - RNA, 22 nt, Homo sapiens
aguaccacgugaugccauuuuc

SEQ ID NO: 346049 - RNA, 23 nt, Homo sapiens
aguacuguaguaauugaggggaa

SEQ ID NO: 346050 - RNA, 17 nt, Homo sapiens
aguacugucccauccuu

SEQ ID NO: 346051 - RNA, 16 nt, Homo sapiens
aguaguuuuacagauu

SEQ ID NO: 346052 - RNA, 22 nt, Homo sapiens
agucacaugccagcacacccag

SEQ ID NO: 346053 - RNA, 17 nt, Homo sapiens
agucaguaguuuguauu

SEQ ID NO: 346054 - RNA, 22 nt, Homo sapiens
agucaguggaguaaauguaauu

SEQ ID NO: 346055 - RNA, 22 nt, Homo sapiens
agucaguguguauugauggcac

SEQ ID NO: 346056 - RNA, 22 nt, Homo sapiens
agucauggcagaaggcaccucu

SEQ ID NO: 346057 - RNA, 22 nt, Homo sapiens
aguccauuugaugaugauucca

SEQ ID NO: 346058 - RNA, 22 nt, Homo sapiens
agucugguguucucacacuagu

SEQ ID NO: 346059 - RNA, 22 nt, Homo sapiens
agugcaguggcauggucauaac

SEQ ID NO: 346060 - RNA, 22 nt, Homo sapiens
cucaguuuugccuuguuuaagg

SEQ ID NO: 346061 - RNA, 22 nt, Homo sapiens
cucauggaauacuucacagcca

SEQ ID NO: 346062 - RNA, 22 nt, Homo sapiens
cucauggagauagagaauagaa

SEQ ID NO: 346063 - RNA, 22 nt, Homo sapiens
cucauugcaaucuccaccuccc

SEQ ID NO: 346064 - RNA, 22 nt, Homo sapiens
cucauugcaaucucugccuccc

SEQ ID NO: 346065 - RNA, 22 nt, Homo sapiens
cuccacugagcaggugggaggc

SEQ ID NO: 346066 - RNA, 22 nt, Homo sapiens
cuccaggugucauccaccuccu

SEQ ID NO: 346067 - RNA, 22 nt, Homo sapiens
cuccagugcaaagucaugauca

SEQ ID NO: 346068 - RNA, 22 nt, Homo sapiens
cucgagagaaaaugcuucacug

SEQ ID NO: 346069 - RNA, 22 nt, Homo sapiens
cucugguggaagcagggggcaa

SEQ ID NO: 346070 - RNA, 15 nt, Homo sapiens
cucugguuuuucuuc

SEQ ID NO: 346071 - RNA, 22 nt, Homo sapiens
cucugguuuuucuuccauuaag

SEQ ID NO: 346072 - RNA, 22 nt, Homo sapiens
cucuuugaguuccuccuggugu

SEQ ID NO: 346073 - RNA, 22 nt, Homo sapiens
cucuuugaugugaaccgugguu

SEQ ID NO: 346074 - RNA, 22 nt, Homo sapiens
cugaauagagcacacugauggg

SEQ ID NO: 346075 - RNA, 22 nt, Homo sapiens
cugaauguucuggauggaagag

SEQ ID NO: 346076 - RNA, 22 nt, Homo sapiens
cugacagucucauugauuugcu

SEQ ID NO: 346077 - RNA, 22 nt, Homo sapiens
cugacuuuagaacccaaaaagu

SEQ ID NO: 346078 - RNA, 22 nt, Homo sapiens
cugagacacucuuaucugcaua

SEQ ID NO: 346079 - RNA, 22 nt, Homo sapiens
cugagauggagucucgcauugu

SEQ ID NO: 346080 - RNA, 22 nt, Homo sapiens
cugagcaaaaugaagacacgau

SEQ ID NO: 346081 - RNA, 22 nt, Homo sapiens
cugagcaaagaagugauaauga

SEQ ID NO: 346082 - RNA, 18 nt, Homo sapiens
cugagcacugcuuuauga

SEQ ID NO: 346083 - RNA, 22 nt, Homo sapiens
cugagcuagaccacuuggcucc

SEQ ID NO: 346084 - RNA, 22 nt, Homo sapiens
cugagcuaguagcauuguguca

SEQ ID NO: 346085 - RNA, 22 nt, Homo sapiens
cugagcuaugccuggaaaggca

SEQ ID NO: 346086 - RNA, 22 nt, Homo sapiens
cugaggaaguucuuuaacaguu

SEQ ID NO: 346087 - RNA, 22 nt, Homo sapiens
cugagguaggugaucagugcuu

SEQ ID NO: 346088 - RNA, 22 nt, Homo sapiens
cugaggugggagaaucacauaa

SEQ ID NO: 346089 - RNA, 18 nt, Homo sapiens
cugagucauuccuggguc

SEQ ID NO: 346090 - RNA, 20 nt, Homo sapiens
cugauacagccugagcucuc

SEQ ID NO: 346091 - RNA, 22 nt, Homo sapiens
cugauugucuauuuaguucacu

SEQ ID NO: 346092 - RNA, 22 nt, Homo sapiens
cugauuuguccccagccucaug

SEQ ID NO: 346093 - RNA, 22 nt, Homo sapiens
cugccuaaagaaaaagacguug

SEQ ID NO: 346094 - RNA, 22 nt, Homo sapiens
cugccuagaucugaaccuggcu

SEQ ID NO: 346095 - RNA, 20 nt, Homo sapiens
cugcuccccuacaaaucuca

SEQ ID NO: 346096 - RNA, 22 nt, Homo sapiens
cuggaaacaucuuaggaaugca

SEQ ID NO: 346097 - RNA, 22 nt, Homo sapiens
cuggaaagaaacccuuaauucu

SEQ ID NO: 346098 - RNA, 18 nt, Homo sapiens
cuggaaggcuacuacagu

SEQ ID NO: 346099 - RNA, 22 nt, Homo sapiens
cuggaauuacaggguugagcua

SEQ ID NO: 346100 - RNA, 22 nt, Homo sapiens
cuggacaaaucuggaaagaacc

SEQ ID NO: 346101 - RNA, 22 nt, Homo sapiens
cuggagaucuugacauugaagu

SEQ ID NO: 346102 - RNA, 22 nt, Homo sapiens
cuggaggccugaacauaaaugg

SEQ ID NO: 346103 - RNA, 22 nt, Homo sapiens
cuggcaaauguuuucuguaaag

SEQ ID NO: 346104 - RNA, 22 nt, Homo sapiens
cuggcaagagugaaccagcugu

SEQ ID NO: 346105 - RNA, 22 nt, Homo sapiens
cugguaagaaggucuaagucaa

SEQ ID NO: 346106 - RNA, 22 nt, Homo sapiens
cuggugauugguuucauucagu

SEQ ID NO: 346107 - RNA, 22 nt, Homo sapiens
cuguagacauuaggccugcacu

SEQ ID NO: 346108 - RNA, 22 nt, Homo sapiens
cuguaguuagcagaugaugaau

SEQ ID NO: 346109 - RNA, 22 nt, Homo sapiens
cugucuagagggcacaugaugc

SEQ ID NO: 346110 - RNA, 22 nt, Homo sapiens
cugucuguuucaaaagugguua

SEQ ID NO: 346111 - RNA, 22 nt, Homo sapiens
cugugaagaaagucauugguag

SEQ ID NO: 346112 - RNA, 22 nt, Homo sapiens
cugugcacaucuggcggcccga

SEQ ID NO: 346113 - RNA, 22 nt, Homo sapiens
cugugcauucuuaaaucaggaa

SEQ ID NO: 346114 - RNA, 19 nt, Homo sapiens
cugugcauuucuguggaag

SEQ ID NO: 346115 - RNA, 22 nt, Homo sapiens
cuguggguuuuacuguuuuacu

SEQ ID NO: 346116 - RNA, 22 nt, Homo sapiens
cuguguaguacuagauugagca

SEQ ID NO: 346117 - RNA, 22 nt, Homo sapiens
cuguuugaggguuugcuuucag

SEQ ID NO: 346118 - RNA, 18 nt, Homo sapiens
cuuaacauugggaugaua

SEQ ID NO: 346119 - RNA, 22 nt, Homo sapiens
cuucaaguaauucugauggcua

SEQ ID NO: 346120 - RNA, 22 nt, Homo sapiens
cuucaccaguuuggcagucuca

SEQ ID NO: 346121 - RNA, 22 nt, Homo sapiens
cuuccaaguggggcacgugcca

SEQ ID NO: 346122 - RNA, 22 nt, Homo sapiens
cuuccagcuggguucagucagu

SEQ ID NO: 346123 - RNA, 22 nt, Homo sapiens
cuucucagugcucaucuuauuu

SEQ ID NO: 346124 - RNA, 22 nt, Homo sapiens
cuucuugagggccugcugggaa

SEQ ID NO: 346125 - RNA, 22 nt, Homo sapiens
cuugacaucugucaguuccuca

SEQ ID NO: 346126 - RNA, 22 nt, Homo sapiens
cuugcacucagaagauucaguu

SEQ ID NO: 346127 - RNA, 22 nt, Homo sapiens
cuuggauuauaauggaauauuu

SEQ ID NO: 346128 - RNA, 22 nt, Homo sapiens
cuuggcauugccccuggaauuu

SEQ ID NO: 346129 - RNA, 22 nt, Homo sapiens
cuugggauauguguuacucugu

SEQ ID NO: 346130 - RNA, 18 nt, Homo sapiens
cuugucaaaucuuuccuc

SEQ ID NO: 346131 - RNA, 22 nt, Homo sapiens
cuugugcaugaccccagguggg

SEQ ID NO: 346132 - RNA, 22 nt, Homo sapiens
cuuguuguggaggggagugcag

SEQ ID NO: 346133 - RNA, 17 nt, Homo sapiens
cuuguugugguaguuug

SEQ ID NO: 346134 - RNA, 22 nt, Homo sapiens
cuuuaugagguuggauggaucu

SEQ ID NO: 346135 - RNA, 22 nt, Homo sapiens
cuuucacacuguuggugggaau

SEQ ID NO: 346136 - RNA, 22 nt, Homo sapiens
guggaucacuugaggucaagag

SEQ ID NO: 346137 - RNA, 22 nt, Homo sapiens
guggcaugaaagcagauaccac

SEQ ID NO: 346138 - RNA, 22 nt, Homo sapiens
guggcauuucccaaaguauucu

SEQ ID NO: 346139 - RNA, 21 nt, Homo sapiens
guggccuuuggagcaugucag

SEQ ID NO: 346140 - RNA, 22 nt, Homo sapiens
guggcuuuauuuagaagcaggg

SEQ ID NO: 346141 - RNA, 22 nt, Homo sapiens
gugggaagcuggaacucccucc

SEQ ID NO: 346142 - RNA, 22 nt, Homo sapiens
gugggguaggugacuugaugag

SEQ ID NO: 346143 - RNA, 22 nt, Homo sapiens
gugguguuugagcugccaggga

SEQ ID NO: 346144 - RNA, 22 nt, Homo sapiens
gugguuuuuagauuucuacagu

SEQ ID NO: 346145 - RNA, 22 nt, Homo sapiens
guguagagaaauagccugaagg

SEQ ID NO: 346146 - RNA, 21 nt, Homo sapiens
gugucacagacaugacagaug

SEQ ID NO: 346147 - RNA, 22 nt, Homo sapiens
gugucaguggggagugaucuuc

SEQ ID NO: 346148 - RNA, 22 nt, Homo sapiens
gugucucagcccagaccuauuu

SEQ ID NO: 346149 - RNA, 22 nt, Homo sapiens
gugugacagcuauagacaugau

SEQ ID NO: 346150 - RNA, 22 nt, Homo sapiens
gugugauguaaagaacugggga

SEQ ID NO: 346151 - RNA, 22 nt, Homo sapiens
gugugcaaauguguaccuacau

SEQ ID NO: 346152 - RNA, 22 nt, Homo sapiens
gugugcaauuuugugggaggca

SEQ ID NO: 346153 - RNA, 22 nt, Homo sapiens
gugugcacaaucuggcaugugc

SEQ ID NO: 346154 - RNA, 21 nt, Homo sapiens
gugugcuugaauucagcuguc

SEQ ID NO: 346155 - RNA, 21 nt, Homo sapiens
gugugcuugagugaugggauu

SEQ ID NO: 346156 - RNA, 22 nt, Homo sapiens
guguguaaauggcagugagcuc

SEQ ID NO: 346157 - RNA, 22 nt, Homo sapiens
guguucaaagcugauugagauu

SEQ ID NO: 346158 - RNA, 22 nt, Homo sapiens
guuaaagacauccacauaggag

SEQ ID NO: 346159 - RNA, 22 nt, Homo sapiens
guuaugcagcaauugauaaucu

SEQ ID NO: 346160 - RNA, 22 nt, Homo sapiens
guuaugcagcuuagaaaaugaa

SEQ ID NO: 346161 - RNA, 22 nt, Homo sapiens
guucacaguucagccuguaaca

SEQ ID NO: 346162 - RNA, 22 nt, Homo sapiens
guucacucuggagaauauugac

SEQ ID NO: 346163 - RNA, 22 nt, Homo sapiens
guucagcaggggcuucaauggu

SEQ ID NO: 346164 - RNA, 22 nt, Homo sapiens
guucaucagggauacuggcuua

SEQ ID NO: 346165 - RNA, 22 nt, Homo sapiens
guugcaaaguaauugugguuuu

SEQ ID NO: 346166 - RNA, 22 nt, Homo sapiens
guugggcccauagacugccagu

SEQ ID NO: 346167 - RNA, 22 nt, Homo sapiens
guuggugaccugaagagaguaa

SEQ ID NO: 346168 - RNA, 22 nt, Homo sapiens
guuuggcucuuguuucugucaa

SEQ ID NO: 346169 - RNA, 17 nt, Homo sapiens
guuuggguacuggguaa

SEQ ID NO: 346170 - RNA, 22 nt, Homo sapiens
guuuugguuauauggaucaguu

SEQ ID NO: 346171 - RNA, 22 nt, Homo sapiens
uaaacugcuugaaaugguguca

SEQ ID NO: 346172 - RNA, 22 nt, Homo sapiens
uaaagauaaggcucgcuuggau

SEQ ID NO: 346173 - RNA, 22 nt, Homo sapiens
uaaagaugcugggaaggcuagg

SEQ ID NO: 346174 - RNA, 22 nt, Homo sapiens
uaaagcacuuuuuucugcaugg

SEQ ID NO: 346175 - RNA, 22 nt, Homo sapiens
uaaagcuaugagaacaccguag

SEQ ID NO: 346176 - RNA, 22 nt, Homo sapiens
uaaagcugaaaugauuaugaca

SEQ ID NO: 346177 - RNA, 18 nt, Homo sapiens
uaaaggcacuguguuguu

SEQ ID NO: 346178 - RNA, 22 nt, Homo sapiens
uaaaugcucuuuaaaagugcuu

SEQ ID NO: 346179 - RNA, 22 nt, Homo sapiens
uaaauggauauugccaucuccu

SEQ ID NO: 346180 - RNA, 22 nt, Homo sapiens
uaacaacauucuaacugacggc

SEQ ID NO: 346181 - RNA, 22 nt, Homo sapiens
uaacaagagagucagucagucc

SEQ ID NO: 346182 - RNA, 22 nt, Homo sapiens
uaacaguauauuuaccaaaccu

SEQ ID NO: 346183 - RNA, 22 nt, Homo sapiens
uaacagucuccucaagguguug

SEQ ID NO: 346184 - RNA, 22 nt, Homo sapiens
uaacccagugucugugaugggu

SEQ ID NO: 346185 - RNA, 22 nt, Homo sapiens
uaacuacuucugcuucagagua

SEQ ID NO: 346186 - RNA, 22 nt, Homo sapiens
uaagaauucuguccgguauacu

SEQ ID NO: 346187 - RNA, 22 nt, Homo sapiens
uaagacuuuuugggaauauaga

SEQ ID NO: 346188 - RNA, 22 nt, Homo sapiens
uaagcaguaaaugaagucuugc

SEQ ID NO: 346189 - RNA, 22 nt, Homo sapiens
uaagcaguguggauccaccuug

SEQ ID NO: 346190 - RNA, 20 nt, Homo sapiens
uaagccacacagucuaaggu

SEQ ID NO: 346191 - RNA, 21 nt, Homo sapiens
uaagcuaaacauucaguuaac

SEQ ID NO: 346192 - RNA, 22 nt, Homo sapiens
uaaggcaaguuuuuaguggaca

SEQ ID NO: 346193 - RNA, 22 nt, Homo sapiens
uaaggcaaucagucaugguguu

SEQ ID NO: 346194 - RNA, 22 nt, Homo sapiens
uaaggcacuacuuuaggcuuuc

SEQ ID NO: 346195 - RNA, 20 nt, Homo sapiens
uaaggcacugugcuuuuagg

SEQ ID NO: 346196 - RNA, 22 nt, Homo sapiens
uaaggcuuugguagguuugguc

SEQ ID NO: 346197 - RNA, 22 nt, Homo sapiens
uaaguaauugugguuuuugcca

SEQ ID NO: 346198 - RNA, 22 nt, Homo sapiens
uaaguaauuguuaauagggaag

SEQ ID NO: 346199 - RNA, 22 nt, Homo sapiens
uaagugaaggaaguguguuuac

SEQ ID NO: 346200 - RNA, 22 nt, Homo sapiens
uaagugaauguuggcuacugaa

SEQ ID NO: 346201 - RNA, 22 nt, Homo sapiens
ccuuuguuuaguugaauuguau

SEQ ID NO: 346202 - RNA, 22 nt, Homo sapiens
cgacuggccuagacuaguguuu

SEQ ID NO: 346203 - RNA, 22 nt, Homo sapiens
cuaaagauagugacaugauuug

SEQ ID NO: 346204 - RNA, 22 nt, Homo sapiens
cuaaaugcacugucaaaggaag

SEQ ID NO: 346205 - RNA, 18 nt, Homo sapiens
cuaagacacuuggcagag

SEQ ID NO: 346206 - RNA, 21 nt, Homo sapiens
cuaaggaaagcuaugaacccu

SEQ ID NO: 346207 - RNA, 22 nt, Homo sapiens
cuaagugaacugucacugagaa

SEQ ID NO: 346208 - RNA, 20 nt, Homo sapiens
cuaaucaucccagaagaaau

SEQ ID NO: 346209 - RNA, 21 nt, Homo sapiens
cuaaucucacccuuuucuggg

SEQ ID NO: 346210 - RNA, 22 nt, Homo sapiens
cuacagcacugagcugugugca

SEQ ID NO: 346211 - RNA, 22 nt, Homo sapiens
cuacauuguagguauucaaacu

SEQ ID NO: 346212 - RNA, 22 nt, Homo sapiens
cuagaguguaguuuucuuagga

SEQ ID NO: 346213 - RNA, 22 nt, Homo sapiens
cuagcagacacuuccagagagu

SEQ ID NO: 346214 - RNA, 22 nt, Homo sapiens
cuauauacugccugcugauuag

SEQ ID NO: 346215 - RNA, 22 nt, Homo sapiens
cuauggcucugucuuuuaaguu

SEQ ID NO: 346216 - RNA, 22 nt, Homo sapiens
cuauuagguuggggcgaaagua

SEQ ID NO: 346217 - RNA, 22 nt, Homo sapiens
cuauuagguuggugcaaaagua

SEQ ID NO: 346218 - RNA, 22 nt, Homo sapiens
cucacaaccuuaugaagcauga

SEQ ID NO: 346219 - RNA, 22 nt, Homo sapiens
cacaaaguagauuagucuucca

SEQ ID NO: 346220 - RNA, 22 nt, Homo sapiens
cacaccuacuagggccgugggc

SEQ ID NO: 346221 - RNA, 22 nt, Homo sapiens
cacacugucuucaauggguggu

SEQ ID NO: 346222 - RNA, 22 nt, Homo sapiens
cacagcacaggcaugaguguca

SEQ ID NO: 346223 - RNA, 22 nt, Homo sapiens
cacagucugggcuuguuuguac

SEQ ID NO: 346224 - RNA, 22 nt, Homo sapiens
cacagucuugcaauauugagau

SEQ ID NO: 346225 - RNA, 22 nt, Homo sapiens
cacagugaacugguggguuuuu

SEQ ID NO: 346226 - RNA, 22 nt, Homo sapiens
cacaguguuacugguaugaagu

SEQ ID NO: 346227 - RNA, 22 nt, Homo sapiens
cacaguguucauagccaucagg

SEQ ID NO: 346228 - RNA, 21 nt, Homo sapiens
cacauggaggcagagagugua

SEQ ID NO: 346229 - RNA, 22 nt, Homo sapiens
cacauguuugcuacauuuuucu

SEQ ID NO: 346230 - RNA, 22 nt, Homo sapiens
caccacagccauuauugucccc

SEQ ID NO: 346231 - RNA, 22 nt, Homo sapiens
caccacuacaccccaggcuggg

SEQ ID NO: 346232 - RNA, 22 nt, Homo sapiens
caccuguacauggcaguguccu

SEQ ID NO: 346233 - RNA, 22 nt, Homo sapiens
cacugaaugugagguuggggag

SEQ ID NO: 346234 - RNA, 18 nt, Homo sapiens
cacugagcccuucacucu

SEQ ID NO: 346235 - RNA, 22 nt, Homo sapiens
cacugcacuccaguuucgguaa

SEQ ID NO: 346236 - RNA, 22 nt, Homo sapiens
cacugcacuccaguuuggauga

SEQ ID NO: 346237 - RNA, 22 nt, Homo sapiens
cacugcaguaaauugcgucggu

SEQ ID NO: 346238 - RNA, 22 nt, Homo sapiens
cacugcauccuccaccuccugg

SEQ ID NO: 346239 - RNA, 22 nt, Homo sapiens
cacugcauccuccauauccugg

SEQ ID NO: 346240 - RNA, 22 nt, Homo sapiens
cacugcauuggaugguuccucc

SEQ ID NO: 346241 - RNA, 22 nt, Homo sapiens
cacugcgaccuccaccucccgg

SEQ ID NO: 346242 - RNA, 22 nt, Homo sapiens
cacugugcaaccuccaccuccc

SEQ ID NO: 346243 - RNA, 22 nt, Homo sapiens
cagagaacauucagagcuguag

SEQ ID NO: 346244 - RNA, 22 nt, Homo sapiens
cagagguauugcaaaagccuag

SEQ ID NO: 346245 - RNA, 22 nt, Homo sapiens
cagaucaucuugagcuuaggaa

SEQ ID NO: 346246 - RNA, 22 nt, Homo sapiens
cagccggguggcuccuagggua

SEQ ID NO: 346247 - RNA, 22 nt, Homo sapiens
cagcuaguaauuuauugaagau

SEQ ID NO: 346248 - RNA, 23 nt, Homo sapiens
cagcucauuuggguccccuuguc

SEQ ID NO: 346249 - RNA, 22 nt, Homo sapiens
cagcugaugucgaaugcacucu

SEQ ID NO: 346250 - RNA, 22 nt, Homo sapiens
cagcugcuuuggaaaauauuuu

SEQ ID NO: 346251 - RNA, 22 nt, Homo sapiens
cagcugguggcaagaagacaga

SEQ ID NO: 346252 - RNA, 22 nt, Homo sapiens
cagcuguuguugggguauagga

SEQ ID NO: 346253 - RNA, 22 nt, Homo sapiens
cagcuugugguauugcugguug

SEQ ID NO: 346254 - RNA, 22 nt, Homo sapiens
caggaaugugaggguucccugc

SEQ ID NO: 346255 - RNA, 22 nt, Homo sapiens
caggaccucuugccuggaagcc

SEQ ID NO: 346256 - RNA, 22 nt, Homo sapiens
caggcagucuggggguguaucc

SEQ ID NO: 346257 - RNA, 22 nt, Homo sapiens
caggcauagucuugaguuuuau

SEQ ID NO: 346258 - RNA, 20 nt, Homo sapiens
cagggcaaugaggagguaaa

SEQ ID NO: 346259 - RNA, 22 nt, Homo sapiens
cagguaggccaauguuuuccaa

SEQ ID NO: 346260 - RNA, 22 nt, Homo sapiens
cagguaguauuugguuacauaa

SEQ ID NO: 346261 - RNA, 22 nt, Homo sapiens
caguaguagccccuuagaugga

SEQ ID NO: 346262 - RNA, 22 nt, Homo sapiens
cagucacagugacaggaugugg

SEQ ID NO: 346263 - RNA, 22 nt, Homo sapiens
cagugcaaagccucugcccaga

SEQ ID NO: 346264 - RNA, 22 nt, Homo sapiens
caguggacuaaauggggaauau

SEQ ID NO: 346265 - RNA, 22 nt, Homo sapiens
cagugguuuucaacccugguug

SEQ ID NO: 346266 - RNA, 22 nt, Homo sapiens
cagugguuuucucaguucagca

SEQ ID NO: 346267 - RNA, 22 nt, Homo sapiens
cagugguuuuuagcuugcuggg

SEQ ID NO: 346268 - RNA, 22 nt, Homo sapiens
cauagguugggcguuugauuuu

SEQ ID NO: 346269 - RNA, 22 nt, Homo sapiens
cauaugguuuuauguucuucau

SEQ ID NO: 346270 - RNA, 23 nt, Homo sapiens
caucacauagaggaaagaggaca

SEQ ID NO: 346271 - RNA, 22 nt, Homo sapiens
caucacaucugcaugguaagua

SEQ ID NO: 346272 - RNA, 22 nt, Homo sapiens
caugaaagugagaaacuccugg

SEQ ID NO: 346273 - RNA, 22 nt, Homo sapiens
caugcauuggucuauuauguga

SEQ ID NO: 346274 - RNA, 19 nt, Homo sapiens
caugccacugcacuugagu

SEQ ID NO: 346275 - RNA, 22 nt, Homo sapiens
caugccacuguggacaaagaca

SEQ ID NO: 346276 - RNA, 22 nt, Homo sapiens
cauggcccugggcugggcgaac

SEQ ID NO: 346277 - RNA, 22 nt, Homo sapiens
cauggcuacugcagauguaggg

SEQ ID NO: 346278 - RNA, 19 nt, Homo sapiens
cauggcuuauaauuuuaau

SEQ ID NO: 346279 - RNA, 22 nt, Homo sapiens
cauggcuuuuauaacaagaaau

SEQ ID NO: 346280 - RNA, 22 nt, Homo sapiens
cauggucaccuuccaaguuauu

SEQ ID NO: 346281 - RNA, 22 nt, Homo sapiens
cauuccacuggauaaacaaggu

SEQ ID NO: 346282 - RNA, 22 nt, Homo sapiens
cauugcacuccagccugaccaa

SEQ ID NO: 346283 - RNA, 22 nt, Homo sapiens
cauugcacuccagccugaguga

SEQ ID NO: 346284 - RNA, 22 nt, Homo sapiens
cauugcacuccagccugcacga

SEQ ID NO: 346285 - RNA, 22 nt, Homo sapiens
cauugcauuuucuuuguaccuu

SEQ ID NO: 346286 - RNA, 22 nt, Homo sapiens
cauugcccuccagccugggcaa

SEQ ID NO: 346287 - RNA, 22 nt, Homo sapiens
cauugcuaaaagucauauauaa

SEQ ID NO: 346288 - RNA, 22 nt, Homo sapiens
cauugcuuuuggugguuuagac

SEQ ID NO: 346289 - RNA, 22 nt, Homo sapiens
cauugguuaguuaacuuuaaga

SEQ ID NO: 346290 - RNA, 22 nt, Homo sapiens
ccaagccucaguuucccucugu

SEQ ID NO: 346291 - RNA, 22 nt, Homo sapiens
ccaaggaauacccucccuuuuu

SEQ ID NO: 346292 - RNA, 22 nt, Homo sapiens
ccaagugcuuaaaauuucauuu

SEQ ID NO: 346293 - RNA, 22 nt, Homo sapiens
ccacuguuuaaauggcugagga

SEQ ID NO: 346294 - RNA, 22 nt, Homo sapiens
ccaguauugaacacaaugaaag

SEQ ID NO: 346295 - RNA, 22 nt, Homo sapiens
ccagugaacugcaagguuuuuc

SEQ ID NO: 346296 - RNA, 22 nt, Homo sapiens
ccagugcugugcaguguaugag

SEQ ID NO: 346297 - RNA, 22 nt, Homo sapiens
ccagugguugggccggagacgg

SEQ ID NO: 346298 - RNA, 22 nt, Homo sapiens
ccaguguuuuugaauuccagga

SEQ ID NO: 346299 - RNA, 22 nt, Homo sapiens
ccaguuuuuggcaaugaugaau

SEQ ID NO: 346300 - RNA, 21 nt, Homo sapiens
cccagguucucugaggguaga

SEQ ID NO: 346301 - RNA, 22 nt, Homo sapiens
cccagugugcugggugacagcu

SEQ ID NO: 346302 - RNA, 22 nt, Homo sapiens
ccccauguucucucugcagcuc

SEQ ID NO: 346303 - RNA, 22 nt, Homo sapiens
ccccauuguugugguuuuaucu

SEQ ID NO: 346304 - RNA, 22 nt, Homo sapiens
ccccggguucugucugcccuug

SEQ ID NO: 346305 - RNA, 22 nt, Homo sapiens
cccugagaaaacuuuguccuua

SEQ ID NO: 346306 - RNA, 22 nt, Homo sapiens
cccugagaugugaauuucagag

SEQ ID NO: 346307 - RNA, 19 nt, Homo sapiens
cccuggcacauggaaaaug

SEQ ID NO: 346308 - RNA, 22 nt, Homo sapiens
ccucccuuuguugcaagggaaa

SEQ ID NO: 346309 - RNA, 22 nt, Homo sapiens
ccucuguaguccugcaagagga

SEQ ID NO: 346310 - RNA, 22 nt, Homo sapiens
ccugagacuugagggggcuucu

SEQ ID NO: 346311 - RNA, 21 nt, Homo sapiens
ccugaugaccucugagaguua

SEQ ID NO: 346312 - RNA, 22 nt, Homo sapiens
ccuggaaugaagcuuauauugc

SEQ ID NO: 346313 - RNA, 22 nt, Homo sapiens
ccuucacaggcacugguucaga

SEQ ID NO: 346314 - RNA, 22 nt, Homo sapiens
uuauaaacaugaagauuugggg

SEQ ID NO: 346315 - RNA, 22 nt, Homo sapiens
uuauagcagugcaggaacagac

SEQ ID NO: 346316 - RNA, 20 nt, Homo sapiens
uuauagcuacaucuugacug

SEQ ID NO: 346317 - RNA, 22 nt, Homo sapiens
uuauauguuacucccucuagca

SEQ ID NO: 346318 - RNA, 22 nt, Homo sapiens
uuauauguuucuguuuggaggc

SEQ ID NO: 346319 - RNA, 22 nt, Homo sapiens
uuauauguuucuuagggacaga

SEQ ID NO: 346320 - RNA, 22 nt, Homo sapiens
uuaucauagugcaguuuucuga

SEQ ID NO: 346321 - RNA, 22 nt, Homo sapiens
uuauccagcgcuguuuuggaga

SEQ ID NO: 346322 - RNA, 22 nt, Homo sapiens
uuaucucagugaacugagugga

SEQ ID NO: 346323 - RNA, 22 nt, Homo sapiens
uuaugaaguagguuaagagcag

SEQ ID NO: 346324 - RNA, 22 nt, Homo sapiens
uuaugcuuauugguguacggua

SEQ ID NO: 346325 - RNA, 22 nt, Homo sapiens
uuauggcuauugaugacaauug

SEQ ID NO: 346326 - RNA, 22 nt, Homo sapiens
uuaugucuuuuguguucagcua

SEQ ID NO: 346327 - RNA, 22 nt, Homo sapiens
uuauucagcaccugcuguguuc

SEQ ID NO: 346328 - RNA, 20 nt, Homo sapiens
uuauugcggcaucauucaug

SEQ ID NO: 346329 - RNA, 22 nt, Homo sapiens
auggcucuguuccaugugucuu

SEQ ID NO: 346330 - RNA, 22 nt, Homo sapiens
auggcuguuccugggaguucua

SEQ ID NO: 346331 - RNA, 22 nt, Homo sapiens
auggcuuuuuaaaucauguugu

SEQ ID NO: 346332 - RNA, 22 nt, Homo sapiens
augggagugugguuagagaccu

SEQ ID NO: 346333 - RNA, 21 nt, Homo sapiens
augggguagaagagaaggcuu

SEQ ID NO: 346334 - RNA, 22 nt, Homo sapiens
augggguaggcuuugcugcagu

SEQ ID NO: 346335 - RNA, 22 nt, Homo sapiens
augguaagcugaaaauaucgaa

SEQ ID NO: 346336 - RNA, 22 nt, Homo sapiens
augguauuuaacagucuuucua

SEQ ID NO: 346337 - RNA, 22 nt, Homo sapiens
auggucccauucauucacguau

SEQ ID NO: 346338 - RNA, 21 nt, Homo sapiens
auggugagaaaguagugucaa

SEQ ID NO: 346339 - RNA, 22 nt, Homo sapiens
auggugugugaauuaaauguua

SEQ ID NO: 346340 - RNA, 22 nt, Homo sapiens
auguaguagcagaaaauauuuu

SEQ ID NO: 346341 - RNA, 22 nt, Homo sapiens
auguauacaugcaggucacagg

SEQ ID NO: 346342 - RNA, 22 nt, Homo sapiens
auguccaugagcacauguauca

SEQ ID NO: 346343 - RNA, 22 nt, Homo sapiens
augucuagagugauacugaagc

SEQ ID NO: 346344 - RNA, 22 nt, Homo sapiens
augucuggcagaagacuucuca

SEQ ID NO: 346345 - RNA, 22 nt, Homo sapiens
augugacagugguuuuaagcgu

SEQ ID NO: 346346 - RNA, 22 nt, Homo sapiens
augugaugguuaauuuuaugug

SEQ ID NO: 346347 - RNA, 18 nt, Homo sapiens
augugcaauuuuguauuu

SEQ ID NO: 346348 - RNA, 22 nt, Homo sapiens
augugcacaugcuuacauguga

SEQ ID NO: 346349 - RNA, 20 nt, Homo sapiens
augugcaguguggcaaccaa

SEQ ID NO: 346350 - RNA, 22 nt, Homo sapiens
auguggaaagcagcaugauaug

SEQ ID NO: 346351 - RNA, 22 nt, Homo sapiens
augugggaggaauguguuucca

SEQ ID NO: 346352 - RNA, 22 nt, Homo sapiens
auguguauuaccucgauuguga

SEQ ID NO: 346353 - RNA, 22 nt, Homo sapiens
augugugcuugauguaaaaagu

SEQ ID NO: 346354 - RNA, 22 nt, Homo sapiens
auguuagcaucuggcacuaugg

SEQ ID NO: 346355 - RNA, 22 nt, Homo sapiens
auguugcuugaaggcauuuugu

SEQ ID NO: 346356 - RNA, 22 nt, Homo sapiens
auguuguaguaugagucaaaau

SEQ ID NO: 346357 - RNA, 22 nt, Homo sapiens
auuaagagcacauguucugggu

SEQ ID NO: 346358 - RNA, 22 nt, Homo sapiens
auuaagugcuugccagugcugg

SEQ ID NO: 346359 - RNA, 22 nt, Homo sapiens
auuaaucaggcaaugcuugcua

SEQ ID NO: 346360 - RNA, 22 nt, Homo sapiens
auuacuuugcaccaaccuaaua

SEQ ID NO: 346361 - RNA, 22 nt, Homo sapiens
auuauaugucaucacagacacc

SEQ ID NO: 346362 - RNA, 22 nt, Homo sapiens
auuauauguguaugugcauacc

SEQ ID NO: 346363 - RNA, 22 nt, Homo sapiens
auucaacuaauuauugaagaug

SEQ ID NO: 346364 - RNA, 22 nt, Homo sapiens
auucaagggauuucaggaggcu

SEQ ID NO: 346365 - RNA, 22 nt, Homo sapiens
auucacagggggagaaggguau

SEQ ID NO: 346366 - RNA, 22 nt, Homo sapiens
auucaucagggauacuggccug

SEQ ID NO: 346367 - RNA, 20 nt, Homo sapiens
auucauggugguacguuguc

SEQ ID NO: 346368 - RNA, 22 nt, Homo sapiens
auuccacuuccacuaguuucuc

SEQ ID NO: 346369 - RNA, 23 nt, Homo sapiens
auuccaguggcaauuggagaaac

SEQ ID NO: 346370 - RNA, 22 nt, Homo sapiens
auuccauuuguuaucacacccg

SEQ ID NO: 346371 - RNA, 22 nt, Homo sapiens
auucccuuggucaacggaugca

SEQ ID NO: 346372 - RNA, 18 nt, Homo sapiens
auucuacaggccuuuuga

SEQ ID NO: 346373 - RNA, 22 nt, Homo sapiens
auugaaugaaauggcagacacu

SEQ ID NO: 346374 - RNA, 22 nt, Homo sapiens
auugaauuugguuugcuaagaa

SEQ ID NO: 346375 - RNA, 16 nt, Homo sapiens
auugacaguggguguu

SEQ ID NO: 346376 - RNA, 18 nt, Homo sapiens
auugagcaugacagaccu

SEQ ID NO: 346377 - RNA, 22 nt, Homo sapiens
auugaggcaggaggaccaucua

SEQ ID NO: 346378 - RNA, 22 nt, Homo sapiens
auugcacuccagccuagucaac

SEQ ID NO: 346379 - RNA, 22 nt, Homo sapiens
auugcacuccagccuggcaaua

SEQ ID NO: 346380 - RNA, 22 nt, Homo sapiens
auugcacuccagccugggugac

SEQ ID NO: 346381 - RNA, 22 nt, Homo sapiens
auugcacuccagccuuggggau

SEQ ID NO: 346382 - RNA, 22 nt, Homo sapiens
auugcacuccagccuugugaca

SEQ ID NO: 346383 - RNA, 22 nt, Homo sapiens
auugcacucugaucugcacucc

SEQ ID NO: 346384 - RNA, 22 nt, Homo sapiens
auugcagaaaugacagagcgcc

SEQ ID NO: 346385 - RNA, 19 nt, Homo sapiens
auugcaguguaaaacuauu

SEQ ID NO: 346386 - RNA, 22 nt, Homo sapiens
auugcaguuucaacuccagggc

SEQ ID NO: 346387 - RNA, 22 nt, Homo sapiens
auugcuaauaugcuucaggcaa

SEQ ID NO: 346388 - RNA, 22 nt, Homo sapiens
auugcucaaaucaguacuugag

SEQ ID NO: 346389 - RNA, 22 nt, Homo sapiens
auugcucagucagggagcucgg

SEQ ID NO: 346390 - RNA, 22 nt, Homo sapiens
auuggaacugaaauaauaacuu

SEQ ID NO: 346391 - RNA, 22 nt, Homo sapiens
auuggcaauggcaaagcagagu

SEQ ID NO: 346392 - RNA, 22 nt, Homo sapiens
auuggcuuuauacauaagaaua

SEQ ID NO: 346393 - RNA, 22 nt, Homo sapiens
auuguaauuuuagagaaagugg

SEQ ID NO: 346394 - RNA, 22 nt, Homo sapiens
auuguacucuagccucugggca

SEQ ID NO: 346395 - RNA, 22 nt, Homo sapiens
auugucacuuaaaagugcaugu

SEQ ID NO: 346396 - RNA, 20 nt, Homo sapiens
auuguccuugauuacacaga

SEQ ID NO: 346397 - RNA, 22 nt, Homo sapiens
auugugcuaaaguaauaaguca

SEQ ID NO: 346398 - RNA, 22 nt, Homo sapiens
auuucacugagacaugugccca

SEQ ID NO: 346399 - RNA, 22 nt, Homo sapiens
auuuggcaacguagggaggcau

SEQ ID NO: 346400 - RNA, 22 nt, Homo sapiens
auuuggcaauuuugaagaugcc

SEQ ID NO: 346401 - RNA, 22 nt, Homo sapiens
auuugucacuuaacagccauua

SEQ ID NO: 346402 - RNA, 22 nt, Homo sapiens
auuuuuggauauagggaaggau

SEQ ID NO: 346403 - RNA, 22 nt, Homo sapiens
auuuuugguuucaccugcacgc

SEQ ID NO: 346404 - RNA, 22 nt, Homo sapiens
caaaggugcuuuccagguccaa

SEQ ID NO: 346405 - RNA, 22 nt, Homo sapiens
caaaguaauugugguuuugcca

SEQ ID NO: 346406 - RNA, 22 nt, Homo sapiens
caaagugcugggacuggccggg

SEQ ID NO: 346407 - RNA, 19 nt, Homo sapiens
caaaguguucuucuuugcc

SEQ ID NO: 346408 - RNA, 22 nt, Homo sapiens
caaauugcuugucuguagugga

SEQ ID NO: 346409 - RNA, 19 nt, Homo sapiens
caacccugcagagaaagga

SEQ ID NO: 346410 - RNA, 22 nt, Homo sapiens
caauacuguuaccugaaauagg

SEQ ID NO: 346411 - RNA, 22 nt, Homo sapiens
caaugcagcuuuuggagagaaa

SEQ ID NO: 346412 - RNA, 21 nt, Homo sapiens
caauggcacgaucuuggcuca

SEQ ID NO: 346413 - RNA, 22 nt, Homo sapiens
ugucauagaugauuuuuuucgg

SEQ ID NO: 346414 - RNA, 22 nt, Homo sapiens
ugucauauagaauguucuauga

SEQ ID NO: 346415 - RNA, 22 nt, Homo sapiens
ugucaucauuggaaucugccuc

SEQ ID NO: 346416 - RNA, 22 nt, Homo sapiens
ugucaugagucuccuccaucuu

SEQ ID NO: 346417 - RNA, 21 nt, Homo sapiens
ugucaugcagagacccuggag

SEQ ID NO: 346418 - RNA, 22 nt, Homo sapiens
ugucauggauucugagucuggg

SEQ ID NO: 346419 - RNA, 22 nt, Homo sapiens
ugucauggggaaaauaacagac

SEQ ID NO: 346420 - RNA, 22 nt, Homo sapiens
ugucauguggcuaacgauucau

SEQ ID NO: 346421 - RNA, 22 nt, Homo sapiens
uguccaaauugaaucaucuggu

SEQ ID NO: 346422 - RNA, 21 nt, Homo sapiens
uguccagcuuuuggaauauaa

SEQ ID NO: 346423 - RNA, 22 nt, Homo sapiens
uguccauuuuuaugcuuauggu

SEQ ID NO: 346424 - RNA, 19 nt, Homo sapiens
ugucccagccauagaggca

SEQ ID NO: 346425 - RNA, 22 nt, Homo sapiens
agcauuacaugguacagagaag

SEQ ID NO: 346426 - RNA, 22 nt, Homo sapiens
agcauuaguugugaagccuuua

SEQ ID NO: 346427 - RNA, 21 nt, Homo sapiens
agccaguguuccuuguggcuc

SEQ ID NO: 346428 - RNA, 22 nt, Homo sapiens
agcccugugauuacuuuuauaa

SEQ ID NO: 346429 - RNA, 22 nt, Homo sapiens
agccuguagugagcugugauug

SEQ ID NO: 346430 - RNA, 22 nt, Homo sapiens
ugagaucgaguaucgcugucac

SEQ ID NO: 346431 - RNA, 22 nt, Homo sapiens
ugagaucgaguuucgcucuugu

SEQ ID NO: 346432 - RNA, 22 nt, Homo sapiens
ugagaucuguaaagucugacau

SEQ ID NO: 346433 - RNA, 22 nt, Homo sapiens
ugagaucuuaccuuccugccuu

SEQ ID NO: 346434 - RNA, 19 nt, Homo sapiens
ugagaucuuuacuggguuu

SEQ ID NO: 346435 - RNA, 22 nt, Homo sapiens
ugagaugaagucuugcucuguu

SEQ ID NO: 346436 - RNA, 22 nt, Homo sapiens
ugagaugaucaaaguauaggcu

SEQ ID NO: 346437 - RNA, 22 nt, Homo sapiens
ugagaugcaaaaugagaauugu

SEQ ID NO: 346438 - RNA, 22 nt, Homo sapiens
ugagaugcuuguaaauucauuu

SEQ ID NO: 346439 - RNA, 22 nt, Homo sapiens
ugagauggaguuucgcucuugu

SEQ ID NO: 346440 - RNA, 22 nt, Homo sapiens
ugagauguaaucucgcucuguc

SEQ ID NO: 346441 - RNA, 22 nt, Homo sapiens
ugagauguggcuagagagguug

SEQ ID NO: 346442 - RNA, 22 nt, Homo sapiens
ugagauguuccaaugacuauua

SEQ ID NO: 346443 - RNA, 22 nt, Homo sapiens
ugagauuacguucggcccacuu

SEQ ID NO: 346444 - RNA, 23 nt, Homo sapiens
ugagauuauaaucuuuuacuucu

SEQ ID NO: 346445 - RNA, 22 nt, Homo sapiens
ugagauuaucuugaucuugaaa

SEQ ID NO: 346446 - RNA, 22 nt, Homo sapiens
ugagcacagagccugggguggc

SEQ ID NO: 346447 - RNA, 22 nt, Homo sapiens
ugagcagaaguuuugauuggcg

SEQ ID NO: 346448 - RNA, 22 nt, Homo sapiens
ugagccaaugauuugaauagag

SEQ ID NO: 346449 - RNA, 22 nt, Homo sapiens
ugagcuauguucuucuuguuuu

SEQ ID NO: 346450 - RNA, 22 nt, Homo sapiens
ugagcucaugcauucuugagga

SEQ ID NO: 346451 - RNA, 22 nt, Homo sapiens
ugagcugagaucuuaccacugc

SEQ ID NO: 346452 - RNA, 22 nt, Homo sapiens
ugagcuguuugaagaagcauuu

SEQ ID NO: 346453 - RNA, 20 nt, Homo sapiens
ugagcuuguaaacacuguuu

SEQ ID NO: 346454 - RNA, 22 nt, Homo sapiens
ugaggcaagauacugauuucau

SEQ ID NO: 346455 - RNA, 22 nt, Homo sapiens
ugaggcaaggcugaaugaaggc

SEQ ID NO: 346456 - RNA, 22 nt, Homo sapiens
ugagguaauagauaauauuuuu

SEQ ID NO: 346457 - RNA, 22 nt, Homo sapiens
ugagguuguccacuauaaucca

SEQ ID NO: 346458 - RNA, 19 nt, Homo sapiens
ugaguaucuuuacacaucu

SEQ ID NO: 346459 - RNA, 22 nt, Homo sapiens
ugaguauguaggaugugucuua

SEQ ID NO: 346460 - RNA, 22 nt, Homo sapiens
ugagucuguucucacauugcua

SEQ ID NO: 346461 - RNA, 22 nt, Homo sapiens
ugagugaaagaagcacuaagga

SEQ ID NO: 346462 - RNA, 22 nt, Homo sapiens
ugaguguguaugugcauacaca

SEQ ID NO: 346463 - RNA, 22 nt, Homo sapiens
ugaguucauggucauuugucac

SEQ ID NO: 346464 - RNA, 22 nt, Homo sapiens
ugaguugagauaagguuacauu

SEQ ID NO: 346465 - RNA, 22 nt, Homo sapiens
ugaguuguagcuauaguuucuu

SEQ ID NO: 346466 - RNA, 22 nt, Homo sapiens
ugaguuguugcauucuuggugu

SEQ ID NO: 346467 - RNA, 22 nt, Homo sapiens
ugauauauugaaugaugaaaca

SEQ ID NO: 346468 - RNA, 22 nt, Homo sapiens
ugauaugucccucgacaucagg

SEQ ID NO: 346469 - RNA, 20 nt, Homo sapiens
ugauauuucuggaaguggag

SEQ ID NO: 346470 - RNA, 22 nt, Homo sapiens
ugaugcugaguggcuauuugaa

SEQ ID NO: 346471 - RNA, 22 nt, Homo sapiens
ugaugcugaugccugccagaag

SEQ ID NO: 346472 - RNA, 22 nt, Homo sapiens
ugauuagagcccaagcuuugaa

SEQ ID NO: 346473 - RNA, 22 nt, Homo sapiens
ugcaaauguuaggugucauuau

SEQ ID NO: 346474 - RNA, 22 nt, Homo sapiens
ugcaacacauugccccugcucu

SEQ ID NO: 346475 - RNA, 22 nt, Homo sapiens
ugcaaccauuguuaagugugca

SEQ ID NO: 346476 - RNA, 22 nt, Homo sapiens
ugcaagaaacauauuccacaag

SEQ ID NO: 346477 - RNA, 21 nt, Homo sapiens
ugcaagaaucaggaagcugcc

SEQ ID NO: 346478 - RNA, 22 nt, Homo sapiens
ugcaagaaucuuucaggcuagc

SEQ ID NO: 346479 - RNA, 22 nt, Homo sapiens
ugcaagacuaaaccuuccccuc

SEQ ID NO: 346480 - RNA, 22 nt, Homo sapiens
ugcaagauaggcaguuugcacu

SEQ ID NO: 346481 - RNA, 22 nt, Homo sapiens
ugcaagucaucuguccuucaga

SEQ ID NO: 346482 - RNA, 22 nt, Homo sapiens
ugcaaucauuuggaggagaaga

SEQ ID NO: 346483 - RNA, 22 nt, Homo sapiens
ugcaccacugcacugccugggu

SEQ ID NO: 346484 - RNA, 22 nt, Homo sapiens
ugcaccacugcuagccugggua

SEQ ID NO: 346485 - RNA, 18 nt, Homo sapiens
ugcaccaguuuacacuuc

SEQ ID NO: 346486 - RNA, 22 nt, Homo sapiens
ugcaccauuacacuccaggcug

SEQ ID NO: 346487 - RNA, 17 nt, Homo sapiens
ugcaccauuugauuuuu

SEQ ID NO: 346488 - RNA, 22 nt, Homo sapiens
ugcacuguggucugagagacag

SEQ ID NO: 346489 - RNA, 22 nt, Homo sapiens
ugcagcacugaacuucugggcu

SEQ ID NO: 346490 - RNA, 20 nt, Homo sapiens
ugcaguguccucacuuguca

SEQ ID NO: 346491 - RNA, 22 nt, Homo sapiens
ugcagugugauuuucuggcuga

SEQ ID NO: 346492 - RNA, 22 nt, Homo sapiens
ugcaguguucuuuagaggaaau

SEQ ID NO: 346493 - RNA, 21 nt, Homo sapiens
ugcauacuucucagaugauua

SEQ ID NO: 346494 - RNA, 22 nt, Homo sapiens
ugcauauguauacaugugccau

SEQ ID NO: 346495 - RNA, 22 nt, Homo sapiens
ugcauauguugagaugcauauu

SEQ ID NO: 346496 - RNA, 22 nt, Homo sapiens
ugcaugcaucuuuuauaguagc

SEQ ID NO: 346497 - RNA, 22 nt, Homo sapiens
ugcauggaagggagggaaagag

SEQ ID NO: 346498 - RNA, 22 nt, Homo sapiens
ugcauuguuccgaauguguccu

SEQ ID NO: 346499 - RNA, 22 nt, Homo sapiens
ugccaacaugccuggcuguuuu

SEQ ID NO: 346500 - RNA, 22 nt, Homo sapiens
ugccaguauuuuauugagcauu

SEQ ID NO: 346501 - RNA, 22 nt, Homo sapiens
ugccaguguuuuguugaagauu

SEQ ID NO: 346502 - RNA, 22 nt, Homo sapiens
ugccaucauuaauauuaggcau

SEQ ID NO: 346503 - RNA, 23 nt, Homo sapiens
ugccuagaccaucagccugaggu

SEQ ID NO: 346504 - RNA, 22 nt, Homo sapiens
ugccuaggcccaguccucagaa

SEQ ID NO: 346505 - RNA, 22 nt, Homo sapiens
ugccuucuguuaaacgaggaug

SEQ ID NO: 346506 - RNA, 22 nt, Homo sapiens
ugcgguagugcaaucauggcuc

SEQ ID NO: 346507 - RNA, 21 nt, Homo sapiens
ugcuccauuuucuagccugaa

SEQ ID NO: 346508 - RNA, 21 nt, Homo sapiens
ugcugcacuucuuuugcugug

SEQ ID NO: 346509 - RNA, 22 nt, Homo sapiens
ugcugguuuaaaaugcaaauuc

SEQ ID NO: 346510 - RNA, 22 nt, Homo sapiens
ugcugguuuucaucaucagugg

SEQ ID NO: 346511 - RNA, 22 nt, Homo sapiens
ugcuguuguuugaugaaguaau

SEQ ID NO: 346512 - RNA, 22 nt, Homo sapiens
ugcuugagacacauaugaauuu

SEQ ID NO: 346513 - RNA, 22 nt, Homo sapiens
ugcuuuguugaaaaucauuugg

SEQ ID NO: 346514 - RNA, 22 nt, Homo sapiens
uggaaaacaugcacauuggauu

SEQ ID NO: 346515 - RNA, 22 nt, Homo sapiens
uggaaaguacugagguccaccu

SEQ ID NO: 346516 - RNA, 22 nt, Homo sapiens
uggaaaguaguucuaaucuaag

SEQ ID NO: 346517 - RNA, 22 nt, Homo sapiens
uggaaaucuaaguuuggauuga

SEQ ID NO: 346518 - RNA, 23 nt, Homo sapiens
uggaagacuccucucuuggcugc

SEQ ID NO: 346519 - RNA, 22 nt, Homo sapiens
ggugacugguuuaucuggcagu

SEQ ID NO: 346520 - RNA, 22 nt, Homo sapiens
ggugagguaguaagguacaaua

SEQ ID NO: 346521 - RNA, 20 nt, Homo sapiens
guaaacucucagcauagaug

SEQ ID NO: 346522 - RNA, 22 nt, Homo sapiens
guaaauaccaguuucuggaaca

SEQ ID NO: 346523 - RNA, 22 nt, Homo sapiens
guaacuggccuucaauuucuuc

SEQ ID NO: 346524 - RNA, 22 nt, Homo sapiens
guaagagcauguaguggcucua

SEQ ID NO: 346525 - RNA, 22 nt, Homo sapiens
guaaggaguaguguaacagugc

SEQ ID NO: 346526 - RNA, 22 nt, Homo sapiens
guaauacuuuugggauauuaga

SEQ ID NO: 346527 - RNA, 22 nt, Homo sapiens
guaaucucagcuacuugggagg

SEQ ID NO: 346528 - RNA, 22 nt, Homo sapiens
guaaucucagcuucuugggagg

SEQ ID NO: 346529 - RNA, 22 nt, Homo sapiens
guaaucuguaguaaagcaccau

SEQ ID NO: 346530 - RNA, 22 nt, Homo sapiens
guaaugaacuugaaagccuguu

SEQ ID NO: 346531 - RNA, 22 nt, Homo sapiens
guacacauacauauaugugugu

SEQ ID NO: 346532 - RNA, 22 nt, Homo sapiens
guacaguauaguaauaggauuu

SEQ ID NO: 346533 - RNA, 22 nt, Homo sapiens
guacaguuuagugcuuugagaa

SEQ ID NO: 346534 - RNA, 22 nt, Homo sapiens
guacaugcaugcaugggugugc

SEQ ID NO: 346535 - RNA, 17 nt, Homo sapiens
guacucagugaccaugg

SEQ ID NO: 346536 - RNA, 22 nt, Homo sapiens
guagcagaacauguuccuugua

SEQ ID NO: 346537 - RNA, 22 nt, Homo sapiens
guagcagaauaucagauaauuu

SEQ ID NO: 346538 - RNA, 22 nt, Homo sapiens
guaguuuaucagaaagaauagg

SEQ ID NO: 346539 - RNA, 22 nt, Homo sapiens
guauacacccugugauauuauu

SEQ ID NO: 346540 - RNA, 22 nt, Homo sapiens
guauacaugucaaaacucacau

SEQ ID NO: 346541 - RNA, 22 nt, Homo sapiens
guauagaucguagaccaauaaa

SEQ ID NO: 346542 - RNA, 22 nt, Homo sapiens
guaugacacaggaagcuuaacc

SEQ ID NO: 346543 - RNA, 22 nt, Homo sapiens
guauuagguuggggcaaaagua

SEQ ID NO: 346544 - RNA, 22 nt, Homo sapiens
guauuagguuggugcaaaauug

SEQ ID NO: 346545 - RNA, 22 nt, Homo sapiens
gucaacauauuaauuauguucu

SEQ ID NO: 346546 - RNA, 22 nt, Homo sapiens
gucacaguguuuguucauccca

SEQ ID NO: 346547 - RNA, 22 nt, Homo sapiens
gucacauugaugcccauggugg

SEQ ID NO: 346548 - RNA, 21 nt, Homo sapiens
gucacuggggcuggauaauuc

SEQ ID NO: 346549 - RNA, 22 nt, Homo sapiens
gucacugugaggaggggccagg

SEQ ID NO: 346550 - RNA, 22 nt, Homo sapiens
gucagaugcagauuccaguucu

SEQ ID NO: 346551 - RNA, 22 nt, Homo sapiens
gucagcaaaguucuccugcaga

SEQ ID NO: 346552 - RNA, 22 nt, Homo sapiens
gucagugcauguaaacauaaaa

SEQ ID NO: 346553 - RNA, 22 nt, Homo sapiens
gucagugcuuuaguucaggaug

SEQ ID NO: 346554 - RNA, 22 nt, Homo sapiens
gucaguggagaaaaggacaugu

SEQ ID NO: 346555 - RNA, 22 nt, Homo sapiens
gucaguggauacugucucuguc

SEQ ID NO: 346556 - RNA, 22 nt, Homo sapiens
gucaucaggacgggucaucugc

SEQ ID NO: 346557 - RNA, 22 nt, Homo sapiens
gucaugcaggguucgccagccc

SEQ ID NO: 346558 - RNA, 22 nt, Homo sapiens
gucauggacaaggugugagcca

SEQ ID NO: 346559 - RNA, 22 nt, Homo sapiens
gucaugggguacuacacauggg

SEQ ID NO: 346560 - RNA, 21 nt, Homo sapiens
guccaaaacaguguccaaugc

SEQ ID NO: 346561 - RNA, 22 nt, Homo sapiens
guccagagaagucauuacuuca

SEQ ID NO: 346562 - RNA, 22 nt, Homo sapiens
guccaguacucuuuccugaaaa

SEQ ID NO: 346563 - RNA, 22 nt, Homo sapiens
guccaugagaugaauccacaca

SEQ ID NO: 346564 - RNA, 22 nt, Homo sapiens
guccauuuguuuccagagcacu

SEQ ID NO: 346565 - RNA, 22 nt, Homo sapiens
gucucauugcaguuagaccugu

SEQ ID NO: 346566 - RNA, 22 nt, Homo sapiens
gucucccagccuacauauuucu

SEQ ID NO: 346567 - RNA, 22 nt, Homo sapiens
gucucugagaugucaacaccua

SEQ ID NO: 346568 - RNA, 22 nt, Homo sapiens
gucucugguugcuuuuguacca

SEQ ID NO: 346569 - RNA, 22 nt, Homo sapiens
gucugguuuuuuauauccucac

SEQ ID NO: 346570 - RNA, 20 nt, Homo sapiens
gucugucuccgaguagaauu

SEQ ID NO: 346571 - RNA, 22 nt, Homo sapiens
gucugucuuuugucuuugaaau

SEQ ID NO: 346572 - RNA, 22 nt, Homo sapiens
gucugugcauuaauacgugcug

SEQ ID NO: 346573 - RNA, 22 nt, Homo sapiens
gucuuccagccuccaucuuucu

SEQ ID NO: 346574 - RNA, 22 nt, Homo sapiens
gucuuugagauaggguuauuuu

SEQ ID NO: 346575 - RNA, 22 nt, Homo sapiens
gugaaagauuaaaccagugugu

SEQ ID NO: 346576 - RNA, 22 nt, Homo sapiens
gugaaagcaucugacugugcca

SEQ ID NO: 346577 - RNA, 22 nt, Homo sapiens
gugaaauauuuaacguccaggu

SEQ ID NO: 346578 - RNA, 17 nt, Homo sapiens
gugaaaucaucauuuuu

SEQ ID NO: 346579 - RNA, 22 nt, Homo sapiens
gugaauguuuucuuacauggua

SEQ ID NO: 346580 - RNA, 22 nt, Homo sapiens
gugacacuggagcuggcacaau

SEQ ID NO: 346581 - RNA, 22 nt, Homo sapiens
gugacagucaaagacaugacuu

SEQ ID NO: 346582 - RNA, 20 nt, Homo sapiens
gugacugagcacgggcacag

SEQ ID NO: 346583 - RNA, 22 nt, Homo sapiens
gugagauggaguuggugucuuu

SEQ ID NO: 346584 - RNA, 19 nt, Homo sapiens
gugagcaaugcauugcacu

SEQ ID NO: 346585 - RNA, 22 nt, Homo sapiens
gugagcagagaucgcgugauug

SEQ ID NO: 346586 - RNA, 22 nt, Homo sapiens
gugagcaguguccuugggggca

SEQ ID NO: 346587 - RNA, 22 nt, Homo sapiens
gugagcauaggaggcuucuguu

SEQ ID NO: 346588 - RNA, 22 nt, Homo sapiens
gugaggcugguccugccuccca

SEQ ID NO: 346589 - RNA, 22 nt, Homo sapiens
gugagguacgugucaagaacca

SEQ ID NO: 346590 - RNA, 22 nt, Homo sapiens
gugaggucguagucauaggcaa

SEQ ID NO: 346591 - RNA, 17 nt, Homo sapiens
gugagguggguaguauc

SEQ ID NO: 346592 - RNA, 22 nt, Homo sapiens
gugauagaucugggauucagaa

SEQ ID NO: 346593 - RNA, 23 nt, Homo sapiens
gugaucauuguuguggguugaau

SEQ ID NO: 346594 - RNA, 22 nt, Homo sapiens
gugaucuguccuucauagccug

SEQ ID NO: 346595 - RNA, 22 nt, Homo sapiens
gugauguguuuguucuaucucu

SEQ ID NO: 346596 - RNA, 20 nt, Homo sapiens
gugauuggucacugguuguu

SEQ ID NO: 346597 - RNA, 22 nt, Homo sapiens
gugauuguuaaacugccucucu

SEQ ID NO: 346598 - RNA, 22 nt, Homo sapiens
gugauuuaguagaugcuaguua

SEQ ID NO: 346599 - RNA, 22 nt, Homo sapiens
gugcaaaucucugaguaucuuu

SEQ ID NO: 346600 - RNA, 22 nt, Homo sapiens
gugcaagagugacugcaguuuu

SEQ ID NO: 346601 - RNA, 22 nt, Homo sapiens
gugcacaacaugcaguuuuguu

SEQ ID NO: 346602 - RNA, 22 nt, Homo sapiens
gugcacaacgugcagguuaguu

SEQ ID NO: 346603 - RNA, 22 nt, Homo sapiens
gugcacaaucgugcauuccuug

SEQ ID NO: 346604 - RNA, 22 nt, Homo sapiens
gugcaugucuaugcgagucuaa

SEQ ID NO: 346605 - RNA, 22 nt, Homo sapiens
guggaaagaacacaaaauuagg

SEQ ID NO: 346606 - RNA, 17 nt, Homo sapiens
guggaaugucaugucaa

SEQ ID NO: 346607 - RNA, 22 nt, Homo sapiens
guggagcuguguggccuugggc

SEQ ID NO: 346608 - RNA, 22 nt, Homo sapiens
guggaucacuugagguuagaag

SEQ ID NO: 346609 - RNA, 22 nt, Homo sapiens
guggcacgaugaucugggcuca

SEQ ID NO: 346610 - RNA, 22 nt, Homo sapiens
guggcagaaaagagaagcaaug

SEQ ID NO: 346611 - RNA, 22 nt, Homo sapiens
guggcagagucagagggaaaug

SEQ ID NO: 346612 - RNA, 22 nt, Homo sapiens
guggcagugugaggauccugcu

SEQ ID NO: 346613 - RNA, 22 nt, Homo sapiens
guggcuagaaugaagguagcug

SEQ ID NO: 346614 - RNA, 22 nt, Homo sapiens
accauugcacuccuuucugggc

SEQ ID NO: 346615 - RNA, 22 nt, Homo sapiens
acccagaauucagucuuaggcc

SEQ ID NO: 346616 - RNA, 22 nt, Homo sapiens
acccaguguucaacauucacau

SEQ ID NO: 346617 - RNA, 23 nt, Homo sapiens
accccuacaggcuuguguccugc

SEQ ID NO: 346618 - RNA, 22 nt, Homo sapiens
acccggagagcaggcgagaagg

SEQ ID NO: 346619 - RNA, 22 nt, Homo sapiens
acccugucaaaacggaccaauc

SEQ ID NO: 346620 - RNA, 22 nt, Homo sapiens
acccuguugagcaacuggccau

SEQ ID NO: 346621 - RNA, 23 nt, Homo sapiens
accugauguuucuguggggagcc

SEQ ID NO: 346622 - RNA, 22 nt, Homo sapiens
accuggcacuuagcaaaucuga

SEQ ID NO: 346623 - RNA, 22 nt, Homo sapiens
accuguagcagacuuaauauuu

SEQ ID NO: 346624 - RNA, 22 nt, Homo sapiens
accugugguuacagucugucuc

SEQ ID NO: 346625 - RNA, 22 nt, Homo sapiens
acgcagcacauucacagcuaug

SEQ ID NO: 346626 - RNA, 22 nt, Homo sapiens
acuaugcuuuucuuagaauuaa

SEQ ID NO: 346627 - RNA, 22 nt, Homo sapiens
acucacagcaaccuccgccucc

SEQ ID NO: 346628 - RNA, 22 nt, Homo sapiens
acuccauuuggacucugggagg

SEQ ID NO: 346629 - RNA, 18 nt, Homo sapiens
acucuguauguggagugg

SEQ ID NO: 346630 - RNA, 22 nt, Homo sapiens
acucugucuaguuguaaaauuu

SEQ ID NO: 346631 - RNA, 22 nt, Homo sapiens
acugaauguaaacacggagugu

SEQ ID NO: 346632 - RNA, 21 nt, Homo sapiens
acugagagaucuggggcacau

SEQ ID NO: 346633 - RNA, 21 nt, Homo sapiens
acugcacuccaaccucaacag

SEQ ID NO: 346634 - RNA, 20 nt, Homo sapiens
acugcacuccaaccuuugug

SEQ ID NO: 346635 - RNA, 22 nt, Homo sapiens
acugcacuccagacucugucuc

SEQ ID NO: 346636 - RNA, 22 nt, Homo sapiens
acugcacuccagcccaggugac

SEQ ID NO: 346637 - RNA, 22 nt, Homo sapiens
acugcacuccagcccgggugac

SEQ ID NO: 346638 - RNA, 22 nt, Homo sapiens
acugcacuccagccucgcaaca

SEQ ID NO: 346639 - RNA, 22 nt, Homo sapiens
acugcacuccagccucguggac

SEQ ID NO: 346640 - RNA, 22 nt, Homo sapiens
acugcacuccagccugcccaac

SEQ ID NO: 346641 - RNA, 22 nt, Homo sapiens
acugcacuccagccugccgaca

SEQ ID NO: 346642 - RNA, 22 nt, Homo sapiens
acugcacuccagccuggaccac

SEQ ID NO: 346643 - RNA, 22 nt, Homo sapiens
acugcacuccagccuggacgaa

SEQ ID NO: 346644 - RNA, 22 nt, Homo sapiens
acugcacuccagccugugcgua

SEQ ID NO: 346645 - RNA, 22 nt, Homo sapiens
acugcacuccagccuguugaca

SEQ ID NO: 346646 - RNA, 20 nt, Homo sapiens
acugcacuccagccuuccag

SEQ ID NO: 346647 - RNA, 22 nt, Homo sapiens
acugcacuccagccuucggaca

SEQ ID NO: 346648 - RNA, 22 nt, Homo sapiens
acugcacuccagccuugcgaca

SEQ ID NO: 346649 - RNA, 22 nt, Homo sapiens
acugcacuccagccuuugcgau

SEQ ID NO: 346650 - RNA, 22 nt, Homo sapiens
acugcacuccagcuuuggugac

SEQ ID NO: 346651 - RNA, 22 nt, Homo sapiens
acugcacuccaguuccgggcaa

SEQ ID NO: 346652 - RNA, 22 nt, Homo sapiens
acugcacuccaucuuagguggc

SEQ ID NO: 346653 - RNA, 22 nt, Homo sapiens
acugcacucccgcccgggugac

SEQ ID NO: 346654 - RNA, 22 nt, Homo sapiens
acugcacucuagccuuggcaac

SEQ ID NO: 346655 - RNA, 22 nt, Homo sapiens
acugcacugcagccuggccaac

SEQ ID NO: 346656 - RNA, 22 nt, Homo sapiens
acugcacugucaaccuccuggg

SEQ ID NO: 346657 - RNA, 22 nt, Homo sapiens
acugcacuucaaccucauugac

SEQ ID NO: 346658 - RNA, 22 nt, Homo sapiens
acugcacuucagccuuggcuac

SEQ ID NO: 346659 - RNA, 22 nt, Homo sapiens
acugcacuucagccuuggggac

SEQ ID NO: 346660 - RNA, 22 nt, Homo sapiens
acugcauaaauauguguaauau

SEQ ID NO: 346661 - RNA, 22 nt, Homo sapiens
acugcauuugguaaagucaaga

SEQ ID NO: 346662 - RNA, 22 nt, Homo sapiens
acugcauuugucugucucaauu

SEQ ID NO: 346663 - RNA, 18 nt, Homo sapiens
acuggauguaaagggucc

SEQ ID NO: 346664 - RNA, 22 nt, Homo sapiens
acuggcuuauuucacuuagcau

SEQ ID NO: 346665 - RNA, 20 nt, Homo sapiens
acugggcuaccgaaguaagg

SEQ ID NO: 346666 - RNA, 22 nt, Homo sapiens
acuguacuccauccugggugac

SEQ ID NO: 346667 - RNA, 22 nt, Homo sapiens
acuguguguuugucuagcacag

SEQ ID NO: 346668 - RNA, 22 nt, Homo sapiens
agaaauguuuacucacccccuu

SEQ ID NO: 346669 - RNA, 22 nt, Homo sapiens
agaaauguuuauucaaacccgu

SEQ ID NO: 346670 - RNA, 22 nt, Homo sapiens
agaacacugaguucagggucag

SEQ ID NO: 346671 - RNA, 20 nt, Homo sapiens
agaagcauugcucucuucag

SEQ ID NO: 346672 - RNA, 22 nt, Homo sapiens
agaaugauccuucucagaggca

SEQ ID NO: 346673 - RNA, 22 nt, Homo sapiens
agaauguaaacagaauagagga

SEQ ID NO: 346674 - RNA, 20 nt, Homo sapiens
agacaguguggagauuccuu

SEQ ID NO: 346675 - RNA, 22 nt, Homo sapiens
agacucauuuccauagucagcu

SEQ ID NO: 346676 - RNA, 19 nt, Homo sapiens
agacuggcccaggcgggug

SEQ ID NO: 346677 - RNA, 22 nt, Homo sapiens
agacuuagagagucuauucuau

SEQ ID NO: 346678 - RNA, 22 nt, Homo sapiens
agagagguggguggagccccca

SEQ ID NO: 346679 - RNA, 22 nt, Homo sapiens
agagauaaagauuuuaauuuug

SEQ ID NO: 346680 - RNA, 22 nt, Homo sapiens
agagcaaugggugaauauuaaa

SEQ ID NO: 346681 - RNA, 22 nt, Homo sapiens
agagccacauuaaauaugggaa

SEQ ID NO: 346682 - RNA, 22 nt, Homo sapiens
agaggaguacuacuccaagucu

SEQ ID NO: 346683 - RNA, 22 nt, Homo sapiens
agagguauacauuugagagcca

SEQ ID NO: 346684 - RNA, 22 nt, Homo sapiens
agaguaguuuauuaugcuaagg

SEQ ID NO: 346685 - RNA, 22 nt, Homo sapiens
agagugcaauggcaccaucucg

SEQ ID NO: 346686 - RNA, 22 nt, Homo sapiens
agagugcuauagauuagauuuc

SEQ ID NO: 346687 - RNA, 22 nt, Homo sapiens
agauacauuggauaaugguggg

SEQ ID NO: 346688 - RNA, 22 nt, Homo sapiens
agaucaauugcugauucgcucu

SEQ ID NO: 346689 - RNA, 22 nt, Homo sapiens
agaucauaugcaguaaugaacu

SEQ ID NO: 346690 - RNA, 23 nt, Homo sapiens
agauggcauuucaguucuuuagg

SEQ ID NO: 346691 - RNA, 22 nt, Homo sapiens
agcaacauagaaauuugggugg

SEQ ID NO: 346692 - RNA, 22 nt, Homo sapiens
agcaacaucagcagcaggaaaa

SEQ ID NO: 346693 - RNA, 22 nt, Homo sapiens
agcaacauuguucauaauagcu

SEQ ID NO: 346694 - RNA, 22 nt, Homo sapiens
agcaagaaugaacucucccaga

SEQ ID NO: 346695 - RNA, 22 nt, Homo sapiens
agcaagacauggcuuccaaaug

SEQ ID NO: 346696 - RNA, 22 nt, Homo sapiens
agcaagaugaaguugagcuagg

SEQ ID NO: 346697 - RNA, 17 nt, Homo sapiens
agcaccacacucucuug

SEQ ID NO: 346698 - RNA, 22 nt, Homo sapiens
agcaccacauacuacagagaua

SEQ ID NO: 346699 - RNA, 22 nt, Homo sapiens
agcaccauuuauugaaaagaca

SEQ ID NO: 346700 - RNA, 22 nt, Homo sapiens
agcagcacaucccuuucuggcc

SEQ ID NO: 346701 - RNA, 17 nt, Homo sapiens
agcagcccauaucccca

SEQ ID NO: 346702 - RNA, 21 nt, Homo sapiens
agcagcuuugguugaagcaga

SEQ ID NO: 346703 - RNA, 22 nt, Homo sapiens
agcagguguggcuuauccugaa

SEQ ID NO: 346704 - RNA, 16 nt, Homo sapiens
agcagguguuagguga

SEQ ID NO: 346705 - RNA, 19 nt, Homo sapiens
agcaguguggagauuucuc

SEQ ID NO: 346706 - RNA, 18 nt, Homo sapiens
agcaucacugaucauccu

SEQ ID NO: 346707 - RNA, 22 nt, Homo sapiens
uccuuggugacauuucuugucu

SEQ ID NO: 346708 - RNA, 22 nt, Homo sapiens
uccuugguugauccugugcaga

SEQ ID NO: 346709 - RNA, 22 nt, Homo sapiens
uccuuuagacugaauccugaga

SEQ ID NO: 346710 - RNA, 22 nt, Homo sapiens
gccaguguguguuguucuccgc

SEQ ID NO: 346711 - RNA, 22 nt, Homo sapiens
gccaguguuuuauugagaauuu

SEQ ID NO: 346712 - RNA, 22 nt, Homo sapiens
gccauugcacuccagccucggc

SEQ ID NO: 346713 - RNA, 22 nt, Homo sapiens
gccauugcacuccagccugagc

SEQ ID NO: 346714 - RNA, 22 nt, Homo sapiens
gccauugcacucuagccugagc

SEQ ID NO: 346715 - RNA, 22 nt, Homo sapiens
gcccugauacauucuucugccu

SEQ ID NO: 346716 - RNA, 22 nt, Homo sapiens
gccuagagaaguaaauauuauc

SEQ ID NO: 346717 - RNA, 22 nt, Homo sapiens
gccucaguuguggccagggauu

SEQ ID NO: 346718 - RNA, 22 nt, Homo sapiens
gccuguagaagaguagaugacc

SEQ ID NO: 346719 - RNA, 22 nt, Homo sapiens
gccuuuggugacaggcaugugu

SEQ ID NO: 346720 - RNA, 22 nt, Homo sapiens
gcuauggccugaauguuugugu

SEQ ID NO: 346721 - RNA, 22 nt, Homo sapiens
gcuaugucuguugcucuugggc

SEQ ID NO: 346722 - RNA, 22 nt, Homo sapiens
gcuccauuuuccauuucucuaa

SEQ ID NO: 346723 - RNA, 22 nt, Homo sapiens
gcugaguaguauuucauuguau

SEQ ID NO: 346724 - RNA, 22 nt, Homo sapiens
gcugauguuggccucugggcuu

SEQ ID NO: 346725 - RNA, 22 nt, Homo sapiens
gcugcacuuuaaggcauccccu

SEQ ID NO: 346726 - RNA, 22 nt, Homo sapiens
gcugguauuacaggcaugagcc

SEQ ID NO: 346727 - RNA, 22 nt, Homo sapiens
gcuggugaaggcugaaaagugg

SEQ ID NO: 346728 - RNA, 22 nt, Homo sapiens
gcugguguagagugcagaaagg

SEQ ID NO: 346729 - RNA, 22 nt, Homo sapiens
gcuguguucucgaggcggggga

SEQ ID NO: 346730 - RNA, 22 nt, Homo sapiens
gcuuggugugcaagugguacua

SEQ ID NO: 346731 - RNA, 22 nt, Homo sapiens
gcuuguguuugcuccccagaau

SEQ ID NO: 346732 - RNA, 22 nt, Homo sapiens
gcuuuggcauguagauguaugg

SEQ ID NO: 346733 - RNA, 22 nt, Homo sapiens
gcuuuguugauggugagucugu

SEQ ID NO: 346734 - RNA, 22 nt, Homo sapiens
gcuuuguuguugaugggaaauc

SEQ ID NO: 346735 - RNA, 22 nt, Homo sapiens
gcuuuuggaggaacuuaagauu

SEQ ID NO: 346736 - RNA, 18 nt, Homo sapiens
ggaaaacuuuucuaagua

SEQ ID NO: 346737 - RNA, 21 nt, Homo sapiens
ggaaaguuaaggaaauacccc

SEQ ID NO: 346738 - RNA, 22 nt, Homo sapiens
ggaaauguuggugucaugaguu

SEQ ID NO: 346739 - RNA, 22 nt, Homo sapiens
ggaaauguuuagcauccacuuu

SEQ ID NO: 346740 - RNA, 22 nt, Homo sapiens
ggaacaccauuuuuccugccuu

SEQ ID NO: 346741 - RNA, 22 nt, Homo sapiens
ggaagagugaauuaucuugacu

SEQ ID NO: 346742 - RNA, 22 nt, Homo sapiens
ggaaguauaaacuuaguggagu

SEQ ID NO: 346743 - RNA, 22 nt, Homo sapiens
ggaaguuaauacagauagagua

SEQ ID NO: 346744 - RNA, 20 nt, Homo sapiens
ggaauagucuacacucugac

SEQ ID NO: 346745 - RNA, 23 nt, Homo sapiens
ggaaugaaaccugguuaugauau

SEQ ID NO: 346746 - RNA, 22 nt, Homo sapiens
ggaauggaacaaagucuugaaa

SEQ ID NO: 346747 - RNA, 22 nt, Homo sapiens
ggaaugggauuugaagucuggc

SEQ ID NO: 346748 - RNA, 22 nt, Homo sapiens
ggaauuaaggcaauugaaagcu

SEQ ID NO: 346749 - RNA, 22 nt, Homo sapiens
ggacacaucaugugaccaaggu

SEQ ID NO: 346750 - RNA, 22 nt, Homo sapiens
ggacagaaaggguucaccaaac

SEQ ID NO: 346751 - RNA, 22 nt, Homo sapiens
ggacugagaggacuacagugua

SEQ ID NO: 346752 - RNA, 22 nt, Homo sapiens
ggagaucuuguuaaaguacaga

SEQ ID NO: 346753 - RNA, 22 nt, Homo sapiens
ggagaucuuugaaguguugugc

SEQ ID NO: 346754 - RNA, 22 nt, Homo sapiens
ggagaugauuaugaaucacuua

SEQ ID NO: 346755 - RNA, 22 nt, Homo sapiens
ggagcugugauuugaguccaga

SEQ ID NO: 346756 - RNA, 20 nt, Homo sapiens
ggagguuguauaaguacauc

SEQ ID NO: 346757 - RNA, 22 nt, Homo sapiens
ggaguaggcuguccggcaccca

SEQ ID NO: 346758 - RNA, 22 nt, Homo sapiens
ggagugcuguuguuacacaagg

SEQ ID NO: 346759 - RNA, 22 nt, Homo sapiens
ggagugugauuguucucuguua

SEQ ID NO: 346760 - RNA, 22 nt, Homo sapiens
ggaguucaucaggugaggggua

SEQ ID NO: 346761 - RNA, 23 nt, Homo sapiens
ggauggaaaguuuugagggccac

SEQ ID NO: 346762 - RNA, 22 nt, Homo sapiens
ggcaaaugaagauggagaggcu

SEQ ID NO: 346763 - RNA, 22 nt, Homo sapiens
ggcaagaaaaugcaauuacugu

SEQ ID NO: 346764 - RNA, 22 nt, Homo sapiens
ggcaagaaccucaauuaccuuu

SEQ ID NO: 346765 - RNA, 17 nt, Homo sapiens
ggcaagaaguggaacuc

SEQ ID NO: 346766 - RNA, 23 nt, Homo sapiens
ggcaagaucucagcucacugcaa

SEQ ID NO: 346767 - RNA, 23 nt, Homo sapiens
ggcacggaauucaaagaggcauu

SEQ ID NO: 346768 - RNA, 22 nt, Homo sapiens
ggcacugugaugugagggggua

SEQ ID NO: 346769 - RNA, 22 nt, Homo sapiens
ggcagaguggacauuuaaaugu

SEQ ID NO: 346770 - RNA, 22 nt, Homo sapiens
ggcagguaaggagugggagccu

SEQ ID NO: 346771 - RNA, 21 nt, Homo sapiens
ggcaugaauggaaaagugaga

SEQ ID NO: 346772 - RNA, 22 nt, Homo sapiens
ggcaugaugcgcacgccuguag

SEQ ID NO: 346773 - RNA, 22 nt, Homo sapiens
ggcaugauggcugaggcuucug

SEQ ID NO: 346774 - RNA, 22 nt, Homo sapiens
ggccagaugcgguggcucacac

SEQ ID NO: 346775 - RNA, 22 nt, Homo sapiens
ggcccugagacaggaaaaagcu

SEQ ID NO: 346776 - RNA, 22 nt, Homo sapiens
ggccuguaaacuagagacccug

SEQ ID NO: 346777 - RNA, 22 nt, Homo sapiens
ggccuguaggguauugguaggg

SEQ ID NO: 346778 - RNA, 22 nt, Homo sapiens
ggcgguguugauggcccccaca

SEQ ID NO: 346779 - RNA, 22 nt, Homo sapiens
ggcuacauuguuacaauuagua

SEQ ID NO: 346780 - RNA, 22 nt, Homo sapiens
ggcuagagacaaguugcugaga

SEQ ID NO: 346781 - RNA, 22 nt, Homo sapiens
ggcuagagagcucagggauaug

SEQ ID NO: 346782 - RNA, 22 nt, Homo sapiens
ggcucaguuuccuccgucugcu

SEQ ID NO: 346783 - RNA, 22 nt, Homo sapiens
gggagcaaaaaugaugcccaag

SEQ ID NO: 346784 - RNA, 22 nt, Homo sapiens
gggagcacaagaaauguuucau

SEQ ID NO: 346785 - RNA, 19 nt, Homo sapiens
gggaggaugcgucuucagg

SEQ ID NO: 346786 - RNA, 22 nt, Homo sapiens
gggagguuguauguaugcgggg

SEQ ID NO: 346787 - RNA, 22 nt, Homo sapiens
gggaugaagcccuaggguuggu

SEQ ID NO: 346788 - RNA, 22 nt, Homo sapiens
gggaugaauuagguauguuuau

SEQ ID NO: 346789 - RNA, 22 nt, Homo sapiens
gggauguuuuauacugagccug

SEQ ID NO: 346790 - RNA, 23 nt, Homo sapiens
gggauuguaaaauaugagggcag

SEQ ID NO: 346791 - RNA, 22 nt, Homo sapiens
gggcaaaacuguacugccaagg

SEQ ID NO: 346792 - RNA, 22 nt, Homo sapiens
gggcaugauggugcacacaugu

SEQ ID NO: 346793 - RNA, 22 nt, Homo sapiens
gggcaugaugucuuaugccuau

SEQ ID NO: 346794 - RNA, 22 nt, Homo sapiens
gggggagugugguacccagcau

SEQ ID NO: 346795 - RNA, 22 nt, Homo sapiens
ggggucaucagagaaucuaccc

SEQ ID NO: 346796 - RNA, 22 nt, Homo sapiens
ggggucauuaaauuccgcuggu

SEQ ID NO: 346797 - RNA, 19 nt, Homo sapiens
gggucaguuugaaugauua

SEQ ID NO: 346798 - RNA, 22 nt, Homo sapiens
gggucaguuuugagaaagcgug

SEQ ID NO: 346799 - RNA, 22 nt, Homo sapiens
gguaaaucuucacuaagacuga

SEQ ID NO: 346800 - RNA, 22 nt, Homo sapiens
gguagacucuguaagugaucau

SEQ ID NO: 346801 - RNA, 22 nt, Homo sapiens
gguauugguugagauuaacuuu

SEQ ID NO: 346802 - RNA, 22 nt, Homo sapiens
ggucaagcuagauuuuaaugau

SEQ ID NO: 346803 - RNA, 22 nt, Homo sapiens
ggucauagagaauucaccagga

SEQ ID NO: 346804 - RNA, 22 nt, Homo sapiens
ggucauggauguuuauaguaca

SEQ ID NO: 346805 - RNA, 22 nt, Homo sapiens
aggugcugagcagagaauccug

SEQ ID NO: 346806 - RNA, 22 nt, Homo sapiens
aggugcuugagggaagaaauua

SEQ ID NO: 346807 - RNA, 21 nt, Homo sapiens
aggugucuuggguucccuggc

SEQ ID NO: 346808 - RNA, 22 nt, Homo sapiens
aguaaacuucagaguucuuccu

SEQ ID NO: 346809 - RNA, 22 nt, Homo sapiens
aguaccauuagauuaggaugac

SEQ ID NO: 346810 - RNA, 22 nt, Homo sapiens
aguacugucugguuaccugaca

SEQ ID NO: 346811 - RNA, 21 nt, Homo sapiens
aguagcacugugucuuacaaa

SEQ ID NO: 346812 - RNA, 22 nt, Homo sapiens
agucacagccuuuuacuuuaga

SEQ ID NO: 346813 - RNA, 22 nt, Homo sapiens
agucacaugcauuuucuucaau

SEQ ID NO: 346814 - RNA, 22 nt, Homo sapiens
agucagugucuguaaggagaac

SEQ ID NO: 346815 - RNA, 22 nt, Homo sapiens
agucauaggagagauaucacug

SEQ ID NO: 346816 - RNA, 21 nt, Homo sapiens
agucauaggaguacauaaugc

SEQ ID NO: 346817 - RNA, 22 nt, Homo sapiens
agucauggaucacaguagccuc

SEQ ID NO: 346818 - RNA, 22 nt, Homo sapiens
agugaaaucugaagaaggucau

SEQ ID NO: 346819 - RNA, 22 nt, Homo sapiens
agugaauguuggaaaguuauuu

SEQ ID NO: 346820 - RNA, 17 nt, Homo sapiens
agugagaucauggcuua

SEQ ID NO: 346821 - RNA, 22 nt, Homo sapiens
agugagcuggagaaaagaaacu

SEQ ID NO: 346822 - RNA, 22 nt, Homo sapiens
agugcacucuuuccucucuuac

SEQ ID NO: 346823 - RNA, 22 nt, Homo sapiens
aguggaauuaagaaacugaauu

SEQ ID NO: 346824 - RNA, 22 nt, Homo sapiens
aguggauuuuauuugacaacua

SEQ ID NO: 346825 - RNA, 22 nt, Homo sapiens
aguggcacaauuuugacucccc

SEQ ID NO: 346826 - RNA, 22 nt, Homo sapiens
aguggguguuccauuggauaaa

SEQ ID NO: 346827 - RNA, 19 nt, Homo sapiens
aguggguguuuucuguuug

SEQ ID NO: 346828 - RNA, 22 nt, Homo sapiens
aguucaaaucgagccuggccau

SEQ ID NO: 346829 - RNA, 22 nt, Homo sapiens
auaaaagcaggucuaggucagg

SEQ ID NO: 346830 - RNA, 18 nt, Homo sapiens
auaaacucaucauuuuua

SEQ ID NO: 346831 - RNA, 22 nt, Homo sapiens
auaaaugcuuccagucauuaaa

SEQ ID NO: 346832 - RNA, 20 nt, Homo sapiens
auaaauguauagguguacau

SEQ ID NO: 346833 - RNA, 22 nt, Homo sapiens
auaacucuguuuuuuucaugca

SEQ ID NO: 346834 - RNA, 22 nt, Homo sapiens
auaaguauuuggacuuuacugu

SEQ ID NO: 346835 - RNA, 22 nt, Homo sapiens
auaauacugggaagaugagcau

SEQ ID NO: 346836 - RNA, 22 nt, Homo sapiens
auaauagcugaucauuuagaag

SEQ ID NO: 346837 - RNA, 23 nt, Homo sapiens
auaaugcaaguggugguaaucug

SEQ ID NO: 346838 - RNA, 22 nt, Homo sapiens
auaauguuugauugagcagaua

SEQ ID NO: 346839 - RNA, 22 nt, Homo sapiens
auacaaggaaugaagagauuug

SEQ ID NO: 346840 - RNA, 22 nt, Homo sapiens
auacaguaucuucuggcaagca

SEQ ID NO: 346841 - RNA, 22 nt, Homo sapiens
auacaguguucugggaagaagu

SEQ ID NO: 346842 - RNA, 22 nt, Homo sapiens
auacaugugccauguugguaug

SEQ ID NO: 346843 - RNA, 22 nt, Homo sapiens
auacaugugugagcgaagaugu

SEQ ID NO: 346844 - RNA, 16 nt, Homo sapiens
auaccacagugacaca

SEQ ID NO: 346845 - RNA, 22 nt, Homo sapiens
auacccauacauauuggugacu

SEQ ID NO: 346846 - RNA, 22 nt, Homo sapiens
auacuagucaagaauguaugag

SEQ ID NO: 346847 - RNA, 22 nt, Homo sapiens
auacuaugagauaauaaagacu

SEQ ID NO: 346848 - RNA, 22 nt, Homo sapiens
auacuccugucucagcugagau

SEQ ID NO: 346849 - RNA, 22 nt, Homo sapiens
auacugccuuuagcaaaacagu

SEQ ID NO: 346850 - RNA, 21 nt, Homo sapiens
auacuugagacuggguaauuu

SEQ ID NO: 346851 - RNA, 22 nt, Homo sapiens
auagagcuaccauagaauccag

SEQ ID NO: 346852 - RNA, 22 nt, Homo sapiens
auagagugcuucaucaguagua

SEQ ID NO: 346853 - RNA, 22 nt, Homo sapiens
auagcacauggcauccucucuu

SEQ ID NO: 346854 - RNA, 22 nt, Homo sapiens
auagcagcaccucacucuacug

SEQ ID NO: 346855 - RNA, 22 nt, Homo sapiens
auagcccauuuguugguccugg

SEQ ID NO: 346856 - RNA, 19 nt, Homo sapiens
auaguguaggaaaacagcu

SEQ ID NO: 346857 - RNA, 22 nt, Homo sapiens
auauagcaaugaaagagaugaa

SEQ ID NO: 346858 - RNA, 22 nt, Homo sapiens
auauaugcuaagugcuaauaaa

SEQ ID NO: 346859 - RNA, 22 nt, Homo sapiens
auaucaaggccauuuucuaaau

SEQ ID NO: 346860 - RNA, 22 nt, Homo sapiens
auaucacaaacaagucuguacu

SEQ ID NO: 346861 - RNA, 22 nt, Homo sapiens
auaugcacaguggaguacuauu

SEQ ID NO: 346862 - RNA, 22 nt, Homo sapiens
auaugcauguacccacacaggc

SEQ ID NO: 346863 - RNA, 20 nt, Homo sapiens
auaugcauguguuuucacuu

SEQ ID NO: 346864 - RNA, 21 nt, Homo sapiens
aucucacuugaauguaaaagc

SEQ ID NO: 346865 - RNA, 22 nt, Homo sapiens
aucucauggagguagagaguaa

SEQ ID NO: 346866 - RNA, 20 nt, Homo sapiens
aucucugggcaaaggaaaau

SEQ ID NO: 346867 - RNA, 22 nt, Homo sapiens
aucugcaaagcugggcugagac

SEQ ID NO: 346868 - RNA, 22 nt, Homo sapiens
aucugcaaauaaugaagauugg

SEQ ID NO: 346869 - RNA, 22 nt, Homo sapiens
aucugcauuagggugaagaccu

SEQ ID NO: 346870 - RNA, 22 nt, Homo sapiens
aucugcuccuggugaggguuuc

SEQ ID NO: 346871 - RNA, 22 nt, Homo sapiens
aucuggguccguucugcuucuc

SEQ ID NO: 346872 - RNA, 22 nt, Homo sapiens
aucuuugauugaagggacccug

SEQ ID NO: 346873 - RNA, 22 nt, Homo sapiens
augaaagguugucuuaagccau

SEQ ID NO: 346874 - RNA, 22 nt, Homo sapiens
augaaauugcuaucgcaguacu

SEQ ID NO: 346875 - RNA, 22 nt, Homo sapiens
augaagaucucugccuuguguc

SEQ ID NO: 346876 - RNA, 22 nt, Homo sapiens
augaagauguugccuuuuuaau

SEQ ID NO: 346877 - RNA, 22 nt, Homo sapiens
augaagucguuacuaccaauug

SEQ ID NO: 346878 - RNA, 23 nt, Homo sapiens
augaauguaaggaguguaagaaa

SEQ ID NO: 346879 - RNA, 22 nt, Homo sapiens
augaauuuucugauguugggua

SEQ ID NO: 346880 - RNA, 23 nt, Homo sapiens
augacacuguccuugaccauuuc

SEQ ID NO: 346881 - RNA, 22 nt, Homo sapiens
augacaguaugacuccaaaagu

SEQ ID NO: 346882 - RNA, 22 nt, Homo sapiens
augacauguauuuccaggauuu

SEQ ID NO: 346883 - RNA, 22 nt, Homo sapiens
augacauugaaaagcaagugga

SEQ ID NO: 346884 - RNA, 22 nt, Homo sapiens
augaccagagagugcgcagggu

SEQ ID NO: 346885 - RNA, 22 nt, Homo sapiens
augacguugugggcucucaagc

SEQ ID NO: 346886 - RNA, 20 nt, Homo sapiens
augacuagaggacaugguaa

SEQ ID NO: 346887 - RNA, 22 nt, Homo sapiens
augacuagaggagggauggcca

SEQ ID NO: 346888 - RNA, 22 nt, Homo sapiens
augacugagacuaacuuacuuu

SEQ ID NO: 346889 - RNA, 22 nt, Homo sapiens
augacugucuugcagaggcuau

SEQ ID NO: 346890 - RNA, 22 nt, Homo sapiens
augagauaggaacaaacuuaca

SEQ ID NO: 346891 - RNA, 22 nt, Homo sapiens
augagaucaaauuuaagcuguu

SEQ ID NO: 346892 - RNA, 22 nt, Homo sapiens
augagaugauaggcguucuaac

SEQ ID NO: 346893 - RNA, 22 nt, Homo sapiens
augagauuauguaaagagacca

SEQ ID NO: 346894 - RNA, 22 nt, Homo sapiens
augagcagaugcuccugccucu

SEQ ID NO: 346895 - RNA, 22 nt, Homo sapiens
augagcugauuuccuuaccaua

SEQ ID NO: 346896 - RNA, 22 nt, Homo sapiens
augaggaaggagccuuugucug

SEQ ID NO: 346897 - RNA, 22 nt, Homo sapiens
augaggugaguaaauaaaugaa

SEQ ID NO: 346898 - RNA, 20 nt, Homo sapiens
augagguguaugacacugaa

SEQ ID NO: 346899 - RNA, 22 nt, Homo sapiens
augauaaguuauuagaagaaga

SEQ ID NO: 346900 - RNA, 22 nt, Homo sapiens
augaucacaccacugcacucca

SEQ ID NO: 346901 - RNA, 22 nt, Homo sapiens
augaugcaguacuuugggaaca

SEQ ID NO: 346902 - RNA, 22 nt, Homo sapiens
augcaaacaucugaagagacau

SEQ ID NO: 346903 - RNA, 22 nt, Homo sapiens
augcaagacaccgauuagcuuu

SEQ ID NO: 346904 - RNA, 22 nt, Homo sapiens
augcaauggaaaggacaauuac

SEQ ID NO: 346905 - RNA, 22 nt, Homo sapiens
augcacuguauaggaucuugcg

SEQ ID NO: 346906 - RNA, 22 nt, Homo sapiens
augccaagagacaaagggaauc

SEQ ID NO: 346907 - RNA, 22 nt, Homo sapiens
augccacugcacuccaaccugg

SEQ ID NO: 346908 - RNA, 22 nt, Homo sapiens
augcccauuuguuuucugaaag

SEQ ID NO: 346909 - RNA, 19 nt, Homo sapiens
augccuggagaugguuaua

SEQ ID NO: 346910 - RNA, 22 nt, Homo sapiens
augcuguuuuguagcucccucu

SEQ ID NO: 346911 - RNA, 22 nt, Homo sapiens
auggaauguauagucauguagg

SEQ ID NO: 346912 - RNA, 22 nt, Homo sapiens
auggaggaggaagcugaaacaa

SEQ ID NO: 346913 - RNA, 22 nt, Homo sapiens
auggaggccuacagaauuuugg

SEQ ID NO: 346914 - RNA, 19 nt, Homo sapiens
auggauacauuuucugcua

SEQ ID NO: 346915 - RNA, 22 nt, Homo sapiens
auggaucauauucuugaggagg

SEQ ID NO: 346916 - RNA, 22 nt, Homo sapiens
auggauuuguaguacaugguug

SEQ ID NO: 346917 - RNA, 22 nt, Homo sapiens
auggcaaaauguuccuaguggu

SEQ ID NO: 346918 - RNA, 22 nt, Homo sapiens
auggcacagacucuuggucaag

SEQ ID NO: 346919 - RNA, 22 nt, Homo sapiens
auggcaguuucagcuauaguuu

SEQ ID NO: 346920 - RNA, 22 nt, Homo sapiens
auggcauugaagaguugucccu

SEQ ID NO: 346921 - RNA, 23 nt, Homo sapiens
auggcccuggugggagugucuuu

SEQ ID NO: 346922 - RNA, 22 nt, Homo sapiens
auggcccuguguggagcugcug

SEQ ID NO: 346923 - RNA, 22 nt, Homo sapiens
auggcucuuauuauuuugaggu

SEQ ID NO: 346924 - RNA, 22 nt, Homo sapiens
auggcuguuuaagaguuucauu

SEQ ID NO: 346925 - RNA, 22 nt, Homo sapiens
uugaauagaagguuuuuuguuc

SEQ ID NO: 346926 - RNA, 22 nt, Homo sapiens
uugaauguacuuguucucacua

SEQ ID NO: 346927 - RNA, 22 nt, Homo sapiens
uugaaugucuauuaaguuguuu

SEQ ID NO: 346928 - RNA, 22 nt, Homo sapiens
uugacagaccuuggucauaucc

SEQ ID NO: 346929 - RNA, 21 nt, Homo sapiens
uugacagugacagguaaaguu

SEQ ID NO: 346930 - RNA, 22 nt, Homo sapiens
uugacuguaagauggcuauuac

SEQ ID NO: 346931 - RNA, 22 nt, Homo sapiens
uugacuucagagcugauucaag

SEQ ID NO: 346932 - RNA, 22 nt, Homo sapiens
uugacuuuuaggaggaaaauga

SEQ ID NO: 346933 - RNA, 22 nt, Homo sapiens
uugacuuuuauucacucugcua

SEQ ID NO: 346934 - RNA, 22 nt, Homo sapiens
uugagacggagucucacucugu

SEQ ID NO: 346935 - RNA, 22 nt, Homo sapiens
uugagauacauaauuaugaaug

SEQ ID NO: 346936 - RNA, 22 nt, Homo sapiens
uugagaucuuuuaggccuuugu

SEQ ID NO: 346937 - RNA, 22 nt, Homo sapiens
uugagauggagcuucacucuug

SEQ ID NO: 346938 - RNA, 22 nt, Homo sapiens
uugagauggagucucacgcauu

SEQ ID NO: 346939 - RNA, 22 nt, Homo sapiens
uugagauggagucucacucuuc

SEQ ID NO: 346940 - RNA, 22 nt, Homo sapiens
uugagauggagucucguucugu

SEQ ID NO: 346941 - RNA, 22 nt, Homo sapiens
uugagauggaguuuugcucuug

SEQ ID NO: 346942 - RNA, 22 nt, Homo sapiens
uugagcaucauguuagcacuca

SEQ ID NO: 346943 - RNA, 22 nt, Homo sapiens
uugagcccuggaggcagaggcu

SEQ ID NO: 346944 - RNA, 22 nt, Homo sapiens
uugaggaaugucauuuguguuu

SEQ ID NO: 346945 - RNA, 22 nt, Homo sapiens
uugaggaggcagucugcccauu

SEQ ID NO: 346946 - RNA, 22 nt, Homo sapiens
uugaggccugauaacacacuga

SEQ ID NO: 346947 - RNA, 22 nt, Homo sapiens
uugagggaggccucaguuuaca

SEQ ID NO: 346948 - RNA, 22 nt, Homo sapiens
uugaggguggcauauauugauu

SEQ ID NO: 346949 - RNA, 20 nt, Homo sapiens
uugaggucaggaguuuggga

SEQ ID NO: 346950 - RNA, 22 nt, Homo sapiens
uugaggucuucaggaucaggcu

SEQ ID NO: 346951 - RNA, 22 nt, Homo sapiens
uugauauguaguuggacuugau

SEQ ID NO: 346952 - RNA, 22 nt, Homo sapiens
uugauauuacucaguaacagau

SEQ ID NO: 346953 - RNA, 22 nt, Homo sapiens
uugauauucugagaagcugaag

SEQ ID NO: 346954 - RNA, 22 nt, Homo sapiens
uugaucuggagagaggcccgug

SEQ ID NO: 346955 - RNA, 18 nt, Homo sapiens
uugcaaauucuucccugu

SEQ ID NO: 346956 - RNA, 22 nt, Homo sapiens
uugcaacauguauucuggugau

SEQ ID NO: 346957 - RNA, 22 nt, Homo sapiens
uugcaagaaaucagagccuucc

SEQ ID NO: 346958 - RNA, 22 nt, Homo sapiens
uugcaagauguuaacauuggag

SEQ ID NO: 346959 - RNA, 22 nt, Homo sapiens
uugcaaggugcucgaagggcuc

SEQ ID NO: 346960 - RNA, 22 nt, Homo sapiens
uugcacaauggaauuuaucuuu

SEQ ID NO: 346961 - RNA, 22 nt, Homo sapiens
uugcacagugcuuucuuugccc

SEQ ID NO: 346962 - RNA, 22 nt, Homo sapiens
uugcacuccagccuuggggaga

SEQ ID NO: 346963 - RNA, 22 nt, Homo sapiens
uugcacuccagcucuaggugac

SEQ ID NO: 346964 - RNA, 22 nt, Homo sapiens
uugcacuugcugaggagugauu

SEQ ID NO: 346965 - RNA, 22 nt, Homo sapiens
uugcagagaaauuucugguuua

SEQ ID NO: 346966 - RNA, 22 nt, Homo sapiens
uugcagcaaagagggaggggca

SEQ ID NO: 346967 - RNA, 19 nt, Homo sapiens
uugcauauguugaaccagg

SEQ ID NO: 346968 - RNA, 22 nt, Homo sapiens
acugcacuccagccuugauggc

SEQ ID NO: 346969 - RNA, 22 nt, Homo sapiens
acugcacuccagccuuggccac

SEQ ID NO: 346970 - RNA, 22 nt, Homo sapiens
acugcacuccagcuuuggguga

SEQ ID NO: 346971 - RNA, 20 nt, Homo sapiens
acugcacuccagucucuggg

SEQ ID NO: 346972 - RNA, 22 nt, Homo sapiens
acugcacuccggccucgugaca

SEQ ID NO: 346973 - RNA, 22 nt, Homo sapiens
acugcacucuagccccugcgac

SEQ ID NO: 346974 - RNA, 22 nt, Homo sapiens
acugcacucuagcuugggugac

SEQ ID NO: 346975 - RNA, 22 nt, Homo sapiens
acugcacuucagccuugugaca

SEQ ID NO: 346976 - RNA, 22 nt, Homo sapiens
acuggauguuagggauuuuauu

SEQ ID NO: 346977 - RNA, 22 nt, Homo sapiens
acuggcuuaaggaugggccacu

SEQ ID NO: 346978 - RNA, 22 nt, Homo sapiens
acuguacuccagccugggugac

SEQ ID NO: 346979 - RNA, 22 nt, Homo sapiens
acuguauagauggaguugauuu

SEQ ID NO: 346980 - RNA, 22 nt, Homo sapiens
acugugcuguuuuaauuauuga

SEQ ID NO: 346981 - RNA, 22 nt, Homo sapiens
acuuugcuuagagggcauuaaa

SEQ ID NO: 346982 - RNA, 22 nt, Homo sapiens
acuuuuguuauacagugugaua

SEQ ID NO: 346983 - RNA, 21 nt, Homo sapiens
agaaaaucuuaugggaaacau

SEQ ID NO: 346984 - RNA, 22 nt, Homo sapiens
agaaacauucucuugccuccuu

SEQ ID NO: 346985 - RNA, 22 nt, Homo sapiens
agaaagcgcuucccuuugcugg

SEQ ID NO: 346986 - RNA, 22 nt, Homo sapiens
agaaccaaucccacauggauac

SEQ ID NO: 346987 - RNA, 22 nt, Homo sapiens
agaacccuuugaaauguguuug

SEQ ID NO: 346988 - RNA, 22 nt, Homo sapiens
agaagaacauagggugacugaa

SEQ ID NO: 346989 - RNA, 22 nt, Homo sapiens
agaaugugaccuuauuuggaga

SEQ ID NO: 346990 - RNA, 22 nt, Homo sapiens
agacccuguauguguuuaguuu

SEQ ID NO: 346991 - RNA, 23 nt, Homo sapiens
agacugaaguaucugagacucag

SEQ ID NO: 346992 - RNA, 22 nt, Homo sapiens
agagagcuugggguguuaaauu

SEQ ID NO: 346993 - RNA, 22 nt, Homo sapiens
agagaugaagauggggcucccg

SEQ ID NO: 346994 - RNA, 20 nt, Homo sapiens
agagcaaagccgcaccccua

SEQ ID NO: 346995 - RNA, 22 nt, Homo sapiens
agaguaguaggaugaauggacu

SEQ ID NO: 346996 - RNA, 19 nt, Homo sapiens
agaguauuguuacuucucu

SEQ ID NO: 346997 - RNA, 21 nt, Homo sapiens
agagucaucucuaucuguacc

SEQ ID NO: 346998 - RNA, 22 nt, Homo sapiens
agagugaagcuuuuuauauucu

SEQ ID NO: 346999 - RNA, 20 nt, Homo sapiens
agagugcugucuguccugag

SEQ ID NO: 347000 - RNA, 23 nt, Homo sapiens
agaugcaucuggcugcgaggcaa

SEQ ID NO: 347001 - RNA, 22 nt, Homo sapiens
agaugcuguuaucaacuguagc

SEQ ID NO: 347002 - RNA, 22 nt, Homo sapiens
agauggugugcuaggaaaugua

SEQ ID NO: 347003 - RNA, 23 nt, Homo sapiens
agcaaaugcucuagcacuccaac

SEQ ID NO: 347004 - RNA, 22 nt, Homo sapiens
agcaacauggaguuugugcgca

SEQ ID NO: 347005 - RNA, 22 nt, Homo sapiens
agcaagauugauggccugcagg

SEQ ID NO: 347006 - RNA, 22 nt, Homo sapiens
agcaagauuguucccauuuucu

SEQ ID NO: 347007 - RNA, 22 nt, Homo sapiens
agcaauaugacauugcuacauc

SEQ ID NO: 347008 - RNA, 22 nt, Homo sapiens
agcacacuggguggcuuaaaca

SEQ ID NO: 347009 - RNA, 22 nt, Homo sapiens
agcaccacaauuuccugccuaa

SEQ ID NO: 347010 - RNA, 22 nt, Homo sapiens
agcaccaccguugcucuauccc

SEQ ID NO: 347011 - RNA, 22 nt, Homo sapiens
agcaccauuguacuccagccug

SEQ ID NO: 347012 - RNA, 22 nt, Homo sapiens
agcacgaaaccaaauucuguga

SEQ ID NO: 347013 - RNA, 22 nt, Homo sapiens
agcagagcaguggauuuuguga

SEQ ID NO: 347014 - RNA, 22 nt, Homo sapiens
agcagcaccaaacagacuaaga

SEQ ID NO: 347015 - RNA, 22 nt, Homo sapiens
agcagcaugcaaauggacuaau

SEQ ID NO: 347016 - RNA, 22 nt, Homo sapiens
agcagcauuccaaaaaucugcu

SEQ ID NO: 347017 - RNA, 20 nt, Homo sapiens
agcagccacagauuccucag

SEQ ID NO: 347018 - RNA, 22 nt, Homo sapiens
agcagcgacacccuguggugag

SEQ ID NO: 347019 - RNA, 22 nt, Homo sapiens
agcagcuuugaucugaaugauu

SEQ ID NO: 347020 - RNA, 22 nt, Homo sapiens
agcagcuuugcauggccuguga

SEQ ID NO: 347021 - RNA, 22 nt, Homo sapiens
agcaguacauaaaaagcauccu

SEQ ID NO: 347022 - RNA, 22 nt, Homo sapiens
agcaucauguuuucgagguuca

SEQ ID NO: 347023 - RNA, 22 nt, Homo sapiens
uuuaaagcuaaaauauguuuau

SEQ ID NO: 347024 - RNA, 23 nt, Homo sapiens
uuuaagcuucauguccuaacauc

SEQ ID NO: 347025 - RNA, 22 nt, Homo sapiens
uuuaagguauguggugaaaauu

SEQ ID NO: 347026 - RNA, 22 nt, Homo sapiens
uuuacaguuuucuaggcuacca

SEQ ID NO: 347027 - RNA, 22 nt, Homo sapiens
uuuacugucuucagucccucug

SEQ ID NO: 347028 - RNA, 22 nt, Homo sapiens
uuuagcaauggagggugacuuu

SEQ ID NO: 347029 - RNA, 22 nt, Homo sapiens
uuuaggcaugcaguucuauuua

SEQ ID NO: 347030 - RNA, 22 nt, Homo sapiens
uuuauucggcuaggagcuucgg

SEQ ID NO: 347031 - RNA, 22 nt, Homo sapiens
uuucaacuaauuuuuuggugag

SEQ ID NO: 347032 - RNA, 23 nt, Homo sapiens
uuucacaguagcuggaucagccu

SEQ ID NO: 347033 - RNA, 21 nt, Homo sapiens
uuucacugugaguuuuucugu

SEQ ID NO: 347034 - RNA, 18 nt, Homo sapiens
uuucaggguggacaugag

SEQ ID NO: 347035 - RNA, 22 nt, Homo sapiens
uuucauagccuuugucgucuga

SEQ ID NO: 347036 - RNA, 22 nt, Homo sapiens
uuucauggacgcaaugccuuuu

SEQ ID NO: 347037 - RNA, 22 nt, Homo sapiens
uuucauggagaaucuucuuacu

SEQ ID NO: 347038 - RNA, 22 nt, Homo sapiens
uuucauggcaguuuggggccug

SEQ ID NO: 347039 - RNA, 22 nt, Homo sapiens
uuucauguuuuucugugaggca

SEQ ID NO: 347040 - RNA, 19 nt, Homo sapiens
uuucauguuuuuggugaga

SEQ ID NO: 347041 - RNA, 22 nt, Homo sapiens
uuuccaguuggaaagccuguuu

SEQ ID NO: 347042 - RNA, 22 nt, Homo sapiens
uuuccaguuuggaggaugcauu

SEQ ID NO: 347043 - RNA, 22 nt, Homo sapiens
uuucccuuacuuaaacuuacuc

SEQ ID NO: 347044 - RNA, 22 nt, Homo sapiens
uuucccuuugcuuugucagcca

SEQ ID NO: 347045 - RNA, 22 nt, Homo sapiens
uuucugggggugcugauggaaa

SEQ ID NO: 347046 - RNA, 23 nt, Homo sapiens
uuucuugggcaugcuaugucagu

SEQ ID NO: 347047 - RNA, 22 nt, Homo sapiens
uuugaagugugaugccuugaug

SEQ ID NO: 347048 - RNA, 22 nt, Homo sapiens
uuugagcaugcagauugccagg

SEQ ID NO: 347049 - RNA, 22 nt, Homo sapiens
uuugcacuuuuguaauaugguu

SEQ ID NO: 347050 - RNA, 22 nt, Homo sapiens
uuugcagugucagcuucugugu

SEQ ID NO: 347051 - RNA, 22 nt, Homo sapiens
uuugcaguuuauuccuggggcu

SEQ ID NO: 347052 - RNA, 22 nt, Homo sapiens
uuugccaauauuuuauugagga

SEQ ID NO: 347053 - RNA, 22 nt, Homo sapiens
uuugcugagucugacuucaugg

SEQ ID NO: 347054 - RNA, 22 nt, Homo sapiens
uuugcuuaaaguccuuguggga

SEQ ID NO: 347055 - RNA, 22 nt, Homo sapiens
uuugcuuaguaaauguagaaaa

SEQ ID NO: 347056 - RNA, 22 nt, Homo sapiens
uuugcuucacuguuuggcaaaa

SEQ ID NO: 347057 - RNA, 22 nt, Homo sapiens
uuugcuugaggucuagcuaccc

SEQ ID NO: 347058 - RNA, 22 nt, Homo sapiens
uuuggacuucuagccuccagag

SEQ ID NO: 347059 - RNA, 20 nt, Homo sapiens
uuuggcacugagugguauaa

SEQ ID NO: 347060 - RNA, 22 nt, Homo sapiens
uuuggcagaaaacaagaaucug

SEQ ID NO: 347061 - RNA, 22 nt, Homo sapiens
uuuggcagaugacccucaaguu

SEQ ID NO: 347062 - RNA, 22 nt, Homo sapiens
guacaguacugaaugaauguau

SEQ ID NO: 347063 - RNA, 22 nt, Homo sapiens
guacaugcauacaugcacaucu

SEQ ID NO: 347064 - RNA, 22 nt, Homo sapiens
guagaagcacagggccuguauu

SEQ ID NO: 347065 - RNA, 22 nt, Homo sapiens
guagaauguauguauaacgcaa

SEQ ID NO: 347066 - RNA, 22 nt, Homo sapiens
guagagagaaauacaaagcugu

SEQ ID NO: 347067 - RNA, 22 nt, Homo sapiens
guaguagcacgagcucugucuc

SEQ ID NO: 347068 - RNA, 22 nt, Homo sapiens
guauacuucugaaaauagcuau

SEQ ID NO: 347069 - RNA, 22 nt, Homo sapiens
guaucauugccuaaugcucuca

SEQ ID NO: 347070 - RNA, 22 nt, Homo sapiens
guaugaaaaucggagauugggu

SEQ ID NO: 347071 - RNA, 22 nt, Homo sapiens
guaugcaagugauaugacauau

SEQ ID NO: 347072 - RNA, 22 nt, Homo sapiens
guauggaagucaguuuguuggc

SEQ ID NO: 347073 - RNA, 22 nt, Homo sapiens
guauuugauuauagcaugcuua

SEQ ID NO: 347074 - RNA, 22 nt, Homo sapiens
gucaagugaagcagugggagua

SEQ ID NO: 347075 - RNA, 22 nt, Homo sapiens
gucacaggaaacuaauaugcgc

SEQ ID NO: 347076 - RNA, 22 nt, Homo sapiens
gucaccagcuguguuagccccu

SEQ ID NO: 347077 - RNA, 22 nt, Homo sapiens
gucacugucuacuguaauagcc

SEQ ID NO: 347078 - RNA, 22 nt, Homo sapiens
gucacuguggagaagaaagugg

SEQ ID NO: 347079 - RNA, 22 nt, Homo sapiens
gucacuguuuccuauuauauuu

SEQ ID NO: 347080 - RNA, 22 nt, Homo sapiens
gucaggugcuuacgcggagauc

SEQ ID NO: 347081 - RNA, 22 nt, Homo sapiens
gucauaucauuggccaguggaa

SEQ ID NO: 347082 - RNA, 22 nt, Homo sapiens
gucauccaggcuggagugaagc

SEQ ID NO: 347083 - RNA, 22 nt, Homo sapiens
gucauggaggaugaauggccaa

SEQ ID NO: 347084 - RNA, 22 nt, Homo sapiens
gucauguuuaacuucuugagga

SEQ ID NO: 347085 - RNA, 22 nt, Homo sapiens
gucccagagauauugugucuuu

SEQ ID NO: 347086 - RNA, 22 nt, Homo sapiens
gucccugaggaacauccagggc

SEQ ID NO: 347087 - RNA, 22 nt, Homo sapiens
guccugaagaccuuccucugga

SEQ ID NO: 347088 - RNA, 22 nt, Homo sapiens
gucucacaggcaugaugccagc

SEQ ID NO: 347089 - RNA, 22 nt, Homo sapiens
gucugcaugucauaugauagua

SEQ ID NO: 347090 - RNA, 22 nt, Homo sapiens
gucuggagacuugggucaucaa

SEQ ID NO: 347091 - RNA, 22 nt, Homo sapiens
gucuggcacagggaaaguacaa

SEQ ID NO: 347092 - RNA, 22 nt, Homo sapiens
gucuggcuccuucuacuacaug

SEQ ID NO: 347093 - RNA, 22 nt, Homo sapiens
gucuggcuuaucucacuuacca

SEQ ID NO: 347094 - RNA, 22 nt, Homo sapiens
gucugugguuccuaugucaccu

SEQ ID NO: 347095 - RNA, 22 nt, Homo sapiens
gucuguuugauccagaucaaaa

SEQ ID NO: 347096 - RNA, 22 nt, Homo sapiens
gucuguuuggggaccuguggcc

SEQ ID NO: 347097 - RNA, 22 nt, Homo sapiens
gucuuggagacauugccauuga

SEQ ID NO: 347098 - RNA, 22 nt, Homo sapiens
gucuuuaguugaaacauguggu

SEQ ID NO: 347099 - RNA, 22 nt, Homo sapiens
gucuuugcauguauguucauga

SEQ ID NO: 347100 - RNA, 22 nt, Homo sapiens
gugaagugugaccucagcaucu

SEQ ID NO: 347101 - RNA, 22 nt, Homo sapiens
gugaaguuuuugugaggccuaa

SEQ ID NO: 347102 - RNA, 22 nt, Homo sapiens
gugaaugaaugggugaauacau

SEQ ID NO: 347103 - RNA, 22 nt, Homo sapiens
gugacuggacucugaagaaaau

SEQ ID NO: 347104 - RNA, 22 nt, Homo sapiens
gugagaugaggucucacucugu

SEQ ID NO: 347105 - RNA, 22 nt, Homo sapiens
gugagauggagucuugcuuugu

SEQ ID NO: 347106 - RNA, 22 nt, Homo sapiens
gugagaugugacuucugccucu

SEQ ID NO: 347107 - RNA, 22 nt, Homo sapiens
gugagauuuucuccagguucag

SEQ ID NO: 347108 - RNA, 22 nt, Homo sapiens
gugagccaugauuuuaccacug

SEQ ID NO: 347109 - RNA, 22 nt, Homo sapiens
gugagcuagaccacuuggcucc

SEQ ID NO: 347110 - RNA, 22 nt, Homo sapiens
gugaggcacugcugcuuuccag

SEQ ID NO: 347111 - RNA, 22 nt, Homo sapiens
gugagguguuaaccaaccugug

SEQ ID NO: 347112 - RNA, 22 nt, Homo sapiens
gugauacugcuuauuaauuuaa

SEQ ID NO: 347113 - RNA, 22 nt, Homo sapiens
gugaugacauucagagaugaag

SEQ ID NO: 347114 - RNA, 22 nt, Homo sapiens
gugauguguuucaacagcuccu

SEQ ID NO: 347115 - RNA, 22 nt, Homo sapiens
gugcaaauuccagcucaacucc

SEQ ID NO: 347116 - RNA, 22 nt, Homo sapiens
gugcacaaaucuuaaauguaca

SEQ ID NO: 347117 - RNA, 22 nt, Homo sapiens
gugcacaacaugcagguuuguu

SEQ ID NO: 347118 - RNA, 22 nt, Homo sapiens
gugcacaacguguagguuuguu

SEQ ID NO: 347119 - RNA, 22 nt, Homo sapiens
gugcacaucuguguuccagcua

SEQ ID NO: 347120 - RNA, 21 nt, Homo sapiens
gugcagacacacauauaggcu

SEQ ID NO: 347121 - RNA, 21 nt, Homo sapiens
gugcagaugccacagucacuc

SEQ ID NO: 347122 - RNA, 22 nt, Homo sapiens
gugcagaugucuuuauaguagc

SEQ ID NO: 347123 - RNA, 22 nt, Homo sapiens
gugcaguguuugcauggaauca

SEQ ID NO: 347124 - RNA, 22 nt, Homo sapiens
gugcauauaaguuguuucuagu

SEQ ID NO: 347125 - RNA, 22 nt, Homo sapiens
gugcaugcaucuuuauaguagc

SEQ ID NO: 347126 - RNA, 22 nt, Homo sapiens
gugcuauguuauccagcaagau

SEQ ID NO: 347127 - RNA, 22 nt, Homo sapiens
guggaaaucucugugugacuua

SEQ ID NO: 347128 - RNA, 22 nt, Homo sapiens
guggaauacuaugaugguggau

SEQ ID NO: 347129 - RNA, 22 nt, Homo sapiens
guggaauauaaagcaucgugua

SEQ ID NO: 347130 - RNA, 22 nt, Homo sapiens
guggacaugaauuuuggaggca

SEQ ID NO: 347131 - RNA, 22 nt, Homo sapiens
guggcaaguguuccaagaggcg

SEQ ID NO: 347132 - RNA, 22 nt, Homo sapiens
guggcaugaaagcaucugugau

SEQ ID NO: 347133 - RNA, 22 nt, Homo sapiens
guggcuauuguucccugguugc

SEQ ID NO: 347134 - RNA, 22 nt, Homo sapiens
gugggaugaucgcuugagccca

SEQ ID NO: 347135 - RNA, 22 nt, Homo sapiens
gugggaugcaaguaaaauuguc

SEQ ID NO: 347136 - RNA, 22 nt, Homo sapiens
gugggauggaaaugggcuucag

SEQ ID NO: 347137 - RNA, 22 nt, Homo sapiens
gugggauggagagaagguauga

SEQ ID NO: 347138 - RNA, 22 nt, Homo sapiens
gugggcaaagcuaguguguaga

SEQ ID NO: 347139 - RNA, 22 nt, Homo sapiens
gugggguagcaggcuccuaucu

SEQ ID NO: 347140 - RNA, 22 nt, Homo sapiens
gugggguaggaggaguacuucc

SEQ ID NO: 347141 - RNA, 22 nt, Homo sapiens
gugguaaaauggcauagagcua

SEQ ID NO: 347142 - RNA, 22 nt, Homo sapiens
gugguuuuaauauucagucuag

SEQ ID NO: 347143 - RNA, 22 nt, Homo sapiens
gugguuuucaacuccaccugca

SEQ ID NO: 347144 - RNA, 22 nt, Homo sapiens
gugguuuuuuucugccuuauag

SEQ ID NO: 347145 - RNA, 20 nt, Homo sapiens
guguaagagcaagcuuccua

SEQ ID NO: 347146 - RNA, 22 nt, Homo sapiens
guguauacauagaauuguguau

SEQ ID NO: 347147 - RNA, 18 nt, Homo sapiens
guguauggauggaggcca

SEQ ID NO: 347148 - RNA, 22 nt, Homo sapiens
guguaugguuguuguagagaga

SEQ ID NO: 347149 - RNA, 22 nt, Homo sapiens
gugucaaggaugccugucaggc

SEQ ID NO: 347150 - RNA, 22 nt, Homo sapiens
gugucacagcuuccaucucggu

SEQ ID NO: 347151 - RNA, 22 nt, Homo sapiens
gugucacuguauaauauuuauu

SEQ ID NO: 347152 - RNA, 22 nt, Homo sapiens
gugucacugugaggauauugua

SEQ ID NO: 347153 - RNA, 22 nt, Homo sapiens
gugucacuguugagaaguccac

SEQ ID NO: 347154 - RNA, 22 nt, Homo sapiens
gugucaugagggggacaggaag

SEQ ID NO: 347155 - RNA, 22 nt, Homo sapiens
guguccucgaguacacaucagg

SEQ ID NO: 347156 - RNA, 18 nt, Homo sapiens
gugucugguuaugggagu

SEQ ID NO: 347157 - RNA, 22 nt, Homo sapiens
gcaugguacuggaugguaguau

SEQ ID NO: 347158 - RNA, 22 nt, Homo sapiens
gccaagaagugucuaagcagga

SEQ ID NO: 347159 - RNA, 22 nt, Homo sapiens
gccaagaugcugcccacagaca

SEQ ID NO: 347160 - RNA, 22 nt, Homo sapiens
gccaagauuuaauucaucaguu

SEQ ID NO: 347161 - RNA, 21 nt, Homo sapiens
gccaguguggcaauuuuucaa

SEQ ID NO: 347162 - RNA, 22 nt, Homo sapiens
gccauugcacuccagccuaggu

SEQ ID NO: 347163 - RNA, 22 nt, Homo sapiens
gccccugagacuugccucgggc

SEQ ID NO: 347164 - RNA, 22 nt, Homo sapiens
gccuagggacaaaccguccgac

SEQ ID NO: 347165 - RNA, 23 nt, Homo sapiens
gcuaggagagaugaaacacaggu

SEQ ID NO: 347166 - RNA, 22 nt, Homo sapiens
gcuccuuugaguagcuucugug

SEQ ID NO: 347167 - RNA, 22 nt, Homo sapiens
gcucuuuugggguaauucugag

SEQ ID NO: 347168 - RNA, 17 nt, Homo sapiens
gcugcauucauguagaa

SEQ ID NO: 347169 - RNA, 22 nt, Homo sapiens
gcugcuuuugaugacaaaaaca

SEQ ID NO: 347170 - RNA, 22 nt, Homo sapiens
gcuggcuuucuccugaucucag

SEQ ID NO: 347171 - RNA, 22 nt, Homo sapiens
gcuggugacuuuaaguugaagc

SEQ ID NO: 347172 - RNA, 22 nt, Homo sapiens
gcuguaguugaggauuuuaaga

SEQ ID NO: 347173 - RNA, 22 nt, Homo sapiens
gcugucaugagcaacacaugaa

SEQ ID NO: 347174 - RNA, 22 nt, Homo sapiens
gcuucauggaggcugggcgcag

SEQ ID NO: 347175 - RNA, 22 nt, Homo sapiens
gcuuugcaauggcauugaccau

SEQ ID NO: 347176 - RNA, 22 nt, Homo sapiens
gcuuugguucaaccaggcaauu

SEQ ID NO: 347177 - RNA, 22 nt, Homo sapiens
ggaaaguaacccauucucuuac

SEQ ID NO: 347178 - RNA, 22 nt, Homo sapiens
ggaaaguccuucuguaggcucc

SEQ ID NO: 347179 - RNA, 22 nt, Homo sapiens
ggaaaucaucauucucgguaua

SEQ ID NO: 347180 - RNA, 22 nt, Homo sapiens
ggaaaucucugaggcucccuuc

SEQ ID NO: 347181 - RNA, 22 nt, Homo sapiens
ggaaauguaaacaauggggcua

SEQ ID NO: 347182 - RNA, 19 nt, Homo sapiens
ggaaaugucuauuaagauc

SEQ ID NO: 347183 - RNA, 23 nt, Homo sapiens
ggaaauguuuaagggguugggag

SEQ ID NO: 347184 - RNA, 20 nt, Homo sapiens
ggaagagugacacaagguau

SEQ ID NO: 347185 - RNA, 22 nt, Homo sapiens
ggaagccugcacucgggcaggg

SEQ ID NO: 347186 - RNA, 17 nt, Homo sapiens
ggaagccuuugguuuaa

SEQ ID NO: 347187 - RNA, 22 nt, Homo sapiens
ggaagguaauugucagcucaua

SEQ ID NO: 347188 - RNA, 22 nt, Homo sapiens
ggaaugagaaauauuacacaau

SEQ ID NO: 347189 - RNA, 22 nt, Homo sapiens
ggacaaaguauuuucaaaugua

SEQ ID NO: 347190 - RNA, 22 nt, Homo sapiens
ggacagaugggcucccgggucu

SEQ ID NO: 347191 - RNA, 22 nt, Homo sapiens
ggacauuaacugcaagauagau

SEQ ID NO: 347192 - RNA, 22 nt, Homo sapiens
ggacuguacuccuggccagugu

SEQ ID NO: 347193 - RNA, 22 nt, Homo sapiens
ggacuguaguuucccgggcugg

SEQ ID NO: 347194 - RNA, 22 nt, Homo sapiens
ggagagugacauauuucuaggc

SEQ ID NO: 347195 - RNA, 22 nt, Homo sapiens
ggagaucauuuccuauuugaag

SEQ ID NO: 347196 - RNA, 22 nt, Homo sapiens
ggaggcuaguaaaaagguagaa

SEQ ID NO: 347197 - RNA, 21 nt, Homo sapiens
ggaguauaaggcaaaggagug

SEQ ID NO: 347198 - RNA, 22 nt, Homo sapiens
ggagucugaacuggacaaugac

SEQ ID NO: 347199 - RNA, 22 nt, Homo sapiens
ggagugucugugcuggucaaag

SEQ ID NO: 347200 - RNA, 22 nt, Homo sapiens
ggauaacagccaggucaaacaa

SEQ ID NO: 347201 - RNA, 22 nt, Homo sapiens
ggauggcauuucuuuagcuuuu

SEQ ID NO: 347202 - RNA, 22 nt, Homo sapiens
ggcaacaugaugaaaugccauc

SEQ ID NO: 347203 - RNA, 22 nt, Homo sapiens
ggcaacaugccgaaaccacguc

SEQ ID NO: 347204 - RNA, 20 nt, Homo sapiens
ggcaagacccaaagugugug

SEQ ID NO: 347205 - RNA, 22 nt, Homo sapiens
ggcaaggugaugaaugucuaca

SEQ ID NO: 347206 - RNA, 22 nt, Homo sapiens
ggcaaggugcuacagacaguga

SEQ ID NO: 347207 - RNA, 22 nt, Homo sapiens
ggcaagugggagggaguguuuc

SEQ ID NO: 347208 - RNA, 22 nt, Homo sapiens
ggcaagugucagcagcaacacc

SEQ ID NO: 347209 - RNA, 21 nt, Homo sapiens
ggcaagugugagguuuggggu

SEQ ID NO: 347210 - RNA, 22 nt, Homo sapiens
ggcaccacagacgccaggcgug

SEQ ID NO: 347211 - RNA, 22 nt, Homo sapiens
ggcacgguggcucacaccugua

SEQ ID NO: 347212 - RNA, 22 nt, Homo sapiens
ggcacgguggcucacgccugua

SEQ ID NO: 347213 - RNA, 19 nt, Homo sapiens
ggcacugugugagugagga

SEQ ID NO: 347214 - RNA, 22 nt, Homo sapiens
ggcagagucuugcaucuuuaga

SEQ ID NO: 347215 - RNA, 22 nt, Homo sapiens
ggcagcuguguccuucguaagg

SEQ ID NO: 347216 - RNA, 22 nt, Homo sapiens
ggcaguggaagugccaguuucu

SEQ ID NO: 347217 - RNA, 22 nt, Homo sapiens
ggcaguuuggcaguuucauaaa

SEQ ID NO: 347218 - RNA, 22 nt, Homo sapiens
ggcauguaauuauucaaagugg

SEQ ID NO: 347219 - RNA, 22 nt, Homo sapiens
ggcauguguggguuauuaaaga

SEQ ID NO: 347220 - RNA, 21 nt, Homo sapiens
ggcauugugcccuugcucuag

SEQ ID NO: 347221 - RNA, 22 nt, Homo sapiens
ggccagaugcaguggcucacac

SEQ ID NO: 347222 - RNA, 22 nt, Homo sapiens
ggcccugauacaaguaaggucu

SEQ ID NO: 347223 - RNA, 18 nt, Homo sapiens
ggcggguguuuuauucac

SEQ ID NO: 347224 - RNA, 22 nt, Homo sapiens
ggcuagaauagggauagaccuu

SEQ ID NO: 347225 - RNA, 22 nt, Homo sapiens
ggcuagagaauagugccacuaa

SEQ ID NO: 347226 - RNA, 22 nt, Homo sapiens
ggcucagugggguccugguucu

SEQ ID NO: 347227 - RNA, 22 nt, Homo sapiens
ggcuguguguuaaaauaggcuu

SEQ ID NO: 347228 - RNA, 22 nt, Homo sapiens
gggaagugugguuucuuuacag

SEQ ID NO: 347229 - RNA, 22 nt, Homo sapiens
gggaggucauuguaaggucuua

SEQ ID NO: 347230 - RNA, 22 nt, Homo sapiens
gggagugugcacacaugguaua

SEQ ID NO: 347231 - RNA, 22 nt, Homo sapiens
gggauguaaaagugggcacauu

SEQ ID NO: 347232 - RNA, 22 nt, Homo sapiens
gggcaagaagucuuguaguuuu

SEQ ID NO: 347233 - RNA, 22 nt, Homo sapiens
uaggacacucucuccaccagua

SEQ ID NO: 347234 - RNA, 22 nt, Homo sapiens
uaggcaguguucucacuuguaa

SEQ ID NO: 347235 - RNA, 22 nt, Homo sapiens
uaggcgagauguguguuucaug

SEQ ID NO: 347236 - RNA, 22 nt, Homo sapiens
uagggcuuuaguuugcuugugu

SEQ ID NO: 347237 - RNA, 22 nt, Homo sapiens
uagguaaguaugugugaugggg

SEQ ID NO: 347238 - RNA, 22 nt, Homo sapiens
uagguaguuacacagcaaugua

SEQ ID NO: 347239 - RNA, 22 nt, Homo sapiens
uaggucuccuuuuugccuaaau

SEQ ID NO: 347240 - RNA, 22 nt, Homo sapiens
uaggugaaugcuggaagaaaug

SEQ ID NO: 347241 - RNA, 22 nt, Homo sapiens
uagguucuccacagguucucca

SEQ ID NO: 347242 - RNA, 22 nt, Homo sapiens
uaguaaacauaguucuuuugcu

SEQ ID NO: 347243 - RNA, 22 nt, Homo sapiens
uagugcaguggcuccaucucag

SEQ ID NO: 347244 - RNA, 22 nt, Homo sapiens
uagugcccuuauaagagcagga

SEQ ID NO: 347245 - RNA, 22 nt, Homo sapiens
uaguuauggaguaauuuuaagc

SEQ ID NO: 347246 - RNA, 22 nt, Homo sapiens
uaguucauuuuucuugcuuaga

SEQ ID NO: 347247 - RNA, 22 nt, Homo sapiens
uauacugucuuuguaugccuag

SEQ ID NO: 347248 - RNA, 20 nt, Homo sapiens
uauagcaauuuuuuucuccu

SEQ ID NO: 347249 - RNA, 21 nt, Homo sapiens
uauaguaguaugauuuacaau

SEQ ID NO: 347250 - RNA, 22 nt, Homo sapiens
uauaucacaugcacucauuuuc

SEQ ID NO: 347251 - RNA, 21 nt, Homo sapiens
uauaugacuuacuauugccuc

SEQ ID NO: 347252 - RNA, 22 nt, Homo sapiens
uauauguucugugucccuuucg

SEQ ID NO: 347253 - RNA, 22 nt, Homo sapiens
uauauguucuugcacuggaaag

SEQ ID NO: 347254 - RNA, 22 nt, Homo sapiens
uaucaaacccaaggaggggguu

SEQ ID NO: 347255 - RNA, 22 nt, Homo sapiens
uaucaaguuggaagagaaguaa

SEQ ID NO: 347256 - RNA, 22 nt, Homo sapiens
uaucacagauucuccaggguuu

SEQ ID NO: 347257 - RNA, 22 nt, Homo sapiens
uaucacccuuucauuguucuuc

SEQ ID NO: 347258 - RNA, 22 nt, Homo sapiens
uaucaccuugcaggagcuauga

SEQ ID NO: 347259 - RNA, 22 nt, Homo sapiens
uaucacuauucauccuagcucc

SEQ ID NO: 347260 - RNA, 22 nt, Homo sapiens
uaucagcagagucauacuucaa

SEQ ID NO: 347261 - RNA, 22 nt, Homo sapiens
uaucauagacaaucaguuauug

SEQ ID NO: 347262 - RNA, 22 nt, Homo sapiens
uaucauaguuuggacuuucauu

SEQ ID NO: 347263 - RNA, 21 nt, Homo sapiens
uaucauggccauccucuucuc

SEQ ID NO: 347264 - RNA, 21 nt, Homo sapiens
uaucauggugaaacccugucu

SEQ ID NO: 347265 - RNA, 22 nt, Homo sapiens
uaucucagaguguacaagauua

SEQ ID NO: 347266 - RNA, 22 nt, Homo sapiens
uaugaacacuuuugggaggcau

SEQ ID NO: 347267 - RNA, 22 nt, Homo sapiens
uaugaagccaggauuuauuauu

SEQ ID NO: 347268 - RNA, 19 nt, Homo sapiens
uaugcaacuuauagugcug

SEQ ID NO: 347269 - RNA, 23 nt, Homo sapiens
uaugccuguuucaaacaaacuuu

SEQ ID NO: 347270 - RNA, 22 nt, Homo sapiens
uaugccuuucucacuaagcuua

SEQ ID NO: 347271 - RNA, 22 nt, Homo sapiens
uauggauuuucagauucuuauc

SEQ ID NO: 347272 - RNA, 22 nt, Homo sapiens
uauggcaaugcauaggaaggaa

SEQ ID NO: 347273 - RNA, 22 nt, Homo sapiens
uauggcguaugaauuauaucuc

SEQ ID NO: 347274 - RNA, 21 nt, Homo sapiens
uauggcuuagucaguguuucc

SEQ ID NO: 347275 - RNA, 22 nt, Homo sapiens
uauggcuucuuauucuuucccg

SEQ ID NO: 347276 - RNA, 22 nt, Homo sapiens
uauggcuuuguuaacauuuucu

SEQ ID NO: 347277 - RNA, 22 nt, Homo sapiens
uauggcuuuucacuuaaguccu

SEQ ID NO: 347278 - RNA, 22 nt, Homo sapiens
uaugggauuucauuaagugucu

SEQ ID NO: 347279 - RNA, 17 nt, Homo sapiens
uauguaguacuuauaaa

SEQ ID NO: 347280 - RNA, 22 nt, Homo sapiens
uauuaagcuaguugucagugcu

SEQ ID NO: 347281 - RNA, 22 nt, Homo sapiens
uauuacuugucugugucucaau

SEQ ID NO: 347282 - RNA, 22 nt, Homo sapiens
uauuagguuggugcaaaaguua

SEQ ID NO: 347283 - RNA, 22 nt, Homo sapiens
uauuccacaauaugauuuuuaa

SEQ ID NO: 347284 - RNA, 22 nt, Homo sapiens
uauuccacuuacaugagguauc

SEQ ID NO: 347285 - RNA, 22 nt, Homo sapiens
uauugaacgugggauauugaag

SEQ ID NO: 347286 - RNA, 17 nt, Homo sapiens
uauugaccuuuguaugu

SEQ ID NO: 347287 - RNA, 22 nt, Homo sapiens
uauugcaacagaagaaagaguc

SEQ ID NO: 347288 - RNA, 22 nt, Homo sapiens
uauugcacgccagccugagcaa

SEQ ID NO: 347289 - RNA, 22 nt, Homo sapiens
uauugcacuccagccuuggcaa

SEQ ID NO: 347290 - RNA, 20 nt, Homo sapiens
uauugcacuccagucugggc

SEQ ID NO: 347291 - RNA, 22 nt, Homo sapiens
uauugcagugagauccaucugg

SEQ ID NO: 347292 - RNA, 22 nt, Homo sapiens
uauugccucuuuuguaaaagug

SEQ ID NO: 347293 - RNA, 22 nt, Homo sapiens
uauugcugaugcugaagggaag

SEQ ID NO: 347294 - RNA, 22 nt, Homo sapiens
uauugcuuaugaugcugaauua

SEQ ID NO: 347295 - RNA, 18 nt, Homo sapiens
uauugcuugguuuggaga

SEQ ID NO: 347296 - RNA, 22 nt, Homo sapiens
uauugcuuuacucucuuauccu

SEQ ID NO: 347297 - RNA, 22 nt, Homo sapiens
uauugcuuuuaacccaaucucu

SEQ ID NO: 347298 - RNA, 22 nt, Homo sapiens
uauuguacauauccucccuuca

SEQ ID NO: 347299 - RNA, 22 nt, Homo sapiens
uauuugguuauaugaguaaguu

SEQ ID NO: 347300 - RNA, 22 nt, Homo sapiens
ucaaaaucucuuagcugugucu

SEQ ID NO: 347301 - RNA, 22 nt, Homo sapiens
ucaaaugauucagaagccaccu

SEQ ID NO: 347302 - RNA, 17 nt, Homo sapiens
ucaaaugcucccaguga

SEQ ID NO: 347303 - RNA, 22 nt, Homo sapiens
ucaacauugcugucaggcaucu

SEQ ID NO: 347304 - RNA, 21 nt, Homo sapiens
ucaacccuugcgucaccaagc

SEQ ID NO: 347305 - RNA, 22 nt, Homo sapiens
ucaagcaauucuccucucagcc

SEQ ID NO: 347306 - RNA, 22 nt, Homo sapiens
ucaaggacucagagagggauua

SEQ ID NO: 347307 - RNA, 22 nt, Homo sapiens
ucaaggcacauuugacauuuuc

SEQ ID NO: 347308 - RNA, 20 nt, Homo sapiens
ucaaggcacgaauaaaaguu

SEQ ID NO: 347309 - RNA, 22 nt, Homo sapiens
ucaaguacuuauuugauaauua

SEQ ID NO: 347310 - RNA, 22 nt, Homo sapiens
ucaagugauucuugugccuuag

SEQ ID NO: 347311 - RNA, 22 nt, Homo sapiens
ucacaaagcuuggccugcuucu

SEQ ID NO: 347312 - RNA, 22 nt, Homo sapiens
ucacaaguguauagacaugucc

SEQ ID NO: 347313 - RNA, 22 nt, Homo sapiens
ucacacugaaacuaggguguga

SEQ ID NO: 347314 - RNA, 22 nt, Homo sapiens
ucacacugucuugguuacucuu

SEQ ID NO: 347315 - RNA, 23 nt, Homo sapiens
ucacacuuaagagaaaugcagcu

SEQ ID NO: 347316 - RNA, 22 nt, Homo sapiens
ucacagacauugaggggaccuu

SEQ ID NO: 347317 - RNA, 22 nt, Homo sapiens
ucacaggguguuauuagaauua

SEQ ID NO: 347318 - RNA, 22 nt, Homo sapiens
uagcacaguucacccucgauuu

SEQ ID NO: 347319 - RNA, 20 nt, Homo sapiens
uagcacaucuggcuguagag

SEQ ID NO: 347320 - RNA, 22 nt, Homo sapiens
uagcacaugucagguaauuugc

SEQ ID NO: 347321 - RNA, 22 nt, Homo sapiens
uagcaccaaacauauacucagu

SEQ ID NO: 347322 - RNA, 22 nt, Homo sapiens
uagcaccaggguugacugaccu

SEQ ID NO: 347323 - RNA, 23 nt, Homo sapiens
uagcacuuuuuacauauggacau

SEQ ID NO: 347324 - RNA, 22 nt, Homo sapiens
uagcagaauauaccucuuacuu

SEQ ID NO: 347325 - RNA, 22 nt, Homo sapiens
uagcagccaggaagggcuggcu

SEQ ID NO: 347326 - RNA, 22 nt, Homo sapiens
uagcauggagucaugcacggcu

SEQ ID NO: 347327 - RNA, 22 nt, Homo sapiens
uagcugcaaaauauagacuucu

SEQ ID NO: 347328 - RNA, 22 nt, Homo sapiens
uagcugcuguauguacacggau

SEQ ID NO: 347329 - RNA, 22 nt, Homo sapiens
uaggaaguuuucuugcugggcc

SEQ ID NO: 347330 - RNA, 22 nt, Homo sapiens
uaggacacagaccuggauggaa

SEQ ID NO: 347331 - RNA, 22 nt, Homo sapiens
ugauuuccaugagaacaugccu

SEQ ID NO: 347332 - RNA, 22 nt, Homo sapiens
ugauuuguccauguggcacgug

SEQ ID NO: 347333 - RNA, 18 nt, Homo sapiens
ugcaaacauguguguguu

SEQ ID NO: 347334 - RNA, 22 nt, Homo sapiens
ugcaaaugucaaggguuagugu

SEQ ID NO: 347335 - RNA, 22 nt, Homo sapiens
ugcaagaaucagccuaucauua

SEQ ID NO: 347336 - RNA, 22 nt, Homo sapiens
ugcaagaugagauuuuggaugg

SEQ ID NO: 347337 - RNA, 22 nt, Homo sapiens
ugcaccaucuugcuucuguggu

SEQ ID NO: 347338 - RNA, 22 nt, Homo sapiens
ugcaccauggcacuccaggcug

SEQ ID NO: 347339 - RNA, 22 nt, Homo sapiens
ugcaccauugcacuccagccug

SEQ ID NO: 347340 - RNA, 22 nt, Homo sapiens
ugcaccauugcauuccagccug

SEQ ID NO: 347341 - RNA, 22 nt, Homo sapiens
ugcaccauugucaccuggguga

SEQ ID NO: 347342 - RNA, 23 nt, Homo sapiens
ugcagcacacugaugggucuuga

SEQ ID NO: 347343 - RNA, 22 nt, Homo sapiens
ugcagcacaguagguuugcaau

SEQ ID NO: 347344 - RNA, 22 nt, Homo sapiens
ugcagcacuguucacaauagcc

SEQ ID NO: 347345 - RNA, 22 nt, Homo sapiens
ugcagcauguaggcacguuauu

SEQ ID NO: 347346 - RNA, 22 nt, Homo sapiens
ugcagguacuugacaacuuggg

SEQ ID NO: 347347 - RNA, 23 nt, Homo sapiens
ugcaguagugagaucuaggcuca

SEQ ID NO: 347348 - RNA, 22 nt, Homo sapiens
ugcagugugcuggggucuccau

SEQ ID NO: 347349 - RNA, 21 nt, Homo sapiens
ugcagugugguugcccugcug

SEQ ID NO: 347350 - RNA, 22 nt, Homo sapiens
ugcauccauucuagacucaucu

SEQ ID NO: 347351 - RNA, 22 nt, Homo sapiens
ugcauggagauauacaguuuuu

SEQ ID NO: 347352 - RNA, 22 nt, Homo sapiens
ugcauggauguuugaacacacu

SEQ ID NO: 347353 - RNA, 21 nt, Homo sapiens
ugcaugguagucacaugauuc

SEQ ID NO: 347354 - RNA, 22 nt, Homo sapiens
ugcauggucauacauggcaccc

SEQ ID NO: 347355 - RNA, 21 nt, Homo sapiens
ugcauugucuugaguuuaaau

SEQ ID NO: 347356 - RNA, 22 nt, Homo sapiens
ugccaggaugaggucaauguuu

SEQ ID NO: 347357 - RNA, 20 nt, Homo sapiens
ugccagugugucaauuuaua

SEQ ID NO: 347358 - RNA, 22 nt, Homo sapiens
ugccaugaagagaggaagcagu

SEQ ID NO: 347359 - RNA, 21 nt, Homo sapiens
ugcccaguggcuuggggucag

SEQ ID NO: 347360 - RNA, 22 nt, Homo sapiens
ugccuaggcuggagugcagugg

SEQ ID NO: 347361 - RNA, 22 nt, Homo sapiens
ugccuaguggccuuaugaguau

SEQ ID NO: 347362 - RNA, 22 nt, Homo sapiens
ugccugagccagguuuuaggag

SEQ ID NO: 347363 - RNA, 22 nt, Homo sapiens
ugcuagaagaucacacacauca

SEQ ID NO: 347364 - RNA, 22 nt, Homo sapiens
ugcuauagcuauaucaucuccu

SEQ ID NO: 347365 - RNA, 22 nt, Homo sapiens
ugcuaugucuucucucacagag

SEQ ID NO: 347366 - RNA, 21 nt, Homo sapiens
ugcucaugaguaaugcaguga

SEQ ID NO: 347367 - RNA, 22 nt, Homo sapiens
ugcugcaaacaugagaggaagu

SEQ ID NO: 347368 - RNA, 22 nt, Homo sapiens
ugcugcuguuaucauuuuacca

SEQ ID NO: 347369 - RNA, 22 nt, Homo sapiens
ugcuggugauucagauucaaau

SEQ ID NO: 347370 - RNA, 22 nt, Homo sapiens
ugcuuugguagaaaucuuuggu

SEQ ID NO: 347371 - RNA, 21 nt, Homo sapiens
ugcuuuggucauacuucuucc

SEQ ID NO: 347372 - RNA, 22 nt, Homo sapiens
uggaaaauuaggggagguuaua

SEQ ID NO: 347373 - RNA, 20 nt, Homo sapiens
uggaaaguaagucaugauau

SEQ ID NO: 347374 - RNA, 22 nt, Homo sapiens
uggaaauuaacagggauugucc

SEQ ID NO: 347375 - RNA, 22 nt, Homo sapiens
uggaagaugggaccucaguuuu

SEQ ID NO: 347376 - RNA, 22 nt, Homo sapiens
uggaagcaugcaaucugugggg

SEQ ID NO: 347377 - RNA, 20 nt, Homo sapiens
uggaaggcaucugcauuauu

SEQ ID NO: 347378 - RNA, 22 nt, Homo sapiens
uggaauacaugucgcugagcug

SEQ ID NO: 347379 - RNA, 22 nt, Homo sapiens
uggaauacuauucugugcugga

SEQ ID NO: 347380 - RNA, 22 nt, Homo sapiens
uggaaucuacuaaagcaaaauc

SEQ ID NO: 347381 - RNA, 22 nt, Homo sapiens
uggaaucuuaggugaaggcuuu

SEQ ID NO: 347382 - RNA, 19 nt, Homo sapiens
uggaaugaaauguuagggg

SEQ ID NO: 347383 - RNA, 21 nt, Homo sapiens
uggaauguucugacuucaggg

SEQ ID NO: 347384 - RNA, 18 nt, Homo sapiens
uggaauguuuggguuaau

SEQ ID NO: 347385 - RNA, 22 nt, Homo sapiens
uggacagaaacauguuuucagu

SEQ ID NO: 347386 - RNA, 22 nt, Homo sapiens
uggacaugaagggcacaggagg

SEQ ID NO: 347387 - RNA, 21 nt, Homo sapiens
uggaccccuacuucucaccau

SEQ ID NO: 347388 - RNA, 22 nt, Homo sapiens
uggacuguaaauuggggacucu

SEQ ID NO: 347389 - RNA, 22 nt, Homo sapiens
uggagagcaaaaucaauccaaa

SEQ ID NO: 347390 - RNA, 22 nt, Homo sapiens
uggagagucauuuauaguauuu

SEQ ID NO: 347391 - RNA, 18 nt, Homo sapiens
uggagauaagaagaacuu

SEQ ID NO: 347392 - RNA, 22 nt, Homo sapiens
uggaggacugcagaacugaggc

SEQ ID NO: 347393 - RNA, 20 nt, Homo sapiens
uggaguuugaguucuuggag

SEQ ID NO: 347394 - RNA, 22 nt, Homo sapiens
uggauagauacuauccaggacu

SEQ ID NO: 347395 - RNA, 22 nt, Homo sapiens
uggaugaagagaugguaguugc

SEQ ID NO: 347396 - RNA, 18 nt, Homo sapiens
uggauuggaaaaguuccu

SEQ ID NO: 347397 - RNA, 22 nt, Homo sapiens
uggcaaagugugacgugggggu

SEQ ID NO: 347398 - RNA, 22 nt, Homo sapiens
uggcaagaacaacaauuacuuu

SEQ ID NO: 347399 - RNA, 22 nt, Homo sapiens
uggcaagaagagcaugagacca

SEQ ID NO: 347400 - RNA, 22 nt, Homo sapiens
uggcaagagaacaacaucucuc

SEQ ID NO: 347401 - RNA, 22 nt, Homo sapiens
uggcaagagauaugugucuaua

SEQ ID NO: 347402 - RNA, 20 nt, Homo sapiens
uggcaagauggcagaauaga

SEQ ID NO: 347403 - RNA, 22 nt, Homo sapiens
uggcacuaugugacaagguuuu

SEQ ID NO: 347404 - RNA, 22 nt, Homo sapiens
uggcacuggagauacauuaaua

SEQ ID NO: 347405 - RNA, 22 nt, Homo sapiens
uggcagauagaaaugugguuaa

SEQ ID NO: 347406 - RNA, 22 nt, Homo sapiens
uggcagaugagccgcgcuccaa

SEQ ID NO: 347407 - RNA, 22 nt, Homo sapiens
uggcaggugcacuggcuuugaa

SEQ ID NO: 347408 - RNA, 22 nt, Homo sapiens
uggcauauaaagauguguucaa

SEQ ID NO: 347409 - RNA, 20 nt, Homo sapiens
uggcaugaaauuuuccaagc

SEQ ID NO: 347410 - RNA, 22 nt, Homo sapiens
uggcaugauauauauucguuug

SEQ ID NO: 347411 - RNA, 22 nt, Homo sapiens
uggcauguagucugggaccugg

SEQ ID NO: 347412 - RNA, 22 nt, Homo sapiens
uggcauuuuguuuuagaauuag

SEQ ID NO: 347413 - RNA, 22 nt, Homo sapiens
uggccaguguuuuuccugggcu

SEQ ID NO: 347414 - RNA, 22 nt, Homo sapiens
uggcccccucccaaaucucaua

SEQ ID NO: 347415 - RNA, 22 nt, Homo sapiens
uggccuguaacgcugucucagc

SEQ ID NO: 347416 - RNA, 22 nt, Homo sapiens
uggcggagacauggacuucaga

SEQ ID NO: 347417 - RNA, 22 nt, Homo sapiens
uggcgggaaaguugggagaaga

SEQ ID NO: 347418 - RNA, 22 nt, Homo sapiens
uggcuaagaugcacacuucacu

SEQ ID NO: 347419 - RNA, 22 nt, Homo sapiens
uggcuacagaaaguacuaguga

SEQ ID NO: 347420 - RNA, 22 nt, Homo sapiens
uggcuacugaccugcuaggggg

SEQ ID NO: 347421 - RNA, 22 nt, Homo sapiens
uggcuguuuauuucaccugggu

SEQ ID NO: 347422 - RNA, 22 nt, Homo sapiens
uuaacaguugcaugagacugag

SEQ ID NO: 347423 - RNA, 22 nt, Homo sapiens
uuaagaagugauuuuccucauu

SEQ ID NO: 347424 - RNA, 23 nt, Homo sapiens
uuaagcaacggcugcuuuucaga

SEQ ID NO: 347425 - RNA, 22 nt, Homo sapiens
uuaagcaguggauuagaauuuu

SEQ ID NO: 347426 - RNA, 22 nt, Homo sapiens
uuaaguagaugaaugugaaugu

SEQ ID NO: 347427 - RNA, 22 nt, Homo sapiens
uuaagugaauuaucuaacaugu

SEQ ID NO: 347428 - RNA, 22 nt, Homo sapiens
uuaaguuaggcuucagcagucu

SEQ ID NO: 347429 - RNA, 22 nt, Homo sapiens
uuaauacugcuuaacuuuagga

SEQ ID NO: 347430 - RNA, 22 nt, Homo sapiens
uuaaucucaggaguuugggacc

SEQ ID NO: 347431 - RNA, 22 nt, Homo sapiens
uuaaucugucuaugauuuuggu

SEQ ID NO: 347432 - RNA, 22 nt, Homo sapiens
uuaauuguccauuauucuguuc

SEQ ID NO: 347433 - RNA, 22 nt, Homo sapiens
uuacaacugucuuacugguuau

SEQ ID NO: 347434 - RNA, 22 nt, Homo sapiens
uuacacaguugguaggggcaga

SEQ ID NO: 347435 - RNA, 22 nt, Homo sapiens
uuacaccuguaauccagcacuu

SEQ ID NO: 347436 - RNA, 22 nt, Homo sapiens
uuacaggacuaagcagcuuugc

SEQ ID NO: 347437 - RNA, 17 nt, Homo sapiens
uuacaggugcugagagu

SEQ ID NO: 347438 - RNA, 22 nt, Homo sapiens
uuacaguagaugaggguauaau

SEQ ID NO: 347439 - RNA, 22 nt, Homo sapiens
uuacaguaugaguaagaguucu

SEQ ID NO: 347440 - RNA, 22 nt, Homo sapiens
uuacaguauugcaaggacuagg

SEQ ID NO: 347441 - RNA, 20 nt, Homo sapiens
uuacagugggaccuuccuga

SEQ ID NO: 347442 - RNA, 19 nt, Homo sapiens
uuacauccauugcauuuca

SEQ ID NO: 347443 - RNA, 22 nt, Homo sapiens
uuaccacagugccugucuaaug

SEQ ID NO: 347444 - RNA, 22 nt, Homo sapiens
uuaccucagaccugcucugugu

SEQ ID NO: 347445 - RNA, 19 nt, Homo sapiens
uuagagaucaucugcuuca

SEQ ID NO: 347446 - RNA, 22 nt, Homo sapiens
uuagcacaucuuucuauguaag

SEQ ID NO: 347447 - RNA, 22 nt, Homo sapiens
uuaggacacuguggguggguca

SEQ ID NO: 347448 - RNA, 22 nt, Homo sapiens
uuaggugguacacagccccagu

SEQ ID NO: 347449 - RNA, 22 nt, Homo sapiens
uuauagacacguuguaacaaac

SEQ ID NO: 347450 - RNA, 18 nt, Homo sapiens
uuauaugcauguguagga

SEQ ID NO: 347451 - RNA, 22 nt, Homo sapiens
uuauauguuuguacuuaggccu

SEQ ID NO: 347452 - RNA, 22 nt, Homo sapiens
uuaucaaacccuaggagguggu

SEQ ID NO: 347453 - RNA, 22 nt, Homo sapiens
uuaucacauugacugauuugca

SEQ ID NO: 347454 - RNA, 22 nt, Homo sapiens
uuaucagcagcaugaaacugga

SEQ ID NO: 347455 - RNA, 22 nt, Homo sapiens
uuaugacauugacaguuuuuag

SEQ ID NO: 347456 - RNA, 22 nt, Homo sapiens
uuauggcuuugcgguguuagca

SEQ ID NO: 347457 - RNA, 22 nt, Homo sapiens
uuaugguuguuaucuugguucg

SEQ ID NO: 347458 - RNA, 22 nt, Homo sapiens
uuaugucacuguucagucuccc

SEQ ID NO: 347459 - RNA, 22 nt, Homo sapiens
uuauuagguugguggaaaagua

SEQ ID NO: 347460 - RNA, 22 nt, Homo sapiens
uuauuguccaaguuucccuuug

SEQ ID NO: 347461 - RNA, 23 nt, Homo sapiens
uucaaaggaugcuuuauggaauu

SEQ ID NO: 347462 - RNA, 22 nt, Homo sapiens
uucaagugaacaaaaugaggag

SEQ ID NO: 347463 - RNA, 22 nt, Homo sapiens
uucacaauuaaaugugguuauu

SEQ ID NO: 347464 - RNA, 22 nt, Homo sapiens
uucacagagagaacucaaacca

SEQ ID NO: 347465 - RNA, 20 nt, Homo sapiens
uucacaggcagcuucuuucu

SEQ ID NO: 347466 - RNA, 22 nt, Homo sapiens
uucaccagggaagucucaacuc

SEQ ID NO: 347467 - RNA, 21 nt, Homo sapiens
uucaccauggcuccacacucu

SEQ ID NO: 347468 - RNA, 22 nt, Homo sapiens
uucacccugguuguagauggac

SEQ ID NO: 347469 - RNA, 21 nt, Homo sapiens
uucacuggucuauuucccuuu

SEQ ID NO: 347470 - RNA, 22 nt, Homo sapiens
uucacuguaaaaugaagagggu

SEQ ID NO: 347471 - RNA, 22 nt, Homo sapiens
uucacuguagccucagccucuu

SEQ ID NO: 347472 - RNA, 22 nt, Homo sapiens
uucacuguagcuuggauguuua

SEQ ID NO: 347473 - RNA, 22 nt, Homo sapiens
uucacugugcuuaaauucugcu

SEQ ID NO: 347474 - RNA, 22 nt, Homo sapiens
uucacugugugacccugggcca

SEQ ID NO: 347475 - RNA, 22 nt, Homo sapiens
uucagcaggccaggcccugacu

SEQ ID NO: 347476 - RNA, 22 nt, Homo sapiens
uucagcuacuugggaggcugaa

SEQ ID NO: 347477 - RNA, 22 nt, Homo sapiens
uucaggcaccauggucauugau

SEQ ID NO: 347478 - RNA, 22 nt, Homo sapiens
uucaggcuccugugagaaucua

SEQ ID NO: 347479 - RNA, 22 nt, Homo sapiens
uucaggguggagaguaugaggu

SEQ ID NO: 347480 - RNA, 22 nt, Homo sapiens
uucaguauugcaccuggagucc

SEQ ID NO: 347481 - RNA, 20 nt, Homo sapiens
uucagugcagguaacaaucc

SEQ ID NO: 347482 - RNA, 22 nt, Homo sapiens
uucagugccuggaagucgugcu

SEQ ID NO: 347483 - RNA, 22 nt, Homo sapiens
uucaguggacuuaguagugcuu

SEQ ID NO: 347484 - RNA, 22 nt, Homo sapiens
uucagugucauuaacacaguag

SEQ ID NO: 347485 - RNA, 22 nt, Homo sapiens
uucauaguaacaguaacuaugg

SEQ ID NO: 347486 - RNA, 22 nt, Homo sapiens
uucaucaggaauauugaccugu

SEQ ID NO: 347487 - RNA, 23 nt, Homo sapiens
uucaucagggauauuggccugaa

SEQ ID NO: 347488 - RNA, 18 nt, Homo sapiens
uucaucaguccucagcug

SEQ ID NO: 347489 - RNA, 22 nt, Homo sapiens
uucaucaguugagcugguugcu

SEQ ID NO: 347490 - RNA, 22 nt, Homo sapiens
uucauggaguugagaaggcuaa

SEQ ID NO: 347491 - RNA, 22 nt, Homo sapiens
uucauugcugcuuaucuccaga

SEQ ID NO: 347492 - RNA, 22 nt, Homo sapiens
uuccacaaugguugaacuaauu

SEQ ID NO: 347493 - RNA, 22 nt, Homo sapiens
uuccacaaugguugaacuagcu

SEQ ID NO: 347494 - RNA, 22 nt, Homo sapiens
uuccacaaugguugaacuaguu

SEQ ID NO: 347495 - RNA, 22 nt, Homo sapiens
uuccacagggauuugcauugau

SEQ ID NO: 347496 - RNA, 22 nt, Homo sapiens
uuccacuuuuuccuugugcucc

SEQ ID NO: 347497 - RNA, 22 nt, Homo sapiens
uuccaguggaguaaauggacaa

SEQ ID NO: 347498 - RNA, 22 nt, Homo sapiens
uuccaguguuugacucaccuuu

SEQ ID NO: 347499 - RNA, 22 nt, Homo sapiens
uuccaugugggcuugucaagua

SEQ ID NO: 347500 - RNA, 22 nt, Homo sapiens
uuccauuuguucggugucgcca

SEQ ID NO: 347501 - RNA, 22 nt, Homo sapiens
uucccguugcugugcuccugcc

SEQ ID NO: 347502 - RNA, 22 nt, Homo sapiens
uucccugagcaucuguugagcc

SEQ ID NO: 347503 - RNA, 22 nt, Homo sapiens
uucccuguaucuucugccaugu

SEQ ID NO: 347504 - RNA, 22 nt, Homo sapiens
uucccugugguauagaagccgu

SEQ ID NO: 347505 - RNA, 22 nt, Homo sapiens
ugggagacuacauuuuuaacaa

SEQ ID NO: 347506 - RNA, 22 nt, Homo sapiens
ugggagugugcacaauuucagc

SEQ ID NO: 347507 - RNA, 22 nt, Homo sapiens
ugggaucagucuggaauauuga

SEQ ID NO: 347508 - RNA, 22 nt, Homo sapiens
ugggaucaugagcaccgcuucc

SEQ ID NO: 347509 - RNA, 22 nt, Homo sapiens
ugggaucuuuccuauuagcgag

SEQ ID NO: 347510 - RNA, 22 nt, Homo sapiens
ugggaugaauacaaugggauca

SEQ ID NO: 347511 - RNA, 22 nt, Homo sapiens
ugggaugaugaaaaggcuuucu

SEQ ID NO: 347512 - RNA, 22 nt, Homo sapiens
ugggaugaugcuugagaauauc

SEQ ID NO: 347513 - RNA, 22 nt, Homo sapiens
ugggauguagccuucuauuuuc

SEQ ID NO: 347514 - RNA, 22 nt, Homo sapiens
ugggcaaauugugagggaggua

SEQ ID NO: 347515 - RNA, 22 nt, Homo sapiens
ugggcauggaguggccuuaugu

SEQ ID NO: 347516 - RNA, 22 nt, Homo sapiens
uggggcuuuuucuuguauucuc

SEQ ID NO: 347517 - RNA, 22 nt, Homo sapiens
ugggguagaauagaauugauau

SEQ ID NO: 347518 - RNA, 19 nt, Homo sapiens
uggguagugaugagacaua

SEQ ID NO: 347519 - RNA, 22 nt, Homo sapiens
uggguagugucagcugauccau

SEQ ID NO: 347520 - RNA, 21 nt, Homo sapiens
uggguaguuuucaaggccccg

SEQ ID NO: 347521 - RNA, 23 nt, Homo sapiens
ugggucaguuuuucugacaucau

SEQ ID NO: 347522 - RNA, 22 nt, Homo sapiens
ugguaaguuuaacaugcauccc

SEQ ID NO: 347523 - RNA, 22 nt, Homo sapiens
uggucaaaucugaugugagaaa

SEQ ID NO: 347524 - RNA, 22 nt, Homo sapiens
uggucagaaaauuacuugauau

SEQ ID NO: 347525 - RNA, 20 nt, Homo sapiens
ugguccccaccaaaucucau

SEQ ID NO: 347526 - RNA, 20 nt, Homo sapiens
ugguccccugagucuggcuu

SEQ ID NO: 347527 - RNA, 22 nt, Homo sapiens
uggucguggagucccuggcuuc

SEQ ID NO: 347528 - RNA, 22 nt, Homo sapiens
uggugcaaugaagugaucucaa

SEQ ID NO: 347529 - RNA, 19 nt, Homo sapiens
uggugccuuguucuuggau

SEQ ID NO: 347530 - RNA, 22 nt, Homo sapiens
ugguggcuuuucguagguucac

SEQ ID NO: 347531 - RNA, 20 nt, Homo sapiens
ugguguuugaacagugaaug

SEQ ID NO: 347532 - RNA, 22 nt, Homo sapiens
ugguuguuuuaaaugucgucug

SEQ ID NO: 347533 - RNA, 22 nt, Homo sapiens
uguacaaaacaagaugggggua

SEQ ID NO: 347534 - RNA, 22 nt, Homo sapiens
uguacuucaagauuaugguuua

SEQ ID NO: 347535 - RNA, 22 nt, Homo sapiens
uguagauauucuuucaguuuuu

SEQ ID NO: 347536 - RNA, 21 nt, Homo sapiens
uguagcagcauaauuuauaau

SEQ ID NO: 347537 - RNA, 21 nt, Homo sapiens
uguagcagcaugauuuauaau

SEQ ID NO: 347538 - RNA, 22 nt, Homo sapiens
uguagguguacauacaugguua

SEQ ID NO: 347539 - RNA, 22 nt, Homo sapiens
uguauaacucacauugaaguuu

SEQ ID NO: 347540 - RNA, 22 nt, Homo sapiens
uguauacauauguauguuuugu

SEQ ID NO: 347541 - RNA, 22 nt, Homo sapiens
uguauaguugagucaaguuuca

SEQ ID NO: 347542 - RNA, 22 nt, Homo sapiens
uguauguuguaagacuuagacc

SEQ ID NO: 347543 - RNA, 20 nt, Homo sapiens
ugucaagaaacauuacuuau

SEQ ID NO: 347544 - RNA, 22 nt, Homo sapiens
ugucacugugaguuugacugcu

SEQ ID NO: 347545 - RNA, 18 nt, Homo sapiens
ugucagaguggauuguaa

SEQ ID NO: 347546 - RNA, 22 nt, Homo sapiens
ugucaggaugcuccuuuuggcu

SEQ ID NO: 347547 - RNA, 22 nt, Homo sapiens
ugucagggaggcucggccgcac

SEQ ID NO: 347548 - RNA, 22 nt, Homo sapiens
ugucaguggucuggaugcagcc

SEQ ID NO: 347549 - RNA, 22 nt, Homo sapiens
ugucauguauauaccacuucca

SEQ ID NO: 347550 - RNA, 22 nt, Homo sapiens
ugucaugugagggaacuuguuc

SEQ ID NO: 347551 - RNA, 22 nt, Homo sapiens
ugucauguuucuacugaccaaa

SEQ ID NO: 347552 - RNA, 22 nt, Homo sapiens
uguccugcagagguguuugccu

SEQ ID NO: 347553 - RNA, 22 nt, Homo sapiens
ugucuaaagaauggcagacuca

SEQ ID NO: 347554 - RNA, 21 nt, Homo sapiens
ugucuagaccucauccuacag

SEQ ID NO: 347555 - RNA, 22 nt, Homo sapiens
ugucucaguuucuguggguuag

SEQ ID NO: 347556 - RNA, 22 nt, Homo sapiens
ugucucccuucccauuaggaag

SEQ ID NO: 347557 - RNA, 22 nt, Homo sapiens
ugucuggaaggguggccuccug

SEQ ID NO: 347558 - RNA, 22 nt, Homo sapiens
ugucuuagagauaaagaaugaa

SEQ ID NO: 347559 - RNA, 22 nt, Homo sapiens
ugucuuggagaauccuggguuu

SEQ ID NO: 347560 - RNA, 21 nt, Homo sapiens
ugucuuggagccagacgccag

SEQ ID NO: 347561 - RNA, 22 nt, Homo sapiens
ugucuuuguuaguuguccuagu

SEQ ID NO: 347562 - RNA, 19 nt, Homo sapiens
ugugaagaaaugcugcaag

SEQ ID NO: 347563 - RNA, 22 nt, Homo sapiens
ugugaauggugcugccgugaag

SEQ ID NO: 347564 - RNA, 22 nt, Homo sapiens
ugugaauguaagaaaauccaac

SEQ ID NO: 347565 - RNA, 22 nt, Homo sapiens
ugugacagcacagcaucucuuu

SEQ ID NO: 347566 - RNA, 22 nt, Homo sapiens
ugugacagguauccuguguucu

SEQ ID NO: 347567 - RNA, 22 nt, Homo sapiens
ugugaccaaaaucaacauaccu

SEQ ID NO: 347568 - RNA, 22 nt, Homo sapiens
ugugacucuggcacauggugag

SEQ ID NO: 347569 - RNA, 22 nt, Homo sapiens
ugugaucaaccugcagggcugg

SEQ ID NO: 347570 - RNA, 22 nt, Homo sapiens
ugugaucaugguauuaaucugc

SEQ ID NO: 347571 - RNA, 22 nt, Homo sapiens
ugugaugaagaguccaagaaca

SEQ ID NO: 347572 - RNA, 18 nt, Homo sapiens
ugugauggauauguuaau

SEQ ID NO: 347573 - RNA, 18 nt, Homo sapiens
ugugcaauauuaaccacc

SEQ ID NO: 347574 - RNA, 22 nt, Homo sapiens
ugugcaaucagcuucauuacau

SEQ ID NO: 347575 - RNA, 22 nt, Homo sapiens
ugugcacaacgugcagguuugu

SEQ ID NO: 347576 - RNA, 22 nt, Homo sapiens
ugugcacaugauauaucacaua

SEQ ID NO: 347577 - RNA, 22 nt, Homo sapiens
ugugcacauugugcagguugau

SEQ ID NO: 347578 - RNA, 22 nt, Homo sapiens
ugugcaguuuugagugaauuuc

SEQ ID NO: 347579 - RNA, 22 nt, Homo sapiens
ugugccacuccagcucuagcuu

SEQ ID NO: 347580 - RNA, 22 nt, Homo sapiens
ugugccacugcacucccgccug

SEQ ID NO: 347581 - RNA, 22 nt, Homo sapiens
ugugcguguaagagaucuaggu

SEQ ID NO: 347582 - RNA, 22 nt, Homo sapiens
ugugcuugaaauucaguuuuga

SEQ ID NO: 347583 - RNA, 22 nt, Homo sapiens
uguggcaaauggucaggaagaa

SEQ ID NO: 347584 - RNA, 20 nt, Homo sapiens
uguggcacuguaucucucag

SEQ ID NO: 347585 - RNA, 22 nt, Homo sapiens
uguggcagugcuuuaugaaacc

SEQ ID NO: 347586 - RNA, 22 nt, Homo sapiens
uguggcugguggcaccuuuucc

SEQ ID NO: 347587 - RNA, 22 nt, Homo sapiens
uguggcuuuacagcaugguuca

SEQ ID NO: 347588 - RNA, 22 nt, Homo sapiens
uguggcuuuuucuuggcugagg

SEQ ID NO: 347589 - RNA, 19 nt, Homo sapiens
uguggucauccugggacga

SEQ ID NO: 347590 - RNA, 22 nt, Homo sapiens
uguguaauacucuaaugaugca

SEQ ID NO: 347591 - RNA, 22 nt, Homo sapiens
ugugucuugcuggugccugcau

SEQ ID NO: 347592 - RNA, 22 nt, Homo sapiens
uuggucaucucccuccuuuuag

SEQ ID NO: 347593 - RNA, 22 nt, Homo sapiens
uugguccccacuccccugccaa

SEQ ID NO: 347594 - RNA, 22 nt, Homo sapiens
uugguccucccaugcucaagag

SEQ ID NO: 347595 - RNA, 22 nt, Homo sapiens
uuguaaacaucuguacauugcu

SEQ ID NO: 347596 - RNA, 22 nt, Homo sapiens
uuguagcaaauauauuuuggaa

SEQ ID NO: 347597 - RNA, 22 nt, Homo sapiens
uuguaguagcauuauuuauaau

SEQ ID NO: 347598 - RNA, 22 nt, Homo sapiens
uuguaugucuucauuugaaaaa

SEQ ID NO: 347599 - RNA, 22 nt, Homo sapiens
uugucauuuucagaguguuacg

SEQ ID NO: 347600 - RNA, 22 nt, Homo sapiens
uuguccauggacagcaccacag

SEQ ID NO: 347601 - RNA, 22 nt, Homo sapiens
uugucccauggggucuuccuuu

SEQ ID NO: 347602 - RNA, 22 nt, Homo sapiens
uugugcaaaguugugguuucug

SEQ ID NO: 347603 - RNA, 22 nt, Homo sapiens
uugugcauaucagagguuugcu

SEQ ID NO: 347604 - RNA, 22 nt, Homo sapiens
uugugcauguauauuaguucac

SEQ ID NO: 347605 - RNA, 22 nt, Homo sapiens
uugugccauucuucugccucag

SEQ ID NO: 347606 - RNA, 22 nt, Homo sapiens
uugugcuugauuugccuagcug

SEQ ID NO: 347607 - RNA, 22 nt, Homo sapiens
uugugguuuuaucuaccuuugg

SEQ ID NO: 347608 - RNA, 22 nt, Homo sapiens
uuguuauguuggucaguaaugu

SEQ ID NO: 347609 - RNA, 22 nt, Homo sapiens
uuguucaggagguuggggaugc

SEQ ID NO: 347610 - RNA, 17 nt, Homo sapiens
uuguucccauuaaaaag

SEQ ID NO: 347611 - RNA, 22 nt, Homo sapiens
uuguuugguuagaugggcaagu

SEQ ID NO: 347612 - RNA, 18 nt, Homo sapiens
uuuacaguagaaggacuu

SEQ ID NO: 347613 - RNA, 21 nt, Homo sapiens
uuuacuguggacccauugcuu

SEQ ID NO: 347614 - RNA, 22 nt, Homo sapiens
uuuacugugggguuucuuagag

SEQ ID NO: 347615 - RNA, 22 nt, Homo sapiens
uuuagcaaugcuguggggaagu

SEQ ID NO: 347616 - RNA, 22 nt, Homo sapiens
uuuagcucauucaauuucaguc

SEQ ID NO: 347617 - RNA, 22 nt, Homo sapiens
uuuaguccucugaaaaucuaua

SEQ ID NO: 347618 - RNA, 22 nt, Homo sapiens
uuuaucuguuuaaaacuguuca

SEQ ID NO: 347619 - RNA, 23 nt, Homo sapiens
uuucacagaaggauuguagggcc

SEQ ID NO: 347620 - RNA, 22 nt, Homo sapiens
uuucacagagggcuucuuucua

SEQ ID NO: 347621 - RNA, 22 nt, Homo sapiens
uuucaguagagacacgguuuug

SEQ ID NO: 347622 - RNA, 22 nt, Homo sapiens
uuucaguguggcaggcauagcu

SEQ ID NO: 347623 - RNA, 22 nt, Homo sapiens
uuucauccggcuguguauuaug

SEQ ID NO: 347624 - RNA, 22 nt, Homo sapiens
uuucauggcgaggcuucauggg

SEQ ID NO: 347625 - RNA, 23 nt, Homo sapiens
uuucauggggauuuacucauucc

SEQ ID NO: 347626 - RNA, 18 nt, Homo sapiens
uuucauugagugugauau

SEQ ID NO: 347627 - RNA, 22 nt, Homo sapiens
uuuccaagaugcuuacuuucuc

SEQ ID NO: 347628 - RNA, 22 nt, Homo sapiens
uuuccuguaggaaggaaauaga

SEQ ID NO: 347629 - RNA, 22 nt, Homo sapiens
uuucgugucuggucugugaugg

SEQ ID NO: 347630 - RNA, 22 nt, Homo sapiens
uuucucaguguuucaggguagg

SEQ ID NO: 347631 - RNA, 22 nt, Homo sapiens
uuugaagacuacugggagugaa

SEQ ID NO: 347632 - RNA, 22 nt, Homo sapiens
uuugaauguaaugagcaggaag

SEQ ID NO: 347633 - RNA, 22 nt, Homo sapiens
uuugacucacagccuggcugcc

SEQ ID NO: 347634 - RNA, 18 nt, Homo sapiens
uuugacugguguccuuau

SEQ ID NO: 347635 - RNA, 22 nt, Homo sapiens
uuugagcauggaaauggcauga

SEQ ID NO: 347636 - RNA, 22 nt, Homo sapiens
uuugaggaaaggcauaaguagg

SEQ ID NO: 347637 - RNA, 22 nt, Homo sapiens
uuugagugugauaucgauugga

SEQ ID NO: 347638 - RNA, 22 nt, Homo sapiens
uuugauguugagacuauaaagc

SEQ ID NO: 347639 - RNA, 22 nt, Homo sapiens
uuugauguugauacuaccuuca

SEQ ID NO: 347640 - RNA, 22 nt, Homo sapiens
uuugcaccuuccuaguggcuga

SEQ ID NO: 347641 - RNA, 22 nt, Homo sapiens
uuugcuuguguaaaaaucugga

SEQ ID NO: 347642 - RNA, 22 nt, Homo sapiens
uuuggcacuauagguaaauuug

SEQ ID NO: 347643 - RNA, 22 nt, Homo sapiens
uuuggcaguuauuuacucagug

SEQ ID NO: 347644 - RNA, 21 nt, Homo sapiens
uuuggcauuaugucaccagag

SEQ ID NO: 347645 - RNA, 23 nt, Homo sapiens
uuuggcauuccagaaauuuucau

SEQ ID NO: 347646 - RNA, 22 nt, Homo sapiens
uuuggcauuuaaauaugcaugg

SEQ ID NO: 347647 - RNA, 22 nt, Homo sapiens
uuugggaaugaguuuaucauuu

SEQ ID NO: 347648 - RNA, 22 nt, Homo sapiens
uuugggccauggcuuuuccacg

SEQ ID NO: 347649 - RNA, 22 nt, Homo sapiens
uuuggucccaaugugauaaggu

SEQ ID NO: 347650 - RNA, 22 nt, Homo sapiens
uuugguccuccuacagggcagg

SEQ ID NO: 347651 - RNA, 22 nt, Homo sapiens
uuugguugcauucacauauuuc

SEQ ID NO: 347652 - RNA, 22 nt, Homo sapiens
uuuguacuucauacaauaacuc

SEQ ID NO: 347653 - RNA, 22 nt, Homo sapiens
uuugucaauaacuaccaacagg

SEQ ID NO: 347654 - RNA, 22 nt, Homo sapiens
uuugugacacaaacacauauau

SEQ ID NO: 347655 - RNA, 22 nt, Homo sapiens
uuugugcuccuaugagaaucua

SEQ ID NO: 347656 - RNA, 22 nt, Homo sapiens
uuugugcuccucucaguaugug

SEQ ID NO: 347657 - RNA, 22 nt, Homo sapiens
uuugugcugcaauuaauuuccc

SEQ ID NO: 347658 - RNA, 22 nt, Homo sapiens
uuuguggaaugcucauguguag

SEQ ID NO: 347659 - RNA, 23 nt, Homo sapiens
uuuguguccccacccaaaucuca

SEQ ID NO: 347660 - RNA, 22 nt, Homo sapiens
uuuuaagcuacaagagacauau

SEQ ID NO: 347661 - RNA, 22 nt, Homo sapiens
uuuuacacaucaccgcucgugu

SEQ ID NO: 347662 - RNA, 22 nt, Homo sapiens
uuuuacacuucgguugugugca

SEQ ID NO: 347663 - RNA, 20 nt, Homo sapiens
uuuuagcacuuguuauggug

SEQ ID NO: 347664 - RNA, 22 nt, Homo sapiens
uuuucaguggccauaguggaga

SEQ ID NO: 347665 - RNA, 19 nt, Homo sapiens
uuuuccccuuucuuaagac

SEQ ID NO: 347666 - RNA, 22 nt, Homo sapiens
uuuugcaaauuccaguggccau

SEQ ID NO: 347667 - RNA, 22 nt, Homo sapiens
uuuugcaguuacagagagugag

SEQ ID NO: 347668 - RNA, 22 nt, Homo sapiens
uuuugcucuucauagguccugu

SEQ ID NO: 347669 - RNA, 18 nt, Homo sapiens
uuuugcuuaacugcgcca

SEQ ID NO: 347670 - RNA, 18 nt, Homo sapiens
gacagugugaagauuccu

SEQ ID NO: 347671 - RNA, 20 nt, Homo sapiens
gacaugacuaggagauagcc

SEQ ID NO: 347672 - RNA, 22 nt, Homo sapiens
gaccaaagaggcaggcauuaga

SEQ ID NO: 347673 - RNA, 22 nt, Homo sapiens
gaccuuguagaaucucaugauu

SEQ ID NO: 347674 - RNA, 22 nt, Homo sapiens
gacugcagugcagcuguuaggc

SEQ ID NO: 347675 - RNA, 20 nt, Homo sapiens
gacuugagagugggagagua

SEQ ID NO: 347676 - RNA, 22 nt, Homo sapiens
gagaacagagauaauuuuacuu

SEQ ID NO: 347677 - RNA, 22 nt, Homo sapiens
gagaacaguguuguauuuuuuc

SEQ ID NO: 347678 - RNA, 22 nt, Homo sapiens
gagaacauuuaagccacucagg

SEQ ID NO: 347679 - RNA, 22 nt, Homo sapiens
gagaacuaaugauguacuaggc

SEQ ID NO: 347680 - RNA, 22 nt, Homo sapiens
gagaaugagauuaugguuacau

SEQ ID NO: 347681 - RNA, 22 nt, Homo sapiens
gagacggagucucgcucugucg

SEQ ID NO: 347682 - RNA, 22 nt, Homo sapiens
gagacggagucuugcucuguug

SEQ ID NO: 347683 - RNA, 22 nt, Homo sapiens
gagacugagucucgcucugccg

SEQ ID NO: 347684 - RNA, 22 nt, Homo sapiens
gagagcaugugcuggcaucagu

SEQ ID NO: 347685 - RNA, 22 nt, Homo sapiens
gagagugcuuggcaucugcuga

SEQ ID NO: 347686 - RNA, 22 nt, Homo sapiens
gagauagguauuucauuuaccc

SEQ ID NO: 347687 - RNA, 22 nt, Homo sapiens
gagauauuauuucccuuucaca

SEQ ID NO: 347688 - RNA, 22 nt, Homo sapiens
gagaucaaugggauggaauuga

SEQ ID NO: 347689 - RNA, 22 nt, Homo sapiens
gagaucaauucauggcauaguu

SEQ ID NO: 347690 - RNA, 22 nt, Homo sapiens
gagaucauguacuagaacaccu

SEQ ID NO: 347691 - RNA, 22 nt, Homo sapiens
gagaucauugugggccaagcug

SEQ ID NO: 347692 - RNA, 22 nt, Homo sapiens
gagauuauuuaaaaggugauuu

SEQ ID NO: 347693 - RNA, 22 nt, Homo sapiens
gagauucaucuagguccagaga

SEQ ID NO: 347694 - RNA, 22 nt, Homo sapiens
gagcaaaaguauguauugguua

SEQ ID NO: 347695 - RNA, 22 nt, Homo sapiens
gagcaacaguggcagugguggg

SEQ ID NO: 347696 - RNA, 22 nt, Homo sapiens
gagcacugaauacugugguggu

SEQ ID NO: 347697 - RNA, 22 nt, Homo sapiens
gagcaucaguggccucaucuca

SEQ ID NO: 347698 - RNA, 22 nt, Homo sapiens
gagcugaucuuuucugauucca

SEQ ID NO: 347699 - RNA, 22 nt, Homo sapiens
gagcuuggguuaaaguugccuu

SEQ ID NO: 347700 - RNA, 22 nt, Homo sapiens
gaggagauauucugcuggaugg

SEQ ID NO: 347701 - RNA, 22 nt, Homo sapiens
gaggcaagaguaguuaaguuag

SEQ ID NO: 347702 - RNA, 22 nt, Homo sapiens
gaggcacucuguacaaaucugc

SEQ ID NO: 347703 - RNA, 22 nt, Homo sapiens
gaggcauugaagauauggaagu

SEQ ID NO: 347704 - RNA, 22 nt, Homo sapiens
gagguaagaugauucguguccu

SEQ ID NO: 347705 - RNA, 22 nt, Homo sapiens
gagguagaauguuuuucagcug

SEQ ID NO: 347706 - RNA, 22 nt, Homo sapiens
gagguagugagcagcugaacua

SEQ ID NO: 347707 - RNA, 22 nt, Homo sapiens
gagguggugguggaggcauagc

SEQ ID NO: 347708 - RNA, 22 nt, Homo sapiens
gagguguaaggacaacagagac

SEQ ID NO: 347709 - RNA, 22 nt, Homo sapiens
gaguauauuugcacuguuaugu

SEQ ID NO: 347710 - RNA, 22 nt, Homo sapiens
gaguuacauuguaauugccgag

SEQ ID NO: 347711 - RNA, 22 nt, Homo sapiens
gaguuagguugucaaugucuua

SEQ ID NO: 347712 - RNA, 22 nt, Homo sapiens
gaguucauuuugaaaccuugau

SEQ ID NO: 347713 - RNA, 22 nt, Homo sapiens
gauaaagauagcaauagggaca

SEQ ID NO: 347714 - RNA, 22 nt, Homo sapiens
gauacaguaugcaugugguauu

SEQ ID NO: 347715 - RNA, 22 nt, Homo sapiens
gauauguguuuuagucaggguu

SEQ ID NO: 347716 - RNA, 22 nt, Homo sapiens
gauauugacuuauucuauguuu

SEQ ID NO: 347717 - RNA, 22 nt, Homo sapiens
gaucaauuggcugaagacacgu

SEQ ID NO: 347718 - RNA, 22 nt, Homo sapiens
gaucacaguuccucacgggcau

SEQ ID NO: 347719 - RNA, 22 nt, Homo sapiens
gaucacaugggagaaugagagu

SEQ ID NO: 347720 - RNA, 22 nt, Homo sapiens
gaucagauggcuguuggugugu

SEQ ID NO: 347721 - RNA, 22 nt, Homo sapiens
gaucaguuucuggagauacgua

SEQ ID NO: 347722 - RNA, 22 nt, Homo sapiens
gaucugagaaagugucauaaca

SEQ ID NO: 347723 - RNA, 22 nt, Homo sapiens
gaugaucaugaccuacagaugg

SEQ ID NO: 347724 - RNA, 22 nt, Homo sapiens
gaugcaaauuaagcuugggaca

SEQ ID NO: 347725 - RNA, 22 nt, Homo sapiens
gaugcagcuaggauuugugaca

SEQ ID NO: 347726 - RNA, 22 nt, Homo sapiens
gauggauuuuaagugaaugaaa

SEQ ID NO: 347727 - RNA, 22 nt, Homo sapiens
gauggcacuguagcaacacaaa

SEQ ID NO: 347728 - RNA, 22 nt, Homo sapiens
gaugguuuuuuaagaagagccu

SEQ ID NO: 347729 - RNA, 22 nt, Homo sapiens
gauuagaacagaagucagauua

SEQ ID NO: 347730 - RNA, 22 nt, Homo sapiens
gauuagagaaauacugcugcua

SEQ ID NO: 347731 - RNA, 22 nt, Homo sapiens
gauuucaucuuuagaggaagga

SEQ ID NO: 347732 - RNA, 22 nt, Homo sapiens
gauuuguuggccugugagcuag

SEQ ID NO: 347733 - RNA, 22 nt, Homo sapiens
gcaaaauugagaagggaauaua

SEQ ID NO: 347734 - RNA, 22 nt, Homo sapiens
gcaaagaaugcagauuugccuc

SEQ ID NO: 347735 - RNA, 22 nt, Homo sapiens
gcaaaguguuuuccaacuuggu

SEQ ID NO: 347736 - RNA, 20 nt, Homo sapiens
gcaaauggaucccacaagcc

SEQ ID NO: 347737 - RNA, 22 nt, Homo sapiens
gcacaggguuacauucuaaggu

SEQ ID NO: 347738 - RNA, 22 nt, Homo sapiens
gcacauuacaaguauuagcuca

SEQ ID NO: 347739 - RNA, 22 nt, Homo sapiens
gcaccacugcacucucagcuug

SEQ ID NO: 347740 - RNA, 22 nt, Homo sapiens
gcacccugucaaaauggaccaa

SEQ ID NO: 347741 - RNA, 22 nt, Homo sapiens
gcacugggccacauuuauuuuc

SEQ ID NO: 347742 - RNA, 22 nt, Homo sapiens
gcagcaucaaaucacacaagau

SEQ ID NO: 347743 - RNA, 22 nt, Homo sapiens
gcaggaaucuugagaaggauuc

SEQ ID NO: 347744 - RNA, 22 nt, Homo sapiens
gcaggaauuucucugcagaccc

SEQ ID NO: 347745 - RNA, 16 nt, Homo sapiens
gcaguguguuuaauag

SEQ ID NO: 347746 - RNA, 17 nt, Homo sapiens
gcauaugucgaaccagc

SEQ ID NO: 347747 - RNA, 17 nt, Homo sapiens
gcauauguugaaccagu

SEQ ID NO: 347748 - RNA, 19 nt, Homo sapiens
gcaucauuaguugcuuuuc

SEQ ID NO: 347749 - RNA, 22 nt, Homo sapiens
gcauggaaggcgcuuugugacu

SEQ ID NO: 347750 - RNA, 22 nt, Homo sapiens
gccaaaaugcugggauuacagg

SEQ ID NO: 347751 - RNA, 22 nt, Homo sapiens
gccaacauggcgcuccauucuu

SEQ ID NO: 347752 - RNA, 22 nt, Homo sapiens
gccaagauugguuuaauauucc

SEQ ID NO: 347753 - RNA, 22 nt, Homo sapiens
gccauugcacuacagccuaggc

SEQ ID NO: 347754 - RNA, 22 nt, Homo sapiens
gcccacuguuaaauuuguuuua

SEQ ID NO: 347755 - RNA, 22 nt, Homo sapiens
gcccagcguucagggaggggcu

SEQ ID NO: 347756 - RNA, 22 nt, Homo sapiens
gccccgggugaugcagccguca

SEQ ID NO: 347757 - RNA, 22 nt, Homo sapiens
gcccugagauucuuggauucug

SEQ ID NO: 347758 - RNA, 22 nt, Homo sapiens
gcccuuugugucuggcuggggu

SEQ ID NO: 347759 - RNA, 22 nt, Homo sapiens
gccuagagaguuaucaggcugu

SEQ ID NO: 347760 - RNA, 22 nt, Homo sapiens
gccugagaggauaugauccccu

SEQ ID NO: 347761 - RNA, 22 nt, Homo sapiens
gcuaaaugcaugaggcgaugug

SEQ ID NO: 347762 - RNA, 22 nt, Homo sapiens
gcuaggagauccacugcucucu

SEQ ID NO: 347763 - RNA, 22 nt, Homo sapiens
gcuaggagaucugcugcucucu

SEQ ID NO: 347764 - RNA, 22 nt, Homo sapiens
gcugagguucaagaagguuaaa

SEQ ID NO: 347765 - RNA, 22 nt, Homo sapiens
gcugcuguaccagaugugguua

SEQ ID NO: 347766 - RNA, 22 nt, Homo sapiens
uaaacugucuuuggagcuuugc

SEQ ID NO: 347767 - RNA, 22 nt, Homo sapiens
uaaagcacaaguaaagaauacu

SEQ ID NO: 347768 - RNA, 22 nt, Homo sapiens
uaaagcauguaauuagguuaga

SEQ ID NO: 347769 - RNA, 22 nt, Homo sapiens
uaaagcuuagauccaugguggc

SEQ ID NO: 347770 - RNA, 21 nt, Homo sapiens
uaaagcuuagcuauaguggcu

SEQ ID NO: 347771 - RNA, 22 nt, Homo sapiens
uaaagugcugagaugaggcugg

SEQ ID NO: 347772 - RNA, 22 nt, Homo sapiens
uaaaguuauugccccucaguua

SEQ ID NO: 347773 - RNA, 22 nt, Homo sapiens
uaaauggauaaaugaauaccua

SEQ ID NO: 347774 - RNA, 18 nt, Homo sapiens
uaacagucucucaggauc

SEQ ID NO: 347775 - RNA, 23 nt, Homo sapiens
uaacauguuuuuaagggaagcuu

SEQ ID NO: 347776 - RNA, 22 nt, Homo sapiens
uaacauuguugauuauacuaag

SEQ ID NO: 347777 - RNA, 21 nt, Homo sapiens
uaacccugaaggagcucugga

SEQ ID NO: 347778 - RNA, 22 nt, Homo sapiens
uaacuagaaaggagacaguugc

SEQ ID NO: 347779 - RNA, 22 nt, Homo sapiens
uaacuguggaaaugacuuuaaa

SEQ ID NO: 347780 - RNA, 20 nt, Homo sapiens
uaacuguggcuucuuuuggc

SEQ ID NO: 347781 - RNA, 18 nt, Homo sapiens
uaacugugggaacuaacu

SEQ ID NO: 347782 - RNA, 22 nt, Homo sapiens
uaagacacuuaaaauguuacau

SEQ ID NO: 347783 - RNA, 22 nt, Homo sapiens
uaagacucuggacucuaauguu

SEQ ID NO: 347784 - RNA, 22 nt, Homo sapiens
uaagcuauagugaauaaauugc

SEQ ID NO: 347785 - RNA, 22 nt, Homo sapiens
uaaggaaggcugugugcuuuua

SEQ ID NO: 347786 - RNA, 22 nt, Homo sapiens
uaaggcuuaugguaaaguccug

SEQ ID NO: 347787 - RNA, 22 nt, Homo sapiens
uaaggcuuugcuggacucaguc

SEQ ID NO: 347788 - RNA, 22 nt, Homo sapiens
uaagggacauguguugccuaag

SEQ ID NO: 347789 - RNA, 22 nt, Homo sapiens
uaagguuacaaaggacuucaua

SEQ ID NO: 347790 - RNA, 22 nt, Homo sapiens
uaagugcuugacuuugauguuu

SEQ ID NO: 347791 - RNA, 22 nt, Homo sapiens
uaaguuguagaacguuuucuua

SEQ ID NO: 347792 - RNA, 18 nt, Homo sapiens
uaauaacugugaccuuga

SEQ ID NO: 347793 - RNA, 21 nt, Homo sapiens
uaauaaugucucagacaccua

SEQ ID NO: 347794 - RNA, 22 nt, Homo sapiens
uaauaauguuaggcuuacucaa

SEQ ID NO: 347795 - RNA, 22 nt, Homo sapiens
uaauacugcugugcuugaguug

SEQ ID NO: 347796 - RNA, 22 nt, Homo sapiens
uaauacuugucauaaaggcauu

SEQ ID NO: 347797 - RNA, 22 nt, Homo sapiens
uaauagcucggauaaacaugau

SEQ ID NO: 347798 - RNA, 22 nt, Homo sapiens
uaauauguuuugaaaucaggaa

SEQ ID NO: 347799 - RNA, 22 nt, Homo sapiens
uaaucacagagguuuggccuca

SEQ ID NO: 347800 - RNA, 22 nt, Homo sapiens
uaaugcaucagugguaguucuu

SEQ ID NO: 347801 - RNA, 22 nt, Homo sapiens
uaauucugacaacaguggcguu

SEQ ID NO: 347802 - RNA, 22 nt, Homo sapiens
uacacacguguguauauauaca

SEQ ID NO: 347803 - RNA, 22 nt, Homo sapiens
uacacagucaaaaauuuccagg

SEQ ID NO: 347804 - RNA, 22 nt, Homo sapiens
uacacaugugaguucuuuucua

SEQ ID NO: 347805 - RNA, 20 nt, Homo sapiens
uacaggacugagaaucugug

SEQ ID NO: 347806 - RNA, 22 nt, Homo sapiens
uacagguauagauguguguucu

SEQ ID NO: 347807 - RNA, 22 nt, Homo sapiens
uacaguaauguuaaucuuugug

SEQ ID NO: 347808 - RNA, 22 nt, Homo sapiens
uacaguacacagguaccaagcu

SEQ ID NO: 347809 - RNA, 22 nt, Homo sapiens
uacagucauaaugccuagugac

SEQ ID NO: 347810 - RNA, 22 nt, Homo sapiens
uacaguggugugaucucagcuc

SEQ ID NO: 347811 - RNA, 22 nt, Homo sapiens
uacaugcaugggcaugugugca

SEQ ID NO: 347812 - RNA, 22 nt, Homo sapiens
uaccaaaguuucggccucuguu

SEQ ID NO: 347813 - RNA, 22 nt, Homo sapiens
uaccacccuuuuuccagaagcc

SEQ ID NO: 347814 - RNA, 22 nt, Homo sapiens
uaccacugccgagaaaacagau

SEQ ID NO: 347815 - RNA, 22 nt, Homo sapiens
uaccagcauuucucuuuaagua

SEQ ID NO: 347816 - RNA, 23 nt, Homo sapiens
uacuaguaagcguguucuuugca

SEQ ID NO: 347817 - RNA, 22 nt, Homo sapiens
uacucaauugcagucaccuggc

SEQ ID NO: 347818 - RNA, 22 nt, Homo sapiens
uacugcacuccagccugccaac

SEQ ID NO: 347819 - RNA, 22 nt, Homo sapiens
uacugcacuccagccuugccaa

SEQ ID NO: 347820 - RNA, 22 nt, Homo sapiens
uacugcacuccagcuuaggaga

SEQ ID NO: 347821 - RNA, 19 nt, Homo sapiens
uacugcacuccagucuggg

SEQ ID NO: 347822 - RNA, 22 nt, Homo sapiens
uacugcuuaaaagucaauuacu

SEQ ID NO: 347823 - RNA, 21 nt, Homo sapiens
uacuugagacagggucuugcu

SEQ ID NO: 347824 - RNA, 22 nt, Homo sapiens
uagaaguaggcuacgugucugg

SEQ ID NO: 347825 - RNA, 22 nt, Homo sapiens
uagaaucuaacucgcaugaaaa

SEQ ID NO: 347826 - RNA, 22 nt, Homo sapiens
uagaauguaacaguuaaaagca

SEQ ID NO: 347827 - RNA, 22 nt, Homo sapiens
uagacccauuguucagagagug

SEQ ID NO: 347828 - RNA, 21 nt, Homo sapiens
uagagagcaauaccuccagag

SEQ ID NO: 347829 - RNA, 22 nt, Homo sapiens
uagagcacaagguagauuucua

SEQ ID NO: 347830 - RNA, 22 nt, Homo sapiens
uagagguauaccaaaaaggcau

SEQ ID NO: 347831 - RNA, 21 nt, Homo sapiens
uagauacuguauuaaaccuag

SEQ ID NO: 347832 - RNA, 21 nt, Homo sapiens
uagauaguugguucugaaucu

SEQ ID NO: 347833 - RNA, 23 nt, Homo sapiens
uagaucaucaaguuuacugugcu

SEQ ID NO: 347834 - RNA, 19 nt, Homo sapiens
uagaugucuuugcauagau

SEQ ID NO: 347835 - RNA, 22 nt, Homo sapiens
uagauuauccggcugggacaau

SEQ ID NO: 347836 - RNA, 22 nt, Homo sapiens
uagauucaucuguuccuuuuga

SEQ ID NO: 347837 - RNA, 22 nt, Homo sapiens
uagcaaaucaauggaauugaag

SEQ ID NO: 347838 - RNA, 21 nt, Homo sapiens
uagcaaauugcuauuaaggca

SEQ ID NO: 347839 - RNA, 23 nt, Homo sapiens
uagcaacaguuggaggugaggua

SEQ ID NO: 347840 - RNA, 22 nt, Homo sapiens
uagcaagaugaauuugugcaaa

SEQ ID NO: 347841 - RNA, 22 nt, Homo sapiens
uagcagcagugguguauuuaga

SEQ ID NO: 347842 - RNA, 22 nt, Homo sapiens
uagcagcauuuuuguagaguau

SEQ ID NO: 347843 - RNA, 22 nt, Homo sapiens
uagcagcuuuauugagguaaau

SEQ ID NO: 347844 - RNA, 22 nt, Homo sapiens
uagcagugugaaaacagacuaa

SEQ ID NO: 347845 - RNA, 22 nt, Homo sapiens
uagcaucaauucauguuaugau

SEQ ID NO: 347846 - RNA, 22 nt, Homo sapiens
uagcugauguuugucuaguagc

SEQ ID NO: 347847 - RNA, 22 nt, Homo sapiens
uagcuucuccauagcuccaugu

SEQ ID NO: 347848 - RNA, 18 nt, Homo sapiens
uaggaacauugauuggag

SEQ ID NO: 347849 - RNA, 22 nt, Homo sapiens
uaggacauugcccuuguggaga

SEQ ID NO: 347850 - RNA, 19 nt, Homo sapiens
uaggacccugguggccccc

SEQ ID NO: 347851 - RNA, 20 nt, Homo sapiens
uaggagcaaugagaguagaa

SEQ ID NO: 347852 - RNA, 22 nt, Homo sapiens
uaggauaguccuccugagaccu

SEQ ID NO: 347853 - RNA, 22 nt, Homo sapiens
uaggcaguggagaaauaaacag

SEQ ID NO: 347854 - RNA, 22 nt, Homo sapiens
uagggcuuuccggccugucaga

SEQ ID NO: 347855 - RNA, 18 nt, Homo sapiens
uaguacuguucucaugau

SEQ ID NO: 347856 - RNA, 22 nt, Homo sapiens
uaguaucacaagguguacaccc

SEQ ID NO: 347857 - RNA, 22 nt, Homo sapiens
uagucaaaucugaaggaaauuu

SEQ ID NO: 347858 - RNA, 22 nt, Homo sapiens
uaguccauuuucaugcugcuau

SEQ ID NO: 347859 - RNA, 22 nt, Homo sapiens
uagugcacuacuugugggaaug

SEQ ID NO: 347860 - RNA, 21 nt, Homo sapiens
uagugcagugggguaugacuu

SEQ ID NO: 347861 - RNA, 18 nt, Homo sapiens
uagugcuguucucaugau

SEQ ID NO: 347862 - RNA, 22 nt, Homo sapiens
augacagagauaugugaauuuu

SEQ ID NO: 347863 - RNA, 22 nt, Homo sapiens
augacagcaucugugaaguugu

SEQ ID NO: 347864 - RNA, 22 nt, Homo sapiens
augaccuuguccucagugucau

SEQ ID NO: 347865 - RNA, 22 nt, Homo sapiens
augacugucagggcagucauug

SEQ ID NO: 347866 - RNA, 22 nt, Homo sapiens
augagaacauaucaagugauug

SEQ ID NO: 347867 - RNA, 22 nt, Homo sapiens
augagaacugucaaugagagcu

SEQ ID NO: 347868 - RNA, 22 nt, Homo sapiens
augagacuagaagagaauaaua

SEQ ID NO: 347869 - RNA, 22 nt, Homo sapiens
augagacuguucuuccucauug

SEQ ID NO: 347870 - RNA, 22 nt, Homo sapiens
augagauaaaccaucucuuaag

SEQ ID NO: 347871 - RNA, 22 nt, Homo sapiens
augagauauguuaaaaguuaaa

SEQ ID NO: 347872 - RNA, 22 nt, Homo sapiens
augagaucugugaacaccuguc

SEQ ID NO: 347873 - RNA, 22 nt, Homo sapiens
augagaugcaagauuagauggg

SEQ ID NO: 347874 - RNA, 22 nt, Homo sapiens
augaggaagucaggcccagggg

SEQ ID NO: 347875 - RNA, 22 nt, Homo sapiens
augaguugaagcuacaagaggc

SEQ ID NO: 347876 - RNA, 22 nt, Homo sapiens
augauacuguucuaagauuuuu

SEQ ID NO: 347877 - RNA, 22 nt, Homo sapiens
augauaugagaaaggaucaaca

SEQ ID NO: 347878 - RNA, 22 nt, Homo sapiens
augaucacuguggaaauucagc

SEQ ID NO: 347879 - RNA, 22 nt, Homo sapiens
augauucugaucuagagcuugg

SEQ ID NO: 347880 - RNA, 22 nt, Homo sapiens
augcaaacaucauagaguguac

SEQ ID NO: 347881 - RNA, 22 nt, Homo sapiens
augcaagcacacaagaggaaau

SEQ ID NO: 347882 - RNA, 19 nt, Homo sapiens
augcaaugucacaggcugc

SEQ ID NO: 347883 - RNA, 22 nt, Homo sapiens
augcaauucuagauugauagua

SEQ ID NO: 347884 - RNA, 22 nt, Homo sapiens
augcacaguccagcccaugugg

SEQ ID NO: 347885 - RNA, 22 nt, Homo sapiens
augcacuguuguuauuggauaa

SEQ ID NO: 347886 - RNA, 22 nt, Homo sapiens
augcacuguuuucuugaugaga

SEQ ID NO: 347887 - RNA, 22 nt, Homo sapiens
augcauaugucuuuauaguggc

SEQ ID NO: 347888 - RNA, 22 nt, Homo sapiens
augcauggcagagucaggguac

SEQ ID NO: 347889 - RNA, 22 nt, Homo sapiens
augccacuguuuaugucacuua

SEQ ID NO: 347890 - RNA, 22 nt, Homo sapiens
augccauugcacuccagccugg

SEQ ID NO: 347891 - RNA, 22 nt, Homo sapiens
augccuaagacccuguggggga

SEQ ID NO: 347892 - RNA, 22 nt, Homo sapiens
augcuguuuugaauucucuaga

SEQ ID NO: 347893 - RNA, 21 nt, Homo sapiens
auggaaagacugccucuucaa

SEQ ID NO: 347894 - RNA, 22 nt, Homo sapiens
auggaacuggagaugguuauau

SEQ ID NO: 347895 - RNA, 22 nt, Homo sapiens
auggaagcauaguauucuauug

SEQ ID NO: 347896 - RNA, 22 nt, Homo sapiens
auggaagcugauuagauaguac

SEQ ID NO: 347897 - RNA, 22 nt, Homo sapiens
auggaaucauccuccugggagc

SEQ ID NO: 347898 - RNA, 22 nt, Homo sapiens
auggaauguaaguuauguuugc

SEQ ID NO: 347899 - RNA, 22 nt, Homo sapiens
auggaauguggaaugguaagua

SEQ ID NO: 347900 - RNA, 22 nt, Homo sapiens
auggacauuaaagcgauguaga

SEQ ID NO: 347901 - RNA, 22 nt, Homo sapiens
auggacucauugaauuaagucc

SEQ ID NO: 347902 - RNA, 22 nt, Homo sapiens
auggagaugugcgaacugagua

SEQ ID NO: 347903 - RNA, 22 nt, Homo sapiens
auggauugucuccuugugccau

SEQ ID NO: 347904 - RNA, 22 nt, Homo sapiens
auggcaagaagagcaauuauuu

SEQ ID NO: 347905 - RNA, 22 nt, Homo sapiens
auggcaauguaagucagaaaaa

SEQ ID NO: 347906 - RNA, 22 nt, Homo sapiens
auggcaccauguuaugauaaua

SEQ ID NO: 347907 - RNA, 22 nt, Homo sapiens
auggcacugauggaaguaccuu

SEQ ID NO: 347908 - RNA, 22 nt, Homo sapiens
auggcagaaucaagccgacagc

SEQ ID NO: 347909 - RNA, 22 nt, Homo sapiens
auggcagcaccccacucuacug

SEQ ID NO: 347910 - RNA, 22 nt, Homo sapiens
auggcaguuucacucugggauu

SEQ ID NO: 347911 - RNA, 22 nt, Homo sapiens
auggcccccuguuugugaacau

SEQ ID NO: 347912 - RNA, 22 nt, Homo sapiens
auggccuuuuuaucucaccaag

SEQ ID NO: 347913 - RNA, 22 nt, Homo sapiens
auggcucaauucuuucccugaa

SEQ ID NO: 347914 - RNA, 22 nt, Homo sapiens
auggcucaguguguaucuauca

SEQ ID NO: 347915 - RNA, 22 nt, Homo sapiens
auggcucuggauagaaugcagg

SEQ ID NO: 347916 - RNA, 22 nt, Homo sapiens
auggcucuuauuauuugaggua

SEQ ID NO: 347917 - RNA, 22 nt, Homo sapiens
auggcuugugacccaugcuuca

SEQ ID NO: 347918 - RNA, 22 nt, Homo sapiens
auggcuuuggucucccagugau

SEQ ID NO: 347919 - RNA, 22 nt, Homo sapiens
auggcuuuuccugucuugcaug

SEQ ID NO: 347920 - RNA, 22 nt, Homo sapiens
augguacuagaguaagaauugu

SEQ ID NO: 347921 - RNA, 21 nt, Homo sapiens
auguaacugggaaugugagag

SEQ ID NO: 347922 - RNA, 20 nt, Homo sapiens
auguaauguaugauauguac

SEQ ID NO: 347923 - RNA, 22 nt, Homo sapiens
auguagauaucaagaggcauau

SEQ ID NO: 347924 - RNA, 22 nt, Homo sapiens
augucaaggugaagaaagauca

SEQ ID NO: 347925 - RNA, 22 nt, Homo sapiens
augucauagaagccugugaacc

SEQ ID NO: 347926 - RNA, 22 nt, Homo sapiens
augucauagauaaggaagugga

SEQ ID NO: 347927 - RNA, 22 nt, Homo sapiens
auguccauggaaucuguagcaa

SEQ ID NO: 347928 - RNA, 21 nt, Homo sapiens
augugcacuaugucauuuaau

SEQ ID NO: 347929 - RNA, 22 nt, Homo sapiens
augugcagauguuacaaauugu

SEQ ID NO: 347930 - RNA, 22 nt, Homo sapiens
augugcauaugaagcacagaca

SEQ ID NO: 347931 - RNA, 22 nt, Homo sapiens
augugcuuaaaaaugcagagaa

SEQ ID NO: 347932 - RNA, 22 nt, Homo sapiens
augugcuugagggaaaucaguu

SEQ ID NO: 347933 - RNA, 22 nt, Homo sapiens
augugcuuuuggugagagauuu

SEQ ID NO: 347934 - RNA, 22 nt, Homo sapiens
auguggauaucuauaucuggau

SEQ ID NO: 347935 - RNA, 22 nt, Homo sapiens
auguggcuuuccuagaucuuag

SEQ ID NO: 347936 - RNA, 22 nt, Homo sapiens
auguggcuuuucaacuguguga

SEQ ID NO: 347937 - RNA, 22 nt, Homo sapiens
augugguaggcccaugagucau

SEQ ID NO: 347938 - RNA, 22 nt, Homo sapiens
auguguaaagcuuuucuuuguu

SEQ ID NO: 347939 - RNA, 22 nt, Homo sapiens
auguuagcaucaauauucauca

SEQ ID NO: 347940 - RNA, 22 nt, Homo sapiens
auguuauguucuucucuguaua

SEQ ID NO: 347941 - RNA, 22 nt, Homo sapiens
auguuugguaagaauauuguua

SEQ ID NO: 347942 - RNA, 22 nt, Homo sapiens
auguuugguagugaauauggua

SEQ ID NO: 347943 - RNA, 22 nt, Homo sapiens
auuaaggaguggguucauggug

SEQ ID NO: 347944 - RNA, 22 nt, Homo sapiens
auuaaguaaugguuccaauaau

SEQ ID NO: 347945 - RNA, 20 nt, Homo sapiens
auuagagcuacauggcuaca

SEQ ID NO: 347946 - RNA, 22 nt, Homo sapiens
auuaucacaguuuugcauaugg

SEQ ID NO: 347947 - RNA, 22 nt, Homo sapiens
auuauuaguuguugaaugaagu

SEQ ID NO: 347948 - RNA, 20 nt, Homo sapiens
auucaaguaugccuugagaa

SEQ ID NO: 347949 - RNA, 22 nt, Homo sapiens
auucaagugaugcagcuguuuu

SEQ ID NO: 347950 - RNA, 22 nt, Homo sapiens
auucaucagggauauugguuga

SEQ ID NO: 347951 - RNA, 22 nt, Homo sapiens
auuccacaguuaacacagaccg

SEQ ID NO: 347952 - RNA, 20 nt, Homo sapiens
auuccacuuguuugagguac

SEQ ID NO: 347953 - RNA, 22 nt, Homo sapiens
auuccagguggcgccauucaca

SEQ ID NO: 347954 - RNA, 20 nt, Homo sapiens
auugaagacuccggggcaga

SEQ ID NO: 347955 - RNA, 22 nt, Homo sapiens
auugacaguuggccaguaagug

SEQ ID NO: 347956 - RNA, 22 nt, Homo sapiens
auugagcaaggucuccuaguau

SEQ ID NO: 347957 - RNA, 22 nt, Homo sapiens
auugagcuuuuuaaaauauagu

SEQ ID NO: 347958 - RNA, 22 nt, Homo sapiens
auugcaaagcguagacucuaaa

SEQ ID NO: 347959 - RNA, 22 nt, Homo sapiens
auugcaaugggaaacuaugaaa

SEQ ID NO: 347960 - RNA, 22 nt, Homo sapiens
auugcacaccagucugggcaaa

SEQ ID NO: 347961 - RNA, 22 nt, Homo sapiens
auugcacaucugcacuacagcc

SEQ ID NO: 347962 - RNA, 22 nt, Homo sapiens
auugcacuccagccuugggcaa

SEQ ID NO: 347963 - RNA, 22 nt, Homo sapiens
auugcacuccggccugggugac

SEQ ID NO: 347964 - RNA, 22 nt, Homo sapiens
auugcacucuagccugggugac

SEQ ID NO: 347965 - RNA, 22 nt, Homo sapiens
auugcacuggggguuagaauuu

SEQ ID NO: 347966 - RNA, 22 nt, Homo sapiens
auugcauaaacacauuucuuau

SEQ ID NO: 347967 - RNA, 22 nt, Homo sapiens
auugcauugugaucuucccaga

SEQ ID NO: 347968 - RNA, 22 nt, Homo sapiens
auugcuaacugaaauaagacca

SEQ ID NO: 347969 - RNA, 22 nt, Homo sapiens
auugcuuacccuguauuagauc

SEQ ID NO: 347970 - RNA, 22 nt, Homo sapiens
auuggacagcauuucuagacuu

SEQ ID NO: 347971 - RNA, 22 nt, Homo sapiens
auuggggaaugguggcuuuagu

SEQ ID NO: 347972 - RNA, 22 nt, Homo sapiens
auuguaccccaauguacaauau

SEQ ID NO: 347973 - RNA, 22 nt, Homo sapiens
auuguacuagguccuagggcuu

SEQ ID NO: 347974 - RNA, 22 nt, Homo sapiens
auuguacuccagccugggcaag

SEQ ID NO: 347975 - RNA, 22 nt, Homo sapiens
auuguacuccagccugggcgac

SEQ ID NO: 347976 - RNA, 22 nt, Homo sapiens
auuguacuccagccugggcugc

SEQ ID NO: 347977 - RNA, 22 nt, Homo sapiens
auuguacuccagccuguggagc

SEQ ID NO: 347978 - RNA, 22 nt, Homo sapiens
auuguacugccccccuguugcu

SEQ ID NO: 347979 - RNA, 22 nt, Homo sapiens
auuguacuuaagccugggugaa

SEQ ID NO: 347980 - RNA, 19 nt, Homo sapiens
auuuccuggagcuggucuc

SEQ ID NO: 347981 - RNA, 22 nt, Homo sapiens
auuuccuguaggggcuugcgaa

SEQ ID NO: 347982 - RNA, 22 nt, Homo sapiens
auuucuacuccuguguccagaa

SEQ ID NO: 347983 - RNA, 19 nt, Homo sapiens
auuugaucaucaggcacag

SEQ ID NO: 347984 - RNA, 22 nt, Homo sapiens
auuuggcagugaagggaucaca

SEQ ID NO: 347985 - RNA, 22 nt, Homo sapiens
auuugggaaugugcauuauacu

SEQ ID NO: 347986 - RNA, 22 nt, Homo sapiens
auuuggguaaugagugcaaggg

SEQ ID NO: 347987 - RNA, 22 nt, Homo sapiens
auuuuugguugucagcacuagg

SEQ ID NO: 347988 - RNA, 22 nt, Homo sapiens
caaaagugauugcgguuuuugc

SEQ ID NO: 347989 - RNA, 22 nt, Homo sapiens
caaagcacuuggcuuggaagau

SEQ ID NO: 347990 - RNA, 22 nt, Homo sapiens
caaaggcuguuauaggccagga

SEQ ID NO: 347991 - RNA, 22 nt, Homo sapiens
caaaguaauugcuguuuugcca

SEQ ID NO: 347992 - RNA, 22 nt, Homo sapiens
caaauacuuucauguugucuug

SEQ ID NO: 347993 - RNA, 22 nt, Homo sapiens
caacacagugaaacccgucucu

SEQ ID NO: 347994 - RNA, 22 nt, Homo sapiens
caacagucagcccauccacaga

SEQ ID NO: 347995 - RNA, 22 nt, Homo sapiens
caagugcuacagagaaaucuuu

SEQ ID NO: 347996 - RNA, 22 nt, Homo sapiens
caagugcuugaugaaugaucaa

SEQ ID NO: 347997 - RNA, 22 nt, Homo sapiens
caaguguuggcuuguauacaaa

SEQ ID NO: 347998 - RNA, 23 nt, Homo sapiens
caauacugaccucacguuaauag

SEQ ID NO: 347999 - RNA, 19 nt, Homo sapiens
caauacuucuuggcauaca

SEQ ID NO: 348000 - RNA, 22 nt, Homo sapiens
cacaccuaccucauuauggaca

SEQ ID NO: 348001 - RNA, 22 nt, Homo sapiens
cacacugucuucauuacuguag

SEQ ID NO: 348002 - RNA, 22 nt, Homo sapiens
cacacugucuuucagaaugguu

SEQ ID NO: 348003 - RNA, 22 nt, Homo sapiens
cacaggaagaggcacggucccu

SEQ ID NO: 348004 - RNA, 22 nt, Homo sapiens
cacagggcuaacauuuuugccc

SEQ ID NO: 348005 - RNA, 22 nt, Homo sapiens
cacaguguuccagcuauuugaa

SEQ ID NO: 348006 - RNA, 22 nt, Homo sapiens
cacauguucaggagcacuuaga

SEQ ID NO: 348007 - RNA, 22 nt, Homo sapiens
cacauugaauuucugaugacaa

SEQ ID NO: 348008 - RNA, 22 nt, Homo sapiens
caccagcuggcauugaauaccu

SEQ ID NO: 348009 - RNA, 22 nt, Homo sapiens
caccagguggcugaggccauga

SEQ ID NO: 348010 - RNA, 22 nt, Homo sapiens
cacccaguaagcaugaggcccu

SEQ ID NO: 348011 - RNA, 22 nt, Homo sapiens
caccccuaccugagucaggagu

SEQ ID NO: 348012 - RNA, 22 nt, Homo sapiens
cacccuugcagggacagcuuug

SEQ ID NO: 348013 - RNA, 22 nt, Homo sapiens
caccuguagucccagcugaggc

SEQ ID NO: 348014 - RNA, 22 nt, Homo sapiens
cacugcaauuacuuuugcacca

SEQ ID NO: 348015 - RNA, 21 nt, Homo sapiens
cacugcacuugccuucugggu

SEQ ID NO: 348016 - RNA, 22 nt, Homo sapiens
cacugcauggucuagcuggguu

SEQ ID NO: 348017 - RNA, 22 nt, Homo sapiens
cacugcauuacucaugagcaug

SEQ ID NO: 348018 - RNA, 22 nt, Homo sapiens
cacugcauucuccaccucccag

SEQ ID NO: 348019 - RNA, 17 nt, Homo sapiens
cacugggugcaagagga

SEQ ID NO: 348020 - RNA, 20 nt, Homo sapiens
cagagcaaagcaguccuggc

SEQ ID NO: 348021 - RNA, 22 nt, Homo sapiens
cagagcaaugcuuuugcuuuga

SEQ ID NO: 348022 - RNA, 22 nt, Homo sapiens
cagagguaagcaagucagcauu

SEQ ID NO: 348023 - RNA, 22 nt, Homo sapiens
cagagucaagcucuuguuccau

SEQ ID NO: 348024 - RNA, 22 nt, Homo sapiens
cagaguuaguagccuuugacaa

SEQ ID NO: 348025 - RNA, 22 nt, Homo sapiens
cagauacuccuggucucaggag

SEQ ID NO: 348026 - RNA, 22 nt, Homo sapiens
cagauacuggaguccugaaguu

SEQ ID NO: 348027 - RNA, 22 nt, Homo sapiens
cagauacuggccuggagcugug

SEQ ID NO: 348028 - RNA, 22 nt, Homo sapiens
cagaugguggucccacagccca

SEQ ID NO: 348029 - RNA, 22 nt, Homo sapiens
cagcaaaucauccuauuugagc

SEQ ID NO: 348030 - RNA, 22 nt, Homo sapiens
cagcaagucucuaagaguucau

SEQ ID NO: 348031 - RNA, 20 nt, Homo sapiens
cagcacgcacaugagacugu

SEQ ID NO: 348032 - RNA, 22 nt, Homo sapiens
cagcgaggucugcgucacauug

SEQ ID NO: 348033 - RNA, 22 nt, Homo sapiens
cagcuguuguuaugucugcagg

SEQ ID NO: 348034 - RNA, 22 nt, Homo sapiens
caggcaaggugaaguguacugg

SEQ ID NO: 348035 - RNA, 22 nt, Homo sapiens
caggcagucuggcucccaagug

SEQ ID NO: 348036 - RNA, 22 nt, Homo sapiens
cagggcauuggcugguaccugg

SEQ ID NO: 348037 - RNA, 22 nt, Homo sapiens
cagguacuucugggcugagcag

SEQ ID NO: 348038 - RNA, 22 nt, Homo sapiens
caggugaaugccucuccuucug

SEQ ID NO: 348039 - RNA, 22 nt, Homo sapiens
caggugguauuugguuuucugu

SEQ ID NO: 348040 - RNA, 22 nt, Homo sapiens
caguagcaugccucagaaugag

SEQ ID NO: 348041 - RNA, 22 nt, Homo sapiens
cagugcaaccuccaucucucgg

SEQ ID NO: 348042 - RNA, 18 nt, Homo sapiens
cagugcaauacaggagag

SEQ ID NO: 348043 - RNA, 20 nt, Homo sapiens
cagugcaccuggcguguuga

SEQ ID NO: 348044 - RNA, 23 nt, Homo sapiens
cagugcaugacuguauaugcaaa

SEQ ID NO: 348045 - RNA, 22 nt, Homo sapiens
cagugcuuuaucaaguccucca

SEQ ID NO: 348046 - RNA, 22 nt, Homo sapiens
caguguuuuuaacaggugcccg

SEQ ID NO: 348047 - RNA, 22 nt, Homo sapiens
cauacagcuaguaaguguaaga

SEQ ID NO: 348048 - RNA, 22 nt, Homo sapiens
cauacaguaggcacuauuugua

SEQ ID NO: 348049 - RNA, 22 nt, Homo sapiens
cauacaugugcuugucuuaugc

SEQ ID NO: 348050 - RNA, 21 nt, Homo sapiens
caucacauuacucaaaguccu

SEQ ID NO: 348051 - RNA, 22 nt, Homo sapiens
caucacuguugguacaaguaau

SEQ ID NO: 348052 - RNA, 22 nt, Homo sapiens
agugcauaugucuuuuuggaag

SEQ ID NO: 348053 - RNA, 22 nt, Homo sapiens
agugcauuugcaucucaauaua

SEQ ID NO: 348054 - RNA, 22 nt, Homo sapiens
aguggaaucuguuauacuaacu

SEQ ID NO: 348055 - RNA, 22 nt, Homo sapiens
aguggaguguaaagcgucuuuu

SEQ ID NO: 348056 - RNA, 22 nt, Homo sapiens
aguggcuuuuuaguggcagaug

SEQ ID NO: 348057 - RNA, 19 nt, Homo sapiens
agugggcuagaaaucaggg

SEQ ID NO: 348058 - RNA, 22 nt, Homo sapiens
agugguuuuggaauggaauuca

SEQ ID NO: 348059 - RNA, 22 nt, Homo sapiens
aguuggccccuacugggaggug

SEQ ID NO: 348060 - RNA, 22 nt, Homo sapiens
auaaaccuacauuuucacuucu

SEQ ID NO: 348061 - RNA, 17 nt, Homo sapiens
auaaacucaucauuuuu

SEQ ID NO: 348062 - RNA, 22 nt, Homo sapiens
auaaagcuauuccucucuuuuu

SEQ ID NO: 348063 - RNA, 22 nt, Homo sapiens
auaaaguucugcuggcauauau

SEQ ID NO: 348064 - RNA, 22 nt, Homo sapiens
auaaaugcauugagaacugcug

SEQ ID NO: 348065 - RNA, 22 nt, Homo sapiens
auaagaguaguacauaugagac

SEQ ID NO: 348066 - RNA, 22 nt, Homo sapiens
auaaucacacccagguuaaaug

SEQ ID NO: 348067 - RNA, 22 nt, Homo sapiens
auaaugacuuccaguuccacuc

SEQ ID NO: 348068 - RNA, 22 nt, Homo sapiens
auacagacacagucagaggggu

SEQ ID NO: 348069 - RNA, 22 nt, Homo sapiens
auacagcuaaaauauuaaguua

SEQ ID NO: 348070 - RNA, 22 nt, Homo sapiens
auacaguaaugucuuaggcugu

SEQ ID NO: 348071 - RNA, 22 nt, Homo sapiens
auacagugaauaucuggggcag

SEQ ID NO: 348072 - RNA, 22 nt, Homo sapiens
auaccugguagucuugcuacac

SEQ ID NO: 348073 - RNA, 22 nt, Homo sapiens
auacuguuuuacaucauugccu

SEQ ID NO: 348074 - RNA, 22 nt, Homo sapiens
auagaucauugucauuuuagau

SEQ ID NO: 348075 - RNA, 22 nt, Homo sapiens
auagcaauuugggaaucagacu

SEQ ID NO: 348076 - RNA, 22 nt, Homo sapiens
auagcacugguuuuucuugguu

SEQ ID NO: 348077 - RNA, 22 nt, Homo sapiens
auagcagaacagugucucacug

SEQ ID NO: 348078 - RNA, 22 nt, Homo sapiens
auagcaggagaauggucauggg

SEQ ID NO: 348079 - RNA, 22 nt, Homo sapiens
auagcagugugaaaauugacug

SEQ ID NO: 348080 - RNA, 22 nt, Homo sapiens
auagcauaucccacaugucaga

SEQ ID NO: 348081 - RNA, 22 nt, Homo sapiens
auagguauguaauacaaaugaa

SEQ ID NO: 348082 - RNA, 22 nt, Homo sapiens
auaguacuauugcaguguuaua

SEQ ID NO: 348083 - RNA, 19 nt, Homo sapiens
auauaacauccaggagcag

SEQ ID NO: 348084 - RNA, 22 nt, Homo sapiens
auauagcucuggcuggaugacu

SEQ ID NO: 348085 - RNA, 23 nt, Homo sapiens
auauaguagaugugcaguaacau

SEQ ID NO: 348086 - RNA, 22 nt, Homo sapiens
auaucacagguguuuaccugau

SEQ ID NO: 348087 - RNA, 22 nt, Homo sapiens
auaucccaguguguaaacacug

SEQ ID NO: 348088 - RNA, 22 nt, Homo sapiens
auauggcauucagaacuguaua

SEQ ID NO: 348089 - RNA, 22 nt, Homo sapiens
auauggcuaugugagcauacca

SEQ ID NO: 348090 - RNA, 22 nt, Homo sapiens
auauguauuuuaacguguaagg

SEQ ID NO: 348091 - RNA, 22 nt, Homo sapiens
auauuacagagaggaccuggga

SEQ ID NO: 348092 - RNA, 22 nt, Homo sapiens
auauuacuggccauaucgcagg

SEQ ID NO: 348093 - RNA, 22 nt, Homo sapiens
auauuagguuggugcaaaagua

SEQ ID NO: 348094 - RNA, 22 nt, Homo sapiens
auauucaagugaggauggcuaa

SEQ ID NO: 348095 - RNA, 22 nt, Homo sapiens
aucaaagcagcauggcccaguc

SEQ ID NO: 348096 - RNA, 22 nt, Homo sapiens
aucaaaguaggcauauguuuuu

SEQ ID NO: 348097 - RNA, 22 nt, Homo sapiens
aucaaaguaucucaauauggua

SEQ ID NO: 348098 - RNA, 22 nt, Homo sapiens
aucaaagugaaauauuaguuau

SEQ ID NO: 348099 - RNA, 22 nt, Homo sapiens
aucaaaguuucccagaaguugu

SEQ ID NO: 348100 - RNA, 22 nt, Homo sapiens
aucaagcugcuuguuugaaucu

SEQ ID NO: 348101 - RNA, 22 nt, Homo sapiens
aucaagguaggacuugaacccu

SEQ ID NO: 348102 - RNA, 22 nt, Homo sapiens
aucacagauauggguuuaaauc

SEQ ID NO: 348103 - RNA, 22 nt, Homo sapiens
aucacagcuacuccucugucuu

SEQ ID NO: 348104 - RNA, 22 nt, Homo sapiens
aucacagguacuauggcugaca

SEQ ID NO: 348105 - RNA, 22 nt, Homo sapiens
aucacagugaaaacagucaauu

SEQ ID NO: 348106 - RNA, 22 nt, Homo sapiens
aucacagugagcauaugucuau

SEQ ID NO: 348107 - RNA, 22 nt, Homo sapiens
aucacauuuauaguggcacgca

SEQ ID NO: 348108 - RNA, 22 nt, Homo sapiens
aucacuguccacucaucuuucu

SEQ ID NO: 348109 - RNA, 22 nt, Homo sapiens
aucagaguugucagggagcuuu

SEQ ID NO: 348110 - RNA, 23 nt, Homo sapiens
aucagauaguuguagguaugugg

SEQ ID NO: 348111 - RNA, 19 nt, Homo sapiens
aucagcacaagugugcuuu

SEQ ID NO: 348112 - RNA, 22 nt, Homo sapiens
aucagcagcaugaaaagcaacu

SEQ ID NO: 348113 - RNA, 22 nt, Homo sapiens
aucagugcauguuuguugagcu

SEQ ID NO: 348114 - RNA, 22 nt, Homo sapiens
aucaucacaguuguguguaaug

SEQ ID NO: 348115 - RNA, 22 nt, Homo sapiens
aucaucaugcacuacagccugg

SEQ ID NO: 348116 - RNA, 22 nt, Homo sapiens
aucaugucuucccagugauucu

SEQ ID NO: 348117 - RNA, 22 nt, Homo sapiens
auccaguguuuucuuuugucac

SEQ ID NO: 348118 - RNA, 22 nt, Homo sapiens
auccaguuuuaggagauuucua

SEQ ID NO: 348119 - RNA, 22 nt, Homo sapiens
auccaucagacggcaggcguug

SEQ ID NO: 348120 - RNA, 22 nt, Homo sapiens
auccauugcacuauggaaagug

SEQ ID NO: 348121 - RNA, 22 nt, Homo sapiens
auccauugcucaagagaaguca

SEQ ID NO: 348122 - RNA, 22 nt, Homo sapiens
aucccugaggaauuucugcacu

SEQ ID NO: 348123 - RNA, 22 nt, Homo sapiens
aucccugugauccaaucacuuc

SEQ ID NO: 348124 - RNA, 22 nt, Homo sapiens
aucccuguguccagcaccugug

SEQ ID NO: 348125 - RNA, 22 nt, Homo sapiens
auccucaguggcuuaaguauag

SEQ ID NO: 348126 - RNA, 22 nt, Homo sapiens
auccucugagaucuaggcagag

SEQ ID NO: 348127 - RNA, 22 nt, Homo sapiens
auccugagacuuugcugaaguu

SEQ ID NO: 348128 - RNA, 22 nt, Homo sapiens
aucgcaccauugcacuccagca

SEQ ID NO: 348129 - RNA, 22 nt, Homo sapiens
aucuaaaucucauaugggcaca

SEQ ID NO: 348130 - RNA, 16 nt, Homo sapiens
aucucagaccugcuga

SEQ ID NO: 348131 - RNA, 22 nt, Homo sapiens
aucucaguuaauuccaucuuuc

SEQ ID NO: 348132 - RNA, 22 nt, Homo sapiens
aucucauuccuucugggcugau

SEQ ID NO: 348133 - RNA, 22 nt, Homo sapiens
aucucugagauguucugauuuu

SEQ ID NO: 348134 - RNA, 22 nt, Homo sapiens
aucugacuuuuaauuugaaaac

SEQ ID NO: 348135 - RNA, 22 nt, Homo sapiens
aucugggguuggcaaaguuugg

SEQ ID NO: 348136 - RNA, 22 nt, Homo sapiens
aucuuugauuguagguacaaug

SEQ ID NO: 348137 - RNA, 22 nt, Homo sapiens
augaaaacaugauuugccuguu

SEQ ID NO: 348138 - RNA, 22 nt, Homo sapiens
augaaacuggcuaauuuuugua

SEQ ID NO: 348139 - RNA, 22 nt, Homo sapiens
augaaagguauguuuucuguga

SEQ ID NO: 348140 - RNA, 22 nt, Homo sapiens
augaaaucuuuccugugaggau

SEQ ID NO: 348141 - RNA, 22 nt, Homo sapiens
augaaaucuuuggcagaucuua

SEQ ID NO: 348142 - RNA, 17 nt, Homo sapiens
augaacucaucauuuuu

SEQ ID NO: 348143 - RNA, 22 nt, Homo sapiens
augaauccauuccugccacaga

SEQ ID NO: 348144 - RNA, 22 nt, Homo sapiens
augaauguaaagaaugugggaa

SEQ ID NO: 348145 - RNA, 20 nt, Homo sapiens
augaauguccuugauggcau

SEQ ID NO: 348146 - RNA, 22 nt, Homo sapiens
augaaugucuuauuuugagaaa

SEQ ID NO: 348147 - RNA, 20 nt, Homo sapiens
gcaguguucacuguauuccu

SEQ ID NO: 348148 - RNA, 20 nt, Homo sapiens
gcaguguucugaccugaauc

SEQ ID NO: 348149 - RNA, 22 nt, Homo sapiens
gcauaugucuuuauagcagcau

SEQ ID NO: 348150 - RNA, 17 nt, Homo sapiens
gcauauguugaaccagc

SEQ ID NO: 348151 - RNA, 22 nt, Homo sapiens
gcaucaaugucuauaguguuug

SEQ ID NO: 348152 - RNA, 20 nt, Homo sapiens
gcaugagucuuuauaguaga

SEQ ID NO: 348153 - RNA, 22 nt, Homo sapiens
gcaugaugaauaauaucacaag

SEQ ID NO: 348154 - RNA, 22 nt, Homo sapiens
gcaugauuuuauaucuauguaa

SEQ ID NO: 348155 - RNA, 22 nt, Homo sapiens
gcauggaguggaaauucuuggg

SEQ ID NO: 348156 - RNA, 22 nt, Homo sapiens
gcaugguaguaaccuacauuug

SEQ ID NO: 348157 - RNA, 18 nt, Homo sapiens
gccaacauguaaacaggu

SEQ ID NO: 348158 - RNA, 20 nt, Homo sapiens
gccacaguuaagcuucugcc

SEQ ID NO: 348159 - RNA, 22 nt, Homo sapiens
gccagugugaugugaucauggc

SEQ ID NO: 348160 - RNA, 22 nt, Homo sapiens
gccauggaggauuuauagaggc

SEQ ID NO: 348161 - RNA, 22 nt, Homo sapiens
gccauugcacuccagccuagcg

SEQ ID NO: 348162 - RNA, 22 nt, Homo sapiens
gccauugcacuccagccuaggc

SEQ ID NO: 348163 - RNA, 22 nt, Homo sapiens
gccauugcacuccagccucggg

SEQ ID NO: 348164 - RNA, 22 nt, Homo sapiens
gccauugcacucuagccuaggu

SEQ ID NO: 348165 - RNA, 22 nt, Homo sapiens
gcccuguguuuggguaugguca

SEQ ID NO: 348166 - RNA, 22 nt, Homo sapiens
gcccuguugcccugaauacaua

SEQ ID NO: 348167 - RNA, 20 nt, Homo sapiens
gcuaaggcacgggaauuacu

SEQ ID NO: 348168 - RNA, 22 nt, Homo sapiens
gcucaaguaauggcaguuuugc

SEQ ID NO: 348169 - RNA, 22 nt, Homo sapiens
gcucaugagacaagcaggagua

SEQ ID NO: 348170 - RNA, 22 nt, Homo sapiens
gcucaugggcagugugauuguu

SEQ ID NO: 348171 - RNA, 22 nt, Homo sapiens
gcucugguuacaaaggcaaauu

SEQ ID NO: 348172 - RNA, 22 nt, Homo sapiens
gcugacagugguuauacuuaga

SEQ ID NO: 348173 - RNA, 22 nt, Homo sapiens
gcugagaucucuugccugaacu

SEQ ID NO: 348174 - RNA, 22 nt, Homo sapiens
gcugauggugcaguucuagccu

SEQ ID NO: 348175 - RNA, 19 nt, Homo sapiens
gcugauguuacauucuugc

SEQ ID NO: 348176 - RNA, 22 nt, Homo sapiens
gcugcuguuucucuuucagcau

SEQ ID NO: 348177 - RNA, 22 nt, Homo sapiens
gcuggaauuaacauagaugugc

SEQ ID NO: 348178 - RNA, 22 nt, Homo sapiens
gcuguauugacuuuguaucaua

SEQ ID NO: 348179 - RNA, 20 nt, Homo sapiens
gcugugcuuaauacacuuuc

SEQ ID NO: 348180 - RNA, 22 nt, Homo sapiens
gcuguguguuaucagaaauugc

SEQ ID NO: 348181 - RNA, 22 nt, Homo sapiens
gcuguguugugcccagcaucau

SEQ ID NO: 348182 - RNA, 22 nt, Homo sapiens
gcuguugugaacuauacaucua

SEQ ID NO: 348183 - RNA, 22 nt, Homo sapiens
gcuguuugccgccaucgcagac

SEQ ID NO: 348184 - RNA, 22 nt, Homo sapiens
gcuugguccccacccaaaucgc

SEQ ID NO: 348185 - RNA, 22 nt, Homo sapiens
gcuuguguuuacuguaguuacu

SEQ ID NO: 348186 - RNA, 19 nt, Homo sapiens
gcuuuguggggaaggagcc

SEQ ID NO: 348187 - RNA, 22 nt, Homo sapiens
gcuuuguuaaaacacagccaca

SEQ ID NO: 348188 - RNA, 21 nt, Homo sapiens
gcuuuuucggaagucuuuggc

SEQ ID NO: 348189 - RNA, 23 nt, Homo sapiens
ggaaacauccagucuuucaccau

SEQ ID NO: 348190 - RNA, 22 nt, Homo sapiens
ggaaagacaccuuacuauguua

SEQ ID NO: 348191 - RNA, 22 nt, Homo sapiens
ggaaagacuauuguaaaggaug

SEQ ID NO: 348192 - RNA, 22 nt, Homo sapiens
ggaaggucaaagggaaagcaga

SEQ ID NO: 348193 - RNA, 22 nt, Homo sapiens
ggaauaguauaaauaccacaaa

SEQ ID NO: 348194 - RNA, 17 nt, Homo sapiens
ggaaugaauuccagccc

SEQ ID NO: 348195 - RNA, 22 nt, Homo sapiens
ggaaugcuaaaauaggaugcug

SEQ ID NO: 348196 - RNA, 22 nt, Homo sapiens
ggaaugugugucaugcuuuugc

SEQ ID NO: 348197 - RNA, 20 nt, Homo sapiens
ggaauguuaaucuccaugau

SEQ ID NO: 348198 - RNA, 22 nt, Homo sapiens
ggacagugaaugccacuccucc

SEQ ID NO: 348199 - RNA, 22 nt, Homo sapiens
ggacuagagaugagauuuuuca

SEQ ID NO: 348200 - RNA, 22 nt, Homo sapiens
ggacuaggagcuaggaagaucu

SEQ ID NO: 348201 - RNA, 22 nt, Homo sapiens
ggacuagggacauggggagcug

SEQ ID NO: 348202 - RNA, 22 nt, Homo sapiens
ggagaucacucuuuguagcgug

SEQ ID NO: 348203 - RNA, 22 nt, Homo sapiens
ggagaucuuuaggaguuggacu

SEQ ID NO: 348204 - RNA, 22 nt, Homo sapiens
ggagaucuuuguuaucuuuuga

SEQ ID NO: 348205 - RNA, 22 nt, Homo sapiens
ggagaugaaaugagcuacuuaa

SEQ ID NO: 348206 - RNA, 16 nt, Homo sapiens
ggaggucaucugggaa

SEQ ID NO: 348207 - RNA, 22 nt, Homo sapiens
ggaguaaaagaguaggaggaau

SEQ ID NO: 348208 - RNA, 22 nt, Homo sapiens
ggaguaugaaacccacuccaau

SEQ ID NO: 348209 - RNA, 22 nt, Homo sapiens
ggagucugacuuauaggaaccu

SEQ ID NO: 348210 - RNA, 22 nt, Homo sapiens
ggagucugauguucuaaggcag

SEQ ID NO: 348211 - RNA, 22 nt, Homo sapiens
ggagucugauuuuuauguugcu

SEQ ID NO: 348212 - RNA, 22 nt, Homo sapiens
ggaguguaauggcgccaucuca

SEQ ID NO: 348213 - RNA, 22 nt, Homo sapiens
ggagugugauucaguauaauau

SEQ ID NO: 348214 - RNA, 21 nt, Homo sapiens
ggauucaucccucaugaauuu

SEQ ID NO: 348215 - RNA, 22 nt, Homo sapiens
ggcaaagagacaugcaucgggg

SEQ ID NO: 348216 - RNA, 22 nt, Homo sapiens
ggcaaauucuuguaugccuacu

SEQ ID NO: 348217 - RNA, 22 nt, Homo sapiens
ggcaacaaagacauuucaacau

SEQ ID NO: 348218 - RNA, 19 nt, Homo sapiens
uuucccugcagaccuacua

SEQ ID NO: 348219 - RNA, 22 nt, Homo sapiens
uuucccuuuagcuuagugauuu

SEQ ID NO: 348220 - RNA, 21 nt, Homo sapiens
uuuccuggagcguauggcuuc

SEQ ID NO: 348221 - RNA, 17 nt, Homo sapiens
uuucucagcccucuucu

SEQ ID NO: 348222 - RNA, 20 nt, Homo sapiens
uuucuccccuauaaaucuca

SEQ ID NO: 348223 - RNA, 22 nt, Homo sapiens
uuucugagaccaaaacuuguaa

SEQ ID NO: 348224 - RNA, 19 nt, Homo sapiens
uuugaauauaaugcagcua

SEQ ID NO: 348225 - RNA, 20 nt, Homo sapiens
uuugaauguaaagcauguca

SEQ ID NO: 348226 - RNA, 22 nt, Homo sapiens
uuugagaucuuuagaaucaggc

SEQ ID NO: 348227 - RNA, 22 nt, Homo sapiens
uuugagcauuagggcaaaggca

SEQ ID NO: 348228 - RNA, 22 nt, Homo sapiens
uuugagcuugacucagcuggag

SEQ ID NO: 348229 - RNA, 23 nt, Homo sapiens
uuugagugugauaaacacuguca

SEQ ID NO: 348230 - RNA, 22 nt, Homo sapiens
uuugcacauauuugggcaaaag

SEQ ID NO: 348231 - RNA, 22 nt, Homo sapiens
uuugcacuuuaauauaauguga

SEQ ID NO: 348232 - RNA, 22 nt, Homo sapiens
uuugcaguguaguuggccagca

SEQ ID NO: 348233 - RNA, 22 nt, Homo sapiens
uuuggcaacguuggaucccuca

SEQ ID NO: 348234 - RNA, 22 nt, Homo sapiens
uuuggcacuguaaauuucucuu

SEQ ID NO: 348235 - RNA, 22 nt, Homo sapiens
uuuggcagaaaacuaaaaggua

SEQ ID NO: 348236 - RNA, 22 nt, Homo sapiens
uuuggcuguuucuggacuaaga

SEQ ID NO: 348237 - RNA, 22 nt, Homo sapiens
uuuggcuuuugugauacguaau

SEQ ID NO: 348238 - RNA, 22 nt, Homo sapiens
uuugguuuuuguuaucacucau

SEQ ID NO: 348239 - RNA, 22 nt, Homo sapiens
uuuguaauaccugaggcugggu

SEQ ID NO: 348240 - RNA, 22 nt, Homo sapiens
uuuguagcucacucugagcuga

SEQ ID NO: 348241 - RNA, 19 nt, Homo sapiens
uuuguauguuuccaguaau

SEQ ID NO: 348242 - RNA, 22 nt, Homo sapiens
uuugucccccguaguucauaua

SEQ ID NO: 348243 - RNA, 19 nt, Homo sapiens
uuuguccugcccuuucuca

SEQ ID NO: 348244 - RNA, 22 nt, Homo sapiens
uuugucuccuaagacucugugg

SEQ ID NO: 348245 - RNA, 22 nt, Homo sapiens
uuugugacucauggucuagugc

SEQ ID NO: 348246 - RNA, 22 nt, Homo sapiens
uuugugaggugauggauauguc

SEQ ID NO: 348247 - RNA, 23 nt, Homo sapiens
uuugugcuaauuuaugggcucuu

SEQ ID NO: 348248 - RNA, 22 nt, Homo sapiens
uuuguguccccacccaaaucuc

SEQ ID NO: 348249 - RNA, 22 nt, Homo sapiens
uuuguucuucguuccugagcca

SEQ ID NO: 348250 - RNA, 22 nt, Homo sapiens
uuuguuugaagucgagacaacu

SEQ ID NO: 348251 - RNA, 22 nt, Homo sapiens
uuuuaacagccaggggacggcc

SEQ ID NO: 348252 - RNA, 23 nt, Homo sapiens
uuuugcaauaagucacuggaaua

SEQ ID NO: 348253 - RNA, 22 nt, Homo sapiens
uuuugcauuggcugaggagugu

SEQ ID NO: 348254 - RNA, 22 nt, Homo sapiens
uuuugcucuucggaagagcuug

SEQ ID NO: 348255 - RNA, 19 nt, Homo sapiens
uuuugcucuuuauaccuau

SEQ ID NO: 348256 - RNA, 19 nt, Homo sapiens
uuuuggaaaugugaacagc

SEQ ID NO: 348257 - RNA, 22 nt, Homo sapiens
uuuuggacuucaauuugacacu

SEQ ID NO: 348258 - RNA, 22 nt, Homo sapiens
uuuuggacuugcuccccugucc

SEQ ID NO: 348259 - RNA, 20 nt, Homo sapiens
uuuuggcuuaaagcagucug

SEQ ID NO: 348260 - RNA, 22 nt, Homo sapiens
uuuugguguacaauucuaugga

SEQ ID NO: 348261 - RNA, 22 nt, Homo sapiens
uuuuuauggccaauccucagaa

SEQ ID NO: 348262 - RNA, 22 nt, Homo sapiens
uuuuugagguauaguguggcua

SEQ ID NO: 348263 - RNA, 22 nt, Homo sapiens
uuuuugauuaauggguagacca

SEQ ID NO: 348264 - RNA, 22 nt, Homo sapiens
uuuuugguugguaggcuauuaa

SEQ ID NO: 348265 - RNA, 23 nt, Homo sapiens
uuuuuguguuucauggaaauagg

SEQ ID NO: 348266 - RNA, 22 nt, Homo sapiens
uggaagacaaguguuagcaugg

SEQ ID NO: 348267 - RNA, 22 nt, Homo sapiens
uggaagacuuuagaggcuuaua

SEQ ID NO: 348268 - RNA, 22 nt, Homo sapiens
uggaagccuagauucuuuucuu

SEQ ID NO: 348269 - RNA, 20 nt, Homo sapiens
uggaagccuggugcuaucuu

SEQ ID NO: 348270 - RNA, 22 nt, Homo sapiens
uggaaguagauagauuguguca

SEQ ID NO: 348271 - RNA, 22 nt, Homo sapiens
uggaaguauagauaauugaaag

SEQ ID NO: 348272 - RNA, 22 nt, Homo sapiens
uggaauaucaugagaguuuguu

SEQ ID NO: 348273 - RNA, 22 nt, Homo sapiens
uggaauaugagacgggguuguc

SEQ ID NO: 348274 - RNA, 21 nt, Homo sapiens
uggaaucuauagaggcaguag

SEQ ID NO: 348275 - RNA, 22 nt, Homo sapiens
uggaauggagagagggugcacg

SEQ ID NO: 348276 - RNA, 19 nt, Homo sapiens
uggaauggauuuaaaugug

SEQ ID NO: 348277 - RNA, 22 nt, Homo sapiens
uggaaugggauuggaaauuuug

SEQ ID NO: 348278 - RNA, 22 nt, Homo sapiens
uggaaugguuggugugauuuua

SEQ ID NO: 348279 - RNA, 22 nt, Homo sapiens
uggaaugucagcuacaagaggg

SEQ ID NO: 348280 - RNA, 22 nt, Homo sapiens
uggaauuaauccuccugguuuc

SEQ ID NO: 348281 - RNA, 21 nt, Homo sapiens
uggaauuaauggagagguguu

SEQ ID NO: 348282 - RNA, 22 nt, Homo sapiens
uggacacuggagauucgucagu

SEQ ID NO: 348283 - RNA, 18 nt, Homo sapiens
uggacagugauuauccau

SEQ ID NO: 348284 - RNA, 20 nt, Homo sapiens
uggaccagagagguggggac

SEQ ID NO: 348285 - RNA, 22 nt, Homo sapiens
uggacuguaagugccuugagua

SEQ ID NO: 348286 - RNA, 22 nt, Homo sapiens
uggacuguaauuuuauaggcau

SEQ ID NO: 348287 - RNA, 22 nt, Homo sapiens
uggagcccuaaacuucuaauau

SEQ ID NO: 348288 - RNA, 20 nt, Homo sapiens
uggagugaagguucuggacc

SEQ ID NO: 348289 - RNA, 22 nt, Homo sapiens
uggagugagaacuucaaugaug

SEQ ID NO: 348290 - RNA, 22 nt, Homo sapiens
uggagugcaauggcaccaucuu

SEQ ID NO: 348291 - RNA, 22 nt, Homo sapiens
uggauaguaauaaacauauagg

SEQ ID NO: 348292 - RNA, 22 nt, Homo sapiens
uggauaguucuucuacuagagu

SEQ ID NO: 348293 - RNA, 21 nt, Homo sapiens
uggaugccuaggcagaaguuu

SEQ ID NO: 348294 - RNA, 22 nt, Homo sapiens
uggauggucagaggguuucugu

SEQ ID NO: 348295 - RNA, 22 nt, Homo sapiens
uggauggugauuggaucaugga

SEQ ID NO: 348296 - RNA, 22 nt, Homo sapiens
uggcaaauauuuuguuuuguaa

SEQ ID NO: 348297 - RNA, 22 nt, Homo sapiens
uggcaaaugaagucagcuguac

SEQ ID NO: 348298 - RNA, 22 nt, Homo sapiens
uggcaaauuccaaaguuaauuc

SEQ ID NO: 348299 - RNA, 22 nt, Homo sapiens
uggcaagaacgaaauguagggu

SEQ ID NO: 348300 - RNA, 22 nt, Homo sapiens
uggcaagaacugcaauugcuuu

SEQ ID NO: 348301 - RNA, 22 nt, Homo sapiens
uggcaagaaggauuuauuccuu

SEQ ID NO: 348302 - RNA, 23 nt, Homo sapiens
uggcaagaauucuuaccgugugg

SEQ ID NO: 348303 - RNA, 22 nt, Homo sapiens
uggcaagagcaaaauguacagu

SEQ ID NO: 348304 - RNA, 22 nt, Homo sapiens
uggcaagaucacaauuacuuuu

SEQ ID NO: 348305 - RNA, 22 nt, Homo sapiens
uggcaagauuguuccgguuugg

SEQ ID NO: 348306 - RNA, 23 nt, Homo sapiens
uggcaagauuuguauugccugga

SEQ ID NO: 348307 - RNA, 22 nt, Homo sapiens
uggcaauauccacaauuacuuu

SEQ ID NO: 348308 - RNA, 21 nt, Homo sapiens
uggcacuauucacaauagcaa

SEQ ID NO: 348309 - RNA, 22 nt, Homo sapiens
uggcagaugggugagcuggaga

SEQ ID NO: 348310 - RNA, 22 nt, Homo sapiens
uggcagugggagauauuuuauu

SEQ ID NO: 348311 - RNA, 22 nt, Homo sapiens
uggcaguuuugauguggagaga

SEQ ID NO: 348312 - RNA, 22 nt, Homo sapiens
uggcaguuuuugccuucaauac

SEQ ID NO: 348313 - RNA, 22 nt, Homo sapiens
aaagugauuguaguuuuugcca

SEQ ID NO: 348314 - RNA, 22 nt, Homo sapiens
aaagugcaguacuucguauauu

SEQ ID NO: 348315 - RNA, 22 nt, Homo sapiens
aaagugcugagucuaggcgggg

SEQ ID NO: 348316 - RNA, 22 nt, Homo sapiens
aaagugcuguagacugggcgca

SEQ ID NO: 348317 - RNA, 22 nt, Homo sapiens
aaagugcuuacuaaguugccaa

SEQ ID NO: 348318 - RNA, 22 nt, Homo sapiens
aaaguggugggauuccaggcau

SEQ ID NO: 348319 - RNA, 22 nt, Homo sapiens
aaaguucuugcugaaggauuau

SEQ ID NO: 348320 - RNA, 15 nt, Homo sapiens
aaauaugucaguucu

SEQ ID NO: 348321 - RNA, 22 nt, Homo sapiens
aaaugcagcacucaagugggaa

SEQ ID NO: 348322 - RNA, 22 nt, Homo sapiens
aaaugcaugaauaagcucgugu

SEQ ID NO: 348323 - RNA, 22 nt, Homo sapiens
aaaugggacugggguccuuuga

SEQ ID NO: 348324 - RNA, 22 nt, Homo sapiens
aaaugguguuaguagaucuuua

SEQ ID NO: 348325 - RNA, 22 nt, Homo sapiens
aaauucaucaaaugguuuguau

SEQ ID NO: 348326 - RNA, 18 nt, Homo sapiens
aaauucugucccuucuuc

SEQ ID NO: 348327 - RNA, 22 nt, Homo sapiens
aaauugcauugagcugcuuauu

SEQ ID NO: 348328 - RNA, 22 nt, Homo sapiens
aacacuaucugccuuacaggga

SEQ ID NO: 348329 - RNA, 22 nt, Homo sapiens
aacagcacacccgcugcuucca

SEQ ID NO: 348330 - RNA, 20 nt, Homo sapiens
aacagcacugucugaagcuu

SEQ ID NO: 348331 - RNA, 22 nt, Homo sapiens
aacagcuaguaccaauccacua

SEQ ID NO: 348332 - RNA, 22 nt, Homo sapiens
aacaggguguuugcaguuucuu

SEQ ID NO: 348333 - RNA, 22 nt, Homo sapiens
aacagugccugucauuuaguag

SEQ ID NO: 348334 - RNA, 20 nt, Homo sapiens
aacaguguguaaguuuccuu

SEQ ID NO: 348335 - RNA, 22 nt, Homo sapiens
aacuaggccuagaaguugagua

SEQ ID NO: 348336 - RNA, 22 nt, Homo sapiens
aacugcacuaggacagguuuuu

SEQ ID NO: 348337 - RNA, 22 nt, Homo sapiens
aacugcuguuuggguacuggug

SEQ ID NO: 348338 - RNA, 19 nt, Homo sapiens
aacuggugugagaugguau

SEQ ID NO: 348339 - RNA, 21 nt, Homo sapiens
aagaaagcuggacuugccgcu

SEQ ID NO: 348340 - RNA, 22 nt, Homo sapiens
aagagaugaagguccugacugu

SEQ ID NO: 348341 - RNA, 22 nt, Homo sapiens
aagagguaggaaauggucauuu

SEQ ID NO: 348342 - RNA, 22 nt, Homo sapiens
aagagguagucugucccuuagc

SEQ ID NO: 348343 - RNA, 23 nt, Homo sapiens
aagagguaugacuaugaagugga

SEQ ID NO: 348344 - RNA, 22 nt, Homo sapiens
aagagguuauagaguguauacu

SEQ ID NO: 348345 - RNA, 22 nt, Homo sapiens
aagagguuguaccuaaaguguu

SEQ ID NO: 348346 - RNA, 22 nt, Homo sapiens
aagaucauucagggaaggcuga

SEQ ID NO: 348347 - RNA, 22 nt, Homo sapiens
aagaugauguuguguuuucacu

SEQ ID NO: 348348 - RNA, 22 nt, Homo sapiens
aagaugcagaagcccagauguu

SEQ ID NO: 348349 - RNA, 22 nt, Homo sapiens
aagaugcagucauacuggagua

SEQ ID NO: 348350 - RNA, 20 nt, Homo sapiens
aagcaagcauuugcaaucau

SEQ ID NO: 348351 - RNA, 22 nt, Homo sapiens
aagcacaauuucaccuucuugu

SEQ ID NO: 348352 - RNA, 22 nt, Homo sapiens
aagcaccaauaggagauuuguc

SEQ ID NO: 348353 - RNA, 22 nt, Homo sapiens
aagcacccuuugucuggacaug

SEQ ID NO: 348354 - RNA, 22 nt, Homo sapiens
aagcaucacuggaggcagccau

SEQ ID NO: 348355 - RNA, 21 nt, Homo sapiens
aagcaugguguaucuuuccau

SEQ ID NO: 348356 - RNA, 22 nt, Homo sapiens
aagcaugguuuccaggggucac

SEQ ID NO: 348357 - RNA, 22 nt, Homo sapiens
aagcuggagugcaguggugcga

SEQ ID NO: 348358 - RNA, 22 nt, Homo sapiens
aagcuggcauucaugagauuac

SEQ ID NO: 348359 - RNA, 22 nt, Homo sapiens
aagcugguuuuauaucugugag

SEQ ID NO: 348360 - RNA, 22 nt, Homo sapiens
uguaugagagacauggcugcuu

SEQ ID NO: 348361 - RNA, 22 nt, Homo sapiens
uguaugagagugaaagcauuuc

SEQ ID NO: 348362 - RNA, 22 nt, Homo sapiens
uguauguaaagacaggauaaca

SEQ ID NO: 348363 - RNA, 22 nt, Homo sapiens
uguauguuuaaggccaguggaa

SEQ ID NO: 348364 - RNA, 22 nt, Homo sapiens
uguauuuguuguuaaauggaga

SEQ ID NO: 348365 - RNA, 22 nt, Homo sapiens
ugucaaaugcagugauauuuga

SEQ ID NO: 348366 - RNA, 22 nt, Homo sapiens
ugucaaauucuggguuaaaaca

SEQ ID NO: 348367 - RNA, 22 nt, Homo sapiens
ugucaauauguaauaacugaau

SEQ ID NO: 348368 - RNA, 22 nt, Homo sapiens
ugucauguagaaauuguccauu

SEQ ID NO: 348369 - RNA, 20 nt, Homo sapiens
ugucccaaccccauggguuc

SEQ ID NO: 348370 - RNA, 22 nt, Homo sapiens
uguccuagagggaugucacccc

SEQ ID NO: 348371 - RNA, 20 nt, Homo sapiens
ugucuauggggguucucugc

SEQ ID NO: 348372 - RNA, 22 nt, Homo sapiens
ugucuggaguccauagaagugu

SEQ ID NO: 348373 - RNA, 22 nt, Homo sapiens
ugucuugagagaggacaugacu

SEQ ID NO: 348374 - RNA, 22 nt, Homo sapiens
ugucuuugguucaggcaaggag

SEQ ID NO: 348375 - RNA, 22 nt, Homo sapiens
ugugaacaaaauuuguugcaua

SEQ ID NO: 348376 - RNA, 22 nt, Homo sapiens
ugugaaugauggagugucgaau

SEQ ID NO: 348377 - RNA, 18 nt, Homo sapiens
ugugacauugagcauguc

SEQ ID NO: 348378 - RNA, 19 nt, Homo sapiens
ugugacugguugucucgcu

SEQ ID NO: 348379 - RNA, 22 nt, Homo sapiens
ugugagacugacagggcagggu

SEQ ID NO: 348380 - RNA, 22 nt, Homo sapiens
ugugauaguuggcuaaagcagu

SEQ ID NO: 348381 - RNA, 17 nt, Homo sapiens
ugugaucaucacccuug

SEQ ID NO: 348382 - RNA, 22 nt, Homo sapiens
ugugaugguuuggaagcuucuu

SEQ ID NO: 348383 - RNA, 22 nt, Homo sapiens
ugugauugauuaaugugugcua

SEQ ID NO: 348384 - RNA, 22 nt, Homo sapiens
ugugcacaacaugcagguuugu

SEQ ID NO: 348385 - RNA, 22 nt, Homo sapiens
ugugcacaaugugcagguuuga

SEQ ID NO: 348386 - RNA, 22 nt, Homo sapiens
ugugcaugacagcauacaaacg

SEQ ID NO: 348387 - RNA, 22 nt, Homo sapiens
ugugccacuccaaccuggguga

SEQ ID NO: 348388 - RNA, 22 nt, Homo sapiens
ugugccacugcacuucagccug

SEQ ID NO: 348389 - RNA, 22 nt, Homo sapiens
uguggcucuucuguucuccacu

SEQ ID NO: 348390 - RNA, 22 nt, Homo sapiens
uguggcuuuguaaccauggguc

SEQ ID NO: 348391 - RNA, 22 nt, Homo sapiens
ugugggaggugcuaauguaaau

SEQ ID NO: 348392 - RNA, 23 nt, Homo sapiens
ugugguauuauuccauuuauagg

SEQ ID NO: 348393 - RNA, 22 nt, Homo sapiens
uguggucaucacuugaagguaa

SEQ ID NO: 348394 - RNA, 22 nt, Homo sapiens
ugugguuuuuuucuccaauagg

SEQ ID NO: 348395 - RNA, 22 nt, Homo sapiens
uguguaaagcuuguuccagaaa

SEQ ID NO: 348396 - RNA, 22 nt, Homo sapiens
uguguaaauauauacacacgug

SEQ ID NO: 348397 - RNA, 22 nt, Homo sapiens
ugugucuacugagaugaucaug

SEQ ID NO: 348398 - RNA, 22 nt, Homo sapiens
ugugucuugagagucucgagaa

SEQ ID NO: 348399 - RNA, 22 nt, Homo sapiens
uguguuugauaaguccauaguu

SEQ ID NO: 348400 - RNA, 22 nt, Homo sapiens
uguguuuuuauguaaaauggaa

SEQ ID NO: 348401 - RNA, 22 nt, Homo sapiens
uguuaguuguucauguuaagag

SEQ ID NO: 348402 - RNA, 22 nt, Homo sapiens
uguuggacuuacuuggcagauu

SEQ ID NO: 348403 - RNA, 22 nt, Homo sapiens
uuaacagugucaaucuguagua

SEQ ID NO: 348404 - RNA, 22 nt, Homo sapiens
uuaagacaccaaucauuggauu

SEQ ID NO: 348405 - RNA, 22 nt, Homo sapiens
uuaagcaaagguaacaugagaa

SEQ ID NO: 348406 - RNA, 22 nt, Homo sapiens
uuaagcuaguuuauucaggaaa

SEQ ID NO: 348407 - RNA, 22 nt, Homo sapiens
uuaaggaguagugucugguauu

SEQ ID NO: 348408 - RNA, 19 nt, Homo sapiens
uuaagguacuuagaugugu

SEQ ID NO: 348409 - RNA, 22 nt, Homo sapiens
ugagagcuuuuuugccugguga

SEQ ID NO: 348410 - RNA, 22 nt, Homo sapiens
ugagaggugauaaagcaagggu

SEQ ID NO: 348411 - RNA, 22 nt, Homo sapiens
ugagauaacuaaaaacauuuug

SEQ ID NO: 348412 - RNA, 21 nt, Homo sapiens
ugagauaauauguuucugaug

SEQ ID NO: 348413 - RNA, 22 nt, Homo sapiens
ugagauaggaucuugcucuguu

SEQ ID NO: 348414 - RNA, 22 nt, Homo sapiens
ugagaucaugccacugcacuuc

SEQ ID NO: 348415 - RNA, 22 nt, Homo sapiens
ugagaucaugucauuugcacuc

SEQ ID NO: 348416 - RNA, 22 nt, Homo sapiens
ugagaucauguguggaccccag

SEQ ID NO: 348417 - RNA, 22 nt, Homo sapiens
ugagaucucauuaugguuuuaa

SEQ ID NO: 348418 - RNA, 22 nt, Homo sapiens
ugagaucuuaucagaaauggug

SEQ ID NO: 348419 - RNA, 22 nt, Homo sapiens
ugagaucuuuuguggcugagaa

SEQ ID NO: 348420 - RNA, 22 nt, Homo sapiens
ugagaugaaagcagaaagacuu

SEQ ID NO: 348421 - RNA, 22 nt, Homo sapiens
ugagaugaacuugauuguuuua

SEQ ID NO: 348422 - RNA, 22 nt, Homo sapiens
ugagaugaggucucacucuguu

SEQ ID NO: 348423 - RNA, 22 nt, Homo sapiens
ugagaugaugggauaagagggc

SEQ ID NO: 348424 - RNA, 22 nt, Homo sapiens
ugagaugauuuaauggagccca

SEQ ID NO: 348425 - RNA, 21 nt, Homo sapiens
ugagaugcaaucaccagggag

SEQ ID NO: 348426 - RNA, 20 nt, Homo sapiens
ugagaugcauugggauguuu

SEQ ID NO: 348427 - RNA, 22 nt, Homo sapiens
ugagaugcucgccggccagcau

SEQ ID NO: 348428 - RNA, 22 nt, Homo sapiens
ugagauggaucuuggauuugaa

SEQ ID NO: 348429 - RNA, 22 nt, Homo sapiens
ugagauguuuagauuguugucu

SEQ ID NO: 348430 - RNA, 21 nt, Homo sapiens
ugagauuaaguuguuuagaag

SEQ ID NO: 348431 - RNA, 21 nt, Homo sapiens
ugagauuauauuaacauggua

SEQ ID NO: 348432 - RNA, 22 nt, Homo sapiens
ugagauuaucuguacauaggag

SEQ ID NO: 348433 - RNA, 22 nt, Homo sapiens
ugagauucucugauuguagguc

SEQ ID NO: 348434 - RNA, 22 nt, Homo sapiens
ugagauuguaucugcaaugugu

SEQ ID NO: 348435 - RNA, 22 nt, Homo sapiens
ugagcauauugugauaccuaaa

SEQ ID NO: 348436 - RNA, 22 nt, Homo sapiens
ugagcuagggccuggaauaggg

SEQ ID NO: 348437 - RNA, 20 nt, Homo sapiens
ugagcuauauauguccuuga

SEQ ID NO: 348438 - RNA, 22 nt, Homo sapiens
ugagcugagaucgugccauugu

SEQ ID NO: 348439 - RNA, 18 nt, Homo sapiens
ugaggaaaggguuugcua

SEQ ID NO: 348440 - RNA, 22 nt, Homo sapiens
ugagggaugcguacccuaugcc

SEQ ID NO: 348441 - RNA, 22 nt, Homo sapiens
ugagguaacaaacuaugaguua

SEQ ID NO: 348442 - RNA, 23 nt, Homo sapiens
ugagguguuaagcagacuugucu

SEQ ID NO: 348443 - RNA, 22 nt, Homo sapiens
ugagguguuugugcaccaucug

SEQ ID NO: 348444 - RNA, 22 nt, Homo sapiens
ugagguuggggucagggcuagc

SEQ ID NO: 348445 - RNA, 22 nt, Homo sapiens
ugagguugguauuacugucucu

SEQ ID NO: 348446 - RNA, 22 nt, Homo sapiens
ugaguauagaucaguucaagug

SEQ ID NO: 348447 - RNA, 22 nt, Homo sapiens
ugaguaugaguucaggaaaggc

SEQ ID NO: 348448 - RNA, 22 nt, Homo sapiens
ugaguauguuuagaaguaaagg

SEQ ID NO: 348449 - RNA, 22 nt, Homo sapiens
ugagucaauggaggcucagagc

SEQ ID NO: 348450 - RNA, 22 nt, Homo sapiens
ugagucagucucacucugcugc

SEQ ID NO: 348451 - RNA, 22 nt, Homo sapiens
ugagucaugcuggagucauggc

SEQ ID NO: 348452 - RNA, 22 nt, Homo sapiens
ugagugaaugugaaggcuaggg

SEQ ID NO: 348453 - RNA, 22 nt, Homo sapiens
ggcaacaauuccuacuucuuuu

SEQ ID NO: 348454 - RNA, 22 nt, Homo sapiens
ggcaagaaccagggauuugcgu

SEQ ID NO: 348455 - RNA, 22 nt, Homo sapiens
ggcaagaacuucacucacuuuu

SEQ ID NO: 348456 - RNA, 22 nt, Homo sapiens
ggcaagaagaacuauaacuuuu

SEQ ID NO: 348457 - RNA, 21 nt, Homo sapiens
ggcaagagaauacaacauaaa

SEQ ID NO: 348458 - RNA, 22 nt, Homo sapiens
ggcaaggaggggcacuuucacu

SEQ ID NO: 348459 - RNA, 22 nt, Homo sapiens
ggcaccauuuuacuccuucccu

SEQ ID NO: 348460 - RNA, 22 nt, Homo sapiens
ggcacuguggcucaagccugua

SEQ ID NO: 348461 - RNA, 22 nt, Homo sapiens
ggcagcacaauuuucugaugga

SEQ ID NO: 348462 - RNA, 22 nt, Homo sapiens
ggcaguguauuacuuaggguuc

SEQ ID NO: 348463 - RNA, 22 nt, Homo sapiens
ggcaguguggcugcauauagca

SEQ ID NO: 348464 - RNA, 22 nt, Homo sapiens
ggcaguguuauuauauuuuugg

SEQ ID NO: 348465 - RNA, 22 nt, Homo sapiens
ggcaguuucucaggcaggggua

SEQ ID NO: 348466 - RNA, 22 nt, Homo sapiens
ggcaugaaguagcccacaggca

SEQ ID NO: 348467 - RNA, 22 nt, Homo sapiens
ggcaugaggccauaaaaguaag

SEQ ID NO: 348468 - RNA, 22 nt, Homo sapiens
ggcaugguggugugugccuaua

SEQ ID NO: 348469 - RNA, 19 nt, Homo sapiens
ggcucagucaacugacugu

SEQ ID NO: 348470 - RNA, 22 nt, Homo sapiens
ggcucaguugcaaaucaguuca

SEQ ID NO: 348471 - RNA, 22 nt, Homo sapiens
ggcucguguuuucuguccaguu

SEQ ID NO: 348472 - RNA, 22 nt, Homo sapiens
ggcucuguugcuaccaauuaag

SEQ ID NO: 348473 - RNA, 22 nt, Homo sapiens
gggaagguaaucauuacuugau

SEQ ID NO: 348474 - RNA, 20 nt, Homo sapiens
gggaaugcaaauucucaucc

SEQ ID NO: 348475 - RNA, 22 nt, Homo sapiens
gggaauggaagacauuaugaug

SEQ ID NO: 348476 - RNA, 22 nt, Homo sapiens
gggaguagagaguuucucugac

SEQ ID NO: 348477 - RNA, 22 nt, Homo sapiens
gggagugucuaaccuguuaaca

SEQ ID NO: 348478 - RNA, 22 nt, Homo sapiens
gggaugaaguugauguagaaag

SEQ ID NO: 348479 - RNA, 22 nt, Homo sapiens
gggauuguaauacugaguuggu

SEQ ID NO: 348480 - RNA, 22 nt, Homo sapiens
aaacugcuuuccaugguggcug

SEQ ID NO: 348481 - RNA, 22 nt, Homo sapiens
aaagaguucagguagauuucaa

SEQ ID NO: 348482 - RNA, 22 nt, Homo sapiens
aaagcacuggagucaucaucua

SEQ ID NO: 348483 - RNA, 22 nt, Homo sapiens
aaaggaccacauauaugguggc

SEQ ID NO: 348484 - RNA, 22 nt, Homo sapiens
aaagggcuguuucuugacuugg

SEQ ID NO: 348485 - RNA, 22 nt, Homo sapiens
aaagggcuuuguaaacuucaag

SEQ ID NO: 348486 - RNA, 22 nt, Homo sapiens
aaagucacuggagaaggaauau

SEQ ID NO: 348487 - RNA, 22 nt, Homo sapiens
aaagugcugggauuaggccagg

SEQ ID NO: 348488 - RNA, 22 nt, Homo sapiens
aaaguggacuaagugaauauga

SEQ ID NO: 348489 - RNA, 22 nt, Homo sapiens
aaaucccuugcucucucagacc

SEQ ID NO: 348490 - RNA, 22 nt, Homo sapiens
aaaugcaccacucuggugcagg

SEQ ID NO: 348491 - RNA, 22 nt, Homo sapiens
aaaugcagucuuuguucugggc

SEQ ID NO: 348492 - RNA, 22 nt, Homo sapiens
aaaugcauggacagcuggucuu

SEQ ID NO: 348493 - RNA, 23 nt, Homo sapiens
aaaugcucucaggugccaguaga

SEQ ID NO: 348494 - RNA, 22 nt, Homo sapiens
aaaugcucuuuaugaaguugga

SEQ ID NO: 348495 - RNA, 22 nt, Homo sapiens
aaauggcuuuuugggcaaggug

SEQ ID NO: 348496 - RNA, 22 nt, Homo sapiens
aaaugucauggaguguuucccc

SEQ ID NO: 348497 - RNA, 19 nt, Homo sapiens
aaaugugcacuguuuucca

SEQ ID NO: 348498 - RNA, 22 nt, Homo sapiens
aacagaauccucuuuuccuggg

SEQ ID NO: 348499 - RNA, 22 nt, Homo sapiens
aacagaccuagauaguauaguc

SEQ ID NO: 348500 - RNA, 22 nt, Homo sapiens
aacauugaacuuggcacaccca

SEQ ID NO: 348501 - RNA, 22 nt, Homo sapiens
aacucugucuccuucaaguuca

SEQ ID NO: 348502 - RNA, 22 nt, Homo sapiens
aacugcucuaauguggugggag

SEQ ID NO: 348503 - RNA, 22 nt, Homo sapiens
aacugggcaagcauuacauggu

SEQ ID NO: 348504 - RNA, 21 nt, Homo sapiens
aacuggugugagaugguaugu

SEQ ID NO: 348505 - RNA, 20 nt, Homo sapiens
aagacacuguccccacugga

SEQ ID NO: 348506 - RNA, 22 nt, Homo sapiens
aagagcauuggauggggagauu

SEQ ID NO: 348507 - RNA, 20 nt, Homo sapiens
aagagcucaccagaauaucu

SEQ ID NO: 348508 - RNA, 22 nt, Homo sapiens
aagagguuuaacugacucacag

SEQ ID NO: 348509 - RNA, 22 nt, Homo sapiens
aagaguuaguaaaauuuccucu

SEQ ID NO: 348510 - RNA, 22 nt, Homo sapiens
aagauagcuaagcuucuucuaa

SEQ ID NO: 348511 - RNA, 22 nt, Homo sapiens
aagcaguguggacuaaugggaa

SEQ ID NO: 348512 - RNA, 22 nt, Homo sapiens
aagcaucacauaauggaucaug

SEQ ID NO: 348513 - RNA, 20 nt, Homo sapiens
aagcauggguuuuaggguca

SEQ ID NO: 348514 - RNA, 22 nt, Homo sapiens
aagcuacauuuuauuuauguca

SEQ ID NO: 348515 - RNA, 22 nt, Homo sapiens
aagcucauugagaucuauggcu

SEQ ID NO: 348516 - RNA, 22 nt, Homo sapiens
aagcucuuguugaaucuuguca

SEQ ID NO: 348517 - RNA, 20 nt, Homo sapiens
aagcugaguguuuuuuuaau

SEQ ID NO: 348518 - RNA, 22 nt, Homo sapiens
aagcugcauuuucuagaugcuu

SEQ ID NO: 348519 - RNA, 22 nt, Homo sapiens
aagcugccaggcaugguggcug

SEQ ID NO: 348520 - RNA, 22 nt, Homo sapiens
aagcugccuugcugaggagaaa

SEQ ID NO: 348521 - RNA, 22 nt, Homo sapiens
aagcugugucuugucagcuacc

SEQ ID NO: 348522 - RNA, 22 nt, Homo sapiens
aagcuguugguggaucuaccau

SEQ ID NO: 348523 - RNA, 22 nt, Homo sapiens
aaggagugugauucuucaguuu

SEQ ID NO: 348524 - RNA, 22 nt, Homo sapiens
aaggcaguggcagaagauguca

SEQ ID NO: 348525 - RNA, 22 nt, Homo sapiens
aaggcaugcaguacguuucuau

SEQ ID NO: 348526 - RNA, 22 nt, Homo sapiens
aaggcgguguggauccuacagc

SEQ ID NO: 348527 - RNA, 22 nt, Homo sapiens
aaggcuagagaagaagggcauc

SEQ ID NO: 348528 - RNA, 22 nt, Homo sapiens
aaggcuauuugagaaugugugu

SEQ ID NO: 348529 - RNA, 22 nt, Homo sapiens
aaggcuguucauuuagcacagu

SEQ ID NO: 348530 - RNA, 20 nt, Homo sapiens
aaggcuuucgaguuccaggg

SEQ ID NO: 348531 - RNA, 22 nt, Homo sapiens
aagggagcugcauaaucuugug

SEQ ID NO: 348532 - RNA, 22 nt, Homo sapiens
aagguauuucuaugggaauaga

SEQ ID NO: 348533 - RNA, 22 nt, Homo sapiens
aaggugcuguaagcauccaugu

SEQ ID NO: 348534 - RNA, 17 nt, Homo sapiens
aaggugcuucgaccucc

SEQ ID NO: 348535 - RNA, 22 nt, Homo sapiens
aagguguagucucuggauaagc

SEQ ID NO: 348536 - RNA, 22 nt, Homo sapiens
aaguaaacauugagagacaaga

SEQ ID NO: 348537 - RNA, 22 nt, Homo sapiens
aagucaaggagagaagcuucag

SEQ ID NO: 348538 - RNA, 22 nt, Homo sapiens
aagucaguuugggagaagcuau

SEQ ID NO: 348539 - RNA, 22 nt, Homo sapiens
aagugaaugaugugaaguguaa

SEQ ID NO: 348540 - RNA, 22 nt, Homo sapiens
aagugacauugugcccauuuga

SEQ ID NO: 348541 - RNA, 23 nt, Homo sapiens
aagugagcuccaauugggugaga

SEQ ID NO: 348542 - RNA, 20 nt, Homo sapiens
aagugaguguuaaacugaac

SEQ ID NO: 348543 - RNA, 22 nt, Homo sapiens
aagugcacuguaagugcaggau

SEQ ID NO: 348544 - RNA, 22 nt, Homo sapiens
aagugcauguauuaguguaguc

SEQ ID NO: 348545 - RNA, 22 nt, Homo sapiens
aagugcucuugugggaagagag

SEQ ID NO: 348546 - RNA, 22 nt, Homo sapiens
aaguggaauguuuguggcacaa

SEQ ID NO: 348547 - RNA, 22 nt, Homo sapiens
aagugguguuugggagcuggac

SEQ ID NO: 348548 - RNA, 22 nt, Homo sapiens
aagugguguuuguauuuaugca

SEQ ID NO: 348549 - RNA, 22 nt, Homo sapiens
aaguuguaguuagagaguugcu

SEQ ID NO: 348550 - RNA, 22 nt, Homo sapiens
aaguuguuggaguuccauuguu

SEQ ID NO: 348551 - RNA, 20 nt, Homo sapiens
aauaacagccccagggaggu

SEQ ID NO: 348552 - RNA, 22 nt, Homo sapiens
aauacugugauaucgagcgauu

SEQ ID NO: 348553 - RNA, 22 nt, Homo sapiens
aauagcacugcuaugguuugaa

SEQ ID NO: 348554 - RNA, 22 nt, Homo sapiens
aauaucacaguuggguguacac

SEQ ID NO: 348555 - RNA, 22 nt, Homo sapiens
aauauguccuugaaauggugcu

SEQ ID NO: 348556 - RNA, 19 nt, Homo sapiens
aauauugacaguggugucu

SEQ ID NO: 348557 - RNA, 22 nt, Homo sapiens
aaucacagccagcuuccgcuau

SEQ ID NO: 348558 - RNA, 22 nt, Homo sapiens
aaucacauugaaucugcuaccu

SEQ ID NO: 348559 - RNA, 22 nt, Homo sapiens
aaucacuuugcuacaaggcagu

SEQ ID NO: 348560 - RNA, 22 nt, Homo sapiens
aaucccuggacuuucggaggcu

SEQ ID NO: 348561 - RNA, 22 nt, Homo sapiens
aaucugggguuguuuggggagu

SEQ ID NO: 348562 - RNA, 22 nt, Homo sapiens
aaugcauaauuuguaugaggua

SEQ ID NO: 348563 - RNA, 22 nt, Homo sapiens
aauggcaaauguuuucuguuga

SEQ ID NO: 348564 - RNA, 22 nt, Homo sapiens
aauggcacaagacaugaagaag

SEQ ID NO: 348565 - RNA, 22 nt, Homo sapiens
aauggcacacaccuggucuaac

SEQ ID NO: 348566 - RNA, 22 nt, Homo sapiens
aauggcaucuagaguggugaau

SEQ ID NO: 348567 - RNA, 22 nt, Homo sapiens
aauggcauuugccagggcaaag

SEQ ID NO: 348568 - RNA, 22 nt, Homo sapiens
aauggcuucuuauugugguuca

SEQ ID NO: 348569 - RNA, 22 nt, Homo sapiens
aaugguuuuaucagcguccaaa

SEQ ID NO: 348570 - RNA, 22 nt, Homo sapiens
aaugucaucuucaguuguacag

SEQ ID NO: 348571 - RNA, 22 nt, Homo sapiens
aaugugcuuucuuucacacagu

SEQ ID NO: 348572 - RNA, 22 nt, Homo sapiens
aauguguuuugaaaucaggaag

SEQ ID NO: 348573 - RNA, 22 nt, Homo sapiens
aauugcuuuuauuuagggccag

SEQ ID NO: 348574 - RNA, 22 nt, Homo sapiens
aauuguacucccauaauucccu

SEQ ID NO: 348575 - RNA, 22 nt, Homo sapiens
acaacaguuuuaucaccccaga

SEQ ID NO: 348576 - RNA, 22 nt, Homo sapiens
agucagugcauaagaaugaagu

SEQ ID NO: 348577 - RNA, 22 nt, Homo sapiens
agugaucauuugaauugaugau

SEQ ID NO: 348578 - RNA, 22 nt, Homo sapiens
agugauuuuaacuuccagcaau

SEQ ID NO: 348579 - RNA, 22 nt, Homo sapiens
agugcaaagccgagguuucuug

SEQ ID NO: 348580 - RNA, 22 nt, Homo sapiens
agugcacuccagccugggcaac

SEQ ID NO: 348581 - RNA, 22 nt, Homo sapiens
agugccauggcugcuagauggc

SEQ ID NO: 348582 - RNA, 22 nt, Homo sapiens
aguggauguuguggccugggag

SEQ ID NO: 348583 - RNA, 22 nt, Homo sapiens
agugggccccuagaggugaggu

SEQ ID NO: 348584 - RNA, 22 nt, Homo sapiens
agugguauaauauuauuuugaa

SEQ ID NO: 348585 - RNA, 23 nt, Homo sapiens
aguggucuccugggcccagcugu

SEQ ID NO: 348586 - RNA, 22 nt, Homo sapiens
aguggugucugaguggccaggg

SEQ ID NO: 348587 - RNA, 19 nt, Homo sapiens
agugucauggucauuauuu

SEQ ID NO: 348588 - RNA, 22 nt, Homo sapiens
aguguuuuuaacaagaaagggu

SEQ ID NO: 348589 - RNA, 22 nt, Homo sapiens
aguucaaugcucuuucuacuau

SEQ ID NO: 348590 - RNA, 19 nt, Homo sapiens
auaaacuagaacugucccc

SEQ ID NO: 348591 - RNA, 22 nt, Homo sapiens
auaacauggaguuugucauuua

SEQ ID NO: 348592 - RNA, 18 nt, Homo sapiens
auaaccuggugcuuucaa

SEQ ID NO: 348593 - RNA, 22 nt, Homo sapiens
auaagagugggguguuagggau

SEQ ID NO: 348594 - RNA, 22 nt, Homo sapiens
auaagauaguggaagugggauu

SEQ ID NO: 348595 - RNA, 22 nt, Homo sapiens
auaagcuaagaguuucugggcu

SEQ ID NO: 348596 - RNA, 22 nt, Homo sapiens
auaaggaguaucauauuaaaac

SEQ ID NO: 348597 - RNA, 22 nt, Homo sapiens
auaaggcugguauagacauuca

SEQ ID NO: 348598 - RNA, 22 nt, Homo sapiens
auaagugagugauucaguguua

SEQ ID NO: 348599 - RNA, 22 nt, Homo sapiens
auaauacuuuuauuuugaggaa

SEQ ID NO: 348600 - RNA, 22 nt, Homo sapiens
auacaagcaguccaacuccaua

SEQ ID NO: 348601 - RNA, 22 nt, Homo sapiens
auacacauuccugggccucacc

SEQ ID NO: 348602 - RNA, 22 nt, Homo sapiens
auacacgugcagaacaugcagg

SEQ ID NO: 348603 - RNA, 22 nt, Homo sapiens
auacagguauacaaugcauaau

SEQ ID NO: 348604 - RNA, 22 nt, Homo sapiens
auacaguauggagggcccagcu

SEQ ID NO: 348605 - RNA, 22 nt, Homo sapiens
auacaucugccauguuggugug

SEQ ID NO: 348606 - RNA, 22 nt, Homo sapiens
auacaugugccaugcuggugug

SEQ ID NO: 348607 - RNA, 22 nt, Homo sapiens
auacauguucaagggcauauau

SEQ ID NO: 348608 - RNA, 22 nt, Homo sapiens
auacccaguaguggaauugcua

SEQ ID NO: 348609 - RNA, 22 nt, Homo sapiens
auacccucugggugguuaguug

SEQ ID NO: 348610 - RNA, 22 nt, Homo sapiens
auacugucucuugcuccugccc

SEQ ID NO: 348611 - RNA, 22 nt, Homo sapiens
auagcaaugccccacuccuugg

SEQ ID NO: 348612 - RNA, 22 nt, Homo sapiens
auagcacaguguguguacacca

SEQ ID NO: 348613 - RNA, 22 nt, Homo sapiens
auagcagaccaccucucccacu

SEQ ID NO: 348614 - RNA, 22 nt, Homo sapiens
auagcagcaccccacuaccuca

SEQ ID NO: 348615 - RNA, 22 nt, Homo sapiens
auagcagugugaaaauguacua

SEQ ID NO: 348616 - RNA, 20 nt, Homo sapiens
auagcauugauggacucaaa

SEQ ID NO: 348617 - RNA, 22 nt, Homo sapiens
auagcucuugcuuacccacugu

SEQ ID NO: 348618 - RNA, 22 nt, Homo sapiens
auagcuguccuuacuagcuagg

SEQ ID NO: 348619 - RNA, 22 nt, Homo sapiens
auagguauuuuuaaaugacugu

SEQ ID NO: 348620 - RNA, 22 nt, Homo sapiens
auaggucaucaugggaguggga

SEQ ID NO: 348621 - RNA, 22 nt, Homo sapiens
auagugaacuuugugagaacaa

SEQ ID NO: 348622 - RNA, 22 nt, Homo sapiens
auagugcugcaacaaauauacg

SEQ ID NO: 348623 - RNA, 22 nt, Homo sapiens
auagugcugcaauaaccauggg

SEQ ID NO: 348624 - RNA, 22 nt, Homo sapiens
auauaugcacacgugugcauau

SEQ ID NO: 348625 - RNA, 22 nt, Homo sapiens
auauauguuuucugggaagaaa

SEQ ID NO: 348626 - RNA, 22 nt, Homo sapiens
auaucaacaucgugucauuagu

SEQ ID NO: 348627 - RNA, 22 nt, Homo sapiens
auaucacaggaaaggaagauac

SEQ ID NO: 348628 - RNA, 22 nt, Homo sapiens
auaucacucccaauaucgcagg

SEQ ID NO: 348629 - RNA, 22 nt, Homo sapiens
auaucccagugaugauugauag

SEQ ID NO: 348630 - RNA, 22 nt, Homo sapiens
auaugacugccagggcccaguc

SEQ ID NO: 348631 - RNA, 22 nt, Homo sapiens
auaugacuuuccucuacuuccu

SEQ ID NO: 348632 - RNA, 22 nt, Homo sapiens
auaugcauacccucaccaacua

SEQ ID NO: 348633 - RNA, 21 nt, Homo sapiens
auauggaacuggugacguguu

SEQ ID NO: 348634 - RNA, 22 nt, Homo sapiens
auauggcuuuuauuauguugag

SEQ ID NO: 348635 - RNA, 22 nt, Homo sapiens
auauuguacugcuacugguucu

SEQ ID NO: 348636 - RNA, 22 nt, Homo sapiens
aucaaagugaauuaaugagaau

SEQ ID NO: 348637 - RNA, 22 nt, Homo sapiens
aucaaaucuccagaaccugucu

SEQ ID NO: 348638 - RNA, 22 nt, Homo sapiens
aucaagcuugacuccuuaaagg

SEQ ID NO: 348639 - RNA, 22 nt, Homo sapiens
aucacaauuguacguaggagcc

SEQ ID NO: 348640 - RNA, 22 nt, Homo sapiens
aucacagagucacgggcaacuu

SEQ ID NO: 348641 - RNA, 22 nt, Homo sapiens
aucacagcccuccucuuggaug

SEQ ID NO: 348642 - RNA, 22 nt, Homo sapiens
aucacaggcaaaauuccuucuc

SEQ ID NO: 348643 - RNA, 22 nt, Homo sapiens
aucacaguuauaacauccuuuu

SEQ ID NO: 348644 - RNA, 22 nt, Homo sapiens
aucacaguuuuaccauuuggua

SEQ ID NO: 348645 - RNA, 22 nt, Homo sapiens
aucaccuggaguagcccguccc

SEQ ID NO: 348646 - RNA, 22 nt, Homo sapiens
aucaccuuucccuuucugaauc

SEQ ID NO: 348647 - RNA, 22 nt, Homo sapiens
aucacuggucaugagagaagua

SEQ ID NO: 348648 - RNA, 22 nt, Homo sapiens
aucagauuccagaggcagcacc

SEQ ID NO: 348649 - RNA, 22 nt, Homo sapiens
aucaggaaccuuuuuggugugu

SEQ ID NO: 348650 - RNA, 22 nt, Homo sapiens
aucaugcacaugcauagguaug

SEQ ID NO: 348651 - RNA, 22 nt, Homo sapiens
aucauggaguauuugcaagucu

SEQ ID NO: 348652 - RNA, 22 nt, Homo sapiens
auccacagugucaauguuguga

SEQ ID NO: 348653 - RNA, 22 nt, Homo sapiens
auccacaugcaguuggaaacag

SEQ ID NO: 348654 - RNA, 22 nt, Homo sapiens
aucccuguaacuagcagccccu

SEQ ID NO: 348655 - RNA, 22 nt, Homo sapiens
aucccuguaguaauauucuagc

SEQ ID NO: 348656 - RNA, 22 nt, Homo sapiens
auccugaugacacagugcugca

SEQ ID NO: 348657 - RNA, 22 nt, Homo sapiens
aucgcgccauuguacuccagcc

SEQ ID NO: 348658 - RNA, 22 nt, Homo sapiens
aucucuugccagucagaauggu

SEQ ID NO: 348659 - RNA, 22 nt, Homo sapiens
aucugcauucccauguuuauug

SEQ ID NO: 348660 - RNA, 22 nt, Homo sapiens
aucuggcuccuuuugacaaugc

SEQ ID NO: 348661 - RNA, 22 nt, Homo sapiens
aucuucucuugaagggugggga

SEQ ID NO: 348662 - RNA, 22 nt, Homo sapiens
augaaaagcauaaacgcugaag

SEQ ID NO: 348663 - RNA, 22 nt, Homo sapiens
augaaaguguguggaaacuuga

SEQ ID NO: 348664 - RNA, 22 nt, Homo sapiens
augaaaucacugugaugcccua

SEQ ID NO: 348665 - RNA, 22 nt, Homo sapiens
augaagagaaaguggaucuugg

SEQ ID NO: 348666 - RNA, 17 nt, Homo sapiens
augaagucaucauuuuu

SEQ ID NO: 348667 - RNA, 20 nt, Homo sapiens
augaagugaaguuagggaac

SEQ ID NO: 348668 - RNA, 22 nt, Homo sapiens
augaaguuagcucauuucuuuu

SEQ ID NO: 348669 - RNA, 22 nt, Homo sapiens
augaauacagcuaugcgugcau

SEQ ID NO: 348670 - RNA, 22 nt, Homo sapiens
augaauagaguuaauugaguac

SEQ ID NO: 348671 - RNA, 23 nt, Homo sapiens
augaauguaaagaaugugggaag

SEQ ID NO: 348672 - RNA, 22 nt, Homo sapiens
augaauucaucugguuuuggga

SEQ ID NO: 348673 - RNA, 22 nt, Homo sapiens
augacacugcagagauguccca

SEQ ID NO: 348674 - RNA, 22 nt, Homo sapiens
augagaauguaaguuaaugaaa

SEQ ID NO: 348675 - RNA, 22 nt, Homo sapiens
augagacauuaaaguguguuug

SEQ ID NO: 348676 - RNA, 22 nt, Homo sapiens
augagagcuaacuguggguaca

SEQ ID NO: 348677 - RNA, 22 nt, Homo sapiens
augagauacuacaaaugaguuu

SEQ ID NO: 348678 - RNA, 22 nt, Homo sapiens
augagcagaagagauacacugu

SEQ ID NO: 348679 - RNA, 17 nt, Homo sapiens
augagcucaucauuuuu

SEQ ID NO: 348680 - RNA, 22 nt, Homo sapiens
augaggagauauuaaauaccau

SEQ ID NO: 348681 - RNA, 22 nt, Homo sapiens
augagguaguagaaagucaggu

SEQ ID NO: 348682 - RNA, 22 nt, Homo sapiens
augaggugggagaaucacuuga

SEQ ID NO: 348683 - RNA, 22 nt, Homo sapiens
augaguaguugcuaaauauuga

SEQ ID NO: 348684 - RNA, 22 nt, Homo sapiens
augauacuggcuucauagaaug

SEQ ID NO: 348685 - RNA, 22 nt, Homo sapiens
augaucauggaaguuuuccugu

SEQ ID NO: 348686 - RNA, 22 nt, Homo sapiens
augaucuguagaacuaguccuu

SEQ ID NO: 348687 - RNA, 22 nt, Homo sapiens
augaugaaguaagugcuuagga

SEQ ID NO: 348688 - RNA, 22 nt, Homo sapiens
augaugcugagguuugggguau

SEQ ID NO: 348689 - RNA, 22 nt, Homo sapiens
augaugcugcaguuguugccaa

SEQ ID NO: 348690 - RNA, 22 nt, Homo sapiens
augauuguucucacucaagaga

SEQ ID NO: 348691 - RNA, 22 nt, Homo sapiens
augcacauggcuaacuuuuuuc

SEQ ID NO: 348692 - RNA, 22 nt, Homo sapiens
augcacuuggcaggaugauucc

SEQ ID NO: 348693 - RNA, 22 nt, Homo sapiens
augcagugugcaacagauuaag

SEQ ID NO: 348694 - RNA, 22 nt, Homo sapiens
augcauauuuuaccuagaagag

SEQ ID NO: 348695 - RNA, 22 nt, Homo sapiens
augcauggagucuuucacaagu

SEQ ID NO: 348696 - RNA, 22 nt, Homo sapiens
augcauggucugaagucaaccu

SEQ ID NO: 348697 - RNA, 22 nt, Homo sapiens
augccacagaaauaaccaaaau

SEQ ID NO: 348698 - RNA, 22 nt, Homo sapiens
augccacuucucuaagucaugu

SEQ ID NO: 348699 - RNA, 22 nt, Homo sapiens
augccaguguccagaguggguu

SEQ ID NO: 348700 - RNA, 22 nt, Homo sapiens
augccauugcacuccagccuag

SEQ ID NO: 348701 - RNA, 19 nt, Homo sapiens
augccucaguuuuguacuu

SEQ ID NO: 348702 - RNA, 22 nt, Homo sapiens
auggaaagcuguuccuacacaa

SEQ ID NO: 348703 - RNA, 22 nt, Homo sapiens
auggaacauuauagauguaaaa

SEQ ID NO: 348704 - RNA, 22 nt, Homo sapiens
auggaaggagaggaaugaauga

SEQ ID NO: 348705 - RNA, 22 nt, Homo sapiens
auggaaugccauuuauaaugga

SEQ ID NO: 348706 - RNA, 22 nt, Homo sapiens
auggagagaauuauucucucag

SEQ ID NO: 348707 - RNA, 22 nt, Homo sapiens
auggagaugaacuuggguaaag

SEQ ID NO: 348708 - RNA, 22 nt, Homo sapiens
auggagcaaaacagauuuggga

SEQ ID NO: 348709 - RNA, 22 nt, Homo sapiens
auggaguguaauauugagagcu

SEQ ID NO: 348710 - RNA, 22 nt, Homo sapiens
auggauaugcuuccaacugccu

SEQ ID NO: 348711 - RNA, 22 nt, Homo sapiens
auggauguucuagggaugugau

SEQ ID NO: 348712 - RNA, 22 nt, Homo sapiens
auggauuuuaggauacaguuga

SEQ ID NO: 348713 - RNA, 22 nt, Homo sapiens
auggauuuugaacuugagaguu

SEQ ID NO: 348714 - RNA, 22 nt, Homo sapiens
auggcaaaaaaugcaauuacuu

SEQ ID NO: 348715 - RNA, 22 nt, Homo sapiens
auggcacuccagccugggcaac

SEQ ID NO: 348716 - RNA, 22 nt, Homo sapiens
auggcacugaagcguauugaca

SEQ ID NO: 348717 - RNA, 22 nt, Homo sapiens
auggcacuguguccugggguca

SEQ ID NO: 348718 - RNA, 22 nt, Homo sapiens
auggcagcccucuuuauccaug

SEQ ID NO: 348719 - RNA, 22 nt, Homo sapiens
auggcagcugacacuuccgucu

SEQ ID NO: 348720 - RNA, 22 nt, Homo sapiens
auggcaguguaugauuauauua

SEQ ID NO: 348721 - RNA, 22 nt, Homo sapiens
auggcagugucuagggguguuu

SEQ ID NO: 348722 - RNA, 22 nt, Homo sapiens
auggcaguuuauucuaaaucaa

SEQ ID NO: 348723 - RNA, 22 nt, Homo sapiens
auggcauuuuuagggcugggug

SEQ ID NO: 348724 - RNA, 22 nt, Homo sapiens
auggccauuacuaagaauguuu

SEQ ID NO: 348725 - RNA, 22 nt, Homo sapiens
auggccugaugcaccuguccca

SEQ ID NO: 348726 - RNA, 22 nt, Homo sapiens
auggcggugugaucuuggcuca

SEQ ID NO: 348727 - RNA, 22 nt, Homo sapiens
auggcuagaaccuguauauuca

SEQ ID NO: 348728 - RNA, 22 nt, Homo sapiens
auggcucuguuuuuuaugcucu

SEQ ID NO: 348729 - RNA, 22 nt, Homo sapiens
auggcuucuucuaaaagugggg

SEQ ID NO: 348730 - RNA, 22 nt, Homo sapiens
auggcuuugggcugcucugccc

SEQ ID NO: 348731 - RNA, 22 nt, Homo sapiens
auggcuuuguguucagagcuga

SEQ ID NO: 348732 - RNA, 22 nt, Homo sapiens
auggcuuuuauuguguugaggu

SEQ ID NO: 348733 - RNA, 22 nt, Homo sapiens
auggcuuuugcccuaaauggau

SEQ ID NO: 348734 - RNA, 22 nt, Homo sapiens
auggcuuuuuucuugggcacuc

SEQ ID NO: 348735 - RNA, 22 nt, Homo sapiens
augggaaaaucagaaggccugg

SEQ ID NO: 348736 - RNA, 21 nt, Homo sapiens
augggacuaacugaugggucu

SEQ ID NO: 348737 - RNA, 22 nt, Homo sapiens
augggacugggugccguggagc

SEQ ID NO: 348738 - RNA, 22 nt, Homo sapiens
augggcacugauguauucugug

SEQ ID NO: 348739 - RNA, 22 nt, Homo sapiens
augggguaggcuugcuguagua

SEQ ID NO: 348740 - RNA, 22 nt, Homo sapiens
augggguagguagcucggggaa

SEQ ID NO: 348741 - RNA, 17 nt, Homo sapiens
augggguuguagcccca

SEQ ID NO: 348742 - RNA, 22 nt, Homo sapiens
augguacucucuugucugcaaa

SEQ ID NO: 348743 - RNA, 22 nt, Homo sapiens
augguauggaaggucuggagga

SEQ ID NO: 348744 - RNA, 22 nt, Homo sapiens
auggucccuguuccaugcuccu

SEQ ID NO: 348745 - RNA, 22 nt, Homo sapiens
augguuuauuuguaagcagagu

SEQ ID NO: 348746 - RNA, 22 nt, Homo sapiens
auguaaacauuuggucuaaauu

SEQ ID NO: 348747 - RNA, 22 nt, Homo sapiens
auguaacaguauuuggagaugu

SEQ ID NO: 348748 - RNA, 22 nt, Homo sapiens
auguaauguuaaauugcuaauu

SEQ ID NO: 348749 - RNA, 17 nt, Homo sapiens
auguauacauccaugua

SEQ ID NO: 348750 - RNA, 22 nt, Homo sapiens
augucaaggugggugauaguuu

SEQ ID NO: 348751 - RNA, 22 nt, Homo sapiens
augucacagguccuagccaagu

SEQ ID NO: 348752 - RNA, 20 nt, Homo sapiens
augucaggaagggagucagg

SEQ ID NO: 348753 - RNA, 22 nt, Homo sapiens
augucuagagcaagagaugcug

SEQ ID NO: 348754 - RNA, 22 nt, Homo sapiens
augucuguuugcugagcccggc

SEQ ID NO: 348755 - RNA, 22 nt, Homo sapiens
augucuuucauagagacccaga

SEQ ID NO: 348756 - RNA, 22 nt, Homo sapiens
augugcaaagcacuguucagca

SEQ ID NO: 348757 - RNA, 22 nt, Homo sapiens
augugcaaauuuccaaacucuu

SEQ ID NO: 348758 - RNA, 22 nt, Homo sapiens
augugcacaacgugcagguuug

SEQ ID NO: 348759 - RNA, 22 nt, Homo sapiens
augugggaggacuuggcuguug

SEQ ID NO: 348760 - RNA, 22 nt, Homo sapiens
auguggugguagccaggacagg

SEQ ID NO: 348761 - RNA, 22 nt, Homo sapiens
augugucaaaucuaggccaaag

SEQ ID NO: 348762 - RNA, 18 nt, Homo sapiens
auguuauguuuguagaag

SEQ ID NO: 348763 - RNA, 22 nt, Homo sapiens
auuaauguaauuaguaaaguug

SEQ ID NO: 348764 - RNA, 22 nt, Homo sapiens
auuagaugguuauaggugugag

SEQ ID NO: 348765 - RNA, 22 nt, Homo sapiens
auucacagcuuuaaaaggcgug

SEQ ID NO: 348766 - RNA, 22 nt, Homo sapiens
auucacuguggcuuucucugau

SEQ ID NO: 348767 - RNA, 22 nt, Homo sapiens
auucacuguggguccuuuggau

SEQ ID NO: 348768 - RNA, 23 nt, Homo sapiens
ugagaucuacagaucucagaucu

SEQ ID NO: 348769 - RNA, 22 nt, Homo sapiens
ugagaucugucuuuauaguauu

SEQ ID NO: 348770 - RNA, 22 nt, Homo sapiens
ugagaugaagcuagaagaaugg

SEQ ID NO: 348771 - RNA, 22 nt, Homo sapiens
ugagaugaagucucacucuguc

SEQ ID NO: 348772 - RNA, 22 nt, Homo sapiens
ugagaugacgacacaccucagu

SEQ ID NO: 348773 - RNA, 22 nt, Homo sapiens
ugagaugagagaaugcuugccu

SEQ ID NO: 348774 - RNA, 22 nt, Homo sapiens
ugagaugaguucucgcucuguc

SEQ ID NO: 348775 - RNA, 22 nt, Homo sapiens
ugagaugauaucuuauuguaau

SEQ ID NO: 348776 - RNA, 21 nt, Homo sapiens
ugagaugauccugcaugcaug

SEQ ID NO: 348777 - RNA, 22 nt, Homo sapiens
ugagaugcauauucuggcuccu

SEQ ID NO: 348778 - RNA, 22 nt, Homo sapiens
ugagauggcugaauucagaaua

SEQ ID NO: 348779 - RNA, 22 nt, Homo sapiens
ugagauguuuguuucagugccu

SEQ ID NO: 348780 - RNA, 22 nt, Homo sapiens
ugagauuaaucuuuaaguaaga

SEQ ID NO: 348781 - RNA, 23 nt, Homo sapiens
ugagauuacccagaaagaguaua

SEQ ID NO: 348782 - RNA, 22 nt, Homo sapiens
ugagauuaucguaauguaucuc

SEQ ID NO: 348783 - RNA, 19 nt, Homo sapiens
ugagauuguaugaggagau

SEQ ID NO: 348784 - RNA, 22 nt, Homo sapiens
ugagcacaggugcgcgguuacu

SEQ ID NO: 348785 - RNA, 22 nt, Homo sapiens
ugagcacuguacuuuaucaggu

SEQ ID NO: 348786 - RNA, 22 nt, Homo sapiens
ugagcagagaagugcccugcgc

SEQ ID NO: 348787 - RNA, 22 nt, Homo sapiens
ugagcuacuacacccagcuugg

SEQ ID NO: 348788 - RNA, 22 nt, Homo sapiens
ugagcucaguauuucauaaaca

SEQ ID NO: 348789 - RNA, 22 nt, Homo sapiens
ugagcugagaucacacuacugu

SEQ ID NO: 348790 - RNA, 22 nt, Homo sapiens
ugagcugagauuaagcugcugc

SEQ ID NO: 348791 - RNA, 22 nt, Homo sapiens
ugaggaauguguguuaaagaua

SEQ ID NO: 348792 - RNA, 22 nt, Homo sapiens
ugaggauaguguugaaggcagg

SEQ ID NO: 348793 - RNA, 22 nt, Homo sapiens
ugagguaaaacaaggauuggau

SEQ ID NO: 348794 - RNA, 22 nt, Homo sapiens
ugagguguuauccagaguucuu

SEQ ID NO: 348795 - RNA, 22 nt, Homo sapiens
ugagguugaaggacauuuuuau

SEQ ID NO: 348796 - RNA, 22 nt, Homo sapiens
ugaguacugauuuaagauacac

SEQ ID NO: 348797 - RNA, 22 nt, Homo sapiens
ugagucauuuccuuaugcuacu

SEQ ID NO: 348798 - RNA, 22 nt, Homo sapiens
ugagucuguuccaaagaaauaa

SEQ ID NO: 348799 - RNA, 22 nt, Homo sapiens
ugagugccuggagggcagggac

SEQ ID NO: 348800 - RNA, 22 nt, Homo sapiens
ugaguuaaucucuacgauagaa

SEQ ID NO: 348801 - RNA, 22 nt, Homo sapiens
ugaguuccuugugugaccuugc

SEQ ID NO: 348802 - RNA, 20 nt, Homo sapiens
ugaguuccuuguucagaagc

SEQ ID NO: 348803 - RNA, 22 nt, Homo sapiens
ugaguuguaggggucaccuggc

SEQ ID NO: 348804 - RNA, 23 nt, Homo sapiens
ugauaacagcauaugaagauucu

SEQ ID NO: 348805 - RNA, 22 nt, Homo sapiens
ugauaacauugggggaagcuga

SEQ ID NO: 348806 - RNA, 22 nt, Homo sapiens
ugauaauguuaggcuuuauuca

SEQ ID NO: 348807 - RNA, 22 nt, Homo sapiens
ugauacguaggaauuaugggag

SEQ ID NO: 348808 - RNA, 18 nt, Homo sapiens
ugauaucaucacaauuga

SEQ ID NO: 348809 - RNA, 22 nt, Homo sapiens
ugauauggcuuggcuaugucac

SEQ ID NO: 348810 - RNA, 22 nt, Homo sapiens
ugauaugucacuugaucauggu

SEQ ID NO: 348811 - RNA, 22 nt, Homo sapiens
ugauauguggcuauugagauug

SEQ ID NO: 348812 - RNA, 22 nt, Homo sapiens
ugauauguguaaacaauguaua

SEQ ID NO: 348813 - RNA, 21 nt, Homo sapiens
ugaucacaugaaaaccaugca

SEQ ID NO: 348814 - RNA, 22 nt, Homo sapiens
ugaucugucucggguuaucagu

SEQ ID NO: 348815 - RNA, 22 nt, Homo sapiens
ugaugacucuguggccccaggc

SEQ ID NO: 348816 - RNA, 20 nt, Homo sapiens
ugaugcaaaucuuuaaaagu

SEQ ID NO: 348817 - RNA, 22 nt, Homo sapiens
ugaugcuacuaccugggcugaa

SEQ ID NO: 348818 - RNA, 22 nt, Homo sapiens
ugauggcauuucauguuuguaa

SEQ ID NO: 348819 - RNA, 22 nt, Homo sapiens
ugauguguuuuguaguucaacu

SEQ ID NO: 348820 - RNA, 22 nt, Homo sapiens
ugauguugacuguaggcagaga

SEQ ID NO: 348821 - RNA, 22 nt, Homo sapiens
ugauuagaggaaugguagauua

SEQ ID NO: 348822 - RNA, 22 nt, Homo sapiens
ugauuugucugcaggaauagug

SEQ ID NO: 348823 - RNA, 22 nt, Homo sapiens
ugauuuguuucaggaguuuucu

SEQ ID NO: 348824 - RNA, 22 nt, Homo sapiens
ugcaaaguccucauucuuaccc

SEQ ID NO: 348825 - RNA, 19 nt, Homo sapiens
ugcaaagucuuuuccuauu

SEQ ID NO: 348826 - RNA, 22 nt, Homo sapiens
ugcaaauguuaguaacaccacu

SEQ ID NO: 348827 - RNA, 19 nt, Homo sapiens
ugcaaauucuaaaaacuga

SEQ ID NO: 348828 - RNA, 22 nt, Homo sapiens
ugcaagacacuguccugggcau

SEQ ID NO: 348829 - RNA, 22 nt, Homo sapiens
ugcaagacugcaguuacuuuug

SEQ ID NO: 348830 - RNA, 22 nt, Homo sapiens
ugcaagaugauuucaauugaua

SEQ ID NO: 348831 - RNA, 22 nt, Homo sapiens
ugcaagcacacccagggauugu

SEQ ID NO: 348832 - RNA, 22 nt, Homo sapiens
ugcaauauccucuacuauaggu

SEQ ID NO: 348833 - RNA, 22 nt, Homo sapiens
ugcacacucuguaugagaaucu

SEQ ID NO: 348834 - RNA, 22 nt, Homo sapiens
ugcacugucuugucgcauagca

SEQ ID NO: 348835 - RNA, 20 nt, Homo sapiens
ugcagcacgggcccuuucca

SEQ ID NO: 348836 - RNA, 20 nt, Homo sapiens
ugcagcacugggaaugcagu

SEQ ID NO: 348837 - RNA, 18 nt, Homo sapiens
ugcagcaucaguacccag

SEQ ID NO: 348838 - RNA, 22 nt, Homo sapiens
ugcaggguccauugucccaagu

SEQ ID NO: 348839 - RNA, 22 nt, Homo sapiens
ugcagguaggcaguaucauuua

SEQ ID NO: 348840 - RNA, 22 nt, Homo sapiens
ugcagugucaauaauaauuagu

SEQ ID NO: 348841 - RNA, 22 nt, Homo sapiens
ugcaguguggcucacgccugua

SEQ ID NO: 348842 - RNA, 22 nt, Homo sapiens
ugcauacacaagcauacaugua

SEQ ID NO: 348843 - RNA, 22 nt, Homo sapiens
ugcauacugaaauauuuuagag

SEQ ID NO: 348844 - RNA, 22 nt, Homo sapiens
ugcauacugggagguugggugu

SEQ ID NO: 348845 - RNA, 22 nt, Homo sapiens
ugcauaugcagcauuuaugauu

SEQ ID NO: 348846 - RNA, 22 nt, Homo sapiens
ugcauaugucuuuauagcagca

SEQ ID NO: 348847 - RNA, 22 nt, Homo sapiens
ugcauaugucuuuauaguagca

SEQ ID NO: 348848 - RNA, 22 nt, Homo sapiens
ugcauauguugaaccagccuug

SEQ ID NO: 348849 - RNA, 22 nt, Homo sapiens
ugcauugccgugauuacugucu

SEQ ID NO: 348850 - RNA, 22 nt, Homo sapiens
ugccaaggagucagucccuaga

SEQ ID NO: 348851 - RNA, 22 nt, Homo sapiens
ugccaugaagaucccugaaaug

SEQ ID NO: 348852 - RNA, 22 nt, Homo sapiens
ugccaugucauagguuaagccu

SEQ ID NO: 348853 - RNA, 22 nt, Homo sapiens
ugccauugcacuccagccuggg

SEQ ID NO: 348854 - RNA, 22 nt, Homo sapiens
ugccuaggcuggaaugcaaugg

SEQ ID NO: 348855 - RNA, 22 nt, Homo sapiens
ugccuaggcuggaaugcagugg

SEQ ID NO: 348856 - RNA, 22 nt, Homo sapiens
ugccuaguagaaggugaacaug

SEQ ID NO: 348857 - RNA, 22 nt, Homo sapiens
ugccugagcccagcccuguagu

SEQ ID NO: 348858 - RNA, 22 nt, Homo sapiens
ugccugcugucuaauauauucu

SEQ ID NO: 348859 - RNA, 16 nt, Homo sapiens
ugccuucuucuguauu

SEQ ID NO: 348860 - RNA, 22 nt, Homo sapiens
ugccuuuguucuggaaugggaa

SEQ ID NO: 348861 - RNA, 22 nt, Homo sapiens
ugcuaucauugauuagugaugu

SEQ ID NO: 348862 - RNA, 23 nt, Homo sapiens
ugcuauguaagcauuuauuaaau

SEQ ID NO: 348863 - RNA, 22 nt, Homo sapiens
ugcuaugucagccaggcugguc

SEQ ID NO: 348864 - RNA, 22 nt, Homo sapiens
ugucaaagagacaucugcacuc

SEQ ID NO: 348865 - RNA, 19 nt, Homo sapiens
ugucaaaugucuccugggg

SEQ ID NO: 348866 - RNA, 22 nt, Homo sapiens
ugucaagaugguuugauguugu

SEQ ID NO: 348867 - RNA, 22 nt, Homo sapiens
ugucaaguugugguucaauuuu

SEQ ID NO: 348868 - RNA, 22 nt, Homo sapiens
ugucacagagauuuugguaugu

SEQ ID NO: 348869 - RNA, 18 nt, Homo sapiens
ugucacuggauaaugguc

SEQ ID NO: 348870 - RNA, 22 nt, Homo sapiens
ugucacugugcagucaugcauu

SEQ ID NO: 348871 - RNA, 22 nt, Homo sapiens
ugucagaaucuagaggcugcua

SEQ ID NO: 348872 - RNA, 22 nt, Homo sapiens
ugucagaaucugagacgacaac

SEQ ID NO: 348873 - RNA, 22 nt, Homo sapiens
ugucaggaggguccagagaaaa

SEQ ID NO: 348874 - RNA, 22 nt, Homo sapiens
ugucaggaguuuuagaaucuua

SEQ ID NO: 348875 - RNA, 22 nt, Homo sapiens
ugucaguggacugugaaaggca

SEQ ID NO: 348876 - RNA, 22 nt, Homo sapiens
ugucaguguaugagccccggau

SEQ ID NO: 348877 - RNA, 22 nt, Homo sapiens
ugucaguuucaguguuagccuu

SEQ ID NO: 348878 - RNA, 22 nt, Homo sapiens
ugucaguuucccuccucuuccu

SEQ ID NO: 348879 - RNA, 19 nt, Homo sapiens
ugucaucaucuuuucuugc

SEQ ID NO: 348880 - RNA, 22 nt, Homo sapiens
ugucaucauuugagagaagaaa

SEQ ID NO: 348881 - RNA, 22 nt, Homo sapiens
ugucaucuagguauuaagcccc

SEQ ID NO: 348882 - RNA, 22 nt, Homo sapiens
ugucaucuagguuuuaagccuu

SEQ ID NO: 348883 - RNA, 22 nt, Homo sapiens
ugucaugucuuuguguaucaau

SEQ ID NO: 348884 - RNA, 20 nt, Homo sapiens
ugucauuaagcacugugcca

SEQ ID NO: 348885 - RNA, 22 nt, Homo sapiens
ugucauuggacuucuuucaugg

SEQ ID NO: 348886 - RNA, 22 nt, Homo sapiens
ugucccugagccuggauuccug

SEQ ID NO: 348887 - RNA, 22 nt, Homo sapiens
uguccuggugaugcccaaauuc

SEQ ID NO: 348888 - RNA, 22 nt, Homo sapiens
ugucuagaaaagccugccuucu

SEQ ID NO: 348889 - RNA, 22 nt, Homo sapiens
ugucuguuugcgaaauugcuuc

SEQ ID NO: 348890 - RNA, 18 nt, Homo sapiens
ugucuuagagcuugaccc

SEQ ID NO: 348891 - RNA, 22 nt, Homo sapiens
ugucuuguagacaauguauagu

SEQ ID NO: 348892 - RNA, 22 nt, Homo sapiens
ugugaaacauggauagaacugg

SEQ ID NO: 348893 - RNA, 21 nt, Homo sapiens
ugugaaaucuaggcagagguu

SEQ ID NO: 348894 - RNA, 19 nt, Homo sapiens
ugugaacaucacagagugu

SEQ ID NO: 348895 - RNA, 21 nt, Homo sapiens
ugugaacauguuggguggcau

SEQ ID NO: 348896 - RNA, 22 nt, Homo sapiens
ugugaagauguuucuuaauuga

SEQ ID NO: 348897 - RNA, 22 nt, Homo sapiens
ugugaaugaagaaugcuaaccu

SEQ ID NO: 348898 - RNA, 22 nt, Homo sapiens
ugugaauggugcuuccuagaug

SEQ ID NO: 348899 - RNA, 22 nt, Homo sapiens
ugugaauguaaccuuauuugga

SEQ ID NO: 348900 - RNA, 17 nt, Homo sapiens
ugugacccugggcuacc

SEQ ID NO: 348901 - RNA, 22 nt, Homo sapiens
ugugagaucucagaauugaacu

SEQ ID NO: 348902 - RNA, 22 nt, Homo sapiens
ugugagcuauggaguuguagag

SEQ ID NO: 348903 - RNA, 19 nt, Homo sapiens
ugugauaguugaaccugcc

SEQ ID NO: 348904 - RNA, 22 nt, Homo sapiens
ugugauggaguuucauggacug

SEQ ID NO: 348905 - RNA, 22 nt, Homo sapiens
ugugauguggagggcagaucca

SEQ ID NO: 348906 - RNA, 22 nt, Homo sapiens
ugugauugauauauuuacagaa

SEQ ID NO: 348907 - RNA, 22 nt, Homo sapiens
ugugcaaauguuaaacuaacuu

SEQ ID NO: 348908 - RNA, 22 nt, Homo sapiens
ugugcacaaugugcagguuugu

SEQ ID NO: 348909 - RNA, 22 nt, Homo sapiens
ugugcacauaacauuuuuuuag

SEQ ID NO: 348910 - RNA, 22 nt, Homo sapiens
ugugccaaucauagggcuuggu

SEQ ID NO: 348911 - RNA, 22 nt, Homo sapiens
ugugccacugcacuccugccug

SEQ ID NO: 348912 - RNA, 22 nt, Homo sapiens
ugugcucaucucagucaacugu

SEQ ID NO: 348913 - RNA, 22 nt, Homo sapiens
ugugcugaucgggcacgguguc

SEQ ID NO: 348914 - RNA, 22 nt, Homo sapiens
ugugcuugcuucuucuccuagu

SEQ ID NO: 348915 - RNA, 22 nt, Homo sapiens
ugugcuuguaaaggccagagca

SEQ ID NO: 348916 - RNA, 22 nt, Homo sapiens
uguggaaauggugcuacgaaca

SEQ ID NO: 348917 - RNA, 22 nt, Homo sapiens
uguggcaaagucuugugaauau

SEQ ID NO: 348918 - RNA, 22 nt, Homo sapiens
uguggccuuuguuucaguuggg

SEQ ID NO: 348919 - RNA, 22 nt, Homo sapiens
ugugguagugcuuaccugcagu

SEQ ID NO: 348920 - RNA, 22 nt, Homo sapiens
ugugguauuagguguaguaucu

SEQ ID NO: 348921 - RNA, 22 nt, Homo sapiens
ugugguuuuucacauuuagaga

SEQ ID NO: 348922 - RNA, 22 nt, Homo sapiens
uguguacaucucuacacacaug

SEQ ID NO: 348923 - RNA, 22 nt, Homo sapiens
ugugucacugaggguuagugua

SEQ ID NO: 348924 - RNA, 22 nt, Homo sapiens
ugugucacugcacuccagcgug

SEQ ID NO: 348925 - RNA, 22 nt, Homo sapiens
ugugucuuuuaucacacaaugu

SEQ ID NO: 348926 - RNA, 22 nt, Homo sapiens
uguuaaggcagagauaauacau

SEQ ID NO: 348927 - RNA, 22 nt, Homo sapiens
uguuacagcagaauugauugca

SEQ ID NO: 348928 - RNA, 22 nt, Homo sapiens
uguuauuuuguguuagggcaca

SEQ ID NO: 348929 - RNA, 22 nt, Homo sapiens
uguucuugagccuuuagaccua

SEQ ID NO: 348930 - RNA, 22 nt, Homo sapiens
uguugcacugguaauguacuga

SEQ ID NO: 348931 - RNA, 22 nt, Homo sapiens
uguugcauuugucaaggucaag

SEQ ID NO: 348932 - RNA, 22 nt, Homo sapiens
uguuugcuguguggaguagcag

SEQ ID NO: 348933 - RNA, 21 nt, Homo sapiens
uguuuuugcuguguaucucuc

SEQ ID NO: 348934 - RNA, 22 nt, Homo sapiens
uuaaaguaauugaaauggccuu

SEQ ID NO: 348935 - RNA, 22 nt, Homo sapiens
uuaaaguguuuucaaaauguca

SEQ ID NO: 348936 - RNA, 22 nt, Homo sapiens
uuaaaugcacauacuugagaaa

SEQ ID NO: 348937 - RNA, 22 nt, Homo sapiens
uuaacacugccauugauacugu

SEQ ID NO: 348938 - RNA, 22 nt, Homo sapiens
uuaacagcacuacguggggauc

SEQ ID NO: 348939 - RNA, 22 nt, Homo sapiens
uuaacagucacuuagcucauuu

SEQ ID NO: 348940 - RNA, 22 nt, Homo sapiens
uuaacaguuaauucuuuggcaa

SEQ ID NO: 348941 - RNA, 22 nt, Homo sapiens
uuaagcaguaguuaaggagagg

SEQ ID NO: 348942 - RNA, 22 nt, Homo sapiens
uuaaggaaagcauuuaauucag

SEQ ID NO: 348943 - RNA, 22 nt, Homo sapiens
uuaaggcagugucuaugccagu

SEQ ID NO: 348944 - RNA, 22 nt, Homo sapiens
uuaaggcauucuuugucuucau

SEQ ID NO: 348945 - RNA, 22 nt, Homo sapiens
uuaagguaugugggcauuuugu

SEQ ID NO: 348946 - RNA, 23 nt, Homo sapiens
uuaaggugaugucuuugugccuc

SEQ ID NO: 348947 - RNA, 21 nt, Homo sapiens
uuaaguaauuacccaacucuc

SEQ ID NO: 348948 - RNA, 19 nt, Homo sapiens
uuaaguaguuagagggucu

SEQ ID NO: 348949 - RNA, 22 nt, Homo sapiens
uuaaucuguucucuguauucua

SEQ ID NO: 348950 - RNA, 22 nt, Homo sapiens
uuaauuguaucuauagauguca

SEQ ID NO: 348951 - RNA, 22 nt, Homo sapiens
uuaauuguccaaguucaucucu

SEQ ID NO: 348952 - RNA, 22 nt, Homo sapiens
uuacacaguaggucccuaguaa

SEQ ID NO: 348953 - RNA, 22 nt, Homo sapiens
uuacagguggagaaguaaggcu

SEQ ID NO: 348954 - RNA, 22 nt, Homo sapiens
uuagaacagugcucaccacaaa

SEQ ID NO: 348955 - RNA, 22 nt, Homo sapiens
uuagaucaacauggaacucuau

SEQ ID NO: 348956 - RNA, 22 nt, Homo sapiens
uuagauuauugguguuuugcaa

SEQ ID NO: 348957 - RNA, 22 nt, Homo sapiens
uuagcacauuuccagcacaugg

SEQ ID NO: 348958 - RNA, 22 nt, Homo sapiens
uuagcacugagaauggcuugcu

SEQ ID NO: 348959 - RNA, 22 nt, Homo sapiens
uuagcagcaucccuggccugua

SEQ ID NO: 348960 - RNA, 22 nt, Homo sapiens
uuguauguuguuugucagagaa

SEQ ID NO: 348961 - RNA, 22 nt, Homo sapiens
uuguauguuucugugcacauga

SEQ ID NO: 348962 - RNA, 22 nt, Homo sapiens
uuguauguuuguucuuucagau

SEQ ID NO: 348963 - RNA, 22 nt, Homo sapiens
uugucaaugggugagugcagag

SEQ ID NO: 348964 - RNA, 22 nt, Homo sapiens
uugucauggucuugauccauua

SEQ ID NO: 348965 - RNA, 22 nt, Homo sapiens
uuguccacugcuagccucugca

SEQ ID NO: 348966 - RNA, 22 nt, Homo sapiens
uuguccuccacauuugaucagu

SEQ ID NO: 348967 - RNA, 22 nt, Homo sapiens
uuguccuggagguucuugcaag

SEQ ID NO: 348968 - RNA, 22 nt, Homo sapiens
uuguccuugagauaguuugcag

SEQ ID NO: 348969 - RNA, 22 nt, Homo sapiens
uuguccuugagauaguuugcug

SEQ ID NO: 348970 - RNA, 22 nt, Homo sapiens
uugugaaaaaccucucguggaa

SEQ ID NO: 348971 - RNA, 22 nt, Homo sapiens
uugugaaaucuaggcagagguu

SEQ ID NO: 348972 - RNA, 22 nt, Homo sapiens
uugugaaugaugucgcaauaaa

SEQ ID NO: 348973 - RNA, 22 nt, Homo sapiens
uugugaauggugcugcaguaaa

SEQ ID NO: 348974 - RNA, 22 nt, Homo sapiens
uugugacacagcugggccuaua

SEQ ID NO: 348975 - RNA, 22 nt, Homo sapiens
uugugaucauugucaaauagug

SEQ ID NO: 348976 - RNA, 22 nt, Homo sapiens
uugugauggugcauacugagcu

SEQ ID NO: 348977 - RNA, 22 nt, Homo sapiens
uugugcaaaaguaauugcgguu

SEQ ID NO: 348978 - RNA, 20 nt, Homo sapiens
uugugcauugggccauuggg

SEQ ID NO: 348979 - RNA, 22 nt, Homo sapiens
uugugcuuaauaaaaaguggua

SEQ ID NO: 348980 - RNA, 22 nt, Homo sapiens
uugugcuuaaugaguguaaggu

SEQ ID NO: 348981 - RNA, 22 nt, Homo sapiens
uugugcuuuuuaaauagcuucc

SEQ ID NO: 348982 - RNA, 22 nt, Homo sapiens
uugugguuuuagcacuguggau

SEQ ID NO: 348983 - RNA, 22 nt, Homo sapiens
uuguguccccacccaaaucuca

SEQ ID NO: 348984 - RNA, 22 nt, Homo sapiens
uugugucccuacccaaaucuca

SEQ ID NO: 348985 - RNA, 22 nt, Homo sapiens
uuguuaugggguggcuugaaag

SEQ ID NO: 348986 - RNA, 22 nt, Homo sapiens
uuguuauguaucucaagauaaa

SEQ ID NO: 348987 - RNA, 22 nt, Homo sapiens
uuguuuuggagaugagcuaaaa

SEQ ID NO: 348988 - RNA, 22 nt, Homo sapiens
uuuaaugcacuaggugguguuc

SEQ ID NO: 348989 - RNA, 22 nt, Homo sapiens
uuuacagucucauagguggaag

SEQ ID NO: 348990 - RNA, 22 nt, Homo sapiens
uuuagguagucaaagguuaguc

SEQ ID NO: 348991 - RNA, 22 nt, Homo sapiens
uuuauagucaggaacuugagga

SEQ ID NO: 348992 - RNA, 22 nt, Homo sapiens
uuuaucaggccuuuggaaaaau

SEQ ID NO: 348993 - RNA, 22 nt, Homo sapiens
uuuauguggagcacuugacaca

SEQ ID NO: 348994 - RNA, 19 nt, Homo sapiens
uuucaauguaaggauggag

SEQ ID NO: 348995 - RNA, 22 nt, Homo sapiens
uuucacagcaauugccuauugu

SEQ ID NO: 348996 - RNA, 22 nt, Homo sapiens
uuucacaguguucucccccaga

SEQ ID NO: 348997 - RNA, 22 nt, Homo sapiens
uuucaggcaagggugacccuga

SEQ ID NO: 348998 - RNA, 22 nt, Homo sapiens
uuuccacauggacuuaccuucg

SEQ ID NO: 348999 - RNA, 22 nt, Homo sapiens
uuucccugaaggcucugaaguc

SEQ ID NO: 349000 - RNA, 22 nt, Homo sapiens
uuuccuggagaaucuuaacaaa

SEQ ID NO: 349001 - RNA, 22 nt, Homo sapiens
uuuccuguagggggcaaggccu

SEQ ID NO: 349002 - RNA, 22 nt, Homo sapiens
uuucugugguccucuugaaggu

SEQ ID NO: 349003 - RNA, 22 nt, Homo sapiens
uuugaaguguggcacugaguuu

SEQ ID NO: 349004 - RNA, 22 nt, Homo sapiens
uuugaauggaaguuuugugaaa

SEQ ID NO: 349005 - RNA, 22 nt, Homo sapiens
uuugacuguggagucgaugcuu

SEQ ID NO: 349006 - RNA, 22 nt, Homo sapiens
uuugagcuagagucucacucug

SEQ ID NO: 349007 - RNA, 22 nt, Homo sapiens
uuugcacuggagauucaauggg

SEQ ID NO: 349008 - RNA, 23 nt, Homo sapiens
uuugcacuugcuccuucuauggc

SEQ ID NO: 349009 - RNA, 20 nt, Homo sapiens
uuugcagaaucuaagaagag

SEQ ID NO: 349010 - RNA, 22 nt, Homo sapiens
uuugcagagacuuguuaggaau

SEQ ID NO: 349011 - RNA, 22 nt, Homo sapiens
uuugcagagucuuucgcugggc

SEQ ID NO: 349012 - RNA, 22 nt, Homo sapiens
uuugccaaucagaggcaucuug

SEQ ID NO: 349013 - RNA, 22 nt, Homo sapiens
uuuggaaugaaacagcagagcc

SEQ ID NO: 349014 - RNA, 22 nt, Homo sapiens
uuuggaaugugcacucagauug

SEQ ID NO: 349015 - RNA, 20 nt, Homo sapiens
uuuggcaauaggguuuuugu

SEQ ID NO: 349016 - RNA, 22 nt, Homo sapiens
uuuggcauuugaguuuguagga

SEQ ID NO: 349017 - RNA, 22 nt, Homo sapiens
uuuggucuuuuauuuaaagcag

SEQ ID NO: 349018 - RNA, 22 nt, Homo sapiens
uuuguaauccuauuccaaagga

SEQ ID NO: 349019 - RNA, 22 nt, Homo sapiens
uuuguacacgugggugaauugu

SEQ ID NO: 349020 - RNA, 22 nt, Homo sapiens
uuuguacacuguuggugguuau

SEQ ID NO: 349021 - RNA, 20 nt, Homo sapiens
uuuguaucucuggguacugg

SEQ ID NO: 349022 - RNA, 22 nt, Homo sapiens
uuugucauagcagcaggaaugg

SEQ ID NO: 349023 - RNA, 22 nt, Homo sapiens
uuugugacuugcuucucagaau

SEQ ID NO: 349024 - RNA, 22 nt, Homo sapiens
uuugugcuaaugcuagauuacu

SEQ ID NO: 349025 - RNA, 18 nt, Homo sapiens
uuugugcuccacaaagga

SEQ ID NO: 349026 - RNA, 22 nt, Homo sapiens
uuugugcuccugugagaaucua

SEQ ID NO: 349027 - RNA, 21 nt, Homo sapiens
uuuguguccccacccaaaucu

SEQ ID NO: 349028 - RNA, 22 nt, Homo sapiens
uuuguguccccacccacaucuc

SEQ ID NO: 349029 - RNA, 22 nt, Homo sapiens
uuuuacagaggagguugcugau

SEQ ID NO: 349030 - RNA, 22 nt, Homo sapiens
uuuuagcuuuucccaggacucc

SEQ ID NO: 349031 - RNA, 22 nt, Homo sapiens
uuuuaguugcucagguauucuc

SEQ ID NO: 349032 - RNA, 22 nt, Homo sapiens
uuuuccagugggacucccauua

SEQ ID NO: 349033 - RNA, 22 nt, Homo sapiens
uuuugcacuagaaccagagguu

SEQ ID NO: 349034 - RNA, 20 nt, Homo sapiens
uuuugcacuccuacuaaggu

SEQ ID NO: 349035 - RNA, 22 nt, Homo sapiens
uuuugcaggucaggggcagaga

SEQ ID NO: 349036 - RNA, 22 nt, Homo sapiens
uuuugcucuugguaaugaaaga

SEQ ID NO: 349037 - RNA, 22 nt, Homo sapiens
uuuugcuugugaauagccacau

SEQ ID NO: 349038 - RNA, 22 nt, Homo sapiens
uuuuggcuuaaagagaauguau

SEQ ID NO: 349039 - RNA, 22 nt, Homo sapiens
uuuugggggugauucacacagu

SEQ ID NO: 349040 - RNA, 22 nt, Homo sapiens
uuuuugaguagcuggagagcag

SEQ ID NO: 349041 - RNA, 22 nt, Homo sapiens
gcacagaugaggagaggucuca

SEQ ID NO: 349042 - RNA, 22 nt, Homo sapiens
gcacagucaacacuuauucacc

SEQ ID NO: 349043 - RNA, 22 nt, Homo sapiens
gcacaguuaaagggucauguga

SEQ ID NO: 349044 - RNA, 22 nt, Homo sapiens
gcaccaugguagaauaauggua

SEQ ID NO: 349045 - RNA, 22 nt, Homo sapiens
gcagcagugcccuggauggaaa

SEQ ID NO: 349046 - RNA, 22 nt, Homo sapiens
gcagcauuaccaagacauggca

SEQ ID NO: 349047 - RNA, 22 nt, Homo sapiens
gcaggcaugacauuucacucuu

SEQ ID NO: 349048 - RNA, 22 nt, Homo sapiens
gcaguggugugugccagccuag

SEQ ID NO: 349049 - RNA, 22 nt, Homo sapiens
gcaguguucaaaucaugcccau

SEQ ID NO: 349050 - RNA, 22 nt, Homo sapiens
gcaguguucugggcaggaagaa

SEQ ID NO: 349051 - RNA, 20 nt, Homo sapiens
gcauaugucuuuauagcaga

SEQ ID NO: 349052 - RNA, 22 nt, Homo sapiens
gcaugacaaugauugcucuuca

SEQ ID NO: 349053 - RNA, 22 nt, Homo sapiens
gcauggagcauacauuucuguu

SEQ ID NO: 349054 - RNA, 22 nt, Homo sapiens
gcauguaguagauguugaauaa

SEQ ID NO: 349055 - RNA, 22 nt, Homo sapiens
gcaugugaauguguaagaaaau

SEQ ID NO: 349056 - RNA, 22 nt, Homo sapiens
gccaagaucugaauaauuaaga

SEQ ID NO: 349057 - RNA, 22 nt, Homo sapiens
gugaccucuguugcugucacua

SEQ ID NO: 349058 - RNA, 22 nt, Homo sapiens
gugacugggaguggugaagaua

SEQ ID NO: 349059 - RNA, 22 nt, Homo sapiens
gugagaauauuuuaaauacuaa

SEQ ID NO: 349060 - RNA, 22 nt, Homo sapiens
gugagauacuagagauauagug

SEQ ID NO: 349061 - RNA, 22 nt, Homo sapiens
gugagcauaacaacagaguuua

SEQ ID NO: 349062 - RNA, 22 nt, Homo sapiens
gugagcuaguuucuuugcugug

SEQ ID NO: 349063 - RNA, 21 nt, Homo sapiens
gugaggaguuacuggcuuuga

SEQ ID NO: 349064 - RNA, 22 nt, Homo sapiens
gugagguagagcaugugaaaga

SEQ ID NO: 349065 - RNA, 22 nt, Homo sapiens
gugaggugguacaauauuaacu

SEQ ID NO: 349066 - RNA, 21 nt, Homo sapiens
gugaucaugucacugcacucc

SEQ ID NO: 349067 - RNA, 22 nt, Homo sapiens
gugaucauuguauugggguuau

SEQ ID NO: 349068 - RNA, 22 nt, Homo sapiens
gugaugcaguacguagaggaga

SEQ ID NO: 349069 - RNA, 22 nt, Homo sapiens
gugcaacaugccuggcuaauuu

SEQ ID NO: 349070 - RNA, 22 nt, Homo sapiens
gugcaaugaguguggcaaagcc

SEQ ID NO: 349071 - RNA, 22 nt, Homo sapiens
gugcaaugucaggagaugcagc

SEQ ID NO: 349072 - RNA, 22 nt, Homo sapiens
gugcacaacgugcaggcuuguu

SEQ ID NO: 349073 - RNA, 22 nt, Homo sapiens
gugcacaacgugcagguuuguu

SEQ ID NO: 349074 - RNA, 22 nt, Homo sapiens
gugcacaaugugcagguuuguu

SEQ ID NO: 349075 - RNA, 22 nt, Homo sapiens
gugcacauauggugcauaagug

SEQ ID NO: 349076 - RNA, 23 nt, Homo sapiens
gugcaguggcgagauuucggcuc

SEQ ID NO: 349077 - RNA, 18 nt, Homo sapiens
gugcauagccauggcagc

SEQ ID NO: 349078 - RNA, 22 nt, Homo sapiens
gugccacugcaccuggccuaag

SEQ ID NO: 349079 - RNA, 23 nt, Homo sapiens
gugccuucugagccuagucucca

SEQ ID NO: 349080 - RNA, 22 nt, Homo sapiens
gugcucauuuagagagaagcac

SEQ ID NO: 349081 - RNA, 22 nt, Homo sapiens
guggaagaccagacuuuccaac

SEQ ID NO: 349082 - RNA, 22 nt, Homo sapiens
guggaagugucuggggccaggg

SEQ ID NO: 349083 - RNA, 22 nt, Homo sapiens
guggaaucuagagaggcaguag

SEQ ID NO: 349084 - RNA, 22 nt, Homo sapiens
guggaaugauaucucauugugg

SEQ ID NO: 349085 - RNA, 22 nt, Homo sapiens
guggacagagacuaaauguugu

SEQ ID NO: 349086 - RNA, 22 nt, Homo sapiens
guggagacaaaggcugagugag

SEQ ID NO: 349087 - RNA, 22 nt, Homo sapiens
caucagcaauguaugaggguuc

SEQ ID NO: 349088 - RNA, 22 nt, Homo sapiens
caucucauugaauugcugagca

SEQ ID NO: 349089 - RNA, 22 nt, Homo sapiens
caugaacacugugcggcuuccu

SEQ ID NO: 349090 - RNA, 23 nt, Homo sapiens
caugaacuaguuugcagccauga

SEQ ID NO: 349091 - RNA, 22 nt, Homo sapiens
caugcacugaguccaccucugg

SEQ ID NO: 349092 - RNA, 22 nt, Homo sapiens
caugccacugcacuccaaccug

SEQ ID NO: 349093 - RNA, 22 nt, Homo sapiens
caugccauugcucuccugggug

SEQ ID NO: 349094 - RNA, 22 nt, Homo sapiens
cauggagcuaggcuugaucccu

SEQ ID NO: 349095 - RNA, 22 nt, Homo sapiens
cauggcacaucuuuucugacua

SEQ ID NO: 349096 - RNA, 22 nt, Homo sapiens
cauggcacugagcagguaugca

SEQ ID NO: 349097 - RNA, 22 nt, Homo sapiens
cauggccuuuggaaugugucua

SEQ ID NO: 349098 - RNA, 22 nt, Homo sapiens
cauggcucuuguuuacucccag

SEQ ID NO: 349099 - RNA, 23 nt, Homo sapiens
cauggcuguuaacacuguuugag

SEQ ID NO: 349100 - RNA, 22 nt, Homo sapiens
cauggcuuucacaguaaagccu

SEQ ID NO: 349101 - RNA, 22 nt, Homo sapiens
caugggacugucuuggcuauac

SEQ ID NO: 349102 - RNA, 22 nt, Homo sapiens
cauuacacuuguaagguuuuuc

SEQ ID NO: 349103 - RNA, 22 nt, Homo sapiens
cauugcacacauuuaccuaugu

SEQ ID NO: 349104 - RNA, 22 nt, Homo sapiens
cauugcacuccacuccugaaca

SEQ ID NO: 349105 - RNA, 22 nt, Homo sapiens
cauugcacuccagccuagccaa

SEQ ID NO: 349106 - RNA, 20 nt, Homo sapiens
cauugcacuccagcuugggc

SEQ ID NO: 349107 - RNA, 22 nt, Homo sapiens
cauugcacuccauccuuggcaa

SEQ ID NO: 349108 - RNA, 22 nt, Homo sapiens
cauugcacuccaucuugggcaa

SEQ ID NO: 349109 - RNA, 22 nt, Homo sapiens
cauugcacugcuucuugggugu

SEQ ID NO: 349110 - RNA, 22 nt, Homo sapiens
cauugcacuuagacaacuuuug

SEQ ID NO: 349111 - RNA, 22 nt, Homo sapiens
cauugcaguaagagugggcucu

SEQ ID NO: 349112 - RNA, 22 nt, Homo sapiens
cauuguacauaaguauggagua

SEQ ID NO: 349113 - RNA, 22 nt, Homo sapiens
cauuugcacugagacucagcuu

SEQ ID NO: 349114 - RNA, 22 nt, Homo sapiens
cauuugguggcuacagaguaac

SEQ ID NO: 349115 - RNA, 22 nt, Homo sapiens
cauuuuacuuuccagacgugga

SEQ ID NO: 349116 - RNA, 22 nt, Homo sapiens
cauuuugguuaaauagguagcu

SEQ ID NO: 349117 - RNA, 19 nt, Homo sapiens
ccacaaugguugaacuaga

SEQ ID NO: 349118 - RNA, 22 nt, Homo sapiens
ccacacugucuuggugggaaac

SEQ ID NO: 349119 - RNA, 22 nt, Homo sapiens
ccacagucuaugcaacaagguc

SEQ ID NO: 349120 - RNA, 22 nt, Homo sapiens
ccacaguggauuaaaguuacug

SEQ ID NO: 349121 - RNA, 22 nt, Homo sapiens
ccacauuaccuugcuugcucca

SEQ ID NO: 349122 - RNA, 22 nt, Homo sapiens
ccacauuggaaaggaucccccc

SEQ ID NO: 349123 - RNA, 22 nt, Homo sapiens
ccagaguggagccuuugcgagg

SEQ ID NO: 349124 - RNA, 22 nt, Homo sapiens
ccagaguuucugauucagcagg

SEQ ID NO: 349125 - RNA, 22 nt, Homo sapiens
ccagauguuuucauucagcaag

SEQ ID NO: 349126 - RNA, 22 nt, Homo sapiens
ccagcaccauuuauuaaauagg

SEQ ID NO: 349127 - RNA, 22 nt, Homo sapiens
ccaggguugagacccacugacu

SEQ ID NO: 349128 - RNA, 23 nt, Homo sapiens
ccaguauuuauguaaggaagugu

SEQ ID NO: 349129 - RNA, 22 nt, Homo sapiens
ccagugauuguauggugaaggu

SEQ ID NO: 349130 - RNA, 20 nt, Homo sapiens
ccaguguuauuuauguucua

SEQ ID NO: 349131 - RNA, 19 nt, Homo sapiens
ccaguguucugauugcacu

SEQ ID NO: 349132 - RNA, 22 nt, Homo sapiens
ccaguguucuggaaggcugagu

SEQ ID NO: 349133 - RNA, 22 nt, Homo sapiens
ccaguucaaugauauggaaacu

SEQ ID NO: 349134 - RNA, 19 nt, Homo sapiens
ccauggcaaugaucugaug

SEQ ID NO: 349135 - RNA, 22 nt, Homo sapiens
ccauggcuauucuguaaggguu

SEQ ID NO: 349136 - RNA, 22 nt, Homo sapiens
ccauugcacuccagccuaggca

SEQ ID NO: 349137 - RNA, 22 nt, Homo sapiens
cccagugugaacuuggcauuuu

SEQ ID NO: 349138 - RNA, 22 nt, Homo sapiens
cccaguguuacgugacagccug

SEQ ID NO: 349139 - RNA, 22 nt, Homo sapiens
cccauuguuaaguugaguaucu

SEQ ID NO: 349140 - RNA, 17 nt, Homo sapiens
ccccugagcgaugcagu

SEQ ID NO: 349141 - RNA, 22 nt, Homo sapiens
cccgugucuuggucuagggccu

SEQ ID NO: 349142 - RNA, 17 nt, Homo sapiens
cccuaguagcugggacu

SEQ ID NO: 349143 - RNA, 23 nt, Homo sapiens
cccucagaagugcagggagagaa

SEQ ID NO: 349144 - RNA, 22 nt, Homo sapiens
cccugagaugcuguuaaucugu

SEQ ID NO: 349145 - RNA, 21 nt, Homo sapiens
cccugguguuuggaguuugag

SEQ ID NO: 349146 - RNA, 22 nt, Homo sapiens
ccucaguguuuaucauuauuuu

SEQ ID NO: 349147 - RNA, 22 nt, Homo sapiens
ccucauggagaacaucugcuag

SEQ ID NO: 349148 - RNA, 22 nt, Homo sapiens
ccucauggagaaccucugcuag

SEQ ID NO: 349149 - RNA, 22 nt, Homo sapiens
ccucauggagaacuucugcuag

SEQ ID NO: 349150 - RNA, 21 nt, Homo sapiens
ccuccauuuguauucuugccc

SEQ ID NO: 349151 - RNA, 22 nt, Homo sapiens
ccuccauuugugucaggaaguc

SEQ ID NO: 349152 - RNA, 21 nt, Homo sapiens
ccucuuugagggaagaaaggg

SEQ ID NO: 349153 - RNA, 22 nt, Homo sapiens
ccugagacugauugacucacaa

SEQ ID NO: 349154 - RNA, 22 nt, Homo sapiens
ccugcauugucaaggccaagcc

SEQ ID NO: 349155 - RNA, 22 nt, Homo sapiens
ccuggcaagagacugaagauag

SEQ ID NO: 349156 - RNA, 22 nt, Homo sapiens
ccugucuugaagagauccuccu

SEQ ID NO: 349157 - RNA, 22 nt, Homo sapiens
ccuucuuuuguaaggcugaaua

SEQ ID NO: 349158 - RNA, 22 nt, Homo sapiens
ccuuggcacuacugacauugua

SEQ ID NO: 349159 - RNA, 16 nt, Homo sapiens
cuaaaaugucuacuug

SEQ ID NO: 349160 - RNA, 22 nt, Homo sapiens
cuaaaguagccaggacugcagg

SEQ ID NO: 349161 - RNA, 22 nt, Homo sapiens
cuaaaguauugagugguaaaga

SEQ ID NO: 349162 - RNA, 22 nt, Homo sapiens
cuaaggaaggacugaaaggaca

SEQ ID NO: 349163 - RNA, 22 nt, Homo sapiens
cuagaggcacagccuaggcacu

SEQ ID NO: 349164 - RNA, 22 nt, Homo sapiens
cuagcccagugcuccuggauca

SEQ ID NO: 349165 - RNA, 22 nt, Homo sapiens
cuagccuggagugcaguggugc

SEQ ID NO: 349166 - RNA, 22 nt, Homo sapiens
cuagcuuuuuaugacaaucuug

SEQ ID NO: 349167 - RNA, 22 nt, Homo sapiens
cuagguucucaaaccagcguca

SEQ ID NO: 349168 - RNA, 22 nt, Homo sapiens
cuauaacagugugguuuggaga

SEQ ID NO: 349169 - RNA, 22 nt, Homo sapiens
cuauggcagccacggccuggag

SEQ ID NO: 349170 - RNA, 22 nt, Homo sapiens
cuauggcuguagucccugugua

SEQ ID NO: 349171 - RNA, 22 nt, Homo sapiens
cuauggugauagaaaucagaau

SEQ ID NO: 349172 - RNA, 22 nt, Homo sapiens
cuauuacuuuuauugaacucag

SEQ ID NO: 349173 - RNA, 22 nt, Homo sapiens
cucaaagugcugggauuggcca

SEQ ID NO: 349174 - RNA, 22 nt, Homo sapiens
cucaaguagugguuuucauuga

SEQ ID NO: 349175 - RNA, 22 nt, Homo sapiens
cucaauuuggaauugucaguaa

SEQ ID NO: 349176 - RNA, 20 nt, Homo sapiens
cucacagacagcuucuuucu

SEQ ID NO: 349177 - RNA, 22 nt, Homo sapiens
cucacugucaacauguauuugg

SEQ ID NO: 349178 - RNA, 22 nt, Homo sapiens
cucagaguacuuuucccacuuc

SEQ ID NO: 349179 - RNA, 22 nt, Homo sapiens
cucagcuacuugagaggcuuag

SEQ ID NO: 349180 - RNA, 22 nt, Homo sapiens
cucaggcacucugauuccagug

SEQ ID NO: 349181 - RNA, 22 nt, Homo sapiens
cucaguagaaaauacauggacu

SEQ ID NO: 349182 - RNA, 22 nt, Homo sapiens
cuuucucagugagacccgagau

SEQ ID NO: 349183 - RNA, 22 nt, Homo sapiens
cuuucugaggagaauagagaac

SEQ ID NO: 349184 - RNA, 22 nt, Homo sapiens
cuuugaugagaaaauacuuugu

SEQ ID NO: 349185 - RNA, 22 nt, Homo sapiens
cuuugcaaauggccuuuccaag

SEQ ID NO: 349186 - RNA, 22 nt, Homo sapiens
cuuuggcaaugucauuuucaau

SEQ ID NO: 349187 - RNA, 22 nt, Homo sapiens
cuuuggguauucucccuugggg

SEQ ID NO: 349188 - RNA, 19 nt, Homo sapiens
cuuugguugagcguguugg

SEQ ID NO: 349189 - RNA, 22 nt, Homo sapiens
cuuuguguggacauuucaggca

SEQ ID NO: 349190 - RNA, 22 nt, Homo sapiens
cuuugugugggccaagggcugg

SEQ ID NO: 349191 - RNA, 22 nt, Homo sapiens
cuuuuacacugcuggugggaau

SEQ ID NO: 349192 - RNA, 22 nt, Homo sapiens
cuuuuacacuguuggugggaau

SEQ ID NO: 349193 - RNA, 22 nt, Homo sapiens
gaaaauccauccccagggagua

SEQ ID NO: 349194 - RNA, 20 nt, Homo sapiens
gaaacaucuauccucuccuu

SEQ ID NO: 349195 - RNA, 22 nt, Homo sapiens
gaaagugcugcuugacugggau

SEQ ID NO: 349196 - RNA, 22 nt, Homo sapiens
gaaaucucuacuauuuugaucu

SEQ ID NO: 349197 - RNA, 23 nt, Homo sapiens
gaaaugucuuagugaaauugcuu

SEQ ID NO: 349198 - RNA, 22 nt, Homo sapiens
gaacacaucuuugguuagagga

SEQ ID NO: 349199 - RNA, 18 nt, Homo sapiens
gaagaaguaggcauggca

SEQ ID NO: 349200 - RNA, 22 nt, Homo sapiens
gaagaucacacuguagaucuau

SEQ ID NO: 349201 - RNA, 22 nt, Homo sapiens
gaaggcaugcugcauggccaga

SEQ ID NO: 349202 - RNA, 22 nt, Homo sapiens
gaagguauauucuguuaaugcu

SEQ ID NO: 349203 - RNA, 22 nt, Homo sapiens
gaauagugcugcgauaaacaua

SEQ ID NO: 349204 - RNA, 22 nt, Homo sapiens
gaaugugcuguuggcugggcgu

SEQ ID NO: 349205 - RNA, 22 nt, Homo sapiens
gacaagagaacacugcuauauu

SEQ ID NO: 349206 - RNA, 22 nt, Homo sapiens
gacaccauuucaguacuagguu

SEQ ID NO: 349207 - RNA, 22 nt, Homo sapiens
gacagugagaugucaugugaaa

SEQ ID NO: 349208 - RNA, 22 nt, Homo sapiens
gacaguuuggugaggaagacga

SEQ ID NO: 349209 - RNA, 20 nt, Homo sapiens
gacauagagacucucaaaaa

SEQ ID NO: 349210 - RNA, 22 nt, Homo sapiens
gacauagagccuugacuucauu

SEQ ID NO: 349211 - RNA, 22 nt, Homo sapiens
gaccacagacuggaaagagggc

SEQ ID NO: 349212 - RNA, 22 nt, Homo sapiens
gaccacauuccacacaggcuuu

SEQ ID NO: 349213 - RNA, 22 nt, Homo sapiens
gacccucuagagggaagcgcuu

SEQ ID NO: 349214 - RNA, 22 nt, Homo sapiens
gacucagaacuaaggguguuuc

SEQ ID NO: 349215 - RNA, 19 nt, Homo sapiens
gacuccagaguugugugcu

SEQ ID NO: 349216 - RNA, 18 nt, Homo sapiens
gacuccauuucagccaga

SEQ ID NO: 349217 - RNA, 22 nt, Homo sapiens
gacuggagcuguaugugguuac

SEQ ID NO: 349218 - RNA, 22 nt, Homo sapiens
gagaacagaagcauuccuaauu

SEQ ID NO: 349219 - RNA, 21 nt, Homo sapiens
gagaaucaucauggcugcaua

SEQ ID NO: 349220 - RNA, 22 nt, Homo sapiens
gagaaugagaggggaaggccac

SEQ ID NO: 349221 - RNA, 22 nt, Homo sapiens
gagacggagucacgcccuguca

SEQ ID NO: 349222 - RNA, 22 nt, Homo sapiens
gagacugagucuugcucugucg

SEQ ID NO: 349223 - RNA, 22 nt, Homo sapiens
gagacugaguuuugcucuuguu

SEQ ID NO: 349224 - RNA, 22 nt, Homo sapiens
gagagugugucagaggcugcga

SEQ ID NO: 349225 - RNA, 22 nt, Homo sapiens
gagauacacccagugcagaggc

SEQ ID NO: 349226 - RNA, 22 nt, Homo sapiens
gagauaguguggguacagcuau

SEQ ID NO: 349227 - RNA, 22 nt, Homo sapiens
gagauauucugguuuacuaaau

SEQ ID NO: 349228 - RNA, 22 nt, Homo sapiens
gagauauuuagaaauguguucu

SEQ ID NO: 349229 - RNA, 22 nt, Homo sapiens
gagaucaaguauucuccacuaa

SEQ ID NO: 349230 - RNA, 22 nt, Homo sapiens
gagaucacuguuuauauucucu

SEQ ID NO: 349231 - RNA, 22 nt, Homo sapiens
gagaucaugcugguucucucau

SEQ ID NO: 349232 - RNA, 22 nt, Homo sapiens
gagaucuuggccaaguuucuua

SEQ ID NO: 349233 - RNA, 22 nt, Homo sapiens
gagaugaaaucuugcucuguca

SEQ ID NO: 349234 - RNA, 22 nt, Homo sapiens
gagaugcaccuugucacguuuc

SEQ ID NO: 349235 - RNA, 20 nt, Homo sapiens
gagauguugaucagggcuau

SEQ ID NO: 349236 - RNA, 22 nt, Homo sapiens
gagccuguaggaggagaggugg

SEQ ID NO: 349237 - RNA, 22 nt, Homo sapiens
gagcuacacugauucauuuguu

SEQ ID NO: 349238 - RNA, 22 nt, Homo sapiens
gagcuagggucaugcuacugca

SEQ ID NO: 349239 - RNA, 22 nt, Homo sapiens
gagcucauuaaaguaggaccua

SEQ ID NO: 349240 - RNA, 22 nt, Homo sapiens
gagcucauuguugcuaaagaga

SEQ ID NO: 349241 - RNA, 22 nt, Homo sapiens
gagcugaaguuuccauuuguac

SEQ ID NO: 349242 - RNA, 22 nt, Homo sapiens
gagcugguccuuuaaggaugca

SEQ ID NO: 349243 - RNA, 22 nt, Homo sapiens
gaggaaguuuacaaagcaucug

SEQ ID NO: 349244 - RNA, 22 nt, Homo sapiens
gaggcaaguggccaccgagucu

SEQ ID NO: 349245 - RNA, 22 nt, Homo sapiens
gagguaagaaagucaguccuuc

SEQ ID NO: 349246 - RNA, 22 nt, Homo sapiens
gagguaagagaauaaacaguuu

SEQ ID NO: 349247 - RNA, 22 nt, Homo sapiens
gagguaaguggauuaugagguc

SEQ ID NO: 349248 - RNA, 22 nt, Homo sapiens
gagguaugugggcagacauuua

SEQ ID NO: 349249 - RNA, 22 nt, Homo sapiens
gaggucaggacauuuuugcuuu

SEQ ID NO: 349250 - RNA, 22 nt, Homo sapiens
gaggugguagguucacagcagc

SEQ ID NO: 349251 - RNA, 22 nt, Homo sapiens
gagucagugucuugcucuguca

SEQ ID NO: 349252 - RNA, 22 nt, Homo sapiens
gagugguaguuucuagaggugu

SEQ ID NO: 349253 - RNA, 22 nt, Homo sapiens
gaguugagagaguuguuauuuc

SEQ ID NO: 349254 - RNA, 22 nt, Homo sapiens
gauaaaucuuggcuagucuaag

SEQ ID NO: 349255 - RNA, 22 nt, Homo sapiens
gauauguacagcucucuaggau

SEQ ID NO: 349256 - RNA, 22 nt, Homo sapiens
gauauguguaucuauguacaug

SEQ ID NO: 349257 - RNA, 22 nt, Homo sapiens
gaucagagugaaccuuguuaug

SEQ ID NO: 349258 - RNA, 20 nt, Homo sapiens
gaucaguuuggaguaagugc

SEQ ID NO: 349259 - RNA, 22 nt, Homo sapiens
gaucauggaguuggguucaagg

SEQ ID NO: 349260 - RNA, 22 nt, Homo sapiens
gaucuggagguuuuccucauga

SEQ ID NO: 349261 - RNA, 22 nt, Homo sapiens
gaucugugugauuggaugcauu

SEQ ID NO: 349262 - RNA, 22 nt, Homo sapiens
gaucuguuucaauugucuuagu

SEQ ID NO: 349263 - RNA, 22 nt, Homo sapiens
gaugacagugaguaaccccaac

SEQ ID NO: 349264 - RNA, 22 nt, Homo sapiens
gaugagguagaagacucagcaa

SEQ ID NO: 349265 - RNA, 22 nt, Homo sapiens
gaugagguaguguaccuagucu

SEQ ID NO: 349266 - RNA, 22 nt, Homo sapiens
gaugaugcuagguguuagggcu

SEQ ID NO: 349267 - RNA, 22 nt, Homo sapiens
gaugauguugaauguucucacc

SEQ ID NO: 349268 - RNA, 22 nt, Homo sapiens
gauggcacuaagccauguagga

SEQ ID NO: 349269 - RNA, 22 nt, Homo sapiens
gauggcucugcaggugagggua

SEQ ID NO: 349270 - RNA, 22 nt, Homo sapiens
gauuagcacuucaguuacagua

SEQ ID NO: 349271 - RNA, 22 nt, Homo sapiens
gauuccacuuacuuagcauucc

SEQ ID NO: 349272 - RNA, 22 nt, Homo sapiens
gauuccacuuucugucucuaug

SEQ ID NO: 349273 - RNA, 22 nt, Homo sapiens
gcaaaucuuauguccucacauu

SEQ ID NO: 349274 - RNA, 22 nt, Homo sapiens
gcaaaugcuacaccauuuugua

SEQ ID NO: 349275 - RNA, 22 nt, Homo sapiens
gcaaaugcuaugccauuuuaua

SEQ ID NO: 349276 - RNA, 22 nt, Homo sapiens
gcaagaaucugggaguaaaauu

SEQ ID NO: 349277 - RNA, 22 nt, Homo sapiens
gcaagaauggaacaggagagcc

SEQ ID NO: 349278 - RNA, 21 nt, Homo sapiens
gcaaguacuaucaucauuauc

SEQ ID NO: 349279 - RNA, 22 nt, Homo sapiens
gcacaaugccugacgaguccug

SEQ ID NO: 349280 - RNA, 22 nt, Homo sapiens
uauaaccauuucuucucucuuc

SEQ ID NO: 349281 - RNA, 22 nt, Homo sapiens
uauacuguuuucuauaguggcu

SEQ ID NO: 349282 - RNA, 22 nt, Homo sapiens
uauagcaaugugccacucucug

SEQ ID NO: 349283 - RNA, 22 nt, Homo sapiens
uauagcacugagaauguaauuc

SEQ ID NO: 349284 - RNA, 22 nt, Homo sapiens
uauagcagugaguauugacuaa

SEQ ID NO: 349285 - RNA, 22 nt, Homo sapiens
uauagcuaugggauguauuugc

SEQ ID NO: 349286 - RNA, 22 nt, Homo sapiens
uauaugcaacauaguguaugug

SEQ ID NO: 349287 - RNA, 22 nt, Homo sapiens
uauaugcuaaacaagggguggg

SEQ ID NO: 349288 - RNA, 22 nt, Homo sapiens
uaucacagguggacugcacacc

SEQ ID NO: 349289 - RNA, 22 nt, Homo sapiens
uaucacaguaaaucugggugca

SEQ ID NO: 349290 - RNA, 22 nt, Homo sapiens
uaucacaguaucuagcacagug

SEQ ID NO: 349291 - RNA, 22 nt, Homo sapiens
uaucacagugcuggaguauucc

SEQ ID NO: 349292 - RNA, 20 nt, Homo sapiens
uaucacaguucaggaacucu

SEQ ID NO: 349293 - RNA, 22 nt, Homo sapiens
uaucaccauguccguuuuaaaa

SEQ ID NO: 349294 - RNA, 22 nt, Homo sapiens
uaucaccuugcaguggaugcua

SEQ ID NO: 349295 - RNA, 22 nt, Homo sapiens
uaucagauugcugccaucugcu

SEQ ID NO: 349296 - RNA, 22 nt, Homo sapiens
uaucaguauggauucauggauu

SEQ ID NO: 349297 - RNA, 22 nt, Homo sapiens
uaucauggaaagauguugaaau

SEQ ID NO: 349298 - RNA, 22 nt, Homo sapiens
uaucaugggggguguacacucc

SEQ ID NO: 349299 - RNA, 21 nt, Homo sapiens
uaucccagucacaucuaccca

SEQ ID NO: 349300 - RNA, 22 nt, Homo sapiens
uaucccaguggauguaccccau

SEQ ID NO: 349301 - RNA, 22 nt, Homo sapiens
uaucucauccuccuugauccca

SEQ ID NO: 349302 - RNA, 22 nt, Homo sapiens
uaucucuuuucauguguaaaug

SEQ ID NO: 349303 - RNA, 22 nt, Homo sapiens
uaucugguuuuguuacagguuc

SEQ ID NO: 349304 - RNA, 22 nt, Homo sapiens
uaugaaucugagagaucuggaa

SEQ ID NO: 349305 - RNA, 22 nt, Homo sapiens
uaugaaucuggcuacuccaggg

SEQ ID NO: 349306 - RNA, 22 nt, Homo sapiens
uaugaauuuuauccaggauaua

SEQ ID NO: 349307 - RNA, 23 nt, Homo sapiens
uaugacagaggaagggggagcug

SEQ ID NO: 349308 - RNA, 22 nt, Homo sapiens
uaugacauaguccuuaacccuc

SEQ ID NO: 349309 - RNA, 22 nt, Homo sapiens
uaugagacugugagugagaaau

SEQ ID NO: 349310 - RNA, 22 nt, Homo sapiens
uaugcacacacguguuuaugug

SEQ ID NO: 349311 - RNA, 22 nt, Homo sapiens
uaugcacaugugccugggugug

SEQ ID NO: 349312 - RNA, 22 nt, Homo sapiens
uaugcacuauggaaguagcuca

SEQ ID NO: 349313 - RNA, 22 nt, Homo sapiens
uaugcagacauuguuccaacca

SEQ ID NO: 349314 - RNA, 22 nt, Homo sapiens
agccuucauucugacaguagga

SEQ ID NO: 349315 - RNA, 22 nt, Homo sapiens
agcgccauugcacuccagccuu

SEQ ID NO: 349316 - RNA, 22 nt, Homo sapiens
agcucacagccuagcacuguga

SEQ ID NO: 349317 - RNA, 22 nt, Homo sapiens
agcucuauuagaagccgugggu

SEQ ID NO: 349318 - RNA, 20 nt, Homo sapiens
agcugcagauauaaauccgc

SEQ ID NO: 349319 - RNA, 22 nt, Homo sapiens
agcugguuuaauaugcugucug

SEQ ID NO: 349320 - RNA, 22 nt, Homo sapiens
agcuguuguuaauuaacucauu

SEQ ID NO: 349321 - RNA, 22 nt, Homo sapiens
agcuguuuuugugggcauguga

SEQ ID NO: 349322 - RNA, 22 nt, Homo sapiens
agcuucauuguuaugaauguca

SEQ ID NO: 349323 - RNA, 22 nt, Homo sapiens
agcuugugauuuagagugagag

SEQ ID NO: 349324 - RNA, 22 nt, Homo sapiens
agcuuguguuugucugccuggg

SEQ ID NO: 349325 - RNA, 19 nt, Homo sapiens
agcuuuggcuaacuuucuc

SEQ ID NO: 349326 - RNA, 22 nt, Homo sapiens
aggaaauguuggucccauuucu

SEQ ID NO: 349327 - RNA, 16 nt, Homo sapiens
aggaagacuuagagau

SEQ ID NO: 349328 - RNA, 22 nt, Homo sapiens
aggaauggaaacuuuugauggu

SEQ ID NO: 349329 - RNA, 22 nt, Homo sapiens
aggaccccucaucagcaccagu

SEQ ID NO: 349330 - RNA, 22 nt, Homo sapiens
aggagaugaagcuuuaucuaaa

SEQ ID NO: 349331 - RNA, 20 nt, Homo sapiens
aggagcauuuacauuggcuc

SEQ ID NO: 349332 - RNA, 23 nt, Homo sapiens
aggagcuuagaaguugccauugc

SEQ ID NO: 349333 - RNA, 22 nt, Homo sapiens
aggagguaggaauugugcuagg

SEQ ID NO: 349334 - RNA, 22 nt, Homo sapiens
aggcaacaugguaaaacccugu

SEQ ID NO: 349335 - RNA, 22 nt, Homo sapiens
aggcaagaaugcuuguuucacc

SEQ ID NO: 349336 - RNA, 22 nt, Homo sapiens
aggcagaugagguccucagcug

SEQ ID NO: 349337 - RNA, 22 nt, Homo sapiens
aggcagucugaguuuugaaagg

SEQ ID NO: 349338 - RNA, 22 nt, Homo sapiens
aggcaugugugcagacugucug

SEQ ID NO: 349339 - RNA, 22 nt, Homo sapiens
aggcuguguggauaauauuggg

SEQ ID NO: 349340 - RNA, 22 nt, Homo sapiens
aggguuuuuauuuauguggcau

SEQ ID NO: 349341 - RNA, 22 nt, Homo sapiens
agguauauuggacagauguaaa

SEQ ID NO: 349342 - RNA, 22 nt, Homo sapiens
aggugaauggauaaacuguggg

SEQ ID NO: 349343 - RNA, 22 nt, Homo sapiens
aggugguauuuaaaauuauuug

SEQ ID NO: 349344 - RNA, 22 nt, Homo sapiens
aggugguauuucaaaguggcag

SEQ ID NO: 349345 - RNA, 22 nt, Homo sapiens
agguguuguugaggagauuuca

SEQ ID NO: 349346 - RNA, 22 nt, Homo sapiens
aguaaagcaucagcuagaugug

SEQ ID NO: 349347 - RNA, 22 nt, Homo sapiens
aguaaagcuacucacugugggc

SEQ ID NO: 349348 - RNA, 22 nt, Homo sapiens
aguaacaggauccaaagaaugu

SEQ ID NO: 349349 - RNA, 22 nt, Homo sapiens
aguacugucagcaggguguuga

SEQ ID NO: 349350 - RNA, 22 nt, Homo sapiens
agucaagaaucucagcaucuuu

SEQ ID NO: 349351 - RNA, 22 nt, Homo sapiens
agucaagauggcaagguaaggc

SEQ ID NO: 349352 - RNA, 22 nt, Homo sapiens
agucacagugaccuugucugac

SEQ ID NO: 349353 - RNA, 22 nt, Homo sapiens
aguccagguuuuguaauggcaa

SEQ ID NO: 349354 - RNA, 22 nt, Homo sapiens
aguccaguguuaugaucaguag

SEQ ID NO: 349355 - RNA, 23 nt, Homo sapiens
agucuguguuuacaggcucucug

SEQ ID NO: 349356 - RNA, 22 nt, Homo sapiens
agugacaugggaucaaaucuga

SEQ ID NO: 349357 - RNA, 22 nt, Homo sapiens
agugagcugcagucuggggucc

SEQ ID NO: 349358 - RNA, 22 nt, Homo sapiens
agugagcuguuuuuacuuucug

SEQ ID NO: 349359 - RNA, 22 nt, Homo sapiens
agugcacugcccgcuuccuguc

SEQ ID NO: 349360 - RNA, 22 nt, Homo sapiens
agugcaguggcucaaaaugccu

SEQ ID NO: 349361 - RNA, 22 nt, Homo sapiens
agugcaguggugccaucauaac

SEQ ID NO: 349362 - RNA, 22 nt, Homo sapiens
agugcauugcaucucugcuuca

SEQ ID NO: 349363 - RNA, 22 nt, Homo sapiens
aguggcacuauucucagaguca

SEQ ID NO: 349364 - RNA, 22 nt, Homo sapiens
agugguguugccuguugaccua

SEQ ID NO: 349365 - RNA, 22 nt, Homo sapiens
agugucaggagacagguagcug

SEQ ID NO: 349366 - RNA, 22 nt, Homo sapiens
aguucaauggguuuucacucau

SEQ ID NO: 349367 - RNA, 21 nt, Homo sapiens
aguucacauggcuccuguguu

SEQ ID NO: 349368 - RNA, 22 nt, Homo sapiens
auaaagacacuuggcaugauuu

SEQ ID NO: 349369 - RNA, 22 nt, Homo sapiens
auaaagcaagucucuggccuca

SEQ ID NO: 349370 - RNA, 22 nt, Homo sapiens
auaaaguagaggugaggugcau

SEQ ID NO: 349371 - RNA, 22 nt, Homo sapiens
auaaaguguuuaguauaggcaa

SEQ ID NO: 349372 - RNA, 22 nt, Homo sapiens
auaaaugccuguuguuuuaagc

SEQ ID NO: 349373 - RNA, 22 nt, Homo sapiens
auaaaugcuuagaucuguauau

SEQ ID NO: 349374 - RNA, 22 nt, Homo sapiens
auaagagcaggcuucuggccag

SEQ ID NO: 349375 - RNA, 23 nt, Homo sapiens
auaagccuuuucuuucugcccca

SEQ ID NO: 349376 - RNA, 22 nt, Homo sapiens
auaaggcagcugcuaaaaggca

SEQ ID NO: 349377 - RNA, 22 nt, Homo sapiens
auaagucaauggaacagauuaa

SEQ ID NO: 349378 - RNA, 22 nt, Homo sapiens
auaauaucagguugugaugaug

SEQ ID NO: 349379 - RNA, 22 nt, Homo sapiens
auaaucaugucugaaaccuuug

SEQ ID NO: 349380 - RNA, 22 nt, Homo sapiens
auaauguuuauccagaggaguu

SEQ ID NO: 349381 - RNA, 19 nt, Homo sapiens
auacacguguauacauaca

SEQ ID NO: 349382 - RNA, 20 nt, Homo sapiens
auaccacagacuggguaguu

SEQ ID NO: 349383 - RNA, 22 nt, Homo sapiens
auacccugucgugagucagaga

SEQ ID NO: 349384 - RNA, 22 nt, Homo sapiens
auacugcacauuuagggaggga

SEQ ID NO: 349385 - RNA, 20 nt, Homo sapiens
auagaagacuagugcagcag

SEQ ID NO: 349386 - RNA, 22 nt, Homo sapiens
auagaaucaucugugcacuagu

SEQ ID NO: 349387 - RNA, 22 nt, Homo sapiens
auagaccuggagaguagauaua

SEQ ID NO: 349388 - RNA, 22 nt, Homo sapiens
auagaucuauuuauguaucccu

SEQ ID NO: 349389 - RNA, 22 nt, Homo sapiens
auagcaaugccccaauccuugg

SEQ ID NO: 349390 - RNA, 21 nt, Homo sapiens
auagcacaucagauuuuauua

SEQ ID NO: 349391 - RNA, 21 nt, Homo sapiens
auagcacuucacuugguuaga

SEQ ID NO: 349392 - RNA, 22 nt, Homo sapiens
auagcagcucacuuauuuaugg

SEQ ID NO: 349393 - RNA, 22 nt, Homo sapiens
auagcagcuugucagggcagac

SEQ ID NO: 349394 - RNA, 22 nt, Homo sapiens
auaggcacauuaggaacuuuug

SEQ ID NO: 349395 - RNA, 22 nt, Homo sapiens
auaguagagagggcaaaaugcu

SEQ ID NO: 349396 - RNA, 21 nt, Homo sapiens
auagugcuagagaguagcagg

SEQ ID NO: 349397 - RNA, 22 nt, Homo sapiens
auagugcuggaauaaauauacg

SEQ ID NO: 349398 - RNA, 22 nt, Homo sapiens
auaucaacaugguaggguuggu

SEQ ID NO: 349399 - RNA, 22 nt, Homo sapiens
auaucugcauugccauuuaugu

SEQ ID NO: 349400 - RNA, 16 nt, Homo sapiens
auaugacuuuaggagg

SEQ ID NO: 349401 - RNA, 22 nt, Homo sapiens
auaugcacgugcauacacacuu

SEQ ID NO: 349402 - RNA, 20 nt, Homo sapiens
auaugcagacacauacauac

SEQ ID NO: 349403 - RNA, 22 nt, Homo sapiens
auaugguuuuuggaagcauauc

SEQ ID NO: 349404 - RNA, 22 nt, Homo sapiens
ugagagaugaacuauucuugaa

SEQ ID NO: 349405 - RNA, 22 nt, Homo sapiens
ugagagcugguuguuuaaagga

SEQ ID NO: 349406 - RNA, 22 nt, Homo sapiens
ugagauaaggaaauugaggcuc

SEQ ID NO: 349407 - RNA, 22 nt, Homo sapiens
ugagauaaugcaugugaagauc

SEQ ID NO: 349408 - RNA, 22 nt, Homo sapiens
ugagauaguacuuuuuuaaagg

SEQ ID NO: 349409 - RNA, 22 nt, Homo sapiens
ugagaucaacugagucagagca

SEQ ID NO: 349410 - RNA, 22 nt, Homo sapiens
auauguaguauggaaacauugu

SEQ ID NO: 349411 - RNA, 21 nt, Homo sapiens
auaugugcuguggaagucagc

SEQ ID NO: 349412 - RNA, 21 nt, Homo sapiens
auauuacuguuagaggacugc

SEQ ID NO: 349413 - RNA, 22 nt, Homo sapiens
auauugacuuucucuuagauca

SEQ ID NO: 349414 - RNA, 22 nt, Homo sapiens
auauugcuuagugaugaagucu

SEQ ID NO: 349415 - RNA, 22 nt, Homo sapiens
auauuggacugugcuaguuaga

SEQ ID NO: 349416 - RNA, 22 nt, Homo sapiens
aucaaauugucauuuuaaggau

SEQ ID NO: 349417 - RNA, 22 nt, Homo sapiens
aucacacuguuauuuuaguuaa

SEQ ID NO: 349418 - RNA, 20 nt, Homo sapiens
aucaccacagcucguucaug

SEQ ID NO: 349419 - RNA, 22 nt, Homo sapiens
aucaccuggaggugaucacuug

SEQ ID NO: 349420 - RNA, 20 nt, Homo sapiens
aucacuggagaaggaaaccu

SEQ ID NO: 349421 - RNA, 22 nt, Homo sapiens
aucacuguaaguuuacacuuug

SEQ ID NO: 349422 - RNA, 23 nt, Homo sapiens
aucacuguuaacaauuucuuccu

SEQ ID NO: 349423 - RNA, 22 nt, Homo sapiens
aucacuuugcucuccagugugg

SEQ ID NO: 349424 - RNA, 22 nt, Homo sapiens
aucauacuguuuugauuacugu

SEQ ID NO: 349425 - RNA, 22 nt, Homo sapiens
aucauuaguuguggaauucuug

SEQ ID NO: 349426 - RNA, 23 nt, Homo sapiens
auccacauucuaguccuuuaugc

SEQ ID NO: 349427 - RNA, 22 nt, Homo sapiens
auccauguggauaaauguguau

SEQ ID NO: 349428 - RNA, 22 nt, Homo sapiens
auccauugucuaaugcuaagau

SEQ ID NO: 349429 - RNA, 20 nt, Homo sapiens
aucccauuccugaagauacu

SEQ ID NO: 349430 - RNA, 22 nt, Homo sapiens
auccucugagagaguuucauaa

SEQ ID NO: 349431 - RNA, 21 nt, Homo sapiens
auccuucuuuuucaaccugug

SEQ ID NO: 349432 - RNA, 22 nt, Homo sapiens
aucuacuugcugggucucugga

SEQ ID NO: 349433 - RNA, 22 nt, Homo sapiens
aucuagagaggcagucuggccg

SEQ ID NO: 349434 - RNA, 22 nt, Homo sapiens
aucucagagaaaauuacuaaga

SEQ ID NO: 349435 - RNA, 22 nt, Homo sapiens
aucucaguuaaugacccuaugc

SEQ ID NO: 349436 - RNA, 22 nt, Homo sapiens
aucuccaggugccagcugcgcc

SEQ ID NO: 349437 - RNA, 22 nt, Homo sapiens
aucugcacaucuguguuuuugu

SEQ ID NO: 349438 - RNA, 22 nt, Homo sapiens
aucuggcuucuuuuaguccaca

SEQ ID NO: 349439 - RNA, 22 nt, Homo sapiens
aucugguguuuccuucacauug

SEQ ID NO: 349440 - RNA, 22 nt, Homo sapiens
aucuguagauucagcacaagcu

SEQ ID NO: 349441 - RNA, 22 nt, Homo sapiens
aucuuguccugagguuuuauug

SEQ ID NO: 349442 - RNA, 22 nt, Homo sapiens
aucuuguguugaauggugcaga

SEQ ID NO: 349443 - RNA, 22 nt, Homo sapiens
aucuuugauuagacugauggau

SEQ ID NO: 349444 - RNA, 22 nt, Homo sapiens
aucuuuggcgggaauaucacag

SEQ ID NO: 349445 - RNA, 22 nt, Homo sapiens
aucuuuggucaucacagcuaga

SEQ ID NO: 349446 - RNA, 22 nt, Homo sapiens
augaaacuggagcgccuggagg

SEQ ID NO: 349447 - RNA, 23 nt, Homo sapiens
augaaagcccuugcaaaugcugg

SEQ ID NO: 349448 - RNA, 22 nt, Homo sapiens
augaaagugauaaaugucucua

SEQ ID NO: 349449 - RNA, 22 nt, Homo sapiens
augaacagagccuugagaaccu

SEQ ID NO: 349450 - RNA, 22 nt, Homo sapiens
augaagacaucgucugggauua

SEQ ID NO: 349451 - RNA, 22 nt, Homo sapiens
augaagcuagcugauugcugau

SEQ ID NO: 349452 - RNA, 22 nt, Homo sapiens
augaaguauuaggacacauuua

SEQ ID NO: 349453 - RNA, 22 nt, Homo sapiens
augaauacugcugcaaugaaca

SEQ ID NO: 349454 - RNA, 21 nt, Homo sapiens
augaauguaaagaauguggga

SEQ ID NO: 349455 - RNA, 22 nt, Homo sapiens
augacaagaguguucagggaga

SEQ ID NO: 349456 - RNA, 22 nt, Homo sapiens
augacaaugaaucccuguuuca

SEQ ID NO: 349457 - RNA, 22 nt, Homo sapiens
augacagugagugagcucucac

SEQ ID NO: 349458 - RNA, 22 nt, Homo sapiens
augacaguguggauuauuguaa

SEQ ID NO: 349459 - RNA, 22 nt, Homo sapiens
augaccaaugggcagagcuaga

SEQ ID NO: 349460 - RNA, 21 nt, Homo sapiens
augacccuggguguccuuucc

SEQ ID NO: 349461 - RNA, 22 nt, Homo sapiens
augaccuuggggaaccaugucu

SEQ ID NO: 349462 - RNA, 22 nt, Homo sapiens
augacuaaaggguuuauguuga

SEQ ID NO: 349463 - RNA, 22 nt, Homo sapiens
augacuauugcacuuuccuggu

SEQ ID NO: 349464 - RNA, 22 nt, Homo sapiens
augacucagaucuguuccuggu

SEQ ID NO: 349465 - RNA, 22 nt, Homo sapiens
augacugaguagcauuccauua

SEQ ID NO: 349466 - RNA, 22 nt, Homo sapiens
augacuuuucugaaaaccacca

SEQ ID NO: 349467 - RNA, 22 nt, Homo sapiens
augagacaguucccuuuaucuu

SEQ ID NO: 349468 - RNA, 22 nt, Homo sapiens
augagauauuuuauaagaucau

SEQ ID NO: 349469 - RNA, 22 nt, Homo sapiens
augagauucuuagagaagucug

SEQ ID NO: 349470 - RNA, 22 nt, Homo sapiens
augagcuguuuggaagacacuu

SEQ ID NO: 349471 - RNA, 22 nt, Homo sapiens
augaggagguaugauuuucuga

SEQ ID NO: 349472 - RNA, 22 nt, Homo sapiens
augaggugggcggcuuggaaga

SEQ ID NO: 349473 - RNA, 22 nt, Homo sapiens
augagguguuuauuguauccug

SEQ ID NO: 349474 - RNA, 22 nt, Homo sapiens
augaguauguucuguauuuuca

SEQ ID NO: 349475 - RNA, 22 nt, Homo sapiens
augagucacuuauuauuggggu

SEQ ID NO: 349476 - RNA, 22 nt, Homo sapiens
augaguuccuuccuugccuagg

SEQ ID NO: 349477 - RNA, 22 nt, Homo sapiens
augauacugaguugaguucuca

SEQ ID NO: 349478 - RNA, 22 nt, Homo sapiens
augauaucuuguuuuucaugca

SEQ ID NO: 349479 - RNA, 22 nt, Homo sapiens
augauauggguugucaguugua

SEQ ID NO: 349480 - RNA, 22 nt, Homo sapiens
augaucuguuuggugaucuugu

SEQ ID NO: 349481 - RNA, 22 nt, Homo sapiens
augauggagguagauuguccau

SEQ ID NO: 349482 - RNA, 22 nt, Homo sapiens
augaugucauuuuaauuucuaa

SEQ ID NO: 349483 - RNA, 22 nt, Homo sapiens
augauugaccaucugcugggcu

SEQ ID NO: 349484 - RNA, 22 nt, Homo sapiens
augauuuuuguaucgccugaug

SEQ ID NO: 349485 - RNA, 22 nt, Homo sapiens
augcaaaucuuaaguaugugug

SEQ ID NO: 349486 - RNA, 22 nt, Homo sapiens
augcaacugcacuccagccugg

SEQ ID NO: 349487 - RNA, 22 nt, Homo sapiens
augcaagaaauaucucuuuuuc

SEQ ID NO: 349488 - RNA, 22 nt, Homo sapiens
augcacaucagcuccagggacc

SEQ ID NO: 349489 - RNA, 22 nt, Homo sapiens
augcagcugaggguaguggagc

SEQ ID NO: 349490 - RNA, 22 nt, Homo sapiens
augcaugucaaauuuguagguu

SEQ ID NO: 349491 - RNA, 19 nt, Homo sapiens
augccacagugaggucaga

SEQ ID NO: 349492 - RNA, 20 nt, Homo sapiens
augccacugagcagugguga

SEQ ID NO: 349493 - RNA, 22 nt, Homo sapiens
augccacugcacuucagcuugg

SEQ ID NO: 349494 - RNA, 22 nt, Homo sapiens
augcuaugugugacuucuuaug

SEQ ID NO: 349495 - RNA, 22 nt, Homo sapiens
augcuggugguucacaugcgca

SEQ ID NO: 349496 - RNA, 22 nt, Homo sapiens
auggaagaaacgauuuucugga

SEQ ID NO: 349497 - RNA, 22 nt, Homo sapiens
auggaaggagaauggucuuuga

SEQ ID NO: 349498 - RNA, 22 nt, Homo sapiens
auggaauggcacuuugaagauu

SEQ ID NO: 349499 - RNA, 21 nt, Homo sapiens
auggacaugguuaggcuuugu

SEQ ID NO: 349500 - RNA, 22 nt, Homo sapiens
auggagugagaauggagguucc

SEQ ID NO: 349501 - RNA, 22 nt, Homo sapiens
auggauauugccuaggguagua

SEQ ID NO: 349502 - RNA, 22 nt, Homo sapiens
auggauuuuggggccagaggca

SEQ ID NO: 349503 - RNA, 22 nt, Homo sapiens
auggcacuaaguucaacacuua

SEQ ID NO: 349504 - RNA, 22 nt, Homo sapiens
auggcacuaaugggaguuuacu

SEQ ID NO: 349505 - RNA, 22 nt, Homo sapiens
uggaagcauagcagcgugugug

SEQ ID NO: 349506 - RNA, 22 nt, Homo sapiens
uggaaggucauuguucauuuga

SEQ ID NO: 349507 - RNA, 22 nt, Homo sapiens
uggaaguaaccaugaauggaau

SEQ ID NO: 349508 - RNA, 20 nt, Homo sapiens
uggaaucuaggcggagguuu

SEQ ID NO: 349509 - RNA, 22 nt, Homo sapiens
uggaaugcuaagcaugugggag

SEQ ID NO: 349510 - RNA, 22 nt, Homo sapiens
uggaauguagcguugacacgag

SEQ ID NO: 349511 - RNA, 22 nt, Homo sapiens
uggaaugucuauguuuuugauu

SEQ ID NO: 349512 - RNA, 22 nt, Homo sapiens
uggaauguuuaucaaaacagua

SEQ ID NO: 349513 - RNA, 22 nt, Homo sapiens
uggaauuuacuuauuuaggggc

SEQ ID NO: 349514 - RNA, 22 nt, Homo sapiens
uggaauuuagguugauaguaua

SEQ ID NO: 349515 - RNA, 22 nt, Homo sapiens
uggacaagugcccuccaccuca

SEQ ID NO: 349516 - RNA, 22 nt, Homo sapiens
uggacacugguggauauggaau

SEQ ID NO: 349517 - RNA, 22 nt, Homo sapiens
uggacagacaagguuauagauc

SEQ ID NO: 349518 - RNA, 22 nt, Homo sapiens
uggacuagagggugggcgaggu

SEQ ID NO: 349519 - RNA, 22 nt, Homo sapiens
uggagcccuaguuccucauaac

SEQ ID NO: 349520 - RNA, 23 nt, Homo sapiens
uggaggacaagcauggauaguga

SEQ ID NO: 349521 - RNA, 22 nt, Homo sapiens
uggagggcuagucauuucuuuu

SEQ ID NO: 349522 - RNA, 20 nt, Homo sapiens
uggaggucaucugucacuac

SEQ ID NO: 349523 - RNA, 22 nt, Homo sapiens
uggaguuugacaugccuuuggg

SEQ ID NO: 349524 - RNA, 22 nt, Homo sapiens
uggaucuguucuauuuaucuga

SEQ ID NO: 349525 - RNA, 22 nt, Homo sapiens
uggauggagaggcuugugaugc

SEQ ID NO: 349526 - RNA, 22 nt, Homo sapiens
uggcaaaaaaacgcaauuacgu

SEQ ID NO: 349527 - RNA, 22 nt, Homo sapiens
uggcaaaaaucacaaguaccuu

SEQ ID NO: 349528 - RNA, 22 nt, Homo sapiens
uggcaaauagcaauaggagggu

SEQ ID NO: 349529 - RNA, 22 nt, Homo sapiens
uggcaaaugugagaugagaacu

SEQ ID NO: 349530 - RNA, 22 nt, Homo sapiens
uggcaagaaccacaauuacuuu

SEQ ID NO: 349531 - RNA, 22 nt, Homo sapiens
uggcaagagcugcauucaucug

SEQ ID NO: 349532 - RNA, 22 nt, Homo sapiens
uggcaagagggaugcaagguuu

SEQ ID NO: 349533 - RNA, 22 nt, Homo sapiens
uggcaauaauucagugugggcu

SEQ ID NO: 349534 - RNA, 19 nt, Homo sapiens
uggcacauguauacauaug

SEQ ID NO: 349535 - RNA, 20 nt, Homo sapiens
uggcaccugacagauagcca

SEQ ID NO: 349536 - RNA, 22 nt, Homo sapiens
uggcaccugacuccgagaugca

SEQ ID NO: 349537 - RNA, 22 nt, Homo sapiens
uggcagauaggauacaggacua

SEQ ID NO: 349538 - RNA, 22 nt, Homo sapiens
uggcagcgcaguugaaaaagaa

SEQ ID NO: 349539 - RNA, 22 nt, Homo sapiens
uggcagcgugaaagacuuuuuc

SEQ ID NO: 349540 - RNA, 22 nt, Homo sapiens
uggcagcugcuucaugggaugc

SEQ ID NO: 349541 - RNA, 22 nt, Homo sapiens
uggcaguuucacauggcucaac

SEQ ID NO: 349542 - RNA, 19 nt, Homo sapiens
uggcaugaaugugaacuaa

SEQ ID NO: 349543 - RNA, 17 nt, Homo sapiens
uggcaugaggguguggg

SEQ ID NO: 349544 - RNA, 22 nt, Homo sapiens
uggcaugauccuagauucaaca

SEQ ID NO: 349545 - RNA, 22 nt, Homo sapiens
uggcauggaguggauggcccca

SEQ ID NO: 349546 - RNA, 22 nt, Homo sapiens
uggcauggggcagaacauuaca

SEQ ID NO: 349547 - RNA, 22 nt, Homo sapiens
uggcaugggguaguagcgcugg

SEQ ID NO: 349548 - RNA, 22 nt, Homo sapiens
uggcauguaaugcagaaguugc

SEQ ID NO: 349549 - RNA, 23 nt, Homo sapiens
uggcauuuuaguuagcuucagug

SEQ ID NO: 349550 - RNA, 22 nt, Homo sapiens
uggcauuuugugugaauuagaa

SEQ ID NO: 349551 - RNA, 23 nt, Homo sapiens
uggcauuuuuggcaaugccuucu

SEQ ID NO: 349552 - RNA, 23 nt, Homo sapiens
uggccagaaacuucuuuucaucc

SEQ ID NO: 349553 - RNA, 22 nt, Homo sapiens
uggccagagggcaauuagcugu

SEQ ID NO: 349554 - RNA, 22 nt, Homo sapiens
uggccagugucggaggccagga

SEQ ID NO: 349555 - RNA, 22 nt, Homo sapiens
uggccaguugaagacaaugcuc

SEQ ID NO: 349556 - RNA, 22 nt, Homo sapiens
uggcucuguuuguuaacuagac

SEQ ID NO: 349557 - RNA, 22 nt, Homo sapiens
uggcuguuuauuucaccuggau

SEQ ID NO: 349558 - RNA, 22 nt, Homo sapiens
uggcuguuuauuucacgugggu

SEQ ID NO: 349559 - RNA, 21 nt, Homo sapiens
uggcuuauuugaaucuggcuu

SEQ ID NO: 349560 - RNA, 22 nt, Homo sapiens
uggcuuuguaagguuucauuuu

SEQ ID NO: 349561 - RNA, 22 nt, Homo sapiens
ugggaagcugcauuuuaacaag

SEQ ID NO: 349562 - RNA, 22 nt, Homo sapiens
ugggaauaugauacaggucuuu

SEQ ID NO: 349563 - RNA, 22 nt, Homo sapiens
ugggaucgucaagugaggcucg

SEQ ID NO: 349564 - RNA, 22 nt, Homo sapiens
ugggaugugagucuucgcuuuc

SEQ ID NO: 349565 - RNA, 22 nt, Homo sapiens
ugggcaaaacuaagagcugugg

SEQ ID NO: 349566 - RNA, 22 nt, Homo sapiens
ugggcaagugacuuggcuucuc

SEQ ID NO: 349567 - RNA, 22 nt, Homo sapiens
ugggcuagaugcuuugggguca

SEQ ID NO: 349568 - RNA, 22 nt, Homo sapiens
uggguagaugaauccauuccaa

SEQ ID NO: 349569 - RNA, 22 nt, Homo sapiens
uggguagucauuggaggguuuu

SEQ ID NO: 349570 - RNA, 22 nt, Homo sapiens
uggguaguuucuuacaacucug

SEQ ID NO: 349571 - RNA, 22 nt, Homo sapiens
uggguaguuuuucagcucuugc

SEQ ID NO: 349572 - RNA, 22 nt, Homo sapiens
ugggugaguaucuauuauucag

SEQ ID NO: 349573 - RNA, 23 nt, Homo sapiens
uggguucauucuugaagucagug

SEQ ID NO: 349574 - RNA, 17 nt, Homo sapiens
ugguagguuuuucuggc

SEQ ID NO: 349575 - RNA, 22 nt, Homo sapiens
ugguauguugucucuuuguucu

SEQ ID NO: 349576 - RNA, 22 nt, Homo sapiens
uggucaccuucuugcucugucu

SEQ ID NO: 349577 - RNA, 22 nt, Homo sapiens
uggucaguugugccucaauucc

SEQ ID NO: 349578 - RNA, 21 nt, Homo sapiens
uggucaguuuucucacuagga

SEQ ID NO: 349579 - RNA, 22 nt, Homo sapiens
uggucauggggcagcugacacu

SEQ ID NO: 349580 - RNA, 22 nt, Homo sapiens
ugguccccaauacuucuauaga

SEQ ID NO: 349581 - RNA, 22 nt, Homo sapiens
uggucuucuggccuccagaacc

SEQ ID NO: 349582 - RNA, 22 nt, Homo sapiens
uggugagaaaagaugucuuugu

SEQ ID NO: 349583 - RNA, 22 nt, Homo sapiens
uggugagaaaugagaugcuuuu

SEQ ID NO: 349584 - RNA, 22 nt, Homo sapiens
uguaaacucaguauguuuuacu

SEQ ID NO: 349585 - RNA, 20 nt, Homo sapiens
uguaaaggagauugcagcug

SEQ ID NO: 349586 - RNA, 22 nt, Homo sapiens
uguaaaucuauuuuuaguguuu

SEQ ID NO: 349587 - RNA, 22 nt, Homo sapiens
uguaagcauuauauaauuguug

SEQ ID NO: 349588 - RNA, 22 nt, Homo sapiens
uguacaaauuucugugguggug

SEQ ID NO: 349589 - RNA, 21 nt, Homo sapiens
uguauauguuuauacacacac

SEQ ID NO: 349590 - RNA, 22 nt, Homo sapiens
uguaugguuauuuguggauggu

SEQ ID NO: 349591 - RNA, 22 nt, Homo sapiens
uguaugucugcucuuuggaacu

SEQ ID NO: 349592 - RNA, 22 nt, Homo sapiens
uguauguugauguuauauucug

SEQ ID NO: 349593 - RNA, 22 nt, Homo sapiens
ugucaaggaaugucauugguuu

SEQ ID NO: 349594 - RNA, 22 nt, Homo sapiens
ugucacaguuuguacuuuauag

SEQ ID NO: 349595 - RNA, 22 nt, Homo sapiens
ugucacccuuuauccauuuccu

SEQ ID NO: 349596 - RNA, 22 nt, Homo sapiens
ugucacuuugccuucuggacuu

SEQ ID NO: 349597 - RNA, 22 nt, Homo sapiens
ugucagcacaacucagguuccu

SEQ ID NO: 349598 - RNA, 22 nt, Homo sapiens
ugucaguguacuguaagaauua

SEQ ID NO: 349599 - RNA, 22 nt, Homo sapiens
ugucauacaguaacaugguugg

SEQ ID NO: 349600 - RNA, 22 nt, Homo sapiens
auggcacuacugggaaugucuu

SEQ ID NO: 349601 - RNA, 22 nt, Homo sapiens
auggcacucaaucaaguugaga

SEQ ID NO: 349602 - RNA, 22 nt, Homo sapiens
auggcacugccuggcuucaugg

SEQ ID NO: 349603 - RNA, 22 nt, Homo sapiens
auggcacuguguauuuuucugu

SEQ ID NO: 349604 - RNA, 22 nt, Homo sapiens
auggcacuuuggacugcuagau

SEQ ID NO: 349605 - RNA, 22 nt, Homo sapiens
auggcagagucagaaagucagg

SEQ ID NO: 349606 - RNA, 22 nt, Homo sapiens
auggcagcugguuuuacccuag

SEQ ID NO: 349607 - RNA, 22 nt, Homo sapiens
auggcagugagucucuaguauu

SEQ ID NO: 349608 - RNA, 22 nt, Homo sapiens
auggcaguuuggucucugugcu

SEQ ID NO: 349609 - RNA, 22 nt, Homo sapiens
auggccuuguauaccuggcaaa

SEQ ID NO: 349610 - RNA, 22 nt, Homo sapiens
auggcuagauuguaugguaguu

SEQ ID NO: 349611 - RNA, 22 nt, Homo sapiens
ugucccguuuucgaggcugcag

SEQ ID NO: 349612 - RNA, 18 nt, Homo sapiens
ugucccuuugcuguucau

SEQ ID NO: 349613 - RNA, 22 nt, Homo sapiens
ugucucagugauuggcuuucug

SEQ ID NO: 349614 - RNA, 21 nt, Homo sapiens
ugucugagagaggagaucuac

SEQ ID NO: 349615 - RNA, 22 nt, Homo sapiens
ugugaaacacgaaagucuaaaa

SEQ ID NO: 349616 - RNA, 22 nt, Homo sapiens
ugugaacaugacagugggcuag

SEQ ID NO: 349617 - RNA, 22 nt, Homo sapiens
ugugaauggugcugcaaugaac

SEQ ID NO: 349618 - RNA, 22 nt, Homo sapiens
ugugacaaauuuaguggacugu

SEQ ID NO: 349619 - RNA, 23 nt, Homo sapiens
ugugacacuuccgucaguucauu

SEQ ID NO: 349620 - RNA, 22 nt, Homo sapiens
ugugacagguagguaauuuuug

SEQ ID NO: 349621 - RNA, 22 nt, Homo sapiens
ugugacaguguuacauuucaug

SEQ ID NO: 349622 - RNA, 21 nt, Homo sapiens
ugugacuguugcauuugucgu

SEQ ID NO: 349623 - RNA, 22 nt, Homo sapiens
ugugagaaaugcagaaucucag

SEQ ID NO: 349624 - RNA, 20 nt, Homo sapiens
ugugagacugguuuugaacu

SEQ ID NO: 349625 - RNA, 22 nt, Homo sapiens
ugugaugcagggccugggccuc

SEQ ID NO: 349626 - RNA, 22 nt, Homo sapiens
ugugcacaaccugcagguuugu

SEQ ID NO: 349627 - RNA, 22 nt, Homo sapiens
ugugcacaauguacagguuagu

SEQ ID NO: 349628 - RNA, 23 nt, Homo sapiens
ugugcacauuuacauauauacac

SEQ ID NO: 349629 - RNA, 22 nt, Homo sapiens
ugugcaccucuucacacaggga

SEQ ID NO: 349630 - RNA, 22 nt, Homo sapiens
ugugcacuggaccuugucuucu

SEQ ID NO: 349631 - RNA, 22 nt, Homo sapiens
ugugcaguuuuagcguauuuua

SEQ ID NO: 349632 - RNA, 22 nt, Homo sapiens
ugugcauaugucuuuauaguag

SEQ ID NO: 349633 - RNA, 22 nt, Homo sapiens
ugugcaugaaauuuaccuuuaa

SEQ ID NO: 349634 - RNA, 22 nt, Homo sapiens
ugugcuauguuauucacauggg

SEQ ID NO: 349635 - RNA, 21 nt, Homo sapiens
uguggcaauggccucacagau

SEQ ID NO: 349636 - RNA, 22 nt, Homo sapiens
uguggcacuguguccagagaaa

SEQ ID NO: 349637 - RNA, 17 nt, Homo sapiens
uguggcucuuaugcuga

SEQ ID NO: 349638 - RNA, 22 nt, Homo sapiens
uguggcuucuuugguucaguau

SEQ ID NO: 349639 - RNA, 22 nt, Homo sapiens
ugugggugguaaaauacaauga

SEQ ID NO: 349640 - RNA, 22 nt, Homo sapiens
uguguagagaaauauuacuuau

SEQ ID NO: 349641 - RNA, 22 nt, Homo sapiens
uguguauaucacugcaugagug

SEQ ID NO: 349642 - RNA, 22 nt, Homo sapiens
ugugucacugcacuccagccug

SEQ ID NO: 349643 - RNA, 22 nt, Homo sapiens
uguuaacauggucucagucugu

SEQ ID NO: 349644 - RNA, 22 nt, Homo sapiens
uguuacagcagaauugaaagag

SEQ ID NO: 349645 - RNA, 22 nt, Homo sapiens
uguuacagugacuaauguuuua

SEQ ID NO: 349646 - RNA, 22 nt, Homo sapiens
uguuagguuggugcaaaaguga

SEQ ID NO: 349647 - RNA, 22 nt, Homo sapiens
uguuauguauggagugauccca

SEQ ID NO: 349648 - RNA, 22 nt, Homo sapiens
uguuauguucuacuuuuaggug

SEQ ID NO: 349649 - RNA, 22 nt, Homo sapiens
uguuauguuguuugagaaaguc

SEQ ID NO: 349650 - RNA, 22 nt, Homo sapiens
uguuauugagguuacuuauaag

SEQ ID NO: 349651 - RNA, 22 nt, Homo sapiens
uguucacaguguuucuuugaga

SEQ ID NO: 349652 - RNA, 22 nt, Homo sapiens
uguucuggagccgguucaaaug

SEQ ID NO: 349653 - RNA, 19 nt, Homo sapiens
uguugcacauaucaauaug

SEQ ID NO: 349654 - RNA, 18 nt, Homo sapiens
uguugguguucacucacu

SEQ ID NO: 349655 - RNA, 22 nt, Homo sapiens
uguuucuacugucucuguagua

SEQ ID NO: 349656 - RNA, 22 nt, Homo sapiens
uguuuguuugagauggagucuc

SEQ ID NO: 349657 - RNA, 22 nt, Homo sapiens
uguuuuggagguccucacuaga

SEQ ID NO: 349658 - RNA, 22 nt, Homo sapiens
uuaaaagcuaucuccaagguca

SEQ ID NO: 349659 - RNA, 22 nt, Homo sapiens
uuaaaaguauaggccuggcaua

SEQ ID NO: 349660 - RNA, 22 nt, Homo sapiens
uuaaaccugucuucucacuaau

SEQ ID NO: 349661 - RNA, 22 nt, Homo sapiens
uuaaacucaucacccagguagu

SEQ ID NO: 349662 - RNA, 22 nt, Homo sapiens
uuaaagugcacacgggucaggc

SEQ ID NO: 349663 - RNA, 22 nt, Homo sapiens
uuaaaguguuugcagacaggug

SEQ ID NO: 349664 - RNA, 22 nt, Homo sapiens
uuaaaugcauagaauguguagu

SEQ ID NO: 349665 - RNA, 22 nt, Homo sapiens
uuaagagcauggugccagguug

SEQ ID NO: 349666 - RNA, 22 nt, Homo sapiens
uuaagagugggaguuggccaca

SEQ ID NO: 349667 - RNA, 22 nt, Homo sapiens
uuaagccacucaagagauagag

SEQ ID NO: 349668 - RNA, 22 nt, Homo sapiens
uuaaggaaggagucuuaaaugg

SEQ ID NO: 349669 - RNA, 22 nt, Homo sapiens
uuaaggcagugcaucuggaguu

SEQ ID NO: 349670 - RNA, 22 nt, Homo sapiens
uuaaggugaaguucucagaugc

SEQ ID NO: 349671 - RNA, 22 nt, Homo sapiens
uuaaguagcugggcaugguggu

SEQ ID NO: 349672 - RNA, 22 nt, Homo sapiens
uuaagugguagguggugcccaa

SEQ ID NO: 349673 - RNA, 22 nt, Homo sapiens
uuaaguuguagcuacaaauaca

SEQ ID NO: 349674 - RNA, 22 nt, Homo sapiens
uuaauacucuucuaaguagucc

SEQ ID NO: 349675 - RNA, 22 nt, Homo sapiens
uuaaucaggccguuuccuaaga

SEQ ID NO: 349676 - RNA, 22 nt, Homo sapiens
uuaaugcuuuugggauauuucu

SEQ ID NO: 349677 - RNA, 22 nt, Homo sapiens
uuaauguaauugauugauugac

SEQ ID NO: 349678 - RNA, 22 nt, Homo sapiens
uuacaaccucagcagugcaaag

SEQ ID NO: 349679 - RNA, 22 nt, Homo sapiens
uuacagauggauggcagcuggc

SEQ ID NO: 349680 - RNA, 23 nt, Homo sapiens
uuacaguggcaugaucucugcuc

SEQ ID NO: 349681 - RNA, 22 nt, Homo sapiens
uuacaguggugaccuuguauug

SEQ ID NO: 349682 - RNA, 19 nt, Homo sapiens
uuacagugugcccuuuuag

SEQ ID NO: 349683 - RNA, 22 nt, Homo sapiens
uuacaguguuuguucuguuacu

SEQ ID NO: 349684 - RNA, 22 nt, Homo sapiens
uuacaucaucacauuaguuugc

SEQ ID NO: 349685 - RNA, 22 nt, Homo sapiens
uuacugcuagcugugugcucuu

SEQ ID NO: 349686 - RNA, 22 nt, Homo sapiens
uuagagcacugaucugcucuuu

SEQ ID NO: 349687 - RNA, 22 nt, Homo sapiens
uuagcacuugggaguauuuauu

SEQ ID NO: 349688 - RNA, 21 nt, Homo sapiens
uuagcauccauguucaucaac

SEQ ID NO: 349689 - RNA, 22 nt, Homo sapiens
uuagcccagugggugcuucucu

SEQ ID NO: 349690 - RNA, 22 nt, Homo sapiens
uuagcccaucuugaggaaagua

SEQ ID NO: 349691 - RNA, 22 nt, Homo sapiens
uuagggaggagucccucuuuuu

SEQ ID NO: 349692 - RNA, 22 nt, Homo sapiens
uuagugcaaacucuucaaugcu

SEQ ID NO: 349693 - RNA, 20 nt, Homo sapiens
uuaguucauuuagaagguuu

SEQ ID NO: 349694 - RNA, 22 nt, Homo sapiens
uccuuuggucaguauucuuuug

SEQ ID NO: 349695 - RNA, 22 nt, Homo sapiens
uccuuugguuauaggcaccucu

SEQ ID NO: 349696 - RNA, 19 nt, Homo sapiens
ucgcgccauucuccugccu

SEQ ID NO: 349697 - RNA, 22 nt, Homo sapiens
ucuaaaacuagauugugaugau

SEQ ID NO: 349698 - RNA, 22 nt, Homo sapiens
ucuaaggcaccuagagucauca

SEQ ID NO: 349699 - RNA, 22 nt, Homo sapiens
ucuaauguaaccugcaaauauu

SEQ ID NO: 349700 - RNA, 22 nt, Homo sapiens
ucucacacugaauguguguggg

SEQ ID NO: 349701 - RNA, 22 nt, Homo sapiens
ucucacaggguuauugaggggg

SEQ ID NO: 349702 - RNA, 22 nt, Homo sapiens
ucucaguguuaucuaucugccu

SEQ ID NO: 349703 - RNA, 20 nt, Homo sapiens
ucucauggagguagagaaua

SEQ ID NO: 349704 - RNA, 22 nt, Homo sapiens
ucucauggagguagagaguaaa

SEQ ID NO: 349705 - RNA, 22 nt, Homo sapiens
ucucauggagucaggagcagaa

SEQ ID NO: 349706 - RNA, 21 nt, Homo sapiens
ucucauuacugaugagccaga

SEQ ID NO: 349707 - RNA, 22 nt, Homo sapiens
ucucccuaccugagccgagcca

SEQ ID NO: 349708 - RNA, 22 nt, Homo sapiens
ucucugagaccacuccaaacuc

SEQ ID NO: 349709 - RNA, 22 nt, Homo sapiens
ucucuggauaucuacuuauguu

SEQ ID NO: 349710 - RNA, 19 nt, Homo sapiens
ucucugguguuggagggga

SEQ ID NO: 349711 - RNA, 22 nt, Homo sapiens
ucucuuggcggaaguugcagug

SEQ ID NO: 349712 - RNA, 22 nt, Homo sapiens
ucucuuggugacuuaaaauguu

SEQ ID NO: 349713 - RNA, 19 nt, Homo sapiens
ucugacagccccagucaac

SEQ ID NO: 349714 - RNA, 22 nt, Homo sapiens
ucugagcaauaaacaacauauu

SEQ ID NO: 349715 - RNA, 22 nt, Homo sapiens
ucugccuacugguuggaggaac

SEQ ID NO: 349716 - RNA, 22 nt, Homo sapiens
ucuggcauuuucucugcuugca

SEQ ID NO: 349717 - RNA, 20 nt, Homo sapiens
ucuggccccuccaaaucuca

SEQ ID NO: 349718 - RNA, 20 nt, Homo sapiens
ucuggccccucuaaaucuca

SEQ ID NO: 349719 - RNA, 17 nt, Homo sapiens
ucuggcuuucacaccug

SEQ ID NO: 349720 - RNA, 22 nt, Homo sapiens
ucuggcuuucuuuacuuaaugu

SEQ ID NO: 349721 - RNA, 22 nt, Homo sapiens
ucugucaaaucuuauguuguag

SEQ ID NO: 349722 - RNA, 22 nt, Homo sapiens
ucugucuuguccucacccuaga

SEQ ID NO: 349723 - RNA, 22 nt, Homo sapiens
ucugucuugugguuugagugcc

SEQ ID NO: 349724 - RNA, 22 nt, Homo sapiens
ucugucuuugccuaaguuuguc

SEQ ID NO: 349725 - RNA, 22 nt, Homo sapiens
ucugucuuugucaggaccagag

SEQ ID NO: 349726 - RNA, 22 nt, Homo sapiens
ucugugguucaggcuggagugc

SEQ ID NO: 349727 - RNA, 22 nt, Homo sapiens
ucugugguuguugcauggaaug

SEQ ID NO: 349728 - RNA, 22 nt, Homo sapiens
ucuguguugaugcucauuaauu

SEQ ID NO: 349729 - RNA, 22 nt, Homo sapiens
ucuguguuugguuggcaauuuc

SEQ ID NO: 349730 - RNA, 22 nt, Homo sapiens
ucuuaggugaugauugauguga

SEQ ID NO: 349731 - RNA, 22 nt, Homo sapiens
ucuuaguuggaaugggauaagg

SEQ ID NO: 349732 - RNA, 22 nt, Homo sapiens
ucuuauuuggggaaaggguccu

SEQ ID NO: 349733 - RNA, 20 nt, Homo sapiens
ucuugaacuuagucaacagg

SEQ ID NO: 349734 - RNA, 22 nt, Homo sapiens
ucuugaacuucugcacacucag

SEQ ID NO: 349735 - RNA, 22 nt, Homo sapiens
ucuugcaguucccaaauucaca

SEQ ID NO: 349736 - RNA, 22 nt, Homo sapiens
ucuugccacuucauccccuuuc

SEQ ID NO: 349737 - RNA, 22 nt, Homo sapiens
ucuuggccaugaauggcaaggc

SEQ ID NO: 349738 - RNA, 22 nt, Homo sapiens
ucuugggugaguuugugaauaa

SEQ ID NO: 349739 - RNA, 21 nt, Homo sapiens
ucuuggguugaauucucccag

SEQ ID NO: 349740 - RNA, 19 nt, Homo sapiens
ucuuuagucacauuuuuau

SEQ ID NO: 349741 - RNA, 22 nt, Homo sapiens
ucuuugauuuuguuacuaagac

SEQ ID NO: 349742 - RNA, 23 nt, Homo sapiens
ucuuuggcucuaauauaccuugu

SEQ ID NO: 349743 - RNA, 22 nt, Homo sapiens
ucuuugguaauggaugucugau

SEQ ID NO: 349744 - RNA, 22 nt, Homo sapiens
ucuuugguauugugaauagugu

SEQ ID NO: 349745 - RNA, 22 nt, Homo sapiens
ucuuugguugcacugcaggugu

SEQ ID NO: 349746 - RNA, 22 nt, Homo sapiens
ucuuuguguaggucaaucuggc

SEQ ID NO: 349747 - RNA, 22 nt, Homo sapiens
ucuuuguuggaguccaaggaua

SEQ ID NO: 349748 - RNA, 20 nt, Homo sapiens
ugaaacacauggacuggggu

SEQ ID NO: 349749 - RNA, 22 nt, Homo sapiens
ugaaacauacacucugaugggg

SEQ ID NO: 349750 - RNA, 22 nt, Homo sapiens
ugaaaugcagaacuuuaggucu

SEQ ID NO: 349751 - RNA, 22 nt, Homo sapiens
ugaaauguguuaucugggccug

SEQ ID NO: 349752 - RNA, 20 nt, Homo sapiens
ugaacugguuacuuucuguc

SEQ ID NO: 349753 - RNA, 22 nt, Homo sapiens
ugaagugaagacucacagaagg

SEQ ID NO: 349754 - RNA, 22 nt, Homo sapiens
ugaauauguuaaauaauguucu

SEQ ID NO: 349755 - RNA, 22 nt, Homo sapiens
ugaauauguuucuaaaagugca

SEQ ID NO: 349756 - RNA, 22 nt, Homo sapiens
ugaaugcaucuagaaauuuauu

SEQ ID NO: 349757 - RNA, 21 nt, Homo sapiens
ugaaugcuuuaaauauuagaa

SEQ ID NO: 349758 - RNA, 22 nt, Homo sapiens
ugaauucuguccaaaauaacug

SEQ ID NO: 349759 - RNA, 23 nt, Homo sapiens
ugacaagagcgagacuuggucuc

SEQ ID NO: 349760 - RNA, 22 nt, Homo sapiens
ugacacauguagacaucuggug

SEQ ID NO: 349761 - RNA, 22 nt, Homo sapiens
ugacagcugaggcccagaguac

SEQ ID NO: 349762 - RNA, 22 nt, Homo sapiens
ugacaguguccucauucccaac

SEQ ID NO: 349763 - RNA, 22 nt, Homo sapiens
ugacaguguccuccuccugaga

SEQ ID NO: 349764 - RNA, 18 nt, Homo sapiens
ugacaguuucuuuauauu

SEQ ID NO: 349765 - RNA, 22 nt, Homo sapiens
ugacaucaccaccuccgucauc

SEQ ID NO: 349766 - RNA, 22 nt, Homo sapiens
ugacaugaagaaaaacagauuu

SEQ ID NO: 349767 - RNA, 22 nt, Homo sapiens
ugacaugaugagcaauaauggc

SEQ ID NO: 349768 - RNA, 22 nt, Homo sapiens
ugacccauagaaauguggauaa

SEQ ID NO: 349769 - RNA, 22 nt, Homo sapiens
ugacuagagggcuuuuguguag

SEQ ID NO: 349770 - RNA, 19 nt, Homo sapiens
ugacuauagccugaucagu

SEQ ID NO: 349771 - RNA, 22 nt, Homo sapiens
ugacuauugauuuagacgugcu

SEQ ID NO: 349772 - RNA, 22 nt, Homo sapiens
ugacucagauagguguguauuc

SEQ ID NO: 349773 - RNA, 22 nt, Homo sapiens
ugacuggagaccucaguagggu

SEQ ID NO: 349774 - RNA, 22 nt, Homo sapiens
ugacuugaaacgugaacagauc

SEQ ID NO: 349775 - RNA, 21 nt, Homo sapiens
ugagaacaacaggucaagcag

SEQ ID NO: 349776 - RNA, 22 nt, Homo sapiens
ugagaacuagagaacaagguga

SEQ ID NO: 349777 - RNA, 22 nt, Homo sapiens
ugagaagacaucagcuuucgga

SEQ ID NO: 349778 - RNA, 22 nt, Homo sapiens
ugagaagaugaacuccuugguc

SEQ ID NO: 349779 - RNA, 22 nt, Homo sapiens
ugagaagcauaccagugucugu

SEQ ID NO: 349780 - RNA, 21 nt, Homo sapiens
ugagacaauccuggucaauau

SEQ ID NO: 349781 - RNA, 22 nt, Homo sapiens
ugagacggagucucgcuguguc

SEQ ID NO: 349782 - RNA, 22 nt, Homo sapiens
ugagacugagucuugcucuugu

SEQ ID NO: 349783 - RNA, 22 nt, Homo sapiens
ugagacugaguuuugccuuugu

SEQ ID NO: 349784 - RNA, 22 nt, Homo sapiens
ugagacugaguuuugcucguug

SEQ ID NO: 349785 - RNA, 22 nt, Homo sapiens
ugagagacaguuuguuaaaauu

SEQ ID NO: 349786 - RNA, 22 nt, Homo sapiens
uauggauguuaagguucacagc

SEQ ID NO: 349787 - RNA, 22 nt, Homo sapiens
uauggcacuaguacuggaaagc

SEQ ID NO: 349788 - RNA, 22 nt, Homo sapiens
uauggcauuauuuugauagaca

SEQ ID NO: 349789 - RNA, 22 nt, Homo sapiens
uauggcuucuuuaaauugaggu

SEQ ID NO: 349790 - RNA, 22 nt, Homo sapiens
uauggcuuucuacuugaguucu

SEQ ID NO: 349791 - RNA, 22 nt, Homo sapiens
uauggcuuuguucaacagccuc

SEQ ID NO: 349792 - RNA, 22 nt, Homo sapiens
uauuagguuggggcaaaaguaa

SEQ ID NO: 349793 - RNA, 22 nt, Homo sapiens
uauuagguuggugcaaaaguaa

SEQ ID NO: 349794 - RNA, 22 nt, Homo sapiens
uauuccacucuguuggagguaa

SEQ ID NO: 349795 - RNA, 22 nt, Homo sapiens
uauuccagcccuggugagccag

SEQ ID NO: 349796 - RNA, 22 nt, Homo sapiens
uauuccauuugugaaaggaagu

SEQ ID NO: 349797 - RNA, 22 nt, Homo sapiens
uauugacauuacagugggucuu

SEQ ID NO: 349798 - RNA, 22 nt, Homo sapiens
uauugcaaauggugaucccagg

SEQ ID NO: 349799 - RNA, 22 nt, Homo sapiens
uauugcacuccucaugcauuug

SEQ ID NO: 349800 - RNA, 22 nt, Homo sapiens
uauugcagaaugugaguuggca

SEQ ID NO: 349801 - RNA, 22 nt, Homo sapiens
uauugcucaugcauuuaauuuc

SEQ ID NO: 349802 - RNA, 22 nt, Homo sapiens
uauuucaguugcguuucccgag

SEQ ID NO: 349803 - RNA, 22 nt, Homo sapiens
uauuucaguugugcagguaguu

SEQ ID NO: 349804 - RNA, 22 nt, Homo sapiens
uauuugauuaacaagagccuaa

SEQ ID NO: 349805 - RNA, 22 nt, Homo sapiens
uauuugauugacuuuagcagga

SEQ ID NO: 349806 - RNA, 22 nt, Homo sapiens
uauuugguagcuauuuugcagu

SEQ ID NO: 349807 - RNA, 22 nt, Homo sapiens
ucaaacauccccaccagggacu

SEQ ID NO: 349808 - RNA, 20 nt, Homo sapiens
ucaaaguaugcucugcacua

SEQ ID NO: 349809 - RNA, 18 nt, Homo sapiens
ucaaauacuuugggcagu

SEQ ID NO: 349810 - RNA, 22 nt, Homo sapiens
ucaaaugcacguagagaaaaua

SEQ ID NO: 349811 - RNA, 22 nt, Homo sapiens
ucaaaugcucuuugcagagagg

SEQ ID NO: 349812 - RNA, 22 nt, Homo sapiens
ucaaaugcuguauuguaguaau

SEQ ID NO: 349813 - RNA, 22 nt, Homo sapiens
ucaacacaguuaaauggggaaa

SEQ ID NO: 349814 - RNA, 22 nt, Homo sapiens
ucaagaccucacauagaggaga

SEQ ID NO: 349815 - RNA, 18 nt, Homo sapiens
ucaagcaauugucaugcc

SEQ ID NO: 349816 - RNA, 22 nt, Homo sapiens
ucaaggcacuagcugagcugca

SEQ ID NO: 349817 - RNA, 22 nt, Homo sapiens
ucaaguacugccuugcucuggc

SEQ ID NO: 349818 - RNA, 22 nt, Homo sapiens
ucacaagcuccugccuuugcuu

SEQ ID NO: 349819 - RNA, 22 nt, Homo sapiens
ucacaagugagaggaauuagau

SEQ ID NO: 349820 - RNA, 21 nt, Homo sapiens
ucacaaugaacagcagcagaa

SEQ ID NO: 349821 - RNA, 22 nt, Homo sapiens
ucacacuguuuugauuauuaua

SEQ ID NO: 349822 - RNA, 22 nt, Homo sapiens
ucacagacugagccaaauagag

SEQ ID NO: 349823 - RNA, 22 nt, Homo sapiens
ucacagaugcuugacccauuuc

SEQ ID NO: 349824 - RNA, 18 nt, Homo sapiens
ucacagguaauuaggauu

SEQ ID NO: 349825 - RNA, 22 nt, Homo sapiens
ucacaguaaauccagaagaaau

SEQ ID NO: 349826 - RNA, 22 nt, Homo sapiens
ucacaguagggaacugacaaag

SEQ ID NO: 349827 - RNA, 20 nt, Homo sapiens
ucacagucacacauaauccu

SEQ ID NO: 349828 - RNA, 22 nt, Homo sapiens
ucacagugcaggaucaguuaau

SEQ ID NO: 349829 - RNA, 23 nt, Homo sapiens
ucacaguggcugcuuaauuguga

SEQ ID NO: 349830 - RNA, 22 nt, Homo sapiens
ucacaugaagauuuuaguauac

SEQ ID NO: 349831 - RNA, 22 nt, Homo sapiens
ucacaugaauugucuuguucca

SEQ ID NO: 349832 - RNA, 22 nt, Homo sapiens
ucacauggaggugauaguugaa

SEQ ID NO: 349833 - RNA, 22 nt, Homo sapiens
ucacaugucagccguggggaag

SEQ ID NO: 349834 - RNA, 22 nt, Homo sapiens
ucacauguguaaauugguguaa

SEQ ID NO: 349835 - RNA, 19 nt, Homo sapiens
ucaccaguacacaauacaa

SEQ ID NO: 349836 - RNA, 22 nt, Homo sapiens
ucaccuggagacaugaagacug

SEQ ID NO: 349837 - RNA, 22 nt, Homo sapiens
ucaccuguagcuaagaccuaau

SEQ ID NO: 349838 - RNA, 22 nt, Homo sapiens
ucacgugguucauaaggcagaa

SEQ ID NO: 349839 - RNA, 22 nt, Homo sapiens
ucacugagcuagaucacuugac

SEQ ID NO: 349840 - RNA, 22 nt, Homo sapiens
ucacugcacucuccgccuugcg

SEQ ID NO: 349841 - RNA, 22 nt, Homo sapiens
ucacugcgaccuccaccucccg

SEQ ID NO: 349842 - RNA, 19 nt, Homo sapiens
ucacuggacagcacacuca

SEQ ID NO: 349843 - RNA, 22 nt, Homo sapiens
ucacuggaggagaggaagugga

SEQ ID NO: 349844 - RNA, 22 nt, Homo sapiens
ucacuggagguuccugaaguuc

SEQ ID NO: 349845 - RNA, 22 nt, Homo sapiens
ucacugugguuggaaggcuuaa

SEQ ID NO: 349846 - RNA, 22 nt, Homo sapiens
ucacuuggccgcagccuucucu

SEQ ID NO: 349847 - RNA, 22 nt, Homo sapiens
auucagaggggcagcugucuug

SEQ ID NO: 349848 - RNA, 22 nt, Homo sapiens
auucaucagggauauuggucug

SEQ ID NO: 349849 - RNA, 22 nt, Homo sapiens
auucaugggagcuacuuuaaaa

SEQ ID NO: 349850 - RNA, 22 nt, Homo sapiens
auuccacagccgauaccaugac

SEQ ID NO: 349851 - RNA, 22 nt, Homo sapiens
auuccacuuacaugaaguaccu

SEQ ID NO: 349852 - RNA, 22 nt, Homo sapiens
auuccaguuguaagguuuuuca

SEQ ID NO: 349853 - RNA, 22 nt, Homo sapiens
auugaacaugccauauguacca

SEQ ID NO: 349854 - RNA, 20 nt, Homo sapiens
auugaacucaguauucugaa

SEQ ID NO: 349855 - RNA, 21 nt, Homo sapiens
auugagcacaugaaacauggc

SEQ ID NO: 349856 - RNA, 22 nt, Homo sapiens
auugagcacugacucugugcca

SEQ ID NO: 349857 - RNA, 22 nt, Homo sapiens
auugaggcauguaccaaugguc

SEQ ID NO: 349858 - RNA, 22 nt, Homo sapiens
auugcacacagaaucaggguaa

SEQ ID NO: 349859 - RNA, 19 nt, Homo sapiens
auugcacuccaaccugggu

SEQ ID NO: 349860 - RNA, 22 nt, Homo sapiens
auugcacuccagccugagcaaa

SEQ ID NO: 349861 - RNA, 22 nt, Homo sapiens
auugcacuccagccuggaugac

SEQ ID NO: 349862 - RNA, 22 nt, Homo sapiens
auugcacuccagccugggcgac

SEQ ID NO: 349863 - RNA, 22 nt, Homo sapiens
auugcacuccagccuugacaca

SEQ ID NO: 349864 - RNA, 22 nt, Homo sapiens
auugcacucuagccuuggcgac

SEQ ID NO: 349865 - RNA, 23 nt, Homo sapiens
auugcagucuugaacuccugggc

SEQ ID NO: 349866 - RNA, 22 nt, Homo sapiens
auugcaguuagaacagaagucu

SEQ ID NO: 349867 - RNA, 22 nt, Homo sapiens
auugcuuacuaaucaucuucag

SEQ ID NO: 349868 - RNA, 22 nt, Homo sapiens
auuggcaagauagcauaugagg

SEQ ID NO: 349869 - RNA, 22 nt, Homo sapiens
auuggguuaaaggauaugaaca

SEQ ID NO: 349870 - RNA, 22 nt, Homo sapiens
auuguacuccagccugggugac

SEQ ID NO: 349871 - RNA, 22 nt, Homo sapiens
auugucauuuucugagaaguaa

SEQ ID NO: 349872 - RNA, 22 nt, Homo sapiens
auuguguuugaaugaggcucca

SEQ ID NO: 349873 - RNA, 22 nt, Homo sapiens
auuguucuuacaugcugucauc

SEQ ID NO: 349874 - RNA, 22 nt, Homo sapiens
auuguucuuguguccuuuuccu

SEQ ID NO: 349875 - RNA, 22 nt, Homo sapiens
auuuaugguuaauauaggaagu

SEQ ID NO: 349876 - RNA, 22 nt, Homo sapiens
auuugacacugagagccucagu

SEQ ID NO: 349877 - RNA, 22 nt, Homo sapiens
auuuggcauagaguaucauucu

SEQ ID NO: 349878 - RNA, 20 nt, Homo sapiens
auuuggcauaguuuaagcaa

SEQ ID NO: 349879 - RNA, 22 nt, Homo sapiens
auuuggccuuuguaugcaguau

SEQ ID NO: 349880 - RNA, 22 nt, Homo sapiens
auuuggguuuuacaucaggcua

SEQ ID NO: 349881 - RNA, 22 nt, Homo sapiens
auuugucaauacacuucuucca

SEQ ID NO: 349882 - RNA, 22 nt, Homo sapiens
caaaagugguucuuauccuuuu

SEQ ID NO: 349883 - RNA, 22 nt, Homo sapiens
caaaccuguaggggccaagagg

SEQ ID NO: 349884 - RNA, 22 nt, Homo sapiens
caaaugacaucauuucauucaa

SEQ ID NO: 349885 - RNA, 22 nt, Homo sapiens
caaccaguagcugaguucaaaa

SEQ ID NO: 349886 - RNA, 22 nt, Homo sapiens
caacugcucacuccuggguuca

SEQ ID NO: 349887 - RNA, 22 nt, Homo sapiens
caagacuguccaacauauuggg

SEQ ID NO: 349888 - RNA, 22 nt, Homo sapiens
caaggaauucucaauagaguua

SEQ ID NO: 349889 - RNA, 22 nt, Homo sapiens
caagugaauaguugcucucaga

SEQ ID NO: 349890 - RNA, 21 nt, Homo sapiens
caagugaugcuucugcuuuaa

SEQ ID NO: 349891 - RNA, 22 nt, Homo sapiens
caaguguuuccuuaaauacuug

SEQ ID NO: 349892 - RNA, 22 nt, Homo sapiens
caaugcauuauucucccacuuc

SEQ ID NO: 349893 - RNA, 22 nt, Homo sapiens
caaugugcuuggggcacaugag

SEQ ID NO: 349894 - RNA, 22 nt, Homo sapiens
caauugcacucuuagguguaca

SEQ ID NO: 349895 - RNA, 22 nt, Homo sapiens
cacaaugucuaagauguuucua

SEQ ID NO: 349896 - RNA, 22 nt, Homo sapiens
cacagcgacuuccgccuaccgg

SEQ ID NO: 349897 - RNA, 23 nt, Homo sapiens
cacagggugaacaccccuaaucc

SEQ ID NO: 349898 - RNA, 22 nt, Homo sapiens
cacauguuuuagcauggcuguu

SEQ ID NO: 349899 - RNA, 22 nt, Homo sapiens
caccaaccucaguagcaucugu

SEQ ID NO: 349900 - RNA, 22 nt, Homo sapiens
cacccuaucagauguccagaga

SEQ ID NO: 349901 - RNA, 22 nt, Homo sapiens
caccgagguuggagugcagugg

SEQ ID NO: 349902 - RNA, 22 nt, Homo sapiens
cacugcacuccagcuugugggc

SEQ ID NO: 349903 - RNA, 22 nt, Homo sapiens
cacugcacuccagcuuugguga

SEQ ID NO: 349904 - RNA, 22 nt, Homo sapiens
cacugcacuccagucccgucuc

SEQ ID NO: 349905 - RNA, 22 nt, Homo sapiens
cacugcacuccagucuggcgac

SEQ ID NO: 349906 - RNA, 22 nt, Homo sapiens
cacugcacucuucuucugggca

SEQ ID NO: 349907 - RNA, 22 nt, Homo sapiens
cacugcauccucugccuggcgg

SEQ ID NO: 349908 - RNA, 22 nt, Homo sapiens
cacugcauccuugaccuucugg

SEQ ID NO: 349909 - RNA, 23 nt, Homo sapiens
cacugggcagcagguguucccag

SEQ ID NO: 349910 - RNA, 22 nt, Homo sapiens
cacugggugagauccauguuua

SEQ ID NO: 349911 - RNA, 22 nt, Homo sapiens
cagagaaugucuuuuuuaacca

SEQ ID NO: 349912 - RNA, 22 nt, Homo sapiens
cagcaguuguuucggauuggga

SEQ ID NO: 349913 - RNA, 22 nt, Homo sapiens
cagcccuacacagacugacuca

SEQ ID NO: 349914 - RNA, 22 nt, Homo sapiens
cagcucauugcagucucgaccu

SEQ ID NO: 349915 - RNA, 22 nt, Homo sapiens
cagcuggugggagcuggguucc

SEQ ID NO: 349916 - RNA, 22 nt, Homo sapiens
cagcugguguuacaaaccagag

SEQ ID NO: 349917 - RNA, 23 nt, Homo sapiens
cagcuucauugaacauaacuccu

SEQ ID NO: 349918 - RNA, 22 nt, Homo sapiens
caggcagugggagacaaaacug

SEQ ID NO: 349919 - RNA, 22 nt, Homo sapiens
cagguaagaugcuuucucuuau

SEQ ID NO: 349920 - RNA, 22 nt, Homo sapiens
cagguaguguguagcacagcag

SEQ ID NO: 349921 - RNA, 22 nt, Homo sapiens
cagugcacugggauuauaagug

SEQ ID NO: 349922 - RNA, 22 nt, Homo sapiens
cagugcauaggaucuaaaauuu

SEQ ID NO: 349923 - RNA, 22 nt, Homo sapiens
cagugcaugacuguauauuauc

SEQ ID NO: 349924 - RNA, 23 nt, Homo sapiens
cagugguguuagagaaaucuuuu

SEQ ID NO: 349925 - RNA, 22 nt, Homo sapiens
cagugucugcauuuggaacuca

SEQ ID NO: 349926 - RNA, 22 nt, Homo sapiens
caguucaugguaggcaccauag

SEQ ID NO: 349927 - RNA, 22 nt, Homo sapiens
caguugguguacauauauguau

SEQ ID NO: 349928 - RNA, 22 nt, Homo sapiens
cauacaagcuacaaucacaaag

SEQ ID NO: 349929 - RNA, 22 nt, Homo sapiens
cauagcacacauuuaccuaugu

SEQ ID NO: 349930 - RNA, 22 nt, Homo sapiens
cauagcacacguauaccuaugu

SEQ ID NO: 349931 - RNA, 19 nt, Homo sapiens
caucacagagucuuccauu

SEQ ID NO: 349932 - RNA, 22 nt, Homo sapiens
caucacagcaaguagggagugg

SEQ ID NO: 349933 - RNA, 22 nt, Homo sapiens
caucacaguacuaaucgucaua

SEQ ID NO: 349934 - RNA, 22 nt, Homo sapiens
caucagagugagauauaagauc

SEQ ID NO: 349935 - RNA, 22 nt, Homo sapiens
caucagauugagaucaucuaag

SEQ ID NO: 349936 - RNA, 22 nt, Homo sapiens
caucauugcacccuauagagaa

SEQ ID NO: 349937 - RNA, 22 nt, Homo sapiens
caucccugucgucaagucucug

SEQ ID NO: 349938 - RNA, 22 nt, Homo sapiens
caugacacauguuuaccuaugu

SEQ ID NO: 349939 - RNA, 22 nt, Homo sapiens
caugaugcuagguauggaugaa

SEQ ID NO: 349940 - RNA, 22 nt, Homo sapiens
cauggcacauauauaucuaggu

SEQ ID NO: 349941 - RNA, 22 nt, Homo sapiens
cauggcccuggguccauaggaa

SEQ ID NO: 349942 - RNA, 22 nt, Homo sapiens
cauggguuuucucaaguaguca

SEQ ID NO: 349943 - RNA, 22 nt, Homo sapiens
gcugcuguggcagauuggauuc

SEQ ID NO: 349944 - RNA, 22 nt, Homo sapiens
gcugcuguuauucaucagaacu

SEQ ID NO: 349945 - RNA, 22 nt, Homo sapiens
gcugcuguuuaguuucuccugg

SEQ ID NO: 349946 - RNA, 22 nt, Homo sapiens
gcuggauguuucaauacaaaua

SEQ ID NO: 349947 - RNA, 21 nt, Homo sapiens
gcugguaaucacuuugccaaa

SEQ ID NO: 349948 - RNA, 22 nt, Homo sapiens
gcuggucugccguaguaggugc

SEQ ID NO: 349949 - RNA, 22 nt, Homo sapiens
gcugguguucaggcccucaguc

SEQ ID NO: 349950 - RNA, 19 nt, Homo sapiens
gcuuguccacgugagauaa

SEQ ID NO: 349951 - RNA, 22 nt, Homo sapiens
gcuuguguucaagucacccuua

SEQ ID NO: 349952 - RNA, 22 nt, Homo sapiens
ggaagccuggaaaaaauuguga

SEQ ID NO: 349953 - RNA, 22 nt, Homo sapiens
ggaagguaauuggguaaugaga

SEQ ID NO: 349954 - RNA, 22 nt, Homo sapiens
ggaagugcuguguggaagucug

SEQ ID NO: 349955 - RNA, 22 nt, Homo sapiens
ggaaucugaaccaugggaaugg

SEQ ID NO: 349956 - RNA, 22 nt, Homo sapiens
ggaaugcagugagcauuagaua

SEQ ID NO: 349957 - RNA, 21 nt, Homo sapiens
ggaauguugccagcagccaga

SEQ ID NO: 349958 - RNA, 22 nt, Homo sapiens
ggacaagagacugggacacuga

SEQ ID NO: 349959 - RNA, 22 nt, Homo sapiens
ggacaucauuaccauggaccca

SEQ ID NO: 349960 - RNA, 22 nt, Homo sapiens
ggacuagaucucccggcuucua

SEQ ID NO: 349961 - RNA, 22 nt, Homo sapiens
ggagagcuaggcagagguuugu

SEQ ID NO: 349962 - RNA, 22 nt, Homo sapiens
ggagaguaauuagacugaaaga

SEQ ID NO: 349963 - RNA, 20 nt, Homo sapiens
ggagagugacauaauucugg

SEQ ID NO: 349964 - RNA, 22 nt, Homo sapiens
ggagauccucugcgggcaaaga

SEQ ID NO: 349965 - RNA, 22 nt, Homo sapiens
ggagcucaucuagcauagaggu

SEQ ID NO: 349966 - RNA, 22 nt, Homo sapiens
ggagggugagaucaauuuggga

SEQ ID NO: 349967 - RNA, 22 nt, Homo sapiens
ggagguagguuugugauuugua

SEQ ID NO: 349968 - RNA, 20 nt, Homo sapiens
ggagguguugauuuuucuuu

SEQ ID NO: 349969 - RNA, 22 nt, Homo sapiens
ggagugucagaaacaguguccu

SEQ ID NO: 349970 - RNA, 22 nt, Homo sapiens
ggaugcauuuuugguugucaca

SEQ ID NO: 349971 - RNA, 21 nt, Homo sapiens
ggcaagaaacacaaucaagua

SEQ ID NO: 349972 - RNA, 22 nt, Homo sapiens
ggcaagaaagaaaucaucuguc

SEQ ID NO: 349973 - RNA, 22 nt, Homo sapiens
ggcaagaaccacaauuacuuuu

SEQ ID NO: 349974 - RNA, 22 nt, Homo sapiens
ggcaagaagagaguuuaaacau

SEQ ID NO: 349975 - RNA, 22 nt, Homo sapiens
ggcaagauagauaucaguguca

SEQ ID NO: 349976 - RNA, 22 nt, Homo sapiens
ggcaagaucuuggcucacugaa

SEQ ID NO: 349977 - RNA, 22 nt, Homo sapiens
ggcaaggauuagauucuccccu

SEQ ID NO: 349978 - RNA, 19 nt, Homo sapiens
ggcaauacuuucuuguugg

SEQ ID NO: 349979 - RNA, 22 nt, Homo sapiens
ggcaccauggaaggacgggagc

SEQ ID NO: 349980 - RNA, 17 nt, Homo sapiens
ggcaggaauuaauguca

SEQ ID NO: 349981 - RNA, 22 nt, Homo sapiens
ggcaguguaauaauuuauuaau

SEQ ID NO: 349982 - RNA, 22 nt, Homo sapiens
ggcauguauucuuauuauuccu

SEQ ID NO: 349983 - RNA, 22 nt, Homo sapiens
ggcauguuuaguagaauguggu

SEQ ID NO: 349984 - RNA, 23 nt, Homo sapiens
ggcauuguggcucacaucuguaa

SEQ ID NO: 349985 - RNA, 22 nt, Homo sapiens
ggccagaugaucuaugaaggaa

SEQ ID NO: 349986 - RNA, 22 nt, Homo sapiens
ggccggguggccauggcugccc

SEQ ID NO: 349987 - RNA, 22 nt, Homo sapiens
ggcucagugaucuguuucugua

SEQ ID NO: 349988 - RNA, 21 nt, Homo sapiens
ggcucuguggucucagguuuc

SEQ ID NO: 349989 - RNA, 22 nt, Homo sapiens
ggcuuggaggaaugugagggcu

SEQ ID NO: 349990 - RNA, 22 nt, Homo sapiens
gggaagaaggagugguuuacuc

SEQ ID NO: 349991 - RNA, 22 nt, Homo sapiens
gggaggucauuguucaaugcug

SEQ ID NO: 349992 - RNA, 22 nt, Homo sapiens
gggaucauuuuucauccuacag

SEQ ID NO: 349993 - RNA, 22 nt, Homo sapiens
gggaugaagaagaauaguucgu

SEQ ID NO: 349994 - RNA, 20 nt, Homo sapiens
gggcaaguaugugggaaguc

SEQ ID NO: 349995 - RNA, 18 nt, Homo sapiens
gggcaaguugccuggcuu

SEQ ID NO: 349996 - RNA, 16 nt, Homo sapiens
gggcaugugaagccua

SEQ ID NO: 349997 - RNA, 22 nt, Homo sapiens
ggguaggcaagcggaugucaga

SEQ ID NO: 349998 - RNA, 17 nt, Homo sapiens
gggucaccuugcaggua

SEQ ID NO: 349999 - RNA, 22 nt, Homo sapiens
gggucauggaugugaagcuaga

SEQ ID NO: 350000 - RNA, 22 nt, Homo sapiens
ggucaacaucaucaugguaagu

SEQ ID NO: 350001 - RNA, 19 nt, Homo sapiens
ggucacagggguuacaagg

SEQ ID NO: 350002 - RNA, 19 nt, Homo sapiens
ggucagcaaagucuagcug

SEQ ID NO: 350003 - RNA, 19 nt, Homo sapiens
ggucauggagguuguguga

SEQ ID NO: 350004 - RNA, 22 nt, Homo sapiens
ggucuagagagagggguggacu

SEQ ID NO: 350005 - RNA, 21 nt, Homo sapiens
ggugagaaaggagacauagac

SEQ ID NO: 350006 - RNA, 22 nt, Homo sapiens
ggugagaaagggauuccuguuc

SEQ ID NO: 350007 - RNA, 19 nt, Homo sapiens
ggugagaaauuaugggucu

SEQ ID NO: 350008 - RNA, 22 nt, Homo sapiens
ggugagauguucagacgaacug

SEQ ID NO: 350009 - RNA, 23 nt, Homo sapiens
ggugaggaguacagagucuucau

SEQ ID NO: 350010 - RNA, 22 nt, Homo sapiens
ggugcagcacaccaacauggca

SEQ ID NO: 350011 - RNA, 22 nt, Homo sapiens
ggugcuugaggaacggaggcug

SEQ ID NO: 350012 - RNA, 22 nt, Homo sapiens
guaaaguaaagcacaucaaggu

SEQ ID NO: 350013 - RNA, 22 nt, Homo sapiens
guaacguaaugucaaaaucuau

SEQ ID NO: 350014 - RNA, 22 nt, Homo sapiens
guaagacuuauuuucuuuauca

SEQ ID NO: 350015 - RNA, 22 nt, Homo sapiens
guaaggcuguuaucuucacguc

SEQ ID NO: 350016 - RNA, 22 nt, Homo sapiens
guaaucucagcuacuugggagc

SEQ ID NO: 350017 - RNA, 19 nt, Homo sapiens
guaaucucaguacuuuggu

SEQ ID NO: 350018 - RNA, 22 nt, Homo sapiens
guacaguaguaaaagugaauga

SEQ ID NO: 350019 - RNA, 22 nt, Homo sapiens
guacaguucucuuuguugucag

SEQ ID NO: 350020 - RNA, 22 nt, Homo sapiens
guaccacaguugcucacggguu

SEQ ID NO: 350021 - RNA, 22 nt, Homo sapiens
guacugagagacaguuacuguu

SEQ ID NO: 350022 - RNA, 22 nt, Homo sapiens
guagaaaguuugcugucacaug

SEQ ID NO: 350023 - RNA, 22 nt, Homo sapiens
guagugcaguuugagaaucagu

SEQ ID NO: 350024 - RNA, 22 nt, Homo sapiens
guaucacacuuauugaccugca

SEQ ID NO: 350025 - RNA, 22 nt, Homo sapiens
guaucccuugcuaucugaaucu

SEQ ID NO: 350026 - RNA, 22 nt, Homo sapiens
guaugcacauauguguauguau

SEQ ID NO: 350027 - RNA, 18 nt, Homo sapiens
guauuccagccugaguga

SEQ ID NO: 350028 - RNA, 22 nt, Homo sapiens
guauuguacuacaagcucuuua

SEQ ID NO: 350029 - RNA, 22 nt, Homo sapiens
guauuugguuauugcagccuga

SEQ ID NO: 350030 - RNA, 22 nt, Homo sapiens
gucaaagugauuguaauuaggu

SEQ ID NO: 350031 - RNA, 22 nt, Homo sapiens
gucaagauuuguaggacagaga

SEQ ID NO: 350032 - RNA, 22 nt, Homo sapiens
gucacagaaaaagauaugccaa

SEQ ID NO: 350033 - RNA, 20 nt, Homo sapiens
gucacuggcccagggcuugu

SEQ ID NO: 350034 - RNA, 22 nt, Homo sapiens
gucacugggugcugcgccuguc

SEQ ID NO: 350035 - RNA, 22 nt, Homo sapiens
gucagcaaagaggaauaguuug

SEQ ID NO: 350036 - RNA, 22 nt, Homo sapiens
gucagcuuguccagagacucug

SEQ ID NO: 350037 - RNA, 22 nt, Homo sapiens
gucaggcaccgauacaguuuuu

SEQ ID NO: 350038 - RNA, 22 nt, Homo sapiens
gucagucugucccugccuggcg

SEQ ID NO: 350039 - RNA, 22 nt, Homo sapiens
gauggcagugcagccccuggcu

SEQ ID NO: 350040 - RNA, 22 nt, Homo sapiens
gauggugucccaggcucaggcu

SEQ ID NO: 350041 - RNA, 22 nt, Homo sapiens
gauguagaaagagugggcugga

SEQ ID NO: 350042 - RNA, 22 nt, Homo sapiens
gauguguuuccaggauuuguuu

SEQ ID NO: 350043 - RNA, 22 nt, Homo sapiens
gauuggcauugcugcaccugag

SEQ ID NO: 350044 - RNA, 21 nt, Homo sapiens
gcaaaguggcuaccuugcucc

SEQ ID NO: 350045 - RNA, 22 nt, Homo sapiens
gcaacugguuucaguuuuucag

SEQ ID NO: 350046 - RNA, 22 nt, Homo sapiens
gcaagaaugagaaggauuaauu

SEQ ID NO: 350047 - RNA, 22 nt, Homo sapiens
gcaagagguaucuuauuuuccc

SEQ ID NO: 350048 - RNA, 22 nt, Homo sapiens
gcaauacugacagcauuaguuu

SEQ ID NO: 350049 - RNA, 22 nt, Homo sapiens
gcaauguuacugaauguguuuu

SEQ ID NO: 350050 - RNA, 22 nt, Homo sapiens
gcacaguguuacuugauauauu

SEQ ID NO: 350051 - RNA, 22 nt, Homo sapiens
gcagagaaacaggucuaaggag

SEQ ID NO: 350052 - RNA, 22 nt, Homo sapiens
gcagcacaugacuguauguaua

SEQ ID NO: 350053 - RNA, 22 nt, Homo sapiens
gcagcacauggcagaacauauu

SEQ ID NO: 350054 - RNA, 20 nt, Homo sapiens
gcagcaccauauuucuaaga

SEQ ID NO: 350055 - RNA, 22 nt, Homo sapiens
gcagcaguggcaguuaauauuu

SEQ ID NO: 350056 - RNA, 22 nt, Homo sapiens
gcagcagugugggcugaaccua

SEQ ID NO: 350057 - RNA, 22 nt, Homo sapiens
gcagguaguuucugacuuuuac

SEQ ID NO: 350058 - RNA, 17 nt, Homo sapiens
gcaguacuuaguaagga

SEQ ID NO: 350059 - RNA, 22 nt, Homo sapiens
gcaguagugugaucuuggcuca

SEQ ID NO: 350060 - RNA, 22 nt, Homo sapiens
gcagugcaugacgguauauaua

SEQ ID NO: 350061 - RNA, 22 nt, Homo sapiens
gcagugugaucacagcuuacug

SEQ ID NO: 350062 - RNA, 22 nt, Homo sapiens
gcaguguggguagagggcaaga

SEQ ID NO: 350063 - RNA, 22 nt, Homo sapiens
uacaguggaaguuaaccccauu

SEQ ID NO: 350064 - RNA, 22 nt, Homo sapiens
uacaguggcaugucaggugcuu

SEQ ID NO: 350065 - RNA, 22 nt, Homo sapiens
uacaucagccugaaagagcucg

SEQ ID NO: 350066 - RNA, 22 nt, Homo sapiens
uacauguauccauuguuuuugg

SEQ ID NO: 350067 - RNA, 22 nt, Homo sapiens
uacauguauguguuuauggcug

SEQ ID NO: 350068 - RNA, 22 nt, Homo sapiens
uacaugugcacaacgugcaggu

SEQ ID NO: 350069 - RNA, 22 nt, Homo sapiens
uacauugcacuuuauuagauac

SEQ ID NO: 350070 - RNA, 22 nt, Homo sapiens
cuuuacaguuggacucacgagg

SEQ ID NO: 350071 - RNA, 22 nt, Homo sapiens
cuuuccauuguuggagcauaaa

SEQ ID NO: 350072 - RNA, 22 nt, Homo sapiens
cuuugauuauaaaaggguguuu

SEQ ID NO: 350073 - RNA, 20 nt, Homo sapiens
cuuuggcaaugagaacaggg

SEQ ID NO: 350074 - RNA, 22 nt, Homo sapiens
cuuuggcacuuccuaagugcca

SEQ ID NO: 350075 - RNA, 21 nt, Homo sapiens
cuuugguagaguuuuuagggu

SEQ ID NO: 350076 - RNA, 22 nt, Homo sapiens
cuuugguguauuuucagagacc

SEQ ID NO: 350077 - RNA, 22 nt, Homo sapiens
cuuugguugugcucuccacuuu

SEQ ID NO: 350078 - RNA, 23 nt, Homo sapiens
cuuuguccccacccaaaucucau

SEQ ID NO: 350079 - RNA, 22 nt, Homo sapiens
cuuuguguaggugccucuggcu

SEQ ID NO: 350080 - RNA, 22 nt, Homo sapiens
cuuuuacacuguuagugggaau

SEQ ID NO: 350081 - RNA, 22 nt, Homo sapiens
cuuuuggugguucugaugcagg

SEQ ID NO: 350082 - RNA, 22 nt, Homo sapiens
cuuuugugauuccucaguuacu

SEQ ID NO: 350083 - RNA, 22 nt, Homo sapiens
cuuuugugauucuucaguuacu

SEQ ID NO: 350084 - RNA, 21 nt, Homo sapiens
cuuuuuacucguucauaugca

SEQ ID NO: 350085 - RNA, 22 nt, Homo sapiens
gaaacugcauuucuaacaagcu

SEQ ID NO: 350086 - RNA, 22 nt, Homo sapiens
gaaagacuuucugcuguggaua

SEQ ID NO: 350087 - RNA, 22 nt, Homo sapiens
gaaagauuuccugagcuagaaa

SEQ ID NO: 350088 - RNA, 22 nt, Homo sapiens
gaaaguaauuaacgauuguugc

SEQ ID NO: 350089 - RNA, 21 nt, Homo sapiens
gaaauacugccuuaggagcug

SEQ ID NO: 350090 - RNA, 22 nt, Homo sapiens
gaaauggaucagagcaagcuuu

SEQ ID NO: 350091 - RNA, 22 nt, Homo sapiens
gaaggagcuuaucugccauuuc

SEQ ID NO: 350092 - RNA, 22 nt, Homo sapiens
gaaggcacugugugccacccug

SEQ ID NO: 350093 - RNA, 22 nt, Homo sapiens
gaaggugcuuggugaaugcauu

SEQ ID NO: 350094 - RNA, 22 nt, Homo sapiens
gaaguaguaaaauuuauugcag

SEQ ID NO: 350095 - RNA, 22 nt, Homo sapiens
gaauacugacuauuucaucugg

SEQ ID NO: 350096 - RNA, 22 nt, Homo sapiens
cuugagacauuguuuuccaagu

SEQ ID NO: 350097 - RNA, 22 nt, Homo sapiens
cuugcacuugaaauuccaguuu

SEQ ID NO: 350098 - RNA, 22 nt, Homo sapiens
cuugcagagcccauggauguca

SEQ ID NO: 350099 - RNA, 22 nt, Homo sapiens
cuugcagaggcccuggggagag

SEQ ID NO: 350100 - RNA, 22 nt, Homo sapiens
cuugcauuuuggagaaugcuga

SEQ ID NO: 350101 - RNA, 19 nt, Homo sapiens
cuugccccauucauccucu

SEQ ID NO: 350102 - RNA, 22 nt, Homo sapiens
cuuggcacgugauagguguuga

SEQ ID NO: 350103 - RNA, 22 nt, Homo sapiens
cuuggcuucuuuauguggcuau

SEQ ID NO: 350104 - RNA, 22 nt, Homo sapiens
cuuggcuugguaucaaauaacc

SEQ ID NO: 350105 - RNA, 18 nt, Homo sapiens
cuuugcagcuuccagagg

SEQ ID NO: 350106 - RNA, 22 nt, Homo sapiens
cuuuggauggaaccucucuuuc

SEQ ID NO: 350107 - RNA, 22 nt, Homo sapiens
cuuugguuaauaggauauggca

SEQ ID NO: 350108 - RNA, 21 nt, Homo sapiens
cuuugguuucugacuugcaua

SEQ ID NO: 350109 - RNA, 22 nt, Homo sapiens
cuuuguggggucuuuccucaaa

SEQ ID NO: 350110 - RNA, 22 nt, Homo sapiens
cuuuuacacuguuggcaggauu

SEQ ID NO: 350111 - RNA, 22 nt, Homo sapiens
cuuuugugauucuucaguugcu

SEQ ID NO: 350112 - RNA, 22 nt, Homo sapiens
cuuuuguggaucuucuguugcu

SEQ ID NO: 350113 - RNA, 22 nt, Homo sapiens
cuuuuugcaaauacaacucuga

SEQ ID NO: 350114 - RNA, 18 nt, Homo sapiens
gaaaugccucuugcuuac

SEQ ID NO: 350115 - RNA, 22 nt, Homo sapiens
gaaauguuuuucaugugggcaa

SEQ ID NO: 350116 - RNA, 22 nt, Homo sapiens
gaacugggguuggguugcgaua

SEQ ID NO: 350117 - RNA, 22 nt, Homo sapiens
gaacuuguguugcuucacaugu

SEQ ID NO: 350118 - RNA, 22 nt, Homo sapiens
gaagaaguacaagacaaauuuu

SEQ ID NO: 350119 - RNA, 22 nt, Homo sapiens
gaagauaucuaguaccauuguc

SEQ ID NO: 350120 - RNA, 22 nt, Homo sapiens
gaagcagcauucugguuuuugg

SEQ ID NO: 350121 - RNA, 22 nt, Homo sapiens
gaagguacgcuuaggaaaugau

SEQ ID NO: 350122 - RNA, 23 nt, Homo sapiens
gaaguauagcaugcacauggaaa

SEQ ID NO: 350123 - RNA, 22 nt, Homo sapiens
gaagugguaggauugcuuuuga

SEQ ID NO: 350124 - RNA, 17 nt, Homo sapiens
gaaguguuucuucauga

SEQ ID NO: 350125 - RNA, 22 nt, Homo sapiens
gaauacuguccaagagugaugg

SEQ ID NO: 350126 - RNA, 22 nt, Homo sapiens
gaauagugcugcaagaaacaua

SEQ ID NO: 350127 - RNA, 22 nt, Homo sapiens
gaaucacagauuaugaguaucu

SEQ ID NO: 350128 - RNA, 22 nt, Homo sapiens
gaaucauuggguugauucaaga

SEQ ID NO: 350129 - RNA, 22 nt, Homo sapiens
gaaugucuuauugcucguugua

SEQ ID NO: 350130 - RNA, 22 nt, Homo sapiens
gacacuggguguuuguuggcgu

SEQ ID NO: 350131 - RNA, 22 nt, Homo sapiens
gacagacacaauugauccauga

SEQ ID NO: 350132 - RNA, 22 nt, Homo sapiens
gacagugugauacuuagucuca

SEQ ID NO: 350133 - RNA, 22 nt, Homo sapiens
gacaguguggcgauuccucaag

SEQ ID NO: 350134 - RNA, 18 nt, Homo sapiens
gacaguguggugauuccu

SEQ ID NO: 350135 - RNA, 22 nt, Homo sapiens
gacauguaaggcucucucuguu

SEQ ID NO: 350136 - RNA, 22 nt, Homo sapiens
gacauguuuucaagauuuauaa

SEQ ID NO: 350137 - RNA, 21 nt, Homo sapiens
gaccacagcagggaaugucag

SEQ ID NO: 350138 - RNA, 22 nt, Homo sapiens
gaccuaggaggauugcuugagc

SEQ ID NO: 350139 - RNA, 22 nt, Homo sapiens
gacuacaacuucuauuauucag

SEQ ID NO: 350140 - RNA, 22 nt, Homo sapiens
gacuagauauuguucuauguca

SEQ ID NO: 350141 - RNA, 22 nt, Homo sapiens
gacugaggaagcgcucucuccu

SEQ ID NO: 350142 - RNA, 22 nt, Homo sapiens
gacugaguaagcagaagcaauu

SEQ ID NO: 350143 - RNA, 22 nt, Homo sapiens
gacugcauuugccccaucgaau

SEQ ID NO: 350144 - RNA, 20 nt, Homo sapiens
gacuucagaagcuucagagu

SEQ ID NO: 350145 - RNA, 22 nt, Homo sapiens
gagaacuggcgugaacugcacg

SEQ ID NO: 350146 - RNA, 22 nt, Homo sapiens
gagaaguaaauuuauuugcaaa

SEQ ID NO: 350147 - RNA, 22 nt, Homo sapiens
gagaagugcgucguuugaugau

SEQ ID NO: 350148 - RNA, 20 nt, Homo sapiens
gagaccugagauucacucaa

SEQ ID NO: 350149 - RNA, 22 nt, Homo sapiens
gagacggagucucgcucuguca

SEQ ID NO: 350150 - RNA, 22 nt, Homo sapiens
gagacugagucucacucuguca

SEQ ID NO: 350151 - RNA, 21 nt, Homo sapiens
gagaggauucgccagccucuu

SEQ ID NO: 350152 - RNA, 22 nt, Homo sapiens
gagagguaguuuuuuggucguc

SEQ ID NO: 350153 - RNA, 22 nt, Homo sapiens
gagaucacuucuguauucuaca

SEQ ID NO: 350154 - RNA, 22 nt, Homo sapiens
gagaucauucugauccagaguc

SEQ ID NO: 350155 - RNA, 23 nt, Homo sapiens
gagaucauucuggaauuagagug

SEQ ID NO: 350156 - RNA, 22 nt, Homo sapiens
gagauggagucuuuuucuguca

SEQ ID NO: 350157 - RNA, 22 nt, Homo sapiens
gagaugucuauuucagagaugu

SEQ ID NO: 350158 - RNA, 22 nt, Homo sapiens
gagcacauguggagagucuggg

SEQ ID NO: 350159 - RNA, 21 nt, Homo sapiens
gagcacauuguccucuaacgc

SEQ ID NO: 350160 - RNA, 18 nt, Homo sapiens
gagcaccuuuuuugcaga

SEQ ID NO: 350161 - RNA, 22 nt, Homo sapiens
gagcaucauggggccaaagcgc

SEQ ID NO: 350162 - RNA, 20 nt, Homo sapiens
gagcucaucuucuuuaccac

SEQ ID NO: 350163 - RNA, 22 nt, Homo sapiens
gagcucauuaaaaauguagaau

SEQ ID NO: 350164 - RNA, 22 nt, Homo sapiens
gagcugaucuuuauguaaauuc

SEQ ID NO: 350165 - RNA, 22 nt, Homo sapiens
gagcuguugguuugaaagaauu

SEQ ID NO: 350166 - RNA, 22 nt, Homo sapiens
gaggaaguaauuuuaggccugu

SEQ ID NO: 350167 - RNA, 22 nt, Homo sapiens
gaggacauuaugcuaaguggaa

SEQ ID NO: 350168 - RNA, 22 nt, Homo sapiens
gaggagucagacugugcaaggu

SEQ ID NO: 350169 - RNA, 22 nt, Homo sapiens
gaggcaguguguccguucucgg

SEQ ID NO: 350170 - RNA, 22 nt, Homo sapiens
gaggcauuauucccaucuuaca

SEQ ID NO: 350171 - RNA, 22 nt, Homo sapiens
gagguagagacuauguauuaga

SEQ ID NO: 350172 - RNA, 22 nt, Homo sapiens
gaggucauguggcaggcagcca

SEQ ID NO: 350173 - RNA, 22 nt, Homo sapiens
gaguaaauguccuagcuucuug

SEQ ID NO: 350174 - RNA, 23 nt, Homo sapiens
gaguggagacucauugauuuccu

SEQ ID NO: 350175 - RNA, 22 nt, Homo sapiens
gaguggugguucugaaacuuuu

SEQ ID NO: 350176 - RNA, 22 nt, Homo sapiens
gaguucauaucuaugagugugc

SEQ ID NO: 350177 - RNA, 22 nt, Homo sapiens
gaguuccuuugagccugagagg

SEQ ID NO: 350178 - RNA, 22 nt, Homo sapiens
gauaaaguauuggguacuaugc

SEQ ID NO: 350179 - RNA, 22 nt, Homo sapiens
gauauguaaaaauuauaucuga

SEQ ID NO: 350180 - RNA, 22 nt, Homo sapiens
gauauguaguaguugaaaaaga

SEQ ID NO: 350181 - RNA, 22 nt, Homo sapiens
gauauguuagggggagaaguua

SEQ ID NO: 350182 - RNA, 22 nt, Homo sapiens
gauauuacuuccaauauugcaa

SEQ ID NO: 350183 - RNA, 22 nt, Homo sapiens
gaucacauuguuucauacauau

SEQ ID NO: 350184 - RNA, 22 nt, Homo sapiens
gaugacagcugacucccuugcu

SEQ ID NO: 350185 - RNA, 22 nt, Homo sapiens
gaugacuaagaauuuuauaauu

SEQ ID NO: 350186 - RNA, 22 nt, Homo sapiens
gaugagaugagcauuugaauug

SEQ ID NO: 350187 - RNA, 22 nt, Homo sapiens
gaugagauguucucauggauug

SEQ ID NO: 350188 - RNA, 22 nt, Homo sapiens
gaugccuuuuuguccucaguua

SEQ ID NO: 350189 - RNA, 22 nt, Homo sapiens
gauggaguugacuaagacaaca

SEQ ID NO: 350190 - RNA, 22 nt, Homo sapiens
gauggcacuuaagagcaagagc

SEQ ID NO: 350191 - RNA, 22 nt, Homo sapiens
uugugucccugcccaaaucuca

SEQ ID NO: 350192 - RNA, 22 nt, Homo sapiens
uuguguuugaugcugacacgca

SEQ ID NO: 350193 - RNA, 22 nt, Homo sapiens
uuguuauguuaaacuacugaaa

SEQ ID NO: 350194 - RNA, 23 nt, Homo sapiens
uuguucccuuccacucagucucc

SEQ ID NO: 350195 - RNA, 22 nt, Homo sapiens
uuuaacauuggaugagaucguc

SEQ ID NO: 350196 - RNA, 17 nt, Homo sapiens
uuuaaugcuaggacucu

SEQ ID NO: 350197 - RNA, 22 nt, Homo sapiens
uuuaauguuacaguauugguau

SEQ ID NO: 350198 - RNA, 22 nt, Homo sapiens
uuuagcaaagcaauuuacacca

SEQ ID NO: 350199 - RNA, 22 nt, Homo sapiens
uuuagcaauucauuuugugucu

SEQ ID NO: 350200 - RNA, 22 nt, Homo sapiens
uuuaggcaauauauucaugucu

SEQ ID NO: 350201 - RNA, 22 nt, Homo sapiens
uuuauugcucuaaaguugccau

SEQ ID NO: 350202 - RNA, 22 nt, Homo sapiens
uuucacagcugucuuccgucuc

SEQ ID NO: 350203 - RNA, 22 nt, Homo sapiens
uuucagguauuuaagggccguu

SEQ ID NO: 350204 - RNA, 20 nt, Homo sapiens
uuucaguacuuucuacuggc

SEQ ID NO: 350205 - RNA, 22 nt, Homo sapiens
uuucaucaagcacagaguagau

SEQ ID NO: 350206 - RNA, 22 nt, Homo sapiens
uuucaucagccagggucagucu

SEQ ID NO: 350207 - RNA, 16 nt, Homo sapiens
uuucaucaguuuuaau

SEQ ID NO: 350208 - RNA, 22 nt, Homo sapiens
uuucauggaauauagucauuuu

SEQ ID NO: 350209 - RNA, 22 nt, Homo sapiens
uuucauggaggauuugcuucuu

SEQ ID NO: 350210 - RNA, 22 nt, Homo sapiens
uuucauggaggcauuuuagauu

SEQ ID NO: 350211 - RNA, 22 nt, Homo sapiens
uuuccaguuguucuagaaagcu

SEQ ID NO: 350212 - RNA, 22 nt, Homo sapiens
uuucccauuguucugcucugug

SEQ ID NO: 350213 - RNA, 22 nt, Homo sapiens
aaauuguccuacugguuugagu

SEQ ID NO: 350214 - RNA, 22 nt, Homo sapiens
aacaccauucucuguaacaaga

SEQ ID NO: 350215 - RNA, 22 nt, Homo sapiens
aacacuggcugcucgaguucuc

SEQ ID NO: 350216 - RNA, 22 nt, Homo sapiens
aacacuguuuccagucaugauc

SEQ ID NO: 350217 - RNA, 22 nt, Homo sapiens
aacagauugcugagccccaccc

SEQ ID NO: 350218 - RNA, 22 nt, Homo sapiens
aacagucaauugcugaugaccu

SEQ ID NO: 350219 - RNA, 21 nt, Homo sapiens
aacagugcugaacagacaccu

SEQ ID NO: 350220 - RNA, 22 nt, Homo sapiens
aacagugcuucauucacacauu

SEQ ID NO: 350221 - RNA, 22 nt, Homo sapiens
aacugcacauauuuguaugggu

SEQ ID NO: 350222 - RNA, 22 nt, Homo sapiens
aacugccucugacauaggcagg

SEQ ID NO: 350223 - RNA, 22 nt, Homo sapiens
aagacuguaauccaucuugagu

SEQ ID NO: 350224 - RNA, 22 nt, Homo sapiens
aagagaacugacaguaccuggg

SEQ ID NO: 350225 - RNA, 22 nt, Homo sapiens
aagagguaauaacaaagcuucu

SEQ ID NO: 350226 - RNA, 22 nt, Homo sapiens
aagaugauguucuuuuucuuag

SEQ ID NO: 350227 - RNA, 22 nt, Homo sapiens
aagaugcagucauacuggagga

SEQ ID NO: 350228 - RNA, 22 nt, Homo sapiens
aagcaacacaucugccccgguu

SEQ ID NO: 350229 - RNA, 22 nt, Homo sapiens
aagcaggugaugagugggugug

SEQ ID NO: 350230 - RNA, 22 nt, Homo sapiens
aagcaggugucugugucuguaa

SEQ ID NO: 350231 - RNA, 22 nt, Homo sapiens
aagcccauuguaaguugaggag

SEQ ID NO: 350232 - RNA, 22 nt, Homo sapiens
aagcuggagugcaguggugcaa

SEQ ID NO: 350233 - RNA, 22 nt, Homo sapiens
aagcuggauuucgcauccuguu

SEQ ID NO: 350234 - RNA, 22 nt, Homo sapiens
aagcuggcuuucauugagugcu

SEQ ID NO: 350235 - RNA, 22 nt, Homo sapiens
aagcuguguguaagcucucaca

SEQ ID NO: 350236 - RNA, 23 nt, Homo sapiens
aaggacacugaacacuucccagc

SEQ ID NO: 350237 - RNA, 22 nt, Homo sapiens
aaggagcuuaagugacuuguac

SEQ ID NO: 350238 - RNA, 22 nt, Homo sapiens
aaggaguagacaacauggcgcc

SEQ ID NO: 350239 - RNA, 22 nt, Homo sapiens
aaggcaagaaaauggauucucc

SEQ ID NO: 350240 - RNA, 22 nt, Homo sapiens
aaggcaagaaugcgugcuuuca

SEQ ID NO: 350241 - RNA, 22 nt, Homo sapiens
aaggcacugaacuuaaauucug

SEQ ID NO: 350242 - RNA, 21 nt, Homo sapiens
aaggugguggugauugagaug

SEQ ID NO: 350243 - RNA, 22 nt, Homo sapiens
aaguaaauauccgguaguccca

SEQ ID NO: 350244 - RNA, 22 nt, Homo sapiens
aaguauuagcuaauugugcuua

SEQ ID NO: 350245 - RNA, 22 nt, Homo sapiens
aaguccccugacagaggggagg

SEQ ID NO: 350246 - RNA, 19 nt, Homo sapiens
aagugaaugcuuuguucac

SEQ ID NO: 350247 - RNA, 22 nt, Homo sapiens
aagugaauucauuguguuauau

SEQ ID NO: 350248 - RNA, 22 nt, Homo sapiens
aagugagugacaaaaacugggc

SEQ ID NO: 350249 - RNA, 22 nt, Homo sapiens
aauaaagcagcuuuuugggacu

SEQ ID NO: 350250 - RNA, 22 nt, Homo sapiens
aauaaagcaggguccuugcacu

SEQ ID NO: 350251 - RNA, 22 nt, Homo sapiens
aauaagaaguggaagggaccgg

SEQ ID NO: 350252 - RNA, 21 nt, Homo sapiens
aauacucuagguuaagagagc

SEQ ID NO: 350253 - RNA, 22 nt, Homo sapiens
aauacugagaugugagguacua

SEQ ID NO: 350254 - RNA, 22 nt, Homo sapiens
aauagcuguuuuuaauuccugc

SEQ ID NO: 350255 - RNA, 22 nt, Homo sapiens
aauagugcugugcagugagugg

SEQ ID NO: 350256 - RNA, 22 nt, Homo sapiens
aauaucacaggguguacacuca

SEQ ID NO: 350257 - RNA, 22 nt, Homo sapiens
aauaugucugcuaauuguuucu

SEQ ID NO: 350258 - RNA, 22 nt, Homo sapiens
aaucacauuaaugcucccucag

SEQ ID NO: 350259 - RNA, 22 nt, Homo sapiens
aaucaccaugcacuacagccuu

SEQ ID NO: 350260 - RNA, 22 nt, Homo sapiens
aaucucagagauaucugugucc

SEQ ID NO: 350261 - RNA, 22 nt, Homo sapiens
aaucugucuagacaaggagucu

SEQ ID NO: 350262 - RNA, 22 nt, Homo sapiens
aaugacacugagcaucuuucau

SEQ ID NO: 350263 - RNA, 22 nt, Homo sapiens
aaugacagugcuaaagaacccu

SEQ ID NO: 350264 - RNA, 22 nt, Homo sapiens
aaugacugugauauuuuucuuc

SEQ ID NO: 350265 - RNA, 22 nt, Homo sapiens
aaugauauguuauguuuagguu

SEQ ID NO: 350266 - RNA, 22 nt, Homo sapiens
aaugccaucagagaaaacucuu

SEQ ID NO: 350267 - RNA, 22 nt, Homo sapiens
aaugccuagugugugacaggug

SEQ ID NO: 350268 - RNA, 22 nt, Homo sapiens
aaugcuguguuauuucaugacc

SEQ ID NO: 350269 - RNA, 22 nt, Homo sapiens
aauggcaagagccacagaggcg

SEQ ID NO: 350270 - RNA, 22 nt, Homo sapiens
aauggcaucuacguuaaauguc

SEQ ID NO: 350271 - RNA, 19 nt, Homo sapiens
aauggcuuuuccuguuccc

SEQ ID NO: 350272 - RNA, 18 nt, Homo sapiens
aaugggacuacaaagcca

SEQ ID NO: 350273 - RNA, 22 nt, Homo sapiens
aaugggacugacgccucccaga

SEQ ID NO: 350274 - RNA, 22 nt, Homo sapiens
aaugugccuacuggagcuugca

SEQ ID NO: 350275 - RNA, 22 nt, Homo sapiens
aaugugcuuugaaaagagcuga

SEQ ID NO: 350276 - RNA, 22 nt, Homo sapiens
aauucuguauuguuuagggacu

SEQ ID NO: 350277 - RNA, 22 nt, Homo sapiens
aauugcaauggacaaugcagca

SEQ ID NO: 350278 - RNA, 23 nt, Homo sapiens
aauugcuuuugaggacuuaguug

SEQ ID NO: 350279 - RNA, 22 nt, Homo sapiens
aauuguacucccaucauuccua

SEQ ID NO: 350280 - RNA, 22 nt, Homo sapiens
acaaaguauggaauguuggugu

SEQ ID NO: 350281 - RNA, 22 nt, Homo sapiens
acaagcacaaauuuaauccugu

SEQ ID NO: 350282 - RNA, 22 nt, Homo sapiens
acacagucaaauccacuuggcu

SEQ ID NO: 350283 - RNA, 22 nt, Homo sapiens
acacaguguuuauugugguuag

SEQ ID NO: 350284 - RNA, 22 nt, Homo sapiens
acacguguugaaauuuaauugc

SEQ ID NO: 350285 - RNA, 22 nt, Homo sapiens
acacucuaguguucuuaaucag

SEQ ID NO: 350286 - RNA, 22 nt, Homo sapiens
acacuggaguuaaaggugauuu

SEQ ID NO: 350287 - RNA, 20 nt, Homo sapiens
acacugugcuaaggauuuuc

SEQ ID NO: 350288 - RNA, 22 nt, Homo sapiens
acacuguuggugggaguguaaa

SEQ ID NO: 350289 - RNA, 22 nt, Homo sapiens
acagaucagagauauuuagguu

SEQ ID NO: 350290 - RNA, 22 nt, Homo sapiens
acagugacagaaagcugauuau

SEQ ID NO: 350291 - RNA, 18 nt, Homo sapiens
acagugcuggcaugagau

SEQ ID NO: 350292 - RNA, 22 nt, Homo sapiens
acagugcuucugauaugaugcc

SEQ ID NO: 350293 - RNA, 22 nt, Homo sapiens
acaguguacaauagccuuuuaa

SEQ ID NO: 350294 - RNA, 18 nt, Homo sapiens
acagugucauggcucaau

SEQ ID NO: 350295 - RNA, 22 nt, Homo sapiens
acauaaagaagcaggacauugu

SEQ ID NO: 350296 - RNA, 22 nt, Homo sapiens
acaucaggcuugugaugauuac

SEQ ID NO: 350297 - RNA, 22 nt, Homo sapiens
acaucauugggggcuacaggug

SEQ ID NO: 350298 - RNA, 22 nt, Homo sapiens
acauccauuugcuuuauuugcu

SEQ ID NO: 350299 - RNA, 18 nt, Homo sapiens
acaucccaugcuggggug

SEQ ID NO: 350300 - RNA, 22 nt, Homo sapiens
acaucccuuucccacccuucac

SEQ ID NO: 350301 - RNA, 22 nt, Homo sapiens
acaugacauugggguggggaua

SEQ ID NO: 350302 - RNA, 22 nt, Homo sapiens
acaugcauccaugugaagagac

SEQ ID NO: 350303 - RNA, 22 nt, Homo sapiens
acaugcauggcaugcauuguac

SEQ ID NO: 350304 - RNA, 22 nt, Homo sapiens
acauggcacugcgggcuucuug

SEQ ID NO: 350305 - RNA, 22 nt, Homo sapiens
acauggcuuaugaauuuggaga

SEQ ID NO: 350306 - RNA, 21 nt, Homo sapiens
acauguacacauguaugcaca

SEQ ID NO: 350307 - RNA, 22 nt, Homo sapiens
accaccauugcacugaacuuuc

SEQ ID NO: 350308 - RNA, 22 nt, Homo sapiens
uugagggaagccagaggucugc

SEQ ID NO: 350309 - RNA, 22 nt, Homo sapiens
uugagggagccuguuagucccg

SEQ ID NO: 350310 - RNA, 22 nt, Homo sapiens
uugagggaggcagggcuugucu

SEQ ID NO: 350311 - RNA, 22 nt, Homo sapiens
uugagugaaugaaugauuaaau

SEQ ID NO: 350312 - RNA, 22 nt, Homo sapiens
uugaguuuaucuaaagaccugg

SEQ ID NO: 350313 - RNA, 22 nt, Homo sapiens
uugauaauguuaacuuugguca

SEQ ID NO: 350314 - RNA, 22 nt, Homo sapiens
uugauagaucagggauuugauu

SEQ ID NO: 350315 - RNA, 22 nt, Homo sapiens
uugauauguggaauauuuaucu

SEQ ID NO: 350316 - RNA, 22 nt, Homo sapiens
uugaucaaaucugagugagaau

SEQ ID NO: 350317 - RNA, 22 nt, Homo sapiens
uugaugauguuucugccuugcc

SEQ ID NO: 350318 - RNA, 22 nt, Homo sapiens
uugcaaacaucuuguuucacau

SEQ ID NO: 350319 - RNA, 22 nt, Homo sapiens
uugcaaagaccucuucacuucc

SEQ ID NO: 350320 - RNA, 22 nt, Homo sapiens
uugcaacuuagaaaaaucauuu

SEQ ID NO: 350321 - RNA, 22 nt, Homo sapiens
uugcacuccagccugggugaca

SEQ ID NO: 350322 - RNA, 22 nt, Homo sapiens
uugcacuccagcucgggugaca

SEQ ID NO: 350323 - RNA, 22 nt, Homo sapiens
uugcacuccggccuggguaaca

SEQ ID NO: 350324 - RNA, 22 nt, Homo sapiens
uugcacucuccagccucggcaa

SEQ ID NO: 350325 - RNA, 22 nt, Homo sapiens
uugcagugguuucacuggcaaa

SEQ ID NO: 350326 - RNA, 22 nt, Homo sapiens
uugcagugugacgacuauauuu

SEQ ID NO: 350327 - RNA, 19 nt, Homo sapiens
uugcauauguugaaccagc

SEQ ID NO: 350328 - RNA, 22 nt, Homo sapiens
uugcaugcuccuuaugagaauc

SEQ ID NO: 350329 - RNA, 22 nt, Homo sapiens
uugcaugggagcugggugaagc

SEQ ID NO: 350330 - RNA, 22 nt, Homo sapiens
uugcaugguuuuuaucugaaau

SEQ ID NO: 350331 - RNA, 22 nt, Homo sapiens
uugcauguacguacagagagag

SEQ ID NO: 350332 - RNA, 22 nt, Homo sapiens
uugcccuuuagguaacuauaua

SEQ ID NO: 350333 - RNA, 22 nt, Homo sapiens
uugcggcaguacagcccaggua

SEQ ID NO: 350334 - RNA, 22 nt, Homo sapiens
uugcuacauugauugccucuuu

SEQ ID NO: 350335 - RNA, 22 nt, Homo sapiens
uugcuagagaugagggaugugu

SEQ ID NO: 350336 - RNA, 22 nt, Homo sapiens
uugcuagaugaaaaugguaccu

SEQ ID NO: 350337 - RNA, 22 nt, Homo sapiens
uugcucaggcuagaguucagcu

SEQ ID NO: 350338 - RNA, 22 nt, Homo sapiens
uuggaaauauguuaagugucau

SEQ ID NO: 350339 - RNA, 20 nt, Homo sapiens
uuggaaaugugaauugggag

SEQ ID NO: 350340 - RNA, 22 nt, Homo sapiens
uuggaacuguucguauugaaau

SEQ ID NO: 350341 - RNA, 22 nt, Homo sapiens
uuggaagacauucugucugcua

SEQ ID NO: 350342 - RNA, 23 nt, Homo sapiens
uuggaaugagaccuaagaguuuu

SEQ ID NO: 350343 - RNA, 22 nt, Homo sapiens
uuggaauuuuacuucuguaaga

SEQ ID NO: 350344 - RNA, 22 nt, Homo sapiens
uuggacaagauugcagagaauu

SEQ ID NO: 350345 - RNA, 22 nt, Homo sapiens
uuggagagagaggacucccggc

SEQ ID NO: 350346 - RNA, 22 nt, Homo sapiens
uuggagagucacuaguuagugc

SEQ ID NO: 350347 - RNA, 22 nt, Homo sapiens
uuggagugugcucauaacugcu

SEQ ID NO: 350348 - RNA, 22 nt, Homo sapiens
uuggauuauaaacugagauuug

SEQ ID NO: 350349 - RNA, 22 nt, Homo sapiens
uuggcaaaugucacaaaucagg

SEQ ID NO: 350350 - RNA, 22 nt, Homo sapiens
uuggcacugagcaagaacaggg

SEQ ID NO: 350351 - RNA, 22 nt, Homo sapiens
uuggcauuguggauggaaucau

SEQ ID NO: 350352 - RNA, 22 nt, Homo sapiens
uuggcauuuuggacacccagga

SEQ ID NO: 350353 - RNA, 22 nt, Homo sapiens
uuggccccuuucauccacagcu

SEQ ID NO: 350354 - RNA, 22 nt, Homo sapiens
uuggcuguguuccucaaggagu

SEQ ID NO: 350355 - RNA, 22 nt, Homo sapiens
uugggcaauaggaagcaggugg

SEQ ID NO: 350356 - RNA, 22 nt, Homo sapiens
uugggguaggaauauggaauga

SEQ ID NO: 350357 - RNA, 22 nt, Homo sapiens
uugguaaugggcugguauaacc

SEQ ID NO: 350358 - RNA, 22 nt, Homo sapiens
uugguccccuucaaccagcugu

SEQ ID NO: 350359 - RNA, 22 nt, Homo sapiens
uuggucucuuaaucacacuuuu

SEQ ID NO: 350360 - RNA, 22 nt, Homo sapiens
uugguucucuuuauaugcugga

SEQ ID NO: 350361 - RNA, 19 nt, Homo sapiens
uugguugguuauuucuuac

SEQ ID NO: 350362 - RNA, 22 nt, Homo sapiens
uuguaaagaucauaugcuguuc

SEQ ID NO: 350363 - RNA, 22 nt, Homo sapiens
uuguagaucuucaguugcuaca

SEQ ID NO: 350364 - RNA, 22 nt, Homo sapiens
uuguauacucuauuuuagcagu

SEQ ID NO: 350365 - RNA, 22 nt, Homo sapiens
uuguauguaaccauuuggcaaa

SEQ ID NO: 350366 - RNA, 22 nt, Homo sapiens
uugucaaacucauucuccaucc

SEQ ID NO: 350367 - RNA, 22 nt, Homo sapiens
uugucacugcacuccagucugg

SEQ ID NO: 350368 - RNA, 22 nt, Homo sapiens
uugucaguguucacucaaagcu

SEQ ID NO: 350369 - RNA, 22 nt, Homo sapiens
uuguccaagucccauuuguuga

SEQ ID NO: 350370 - RNA, 21 nt, Homo sapiens
uugucuagagaaauauaucuc

SEQ ID NO: 350371 - RNA, 22 nt, Homo sapiens
uugucucacuggaguuuaguaa

SEQ ID NO: 350372 - RNA, 19 nt, Homo sapiens
uugucuuagaguugucauu

SEQ ID NO: 350373 - RNA, 22 nt, Homo sapiens
uugugaauggaguagcaggauc

SEQ ID NO: 350374 - RNA, 22 nt, Homo sapiens
uugugaauggugccgcaauaaa

SEQ ID NO: 350375 - RNA, 22 nt, Homo sapiens
uugugcaugaugcauacauggu

SEQ ID NO: 350376 - RNA, 22 nt, Homo sapiens
uugugcuucaucaccuagcaga

SEQ ID NO: 350377 - RNA, 22 nt, Homo sapiens
uugugcuugcuguguucuaugc

SEQ ID NO: 350378 - RNA, 22 nt, Homo sapiens
uugugcuuuacuuacuaccaga

SEQ ID NO: 350379 - RNA, 22 nt, Homo sapiens
uuguggcuuaucucauuuagcg

SEQ ID NO: 350380 - RNA, 19 nt, Homo sapiens
uugugggaggacagagggg

SEQ ID NO: 350381 - RNA, 22 nt, Homo sapiens
uugugguuauagagucucccug

SEQ ID NO: 350382 - RNA, 22 nt, Homo sapiens
uugugguugauacacguaggaa

SEQ ID NO: 350383 - RNA, 22 nt, Homo sapiens
uugugucaaauggcaauuagca

SEQ ID NO: 350384 - RNA, 22 nt, Homo sapiens
aaauggcuuugaggguaggaca

SEQ ID NO: 350385 - RNA, 21 nt, Homo sapiens
aaaugugcuuuaguacccuca

SEQ ID NO: 350386 - RNA, 22 nt, Homo sapiens
aaauucaugucaccucuaggua

SEQ ID NO: 350387 - RNA, 22 nt, Homo sapiens
aaauugcuuuugaagacuuagu

SEQ ID NO: 350388 - RNA, 16 nt, Homo sapiens
uacauuuguuacaugg

SEQ ID NO: 350389 - RNA, 22 nt, Homo sapiens
uaccagugucagcuuccugugu

SEQ ID NO: 350390 - RNA, 19 nt, Homo sapiens
uacccagaagcagcauugu

SEQ ID NO: 350391 - RNA, 22 nt, Homo sapiens
uaccuguagacuacagcuucag

SEQ ID NO: 350392 - RNA, 22 nt, Homo sapiens
uaccuuugucaguuacucaccu

SEQ ID NO: 350393 - RNA, 22 nt, Homo sapiens
uacugaccugucauucagaguu

SEQ ID NO: 350394 - RNA, 22 nt, Homo sapiens
uacugcacauaugaagguuccc

SEQ ID NO: 350395 - RNA, 19 nt, Homo sapiens
uacugcaccucaaccuggg

SEQ ID NO: 350396 - RNA, 22 nt, Homo sapiens
uacugcacuccaaccugagaga

SEQ ID NO: 350397 - RNA, 22 nt, Homo sapiens
uacugcacuccagccucgguga

SEQ ID NO: 350398 - RNA, 18 nt, Homo sapiens
uacugcacucuccagccu

SEQ ID NO: 350399 - RNA, 22 nt, Homo sapiens
uacugcuuaagggcaugggccc

SEQ ID NO: 350400 - RNA, 21 nt, Homo sapiens
uacuggagauacagucugcaa

SEQ ID NO: 350401 - RNA, 22 nt, Homo sapiens
uagaacauuccaggugauguug

SEQ ID NO: 350402 - RNA, 22 nt, Homo sapiens
uagagauaucaauuucauggug

SEQ ID NO: 350403 - RNA, 22 nt, Homo sapiens
uagagcaugugccauacguaca

SEQ ID NO: 350404 - RNA, 21 nt, Homo sapiens
uagagcuuggcacagaguaga

SEQ ID NO: 350405 - RNA, 22 nt, Homo sapiens
uagagguagguguaugaacuag

SEQ ID NO: 350406 - RNA, 22 nt, Homo sapiens
uagagguauuaacaguagaaga

SEQ ID NO: 350407 - RNA, 22 nt, Homo sapiens
uagaucauauacuugccaugac

SEQ ID NO: 350408 - RNA, 21 nt, Homo sapiens
uagaugguguucuagagagaa

SEQ ID NO: 350409 - RNA, 22 nt, Homo sapiens
uagauuaucuaugaggcuucca

SEQ ID NO: 350410 - RNA, 22 nt, Homo sapiens
uagcaccacaaucaagauacag

SEQ ID NO: 350411 - RNA, 22 nt, Homo sapiens
uagcaccucuuuggccuuucgu

SEQ ID NO: 350412 - RNA, 22 nt, Homo sapiens
uagcagcaaagcaggaucugcu

SEQ ID NO: 350413 - RNA, 22 nt, Homo sapiens
uagcagcaccccacucuacugg

SEQ ID NO: 350414 - RNA, 22 nt, Homo sapiens
uagcagcauaaauggacuaaga

SEQ ID NO: 350415 - RNA, 22 nt, Homo sapiens
uagcagcaucucuggcuucuac

SEQ ID NO: 350416 - RNA, 19 nt, Homo sapiens
uagcagcaugauuuauaau

SEQ ID NO: 350417 - RNA, 22 nt, Homo sapiens
uagcaucagauuccauauucua

SEQ ID NO: 350418 - RNA, 22 nt, Homo sapiens
uagcauggaggcggccauagug

SEQ ID NO: 350419 - RNA, 22 nt, Homo sapiens
uagcccauuuguuuagggaaag

SEQ ID NO: 350420 - RNA, 22 nt, Homo sapiens
uagccuguggugaauguuucug

SEQ ID NO: 350421 - RNA, 22 nt, Homo sapiens
uagcuaaauucagcucuaggua

SEQ ID NO: 350422 - RNA, 18 nt, Homo sapiens
uagcucuuguugguccau

SEQ ID NO: 350423 - RNA, 22 nt, Homo sapiens
uagcugagacuacaguaggugc

SEQ ID NO: 350424 - RNA, 22 nt, Homo sapiens
uagcugaucuuuuaaagaauga

SEQ ID NO: 350425 - RNA, 22 nt, Homo sapiens
uagcugcauccugugcacucaa

SEQ ID NO: 350426 - RNA, 22 nt, Homo sapiens
uaggaaguacaucucagaaucu

SEQ ID NO: 350427 - RNA, 22 nt, Homo sapiens
uaggaaugaacgauuuauuggu

SEQ ID NO: 350428 - RNA, 22 nt, Homo sapiens
uaggagcauaggauuguuugag

SEQ ID NO: 350429 - RNA, 22 nt, Homo sapiens
uaggcaguuuuccuuucacagu

SEQ ID NO: 350430 - RNA, 22 nt, Homo sapiens
uaggcuuuucugggaugugggc

SEQ ID NO: 350431 - RNA, 22 nt, Homo sapiens
uagggagugucuucauuuugua

SEQ ID NO: 350432 - RNA, 22 nt, Homo sapiens
uaggggcacacuucgguuagca

SEQ ID NO: 350433 - RNA, 22 nt, Homo sapiens
uagguaagauguuaacagcuga

SEQ ID NO: 350434 - RNA, 22 nt, Homo sapiens
uagguaaguaauauacagauga

SEQ ID NO: 350435 - RNA, 22 nt, Homo sapiens
uagguauguauauacacacaca

SEQ ID NO: 350436 - RNA, 22 nt, Homo sapiens
uaggucaguuuuggcuuggcuu

SEQ ID NO: 350437 - RNA, 22 nt, Homo sapiens
uagguuguucuauuaucuuaca

SEQ ID NO: 350438 - RNA, 22 nt, Homo sapiens
uagucccauaugauuuagugaa

SEQ ID NO: 350439 - RNA, 22 nt, Homo sapiens
uagugcugagauugagaagccc

SEQ ID NO: 350440 - RNA, 22 nt, Homo sapiens
uauaacaaugcaagaauggccu

SEQ ID NO: 350441 - RNA, 22 nt, Homo sapiens
uauacacgugugcauauauaca

SEQ ID NO: 350442 - RNA, 22 nt, Homo sapiens
uauacaguaggcacucaguggc

SEQ ID NO: 350443 - RNA, 22 nt, Homo sapiens
uauagcaguguaagaaucgagu

SEQ ID NO: 350444 - RNA, 22 nt, Homo sapiens
uauagcuuaaaguuuagauccu

SEQ ID NO: 350445 - RNA, 22 nt, Homo sapiens
uauagcuugaaggaauggucau

SEQ ID NO: 350446 - RNA, 22 nt, Homo sapiens
uauagcuuuuuagggaauuugg

SEQ ID NO: 350447 - RNA, 19 nt, Homo sapiens
uaucaaguaugcacuguac

SEQ ID NO: 350448 - RNA, 20 nt, Homo sapiens
uaucacaggucagaaacccu

SEQ ID NO: 350449 - RNA, 22 nt, Homo sapiens
uaucacaguagaacucuuucca

SEQ ID NO: 350450 - RNA, 22 nt, Homo sapiens
uaucacaguugcauauuuaagg

SEQ ID NO: 350451 - RNA, 21 nt, Homo sapiens
uaucagagacauugagaggca

SEQ ID NO: 350452 - RNA, 22 nt, Homo sapiens
uaucagaguuacacugaagacu

SEQ ID NO: 350453 - RNA, 22 nt, Homo sapiens
uaucauagucacuuccaguuug

SEQ ID NO: 350454 - RNA, 22 nt, Homo sapiens
uaucaucauguuuuugcugugu

SEQ ID NO: 350455 - RNA, 22 nt, Homo sapiens
uaucauugccucaaucuguauu

SEQ ID NO: 350456 - RNA, 22 nt, Homo sapiens
uaucccaauguaauaucacaaa

SEQ ID NO: 350457 - RNA, 22 nt, Homo sapiens
uauccuguagcucauccaccgc

SEQ ID NO: 350458 - RNA, 23 nt, Homo sapiens
uaucucaaugcacagagaggaaa

SEQ ID NO: 350459 - RNA, 22 nt, Homo sapiens
uaucucagagaaucagauuuac

SEQ ID NO: 350460 - RNA, 21 nt, Homo sapiens
uaucucaguuuuccuuugugg

SEQ ID NO: 350461 - RNA, 22 nt, Homo sapiens
uaugaaagcuacuucucacaau

SEQ ID NO: 350462 - RNA, 22 nt, Homo sapiens
uaugagagcugguagguagaga

SEQ ID NO: 350463 - RNA, 22 nt, Homo sapiens
uaugagaugaggccacugggua

SEQ ID NO: 350464 - RNA, 22 nt, Homo sapiens
uaugagcacauauguaucuaug

SEQ ID NO: 350465 - RNA, 22 nt, Homo sapiens
uaugcacaugcaugcuugaaua

SEQ ID NO: 350466 - RNA, 22 nt, Homo sapiens
uauggaaaucuuaccuuauggu

SEQ ID NO: 350467 - RNA, 22 nt, Homo sapiens
uauggccuuuuuaaugauauug

SEQ ID NO: 350468 - RNA, 22 nt, Homo sapiens
uauggcuaugggaacugggagu

SEQ ID NO: 350469 - RNA, 22 nt, Homo sapiens
uauggcuuuuauuauguuguag

SEQ ID NO: 350470 - RNA, 22 nt, Homo sapiens
uaugguuuucucuuacguguug

SEQ ID NO: 350471 - RNA, 22 nt, Homo sapiens
uaugugcuuuguuaaacagaug

SEQ ID NO: 350472 - RNA, 22 nt, Homo sapiens
uauuacagaccauaucgccggg

SEQ ID NO: 350473 - RNA, 22 nt, Homo sapiens
uauuacauccauaggcucugcu

SEQ ID NO: 350474 - RNA, 22 nt, Homo sapiens
uauuaguuuucuguggauuaca

SEQ ID NO: 350475 - RNA, 22 nt, Homo sapiens
uauucacaggugugggacaaag

SEQ ID NO: 350476 - RNA, 22 nt, Homo sapiens
uauugauuuucaguguucagcu

SEQ ID NO: 350477 - RNA, 22 nt, Homo sapiens
uauugcaauuggggaaacuggg

SEQ ID NO: 350478 - RNA, 22 nt, Homo sapiens
uauugcacaugaggagacauug

SEQ ID NO: 350479 - RNA, 22 nt, Homo sapiens
uauugcacuuuuccauaggagu

SEQ ID NO: 350480 - RNA, 22 nt, Homo sapiens
ucgugccacugcacuccagccu

SEQ ID NO: 350481 - RNA, 22 nt, Homo sapiens
ucuauggaguuugaaugagaaa

SEQ ID NO: 350482 - RNA, 22 nt, Homo sapiens
ucucaagaugguagaugggaau

SEQ ID NO: 350483 - RNA, 22 nt, Homo sapiens
ucucaauuugauuacauucaua

SEQ ID NO: 350484 - RNA, 22 nt, Homo sapiens
ucucacaccccucucauauacc

SEQ ID NO: 350485 - RNA, 22 nt, Homo sapiens
ucucacagaguugaauguuucu

SEQ ID NO: 350486 - RNA, 19 nt, Homo sapiens
ucucacagcucuacuaugu

SEQ ID NO: 350487 - RNA, 22 nt, Homo sapiens
ucucagcacagucagggcgccu

SEQ ID NO: 350488 - RNA, 19 nt, Homo sapiens
ucucaguguuggucaggug

SEQ ID NO: 350489 - RNA, 20 nt, Homo sapiens
ucucauggagggaaagagca

SEQ ID NO: 350490 - RNA, 22 nt, Homo sapiens
ucuccauugaaauggacauaau

SEQ ID NO: 350491 - RNA, 22 nt, Homo sapiens
ucuccauuuguaaggguuucuc

SEQ ID NO: 350492 - RNA, 22 nt, Homo sapiens
ucucccauccguacacggauug

SEQ ID NO: 350493 - RNA, 22 nt, Homo sapiens
ucuccggguggcggcgaaggga

SEQ ID NO: 350494 - RNA, 22 nt, Homo sapiens
ucucugagaaaaguuucuccca

SEQ ID NO: 350495 - RNA, 22 nt, Homo sapiens
ucucugauuauugcauuucauu

SEQ ID NO: 350496 - RNA, 22 nt, Homo sapiens
ucucugguuuguggaaucuuag

SEQ ID NO: 350497 - RNA, 22 nt, Homo sapiens
ucucuguuugucuguuacuggu

SEQ ID NO: 350498 - RNA, 22 nt, Homo sapiens
ucugaaucguucccaugcagga

SEQ ID NO: 350499 - RNA, 22 nt, Homo sapiens
ucugacagugugaauauugacu

SEQ ID NO: 350500 - RNA, 22 nt, Homo sapiens
ucugacuagacaagcaguguac

SEQ ID NO: 350501 - RNA, 22 nt, Homo sapiens
ucugagaucaugucugugcugu

SEQ ID NO: 350502 - RNA, 22 nt, Homo sapiens
ucugagcaauagauguggauau

SEQ ID NO: 350503 - RNA, 23 nt, Homo sapiens
ucugauguuauaaaauucuuugg

SEQ ID NO: 350504 - RNA, 20 nt, Homo sapiens
ucugauugcaacugcaugag

SEQ ID NO: 350505 - RNA, 22 nt, Homo sapiens
ucugccuacugagcacacagug

SEQ ID NO: 350506 - RNA, 22 nt, Homo sapiens
ucugccuuuucaugugggaugg

SEQ ID NO: 350507 - RNA, 23 nt, Homo sapiens
ucuggaucauucguagugccagc

SEQ ID NO: 350508 - RNA, 22 nt, Homo sapiens
ucuggauuuuugaggcaauaua

SEQ ID NO: 350509 - RNA, 21 nt, Homo sapiens
ucuggcccccucaaaucucau

SEQ ID NO: 350510 - RNA, 22 nt, Homo sapiens
ucuggccuacaucauuuuuccg

SEQ ID NO: 350511 - RNA, 22 nt, Homo sapiens
ucuggccuccuaugagaaucga

SEQ ID NO: 350512 - RNA, 22 nt, Homo sapiens
ucuggcuccaaagucuauuuuu

SEQ ID NO: 350513 - RNA, 22 nt, Homo sapiens
ucuggcuccacacuuuauuaac

SEQ ID NO: 350514 - RNA, 16 nt, Homo sapiens
ucuggcucuacaguuc

SEQ ID NO: 350515 - RNA, 22 nt, Homo sapiens
ucuggcuuauuucacuuagcau

SEQ ID NO: 350516 - RNA, 18 nt, Homo sapiens
ucuggcuucuuuguucca

SEQ ID NO: 350517 - RNA, 21 nt, Homo sapiens
ucuggcuuucauuccccuucu

SEQ ID NO: 350518 - RNA, 22 nt, Homo sapiens
ucugguuccugcauucauucaa

SEQ ID NO: 350519 - RNA, 22 nt, Homo sapiens
ucugguuccuuggcuucggguc

SEQ ID NO: 350520 - RNA, 22 nt, Homo sapiens
ucuguaacauccaccuucuggg

SEQ ID NO: 350521 - RNA, 19 nt, Homo sapiens
ucugucacuggggguauuc

SEQ ID NO: 350522 - RNA, 22 nt, Homo sapiens
ucugugcggucuguguuaugaa

SEQ ID NO: 350523 - RNA, 22 nt, Homo sapiens
ucugugcugagaguugaaaguu

SEQ ID NO: 350524 - RNA, 19 nt, Homo sapiens
ucugugcuugucccccugu

SEQ ID NO: 350525 - RNA, 22 nt, Homo sapiens
ucuguuguuguuuuaagagaca

SEQ ID NO: 350526 - RNA, 22 nt, Homo sapiens
ucuuagguaagaaauuuuaaca

SEQ ID NO: 350527 - RNA, 22 nt, Homo sapiens
ucuuaguuugggguggggauag

SEQ ID NO: 350528 - RNA, 22 nt, Homo sapiens
ucuuggguuuguccuucuccua

SEQ ID NO: 350529 - RNA, 22 nt, Homo sapiens
ucuugguuuauugauggagagg

SEQ ID NO: 350530 - RNA, 22 nt, Homo sapiens
ucuugguuuauugugguaugaa

SEQ ID NO: 350531 - RNA, 23 nt, Homo sapiens
ucuuguacuuugagugagcaugg

SEQ ID NO: 350532 - RNA, 17 nt, Homo sapiens
ucuugugguucuugaau

SEQ ID NO: 350533 - RNA, 22 nt, Homo sapiens
ucuuuagguguuauaguucaag

SEQ ID NO: 350534 - RNA, 22 nt, Homo sapiens
ucuuuaguaauuucuguaaggc

SEQ ID NO: 350535 - RNA, 22 nt, Homo sapiens
ucuuuagugacaguugugcaag

SEQ ID NO: 350536 - RNA, 22 nt, Homo sapiens
ucuuucacuuagcaugauguuu

SEQ ID NO: 350537 - RNA, 22 nt, Homo sapiens
ucuuugaguguauacuuagauu

SEQ ID NO: 350538 - RNA, 22 nt, Homo sapiens
ucuuuggucuacuuucauaugu

SEQ ID NO: 350539 - RNA, 22 nt, Homo sapiens
ucuuugguucuguuuauguaau

SEQ ID NO: 350540 - RNA, 22 nt, Homo sapiens
ucuuuguguucaggagccacgu

SEQ ID NO: 350541 - RNA, 22 nt, Homo sapiens
ucuuuuggguauggagccauca

SEQ ID NO: 350542 - RNA, 22 nt, Homo sapiens
ucuuuuguucuauucaggccuu

SEQ ID NO: 350543 - RNA, 20 nt, Homo sapiens
ucuuuuuguggccccagagu

SEQ ID NO: 350544 - RNA, 22 nt, Homo sapiens
ugaaaagucuaagauuaagguu

SEQ ID NO: 350545 - RNA, 22 nt, Homo sapiens
ugaaacugcagugggcuuggca

SEQ ID NO: 350546 - RNA, 22 nt, Homo sapiens
ugaaaguaauugcaguuuuuac

SEQ ID NO: 350547 - RNA, 21 nt, Homo sapiens
ugaaaugcaugugcacauuaa

SEQ ID NO: 350548 - RNA, 22 nt, Homo sapiens
ugaaaugccuugagauuuugac

SEQ ID NO: 350549 - RNA, 22 nt, Homo sapiens
ugaaaugccuuuaaugaauuua

SEQ ID NO: 350550 - RNA, 22 nt, Homo sapiens
ugaaaugcuaauucguagcuaa

SEQ ID NO: 350551 - RNA, 22 nt, Homo sapiens
ugaacuguaagguauaggugau

SEQ ID NO: 350552 - RNA, 22 nt, Homo sapiens
ugaagacauuuuugggugugua

SEQ ID NO: 350553 - RNA, 22 nt, Homo sapiens
ugaagacucaauuauuaugaac

SEQ ID NO: 350554 - RNA, 22 nt, Homo sapiens
ugaagacucauacuugaaucag

SEQ ID NO: 350555 - RNA, 22 nt, Homo sapiens
ugaaggacauaaggcagaguga

SEQ ID NO: 350556 - RNA, 22 nt, Homo sapiens
ugaaggacauucuaugguagau

SEQ ID NO: 350557 - RNA, 21 nt, Homo sapiens
ugaaguagcauaggaugucaa

SEQ ID NO: 350558 - RNA, 22 nt, Homo sapiens
ugaagugggaaaugaguauuaa

SEQ ID NO: 350559 - RNA, 22 nt, Homo sapiens
ugaauacagcacacccaugggu

SEQ ID NO: 350560 - RNA, 22 nt, Homo sapiens
ugaauacugugcaaaggauuug

SEQ ID NO: 350561 - RNA, 22 nt, Homo sapiens
ugaauauguuaauuagcaucau

SEQ ID NO: 350562 - RNA, 22 nt, Homo sapiens
ugaauauuugcuacucacucuu

SEQ ID NO: 350563 - RNA, 21 nt, Homo sapiens
ugaauauuuggguugugucca

SEQ ID NO: 350564 - RNA, 22 nt, Homo sapiens
ugaaugcauggggccaagaagg

SEQ ID NO: 350565 - RNA, 22 nt, Homo sapiens
ugaaugcuaaaggaaaacagua

SEQ ID NO: 350566 - RNA, 22 nt, Homo sapiens
ugaauguccauugauguuuuga

SEQ ID NO: 350567 - RNA, 22 nt, Homo sapiens
ugaaugugauggguuucaugug

SEQ ID NO: 350568 - RNA, 22 nt, Homo sapiens
ugacaagcucccucugcaccuu

SEQ ID NO: 350569 - RNA, 22 nt, Homo sapiens
ugacacagugggggauccuuuu

SEQ ID NO: 350570 - RNA, 22 nt, Homo sapiens
ugacacuugcccuuagaaacau

SEQ ID NO: 350571 - RNA, 22 nt, Homo sapiens
ugacagagaagcauugaguuca

SEQ ID NO: 350572 - RNA, 22 nt, Homo sapiens
ugacagagcaggacuucaucuc

SEQ ID NO: 350573 - RNA, 22 nt, Homo sapiens
ugacagaggucuuuuaauagcu

SEQ ID NO: 350574 - RNA, 18 nt, Homo sapiens
ugacagcacaugugggga

SEQ ID NO: 350575 - RNA, 22 nt, Homo sapiens
ugacagcaucaggauuggagag

SEQ ID NO: 350576 - RNA, 22 nt, Homo sapiens
ugacaggauggagaucgguauu

SEQ ID NO: 350577 - RNA, 23 nt, Homo sapiens
ugacagugcuugaaauugcucuu

SEQ ID NO: 350578 - RNA, 22 nt, Homo sapiens
ugacagugugagauccugucuc

SEQ ID NO: 350579 - RNA, 20 nt, Homo sapiens
ugacaucagcaauguaauaa

SEQ ID NO: 350580 - RNA, 22 nt, Homo sapiens
ugacauggagggugcggcugca

SEQ ID NO: 350581 - RNA, 22 nt, Homo sapiens
ugacauguugcauuauauuucc

SEQ ID NO: 350582 - RNA, 21 nt, Homo sapiens
ugacauguugguguucugcac

SEQ ID NO: 350583 - RNA, 21 nt, Homo sapiens
ugacauguugguuugcugcac

SEQ ID NO: 350584 - RNA, 22 nt, Homo sapiens
ugacggaggcauuggaagcuug

SEQ ID NO: 350585 - RNA, 22 nt, Homo sapiens
ugacuaagaugaggucuggaua

SEQ ID NO: 350586 - RNA, 21 nt, Homo sapiens
ugacuagauuccagauuggcc

SEQ ID NO: 350587 - RNA, 22 nt, Homo sapiens
ugacuaguuuugcuguuguuau

SEQ ID NO: 350588 - RNA, 22 nt, Homo sapiens
ugacugaguaguauuccacuau

SEQ ID NO: 350589 - RNA, 18 nt, Homo sapiens
ugacuguccagguggacc

SEQ ID NO: 350590 - RNA, 22 nt, Homo sapiens
ugacuuuagaauuuuauccaga

SEQ ID NO: 350591 - RNA, 22 nt, Homo sapiens
ugagaacauggagaacccccca

SEQ ID NO: 350592 - RNA, 22 nt, Homo sapiens
ugagaacucaugggucugcugg

SEQ ID NO: 350593 - RNA, 22 nt, Homo sapiens
ugagaacugccuguauuuaucu

SEQ ID NO: 350594 - RNA, 22 nt, Homo sapiens
ugagaagugacgcagcaggguu

SEQ ID NO: 350595 - RNA, 22 nt, Homo sapiens
ugagaagugauauagaaguuaa

SEQ ID NO: 350596 - RNA, 22 nt, Homo sapiens
ugagaauauuugaagauguuag

SEQ ID NO: 350597 - RNA, 22 nt, Homo sapiens
ugagaauauuuuccaugucuca

SEQ ID NO: 350598 - RNA, 22 nt, Homo sapiens
ugagacaaaguuguuggauguu

SEQ ID NO: 350599 - RNA, 22 nt, Homo sapiens
ugagacaaucucaucucaguga

SEQ ID NO: 350600 - RNA, 22 nt, Homo sapiens
ugagacacugaauccggccuga

SEQ ID NO: 350601 - RNA, 22 nt, Homo sapiens
ugagacauauuauacugcuuuu

SEQ ID NO: 350602 - RNA, 22 nt, Homo sapiens
ugagacaucugagauuuuaagc

SEQ ID NO: 350603 - RNA, 22 nt, Homo sapiens
ugagaccaacagauuccaguuc

SEQ ID NO: 350604 - RNA, 22 nt, Homo sapiens
ugagacggagucucacucuguu

SEQ ID NO: 350605 - RNA, 22 nt, Homo sapiens
ugagacggagucucgcucuguc

SEQ ID NO: 350606 - RNA, 22 nt, Homo sapiens
ugagacggagucucgcucuguu

SEQ ID NO: 350607 - RNA, 22 nt, Homo sapiens
ugagacggagucuugcucuguc

SEQ ID NO: 350608 - RNA, 22 nt, Homo sapiens
ugagacugagucucgcucuauu

SEQ ID NO: 350609 - RNA, 22 nt, Homo sapiens
ugagacugaguuuccaucuugu

SEQ ID NO: 350610 - RNA, 22 nt, Homo sapiens
ugagagacagacauuaucuuau

SEQ ID NO: 350611 - RNA, 22 nt, Homo sapiens
ugagagaugaacucugauaugu

SEQ ID NO: 350612 - RNA, 22 nt, Homo sapiens
ugagauaaagcauguacugugu

SEQ ID NO: 350613 - RNA, 22 nt, Homo sapiens
ugagaucugauaggccuggguu

SEQ ID NO: 350614 - RNA, 22 nt, Homo sapiens
ugagaucuucgcucuucacaga

SEQ ID NO: 350615 - RNA, 22 nt, Homo sapiens
ugagaucuuggaggcuuuguga

SEQ ID NO: 350616 - RNA, 22 nt, Homo sapiens
ugagaucuuugcuguccucacc

SEQ ID NO: 350617 - RNA, 19 nt, Homo sapiens
ugagaugaagacagggguu

SEQ ID NO: 350618 - RNA, 22 nt, Homo sapiens
ugagaugaagugauguaaaaca

SEQ ID NO: 350619 - RNA, 22 nt, Homo sapiens
ugagaugagaaucaguucuaau

SEQ ID NO: 350620 - RNA, 22 nt, Homo sapiens
ugagaugagggaagccuaggca

SEQ ID NO: 350621 - RNA, 22 nt, Homo sapiens
ugagaugagggcugcacucaaa

SEQ ID NO: 350622 - RNA, 22 nt, Homo sapiens
ugagaugaggucucgcucuguc

SEQ ID NO: 350623 - RNA, 22 nt, Homo sapiens
ugagaugagucucgcucuguca

SEQ ID NO: 350624 - RNA, 22 nt, Homo sapiens
ugagaugaguugcgcucugucg

SEQ ID NO: 350625 - RNA, 22 nt, Homo sapiens
ugagaugaguugcuggcucuga

SEQ ID NO: 350626 - RNA, 22 nt, Homo sapiens
ugagaugauagauauguuaauu

SEQ ID NO: 350627 - RNA, 22 nt, Homo sapiens
ugagaugcuccucuugcaaagc

SEQ ID NO: 350628 - RNA, 22 nt, Homo sapiens
ugagauggagucuugucgccua

SEQ ID NO: 350629 - RNA, 21 nt, Homo sapiens
ugagaugugaccagggcauca

SEQ ID NO: 350630 - RNA, 22 nt, Homo sapiens
ugagauuauauuucuuaacaga

SEQ ID NO: 350631 - RNA, 22 nt, Homo sapiens
ugagcaacauuucaaaacucca

SEQ ID NO: 350632 - RNA, 22 nt, Homo sapiens
ugagcacagcgugugggagagc

SEQ ID NO: 350633 - RNA, 22 nt, Homo sapiens
ugagcagugaguguggugcagg

SEQ ID NO: 350634 - RNA, 21 nt, Homo sapiens
ugagcauuaguacaguaggga

SEQ ID NO: 350635 - RNA, 22 nt, Homo sapiens
ugagccaaguucacaccauugc

SEQ ID NO: 350636 - RNA, 22 nt, Homo sapiens
ugagcuaggaucacaccugcau

SEQ ID NO: 350637 - RNA, 22 nt, Homo sapiens
ugagcugagaaaugcagcagcu

SEQ ID NO: 350638 - RNA, 22 nt, Homo sapiens
ugagcugagacaauaaguuuuu

SEQ ID NO: 350639 - RNA, 22 nt, Homo sapiens
ugagcugagaucaugcuauugu

SEQ ID NO: 350640 - RNA, 22 nt, Homo sapiens
ugaggacugagaggcacugugg

SEQ ID NO: 350641 - RNA, 22 nt, Homo sapiens
ugagguaagauguucauuuuuc

SEQ ID NO: 350642 - RNA, 22 nt, Homo sapiens
ugagguaugacuuauuauucuu

SEQ ID NO: 350643 - RNA, 22 nt, Homo sapiens
ugagguauuuuguuaugcagcc

SEQ ID NO: 350644 - RNA, 22 nt, Homo sapiens
ugaggugagggguuaggugcua

SEQ ID NO: 350645 - RNA, 22 nt, Homo sapiens
ugaggugaggguaucaaaugcu

SEQ ID NO: 350646 - RNA, 22 nt, Homo sapiens
ugagguguauugggggaaauuc

SEQ ID NO: 350647 - RNA, 22 nt, Homo sapiens
ugagguuggguaauuuaugaag

SEQ ID NO: 350648 - RNA, 22 nt, Homo sapiens
ugagguugucagugucauucuu

SEQ ID NO: 350649 - RNA, 22 nt, Homo sapiens
ugaguacuacuaguuacugcua

SEQ ID NO: 350650 - RNA, 22 nt, Homo sapiens
ugaguagcuaauguuuacugag

SEQ ID NO: 350651 - RNA, 22 nt, Homo sapiens
ugaguauguuuaaugugacaau

SEQ ID NO: 350652 - RNA, 22 nt, Homo sapiens
ugagucauguaauaaugcugcu

SEQ ID NO: 350653 - RNA, 22 nt, Homo sapiens
ugagugaggcugggcagucccu

SEQ ID NO: 350654 - RNA, 21 nt, Homo sapiens
ugagugcugagugaggguuga

SEQ ID NO: 350655 - RNA, 22 nt, Homo sapiens
ugaguggagacuguguguagag

SEQ ID NO: 350656 - RNA, 22 nt, Homo sapiens
ugaguggagaucgcaccauugc

SEQ ID NO: 350657 - RNA, 22 nt, Homo sapiens
ugaguucaauuguauuuuauua

SEQ ID NO: 350658 - RNA, 22 nt, Homo sapiens
ugaguuccuuucccaguccagu

SEQ ID NO: 350659 - RNA, 22 nt, Homo sapiens
ugaguucuuccuaucucugccu

SEQ ID NO: 350660 - RNA, 22 nt, Homo sapiens
ugaguucuuuuacauuuugaau

SEQ ID NO: 350661 - RNA, 22 nt, Homo sapiens
ugaguuuaucuaaagaccuggg

SEQ ID NO: 350662 - RNA, 22 nt, Homo sapiens
ugauaacugaucuggauuugua

SEQ ID NO: 350663 - RNA, 22 nt, Homo sapiens
ugauaagugagauagcaaguga

SEQ ID NO: 350664 - RNA, 22 nt, Homo sapiens
ugauacuggcuucauagaauga

SEQ ID NO: 350665 - RNA, 22 nt, Homo sapiens
ugauaucucuugccuccaaaug

SEQ ID NO: 350666 - RNA, 22 nt, Homo sapiens
ugauaucugaucauccuugaua

SEQ ID NO: 350667 - RNA, 22 nt, Homo sapiens
ugauaugaaagggaaauaagug

SEQ ID NO: 350668 - RNA, 22 nt, Homo sapiens
ugauaugugaguauaugguuau

SEQ ID NO: 350669 - RNA, 22 nt, Homo sapiens
ugauauguggauucagcucaaa

SEQ ID NO: 350670 - RNA, 17 nt, Homo sapiens
ugauauuuucccagaua

SEQ ID NO: 350671 - RNA, 20 nt, Homo sapiens
ugauauuuucugagcaggaa

SEQ ID NO: 350672 - RNA, 22 nt, Homo sapiens
ugauauuuuugauccuuaaguu

SEQ ID NO: 350673 - RNA, 22 nt, Homo sapiens
ugaucacagcuugacuaaagga

SEQ ID NO: 350674 - RNA, 22 nt, Homo sapiens
ugaucugucacuuaucacauuu

SEQ ID NO: 350675 - RNA, 22 nt, Homo sapiens
ugaucuguguauauugaaccag

SEQ ID NO: 350676 - RNA, 22 nt, Homo sapiens
ugaugacacugauuucuucaau

SEQ ID NO: 350677 - RNA, 20 nt, Homo sapiens
ugauguccaggcagagguuu

SEQ ID NO: 350678 - RNA, 22 nt, Homo sapiens
ugauuggagaacaaacugcaua

SEQ ID NO: 350679 - RNA, 22 nt, Homo sapiens
acaagugcuuuuccuggagaca

SEQ ID NO: 350680 - RNA, 22 nt, Homo sapiens
acacagugucuguguauuuaaa

SEQ ID NO: 350681 - RNA, 20 nt, Homo sapiens
acacuggaguaucaaggccc

SEQ ID NO: 350682 - RNA, 22 nt, Homo sapiens
acagaacugggcuugcuuuugg

SEQ ID NO: 350683 - RNA, 22 nt, Homo sapiens
acagaccuauuucaaucauuua

SEQ ID NO: 350684 - RNA, 22 nt, Homo sapiens
acagagcaaugagcuacggucu

SEQ ID NO: 350685 - RNA, 22 nt, Homo sapiens
acagauagacauauauagcuca

SEQ ID NO: 350686 - RNA, 22 nt, Homo sapiens
acagcagugccccacucuacug

SEQ ID NO: 350687 - RNA, 22 nt, Homo sapiens
acaggugaaguauuacacuaag

SEQ ID NO: 350688 - RNA, 22 nt, Homo sapiens
acaguacaugauaaauaaggua

SEQ ID NO: 350689 - RNA, 22 nt, Homo sapiens
acaguacucugcucuuuugauu

SEQ ID NO: 350690 - RNA, 22 nt, Homo sapiens
acaguacuguuguuugcugcca

SEQ ID NO: 350691 - RNA, 21 nt, Homo sapiens
acaguaguaauaguguagcca

SEQ ID NO: 350692 - RNA, 18 nt, Homo sapiens
acagugcugucacugcuu

SEQ ID NO: 350693 - RNA, 22 nt, Homo sapiens
acagugcuguggucaugggucu

SEQ ID NO: 350694 - RNA, 22 nt, Homo sapiens
acagugcuguuguguuuucacg

SEQ ID NO: 350695 - RNA, 22 nt, Homo sapiens
acagugcuuucaauguucagua

SEQ ID NO: 350696 - RNA, 22 nt, Homo sapiens
acagugcuuuuguuccucuccu

SEQ ID NO: 350697 - RNA, 22 nt, Homo sapiens
acaguggaauguaggguuugag

SEQ ID NO: 350698 - RNA, 23 nt, Homo sapiens
acaguggugugaucuuggcucag

SEQ ID NO: 350699 - RNA, 22 nt, Homo sapiens
acaguguagugacugccaacuu

SEQ ID NO: 350700 - RNA, 19 nt, Homo sapiens
acagugucucuauaaugau

SEQ ID NO: 350701 - RNA, 22 nt, Homo sapiens
acaguguuacuugauaguguau

SEQ ID NO: 350702 - RNA, 22 nt, Homo sapiens
acaguguuccuuuguugugacu

SEQ ID NO: 350703 - RNA, 22 nt, Homo sapiens
acauagaguaguggugaggaug

SEQ ID NO: 350704 - RNA, 22 nt, Homo sapiens
acauaugaguacaugugccaug

SEQ ID NO: 350705 - RNA, 17 nt, Homo sapiens
acaugagacuggauucu

SEQ ID NO: 350706 - RNA, 22 nt, Homo sapiens
acaugguacugauuuacgaaau

SEQ ID NO: 350707 - RNA, 23 nt, Homo sapiens
acauguauagacuuuuuuuccuu

SEQ ID NO: 350708 - RNA, 22 nt, Homo sapiens
acauguauauaaugcauagcga

SEQ ID NO: 350709 - RNA, 19 nt, Homo sapiens
acauugcauuuguaggcuu

SEQ ID NO: 350710 - RNA, 22 nt, Homo sapiens
acauugcucuuaccaaguuugu

SEQ ID NO: 350711 - RNA, 22 nt, Homo sapiens
accacuguuucaagaagcuugu

SEQ ID NO: 350712 - RNA, 22 nt, Homo sapiens
accaguguuuaccaaguagcau

SEQ ID NO: 350713 - RNA, 22 nt, Homo sapiens
accauugcacuccagcccgggc

SEQ ID NO: 350714 - RNA, 22 nt, Homo sapiens
accauugcacuucagccuaggc

SEQ ID NO: 350715 - RNA, 22 nt, Homo sapiens
acccauguaggugggauuacag

SEQ ID NO: 350716 - RNA, 22 nt, Homo sapiens
acccugcuaaacagcccccugc

SEQ ID NO: 350717 - RNA, 22 nt, Homo sapiens
acccuggagagugcuguaguaa

SEQ ID NO: 350718 - RNA, 22 nt, Homo sapiens
acccuggaguaguaggaaucug

SEQ ID NO: 350719 - RNA, 22 nt, Homo sapiens
acccugucaaaauagaccaauc

SEQ ID NO: 350720 - RNA, 22 nt, Homo sapiens
acccugucagcuggccugggca

SEQ ID NO: 350721 - RNA, 22 nt, Homo sapiens
acccugucauccacauggugcu

SEQ ID NO: 350722 - RNA, 19 nt, Homo sapiens
acccuguccccaccuuuac

SEQ ID NO: 350723 - RNA, 22 nt, Homo sapiens
acccugugaauauuuaaacuuc

SEQ ID NO: 350724 - RNA, 22 nt, Homo sapiens
acccuuuagguuggaugaggau

SEQ ID NO: 350725 - RNA, 22 nt, Homo sapiens
accgaguuagccaggauggucu

SEQ ID NO: 350726 - RNA, 23 nt, Homo sapiens
accugugguuauuuuacucuucc

SEQ ID NO: 350727 - RNA, 22 nt, Homo sapiens
acuacauaugacaucuucuuua

SEQ ID NO: 350728 - RNA, 22 nt, Homo sapiens
acuacuucuaaguuuuggaaga

SEQ ID NO: 350729 - RNA, 22 nt, Homo sapiens
acuccacuuucaccacagcgga

SEQ ID NO: 350730 - RNA, 22 nt, Homo sapiens
acugacaugaucaggcauguuc

SEQ ID NO: 350731 - RNA, 20 nt, Homo sapiens
acugauauguuccuguucuc

SEQ ID NO: 350732 - RNA, 22 nt, Homo sapiens
acugcaaugucgaauagagaug

SEQ ID NO: 350733 - RNA, 22 nt, Homo sapiens
acugcacuccaaccuguugggc

SEQ ID NO: 350734 - RNA, 22 nt, Homo sapiens
acugcacuccaaccuuggugac

SEQ ID NO: 350735 - RNA, 22 nt, Homo sapiens
acugcacuccaccuugggcaac

SEQ ID NO: 350736 - RNA, 22 nt, Homo sapiens
acugcacuccagccucccgucu

SEQ ID NO: 350737 - RNA, 22 nt, Homo sapiens
acugcacuccagccucggcaau

SEQ ID NO: 350738 - RNA, 22 nt, Homo sapiens
acugcacuccagccucggugac

SEQ ID NO: 350739 - RNA, 22 nt, Homo sapiens
acugcacuccagccugaugaaa

SEQ ID NO: 350740 - RNA, 22 nt, Homo sapiens
acugcacuccagccugcugaca

SEQ ID NO: 350741 - RNA, 22 nt, Homo sapiens
acugcacuccagccugcuggau

SEQ ID NO: 350742 - RNA, 22 nt, Homo sapiens
acugcacuccagccugcuggca

SEQ ID NO: 350743 - RNA, 22 nt, Homo sapiens
acugcacuccagccugcugggu

SEQ ID NO: 350744 - RNA, 22 nt, Homo sapiens
acugcacuccagccugugagac

SEQ ID NO: 350745 - RNA, 22 nt, Homo sapiens
acugcacuccagccuuagugac

SEQ ID NO: 350746 - RNA, 22 nt, Homo sapiens
acugcacuccagccuuggcaac

SEQ ID NO: 350747 - RNA, 22 nt, Homo sapiens
acugcacuccagccuugugaca

SEQ ID NO: 350748 - RNA, 22 nt, Homo sapiens
acugcacuccagcuugggugac

SEQ ID NO: 350749 - RNA, 20 nt, Homo sapiens
acugcacuccaggcugccca

SEQ ID NO: 350750 - RNA, 18 nt, Homo sapiens
acugcacuccauccuagg

SEQ ID NO: 350751 - RNA, 22 nt, Homo sapiens
acugcacuccggccuggcaaca

SEQ ID NO: 350752 - RNA, 19 nt, Homo sapiens
acugcacuccuccuugggu

SEQ ID NO: 350753 - RNA, 22 nt, Homo sapiens
acugcacuccuccuugggugac

SEQ ID NO: 350754 - RNA, 22 nt, Homo sapiens
acugcacucuagcauggguaau

SEQ ID NO: 350755 - RNA, 22 nt, Homo sapiens
acugcacuguccuagaguccuc

SEQ ID NO: 350756 - RNA, 22 nt, Homo sapiens
acugcacuuauccuccaauguu

SEQ ID NO: 350757 - RNA, 22 nt, Homo sapiens
acugcacuucagccuguugaca

SEQ ID NO: 350758 - RNA, 20 nt, Homo sapiens
acugcauuuaguccucagga

SEQ ID NO: 350759 - RNA, 22 nt, Homo sapiens
acugcauuugucccuuuugaac

SEQ ID NO: 350760 - RNA, 18 nt, Homo sapiens
acuggaauuaaacuuuuu

SEQ ID NO: 350761 - RNA, 22 nt, Homo sapiens
acuggcaauggcagaaauaguu

SEQ ID NO: 350762 - RNA, 20 nt, Homo sapiens
acuggcacugguaggugugg

SEQ ID NO: 350763 - RNA, 22 nt, Homo sapiens
acugggauauuauugguaauau

SEQ ID NO: 350764 - RNA, 22 nt, Homo sapiens
acuguacuacagccugggugac

SEQ ID NO: 350765 - RNA, 22 nt, Homo sapiens
acuucauucucuggaucagaau

SEQ ID NO: 350766 - RNA, 22 nt, Homo sapiens
acuuugguuaucauacuuucag

SEQ ID NO: 350767 - RNA, 22 nt, Homo sapiens
acuuugguuuauagaauuuagg

SEQ ID NO: 350768 - RNA, 22 nt, Homo sapiens
agaaaugcagcaugaggcggca

SEQ ID NO: 350769 - RNA, 23 nt, Homo sapiens
agaaaugucuauucagggucccu

SEQ ID NO: 350770 - RNA, 19 nt, Homo sapiens
agaaucuaaauuauuucug

SEQ ID NO: 350771 - RNA, 22 nt, Homo sapiens
agaaugugaacaucuugaaagu

SEQ ID NO: 350772 - RNA, 22 nt, Homo sapiens
agaauguuuuagaccaauacaa

SEQ ID NO: 350773 - RNA, 22 nt, Homo sapiens
agacaguauuggcaaagugugu

SEQ ID NO: 350774 - RNA, 22 nt, Homo sapiens
agacaguguguguauauauggu

SEQ ID NO: 350775 - RNA, 22 nt, Homo sapiens
ucaccaccugcugaucauagag

SEQ ID NO: 350776 - RNA, 22 nt, Homo sapiens
ucaccuugcacaguuguguggg

SEQ ID NO: 350777 - RNA, 19 nt, Homo sapiens
ucaccuugcccugcacaca

SEQ ID NO: 350778 - RNA, 23 nt, Homo sapiens
ucacuagaguccuggaguuugag

SEQ ID NO: 350779 - RNA, 22 nt, Homo sapiens
ucacuggacucuagccugggug

SEQ ID NO: 350780 - RNA, 20 nt, Homo sapiens
ucacuggagcucauuugauu

SEQ ID NO: 350781 - RNA, 20 nt, Homo sapiens
ucacugugaacuucuugagg

SEQ ID NO: 350782 - RNA, 22 nt, Homo sapiens
ucacuguguauguauaugcagg

SEQ ID NO: 350783 - RNA, 22 nt, Homo sapiens
ucacugugugucucuguaucug

SEQ ID NO: 350784 - RNA, 18 nt, Homo sapiens
ucacugugugucuugggu

SEQ ID NO: 350785 - RNA, 22 nt, Homo sapiens
ucacuguugaugggcaugcagg

SEQ ID NO: 350786 - RNA, 22 nt, Homo sapiens
ucagacacugcccuccaccugu

SEQ ID NO: 350787 - RNA, 22 nt, Homo sapiens
ucagaccauuucauuacagacu

SEQ ID NO: 350788 - RNA, 22 nt, Homo sapiens
ucagagcaaagacacuuuauca

SEQ ID NO: 350789 - RNA, 22 nt, Homo sapiens
ucagaguagagcgacuucuccu

SEQ ID NO: 350790 - RNA, 22 nt, Homo sapiens
ucagaguaguuccuggcagaaa

SEQ ID NO: 350791 - RNA, 18 nt, Homo sapiens
ucagagugcagacuauac

SEQ ID NO: 350792 - RNA, 22 nt, Homo sapiens
ucagaguggccucucuugaaga

SEQ ID NO: 350793 - RNA, 22 nt, Homo sapiens
ucagcagugccccacucuacug

SEQ ID NO: 350794 - RNA, 21 nt, Homo sapiens
ucagcucaucacugccuggag

SEQ ID NO: 350795 - RNA, 22 nt, Homo sapiens
ucaggcacucagcuuagagucu

SEQ ID NO: 350796 - RNA, 22 nt, Homo sapiens
ucaguacgugggcaguuccuuc

SEQ ID NO: 350797 - RNA, 22 nt, Homo sapiens
ucagugaauguuggccacuacu

SEQ ID NO: 350798 - RNA, 22 nt, Homo sapiens
ucagugacugcugcuuguauac

SEQ ID NO: 350799 - RNA, 22 nt, Homo sapiens
ucagugacuggguauuaaauca

SEQ ID NO: 350800 - RNA, 21 nt, Homo sapiens
ucagugcaauucuauggggaa

SEQ ID NO: 350801 - RNA, 17 nt, Homo sapiens
ucagugcauuuaagaga

SEQ ID NO: 350802 - RNA, 19 nt, Homo sapiens
ucagugcuauguaauguag

SEQ ID NO: 350803 - RNA, 22 nt, Homo sapiens
ucagugcuguaccaucuaagga

SEQ ID NO: 350804 - RNA, 21 nt, Homo sapiens
ucagugcugugggcaaggugc

SEQ ID NO: 350805 - RNA, 22 nt, Homo sapiens
ucagugcuguuugcccucguuu

SEQ ID NO: 350806 - RNA, 22 nt, Homo sapiens
ucaguggagagcuuccaggauu

SEQ ID NO: 350807 - RNA, 22 nt, Homo sapiens
ucaguggagccucacucugugg

SEQ ID NO: 350808 - RNA, 22 nt, Homo sapiens
ucaguggagcuacaauucuggg

SEQ ID NO: 350809 - RNA, 22 nt, Homo sapiens
ucaguggauuuaaccugaauca

SEQ ID NO: 350810 - RNA, 22 nt, Homo sapiens
ucagugggcuauguaauuaacu

SEQ ID NO: 350811 - RNA, 22 nt, Homo sapiens
ucagugucugugcaccgcugga

SEQ ID NO: 350812 - RNA, 22 nt, Homo sapiens
ucaguguuuggaaucucaauuu

SEQ ID NO: 350813 - RNA, 22 nt, Homo sapiens
ucaguuuguauuucagguugca

SEQ ID NO: 350814 - RNA, 22 nt, Homo sapiens
ucauaguagucacuuaauaaau

SEQ ID NO: 350815 - RNA, 21 nt, Homo sapiens
ucauauguaucuuugugccuc

SEQ ID NO: 350816 - RNA, 22 nt, Homo sapiens
ucaucagaguuuacaagcucag

SEQ ID NO: 350817 - RNA, 22 nt, Homo sapiens
ucaucagguaugucagcggagu

SEQ ID NO: 350818 - RNA, 22 nt, Homo sapiens
ucaucagugcuugcaaauuauu

SEQ ID NO: 350819 - RNA, 19 nt, Homo sapiens
ucauggcuuuuucagcugu

SEQ ID NO: 350820 - RNA, 22 nt, Homo sapiens
ucauggggugcuuugcuagauu

SEQ ID NO: 350821 - RNA, 22 nt, Homo sapiens
ucauguaauuuugugucuauga

SEQ ID NO: 350822 - RNA, 22 nt, Homo sapiens
ucaugugagcacagagcaagau

SEQ ID NO: 350823 - RNA, 22 nt, Homo sapiens
ucauucauucauccagcuugag

SEQ ID NO: 350824 - RNA, 22 nt, Homo sapiens
ucauucauuugcucacuccaca

SEQ ID NO: 350825 - RNA, 22 nt, Homo sapiens
ucauugcacucccagacacccu

SEQ ID NO: 350826 - RNA, 22 nt, Homo sapiens
ucauugcauuccagcccaagca

SEQ ID NO: 350827 - RNA, 22 nt, Homo sapiens
ucauugcuuauuuguuggugga

SEQ ID NO: 350828 - RNA, 22 nt, Homo sapiens
uccacagugguugaacuaguaa

SEQ ID NO: 350829 - RNA, 18 nt, Homo sapiens
uccacgugcuuuccagau

SEQ ID NO: 350830 - RNA, 22 nt, Homo sapiens
uccagguuucaugcucuuuauu

SEQ ID NO: 350831 - RNA, 22 nt, Homo sapiens
uccaguuguucucgaagcuccu

SEQ ID NO: 350832 - RNA, 22 nt, Homo sapiens
uccaguuuggaggcuugaugug

SEQ ID NO: 350833 - RNA, 22 nt, Homo sapiens
uccauagacauuuuaagguagu

SEQ ID NO: 350834 - RNA, 19 nt, Homo sapiens
uccaugagcccacagugau

SEQ ID NO: 350835 - RNA, 22 nt, Homo sapiens
uccauggagacacauuuuauau

SEQ ID NO: 350836 - RNA, 22 nt, Homo sapiens
ucccacugucuucucgugcucg

SEQ ID NO: 350837 - RNA, 22 nt, Homo sapiens
ucccaguguguagcuugucucu

SEQ ID NO: 350838 - RNA, 17 nt, Homo sapiens
ucccauguuucuucuac

SEQ ID NO: 350839 - RNA, 19 nt, Homo sapiens
uccccaguuuuccguucag

SEQ ID NO: 350840 - RNA, 22 nt, Homo sapiens
uccccgucacacgcaggcuuac

SEQ ID NO: 350841 - RNA, 22 nt, Homo sapiens
uccuacaugcaguacauucaaa

SEQ ID NO: 350842 - RNA, 22 nt, Homo sapiens
uccugcauucauccugguguug

SEQ ID NO: 350843 - RNA, 22 nt, Homo sapiens
uccuugagccucccagacucag

SEQ ID NO: 350844 - RNA, 21 nt, Homo sapiens
uccuuggugaugcccugcagu

SEQ ID NO: 350845 - RNA, 18 nt, Homo sapiens
uccuuuugggguaggaga

SEQ ID NO: 350846 - RNA, 22 nt, Homo sapiens
ucgcaccauugcacuccagcca

SEQ ID NO: 350847 - RNA, 22 nt, Homo sapiens
ucgcagcacgagcaugcaaggu

SEQ ID NO: 350848 - RNA, 23 nt, Homo sapiens
ucgcagcauucaauaccaggcag

SEQ ID NO: 350849 - RNA, 22 nt, Homo sapiens
ucgcauggucuccaggcagcuc

SEQ ID NO: 350850 - RNA, 22 nt, Homo sapiens
ucgcgccauucuccugccucag

SEQ ID NO: 350851 - RNA, 18 nt, Homo sapiens
ucucacagcaaucuguca

SEQ ID NO: 350852 - RNA, 22 nt, Homo sapiens
ucucacagccauuucucccucu

SEQ ID NO: 350853 - RNA, 22 nt, Homo sapiens
ucucacauuucacagggauggg

SEQ ID NO: 350854 - RNA, 22 nt, Homo sapiens
ucucaguggcacccccaacacc

SEQ ID NO: 350855 - RNA, 22 nt, Homo sapiens
ucucaguggcuuccucacuuuu

SEQ ID NO: 350856 - RNA, 22 nt, Homo sapiens
ucucaguggugcuggcagggga

SEQ ID NO: 350857 - RNA, 22 nt, Homo sapiens
ucucaguuuucuggggaagaaa

SEQ ID NO: 350858 - RNA, 22 nt, Homo sapiens
ucucaugaagauagagaauaga

SEQ ID NO: 350859 - RNA, 22 nt, Homo sapiens
ucucauggcucacccugcauag

SEQ ID NO: 350860 - RNA, 22 nt, Homo sapiens
ucucccauccaugaacuucugu

SEQ ID NO: 350861 - RNA, 17 nt, Homo sapiens
ucucccaucccuuucuc

SEQ ID NO: 350862 - RNA, 22 nt, Homo sapiens
ucugacaaugaacaaucuauag

SEQ ID NO: 350863 - RNA, 22 nt, Homo sapiens
ucugacacagugauuaguaaau

SEQ ID NO: 350864 - RNA, 22 nt, Homo sapiens
ucugagaugagacuuugaauuu

SEQ ID NO: 350865 - RNA, 21 nt, Homo sapiens
ucugagucauucaguggccug

SEQ ID NO: 350866 - RNA, 22 nt, Homo sapiens
ucugcaagucuaaacuagccau

SEQ ID NO: 350867 - RNA, 22 nt, Homo sapiens
ucugcauaucaugcagaacuau

SEQ ID NO: 350868 - RNA, 22 nt, Homo sapiens
ucugccacugucauugugugau

SEQ ID NO: 350869 - RNA, 22 nt, Homo sapiens
ucuggaauguaaaguuuauggg

SEQ ID NO: 350870 - RNA, 22 nt, Homo sapiens
ucuggagugugaaguggauaug

SEQ ID NO: 350871 - RNA, 22 nt, Homo sapiens
uuagcagugugagcacagacua

SEQ ID NO: 350872 - RNA, 22 nt, Homo sapiens
uuaggcaaugcucucaaauuug

SEQ ID NO: 350873 - RNA, 22 nt, Homo sapiens
uuaggcuaguugauauaguuug

SEQ ID NO: 350874 - RNA, 22 nt, Homo sapiens
uuaggcuuuucagacacuucau

SEQ ID NO: 350875 - RNA, 22 nt, Homo sapiens
uuaggcuuuuuaaccaguuguu

SEQ ID NO: 350876 - RNA, 22 nt, Homo sapiens
uuagggaggcucaggacaagag

SEQ ID NO: 350877 - RNA, 22 nt, Homo sapiens
uuaggugcauggaaguguuuuc

SEQ ID NO: 350878 - RNA, 22 nt, Homo sapiens
uuagguuauuacugacaauaau

SEQ ID NO: 350879 - RNA, 22 nt, Homo sapiens
uuaguaguuugauaggaauagc

SEQ ID NO: 350880 - RNA, 22 nt, Homo sapiens
uuagucaaguguacugugaaug

SEQ ID NO: 350881 - RNA, 20 nt, Homo sapiens
uuagucuccucugcccuguc

SEQ ID NO: 350882 - RNA, 22 nt, Homo sapiens
uuagugaaugcaccacuucuga

SEQ ID NO: 350883 - RNA, 22 nt, Homo sapiens
uuauacacugugggaguguaaa

SEQ ID NO: 350884 - RNA, 22 nt, Homo sapiens
uuauacuacuauaaagagguag

SEQ ID NO: 350885 - RNA, 19 nt, Homo sapiens
uuauacuguauuguuuagg

SEQ ID NO: 350886 - RNA, 22 nt, Homo sapiens
uuaucccacuuucuguuccugu

SEQ ID NO: 350887 - RNA, 22 nt, Homo sapiens
uuaucucaguguuuguaaacaa

SEQ ID NO: 350888 - RNA, 22 nt, Homo sapiens
uuaugcagcaaagugcuugaaa

SEQ ID NO: 350889 - RNA, 22 nt, Homo sapiens
uuaugcaucuuccacacucauu

SEQ ID NO: 350890 - RNA, 22 nt, Homo sapiens
uuaugcuguuuucuggagauuu

SEQ ID NO: 350891 - RNA, 23 nt, Homo sapiens
uuauggcuuuuauuauguugagg

SEQ ID NO: 350892 - RNA, 22 nt, Homo sapiens
uuauguguuuaauguuucugaa

SEQ ID NO: 350893 - RNA, 22 nt, Homo sapiens
uuauuacuccuauuuuguagau

SEQ ID NO: 350894 - RNA, 22 nt, Homo sapiens
uuauuagcacccuaccaugugg

SEQ ID NO: 350895 - RNA, 22 nt, Homo sapiens
uuauucugucuuuggucucaau

SEQ ID NO: 350896 - RNA, 22 nt, Homo sapiens
uuauugcuuaugauuagguguu

SEQ ID NO: 350897 - RNA, 22 nt, Homo sapiens
uuauugcuuuugugcaggugag

SEQ ID NO: 350898 - RNA, 22 nt, Homo sapiens
uucaagcuacaguggcaggguu

SEQ ID NO: 350899 - RNA, 22 nt, Homo sapiens
uucaagcuauggugaucuuuuc

SEQ ID NO: 350900 - RNA, 22 nt, Homo sapiens
uucacaaugccuuguugauggu

SEQ ID NO: 350901 - RNA, 22 nt, Homo sapiens
uucacacuagccacucugguag

SEQ ID NO: 350902 - RNA, 22 nt, Homo sapiens
uucacaguacucccuggaauua

SEQ ID NO: 350903 - RNA, 22 nt, Homo sapiens
uucacagucacccuucuccaug

SEQ ID NO: 350904 - RNA, 22 nt, Homo sapiens
uucacaguggugggagacguca

SEQ ID NO: 350905 - RNA, 22 nt, Homo sapiens
uucaccuggguuggccaucauu

SEQ ID NO: 350906 - RNA, 23 nt, Homo sapiens
uucaccugguuauuaauagccuc

SEQ ID NO: 350907 - RNA, 22 nt, Homo sapiens
uucaccuguagcaugcccuugg

SEQ ID NO: 350908 - RNA, 22 nt, Homo sapiens
uucaccuugggucccacuugcu

SEQ ID NO: 350909 - RNA, 22 nt, Homo sapiens
uucacugcacuccagccugagc

SEQ ID NO: 350910 - RNA, 22 nt, Homo sapiens
uucacugcaugaaaaggacagc

SEQ ID NO: 350911 - RNA, 22 nt, Homo sapiens
uucacugugaauaaaggcuccc

SEQ ID NO: 350912 - RNA, 22 nt, Homo sapiens
uucagagagggagggauaccua

SEQ ID NO: 350913 - RNA, 20 nt, Homo sapiens
uucagcaaaggaaugggagu

SEQ ID NO: 350914 - RNA, 22 nt, Homo sapiens
uucagcaaugacagccuauaua

SEQ ID NO: 350915 - RNA, 22 nt, Homo sapiens
uucaggcuuuuauuuacugaua

SEQ ID NO: 350916 - RNA, 22 nt, Homo sapiens
uucagggagaaggcaaacguug

SEQ ID NO: 350917 - RNA, 22 nt, Homo sapiens
uucagguaauuaugguuugucu

SEQ ID NO: 350918 - RNA, 22 nt, Homo sapiens
uucaguacacguguucucauuu

SEQ ID NO: 350919 - RNA, 22 nt, Homo sapiens
uucaguucugcacugaucuuag

SEQ ID NO: 350920 - RNA, 22 nt, Homo sapiens
uucauacaguggcugcacucca

SEQ ID NO: 350921 - RNA, 22 nt, Homo sapiens
uucauagugaaaaauucaaagu

SEQ ID NO: 350922 - RNA, 22 nt, Homo sapiens
uucaucagggagaaauaauuuc

SEQ ID NO: 350923 - RNA, 22 nt, Homo sapiens
uucaucagggguauuggccaau

SEQ ID NO: 350924 - RNA, 22 nt, Homo sapiens
uucauggaauauugaccauuuu

SEQ ID NO: 350925 - RNA, 22 nt, Homo sapiens
uucauguaauauuucacagcuu

SEQ ID NO: 350926 - RNA, 22 nt, Homo sapiens
uucauguaaucaaggcagcuaa

SEQ ID NO: 350927 - RNA, 22 nt, Homo sapiens
uucauugaaugauuuuuagaag

SEQ ID NO: 350928 - RNA, 22 nt, Homo sapiens
uucauuggauguuacacugugu

SEQ ID NO: 350929 - RNA, 22 nt, Homo sapiens
uuccagaugggaguucuauucu

SEQ ID NO: 350930 - RNA, 22 nt, Homo sapiens
uuccaggugggcgugggccugg

SEQ ID NO: 350931 - RNA, 22 nt, Homo sapiens
uuccagugggacgagaugugga

SEQ ID NO: 350932 - RNA, 22 nt, Homo sapiens
uuccaguuauuauaccucuuaa

SEQ ID NO: 350933 - RNA, 22 nt, Homo sapiens
uuccauugugucaucuuggugg

SEQ ID NO: 350934 - RNA, 22 nt, Homo sapiens
uucccagagagggacuucuaau

SEQ ID NO: 350935 - RNA, 22 nt, Homo sapiens
uucccagagccugggagugagg

SEQ ID NO: 350936 - RNA, 22 nt, Homo sapiens
uucccucagaaacacacagccc

SEQ ID NO: 350937 - RNA, 22 nt, Homo sapiens
uucccugugugcagaugggugu

SEQ ID NO: 350938 - RNA, 22 nt, Homo sapiens
uucccuuuuuucuaguagguag

SEQ ID NO: 350939 - RNA, 22 nt, Homo sapiens
uuccuagagauuagcaagcugc

SEQ ID NO: 350940 - RNA, 22 nt, Homo sapiens
uuccuguagcgauuuuaguaau

SEQ ID NO: 350941 - RNA, 22 nt, Homo sapiens
uuccugugacccccaagcccac

SEQ ID NO: 350942 - RNA, 22 nt, Homo sapiens
uucuaaacaucuuacaaugcau

SEQ ID NO: 350943 - RNA, 21 nt, Homo sapiens
uucuaaguaaauguuggacau

SEQ ID NO: 350944 - RNA, 22 nt, Homo sapiens
uucuauguuugaaaaugccaaa

SEQ ID NO: 350945 - RNA, 21 nt, Homo sapiens
uucucagaggcaggggauaaa

SEQ ID NO: 350946 - RNA, 22 nt, Homo sapiens
uucucgcuuuuuccaccuguau

SEQ ID NO: 350947 - RNA, 22 nt, Homo sapiens
uucucuaguuacuuuaauggag

SEQ ID NO: 350948 - RNA, 22 nt, Homo sapiens
uucucugggacauaggucgggu

SEQ ID NO: 350949 - RNA, 22 nt, Homo sapiens
uucucuguggauugggugagag

SEQ ID NO: 350950 - RNA, 22 nt, Homo sapiens
uucugagguuauauucucucaa

SEQ ID NO: 350951 - RNA, 22 nt, Homo sapiens
uucuggaaaucagcagagggug

SEQ ID NO: 350952 - RNA, 22 nt, Homo sapiens
uucuggcuuuuaaagaaauguu

SEQ ID NO: 350953 - RNA, 22 nt, Homo sapiens
uucugugguagaaaucucaaau

SEQ ID NO: 350954 - RNA, 22 nt, Homo sapiens
uucuucaggccacaaaaauggu

SEQ ID NO: 350955 - RNA, 22 nt, Homo sapiens
uucuucugguuaugaaauuuga

SEQ ID NO: 350956 - RNA, 21 nt, Homo sapiens
uucuuugcucaguguuagagu

SEQ ID NO: 350957 - RNA, 22 nt, Homo sapiens
uugaaagaaaggagacugaguu

SEQ ID NO: 350958 - RNA, 22 nt, Homo sapiens
uugaaaucuuccacagcccaag

SEQ ID NO: 350959 - RNA, 22 nt, Homo sapiens
uugaagacuaaguuaucaggau

SEQ ID NO: 350960 - RNA, 22 nt, Homo sapiens
uugaagacuaccuaccauacuu

SEQ ID NO: 350961 - RNA, 22 nt, Homo sapiens
uugaaguaggaaaggaggaggu

SEQ ID NO: 350962 - RNA, 22 nt, Homo sapiens
uugaaguaguacuuuauuauag

SEQ ID NO: 350963 - RNA, 22 nt, Homo sapiens
uugaauggaauguuggaacuau

SEQ ID NO: 350964 - RNA, 23 nt, Homo sapiens
uugaauguuuccccucccaaauu

SEQ ID NO: 350965 - RNA, 20 nt, Homo sapiens
uugacagagggaaaguugcu

SEQ ID NO: 350966 - RNA, 22 nt, Homo sapiens
uugacaguggcuuaaauugguu

SEQ ID NO: 350967 - RNA, 22 nt, Homo sapiens
cagcuguuguuccagucuuuua

SEQ ID NO: 350968 - RNA, 22 nt, Homo sapiens
caggcaacauggcgaaacucug

SEQ ID NO: 350969 - RNA, 22 nt, Homo sapiens
caggcuuuuccacacauggguu

SEQ ID NO: 350970 - RNA, 19 nt, Homo sapiens
cagguagugugcugacaug

SEQ ID NO: 350971 - RNA, 22 nt, Homo sapiens
caggugcuuacuuaauagccau

SEQ ID NO: 350972 - RNA, 22 nt, Homo sapiens
caguaaauaucugagcgagguc

SEQ ID NO: 350973 - RNA, 22 nt, Homo sapiens
caguacaauguggaaaaggagu

SEQ ID NO: 350974 - RNA, 22 nt, Homo sapiens
caguacaauguugauuagaagu

SEQ ID NO: 350975 - RNA, 22 nt, Homo sapiens
cagucacugggauuauggucau

SEQ ID NO: 350976 - RNA, 22 nt, Homo sapiens
cagugacacugaaaaguucggg

SEQ ID NO: 350977 - RNA, 20 nt, Homo sapiens
cagugcacuuucccacuggu

SEQ ID NO: 350978 - RNA, 22 nt, Homo sapiens
cagugcauguggcacucuccag

SEQ ID NO: 350979 - RNA, 20 nt, Homo sapiens
cagugcauugcuucugauuu

SEQ ID NO: 350980 - RNA, 22 nt, Homo sapiens
cagugcuuguuauuguucuauu

SEQ ID NO: 350981 - RNA, 22 nt, Homo sapiens
cauaaagauggaggaggccagg

SEQ ID NO: 350982 - RNA, 21 nt, Homo sapiens
cauaaugcuacuuauuuuaug

SEQ ID NO: 350983 - RNA, 22 nt, Homo sapiens
cauagcacugagcucuacccuc

SEQ ID NO: 350984 - RNA, 18 nt, Homo sapiens
cauagcacuucagcacau

SEQ ID NO: 350985 - RNA, 22 nt, Homo sapiens
caucaaaguggagggaaggacc

SEQ ID NO: 350986 - RNA, 22 nt, Homo sapiens
caucacacuuggauguaagaca

SEQ ID NO: 350987 - RNA, 23 nt, Homo sapiens
caucacagagccuuccuugacuc

SEQ ID NO: 350988 - RNA, 22 nt, Homo sapiens
caucacaugcuuauuuuccuca

SEQ ID NO: 350989 - RNA, 22 nt, Homo sapiens
caucacauucugagauacugag

SEQ ID NO: 350990 - RNA, 20 nt, Homo sapiens
caucaccuggcaggauuugu

SEQ ID NO: 350991 - RNA, 22 nt, Homo sapiens
caugaaagacugaggaauugga

SEQ ID NO: 350992 - RNA, 22 nt, Homo sapiens
caugacacuggcauguuucuuu

SEQ ID NO: 350993 - RNA, 22 nt, Homo sapiens
caugauauugcagaauguuggu

SEQ ID NO: 350994 - RNA, 22 nt, Homo sapiens
caugcagcacacaugucugugc

SEQ ID NO: 350995 - RNA, 22 nt, Homo sapiens
cauggcacagagaauguguucu

SEQ ID NO: 350996 - RNA, 22 nt, Homo sapiens
cauggcaucuguguggccucca

SEQ ID NO: 350997 - RNA, 22 nt, Homo sapiens
caugucacuuccucucugaugg

SEQ ID NO: 350998 - RNA, 22 nt, Homo sapiens
gaauagugcugcaaugaacaua

SEQ ID NO: 350999 - RNA, 22 nt, Homo sapiens
gaauagugcugcaguaaacaua

SEQ ID NO: 351000 - RNA, 22 nt, Homo sapiens
gaaucaauugaucuaugugucu

SEQ ID NO: 351001 - RNA, 22 nt, Homo sapiens
gaaucacaguuauuagagcagc

SEQ ID NO: 351002 - RNA, 22 nt, Homo sapiens
gaaucauuguuucuaaguuugu

SEQ ID NO: 351003 - RNA, 22 nt, Homo sapiens
gaaugaauguuuauccuuagau

SEQ ID NO: 351004 - RNA, 22 nt, Homo sapiens
gaaugcagcagugacagggcug

SEQ ID NO: 351005 - RNA, 22 nt, Homo sapiens
gaaugcuaccagcaucuagugg

SEQ ID NO: 351006 - RNA, 18 nt, Homo sapiens
gacaguguggcaauuccu

SEQ ID NO: 351007 - RNA, 22 nt, Homo sapiens
gacaguuucucaggcuuccuua

SEQ ID NO: 351008 - RNA, 22 nt, Homo sapiens
gacauagcuagauaaccucaug

SEQ ID NO: 351009 - RNA, 22 nt, Homo sapiens
gacccucuagauggaagcacug

SEQ ID NO: 351010 - RNA, 17 nt, Homo sapiens
gacgaucaucaggaggc

SEQ ID NO: 351011 - RNA, 22 nt, Homo sapiens
gacguagagaaaugugaaaugg

SEQ ID NO: 351012 - RNA, 22 nt, Homo sapiens
gacuagugcccucagaccuaga

SEQ ID NO: 351013 - RNA, 18 nt, Homo sapiens
gacucaguuucuaaggca

SEQ ID NO: 351014 - RNA, 22 nt, Homo sapiens
gacucuguagacaaucacaucu

SEQ ID NO: 351015 - RNA, 18 nt, Homo sapiens
gacuuggaguuuacagug

SEQ ID NO: 351016 - RNA, 22 nt, Homo sapiens
gagaaccauuuggagaaaaagu

SEQ ID NO: 351017 - RNA, 22 nt, Homo sapiens
gagaacugagauaagugauauu

SEQ ID NO: 351018 - RNA, 21 nt, Homo sapiens
gagaaucuuuucagggcaaac

SEQ ID NO: 351019 - RNA, 22 nt, Homo sapiens
gagacauguuugccaauaauuu

SEQ ID NO: 351020 - RNA, 22 nt, Homo sapiens
gagaccauuuacugccuacuua

SEQ ID NO: 351021 - RNA, 22 nt, Homo sapiens
gagacugagucuugcccuguca

SEQ ID NO: 351022 - RNA, 22 nt, Homo sapiens
gagacugagucuugcucuguca

SEQ ID NO: 351023 - RNA, 22 nt, Homo sapiens
gagacugagucuugcuuuguca

SEQ ID NO: 351024 - RNA, 22 nt, Homo sapiens
gagagcauuaagccaucaucau

SEQ ID NO: 351025 - RNA, 22 nt, Homo sapiens
gagagugaaguuugcuaccugu

SEQ ID NO: 351026 - RNA, 22 nt, Homo sapiens
gagauaaauaggucacaguucu

SEQ ID NO: 351027 - RNA, 22 nt, Homo sapiens
gagauaggauucacuuucaugu

SEQ ID NO: 351028 - RNA, 22 nt, Homo sapiens
gagauauguuggcagcugguau

SEQ ID NO: 351029 - RNA, 22 nt, Homo sapiens
gagaucaucuaaucuggccucu

SEQ ID NO: 351030 - RNA, 22 nt, Homo sapiens
gagaucauuaugucagggguca

SEQ ID NO: 351031 - RNA, 22 nt, Homo sapiens
gagaugaagugucaauaaggau

SEQ ID NO: 351032 - RNA, 22 nt, Homo sapiens
gagaugaaguuaaggaucuuua

SEQ ID NO: 351033 - RNA, 22 nt, Homo sapiens
gagaugaugagauguucacagu

SEQ ID NO: 351034 - RNA, 22 nt, Homo sapiens
gagaugugguucaaggguguuu

SEQ ID NO: 351035 - RNA, 22 nt, Homo sapiens
gagauguuuuguuaucaaagga

SEQ ID NO: 351036 - RNA, 22 nt, Homo sapiens
gagauuaacauuugaggagcug

SEQ ID NO: 351037 - RNA, 22 nt, Homo sapiens
gagauugucaugauuacauugu

SEQ ID NO: 351038 - RNA, 22 nt, Homo sapiens
gagcaccagucccugucagugc

SEQ ID NO: 351039 - RNA, 22 nt, Homo sapiens
gagcuacauggauagucugcau

SEQ ID NO: 351040 - RNA, 22 nt, Homo sapiens
gagcucaccuuaccucuggagc

SEQ ID NO: 351041 - RNA, 22 nt, Homo sapiens
gagcugaauugcugccauuugc

SEQ ID NO: 351042 - RNA, 22 nt, Homo sapiens
gagcugccuugccuaugcaaga

SEQ ID NO: 351043 - RNA, 22 nt, Homo sapiens
gaggaaguagcuacugucuuuc

SEQ ID NO: 351044 - RNA, 22 nt, Homo sapiens
gaggaucucuugagcccagaag

SEQ ID NO: 351045 - RNA, 22 nt, Homo sapiens
gaggcagucugacccuuagcag

SEQ ID NO: 351046 - RNA, 22 nt, Homo sapiens
gaggcagucuguccauucucag

SEQ ID NO: 351047 - RNA, 22 nt, Homo sapiens
gaggcagucugucccuuagcag

SEQ ID NO: 351048 - RNA, 22 nt, Homo sapiens
gagguaagaguuuuccauuucu

SEQ ID NO: 351049 - RNA, 22 nt, Homo sapiens
gagguaaguaagaauggcaagc

SEQ ID NO: 351050 - RNA, 22 nt, Homo sapiens
gagguaguuuaguuuuggggaa

SEQ ID NO: 351051 - RNA, 22 nt, Homo sapiens
gagguauggauaucuggagagg

SEQ ID NO: 351052 - RNA, 22 nt, Homo sapiens
gaggugauaucucauugugguu

SEQ ID NO: 351053 - RNA, 22 nt, Homo sapiens
gagguggauacauuaaauaaug

SEQ ID NO: 351054 - RNA, 22 nt, Homo sapiens
gaguaaaugucaaguacuuagg

SEQ ID NO: 351055 - RNA, 22 nt, Homo sapiens
gagucuauucaauguaguuaga

SEQ ID NO: 351056 - RNA, 22 nt, Homo sapiens
gagugcaauggcaagaucuugg

SEQ ID NO: 351057 - RNA, 22 nt, Homo sapiens
gagugcaucguggccauuuuaa

SEQ ID NO: 351058 - RNA, 22 nt, Homo sapiens
gagugcugagcccacuuccuug

SEQ ID NO: 351059 - RNA, 18 nt, Homo sapiens
gaguggugcuucccuugu

SEQ ID NO: 351060 - RNA, 19 nt, Homo sapiens
gaguugggguuuacuguaa

SEQ ID NO: 351061 - RNA, 22 nt, Homo sapiens
gaguuuguaaacuauucacuaa

SEQ ID NO: 351062 - RNA, 22 nt, Homo sapiens
gauacuguauccuaaaagcuuu

SEQ ID NO: 351063 - RNA, 17 nt, Homo sapiens
gaucacagucgucuccu

SEQ ID NO: 351064 - RNA, 22 nt, Homo sapiens
gaucacauggccauuucuagcu

SEQ ID NO: 351065 - RNA, 22 nt, Homo sapiens
gaucacauguguacucaaugug

SEQ ID NO: 351066 - RNA, 22 nt, Homo sapiens
gaucuggucuuugauuagacac

SEQ ID NO: 351067 - RNA, 22 nt, Homo sapiens
gaucuguguuuguaugcauaag

SEQ ID NO: 351068 - RNA, 19 nt, Homo sapiens
gaucuguugaucaaugugu

SEQ ID NO: 351069 - RNA, 22 nt, Homo sapiens
gaugagaucauaaguguggagc

SEQ ID NO: 351070 - RNA, 22 nt, Homo sapiens
gaugauauuugagucauuagaa

SEQ ID NO: 351071 - RNA, 20 nt, Homo sapiens
gauuagagagaggcugugca

SEQ ID NO: 351072 - RNA, 22 nt, Homo sapiens
gauuccacuuucaaauucaaau

SEQ ID NO: 351073 - RNA, 22 nt, Homo sapiens
gauuccauugcgaauuuucaga

SEQ ID NO: 351074 - RNA, 22 nt, Homo sapiens
gauuuuccaguggcccugauca

SEQ ID NO: 351075 - RNA, 22 nt, Homo sapiens
gcaaaguguuuuuaggaagucu

SEQ ID NO: 351076 - RNA, 22 nt, Homo sapiens
gcaagacaugucuaagguuuaa

SEQ ID NO: 351077 - RNA, 22 nt, Homo sapiens
gcaagaguauuucaaggaagau

SEQ ID NO: 351078 - RNA, 22 nt, Homo sapiens
gcaaggacucccugggucauuc

SEQ ID NO: 351079 - RNA, 22 nt, Homo sapiens
gcacauauguaaauagcugccu

SEQ ID NO: 351080 - RNA, 22 nt, Homo sapiens
gcacauggccccaucgugccga

SEQ ID NO: 351081 - RNA, 22 nt, Homo sapiens
gcaccauugacaagaaauaggu

SEQ ID NO: 351082 - RNA, 22 nt, Homo sapiens
gcaccccuuaccgggcuggguu

SEQ ID NO: 351083 - RNA, 22 nt, Homo sapiens
gcacugagagaagccccaagua

SEQ ID NO: 351084 - RNA, 22 nt, Homo sapiens
gcagugcaguggcgcgaucucg

SEQ ID NO: 351085 - RNA, 22 nt, Homo sapiens
gcagugugauguuuuaaucuau

SEQ ID NO: 351086 - RNA, 22 nt, Homo sapiens
gcagugugugaggaauuugggu

SEQ ID NO: 351087 - RNA, 22 nt, Homo sapiens
gcaguguuggggccggaggcug

SEQ ID NO: 351088 - RNA, 22 nt, Homo sapiens
gcaguguugugauccaggucuu

SEQ ID NO: 351089 - RNA, 20 nt, Homo sapiens
gcauaugucuuuauggcagc

SEQ ID NO: 351090 - RNA, 22 nt, Homo sapiens
gcauauguuuggguguguauau

SEQ ID NO: 351091 - RNA, 22 nt, Homo sapiens
gcaucacagggagacaggccuc

SEQ ID NO: 351092 - RNA, 22 nt, Homo sapiens
gcauggagaaggggacugauuc

SEQ ID NO: 351093 - RNA, 22 nt, Homo sapiens
gggcauaucacuugaggucagg

SEQ ID NO: 351094 - RNA, 22 nt, Homo sapiens
ggggaauguuaaagaauuugca

SEQ ID NO: 351095 - RNA, 22 nt, Homo sapiens
ggguaaaucucuuuucauggcu

SEQ ID NO: 351096 - RNA, 22 nt, Homo sapiens
ggguucccuucuggcucagggu

SEQ ID NO: 351097 - RNA, 22 nt, Homo sapiens
gguagacaucgugcucugugau

SEQ ID NO: 351098 - RNA, 22 nt, Homo sapiens
gguauuuaaaguaccugucugc

SEQ ID NO: 351099 - RNA, 22 nt, Homo sapiens
ggucacauuggacuaucaaguu

SEQ ID NO: 351100 - RNA, 22 nt, Homo sapiens
ggucacccugaugcuggugguc

SEQ ID NO: 351101 - RNA, 22 nt, Homo sapiens
ggucagugcauucuaaaggcaa

SEQ ID NO: 351102 - RNA, 22 nt, Homo sapiens
ggucaguguuaucaccgaagga

SEQ ID NO: 351103 - RNA, 22 nt, Homo sapiens
ggucaguuuucuccaggaucca

SEQ ID NO: 351104 - RNA, 22 nt, Homo sapiens
ggucauggauaagauccagaag

SEQ ID NO: 351105 - RNA, 22 nt, Homo sapiens
ggucauggauugucuuuucuug

SEQ ID NO: 351106 - RNA, 22 nt, Homo sapiens
gguggugguauuucagaaaaug

SEQ ID NO: 351107 - RNA, 22 nt, Homo sapiens
guaacagucucaacaguggucu

SEQ ID NO: 351108 - RNA, 22 nt, Homo sapiens
guaaccuauaguuaccaauagu

SEQ ID NO: 351109 - RNA, 22 nt, Homo sapiens
guaauacuggacaggguaucag

SEQ ID NO: 351110 - RNA, 22 nt, Homo sapiens
guaaucucaccuacuugggagg

SEQ ID NO: 351111 - RNA, 22 nt, Homo sapiens
guacaggcagcaaacaccauaa

SEQ ID NO: 351112 - RNA, 22 nt, Homo sapiens
ucacagucaaaguaaucauaga

SEQ ID NO: 351113 - RNA, 22 nt, Homo sapiens
ucacagucacugucacguugaa

SEQ ID NO: 351114 - RNA, 22 nt, Homo sapiens
ucacaguguuaaaccuuucuuu

SEQ ID NO: 351115 - RNA, 22 nt, Homo sapiens
ucacaguucagcauggcugagg

SEQ ID NO: 351116 - RNA, 22 nt, Homo sapiens
ucacaguugauugaaacacagc

SEQ ID NO: 351117 - RNA, 22 nt, Homo sapiens
ucacauaguuuucgggaccuug

SEQ ID NO: 351118 - RNA, 20 nt, Homo sapiens
ucacauccucucccaacaug

SEQ ID NO: 351119 - RNA, 21 nt, Homo sapiens
ucacauggccagaguaggaac

SEQ ID NO: 351120 - RNA, 18 nt, Homo sapiens
ucacauggccgagagaga

SEQ ID NO: 351121 - RNA, 22 nt, Homo sapiens
ucacaugggugcaauauaauca

SEQ ID NO: 351122 - RNA, 22 nt, Homo sapiens
uggcuuuuauuauguugaggua

SEQ ID NO: 351123 - RNA, 22 nt, Homo sapiens
uggcuuuucauccugggacauu

SEQ ID NO: 351124 - RNA, 22 nt, Homo sapiens
uggcuuuuccuugaaucugccu

SEQ ID NO: 351125 - RNA, 20 nt, Homo sapiens
ugggaaauguccaggacaua

SEQ ID NO: 351126 - RNA, 22 nt, Homo sapiens
ugggaacugaggugaaaagaca

SEQ ID NO: 351127 - RNA, 22 nt, Homo sapiens
ugggaagaagguuuacuugcca

SEQ ID NO: 351128 - RNA, 22 nt, Homo sapiens
ugggaagcugcugaacuacagu

SEQ ID NO: 351129 - RNA, 22 nt, Homo sapiens
ugggaaugaaauuacauagcuu

SEQ ID NO: 351130 - RNA, 22 nt, Homo sapiens
uuuugguaaugaacuuaggaag

SEQ ID NO: 351131 - RNA, 22 nt, Homo sapiens
uuuugguguauuguauaaggua

SEQ ID NO: 351132 - RNA, 22 nt, Homo sapiens
uuuuguacaacagcucugggga

SEQ ID NO: 351133 - RNA, 22 nt, Homo sapiens
uuuuguacgccuguguccauca

SEQ ID NO: 351134 - RNA, 21 nt, Homo sapiens
uuuugugcaugugcagccugc

SEQ ID NO: 351135 - RNA, 22 nt, Homo sapiens
uuuuugagaauuggugaaacac

SEQ ID NO: 351136 - RNA, 18 nt, Homo sapiens
uuuuugaggcacagggga

SEQ ID NO: 351137 - RNA, 22 nt, Homo sapiens
uuuuugaguaaauauaaauugu

SEQ ID NO: 351138 - RNA, 22 nt, Homo sapiens
uuuuuggguaaugauuaucaau

SEQ ID NO: 351139 - RNA, 22 nt, Homo sapiens
uuuuuuaguuagcugggcauga

SEQ ID NO: 351140 - RNA, 22 nt, Homo sapiens
uuggaauuuuaaaauaggcaac

SEQ ID NO: 351141 - RNA, 22 nt, Homo sapiens
uuggacuaagaacuuaaaauaa

SEQ ID NO: 351142 - RNA, 22 nt, Homo sapiens
uuggagcacuggggcacugaca

SEQ ID NO: 351143 - RNA, 22 nt, Homo sapiens
uuggaugauaaagaagccuaag

SEQ ID NO: 351144 - RNA, 22 nt, Homo sapiens
uuggcacugggaaaaugaccac

SEQ ID NO: 351145 - RNA, 22 nt, Homo sapiens
uuggcacuugauaauauucugg

SEQ ID NO: 351146 - RNA, 22 nt, Homo sapiens
uuggcagucugaggcacagacu

SEQ ID NO: 351147 - RNA, 22 nt, Homo sapiens
uuggcauagaggcucucaagcu

SEQ ID NO: 351148 - RNA, 23 nt, Homo sapiens
uuggccuccuugugucuagggcu

SEQ ID NO: 351149 - RNA, 22 nt, Homo sapiens
uuggcuguguuucccuacaaau

SEQ ID NO: 351150 - RNA, 22 nt, Homo sapiens
uugggaaugcuaaaccucuauu

SEQ ID NO: 351151 - RNA, 22 nt, Homo sapiens
uugggacuggaaggaguaaggg

SEQ ID NO: 351152 - RNA, 23 nt, Homo sapiens
uugggcaaaucacugagggcaga

SEQ ID NO: 351153 - RNA, 22 nt, Homo sapiens
uugggcauugggcuaaacuccc

SEQ ID NO: 351154 - RNA, 22 nt, Homo sapiens
uugggcuugagggugcccaguc

SEQ ID NO: 351155 - RNA, 22 nt, Homo sapiens
uugguauguaauuuauauugua

SEQ ID NO: 351156 - RNA, 22 nt, Homo sapiens
uuggucaggagccucccucuuu

SEQ ID NO: 351157 - RNA, 22 nt, Homo sapiens
uucccuuugaauuggaaaggug

SEQ ID NO: 351158 - RNA, 22 nt, Homo sapiens
uucccuuugugcauaggauuug

SEQ ID NO: 351159 - RNA, 22 nt, Homo sapiens
uucccuuuguuaaauuggaaga

SEQ ID NO: 351160 - RNA, 22 nt, Homo sapiens
uuccguguaguugagcaguuuu

SEQ ID NO: 351161 - RNA, 22 nt, Homo sapiens
uuccugcacuugcuugccuaug

SEQ ID NO: 351162 - RNA, 22 nt, Homo sapiens
uuccuugagagcuugauaucac

SEQ ID NO: 351163 - RNA, 22 nt, Homo sapiens
uuccuugguucagggaaggucc

SEQ ID NO: 351164 - RNA, 22 nt, Homo sapiens
uuccuugugacuaguagugacc

SEQ ID NO: 351165 - RNA, 20 nt, Homo sapiens
uucuauggugaugaguccug

SEQ ID NO: 351166 - RNA, 22 nt, Homo sapiens
uucuauugguaauauuuucugu

SEQ ID NO: 351167 - RNA, 22 nt, Homo sapiens
uucucauggaacaucuguacug

SEQ ID NO: 351168 - RNA, 22 nt, Homo sapiens
uucuccugguggacccuaaacg

SEQ ID NO: 351169 - RNA, 22 nt, Homo sapiens
uucuggccccucccaaucucau

SEQ ID NO: 351170 - RNA, 22 nt, Homo sapiens
uucuggcucgauucucugaccg

SEQ ID NO: 351171 - RNA, 22 nt, Homo sapiens
uggcaugauguguucauugaaa

SEQ ID NO: 351172 - RNA, 22 nt, Homo sapiens
uggcauguauuuuguguauuaa

SEQ ID NO: 351173 - RNA, 22 nt, Homo sapiens
uggcaugucagguuucuggguu

SEQ ID NO: 351174 - RNA, 22 nt, Homo sapiens
uggcaugugugaagugcccagc

SEQ ID NO: 351175 - RNA, 22 nt, Homo sapiens
uggcauguuggguguugacucc

SEQ ID NO: 351176 - RNA, 20 nt, Homo sapiens
uggcauguugguaugcaccc

SEQ ID NO: 351177 - RNA, 22 nt, Homo sapiens
uggcuacugacugaugauuaua

SEQ ID NO: 351178 - RNA, 19 nt, Homo sapiens
uggcuagaggccaggcguu

SEQ ID NO: 351179 - RNA, 22 nt, Homo sapiens
uggcucauuucuaaacccagcu

SEQ ID NO: 351180 - RNA, 22 nt, Homo sapiens
uggcuguuguuacuaacaguuc

SEQ ID NO: 351181 - RNA, 22 nt, Homo sapiens
uggcuguuuauuucaccugggc

SEQ ID NO: 351182 - RNA, 20 nt, Homo sapiens
uggcuucuuaauugcaggca

SEQ ID NO: 351183 - RNA, 22 nt, Homo sapiens
uggcuuuuaucuacucucaacu

SEQ ID NO: 351184 - RNA, 22 nt, Homo sapiens
uggcuuuuguuauuuggaagcu

SEQ ID NO: 351185 - RNA, 22 nt, Homo sapiens
ugggaagaugcugcuucuuccu

SEQ ID NO: 351186 - RNA, 22 nt, Homo sapiens
ugggaugaaaauagcuucuucc

SEQ ID NO: 351187 - RNA, 22 nt, Homo sapiens
ugggcaagagagcaugacccug

SEQ ID NO: 351188 - RNA, 22 nt, Homo sapiens
ugggcagugggacagcuuugug

SEQ ID NO: 351189 - RNA, 22 nt, Homo sapiens
ugggguaggcuguauacucugu

SEQ ID NO: 351190 - RNA, 22 nt, Homo sapiens
uggguaggaccagaaaugcacu

SEQ ID NO: 351191 - RNA, 22 nt, Homo sapiens
uggguaguguaaagcacuccag

SEQ ID NO: 351192 - RNA, 19 nt, Homo sapiens
uggguaguuuucuggcugg

SEQ ID NO: 351193 - RNA, 22 nt, Homo sapiens
ugggucaguagcauguaugucu

SEQ ID NO: 351194 - RNA, 22 nt, Homo sapiens
uggguucccugucuguccuuga

SEQ ID NO: 351195 - RNA, 22 nt, Homo sapiens
ugguaagaaaaccauuauuagc

SEQ ID NO: 351196 - RNA, 22 nt, Homo sapiens
ugguaagaucagaacuggaguc

SEQ ID NO: 351197 - RNA, 22 nt, Homo sapiens
ugguaagaucugugagccaggc

SEQ ID NO: 351198 - RNA, 20 nt, Homo sapiens
ugguaauguaagagaggaga

SEQ ID NO: 351199 - RNA, 22 nt, Homo sapiens
ugguauuuaauauaugagaguu

SEQ ID NO: 351200 - RNA, 22 nt, Homo sapiens
uggucagaugcugaguggaucu

SEQ ID NO: 351201 - RNA, 22 nt, Homo sapiens
uggucaguugaguccuugccaa

SEQ ID NO: 351202 - RNA, 22 nt, Homo sapiens
uggucauggaaauagaaugcac

SEQ ID NO: 351203 - RNA, 21 nt, Homo sapiens
uggucccuucagaucggauuu

SEQ ID NO: 351204 - RNA, 22 nt, Homo sapiens
ugguccucugcuuccagaauuc

SEQ ID NO: 351205 - RNA, 15 nt, Homo sapiens
uggugguguugagac

SEQ ID NO: 351206 - RNA, 22 nt, Homo sapiens
ugguguuugagaagcugauguc

SEQ ID NO: 351207 - RNA, 22 nt, Homo sapiens
ugguuagucuguguguauauau

SEQ ID NO: 351208 - RNA, 22 nt, Homo sapiens
ugguucaguugcacaggcuguu

SEQ ID NO: 351209 - RNA, 21 nt, Homo sapiens
ugguugauccuccuagugccu

SEQ ID NO: 351210 - RNA, 22 nt, Homo sapiens
uguaaacauguauguguuuaug

SEQ ID NO: 351211 - RNA, 22 nt, Homo sapiens
uguaaacuuuugagauugacuu

SEQ ID NO: 351212 - RNA, 22 nt, Homo sapiens
uguaaagaaagcuguuguugua

SEQ ID NO: 351213 - RNA, 22 nt, Homo sapiens
uguaacaguaguuacuauucuu

SEQ ID NO: 351214 - RNA, 22 nt, Homo sapiens
uguaauaguaggcucacauuug

SEQ ID NO: 351215 - RNA, 22 nt, Homo sapiens
uguagggagagggaguugcacc

SEQ ID NO: 351216 - RNA, 22 nt, Homo sapiens
uguagucauuuggaguccagcu

SEQ ID NO: 351217 - RNA, 23 nt, Homo sapiens
uguauacacccugugcaucuggg

SEQ ID NO: 351218 - RNA, 21 nt, Homo sapiens
uguauacauauguuaggugca

SEQ ID NO: 351219 - RNA, 22 nt, Homo sapiens
ugaguguccaaguaaggugaaa

SEQ ID NO: 351220 - RNA, 22 nt, Homo sapiens
ugaguguccaccccuuucacag

SEQ ID NO: 351221 - RNA, 22 nt, Homo sapiens
ugagugugacuuagcagaagga

SEQ ID NO: 351222 - RNA, 22 nt, Homo sapiens
ugagugugaggaagaauuagaa

SEQ ID NO: 351223 - RNA, 22 nt, Homo sapiens
ugaguuagguguuuuaaauaua

SEQ ID NO: 351224 - RNA, 22 nt, Homo sapiens
ugauaggagauuuucaucugua

SEQ ID NO: 351225 - RNA, 22 nt, Homo sapiens
ugauauguuagaaucuugcaag

SEQ ID NO: 351226 - RNA, 22 nt, Homo sapiens
ugaucuguccaccucagcuucc

SEQ ID NO: 351227 - RNA, 22 nt, Homo sapiens
ugaucuuuuuaauguccauggg

SEQ ID NO: 351228 - RNA, 22 nt, Homo sapiens
ugaugaaguauaggaagggcuu

SEQ ID NO: 351229 - RNA, 22 nt, Homo sapiens
ugauggcacagugaguuccagg

SEQ ID NO: 351230 - RNA, 22 nt, Homo sapiens
ugaugucuugcaggcacgagau

SEQ ID NO: 351231 - RNA, 19 nt, Homo sapiens
ugauuguaagcuuggugag

SEQ ID NO: 351232 - RNA, 22 nt, Homo sapiens
ugauuuguuuagugccaaguuu

SEQ ID NO: 351233 - RNA, 22 nt, Homo sapiens
ugcaaacuuccuugggcagcau

SEQ ID NO: 351234 - RNA, 22 nt, Homo sapiens
ugcaaaugcugcuauuucucuu

SEQ ID NO: 351235 - RNA, 22 nt, Homo sapiens
ugcaaauguuauuuugguuucu

SEQ ID NO: 351236 - RNA, 22 nt, Homo sapiens
ugcaagacaucguauuuugguc

SEQ ID NO: 351237 - RNA, 22 nt, Homo sapiens
ugcaagaggagacuguacucag

SEQ ID NO: 351238 - RNA, 22 nt, Homo sapiens
ugcaccaauucuaaacaguucu

SEQ ID NO: 351239 - RNA, 22 nt, Homo sapiens
ugcaccauugcauacuuaauua

SEQ ID NO: 351240 - RNA, 22 nt, Homo sapiens
ugcagagaaacauuuuguauuu

SEQ ID NO: 351241 - RNA, 22 nt, Homo sapiens
ugcagauucguuuugaggggua

SEQ ID NO: 351242 - RNA, 19 nt, Homo sapiens
ugcagcaauguaaaagaca

SEQ ID NO: 351243 - RNA, 17 nt, Homo sapiens
ugcagcacacugauggg

SEQ ID NO: 351244 - RNA, 22 nt, Homo sapiens
ugcagugcaugacuguguuaug

SEQ ID NO: 351245 - RNA, 22 nt, Homo sapiens
ugcagugugaaagagccugaca

SEQ ID NO: 351246 - RNA, 18 nt, Homo sapiens
ugcauacuaucugauuuu

SEQ ID NO: 351247 - RNA, 22 nt, Homo sapiens
ugcauagcaaaauaggauuaga

SEQ ID NO: 351248 - RNA, 19 nt, Homo sapiens
ugcauaggguuacauacuc

SEQ ID NO: 351249 - RNA, 22 nt, Homo sapiens
ugcauauguucaaaguauucug

SEQ ID NO: 351250 - RNA, 18 nt, Homo sapiens
ugcauauguugaaccagc

SEQ ID NO: 351251 - RNA, 22 nt, Homo sapiens
ugcauauguugaaccaggcuug

SEQ ID NO: 351252 - RNA, 22 nt, Homo sapiens
ugcauggagcucucuuuggacu

SEQ ID NO: 351253 - RNA, 22 nt, Homo sapiens
ugcauguucuuacucauacaug

SEQ ID NO: 351254 - RNA, 22 nt, Homo sapiens
ugcauuagucuguucucacacu

SEQ ID NO: 351255 - RNA, 22 nt, Homo sapiens
ugccaguguugccuuucacuag

SEQ ID NO: 351256 - RNA, 19 nt, Homo sapiens
ugccauguagcacaugguc

SEQ ID NO: 351257 - RNA, 22 nt, Homo sapiens
ugcccuguaucccacuguuuca

SEQ ID NO: 351258 - RNA, 22 nt, Homo sapiens
ugccuaguggaaggagagcaaa

SEQ ID NO: 351259 - RNA, 22 nt, Homo sapiens
ugccuggagagcuccuacauau

SEQ ID NO: 351260 - RNA, 22 nt, Homo sapiens
ugccuuauuccaacugagcucu

SEQ ID NO: 351261 - RNA, 21 nt, Homo sapiens
ugccuuuguaguaggugucuu

SEQ ID NO: 351262 - RNA, 18 nt, Homo sapiens
ugcuaugagauuauuuua

SEQ ID NO: 351263 - RNA, 22 nt, Homo sapiens
ugcucaguuuaaaacuuuugag

SEQ ID NO: 351264 - RNA, 23 nt, Homo sapiens
ugcugagaccuagauccuaaaga

SEQ ID NO: 351265 - RNA, 20 nt, Homo sapiens
ugcugcacuuaagcaugggc

SEQ ID NO: 351266 - RNA, 22 nt, Homo sapiens
ugcugcuguuguuguuacuagc

SEQ ID NO: 351267 - RNA, 22 nt, Homo sapiens
ugcuuaguguugacccucugcc

SEQ ID NO: 351268 - RNA, 22 nt, Homo sapiens
ugcuuguguucagguaaccuuu

SEQ ID NO: 351269 - RNA, 23 nt, Homo sapiens
uggaacugaauuucuuagcauuu

SEQ ID NO: 351270 - RNA, 22 nt, Homo sapiens
gggcagaugucuggacaccuca

SEQ ID NO: 351271 - RNA, 22 nt, Homo sapiens
gggcauguggacuuguauguuu

SEQ ID NO: 351272 - RNA, 22 nt, Homo sapiens
gggcauugugggcagagggcag

SEQ ID NO: 351273 - RNA, 22 nt, Homo sapiens
gggccagaugcauuuguuauuu

SEQ ID NO: 351274 - RNA, 22 nt, Homo sapiens
gggguaguuacuguuguucuuu

SEQ ID NO: 351275 - RNA, 22 nt, Homo sapiens
ggguucccugaugagaguuagu

SEQ ID NO: 351276 - RNA, 22 nt, Homo sapiens
gguaaguuuggggcuaauuugu

SEQ ID NO: 351277 - RNA, 22 nt, Homo sapiens
gguauguaggucuacgguacaa

SEQ ID NO: 351278 - RNA, 22 nt, Homo sapiens
ggucagauggcagcugggccug

SEQ ID NO: 351279 - RNA, 22 nt, Homo sapiens
ggucaggagaaugguaacugag

SEQ ID NO: 351280 - RNA, 22 nt, Homo sapiens
ggucauggagcuuuacuuuaug

SEQ ID NO: 351281 - RNA, 22 nt, Homo sapiens
gguccgccugccuuggccuccc

SEQ ID NO: 351282 - RNA, 22 nt, Homo sapiens
ggugagcacagaaugcccugag

SEQ ID NO: 351283 - RNA, 22 nt, Homo sapiens
gguggcaaaucugaguggcgcu

SEQ ID NO: 351284 - RNA, 22 nt, Homo sapiens
gguggcuuuuugugauggcuga

SEQ ID NO: 351285 - RNA, 22 nt, Homo sapiens
ggugucaguuggccccuacugg

SEQ ID NO: 351286 - RNA, 22 nt, Homo sapiens
gguguguaaauuacuuaucucu

SEQ ID NO: 351287 - RNA, 22 nt, Homo sapiens
guaaagacacaugcacacguau

SEQ ID NO: 351288 - RNA, 22 nt, Homo sapiens
guaacacaugcugcucucuggu

SEQ ID NO: 351289 - RNA, 22 nt, Homo sapiens
guaaguagcuuuagauauaaau

SEQ ID NO: 351290 - RNA, 23 nt, Homo sapiens
guaauacuagucauaguagcagg

SEQ ID NO: 351291 - RNA, 22 nt, Homo sapiens
guaaucucagcuacuugggagu

SEQ ID NO: 351292 - RNA, 22 nt, Homo sapiens
guacacguggcuguguaggagu

SEQ ID NO: 351293 - RNA, 17 nt, Homo sapiens
guacacuucuucuguga

SEQ ID NO: 351294 - RNA, 22 nt, Homo sapiens
guacaguggguguagggaccag

SEQ ID NO: 351295 - RNA, 22 nt, Homo sapiens
guacaguuuucaguguucacug

SEQ ID NO: 351296 - RNA, 22 nt, Homo sapiens
guacuuuguuauaacccacagg

SEQ ID NO: 351297 - RNA, 22 nt, Homo sapiens
guagaaagcauuucagauuugc

SEQ ID NO: 351298 - RNA, 22 nt, Homo sapiens
guagaagcacaggugaguuggu

SEQ ID NO: 351299 - RNA, 22 nt, Homo sapiens
guagaucucaacacuggaagua

SEQ ID NO: 351300 - RNA, 22 nt, Homo sapiens
guagcagucacauagcagauug

SEQ ID NO: 351301 - RNA, 22 nt, Homo sapiens
guauggcacuauccucucugau

SEQ ID NO: 351302 - RNA, 22 nt, Homo sapiens
guauuagguuggugcaaaauaa

SEQ ID NO: 351303 - RNA, 19 nt, Homo sapiens
guauuugguaaacucucca

SEQ ID NO: 351304 - RNA, 22 nt, Homo sapiens
guauuuggugaugccuccaaac

SEQ ID NO: 351305 - RNA, 22 nt, Homo sapiens
guauuuguugcagcagcacuau

SEQ ID NO: 351306 - RNA, 22 nt, Homo sapiens
gucaaaugcacagaaccauuaa

SEQ ID NO: 351307 - RNA, 22 nt, Homo sapiens
gucacaguggccagugauguuc

SEQ ID NO: 351308 - RNA, 22 nt, Homo sapiens
gucacuggcugucuuguaugau

SEQ ID NO: 351309 - RNA, 22 nt, Homo sapiens
gucacugugacggcaguuacau

SEQ ID NO: 351310 - RNA, 22 nt, Homo sapiens
gucagcuuuuccuuacuuuagg

SEQ ID NO: 351311 - RNA, 22 nt, Homo sapiens
gucaggaccucgguggcauucu

SEQ ID NO: 351312 - RNA, 22 nt, Homo sapiens
gucagugugauaucugcagggg

SEQ ID NO: 351313 - RNA, 22 nt, Homo sapiens
gucauucauucagcaagcacug

SEQ ID NO: 351314 - RNA, 22 nt, Homo sapiens
gucauugaaguggaaucaucca

SEQ ID NO: 351315 - RNA, 22 nt, Homo sapiens
guccaguguuggagguuuuacc

SEQ ID NO: 351316 - RNA, 18 nt, Homo sapiens
guccauuuguugguacac

SEQ ID NO: 351317 - RNA, 22 nt, Homo sapiens
gucccugcgauugugggauccu

SEQ ID NO: 351318 - RNA, 22 nt, Homo sapiens
gucccugugucuuuauguggcc

SEQ ID NO: 351319 - RNA, 22 nt, Homo sapiens
guccuggagaagcguggaccgg

SEQ ID NO: 351320 - RNA, 22 nt, Homo sapiens
gucguggagucucuggcuugua

SEQ ID NO: 351321 - RNA, 22 nt, Homo sapiens
gucucuuguuaucauuucugag

SEQ ID NO: 351322 - RNA, 22 nt, Homo sapiens
gucuggcaauggcagacuggca

SEQ ID NO: 351323 - RNA, 22 nt, Homo sapiens
gucuggguuuguuuguacuugc

SEQ ID NO: 351324 - RNA, 22 nt, Homo sapiens
gucugguuccugggagauuucu

SEQ ID NO: 351325 - RNA, 22 nt, Homo sapiens
gucugguugacagcauguggcc

SEQ ID NO: 351326 - RNA, 22 nt, Homo sapiens
gucugguuggaguaguuuucag

SEQ ID NO: 351327 - RNA, 22 nt, Homo sapiens
gucuuugaugucuaugugcuuc

SEQ ID NO: 351328 - RNA, 17 nt, Homo sapiens
gucuuugguugaguuua

SEQ ID NO: 351329 - RNA, 22 nt, Homo sapiens
gucuuuugcuagccagagagcu

SEQ ID NO: 351330 - RNA, 22 nt, Homo sapiens
gugaaauacauaaucccaagug

SEQ ID NO: 351331 - RNA, 22 nt, Homo sapiens
gugaaaugaaacgcuaugucuu

SEQ ID NO: 351332 - RNA, 22 nt, Homo sapiens
gugaagaucccuguccuguucc

SEQ ID NO: 351333 - RNA, 22 nt, Homo sapiens
gugaaguuuuuugcugagaguc

SEQ ID NO: 351334 - RNA, 22 nt, Homo sapiens
gugaauguaaagucaugugacu

SEQ ID NO: 351335 - RNA, 20 nt, Homo sapiens
gugacacucguuaaccucug

SEQ ID NO: 351336 - RNA, 22 nt, Homo sapiens
gugacagaguaagacccuguau

SEQ ID NO: 351337 - RNA, 22 nt, Homo sapiens
gugacaguggagacuuacuuca

SEQ ID NO: 351338 - RNA, 22 nt, Homo sapiens
uuaagguuuuuguagcaaggau

SEQ ID NO: 351339 - RNA, 22 nt, Homo sapiens
uuaaguaaucagagaagagaac

SEQ ID NO: 351340 - RNA, 22 nt, Homo sapiens
uuaagucacacuagacaacuga

SEQ ID NO: 351341 - RNA, 22 nt, Homo sapiens
uuaaugaacuuuauuuuguaga

SEQ ID NO: 351342 - RNA, 22 nt, Homo sapiens
uuaaugacaucauaggugaagu

SEQ ID NO: 351343 - RNA, 22 nt, Homo sapiens
uuaaugcuuggggaguaguucu

SEQ ID NO: 351344 - RNA, 22 nt, Homo sapiens
uuaauggagaguuucauuggug

SEQ ID NO: 351345 - RNA, 19 nt, Homo sapiens
uuacacaaccuaguggggc

SEQ ID NO: 351346 - RNA, 22 nt, Homo sapiens
uuacagauggcacacucaaggg

SEQ ID NO: 351347 - RNA, 22 nt, Homo sapiens
uuacauugcuucaaauucagug

SEQ ID NO: 351348 - RNA, 22 nt, Homo sapiens
uuacugcauaauuccugggaag

SEQ ID NO: 351349 - RNA, 22 nt, Homo sapiens
uuagaaaguagaaaagcugguu

SEQ ID NO: 351350 - RNA, 22 nt, Homo sapiens
uuagacacacauacauuuaucu

SEQ ID NO: 351351 - RNA, 22 nt, Homo sapiens
uuagauuauugagcauccacug

SEQ ID NO: 351352 - RNA, 22 nt, Homo sapiens
uuagcagcucuggugacaaggu

SEQ ID NO: 351353 - RNA, 22 nt, Homo sapiens
uuagcaugucuacuaauuugcu

SEQ ID NO: 351354 - RNA, 22 nt, Homo sapiens
uuagccccuuugagccucaacu

SEQ ID NO: 351355 - RNA, 21 nt, Homo sapiens
uuaggcagugucagaggugag

SEQ ID NO: 351356 - RNA, 22 nt, Homo sapiens
uuaggcaguuuauugauuuuca

SEQ ID NO: 351357 - RNA, 22 nt, Homo sapiens
uuagggaggacaguuacaacag

SEQ ID NO: 351358 - RNA, 22 nt, Homo sapiens
uuagggaguaaucuaaaaaugg

SEQ ID NO: 351359 - RNA, 22 nt, Homo sapiens
uuagguacuuuggagagauuca

SEQ ID NO: 351360 - RNA, 22 nt, Homo sapiens
uuaguaguagcugcaugucagu

SEQ ID NO: 351361 - RNA, 22 nt, Homo sapiens
uuaguaucauccuucugcauuc

SEQ ID NO: 351362 - RNA, 22 nt, Homo sapiens
uuagugaaugggugugauuugu

SEQ ID NO: 351363 - RNA, 22 nt, Homo sapiens
uuauaacagagacuccugugcu

SEQ ID NO: 351364 - RNA, 22 nt, Homo sapiens
uuauaugcuaaacaaggggugg

SEQ ID NO: 351365 - RNA, 22 nt, Homo sapiens
uuaucagcagcaugaaaauaga

SEQ ID NO: 351366 - RNA, 22 nt, Homo sapiens
uuaucagcagugcgaaaacaga

SEQ ID NO: 351367 - RNA, 21 nt, Homo sapiens
uuauccagcacuguuucggac

SEQ ID NO: 351368 - RNA, 22 nt, Homo sapiens
uuauggcucuuggggaaguaga

SEQ ID NO: 351369 - RNA, 22 nt, Homo sapiens
uuauguaaaucaaucuggaauc

SEQ ID NO: 351370 - RNA, 22 nt, Homo sapiens
uuaugucauuuuuggauguuaa

SEQ ID NO: 351371 - RNA, 22 nt, Homo sapiens
uuauuagguuaaccuauagcua

SEQ ID NO: 351372 - RNA, 22 nt, Homo sapiens
uuauuagguuagugcaaaaguu

SEQ ID NO: 351373 - RNA, 22 nt, Homo sapiens
uuauugcacuccagccugggua

SEQ ID NO: 351374 - RNA, 16 nt, Homo sapiens
uuauugcauucuucuc

SEQ ID NO: 351375 - RNA, 22 nt, Homo sapiens
uucaaaggauagauuaagauca

SEQ ID NO: 351376 - RNA, 22 nt, Homo sapiens
uucaagauggcaccagugagug

SEQ ID NO: 351377 - RNA, 21 nt, Homo sapiens
uucacaagggaaguagggggc

SEQ ID NO: 351378 - RNA, 22 nt, Homo sapiens
uucacagaaaaaggcgaugagg

SEQ ID NO: 351379 - RNA, 22 nt, Homo sapiens
uucacaguguuucucacgguua

SEQ ID NO: 351380 - RNA, 22 nt, Homo sapiens
uucaccaguuuugucacgaaug

SEQ ID NO: 351381 - RNA, 22 nt, Homo sapiens
uucaccuggaguucaggauaag

SEQ ID NO: 351382 - RNA, 22 nt, Homo sapiens
uucacugcacuccagccugggu

SEQ ID NO: 351383 - RNA, 22 nt, Homo sapiens
uucacugcauuucagccugggc

SEQ ID NO: 351384 - RNA, 22 nt, Homo sapiens
cauuaagcuacuuagaaggugc

SEQ ID NO: 351385 - RNA, 22 nt, Homo sapiens
cauuccacauguaggacaauuu

SEQ ID NO: 351386 - RNA, 22 nt, Homo sapiens
cauugcaaugaggucuugcagu

SEQ ID NO: 351387 - RNA, 22 nt, Homo sapiens
cauugcacuccagccucggcaa

SEQ ID NO: 351388 - RNA, 22 nt, Homo sapiens
cauugcacuccagccugaggga

SEQ ID NO: 351389 - RNA, 22 nt, Homo sapiens
cauugcacuccagccugcugac

SEQ ID NO: 351390 - RNA, 22 nt, Homo sapiens
cauugcacuccagccuggccaa

SEQ ID NO: 351391 - RNA, 22 nt, Homo sapiens
cauugcacuccagccuuggcaa

SEQ ID NO: 351392 - RNA, 22 nt, Homo sapiens
cauugcacuccagcucugggcg

SEQ ID NO: 351393 - RNA, 22 nt, Homo sapiens
cauugcacuccagcuugggcaa

SEQ ID NO: 351394 - RNA, 22 nt, Homo sapiens
cauugcacucuagccucggcaa

SEQ ID NO: 351395 - RNA, 22 nt, Homo sapiens
cauugcacucuagucuggguga

SEQ ID NO: 351396 - RNA, 22 nt, Homo sapiens
cauugcacucugcauuccaguc

SEQ ID NO: 351397 - RNA, 22 nt, Homo sapiens
cauugguuccaguuuguccuua

SEQ ID NO: 351398 - RNA, 22 nt, Homo sapiens
cauugguugaacagauuguguu

SEQ ID NO: 351399 - RNA, 22 nt, Homo sapiens
cauugucccucaaugacuauga

SEQ ID NO: 351400 - RNA, 22 nt, Homo sapiens
ccaaaguauuuucacugauauc

SEQ ID NO: 351401 - RNA, 22 nt, Homo sapiens
ccaaguguuuucauuguuccau

SEQ ID NO: 351402 - RNA, 22 nt, Homo sapiens
ccacaaccucaacagcaucuau

SEQ ID NO: 351403 - RNA, 22 nt, Homo sapiens
ccacccuuccauucuuccucuu

SEQ ID NO: 351404 - RNA, 22 nt, Homo sapiens
ccacugcacuccagcccggcaa

SEQ ID NO: 351405 - RNA, 22 nt, Homo sapiens
ccacugggcuagguguuuugga

SEQ ID NO: 351406 - RNA, 22 nt, Homo sapiens
ccacugugguaucugauacugg

SEQ ID NO: 351407 - RNA, 22 nt, Homo sapiens
ccagcaccauuuguugaauagg

SEQ ID NO: 351408 - RNA, 22 nt, Homo sapiens
ccaggguugcuuuagauucuga

SEQ ID NO: 351409 - RNA, 17 nt, Homo sapiens
ccagugaucccuuuugu

SEQ ID NO: 351410 - RNA, 21 nt, Homo sapiens
ccaguguaaugauagcaggca

SEQ ID NO: 351411 - RNA, 22 nt, Homo sapiens
ccaguguauuuuugggaccugc

SEQ ID NO: 351412 - RNA, 22 nt, Homo sapiens
ccagugucugacagacacggcg

SEQ ID NO: 351413 - RNA, 22 nt, Homo sapiens
ccaucacaggccucagugggaa

SEQ ID NO: 351414 - RNA, 22 nt, Homo sapiens
ccaucccuuucugagcaguucc

SEQ ID NO: 351415 - RNA, 22 nt, Homo sapiens
ccauugaacaugaaggaaugug

SEQ ID NO: 351416 - RNA, 22 nt, Homo sapiens
ccauugcacuccauccugggca

SEQ ID NO: 351417 - RNA, 22 nt, Homo sapiens
ccauugcacuucagccuaggug

SEQ ID NO: 351418 - RNA, 22 nt, Homo sapiens
cccagagacagaaugauaaacu

SEQ ID NO: 351419 - RNA, 19 nt, Homo sapiens
cccagugucagagaagggu

SEQ ID NO: 351420 - RNA, 22 nt, Homo sapiens
cccaguuuugccacuuacuagc

SEQ ID NO: 351421 - RNA, 18 nt, Homo sapiens
cccgggugggcuguuccc

SEQ ID NO: 351422 - RNA, 20 nt, Homo sapiens
cccuaagccagaugcugggg

SEQ ID NO: 351423 - RNA, 22 nt, Homo sapiens
cccugacauucggagauguagu

SEQ ID NO: 351424 - RNA, 22 nt, Homo sapiens
cccuguguuguucaaggaucug

SEQ ID NO: 351425 - RNA, 22 nt, Homo sapiens
cccuguguuuagcugaagguuu

SEQ ID NO: 351426 - RNA, 22 nt, Homo sapiens
cccuugcacuucagagcugcau

SEQ ID NO: 351427 - RNA, 22 nt, Homo sapiens
ccuaggcacugggguccagccc

SEQ ID NO: 351428 - RNA, 22 nt, Homo sapiens
ccucauugcuaucccaggcuga

SEQ ID NO: 351429 - RNA, 22 nt, Homo sapiens
ccucuuuguugagacuucacca

SEQ ID NO: 351430 - RNA, 21 nt, Homo sapiens
ccugaguacaacccacuccac

SEQ ID NO: 351431 - RNA, 19 nt, Homo sapiens
ccugcuguucuuuugcacc

SEQ ID NO: 351432 - RNA, 22 nt, Homo sapiens
ccugucuugauuaaauuacuua

SEQ ID NO: 351433 - RNA, 22 nt, Homo sapiens
ccuguguuaugguuucuaaugu

SEQ ID NO: 351434 - RNA, 22 nt, Homo sapiens
ccuucauccuccagcaggcuag

SEQ ID NO: 351435 - RNA, 22 nt, Homo sapiens
ccuucauucauuaauuuagccc

SEQ ID NO: 351436 - RNA, 22 nt, Homo sapiens
ccuucauugcaucuuuaagaga

SEQ ID NO: 351437 - RNA, 21 nt, Homo sapiens
ccuugagaacaucaauuugcu

SEQ ID NO: 351438 - RNA, 19 nt, Homo sapiens
ccuuugguuuccaugacau

SEQ ID NO: 351439 - RNA, 22 nt, Homo sapiens
cgccgggggaugggcaccagcg

SEQ ID NO: 351440 - RNA, 22 nt, Homo sapiens
cgccugagcugaggaagcugca

SEQ ID NO: 351441 - RNA, 22 nt, Homo sapiens
cgcuggugucuaagcgacagcu

SEQ ID NO: 351442 - RNA, 22 nt, Homo sapiens
cggcaguggguaagccaagcuu

SEQ ID NO: 351443 - RNA, 22 nt, Homo sapiens
cuaaaguucuucugagagaaca

SEQ ID NO: 351444 - RNA, 22 nt, Homo sapiens
cuaacacagagguuuauuucuc

SEQ ID NO: 351445 - RNA, 22 nt, Homo sapiens
cuaagcaccuuaguggggaauc

SEQ ID NO: 351446 - RNA, 22 nt, Homo sapiens
cuacacaugcaggcucccugcc

SEQ ID NO: 351447 - RNA, 22 nt, Homo sapiens
cuacagaguaucuaaagaggua

SEQ ID NO: 351448 - RNA, 22 nt, Homo sapiens
cuagcagacaugggcugaacca

SEQ ID NO: 351449 - RNA, 22 nt, Homo sapiens
cuauggcucugguuauggcugu

SEQ ID NO: 351450 - RNA, 22 nt, Homo sapiens
cuauggcuguaaggauaguaac

SEQ ID NO: 351451 - RNA, 22 nt, Homo sapiens
ugacaucugcuugugcccagga

SEQ ID NO: 351452 - RNA, 22 nt, Homo sapiens
ugacaugaagucucccucuguu

SEQ ID NO: 351453 - RNA, 22 nt, Homo sapiens
cucugguuaaggcugaacuaua

SEQ ID NO: 351454 - RNA, 22 nt, Homo sapiens
cucugguuucgcaggaaauaga

SEQ ID NO: 351455 - RNA, 21 nt, Homo sapiens
cucugguuugcauuggauuau

SEQ ID NO: 351456 - RNA, 22 nt, Homo sapiens
cucuuugaggugagcugcccau

SEQ ID NO: 351457 - RNA, 22 nt, Homo sapiens
cugaaauggaaugugugcacag

SEQ ID NO: 351458 - RNA, 22 nt, Homo sapiens
cugaaauguccaucgacugaug

SEQ ID NO: 351459 - RNA, 22 nt, Homo sapiens
cugaagugcuugccacauaaaa

SEQ ID NO: 351460 - RNA, 20 nt, Homo sapiens
cugaaugucaaggcagaggu

SEQ ID NO: 351461 - RNA, 22 nt, Homo sapiens
cugaauguuucacucugaaaug

SEQ ID NO: 351462 - RNA, 22 nt, Homo sapiens
cugacauuguugaucacagcca

SEQ ID NO: 351463 - RNA, 22 nt, Homo sapiens
cugacugaggaucaguucauca

SEQ ID NO: 351464 - RNA, 22 nt, Homo sapiens
cugagaaugaugauuuccaguu

SEQ ID NO: 351465 - RNA, 22 nt, Homo sapiens
cugagacuggugauuuaugaag

SEQ ID NO: 351466 - RNA, 22 nt, Homo sapiens
cugagagaggagcuaaaacugc

SEQ ID NO: 351467 - RNA, 22 nt, Homo sapiens
cugagauacacuaauagucucu

SEQ ID NO: 351468 - RNA, 22 nt, Homo sapiens
cugagauaggacucugcuggcu

SEQ ID NO: 351469 - RNA, 22 nt, Homo sapiens
cugagaucaagucuugcucugu

SEQ ID NO: 351470 - RNA, 22 nt, Homo sapiens
cugagaucuuauuagaaaugca

SEQ ID NO: 351471 - RNA, 22 nt, Homo sapiens
cugaggacaucagggaagcauc

SEQ ID NO: 351472 - RNA, 22 nt, Homo sapiens
cugaggauauucagccucugug

SEQ ID NO: 351473 - RNA, 22 nt, Homo sapiens
cugaggguagaaggaucacuug

SEQ ID NO: 351474 - RNA, 22 nt, Homo sapiens
cugaggugggaggauuggcuug

SEQ ID NO: 351475 - RNA, 22 nt, Homo sapiens
cugagguuguucuucucagugg

SEQ ID NO: 351476 - RNA, 22 nt, Homo sapiens
cugaucuguagcagccaccaca

SEQ ID NO: 351477 - RNA, 22 nt, Homo sapiens
cugaucuguuauacuuuucuau

SEQ ID NO: 351478 - RNA, 21 nt, Homo sapiens
cugcaaaugcugcugccugau

SEQ ID NO: 351479 - RNA, 22 nt, Homo sapiens
cugcaagaugcauaggaauuuu

SEQ ID NO: 351480 - RNA, 22 nt, Homo sapiens
cugcaauggagaaagugagacu

SEQ ID NO: 351481 - RNA, 22 nt, Homo sapiens
cugcaguaaccacuguaggugu

SEQ ID NO: 351482 - RNA, 22 nt, Homo sapiens
cugcauuugaugacguauggug

SEQ ID NO: 351483 - RNA, 18 nt, Homo sapiens
cugccagugugcucuccg

SEQ ID NO: 351484 - RNA, 22 nt, Homo sapiens
cugccaguuugauucgggccac

SEQ ID NO: 351485 - RNA, 22 nt, Homo sapiens
cugcuaagagaaugagacuuag

SEQ ID NO: 351486 - RNA, 22 nt, Homo sapiens
cuggaaagcaaagggugcauug

SEQ ID NO: 351487 - RNA, 22 nt, Homo sapiens
cuggaaucuauggauaacaucg

SEQ ID NO: 351488 - RNA, 22 nt, Homo sapiens
cuggagauauuggaagaaagaa

SEQ ID NO: 351489 - RNA, 22 nt, Homo sapiens
cuggaguuugaggcugcaguga

SEQ ID NO: 351490 - RNA, 22 nt, Homo sapiens
cuggcaccauacacuguuguug

SEQ ID NO: 351491 - RNA, 22 nt, Homo sapiens
cugggguaggacuggcuuuuga

SEQ ID NO: 351492 - RNA, 22 nt, Homo sapiens
cuguaaagaucacagagcuggu

SEQ ID NO: 351493 - RNA, 22 nt, Homo sapiens
cuguaaaguucucauuguagcc

SEQ ID NO: 351494 - RNA, 22 nt, Homo sapiens
cuguagcuuuuauaugcuuagc

SEQ ID NO: 351495 - RNA, 22 nt, Homo sapiens
cuguaugugagaaauaauaagu

SEQ ID NO: 351496 - RNA, 22 nt, Homo sapiens
cuguauguuucuaugaauguga

SEQ ID NO: 351497 - RNA, 22 nt, Homo sapiens
cugucacaguuuuggaggccag

SEQ ID NO: 351498 - RNA, 22 nt, Homo sapiens
cugucuggaguccuucgugugc

SEQ ID NO: 351499 - RNA, 22 nt, Homo sapiens
cugugacugcagggcauauuug

SEQ ID NO: 351500 - RNA, 22 nt, Homo sapiens
cugugcauaugacuuuauugga

SEQ ID NO: 351501 - RNA, 20 nt, Homo sapiens
cugugguagggaccaggaau

SEQ ID NO: 351502 - RNA, 22 nt, Homo sapiens
cuguucaaauuguuugugaagu

SEQ ID NO: 351503 - RNA, 22 nt, Homo sapiens
cuguucaggaggcauuuggugg

SEQ ID NO: 351504 - RNA, 22 nt, Homo sapiens
cuguugguguuuaaucacugca

SEQ ID NO: 351505 - RNA, 19 nt, Homo sapiens
cuguuguacuccaggcauu

SEQ ID NO: 351506 - RNA, 22 nt, Homo sapiens
cuuagguuaugauaaauuuagu

SEQ ID NO: 351507 - RNA, 20 nt, Homo sapiens
cuucacagaaguggaaucau

SEQ ID NO: 351508 - RNA, 22 nt, Homo sapiens
cuucacuggagucccuggauuc

SEQ ID NO: 351509 - RNA, 18 nt, Homo sapiens
cuucauugcuguuuugcu

SEQ ID NO: 351510 - RNA, 22 nt, Homo sapiens
cuucuugagacuuaggcuuugg

SEQ ID NO: 351511 - RNA, 22 nt, Homo sapiens
cuucuugcuguguccucacaug

SEQ ID NO: 351512 - RNA, 22 nt, Homo sapiens
cuugaauguaaauaauguacag

SEQ ID NO: 351513 - RNA, 22 nt, Homo sapiens
cuugagcuugagauccuuucug

SEQ ID NO: 351514 - RNA, 22 nt, Homo sapiens
cuugauagugguaaucauuuuu

SEQ ID NO: 351515 - RNA, 20 nt, Homo sapiens
cuugcuccccuuguucuaga

SEQ ID NO: 351516 - RNA, 22 nt, Homo sapiens
cuuggcauuguguugauagaag

SEQ ID NO: 351517 - RNA, 18 nt, Homo sapiens
cuuggcgaugccaacaua

SEQ ID NO: 351518 - RNA, 22 nt, Homo sapiens
cuuggcuuguuguccccugcuc

SEQ ID NO: 351519 - RNA, 22 nt, Homo sapiens
cuugggcagugugcauguguau

SEQ ID NO: 351520 - RNA, 22 nt, Homo sapiens
cuuguacacuguuggugggaau

SEQ ID NO: 351521 - RNA, 22 nt, Homo sapiens
cuuguacuacuuaggaucugga

SEQ ID NO: 351522 - RNA, 19 nt, Homo sapiens
cuuguacucggcgcaguug

SEQ ID NO: 351523 - RNA, 22 nt, Homo sapiens
cuuuggagaaaaguucuugggc

SEQ ID NO: 351524 - RNA, 22 nt, Homo sapiens
cuuuggcauuagccuguauaga

SEQ ID NO: 351525 - RNA, 22 nt, Homo sapiens
cuuuggccauagcuaaaugauu

SEQ ID NO: 351526 - RNA, 22 nt, Homo sapiens
cuuugggaccgcgguuuauacu

SEQ ID NO: 351527 - RNA, 22 nt, Homo sapiens
cuuuggugagggauaaauuuca

SEQ ID NO: 351528 - RNA, 22 nt, Homo sapiens
cuuugguucuguuuauaugcug

SEQ ID NO: 351529 - RNA, 22 nt, Homo sapiens
cuuugguuuacuuggugcuagu

SEQ ID NO: 351530 - RNA, 20 nt, Homo sapiens
cuuuguccuccugcugugcu

SEQ ID NO: 351531 - RNA, 22 nt, Homo sapiens
cuuuuacacugguggugggaau

SEQ ID NO: 351532 - RNA, 22 nt, Homo sapiens
cuuuugcugggucagcgguggu

SEQ ID NO: 351533 - RNA, 22 nt, Homo sapiens
gaaagcugguauagauacauua

SEQ ID NO: 351534 - RNA, 22 nt, Homo sapiens
gaaagugcugcaaggccaugca

SEQ ID NO: 351535 - RNA, 22 nt, Homo sapiens
gaaaugcucagggguuuuccag

SEQ ID NO: 351536 - RNA, 22 nt, Homo sapiens
gaaauguauuaaugaguugaaa

SEQ ID NO: 351537 - RNA, 22 nt, Homo sapiens
gaaauguugauagugggcauug

SEQ ID NO: 351538 - RNA, 22 nt, Homo sapiens
gaacccuggaggcggagguugc

SEQ ID NO: 351539 - RNA, 22 nt, Homo sapiens
gaacuguuucuggugaaagagu

SEQ ID NO: 351540 - RNA, 22 nt, Homo sapiens
gaagguaguuuauagauguggu

SEQ ID NO: 351541 - RNA, 19 nt, Homo sapiens
gaaguguuuguucuccaug

SEQ ID NO: 351542 - RNA, 22 nt, Homo sapiens
gaauagugcugcaauaaacaua

SEQ ID NO: 351543 - RNA, 22 nt, Homo sapiens
gaaugauacuguuaacgaaaga

SEQ ID NO: 351544 - RNA, 22 nt, Homo sapiens
gaauggaacugacuauagcuga

SEQ ID NO: 351545 - RNA, 20 nt, Homo sapiens
gaaugguuucgggguucuug

SEQ ID NO: 351546 - RNA, 22 nt, Homo sapiens
gaauguuuacuuuguuuaauac

SEQ ID NO: 351547 - RNA, 22 nt, Homo sapiens
gaauucugucgcuuacuagaug

SEQ ID NO: 351548 - RNA, 22 nt, Homo sapiens
gacacagugaagucucuacuug

SEQ ID NO: 351549 - RNA, 22 nt, Homo sapiens
uaguucauuauguguugcucag

SEQ ID NO: 351550 - RNA, 22 nt, Homo sapiens
uaguuuaucuucuggauggaca

SEQ ID NO: 351551 - RNA, 22 nt, Homo sapiens
uauacaugugggcaucaggaga

SEQ ID NO: 351552 - RNA, 22 nt, Homo sapiens
uauagcagccugaacaaaguaa

SEQ ID NO: 351553 - RNA, 22 nt, Homo sapiens
uauagcuauuguuaauggaacu

SEQ ID NO: 351554 - RNA, 22 nt, Homo sapiens
uauagcuugauuauggugaugg

SEQ ID NO: 351555 - RNA, 22 nt, Homo sapiens
uauaguguuuucaaaaguaugu

SEQ ID NO: 351556 - RNA, 22 nt, Homo sapiens
uauaugcacucagguguaugug

SEQ ID NO: 351557 - RNA, 22 nt, Homo sapiens
uauaugcucugggauccugaaa

SEQ ID NO: 351558 - RNA, 22 nt, Homo sapiens
uaucaacaggguggccagugua

SEQ ID NO: 351559 - RNA, 22 nt, Homo sapiens
uaucaagaugacaaacuuugcu

SEQ ID NO: 351560 - RNA, 22 nt, Homo sapiens
uaucacaaacuuagcaguuuaa

SEQ ID NO: 351561 - RNA, 22 nt, Homo sapiens
uaucacagcauugucuauaaua

SEQ ID NO: 351562 - RNA, 22 nt, Homo sapiens
uaucacagcgggguguacaccc

SEQ ID NO: 351563 - RNA, 20 nt, Homo sapiens
uaucacauggggagaaaccu

SEQ ID NO: 351564 - RNA, 21 nt, Homo sapiens
uaucacauuggugauuaaguu

SEQ ID NO: 351565 - RNA, 22 nt, Homo sapiens
uaucaccuugagagaccuuauc

SEQ ID NO: 351566 - RNA, 19 nt, Homo sapiens
uaucacuucccuggaaaca

SEQ ID NO: 351567 - RNA, 22 nt, Homo sapiens
uaucagcacaguggguucaugg

SEQ ID NO: 351568 - RNA, 22 nt, Homo sapiens
uaucauuguguuauuucuucca

SEQ ID NO: 351569 - RNA, 22 nt, Homo sapiens
uaucuacauguagguauguaug

SEQ ID NO: 351570 - RNA, 22 nt, Homo sapiens
uaucucagaugagacuuguaac

SEQ ID NO: 351571 - RNA, 22 nt, Homo sapiens
uaucugguuauugcugcugauu

SEQ ID NO: 351572 - RNA, 20 nt, Homo sapiens
uaugaaacaguguagagcaa

SEQ ID NO: 351573 - RNA, 20 nt, Homo sapiens
uaugacaaagccuagugagu

SEQ ID NO: 351574 - RNA, 22 nt, Homo sapiens
uaugacuuguuuucuggucugc

SEQ ID NO: 351575 - RNA, 22 nt, Homo sapiens
uaugacuuuggaaaaauuacuu

SEQ ID NO: 351576 - RNA, 22 nt, Homo sapiens
uaugacuuuugaauacagaugg

SEQ ID NO: 351577 - RNA, 20 nt, Homo sapiens
uaugagacugggagaaguuc

SEQ ID NO: 351578 - RNA, 22 nt, Homo sapiens
uaugagacugguuaauuuuugu

SEQ ID NO: 351579 - RNA, 22 nt, Homo sapiens
uaugaucauuauguuauugcag

SEQ ID NO: 351580 - RNA, 22 nt, Homo sapiens
uaugauuuuugggagaggucaa

SEQ ID NO: 351581 - RNA, 22 nt, Homo sapiens
uaugcacacguguccaugugca

SEQ ID NO: 351582 - RNA, 22 nt, Homo sapiens
uaugcacacucucccaggaggg

SEQ ID NO: 351583 - RNA, 22 nt, Homo sapiens
uaugcuuauugucucauccacu

SEQ ID NO: 351584 - RNA, 22 nt, Homo sapiens
uauggauuugccuauucuguau

SEQ ID NO: 351585 - RNA, 22 nt, Homo sapiens
uauggcacacguuuaccuaugu

SEQ ID NO: 351586 - RNA, 22 nt, Homo sapiens
uauggcucuauuuccuugucua

SEQ ID NO: 351587 - RNA, 22 nt, Homo sapiens
uauggcuucuauaaggaagcuu

SEQ ID NO: 351588 - RNA, 22 nt, Homo sapiens
uauggcuuuuaacugucguaug

SEQ ID NO: 351589 - RNA, 19 nt, Homo sapiens
uaugggauuuuuagggugu

SEQ ID NO: 351590 - RNA, 21 nt, Homo sapiens
uaugguuucuaauucugcagg

SEQ ID NO: 351591 - RNA, 19 nt, Homo sapiens
uauguaguuuucucaauau

SEQ ID NO: 351592 - RNA, 22 nt, Homo sapiens
uauguguuuuauggucagggag

SEQ ID NO: 351593 - RNA, 18 nt, Homo sapiens
uauuaagcuagauauuau

SEQ ID NO: 351594 - RNA, 20 nt, Homo sapiens
uauuacagaguaauggugga

SEQ ID NO: 351595 - RNA, 22 nt, Homo sapiens
uauuacugucaauaucacagaa

SEQ ID NO: 351596 - RNA, 22 nt, Homo sapiens
uauuacuguuauuccuaucaaa

SEQ ID NO: 351597 - RNA, 22 nt, Homo sapiens
uauuagguuggugcaacaguaa

SEQ ID NO: 351598 - RNA, 22 nt, Homo sapiens
uauuagugccuaagucuuaggg

SEQ ID NO: 351599 - RNA, 22 nt, Homo sapiens
uauuccacacuguuggugggau

SEQ ID NO: 351600 - RNA, 22 nt, Homo sapiens
uauuccacuauuaguccagaug

SEQ ID NO: 351601 - RNA, 22 nt, Homo sapiens
uauuccacuggcacugcauuug

SEQ ID NO: 351602 - RNA, 22 nt, Homo sapiens
uauugauuaauugugauuaggc

SEQ ID NO: 351603 - RNA, 22 nt, Homo sapiens
uauugcaauuggcagagugcua

SEQ ID NO: 351604 - RNA, 22 nt, Homo sapiens
uauugcuaaauucuuuuccuag

SEQ ID NO: 351605 - RNA, 22 nt, Homo sapiens
uauugcuaacaucccuuaugua

SEQ ID NO: 351606 - RNA, 22 nt, Homo sapiens
uauugcuggauguauuacaugu

SEQ ID NO: 351607 - RNA, 22 nt, Homo sapiens
uauugcuugaggaaaugguaau

SEQ ID NO: 351608 - RNA, 22 nt, Homo sapiens
uauugcuuuugauucaaggcag

SEQ ID NO: 351609 - RNA, 22 nt, Homo sapiens
uauugucacuaaaggaagcugg

SEQ ID NO: 351610 - RNA, 22 nt, Homo sapiens
uauuguccacuuugcacugugu

SEQ ID NO: 351611 - RNA, 22 nt, Homo sapiens
uauuuguccccuccaaaaguca

SEQ ID NO: 351612 - RNA, 22 nt, Homo sapiens
ucaaacacuccauaucgcgauu

SEQ ID NO: 351613 - RNA, 22 nt, Homo sapiens
ucaaacugcuugaggccauuua

SEQ ID NO: 351614 - RNA, 22 nt, Homo sapiens
ucaaacugucagguugaccaga

SEQ ID NO: 351615 - RNA, 22 nt, Homo sapiens
ucaaagacacacaaggagaagg

SEQ ID NO: 351616 - RNA, 22 nt, Homo sapiens
ucaaagugcuauggcucagguu

SEQ ID NO: 351617 - RNA, 22 nt, Homo sapiens
ucaaaugauucacccaccuuug

SEQ ID NO: 351618 - RNA, 22 nt, Homo sapiens
ucaaaugauucuccugccucag

SEQ ID NO: 351619 - RNA, 22 nt, Homo sapiens
ucaaaugguccacgugaacauu

SEQ ID NO: 351620 - RNA, 22 nt, Homo sapiens
ucaacagugauggaaaguuaua

SEQ ID NO: 351621 - RNA, 22 nt, Homo sapiens
ucaaccggugagagcuuccucc

SEQ ID NO: 351622 - RNA, 22 nt, Homo sapiens
ucaacugcuugagaucacaaau

SEQ ID NO: 351623 - RNA, 18 nt, Homo sapiens
ucaagcuauugucaugcc

SEQ ID NO: 351624 - RNA, 19 nt, Homo sapiens
ucaauucugucaauggcuu

SEQ ID NO: 351625 - RNA, 22 nt, Homo sapiens
ucaauugcaucaacaguguaca

SEQ ID NO: 351626 - RNA, 20 nt, Homo sapiens
ucacaagccaagaucacguc

SEQ ID NO: 351627 - RNA, 22 nt, Homo sapiens
ucacaaggcaggaaugaaaggg

SEQ ID NO: 351628 - RNA, 22 nt, Homo sapiens
ucacaauucucaauuugugaaa

SEQ ID NO: 351629 - RNA, 22 nt, Homo sapiens
ucacacgugaacucaucacaga

SEQ ID NO: 351630 - RNA, 22 nt, Homo sapiens
ucacacugaauuugaagcaaug

SEQ ID NO: 351631 - RNA, 22 nt, Homo sapiens
ucacagauaaauaaagaugauu

SEQ ID NO: 351632 - RNA, 22 nt, Homo sapiens
ucacagaugaggcgagaggcag

SEQ ID NO: 351633 - RNA, 22 nt, Homo sapiens
ucacagccuaguuuuauacauu

SEQ ID NO: 351634 - RNA, 22 nt, Homo sapiens
ucacaguagagcuucuuucaga

SEQ ID NO: 351635 - RNA, 22 nt, Homo sapiens
ucacaguccuguuuaggagagg

SEQ ID NO: 351636 - RNA, 23 nt, Homo sapiens
ucacaguuacuuuugcaucaacc

SEQ ID NO: 351637 - RNA, 22 nt, Homo sapiens
ucacaguuggccuggccuuuua

SEQ ID NO: 351638 - RNA, 22 nt, Homo sapiens
ucacauagcauaaugucugcaa

SEQ ID NO: 351639 - RNA, 22 nt, Homo sapiens
ucacauggauuaacucauuuau

SEQ ID NO: 351640 - RNA, 22 nt, Homo sapiens
ucacauggcagagaagaagcuc

SEQ ID NO: 351641 - RNA, 22 nt, Homo sapiens
ucacauguguaugagcuuugau

SEQ ID NO: 351642 - RNA, 22 nt, Homo sapiens
ucacauuaagcuguuauuucuu

SEQ ID NO: 351643 - RNA, 22 nt, Homo sapiens
ucacauuguauauguaccuauc

SEQ ID NO: 351644 - RNA, 22 nt, Homo sapiens
ucacauuguguagccugcucac

SEQ ID NO: 351645 - RNA, 22 nt, Homo sapiens
ucacuuggugaacacauuaugu

SEQ ID NO: 351646 - RNA, 22 nt, Homo sapiens
ucacuuuguuuuuggauaaguu

SEQ ID NO: 351647 - RNA, 21 nt, Homo sapiens
ucagaagcucccagggaggac

SEQ ID NO: 351648 - RNA, 19 nt, Homo sapiens
ucagaucagcccaagggau

SEQ ID NO: 351649 - RNA, 22 nt, Homo sapiens
ucagaugauuccguugacgaga

SEQ ID NO: 351650 - RNA, 22 nt, Homo sapiens
ucagauuggugcaaaaguaauu

SEQ ID NO: 351651 - RNA, 22 nt, Homo sapiens
ucagcaaugaccuaagcaaaua

SEQ ID NO: 351652 - RNA, 22 nt, Homo sapiens
ucagcaccauguaacaauugau

SEQ ID NO: 351653 - RNA, 22 nt, Homo sapiens
ucagcagugugaaaacaaacua

SEQ ID NO: 351654 - RNA, 22 nt, Homo sapiens
ucaggcaccuuccucuuaucug

SEQ ID NO: 351655 - RNA, 22 nt, Homo sapiens
ucagggacgcuugacacaagcc

SEQ ID NO: 351656 - RNA, 22 nt, Homo sapiens
ucaguaaaugcuguucucuuuu

SEQ ID NO: 351657 - RNA, 23 nt, Homo sapiens
ucaguacucuauaagugccagcu

SEQ ID NO: 351658 - RNA, 22 nt, Homo sapiens
ucaguccccucgcugagucuac

SEQ ID NO: 351659 - RNA, 22 nt, Homo sapiens
ucagugaacgaggaggagggug

SEQ ID NO: 351660 - RNA, 22 nt, Homo sapiens
ucagugauugguuauuuuaggc

SEQ ID NO: 351661 - RNA, 20 nt, Homo sapiens
ucagugcagauuguccaagu

SEQ ID NO: 351662 - RNA, 22 nt, Homo sapiens
ucagugcaggaauuuccuuaga

SEQ ID NO: 351663 - RNA, 22 nt, Homo sapiens
ucagugcuuuuuguugucauca

SEQ ID NO: 351664 - RNA, 22 nt, Homo sapiens
ucaguggauuauuaaagucacc

SEQ ID NO: 351665 - RNA, 22 nt, Homo sapiens
ucagugguuaaaagauucuaga

SEQ ID NO: 351666 - RNA, 22 nt, Homo sapiens
ucagugucugcauucuuauugu

SEQ ID NO: 351667 - RNA, 23 nt, Homo sapiens
ucagugucuggauccugcucagu

SEQ ID NO: 351668 - RNA, 22 nt, Homo sapiens
ucaguguuuuauccuccagagc

SEQ ID NO: 351669 - RNA, 22 nt, Homo sapiens
ucaguuaaugcugccugcugga

SEQ ID NO: 351670 - RNA, 22 nt, Homo sapiens
ucauaucauuagaucuacugua

SEQ ID NO: 351671 - RNA, 22 nt, Homo sapiens
ucaucagaaucccuuagggaug

SEQ ID NO: 351672 - RNA, 22 nt, Homo sapiens
ucaucaggaaacuuaugcagug

SEQ ID NO: 351673 - RNA, 22 nt, Homo sapiens
ucaucaggcucauucaagcuga

SEQ ID NO: 351674 - RNA, 20 nt, Homo sapiens
ucaucaguuggugcucgcug

SEQ ID NO: 351675 - RNA, 22 nt, Homo sapiens
ucaucaguuuuuuauaugugau

SEQ ID NO: 351676 - RNA, 22 nt, Homo sapiens
ucaucuggcgaaugugaagagu

SEQ ID NO: 351677 - RNA, 22 nt, Homo sapiens
ucaugaaguaguuaacugguug

SEQ ID NO: 351678 - RNA, 22 nt, Homo sapiens
ucaugacacagcauacugacuu

SEQ ID NO: 351679 - RNA, 22 nt, Homo sapiens
ucaugcaucuuguggaauuuga

SEQ ID NO: 351680 - RNA, 20 nt, Homo sapiens
ucaugccacugcgcuccagc

SEQ ID NO: 351681 - RNA, 22 nt, Homo sapiens
ucauggcacugaugagaguuuc

SEQ ID NO: 351682 - RNA, 22 nt, Homo sapiens
ucaugggagcccccaucaugag

SEQ ID NO: 351683 - RNA, 22 nt, Homo sapiens
ucauggguuuugguccaagcaa

SEQ ID NO: 351684 - RNA, 22 nt, Homo sapiens
ucauuagagaucuuggggaaaa

SEQ ID NO: 351685 - RNA, 22 nt, Homo sapiens
ucauucacucccuugaaguuag

SEQ ID NO: 351686 - RNA, 22 nt, Homo sapiens
ucauugagacuuguuuuguggc

SEQ ID NO: 351687 - RNA, 22 nt, Homo sapiens
ucauuguccaacuucuuucagu

SEQ ID NO: 351688 - RNA, 22 nt, Homo sapiens
uccaagaugcuggcagcuacag

SEQ ID NO: 351689 - RNA, 22 nt, Homo sapiens
uccacaauggcugaacuagauu

SEQ ID NO: 351690 - RNA, 19 nt, Homo sapiens
uccaccgcgugcaccucua

SEQ ID NO: 351691 - RNA, 22 nt, Homo sapiens
uccagguacucagggggcugag

SEQ ID NO: 351692 - RNA, 22 nt, Homo sapiens
uccagugcauucagacacuugg

SEQ ID NO: 351693 - RNA, 22 nt, Homo sapiens
uccagugugcaggcaaguuuga

SEQ ID NO: 351694 - RNA, 22 nt, Homo sapiens
uccaguguuccucagucacccc

SEQ ID NO: 351695 - RNA, 18 nt, Homo sapiens
uccauugcagcauuauuu

SEQ ID NO: 351696 - RNA, 22 nt, Homo sapiens
uccauugucuagauguaacaca

SEQ ID NO: 351697 - RNA, 22 nt, Homo sapiens
uccauuugucuauguuucuguu

SEQ ID NO: 351698 - RNA, 22 nt, Homo sapiens
uccauuuguuguaggguauagu

SEQ ID NO: 351699 - RNA, 23 nt, Homo sapiens
ucccaagauggaccagaccaagg

SEQ ID NO: 351700 - RNA, 22 nt, Homo sapiens
uccccugagucaccugcuucuc

SEQ ID NO: 351701 - RNA, 22 nt, Homo sapiens
ucccgaggacaucugggggcaa

SEQ ID NO: 351702 - RNA, 22 nt, Homo sapiens
ucccuacuggggcacugccuag

SEQ ID NO: 351703 - RNA, 18 nt, Homo sapiens
ucccucagaauuauagaa

SEQ ID NO: 351704 - RNA, 22 nt, Homo sapiens
ucccugaagcugcagcaacaca

SEQ ID NO: 351705 - RNA, 22 nt, Homo sapiens
ucccugacagggucugagcuuu

SEQ ID NO: 351706 - RNA, 22 nt, Homo sapiens
ucccugacagucacagagcuac

SEQ ID NO: 351707 - RNA, 22 nt, Homo sapiens
ucccugagguccuggauuauug

SEQ ID NO: 351708 - RNA, 19 nt, Homo sapiens
ucccugagucuuagcuuga

SEQ ID NO: 351709 - RNA, 22 nt, Homo sapiens
ucccuggacagccuugccuggg

SEQ ID NO: 351710 - RNA, 22 nt, Homo sapiens
ucccuuagccaaauccccagcc

SEQ ID NO: 351711 - RNA, 22 nt, Homo sapiens
ucccuugagccuggcuucucac

SEQ ID NO: 351712 - RNA, 22 nt, Homo sapiens
uccucaguggauuggauggugc

SEQ ID NO: 351713 - RNA, 22 nt, Homo sapiens
uccugagaauagaguugcaugu

SEQ ID NO: 351714 - RNA, 22 nt, Homo sapiens
uccugagacugaggagcuuugg

SEQ ID NO: 351715 - RNA, 22 nt, Homo sapiens
uccugcauucugaaauacaagu

SEQ ID NO: 351716 - RNA, 22 nt, Homo sapiens
uccugcauucugacuugcuuuc

SEQ ID NO: 351717 - RNA, 22 nt, Homo sapiens
uccuucacucuacaucuuuguu

SEQ ID NO: 351718 - RNA, 22 nt, Homo sapiens
uccuucaguccaguggguuuug

SEQ ID NO: 351719 - RNA, 22 nt, Homo sapiens
uccuucauuugucaacucuagu

SEQ ID NO: 351720 - RNA, 22 nt, Homo sapiens
uccuugagccuuaaauuauaaa

SEQ ID NO: 351721 - RNA, 22 nt, Homo sapiens
uccuugcacuaacuuaaggagg

SEQ ID NO: 351722 - RNA, 22 nt, Homo sapiens
uccuuggucauggaagagacag

SEQ ID NO: 351723 - RNA, 23 nt, Homo sapiens
uccuugguuggcgcccuaugugu

SEQ ID NO: 351724 - RNA, 22 nt, Homo sapiens
uccuuuggguagcuguucagau

SEQ ID NO: 351725 - RNA, 20 nt, Homo sapiens
ucgcaccacuauacuccagc

SEQ ID NO: 351726 - RNA, 22 nt, Homo sapiens
ucgcaguuaauaaugaugugcg

SEQ ID NO: 351727 - RNA, 22 nt, Homo sapiens
ucuagcacuuacuggcugugug

SEQ ID NO: 351728 - RNA, 22 nt, Homo sapiens
ucuaucacagccccacacucuc

SEQ ID NO: 351729 - RNA, 22 nt, Homo sapiens
ucucacagaguugaacuuucuu

SEQ ID NO: 351730 - RNA, 22 nt, Homo sapiens
ucucagagccuaggguuuuuca

SEQ ID NO: 351731 - RNA, 22 nt, Homo sapiens
ucucagcacaaacaaaauugcu

SEQ ID NO: 351732 - RNA, 22 nt, Homo sapiens
ucucagugaaauaaauuauuuu

SEQ ID NO: 351733 - RNA, 22 nt, Homo sapiens
ucucagugaauugguuuugucu

SEQ ID NO: 351734 - RNA, 22 nt, Homo sapiens
ucucauagaggcagagaguaaa

SEQ ID NO: 351735 - RNA, 22 nt, Homo sapiens
ucuccaguuuccuucgucuauc

SEQ ID NO: 351736 - RNA, 20 nt, Homo sapiens
ucucccaaacagcaggcccu

SEQ ID NO: 351737 - RNA, 22 nt, Homo sapiens
ucucuagagagccugguguuca

SEQ ID NO: 351738 - RNA, 22 nt, Homo sapiens
ucucugauuaaacaagauagug

SEQ ID NO: 351739 - RNA, 22 nt, Homo sapiens
ucucugguuaugucauuaagca

SEQ ID NO: 351740 - RNA, 22 nt, Homo sapiens
ucucuguuuauuuuugguguau

SEQ ID NO: 351741 - RNA, 22 nt, Homo sapiens
ucucuugguugaacaguuugga

SEQ ID NO: 351742 - RNA, 22 nt, Homo sapiens
ucugacagugagagaaaucuga

SEQ ID NO: 351743 - RNA, 22 nt, Homo sapiens
ucugacucuggagucucagguu

SEQ ID NO: 351744 - RNA, 22 nt, Homo sapiens
ucugagacuguuucuaacaagc

SEQ ID NO: 351745 - RNA, 22 nt, Homo sapiens
ucugagcaugcaucuugccugg

SEQ ID NO: 351746 - RNA, 22 nt, Homo sapiens
ucugagucaucacaaaugaugc

SEQ ID NO: 351747 - RNA, 22 nt, Homo sapiens
ucugaguggcagaaugagcuga

SEQ ID NO: 351748 - RNA, 23 nt, Homo sapiens
ucugcggguguggacccuagugc

SEQ ID NO: 351749 - RNA, 22 nt, Homo sapiens
ucuggcaagagccgagggcagu

SEQ ID NO: 351750 - RNA, 15 nt, Homo sapiens
ucuggcucugucacu

SEQ ID NO: 351751 - RNA, 22 nt, Homo sapiens
ucuggcuucugacuuaggggac

SEQ ID NO: 351752 - RNA, 22 nt, Homo sapiens
ucuggcuuuagcaugugggaag

SEQ ID NO: 351753 - RNA, 22 nt, Homo sapiens
ucuggcuuugugaguugccaga

SEQ ID NO: 351754 - RNA, 22 nt, Homo sapiens
ucuggcuuuuaacaucuauaaa

SEQ ID NO: 351755 - RNA, 22 nt, Homo sapiens
ucuggguuuuguaccgugcucg

SEQ ID NO: 351756 - RNA, 19 nt, Homo sapiens
ucuguaguuagggcuacag

SEQ ID NO: 351757 - RNA, 22 nt, Homo sapiens
ucugucacugaaucccugucac

SEQ ID NO: 351758 - RNA, 22 nt, Homo sapiens
ucugucacugguggacgaucac

SEQ ID NO: 351759 - RNA, 22 nt, Homo sapiens
ucugugaaugaacacuugaaaa

SEQ ID NO: 351760 - RNA, 22 nt, Homo sapiens
ucugugcuugucauaugcuuug

SEQ ID NO: 351761 - RNA, 22 nt, Homo sapiens
ucugugguaagaaacgcauguc

SEQ ID NO: 351762 - RNA, 22 nt, Homo sapiens
ucuguggucagcauccgccacu

SEQ ID NO: 351763 - RNA, 22 nt, Homo sapiens
ucugugguucaaaccagcaacu

SEQ ID NO: 351764 - RNA, 22 nt, Homo sapiens
ucugugguucuagcuacuuugg

SEQ ID NO: 351765 - RNA, 22 nt, Homo sapiens
ucuguguuugaucaagauugua

SEQ ID NO: 351766 - RNA, 22 nt, Homo sapiens
ucuucaugcuugaaauaauagc

SEQ ID NO: 351767 - RNA, 17 nt, Homo sapiens
ucuucuguuacuguggc

SEQ ID NO: 351768 - RNA, 22 nt, Homo sapiens
ucuuggguggauucauucuuuc

SEQ ID NO: 351769 - RNA, 15 nt, Homo sapiens
ucuuuaguuuuucuu

SEQ ID NO: 351770 - RNA, 22 nt, Homo sapiens
ucuuugagugcccugagucccu

SEQ ID NO: 351771 - RNA, 22 nt, Homo sapiens
ucuuugccuaacccaaggucau

SEQ ID NO: 351772 - RNA, 19 nt, Homo sapiens
ucuuugcuuuucuaagagg

SEQ ID NO: 351773 - RNA, 22 nt, Homo sapiens
ucuuuggaggcgaucuguuuga

SEQ ID NO: 351774 - RNA, 22 nt, Homo sapiens
ucuuuggguagauauguagcug

SEQ ID NO: 351775 - RNA, 22 nt, Homo sapiens
ucuuugguaggaguaggaggcc

SEQ ID NO: 351776 - RNA, 22 nt, Homo sapiens
ucuuuggucagaaagauuacac

SEQ ID NO: 351777 - RNA, 22 nt, Homo sapiens
ucuuuguugcauaggcuuguuc

SEQ ID NO: 351778 - RNA, 22 nt, Homo sapiens
ucuuuguuuucugauccugaag

SEQ ID NO: 351779 - RNA, 22 nt, Homo sapiens
ucuuuugggccucuugucagac

SEQ ID NO: 351780 - RNA, 22 nt, Homo sapiens
ucuuuugguuucuagaggccgc

SEQ ID NO: 351781 - RNA, 22 nt, Homo sapiens
ucuuuuguaaaaugaggaggug

SEQ ID NO: 351782 - RNA, 22 nt, Homo sapiens
ucuuuugugagucagccucucc

SEQ ID NO: 351783 - RNA, 22 nt, Homo sapiens
ucuuuuugagucaguuucggua

SEQ ID NO: 351784 - RNA, 18 nt, Homo sapiens
ugaaacacauuuuuuccu

SEQ ID NO: 351785 - RNA, 22 nt, Homo sapiens
ugaaagacacagaaguugccca

SEQ ID NO: 351786 - RNA, 22 nt, Homo sapiens
ugaaagacugaaagcuuuucuu

SEQ ID NO: 351787 - RNA, 22 nt, Homo sapiens
ugaaaguuauauugugaaauuc

SEQ ID NO: 351788 - RNA, 22 nt, Homo sapiens
ugaaaucauguaguuauugcaa

SEQ ID NO: 351789 - RNA, 22 nt, Homo sapiens
ugaaaucuaaaauguuccaaga

SEQ ID NO: 351790 - RNA, 20 nt, Homo sapiens
ugaaaucuucacuaagucuc

SEQ ID NO: 351791 - RNA, 22 nt, Homo sapiens
ugaaaugcugucuaggggaaau

SEQ ID NO: 351792 - RNA, 22 nt, Homo sapiens
ugaaauggaagaagucccuuuu

SEQ ID NO: 351793 - RNA, 22 nt, Homo sapiens
ugaaauguaaguugucuagucu

SEQ ID NO: 351794 - RNA, 22 nt, Homo sapiens
ugaaaugucuuuaggaggcuuc

SEQ ID NO: 351795 - RNA, 22 nt, Homo sapiens
ugaaauguugggugauggaauc

SEQ ID NO: 351796 - RNA, 22 nt, Homo sapiens
ugaaauuauucuuaccaaggug

SEQ ID NO: 351797 - RNA, 22 nt, Homo sapiens
ugaacacagccugccucugcca

SEQ ID NO: 351798 - RNA, 21 nt, Homo sapiens
ugaacacuggacugagugucc

SEQ ID NO: 351799 - RNA, 22 nt, Homo sapiens
ugaacagagaaacacuggccau

SEQ ID NO: 351800 - RNA, 22 nt, Homo sapiens
ugaacucauccuuucuuauggc

SEQ ID NO: 351801 - RNA, 22 nt, Homo sapiens
ugaagggcauuguuuugccaaa

SEQ ID NO: 351802 - RNA, 22 nt, Homo sapiens
ugaaguaauguuuuauucuauu

SEQ ID NO: 351803 - RNA, 18 nt, Homo sapiens
ugaauacagcguugggaa

SEQ ID NO: 351804 - RNA, 22 nt, Homo sapiens
ugaauagacacuaaagacugua

SEQ ID NO: 351805 - RNA, 22 nt, Homo sapiens
ugaauguaacuaaaggacuuuu

SEQ ID NO: 351806 - RNA, 22 nt, Homo sapiens
ugaauguaagaugucugcuggu

SEQ ID NO: 351807 - RNA, 22 nt, Homo sapiens
ugaauucaucucacagaguuaa

SEQ ID NO: 351808 - RNA, 22 nt, Homo sapiens
ugacaagggaaaugcaaaaugu

SEQ ID NO: 351809 - RNA, 22 nt, Homo sapiens
ugacacagcaagauggaaccau

SEQ ID NO: 351810 - RNA, 19 nt, Homo sapiens
ugacacuguuggugggagg

SEQ ID NO: 351811 - RNA, 22 nt, Homo sapiens
ugacaguaaacagucuugauua

SEQ ID NO: 351812 - RNA, 23 nt, Homo sapiens
ugacagucucccgauggcuaggc

SEQ ID NO: 351813 - RNA, 22 nt, Homo sapiens
ugacagugaacagguuaccacu

SEQ ID NO: 351814 - RNA, 22 nt, Homo sapiens
ugacagugugagacuuugucuc

SEQ ID NO: 351815 - RNA, 20 nt, Homo sapiens
ugacaguuaagggauagaag

SEQ ID NO: 351816 - RNA, 22 nt, Homo sapiens
ugacaguuuccagggcugucuc

SEQ ID NO: 351817 - RNA, 22 nt, Homo sapiens
ugacauagcuauuaagugaugc

SEQ ID NO: 351818 - RNA, 21 nt, Homo sapiens
ugacauguuggugugcugcac

SEQ ID NO: 351819 - RNA, 22 nt, Homo sapiens
ugacauuacagucacuugcugu

SEQ ID NO: 351820 - RNA, 22 nt, Homo sapiens
ugacccuguggcagcgucuaag

SEQ ID NO: 351821 - RNA, 22 nt, Homo sapiens
ugacggaggacaccugcggaau

SEQ ID NO: 351822 - RNA, 22 nt, Homo sapiens
ugacuaaggaaggauuaugugc

SEQ ID NO: 351823 - RNA, 22 nt, Homo sapiens
ugacucaguuguuagucuucau

SEQ ID NO: 351824 - RNA, 22 nt, Homo sapiens
ugacucaguuucucagguagua

SEQ ID NO: 351825 - RNA, 23 nt, Homo sapiens
ugacugaguauauguuuggugcu

SEQ ID NO: 351826 - RNA, 22 nt, Homo sapiens
ugacuucauuuuuggccaugag

SEQ ID NO: 351827 - RNA, 22 nt, Homo sapiens
ugagaaccucugugugcccacu

SEQ ID NO: 351828 - RNA, 22 nt, Homo sapiens
ugagaacucaugaaucuuucca

SEQ ID NO: 351829 - RNA, 22 nt, Homo sapiens
ugagaagacaucuuugcuuugu

SEQ ID NO: 351830 - RNA, 22 nt, Homo sapiens
ugagaaugacugggcaugcugc

SEQ ID NO: 351831 - RNA, 22 nt, Homo sapiens
ugagacacuucccagaucccuu

SEQ ID NO: 351832 - RNA, 22 nt, Homo sapiens
ugagacugagucucccucuguc

SEQ ID NO: 351833 - RNA, 22 nt, Homo sapiens
ugagacugguaauguguagggc

SEQ ID NO: 351834 - RNA, 22 nt, Homo sapiens
ugagagacauuuguuguagagu

SEQ ID NO: 351835 - RNA, 22 nt, Homo sapiens
aaggaacuggaauauuuugaac

SEQ ID NO: 351836 - RNA, 22 nt, Homo sapiens
aaggaaguaauuugguuuauag

SEQ ID NO: 351837 - RNA, 22 nt, Homo sapiens
aaggaauucaaauuuucucugg

SEQ ID NO: 351838 - RNA, 22 nt, Homo sapiens
aaggauuguaaaguugacaaau

SEQ ID NO: 351839 - RNA, 22 nt, Homo sapiens
aaggcaagauacugguugcuga

SEQ ID NO: 351840 - RNA, 22 nt, Homo sapiens
aaggcaauuuguugugaggauu

SEQ ID NO: 351841 - RNA, 22 nt, Homo sapiens
aaggcagucacuaaauagugag

SEQ ID NO: 351842 - RNA, 22 nt, Homo sapiens
aaggcaugcaaagaacauuuua

SEQ ID NO: 351843 - RNA, 22 nt, Homo sapiens
aaggcauucucaaacuaguucu

SEQ ID NO: 351844 - RNA, 23 nt, Homo sapiens
aagguaagcuagaaagauguaga

SEQ ID NO: 351845 - RNA, 22 nt, Homo sapiens
aagguaguuuucuuuaaugcug

SEQ ID NO: 351846 - RNA, 22 nt, Homo sapiens
aaggugguuuucucuuggaguc

SEQ ID NO: 351847 - RNA, 19 nt, Homo sapiens
aaguacuugucuuuugaag

SEQ ID NO: 351848 - RNA, 22 nt, Homo sapiens
aaguagcagaggcaagacuuga

SEQ ID NO: 351849 - RNA, 19 nt, Homo sapiens
aaguaguugugacagaugc

SEQ ID NO: 351850 - RNA, 22 nt, Homo sapiens
aaguauguaucaagucauacuu

SEQ ID NO: 351851 - RNA, 22 nt, Homo sapiens
aaguauuagugaggauauggaa

SEQ ID NO: 351852 - RNA, 22 nt, Homo sapiens
aagugacuagacuaugaaaccu

SEQ ID NO: 351853 - RNA, 22 nt, Homo sapiens
aagugagaugcaguggaguucc

SEQ ID NO: 351854 - RNA, 22 nt, Homo sapiens
aagugcccuauuuggcccuuga

SEQ ID NO: 351855 - RNA, 22 nt, Homo sapiens
aagugcuguccuaccuuuggga

SEQ ID NO: 351856 - RNA, 22 nt, Homo sapiens
aagugcuuacagggaacaugau

SEQ ID NO: 351857 - RNA, 22 nt, Homo sapiens
aagugcuucagaagacaauauu

SEQ ID NO: 351858 - RNA, 20 nt, Homo sapiens
aagugcuuccuuuuagaggg

SEQ ID NO: 351859 - RNA, 22 nt, Homo sapiens
aagugguagggucaggauugga

SEQ ID NO: 351860 - RNA, 22 nt, Homo sapiens
aaguugcuuuagguaagucaau

SEQ ID NO: 351861 - RNA, 22 nt, Homo sapiens
aaguugguguaugagacagaag

SEQ ID NO: 351862 - RNA, 22 nt, Homo sapiens
aauacagcacacagaugggucu

SEQ ID NO: 351863 - RNA, 22 nt, Homo sapiens
aauacugcuuugauguaagcua

SEQ ID NO: 351864 - RNA, 22 nt, Homo sapiens
aauacuggcacugaagaccaug

SEQ ID NO: 351865 - RNA, 22 nt, Homo sapiens
aauacuuccaaaucuagucauu

SEQ ID NO: 351866 - RNA, 22 nt, Homo sapiens
aauagcuguccuuagaagugug

SEQ ID NO: 351867 - RNA, 23 nt, Homo sapiens
aauaucacaguggguguacaccc

SEQ ID NO: 351868 - RNA, 22 nt, Homo sapiens
aauauguccaguguuuugggag

SEQ ID NO: 351869 - RNA, 22 nt, Homo sapiens
aauaugucuugaaauuggguaa

SEQ ID NO: 351870 - RNA, 22 nt, Homo sapiens
aaucaacauuguuuuaagucaa

SEQ ID NO: 351871 - RNA, 22 nt, Homo sapiens
aaucacaguuaguaagggagaa

SEQ ID NO: 351872 - RNA, 22 nt, Homo sapiens
aaucacuaugccaugaaguaca

SEQ ID NO: 351873 - RNA, 22 nt, Homo sapiens
aaucccugagcuagacacaaag

SEQ ID NO: 351874 - RNA, 22 nt, Homo sapiens
aaucuguagaaggugcacauuc

SEQ ID NO: 351875 - RNA, 22 nt, Homo sapiens
aaucugucaguuuuguguuaau

SEQ ID NO: 351876 - RNA, 22 nt, Homo sapiens
aaugaucaauguuugaggugau

SEQ ID NO: 351877 - RNA, 22 nt, Homo sapiens
aaugcacauauauuuccuuauu

SEQ ID NO: 351878 - RNA, 22 nt, Homo sapiens
aaugcuguucuuugcuuaaguu

SEQ ID NO: 351879 - RNA, 22 nt, Homo sapiens
aauggcagaugaaauugucauu

SEQ ID NO: 351880 - RNA, 22 nt, Homo sapiens
aauggcaguagauggaugggua

SEQ ID NO: 351881 - RNA, 22 nt, Homo sapiens
aauggcuuucagcuuuucccca

SEQ ID NO: 351882 - RNA, 22 nt, Homo sapiens
aaugugccuacagugggcuguu

SEQ ID NO: 351883 - RNA, 22 nt, Homo sapiens
aaugugcuucuggcugugguca

SEQ ID NO: 351884 - RNA, 22 nt, Homo sapiens
aauuacauggcaauugggaaau

SEQ ID NO: 351885 - RNA, 22 nt, Homo sapiens
aauuaguuggcugggugcggug

SEQ ID NO: 351886 - RNA, 22 nt, Homo sapiens
aauugaaugauaugggacauuu

SEQ ID NO: 351887 - RNA, 22 nt, Homo sapiens
aauugcuucuguauuuuggaca

SEQ ID NO: 351888 - RNA, 22 nt, Homo sapiens
acaaaguguuuucugaaggccu

SEQ ID NO: 351889 - RNA, 22 nt, Homo sapiens
acaagcacaaaugcauagaugg

SEQ ID NO: 351890 - RNA, 22 nt, Homo sapiens
acaagugaauacaggauucucu

SEQ ID NO: 351891 - RNA, 22 nt, Homo sapiens
acacaugugcguagacucuuua

SEQ ID NO: 351892 - RNA, 22 nt, Homo sapiens
acacauuggcaauucuggagca

SEQ ID NO: 351893 - RNA, 22 nt, Homo sapiens
acaccauugcauuccagccugg

SEQ ID NO: 351894 - RNA, 22 nt, Homo sapiens
acacgggugccggcaucagcac

SEQ ID NO: 351895 - RNA, 22 nt, Homo sapiens
acacuguugacauuuuguagug

SEQ ID NO: 351896 - RNA, 16 nt, Homo sapiens
acacuguuuagggaca

SEQ ID NO: 351897 - RNA, 22 nt, Homo sapiens
acacuguuuuguggagaaugua

SEQ ID NO: 351898 - RNA, 19 nt, Homo sapiens
acagauagaauguucuaca

SEQ ID NO: 351899 - RNA, 22 nt, Homo sapiens
acagauugcugggccccagccc

SEQ ID NO: 351900 - RNA, 20 nt, Homo sapiens
acagcacugguuucaagcaa

SEQ ID NO: 351901 - RNA, 20 nt, Homo sapiens
acagcauagccuuuuaaagc

SEQ ID NO: 351902 - RNA, 22 nt, Homo sapiens
acagccauuccagccaaauacu

SEQ ID NO: 351903 - RNA, 22 nt, Homo sapiens
acaguacuuuuggauuugugaa

SEQ ID NO: 351904 - RNA, 19 nt, Homo sapiens
acaguauugugcacagguu

SEQ ID NO: 351905 - RNA, 22 nt, Homo sapiens
acauaguagacacugaaaauau

SEQ ID NO: 351906 - RNA, 21 nt, Homo sapiens
acaucagaguugugaagguag

SEQ ID NO: 351907 - RNA, 22 nt, Homo sapiens
acaugagacuggguuuguaggg

SEQ ID NO: 351908 - RNA, 22 nt, Homo sapiens
acauucagcuguuguuucaaug

SEQ ID NO: 351909 - RNA, 18 nt, Homo sapiens
acauucagcuugaagaua

SEQ ID NO: 351910 - RNA, 22 nt, Homo sapiens
accacagugcuuccugcucacg

SEQ ID NO: 351911 - RNA, 22 nt, Homo sapiens
accaccacucccgcauucuaaa

SEQ ID NO: 351912 - RNA, 19 nt, Homo sapiens
accagauugcauucuugga

SEQ ID NO: 351913 - RNA, 22 nt, Homo sapiens
acccaguguucagacuaccugu

SEQ ID NO: 351914 - RNA, 22 nt, Homo sapiens
accccauuugcacugagcccuu

SEQ ID NO: 351915 - RNA, 22 nt, Homo sapiens
acccgguuagggggcaguggau

SEQ ID NO: 351916 - RNA, 22 nt, Homo sapiens
acccucagaccaguuucccugg

SEQ ID NO: 351917 - RNA, 22 nt, Homo sapiens
acccuggaggucuacagugcag

SEQ ID NO: 351918 - RNA, 22 nt, Homo sapiens
accucagcccggggaaguugag

SEQ ID NO: 351919 - RNA, 22 nt, Homo sapiens
accugagauuacaggugcuggc

SEQ ID NO: 351920 - RNA, 22 nt, Homo sapiens
acggaacugcuccauucuuugc

SEQ ID NO: 351921 - RNA, 22 nt, Homo sapiens
acucagagauuagcacauguuu

SEQ ID NO: 351922 - RNA, 19 nt, Homo sapiens
acugagcuaccugggggca

SEQ ID NO: 351923 - RNA, 19 nt, Homo sapiens
acugcacuccaaccuccug

SEQ ID NO: 351924 - RNA, 22 nt, Homo sapiens
acugcacuccacccuuggcagc

SEQ ID NO: 351925 - RNA, 22 nt, Homo sapiens
acugcacuccagccucaugaca

SEQ ID NO: 351926 - RNA, 22 nt, Homo sapiens
acugcacuccagccuccugaca

SEQ ID NO: 351927 - RNA, 22 nt, Homo sapiens
acugcacuccagccucggggac

SEQ ID NO: 351928 - RNA, 22 nt, Homo sapiens
acugcacuccagccuggacgac

SEQ ID NO: 351929 - RNA, 22 nt, Homo sapiens
acugcacuccagccuugagagc

SEQ ID NO: 351930 - RNA, 20 nt, Homo sapiens
uucacugggcucucuguugg

SEQ ID NO: 351931 - RNA, 22 nt, Homo sapiens
uucacuguuaagcaguuaaacu

SEQ ID NO: 351932 - RNA, 22 nt, Homo sapiens
uucagagugguaugaagugaug

SEQ ID NO: 351933 - RNA, 22 nt, Homo sapiens
uucagcaguggccaguggaaau

SEQ ID NO: 351934 - RNA, 19 nt, Homo sapiens
uucagcagugucugcucuu

SEQ ID NO: 351935 - RNA, 22 nt, Homo sapiens
uucagguucauuugcugcuauu

SEQ ID NO: 351936 - RNA, 22 nt, Homo sapiens
uucaguggguggaugaauauga

SEQ ID NO: 351937 - RNA, 22 nt, Homo sapiens
uucagugguuauuugugagauu

SEQ ID NO: 351938 - RNA, 22 nt, Homo sapiens
uucaguucugcucugaucuuag

SEQ ID NO: 351939 - RNA, 22 nt, Homo sapiens
uucauagucacauucgaugucu

SEQ ID NO: 351940 - RNA, 22 nt, Homo sapiens
uucaucagcuguagaugucaug

SEQ ID NO: 351941 - RNA, 20 nt, Homo sapiens
uucaucaggauauuggucua

SEQ ID NO: 351942 - RNA, 22 nt, Homo sapiens
uucaucaguuauauuggccuga

SEQ ID NO: 351943 - RNA, 21 nt, Homo sapiens
uucaucuggccguauuccagg

SEQ ID NO: 351944 - RNA, 22 nt, Homo sapiens
uucaugcaucuguagugguuaa

SEQ ID NO: 351945 - RNA, 20 nt, Homo sapiens
uucaugggagcaaagaggcc

SEQ ID NO: 351946 - RNA, 22 nt, Homo sapiens
uuccaagugggaaacaaaaaug

SEQ ID NO: 351947 - RNA, 22 nt, Homo sapiens
uuccagagucaccuuucugucg

SEQ ID NO: 351948 - RNA, 20 nt, Homo sapiens
uuccagcacauuagggaagc

SEQ ID NO: 351949 - RNA, 22 nt, Homo sapiens
uuccaguggacuacuucauccu

SEQ ID NO: 351950 - RNA, 22 nt, Homo sapiens
uuccauguaguugagcaguuuu

SEQ ID NO: 351951 - RNA, 22 nt, Homo sapiens
uucccauuguuggccagcaugu

SEQ ID NO: 351952 - RNA, 20 nt, Homo sapiens
uucccucagccuugagggua

SEQ ID NO: 351953 - RNA, 22 nt, Homo sapiens
uucccugaaauauucacuuuca

SEQ ID NO: 351954 - RNA, 22 nt, Homo sapiens
uucccugugggaguaggaaagu

SEQ ID NO: 351955 - RNA, 22 nt, Homo sapiens
uucccuugcaggaugaucugga

SEQ ID NO: 351956 - RNA, 22 nt, Homo sapiens
uucccuuucugaaaaucucauu

SEQ ID NO: 351957 - RNA, 22 nt, Homo sapiens
uucccuuucuuaaagaguuagg

SEQ ID NO: 351958 - RNA, 22 nt, Homo sapiens
uucccuuugaaacuaaacuugc

SEQ ID NO: 351959 - RNA, 22 nt, Homo sapiens
uuccuaguccugagucucugcg

SEQ ID NO: 351960 - RNA, 22 nt, Homo sapiens
uuccugaggccuccccagaagc

SEQ ID NO: 351961 - RNA, 22 nt, Homo sapiens
uuccugucuuccaagagagauu

SEQ ID NO: 351962 - RNA, 22 nt, Homo sapiens
uuccugugacuguguggcaccc

SEQ ID NO: 351963 - RNA, 22 nt, Homo sapiens
uucuaaguaauuuugcaugccu

SEQ ID NO: 351964 - RNA, 21 nt, Homo sapiens
uucuacuccggcguuguuuuu

SEQ ID NO: 351965 - RNA, 22 nt, Homo sapiens
uucuaugguuaccaggcuaguc

SEQ ID NO: 351966 - RNA, 22 nt, Homo sapiens
uucucagugaaguuuagaacau

SEQ ID NO: 351967 - RNA, 22 nt, Homo sapiens
uucucauggugauggcaaaauc

SEQ ID NO: 351968 - RNA, 22 nt, Homo sapiens
uucugcacaucgaucacaagau

SEQ ID NO: 351969 - RNA, 23 nt, Homo sapiens
uucugccacugaaaaugccucag

SEQ ID NO: 351970 - RNA, 22 nt, Homo sapiens
uucuggcuaugggauacuaaau

SEQ ID NO: 351971 - RNA, 22 nt, Homo sapiens
uucugugguugaaaggagagau

SEQ ID NO: 351972 - RNA, 22 nt, Homo sapiens
uucuuccagccuugaggggccc

SEQ ID NO: 351973 - RNA, 22 nt, Homo sapiens
uucuugguguaguaguugaaaa

SEQ ID NO: 351974 - RNA, 18 nt, Homo sapiens
uucuuguguugauauuuu

SEQ ID NO: 351975 - RNA, 22 nt, Homo sapiens
uucuuugguacaagggccgacc

SEQ ID NO: 351976 - RNA, 22 nt, Homo sapiens
uugaaagaugaacuggauugga

SEQ ID NO: 351977 - RNA, 22 nt, Homo sapiens
uugaaaguaaacaucacaaaga

SEQ ID NO: 351978 - RNA, 22 nt, Homo sapiens
uugaaagucuaggcuuacagua

SEQ ID NO: 351979 - RNA, 22 nt, Homo sapiens
uugaaaguguucacaaugguau

SEQ ID NO: 351980 - RNA, 22 nt, Homo sapiens
uugaagacuaauuuagauaaug

SEQ ID NO: 351981 - RNA, 22 nt, Homo sapiens
uugaagguaauugguuuuauga

SEQ ID NO: 351982 - RNA, 22 nt, Homo sapiens
agcauggucacuuugggcccca

SEQ ID NO: 351983 - RNA, 17 nt, Homo sapiens
agcauguguuugagauu

SEQ ID NO: 351984 - RNA, 22 nt, Homo sapiens
agccccauuuguugaaaagacg

SEQ ID NO: 351985 - RNA, 23 nt, Homo sapiens
agccuguugccuaggcagcucau

SEQ ID NO: 351986 - RNA, 22 nt, Homo sapiens
agcggcuguuccccuggucuau

SEQ ID NO: 351987 - RNA, 22 nt, Homo sapiens
agcuaguauuuucuuaaggauu

SEQ ID NO: 351988 - RNA, 18 nt, Homo sapiens
agcucaguguuugcuuac

SEQ ID NO: 351989 - RNA, 22 nt, Homo sapiens
agcuccauuguaaucaccuggu

SEQ ID NO: 351990 - RNA, 22 nt, Homo sapiens
agcugccagucuuguaaggccu

SEQ ID NO: 351991 - RNA, 22 nt, Homo sapiens
agcuggaauuuaagguagauag

SEQ ID NO: 351992 - RNA, 22 nt, Homo sapiens
agcuggauguauguuaagugaa

SEQ ID NO: 351993 - RNA, 22 nt, Homo sapiens
agcuggauguggaugacccugu

SEQ ID NO: 351994 - RNA, 20 nt, Homo sapiens
agcuggguguguuggugcau

SEQ ID NO: 351995 - RNA, 22 nt, Homo sapiens
agcugguauuuugucaaggaua

SEQ ID NO: 351996 - RNA, 22 nt, Homo sapiens
agcugguuuauuucuauauccu

SEQ ID NO: 351997 - RNA, 22 nt, Homo sapiens
agcugguuuauuucucacaaca

SEQ ID NO: 351998 - RNA, 22 nt, Homo sapiens
agcuguguugucugaagucaga

SEQ ID NO: 351999 - RNA, 22 nt, Homo sapiens
agcuguuguacacuuuaccuuu

SEQ ID NO: 352000 - RNA, 22 nt, Homo sapiens
agcuguuguucucagaggcuuu

SEQ ID NO: 352001 - RNA, 22 nt, Homo sapiens
agcuucacaaugcagagggcag

SEQ ID NO: 352002 - RNA, 21 nt, Homo sapiens
agcuuguguguaucacagugu

SEQ ID NO: 352003 - RNA, 22 nt, Homo sapiens
agcuuuuugggaggccuuagga

SEQ ID NO: 352004 - RNA, 22 nt, Homo sapiens
aggaagugucuucuuuuaggca

SEQ ID NO: 352005 - RNA, 22 nt, Homo sapiens
aggaccaugguauugcuuuggg

SEQ ID NO: 352006 - RNA, 19 nt, Homo sapiens
aggacuaaagacuagaagu

SEQ ID NO: 352007 - RNA, 22 nt, Homo sapiens
aggagaauugguucuucuugau

SEQ ID NO: 352008 - RNA, 21 nt, Homo sapiens
aggagcauucucuugcuuugu

SEQ ID NO: 352009 - RNA, 22 nt, Homo sapiens
aggauaguaaugauagagaggc

SEQ ID NO: 352010 - RNA, 16 nt, Homo sapiens
aggcaagaauugaggu

SEQ ID NO: 352011 - RNA, 21 nt, Homo sapiens
aggcaagacuuuuagguuugu

SEQ ID NO: 352012 - RNA, 22 nt, Homo sapiens
aggcaaguugcucaaaugcaaa

SEQ ID NO: 352013 - RNA, 22 nt, Homo sapiens
aggcacggugucucaugccugu

SEQ ID NO: 352014 - RNA, 22 nt, Homo sapiens
aggcaggugaaagauaguuuua

SEQ ID NO: 352015 - RNA, 22 nt, Homo sapiens
aggcaguuucagugagagguga

SEQ ID NO: 352016 - RNA, 22 nt, Homo sapiens
aggcaugauuguauuuugcucu

SEQ ID NO: 352017 - RNA, 22 nt, Homo sapiens
aggcauguggcucuguucugac

SEQ ID NO: 352018 - RNA, 20 nt, Homo sapiens
aggcauguugguuugcgugu

SEQ ID NO: 352019 - RNA, 22 nt, Homo sapiens
agggcaguguuaggacugucug

SEQ ID NO: 352020 - RNA, 22 nt, Homo sapiens
aggguaguaggcuugggauugg

SEQ ID NO: 352021 - RNA, 20 nt, Homo sapiens
agguagauagaugauagaua

SEQ ID NO: 352022 - RNA, 22 nt, Homo sapiens
uugcaugggagcugggugaggc

SEQ ID NO: 352023 - RNA, 22 nt, Homo sapiens
uugccuaggcuggagugcagug

SEQ ID NO: 352024 - RNA, 22 nt, Homo sapiens
uugccuaggcuggaguguggug

SEQ ID NO: 352025 - RNA, 22 nt, Homo sapiens
uugccugagaagccaagaauaa

SEQ ID NO: 352026 - RNA, 22 nt, Homo sapiens
uugcuccucugccaggaccugu

SEQ ID NO: 352027 - RNA, 22 nt, Homo sapiens
uugcuuagagccaaucuugauu

SEQ ID NO: 352028 - RNA, 22 nt, Homo sapiens
uuggaaagagguguuuaugacu

SEQ ID NO: 352029 - RNA, 22 nt, Homo sapiens
uuggaaaguuguuguaguuauu

SEQ ID NO: 352030 - RNA, 22 nt, Homo sapiens
uuggaagagaagggagauaaac

SEQ ID NO: 352031 - RNA, 22 nt, Homo sapiens
uuggaaugcaacagaaggauaa

SEQ ID NO: 352032 - RNA, 22 nt, Homo sapiens
uuggaauuuauuuggaugggag

SEQ ID NO: 352033 - RNA, 22 nt, Homo sapiens
uuggacucccuccccagcuuca

SEQ ID NO: 352034 - RNA, 22 nt, Homo sapiens
uuggacugugagguuucguggg

SEQ ID NO: 352035 - RNA, 22 nt, Homo sapiens
uuggacuucuaacugacaugga

SEQ ID NO: 352036 - RNA, 22 nt, Homo sapiens
uuggacuuuuauucugcaggca

SEQ ID NO: 352037 - RNA, 22 nt, Homo sapiens
uuggagagugauauucagaugc

SEQ ID NO: 352038 - RNA, 22 nt, Homo sapiens
uuggauggucuuuauauaguau

SEQ ID NO: 352039 - RNA, 22 nt, Homo sapiens
uuggauuguuucuagauugggg

SEQ ID NO: 352040 - RNA, 22 nt, Homo sapiens
uuggauuuuaacaaacuaggug

SEQ ID NO: 352041 - RNA, 22 nt, Homo sapiens
uuggcagcauuccagccaagca

SEQ ID NO: 352042 - RNA, 22 nt, Homo sapiens
uuggcaguaucuacuacagcua

SEQ ID NO: 352043 - RNA, 22 nt, Homo sapiens
uuggcagugcccgaugcugggg

SEQ ID NO: 352044 - RNA, 22 nt, Homo sapiens
uuggcagugguucugacggacc

SEQ ID NO: 352045 - RNA, 22 nt, Homo sapiens
uuggcauugaguuucaaaucau

SEQ ID NO: 352046 - RNA, 22 nt, Homo sapiens
uuggcauugccaaacugucaac

SEQ ID NO: 352047 - RNA, 20 nt, Homo sapiens
uuggcauuuagacaagaguu

SEQ ID NO: 352048 - RNA, 22 nt, Homo sapiens
uuggcauuuuuagucaugggaa

SEQ ID NO: 352049 - RNA, 22 nt, Homo sapiens
uuggccagugucuuuuuuuccu

SEQ ID NO: 352050 - RNA, 22 nt, Homo sapiens
uuggccauaugacuugcuuugg

SEQ ID NO: 352051 - RNA, 22 nt, Homo sapiens
uuggccccucccaaauuucaug

SEQ ID NO: 352052 - RNA, 19 nt, Homo sapiens
uuggcccugguucucuucu

SEQ ID NO: 352053 - RNA, 22 nt, Homo sapiens
uuggccuccuggucauauccag

SEQ ID NO: 352054 - RNA, 21 nt, Homo sapiens
uuggccuggaggccugaaugu

SEQ ID NO: 352055 - RNA, 22 nt, Homo sapiens
uuggcuaagaucacgugagaau

SEQ ID NO: 352056 - RNA, 22 nt, Homo sapiens
uuggcuguguuuauaugcugga

SEQ ID NO: 352057 - RNA, 22 nt, Homo sapiens
uugggaauguccuaauaucucg

SEQ ID NO: 352058 - RNA, 22 nt, Homo sapiens
uugggauaaucacaaaguaaaa

SEQ ID NO: 352059 - RNA, 22 nt, Homo sapiens
uugggcauugcuauaaauucuu

SEQ ID NO: 352060 - RNA, 21 nt, Homo sapiens
uuggggaauggagagguuuuc

SEQ ID NO: 352061 - RNA, 22 nt, Homo sapiens
uuggguccucugguccuugguu

SEQ ID NO: 352062 - RNA, 22 nt, Homo sapiens
uugguauguguuucauacucaa

SEQ ID NO: 352063 - RNA, 22 nt, Homo sapiens
uuggucaggcuagaguguggug

SEQ ID NO: 352064 - RNA, 19 nt, Homo sapiens
uuggucccuuuggguucuu

SEQ ID NO: 352065 - RNA, 23 nt, Homo sapiens
uuggucucccaaaguguugagau

SEQ ID NO: 352066 - RNA, 22 nt, Homo sapiens
uugguuccuuagccuaggacua

SEQ ID NO: 352067 - RNA, 22 nt, Homo sapiens
uuguacaggaguguaagcuuca

SEQ ID NO: 352068 - RNA, 16 nt, Homo sapiens
uugucccuucccaaau

SEQ ID NO: 352069 - RNA, 22 nt, Homo sapiens
uuguccucuccaaaucucaugu

SEQ ID NO: 352070 - RNA, 22 nt, Homo sapiens
uugucuagugaauacauuaaug

SEQ ID NO: 352071 - RNA, 22 nt, Homo sapiens
uugugaaugaugccgcaauaaa

SEQ ID NO: 352072 - RNA, 22 nt, Homo sapiens
uugugaauggugccacaauaaa

SEQ ID NO: 352073 - RNA, 22 nt, Homo sapiens
uugugcuuguaacuacauucag

SEQ ID NO: 352074 - RNA, 22 nt, Homo sapiens
uugugcuuuugagcugagauga

SEQ ID NO: 352075 - RNA, 16 nt, Homo sapiens
uuguggcuuuugcaca

SEQ ID NO: 352076 - RNA, 22 nt, Homo sapiens
uugugucccugcggcugaggag

SEQ ID NO: 352077 - RNA, 22 nt, Homo sapiens
uuguguuuuuaguagggaaggg

SEQ ID NO: 352078 - RNA, 22 nt, Homo sapiens
auaugucuauuauuagggcagg

SEQ ID NO: 352079 - RNA, 22 nt, Homo sapiens
auaugucuguuuagucuguaau

SEQ ID NO: 352080 - RNA, 22 nt, Homo sapiens
auauuacuggcuauaucgcaag

SEQ ID NO: 352081 - RNA, 22 nt, Homo sapiens
auauuagguuggugccaaagua

SEQ ID NO: 352082 - RNA, 22 nt, Homo sapiens
auauuugguuaccugugggucu

SEQ ID NO: 352083 - RNA, 20 nt, Homo sapiens
aucaaagacuuagaggggga

SEQ ID NO: 352084 - RNA, 22 nt, Homo sapiens
aucaagccaaagaaaguccuug

SEQ ID NO: 352085 - RNA, 22 nt, Homo sapiens
aucaagcuacacccuuuggaaa

SEQ ID NO: 352086 - RNA, 22 nt, Homo sapiens
aucacagaacuuugagcagaga

SEQ ID NO: 352087 - RNA, 22 nt, Homo sapiens
aucacagaguuaaaacuuucuu

SEQ ID NO: 352088 - RNA, 22 nt, Homo sapiens
aucacaguggcucacaagagcc

SEQ ID NO: 352089 - RNA, 22 nt, Homo sapiens
aucacaguggucagguauagau

SEQ ID NO: 352090 - RNA, 22 nt, Homo sapiens
aucacaguuaagaggugaugaa

SEQ ID NO: 352091 - RNA, 22 nt, Homo sapiens
aucacauggccagguaguaauc

SEQ ID NO: 352092 - RNA, 22 nt, Homo sapiens
aucaccugagcaguauacacug

SEQ ID NO: 352093 - RNA, 22 nt, Homo sapiens
aucacugggcaagauaucauga

SEQ ID NO: 352094 - RNA, 22 nt, Homo sapiens
aucacugugauuucuacugugc

SEQ ID NO: 352095 - RNA, 22 nt, Homo sapiens
aucacuguuuugaugcucggac

SEQ ID NO: 352096 - RNA, 22 nt, Homo sapiens
aucagaaucucuugagaguguu

SEQ ID NO: 352097 - RNA, 20 nt, Homo sapiens
aucagagccggugaaagggc

SEQ ID NO: 352098 - RNA, 22 nt, Homo sapiens
aucagauuccacauuuuaucag

SEQ ID NO: 352099 - RNA, 23 nt, Homo sapiens
aucagguuguagaauguguuugc

SEQ ID NO: 352100 - RNA, 22 nt, Homo sapiens
aucagugcagugggaacuagaa

SEQ ID NO: 352101 - RNA, 22 nt, Homo sapiens
aucagugcauaguauuuaauga

SEQ ID NO: 352102 - RNA, 22 nt, Homo sapiens
aucauaucaucugcaaacaaag

SEQ ID NO: 352103 - RNA, 22 nt, Homo sapiens
aucauaucauuggugaacagug

SEQ ID NO: 352104 - RNA, 22 nt, Homo sapiens
aucauauccuagauauaacuuc

SEQ ID NO: 352105 - RNA, 22 nt, Homo sapiens
aucauccagccccagaagggag

SEQ ID NO: 352106 - RNA, 22 nt, Homo sapiens
aucauccugucaggagcuguga

SEQ ID NO: 352107 - RNA, 22 nt, Homo sapiens
aucauguaguaagacacauuua

SEQ ID NO: 352108 - RNA, 22 nt, Homo sapiens
aucauugugcaucuucauucca

SEQ ID NO: 352109 - RNA, 22 nt, Homo sapiens
aucccagaaacucggguuucuc

SEQ ID NO: 352110 - RNA, 22 nt, Homo sapiens
aucccugagaacuuuuaauguu

SEQ ID NO: 352111 - RNA, 22 nt, Homo sapiens
aucccugagccugacucucaga

SEQ ID NO: 352112 - RNA, 22 nt, Homo sapiens
aucccugugacgagcaucccua

SEQ ID NO: 352113 - RNA, 22 nt, Homo sapiens
aucccuuucucuggcuaggggg

SEQ ID NO: 352114 - RNA, 22 nt, Homo sapiens
uuuggccauguuggucaggcug

SEQ ID NO: 352115 - RNA, 18 nt, Homo sapiens
uuuggcuguucaugacuc

SEQ ID NO: 352116 - RNA, 22 nt, Homo sapiens
uuuggcuuuuguaauaacugcc

SEQ ID NO: 352117 - RNA, 22 nt, Homo sapiens
uuugggaaaugaaguugguaga

SEQ ID NO: 352118 - RNA, 22 nt, Homo sapiens
uuugggaaugguuugucuccca

SEQ ID NO: 352119 - RNA, 22 nt, Homo sapiens
uuugguccaguguucagguccu

SEQ ID NO: 352120 - RNA, 18 nt, Homo sapiens
uuugguccuuuauaaaca

SEQ ID NO: 352121 - RNA, 22 nt, Homo sapiens
uuugguuauauauauacacucu

SEQ ID NO: 352122 - RNA, 22 nt, Homo sapiens
uuuguacacuguugguaggauu

SEQ ID NO: 352123 - RNA, 21 nt, Homo sapiens
uuuguaguagcaugauuuaua

SEQ ID NO: 352124 - RNA, 21 nt, Homo sapiens
uuuguccaccuguguucacca

SEQ ID NO: 352125 - RNA, 22 nt, Homo sapiens
uuugugaaugucauaagcucca

SEQ ID NO: 352126 - RNA, 22 nt, Homo sapiens
uuugugcaugaagagggggugc

SEQ ID NO: 352127 - RNA, 22 nt, Homo sapiens
uuugugcuauguuauauauucu

SEQ ID NO: 352128 - RNA, 22 nt, Homo sapiens
uuugugcuccuguugagaaucu

SEQ ID NO: 352129 - RNA, 21 nt, Homo sapiens
uuugugguuacugugugagcu

SEQ ID NO: 352130 - RNA, 22 nt, Homo sapiens
uuugugugugauuauaaaaggu

SEQ ID NO: 352131 - RNA, 22 nt, Homo sapiens
uuuguucaccucaaggauggga

SEQ ID NO: 352132 - RNA, 22 nt, Homo sapiens
uuuuacacuguugguuggaaug

SEQ ID NO: 352133 - RNA, 22 nt, Homo sapiens
uuuuagcaaagagacugguggc

SEQ ID NO: 352134 - RNA, 22 nt, Homo sapiens
uuuuauguuuguucccugccaa

SEQ ID NO: 352135 - RNA, 22 nt, Homo sapiens
uuuucaguuuuccagguagccg

SEQ ID NO: 352136 - RNA, 22 nt, Homo sapiens
uuuugcaauauguuccugaaua

SEQ ID NO: 352137 - RNA, 20 nt, Homo sapiens
uuuuggacuaaaggcauccc

SEQ ID NO: 352138 - RNA, 22 nt, Homo sapiens
uuuuggcacuuugucugauucu

SEQ ID NO: 352139 - RNA, 22 nt, Homo sapiens
uuuuggcuuuuccucagcaagc

SEQ ID NO: 352140 - RNA, 22 nt, Homo sapiens
uuuuggucuccaguuucugcug

SEQ ID NO: 352141 - RNA, 19 nt, Homo sapiens
uuuuguacucugugacuug

SEQ ID NO: 352142 - RNA, 22 nt, Homo sapiens
uuuuuugguaauugaacaauga

SEQ ID NO: 352143 - RNA, 22 nt, Homo sapiens
auggcuuaagacaaccuuucau

SEQ ID NO: 352144 - RNA, 22 nt, Homo sapiens
auggcuucuuacucuucugcau

SEQ ID NO: 352145 - RNA, 22 nt, Homo sapiens
auggcuuuugaccugguaggau

SEQ ID NO: 352146 - RNA, 22 nt, Homo sapiens
augggauaguaucaguggaaua

SEQ ID NO: 352147 - RNA, 22 nt, Homo sapiens
augggcaaauguuggaaauucc

SEQ ID NO: 352148 - RNA, 22 nt, Homo sapiens
auguaacuaucugagccauggg

SEQ ID NO: 352149 - RNA, 22 nt, Homo sapiens
auguaguauuaaugagagauaa

SEQ ID NO: 352150 - RNA, 22 nt, Homo sapiens
auguagugugauuuucacuaga

SEQ ID NO: 352151 - RNA, 22 nt, Homo sapiens
auguauacauagauacgugugu

SEQ ID NO: 352152 - RNA, 22 nt, Homo sapiens
augucacugcacuccugccugg

SEQ ID NO: 352153 - RNA, 22 nt, Homo sapiens
augucugguagccaccuggagg

SEQ ID NO: 352154 - RNA, 22 nt, Homo sapiens
augugaacugaauuaauucaca

SEQ ID NO: 352155 - RNA, 22 nt, Homo sapiens
augugacugauguaaucagaca

SEQ ID NO: 352156 - RNA, 22 nt, Homo sapiens
augugacuuuuuccugugccuu

SEQ ID NO: 352157 - RNA, 22 nt, Homo sapiens
augugcaugcuguucugccaga

SEQ ID NO: 352158 - RNA, 22 nt, Homo sapiens
augugcuuauagguguauguuu

SEQ ID NO: 352159 - RNA, 22 nt, Homo sapiens
augugcuuuuuaaacagaugcu

SEQ ID NO: 352160 - RNA, 22 nt, Homo sapiens
auguggaaauguauaugugucu

SEQ ID NO: 352161 - RNA, 18 nt, Homo sapiens
auguggcuuuugaaggcu

SEQ ID NO: 352162 - RNA, 23 nt, Homo sapiens
augugugcuuggagagcaggaug

SEQ ID NO: 352163 - RNA, 22 nt, Homo sapiens
augugugcuugugacacagccu

SEQ ID NO: 352164 - RNA, 22 nt, Homo sapiens
auguguucaucacagcacaauu

SEQ ID NO: 352165 - RNA, 22 nt, Homo sapiens
auuaagugcuugcagaagucca

SEQ ID NO: 352166 - RNA, 22 nt, Homo sapiens
auuaaguuaggauuuugagaua

SEQ ID NO: 352167 - RNA, 22 nt, Homo sapiens
auuauuagucggccagcuguua

SEQ ID NO: 352168 - RNA, 20 nt, Homo sapiens
auucauggaggagcaauugg

SEQ ID NO: 352169 - RNA, 22 nt, Homo sapiens
auuccaguuugugagaagcugu

SEQ ID NO: 352170 - RNA, 22 nt, Homo sapiens
auuccauuuguguggaauggcu

SEQ ID NO: 352171 - RNA, 22 nt, Homo sapiens
auucuauaguccuaggauuggg

SEQ ID NO: 352172 - RNA, 23 nt, Homo sapiens
auugaacacuuucauaugugagg

SEQ ID NO: 352173 - RNA, 22 nt, Homo sapiens
auugacacugauuuuucuuuaa

SEQ ID NO: 352174 - RNA, 22 nt, Homo sapiens
auugagcaauuccuaugugcuu

SEQ ID NO: 352175 - RNA, 22 nt, Homo sapiens
auugaguaaaaaauagugaugu

SEQ ID NO: 352176 - RNA, 21 nt, Homo sapiens
auugcacaauauacccaugua

SEQ ID NO: 352177 - RNA, 22 nt, Homo sapiens
cucacuggguguaaaacaugua

SEQ ID NO: 352178 - RNA, 22 nt, Homo sapiens
cucagcuacuugggaagcugag

SEQ ID NO: 352179 - RNA, 20 nt, Homo sapiens
cucagugcacccccauaaaa

SEQ ID NO: 352180 - RNA, 22 nt, Homo sapiens
cucagugucuggcacacagaaa

SEQ ID NO: 352181 - RNA, 22 nt, Homo sapiens
cucaguguuucagcugcucaga

SEQ ID NO: 352182 - RNA, 22 nt, Homo sapiens
cucauggauggucuggcagcca

SEQ ID NO: 352183 - RNA, 22 nt, Homo sapiens
cucauuggcuacugaggcuugu

SEQ ID NO: 352184 - RNA, 22 nt, Homo sapiens
cuccaggugagguuaagggacu

SEQ ID NO: 352185 - RNA, 23 nt, Homo sapiens
cuccaugagccguccagggccug

SEQ ID NO: 352186 - RNA, 22 nt, Homo sapiens
cuccauuuaguccuuuuagaag

SEQ ID NO: 352187 - RNA, 22 nt, Homo sapiens
cuccauuuggaacagauguccu

SEQ ID NO: 352188 - RNA, 20 nt, Homo sapiens
cucccugacaaauguggaaa

SEQ ID NO: 352189 - RNA, 22 nt, Homo sapiens
cucccugagccagggcuuugac

SEQ ID NO: 352190 - RNA, 22 nt, Homo sapiens
cuccuggugauuggagugugaa

SEQ ID NO: 352191 - RNA, 22 nt, Homo sapiens
cucucaagaugcugggauuaca

SEQ ID NO: 352192 - RNA, 22 nt, Homo sapiens
cucugguucugcagugcacccu

SEQ ID NO: 352193 - RNA, 22 nt, Homo sapiens
cucuuggguagauuuugcagag

SEQ ID NO: 352194 - RNA, 22 nt, Homo sapiens
cucuuuaguaagcaguugauga

SEQ ID NO: 352195 - RNA, 22 nt, Homo sapiens
cucuuugcuucuggcaucauug

SEQ ID NO: 352196 - RNA, 22 nt, Homo sapiens
cucuuuuguuccuaguuugauc

SEQ ID NO: 352197 - RNA, 22 nt, Homo sapiens
cucuuuuguuuagcugagaggg

SEQ ID NO: 352198 - RNA, 22 nt, Homo sapiens
cugaauguucuauagaagccgc

SEQ ID NO: 352199 - RNA, 22 nt, Homo sapiens
cugaauguuuucuucuauucug

SEQ ID NO: 352200 - RNA, 22 nt, Homo sapiens
cugacagaugacugccacugua

SEQ ID NO: 352201 - RNA, 22 nt, Homo sapiens
cugacuaguuuuaaugcagauu

SEQ ID NO: 352202 - RNA, 22 nt, Homo sapiens
cugacuuauguggacuauuuca

SEQ ID NO: 352203 - RNA, 22 nt, Homo sapiens
cugagaagaaacagguaaggac

SEQ ID NO: 352204 - RNA, 22 nt, Homo sapiens
cugagaucaugggucagguggu

SEQ ID NO: 352205 - RNA, 22 nt, Homo sapiens
cugagaucugaaccaggagugu

SEQ ID NO: 352206 - RNA, 22 nt, Homo sapiens
cugagauuaagauauugggagu

SEQ ID NO: 352207 - RNA, 22 nt, Homo sapiens
cugagcaagucauuuuguuaaa

SEQ ID NO: 352208 - RNA, 22 nt, Homo sapiens
cugagcacugagauccucuagc

SEQ ID NO: 352209 - RNA, 22 nt, Homo sapiens
cugagcaugacaucaugugacu

SEQ ID NO: 352210 - RNA, 20 nt, Homo sapiens
cugaggugggagaaucgcuu

SEQ ID NO: 352211 - RNA, 22 nt, Homo sapiens
cugagguuaggaguuugagacc

SEQ ID NO: 352212 - RNA, 20 nt, Homo sapiens
cugagguugggguccuuccc

SEQ ID NO: 352213 - RNA, 22 nt, Homo sapiens
cugauacucuccuuuuagagag

SEQ ID NO: 352214 - RNA, 22 nt, Homo sapiens
cugaucuaugaacacaggauau

SEQ ID NO: 352215 - RNA, 22 nt, Homo sapiens
cugaucuggaggugucugggga

SEQ ID NO: 352216 - RNA, 20 nt, Homo sapiens
cugcaaaugcugcugcugau

SEQ ID NO: 352217 - RNA, 22 nt, Homo sapiens
cugcacugagacccucuuugcu

SEQ ID NO: 352218 - RNA, 21 nt, Homo sapiens
cugcauccauuucugagugau

SEQ ID NO: 352219 - RNA, 22 nt, Homo sapiens
cugcauuagucuguuuaguguu

SEQ ID NO: 352220 - RNA, 22 nt, Homo sapiens
cugcauuggguuaugcauuuuu

SEQ ID NO: 352221 - RNA, 22 nt, Homo sapiens
cugccuagauguuguagggggu

SEQ ID NO: 352222 - RNA, 22 nt, Homo sapiens
cuggaaagaaucaggcuaaacu

SEQ ID NO: 352223 - RNA, 22 nt, Homo sapiens
cuggaagcacaacgcauuuauu

SEQ ID NO: 352224 - RNA, 22 nt, Homo sapiens
cuggaaucuagaaaagguaagg

SEQ ID NO: 352225 - RNA, 22 nt, Homo sapiens
cuggaaugcagcuuuaggggcu

SEQ ID NO: 352226 - RNA, 22 nt, Homo sapiens
cuggagauuaaccaauugccau

SEQ ID NO: 352227 - RNA, 20 nt, Homo sapiens
cuggaugucgaggcagaggu

SEQ ID NO: 352228 - RNA, 22 nt, Homo sapiens
cuggcacccuugcuuaggaaga

SEQ ID NO: 352229 - RNA, 22 nt, Homo sapiens
cuggcaguguuucuugugggcu

SEQ ID NO: 352230 - RNA, 22 nt, Homo sapiens
cugggaucaguucuagucagaa

SEQ ID NO: 352231 - RNA, 22 nt, Homo sapiens
cugggaugauguaaauaggcua

SEQ ID NO: 352232 - RNA, 22 nt, Homo sapiens
cugggaugugacuguugccccc

SEQ ID NO: 352233 - RNA, 21 nt, Homo sapiens
cugguccccuuuauguaugug

SEQ ID NO: 352234 - RNA, 22 nt, Homo sapiens
cuggugagaugucuuuccucuu

SEQ ID NO: 352235 - RNA, 21 nt, Homo sapiens
cugguguuagcacuucuuccc

SEQ ID NO: 352236 - RNA, 22 nt, Homo sapiens
cugucacugggaggggcagcag

SEQ ID NO: 352237 - RNA, 22 nt, Homo sapiens
cugucucagccucuccaguagc

SEQ ID NO: 352238 - RNA, 22 nt, Homo sapiens
cugucuggaggccugcaaauaa

SEQ ID NO: 352239 - RNA, 22 nt, Homo sapiens
cugugcuugauuauaugagugu

SEQ ID NO: 352240 - RNA, 22 nt, Homo sapiens
cugugcuuggagucccccuagg

SEQ ID NO: 352241 - RNA, 22 nt, Homo sapiens
cuguggauguauugcacagucu

SEQ ID NO: 352242 - RNA, 22 nt, Homo sapiens
cugugguguaacucuuggggcg

SEQ ID NO: 352243 - RNA, 22 nt, Homo sapiens
cugugguuacguucuuugugcu

SEQ ID NO: 352244 - RNA, 22 nt, Homo sapiens
cugugguugagcuuugccauga

SEQ ID NO: 352245 - RNA, 22 nt, Homo sapiens
cuguugguuaaauuccaugcag

SEQ ID NO: 352246 - RNA, 22 nt, Homo sapiens
cuguuuguuuaggguacucaga

SEQ ID NO: 352247 - RNA, 22 nt, Homo sapiens
cuuaaagcgaauauugguggua

SEQ ID NO: 352248 - RNA, 22 nt, Homo sapiens
cuucaugggagaaccacaggua

SEQ ID NO: 352249 - RNA, 22 nt, Homo sapiens
cuuccauaguauuuuuacaaaa

SEQ ID NO: 352250 - RNA, 18 nt, Homo sapiens
cuuccuuagucugguuaa

SEQ ID NO: 352251 - RNA, 21 nt, Homo sapiens
cuucuuggggcagggcagggu

SEQ ID NO: 352252 - RNA, 22 nt, Homo sapiens
cuugaacaaagagauuccauua

SEQ ID NO: 352253 - RNA, 20 nt, Homo sapiens
cuugaagacuaugcugcuga

SEQ ID NO: 352254 - RNA, 22 nt, Homo sapiens
uugagauaggaacucacuaugc

SEQ ID NO: 352255 - RNA, 22 nt, Homo sapiens
uugagauagggucuaccucugu

SEQ ID NO: 352256 - RNA, 22 nt, Homo sapiens
uugagaucaugcuacugcacuc

SEQ ID NO: 352257 - RNA, 22 nt, Homo sapiens
uugagauggagucucacucugc

SEQ ID NO: 352258 - RNA, 22 nt, Homo sapiens
uugagauggagucucacucugu

SEQ ID NO: 352259 - RNA, 22 nt, Homo sapiens
uugagauggagucucacucuug

SEQ ID NO: 352260 - RNA, 22 nt, Homo sapiens
uugagauggagucuugcucucu

SEQ ID NO: 352261 - RNA, 22 nt, Homo sapiens
uugagauggagucuugcucugu

SEQ ID NO: 352262 - RNA, 22 nt, Homo sapiens
uugagauggaguguugcucugu

SEQ ID NO: 352263 - RNA, 22 nt, Homo sapiens
uugagauggaguucauuuuugu

SEQ ID NO: 352264 - RNA, 22 nt, Homo sapiens
uugagauggaguuucaauauug

SEQ ID NO: 352265 - RNA, 22 nt, Homo sapiens
uugagauggaguuucacucucg

SEQ ID NO: 352266 - RNA, 22 nt, Homo sapiens
uugagauggaguuucgcucuuu

SEQ ID NO: 352267 - RNA, 22 nt, Homo sapiens
uugagauguauguauauaaugu

SEQ ID NO: 352268 - RNA, 22 nt, Homo sapiens
uugagcaaaacauuaauauuag

SEQ ID NO: 352269 - RNA, 22 nt, Homo sapiens
uugagcacugucugugugcagu

SEQ ID NO: 352270 - RNA, 22 nt, Homo sapiens
uugagcuuuuuacuuguccaau

SEQ ID NO: 352271 - RNA, 22 nt, Homo sapiens
uugaggaagugguuccccagag

SEQ ID NO: 352272 - RNA, 22 nt, Homo sapiens
uugaggcaaugaggagaagcug

SEQ ID NO: 352273 - RNA, 17 nt, Homo sapiens
uuauugcuauaagcuga

SEQ ID NO: 352274 - RNA, 22 nt, Homo sapiens
uuauuugguuauuguaauuggg

SEQ ID NO: 352275 - RNA, 22 nt, Homo sapiens
uuauuugguugcugacuuggaa

SEQ ID NO: 352276 - RNA, 22 nt, Homo sapiens
uucaaaggauuuagauuagcua

SEQ ID NO: 352277 - RNA, 23 nt, Homo sapiens
uucaaauguucucugguugucag

SEQ ID NO: 352278 - RNA, 22 nt, Homo sapiens
uucaagauggccccagugagcc

SEQ ID NO: 352279 - RNA, 22 nt, Homo sapiens
uucaaguaagaaagacaucagg

SEQ ID NO: 352280 - RNA, 22 nt, Homo sapiens
uucaauaugucauuggcaggca

SEQ ID NO: 352281 - RNA, 22 nt, Homo sapiens
uucaauuaauauuauacucuca

SEQ ID NO: 352282 - RNA, 22 nt, Homo sapiens
uucaccuugcccacagcagucu

SEQ ID NO: 352283 - RNA, 22 nt, Homo sapiens
uucacugugaacucauauucag

SEQ ID NO: 352284 - RNA, 22 nt, Homo sapiens
uucagaguggacagaaauuaag

SEQ ID NO: 352285 - RNA, 22 nt, Homo sapiens
uucagaucaucccagcuccacu

SEQ ID NO: 352286 - RNA, 22 nt, Homo sapiens
uucagaugcacacuguagucua

SEQ ID NO: 352287 - RNA, 22 nt, Homo sapiens
uucaggcaccauugucauugau

SEQ ID NO: 352288 - RNA, 22 nt, Homo sapiens
uucaggcuccgugccagcuccg

SEQ ID NO: 352289 - RNA, 22 nt, Homo sapiens
uucagguaucccuugucuauag

SEQ ID NO: 352290 - RNA, 22 nt, Homo sapiens
uucaguaaauguucuuacuaua

SEQ ID NO: 352291 - RNA, 22 nt, Homo sapiens
uucaguaguaaguuggaacucu

SEQ ID NO: 352292 - RNA, 22 nt, Homo sapiens
uucaguccauuuccuuggucac

SEQ ID NO: 352293 - RNA, 22 nt, Homo sapiens
uucaguggagaggcugaguggu

SEQ ID NO: 352294 - RNA, 19 nt, Homo sapiens
uucauacagugagagcagc

SEQ ID NO: 352295 - RNA, 22 nt, Homo sapiens
uucauaguucuuuuagucauua

SEQ ID NO: 352296 - RNA, 22 nt, Homo sapiens
uucauaguuuauacugauauuu

SEQ ID NO: 352297 - RNA, 21 nt, Homo sapiens
uucaucagccagaaaucaagc

SEQ ID NO: 352298 - RNA, 22 nt, Homo sapiens
uucauccccuccaaaucucaug

SEQ ID NO: 352299 - RNA, 22 nt, Homo sapiens
uucaucuggcaauucagagauu

SEQ ID NO: 352300 - RNA, 22 nt, Homo sapiens
uucauguagucaucauccugcu

SEQ ID NO: 352301 - RNA, 22 nt, Homo sapiens
uucaugucuuggcuguuagagu

SEQ ID NO: 352302 - RNA, 22 nt, Homo sapiens
uuccacaauggcugaacuaguu

SEQ ID NO: 352303 - RNA, 22 nt, Homo sapiens
uuccacaggguugaacuaguuu

SEQ ID NO: 352304 - RNA, 23 nt, Homo sapiens
uuccaccauugacuaguuacaua

SEQ ID NO: 352305 - RNA, 22 nt, Homo sapiens
uuccaguaauagcacagcauug

SEQ ID NO: 352306 - RNA, 22 nt, Homo sapiens
uuccaguauuugggcaagcgca

SEQ ID NO: 352307 - RNA, 21 nt, Homo sapiens
uuccagugagccuagaugccu

SEQ ID NO: 352308 - RNA, 22 nt, Homo sapiens
uuccaguguguucauccucaga

SEQ ID NO: 352309 - RNA, 22 nt, Homo sapiens
uuccauaggcuagaucaaccag

SEQ ID NO: 352310 - RNA, 22 nt, Homo sapiens
uuccaugagaugcaucaaagcu

SEQ ID NO: 352311 - RNA, 22 nt, Homo sapiens
uuccauguaguugaacgguuuu

SEQ ID NO: 352312 - RNA, 22 nt, Homo sapiens
uuccauguugauacgugaaguu

SEQ ID NO: 352313 - RNA, 22 nt, Homo sapiens
uucccagagaaaaggguuucuu

SEQ ID NO: 352314 - RNA, 22 nt, Homo sapiens
uucccaguggaacauguaguca

SEQ ID NO: 352315 - RNA, 22 nt, Homo sapiens
uucccgggguggaaugcaguga

SEQ ID NO: 352316 - RNA, 22 nt, Homo sapiens
uucccugaaguguuacucuaga

SEQ ID NO: 352317 - RNA, 22 nt, Homo sapiens
uucccugaguaucuuaccaugg

SEQ ID NO: 352318 - RNA, 22 nt, Homo sapiens
uucccugugggcuggugcucca

SEQ ID NO: 352319 - RNA, 19 nt, Homo sapiens
uuccugagaacaagggcuu

SEQ ID NO: 352320 - RNA, 22 nt, Homo sapiens
uuccugagagggcugggugcag

SEQ ID NO: 352321 - RNA, 22 nt, Homo sapiens
uuccuuguagcaaaugcgauga

SEQ ID NO: 352322 - RNA, 22 nt, Homo sapiens
uucuaaguaagucuguggggaa

SEQ ID NO: 352323 - RNA, 20 nt, Homo sapiens
uucuacagucacaggaagau

SEQ ID NO: 352324 - RNA, 22 nt, Homo sapiens
uucuacuccucauggcagguug

SEQ ID NO: 352325 - RNA, 22 nt, Homo sapiens
uucuagagagaagacuuaagcu

SEQ ID NO: 352326 - RNA, 22 nt, Homo sapiens
uucuagcaauggcagagugucu

SEQ ID NO: 352327 - RNA, 22 nt, Homo sapiens
uucucaauggcaacuuguugcu

SEQ ID NO: 352328 - RNA, 22 nt, Homo sapiens
uucucacaguacagggagcucu

SEQ ID NO: 352329 - RNA, 21 nt, Homo sapiens
uucucaggguguguccuaccc

SEQ ID NO: 352330 - RNA, 17 nt, Homo sapiens
uucucaguucugaucuc

SEQ ID NO: 352331 - RNA, 22 nt, Homo sapiens
uucucuggucagaggggagguu

SEQ ID NO: 352332 - RNA, 22 nt, Homo sapiens
uucugaguggcuuucaacacug

SEQ ID NO: 352333 - RNA, 22 nt, Homo sapiens
uucugcuugaucuaguguguug

SEQ ID NO: 352334 - RNA, 22 nt, Homo sapiens
uucuggcucaggucaacacuuc

SEQ ID NO: 352335 - RNA, 22 nt, Homo sapiens
uucuggcuuauaaacgugacuu

SEQ ID NO: 352336 - RNA, 22 nt, Homo sapiens
uucugugcuuguggaugaagug

SEQ ID NO: 352337 - RNA, 22 nt, Homo sapiens
uucugugguuucauuuaccugu

SEQ ID NO: 352338 - RNA, 21 nt, Homo sapiens
uucuucaggcagaaggauuau

SEQ ID NO: 352339 - RNA, 22 nt, Homo sapiens
uucuucaguuacaacaaggggg

SEQ ID NO: 352340 - RNA, 20 nt, Homo sapiens
uucuugaguuaacaaguuac

SEQ ID NO: 352341 - RNA, 22 nt, Homo sapiens
uucuugcugaauugugcccuuc

SEQ ID NO: 352342 - RNA, 22 nt, Homo sapiens
uucuugguuggcaaccaacagu

SEQ ID NO: 352343 - RNA, 22 nt, Homo sapiens
uugaaagacaucaccuacugcu

SEQ ID NO: 352344 - RNA, 22 nt, Homo sapiens
uugaaagucauggcacaggcaa

SEQ ID NO: 352345 - RNA, 22 nt, Homo sapiens
uugaaggaggugcucacucucg

SEQ ID NO: 352346 - RNA, 22 nt, Homo sapiens
uugaagguagaaguucucaauu

SEQ ID NO: 352347 - RNA, 22 nt, Homo sapiens
uugaagguaggaugugcuauca

SEQ ID NO: 352348 - RNA, 22 nt, Homo sapiens
uugaaguagaaagacgaaauuu

SEQ ID NO: 352349 - RNA, 22 nt, Homo sapiens
uugaaguagcauuucaugucua

SEQ ID NO: 352350 - RNA, 22 nt, Homo sapiens
uugaauguaugcuggguuuacu

SEQ ID NO: 352351 - RNA, 22 nt, Homo sapiens
uugaauguguugggaagcccuu

SEQ ID NO: 352352 - RNA, 22 nt, Homo sapiens
uugacugggccagacagagauc

SEQ ID NO: 352353 - RNA, 22 nt, Homo sapiens
uaagugaauuugacagguaaug

SEQ ID NO: 352354 - RNA, 22 nt, Homo sapiens
uaagugaugucuuuuugugugc

SEQ ID NO: 352355 - RNA, 18 nt, Homo sapiens
uaagugcuuuaaacacau

SEQ ID NO: 352356 - RNA, 23 nt, Homo sapiens
uaaguucaucucuaauaggugga

SEQ ID NO: 352357 - RNA, 22 nt, Homo sapiens
uaaguuguugacauuaggggaa

SEQ ID NO: 352358 - RNA, 22 nt, Homo sapiens
uaauacuagugaauagcaggau

SEQ ID NO: 352359 - RNA, 22 nt, Homo sapiens
uaauaugugguugcuugggcac

SEQ ID NO: 352360 - RNA, 22 nt, Homo sapiens
uaauccugucuugaccaucagg

SEQ ID NO: 352361 - RNA, 22 nt, Homo sapiens
uaaucucagcugagcugagauu

SEQ ID NO: 352362 - RNA, 22 nt, Homo sapiens
uaaugugaauagugcuguaaug

SEQ ID NO: 352363 - RNA, 22 nt, Homo sapiens
uaaugugcuucucuaccauagg

SEQ ID NO: 352364 - RNA, 22 nt, Homo sapiens
uacaagcuaaaauggaagauca

SEQ ID NO: 352365 - RNA, 22 nt, Homo sapiens
uacaccauuugauucuuuaagc

SEQ ID NO: 352366 - RNA, 20 nt, Homo sapiens
uacacguaugagcacaugug

SEQ ID NO: 352367 - RNA, 20 nt, Homo sapiens
uacacguguagcauucucua

SEQ ID NO: 352368 - RNA, 22 nt, Homo sapiens
uacagaguauccauuugaguuc

SEQ ID NO: 352369 - RNA, 22 nt, Homo sapiens
uacagccacauaauguaugauu

SEQ ID NO: 352370 - RNA, 22 nt, Homo sapiens
uacaggacuucucagaguuauu

SEQ ID NO: 352371 - RNA, 22 nt, Homo sapiens
uacaggugcuuauguggacaua

SEQ ID NO: 352372 - RNA, 22 nt, Homo sapiens
uacaguacagugacaccauuau

SEQ ID NO: 352373 - RNA, 22 nt, Homo sapiens
uacaguaguaucuucauuuguu

SEQ ID NO: 352374 - RNA, 22 nt, Homo sapiens
uacaguauuaugagugauugaa

SEQ ID NO: 352375 - RNA, 22 nt, Homo sapiens
uacauccauccugcugggcagu

SEQ ID NO: 352376 - RNA, 22 nt, Homo sapiens
uaccacagucauuacacuugua

SEQ ID NO: 352377 - RNA, 23 nt, Homo sapiens
uaccacauuccuucuuuccuguu

SEQ ID NO: 352378 - RNA, 22 nt, Homo sapiens
uaccaucauuauacguagaaau

SEQ ID NO: 352379 - RNA, 22 nt, Homo sapiens
uacccaguaacaaguauuuugg

SEQ ID NO: 352380 - RNA, 22 nt, Homo sapiens
uacccuuauguaaucauuauac

SEQ ID NO: 352381 - RNA, 22 nt, Homo sapiens
uacccuuuaguauaaaaucaga

SEQ ID NO: 352382 - RNA, 22 nt, Homo sapiens
uacuacuuucucuucugggaaa

SEQ ID NO: 352383 - RNA, 22 nt, Homo sapiens
uacuagaaccuuauucagagug

SEQ ID NO: 352384 - RNA, 22 nt, Homo sapiens
uacucacauucuguuucuugcu

SEQ ID NO: 352385 - RNA, 22 nt, Homo sapiens
uacucaguaagugcuggcugcu

SEQ ID NO: 352386 - RNA, 22 nt, Homo sapiens
uacugagagaggaauauugaaa

SEQ ID NO: 352387 - RNA, 20 nt, Homo sapiens
uacugcacuccaaccuaggc

SEQ ID NO: 352388 - RNA, 22 nt, Homo sapiens
uacugcacuccacccuggguga

SEQ ID NO: 352389 - RNA, 22 nt, Homo sapiens
uacugcacucuagccuggguga

SEQ ID NO: 352390 - RNA, 22 nt, Homo sapiens
uacugcacuugaccuccugggc

SEQ ID NO: 352391 - RNA, 20 nt, Homo sapiens
uacugcacuuuccucauggu

SEQ ID NO: 352392 - RNA, 22 nt, Homo sapiens
uacugcaguugcagcuugagga

SEQ ID NO: 352393 - RNA, 22 nt, Homo sapiens
uacugcaucgaaaugcuuuuau

SEQ ID NO: 352394 - RNA, 22 nt, Homo sapiens
uacugcaucuacuuagagccag

SEQ ID NO: 352395 - RNA, 22 nt, Homo sapiens
uacugcuaccuccagcuucugg

SEQ ID NO: 352396 - RNA, 22 nt, Homo sapiens
uacuguguaguuagaccucaga

SEQ ID NO: 352397 - RNA, 22 nt, Homo sapiens
uacuuuguagauuguuuccuuu

SEQ ID NO: 352398 - RNA, 22 nt, Homo sapiens
uagaagcacuaucccuccuagu

SEQ ID NO: 352399 - RNA, 23 nt, Homo sapiens
uagaauguuuuuccauguuucuu

SEQ ID NO: 352400 - RNA, 22 nt, Homo sapiens
uagacacuagauaugugacuga

SEQ ID NO: 352401 - RNA, 22 nt, Homo sapiens
uagaggaaugaauuuggccaga

SEQ ID NO: 352402 - RNA, 22 nt, Homo sapiens
uagagguagagugacuucccca

SEQ ID NO: 352403 - RNA, 22 nt, Homo sapiens
uagagguaggucuucgagucuc

SEQ ID NO: 352404 - RNA, 20 nt, Homo sapiens
uagaugcauuuagauucauu

SEQ ID NO: 352405 - RNA, 22 nt, Homo sapiens
uagauuguaauaugcagaaugg

SEQ ID NO: 352406 - RNA, 22 nt, Homo sapiens
uagcaacauucagcucagguac

SEQ ID NO: 352407 - RNA, 22 nt, Homo sapiens
uagcaaguguuuaagcacuuuu

SEQ ID NO: 352408 - RNA, 20 nt, Homo sapiens
uagcacacauguagaauagu

SEQ ID NO: 352409 - RNA, 17 nt, Homo sapiens
uagcacagugccuggua

SEQ ID NO: 352410 - RNA, 22 nt, Homo sapiens
uagcacaucuucuuggccugca

SEQ ID NO: 352411 - RNA, 22 nt, Homo sapiens
uagcacugucuugcaccugugc

SEQ ID NO: 352412 - RNA, 22 nt, Homo sapiens
uagcagaauaacuugccagccu

SEQ ID NO: 352413 - RNA, 20 nt, Homo sapiens
uagcagcagacagagggagg

SEQ ID NO: 352414 - RNA, 22 nt, Homo sapiens
uagcccagugagguugauuugg

SEQ ID NO: 352415 - RNA, 22 nt, Homo sapiens
uagccucacaaagugcuuaaga

SEQ ID NO: 352416 - RNA, 17 nt, Homo sapiens
uagcucuauuucuagcc

SEQ ID NO: 352417 - RNA, 21 nt, Homo sapiens
uagcugaugauguaggggaug

SEQ ID NO: 352418 - RNA, 21 nt, Homo sapiens
uagcugcacccaggccuccuu

SEQ ID NO: 352419 - RNA, 22 nt, Homo sapiens
uagcugcacuuacaagugagaa

SEQ ID NO: 352420 - RNA, 22 nt, Homo sapiens
uagcugcugcuaggcuaaggau

SEQ ID NO: 352421 - RNA, 22 nt, Homo sapiens
uaggacacagauggagaaaagc

SEQ ID NO: 352422 - RNA, 22 nt, Homo sapiens
uaggacacaggacauauguaga

SEQ ID NO: 352423 - RNA, 22 nt, Homo sapiens
uaggagcacagcagcauguggg

SEQ ID NO: 352424 - RNA, 22 nt, Homo sapiens
uaggcaaaugcaagaguagaac

SEQ ID NO: 352425 - RNA, 22 nt, Homo sapiens
uaggcaaguugcccaaucucuc

SEQ ID NO: 352426 - RNA, 22 nt, Homo sapiens
uaggcacugagaauaugaggau

SEQ ID NO: 352427 - RNA, 22 nt, Homo sapiens
uaggcacuguguuuguaggagu

SEQ ID NO: 352428 - RNA, 22 nt, Homo sapiens
uaggcagccagcuguggauuga

SEQ ID NO: 352429 - RNA, 21 nt, Homo sapiens
uaggccgggugcaggaugcuu

SEQ ID NO: 352430 - RNA, 22 nt, Homo sapiens
uaggcuuuuggacccugucucu

SEQ ID NO: 352431 - RNA, 22 nt, Homo sapiens
uagggaguguccuuucgggaaa

SEQ ID NO: 352432 - RNA, 22 nt, Homo sapiens
uagggaguuuuggggugcagaa

SEQ ID NO: 352433 - RNA, 22 nt, Homo sapiens
uaggugaauguaguaagguguu

SEQ ID NO: 352434 - RNA, 22 nt, Homo sapiens
uaggugauugaagguggaaugu

SEQ ID NO: 352435 - RNA, 22 nt, Homo sapiens
uaggugguuugaaauacucaag

SEQ ID NO: 352436 - RNA, 19 nt, Homo sapiens
uaggugguuuuccccucac

SEQ ID NO: 352437 - RNA, 20 nt, Homo sapiens
uagguuuucacagaauugcc

SEQ ID NO: 352438 - RNA, 22 nt, Homo sapiens
uaguaacacauugaacgaucgc

SEQ ID NO: 352439 - RNA, 23 nt, Homo sapiens
uaguaccauauuguuggcagcac

SEQ ID NO: 352440 - RNA, 22 nt, Homo sapiens
uaguacuggcauguauuuccca

SEQ ID NO: 352441 - RNA, 22 nt, Homo sapiens
uaguagcauaccuaaguauacu

SEQ ID NO: 352442 - RNA, 22 nt, Homo sapiens
uaguaucacauggucuuaauua

SEQ ID NO: 352443 - RNA, 22 nt, Homo sapiens
uagucacacacucaacuuuuca

SEQ ID NO: 352444 - RNA, 22 nt, Homo sapiens
uagucagcaauguucauguucu

SEQ ID NO: 352445 - RNA, 20 nt, Homo sapiens
uaguggcaugcaccuguagc

SEQ ID NO: 352446 - RNA, 22 nt, Homo sapiens
uauaacacccacauauagucuu

SEQ ID NO: 352447 - RNA, 20 nt, Homo sapiens
uauaacaguuuggacccagu

SEQ ID NO: 352448 - RNA, 18 nt, Homo sapiens
auugcacaccagccuggg

SEQ ID NO: 352449 - RNA, 21 nt, Homo sapiens
auugcacuccagccugggcga

SEQ ID NO: 352450 - RNA, 22 nt, Homo sapiens
auugcacuccagccugggugag

SEQ ID NO: 352451 - RNA, 22 nt, Homo sapiens
auugcacuccagcuuaggcgac

SEQ ID NO: 352452 - RNA, 23 nt, Homo sapiens
auugcagaaucacagagguagug

SEQ ID NO: 352453 - RNA, 22 nt, Homo sapiens
auugcagcuugcagggugugua

SEQ ID NO: 352454 - RNA, 22 nt, Homo sapiens
auugcauuuucagguuggucug

SEQ ID NO: 352455 - RNA, 22 nt, Homo sapiens
auugcuauuauuugaccauugu

SEQ ID NO: 352456 - RNA, 22 nt, Homo sapiens
auugcugagacauugcuaaucu

SEQ ID NO: 352457 - RNA, 22 nt, Homo sapiens
auugcuucugauuuuaaaugag

SEQ ID NO: 352458 - RNA, 22 nt, Homo sapiens
auugcuuuuacugggagcuuug

SEQ ID NO: 352459 - RNA, 22 nt, Homo sapiens
auuggcaauagcuuucuuacua

SEQ ID NO: 352460 - RNA, 22 nt, Homo sapiens
auuggccaaugggacgucagca

SEQ ID NO: 352461 - RNA, 22 nt, Homo sapiens
auuguacauacaccggugugua

SEQ ID NO: 352462 - RNA, 22 nt, Homo sapiens
auuguacuccagccuaggcaac

SEQ ID NO: 352463 - RNA, 22 nt, Homo sapiens
auuguacuccagccugggcaaa

SEQ ID NO: 352464 - RNA, 22 nt, Homo sapiens
auuguacuccagccugggcagc

SEQ ID NO: 352465 - RNA, 22 nt, Homo sapiens
auuguacuccagccugggcuaa

SEQ ID NO: 352466 - RNA, 22 nt, Homo sapiens
auuguaguuugcuauggcaaua

SEQ ID NO: 352467 - RNA, 21 nt, Homo sapiens
auuguauguaaaccaaaugag

SEQ ID NO: 352468 - RNA, 22 nt, Homo sapiens
auugucauuuauaacuguguag

SEQ ID NO: 352469 - RNA, 20 nt, Homo sapiens
auuugcauuauggagcaccc

SEQ ID NO: 352470 - RNA, 22 nt, Homo sapiens
auuuggcaguauaaugcuuugg

SEQ ID NO: 352471 - RNA, 22 nt, Homo sapiens
caaaggcuuccacugcauccuu

SEQ ID NO: 352472 - RNA, 22 nt, Homo sapiens
caaaguaauuacgguuuuggcc

SEQ ID NO: 352473 - RNA, 22 nt, Homo sapiens
caaagugcugaaagaggccagg

SEQ ID NO: 352474 - RNA, 22 nt, Homo sapiens
caaagugcuggaauuggccggg

SEQ ID NO: 352475 - RNA, 22 nt, Homo sapiens
caaagugcugggaugggccagg

SEQ ID NO: 352476 - RNA, 22 nt, Homo sapiens
caaauccucaccucaucaugaa

SEQ ID NO: 352477 - RNA, 22 nt, Homo sapiens
caaaugaucugcuggccucagc

SEQ ID NO: 352478 - RNA, 22 nt, Homo sapiens
caacacuguuuauuggauagcc

SEQ ID NO: 352479 - RNA, 22 nt, Homo sapiens
caacaguaaagcauuuuuaagu

SEQ ID NO: 352480 - RNA, 22 nt, Homo sapiens
caacucuguaggauccaggugg

SEQ ID NO: 352481 - RNA, 22 nt, Homo sapiens
caagagaccugagugucauucu

SEQ ID NO: 352482 - RNA, 22 nt, Homo sapiens
caagagagcugaugguuuuaaa

SEQ ID NO: 352483 - RNA, 22 nt, Homo sapiens
caaggugcugagacaggagccc

SEQ ID NO: 352484 - RNA, 22 nt, Homo sapiens
caauacuguguugaauaagagu

SEQ ID NO: 352485 - RNA, 21 nt, Homo sapiens
caaugacacuguagcugugcu

SEQ ID NO: 352486 - RNA, 22 nt, Homo sapiens
cacacuguuuuccauggggguu

SEQ ID NO: 352487 - RNA, 22 nt, Homo sapiens
cacagagugagacccugucucu

SEQ ID NO: 352488 - RNA, 22 nt, Homo sapiens
cacagcuagucaaugguagaca

SEQ ID NO: 352489 - RNA, 22 nt, Homo sapiens
cacagugaacaauauccucugu

SEQ ID NO: 352490 - RNA, 22 nt, Homo sapiens
cacaguugccuaucuccugaag

SEQ ID NO: 352491 - RNA, 22 nt, Homo sapiens
cacauagcuagucaguagugaa

SEQ ID NO: 352492 - RNA, 22 nt, Homo sapiens
cacauagucccugcuaaucuuc

SEQ ID NO: 352493 - RNA, 22 nt, Homo sapiens
cacauugcaggaaaguucauua

SEQ ID NO: 352494 - RNA, 16 nt, Homo sapiens
cacauugcugcauggc

SEQ ID NO: 352495 - RNA, 22 nt, Homo sapiens
caccacauuccauugaucaggc

SEQ ID NO: 352496 - RNA, 22 nt, Homo sapiens
caccauguguucagaaggauug

SEQ ID NO: 352497 - RNA, 19 nt, Homo sapiens
caccgccugcccccugcug

SEQ ID NO: 352498 - RNA, 22 nt, Homo sapiens
cacugcacuccagccuaagagg

SEQ ID NO: 352499 - RNA, 22 nt, Homo sapiens
cacugcacuccagucugacgac

SEQ ID NO: 352500 - RNA, 21 nt, Homo sapiens
cacugcaucacaggacagcau

SEQ ID NO: 352501 - RNA, 21 nt, Homo sapiens
cacuggguucaggcuugugga

SEQ ID NO: 352502 - RNA, 22 nt, Homo sapiens
cacuggucucauggcaugagag

SEQ ID NO: 352503 - RNA, 22 nt, Homo sapiens
cacuguggauggaacuauguga

SEQ ID NO: 352504 - RNA, 18 nt, Homo sapiens
cacuuggcuuugccccuc

SEQ ID NO: 352505 - RNA, 22 nt, Homo sapiens
cagagcacuaaagguaaaaggc

SEQ ID NO: 352506 - RNA, 22 nt, Homo sapiens
cagaugcaugaccugggcuugg

SEQ ID NO: 352507 - RNA, 22 nt, Homo sapiens
cagauggucuuaaggcagccuu

SEQ ID NO: 352508 - RNA, 20 nt, Homo sapiens
cagcaaccugcucucuuccu

SEQ ID NO: 352509 - RNA, 22 nt, Homo sapiens
cagcacauagcaguugcucagu

SEQ ID NO: 352510 - RNA, 23 nt, Homo sapiens
cagcuggugauuuuaaguugaag

SEQ ID NO: 352511 - RNA, 22 nt, Homo sapiens
cagcuggugcugcaccaguggg

SEQ ID NO: 352512 - RNA, 22 nt, Homo sapiens
ucacauuguacaaacagguaag

SEQ ID NO: 352513 - RNA, 20 nt, Homo sapiens
ucacccugacaucugcccag

SEQ ID NO: 352514 - RNA, 18 nt, Homo sapiens
ucaccuugaugcuggguc

SEQ ID NO: 352515 - RNA, 22 nt, Homo sapiens
ucacuagggagaaacugaggcu

SEQ ID NO: 352516 - RNA, 21 nt, Homo sapiens
ucacuaguaaaaggugaacug

SEQ ID NO: 352517 - RNA, 22 nt, Homo sapiens
ucacuggagauagcaaucuggu

SEQ ID NO: 352518 - RNA, 22 nt, Homo sapiens
ucacugggagcauuugagccuu

SEQ ID NO: 352519 - RNA, 22 nt, Homo sapiens
ucacugugcacauaugauaggu

SEQ ID NO: 352520 - RNA, 22 nt, Homo sapiens
ucacugugcaugaaggaugcug

SEQ ID NO: 352521 - RNA, 22 nt, Homo sapiens
ucacugugguuugggaaagugc

SEQ ID NO: 352522 - RNA, 22 nt, Homo sapiens
ucacugugguuuugaugugcau

SEQ ID NO: 352523 - RNA, 22 nt, Homo sapiens
ucacuugguggcaaaguuuaug

SEQ ID NO: 352524 - RNA, 22 nt, Homo sapiens
ucagacacuguggccuuuggac

SEQ ID NO: 352525 - RNA, 22 nt, Homo sapiens
ucagagucuagaucacucacug

SEQ ID NO: 352526 - RNA, 22 nt, Homo sapiens
ucagagugcagggaguagcagc

SEQ ID NO: 352527 - RNA, 22 nt, Homo sapiens
ucagaguggagucugcagccuu

SEQ ID NO: 352528 - RNA, 22 nt, Homo sapiens
ucagauacuggugacaugaaug

SEQ ID NO: 352529 - RNA, 22 nt, Homo sapiens
ucagaucauauucuucgcugcu

SEQ ID NO: 352530 - RNA, 22 nt, Homo sapiens
ucagaugauucuguuguugugu

SEQ ID NO: 352531 - RNA, 22 nt, Homo sapiens
ucagauguuucuuuaacgcaug

SEQ ID NO: 352532 - RNA, 22 nt, Homo sapiens
ucagauguuugagaaguauacu

SEQ ID NO: 352533 - RNA, 19 nt, Homo sapiens
ucagcaguaaucaacuuca

SEQ ID NO: 352534 - RNA, 22 nt, Homo sapiens
ucagcagucacuccuaugacaa

SEQ ID NO: 352535 - RNA, 22 nt, Homo sapiens
ucagcagugagagaccucaccc

SEQ ID NO: 352536 - RNA, 21 nt, Homo sapiens
ucaggaccucuaguuagccag

SEQ ID NO: 352537 - RNA, 22 nt, Homo sapiens
ucaggcaugcagcaaugcagug

SEQ ID NO: 352538 - RNA, 22 nt, Homo sapiens
ucagguagcauuuuggaaacag

SEQ ID NO: 352539 - RNA, 22 nt, Homo sapiens
ucagguaguuugugggagauga

SEQ ID NO: 352540 - RNA, 22 nt, Homo sapiens
ucaggugcaguggcucaugcuu

SEQ ID NO: 352541 - RNA, 22 nt, Homo sapiens
ucaggugcaguggcucugaccu

SEQ ID NO: 352542 - RNA, 23 nt, Homo sapiens
ucaguacuccacuuucaauagug

SEQ ID NO: 352543 - RNA, 22 nt, Homo sapiens
ucagugaauauauaacagcgau

SEQ ID NO: 352544 - RNA, 22 nt, Homo sapiens
ucagugcaggaaucucuagcca

SEQ ID NO: 352545 - RNA, 22 nt, Homo sapiens
ucagugccauugccauaugagu

SEQ ID NO: 352546 - RNA, 22 nt, Homo sapiens
ucagugcuuggcacagagagcu

SEQ ID NO: 352547 - RNA, 22 nt, Homo sapiens
ucaguggacuuagucuuucccc

SEQ ID NO: 352548 - RNA, 22 nt, Homo sapiens
ucaguguugauggcugcugacu

SEQ ID NO: 352549 - RNA, 21 nt, Homo sapiens
ucauaagcucaacaucuguag

SEQ ID NO: 352550 - RNA, 22 nt, Homo sapiens
ucauacuguugugaaacaaaac

SEQ ID NO: 352551 - RNA, 22 nt, Homo sapiens
ucauagaucaaguaauaagaca

SEQ ID NO: 352552 - RNA, 18 nt, Homo sapiens
ucauagaucaugacagug

SEQ ID NO: 352553 - RNA, 22 nt, Homo sapiens
ucauauguaugugcaauuuugu

SEQ ID NO: 352554 - RNA, 22 nt, Homo sapiens
ucaucaguggggaugugguuga

SEQ ID NO: 352555 - RNA, 22 nt, Homo sapiens
ucauccauacaguuagcaaagg

SEQ ID NO: 352556 - RNA, 22 nt, Homo sapiens
ucaugacacuggcaggagcuaa

SEQ ID NO: 352557 - RNA, 22 nt, Homo sapiens
ucaugagacacacuggaaagga

SEQ ID NO: 352558 - RNA, 23 nt, Homo sapiens
ucaugaggccauucaaauccauu

SEQ ID NO: 352559 - RNA, 23 nt, Homo sapiens
ucaugguagcaccaacaauaacu

SEQ ID NO: 352560 - RNA, 22 nt, Homo sapiens
ucauugcaaucucugccucccg

SEQ ID NO: 352561 - RNA, 21 nt, Homo sapiens
ucauugguuggcugcccugua

SEQ ID NO: 352562 - RNA, 22 nt, Homo sapiens
uccaauguaaucaucauugaau

SEQ ID NO: 352563 - RNA, 22 nt, Homo sapiens
uccacagugguugaacuaguuu

SEQ ID NO: 352564 - RNA, 22 nt, Homo sapiens
uccacguggucuaucuguccuu

SEQ ID NO: 352565 - RNA, 20 nt, Homo sapiens
uccacugagcgucacggcag

SEQ ID NO: 352566 - RNA, 22 nt, Homo sapiens
uccagguuuggcuuuauaacuu

SEQ ID NO: 352567 - RNA, 22 nt, Homo sapiens
uccagguuuugugaguuuaaau

SEQ ID NO: 352568 - RNA, 22 nt, Homo sapiens
uccaguacaggucucucauuuc

SEQ ID NO: 352569 - RNA, 22 nt, Homo sapiens
uccaguggacagacauaccaug

SEQ ID NO: 352570 - RNA, 22 nt, Homo sapiens
uccaguguuucuuccacuauuu

SEQ ID NO: 352571 - RNA, 20 nt, Homo sapiens
uccaguuuuggagacauucu

SEQ ID NO: 352572 - RNA, 22 nt, Homo sapiens
uccaugugaaaucuaugaggac

SEQ ID NO: 352573 - RNA, 22 nt, Homo sapiens
uccauuuguagguagugagaca

SEQ ID NO: 352574 - RNA, 19 nt, Homo sapiens
ucccaagaugcucauacau

SEQ ID NO: 352575 - RNA, 19 nt, Homo sapiens
ucccaauguuuccaggcag

SEQ ID NO: 352576 - RNA, 16 nt, Homo sapiens
ucccaccauugcuugu

SEQ ID NO: 352577 - RNA, 22 nt, Homo sapiens
ucccagaaacgcauauguucau

SEQ ID NO: 352578 - RNA, 22 nt, Homo sapiens
ucccaguauucauuuacagaag

SEQ ID NO: 352579 - RNA, 22 nt, Homo sapiens
ucccagugcuaugcaaaagccu

SEQ ID NO: 352580 - RNA, 22 nt, Homo sapiens
ucccaguggucuugaaacaggg

SEQ ID NO: 352581 - RNA, 19 nt, Homo sapiens
uccccgggucuagugcagc

SEQ ID NO: 352582 - RNA, 22 nt, Homo sapiens
ucccugaaagcugagauuggaa

SEQ ID NO: 352583 - RNA, 22 nt, Homo sapiens
ucccugaaucucagguucugua

SEQ ID NO: 352584 - RNA, 22 nt, Homo sapiens
ucccugaguaucuaauguguuu

SEQ ID NO: 352585 - RNA, 22 nt, Homo sapiens
ucccugagugauugaaaauaaa

SEQ ID NO: 352586 - RNA, 22 nt, Homo sapiens
ucccuggagcaagagaagaagg

SEQ ID NO: 352587 - RNA, 22 nt, Homo sapiens
ucccuguuguuucauaauuuua

SEQ ID NO: 352588 - RNA, 22 nt, Homo sapiens
uccgaguguuagagagcugugu

SEQ ID NO: 352589 - RNA, 22 nt, Homo sapiens
uccucauggagaaccucugcua

SEQ ID NO: 352590 - RNA, 22 nt, Homo sapiens
uccugagacucacaggcucccc

SEQ ID NO: 352591 - RNA, 21 nt, Homo sapiens
uccugagagaggaguaacucu

SEQ ID NO: 352592 - RNA, 20 nt, Homo sapiens
uccugagauucccaguucuc

SEQ ID NO: 352593 - RNA, 22 nt, Homo sapiens
uccuugaaacaggaagaauuca

SEQ ID NO: 352594 - RNA, 22 nt, Homo sapiens
uccuuggucaaaaagaaagugu

SEQ ID NO: 352595 - RNA, 22 nt, Homo sapiens
uccuuugguggagucuuuaggg

SEQ ID NO: 352596 - RNA, 22 nt, Homo sapiens
uccuuuguuacaguuggcucug

SEQ ID NO: 352597 - RNA, 22 nt, Homo sapiens
ucgcugcgaccuccaccucccg

SEQ ID NO: 352598 - RNA, 22 nt, Homo sapiens
ucgcugggaaccagagguaaag

SEQ ID NO: 352599 - RNA, 22 nt, Homo sapiens
ucgcugggaagacugaaguguc

SEQ ID NO: 352600 - RNA, 22 nt, Homo sapiens
gugugauggcgcacacagggug

SEQ ID NO: 352601 - RNA, 22 nt, Homo sapiens
guuauuguccauuuauuuagca

SEQ ID NO: 352602 - RNA, 20 nt, Homo sapiens
guucauguaauuaguucagg

SEQ ID NO: 352603 - RNA, 22 nt, Homo sapiens
guucucacuggugcugguaagu

SEQ ID NO: 352604 - RNA, 18 nt, Homo sapiens
guugagcuuuuccuuuag

SEQ ID NO: 352605 - RNA, 22 nt, Homo sapiens
guuggcuguuucccccaaguga

SEQ ID NO: 352606 - RNA, 22 nt, Homo sapiens
guuuacagucgacuugggaaua

SEQ ID NO: 352607 - RNA, 22 nt, Homo sapiens
guuuggauauuaggcaagagua

SEQ ID NO: 352608 - RNA, 22 nt, Homo sapiens
uaaagcuagaauuguuccagca

SEQ ID NO: 352609 - RNA, 20 nt, Homo sapiens
uaaagcugcucagggggcuc

SEQ ID NO: 352610 - RNA, 21 nt, Homo sapiens
uaaaggcuccaauuauacccc

SEQ ID NO: 352611 - RNA, 22 nt, Homo sapiens
uaaagugaggauggcaguaggu

SEQ ID NO: 352612 - RNA, 20 nt, Homo sapiens
uaaaugccucaugcuuuauu

SEQ ID NO: 352613 - RNA, 19 nt, Homo sapiens
uaacacaguuguguuugag

SEQ ID NO: 352614 - RNA, 22 nt, Homo sapiens
uaacaguauaugugguaucuau

SEQ ID NO: 352615 - RNA, 22 nt, Homo sapiens
uaacagucaagguuugaccagg

SEQ ID NO: 352616 - RNA, 22 nt, Homo sapiens
uaacauagucauauacuugcuu

SEQ ID NO: 352617 - RNA, 23 nt, Homo sapiens
uaacauugcaugauuaccugcau

SEQ ID NO: 352618 - RNA, 22 nt, Homo sapiens
uaacccugaggggcuuggggac

SEQ ID NO: 352619 - RNA, 22 nt, Homo sapiens
uaacgcuaguaucaccaggcua

SEQ ID NO: 352620 - RNA, 22 nt, Homo sapiens
uaacugcaaccucugccugcug

SEQ ID NO: 352621 - RNA, 22 nt, Homo sapiens
uaacuucaucauaagucaagaa

SEQ ID NO: 352622 - RNA, 22 nt, Homo sapiens
uaagacacauguguucccaggc

SEQ ID NO: 352623 - RNA, 23 nt, Homo sapiens
uaagacacuaacuuuaugcuuug

SEQ ID NO: 352624 - RNA, 19 nt, Homo sapiens
uaagaugaagcugucuggg

SEQ ID NO: 352625 - RNA, 22 nt, Homo sapiens
uaagccaccgugccuggccuaa

SEQ ID NO: 352626 - RNA, 22 nt, Homo sapiens
uaagcucauuccagccaugucc

SEQ ID NO: 352627 - RNA, 22 nt, Homo sapiens
uaaggcacccuucugaguagag

SEQ ID NO: 352628 - RNA, 22 nt, Homo sapiens
uaaggcuugaucuuggugagau

SEQ ID NO: 352629 - RNA, 22 nt, Homo sapiens
uaaggcuugcuucagucuugaa

SEQ ID NO: 352630 - RNA, 22 nt, Homo sapiens
uaagggcaugcugcaugagagu

SEQ ID NO: 352631 - RNA, 22 nt, Homo sapiens
uaaguauuaugugcugcauuuu

SEQ ID NO: 352632 - RNA, 22 nt, Homo sapiens
uaaguucauucaugaaacuuag

SEQ ID NO: 352633 - RNA, 22 nt, Homo sapiens
uaauacauucaaggugguaguu

SEQ ID NO: 352634 - RNA, 22 nt, Homo sapiens
uaauacuguaauggugguuccg

SEQ ID NO: 352635 - RNA, 22 nt, Homo sapiens
uaauccuagcacuuuggaagac

SEQ ID NO: 352636 - RNA, 22 nt, Homo sapiens
uaauugaaugcagacaccaggg

SEQ ID NO: 352637 - RNA, 22 nt, Homo sapiens
uaauugcaguucuguguuauau

SEQ ID NO: 352638 - RNA, 22 nt, Homo sapiens
uaauuggaucucaaaaaagugu

SEQ ID NO: 352639 - RNA, 22 nt, Homo sapiens
uacaagcacaggcagcaggcug

SEQ ID NO: 352640 - RNA, 21 nt, Homo sapiens
uacaagcuguagcacaugcca

SEQ ID NO: 352641 - RNA, 22 nt, Homo sapiens
uacaaguaauaagggaagaauu

SEQ ID NO: 352642 - RNA, 18 nt, Homo sapiens
uacagaacuggaguagaa

SEQ ID NO: 352643 - RNA, 22 nt, Homo sapiens
uacagaauugcagguguggcag

SEQ ID NO: 352644 - RNA, 22 nt, Homo sapiens
uacagaguagaagauuugcaga

SEQ ID NO: 352645 - RNA, 22 nt, Homo sapiens
uacagcuaugugcaugcaugcu

SEQ ID NO: 352646 - RNA, 23 nt, Homo sapiens
uacagcugcagaaucaggcuaag

SEQ ID NO: 352647 - RNA, 19 nt, Homo sapiens
uacaggacugagcugaggu

SEQ ID NO: 352648 - RNA, 22 nt, Homo sapiens
uacaggauagacaauuuauuaa

SEQ ID NO: 352649 - RNA, 22 nt, Homo sapiens
uacaggcagguguucccugguu

SEQ ID NO: 352650 - RNA, 22 nt, Homo sapiens
uacaguagagaucagcaaacua

SEQ ID NO: 352651 - RNA, 22 nt, Homo sapiens
uacaguaggauuuucagggucu

SEQ ID NO: 352652 - RNA, 22 nt, Homo sapiens
uacagucuggaggccuguguug

SEQ ID NO: 352653 - RNA, 22 nt, Homo sapiens
uacagugggcacuggcgcccug

SEQ ID NO: 352654 - RNA, 22 nt, Homo sapiens
uaccaaguauuuucacaugaac

SEQ ID NO: 352655 - RNA, 22 nt, Homo sapiens
uaccacaggcuggguaaucuau

SEQ ID NO: 352656 - RNA, 22 nt, Homo sapiens
uaccacauuguagagggcauuc

SEQ ID NO: 352657 - RNA, 22 nt, Homo sapiens
uaccaguaaugguucuagagga

SEQ ID NO: 352658 - RNA, 22 nt, Homo sapiens
uacuacuuucugacaucuuuaa

SEQ ID NO: 352659 - RNA, 22 nt, Homo sapiens
uacuagaggcgggguuucgcca

SEQ ID NO: 352660 - RNA, 22 nt, Homo sapiens
uacucaguagucuguugcuguc

SEQ ID NO: 352661 - RNA, 22 nt, Homo sapiens
uacucuuuagcuccuuaaggaa

SEQ ID NO: 352662 - RNA, 22 nt, Homo sapiens
uacugcacuccagccugggaga

SEQ ID NO: 352663 - RNA, 22 nt, Homo sapiens
uacugcacuccagccuggguga

SEQ ID NO: 352664 - RNA, 22 nt, Homo sapiens
uacugcacuccaggcucaccug

SEQ ID NO: 352665 - RNA, 20 nt, Homo sapiens
uacugcacuccauccugggu

SEQ ID NO: 352666 - RNA, 22 nt, Homo sapiens
uacugcacuggaggccucagau

SEQ ID NO: 352667 - RNA, 22 nt, Homo sapiens
uacuuuguagagugugagaauu

SEQ ID NO: 352668 - RNA, 22 nt, Homo sapiens
uacuuuguuauagcagcaggaa

SEQ ID NO: 352669 - RNA, 22 nt, Homo sapiens
uagaaagcaugaccuucagaua

SEQ ID NO: 352670 - RNA, 22 nt, Homo sapiens
uagaauguauaauauuuuacuu

SEQ ID NO: 352671 - RNA, 22 nt, Homo sapiens
uagaaugucagcuucuugaggg

SEQ ID NO: 352672 - RNA, 22 nt, Homo sapiens
uagacacugcauauuuuuuuaa

SEQ ID NO: 352673 - RNA, 22 nt, Homo sapiens
uagaccauucuauuuccuaugc

SEQ ID NO: 352674 - RNA, 20 nt, Homo sapiens
uagagagauauggggguucc

SEQ ID NO: 352675 - RNA, 22 nt, Homo sapiens
uagagaucuuauauuuuaugac

SEQ ID NO: 352676 - RNA, 22 nt, Homo sapiens
uagaggaaggauuggaaacgca

SEQ ID NO: 352677 - RNA, 22 nt, Homo sapiens
uagagguagccuacuacacacc

SEQ ID NO: 352678 - RNA, 22 nt, Homo sapiens
uagagguauguauaguauucuu

SEQ ID NO: 352679 - RNA, 22 nt, Homo sapiens
uagaucacucaggcaauaaaag

SEQ ID NO: 352680 - RNA, 22 nt, Homo sapiens
uagaucauauucagugcuuacu

SEQ ID NO: 352681 - RNA, 22 nt, Homo sapiens
uagauuaucuguaugugcucuu

SEQ ID NO: 352682 - RNA, 21 nt, Homo sapiens
uguuaacaugcagauuacugg

SEQ ID NO: 352683 - RNA, 22 nt, Homo sapiens
uguuacagcagcacaaaaugga

SEQ ID NO: 352684 - RNA, 22 nt, Homo sapiens
uguuauguuuuagagguuucaa

SEQ ID NO: 352685 - RNA, 22 nt, Homo sapiens
uguucuugaguugggaguacaa

SEQ ID NO: 352686 - RNA, 22 nt, Homo sapiens
uguugcaccugccuugcuuuag

SEQ ID NO: 352687 - RNA, 22 nt, Homo sapiens
uguuuguuugauaugggauaaa

SEQ ID NO: 352688 - RNA, 22 nt, Homo sapiens
uguuuuggaggccagaagucca

SEQ ID NO: 352689 - RNA, 22 nt, Homo sapiens
uuaaagccauaccugagagagu

SEQ ID NO: 352690 - RNA, 22 nt, Homo sapiens
uuaaagugaucauaaggauagu

SEQ ID NO: 352691 - RNA, 22 nt, Homo sapiens
uuaaauacagcaugguguuucu

SEQ ID NO: 352692 - RNA, 20 nt, Homo sapiens
uuaaaucuagugcagacuca

SEQ ID NO: 352693 - RNA, 22 nt, Homo sapiens
uuaaaugcucacauaaagguag

SEQ ID NO: 352694 - RNA, 19 nt, Homo sapiens
uucugguguuuuaagccaa

SEQ ID NO: 352695 - RNA, 22 nt, Homo sapiens
uucugguuaauacuugcaaaaa

SEQ ID NO: 352696 - RNA, 22 nt, Homo sapiens
uucuuagucaaguuguauuuca

SEQ ID NO: 352697 - RNA, 22 nt, Homo sapiens
uucuucaggcauucccagaagc

SEQ ID NO: 352698 - RNA, 22 nt, Homo sapiens
uucuugaggcaugccgcuggga

SEQ ID NO: 352699 - RNA, 22 nt, Homo sapiens
uucuuuaguucacuugcuccag

SEQ ID NO: 352700 - RNA, 19 nt, Homo sapiens
uucuuuguugugggggcug

SEQ ID NO: 352701 - RNA, 22 nt, Homo sapiens
uugaaagucauuucuucuaagu

SEQ ID NO: 352702 - RNA, 22 nt, Homo sapiens
uugaaauguguaagcuccgaaa

SEQ ID NO: 352703 - RNA, 22 nt, Homo sapiens
uugaagacuauaugauucuuca

SEQ ID NO: 352704 - RNA, 22 nt, Homo sapiens
uugaagugaagaacaauaucac

SEQ ID NO: 352705 - RNA, 22 nt, Homo sapiens
uugaaugaaaugaugucauuug

SEQ ID NO: 352706 - RNA, 22 nt, Homo sapiens
uugaaugaaauuggugugggga

SEQ ID NO: 352707 - RNA, 22 nt, Homo sapiens
uugacaaggagccauugcaucu

SEQ ID NO: 352708 - RNA, 22 nt, Homo sapiens
uugacagagaaaagugugacuu

SEQ ID NO: 352709 - RNA, 22 nt, Homo sapiens
uugacaggaugcucagggccca

SEQ ID NO: 352710 - RNA, 20 nt, Homo sapiens
uugacaguggguuguuaaag

SEQ ID NO: 352711 - RNA, 22 nt, Homo sapiens
uugacaguugggcagggaaguu

SEQ ID NO: 352712 - RNA, 22 nt, Homo sapiens
uugacauugcuguaguguccag

SEQ ID NO: 352713 - RNA, 23 nt, Homo sapiens
uugacuguggguacaaugugaua

SEQ ID NO: 352714 - RNA, 21 nt, Homo sapiens
uugagaagaauuagcucuucc

SEQ ID NO: 352715 - RNA, 22 nt, Homo sapiens
uugagaaucuuucgaauguucu

SEQ ID NO: 352716 - RNA, 22 nt, Homo sapiens
uugagaaucuuugcuaaaggaa

SEQ ID NO: 352717 - RNA, 22 nt, Homo sapiens
uugagacugaacauuuguguac

SEQ ID NO: 352718 - RNA, 22 nt, Homo sapiens
uugagagaaaaggccaugccuu

SEQ ID NO: 352719 - RNA, 22 nt, Homo sapiens
uugagauccuuuugcucaucag

SEQ ID NO: 352720 - RNA, 22 nt, Homo sapiens
uugagaucugugcuuuugcguu

SEQ ID NO: 352721 - RNA, 22 nt, Homo sapiens
uugagaucuugauauguuugaa

SEQ ID NO: 352722 - RNA, 22 nt, Homo sapiens
uugagauggagccucacucugc

SEQ ID NO: 352723 - RNA, 22 nt, Homo sapiens
uugagauggagucucacuccuu

SEQ ID NO: 352724 - RNA, 22 nt, Homo sapiens
uugagauggagucucgcacugu

SEQ ID NO: 352725 - RNA, 22 nt, Homo sapiens
uugagauggagucucgcugugu

SEQ ID NO: 352726 - RNA, 22 nt, Homo sapiens
uugagauggagucuugcacugu

SEQ ID NO: 352727 - RNA, 22 nt, Homo sapiens
uugagauggagucuugcgcugu

SEQ ID NO: 352728 - RNA, 22 nt, Homo sapiens
uugagauggagucuuguucucu

SEQ ID NO: 352729 - RNA, 22 nt, Homo sapiens
uugagauggaguuucacucuug

SEQ ID NO: 352730 - RNA, 22 nt, Homo sapiens
uugagauguaguuucacuccug

SEQ ID NO: 352731 - RNA, 22 nt, Homo sapiens
uugagauuauuguguuccuuua

SEQ ID NO: 352732 - RNA, 22 nt, Homo sapiens
uugagcaacauagugagacugu

SEQ ID NO: 352733 - RNA, 22 nt, Homo sapiens
uugagcauugguauagguuuua

SEQ ID NO: 352734 - RNA, 22 nt, Homo sapiens
uugaggaaugugauuucaaaua

SEQ ID NO: 352735 - RNA, 22 nt, Homo sapiens
uugaggaucauuguuuucggag

SEQ ID NO: 352736 - RNA, 22 nt, Homo sapiens
uugagggaaacauucacaucau

SEQ ID NO: 352737 - RNA, 22 nt, Homo sapiens
uugagguauuuugucaacugua

SEQ ID NO: 352738 - RNA, 22 nt, Homo sapiens
uugaggucagagguucgagacc

SEQ ID NO: 352739 - RNA, 22 nt, Homo sapiens
uugaggugggaggaucacuuga

SEQ ID NO: 352740 - RNA, 20 nt, Homo sapiens
uugaggugugaggggcagag

SEQ ID NO: 352741 - RNA, 22 nt, Homo sapiens
uugaguaguaaggauauuaucu

SEQ ID NO: 352742 - RNA, 22 nt, Homo sapiens
uugauaguaccauugggaaauu

SEQ ID NO: 352743 - RNA, 22 nt, Homo sapiens
uugauaugguauaagauuucau

SEQ ID NO: 352744 - RNA, 22 nt, Homo sapiens
uugaucacuguacuaugacuau

SEQ ID NO: 352745 - RNA, 22 nt, Homo sapiens
uugaucuguguuagaagcuaag

SEQ ID NO: 352746 - RNA, 20 nt, Homo sapiens
uugauucccucuaaacucgc

SEQ ID NO: 352747 - RNA, 22 nt, Homo sapiens
uugcaaaucucuuguguuuggu

SEQ ID NO: 352748 - RNA, 21 nt, Homo sapiens
uugcaaaugcugcugccugau

SEQ ID NO: 352749 - RNA, 22 nt, Homo sapiens
uugcacauggcuggggaggccu

SEQ ID NO: 352750 - RNA, 22 nt, Homo sapiens
uugcacauguugaaccagcaaa

SEQ ID NO: 352751 - RNA, 22 nt, Homo sapiens
uugcacauugauuuuguauccu

SEQ ID NO: 352752 - RNA, 22 nt, Homo sapiens
uugcacauugauuuuguaucuu

SEQ ID NO: 352753 - RNA, 22 nt, Homo sapiens
uugcacucuagccugggugaca

SEQ ID NO: 352754 - RNA, 22 nt, Homo sapiens
uugcacucugaagaccuacugu

SEQ ID NO: 352755 - RNA, 22 nt, Homo sapiens
uugcacugagauuuugcuuaca

SEQ ID NO: 352756 - RNA, 22 nt, Homo sapiens
uugcagagccccugcaaggguc

SEQ ID NO: 352757 - RNA, 22 nt, Homo sapiens
uugcagcaacauggaugaaacu

SEQ ID NO: 352758 - RNA, 22 nt, Homo sapiens
uugcagcauucugguuccuggu

SEQ ID NO: 352759 - RNA, 18 nt, Homo sapiens
uugcaucauuuuguuguu

SEQ ID NO: 352760 - RNA, 22 nt, Homo sapiens
uugcauuagugugguacauuug

SEQ ID NO: 352761 - RNA, 23 nt, Homo sapiens
uugcauugcccuccauaguacuc

SEQ ID NO: 352762 - RNA, 22 nt, Homo sapiens
uugccaacauggugaacuccca

SEQ ID NO: 352763 - RNA, 22 nt, Homo sapiens
uugccauggaguagaauugaag

SEQ ID NO: 352764 - RNA, 22 nt, Homo sapiens
uugccuaggcuggagugcagua

SEQ ID NO: 352765 - RNA, 22 nt, Homo sapiens
uugccuaggcuggaguucagug

SEQ ID NO: 352766 - RNA, 22 nt, Homo sapiens
uugcucaccugagaagaauaga

SEQ ID NO: 352767 - RNA, 22 nt, Homo sapiens
uugcuccccaggaaaggaagca

SEQ ID NO: 352768 - RNA, 22 nt, Homo sapiens
uugcugagucuuucuagguugc

SEQ ID NO: 352769 - RNA, 20 nt, Homo sapiens
uugcugguguuagaggaggc

SEQ ID NO: 352770 - RNA, 22 nt, Homo sapiens
uugcuucuuucgucuggcccca

SEQ ID NO: 352771 - RNA, 22 nt, Homo sapiens
uuggaaaugguaaaggguuaau

SEQ ID NO: 352772 - RNA, 22 nt, Homo sapiens
uuggaaggcuccuaaugaaugg

SEQ ID NO: 352773 - RNA, 22 nt, Homo sapiens
uuggaauuaaccuggugcugga

SEQ ID NO: 352774 - RNA, 22 nt, Homo sapiens
uuggaauuagacaagugguggu

SEQ ID NO: 352775 - RNA, 22 nt, Homo sapiens
aaaccacagugugcugcugggg

SEQ ID NO: 352776 - RNA, 22 nt, Homo sapiens
agacuagagggaaaugaguugg

SEQ ID NO: 352777 - RNA, 22 nt, Homo sapiens
agagaucaauaugaaggaaaug

SEQ ID NO: 352778 - RNA, 22 nt, Homo sapiens
agagcauugaguuaaugguuca

SEQ ID NO: 352779 - RNA, 22 nt, Homo sapiens
agagccacacucuccuaacuca

SEQ ID NO: 352780 - RNA, 20 nt, Homo sapiens
agagguuuugauagguucug

SEQ ID NO: 352781 - RNA, 22 nt, Homo sapiens
agagguuuugcacugguucuuu

SEQ ID NO: 352782 - RNA, 22 nt, Homo sapiens
agagguuuuggggcugagagcu

SEQ ID NO: 352783 - RNA, 22 nt, Homo sapiens
agaguacugacguuugcaaauu

SEQ ID NO: 352784 - RNA, 22 nt, Homo sapiens
agaguauagcaacuuaguaaaa

SEQ ID NO: 352785 - RNA, 23 nt, Homo sapiens
agagugcaauggugccaucucgg

SEQ ID NO: 352786 - RNA, 20 nt, Homo sapiens
agagugcuggacugaggagc

SEQ ID NO: 352787 - RNA, 22 nt, Homo sapiens
agagugcuuuauuagauguagc

SEQ ID NO: 352788 - RNA, 22 nt, Homo sapiens
agauauguuuaguuucaaaaug

SEQ ID NO: 352789 - RNA, 22 nt, Homo sapiens
agaugauguuuacugagcauca

SEQ ID NO: 352790 - RNA, 22 nt, Homo sapiens
agaugccucauguucuagguuc

SEQ ID NO: 352791 - RNA, 18 nt, Homo sapiens
agaugguguugcuucugu

SEQ ID NO: 352792 - RNA, 22 nt, Homo sapiens
agcaacauugagacugcaguug

SEQ ID NO: 352793 - RNA, 22 nt, Homo sapiens
agcaaccagaggagaugaggcu

SEQ ID NO: 352794 - RNA, 22 nt, Homo sapiens
agcaagauccagucgcacagga

SEQ ID NO: 352795 - RNA, 22 nt, Homo sapiens
agcacagugaaugguuuacuca

SEQ ID NO: 352796 - RNA, 23 nt, Homo sapiens
agcaccaccccaggucacaagug

SEQ ID NO: 352797 - RNA, 22 nt, Homo sapiens
agcaccaugggcugaguaagug

SEQ ID NO: 352798 - RNA, 22 nt, Homo sapiens
agcaccauugcacuccagccug

SEQ ID NO: 352799 - RNA, 22 nt, Homo sapiens
agcaccauuucucuaaagcacu

SEQ ID NO: 352800 - RNA, 22 nt, Homo sapiens
agcagcauuaguggaaucuugu

SEQ ID NO: 352801 - RNA, 22 nt, Homo sapiens
agcagcauuaugauauaucuua

SEQ ID NO: 352802 - RNA, 22 nt, Homo sapiens
agcagcuuugcauggccugugg

SEQ ID NO: 352803 - RNA, 22 nt, Homo sapiens
agcaggacaauaugggaucagg

SEQ ID NO: 352804 - RNA, 22 nt, Homo sapiens
agcagguauucgggucaugggg

SEQ ID NO: 352805 - RNA, 22 nt, Homo sapiens
agcagugucauuuucuggugag

SEQ ID NO: 352806 - RNA, 22 nt, Homo sapiens
agcagugugagaauggacuaau

SEQ ID NO: 352807 - RNA, 22 nt, Homo sapiens
agcaucaugcaguugcuauuca

SEQ ID NO: 352808 - RNA, 19 nt, Homo sapiens
agcaucauuauuguuuugg

SEQ ID NO: 352809 - RNA, 20 nt, Homo sapiens
agcaucauugcaauuuguca

SEQ ID NO: 352810 - RNA, 20 nt, Homo sapiens
agcaucguuguguuauagcc

SEQ ID NO: 352811 - RNA, 22 nt, Homo sapiens
agcaugacauauuguagagaaa

SEQ ID NO: 352812 - RNA, 20 nt, Homo sapiens
agcauugguuagaacaguag

SEQ ID NO: 352813 - RNA, 22 nt, Homo sapiens
agcuaaaucucauguugaauug

SEQ ID NO: 352814 - RNA, 22 nt, Homo sapiens
agcuaguauuuuguuaaggauu

SEQ ID NO: 352815 - RNA, 22 nt, Homo sapiens
agcucauugcaaccuccgccuc

SEQ ID NO: 352816 - RNA, 22 nt, Homo sapiens
agcucauugcuguccuggagga

SEQ ID NO: 352817 - RNA, 22 nt, Homo sapiens
agcuccaugauaguaugucugu

SEQ ID NO: 352818 - RNA, 22 nt, Homo sapiens
agcuccuacuguuacaucauug

SEQ ID NO: 352819 - RNA, 22 nt, Homo sapiens
agcugcacaaauggaugugagg

SEQ ID NO: 352820 - RNA, 22 nt, Homo sapiens
agcugcacgugguaaauguaaa

SEQ ID NO: 352821 - RNA, 22 nt, Homo sapiens
agcugcacugguauaggagaaa

SEQ ID NO: 352822 - RNA, 22 nt, Homo sapiens
agcuggauuguuuaccuggggc

SEQ ID NO: 352823 - RNA, 22 nt, Homo sapiens
agcuggcuguagcugcaagucu

SEQ ID NO: 352824 - RNA, 22 nt, Homo sapiens
agcuggucuuggggaagaguag

SEQ ID NO: 352825 - RNA, 20 nt, Homo sapiens
agcugguuuuaugaaucuuu

SEQ ID NO: 352826 - RNA, 22 nt, Homo sapiens
agcuguaguuugguggauguaa

SEQ ID NO: 352827 - RNA, 22 nt, Homo sapiens
agcuucauuccaacuuccuucu

SEQ ID NO: 352828 - RNA, 22 nt, Homo sapiens
agcuuguauuuguagccuguug

SEQ ID NO: 352829 - RNA, 22 nt, Homo sapiens
agcuuguggugaauacugcuag

SEQ ID NO: 352830 - RNA, 21 nt, Homo sapiens
aggaagacuaugaucaauugg

SEQ ID NO: 352831 - RNA, 22 nt, Homo sapiens
aggaagacugaaauugcuguuc

SEQ ID NO: 352832 - RNA, 22 nt, Homo sapiens
aggaagguaaacuaacuugccu

SEQ ID NO: 352833 - RNA, 22 nt, Homo sapiens
aggaagugugcaauuaauuucu

SEQ ID NO: 352834 - RNA, 22 nt, Homo sapiens
aggaaucuaagguaucagguua

SEQ ID NO: 352835 - RNA, 22 nt, Homo sapiens
aggaauuuaauguaugauaaua

SEQ ID NO: 352836 - RNA, 22 nt, Homo sapiens
aggacacugauagucuuuggca

SEQ ID NO: 352837 - RNA, 22 nt, Homo sapiens
aggaccauuguguagcagacau

SEQ ID NO: 352838 - RNA, 21 nt, Homo sapiens
aggagauguuuguccuuuuag

SEQ ID NO: 352839 - RNA, 22 nt, Homo sapiens
aggagcacaauggucaugugga

SEQ ID NO: 352840 - RNA, 22 nt, Homo sapiens
aggagcacaggacuuugauuau

SEQ ID NO: 352841 - RNA, 18 nt, Homo sapiens
aggagcauagugcuauga

SEQ ID NO: 352842 - RNA, 22 nt, Homo sapiens
aggagguagaacauugccauuu

SEQ ID NO: 352843 - RNA, 21 nt, Homo sapiens
aggcaagauuacuuacgagca

SEQ ID NO: 352844 - RNA, 21 nt, Homo sapiens
aggcaagguguuauuauugaa

SEQ ID NO: 352845 - RNA, 22 nt, Homo sapiens
aggcagcuguuauauacugagu

SEQ ID NO: 352846 - RNA, 22 nt, Homo sapiens
aggcauggagacuaaaauuaua

SEQ ID NO: 352847 - RNA, 22 nt, Homo sapiens
aggccaguuuuuggagggaaac

SEQ ID NO: 352848 - RNA, 22 nt, Homo sapiens
aggcuuuuggagaacacugcac

SEQ ID NO: 352849 - RNA, 22 nt, Homo sapiens
agggaauguaaguuuuaugaga

SEQ ID NO: 352850 - RNA, 22 nt, Homo sapiens
agggagcaaaguggucuuucuc

SEQ ID NO: 352851 - RNA, 22 nt, Homo sapiens
agggcuuuugagcugagauggu

SEQ ID NO: 352852 - RNA, 20 nt, Homo sapiens
agguacacugacaugccuuc

SEQ ID NO: 352853 - RNA, 22 nt, Homo sapiens
agguacuugagauucugaacug

SEQ ID NO: 352854 - RNA, 22 nt, Homo sapiens
agguagaguguuuuguucuucu

SEQ ID NO: 352855 - RNA, 22 nt, Homo sapiens
agguagcauagcgggaauauca

SEQ ID NO: 352856 - RNA, 22 nt, Homo sapiens
agguagguugagaugggcauca

SEQ ID NO: 352857 - RNA, 22 nt, Homo sapiens
agguauguaugucuguacagcg

SEQ ID NO: 352858 - RNA, 21 nt, Homo sapiens
aggucaguaagaaugcagcac

SEQ ID NO: 352859 - RNA, 22 nt, Homo sapiens
aggugcacucagaaaacagaua

SEQ ID NO: 352860 - RNA, 22 nt, Homo sapiens
aggugguguuggguuccagccc

SEQ ID NO: 352861 - RNA, 22 nt, Homo sapiens
aggugguuuuaggcagagacau

SEQ ID NO: 352862 - RNA, 22 nt, Homo sapiens
aggugguuuugaugagcaggua

SEQ ID NO: 352863 - RNA, 20 nt, Homo sapiens
agguuauuauaauuagaaga

SEQ ID NO: 352864 - RNA, 18 nt, Homo sapiens
agguuauuucccaagacu

SEQ ID NO: 352865 - RNA, 22 nt, Homo sapiens
aguaaauuucugugcuuucaua

SEQ ID NO: 352866 - RNA, 22 nt, Homo sapiens
aguaacacaccugcauggugug

SEQ ID NO: 352867 - RNA, 22 nt, Homo sapiens
aguaagauggcaacucuccaca

SEQ ID NO: 352868 - RNA, 22 nt, Homo sapiens
aguagcacaugccacccugucu

SEQ ID NO: 352869 - RNA, 22 nt, Homo sapiens
aguaucaagccacacaugguca

SEQ ID NO: 352870 - RNA, 22 nt, Homo sapiens
aguauuuguuggaauaccuguu

SEQ ID NO: 352871 - RNA, 22 nt, Homo sapiens
agucaaaugcuuauguauaaag

SEQ ID NO: 352872 - RNA, 22 nt, Homo sapiens
ucuggcacugaugugggaugcu

SEQ ID NO: 352873 - RNA, 21 nt, Homo sapiens
ucuggccccuccaaaucucau

SEQ ID NO: 352874 - RNA, 22 nt, Homo sapiens
ucuggccccucccaaaucucau

SEQ ID NO: 352875 - RNA, 22 nt, Homo sapiens
ucuggccccucucaaaucucau

SEQ ID NO: 352876 - RNA, 22 nt, Homo sapiens
ucuggccuacaaguaauuuuau

SEQ ID NO: 352877 - RNA, 22 nt, Homo sapiens
ucuggccuagaacaauuaauua

SEQ ID NO: 352878 - RNA, 22 nt, Homo sapiens
ucuggcuugugaacugucuucu

SEQ ID NO: 352879 - RNA, 23 nt, Homo sapiens
ucuggcuuugggaugcucaaggg

SEQ ID NO: 352880 - RNA, 22 nt, Homo sapiens
ucugggguuagucaaagguaug

SEQ ID NO: 352881 - RNA, 22 nt, Homo sapiens
ucugggguuuccacuuuuacuu

SEQ ID NO: 352882 - RNA, 20 nt, Homo sapiens
ucuggguuuuggccacgccc

SEQ ID NO: 352883 - RNA, 22 nt, Homo sapiens
ucuggguuuuuacaauguuuac

SEQ ID NO: 352884 - RNA, 22 nt, Homo sapiens
ucuggguuuuuccauugccggu

SEQ ID NO: 352885 - RNA, 22 nt, Homo sapiens
ucugguggugaugagagacagu

SEQ ID NO: 352886 - RNA, 22 nt, Homo sapiens
ucugguguuacugagccuccca

SEQ ID NO: 352887 - RNA, 22 nt, Homo sapiens
ucuguacugccaaguuucuuua

SEQ ID NO: 352888 - RNA, 22 nt, Homo sapiens
ucuguaguuaacagcuucagcu

SEQ ID NO: 352889 - RNA, 22 nt, Homo sapiens
ucugugaaugugaccuuauuug

SEQ ID NO: 352890 - RNA, 22 nt, Homo sapiens
ucuguuguuaucauaauauuga

SEQ ID NO: 352891 - RNA, 22 nt, Homo sapiens
ucuuaguuuagauuagcaauuc

SEQ ID NO: 352892 - RNA, 22 nt, Homo sapiens
ucuucuagcggaacccucuugu

SEQ ID NO: 352893 - RNA, 22 nt, Homo sapiens
ucuugaacuucauaggucuaga

SEQ ID NO: 352894 - RNA, 22 nt, Homo sapiens
ucuuggcaaagaauuuuuggcu

SEQ ID NO: 352895 - RNA, 20 nt, Homo sapiens
ucuugggaauguagccuagg

SEQ ID NO: 352896 - RNA, 22 nt, Homo sapiens
ucuuggguuguuggcuucuccu

SEQ ID NO: 352897 - RNA, 22 nt, Homo sapiens
ucuugguaaugucacauuuccu

SEQ ID NO: 352898 - RNA, 22 nt, Homo sapiens
ucuugucacugcauccccagcu

SEQ ID NO: 352899 - RNA, 22 nt, Homo sapiens
ucuuuaguuaagggacauuuua

SEQ ID NO: 352900 - RNA, 22 nt, Homo sapiens
ucuuugauaagauccagaagaa

SEQ ID NO: 352901 - RNA, 22 nt, Homo sapiens
ucuuugauguucugaaagaugg

SEQ ID NO: 352902 - RNA, 22 nt, Homo sapiens
ucuuugauuaugcagauggguu

SEQ ID NO: 352903 - RNA, 22 nt, Homo sapiens
ucuuuggucaucaugggaagca

SEQ ID NO: 352904 - RNA, 22 nt, Homo sapiens
ucuuugucuacauccuguuaaa

SEQ ID NO: 352905 - RNA, 22 nt, Homo sapiens
ucuuuguuagaacccucuccuu

SEQ ID NO: 352906 - RNA, 22 nt, Homo sapiens
ucuuuguucaggagccaacucc

SEQ ID NO: 352907 - RNA, 22 nt, Homo sapiens
ugaaacacacagagaagggaga

SEQ ID NO: 352908 - RNA, 22 nt, Homo sapiens
ugaaagacugaagaauaggcau

SEQ ID NO: 352909 - RNA, 22 nt, Homo sapiens
ugaaagcuacaggaaaguauuu

SEQ ID NO: 352910 - RNA, 22 nt, Homo sapiens
ugaaauacuuaauuucuccaug

SEQ ID NO: 352911 - RNA, 22 nt, Homo sapiens
ugaaaucuuugaugguggcauu

SEQ ID NO: 352912 - RNA, 22 nt, Homo sapiens
ugaaauguuaaacaaguggcuc

SEQ ID NO: 352913 - RNA, 22 nt, Homo sapiens
ugaacagcaccuccuagaguug

SEQ ID NO: 352914 - RNA, 22 nt, Homo sapiens
ugaacucagcauccagggccaa

SEQ ID NO: 352915 - RNA, 22 nt, Homo sapiens
ugaaggccgggcaugguggcuc

SEQ ID NO: 352916 - RNA, 22 nt, Homo sapiens
ugaaguaggcauaaguuaagcu

SEQ ID NO: 352917 - RNA, 19 nt, Homo sapiens
ugaaguauagggcuucuga

SEQ ID NO: 352918 - RNA, 22 nt, Homo sapiens
ugaagugaagcaguaguguggg

SEQ ID NO: 352919 - RNA, 22 nt, Homo sapiens
ugaagugaaugguaaguaugcc

SEQ ID NO: 352920 - RNA, 22 nt, Homo sapiens
ugaauacuucaaaaaaauagcu

SEQ ID NO: 352921 - RNA, 22 nt, Homo sapiens
ugaauacuucguucaaagauaa

SEQ ID NO: 352922 - RNA, 22 nt, Homo sapiens
ugaauaggcaguuaaguuuaug

SEQ ID NO: 352923 - RNA, 22 nt, Homo sapiens
ugaauaguaauguguuuggucu

SEQ ID NO: 352924 - RNA, 22 nt, Homo sapiens
ugaauagugucacaauaaacau

SEQ ID NO: 352925 - RNA, 22 nt, Homo sapiens
ugaaucaugcugcuauaaagac

SEQ ID NO: 352926 - RNA, 22 nt, Homo sapiens
ugaauguccugacgcugcaguu

SEQ ID NO: 352927 - RNA, 21 nt, Homo sapiens
ugaaugucuaggcagaaguuu

SEQ ID NO: 352928 - RNA, 22 nt, Homo sapiens
ugaauguuguugguugagauau

SEQ ID NO: 352929 - RNA, 22 nt, Homo sapiens
ugacaagaacuuuccauaguaa

SEQ ID NO: 352930 - RNA, 22 nt, Homo sapiens
ugacaagaguagagagggugcc

SEQ ID NO: 352931 - RNA, 20 nt, Homo sapiens
ugacaaggugcaaagaauca

SEQ ID NO: 352932 - RNA, 23 nt, Homo sapiens
ugacagaccuucuggaagaaguc

SEQ ID NO: 352933 - RNA, 22 nt, Homo sapiens
ugacagcugaagauguugaacc

SEQ ID NO: 352934 - RNA, 22 nt, Homo sapiens
ugacaggagauuaugugauguu

SEQ ID NO: 352935 - RNA, 22 nt, Homo sapiens
ugacagucaccaggacccacag

SEQ ID NO: 352936 - RNA, 22 nt, Homo sapiens
ugacagugaauaagucucuuaa

SEQ ID NO: 352937 - RNA, 19 nt, Homo sapiens
ugacaugaaacccaagauc

SEQ ID NO: 352938 - RNA, 22 nt, Homo sapiens
ugacaugauuguauauuuagaa

SEQ ID NO: 352939 - RNA, 21 nt, Homo sapiens
ugacauuauuucaugucagua

SEQ ID NO: 352940 - RNA, 22 nt, Homo sapiens
ugaccucugauagcaguaggug

SEQ ID NO: 352941 - RNA, 22 nt, Homo sapiens
ugacuacacacaauuugucaag

SEQ ID NO: 352942 - RNA, 22 nt, Homo sapiens
ugacuacauaaguaaucucaaa

SEQ ID NO: 352943 - RNA, 22 nt, Homo sapiens
ugacuagagcaauuggaaacaa

SEQ ID NO: 352944 - RNA, 22 nt, Homo sapiens
ugacuaggaggcuggaggauga

SEQ ID NO: 352945 - RNA, 22 nt, Homo sapiens
ugacuggaaacaguguuauuug

SEQ ID NO: 352946 - RNA, 20 nt, Homo sapiens
ugagaacauguggcauuugg

SEQ ID NO: 352947 - RNA, 18 nt, Homo sapiens
ugagaacauguguacaca

SEQ ID NO: 352948 - RNA, 22 nt, Homo sapiens
ugagaacauuccucuuccuggc

SEQ ID NO: 352949 - RNA, 22 nt, Homo sapiens
ugagaacugguagcacuuguga

SEQ ID NO: 352950 - RNA, 22 nt, Homo sapiens
ugagaacuuauggugauuuuuu

SEQ ID NO: 352951 - RNA, 22 nt, Homo sapiens
ugagaacuuugucuuuuacucu

SEQ ID NO: 352952 - RNA, 22 nt, Homo sapiens
ugagaaugcagaaucucgugca

SEQ ID NO: 352953 - RNA, 22 nt, Homo sapiens
ugagacauacuuacaggggaug

SEQ ID NO: 352954 - RNA, 22 nt, Homo sapiens
ugagacaucacaaaauccucaa

SEQ ID NO: 352955 - RNA, 22 nt, Homo sapiens
ugagacaucucuccugagacag

SEQ ID NO: 352956 - RNA, 22 nt, Homo sapiens
ugagacaugugaauauuuguac

SEQ ID NO: 352957 - RNA, 22 nt, Homo sapiens
ugagacgaagucuugcucuguu

SEQ ID NO: 352958 - RNA, 22 nt, Homo sapiens
ugagacugaaauuaggaaacug

SEQ ID NO: 352959 - RNA, 22 nt, Homo sapiens
ugagacugaguuuugcucuugu

SEQ ID NO: 352960 - RNA, 22 nt, Homo sapiens
ugagagaugauaaaauguuugu

SEQ ID NO: 352961 - RNA, 22 nt, Homo sapiens
ugagagcuuugaugcacuguuu

SEQ ID NO: 352962 - RNA, 22 nt, Homo sapiens
ugagaguagggguugggauugg

SEQ ID NO: 352963 - RNA, 21 nt, Homo sapiens
ugagaguaguguauuauucuc

SEQ ID NO: 352964 - RNA, 22 nt, Homo sapiens
ugagauagggucucacucuguc

SEQ ID NO: 352965 - RNA, 22 nt, Homo sapiens
ugagaucacgccacugcacucc

SEQ ID NO: 352966 - RNA, 20 nt, Homo sapiens
ugagauccacgugaaguaug

SEQ ID NO: 352967 - RNA, 22 nt, Homo sapiens
ugagaucgagucucgcucuguc

SEQ ID NO: 352968 - RNA, 21 nt, Homo sapiens
ugcuauguuguccaggcuggc

SEQ ID NO: 352969 - RNA, 22 nt, Homo sapiens
ugcucaccugcugcucaccucc

SEQ ID NO: 352970 - RNA, 22 nt, Homo sapiens
ugcugcacaguucuuaagauua

SEQ ID NO: 352971 - RNA, 19 nt, Homo sapiens
ugcugcauugugaccuugc

SEQ ID NO: 352972 - RNA, 22 nt, Homo sapiens
ugcuggugucaucaaggcuuug

SEQ ID NO: 352973 - RNA, 22 nt, Homo sapiens
ugcugguguuuaggaauaagaa

SEQ ID NO: 352974 - RNA, 22 nt, Homo sapiens
uggaaacuuauguucuucugug

SEQ ID NO: 352975 - RNA, 22 nt, Homo sapiens
uggaaaguacuugaguuuguau

SEQ ID NO: 352976 - RNA, 22 nt, Homo sapiens
uggaaauaaaugugccaagauc

SEQ ID NO: 352977 - RNA, 20 nt, Homo sapiens
uggaaauuaaccuuucaggu

SEQ ID NO: 352978 - RNA, 22 nt, Homo sapiens
uggaaauuaagucuuuccugag

SEQ ID NO: 352979 - RNA, 22 nt, Homo sapiens
uggaacaccaggcuggcguggc

SEQ ID NO: 352980 - RNA, 19 nt, Homo sapiens
uggaacauaaaaguugguu

SEQ ID NO: 352981 - RNA, 22 nt, Homo sapiens
uggaacugauauugauggaaaa

SEQ ID NO: 352982 - RNA, 22 nt, Homo sapiens
uggaagacucuagucucuugag

SEQ ID NO: 352983 - RNA, 22 nt, Homo sapiens
uggaagauggaguuuuaucauu

SEQ ID NO: 352984 - RNA, 22 nt, Homo sapiens
uggaaggcuucauauguaaaga

SEQ ID NO: 352985 - RNA, 22 nt, Homo sapiens
uggaagguaaguuuugagcauu

SEQ ID NO: 352986 - RNA, 23 nt, Homo sapiens
uggaaguauggaggaggcagaau

SEQ ID NO: 352987 - RNA, 22 nt, Homo sapiens
uggaagucuucauuauguauag

SEQ ID NO: 352988 - RNA, 22 nt, Homo sapiens
uggaagugaacaaccaaggcag

SEQ ID NO: 352989 - RNA, 22 nt, Homo sapiens
uggaaguuaaaugacucuuucu

SEQ ID NO: 352990 - RNA, 22 nt, Homo sapiens
uggaaucaucaacgaaugaaau

SEQ ID NO: 352991 - RNA, 22 nt, Homo sapiens
uggaaucuagagaaaugcaaac

SEQ ID NO: 352992 - RNA, 21 nt, Homo sapiens
uggaaucuauuauuccaguuu

SEQ ID NO: 352993 - RNA, 20 nt, Homo sapiens
uggaaucugaagaucucagu

SEQ ID NO: 352994 - RNA, 21 nt, Homo sapiens
uggaaugaauggccaacaugg

SEQ ID NO: 352995 - RNA, 22 nt, Homo sapiens
uggaaugcucuccccacggacu

SEQ ID NO: 352996 - RNA, 22 nt, Homo sapiens
uggaaugguaucuuguuggggu

SEQ ID NO: 352997 - RNA, 22 nt, Homo sapiens
uggaauuaauuaaaauauacug

SEQ ID NO: 352998 - RNA, 22 nt, Homo sapiens
uggacagagagaccggcauuuu

SEQ ID NO: 352999 - RNA, 22 nt, Homo sapiens
uggacugagauuucagcugcca

SEQ ID NO: 353000 - RNA, 22 nt, Homo sapiens
uggagacugaucccucuuuccu

SEQ ID NO: 353001 - RNA, 22 nt, Homo sapiens
uggagagugauaaguaaaugga

SEQ ID NO: 353002 - RNA, 22 nt, Homo sapiens
uggagauguuuaaaauccacug

SEQ ID NO: 353003 - RNA, 22 nt, Homo sapiens
uggaggucauuggaucaugggg

SEQ ID NO: 353004 - RNA, 22 nt, Homo sapiens
uggaguaggccuaagaaugaca

SEQ ID NO: 353005 - RNA, 19 nt, Homo sapiens
uggagucaucaugcugcua

SEQ ID NO: 353006 - RNA, 22 nt, Homo sapiens
uggauaguaaagucagauuccc

SEQ ID NO: 353007 - RNA, 22 nt, Homo sapiens
uggaugacuguuauaugcauau

SEQ ID NO: 353008 - RNA, 22 nt, Homo sapiens
uggcaaaauauuuugguuucug

SEQ ID NO: 353009 - RNA, 22 nt, Homo sapiens
uggcaagaaccacaguuacuuu

SEQ ID NO: 353010 - RNA, 22 nt, Homo sapiens
uggcaagaccccaucucuacaa

SEQ ID NO: 353011 - RNA, 19 nt, Homo sapiens
uggcaaugucagcagagau

SEQ ID NO: 353012 - RNA, 22 nt, Homo sapiens
uggcaauguggaaugguccagg

SEQ ID NO: 353013 - RNA, 22 nt, Homo sapiens
uggcacaaugacccuugugggc

SEQ ID NO: 353014 - RNA, 22 nt, Homo sapiens
uggcagaugcucuuggugccca

SEQ ID NO: 353015 - RNA, 22 nt, Homo sapiens
uggcagcgugaauguggcugaa

SEQ ID NO: 353016 - RNA, 22 nt, Homo sapiens
uggcaguuuacaaaugccauga

SEQ ID NO: 353017 - RNA, 22 nt, Homo sapiens
uggcaugaagaccccauccuuu

SEQ ID NO: 353018 - RNA, 22 nt, Homo sapiens
uggcaugaaguguguuuuaucu

SEQ ID NO: 353019 - RNA, 22 nt, Homo sapiens
uggcaugcauuguggguaauua

SEQ ID NO: 353020 - RNA, 22 nt, Homo sapiens
uggcauggaacuacuuugaaac

SEQ ID NO: 353021 - RNA, 22 nt, Homo sapiens
uggcauggucugcccaaguuuc

SEQ ID NO: 353022 - RNA, 22 nt, Homo sapiens
uggcauuuucucuguucuuaga

SEQ ID NO: 353023 - RNA, 22 nt, Homo sapiens
uggccuuuuccaagaacuacua

SEQ ID NO: 353024 - RNA, 22 nt, Homo sapiens
uggcuacuguacuugagcuauu

SEQ ID NO: 353025 - RNA, 22 nt, Homo sapiens
uggcuguguccucucccaaauc

SEQ ID NO: 353026 - RNA, 22 nt, Homo sapiens
uggcuguuuauuucacaugggu

SEQ ID NO: 353027 - RNA, 22 nt, Homo sapiens
uggcuuucuggggcuucuguuc

SEQ ID NO: 353028 - RNA, 22 nt, Homo sapiens
ugggaaacauccagcacauacu

SEQ ID NO: 353029 - RNA, 22 nt, Homo sapiens
ugggaaauguagccuagcugug

SEQ ID NO: 353030 - RNA, 22 nt, Homo sapiens
ugggaacaugaagguuaaagag

SEQ ID NO: 353031 - RNA, 19 nt, Homo sapiens
ugggaauguaaauuaguuc

SEQ ID NO: 353032 - RNA, 22 nt, Homo sapiens
ugggagcauugcauuagaagcc

SEQ ID NO: 353033 - RNA, 22 nt, Homo sapiens
ugggaucagcugggcucucugu

SEQ ID NO: 353034 - RNA, 22 nt, Homo sapiens
ugggaucauuaugcauagugua

SEQ ID NO: 353035 - RNA, 22 nt, Homo sapiens
ugggaucauucaaugacgaaau

SEQ ID NO: 353036 - RNA, 22 nt, Homo sapiens
ugggauccaugugguuuaagca

SEQ ID NO: 353037 - RNA, 22 nt, Homo sapiens
ugggcaguauggucauuuucgu

SEQ ID NO: 353038 - RNA, 22 nt, Homo sapiens
ugggccgcugcaggaugguccc

SEQ ID NO: 353039 - RNA, 22 nt, Homo sapiens
ugggcggagacgugcagccgcc

SEQ ID NO: 353040 - RNA, 22 nt, Homo sapiens
ugggguaggccugguuaugugc

SEQ ID NO: 353041 - RNA, 22 nt, Homo sapiens
uggguaggcccucauuggacag

SEQ ID NO: 353042 - RNA, 22 nt, Homo sapiens
ugguaagaggcccugaguuugu

SEQ ID NO: 353043 - RNA, 22 nt, Homo sapiens
ugguacuguccuucuagauucc

SEQ ID NO: 353044 - RNA, 22 nt, Homo sapiens
ugguaucuaagaugcacguugu

SEQ ID NO: 353045 - RNA, 19 nt, Homo sapiens
uggucaguucugggagcug

SEQ ID NO: 353046 - RNA, 19 nt, Homo sapiens
uggucccccgcaaucucau

SEQ ID NO: 353047 - RNA, 22 nt, Homo sapiens
uggucccucugaaaauugggug

SEQ ID NO: 353048 - RNA, 22 nt, Homo sapiens
uggugagaaacuagauauuuuu

SEQ ID NO: 353049 - RNA, 22 nt, Homo sapiens
uggugcccuguccuucuguggc

SEQ ID NO: 353050 - RNA, 22 nt, Homo sapiens
uggugcuuaaauaaggcuuuca

SEQ ID NO: 353051 - RNA, 22 nt, Homo sapiens
ugguguccugucucugcgcuug

SEQ ID NO: 353052 - RNA, 22 nt, Homo sapiens
uguaaaaagcccagccgcugag

SEQ ID NO: 353053 - RNA, 22 nt, Homo sapiens
uguaaaucugguuaauuggaua

SEQ ID NO: 353054 - RNA, 22 nt, Homo sapiens
uguaaggcaguuagagcaaauu

SEQ ID NO: 353055 - RNA, 22 nt, Homo sapiens
uguagacaccaaagacagcaua

SEQ ID NO: 353056 - RNA, 22 nt, Homo sapiens
uguagacagcacguaguugagu

SEQ ID NO: 353057 - RNA, 22 nt, Homo sapiens
uguagauaucuaucaggucaau

SEQ ID NO: 353058 - RNA, 22 nt, Homo sapiens
uguagcaaauaaaagucuggau

SEQ ID NO: 353059 - RNA, 21 nt, Homo sapiens
uguauacauggaagaaugguc

SEQ ID NO: 353060 - RNA, 22 nt, Homo sapiens
uguauacauguguguucacgca

SEQ ID NO: 353061 - RNA, 22 nt, Homo sapiens
uguauagaucugauucaucucc

SEQ ID NO: 353062 - RNA, 22 nt, Homo sapiens
uguauauguuuguacauauguc

SEQ ID NO: 353063 - RNA, 22 nt, Homo sapiens
uguauguaauugaaguuaaguu

SEQ ID NO: 353064 - RNA, 22 nt, Homo sapiens
uugacugugguaauggaagcug

SEQ ID NO: 353065 - RNA, 22 nt, Homo sapiens
uugacuuagacauucaguugga

SEQ ID NO: 353066 - RNA, 22 nt, Homo sapiens
uugagaagugucuguucauguc

SEQ ID NO: 353067 - RNA, 22 nt, Homo sapiens
uugagacgaagucucacucuug

SEQ ID NO: 353068 - RNA, 22 nt, Homo sapiens
uugagacggagucuugcucuuu

SEQ ID NO: 353069 - RNA, 22 nt, Homo sapiens
uugagacggaguuuugcucuug

SEQ ID NO: 353070 - RNA, 22 nt, Homo sapiens
uugagaugaagucuugcucucu

SEQ ID NO: 353071 - RNA, 22 nt, Homo sapiens
uugagaugaaguuuugcucuuu

SEQ ID NO: 353072 - RNA, 22 nt, Homo sapiens
uugagaugauggauaugcuaau

SEQ ID NO: 353073 - RNA, 22 nt, Homo sapiens
uugagauggaaucucgcuuugu

SEQ ID NO: 353074 - RNA, 22 nt, Homo sapiens
uugagauggagucucacucuuu

SEQ ID NO: 353075 - RNA, 22 nt, Homo sapiens
uugagauggagucucgcucugu

SEQ ID NO: 353076 - RNA, 22 nt, Homo sapiens
uugagauggagucucgcucuuu

SEQ ID NO: 353077 - RNA, 22 nt, Homo sapiens
uugagauggagucuugcucuug

SEQ ID NO: 353078 - RNA, 22 nt, Homo sapiens
uugagauggagucuuguucuuu

SEQ ID NO: 353079 - RNA, 22 nt, Homo sapiens
uugagauggaguuucacucugu

SEQ ID NO: 353080 - RNA, 22 nt, Homo sapiens
uugagauggaguuucgcucuug

SEQ ID NO: 353081 - RNA, 22 nt, Homo sapiens
uugagauggugccacuguacuc

SEQ ID NO: 353082 - RNA, 22 nt, Homo sapiens
uugagauguggguuggugacuu

SEQ ID NO: 353083 - RNA, 22 nt, Homo sapiens
uugagcucuucuagcaauucua

SEQ ID NO: 353084 - RNA, 21 nt, Homo sapiens
uugagcuuuuaguacagacag

SEQ ID NO: 353085 - RNA, 22 nt, Homo sapiens
uugaggacugcuaagcauuuga

SEQ ID NO: 353086 - RNA, 22 nt, Homo sapiens
uugaggacuggaacacaggucu

SEQ ID NO: 353087 - RNA, 22 nt, Homo sapiens
uugaggacugguugaaagcuuu

SEQ ID NO: 353088 - RNA, 22 nt, Homo sapiens
uugaggaggcagucucuccauu

SEQ ID NO: 353089 - RNA, 22 nt, Homo sapiens
uugaggaggcagucuguccguu

SEQ ID NO: 353090 - RNA, 22 nt, Homo sapiens
uugaggcuuuugaccucaugug

SEQ ID NO: 353091 - RNA, 22 nt, Homo sapiens
uugagguggugucuugcucugu

SEQ ID NO: 353092 - RNA, 22 nt, Homo sapiens
uugauagguuuuauguauaguu

SEQ ID NO: 353093 - RNA, 22 nt, Homo sapiens
uugauaguuuaauuaaugcuag

SEQ ID NO: 353094 - RNA, 22 nt, Homo sapiens
uugauaugaauggcuguuugug

SEQ ID NO: 353095 - RNA, 22 nt, Homo sapiens
uugaucugugucccugcccaau

SEQ ID NO: 353096 - RNA, 22 nt, Homo sapiens
uugauguugaggacauaaaccu

SEQ ID NO: 353097 - RNA, 22 nt, Homo sapiens
uugcaacauuguaaguuuauau

SEQ ID NO: 353098 - RNA, 22 nt, Homo sapiens
uugcaagaaaugcagauucuca

SEQ ID NO: 353099 - RNA, 22 nt, Homo sapiens
uugcaagauguucaugggcugu

SEQ ID NO: 353100 - RNA, 22 nt, Homo sapiens
uugcacaauccugugagugagu

SEQ ID NO: 353101 - RNA, 22 nt, Homo sapiens
uugcacauggcaggugcucaau

SEQ ID NO: 353102 - RNA, 22 nt, Homo sapiens
uugcacauugcaccuuuuguau

SEQ ID NO: 353103 - RNA, 22 nt, Homo sapiens
uugcacauuuuuucuggcagaa

SEQ ID NO: 353104 - RNA, 22 nt, Homo sapiens
uugcacuccagccuggaugaca

SEQ ID NO: 353105 - RNA, 22 nt, Homo sapiens
uugcacuccagucuggggggca

SEQ ID NO: 353106 - RNA, 22 nt, Homo sapiens
uugcacuccauccuggguugac

SEQ ID NO: 353107 - RNA, 18 nt, Homo sapiens
uugcacuccugccugggu

SEQ ID NO: 353108 - RNA, 22 nt, Homo sapiens
uugcacuguaauuuauuuaugu

SEQ ID NO: 353109 - RNA, 22 nt, Homo sapiens
uugcacuuccgccugggugaca

SEQ ID NO: 353110 - RNA, 22 nt, Homo sapiens
uugcagagucaguuauuuugcc

SEQ ID NO: 353111 - RNA, 22 nt, Homo sapiens
uugcagcaaauaggaaugagga

SEQ ID NO: 353112 - RNA, 22 nt, Homo sapiens
uugcaggugguuuaugcaagac

SEQ ID NO: 353113 - RNA, 22 nt, Homo sapiens
uugcaugcacaguucucaauag

SEQ ID NO: 353114 - RNA, 22 nt, Homo sapiens
uugcauugacacaugaagcuca

SEQ ID NO: 353115 - RNA, 22 nt, Homo sapiens
uugcauuuucuaggagggcaaa

SEQ ID NO: 353116 - RNA, 22 nt, Homo sapiens
uugccaucaucucuuacucagu

SEQ ID NO: 353117 - RNA, 18 nt, Homo sapiens
uugccuauucacucugau

SEQ ID NO: 353118 - RNA, 22 nt, Homo sapiens
uugcuggugguucgagcaacac

SEQ ID NO: 353119 - RNA, 22 nt, Homo sapiens
uugcuucauucaacauugaggg

SEQ ID NO: 353120 - RNA, 22 nt, Homo sapiens
uugcuuuguugucuggggaaua

SEQ ID NO: 353121 - RNA, 22 nt, Homo sapiens
uuggaaaaauccaccuugaucu

SEQ ID NO: 353122 - RNA, 22 nt, Homo sapiens
uuggaaacaccuggugagguua

SEQ ID NO: 353123 - RNA, 22 nt, Homo sapiens
uuggaaacauuuaugguaacag

SEQ ID NO: 353124 - RNA, 22 nt, Homo sapiens
uuggaaaccucugcagguguuu

SEQ ID NO: 353125 - RNA, 22 nt, Homo sapiens
uuggaaacgucaccuuuuccuu

SEQ ID NO: 353126 - RNA, 22 nt, Homo sapiens
uuggaaauguguuugcauucag

SEQ ID NO: 353127 - RNA, 22 nt, Homo sapiens
uuggaaggcugaauggccucuc

SEQ ID NO: 353128 - RNA, 22 nt, Homo sapiens
uuggaagguaaucaaaaguucu

SEQ ID NO: 353129 - RNA, 22 nt, Homo sapiens
uuggaauauuauuauugggcag

SEQ ID NO: 353130 - RNA, 22 nt, Homo sapiens
uuggaaugugacugauaauauu

SEQ ID NO: 353131 - RNA, 22 nt, Homo sapiens
uuggacuuuaagauagagaugu

SEQ ID NO: 353132 - RNA, 22 nt, Homo sapiens
uuggagagaaaggcaguuccug

SEQ ID NO: 353133 - RNA, 22 nt, Homo sapiens
uuggauggugauaugguuugga

SEQ ID NO: 353134 - RNA, 22 nt, Homo sapiens
uuggauuuugguggcaacucau

SEQ ID NO: 353135 - RNA, 22 nt, Homo sapiens
uuggcaaagaggaaugccacuu

SEQ ID NO: 353136 - RNA, 22 nt, Homo sapiens
uuggcaaauagguuuuauugca

SEQ ID NO: 353137 - RNA, 22 nt, Homo sapiens
uuggcaaguccccaccucucuc

SEQ ID NO: 353138 - RNA, 21 nt, Homo sapiens
uuggcacucuucucuccuuau

SEQ ID NO: 353139 - RNA, 22 nt, Homo sapiens
uuggcagcacgcaguccagagg

SEQ ID NO: 353140 - RNA, 22 nt, Homo sapiens
uuggcagcuguggaaucugggc

SEQ ID NO: 353141 - RNA, 22 nt, Homo sapiens
uuggcauuuauucuaaggucaa

SEQ ID NO: 353142 - RNA, 22 nt, Homo sapiens
uuggccauggagcacuuuucua

SEQ ID NO: 353143 - RNA, 22 nt, Homo sapiens
uuggccccuccaaaucucaugu

SEQ ID NO: 353144 - RNA, 22 nt, Homo sapiens
uuggcuuuuaugcagcuuaggu

SEQ ID NO: 353145 - RNA, 22 nt, Homo sapiens
uugggauggaaauuuguacccc

SEQ ID NO: 353146 - RNA, 22 nt, Homo sapiens
uugggauggaacuuuucaguga

SEQ ID NO: 353147 - RNA, 23 nt, Homo sapiens
uugggcaaaucacuaacgucucc

SEQ ID NO: 353148 - RNA, 22 nt, Homo sapiens
uugggguagaauugcaacauau

SEQ ID NO: 353149 - RNA, 22 nt, Homo sapiens
uugguaagguggaugaugaaua

SEQ ID NO: 353150 - RNA, 22 nt, Homo sapiens
uuggucaaaucugaugggagaa

SEQ ID NO: 353151 - RNA, 22 nt, Homo sapiens
uuggucacugacauguuugaaa

SEQ ID NO: 353152 - RNA, 22 nt, Homo sapiens
uuggucagcuagauuauucccu

SEQ ID NO: 353153 - RNA, 22 nt, Homo sapiens
uuggucaggcuaaucucgaacg

SEQ ID NO: 353154 - RNA, 20 nt, Homo sapiens
uuggugaccuacagaugugg

SEQ ID NO: 353155 - RNA, 22 nt, Homo sapiens
uugguucucuuagccaucuuaa

SEQ ID NO: 353156 - RNA, 22 nt, Homo sapiens
uuguaacaugcuuucacuucag

SEQ ID NO: 353157 - RNA, 22 nt, Homo sapiens
uuguaagaaucuagcucuuuau

SEQ ID NO: 353158 - RNA, 22 nt, Homo sapiens
uuguaauggagcaaacagguug

SEQ ID NO: 353159 - RNA, 22 nt, Homo sapiens
uuguacuuuuaguagagacggg

SEQ ID NO: 353160 - RNA, 22 nt, Homo sapiens
caugguacugccacagaagagu

SEQ ID NO: 353161 - RNA, 22 nt, Homo sapiens
cauguaacaucccgcuguagga

SEQ ID NO: 353162 - RNA, 22 nt, Homo sapiens
cauguaguagaaggagccagac

SEQ ID NO: 353163 - RNA, 22 nt, Homo sapiens
cauguauagauuccauaguggu

SEQ ID NO: 353164 - RNA, 22 nt, Homo sapiens
caugucuuuuauucugugugau

SEQ ID NO: 353165 - RNA, 22 nt, Homo sapiens
caugugcaugcuuucuuaugug

SEQ ID NO: 353166 - RNA, 20 nt, Homo sapiens
cauuacacuccaaccugggu

SEQ ID NO: 353167 - RNA, 20 nt, Homo sapiens
cauuccacuuuccugucagu

SEQ ID NO: 353168 - RNA, 22 nt, Homo sapiens
cauugcacuccaccuuggguaa

SEQ ID NO: 353169 - RNA, 22 nt, Homo sapiens
cauugcacuccagccugccugg

SEQ ID NO: 353170 - RNA, 22 nt, Homo sapiens
cauugcacuccagccuggcaac

SEQ ID NO: 353171 - RNA, 22 nt, Homo sapiens
cauugcacuccagccuugguga

SEQ ID NO: 353172 - RNA, 22 nt, Homo sapiens
cauugcacuccagcuugggcga

SEQ ID NO: 353173 - RNA, 22 nt, Homo sapiens
cauugcaguuuuugguguaucu

SEQ ID NO: 353174 - RNA, 22 nt, Homo sapiens
cauugguuggacaguucucucu

SEQ ID NO: 353175 - RNA, 22 nt, Homo sapiens
cauugucccucaaugucuauga

SEQ ID NO: 353176 - RNA, 22 nt, Homo sapiens
cauuuugcaguuucugucucca

SEQ ID NO: 353177 - RNA, 22 nt, Homo sapiens
ccaaguguucucauuguucaau

SEQ ID NO: 353178 - RNA, 23 nt, Homo sapiens
ccacaaugguugaacuagauuac

SEQ ID NO: 353179 - RNA, 23 nt, Homo sapiens
ccacacuguuuagaauggcauca

SEQ ID NO: 353180 - RNA, 22 nt, Homo sapiens
ccacaguugaaauuuugacugu

SEQ ID NO: 353181 - RNA, 22 nt, Homo sapiens
ccacccuuccacacccugggua

SEQ ID NO: 353182 - RNA, 22 nt, Homo sapiens
ccaggguuccacgccuggcugu

SEQ ID NO: 353183 - RNA, 18 nt, Homo sapiens
ccagugcaaggaaagccc

SEQ ID NO: 353184 - RNA, 22 nt, Homo sapiens
ccagugcauggaucccaggggg

SEQ ID NO: 353185 - RNA, 19 nt, Homo sapiens
ccaguguugccagagcuga

SEQ ID NO: 353186 - RNA, 22 nt, Homo sapiens
ccaguguuuggauuagggaugc

SEQ ID NO: 353187 - RNA, 22 nt, Homo sapiens
ccauacugucaaauagauuucc

SEQ ID NO: 353188 - RNA, 20 nt, Homo sapiens
ccaucaguccucucuuguuc

SEQ ID NO: 353189 - RNA, 22 nt, Homo sapiens
ccauggcaauggucagucuauu

SEQ ID NO: 353190 - RNA, 21 nt, Homo sapiens
ccaugggacggaaugaauaca

SEQ ID NO: 353191 - RNA, 22 nt, Homo sapiens
ccauugcacucuggccuaggug

SEQ ID NO: 353192 - RNA, 22 nt, Homo sapiens
ccauuucacucuuccugaagga

SEQ ID NO: 353193 - RNA, 22 nt, Homo sapiens
cccaguguguuguggauauuua

SEQ ID NO: 353194 - RNA, 22 nt, Homo sapiens
cccaguguuuauuuugagccaa

SEQ ID NO: 353195 - RNA, 22 nt, Homo sapiens
cccaguuuugcuucucaugagg

SEQ ID NO: 353196 - RNA, 20 nt, Homo sapiens
ccccaguuuuucuauuagcu

SEQ ID NO: 353197 - RNA, 20 nt, Homo sapiens
ccccuggaguggggcugcuu

SEQ ID NO: 353198 - RNA, 22 nt, Homo sapiens
cccugaagaaagccuaggacau

SEQ ID NO: 353199 - RNA, 22 nt, Homo sapiens
cccugagagcagggucuuucuc

SEQ ID NO: 353200 - RNA, 22 nt, Homo sapiens
cccuguagcagcauucuuaaau

SEQ ID NO: 353201 - RNA, 22 nt, Homo sapiens
cccuucauucaaggguugugag

SEQ ID NO: 353202 - RNA, 22 nt, Homo sapiens
ccugagaucauacuguuaguaa

SEQ ID NO: 353203 - RNA, 22 nt, Homo sapiens
ccuggcacugggccccguggcu

SEQ ID NO: 353204 - RNA, 22 nt, Homo sapiens
ccugugguuaaccagcuagaug

SEQ ID NO: 353205 - RNA, 22 nt, Homo sapiens
ccuuggcaauggcuggggcuga

SEQ ID NO: 353206 - RNA, 21 nt, Homo sapiens
ccuugguuaucuucccauuca

SEQ ID NO: 353207 - RNA, 22 nt, Homo sapiens
ccuuuguuaguuugcugagaau

SEQ ID NO: 353208 - RNA, 22 nt, Homo sapiens
cgcaguguuugugucccugggu

SEQ ID NO: 353209 - RNA, 22 nt, Homo sapiens
cgcccuguagcuagcuagaggu

SEQ ID NO: 353210 - RNA, 22 nt, Homo sapiens
cgugaauguuuuggucuuucac

SEQ ID NO: 353211 - RNA, 22 nt, Homo sapiens
cuaaaggaaucugagccccuga

SEQ ID NO: 353212 - RNA, 22 nt, Homo sapiens
cuaacuaugucucaggaugucc

SEQ ID NO: 353213 - RNA, 17 nt, Homo sapiens
cuaaggcaagagucugc

SEQ ID NO: 353214 - RNA, 22 nt, Homo sapiens
cuaagggaggaagcugugcagg

SEQ ID NO: 353215 - RNA, 22 nt, Homo sapiens
cuaauacaguuguccaagcugg

SEQ ID NO: 353216 - RNA, 18 nt, Homo sapiens
cuaauacuauucaacaag

SEQ ID NO: 353217 - RNA, 22 nt, Homo sapiens
cuaaugcagucaggagaaggaa

SEQ ID NO: 353218 - RNA, 22 nt, Homo sapiens
cuacaguagagaggauguagaa

SEQ ID NO: 353219 - RNA, 22 nt, Homo sapiens
cuacaguaugaaaccuuuacuc

SEQ ID NO: 353220 - RNA, 22 nt, Homo sapiens
cuacucuggagagugacaauca

SEQ ID NO: 353221 - RNA, 22 nt, Homo sapiens
cuacugcacaucaucugaguua

SEQ ID NO: 353222 - RNA, 22 nt, Homo sapiens
cuagagagaagcugugugaccu

SEQ ID NO: 353223 - RNA, 22 nt, Homo sapiens
cuagcacauuuaucuuuauaca

SEQ ID NO: 353224 - RNA, 22 nt, Homo sapiens
cuagcugcacuuccugcuacug

SEQ ID NO: 353225 - RNA, 22 nt, Homo sapiens
cuaggaaguauguguuauugcu

SEQ ID NO: 353226 - RNA, 22 nt, Homo sapiens
cuauaugucuguuuugguacca

SEQ ID NO: 353227 - RNA, 22 nt, Homo sapiens
cuaucucaggcccaggcccuug

SEQ ID NO: 353228 - RNA, 22 nt, Homo sapiens
cuaugcuuucugggcccugggu

SEQ ID NO: 353229 - RNA, 22 nt, Homo sapiens
cuauggcuguaugacgugcaug

SEQ ID NO: 353230 - RNA, 22 nt, Homo sapiens
cuaugguaggggcuggaggaag

SEQ ID NO: 353231 - RNA, 22 nt, Homo sapiens
cucaaaguacuuugguuauugu

SEQ ID NO: 353232 - RNA, 22 nt, Homo sapiens
cucaaagucaagggaaagcagg

SEQ ID NO: 353233 - RNA, 22 nt, Homo sapiens
cucaaagugcuaagauuaggcu

SEQ ID NO: 353234 - RNA, 22 nt, Homo sapiens
cucaaaguguggucuguggguu

SEQ ID NO: 353235 - RNA, 22 nt, Homo sapiens
cucaaguacaugggauuacagg

SEQ ID NO: 353236 - RNA, 18 nt, Homo sapiens
cucacacccuaaucagga

SEQ ID NO: 353237 - RNA, 18 nt, Homo sapiens
cucacaguaacuuuuaag

SEQ ID NO: 353238 - RNA, 22 nt, Homo sapiens
cucacaguucuaaaggcaagaa

SEQ ID NO: 353239 - RNA, 22 nt, Homo sapiens
cucacggugcaggcuucuggga

SEQ ID NO: 353240 - RNA, 22 nt, Homo sapiens
cucacuaguaaggcuguuuagu

SEQ ID NO: 353241 - RNA, 17 nt, Homo sapiens
cucacugagaacagcua

SEQ ID NO: 353242 - RNA, 22 nt, Homo sapiens
cucacugggaccacucugaagu

SEQ ID NO: 353243 - RNA, 22 nt, Homo sapiens
cucacugugguguccuuaggua

SEQ ID NO: 353244 - RNA, 22 nt, Homo sapiens
cucagagcacaguuuaugacag

SEQ ID NO: 353245 - RNA, 22 nt, Homo sapiens
cucagauacuugggagguugag

SEQ ID NO: 353246 - RNA, 22 nt, Homo sapiens
cucagcaguggauuuaccacca

SEQ ID NO: 353247 - RNA, 20 nt, Homo sapiens
cucagguauuugaggcugca

SEQ ID NO: 353248 - RNA, 22 nt, Homo sapiens
cucaguacuugcacagaagaac

SEQ ID NO: 353249 - RNA, 22 nt, Homo sapiens
cucaguguucccauucuaccuu

SEQ ID NO: 353250 - RNA, 22 nt, Homo sapiens
cuccaugagauuguugaaguag

SEQ ID NO: 353251 - RNA, 22 nt, Homo sapiens
cuccauguggcuaacuuuuaaa

SEQ ID NO: 353252 - RNA, 22 nt, Homo sapiens
cucccauugcaaacaacagaag

SEQ ID NO: 353253 - RNA, 22 nt, Homo sapiens
cucccuuugcugaauguuuuuc

SEQ ID NO: 353254 - RNA, 17 nt, Homo sapiens
cucucugguuuaaagca

SEQ ID NO: 353255 - RNA, 22 nt, Homo sapiens
cucucuguuugucuguuauugg

SEQ ID NO: 353256 - RNA, 22 nt, Homo sapiens
gucagugccugucccaggcuuu

SEQ ID NO: 353257 - RNA, 22 nt, Homo sapiens
gucagugucuuugcagcucaga

SEQ ID NO: 353258 - RNA, 22 nt, Homo sapiens
gucaguucuugugguugcauuc

SEQ ID NO: 353259 - RNA, 22 nt, Homo sapiens
gucaguuugguuaaucauucca

SEQ ID NO: 353260 - RNA, 22 nt, Homo sapiens
gucauauaggguuuaccuguau

SEQ ID NO: 353261 - RNA, 22 nt, Homo sapiens
gucauggagggacauaacuaac

SEQ ID NO: 353262 - RNA, 22 nt, Homo sapiens
gucauggguuaaagguggauac

SEQ ID NO: 353263 - RNA, 22 nt, Homo sapiens
gucauugcuuaucugcugacgu

SEQ ID NO: 353264 - RNA, 20 nt, Homo sapiens
guccauuugcugccauugcu

SEQ ID NO: 353265 - RNA, 22 nt, Homo sapiens
gucucacagcuagcugcuuuau

SEQ ID NO: 353266 - RNA, 22 nt, Homo sapiens
gucucccaaccccugugcccag

SEQ ID NO: 353267 - RNA, 22 nt, Homo sapiens
gucucccagccuacaucuuucu

SEQ ID NO: 353268 - RNA, 22 nt, Homo sapiens
gucucuugguuuagagcauuua

SEQ ID NO: 353269 - RNA, 22 nt, Homo sapiens
gucuggcuccugucuaaucacu

SEQ ID NO: 353270 - RNA, 21 nt, Homo sapiens
gucuuacagccagaugccucu

SEQ ID NO: 353271 - RNA, 22 nt, Homo sapiens
gucuuggagaacucagcuuggc

SEQ ID NO: 353272 - RNA, 22 nt, Homo sapiens
gucuuggcaugugcagcuggga

SEQ ID NO: 353273 - RNA, 20 nt, Homo sapiens
gucuuguagcucaaguuauu

SEQ ID NO: 353274 - RNA, 22 nt, Homo sapiens
gucuuuguuuggucuguaucag

SEQ ID NO: 353275 - RNA, 22 nt, Homo sapiens
gugaaaagaugagcaccauaca

SEQ ID NO: 353276 - RNA, 22 nt, Homo sapiens
gugaaacuggguggugagagac

SEQ ID NO: 353277 - RNA, 22 nt, Homo sapiens
gugaaagacauauaugguuuga

SEQ ID NO: 353278 - RNA, 22 nt, Homo sapiens
gugaaauguguagaggaucugg

SEQ ID NO: 353279 - RNA, 22 nt, Homo sapiens
gugaacaauguuuuauccuggg

SEQ ID NO: 353280 - RNA, 22 nt, Homo sapiens
gugaacagaaccugggaucgaa

SEQ ID NO: 353281 - RNA, 22 nt, Homo sapiens
gugaaucuguuuucuucuguuc

SEQ ID NO: 353282 - RNA, 22 nt, Homo sapiens
gugacauuuuuacugaugagag

SEQ ID NO: 353283 - RNA, 22 nt, Homo sapiens
gugaccaaagauagcucaaguu

SEQ ID NO: 353284 - RNA, 22 nt, Homo sapiens
gugagaagaaaaauauggcugu

SEQ ID NO: 353285 - RNA, 22 nt, Homo sapiens
gugagaccaauguacuaccuuc

SEQ ID NO: 353286 - RNA, 22 nt, Homo sapiens
gugagacugaguuucgcucuug

SEQ ID NO: 353287 - RNA, 22 nt, Homo sapiens
gugagaggaggcagcuuuuaca

SEQ ID NO: 353288 - RNA, 22 nt, Homo sapiens
gugagcaauugauacuugaagu

SEQ ID NO: 353289 - RNA, 22 nt, Homo sapiens
gugagcacugaaagaaggcaag

SEQ ID NO: 353290 - RNA, 22 nt, Homo sapiens
gugagcauucaaggaaggagcu

SEQ ID NO: 353291 - RNA, 22 nt, Homo sapiens
gugagcuccucuucugcugcag

SEQ ID NO: 353292 - RNA, 22 nt, Homo sapiens
gugaggaaggaaaccugcuagc

SEQ ID NO: 353293 - RNA, 22 nt, Homo sapiens
gugagggaugugaaaaagguca

SEQ ID NO: 353294 - RNA, 21 nt, Homo sapiens
gugaggucauugggcuuucug

SEQ ID NO: 353295 - RNA, 22 nt, Homo sapiens
gugagguugaaaauaauggaaa

SEQ ID NO: 353296 - RNA, 22 nt, Homo sapiens
gugaguuauuauuuauguaaac

SEQ ID NO: 353297 - RNA, 22 nt, Homo sapiens
gugaucaugauccugaagcauu

SEQ ID NO: 353298 - RNA, 22 nt, Homo sapiens
gugcaaauguuauugagguuuu

SEQ ID NO: 353299 - RNA, 22 nt, Homo sapiens
gugcaacaucccuccauaauuu

SEQ ID NO: 353300 - RNA, 22 nt, Homo sapiens
gugcaagagugauugcaguuuu

SEQ ID NO: 353301 - RNA, 22 nt, Homo sapiens
gugcacaacgugcaaguuuguu

SEQ ID NO: 353302 - RNA, 22 nt, Homo sapiens
gugcacaugguagguauugagu

SEQ ID NO: 353303 - RNA, 22 nt, Homo sapiens
gugcacuguagaacccuuuguu

SEQ ID NO: 353304 - RNA, 22 nt, Homo sapiens
gugcaguuuacaguuacccagu

SEQ ID NO: 353305 - RNA, 22 nt, Homo sapiens
gugcaguuugaaaguagaaaca

SEQ ID NO: 353306 - RNA, 22 nt, Homo sapiens
gugcaguuuuaagugaguuucu

SEQ ID NO: 353307 - RNA, 22 nt, Homo sapiens
gugcaguuuugagugaguuucu

SEQ ID NO: 353308 - RNA, 19 nt, Homo sapiens
gugcauaguuauuaaagag

SEQ ID NO: 353309 - RNA, 22 nt, Homo sapiens
gugcauaugcaugugcaugcac

SEQ ID NO: 353310 - RNA, 22 nt, Homo sapiens
gugccacaguguuaagggauuc

SEQ ID NO: 353311 - RNA, 22 nt, Homo sapiens
gugcgggaggcgcgccuaggug

SEQ ID NO: 353312 - RNA, 22 nt, Homo sapiens
gugcuaggugcuaggaagauag

SEQ ID NO: 353313 - RNA, 21 nt, Homo sapiens
guggaaauggaauuuacuaau

SEQ ID NO: 353314 - RNA, 22 nt, Homo sapiens
guggaagcacaggccuccugga

SEQ ID NO: 353315 - RNA, 22 nt, Homo sapiens
guggaagguaaugcagcuuacu

SEQ ID NO: 353316 - RNA, 22 nt, Homo sapiens
guggaaggucaugaauguucuu

SEQ ID NO: 353317 - RNA, 22 nt, Homo sapiens
guggaagucuuugguauuggua

SEQ ID NO: 353318 - RNA, 22 nt, Homo sapiens
guggaauggaaugauuguguau

SEQ ID NO: 353319 - RNA, 22 nt, Homo sapiens
guggacggagguugcagugagc

SEQ ID NO: 353320 - RNA, 22 nt, Homo sapiens
guggaggacuggauaaagaaaa

SEQ ID NO: 353321 - RNA, 22 nt, Homo sapiens
guggaggagaaagaagcauuuc

SEQ ID NO: 353322 - RNA, 22 nt, Homo sapiens
guggagucaucacucagagugg

SEQ ID NO: 353323 - RNA, 22 nt, Homo sapiens
guggcaagaauguacaaaaggu

SEQ ID NO: 353324 - RNA, 22 nt, Homo sapiens
guggcagaacagguaggguucu

SEQ ID NO: 353325 - RNA, 22 nt, Homo sapiens
guggcagcacauauagguuguu

SEQ ID NO: 353326 - RNA, 22 nt, Homo sapiens
guggcaguuuuaaauaugaaaa

SEQ ID NO: 353327 - RNA, 22 nt, Homo sapiens
guggcuaaagauuuggaaucug

SEQ ID NO: 353328 - RNA, 22 nt, Homo sapiens
gugggcucguucguguuagaca

SEQ ID NO: 353329 - RNA, 22 nt, Homo sapiens
guggguaaaucucuggggcucu

SEQ ID NO: 353330 - RNA, 22 nt, Homo sapiens
gugguauaaguaccuccuuuca

SEQ ID NO: 353331 - RNA, 22 nt, Homo sapiens
gugguucuagaauugaguaucc

SEQ ID NO: 353332 - RNA, 22 nt, Homo sapiens
guguauauccuauuaguucugu

SEQ ID NO: 353333 - RNA, 22 nt, Homo sapiens
guguauguuucucccugucccu

SEQ ID NO: 353334 - RNA, 22 nt, Homo sapiens
gugucaugaagguuuuaugcag

SEQ ID NO: 353335 - RNA, 19 nt, Homo sapiens
gugugcauaucacagagca

SEQ ID NO: 353336 - RNA, 22 nt, Homo sapiens
gugugcauaugucuuuauagua

SEQ ID NO: 353337 - RNA, 22 nt, Homo sapiens
gugugcucaucacaugcaauag

SEQ ID NO: 353338 - RNA, 22 nt, Homo sapiens
guguggaacucaauacaacgca

SEQ ID NO: 353339 - RNA, 22 nt, Homo sapiens
guguggcaggugggggcucaga

SEQ ID NO: 353340 - RNA, 22 nt, Homo sapiens
guguucaaauucugacagagag

SEQ ID NO: 353341 - RNA, 22 nt, Homo sapiens
guuaagaaguguaacuuaaguu

SEQ ID NO: 353342 - RNA, 22 nt, Homo sapiens
guuauggaguauaugugaacug

SEQ ID NO: 353343 - RNA, 21 nt, Homo sapiens
guucaagugauccuccugucu

SEQ ID NO: 353344 - RNA, 20 nt, Homo sapiens
guucacagagguuaugauua

SEQ ID NO: 353345 - RNA, 22 nt, Homo sapiens
guucagguauucuggaacagag

SEQ ID NO: 353346 - RNA, 22 nt, Homo sapiens
guucaguaguucauucauuuau

SEQ ID NO: 353347 - RNA, 22 nt, Homo sapiens
guuguauaggcauggggagaau

SEQ ID NO: 353348 - RNA, 22 nt, Homo sapiens
guugugcuuaagccuauugauu

SEQ ID NO: 353349 - RNA, 22 nt, Homo sapiens
guuugcauagugcugggagggg

SEQ ID NO: 353350 - RNA, 22 nt, Homo sapiens
uaaacugcuugaggguaaguac

SEQ ID NO: 353351 - RNA, 22 nt, Homo sapiens
uaaacugucuugcaguuacaug

SEQ ID NO: 353352 - RNA, 15 nt, Homo sapiens
aaacccugucucaag

SEQ ID NO: 353353 - RNA, 22 nt, Homo sapiens
aaacugucuucugacaguuucc

SEQ ID NO: 353354 - RNA, 22 nt, Homo sapiens
aaagagaucuaugggcacuaug

SEQ ID NO: 353355 - RNA, 22 nt, Homo sapiens
aaaggcacugugacuuuauagg

SEQ ID NO: 353356 - RNA, 22 nt, Homo sapiens
aaaggcaucauuaguaccaagu

SEQ ID NO: 353357 - RNA, 22 nt, Homo sapiens
cuauuagguuggugcaaaaguc

SEQ ID NO: 353358 - RNA, 22 nt, Homo sapiens
cuauuugguuggugaaaaaagu

SEQ ID NO: 353359 - RNA, 22 nt, Homo sapiens
cucaaagugcugggacuggcug

SEQ ID NO: 353360 - RNA, 22 nt, Homo sapiens
cucacagucucucccuaauuuu

SEQ ID NO: 353361 - RNA, 20 nt, Homo sapiens
cucaccagguguaggcugag

SEQ ID NO: 353362 - RNA, 22 nt, Homo sapiens
cucaggguacuucuccuuugcu

SEQ ID NO: 353363 - RNA, 22 nt, Homo sapiens
cucagggugguggacucuaaua

SEQ ID NO: 353364 - RNA, 22 nt, Homo sapiens
cucagucuaugauacuuugcua

SEQ ID NO: 353365 - RNA, 22 nt, Homo sapiens
cucagugaagggcaagaggcaa

SEQ ID NO: 353366 - RNA, 22 nt, Homo sapiens
cucaguguuaaggccaccucug

SEQ ID NO: 353367 - RNA, 21 nt, Homo sapiens
cucauauugcuuuuccauggu

SEQ ID NO: 353368 - RNA, 22 nt, Homo sapiens
cucauuaguuguuuuaagauga

SEQ ID NO: 353369 - RNA, 22 nt, Homo sapiens
cucccagagccaguuauaggcu

SEQ ID NO: 353370 - RNA, 22 nt, Homo sapiens
cucccagugacccaggaacagg

SEQ ID NO: 353371 - RNA, 22 nt, Homo sapiens
cuccccuuuaguuucuuaauaa

SEQ ID NO: 353372 - RNA, 23 nt, Homo sapiens
cucccugaacaugacacaccaga

SEQ ID NO: 353373 - RNA, 22 nt, Homo sapiens
cucucaguguggaggccagaaa

SEQ ID NO: 353374 - RNA, 21 nt, Homo sapiens
cucucugcuuaugaauaguga

SEQ ID NO: 353375 - RNA, 22 nt, Homo sapiens
cucugacagugguuagcacugu

SEQ ID NO: 353376 - RNA, 22 nt, Homo sapiens
cucugagguuauucguaauauu

SEQ ID NO: 353377 - RNA, 20 nt, Homo sapiens
cucugguugugaauugucuu

SEQ ID NO: 353378 - RNA, 19 nt, Homo sapiens
cugaaacacagagagggcu

SEQ ID NO: 353379 - RNA, 22 nt, Homo sapiens
cugaaagagcauguaacacagu

SEQ ID NO: 353380 - RNA, 22 nt, Homo sapiens
cugaaaucagccaguuaguuuc

SEQ ID NO: 353381 - RNA, 22 nt, Homo sapiens
cugaaaugaauuauuuucuuuc

SEQ ID NO: 353382 - RNA, 22 nt, Homo sapiens
cugaagugugaaagucuuuuuu

SEQ ID NO: 353383 - RNA, 22 nt, Homo sapiens
cugaaucauugcauuaucaagg

SEQ ID NO: 353384 - RNA, 22 nt, Homo sapiens
cugaauguccaggcagagguuu

SEQ ID NO: 353385 - RNA, 22 nt, Homo sapiens
accaucuagauuuguguaggua

SEQ ID NO: 353386 - RNA, 22 nt, Homo sapiens
accauugcacuccaaccugggc

SEQ ID NO: 353387 - RNA, 22 nt, Homo sapiens
aaaagagcugagagguauucuu

SEQ ID NO: 353388 - RNA, 22 nt, Homo sapiens
aaaagucuguagugaaagguga

SEQ ID NO: 353389 - RNA, 20 nt, Homo sapiens
aaacucugucuucuuuauca

SEQ ID NO: 353390 - RNA, 22 nt, Homo sapiens
aaacugucuggaugcuugugga

SEQ ID NO: 353391 - RNA, 22 nt, Homo sapiens
aaagcaucacuuuuccuacuuu

SEQ ID NO: 353392 - RNA, 22 nt, Homo sapiens
aaagcuaagguagcauuggaga

SEQ ID NO: 353393 - RNA, 22 nt, Homo sapiens
aaagcuaccagauucuguugga

SEQ ID NO: 353394 - RNA, 22 nt, Homo sapiens
aaaggcacugaucuuauccagu

SEQ ID NO: 353395 - RNA, 22 nt, Homo sapiens
aaaggcaucugcucggcucccu

SEQ ID NO: 353396 - RNA, 22 nt, Homo sapiens
aaaggcuucggaucagaaggua

SEQ ID NO: 353397 - RNA, 19 nt, Homo sapiens
aaagguaguaaccucugau

SEQ ID NO: 353398 - RNA, 22 nt, Homo sapiens
aaaguacucaguucaguuccgu

SEQ ID NO: 353399 - RNA, 22 nt, Homo sapiens
aaagucuguuacagcuauuucu

SEQ ID NO: 353400 - RNA, 22 nt, Homo sapiens
aaagugaauguaucccguaagu

SEQ ID NO: 353401 - RNA, 18 nt, Homo sapiens
aaagugaugucauucuuu

SEQ ID NO: 353402 - RNA, 22 nt, Homo sapiens
aaagugauguccaggcuuucag

SEQ ID NO: 353403 - RNA, 22 nt, Homo sapiens
aaagugcugagaguucuaacuu

SEQ ID NO: 353404 - RNA, 22 nt, Homo sapiens
aaagugcuucucuuuggugggu

SEQ ID NO: 353405 - RNA, 22 nt, Homo sapiens
aaaguucuguugauagugcuga

SEQ ID NO: 353406 - RNA, 22 nt, Homo sapiens
aaauaacugucagguucuggaa

SEQ ID NO: 353407 - RNA, 22 nt, Homo sapiens
aaauccauuuguucagcuaugc

SEQ ID NO: 353408 - RNA, 22 nt, Homo sapiens
aaaugcagauucugcuuagguu

SEQ ID NO: 353409 - RNA, 22 nt, Homo sapiens
aaaugccucccauucuacugac

SEQ ID NO: 353410 - RNA, 20 nt, Homo sapiens
uauugccuaaauaccagaau

SEQ ID NO: 353411 - RNA, 22 nt, Homo sapiens
uauuggcucuguuucucugaag

SEQ ID NO: 353412 - RNA, 22 nt, Homo sapiens
uauuguacauguuauagauuuu

SEQ ID NO: 353413 - RNA, 22 nt, Homo sapiens
cugacacuucaaaacugccaau

SEQ ID NO: 353414 - RNA, 22 nt, Homo sapiens
cugacaugcagccacugcaccu

SEQ ID NO: 353415 - RNA, 22 nt, Homo sapiens
cugaccucugucaaagacaccc

SEQ ID NO: 353416 - RNA, 22 nt, Homo sapiens
cugacugugcaugcccagcccc

SEQ ID NO: 353417 - RNA, 22 nt, Homo sapiens
cugagaauguaaaugaagcuuu

SEQ ID NO: 353418 - RNA, 22 nt, Homo sapiens
cugagacuggguaauguauaaa

SEQ ID NO: 353419 - RNA, 22 nt, Homo sapiens
cugagauaauuucuagguguca

SEQ ID NO: 353420 - RNA, 22 nt, Homo sapiens
cugagaucguggggcugcuguc

SEQ ID NO: 353421 - RNA, 22 nt, Homo sapiens
cugagauuuuuagauccuggcg

SEQ ID NO: 353422 - RNA, 22 nt, Homo sapiens
cugagcaaaguucuauuuaugg

SEQ ID NO: 353423 - RNA, 22 nt, Homo sapiens
cugagcaauauagugagaucuu

SEQ ID NO: 353424 - RNA, 22 nt, Homo sapiens
cugagguacccacuucaucuca

SEQ ID NO: 353425 - RNA, 22 nt, Homo sapiens
cugagguacugggggccaggau

SEQ ID NO: 353426 - RNA, 22 nt, Homo sapiens
cugaggugggaggauuacuuga

SEQ ID NO: 353427 - RNA, 22 nt, Homo sapiens
cugauaguucucuuuagaguuu

SEQ ID NO: 353428 - RNA, 22 nt, Homo sapiens
cugauugugcagagguguaauu

SEQ ID NO: 353429 - RNA, 22 nt, Homo sapiens
cugcaaauacuugugggauuuu

SEQ ID NO: 353430 - RNA, 22 nt, Homo sapiens
cugcaagaaucguaguauuuga

SEQ ID NO: 353431 - RNA, 20 nt, Homo sapiens
cugcacauccacucuacuuc

SEQ ID NO: 353432 - RNA, 19 nt, Homo sapiens
cugcacugagaaaaggagg

SEQ ID NO: 353433 - RNA, 22 nt, Homo sapiens
cugcagguaggggcagcuuugg

SEQ ID NO: 353434 - RNA, 22 nt, Homo sapiens
cugcagucaucugaagauuuug

SEQ ID NO: 353435 - RNA, 22 nt, Homo sapiens
cugccacugacaccucaaggac

SEQ ID NO: 353436 - RNA, 22 nt, Homo sapiens
cugcccuuucuauaugauguaa

SEQ ID NO: 353437 - RNA, 22 nt, Homo sapiens
cugcuggucuuuaaggucuagg

SEQ ID NO: 353438 - RNA, 22 nt, Homo sapiens
cuggaaaguagacaaucuaaaa

SEQ ID NO: 353439 - RNA, 22 nt, Homo sapiens
cuggaagaaaaucacgccaucu

SEQ ID NO: 353440 - RNA, 22 nt, Homo sapiens
cuggaaggaaaaacaaccacag

SEQ ID NO: 353441 - RNA, 22 nt, Homo sapiens
cuggaauguuccuaaagauuca

SEQ ID NO: 353442 - RNA, 22 nt, Homo sapiens
cuggagcaaaggugacucuugu

SEQ ID NO: 353443 - RNA, 22 nt, Homo sapiens
cuggagcauugguggauuuguu

SEQ ID NO: 353444 - RNA, 22 nt, Homo sapiens
cuggaguaugaaccauguauca

SEQ ID NO: 353445 - RNA, 22 nt, Homo sapiens
cuggauggugagauaaagaaaa

SEQ ID NO: 353446 - RNA, 22 nt, Homo sapiens
cuggcaccauuuugaucaaagg

SEQ ID NO: 353447 - RNA, 22 nt, Homo sapiens
cuggcagucugccucuucacug

SEQ ID NO: 353448 - RNA, 22 nt, Homo sapiens
cuggccagagacauucauuaaa

SEQ ID NO: 353449 - RNA, 22 nt, Homo sapiens
cuggcccaguucugcguuuugc

SEQ ID NO: 353450 - RNA, 22 nt, Homo sapiens
cuggcucugagguguuuagggc

SEQ ID NO: 353451 - RNA, 22 nt, Homo sapiens
cuggcucugggcuaaagaaaua

SEQ ID NO: 353452 - RNA, 22 nt, Homo sapiens
cuggcucuguuagaagaaccag

SEQ ID NO: 353453 - RNA, 22 nt, Homo sapiens
cuggcugagugguaaguagagg

SEQ ID NO: 353454 - RNA, 22 nt, Homo sapiens
cugguuuguaaaguuccugaga

SEQ ID NO: 353455 - RNA, 22 nt, Homo sapiens
cuguaagcauuauaaagagaua

SEQ ID NO: 353456 - RNA, 22 nt, Homo sapiens
cuguaaggcacuaagcauaugu

SEQ ID NO: 353457 - RNA, 19 nt, Homo sapiens
cugucacugaggaagacug

SEQ ID NO: 353458 - RNA, 22 nt, Homo sapiens
cugucaucauuucuaugugcca

SEQ ID NO: 353459 - RNA, 22 nt, Homo sapiens
cugucuaugagccaggaagcca

SEQ ID NO: 353460 - RNA, 22 nt, Homo sapiens
cugucucagugaauugguuuua

SEQ ID NO: 353461 - RNA, 22 nt, Homo sapiens
cugugaucuuuuuucauguggu

SEQ ID NO: 353462 - RNA, 17 nt, Homo sapiens
cugugaugaucuugucu

SEQ ID NO: 353463 - RNA, 22 nt, Homo sapiens
cugugcaaacaagugaaccccu

SEQ ID NO: 353464 - RNA, 22 nt, Homo sapiens
cugugcauaucuuggacugugu

SEQ ID NO: 353465 - RNA, 22 nt, Homo sapiens
cugugcauuggaugucucccug

SEQ ID NO: 353466 - RNA, 22 nt, Homo sapiens
cugugccaagcuugcgaugugc

SEQ ID NO: 353467 - RNA, 22 nt, Homo sapiens
cugugcuugagagaugacacag

SEQ ID NO: 353468 - RNA, 23 nt, Homo sapiens
cuguggauaugaguuguaaaugg

SEQ ID NO: 353469 - RNA, 22 nt, Homo sapiens
cuguugcaguuauggcugcagg

SEQ ID NO: 353470 - RNA, 20 nt, Homo sapiens
cuuaucaguggcaaguauaa

SEQ ID NO: 353471 - RNA, 20 nt, Homo sapiens
cuuccaguggccccaucuuu

SEQ ID NO: 353472 - RNA, 22 nt, Homo sapiens
cuuccugaguccugggcucaca

SEQ ID NO: 353473 - RNA, 22 nt, Homo sapiens
cuucugauugaaaauggaguag

SEQ ID NO: 353474 - RNA, 22 nt, Homo sapiens
cuugacaaugcuucaggcugaa

SEQ ID NO: 353475 - RNA, 22 nt, Homo sapiens
cuugagcauauucuauauuaaa

SEQ ID NO: 353476 - RNA, 22 nt, Homo sapiens
cuugcacuagugcagaggcgcu

SEQ ID NO: 353477 - RNA, 22 nt, Homo sapiens
cuugcacuccacuguucuccug

SEQ ID NO: 353478 - RNA, 22 nt, Homo sapiens
cuugccuuugucuucaaaggcu

SEQ ID NO: 353479 - RNA, 21 nt, Homo sapiens
cuugucuugcuuagaauagac

SEQ ID NO: 353480 - RNA, 22 nt, Homo sapiens
cuuguggugcuuuuacgugggc

SEQ ID NO: 353481 - RNA, 22 nt, Homo sapiens
cuuuacacauccuaaccagugu

SEQ ID NO: 353482 - RNA, 22 nt, Homo sapiens
uauuguuaaagauguuaaugau

SEQ ID NO: 353483 - RNA, 22 nt, Homo sapiens
uauuucccuuaacuuuccugca

SEQ ID NO: 353484 - RNA, 22 nt, Homo sapiens
uauuugcacucccaucauggug

SEQ ID NO: 353485 - RNA, 22 nt, Homo sapiens
uauuugguuacuugaauagcua

SEQ ID NO: 353486 - RNA, 22 nt, Homo sapiens
ucaaagugagcuccuucucacu

SEQ ID NO: 353487 - RNA, 22 nt, Homo sapiens
ucaaaucaucuuuuccaaagcu

SEQ ID NO: 353488 - RNA, 22 nt, Homo sapiens
ucaaaugaucugcccgccuugg

SEQ ID NO: 353489 - RNA, 23 nt, Homo sapiens
ucaagugaugguggccacaaggg

SEQ ID NO: 353490 - RNA, 22 nt, Homo sapiens
ucaaugcaaccuccaccucugg

SEQ ID NO: 353491 - RNA, 22 nt, Homo sapiens
ucaauguaucuccaagaauuga

SEQ ID NO: 353492 - RNA, 18 nt, Homo sapiens
ucaauguggauguucuuu

SEQ ID NO: 353493 - RNA, 22 nt, Homo sapiens
ucaauugcuuaugaagauacau

SEQ ID NO: 353494 - RNA, 18 nt, Homo sapiens
ucacaaccacagugcugu

SEQ ID NO: 353495 - RNA, 22 nt, Homo sapiens
ucacaauggcugaacuaauuua

SEQ ID NO: 353496 - RNA, 22 nt, Homo sapiens
ucacaauucacuacaggcuuga

SEQ ID NO: 353497 - RNA, 22 nt, Homo sapiens
ucacaccauucuucuacuucag

SEQ ID NO: 353498 - RNA, 22 nt, Homo sapiens
ucacacucucaccaacauuugg

SEQ ID NO: 353499 - RNA, 22 nt, Homo sapiens
ucacacugcaucuguuggaauu

SEQ ID NO: 353500 - RNA, 19 nt, Homo sapiens
ucacacuguggcuucuuua

SEQ ID NO: 353501 - RNA, 21 nt, Homo sapiens
ucacagccuaggaccugaaga

SEQ ID NO: 353502 - RNA, 19 nt, Homo sapiens
ucacaggguugacuugagg

SEQ ID NO: 353503 - RNA, 18 nt, Homo sapiens
ucacagguaaaguugaca

SEQ ID NO: 353504 - RNA, 22 nt, Homo sapiens
ucacagucuccucuagggaggg

SEQ ID NO: 353505 - RNA, 22 nt, Homo sapiens
ucacagugaguggaguggggug

SEQ ID NO: 353506 - RNA, 22 nt, Homo sapiens
ucacauagcugaguaaaaugga

SEQ ID NO: 353507 - RNA, 22 nt, Homo sapiens
ucacaucucagguuucuugaca

SEQ ID NO: 353508 - RNA, 22 nt, Homo sapiens
ucacaugcacaucucuggaacc

SEQ ID NO: 353509 - RNA, 22 nt, Homo sapiens
ucacauggggaagggacuagcu

SEQ ID NO: 353510 - RNA, 22 nt, Homo sapiens
ucacaugugaagauugggagua

SEQ ID NO: 353511 - RNA, 22 nt, Homo sapiens
ucacaugugacauauauauuug

SEQ ID NO: 353512 - RNA, 22 nt, Homo sapiens
ucacaugugcguuuuggcaugu

SEQ ID NO: 353513 - RNA, 22 nt, Homo sapiens
ucacauuguuauguaaauguuu

SEQ ID NO: 353514 - RNA, 22 nt, Homo sapiens
ucacccacacaggagacaggga

SEQ ID NO: 353515 - RNA, 22 nt, Homo sapiens
ucacccugacaugcggccgaac

SEQ ID NO: 353516 - RNA, 22 nt, Homo sapiens
ucaccuggagccuucacauucu

SEQ ID NO: 353517 - RNA, 21 nt, Homo sapiens
ucaccuguagcugcauguucu

SEQ ID NO: 353518 - RNA, 22 nt, Homo sapiens
ucacgugcucuuguguguucug

SEQ ID NO: 353519 - RNA, 22 nt, Homo sapiens
ucacugaaaccgccuccaccuc

SEQ ID NO: 353520 - RNA, 21 nt, Homo sapiens
ucacugagguuaaauaggguu

SEQ ID NO: 353521 - RNA, 20 nt, Homo sapiens
ucacugagugguccacagua

SEQ ID NO: 353522 - RNA, 22 nt, Homo sapiens
ucacugcacuagguaaugccac

SEQ ID NO: 353523 - RNA, 22 nt, Homo sapiens
ucacugcacuccagccuuuaug

SEQ ID NO: 353524 - RNA, 22 nt, Homo sapiens
ucacugcacuucaggcuuucuc

SEQ ID NO: 353525 - RNA, 22 nt, Homo sapiens
ucacugcgaccuccaccuccug

SEQ ID NO: 353526 - RNA, 22 nt, Homo sapiens
ucacuggacagaaauaaaggug

SEQ ID NO: 353527 - RNA, 22 nt, Homo sapiens
ucacuggcaaauauauccguug

SEQ ID NO: 353528 - RNA, 22 nt, Homo sapiens
ucacugggagaccaaagccauc

SEQ ID NO: 353529 - RNA, 22 nt, Homo sapiens
ucacugugagaguuuauccugu

SEQ ID NO: 353530 - RNA, 22 nt, Homo sapiens
ucacuguggaacucaaaaagcu

SEQ ID NO: 353531 - RNA, 22 nt, Homo sapiens
ucacuuugacggccaacuucua

SEQ ID NO: 353532 - RNA, 22 nt, Homo sapiens
ucagaauguaacuuuaguugga

SEQ ID NO: 353533 - RNA, 22 nt, Homo sapiens
ucagacacugagcaaacgacua

SEQ ID NO: 353534 - RNA, 22 nt, Homo sapiens
ucagagugguuguaccauuuga

SEQ ID NO: 353535 - RNA, 22 nt, Homo sapiens
ucagaguguuuuccaacuuggu

SEQ ID NO: 353536 - RNA, 22 nt, Homo sapiens
ucagaucaguuccacaagaacu

SEQ ID NO: 353537 - RNA, 22 nt, Homo sapiens
ucagaugaugucccuguucuaa

SEQ ID NO: 353538 - RNA, 19 nt, Homo sapiens
ucagaugcauuagggguua

SEQ ID NO: 353539 - RNA, 22 nt, Homo sapiens
ucagauugaugcauacuuaaau

SEQ ID NO: 353540 - RNA, 22 nt, Homo sapiens
ucagcacauucaaggccugccu

SEQ ID NO: 353541 - RNA, 20 nt, Homo sapiens
ucagcagucuggagcagagg

SEQ ID NO: 353542 - RNA, 22 nt, Homo sapiens
ucagcaguggacagaaugguag

SEQ ID NO: 353543 - RNA, 22 nt, Homo sapiens
ucagcagugugaaaauggacua

SEQ ID NO: 353544 - RNA, 20 nt, Homo sapiens
ucaggcuccgcauuaacuua

SEQ ID NO: 353545 - RNA, 22 nt, Homo sapiens
ucaggcuuuucccagagugaug

SEQ ID NO: 353546 - RNA, 22 nt, Homo sapiens
ucagguaaucuauuugucuuuu

SEQ ID NO: 353547 - RNA, 22 nt, Homo sapiens
ucaggucauuccaggagggcca

SEQ ID NO: 353548 - RNA, 22 nt, Homo sapiens
ucaggugcagagaagaaauggg

SEQ ID NO: 353549 - RNA, 22 nt, Homo sapiens
ucaggugccuuggcuaauuguu

SEQ ID NO: 353550 - RNA, 22 nt, Homo sapiens
ucagguugcuaaguauaauauu

SEQ ID NO: 353551 - RNA, 22 nt, Homo sapiens
ucaguagcauugcuuauacagu

SEQ ID NO: 353552 - RNA, 19 nt, Homo sapiens
ucaguagugcacauaagcc

SEQ ID NO: 353553 - RNA, 22 nt, Homo sapiens
ucagugauugcuuucauggaaa

SEQ ID NO: 353554 - RNA, 20 nt, Homo sapiens
ucagugauugguuuaguuau

SEQ ID NO: 353555 - RNA, 22 nt, Homo sapiens
ucagugccucaguuuuuaaaga

SEQ ID NO: 353556 - RNA, 22 nt, Homo sapiens
ucauaugucauaguaugaucuu

SEQ ID NO: 353557 - RNA, 21 nt, Homo sapiens
ucaucaagcuguagacaugau

SEQ ID NO: 353558 - RNA, 21 nt, Homo sapiens
ucaucagucaaagacaauggu

SEQ ID NO: 353559 - RNA, 22 nt, Homo sapiens
ucauggggugagcuacaggcac

SEQ ID NO: 353560 - RNA, 22 nt, Homo sapiens
ucauguguugcacugaggaccu

SEQ ID NO: 353561 - RNA, 22 nt, Homo sapiens
ucauuagagacagggugucacu

SEQ ID NO: 353562 - RNA, 22 nt, Homo sapiens
ucauugcacuucuuuaguugca

SEQ ID NO: 353563 - RNA, 22 nt, Homo sapiens
ucauugcauguuaauuaaacag

SEQ ID NO: 353564 - RNA, 22 nt, Homo sapiens
uccaaaucucuggcacugggau

SEQ ID NO: 353565 - RNA, 22 nt, Homo sapiens
uccacuuuugugcugaauugga

SEQ ID NO: 353566 - RNA, 22 nt, Homo sapiens
uccaguguuauaauaugcgucu

SEQ ID NO: 353567 - RNA, 22 nt, Homo sapiens
uccauaguugcacucuggagcc

SEQ ID NO: 353568 - RNA, 22 nt, Homo sapiens
uccauguagaagacaggggaga

SEQ ID NO: 353569 - RNA, 22 nt, Homo sapiens
uccauuuguucagcuucaggaa

SEQ ID NO: 353570 - RNA, 22 nt, Homo sapiens
ucccaagaugagaugggggcug

SEQ ID NO: 353571 - RNA, 22 nt, Homo sapiens
ucccuacugggguacugccuag

SEQ ID NO: 353572 - RNA, 22 nt, Homo sapiens
ucccugagcaaaguuuucugua

SEQ ID NO: 353573 - RNA, 19 nt, Homo sapiens
ucccuguagaccacagugc

SEQ ID NO: 353574 - RNA, 22 nt, Homo sapiens
ucccuguguccugggggcaccu

SEQ ID NO: 353575 - RNA, 22 nt, Homo sapiens
uccuacugucuucggggcacug

SEQ ID NO: 353576 - RNA, 22 nt, Homo sapiens
uccugagagcagacccucuaua

SEQ ID NO: 353577 - RNA, 22 nt, Homo sapiens
gugggaugaucacaguucacug

SEQ ID NO: 353578 - RNA, 22 nt, Homo sapiens
gugggguaggcaauuccuagug

SEQ ID NO: 353579 - RNA, 22 nt, Homo sapiens
gugggguaggguaggacucaac

SEQ ID NO: 353580 - RNA, 22 nt, Homo sapiens
guggucagaaaucucaguggca

SEQ ID NO: 353581 - RNA, 22 nt, Homo sapiens
guguaaaugagugcugaaggag

SEQ ID NO: 353582 - RNA, 22 nt, Homo sapiens
guguaauacacacauauaugca

SEQ ID NO: 353583 - RNA, 22 nt, Homo sapiens
guguagagaaaaguaccauuuu

SEQ ID NO: 353584 - RNA, 22 nt, Homo sapiens
guguaugugagaaugcucaugu

SEQ ID NO: 353585 - RNA, 22 nt, Homo sapiens
gugucccagugugcauacaggu

SEQ ID NO: 353586 - RNA, 22 nt, Homo sapiens
gugugacugcucuauuagggcg

SEQ ID NO: 353587 - RNA, 22 nt, Homo sapiens
gugugauuauuucaauugaugc

SEQ ID NO: 353588 - RNA, 22 nt, Homo sapiens
gugugcauggagggggcaguga

SEQ ID NO: 353589 - RNA, 22 nt, Homo sapiens
gugugguauuauaacuagguau

SEQ ID NO: 353590 - RNA, 22 nt, Homo sapiens
gugugucuugaccaggaucgga

SEQ ID NO: 353591 - RNA, 22 nt, Homo sapiens
guguucaaacccaggucugucu

SEQ ID NO: 353592 - RNA, 22 nt, Homo sapiens
guuaaugcuggaauaaguuaag

SEQ ID NO: 353593 - RNA, 22 nt, Homo sapiens
guuacugucuuccugauugcuu

SEQ ID NO: 353594 - RNA, 22 nt, Homo sapiens
guuauguuaaauuguuguaugc

SEQ ID NO: 353595 - RNA, 22 nt, Homo sapiens
guuauguuaguuacaaggcuag

SEQ ID NO: 353596 - RNA, 22 nt, Homo sapiens
guuauguuauguuauguuaugu

SEQ ID NO: 353597 - RNA, 22 nt, Homo sapiens
guuauuaguugauauuaaguuc

SEQ ID NO: 353598 - RNA, 22 nt, Homo sapiens
guuauugcucucgaagacucuc

SEQ ID NO: 353599 - RNA, 22 nt, Homo sapiens
guucaagcaauucugcugccuc

SEQ ID NO: 353600 - RNA, 20 nt, Homo sapiens
guucacaggcuuccuuucag

SEQ ID NO: 353601 - RNA, 22 nt, Homo sapiens
guucacagugguugccuuccag

SEQ ID NO: 353602 - RNA, 22 nt, Homo sapiens
guucacaguuaggacaacugcu

SEQ ID NO: 353603 - RNA, 22 nt, Homo sapiens
guucacaguuucuaaucccagc

SEQ ID NO: 353604 - RNA, 22 nt, Homo sapiens
guucaguuugcugaugcguuga

SEQ ID NO: 353605 - RNA, 22 nt, Homo sapiens
guucaucagggauauuggcuua

SEQ ID NO: 353606 - RNA, 17 nt, Homo sapiens
guucccaguggcauuug

SEQ ID NO: 353607 - RNA, 22 nt, Homo sapiens
guucuggagauaaagccaaggu

SEQ ID NO: 353608 - RNA, 22 nt, Homo sapiens
guugaucuauguugcuggcagu

SEQ ID NO: 353609 - RNA, 20 nt, Homo sapiens
guugaugcugaaguugcuua

SEQ ID NO: 353610 - RNA, 22 nt, Homo sapiens
guugcacagucuuuccuggacu

SEQ ID NO: 353611 - RNA, 22 nt, Homo sapiens
guugcagaguucuuccuccuga

SEQ ID NO: 353612 - RNA, 22 nt, Homo sapiens
guuggcaagaggugcuguacac

SEQ ID NO: 353613 - RNA, 22 nt, Homo sapiens
guuggcaaguggcugagcuggg

SEQ ID NO: 353614 - RNA, 22 nt, Homo sapiens
guuugcacuccuaugagaaucu

SEQ ID NO: 353615 - RNA, 22 nt, Homo sapiens
guuugugcuccuaugagaaucu

SEQ ID NO: 353616 - RNA, 22 nt, Homo sapiens
uaaacacucacuucauagccau

SEQ ID NO: 353617 - RNA, 22 nt, Homo sapiens
uaaaccacguuuacauuugaga

SEQ ID NO: 353618 - RNA, 21 nt, Homo sapiens
uaaagcuagaaccuuagcuuu

SEQ ID NO: 353619 - RNA, 22 nt, Homo sapiens
uaaauugcauaaguacaaauga

SEQ ID NO: 353620 - RNA, 22 nt, Homo sapiens
uaacacagagcuccuaaucccu

SEQ ID NO: 353621 - RNA, 22 nt, Homo sapiens
uaacaccuuugauagcacuuuu

SEQ ID NO: 353622 - RNA, 22 nt, Homo sapiens
uaacagcucuacagcugcucuu

SEQ ID NO: 353623 - RNA, 22 nt, Homo sapiens
uaacaggcaaggucacaccuug

SEQ ID NO: 353624 - RNA, 22 nt, Homo sapiens
uaacaguggucugugguaucug

SEQ ID NO: 353625 - RNA, 22 nt, Homo sapiens
uaacuaaagagaagucaauguc

SEQ ID NO: 353626 - RNA, 22 nt, Homo sapiens
uaacuccauuuggacucaguau

SEQ ID NO: 353627 - RNA, 20 nt, Homo sapiens
uaagacaugguccacaugcc

SEQ ID NO: 353628 - RNA, 22 nt, Homo sapiens
uaagagagcuccaucuuuuccu

SEQ ID NO: 353629 - RNA, 22 nt, Homo sapiens
uaagcagugcaagaauggaaua

SEQ ID NO: 353630 - RNA, 16 nt, Homo sapiens
uaagccccacgugcau

SEQ ID NO: 353631 - RNA, 22 nt, Homo sapiens
uaaggaacucugauaucuggaa

SEQ ID NO: 353632 - RNA, 18 nt, Homo sapiens
uaaggcacuauaggcauu

SEQ ID NO: 353633 - RNA, 22 nt, Homo sapiens
uaaggcuucuuggaauacugca

SEQ ID NO: 353634 - RNA, 22 nt, Homo sapiens
uaaggcuuugucuuaggacuuu

SEQ ID NO: 353635 - RNA, 22 nt, Homo sapiens
uaaggcuuuuguucagcguggg

SEQ ID NO: 353636 - RNA, 22 nt, Homo sapiens
uaagggacgcccccuucucucu

SEQ ID NO: 353637 - RNA, 22 nt, Homo sapiens
uaagguguagacuggucacaag

SEQ ID NO: 353638 - RNA, 22 nt, Homo sapiens
uaaguacaugcuagauggaaug

SEQ ID NO: 353639 - RNA, 22 nt, Homo sapiens
uaaguacuuuacagacauuauc

SEQ ID NO: 353640 - RNA, 19 nt, Homo sapiens
uaaguagaugacugaugcu

SEQ ID NO: 353641 - RNA, 22 nt, Homo sapiens
uaagugaauauggacaguuagc

SEQ ID NO: 353642 - RNA, 22 nt, Homo sapiens
uaagugaauuucacuacugagu

SEQ ID NO: 353643 - RNA, 22 nt, Homo sapiens
uaagugcuguguuguuaccuaa

SEQ ID NO: 353644 - RNA, 20 nt, Homo sapiens
uaagugcuugaugaaugaac

SEQ ID NO: 353645 - RNA, 20 nt, Homo sapiens
uaagugcuuuauauugauua

SEQ ID NO: 353646 - RNA, 22 nt, Homo sapiens
uaagugguguucauucuuuuga

SEQ ID NO: 353647 - RNA, 20 nt, Homo sapiens
uaaguuguauuugucaugaa

SEQ ID NO: 353648 - RNA, 22 nt, Homo sapiens
uaauagagucauuauuauuguu

SEQ ID NO: 353649 - RNA, 22 nt, Homo sapiens
uaaucucagcuacucaggaggc

SEQ ID NO: 353650 - RNA, 22 nt, Homo sapiens
uaaugcacucgaaucauggaau

SEQ ID NO: 353651 - RNA, 22 nt, Homo sapiens
uaaugcuguggucugguuuaaa

SEQ ID NO: 353652 - RNA, 22 nt, Homo sapiens
uaauucuguauguaucagaguu

SEQ ID NO: 353653 - RNA, 22 nt, Homo sapiens
uacaaaguaacaguuccuguau

SEQ ID NO: 353654 - RNA, 22 nt, Homo sapiens
uacaacacugguucgacaugug

SEQ ID NO: 353655 - RNA, 22 nt, Homo sapiens
uacaagcaggaaaugguauaug

SEQ ID NO: 353656 - RNA, 21 nt, Homo sapiens
uacaaugcacaggagagccuc

SEQ ID NO: 353657 - RNA, 22 nt, Homo sapiens
uacaccugaguuugugguuuuc

SEQ ID NO: 353658 - RNA, 22 nt, Homo sapiens
uacagaauauuucugcccugag

SEQ ID NO: 353659 - RNA, 22 nt, Homo sapiens
uacaggcaccuggcuaauuuuu

SEQ ID NO: 353660 - RNA, 22 nt, Homo sapiens
uacaggugcucuacagacagga

SEQ ID NO: 353661 - RNA, 22 nt, Homo sapiens
uacagucacauuccugaccaua

SEQ ID NO: 353662 - RNA, 22 nt, Homo sapiens
uacagugcauagaggcaugaua

SEQ ID NO: 353663 - RNA, 22 nt, Homo sapiens
uacagugcuugguaucuaguaa

SEQ ID NO: 353664 - RNA, 22 nt, Homo sapiens
uacagugcuuuuugguggagaa

SEQ ID NO: 353665 - RNA, 22 nt, Homo sapiens
aaauucaugucaccucuaggua

SEQ ID NO: 353666 - RNA, 22 nt, Homo sapiens
aaccuuuagucagcucuuagga

SEQ ID NO: 353667 - RNA, 21 nt, Homo sapiens
aagcaugguguaucuuuccau

SEQ ID NO: 353668 - RNA, 22 nt, Homo sapiens
aagcucauugagaucuauggcu

SEQ ID NO: 353669 - RNA, 22 nt, Homo sapiens
aauaaagcugaauccuuccuga

SEQ ID NO: 353670 - RNA, 22 nt, Homo sapiens
aauuaggcuagaauguuauuaa

SEQ ID NO: 353671 - RNA, 22 nt, Homo sapiens
agguauuuucaacuuagaaugg

SEQ ID NO: 353672 - RNA, 22 nt, Homo sapiens
agucugguguucucacacuagu

SEQ ID NO: 353673 - RNA, 22 nt, Homo sapiens
auagcaauuugggaaucagacu

SEQ ID NO: 353674 - RNA, 22 nt, Homo sapiens
aucucuugccagucagaauggu

SEQ ID NO: 353675 - RNA, 22 nt, Homo sapiens
auggauguucuagggaugugau

SEQ ID NO: 353676 - RNA, 22 nt, Homo sapiens
auucaaagugcauguucccacu

SEQ ID NO: 353677 - RNA, 22 nt, Homo sapiens
caaaguaauugcuguuuugcca

SEQ ID NO: 353678 - RNA, 22 nt, Homo sapiens
cccaguuuugccacuuacuagc

SEQ ID NO: 353679 - RNA, 20 nt, Homo sapiens
ccccaguuuuucuauuagcu

SEQ ID NO: 353680 - RNA, 22 nt, Homo sapiens
cucaguacuugcacagaagaac

SEQ ID NO: 353681 - RNA, 22 nt, Homo sapiens
cuuuugugauucuucaguuacu

SEQ ID NO: 353682 - RNA, 22 nt, Homo sapiens
gaaaguaauuaacgauuguugc

SEQ ID NO: 353683 - RNA, 22 nt, Homo sapiens
gaaguaggugcuguuauuaucu

SEQ ID NO: 353684 - RNA, 22 nt, Homo sapiens
ggucugguguugaaauucuuca

SEQ ID NO: 353685 - RNA, 22 nt, Homo sapiens
guagaaagcauuucagauuugc

SEQ ID NO: 353686 - RNA, 19 nt, Homo sapiens
guauuugacuuucuuguuu

SEQ ID NO: 353687 - RNA, 22 nt, Homo sapiens
gucugguuccugggagauuucu

SEQ ID NO: 353688 - RNA, 22 nt, Homo sapiens
gucugguuuuuuauauccucac

SEQ ID NO: 353689 - RNA, 22 nt, Homo sapiens
gugaaagcaucugacugugcca

SEQ ID NO: 353690 - RNA, 22 nt, Homo sapiens
gugauacugaugacuuagagaa

SEQ ID NO: 353691 - RNA, 22 nt, Homo sapiens
gugcacaacaugcagguuuguu

SEQ ID NO: 353692 - RNA, 22 nt, Homo sapiens
uuccuugagagcuugauaucac

SEQ ID NO: 353693 - RNA, 22 nt, Homo sapiens
uugaaugaaaugaugucauuug

SEQ ID NO: 353694 - RNA, 22 nt, Homo sapiens
uugauagaucagggauuugauu

SEQ ID NO: 353695 - RNA, 22 nt, Homo sapiens
uuggagucaucucuguacugua

SEQ ID NO: 353696 - RNA, 22 nt, Homo sapiens
uugugcuucaucaccuagcaga

SEQ ID NO: 353697 - RNA, 22 nt, Homo sapiens
uuuaaaguuagaaggaaagggc

SEQ ID NO: 353698 - RNA, 22 nt, Homo sapiens
uuugagugugauaucgauugga

SEQ ID NO: 353699 - RNA, 20 nt, Homo sapiens
uuugcagaaucuaagaagag

SEQ ID NO: 353700 - RNA, 22 nt, Homo sapiens
uuugugagguggauagauugca

SEQ ID NO: 353701 - RNA, 21 nt, Homo sapiens
aauaaagcaaccuuaugccau

SEQ ID NO: 353702 - RNA, 22 nt, Homo sapiens
aauaaagcaggguccuugcacu

SEQ ID NO: 353703 - RNA, 22 nt, Homo sapiens
aauaaagcauggcuacuccaua

SEQ ID NO: 353704 - RNA, 22 nt, Homo sapiens
aaugugcacuuggagccuugcu

SEQ ID NO: 353705 - RNA, 18 nt, Homo sapiens
agagcacugaguuuuaga

SEQ ID NO: 353706 - RNA, 16 nt, Homo sapiens
agcagguguuagguga

SEQ ID NO: 353707 - RNA, 22 nt, Homo sapiens
agccgguguccacgaagaagag

SEQ ID NO: 353708 - RNA, 22 nt, Homo sapiens
agccuauccaauaucagugaga

SEQ ID NO: 353709 - RNA, 22 nt, Homo sapiens
agggagcaaaguggucuuucuc

SEQ ID NO: 353710 - RNA, 19 nt, Homo sapiens
auaguguaggaaaacagcu

SEQ ID NO: 353711 - RNA, 20 nt, Homo sapiens
aucaaagacuuagaggggga

SEQ ID NO: 353712 - RNA, 22 nt, Homo sapiens
augugggaggaauguguuucca

SEQ ID NO: 353713 - RNA, 22 nt, Homo sapiens
auucacagggggagaaggguau

SEQ ID NO: 353714 - RNA, 22 nt, Homo sapiens
auuggacagcauuucuagacuu

SEQ ID NO: 353715 - RNA, 22 nt, Homo sapiens
caaggaauucucaauagaguua

SEQ ID NO: 353716 - RNA, 22 nt, Homo sapiens
cccuucauucaaggguugugag

SEQ ID NO: 353717 - RNA, 22 nt, Homo sapiens
cggugcaaauguaauugcaguu

SEQ ID NO: 353718 - RNA, 22 nt, Homo sapiens
cuucaaaguuggcuaggagaca

SEQ ID NO: 353719 - RNA, 22 nt, Homo sapiens
cuugcagagcccauggauguca

SEQ ID NO: 353720 - RNA, 22 nt, Homo sapiens
cuugcagaggcccuggggagag

SEQ ID NO: 353721 - RNA, 22 nt, Homo sapiens
gaaagcugguauagauacauua

SEQ ID NO: 353722 - RNA, 22 nt, Homo sapiens
gagaugugugugauuauauaau

SEQ ID NO: 353723 - RNA, 22 nt, Homo sapiens
gaggcggugugaugucacaugc

SEQ ID NO: 353724 - RNA, 21 nt, Homo sapiens
gagugcaaauaaagagagggc

SEQ ID NO: 353725 - RNA, 21 nt, Homo sapiens
gauaucuuuauucccaagagc

SEQ ID NO: 353726 - RNA, 22 nt, Homo sapiens
gauaucuuuuguauggugagcu

SEQ ID NO: 353727 - RNA, 22 nt, Homo sapiens
gauugguugaaaguagaauacu

SEQ ID NO: 353728 - RNA, 22 nt, Homo sapiens
gcagugugugaggaauuugggu

SEQ ID NO: 353729 - RNA, 22 nt, Homo sapiens
gccaagaagugucuaagcagga

SEQ ID NO: 353730 - RNA, 22 nt, Homo sapiens
gggauguaugauauauguuggu

SEQ ID NO: 353731 - RNA, 22 nt, Homo sapiens
gucagcuuuuccuuacuuuagg

SEQ ID NO: 353732 - RNA, 22 nt, Homo sapiens
gugucuccuguggagcuaugua

SEQ ID NO: 353733 - RNA, 21 nt, Homo sapiens
gugugcuugagugaugggauu

SEQ ID NO: 353734 - RNA, 22 nt, Homo sapiens
guuaagaaguguaacuuaaguu

SEQ ID NO: 353735 - RNA, 22 nt, Homo sapiens
uacagaauucugucccuugagu

SEQ ID NO: 353736 - RNA, 20 nt, Homo sapiens
uaggagcaaugagaguagaa

SEQ ID NO: 353737 - RNA, 22 nt, Homo sapiens
uauacaugugggcaucaggaga

SEQ ID NO: 353738 - RNA, 21 nt, Homo sapiens
uauagcagcacgauuuauaau

SEQ ID NO: 353739 - RNA, 21 nt, Homo sapiens
uauagcagcacgauuuauagu

SEQ ID NO: 353740 - RNA, 22 nt, Homo sapiens
uauuccauuugugaaaggaagu

SEQ ID NO: 353741 - RNA, 22 nt, Homo sapiens
uauugcuuuugauucaaggcag

SEQ ID NO: 353742 - RNA, 20 nt, Homo sapiens
ucaaagacauggcugucaga

SEQ ID NO: 353743 - RNA, 18 nt, Homo sapiens
uccaguuuucccagcauc

SEQ ID NO: 353744 - RNA, 22 nt, Homo sapiens
ucugucuuguccucacccuaga

SEQ ID NO: 353745 - RNA, 22 nt, Homo sapiens
ucugucuugugguuugagugcc

SEQ ID NO: 353746 - RNA, 19 nt, Homo sapiens
ucugugcuugucccccugu

SEQ ID NO: 353747 - RNA, 22 nt, Homo sapiens
ugaaagcuacaggaaaguauuu

SEQ ID NO: 353748 - RNA, 22 nt, Homo sapiens
ugacaagcucccucugcaccuu

SEQ ID NO: 353749 - RNA, 22 nt, Homo sapiens
ugugccuucuaagaaggagucu

SEQ ID NO: 353750 - RNA, 22 nt, Homo sapiens
ugugucuugagagucucgagaa

SEQ ID NO: 353751 - RNA, 22 nt, Homo sapiens
ugugucuuguuuuuucccaggc

SEQ ID NO: 353752 - RNA, 16 nt, Homo sapiens
uuaggcagugugauac

SEQ ID NO: 353753 - RNA, 22 nt, Homo sapiens
uuaguaguaguuugcauuuacc

SEQ ID NO: 353754 - RNA, 22 nt, Homo sapiens
uuaguaguuugaguggggguua

SEQ ID NO: 353755 - RNA, 22 nt, Homo sapiens
uuauuagguuaaccuauagcua

SEQ ID NO: 353756 - RNA, 22 nt, Homo sapiens
uuauuagguugguggaaaagua

SEQ ID NO: 353757 - RNA, 22 nt, Homo sapiens
uucaagaauuaaaguggcuuuu

SEQ ID NO: 353758 - RNA, 22 nt, Homo sapiens
uucauguagucaucauccugcu

SEQ ID NO: 353759 - RNA, 22 nt, Homo sapiens
uucugugcuuguggaugaagug

SEQ ID NO: 353760 - RNA, 22 nt, Homo sapiens
uugaaagcuaucagagauucca

SEQ ID NO: 353761 - RNA, 22 nt, Homo sapiens
uugaaagcuaucucaaaucgcu

SEQ ID NO: 353762 - RNA, 22 nt, Homo sapiens
uugcaaaguugccaaggaagga

SEQ ID NO: 353763 - RNA, 22 nt, Homo sapiens
uugcaaggugcucgaagggcuc

SEQ ID NO: 353764 - RNA, 22 nt, Homo sapiens
uuggacuucuaacugacaugga

SEQ ID NO: 353765 - RNA, 22 nt, Homo sapiens
uuggacuucucaaggcaauaaa

SEQ ID NO: 353766 - RNA, 22 nt, Homo sapiens
uuggacuuuaagauagagaugu

SEQ ID NO: 353767 - RNA, 22 nt, Homo sapiens
uuuaauagcagggacuuccggg

SEQ ID NO: 353768 - RNA, 22 nt, Homo sapiens
uuucacagcugucuuccgucuc

SEQ ID NO: 353769 - RNA, 22 nt, Homo sapiens
uuucagagucaucugcccaagu

SEQ ID NO: 353770 - RNA, 22 nt, Homo sapiens
uuugauugguguaccugaaagu

SEQ ID NO: 353771 - RNA, 22 nt, Homo sapiens
auccaagagacugaugacuucc

SEQ ID NO: 353772 - RNA, 22 nt, Homo sapiens
auccuugagaaaauaaaugacc

SEQ ID NO: 353773 - RNA, 22 nt, Homo sapiens
aucugcauuagggugaagaccu

SEQ ID NO: 353774 - RNA, 23 nt, Homo sapiens
augaaagcccuugcaaaugcugg

SEQ ID NO: 353775 - RNA, 22 nt, Homo sapiens
augacuuuucugaaaaccacca

SEQ ID NO: 353776 - RNA, 22 nt, Homo sapiens
auggauuuuggggccagaggca

SEQ ID NO: 353777 - RNA, 22 nt, Homo sapiens
auggccuuguauaccuggcaaa

SEQ ID NO: 353778 - RNA, 22 nt, Homo sapiens
auguguauuaccucgauuguga

SEQ ID NO: 353779 - RNA, 22 nt, Homo sapiens
auuacaugucuauccaugaaca

SEQ ID NO: 353780 - RNA, 22 nt, Homo sapiens
auuauguuguauuuccuugcag

SEQ ID NO: 353781 - RNA, 22 nt, Homo sapiens
auugaguaaaugaaaauugccu

SEQ ID NO: 353782 - RNA, 23 nt, Homo sapiens
cagcuucauugaacauaacuccu

SEQ ID NO: 353783 - RNA, 22 nt, Homo sapiens
caggcagucuggcucccaagug

SEQ ID NO: 353784 - RNA, 22 nt, Homo sapiens
cguauccuguuuagcucuccca

SEQ ID NO: 353785 - RNA, 22 nt, Homo sapiens
cugugguauuauuagaaauauc

SEQ ID NO: 353786 - RNA, 18 nt, Homo sapiens
cuucauugcuguuuugcu

SEQ ID NO: 353787 - RNA, 22 nt, Homo sapiens
cuugagcauauucuauauuaaa

SEQ ID NO: 353788 - RNA, 22 nt, Homo sapiens
gaaauggaucagagcaagcuuu

SEQ ID NO: 353789 - RNA, 22 nt, Homo sapiens
gauauguaguaguugaaaaaga

SEQ ID NO: 353790 - RNA, 22 nt, Homo sapiens
gaucugugugauuggaugcauu

SEQ ID NO: 353791 - RNA, 22 nt, Homo sapiens
gcccagcguucagggaggggcu

SEQ ID NO: 353792 - RNA, 23 nt, Homo sapiens
ggaguguaaauuauuucaaccau

SEQ ID NO: 353793 - RNA, 22 nt, Homo sapiens
ggcaaaaucgcaauuacuuuug

SEQ ID NO: 353794 - RNA, 22 nt, Homo sapiens
gggauguuuuauacugagccug

SEQ ID NO: 353795 - RNA, 22 nt, Homo sapiens
guauuugauuauagcaugcuua

SEQ ID NO: 353796 - RNA, 22 nt, Homo sapiens
gucugugguuccuaugucaccu

SEQ ID NO: 353797 - RNA, 21 nt, Homo sapiens
guucaagugauccuccugucu

SEQ ID NO: 353798 - RNA, 22 nt, Homo sapiens
uaaacugucuugcaguuacaug

SEQ ID NO: 353799 - RNA, 22 nt, Homo sapiens
uaaagccuagaacuuucagccc

SEQ ID NO: 353800 - RNA, 22 nt, Homo sapiens
uaaggcccgugaguuucauauc

SEQ ID NO: 353801 - RNA, 22 nt, Homo sapiens
uagcagcagugguguauuuaga

SEQ ID NO: 353802 - RNA, 19 nt, Homo sapiens
uagcagcaugauuuauaau

SEQ ID NO: 353803 - RNA, 22 nt, Homo sapiens
uaggucuuuuaugaaauauauu

SEQ ID NO: 353804 - RNA, 22 nt, Homo sapiens
uaguaguuuuguguauaauaau

SEQ ID NO: 353805 - RNA, 22 nt, Homo sapiens
uauacaugugccauguuggugu

SEQ ID NO: 353806 - RNA, 22 nt, Homo sapiens
uauugauuaauugugauuaggc

SEQ ID NO: 353807 - RNA, 22 nt, Homo sapiens
uauugcuuaugaugcugaauua

SEQ ID NO: 353808 - RNA, 22 nt, Homo sapiens
uauuugauugacuuuagcagga

SEQ ID NO: 353809 - RNA, 22 nt, Homo sapiens
uauuuggugaaugaaugcaugu

SEQ ID NO: 353810 - RNA, 22 nt, Homo sapiens
uauuugguuggugcaaaaguaa

SEQ ID NO: 353811 - RNA, 22 nt, Homo sapiens
ucaaaaucucuuagcugugucu

SEQ ID NO: 353812 - RNA, 23 nt, Homo sapiens
ucaguacuccacuuucaauagug

SEQ ID NO: 353813 - RNA, 22 nt, Homo sapiens
ucauguaauuuugugucuauga

SEQ ID NO: 353814 - RNA, 22 nt, Homo sapiens
ugaaagcuacagucuccuagga

SEQ ID NO: 353815 - RNA, 22 nt, Homo sapiens
ugaauagacacuaaagacugua

SEQ ID NO: 353816 - RNA, 22 nt, Homo sapiens
ugaggaaugaccccgugugguc

SEQ ID NO: 353817 - RNA, 20 nt, Homo sapiens
ugaguuccuuguucagaagc

SEQ ID NO: 353818 - RNA, 22 nt, Homo sapiens
ugcaagaaucagccuaucauua

SEQ ID NO: 353819 - RNA, 20 nt, Homo sapiens
ugggaacaugugguauaugg

SEQ ID NO: 353820 - RNA, 21 nt, Homo sapiens
uguagcagcauaauuuauaau

SEQ ID NO: 353821 - RNA, 22 nt, Homo sapiens
ugugaaaucagauagccuuuuu

SEQ ID NO: 353822 - RNA, 22 nt, Homo sapiens
ugugcuauguuauucacauggg

SEQ ID NO: 353823 - RNA, 22 nt, Homo sapiens
ugugucuuuuaucacacaaugu

SEQ ID NO: 353824 - RNA, 22 nt, Homo sapiens
uguucuugaguugggaguacaa

SEQ ID NO: 353825 - RNA, 22 nt, Homo sapiens
uuaaagccauaccugagagagu

SEQ ID NO: 353826 - RNA, 22 nt, Homo sapiens
uuaagggaggagcuucaagaug

SEQ ID NO: 353827 - RNA, 20 nt, Homo sapiens
uuagcagcaugauuuauaau

SEQ ID NO: 353828 - RNA, 22 nt, Homo sapiens
uucauagucuaugcaaguaaga

SEQ ID NO: 353829 - RNA, 22 nt, Homo sapiens
uucauggugguacaaaagcaau

SEQ ID NO: 353830 - RNA, 22 nt, Homo sapiens
uucauguaauauauuucaggcc

SEQ ID NO: 353831 - RNA, 22 nt, Homo sapiens
uucugugguugaaaggagagau

SEQ ID NO: 353832 - RNA, 22 nt, Homo sapiens
uugaggaaugugauuucaaaua

SEQ ID NO: 353833 - RNA, 22 nt, Homo sapiens
uuggacagaugguuacauuuuu

SEQ ID NO: 353834 - RNA, 22 nt, Homo sapiens
uuggacuuuuauucugcaggca

SEQ ID NO: 353835 - RNA, 22 nt, Homo sapiens
uuguaaaguucucucccgaaaa

SEQ ID NO: 353836 - RNA, 22 nt, Homo sapiens
uugugggaggugauuagaucau

SEQ ID NO: 353837 - RNA, 22 nt, Homo sapiens
uuugaggaaaggcauaaguagg

SEQ ID NO: 353838 - RNA, 22 nt, Homo sapiens
uuuguguggccuuggccuggca

SEQ ID NO: 353839 - RNA, 22 nt, Homo sapiens
uuuguucaccucaaggauggga

SEQ ID NO: 353840 - RNA, 22 nt, Homo sapiens
aaagcacuggagucaucaucua

SEQ ID NO: 353841 - RNA, 20 nt, Homo sapiens
aagugcaucguugugucugc

SEQ ID NO: 353842 - RNA, 22 nt, Homo sapiens
aauaaagccugucucuuuagag

SEQ ID NO: 353843 - RNA, 22 nt, Homo sapiens
aauugcuuuuauuuagggccag

SEQ ID NO: 353844 - RNA, 22 nt, Homo sapiens
agacuagaaaucauuuguugag

SEQ ID NO: 353845 - RNA, 22 nt, Homo sapiens
aggaauggaaacuuuugauggu

SEQ ID NO: 353846 - RNA, 20 nt, Homo sapiens
agucaguuuauuuucucucu

SEQ ID NO: 353847 - RNA, 22 nt, Homo sapiens
auaaagccaggagacguaauug

SEQ ID NO: 353848 - RNA, 22 nt, Homo sapiens
auaaaguagaggugaggugcau

SEQ ID NO: 353849 - RNA, 20 nt, Homo sapiens
auaaauguauagguguacau

SEQ ID NO: 353850 - RNA, 22 nt, Homo sapiens
auaauaucagguugugaugaug

SEQ ID NO: 353851 - RNA, 19 nt, Homo sapiens
auaauuagcagugaggaca

SEQ ID NO: 353852 - RNA, 22 nt, Homo sapiens
aucacaggcaaaauuccuucuc

SEQ ID NO: 353853 - RNA, 22 nt, Homo sapiens
aucagugaaagugaaaucuccg

SEQ ID NO: 353854 - RNA, 21 nt, Homo sapiens
aacuggugugagaugguaugu

SEQ ID NO: 353855 - RNA, 22 nt, Homo sapiens
aagagccgcaagggugaagggu

SEQ ID NO: 353856 - RNA, 22 nt, Homo sapiens
aauaaagcagcuuuuugggacu

SEQ ID NO: 353857 - RNA, 22 nt, Homo sapiens
aauaaagcuuugagcuuugcug

SEQ ID NO: 353858 - RNA, 22 nt, Homo sapiens
agaauaauguccccccaaggga

SEQ ID NO: 353859 - RNA, 22 nt, Homo sapiens
agauucauccaaguuguugcau

SEQ ID NO: 353860 - RNA, 19 nt, Homo sapiens
aggacuaaagacuagaagu

SEQ ID NO: 353861 - RNA, 22 nt, Homo sapiens
auaaagccaugagcuugagaug

SEQ ID NO: 353862 - RNA, 22 nt, Homo sapiens
auauucacagguaucagagauu

SEQ ID NO: 353863 - RNA, 22 nt, Homo sapiens
auccagaugggcuuaauguaau

SEQ ID NO: 353864 - RNA, 22 nt, Homo sapiens
aucccugaggaauuucugcacu

SEQ ID NO: 353865 - RNA, 22 nt, Homo sapiens
aucuuguguugaauggugcaga

SEQ ID NO: 353866 - RNA, 22 nt, Homo sapiens
augugggaggacuuggcuguug

SEQ ID NO: 353867 - RNA, 22 nt, Homo sapiens
auucaagggauuucaggaggcu

SEQ ID NO: 353868 - RNA, 22 nt, Homo sapiens
caaaguaauugugguuuugcca

SEQ ID NO: 353869 - RNA, 22 nt, Homo sapiens
cacugcauuacucaugagcaug

SEQ ID NO: 353870 - RNA, 22 nt, Homo sapiens
cccaguuuugcuucucaugagg

SEQ ID NO: 353871 - RNA, 22 nt, Homo sapiens
cggugcaauucuccugucucag

SEQ ID NO: 353872 - RNA, 22 nt, Homo sapiens
cugaugaaguauuuguucugga

SEQ ID NO: 353873 - RNA, 22 nt, Homo sapiens
cuugcagagucauucuaauuuc

SEQ ID NO: 353874 - RNA, 22 nt, Homo sapiens
cuuuugugauuccucaguuacu

SEQ ID NO: 353875 - RNA, 22 nt, Homo sapiens
gaggucuuacauuuuaauauuu

SEQ ID NO: 353876 - RNA, 22 nt, Homo sapiens
ggcaagaagaacuauaacuuuu

SEQ ID NO: 353877 - RNA, 22 nt, Homo sapiens
ggcaagaagagaguuuaaacau

SEQ ID NO: 353878 - RNA, 22 nt, Homo sapiens
ggcagaauugcugaggaugcua

SEQ ID NO: 353879 - RNA, 22 nt, Homo sapiens
gggaugaaguugauguagaaag

SEQ ID NO: 353880 - RNA, 22 nt, Homo sapiens
guagcagaauaucagauaauuu

SEQ ID NO: 353881 - RNA, 22 nt, Homo sapiens
gucagcaucaccaugucuauga

SEQ ID NO: 353882 - RNA, 22 nt, Homo sapiens
gucaugaacuguacuacuccua

SEQ ID NO: 353883 - RNA, 22 nt, Homo sapiens
gucaugaaguuuugaaugaaau

SEQ ID NO: 353884 - RNA, 22 nt, Homo sapiens
gucugguugacagcauguggcc

SEQ ID NO: 353885 - RNA, 22 nt, Homo sapiens
gucugguuggaguaguuuucag

SEQ ID NO: 353886 - RNA, 22 nt, Homo sapiens
gucuguuuggggaccuguggcc

SEQ ID NO: 353887 - RNA, 22 nt, Homo sapiens
gugacaucagcuccagguauaa

SEQ ID NO: 353888 - RNA, 22 nt, Homo sapiens
gugaucucagcucacuggaacc

SEQ ID NO: 353889 - RNA, 22 nt, Homo sapiens
gugaucucauuuggaauuagag

SEQ ID NO: 353890 - RNA, 22 nt, Homo sapiens
gugauugcauuaugaauauuau

SEQ ID NO: 353891 - RNA, 22 nt, Homo sapiens
gugugcaauuuugugggaggca

SEQ ID NO: 353892 - RNA, 22 nt, Homo sapiens
uaaagauaaggcucgcuuggau

SEQ ID NO: 353893 - RNA, 22 nt, Homo sapiens
uaaauggauaaaugaauaccua

SEQ ID NO: 353894 - RNA, 22 nt, Homo sapiens
uaauuggaucucaaaaaagugu

SEQ ID NO: 353895 - RNA, 22 nt, Homo sapiens
uagauuauuggcugauuugauc

SEQ ID NO: 353896 - RNA, 22 nt, Homo sapiens
uagcagaauaacuugccagccu

SEQ ID NO: 353897 - RNA, 22 nt, Homo sapiens
uagcagaauauaccucuuacuu

SEQ ID NO: 353898 - RNA, 22 nt, Homo sapiens
uaggucuuuuagcauaggagcu

SEQ ID NO: 353899 - RNA, 22 nt, Homo sapiens
uauuugauuaacaagagccuaa

SEQ ID NO: 353900 - RNA, 22 nt, Homo sapiens
uauuugguuacuugaauagcua

SEQ ID NO: 353901 - RNA, 22 nt, Homo sapiens
ucaguuaaugcugccugcugga

SEQ ID NO: 353902 - RNA, 22 nt, Homo sapiens
uccuugaaacaggaagaauuca

SEQ ID NO: 353903 - RNA, 21 nt, Homo sapiens
ucuggcuuucauuccccuucu

SEQ ID NO: 353904 - RNA, 22 nt, Homo sapiens
ucuugcaguucccaaauucaca

SEQ ID NO: 353905 - RNA, 23 nt, Homo sapiens
ucuugguuauagaaaaauaguug

SEQ ID NO: 353906 - RNA, 22 nt, Homo sapiens
ugaaauaguuaaguugccuagu

SEQ ID NO: 353907 - RNA, 22 nt, Homo sapiens
ugaguauguuuagaaguaaagg

SEQ ID NO: 353908 - RNA, 22 nt, Homo sapiens
ugaguuuaucuaaagaccuggg

SEQ ID NO: 353909 - RNA, 22 nt, Homo sapiens
ugauaucugaauagauacacaa

SEQ ID NO: 353910 - RNA, 22 nt, Homo sapiens
ugauaugaaagggaaauaagug

SEQ ID NO: 353911 - RNA, 22 nt, Homo sapiens
ugcaaguaauuggcgaggaguu

SEQ ID NO: 353912 - RNA, 22 nt, Homo sapiens
ugcagaaucccuucagauccga

SEQ ID NO: 353913 - RNA, 22 nt, Homo sapiens
uggaaguagauagauuguguca

SEQ ID NO: 353914 - RNA, 22 nt, Homo sapiens
ugguauuuaauauaugagaguu

SEQ ID NO: 353915 - RNA, 23 nt, Homo sapiens
ugguuuguaagagauggacugga

SEQ ID NO: 353916 - RNA, 22 nt, Homo sapiens
uguagacagcacguaguugagu

SEQ ID NO: 353917 - RNA, 22 nt, Homo sapiens
uguaugcuuuugagagauauuu

SEQ ID NO: 353918 - RNA, 22 nt, Homo sapiens
ugugcuugaaauucaguuuuga

SEQ ID NO: 353919 - RNA, 22 nt, Homo sapiens
uuaagcaguggauuagaauuuu

SEQ ID NO: 353920 - RNA, 22 nt, Homo sapiens
uuaguaguuugauaggaauagc

SEQ ID NO: 353921 - RNA, 22 nt, Homo sapiens
uuauuagguuagugcaaaaguu

SEQ ID NO: 353922 - RNA, 18 nt, Homo sapiens
uucaguuuguaucugggg

SEQ ID NO: 353923 - RNA, 22 nt, Homo sapiens
uucuggcucaggucaacacuuc

SEQ ID NO: 353924 - RNA, 22 nt, Homo sapiens
uucugguuaauacuugcaaaaa

SEQ ID NO: 353925 - RNA, 22 nt, Homo sapiens
uugaaguagaaagacgaaauuu

SEQ ID NO: 353926 - RNA, 22 nt, Homo sapiens
uugugcuugauuugccuagcug

SEQ ID NO: 353927 - RNA, 22 nt, Homo sapiens
uugugcuuuugagcugagauga

SEQ ID NO: 353928 - RNA, 19 nt, Homo sapiens
uugugggaggacagagggg

SEQ ID NO: 353929 - RNA, 22 nt, Homo sapiens
uuucugugguccucuugaaggu

SEQ ID NO: 353930 - RNA, 22 nt, Homo sapiens
uuugauuguacuaaaauuguac

SEQ ID NO: 353931 - RNA, 22 nt, Homo sapiens
gugcacaacgugcaggcuuguu

SEQ ID NO: 353932 - RNA, 22 nt, Homo sapiens
gugcacaacgugcagguuuguu

SEQ ID NO: 353933 - RNA, 22 nt, Homo sapiens
gugcacaacguguagguuuguu

SEQ ID NO: 353934 - RNA, 22 nt, Homo sapiens
gugcacaaugugcagguuuguu

SEQ ID NO: 353935 - RNA, 22 nt, Homo sapiens
gugccuucuagcuaugguuggc

SEQ ID NO: 353936 - RNA, 21 nt, Homo sapiens
guggaaauggaauuuacuaau

SEQ ID NO: 353937 - RNA, 18 nt, Homo sapiens
guugagcuuuuccuuuag

SEQ ID NO: 353938 - RNA, 22 nt, Homo sapiens
guugcagaguucuuccuccuga

SEQ ID NO: 353939 - RNA, 22 nt, Homo sapiens
uaaagcugaaaugauuaugaca

SEQ ID NO: 353940 - RNA, 22 nt, Homo sapiens
uaagccuaggucugugcucuuc

SEQ ID NO: 353941 - RNA, 22 nt, Homo sapiens
uacuuuguagagugugagaauu

SEQ ID NO: 353942 - RNA, 22 nt, Homo sapiens
ucaaagacacacaaggagaagg

SEQ ID NO: 353943 - RNA, 22 nt, Homo sapiens
ucagcaucacaggcagugagug

SEQ ID NO: 353944 - RNA, 23 nt, Homo sapiens
ucagguaggccuagaguauucuu

SEQ ID NO: 353945 - RNA, 22 nt, Homo sapiens
ucuucaugcuugaaauaauagc

SEQ ID NO: 353946 - RNA, 22 nt, Homo sapiens
ugaaaugauuauaugguguuug

SEQ ID NO: 353947 - RNA, 22 nt, Homo sapiens
ugaaugcuucaugucugggcug

SEQ ID NO: 353948 - RNA, 22 nt, Homo sapiens
ugacuucauuugguaauugggu

SEQ ID NO: 353949 - RNA, 22 nt, Homo sapiens
ugaguaugaguucaggaaaggc

SEQ ID NO: 353950 - RNA, 22 nt, Homo sapiens
ugauaugaaguucaaaccaggu

SEQ ID NO: 353951 - RNA, 22 nt, Homo sapiens
ugcauuguuuuugguucccagg

SEQ ID NO: 353952 - RNA, 22 nt, Homo sapiens
ugcugguuuucaucaucagugg

SEQ ID NO: 353953 - RNA, 22 nt, Homo sapiens
uguaaaaagcccagccgcugag

SEQ ID NO: 353954 - RNA, 21 nt, Homo sapiens
uguagcagcaugauuuauaau

SEQ ID NO: 353955 - RNA, 22 nt, Homo sapiens
uguucuugagccuuuagaccua

SEQ ID NO: 353956 - RNA, 22 nt, Homo sapiens
uuaauacucuucuaaguagucc

SEQ ID NO: 353957 - RNA, 22 nt, Homo sapiens
uuacaguaugaguaagaguucu

SEQ ID NO: 353958 - RNA, 22 nt, Homo sapiens
uuaggcaggauaguuacauauu

SEQ ID NO: 353959 - RNA, 21 nt, Homo sapiens
uuaggcagugucagaggugag

SEQ ID NO: 353960 - RNA, 22 nt, Homo sapiens
uuaggcaguuuauugauuuuca

SEQ ID NO: 353961 - RNA, 22 nt, Homo sapiens
uuaguaguagcugcaugucagu

SEQ ID NO: 353962 - RNA, 22 nt, Homo sapiens
uuaguaguagugcuguaauuuu

SEQ ID NO: 353963 - RNA, 22 nt, Homo sapiens
uuaguaguugugauagguaccu

SEQ ID NO: 353964 - RNA, 18 nt, Homo sapiens
uucauaguagcaugauuu

SEQ ID NO: 353965 - RNA, 22 nt, Homo sapiens
uuccuugagaaaggcacaaguu

SEQ ID NO: 353966 - RNA, 22 nt, Homo sapiens
auaucacagguguuuaccugau

SEQ ID NO: 353967 - RNA, 22 nt, Homo sapiens
auaucccaguguguaaacacug

SEQ ID NO: 353968 - RNA, 22 nt, Homo sapiens
auauguaguuucagaaguggaa

SEQ ID NO: 353969 - RNA, 22 nt, Homo sapiens
auauucaagugaggauggcuaa

SEQ ID NO: 353970 - RNA, 22 nt, Homo sapiens
auauucacagguaucagagauu

SEQ ID NO: 353971 - RNA, 22 nt, Homo sapiens
auauucacuauaugcagaacca

SEQ ID NO: 353972 - RNA, 19 nt, Homo sapiens
aucaaacugcucuuugagg

SEQ ID NO: 353973 - RNA, 22 nt, Homo sapiens
aucaaagugaauuaaugagaau

SEQ ID NO: 353974 - RNA, 22 nt, Homo sapiens
aucacagaguuaaaacuuucuu

SEQ ID NO: 353975 - RNA, 22 nt, Homo sapiens
aucacagugaaaacagucaauu

SEQ ID NO: 353976 - RNA, 22 nt, Homo sapiens
aucacaguuaagaggugaugaa

SEQ ID NO: 353977 - RNA, 22 nt, Homo sapiens
aucacaguuuuaccauuuggua

SEQ ID NO: 353978 - RNA, 22 nt, Homo sapiens
aucacauggccagguaguaauc

SEQ ID NO: 353979 - RNA, 22 nt, Homo sapiens
aucacauggccuagccuaaccu

SEQ ID NO: 353980 - RNA, 22 nt, Homo sapiens
aucacauuuauaguggcacgca

SEQ ID NO: 353981 - RNA, 22 nt, Homo sapiens
aucacuuugcucuccagugugg

SEQ ID NO: 353982 - RNA, 22 nt, Homo sapiens
auccucaguggcuuaaguauag

SEQ ID NO: 353983 - RNA, 22 nt, Homo sapiens
auccugaagcuuuacugaauuc

SEQ ID NO: 353984 - RNA, 22 nt, Homo sapiens
aucgcaccauugcacuccagca

SEQ ID NO: 353985 - RNA, 21 nt, Homo sapiens
aucucacuugaauguaaaagc

SEQ ID NO: 353986 - RNA, 22 nt, Homo sapiens
aucucaguucaggcuggccaca

SEQ ID NO: 353987 - RNA, 20 nt, Homo sapiens
aucucugggcaaaggaaaau

SEQ ID NO: 353988 - RNA, 19 nt, Homo sapiens
aucuggaguuccuggggcu

SEQ ID NO: 353989 - RNA, 22 nt, Homo sapiens
aucugguguauuggugcugggu

SEQ ID NO: 353990 - RNA, 22 nt, Homo sapiens
aucugguguccucgugggaguc

SEQ ID NO: 353991 - RNA, 22 nt, Homo sapiens
augaaagucaauccccaagugu

SEQ ID NO: 353992 - RNA, 18 nt, Homo sapiens
augaacucaucauuuuuu

SEQ ID NO: 353993 - RNA, 22 nt, Homo sapiens
augaauacugcugcaaugaaca

SEQ ID NO: 353994 - RNA, 22 nt, Homo sapiens
augacauugaugcucuggcugg

SEQ ID NO: 353995 - RNA, 22 nt, Homo sapiens
augagaaugauucuguuauggu

SEQ ID NO: 353996 - RNA, 22 nt, Homo sapiens
augagauaaaccaucucuuaag

SEQ ID NO: 353997 - RNA, 22 nt, Homo sapiens
augagauauguuaaaaguuaaa

SEQ ID NO: 353998 - RNA, 21 nt, Homo sapiens
augagauguuagacuuuagac

SEQ ID NO: 353999 - RNA, 22 nt, Homo sapiens
augagauuguuugugugaaaua

SEQ ID NO: 354000 - RNA, 21 nt, Homo sapiens
uuaucccagugucucugcagg

SEQ ID NO: 354001 - RNA, 17 nt, Homo sapiens
uuaugagacuucuuagc

SEQ ID NO: 354002 - RNA, 22 nt, Homo sapiens
uuaugguacaugugcacaaugu

SEQ ID NO: 354003 - RNA, 22 nt, Homo sapiens
uuauuacuccuauuuuguagau

SEQ ID NO: 354004 - RNA, 22 nt, Homo sapiens
uuauuauguuggugcaaaggua

SEQ ID NO: 354005 - RNA, 22 nt, Homo sapiens
uucaagucaacaagcacuugag

SEQ ID NO: 354006 - RNA, 22 nt, Homo sapiens
uucaagucaauuuuugaaugac

SEQ ID NO: 354007 - RNA, 22 nt, Homo sapiens
uucacagaaaaaggcgaugagg

SEQ ID NO: 354008 - RNA, 22 nt, Homo sapiens
uucacagaguuauuuuuaugcu

SEQ ID NO: 354009 - RNA, 22 nt, Homo sapiens
uucacaugacagggugaagcau

SEQ ID NO: 354010 - RNA, 22 nt, Homo sapiens
uucagcuacuugggaggcugaa

SEQ ID NO: 354011 - RNA, 22 nt, Homo sapiens
uucauaguauuuuucuccaaau

SEQ ID NO: 354012 - RNA, 22 nt, Homo sapiens
uucauaguguuuccuuccagug

SEQ ID NO: 354013 - RNA, 18 nt, Homo sapiens
uucaucaguccucagcug

SEQ ID NO: 354014 - RNA, 22 nt, Homo sapiens
uucauccccuccaaaucucaug

SEQ ID NO: 354015 - RNA, 22 nt, Homo sapiens
uucauggaguugagaaggcuaa

SEQ ID NO: 354016 - RNA, 22 nt, Homo sapiens
uucauguaauauuucacagcuu

SEQ ID NO: 354017 - RNA, 22 nt, Homo sapiens
uucaugucuuggcuguuagagu

SEQ ID NO: 354018 - RNA, 22 nt, Homo sapiens
augaggaaggagccuuugucug

SEQ ID NO: 354019 - RNA, 22 nt, Homo sapiens
augaggcuauaauuuuuaugua

SEQ ID NO: 354020 - RNA, 22 nt, Homo sapiens
augaggugaggucaguaaggua

SEQ ID NO: 354021 - RNA, 22 nt, Homo sapiens
augauacuggcuucauagaaug

SEQ ID NO: 354022 - RNA, 22 nt, Homo sapiens
augaugcugagguuugggguau

SEQ ID NO: 354023 - RNA, 22 nt, Homo sapiens
augcaaacaucauagaguguac

SEQ ID NO: 354024 - RNA, 22 nt, Homo sapiens
augcauagugggaugcucugug

SEQ ID NO: 354025 - RNA, 22 nt, Homo sapiens
augcccauuuguuuucugaaag

SEQ ID NO: 354026 - RNA, 22 nt, Homo sapiens
auggaaugccauuuauaaugga

SEQ ID NO: 354027 - RNA, 22 nt, Homo sapiens
auggaauguauagucauguagg

SEQ ID NO: 354028 - RNA, 22 nt, Homo sapiens
auggagaugaacuuggguaaag

SEQ ID NO: 354029 - RNA, 22 nt, Homo sapiens
auggagaugugcgaacugagua

SEQ ID NO: 354030 - RNA, 22 nt, Homo sapiens
auggagguguggggagugaguu

SEQ ID NO: 354031 - RNA, 22 nt, Homo sapiens
auggaguguucugaauccuuug

SEQ ID NO: 354032 - RNA, 22 nt, Homo sapiens
auggauagucucacucacauac

SEQ ID NO: 354033 - RNA, 22 nt, Homo sapiens
auggaucauauucuugaggagg

SEQ ID NO: 354034 - RNA, 22 nt, Homo sapiens
auggauugucuccuugugccau

SEQ ID NO: 354035 - RNA, 22 nt, Homo sapiens
auggcacuccagccugggcaac

SEQ ID NO: 354036 - RNA, 22 nt, Homo sapiens
auggcaguuucagcuauaguuu

SEQ ID NO: 354037 - RNA, 22 nt, Homo sapiens
auggcccccuguuugugaacau

SEQ ID NO: 354038 - RNA, 22 nt, Homo sapiens
auggcuguuucugcaaugucua

SEQ ID NO: 354039 - RNA, 22 nt, Homo sapiens
auggcuuucaggacguggcgag

SEQ ID NO: 354040 - RNA, 22 nt, Homo sapiens
auggcuuugggcugcucugccc

SEQ ID NO: 354041 - RNA, 22 nt, Homo sapiens
auggcuuuguguucagagcuga

SEQ ID NO: 354042 - RNA, 22 nt, Homo sapiens
auggcuuuuccugucuugcaug

SEQ ID NO: 354043 - RNA, 22 nt, Homo sapiens
auggcuuuugcccuaaauggau

SEQ ID NO: 354044 - RNA, 22 nt, Homo sapiens
augggaaaaucagaaggccugg

SEQ ID NO: 354045 - RNA, 21 nt, Homo sapiens
augggacuaacugaugggucu

SEQ ID NO: 354046 - RNA, 22 nt, Homo sapiens
augggcacugauguauucugug

SEQ ID NO: 354047 - RNA, 22 nt, Homo sapiens
augguauuuugugauaccuugu

SEQ ID NO: 354048 - RNA, 22 nt, Homo sapiens
auguaauugagguuuuugccau

SEQ ID NO: 354049 - RNA, 22 nt, Homo sapiens
auguagugugauuuucacuaga

SEQ ID NO: 354050 - RNA, 22 nt, Homo sapiens
auguccuggacccagacaaagc

SEQ ID NO: 354051 - RNA, 22 nt, Homo sapiens
augugcaaagcacuguucagca

SEQ ID NO: 354052 - RNA, 22 nt, Homo sapiens
augugcacaugcuuacauguga

SEQ ID NO: 354053 - RNA, 19 nt, Homo sapiens
augugguuagcaugacugc

SEQ ID NO: 354054 - RNA, 22 nt, Homo sapiens
augugucaaaucuaggccaaag

SEQ ID NO: 354055 - RNA, 22 nt, Homo sapiens
auguuagcaucuggcacuaugg

SEQ ID NO: 354056 - RNA, 22 nt, Homo sapiens
auguugcaguuuaauuauccua

SEQ ID NO: 354057 - RNA, 22 nt, Homo sapiens
auguuguaguaugagucaaaau

SEQ ID NO: 354058 - RNA, 22 nt, Homo sapiens
auuaaucaggcaaugcuugcua

SEQ ID NO: 354059 - RNA, 22 nt, Homo sapiens
auuacuuugcaccaaccuaaua

SEQ ID NO: 354060 - RNA, 22 nt, Homo sapiens
auuagaugguuauaggugugag

SEQ ID NO: 354061 - RNA, 22 nt, Homo sapiens
auucaaagugcauguucccacu

SEQ ID NO: 354062 - RNA, 22 nt, Homo sapiens
auucuugcuugaacuuggugca

SEQ ID NO: 354063 - RNA, 22 nt, Homo sapiens
auugaacaugccauauguacca

SEQ ID NO: 354064 - RNA, 22 nt, Homo sapiens
auugcaaagcguagacucuaaa

SEQ ID NO: 354065 - RNA, 22 nt, Homo sapiens
auugcacuccagccuggccaac

SEQ ID NO: 354066 - RNA, 21 nt, Homo sapiens
auugcacuccagccugggcga

SEQ ID NO: 354067 - RNA, 22 nt, Homo sapiens
auugcacuccagccuuggggau

SEQ ID NO: 354068 - RNA, 22 nt, Homo sapiens
auugcacugcagccugggcaac

SEQ ID NO: 354069 - RNA, 22 nt, Homo sapiens
auugccucaauuccaagacugc

SEQ ID NO: 354070 - RNA, 22 nt, Homo sapiens
auuguacuccagccugggcaag

SEQ ID NO: 354071 - RNA, 22 nt, Homo sapiens
auuguacuccagccuguggagc

SEQ ID NO: 354072 - RNA, 22 nt, Homo sapiens
auugucccucuuaaucccagca

SEQ ID NO: 354073 - RNA, 22 nt, Homo sapiens
auuuggguaaugagugcaaggg

SEQ ID NO: 354074 - RNA, 22 nt, Homo sapiens
auuugguagaguucgauaccug

SEQ ID NO: 354075 - RNA, 22 nt, Homo sapiens
caaaguaauuacgguuuuggcc

SEQ ID NO: 354076 - RNA, 22 nt, Homo sapiens
caaagugcugggaugggccagg

SEQ ID NO: 354077 - RNA, 22 nt, Homo sapiens
caagugcucuaggauccugagu

SEQ ID NO: 354078 - RNA, 22 nt, Homo sapiens
caaugcauuauucucccacuuc

SEQ ID NO: 354079 - RNA, 22 nt, Homo sapiens
cacaaugucuaagauguuucua

SEQ ID NO: 354080 - RNA, 22 nt, Homo sapiens
uuccacaaugguugaacuaauu

SEQ ID NO: 354081 - RNA, 22 nt, Homo sapiens
uuccacaggguugaacuaguuu

SEQ ID NO: 354082 - RNA, 22 nt, Homo sapiens
uucccuuucugccuugaaucuu

SEQ ID NO: 354083 - RNA, 22 nt, Homo sapiens
uuccuaguccugagucucugcg

SEQ ID NO: 354084 - RNA, 22 nt, Homo sapiens
uuccuggaggggaaguguccaa

SEQ ID NO: 354085 - RNA, 22 nt, Homo sapiens
uucucacaguacagggagcucu

SEQ ID NO: 354086 - RNA, 19 nt, Homo sapiens
uucucugguuguacuaccc

SEQ ID NO: 354087 - RNA, 22 nt, Homo sapiens
uucuuagucaaguuguauuuca

SEQ ID NO: 354088 - RNA, 22 nt, Homo sapiens
uucuuuggauaaaguuuuaugc

SEQ ID NO: 354089 - RNA, 22 nt, Homo sapiens
uugaaagacagaggggcaaguu

SEQ ID NO: 354090 - RNA, 22 nt, Homo sapiens
uugaaagacaucaccuacugcu

SEQ ID NO: 354091 - RNA, 22 nt, Homo sapiens
uugacauugcuguaguguccag

SEQ ID NO: 354092 - RNA, 22 nt, Homo sapiens
uugacuuuuaggaggaaaauga

SEQ ID NO: 354093 - RNA, 22 nt, Homo sapiens
uugagaagugucuguucauguc

SEQ ID NO: 354094 - RNA, 22 nt, Homo sapiens
uugagagcugaugaaagauaaa

SEQ ID NO: 354095 - RNA, 22 nt, Homo sapiens
uugagauagaauaggaauggga

SEQ ID NO: 354096 - RNA, 22 nt, Homo sapiens
uugagauaucuuggccuuugca

SEQ ID NO: 354097 - RNA, 22 nt, Homo sapiens
uugagcuccucucaaccuaagg

SEQ ID NO: 354098 - RNA, 22 nt, Homo sapiens
uugaggaagugguuccccagag

SEQ ID NO: 354099 - RNA, 22 nt, Homo sapiens
uugauagacacauauccaugug

SEQ ID NO: 354100 - RNA, 22 nt, Homo sapiens
uugcacauuuuuucuggcagaa

SEQ ID NO: 354101 - RNA, 22 nt, Homo sapiens
uugcacucugaagaccuacugu

SEQ ID NO: 354102 - RNA, 20 nt, Homo sapiens
uugcagagcccaacccugga

SEQ ID NO: 354103 - RNA, 22 nt, Homo sapiens
uugcagagccccacacugggcu

SEQ ID NO: 354104 - RNA, 22 nt, Homo sapiens
uugcagagccccugcaaggguc

SEQ ID NO: 354105 - RNA, 22 nt, Homo sapiens
uugcagcaaauaggaaugagga

SEQ ID NO: 354106 - RNA, 22 nt, Homo sapiens
uugcagugugacgacuauauuu

SEQ ID NO: 354107 - RNA, 23 nt, Homo sapiens
uugcauagacauccucauagauu

SEQ ID NO: 354108 - RNA, 22 nt, Homo sapiens
uugcauugacacaugaagcuca

SEQ ID NO: 354109 - RNA, 22 nt, Homo sapiens
uugcuuaggcuggagugcagug

SEQ ID NO: 354110 - RNA, 22 nt, Homo sapiens
uugcuucauucaacauugaggg

SEQ ID NO: 354111 - RNA, 22 nt, Homo sapiens
uuggaaggcugaauggccucuc

SEQ ID NO: 354112 - RNA, 22 nt, Homo sapiens
uuggaagguaaucaaaaguucu

SEQ ID NO: 354113 - RNA, 22 nt, Homo sapiens
uuggcagcacgcaguccagagg

SEQ ID NO: 354114 - RNA, 23 nt, Homo sapiens
uuggcaucugggacacaagcuga

SEQ ID NO: 354115 - RNA, 22 nt, Homo sapiens
uuggccagugucuuuuuuuccu

SEQ ID NO: 354116 - RNA, 22 nt, Homo sapiens
uuggccccuccaaaucucaugu

SEQ ID NO: 354117 - RNA, 22 nt, Homo sapiens
uuggcuuuuaugcagcuuaggu

SEQ ID NO: 354118 - RNA, 22 nt, Homo sapiens
uuguaaagaucauaugcuguuc

SEQ ID NO: 354119 - RNA, 22 nt, Homo sapiens
uugucaaacucauucuccaucc

SEQ ID NO: 354120 - RNA, 19 nt, Homo sapiens
uugucuuagaguugucauu

SEQ ID NO: 354121 - RNA, 22 nt, Homo sapiens
uugugccauucuucugccucag

SEQ ID NO: 354122 - RNA, 18 nt, Homo sapiens
uuguggccccuacaaauu

SEQ ID NO: 354123 - RNA, 22 nt, Homo sapiens
uuuacagucucauagguggaag

SEQ ID NO: 354124 - RNA, 22 nt, Homo sapiens
uuuagcagcaaagagccaugcu

SEQ ID NO: 354125 - RNA, 22 nt, Homo sapiens
uuuauagucaggaacuugagga

SEQ ID NO: 354126 - RNA, 22 nt, Homo sapiens
uuucaggcaagggugacccuga

SEQ ID NO: 354127 - RNA, 22 nt, Homo sapiens
uuugacuuuuagaauaugaguu

SEQ ID NO: 354128 - RNA, 21 nt, Homo sapiens
uuugaucauuaaaagugaauc

SEQ ID NO: 354129 - RNA, 22 nt, Homo sapiens
uuugauguugauacuaccuuca

SEQ ID NO: 354130 - RNA, 22 nt, Homo sapiens
uuugcacucaguaagugggagc

SEQ ID NO: 354131 - RNA, 22 nt, Homo sapiens
uuugcacuuuuguaauaugguu

SEQ ID NO: 354132 - RNA, 22 nt, Homo sapiens
uuugcuuaguaaauguagaaaa

SEQ ID NO: 354133 - RNA, 22 nt, Homo sapiens
uuuggcagaaaacuaaaaggua

SEQ ID NO: 354134 - RNA, 22 nt, Homo sapiens
uuuggcuuuuguaauaacugcc

SEQ ID NO: 354135 - RNA, 22 nt, Homo sapiens
uuuggucagcugcgggucagcu

SEQ ID NO: 354136 - RNA, 22 nt, Homo sapiens
uuuguacuugguguucuggaaa

SEQ ID NO: 354137 - RNA, 22 nt, Homo sapiens
uuuguauguuggagauuggaga

SEQ ID NO: 354138 - RNA, 22 nt, Homo sapiens
uuugugauugcacacucaagau

SEQ ID NO: 354139 - RNA, 22 nt, Homo sapiens
uuugugcuaaugcuagauuacu

SEQ ID NO: 354140 - RNA, 23 nt, Homo sapiens
uuugugcuaauuuaugggcucuu

SEQ ID NO: 354141 - RNA, 22 nt, Homo sapiens
uuugugcuauguuauauauucu

SEQ ID NO: 354142 - RNA, 22 nt, Homo sapiens
uuugugcuccugugagaaucua

SEQ ID NO: 354143 - RNA, 22 nt, Homo sapiens
uuuguggaaugcccuuauuuau

SEQ ID NO: 354144 - RNA, 22 nt, Homo sapiens
uuugugucccucuaaaauuuau

SEQ ID NO: 354145 - RNA, 22 nt, Homo sapiens
uuuuagcaaagagacugguggc

SEQ ID NO: 354146 - RNA, 22 nt, Homo sapiens
uuuuaugggcuauuugcauuag

SEQ ID NO: 354147 - RNA, 19 nt, Homo sapiens
uuuugcucuuuauaccuau

SEQ ID NO: 354148 - RNA, 22 nt, Homo sapiens
uuuuguacaacagcucugggga

SEQ ID NO: 354149 - RNA, 22 nt, Homo sapiens
uuuuuugcuguaugcaaacauc

SEQ ID NO: 354150 - RNA, 22 nt, Homo sapiens
aaucugauguuaucagcuuaag

SEQ ID NO: 354151 - RNA, 22 nt, Homo sapiens
aaucugucuuuuguuauugagg

SEQ ID NO: 354152 - RNA, 22 nt, Homo sapiens
aaugccacugugccugccaagg

SEQ ID NO: 354153 - RNA, 22 nt, Homo sapiens
aauggcaaauguuuucuguuga

SEQ ID NO: 354154 - RNA, 22 nt, Homo sapiens
aauggcacuuuauaaauguuaa

SEQ ID NO: 354155 - RNA, 22 nt, Homo sapiens
aaugugcacuuggagccuugcu

SEQ ID NO: 354156 - RNA, 22 nt, Homo sapiens
aauucuguauuguuuagggacu

SEQ ID NO: 354157 - RNA, 22 nt, Homo sapiens
aauugcaucuguucuuugccag

SEQ ID NO: 354158 - RNA, 21 nt, Homo sapiens
acaaagcuggagggagacugc

SEQ ID NO: 354159 - RNA, 16 nt, Homo sapiens
acaaagcuggcuaucu

SEQ ID NO: 354160 - RNA, 22 nt, Homo sapiens
acaagacuucuuguauucuagu

SEQ ID NO: 354161 - RNA, 22 nt, Homo sapiens
acacaugcuccacuguggccuc

SEQ ID NO: 354162 - RNA, 22 nt, Homo sapiens
acacaugugcguagacucuuua

SEQ ID NO: 354163 - RNA, 22 nt, Homo sapiens
acacuguauccuucuguccuuu

SEQ ID NO: 354164 - RNA, 22 nt, Homo sapiens
acacuguccaguuaggcuacau

SEQ ID NO: 354165 - RNA, 22 nt, Homo sapiens
acacuguuggugggaguguaaa

SEQ ID NO: 354166 - RNA, 22 nt, Homo sapiens
acagagcaaugagcuacggucu

SEQ ID NO: 354167 - RNA, 19 nt, Homo sapiens
acagauagaauguucuaca

SEQ ID NO: 354168 - RNA, 22 nt, Homo sapiens
acaggagugggauuugaguccu

SEQ ID NO: 354169 - RNA, 18 nt, Homo sapiens
acagugcugucacugcuu

SEQ ID NO: 354170 - RNA, 22 nt, Homo sapiens
acagugcuuggcacacaguaau

SEQ ID NO: 354171 - RNA, 22 nt, Homo sapiens
acaguguguguguucaccuaga

SEQ ID NO: 354172 - RNA, 21 nt, Homo sapiens
acaucagaguugugaagguag

SEQ ID NO: 354173 - RNA, 22 nt, Homo sapiens
acaucccaugccuggguacucc

SEQ ID NO: 354174 - RNA, 22 nt, Homo sapiens
acauugcagauguguuuaaugu

SEQ ID NO: 354175 - RNA, 19 nt, Homo sapiens
acauugcauuuguaggcuu

SEQ ID NO: 354176 - RNA, 22 nt, Homo sapiens
accaugcaguccaauaugcaca

SEQ ID NO: 354177 - RNA, 22 nt, Homo sapiens
accauugcacuccagccugggc

SEQ ID NO: 354178 - RNA, 22 nt, Homo sapiens
acccugaagccaugaguggaac

SEQ ID NO: 354179 - RNA, 18 nt, Homo sapiens
aaacagugucucuuucug

SEQ ID NO: 354180 - RNA, 22 nt, Homo sapiens
aaacugucuggaugcuugugga

SEQ ID NO: 354181 - RNA, 22 nt, Homo sapiens
aaaggcacacacuccuuguuau

SEQ ID NO: 354182 - RNA, 20 nt, Homo sapiens
aaaggcugugagaacgagau

SEQ ID NO: 354183 - RNA, 22 nt, Homo sapiens
aaagugccugacucauaguuag

SEQ ID NO: 354184 - RNA, 22 nt, Homo sapiens
aaagugcugagauuguaggcau

SEQ ID NO: 354185 - RNA, 22 nt, Homo sapiens
aaagugcugggaucacacugaa

SEQ ID NO: 354186 - RNA, 19 nt, Homo sapiens
aaaguguuuuaaagaggau

SEQ ID NO: 354187 - RNA, 22 nt, Homo sapiens
aaaugcauaucaagauugcccu

SEQ ID NO: 354188 - RNA, 22 nt, Homo sapiens
aaaugcaucauuaggugauuuu

SEQ ID NO: 354189 - RNA, 22 nt, Homo sapiens
aaaugcucucuacacguuucug

SEQ ID NO: 354190 - RNA, 22 nt, Homo sapiens
aaaugucauggaguguuucccc

SEQ ID NO: 354191 - RNA, 19 nt, Homo sapiens
aaaugugcacuguuuucca

SEQ ID NO: 354192 - RNA, 22 nt, Homo sapiens
aaauucauuucagcucugggua

SEQ ID NO: 354193 - RNA, 18 nt, Homo sapiens
aaauucugucccuucuuc

SEQ ID NO: 354194 - RNA, 22 nt, Homo sapiens
aaauugcuuuugaagacuuagu

SEQ ID NO: 354195 - RNA, 22 nt, Homo sapiens
aacaccaucccuuugaugcuuu

SEQ ID NO: 354196 - RNA, 22 nt, Homo sapiens
aacaccauuuuucugcagccuu

SEQ ID NO: 354197 - RNA, 22 nt, Homo sapiens
aacaguaucuaacgagugauga

SEQ ID NO: 354198 - RNA, 22 nt, Homo sapiens
aacuaugucaaauaaaaugagg

SEQ ID NO: 354199 - RNA, 22 nt, Homo sapiens
aacuggccuggcgugcagaggg

SEQ ID NO: 354200 - RNA, 22 nt, Homo sapiens
aagaccuaugcaggaagaaaug

SEQ ID NO: 354201 - RNA, 22 nt, Homo sapiens
aagagaugaagguccugacugu

SEQ ID NO: 354202 - RNA, 22 nt, Homo sapiens
aagagcauuauuuaguaauuuc

SEQ ID NO: 354203 - RNA, 22 nt, Homo sapiens
aagauauguuaguuauaaacuc

SEQ ID NO: 354204 - RNA, 22 nt, Homo sapiens
aagcuaguguuccagugaacag

SEQ ID NO: 354205 - RNA, 22 nt, Homo sapiens
aagcuggauuucgcauccuguu

SEQ ID NO: 354206 - RNA, 22 nt, Homo sapiens
aaggaagcuagcaggaauuggu

SEQ ID NO: 354207 - RNA, 22 nt, Homo sapiens
aaggcacugaacuuaaauucug

SEQ ID NO: 354208 - RNA, 22 nt, Homo sapiens
aaggcagucacuaaauagugag

SEQ ID NO: 354209 - RNA, 22 nt, Homo sapiens
aaguaaacauuuuguacaauaa

SEQ ID NO: 354210 - RNA, 22 nt, Homo sapiens
aagugaaugugcuggaauagcu

SEQ ID NO: 354211 - RNA, 22 nt, Homo sapiens
aagugucuuaccgggagggagu

SEQ ID NO: 354212 - RNA, 22 nt, Homo sapiens
aaguuaauguuuaagacuccua

SEQ ID NO: 354213 - RNA, 22 nt, Homo sapiens
aauagagucaggguuucaccau

SEQ ID NO: 354214 - RNA, 22 nt, Homo sapiens
aauaucacaggguguacacuca

SEQ ID NO: 354215 - RNA, 22 nt, Homo sapiens
aauaucacaguggguguacacc

SEQ ID NO: 354216 - RNA, 22 nt, Homo sapiens
aaucucagagauaucugugucc

SEQ ID NO: 354217 - RNA, 22 nt, Homo sapiens
gcacaguggcucccgucuauaa

SEQ ID NO: 354218 - RNA, 22 nt, Homo sapiens
gcaccacugcacucucagcuug

SEQ ID NO: 354219 - RNA, 22 nt, Homo sapiens
gcagcagugugggcugaaccua

SEQ ID NO: 354220 - RNA, 20 nt, Homo sapiens
gcaguacuuuuaguucuaag

SEQ ID NO: 354221 - RNA, 19 nt, Homo sapiens
gcaguauugaaggccaguc

SEQ ID NO: 354222 - RNA, 22 nt, Homo sapiens
gcaguggugugugccagccuag

SEQ ID NO: 354223 - RNA, 22 nt, Homo sapiens
gccauagucauagauggcaggg

SEQ ID NO: 354224 - RNA, 22 nt, Homo sapiens
gccauugcacuacagccuaggc

SEQ ID NO: 354225 - RNA, 22 nt, Homo sapiens
gccauugcacuccagccuaggu

SEQ ID NO: 354226 - RNA, 22 nt, Homo sapiens
gccauugcacuccagccucggc

SEQ ID NO: 354227 - RNA, 22 nt, Homo sapiens
gccauugcacucuagccuaggu

SEQ ID NO: 354228 - RNA, 22 nt, Homo sapiens
gcccuguugcccaggcuggagu

SEQ ID NO: 354229 - RNA, 22 nt, Homo sapiens
gcuaggagaucugcugcucucu

SEQ ID NO: 354230 - RNA, 22 nt, Homo sapiens
gcuccuuugaguagcuucugug

SEQ ID NO: 354231 - RNA, 22 nt, Homo sapiens
gcugaaauguuuaauuugggag

SEQ ID NO: 354232 - RNA, 22 nt, Homo sapiens
gcuggcuuucuccugaucucag

SEQ ID NO: 354233 - RNA, 22 nt, Homo sapiens
gcuugguccccacccaaaucgc

SEQ ID NO: 354234 - RNA, 22 nt, Homo sapiens
gcuuuguugauggugagucugu

SEQ ID NO: 354235 - RNA, 21 nt, Homo sapiens
ggaaaguuaaggaaauacccc

SEQ ID NO: 354236 - RNA, 22 nt, Homo sapiens
ggaagacaguguggugauuccu

SEQ ID NO: 354237 - RNA, 22 nt, Homo sapiens
ggaaggucaaagggaaagcaga

SEQ ID NO: 354238 - RNA, 21 nt, Homo sapiens
ggaauuuagggaaugauuuag

SEQ ID NO: 354239 - RNA, 22 nt, Homo sapiens
ggacacaucaugugaccaaggu

SEQ ID NO: 354240 - RNA, 22 nt, Homo sapiens
ggagauaauccagggagggacu

SEQ ID NO: 354241 - RNA, 20 nt, Homo sapiens
ggagguguuggauuucuagu

SEQ ID NO: 354242 - RNA, 22 nt, Homo sapiens
ggcaaggauguuuuucuggcaa

SEQ ID NO: 354243 - RNA, 23 nt, Homo sapiens
ggcacggaauucaaagaggcauu

SEQ ID NO: 354244 - RNA, 23 nt, Homo sapiens
ggcagguuggucuaggucuauuc

SEQ ID NO: 354245 - RNA, 22 nt, Homo sapiens
ggcaguuuguuugugaggucca

SEQ ID NO: 354246 - RNA, 22 nt, Homo sapiens
ggccuguaggguauugguaggg

SEQ ID NO: 354247 - RNA, 22 nt, Homo sapiens
ggcucagugaucuguuucugua

SEQ ID NO: 354248 - RNA, 22 nt, Homo sapiens
ggcucaguugcaaaucaguuca

SEQ ID NO: 354249 - RNA, 22 nt, Homo sapiens
gggaaaaugucuauugaaugaa

SEQ ID NO: 354250 - RNA, 22 nt, Homo sapiens
gggaugaaguugauguagaaag

SEQ ID NO: 354251 - RNA, 22 nt, Homo sapiens
ggggaguguggacaucacccug

SEQ ID NO: 354252 - RNA, 22 nt, Homo sapiens
gggguaggcuacacugaguucc

SEQ ID NO: 354253 - RNA, 22 nt, Homo sapiens
gguagacaucgugcucugugau

SEQ ID NO: 354254 - RNA, 22 nt, Homo sapiens
ggucacauugcuagcauggguu

SEQ ID NO: 354255 - RNA, 19 nt, Homo sapiens
ggucagcaaagucuagcug

SEQ ID NO: 354256 - RNA, 22 nt, Homo sapiens
ggugaggaaaguugaguuucua

SEQ ID NO: 354257 - RNA, 18 nt, Homo sapiens
guaaauguaucuauugcc

SEQ ID NO: 354258 - RNA, 22 nt, Homo sapiens
guaaauguccccugugauauug

SEQ ID NO: 354259 - RNA, 22 nt, Homo sapiens
guaaauguccugcuacagagug

SEQ ID NO: 354260 - RNA, 22 nt, Homo sapiens
guaaggaguaguguaacagugc

SEQ ID NO: 354261 - RNA, 22 nt, Homo sapiens
guacaguacugaaugaauguau

SEQ ID NO: 354262 - RNA, 22 nt, Homo sapiens
guacaguuuagugcuuugagaa

SEQ ID NO: 354263 - RNA, 22 nt, Homo sapiens
guacauguaugcaugcaugcau

SEQ ID NO: 354264 - RNA, 22 nt, Homo sapiens
guacaugugcacagugugcagg

SEQ ID NO: 354265 - RNA, 22 nt, Homo sapiens
guagaaaguuugcugucacaug

SEQ ID NO: 354266 - RNA, 22 nt, Homo sapiens
guagaagcacaggugaguuggu

SEQ ID NO: 354267 - RNA, 22 nt, Homo sapiens
guauuugauuauagcaugcuua

SEQ ID NO: 354268 - RNA, 19 nt, Homo sapiens
gucaaagucgguauucaaa

SEQ ID NO: 354269 - RNA, 22 nt, Homo sapiens
gucacagaggcuaagaccccac

SEQ ID NO: 354270 - RNA, 22 nt, Homo sapiens
guccugaagaccuuccucugga

SEQ ID NO: 354271 - RNA, 22 nt, Homo sapiens
gucucacagcuagcugcuuuau

SEQ ID NO: 354272 - RNA, 22 nt, Homo sapiens
gucucccagccuacaucuuucu

SEQ ID NO: 354273 - RNA, 22 nt, Homo sapiens
gucuuccagccuccaucuuucu

SEQ ID NO: 354274 - RNA, 22 nt, Homo sapiens
gucuuuguuuggucuguaucag

SEQ ID NO: 354275 - RNA, 22 nt, Homo sapiens
gugaaagacagcauuaauggcu

SEQ ID NO: 354276 - RNA, 22 nt, Homo sapiens
gugaaagcaucugacugugcca

SEQ ID NO: 354277 - RNA, 22 nt, Homo sapiens
gugaaauacauaaucccaagug

SEQ ID NO: 354278 - RNA, 22 nt, Homo sapiens
gugaaaugaaucuggaaauauu

SEQ ID NO: 354279 - RNA, 22 nt, Homo sapiens
gugaacuguuugaggaagagaa

SEQ ID NO: 354280 - RNA, 20 nt, Homo sapiens
gugaauacauuugguuucau

SEQ ID NO: 354281 - RNA, 22 nt, Homo sapiens
gugacauuauuucagcuacaug

SEQ ID NO: 354282 - RNA, 22 nt, Homo sapiens
gugacuggacucugaagaaaau

SEQ ID NO: 354283 - RNA, 22 nt, Homo sapiens
gugagagaaugacuauguguuu

SEQ ID NO: 354284 - RNA, 22 nt, Homo sapiens
gugagcuccucuucugcugcag

SEQ ID NO: 354285 - RNA, 22 nt, Homo sapiens
aaguaauugagguuuuugcugu

SEQ ID NO: 354286 - RNA, 22 nt, Homo sapiens
aagugcauguauuaguguaguc

SEQ ID NO: 354287 - RNA, 20 nt, Homo sapiens
aagugcuauuucuuuugugg

SEQ ID NO: 354288 - RNA, 22 nt, Homo sapiens
aagugcuggccuacucaaucga

SEQ ID NO: 354289 - RNA, 22 nt, Homo sapiens
aagugcugggauuggccgggca

SEQ ID NO: 354290 - RNA, 22 nt, Homo sapiens
aagugcuguccuaccuuuggga

SEQ ID NO: 354291 - RNA, 22 nt, Homo sapiens
aagugcuuccuuucagaggguu

SEQ ID NO: 354292 - RNA, 22 nt, Homo sapiens
aagugcuucuuuccucgagaag

SEQ ID NO: 354293 - RNA, 22 nt, Homo sapiens
aagugcuuuacacaugcaugau

SEQ ID NO: 354294 - RNA, 22 nt, Homo sapiens
aagugcuuuguacagggguuga

SEQ ID NO: 354295 - RNA, 22 nt, Homo sapiens
aagugguguuuguauuuaugca

SEQ ID NO: 354296 - RNA, 23 nt, Homo sapiens
aaguucaugcucaucuguuacac

SEQ ID NO: 354297 - RNA, 22 nt, Homo sapiens
aauaaagccugucucuuuagag

SEQ ID NO: 354298 - RNA, 22 nt, Homo sapiens
aauaaguugagaugaggucaua

SEQ ID NO: 354299 - RNA, 22 nt, Homo sapiens
aauauagcuauguacaugucca

SEQ ID NO: 354300 - RNA, 23 nt, Homo sapiens
aauaucacaguggguguacaccc

SEQ ID NO: 354301 - RNA, 22 nt, Homo sapiens
aaucacuuugcuacaaggcagu

SEQ ID NO: 354302 - RNA, 22 nt, Homo sapiens
aaucacuuuggcaccaaccuaa

SEQ ID NO: 354303 - RNA, 22 nt, Homo sapiens
aaugacacugagcaucuuucau

SEQ ID NO: 354304 - RNA, 22 nt, Homo sapiens
aaugcaucuagaaaggugaauu

SEQ ID NO: 354305 - RNA, 22 nt, Homo sapiens
aauggcacacaccuggucuaac

SEQ ID NO: 354306 - RNA, 22 nt, Homo sapiens
aauugcaauggacaaugcagca

SEQ ID NO: 354307 - RNA, 22 nt, Homo sapiens
aauugcuuuuauuuagggccag

SEQ ID NO: 354308 - RNA, 22 nt, Homo sapiens
aauuguacucccaucauuccua

SEQ ID NO: 354309 - RNA, 22 nt, Homo sapiens
acaaaguauggaauguuggugu

SEQ ID NO: 354310 - RNA, 23 nt, Homo sapiens
acacaguaaacuaaaagcuagcu

SEQ ID NO: 354311 - RNA, 22 nt, Homo sapiens
acacaguauaugacaaugcuuu

SEQ ID NO: 354312 - RNA, 22 nt, Homo sapiens
acacagucaaauccacuuggcu

SEQ ID NO: 354313 - RNA, 22 nt, Homo sapiens
acacagugucuguguauuuaaa

SEQ ID NO: 354314 - RNA, 22 nt, Homo sapiens
acaccuguggucccaguaacuu

SEQ ID NO: 354315 - RNA, 22 nt, Homo sapiens
acacugucaugucucacaggca

SEQ ID NO: 354316 - RNA, 22 nt, Homo sapiens
acacuguuuuaguuauuauagc

SEQ ID NO: 354317 - RNA, 22 nt, Homo sapiens
acacuguuuuguggagaaugua

SEQ ID NO: 354318 - RNA, 22 nt, Homo sapiens
acagauagacauauauagcuca

SEQ ID NO: 354319 - RNA, 20 nt, Homo sapiens
acaguagaagggauuucaaa

SEQ ID NO: 354320 - RNA, 22 nt, Homo sapiens
acaguagugggcuacagaauca

SEQ ID NO: 354321 - RNA, 22 nt, Homo sapiens
acagucuggagaaugggugcuc

SEQ ID NO: 354322 - RNA, 22 nt, Homo sapiens
acagugacagaaagcugauuau

SEQ ID NO: 354323 - RNA, 18 nt, Homo sapiens
acagugcuggcaugagau

SEQ ID NO: 354324 - RNA, 22 nt, Homo sapiens
acaguggugcgaucucggcuca

SEQ ID NO: 354325 - RNA, 22 nt, Homo sapiens
acauaaagaagcaggacauugu

SEQ ID NO: 354326 - RNA, 22 nt, Homo sapiens
acaucaggcuugugaugauuac

SEQ ID NO: 354327 - RNA, 22 nt, Homo sapiens
acaugguacugauuuacgaaau

SEQ ID NO: 354328 - RNA, 22 nt, Homo sapiens
accacuguuucaagaagcuugu

SEQ ID NO: 354329 - RNA, 22 nt, Homo sapiens
acccagaguuccuugucuuuca

SEQ ID NO: 354330 - RNA, 22 nt, Homo sapiens
acccaguagccagauguagcug

SEQ ID NO: 354331 - RNA, 21 nt, Homo sapiens
acccccacaccuccuuaguuc

SEQ ID NO: 354332 - RNA, 22 nt, Homo sapiens
acccuggaggucuacagugcag

SEQ ID NO: 354333 - RNA, 22 nt, Homo sapiens
acccuggauucguggccuugaa

SEQ ID NO: 354334 - RNA, 22 nt, Homo sapiens
acuaaggcacaauuuucucaua

SEQ ID NO: 354335 - RNA, 19 nt, Homo sapiens
acugagcuaccugggggca

SEQ ID NO: 354336 - RNA, 18 nt, Homo sapiens
acuggauguaaagggucc

SEQ ID NO: 354337 - RNA, 22 nt, Homo sapiens
acuggcucugcuuuacaaacag

SEQ ID NO: 354338 - RNA, 22 nt, Homo sapiens
acuggcuuuugagaaaaacacu

SEQ ID NO: 354339 - RNA, 20 nt, Homo sapiens
acugggcuaccgaaguaagg

SEQ ID NO: 354340 - RNA, 22 nt, Homo sapiens
acuuuguuauggcaacccuaag

SEQ ID NO: 354341 - RNA, 20 nt, Homo sapiens
agaaccuguaguguagaggg

SEQ ID NO: 354342 - RNA, 22 nt, Homo sapiens
agacaucauuugauggugggag

SEQ ID NO: 354343 - RNA, 19 nt, Homo sapiens
agagacucauuguagcauu

SEQ ID NO: 354344 - RNA, 22 nt, Homo sapiens
agagagcuuuaacuacccauuu

SEQ ID NO: 354345 - RNA, 20 nt, Homo sapiens
agagaucaguaauucaucaa

SEQ ID NO: 354346 - RNA, 22 nt, Homo sapiens
agagugcuauagauuagauuuc

SEQ ID NO: 354347 - RNA, 22 nt, Homo sapiens
agauauguuauugauguuaaug

SEQ ID NO: 354348 - RNA, 22 nt, Homo sapiens
agauggugugcuaggaaaugua

SEQ ID NO: 354349 - RNA, 22 nt, Homo sapiens
agcacagccuuguguuuucuug

SEQ ID NO: 354350 - RNA, 17 nt, Homo sapiens
agcaccacacucucuug

SEQ ID NO: 354351 - RNA, 23 nt, Homo sapiens
agcaccaccccaggucacaagug

SEQ ID NO: 354352 - RNA, 22 nt, Homo sapiens
agcaccauugcacuccagccug

SEQ ID NO: 354353 - RNA, 22 nt, Homo sapiens
agcaccauuuauugaaaagaca

SEQ ID NO: 354354 - RNA, 22 nt, Homo sapiens
agcagcucaugccuuugggagg

SEQ ID NO: 354355 - RNA, 22 nt, Homo sapiens
agcaguagaauuccugcaucac

SEQ ID NO: 354356 - RNA, 22 nt, Homo sapiens
agcauuaguugugaagccuuua

SEQ ID NO: 354357 - RNA, 16 nt, Homo sapiens
agccaccauuuacuug

SEQ ID NO: 354358 - RNA, 19 nt, Homo sapiens
agccaguuuucccagcacc

SEQ ID NO: 354359 - RNA, 17 nt, Homo sapiens
agccccauuagcuaguu

SEQ ID NO: 354360 - RNA, 21 nt, Homo sapiens
agccugugggucauaguugcc

SEQ ID NO: 354361 - RNA, 22 nt, Homo sapiens
agcuaguggucauucaauccuu

SEQ ID NO: 354362 - RNA, 21 nt, Homo sapiens
agcuccacucguucccaaagc

SEQ ID NO: 354363 - RNA, 22 nt, Homo sapiens
agcuggucugauacuuaccucc

SEQ ID NO: 354364 - RNA, 22 nt, Homo sapiens
agcuugugauucuccaucaugu

SEQ ID NO: 354365 - RNA, 22 nt, Homo sapiens
agcuuguguuugucugccuggg

SEQ ID NO: 354366 - RNA, 21 nt, Homo sapiens
aggagcauuguugugguggag

SEQ ID NO: 354367 - RNA, 20 nt, Homo sapiens
aggagcauuuacauuggcuc

SEQ ID NO: 354368 - RNA, 22 nt, Homo sapiens
aggagguagggugugaaacagc

SEQ ID NO: 354369 - RNA, 22 nt, Homo sapiens
aggcagucugaguuuugaaagg

SEQ ID NO: 354370 - RNA, 22 nt, Homo sapiens
aggcuguguggauaauauuggg

SEQ ID NO: 354371 - RNA, 22 nt, Homo sapiens
agggagcaaaguggucuuucuc

SEQ ID NO: 354372 - RNA, 22 nt, Homo sapiens
aggucccauguccucccugacc

SEQ ID NO: 354373 - RNA, 22 nt, Homo sapiens
aguacaauguugaguagaagug

SEQ ID NO: 354374 - RNA, 23 nt, Homo sapiens
aguacuguaguaauugaggggaa

SEQ ID NO: 354375 - RNA, 17 nt, Homo sapiens
aguacugucccauccuu

SEQ ID NO: 354376 - RNA, 22 nt, Homo sapiens
agucacaugccagcacacccag

SEQ ID NO: 354377 - RNA, 17 nt, Homo sapiens
agucaguaguuuguauu

SEQ ID NO: 354378 - RNA, 22 nt, Homo sapiens
agugaucauuugaauugaugau

SEQ ID NO: 354379 - RNA, 22 nt, Homo sapiens
agugcaauggugccaucauagc

SEQ ID NO: 354380 - RNA, 19 nt, Homo sapiens
agugcaauugccuuugugc

SEQ ID NO: 354381 - RNA, 22 nt, Homo sapiens
agugcaguggcacaaucuuggc

SEQ ID NO: 354382 - RNA, 22 nt, Homo sapiens
uucacagucacccuucuccaug

SEQ ID NO: 354383 - RNA, 16 nt, Homo sapiens
uucacauggcagcagg

SEQ ID NO: 354384 - RNA, 23 nt, Homo sapiens
uucaccugguuauuaauagccuc

SEQ ID NO: 354385 - RNA, 22 nt, Homo sapiens
uucacuguagccucagccucuu

SEQ ID NO: 354386 - RNA, 22 nt, Homo sapiens
uucagcuaccugggaugcugaa

SEQ ID NO: 354387 - RNA, 22 nt, Homo sapiens
uucaggcuccugugagaaucua

SEQ ID NO: 354388 - RNA, 22 nt, Homo sapiens
uucagggacuuuagacaagaga

SEQ ID NO: 354389 - RNA, 18 nt, Homo sapiens
uucagugaauucuuuuga

SEQ ID NO: 354390 - RNA, 22 nt, Homo sapiens
uucagugucauuaacacaguag

SEQ ID NO: 354391 - RNA, 21 nt, Homo sapiens
uucauaugcacugagugccca

SEQ ID NO: 354392 - RNA, 22 nt, Homo sapiens
uucaucacagucuccgaugccc

SEQ ID NO: 354393 - RNA, 22 nt, Homo sapiens
uucauggugguacaaaagcaau

SEQ ID NO: 354394 - RNA, 23 nt, Homo sapiens
uuccaccauugacuaguuacaua

SEQ ID NO: 354395 - RNA, 22 nt, Homo sapiens
uuccauuuguucggugucgcca

SEQ ID NO: 354396 - RNA, 22 nt, Homo sapiens
uucucugggacauaggucgggu

SEQ ID NO: 354397 - RNA, 22 nt, Homo sapiens
uucucuggucagaggggagguu

SEQ ID NO: 354398 - RNA, 20 nt, Homo sapiens
uucuugaguuaacaaguuac

SEQ ID NO: 354399 - RNA, 22 nt, Homo sapiens
uucuugcacuuaacugacauuc

SEQ ID NO: 354400 - RNA, 18 nt, Homo sapiens
uucuuguguugauauuuu

SEQ ID NO: 354401 - RNA, 22 nt, Homo sapiens
uugaaagaugaacuggauugga

SEQ ID NO: 354402 - RNA, 22 nt, Homo sapiens
uugaaguaugaccgcugagaau

SEQ ID NO: 354403 - RNA, 22 nt, Homo sapiens
uugacacuaauuauuauaggug

SEQ ID NO: 354404 - RNA, 22 nt, Homo sapiens
uugacacuuuguaagaaagggg

SEQ ID NO: 354405 - RNA, 22 nt, Homo sapiens
uugacauguaaguacucuauag

SEQ ID NO: 354406 - RNA, 22 nt, Homo sapiens
uugagacggagucuugcucuuu

SEQ ID NO: 354407 - RNA, 22 nt, Homo sapiens
uugagauaggaacucacuaugc

SEQ ID NO: 354408 - RNA, 22 nt, Homo sapiens
uugagauggaguucauuuuugu

SEQ ID NO: 354409 - RNA, 22 nt, Homo sapiens
uugagauuuuccucaaauauuu

SEQ ID NO: 354410 - RNA, 22 nt, Homo sapiens
uugaggaggcagucucuccauu

SEQ ID NO: 354411 - RNA, 22 nt, Homo sapiens
uugaggaggcagucugcccauu

SEQ ID NO: 354412 - RNA, 20 nt, Homo sapiens
uugaggugugaggggcagag

SEQ ID NO: 354413 - RNA, 22 nt, Homo sapiens
uugaguaguaagugguucaccg

SEQ ID NO: 354414 - RNA, 22 nt, Homo sapiens
uugauauucugagaagcugaag

SEQ ID NO: 354415 - RNA, 22 nt, Homo sapiens
uugauuagauccaguugauuga

SEQ ID NO: 354416 - RNA, 23 nt, Homo sapiens
uugcaaagccugaaacucuucag

SEQ ID NO: 354417 - RNA, 22 nt, Homo sapiens
uugcaaggugcucgaagggcuc

SEQ ID NO: 354418 - RNA, 18 nt, Homo sapiens
uugcacuccugccugggu

SEQ ID NO: 354419 - RNA, 22 nt, Homo sapiens
uugcagcaaagagggaggggca

SEQ ID NO: 354420 - RNA, 22 nt, Homo sapiens
uugcaguagucugaaagcaaua

SEQ ID NO: 354421 - RNA, 19 nt, Homo sapiens
uugcaguauccuauauguu

SEQ ID NO: 354422 - RNA, 22 nt, Homo sapiens
uugccacuucucuugccccauu

SEQ ID NO: 354423 - RNA, 22 nt, Homo sapiens
uuggacugagaguuccaccauu

SEQ ID NO: 354424 - RNA, 22 nt, Homo sapiens
uuggacugggauggccgaggcu

SEQ ID NO: 354425 - RNA, 22 nt, Homo sapiens
uuggcauugaguuucaaaucau

SEQ ID NO: 354426 - RNA, 22 nt, Homo sapiens
uuggccccuuucauccacagcu

SEQ ID NO: 354427 - RNA, 22 nt, Homo sapiens
uugggagugucucuggacugca

SEQ ID NO: 354428 - RNA, 22 nt, Homo sapiens
uuguaaaguucuuaggaagcuc

SEQ ID NO: 354429 - RNA, 22 nt, Homo sapiens
uuguccacugcuagccucugca

SEQ ID NO: 354430 - RNA, 22 nt, Homo sapiens
uugugguugaugaagacugucu

SEQ ID NO: 354431 - RNA, 22 nt, Homo sapiens
uuuaaugcacuaggugguguuc

SEQ ID NO: 354432 - RNA, 21 nt, Homo sapiens
augucauggaugacuaauuca

SEQ ID NO: 354433 - RNA, 22 nt, Homo sapiens
augugcaaauuuccaaacucuu

SEQ ID NO: 354434 - RNA, 22 nt, Homo sapiens
augugcaauggugucaccacau

SEQ ID NO: 354435 - RNA, 21 nt, Homo sapiens
augugcacuaugucauuuaau

SEQ ID NO: 354436 - RNA, 22 nt, Homo sapiens
augugcagauguuacaaauugu

SEQ ID NO: 354437 - RNA, 22 nt, Homo sapiens
auguggaaagcagcaugauaug

SEQ ID NO: 354438 - RNA, 22 nt, Homo sapiens
augugggaggacuuggcuguug

SEQ ID NO: 354439 - RNA, 22 nt, Homo sapiens
auuaacaucuagaguuuuggug

SEQ ID NO: 354440 - RNA, 22 nt, Homo sapiens
auuaaggaguggguucauggug

SEQ ID NO: 354441 - RNA, 22 nt, Homo sapiens
auuaagugcuugccagugcugg

SEQ ID NO: 354442 - RNA, 22 nt, Homo sapiens
auuaaguuaggauuuugagaua

SEQ ID NO: 354443 - RNA, 22 nt, Homo sapiens
auuauauguguaugugcauacc

SEQ ID NO: 354444 - RNA, 22 nt, Homo sapiens
auuaucacaguuuugcauaugg

SEQ ID NO: 354445 - RNA, 22 nt, Homo sapiens
auucaucagggauauugguuga

SEQ ID NO: 354446 - RNA, 22 nt, Homo sapiens
auuccauuuguguggaauggcu

SEQ ID NO: 354447 - RNA, 22 nt, Homo sapiens
auugcaaugggaaacuaugaaa

SEQ ID NO: 354448 - RNA, 22 nt, Homo sapiens
auugcaauuaguccauagaguu

SEQ ID NO: 354449 - RNA, 22 nt, Homo sapiens
auugcacuccagccuggcaaua

SEQ ID NO: 354450 - RNA, 22 nt, Homo sapiens
auugcacuccagccuugugaca

SEQ ID NO: 354451 - RNA, 22 nt, Homo sapiens
auugcuaauaugcuucaggcaa

SEQ ID NO: 354452 - RNA, 22 nt, Homo sapiens
auugcucuuagaaauauuucuu

SEQ ID NO: 354453 - RNA, 22 nt, Homo sapiens
auuguacuagguccuagggcuu

SEQ ID NO: 354454 - RNA, 22 nt, Homo sapiens
auuguacuccagccugggcugc

SEQ ID NO: 354455 - RNA, 22 nt, Homo sapiens
auuguacucuagccucugggca

SEQ ID NO: 354456 - RNA, 22 nt, Homo sapiens
auuguacuuauugccagaauuu

SEQ ID NO: 354457 - RNA, 22 nt, Homo sapiens
auugucacugugcuccaccagu

SEQ ID NO: 354458 - RNA, 22 nt, Homo sapiens
auuuaugguuaauauaggaagu

SEQ ID NO: 354459 - RNA, 22 nt, Homo sapiens
auuuugguuacauaguugagcu

SEQ ID NO: 354460 - RNA, 22 nt, Homo sapiens
auuuuugguugguaggcuauua

SEQ ID NO: 354461 - RNA, 22 nt, Homo sapiens
caaaguaauugcuguuuugcca

SEQ ID NO: 354462 - RNA, 22 nt, Homo sapiens
agugcaauggcgugaucuuggc

SEQ ID NO: 354463 - RNA, 22 nt, Homo sapiens
agugcacuccagccugggcaac

SEQ ID NO: 354464 - RNA, 19 nt, Homo sapiens
auaaaugccuacaagggug

SEQ ID NO: 354465 - RNA, 22 nt, Homo sapiens
auaaaugccuguuguuuuaagc

SEQ ID NO: 354466 - RNA, 22 nt, Homo sapiens
auaaaugcuuagaucuguauau

SEQ ID NO: 354467 - RNA, 22 nt, Homo sapiens
auaagaagugaaccagacgucu

SEQ ID NO: 354468 - RNA, 22 nt, Homo sapiens
auaaggcagcugcuaaaaggca

SEQ ID NO: 354469 - RNA, 22 nt, Homo sapiens
auacacauuccugggccucacc

SEQ ID NO: 354470 - RNA, 22 nt, Homo sapiens
auacacgugccauguugguaug

SEQ ID NO: 354471 - RNA, 19 nt, Homo sapiens
auacacguguauacauaca

SEQ ID NO: 354472 - RNA, 22 nt, Homo sapiens
auacaguaucuucuggcaagca

SEQ ID NO: 354473 - RNA, 22 nt, Homo sapiens
auacaguauggagggcccagcu

SEQ ID NO: 354474 - RNA, 22 nt, Homo sapiens
auacauguucaagggcauauau

SEQ ID NO: 354475 - RNA, 22 nt, Homo sapiens
auaguacuauugcaguguuaua

SEQ ID NO: 354476 - RNA, 22 nt, Homo sapiens
auauaugcacacgugugcauau

SEQ ID NO: 354477 - RNA, 22 nt, Homo sapiens
auaucacucccaauaucgcagg

SEQ ID NO: 354478 - RNA, 22 nt, Homo sapiens
auaugcaaauccauagagacag

SEQ ID NO: 354479 - RNA, 22 nt, Homo sapiens
auaugcauacauguaugcagga

SEQ ID NO: 354480 - RNA, 22 nt, Homo sapiens
auauguauuuuaacguguaagg

SEQ ID NO: 354481 - RNA, 22 nt, Homo sapiens
aucacagauauggguuuaaauc

SEQ ID NO: 354482 - RNA, 22 nt, Homo sapiens
aucacagguacuauggcugaca

SEQ ID NO: 354483 - RNA, 22 nt, Homo sapiens
aucacagugagcauaugucuau

SEQ ID NO: 354484 - RNA, 22 nt, Homo sapiens
aucaggaaccuuuuuggugugu

SEQ ID NO: 354485 - RNA, 22 nt, Homo sapiens
aucaugucuucccagugauucu

SEQ ID NO: 354486 - RNA, 20 nt, Homo sapiens
aucccauuccugaagauacu

SEQ ID NO: 354487 - RNA, 22 nt, Homo sapiens
aucccugagccugacucucaga

SEQ ID NO: 354488 - RNA, 22 nt, Homo sapiens
aucccuuucugauacuuucccu

SEQ ID NO: 354489 - RNA, 22 nt, Homo sapiens
auccuuuagacuguccaguuga

SEQ ID NO: 354490 - RNA, 22 nt, Homo sapiens
aucgcacuccauccugggcaac

SEQ ID NO: 354491 - RNA, 22 nt, Homo sapiens
aucugguguuuccuucacauug

SEQ ID NO: 354492 - RNA, 22 nt, Homo sapiens
augaaaucuuuggcagaucuua

SEQ ID NO: 354493 - RNA, 22 nt, Homo sapiens
augaaauguaugagucuggguu

SEQ ID NO: 354494 - RNA, 19 nt, Homo sapiens
augaacucauucuuuuuau

SEQ ID NO: 354495 - RNA, 17 nt, Homo sapiens
augaagucaucauuuuu

SEQ ID NO: 354496 - RNA, 22 nt, Homo sapiens
augacauguauuuccaggauuu

SEQ ID NO: 354497 - RNA, 19 nt, Homo sapiens
augacauuuggggguggac

SEQ ID NO: 354498 - RNA, 22 nt, Homo sapiens
augacuggauaauggacacaca

SEQ ID NO: 354499 - RNA, 22 nt, Homo sapiens
augagaacugucaaugagagcu

SEQ ID NO: 354500 - RNA, 22 nt, Homo sapiens
augagagcuaacuguggguaca

SEQ ID NO: 354501 - RNA, 22 nt, Homo sapiens
augagauaggaacaaacuuaca

SEQ ID NO: 354502 - RNA, 22 nt, Homo sapiens
augagaugaauaccgacgaugu

SEQ ID NO: 354503 - RNA, 22 nt, Homo sapiens
augagcuaggacagaaugucag

SEQ ID NO: 354504 - RNA, 22 nt, Homo sapiens
augagcuguuuggaagacacuu

SEQ ID NO: 354505 - RNA, 22 nt, Homo sapiens
augagggagggguggugccgca

SEQ ID NO: 354506 - RNA, 22 nt, Homo sapiens
augagucacuuauuauuggggu

SEQ ID NO: 354507 - RNA, 22 nt, Homo sapiens
augauggaggccgugauggacg

SEQ ID NO: 354508 - RNA, 22 nt, Homo sapiens
augcagagucccagccccuagc

SEQ ID NO: 354509 - RNA, 22 nt, Homo sapiens
augccaagagacaaagggaauc

SEQ ID NO: 354510 - RNA, 19 nt, Homo sapiens
augccuggagaugguuaua

SEQ ID NO: 354511 - RNA, 22 nt, Homo sapiens
auggagaugaauaucaucuguu

SEQ ID NO: 354512 - RNA, 22 nt, Homo sapiens
auggagcuugacaguuguagag

SEQ ID NO: 354513 - RNA, 22 nt, Homo sapiens
auggagugagaauggagguucc

SEQ ID NO: 354514 - RNA, 22 nt, Homo sapiens
auggaguuugaacaauuuccug

SEQ ID NO: 354515 - RNA, 22 nt, Homo sapiens
auggcccaguuugcuaucccua

SEQ ID NO: 354516 - RNA, 22 nt, Homo sapiens
auggcccugggaaaggaggcau

SEQ ID NO: 354517 - RNA, 22 nt, Homo sapiens
auggcucaguguguaucuauca

SEQ ID NO: 354518 - RNA, 22 nt, Homo sapiens
auggcucuuauuauuuugaggu

SEQ ID NO: 354519 - RNA, 22 nt, Homo sapiens
auggcuuuggucucccagugau

SEQ ID NO: 354520 - RNA, 22 nt, Homo sapiens
auggcuuuuauuguguugaggu

SEQ ID NO: 354521 - RNA, 22 nt, Homo sapiens
auggcuuuucacagaggguucu

SEQ ID NO: 354522 - RNA, 22 nt, Homo sapiens
auggcuuuuuucuugggcacuc

SEQ ID NO: 354523 - RNA, 22 nt, Homo sapiens
auguaaacuacagauuuugggu

SEQ ID NO: 354524 - RNA, 22 nt, Homo sapiens
auguaagugugcucaaauguua

SEQ ID NO: 354525 - RNA, 22 nt, Homo sapiens
auguauggaguuuaggggaugg

SEQ ID NO: 354526 - RNA, 22 nt, Homo sapiens
augugcauaugaagcacagaca

SEQ ID NO: 354527 - RNA, 22 nt, Homo sapiens
auuaaauguuggacguauacau

SEQ ID NO: 354528 - RNA, 22 nt, Homo sapiens
auuacauagucaaggugucuca

SEQ ID NO: 354529 - RNA, 20 nt, Homo sapiens
auuagagcuacauggcuaca

SEQ ID NO: 354530 - RNA, 22 nt, Homo sapiens
auuagguaauauaaucauggca

SEQ ID NO: 354531 - RNA, 22 nt, Homo sapiens
auuauuaguuguugaaugaagu

SEQ ID NO: 354532 - RNA, 22 nt, Homo sapiens
auucaagugaugcagcuguuuu

SEQ ID NO: 354533 - RNA, 22 nt, Homo sapiens
auuccacagccgauaccaugac

SEQ ID NO: 354534 - RNA, 22 nt, Homo sapiens
auuccacaguuaacacagaccg

SEQ ID NO: 354535 - RNA, 22 nt, Homo sapiens
auucccuguagaauaaggaugg

SEQ ID NO: 354536 - RNA, 22 nt, Homo sapiens
auugcacuccagccuaggcaac

SEQ ID NO: 354537 - RNA, 22 nt, Homo sapiens
auugcacuccagccugggcaac

SEQ ID NO: 354538 - RNA, 22 nt, Homo sapiens
auugcacuccagccugggcgac

SEQ ID NO: 354539 - RNA, 22 nt, Homo sapiens
auugcacuccagccugggcuag

SEQ ID NO: 354540 - RNA, 22 nt, Homo sapiens
auugcacuccagccuugggcaa

SEQ ID NO: 354541 - RNA, 22 nt, Homo sapiens
auugcacuccauccugggcaau

SEQ ID NO: 354542 - RNA, 22 nt, Homo sapiens
auugcauaaacacauuucuuau

SEQ ID NO: 354543 - RNA, 22 nt, Homo sapiens
auugcauugugaucuucccaga

SEQ ID NO: 354544 - RNA, 22 nt, Homo sapiens
auuguacuccagccugggcaaa

SEQ ID NO: 354545 - RNA, 22 nt, Homo sapiens
auuguacuccagccugggcagc

SEQ ID NO: 354546 - RNA, 22 nt, Homo sapiens
auuguacuccagccugggcgac

SEQ ID NO: 354547 - RNA, 22 nt, Homo sapiens
auuguacuccagccuuggggac

SEQ ID NO: 354548 - RNA, 22 nt, Homo sapiens
auugugcuaaaguaauaaguca

SEQ ID NO: 354549 - RNA, 22 nt, Homo sapiens
auuugggaaugugcauuauacu

SEQ ID NO: 354550 - RNA, 22 nt, Homo sapiens
auuugguaauauuuaaggacuu

SEQ ID NO: 354551 - RNA, 22 nt, Homo sapiens
caaaggauucauuuccaggagu

SEQ ID NO: 354552 - RNA, 22 nt, Homo sapiens
caaaguaauugugguuuugcca

SEQ ID NO: 354553 - RNA, 22 nt, Homo sapiens
caaagugcugggacuggccggg

SEQ ID NO: 354554 - RNA, 19 nt, Homo sapiens
caaaguguucuucuuugcc

SEQ ID NO: 354555 - RNA, 22 nt, Homo sapiens
caauacuguguugaauaagagu

SEQ ID NO: 354556 - RNA, 19 nt, Homo sapiens
caauacuucuuggcauaca

SEQ ID NO: 354557 - RNA, 22 nt, Homo sapiens
gaccacauuccacacaggcuuu

SEQ ID NO: 354558 - RNA, 18 nt, Homo sapiens
gacuccauuucagccaga

SEQ ID NO: 354559 - RNA, 22 nt, Homo sapiens
gacuuagaauuuuugccugcua

SEQ ID NO: 354560 - RNA, 22 nt, Homo sapiens
gacuugaagaaucuaagggagg

SEQ ID NO: 354561 - RNA, 22 nt, Homo sapiens
gagaacauacggcauuugguuu

SEQ ID NO: 354562 - RNA, 22 nt, Homo sapiens
gagacggagucucgcucuguca

SEQ ID NO: 354563 - RNA, 22 nt, Homo sapiens
gagacugagucucacucuguca

SEQ ID NO: 354564 - RNA, 22 nt, Homo sapiens
gagacugagucuugcucugucg

SEQ ID NO: 354565 - RNA, 22 nt, Homo sapiens
gagagcuaggccacuggggcuu

SEQ ID NO: 354566 - RNA, 21 nt, Homo sapiens
gagaggauucgccagccucuu

SEQ ID NO: 354567 - RNA, 22 nt, Homo sapiens
gagagugcuuggcaucugcuga

SEQ ID NO: 354568 - RNA, 22 nt, Homo sapiens
gagauaauagcuauaggaucuu

SEQ ID NO: 354569 - RNA, 22 nt, Homo sapiens
gagauaauuugaaucauggggg

SEQ ID NO: 354570 - RNA, 22 nt, Homo sapiens
gagauaggauucacuuucaugu

SEQ ID NO: 354571 - RNA, 21 nt, Homo sapiens
gagauagguaccgaagcuuag

SEQ ID NO: 354572 - RNA, 22 nt, Homo sapiens
gagaucaaguauucuccacuaa

SEQ ID NO: 354573 - RNA, 22 nt, Homo sapiens
gagccuguaggaggagaggugg

SEQ ID NO: 354574 - RNA, 22 nt, Homo sapiens
gagcuacacugauucauuuguu

SEQ ID NO: 354575 - RNA, 22 nt, Homo sapiens
gaggcaagaguaguuaaguuag

SEQ ID NO: 354576 - RNA, 22 nt, Homo sapiens
gaggcacucuguacaaaucugc

SEQ ID NO: 354577 - RNA, 22 nt, Homo sapiens
gagguugggaugagggauacag

SEQ ID NO: 354578 - RNA, 22 nt, Homo sapiens
gagugcaauggcaugaucuggg

SEQ ID NO: 354579 - RNA, 22 nt, Homo sapiens
gagugcuguuagcccuggguuu

SEQ ID NO: 354580 - RNA, 22 nt, Homo sapiens
gauauguaguaguugaaaaaga

SEQ ID NO: 354581 - RNA, 22 nt, Homo sapiens
gaucacaugggagaaugagagu

SEQ ID NO: 354582 - RNA, 22 nt, Homo sapiens
gaucacauuguuucauacauau

SEQ ID NO: 354583 - RNA, 22 nt, Homo sapiens
gauggcacuaagccauguagga

SEQ ID NO: 354584 - RNA, 22 nt, Homo sapiens
gauggcacuuaagagcaagagc

SEQ ID NO: 354585 - RNA, 22 nt, Homo sapiens
gauggcaugugcugccaccaag

SEQ ID NO: 354586 - RNA, 22 nt, Homo sapiens
gauuucaucuuuagaggaagga

SEQ ID NO: 354587 - RNA, 22 nt, Homo sapiens
gcacaggguuacauucuaaggu

SEQ ID NO: 354588 - RNA, 22 nt, Homo sapiens
gcacaguuaaagggucauguga

SEQ ID NO: 354589 - RNA, 22 nt, Homo sapiens
gcacugagagaagccccaagua

SEQ ID NO: 354590 - RNA, 22 nt, Homo sapiens
gcagagaaacaggucuaaggag

SEQ ID NO: 354591 - RNA, 23 nt, Homo sapiens
gcagcaaugucacagggguccgg

SEQ ID NO: 354592 - RNA, 22 nt, Homo sapiens
gcaggcaugacauuucacucuu

SEQ ID NO: 354593 - RNA, 22 nt, Homo sapiens
gcaugguaguaaccuacauuug

SEQ ID NO: 354594 - RNA, 22 nt, Homo sapiens
gccauugcacuccagccuagcg

SEQ ID NO: 354595 - RNA, 22 nt, Homo sapiens
gccauugcacuccagccuaggc

SEQ ID NO: 354596 - RNA, 22 nt, Homo sapiens
gccauugcacuccagccugagc

SEQ ID NO: 354597 - RNA, 22 nt, Homo sapiens
gcccagcguucagggaggggcu

SEQ ID NO: 354598 - RNA, 22 nt, Homo sapiens
gccuuuggugacaggcaugugu

SEQ ID NO: 354599 - RNA, 22 nt, Homo sapiens
gcuaaggcagggcaaucauuug

SEQ ID NO: 354600 - RNA, 22 nt, Homo sapiens
gcucaguuuccucagcugcaaa

SEQ ID NO: 354601 - RNA, 22 nt, Homo sapiens
gcugucaugagcaacacaugaa

SEQ ID NO: 354602 - RNA, 22 nt, Homo sapiens
gcugugguuuaguagaaagaag

SEQ ID NO: 354603 - RNA, 19 nt, Homo sapiens
gcuuuguggggaaggagcc

SEQ ID NO: 354604 - RNA, 23 nt, Homo sapiens
ggaaauguuuaagggguugggag

SEQ ID NO: 354605 - RNA, 22 nt, Homo sapiens
ggaaauguuuagcauccacuuu

SEQ ID NO: 354606 - RNA, 22 nt, Homo sapiens
ggaaguauaaacuuaguggagu

SEQ ID NO: 354607 - RNA, 22 nt, Homo sapiens
ggacaguagugcuuucuaucau

SEQ ID NO: 354608 - RNA, 22 nt, Homo sapiens
ggacugagaggacuacagugua

SEQ ID NO: 354609 - RNA, 22 nt, Homo sapiens
ggagaugaaaugagcuacuuaa

SEQ ID NO: 354610 - RNA, 22 nt, Homo sapiens
ggcaaaauauugucugguauag

SEQ ID NO: 354611 - RNA, 22 nt, Homo sapiens
ggcaaaaucgcaauuacuuuug

SEQ ID NO: 354612 - RNA, 22 nt, Homo sapiens
ggcaagaucuuggcucacugaa

SEQ ID NO: 354613 - RNA, 22 nt, Homo sapiens
ggcaaggugcuacagacaguga

SEQ ID NO: 354614 - RNA, 19 nt, Homo sapiens
ggcaauacuuucuuguugg

SEQ ID NO: 354615 - RNA, 22 nt, Homo sapiens
ggcagaucauuggccucaguuu

SEQ ID NO: 354616 - RNA, 22 nt, Homo sapiens
ggcuagagaauagugccacuaa

SEQ ID NO: 354617 - RNA, 22 nt, Homo sapiens
ggcuagagacaaguugcugaga

SEQ ID NO: 354618 - RNA, 22 nt, Homo sapiens
gggaagaaggagugguuuacuc

SEQ ID NO: 354619 - RNA, 22 nt, Homo sapiens
gggaagugugguuucuuuacag

SEQ ID NO: 354620 - RNA, 18 nt, Homo sapiens
gggcaaguugccuggcuu

SEQ ID NO: 354621 - RNA, 22 nt, Homo sapiens
gggcgagaaucggcugcucagc

SEQ ID NO: 354622 - RNA, 22 nt, Homo sapiens
gggguauguaagugagugagug

SEQ ID NO: 354623 - RNA, 22 nt, Homo sapiens
ggucacauuggacuaucaaguu

SEQ ID NO: 354624 - RNA, 22 nt, Homo sapiens
ggugacugguuuaucuggcagu

SEQ ID NO: 354625 - RNA, 23 nt, Homo sapiens
ggugaggaguacagagucuucau

SEQ ID NO: 354626 - RNA, 22 nt, Homo sapiens
guaacacaugcugcucucuggu

SEQ ID NO: 354627 - RNA, 22 nt, Homo sapiens
guaagugguagagcugggcuau

SEQ ID NO: 354628 - RNA, 17 nt, Homo sapiens
guacacuucuucuguga

SEQ ID NO: 354629 - RNA, 22 nt, Homo sapiens
guacaguauaguaauaggauuu

SEQ ID NO: 354630 - RNA, 22 nt, Homo sapiens
guauacaugucaaaacucacau

SEQ ID NO: 354631 - RNA, 22 nt, Homo sapiens
guaugauacuguaacagugggu

SEQ ID NO: 354632 - RNA, 22 nt, Homo sapiens
guauuagaugguauuugaagau

SEQ ID NO: 354633 - RNA, 22 nt, Homo sapiens
gucaguuucacucagcuggaac

SEQ ID NO: 354634 - RNA, 22 nt, Homo sapiens
gucucccagccuacauauuucu

SEQ ID NO: 354635 - RNA, 22 nt, Homo sapiens
gucucugguugcuuuuguacca

SEQ ID NO: 354636 - RNA, 22 nt, Homo sapiens
gucuggagacuugggucaucaa

SEQ ID NO: 354637 - RNA, 22 nt, Homo sapiens
gugaaagacauauaugguuuga

SEQ ID NO: 354638 - RNA, 22 nt, Homo sapiens
gugaaagauuaaaccagugugu

SEQ ID NO: 354639 - RNA, 22 nt, Homo sapiens
gugaaguuuuugugaggccuaa

SEQ ID NO: 354640 - RNA, 22 nt, Homo sapiens
gugacauuuuuacugaugagag

SEQ ID NO: 354641 - RNA, 22 nt, Homo sapiens
gugagauacuagagauauagug

SEQ ID NO: 354642 - RNA, 22 nt, Homo sapiens
gugagaugugacuucugccucu

SEQ ID NO: 354643 - RNA, 22 nt, Homo sapiens
gugagauuaguucuggaccugg

SEQ ID NO: 354644 - RNA, 22 nt, Homo sapiens
gugagcauaggaggcuucuguu

SEQ ID NO: 354645 - RNA, 22 nt, Homo sapiens
gugaggcuuuuccuguuagacu

SEQ ID NO: 354646 - RNA, 22 nt, Homo sapiens
gugauguguuucaacagcuccu

SEQ ID NO: 354647 - RNA, 22 nt, Homo sapiens
gugcaaaucucugaguaucuuu

SEQ ID NO: 354648 - RNA, 22 nt, Homo sapiens
gugcaaugagaaggggcucugg

SEQ ID NO: 354649 - RNA, 20 nt, Homo sapiens
guggaagauaaguagccuga

SEQ ID NO: 354650 - RNA, 22 nt, Homo sapiens
guggaaggucaugaauguucuu

SEQ ID NO: 354651 - RNA, 22 nt, Homo sapiens
guggacggagguugcagugagc

SEQ ID NO: 354652 - RNA, 22 nt, Homo sapiens
ucaaaugcuguauuguaguaau

SEQ ID NO: 354653 - RNA, 22 nt, Homo sapiens
ucaaauguucccuguacuggcc

SEQ ID NO: 354654 - RNA, 22 nt, Homo sapiens
ucaagcaauucugcugccucag

SEQ ID NO: 354655 - RNA, 22 nt, Homo sapiens
ucacacugucuugguuacucuu

SEQ ID NO: 354656 - RNA, 22 nt, Homo sapiens
ucacacuguuuugauuauuaua

SEQ ID NO: 354657 - RNA, 22 nt, Homo sapiens
ucacagauaaauaaagaugauu

SEQ ID NO: 354658 - RNA, 22 nt, Homo sapiens
ucacagcuaaaaugaaaguagu

SEQ ID NO: 354659 - RNA, 22 nt, Homo sapiens
ucacaggguguuauuagaauua

SEQ ID NO: 354660 - RNA, 22 nt, Homo sapiens
ucacaguagagcuucuuucaga

SEQ ID NO: 354661 - RNA, 22 nt, Homo sapiens
ucacagucggugacuucuugcu

SEQ ID NO: 354662 - RNA, 22 nt, Homo sapiens
ucacaguugauugaaacacagc

SEQ ID NO: 354663 - RNA, 22 nt, Homo sapiens
ucacauguguaugagcuuugau

SEQ ID NO: 354664 - RNA, 22 nt, Homo sapiens
ucacauuguguagccugcucac

SEQ ID NO: 354665 - RNA, 22 nt, Homo sapiens
ucaccaccugcugaucauagag

SEQ ID NO: 354666 - RNA, 20 nt, Homo sapiens
ucacuggagcucauuugauu

SEQ ID NO: 354667 - RNA, 22 nt, Homo sapiens
ucacugggagcauuugagccuu

SEQ ID NO: 354668 - RNA, 22 nt, Homo sapiens
ucagagucuagaucacucacug

SEQ ID NO: 354669 - RNA, 22 nt, Homo sapiens
ucaguagcaugaaaacagacua

SEQ ID NO: 354670 - RNA, 23 nt, Homo sapiens
ucaguagucauugggaaagugug

SEQ ID NO: 354671 - RNA, 22 nt, Homo sapiens
ucaguggagcuacaauucuggg

SEQ ID NO: 354672 - RNA, 22 nt, Homo sapiens
ucauaguagucacuuaauaaau

SEQ ID NO: 354673 - RNA, 22 nt, Homo sapiens
ucaucaggaaacuuaugcagug

SEQ ID NO: 354674 - RNA, 22 nt, Homo sapiens
ucauccauacaguuagcaaagg

SEQ ID NO: 354675 - RNA, 22 nt, Homo sapiens
ucauugcaaucucugccucccg

SEQ ID NO: 354676 - RNA, 22 nt, Homo sapiens
uccacaguaaggacccugccuu

SEQ ID NO: 354677 - RNA, 22 nt, Homo sapiens
uccagaguggugaugcuggggc

SEQ ID NO: 354678 - RNA, 22 nt, Homo sapiens
uccaugagaauaguuaggcucu

SEQ ID NO: 354679 - RNA, 22 nt, Homo sapiens
uccaugaggcuacaguaaucuc

SEQ ID NO: 354680 - RNA, 19 nt, Homo sapiens
uccccaguuuuccguucag

SEQ ID NO: 354681 - RNA, 22 nt, Homo sapiens
ucccuacuggggcacugccuag

SEQ ID NO: 354682 - RNA, 22 nt, Homo sapiens
ucccugaagcugcagcaacaca

SEQ ID NO: 354683 - RNA, 22 nt, Homo sapiens
ucccugacagggucugagcuuu

SEQ ID NO: 354684 - RNA, 22 nt, Homo sapiens
ucccuguagugccuagaucaga

SEQ ID NO: 354685 - RNA, 22 nt, Homo sapiens
ucccuguguccugggggcaccu

SEQ ID NO: 354686 - RNA, 22 nt, Homo sapiens
ucccuugguaauucuguuccuu

SEQ ID NO: 354687 - RNA, 20 nt, Homo sapiens
uccugagauucccaguucuc

SEQ ID NO: 354688 - RNA, 22 nt, Homo sapiens
uccuugaaacaggaagaauuca

SEQ ID NO: 354689 - RNA, 22 nt, Homo sapiens
uccuugagucuuugcucagaug

SEQ ID NO: 354690 - RNA, 22 nt, Homo sapiens
uccuuuguuacaguuggcucug

SEQ ID NO: 354691 - RNA, 22 nt, Homo sapiens
ucuauguuuuugcuaguagugu

SEQ ID NO: 354692 - RNA, 22 nt, Homo sapiens
ucucacaggguuauugaggggg

SEQ ID NO: 354693 - RNA, 22 nt, Homo sapiens
ucucacauuucacagggauggg

SEQ ID NO: 354694 - RNA, 22 nt, Homo sapiens
ucucaguguuaucuaucugccu

SEQ ID NO: 354695 - RNA, 22 nt, Homo sapiens
ucucuguuuagagccagcaauu

SEQ ID NO: 354696 - RNA, 22 nt, Homo sapiens
ucugacagugagagaaaucuga

SEQ ID NO: 354697 - RNA, 22 nt, Homo sapiens
ucugagcaugcaucuugccugg

SEQ ID NO: 354698 - RNA, 22 nt, Homo sapiens
ucugagucaucacaaaugaugc

SEQ ID NO: 354699 - RNA, 21 nt, Homo sapiens
ucugagucauucaguggccug

SEQ ID NO: 354700 - RNA, 22 nt, Homo sapiens
ucugccuuuucaugugggaugg

SEQ ID NO: 354701 - RNA, 22 nt, Homo sapiens
ucuggccuagaacaauuaauua

SEQ ID NO: 354702 - RNA, 22 nt, Homo sapiens
ucuggcuuucuuuacuuaaugu

SEQ ID NO: 354703 - RNA, 23 nt, Homo sapiens
ucuggcuuugggaugcucaaggg

SEQ ID NO: 354704 - RNA, 22 nt, Homo sapiens
ucuggcuuugugaguugccaga

SEQ ID NO: 354705 - RNA, 20 nt, Homo sapiens
ucuggguuuuggccacgccc

SEQ ID NO: 354706 - RNA, 22 nt, Homo sapiens
ucugucacugguggacgaucac

SEQ ID NO: 354707 - RNA, 22 nt, Homo sapiens
ucuguguuugaucaagauugua

SEQ ID NO: 354708 - RNA, 22 nt, Homo sapiens
ucuguugguucuuugaggagga

SEQ ID NO: 354709 - RNA, 22 nt, Homo sapiens
ucuguuguuguuuuaagagaca

SEQ ID NO: 354710 - RNA, 22 nt, Homo sapiens
ucuuugaguuauugugcagacu

SEQ ID NO: 354711 - RNA, 23 nt, Homo sapiens
ucuuuggcucuaauauaccuugu

SEQ ID NO: 354712 - RNA, 22 nt, Homo sapiens
ugaaacugcagugggcuuggca

SEQ ID NO: 354713 - RNA, 22 nt, Homo sapiens
ugaaaugguuaugugaggagau

SEQ ID NO: 354714 - RNA, 22 nt, Homo sapiens
ugaaauguugggugauggaauc

SEQ ID NO: 354715 - RNA, 22 nt, Homo sapiens
ugaacacuggauaaggagucag

SEQ ID NO: 354716 - RNA, 20 nt, Homo sapiens
ugaaggaggucauuuauacc

SEQ ID NO: 354717 - RNA, 22 nt, Homo sapiens
ugaaggaguauggauaagucgu

SEQ ID NO: 354718 - RNA, 22 nt, Homo sapiens
ugaauagaaguggcaggaguag

SEQ ID NO: 354719 - RNA, 21 nt, Homo sapiens
ugaauauuuggguugugucca

SEQ ID NO: 354720 - RNA, 22 nt, Homo sapiens
ugaaugcuucaugucugggcug

SEQ ID NO: 354721 - RNA, 22 nt, Homo sapiens
ugaauguuguugguugagauau

SEQ ID NO: 354722 - RNA, 22 nt, Homo sapiens
ugacagagaagcauugaguuca

SEQ ID NO: 354723 - RNA, 22 nt, Homo sapiens
ugacaguaaacagucuugauua

SEQ ID NO: 354724 - RNA, 22 nt, Homo sapiens
ugacagugaauaagucucuuaa

SEQ ID NO: 354725 - RNA, 18 nt, Homo sapiens
ugacaucauuuagaaagg

SEQ ID NO: 354726 - RNA, 22 nt, Homo sapiens
ugacauggagguggaggaagau

SEQ ID NO: 354727 - RNA, 19 nt, Homo sapiens
ugaccagggacagaaacca

SEQ ID NO: 354728 - RNA, 22 nt, Homo sapiens
ugacggaggacaccugcggaau

SEQ ID NO: 354729 - RNA, 22 nt, Homo sapiens
ugacuccagagacugugcuguc

SEQ ID NO: 354730 - RNA, 23 nt, Homo sapiens
ugacugaguauauguuuggugcu

SEQ ID NO: 354731 - RNA, 22 nt, Homo sapiens
ugacuugauccauggggcucca

SEQ ID NO: 354732 - RNA, 20 nt, Homo sapiens
ugagaacauguggcauuugg

SEQ ID NO: 354733 - RNA, 22 nt, Homo sapiens
ugagaacucaugaaucuuucca

SEQ ID NO: 354734 - RNA, 22 nt, Homo sapiens
ugagaacucaugggucugcugg

SEQ ID NO: 354735 - RNA, 22 nt, Homo sapiens
ugagaacugccuguauuuaucu

SEQ ID NO: 354736 - RNA, 22 nt, Homo sapiens
ugagaagcauaccagugucugu

SEQ ID NO: 354737 - RNA, 22 nt, Homo sapiens
ugagaauauuuuccaugucuca

SEQ ID NO: 354738 - RNA, 22 nt, Homo sapiens
ugagacaaaguuguuggauguu

SEQ ID NO: 354739 - RNA, 22 nt, Homo sapiens
ugagauaaagcauguacugugu

SEQ ID NO: 354740 - RNA, 22 nt, Homo sapiens
ugagauaaucaugugauuucau

SEQ ID NO: 354741 - RNA, 22 nt, Homo sapiens
ugagauaaucaugugguuuuug

SEQ ID NO: 354742 - RNA, 22 nt, Homo sapiens
ugagauaaugcaugugaagauc

SEQ ID NO: 354743 - RNA, 22 nt, Homo sapiens
ugagaucaacugagucagagca

SEQ ID NO: 354744 - RNA, 18 nt, Homo sapiens
ugagaucagcaucaaggg

SEQ ID NO: 354745 - RNA, 22 nt, Homo sapiens
ugagauggcugaauucagaaua

SEQ ID NO: 354746 - RNA, 22 nt, Homo sapiens
ugagauguagauauggauuaga

SEQ ID NO: 354747 - RNA, 22 nt, Homo sapiens
gagugcugagcccacuuccuug

SEQ ID NO: 354748 - RNA, 22 nt, Homo sapiens
gauauguaaaaauuauaucuga

SEQ ID NO: 354749 - RNA, 22 nt, Homo sapiens
gaugagauguucucauggauug

SEQ ID NO: 354750 - RNA, 19 nt, Homo sapiens
gaugcaaugcacugagguc

SEQ ID NO: 354751 - RNA, 22 nt, Homo sapiens
gauggauuuuaagugaaugaaa

SEQ ID NO: 354752 - RNA, 22 nt, Homo sapiens
gauuggcauugcugcaccugag

SEQ ID NO: 354753 - RNA, 22 nt, Homo sapiens
gauuuugguuagggaaggauac

SEQ ID NO: 354754 - RNA, 22 nt, Homo sapiens
gcaaaaaguagugcugguuagg

SEQ ID NO: 354755 - RNA, 22 nt, Homo sapiens
gcaaaauugagaagggaauaua

SEQ ID NO: 354756 - RNA, 21 nt, Homo sapiens
gcaaaguggcuaccuugcucc

SEQ ID NO: 354757 - RNA, 22 nt, Homo sapiens
gcacagucaacacuuauucacc

SEQ ID NO: 354758 - RNA, 22 nt, Homo sapiens
gcaccauugacaagaaauaggu

SEQ ID NO: 354759 - RNA, 22 nt, Homo sapiens
gcagguguuaugcaaacaacug

SEQ ID NO: 354760 - RNA, 22 nt, Homo sapiens
gcaguacacuguugguaggaau

SEQ ID NO: 354761 - RNA, 22 nt, Homo sapiens
gcaguagugcgaucucagcuca

SEQ ID NO: 354762 - RNA, 22 nt, Homo sapiens
gcaguagugugaucuuggcuca

SEQ ID NO: 354763 - RNA, 22 nt, Homo sapiens
gcaucacagcuccugugcuggc

SEQ ID NO: 354764 - RNA, 22 nt, Homo sapiens
gcaucacagggagacaggccuc

SEQ ID NO: 354765 - RNA, 19 nt, Homo sapiens
gcaucauuaguugcuuuuc

SEQ ID NO: 354766 - RNA, 22 nt, Homo sapiens
gcaugcacaugugaaaaaauga

SEQ ID NO: 354767 - RNA, 22 nt, Homo sapiens
gcauggagaaggggacugauuc

SEQ ID NO: 354768 - RNA, 22 nt, Homo sapiens
gcauggagcauacauuucuguu

SEQ ID NO: 354769 - RNA, 22 nt, Homo sapiens
gcaugguacuggaugguaguau

SEQ ID NO: 354770 - RNA, 18 nt, Homo sapiens
gccaacauguaaacaggu

SEQ ID NO: 354771 - RNA, 20 nt, Homo sapiens
gccacaguuaagcuucugcc

SEQ ID NO: 354772 - RNA, 22 nt, Homo sapiens
gccauugcacuccagcuugggc

SEQ ID NO: 354773 - RNA, 22 nt, Homo sapiens
gccauugcacuccgcccugggc

SEQ ID NO: 354774 - RNA, 22 nt, Homo sapiens
gccauugcacucuagccugagc

SEQ ID NO: 354775 - RNA, 22 nt, Homo sapiens
gccccgggugaugcagccguca

SEQ ID NO: 354776 - RNA, 22 nt, Homo sapiens
gccgagagauuuggaaugggga

SEQ ID NO: 354777 - RNA, 22 nt, Homo sapiens
gccuguagaagaguagaugacc

SEQ ID NO: 354778 - RNA, 20 nt, Homo sapiens
gcuaaggcacgggaauuacu

SEQ ID NO: 354779 - RNA, 22 nt, Homo sapiens
gcuccauuuuccauuucucuaa

SEQ ID NO: 354780 - RNA, 22 nt, Homo sapiens
gcucguccccuccugacucugc

SEQ ID NO: 354781 - RNA, 22 nt, Homo sapiens
gcugcuguuucucuuucagcau

SEQ ID NO: 354782 - RNA, 22 nt, Homo sapiens
gcuggguugccagguuacuuaa

SEQ ID NO: 354783 - RNA, 22 nt, Homo sapiens
gcuucauggaggcugggcgcag

SEQ ID NO: 354784 - RNA, 22 nt, Homo sapiens
ggaaagacuauuguaaaggaug

SEQ ID NO: 354785 - RNA, 17 nt, Homo sapiens
ggaagccuuugguuuaa

SEQ ID NO: 354786 - RNA, 22 nt, Homo sapiens
ggaaucugaaccaugggaaugg

SEQ ID NO: 354787 - RNA, 22 nt, Homo sapiens
ggaaugggauuugaagucuggc

SEQ ID NO: 354788 - RNA, 22 nt, Homo sapiens
ggagaugugccugcucugcucu

SEQ ID NO: 354789 - RNA, 22 nt, Homo sapiens
ggagggugagaucaauuuggga

SEQ ID NO: 354790 - RNA, 22 nt, Homo sapiens
ggaguaggcuguccggcaccca

SEQ ID NO: 354791 - RNA, 21 nt, Homo sapiens
ggauagaaaacuuggcuguau

SEQ ID NO: 354792 - RNA, 22 nt, Homo sapiens
ggcaaaauggccagugggucac

SEQ ID NO: 354793 - RNA, 22 nt, Homo sapiens
ggcaaagagacaugcaucgggg

SEQ ID NO: 354794 - RNA, 22 nt, Homo sapiens
ggcaagaagagaguuuaaacau

SEQ ID NO: 354795 - RNA, 22 nt, Homo sapiens
ggcaagaggagauucugcuccc

SEQ ID NO: 354796 - RNA, 19 nt, Homo sapiens
ggcaagaguuguucugugu

SEQ ID NO: 354797 - RNA, 22 nt, Homo sapiens
ggcaagugggagggaguguuuc

SEQ ID NO: 354798 - RNA, 22 nt, Homo sapiens
ggcaagugucagcagcaacacc

SEQ ID NO: 354799 - RNA, 19 nt, Homo sapiens
ggcacugugugagugagga

SEQ ID NO: 354800 - RNA, 22 nt, Homo sapiens
ggcagcauugccuuugcaguga

SEQ ID NO: 354801 - RNA, 22 nt, Homo sapiens
ggcgccauugcacuccagccug

SEQ ID NO: 354802 - RNA, 22 nt, Homo sapiens
gggaucauuuuucauccuacag

SEQ ID NO: 354803 - RNA, 22 nt, Homo sapiens
ggucauagagaauucaccagga

SEQ ID NO: 354804 - RNA, 22 nt, Homo sapiens
ggucauggauaagauccagaag

SEQ ID NO: 354805 - RNA, 22 nt, Homo sapiens
gguggcuuuuugugauggcuga

SEQ ID NO: 354806 - RNA, 22 nt, Homo sapiens
guaacuggccuucaauuucuuc

SEQ ID NO: 354807 - RNA, 22 nt, Homo sapiens
guacaguaguaaaagugaauga

SEQ ID NO: 354808 - RNA, 22 nt, Homo sapiens
guacagugcucacaaugagagc

SEQ ID NO: 354809 - RNA, 22 nt, Homo sapiens
guaucauuggcauguaaccaga

SEQ ID NO: 354810 - RNA, 22 nt, Homo sapiens
guaucucaguucucgugauuag

SEQ ID NO: 354811 - RNA, 22 nt, Homo sapiens
gucauugcacuccagccuggac

SEQ ID NO: 354812 - RNA, 22 nt, Homo sapiens
gucauugcuuaaggguucaugc

SEQ ID NO: 354813 - RNA, 22 nt, Homo sapiens
gucuaugguucaggguggagug

SEQ ID NO: 354814 - RNA, 18 nt, Homo sapiens
gucucacaugguggaagc

SEQ ID NO: 354815 - RNA, 22 nt, Homo sapiens
gucucccaaccccugugcccag

SEQ ID NO: 354816 - RNA, 20 nt, Homo sapiens
gucuugcuccguugcccagg

SEQ ID NO: 354817 - RNA, 22 nt, Homo sapiens
gucuuuaguugaaacauguggu

SEQ ID NO: 354818 - RNA, 22 nt, Homo sapiens
gucuuugagauaggguuauuuu

SEQ ID NO: 354819 - RNA, 22 nt, Homo sapiens
gucuuuguuuugauuuaccaga

SEQ ID NO: 354820 - RNA, 22 nt, Homo sapiens
gugacugggaguggugaagaua

SEQ ID NO: 354821 - RNA, 22 nt, Homo sapiens
gugagaacugugucuuauaaac

SEQ ID NO: 354822 - RNA, 22 nt, Homo sapiens
gugagucagucuguguagggcu

SEQ ID NO: 354823 - RNA, 22 nt, Homo sapiens
gugauauguuaggaucuaaguc

SEQ ID NO: 354824 - RNA, 18 nt, Homo sapiens
gugcaaugaauagcagag

SEQ ID NO: 354825 - RNA, 22 nt, Homo sapiens
gugcacaacgugcaaguuuguu

SEQ ID NO: 354826 - RNA, 22 nt, Homo sapiens
gugcacaacgugcaggcuuguu

SEQ ID NO: 354827 - RNA, 22 nt, Homo sapiens
gugcacaacgugcagguuuguu

SEQ ID NO: 354828 - RNA, 22 nt, Homo sapiens
gugcacaacguguagguuuguu

SEQ ID NO: 354829 - RNA, 22 nt, Homo sapiens
gugcacaaugugcagguuuguu

SEQ ID NO: 354830 - RNA, 22 nt, Homo sapiens
gugccacugcaccuggccuaag

SEQ ID NO: 354831 - RNA, 22 nt, Homo sapiens
gugcucauuuagagagaagcac

SEQ ID NO: 354832 - RNA, 22 nt, Homo sapiens
guggcaugaaagcaucugugau

SEQ ID NO: 354833 - RNA, 23 nt, Homo sapiens
guggccuuuggccaguccgaguc

SEQ ID NO: 354834 - RNA, 22 nt, Homo sapiens
gugggaagcuggaacucccucc

SEQ ID NO: 354835 - RNA, 22 nt, Homo sapiens
gugggaugaucacaguucacug

SEQ ID NO: 354836 - RNA, 22 nt, Homo sapiens
guguuugguugauagagccacu

SEQ ID NO: 354837 - RNA, 22 nt, Homo sapiens
guuggcuguuucccccaaguga

SEQ ID NO: 354838 - RNA, 22 nt, Homo sapiens
uaaacugcuugaaaugguguca

SEQ ID NO: 354839 - RNA, 22 nt, Homo sapiens
uaaagccuagaacuuucagccc

SEQ ID NO: 354840 - RNA, 22 nt, Homo sapiens
uaaagcuuggauuuaggcuaau

SEQ ID NO: 354841 - RNA, 22 nt, Homo sapiens
acccuguaggugcuggcagaga

SEQ ID NO: 354842 - RNA, 22 nt, Homo sapiens
acccuuugucaaucaguacuaa

SEQ ID NO: 354843 - RNA, 22 nt, Homo sapiens
accuguagcagacuuaauauuu

SEQ ID NO: 354844 - RNA, 22 nt, Homo sapiens
accuucauuguugccaugucca

SEQ ID NO: 354845 - RNA, 21 nt, Homo sapiens
acugagagaucuggggcacau

SEQ ID NO: 354846 - RNA, 21 nt, Homo sapiens
acuuucuguggcaguccauuc

SEQ ID NO: 354847 - RNA, 22 nt, Homo sapiens
agaaauguuuauucaaacccgu

SEQ ID NO: 354848 - RNA, 22 nt, Homo sapiens
agaauguauauucuguaguugu

SEQ ID NO: 354849 - RNA, 22 nt, Homo sapiens
agacaguauuggcaaagugugu

SEQ ID NO: 354850 - RNA, 22 nt, Homo sapiens
agagcacugcugcaggguucug

SEQ ID NO: 354851 - RNA, 22 nt, Homo sapiens
agagguaagaauaguaguugga

SEQ ID NO: 354852 - RNA, 22 nt, Homo sapiens
agagguuuugcacugguucuuu

SEQ ID NO: 354853 - RNA, 22 nt, Homo sapiens
agaugcuguuaucaacuguagc

SEQ ID NO: 354854 - RNA, 22 nt, Homo sapiens
agauggauuuuguagccccagc

SEQ ID NO: 354855 - RNA, 23 nt, Homo sapiens
agauggcauuucaguucuuuagg

SEQ ID NO: 354856 - RNA, 22 nt, Homo sapiens
agaugguguuuucucaccagau

SEQ ID NO: 354857 - RNA, 23 nt, Homo sapiens
agcaaaugcucuagcacuccaac

SEQ ID NO: 354858 - RNA, 22 nt, Homo sapiens
agcaacauugagacugcaguug

SEQ ID NO: 354859 - RNA, 22 nt, Homo sapiens
agcaauaugacauugcuacauc

SEQ ID NO: 354860 - RNA, 22 nt, Homo sapiens
agcacacuggguggcuuaaaca

SEQ ID NO: 354861 - RNA, 22 nt, Homo sapiens
agcaccacaauuuccugccuaa

SEQ ID NO: 354862 - RNA, 22 nt, Homo sapiens
agcaccaugggcugaguaagug

SEQ ID NO: 354863 - RNA, 22 nt, Homo sapiens
agcaccauuguacuccagccug

SEQ ID NO: 354864 - RNA, 22 nt, Homo sapiens
agcaccauuucucuaaagcacu

SEQ ID NO: 354865 - RNA, 22 nt, Homo sapiens
agcaucauaccaaucugguccu

SEQ ID NO: 354866 - RNA, 22 nt, Homo sapiens
agcaucauuugauguucccgag

SEQ ID NO: 354867 - RNA, 20 nt, Homo sapiens
agcaucguuguguuauagcc

SEQ ID NO: 354868 - RNA, 20 nt, Homo sapiens
agccccauguaaaccacaug

SEQ ID NO: 354869 - RNA, 22 nt, Homo sapiens
agcccuuagauggcuccuucca

SEQ ID NO: 354870 - RNA, 22 nt, Homo sapiens
agcugauuuuaaguccuugucc

SEQ ID NO: 354871 - RNA, 22 nt, Homo sapiens
agcugcacaaauggaugugagg

SEQ ID NO: 354872 - RNA, 22 nt, Homo sapiens
agcugccagucuuguaaggccu

SEQ ID NO: 354873 - RNA, 17 nt, Homo sapiens
agcuggaauuacgggag

SEQ ID NO: 354874 - RNA, 22 nt, Homo sapiens
aggaaguaauaaguuugguucu

SEQ ID NO: 354875 - RNA, 22 nt, Homo sapiens
aggaaucuaagguaucagguua

SEQ ID NO: 354876 - RNA, 22 nt, Homo sapiens
aggaccccucaucagcaccagu

SEQ ID NO: 354877 - RNA, 21 nt, Homo sapiens
aggagauguuuguccuuuuag

SEQ ID NO: 354878 - RNA, 22 nt, Homo sapiens
aggagcacuggccuuggaguca

SEQ ID NO: 354879 - RNA, 21 nt, Homo sapiens
aggagcauucaugacgagguu

SEQ ID NO: 354880 - RNA, 22 nt, Homo sapiens
aggcaagaaugcuuguuucacc

SEQ ID NO: 354881 - RNA, 22 nt, Homo sapiens
agggcaagacuuguuaagaaca

SEQ ID NO: 354882 - RNA, 22 nt, Homo sapiens
agguagugugaugcuccuguuu

SEQ ID NO: 354883 - RNA, 22 nt, Homo sapiens
aguaacaggauccaaagaaugu

SEQ ID NO: 354884 - RNA, 22 nt, Homo sapiens
agucaaguuuuuucagagaaua

SEQ ID NO: 354885 - RNA, 22 nt, Homo sapiens
agucacagugaccuugucugac

SEQ ID NO: 354886 - RNA, 22 nt, Homo sapiens
agucagugucuguaaggagaac

SEQ ID NO: 354887 - RNA, 22 nt, Homo sapiens
agugaaaucugaagaaggucau

SEQ ID NO: 354888 - RNA, 22 nt, Homo sapiens
agugaaaugucaccuuuuagga

SEQ ID NO: 354889 - RNA, 22 nt, Homo sapiens
aguggaguguaaagcgucuuuu

SEQ ID NO: 354890 - RNA, 22 nt, Homo sapiens
aguggcuuuuuaguggcagaug

SEQ ID NO: 354891 - RNA, 22 nt, Homo sapiens
aguguuuuuaucaugaaagggu

SEQ ID NO: 354892 - RNA, 22 nt, Homo sapiens
aguugcaagucuugaguaaaga

SEQ ID NO: 354893 - RNA, 22 nt, Homo sapiens
aguuggcacugagcugugauug

SEQ ID NO: 354894 - RNA, 22 nt, Homo sapiens
auaaaugcaaugguauuuuuga

SEQ ID NO: 354895 - RNA, 22 nt, Homo sapiens
auaaaugcauugagaacugcug

SEQ ID NO: 354896 - RNA, 20 nt, Homo sapiens
auaaauguauagguguacau

SEQ ID NO: 354897 - RNA, 22 nt, Homo sapiens
auaacucuguuuuuuucaugca

SEQ ID NO: 354898 - RNA, 22 nt, Homo sapiens
auacaagugccauguuggugug

SEQ ID NO: 354899 - RNA, 22 nt, Homo sapiens
auacaugugugagcgaagaugu

SEQ ID NO: 354900 - RNA, 22 nt, Homo sapiens
auacuccugucucagcugagau

SEQ ID NO: 354901 - RNA, 22 nt, Homo sapiens
auagacacugaaaucccugcca

SEQ ID NO: 354902 - RNA, 22 nt, Homo sapiens
auagcagcaccccacuaccuca

SEQ ID NO: 354903 - RNA, 22 nt, Homo sapiens
auagcagcaccucacucuacug

SEQ ID NO: 354904 - RNA, 22 nt, Homo sapiens
auagucaguagucucauaauga

SEQ ID NO: 354905 - RNA, 22 nt, Homo sapiens
auaucccagugaugauugauag

SEQ ID NO: 354906 - RNA, 21 nt, Homo sapiens
caucacauuacucaaaguccu

SEQ ID NO: 354907 - RNA, 22 nt, Homo sapiens
caucccugucgucaagucucug

SEQ ID NO: 354908 - RNA, 22 nt, Homo sapiens
cauggcauuucaagauuuacca

SEQ ID NO: 354909 - RNA, 22 nt, Homo sapiens
caugucacuuccucucugaugg

SEQ ID NO: 354910 - RNA, 22 nt, Homo sapiens
cauugcaacuucugccucccag

SEQ ID NO: 354911 - RNA, 22 nt, Homo sapiens
cauugcaaugaggucuugcagu

SEQ ID NO: 354912 - RNA, 22 nt, Homo sapiens
cauugcacuccagucugggcaa

SEQ ID NO: 354913 - RNA, 22 nt, Homo sapiens
cauugcacuccaucuugggcaa

SEQ ID NO: 354914 - RNA, 22 nt, Homo sapiens
cauugcacugcagcccgggcaa

SEQ ID NO: 354915 - RNA, 22 nt, Homo sapiens
ccaaguguucucauuguucaau

SEQ ID NO: 354916 - RNA, 22 nt, Homo sapiens
ccacaguagucuugggaugggc

SEQ ID NO: 354917 - RNA, 22 nt, Homo sapiens
ccacaguugaaauuuugacugu

SEQ ID NO: 354918 - RNA, 22 nt, Homo sapiens
ccacugcacuccagcccggcaa

SEQ ID NO: 354919 - RNA, 22 nt, Homo sapiens
ccacugggcuagguguuuugga

SEQ ID NO: 354920 - RNA, 22 nt, Homo sapiens
ccaucacaggccucagugggaa

SEQ ID NO: 354921 - RNA, 22 nt, Homo sapiens
ccauggcuauucuguaaggguu

SEQ ID NO: 354922 - RNA, 21 nt, Homo sapiens
ccaugggacggaaugaauaca

SEQ ID NO: 354923 - RNA, 22 nt, Homo sapiens
ccauugcacucuggccuaggug

SEQ ID NO: 354924 - RNA, 22 nt, Homo sapiens
cccagagacagaaugauaaacu

SEQ ID NO: 354925 - RNA, 22 nt, Homo sapiens
cccaguuuugcuucucaugagg

SEQ ID NO: 354926 - RNA, 22 nt, Homo sapiens
ccugaugacacgggagauguac

SEQ ID NO: 354927 - RNA, 22 nt, Homo sapiens
ccuuggcacuuugccacagugc

SEQ ID NO: 354928 - RNA, 22 nt, Homo sapiens
cgccugagcugaggaagcugca

SEQ ID NO: 354929 - RNA, 22 nt, Homo sapiens
cguugcacuccagccugggcaa

SEQ ID NO: 354930 - RNA, 22 nt, Homo sapiens
cuaauacaguuguccaagcugg

SEQ ID NO: 354931 - RNA, 22 nt, Homo sapiens
cuacagguaugaaagggaguau

SEQ ID NO: 354932 - RNA, 22 nt, Homo sapiens
cuacaguaugaaaccuuuacuc

SEQ ID NO: 354933 - RNA, 22 nt, Homo sapiens
cuacuauguagagauauugaau

SEQ ID NO: 354934 - RNA, 22 nt, Homo sapiens
cuacugcacaucaucugaguua

SEQ ID NO: 354935 - RNA, 22 nt, Homo sapiens
cuagaauguauaaaaccaagcu

SEQ ID NO: 354936 - RNA, 22 nt, Homo sapiens
cuagacacugacguuccuccga

SEQ ID NO: 354937 - RNA, 22 nt, Homo sapiens
cuagcuuuuuaugacaaucuug

SEQ ID NO: 354938 - RNA, 18 nt, Homo sapiens
cuaguguuucuugaauca

SEQ ID NO: 354939 - RNA, 22 nt, Homo sapiens
cuauggcucugucuuuuaaguu

SEQ ID NO: 354940 - RNA, 22 nt, Homo sapiens
cuauggcuguagucccugugua

SEQ ID NO: 354941 - RNA, 22 nt, Homo sapiens
cucaaaguguggucuguggguu

SEQ ID NO: 354942 - RNA, 20 nt, Homo sapiens
cucacagacagcuucuuucu

SEQ ID NO: 354943 - RNA, 22 nt, Homo sapiens
cucauugcaaucucugccuccc

SEQ ID NO: 354944 - RNA, 22 nt, Homo sapiens
cuccauuuggaacagauguccu

SEQ ID NO: 354945 - RNA, 23 nt, Homo sapiens
cucccugaacaugacacaccaga

SEQ ID NO: 354946 - RNA, 22 nt, Homo sapiens
cuccuugauuagaguauagagu

SEQ ID NO: 354947 - RNA, 17 nt, Homo sapiens
cucucugguuuaaagca

SEQ ID NO: 354948 - RNA, 22 nt, Homo sapiens
cucugcuuaaugucccacuuga

SEQ ID NO: 354949 - RNA, 22 nt, Homo sapiens
cucugguggaagcagggggcaa

SEQ ID NO: 354950 - RNA, 19 nt, Homo sapiens
cucuuuggugucucuucuu

SEQ ID NO: 354951 - RNA, 22 nt, Homo sapiens
cugaauguuucacucugaaaug

SEQ ID NO: 354952 - RNA, 22 nt, Homo sapiens
cugaccauagacuacucugggc

SEQ ID NO: 354953 - RNA, 22 nt, Homo sapiens
cugagauaggacucugcuggcu

SEQ ID NO: 354954 - RNA, 22 nt, Homo sapiens
cugagcccauucuggggagaag

SEQ ID NO: 354955 - RNA, 22 nt, Homo sapiens
cugaggacaucagggaagcauc

SEQ ID NO: 354956 - RNA, 22 nt, Homo sapiens
cugaggcacggcgaccuuaagu

SEQ ID NO: 354957 - RNA, 22 nt, Homo sapiens
cugcaguaaccacuguaggugu

SEQ ID NO: 354958 - RNA, 22 nt, Homo sapiens
cuggaaagcaaagggugcauug

SEQ ID NO: 354959 - RNA, 18 nt, Homo sapiens
cuggaaggcuacuacagu

SEQ ID NO: 354960 - RNA, 22 nt, Homo sapiens
cuggaauucaaaaucugaauuu

SEQ ID NO: 354961 - RNA, 22 nt, Homo sapiens
cuggagaucuugacauugaagu

SEQ ID NO: 354962 - RNA, 22 nt, Homo sapiens
cuggagauuaaccaauugccau

SEQ ID NO: 354963 - RNA, 22 nt, Homo sapiens
cuggagucugacugacacaagg

SEQ ID NO: 354964 - RNA, 20 nt, Homo sapiens
cuggaucaucaguaaaguua

SEQ ID NO: 354965 - RNA, 22 nt, Homo sapiens
cuggcaccauuuugaucaaagg

SEQ ID NO: 354966 - RNA, 22 nt, Homo sapiens
cugucacaguuuuggaggccag

SEQ ID NO: 354967 - RNA, 22 nt, Homo sapiens
cugugaagaaagucauugguag

SEQ ID NO: 354968 - RNA, 22 nt, Homo sapiens
cuucacuuuguuaaacuccaau

SEQ ID NO: 354969 - RNA, 22 nt, Homo sapiens
cuucuugagggccugcugggaa

SEQ ID NO: 354970 - RNA, 21 nt, Homo sapiens
cuugucuugcuuagaauagac

SEQ ID NO: 354971 - RNA, 19 nt, Homo sapiens
cuugugccugaagcuuggg

SEQ ID NO: 354972 - RNA, 22 nt, Homo sapiens
cuuguucuccuaagaugaaugc

SEQ ID NO: 354973 - RNA, 22 nt, Homo sapiens
cuuugcuaauccaacccucauc

SEQ ID NO: 354974 - RNA, 22 nt, Homo sapiens
cuuuggcauuagccuguauaga

SEQ ID NO: 354975 - RNA, 22 nt, Homo sapiens
cuuugggaccgcgguuuauacu

SEQ ID NO: 354976 - RNA, 23 nt, Homo sapiens
cuuuugcaaugugaucuugccac

SEQ ID NO: 354977 - RNA, 22 nt, Homo sapiens
cuuuuggugguucugaugcagg

SEQ ID NO: 354978 - RNA, 22 nt, Homo sapiens
gaaagugcugcuugacugggau

SEQ ID NO: 354979 - RNA, 22 nt, Homo sapiens
gaaauggaucagagcaagcuuu

SEQ ID NO: 354980 - RNA, 22 nt, Homo sapiens
gaagaaguacaagacaaauuuu

SEQ ID NO: 354981 - RNA, 18 nt, Homo sapiens
gaagaaguaggcauggca

SEQ ID NO: 354982 - RNA, 22 nt, Homo sapiens
gaaguaauaaauggauucuuaa

SEQ ID NO: 354983 - RNA, 23 nt, Homo sapiens
gaaguaauaaauggauucuuaac

SEQ ID NO: 354984 - RNA, 22 nt, Homo sapiens
gaaguaggugcuguuauuaucu

SEQ ID NO: 354985 - RNA, 22 nt, Homo sapiens
gaaucccuugcauuaucccuuu

SEQ ID NO: 354986 - RNA, 22 nt, Homo sapiens
gaauucugucgcuuacuagaug

SEQ ID NO: 354987 - RNA, 22 nt, Homo sapiens
gacaccauuucaguacuagguu

SEQ ID NO: 354988 - RNA, 22 nt, Homo sapiens
gacauguaaggcucucucuguu

SEQ ID NO: 354989 - RNA, 22 nt, Homo sapiens
gacuagaaauuauuuagugagc

SEQ ID NO: 354990 - RNA, 22 nt, Homo sapiens
gagaacuaaugguuugauaagg

SEQ ID NO: 354991 - RNA, 22 nt, Homo sapiens
gagacauguuugccaauaauuu

SEQ ID NO: 354992 - RNA, 23 nt, Homo sapiens
gagaccagcuucagaaagcacga

SEQ ID NO: 354993 - RNA, 22 nt, Homo sapiens
gagacugaguuuugcucuuguu

SEQ ID NO: 354994 - RNA, 22 nt, Homo sapiens
gagauaaauaggucacaguucu

SEQ ID NO: 354995 - RNA, 22 nt, Homo sapiens
gagauuauuuaaaaggugauuu

SEQ ID NO: 354996 - RNA, 22 nt, Homo sapiens
gagcugaaguuuccauuuguac

SEQ ID NO: 354997 - RNA, 22 nt, Homo sapiens
gaggcagucugacccuuagcag

SEQ ID NO: 354998 - RNA, 22 nt, Homo sapiens
gaggucaggacauuuuugcuuu

SEQ ID NO: 354999 - RNA, 22 nt, Homo sapiens
gagugcaauggcgcgaucuggg

SEQ ID NO: 355000 - RNA, 17 nt, Homo sapiens
auaugaauuuuggagau

SEQ ID NO: 355001 - RNA, 22 nt, Homo sapiens
auaugcauacccucaccaacua

SEQ ID NO: 355002 - RNA, 22 nt, Homo sapiens
auaugcauguacccacacaggc

SEQ ID NO: 355003 - RNA, 20 nt, Homo sapiens
auaugcauguguuuucacuu

SEQ ID NO: 355004 - RNA, 22 nt, Homo sapiens
aucaaacugcaaggcagcagca

SEQ ID NO: 355005 - RNA, 22 nt, Homo sapiens
aucaaaguaggcauauguuuuu

SEQ ID NO: 355006 - RNA, 22 nt, Homo sapiens
aucacagagucacgggcaacuu

SEQ ID NO: 355007 - RNA, 22 nt, Homo sapiens
auccacagugucaauguuguga

SEQ ID NO: 355008 - RNA, 22 nt, Homo sapiens
aucucaguuaauuccaucuuuc

SEQ ID NO: 355009 - RNA, 22 nt, Homo sapiens
aucugguguggcugugauccuc

SEQ ID NO: 355010 - RNA, 23 nt, Homo sapiens
augaaagcccuugcaaaugcugg

SEQ ID NO: 355011 - RNA, 22 nt, Homo sapiens
augaagagaaaguggaucuugg

SEQ ID NO: 355012 - RNA, 18 nt, Homo sapiens
augaagucaucacuuuua

SEQ ID NO: 355013 - RNA, 22 nt, Homo sapiens
augaagucguuacuaccaauug

SEQ ID NO: 355014 - RNA, 22 nt, Homo sapiens
augacauuccacagccguagag

SEQ ID NO: 355015 - RNA, 22 nt, Homo sapiens
augacauugaaaagcaagugga

SEQ ID NO: 355016 - RNA, 22 nt, Homo sapiens
augacuggaacagcaauuuaca

SEQ ID NO: 355017 - RNA, 22 nt, Homo sapiens
augacuuuucugaaaaccacca

SEQ ID NO: 355018 - RNA, 22 nt, Homo sapiens
augagaacauaucaagugauug

SEQ ID NO: 355019 - RNA, 22 nt, Homo sapiens
augagaauguaaguuaaugaaa

SEQ ID NO: 355020 - RNA, 22 nt, Homo sapiens
augagauacuacaaaugaguuu

SEQ ID NO: 355021 - RNA, 22 nt, Homo sapiens
augagauauuuuauaagaucau

SEQ ID NO: 355022 - RNA, 22 nt, Homo sapiens
augaggugggcggcuuggaaga

SEQ ID NO: 355023 - RNA, 22 nt, Homo sapiens
augauauguuuguagcuaucuc

SEQ ID NO: 355024 - RNA, 22 nt, Homo sapiens
augaucacaccacugcacucca

SEQ ID NO: 355025 - RNA, 22 nt, Homo sapiens
augcagagaaaucuaaaauaug

SEQ ID NO: 355026 - RNA, 22 nt, Homo sapiens
augcagcugaggguaguggagc

SEQ ID NO: 355027 - RNA, 22 nt, Homo sapiens
auggaagaaacgauuuucugga

SEQ ID NO: 355028 - RNA, 22 nt, Homo sapiens
auggaagaaaguuggguucuug

SEQ ID NO: 355029 - RNA, 22 nt, Homo sapiens
auggaagaauugucggggaugu

SEQ ID NO: 355030 - RNA, 22 nt, Homo sapiens
auggaaggagaggaaugaauga

SEQ ID NO: 355031 - RNA, 22 nt, Homo sapiens
guucucacuggugcugguaagu

SEQ ID NO: 355032 - RNA, 22 nt, Homo sapiens
guuugcagaucaugaagaaccc

SEQ ID NO: 355033 - RNA, 22 nt, Homo sapiens
guuugugcuccuaugagaaccu

SEQ ID NO: 355034 - RNA, 18 nt, Homo sapiens
uaaaggcacuguguuguu

SEQ ID NO: 355035 - RNA, 21 nt, Homo sapiens
uaaaugucauacaaagcaaug

SEQ ID NO: 355036 - RNA, 22 nt, Homo sapiens
uaacauagucauauacuugcuu

SEQ ID NO: 355037 - RNA, 22 nt, Homo sapiens
uaacccugaggggcuuggggac

SEQ ID NO: 355038 - RNA, 22 nt, Homo sapiens
uaacuccauuuggacucaguau

SEQ ID NO: 355039 - RNA, 22 nt, Homo sapiens
uaaggcacccuucugaguagag

SEQ ID NO: 355040 - RNA, 20 nt, Homo sapiens
uaaggcacugugcuuuuagg

SEQ ID NO: 355041 - RNA, 22 nt, Homo sapiens
uaaguacuuuacagacauuauc

SEQ ID NO: 355042 - RNA, 22 nt, Homo sapiens
uaagugaugucuuuuugugugc

SEQ ID NO: 355043 - RNA, 20 nt, Homo sapiens
uaagugcauaggauauuucu

SEQ ID NO: 355044 - RNA, 22 nt, Homo sapiens
uaagugcuguguuguuaccuaa

SEQ ID NO: 355045 - RNA, 20 nt, Homo sapiens
uaagugcuuuauauugauua

SEQ ID NO: 355046 - RNA, 22 nt, Homo sapiens
uaaguguaaugucugaaguuug

SEQ ID NO: 355047 - RNA, 23 nt, Homo sapiens
uaaguucaucucuaauaggugga

SEQ ID NO: 355048 - RNA, 22 nt, Homo sapiens
uaauacucuucucauuuuacag

SEQ ID NO: 355049 - RNA, 22 nt, Homo sapiens
uaauacugcugugcuugaguug

SEQ ID NO: 355050 - RNA, 22 nt, Homo sapiens
uaauucacauaaagcacuuaga

SEQ ID NO: 355051 - RNA, 22 nt, Homo sapiens
uaauugcaguucuguguuauau

SEQ ID NO: 355052 - RNA, 22 nt, Homo sapiens
uacaaagcuuugaugugucuuu

SEQ ID NO: 355053 - RNA, 22 nt, Homo sapiens
uacaaguauuuuuauuagugcc

SEQ ID NO: 355054 - RNA, 22 nt, Homo sapiens
uacaccauuugauucuuuaagc

SEQ ID NO: 355055 - RNA, 22 nt, Homo sapiens
uacaguagagaucagcaaacua

SEQ ID NO: 355056 - RNA, 22 nt, Homo sapiens
uacaguauuaugagugauugaa

SEQ ID NO: 355057 - RNA, 22 nt, Homo sapiens
uacaugcaugggcaugugugca

SEQ ID NO: 355058 - RNA, 22 nt, Homo sapiens
uacauguauacaggguuuacuu

SEQ ID NO: 355059 - RNA, 22 nt, Homo sapiens
uaccaccauuguaguuuggaaa

SEQ ID NO: 355060 - RNA, 22 nt, Homo sapiens
uaccaugaagguggagagagaa

SEQ ID NO: 355061 - RNA, 22 nt, Homo sapiens
uaccugagacaacuuugaggaa

SEQ ID NO: 355062 - RNA, 22 nt, Homo sapiens
uacuacuuucugacaucuuuaa

SEQ ID NO: 355063 - RNA, 22 nt, Homo sapiens
uacucaauugcagucaccuggc

SEQ ID NO: 355064 - RNA, 22 nt, Homo sapiens
uacucacauucuguuucuugcu

SEQ ID NO: 355065 - RNA, 22 nt, Homo sapiens
uacugcugucagugccaaguag

SEQ ID NO: 355066 - RNA, 22 nt, Homo sapiens
uagaacauuccaggugauguug

SEQ ID NO: 355067 - RNA, 22 nt, Homo sapiens
uagagcuacagcccucacuguc

SEQ ID NO: 355068 - RNA, 22 nt, Homo sapiens
uagagguucuaagauucucaga

SEQ ID NO: 355069 - RNA, 22 nt, Homo sapiens
uagauaauuagaggguuuuaag

SEQ ID NO: 355070 - RNA, 22 nt, Homo sapiens
uagaugauucacuuuacuucca

SEQ ID NO: 355071 - RNA, 20 nt, Homo sapiens
uagcacaucuggcuguagag

SEQ ID NO: 355072 - RNA, 22 nt, Homo sapiens
ucucacagaguugaauguuucu

SEQ ID NO: 355073 - RNA, 22 nt, Homo sapiens
ucucaguggcuuccucacuuuu

SEQ ID NO: 355074 - RNA, 23 nt, Homo sapiens
ucucauuccuugaaaauaaugac

SEQ ID NO: 355075 - RNA, 22 nt, Homo sapiens
ucucugagaaaaguuucuccca

SEQ ID NO: 355076 - RNA, 22 nt, Homo sapiens
ucucugagaccacuccaaacuc

SEQ ID NO: 355077 - RNA, 22 nt, Homo sapiens
ucugaaucguucccaugcagga

SEQ ID NO: 355078 - RNA, 23 nt, Homo sapiens
ucugcggguguggacccuagugc

SEQ ID NO: 355079 - RNA, 22 nt, Homo sapiens
ucuggagugugaaguggauaug

SEQ ID NO: 355080 - RNA, 22 nt, Homo sapiens
ucuggccuacaaguaauuuuau

SEQ ID NO: 355081 - RNA, 22 nt, Homo sapiens
ucuggccuacaucauuuuuccg

SEQ ID NO: 355082 - RNA, 21 nt, Homo sapiens
ucuggcuuucauuccccuucu

SEQ ID NO: 355083 - RNA, 22 nt, Homo sapiens
ucuguaguuaacagcuucagcu

SEQ ID NO: 355084 - RNA, 19 nt, Homo sapiens
ucuguaguuagggcuacag

SEQ ID NO: 355085 - RNA, 17 nt, Homo sapiens
ucuucuguuacuguggc

SEQ ID NO: 355086 - RNA, 22 nt, Homo sapiens
ucuugcacaaauuauuuuaacu

SEQ ID NO: 355087 - RNA, 22 nt, Homo sapiens
ucuugcauuuuuaaauagugcu

SEQ ID NO: 355088 - RNA, 22 nt, Homo sapiens
ucuugggugaguuugugaauaa

SEQ ID NO: 355089 - RNA, 22 nt, Homo sapiens
ucuuggguggauucauucuuuc

SEQ ID NO: 355090 - RNA, 21 nt, Homo sapiens
ucuuggguugaauucucccag

SEQ ID NO: 355091 - RNA, 22 nt, Homo sapiens
ucuuuaguaauuucuguaaggc

SEQ ID NO: 355092 - RNA, 22 nt, Homo sapiens
ucuuucacuuagcaugauguuu

SEQ ID NO: 355093 - RNA, 22 nt, Homo sapiens
ucuuugguucuguuuauguaau

SEQ ID NO: 355094 - RNA, 22 nt, Homo sapiens
ucuuuguuuucugauccugaag

SEQ ID NO: 355095 - RNA, 22 nt, Homo sapiens
ucuuuugggccucuugucagac

SEQ ID NO: 355096 - RNA, 22 nt, Homo sapiens
ugaaacacacagagaagggaga

SEQ ID NO: 355097 - RNA, 20 nt, Homo sapiens
ugaaacacauggacuggggu

SEQ ID NO: 355098 - RNA, 22 nt, Homo sapiens
ugaaagacugaagaauaggcau

SEQ ID NO: 355099 - RNA, 22 nt, Homo sapiens
ugaaaucauguaguuauugcaa

SEQ ID NO: 355100 - RNA, 22 nt, Homo sapiens
ugaagcuaugacuauugagcau

SEQ ID NO: 355101 - RNA, 22 nt, Homo sapiens
ugaaguguuuuuucaggcaugu

SEQ ID NO: 355102 - RNA, 22 nt, Homo sapiens
ugaauagacacuaaagacugua

SEQ ID NO: 355103 - RNA, 22 nt, Homo sapiens
ugaauagacagucacugccucc

SEQ ID NO: 355104 - RNA, 22 nt, Homo sapiens
ugaauguuugcuuacuuccaua

SEQ ID NO: 355105 - RNA, 20 nt, Homo sapiens
ugacaaggugcaaagaauca

SEQ ID NO: 355106 - RNA, 22 nt, Homo sapiens
ugacacuugcccuuagaaacau

SEQ ID NO: 355107 - RNA, 22 nt, Homo sapiens
ugacauguagagaacuucucau

SEQ ID NO: 355108 - RNA, 22 nt, Homo sapiens
ugacccuguggcagcgucuaag

SEQ ID NO: 355109 - RNA, 22 nt, Homo sapiens
ugacuaggaggcuggaggauga

SEQ ID NO: 355110 - RNA, 22 nt, Homo sapiens
ugacuaguuuugcuguuguuau

SEQ ID NO: 355111 - RNA, 22 nt, Homo sapiens
ugacuauaggauaacaugcauu

SEQ ID NO: 355112 - RNA, 22 nt, Homo sapiens
ugacucaguuucucagguagua

SEQ ID NO: 355113 - RNA, 22 nt, Homo sapiens
ugacucgaggcgccuccagucc

SEQ ID NO: 355114 - RNA, 22 nt, Homo sapiens
ugagaacuaaaaugugguauau

SEQ ID NO: 355115 - RNA, 22 nt, Homo sapiens
ugagaacuaaugaagaauuuau

SEQ ID NO: 355116 - RNA, 22 nt, Homo sapiens
ugagaacuagagaacaagguga

SEQ ID NO: 355117 - RNA, 22 nt, Homo sapiens
ugagaacugcagggagcugcau

SEQ ID NO: 355118 - RNA, 22 nt, Homo sapiens
ugagaacuuauggugauuuuuu

SEQ ID NO: 355119 - RNA, 22 nt, Homo sapiens
ugagaacuuugucuuuuacucu

SEQ ID NO: 355120 - RNA, 22 nt, Homo sapiens
ugagaagugacgcagcaggguu

SEQ ID NO: 355121 - RNA, 22 nt, Homo sapiens
ugagacaugugaacuguaguuc

SEQ ID NO: 355122 - RNA, 22 nt, Homo sapiens
ugagacgaagucuugcucuguu

SEQ ID NO: 355123 - RNA, 22 nt, Homo sapiens
ugagacggagucuugcucuguc

SEQ ID NO: 355124 - RNA, 22 nt, Homo sapiens
ugagacugaaauuaggaaacug

SEQ ID NO: 355125 - RNA, 21 nt, Homo sapiens
ugagauaauauguuucugaug

SEQ ID NO: 355126 - RNA, 22 nt, Homo sapiens
ugagauaauuuacuuguugagg

SEQ ID NO: 355127 - RNA, 22 nt, Homo sapiens
ugagauagcauaagggacagaa

SEQ ID NO: 355128 - RNA, 22 nt, Homo sapiens
ugagauaggaucuugcucuguu

SEQ ID NO: 355129 - RNA, 22 nt, Homo sapiens
ugagauauugggaguaauguca

SEQ ID NO: 355130 - RNA, 22 nt, Homo sapiens
ugagauggcuuuauugcugaau

SEQ ID NO: 355131 - RNA, 20 nt, Homo sapiens
ugagcucaugacauuuuucu

SEQ ID NO: 355132 - RNA, 22 nt, Homo sapiens
ugagcuccuucauaaaaaggca

SEQ ID NO: 355133 - RNA, 22 nt, Homo sapiens
ugagguaaugcuguagcuguga

SEQ ID NO: 355134 - RNA, 22 nt, Homo sapiens
ugaggucacuuguuuuaugcuu

SEQ ID NO: 355135 - RNA, 22 nt, Homo sapiens
ugaggugagggguuaggugcua

SEQ ID NO: 355136 - RNA, 22 nt, Homo sapiens
ugagucauuuccuuaugcuacu

SEQ ID NO: 355137 - RNA, 22 nt, Homo sapiens
ugagugccuggagggcagggac

SEQ ID NO: 355138 - RNA, 22 nt, Homo sapiens
ugaguggagaucgcaccauugc

SEQ ID NO: 355139 - RNA, 22 nt, Homo sapiens
ugaguucaugcuuguaguucua

SEQ ID NO: 355140 - RNA, 22 nt, Homo sapiens
ugaguucauggucauuugucac

SEQ ID NO: 355141 - RNA, 22 nt, Homo sapiens
ugauagucuuugcuggugaccu

SEQ ID NO: 355142 - RNA, 22 nt, Homo sapiens
ugauauauugaaugaugaaaca

SEQ ID NO: 355143 - RNA, 22 nt, Homo sapiens
ugauggccuguucuccauaugu

SEQ ID NO: 355144 - RNA, 22 nt, Homo sapiens
ugcaaagucgaaacugcaguuu

SEQ ID NO: 355145 - RNA, 22 nt, Homo sapiens
ugcaagaaucagccuaucauua

SEQ ID NO: 355146 - RNA, 22 nt, Homo sapiens
ugcaaguggauuuuuccccaga

SEQ ID NO: 355147 - RNA, 22 nt, Homo sapiens
ugcaauauccucuacuauaggu

SEQ ID NO: 355148 - RNA, 22 nt, Homo sapiens
ugcaccacacuccauccugggc

SEQ ID NO: 355149 - RNA, 22 nt, Homo sapiens
ugcaccacugcacuccagcuug

SEQ ID NO: 355150 - RNA, 22 nt, Homo sapiens
ugcaccacugcacugccugggu

SEQ ID NO: 355151 - RNA, 18 nt, Homo sapiens
ugcaccaguuuacacuuc

SEQ ID NO: 355152 - RNA, 22 nt, Homo sapiens
ugcagagaaacauuuuguauuu

SEQ ID NO: 355153 - RNA, 22 nt, Homo sapiens
ugcagcauugcacuccagccug

SEQ ID NO: 355154 - RNA, 22 nt, Homo sapiens
ugcaguagugugaucuuggcuc

SEQ ID NO: 355155 - RNA, 22 nt, Homo sapiens
ugcagugcaugacuguguuaug

SEQ ID NO: 355156 - RNA, 20 nt, Homo sapiens
ugccaagaaaugaggguauu

SEQ ID NO: 355157 - RNA, 20 nt, Homo sapiens
ugccagugugucaauuuaua

SEQ ID NO: 355158 - RNA, 22 nt, Homo sapiens
ugccauugcacuccagccuggg

SEQ ID NO: 355159 - RNA, 23 nt, Homo sapiens
ugccuagaccaucagccugaggu

SEQ ID NO: 355160 - RNA, 22 nt, Homo sapiens
ugcgccauugcauuccagccug

SEQ ID NO: 355161 - RNA, 22 nt, Homo sapiens
ugcucaccugcugcucaccucc

SEQ ID NO: 355162 - RNA, 22 nt, Homo sapiens
uggaaucuacuaaagcaaaauc

SEQ ID NO: 355163 - RNA, 22 nt, Homo sapiens
uggaaucuagagaaaugcaaac

SEQ ID NO: 355164 - RNA, 21 nt, Homo sapiens
uggaaucuauagaggcaguag

SEQ ID NO: 355165 - RNA, 20 nt, Homo sapiens
uggaaucugaagaucucagu

SEQ ID NO: 355166 - RNA, 18 nt, Homo sapiens
uggaauguuuggguuaau

SEQ ID NO: 355167 - RNA, 21 nt, Homo sapiens
uggaccccuuccuugcaccau

SEQ ID NO: 355168 - RNA, 22 nt, Homo sapiens
uggaccccuucuccuauuaaaa

SEQ ID NO: 355169 - RNA, 22 nt, Homo sapiens
aaaugcauggacagcuggucuu

SEQ ID NO: 355170 - RNA, 22 nt, Homo sapiens
aaaugcauugagggaaaaggca

SEQ ID NO: 355171 - RNA, 22 nt, Homo sapiens
aaaugccucccauucuacugac

SEQ ID NO: 355172 - RNA, 22 nt, Homo sapiens
aaaugcuguuccaggaccuauc

SEQ ID NO: 355173 - RNA, 22 nt, Homo sapiens
aaaugcuuucuuggaccauuug

SEQ ID NO: 355174 - RNA, 22 nt, Homo sapiens
aaauggcacaguaagggcauuu

SEQ ID NO: 355175 - RNA, 22 nt, Homo sapiens
aaauugcaguuaggaugauggu

SEQ ID NO: 355176 - RNA, 23 nt, Homo sapiens
aaauuugccuauuauuccuaugg

SEQ ID NO: 355177 - RNA, 22 nt, Homo sapiens
aacacuggcugcucgaguucuc

SEQ ID NO: 355178 - RNA, 22 nt, Homo sapiens
aacaggguguuugcaguuucuu

SEQ ID NO: 355179 - RNA, 22 nt, Homo sapiens
aacagugcuguuauaaauguac

SEQ ID NO: 355180 - RNA, 22 nt, Homo sapiens
aaccuucauuccuuucccugcc

SEQ ID NO: 355181 - RNA, 22 nt, Homo sapiens
aacuccauuuuagacccuagau

SEQ ID NO: 355182 - RNA, 19 nt, Homo sapiens
aacuggugugagaugguau

SEQ ID NO: 355183 - RNA, 20 nt, Homo sapiens
aagcaagcauuugcaaucau

SEQ ID NO: 355184 - RNA, 21 nt, Homo sapiens
aagcacauugaguguguguga

SEQ ID NO: 355185 - RNA, 22 nt, Homo sapiens
aagcuggauuuaguguggagca

SEQ ID NO: 355186 - RNA, 22 nt, Homo sapiens
aaggagcagagagcccuguuuc

SEQ ID NO: 355187 - RNA, 22 nt, Homo sapiens
aaggaguagaggaauagcaaug

SEQ ID NO: 355188 - RNA, 22 nt, Homo sapiens
aaggcaagaaugcgugcuuuca

SEQ ID NO: 355189 - RNA, 22 nt, Homo sapiens
aaggcaagagaaaauuucgagu

SEQ ID NO: 355190 - RNA, 22 nt, Homo sapiens
aagggaauguuguggcugguug

SEQ ID NO: 355191 - RNA, 22 nt, Homo sapiens
aaggugcucucuuauguagaaa

SEQ ID NO: 355192 - RNA, 22 nt, Homo sapiens
aagguuguauuuaauauacugu

SEQ ID NO: 355193 - RNA, 23 nt, Homo sapiens
agugccuaguauauaggaggcgc

SEQ ID NO: 355194 - RNA, 22 nt, Homo sapiens
aguguuuuucaugggauacuuu

SEQ ID NO: 355195 - RNA, 18 nt, Homo sapiens
auaaacucaucauuuuua

SEQ ID NO: 355196 - RNA, 22 nt, Homo sapiens
auaacauggaguuugucauuua

SEQ ID NO: 355197 - RNA, 22 nt, Homo sapiens
auaaguauuuggacuuuacugu

SEQ ID NO: 355198 - RNA, 22 nt, Homo sapiens
auaauagcugaucauuuagaag

SEQ ID NO: 355199 - RNA, 22 nt, Homo sapiens
auaauagguugauugacauugc

SEQ ID NO: 355200 - RNA, 22 nt, Homo sapiens
auaauaguguuuagauuuggga

SEQ ID NO: 355201 - RNA, 22 nt, Homo sapiens
auacaaguuauuugaacugcgg

SEQ ID NO: 355202 - RNA, 22 nt, Homo sapiens
auacaguaaugucuuaggcugu

SEQ ID NO: 355203 - RNA, 22 nt, Homo sapiens
auacaguugccauuucuugugc

SEQ ID NO: 355204 - RNA, 22 nt, Homo sapiens
auagaaucaucugugcacuagu

SEQ ID NO: 355205 - RNA, 22 nt, Homo sapiens
auagcagaagaagggacaauuc

SEQ ID NO: 355206 - RNA, 22 nt, Homo sapiens
auagcagugugaaaauguacua

SEQ ID NO: 355207 - RNA, 22 nt, Homo sapiens
auagcaucauuucuugaaaaga

SEQ ID NO: 355208 - RNA, 22 nt, Homo sapiens
auauaccuaggcuacaugguuu

SEQ ID NO: 355209 - RNA, 22 nt, Homo sapiens
aucaaaguuucccagaaguugu

SEQ ID NO: 355210 - RNA, 22 nt, Homo sapiens
aucaagcuacacccuuuggaaa

SEQ ID NO: 355211 - RNA, 22 nt, Homo sapiens
aucacagaacuuugagcagaga

SEQ ID NO: 355212 - RNA, 20 nt, Homo sapiens
aucaccacagcucguucaug

SEQ ID NO: 355213 - RNA, 22 nt, Homo sapiens
aucagcauucccaaaugaugug

SEQ ID NO: 355214 - RNA, 22 nt, Homo sapiens
aucaggcacacauuggaguuug

SEQ ID NO: 355215 - RNA, 22 nt, Homo sapiens
aucaucacaguuguguguaaug

SEQ ID NO: 355216 - RNA, 22 nt, Homo sapiens
aucccuguaacuagcagccccu

SEQ ID NO: 355217 - RNA, 22 nt, Homo sapiens
aucccuuucucuggcuaggggg

SEQ ID NO: 355218 - RNA, 22 nt, Homo sapiens
aucgcgccauuguacuccagcc

SEQ ID NO: 355219 - RNA, 22 nt, Homo sapiens
aucuacuugcugggucucugga

SEQ ID NO: 355220 - RNA, 22 nt, Homo sapiens
aucucugagauguucugauuuu

SEQ ID NO: 355221 - RNA, 22 nt, Homo sapiens
aucugcacaucuguguuuuugu

SEQ ID NO: 355222 - RNA, 22 nt, Homo sapiens
aucugcuccuggugaggguuuc

SEQ ID NO: 355223 - RNA, 22 nt, Homo sapiens
aucugguguuuuucucccucgu

SEQ ID NO: 355224 - RNA, 22 nt, Homo sapiens
augaaaacaugauuugccuguu

SEQ ID NO: 355225 - RNA, 22 nt, Homo sapiens
augaaagguauguuuucuguga

SEQ ID NO: 355226 - RNA, 22 nt, Homo sapiens
augaaaucuuuccugugaggau

SEQ ID NO: 355227 - RNA, 18 nt, Homo sapiens
augaacucaucauuuuua

SEQ ID NO: 355228 - RNA, 22 nt, Homo sapiens
augaaguauuaggacacauuua

SEQ ID NO: 355229 - RNA, 22 nt, Homo sapiens
augacuggaacggcacuuuaca

SEQ ID NO: 355230 - RNA, 22 nt, Homo sapiens
augaggaagucaggcccagggg

SEQ ID NO: 355231 - RNA, 22 nt, Homo sapiens
augaggcacugcgcccuacuga

SEQ ID NO: 355232 - RNA, 22 nt, Homo sapiens
augaggcaggaaaggcguaucu

SEQ ID NO: 355233 - RNA, 22 nt, Homo sapiens
augagggaagcucacgugucca

SEQ ID NO: 355234 - RNA, 18 nt, Homo sapiens
augagucauuguggaaau

SEQ ID NO: 355235 - RNA, 22 nt, Homo sapiens
augaucacuguggaaauucagc

SEQ ID NO: 355236 - RNA, 22 nt, Homo sapiens
augaucuguuuggugaucuugu

SEQ ID NO: 355237 - RNA, 22 nt, Homo sapiens
augauguccacagggguguuca

SEQ ID NO: 355238 - RNA, 22 nt, Homo sapiens
augcaaggaugguuagauauau

SEQ ID NO: 355239 - RNA, 22 nt, Homo sapiens
augcacuuggcaggaugauucc

SEQ ID NO: 355240 - RNA, 22 nt, Homo sapiens
augccacagaaauaaccaaaau

SEQ ID NO: 355241 - RNA, 19 nt, Homo sapiens
augccacagugaggucaga

SEQ ID NO: 355242 - RNA, 22 nt, Homo sapiens
augcuacugaccccuacuuaca

SEQ ID NO: 355243 - RNA, 22 nt, Homo sapiens
augcuacuggauuuguauaaau

SEQ ID NO: 355244 - RNA, 22 nt, Homo sapiens
auggaaggagaauggucuuuga

SEQ ID NO: 355245 - RNA, 22 nt, Homo sapiens
auggaauggcacuuugaagauu

SEQ ID NO: 355246 - RNA, 22 nt, Homo sapiens
auggaauguaaguuauguuugc

SEQ ID NO: 355247 - RNA, 22 nt, Homo sapiens
auggaguguaauauugagagcu

SEQ ID NO: 355248 - RNA, 22 nt, Homo sapiens
auggauguucuagggaugugau

SEQ ID NO: 355249 - RNA, 22 nt, Homo sapiens
auggcacagaguagaugcucaa

SEQ ID NO: 355250 - RNA, 22 nt, Homo sapiens
auggcagcccucuuuauccaug

SEQ ID NO: 355251 - RNA, 23 nt, Homo sapiens
auggcccuggugggagugucuuu

SEQ ID NO: 355252 - RNA, 22 nt, Homo sapiens
auggcccuguguggagcugcug

SEQ ID NO: 355253 - RNA, 22 nt, Homo sapiens
auggccuuguauaccuggcaaa

SEQ ID NO: 355254 - RNA, 22 nt, Homo sapiens
auggccuuuacaauuugguaug

SEQ ID NO: 355255 - RNA, 22 nt, Homo sapiens
auggcugugaaaugguaggugg

SEQ ID NO: 355256 - RNA, 22 nt, Homo sapiens
auggcuguuuaagaguuucauu

SEQ ID NO: 355257 - RNA, 22 nt, Homo sapiens
auggcuuuaagagugucugaau

SEQ ID NO: 355258 - RNA, 22 nt, Homo sapiens
auggcuuuugaccugguaggau

SEQ ID NO: 355259 - RNA, 22 nt, Homo sapiens
auggcuuuuuaaaucauguugu

SEQ ID NO: 355260 - RNA, 22 nt, Homo sapiens
cauugcacuccagccuaggcaa

SEQ ID NO: 355261 - RNA, 22 nt, Homo sapiens
cauugcacuccagccugaggga

SEQ ID NO: 355262 - RNA, 22 nt, Homo sapiens
cauugcacuccagcucugggcg

SEQ ID NO: 355263 - RNA, 22 nt, Homo sapiens
cauugcacuccauccuuggcaa

SEQ ID NO: 355264 - RNA, 22 nt, Homo sapiens
cauugcagauccuucaaaugac

SEQ ID NO: 355265 - RNA, 22 nt, Homo sapiens
ccaaguguuuucauuguuccau

SEQ ID NO: 355266 - RNA, 22 nt, Homo sapiens
ccaggguugagacccacugacu

SEQ ID NO: 355267 - RNA, 22 nt, Homo sapiens
ccaggguugcuuuagauucuga

SEQ ID NO: 355268 - RNA, 22 nt, Homo sapiens
ccagugauggcugccucauuug

SEQ ID NO: 355269 - RNA, 22 nt, Homo sapiens
ccauugcacuccagccucggca

SEQ ID NO: 355270 - RNA, 22 nt, Homo sapiens
ccauugcacuccauccugggca

SEQ ID NO: 355271 - RNA, 22 nt, Homo sapiens
ccccaguguguaaaggccuugc

SEQ ID NO: 355272 - RNA, 22 nt, Homo sapiens
ccccauguucucucugcagcuc

SEQ ID NO: 355273 - RNA, 22 nt, Homo sapiens
cccuguagcagcauucuuaaau

SEQ ID NO: 355274 - RNA, 22 nt, Homo sapiens
ccuccauuugugucaggaaguc

SEQ ID NO: 355275 - RNA, 21 nt, Homo sapiens
ccugaguacaacccacuccac

SEQ ID NO: 355276 - RNA, 22 nt, Homo sapiens
ccuucauucauuaauuuagccc

SEQ ID NO: 355277 - RNA, 22 nt, Homo sapiens
ccuucauugcaucuuuaagaga

SEQ ID NO: 355278 - RNA, 22 nt, Homo sapiens
cgugaggaguauuuuuaggugc

SEQ ID NO: 355279 - RNA, 22 nt, Homo sapiens
cuaaagugcugagauuauaggu

SEQ ID NO: 355280 - RNA, 22 nt, Homo sapiens
cuaaaugucucuacuaaguuua

SEQ ID NO: 355281 - RNA, 22 nt, Homo sapiens
cuaacuaugucucaggaugucc

SEQ ID NO: 355282 - RNA, 22 nt, Homo sapiens
cuaaggaaggacugaaaggaca

SEQ ID NO: 355283 - RNA, 22 nt, Homo sapiens
cuaagugaacugucacugagaa

SEQ ID NO: 355284 - RNA, 20 nt, Homo sapiens
cuaaucaucccagaagaaau

SEQ ID NO: 355285 - RNA, 22 nt, Homo sapiens
cuacaguagagaggauguagaa

SEQ ID NO: 355286 - RNA, 22 nt, Homo sapiens
cuagaacuagaacugcuggggu

SEQ ID NO: 355287 - RNA, 22 nt, Homo sapiens
cuagaguacuuaccacagcaug

SEQ ID NO: 355288 - RNA, 22 nt, Homo sapiens
cuagcagacaugggcugaacca

SEQ ID NO: 355289 - RNA, 22 nt, Homo sapiens
cuagucacaggaguugaaggau

SEQ ID NO: 355290 - RNA, 22 nt, Homo sapiens
cucaccuugugauccuccugcc

SEQ ID NO: 355291 - RNA, 22 nt, Homo sapiens
cucaguuuugccuuguuuaagg

SEQ ID NO: 355292 - RNA, 22 nt, Homo sapiens
cuccaggugucauccaccuccu

SEQ ID NO: 355293 - RNA, 22 nt, Homo sapiens
cucccuuugcugaauguuuuuc

SEQ ID NO: 355294 - RNA, 22 nt, Homo sapiens
cucucugagccauggcugcccu

SEQ ID NO: 355295 - RNA, 22 nt, Homo sapiens
cugaaagagcauguaacacagu

SEQ ID NO: 355296 - RNA, 22 nt, Homo sapiens
cugaaauggaaugugugcacag

SEQ ID NO: 355297 - RNA, 22 nt, Homo sapiens
cugaauagagcacacugauggg

SEQ ID NO: 355298 - RNA, 22 nt, Homo sapiens
cugacauuguugaucacagcca

SEQ ID NO: 355299 - RNA, 22 nt, Homo sapiens
cugacucagacacauguauaug

SEQ ID NO: 355300 - RNA, 22 nt, Homo sapiens
cugagauacacuaauagucucu

SEQ ID NO: 355301 - RNA, 18 nt, Homo sapiens
cugagcacugcuuuauga

SEQ ID NO: 355302 - RNA, 22 nt, Homo sapiens
cugaggaaguucuuuaacaguu

SEQ ID NO: 355303 - RNA, 22 nt, Homo sapiens
cugcaguaaacuuucccauuca

SEQ ID NO: 355304 - RNA, 22 nt, Homo sapiens
cuggagauauuggaagaaagaa

SEQ ID NO: 355305 - RNA, 22 nt, Homo sapiens
cuggagcauugguggauuuguu

SEQ ID NO: 355306 - RNA, 22 nt, Homo sapiens
cuggauauguugcaacauuucc

SEQ ID NO: 355307 - RNA, 22 nt, Homo sapiens
cuggcccaguucugcguuuugc

SEQ ID NO: 355308 - RNA, 22 nt, Homo sapiens
cuggcugagugguaaguagagg

SEQ ID NO: 355309 - RNA, 21 nt, Homo sapiens
cugguguuagcacuucuuccc

SEQ ID NO: 355310 - RNA, 22 nt, Homo sapiens
cugugcuuggagucccccuagg

SEQ ID NO: 355311 - RNA, 22 nt, Homo sapiens
cuguucaggaggcauuuggugg

SEQ ID NO: 355312 - RNA, 22 nt, Homo sapiens
cuguugcaguuauggcugcagg

SEQ ID NO: 355313 - RNA, 18 nt, Homo sapiens
cuuaacauugggaugaua

SEQ ID NO: 355314 - RNA, 22 nt, Homo sapiens
cuuaaggccagauaauuucuau

SEQ ID NO: 355315 - RNA, 22 nt, Homo sapiens
cuucaagucuuuggauaauuag

SEQ ID NO: 355316 - RNA, 22 nt, Homo sapiens
cuucaucugguuugugaacuuu

SEQ ID NO: 355317 - RNA, 22 nt, Homo sapiens
cuuuaugagguuggauggaucu

SEQ ID NO: 355318 - RNA, 23 nt, Homo sapiens
cuuugguaggaaauuugaauuau

SEQ ID NO: 355319 - RNA, 23 nt, Homo sapiens
cuuuguacagcuugacuacuggg

SEQ ID NO: 355320 - RNA, 22 nt, Homo sapiens
cuuuguguggacauuucaggca

SEQ ID NO: 355321 - RNA, 21 nt, Homo sapiens
cuuuugcacuccagccugggu

SEQ ID NO: 355322 - RNA, 22 nt, Homo sapiens
gaaaugcucauuuuggauccuu

SEQ ID NO: 355323 - RNA, 22 nt, Homo sapiens
gaaauguuuuucaugugggcaa

SEQ ID NO: 355324 - RNA, 22 nt, Homo sapiens
gaagacauuuacaugggagacc

SEQ ID NO: 355325 - RNA, 22 nt, Homo sapiens
uaagugcaugauuacaugcaua

SEQ ID NO: 355326 - RNA, 20 nt, Homo sapiens
uaagugcuugagacuucuga

SEQ ID NO: 355327 - RNA, 20 nt, Homo sapiens
uaagugcuugaugaaugaac

SEQ ID NO: 355328 - RNA, 18 nt, Homo sapiens
uaauaacugugaccuuga

SEQ ID NO: 355329 - RNA, 22 nt, Homo sapiens
uaauacauucaaggugguaguu

SEQ ID NO: 355330 - RNA, 22 nt, Homo sapiens
uaaugcauacagaagguguuuu

SEQ ID NO: 355331 - RNA, 22 nt, Homo sapiens
uaaugcauguaaugggcugaua

SEQ ID NO: 355332 - RNA, 22 nt, Homo sapiens
uaauucugacaacaguggcguu

SEQ ID NO: 355333 - RNA, 22 nt, Homo sapiens
uaauucuguauguaucagaguu

SEQ ID NO: 355334 - RNA, 22 nt, Homo sapiens
uacaaagcuacucgagggcagg

SEQ ID NO: 355335 - RNA, 22 nt, Homo sapiens
uacaaaguaacaguuccuguau

SEQ ID NO: 355336 - RNA, 22 nt, Homo sapiens
uacaaagugggaaacgaagguu

SEQ ID NO: 355337 - RNA, 22 nt, Homo sapiens
uacaacacugguucgacaugug

SEQ ID NO: 355338 - RNA, 22 nt, Homo sapiens
uacacagucaaaaauuuccagg

SEQ ID NO: 355339 - RNA, 22 nt, Homo sapiens
uacacaugugaguucuuuucua

SEQ ID NO: 355340 - RNA, 22 nt, Homo sapiens
uaccuaguguugacuucucuuc

SEQ ID NO: 355341 - RNA, 22 nt, Homo sapiens
uacuuuguagauuguuuccuuu

SEQ ID NO: 355342 - RNA, 22 nt, Homo sapiens
uagaaagcaugaccuucagaua

SEQ ID NO: 355343 - RNA, 22 nt, Homo sapiens
uagaggaaggauuggaaacgca

SEQ ID NO: 355344 - RNA, 21 nt, Homo sapiens
uagcaaauugcuauuaaggca

SEQ ID NO: 355345 - RNA, 22 nt, Homo sapiens
uagcaagaugaauuugugcaaa

SEQ ID NO: 355346 - RNA, 22 nt, Homo sapiens
uagcaccugugcacaccaggca

SEQ ID NO: 355347 - RNA, 20 nt, Homo sapiens
uagcagcagacagagggagg

SEQ ID NO: 355348 - RNA, 22 nt, Homo sapiens
uagcagcauaaauggacuaaga

SEQ ID NO: 355349 - RNA, 22 nt, Homo sapiens
uagcagccaggaagggcuggcu

SEQ ID NO: 355350 - RNA, 22 nt, Homo sapiens
uagcaguaagaaacugacauug

SEQ ID NO: 355351 - RNA, 17 nt, Homo sapiens
uagcucuauuucuagcc

SEQ ID NO: 355352 - RNA, 22 nt, Homo sapiens
uagcuggaauuacuugcaccug

SEQ ID NO: 355353 - RNA, 22 nt, Homo sapiens
uagcuggaguuuuuguuauagg

SEQ ID NO: 355354 - RNA, 18 nt, Homo sapiens
uaggaacauugauuggag

SEQ ID NO: 355355 - RNA, 22 nt, Homo sapiens
uaggagcacaaacccuacugug

SEQ ID NO: 355356 - RNA, 22 nt, Homo sapiens
uaggucaguuuuggcuuggcuu

SEQ ID NO: 355357 - RNA, 22 nt, Homo sapiens
uaggucuuuuaugaaauauauu

SEQ ID NO: 355358 - RNA, 22 nt, Homo sapiens
uaguagcaccucucaugagcuu

SEQ ID NO: 355359 - RNA, 22 nt, Homo sapiens
uagugcacuacuugugggaaug

SEQ ID NO: 355360 - RNA, 21 nt, Homo sapiens
uagugcugaggcaguauggga

SEQ ID NO: 355361 - RNA, 22 nt, Homo sapiens
uagugcugugauaaacauauau

SEQ ID NO: 355362 - RNA, 22 nt, Homo sapiens
uagugcugugauuaacauaaug

SEQ ID NO: 355363 - RNA, 21 nt, Homo sapiens
uauagcagcacgauuuauagu

SEQ ID NO: 355364 - RNA, 22 nt, Homo sapiens
uauagcagugaguauugacuaa

SEQ ID NO: 355365 - RNA, 22 nt, Homo sapiens
uauaggacuugguguaguuucu

SEQ ID NO: 355366 - RNA, 22 nt, Homo sapiens
uauaugcauugugggguacuga

SEQ ID NO: 355367 - RNA, 22 nt, Homo sapiens
uaucacaaacuuagcaguuuaa

SEQ ID NO: 355368 - RNA, 22 nt, Homo sapiens
uaucacagaggguauccuagag

SEQ ID NO: 355369 - RNA, 22 nt, Homo sapiens
uaucacuuugauaguuuaaaug

SEQ ID NO: 355370 - RNA, 21 nt, Homo sapiens
uauccacuugcaacagagaag

SEQ ID NO: 355371 - RNA, 22 nt, Homo sapiens
uaucucacauauucaguagguu

SEQ ID NO: 355372 - RNA, 22 nt, Homo sapiens
uauggaaaucuuaccuuauggu

SEQ ID NO: 355373 - RNA, 22 nt, Homo sapiens
uauggcacuaguacuggaaagc

SEQ ID NO: 355374 - RNA, 21 nt, Homo sapiens
uaugguuucuaauucugcagg

SEQ ID NO: 355375 - RNA, 22 nt, Homo sapiens
uaugucacuugguuuggugcua

SEQ ID NO: 355376 - RNA, 22 nt, Homo sapiens
uauuccacacuguuggugggau

SEQ ID NO: 355377 - RNA, 22 nt, Homo sapiens
uauugcaacagaagaaagaguc

SEQ ID NO: 355378 - RNA, 22 nt, Homo sapiens
uauugcaauuggggaaacuggg

SEQ ID NO: 355379 - RNA, 18 nt, Homo sapiens
uauugcuugguuuggaga

SEQ ID NO: 355380 - RNA, 22 nt, Homo sapiens
uauugcuuuacucucuuauccu

SEQ ID NO: 355381 - RNA, 22 nt, Homo sapiens
uauugcuuuuaacccaaucucu

SEQ ID NO: 355382 - RNA, 22 nt, Homo sapiens
uauugucaccaucccuguuuua

SEQ ID NO: 355383 - RNA, 22 nt, Homo sapiens
ucaacagugggcacuguaaaug

SEQ ID NO: 355384 - RNA, 21 nt, Homo sapiens
ucaaggaguauacguaugcca

SEQ ID NO: 355385 - RNA, 22 nt, Homo sapiens
ucaaggcacuagcugagcugca

SEQ ID NO: 355386 - RNA, 18 nt, Homo sapiens
ucacagguaaaguugaca

SEQ ID NO: 355387 - RNA, 22 nt, Homo sapiens
ucacaguagcaaauguuagaaa

SEQ ID NO: 355388 - RNA, 22 nt, Homo sapiens
ucacaguauucaugaacaugga

SEQ ID NO: 355389 - RNA, 22 nt, Homo sapiens
ucacagucuccucuagggaggg

SEQ ID NO: 355390 - RNA, 22 nt, Homo sapiens
ucacaucucagguuucuugaca

SEQ ID NO: 355391 - RNA, 22 nt, Homo sapiens
ucacaugugacauauauauuug

SEQ ID NO: 355392 - RNA, 22 nt, Homo sapiens
ucacauuguuauguaaauguuu

SEQ ID NO: 355393 - RNA, 22 nt, Homo sapiens
ucacccugacaugcggccgaac

SEQ ID NO: 355394 - RNA, 18 nt, Homo sapiens
ucaccuugaugcuggguc

SEQ ID NO: 355395 - RNA, 22 nt, Homo sapiens
uuuagcagcaaagagcuguguu

SEQ ID NO: 355396 - RNA, 22 nt, Homo sapiens
uuucaccguguuggccaggcug

SEQ ID NO: 355397 - RNA, 22 nt, Homo sapiens
uuucagcguggggugcugaaga

SEQ ID NO: 355398 - RNA, 20 nt, Homo sapiens
uuucaguacuuucuacuggc

SEQ ID NO: 355399 - RNA, 22 nt, Homo sapiens
uuucauccggcuguguauuaug

SEQ ID NO: 355400 - RNA, 22 nt, Homo sapiens
uuucuacagugaacgauuucua

SEQ ID NO: 355401 - RNA, 17 nt, Homo sapiens
uuucucagcccucuucu

SEQ ID NO: 355402 - RNA, 22 nt, Homo sapiens
uuucucaguguuucaggguagg

SEQ ID NO: 355403 - RNA, 22 nt, Homo sapiens
uuugaagugugaugccuugaug

SEQ ID NO: 355404 - RNA, 22 nt, Homo sapiens
uuugaaguguggcacugaguuu

SEQ ID NO: 355405 - RNA, 22 nt, Homo sapiens
uuugagaaugcuaccagagaag

SEQ ID NO: 355406 - RNA, 22 nt, Homo sapiens
uuugagcuagagucucacucug

SEQ ID NO: 355407 - RNA, 22 nt, Homo sapiens
uuugcacuucugagugugacau

SEQ ID NO: 355408 - RNA, 22 nt, Homo sapiens
uuugggaaugguuugucuccca

SEQ ID NO: 355409 - RNA, 22 nt, Homo sapiens
uuuguaauccuauuccaaagga

SEQ ID NO: 355410 - RNA, 22 nt, Homo sapiens
uuuguacacuguugguaggauu

SEQ ID NO: 355411 - RNA, 22 nt, Homo sapiens
uuuguacugagccaagauggua

SEQ ID NO: 355412 - RNA, 22 nt, Homo sapiens
uuugugaggugauggauauguc

SEQ ID NO: 355413 - RNA, 22 nt, Homo sapiens
uuuguggaaugcucauguguag

SEQ ID NO: 355414 - RNA, 21 nt, Homo sapiens
uuugugguuacugugugagcu

SEQ ID NO: 355415 - RNA, 22 nt, Homo sapiens
uuuuaagcuacaagagacauau

SEQ ID NO: 355416 - RNA, 22 nt, Homo sapiens
uuuuauguuuguucccugccaa

SEQ ID NO: 355417 - RNA, 21 nt, Homo sapiens
uuuugcacacuaugcagcuuu

SEQ ID NO: 355418 - RNA, 22 nt, Homo sapiens
uuuugguauaugcaggggucuu

SEQ ID NO: 355419 - RNA, 22 nt, Homo sapiens
uuuuguacgccuguguccauca

SEQ ID NO: 355420 - RNA, 22 nt, Homo sapiens
uuuuuggaggagguuagaucau

SEQ ID NO: 355421 - RNA, 22 nt, Homo sapiens
uguugcacucuagccugggcaa

SEQ ID NO: 355422 - RNA, 22 nt, Homo sapiens
uguuuuggaggccagaagucca

SEQ ID NO: 355423 - RNA, 22 nt, Homo sapiens
uguuuuggaguggacuuugcau

SEQ ID NO: 355424 - RNA, 22 nt, Homo sapiens
uguuuugguugucccuggccag

SEQ ID NO: 355425 - RNA, 22 nt, Homo sapiens
uuaaacugcuugaauuggguuu

SEQ ID NO: 355426 - RNA, 22 nt, Homo sapiens
uuaaaggcauguacacuagagu

SEQ ID NO: 355427 - RNA, 22 nt, Homo sapiens
uuaaauacagcaugguguuucu

SEQ ID NO: 355428 - RNA, 22 nt, Homo sapiens
uuaaaugcacauacuugagaaa

SEQ ID NO: 355429 - RNA, 22 nt, Homo sapiens
uuaagaagugauuuuccucauu

SEQ ID NO: 355430 - RNA, 22 nt, Homo sapiens
uuaagcaguaguuaaggagagg

SEQ ID NO: 355431 - RNA, 22 nt, Homo sapiens
uuaaggcagugcaucuggaguu

SEQ ID NO: 355432 - RNA, 19 nt, Homo sapiens
uuaaguaguuagagggucu

SEQ ID NO: 355433 - RNA, 21 nt, Homo sapiens
uuacaauggcuccuugaaggu

SEQ ID NO: 355434 - RNA, 22 nt, Homo sapiens
uuacagcugggugugucuggua

SEQ ID NO: 355435 - RNA, 22 nt, Homo sapiens
uuacaguagaugaggguauaau

SEQ ID NO: 355436 - RNA, 22 nt, Homo sapiens
uuacaguauugcaaggacuagg

SEQ ID NO: 355437 - RNA, 22 nt, Homo sapiens
uuacauugcuucaaauucagug

SEQ ID NO: 355438 - RNA, 22 nt, Homo sapiens
uuaccucuguggcucucggacu

SEQ ID NO: 355439 - RNA, 22 nt, Homo sapiens
uuaccugagaaggugacauuug

SEQ ID NO: 355440 - RNA, 17 nt, Homo sapiens
uuagacagacauccugc

SEQ ID NO: 355441 - RNA, 18 nt, Homo sapiens
uuagagugcauuacuuug

SEQ ID NO: 355442 - RNA, 22 nt, Homo sapiens
uuaggcaggauaguuacauauu

SEQ ID NO: 355443 - RNA, 21 nt, Homo sapiens
uuaggcagugucagaggugag

SEQ ID NO: 355444 - RNA, 22 nt, Homo sapiens
uuagggaggcucaggacaagag

SEQ ID NO: 355445 - RNA, 22 nt, Homo sapiens
uuagucaaguguacugugaaug

SEQ ID NO: 355446 - RNA, 22 nt, Homo sapiens
uuagugaaugggugugauuugu

SEQ ID NO: 355447 - RNA, 22 nt, Homo sapiens
uuagugcugaguggaauguucu

SEQ ID NO: 355448 - RNA, 22 nt, Homo sapiens
uuauaacagagacuccugugcu

SEQ ID NO: 355449 - RNA, 20 nt, Homo sapiens
uuauaacuuuuguucugggg

SEQ ID NO: 355450 - RNA, 22 nt, Homo sapiens
uuaucccacuuucuguuccugu

SEQ ID NO: 355451 - RNA, 22 nt, Homo sapiens
uuauccucuagacauagguuua

SEQ ID NO: 355452 - RNA, 22 nt, Homo sapiens
uuaugcaucuuccacacucauu

SEQ ID NO: 355453 - RNA, 22 nt, Homo sapiens
uuauggauuuauauucuguagu

SEQ ID NO: 355454 - RNA, 22 nt, Homo sapiens
uuaugguuuuucugugagaugg

SEQ ID NO: 355455 - RNA, 22 nt, Homo sapiens
uuauuagagauauuugguuagg

SEQ ID NO: 355456 - RNA, 22 nt, Homo sapiens
uucaagucuuggcuuugccacc

SEQ ID NO: 355457 - RNA, 20 nt, Homo sapiens
uucaagugauucucaugccu

SEQ ID NO: 355458 - RNA, 22 nt, Homo sapiens
uucacaugguugccuuuugauc

SEQ ID NO: 355459 - RNA, 23 nt, Homo sapiens
uucaccguguuggccaggcuggu

SEQ ID NO: 355460 - RNA, 22 nt, Homo sapiens
uucagagagggagggauaccua

SEQ ID NO: 355461 - RNA, 22 nt, Homo sapiens
uucagaugcacacuguagucua

SEQ ID NO: 355462 - RNA, 22 nt, Homo sapiens
uucaguugcaucaguugaccag

SEQ ID NO: 355463 - RNA, 21 nt, Homo sapiens
uucaucagccagaaaucaagc

SEQ ID NO: 355464 - RNA, 22 nt, Homo sapiens
uucaucagcuguagaugucaug

SEQ ID NO: 355465 - RNA, 22 nt, Homo sapiens
uucaucuggcaauucagagauu

SEQ ID NO: 355466 - RNA, 22 nt, Homo sapiens
uucauggacucaauaguuucgc

SEQ ID NO: 355467 - RNA, 22 nt, Homo sapiens
uucauugaaugauuuuuagaag

SEQ ID NO: 355468 - RNA, 22 nt, Homo sapiens
uucauuggacuuguguucuuga

SEQ ID NO: 355469 - RNA, 22 nt, Homo sapiens
uucccuuugaaacuaaacuugc

SEQ ID NO: 355470 - RNA, 22 nt, Homo sapiens
uucccuuugaauuggaaaggug

SEQ ID NO: 355471 - RNA, 22 nt, Homo sapiens
uucccuuuguuaaauuggaaga

SEQ ID NO: 355472 - RNA, 22 nt, Homo sapiens
uucccuuuuuucuaguagguag

SEQ ID NO: 355473 - RNA, 22 nt, Homo sapiens
uugaaagaaaggagacugaguu

SEQ ID NO: 355474 - RNA, 22 nt, Homo sapiens
uugaaagcuaucagagauucca

SEQ ID NO: 355475 - RNA, 22 nt, Homo sapiens
uugaaggaacgcuguucccuug

SEQ ID NO: 355476 - RNA, 22 nt, Homo sapiens
uugaaguagaaagacgaaauuu

SEQ ID NO: 355477 - RNA, 22 nt, Homo sapiens
uugaauggaauguuggaacuau

SEQ ID NO: 355478 - RNA, 22 nt, Homo sapiens
uugacauaguuucugaaauaga

SEQ ID NO: 355479 - RNA, 22 nt, Homo sapiens
uugagauagggucuaccucugu

SEQ ID NO: 355480 - RNA, 22 nt, Homo sapiens
uugagauauccauaaaugggaa

SEQ ID NO: 355481 - RNA, 22 nt, Homo sapiens
uugagccaaggauugucuuucc

SEQ ID NO: 355482 - RNA, 22 nt, Homo sapiens
uugaggaaugugauuucaaaua

SEQ ID NO: 355483 - RNA, 22 nt, Homo sapiens
uugagggaaacauucacaucau

SEQ ID NO: 355484 - RNA, 22 nt, Homo sapiens
uugcaaagaccucuucacuucc

SEQ ID NO: 355485 - RNA, 18 nt, Homo sapiens
uugcaaauucuucccugu

SEQ ID NO: 355486 - RNA, 22 nt, Homo sapiens
uugcaacauguauucuggugau

SEQ ID NO: 355487 - RNA, 20 nt, Homo sapiens
uugcacagagaaggaggcag

SEQ ID NO: 355488 - RNA, 22 nt, Homo sapiens
uugcacauugauuuuguaucuu

SEQ ID NO: 355489 - RNA, 22 nt, Homo sapiens
uugcacauugcaccuuuuguau

SEQ ID NO: 355490 - RNA, 22 nt, Homo sapiens
uugcacuccggccuggguaaca

SEQ ID NO: 355491 - RNA, 22 nt, Homo sapiens
uugcacucuccagccucggcaa

SEQ ID NO: 355492 - RNA, 22 nt, Homo sapiens
uugccuuuguuggaaacaagug

SEQ ID NO: 355493 - RNA, 22 nt, Homo sapiens
uuggaaggcuccuaaugaaugg

SEQ ID NO: 355494 - RNA, 22 nt, Homo sapiens
uuggagucaucucuguacugua

SEQ ID NO: 355495 - RNA, 22 nt, Homo sapiens
uuggauggugauaugguuugga

SEQ ID NO: 355496 - RNA, 22 nt, Homo sapiens
uuggcagcauuccagccaagca

SEQ ID NO: 355497 - RNA, 22 nt, Homo sapiens
uuggcagcuguggaaucugggc

SEQ ID NO: 355498 - RNA, 22 nt, Homo sapiens
uuggccccucccaaauuucaug

SEQ ID NO: 355499 - RNA, 22 nt, Homo sapiens
uugggacuggaaggaguaaggg

SEQ ID NO: 355500 - RNA, 22 nt, Homo sapiens
uugggccacuuuaguuuccuua

SEQ ID NO: 355501 - RNA, 22 nt, Homo sapiens
uuggucaaaucugaugggagaa

SEQ ID NO: 355502 - RNA, 22 nt, Homo sapiens
uuguaacaguuuauugacucga

SEQ ID NO: 355503 - RNA, 22 nt, Homo sapiens
uuguaaucaacacaucauuggg

SEQ ID NO: 355504 - RNA, 22 nt, Homo sapiens
uuguacuuuuaguagagacggg

SEQ ID NO: 355505 - RNA, 22 nt, Homo sapiens
uuguaguagcauuauuuauaau

SEQ ID NO: 355506 - RNA, 22 nt, Homo sapiens
uuguauaggcucaguaagaauc

SEQ ID NO: 355507 - RNA, 22 nt, Homo sapiens
uuguauguuucugugcacauga

SEQ ID NO: 355508 - RNA, 22 nt, Homo sapiens
uugugaaaucuaggcagagguu

SEQ ID NO: 355509 - RNA, 22 nt, Homo sapiens
uugugaauggugccucaguaaa

SEQ ID NO: 355510 - RNA, 22 nt, Homo sapiens
uugugagggagcuaagaugagu

SEQ ID NO: 355511 - RNA, 21 nt, Homo sapiens
uugugccaaacccuggaggga

SEQ ID NO: 355512 - RNA, 22 nt, Homo sapiens
uuguuaagaugcagauucugga

SEQ ID NO: 355513 - RNA, 22 nt, Homo sapiens
uuuaauacugcaucuuuacucu

SEQ ID NO: 355514 - RNA, 22 nt, Homo sapiens
uuuaaugcugcccagucauggg

SEQ ID NO: 355515 - RNA, 18 nt, Homo sapiens
uuuacaguagaaggacuu

SEQ ID NO: 355516 - RNA, 22 nt, Homo sapiens
aaaagcauucagagugcugggc

SEQ ID NO: 355517 - RNA, 22 nt, Homo sapiens
aaaagcuuagaugggcuuguau

SEQ ID NO: 355518 - RNA, 22 nt, Homo sapiens
aaagugcaguacuucguauauu

SEQ ID NO: 355519 - RNA, 22 nt, Homo sapiens
aaagugcugagacagacuggga

SEQ ID NO: 355520 - RNA, 22 nt, Homo sapiens
aaagugcugagaguucuaacuu

SEQ ID NO: 355521 - RNA, 22 nt, Homo sapiens
aaagugcugagucuaggcgggg

SEQ ID NO: 355522 - RNA, 22 nt, Homo sapiens
aaagugcuuccuuuuugagggu

SEQ ID NO: 355523 - RNA, 22 nt, Homo sapiens
aaaguggugggauuccaggcau

SEQ ID NO: 355524 - RNA, 22 nt, Homo sapiens
aaauaguagcugaaugagggaa

SEQ ID NO: 355525 - RNA, 22 nt, Homo sapiens
aaaugcccuaaaauggagcauc

SEQ ID NO: 355526 - RNA, 22 nt, Homo sapiens
aaaugcuucuauguggcauguu

SEQ ID NO: 355527 - RNA, 22 nt, Homo sapiens
aaauucaucaaaugguuuguau

SEQ ID NO: 355528 - RNA, 22 nt, Homo sapiens
aaauucaugucaccucuaggua

SEQ ID NO: 355529 - RNA, 22 nt, Homo sapiens
aaauugcaaugcgaggcagagg

SEQ ID NO: 355530 - RNA, 22 nt, Homo sapiens
aacacuguuuccagucaugauc

SEQ ID NO: 355531 - RNA, 22 nt, Homo sapiens
aacauguuuagcagauaccugu

SEQ ID NO: 355532 - RNA, 22 nt, Homo sapiens
aacccugagucaugagucuaga

SEQ ID NO: 355533 - RNA, 22 nt, Homo sapiens
aacugcauuuucugauugugug

SEQ ID NO: 355534 - RNA, 22 nt, Homo sapiens
aacuggcauagccagacuucuc

SEQ ID NO: 355535 - RNA, 20 nt, Homo sapiens
aagacacuguccccacugga

SEQ ID NO: 355536 - RNA, 22 nt, Homo sapiens
aagcuacauuuuauuuauguca

SEQ ID NO: 355537 - RNA, 22 nt, Homo sapiens
aagcuagugagacagugguacu

SEQ ID NO: 355538 - RNA, 22 nt, Homo sapiens
cacaaaguagauuagucuucca

SEQ ID NO: 355539 - RNA, 22 nt, Homo sapiens
cacacugucuucauuacuguag

SEQ ID NO: 355540 - RNA, 22 nt, Homo sapiens
cacaggaagaggcacggucccu

SEQ ID NO: 355541 - RNA, 22 nt, Homo sapiens
cacauguucaggagcacuuaga

SEQ ID NO: 355542 - RNA, 22 nt, Homo sapiens
cacauguuuuagcauggcuguu

SEQ ID NO: 355543 - RNA, 22 nt, Homo sapiens
cacuaccucuacaggcagcugg

SEQ ID NO: 355544 - RNA, 22 nt, Homo sapiens
cacuaggcuggagugcaguggc

SEQ ID NO: 355545 - RNA, 21 nt, Homo sapiens
cacugguguugcuauaucaaa

SEQ ID NO: 355546 - RNA, 22 nt, Homo sapiens
cagcacauagcaguugcucagu

SEQ ID NO: 355547 - RNA, 22 nt, Homo sapiens
cagcuaaauuguuaaauccaag

SEQ ID NO: 355548 - RNA, 22 nt, Homo sapiens
cagcugcuuuggaaaauauuuu

SEQ ID NO: 355549 - RNA, 22 nt, Homo sapiens
cagcuguguuauaaacuaccau

SEQ ID NO: 355550 - RNA, 22 nt, Homo sapiens
caggcagucuggcucccaagug

SEQ ID NO: 355551 - RNA, 22 nt, Homo sapiens
caggcagugggagacaaaacug

SEQ ID NO: 355552 - RNA, 21 nt, Homo sapiens
cagguagugucugaagccaga

SEQ ID NO: 355553 - RNA, 22 nt, Homo sapiens
caggugaaugccucuccuucug

SEQ ID NO: 355554 - RNA, 18 nt, Homo sapiens
cagugcaauacaggagag

SEQ ID NO: 355555 - RNA, 22 nt, Homo sapiens
cauaaagauggaggaggccagg

SEQ ID NO: 355556 - RNA, 22 nt, Homo sapiens
cauacaagcuacaaucacaaag

SEQ ID NO: 355557 - RNA, 22 nt, Homo sapiens
caugcacugagagggucucggc

SEQ ID NO: 355558 - RNA, 22 nt, Homo sapiens
cauggcaucuguguggccucca

SEQ ID NO: 355559 - RNA, 22 nt, Homo sapiens
cauggcccuggguccauaggaa

SEQ ID NO: 355560 - RNA, 22 nt, Homo sapiens
cauugcacuccagccuagccaa

SEQ ID NO: 355561 - RNA, 22 nt, Homo sapiens
cauugcacuccagccugccugg

SEQ ID NO: 355562 - RNA, 20 nt, Homo sapiens
cauugcacuccagcuugggc

SEQ ID NO: 355563 - RNA, 22 nt, Homo sapiens
cauugcacuccagcuugggcaa

SEQ ID NO: 355564 - RNA, 22 nt, Homo sapiens
cauugcacuccagcuugggcga

SEQ ID NO: 355565 - RNA, 22 nt, Homo sapiens
cauugcacugcauucugggcaa

SEQ ID NO: 355566 - RNA, 22 nt, Homo sapiens
cauugcucuuacagagugagua

SEQ ID NO: 355567 - RNA, 22 nt, Homo sapiens
ccaaaguauuuucacugauauc

SEQ ID NO: 355568 - RNA, 22 nt, Homo sapiens
ccacccuggagaauuugagguc

SEQ ID NO: 355569 - RNA, 22 nt, Homo sapiens
ccagccgggugcaguggcucac

SEQ ID NO: 355570 - RNA, 22 nt, Homo sapiens
ccaggguuccacgccuggcugu

SEQ ID NO: 355571 - RNA, 22 nt, Homo sapiens
ccagugauuguauggugaaggu

SEQ ID NO: 355572 - RNA, 22 nt, Homo sapiens
ccaucacacugugauuauuauc

SEQ ID NO: 355573 - RNA, 23 nt, Homo sapiens
ccauugcacuccagccucaguga

SEQ ID NO: 355574 - RNA, 22 nt, Homo sapiens
ccauugcacuucagccuaggug

SEQ ID NO: 355575 - RNA, 23 nt, Homo sapiens
cccucagaagugcagggagagaa

SEQ ID NO: 355576 - RNA, 22 nt, Homo sapiens
ccucacaaccuuuauugaagag

SEQ ID NO: 355577 - RNA, 21 nt, Homo sapiens
ccugaugaccucugagaguua

SEQ ID NO: 355578 - RNA, 22 nt, Homo sapiens
ccugucuugauuaaauuacuua

SEQ ID NO: 355579 - RNA, 22 nt, Homo sapiens
ccuucacaggcacugguucaga

SEQ ID NO: 355580 - RNA, 22 nt, Homo sapiens
ccuuuuugaguugccagaguuc

SEQ ID NO: 355581 - RNA, 22 nt, Homo sapiens
cgugaggaaaacagaggguguu

SEQ ID NO: 355582 - RNA, 22 nt, Homo sapiens
cuacaguuauguuuuaaaugug

SEQ ID NO: 355583 - RNA, 22 nt, Homo sapiens
cuaugcuuucugggcccugggu

SEQ ID NO: 355584 - RNA, 22 nt, Homo sapiens
cuauucacaggcaauauguaca

SEQ ID NO: 355585 - RNA, 21 nt, Homo sapiens
cucaaaguacugauauuacag

SEQ ID NO: 355586 - RNA, 22 nt, Homo sapiens
cucacagugacacgaaccccca

SEQ ID NO: 355587 - RNA, 22 nt, Homo sapiens
cucacaugcucaccugguguuc

SEQ ID NO: 355588 - RNA, 22 nt, Homo sapiens
cucagucuaugauacuuugcua

SEQ ID NO: 355589 - RNA, 22 nt, Homo sapiens
cucaugcugucuucugggguaa

SEQ ID NO: 355590 - RNA, 22 nt, Homo sapiens
cuccaggugagguuaagggacu

SEQ ID NO: 355591 - RNA, 22 nt, Homo sapiens
cuccauuuaguccuuuuagaag

SEQ ID NO: 355592 - RNA, 22 nt, Homo sapiens
cucccugagccagggcuuugac

SEQ ID NO: 355593 - RNA, 22 nt, Homo sapiens
cugaagugugaaagucuuuuuu

SEQ ID NO: 355594 - RNA, 22 nt, Homo sapiens
cugacaagauucaucacucagu

SEQ ID NO: 355595 - RNA, 22 nt, Homo sapiens
cugagauaauuucuagguguca

SEQ ID NO: 355596 - RNA, 22 nt, Homo sapiens
cugagcaucauggcagaaucuu

SEQ ID NO: 355597 - RNA, 20 nt, Homo sapiens
cugagguacgaggguuaaau

SEQ ID NO: 355598 - RNA, 22 nt, Homo sapiens
cugaggucugaauccagguauc

SEQ ID NO: 355599 - RNA, 18 nt, Homo sapiens
cugagucauuccuggguc

SEQ ID NO: 355600 - RNA, 22 nt, Homo sapiens
cugauugugcagagguguaauu

SEQ ID NO: 355601 - RNA, 19 nt, Homo sapiens
cugcaagguaauaggucag

SEQ ID NO: 355602 - RNA, 22 nt, Homo sapiens
cugcagucaucugaagauuuug

SEQ ID NO: 355603 - RNA, 22 nt, Homo sapiens
cugccugagaaaauggagggca

SEQ ID NO: 355604 - RNA, 22 nt, Homo sapiens
cuggaauuacaggguugagcua

SEQ ID NO: 355605 - RNA, 22 nt, Homo sapiens
cuggaggccugaacauaaaugg

SEQ ID NO: 355606 - RNA, 22 nt, Homo sapiens
cuggauauuaacauugaugaaa

SEQ ID NO: 355607 - RNA, 22 nt, Homo sapiens
cuggauggugagauaaagaaaa

SEQ ID NO: 355608 - RNA, 22 nt, Homo sapiens
cugggauggaggagaauuagag

SEQ ID NO: 355609 - RNA, 22 nt, Homo sapiens
cuggguacccuuuaaacaggaa

SEQ ID NO: 355610 - RNA, 22 nt, Homo sapiens
cuguaacagaauaaauuuguuu

SEQ ID NO: 355611 - RNA, 22 nt, Homo sapiens
cugugcacaucuggcggcccga

SEQ ID NO: 355612 - RNA, 22 nt, Homo sapiens
cuguuuguuuaggguacucaga

SEQ ID NO: 355613 - RNA, 22 nt, Homo sapiens
cuuacagucuaucagccacaac

SEQ ID NO: 355614 - RNA, 19 nt, Homo sapiens
cuuaggugaccaguuccca

SEQ ID NO: 355615 - RNA, 20 nt, Homo sapiens
cuuccaguggccccaucuuu

SEQ ID NO: 355616 - RNA, 22 nt, Homo sapiens
cuugugccugaucuuagggggc

SEQ ID NO: 355617 - RNA, 22 nt, Homo sapiens
cuuucacacuguuggugggaau

SEQ ID NO: 355618 - RNA, 22 nt, Homo sapiens
cuuugauuauaaaaggguguuu

SEQ ID NO: 355619 - RNA, 18 nt, Homo sapiens
cuuugcagcuuccagagg

SEQ ID NO: 355620 - RNA, 22 nt, Homo sapiens
cuuuggagaaaaguucuugggc

SEQ ID NO: 355621 - RNA, 22 nt, Homo sapiens
cuuuguaugucaugacaacugu

SEQ ID NO: 355622 - RNA, 22 nt, Homo sapiens
cuuugugugggccaagggcugg

SEQ ID NO: 355623 - RNA, 22 nt, Homo sapiens
cuuuuggucuaucagagaagca

SEQ ID NO: 355624 - RNA, 22 nt, Homo sapiens
gaaaugcucagggguuuuccag

SEQ ID NO: 355625 - RNA, 22 nt, Homo sapiens
gaacccuggaggcggagguugc

SEQ ID NO: 355626 - RNA, 22 nt, Homo sapiens
gaagauaucuaguaccauuguc

SEQ ID NO: 355627 - RNA, 22 nt, Homo sapiens
gaagugcuuuuggacuaacagu

SEQ ID NO: 355628 - RNA, 22 nt, Homo sapiens
gaauaaacuagagaggacugag

SEQ ID NO: 355629 - RNA, 22 nt, Homo sapiens
gaaugaauguuuauccuuagau

SEQ ID NO: 355630 - RNA, 22 nt, Homo sapiens
gacaccugguguggaacuggag

SEQ ID NO: 355631 - RNA, 22 nt, Homo sapiens
gacacugucuucugcucuuaaa

SEQ ID NO: 355632 - RNA, 22 nt, Homo sapiens
gacaucauuaugagauuuaaac

SEQ ID NO: 355633 - RNA, 22 nt, Homo sapiens
ugagauguguccagaucuaguu

SEQ ID NO: 355634 - RNA, 22 nt, Homo sapiens
ugagauguugcucugaaacaag

SEQ ID NO: 355635 - RNA, 22 nt, Homo sapiens
ugagauguuuguuucagugccu

SEQ ID NO: 355636 - RNA, 23 nt, Homo sapiens
ugagauuacccagaaagaguaua

SEQ ID NO: 355637 - RNA, 22 nt, Homo sapiens
ugagcacauuuacaucaguucc

SEQ ID NO: 355638 - RNA, 22 nt, Homo sapiens
ugaggcaaggcugaaugaaggc

SEQ ID NO: 355639 - RNA, 22 nt, Homo sapiens
ugagguaacaaacuaugaguua

SEQ ID NO: 355640 - RNA, 22 nt, Homo sapiens
ugaguaauguugaucuuugaua

SEQ ID NO: 355641 - RNA, 22 nt, Homo sapiens
ugaguagcuaagacgauaggca

SEQ ID NO: 355642 - RNA, 22 nt, Homo sapiens
ugaguauagaucaguucaagug

SEQ ID NO: 355643 - RNA, 19 nt, Homo sapiens
ugaguaucuuuacacaucu

SEQ ID NO: 355644 - RNA, 22 nt, Homo sapiens
ugagucaauggaggcucagagc

SEQ ID NO: 355645 - RNA, 23 nt, Homo sapiens
ugagucacuuugcuggggucucu

SEQ ID NO: 355646 - RNA, 22 nt, Homo sapiens
ugaucuuuuuaauguccauggg

SEQ ID NO: 355647 - RNA, 18 nt, Homo sapiens
ugcaaacauguguguguu

SEQ ID NO: 355648 - RNA, 22 nt, Homo sapiens
ugcaaaugcugcuauuucucuu

SEQ ID NO: 355649 - RNA, 22 nt, Homo sapiens
ugcaaaugucaaggguuagugu

SEQ ID NO: 355650 - RNA, 22 nt, Homo sapiens
ugcaagucaucuguccuucaga

SEQ ID NO: 355651 - RNA, 22 nt, Homo sapiens
ugcaaucaucgcuguuggccac

SEQ ID NO: 355652 - RNA, 22 nt, Homo sapiens
ugcacugucuugucgcauagca

SEQ ID NO: 355653 - RNA, 22 nt, Homo sapiens
ugcagcacugaacuucugggcu

SEQ ID NO: 355654 - RNA, 22 nt, Homo sapiens
ugcagcucaaauuccuaacaag

SEQ ID NO: 355655 - RNA, 22 nt, Homo sapiens
ugcaguacauucagcauccucu

SEQ ID NO: 355656 - RNA, 23 nt, Homo sapiens
ugcauaguacccaauacuuuauc

SEQ ID NO: 355657 - RNA, 22 nt, Homo sapiens
ugcauaugcagcauuuaugauu

SEQ ID NO: 355658 - RNA, 22 nt, Homo sapiens
ugccuaggcccaguccucagaa

SEQ ID NO: 355659 - RNA, 22 nt, Homo sapiens
ugccuaguggaaggagagcaaa

SEQ ID NO: 355660 - RNA, 22 nt, Homo sapiens
ugccugagcccagcccuguagu

SEQ ID NO: 355661 - RNA, 22 nt, Homo sapiens
ugccuggagagcuccuacauau

SEQ ID NO: 355662 - RNA, 22 nt, Homo sapiens
ugccuuauuccaacugagcucu

SEQ ID NO: 355663 - RNA, 22 nt, Homo sapiens
ugcgccauugcacuccagccug

SEQ ID NO: 355664 - RNA, 20 nt, Homo sapiens
ugcugcacuuaagcaugggc

SEQ ID NO: 355665 - RNA, 22 nt, Homo sapiens
ugcugcacuuauggcucugagg

SEQ ID NO: 355666 - RNA, 21 nt, Homo sapiens
ugcuuacugaauguuaauuuc

SEQ ID NO: 355667 - RNA, 22 nt, Homo sapiens
ugcuuaggcuuccuuacaguau

SEQ ID NO: 355668 - RNA, 22 nt, Homo sapiens
ugcuuagucuugcuuuagcuau

SEQ ID NO: 355669 - RNA, 20 nt, Homo sapiens
uggaaaguaagucaugauau

SEQ ID NO: 355670 - RNA, 22 nt, Homo sapiens
uggaaaguacuugaguuuguau

SEQ ID NO: 355671 - RNA, 22 nt, Homo sapiens
uggaaauuaacagggauugucc

SEQ ID NO: 355672 - RNA, 22 nt, Homo sapiens
uggaaguaaucaugagguagca

SEQ ID NO: 355673 - RNA, 22 nt, Homo sapiens
uggacagagagaccggcauuuu

SEQ ID NO: 355674 - RNA, 21 nt, Homo sapiens
uggaccccuuccuuacaucau

SEQ ID NO: 355675 - RNA, 22 nt, Homo sapiens
uggacugagauuucagcugcca

SEQ ID NO: 355676 - RNA, 22 nt, Homo sapiens
uggagaacauucauuugcaaga

SEQ ID NO: 355677 - RNA, 22 nt, Homo sapiens
uggagaacugaugucuccaaga

SEQ ID NO: 355678 - RNA, 22 nt, Homo sapiens
uggagacugaucccucuuuccu

SEQ ID NO: 355679 - RNA, 22 nt, Homo sapiens
uggagagucauuuauaguauuu

SEQ ID NO: 355680 - RNA, 22 nt, Homo sapiens
uggagguagagaugggaucucc

SEQ ID NO: 355681 - RNA, 22 nt, Homo sapiens
uggagguagggccuaggaaucu

SEQ ID NO: 355682 - RNA, 22 nt, Homo sapiens
uggauggagaggcuugugaugc

SEQ ID NO: 355683 - RNA, 22 nt, Homo sapiens
uggcaagaccccaucucuacaa

SEQ ID NO: 355684 - RNA, 22 nt, Homo sapiens
uggcauggggcagaacauuaca

SEQ ID NO: 355685 - RNA, 23 nt, Homo sapiens
uggcauuuuaguuagcuucagug

SEQ ID NO: 355686 - RNA, 22 nt, Homo sapiens
uggcccccucccaaaucucaua

SEQ ID NO: 355687 - RNA, 22 nt, Homo sapiens
uggcucauuucuaaacccagcu

SEQ ID NO: 355688 - RNA, 22 nt, Homo sapiens
ugggaaacauccagcacauacu

SEQ ID NO: 355689 - RNA, 22 nt, Homo sapiens
ugggaaauguagccuagcugug

SEQ ID NO: 355690 - RNA, 19 nt, Homo sapiens
ugggaauguaaauuaguuc

SEQ ID NO: 355691 - RNA, 22 nt, Homo sapiens
ugggcaagagagcaugacccug

SEQ ID NO: 355692 - RNA, 22 nt, Homo sapiens
uggguagagaaucaggaucuua

SEQ ID NO: 355693 - RNA, 22 nt, Homo sapiens
uggucauggaaauagaaugcac

SEQ ID NO: 355694 - RNA, 22 nt, Homo sapiens
uggucucuuugcuuuagucauc

SEQ ID NO: 355695 - RNA, 22 nt, Homo sapiens
uggugcaaauguaauugugguu

SEQ ID NO: 355696 - RNA, 20 nt, Homo sapiens
ugguguuugaacagugaaug

SEQ ID NO: 355697 - RNA, 22 nt, Homo sapiens
uguaagcagcagagacuauccu

SEQ ID NO: 355698 - RNA, 22 nt, Homo sapiens
uguagucauuugaaggaugucc

SEQ ID NO: 355699 - RNA, 22 nt, Homo sapiens
ugucaguguacuguaagaauua

SEQ ID NO: 355700 - RNA, 22 nt, Homo sapiens
ugucccaguuggguauugaauu

SEQ ID NO: 355701 - RNA, 22 nt, Homo sapiens
ugucuaguuuugaaguauagca

SEQ ID NO: 355702 - RNA, 22 nt, Homo sapiens
ugucuggaaggguggccuccug

SEQ ID NO: 355703 - RNA, 22 nt, Homo sapiens
ugucuuguagacugaaggcuuc

SEQ ID NO: 355704 - RNA, 22 nt, Homo sapiens
ugugaacauuuuguauauauua

SEQ ID NO: 355705 - RNA, 22 nt, Homo sapiens
ugugaagaugagaugacgcccu

SEQ ID NO: 355706 - RNA, 22 nt, Homo sapiens
ugugacaaauuuaguggacugu

SEQ ID NO: 355707 - RNA, 22 nt, Homo sapiens
ugugacagguauccuguguucu

SEQ ID NO: 355708 - RNA, 17 nt, Homo sapiens
ugugacccugggcuacc

SEQ ID NO: 355709 - RNA, 19 nt, Homo sapiens
ugugagcauuagcauuuag

SEQ ID NO: 355710 - RNA, 22 nt, Homo sapiens
ugugauguggagggcagaucca

SEQ ID NO: 355711 - RNA, 22 nt, Homo sapiens
ugugcacaaccugcagguuugu

SEQ ID NO: 355712 - RNA, 22 nt, Homo sapiens
ugugcacuggaccuugucuucu

SEQ ID NO: 355713 - RNA, 22 nt, Homo sapiens
ugugcauauaaguguguauaua

SEQ ID NO: 355714 - RNA, 22 nt, Homo sapiens
ugugccuucuaagaaggagucu

SEQ ID NO: 355715 - RNA, 22 nt, Homo sapiens
ugugcgugugccuguaagaauu

SEQ ID NO: 355716 - RNA, 22 nt, Homo sapiens
ugugcugaucgggcacgguguc

SEQ ID NO: 355717 - RNA, 22 nt, Homo sapiens
ugugcuuguaaaggccagagca

SEQ ID NO: 355718 - RNA, 22 nt, Homo sapiens
uguggccuuuguuucaguuggg

SEQ ID NO: 355719 - RNA, 22 nt, Homo sapiens
uguggcuuuuucuuggcugagg

SEQ ID NO: 355720 - RNA, 22 nt, Homo sapiens
ugugggaggugcuaauguaaau

SEQ ID NO: 355721 - RNA, 23 nt, Homo sapiens
ugugguauuauuccauuuauagg

SEQ ID NO: 355722 - RNA, 22 nt, Homo sapiens
uguuauuuuguguuagggcaca

SEQ ID NO: 355723 - RNA, 22 nt, Homo sapiens
uguucaugaguucucauuuuua

SEQ ID NO: 355724 - RNA, 22 nt, Homo sapiens
uguucuggagccgguucaaaug

SEQ ID NO: 355725 - RNA, 22 nt, Homo sapiens
uguugcacuccagccuagguga

SEQ ID NO: 355726 - RNA, 22 nt, Homo sapiens
uguugcacuccagccuggguga

SEQ ID NO: 355727 - RNA, 19 nt, Homo sapiens
uguugcacuccagcuuggg

SEQ ID NO: 355728 - RNA, 22 nt, Homo sapiens
aaaaguucuuugagccuugaca

SEQ ID NO: 355729 - RNA, 22 nt, Homo sapiens
aaagcacugaauaaauuugcuu

SEQ ID NO: 355730 - RNA, 22 nt, Homo sapiens
aaaggcacuagaaguuaccuuu

SEQ ID NO: 355731 - RNA, 20 nt, Homo sapiens
aaaguaggcuaauaccaaaa

SEQ ID NO: 355732 - RNA, 22 nt, Homo sapiens
aaaguaguagcaguuucugcca

SEQ ID NO: 355733 - RNA, 22 nt, Homo sapiens
aaagugcugggauuaggccagg

SEQ ID NO: 355734 - RNA, 22 nt, Homo sapiens
aaagugcuuacuaaguugccaa

SEQ ID NO: 355735 - RNA, 22 nt, Homo sapiens
aaaugcacagaaaggaugugga

SEQ ID NO: 355736 - RNA, 22 nt, Homo sapiens
aaaugcacgcuacccagcuaga

SEQ ID NO: 355737 - RNA, 22 nt, Homo sapiens
aaaugcaugaggugggaagaaa

SEQ ID NO: 355738 - RNA, 22 nt, Homo sapiens
uggaagcauagcagcgugugug

SEQ ID NO: 355739 - RNA, 22 nt, Homo sapiens
uggaagcaugcaaucugugggg

SEQ ID NO: 355740 - RNA, 22 nt, Homo sapiens
uggaaguaaccaugaauggaau

SEQ ID NO: 355741 - RNA, 22 nt, Homo sapiens
uggaagugaacaaccaaggcag

SEQ ID NO: 355742 - RNA, 22 nt, Homo sapiens
uggaagugucugugcccagcuc

SEQ ID NO: 355743 - RNA, 22 nt, Homo sapiens
uggaauacaugucgcugagcug

SEQ ID NO: 355744 - RNA, 22 nt, Homo sapiens
uggaauacuauucugugcugga

SEQ ID NO: 355745 - RNA, 20 nt, Homo sapiens
uggaaucuaggcggagguuu

SEQ ID NO: 355746 - RNA, 22 nt, Homo sapiens
uggaaugucuuuuccccaaagc

SEQ ID NO: 355747 - RNA, 22 nt, Homo sapiens
uggacaagugcccuccaccuca

SEQ ID NO: 355748 - RNA, 21 nt, Homo sapiens
uggaccccuuccagucaucau

SEQ ID NO: 355749 - RNA, 19 nt, Homo sapiens
uggaccccuuccuuacacc

SEQ ID NO: 355750 - RNA, 22 nt, Homo sapiens
uggagagugagggccuccuuaa

SEQ ID NO: 355751 - RNA, 16 nt, Homo sapiens
uggagucauccuugac

SEQ ID NO: 355752 - RNA, 22 nt, Homo sapiens
uggagugcgagggugaaacuuu

SEQ ID NO: 355753 - RNA, 22 nt, Homo sapiens
uggagugcgugucugaguuuuu

SEQ ID NO: 355754 - RNA, 22 nt, Homo sapiens
uggaugacauccuuguaugcag

SEQ ID NO: 355755 - RNA, 19 nt, Homo sapiens
uggcacauguauacuuaug

SEQ ID NO: 355756 - RNA, 22 nt, Homo sapiens
uggcaccauccaggugucucua

SEQ ID NO: 355757 - RNA, 22 nt, Homo sapiens
uggcagcgugaauguggcugaa

SEQ ID NO: 355758 - RNA, 22 nt, Homo sapiens
uggcagcugcuucaugggaugc

SEQ ID NO: 355759 - RNA, 22 nt, Homo sapiens
uggcaggugcacuggcuuugaa

SEQ ID NO: 355760 - RNA, 22 nt, Homo sapiens
uggccuguaacccucucauagg

SEQ ID NO: 355761 - RNA, 21 nt, Homo sapiens
uggcuguuuucaugcuagaac

SEQ ID NO: 355762 - RNA, 22 nt, Homo sapiens
ugggaacaugaagguuaaagag

SEQ ID NO: 355763 - RNA, 20 nt, Homo sapiens
ugggaacaugugguauaugg

SEQ ID NO: 355764 - RNA, 22 nt, Homo sapiens
ugggaccccuacucuuuccaca

SEQ ID NO: 355765 - RNA, 22 nt, Homo sapiens
ugggagcauugcauuagaagcc

SEQ ID NO: 355766 - RNA, 22 nt, Homo sapiens
ugggaucaugagcaccgcuucc

SEQ ID NO: 355767 - RNA, 22 nt, Homo sapiens
ugggguaggcuguauacucugu

SEQ ID NO: 355768 - RNA, 22 nt, Homo sapiens
uggguagauaucauaguugccc

SEQ ID NO: 355769 - RNA, 23 nt, Homo sapiens
ugggucaguuuuucugacaucau

SEQ ID NO: 355770 - RNA, 22 nt, Homo sapiens
ugguaucuaagaugcacguugu

SEQ ID NO: 355771 - RNA, 22 nt, Homo sapiens
uguaacaguaguuacuauucuu

SEQ ID NO: 355772 - RNA, 22 nt, Homo sapiens
uguaauguuucaucauuauuaa

SEQ ID NO: 355773 - RNA, 22 nt, Homo sapiens
uguacaugggacaggaggagag

SEQ ID NO: 355774 - RNA, 22 nt, Homo sapiens
uguagacaccaaagacagcaua

SEQ ID NO: 355775 - RNA, 22 nt, Homo sapiens
uguagcuuuugagauuuauauu

SEQ ID NO: 355776 - RNA, 22 nt, Homo sapiens
uguagucauuuggaguccagcu

SEQ ID NO: 355777 - RNA, 21 nt, Homo sapiens
ugucaagaugacugcugcggc

SEQ ID NO: 355778 - RNA, 22 nt, Homo sapiens
ugucaaggaaugucauugguuu

SEQ ID NO: 355779 - RNA, 22 nt, Homo sapiens
ugucacauccaagaaggugcag

SEQ ID NO: 355780 - RNA, 20 nt, Homo sapiens
ugucauuaagcacugugcca

SEQ ID NO: 355781 - RNA, 22 nt, Homo sapiens
uguccaaauugaaucaucuggu

SEQ ID NO: 355782 - RNA, 22 nt, Homo sapiens
ugucucaguuacggcaauucca

SEQ ID NO: 355783 - RNA, 22 nt, Homo sapiens
ugucucccuucccauuaggaag

SEQ ID NO: 355784 - RNA, 22 nt, Homo sapiens
ugucugagacuguuuuacuuuc

SEQ ID NO: 355785 - RNA, 22 nt, Homo sapiens
ugugacagcacagcaucucuuu

SEQ ID NO: 355786 - RNA, 22 nt, Homo sapiens
ugugacagcacgguucaacugc

SEQ ID NO: 355787 - RNA, 22 nt, Homo sapiens
ugugcaaucuuccauuuuuagg

SEQ ID NO: 355788 - RNA, 22 nt, Homo sapiens
ugugcacaacgugcagguuugu

SEQ ID NO: 355789 - RNA, 22 nt, Homo sapiens
ugugcacaauguacagguuagu

SEQ ID NO: 355790 - RNA, 22 nt, Homo sapiens
ugugcacauaacauuuuuuuag

SEQ ID NO: 355791 - RNA, 22 nt, Homo sapiens
ugugccacugcacuccugccug

SEQ ID NO: 355792 - RNA, 22 nt, Homo sapiens
uguggccccuagcuacuagaga

SEQ ID NO: 355793 - RNA, 22 nt, Homo sapiens
ugugggugguaaaauacaauga

SEQ ID NO: 355794 - RNA, 22 nt, Homo sapiens
uguuagguuggugcaaaaguga

SEQ ID NO: 355795 - RNA, 22 nt, Homo sapiens
uguugcacuccagccugggcaa

SEQ ID NO: 355796 - RNA, 22 nt, Homo sapiens
uguugcacuccauccugggcga

SEQ ID NO: 355797 - RNA, 22 nt, Homo sapiens
uguuuuggagguccucacuaga

SEQ ID NO: 355798 - RNA, 22 nt, Homo sapiens
uuaaaguaauugaaauggccuu

SEQ ID NO: 355799 - RNA, 22 nt, Homo sapiens
uuaaaugcuagaauuuucuuug

SEQ ID NO: 355800 - RNA, 18 nt, Homo sapiens
uuaaggcaggacuuuaag

SEQ ID NO: 355801 - RNA, 22 nt, Homo sapiens
uuaaggcuuucccuauguaaaa

SEQ ID NO: 355802 - RNA, 22 nt, Homo sapiens
uuaaggugaaguucucagaugc

SEQ ID NO: 355803 - RNA, 22 nt, Homo sapiens
uuaauccugccuuauuucagua

SEQ ID NO: 355804 - RNA, 22 nt, Homo sapiens
uuaaugcuuuugggauauuucu

SEQ ID NO: 355805 - RNA, 22 nt, Homo sapiens
uuaauuguccaaguucaucucu

SEQ ID NO: 355806 - RNA, 22 nt, Homo sapiens
uuacaggacuaagcagcuuugc

SEQ ID NO: 355807 - RNA, 22 nt, Homo sapiens
uuacaugucuugguaagguuag

SEQ ID NO: 355808 - RNA, 22 nt, Homo sapiens
uuagaacagugcucaccacaaa

SEQ ID NO: 355809 - RNA, 22 nt, Homo sapiens
uuagagcacugaucugcucuuu

SEQ ID NO: 355810 - RNA, 22 nt, Homo sapiens
uuagcacuugggaguauuuauu

SEQ ID NO: 355811 - RNA, 22 nt, Homo sapiens
uuaggaucacagaaaauccucu

SEQ ID NO: 355812 - RNA, 18 nt, Homo sapiens
uuauacuccccaggcaau

SEQ ID NO: 355813 - RNA, 18 nt, Homo sapiens
uuauaugcauguguagga

SEQ ID NO: 355814 - RNA, 22 nt, Homo sapiens
uccuuuggguagcuguucagau

SEQ ID NO: 355815 - RNA, 22 nt, Homo sapiens
uccuuuggucaguauucuuuug

SEQ ID NO: 355816 - RNA, 22 nt, Homo sapiens
ucgcaccauugcacuccagcca

SEQ ID NO: 355817 - RNA, 22 nt, Homo sapiens
ucgugcaaacguaauugugguu

SEQ ID NO: 355818 - RNA, 22 nt, Homo sapiens
ucuaaaguacuacuacuguugg

SEQ ID NO: 355819 - RNA, 19 nt, Homo sapiens
ucucacagcucuacuaugu

SEQ ID NO: 355820 - RNA, 22 nt, Homo sapiens
ucucaugaagauagagaauaga

SEQ ID NO: 355821 - RNA, 22 nt, Homo sapiens
ucucugaaacucuugacauccu

SEQ ID NO: 355822 - RNA, 22 nt, Homo sapiens
ucucuuggcggaaguugcagug

SEQ ID NO: 355823 - RNA, 22 nt, Homo sapiens
ucugcaagucuaaacuagccau

SEQ ID NO: 355824 - RNA, 22 nt, Homo sapiens
ucugccaaccacaaaauuuauu

SEQ ID NO: 355825 - RNA, 22 nt, Homo sapiens
ucuggguuuuuccauugccggu

SEQ ID NO: 355826 - RNA, 22 nt, Homo sapiens
ucugucuugugguuugagugcc

SEQ ID NO: 355827 - RNA, 22 nt, Homo sapiens
ucugucuuugccuaaguuuguc

SEQ ID NO: 355828 - RNA, 22 nt, Homo sapiens
ucugucuuugucaggaccagag

SEQ ID NO: 355829 - RNA, 22 nt, Homo sapiens
ucugugcauuguaacaacuaaa

SEQ ID NO: 355830 - RNA, 22 nt, Homo sapiens
ucuguguuuagacccaggguag

SEQ ID NO: 355831 - RNA, 22 nt, Homo sapiens
ucuugcaauuuccuuaguggug

SEQ ID NO: 355832 - RNA, 22 nt, Homo sapiens
ucuuggguuguuggcuucuccu

SEQ ID NO: 355833 - RNA, 22 nt, Homo sapiens
ucuuggguuuguccuucuccua

SEQ ID NO: 355834 - RNA, 22 nt, Homo sapiens
ucuugguuuauugauggagagg

SEQ ID NO: 355835 - RNA, 19 nt, Homo sapiens
ucuuuagucacauuuuuau

SEQ ID NO: 355836 - RNA, 22 nt, Homo sapiens
ucuuuggguguauuucacagcc

SEQ ID NO: 355837 - RNA, 22 nt, Homo sapiens
ucuuuggucuacuuucauaugu

SEQ ID NO: 355838 - RNA, 22 nt, Homo sapiens
ucuuuggugaauggucauccag

SEQ ID NO: 355839 - RNA, 22 nt, Homo sapiens
ucuuuguuagaacccucuccuu

SEQ ID NO: 355840 - RNA, 20 nt, Homo sapiens
ucuuuuuguggccccagagu

SEQ ID NO: 355841 - RNA, 22 nt, Homo sapiens
ugaaacacaccuccucuccauc

SEQ ID NO: 355842 - RNA, 22 nt, Homo sapiens
ugaaaguuauauugugaaauuc

SEQ ID NO: 355843 - RNA, 22 nt, Homo sapiens
ugaaaugcuaauucguagcuaa

SEQ ID NO: 355844 - RNA, 22 nt, Homo sapiens
ugaaauggaaagaguguagacu

SEQ ID NO: 355845 - RNA, 22 nt, Homo sapiens
ugaaauguuaaacaaguggcuc

SEQ ID NO: 355846 - RNA, 22 nt, Homo sapiens
ugaagcuuguuucuguaccuuu

SEQ ID NO: 355847 - RNA, 22 nt, Homo sapiens
ugaaguaauguuuuauucuauu

SEQ ID NO: 355848 - RNA, 21 nt, Homo sapiens
ugaaguguaaccgugcagggc

SEQ ID NO: 355849 - RNA, 22 nt, Homo sapiens
ugaauauuugcuacucacucuu

SEQ ID NO: 355850 - RNA, 22 nt, Homo sapiens
ugaauguacuuaacacuggauu

SEQ ID NO: 355851 - RNA, 22 nt, Homo sapiens
ugaauuguuucauucuuuacau

SEQ ID NO: 355852 - RNA, 23 nt, Homo sapiens
ugacaaccucaugcuuugucaug

SEQ ID NO: 355853 - RNA, 22 nt, Homo sapiens
ugacaagauauggucuuaucaa

SEQ ID NO: 355854 - RNA, 22 nt, Homo sapiens
ugacagcugaagauguugaacc

SEQ ID NO: 355855 - RNA, 22 nt, Homo sapiens
ugacauggugcucuuucaggca

SEQ ID NO: 355856 - RNA, 22 nt, Homo sapiens
ugacugaguaguauuccacuau

SEQ ID NO: 355857 - RNA, 22 nt, Homo sapiens
ugacuucauuuuuggccaugag

SEQ ID NO: 355858 - RNA, 22 nt, Homo sapiens
ugagaacauuccucuuccuggc

SEQ ID NO: 355859 - RNA, 22 nt, Homo sapiens
ugagaacugguagcacuuguga

SEQ ID NO: 355860 - RNA, 22 nt, Homo sapiens
ugagaacuguuuugguuugggu

SEQ ID NO: 355861 - RNA, 22 nt, Homo sapiens
ugagaagacaucagcuuucgga

SEQ ID NO: 355862 - RNA, 22 nt, Homo sapiens
ugagaagugauauagaaguuaa

SEQ ID NO: 355863 - RNA, 22 nt, Homo sapiens
ugagacacuucccagaucccuu

SEQ ID NO: 355864 - RNA, 22 nt, Homo sapiens
ugagaccugaucuugguacugc

SEQ ID NO: 355865 - RNA, 22 nt, Homo sapiens
ugagagaugauaaaauguuugu

SEQ ID NO: 355866 - RNA, 21 nt, Homo sapiens
ugagaguaguguauuauucuc

SEQ ID NO: 355867 - RNA, 22 nt, Homo sapiens
ugagauaacuaaaaacauuuug

SEQ ID NO: 355868 - RNA, 22 nt, Homo sapiens
ugagaucagaaggauuucucug

SEQ ID NO: 355869 - RNA, 22 nt, Homo sapiens
ugagaucagugaagaaguguuu

SEQ ID NO: 355870 - RNA, 22 nt, Homo sapiens
ugagaucaugucauuugcacuc

SEQ ID NO: 355871 - RNA, 22 nt, Homo sapiens
ugagaugaacuugauuguuuua

SEQ ID NO: 355872 - RNA, 22 nt, Homo sapiens
ugagaugaucaaaguauaggcu

SEQ ID NO: 355873 - RNA, 21 nt, Homo sapiens
ugagaugauccugcaugcaug

SEQ ID NO: 355874 - RNA, 22 nt, Homo sapiens
ugagauggguaauuaaauggug

SEQ ID NO: 355875 - RNA, 22 nt, Homo sapiens
ugagauguaaucucgcucuguc

SEQ ID NO: 355876 - RNA, 21 nt, Homo sapiens
ugagaugugaccagggcauca

SEQ ID NO: 355877 - RNA, 22 nt, Homo sapiens
ugagauuaucguaauguaucuc

SEQ ID NO: 355878 - RNA, 22 nt, Homo sapiens
ugagcacagcgugugggagagc

SEQ ID NO: 355879 - RNA, 22 nt, Homo sapiens
ugaggacugagaggcacugugg

SEQ ID NO: 355880 - RNA, 22 nt, Homo sapiens
ugaggauaguguugaaggcagg

SEQ ID NO: 355881 - RNA, 22 nt, Homo sapiens
ugaggcaagauacugauuucau

SEQ ID NO: 355882 - RNA, 22 nt, Homo sapiens
ugaggcuaggauaggcugauuc

SEQ ID NO: 355883 - RNA, 22 nt, Homo sapiens
ugaggugagauggcuaccccaa

SEQ ID NO: 355884 - RNA, 22 nt, Homo sapiens
ugagugaggcugggcagucccu

SEQ ID NO: 355885 - RNA, 22 nt, Homo sapiens
ugagugugacuuagcagaagga

SEQ ID NO: 355886 - RNA, 22 nt, Homo sapiens
ugauaugucacuugaucauggu

SEQ ID NO: 355887 - RNA, 22 nt, Homo sapiens
ugauauguggcuauugagauug

SEQ ID NO: 355888 - RNA, 22 nt, Homo sapiens
ugaugucuugcaggcacgagau

SEQ ID NO: 355889 - RNA, 22 nt, Homo sapiens
ugcaaagaaauuuuggugacca

SEQ ID NO: 355890 - RNA, 22 nt, Homo sapiens
ugcaaauguuaggugucauuau

SEQ ID NO: 355891 - RNA, 22 nt, Homo sapiens
ugcaaauguuaguaacaccacu

SEQ ID NO: 355892 - RNA, 22 nt, Homo sapiens
ugcaaauguuauuuugguuucu

SEQ ID NO: 355893 - RNA, 22 nt, Homo sapiens
ugcaaccauuguuaagugugca

SEQ ID NO: 355894 - RNA, 23 nt, Homo sapiens
ugcaccacuacacacucuugggu

SEQ ID NO: 355895 - RNA, 22 nt, Homo sapiens
ugcaccaucuugcuucuguggu

SEQ ID NO: 355896 - RNA, 20 nt, Homo sapiens
ugcagcacugggaaugcagu

SEQ ID NO: 355897 - RNA, 22 nt, Homo sapiens
ugcagcacuguucacaauagcc

SEQ ID NO: 355898 - RNA, 23 nt, Homo sapiens
ugcaguagugagaucuaggcuca

SEQ ID NO: 355899 - RNA, 20 nt, Homo sapiens
ugcaguguccucacuuguca

SEQ ID NO: 355900 - RNA, 22 nt, Homo sapiens
ugcauuguuccgaauguguccu

SEQ ID NO: 355901 - RNA, 22 nt, Homo sapiens
ugcuaucauugauuagugaugu

SEQ ID NO: 355902 - RNA, 18 nt, Homo sapiens
ugcuaugagauuauuuua

SEQ ID NO: 355903 - RNA, 21 nt, Homo sapiens
ugcuauguuguccaggcuggc

SEQ ID NO: 355904 - RNA, 21 nt, Homo sapiens
ugcuccauuuucuagccugaa

SEQ ID NO: 355905 - RNA, 22 nt, Homo sapiens
ugcugaguguuaccggacaccg

SEQ ID NO: 355906 - RNA, 22 nt, Homo sapiens
uggaaaguaguucuaaucuaag

SEQ ID NO: 355907 - RNA, 22 nt, Homo sapiens
uggaacugauauugauggaaaa

SEQ ID NO: 355908 - RNA, 22 nt, Homo sapiens
cuaaaacuuucugagugcagca

SEQ ID NO: 355909 - RNA, 22 nt, Homo sapiens
cuaaaugcacugucaaaggaag

SEQ ID NO: 355910 - RNA, 22 nt, Homo sapiens
cuaagcaccuuaguggggaauc

SEQ ID NO: 355911 - RNA, 17 nt, Homo sapiens
cuaaggcaagagucugc

SEQ ID NO: 355912 - RNA, 22 nt, Homo sapiens
cuaaggcaguagccugaauaau

SEQ ID NO: 355913 - RNA, 22 nt, Homo sapiens
cuaauccugugguagcacucaa

SEQ ID NO: 355914 - RNA, 22 nt, Homo sapiens
cuagagagaagcugugugaccu

SEQ ID NO: 355915 - RNA, 21 nt, Homo sapiens
cuaucucaguguuuacauuug

SEQ ID NO: 355916 - RNA, 22 nt, Homo sapiens
cuauucacaauggugaagauau

SEQ ID NO: 355917 - RNA, 22 nt, Homo sapiens
cucaaagugcugggauuggcca

SEQ ID NO: 355918 - RNA, 18 nt, Homo sapiens
cucacacccuaaucagga

SEQ ID NO: 355919 - RNA, 22 nt, Homo sapiens
cucaguggauuagauaaugcac

SEQ ID NO: 355920 - RNA, 21 nt, Homo sapiens
cucauauugcuuuuccauggu

SEQ ID NO: 355921 - RNA, 22 nt, Homo sapiens
cuccauagucuucgaagaauga

SEQ ID NO: 355922 - RNA, 20 nt, Homo sapiens
cucccugacaaauguggaaa

SEQ ID NO: 355923 - RNA, 22 nt, Homo sapiens
cucucugagccccagacaccuu

SEQ ID NO: 355924 - RNA, 22 nt, Homo sapiens
cucugacagugguuagcacugu

SEQ ID NO: 355925 - RNA, 22 nt, Homo sapiens
cucuuuuguuuagcugagaggg

SEQ ID NO: 355926 - RNA, 22 nt, Homo sapiens
cugaaagagcauuugaaugggu

SEQ ID NO: 355927 - RNA, 22 nt, Homo sapiens
cugacuuuagaacccaaaaagu

SEQ ID NO: 355928 - RNA, 22 nt, Homo sapiens
cugagaagaaacagguaaggac

SEQ ID NO: 355929 - RNA, 22 nt, Homo sapiens
cugagcaauauagugagaucuu

SEQ ID NO: 355930 - RNA, 22 nt, Homo sapiens
cugagguuaggaguuugagacc

SEQ ID NO: 355931 - RNA, 22 nt, Homo sapiens
cugagugcaagugauccuccca

SEQ ID NO: 355932 - RNA, 22 nt, Homo sapiens
cugauaguucucuuuagaguuu

SEQ ID NO: 355933 - RNA, 22 nt, Homo sapiens
cugaucuggaggugucugggga

SEQ ID NO: 355934 - RNA, 22 nt, Homo sapiens
cugcaauguuugaaauggcaaa

SEQ ID NO: 355935 - RNA, 22 nt, Homo sapiens
cugcagaucuuggggcuugcca

SEQ ID NO: 355936 - RNA, 19 nt, Homo sapiens
cugcaugagacaguugguu

SEQ ID NO: 355937 - RNA, 20 nt, Homo sapiens
cugcuccccuacaaaucuca

SEQ ID NO: 355938 - RNA, 22 nt, Homo sapiens
cuggaaggaaaaacaaccacag

SEQ ID NO: 355939 - RNA, 22 nt, Homo sapiens
cuggaaugugagccccaaaaag

SEQ ID NO: 355940 - RNA, 22 nt, Homo sapiens
cuggcaguguuucuugugggcu

SEQ ID NO: 355941 - RNA, 22 nt, Homo sapiens
cuggcucuguuagaagaaccag

SEQ ID NO: 355942 - RNA, 22 nt, Homo sapiens
uagcacaucuucuuggccugca

SEQ ID NO: 355943 - RNA, 22 nt, Homo sapiens
uagcagcagugguguauuuaga

SEQ ID NO: 355944 - RNA, 22 nt, Homo sapiens
uagcagcaucucuggcuucuac

SEQ ID NO: 355945 - RNA, 22 nt, Homo sapiens
uagcagcuuuauugagguaaau

SEQ ID NO: 355946 - RNA, 20 nt, Homo sapiens
uagcaggugucaggugauau

SEQ ID NO: 355947 - RNA, 22 nt, Homo sapiens
uagcaguuguuguuacuuguau

SEQ ID NO: 355948 - RNA, 22 nt, Homo sapiens
uagcuaaauucagcucuaggua

SEQ ID NO: 355949 - RNA, 22 nt, Homo sapiens
uagcucagcccagcuaagcuca

SEQ ID NO: 355950 - RNA, 22 nt, Homo sapiens
uagcuucuccauagcuccaugu

SEQ ID NO: 355951 - RNA, 23 nt, Homo sapiens
uagcuucucccagaccugcuccc

SEQ ID NO: 355952 - RNA, 22 nt, Homo sapiens
uaggcaguguucucacuuguaa

SEQ ID NO: 355953 - RNA, 22 nt, Homo sapiens
uaggcaguuuuccuuucacagu

SEQ ID NO: 355954 - RNA, 22 nt, Homo sapiens
uagguugucuucccagaguuuu

SEQ ID NO: 355955 - RNA, 18 nt, Homo sapiens
uaguacuguucucaugau

SEQ ID NO: 355956 - RNA, 22 nt, Homo sapiens
uaguaggacaggauuucaguua

SEQ ID NO: 355957 - RNA, 22 nt, Homo sapiens
uaguaucacauggucuuaauua

SEQ ID NO: 355958 - RNA, 22 nt, Homo sapiens
uagucacacacucaacuuuuca

SEQ ID NO: 355959 - RNA, 22 nt, Homo sapiens
uagugcugagauugagaagccc

SEQ ID NO: 355960 - RNA, 22 nt, Homo sapiens
uauauguucugugucccuuucg

SEQ ID NO: 355961 - RNA, 22 nt, Homo sapiens
uaucaacaggguggccagugua

SEQ ID NO: 355962 - RNA, 19 nt, Homo sapiens
uaucaaguaugcacuguac

SEQ ID NO: 355963 - RNA, 22 nt, Homo sapiens
uaucacacgccuugcuucauuu

SEQ ID NO: 355964 - RNA, 22 nt, Homo sapiens
uaucaccauguccguuuuaaaa

SEQ ID NO: 355965 - RNA, 22 nt, Homo sapiens
uaucaucauuggcaggugagaa

SEQ ID NO: 355966 - RNA, 21 nt, Homo sapiens
uaucauggccauccucuucuc

SEQ ID NO: 355967 - RNA, 22 nt, Homo sapiens
uaucaugggggguguacacucc

SEQ ID NO: 355968 - RNA, 22 nt, Homo sapiens
uaucucagagaaucagauuuac

SEQ ID NO: 355969 - RNA, 22 nt, Homo sapiens
uaucugcaucccauuuuuauca

SEQ ID NO: 355970 - RNA, 22 nt, Homo sapiens
uaugauuuuugggagaggucaa

SEQ ID NO: 355971 - RNA, 22 nt, Homo sapiens
uaugcaugucucuguacacgug

SEQ ID NO: 355972 - RNA, 22 nt, Homo sapiens
uaugcuuauugucucauccacu

SEQ ID NO: 355973 - RNA, 22 nt, Homo sapiens
uaugucacuggacauaaguucu

SEQ ID NO: 355974 - RNA, 22 nt, Homo sapiens
uauguuaucaaaaagcuaagga

SEQ ID NO: 355975 - RNA, 22 nt, Homo sapiens
uauuacuugucugugucucaau

SEQ ID NO: 355976 - RNA, 22 nt, Homo sapiens
uauuccuuuugcauuuccacau

SEQ ID NO: 355977 - RNA, 22 nt, Homo sapiens
uauugauuaauugugauuaggc

SEQ ID NO: 355978 - RNA, 22 nt, Homo sapiens
uauugcagaaugugaguuggca

SEQ ID NO: 355979 - RNA, 22 nt, Homo sapiens
uauuucaguugugcagguaguu

SEQ ID NO: 355980 - RNA, 22 nt, Homo sapiens
ucaaauguuuguuuaaggcuua

SEQ ID NO: 355981 - RNA, 22 nt, Homo sapiens
ucaacauugcugucaggcaucu

SEQ ID NO: 355982 - RNA, 19 nt, Homo sapiens
ucaagcuauucuccugccu

SEQ ID NO: 355983 - RNA, 22 nt, Homo sapiens
ucaaugcaugugacaaagagua

SEQ ID NO: 355984 - RNA, 22 nt, Homo sapiens
ucacaaagcuuggccugcuucu

SEQ ID NO: 355985 - RNA, 18 nt, Homo sapiens
ucacaaccacagugcugu

SEQ ID NO: 355986 - RNA, 21 nt, Homo sapiens
ucacaaugaacagcagcagaa

SEQ ID NO: 355987 - RNA, 22 nt, Homo sapiens
ucacacugaauuugaagcaaug

SEQ ID NO: 355988 - RNA, 22 nt, Homo sapiens
ucacacugcaucuguuggaauu

SEQ ID NO: 355989 - RNA, 22 nt, Homo sapiens
ucacagaggagaagaccuuuaa

SEQ ID NO: 355990 - RNA, 19 nt, Homo sapiens
ucacaggguugacuugagg

SEQ ID NO: 355991 - RNA, 22 nt, Homo sapiens
ucacaguagccccucccaucau

SEQ ID NO: 355992 - RNA, 20 nt, Homo sapiens
ucacagucacacauaauccu

SEQ ID NO: 355993 - RNA, 22 nt, Homo sapiens
ucacagucacugucacguugaa

SEQ ID NO: 355994 - RNA, 22 nt, Homo sapiens
ucacagugcaggaucaguuaau

SEQ ID NO: 355995 - RNA, 22 nt, Homo sapiens
ucacaugaagauuuuaguauac

SEQ ID NO: 355996 - RNA, 22 nt, Homo sapiens
ucaccaccugcugauuguagag

SEQ ID NO: 355997 - RNA, 22 nt, Homo sapiens
ucaccaccuuccaggaccacug

SEQ ID NO: 355998 - RNA, 22 nt, Homo sapiens
ucaccggagguggguugaccag

SEQ ID NO: 355999 - RNA, 22 nt, Homo sapiens
ucacgguggaaucccagauccc

SEQ ID NO: 356000 - RNA, 22 nt, Homo sapiens
ucacuagggagaaacugaggcu

SEQ ID NO: 356001 - RNA, 22 nt, Homo sapiens
ucacugagcacaggagaugugc

SEQ ID NO: 356002 - RNA, 22 nt, Homo sapiens
ucacuuuggguacuauggaaau

SEQ ID NO: 356003 - RNA, 22 nt, Homo sapiens
ucacuuuguauagcgacuggcu

SEQ ID NO: 356004 - RNA, 22 nt, Homo sapiens
ucacuuuguuuuuggauaaguu

SEQ ID NO: 356005 - RNA, 22 nt, Homo sapiens
ucagaugaugucccuguucuaa

SEQ ID NO: 356006 - RNA, 22 nt, Homo sapiens
ucagaugauuccguugacgaga

SEQ ID NO: 356007 - RNA, 22 nt, Homo sapiens
ucagcagugugaaaacaaacua

SEQ ID NO: 356008 - RNA, 21 nt, Homo sapiens
ucaggaccucuaguuagccag

SEQ ID NO: 356009 - RNA, 22 nt, Homo sapiens
ucagguccuuacugugcucccu

SEQ ID NO: 356010 - RNA, 19 nt, Homo sapiens
ucaguagugcacauaagcc

SEQ ID NO: 356011 - RNA, 22 nt, Homo sapiens
ucagucauguuuaccagacgua

SEQ ID NO: 356012 - RNA, 22 nt, Homo sapiens
ucagucauucaauuguugaaug

SEQ ID NO: 356013 - RNA, 22 nt, Homo sapiens
ucagucuuuuaccauuaaguau

SEQ ID NO: 356014 - RNA, 22 nt, Homo sapiens
ucaguuaaugcugccugcugga

SEQ ID NO: 356015 - RNA, 22 nt, Homo sapiens
ucauaguacuuuguuuugaaaa

SEQ ID NO: 356016 - RNA, 22 nt, Homo sapiens
ucauaucauuagaucuacugua

SEQ ID NO: 356017 - RNA, 23 nt, Homo sapiens
ucaucacagcauuuccugguauu

SEQ ID NO: 356018 - RNA, 22 nt, Homo sapiens
ucaucagguaugucagcggagu

SEQ ID NO: 356019 - RNA, 22 nt, Homo sapiens
ucauucauucauccagcuugag

SEQ ID NO: 356020 - RNA, 22 nt, Homo sapiens
ucauucauuugcucacuccaca

SEQ ID NO: 356021 - RNA, 22 nt, Homo sapiens
ucauugcacucccagacacccu

SEQ ID NO: 356022 - RNA, 22 nt, Homo sapiens
ucauugcacuucuuuaguugca

SEQ ID NO: 356023 - RNA, 22 nt, Homo sapiens
uccacagugguggaauuguuca

SEQ ID NO: 356024 - RNA, 22 nt, Homo sapiens
uccacagugguugaacuaguuu

SEQ ID NO: 356025 - RNA, 22 nt, Homo sapiens
uccaguguuccucagucacccc

SEQ ID NO: 356026 - RNA, 19 nt, Homo sapiens
uccaugagcccacagugau

SEQ ID NO: 356027 - RNA, 22 nt, Homo sapiens
uccccgaggcuggagugcagug

SEQ ID NO: 356028 - RNA, 22 nt, Homo sapiens
ucccuacugggguacugccuag

SEQ ID NO: 356029 - RNA, 22 nt, Homo sapiens
ucccugacagucacagagcuac

SEQ ID NO: 356030 - RNA, 18 nt, Homo sapiens
ucccugacucaaauucuu

SEQ ID NO: 356031 - RNA, 22 nt, Homo sapiens
ucccuggacagccuugccuggg

SEQ ID NO: 356032 - RNA, 19 nt, Homo sapiens
ucccuguagaccacagugc

SEQ ID NO: 356033 - RNA, 22 nt, Homo sapiens
uccugagacucacaggcucccc

SEQ ID NO: 356034 - RNA, 19 nt, Homo sapiens
ucgcgccauucuccugccu

SEQ ID NO: 356035 - RNA, 22 nt, Homo sapiens
ucgugccacugcacuccagccu

SEQ ID NO: 356036 - RNA, 22 nt, Homo sapiens
ucgugcugugucaucuuguggc

SEQ ID NO: 356037 - RNA, 22 nt, Homo sapiens
ucguucuugucaguuuauaaag

SEQ ID NO: 356038 - RNA, 22 nt, Homo sapiens
ucuaaggcaccuagagucauca

SEQ ID NO: 356039 - RNA, 22 nt, Homo sapiens
ucucacagaguugaacuuucuu

SEQ ID NO: 356040 - RNA, 21 nt, Homo sapiens
uggaccccuuucuuacaccgu

SEQ ID NO: 356041 - RNA, 22 nt, Homo sapiens
uggagcccuaguuccucauaac

SEQ ID NO: 356042 - RNA, 22 nt, Homo sapiens
uggaguauuauguaauuucaau

SEQ ID NO: 356043 - RNA, 22 nt, Homo sapiens
uggagugauaugguuauauggg

SEQ ID NO: 356044 - RNA, 20 nt, Homo sapiens
uggaguuugaguucuuggag

SEQ ID NO: 356045 - RNA, 22 nt, Homo sapiens
uggcaugggguaguagcgcugg

SEQ ID NO: 356046 - RNA, 22 nt, Homo sapiens
ugggcaaaacuaagagcugugg

SEQ ID NO: 356047 - RNA, 23 nt, Homo sapiens
uggguucccuaagcgcaugcugc

SEQ ID NO: 356048 - RNA, 22 nt, Homo sapiens
uggucagaaaauuacuugauau

SEQ ID NO: 356049 - RNA, 22 nt, Homo sapiens
uggucuccuuuguacccugggc

SEQ ID NO: 356050 - RNA, 22 nt, Homo sapiens
ugucaagaugguuugauguugu

SEQ ID NO: 356051 - RNA, 22 nt, Homo sapiens
ugucaauauguaauaacugaau

SEQ ID NO: 356052 - RNA, 22 nt, Homo sapiens
ugucacugugaguuugacugcu

SEQ ID NO: 356053 - RNA, 22 nt, Homo sapiens
uguccugaagcuuuguuaugua

SEQ ID NO: 356054 - RNA, 22 nt, Homo sapiens
ugucuuagagauaaagaaugaa

SEQ ID NO: 356055 - RNA, 22 nt, Homo sapiens
ugugaaaucagauagccuuuuu

SEQ ID NO: 356056 - RNA, 22 nt, Homo sapiens
ugugaacugagcauuaacuaca

SEQ ID NO: 356057 - RNA, 20 nt, Homo sapiens
ugugagacugguuuugaacu

SEQ ID NO: 356058 - RNA, 22 nt, Homo sapiens
ugugaguguguacuaguuauca

SEQ ID NO: 356059 - RNA, 22 nt, Homo sapiens
ugugaucaugugugccuuaguc

SEQ ID NO: 356060 - RNA, 20 nt, Homo sapiens
ugugauuauuuaguugcaug

SEQ ID NO: 356061 - RNA, 22 nt, Homo sapiens
ugugcacaaugugcagguuuga

SEQ ID NO: 356062 - RNA, 22 nt, Homo sapiens
ugugcacauugugcagguugau

SEQ ID NO: 356063 - RNA, 22 nt, Homo sapiens
ugugcaugacagcauacaaacg

SEQ ID NO: 356064 - RNA, 22 nt, Homo sapiens
ugugcguguaagagaucuaggu

SEQ ID NO: 356065 - RNA, 22 nt, Homo sapiens
uguggcaaagucuugugaauau

SEQ ID NO: 356066 - RNA, 22 nt, Homo sapiens
uguguaauaccuuugacuauau

SEQ ID NO: 356067 - RNA, 22 nt, Homo sapiens
ugugucacugcacuccagccug

SEQ ID NO: 356068 - RNA, 22 nt, Homo sapiens
uguguuugauaaguccauaguu

SEQ ID NO: 356069 - RNA, 22 nt, Homo sapiens
uguuuaguuaagacauagaauu

SEQ ID NO: 356070 - RNA, 22 nt, Homo sapiens
uuaaaggcaugguuagacaugg

SEQ ID NO: 356071 - RNA, 22 nt, Homo sapiens
uuaacacugccauugauacugu

SEQ ID NO: 356072 - RNA, 22 nt, Homo sapiens
uuaagcaaagguaacaugagaa

SEQ ID NO: 356073 - RNA, 22 nt, Homo sapiens
uuaaggcagugucuaugccagu

SEQ ID NO: 356074 - RNA, 22 nt, Homo sapiens
uuaaggcauucuuugucuucau

SEQ ID NO: 356075 - RNA, 22 nt, Homo sapiens
uuaagggaggagcuucaagaug

SEQ ID NO: 356076 - RNA, 22 nt, Homo sapiens
uuaauaccgucacauggcugaa

SEQ ID NO: 356077 - RNA, 22 nt, Homo sapiens
uuaauuguccauuauucuguuc

SEQ ID NO: 356078 - RNA, 22 nt, Homo sapiens
uuacacaguaggucccuaguaa

SEQ ID NO: 356079 - RNA, 22 nt, Homo sapiens
uuagaacaguguuugccucgcu

SEQ ID NO: 356080 - RNA, 22 nt, Homo sapiens
uuagauguuugacugggccuua

SEQ ID NO: 356081 - RNA, 22 nt, Homo sapiens
uuaucagcagcaugaaacugga

SEQ ID NO: 356082 - RNA, 22 nt, Homo sapiens
uuaucucaguguuuguaaacaa

SEQ ID NO: 356083 - RNA, 22 nt, Homo sapiens
uuaugcagcaaagugcuugaaa

SEQ ID NO: 356084 - RNA, 22 nt, Homo sapiens
uucaagucaaggaaagaggucu

SEQ ID NO: 356085 - RNA, 22 nt, Homo sapiens
uucacagacaacuggucccuua

SEQ ID NO: 356086 - RNA, 22 nt, Homo sapiens
gaaggcacugugugccacccug

SEQ ID NO: 356087 - RNA, 22 nt, Homo sapiens
gaaugcaugaggggaucagaug

SEQ ID NO: 356088 - RNA, 22 nt, Homo sapiens
gaauuguacugcaaucagggga

SEQ ID NO: 356089 - RNA, 22 nt, Homo sapiens
gacaguguggcgauuccucaag

SEQ ID NO: 356090 - RNA, 20 nt, Homo sapiens
gacauguugguuugcugcac

SEQ ID NO: 356091 - RNA, 22 nt, Homo sapiens
gacucuguagacaaucacaucu

SEQ ID NO: 356092 - RNA, 22 nt, Homo sapiens
gagaaccauuuggagaaaaagu

SEQ ID NO: 356093 - RNA, 22 nt, Homo sapiens
gagaaccuccagcaagguagua

SEQ ID NO: 356094 - RNA, 22 nt, Homo sapiens
gagacauguuugcuuaucugag

SEQ ID NO: 356095 - RNA, 22 nt, Homo sapiens
gagauacacccagugcagaggc

SEQ ID NO: 356096 - RNA, 22 nt, Homo sapiens
gagauguuuuguuaucaaagga

SEQ ID NO: 356097 - RNA, 22 nt, Homo sapiens
gagcaaaaguauguauugguua

SEQ ID NO: 356098 - RNA, 22 nt, Homo sapiens
gaggagucagacugugcaaggu

SEQ ID NO: 356099 - RNA, 22 nt, Homo sapiens
gaggcaaguggccaccgagucu

SEQ ID NO: 356100 - RNA, 22 nt, Homo sapiens
gaggcagucuguccauucucag

SEQ ID NO: 356101 - RNA, 22 nt, Homo sapiens
gaggcagucugucccuuagcag

SEQ ID NO: 356102 - RNA, 22 nt, Homo sapiens
gagucagugucuugcucuguca

SEQ ID NO: 356103 - RNA, 18 nt, Homo sapiens
gaguggugcuucccuugu

SEQ ID NO: 356104 - RNA, 22 nt, Homo sapiens
gaguucaaaucucagcucuguu

SEQ ID NO: 356105 - RNA, 19 nt, Homo sapiens
gaguugggguuuacuguaa

SEQ ID NO: 356106 - RNA, 22 nt, Homo sapiens
gauagugaaccaagggguaauu

SEQ ID NO: 356107 - RNA, 22 nt, Homo sapiens
gaucacauggccauuucuagcu

SEQ ID NO: 356108 - RNA, 22 nt, Homo sapiens
gaucacauguguacucaaugug

SEQ ID NO: 356109 - RNA, 22 nt, Homo sapiens
gaugagaucauaaguguggagc

SEQ ID NO: 356110 - RNA, 22 nt, Homo sapiens
gauggcaucugagaguguuaga

SEQ ID NO: 356111 - RNA, 21 nt, Homo sapiens
gcaaaggaauugccuaagcuu

SEQ ID NO: 356112 - RNA, 22 nt, Homo sapiens
gcaaaucuuauguccucacauu

SEQ ID NO: 356113 - RNA, 22 nt, Homo sapiens
gcaagaguauuucaaggaagau

SEQ ID NO: 356114 - RNA, 22 nt, Homo sapiens
gcacacuuacacgaaccuagau

SEQ ID NO: 356115 - RNA, 22 nt, Homo sapiens
ucaccuugcacaguuguguggg

SEQ ID NO: 356116 - RNA, 22 nt, Homo sapiens
ucacgcugcugcaaccagccug

SEQ ID NO: 356117 - RNA, 22 nt, Homo sapiens
ucacucagaccuggugauaugc

SEQ ID NO: 356118 - RNA, 22 nt, Homo sapiens
ucagagcaaagacacuuuauca

SEQ ID NO: 356119 - RNA, 22 nt, Homo sapiens
ucagauacuggugacaugaaug

SEQ ID NO: 356120 - RNA, 22 nt, Homo sapiens
ucagaugauucuguuguugugu

SEQ ID NO: 356121 - RNA, 20 nt, Homo sapiens
ucagcagucuggagcagagg

SEQ ID NO: 356122 - RNA, 22 nt, Homo sapiens
ucagcagugagagaccucaccc

SEQ ID NO: 356123 - RNA, 23 nt, Homo sapiens
ucaguacucuauaagugccagcu

SEQ ID NO: 356124 - RNA, 22 nt, Homo sapiens
ucaguaguuuuuuuacuaggug

SEQ ID NO: 356125 - RNA, 22 nt, Homo sapiens
ucagugcuuggcacagagagcu

SEQ ID NO: 356126 - RNA, 22 nt, Homo sapiens
ucaguguuuggaaucucaauuu

SEQ ID NO: 356127 - RNA, 22 nt, Homo sapiens
ucauagaucaaguaauaagaca

SEQ ID NO: 356128 - RNA, 22 nt, Homo sapiens
ucauucauucuucaguggguac

SEQ ID NO: 356129 - RNA, 22 nt, Homo sapiens
ucauugcacuccagccugggug

SEQ ID NO: 356130 - RNA, 22 nt, Homo sapiens
ucauugcauguuaauuaaacag

SEQ ID NO: 356131 - RNA, 22 nt, Homo sapiens
ucauugcauuccagcccaagca

SEQ ID NO: 356132 - RNA, 21 nt, Homo sapiens
ucauugguuggcugcccugua

SEQ ID NO: 356133 - RNA, 22 nt, Homo sapiens
uccacagugguugaacuaguaa

SEQ ID NO: 356134 - RNA, 22 nt, Homo sapiens
uccagguacucagggggcugag

SEQ ID NO: 356135 - RNA, 22 nt, Homo sapiens
uccaguguuauaauaugcgucu

SEQ ID NO: 356136 - RNA, 16 nt, Homo sapiens
ucccaccauugcuugu

SEQ ID NO: 356137 - RNA, 22 nt, Homo sapiens
ucccugaacacauguugagaag

SEQ ID NO: 356138 - RNA, 22 nt, Homo sapiens
uccuguaaucccagcuaccaga

SEQ ID NO: 356139 - RNA, 22 nt, Homo sapiens
ugccugagccagguuuuaggag

SEQ ID NO: 356140 - RNA, 22 nt, Homo sapiens
ugcuaugucagccaggcugguc

SEQ ID NO: 356141 - RNA, 22 nt, Homo sapiens
uggaacacaucuaaggaagcag

SEQ ID NO: 356142 - RNA, 22 nt, Homo sapiens
uggaagacucuagucucuugag

SEQ ID NO: 356143 - RNA, 20 nt, Homo sapiens
uggaaggcaucugcauuauu

SEQ ID NO: 356144 - RNA, 22 nt, Homo sapiens
uggaaggcuucauauguaaaga

SEQ ID NO: 356145 - RNA, 23 nt, Homo sapiens
uggaaguauggaggaggcagaau

SEQ ID NO: 356146 - RNA, 22 nt, Homo sapiens
uggaaucaucaacgaaugaaau

SEQ ID NO: 356147 - RNA, 21 nt, Homo sapiens
uggaaucuauuauuccaguuu

SEQ ID NO: 356148 - RNA, 22 nt, Homo sapiens
uggaaucuuaggugaaggcuuu

SEQ ID NO: 356149 - RNA, 22 nt, Homo sapiens
uggaauggagagagggugcacg

SEQ ID NO: 356150 - RNA, 19 nt, Homo sapiens
uggaauggauuuaaaugug

SEQ ID NO: 356151 - RNA, 22 nt, Homo sapiens
uggaaugguaucuuguuggggu

SEQ ID NO: 356152 - RNA, 22 nt, Homo sapiens
uggaauuuagguugauaguaua

SEQ ID NO: 356153 - RNA, 22 nt, Homo sapiens
uggacaugaagggcacaggagg

SEQ ID NO: 356154 - RNA, 21 nt, Homo sapiens
uggaccccuacuucucaccau

SEQ ID NO: 356155 - RNA, 22 nt, Homo sapiens
uggaccccugcucgggagcccu

SEQ ID NO: 356156 - RNA, 22 nt, Homo sapiens
uggagacaaagauagaaaagca

SEQ ID NO: 356157 - RNA, 22 nt, Homo sapiens
uggagauguuuaaaauccacug

SEQ ID NO: 356158 - RNA, 22 nt, Homo sapiens
uggagguagacauugggaagag

SEQ ID NO: 356159 - RNA, 19 nt, Homo sapiens
uggagucaucaugcugcua

SEQ ID NO: 356160 - RNA, 20 nt, Homo sapiens
uggaguuguggcaguuugga

SEQ ID NO: 356161 - RNA, 22 nt, Homo sapiens
uggaguuugacaugccuuuggg

SEQ ID NO: 356162 - RNA, 18 nt, Homo sapiens
uggauaugaaauucugga

SEQ ID NO: 356163 - RNA, 22 nt, Homo sapiens
uggaugaagagaugguaguugc

SEQ ID NO: 356164 - RNA, 22 nt, Homo sapiens
uggaugacuguuauaugcauau

SEQ ID NO: 356165 - RNA, 22 nt, Homo sapiens
uggcaacaucuggggacauguu

SEQ ID NO: 356166 - RNA, 22 nt, Homo sapiens
uggcaagaagagcaugagacca

SEQ ID NO: 356167 - RNA, 22 nt, Homo sapiens
uggcauggaaagcuuuucauac

SEQ ID NO: 356168 - RNA, 22 nt, Homo sapiens
uggccagugucggaggccagga

SEQ ID NO: 356169 - RNA, 22 nt, Homo sapiens
uggccagugucuauugguuucc

SEQ ID NO: 356170 - RNA, 22 nt, Homo sapiens
uggccaguguuuuuccugggcu

SEQ ID NO: 356171 - RNA, 22 nt, Homo sapiens
uggccaguugaagacaaugcuc

SEQ ID NO: 356172 - RNA, 22 nt, Homo sapiens
uggccaguuuuuaauugggucu

SEQ ID NO: 356173 - RNA, 22 nt, Homo sapiens
uggcuccguuguacaggcugga

SEQ ID NO: 356174 - RNA, 22 nt, Homo sapiens
uggcuguguccucucccaaauc

SEQ ID NO: 356175 - RNA, 20 nt, Homo sapiens
uggcuucuuaauugcaggca

SEQ ID NO: 356176 - RNA, 22 nt, Homo sapiens
uggcuuuuauuauguugaggua

SEQ ID NO: 356177 - RNA, 22 nt, Homo sapiens
ugggaacugaggugaaaagaca

SEQ ID NO: 356178 - RNA, 22 nt, Homo sapiens
ugggagugugcacaauuucagc

SEQ ID NO: 356179 - RNA, 22 nt, Homo sapiens
ugggcaagugacuuggcuucuc

SEQ ID NO: 356180 - RNA, 22 nt, Homo sapiens
ugggcagugggacagcuuugug

SEQ ID NO: 356181 - RNA, 19 nt, Homo sapiens
uggguaguuuucuggcugg

SEQ ID NO: 356182 - RNA, 22 nt, Homo sapiens
uggguaguuuuucagcucuugc

SEQ ID NO: 356183 - RNA, 22 nt, Homo sapiens
ugguacuucaugcucacagaua

SEQ ID NO: 356184 - RNA, 22 nt, Homo sapiens
uggucaaaucugaugugagaaa

SEQ ID NO: 356185 - RNA, 22 nt, Homo sapiens
uggucaguugugccucaauucc

SEQ ID NO: 356186 - RNA, 22 nt, Homo sapiens
ugguccaguucugugauauugc

SEQ ID NO: 356187 - RNA, 22 nt, Homo sapiens
uguaagugugcaauucagugau

SEQ ID NO: 356188 - RNA, 22 nt, Homo sapiens
uguagauaucuaucaggucaau

SEQ ID NO: 356189 - RNA, 22 nt, Homo sapiens
uguauagaucugauucaucucc

SEQ ID NO: 356190 - RNA, 22 nt, Homo sapiens
uguauguugggucaaaguacau

SEQ ID NO: 356191 - RNA, 22 nt, Homo sapiens
ugucaagaaaucaaggugugag

SEQ ID NO: 356192 - RNA, 19 nt, Homo sapiens
ugucccagccauagaggca

SEQ ID NO: 356193 - RNA, 22 nt, Homo sapiens
uguccuagagggaugucacccc

SEQ ID NO: 356194 - RNA, 22 nt, Homo sapiens
ugucuggaguccauagaagugu

SEQ ID NO: 356195 - RNA, 19 nt, Homo sapiens
ugugaacaucacagagugu

SEQ ID NO: 356196 - RNA, 22 nt, Homo sapiens
ugugaaugaagaaugcuaaccu

SEQ ID NO: 356197 - RNA, 22 nt, Homo sapiens
ugugacaguuaguuugguguua

SEQ ID NO: 356198 - RNA, 22 nt, Homo sapiens
ugugagaaaugcagaaucucag

SEQ ID NO: 356199 - RNA, 18 nt, Homo sapiens
ugugcaauauuaaccacc

SEQ ID NO: 356200 - RNA, 22 nt, Homo sapiens
ugugcaaucagcuucauuacau

SEQ ID NO: 356201 - RNA, 22 nt, Homo sapiens
ugugcaauucgauggagcucau

SEQ ID NO: 356202 - RNA, 22 nt, Homo sapiens
ugugcacaacaugcagguuugu

SEQ ID NO: 356203 - RNA, 22 nt, Homo sapiens
ugugcacaaugugcagguuugu

SEQ ID NO: 356204 - RNA, 22 nt, Homo sapiens
uguggcaaauggucaggaagaa

SEQ ID NO: 356205 - RNA, 22 nt, Homo sapiens
uguguaauacucuaaugaugca

SEQ ID NO: 356206 - RNA, 22 nt, Homo sapiens
uguguuuuuauguaaaauggaa

SEQ ID NO: 356207 - RNA, 22 nt, Homo sapiens
uguuaagaugucaauuuuccac

SEQ ID NO: 356208 - RNA, 20 nt, Homo sapiens
uguugcacucuagccugggu

SEQ ID NO: 356209 - RNA, 22 nt, Homo sapiens
uuaaagccauaccugagagagu

SEQ ID NO: 356210 - RNA, 22 nt, Homo sapiens
uuaaaugcauagaauguguagu

SEQ ID NO: 356211 - RNA, 22 nt, Homo sapiens
uuaaaugcucacauaaagguag

SEQ ID NO: 356212 - RNA, 22 nt, Homo sapiens
uuaaaugucuguagaugugcug

SEQ ID NO: 356213 - RNA, 22 nt, Homo sapiens
uuaagaugcauuuugaaguuaa

SEQ ID NO: 356214 - RNA, 22 nt, Homo sapiens
uuaaguuaggcuucagcagucu

SEQ ID NO: 356215 - RNA, 22 nt, Homo sapiens
uuacaguaugaguaagaguucu

SEQ ID NO: 356216 - RNA, 22 nt, Homo sapiens
uuagacaguggugcacugcacu

SEQ ID NO: 356217 - RNA, 22 nt, Homo sapiens
uuagcagcaucccuggccugua

SEQ ID NO: 356218 - RNA, 22 nt, Homo sapiens
uuaguagcacagaguaucagca

SEQ ID NO: 356219 - RNA, 22 nt, Homo sapiens
uuauacucgucugaaugauucu

SEQ ID NO: 356220 - RNA, 22 nt, Homo sapiens
uuauagcuaacaucugugaaaa

SEQ ID NO: 356221 - RNA, 22 nt, Homo sapiens
uuaugguuguuaucuugguucg

SEQ ID NO: 356222 - RNA, 22 nt, Homo sapiens
uuauguaaaucaaucuggaauc

SEQ ID NO: 356223 - RNA, 22 nt, Homo sapiens
uucaaaguaaaaauguguucac

SEQ ID NO: 356224 - RNA, 22 nt, Homo sapiens
uucaaauguucuuucaccaccc

SEQ ID NO: 356225 - RNA, 22 nt, Homo sapiens
uucaaggacuaaggauuuuugg

SEQ ID NO: 356226 - RNA, 22 nt, Homo sapiens
uucaauaugucauuggcaggca

SEQ ID NO: 356227 - RNA, 22 nt, Homo sapiens
uucaauuaauauuauacucuca

SEQ ID NO: 356228 - RNA, 22 nt, Homo sapiens
uucacacugggccuacucugug

SEQ ID NO: 356229 - RNA, 22 nt, Homo sapiens
uucacagagagaacucaaacca

SEQ ID NO: 356230 - RNA, 22 nt, Homo sapiens
uucacagugugaucuaugggca

SEQ ID NO: 356231 - RNA, 22 nt, Homo sapiens
uucaccaguuuugucacgaaug

SEQ ID NO: 356232 - RNA, 21 nt, Homo sapiens
uucaccauggcuccacacucu

SEQ ID NO: 356233 - RNA, 20 nt, Homo sapiens
uucagugcagguaacaaucc

SEQ ID NO: 356234 - RNA, 22 nt, Homo sapiens
uucauaguuuauacugauauuu

SEQ ID NO: 356235 - RNA, 22 nt, Homo sapiens
uucaugcaucuguagugguuaa

SEQ ID NO: 356236 - RNA, 22 nt, Homo sapiens
uucauguaauuccauaagguaa

SEQ ID NO: 356237 - RNA, 22 nt, Homo sapiens
uucccuuucugaaaaucucauu

SEQ ID NO: 356238 - RNA, 22 nt, Homo sapiens
uucccuuucuuaaagaguuagg

SEQ ID NO: 356239 - RNA, 22 nt, Homo sapiens
uucccuuugugcauaggauuug

SEQ ID NO: 356240 - RNA, 19 nt, Homo sapiens
uuccuagugguugggaagu

SEQ ID NO: 356241 - RNA, 22 nt, Homo sapiens
uuccuguagcgauuuuaguaau

SEQ ID NO: 356242 - RNA, 22 nt, Homo sapiens
uuccuugagaaaguacaaggcu

SEQ ID NO: 356243 - RNA, 22 nt, Homo sapiens
uucuagcaauggcagagugucu

SEQ ID NO: 356244 - RNA, 22 nt, Homo sapiens
uucuagcacuuugggagacuga

SEQ ID NO: 356245 - RNA, 22 nt, Homo sapiens
uucugacuggugugagauggua

SEQ ID NO: 356246 - RNA, 22 nt, Homo sapiens
uucugcacaucgaucacaagau

SEQ ID NO: 356247 - RNA, 23 nt, Homo sapiens
uucugccacugaaaaugccucag

SEQ ID NO: 356248 - RNA, 22 nt, Homo sapiens
uucuggaaaucagcagagggug

SEQ ID NO: 356249 - RNA, 19 nt, Homo sapiens
uucugguguuuuaagccaa

SEQ ID NO: 356250 - RNA, 21 nt, Homo sapiens
uucuucaggcagaaggauuau

SEQ ID NO: 356251 - RNA, 22 nt, Homo sapiens
uucuucaggcauucccagaagc

SEQ ID NO: 356252 - RNA, 22 nt, Homo sapiens
uucuucaggccacaaaaauggu

SEQ ID NO: 356253 - RNA, 22 nt, Homo sapiens
uugaaggaggugcucacucucg

SEQ ID NO: 356254 - RNA, 19 nt, Homo sapiens
uugaaggccgccuugcaga

SEQ ID NO: 356255 - RNA, 22 nt, Homo sapiens
uugacaggaugcucagggccca

SEQ ID NO: 356256 - RNA, 20 nt, Homo sapiens
uugacaguggguuguuaaag

SEQ ID NO: 356257 - RNA, 22 nt, Homo sapiens
uugacugggccagacagagauc

SEQ ID NO: 356258 - RNA, 22 nt, Homo sapiens
uugagacggaguuuugcucuug

SEQ ID NO: 356259 - RNA, 22 nt, Homo sapiens
uugagagaaaaaauuuauuggu

SEQ ID NO: 356260 - RNA, 22 nt, Homo sapiens
uugagagagaacauuuguuaca

SEQ ID NO: 356261 - RNA, 22 nt, Homo sapiens
uugagauacauaauuaugaaug

SEQ ID NO: 356262 - RNA, 22 nt, Homo sapiens
uugagauaggagcuguuguucu

SEQ ID NO: 356263 - RNA, 22 nt, Homo sapiens
uugagaugauggauaugcuaau

SEQ ID NO: 356264 - RNA, 22 nt, Homo sapiens
uugagcaaaacauuaauauuag

SEQ ID NO: 356265 - RNA, 22 nt, Homo sapiens
uugagcaccaugccuggccaug

SEQ ID NO: 356266 - RNA, 22 nt, Homo sapiens
uugagcucuucuagcaauucua

SEQ ID NO: 356267 - RNA, 22 nt, Homo sapiens
uugaggaaugucauuuguguuu

SEQ ID NO: 356268 - RNA, 22 nt, Homo sapiens
uugaggaggcagucuguccguu

SEQ ID NO: 356269 - RNA, 22 nt, Homo sapiens
uugaggccugauaacacacuga

SEQ ID NO: 356270 - RNA, 22 nt, Homo sapiens
uugaggcuuuugaccucaugug

SEQ ID NO: 356271 - RNA, 22 nt, Homo sapiens
uugauaguaccauugggaaauu

SEQ ID NO: 356272 - RNA, 22 nt, Homo sapiens
uugauuagugacuggcuacacg

SEQ ID NO: 356273 - RNA, 22 nt, Homo sapiens
uugcacauugauuuuguauccu

SEQ ID NO: 356274 - RNA, 22 nt, Homo sapiens
uugcaguacuucuggcuuuaca

SEQ ID NO: 356275 - RNA, 22 nt, Homo sapiens
uugcaguaguaacuccuuaccu

SEQ ID NO: 356276 - RNA, 22 nt, Homo sapiens
uugcauagacaauauuaaucuu

SEQ ID NO: 356277 - RNA, 22 nt, Homo sapiens
uugccuauucacucugaugaua

SEQ ID NO: 356278 - RNA, 22 nt, Homo sapiens
uugcuccucugccaggaccugu

SEQ ID NO: 356279 - RNA, 22 nt, Homo sapiens
uuggauggucuuuauauaguau

SEQ ID NO: 356280 - RNA, 22 nt, Homo sapiens
aaacccauauaccagcugugcu

SEQ ID NO: 356281 - RNA, 22 nt, Homo sapiens
aaagagaucuaugggcacuaug

SEQ ID NO: 356282 - RNA, 22 nt, Homo sapiens
aaaggcacugaucuuauccagu

SEQ ID NO: 356283 - RNA, 22 nt, Homo sapiens
aaaggcacugugacuuuauagg

SEQ ID NO: 356284 - RNA, 22 nt, Homo sapiens
aaagggcuguuucuugacuugg

SEQ ID NO: 356285 - RNA, 17 nt, Homo sapiens
aaaguccuuugcuaucu

SEQ ID NO: 356286 - RNA, 22 nt, Homo sapiens
aaagugcuaggauuaccugggg

SEQ ID NO: 356287 - RNA, 22 nt, Homo sapiens
aaagugcugggauuggccgggc

SEQ ID NO: 356288 - RNA, 22 nt, Homo sapiens
aaagugcugggauuggcugggc

SEQ ID NO: 356289 - RNA, 22 nt, Homo sapiens
aaagugcugggauuuuaggcau

SEQ ID NO: 356290 - RNA, 22 nt, Homo sapiens
aaagugcuguagacugggcgca

SEQ ID NO: 356291 - RNA, 22 nt, Homo sapiens
aaagugcuucucuuuggugggu

SEQ ID NO: 356292 - RNA, 22 nt, Homo sapiens
aaaguggacuaagugaauauga

SEQ ID NO: 356293 - RNA, 22 nt, Homo sapiens
aaaugcaugaauaagcucgugu

SEQ ID NO: 356294 - RNA, 22 nt, Homo sapiens
aacaccauucucuguaacaaga

SEQ ID NO: 356295 - RNA, 22 nt, Homo sapiens
aacagcauaguacccgugauaa

SEQ ID NO: 356296 - RNA, 22 nt, Homo sapiens
aacaggguggugccugguccau

SEQ ID NO: 356297 - RNA, 22 nt, Homo sapiens
aacugcuguuuggguacuggug

SEQ ID NO: 356298 - RNA, 22 nt, Homo sapiens
aacuggucuuaugcaagcacua

SEQ ID NO: 356299 - RNA, 22 nt, Homo sapiens
aagagccgcaagggugaagggu

SEQ ID NO: 356300 - RNA, 22 nt, Homo sapiens
aagaggccuaggaaucuguauu

SEQ ID NO: 356301 - RNA, 22 nt, Homo sapiens
aagagguaauaacaaagcuucu

SEQ ID NO: 356302 - RNA, 22 nt, Homo sapiens
aagaguuaguaaaauuuccucu

SEQ ID NO: 356303 - RNA, 22 nt, Homo sapiens
aagccagugugacaggaaacuu

SEQ ID NO: 356304 - RNA, 22 nt, Homo sapiens
aagcuggagugcaguggugcaa

SEQ ID NO: 356305 - RNA, 22 nt, Homo sapiens
aagcuggagugcaguggugcga

SEQ ID NO: 356306 - RNA, 22 nt, Homo sapiens
aagcuguguguaagcucucaca

SEQ ID NO: 356307 - RNA, 22 nt, Homo sapiens
aaggagcaguggacggguccua

SEQ ID NO: 356308 - RNA, 22 nt, Homo sapiens
aaggagugugauucuucaguuu

SEQ ID NO: 356309 - RNA, 22 nt, Homo sapiens
aaggcaagaaaauggauucucc

SEQ ID NO: 356310 - RNA, 22 nt, Homo sapiens
aaggcaagaagagaaccaucgg

SEQ ID NO: 356311 - RNA, 22 nt, Homo sapiens
aaggcaagauacugguugcuga

SEQ ID NO: 356312 - RNA, 22 nt, Homo sapiens
aaggcaagguggauaaugaagc

SEQ ID NO: 356313 - RNA, 22 nt, Homo sapiens
aaggcaguggcagaagauguca

SEQ ID NO: 356314 - RNA, 22 nt, Homo sapiens
aaggcagugugcacauaacacu

SEQ ID NO: 356315 - RNA, 22 nt, Homo sapiens
aaggcuguuguguaauaggauu

SEQ ID NO: 356316 - RNA, 22 nt, Homo sapiens
aagggaaugcuuccaguuugug

SEQ ID NO: 356317 - RNA, 22 nt, Homo sapiens
aagggaauguuguggcugguuu

SEQ ID NO: 356318 - RNA, 22 nt, Homo sapiens
aaguaaaucuuaugucagggag

SEQ ID NO: 356319 - RNA, 22 nt, Homo sapiens
aaguagcuggaugcaguggcac

SEQ ID NO: 356320 - RNA, 19 nt, Homo sapiens
aagugaaugcuuuguucac

SEQ ID NO: 356321 - RNA, 23 nt, Homo sapiens
aagugagcuccaauugggugaga

SEQ ID NO: 356322 - RNA, 22 nt, Homo sapiens
aagugcuguaugggagccuagg

SEQ ID NO: 356323 - RNA, 22 nt, Homo sapiens
aagugcuuacagggaacaugau

SEQ ID NO: 356324 - RNA, 22 nt, Homo sapiens
aagugcuuaggauagugugugg

SEQ ID NO: 356325 - RNA, 22 nt, Homo sapiens
aauagcuguuuuuaauuccugc

SEQ ID NO: 356326 - RNA, 22 nt, Homo sapiens
aauaucacaguuggguguacac

SEQ ID NO: 356327 - RNA, 22 nt, Homo sapiens
aaucagcacacugugcuuucca

SEQ ID NO: 356328 - RNA, 22 nt, Homo sapiens
aaugacccugauuggcaaguug

SEQ ID NO: 356329 - RNA, 22 nt, Homo sapiens
aaugacuaagaugguacauuuu

SEQ ID NO: 356330 - RNA, 22 nt, Homo sapiens
aauucugugagauggugcagau

SEQ ID NO: 356331 - RNA, 23 nt, Homo sapiens
aauugcuuuugaggacuuaguug

SEQ ID NO: 356332 - RNA, 22 nt, Homo sapiens
acaaaguaggcagugggcugga

SEQ ID NO: 356333 - RNA, 22 nt, Homo sapiens
acaaaguguuuucugaaggccu

SEQ ID NO: 356334 - RNA, 22 nt, Homo sapiens
acaagcacaaaugcauagaugg

SEQ ID NO: 356335 - RNA, 22 nt, Homo sapiens
acacaguguuuauugugguuag

SEQ ID NO: 356336 - RNA, 22 nt, Homo sapiens
acacauacacauaugguguaua

SEQ ID NO: 356337 - RNA, 22 nt, Homo sapiens
acacaugugaaaaaaauguuac

SEQ ID NO: 356338 - RNA, 22 nt, Homo sapiens
acacugucucuugcugaccaug

SEQ ID NO: 356339 - RNA, 22 nt, Homo sapiens
acacuguugacauuuuguagug

SEQ ID NO: 356340 - RNA, 22 nt, Homo sapiens
acagaccuauuucaaucauuua

SEQ ID NO: 356341 - RNA, 22 nt, Homo sapiens
acaguacaugauaaauaaggua

SEQ ID NO: 356342 - RNA, 22 nt, Homo sapiens
acagugcuucugauaugaugcc

SEQ ID NO: 356343 - RNA, 22 nt, Homo sapiens
acagugcuuucaauguucagua

SEQ ID NO: 356344 - RNA, 17 nt, Homo sapiens
acagugcuuugcuuucc

SEQ ID NO: 356345 - RNA, 22 nt, Homo sapiens
acagugcuuuuguuccucuccu

SEQ ID NO: 356346 - RNA, 22 nt, Homo sapiens
acaguguagugacugccaacuu

SEQ ID NO: 356347 - RNA, 22 nt, Homo sapiens
acaucacuguuugauugauuga

SEQ ID NO: 356348 - RNA, 22 nt, Homo sapiens
acaugcauauguuggaagaaag

SEQ ID NO: 356349 - RNA, 22 nt, Homo sapiens
acauugcauauggcacccucuu

SEQ ID NO: 356350 - RNA, 22 nt, Homo sapiens
acccaguguucaacauucacau

SEQ ID NO: 356351 - RNA, 22 nt, Homo sapiens
acccggagagcaggcgagaagg

SEQ ID NO: 356352 - RNA, 22 nt, Homo sapiens
acccuguaacauacaagugguu

SEQ ID NO: 356353 - RNA, 22 nt, Homo sapiens
accugugguuacagucugucuc

SEQ ID NO: 356354 - RNA, 22 nt, Homo sapiens
acucauugcucauaccuuaucu

SEQ ID NO: 356355 - RNA, 22 nt, Homo sapiens
acugagucauugaggcccucuc

SEQ ID NO: 356356 - RNA, 22 nt, Homo sapiens
acuggaguuuguucaagaaaua

SEQ ID NO: 356357 - RNA, 22 nt, Homo sapiens
acuggguuaauuugaagguuga

SEQ ID NO: 356358 - RNA, 22 nt, Homo sapiens
acuguauagauggaguugauuu

SEQ ID NO: 356359 - RNA, 22 nt, Homo sapiens
acuuuuugcaaccauuuggacc

SEQ ID NO: 356360 - RNA, 22 nt, Homo sapiens
agaaauguuuacucacccccuu

SEQ ID NO: 356361 - RNA, 22 nt, Homo sapiens
agaaccaaucccacauggauac

SEQ ID NO: 356362 - RNA, 22 nt, Homo sapiens
agaaugauccuucucagaggca

SEQ ID NO: 356363 - RNA, 22 nt, Homo sapiens
agaauucugucauguuuauauu

SEQ ID NO: 356364 - RNA, 22 nt, Homo sapiens
ucaguccccucgcugagucuac

SEQ ID NO: 356365 - RNA, 22 nt, Homo sapiens
ucagugguuaaaagauucuaga

SEQ ID NO: 356366 - RNA, 16 nt, Homo sapiens
ucauaguaucucuucu

SEQ ID NO: 356367 - RNA, 22 nt, Homo sapiens
ucauauguaugugcaauuuugu

SEQ ID NO: 356368 - RNA, 16 nt, Homo sapiens
ucaucacagucucugg

SEQ ID NO: 356369 - RNA, 22 nt, Homo sapiens
ucaucaggcucauucaagcuga

SEQ ID NO: 356370 - RNA, 22 nt, Homo sapiens
uccaugaguccauuagaaaaaa

SEQ ID NO: 356371 - RNA, 22 nt, Homo sapiens
ucccaguggucuugaaacaggg

SEQ ID NO: 356372 - RNA, 20 nt, Homo sapiens
ucccuaagagccuuuccuuc

SEQ ID NO: 356373 - RNA, 22 nt, Homo sapiens
uccuacaugcaguacauucaaa

SEQ ID NO: 356374 - RNA, 22 nt, Homo sapiens
ucuaaaacuagauugugaugau

SEQ ID NO: 356375 - RNA, 17 nt, Homo sapiens
ucuaauaauaugcauuu

SEQ ID NO: 356376 - RNA, 22 nt, Homo sapiens
ucuauggauaaaaugcccucau

SEQ ID NO: 356377 - RNA, 22 nt, Homo sapiens
ucucaaccucccaaguagcugg

SEQ ID NO: 356378 - RNA, 18 nt, Homo sapiens
ucucacagcaaucuguca

SEQ ID NO: 356379 - RNA, 22 nt, Homo sapiens
ucucacagccauuucucccucu

SEQ ID NO: 356380 - RNA, 22 nt, Homo sapiens
ucucugauuaaacaagauagug

SEQ ID NO: 356381 - RNA, 19 nt, Homo sapiens
ucugacagccccagucaac

SEQ ID NO: 356382 - RNA, 22 nt, Homo sapiens
ucugacucugugaugggcccaa

SEQ ID NO: 356383 - RNA, 22 nt, Homo sapiens
ucugccuacugagcacacagug

SEQ ID NO: 356384 - RNA, 22 nt, Homo sapiens
ucuggcauuuucucugcuugca

SEQ ID NO: 356385 - RNA, 22 nt, Homo sapiens
ucuggccuccuaugagaaucga

SEQ ID NO: 356386 - RNA, 22 nt, Homo sapiens
ucuggcuugugaacugucuucu

SEQ ID NO: 356387 - RNA, 22 nt, Homo sapiens
ucuggcuuuuaacaucuauaaa

SEQ ID NO: 356388 - RNA, 22 nt, Homo sapiens
ucuggguuuuguaccgugcucg

SEQ ID NO: 356389 - RNA, 22 nt, Homo sapiens
ucuggguuuuuacaauguuuac

SEQ ID NO: 356390 - RNA, 22 nt, Homo sapiens
ucugucuuguccucacccuaga

SEQ ID NO: 356391 - RNA, 19 nt, Homo sapiens
ucugugcuugucccccugu

SEQ ID NO: 356392 - RNA, 22 nt, Homo sapiens
ucuguggucagcauccgccacu

SEQ ID NO: 356393 - RNA, 22 nt, Homo sapiens
ucugugguucaaaccagcaacu

SEQ ID NO: 356394 - RNA, 22 nt, Homo sapiens
ucugugguucaggcuggagugc

SEQ ID NO: 356395 - RNA, 22 nt, Homo sapiens
ucugugguucuagcuacuuugg

SEQ ID NO: 356396 - RNA, 22 nt, Homo sapiens
ucuuagugcggcugcugcagcc

SEQ ID NO: 356397 - RNA, 22 nt, Homo sapiens
ucuugaacuucugcacacucag

SEQ ID NO: 356398 - RNA, 20 nt, Homo sapiens
ucuugggaauguagccuagg

SEQ ID NO: 356399 - RNA, 22 nt, Homo sapiens
ucuuggguuugccuugcugcug

SEQ ID NO: 356400 - RNA, 22 nt, Homo sapiens
ucuuuagugacaguugugcaag

SEQ ID NO: 356401 - RNA, 19 nt, Homo sapiens
ucuuugcuuuucuaagagg

SEQ ID NO: 356402 - RNA, 22 nt, Homo sapiens
ugaaauacuuaauuucuccaug

SEQ ID NO: 356403 - RNA, 22 nt, Homo sapiens
ugaauagaaguuuacuccuuuu

SEQ ID NO: 356404 - RNA, 22 nt, Homo sapiens
ugaaugcaucuagaaauuuauu

SEQ ID NO: 356405 - RNA, 22 nt, Homo sapiens
ugaauggauccaauucuuagua

SEQ ID NO: 356406 - RNA, 22 nt, Homo sapiens
ugaauguuugcagcuuauacca

SEQ ID NO: 356407 - RNA, 22 nt, Homo sapiens
ugaauugucucucacuggguuc

SEQ ID NO: 356408 - RNA, 22 nt, Homo sapiens
ugaauuguuuacgagaugugag

SEQ ID NO: 356409 - RNA, 22 nt, Homo sapiens
ugacaugauguuccuacacugu

SEQ ID NO: 356410 - RNA, 22 nt, Homo sapiens
ugacaugauuguauauuuagaa

SEQ ID NO: 356411 - RNA, 22 nt, Homo sapiens
ugacauggagggugcggcugca

SEQ ID NO: 356412 - RNA, 22 nt, Homo sapiens
ugaccacagaaagugagggagc

SEQ ID NO: 356413 - RNA, 22 nt, Homo sapiens
ugagaacaugugauauuuggug

SEQ ID NO: 356414 - RNA, 17 nt, Homo sapiens
ugagaacaugugguauu

SEQ ID NO: 356415 - RNA, 20 nt, Homo sapiens
ugagaacaugugguauuugg

SEQ ID NO: 356416 - RNA, 18 nt, Homo sapiens
ugagaacauguguacaca

SEQ ID NO: 356417 - RNA, 22 nt, Homo sapiens
ugagaagacaucuuugcuuugu

SEQ ID NO: 356418 - RNA, 22 nt, Homo sapiens
ugagaagaugaacuccuugguc

SEQ ID NO: 356419 - RNA, 22 nt, Homo sapiens
ugagaauauuugaagauguuag

SEQ ID NO: 356420 - RNA, 22 nt, Homo sapiens
ugagacugauaggacauuuucu

SEQ ID NO: 356421 - RNA, 22 nt, Homo sapiens
ugagagacauuuguuguagagu

SEQ ID NO: 356422 - RNA, 22 nt, Homo sapiens
ugagaggugauaaagcaagggu

SEQ ID NO: 356423 - RNA, 22 nt, Homo sapiens
ugagaguauaaauugaugcagc

SEQ ID NO: 356424 - RNA, 22 nt, Homo sapiens
ugagagucacugaccugguaua

SEQ ID NO: 356425 - RNA, 22 nt, Homo sapiens
ugagagucauacaaauaaaaau

SEQ ID NO: 356426 - RNA, 22 nt, Homo sapiens
ugagauaaggaaauugaggcuc

SEQ ID NO: 356427 - RNA, 22 nt, Homo sapiens
ugagaucacuaagagguaaugg

SEQ ID NO: 356428 - RNA, 22 nt, Homo sapiens
ugagaugaagcuagaagaaugg

SEQ ID NO: 356429 - RNA, 22 nt, Homo sapiens
ugagaugauagauauguuaauu

SEQ ID NO: 356430 - RNA, 22 nt, Homo sapiens
ugagauuaaucuuuaaguaaga

SEQ ID NO: 356431 - RNA, 22 nt, Homo sapiens
ugagcagugagugugcugcagg

SEQ ID NO: 356432 - RNA, 22 nt, Homo sapiens
ugagcauauuuaagguaugcua

SEQ ID NO: 356433 - RNA, 21 nt, Homo sapiens
ugagcauuaguacaguaggga

SEQ ID NO: 356434 - RNA, 22 nt, Homo sapiens
ugagccaaguucacaccauugc

SEQ ID NO: 356435 - RNA, 22 nt, Homo sapiens
ugagguuggggucagggcuagc

SEQ ID NO: 356436 - RNA, 22 nt, Homo sapiens
ugaguagaacuagucuagagcu

SEQ ID NO: 356437 - RNA, 21 nt, Homo sapiens
ugagugcugagugaggguuga

SEQ ID NO: 356438 - RNA, 22 nt, Homo sapiens
ugagugugaggaagaauuagaa

SEQ ID NO: 356439 - RNA, 22 nt, Homo sapiens
ugaguguguaugugcauacaca

SEQ ID NO: 356440 - RNA, 22 nt, Homo sapiens
ugaguuaauuuuuguaucaugu

SEQ ID NO: 356441 - RNA, 22 nt, Homo sapiens
ugaguuagguaauaauaaauau

SEQ ID NO: 356442 - RNA, 22 nt, Homo sapiens
ugauauguaugugaccuagaaa

SEQ ID NO: 356443 - RNA, 22 nt, Homo sapiens
ugaugcugaguggcuauuugaa

SEQ ID NO: 356444 - RNA, 22 nt, Homo sapiens
ugaugcugaugccugccagaag

SEQ ID NO: 356445 - RNA, 22 nt, Homo sapiens
ugauggcauuucauguuuguaa

SEQ ID NO: 356446 - RNA, 19 nt, Homo sapiens
ugcaaagucagugaagggu

SEQ ID NO: 356447 - RNA, 22 nt, Homo sapiens
ugcaaaucuuguguaguuguga

SEQ ID NO: 356448 - RNA, 22 nt, Homo sapiens
ugcaaucauuuggaggagaaga

SEQ ID NO: 356449 - RNA, 22 nt, Homo sapiens
ugcacaguccagugcccacuga

SEQ ID NO: 356450 - RNA, 20 nt, Homo sapiens
ugcagauucaaccaacugug

SEQ ID NO: 356451 - RNA, 17 nt, Homo sapiens
ugcagcacacugauggg

SEQ ID NO: 356452 - RNA, 22 nt, Homo sapiens
ugcaguacugucagacuucuua

SEQ ID NO: 356453 - RNA, 22 nt, Homo sapiens
ugcaguacuuugaaauauacug

SEQ ID NO: 356454 - RNA, 22 nt, Homo sapiens
ugcaguaggcccagcgggaggc

SEQ ID NO: 356455 - RNA, 22 nt, Homo sapiens
ugccaguguuuuguugaagauu

SEQ ID NO: 356456 - RNA, 22 nt, Homo sapiens
ugccuagucuauugagagucuu

SEQ ID NO: 356457 - RNA, 22 nt, Homo sapiens
ugccuaguguguugagaguuuu

SEQ ID NO: 356458 - RNA, 22 nt, Homo sapiens
uaaagugcugagaugaggcugg

SEQ ID NO: 356459 - RNA, 22 nt, Homo sapiens
uaaaguuauugccccucaguua

SEQ ID NO: 356460 - RNA, 22 nt, Homo sapiens
uaaaugacugucaguagaugaa

SEQ ID NO: 356461 - RNA, 22 nt, Homo sapiens
uaaaugcuuaauugaaugugga

SEQ ID NO: 356462 - RNA, 22 nt, Homo sapiens
uaacaacauucuaacugacggc

SEQ ID NO: 356463 - RNA, 22 nt, Homo sapiens
uaacaguguauuuacuacuucc

SEQ ID NO: 356464 - RNA, 22 nt, Homo sapiens
uaaggcacauaggccuggaaac

SEQ ID NO: 356465 - RNA, 18 nt, Homo sapiens
uaaggcacuauaggcauu

SEQ ID NO: 356466 - RNA, 22 nt, Homo sapiens
uaagguguagacuggucacaag

SEQ ID NO: 356467 - RNA, 19 nt, Homo sapiens
uaaguagaugacugaugcu

SEQ ID NO: 356468 - RNA, 22 nt, Homo sapiens
uaauaauguuaggcuuacucaa

SEQ ID NO: 356469 - RNA, 19 nt, Homo sapiens
uaaugccacugccuggcau

SEQ ID NO: 356470 - RNA, 19 nt, Homo sapiens
uacaggacugagcugaggu

SEQ ID NO: 356471 - RNA, 22 nt, Homo sapiens
uacagucuagaggagaaucagg

SEQ ID NO: 356472 - RNA, 22 nt, Homo sapiens
uacauguauguguuuauggcug

SEQ ID NO: 356473 - RNA, 22 nt, Homo sapiens
uacauugcacuuuauuagauac

SEQ ID NO: 356474 - RNA, 22 nt, Homo sapiens
uaccaguaaugguucuagagga

SEQ ID NO: 356475 - RNA, 19 nt, Homo sapiens
uacccagaagcagcauugu

SEQ ID NO: 356476 - RNA, 23 nt, Homo sapiens
uacuaguaagcguguucuuugca

SEQ ID NO: 356477 - RNA, 22 nt, Homo sapiens
uacugagagaggaauauugaaa

SEQ ID NO: 356478 - RNA, 22 nt, Homo sapiens
uacuggccccaaaguagguagu

SEQ ID NO: 356479 - RNA, 22 nt, Homo sapiens
uagagauaucaauuucauggug

SEQ ID NO: 356480 - RNA, 22 nt, Homo sapiens
uagagcuagggacucgcaaugu

SEQ ID NO: 356481 - RNA, 22 nt, Homo sapiens
uagagcuaguuuuuaaucuaac

SEQ ID NO: 356482 - RNA, 23 nt, Homo sapiens
uagaucaucaaguuuacugugcu

SEQ ID NO: 356483 - RNA, 22 nt, Homo sapiens
uagcaaaucaauggaauugaag

SEQ ID NO: 356484 - RNA, 22 nt, Homo sapiens
uagcaacauucagcucagguac

SEQ ID NO: 356485 - RNA, 20 nt, Homo sapiens
uagcacacauguagaauagu

SEQ ID NO: 356486 - RNA, 22 nt, Homo sapiens
uagcagcaaagcaggaucugcu

SEQ ID NO: 356487 - RNA, 19 nt, Homo sapiens
uagcagcaugauuuauaau

SEQ ID NO: 356488 - RNA, 22 nt, Homo sapiens
uagcagcauuuuuguagaguau

SEQ ID NO: 356489 - RNA, 20 nt, Homo sapiens
uaggagcaaugagaguagaa

SEQ ID NO: 356490 - RNA, 22 nt, Homo sapiens
uaggagcacagcagcauguggg

SEQ ID NO: 356491 - RNA, 22 nt, Homo sapiens
uaggagcauaggauuguuugag

SEQ ID NO: 356492 - RNA, 22 nt, Homo sapiens
uaggcaaguugcccaaucucuc

SEQ ID NO: 356493 - RNA, 22 nt, Homo sapiens
uaggcacacaucuacuacaaau

SEQ ID NO: 356494 - RNA, 22 nt, Homo sapiens
uaggcaguggagaaauaaacag

SEQ ID NO: 356495 - RNA, 22 nt, Homo sapiens
uaggcuguguggccguggggcu

SEQ ID NO: 356496 - RNA, 22 nt, Homo sapiens
uagguucuccacagguucucca

SEQ ID NO: 356497 - RNA, 21 nt, Homo sapiens
uauagcagcacgauuuauaau

SEQ ID NO: 356498 - RNA, 22 nt, Homo sapiens
uauaucacaugcacucauuuuc

SEQ ID NO: 356499 - RNA, 22 nt, Homo sapiens
uauaugcacucagguguaugug

SEQ ID NO: 356500 - RNA, 22 nt, Homo sapiens
uaucacaguugcauauuuaagg

SEQ ID NO: 356501 - RNA, 22 nt, Homo sapiens
uaucaccacccugggaaacaua

SEQ ID NO: 356502 - RNA, 22 nt, Homo sapiens
uaucagcagcaggggcugcaga

SEQ ID NO: 356503 - RNA, 22 nt, Homo sapiens
uaucauaguuuggacuuucauu

SEQ ID NO: 356504 - RNA, 22 nt, Homo sapiens
uaucucagaguguacaagauua

SEQ ID NO: 356505 - RNA, 22 nt, Homo sapiens
uaucugcacauacacuuauagc

SEQ ID NO: 356506 - RNA, 22 nt, Homo sapiens
uaugaagccaggauuuauuauu

SEQ ID NO: 356507 - RNA, 22 nt, Homo sapiens
uaugaucauuauguuauugcag

SEQ ID NO: 356508 - RNA, 22 nt, Homo sapiens
uaugccucuucauaaaguauga

SEQ ID NO: 356509 - RNA, 22 nt, Homo sapiens
uaugccuuuuggcucaagaaac

SEQ ID NO: 356510 - RNA, 22 nt, Homo sapiens
uaugucacagguuuuggugaaa

SEQ ID NO: 356511 - RNA, 22 nt, Homo sapiens
uauuacagaccauaucgccggg

SEQ ID NO: 356512 - RNA, 22 nt, Homo sapiens
uauuccacuuacaugagguauc

SEQ ID NO: 356513 - RNA, 22 nt, Homo sapiens
uauugauuuucaguguucagcu

SEQ ID NO: 356514 - RNA, 22 nt, Homo sapiens
uauugcacuuuuccauaggagu

SEQ ID NO: 356515 - RNA, 22 nt, Homo sapiens
uauuugauugacuuuagcagga

SEQ ID NO: 356516 - RNA, 22 nt, Homo sapiens
ucaaaguauucuucugagaacc

SEQ ID NO: 356517 - RNA, 21 nt, Homo sapiens
ucaaaguguucuuuuguugaa

SEQ ID NO: 356518 - RNA, 22 nt, Homo sapiens
ucaacaggucaauugcauagaa

SEQ ID NO: 356519 - RNA, 22 nt, Homo sapiens
ucaagaccucacauagaggaga

SEQ ID NO: 356520 - RNA, 22 nt, Homo sapiens
ucaagcaauucuccugccucag

SEQ ID NO: 356521 - RNA, 20 nt, Homo sapiens
ucaaggcaggaacuguacau

SEQ ID NO: 356522 - RNA, 22 nt, Homo sapiens
ucacaauggcugaacuaauuua

SEQ ID NO: 356523 - RNA, 23 nt, Homo sapiens
ucacacuuaagagaaaugcagcu

SEQ ID NO: 356524 - RNA, 22 nt, Homo sapiens
ucacagacauugaggggaccuu

SEQ ID NO: 356525 - RNA, 22 nt, Homo sapiens
ucacagacugagccaaauagag

SEQ ID NO: 356526 - RNA, 22 nt, Homo sapiens
ucacagaugaggcgagaggcag

SEQ ID NO: 356527 - RNA, 22 nt, Homo sapiens
ucacaguaacuuuguugcuuuu

SEQ ID NO: 356528 - RNA, 22 nt, Homo sapiens
ucacaguagggaacugacaaag

SEQ ID NO: 356529 - RNA, 22 nt, Homo sapiens
ucacaguaucaugggggacaga

SEQ ID NO: 356530 - RNA, 22 nt, Homo sapiens
ucacaguauggggggugguuau

SEQ ID NO: 356531 - RNA, 22 nt, Homo sapiens
ucacagucaaaguaaucauaga

SEQ ID NO: 356532 - RNA, 22 nt, Homo sapiens
ucacaguccuguuuaggagagg

SEQ ID NO: 356533 - RNA, 22 nt, Homo sapiens
ucacagucugcgugaugagaca

SEQ ID NO: 356534 - RNA, 23 nt, Homo sapiens
ucacaguggcugcuuaauuguga

SEQ ID NO: 356535 - RNA, 22 nt, Homo sapiens
ucacaugugaagauugggagua

SEQ ID NO: 356536 - RNA, 18 nt, Homo sapiens
ucaccuugugagagagag

SEQ ID NO: 356537 - RNA, 22 nt, Homo sapiens
ucacuaaagaaaauggcaugga

SEQ ID NO: 356538 - RNA, 22 nt, Homo sapiens
ucacuguugaugggcaugcagg

SEQ ID NO: 356539 - RNA, 22 nt, Homo sapiens
ucacuuugacggccaacuucua

SEQ ID NO: 356540 - RNA, 22 nt, Homo sapiens
ucagaaccuccuagcaguguuc

SEQ ID NO: 356541 - RNA, 22 nt, Homo sapiens
ucagaaccucugauuuauacuu

SEQ ID NO: 356542 - RNA, 22 nt, Homo sapiens
ucagaugaucugguaagaacuu

SEQ ID NO: 356543 - RNA, 22 nt, Homo sapiens
ucagcaaugaccuaagcaaaua

SEQ ID NO: 356544 - RNA, 22 nt, Homo sapiens
ucaggcaugcagcaaugcagug

SEQ ID NO: 356545 - RNA, 22 nt, Homo sapiens
ucagguaaucuauuugucuuuu

SEQ ID NO: 356546 - RNA, 22 nt, Homo sapiens
ucagguaguuugugggagauga

SEQ ID NO: 356547 - RNA, 22 nt, Homo sapiens
ucagguugcuaaguauaauauu

SEQ ID NO: 356548 - RNA, 22 nt, Homo sapiens
ucaguaaauguuaggacauuuc

SEQ ID NO: 356549 - RNA, 22 nt, Homo sapiens
ucaguaguaaauggauuuggaa

SEQ ID NO: 356550 - RNA, 22 nt, Homo sapiens
ucaguaguuccaguggguauuu

SEQ ID NO: 356551 - RNA, 20 nt, Homo sapiens
ucaguauauuguuuccacag

SEQ ID NO: 356552 - RNA, 22 nt, Homo sapiens
auggaauguggaaugguaagua

SEQ ID NO: 356553 - RNA, 21 nt, Homo sapiens
auggacaugguuaggcuuugu

SEQ ID NO: 356554 - RNA, 22 nt, Homo sapiens
auggagcaaaacagauuuggga

SEQ ID NO: 356555 - RNA, 22 nt, Homo sapiens
auggcaguuuauucuaaaucaa

SEQ ID NO: 356556 - RNA, 20 nt, Homo sapiens
auggcccugcugggaguguc

SEQ ID NO: 356557 - RNA, 22 nt, Homo sapiens
auggcuguuccugggaguucua

SEQ ID NO: 356558 - RNA, 22 nt, Homo sapiens
auggcuucuuacucuucugcau

SEQ ID NO: 356559 - RNA, 22 nt, Homo sapiens
augggacugggugccguggagc

SEQ ID NO: 356560 - RNA, 22 nt, Homo sapiens
augggagugugguuagagaccu

SEQ ID NO: 356561 - RNA, 22 nt, Homo sapiens
augguuuuacugcaaaauggga

SEQ ID NO: 356562 - RNA, 22 nt, Homo sapiens
auguaaacagaugugcagcuug

SEQ ID NO: 356563 - RNA, 17 nt, Homo sapiens
auguaauccucaucucu

SEQ ID NO: 356564 - RNA, 22 nt, Homo sapiens
auguauacaugcaggucacagg

SEQ ID NO: 356565 - RNA, 22 nt, Homo sapiens
augugacuuuuuccugugccuu

SEQ ID NO: 356566 - RNA, 22 nt, Homo sapiens
auguggcacuugacuuucucgc

SEQ ID NO: 356567 - RNA, 22 nt, Homo sapiens
augugugaaucccagaaccugu

SEQ ID NO: 356568 - RNA, 22 nt, Homo sapiens
auguguucaucacagcacaauu

SEQ ID NO: 356569 - RNA, 20 nt, Homo sapiens
auguucuggaggacagaagc

SEQ ID NO: 356570 - RNA, 22 nt, Homo sapiens
auuacacuuucuauucaaugag

SEQ ID NO: 356571 - RNA, 22 nt, Homo sapiens
auuauuagucggccagcuguua

SEQ ID NO: 356572 - RNA, 22 nt, Homo sapiens
auuccaguggguuuacauccca

SEQ ID NO: 356573 - RNA, 22 nt, Homo sapiens
auugagucauuucaaauccaag

SEQ ID NO: 356574 - RNA, 22 nt, Homo sapiens
auugcacaaagagggaaacuga

SEQ ID NO: 356575 - RNA, 18 nt, Homo sapiens
auugcacaccagccuggg

SEQ ID NO: 356576 - RNA, 22 nt, Homo sapiens
auugcacaccagucugggcaaa

SEQ ID NO: 356577 - RNA, 22 nt, Homo sapiens
auugcacaucugcacuacagcc

SEQ ID NO: 356578 - RNA, 19 nt, Homo sapiens
auugcacuccaaccugggu

SEQ ID NO: 356579 - RNA, 22 nt, Homo sapiens
auugcacuccacccugggcaac

SEQ ID NO: 356580 - RNA, 22 nt, Homo sapiens
auugcacuccagccugagcaaa

SEQ ID NO: 356581 - RNA, 22 nt, Homo sapiens
auugcacuccagccugggcagc

SEQ ID NO: 356582 - RNA, 22 nt, Homo sapiens
auugcacuccagccuggggaac

SEQ ID NO: 356583 - RNA, 22 nt, Homo sapiens
auugcacuccagucugggcaac

SEQ ID NO: 356584 - RNA, 18 nt, Homo sapiens
auugcacuccugccuggg

SEQ ID NO: 356585 - RNA, 22 nt, Homo sapiens
auugcagcccacccugggugau

SEQ ID NO: 356586 - RNA, 22 nt, Homo sapiens
auugcagcuugcagggugugua

SEQ ID NO: 356587 - RNA, 22 nt, Homo sapiens
auugcaguuagaacagaagucu

SEQ ID NO: 356588 - RNA, 22 nt, Homo sapiens
auuguacuccagccuaggcaac

SEQ ID NO: 356589 - RNA, 22 nt, Homo sapiens
auuguacuccagccugggcuaa

SEQ ID NO: 356590 - RNA, 22 nt, Homo sapiens
auuguacugccccccuguugcu

SEQ ID NO: 356591 - RNA, 22 nt, Homo sapiens
auuuugcauugcuguaaaggaa

SEQ ID NO: 356592 - RNA, 22 nt, Homo sapiens
caaaccuguaggggccaagagg

SEQ ID NO: 356593 - RNA, 22 nt, Homo sapiens
caaagcacuuggcuuggaagau

SEQ ID NO: 356594 - RNA, 22 nt, Homo sapiens
caaagugcugaaagaggccagg

SEQ ID NO: 356595 - RNA, 22 nt, Homo sapiens
caaagugcuggccgggcgcagu

SEQ ID NO: 356596 - RNA, 22 nt, Homo sapiens
caaggcacagccccuacuuccu

SEQ ID NO: 356597 - RNA, 22 nt, Homo sapiens
caagugcuacagagaaaucuuu

SEQ ID NO: 356598 - RNA, 22 nt, Homo sapiens
caagugcuuucuuggggauuua

SEQ ID NO: 356599 - RNA, 22 nt, Homo sapiens
cacagcuagucaaugguagaca

SEQ ID NO: 356600 - RNA, 22 nt, Homo sapiens
cacagucuugcaauauugagau

SEQ ID NO: 356601 - RNA, 22 nt, Homo sapiens
cacaguguucauagccaucagg

SEQ ID NO: 356602 - RNA, 22 nt, Homo sapiens
cacauugaauuucugaugacaa

SEQ ID NO: 356603 - RNA, 22 nt, Homo sapiens
caccuguagucccagcugaggc

SEQ ID NO: 356604 - RNA, 22 nt, Homo sapiens
cagaaguauugguaugcucugu

SEQ ID NO: 356605 - RNA, 22 nt, Homo sapiens
cagcaaaucauccuauuugagc

SEQ ID NO: 356606 - RNA, 22 nt, Homo sapiens
cagcaucauucaucugggguaa

SEQ ID NO: 356607 - RNA, 20 nt, Homo sapiens
cagggcaaugaggagguaaa

SEQ ID NO: 356608 - RNA, 22 nt, Homo sapiens
caggguccccuaccuuuugaug

SEQ ID NO: 356609 - RNA, 22 nt, Homo sapiens
cagucacagugacaggaugugg

SEQ ID NO: 356610 - RNA, 22 nt, Homo sapiens
cagugcauaggaucuaaaauuu

SEQ ID NO: 356611 - RNA, 22 nt, Homo sapiens
cagugcuuuaucaaguccucca

SEQ ID NO: 356612 - RNA, 22 nt, Homo sapiens
cagugguuuuuagcuugcuggg

SEQ ID NO: 356613 - RNA, 22 nt, Homo sapiens
cauacaugugcuugucuuaugc

SEQ ID NO: 356614 - RNA, 22 nt, Homo sapiens
cauaguacuugcauaguacuau

SEQ ID NO: 356615 - RNA, 22 nt, Homo sapiens
cugggaugauguaaauaggcua

SEQ ID NO: 356616 - RNA, 22 nt, Homo sapiens
cugucacugggaggggcagcag

SEQ ID NO: 356617 - RNA, 23 nt, Homo sapiens
cuguggauaugaguuguaaaugg

SEQ ID NO: 356618 - RNA, 20 nt, Homo sapiens
cuuaucaguggcaaguauaa

SEQ ID NO: 356619 - RNA, 22 nt, Homo sapiens
cuucaaguguggccaccugacc

SEQ ID NO: 356620 - RNA, 20 nt, Homo sapiens
cuucacagaaguggaaucau

SEQ ID NO: 356621 - RNA, 22 nt, Homo sapiens
cuugagcaaacaaaggugguag

SEQ ID NO: 356622 - RNA, 22 nt, Homo sapiens
cuugccuuugucuucaaaggcu

SEQ ID NO: 356623 - RNA, 22 nt, Homo sapiens
cuuuacaguuggacucacgagg

SEQ ID NO: 356624 - RNA, 22 nt, Homo sapiens
cuuuaguugucuccucaagggu

SEQ ID NO: 356625 - RNA, 21 nt, Homo sapiens
cuuugguagaguuuuuagggu

SEQ ID NO: 356626 - RNA, 22 nt, Homo sapiens
cuuugguguauuuucagagacc

SEQ ID NO: 356627 - RNA, 22 nt, Homo sapiens
cuuugugcccuucugcccauca

SEQ ID NO: 356628 - RNA, 22 nt, Homo sapiens
cuuuguguaggugccucuggcu

SEQ ID NO: 356629 - RNA, 22 nt, Homo sapiens
cuuuuguggaucuucuguugcu

SEQ ID NO: 356630 - RNA, 22 nt, Homo sapiens
gaaagcuaaugacuuuggguga

SEQ ID NO: 356631 - RNA, 22 nt, Homo sapiens
gaaagugcugcaaggccaugca

SEQ ID NO: 356632 - RNA, 23 nt, Homo sapiens
gaaaugucuuagugaaauugcuu

SEQ ID NO: 356633 - RNA, 22 nt, Homo sapiens
gaaauguugauagugggcauug

SEQ ID NO: 356634 - RNA, 22 nt, Homo sapiens
gaacugggguuggguugcgaua

SEQ ID NO: 356635 - RNA, 22 nt, Homo sapiens
gaaucacaguuauuagagcagc

SEQ ID NO: 356636 - RNA, 22 nt, Homo sapiens
gaaucacugugguaucccaugc

SEQ ID NO: 356637 - RNA, 22 nt, Homo sapiens
gaaucauuguuucuaaguuugu

SEQ ID NO: 356638 - RNA, 17 nt, Homo sapiens
gacauaggaaaaggaga

SEQ ID NO: 356639 - RNA, 22 nt, Homo sapiens
gaccccuagagauaggaggaac

SEQ ID NO: 356640 - RNA, 22 nt, Homo sapiens
gaccugagagguacauguauuu

SEQ ID NO: 356641 - RNA, 20 nt, Homo sapiens
gacuucagaagcuucagagu

SEQ ID NO: 356642 - RNA, 22 nt, Homo sapiens
gagaacauuaauaguuaauuuu

SEQ ID NO: 356643 - RNA, 22 nt, Homo sapiens
gagaacauuuaagccacucagg

SEQ ID NO: 356644 - RNA, 21 nt, Homo sapiens
gagaaucuuuucagggcaaac

SEQ ID NO: 356645 - RNA, 20 nt, Homo sapiens
gagaccugagauucacucaa

SEQ ID NO: 356646 - RNA, 22 nt, Homo sapiens
gagacggagucacgcccuguca

SEQ ID NO: 356647 - RNA, 22 nt, Homo sapiens
gagacggagucucgcucugucg

SEQ ID NO: 356648 - RNA, 22 nt, Homo sapiens
gagacggagucuugcucuguug

SEQ ID NO: 356649 - RNA, 22 nt, Homo sapiens
gagacugagucuugcucuguca

SEQ ID NO: 356650 - RNA, 22 nt, Homo sapiens
gagagucacagugaauguggca

SEQ ID NO: 356651 - RNA, 22 nt, Homo sapiens
gagagugaaguuugcuaccugu

SEQ ID NO: 356652 - RNA, 22 nt, Homo sapiens
gagauauuuagaaauguguucu

SEQ ID NO: 356653 - RNA, 22 nt, Homo sapiens
gagaugaagugucaauaaggau

SEQ ID NO: 356654 - RNA, 22 nt, Homo sapiens
gagauuaauacacaucaaaugc

SEQ ID NO: 356655 - RNA, 22 nt, Homo sapiens
gagauucuucaauauuuauucu

SEQ ID NO: 356656 - RNA, 22 nt, Homo sapiens
gagcagacaugaggaccgcugg

SEQ ID NO: 356657 - RNA, 22 nt, Homo sapiens
gagcuccuccccuuggcuuuca

SEQ ID NO: 356658 - RNA, 22 nt, Homo sapiens
gagcugaauugcugccauuugc

SEQ ID NO: 356659 - RNA, 22 nt, Homo sapiens
gagcuggacuucuuaccuuuuc

SEQ ID NO: 356660 - RNA, 22 nt, Homo sapiens
gagcuuggguuaaaguugccuu

SEQ ID NO: 356661 - RNA, 22 nt, Homo sapiens
gaggagauauucugcuggaugg

SEQ ID NO: 356662 - RNA, 22 nt, Homo sapiens
gaggcaguguguccguucucgg

SEQ ID NO: 356663 - RNA, 22 nt, Homo sapiens
gagguaagaaagucaguccuuc

SEQ ID NO: 356664 - RNA, 22 nt, Homo sapiens
gagguaagaugauucguguccu

SEQ ID NO: 356665 - RNA, 22 nt, Homo sapiens
gagguagguacaauugccacca

SEQ ID NO: 356666 - RNA, 22 nt, Homo sapiens
gaggucauguggcaggcagcca

SEQ ID NO: 356667 - RNA, 22 nt, Homo sapiens
gaggucauucugugguacccag

SEQ ID NO: 356668 - RNA, 22 nt, Homo sapiens
gagguguagucaugccaagauc

SEQ ID NO: 356669 - RNA, 22 nt, Homo sapiens
gagugcaauggugcuaucucgg

SEQ ID NO: 356670 - RNA, 22 nt, Homo sapiens
gaguggugguucugaaacuuuu

SEQ ID NO: 356671 - RNA, 22 nt, Homo sapiens
gaguuuguaaacuauucacuaa

SEQ ID NO: 356672 - RNA, 22 nt, Homo sapiens
gaugaacugucuuacuacucac

SEQ ID NO: 356673 - RNA, 22 nt, Homo sapiens
gaugcaguaagaaugcauagcg

SEQ ID NO: 356674 - RNA, 22 nt, Homo sapiens
gauggauuuuuuaggcagagcu

SEQ ID NO: 356675 - RNA, 22 nt, Homo sapiens
gauggcauuucuggaucugaca

SEQ ID NO: 356676 - RNA, 22 nt, Homo sapiens
gauuccacuuucaaauucaaau

SEQ ID NO: 356677 - RNA, 22 nt, Homo sapiens
gcaaagaaugcagauuugccuc

SEQ ID NO: 356678 - RNA, 20 nt, Homo sapiens
gcaaaguuuagcucccacua

SEQ ID NO: 356679 - RNA, 22 nt, Homo sapiens
gcaagacaugucuaagguuuaa

SEQ ID NO: 356680 - RNA, 22 nt, Homo sapiens
gcaagagguaucuuauuuuccc

SEQ ID NO: 356681 - RNA, 22 nt, Homo sapiens
gcagcagugcccuggauggaaa

SEQ ID NO: 356682 - RNA, 22 nt, Homo sapiens
gcaguauuguugaaauguccau

SEQ ID NO: 356683 - RNA, 22 nt, Homo sapiens
gcauggaguggaaauucuuggg

SEQ ID NO: 356684 - RNA, 22 nt, Homo sapiens
gcauugcacuuggcauagacug

SEQ ID NO: 356685 - RNA, 22 nt, Homo sapiens
gccauugcacuccagccucggg

SEQ ID NO: 356686 - RNA, 22 nt, Homo sapiens
gcccugagauucuuggauucug

SEQ ID NO: 356687 - RNA, 22 nt, Homo sapiens
gcccuuugugucuggcuggggu

SEQ ID NO: 356688 - RNA, 22 nt, Homo sapiens
gccugagaggauaugauccccu

SEQ ID NO: 356689 - RNA, 22 nt, Homo sapiens
gcuaaggcaggagcauugcuug

SEQ ID NO: 356690 - RNA, 22 nt, Homo sapiens
gcuaggagauccacugcucucu

SEQ ID NO: 356691 - RNA, 22 nt, Homo sapiens
gcugacagugguuauacuuaga

SEQ ID NO: 356692 - RNA, 22 nt, Homo sapiens
gcugcacuuuaaggcauccccu

SEQ ID NO: 356693 - RNA, 22 nt, Homo sapiens
gcuggauguuucaauacaaaua

SEQ ID NO: 356694 - RNA, 22 nt, Homo sapiens
gcuggguucagagugggcugcg

SEQ ID NO: 356695 - RNA, 22 nt, Homo sapiens
gcuguaguugaggauuuuaaga

SEQ ID NO: 356696 - RNA, 23 nt, Homo sapiens
ggaaacauccagucuuucaccau

SEQ ID NO: 356697 - RNA, 22 nt, Homo sapiens
ggaaaguaacccauucucuuac

SEQ ID NO: 356698 - RNA, 18 nt, Homo sapiens
ggaagauuggcuaugugc

SEQ ID NO: 356699 - RNA, 22 nt, Homo sapiens
ggagaucuuugaaguguugugc

SEQ ID NO: 356700 - RNA, 22 nt, Homo sapiens
ggaggcuaguaaaaagguagaa

SEQ ID NO: 356701 - RNA, 22 nt, Homo sapiens
ggauacaucuggacagccgaau

SEQ ID NO: 356702 - RNA, 23 nt, Homo sapiens
ggauggaaaguuuugagggccac

SEQ ID NO: 356703 - RNA, 22 nt, Homo sapiens
ggcaaagaugaccauuacuuuu

SEQ ID NO: 356704 - RNA, 22 nt, Homo sapiens
ggcaaaugaagauggagaggcu

SEQ ID NO: 356705 - RNA, 21 nt, Homo sapiens
ggcaagugugagguuuggggu

SEQ ID NO: 356706 - RNA, 22 nt, Homo sapiens
ggcaccauggaaggacgggagc

SEQ ID NO: 356707 - RNA, 22 nt, Homo sapiens
ggcagaauugcugaggaugcua

SEQ ID NO: 356708 - RNA, 22 nt, Homo sapiens
ggccagaugcaguggcucacac

SEQ ID NO: 356709 - RNA, 22 nt, Homo sapiens
ggccagaugcgguggcucacac

SEQ ID NO: 356710 - RNA, 22 nt, Homo sapiens
ggccuguaaacuagagacccug

SEQ ID NO: 356711 - RNA, 22 nt, Homo sapiens
ggcuuggaggaaugugagggcu

SEQ ID NO: 356712 - RNA, 22 nt, Homo sapiens
gggaagguaaucauuacuugau

SEQ ID NO: 356713 - RNA, 22 nt, Homo sapiens
gggaagugugcagaguucucuu

SEQ ID NO: 356714 - RNA, 22 nt, Homo sapiens
gggaguagagaguuucucugac

SEQ ID NO: 356715 - RNA, 22 nt, Homo sapiens
gggcaguauggucauuuucaca

SEQ ID NO: 356716 - RNA, 22 nt, Homo sapiens
gggcauaucacuugaggucagg

SEQ ID NO: 356717 - RNA, 23 nt, Homo sapiens
gggcuagaugagagcuuccuggg

SEQ ID NO: 356718 - RNA, 22 nt, Homo sapiens
ggggaauguuaaagaauuugca

SEQ ID NO: 356719 - RNA, 22 nt, Homo sapiens
ggucagugcauucuaaaggcaa

SEQ ID NO: 356720 - RNA, 22 nt, Homo sapiens
ggugagaaaaacauagucucag

SEQ ID NO: 356721 - RNA, 21 nt, Homo sapiens
ggugagaaaggagacauagac

SEQ ID NO: 356722 - RNA, 22 nt, Homo sapiens
ggugagaaagggauuccuguuc

SEQ ID NO: 356723 - RNA, 19 nt, Homo sapiens
ggugagaaauuaugggucu

SEQ ID NO: 356724 - RNA, 22 nt, Homo sapiens
ggugaucauugucucuaguaug

SEQ ID NO: 356725 - RNA, 22 nt, Homo sapiens
guaaauaccaguuucuggaaca

SEQ ID NO: 356726 - RNA, 22 nt, Homo sapiens
guaaaugcagaugcaugaccuu

SEQ ID NO: 356727 - RNA, 22 nt, Homo sapiens
guaaucucagcuacucaggagg

SEQ ID NO: 356728 - RNA, 19 nt, Homo sapiens
guaaucucaguacuuuggu

SEQ ID NO: 356729 - RNA, 22 nt, Homo sapiens
guacaggcagcaaacaccauaa

SEQ ID NO: 356730 - RNA, 22 nt, Homo sapiens
guaugaaaaucggagauugggu

SEQ ID NO: 356731 - RNA, 22 nt, Homo sapiens
gucaaagucuauuggcuaauuc

SEQ ID NO: 356732 - RNA, 22 nt, Homo sapiens
gucaaagugauuguaauuaggu

SEQ ID NO: 356733 - RNA, 22 nt, Homo sapiens
gucacagaaaaagauaugccaa

SEQ ID NO: 356734 - RNA, 22 nt, Homo sapiens
gucacaguguuuguucauccca

SEQ ID NO: 356735 - RNA, 22 nt, Homo sapiens
gucacauugaugcccauggugg

SEQ ID NO: 356736 - RNA, 22 nt, Homo sapiens
gucagggagggauagaugauua

SEQ ID NO: 356737 - RNA, 22 nt, Homo sapiens
gucagucugucccugccuggcg

SEQ ID NO: 356738 - RNA, 22 nt, Homo sapiens
gucccugcgauugugggauccu

SEQ ID NO: 356739 - RNA, 22 nt, Homo sapiens
guccuguuuuuaagguucauag

SEQ ID NO: 356740 - RNA, 22 nt, Homo sapiens
gucucacaggcaugaugccagc

SEQ ID NO: 356741 - RNA, 22 nt, Homo sapiens
gucucugagaugucaacaccua

SEQ ID NO: 356742 - RNA, 21 nt, Homo sapiens
gucugguguuuuaaugaggac

SEQ ID NO: 356743 - RNA, 22 nt, Homo sapiens
gucuuugaugucuaugugcuuc

SEQ ID NO: 356744 - RNA, 22 nt, Homo sapiens
gugaaauauuuaacguccaggu

SEQ ID NO: 356745 - RNA, 22 nt, Homo sapiens
gugaacaauguuuuauccuggg

SEQ ID NO: 356746 - RNA, 22 nt, Homo sapiens
gugagauaaugucucauugugg

SEQ ID NO: 356747 - RNA, 22 nt, Homo sapiens
gugagauaucuagacuagggaa

SEQ ID NO: 356748 - RNA, 22 nt, Homo sapiens
gugaggcacugcugcuuuccag

SEQ ID NO: 356749 - RNA, 22 nt, Homo sapiens
gugcaaccaucaccacugacuc

SEQ ID NO: 356750 - RNA, 22 nt, Homo sapiens
gugcaaguguaauacagcuagg

SEQ ID NO: 356751 - RNA, 22 nt, Homo sapiens
gugcacaacaugcagguuuguu

SEQ ID NO: 356752 - RNA, 22 nt, Homo sapiens
gugcacaacaugcaguuuuguu

SEQ ID NO: 356753 - RNA, 22 nt, Homo sapiens
gugcacauauggugcauaagug

SEQ ID NO: 356754 - RNA, 22 nt, Homo sapiens
gugcacauuguuuaugucuguu

SEQ ID NO: 356755 - RNA, 21 nt, Homo sapiens
gugcagaugccacagucacuc

SEQ ID NO: 356756 - RNA, 22 nt, Homo sapiens
gugcauacgucuuuauaguagc

SEQ ID NO: 356757 - RNA, 22 nt, Homo sapiens
gugccuuuucugagcaaugagc

SEQ ID NO: 356758 - RNA, 22 nt, Homo sapiens
gugcuuguguuaauauguagcu

SEQ ID NO: 356759 - RNA, 22 nt, Homo sapiens
guggaagguaaugcagcuuacu

SEQ ID NO: 356760 - RNA, 22 nt, Homo sapiens
guggaaguguaaaagcucuugg

SEQ ID NO: 356761 - RNA, 22 nt, Homo sapiens
gugguacuaucuuugguuucag

SEQ ID NO: 356762 - RNA, 22 nt, Homo sapiens
guggucagaaaucucaguggca

SEQ ID NO: 356763 - RNA, 22 nt, Homo sapiens
guguaaaucugcugugaacauu

SEQ ID NO: 356764 - RNA, 22 nt, Homo sapiens
guguauauccuauuaguucugu

SEQ ID NO: 356765 - RNA, 22 nt, Homo sapiens
guguaugugagaaugcucaugu

SEQ ID NO: 356766 - RNA, 19 nt, Homo sapiens
gugugcauaucacagagca

SEQ ID NO: 356767 - RNA, 22 nt, Homo sapiens
guuaugcagcaauugauaaucu

SEQ ID NO: 356768 - RNA, 22 nt, Homo sapiens
caaagugcuggaauuggccggg

SEQ ID NO: 356769 - RNA, 22 nt, Homo sapiens
caaauacuuucauguugucuug

SEQ ID NO: 356770 - RNA, 22 nt, Homo sapiens
caacacuguuuauuggauagcc

SEQ ID NO: 356771 - RNA, 22 nt, Homo sapiens
caacauccaccuccuggguuca

SEQ ID NO: 356772 - RNA, 22 nt, Homo sapiens
caagugcuugaugaaugaucaa

SEQ ID NO: 356773 - RNA, 22 nt, Homo sapiens
caauugcacucuuagguguaca

SEQ ID NO: 356774 - RNA, 22 nt, Homo sapiens
cacaaccuccgccuccuggguu

SEQ ID NO: 356775 - RNA, 22 nt, Homo sapiens
cacaaugucugguaggccacuu

SEQ ID NO: 356776 - RNA, 22 nt, Homo sapiens
cacagcuaacaacuguuucuuc

SEQ ID NO: 356777 - RNA, 22 nt, Homo sapiens
cacagggcuaacauuuuugccc

SEQ ID NO: 356778 - RNA, 22 nt, Homo sapiens
cacagugaaugucaucauugcc

SEQ ID NO: 356779 - RNA, 22 nt, Homo sapiens
cacaguguuccagcuauuugaa

SEQ ID NO: 356780 - RNA, 22 nt, Homo sapiens
caccacuacaccccaggcuggg

SEQ ID NO: 356781 - RNA, 22 nt, Homo sapiens
caccaggugcccagcacggcca

SEQ ID NO: 356782 - RNA, 16 nt, Homo sapiens
cacuggucuuaccaug

SEQ ID NO: 356783 - RNA, 22 nt, Homo sapiens
cagauaguuguagauaugcagc

SEQ ID NO: 356784 - RNA, 22 nt, Homo sapiens
cagcacauuacaaguacuuggu

SEQ ID NO: 356785 - RNA, 22 nt, Homo sapiens
caggaaugugaggguucccugc

SEQ ID NO: 356786 - RNA, 22 nt, Homo sapiens
caggaccucuugccuggaagcc

SEQ ID NO: 356787 - RNA, 22 nt, Homo sapiens
caggcaaggugaaguguacugg

SEQ ID NO: 356788 - RNA, 22 nt, Homo sapiens
cagguaguguguagcacagcag

SEQ ID NO: 356789 - RNA, 22 nt, Homo sapiens
caguacaauguugauuagaagu

SEQ ID NO: 356790 - RNA, 19 nt, Homo sapiens
caguaucauugcacauagu

SEQ ID NO: 356791 - RNA, 22 nt, Homo sapiens
cagugcuuguuauuguucuauu

SEQ ID NO: 356792 - RNA, 22 nt, Homo sapiens
caguggaugauguuuucugugg

SEQ ID NO: 356793 - RNA, 22 nt, Homo sapiens
caguguuuuuaacaggugcccg

SEQ ID NO: 356794 - RNA, 22 nt, Homo sapiens
caucacuuuuccuuuuacagau

SEQ ID NO: 356795 - RNA, 19 nt, Homo sapiens
caugccacugcacuugagu

SEQ ID NO: 356796 - RNA, 22 nt, Homo sapiens
cauggucaccuuccaaguuauu

SEQ ID NO: 356797 - RNA, 22 nt, Homo sapiens
caugucuuuuaaacauucaacu

SEQ ID NO: 356798 - RNA, 20 nt, Homo sapiens
cauuacacuccaaccugggu

SEQ ID NO: 356799 - RNA, 22 nt, Homo sapiens
cauuccacuggauaaacaaggu

SEQ ID NO: 356800 - RNA, 22 nt, Homo sapiens
cauugcaauccagccugggcaa

SEQ ID NO: 356801 - RNA, 19 nt, Homo sapiens
cauugcacuccacccuggg

SEQ ID NO: 356802 - RNA, 22 nt, Homo sapiens
cauugcacuccagccucggcaa

SEQ ID NO: 356803 - RNA, 20 nt, Homo sapiens
cauugcacuccagccugcug

SEQ ID NO: 356804 - RNA, 22 nt, Homo sapiens
cauugcacuccagccuggcaac

SEQ ID NO: 356805 - RNA, 22 nt, Homo sapiens
cauugcacuccagccuggccaa

SEQ ID NO: 356806 - RNA, 22 nt, Homo sapiens
cauugcacuccagccuuggcaa

SEQ ID NO: 356807 - RNA, 22 nt, Homo sapiens
cauugcacucuagccucggcaa

SEQ ID NO: 356808 - RNA, 22 nt, Homo sapiens
cauugcaugccagccugggcaa

SEQ ID NO: 356809 - RNA, 20 nt, Homo sapiens
cauugcccuccagccugggc

SEQ ID NO: 356810 - RNA, 22 nt, Homo sapiens
cauugcccuccagccugggcaa

SEQ ID NO: 356811 - RNA, 22 nt, Homo sapiens
cauugcuuuuggugguuuagac

SEQ ID NO: 356812 - RNA, 22 nt, Homo sapiens
cauuugcacugagacucagcuu

SEQ ID NO: 356813 - RNA, 22 nt, Homo sapiens
ccacagucuaugcaacaagguc

SEQ ID NO: 356814 - RNA, 22 nt, Homo sapiens
ccacaguggauuaaaguuacug

SEQ ID NO: 356815 - RNA, 18 nt, Homo sapiens
ccagugcaaggaaagccc

SEQ ID NO: 356816 - RNA, 22 nt, Homo sapiens
ccagugguucccuguggccuga

SEQ ID NO: 356817 - RNA, 21 nt, Homo sapiens
ccagugguuggaaacuauggg

SEQ ID NO: 356818 - RNA, 22 nt, Homo sapiens
ccagugguugggccggagacgg

SEQ ID NO: 356819 - RNA, 22 nt, Homo sapiens
ccauugcacuccagccuaggca

SEQ ID NO: 356820 - RNA, 22 nt, Homo sapiens
ccauuucacucuuccugaagga

SEQ ID NO: 356821 - RNA, 22 nt, Homo sapiens
ccccagguuucaauaaagccca

SEQ ID NO: 356822 - RNA, 22 nt, Homo sapiens
ccccagugguugcaacagcaga

SEQ ID NO: 356823 - RNA, 22 nt, Homo sapiens
ccccauuugaacuccuucaacu

SEQ ID NO: 356824 - RNA, 22 nt, Homo sapiens
cccgugucuuggucuagggccu

SEQ ID NO: 356825 - RNA, 22 nt, Homo sapiens
cccucgagaaaccaucugcuga

SEQ ID NO: 356826 - RNA, 22 nt, Homo sapiens
cccugagaugugaauuucagag

SEQ ID NO: 356827 - RNA, 21 nt, Homo sapiens
cccugguguuuggaguuugag

SEQ ID NO: 356828 - RNA, 22 nt, Homo sapiens
ccuggcacugagcaguguucua

SEQ ID NO: 356829 - RNA, 22 nt, Homo sapiens
ccuggguuacaggugugagcca

SEQ ID NO: 356830 - RNA, 22 nt, Homo sapiens
cggucacagugauucaaggguc

SEQ ID NO: 356831 - RNA, 20 nt, Homo sapiens
cguugcacuccagccugggc

SEQ ID NO: 356832 - RNA, 22 nt, Homo sapiens
cacacugucuucaauggguggu

SEQ ID NO: 356833 - RNA, 22 nt, Homo sapiens
cacacugucuuucagaaugguu

SEQ ID NO: 356834 - RNA, 22 nt, Homo sapiens
cacacuguuuuccauggggguu

SEQ ID NO: 356835 - RNA, 22 nt, Homo sapiens
cacagaauucauuggauuaccu

SEQ ID NO: 356836 - RNA, 23 nt, Homo sapiens
cacagggugaacaccccuaaucc

SEQ ID NO: 356837 - RNA, 22 nt, Homo sapiens
cacaguagaauagagcacuagg

SEQ ID NO: 356838 - RNA, 23 nt, Homo sapiens
caccaguauaauuagcuuuuaaa

SEQ ID NO: 356839 - RNA, 22 nt, Homo sapiens
cacucaguuugugguacuuugu

SEQ ID NO: 356840 - RNA, 22 nt, Homo sapiens
cacuggucagugaaacaguauu

SEQ ID NO: 356841 - RNA, 22 nt, Homo sapiens
cacuggucucauggcaugagag

SEQ ID NO: 356842 - RNA, 22 nt, Homo sapiens
cacugugcaaccuccaccuccc

SEQ ID NO: 356843 - RNA, 22 nt, Homo sapiens
cagagaaugucuuuuuuaacca

SEQ ID NO: 356844 - RNA, 22 nt, Homo sapiens
cagagucaagcucuuguuccau

SEQ ID NO: 356845 - RNA, 22 nt, Homo sapiens
cagaucaucuugagcuuaggaa

SEQ ID NO: 356846 - RNA, 22 nt, Homo sapiens
cagaugcaugaccugggcuugg

SEQ ID NO: 356847 - RNA, 22 nt, Homo sapiens
caggcagucuggggguguaucc

SEQ ID NO: 356848 - RNA, 19 nt, Homo sapiens
cagguagugugcugacaug

SEQ ID NO: 356849 - RNA, 22 nt, Homo sapiens
cagugacacugaaaaguucggg

SEQ ID NO: 356850 - RNA, 22 nt, Homo sapiens
cagugcauagaugugccacauu

SEQ ID NO: 356851 - RNA, 23 nt, Homo sapiens
cagugguguuagagaaaucuuuu

SEQ ID NO: 356852 - RNA, 22 nt, Homo sapiens
cagugucugcauuuggaacuca

SEQ ID NO: 356853 - RNA, 22 nt, Homo sapiens
caguuacuugacacaaccaauu

SEQ ID NO: 356854 - RNA, 22 nt, Homo sapiens
caucacacuuggauguaagaca

SEQ ID NO: 356855 - RNA, 22 nt, Homo sapiens
caucacaucugcaugguaagua

SEQ ID NO: 356856 - RNA, 22 nt, Homo sapiens
caucagauugagaucaucuaag

SEQ ID NO: 356857 - RNA, 22 nt, Homo sapiens
caucgcacuccagccugggcaa

SEQ ID NO: 356858 - RNA, 22 nt, Homo sapiens
caugcauuggucuauuauguga

SEQ ID NO: 356859 - RNA, 22 nt, Homo sapiens
cauguaguagaaggagccagac

SEQ ID NO: 356860 - RNA, 22 nt, Homo sapiens
cauguauagauuccauaguggu

SEQ ID NO: 356861 - RNA, 22 nt, Homo sapiens
cauuaagcuacuuagaaggugc

SEQ ID NO: 356862 - RNA, 22 nt, Homo sapiens
cauuacacuuguaagguuuuuc

SEQ ID NO: 356863 - RNA, 22 nt, Homo sapiens
agacaagauggcuugagguuca

SEQ ID NO: 356864 - RNA, 22 nt, Homo sapiens
agacagcugggaaauggagugu

SEQ ID NO: 356865 - RNA, 22 nt, Homo sapiens
agagagcuuuugguugcccuaa

SEQ ID NO: 356866 - RNA, 22 nt, Homo sapiens
agagagguggguggagccccca

SEQ ID NO: 356867 - RNA, 22 nt, Homo sapiens
agagaucacugaaucacggggg

SEQ ID NO: 356868 - RNA, 22 nt, Homo sapiens
agagaugauuaacauuuuggua

SEQ ID NO: 356869 - RNA, 22 nt, Homo sapiens
agagcacuguggguccaaauau

SEQ ID NO: 356870 - RNA, 22 nt, Homo sapiens
agagcuaguauuuacggagcau

SEQ ID NO: 356871 - RNA, 22 nt, Homo sapiens
agagguauuggaaggaguguca

SEQ ID NO: 356872 - RNA, 22 nt, Homo sapiens
agaucacucagguuucucccug

SEQ ID NO: 356873 - RNA, 22 nt, Homo sapiens
agcaacaucagcagcaggaaaa

SEQ ID NO: 356874 - RNA, 22 nt, Homo sapiens
agcaccauuagcguugggccgg

SEQ ID NO: 356875 - RNA, 22 nt, Homo sapiens
agcagcacaucccuuucuggcc

SEQ ID NO: 356876 - RNA, 22 nt, Homo sapiens
agcagcaugcaaauggacuaau

SEQ ID NO: 356877 - RNA, 22 nt, Homo sapiens
agcagcauggguauaaaucucc

SEQ ID NO: 356878 - RNA, 22 nt, Homo sapiens
agcaguacauaaaaagcauccu

SEQ ID NO: 356879 - RNA, 22 nt, Homo sapiens
agcauggucacuuugggcccca

SEQ ID NO: 356880 - RNA, 22 nt, Homo sapiens
agccuguagugagcugugauug

SEQ ID NO: 356881 - RNA, 22 nt, Homo sapiens
agccuguguugaauuauagaaa

SEQ ID NO: 356882 - RNA, 19 nt, Homo sapiens
agcuagugcucagcuguca

SEQ ID NO: 356883 - RNA, 22 nt, Homo sapiens
agcuagugugauucuuuggggu

SEQ ID NO: 356884 - RNA, 22 nt, Homo sapiens
agcuaguguucaccagagguca

SEQ ID NO: 356885 - RNA, 22 nt, Homo sapiens
agcuccuuugcuuuuuccagga

SEQ ID NO: 356886 - RNA, 16 nt, Homo sapiens
agcuggaauuacaggc

SEQ ID NO: 356887 - RNA, 22 nt, Homo sapiens
agcuggaauuuaagguagauag

SEQ ID NO: 356888 - RNA, 22 nt, Homo sapiens
agcuggcuguagcugcaagucu

SEQ ID NO: 356889 - RNA, 22 nt, Homo sapiens
agcuucauuguuaugaauguca

SEQ ID NO: 356890 - RNA, 22 nt, Homo sapiens
aggaagugucuucuuuuaggca

SEQ ID NO: 356891 - RNA, 22 nt, Homo sapiens
aggagaugaagcuuuaucuaaa

SEQ ID NO: 356892 - RNA, 22 nt, Homo sapiens
aggcaagugggagacagcauuu

SEQ ID NO: 356893 - RNA, 22 nt, Homo sapiens
aggcacacaacccuggaccuga

SEQ ID NO: 356894 - RNA, 22 nt, Homo sapiens
aggcagcuguuauauacugagu

SEQ ID NO: 356895 - RNA, 22 nt, Homo sapiens
aggcaugauggcuccagaucau

SEQ ID NO: 356896 - RNA, 22 nt, Homo sapiens
aggcauguggcucuguucugac

SEQ ID NO: 356897 - RNA, 22 nt, Homo sapiens
aggccaguuuuuggagggaaac

SEQ ID NO: 356898 - RNA, 22 nt, Homo sapiens
agguaagucucuaauuaugaau

SEQ ID NO: 356899 - RNA, 22 nt, Homo sapiens
agguaguguuauuugcagcuga

SEQ ID NO: 356900 - RNA, 22 nt, Homo sapiens
aguaaaucacuaauggcuuccg

SEQ ID NO: 356901 - RNA, 22 nt, Homo sapiens
aguaaauuucugugcuuucaua

SEQ ID NO: 356902 - RNA, 22 nt, Homo sapiens
aguacugucagcaggguguuga

SEQ ID NO: 356903 - RNA, 22 nt, Homo sapiens
aguacugucugguuaccugaca

SEQ ID NO: 356904 - RNA, 22 nt, Homo sapiens
agucaagauggcaagguaaggc

SEQ ID NO: 356905 - RNA, 22 nt, Homo sapiens
agucacagguucuugggauuag

SEQ ID NO: 356906 - RNA, 22 nt, Homo sapiens
agucacaugcauuuucuucaau

SEQ ID NO: 356907 - RNA, 22 nt, Homo sapiens
agucagucuguccugugcugag

SEQ ID NO: 356908 - RNA, 21 nt, Homo sapiens
agugagucauuuggaaagcaa

SEQ ID NO: 356909 - RNA, 22 nt, Homo sapiens
agugauggagccaggauuuaau

SEQ ID NO: 356910 - RNA, 22 nt, Homo sapiens
agugccuacuauguagaugcug

SEQ ID NO: 356911 - RNA, 22 nt, Homo sapiens
aguggauguuguggccugggag

SEQ ID NO: 356912 - RNA, 22 nt, Homo sapiens
agugguuugaucacagcucacu

SEQ ID NO: 356913 - RNA, 22 nt, Homo sapiens
aguuccuacuggcuguaaagaa

SEQ ID NO: 356914 - RNA, 22 nt, Homo sapiens
aguuggugauugauugggucug

SEQ ID NO: 356915 - RNA, 22 nt, Homo sapiens
auaaauaguaguugugguggcc

SEQ ID NO: 356916 - RNA, 22 nt, Homo sapiens
auaaaugcuuccagucauuaaa

SEQ ID NO: 356917 - RNA, 22 nt, Homo sapiens
auaauaccugccacauuugaau

SEQ ID NO: 356918 - RNA, 22 nt, Homo sapiens
auaauacuuuuauuuugaggaa

SEQ ID NO: 356919 - RNA, 22 nt, Homo sapiens
auacuagucaagaauguaugag

SEQ ID NO: 356920 - RNA, 22 nt, Homo sapiens
auagcacaugugcaaauggcug

SEQ ID NO: 356921 - RNA, 22 nt, Homo sapiens
auagcagacauuucaaggcagg

SEQ ID NO: 356922 - RNA, 22 nt, Homo sapiens
auaucacaaacaagucuguacu

SEQ ID NO: 356923 - RNA, 22 nt, Homo sapiens
aagcugccaggcaugguggcug

SEQ ID NO: 356924 - RNA, 22 nt, Homo sapiens
aaggaguguggugaucuugggc

SEQ ID NO: 356925 - RNA, 22 nt, Homo sapiens
aaggcuguucauuuagcacagu

SEQ ID NO: 356926 - RNA, 22 nt, Homo sapiens
aagggaaugcgcugccuguguu

SEQ ID NO: 356927 - RNA, 22 nt, Homo sapiens
aagggaaugugguagcugguuu

SEQ ID NO: 356928 - RNA, 22 nt, Homo sapiens
aagggaauguuguagcugguuu

SEQ ID NO: 356929 - RNA, 22 nt, Homo sapiens
aaguacuguuuaaauugcagaa

SEQ ID NO: 356930 - RNA, 22 nt, Homo sapiens
aaguaucaggaauaguuauugg

SEQ ID NO: 356931 - RNA, 20 nt, Homo sapiens
aagugcaucguugugucugc

SEQ ID NO: 356932 - RNA, 22 nt, Homo sapiens
aagugcuucagaagacaauauu

SEQ ID NO: 356933 - RNA, 20 nt, Homo sapiens
aagugcuuccuuuuagaggg

SEQ ID NO: 356934 - RNA, 22 nt, Homo sapiens
aagugcuuuuuagauaugguuu

SEQ ID NO: 356935 - RNA, 22 nt, Homo sapiens
aagugguguuugggagcuggac

SEQ ID NO: 356936 - RNA, 22 nt, Homo sapiens
aauaucuguguauagauggggg

SEQ ID NO: 356937 - RNA, 22 nt, Homo sapiens
aaucccuuuguccagucucuuu

SEQ ID NO: 356938 - RNA, 22 nt, Homo sapiens
aauggcagaugaaauugucauu

SEQ ID NO: 356939 - RNA, 22 nt, Homo sapiens
aauggcaucuacguuaaauguc

SEQ ID NO: 356940 - RNA, 22 nt, Homo sapiens
aauggcaucuagaguggugaau

SEQ ID NO: 356941 - RNA, 22 nt, Homo sapiens
aaugugcacuauuagggugaua

SEQ ID NO: 356942 - RNA, 22 nt, Homo sapiens
aauugcuucuguauuuuggaca

SEQ ID NO: 356943 - RNA, 22 nt, Homo sapiens
acaaagcuagggaauccaucuu

SEQ ID NO: 356944 - RNA, 22 nt, Homo sapiens
acacaaugguaaguguuugugu

SEQ ID NO: 356945 - RNA, 22 nt, Homo sapiens
acacugucugaugaaaguaguu

SEQ ID NO: 356946 - RNA, 22 nt, Homo sapiens
acacuuucuggagcugcacaua

SEQ ID NO: 356947 - RNA, 22 nt, Homo sapiens
acagcacugccaagugacccau

SEQ ID NO: 356948 - RNA, 20 nt, Homo sapiens
acagcacugguuucaagcaa

SEQ ID NO: 356949 - RNA, 22 nt, Homo sapiens
acaguacucugcucuuuugauu

SEQ ID NO: 356950 - RNA, 21 nt, Homo sapiens
acaguaguaauaguguagcca

SEQ ID NO: 356951 - RNA, 23 nt, Homo sapiens
acaguauguggauguggcuaagu

SEQ ID NO: 356952 - RNA, 22 nt, Homo sapiens
acagucacaauuuguaccuuuu

SEQ ID NO: 356953 - RNA, 22 nt, Homo sapiens
acagugcuguuguguuuucacg

SEQ ID NO: 356954 - RNA, 23 nt, Homo sapiens
acaguggugugaucuuggcucag

SEQ ID NO: 356955 - RNA, 22 nt, Homo sapiens
acaguguuccuuuguugugacu

SEQ ID NO: 356956 - RNA, 22 nt, Homo sapiens
acauaguagacacugaaaauau

SEQ ID NO: 356957 - RNA, 22 nt, Homo sapiens
acaucauugggggcuacaggug

SEQ ID NO: 356958 - RNA, 22 nt, Homo sapiens
acaugagacuggguuuguaggg

SEQ ID NO: 356959 - RNA, 22 nt, Homo sapiens
acaugcauccaugugaagagac

SEQ ID NO: 356960 - RNA, 22 nt, Homo sapiens
acauugcucuuaccaaguuugu

SEQ ID NO: 356961 - RNA, 22 nt, Homo sapiens
accacagugcuuccugcucacg

SEQ ID NO: 356962 - RNA, 22 nt, Homo sapiens
accaccacucccgcauucuaaa

SEQ ID NO: 356963 - RNA, 22 nt, Homo sapiens
acccagaauucagucuuaggcc

SEQ ID NO: 356964 - RNA, 22 nt, Homo sapiens
accccugagaucgaaucaugcu

SEQ ID NO: 356965 - RNA, 19 nt, Homo sapiens
accuguagaaaguacaaca

SEQ ID NO: 356966 - RNA, 23 nt, Homo sapiens
accugugguuauuuuacucuucc

SEQ ID NO: 356967 - RNA, 22 nt, Homo sapiens
acucacagcaaccuccgccucc

SEQ ID NO: 356968 - RNA, 22 nt, Homo sapiens
acugagaucuuuaaauaaauaa

SEQ ID NO: 356969 - RNA, 22 nt, Homo sapiens
acugagucauugggugcccaga

SEQ ID NO: 356970 - RNA, 22 nt, Homo sapiens
acuuaguauggggcuuuugaga

SEQ ID NO: 356971 - RNA, 22 nt, Homo sapiens
acuucauucucuggaucagaau

SEQ ID NO: 356972 - RNA, 22 nt, Homo sapiens
acuuuuguuauacagugugaua

SEQ ID NO: 356973 - RNA, 22 nt, Homo sapiens
agaaacauucucuugccuccuu

SEQ ID NO: 356974 - RNA, 22 nt, Homo sapiens
agacagcuggaguaucauagcu

SEQ ID NO: 356975 - RNA, 22 nt, Homo sapiens
agacccuguauguguuuaguuu

SEQ ID NO: 356976 - RNA, 22 nt, Homo sapiens
agagauaaagauuuuaauuuug

SEQ ID NO: 356977 - RNA, 22 nt, Homo sapiens
agagauaauuagguuaaaugag

SEQ ID NO: 356978 - RNA, 22 nt, Homo sapiens
agagaucaacugaauuacugga

SEQ ID NO: 356979 - RNA, 22 nt, Homo sapiens
agagugaagcuuuuuauauucu

SEQ ID NO: 356980 - RNA, 22 nt, Homo sapiens
agauacaucuaugugucugugu

SEQ ID NO: 356981 - RNA, 22 nt, Homo sapiens
agauauuuguuaggucugucag

SEQ ID NO: 356982 - RNA, 22 nt, Homo sapiens
agauguuguucaucugauuguu

SEQ ID NO: 356983 - RNA, 22 nt, Homo sapiens
agcaacauagaaauuugggugg

SEQ ID NO: 356984 - RNA, 22 nt, Homo sapiens
agcaagauccagucgcacagga

SEQ ID NO: 356985 - RNA, 22 nt, Homo sapiens
agcagcaucgggaaguuggcca

SEQ ID NO: 356986 - RNA, 22 nt, Homo sapiens
agcagcaugaggggacuucugc

SEQ ID NO: 356987 - RNA, 22 nt, Homo sapiens
agcagcauuaguggaaucuugu

SEQ ID NO: 356988 - RNA, 22 nt, Homo sapiens
agcagcauuaugauauaucuua

SEQ ID NO: 356989 - RNA, 22 nt, Homo sapiens
agcaggacaauaugggaucagg

SEQ ID NO: 356990 - RNA, 22 nt, Homo sapiens
agcaguagugaaaguagacuua

SEQ ID NO: 356991 - RNA, 22 nt, Homo sapiens
agcaucacaugggcugcuuggg

SEQ ID NO: 356992 - RNA, 22 nt, Homo sapiens
agccaguauuuccacagagugg

SEQ ID NO: 356993 - RNA, 22 nt, Homo sapiens
agccccauuuguugaaaagacg

SEQ ID NO: 356994 - RNA, 22 nt, Homo sapiens
agcgccauugcacuccagccuu

SEQ ID NO: 356995 - RNA, 22 nt, Homo sapiens
agcucacagccuagcacuguga

SEQ ID NO: 356996 - RNA, 22 nt, Homo sapiens
agcuuguuuucccauaacuaga

SEQ ID NO: 356997 - RNA, 22 nt, Homo sapiens
agcuuuuugggcagcuauugac

SEQ ID NO: 356998 - RNA, 22 nt, Homo sapiens
aggaagguaaacuaacuugccu

SEQ ID NO: 356999 - RNA, 23 nt, Homo sapiens
aggaauggaaaaccaaguaucau

SEQ ID NO: 357000 - RNA, 22 nt, Homo sapiens
aggaauggaaacuuuugauggu

SEQ ID NO: 357001 - RNA, 22 nt, Homo sapiens
aggacacugagcaugggagguu

SEQ ID NO: 357002 - RNA, 20 nt, Homo sapiens
aggacuacagaggguaggau

SEQ ID NO: 357003 - RNA, 22 nt, Homo sapiens
aggagguaggaauugugcuagg

SEQ ID NO: 357004 - RNA, 21 nt, Homo sapiens
aggcaagacuuuuagguuugu

SEQ ID NO: 357005 - RNA, 21 nt, Homo sapiens
aggcaagauuacuuacgagca

SEQ ID NO: 357006 - RNA, 22 nt, Homo sapiens
aggcaaugugagaguuuauuca

SEQ ID NO: 357007 - RNA, 22 nt, Homo sapiens
aggcagaugagguccucagcug

SEQ ID NO: 357008 - RNA, 22 nt, Homo sapiens
aggcaugugugcagacugucug

SEQ ID NO: 357009 - RNA, 19 nt, Homo sapiens
aggcauugugcucaucugu

SEQ ID NO: 357010 - RNA, 23 nt, Homo sapiens
aggccaguuuuuccugcuugcug

SEQ ID NO: 357011 - RNA, 21 nt, Homo sapiens
aggucaguaagaaugcagcac

SEQ ID NO: 357012 - RNA, 22 nt, Homo sapiens
agucaacaucaugaaguggaaa

SEQ ID NO: 357013 - RNA, 22 nt, Homo sapiens
aguccaguguuaugaucaguag

SEQ ID NO: 357014 - RNA, 22 nt, Homo sapiens
agugagcugcagucuggggucc

SEQ ID NO: 357015 - RNA, 22 nt, Homo sapiens
agugcaauaaggauguagaacu

SEQ ID NO: 357016 - RNA, 22 nt, Homo sapiens
agugcaaugauccggugcuggg

SEQ ID NO: 357017 - RNA, 22 nt, Homo sapiens
guggaggacuggauaaagaaaa

SEQ ID NO: 357018 - RNA, 22 nt, Homo sapiens
guggcuuuaaguacgauugagg

SEQ ID NO: 357019 - RNA, 22 nt, Homo sapiens
guggcuuuauuuagaagcaggg

SEQ ID NO: 357020 - RNA, 22 nt, Homo sapiens
gugggguaggguaggacucaac

SEQ ID NO: 357021 - RNA, 21 nt, Homo sapiens
gugucacagacaugacagaug

SEQ ID NO: 357022 - RNA, 22 nt, Homo sapiens
gugucucagcccagaccuauuu

SEQ ID NO: 357023 - RNA, 18 nt, Homo sapiens
gugucugguuaugggagu

SEQ ID NO: 357024 - RNA, 22 nt, Homo sapiens
guuacagucuuguguaagguua

SEQ ID NO: 357025 - RNA, 22 nt, Homo sapiens
guuagugcuuauuaaauaguau

SEQ ID NO: 357026 - RNA, 22 nt, Homo sapiens
guuauguguuuccuuaauugcu

SEQ ID NO: 357027 - RNA, 22 nt, Homo sapiens
guucaagcaauucugcugccuc

SEQ ID NO: 357028 - RNA, 22 nt, Homo sapiens
guugcaauugauguaugucuga

SEQ ID NO: 357029 - RNA, 22 nt, Homo sapiens
uaaagcuuagauccaugguggc

SEQ ID NO: 357030 - RNA, 22 nt, Homo sapiens
uaacaagagagucagucagucc

SEQ ID NO: 357031 - RNA, 19 nt, Homo sapiens
uaacacaguuguguuugag

SEQ ID NO: 357032 - RNA, 22 nt, Homo sapiens
uaacauucacaugcugcaaaaa

SEQ ID NO: 357033 - RNA, 22 nt, Homo sapiens
uaaggaaggcugugugcuuuua

SEQ ID NO: 357034 - RNA, 22 nt, Homo sapiens
uaaggcacucuucugugugccu

SEQ ID NO: 357035 - RNA, 22 nt, Homo sapiens
uaagugcuugacuuugauguuu

SEQ ID NO: 357036 - RNA, 18 nt, Homo sapiens
uaagugcuuuaaacacau

SEQ ID NO: 357037 - RNA, 22 nt, Homo sapiens
uaaguuagugugagaauuuugc

SEQ ID NO: 357038 - RNA, 22 nt, Homo sapiens
uaaguucauucaugaaacuuag

SEQ ID NO: 357039 - RNA, 22 nt, Homo sapiens
uaaucucagcuacucaggaggc

SEQ ID NO: 357040 - RNA, 22 nt, Homo sapiens
uaaugcaucagugguaguucuu

SEQ ID NO: 357041 - RNA, 22 nt, Homo sapiens
uaaugcaucaugguuggcaaac

SEQ ID NO: 357042 - RNA, 22 nt, Homo sapiens
uacaaagcuuucugcaaaucau

SEQ ID NO: 357043 - RNA, 21 nt, Homo sapiens
uacaaugcacaggagagccuc

SEQ ID NO: 357044 - RNA, 22 nt, Homo sapiens
uacagaguagaagauuugcaga

SEQ ID NO: 357045 - RNA, 22 nt, Homo sapiens
uacagcuaugugcaugcaugcu

SEQ ID NO: 357046 - RNA, 22 nt, Homo sapiens
uacauacuucacagacuuuaaa

SEQ ID NO: 357047 - RNA, 19 nt, Homo sapiens
uacaugcagcaggcacgca

SEQ ID NO: 357048 - RNA, 22 nt, Homo sapiens
uacauguauccauuguuuuugg

SEQ ID NO: 357049 - RNA, 22 nt, Homo sapiens
uaccugagucuagagucuagaa

SEQ ID NO: 357050 - RNA, 22 nt, Homo sapiens
uacgccuguaauaucagcauuu

SEQ ID NO: 357051 - RNA, 22 nt, Homo sapiens
uacucaguagacacucauaugu

SEQ ID NO: 357052 - RNA, 22 nt, Homo sapiens
uacuuuguagagugugagaauu

SEQ ID NO: 357053 - RNA, 22 nt, Homo sapiens
uacuuuguuauagcagcaggaa

SEQ ID NO: 357054 - RNA, 22 nt, Homo sapiens
uagaauggaagguugagaagaa

SEQ ID NO: 357055 - RNA, 22 nt, Homo sapiens
uagaauguaaauuccaagggca

SEQ ID NO: 357056 - RNA, 22 nt, Homo sapiens
uagaauguaacuuccaugucau

SEQ ID NO: 357057 - RNA, 21 nt, Homo sapiens
uagagagcaauaccuccagag

SEQ ID NO: 357058 - RNA, 22 nt, Homo sapiens
uagagcacauuaucauuuccaa

SEQ ID NO: 357059 - RNA, 22 nt, Homo sapiens
uagagccauugcagauguuuga

SEQ ID NO: 357060 - RNA, 22 nt, Homo sapiens
uagagcuaguugcucacugcuu

SEQ ID NO: 357061 - RNA, 22 nt, Homo sapiens
uagauucauuuuagcaaaaguu

SEQ ID NO: 357062 - RNA, 23 nt, Homo sapiens
uagcaacaguuggaggugaggua

SEQ ID NO: 357063 - RNA, 22 nt, Homo sapiens
uagcagcaccccacucuacugg

SEQ ID NO: 357064 - RNA, 22 nt, Homo sapiens
uaggaaugaacgauuuauuggu

SEQ ID NO: 357065 - RNA, 19 nt, Homo sapiens
uaggacccugguggccccc

SEQ ID NO: 357066 - RNA, 22 nt, Homo sapiens
uaggagcacaaaccccauugug

SEQ ID NO: 357067 - RNA, 22 nt, Homo sapiens
uagggaguuuuggggugcagaa

SEQ ID NO: 357068 - RNA, 22 nt, Homo sapiens
uagguaaguaauauacagauga

SEQ ID NO: 357069 - RNA, 22 nt, Homo sapiens
uaguacuggcauguauuuccca

SEQ ID NO: 357070 - RNA, 22 nt, Homo sapiens
uagugcuguaauucuaaugaaa

SEQ ID NO: 357071 - RNA, 22 nt, Homo sapiens
uagugcugugauauuuuuggcc

SEQ ID NO: 357072 - RNA, 18 nt, Homo sapiens
uagugcuguucucaugau

SEQ ID NO: 357073 - RNA, 22 nt, Homo sapiens
uaguggauguucagagauuuga

SEQ ID NO: 357074 - RNA, 22 nt, Homo sapiens
uaguguuuuucauuggcagagg

SEQ ID NO: 357075 - RNA, 20 nt, Homo sapiens
uaguuggugauacagugcau

SEQ ID NO: 357076 - RNA, 22 nt, Homo sapiens
uaguuuaucuucuggauggaca

SEQ ID NO: 357077 - RNA, 22 nt, Homo sapiens
uauacaugugggcaucaggaga

SEQ ID NO: 357078 - RNA, 22 nt, Homo sapiens
uauagcuugauuauggugaugg

SEQ ID NO: 357079 - RNA, 22 nt, Homo sapiens
uauaucuguccauggcccugcu

SEQ ID NO: 357080 - RNA, 22 nt, Homo sapiens
uauaugcaacauaguguaugug

SEQ ID NO: 357081 - RNA, 22 nt, Homo sapiens
uauauguucuugcacuggaaag

SEQ ID NO: 357082 - RNA, 22 nt, Homo sapiens
uaucacagcauugucuauaaua

SEQ ID NO: 357083 - RNA, 19 nt, Homo sapiens
uaucacuucccuggaaaca

SEQ ID NO: 357084 - RNA, 21 nt, Homo sapiens
uaucagagacauugagaggca

SEQ ID NO: 357085 - RNA, 22 nt, Homo sapiens
uaucagcagagucauacuucaa

SEQ ID NO: 357086 - RNA, 22 nt, Homo sapiens
uaucaucauguuuuugcugugu

SEQ ID NO: 357087 - RNA, 21 nt, Homo sapiens
uaucauggugaaacccugucu

SEQ ID NO: 357088 - RNA, 18 nt, Homo sapiens
uaucauguagggaaguug

SEQ ID NO: 357089 - RNA, 22 nt, Homo sapiens
uaucccaauguaauaucacaaa

SEQ ID NO: 357090 - RNA, 22 nt, Homo sapiens
uaugacuuuugaauacagaugg

SEQ ID NO: 357091 - RNA, 22 nt, Homo sapiens
uaugagguagguaugacuauca

SEQ ID NO: 357092 - RNA, 22 nt, Homo sapiens
uaugcccauuuaaauugaacaa

SEQ ID NO: 357093 - RNA, 22 nt, Homo sapiens
uaugcuuauuaaaacagugugu

SEQ ID NO: 357094 - RNA, 22 nt, Homo sapiens
uauggauguuaagguucacagc

SEQ ID NO: 357095 - RNA, 21 nt, Homo sapiens
uauggauuugccuauucugga

SEQ ID NO: 357096 - RNA, 22 nt, Homo sapiens
uauggguuuauuucuggucuca

SEQ ID NO: 357097 - RNA, 22 nt, Homo sapiens
uauggguuuuugucuguuuacu

SEQ ID NO: 357098 - RNA, 20 nt, Homo sapiens
uauuacagaguaauggugga

SEQ ID NO: 357099 - RNA, 22 nt, Homo sapiens
uauucacuguaucauugauggg

SEQ ID NO: 357100 - RNA, 18 nt, Homo sapiens
uauuccucuuccucuauc

SEQ ID NO: 357101 - RNA, 22 nt, Homo sapiens
uauugaacgugggauauugaag

SEQ ID NO: 357102 - RNA, 22 nt, Homo sapiens
uauugcaauuggcagagugcua

SEQ ID NO: 357103 - RNA, 22 nt, Homo sapiens
uauugcuuaugaugcugaauua

SEQ ID NO: 357104 - RNA, 22 nt, Homo sapiens
uauugcuugaggaaaugguaau

SEQ ID NO: 357105 - RNA, 22 nt, Homo sapiens
uauugcuuuugauucaaggcag

SEQ ID NO: 357106 - RNA, 22 nt, Homo sapiens
uauuguuaaagauguuaaugau

SEQ ID NO: 357107 - RNA, 22 nt, Homo sapiens
uauuucaguugcguuucccgag

SEQ ID NO: 357108 - RNA, 22 nt, Homo sapiens
uauuuggugaaugaaugcaugu

SEQ ID NO: 357109 - RNA, 22 nt, Homo sapiens
ucaaacugucagguugaccaga

SEQ ID NO: 357110 - RNA, 22 nt, Homo sapiens
ucaaagugacaaaguugcagca

SEQ ID NO: 357111 - RNA, 22 nt, Homo sapiens
ucaaaugcacguagagaaaaua

SEQ ID NO: 357112 - RNA, 22 nt, Homo sapiens
uuggcauuuuggacacccagga

SEQ ID NO: 357113 - RNA, 22 nt, Homo sapiens
uuggccauaugacuugcuuugg

SEQ ID NO: 357114 - RNA, 22 nt, Homo sapiens
uuggucacugacauguuugaaa

SEQ ID NO: 357115 - RNA, 22 nt, Homo sapiens
uuggucaucucccuccuuuuag

SEQ ID NO: 357116 - RNA, 22 nt, Homo sapiens
uuguaaagucugucucagucag

SEQ ID NO: 357117 - RNA, 22 nt, Homo sapiens
uuguaaaguucucucccgaaaa

SEQ ID NO: 357118 - RNA, 22 nt, Homo sapiens
uugugaauggugcugcaguaaa

SEQ ID NO: 357119 - RNA, 22 nt, Homo sapiens
uugugauugagugauccuuguu

SEQ ID NO: 357120 - RNA, 22 nt, Homo sapiens
uugugcaugaugcauacauggu

SEQ ID NO: 357121 - RNA, 22 nt, Homo sapiens
uugugcuucaucaccuagcaga

SEQ ID NO: 357122 - RNA, 22 nt, Homo sapiens
uugugcuugauuugccuagcug

SEQ ID NO: 357123 - RNA, 22 nt, Homo sapiens
uuguuugguugaguauggaagu

SEQ ID NO: 357124 - RNA, 22 nt, Homo sapiens
uuuaacauuggaugagaucguc

SEQ ID NO: 357125 - RNA, 22 nt, Homo sapiens
uuuaaugcgucucugaguuuug

SEQ ID NO: 357126 - RNA, 22 nt, Homo sapiens
uuuacagucuuuugugugaguc

SEQ ID NO: 357127 - RNA, 22 nt, Homo sapiens
uuuacaguuuucuaggcuacca

SEQ ID NO: 357128 - RNA, 22 nt, Homo sapiens
uuucacaguguucucccccaga

SEQ ID NO: 357129 - RNA, 22 nt, Homo sapiens
uuucauagccuucuaaugaguu

SEQ ID NO: 357130 - RNA, 19 nt, Homo sapiens
uuucauguuuuuggugaga

SEQ ID NO: 357131 - RNA, 22 nt, Homo sapiens
uuucccuuuagcuuagugauuu

SEQ ID NO: 357132 - RNA, 22 nt, Homo sapiens
uuucugggggugcugauggaaa

SEQ ID NO: 357133 - RNA, 22 nt, Homo sapiens
uuugaagacuacugggagugaa

SEQ ID NO: 357134 - RNA, 22 nt, Homo sapiens
uuugaauguaaugagcaggaag

SEQ ID NO: 357135 - RNA, 22 nt, Homo sapiens
uuugcacuuuaauauaauguga

SEQ ID NO: 357136 - RNA, 22 nt, Homo sapiens
uuugcagugucagcuucugugu

SEQ ID NO: 357137 - RNA, 22 nt, Homo sapiens
uuugcugagucauuccaugcug

SEQ ID NO: 357138 - RNA, 22 nt, Homo sapiens
uuugcugagucugacuucaugg

SEQ ID NO: 357139 - RNA, 22 nt, Homo sapiens
uuuguacacuguuggugguuau

SEQ ID NO: 357140 - RNA, 22 nt, Homo sapiens
uuuguacuugaagaaucuuuau

SEQ ID NO: 357141 - RNA, 18 nt, Homo sapiens
uuuguacuuuuucuaaug

SEQ ID NO: 357142 - RNA, 21 nt, Homo sapiens
uuuguaguagcaugauuuaua

SEQ ID NO: 357143 - RNA, 22 nt, Homo sapiens
uuuguccugccaugguuuauuu

SEQ ID NO: 357144 - RNA, 22 nt, Homo sapiens
uuugugcuaacuuuaacucuua

SEQ ID NO: 357145 - RNA, 16 nt, Homo sapiens
uuugugugugacgaga

SEQ ID NO: 357146 - RNA, 20 nt, Homo sapiens
uuuuagcuuuuauugaaagc

SEQ ID NO: 357147 - RNA, 22 nt, Homo sapiens
uuuugcaguuacagagagugag

SEQ ID NO: 357148 - RNA, 22 nt, Homo sapiens
uuuugcucuugguaaugaaaga

SEQ ID NO: 357149 - RNA, 22 nt, Homo sapiens
uuuugguaaugaacuuaggaag

SEQ ID NO: 357150 - RNA, 22 nt, Homo sapiens
uuuugguauacacaaggguccu

SEQ ID NO: 357151 - RNA, 22 nt, Homo sapiens
uuuugguauauacggggguccu

SEQ ID NO: 357152 - RNA, 21 nt, Homo sapiens
uuuuggucauucaggaagaaa

SEQ ID NO: 357153 - RNA, 16 nt, Homo sapiens
uuuuugcagaaaugac

SEQ ID NO: 357154 - RNA, 22 nt, Homo sapiens
uuuuuuaguuagcugggcauga

SEQ ID NO: 357155 - RNA, 22 nt, Homo sapiens
gugaggaaggaaaccugcuagc

SEQ ID NO: 357156 - RNA, 22 nt, Homo sapiens
gugaggcugguccugccuccca

SEQ ID NO: 357157 - RNA, 22 nt, Homo sapiens
gugagucaaucugagggguuca

SEQ ID NO: 357158 - RNA, 22 nt, Homo sapiens
gugagucaugucccaucugauu

SEQ ID NO: 357159 - RNA, 20 nt, Homo sapiens
gugagucauuaguaaccaaa

SEQ ID NO: 357160 - RNA, 22 nt, Homo sapiens
guggcagcacauauagguuguu

SEQ ID NO: 357161 - RNA, 22 nt, Homo sapiens
gugggagugucccguuuuucca

SEQ ID NO: 357162 - RNA, 22 nt, Homo sapiens
gugucacuguugagaaguccac

SEQ ID NO: 357163 - RNA, 22 nt, Homo sapiens
gugugacuagucaugccugaau

SEQ ID NO: 357164 - RNA, 22 nt, Homo sapiens
guuauuaguugauauuaaguuc

SEQ ID NO: 357165 - RNA, 22 nt, Homo sapiens
guugaacaauagauucauauca

SEQ ID NO: 357166 - RNA, 22 nt, Homo sapiens
guuggaguuaagcaguaaugaa

SEQ ID NO: 357167 - RNA, 22 nt, Homo sapiens
guuggugaccugaagagaguaa

SEQ ID NO: 357168 - RNA, 22 nt, Homo sapiens
guugugcuuaagccuauugauu

SEQ ID NO: 357169 - RNA, 22 nt, Homo sapiens
guuuaacugguacuucaagucu

SEQ ID NO: 357170 - RNA, 22 nt, Homo sapiens
guuuguaacucuagugacuaga

SEQ ID NO: 357171 - RNA, 22 nt, Homo sapiens
guuugugcuccuaugagaaucu

SEQ ID NO: 357172 - RNA, 22 nt, Homo sapiens
uaaacacucacuucauagccau

SEQ ID NO: 357173 - RNA, 22 nt, Homo sapiens
uaaacugucuuuggagcuuugc

SEQ ID NO: 357174 - RNA, 21 nt, Homo sapiens
uaaagcuuagcuauaguggcu

SEQ ID NO: 357175 - RNA, 22 nt, Homo sapiens
uaaaguucuuuuaugggccggg

SEQ ID NO: 357176 - RNA, 22 nt, Homo sapiens
uaacacccuucuccagguacau

SEQ ID NO: 357177 - RNA, 22 nt, Homo sapiens
uaacaguguagaggccuauugg

SEQ ID NO: 357178 - RNA, 22 nt, Homo sapiens
uaacuaaagagaagucaauguc

SEQ ID NO: 357179 - RNA, 22 nt, Homo sapiens
uaaggcacuacuuuaggcuuuc

SEQ ID NO: 357180 - RNA, 22 nt, Homo sapiens
uaagugcaacauaaguguuaaa

SEQ ID NO: 357181 - RNA, 22 nt, Homo sapiens
uuuauccagccucuagcaaggu

SEQ ID NO: 357182 - RNA, 22 nt, Homo sapiens
uuucaagugcugucuuagcugu

SEQ ID NO: 357183 - RNA, 17 nt, Homo sapiens
uuucagaguggaagugu

SEQ ID NO: 357184 - RNA, 22 nt, Homo sapiens
uuucauagccuuugucgucuga

SEQ ID NO: 357185 - RNA, 22 nt, Homo sapiens
uuucccuuacuuaaacuuacuc

SEQ ID NO: 357186 - RNA, 22 nt, Homo sapiens
uuucugguuaauuucuaagagc

SEQ ID NO: 357187 - RNA, 22 nt, Homo sapiens
uuugcacuugaaaacacucuca

SEQ ID NO: 357188 - RNA, 22 nt, Homo sapiens
uuugcauauguugaaccagccu

SEQ ID NO: 357189 - RNA, 22 nt, Homo sapiens
uuugggcuuuuaaucuagagca

SEQ ID NO: 357190 - RNA, 22 nt, Homo sapiens
uuuggucacugccgccgccagc

SEQ ID NO: 357191 - RNA, 22 nt, Homo sapiens
uuuguacacgugggugaauugu

SEQ ID NO: 357192 - RNA, 22 nt, Homo sapiens
uuuguacuaugguuuuucacua

SEQ ID NO: 357193 - RNA, 22 nt, Homo sapiens
uuuguacucccuuuagauaaaa

SEQ ID NO: 357194 - RNA, 19 nt, Homo sapiens
uuuguauguuuccaguaau

SEQ ID NO: 357195 - RNA, 22 nt, Homo sapiens
uuugugagguggauagauugca

SEQ ID NO: 357196 - RNA, 22 nt, Homo sapiens
uuugugcuccuaugagaaucua

SEQ ID NO: 357197 - RNA, 22 nt, Homo sapiens
uuugugcuccucucaguaugug

SEQ ID NO: 357198 - RNA, 22 nt, Homo sapiens
uuugugcuccuguugagaaucu

SEQ ID NO: 357199 - RNA, 22 nt, Homo sapiens
uuugugcugcaauuaauuuccc

SEQ ID NO: 357200 - RNA, 22 nt, Homo sapiens
uuugugugugauuauaaaaggu

SEQ ID NO: 357201 - RNA, 22 nt, Homo sapiens
uuuguuugaagucgagacaacu

SEQ ID NO: 357202 - RNA, 22 nt, Homo sapiens
uuuuaacagccaggggacggcc

SEQ ID NO: 357203 - RNA, 22 nt, Homo sapiens
uuuuacagaggagguugcugau

SEQ ID NO: 357204 - RNA, 22 nt, Homo sapiens
uuuuaguggacaaagguauuua

SEQ ID NO: 357205 - RNA, 22 nt, Homo sapiens
uuuugcaggcauuggaaguuua

SEQ ID NO: 357206 - RNA, 22 nt, Homo sapiens
uuuugcaggucaggggcagaga

SEQ ID NO: 357207 - RNA, 22 nt, Homo sapiens
uuuuggucuccaguuucugcug

SEQ ID NO: 357208 - RNA, 22 nt, Homo sapiens
uuuugguuguuggguaagagua

SEQ ID NO: 357209 - RNA, 19 nt, Homo sapiens
uuuuguacucugugacuug

SEQ ID NO: 357210 - RNA, 22 nt, Homo sapiens
uuuugugacuauuguaaauggg

SEQ ID NO: 357211 - RNA, 22 nt, Homo sapiens
uuuugugcauggcccaguggua

SEQ ID NO: 357212 - RNA, 22 nt, Homo sapiens
aaaagcuuagaugggcuuguau

SEQ ID NO: 357213 - RNA, 22 nt, Homo sapiens
aaaaguucuuugagccuugaca

SEQ ID NO: 357214 - RNA, 18 nt, Homo sapiens
aaacagugucucuuucug

SEQ ID NO: 357215 - RNA, 22 nt, Homo sapiens
aaacugcuuuccaugguggcug

SEQ ID NO: 357216 - RNA, 22 nt, Homo sapiens
aaacugucuucugacaguuucc

SEQ ID NO: 357217 - RNA, 22 nt, Homo sapiens
aaagcacuggagucaucaucua

SEQ ID NO: 357218 - RNA, 22 nt, Homo sapiens
aaagcagcaggugguuuucaau

SEQ ID NO: 357219 - RNA, 22 nt, Homo sapiens
aaaggaccacauauaugguggc

SEQ ID NO: 357220 - RNA, 22 nt, Homo sapiens
aaaggcacugaucuuauccagu

SEQ ID NO: 357221 - RNA, 19 nt, Homo sapiens
aaagguaguaaccucugau

SEQ ID NO: 357222 - RNA, 22 nt, Homo sapiens
aaagucacuggagaaggaauau

SEQ ID NO: 357223 - RNA, 22 nt, Homo sapiens
aaagucuagaggaucaugugug

SEQ ID NO: 357224 - RNA, 22 nt, Homo sapiens
aaagucuguuacagcuauuucu

SEQ ID NO: 357225 - RNA, 22 nt, Homo sapiens
aaagugcacuuggaagagggcc

SEQ ID NO: 357226 - RNA, 22 nt, Homo sapiens
aaagugcaguacuucguauauu

SEQ ID NO: 357227 - RNA, 22 nt, Homo sapiens
aaagugcugggauuggcugggc

SEQ ID NO: 357228 - RNA, 22 nt, Homo sapiens
aaagugcugggauuuuaggcau

SEQ ID NO: 357229 - RNA, 22 nt, Homo sapiens
aaaguucugcguuagggcuaaa

SEQ ID NO: 357230 - RNA, 22 nt, Homo sapiens
aaauaacugucagguucuggaa

SEQ ID NO: 357231 - RNA, 22 nt, Homo sapiens
aaauaguagcugaaugagggaa

SEQ ID NO: 357232 - RNA, 22 nt, Homo sapiens
aaauccauuuguucagcuaugc

SEQ ID NO: 357233 - RNA, 22 nt, Homo sapiens
aaaugacuuuuuaugcagagua

SEQ ID NO: 357234 - RNA, 22 nt, Homo sapiens
aaaugcacagaaaggaugugga

SEQ ID NO: 357235 - RNA, 22 nt, Homo sapiens
aaaugcaugaauaagcucgugu

SEQ ID NO: 357236 - RNA, 22 nt, Homo sapiens
aaaugcauugagggaaaaggca

SEQ ID NO: 357237 - RNA, 22 nt, Homo sapiens
aaaugcucuguggguaguaaug

SEQ ID NO: 357238 - RNA, 22 nt, Homo sapiens
aaaugcugcuuuggccucuucu

SEQ ID NO: 357239 - RNA, 22 nt, Homo sapiens
aaaugcugucugugagccucau

SEQ ID NO: 357240 - RNA, 22 nt, Homo sapiens
aaauucaucaaaugguuuguau

SEQ ID NO: 357241 - RNA, 18 nt, Homo sapiens
aaauucugucccuucuuc

SEQ ID NO: 357242 - RNA, 22 nt, Homo sapiens
aacagaccuagauaguauaguc

SEQ ID NO: 357243 - RNA, 22 nt, Homo sapiens
aacagcauaguacccgugauaa

SEQ ID NO: 357244 - RNA, 22 nt, Homo sapiens
aacagugcauuccuguccauau

SEQ ID NO: 357245 - RNA, 22 nt, Homo sapiens
aacaguguuuuggguuuucugg

SEQ ID NO: 357246 - RNA, 22 nt, Homo sapiens
aacaucaaccaugaggguugga

SEQ ID NO: 357247 - RNA, 22 nt, Homo sapiens
aaccuucauuccuuucccugcc

SEQ ID NO: 357248 - RNA, 22 nt, Homo sapiens
aaccuuuagucagcucuuagga

SEQ ID NO: 357249 - RNA, 22 nt, Homo sapiens
aacuccauuuuagacccuagau

SEQ ID NO: 357250 - RNA, 22 nt, Homo sapiens
aacugcacuaggacagguuuuu

SEQ ID NO: 357251 - RNA, 22 nt, Homo sapiens
aacuggcauaugaacuuguucu

SEQ ID NO: 357252 - RNA, 22 nt, Homo sapiens
aacugggcaagcauuacauggu

SEQ ID NO: 357253 - RNA, 19 nt, Homo sapiens
aacuggugugagaugauau

SEQ ID NO: 357254 - RNA, 22 nt, Homo sapiens
aagagagccagcugguauauuu

SEQ ID NO: 357255 - RNA, 22 nt, Homo sapiens
aagagaugaagguccugacugu

SEQ ID NO: 357256 - RNA, 22 nt, Homo sapiens
aagagcgcugauaacauguuug

SEQ ID NO: 357257 - RNA, 18 nt, Homo sapiens
aagagcucagcacagguu

SEQ ID NO: 357258 - RNA, 22 nt, Homo sapiens
aagagguaauaacaaagcuucu

SEQ ID NO: 357259 - RNA, 22 nt, Homo sapiens
aagagguuguaccuaaaguguu

SEQ ID NO: 357260 - RNA, 22 nt, Homo sapiens
aagaugcagucauacuggagua

SEQ ID NO: 357261 - RNA, 22 nt, Homo sapiens
aagcaggugaugagugggugug

SEQ ID NO: 357262 - RNA, 22 nt, Homo sapiens
aagcaucauuuggaauuugaga

SEQ ID NO: 357263 - RNA, 21 nt, Homo sapiens
aagcaugguguaucuuuccau

SEQ ID NO: 357264 - RNA, 22 nt, Homo sapiens
aagccacuguaccugucucuua

SEQ ID NO: 357265 - RNA, 22 nt, Homo sapiens
aagcgguguugaauuuuguuga

SEQ ID NO: 357266 - RNA, 22 nt, Homo sapiens
aagcuggauuuaguguggagca

SEQ ID NO: 357267 - RNA, 22 nt, Homo sapiens
aagcugguguguauuauucacu

SEQ ID NO: 357268 - RNA, 22 nt, Homo sapiens
aagcugguguugcugcucuguu

SEQ ID NO: 357269 - RNA, 22 nt, Homo sapiens
aagcugugucuugucagcuacc

SEQ ID NO: 357270 - RNA, 22 nt, Homo sapiens
aaggauuguaaaguugacaaau

SEQ ID NO: 357271 - RNA, 22 nt, Homo sapiens
agcaccaauaacaguuucuagc

SEQ ID NO: 357272 - RNA, 22 nt, Homo sapiens
agcaccaauaaucagaguucuu

SEQ ID NO: 357273 - RNA, 22 nt, Homo sapiens
agcaccacaauuuccugccuaa

SEQ ID NO: 357274 - RNA, 23 nt, Homo sapiens
agcaccaccccaggucacaagug

SEQ ID NO: 357275 - RNA, 22 nt, Homo sapiens
agcaccauuagcguugggccgg

SEQ ID NO: 357276 - RNA, 19 nt, Homo sapiens
agcagaacaaauguguggg

SEQ ID NO: 357277 - RNA, 22 nt, Homo sapiens
agcagagcaguggauuuuguga

SEQ ID NO: 357278 - RNA, 22 nt, Homo sapiens
agcagcacaucccuuucuggcc

SEQ ID NO: 357279 - RNA, 22 nt, Homo sapiens
agcagcaugcaaauggacuaau

SEQ ID NO: 357280 - RNA, 22 nt, Homo sapiens
agcagcauuaugauauaucuua

SEQ ID NO: 357281 - RNA, 22 nt, Homo sapiens
agcagugucauuuucuggugag

SEQ ID NO: 357282 - RNA, 22 nt, Homo sapiens
agcaucagugauuuuguugaag

SEQ ID NO: 357283 - RNA, 22 nt, Homo sapiens
agccaguauuuuauugaggauu

SEQ ID NO: 357284 - RNA, 22 nt, Homo sapiens
agccucauucuacauguuaaug

SEQ ID NO: 357285 - RNA, 22 nt, Homo sapiens
agccuguguugaauuauagaaa

SEQ ID NO: 357286 - RNA, 22 nt, Homo sapiens
agcuacaucuugcucugggaug

SEQ ID NO: 357287 - RNA, 22 nt, Homo sapiens
agcuagcauucauaguuugagg

SEQ ID NO: 357288 - RNA, 22 nt, Homo sapiens
agcuauauugaggaugccauuc

SEQ ID NO: 357289 - RNA, 22 nt, Homo sapiens
agcuaugucugaugccugauua

SEQ ID NO: 357290 - RNA, 22 nt, Homo sapiens
agcucauugcuguccuggagga

SEQ ID NO: 357291 - RNA, 22 nt, Homo sapiens
agcuccuuucugcagguagguu

SEQ ID NO: 357292 - RNA, 22 nt, Homo sapiens
agcugcaauguuuaguauaaua

SEQ ID NO: 357293 - RNA, 22 nt, Homo sapiens
agcuggacuugauaaaugaaua

SEQ ID NO: 357294 - RNA, 22 nt, Homo sapiens
agcugguaugaaaaucucccca

SEQ ID NO: 357295 - RNA, 22 nt, Homo sapiens
agcugguccugugacuugcuuc

SEQ ID NO: 357296 - RNA, 21 nt, Homo sapiens
agcugguuuccacagugugcu

SEQ ID NO: 357297 - RNA, 22 nt, Homo sapiens
agcuguaguuuauucauguuaa

SEQ ID NO: 357298 - RNA, 19 nt, Homo sapiens
agcuguguugccugugaga

SEQ ID NO: 357299 - RNA, 22 nt, Homo sapiens
agcuguuuuugugggcauguga

SEQ ID NO: 357300 - RNA, 22 nt, Homo sapiens
aggaagacugaaauugcuguuc

SEQ ID NO: 357301 - RNA, 22 nt, Homo sapiens
aggaagugucuucuuuuaggca

SEQ ID NO: 357302 - RNA, 23 nt, Homo sapiens
aggaauggaaaaccaaguaucau

SEQ ID NO: 357303 - RNA, 22 nt, Homo sapiens
aggaauggaaacuuuugauggu

SEQ ID NO: 357304 - RNA, 22 nt, Homo sapiens
aggaauguuaguacuucuuagu

SEQ ID NO: 357305 - RNA, 20 nt, Homo sapiens
aggacuacagaggguaggau

SEQ ID NO: 357306 - RNA, 21 nt, Homo sapiens
aggagcauuguugugguggag

SEQ ID NO: 357307 - RNA, 22 nt, Homo sapiens
aggauacugguaugggcugaau

SEQ ID NO: 357308 - RNA, 22 nt, Homo sapiens
aggaucauugacuauuauaagg

SEQ ID NO: 357309 - RNA, 22 nt, Homo sapiens
aggcaagagugacuacgugaaa

SEQ ID NO: 357310 - RNA, 22 nt, Homo sapiens
aggcagcuguuauauacugagu

SEQ ID NO: 357311 - RNA, 22 nt, Homo sapiens
aggcaggugaaagauaguuuua

SEQ ID NO: 357312 - RNA, 22 nt, Homo sapiens
aggcaugaguucagaggguaug

SEQ ID NO: 357313 - RNA, 23 nt, Homo sapiens
aggcauuguacaguaauggaaaa

SEQ ID NO: 357314 - RNA, 22 nt, Homo sapiens
agggaagugugcuaugcauuua

SEQ ID NO: 357315 - RNA, 22 nt, Homo sapiens
agggaauguaaguuuuaugaga

SEQ ID NO: 357316 - RNA, 22 nt, Homo sapiens
agggcaagacuuguuaagaaca

SEQ ID NO: 357317 - RNA, 22 nt, Homo sapiens
agggcauuguacaaaucaucau

SEQ ID NO: 357318 - RNA, 22 nt, Homo sapiens
aggguaguaggcuugggauugg

SEQ ID NO: 357319 - RNA, 22 nt, Homo sapiens
aggguuuuuauuuauguggcau

SEQ ID NO: 357320 - RNA, 22 nt, Homo sapiens
agguaauuuucccagagggaaa

SEQ ID NO: 357321 - RNA, 22 nt, Homo sapiens
agguacuugagauucugaacug

SEQ ID NO: 357322 - RNA, 20 nt, Homo sapiens
agguaguuauacaaaugugu

SEQ ID NO: 357323 - RNA, 21 nt, Homo sapiens
aggucaguaagaaugcagcac

SEQ ID NO: 357324 - RNA, 22 nt, Homo sapiens
aggugcugagcagagaauccug

SEQ ID NO: 357325 - RNA, 22 nt, Homo sapiens
agguuguguuugugauuagaua

SEQ ID NO: 357326 - RNA, 22 nt, Homo sapiens
agguuuucagccccagccuagg

SEQ ID NO: 357327 - RNA, 22 nt, Homo sapiens
aguaagauggcaacucuccaca

SEQ ID NO: 357328 - RNA, 22 nt, Homo sapiens
aguaccacgugaugccauuuuc

SEQ ID NO: 357329 - RNA, 22 nt, Homo sapiens
aguaccauuagauuaggaugac

SEQ ID NO: 357330 - RNA, 22 nt, Homo sapiens
aguacugucugguuaccugaca

SEQ ID NO: 357331 - RNA, 22 nt, Homo sapiens
aguaucacaguggguguauacc

SEQ ID NO: 357332 - RNA, 22 nt, Homo sapiens
aguauuaggugaguguauuuca

SEQ ID NO: 357333 - RNA, 22 nt, Homo sapiens
aguauuaguuuaugggugugga

SEQ ID NO: 357334 - RNA, 22 nt, Homo sapiens
agucacagugaccuugucugac

SEQ ID NO: 357335 - RNA, 22 nt, Homo sapiens
agucacaugccagcacacccag

SEQ ID NO: 357336 - RNA, 22 nt, Homo sapiens
agucaguggaguaaauguaauu

SEQ ID NO: 357337 - RNA, 20 nt, Homo sapiens
agucaguuuauuuucucucu

SEQ ID NO: 357338 - RNA, 23 nt, Homo sapiens
agucuguguuuacaggcucucug

SEQ ID NO: 357339 - RNA, 22 nt, Homo sapiens
agugaacaaagaagugcagaua

SEQ ID NO: 357340 - RNA, 19 nt, Homo sapiens
agugagccaagauccuacc

SEQ ID NO: 357341 - RNA, 22 nt, Homo sapiens
agugagcugcagucuggggucc

SEQ ID NO: 357342 - RNA, 22 nt, Homo sapiens
agugauuuuaacuuccagcaau

SEQ ID NO: 357343 - RNA, 22 nt, Homo sapiens
agugcauugcaucucugcuuca

SEQ ID NO: 357344 - RNA, 22 nt, Homo sapiens
agugcauuugcaucucaauaua

SEQ ID NO: 357345 - RNA, 22 nt, Homo sapiens
agugccaaaucgagggcucuga

SEQ ID NO: 357346 - RNA, 22 nt, Homo sapiens
agugccuauugauggaaagaua

SEQ ID NO: 357347 - RNA, 19 nt, Homo sapiens
agugggcuagaaaucaggg

SEQ ID NO: 357348 - RNA, 22 nt, Homo sapiens
aguggguguuccauuggauaaa

SEQ ID NO: 357349 - RNA, 23 nt, Homo sapiens
aguggucuccugggcccagcugu

SEQ ID NO: 357350 - RNA, 22 nt, Homo sapiens
agugguuugaucacagcucacu

SEQ ID NO: 357351 - RNA, 20 nt, Homo sapiens
agugguuuucaaauaugucu

SEQ ID NO: 357352 - RNA, 19 nt, Homo sapiens
agugucauggucauuauuu

SEQ ID NO: 357353 - RNA, 22 nt, Homo sapiens
aguguuuuucaugggauacuuu

SEQ ID NO: 357354 - RNA, 22 nt, Homo sapiens
aguucaauggguuuucacucau

SEQ ID NO: 357355 - RNA, 22 nt, Homo sapiens
auaaaagcaggucuaggucagg

SEQ ID NO: 357356 - RNA, 22 nt, Homo sapiens
auaaaugcauugagaacugcug

SEQ ID NO: 357357 - RNA, 22 nt, Homo sapiens
auaaaugcuuagaucuguauau

SEQ ID NO: 357358 - RNA, 22 nt, Homo sapiens
auaaaugcuuccagucauuaaa

SEQ ID NO: 357359 - RNA, 22 nt, Homo sapiens
augaagaucaugaagacggcuu

SEQ ID NO: 357360 - RNA, 20 nt, Homo sapiens
augaaggcaggugugaguuu

SEQ ID NO: 357361 - RNA, 22 nt, Homo sapiens
augaaguauuaggacacauuua

SEQ ID NO: 357362 - RNA, 20 nt, Homo sapiens
augaagugaaguuagggaac

SEQ ID NO: 357363 - RNA, 22 nt, Homo sapiens
augaauguaaagaaugugggaa

SEQ ID NO: 357364 - RNA, 22 nt, Homo sapiens
augacaaugaaucccuguuuca

SEQ ID NO: 357365 - RNA, 22 nt, Homo sapiens
augacagagauaugugaauuuu

SEQ ID NO: 357366 - RNA, 22 nt, Homo sapiens
augacaguaugacuccaaaagu

SEQ ID NO: 357367 - RNA, 22 nt, Homo sapiens
augacauugaugcucuggcugg

SEQ ID NO: 357368 - RNA, 22 nt, Homo sapiens
augaccagagagugcgcagggu

SEQ ID NO: 357369 - RNA, 22 nt, Homo sapiens
augaccuuggggaaccaugucu

SEQ ID NO: 357370 - RNA, 22 nt, Homo sapiens
augacucagaucuguuccuggu

SEQ ID NO: 357371 - RNA, 22 nt, Homo sapiens
augacugaguagcauuccauua

SEQ ID NO: 357372 - RNA, 22 nt, Homo sapiens
augacuggauaauggacacaca

SEQ ID NO: 357373 - RNA, 17 nt, Homo sapiens
augacuucuucagugug

SEQ ID NO: 357374 - RNA, 22 nt, Homo sapiens
augagagcugacuuuaaggcaa

SEQ ID NO: 357375 - RNA, 22 nt, Homo sapiens
augagauaaaccaucucuuaag

SEQ ID NO: 357376 - RNA, 22 nt, Homo sapiens
augagauacuacaaaugaguuu

SEQ ID NO: 357377 - RNA, 22 nt, Homo sapiens
augagaucugugaacaccuguc

SEQ ID NO: 357378 - RNA, 22 nt, Homo sapiens
augagaugauaggcguucuaac

SEQ ID NO: 357379 - RNA, 22 nt, Homo sapiens
augagaugcaagauuagauggg

SEQ ID NO: 357380 - RNA, 22 nt, Homo sapiens
augagauucuuagagaagucug

SEQ ID NO: 357381 - RNA, 22 nt, Homo sapiens
augagcucauugggugacuggg

SEQ ID NO: 357382 - RNA, 22 nt, Homo sapiens
augaggaaggagccuuugucug

SEQ ID NO: 357383 - RNA, 22 nt, Homo sapiens
augagguaauaaguccuuggaa

SEQ ID NO: 357384 - RNA, 22 nt, Homo sapiens
augagguaguagaaagucaggu

SEQ ID NO: 357385 - RNA, 22 nt, Homo sapiens
augaggugcagaggaaaugagu

SEQ ID NO: 357386 - RNA, 22 nt, Homo sapiens
augaggugggagaaucacuuga

SEQ ID NO: 357387 - RNA, 20 nt, Homo sapiens
augagguguaugacacugaa

SEQ ID NO: 357388 - RNA, 22 nt, Homo sapiens
augaucacuguggaaauucagc

SEQ ID NO: 357389 - RNA, 22 nt, Homo sapiens
augaugaaguaagugcuuagga

SEQ ID NO: 357390 - RNA, 22 nt, Homo sapiens
augauuuuuguaucgccugaug

SEQ ID NO: 357391 - RNA, 22 nt, Homo sapiens
augcaagacaccgauuagcuuu

SEQ ID NO: 357392 - RNA, 22 nt, Homo sapiens
augcaauucuagauugauagua

SEQ ID NO: 357393 - RNA, 22 nt, Homo sapiens
augcacuguuuucuugaugaga

SEQ ID NO: 357394 - RNA, 22 nt, Homo sapiens
augcagaucacauuuuucuguc

SEQ ID NO: 357395 - RNA, 22 nt, Homo sapiens
augcagcugaggguaguggagc

SEQ ID NO: 357396 - RNA, 22 nt, Homo sapiens
augcagugugcaacagauuaag

SEQ ID NO: 357397 - RNA, 22 nt, Homo sapiens
augcauauuuuaccuagaagag

SEQ ID NO: 357398 - RNA, 19 nt, Homo sapiens
augccacagugaggucaga

SEQ ID NO: 357399 - RNA, 22 nt, Homo sapiens
augccagggagaauuguucaag

SEQ ID NO: 357400 - RNA, 22 nt, Homo sapiens
augcccauuuguuuucugaaag

SEQ ID NO: 357401 - RNA, 22 nt, Homo sapiens
augcuauguagaugagggccca

SEQ ID NO: 357402 - RNA, 22 nt, Homo sapiens
augcuguuuugaauucucuaga

SEQ ID NO: 357403 - RNA, 22 nt, Homo sapiens
auggaagaaacgauuuucugga

SEQ ID NO: 357404 - RNA, 22 nt, Homo sapiens
auggaagaauugucggggaugu

SEQ ID NO: 357405 - RNA, 22 nt, Homo sapiens
auggaagcugauuagauaguac

SEQ ID NO: 357406 - RNA, 22 nt, Homo sapiens
auggaauggcacuuugaagauu

SEQ ID NO: 357407 - RNA, 22 nt, Homo sapiens
auggaaugguugggucauaagg

SEQ ID NO: 357408 - RNA, 22 nt, Homo sapiens
auggaauguggaaugguaagua

SEQ ID NO: 357409 - RNA, 22 nt, Homo sapiens
auggacagaaaaaaauagaugu

SEQ ID NO: 357410 - RNA, 22 nt, Homo sapiens
auggagaugaauaucaucuguu

SEQ ID NO: 357411 - RNA, 22 nt, Homo sapiens
auggaggacaaugucaccuuca

SEQ ID NO: 357412 - RNA, 22 nt, Homo sapiens
auggaggaggaagcugaaacaa

SEQ ID NO: 357413 - RNA, 22 nt, Homo sapiens
auggagugagaauggagguucc

SEQ ID NO: 357414 - RNA, 22 nt, Homo sapiens
auggaguguaauauugagagcu

SEQ ID NO: 357415 - RNA, 22 nt, Homo sapiens
auggaguuuacuuaguguaaua

SEQ ID NO: 357416 - RNA, 22 nt, Homo sapiens
auggcacuaaguucaacacuua

SEQ ID NO: 357417 - RNA, 22 nt, Homo sapiens
auggcacugaagcguauugaca

SEQ ID NO: 357418 - RNA, 22 nt, Homo sapiens
auggcacuuuggacugcuagau

SEQ ID NO: 357419 - RNA, 18 nt, Homo sapiens
auggcagaacaauuuaca

SEQ ID NO: 357420 - RNA, 22 nt, Homo sapiens
auggcagcaccccacucuacug

SEQ ID NO: 357421 - RNA, 22 nt, Homo sapiens
auggcagugagucucuaguauu

SEQ ID NO: 357422 - RNA, 22 nt, Homo sapiens
auggcaguguaugauuauauua

SEQ ID NO: 357423 - RNA, 23 nt, Homo sapiens
auggcccuggugggagugucuuu

SEQ ID NO: 357424 - RNA, 22 nt, Homo sapiens
auggccuuguauaccuggcaaa

SEQ ID NO: 357425 - RNA, 22 nt, Homo sapiens
auggcggugugaucuuggcuca

SEQ ID NO: 357426 - RNA, 22 nt, Homo sapiens
auggcucuggauagaaugcagg

SEQ ID NO: 357427 - RNA, 22 nt, Homo sapiens
auggcugugaaaugguaggugg

SEQ ID NO: 357428 - RNA, 22 nt, Homo sapiens
auggcuguuuaagaguuucauu

SEQ ID NO: 357429 - RNA, 22 nt, Homo sapiens
auggcuguuuuuuauguuacag

SEQ ID NO: 357430 - RNA, 22 nt, Homo sapiens
auggcuucuucuaaaagugggg

SEQ ID NO: 357431 - RNA, 22 nt, Homo sapiens
auggcuuuggucucccagugau

SEQ ID NO: 357432 - RNA, 22 nt, Homo sapiens
augggguaggcuuugcugcagu

SEQ ID NO: 357433 - RNA, 22 nt, Homo sapiens
augguaagcugaaaauaucgaa

SEQ ID NO: 357434 - RNA, 22 nt, Homo sapiens
auggucccauucauucacguau

SEQ ID NO: 357435 - RNA, 22 nt, Homo sapiens
auggucccuguuccaugcuccu

SEQ ID NO: 357436 - RNA, 22 nt, Homo sapiens
augguuugugcuccuauaagaa

SEQ ID NO: 357437 - RNA, 22 nt, Homo sapiens
auguaauguuaaauugcuaauu

SEQ ID NO: 357438 - RNA, 22 nt, Homo sapiens
auguagauaucaagaggcauau

SEQ ID NO: 357439 - RNA, 22 nt, Homo sapiens
auguaguaugaagaagaugcuu

SEQ ID NO: 357440 - RNA, 22 nt, Homo sapiens
auguauggagauauuuuugguu

SEQ ID NO: 357441 - RNA, 22 nt, Homo sapiens
augucaacauagacaguagagu

SEQ ID NO: 357442 - RNA, 22 nt, Homo sapiens
augucaaggugaagaaagauca

SEQ ID NO: 357443 - RNA, 22 nt, Homo sapiens
auguccuaaucuccuguucuua

SEQ ID NO: 357444 - RNA, 22 nt, Homo sapiens
augucuuucauagagacccaga

SEQ ID NO: 357445 - RNA, 22 nt, Homo sapiens
augugacagcaacccccagccc

SEQ ID NO: 357446 - RNA, 22 nt, Homo sapiens
augugcaaagcacuguucagca

SEQ ID NO: 357447 - RNA, 16 nt, Homo sapiens
uuauugcauucuucuc

SEQ ID NO: 357448 - RNA, 17 nt, Homo sapiens
uuauugcuauaagcuga

SEQ ID NO: 357449 - RNA, 22 nt, Homo sapiens
uucaaaggauagauuaagauca

SEQ ID NO: 357450 - RNA, 22 nt, Homo sapiens
uucaaaguaaagggauggagac

SEQ ID NO: 357451 - RNA, 22 nt, Homo sapiens
uucaaaucuuuggcucccacua

SEQ ID NO: 357452 - RNA, 22 nt, Homo sapiens
uucaaguagguaggaccacagg

SEQ ID NO: 357453 - RNA, 22 nt, Homo sapiens
uucaauacuguugauccuuaug

SEQ ID NO: 357454 - RNA, 22 nt, Homo sapiens
uucaauuaauauuauacucuca

SEQ ID NO: 357455 - RNA, 22 nt, Homo sapiens
uucacacuagccacucugguag

SEQ ID NO: 357456 - RNA, 22 nt, Homo sapiens
uucacagaaaaaggcgaugagg

SEQ ID NO: 357457 - RNA, 22 nt, Homo sapiens
uucaccagggaagucucaacuc

SEQ ID NO: 357458 - RNA, 23 nt, Homo sapiens
uucaccguguuggccaggcuggu

SEQ ID NO: 357459 - RNA, 22 nt, Homo sapiens
uucacuguagcuuggauguuua

SEQ ID NO: 357460 - RNA, 22 nt, Homo sapiens
uucagagagggagggauaccua

SEQ ID NO: 357461 - RNA, 22 nt, Homo sapiens
uucagauugcauaccgaaagua

SEQ ID NO: 357462 - RNA, 19 nt, Homo sapiens
uucagcagugucugcucuu

SEQ ID NO: 357463 - RNA, 22 nt, Homo sapiens
uucaggcuuuuauuuacugaua

SEQ ID NO: 357464 - RNA, 22 nt, Homo sapiens
uucagguaucccuugucuauag

SEQ ID NO: 357465 - RNA, 22 nt, Homo sapiens
uucaguacacguguucucauuu

SEQ ID NO: 357466 - RNA, 20 nt, Homo sapiens
uucagugcagguaacaaucc

SEQ ID NO: 357467 - RNA, 22 nt, Homo sapiens
uucagugguuauuugugagauu

SEQ ID NO: 357468 - RNA, 22 nt, Homo sapiens
uucagugucauuaacacaguag

SEQ ID NO: 357469 - RNA, 22 nt, Homo sapiens
uucauagucacauucgaugucu

SEQ ID NO: 357470 - RNA, 22 nt, Homo sapiens
uucauagucuaugcaaguaaga

SEQ ID NO: 357471 - RNA, 22 nt, Homo sapiens
uucauaguucuuuuagucauua

SEQ ID NO: 357472 - RNA, 22 nt, Homo sapiens
uucaucagggagaaauaauuuc

SEQ ID NO: 357473 - RNA, 22 nt, Homo sapiens
uucauggacucaauaguuucgc

SEQ ID NO: 357474 - RNA, 22 nt, Homo sapiens
uucauggaugcauuugaggggu

SEQ ID NO: 357475 - RNA, 22 nt, Homo sapiens
uucauguaauauauuucaggcc

SEQ ID NO: 357476 - RNA, 16 nt, Homo sapiens
uuccacagucgaggug

SEQ ID NO: 357477 - RNA, 22 nt, Homo sapiens
uuccaguggacuacuucauccu

SEQ ID NO: 357478 - RNA, 22 nt, Homo sapiens
uuccaguggaguaaauggacaa

SEQ ID NO: 357479 - RNA, 22 nt, Homo sapiens
uuccagugggacgagaugugga

SEQ ID NO: 357480 - RNA, 22 nt, Homo sapiens
uuccaguguguucauccucaga

SEQ ID NO: 357481 - RNA, 22 nt, Homo sapiens
uucccagagaaaaggguuucuu

SEQ ID NO: 357482 - RNA, 22 nt, Homo sapiens
uucccagagccugggagugagg

SEQ ID NO: 357483 - RNA, 22 nt, Homo sapiens
uucccagugccaggcacuggga

SEQ ID NO: 357484 - RNA, 22 nt, Homo sapiens
uucccaguuggggaaagcgacc

SEQ ID NO: 357485 - RNA, 22 nt, Homo sapiens
uucccauuguuggccagcaugu

SEQ ID NO: 357486 - RNA, 22 nt, Homo sapiens
uucccugaaguguuacucuaga

SEQ ID NO: 357487 - RNA, 22 nt, Homo sapiens
uucccugugggcuggugcucca

SEQ ID NO: 357488 - RNA, 23 nt, Homo sapiens
uucccuuagaagaaggggagaaa

SEQ ID NO: 357489 - RNA, 22 nt, Homo sapiens
uucccuuucugaaaaucucauu

SEQ ID NO: 357490 - RNA, 22 nt, Homo sapiens
uucccuuugaaacuaaacuugc

SEQ ID NO: 357491 - RNA, 22 nt, Homo sapiens
uuccugagagggcugggugcag

SEQ ID NO: 357492 - RNA, 22 nt, Homo sapiens
uuccugaggccuccccagaagc

SEQ ID NO: 357493 - RNA, 22 nt, Homo sapiens
uuccuggaggggaaguguccaa

SEQ ID NO: 357494 - RNA, 22 nt, Homo sapiens
uuccuguagcgauuuuaguaau

SEQ ID NO: 357495 - RNA, 22 nt, Homo sapiens
uuccuucaugcuugaaggguau

SEQ ID NO: 357496 - RNA, 22 nt, Homo sapiens
uucuacaggcuguucaagaagc

SEQ ID NO: 357497 - RNA, 22 nt, Homo sapiens
uucuacagugacugcagccaua

SEQ ID NO: 357498 - RNA, 22 nt, Homo sapiens
uucuagagagaagacuuaagcu

SEQ ID NO: 357499 - RNA, 22 nt, Homo sapiens
uucuauggucacagaugcuuga

SEQ ID NO: 357500 - RNA, 22 nt, Homo sapiens
uucuaugguuaccaggcuaguc

SEQ ID NO: 357501 - RNA, 22 nt, Homo sapiens
uucucaaggagccuucguaacu

SEQ ID NO: 357502 - RNA, 22 nt, Homo sapiens
uucucaauggcaacuuguugcu

SEQ ID NO: 357503 - RNA, 22 nt, Homo sapiens
uucucacaguacagggagcucu

SEQ ID NO: 357504 - RNA, 22 nt, Homo sapiens
uucucagcccccugacagucag

SEQ ID NO: 357505 - RNA, 22 nt, Homo sapiens
uucucugggacauaggucgggu

SEQ ID NO: 357506 - RNA, 22 nt, Homo sapiens
uucuggcuaugggauacuaaau

SEQ ID NO: 357507 - RNA, 22 nt, Homo sapiens
uucugugguagaaaucucaaau

SEQ ID NO: 357508 - RNA, 22 nt, Homo sapiens
uucugugguuucauuuaccugu

SEQ ID NO: 357509 - RNA, 22 nt, Homo sapiens
uucuugcuguauccucacaugg

SEQ ID NO: 357510 - RNA, 22 nt, Homo sapiens
uucuugguuggcaaccaacagu

SEQ ID NO: 357511 - RNA, 22 nt, Homo sapiens
uucuuuggaaacaguacuaauu

SEQ ID NO: 357512 - RNA, 22 nt, Homo sapiens
uucuuugguacaagggccgacc

SEQ ID NO: 357513 - RNA, 22 nt, Homo sapiens
uugaaagcuaucagagauucca

SEQ ID NO: 357514 - RNA, 22 nt, Homo sapiens
uugaaagucauggcacaggcaa

SEQ ID NO: 357515 - RNA, 22 nt, Homo sapiens
uugaaagucuaggcuuacagua

SEQ ID NO: 357516 - RNA, 22 nt, Homo sapiens
uugaaguaguacuuuauuauag

SEQ ID NO: 357517 - RNA, 22 nt, Homo sapiens
uugaauagaaguguugaaagug

SEQ ID NO: 357518 - RNA, 22 nt, Homo sapiens
uugaauagacagccagcuuuaa

SEQ ID NO: 357519 - RNA, 18 nt, Homo sapiens
uugaauaguguccaaucu

SEQ ID NO: 357520 - RNA, 22 nt, Homo sapiens
uugaauguguugggaagcccuu

SEQ ID NO: 357521 - RNA, 22 nt, Homo sapiens
uugacagaccuuggucauaucc

SEQ ID NO: 357522 - RNA, 21 nt, Homo sapiens
uugacagugacagguaaaguu

SEQ ID NO: 357523 - RNA, 23 nt, Homo sapiens
uugacuguggguacaaugugaua

SEQ ID NO: 357524 - RNA, 22 nt, Homo sapiens
uugacuucagagcugauucaag

SEQ ID NO: 357525 - RNA, 22 nt, Homo sapiens
uugagaaucuuucgaauguucu

SEQ ID NO: 357526 - RNA, 22 nt, Homo sapiens
uugagacggaguuuugcucuug

SEQ ID NO: 357527 - RNA, 22 nt, Homo sapiens
uugagagcugaugaaagauaaa

SEQ ID NO: 357528 - RNA, 22 nt, Homo sapiens
uugagauacauaauuaugaaug

SEQ ID NO: 357529 - RNA, 22 nt, Homo sapiens
uugagauaggaacucacuaugc

SEQ ID NO: 357530 - RNA, 22 nt, Homo sapiens
uugagaucaugcuacugcacuc

SEQ ID NO: 357531 - RNA, 22 nt, Homo sapiens
uugagauggagucucacucuuc

SEQ ID NO: 357532 - RNA, 22 nt, Homo sapiens
uugagauggagucuugcacugu

SEQ ID NO: 357533 - RNA, 22 nt, Homo sapiens
uugagauggagucuugcgcugu

SEQ ID NO: 357534 - RNA, 22 nt, Homo sapiens
uugagauggagucuugcucucu

SEQ ID NO: 357535 - RNA, 22 nt, Homo sapiens
uugagauggaguguugcucugu

SEQ ID NO: 357536 - RNA, 22 nt, Homo sapiens
uugagauggaguuucaauauug

SEQ ID NO: 357537 - RNA, 22 nt, Homo sapiens
uugagauggaguuucgcucuug

SEQ ID NO: 357538 - RNA, 22 nt, Homo sapiens
uugagauggauagacauagcau

SEQ ID NO: 357539 - RNA, 22 nt, Homo sapiens
uugagauguaguuucacuccug

SEQ ID NO: 357540 - RNA, 22 nt, Homo sapiens
uugagauguauguauauaaugu

SEQ ID NO: 357541 - RNA, 22 nt, Homo sapiens
uugagauuuuccucaaauauuu

SEQ ID NO: 357542 - RNA, 22 nt, Homo sapiens
uugagcaaaacauuaauauuag

SEQ ID NO: 357543 - RNA, 22 nt, Homo sapiens
uugagcacaggaguuuugagac

SEQ ID NO: 357544 - RNA, 22 nt, Homo sapiens
uugagcucuuccagccuggagc

SEQ ID NO: 357545 - RNA, 22 nt, Homo sapiens
uugaggaagugguuccccagag

SEQ ID NO: 357546 - RNA, 22 nt, Homo sapiens
uugaggaggcagucuguccguu

SEQ ID NO: 357547 - RNA, 22 nt, Homo sapiens
uugaggcaaugaggagaagcug

SEQ ID NO: 357548 - RNA, 22 nt, Homo sapiens
uugagggaagccagaggucugc

SEQ ID NO: 357549 - RNA, 22 nt, Homo sapiens
uugagguauugauaaaacauuu

SEQ ID NO: 357550 - RNA, 20 nt, Homo sapiens
uugaggucaggaguuuggga

SEQ ID NO: 357551 - RNA, 20 nt, Homo sapiens
uugaggugugaggggcagag

SEQ ID NO: 357552 - RNA, 22 nt, Homo sapiens
uugaguaguaagaagaugauag

SEQ ID NO: 357553 - RNA, 22 nt, Homo sapiens
uugaguauuggacugguaucuu

SEQ ID NO: 357554 - RNA, 22 nt, Homo sapiens
uugaguuugaguauucuaaagc

SEQ ID NO: 357555 - RNA, 22 nt, Homo sapiens
uugauagaucagggauuugauu

SEQ ID NO: 357556 - RNA, 22 nt, Homo sapiens
uugauaguuuuaaaauuaaucu

SEQ ID NO: 357557 - RNA, 22 nt, Homo sapiens
uugauaugacuaucuuuuaugu

SEQ ID NO: 357558 - RNA, 22 nt, Homo sapiens
uugaucugugucccugcccaau

SEQ ID NO: 357559 - RNA, 22 nt, Homo sapiens
uugaucuguguuagaagcuaag

SEQ ID NO: 357560 - RNA, 22 nt, Homo sapiens
uugcaagauguucaugggcugu

SEQ ID NO: 357561 - RNA, 22 nt, Homo sapiens
uugcaaguggagcuuccagggc

SEQ ID NO: 357562 - RNA, 22 nt, Homo sapiens
uugcaccacugcguuccagccu

SEQ ID NO: 357563 - RNA, 22 nt, Homo sapiens
uugcaccccuacuauuugccaa

SEQ ID NO: 357564 - RNA, 22 nt, Homo sapiens
uugcaccuugaagccaauagca

SEQ ID NO: 357565 - RNA, 22 nt, Homo sapiens
uugcacuccagccuggaugaca

SEQ ID NO: 357566 - RNA, 22 nt, Homo sapiens
uugcacuccagcucuaggugac

SEQ ID NO: 357567 - RNA, 22 nt, Homo sapiens
uugcagagccccugcaaggguc

SEQ ID NO: 357568 - RNA, 22 nt, Homo sapiens
uugcagcaaauaggaaugagga

SEQ ID NO: 357569 - RNA, 22 nt, Homo sapiens
uugcagugugacgacuauauuu

SEQ ID NO: 357570 - RNA, 22 nt, Homo sapiens
uugcauaagugcauucugugau

SEQ ID NO: 357571 - RNA, 22 nt, Homo sapiens
uugcauagaggugaguauagua

SEQ ID NO: 357572 - RNA, 19 nt, Homo sapiens
uugcauauguugaaccagc

SEQ ID NO: 357573 - RNA, 22 nt, Homo sapiens
uugcauauguugaaccagccuu

SEQ ID NO: 357574 - RNA, 23 nt, Homo sapiens
uugcauugcccuccauaguacuc

SEQ ID NO: 357575 - RNA, 22 nt, Homo sapiens
uugcccuuuagguaacuauaua

SEQ ID NO: 357576 - RNA, 22 nt, Homo sapiens
uugcuauguugcccagucugga

SEQ ID NO: 357577 - RNA, 22 nt, Homo sapiens
uugcucaggcuggaguacaaug

SEQ ID NO: 357578 - RNA, 22 nt, Homo sapiens
uugcuggugguucgagcaacac

SEQ ID NO: 357579 - RNA, 20 nt, Homo sapiens
uugcugguguuagaggaggc

SEQ ID NO: 357580 - RNA, 22 nt, Homo sapiens
uuggaaggcuccuaaugaaugg

SEQ ID NO: 357581 - RNA, 22 nt, Homo sapiens
uuggaaggcugaauggccucuc

SEQ ID NO: 357582 - RNA, 22 nt, Homo sapiens
uuggaauuaagagauauuuucu

SEQ ID NO: 357583 - RNA, 22 nt, Homo sapiens
uuggacugagaguuccaccauu

SEQ ID NO: 357584 - RNA, 22 nt, Homo sapiens
uuggagagagaggacucccggc

SEQ ID NO: 357585 - RNA, 22 nt, Homo sapiens
uuggagcacuggggcacugaca

SEQ ID NO: 357586 - RNA, 22 nt, Homo sapiens
uuggagcccuaacucucaguac

SEQ ID NO: 357587 - RNA, 22 nt, Homo sapiens
uuggaguguucugguccgggcu

SEQ ID NO: 357588 - RNA, 22 nt, Homo sapiens
uuggauuuuaacaaacuaggug

SEQ ID NO: 357589 - RNA, 22 nt, Homo sapiens
uuggcaaguuucugucagcaaa

SEQ ID NO: 357590 - RNA, 21 nt, Homo sapiens
uuggcacucuucucuccuuau

SEQ ID NO: 357591 - RNA, 22 nt, Homo sapiens
uuggcacugagcaagaacaggg

SEQ ID NO: 357592 - RNA, 22 nt, Homo sapiens
uuggcagaauguuagaaacuua

SEQ ID NO: 357593 - RNA, 22 nt, Homo sapiens
uuggcagcacgcaguccagagg

SEQ ID NO: 357594 - RNA, 22 nt, Homo sapiens
uuggcagcauuccagccaagca

SEQ ID NO: 357595 - RNA, 22 nt, Homo sapiens
uuggcagcuguggaaucugggc

SEQ ID NO: 357596 - RNA, 22 nt, Homo sapiens
uuggcaguaucuacuacagcua

SEQ ID NO: 357597 - RNA, 22 nt, Homo sapiens
uuggcagucugaggcacagacu

SEQ ID NO: 357598 - RNA, 22 nt, Homo sapiens
uuggcagugguucugacggacc

SEQ ID NO: 357599 - RNA, 20 nt, Homo sapiens
uuggcauuuagacaagaguu

SEQ ID NO: 357600 - RNA, 22 nt, Homo sapiens
uuggccagugucuuuuuuuccu

SEQ ID NO: 357601 - RNA, 22 nt, Homo sapiens
uuggccccuuucauccacagcu

SEQ ID NO: 357602 - RNA, 22 nt, Homo sapiens
uuggcccugcugaccauucccu

SEQ ID NO: 357603 - RNA, 19 nt, Homo sapiens
uuggcccugguucucuucu

SEQ ID NO: 357604 - RNA, 21 nt, Homo sapiens
uuggccuggaggccugaaugu

SEQ ID NO: 357605 - RNA, 22 nt, Homo sapiens
uugggaauguccuaauaucucg

SEQ ID NO: 357606 - RNA, 22 nt, Homo sapiens
uugggacuggaaggaguaaggg

SEQ ID NO: 357607 - RNA, 22 nt, Homo sapiens
uugggagugucucuggacugca

SEQ ID NO: 357608 - RNA, 22 nt, Homo sapiens
uugggauggaaauuuguacccc

SEQ ID NO: 357609 - RNA, 22 nt, Homo sapiens
uugggauggaacuuuucaguga

SEQ ID NO: 357610 - RNA, 23 nt, Homo sapiens
uugggcaaaucacuaacgucucc

SEQ ID NO: 357611 - RNA, 21 nt, Homo sapiens
uuggggaauggagagguuuuc

SEQ ID NO: 357612 - RNA, 22 nt, Homo sapiens
uugguaccccugguguacuaau

SEQ ID NO: 357613 - RNA, 22 nt, Homo sapiens
uuggucaggcuagaguguggug

SEQ ID NO: 357614 - RNA, 22 nt, Homo sapiens
uugguccacugugaaauuggga

SEQ ID NO: 357615 - RNA, 23 nt, Homo sapiens
uuggucucccaaaguguugagau

SEQ ID NO: 357616 - RNA, 22 nt, Homo sapiens
uugguucucuuagccaucuuaa

SEQ ID NO: 357617 - RNA, 22 nt, Homo sapiens
uuguaaagucugucucagucag

SEQ ID NO: 357618 - RNA, 22 nt, Homo sapiens
uuguaaaguucucucccgaaaa

SEQ ID NO: 357619 - RNA, 22 nt, Homo sapiens
uuguaagaaucuagcucuuuau

SEQ ID NO: 357620 - RNA, 22 nt, Homo sapiens
uuguacaggaguguaagcuuca

SEQ ID NO: 357621 - RNA, 22 nt, Homo sapiens
uuguacuagaaaauuauucuuu

SEQ ID NO: 357622 - RNA, 22 nt, Homo sapiens
uuguacuagucauauuuugaaa

SEQ ID NO: 357623 - RNA, 22 nt, Homo sapiens
uacaugugccauguugguuugc

SEQ ID NO: 357624 - RNA, 19 nt, Homo sapiens
uacccagaagcagcauugu

SEQ ID NO: 357625 - RNA, 22 nt, Homo sapiens
uacccaguaacaaguauuuugg

SEQ ID NO: 357626 - RNA, 22 nt, Homo sapiens
uaccugagcccucugcugaguu

SEQ ID NO: 357627 - RNA, 22 nt, Homo sapiens
uaccuguagacuacagcuucag

SEQ ID NO: 357628 - RNA, 22 nt, Homo sapiens
uacuagaguagugcagagggga

SEQ ID NO: 357629 - RNA, 22 nt, Homo sapiens
uacucaguaagugcuggcugcu

SEQ ID NO: 357630 - RNA, 22 nt, Homo sapiens
uacuccccuuguucugugagcu

SEQ ID NO: 357631 - RNA, 22 nt, Homo sapiens
uacugagagaggaauauugaaa

SEQ ID NO: 357632 - RNA, 22 nt, Homo sapiens
uacugcacuccagccuggguga

SEQ ID NO: 357633 - RNA, 22 nt, Homo sapiens
uacugcagucagacuccugggc

SEQ ID NO: 357634 - RNA, 22 nt, Homo sapiens
uacugcauucuccgccuccggg

SEQ ID NO: 357635 - RNA, 22 nt, Homo sapiens
aaaagagcugagagguauucuu

SEQ ID NO: 357636 - RNA, 22 nt, Homo sapiens
aaaccacagugugcugcugggg

SEQ ID NO: 357637 - RNA, 15 nt, Homo sapiens
aaacccugucucaag

SEQ ID NO: 357638 - RNA, 23 nt, Homo sapiens
aaagacuagucaggugcaguggu

SEQ ID NO: 357639 - RNA, 22 nt, Homo sapiens
auuggguuaaaggauaugaaca

SEQ ID NO: 357640 - RNA, 22 nt, Homo sapiens
auuggucuugaaaccagagaga

SEQ ID NO: 357641 - RNA, 22 nt, Homo sapiens
auuguguuugaaugaggcucca

SEQ ID NO: 357642 - RNA, 22 nt, Homo sapiens
auuguuccccggucauuuuugu

SEQ ID NO: 357643 - RNA, 22 nt, Homo sapiens
auuuaugguuaauauaggaagu

SEQ ID NO: 357644 - RNA, 22 nt, Homo sapiens
auuugggaaugugcauuauacu

SEQ ID NO: 357645 - RNA, 22 nt, Homo sapiens
auuuugguuacauaguugagcu

SEQ ID NO: 357646 - RNA, 22 nt, Homo sapiens
caaaagugguucuuauccuuuu

SEQ ID NO: 357647 - RNA, 22 nt, Homo sapiens
caaaggauucauuuccaggagu

SEQ ID NO: 357648 - RNA, 22 nt, Homo sapiens
caaaggcuguuauaggccagga

SEQ ID NO: 357649 - RNA, 22 nt, Homo sapiens
caaauacuuucauguugucuug

SEQ ID NO: 357650 - RNA, 22 nt, Homo sapiens
caaaugaucugcuggccucagc

SEQ ID NO: 357651 - RNA, 22 nt, Homo sapiens
caaauugcuugucuguagugga

SEQ ID NO: 357652 - RNA, 20 nt, Homo sapiens
caaauugcuuucuugguuuu

SEQ ID NO: 357653 - RNA, 22 nt, Homo sapiens
caacacagugaaacccgucucu

SEQ ID NO: 357654 - RNA, 22 nt, Homo sapiens
caaggaauucucaauagaguua

SEQ ID NO: 357655 - RNA, 22 nt, Homo sapiens
cacacugucuucauuacuguag

SEQ ID NO: 357656 - RNA, 22 nt, Homo sapiens
cacagcgacuuccgccuaccgg

SEQ ID NO: 357657 - RNA, 22 nt, Homo sapiens
cacagucugggcuuguuuguac

SEQ ID NO: 357658 - RNA, 22 nt, Homo sapiens
cacaguugccuaucuccugaag

SEQ ID NO: 357659 - RNA, 22 nt, Homo sapiens
cacauguuuuagcauggcuguu

SEQ ID NO: 357660 - RNA, 22 nt, Homo sapiens
caccacagccauuauugucccc

SEQ ID NO: 357661 - RNA, 22 nt, Homo sapiens
caccaggugcccagcacggcca

SEQ ID NO: 357662 - RNA, 22 nt, Homo sapiens
caccagguuggagugcaguggu

SEQ ID NO: 357663 - RNA, 22 nt, Homo sapiens
cacccaguaagcaugaggcccu

SEQ ID NO: 357664 - RNA, 22 nt, Homo sapiens
cacccagucaucuuggguuuuu

SEQ ID NO: 357665 - RNA, 22 nt, Homo sapiens
caccccuaccugagucaggagu

SEQ ID NO: 357666 - RNA, 22 nt, Homo sapiens
cacugcacuccagcuuugguga

SEQ ID NO: 357667 - RNA, 22 nt, Homo sapiens
cacugcacuccagucccgucuc

SEQ ID NO: 357668 - RNA, 22 nt, Homo sapiens
cacugcacuccaguuuggauga

SEQ ID NO: 357669 - RNA, 22 nt, Homo sapiens
cacugcaguggaagauuaagaa

SEQ ID NO: 357670 - RNA, 22 nt, Homo sapiens
cacugcauggccacccauguua

SEQ ID NO: 357671 - RNA, 22 nt, Homo sapiens
cacugcauuacucaugagcaug

SEQ ID NO: 357672 - RNA, 17 nt, Homo sapiens
cacugggugcaagagga

SEQ ID NO: 357673 - RNA, 22 nt, Homo sapiens
cacugugcaaccuccaccuccc

SEQ ID NO: 357674 - RNA, 22 nt, Homo sapiens
cagagaacauucagagcuguag

SEQ ID NO: 357675 - RNA, 22 nt, Homo sapiens
cagagaacugaguuauuuucuu

SEQ ID NO: 357676 - RNA, 22 nt, Homo sapiens
cagagagcuugcccuuguauau

SEQ ID NO: 357677 - RNA, 22 nt, Homo sapiens
cagagcaaugcuuuugcuuuga

SEQ ID NO: 357678 - RNA, 22 nt, Homo sapiens
cagagcacuaaagguaaaaggc

SEQ ID NO: 357679 - RNA, 22 nt, Homo sapiens
cagagguauugcaaaagccuag

SEQ ID NO: 357680 - RNA, 22 nt, Homo sapiens
cagaucaucuugagcuuaggaa

SEQ ID NO: 357681 - RNA, 22 nt, Homo sapiens
cagcaaaucauccuauuugagc

SEQ ID NO: 357682 - RNA, 22 nt, Homo sapiens
cagcaguuguuucggauuggga

SEQ ID NO: 357683 - RNA, 22 nt, Homo sapiens
cagccggguggcuccuagggua

SEQ ID NO: 357684 - RNA, 22 nt, Homo sapiens
cagcgaggucugcgucacauug

SEQ ID NO: 357685 - RNA, 22 nt, Homo sapiens
cagcuaguaauuuauugaagau

SEQ ID NO: 357686 - RNA, 22 nt, Homo sapiens
cagcugaugucgaaugcacucu

SEQ ID NO: 357687 - RNA, 22 nt, Homo sapiens
cagcuggugggagcuggguucc

SEQ ID NO: 357688 - RNA, 22 nt, Homo sapiens
cagcugguguuacaaaccagag

SEQ ID NO: 357689 - RNA, 22 nt, Homo sapiens
cagcuguguuauaaacuaccau

SEQ ID NO: 357690 - RNA, 22 nt, Homo sapiens
cagcuugugguauugcugguug

SEQ ID NO: 357691 - RNA, 22 nt, Homo sapiens
caggcauagucuugaguuuuau

SEQ ID NO: 357692 - RNA, 20 nt, Homo sapiens
cagggcaaugaggagguaaa

SEQ ID NO: 357693 - RNA, 22 nt, Homo sapiens
caguagcaugccucagaaugag

SEQ ID NO: 357694 - RNA, 22 nt, Homo sapiens
cagucacagugacaggaugugg

SEQ ID NO: 357695 - RNA, 20 nt, Homo sapiens
cagucauagacaucagaguc

SEQ ID NO: 357696 - RNA, 22 nt, Homo sapiens
cagugcacugggauuauaagug

SEQ ID NO: 357697 - RNA, 20 nt, Homo sapiens
cagugcacuuucccacuggu

SEQ ID NO: 357698 - RNA, 22 nt, Homo sapiens
cagugcaugacuguauauuauc

SEQ ID NO: 357699 - RNA, 22 nt, Homo sapiens
cauaaaucuuguugaauagcac

SEQ ID NO: 357700 - RNA, 22 nt, Homo sapiens
cauacaagcuacaaucacaaag

SEQ ID NO: 357701 - RNA, 22 nt, Homo sapiens
cacaguguuacugguaugaagu

SEQ ID NO: 357702 - RNA, 22 nt, Homo sapiens
cacaguguuccagcuauuugaa

SEQ ID NO: 357703 - RNA, 22 nt, Homo sapiens
cacauagcuagucaguagugaa

SEQ ID NO: 357704 - RNA, 22 nt, Homo sapiens
cacauguuugcuacauuuuucu

SEQ ID NO: 357705 - RNA, 22 nt, Homo sapiens
cacauugaauuucugaugacaa

SEQ ID NO: 357706 - RNA, 23 nt, Homo sapiens
caccaguauaauuagcuuuuaaa

SEQ ID NO: 357707 - RNA, 22 nt, Homo sapiens
caccgagguuggagugcagugg

SEQ ID NO: 357708 - RNA, 22 nt, Homo sapiens
caccugagcgggaugcucgccu

SEQ ID NO: 357709 - RNA, 22 nt, Homo sapiens
caccuguacauggcaguguccu

SEQ ID NO: 357710 - RNA, 22 nt, Homo sapiens
caccuguagucccagcugaggc

SEQ ID NO: 357711 - RNA, 22 nt, Homo sapiens
cacugcacuccagucuggcgac

SEQ ID NO: 357712 - RNA, 22 nt, Homo sapiens
cacugcacucuucuucugggca

SEQ ID NO: 357713 - RNA, 21 nt, Homo sapiens
cacugcacuugccuucugggu

SEQ ID NO: 357714 - RNA, 22 nt, Homo sapiens
cacugcauggucuagcuggguu

SEQ ID NO: 357715 - RNA, 22 nt, Homo sapiens
cacugcauuggaugguuccucc

SEQ ID NO: 357716 - RNA, 22 nt, Homo sapiens
cacugcgaccucugccuaccgg

SEQ ID NO: 357717 - RNA, 22 nt, Homo sapiens
cacugcgacguccgccucccgg

SEQ ID NO: 357718 - RNA, 20 nt, Homo sapiens
cagagcaaagcaguccuggc

SEQ ID NO: 357719 - RNA, 22 nt, Homo sapiens
cagagucaagcucuuguuccau

SEQ ID NO: 357720 - RNA, 22 nt, Homo sapiens
cagagugcauguuuagaugagu

SEQ ID NO: 357721 - RNA, 22 nt, Homo sapiens
cagauggucuuaaggcagccuu

SEQ ID NO: 357722 - RNA, 22 nt, Homo sapiens
cagcagguuuuuaucaguuaag

SEQ ID NO: 357723 - RNA, 22 nt, Homo sapiens
cagccgggugagguggcuuguu

SEQ ID NO: 357724 - RNA, 22 nt, Homo sapiens
cagcucauugcagucucgaccu

SEQ ID NO: 357725 - RNA, 22 nt, Homo sapiens
cagcugcuuuggaaaauauuuu

SEQ ID NO: 357726 - RNA, 23 nt, Homo sapiens
cagcuucauugaacauaacuccu

SEQ ID NO: 357727 - RNA, 22 nt, Homo sapiens
caggaaugugaggguucccugc

SEQ ID NO: 357728 - RNA, 22 nt, Homo sapiens
caggaccucuugccuggaagcc

SEQ ID NO: 357729 - RNA, 22 nt, Homo sapiens
caggcagucuggcucccaagug

SEQ ID NO: 357730 - RNA, 22 nt, Homo sapiens
caggcagugggagacaaaacug

SEQ ID NO: 357731 - RNA, 22 nt, Homo sapiens
caggcauuguccaugcugaagg

SEQ ID NO: 357732 - RNA, 22 nt, Homo sapiens
caggcuuuuccacacauggguu

SEQ ID NO: 357733 - RNA, 22 nt, Homo sapiens
cagggcaugugggucuauuggc

SEQ ID NO: 357734 - RNA, 22 nt, Homo sapiens
cagguaagaugcuuucucuuau

SEQ ID NO: 357735 - RNA, 22 nt, Homo sapiens
cagguacaugcaugugugugca

SEQ ID NO: 357736 - RNA, 22 nt, Homo sapiens
cagguacuucugggcugagcag

SEQ ID NO: 357737 - RNA, 22 nt, Homo sapiens
caguaguagccccuuagaugga

SEQ ID NO: 357738 - RNA, 22 nt, Homo sapiens
cagugacacugaaaaguucggg

SEQ ID NO: 357739 - RNA, 22 nt, Homo sapiens
cagugcauagaugugccacauu

SEQ ID NO: 357740 - RNA, 22 nt, Homo sapiens
cagugcauccauguucagcagu

SEQ ID NO: 357741 - RNA, 23 nt, Homo sapiens
cagugcaugacuguauaugcaaa

SEQ ID NO: 357742 - RNA, 22 nt, Homo sapiens
cagugcauguggcacucuccag

SEQ ID NO: 357743 - RNA, 22 nt, Homo sapiens
cagugcuuuaucaaguccucca

SEQ ID NO: 357744 - RNA, 22 nt, Homo sapiens
cagugucugcauuuggaacuca

SEQ ID NO: 357745 - RNA, 22 nt, Homo sapiens
cauaaagauggaggaggccagg

SEQ ID NO: 357746 - RNA, 23 nt, Homo sapiens
caucacagagccuuccuugacuc

SEQ ID NO: 357747 - RNA, 22 nt, Homo sapiens
caucacagcaaguagggagugg

SEQ ID NO: 357748 - RNA, 22 nt, Homo sapiens
caucacaucugcaugguaagua

SEQ ID NO: 357749 - RNA, 22 nt, Homo sapiens
caucacuguugguacaaguaau

SEQ ID NO: 357750 - RNA, 22 nt, Homo sapiens
caucccugaaccccagaaaucu

SEQ ID NO: 357751 - RNA, 19 nt, Homo sapiens
caucccugagcugaagugg

SEQ ID NO: 357752 - RNA, 19 nt, Homo sapiens
caugauacugcucccucuc

SEQ ID NO: 357753 - RNA, 22 nt, Homo sapiens
cauggauuuuuuugaauggcag

SEQ ID NO: 357754 - RNA, 22 nt, Homo sapiens
cauggcacugagcagguaugca

SEQ ID NO: 357755 - RNA, 22 nt, Homo sapiens
cauggcauuugcagaguugaaa

SEQ ID NO: 357756 - RNA, 22 nt, Homo sapiens
cauggcccugggcugggcgaac

SEQ ID NO: 357757 - RNA, 22 nt, Homo sapiens
cauggcuuuaagcaacaccaag

SEQ ID NO: 357758 - RNA, 22 nt, Homo sapiens
cauggcuuuuauaacaagaaau

SEQ ID NO: 357759 - RNA, 22 nt, Homo sapiens
caugucuuuuaaacauucaacu

SEQ ID NO: 357760 - RNA, 19 nt, Homo sapiens
caugugcacuacuggcuuc

SEQ ID NO: 357761 - RNA, 22 nt, Homo sapiens
cauugcaacuucugccucccag

SEQ ID NO: 357762 - RNA, 22 nt, Homo sapiens
cauugcaaugaggucuugcagu

SEQ ID NO: 357763 - RNA, 20 nt, Homo sapiens
cauugcacuccagccugcug

SEQ ID NO: 357764 - RNA, 22 nt, Homo sapiens
cauugcacuccagccugcugac

SEQ ID NO: 357765 - RNA, 22 nt, Homo sapiens
cauugcacuccagcuugggcaa

SEQ ID NO: 357766 - RNA, 22 nt, Homo sapiens
cauugcacuccagcuugggcga

SEQ ID NO: 357767 - RNA, 22 nt, Homo sapiens
cauugcacucuagccucggcaa

SEQ ID NO: 357768 - RNA, 22 nt, Homo sapiens
cauugcacucugcauuccaguc

SEQ ID NO: 357769 - RNA, 22 nt, Homo sapiens
cauugcacugcauucugggcaa

SEQ ID NO: 357770 - RNA, 22 nt, Homo sapiens
cauugcacuuagacaacuuuug

SEQ ID NO: 357771 - RNA, 20 nt, Homo sapiens
cauugcccuccagccugggc

SEQ ID NO: 357772 - RNA, 22 nt, Homo sapiens
cauugguugaacagauuguguu

SEQ ID NO: 357773 - RNA, 22 nt, Homo sapiens
cauugguuggacaguucucucu

SEQ ID NO: 357774 - RNA, 22 nt, Homo sapiens
cauugguuuauagauggggaaa

SEQ ID NO: 357775 - RNA, 22 nt, Homo sapiens
cauugucccucaaugucuauga

SEQ ID NO: 357776 - RNA, 22 nt, Homo sapiens
cauuugcacugagacucagcuu

SEQ ID NO: 357777 - RNA, 22 nt, Homo sapiens
cauuuugcaguuucugucucca

SEQ ID NO: 357778 - RNA, 22 nt, Homo sapiens
ccaaaguauuuucacugauauc

SEQ ID NO: 357779 - RNA, 22 nt, Homo sapiens
ccaaaucucauguugaaaugug

SEQ ID NO: 357780 - RNA, 22 nt, Homo sapiens
ccaaguguucucauuguucaau

SEQ ID NO: 357781 - RNA, 22 nt, Homo sapiens
ccacagucuaugcaacaagguc

SEQ ID NO: 357782 - RNA, 22 nt, Homo sapiens
ccacaguggauuaaaguuacug

SEQ ID NO: 357783 - RNA, 22 nt, Homo sapiens
ccaggguugcuuuagauucuga

SEQ ID NO: 357784 - RNA, 22 nt, Homo sapiens
ccagguuucuagaauaauuccu

SEQ ID NO: 357785 - RNA, 22 nt, Homo sapiens
ccaguauuuuauugaggguuuu

SEQ ID NO: 357786 - RNA, 22 nt, Homo sapiens
ccagugguugggccggagacgg

SEQ ID NO: 357787 - RNA, 19 nt, Homo sapiens
ccaguguugccagagcuga

SEQ ID NO: 357788 - RNA, 22 nt, Homo sapiens
ccaguucaaugauauggaaacu

SEQ ID NO: 357789 - RNA, 22 nt, Homo sapiens
gaaggcacugugugccacccug

SEQ ID NO: 357790 - RNA, 22 nt, Homo sapiens
gaaguaggugcuguuauuaucu

SEQ ID NO: 357791 - RNA, 22 nt, Homo sapiens
gaagugcaguggcacagucaug

SEQ ID NO: 357792 - RNA, 17 nt, Homo sapiens
gaaguguuucuucauga

SEQ ID NO: 357793 - RNA, 19 nt, Homo sapiens
gaaguguuuguucuccaug

SEQ ID NO: 357794 - RNA, 22 nt, Homo sapiens
gaauagugcugcaauaaacaua

SEQ ID NO: 357795 - RNA, 22 nt, Homo sapiens
gaaucacagauuaugaguaucu

SEQ ID NO: 357796 - RNA, 22 nt, Homo sapiens
gaaugaauguuuauccuuagau

SEQ ID NO: 357797 - RNA, 22 nt, Homo sapiens
gaaugucuuauugcucguugua

SEQ ID NO: 357798 - RNA, 22 nt, Homo sapiens
gaauguuuacuuuguuuaauac

SEQ ID NO: 357799 - RNA, 22 nt, Homo sapiens
gaauuguacugcaaucagggga

SEQ ID NO: 357800 - RNA, 22 nt, Homo sapiens
gacaaguuugauuuauuccaag

SEQ ID NO: 357801 - RNA, 22 nt, Homo sapiens
gacagacacaauugauccauga

SEQ ID NO: 357802 - RNA, 18 nt, Homo sapiens
gacagugugaagauuccu

SEQ ID NO: 357803 - RNA, 18 nt, Homo sapiens
gacaguguggcaauuccu

SEQ ID NO: 357804 - RNA, 22 nt, Homo sapiens
gacaucauuaugagauuuaaac

SEQ ID NO: 357805 - RNA, 22 nt, Homo sapiens
gacauuaucagguuuguuuucu

SEQ ID NO: 357806 - RNA, 22 nt, Homo sapiens
gaccacagacuggaaagagggc

SEQ ID NO: 357807 - RNA, 18 nt, Homo sapiens
gacucaguuucuaaggca

SEQ ID NO: 357808 - RNA, 18 nt, Homo sapiens
gacuccauuucagccaga

SEQ ID NO: 357809 - RNA, 22 nt, Homo sapiens
gacugaguaagcagaagcaauu

SEQ ID NO: 357810 - RNA, 22 nt, Homo sapiens
gagaaccauuuggagaaaaagu

SEQ ID NO: 357811 - RNA, 22 nt, Homo sapiens
gagaacugagugugcuggcgga

SEQ ID NO: 357812 - RNA, 21 nt, Homo sapiens
gagaaucaucauggcugcaua

SEQ ID NO: 357813 - RNA, 22 nt, Homo sapiens
gagaaugagaggggaaggccac

SEQ ID NO: 357814 - RNA, 22 nt, Homo sapiens
gagaaugaugauuuccaauuuc

SEQ ID NO: 357815 - RNA, 22 nt, Homo sapiens
gagacauguuugccaauaauuu

SEQ ID NO: 357816 - RNA, 22 nt, Homo sapiens
gagacuaaagagcuugcccugg

SEQ ID NO: 357817 - RNA, 22 nt, Homo sapiens
gagacucuuagauuggaaaucu

SEQ ID NO: 357818 - RNA, 22 nt, Homo sapiens
gagacugagucucacucuguca

SEQ ID NO: 357819 - RNA, 22 nt, Homo sapiens
gagagcuaggccacuggggcuu

SEQ ID NO: 357820 - RNA, 22 nt, Homo sapiens
gagauaggauucacuuucaugu

SEQ ID NO: 357821 - RNA, 22 nt, Homo sapiens
gagauauucugguuuacuaaau

SEQ ID NO: 357822 - RNA, 22 nt, Homo sapiens
gagaucuuuaagaacuacugcu

SEQ ID NO: 357823 - RNA, 22 nt, Homo sapiens
gagaugaagugucaauaaggau

SEQ ID NO: 357824 - RNA, 22 nt, Homo sapiens
gagaugucuauuucagagaugu

SEQ ID NO: 357825 - RNA, 22 nt, Homo sapiens
gagaugugguucaaggguguuu

SEQ ID NO: 357826 - RNA, 22 nt, Homo sapiens
gagauguuuguuucacugucac

SEQ ID NO: 357827 - RNA, 22 nt, Homo sapiens
gagcaacaguggcagugguggg

SEQ ID NO: 357828 - RNA, 21 nt, Homo sapiens
gagcacauuguccucuaacgc

SEQ ID NO: 357829 - RNA, 22 nt, Homo sapiens
gagcagacaugaggaccgcugg

SEQ ID NO: 357830 - RNA, 22 nt, Homo sapiens
gagcuagggucaugcuacugca

SEQ ID NO: 357831 - RNA, 21 nt, Homo sapiens
gagcuaggugaggcuguaaug

SEQ ID NO: 357832 - RNA, 22 nt, Homo sapiens
gagcuagguuuugaauccagac

SEQ ID NO: 357833 - RNA, 22 nt, Homo sapiens
gagcucauuaaaguaggaccua

SEQ ID NO: 357834 - RNA, 22 nt, Homo sapiens
gagcucauuguugcuaaagaga

SEQ ID NO: 357835 - RNA, 22 nt, Homo sapiens
gagcuggacuucuuaccuuuuc

SEQ ID NO: 357836 - RNA, 22 nt, Homo sapiens
gaggaaguuuacaaagcaucug

SEQ ID NO: 357837 - RNA, 22 nt, Homo sapiens
gaggcagucugacccuuagcag

SEQ ID NO: 357838 - RNA, 22 nt, Homo sapiens
gaggcagucuguccauucucag

SEQ ID NO: 357839 - RNA, 22 nt, Homo sapiens
gaggcauuauucccaucuuaca

SEQ ID NO: 357840 - RNA, 22 nt, Homo sapiens
gagguaggggccuuaaagaugc

SEQ ID NO: 357841 - RNA, 22 nt, Homo sapiens
gagguagggucccacuauguug

SEQ ID NO: 357842 - RNA, 22 nt, Homo sapiens
gaggugaaggucucaauaaaua

SEQ ID NO: 357843 - RNA, 22 nt, Homo sapiens
gaguagaacugguuaucuaaua

SEQ ID NO: 357844 - RNA, 22 nt, Homo sapiens
gaguagugcugcaguaaacaua

SEQ ID NO: 357845 - RNA, 22 nt, Homo sapiens
gaguauauuugcacuguuaugu

SEQ ID NO: 357846 - RNA, 23 nt, Homo sapiens
gagugcaaugacaugaucucgga

SEQ ID NO: 357847 - RNA, 22 nt, Homo sapiens
gagugcauugguggucaggugu

SEQ ID NO: 357848 - RNA, 22 nt, Homo sapiens
gagugcugagcccacuuccuug

SEQ ID NO: 357849 - RNA, 23 nt, Homo sapiens
gaguggagacucauugauuuccu

SEQ ID NO: 357850 - RNA, 22 nt, Homo sapiens
gaguucauaucuaugagugugc

SEQ ID NO: 357851 - RNA, 22 nt, Homo sapiens
gaguuccuuugagccugagagg

SEQ ID NO: 357852 - RNA, 19 nt, Homo sapiens
gaguugggguuuacuguaa

SEQ ID NO: 357853 - RNA, 22 nt, Homo sapiens
gaguuguuuuaaggcacugacu

SEQ ID NO: 357854 - RNA, 22 nt, Homo sapiens
gauaaagauagcaauagggaca

SEQ ID NO: 357855 - RNA, 21 nt, Homo sapiens
gauaaguuggcagccagcacc

SEQ ID NO: 357856 - RNA, 22 nt, Homo sapiens
gauacaguaugcaugugguauu

SEQ ID NO: 357857 - RNA, 19 nt, Homo sapiens
gauagacaucacagugcca

SEQ ID NO: 357858 - RNA, 21 nt, Homo sapiens
gauaucuuuauucccaagagc

SEQ ID NO: 357859 - RNA, 22 nt, Homo sapiens
gauaucuuuuguauggugagcu

SEQ ID NO: 357860 - RNA, 22 nt, Homo sapiens
gaucacauggccauuucuagcu

SEQ ID NO: 357861 - RNA, 22 nt, Homo sapiens
gaucagagugaaccuuguuaug

SEQ ID NO: 357862 - RNA, 22 nt, Homo sapiens
gaugacagcugacucccuugcu

SEQ ID NO: 357863 - RNA, 22 nt, Homo sapiens
gaugagcuaaguucucacagca

SEQ ID NO: 357864 - RNA, 22 nt, Homo sapiens
gaugaggcuagagacaugugua

SEQ ID NO: 357865 - RNA, 22 nt, Homo sapiens
gaugauguuugauaaauaauaa

SEQ ID NO: 357866 - RNA, 22 nt, Homo sapiens
gauggcacuaagccauguagga

SEQ ID NO: 357867 - RNA, 22 nt, Homo sapiens
gauggugucccaggcucaggcu

SEQ ID NO: 357868 - RNA, 22 nt, Homo sapiens
gauguagaaagagugggcugga

SEQ ID NO: 357869 - RNA, 22 nt, Homo sapiens
gauuccauuuguggcuauuuac

SEQ ID NO: 357870 - RNA, 22 nt, Homo sapiens
gauuggcauugcugcaccugag

SEQ ID NO: 357871 - RNA, 21 nt, Homo sapiens
gcaaacauccuuugaugccag

SEQ ID NO: 357872 - RNA, 21 nt, Homo sapiens
gcaaaggaauugccuaagcuu

SEQ ID NO: 357873 - RNA, 22 nt, Homo sapiens
gcaaaucuuauguccucacauu

SEQ ID NO: 357874 - RNA, 22 nt, Homo sapiens
gcaagagguaucuuauuuuccc

SEQ ID NO: 357875 - RNA, 22 nt, Homo sapiens
gcaagugucugagguuuuguau

SEQ ID NO: 357876 - RNA, 22 nt, Homo sapiens
gcaauggaaucccuugaucaau

SEQ ID NO: 357877 - RNA, 22 nt, Homo sapiens
guuggugaccugaagagaguaa

SEQ ID NO: 357878 - RNA, 22 nt, Homo sapiens
guuugcagaucaugaagaaccc

SEQ ID NO: 357879 - RNA, 22 nt, Homo sapiens
guuugccuuuuagauaggaaug

SEQ ID NO: 357880 - RNA, 22 nt, Homo sapiens
guuuuuggggucacuauuaccg

SEQ ID NO: 357881 - RNA, 22 nt, Homo sapiens
uaaagagcuuuugaggugucau

SEQ ID NO: 357882 - RNA, 22 nt, Homo sapiens
uaaagcuaucacauuggugauu

SEQ ID NO: 357883 - RNA, 22 nt, Homo sapiens
uaaagcugaaaugauuaugaca

SEQ ID NO: 357884 - RNA, 21 nt, Homo sapiens
uaaagcuuagcuauaguggcu

SEQ ID NO: 357885 - RNA, 22 nt, Homo sapiens
uaaaguguuuguuauuaaaggu

SEQ ID NO: 357886 - RNA, 22 nt, Homo sapiens
uaaaugcuuaauugaaugugga

SEQ ID NO: 357887 - RNA, 18 nt, Homo sapiens
uaaauugcuucaccugag

SEQ ID NO: 357888 - RNA, 16 nt, Homo sapiens
uaacacaguucccacc

SEQ ID NO: 357889 - RNA, 19 nt, Homo sapiens
uaacacaguuguguuugag

SEQ ID NO: 357890 - RNA, 22 nt, Homo sapiens
uaacagucuccucaagguguug

SEQ ID NO: 357891 - RNA, 23 nt, Homo sapiens
uaacauguuuuuaagggaagcuu

SEQ ID NO: 357892 - RNA, 21 nt, Homo sapiens
uaacccugaaggagcucugga

SEQ ID NO: 357893 - RNA, 22 nt, Homo sapiens
uaacuagaaaggagacaguugc

SEQ ID NO: 357894 - RNA, 22 nt, Homo sapiens
uaacuguggaaaugacuuuaaa

SEQ ID NO: 357895 - RNA, 22 nt, Homo sapiens
uaagacacauguguucccaggc

SEQ ID NO: 357896 - RNA, 22 nt, Homo sapiens
uaagcaguguggauccaccuug

SEQ ID NO: 357897 - RNA, 21 nt, Homo sapiens
uaagcuaaacauucaguuaac

SEQ ID NO: 357898 - RNA, 22 nt, Homo sapiens
uaagcucauuccagccaugucc

SEQ ID NO: 357899 - RNA, 22 nt, Homo sapiens
uaaggcaaguuuuuaguggaca

SEQ ID NO: 357900 - RNA, 18 nt, Homo sapiens
uaaggcacuauaggcauu

SEQ ID NO: 357901 - RNA, 22 nt, Homo sapiens
uaaggcauuuuuuugaguugca

SEQ ID NO: 357902 - RNA, 22 nt, Homo sapiens
uaaggcuuugucuuaggacuuu

SEQ ID NO: 357903 - RNA, 22 nt, Homo sapiens
uaaguauuaugugcugcauuuu

SEQ ID NO: 357904 - RNA, 22 nt, Homo sapiens
uaagugaugucuuuuugugugc

SEQ ID NO: 357905 - RNA, 22 nt, Homo sapiens
uaagugcaacauaaguguuaaa

SEQ ID NO: 357906 - RNA, 20 nt, Homo sapiens
uaagugcuugagacuucuga

SEQ ID NO: 357907 - RNA, 22 nt, Homo sapiens
uaaguggaagaugucaaucaua

SEQ ID NO: 357908 - RNA, 22 nt, Homo sapiens
uaaguuagugugagaauuuugc

SEQ ID NO: 357909 - RNA, 23 nt, Homo sapiens
uaaguucaucucuaauaggugga

SEQ ID NO: 357910 - RNA, 22 nt, Homo sapiens
uaaguuguagaacguuuucuua

SEQ ID NO: 357911 - RNA, 18 nt, Homo sapiens
uaauaacugugaccuuga

SEQ ID NO: 357912 - RNA, 22 nt, Homo sapiens
uaauacauucaaggugguaguu

SEQ ID NO: 357913 - RNA, 22 nt, Homo sapiens
uaauacuguaauggugguuccg

SEQ ID NO: 357914 - RNA, 22 nt, Homo sapiens
uaauauguauacagacagauac

SEQ ID NO: 357915 - RNA, 22 nt, Homo sapiens
uaauaugugguugcuugggcac

SEQ ID NO: 357916 - RNA, 22 nt, Homo sapiens
uaaucucagcuacucaggaggc

SEQ ID NO: 357917 - RNA, 22 nt, Homo sapiens
uaaucucagcugagcugagauu

SEQ ID NO: 357918 - RNA, 22 nt, Homo sapiens
uaaugcaucaugguuggcaaac

SEQ ID NO: 357919 - RNA, 22 nt, Homo sapiens
uaaugugcuucucuaccauagg

SEQ ID NO: 357920 - RNA, 22 nt, Homo sapiens
uacaaagcuacucgagggcagg

SEQ ID NO: 357921 - RNA, 22 nt, Homo sapiens
uacaaagcuuucugcaaaucau

SEQ ID NO: 357922 - RNA, 22 nt, Homo sapiens
uacaacacugguucgacaugug

SEQ ID NO: 357923 - RNA, 22 nt, Homo sapiens
uacaagcacaggcagcaggcug

SEQ ID NO: 357924 - RNA, 22 nt, Homo sapiens
uacaaguaauaagggaagaauu

SEQ ID NO: 357925 - RNA, 16 nt, Homo sapiens
uacaauguagaaaaca

SEQ ID NO: 357926 - RNA, 22 nt, Homo sapiens
uacaccugcacucuagccuggg

SEQ ID NO: 357927 - RNA, 22 nt, Homo sapiens
uacaggcagguguucccugguu

SEQ ID NO: 357928 - RNA, 22 nt, Homo sapiens
uacaguaauguuaaucuuugug

SEQ ID NO: 357929 - RNA, 22 nt, Homo sapiens
uacaguacacagguaccaagcu

SEQ ID NO: 357930 - RNA, 22 nt, Homo sapiens
uacaguacagugacaccauuau

SEQ ID NO: 357931 - RNA, 22 nt, Homo sapiens
uacaguauuaugagugauugaa

SEQ ID NO: 357932 - RNA, 22 nt, Homo sapiens
uacagucauaaugccuagugac

SEQ ID NO: 357933 - RNA, 22 nt, Homo sapiens
uacaguggcaugucaggugcuu

SEQ ID NO: 357934 - RNA, 22 nt, Homo sapiens
uacagugggcacuggcgcccug

SEQ ID NO: 357935 - RNA, 19 nt, Homo sapiens
uacauaguauuuaguggca

SEQ ID NO: 357936 - RNA, 22 nt, Homo sapiens
uacaugcaugggcaugugugca

SEQ ID NO: 357937 - RNA, 22 nt, Homo sapiens
uaccaaaguuucggccucuguu

SEQ ID NO: 357938 - RNA, 23 nt, Homo sapiens
uaccacauuccuucuuuccuguu

SEQ ID NO: 357939 - RNA, 22 nt, Homo sapiens
uaccacauuguagagggcauuc

SEQ ID NO: 357940 - RNA, 22 nt, Homo sapiens
uaccaguaaugguucuagagga

SEQ ID NO: 357941 - RNA, 22 nt, Homo sapiens
uaccugagucuagagucuagaa

SEQ ID NO: 357942 - RNA, 22 nt, Homo sapiens
uaccuguagcucuucuaggcug

SEQ ID NO: 357943 - RNA, 22 nt, Homo sapiens
uacguaucagucguuucuguga

SEQ ID NO: 357944 - RNA, 22 nt, Homo sapiens
uacuagaaccuuauucagagug

SEQ ID NO: 357945 - RNA, 22 nt, Homo sapiens
uacucaguagacacucauaugu

SEQ ID NO: 357946 - RNA, 22 nt, Homo sapiens
uacucuuuagcuccuuaaggaa

SEQ ID NO: 357947 - RNA, 22 nt, Homo sapiens
uacugcacuccacccuggguga

SEQ ID NO: 357948 - RNA, 22 nt, Homo sapiens
uacugcuaccuccagcuucugg

SEQ ID NO: 357949 - RNA, 22 nt, Homo sapiens
uacuguguaguuagaccucaga

SEQ ID NO: 357950 - RNA, 22 nt, Homo sapiens
uacuuuguagauuguuuccuuu

SEQ ID NO: 357951 - RNA, 22 nt, Homo sapiens
uagaaguaggcuacgugucugg

SEQ ID NO: 357952 - RNA, 22 nt, Homo sapiens
uagaaucuaacucgcaugaaaa

SEQ ID NO: 357953 - RNA, 22 nt, Homo sapiens
uagaauguaaauuccaagggca

SEQ ID NO: 357954 - RNA, 22 nt, Homo sapiens
uagaccaauuggcauauaguaa

SEQ ID NO: 357955 - RNA, 22 nt, Homo sapiens
uagacuguaagauccaggagag

SEQ ID NO: 357956 - RNA, 22 nt, Homo sapiens
uagagauaucaauuucauggug

SEQ ID NO: 357957 - RNA, 21 nt, Homo sapiens
uagagcaacacacgcccucuc

SEQ ID NO: 357958 - RNA, 22 nt, Homo sapiens
uagagcacaagguagauuucua

SEQ ID NO: 357959 - RNA, 22 nt, Homo sapiens
uagagccauugcagauguuuga

SEQ ID NO: 357960 - RNA, 23 nt, Homo sapiens
uagaucaucaaguuuacugugcu

SEQ ID NO: 357961 - RNA, 22 nt, Homo sapiens
uagcaaguguuuaagcacuuuu

SEQ ID NO: 357962 - RNA, 22 nt, Homo sapiens
uagcacagggaauugguucucu

SEQ ID NO: 357963 - RNA, 17 nt, Homo sapiens
uagcacagugccuggua

SEQ ID NO: 357964 - RNA, 22 nt, Homo sapiens
uagcacaguucacccucgauuu

SEQ ID NO: 357965 - RNA, 22 nt, Homo sapiens
ucaaagugcuauggcucagguu

SEQ ID NO: 357966 - RNA, 22 nt, Homo sapiens
ucaaaugaucugcccgccuugg

SEQ ID NO: 357967 - RNA, 22 nt, Homo sapiens
ucaaaugauucacccaccuuug

SEQ ID NO: 357968 - RNA, 22 nt, Homo sapiens
ucaaaugcucuuugcagagagg

SEQ ID NO: 357969 - RNA, 22 nt, Homo sapiens
ucaaauguuuguuuaaggcuua

SEQ ID NO: 357970 - RNA, 22 nt, Homo sapiens
ucaaggacucagagagggauua

SEQ ID NO: 357971 - RNA, 22 nt, Homo sapiens
ucaagugauucuugugccuuag

SEQ ID NO: 357972 - RNA, 19 nt, Homo sapiens
ucaauucugucaauggcuu

SEQ ID NO: 357973 - RNA, 20 nt, Homo sapiens
ucacaagccaagaucacguc

SEQ ID NO: 357974 - RNA, 22 nt, Homo sapiens
ucacaaggcaggaaugaaaggg

SEQ ID NO: 357975 - RNA, 22 nt, Homo sapiens
ucacaaguguauagacaugucc

SEQ ID NO: 357976 - RNA, 22 nt, Homo sapiens
ucacaauucucaauuugugaaa

SEQ ID NO: 357977 - RNA, 19 nt, Homo sapiens
ucacacuguggcuucuuua

SEQ ID NO: 357978 - RNA, 22 nt, Homo sapiens
ucacagacugagccaaauagag

SEQ ID NO: 357979 - RNA, 22 nt, Homo sapiens
ucacagauaaauaaagaugauu

SEQ ID NO: 357980 - RNA, 22 nt, Homo sapiens
ucacagaugaggcgagaggcag

SEQ ID NO: 357981 - RNA, 22 nt, Homo sapiens
ucacaguaaauccagaagaaau

SEQ ID NO: 357982 - RNA, 22 nt, Homo sapiens
ucacaguagggaacugacaaag

SEQ ID NO: 357983 - RNA, 22 nt, Homo sapiens
ucacaguauucaugaacaugga

SEQ ID NO: 357984 - RNA, 20 nt, Homo sapiens
ucacagucacacauaauccu

SEQ ID NO: 357985 - RNA, 22 nt, Homo sapiens
ucacagucuccucuagggaggg

SEQ ID NO: 357986 - RNA, 22 nt, Homo sapiens
ucacaguguuaaaccuuucuuu

SEQ ID NO: 357987 - RNA, 22 nt, Homo sapiens
ucacaguucagcauggcugagg

SEQ ID NO: 357988 - RNA, 22 nt, Homo sapiens
ucacaguugauugaaacacagc

SEQ ID NO: 357989 - RNA, 22 nt, Homo sapiens
ucacauagcauaaugucugcaa

SEQ ID NO: 357990 - RNA, 22 nt, Homo sapiens
ucacauggaggugauaguugaa

SEQ ID NO: 357991 - RNA, 22 nt, Homo sapiens
ucacaugugacauauauauuug

SEQ ID NO: 357992 - RNA, 22 nt, Homo sapiens
ucacauuaagcuguuauuucuu

SEQ ID NO: 357993 - RNA, 22 nt, Homo sapiens
ucacauucaauuguaauccccg

SEQ ID NO: 357994 - RNA, 22 nt, Homo sapiens
ucaccaccuuccaggaccacug

SEQ ID NO: 357995 - RNA, 22 nt, Homo sapiens
ucaccaguaauaaagagccugc

SEQ ID NO: 357996 - RNA, 22 nt, Homo sapiens
ucaccaguacuccaaauugagg

SEQ ID NO: 357997 - RNA, 20 nt, Homo sapiens
ucacccugacaucugcccag

SEQ ID NO: 357998 - RNA, 19 nt, Homo sapiens
ucaccuugcccugcacaca

SEQ ID NO: 357999 - RNA, 22 nt, Homo sapiens
ucacucagaccuggugauaugc

SEQ ID NO: 358000 - RNA, 22 nt, Homo sapiens
ucacugaaaccacugccuccug

SEQ ID NO: 358001 - RNA, 22 nt, Homo sapiens
ucacugagcacaggagaugugc

SEQ ID NO: 358002 - RNA, 21 nt, Homo sapiens
ucacugagcaucaugguuuca

SEQ ID NO: 358003 - RNA, 22 nt, Homo sapiens
ucacugagcuagaucacuugac

SEQ ID NO: 358004 - RNA, 22 nt, Homo sapiens
ucacugaggucugagcuuuaug

SEQ ID NO: 358005 - RNA, 20 nt, Homo sapiens
ucacugaguaucuacgauua

SEQ ID NO: 358006 - RNA, 20 nt, Homo sapiens
ucacugugaacuucuugagg

SEQ ID NO: 358007 - RNA, 22 nt, Homo sapiens
ucacugugagaguuuauccugu

SEQ ID NO: 358008 - RNA, 22 nt, Homo sapiens
ucacugugcacauaugauaggu

SEQ ID NO: 358009 - RNA, 22 nt, Homo sapiens
ucacugugguuugggaaagugc

SEQ ID NO: 358010 - RNA, 18 nt, Homo sapiens
ucacugugugucuugggu

SEQ ID NO: 358011 - RNA, 22 nt, Homo sapiens
ucacuuggccgcagccuucucu

SEQ ID NO: 358012 - RNA, 22 nt, Homo sapiens
ucagacacugagcaaacgacua

SEQ ID NO: 358013 - RNA, 22 nt, Homo sapiens
ucagacacuguggccuuuggac

SEQ ID NO: 358014 - RNA, 22 nt, Homo sapiens
ucagaccauuucauuacagacu

SEQ ID NO: 358015 - RNA, 22 nt, Homo sapiens
ucagaguagcugucugaggugc

SEQ ID NO: 358016 - RNA, 22 nt, Homo sapiens
ucagaguaguuccuggcagaaa

SEQ ID NO: 358017 - RNA, 22 nt, Homo sapiens
ucagaucauauucuucgcugcu

SEQ ID NO: 358018 - RNA, 19 nt, Homo sapiens
ucagaugcauuagggguua

SEQ ID NO: 358019 - RNA, 22 nt, Homo sapiens
ucagauguuucuuuaacgcaug

SEQ ID NO: 358020 - RNA, 22 nt, Homo sapiens
ucagcaaugaccuaagcaaaua

SEQ ID NO: 358021 - RNA, 22 nt, Homo sapiens
ucagcaguggacagaaugguag

SEQ ID NO: 358022 - RNA, 22 nt, Homo sapiens
ucagcaucacaggcagugagug

SEQ ID NO: 358023 - RNA, 16 nt, Homo sapiens
ucagcgagggagccag

SEQ ID NO: 358024 - RNA, 22 nt, Homo sapiens
ucaggcaccuuccucuuaucug

SEQ ID NO: 358025 - RNA, 22 nt, Homo sapiens
ucaggcuuuucccagagugaug

SEQ ID NO: 358026 - RNA, 21 nt, Homo sapiens
ucaggcuuuuugagugccaau

SEQ ID NO: 358027 - RNA, 22 nt, Homo sapiens
ucagguagugccaugauugauu

SEQ ID NO: 358028 - RNA, 23 nt, Homo sapiens
ucagguaguuucagaggaccuug

SEQ ID NO: 358029 - RNA, 22 nt, Homo sapiens
ucagguaguuugugggagauga

SEQ ID NO: 358030 - RNA, 22 nt, Homo sapiens
ucaggugcaguggcucaugcuu

SEQ ID NO: 358031 - RNA, 23 nt, Homo sapiens
ucaguacucuauaagugccagcu

SEQ ID NO: 358032 - RNA, 19 nt, Homo sapiens
ucaguagugcacauaagcc

SEQ ID NO: 358033 - RNA, 22 nt, Homo sapiens
ucagucauguuuaccagacgua

SEQ ID NO: 358034 - RNA, 22 nt, Homo sapiens
ucagugcaggaauuuccuuaga

SEQ ID NO: 358035 - RNA, 22 nt, Homo sapiens
ucagugcuuggcacagagagcu

SEQ ID NO: 358036 - RNA, 22 nt, Homo sapiens
ucaguggagccucacucugugg

SEQ ID NO: 358037 - RNA, 22 nt, Homo sapiens
ucaguggagcuacaauucuggg

SEQ ID NO: 358038 - RNA, 22 nt, Homo sapiens
ucaguggauuauuaaagucacc

SEQ ID NO: 358039 - RNA, 22 nt, Homo sapiens
ucagugucugcauucuuauugu

SEQ ID NO: 358040 - RNA, 22 nt, Homo sapiens
ucaguguuuggaaucucaauuu

SEQ ID NO: 358041 - RNA, 22 nt, Homo sapiens
ucaguuaaugcugccugcugga

SEQ ID NO: 358042 - RNA, 22 nt, Homo sapiens
ucauacuguugugaaacaaaac

SEQ ID NO: 358043 - RNA, 20 nt, Homo sapiens
ucauagcuuuuuccacuuua

SEQ ID NO: 358044 - RNA, 22 nt, Homo sapiens
ucauaucauuagaucuacugua

SEQ ID NO: 358045 - RNA, 22 nt, Homo sapiens
ucauauugguuaaaauaguggg

SEQ ID NO: 358046 - RNA, 16 nt, Homo sapiens
ucaucacagucucugg

SEQ ID NO: 358047 - RNA, 22 nt, Homo sapiens
ucaucaggcucauucaagcuga

SEQ ID NO: 358048 - RNA, 22 nt, Homo sapiens
ucaucucaguuucuugccguac

SEQ ID NO: 358049 - RNA, 22 nt, Homo sapiens
ucaucuggcgaaugugaagagu

SEQ ID NO: 358050 - RNA, 22 nt, Homo sapiens
ucaugacacagcauacugacuu

SEQ ID NO: 358051 - RNA, 22 nt, Homo sapiens
ucauguacuuguagucccggcu

SEQ ID NO: 358052 - RNA, 22 nt, Homo sapiens
ucaugugaggauaacaauagug

SEQ ID NO: 358053 - RNA, 22 nt, Homo sapiens
ucuugcaauuuccuuaguggug

SEQ ID NO: 358054 - RNA, 22 nt, Homo sapiens
ucuugcuuuugcagagcuucuc

SEQ ID NO: 358055 - RNA, 20 nt, Homo sapiens
ucuugggaauguagccuagg

SEQ ID NO: 358056 - RNA, 22 nt, Homo sapiens
ucuugggugaguuugugaauaa

SEQ ID NO: 358057 - RNA, 21 nt, Homo sapiens
ucuuggguugaauucucccag

SEQ ID NO: 358058 - RNA, 22 nt, Homo sapiens
ucuuggguuguuggcuucuccu

SEQ ID NO: 358059 - RNA, 22 nt, Homo sapiens
ucuuggguuuguccuucuccua

SEQ ID NO: 358060 - RNA, 22 nt, Homo sapiens
ucuuugauuaugcagauggguu

SEQ ID NO: 358061 - RNA, 22 nt, Homo sapiens
ucuuugguaauggaugucugau

SEQ ID NO: 358062 - RNA, 22 nt, Homo sapiens
ucuuugguaugugcaugugcuu

SEQ ID NO: 358063 - RNA, 22 nt, Homo sapiens
ucuuuggucagaaagauuacac

SEQ ID NO: 358064 - RNA, 22 nt, Homo sapiens
ucuuuguguaggucaaucuggc

SEQ ID NO: 358065 - RNA, 22 nt, Homo sapiens
ucuuuguuggaguccaaggaua

SEQ ID NO: 358066 - RNA, 22 nt, Homo sapiens
ucuuuuguaaaaugaggaggug

SEQ ID NO: 358067 - RNA, 22 nt, Homo sapiens
ucuuuugugagucagccucucc

SEQ ID NO: 358068 - RNA, 22 nt, Homo sapiens
ugaaaagucuaagauuaagguu

SEQ ID NO: 358069 - RNA, 22 nt, Homo sapiens
ugaaagacugaaagcuuuucuu

SEQ ID NO: 358070 - RNA, 20 nt, Homo sapiens
ugaaaucuucacuaagucuc

SEQ ID NO: 358071 - RNA, 21 nt, Homo sapiens
ugaaaugcaugugcacauuaa

SEQ ID NO: 358072 - RNA, 22 nt, Homo sapiens
ugaaaugcuaauucguagcuaa

SEQ ID NO: 358073 - RNA, 22 nt, Homo sapiens
ugaaauggugcggucugcagca

SEQ ID NO: 358074 - RNA, 22 nt, Homo sapiens
ugaaauguaaguugucuagucu

SEQ ID NO: 358075 - RNA, 22 nt, Homo sapiens
ugaaauguuaaacaaguggcuc

SEQ ID NO: 358076 - RNA, 22 nt, Homo sapiens
ugaacagagaaacacuggccau

SEQ ID NO: 358077 - RNA, 22 nt, Homo sapiens
ugaagacauuuuugggugugua

SEQ ID NO: 358078 - RNA, 22 nt, Homo sapiens
ugaaggacauaaggcagaguga

SEQ ID NO: 358079 - RNA, 22 nt, Homo sapiens
ugaaggcaggagggagaaaagu

SEQ ID NO: 358080 - RNA, 22 nt, Homo sapiens
ugaaggccgggcaugguggcuc

SEQ ID NO: 358081 - RNA, 22 nt, Homo sapiens
ugaaguaggcauaaguuaagcu

SEQ ID NO: 358082 - RNA, 22 nt, Homo sapiens
ugaagugaagacucacagaagg

SEQ ID NO: 358083 - RNA, 22 nt, Homo sapiens
ugaagugggaaaugaguauuaa

SEQ ID NO: 358084 - RNA, 21 nt, Homo sapiens
ugaaguguaaccgugcagggc

SEQ ID NO: 358085 - RNA, 22 nt, Homo sapiens
ugaaguguuuuuucaggcaugu

SEQ ID NO: 358086 - RNA, 22 nt, Homo sapiens
ugaauagaaguuuacuccuuuu

SEQ ID NO: 358087 - RNA, 22 nt, Homo sapiens
ugaauauguuaaauaauguucu

SEQ ID NO: 358088 - RNA, 22 nt, Homo sapiens
ugaauggauccaauucuuagua

SEQ ID NO: 358089 - RNA, 22 nt, Homo sapiens
ugaaugguaaagaaaagcacug

SEQ ID NO: 358090 - RNA, 22 nt, Homo sapiens
ugaauguaacuaaaccugugaa

SEQ ID NO: 358091 - RNA, 22 nt, Homo sapiens
ugaauguaagaugucugcuggu

SEQ ID NO: 358092 - RNA, 21 nt, Homo sapiens
ugaaugucuaggcagaaguuu

SEQ ID NO: 358093 - RNA, 22 nt, Homo sapiens
ugaauguuguugguugagauau

SEQ ID NO: 358094 - RNA, 22 nt, Homo sapiens
ugacaagaaagcgucuucuuuu

SEQ ID NO: 358095 - RNA, 22 nt, Homo sapiens
ugacaagagaccccuccgcagg

SEQ ID NO: 358096 - RNA, 23 nt, Homo sapiens
ugacaagagcgagacuuggucuc

SEQ ID NO: 358097 - RNA, 22 nt, Homo sapiens
ugacaagaguagagagggugcc

SEQ ID NO: 358098 - RNA, 22 nt, Homo sapiens
ugacacagugggggauccuuuu

SEQ ID NO: 358099 - RNA, 22 nt, Homo sapiens
ugacagagaagcauugaguuca

SEQ ID NO: 358100 - RNA, 22 nt, Homo sapiens
ugacagaggucuuuuaauagcu

SEQ ID NO: 358101 - RNA, 18 nt, Homo sapiens
ugacagcacaugugggga

SEQ ID NO: 358102 - RNA, 22 nt, Homo sapiens
ugacagcaucaggauuggagag

SEQ ID NO: 358103 - RNA, 22 nt, Homo sapiens
ugacaguaaacagucuugauua

SEQ ID NO: 358104 - RNA, 22 nt, Homo sapiens
ugacagugaacagguuaccacu

SEQ ID NO: 358105 - RNA, 22 nt, Homo sapiens
ugacagugaauaagucucuuaa

SEQ ID NO: 358106 - RNA, 23 nt, Homo sapiens
ugacagugcuugaaauugcucuu

SEQ ID NO: 358107 - RNA, 20 nt, Homo sapiens
ugacaucagcaauguaauaa

SEQ ID NO: 358108 - RNA, 22 nt, Homo sapiens
ugacaugaagaaaaacagauuu

SEQ ID NO: 358109 - RNA, 22 nt, Homo sapiens
ugacaugaugagcaauaauggc

SEQ ID NO: 358110 - RNA, 22 nt, Homo sapiens
ugacauggaaguagguauacau

SEQ ID NO: 358111 - RNA, 22 nt, Homo sapiens
ugacauggagggugcggcugca

SEQ ID NO: 358112 - RNA, 19 nt, Homo sapiens
ugaccagggacagaaacca

SEQ ID NO: 358113 - RNA, 22 nt, Homo sapiens
ugacccuguggcagcgucuaag

SEQ ID NO: 358114 - RNA, 22 nt, Homo sapiens
ugacuagagacagaaacuaaaa

SEQ ID NO: 358115 - RNA, 22 nt, Homo sapiens
ugacuauaggauaacaugcauu

SEQ ID NO: 358116 - RNA, 23 nt, Homo sapiens
ugacugaguauauguuuggugcu

SEQ ID NO: 358117 - RNA, 22 nt, Homo sapiens
ugacugucuagauagagcuugg

SEQ ID NO: 358118 - RNA, 22 nt, Homo sapiens
ugacuucagacugaaaugauuc

SEQ ID NO: 358119 - RNA, 22 nt, Homo sapiens
ugacuugaacuucuaugucacc

SEQ ID NO: 358120 - RNA, 22 nt, Homo sapiens
ugacuugaucacccccuaaggg

SEQ ID NO: 358121 - RNA, 22 nt, Homo sapiens
ugacuuuagaauuuuauccaga

SEQ ID NO: 358122 - RNA, 17 nt, Homo sapiens
ugagaacaugugguauu

SEQ ID NO: 358123 - RNA, 19 nt, Homo sapiens
ugagaacaugugguauuug

SEQ ID NO: 358124 - RNA, 22 nt, Homo sapiens
ugagaacuagagaacaagguga

SEQ ID NO: 358125 - RNA, 22 nt, Homo sapiens
ugagaagaugaacuccuugguc

SEQ ID NO: 358126 - RNA, 22 nt, Homo sapiens
ugagaagcauaccagugucugu

SEQ ID NO: 358127 - RNA, 22 nt, Homo sapiens
ugagaauauuuuccaugucuca

SEQ ID NO: 358128 - RNA, 22 nt, Homo sapiens
ugagacacuucccagaucccuu

SEQ ID NO: 358129 - RNA, 22 nt, Homo sapiens
ugagacgaagucuugcucuguu

SEQ ID NO: 358130 - RNA, 22 nt, Homo sapiens
ugagacggagucucgcucuguu

SEQ ID NO: 358131 - RNA, 22 nt, Homo sapiens
ugagacggagucuugcucuguc

SEQ ID NO: 358132 - RNA, 22 nt, Homo sapiens
ugagacggaguuuugcucuugu

SEQ ID NO: 358133 - RNA, 22 nt, Homo sapiens
ugagacugagucuugcucuugu

SEQ ID NO: 358134 - RNA, 22 nt, Homo sapiens
ugagacugaguuuugcucuugu

SEQ ID NO: 358135 - RNA, 22 nt, Homo sapiens
ugagagacagacauuaucuuau

SEQ ID NO: 358136 - RNA, 22 nt, Homo sapiens
ugagagacaguuuguuaaaauu

SEQ ID NO: 358137 - RNA, 22 nt, Homo sapiens
ugagagaugaacuauucuugaa

SEQ ID NO: 358138 - RNA, 22 nt, Homo sapiens
ugagauaaucaugugauuucau

SEQ ID NO: 358139 - RNA, 22 nt, Homo sapiens
ugagauaguacuuuuuuaaagg

SEQ ID NO: 358140 - RNA, 22 nt, Homo sapiens
ugagaucaacugagucagagca

SEQ ID NO: 358141 - RNA, 22 nt, Homo sapiens
ugggaaugaaauuacauagcuu

SEQ ID NO: 358142 - RNA, 19 nt, Homo sapiens
ugggaauguaaauuaguuc

SEQ ID NO: 358143 - RNA, 22 nt, Homo sapiens
ugggagcauugcauuagaagcc

SEQ ID NO: 358144 - RNA, 22 nt, Homo sapiens
ugggagugugcacaauuucagc

SEQ ID NO: 358145 - RNA, 22 nt, Homo sapiens
ugggaucauucaaugacgaaau

SEQ ID NO: 358146 - RNA, 22 nt, Homo sapiens
ugggaugaugaaaaggcuuucu

SEQ ID NO: 358147 - RNA, 22 nt, Homo sapiens
ugggaugauguuaaacguacuc

SEQ ID NO: 358148 - RNA, 22 nt, Homo sapiens
ugggcaaaugcuuuuuagucaa

SEQ ID NO: 358149 - RNA, 22 nt, Homo sapiens
ugggcagugggacagcuuugug

SEQ ID NO: 358150 - RNA, 22 nt, Homo sapiens
ugggcggagacgugcagccgcc

SEQ ID NO: 358151 - RNA, 22 nt, Homo sapiens
ugggguaggcuguauacucugu

SEQ ID NO: 358152 - RNA, 22 nt, Homo sapiens
uggggucguaggugcccgccag

SEQ ID NO: 358153 - RNA, 22 nt, Homo sapiens
uggguaaaucucuguucagggc

SEQ ID NO: 358154 - RNA, 22 nt, Homo sapiens
uggguaaaucuguuuggggcuc

SEQ ID NO: 358155 - RNA, 22 nt, Homo sapiens
uggguaggaccagaaaugcacu

SEQ ID NO: 358156 - RNA, 22 nt, Homo sapiens
uggguaggcccucauuggacag

SEQ ID NO: 358157 - RNA, 22 nt, Homo sapiens
uggguagugucagcugauccau

SEQ ID NO: 358158 - RNA, 22 nt, Homo sapiens
uggguaguuucuuacaacucug

SEQ ID NO: 358159 - RNA, 22 nt, Homo sapiens
ugggugaguaucuauuauucag

SEQ ID NO: 358160 - RNA, 23 nt, Homo sapiens
uggguucauucuugaagucagug

SEQ ID NO: 358161 - RNA, 23 nt, Homo sapiens
uggguucccuaagcgcaugcugc

SEQ ID NO: 358162 - RNA, 22 nt, Homo sapiens
ugguaccuuuuaaugacuaauu

SEQ ID NO: 358163 - RNA, 22 nt, Homo sapiens
ugguacugucucuauuuuguag

SEQ ID NO: 358164 - RNA, 22 nt, Homo sapiens
uggucaaaucugaugugagaaa

SEQ ID NO: 358165 - RNA, 22 nt, Homo sapiens
uggucaccugaauuaugcaugu

SEQ ID NO: 358166 - RNA, 20 nt, Homo sapiens
uggucaccuucaggagguuc

SEQ ID NO: 358167 - RNA, 22 nt, Homo sapiens
uggucagaaaauuacuugauau

SEQ ID NO: 358168 - RNA, 22 nt, Homo sapiens
uggucagaugcugaguggaucu

SEQ ID NO: 358169 - RNA, 22 nt, Homo sapiens
uggucauggaaauagaaugcac

SEQ ID NO: 358170 - RNA, 22 nt, Homo sapiens
uggugagaaaugagaugcuuuu

SEQ ID NO: 358171 - RNA, 22 nt, Homo sapiens
uggugcaaauguaauugugguu

SEQ ID NO: 358172 - RNA, 22 nt, Homo sapiens
ugguggcuuuucguagguucac

SEQ ID NO: 358173 - RNA, 20 nt, Homo sapiens
ugguguuugaacagugaaug

SEQ ID NO: 358174 - RNA, 21 nt, Homo sapiens
ugguucaguucguuacgugug

SEQ ID NO: 358175 - RNA, 22 nt, Homo sapiens
ugguucaguugcacaggcuguu

SEQ ID NO: 358176 - RNA, 22 nt, Homo sapiens
ugguuccauauuaauuuuagga

SEQ ID NO: 358177 - RNA, 22 nt, Homo sapiens
uguaaacauguauguguuuaug

SEQ ID NO: 358178 - RNA, 22 nt, Homo sapiens
uguaacaguaguuacuauucuu

SEQ ID NO: 358179 - RNA, 22 nt, Homo sapiens
uguaaccauccagagucccagg

SEQ ID NO: 358180 - RNA, 22 nt, Homo sapiens
uguaauuuaaaugauccuugga

SEQ ID NO: 358181 - RNA, 22 nt, Homo sapiens
uguagauaucuaucaggucaau

SEQ ID NO: 358182 - RNA, 20 nt, Homo sapiens
uguagguguacaguaaggag

SEQ ID NO: 358183 - RNA, 23 nt, Homo sapiens
uguauacacccugugcaucuggg

SEQ ID NO: 358184 - RNA, 21 nt, Homo sapiens
uguauauguuuauacacacac

SEQ ID NO: 358185 - RNA, 22 nt, Homo sapiens
uguauauguuuguacauauguc

SEQ ID NO: 358186 - RNA, 22 nt, Homo sapiens
uguaugucugcucuuuggaacu

SEQ ID NO: 358187 - RNA, 16 nt, Homo sapiens
uguauugcuaaaaaga

SEQ ID NO: 358188 - RNA, 22 nt, Homo sapiens
uguauuuguuguuaaauggaga

SEQ ID NO: 358189 - RNA, 22 nt, Homo sapiens
ugucaaaugcagugauauuuga

SEQ ID NO: 358190 - RNA, 20 nt, Homo sapiens
ugucaaggaauucccaaauc

SEQ ID NO: 358191 - RNA, 22 nt, Homo sapiens
ugucaggaggguccagagaaaa

SEQ ID NO: 358192 - RNA, 22 nt, Homo sapiens
ugucaggaugcuccuuuuggcu

SEQ ID NO: 358193 - RNA, 22 nt, Homo sapiens
ugucaguggucuggaugcagcc

SEQ ID NO: 358194 - RNA, 22 nt, Homo sapiens
ugucaguguacuguaagaauua

SEQ ID NO: 358195 - RNA, 22 nt, Homo sapiens
ugucaguuucuugagauggaac

SEQ ID NO: 358196 - RNA, 22 nt, Homo sapiens
ugucauacaguaacaugguugg

SEQ ID NO: 358197 - RNA, 22 nt, Homo sapiens
ugucauagaugauuuuuuucgg

SEQ ID NO: 358198 - RNA, 22 nt, Homo sapiens
ugucauauagaauguucuauga

SEQ ID NO: 358199 - RNA, 19 nt, Homo sapiens
ugucaucaucuuuucuugc

SEQ ID NO: 358200 - RNA, 22 nt, Homo sapiens
ugucaugagucuccuccaucuu

SEQ ID NO: 358201 - RNA, 22 nt, Homo sapiens
ugucaugguagcaaggacgagg

SEQ ID NO: 358202 - RNA, 22 nt, Homo sapiens
ugucauggucacaggcauuuca

SEQ ID NO: 358203 - RNA, 22 nt, Homo sapiens
ugucaugguguuaauuuuccug

SEQ ID NO: 358204 - RNA, 22 nt, Homo sapiens
ugucaugugagggaacuuguuc

SEQ ID NO: 358205 - RNA, 22 nt, Homo sapiens
ugucauguugguguacugcacc

SEQ ID NO: 358206 - RNA, 22 nt, Homo sapiens
ugucauucaggaaauucuaagu

SEQ ID NO: 358207 - RNA, 19 nt, Homo sapiens
uguccuagaggaguucaca

SEQ ID NO: 358208 - RNA, 22 nt, Homo sapiens
uguccuguaggaggcagaacaa

SEQ ID NO: 358209 - RNA, 21 nt, Homo sapiens
ugucgugcaggaucuguggga

SEQ ID NO: 358210 - RNA, 22 nt, Homo sapiens
ugucuaguuuugaaguauagca

SEQ ID NO: 358211 - RNA, 22 nt, Homo sapiens
ugucucagugauuggcuuucug

SEQ ID NO: 358212 - RNA, 22 nt, Homo sapiens
ugucuuggagaauccuggguuu

SEQ ID NO: 358213 - RNA, 22 nt, Homo sapiens
ugucuuuguuaguuguccuagu

SEQ ID NO: 358214 - RNA, 22 nt, Homo sapiens
ugugaaacacgaaagucuaaaa

SEQ ID NO: 358215 - RNA, 22 nt, Homo sapiens
ugugaaauguuaucccgucgug

SEQ ID NO: 358216 - RNA, 22 nt, Homo sapiens
ugugaacagaauuagucaccua

SEQ ID NO: 358217 - RNA, 22 nt, Homo sapiens
ugugaauggugcugccgugaag

SEQ ID NO: 358218 - RNA, 22 nt, Homo sapiens
ugugacaguuaguuugguguua

SEQ ID NO: 358219 - RNA, 21 nt, Homo sapiens
ugugaccucugucucugaguc

SEQ ID NO: 358220 - RNA, 19 nt, Homo sapiens
ugugagcauuagcauuuag

SEQ ID NO: 358221 - RNA, 22 nt, Homo sapiens
ugugaucaugguauuaaucugc

SEQ ID NO: 358222 - RNA, 16 nt, Homo sapiens
ugugaucuuuuuucuu

SEQ ID NO: 358223 - RNA, 22 nt, Homo sapiens
ugugaugaaggcauagggaugu

SEQ ID NO: 358224 - RNA, 22 nt, Homo sapiens
ugugauggaguuucauggacug

SEQ ID NO: 358225 - RNA, 22 nt, Homo sapiens
ugugauuauuuaaauaggacag

SEQ ID NO: 358226 - RNA, 17 nt, Homo sapiens
ugugauugaagucaucc

SEQ ID NO: 358227 - RNA, 18 nt, Homo sapiens
ugugcaauauuaaccacc

SEQ ID NO: 358228 - RNA, 22 nt, Homo sapiens
ugugcacaacgugcagguuugu

SEQ ID NO: 358229 - RNA, 22 nt, Homo sapiens
auggcaguuuggucucugugcu

SEQ ID NO: 358230 - RNA, 22 nt, Homo sapiens
auggccauuacuaagaauguuu

SEQ ID NO: 358231 - RNA, 22 nt, Homo sapiens
auggcccugaguucaauauauu

SEQ ID NO: 358232 - RNA, 22 nt, Homo sapiens
auggcccugggaaaggaggcau

SEQ ID NO: 358233 - RNA, 22 nt, Homo sapiens
auggcccuguguggagcugcug

SEQ ID NO: 358234 - RNA, 22 nt, Homo sapiens
auggccuuuuuaucucaccaag

SEQ ID NO: 358235 - RNA, 22 nt, Homo sapiens
auggcuuuucacagaggguucu

SEQ ID NO: 358236 - RNA, 22 nt, Homo sapiens
auggcuuuuuaaaucauguugu

SEQ ID NO: 358237 - RNA, 22 nt, Homo sapiens
auggcuuuuuucuugggcacuc

SEQ ID NO: 358238 - RNA, 22 nt, Homo sapiens
augggcaaauguuggaaauucc

SEQ ID NO: 358239 - RNA, 21 nt, Homo sapiens
augguacugucucuggagaua

SEQ ID NO: 358240 - RNA, 21 nt, Homo sapiens
auggugagaaaguagugucaa

SEQ ID NO: 358241 - RNA, 22 nt, Homo sapiens
auguaaacagaugugcagcuug

SEQ ID NO: 358242 - RNA, 17 nt, Homo sapiens
auguauacauccaugua

SEQ ID NO: 358243 - RNA, 22 nt, Homo sapiens
auguauacaugcaggucacagg

SEQ ID NO: 358244 - RNA, 22 nt, Homo sapiens
augucacugcacuccugccugg

SEQ ID NO: 358245 - RNA, 22 nt, Homo sapiens
auguccauggaaucuguagcaa

SEQ ID NO: 358246 - RNA, 22 nt, Homo sapiens
auguccuggacccagacaaagc

SEQ ID NO: 358247 - RNA, 22 nt, Homo sapiens
augugaacaucauagaaugcac

SEQ ID NO: 358248 - RNA, 22 nt, Homo sapiens
augugacuggaucauggggacg

SEQ ID NO: 358249 - RNA, 22 nt, Homo sapiens
augugcaacugcuggaacaguc

SEQ ID NO: 358250 - RNA, 18 nt, Homo sapiens
augugcaauuuuguauuu

SEQ ID NO: 358251 - RNA, 21 nt, Homo sapiens
augugcacuaugucauuuaau

SEQ ID NO: 358252 - RNA, 22 nt, Homo sapiens
augugcauaugaagcacagaca

SEQ ID NO: 358253 - RNA, 22 nt, Homo sapiens
augugccaauuaggauuccaag

SEQ ID NO: 358254 - RNA, 22 nt, Homo sapiens
auguggcuuuucaacuguguga

SEQ ID NO: 358255 - RNA, 22 nt, Homo sapiens
augugugcuugugacacagccu

SEQ ID NO: 358256 - RNA, 22 nt, Homo sapiens
auguuacggaguuuuuauccag

SEQ ID NO: 358257 - RNA, 22 nt, Homo sapiens
auguuagcaucuggcacuaugg

SEQ ID NO: 358258 - RNA, 22 nt, Homo sapiens
auuaacaucuagaguuuuggug

SEQ ID NO: 358259 - RNA, 22 nt, Homo sapiens
auuaaguaaugguuccaauaau

SEQ ID NO: 358260 - RNA, 22 nt, Homo sapiens
auuaaguugugccugaaaacuu

SEQ ID NO: 358261 - RNA, 22 nt, Homo sapiens
auuaaucaggcaaugcuugcua

SEQ ID NO: 358262 - RNA, 22 nt, Homo sapiens
auuacacuuucuauucaaugag

SEQ ID NO: 358263 - RNA, 22 nt, Homo sapiens
auuauugacucauagaaaggau

SEQ ID NO: 358264 - RNA, 23 nt, Homo sapiens
auucaaguagugagagugguuau

SEQ ID NO: 358265 - RNA, 22 nt, Homo sapiens
auucacuguggcuuucucugau

SEQ ID NO: 358266 - RNA, 20 nt, Homo sapiens
auucauggugguacguuguc

SEQ ID NO: 358267 - RNA, 22 nt, Homo sapiens
auuccacagccgauaccaugac

SEQ ID NO: 358268 - RNA, 22 nt, Homo sapiens
auugacaguuggccaguaagug

SEQ ID NO: 358269 - RNA, 22 nt, Homo sapiens
auugagcuuuuuaaaauauagu

SEQ ID NO: 358270 - RNA, 22 nt, Homo sapiens
auugcacuccagcuugggugac

SEQ ID NO: 358271 - RNA, 22 nt, Homo sapiens
auugcacuccagucucaccagg

SEQ ID NO: 358272 - RNA, 22 nt, Homo sapiens
auugcauaaacacauuucuuau

SEQ ID NO: 358273 - RNA, 22 nt, Homo sapiens
auugcccaggcuggagugcagu

SEQ ID NO: 358274 - RNA, 22 nt, Homo sapiens
auugcuauuauuugaccauugu

SEQ ID NO: 358275 - RNA, 22 nt, Homo sapiens
auugcugagacauugcuaaucu

SEQ ID NO: 358276 - RNA, 22 nt, Homo sapiens
auuggugaccugcggcaguaug

SEQ ID NO: 358277 - RNA, 22 nt, Homo sapiens
auuguacugccccccuguugcu

SEQ ID NO: 358278 - RNA, 22 nt, Homo sapiens
auugugucuuguagagagauau

SEQ ID NO: 358279 - RNA, 19 nt, Homo sapiens
auuuccuggagcuggucuc

SEQ ID NO: 358280 - RNA, 22 nt, Homo sapiens
auuuggguuuuacaucaggcua

SEQ ID NO: 358281 - RNA, 21 nt, Homo sapiens
auuugguggcugugugacacu

SEQ ID NO: 358282 - RNA, 21 nt, Homo sapiens
auuugguguuagaaauaaauu

SEQ ID NO: 358283 - RNA, 18 nt, Homo sapiens
auuuuugcaguccacaug

SEQ ID NO: 358284 - RNA, 22 nt, Homo sapiens
auuuuuggauauagggaaggau

SEQ ID NO: 358285 - RNA, 22 nt, Homo sapiens
auuuuugguugguaggcuauua

SEQ ID NO: 358286 - RNA, 22 nt, Homo sapiens
auuuuugguugucagcacuagg

SEQ ID NO: 358287 - RNA, 22 nt, Homo sapiens
auuuuugguuucaccugcacgc

SEQ ID NO: 358288 - RNA, 22 nt, Homo sapiens
caaagcuauagcaccagaggga

SEQ ID NO: 358289 - RNA, 22 nt, Homo sapiens
caaaggcuucugaaacugcaga

SEQ ID NO: 358290 - RNA, 22 nt, Homo sapiens
caaaguaauugugguuuugcca

SEQ ID NO: 358291 - RNA, 22 nt, Homo sapiens
caaaugcuucuauggacugucu

SEQ ID NO: 358292 - RNA, 22 nt, Homo sapiens
caaccaguagcugaguucaaaa

SEQ ID NO: 358293 - RNA, 22 nt, Homo sapiens
caagacuguccaacauauuggg

SEQ ID NO: 358294 - RNA, 22 nt, Homo sapiens
caagaucauuuaugcuaaaauu

SEQ ID NO: 358295 - RNA, 22 nt, Homo sapiens
caagguacuuuuacaauuuccc

SEQ ID NO: 358296 - RNA, 22 nt, Homo sapiens
caaguacugggcuauggauauu

SEQ ID NO: 358297 - RNA, 22 nt, Homo sapiens
caagugcuacagagaaaucuuu

SEQ ID NO: 358298 - RNA, 22 nt, Homo sapiens
caaguguuuccuuaaauacuug

SEQ ID NO: 358299 - RNA, 22 nt, Homo sapiens
caaugcauuauucucccacuuc

SEQ ID NO: 358300 - RNA, 22 nt, Homo sapiens
caauggcacgaucucgucucac

SEQ ID NO: 358301 - RNA, 21 nt, Homo sapiens
caauggcacgaucuuggcuca

SEQ ID NO: 358302 - RNA, 22 nt, Homo sapiens
caauggcacuauuggaaaaggu

SEQ ID NO: 358303 - RNA, 22 nt, Homo sapiens
caaugguacuagauaucuucag

SEQ ID NO: 358304 - RNA, 22 nt, Homo sapiens
cacaaugucugguaggccacuu

SEQ ID NO: 358305 - RNA, 22 nt, Homo sapiens
cacacugucuuucagaaugguu

SEQ ID NO: 358306 - RNA, 22 nt, Homo sapiens
cacacuguuuuccauggggguu

SEQ ID NO: 358307 - RNA, 22 nt, Homo sapiens
cacagaauucauuggauuaccu

SEQ ID NO: 358308 - RNA, 22 nt, Homo sapiens
cacagcuagucaaugguagaca

SEQ ID NO: 358309 - RNA, 22 nt, Homo sapiens
cacagucuugcaauauugagau

SEQ ID NO: 358310 - RNA, 22 nt, Homo sapiens
cacagugaacugguggguuuuu

SEQ ID NO: 358311 - RNA, 22 nt, Homo sapiens
ucucaguggcacccccaacacc

SEQ ID NO: 358312 - RNA, 22 nt, Homo sapiens
ucucaguggugcuggcagggga

SEQ ID NO: 358313 - RNA, 19 nt, Homo sapiens
ucucaguguuggucaggug

SEQ ID NO: 358314 - RNA, 22 nt, Homo sapiens
ucucaguuuucuggggaagaaa

SEQ ID NO: 358315 - RNA, 20 nt, Homo sapiens
ucucauagagguagagaaua

SEQ ID NO: 358316 - RNA, 22 nt, Homo sapiens
ucucaugaagauagagaauaga

SEQ ID NO: 358317 - RNA, 22 nt, Homo sapiens
cacuaccucuacaggcagcugg

SEQ ID NO: 358318 - RNA, 22 nt, Homo sapiens
cacuaggcuggagugcaguggc

SEQ ID NO: 358319 - RNA, 22 nt, Homo sapiens
cacucaguuugugguacuuugu

SEQ ID NO: 358320 - RNA, 22 nt, Homo sapiens
cacugcacuccagccuaagagg

SEQ ID NO: 358321 - RNA, 22 nt, Homo sapiens
cacugcacuccagucugacgac

SEQ ID NO: 358322 - RNA, 22 nt, Homo sapiens
cacugcacuccaguuucgguaa

SEQ ID NO: 358323 - RNA, 22 nt, Homo sapiens
cacugcaguaaauugcgucggu

SEQ ID NO: 358324 - RNA, 22 nt, Homo sapiens
cacugcauccuccaccuccugg

SEQ ID NO: 358325 - RNA, 22 nt, Homo sapiens
cacugcauccuugaccuucugg

SEQ ID NO: 358326 - RNA, 22 nt, Homo sapiens
cacugggugccauauguuugcu

SEQ ID NO: 358327 - RNA, 22 nt, Homo sapiens
cacuggguuagaacaugcuccu

SEQ ID NO: 358328 - RNA, 18 nt, Homo sapiens
cacuuggcuuugccccuc

SEQ ID NO: 358329 - RNA, 22 nt, Homo sapiens
cagaaguauugguaugcucugu

SEQ ID NO: 358330 - RNA, 22 nt, Homo sapiens
cagagaaugucuuuuuuaacca

SEQ ID NO: 358331 - RNA, 22 nt, Homo sapiens
cagagaucaugcaacugcucgc

SEQ ID NO: 358332 - RNA, 22 nt, Homo sapiens
cagagguaagcaagucagcauu

SEQ ID NO: 358333 - RNA, 22 nt, Homo sapiens
cagauaguuguagauaugcagc

SEQ ID NO: 358334 - RNA, 22 nt, Homo sapiens
cagaugguggucccacagccca

SEQ ID NO: 358335 - RNA, 22 nt, Homo sapiens
cagcacauuacaaguacuuggu

SEQ ID NO: 358336 - RNA, 22 nt, Homo sapiens
cagcuaaauuguuaaauccaag

SEQ ID NO: 358337 - RNA, 22 nt, Homo sapiens
cagcuguuguuaugucugcagg

SEQ ID NO: 358338 - RNA, 22 nt, Homo sapiens
cagcuguuguuccagucuuuua

SEQ ID NO: 358339 - RNA, 22 nt, Homo sapiens
caggcaaggugaaguguacugg

SEQ ID NO: 358340 - RNA, 21 nt, Homo sapiens
cagguagugucugaagccaga

SEQ ID NO: 358341 - RNA, 19 nt, Homo sapiens
cagguagugugcugacaug

SEQ ID NO: 358342 - RNA, 22 nt, Homo sapiens
caggugcauuggcugacaccug

SEQ ID NO: 358343 - RNA, 22 nt, Homo sapiens
caguacaauguggaaaaggagu

SEQ ID NO: 358344 - RNA, 20 nt, Homo sapiens
cagucaugaagaacugugag

SEQ ID NO: 358345 - RNA, 22 nt, Homo sapiens
cagugaauuucaggucaagagu

SEQ ID NO: 358346 - RNA, 22 nt, Homo sapiens
cagugcaaccuccaucucucgg

SEQ ID NO: 358347 - RNA, 23 nt, Homo sapiens
cagugcauuguggcauucagcau

SEQ ID NO: 358348 - RNA, 22 nt, Homo sapiens
caguguuuuuaacaggugcccg

SEQ ID NO: 358349 - RNA, 22 nt, Homo sapiens
caguuacuugacacaaccaauu

SEQ ID NO: 358350 - RNA, 22 nt, Homo sapiens
caguucaugguaggcaccauag

SEQ ID NO: 358351 - RNA, 22 nt, Homo sapiens
caguuguuuuaugacauaagau

SEQ ID NO: 358352 - RNA, 18 nt, Homo sapiens
cauagcacuucagcacau

SEQ ID NO: 358353 - RNA, 22 nt, Homo sapiens
cauauaguaggugcucuguguu

SEQ ID NO: 358354 - RNA, 22 nt, Homo sapiens
cauauucacuuuacagagcugu

SEQ ID NO: 358355 - RNA, 22 nt, Homo sapiens
caucacacuuggauguaagaca

SEQ ID NO: 358356 - RNA, 19 nt, Homo sapiens
caucacagagucuuccauu

SEQ ID NO: 358357 - RNA, 21 nt, Homo sapiens
caucacauuacucaaaguccu

SEQ ID NO: 358358 - RNA, 22 nt, Homo sapiens
caucacauucugagauacugag

SEQ ID NO: 358359 - RNA, 22 nt, Homo sapiens
caucaggugaggauucaaugca

SEQ ID NO: 358360 - RNA, 22 nt, Homo sapiens
cauccccugcaccaaccuuuac

SEQ ID NO: 358361 - RNA, 22 nt, Homo sapiens
caucccugucgucaagucucug

SEQ ID NO: 358362 - RNA, 22 nt, Homo sapiens
caucucauugaauugcugagca

SEQ ID NO: 358363 - RNA, 23 nt, Homo sapiens
caugaacuaguuugcagccauga

SEQ ID NO: 358364 - RNA, 22 nt, Homo sapiens
caugacacauguuuaccuaugu

SEQ ID NO: 358365 - RNA, 22 nt, Homo sapiens
caugauauugcagaauguuggu

SEQ ID NO: 358366 - RNA, 22 nt, Homo sapiens
caugcauuggucuauuauguga

SEQ ID NO: 358367 - RNA, 22 nt, Homo sapiens
cauggagcuaggcuugaucccu

SEQ ID NO: 358368 - RNA, 22 nt, Homo sapiens
cauggcacuggugggagugucu

SEQ ID NO: 358369 - RNA, 22 nt, Homo sapiens
cauggcaucuguguggccucca

SEQ ID NO: 358370 - RNA, 22 nt, Homo sapiens
cauggcccuggguccauaggaa

SEQ ID NO: 358371 - RNA, 22 nt, Homo sapiens
cauggccuuuggaaugugucua

SEQ ID NO: 358372 - RNA, 19 nt, Homo sapiens
cauggcuuauaauuuuaau

SEQ ID NO: 358373 - RNA, 22 nt, Homo sapiens
cauggcuuguauaagauucuca

SEQ ID NO: 358374 - RNA, 22 nt, Homo sapiens
cauggcuuucacaguaaagccu

SEQ ID NO: 358375 - RNA, 22 nt, Homo sapiens
caugggacugucuuggcuauac

SEQ ID NO: 358376 - RNA, 21 nt, Homo sapiens
caugucacugcacucuagccu

SEQ ID NO: 358377 - RNA, 22 nt, Homo sapiens
caugugcaugcuuucuuaugug

SEQ ID NO: 358378 - RNA, 22 nt, Homo sapiens
cauuccacuggauaaacaaggu

SEQ ID NO: 358379 - RNA, 22 nt, Homo sapiens
cauugcacuccagcccagguga

SEQ ID NO: 358380 - RNA, 22 nt, Homo sapiens
cauugcacuccagccuaggcaa

SEQ ID NO: 358381 - RNA, 22 nt, Homo sapiens
cauugcacuccagccucggcaa

SEQ ID NO: 358382 - RNA, 22 nt, Homo sapiens
cauugcaguaagagugggcucu

SEQ ID NO: 358383 - RNA, 22 nt, Homo sapiens
cauugcauuuucuuuguaccuu

SEQ ID NO: 358384 - RNA, 22 nt, Homo sapiens
cauugcuaaaagucauauauaa

SEQ ID NO: 358385 - RNA, 22 nt, Homo sapiens
cauugguuccaguuuguccuua

SEQ ID NO: 358386 - RNA, 22 nt, Homo sapiens
cauugucccucaaugacuauga

SEQ ID NO: 358387 - RNA, 22 nt, Homo sapiens
ccaaggcacugauucuguacuc

SEQ ID NO: 358388 - RNA, 23 nt, Homo sapiens
ccacaaugguugaacuagauuac

SEQ ID NO: 358389 - RNA, 22 nt, Homo sapiens
ccacacugucuuggugggaaac

SEQ ID NO: 358390 - RNA, 23 nt, Homo sapiens
ccacacuguuuagaauggcauca

SEQ ID NO: 358391 - RNA, 22 nt, Homo sapiens
ccacccuggagaauuugagguc

SEQ ID NO: 358392 - RNA, 22 nt, Homo sapiens
ccacugcacuccagcccggcaa

SEQ ID NO: 358393 - RNA, 22 nt, Homo sapiens
ccacugugguaucugauacugg

SEQ ID NO: 358394 - RNA, 22 nt, Homo sapiens
ccagaauucucauuggaaggaa

SEQ ID NO: 358395 - RNA, 22 nt, Homo sapiens
ccagaguggagccuuugcgagg

SEQ ID NO: 358396 - RNA, 22 nt, Homo sapiens
ugacauggagagagaagccuuu

SEQ ID NO: 358397 - RNA, 22 nt, Homo sapiens
ugacauguauaucuuacgcuau

SEQ ID NO: 358398 - RNA, 22 nt, Homo sapiens
ugacauguccaggugguccugu

SEQ ID NO: 358399 - RNA, 22 nt, Homo sapiens
ugacauguugcauuauauuucc

SEQ ID NO: 358400 - RNA, 22 nt, Homo sapiens
ugaccacagaaagugagggagc

SEQ ID NO: 358401 - RNA, 22 nt, Homo sapiens
ugaccuguuugaaauugccaau

SEQ ID NO: 358402 - RNA, 22 nt, Homo sapiens
ugacuacagauuugcugccaga

SEQ ID NO: 358403 - RNA, 22 nt, Homo sapiens
ugacuaggaaauuagaacuuuu

SEQ ID NO: 358404 - RNA, 22 nt, Homo sapiens
ugacuagucauaggcauggggg

SEQ ID NO: 358405 - RNA, 22 nt, Homo sapiens
ccaguuuucucacuguugcagu

SEQ ID NO: 358406 - RNA, 22 nt, Homo sapiens
ccaguuuuucauuuauacuagu

SEQ ID NO: 358407 - RNA, 19 nt, Homo sapiens
ccauggcaaugaucugaug

SEQ ID NO: 358408 - RNA, 21 nt, Homo sapiens
ccauggcaaugguaaacugac

SEQ ID NO: 358409 - RNA, 22 nt, Homo sapiens
ccauggcuauucuguaaggguu

SEQ ID NO: 358410 - RNA, 22 nt, Homo sapiens
ccauugcacuccagccuaggca

SEQ ID NO: 358411 - RNA, 21 nt, Homo sapiens
cccagguucucugaggguaga

SEQ ID NO: 358412 - RNA, 22 nt, Homo sapiens
ccccagguuucaauaaagccca

SEQ ID NO: 358413 - RNA, 17 nt, Homo sapiens
ccccugagcgaugcagu

SEQ ID NO: 358414 - RNA, 22 nt, Homo sapiens
cccugaagacuccaccgucaug

SEQ ID NO: 358415 - RNA, 22 nt, Homo sapiens
cccugaagauacagaguuuggg

SEQ ID NO: 358416 - RNA, 22 nt, Homo sapiens
cccugagaugugaauuucagag

SEQ ID NO: 358417 - RNA, 19 nt, Homo sapiens
ccucaaguacuaauauguu

SEQ ID NO: 358418 - RNA, 22 nt, Homo sapiens
ccucacaaccuuuauugaagag

SEQ ID NO: 358419 - RNA, 21 nt, Homo sapiens
ccuccauuuguauucuugccc

SEQ ID NO: 358420 - RNA, 22 nt, Homo sapiens
ccucccuuuguugcaagggaaa

SEQ ID NO: 358421 - RNA, 22 nt, Homo sapiens
ccucuguaguccugcaagagga

SEQ ID NO: 358422 - RNA, 21 nt, Homo sapiens
ccugaguacaacccacuccac

SEQ ID NO: 358423 - RNA, 22 nt, Homo sapiens
ccugaugacacgggagauguac

SEQ ID NO: 358424 - RNA, 21 nt, Homo sapiens
ccugaugaccucugagaguua

SEQ ID NO: 358425 - RNA, 19 nt, Homo sapiens
ccugcuguucuuuugcacc

SEQ ID NO: 358426 - RNA, 22 nt, Homo sapiens
ccugucuugauuaaauuacuua

SEQ ID NO: 358427 - RNA, 22 nt, Homo sapiens
ccugugguuaaccagcuagaug

SEQ ID NO: 358428 - RNA, 22 nt, Homo sapiens
ccuguguuaugguuucuaaugu

SEQ ID NO: 358429 - RNA, 22 nt, Homo sapiens
ccuucauccuccagcaggcuag

SEQ ID NO: 358430 - RNA, 22 nt, Homo sapiens
ccuucauugcaucuuuaagaga

SEQ ID NO: 358431 - RNA, 21 nt, Homo sapiens
ccuugagaacaucaauuugcu

SEQ ID NO: 358432 - RNA, 21 nt, Homo sapiens
ccuugguuaucuucccauuca

SEQ ID NO: 358433 - RNA, 22 nt, Homo sapiens
ccuugucacugaguggaaugaa

SEQ ID NO: 358434 - RNA, 22 nt, Homo sapiens
cgccugagcugaggaagcugca

SEQ ID NO: 358435 - RNA, 22 nt, Homo sapiens
cggcaguggguaagccaagcuu

SEQ ID NO: 358436 - RNA, 20 nt, Homo sapiens
cguugcacuccagccugggc

SEQ ID NO: 358437 - RNA, 22 nt, Homo sapiens
cuaaaguagccaggacugcagg

SEQ ID NO: 358438 - RNA, 22 nt, Homo sapiens
cuaaaguucuucugagagaaca

SEQ ID NO: 358439 - RNA, 19 nt, Homo sapiens
cuaaguccccuugauuaga

SEQ ID NO: 358440 - RNA, 22 nt, Homo sapiens
cuacacaugcaggcucccugcc

SEQ ID NO: 358441 - RNA, 22 nt, Homo sapiens
cuacaguagagaggauguagaa

SEQ ID NO: 358442 - RNA, 22 nt, Homo sapiens
cuacaguguauuuauggagggu

SEQ ID NO: 358443 - RNA, 22 nt, Homo sapiens
cuagaagcauauucagaacaga

SEQ ID NO: 358444 - RNA, 22 nt, Homo sapiens
cuagacacugacguuccuccga

SEQ ID NO: 358445 - RNA, 22 nt, Homo sapiens
cuaggcuuuucuuggauccagg

SEQ ID NO: 358446 - RNA, 22 nt, Homo sapiens
cuagguuauacucugaaauggu

SEQ ID NO: 358447 - RNA, 21 nt, Homo sapiens
cuaucucaguguuuacauuug

SEQ ID NO: 358448 - RNA, 22 nt, Homo sapiens
cuaugagcuuuuuuaagccuca

SEQ ID NO: 358449 - RNA, 22 nt, Homo sapiens
cuaugagucugcagaucuauua

SEQ ID NO: 358450 - RNA, 22 nt, Homo sapiens
cuauuacuuuuauugaacucag

SEQ ID NO: 358451 - RNA, 22 nt, Homo sapiens
cuauucacaggcaauauguaca

SEQ ID NO: 358452 - RNA, 22 nt, Homo sapiens
cucaaguaauccucccgccuug

SEQ ID NO: 358453 - RNA, 20 nt, Homo sapiens
cucacagacagcuucuuucu

SEQ ID NO: 358454 - RNA, 22 nt, Homo sapiens
cucagaguacuuuucccacuuc

SEQ ID NO: 358455 - RNA, 22 nt, Homo sapiens
cucagauacuugggagguugag

SEQ ID NO: 358456 - RNA, 22 nt, Homo sapiens
cucagggugguggacucuaaua

SEQ ID NO: 358457 - RNA, 22 nt, Homo sapiens
cucagguaguuccuuauagcaa

SEQ ID NO: 358458 - RNA, 20 nt, Homo sapiens
cucagugcacccccauaaaa

SEQ ID NO: 358459 - RNA, 22 nt, Homo sapiens
cucagugguugauuuauuuauc

SEQ ID NO: 358460 - RNA, 22 nt, Homo sapiens
cucaguguuucagcugcucaga

SEQ ID NO: 358461 - RNA, 21 nt, Homo sapiens
cucauauugcuuuuccauggu

SEQ ID NO: 358462 - RNA, 22 nt, Homo sapiens
cucauugcaaucuccaccuccc

SEQ ID NO: 358463 - RNA, 22 nt, Homo sapiens
cuccacgugaaugccaaguauu

SEQ ID NO: 358464 - RNA, 23 nt, Homo sapiens
cuccaugagccguccagggccug

SEQ ID NO: 358465 - RNA, 22 nt, Homo sapiens
cuccauuuaguccuuuuagaag

SEQ ID NO: 358466 - RNA, 22 nt, Homo sapiens
cuccauuuaucugaaauuuuau

SEQ ID NO: 358467 - RNA, 22 nt, Homo sapiens
cucccauugcaaacaacagaag

SEQ ID NO: 358468 - RNA, 22 nt, Homo sapiens
cucucaguugucuaauuaguuu

SEQ ID NO: 358469 - RNA, 22 nt, Homo sapiens
cucucugagccccagacaccuu

SEQ ID NO: 358470 - RNA, 22 nt, Homo sapiens
cucucuguuugucuguuauugg

SEQ ID NO: 358471 - RNA, 22 nt, Homo sapiens
cucugacagugguuagcacugu

SEQ ID NO: 358472 - RNA, 22 nt, Homo sapiens
cucugagccugagguuccuacu

SEQ ID NO: 358473 - RNA, 22 nt, Homo sapiens
cucuuuaguaagcaguugauga

SEQ ID NO: 358474 - RNA, 22 nt, Homo sapiens
cucuuugaugugaaccgugguu

SEQ ID NO: 358475 - RNA, 22 nt, Homo sapiens
cucuuuuguuccuaguuugauc

SEQ ID NO: 358476 - RNA, 22 nt, Homo sapiens
cugaaaguuauucaggggcaag

SEQ ID NO: 358477 - RNA, 20 nt, Homo sapiens
cugaaugucaaggcagaggu

SEQ ID NO: 358478 - RNA, 22 nt, Homo sapiens
cugaauguuucacucugaaaug

SEQ ID NO: 358479 - RNA, 22 nt, Homo sapiens
cugaauguuuucuucuauucug

SEQ ID NO: 358480 - RNA, 22 nt, Homo sapiens
cugacaagauucaucacucagu

SEQ ID NO: 358481 - RNA, 22 nt, Homo sapiens
cugacagucucauugauuugcu

SEQ ID NO: 358482 - RNA, 22 nt, Homo sapiens
uacauaguagauauaggguuua

SEQ ID NO: 358483 - RNA, 22 nt, Homo sapiens
uacauguauguguuuauggcug

SEQ ID NO: 358484 - RNA, 22 nt, Homo sapiens
uaccacccuuuuuccagaagcc

SEQ ID NO: 358485 - RNA, 22 nt, Homo sapiens
uaccaugcagguguauguuugu

SEQ ID NO: 358486 - RNA, 22 nt, Homo sapiens
uaccauguauguuucuccauug

SEQ ID NO: 358487 - RNA, 22 nt, Homo sapiens
uacccuuagcuuacauucuagg

SEQ ID NO: 358488 - RNA, 22 nt, Homo sapiens
uacuacuuucugacaucuuuaa

SEQ ID NO: 358489 - RNA, 22 nt, Homo sapiens
uacucugcagccauaaaacaga

SEQ ID NO: 358490 - RNA, 22 nt, Homo sapiens
uacugcacuccaaccugagaga

SEQ ID NO: 358491 - RNA, 22 nt, Homo sapiens
uacugcacucuagccuggguga

SEQ ID NO: 358492 - RNA, 23 nt, Homo sapiens
uacugcauccuccgccucuaggg

SEQ ID NO: 358493 - RNA, 22 nt, Homo sapiens
uacugcaucuacuuagagccag

SEQ ID NO: 358494 - RNA, 22 nt, Homo sapiens
uacugcauuccaaucugggcga

SEQ ID NO: 358495 - RNA, 22 nt, Homo sapiens
uacugcuuaagggcaugggccc

SEQ ID NO: 358496 - RNA, 22 nt, Homo sapiens
uacuggccuugaacucuggugu

SEQ ID NO: 358497 - RNA, 22 nt, Homo sapiens
uacuuagagauuccaggaacuc

SEQ ID NO: 358498 - RNA, 21 nt, Homo sapiens
uacuugagacagggucuugcu

SEQ ID NO: 358499 - RNA, 22 nt, Homo sapiens
uacuuuguagagugugagaauu

SEQ ID NO: 358500 - RNA, 22 nt, Homo sapiens
uacuuuguuauagcagcaggaa

SEQ ID NO: 358501 - RNA, 22 nt, Homo sapiens
uagaaaguagggaagguaggau

SEQ ID NO: 358502 - RNA, 22 nt, Homo sapiens
uagaacauuccaggugauguug

SEQ ID NO: 358503 - RNA, 22 nt, Homo sapiens
uagaagcacuaucccuccuagu

SEQ ID NO: 358504 - RNA, 22 nt, Homo sapiens
uagaauguauaauauuuuacuu

SEQ ID NO: 358505 - RNA, 22 nt, Homo sapiens
uagaaugucagcuucuugaggg

SEQ ID NO: 358506 - RNA, 22 nt, Homo sapiens
uagacccauuguucagagagug

SEQ ID NO: 358507 - RNA, 21 nt, Homo sapiens
uagagagcaauaccuccagag

SEQ ID NO: 358508 - RNA, 21 nt, Homo sapiens
uagagcuuggcacagaguaga

SEQ ID NO: 358509 - RNA, 22 nt, Homo sapiens
uagaggaaggauuggaaacgca

SEQ ID NO: 358510 - RNA, 22 nt, Homo sapiens
uagauaauuagaggguuuuaag

SEQ ID NO: 358511 - RNA, 22 nt, Homo sapiens
ucaggcacucagcuuagagucu

SEQ ID NO: 358512 - RNA, 20 nt, Homo sapiens
ucaggcuccgcauuaacuua

SEQ ID NO: 358513 - RNA, 22 nt, Homo sapiens
ucagguaucucuauagcaaugu

SEQ ID NO: 358514 - RNA, 22 nt, Homo sapiens
ucaggugcaguggcucugaccu

SEQ ID NO: 358515 - RNA, 22 nt, Homo sapiens
ucaguacuuuggagcucacaua

SEQ ID NO: 358516 - RNA, 23 nt, Homo sapiens
ucaguagucauugggaaagugug

SEQ ID NO: 358517 - RNA, 22 nt, Homo sapiens
ucaguccccucgcugagucuac

SEQ ID NO: 358518 - RNA, 22 nt, Homo sapiens
ucagucuuuuaccauuaaguau

SEQ ID NO: 358519 - RNA, 22 nt, Homo sapiens
ucagucuuuuuuuggcaagcau

SEQ ID NO: 358520 - RNA, 23 nt, Homo sapiens
ucagugaaggaacaacuaaauag

SEQ ID NO: 358521 - RNA, 22 nt, Homo sapiens
ucagugacuggguauuaaauca

SEQ ID NO: 358522 - RNA, 21 nt, Homo sapiens
ucagugcaauucuauggggaa

SEQ ID NO: 358523 - RNA, 17 nt, Homo sapiens
ucagugcauuuaagaga

SEQ ID NO: 358524 - RNA, 22 nt, Homo sapiens
ucagugccucaguuuuuaaaga

SEQ ID NO: 358525 - RNA, 19 nt, Homo sapiens
ucagugcuauguaauguag

SEQ ID NO: 358526 - RNA, 21 nt, Homo sapiens
ucagugcugugggcaaggugc

SEQ ID NO: 358527 - RNA, 22 nt, Homo sapiens
ucaguggagagcuuccaggauu

SEQ ID NO: 358528 - RNA, 22 nt, Homo sapiens
ucaguggauuuaaccugaauca

SEQ ID NO: 358529 - RNA, 22 nt, Homo sapiens
ucagugguuaaaagauucuaga

SEQ ID NO: 358530 - RNA, 22 nt, Homo sapiens
ucagugucugugcaccgcugga

SEQ ID NO: 358531 - RNA, 22 nt, Homo sapiens
ucaguuuagguguaacggccac

SEQ ID NO: 358532 - RNA, 22 nt, Homo sapiens
ucauaaaguuguuuuaauggga

SEQ ID NO: 358533 - RNA, 22 nt, Homo sapiens
ucauacgucuccuugugccacc

SEQ ID NO: 358534 - RNA, 22 nt, Homo sapiens
ucauacuguccaauucuagugg

SEQ ID NO: 358535 - RNA, 22 nt, Homo sapiens
ucauagaucaaguaauaagaca

SEQ ID NO: 358536 - RNA, 18 nt, Homo sapiens
ucauagaucaugacagug

SEQ ID NO: 358537 - RNA, 22 nt, Homo sapiens
ucauaguagucacuuaauaaau

SEQ ID NO: 358538 - RNA, 21 nt, Homo sapiens
ucaucaagcuguagacaugau

SEQ ID NO: 358539 - RNA, 22 nt, Homo sapiens
ucaugagacacacuggaaagga

SEQ ID NO: 358540 - RNA, 19 nt, Homo sapiens
ucauggcuuuuucagcugu

SEQ ID NO: 358541 - RNA, 22 nt, Homo sapiens
ucaugggagcccccaucaugag

SEQ ID NO: 358542 - RNA, 22 nt, Homo sapiens
ucauggggugcuuugcuagauu

SEQ ID NO: 358543 - RNA, 22 nt, Homo sapiens
ucauguaauuuugugucuauga

SEQ ID NO: 358544 - RNA, 22 nt, Homo sapiens
ucauucauucauccagcuugag

SEQ ID NO: 358545 - RNA, 22 nt, Homo sapiens
ucauucauucuucaguggguac

SEQ ID NO: 358546 - RNA, 22 nt, Homo sapiens
uccacaauggcugaacuagauu

SEQ ID NO: 358547 - RNA, 22 nt, Homo sapiens
uccaguguuccucagucacccc

SEQ ID NO: 358548 - RNA, 22 nt, Homo sapiens
uccaguuuggaggcuugaugug

SEQ ID NO: 358549 - RNA, 22 nt, Homo sapiens
uccaugaggcuacaguaaucuc

SEQ ID NO: 358550 - RNA, 22 nt, Homo sapiens
ucccacugucuucucgugcucg

SEQ ID NO: 358551 - RNA, 22 nt, Homo sapiens
ucccagaaacgcauauguucau

SEQ ID NO: 358552 - RNA, 22 nt, Homo sapiens
ucccaguguguagcuugucucu

SEQ ID NO: 358553 - RNA, 22 nt, Homo sapiens
ucccauugucucugaccuugcc

SEQ ID NO: 358554 - RNA, 22 nt, Homo sapiens
uccccaguaggcaauuaacacc

SEQ ID NO: 358555 - RNA, 22 nt, Homo sapiens
uccccgaggcuggagugcagug

SEQ ID NO: 358556 - RNA, 22 nt, Homo sapiens
uccccugagaccccucagcacu

SEQ ID NO: 358557 - RNA, 22 nt, Homo sapiens
uccccugauaccaaccaccaug

SEQ ID NO: 358558 - RNA, 22 nt, Homo sapiens
ucccuacuggggcacugccuag

SEQ ID NO: 358559 - RNA, 22 nt, Homo sapiens
ucccugaaaaauuggcuuaaca

SEQ ID NO: 358560 - RNA, 22 nt, Homo sapiens
ucccugacagggucugagcuuu

SEQ ID NO: 358561 - RNA, 22 nt, Homo sapiens
ucccuugagccuggcuucucac

SEQ ID NO: 358562 - RNA, 22 nt, Homo sapiens
uccugagaauagaguugcaugu

SEQ ID NO: 358563 - RNA, 22 nt, Homo sapiens
uccugagacucacaggcucccc

SEQ ID NO: 358564 - RNA, 22 nt, Homo sapiens
uccugagagcagacccucuaua

SEQ ID NO: 358565 - RNA, 20 nt, Homo sapiens
uccugagauucccaguucuc

SEQ ID NO: 358566 - RNA, 22 nt, Homo sapiens
uccugagucagcauccguuugu

SEQ ID NO: 358567 - RNA, 22 nt, Homo sapiens
uccuucacucuacaucuuuguu

SEQ ID NO: 358568 - RNA, 22 nt, Homo sapiens
uccuucaguccaguggguuuug

SEQ ID NO: 358569 - RNA, 22 nt, Homo sapiens
uccuugagccucccagacucag

SEQ ID NO: 358570 - RNA, 22 nt, Homo sapiens
uccuugagccuuaaauuauaaa

SEQ ID NO: 358571 - RNA, 19 nt, Homo sapiens
uccuugauugcaccacugc

SEQ ID NO: 358572 - RNA, 22 nt, Homo sapiens
uccuuggucaaaaagaaagugu

SEQ ID NO: 358573 - RNA, 22 nt, Homo sapiens
uccuuuggcuaacuuucuaagu

SEQ ID NO: 358574 - RNA, 22 nt, Homo sapiens
uccuuuggucaguauucuuuug

SEQ ID NO: 358575 - RNA, 22 nt, Homo sapiens
uccuuuguuacaguuggcucug

SEQ ID NO: 358576 - RNA, 22 nt, Homo sapiens
ucgugccacugcacuccagccu

SEQ ID NO: 358577 - RNA, 22 nt, Homo sapiens
ucuaaggcaccuagagucauca

SEQ ID NO: 358578 - RNA, 21 nt, Homo sapiens
ucuaccuacugcucacaggcu

SEQ ID NO: 358579 - RNA, 18 nt, Homo sapiens
ucuagacacugugucuau

SEQ ID NO: 358580 - RNA, 22 nt, Homo sapiens
ucuauggaguuugaaugagaaa

SEQ ID NO: 358581 - RNA, 22 nt, Homo sapiens
ucuauuugggguaccuguggua

SEQ ID NO: 358582 - RNA, 22 nt, Homo sapiens
ucucaagaugguagaugggaau

SEQ ID NO: 358583 - RNA, 22 nt, Homo sapiens
ucucaaguaacugggacaauaa

SEQ ID NO: 358584 - RNA, 22 nt, Homo sapiens
ucucaauuugauuacauucaua

SEQ ID NO: 358585 - RNA, 22 nt, Homo sapiens
ucucacacugaauguguguggg

SEQ ID NO: 358586 - RNA, 22 nt, Homo sapiens
ucucaguguuaucuaucugccu

SEQ ID NO: 358587 - RNA, 22 nt, Homo sapiens
ucucaguuuucaagcugucgau

SEQ ID NO: 358588 - RNA, 20 nt, Homo sapiens
ucucauggagguagagaaua

SEQ ID NO: 358589 - RNA, 22 nt, Homo sapiens
ucucugaaacucuugacauccu

SEQ ID NO: 358590 - RNA, 22 nt, Homo sapiens
ucucuguuugucuguuacuggu

SEQ ID NO: 358591 - RNA, 22 nt, Homo sapiens
ucucuuggcggaaguugcagug

SEQ ID NO: 358592 - RNA, 22 nt, Homo sapiens
ucugacagugagagaaaucuga

SEQ ID NO: 358593 - RNA, 22 nt, Homo sapiens
ucugacucuggagucucagguu

SEQ ID NO: 358594 - RNA, 22 nt, Homo sapiens
ucugagaucaugucugugcugu

SEQ ID NO: 358595 - RNA, 22 nt, Homo sapiens
ucugagcaauagauguggauau

SEQ ID NO: 358596 - RNA, 22 nt, Homo sapiens
ucugagucaucacaaaugaugc

SEQ ID NO: 358597 - RNA, 22 nt, Homo sapiens
ucuggcaagagccgagggcagu

SEQ ID NO: 358598 - RNA, 22 nt, Homo sapiens
uauccuguagcucauccaccgc

SEQ ID NO: 358599 - RNA, 22 nt, Homo sapiens
uaucucacauauucaguagguu

SEQ ID NO: 358600 - RNA, 22 nt, Homo sapiens
uaugacuuuggaaaaauuacuu

SEQ ID NO: 358601 - RNA, 22 nt, Homo sapiens
uaugagcaaaaugaggguuagu

SEQ ID NO: 358602 - RNA, 22 nt, Homo sapiens
uaugaggaguauaacccgguga

SEQ ID NO: 358603 - RNA, 22 nt, Homo sapiens
uaugcacaugcaugcuugaaua

SEQ ID NO: 358604 - RNA, 22 nt, Homo sapiens
uaugcacuaggcacuguguuug

SEQ ID NO: 358605 - RNA, 22 nt, Homo sapiens
uaugcacuauggaaguagcuca

SEQ ID NO: 358606 - RNA, 22 nt, Homo sapiens
uaugccuuugaccauuuuguga

SEQ ID NO: 358607 - RNA, 22 nt, Homo sapiens
uaugccuuuuggcucaagaaac

SEQ ID NO: 358608 - RNA, 22 nt, Homo sapiens
uauggauucuagcucaguaggu

SEQ ID NO: 358609 - RNA, 21 nt, Homo sapiens
uauggauuugccuauucugga

SEQ ID NO: 358610 - RNA, 22 nt, Homo sapiens
uauggauuugccuauucuguau

SEQ ID NO: 358611 - RNA, 22 nt, Homo sapiens
uauggcauuguuggugaugaua

SEQ ID NO: 358612 - RNA, 22 nt, Homo sapiens
uauggccacugucuuugaguca

SEQ ID NO: 358613 - RNA, 22 nt, Homo sapiens
uauggccccuacaugugcaaaa

SEQ ID NO: 358614 - RNA, 22 nt, Homo sapiens
uauggcuucuauaaggaagcuu

SEQ ID NO: 358615 - RNA, 22 nt, Homo sapiens
uauggcuuuuaacugucguaug

SEQ ID NO: 358616 - RNA, 22 nt, Homo sapiens
uauggcuuuucacuuaaguccu

SEQ ID NO: 358617 - RNA, 17 nt, Homo sapiens
uauguaguacuuauaaa

SEQ ID NO: 358618 - RNA, 19 nt, Homo sapiens
uauguaguuuucucaauau

SEQ ID NO: 358619 - RNA, 22 nt, Homo sapiens
uaugugcuuuguuaaacagaug

SEQ ID NO: 358620 - RNA, 22 nt, Homo sapiens
uaugugguuaauaggaauuugu

SEQ ID NO: 358621 - RNA, 22 nt, Homo sapiens
uauuagguuggugcaaaaguaa

SEQ ID NO: 358622 - RNA, 22 nt, Homo sapiens
uauuagguuggugcaaaaguua

SEQ ID NO: 358623 - RNA, 22 nt, Homo sapiens
uauuaugcacuuuauaaaaauu

SEQ ID NO: 358624 - RNA, 22 nt, Homo sapiens
uauucaagccaaauucaagcca

SEQ ID NO: 358625 - RNA, 22 nt, Homo sapiens
uauuccagcccuggugagccag

SEQ ID NO: 358626 - RNA, 22 nt, Homo sapiens
uauuccuuuugcauuuccacau

SEQ ID NO: 358627 - RNA, 22 nt, Homo sapiens
uauugcaaauggugaucccagg

SEQ ID NO: 358628 - RNA, 22 nt, Homo sapiens
uauugcaauuggcagagugcua

SEQ ID NO: 358629 - RNA, 22 nt, Homo sapiens
uauugcuaaaacucaugguugc

SEQ ID NO: 358630 - RNA, 22 nt, Homo sapiens
cugaccucugucaaagacaccc

SEQ ID NO: 358631 - RNA, 22 nt, Homo sapiens
cugacuaguuuuaaugcagauu

SEQ ID NO: 358632 - RNA, 22 nt, Homo sapiens
cugacuuauguggacuauuuca

SEQ ID NO: 358633 - RNA, 22 nt, Homo sapiens
cugagaagaaacagguaaggac

SEQ ID NO: 358634 - RNA, 22 nt, Homo sapiens
cugagacacucuuaucugcaua

SEQ ID NO: 358635 - RNA, 22 nt, Homo sapiens
cugagagaugagaccucucacu

SEQ ID NO: 358636 - RNA, 22 nt, Homo sapiens
cugagaucugaaccaggagugu

SEQ ID NO: 358637 - RNA, 22 nt, Homo sapiens
cugagcaaagaagugauaauga

SEQ ID NO: 358638 - RNA, 22 nt, Homo sapiens
cugagguacugggggccaggau

SEQ ID NO: 358639 - RNA, 22 nt, Homo sapiens
cugagguagcucaggguauugc

SEQ ID NO: 358640 - RNA, 22 nt, Homo sapiens
cugaggugggagaaucacauaa

SEQ ID NO: 358641 - RNA, 20 nt, Homo sapiens
cugaggugggagaaucgcuu

SEQ ID NO: 358642 - RNA, 22 nt, Homo sapiens
cugaggugggaggauuacuuga

SEQ ID NO: 358643 - RNA, 22 nt, Homo sapiens
cugaggugggaggauuggcuug

SEQ ID NO: 358644 - RNA, 22 nt, Homo sapiens
uacacaugugaguucuuuucua

SEQ ID NO: 358645 - RNA, 20 nt, Homo sapiens
uacacguaugagcacaugug

SEQ ID NO: 358646 - RNA, 22 nt, Homo sapiens
uacacgugcacaacgugcacgu

SEQ ID NO: 358647 - RNA, 22 nt, Homo sapiens
uacagaguauccauuugaguuc

SEQ ID NO: 358648 - RNA, 22 nt, Homo sapiens
uacagcacaggugcagguguug

SEQ ID NO: 358649 - RNA, 22 nt, Homo sapiens
uacaggaaugucagguugcugu

SEQ ID NO: 358650 - RNA, 19 nt, Homo sapiens
uacaggacugagcugaggu

SEQ ID NO: 358651 - RNA, 22 nt, Homo sapiens
aagaugcagaagcccagauguu

SEQ ID NO: 358652 - RNA, 22 nt, Homo sapiens
aagcaguguggacuaaugggaa

SEQ ID NO: 358653 - RNA, 22 nt, Homo sapiens
aagcucauugagaucuauggcu

SEQ ID NO: 358654 - RNA, 22 nt, Homo sapiens
aagcuguguguaagcucucaca

SEQ ID NO: 358655 - RNA, 22 nt, Homo sapiens
aaggaauucaaauuuucucugg

SEQ ID NO: 358656 - RNA, 22 nt, Homo sapiens
aaggagcaguggacggguccua

SEQ ID NO: 358657 - RNA, 22 nt, Homo sapiens
aaggaguagaggaauagcaaug

SEQ ID NO: 358658 - RNA, 22 nt, Homo sapiens
aaggagugugauucuucaguuu

SEQ ID NO: 358659 - RNA, 22 nt, Homo sapiens
aaggcaagaaaauggauucucc

SEQ ID NO: 358660 - RNA, 22 nt, Homo sapiens
aaggcaagaagagaaccaucgg

SEQ ID NO: 358661 - RNA, 22 nt, Homo sapiens
aaggcaagguggauaaugaagc

SEQ ID NO: 358662 - RNA, 22 nt, Homo sapiens
aaggcacugaacuuaaauucug

SEQ ID NO: 358663 - RNA, 22 nt, Homo sapiens
aaggcauggugacuauuuaggc

SEQ ID NO: 358664 - RNA, 22 nt, Homo sapiens
aaggcgguguggauccuacagc

SEQ ID NO: 358665 - RNA, 22 nt, Homo sapiens
aaggcuagagaagaagggcauc

SEQ ID NO: 358666 - RNA, 22 nt, Homo sapiens
aagggaauguuguagcugguuu

SEQ ID NO: 358667 - RNA, 22 nt, Homo sapiens
aagggagcugcauaaucuugug

SEQ ID NO: 358668 - RNA, 22 nt, Homo sapiens
aagguuguauuuaauauacugu

SEQ ID NO: 358669 - RNA, 22 nt, Homo sapiens
aaguauagcuaugauaaacauu

SEQ ID NO: 358670 - RNA, 22 nt, Homo sapiens
aaguaucaggaauaguuauugg

SEQ ID NO: 358671 - RNA, 23 nt, Homo sapiens
aagucauggaaucaaaugaggug

SEQ ID NO: 358672 - RNA, 22 nt, Homo sapiens
aagugcugggauuggccgggca

SEQ ID NO: 358673 - RNA, 22 nt, Homo sapiens
aagugcuguccuaccuuuggga

SEQ ID NO: 358674 - RNA, 22 nt, Homo sapiens
aagugcuuacagggaacaugau

SEQ ID NO: 358675 - RNA, 22 nt, Homo sapiens
aaguggaauguuuguggcacaa

SEQ ID NO: 358676 - RNA, 22 nt, Homo sapiens
aagugguguuugggagcuggac

SEQ ID NO: 358677 - RNA, 22 nt, Homo sapiens
aaguguaaguuaauguuuaggu

SEQ ID NO: 358678 - RNA, 22 nt, Homo sapiens
aaguuguaguuagagaguugcu

SEQ ID NO: 358679 - RNA, 22 nt, Homo sapiens
aaguuguuggaguuccauuguu

SEQ ID NO: 358680 - RNA, 22 nt, Homo sapiens
aauaaagcaggguccuugcacu

SEQ ID NO: 358681 - RNA, 22 nt, Homo sapiens
aauaaaguaggaggugaggaaa

SEQ ID NO: 358682 - RNA, 22 nt, Homo sapiens
aauaaguugagaugaggucaua

SEQ ID NO: 358683 - RNA, 21 nt, Homo sapiens
aauacucuagguuaagagagc

SEQ ID NO: 358684 - RNA, 22 nt, Homo sapiens
aauacucuauaagggaagcugu

SEQ ID NO: 358685 - RNA, 22 nt, Homo sapiens
aauacugaaaguauuuucaaau

SEQ ID NO: 358686 - RNA, 22 nt, Homo sapiens
aauaucacaguggguguacacc

SEQ ID NO: 358687 - RNA, 22 nt, Homo sapiens
aaucacaguuaguaagggagaa

SEQ ID NO: 358688 - RNA, 22 nt, Homo sapiens
aaucacuuuggcaccaaccuaa

SEQ ID NO: 358689 - RNA, 22 nt, Homo sapiens
aaugaaguuagauguugagaag

SEQ ID NO: 358690 - RNA, 17 nt, Homo sapiens
aaugagacauuucugcu

SEQ ID NO: 358691 - RNA, 22 nt, Homo sapiens
aauggcacacaccuggucuaac

SEQ ID NO: 358692 - RNA, 22 nt, Homo sapiens
agggcaguguuaggacugucug

SEQ ID NO: 358693 - RNA, 22 nt, Homo sapiens
agggcuuguuuaacuaucauua

SEQ ID NO: 358694 - RNA, 20 nt, Homo sapiens
agguacacugacaugccuuc

SEQ ID NO: 358695 - RNA, 22 nt, Homo sapiens
agguagugugaugcuccuguuu

SEQ ID NO: 358696 - RNA, 22 nt, Homo sapiens
agguauauuggacagauguaaa

SEQ ID NO: 358697 - RNA, 22 nt, Homo sapiens
aggucaccucaggaaauacuga

SEQ ID NO: 358698 - RNA, 22 nt, Homo sapiens
agguccauuauuuucauucaug

SEQ ID NO: 358699 - RNA, 22 nt, Homo sapiens
aggugacugguuuaucuggcag

SEQ ID NO: 358700 - RNA, 22 nt, Homo sapiens
aggugcaugcuucacuggauau

SEQ ID NO: 358701 - RNA, 22 nt, Homo sapiens
aggugguauuucaaaguggcag

SEQ ID NO: 358702 - RNA, 22 nt, Homo sapiens
agguucccuuuuggccugggau

SEQ ID NO: 358703 - RNA, 22 nt, Homo sapiens
aguaaacuucagaguucuuccu

SEQ ID NO: 358704 - RNA, 22 nt, Homo sapiens
aguaaagcuacucacugugggc

SEQ ID NO: 358705 - RNA, 22 nt, Homo sapiens
aguaacacaccugcauggugug

SEQ ID NO: 358706 - RNA, 22 nt, Homo sapiens
aguacacuguugaacagaagug

SEQ ID NO: 358707 - RNA, 22 nt, Homo sapiens
aguaccauuacucacuuauuuu

SEQ ID NO: 358708 - RNA, 20 nt, Homo sapiens
aguauucacuuuuuucaugg

SEQ ID NO: 358709 - RNA, 22 nt, Homo sapiens
agucaaaugcuuauguauaaag

SEQ ID NO: 358710 - RNA, 22 nt, Homo sapiens
agucaagauggcaagguaaggc

SEQ ID NO: 358711 - RNA, 22 nt, Homo sapiens
agucaaguuuuuucagagaaua

SEQ ID NO: 358712 - RNA, 22 nt, Homo sapiens
agucacaugcauuuucuucaau

SEQ ID NO: 358713 - RNA, 22 nt, Homo sapiens
agucauaggagagauaucacug

SEQ ID NO: 358714 - RNA, 22 nt, Homo sapiens
agucaugggagagaugugaucg

SEQ ID NO: 358715 - RNA, 22 nt, Homo sapiens
agucgguguuacugacagaaug

SEQ ID NO: 358716 - RNA, 22 nt, Homo sapiens
agugaauguuggaaaguuauuu

SEQ ID NO: 358717 - RNA, 22 nt, Homo sapiens
agugaauuguucaacaggagga

SEQ ID NO: 358718 - RNA, 22 nt, Homo sapiens
agugacaugggaucaaaucuga

SEQ ID NO: 358719 - RNA, 22 nt, Homo sapiens
agugcaaagccgagguuucuug

SEQ ID NO: 358720 - RNA, 22 nt, Homo sapiens
agugcaguggcauggucauaac

SEQ ID NO: 358721 - RNA, 22 nt, Homo sapiens
agugcagugguuaggagccagg

SEQ ID NO: 358722 - RNA, 22 nt, Homo sapiens
agugcauaugucuuuuuggaag

SEQ ID NO: 358723 - RNA, 22 nt, Homo sapiens
agugcauuuguucugugucagg

SEQ ID NO: 358724 - RNA, 22 nt, Homo sapiens
agugccacugcacucuagccug

SEQ ID NO: 358725 - RNA, 22 nt, Homo sapiens
agugccauggcugcuagauggc

SEQ ID NO: 358726 - RNA, 22 nt, Homo sapiens
agugccuacuugaauuguagug

SEQ ID NO: 358727 - RNA, 22 nt, Homo sapiens
agugcuuaauagauguccagca

SEQ ID NO: 358728 - RNA, 22 nt, Homo sapiens
aguggcaaugugauguccugaa

SEQ ID NO: 358729 - RNA, 22 nt, Homo sapiens
agugggccccuagaggugaggu

SEQ ID NO: 358730 - RNA, 22 nt, Homo sapiens
agugguuuuaaguagagcauac

SEQ ID NO: 358731 - RNA, 22 nt, Homo sapiens
agugguuuuggaauggaauuca

SEQ ID NO: 358732 - RNA, 22 nt, Homo sapiens
agugucaggagacagguagcug

SEQ ID NO: 358733 - RNA, 22 nt, Homo sapiens
aguuggugauugauugggucug

SEQ ID NO: 358734 - RNA, 18 nt, Homo sapiens
aguuguuuuauccugccc

SEQ ID NO: 358735 - RNA, 22 nt, Homo sapiens
auaaacugucaguggagaguaa

SEQ ID NO: 358736 - RNA, 22 nt, Homo sapiens
auaaagcuauuccucucuuuuu

SEQ ID NO: 358737 - RNA, 22 nt, Homo sapiens
auaaaguucugcuggcauauau

SEQ ID NO: 358738 - RNA, 22 nt, Homo sapiens
auaaauaguaguugugguggcc

SEQ ID NO: 358739 - RNA, 22 nt, Homo sapiens
auaacagcauuauugcauacgu

SEQ ID NO: 358740 - RNA, 22 nt, Homo sapiens
auaagugagugauucaguguua

SEQ ID NO: 358741 - RNA, 22 nt, Homo sapiens
auaagugcuuguugaauaauag

SEQ ID NO: 358742 - RNA, 22 nt, Homo sapiens
auacacauuccugggccucacc

SEQ ID NO: 358743 - RNA, 22 nt, Homo sapiens
auacagcuaaaauauuaaguua

SEQ ID NO: 358744 - RNA, 22 nt, Homo sapiens
auacagugaauacuuacagugu

SEQ ID NO: 358745 - RNA, 22 nt, Homo sapiens
auacaugcauuugcacgagagu

SEQ ID NO: 358746 - RNA, 22 nt, Homo sapiens
auacuagucaagaauguaugag

SEQ ID NO: 358747 - RNA, 22 nt, Homo sapiens
auacuguuucugaacuuugauu

SEQ ID NO: 358748 - RNA, 22 nt, Homo sapiens
auagcaagaugauugauccauu

SEQ ID NO: 358749 - RNA, 22 nt, Homo sapiens
auagcaauuugggaaucagacu

SEQ ID NO: 358750 - RNA, 22 nt, Homo sapiens
auagcacacuauagcuucaaac

SEQ ID NO: 358751 - RNA, 22 nt, Homo sapiens
auagcacaguguguguacacca

SEQ ID NO: 358752 - RNA, 22 nt, Homo sapiens
auagcagaauuuggucaagucu

SEQ ID NO: 358753 - RNA, 22 nt, Homo sapiens
auagcagcaccucacucuacug

SEQ ID NO: 358754 - RNA, 22 nt, Homo sapiens
auagcagcucacuuauuuaugg

SEQ ID NO: 358755 - RNA, 22 nt, Homo sapiens
auagcagugugaaaauugacug

SEQ ID NO: 358756 - RNA, 22 nt, Homo sapiens
auagcauaucccacaugucaga

SEQ ID NO: 358757 - RNA, 22 nt, Homo sapiens
auagguuauuagagcaaagcuu

SEQ ID NO: 358758 - RNA, 22 nt, Homo sapiens
auagguuuucacuguagauucu

SEQ ID NO: 358759 - RNA, 22 nt, Homo sapiens
auaguagcaugcacuggugcug

SEQ ID NO: 358760 - RNA, 22 nt, Homo sapiens
auagugcugcaauaaacauaug

SEQ ID NO: 358761 - RNA, 22 nt, Homo sapiens
auagugcugcaaucaacauaca

SEQ ID NO: 358762 - RNA, 22 nt, Homo sapiens
auagugcugcaauuaacauaca

SEQ ID NO: 358763 - RNA, 22 nt, Homo sapiens
auauauguuuucugggaagaaa

SEQ ID NO: 358764 - RNA, 22 nt, Homo sapiens
auaucaacaucgugucauuagu

SEQ ID NO: 358765 - RNA, 22 nt, Homo sapiens
auaucaaggccauuuucuaaau

SEQ ID NO: 358766 - RNA, 22 nt, Homo sapiens
auaucacaaacaagucuguacu

SEQ ID NO: 358767 - RNA, 22 nt, Homo sapiens
auaugcaaauccauagagacag

SEQ ID NO: 358768 - RNA, 22 nt, Homo sapiens
auaugcacuauacacacguaua

SEQ ID NO: 358769 - RNA, 22 nt, Homo sapiens
auaugcauacauguaugcagga

SEQ ID NO: 358770 - RNA, 22 nt, Homo sapiens
auauggcauucagaacuguaua

SEQ ID NO: 358771 - RNA, 22 nt, Homo sapiens
auauguaguauggaaacauugu

SEQ ID NO: 358772 - RNA, 22 nt, Homo sapiens
auauguaguuucagaaguggaa

SEQ ID NO: 358773 - RNA, 22 nt, Homo sapiens
auauuacagagaggaccuggga

SEQ ID NO: 358774 - RNA, 18 nt, Homo sapiens
auauugccuucagacuag

SEQ ID NO: 358775 - RNA, 20 nt, Homo sapiens
aucaaagacuuagaggggga

SEQ ID NO: 358776 - RNA, 22 nt, Homo sapiens
aucaaaguaucucaauauggua

SEQ ID NO: 358777 - RNA, 22 nt, Homo sapiens
aucaaagugaaauauuaguuau

SEQ ID NO: 358778 - RNA, 22 nt, Homo sapiens
aucaaaguuucccagaaguugu

SEQ ID NO: 358779 - RNA, 22 nt, Homo sapiens
aucaaaucuccagaaccugucu

SEQ ID NO: 358780 - RNA, 22 nt, Homo sapiens
aucaaauugucauuuuaaggau

SEQ ID NO: 358781 - RNA, 22 nt, Homo sapiens
aucacaauuguacguaggagcc

SEQ ID NO: 358782 - RNA, 22 nt, Homo sapiens
aucacagauauggguuuaaauc

SEQ ID NO: 358783 - RNA, 22 nt, Homo sapiens
aucacaguggucagguauagau

SEQ ID NO: 358784 - RNA, 22 nt, Homo sapiens
aucacaguuaagaggugaugaa

SEQ ID NO: 358785 - RNA, 22 nt, Homo sapiens
aucacauggccagguaguaauc

SEQ ID NO: 358786 - RNA, 22 nt, Homo sapiens
aucacauggccuagccuaaccu

SEQ ID NO: 358787 - RNA, 20 nt, Homo sapiens
aucaccacagcucguucaug

SEQ ID NO: 358788 - RNA, 22 nt, Homo sapiens
aucagaaucucuagugggacca

SEQ ID NO: 358789 - RNA, 20 nt, Homo sapiens
aucagagccggugaaagggc

SEQ ID NO: 358790 - RNA, 22 nt, Homo sapiens
aucagagugaaacaugggagau

SEQ ID NO: 358791 - RNA, 19 nt, Homo sapiens
aucagcacaagugugcuuu

SEQ ID NO: 358792 - RNA, 22 nt, Homo sapiens
aucagugaaagugaaaucuccg

SEQ ID NO: 358793 - RNA, 22 nt, Homo sapiens
aucagugagugguuagugaaug

SEQ ID NO: 358794 - RNA, 22 nt, Homo sapiens
aucagugcauaguauuuaauga

SEQ ID NO: 358795 - RNA, 22 nt, Homo sapiens
aucaucaugcacuacagccugg

SEQ ID NO: 358796 - RNA, 22 nt, Homo sapiens
aucauccagccccagaagggag

SEQ ID NO: 358797 - RNA, 22 nt, Homo sapiens
aucauccugucaggagcuguga

SEQ ID NO: 358798 - RNA, 22 nt, Homo sapiens
auccacauucauggaccagucc

SEQ ID NO: 358799 - RNA, 22 nt, Homo sapiens
auccauugcucaagagaaguca

SEQ ID NO: 358800 - RNA, 22 nt, Homo sapiens
aucccugagccugacucucaga

SEQ ID NO: 358801 - RNA, 22 nt, Homo sapiens
aucccuguaguaauauucuagc

SEQ ID NO: 358802 - RNA, 22 nt, Homo sapiens
aucccuuccuagcacuuggugu

SEQ ID NO: 358803 - RNA, 22 nt, Homo sapiens
auccuagguuagagaacaaaac

SEQ ID NO: 358804 - RNA, 22 nt, Homo sapiens
auccucaguggcuuaaguauag

SEQ ID NO: 358805 - RNA, 22 nt, Homo sapiens
auccucugagagaguuucauaa

SEQ ID NO: 358806 - RNA, 22 nt, Homo sapiens
auccugagacuuugcugaaguu

SEQ ID NO: 358807 - RNA, 22 nt, Homo sapiens
auccugagacuuuucugaaguu

SEQ ID NO: 358808 - RNA, 22 nt, Homo sapiens
auccugaugacacagugcugca

SEQ ID NO: 358809 - RNA, 22 nt, Homo sapiens
auccuguagagaugagggugga

SEQ ID NO: 358810 - RNA, 20 nt, Homo sapiens
aucguggccugaggagauac

SEQ ID NO: 358811 - RNA, 22 nt, Homo sapiens
aucucugagauguucugauuuu

SEQ ID NO: 358812 - RNA, 20 nt, Homo sapiens
aucucugggcaaaggaaaau

SEQ ID NO: 358813 - RNA, 22 nt, Homo sapiens
aucugcaaagcugggcugagac

SEQ ID NO: 358814 - RNA, 22 nt, Homo sapiens
aucugcauuagggugaagaccu

SEQ ID NO: 358815 - RNA, 22 nt, Homo sapiens
aucugguguauuggugcugggu

SEQ ID NO: 358816 - RNA, 22 nt, Homo sapiens
aucugugguuguaugcauauua

SEQ ID NO: 358817 - RNA, 22 nt, Homo sapiens
aucuuugcugagaugcauggca

SEQ ID NO: 358818 - RNA, 22 nt, Homo sapiens
aucuuuggcgggaauaucacag

SEQ ID NO: 358819 - RNA, 22 nt, Homo sapiens
aucuuuggucaucacagcuaga

SEQ ID NO: 358820 - RNA, 22 nt, Homo sapiens
augaacagagccuugagaaccu

SEQ ID NO: 358821 - RNA, 18 nt, Homo sapiens
augaacucaucauuuuua

SEQ ID NO: 358822 - RNA, 18 nt, Homo sapiens
augaacucaucauuuuuu

SEQ ID NO: 358823 - RNA, 17 nt, Homo sapiens
augaacucaucguucuu

SEQ ID NO: 358824 - RNA, 18 nt, Homo sapiens
augaagucaucacuuuua

SEQ ID NO: 358825 - RNA, 22 nt, Homo sapiens
augaaguuagcucauuucuuuu

SEQ ID NO: 358826 - RNA, 22 nt, Homo sapiens
augaauacugcugcaaugaaca

SEQ ID NO: 358827 - RNA, 20 nt, Homo sapiens
augaauguccuugauggcau

SEQ ID NO: 358828 - RNA, 22 nt, Homo sapiens
augacagugagugagcucucac

SEQ ID NO: 358829 - RNA, 22 nt, Homo sapiens
augacauagaagcaauccccua

SEQ ID NO: 358830 - RNA, 22 nt, Homo sapiens
augacauuccacagccguagag

SEQ ID NO: 358831 - RNA, 21 nt, Homo sapiens
augacccuggguguccuuucc

SEQ ID NO: 358832 - RNA, 22 nt, Homo sapiens
augaccuuguccucagugucau

SEQ ID NO: 358833 - RNA, 22 nt, Homo sapiens
augacuauugcacuuuccuggu

SEQ ID NO: 358834 - RNA, 22 nt, Homo sapiens
augagaaucauuucagcuugua

SEQ ID NO: 358835 - RNA, 22 nt, Homo sapiens
augagaaugaagccuggcgugu

SEQ ID NO: 358836 - RNA, 22 nt, Homo sapiens
agcuggaauuuaagguagauag

SEQ ID NO: 358837 - RNA, 23 nt, Homo sapiens
agcugguacuagaggcuugcgcc

SEQ ID NO: 358838 - RNA, 22 nt, Homo sapiens
agcuggucuacguguguaugag

SEQ ID NO: 358839 - RNA, 22 nt, Homo sapiens
agcuggucucaggugcccugcu

SEQ ID NO: 358840 - RNA, 22 nt, Homo sapiens
agcuggucugauacuuaccucc

SEQ ID NO: 358841 - RNA, 22 nt, Homo sapiens
agcuggucuuggggaagaguag

SEQ ID NO: 358842 - RNA, 22 nt, Homo sapiens
agcugugucuucuuaaagauuu

SEQ ID NO: 358843 - RNA, 22 nt, Homo sapiens
agcuguguugucugaagucaga

SEQ ID NO: 358844 - RNA, 22 nt, Homo sapiens
agcuucauucugaauagguuga

SEQ ID NO: 358845 - RNA, 20 nt, Homo sapiens
agcuugguuuggaugaucac

SEQ ID NO: 358846 - RNA, 22 nt, Homo sapiens
agcuuguggugaauacugcuag

SEQ ID NO: 358847 - RNA, 21 nt, Homo sapiens
agcuuguguguaucacagugu

SEQ ID NO: 358848 - RNA, 22 nt, Homo sapiens
agcuuguguuugucugccuggg

SEQ ID NO: 358849 - RNA, 22 nt, Homo sapiens
agcuuguuuuccugcaacuaga

SEQ ID NO: 358850 - RNA, 22 nt, Homo sapiens
aggaaauguuggucccauuucu

SEQ ID NO: 358851 - RNA, 21 nt, Homo sapiens
aggaagacuaugaucaauugg

SEQ ID NO: 358852 - RNA, 16 nt, Homo sapiens
aggaagacuuagagau

SEQ ID NO: 358853 - RNA, 22 nt, Homo sapiens
aggaagcuagcauuuguucagu

SEQ ID NO: 358854 - RNA, 22 nt, Homo sapiens
aggaagguaaacuaacuugccu

SEQ ID NO: 358855 - RNA, 22 nt, Homo sapiens
aggacacugauguaugcugugg

SEQ ID NO: 358856 - RNA, 22 nt, Homo sapiens
aggagcacaauggucaugugga

SEQ ID NO: 358857 - RNA, 22 nt, Homo sapiens
aggagcacaggacuuugauuau

SEQ ID NO: 358858 - RNA, 18 nt, Homo sapiens
aggagcauagugcuauga

SEQ ID NO: 358859 - RNA, 21 nt, Homo sapiens
aggagcauucaugacgagguu

SEQ ID NO: 358860 - RNA, 22 nt, Homo sapiens
aggagcuuuggggaaaacagau

SEQ ID NO: 358861 - RNA, 22 nt, Homo sapiens
aggagguagaacauugccauuu

SEQ ID NO: 358862 - RNA, 21 nt, Homo sapiens
aggauaguagauuaaauauuu

SEQ ID NO: 358863 - RNA, 22 nt, Homo sapiens
aggcaagaaugcuuguuucacc

SEQ ID NO: 358864 - RNA, 22 nt, Homo sapiens
aggcaagugauagcugcguaau

SEQ ID NO: 358865 - RNA, 22 nt, Homo sapiens
aggcagucugaguuuugaaagg

SEQ ID NO: 358866 - RNA, 22 nt, Homo sapiens
aggcaugauuguauuuugcucu

SEQ ID NO: 358867 - RNA, 22 nt, Homo sapiens
aggcaugugugcagacugucug

SEQ ID NO: 358868 - RNA, 23 nt, Homo sapiens
aggccaguuuuuccugcuugcug

SEQ ID NO: 358869 - RNA, 22 nt, Homo sapiens
aggcuaagaugacuccaccccc

SEQ ID NO: 358870 - RNA, 22 nt, Homo sapiens
aggcuagaaucuuccaucuugg

SEQ ID NO: 358871 - RNA, 22 nt, Homo sapiens
guagagugcugggcacuggcuc

SEQ ID NO: 358872 - RNA, 22 nt, Homo sapiens
guagcagccacacuugauaacu

SEQ ID NO: 358873 - RNA, 22 nt, Homo sapiens
guagcagucacauagcagauug

SEQ ID NO: 358874 - RNA, 22 nt, Homo sapiens
guauacuucugaaaauagcuau

SEQ ID NO: 358875 - RNA, 22 nt, Homo sapiens
guauaguaguacaaaaguuuuu

SEQ ID NO: 358876 - RNA, 22 nt, Homo sapiens
guaucaucauguuggccaggcu

SEQ ID NO: 358877 - RNA, 22 nt, Homo sapiens
guaucauuggcauguaaccaga

SEQ ID NO: 358878 - RNA, 22 nt, Homo sapiens
guauccugaaguucucagcacu

SEQ ID NO: 358879 - RNA, 22 nt, Homo sapiens
guaugcaagugauaugacauau

SEQ ID NO: 358880 - RNA, 22 nt, Homo sapiens
guauggaagucaguuuguuggc

SEQ ID NO: 358881 - RNA, 22 nt, Homo sapiens
guauggcacuauccucucugau

SEQ ID NO: 358882 - RNA, 22 nt, Homo sapiens
guaugguacuuuaugguuagug

SEQ ID NO: 358883 - RNA, 22 nt, Homo sapiens
guaugucuugucuauggcugcu

SEQ ID NO: 358884 - RNA, 22 nt, Homo sapiens
ucagguauuucuuuuagcugug

SEQ ID NO: 358885 - RNA, 22 nt, Homo sapiens
ucaggucauuccaggagggcca

SEQ ID NO: 358886 - RNA, 22 nt, Homo sapiens
ucaggugccuuggcuaauuguu

SEQ ID NO: 358887 - RNA, 22 nt, Homo sapiens
ucaguaaaugcuguucucuuuu

SEQ ID NO: 358888 - RNA, 22 nt, Homo sapiens
ucagugaauauauaacagcgau

SEQ ID NO: 358889 - RNA, 22 nt, Homo sapiens
ucagugaauguuggccacuacu

SEQ ID NO: 358890 - RNA, 22 nt, Homo sapiens
ucagugacugcugcuuguauac

SEQ ID NO: 358891 - RNA, 22 nt, Homo sapiens
ucagugccauugccauaugagu

SEQ ID NO: 358892 - RNA, 22 nt, Homo sapiens
ucagugcuuuuuguugucauca

SEQ ID NO: 358893 - RNA, 22 nt, Homo sapiens
ucagugggcuauguaauuaacu

SEQ ID NO: 358894 - RNA, 23 nt, Homo sapiens
ucagugucuggauccugcucagu

SEQ ID NO: 358895 - RNA, 22 nt, Homo sapiens
ucagugucugugauggagaggu

SEQ ID NO: 358896 - RNA, 21 nt, Homo sapiens
ucaguuacugagagagaagug

SEQ ID NO: 358897 - RNA, 20 nt, Homo sapiens
ucauagggugguggcagugg

SEQ ID NO: 358898 - RNA, 21 nt, Homo sapiens
ucauauguaucuuugugccuc

SEQ ID NO: 358899 - RNA, 22 nt, Homo sapiens
ucauauugcgguucauugacuu

SEQ ID NO: 358900 - RNA, 21 nt, Homo sapiens
ucaucagucaaagacaauggu

SEQ ID NO: 358901 - RNA, 22 nt, Homo sapiens
ucaucagugcuugcaaauuauu

SEQ ID NO: 358902 - RNA, 22 nt, Homo sapiens
ucaucaguuuuuuauaugugau

SEQ ID NO: 358903 - RNA, 22 nt, Homo sapiens
ucaugaaguaguuaacugguug

SEQ ID NO: 358904 - RNA, 22 nt, Homo sapiens
ucaugcaaugcaaggggaaauu

SEQ ID NO: 358905 - RNA, 21 nt, Homo sapiens
ucaugccacugcacuuuagcc

SEQ ID NO: 358906 - RNA, 22 nt, Homo sapiens
ugaaaucuaaaauguuccaaga

SEQ ID NO: 358907 - RNA, 22 nt, Homo sapiens
ugaaaucuuugaugguggcauu

SEQ ID NO: 358908 - RNA, 22 nt, Homo sapiens
ugaaaugaucaguuugguuacu

SEQ ID NO: 358909 - RNA, 22 nt, Homo sapiens
ugaaaugcagaacuuuaggucu

SEQ ID NO: 358910 - RNA, 22 nt, Homo sapiens
ugaaaugccuuuaaugaauuua

SEQ ID NO: 358911 - RNA, 22 nt, Homo sapiens
ugaaaugcugucuaggggaaau

SEQ ID NO: 358912 - RNA, 22 nt, Homo sapiens
ugaaaugucuuuaggaggcuuc

SEQ ID NO: 358913 - RNA, 22 nt, Homo sapiens
ugaaauuuuuuauucguuggcu

SEQ ID NO: 358914 - RNA, 22 nt, Homo sapiens
ugaacagcaccuccuagaguug

SEQ ID NO: 358915 - RNA, 22 nt, Homo sapiens
ugaaggacauucuaugguagau

SEQ ID NO: 358916 - RNA, 20 nt, Homo sapiens
ugaaggaggucauuuauacc

SEQ ID NO: 358917 - RNA, 22 nt, Homo sapiens
ugaagugcugugggccaggcgu

SEQ ID NO: 358918 - RNA, 22 nt, Homo sapiens
ugaauagaaguggcaggaguag

SEQ ID NO: 358919 - RNA, 22 nt, Homo sapiens
ugaauaguaauguguuuggucu

SEQ ID NO: 358920 - RNA, 21 nt, Homo sapiens
ugaaugcuuuaaauauuagaa

SEQ ID NO: 358921 - RNA, 22 nt, Homo sapiens
ugaaugguaauuuaguaggcac

SEQ ID NO: 358922 - RNA, 22 nt, Homo sapiens
ugaauguccauugauguuuuga

SEQ ID NO: 358923 - RNA, 22 nt, Homo sapiens
ugaauguuugcagcuuauacca

SEQ ID NO: 358924 - RNA, 22 nt, Homo sapiens
ugacaaguaaacagucagcacc

SEQ ID NO: 358925 - RNA, 18 nt, Homo sapiens
ugacaaugcuaguccugg

SEQ ID NO: 358926 - RNA, 22 nt, Homo sapiens
ugacacauguagacaucuggug

SEQ ID NO: 358927 - RNA, 21 nt, Homo sapiens
ugacagaaaauugaguuugcu

SEQ ID NO: 358928 - RNA, 23 nt, Homo sapiens
ugacagaccuucuggaagaaguc

SEQ ID NO: 358929 - RNA, 22 nt, Homo sapiens
ugacagcugaggcccagaguac

SEQ ID NO: 358930 - RNA, 22 nt, Homo sapiens
ugacaggagauuaugugauguu

SEQ ID NO: 358931 - RNA, 22 nt, Homo sapiens
ugacaggauggagaucgguauu

SEQ ID NO: 358932 - RNA, 22 nt, Homo sapiens
ugacaggucuaauuuacugaca

SEQ ID NO: 358933 - RNA, 22 nt, Homo sapiens
ugacagucaccaggacccacag

SEQ ID NO: 358934 - RNA, 22 nt, Homo sapiens
ugacagugugagauccugucuc

SEQ ID NO: 358935 - RNA, 22 nt, Homo sapiens
ugacaugaaggcaccucugucc

SEQ ID NO: 358936 - RNA, 22 nt, Homo sapiens
ugacaugauguuccuacacugu

SEQ ID NO: 358937 - RNA, 22 nt, Homo sapiens
ugacauggagguggaggaagau

SEQ ID NO: 358938 - RNA, 21 nt, Homo sapiens
ugacauuauuucaugucagua

SEQ ID NO: 358939 - RNA, 22 nt, Homo sapiens
ugacuacaaccuccaccucccg

SEQ ID NO: 358940 - RNA, 22 nt, Homo sapiens
ugacuagagggcuuuuguguag

SEQ ID NO: 358941 - RNA, 21 nt, Homo sapiens
ugacuagauuccagauuggcc

SEQ ID NO: 358942 - RNA, 22 nt, Homo sapiens
ugacucaguuucucagguagua

SEQ ID NO: 358943 - RNA, 22 nt, Homo sapiens
ugacugaguaguauuccacuau

SEQ ID NO: 358944 - RNA, 22 nt, Homo sapiens
ugacuggaacuuuagugagucu

SEQ ID NO: 358945 - RNA, 22 nt, Homo sapiens
ugacugugcagcuccaucaggg

SEQ ID NO: 358946 - RNA, 22 nt, Homo sapiens
ugagaacaugcacuugagguug

SEQ ID NO: 358947 - RNA, 22 nt, Homo sapiens
ugagaacuaaugaagaauuuau

SEQ ID NO: 358948 - RNA, 22 nt, Homo sapiens
ugagaacugccuguauuuaucu

SEQ ID NO: 358949 - RNA, 22 nt, Homo sapiens
ugagaagacaucagcuuucgga

SEQ ID NO: 358950 - RNA, 22 nt, Homo sapiens
ugagaagacaucuuugcuuugu

SEQ ID NO: 358951 - RNA, 22 nt, Homo sapiens
ugagaauauuugaagauguuag

SEQ ID NO: 358952 - RNA, 22 nt, Homo sapiens
ugagaaugaugauugguaaacc

SEQ ID NO: 358953 - RNA, 22 nt, Homo sapiens
ugagacacugaauccggccuga

SEQ ID NO: 358954 - RNA, 22 nt, Homo sapiens
ugagacauacuuacaggggaug

SEQ ID NO: 358955 - RNA, 22 nt, Homo sapiens
ugagacggagucucacucuguu

SEQ ID NO: 358956 - RNA, 22 nt, Homo sapiens
ugagacggagucucgcuguguc

SEQ ID NO: 358957 - RNA, 22 nt, Homo sapiens
ugagacugaguuuccaucuugu

SEQ ID NO: 358958 - RNA, 22 nt, Homo sapiens
ugagacugaguuuugccuuugu

SEQ ID NO: 358959 - RNA, 22 nt, Homo sapiens
ugagacugaguuuugcucguug

SEQ ID NO: 358960 - RNA, 22 nt, Homo sapiens
ugagauaguuguagauguacau

SEQ ID NO: 358961 - RNA, 22 nt, Homo sapiens
ugagaucaaggugggcccuggg

SEQ ID NO: 358962 - RNA, 18 nt, Homo sapiens
ugagaucagcaucaaggg

SEQ ID NO: 358963 - RNA, 20 nt, Homo sapiens
ugagaucaggauuaaggcua

SEQ ID NO: 358964 - RNA, 22 nt, Homo sapiens
uucacagcuuaauaaggcucag

SEQ ID NO: 358965 - RNA, 22 nt, Homo sapiens
uucacaguacucccuggaauua

SEQ ID NO: 358966 - RNA, 22 nt, Homo sapiens
uucacagugugaucuaugggca

SEQ ID NO: 358967 - RNA, 22 nt, Homo sapiens
uucacaguguguacaccagggg

SEQ ID NO: 358968 - RNA, 22 nt, Homo sapiens
uucacaugguugccuuuugauc

SEQ ID NO: 358969 - RNA, 22 nt, Homo sapiens
uucacuggagcccaggaguugg

SEQ ID NO: 358970 - RNA, 22 nt, Homo sapiens
uucacuguagccucagccucuu

SEQ ID NO: 358971 - RNA, 22 nt, Homo sapiens
uucacugugaacucauauucag

SEQ ID NO: 358972 - RNA, 22 nt, Homo sapiens
uucagcacugaaaauaugucau

SEQ ID NO: 358973 - RNA, 22 nt, Homo sapiens
uucagcaggccaggcccugacu

SEQ ID NO: 358974 - RNA, 22 nt, Homo sapiens
uucagcaguggccaguggaaau

SEQ ID NO: 358975 - RNA, 22 nt, Homo sapiens
uucaggcaccauggucauugau

SEQ ID NO: 358976 - RNA, 22 nt, Homo sapiens
uucaggcuccugugagaaucua

SEQ ID NO: 358977 - RNA, 22 nt, Homo sapiens
uucagggacuuuagacaagaga

SEQ ID NO: 358978 - RNA, 22 nt, Homo sapiens
uucagguaauuaugguuugucu

SEQ ID NO: 358979 - RNA, 22 nt, Homo sapiens
uucagguacuauaggcuguugg

SEQ ID NO: 358980 - RNA, 22 nt, Homo sapiens
uucaguagucuccauagaaccg

SEQ ID NO: 358981 - RNA, 22 nt, Homo sapiens
uucaguccauuuccuuggucac

SEQ ID NO: 358982 - RNA, 22 nt, Homo sapiens
uucagugagacgaaaacaacaa

SEQ ID NO: 358983 - RNA, 22 nt, Homo sapiens
uucaguucugcucugaucuuag

SEQ ID NO: 358984 - RNA, 22 nt, Homo sapiens
uucauacaguggcugcacucca

SEQ ID NO: 358985 - RNA, 22 nt, Homo sapiens
uucauagaggacauuacuggag

SEQ ID NO: 358986 - RNA, 20 nt, Homo sapiens
uucaucaggauauuggucua

SEQ ID NO: 358987 - RNA, 22 nt, Homo sapiens
uucaucuggcaauucagagauu

SEQ ID NO: 358988 - RNA, 22 nt, Homo sapiens
uucauggaacaaguggguucaa

SEQ ID NO: 358989 - RNA, 22 nt, Homo sapiens
uucauggaauauugaccauuuu

SEQ ID NO: 358990 - RNA, 22 nt, Homo sapiens
uucauggagccauccuuugauc

SEQ ID NO: 358991 - RNA, 22 nt, Homo sapiens
uucauggauggaaaugauuuug

SEQ ID NO: 358992 - RNA, 22 nt, Homo sapiens
uucauguaauauuucacagcuu

SEQ ID NO: 358993 - RNA, 22 nt, Homo sapiens
uucauguagucaucauccugcu

SEQ ID NO: 358994 - RNA, 22 nt, Homo sapiens
uucauuggacuuguguucuuga

SEQ ID NO: 358995 - RNA, 23 nt, Homo sapiens
uuccaccauugacuaguuacaua

SEQ ID NO: 358996 - RNA, 22 nt, Homo sapiens
uuccagaugggaguucuauucu

SEQ ID NO: 358997 - RNA, 20 nt, Homo sapiens
uuccagcacauuagggaagc

SEQ ID NO: 358998 - RNA, 22 nt, Homo sapiens
uuccaggugggcgugggccugg

SEQ ID NO: 358999 - RNA, 22 nt, Homo sapiens
uuccaguaauagcacagcauug

SEQ ID NO: 359000 - RNA, 22 nt, Homo sapiens
uuccaguuauuauaccucuuaa

SEQ ID NO: 359001 - RNA, 22 nt, Homo sapiens
uuccauguaguugagcaguuuu

SEQ ID NO: 359002 - RNA, 22 nt, Homo sapiens
uuccauugugucaucuuggugg

SEQ ID NO: 359003 - RNA, 22 nt, Homo sapiens
uuccauuuguucggugucgcca

SEQ ID NO: 359004 - RNA, 22 nt, Homo sapiens
uucccaguaaacucuaucccuc

SEQ ID NO: 359005 - RNA, 22 nt, Homo sapiens
uucccucagaaacacacagccc

SEQ ID NO: 359006 - RNA, 20 nt, Homo sapiens
uucccucagccuugagggua

SEQ ID NO: 359007 - RNA, 22 nt, Homo sapiens
uuccguguaguugagcaguuuu

SEQ ID NO: 359008 - RNA, 22 nt, Homo sapiens
uuccugagaucagaauucaaau

SEQ ID NO: 359009 - RNA, 22 nt, Homo sapiens
uuccuuaguuauuugguccccu

SEQ ID NO: 359010 - RNA, 22 nt, Homo sapiens
uuccuugaaacagucaagagaa

SEQ ID NO: 359011 - RNA, 22 nt, Homo sapiens
uuccuugagaaaggcacaaguu

SEQ ID NO: 359012 - RNA, 21 nt, Homo sapiens
uucuaaguaaauguuggacau

SEQ ID NO: 359013 - RNA, 21 nt, Homo sapiens
uucuacuccggcguuguuuuu

SEQ ID NO: 359014 - RNA, 21 nt, Homo sapiens
uucucagaggcaggggauaaa

SEQ ID NO: 359015 - RNA, 21 nt, Homo sapiens
uucucaggguguguccuaccc

SEQ ID NO: 359016 - RNA, 22 nt, Homo sapiens
uucucaguaauuccagauuuuu

SEQ ID NO: 359017 - RNA, 17 nt, Homo sapiens
uucucaguucugaucuc

SEQ ID NO: 359018 - RNA, 22 nt, Homo sapiens
uucucauggaacaucuguacug

SEQ ID NO: 359019 - RNA, 19 nt, Homo sapiens
uucucugguuguacuaccc

SEQ ID NO: 359020 - RNA, 22 nt, Homo sapiens
uucucuguggauugggugagag

SEQ ID NO: 359021 - RNA, 22 nt, Homo sapiens
uucugagguuauauucucucaa

SEQ ID NO: 359022 - RNA, 22 nt, Homo sapiens
uucugcacaucgaucacaagau

SEQ ID NO: 359023 - RNA, 22 nt, Homo sapiens
uucuggcucgauucucugaccg

SEQ ID NO: 359024 - RNA, 22 nt, Homo sapiens
uucugugcugaaucaaagacug

SEQ ID NO: 359025 - RNA, 22 nt, Homo sapiens
uucuucaggccacaaaaauggu

SEQ ID NO: 359026 - RNA, 22 nt, Homo sapiens
uucuugcacuuaacugacauuc

SEQ ID NO: 359027 - RNA, 22 nt, Homo sapiens
uucuugcugaauugugcccuuc

SEQ ID NO: 359028 - RNA, 18 nt, Homo sapiens
uucuuguguugauauuuu

SEQ ID NO: 359029 - RNA, 21 nt, Homo sapiens
uucuuugcucaguguuagagu

SEQ ID NO: 359030 - RNA, 19 nt, Homo sapiens
uucuuuguugugggggcug

SEQ ID NO: 359031 - RNA, 22 nt, Homo sapiens
uugaaagacagaggggcaaguu

SEQ ID NO: 359032 - RNA, 22 nt, Homo sapiens
uugaaagaugaacuggauugga

SEQ ID NO: 359033 - RNA, 22 nt, Homo sapiens
uugaaaguguucacaaugguau

SEQ ID NO: 359034 - RNA, 22 nt, Homo sapiens
uugaacugguaguuggaaaucu

SEQ ID NO: 359035 - RNA, 22 nt, Homo sapiens
uugaagguaauugguuuuauga

SEQ ID NO: 359036 - RNA, 22 nt, Homo sapiens
uugaaguaugaccgcugagaau

SEQ ID NO: 359037 - RNA, 22 nt, Homo sapiens
uugaauaguggugaaaguuuga

SEQ ID NO: 359038 - RNA, 22 nt, Homo sapiens
uugaauguacuuguucucacua

SEQ ID NO: 359039 - RNA, 22 nt, Homo sapiens
uugaaugucuauuaaguuguuu

SEQ ID NO: 359040 - RNA, 22 nt, Homo sapiens
uugacaaggagccauugcaucu

SEQ ID NO: 359041 - RNA, 22 nt, Homo sapiens
uugacaaggagugggguugaga

SEQ ID NO: 359042 - RNA, 22 nt, Homo sapiens
uugacaaguuguccaguaugag

SEQ ID NO: 359043 - RNA, 20 nt, Homo sapiens
uugacagagggaaaguugcu

SEQ ID NO: 359044 - RNA, 22 nt, Homo sapiens
uugacaguggcuuaaauugguu

SEQ ID NO: 359045 - RNA, 22 nt, Homo sapiens
uugacugggccagacagagauc

SEQ ID NO: 359046 - RNA, 22 nt, Homo sapiens
uugagaagugucuguucauguc

SEQ ID NO: 359047 - RNA, 22 nt, Homo sapiens
uugagagaaaaaauuuauuggu

SEQ ID NO: 359048 - RNA, 22 nt, Homo sapiens
uugagauauccauaaaugggaa

SEQ ID NO: 359049 - RNA, 22 nt, Homo sapiens
uugagauaucuuggccuuugca

SEQ ID NO: 359050 - RNA, 22 nt, Homo sapiens
uugagaugaagucuugcucucu

SEQ ID NO: 359051 - RNA, 22 nt, Homo sapiens
cuuugguuuacuuggugcuagu

SEQ ID NO: 359052 - RNA, 21 nt, Homo sapiens
cuuugguuucugacuugcaua

SEQ ID NO: 359053 - RNA, 23 nt, Homo sapiens
cuuuguccccacccaaaucucau

SEQ ID NO: 359054 - RNA, 20 nt, Homo sapiens
cuuuguccuccugcugugcu

SEQ ID NO: 359055 - RNA, 22 nt, Homo sapiens
cuuuguggggucuuuccucaaa

SEQ ID NO: 359056 - RNA, 22 nt, Homo sapiens
cuuuuacacuguuggugggaau

SEQ ID NO: 359057 - RNA, 22 nt, Homo sapiens
cuuuuggucuaucagagaagca

SEQ ID NO: 359058 - RNA, 22 nt, Homo sapiens
cuuuugugauucuucaguuacu

SEQ ID NO: 359059 - RNA, 21 nt, Homo sapiens
cuuuuuacucguucauaugca

SEQ ID NO: 359060 - RNA, 22 nt, Homo sapiens
cuuuuugcaaauacaacucuga

SEQ ID NO: 359061 - RNA, 22 nt, Homo sapiens
cuuuuugcuagagucuaggguc

SEQ ID NO: 359062 - RNA, 22 nt, Homo sapiens
gaaaauccauccccagggagua

SEQ ID NO: 359063 - RNA, 20 nt, Homo sapiens
gaaacaucuauccucuccuu

SEQ ID NO: 359064 - RNA, 22 nt, Homo sapiens
gaaaguguugagauuacaggca

SEQ ID NO: 359065 - RNA, 22 nt, Homo sapiens
gaaauguauuaaugaguugaaa

SEQ ID NO: 359066 - RNA, 22 nt, Homo sapiens
gaaauguuuuucaugugggcaa

SEQ ID NO: 359067 - RNA, 18 nt, Homo sapiens
gaagaaguaggcauggca

SEQ ID NO: 359068 - RNA, 22 nt, Homo sapiens
gaagacauuuacaugggagacc

SEQ ID NO: 359069 - RNA, 22 nt, Homo sapiens
gaagauucaaccaaaccagaac

SEQ ID NO: 359070 - RNA, 22 nt, Homo sapiens
gaaggagcuuaucugccauuuc

SEQ ID NO: 359071 - RNA, 22 nt, Homo sapiens
gaaggcaugcugcauggccaga

SEQ ID NO: 359072 - RNA, 22 nt, Homo sapiens
gaagguacgcuuaggaaaugau

SEQ ID NO: 359073 - RNA, 22 nt, Homo sapiens
gaaguaauaaauggauucuuaa

SEQ ID NO: 359074 - RNA, 23 nt, Homo sapiens
gaaguaauaaauggauucuuaac

SEQ ID NO: 359075 - RNA, 23 nt, Homo sapiens
gaaguauagcaugcacauggaaa

SEQ ID NO: 359076 - RNA, 17 nt, Homo sapiens
gaaguguuucagcagcu

SEQ ID NO: 359077 - RNA, 22 nt, Homo sapiens
gaauagugcugcagcaaacaua

SEQ ID NO: 359078 - RNA, 22 nt, Homo sapiens
gaaucauuggguugauucaaga

SEQ ID NO: 359079 - RNA, 22 nt, Homo sapiens
gaaucauuguuucuaaguuugu

SEQ ID NO: 359080 - RNA, 22 nt, Homo sapiens
gaaugauacuguuaacgaaaga

SEQ ID NO: 359081 - RNA, 22 nt, Homo sapiens
gaaugcuaccagcaucuagugg

SEQ ID NO: 359082 - RNA, 22 nt, Homo sapiens
gaauggaacugacuauagcuga

SEQ ID NO: 359083 - RNA, 20 nt, Homo sapiens
gaaugguuucgggguucuug

SEQ ID NO: 359084 - RNA, 22 nt, Homo sapiens
gacagugugauacuuagucuca

SEQ ID NO: 359085 - RNA, 22 nt, Homo sapiens
gacauguaaggcucucucuguu

SEQ ID NO: 359086 - RNA, 22 nt, Homo sapiens
gacauguuuacaguguugagag

SEQ ID NO: 359087 - RNA, 22 nt, Homo sapiens
gacauguuuucauguauuugga

SEQ ID NO: 359088 - RNA, 22 nt, Homo sapiens
gaccaaagaggcaggcauuaga

SEQ ID NO: 359089 - RNA, 22 nt, Homo sapiens
gacuagugcccucagaccuaga

SEQ ID NO: 359090 - RNA, 22 nt, Homo sapiens
gacucagaacuaaggguguuuc

SEQ ID NO: 359091 - RNA, 22 nt, Homo sapiens
gacucuguagacaaucacaucu

SEQ ID NO: 359092 - RNA, 22 nt, Homo sapiens
gacuggccauugauacagaggu

SEQ ID NO: 359093 - RNA, 22 nt, Homo sapiens
gagaacauacggcauuugguuu

SEQ ID NO: 359094 - RNA, 22 nt, Homo sapiens
gagaacuaaugguuugauaagg

SEQ ID NO: 359095 - RNA, 22 nt, Homo sapiens
gagaacugagauaagugauauu

SEQ ID NO: 359096 - RNA, 22 nt, Homo sapiens
gagaacuggcugauucaaggac

SEQ ID NO: 359097 - RNA, 22 nt, Homo sapiens
gagaaguaaauuuauuugcaaa

SEQ ID NO: 359098 - RNA, 22 nt, Homo sapiens
gagaaugaacagacugccucuu

SEQ ID NO: 359099 - RNA, 22 nt, Homo sapiens
gagaaugagauuaugguuacau

SEQ ID NO: 359100 - RNA, 22 nt, Homo sapiens
gagacauguuugcuuaucugag

SEQ ID NO: 359101 - RNA, 22 nt, Homo sapiens
gagacggagucucgcucuguca

SEQ ID NO: 359102 - RNA, 22 nt, Homo sapiens
gagagguaguuuuuuggucguc

SEQ ID NO: 359103 - RNA, 22 nt, Homo sapiens
gagaggucguauaugauuucug

SEQ ID NO: 359104 - RNA, 22 nt, Homo sapiens
gagauaaauaggucacaguucu

SEQ ID NO: 359105 - RNA, 22 nt, Homo sapiens
gagauacacccagugcagaggc

SEQ ID NO: 359106 - RNA, 22 nt, Homo sapiens
gagaucacuguuuauauucucu

SEQ ID NO: 359107 - RNA, 22 nt, Homo sapiens
gagaucaugcugguucucucau

SEQ ID NO: 359108 - RNA, 22 nt, Homo sapiens
gagaucauucugauccagaguc

SEQ ID NO: 359109 - RNA, 23 nt, Homo sapiens
gagaucauucuggaauuagagug

SEQ ID NO: 359110 - RNA, 22 nt, Homo sapiens
gagaucuucguguggggagaca

SEQ ID NO: 359111 - RNA, 22 nt, Homo sapiens
gagaucuuggccaaguuucuua

SEQ ID NO: 359112 - RNA, 22 nt, Homo sapiens
gagaugaaaucuugcucuguca

SEQ ID NO: 359113 - RNA, 22 nt, Homo sapiens
gagaugauuugccccauguauu

SEQ ID NO: 359114 - RNA, 22 nt, Homo sapiens
gagaugcaccuugucacguuuc

SEQ ID NO: 359115 - RNA, 22 nt, Homo sapiens
gagauggagucuuuuucuguca

SEQ ID NO: 359116 - RNA, 22 nt, Homo sapiens
gagauggaguuucacuucgcuc

SEQ ID NO: 359117 - RNA, 22 nt, Homo sapiens
gagcacccuuuguugauugcaa

SEQ ID NO: 359118 - RNA, 22 nt, Homo sapiens
gagcacugaauacugugguggu

SEQ ID NO: 359119 - RNA, 22 nt, Homo sapiens
gagcaucaauggcaugugggaa

SEQ ID NO: 359120 - RNA, 20 nt, Homo sapiens
gagcaucacaggccucugcu

SEQ ID NO: 359121 - RNA, 22 nt, Homo sapiens
gagcccauuucacuuguccagc

SEQ ID NO: 359122 - RNA, 22 nt, Homo sapiens
gagcugaauugcugccauuugc

SEQ ID NO: 359123 - RNA, 22 nt, Homo sapiens
gagcugguccuuuaaggaugca

SEQ ID NO: 359124 - RNA, 22 nt, Homo sapiens
gaggacauuaugcuaaguggaa

SEQ ID NO: 359125 - RNA, 22 nt, Homo sapiens
gaggaucucuugagcccagaag

SEQ ID NO: 359126 - RNA, 22 nt, Homo sapiens
gaggcagucugucccuuagcag

SEQ ID NO: 359127 - RNA, 22 nt, Homo sapiens
gaggcaguguguccguucucgg

SEQ ID NO: 359128 - RNA, 22 nt, Homo sapiens
gagggcacugcuuuccuuucaa

SEQ ID NO: 359129 - RNA, 22 nt, Homo sapiens
gaggguguuguguugcuuaaua

SEQ ID NO: 359130 - RNA, 22 nt, Homo sapiens
gagguagguacaauugccacca

SEQ ID NO: 359131 - RNA, 22 nt, Homo sapiens
gagguagguuugguuacaaaag

SEQ ID NO: 359132 - RNA, 22 nt, Homo sapiens
gagguauaauugacaagcaaaa

SEQ ID NO: 359133 - RNA, 22 nt, Homo sapiens
cucauuggcuacugaggcuugu

SEQ ID NO: 359134 - RNA, 22 nt, Homo sapiens
cuccaggugucauccaccuccu

SEQ ID NO: 359135 - RNA, 22 nt, Homo sapiens
cuccagugcaaagucaugauca

SEQ ID NO: 359136 - RNA, 22 nt, Homo sapiens
cuccaguuucagaaucccaugu

SEQ ID NO: 359137 - RNA, 22 nt, Homo sapiens
cuccauuuggaacagauguccu

SEQ ID NO: 359138 - RNA, 22 nt, Homo sapiens
cucccagagccaguuauaggcu

SEQ ID NO: 359139 - RNA, 20 nt, Homo sapiens
cucugguugugaauugucuu

SEQ ID NO: 359140 - RNA, 22 nt, Homo sapiens
cucugguuuuucuuccauuaag

SEQ ID NO: 359141 - RNA, 22 nt, Homo sapiens
cucuuggguagauuuugcagag

SEQ ID NO: 359142 - RNA, 22 nt, Homo sapiens
cucuuugaguuccuccuggugu

SEQ ID NO: 359143 - RNA, 22 nt, Homo sapiens
cugaaagagcauguaacacagu

SEQ ID NO: 359144 - RNA, 22 nt, Homo sapiens
cugaaauggaaugugugcacag

SEQ ID NO: 359145 - RNA, 22 nt, Homo sapiens
cugacaagugaucacagcagca

SEQ ID NO: 359146 - RNA, 22 nt, Homo sapiens
cugaccauagacuacucugggc

SEQ ID NO: 359147 - RNA, 17 nt, Homo sapiens
cugaccucauuguguac

SEQ ID NO: 359148 - RNA, 22 nt, Homo sapiens
cugagaacaucauucagauauu

SEQ ID NO: 359149 - RNA, 22 nt, Homo sapiens
cugagagugguauguuuaagug

SEQ ID NO: 359150 - RNA, 22 nt, Homo sapiens
cugagauaggacucugcuggcu

SEQ ID NO: 359151 - RNA, 22 nt, Homo sapiens
cugagaucaagucuugcucugu

SEQ ID NO: 359152 - RNA, 22 nt, Homo sapiens
cugagcaucauggcagaaucuu

SEQ ID NO: 359153 - RNA, 22 nt, Homo sapiens
cugaggacaucagggaagcauc

SEQ ID NO: 359154 - RNA, 22 nt, Homo sapiens
cugaggcacggcgaccuuaagu

SEQ ID NO: 359155 - RNA, 22 nt, Homo sapiens
cugaggguagaaggaucacuug

SEQ ID NO: 359156 - RNA, 22 nt, Homo sapiens
cugagguaauuuguugccagua

SEQ ID NO: 359157 - RNA, 22 nt, Homo sapiens
cugagguaauuuuccagauaau

SEQ ID NO: 359158 - RNA, 22 nt, Homo sapiens
cugagguauaucccauuagaag

SEQ ID NO: 359159 - RNA, 22 nt, Homo sapiens
cugaggucugaauccagguauc

SEQ ID NO: 359160 - RNA, 22 nt, Homo sapiens
cugaguauuugaggccgaagga

SEQ ID NO: 359161 - RNA, 22 nt, Homo sapiens
cugagugcaagugauccuccca

SEQ ID NO: 359162 - RNA, 22 nt, Homo sapiens
cugauaaguuuuucuuuauaag

SEQ ID NO: 359163 - RNA, 22 nt, Homo sapiens
cugauauuuuaaaauuggcugg

SEQ ID NO: 359164 - RNA, 22 nt, Homo sapiens
cugaucuguagcagccaccaca

SEQ ID NO: 359165 - RNA, 22 nt, Homo sapiens
cugaugaaguauuuguucugga

SEQ ID NO: 359166 - RNA, 22 nt, Homo sapiens
cugauuuguccccagccucaug

SEQ ID NO: 359167 - RNA, 22 nt, Homo sapiens
cugcaauguuugaaauggcaaa

SEQ ID NO: 359168 - RNA, 22 nt, Homo sapiens
cugcagguaggggcagcuuugg

SEQ ID NO: 359169 - RNA, 21 nt, Homo sapiens
cugcauccauuucugagugau

SEQ ID NO: 359170 - RNA, 19 nt, Homo sapiens
cugcaugagacaguugguu

SEQ ID NO: 359171 - RNA, 18 nt, Homo sapiens
cugccagugugcucuccg

SEQ ID NO: 359172 - RNA, 22 nt, Homo sapiens
cugccaguuugauucgggccac

SEQ ID NO: 359173 - RNA, 22 nt, Homo sapiens
cugccuagaucugaaccuggcu

SEQ ID NO: 359174 - RNA, 22 nt, Homo sapiens
cuggaaaguagacaaucuaaaa

SEQ ID NO: 359175 - RNA, 22 nt, Homo sapiens
cuggaaucuagaaaagguaagg

SEQ ID NO: 359176 - RNA, 22 nt, Homo sapiens
cuggagaucuugacauugaagu

SEQ ID NO: 359177 - RNA, 22 nt, Homo sapiens
cuggagcaaaggugacucuugu

SEQ ID NO: 359178 - RNA, 22 nt, Homo sapiens
cuggagcauugguggauuuguu

SEQ ID NO: 359179 - RNA, 22 nt, Homo sapiens
cuggaggccugaacauaaaugg

SEQ ID NO: 359180 - RNA, 22 nt, Homo sapiens
cuggauagucaggagauauaua

SEQ ID NO: 359181 - RNA, 20 nt, Homo sapiens
cuggaugucgaggcagaggu

SEQ ID NO: 359182 - RNA, 22 nt, Homo sapiens
cuggcccaguucugcguuuugc

SEQ ID NO: 359183 - RNA, 22 nt, Homo sapiens
cuggcucauuucauuuagcaua

SEQ ID NO: 359184 - RNA, 21 nt, Homo sapiens
cugguccccuuuauguaugug

SEQ ID NO: 359185 - RNA, 22 nt, Homo sapiens
cuggugagaugucuuuccucuu

SEQ ID NO: 359186 - RNA, 22 nt, Homo sapiens
cuguaugugagaaauaauaagu

SEQ ID NO: 359187 - RNA, 22 nt, Homo sapiens
cuguccugcagagucagaauga

SEQ ID NO: 359188 - RNA, 22 nt, Homo sapiens
cugucucagccucuccaguagc

SEQ ID NO: 359189 - RNA, 22 nt, Homo sapiens
cugugaagaaagucauugguag

SEQ ID NO: 359190 - RNA, 22 nt, Homo sapiens
cugugcuugauuauaugagugu

SEQ ID NO: 359191 - RNA, 22 nt, Homo sapiens
cugugguugagcuuugccauga

SEQ ID NO: 359192 - RNA, 22 nt, Homo sapiens
cuguugcaguuauggcugcagg

SEQ ID NO: 359193 - RNA, 22 nt, Homo sapiens
cuguugguguuuaaucacugca

SEQ ID NO: 359194 - RNA, 22 nt, Homo sapiens
cuguuugguaaggaugccucag

SEQ ID NO: 359195 - RNA, 22 nt, Homo sapiens
cuguuugguuaucuuuuccugu

SEQ ID NO: 359196 - RNA, 22 nt, Homo sapiens
cuuagcaaugucguguacucac

SEQ ID NO: 359197 - RNA, 22 nt, Homo sapiens
cuucaagucuuuggauaauuag

SEQ ID NO: 359198 - RNA, 22 nt, Homo sapiens
cuucaaguguggccaccugacc

SEQ ID NO: 359199 - RNA, 22 nt, Homo sapiens
aaagaguucagguagauuucaa

SEQ ID NO: 359200 - RNA, 22 nt, Homo sapiens
aaagcaucacuuuuccuacuuu

SEQ ID NO: 359201 - RNA, 22 nt, Homo sapiens
aaagcuacaggaccugcucauu

SEQ ID NO: 359202 - RNA, 22 nt, Homo sapiens
aaaggcacuagaaguuaccuuu

SEQ ID NO: 359203 - RNA, 22 nt, Homo sapiens
aaagggcacugugcuuuggcaa

SEQ ID NO: 359204 - RNA, 22 nt, Homo sapiens
aaagguaguacuucuagaaggg

SEQ ID NO: 359205 - RNA, 22 nt, Homo sapiens
aaaguaauugcaguuuuugcaa

SEQ ID NO: 359206 - RNA, 22 nt, Homo sapiens
aaaguacucaguucaguuccgu

SEQ ID NO: 359207 - RNA, 17 nt, Homo sapiens
aaaguccuuugcuaucu

SEQ ID NO: 359208 - RNA, 22 nt, Homo sapiens
aaagucuguuuugucagagacu

SEQ ID NO: 359209 - RNA, 22 nt, Homo sapiens
aaagugaauguaucccguaagu

SEQ ID NO: 359210 - RNA, 22 nt, Homo sapiens
aaagugauuguaguuuuugcca

SEQ ID NO: 359211 - RNA, 22 nt, Homo sapiens
aaagugcugagaguucuaacuu

SEQ ID NO: 359212 - RNA, 22 nt, Homo sapiens
aaaguggugggauuccaggcau

SEQ ID NO: 359213 - RNA, 22 nt, Homo sapiens
aaaguggugugaguauguaucu

SEQ ID NO: 359214 - RNA, 22 nt, Homo sapiens
aaaguguguuuccaaccugugg

SEQ ID NO: 359215 - RNA, 19 nt, Homo sapiens
aaaguguuuuaaagaggau

SEQ ID NO: 359216 - RNA, 22 nt, Homo sapiens
aaaucccuugcucucucagacc

SEQ ID NO: 359217 - RNA, 22 nt, Homo sapiens
aaaugcacaaagauuuugcacu

SEQ ID NO: 359218 - RNA, 22 nt, Homo sapiens
aaaugcaccacucuggugcagg

SEQ ID NO: 359219 - RNA, 22 nt, Homo sapiens
aaaugcacgcuacccagcuaga

SEQ ID NO: 359220 - RNA, 22 nt, Homo sapiens
aaaugcagauucugcuuagguu

SEQ ID NO: 359221 - RNA, 22 nt, Homo sapiens
aaaugcagcacucaagugggaa

SEQ ID NO: 359222 - RNA, 22 nt, Homo sapiens
aaaugcagucuuuguucugggc

SEQ ID NO: 359223 - RNA, 22 nt, Homo sapiens
aaaugcauaucaagauugcccu

SEQ ID NO: 359224 - RNA, 22 nt, Homo sapiens
aaaugcaugaggugggaagaaa

SEQ ID NO: 359225 - RNA, 22 nt, Homo sapiens
aaaugcauggacagcuggucuu

SEQ ID NO: 359226 - RNA, 22 nt, Homo sapiens
aaaugcccuaaaauggagcauc

SEQ ID NO: 359227 - RNA, 18 nt, Homo sapiens
aaaugcucuucuggaaua

SEQ ID NO: 359228 - RNA, 22 nt, Homo sapiens
aaaugcugucaaauuguguucu

SEQ ID NO: 359229 - RNA, 22 nt, Homo sapiens
aaauggcacaguaagggcauuu

SEQ ID NO: 359230 - RNA, 22 nt, Homo sapiens
aaaugggacugggguccuuuga

SEQ ID NO: 359231 - RNA, 22 nt, Homo sapiens
aaaugguguuaguagaucuuua

SEQ ID NO: 359232 - RNA, 19 nt, Homo sapiens
aaaugugcacuguuuucca

SEQ ID NO: 359233 - RNA, 22 nt, Homo sapiens
aacagacugucacauaaaauug

SEQ ID NO: 359234 - RNA, 22 nt, Homo sapiens
aacagcacacccgcugcuucca

SEQ ID NO: 359235 - RNA, 22 nt, Homo sapiens
aacagucaauugcugaugaccu

SEQ ID NO: 359236 - RNA, 22 nt, Homo sapiens
aacccugagucaugagucuaga

SEQ ID NO: 359237 - RNA, 22 nt, Homo sapiens
aaccuacauucuuaacuguugc

SEQ ID NO: 359238 - RNA, 22 nt, Homo sapiens
aacuggcauauucugguugcgg

SEQ ID NO: 359239 - RNA, 22 nt, Homo sapiens
aacuugcacuugauugagagcu

SEQ ID NO: 359240 - RNA, 22 nt, Homo sapiens
aagagcauuggauggggagauu

SEQ ID NO: 359241 - RNA, 22 nt, Homo sapiens
aagaggcuguaggauaaugccu

SEQ ID NO: 359242 - RNA, 22 nt, Homo sapiens
aagagguaggaaauggucauuu

SEQ ID NO: 359243 - RNA, 22 nt, Homo sapiens
aagagguuauagaguguauacu

SEQ ID NO: 359244 - RNA, 22 nt, Homo sapiens
aagaugauguuguguuuucacu

SEQ ID NO: 359245 - RNA, 22 nt, Homo sapiens
uaucaagaugacaaacuuugcu

SEQ ID NO: 359246 - RNA, 22 nt, Homo sapiens
uaucaagauggauaaggauaga

SEQ ID NO: 359247 - RNA, 22 nt, Homo sapiens
uaucaaguguuagggagaugug

SEQ ID NO: 359248 - RNA, 22 nt, Homo sapiens
uaucacaaacuuagcaguuuaa

SEQ ID NO: 359249 - RNA, 21 nt, Homo sapiens
aggucaugaagauguucuaau

SEQ ID NO: 359250 - RNA, 22 nt, Homo sapiens
agguccacuuacuacuccuguu

SEQ ID NO: 359251 - RNA, 22 nt, Homo sapiens
aggugcucuuccuguaggucac

SEQ ID NO: 359252 - RNA, 21 nt, Homo sapiens
aggugucuuggguucccuggc

SEQ ID NO: 359253 - RNA, 20 nt, Homo sapiens
agguuauuauaauuagaaga

SEQ ID NO: 359254 - RNA, 22 nt, Homo sapiens
agguuguugcaugcuccuuagg

SEQ ID NO: 359255 - RNA, 22 nt, Homo sapiens
aguaaauuucugugcuuucaua

SEQ ID NO: 359256 - RNA, 22 nt, Homo sapiens
aguaacaggauccaaagaaugu

SEQ ID NO: 359257 - RNA, 22 nt, Homo sapiens
aguaucaucuuguuggccaggc

SEQ ID NO: 359258 - RNA, 22 nt, Homo sapiens
agucaagugggguuagauaguu

SEQ ID NO: 359259 - RNA, 22 nt, Homo sapiens
agucacggugguuugcacuugu

SEQ ID NO: 359260 - RNA, 22 nt, Homo sapiens
agucagugcauaagaaugaagu

SEQ ID NO: 359261 - RNA, 22 nt, Homo sapiens
agucagugucuguaaggagaac

SEQ ID NO: 359262 - RNA, 22 nt, Homo sapiens
agucauggcagaaggcaccucu

SEQ ID NO: 359263 - RNA, 22 nt, Homo sapiens
aguccagguuuuguaauggcaa

SEQ ID NO: 359264 - RNA, 22 nt, Homo sapiens
agucugguguucucacacuagu

SEQ ID NO: 359265 - RNA, 22 nt, Homo sapiens
agugaaaugucaccuuuuagga

SEQ ID NO: 359266 - RNA, 22 nt, Homo sapiens
agugaucauuugaauugaugau

SEQ ID NO: 359267 - RNA, 22 nt, Homo sapiens
agugauggagccaggauuuaau

SEQ ID NO: 359268 - RNA, 22 nt, Homo sapiens
agugauguggaguuuggaugga

SEQ ID NO: 359269 - RNA, 22 nt, Homo sapiens
agugcacuccagccugggcaac

SEQ ID NO: 359270 - RNA, 22 nt, Homo sapiens
aguggauguuguggccugggag

SEQ ID NO: 359271 - RNA, 19 nt, Homo sapiens
aguggguguuuucuguuug

SEQ ID NO: 359272 - RNA, 22 nt, Homo sapiens
aguguuuuuacaagcacucugg

SEQ ID NO: 359273 - RNA, 22 nt, Homo sapiens
aguuaguguugugauaaaucca

SEQ ID NO: 359274 - RNA, 22 nt, Homo sapiens
aguuccauuuauucucgucucu

SEQ ID NO: 359275 - RNA, 19 nt, Homo sapiens
auaaacuagaacugucccc

SEQ ID NO: 359276 - RNA, 22 nt, Homo sapiens
auaaagccaggagacguaauug

SEQ ID NO: 359277 - RNA, 22 nt, Homo sapiens
auaaagguaagcacuauccuga

SEQ ID NO: 359278 - RNA, 22 nt, Homo sapiens
auaaaugcaaugguauuuuuga

SEQ ID NO: 359279 - RNA, 20 nt, Homo sapiens
auaaauguauagguguacau

SEQ ID NO: 359280 - RNA, 22 nt, Homo sapiens
auaacucuguuuuuuucaugca

SEQ ID NO: 359281 - RNA, 22 nt, Homo sapiens
auaagaagugaaccagacgucu

SEQ ID NO: 359282 - RNA, 22 nt, Homo sapiens
auaagcuaagaguuucugggcu

SEQ ID NO: 359283 - RNA, 22 nt, Homo sapiens
auaauaccugccacauuugaau

SEQ ID NO: 359284 - RNA, 22 nt, Homo sapiens
auaauagguaguaauggauuga

SEQ ID NO: 359285 - RNA, 22 nt, Homo sapiens
auaauaucagguugugaugaug

SEQ ID NO: 359286 - RNA, 22 nt, Homo sapiens
auacaagugccauguuggugug

SEQ ID NO: 359287 - RNA, 22 nt, Homo sapiens
auacaguaucuucuggcaagca

SEQ ID NO: 359288 - RNA, 22 nt, Homo sapiens
auacaugugccaugcuggugug

SEQ ID NO: 359289 - RNA, 22 nt, Homo sapiens
auacaugugccauguugguaug

SEQ ID NO: 359290 - RNA, 22 nt, Homo sapiens
auacauguucaagggcauauau

SEQ ID NO: 359291 - RNA, 20 nt, Homo sapiens
auacccaguagcacaacagc

SEQ ID NO: 359292 - RNA, 22 nt, Homo sapiens
auacguacauaugcacauaugg

SEQ ID NO: 359293 - RNA, 22 nt, Homo sapiens
auacuccugucucagcugagau

SEQ ID NO: 359294 - RNA, 22 nt, Homo sapiens
auagaauguauuaguaaauuug

SEQ ID NO: 359295 - RNA, 22 nt, Homo sapiens
auagagugcuucaucaguagua

SEQ ID NO: 359296 - RNA, 22 nt, Homo sapiens
auagcagacauuucaaggcagg

SEQ ID NO: 359297 - RNA, 22 nt, Homo sapiens
auagcagcagcuaguagugaua

SEQ ID NO: 359298 - RNA, 20 nt, Homo sapiens
auagcagcaugauuuauagu

SEQ ID NO: 359299 - RNA, 22 nt, Homo sapiens
auagcagugucccacuccuugg

SEQ ID NO: 359300 - RNA, 22 nt, Homo sapiens
auagcagugugaaaauguacua

SEQ ID NO: 359301 - RNA, 22 nt, Homo sapiens
auagcagugugaggacagacua

SEQ ID NO: 359302 - RNA, 22 nt, Homo sapiens
auagccaguagagagcuguuag

SEQ ID NO: 359303 - RNA, 22 nt, Homo sapiens
auaggagugugcacagaguagg

SEQ ID NO: 359304 - RNA, 22 nt, Homo sapiens
auagguauguaauacaaaugaa

SEQ ID NO: 359305 - RNA, 22 nt, Homo sapiens
auagucaaaucucauuaccccc

SEQ ID NO: 359306 - RNA, 22 nt, Homo sapiens
auagugcugcaacaaauauacg

SEQ ID NO: 359307 - RNA, 22 nt, Homo sapiens
auagugcugcaauaaacauacg

SEQ ID NO: 359308 - RNA, 22 nt, Homo sapiens
auagugcugcacuaaacauaca

SEQ ID NO: 359309 - RNA, 22 nt, Homo sapiens
auagugcugcagucaauguacg

SEQ ID NO: 359310 - RNA, 22 nt, Homo sapiens
auagugcugcauuaaacauacg

SEQ ID NO: 359311 - RNA, 22 nt, Homo sapiens
auaucacaggaaaggaagauac

SEQ ID NO: 359312 - RNA, 22 nt, Homo sapiens
auauccuggagcauuuuugcaa

SEQ ID NO: 359313 - RNA, 22 nt, Homo sapiens
auaucugcauugccauuuaugu

SEQ ID NO: 359314 - RNA, 22 nt, Homo sapiens
auaugcacaguggaguacuauu

SEQ ID NO: 359315 - RNA, 22 nt, Homo sapiens
auaugcacgugcauacacacuu

SEQ ID NO: 359316 - RNA, 20 nt, Homo sapiens
auaugcauguguuuucacuu

SEQ ID NO: 359317 - RNA, 20 nt, Homo sapiens
auaugguugugagugauuuu

SEQ ID NO: 359318 - RNA, 22 nt, Homo sapiens
auaugucuuaguuaccuugggc

SEQ ID NO: 359319 - RNA, 22 nt, Homo sapiens
auauucaagugaggauggcuaa

SEQ ID NO: 359320 - RNA, 22 nt, Homo sapiens
auauugguuaaauauuauguga

SEQ ID NO: 359321 - RNA, 22 nt, Homo sapiens
auauuguacugcuacugguucu

SEQ ID NO: 359322 - RNA, 22 nt, Homo sapiens
aucaaacugcaaggcagcagca

SEQ ID NO: 359323 - RNA, 19 nt, Homo sapiens
aucaaacugcucuuugagg

SEQ ID NO: 359324 - RNA, 22 nt, Homo sapiens
aucaaagccaugcucaguuuuc

SEQ ID NO: 359325 - RNA, 22 nt, Homo sapiens
aucaaaugcuggcagagugccu

SEQ ID NO: 359326 - RNA, 22 nt, Homo sapiens
aucaagcugcuuguuugaaucu

SEQ ID NO: 359327 - RNA, 22 nt, Homo sapiens
aucaagcuggcauauguaguuc

SEQ ID NO: 359328 - RNA, 22 nt, Homo sapiens
aucacagaacuuugagcagaga

SEQ ID NO: 359329 - RNA, 22 nt, Homo sapiens
aucacagcuacuccucugucuu

SEQ ID NO: 359330 - RNA, 22 nt, Homo sapiens
aucacaguggcucacaagagcc

SEQ ID NO: 359331 - RNA, 19 nt, Homo sapiens
aucaccauuauuuggaaca

SEQ ID NO: 359332 - RNA, 22 nt, Homo sapiens
aucacuguaaguuuacacuuug

SEQ ID NO: 359333 - RNA, 22 nt, Homo sapiens
uaucacagcaaggacccauuau

SEQ ID NO: 359334 - RNA, 20 nt, Homo sapiens
uaucacaggucagaaacccu

SEQ ID NO: 359335 - RNA, 21 nt, Homo sapiens
uaucacaguagaauaggaucu

SEQ ID NO: 359336 - RNA, 22 nt, Homo sapiens
uaucacaguugcauauuuaagg

SEQ ID NO: 359337 - RNA, 22 nt, Homo sapiens
uaucagcagagucauacuucaa

SEQ ID NO: 359338 - RNA, 22 nt, Homo sapiens
uaucagugaaucuuauuuugcc

SEQ ID NO: 359339 - RNA, 22 nt, Homo sapiens
uaucauaguuuggacuuucauu

SEQ ID NO: 359340 - RNA, 22 nt, Homo sapiens
uaucaucauguuuuugcugugu

SEQ ID NO: 359341 - RNA, 22 nt, Homo sapiens
uaucaugucuguguguaccuag

SEQ ID NO: 359342 - RNA, 22 nt, Homo sapiens
uaucauuguguuauuucuucca

SEQ ID NO: 359343 - RNA, 21 nt, Homo sapiens
uauccacuugcaacagagaag

SEQ ID NO: 359344 - RNA, 22 nt, Homo sapiens
uaucccaguggauguaccccau

SEQ ID NO: 359345 - RNA, 20 nt, Homo sapiens
uaucuacuugcaaaugccau

SEQ ID NO: 359346 - RNA, 21 nt, Homo sapiens
uaucucaguuuuccuuugugg

SEQ ID NO: 359347 - RNA, 20 nt, Homo sapiens
uaugacaaagccuagugagu

SEQ ID NO: 359348 - RNA, 20 nt, Homo sapiens
uaugagacugggagaaguuc

SEQ ID NO: 359349 - RNA, 22 nt, Homo sapiens
uaugagacugguuaauuuuugu

SEQ ID NO: 359350 - RNA, 22 nt, Homo sapiens
uaugagcacauauguaucuaug

SEQ ID NO: 359351 - RNA, 23 nt, Homo sapiens
uaugccuguuucaaacaaacuuu

SEQ ID NO: 359352 - RNA, 19 nt, Homo sapiens
uaugcuagagagggaagcu

SEQ ID NO: 359353 - RNA, 19 nt, Homo sapiens
uaugcuauuuauuagaagu

SEQ ID NO: 359354 - RNA, 22 nt, Homo sapiens
uaugcuguuucugauuuaggga

SEQ ID NO: 359355 - RNA, 22 nt, Homo sapiens
uaugcuuauuaaaacagugugu

SEQ ID NO: 359356 - RNA, 22 nt, Homo sapiens
uauggauguuaagguucacagc

SEQ ID NO: 359357 - RNA, 22 nt, Homo sapiens
uauggauuuucagauucuuauc

SEQ ID NO: 359358 - RNA, 22 nt, Homo sapiens
uauggcauuauuuugauagaca

SEQ ID NO: 359359 - RNA, 21 nt, Homo sapiens
uauggcuuagucaguguuucc

SEQ ID NO: 359360 - RNA, 22 nt, Homo sapiens
uauggcuucuuuaaauugaggu

SEQ ID NO: 359361 - RNA, 22 nt, Homo sapiens
uaugggcuuuguuuuguacuag

SEQ ID NO: 359362 - RNA, 22 nt, Homo sapiens
uaugggucuuaaaucacuuagu

SEQ ID NO: 359363 - RNA, 22 nt, Homo sapiens
uauggguuucagagggugauag

SEQ ID NO: 359364 - RNA, 22 nt, Homo sapiens
uaugucuggaguuacugagcug

SEQ ID NO: 359365 - RNA, 22 nt, Homo sapiens
uaugugcacaugcccuggugac

SEQ ID NO: 359366 - RNA, 22 nt, Homo sapiens
uauguuaucaaaaagcuaagga

SEQ ID NO: 359367 - RNA, 22 nt, Homo sapiens
uauuacuguuauuccuaucaaa

SEQ ID NO: 359368 - RNA, 22 nt, Homo sapiens
uauuagguuggggcaaaaguaa

SEQ ID NO: 359369 - RNA, 22 nt, Homo sapiens
uauuagugccuaagucuuaggg

SEQ ID NO: 359370 - RNA, 22 nt, Homo sapiens
uauuaguuguaugauucccaag

SEQ ID NO: 359371 - RNA, 20 nt, Homo sapiens
uauucacucuccagucuugc

SEQ ID NO: 359372 - RNA, 22 nt, Homo sapiens
uauuccacacuguuggugggau

SEQ ID NO: 359373 - RNA, 22 nt, Homo sapiens
uauuccacuggcacugcauuug

SEQ ID NO: 359374 - RNA, 22 nt, Homo sapiens
uauuccauuugugaaaggaagu

SEQ ID NO: 359375 - RNA, 22 nt, Homo sapiens
uauuccucuuuguugagguuau

SEQ ID NO: 359376 - RNA, 22 nt, Homo sapiens
uauugacauuacagugggucuu

SEQ ID NO: 359377 - RNA, 22 nt, Homo sapiens
uauugcagaaugugaguuggca

SEQ ID NO: 359378 - RNA, 22 nt, Homo sapiens
uauugccugucuccaaaaauca

SEQ ID NO: 359379 - RNA, 22 nt, Homo sapiens
uauugcugaaaaugcuaaugau

SEQ ID NO: 359380 - RNA, 22 nt, Homo sapiens
uauugcuggauguauuacaugu

SEQ ID NO: 359381 - RNA, 22 nt, Homo sapiens
uauuucccuuaacuuuccugca

SEQ ID NO: 359382 - RNA, 22 nt, Homo sapiens
uauuugguuauaugaguaaguu

SEQ ID NO: 359383 - RNA, 20 nt, Homo sapiens
uauuugguuauuuccauggu

SEQ ID NO: 359384 - RNA, 22 nt, Homo sapiens
ucaaacauccccaccagggacu

SEQ ID NO: 359385 - RNA, 22 nt, Homo sapiens
ucaaagucuucucaaguaacau

SEQ ID NO: 359386 - RNA, 22 nt, Homo sapiens
ucaaagugagcuccuucucacu

SEQ ID NO: 359387 - RNA, 18 nt, Homo sapiens
ucaaauacuuugggcagu

SEQ ID NO: 359388 - RNA, 22 nt, Homo sapiens
ucaaaugcacguagagaaaaua

SEQ ID NO: 359389 - RNA, 22 nt, Homo sapiens
ucaaaugcuguauuguaguaau

SEQ ID NO: 359390 - RNA, 22 nt, Homo sapiens
ucaaaugguccacgugaacauu

SEQ ID NO: 359391 - RNA, 22 nt, Homo sapiens
ucaacagugggcacuguaaaug

SEQ ID NO: 359392 - RNA, 22 nt, Homo sapiens
ucaacugcuugagaucacaaau

SEQ ID NO: 359393 - RNA, 18 nt, Homo sapiens
ucaagcaauugucaugcc

SEQ ID NO: 359394 - RNA, 22 nt, Homo sapiens
ucaaggcaguggccuuccuucu

SEQ ID NO: 359395 - RNA, 22 nt, Homo sapiens
ucaaguacuuauuugauaauua

SEQ ID NO: 359396 - RNA, 22 nt, Homo sapiens
ucaaugcaaccuccaccucugg

SEQ ID NO: 359397 - RNA, 22 nt, Homo sapiens
ucaaugcaugugacaaagagua

SEQ ID NO: 359398 - RNA, 18 nt, Homo sapiens
ucaauguggauguucuuu

SEQ ID NO: 359399 - RNA, 22 nt, Homo sapiens
ucacacucucaccaacauuugg

SEQ ID NO: 359400 - RNA, 22 nt, Homo sapiens
ucacaguagcaaauguuagaaa

SEQ ID NO: 359401 - RNA, 22 nt, Homo sapiens
ucacaguaucaugggggacaga

SEQ ID NO: 359402 - RNA, 22 nt, Homo sapiens
ucacagucacugucacguugaa

SEQ ID NO: 359403 - RNA, 17 nt, Homo sapiens
ucacaguguuaggauga

SEQ ID NO: 359404 - RNA, 22 nt, Homo sapiens
ucacaugaauugucuuguucca

SEQ ID NO: 359405 - RNA, 22 nt, Homo sapiens
ucacaugcacaucucuggaacc

SEQ ID NO: 359406 - RNA, 22 nt, Homo sapiens
ucacaugggugcaauauaauca

SEQ ID NO: 359407 - RNA, 22 nt, Homo sapiens
ucacauguguaaauugguguaa

SEQ ID NO: 359408 - RNA, 22 nt, Homo sapiens
ucacauguguaugagcuuugau

SEQ ID NO: 359409 - RNA, 22 nt, Homo sapiens
ucacccuguguuuugcguuugc

SEQ ID NO: 359410 - RNA, 22 nt, Homo sapiens
ucaccuggggcacagcugaaga

SEQ ID NO: 359411 - RNA, 22 nt, Homo sapiens
ucaccuugcacaguuguguggg

SEQ ID NO: 359412 - RNA, 23 nt, Homo sapiens
ucacggagaccugcaagaccaau

SEQ ID NO: 359413 - RNA, 20 nt, Homo sapiens
ucacugagugguccacagua

SEQ ID NO: 359414 - RNA, 22 nt, Homo sapiens
ucacugcacuccagccuuuaug

SEQ ID NO: 359415 - RNA, 22 nt, Homo sapiens
ucacugcacucuccgccuugcg

SEQ ID NO: 359416 - RNA, 19 nt, Homo sapiens
ucacuggacagcacacuca

SEQ ID NO: 359417 - RNA, 22 nt, Homo sapiens
ucacuggaggagaggaagugga

SEQ ID NO: 359418 - RNA, 22 nt, Homo sapiens
ucacuggagguuccugaaguuc

SEQ ID NO: 359419 - RNA, 22 nt, Homo sapiens
ucacugugcaugaaggaugcug

SEQ ID NO: 359420 - RNA, 22 nt, Homo sapiens
aagcugguuuuauaucugugag

SEQ ID NO: 359421 - RNA, 22 nt, Homo sapiens
aagcuguugguggauguaccau

SEQ ID NO: 359422 - RNA, 22 nt, Homo sapiens
aagcuguuguucauccugaauu

SEQ ID NO: 359423 - RNA, 22 nt, Homo sapiens
aaggaguagaauagaugcaccu

SEQ ID NO: 359424 - RNA, 22 nt, Homo sapiens
aaggaguaucuguuuucucacc

SEQ ID NO: 359425 - RNA, 22 nt, Homo sapiens
aaggcaagauacugguugcuga

SEQ ID NO: 359426 - RNA, 22 nt, Homo sapiens
aaggcagucacuaaauagugag

SEQ ID NO: 359427 - RNA, 22 nt, Homo sapiens
aaggcuguuguguaauaggauu

SEQ ID NO: 359428 - RNA, 22 nt, Homo sapiens
aaguaaacauugagagacaaga

SEQ ID NO: 359429 - RNA, 22 nt, Homo sapiens
aaguaguuaggaacauucucuc

SEQ ID NO: 359430 - RNA, 22 nt, Homo sapiens
aaguauuaagacuaagaggcuu

SEQ ID NO: 359431 - RNA, 22 nt, Homo sapiens
aagucaaggagagaggcgucag

SEQ ID NO: 359432 - RNA, 22 nt, Homo sapiens
aagucaguuugggagaagcuau

SEQ ID NO: 359433 - RNA, 22 nt, Homo sapiens
aagucaugaagaggaaaggaca

SEQ ID NO: 359434 - RNA, 22 nt, Homo sapiens
aagucauggaggaguaugugag

SEQ ID NO: 359435 - RNA, 22 nt, Homo sapiens
aaguccaugaagucuugugggu

SEQ ID NO: 359436 - RNA, 20 nt, Homo sapiens
aagugaguguuaaacugaac

SEQ ID NO: 359437 - RNA, 22 nt, Homo sapiens
aagugcaaaucuguggcugaaa

SEQ ID NO: 359438 - RNA, 21 nt, Homo sapiens
aagugcucugggacucuaaau

SEQ ID NO: 359439 - RNA, 22 nt, Homo sapiens
aagugcuuuacacaugcaugau

SEQ ID NO: 359440 - RNA, 22 nt, Homo sapiens
aaguggcauugaggaaaaaaau

SEQ ID NO: 359441 - RNA, 22 nt, Homo sapiens
aagugguucuaugaguuugcaa

SEQ ID NO: 359442 - RNA, 23 nt, Homo sapiens
aaguucaugcucaucuguuacac

SEQ ID NO: 359443 - RNA, 21 nt, Homo sapiens
aauaaagcaaccuuaugccau

SEQ ID NO: 359444 - RNA, 22 nt, Homo sapiens
aauaaagcauggcuacuccaua

SEQ ID NO: 359445 - RNA, 22 nt, Homo sapiens
aauaaagccugucucuuuagag

SEQ ID NO: 359446 - RNA, 22 nt, Homo sapiens
aauaagcauaguaccugauagg

SEQ ID NO: 359447 - RNA, 19 nt, Homo sapiens
aauaaugccagaugucugu

SEQ ID NO: 359448 - RNA, 22 nt, Homo sapiens
aauacuggcacugaagaccaug

SEQ ID NO: 359449 - RNA, 22 nt, Homo sapiens
aauacuuccaaaucuagucauu

SEQ ID NO: 359450 - RNA, 22 nt, Homo sapiens
aauagcauugaaucuaccaauu

SEQ ID NO: 359451 - RNA, 22 nt, Homo sapiens
aauauguccuugaaauggugcu

SEQ ID NO: 359452 - RNA, 22 nt, Homo sapiens
aauaugucuugaaauuggguaa

SEQ ID NO: 359453 - RNA, 21 nt, Homo sapiens
aaucacaguuguucugccuuc

SEQ ID NO: 359454 - RNA, 22 nt, Homo sapiens
aaucacuaugccaugaaguaca

SEQ ID NO: 359455 - RNA, 22 nt, Homo sapiens
aaucagauuccagugguuggaa

SEQ ID NO: 359456 - RNA, 22 nt, Homo sapiens
aaucccugagcuagacacaaag

SEQ ID NO: 359457 - RNA, 22 nt, Homo sapiens
ugucccguuuucgaggcugcag

SEQ ID NO: 359458 - RNA, 22 nt, Homo sapiens
ugucccugagccuggauuccug

SEQ ID NO: 359459 - RNA, 22 nt, Homo sapiens
uguccuagagggaugucacccc

SEQ ID NO: 359460 - RNA, 20 nt, Homo sapiens
ugucuauggggguucucugc

SEQ ID NO: 359461 - RNA, 22 nt, Homo sapiens
ugucuggaaggguggccuccug

SEQ ID NO: 359462 - RNA, 22 nt, Homo sapiens
ugucuuguagacaauguauagu

SEQ ID NO: 359463 - RNA, 21 nt, Homo sapiens
ugugaaaucuaggcagagguu

SEQ ID NO: 359464 - RNA, 22 nt, Homo sapiens
ugugaacaaaauuuguugcaua

SEQ ID NO: 359465 - RNA, 19 nt, Homo sapiens
ugugaacaucacagagugu

SEQ ID NO: 359466 - RNA, 22 nt, Homo sapiens
ugugaacugagcauuaacuaca

SEQ ID NO: 359467 - RNA, 22 nt, Homo sapiens
ugugaagaugagaugacgcccu

SEQ ID NO: 359468 - RNA, 22 nt, Homo sapiens
ugugaauggugcugcaaugaac

SEQ ID NO: 359469 - RNA, 22 nt, Homo sapiens
ugugaauguaaccuuauuugga

SEQ ID NO: 359470 - RNA, 18 nt, Homo sapiens
ugugacauugagcauguc

SEQ ID NO: 359471 - RNA, 22 nt, Homo sapiens
ugugacuaguggugaaugacgc

SEQ ID NO: 359472 - RNA, 22 nt, Homo sapiens
ugugagaucucagaauugaacu

SEQ ID NO: 359473 - RNA, 22 nt, Homo sapiens
ugugagcuauggaguuguagag

SEQ ID NO: 359474 - RNA, 17 nt, Homo sapiens
ugugaucaucacccuug

SEQ ID NO: 359475 - RNA, 22 nt, Homo sapiens
ugugaucauuucaggaauuuug

SEQ ID NO: 359476 - RNA, 22 nt, Homo sapiens
ugugauuauuuauagacaguca

SEQ ID NO: 359477 - RNA, 22 nt, Homo sapiens
ugugauugauuaaugugugcua

SEQ ID NO: 359478 - RNA, 22 nt, Homo sapiens
ugugcaaaaacaauugcgguuu

SEQ ID NO: 359479 - RNA, 22 nt, Homo sapiens
ugugcaaaaguaauugcgguuu

SEQ ID NO: 359480 - RNA, 22 nt, Homo sapiens
ugugcaaauuagcacaacccga

SEQ ID NO: 359481 - RNA, 22 nt, Homo sapiens
ugugcacaaccugcagguuugu

SEQ ID NO: 359482 - RNA, 22 nt, Homo sapiens
ugugcacaauguacagguuagu

SEQ ID NO: 359483 - RNA, 22 nt, Homo sapiens
ugugcacaaugugcagguuugu

SEQ ID NO: 359484 - RNA, 22 nt, Homo sapiens
ugugcaccucuucacacaggga

SEQ ID NO: 359485 - RNA, 22 nt, Homo sapiens
ugugcaguuuuagcguauuuua

SEQ ID NO: 359486 - RNA, 22 nt, Homo sapiens
ugugcauagugugugcggggcg

SEQ ID NO: 359487 - RNA, 22 nt, Homo sapiens
ugugccacugcacuccugccug

SEQ ID NO: 359488 - RNA, 22 nt, Homo sapiens
ugugccacugcacuccugggug

SEQ ID NO: 359489 - RNA, 22 nt, Homo sapiens
ugugccacuguucuguaaagug

SEQ ID NO: 359490 - RNA, 22 nt, Homo sapiens
ugugcgugugccuguaagaauu

SEQ ID NO: 359491 - RNA, 22 nt, Homo sapiens
ugugcuauguuauucacauggg

SEQ ID NO: 359492 - RNA, 22 nt, Homo sapiens
ugugcuugaauuuaguagcuua

SEQ ID NO: 359493 - RNA, 22 nt, Homo sapiens
ugugcuugcuucuucuccuagu

SEQ ID NO: 359494 - RNA, 22 nt, Homo sapiens
uguggaaauaaaagaaagguua

SEQ ID NO: 359495 - RNA, 22 nt, Homo sapiens
uguggcaaagucuugugaauau

SEQ ID NO: 359496 - RNA, 22 nt, Homo sapiens
uguggcuuuacagcaugguuca

SEQ ID NO: 359497 - RNA, 22 nt, Homo sapiens
ugugggaggugcuaauguaaau

SEQ ID NO: 359498 - RNA, 22 nt, Homo sapiens
ugugguagugcuuaccugcagu

SEQ ID NO: 359499 - RNA, 22 nt, Homo sapiens
uguguaaagcuuguuccagaaa

SEQ ID NO: 359500 - RNA, 22 nt, Homo sapiens
uguguaaauauauacacacgug

SEQ ID NO: 359501 - RNA, 22 nt, Homo sapiens
uguguacugcagaguauucugu

SEQ ID NO: 359502 - RNA, 22 nt, Homo sapiens
ugugucacugcacuccagcgug

SEQ ID NO: 359503 - RNA, 22 nt, Homo sapiens
ugugucuacugagaugaucaug

SEQ ID NO: 359504 - RNA, 22 nt, Homo sapiens
ugugucuugcuggugccugcau

SEQ ID NO: 359505 - RNA, 22 nt, Homo sapiens
uguuaacauggucucagucugu

SEQ ID NO: 359506 - RNA, 22 nt, Homo sapiens
uguuauguauggagugauccca

SEQ ID NO: 359507 - RNA, 22 nt, Homo sapiens
uguucacaguguuucuuugaga

SEQ ID NO: 359508 - RNA, 22 nt, Homo sapiens
uuagacacacauacauuuaucu

SEQ ID NO: 359509 - RNA, 22 nt, Homo sapiens
uuagacaguggugcacugcacu

SEQ ID NO: 359510 - RNA, 19 nt, Homo sapiens
uuagagaucaucugcuuca

SEQ ID NO: 359511 - RNA, 22 nt, Homo sapiens
uuagaguacaggggaaucaagg

SEQ ID NO: 359512 - RNA, 22 nt, Homo sapiens
uuagauuauugagcauccacug

SEQ ID NO: 359513 - RNA, 22 nt, Homo sapiens
uuagcagcacaaaagcagacua

SEQ ID NO: 359514 - RNA, 22 nt, Homo sapiens
uuagcgccuuucuuccucuccu

SEQ ID NO: 359515 - RNA, 22 nt, Homo sapiens
uuaggaucacagaaaauccucu

SEQ ID NO: 359516 - RNA, 22 nt, Homo sapiens
uuaggcuuuuuaaccaguuguu

SEQ ID NO: 359517 - RNA, 22 nt, Homo sapiens
uuagggcaggcaugagagaacu

SEQ ID NO: 359518 - RNA, 23 nt, Homo sapiens
uuaguaaacucaaugacaccaca

SEQ ID NO: 359519 - RNA, 21 nt, Homo sapiens
uuagugcucaguuugacaaaa

SEQ ID NO: 359520 - RNA, 22 nt, Homo sapiens
uuaguucauugugacuggacuc

SEQ ID NO: 359521 - RNA, 22 nt, Homo sapiens
uuaguucccucauucuugacuu

SEQ ID NO: 359522 - RNA, 22 nt, Homo sapiens
uuauaaacaugaagauuugggg

SEQ ID NO: 359523 - RNA, 22 nt, Homo sapiens
uuauaacagagacuccugugcu

SEQ ID NO: 359524 - RNA, 22 nt, Homo sapiens
uuauacucgucugaaugauucu

SEQ ID NO: 359525 - RNA, 22 nt, Homo sapiens
uuauagcagugcaggaacagac

SEQ ID NO: 359526 - RNA, 22 nt, Homo sapiens
uuaucacauugacugauuugca

SEQ ID NO: 359527 - RNA, 22 nt, Homo sapiens
uuaugacaggcucaggagcccc

SEQ ID NO: 359528 - RNA, 22 nt, Homo sapiens
uuaugccagugauuauaagggc

SEQ ID NO: 359529 - RNA, 22 nt, Homo sapiens
uuaugguacaugugcacaaugu

SEQ ID NO: 359530 - RNA, 22 nt, Homo sapiens
uuauguaaaucaaucuggaauc

SEQ ID NO: 359531 - RNA, 22 nt, Homo sapiens
uuaugucuuugagcaaugcugu

SEQ ID NO: 359532 - RNA, 22 nt, Homo sapiens
uuaugucuuuuguguucagcua

SEQ ID NO: 359533 - RNA, 22 nt, Homo sapiens
uuauuagguugguggaaaagua

SEQ ID NO: 359534 - RNA, 22 nt, Homo sapiens
uuauugaguaaaaagaaugguu

SEQ ID NO: 359535 - RNA, 22 nt, Homo sapiens
uuauugcacuccagccugggua

SEQ ID NO: 359536 - RNA, 22 nt, Homo sapiens
uuauugcuuuugugcaggugag

SEQ ID NO: 359537 - RNA, 22 nt, Homo sapiens
uuauuguccaaguuucccuuug

SEQ ID NO: 359538 - RNA, 22 nt, Homo sapiens
uucaaaguguugguuuugggcu

SEQ ID NO: 359539 - RNA, 23 nt, Homo sapiens
uucaaauguucucugguugucag

SEQ ID NO: 359540 - RNA, 22 nt, Homo sapiens
uucaacagugauggccuuugua

SEQ ID NO: 359541 - RNA, 22 nt, Homo sapiens
uucaagcuauggugaucuuuuc

SEQ ID NO: 359542 - RNA, 21 nt, Homo sapiens
uucacaagggaaguagggggc

SEQ ID NO: 359543 - RNA, 22 nt, Homo sapiens
uucacaaugccuuguugauggu

SEQ ID NO: 359544 - RNA, 22 nt, Homo sapiens
uucacacugggccuacucugug

SEQ ID NO: 359545 - RNA, 22 nt, Homo sapiens
uucacagccgcaccccaucacu

SEQ ID NO: 359546 - RNA, 22 nt, Homo sapiens
uucaccaguuuugucacgaaug

SEQ ID NO: 359547 - RNA, 21 nt, Homo sapiens
uucaccauggcuccacacucu

SEQ ID NO: 359548 - RNA, 22 nt, Homo sapiens
uucacugcauuucagccugggc

SEQ ID NO: 359549 - RNA, 22 nt, Homo sapiens
uucacugugaauaaaggcuccc

SEQ ID NO: 359550 - RNA, 22 nt, Homo sapiens
uucagagugaggcucucggaac

SEQ ID NO: 359551 - RNA, 22 nt, Homo sapiens
uucagcacaguguggaucauuc

SEQ ID NO: 359552 - RNA, 22 nt, Homo sapiens
uucagcuaccugggaugcugaa

SEQ ID NO: 359553 - RNA, 22 nt, Homo sapiens
uucaggcaccauugucauugau

SEQ ID NO: 359554 - RNA, 22 nt, Homo sapiens
uucagggagaaggcaaacguug

SEQ ID NO: 359555 - RNA, 22 nt, Homo sapiens
uucaguaaauguucuuacuaua

SEQ ID NO: 359556 - RNA, 22 nt, Homo sapiens
uucaguggagaggcugaguggu

SEQ ID NO: 359557 - RNA, 22 nt, Homo sapiens
uucaguggguggaugaauauga

SEQ ID NO: 359558 - RNA, 22 nt, Homo sapiens
uucaguucugcacugaucuuag

SEQ ID NO: 359559 - RNA, 18 nt, Homo sapiens
uucaguuuguaucugggg

SEQ ID NO: 359560 - RNA, 18 nt, Homo sapiens
uucauaguagcaugauuu

SEQ ID NO: 359561 - RNA, 20 nt, Homo sapiens
auuccacuuauaugaggucc

SEQ ID NO: 359562 - RNA, 22 nt, Homo sapiens
auuccagguggcgccauucaca

SEQ ID NO: 359563 - RNA, 22 nt, Homo sapiens
auucccuuagcugccucagccu

SEQ ID NO: 359564 - RNA, 22 nt, Homo sapiens
auugaaucuaaaaugagucucu

SEQ ID NO: 359565 - RNA, 22 nt, Homo sapiens
auugagcacugacucugugcca

SEQ ID NO: 359566 - RNA, 22 nt, Homo sapiens
auugaggcaggaggaccaucua

SEQ ID NO: 359567 - RNA, 21 nt, Homo sapiens
auugcacaauauacccaugua

SEQ ID NO: 359568 - RNA, 22 nt, Homo sapiens
auugcacacagaaucaggguaa

SEQ ID NO: 359569 - RNA, 22 nt, Homo sapiens
auugcacuccagccugggugag

SEQ ID NO: 359570 - RNA, 22 nt, Homo sapiens
auugcacuccagccuggugaca

SEQ ID NO: 359571 - RNA, 22 nt, Homo sapiens
auugcacuccggccugggugac

SEQ ID NO: 359572 - RNA, 22 nt, Homo sapiens
auugcacucugaucugcacucc

SEQ ID NO: 359573 - RNA, 18 nt, Homo sapiens
auugcccucauggggcuu

SEQ ID NO: 359574 - RNA, 23 nt, Homo sapiens
auugcccuugaaggcuaaacucu

SEQ ID NO: 359575 - RNA, 22 nt, Homo sapiens
auugcucagucagggagcucgg

SEQ ID NO: 359576 - RNA, 22 nt, Homo sapiens
auugcuuacuaaucaucuucag

SEQ ID NO: 359577 - RNA, 22 nt, Homo sapiens
auuggucuauuaaaccuaaguu

SEQ ID NO: 359578 - RNA, 22 nt, Homo sapiens
auuguaauuuuagagaaagugg

SEQ ID NO: 359579 - RNA, 22 nt, Homo sapiens
auuguacauacaccggugugua

SEQ ID NO: 359580 - RNA, 22 nt, Homo sapiens
auuguacuccagccuuggggac

SEQ ID NO: 359581 - RNA, 22 nt, Homo sapiens
auuguacucuagccucugggca

SEQ ID NO: 359582 - RNA, 22 nt, Homo sapiens
auuguccuacuaggguuccagu

SEQ ID NO: 359583 - RNA, 22 nt, Homo sapiens
auuuagcaauggagguagugua

SEQ ID NO: 359584 - RNA, 22 nt, Homo sapiens
auuuccuguaggggcuugcgaa

SEQ ID NO: 359585 - RNA, 22 nt, Homo sapiens
auuugacacugagagccucagu

SEQ ID NO: 359586 - RNA, 19 nt, Homo sapiens
auuugaucaucaggcacag

SEQ ID NO: 359587 - RNA, 22 nt, Homo sapiens
auuuggguaaugagugcaaggg

SEQ ID NO: 359588 - RNA, 22 nt, Homo sapiens
caaaggcuuccacugcauccuu

SEQ ID NO: 359589 - RNA, 22 nt, Homo sapiens
caaaguaauuacgguuuuggcc

SEQ ID NO: 359590 - RNA, 22 nt, Homo sapiens
caaagugcugaaagaggccagg

SEQ ID NO: 359591 - RNA, 22 nt, Homo sapiens
caaagugcuggccgggcgcagu

SEQ ID NO: 359592 - RNA, 22 nt, Homo sapiens
caaauccucaccucaucaugaa

SEQ ID NO: 359593 - RNA, 22 nt, Homo sapiens
caaaugacaucauuucauucaa

SEQ ID NO: 359594 - RNA, 22 nt, Homo sapiens
caacacuguuuauuggauagcc

SEQ ID NO: 359595 - RNA, 19 nt, Homo sapiens
caacccugcagagaaagga

SEQ ID NO: 359596 - RNA, 22 nt, Homo sapiens
caacucuguaggauccaggugg

SEQ ID NO: 359597 - RNA, 22 nt, Homo sapiens
caauacuguuaccugaaauagg

SEQ ID NO: 359598 - RNA, 22 nt, Homo sapiens
caaugcagcuuuuggagagaaa

SEQ ID NO: 359599 - RNA, 22 nt, Homo sapiens
caauggcaaugaaauagugaga

SEQ ID NO: 359600 - RNA, 22 nt, Homo sapiens
cacacugucuucaauggguggu

SEQ ID NO: 359601 - RNA, 22 nt, Homo sapiens
cacagcacaggcaugaguguca

SEQ ID NO: 359602 - RNA, 22 nt, Homo sapiens
cacaggccugucucuuucuaac

SEQ ID NO: 359603 - RNA, 22 nt, Homo sapiens
cacaguguucauagccaucagg

SEQ ID NO: 359604 - RNA, 22 nt, Homo sapiens
cacauagucccugcuaaucuuc

SEQ ID NO: 359605 - RNA, 21 nt, Homo sapiens
cacauggaggcagagagugua

SEQ ID NO: 359606 - RNA, 22 nt, Homo sapiens
caccauguguucagaaggauug

SEQ ID NO: 359607 - RNA, 22 nt, Homo sapiens
caccuagacuggagugcagugg

SEQ ID NO: 359608 - RNA, 22 nt, Homo sapiens
cacugaaugugagguuggggag

SEQ ID NO: 359609 - RNA, 18 nt, Homo sapiens
cacugagcccuucacucu

SEQ ID NO: 359610 - RNA, 22 nt, Homo sapiens
cacugcacuccagcuugugggc

SEQ ID NO: 359611 - RNA, 22 nt, Homo sapiens
cacugcauccuccaccugccag

SEQ ID NO: 359612 - RNA, 22 nt, Homo sapiens
cacugcauccuccauauccugg

SEQ ID NO: 359613 - RNA, 22 nt, Homo sapiens
cacugcauccucugccuggcgg

SEQ ID NO: 359614 - RNA, 23 nt, Homo sapiens
cacugggcagcagguguucccag

SEQ ID NO: 359615 - RNA, 22 nt, Homo sapiens
cacuuugguucaccugaguuuc

SEQ ID NO: 359616 - RNA, 22 nt, Homo sapiens
cagagcacugauacuggguucu

SEQ ID NO: 359617 - RNA, 22 nt, Homo sapiens
cagauacuccuggucucaggag

SEQ ID NO: 359618 - RNA, 22 nt, Homo sapiens
cagaugcaugaccugggcuugg

SEQ ID NO: 359619 - RNA, 20 nt, Homo sapiens
cagcuagugguaggagucgg

SEQ ID NO: 359620 - RNA, 22 nt, Homo sapiens
caggcacgcuugggagacacac

SEQ ID NO: 359621 - RNA, 22 nt, Homo sapiens
caggcagucuggggguguaucc

SEQ ID NO: 359622 - RNA, 22 nt, Homo sapiens
cagggcauuggcugguaccugg

SEQ ID NO: 359623 - RNA, 22 nt, Homo sapiens
cagguacauuuuaaagggcuca

SEQ ID NO: 359624 - RNA, 22 nt, Homo sapiens
caggugaaugccucuccuucug

SEQ ID NO: 359625 - RNA, 22 nt, Homo sapiens
caguacaauguugauuagaagu

SEQ ID NO: 359626 - RNA, 19 nt, Homo sapiens
caguaucauugcacauagu

SEQ ID NO: 359627 - RNA, 18 nt, Homo sapiens
cagugcaauacaggagag

SEQ ID NO: 359628 - RNA, 22 nt, Homo sapiens
cagugcauaggaucuaaaauuu

SEQ ID NO: 359629 - RNA, 20 nt, Homo sapiens
cagugcauugcuucugauuu

SEQ ID NO: 359630 - RNA, 23 nt, Homo sapiens
cagugguguuagagaaaucuuuu

SEQ ID NO: 359631 - RNA, 22 nt, Homo sapiens
cuauauacugccugcugauuag

SEQ ID NO: 359632 - RNA, 18 nt, Homo sapiens
cuaugccacuuuauauca

SEQ ID NO: 359633 - RNA, 22 nt, Homo sapiens
cuauggauuuacuguauagggu

SEQ ID NO: 359634 - RNA, 22 nt, Homo sapiens
cuauggcucugguuauggcugu

SEQ ID NO: 359635 - RNA, 22 nt, Homo sapiens
cuauucacaauggugaagauau

SEQ ID NO: 359636 - RNA, 22 nt, Homo sapiens
cucaaagucaagggaaagcagg

SEQ ID NO: 359637 - RNA, 22 nt, Homo sapiens
cucaaagugcugggacuggcug

SEQ ID NO: 359638 - RNA, 22 nt, Homo sapiens
cucaaagugcugggauuggcca

SEQ ID NO: 359639 - RNA, 22 nt, Homo sapiens
cucaaaguguggucuguggguu

SEQ ID NO: 359640 - RNA, 18 nt, Homo sapiens
cucaaccucaugcagggc

SEQ ID NO: 359641 - RNA, 22 nt, Homo sapiens
cucaccuugugauccacccacc

SEQ ID NO: 359642 - RNA, 22 nt, Homo sapiens
cucaccuugugauccacccgcc

SEQ ID NO: 359643 - RNA, 22 nt, Homo sapiens
cucagcuacuugagaggcuuag

SEQ ID NO: 359644 - RNA, 22 nt, Homo sapiens
cucagugaagggcaagaggcaa

SEQ ID NO: 359645 - RNA, 22 nt, Homo sapiens
cucaguggauuagauaaugcac

SEQ ID NO: 359646 - RNA, 22 nt, Homo sapiens
cucagugucuggcacacagaaa

SEQ ID NO: 359647 - RNA, 22 nt, Homo sapiens
cucauggagaacaucugcuagg

SEQ ID NO: 359648 - RNA, 22 nt, Homo sapiens
cucauggagaaccucugcuagg

SEQ ID NO: 359649 - RNA, 22 nt, Homo sapiens
cucauggauggucuggcagcca

SEQ ID NO: 359650 - RNA, 22 nt, Homo sapiens
cucauuaguuguuuuaagauga

SEQ ID NO: 359651 - RNA, 22 nt, Homo sapiens
cuccauagucuucgaagaauga

SEQ ID NO: 359652 - RNA, 22 nt, Homo sapiens
cuccauguggcuaacuuuuaaa

SEQ ID NO: 359653 - RNA, 22 nt, Homo sapiens
cucccacccucauuuuuaggca

SEQ ID NO: 359654 - RNA, 23 nt, Homo sapiens
cucccugaacaugacacaccaga

SEQ ID NO: 359655 - RNA, 22 nt, Homo sapiens
cucccuuugcugaauguuuuuc

SEQ ID NO: 359656 - RNA, 22 nt, Homo sapiens
cucucugagccauggcugcccu

SEQ ID NO: 359657 - RNA, 21 nt, Homo sapiens
cucucugcuuaugaauaguga

SEQ ID NO: 359658 - RNA, 21 nt, Homo sapiens
cucugguuugcauuggauuau

SEQ ID NO: 359659 - RNA, 22 nt, Homo sapiens
cucuuugaggugagcugcccau

SEQ ID NO: 359660 - RNA, 22 nt, Homo sapiens
cucuuuuguuuagcugagaggg

SEQ ID NO: 359661 - RNA, 22 nt, Homo sapiens
cugaaucauugcauuaucaagg

SEQ ID NO: 359662 - RNA, 22 nt, Homo sapiens
cugaauguucuauagaagccgc

SEQ ID NO: 359663 - RNA, 22 nt, Homo sapiens
cugacagaugacugccacugua

SEQ ID NO: 359664 - RNA, 22 nt, Homo sapiens
cugacaucuucaagugaggaga

SEQ ID NO: 359665 - RNA, 22 nt, Homo sapiens
cugacaugcagccacugcaccu

SEQ ID NO: 359666 - RNA, 22 nt, Homo sapiens
cugacugaggaucaguucauca

SEQ ID NO: 359667 - RNA, 22 nt, Homo sapiens
cugagaucguggggcugcuguc

SEQ ID NO: 359668 - RNA, 22 nt, Homo sapiens
cugagaucuuauuagaaaugca

SEQ ID NO: 359669 - RNA, 22 nt, Homo sapiens
cugagcaagucauuuuguuaaa

SEQ ID NO: 359670 - RNA, 22 nt, Homo sapiens
cugagcuaugccuggaaaggca

SEQ ID NO: 359671 - RNA, 22 nt, Homo sapiens
cugaggaaguucuuuaacaguu

SEQ ID NO: 359672 - RNA, 22 nt, Homo sapiens
cugagguaggcccugagaauau

SEQ ID NO: 359673 - RNA, 22 nt, Homo sapiens
cugaggugggaguuuuucucau

SEQ ID NO: 359674 - RNA, 22 nt, Homo sapiens
cugagguuaggaguuugagacc

SEQ ID NO: 359675 - RNA, 20 nt, Homo sapiens
cugagguugggguccuuccc

SEQ ID NO: 359676 - RNA, 22 nt, Homo sapiens
cugauaguucucuuuagaguuu

SEQ ID NO: 359677 - RNA, 22 nt, Homo sapiens
cugaucuggaggugucugggga

SEQ ID NO: 359678 - RNA, 22 nt, Homo sapiens
cugcaaauacuugugggauuuu

SEQ ID NO: 359679 - RNA, 21 nt, Homo sapiens
cugcaaaugcugcugccugau

SEQ ID NO: 359680 - RNA, 20 nt, Homo sapiens
cugcacauccacucuacuuc

SEQ ID NO: 359681 - RNA, 19 nt, Homo sapiens
cugcacugagaaaaggagg

SEQ ID NO: 359682 - RNA, 22 nt, Homo sapiens
cugcauuugaugacguauggug

SEQ ID NO: 359683 - RNA, 20 nt, Homo sapiens
cugcuccccuacaaaucuca

SEQ ID NO: 359684 - RNA, 22 nt, Homo sapiens
cugcuguuguuaacuuuuggag

SEQ ID NO: 359685 - RNA, 22 nt, Homo sapiens
cuggaagaaaaucacgccaucu

SEQ ID NO: 359686 - RNA, 18 nt, Homo sapiens
cuggaaggcuacuacagu

SEQ ID NO: 359687 - RNA, 22 nt, Homo sapiens
cuggaaugcagcuuuaggggcu

SEQ ID NO: 359688 - RNA, 22 nt, Homo sapiens
cuggaauucaaaaucugaauuu

SEQ ID NO: 359689 - RNA, 22 nt, Homo sapiens
cuggagauauuggaagaaagaa

SEQ ID NO: 359690 - RNA, 22 nt, Homo sapiens
cuggagauuaaccaauugccau

SEQ ID NO: 359691 - RNA, 22 nt, Homo sapiens
cuggcaaauguuuucuguaaag

SEQ ID NO: 359692 - RNA, 22 nt, Homo sapiens
cuggcaagagugaaccagcugu

SEQ ID NO: 359693 - RNA, 22 nt, Homo sapiens
cuggcagugcuuguuauccugg

SEQ ID NO: 359694 - RNA, 22 nt, Homo sapiens
cuggcaguguuucuugugggcu

SEQ ID NO: 359695 - RNA, 22 nt, Homo sapiens
cuggccagagacauucauuaaa

SEQ ID NO: 359696 - RNA, 22 nt, Homo sapiens
cuggcucugagguguuuagggc

SEQ ID NO: 359697 - RNA, 22 nt, Homo sapiens
cuggcucugggcuaaagaaaua

SEQ ID NO: 359698 - RNA, 22 nt, Homo sapiens
cugggaucaguucuagucagaa

SEQ ID NO: 359699 - RNA, 22 nt, Homo sapiens
cugggaugauguaaauaggcua

SEQ ID NO: 359700 - RNA, 22 nt, Homo sapiens
cugggaugugacuguugccccc

SEQ ID NO: 359701 - RNA, 22 nt, Homo sapiens
cugggcaaugcggcuggauaga

SEQ ID NO: 359702 - RNA, 22 nt, Homo sapiens
cugguuguuacaugcuugccag

SEQ ID NO: 359703 - RNA, 22 nt, Homo sapiens
cuguaaagaucacagagcuggu

SEQ ID NO: 359704 - RNA, 22 nt, Homo sapiens
cuguaaaguaagagguaaguua

SEQ ID NO: 359705 - RNA, 22 nt, Homo sapiens
cuguaaaguucucauuguagcc

SEQ ID NO: 359706 - RNA, 23 nt, Homo sapiens
cuguacacauauacaucuaagua

SEQ ID NO: 359707 - RNA, 22 nt, Homo sapiens
cuguagacauuaggccugcacu

SEQ ID NO: 359708 - RNA, 22 nt, Homo sapiens
cuguaguuagcagaugaugaau

SEQ ID NO: 359709 - RNA, 22 nt, Homo sapiens
cugucacuggggcacauguccc

SEQ ID NO: 359710 - RNA, 22 nt, Homo sapiens
cugucuguuucaaaagugguua

SEQ ID NO: 359711 - RNA, 17 nt, Homo sapiens
cugugaugaucuugucu

SEQ ID NO: 359712 - RNA, 22 nt, Homo sapiens
cugugcaaguuauaggccaggu

SEQ ID NO: 359713 - RNA, 22 nt, Homo sapiens
cugugcacaucuggcggcccga

SEQ ID NO: 359714 - RNA, 22 nt, Homo sapiens
cugugcauaugacuuuauugga

SEQ ID NO: 359715 - RNA, 22 nt, Homo sapiens
cugugcauguuguccaauucuu

SEQ ID NO: 359716 - RNA, 22 nt, Homo sapiens
cugugguuuaaggaauuuugac

SEQ ID NO: 359717 - RNA, 22 nt, Homo sapiens
cuuaagcauugacuuuggacag

SEQ ID NO: 359718 - RNA, 22 nt, Homo sapiens
cuuaggguacuuuggugcauca

SEQ ID NO: 359719 - RNA, 17 nt, Homo sapiens
cuucaaauaauuucccc

SEQ ID NO: 359720 - RNA, 22 nt, Homo sapiens
cuucaugagacuuuuggaaggc

SEQ ID NO: 359721 - RNA, 20 nt, Homo sapiens
cuuccaguggccccaucuuu

SEQ ID NO: 359722 - RNA, 23 nt, Homo sapiens
cuugagacaaaugcgugugugca

SEQ ID NO: 359723 - RNA, 22 nt, Homo sapiens
cuugagacauuguuuuccaagu

SEQ ID NO: 359724 - RNA, 22 nt, Homo sapiens
cuugcacucagaagauucaguu

SEQ ID NO: 359725 - RNA, 22 nt, Homo sapiens
cuugcacuccacuguucuccug

SEQ ID NO: 359726 - RNA, 22 nt, Homo sapiens
cuuggcuugguaucaaauaacc

SEQ ID NO: 359727 - RNA, 19 nt, Homo sapiens
cuuguacucggcgcaguug

SEQ ID NO: 359728 - RNA, 22 nt, Homo sapiens
cuugucacuguuggcuuuagaa

SEQ ID NO: 359729 - RNA, 21 nt, Homo sapiens
cuugucuugcuuagaauagac

SEQ ID NO: 359730 - RNA, 22 nt, Homo sapiens
cuuuaugagguuggauggaucu

SEQ ID NO: 359731 - RNA, 22 nt, Homo sapiens
cuuuggucaaaauaaguaaguu

SEQ ID NO: 359732 - RNA, 20 nt, Homo sapiens
cuuuggugagucaacuccuu

SEQ ID NO: 359733 - RNA, 22 nt, Homo sapiens
uggcuccguuguacaggcugga

SEQ ID NO: 359734 - RNA, 22 nt, Homo sapiens
uggcuguuuauuucacaugggu

SEQ ID NO: 359735 - RNA, 22 nt, Homo sapiens
uggcuguuuauuucaccuggau

SEQ ID NO: 359736 - RNA, 22 nt, Homo sapiens
uggcuguuuauuucaccugggc

SEQ ID NO: 359737 - RNA, 22 nt, Homo sapiens
uggcuguuuauuucaccugggu

SEQ ID NO: 359738 - RNA, 22 nt, Homo sapiens
ugggaacaugaagguuaaagag

SEQ ID NO: 359739 - RNA, 22 nt, Homo sapiens
ugggaagagggagcgauuuugg

SEQ ID NO: 359740 - RNA, 22 nt, Homo sapiens
ugggagacuacauuuuuaacaa

SEQ ID NO: 359741 - RNA, 22 nt, Homo sapiens
ugggaucuuuccuauuagcgag

SEQ ID NO: 359742 - RNA, 22 nt, Homo sapiens
ugggaugaauacaaugggauca

SEQ ID NO: 359743 - RNA, 22 nt, Homo sapiens
ugggcaaaacuaagagcugugg

SEQ ID NO: 359744 - RNA, 22 nt, Homo sapiens
ugggccgcugcaggaugguccc

SEQ ID NO: 359745 - RNA, 22 nt, Homo sapiens
uggggcuuuuucuuguauucuc

SEQ ID NO: 359746 - RNA, 22 nt, Homo sapiens
uggguaguguaaagcacuccag

SEQ ID NO: 359747 - RNA, 21 nt, Homo sapiens
uggguaguuuucaaggccccg

SEQ ID NO: 359748 - RNA, 22 nt, Homo sapiens
uggguucccugucuguccuuga

SEQ ID NO: 359749 - RNA, 22 nt, Homo sapiens
ugguaauguaauuuggagaagg

SEQ ID NO: 359750 - RNA, 22 nt, Homo sapiens
ugguacuucaugcucacagaua

SEQ ID NO: 359751 - RNA, 22 nt, Homo sapiens
guuauuguccauuuauuuagca

SEQ ID NO: 359752 - RNA, 22 nt, Homo sapiens
guucaagugauagcugggauua

SEQ ID NO: 359753 - RNA, 22 nt, Homo sapiens
guucaagugauucuacugccuc

SEQ ID NO: 359754 - RNA, 22 nt, Homo sapiens
guucacaguuaggacaacugcu

SEQ ID NO: 359755 - RNA, 22 nt, Homo sapiens
guucacaguucagccuguaaca

SEQ ID NO: 359756 - RNA, 22 nt, Homo sapiens
guucacaguuucuaaucccagc

SEQ ID NO: 359757 - RNA, 22 nt, Homo sapiens
guucaucagggacacugguuug

SEQ ID NO: 359758 - RNA, 20 nt, Homo sapiens
guucccuguaggugugcgga

SEQ ID NO: 359759 - RNA, 22 nt, Homo sapiens
guucuggagauaaagccaaggu

SEQ ID NO: 359760 - RNA, 22 nt, Homo sapiens
guugaucuauguugcuggcagu

SEQ ID NO: 359761 - RNA, 22 nt, Homo sapiens
guugcucaggccggagugcagu

SEQ ID NO: 359762 - RNA, 22 nt, Homo sapiens
guugcucaggcugaagugcagu

SEQ ID NO: 359763 - RNA, 22 nt, Homo sapiens
guuggaauguauugcuacuucu

SEQ ID NO: 359764 - RNA, 22 nt, Homo sapiens
guuggucucguauaaaucaagg

SEQ ID NO: 359765 - RNA, 22 nt, Homo sapiens
guuuggauuuucuaauuucugu

SEQ ID NO: 359766 - RNA, 22 nt, Homo sapiens
guuuggcuuucucucuauccug

SEQ ID NO: 359767 - RNA, 15 nt, Homo sapiens
guuuuuggauacaau

SEQ ID NO: 359768 - RNA, 21 nt, Homo sapiens
uaaaacuguaacuuuguccug

SEQ ID NO: 359769 - RNA, 22 nt, Homo sapiens
uaaacacucacuucauagccau

SEQ ID NO: 359770 - RNA, 22 nt, Homo sapiens
uaaaccacguuuacauuugaga

SEQ ID NO: 359771 - RNA, 22 nt, Homo sapiens
uaaaccuagcauuuugcauaug

SEQ ID NO: 359772 - RNA, 22 nt, Homo sapiens
uaaagcuacaguauaugguauu

SEQ ID NO: 359773 - RNA, 22 nt, Homo sapiens
uaaagcuuagauccaugguggc

SEQ ID NO: 359774 - RNA, 22 nt, Homo sapiens
uaaagugcugagaugaggcugg

SEQ ID NO: 359775 - RNA, 22 nt, Homo sapiens
uaaaguuauugccccucaguua

SEQ ID NO: 359776 - RNA, 22 nt, Homo sapiens
uaaaguucuuuuaugggccggg

SEQ ID NO: 359777 - RNA, 20 nt, Homo sapiens
uaaaugccucaugcuuuauu

SEQ ID NO: 359778 - RNA, 22 nt, Homo sapiens
uaaauggauaaaugaauaccua

SEQ ID NO: 359779 - RNA, 22 nt, Homo sapiens
uaaauugcauaaguacaaauga

SEQ ID NO: 359780 - RNA, 22 nt, Homo sapiens
uaacaagagagucagucagucc

SEQ ID NO: 359781 - RNA, 22 nt, Homo sapiens
uaacaguauaugugguaucuau

SEQ ID NO: 359782 - RNA, 22 nt, Homo sapiens
uaacaguauauuuaccaaaccu

SEQ ID NO: 359783 - RNA, 22 nt, Homo sapiens
uaacaguggucugugguaucug

SEQ ID NO: 359784 - RNA, 22 nt, Homo sapiens
uaacccuuaguaucuguggguu

SEQ ID NO: 359785 - RNA, 22 nt, Homo sapiens
uaacuaguagauggcugacaua

SEQ ID NO: 359786 - RNA, 22 nt, Homo sapiens
uaacucugccuagugacauggu

SEQ ID NO: 359787 - RNA, 23 nt, Homo sapiens
uaagacacuaacuuuaugcuuug

SEQ ID NO: 359788 - RNA, 20 nt, Homo sapiens
uaagacaugguccacaugcc

SEQ ID NO: 359789 - RNA, 22 nt, Homo sapiens
uaagacugccccagacagcaag

SEQ ID NO: 359790 - RNA, 19 nt, Homo sapiens
uaagaugaagcugucuggg

SEQ ID NO: 359791 - RNA, 22 nt, Homo sapiens
uaagaugaaggcucaccuagaa

SEQ ID NO: 359792 - RNA, 22 nt, Homo sapiens
uaagccaccgugccuggccuaa

SEQ ID NO: 359793 - RNA, 22 nt, Homo sapiens
uaaggauuuuggugauuacacu

SEQ ID NO: 359794 - RNA, 22 nt, Homo sapiens
uaaggcacccuucugaguagag

SEQ ID NO: 359795 - RNA, 22 nt, Homo sapiens
uaaggcacucuucugugugccu

SEQ ID NO: 359796 - RNA, 22 nt, Homo sapiens
uaaggcuagcaagaugagaaua

SEQ ID NO: 359797 - RNA, 22 nt, Homo sapiens
uaagguccuuaaauguguaacc

SEQ ID NO: 359798 - RNA, 22 nt, Homo sapiens
uaaguaauuguuaauagggaag

SEQ ID NO: 359799 - RNA, 22 nt, Homo sapiens
uaaguacuuuacagacauuauc

SEQ ID NO: 359800 - RNA, 19 nt, Homo sapiens
uaaguagaugacugaugcu

SEQ ID NO: 359801 - RNA, 22 nt, Homo sapiens
uaagucuuuuuggaguuuauaa

SEQ ID NO: 359802 - RNA, 22 nt, Homo sapiens
uaagugaauauggacaguuagc

SEQ ID NO: 359803 - RNA, 20 nt, Homo sapiens
uaagugcuugaugaaugaac

SEQ ID NO: 359804 - RNA, 22 nt, Homo sapiens
uaaguggugcauuguuaaaugg

SEQ ID NO: 359805 - RNA, 22 nt, Homo sapiens
uaaguucauucaugaaacuuag

SEQ ID NO: 359806 - RNA, 22 nt, Homo sapiens
uaauacuugucauaaaggcauu

SEQ ID NO: 359807 - RNA, 22 nt, Homo sapiens
uaauagagucauuauuauuguu

SEQ ID NO: 359808 - RNA, 22 nt, Homo sapiens
uaauaguguuaaugcuagagcu

SEQ ID NO: 359809 - RNA, 22 nt, Homo sapiens
uaauaguuggcacuggagaaag

SEQ ID NO: 359810 - RNA, 22 nt, Homo sapiens
uaaugcuguggucugguuuaaa

SEQ ID NO: 359811 - RNA, 22 nt, Homo sapiens
uaauucugacaacaguggcguu

SEQ ID NO: 359812 - RNA, 22 nt, Homo sapiens
uacaaagugggaaacgaagguu

SEQ ID NO: 359813 - RNA, 22 nt, Homo sapiens
uacaaccucugccucccaaguu

SEQ ID NO: 359814 - RNA, 22 nt, Homo sapiens
uacaaguggguuugugcaggag

SEQ ID NO: 359815 - RNA, 21 nt, Homo sapiens
uacaaugcacaggagagccuc

SEQ ID NO: 359816 - RNA, 22 nt, Homo sapiens
uacacagucaaaaauuuccagg

SEQ ID NO: 359817 - RNA, 22 nt, Homo sapiens
uacagaguagaagauuugcaga

SEQ ID NO: 359818 - RNA, 23 nt, Homo sapiens
uacagcugcagaaucaggcuaag

SEQ ID NO: 359819 - RNA, 22 nt, Homo sapiens
uacaggacuauagaacuuuccc

SEQ ID NO: 359820 - RNA, 20 nt, Homo sapiens
uacaggacugagaaucugug

SEQ ID NO: 359821 - RNA, 22 nt, Homo sapiens
uacaggacuucucagaguuauu

SEQ ID NO: 359822 - RNA, 22 nt, Homo sapiens
uacagucuagaggagaaucagg

SEQ ID NO: 359823 - RNA, 22 nt, Homo sapiens
uacagugcauagaggcaugaua

SEQ ID NO: 359824 - RNA, 22 nt, Homo sapiens
uacaguggugugaucucagcuc

SEQ ID NO: 359825 - RNA, 22 nt, Homo sapiens
uacauacuucacagacuuuaaa

SEQ ID NO: 359826 - RNA, 20 nt, Homo sapiens
uacauaguaaacugagagca

SEQ ID NO: 359827 - RNA, 22 nt, Homo sapiens
uacaucagccugaaagagcucg

SEQ ID NO: 359828 - RNA, 22 nt, Homo sapiens
uacaugugcacaacgugcaggu

SEQ ID NO: 359829 - RNA, 22 nt, Homo sapiens
ugugccacuccaaccuggguga

SEQ ID NO: 359830 - RNA, 22 nt, Homo sapiens
ugugccacugcacucccgccug

SEQ ID NO: 359831 - RNA, 22 nt, Homo sapiens
ugugccuaguaauguguccaga

SEQ ID NO: 359832 - RNA, 22 nt, Homo sapiens
ugugccuucuaagaaggagucu

SEQ ID NO: 359833 - RNA, 22 nt, Homo sapiens
ugugcgcaucggggccugcuuc

SEQ ID NO: 359834 - RNA, 22 nt, Homo sapiens
ugugcguguaagagaucuaggu

SEQ ID NO: 359835 - RNA, 22 nt, Homo sapiens
uguggaguguaugugacagaga

SEQ ID NO: 359836 - RNA, 22 nt, Homo sapiens
uguggccuuuguuucaguuggg

SEQ ID NO: 359837 - RNA, 22 nt, Homo sapiens
uguggcugguggcaccuuuucc

SEQ ID NO: 359838 - RNA, 22 nt, Homo sapiens
uguggcuucuuugguucaguau

SEQ ID NO: 359839 - RNA, 22 nt, Homo sapiens
uguggcuuuguaaccauggguc

SEQ ID NO: 359840 - RNA, 22 nt, Homo sapiens
uguggcuuuuucuuggcugagg

SEQ ID NO: 359841 - RNA, 19 nt, Homo sapiens
uguggucauccugggacga

SEQ ID NO: 359842 - RNA, 22 nt, Homo sapiens
ugugguuuuaguaaaacuaugu

SEQ ID NO: 359843 - RNA, 22 nt, Homo sapiens
ugugguuuuucacauuuagaga

SEQ ID NO: 359844 - RNA, 22 nt, Homo sapiens
ugugucuuguuuuuucccaggc

SEQ ID NO: 359845 - RNA, 22 nt, Homo sapiens
ugugucuuuuaucacacaaugu

SEQ ID NO: 359846 - RNA, 21 nt, Homo sapiens
uguuaacaugcagauuacugg

SEQ ID NO: 359847 - RNA, 22 nt, Homo sapiens
uguuacagcagcacaaaaugga

SEQ ID NO: 359848 - RNA, 22 nt, Homo sapiens
uguuauguuguuugagaaaguc

SEQ ID NO: 359849 - RNA, 22 nt, Homo sapiens
uguuucuacugucucuguagua

SEQ ID NO: 359850 - RNA, 22 nt, Homo sapiens
uguuugcuuaacguggagccag

SEQ ID NO: 359851 - RNA, 22 nt, Homo sapiens
auaacagcugcaaggcaaaagc

SEQ ID NO: 359852 - RNA, 18 nt, Homo sapiens
auaaccuggugcuuucaa

SEQ ID NO: 359853 - RNA, 22 nt, Homo sapiens
auaagaguaguacauaugagac

SEQ ID NO: 359854 - RNA, 22 nt, Homo sapiens
auaagaugaaggaagccauauc

SEQ ID NO: 359855 - RNA, 22 nt, Homo sapiens
auaaggcuaaggacuugaguua

SEQ ID NO: 359856 - RNA, 22 nt, Homo sapiens
auaagucaauggaacagauuaa

SEQ ID NO: 359857 - RNA, 22 nt, Homo sapiens
auaauaguguuuagauuuggga

SEQ ID NO: 359858 - RNA, 22 nt, Homo sapiens
auaaucacacccagguuaaaug

SEQ ID NO: 359859 - RNA, 22 nt, Homo sapiens
auaaugcuggaacuagagggca

SEQ ID NO: 359860 - RNA, 22 nt, Homo sapiens
auaauguuugauugagcagaua

SEQ ID NO: 359861 - RNA, 22 nt, Homo sapiens
auacacgguaggcacauauuua

SEQ ID NO: 359862 - RNA, 22 nt, Homo sapiens
auacagacacagucagaggggu

SEQ ID NO: 359863 - RNA, 22 nt, Homo sapiens
auacaguauggagggcccagcu

SEQ ID NO: 359864 - RNA, 22 nt, Homo sapiens
auacagucuguuagauuuccuc

SEQ ID NO: 359865 - RNA, 22 nt, Homo sapiens
auacaguguauguauaguacau

SEQ ID NO: 359866 - RNA, 22 nt, Homo sapiens
auacaguguucugggaagaagu

SEQ ID NO: 359867 - RNA, 22 nt, Homo sapiens
auacaugugcaggucagguuac

SEQ ID NO: 359868 - RNA, 22 nt, Homo sapiens
auacaugugccauggugguuug

SEQ ID NO: 359869 - RNA, 22 nt, Homo sapiens
auacaugugccauguucgugug

SEQ ID NO: 359870 - RNA, 22 nt, Homo sapiens
auacaugugccauguugguuug

SEQ ID NO: 359871 - RNA, 22 nt, Homo sapiens
auacaugugugagcgaagaugu

SEQ ID NO: 359872 - RNA, 20 nt, Homo sapiens
auaccacagacuggguaguu

SEQ ID NO: 359873 - RNA, 16 nt, Homo sapiens
auaccacagugacaca

SEQ ID NO: 359874 - RNA, 22 nt, Homo sapiens
auagaauguuugcgccagguga

SEQ ID NO: 359875 - RNA, 22 nt, Homo sapiens
auagcaaugcaagaauggcuua

SEQ ID NO: 359876 - RNA, 22 nt, Homo sapiens
auagcagaacagugucucacug

SEQ ID NO: 359877 - RNA, 22 nt, Homo sapiens
auagcagaccaccucucccacu

SEQ ID NO: 359878 - RNA, 22 nt, Homo sapiens
auagcagcauauguaauguuga

SEQ ID NO: 359879 - RNA, 20 nt, Homo sapiens
auagcagcaugauuuauaau

SEQ ID NO: 359880 - RNA, 22 nt, Homo sapiens
auagcagugugagaaugaacua

SEQ ID NO: 359881 - RNA, 22 nt, Homo sapiens
auagcaucauuucuugaaaaga

SEQ ID NO: 359882 - RNA, 22 nt, Homo sapiens
auaggcaagaugagguuuuuau

SEQ ID NO: 359883 - RNA, 22 nt, Homo sapiens
auagguauuuuuaaaugacugu

SEQ ID NO: 359884 - RNA, 21 nt, Homo sapiens
auagugcuagagaguagcagg

SEQ ID NO: 359885 - RNA, 22 nt, Homo sapiens
auagugcugcaaaaaacauacg

SEQ ID NO: 359886 - RNA, 22 nt, Homo sapiens
auagugcugcaagaaacauacg

SEQ ID NO: 359887 - RNA, 22 nt, Homo sapiens
auagugcugccauaaacauacg

SEQ ID NO: 359888 - RNA, 22 nt, Homo sapiens
auagugcuggaauaaauauacg

SEQ ID NO: 359889 - RNA, 19 nt, Homo sapiens
auauaacauccaggagcag

SEQ ID NO: 359890 - RNA, 22 nt, Homo sapiens
auauaugcuaagugcuaauaaa

SEQ ID NO: 359891 - RNA, 22 nt, Homo sapiens
auaucacagguguuuaccugau

SEQ ID NO: 359892 - RNA, 22 nt, Homo sapiens
auaucagugucuuacuguuuuu

SEQ ID NO: 359893 - RNA, 22 nt, Homo sapiens
auaugcauacccucaccaacua

SEQ ID NO: 359894 - RNA, 22 nt, Homo sapiens
auaugcauguacccacacaggc

SEQ ID NO: 359895 - RNA, 22 nt, Homo sapiens
auaugcuuauuagcaagaaaua

SEQ ID NO: 359896 - RNA, 21 nt, Homo sapiens
auauggaacuggugacguguu

SEQ ID NO: 359897 - RNA, 19 nt, Homo sapiens
auaugggguuugaacugug

SEQ ID NO: 359898 - RNA, 22 nt, Homo sapiens
auauuacuggcuauaucgcaag

SEQ ID NO: 359899 - RNA, 22 nt, Homo sapiens
auauucacagguaucagagauu

SEQ ID NO: 359900 - RNA, 22 nt, Homo sapiens
auauuggccuaaaauucucuuu

SEQ ID NO: 359901 - RNA, 22 nt, Homo sapiens
auauuggucuucaagaccugug

SEQ ID NO: 359902 - RNA, 22 nt, Homo sapiens
aucaaaguaggcauauguuuuu

SEQ ID NO: 359903 - RNA, 22 nt, Homo sapiens
aucacagagucacgggcaacuu

SEQ ID NO: 359904 - RNA, 22 nt, Homo sapiens
aucacagugaaaacagucaauu

SEQ ID NO: 359905 - RNA, 22 nt, Homo sapiens
aucacauuuauaguggcacgca

SEQ ID NO: 359906 - RNA, 22 nt, Homo sapiens
aucaccugagcaguauacacug

SEQ ID NO: 359907 - RNA, 22 nt, Homo sapiens
aucaccuggaggugaucacuug

SEQ ID NO: 359908 - RNA, 22 nt, Homo sapiens
aucacuggucaugagagaagua

SEQ ID NO: 359909 - RNA, 22 nt, Homo sapiens
aucacuguccacucaucuuucu

SEQ ID NO: 359910 - RNA, 22 nt, Homo sapiens
aucagaaucucuagaggacugu

SEQ ID NO: 359911 - RNA, 22 nt, Homo sapiens
aucagaguggguuuuaaaagug

SEQ ID NO: 359912 - RNA, 23 nt, Homo sapiens
aucagguuguagaauguguuugc

SEQ ID NO: 359913 - RNA, 21 nt, Homo sapiens
aucauaugcucacuccuagaa

SEQ ID NO: 359914 - RNA, 22 nt, Homo sapiens
aucauggaguauuugcaagucu

SEQ ID NO: 359915 - RNA, 22 nt, Homo sapiens
auccacaugcaguuggaaacag

SEQ ID NO: 359916 - RNA, 23 nt, Homo sapiens
auccacauucuaguccuuuaugc

SEQ ID NO: 359917 - RNA, 22 nt, Homo sapiens
auccaucagacggcaggcguug

SEQ ID NO: 359918 - RNA, 22 nt, Homo sapiens
aucccagaaacucggguuucuc

SEQ ID NO: 359919 - RNA, 22 nt, Homo sapiens
aucccaguaaaaauggcuucua

SEQ ID NO: 359920 - RNA, 22 nt, Homo sapiens
aucccuuucugauacuuucccu

SEQ ID NO: 359921 - RNA, 22 nt, Homo sapiens
aucgcgccauuguacuccagcc

SEQ ID NO: 359922 - RNA, 22 nt, Homo sapiens
aucuagagaggcagucuggccg

SEQ ID NO: 359923 - RNA, 21 nt, Homo sapiens
aucucacuugaauguaaaagc

SEQ ID NO: 359924 - RNA, 22 nt, Homo sapiens
aucucaguucaggcuggccaca

SEQ ID NO: 359925 - RNA, 22 nt, Homo sapiens
aucuccaggugccagcugcgcc

SEQ ID NO: 359926 - RNA, 22 nt, Homo sapiens
aucugcuccuggugaggguuuc

SEQ ID NO: 359927 - RNA, 22 nt, Homo sapiens
aucuggcuccuuuugacaaugc

SEQ ID NO: 359928 - RNA, 22 nt, Homo sapiens
aucugggguuggcaaaguuugg

SEQ ID NO: 359929 - RNA, 22 nt, Homo sapiens
aucuugcauuugcuaaaaugca

SEQ ID NO: 359930 - RNA, 22 nt, Homo sapiens
aucuuuaguggcuguuuucaga

SEQ ID NO: 359931 - RNA, 22 nt, Homo sapiens
aucuuuggauacuugauauagu

SEQ ID NO: 359932 - RNA, 22 nt, Homo sapiens
aucuuuggugaguucuuugguc

SEQ ID NO: 359933 - RNA, 22 nt, Homo sapiens
aucuuuggugcaugauacuuug

SEQ ID NO: 359934 - RNA, 22 nt, Homo sapiens
augaaagugauaaaugucucua

SEQ ID NO: 359935 - RNA, 22 nt, Homo sapiens
augaaaucuuuccugugaggau

SEQ ID NO: 359936 - RNA, 22 nt, Homo sapiens
augaaauguaugagucuggguu

SEQ ID NO: 359937 - RNA, 22 nt, Homo sapiens
augaaauugcuaucgcaguacu

SEQ ID NO: 359938 - RNA, 22 nt, Homo sapiens
augaagacaucgucugggauua

SEQ ID NO: 359939 - RNA, 18 nt, Homo sapiens
ugaguucauuagacuucc

SEQ ID NO: 359940 - RNA, 22 nt, Homo sapiens
ugaguuccuuucccaguccagu

SEQ ID NO: 359941 - RNA, 22 nt, Homo sapiens
ugaguucuuccuaucucugccu

SEQ ID NO: 359942 - RNA, 22 nt, Homo sapiens
ugaguucuuuguagauucugug

SEQ ID NO: 359943 - RNA, 22 nt, Homo sapiens
ugaguucuuuuagggauauugc

SEQ ID NO: 359944 - RNA, 22 nt, Homo sapiens
ugaguuguagcuauaguuucuu

SEQ ID NO: 359945 - RNA, 22 nt, Homo sapiens
ugauaacauugggggaagcuga

SEQ ID NO: 359946 - RNA, 22 nt, Homo sapiens
ugauaauguuaggcuuuauuca

SEQ ID NO: 359947 - RNA, 22 nt, Homo sapiens
ugauaucucuugccuccaaaug

SEQ ID NO: 359948 - RNA, 22 nt, Homo sapiens
ugauaugcuuugaacucucugg

SEQ ID NO: 359949 - RNA, 21 nt, Homo sapiens
ugauaugguuuggauaugugu

SEQ ID NO: 359950 - RNA, 17 nt, Homo sapiens
ugauauuuucccagaua

SEQ ID NO: 359951 - RNA, 22 nt, Homo sapiens
ugaucacagcuugacuaaagga

SEQ ID NO: 359952 - RNA, 22 nt, Homo sapiens
ugaucugucucggguuaucagu

SEQ ID NO: 359953 - RNA, 22 nt, Homo sapiens
ugaugacucuguggccccaggc

SEQ ID NO: 359954 - RNA, 22 nt, Homo sapiens
ugauggcacagugaguuccagg

SEQ ID NO: 359955 - RNA, 22 nt, Homo sapiens
ugauguugacuguaggcagaga

SEQ ID NO: 359956 - RNA, 22 nt, Homo sapiens
ugauuagagcccaagcuuugaa

SEQ ID NO: 359957 - RNA, 20 nt, Homo sapiens
ugauuaguccacuuggcucu

SEQ ID NO: 359958 - RNA, 22 nt, Homo sapiens
ugauugacauacauaggugugg

SEQ ID NO: 359959 - RNA, 18 nt, Homo sapiens
ugauugacuuauuuaggu

SEQ ID NO: 359960 - RNA, 22 nt, Homo sapiens
ugauuggagaugaauuucguuu

SEQ ID NO: 359961 - RNA, 22 nt, Homo sapiens
ugauuuccaugagaacaugccu

SEQ ID NO: 359962 - RNA, 18 nt, Homo sapiens
ugcaaacauguguguguu

SEQ ID NO: 359963 - RNA, 22 nt, Homo sapiens
ugcaaacuuccuugggcagcau

SEQ ID NO: 359964 - RNA, 22 nt, Homo sapiens
ugcaacacauugccccugcucu

SEQ ID NO: 359965 - RNA, 22 nt, Homo sapiens
ugcaaccauuguuaagugugca

SEQ ID NO: 359966 - RNA, 22 nt, Homo sapiens
ugcaauauccucuacuauaggu

SEQ ID NO: 359967 - RNA, 22 nt, Homo sapiens
ugcaccacugcacuccaggcug

SEQ ID NO: 359968 - RNA, 22 nt, Homo sapiens
ugcaccacugcacugccugggu

SEQ ID NO: 359969 - RNA, 16 nt, Homo sapiens
ugcagaguaggugaau

SEQ ID NO: 359970 - RNA, 22 nt, Homo sapiens
ugcagcacugaacuucugggcu

SEQ ID NO: 359971 - RNA, 22 nt, Homo sapiens
ugcagcauguaggcacguuauu

SEQ ID NO: 359972 - RNA, 20 nt, Homo sapiens
ugcaguguccucacuuguca

SEQ ID NO: 359973 - RNA, 22 nt, Homo sapiens
ugcagugugaaagagccugaca

SEQ ID NO: 359974 - RNA, 21 nt, Homo sapiens
ugcagugugguugcccugcug

SEQ ID NO: 359975 - RNA, 22 nt, Homo sapiens
ugcauacugaaauauuuuagag

SEQ ID NO: 359976 - RNA, 22 nt, Homo sapiens
ugcauacuguaugcgugcauac

SEQ ID NO: 359977 - RNA, 22 nt, Homo sapiens
ugcauaggagcagggucuaugu

SEQ ID NO: 359978 - RNA, 19 nt, Homo sapiens
ugcauaggguuacauacuc

SEQ ID NO: 359979 - RNA, 22 nt, Homo sapiens
ugcauauguauacaugugccau

SEQ ID NO: 359980 - RNA, 22 nt, Homo sapiens
ugcauaugucuuuauaguagca

SEQ ID NO: 359981 - RNA, 22 nt, Homo sapiens
ugcauauguucaaaguauucug

SEQ ID NO: 359982 - RNA, 22 nt, Homo sapiens
ugcaucaggcugcuuauuacaa

SEQ ID NO: 359983 - RNA, 22 nt, Homo sapiens
ugcauccauucuagacucaucu

SEQ ID NO: 359984 - RNA, 22 nt, Homo sapiens
acccuggauucguggccuugaa

SEQ ID NO: 359985 - RNA, 22 nt, Homo sapiens
acccuguaguuagaaacuuuca

SEQ ID NO: 359986 - RNA, 22 nt, Homo sapiens
acccugucauccacauggugcu

SEQ ID NO: 359987 - RNA, 22 nt, Homo sapiens
acccuguugagcaacuggccau

SEQ ID NO: 359988 - RNA, 23 nt, Homo sapiens
accugauguuucuguggggagcc

SEQ ID NO: 359989 - RNA, 22 nt, Homo sapiens
accuggguguauguucaguuug

SEQ ID NO: 359990 - RNA, 23 nt, Homo sapiens
accugugguuauuuuacucuucc

SEQ ID NO: 359991 - RNA, 22 nt, Homo sapiens
acgcagcacauucacagcuaug

SEQ ID NO: 359992 - RNA, 22 nt, Homo sapiens
acggcacugguggaaguguagc

SEQ ID NO: 359993 - RNA, 22 nt, Homo sapiens
acuacugucagacugccacuga

SEQ ID NO: 359994 - RNA, 22 nt, Homo sapiens
acuaugcuuuucuuagaauuaa

SEQ ID NO: 359995 - RNA, 22 nt, Homo sapiens
acucagagugggccccuagaua

SEQ ID NO: 359996 - RNA, 21 nt, Homo sapiens
acugagagaucuggggcacau

SEQ ID NO: 359997 - RNA, 22 nt, Homo sapiens
acugagucauugggugcccaga

SEQ ID NO: 359998 - RNA, 22 nt, Homo sapiens
acugcacuccaccuugggcaac

SEQ ID NO: 359999 - RNA, 22 nt, Homo sapiens
acugcacuccagccucccgucu

SEQ ID NO: 360000 - RNA, 22 nt, Homo sapiens
acugcacuccagccuccugaca

SEQ ID NO: 360001 - RNA, 22 nt, Homo sapiens
acugcacuccagccucggugac

SEQ ID NO: 360002 - RNA, 22 nt, Homo sapiens
acugcacuccagccuuggcggc

SEQ ID NO: 360003 - RNA, 22 nt, Homo sapiens
acugcacucccgcccgggugac

SEQ ID NO: 360004 - RNA, 22 nt, Homo sapiens
acugcacucuagccccugcgac

SEQ ID NO: 360005 - RNA, 20 nt, Homo sapiens
acuggcacugguaggugugg

SEQ ID NO: 360006 - RNA, 22 nt, Homo sapiens
acuggcauagggcgggcacagu

SEQ ID NO: 360007 - RNA, 22 nt, Homo sapiens
acuggcucugcuuuacaaacag

SEQ ID NO: 360008 - RNA, 22 nt, Homo sapiens
acugguguaugggaggucccaa

SEQ ID NO: 360009 - RNA, 22 nt, Homo sapiens
acuguacuccauccugggugac

SEQ ID NO: 360010 - RNA, 22 nt, Homo sapiens
acuucauucucuggaucagaau

SEQ ID NO: 360011 - RNA, 22 nt, Homo sapiens
acuugacacuuauauuacucac

SEQ ID NO: 360012 - RNA, 22 nt, Homo sapiens
acuuuuugauggggagaacauu

SEQ ID NO: 360013 - RNA, 22 nt, Homo sapiens
agaaacacagguggaauugcuu

SEQ ID NO: 360014 - RNA, 22 nt, Homo sapiens
agaaacauucucuugccuccuu

SEQ ID NO: 360015 - RNA, 22 nt, Homo sapiens
agaaauguuuacucacccccuu

SEQ ID NO: 360016 - RNA, 22 nt, Homo sapiens
agaacacugaguucagggucag

SEQ ID NO: 360017 - RNA, 22 nt, Homo sapiens
ugagaugaacuugauuguuuua

SEQ ID NO: 360018 - RNA, 22 nt, Homo sapiens
ugagaugagucucgcucuguca

SEQ ID NO: 360019 - RNA, 22 nt, Homo sapiens
ugagaugaguugcgcucugucg

SEQ ID NO: 360020 - RNA, 22 nt, Homo sapiens
ugagaugauagauauguuaauu

SEQ ID NO: 360021 - RNA, 22 nt, Homo sapiens
ugagauggaucuuggauuugaa

SEQ ID NO: 360022 - RNA, 22 nt, Homo sapiens
ugagauggguaauuaaauggug

SEQ ID NO: 360023 - RNA, 22 nt, Homo sapiens
ugagauguaaucucgcucuguc

SEQ ID NO: 360024 - RNA, 22 nt, Homo sapiens
ugagaugugaagaucacaugaa

SEQ ID NO: 360025 - RNA, 22 nt, Homo sapiens
ugagauguugcucugaaacaag

SEQ ID NO: 360026 - RNA, 22 nt, Homo sapiens
ugagauuacguucggcccacuu

SEQ ID NO: 360027 - RNA, 22 nt, Homo sapiens
ugagauuguaucugcaaugugu

SEQ ID NO: 360028 - RNA, 23 nt, Homo sapiens
ugagcaauauucuacuauugagu

SEQ ID NO: 360029 - RNA, 22 nt, Homo sapiens
ugagcagagaagugcccugcgc

SEQ ID NO: 360030 - RNA, 22 nt, Homo sapiens
ugagcagugagugugcugcagg

SEQ ID NO: 360031 - RNA, 22 nt, Homo sapiens
ugagccaaugauuugaauagag

SEQ ID NO: 360032 - RNA, 23 nt, Homo sapiens
ugagccaugggacuccaagggag

SEQ ID NO: 360033 - RNA, 22 nt, Homo sapiens
ugagcccauuguccugguuuau

SEQ ID NO: 360034 - RNA, 20 nt, Homo sapiens
ugagcucaauuguugcaagu

SEQ ID NO: 360035 - RNA, 22 nt, Homo sapiens
ugagcucaguauuucauaaaca

SEQ ID NO: 360036 - RNA, 22 nt, Homo sapiens
ugagcugagacaauaaguuuuu

SEQ ID NO: 360037 - RNA, 22 nt, Homo sapiens
ugagcugagaucacacuacugu

SEQ ID NO: 360038 - RNA, 22 nt, Homo sapiens
ugagcugagaucgugccauugu

SEQ ID NO: 360039 - RNA, 22 nt, Homo sapiens
ugagcuguuugaagaagcauuu

SEQ ID NO: 360040 - RNA, 18 nt, Homo sapiens
ugaggaaaggguuugcua

SEQ ID NO: 360041 - RNA, 22 nt, Homo sapiens
ugaggagugaacuauuucugau

SEQ ID NO: 360042 - RNA, 22 nt, Homo sapiens
ugaggagugagaaauugguuuc

SEQ ID NO: 360043 - RNA, 22 nt, Homo sapiens
ugagguaucauugcccaggcug

SEQ ID NO: 360044 - RNA, 22 nt, Homo sapiens
ugagguauuuuguuaugcagcc

SEQ ID NO: 360045 - RNA, 22 nt, Homo sapiens
ugaggucacuuguuuuaugcuu

SEQ ID NO: 360046 - RNA, 22 nt, Homo sapiens
ugaggugagggguuaggugcua

SEQ ID NO: 360047 - RNA, 22 nt, Homo sapiens
ugaggugaggguaucaaaugcu

SEQ ID NO: 360048 - RNA, 23 nt, Homo sapiens
ugagguguuaagcagacuugucu

SEQ ID NO: 360049 - RNA, 22 nt, Homo sapiens
ugagguguuauccagaguucuu

SEQ ID NO: 360050 - RNA, 22 nt, Homo sapiens
ugagguugaaggacauuuuuau

SEQ ID NO: 360051 - RNA, 22 nt, Homo sapiens
ugagguuggguaauuuaugaag

SEQ ID NO: 360052 - RNA, 22 nt, Homo sapiens
ugaguagagaauucagcuaagg

SEQ ID NO: 360053 - RNA, 22 nt, Homo sapiens
ugaguagcuaauguuuacugag

SEQ ID NO: 360054 - RNA, 22 nt, Homo sapiens
ugaguagugcugcaauaaacau

SEQ ID NO: 360055 - RNA, 22 nt, Homo sapiens
ugaguauguuuaaugugacaau

SEQ ID NO: 360056 - RNA, 22 nt, Homo sapiens
ugagucgagauugcgccacugu

SEQ ID NO: 360057 - RNA, 22 nt, Homo sapiens
ugagugaacgcugagaccaaau

SEQ ID NO: 360058 - RNA, 22 nt, Homo sapiens
ugagugaaugugaaggcuaggg

SEQ ID NO: 360059 - RNA, 22 nt, Homo sapiens
ugaguguguaugugcauacaca

SEQ ID NO: 360060 - RNA, 22 nt, Homo sapiens
ugaguucauggucauuugucac

SEQ ID NO: 360061 - RNA, 18 nt, Homo sapiens
agcucaguguuugcuuac

SEQ ID NO: 360062 - RNA, 20 nt, Homo sapiens
agcuccauuccugaaggcug

SEQ ID NO: 360063 - RNA, 22 nt, Homo sapiens
agcuccauuguaaucaccuggu

SEQ ID NO: 360064 - RNA, 22 nt, Homo sapiens
agcuccuacuguuacaucauug

SEQ ID NO: 360065 - RNA, 22 nt, Homo sapiens
agcugcacgugguaaauguaaa

SEQ ID NO: 360066 - RNA, 20 nt, Homo sapiens
agcugcagauauaaauccgc

SEQ ID NO: 360067 - RNA, 22 nt, Homo sapiens
agcuggauuguuuaccuggggc

SEQ ID NO: 360068 - RNA, 20 nt, Homo sapiens
agcuggguguguuggugcau

SEQ ID NO: 360069 - RNA, 22 nt, Homo sapiens
agcugguaguuuucuaguguuu

SEQ ID NO: 360070 - RNA, 22 nt, Homo sapiens
agcugguauuuugucgaggacu

SEQ ID NO: 360071 - RNA, 22 nt, Homo sapiens
agcuuaugcuuggaagagauga

SEQ ID NO: 360072 - RNA, 22 nt, Homo sapiens
agcuucauuccaacuuccuucu

SEQ ID NO: 360073 - RNA, 22 nt, Homo sapiens
agcuugugauucuccaucaugu

SEQ ID NO: 360074 - RNA, 22 nt, Homo sapiens
agcuugugcuguaugaagggcc

SEQ ID NO: 360075 - RNA, 22 nt, Homo sapiens
agcuuguguuuuucuaaguauc

SEQ ID NO: 360076 - RNA, 22 nt, Homo sapiens
aggaagacauauagaacuaaaa

SEQ ID NO: 360077 - RNA, 23 nt, Homo sapiens
aggaaguaacuaucuuuucuguc

SEQ ID NO: 360078 - RNA, 22 nt, Homo sapiens
aggaaguaauaaguuugguucu

SEQ ID NO: 360079 - RNA, 22 nt, Homo sapiens
aggaaucuaagguaucagguua

SEQ ID NO: 360080 - RNA, 22 nt, Homo sapiens
aggacacugagcaugggagguu

SEQ ID NO: 360081 - RNA, 22 nt, Homo sapiens
aggacacugauagucuuuggca

SEQ ID NO: 360082 - RNA, 22 nt, Homo sapiens
aggaccccucaucagcaccagu

SEQ ID NO: 360083 - RNA, 22 nt, Homo sapiens
aggagaauugguucuucuugau

SEQ ID NO: 360084 - RNA, 22 nt, Homo sapiens
aggagcacuggccuuggaguca

SEQ ID NO: 360085 - RNA, 22 nt, Homo sapiens
aggagguaggaauugugcuagg

SEQ ID NO: 360086 - RNA, 22 nt, Homo sapiens
aggagguagggugugaaacagc

SEQ ID NO: 360087 - RNA, 22 nt, Homo sapiens
aggaguguguauuaaugaaauu

SEQ ID NO: 360088 - RNA, 21 nt, Homo sapiens
aggcaaaugaagcagccgcuc

SEQ ID NO: 360089 - RNA, 22 nt, Homo sapiens
aggcaaaugccagcaaucacac

SEQ ID NO: 360090 - RNA, 22 nt, Homo sapiens
aggcaacaugguaaaacccugu

SEQ ID NO: 360091 - RNA, 21 nt, Homo sapiens
aggcaagguguuauuauugaa

SEQ ID NO: 360092 - RNA, 22 nt, Homo sapiens
uucuagcacuuugggagacuga

SEQ ID NO: 360093 - RNA, 20 nt, Homo sapiens
uucuaguacuucuguuucca

SEQ ID NO: 360094 - RNA, 22 nt, Homo sapiens
uucuauguuugaaaaugccaaa

SEQ ID NO: 360095 - RNA, 22 nt, Homo sapiens
uucucagugaacuccagcuugu

SEQ ID NO: 360096 - RNA, 22 nt, Homo sapiens
uucucagugaaguuuagaacau

SEQ ID NO: 360097 - RNA, 22 nt, Homo sapiens
uucucaguuccuacuuugguga

SEQ ID NO: 360098 - RNA, 22 nt, Homo sapiens
uucucauggugauggcaaaauc

SEQ ID NO: 360099 - RNA, 22 nt, Homo sapiens
uucugccaaucaacccacaucc

SEQ ID NO: 360100 - RNA, 22 nt, Homo sapiens
uucugguuaauacuugcaaaaa

SEQ ID NO: 360101 - RNA, 22 nt, Homo sapiens
uucugugguugaaaggagagau

SEQ ID NO: 360102 - RNA, 22 nt, Homo sapiens
uucuuagucaaguuguauuuca

SEQ ID NO: 360103 - RNA, 22 nt, Homo sapiens
uucuuagucauguaauagucca

SEQ ID NO: 360104 - RNA, 21 nt, Homo sapiens
uucuucaggcagaaggauuau

SEQ ID NO: 360105 - RNA, 22 nt, Homo sapiens
uucuucaggcauucccagaagc

SEQ ID NO: 360106 - RNA, 20 nt, Homo sapiens
uucuugaguuaacaaguuac

SEQ ID NO: 360107 - RNA, 22 nt, Homo sapiens
uucuugcacuuggcccucauua

SEQ ID NO: 360108 - RNA, 22 nt, Homo sapiens
uucuuuaguucacuugcuccag

SEQ ID NO: 360109 - RNA, 22 nt, Homo sapiens
uucuuuggauaaaguuuuaugc

SEQ ID NO: 360110 - RNA, 22 nt, Homo sapiens
uugaaaguaaacaucacaaaga

SEQ ID NO: 360111 - RNA, 22 nt, Homo sapiens
uugaaagucauuucuucuaagu

SEQ ID NO: 360112 - RNA, 22 nt, Homo sapiens
uugaagacuauaugauucuuca

SEQ ID NO: 360113 - RNA, 22 nt, Homo sapiens
uugaaguagcauuucaugucua

SEQ ID NO: 360114 - RNA, 22 nt, Homo sapiens
uugaagugaagaacaauaucac

SEQ ID NO: 360115 - RNA, 22 nt, Homo sapiens
uugaauaggcucaugcuuauca

SEQ ID NO: 360116 - RNA, 22 nt, Homo sapiens
uugaauguaugcuggguuuacu

SEQ ID NO: 360117 - RNA, 23 nt, Homo sapiens
uugaauguuuccccucccaaauu

SEQ ID NO: 360118 - RNA, 22 nt, Homo sapiens
uugacaaugcacugugcuaagu

SEQ ID NO: 360119 - RNA, 22 nt, Homo sapiens
uugacacuaauuauuauaggug

SEQ ID NO: 360120 - RNA, 20 nt, Homo sapiens
uugacaguggguuguuaaag

SEQ ID NO: 360121 - RNA, 22 nt, Homo sapiens
uugacauaguuucugaaauaga

SEQ ID NO: 360122 - RNA, 22 nt, Homo sapiens
uugacauugcuguaguguccag

SEQ ID NO: 360123 - RNA, 22 nt, Homo sapiens
uugaccacugggcacaguaagu

SEQ ID NO: 360124 - RNA, 22 nt, Homo sapiens
uugacuagaccaucuuucuaga

SEQ ID NO: 360125 - RNA, 22 nt, Homo sapiens
uugacugugguaauggaagcug

SEQ ID NO: 360126 - RNA, 22 nt, Homo sapiens
uugagacgaagucucacucuug

SEQ ID NO: 360127 - RNA, 22 nt, Homo sapiens
uugagacggagucucacucugu

SEQ ID NO: 360128 - RNA, 22 nt, Homo sapiens
uugagacggagucuugcucuuu

SEQ ID NO: 360129 - RNA, 22 nt, Homo sapiens
uugagagagaacauuuguuaca

SEQ ID NO: 360130 - RNA, 22 nt, Homo sapiens
uugagauggagucucacgcauu

SEQ ID NO: 360131 - RNA, 22 nt, Homo sapiens
uugagauggagucucacucugu

SEQ ID NO: 360132 - RNA, 22 nt, Homo sapiens
uugagauggagucucgcacugu

SEQ ID NO: 360133 - RNA, 22 nt, Homo sapiens
uugagauggagucucgcucuuu

SEQ ID NO: 360134 - RNA, 22 nt, Homo sapiens
uugagauggaguucauuuuugu

SEQ ID NO: 360135 - RNA, 22 nt, Homo sapiens
uugagauggaguuucacucugu

SEQ ID NO: 360136 - RNA, 22 nt, Homo sapiens
uugagauggaguuucgcucuuu

SEQ ID NO: 360137 - RNA, 22 nt, Homo sapiens
uugagauuauuguguuccuuua

SEQ ID NO: 360138 - RNA, 22 nt, Homo sapiens
uugagcaauccuccugccaugu

SEQ ID NO: 360139 - RNA, 22 nt, Homo sapiens
uugagcaccaugccuggccaug

SEQ ID NO: 360140 - RNA, 22 nt, Homo sapiens
uugagccaaggauugucuuucc

SEQ ID NO: 360141 - RNA, 22 nt, Homo sapiens
uugagcucaucuucagggguga

SEQ ID NO: 360142 - RNA, 21 nt, Homo sapiens
uugagcuuuuaguacagacag

SEQ ID NO: 360143 - RNA, 22 nt, Homo sapiens
uugagcuuuuuacuuguccaau

SEQ ID NO: 360144 - RNA, 22 nt, Homo sapiens
uugaggaaugugauuucaaaua

SEQ ID NO: 360145 - RNA, 22 nt, Homo sapiens
uugaggaggcagucucuccauu

SEQ ID NO: 360146 - RNA, 22 nt, Homo sapiens
uugaggaggcagucugcccauu

SEQ ID NO: 360147 - RNA, 22 nt, Homo sapiens
uugaggcuuuugaccucaugug

SEQ ID NO: 360148 - RNA, 22 nt, Homo sapiens
uugagguaauaaacagccauuc

SEQ ID NO: 360149 - RNA, 22 nt, Homo sapiens
uugagguaggaggagcuuggau

SEQ ID NO: 360150 - RNA, 22 nt, Homo sapiens
uugagguauuuugucaacugua

SEQ ID NO: 360151 - RNA, 22 nt, Homo sapiens
uugaggugggaggaucacuuga

SEQ ID NO: 360152 - RNA, 22 nt, Homo sapiens
uugagguggugucuugcucugu

SEQ ID NO: 360153 - RNA, 22 nt, Homo sapiens
uugaguaguaagugguucaccg

SEQ ID NO: 360154 - RNA, 22 nt, Homo sapiens
uugaguccauucgaugcugauu

SEQ ID NO: 360155 - RNA, 22 nt, Homo sapiens
uugauaguccuguaucuauuuu

SEQ ID NO: 360156 - RNA, 22 nt, Homo sapiens
uugauugacaugucucuguuca

SEQ ID NO: 360157 - RNA, 22 nt, Homo sapiens
uugcaaaguugccaaggaagga

SEQ ID NO: 360158 - RNA, 22 nt, Homo sapiens
uugcaaaucucuuguguuuggu

SEQ ID NO: 360159 - RNA, 21 nt, Homo sapiens
uugcaaaugcugcugccugau

SEQ ID NO: 360160 - RNA, 22 nt, Homo sapiens
uugcaacauuguaaguuuauau

SEQ ID NO: 360161 - RNA, 22 nt, Homo sapiens
uugcaagaaaucagagccuucc

SEQ ID NO: 360162 - RNA, 22 nt, Homo sapiens
uugcaagaaaugcagauucuca

SEQ ID NO: 360163 - RNA, 22 nt, Homo sapiens
uugcacaauccugugagugagu

SEQ ID NO: 360164 - RNA, 20 nt, Homo sapiens
uugcacagagaaggaggcag

SEQ ID NO: 360165 - RNA, 22 nt, Homo sapiens
uugcacagugcuuucuuugccc

SEQ ID NO: 360166 - RNA, 22 nt, Homo sapiens
uugcacaguguguacagcacca

SEQ ID NO: 360167 - RNA, 22 nt, Homo sapiens
uugcacauggcuggggaggccu

SEQ ID NO: 360168 - RNA, 22 nt, Homo sapiens
uugcacauguugaaccagcaaa

SEQ ID NO: 360169 - RNA, 22 nt, Homo sapiens
uugcacauugauuuuguaucuu

SEQ ID NO: 360170 - RNA, 22 nt, Homo sapiens
uugcagcaaagagggaggggca

SEQ ID NO: 360171 - RNA, 22 nt, Homo sapiens
uugcagcaacauggaugaaacu

SEQ ID NO: 360172 - RNA, 22 nt, Homo sapiens
uugcagcauucugguuccuggu

SEQ ID NO: 360173 - RNA, 22 nt, Homo sapiens
uugcaggcaugagccaccgugc

SEQ ID NO: 360174 - RNA, 22 nt, Homo sapiens
uugcaguagucugaaagcaaua

SEQ ID NO: 360175 - RNA, 22 nt, Homo sapiens
uugcauauguugaaccaagcgu

SEQ ID NO: 360176 - RNA, 22 nt, Homo sapiens
uugcaucagcaggcauaauugg

SEQ ID NO: 360177 - RNA, 22 nt, Homo sapiens
uugcaugguggaacuuggagcu

SEQ ID NO: 360178 - RNA, 22 nt, Homo sapiens
uugcauuguacuugguacggcu

SEQ ID NO: 360179 - RNA, 22 nt, Homo sapiens
aggcaagugggagacagcauuu

SEQ ID NO: 360180 - RNA, 22 nt, Homo sapiens
aggcaaugugagaguuuauuca

SEQ ID NO: 360181 - RNA, 22 nt, Homo sapiens
aggcacacaacccuggaccuga

SEQ ID NO: 360182 - RNA, 22 nt, Homo sapiens
aggcaguuucagugagagguga

SEQ ID NO: 360183 - RNA, 22 nt, Homo sapiens
aggcauggagacuaaaauuaua

SEQ ID NO: 360184 - RNA, 22 nt, Homo sapiens
aggcaugguggcacauacaugu

SEQ ID NO: 360185 - RNA, 22 nt, Homo sapiens
aggcugguauuuacaaaagcuc

SEQ ID NO: 360186 - RNA, 22 nt, Homo sapiens
aggcuuuauuacagggucucag

SEQ ID NO: 360187 - RNA, 22 nt, Homo sapiens
agggagcaaaguggucuuucuc

SEQ ID NO: 360188 - RNA, 22 nt, Homo sapiens
agggccuuuguagauguacuca

SEQ ID NO: 360189 - RNA, 22 nt, Homo sapiens
agguauuuuuuauccuccagca

SEQ ID NO: 360190 - RNA, 22 nt, Homo sapiens
aggugcugacaggauagguuuc

SEQ ID NO: 360191 - RNA, 22 nt, Homo sapiens
aggugcuugaaucuaugagcuc

SEQ ID NO: 360192 - RNA, 22 nt, Homo sapiens
aggugguuuuaggcagagacau

SEQ ID NO: 360193 - RNA, 22 nt, Homo sapiens
aguaacauuucuaguagagagu

SEQ ID NO: 360194 - RNA, 22 nt, Homo sapiens
aguaaucaucugagggcagaaa

SEQ ID NO: 360195 - RNA, 21 nt, Homo sapiens
aguagcacugugucuuacaaa

SEQ ID NO: 360196 - RNA, 22 nt, Homo sapiens
aguaucaagccacacaugguca

SEQ ID NO: 360197 - RNA, 22 nt, Homo sapiens
agucaaggaggccuuucagaug

SEQ ID NO: 360198 - RNA, 22 nt, Homo sapiens
agucaagugguuucugaguugg

SEQ ID NO: 360199 - RNA, 22 nt, Homo sapiens
agucacagccuuuuacuuuaga

SEQ ID NO: 360200 - RNA, 22 nt, Homo sapiens
agucacagguucuugggauuag

SEQ ID NO: 360201 - RNA, 22 nt, Homo sapiens
agucaguguguauugauggcac

SEQ ID NO: 360202 - RNA, 21 nt, Homo sapiens
agucauaggaguacauaaugc

SEQ ID NO: 360203 - RNA, 22 nt, Homo sapiens
agucauggaucacaguagccuc

SEQ ID NO: 360204 - RNA, 22 nt, Homo sapiens
agucaugguaguaaauuuggac

SEQ ID NO: 360205 - RNA, 22 nt, Homo sapiens
agugaaaucugaagaaggucau

SEQ ID NO: 360206 - RNA, 22 nt, Homo sapiens
agugaacacagcuucuuugguu

SEQ ID NO: 360207 - RNA, 22 nt, Homo sapiens
agugcaguggcacaaucuuggc

SEQ ID NO: 360208 - RNA, 22 nt, Homo sapiens
agugcaguggcucaaaaugccu

SEQ ID NO: 360209 - RNA, 22 nt, Homo sapiens
agugcaguggugccaucauaac

SEQ ID NO: 360210 - RNA, 22 nt, Homo sapiens
agugcaguugucacgugccuuc

SEQ ID NO: 360211 - RNA, 22 nt, Homo sapiens
agugcauugagacuugugaguu

SEQ ID NO: 360212 - RNA, 22 nt, Homo sapiens
aguggcacaauuuugacucccc

SEQ ID NO: 360213 - RNA, 22 nt, Homo sapiens
aguggcuuuuuaguggcagaug

SEQ ID NO: 360214 - RNA, 22 nt, Homo sapiens
aguggugucugaguggccaggg

SEQ ID NO: 360215 - RNA, 22 nt, Homo sapiens
aguguuuuuaacaagaaagggu

SEQ ID NO: 360216 - RNA, 22 nt, Homo sapiens
aguguuuuuaucaugaaagggu

SEQ ID NO: 360217 - RNA, 22 nt, Homo sapiens
aguuagcaaaacucccaaaggu

SEQ ID NO: 360218 - RNA, 21 nt, Homo sapiens
aguucacauggcuccuguguu

SEQ ID NO: 360219 - RNA, 22 nt, Homo sapiens
aguuggcacugagcugugauug

SEQ ID NO: 360220 - RNA, 22 nt, Homo sapiens
aguuggccccuacugggaggug

SEQ ID NO: 360221 - RNA, 22 nt, Homo sapiens
aguuuuugcugauagcaugcuu

SEQ ID NO: 360222 - RNA, 22 nt, Homo sapiens
auaaacagcuuauccucuauuc

SEQ ID NO: 360223 - RNA, 22 nt, Homo sapiens
auaaaccuacauuuucacuucu

SEQ ID NO: 360224 - RNA, 17 nt, Homo sapiens
auaaacucaucauuuuu

SEQ ID NO: 360225 - RNA, 22 nt, Homo sapiens
auaaagacacuuggcaugauuu

SEQ ID NO: 360226 - RNA, 22 nt, Homo sapiens
auaaagcaagucucuggccuca

SEQ ID NO: 360227 - RNA, 22 nt, Homo sapiens
auaaaguagaggugaggugcau

SEQ ID NO: 360228 - RNA, 22 nt, Homo sapiens
auaaaugccuguuguuuuaagc

SEQ ID NO: 360229 - RNA, 22 nt, Homo sapiens
auaacauggaguuugucauuua

SEQ ID NO: 360230 - RNA, 22 nt, Homo sapiens
auaaggcuaguguaggagccag

SEQ ID NO: 360231 - RNA, 22 nt, Homo sapiens
auaaugacuuccaguuccacuc

SEQ ID NO: 360232 - RNA, 22 nt, Homo sapiens
auaauguuuauccagaggaguu

SEQ ID NO: 360233 - RNA, 22 nt, Homo sapiens
auacaaguuauuugaacugcgg

SEQ ID NO: 360234 - RNA, 22 nt, Homo sapiens
auacacuagggcuccugcagaa

SEQ ID NO: 360235 - RNA, 22 nt, Homo sapiens
auacaguaaugucuuaggcugu

SEQ ID NO: 360236 - RNA, 22 nt, Homo sapiens
auacaucugccauguuggugug

SEQ ID NO: 360237 - RNA, 22 nt, Homo sapiens
auacaugugucauguugguuug

SEQ ID NO: 360238 - RNA, 22 nt, Homo sapiens
auacauguuucauguuggugug

SEQ ID NO: 360239 - RNA, 22 nt, Homo sapiens
uuuagcaaugcuguggggaagu

SEQ ID NO: 360240 - RNA, 22 nt, Homo sapiens
uuuagcaauucauuuugugucu

SEQ ID NO: 360241 - RNA, 22 nt, Homo sapiens
uuuagcucauucaauuucaguc

SEQ ID NO: 360242 - RNA, 22 nt, Homo sapiens
uuuagggcaggccuggugguga

SEQ ID NO: 360243 - RNA, 22 nt, Homo sapiens
uuuagguuacauauaauccaaa

SEQ ID NO: 360244 - RNA, 22 nt, Homo sapiens
uuuaucaggccuuuggaaaaau

SEQ ID NO: 360245 - RNA, 21 nt, Homo sapiens
uuucacugugaguuuuucugu

SEQ ID NO: 360246 - RNA, 22 nt, Homo sapiens
uuucauagccuucuaaugaguu

SEQ ID NO: 360247 - RNA, 22 nt, Homo sapiens
uuucauggaggauuugcuucuu

SEQ ID NO: 360248 - RNA, 22 nt, Homo sapiens
uuuccuguagggggcaaggccu

SEQ ID NO: 360249 - RNA, 22 nt, Homo sapiens
uuucgugucuggucugugaugg

SEQ ID NO: 360250 - RNA, 22 nt, Homo sapiens
uuucuacagugaacgauuucua

SEQ ID NO: 360251 - RNA, 20 nt, Homo sapiens
uuucuccccuauaaaucuca

SEQ ID NO: 360252 - RNA, 22 nt, Homo sapiens
uuucugagaccaaaacuuguaa

SEQ ID NO: 360253 - RNA, 22 nt, Homo sapiens
uuucugaggccucaccagaagc

SEQ ID NO: 360254 - RNA, 22 nt, Homo sapiens
uuugaagacuacugggagugaa

SEQ ID NO: 360255 - RNA, 22 nt, Homo sapiens
uuugaagcaauugugaauggga

SEQ ID NO: 360256 - RNA, 22 nt, Homo sapiens
uuugaagcuaaggugcuugguu

SEQ ID NO: 360257 - RNA, 22 nt, Homo sapiens
uuugaagugugaugccuugaug

SEQ ID NO: 360258 - RNA, 19 nt, Homo sapiens
uuugaauauaaugcagcua

SEQ ID NO: 360259 - RNA, 22 nt, Homo sapiens
uuugaauguaaugagcaggaag

SEQ ID NO: 360260 - RNA, 22 nt, Homo sapiens
uuugagcaugcagauugccagg

SEQ ID NO: 360261 - RNA, 23 nt, Homo sapiens
uuugagugugauaaacacuguca

SEQ ID NO: 360262 - RNA, 22 nt, Homo sapiens
uuugcaauagguuguggggagg

SEQ ID NO: 360263 - RNA, 22 nt, Homo sapiens
uuugcaauguugugauggugaa

SEQ ID NO: 360264 - RNA, 22 nt, Homo sapiens
uuugcaccuuccuaguggcuga

SEQ ID NO: 360265 - RNA, 22 nt, Homo sapiens
augaauagaguuaauugaguac

SEQ ID NO: 360266 - RNA, 21 nt, Homo sapiens
augaauguaaagaauguggga

SEQ ID NO: 360267 - RNA, 23 nt, Homo sapiens
augaauguaaggaguguaagaaa

SEQ ID NO: 360268 - RNA, 22 nt, Homo sapiens
augacagcaucugugaaguugu

SEQ ID NO: 360269 - RNA, 22 nt, Homo sapiens
augacaguguggauuauuguaa

SEQ ID NO: 360270 - RNA, 22 nt, Homo sapiens
augacauugaaaagcaagugga

SEQ ID NO: 360271 - RNA, 22 nt, Homo sapiens
augaccaaugggcagagcuaga

SEQ ID NO: 360272 - RNA, 22 nt, Homo sapiens
augacuuuucugaaaaccacca

SEQ ID NO: 360273 - RNA, 22 nt, Homo sapiens
augagaacauaucaagugauug

SEQ ID NO: 360274 - RNA, 22 nt, Homo sapiens
augagaauguaaguuaaugaaa

SEQ ID NO: 360275 - RNA, 22 nt, Homo sapiens
augagaccagcagaaaaccugu

SEQ ID NO: 360276 - RNA, 22 nt, Homo sapiens
augagagcaacaccuucacuug

SEQ ID NO: 360277 - RNA, 22 nt, Homo sapiens
augagagcuaacuguggguaca

SEQ ID NO: 360278 - RNA, 22 nt, Homo sapiens
augagauauguuaaaaguuaaa

SEQ ID NO: 360279 - RNA, 22 nt, Homo sapiens
augagaugaauaccgacgaugu

SEQ ID NO: 360280 - RNA, 22 nt, Homo sapiens
augagcagaugcuccugccucu

SEQ ID NO: 360281 - RNA, 22 nt, Homo sapiens
augaggaagucaggcccagggg

SEQ ID NO: 360282 - RNA, 22 nt, Homo sapiens
augaggagguaugauuuucuga

SEQ ID NO: 360283 - RNA, 22 nt, Homo sapiens
augaggugaggucaguaaggua

SEQ ID NO: 360284 - RNA, 21 nt, Homo sapiens
augagguguacuguggugaaa

SEQ ID NO: 360285 - RNA, 22 nt, Homo sapiens
augaguaugagaauacauuaag

SEQ ID NO: 360286 - RNA, 22 nt, Homo sapiens
augauacuguucuaagauuuuu

SEQ ID NO: 360287 - RNA, 22 nt, Homo sapiens
augauaugagaaaggaucaaca

SEQ ID NO: 360288 - RNA, 22 nt, Homo sapiens
augaugcaguacuuugggaaca

SEQ ID NO: 360289 - RNA, 22 nt, Homo sapiens
uuugcacuucugagugugacau

SEQ ID NO: 360290 - RNA, 22 nt, Homo sapiens
uuugccaauauuuuauugagga

SEQ ID NO: 360291 - RNA, 18 nt, Homo sapiens
uuugccacuucccagaaa

SEQ ID NO: 360292 - RNA, 19 nt, Homo sapiens
uuugccuaggcacauggcc

SEQ ID NO: 360293 - RNA, 22 nt, Homo sapiens
uuuggacuucuagccuccagag

SEQ ID NO: 360294 - RNA, 22 nt, Homo sapiens
uuuggauagugugguccuuuua

SEQ ID NO: 360295 - RNA, 22 nt, Homo sapiens
uuuggcaauuugacuguauagg

SEQ ID NO: 360296 - RNA, 22 nt, Homo sapiens
uuuggcagaaaacuaaaaggua

SEQ ID NO: 360297 - RNA, 22 nt, Homo sapiens
uuuggccauguuggucaggcug

SEQ ID NO: 360298 - RNA, 22 nt, Homo sapiens
uuuggcccugagggauggcaua

SEQ ID NO: 360299 - RNA, 22 nt, Homo sapiens
uuuggcuguuucuggacuaaga

SEQ ID NO: 360300 - RNA, 22 nt, Homo sapiens
uuuggcuuuuguaauaacugcc

SEQ ID NO: 360301 - RNA, 22 nt, Homo sapiens
uuugggaaaugaaguugguaga

SEQ ID NO: 360302 - RNA, 22 nt, Homo sapiens
uuugggaaugaguuuaucauuu

SEQ ID NO: 360303 - RNA, 22 nt, Homo sapiens
uuugggaaugguuugucuccca

SEQ ID NO: 360304 - RNA, 22 nt, Homo sapiens
uuuggguuaguuuuccaaucuu

SEQ ID NO: 360305 - RNA, 22 nt, Homo sapiens
uuuggucccaaugugauaaggu

SEQ ID NO: 360306 - RNA, 22 nt, Homo sapiens
uuugguccuccuacagggcagg

SEQ ID NO: 360307 - RNA, 22 nt, Homo sapiens
uuugguguauaaaaaugcuagu

SEQ ID NO: 360308 - RNA, 22 nt, Homo sapiens
uuugguugucacaacuggggga

SEQ ID NO: 360309 - RNA, 22 nt, Homo sapiens
uuuguaagaugcauagauugca

SEQ ID NO: 360310 - RNA, 22 nt, Homo sapiens
uuuguaauccuauuccaaagga

SEQ ID NO: 360311 - RNA, 22 nt, Homo sapiens
uuuguacuaugguuuuucacua

SEQ ID NO: 360312 - RNA, 23 nt, Homo sapiens
uuuguacuaugucaguuuagaua

SEQ ID NO: 360313 - RNA, 22 nt, Homo sapiens
uuuguacugagccaagauggua

SEQ ID NO: 360314 - RNA, 22 nt, Homo sapiens
uuuguagcuacaaagugagaug

SEQ ID NO: 360315 - RNA, 22 nt, Homo sapiens
uuugucccucucaccaacgggg

SEQ ID NO: 360316 - RNA, 22 nt, Homo sapiens
uuugugcuaaugcuagauuacu

SEQ ID NO: 360317 - RNA, 16 nt, Homo sapiens
uuugugugugacgaga

SEQ ID NO: 360318 - RNA, 22 nt, Homo sapiens
uuugugugugauuauaaaaggu

SEQ ID NO: 360319 - RNA, 22 nt, Homo sapiens
uuuguucaccucaaggauggga

SEQ ID NO: 360320 - RNA, 22 nt, Homo sapiens
uuuguuugaagucgagacaacu

SEQ ID NO: 360321 - RNA, 22 nt, Homo sapiens
uuuuaguugcucagguauucuc

SEQ ID NO: 360322 - RNA, 22 nt, Homo sapiens
uuuuaugggcuauuugcauuag

SEQ ID NO: 360323 - RNA, 23 nt, Homo sapiens
uuuugcaauaagucacuggaaua

SEQ ID NO: 360324 - RNA, 22 nt, Homo sapiens
uuuugcaauauguuccugaaua

SEQ ID NO: 360325 - RNA, 22 nt, Homo sapiens
uuuugcaccauccuaauaguau

SEQ ID NO: 360326 - RNA, 20 nt, Homo sapiens
uuuugcacuccuacuaaggu

SEQ ID NO: 360327 - RNA, 22 nt, Homo sapiens
uuuugcaguuacagagagugag

SEQ ID NO: 360328 - RNA, 22 nt, Homo sapiens
uuuugcucuucauagguccugu

SEQ ID NO: 360329 - RNA, 19 nt, Homo sapiens
uuuuggaaaugugaacagc

SEQ ID NO: 360330 - RNA, 20 nt, Homo sapiens
uuuuggacuaaaggcauccc

SEQ ID NO: 360331 - RNA, 22 nt, Homo sapiens
uuuuggcuuaaagagaauguau

SEQ ID NO: 360332 - RNA, 22 nt, Homo sapiens
uuuuggugguuaugugucaaug

SEQ ID NO: 360333 - RNA, 22 nt, Homo sapiens
uuuuguacgccuguguccauca

SEQ ID NO: 360334 - RNA, 22 nt, Homo sapiens
uuuugugacuauuguaaauggg

SEQ ID NO: 360335 - RNA, 22 nt, Homo sapiens
uuuuugguugguaggcuauuaa

SEQ ID NO: 360336 - RNA, 23 nt, Homo sapiens
uuuuuguguuucauggaaauagg

SEQ ID NO: 360337 - RNA, 22 nt, Homo sapiens
augauggagguagauuguccau

SEQ ID NO: 360338 - RNA, 22 nt, Homo sapiens
augauguguguuuaagaugucu

SEQ ID NO: 360339 - RNA, 22 nt, Homo sapiens
augauucugaucuagagcuugg

SEQ ID NO: 360340 - RNA, 22 nt, Homo sapiens
augcaaacaucauagaguguac

SEQ ID NO: 360341 - RNA, 22 nt, Homo sapiens
augcaagaaauaucucuuuuuc

SEQ ID NO: 360342 - RNA, 22 nt, Homo sapiens
augcaagacaccacgugagaau

SEQ ID NO: 360343 - RNA, 22 nt, Homo sapiens
augcaagcacacaagaggaaau

SEQ ID NO: 360344 - RNA, 22 nt, Homo sapiens
augcacaugcgaaaacuugugu

SEQ ID NO: 360345 - RNA, 22 nt, Homo sapiens
augcacuuggcaggaugauucc

SEQ ID NO: 360346 - RNA, 22 nt, Homo sapiens
augcauauuccugggccucacu

SEQ ID NO: 360347 - RNA, 22 nt, Homo sapiens
augccacugcacuccaaccugg

SEQ ID NO: 360348 - RNA, 22 nt, Homo sapiens
augccacugcacuucagcuugg

SEQ ID NO: 360349 - RNA, 22 nt, Homo sapiens
augccacugcauaagguuuuca

SEQ ID NO: 360350 - RNA, 22 nt, Homo sapiens
augcuacauucuacaauuaggc

SEQ ID NO: 360351 - RNA, 22 nt, Homo sapiens
augcuacuggacaauggugacu

SEQ ID NO: 360352 - RNA, 22 nt, Homo sapiens
augcuguuuuguagcucccucu

SEQ ID NO: 360353 - RNA, 22 nt, Homo sapiens
augcuuguugcagccugagccu

SEQ ID NO: 360354 - RNA, 22 nt, Homo sapiens
auggaacauaacuauuugggga

SEQ ID NO: 360355 - RNA, 19 nt, Homo sapiens
auggaacugcuggagccac

SEQ ID NO: 360356 - RNA, 22 nt, Homo sapiens
auggaagacuccucuuugggua

SEQ ID NO: 360357 - RNA, 22 nt, Homo sapiens
auggaagcauaguauucuauug

SEQ ID NO: 360358 - RNA, 22 nt, Homo sapiens
auggaagucucuguuaaguuuc

SEQ ID NO: 360359 - RNA, 22 nt, Homo sapiens
auggacagacacuggccuucug

SEQ ID NO: 360360 - RNA, 21 nt, Homo sapiens
auggacaugguuaggcuuugu

SEQ ID NO: 360361 - RNA, 22 nt, Homo sapiens
auggagaugugcgaacugagua

SEQ ID NO: 360362 - RNA, 22 nt, Homo sapiens
auggagcuugacaguuguagag

SEQ ID NO: 360363 - RNA, 19 nt, Homo sapiens
auggauacauuuucugcua

SEQ ID NO: 360364 - RNA, 22 nt, Homo sapiens
auggauauuuuuugaacauaga

SEQ ID NO: 360365 - RNA, 22 nt, Homo sapiens
auggauuuuaggauacaguuga

SEQ ID NO: 360366 - RNA, 22 nt, Homo sapiens
auggauuuugaacuugagaguu

SEQ ID NO: 360367 - RNA, 22 nt, Homo sapiens
auggauuuuggggccagaggca

SEQ ID NO: 360368 - RNA, 22 nt, Homo sapiens
auggcacagacucuuggucaag

SEQ ID NO: 360369 - RNA, 22 nt, Homo sapiens
auggcacagaguagaugcucaa

SEQ ID NO: 360370 - RNA, 22 nt, Homo sapiens
auggcacuacugggaaugucuu

SEQ ID NO: 360371 - RNA, 22 nt, Homo sapiens
auggcacucaaucaaguugaga

SEQ ID NO: 360372 - RNA, 22 nt, Homo sapiens
auggcagaaucaagccgacagc

SEQ ID NO: 360373 - RNA, 22 nt, Homo sapiens
auggcagcugguuuuacccuag

SEQ ID NO: 360374 - RNA, 22 nt, Homo sapiens
auggcccaguuugcuaucccua

SEQ ID NO: 360375 - RNA, 20 nt, Homo sapiens
auggcccugcugggaguguc

SEQ ID NO: 360376 - RNA, 22 nt, Homo sapiens
auggccgggugcgguggcucac

SEQ ID NO: 360377 - RNA, 22 nt, Homo sapiens
auggcguguggcuuggaggcug

SEQ ID NO: 360378 - RNA, 22 nt, Homo sapiens
auggcuagauuguaugguaguu

SEQ ID NO: 360379 - RNA, 22 nt, Homo sapiens
auggcugagugauuucaaacag

SEQ ID NO: 360380 - RNA, 22 nt, Homo sapiens
auggcuguuccugggaguucua

SEQ ID NO: 360381 - RNA, 22 nt, Homo sapiens
auggcuguuucugcaaugucua

SEQ ID NO: 360382 - RNA, 22 nt, Homo sapiens
auggcuuucaggacguggcgag

SEQ ID NO: 360383 - RNA, 22 nt, Homo sapiens
auggcuuuguguucagagcuga

SEQ ID NO: 360384 - RNA, 22 nt, Homo sapiens
auggcuuuuauuguguugaggu

SEQ ID NO: 360385 - RNA, 22 nt, Homo sapiens
auggcuuuuccugucuugcaug

SEQ ID NO: 360386 - RNA, 22 nt, Homo sapiens
auggcuuuugaccugguaggau

SEQ ID NO: 360387 - RNA, 22 nt, Homo sapiens
auggcuuuugcccuaaauggau

SEQ ID NO: 360388 - RNA, 22 nt, Homo sapiens
augggauaguaucaguggaaua

SEQ ID NO: 360389 - RNA, 22 nt, Homo sapiens
augggcuaguaaagacaaacuu

SEQ ID NO: 360390 - RNA, 22 nt, Homo sapiens
augguacucucuugucugcaaa

SEQ ID NO: 360391 - RNA, 22 nt, Homo sapiens
augguaguagaugugugguuuu

SEQ ID NO: 360392 - RNA, 22 nt, Homo sapiens
augguauuuaacagucuuucua

SEQ ID NO: 360393 - RNA, 22 nt, Homo sapiens
augguugguuaaaucuguguau

SEQ ID NO: 360394 - RNA, 22 nt, Homo sapiens
auguaaacauuuggucuaaauu

SEQ ID NO: 360395 - RNA, 22 nt, Homo sapiens
auguaguagauauuuauggaaa

SEQ ID NO: 360396 - RNA, 22 nt, Homo sapiens
auguaugagaguuccagcugau

SEQ ID NO: 360397 - RNA, 22 nt, Homo sapiens
augucaaggugggugauaguuu

SEQ ID NO: 360398 - RNA, 22 nt, Homo sapiens
augucauagaagccugugaacc

SEQ ID NO: 360399 - RNA, 22 nt, Homo sapiens
augucauagauaaggaagugga

SEQ ID NO: 360400 - RNA, 22 nt, Homo sapiens
auguccuagagagauggugguc

SEQ ID NO: 360401 - RNA, 22 nt, Homo sapiens
augucuagagcaagagaugcug

SEQ ID NO: 360402 - RNA, 22 nt, Homo sapiens
augugaacugaauuaauucaca

SEQ ID NO: 360403 - RNA, 21 nt, Homo sapiens
ucuggcccccucaaaucucau

SEQ ID NO: 360404 - RNA, 22 nt, Homo sapiens
ucuggccuagaacaauuaauua

SEQ ID NO: 360405 - RNA, 16 nt, Homo sapiens
ucuggcucuacaguuc

SEQ ID NO: 360406 - RNA, 15 nt, Homo sapiens
ucuggcucugucacu

SEQ ID NO: 360407 - RNA, 22 nt, Homo sapiens
ucuggcuuauuucacuuagcau

SEQ ID NO: 360408 - RNA, 17 nt, Homo sapiens
ucuggcuuucacaccug

SEQ ID NO: 360409 - RNA, 22 nt, Homo sapiens
ucuggcuuucuuuacuuaaugu

SEQ ID NO: 360410 - RNA, 22 nt, Homo sapiens
ucuggcuuugugaguugccaga

SEQ ID NO: 360411 - RNA, 22 nt, Homo sapiens
ucugggguuagucaaagguaug

SEQ ID NO: 360412 - RNA, 22 nt, Homo sapiens
ucugguguuauucauguaguuu

SEQ ID NO: 360413 - RNA, 23 nt, Homo sapiens
ucugguguugucaaaugcugguu

SEQ ID NO: 360414 - RNA, 22 nt, Homo sapiens
ucugucaaaucuuauguuguag

SEQ ID NO: 360415 - RNA, 22 nt, Homo sapiens
ucugucuuugucaggaccagag

SEQ ID NO: 360416 - RNA, 22 nt, Homo sapiens
ucugugaaaucauuuccuguaa

SEQ ID NO: 360417 - RNA, 22 nt, Homo sapiens
ucugugaaugaacacuugaaaa

SEQ ID NO: 360418 - RNA, 22 nt, Homo sapiens
ucuguggucagcauccgccacu

SEQ ID NO: 360419 - RNA, 21 nt, Homo sapiens
ucuguguugaucucacuggga

SEQ ID NO: 360420 - RNA, 22 nt, Homo sapiens
ucuguguugaugcucauuaauu

SEQ ID NO: 360421 - RNA, 22 nt, Homo sapiens
ucuguguuuagacccaggguag

SEQ ID NO: 360422 - RNA, 22 nt, Homo sapiens
ucuuagugcggcugcugcagcc

SEQ ID NO: 360423 - RNA, 22 nt, Homo sapiens
ucuuaguuuagauuagcaauuc

SEQ ID NO: 360424 - RNA, 22 nt, Homo sapiens
ucuucagucauauuggccugga

SEQ ID NO: 360425 - RNA, 22 nt, Homo sapiens
ucuugcaguucccaaauucaca

SEQ ID NO: 360426 - RNA, 22 nt, Homo sapiens
ucuugccacuucauccccuuuc

SEQ ID NO: 360427 - RNA, 22 nt, Homo sapiens
ucuuggacuuuugugagaaauc

SEQ ID NO: 360428 - RNA, 22 nt, Homo sapiens
ucuuggguuugccuugcugcug

SEQ ID NO: 360429 - RNA, 20 nt, Homo sapiens
ucuugguuggaggucuuuua

SEQ ID NO: 360430 - RNA, 19 nt, Homo sapiens
ucuuuagucacauuuuuau

SEQ ID NO: 360431 - RNA, 22 nt, Homo sapiens
ucuuuagugacaguugugcaag

SEQ ID NO: 360432 - RNA, 22 nt, Homo sapiens
ucuuugaguguauacuuagauu

SEQ ID NO: 360433 - RNA, 22 nt, Homo sapiens
ucuuugauaagauccagaagaa

SEQ ID NO: 360434 - RNA, 22 nt, Homo sapiens
ucuuugccuaacccaaggucau

SEQ ID NO: 360435 - RNA, 22 nt, Homo sapiens
ucuuuggaggcgaucuguuuga

SEQ ID NO: 360436 - RNA, 22 nt, Homo sapiens
ucuuuggguagauauguagcug

SEQ ID NO: 360437 - RNA, 19 nt, Homo sapiens
ucuuugguacgugcuuuga

SEQ ID NO: 360438 - RNA, 22 nt, Homo sapiens
ucuuugguauuuguggggaauu

SEQ ID NO: 360439 - RNA, 22 nt, Homo sapiens
ucuuuggucuacuuucauaugu

SEQ ID NO: 360440 - RNA, 22 nt, Homo sapiens
ucuuugguuucugucucuguaa

SEQ ID NO: 360441 - RNA, 22 nt, Homo sapiens
ucuuuguuuucugauccugaag

SEQ ID NO: 360442 - RNA, 22 nt, Homo sapiens
ucuuuugggccucuugucagac

SEQ ID NO: 360443 - RNA, 22 nt, Homo sapiens
ucuuuuggguauggagccauca

SEQ ID NO: 360444 - RNA, 22 nt, Homo sapiens
ucuuuugguuucuagaggccgc

SEQ ID NO: 360445 - RNA, 22 nt, Homo sapiens
ucuuuuguucuauucaggccuu

SEQ ID NO: 360446 - RNA, 20 nt, Homo sapiens
ucuuuuuguggccccagagu

SEQ ID NO: 360447 - RNA, 22 nt, Homo sapiens
ugaaacugcagugggcuuggca

SEQ ID NO: 360448 - RNA, 22 nt, Homo sapiens
ugaaagguauagguucuggagg

SEQ ID NO: 360449 - RNA, 22 nt, Homo sapiens
ugaaaugauuauaugguguuug

SEQ ID NO: 360450 - RNA, 22 nt, Homo sapiens
ugaaaugccuugagauuuugac

SEQ ID NO: 360451 - RNA, 22 nt, Homo sapiens
ugaaaugguuaugugaggagau

SEQ ID NO: 360452 - RNA, 22 nt, Homo sapiens
ugaaauguguuaucugggccug

SEQ ID NO: 360453 - RNA, 22 nt, Homo sapiens
ugaaauuauucuuaccaaggug

SEQ ID NO: 360454 - RNA, 22 nt, Homo sapiens
ugaaauuguuugcaaggauagg

SEQ ID NO: 360455 - RNA, 22 nt, Homo sapiens
ugaacagcacguuuauucagaa

SEQ ID NO: 360456 - RNA, 22 nt, Homo sapiens
ugaagcuaacuugauugugaug

SEQ ID NO: 360457 - RNA, 22 nt, Homo sapiens
ugaagcuaugacuauugagcau

SEQ ID NO: 360458 - RNA, 22 nt, Homo sapiens
ugaagggcauuguuuugccaaa

SEQ ID NO: 360459 - RNA, 22 nt, Homo sapiens
ugaaguaauguuuuauucuauu

SEQ ID NO: 360460 - RNA, 22 nt, Homo sapiens
ugaauacuucaaaaaaauagcu

SEQ ID NO: 360461 - RNA, 22 nt, Homo sapiens
ugaauagacacuaaagacugua

SEQ ID NO: 360462 - RNA, 22 nt, Homo sapiens
ugaauaguuugacagaacucuu

SEQ ID NO: 360463 - RNA, 22 nt, Homo sapiens
ugaauauguuaauuagcaucau

SEQ ID NO: 360464 - RNA, 22 nt, Homo sapiens
ugaauauguuucuaaaagugca

SEQ ID NO: 360465 - RNA, 22 nt, Homo sapiens
ugaauauuugcuacucacucuu

SEQ ID NO: 360466 - RNA, 22 nt, Homo sapiens
ugaaucaugcugcuauaaagac

SEQ ID NO: 360467 - RNA, 22 nt, Homo sapiens
ugaaucauuucuugucuucagu

SEQ ID NO: 360468 - RNA, 22 nt, Homo sapiens
ugaaugauuuuaaaagccucuc

SEQ ID NO: 360469 - RNA, 22 nt, Homo sapiens
ugaaugcaucuagaaauuuauu

SEQ ID NO: 360470 - RNA, 22 nt, Homo sapiens
ugaaugcauggggccaagaagg

SEQ ID NO: 360471 - RNA, 22 nt, Homo sapiens
ugaaugcuaaaggaaaacagua

SEQ ID NO: 360472 - RNA, 22 nt, Homo sapiens
ugaaugguuuuuagagaacaau

SEQ ID NO: 360473 - RNA, 22 nt, Homo sapiens
ugaauguaacuaaaggacuuuu

SEQ ID NO: 360474 - RNA, 20 nt, Homo sapiens
ugaauguaauuacagaugua

SEQ ID NO: 360475 - RNA, 22 nt, Homo sapiens
ugaauguacacgcguacuuguu

SEQ ID NO: 360476 - RNA, 22 nt, Homo sapiens
ugaauguacuuaacacuggauu

SEQ ID NO: 360477 - RNA, 23 nt, Homo sapiens
ugaauguaucgaaugugggaaag

SEQ ID NO: 360478 - RNA, 22 nt, Homo sapiens
ugaauguauuuauuaccauuca

SEQ ID NO: 360479 - RNA, 22 nt, Homo sapiens
ugaauguccugacgcugcaguu

SEQ ID NO: 360480 - RNA, 22 nt, Homo sapiens
ugaaugugauggguuucaugug

SEQ ID NO: 360481 - RNA, 22 nt, Homo sapiens
ugaauguuugcuuacuuccaua

SEQ ID NO: 360482 - RNA, 22 nt, Homo sapiens
ugaauucuguccaaaauaacug

SEQ ID NO: 360483 - RNA, 22 nt, Homo sapiens
ugacaagacuacauaucccauu

SEQ ID NO: 360484 - RNA, 22 nt, Homo sapiens
ugacaagauauggucuuaucaa

SEQ ID NO: 360485 - RNA, 22 nt, Homo sapiens
ugacaagugauuaaggcauauu

SEQ ID NO: 360486 - RNA, 17 nt, Homo sapiens
ugacagaaacuuguugu

SEQ ID NO: 360487 - RNA, 22 nt, Homo sapiens
ugacagguugauaggugcagca

SEQ ID NO: 360488 - RNA, 22 nt, Homo sapiens
ugacagguuggaauuaugggag

SEQ ID NO: 360489 - RNA, 22 nt, Homo sapiens
ugacaguaucuacagcuucuua

SEQ ID NO: 360490 - RNA, 22 nt, Homo sapiens
uauugcuaaauucuuuuccuag

SEQ ID NO: 360491 - RNA, 22 nt, Homo sapiens
uauugcucugacugauuggaug

SEQ ID NO: 360492 - RNA, 22 nt, Homo sapiens
uauugcuugaggaaaugguaau

SEQ ID NO: 360493 - RNA, 22 nt, Homo sapiens
uauugggcuucucagaauagag

SEQ ID NO: 360494 - RNA, 22 nt, Homo sapiens
uauuguccaauaggauguuccu

SEQ ID NO: 360495 - RNA, 22 nt, Homo sapiens
uauuucaguugugcagguaguu

SEQ ID NO: 360496 - RNA, 22 nt, Homo sapiens
uauuugauuaacaagagccuaa

SEQ ID NO: 360497 - RNA, 22 nt, Homo sapiens
uauuugguuggugcaaaaguaa

SEQ ID NO: 360498 - RNA, 22 nt, Homo sapiens
uauuuguccccuccaaaaguca

SEQ ID NO: 360499 - RNA, 22 nt, Homo sapiens
ucaaacugucagguugaccaga

SEQ ID NO: 360500 - RNA, 20 nt, Homo sapiens
ucaaaguaugcucugcacua

SEQ ID NO: 360501 - RNA, 22 nt, Homo sapiens
ucaaaucaucuuuuccaaagcu

SEQ ID NO: 360502 - RNA, 22 nt, Homo sapiens
ucaaaugauucuccugccucag

SEQ ID NO: 360503 - RNA, 22 nt, Homo sapiens
ucaaauguucccuguacuggcc

SEQ ID NO: 360504 - RNA, 22 nt, Homo sapiens
ucaagcaauucgccugucucag

SEQ ID NO: 360505 - RNA, 22 nt, Homo sapiens
ucaaguaauacucccaucuugg

SEQ ID NO: 360506 - RNA, 22 nt, Homo sapiens
ucaaugaaugaugguugguaug

SEQ ID NO: 360507 - RNA, 22 nt, Homo sapiens
ucaauugcuuaugaagauacau

SEQ ID NO: 360508 - RNA, 22 nt, Homo sapiens
ucacaaagcuuggccugcuucu

SEQ ID NO: 360509 - RNA, 21 nt, Homo sapiens
ucacaaugaacagcagcagaa

SEQ ID NO: 360510 - RNA, 22 nt, Homo sapiens
ucacaauggcugaacuaauuua

SEQ ID NO: 360511 - RNA, 22 nt, Homo sapiens
ucacaccauucuucuacuucag

SEQ ID NO: 360512 - RNA, 22 nt, Homo sapiens
ucacacgugaacucaucacaga

SEQ ID NO: 360513 - RNA, 22 nt, Homo sapiens
ucacacugucuugguuacucuu

SEQ ID NO: 360514 - RNA, 22 nt, Homo sapiens
ucacagaggagaagaccuuuaa

SEQ ID NO: 360515 - RNA, 21 nt, Homo sapiens
ucacagccuaggaccugaaga

SEQ ID NO: 360516 - RNA, 22 nt, Homo sapiens
ucacaguagagcuucuuucaga

SEQ ID NO: 360517 - RNA, 22 nt, Homo sapiens
ucacaguagccccucccaucau

SEQ ID NO: 360518 - RNA, 22 nt, Homo sapiens
ucacaguccuguuuaggagagg

SEQ ID NO: 360519 - RNA, 22 nt, Homo sapiens
ucacagugcaggaucaguuaau

SEQ ID NO: 360520 - RNA, 22 nt, Homo sapiens
ucacaucucagguuucuugaca

SEQ ID NO: 360521 - RNA, 22 nt, Homo sapiens
ucacaugaagauuuuaguauac

SEQ ID NO: 360522 - RNA, 22 nt, Homo sapiens
ucacaugucagccguggggaag

SEQ ID NO: 360523 - RNA, 22 nt, Homo sapiens
ucacaugugcguuuuggcaugu

SEQ ID NO: 360524 - RNA, 22 nt, Homo sapiens
ucacauuguuauguaaauguuu

SEQ ID NO: 360525 - RNA, 22 nt, Homo sapiens
ucaccaccugcugaucauagag

SEQ ID NO: 360526 - RNA, 22 nt, Homo sapiens
ucaccuggagccuucacauucu

SEQ ID NO: 360527 - RNA, 18 nt, Homo sapiens
ucaccuugaugcuggguc

SEQ ID NO: 360528 - RNA, 22 nt, Homo sapiens
ucacgugcucuuguguguucug

SEQ ID NO: 360529 - RNA, 22 nt, Homo sapiens
ucacuaggcuggagugcagugg

SEQ ID NO: 360530 - RNA, 22 nt, Homo sapiens
ucacuagggagaaacugaggcu

SEQ ID NO: 360531 - RNA, 22 nt, Homo sapiens
ucacuauagaaaacagugugga

SEQ ID NO: 360532 - RNA, 22 nt, Homo sapiens
ucacuggagauagcaaucuggu

SEQ ID NO: 360533 - RNA, 22 nt, Homo sapiens
ucacugggagaccaaagccauc

SEQ ID NO: 360534 - RNA, 22 nt, Homo sapiens
ucacugggagcauuugagccuu

SEQ ID NO: 360535 - RNA, 20 nt, Homo sapiens
ucacuggguucuugaagucu

SEQ ID NO: 360536 - RNA, 22 nt, Homo sapiens
ucacuguggaacucaaaaagcu

SEQ ID NO: 360537 - RNA, 22 nt, Homo sapiens
ucacuguguauguauaugcagg

SEQ ID NO: 360538 - RNA, 22 nt, Homo sapiens
ucacugugugucucuguaucug

SEQ ID NO: 360539 - RNA, 22 nt, Homo sapiens
ucacuugguggcaaaguuuaug

SEQ ID NO: 360540 - RNA, 22 nt, Homo sapiens
ucacuuugacggccaacuucua

SEQ ID NO: 360541 - RNA, 22 nt, Homo sapiens
ucagaguagaaacacuuccaua

SEQ ID NO: 360542 - RNA, 22 nt, Homo sapiens
ucagagugguuguaccauuuga

SEQ ID NO: 360543 - RNA, 20 nt, Homo sapiens
ucagcagucuggagcagagg

SEQ ID NO: 360544 - RNA, 22 nt, Homo sapiens
ucagcagugccccacucuacug

SEQ ID NO: 360545 - RNA, 22 nt, Homo sapiens
gagauacuugguuucuguuucu

SEQ ID NO: 360546 - RNA, 22 nt, Homo sapiens
gagauauuauuucccuuucaca

SEQ ID NO: 360547 - RNA, 22 nt, Homo sapiens
gagauauuuagaaauguguucu

SEQ ID NO: 360548 - RNA, 22 nt, Homo sapiens
gagaucaaguauucuccacuaa

SEQ ID NO: 360549 - RNA, 22 nt, Homo sapiens
gagauggagacuuggccuuaaa

SEQ ID NO: 360550 - RNA, 22 nt, Homo sapiens
gagaugugugugauuauauaau

SEQ ID NO: 360551 - RNA, 22 nt, Homo sapiens
gagauguuuuguuaucaaagga

SEQ ID NO: 360552 - RNA, 22 nt, Homo sapiens
gagcaaaaguauguauugguua

SEQ ID NO: 360553 - RNA, 18 nt, Homo sapiens
gagcaccuuuuuugcaga

SEQ ID NO: 360554 - RNA, 22 nt, Homo sapiens
gagcaucauucaacaaaagucu

SEQ ID NO: 360555 - RNA, 22 nt, Homo sapiens
gagcucaccuuaccucuggagc

SEQ ID NO: 360556 - RNA, 20 nt, Homo sapiens
gagcucaucuucuuuaccac

SEQ ID NO: 360557 - RNA, 22 nt, Homo sapiens
gagcugaucuuuauguaaauuc

SEQ ID NO: 360558 - RNA, 22 nt, Homo sapiens
gagcugccuugccuaugcaaga

SEQ ID NO: 360559 - RNA, 22 nt, Homo sapiens
gaggaaguaauuuuaggccugu

SEQ ID NO: 360560 - RNA, 22 nt, Homo sapiens
gaggcuagauggggaugugucc

SEQ ID NO: 360561 - RNA, 22 nt, Homo sapiens
gagguaaguggauuaugagguc

SEQ ID NO: 360562 - RNA, 22 nt, Homo sapiens
gagguaggaauaaacauuugaa

SEQ ID NO: 360563 - RNA, 22 nt, Homo sapiens
gagguaggaggauugcuuaagg

SEQ ID NO: 360564 - RNA, 17 nt, Homo sapiens
gagguaguuuacuuuca

SEQ ID NO: 360565 - RNA, 22 nt, Homo sapiens
gagguaugauugacauauaaaa

SEQ ID NO: 360566 - RNA, 22 nt, Homo sapiens
gagguauggauaucuggagagg

SEQ ID NO: 360567 - RNA, 22 nt, Homo sapiens
gagguugggaugagggauacag

SEQ ID NO: 360568 - RNA, 22 nt, Homo sapiens
gaguaacauugacaacuucaug

SEQ ID NO: 360569 - RNA, 22 nt, Homo sapiens
gaguagugcugcaguaaacaca

SEQ ID NO: 360570 - RNA, 22 nt, Homo sapiens
gagucagugucuugcucuguca

SEQ ID NO: 360571 - RNA, 21 nt, Homo sapiens
gagugcaaauaaagagagggc

SEQ ID NO: 360572 - RNA, 21 nt, Homo sapiens
gaguggcuuuuguuucaccag

SEQ ID NO: 360573 - RNA, 22 nt, Homo sapiens
gauauguaguaguugaaaaaga

SEQ ID NO: 360574 - RNA, 22 nt, Homo sapiens
gauauuacuuccaauauugcaa

SEQ ID NO: 360575 - RNA, 22 nt, Homo sapiens
gaucacaguuccucacgggcau

SEQ ID NO: 360576 - RNA, 22 nt, Homo sapiens
gaucucaguggauacugugaug

SEQ ID NO: 360577 - RNA, 22 nt, Homo sapiens
gaucuggagguuuuccucauga

SEQ ID NO: 360578 - RNA, 22 nt, Homo sapiens
gaugagauguucucauggauug

SEQ ID NO: 360579 - RNA, 22 nt, Homo sapiens
gaugagguaggccugcuuugaa

SEQ ID NO: 360580 - RNA, 22 nt, Homo sapiens
gauggguuuuuugaagacagca

SEQ ID NO: 360581 - RNA, 22 nt, Homo sapiens
gauuucaucuuuagaggaagga

SEQ ID NO: 360582 - RNA, 22 nt, Homo sapiens
gauuuugguuagggaaggauac

SEQ ID NO: 360583 - RNA, 22 nt, Homo sapiens
gcaaagaaugcagauuugccuc

SEQ ID NO: 360584 - RNA, 22 nt, Homo sapiens
gcaaaguguuuuccaacuuggu

SEQ ID NO: 360585 - RNA, 20 nt, Homo sapiens
gcaaauggaucccacaagcc

SEQ ID NO: 360586 - RNA, 22 nt, Homo sapiens
gcaagaguauuucaaggaagau

SEQ ID NO: 360587 - RNA, 22 nt, Homo sapiens
gcaauguuacugaauguguuuu

SEQ ID NO: 360588 - RNA, 22 nt, Homo sapiens
gcacaguuaaagggucauguga

SEQ ID NO: 360589 - RNA, 22 nt, Homo sapiens
gcagaauugguuucuucuaagg

SEQ ID NO: 360590 - RNA, 22 nt, Homo sapiens
gcagaucucuucauuucucuua

SEQ ID NO: 360591 - RNA, 22 nt, Homo sapiens
gcagcagugugggcugaaccua

SEQ ID NO: 360592 - RNA, 22 nt, Homo sapiens
gcagucacagggagauggugac

SEQ ID NO: 360593 - RNA, 22 nt, Homo sapiens
gcaguguggguagagggcaaga

SEQ ID NO: 360594 - RNA, 22 nt, Homo sapiens
gcaguguucugggcaggaagaa

SEQ ID NO: 360595 - RNA, 17 nt, Homo sapiens
gcauaugucgaaccagc

SEQ ID NO: 360596 - RNA, 17 nt, Homo sapiens
gcauauguugaaccagu

SEQ ID NO: 360597 - RNA, 22 nt, Homo sapiens
gcaucacagcuccugugcuggc

SEQ ID NO: 360598 - RNA, 22 nt, Homo sapiens
gcaugcacaugugaaaaaauga

SEQ ID NO: 360599 - RNA, 22 nt, Homo sapiens
gcaugguacuggaugguaguau

SEQ ID NO: 360600 - RNA, 22 nt, Homo sapiens
gcaugguaguaaccuacauuug

SEQ ID NO: 360601 - RNA, 22 nt, Homo sapiens
gcauguaguagauguugaauaa

SEQ ID NO: 360602 - RNA, 18 nt, Homo sapiens
gccaacauguaaacaggu

SEQ ID NO: 360603 - RNA, 22 nt, Homo sapiens
gccaagaugcugcccacagaca

SEQ ID NO: 360604 - RNA, 22 nt, Homo sapiens
gccagauuguccaguuuuuuau

SEQ ID NO: 360605 - RNA, 22 nt, Homo sapiens
gccagugugaugugaucauggc

SEQ ID NO: 360606 - RNA, 22 nt, Homo sapiens
gccauugcacuccagcuugggc

SEQ ID NO: 360607 - RNA, 22 nt, Homo sapiens
gccccugagacuugccucgggc

SEQ ID NO: 360608 - RNA, 22 nt, Homo sapiens
gcccuguguuuggguaugguca

SEQ ID NO: 360609 - RNA, 22 nt, Homo sapiens
gccgagagauuuggaaugggga

SEQ ID NO: 360610 - RNA, 22 nt, Homo sapiens
gccucaguuguggccagggauu

SEQ ID NO: 360611 - RNA, 22 nt, Homo sapiens
gccugagaggauaugauccccu

SEQ ID NO: 360612 - RNA, 22 nt, Homo sapiens
gccuguagaagaguagaugacc

SEQ ID NO: 360613 - RNA, 22 nt, Homo sapiens
gcguugcacuccagccugggua

SEQ ID NO: 360614 - RNA, 22 nt, Homo sapiens
gcuagcauucaaaugugcagcc

SEQ ID NO: 360615 - RNA, 22 nt, Homo sapiens
ugucaauauguaauaacugaau

SEQ ID NO: 360616 - RNA, 22 nt, Homo sapiens
ugucacagagauuuugguaugu

SEQ ID NO: 360617 - RNA, 22 nt, Homo sapiens
ugucacccuuuauccauuuccu

SEQ ID NO: 360618 - RNA, 22 nt, Homo sapiens
ugucagcacaacucagguuccu

SEQ ID NO: 360619 - RNA, 22 nt, Homo sapiens
ugucaggagcaaugauaaauuu

SEQ ID NO: 360620 - RNA, 22 nt, Homo sapiens
ugucaguggacugugaaaggca

SEQ ID NO: 360621 - RNA, 22 nt, Homo sapiens
ugucaguguaugagccccggau

SEQ ID NO: 360622 - RNA, 22 nt, Homo sapiens
ugucaguuucaguguuagccuu

SEQ ID NO: 360623 - RNA, 21 nt, Homo sapiens
ugucaguuuccagaguucaac

SEQ ID NO: 360624 - RNA, 22 nt, Homo sapiens
ugucaucauuggaaucugccuc

SEQ ID NO: 360625 - RNA, 22 nt, Homo sapiens
ugucaucuagguauuaagcccc

SEQ ID NO: 360626 - RNA, 22 nt, Homo sapiens
ugucaucuagguuuuaagccuu

SEQ ID NO: 360627 - RNA, 22 nt, Homo sapiens
ugucauggauucugagucuggg

SEQ ID NO: 360628 - RNA, 22 nt, Homo sapiens
uguccauuuuuaugcuuauggu

SEQ ID NO: 360629 - RNA, 20 nt, Homo sapiens
ugucccaaccccauggguuc

SEQ ID NO: 360630 - RNA, 22 nt, Homo sapiens
ugucuaaagaauggcagacuca

SEQ ID NO: 360631 - RNA, 22 nt, Homo sapiens
ugucuacugaugauguaguuaa

SEQ ID NO: 360632 - RNA, 22 nt, Homo sapiens
ugucuagaucugaauguaauug

SEQ ID NO: 360633 - RNA, 22 nt, Homo sapiens
ugucugagacuguuuuacuuuc

SEQ ID NO: 360634 - RNA, 22 nt, Homo sapiens
ugucuguuugcgaaauugcuuc

SEQ ID NO: 360635 - RNA, 22 nt, Homo sapiens
ugugaacauuuuguauauauua

SEQ ID NO: 360636 - RNA, 20 nt, Homo sapiens
ugugaacuguagauagucuu

SEQ ID NO: 360637 - RNA, 19 nt, Homo sapiens
ugugaagaaaugcugcaag

SEQ ID NO: 360638 - RNA, 22 nt, Homo sapiens
ugugacaaauuuaguggacugu

SEQ ID NO: 360639 - RNA, 22 nt, Homo sapiens
ugugacacugaauggcagaacu

SEQ ID NO: 360640 - RNA, 23 nt, Homo sapiens
ugugacacuuccgucaguucauu

SEQ ID NO: 360641 - RNA, 22 nt, Homo sapiens
ugugacagcacagcaucucuuu

SEQ ID NO: 360642 - RNA, 22 nt, Homo sapiens
ugugacagcacgguucaacugc

SEQ ID NO: 360643 - RNA, 22 nt, Homo sapiens
ugugacagguauccuguguucu

SEQ ID NO: 360644 - RNA, 22 nt, Homo sapiens
ugugacaguguuacauuucaug

SEQ ID NO: 360645 - RNA, 17 nt, Homo sapiens
ugugacccugggcuacc

SEQ ID NO: 360646 - RNA, 19 nt, Homo sapiens
ugugacugggccagccuag

SEQ ID NO: 360647 - RNA, 20 nt, Homo sapiens
ugugagacugguuuugaacu

SEQ ID NO: 360648 - RNA, 22 nt, Homo sapiens
ugugauguggagggcagaucca

SEQ ID NO: 360649 - RNA, 20 nt, Homo sapiens
ugugauuauuuaguugcaug

SEQ ID NO: 360650 - RNA, 22 nt, Homo sapiens
ugugcaaauguuaaacuaacuu

SEQ ID NO: 360651 - RNA, 22 nt, Homo sapiens
ugugcaaggcucucaaccugug

SEQ ID NO: 360652 - RNA, 22 nt, Homo sapiens
ugugcacauugugcagguugau

SEQ ID NO: 360653 - RNA, 22 nt, Homo sapiens
ugugcaugaaauuuaccuuuaa

SEQ ID NO: 360654 - RNA, 22 nt, Homo sapiens
ugugccacugcacucugggcaa

SEQ ID NO: 360655 - RNA, 22 nt, Homo sapiens
ugugcucaucucagucaacugu

SEQ ID NO: 360656 - RNA, 21 nt, Homo sapiens
uguggcaauggccucacagau

SEQ ID NO: 360657 - RNA, 22 nt, Homo sapiens
uguggcauuuucagaaaggaug

SEQ ID NO: 360658 - RNA, 18 nt, Homo sapiens
uguggcuguuuuccaaua

SEQ ID NO: 360659 - RNA, 22 nt, Homo sapiens
ugugguuuuuuucuccaauagg

SEQ ID NO: 360660 - RNA, 22 nt, Homo sapiens
ugugucacugaggguuagugua

SEQ ID NO: 360661 - RNA, 22 nt, Homo sapiens
ugugucuuguuuauagcuuucu

SEQ ID NO: 360662 - RNA, 22 nt, Homo sapiens
uguguuuuuauguaaaauggaa

SEQ ID NO: 360663 - RNA, 22 nt, Homo sapiens
uguuacagcagaauugauugca

SEQ ID NO: 360664 - RNA, 22 nt, Homo sapiens
uguuacagugacuaauguuuua

SEQ ID NO: 360665 - RNA, 22 nt, Homo sapiens
uguuauugagguuacuuauaag

SEQ ID NO: 360666 - RNA, 22 nt, Homo sapiens
uguuauuuuguguuagggcaca

SEQ ID NO: 360667 - RNA, 22 nt, Homo sapiens
uguugcacuccagccuggguga

SEQ ID NO: 360668 - RNA, 22 nt, Homo sapiens
uguuugcuguuuucuccaauga

SEQ ID NO: 360669 - RNA, 22 nt, Homo sapiens
uguuuguuugauaugggauaaa

SEQ ID NO: 360670 - RNA, 22 nt, Homo sapiens
uguuuuggaggccagaagucca

SEQ ID NO: 360671 - RNA, 22 nt, Homo sapiens
uguuuuggagguccucacuaga

SEQ ID NO: 360672 - RNA, 21 nt, Homo sapiens
uguuuuugcuguguaucucuc

SEQ ID NO: 360673 - RNA, 22 nt, Homo sapiens
uuaaaaguauaggccuggcaua

SEQ ID NO: 360674 - RNA, 22 nt, Homo sapiens
uuaaaggcaugguuagacaugg

SEQ ID NO: 360675 - RNA, 22 nt, Homo sapiens
uuaaaugcacauacuugagaaa

SEQ ID NO: 360676 - RNA, 22 nt, Homo sapiens
uuaacagugucaaucuguagua

SEQ ID NO: 360677 - RNA, 22 nt, Homo sapiens
uuaagagcauggugccagguug

SEQ ID NO: 360678 - RNA, 22 nt, Homo sapiens
uuaagaugcauuuugaaguuaa

SEQ ID NO: 360679 - RNA, 19 nt, Homo sapiens
uuaagugugauaucucagu

SEQ ID NO: 360680 - RNA, 22 nt, Homo sapiens
uuaauuguaucuauagauguca

SEQ ID NO: 360681 - RNA, 22 nt, Homo sapiens
uuaauuguccauuauucuguuc

SEQ ID NO: 360682 - RNA, 22 nt, Homo sapiens
uuacaagaugucuguccaacac

SEQ ID NO: 360683 - RNA, 22 nt, Homo sapiens
uuacaaguggcaucucucugga

SEQ ID NO: 360684 - RNA, 22 nt, Homo sapiens
uuacacaguugguaggggcaga

SEQ ID NO: 360685 - RNA, 22 nt, Homo sapiens
uuacaccuguaauccagcacuu

SEQ ID NO: 360686 - RNA, 22 nt, Homo sapiens
uuacaggacuaagcagcuuugc

SEQ ID NO: 360687 - RNA, 22 nt, Homo sapiens
uuacagguggagaaguaaggcu

SEQ ID NO: 360688 - RNA, 22 nt, Homo sapiens
uuacagugguugcuauugugaa

SEQ ID NO: 360689 - RNA, 22 nt, Homo sapiens
uuacaguugugagccaccaugc

SEQ ID NO: 360690 - RNA, 22 nt, Homo sapiens
uuacauguuguggguuguggcc

SEQ ID NO: 360691 - RNA, 22 nt, Homo sapiens
uuacuguauagaaucaucuuga

SEQ ID NO: 360692 - RNA, 22 nt, Homo sapiens
uuagaucaacauggaacucuau

SEQ ID NO: 360693 - RNA, 22 nt, Homo sapiens
uuagcacuaauucguuggggca

SEQ ID NO: 360694 - RNA, 22 nt, Homo sapiens
uuagcacugagaauggcuugcu

SEQ ID NO: 360695 - RNA, 22 nt, Homo sapiens
uuagcagcaugagaauggacua

SEQ ID NO: 360696 - RNA, 20 nt, Homo sapiens
uuagcagcaugauuuauaau

SEQ ID NO: 360697 - RNA, 22 nt, Homo sapiens
uuagcagcucuaauaacugcua

SEQ ID NO: 360698 - RNA, 22 nt, Homo sapiens
uuagcucaguuggugagagcgu

SEQ ID NO: 360699 - RNA, 22 nt, Homo sapiens
uuaggcuaguugauauaguuug

SEQ ID NO: 360700 - RNA, 22 nt, Homo sapiens
uuaggcuuuguguccccaccca

SEQ ID NO: 360701 - RNA, 22 nt, Homo sapiens
uuaggugcauggaaguguuuuc

SEQ ID NO: 360702 - RNA, 22 nt, Homo sapiens
uggauggagaggcuugugaugc

SEQ ID NO: 360703 - RNA, 22 nt, Homo sapiens
uggauggucagaggguuucugu

SEQ ID NO: 360704 - RNA, 22 nt, Homo sapiens
uggauggugauuggaucaugga

SEQ ID NO: 360705 - RNA, 22 nt, Homo sapiens
uggauugagaagcuguggcuca

SEQ ID NO: 360706 - RNA, 22 nt, Homo sapiens
uggcaaaaaaacgcaauuacgu

SEQ ID NO: 360707 - RNA, 22 nt, Homo sapiens
uggcaagaagagcaugagacca

SEQ ID NO: 360708 - RNA, 23 nt, Homo sapiens
uggcaagaauucuuaccgugugg

SEQ ID NO: 360709 - RNA, 22 nt, Homo sapiens
uggcaauaauucagugugggcu

SEQ ID NO: 360710 - RNA, 22 nt, Homo sapiens
uggcaauauccacaauuacuuu

SEQ ID NO: 360711 - RNA, 22 nt, Homo sapiens
uggcaccauccaggugucucua

SEQ ID NO: 360712 - RNA, 22 nt, Homo sapiens
uggcaccugacuccgagaugca

SEQ ID NO: 360713 - RNA, 22 nt, Homo sapiens
uggcagcgugaauguggcugaa

SEQ ID NO: 360714 - RNA, 22 nt, Homo sapiens
uggcagugggagauauuuuauu

SEQ ID NO: 360715 - RNA, 22 nt, Homo sapiens
uggcaguuuuaugugguucaac

SEQ ID NO: 360716 - RNA, 22 nt, Homo sapiens
uggcauggaaagcuuuucauac

SEQ ID NO: 360717 - RNA, 22 nt, Homo sapiens
uggcauggaacuacuuugaaac

SEQ ID NO: 360718 - RNA, 22 nt, Homo sapiens
uggcauggucugcccaaguuuc

SEQ ID NO: 360719 - RNA, 22 nt, Homo sapiens
uggcauguagucugggaccugg

SEQ ID NO: 360720 - RNA, 22 nt, Homo sapiens
uggcauguauuuuguguauuaa

SEQ ID NO: 360721 - RNA, 22 nt, Homo sapiens
uggcauguguuugaaugaguau

SEQ ID NO: 360722 - RNA, 22 nt, Homo sapiens
uggccagagggcaauuagcugu

SEQ ID NO: 360723 - RNA, 22 nt, Homo sapiens
uggccagugucggaggccagga

SEQ ID NO: 360724 - RNA, 22 nt, Homo sapiens
uggcucuguuuguuaacuagac

SEQ ID NO: 360725 - RNA, 22 nt, Homo sapiens
uggcuguuuauuucacgugggu

SEQ ID NO: 360726 - RNA, 22 nt, Homo sapiens
ugggaacugaggugaaaagaca

SEQ ID NO: 360727 - RNA, 22 nt, Homo sapiens
ugggaccccuacucuuuccaca

SEQ ID NO: 360728 - RNA, 22 nt, Homo sapiens
ugggauccaugugguuuaagca

SEQ ID NO: 360729 - RNA, 22 nt, Homo sapiens
ugggcaagagagcaugacccug

SEQ ID NO: 360730 - RNA, 22 nt, Homo sapiens
ugggcaagugacuuggcuucuc

SEQ ID NO: 360731 - RNA, 22 nt, Homo sapiens
ugggcuagaugcuuugggguca

SEQ ID NO: 360732 - RNA, 22 nt, Homo sapiens
uggggugugagggagaaagaaa

SEQ ID NO: 360733 - RNA, 22 nt, Homo sapiens
uggguagagaaucaggaucuua

SEQ ID NO: 360734 - RNA, 19 nt, Homo sapiens
uggguagugaugagacaua

SEQ ID NO: 360735 - RNA, 22 nt, Homo sapiens
ugggucaguagcauguaugucu

SEQ ID NO: 360736 - RNA, 22 nt, Homo sapiens
uggguccccuacucuuuccaca

SEQ ID NO: 360737 - RNA, 22 nt, Homo sapiens
ugggugugaccgcucaaggggg

SEQ ID NO: 360738 - RNA, 22 nt, Homo sapiens
ugguaagaucugugagccaggc

SEQ ID NO: 360739 - RNA, 22 nt, Homo sapiens
ugguaguuucuguaucucacag

SEQ ID NO: 360740 - RNA, 22 nt, Homo sapiens
uggucaaaugccaaucuguagu

SEQ ID NO: 360741 - RNA, 21 nt, Homo sapiens
uggucaguuuucucacuagga

SEQ ID NO: 360742 - RNA, 22 nt, Homo sapiens
uggucauggggcagcugacacu

SEQ ID NO: 360743 - RNA, 22 nt, Homo sapiens
ugguccaguucugugauauugc

SEQ ID NO: 360744 - RNA, 22 nt, Homo sapiens
ugguccccaauacuucuauaga

SEQ ID NO: 360745 - RNA, 22 nt, Homo sapiens
uggucucuuugcuuuagucauc

SEQ ID NO: 360746 - RNA, 22 nt, Homo sapiens
uggugagaaacuagauauuuuu

SEQ ID NO: 360747 - RNA, 22 nt, Homo sapiens
uggugcuugaugaggguggagc

SEQ ID NO: 360748 - RNA, 20 nt, Homo sapiens
uggugguuuuaugugguuua

SEQ ID NO: 360749 - RNA, 20 nt, Homo sapiens
uggugucuuggaaagagcuc

SEQ ID NO: 360750 - RNA, 22 nt, Homo sapiens
uguaaaaagcccagccgcugag

SEQ ID NO: 360751 - RNA, 22 nt, Homo sapiens
uguaaaccauauauguauguag

SEQ ID NO: 360752 - RNA, 22 nt, Homo sapiens
uguaaaccucugaguacaagcu

SEQ ID NO: 360753 - RNA, 23 nt, Homo sapiens
uguaaagcuaugaauuauucuuu

SEQ ID NO: 360754 - RNA, 22 nt, Homo sapiens
uguaacacacacuguuuacucc

SEQ ID NO: 360755 - RNA, 22 nt, Homo sapiens
uguaacaggaggaaaaugugaa

SEQ ID NO: 360756 - RNA, 22 nt, Homo sapiens
uguaagcauuauauaauuguug

SEQ ID NO: 360757 - RNA, 20 nt, Homo sapiens
uguaaucuaaguuuuaagcc

SEQ ID NO: 360758 - RNA, 22 nt, Homo sapiens
uguaauguuucaucauuauuaa

SEQ ID NO: 360759 - RNA, 22 nt, Homo sapiens
uguacaaaacaagaugggggua

SEQ ID NO: 360760 - RNA, 19 nt, Homo sapiens
uguacacuguaaaccugug

SEQ ID NO: 360761 - RNA, 22 nt, Homo sapiens
uguagcaaaucgauacuauugg

SEQ ID NO: 360762 - RNA, 22 nt, Homo sapiens
uguagggagagggaguugcacc

SEQ ID NO: 360763 - RNA, 22 nt, Homo sapiens
uguagguguacauacaugguua

SEQ ID NO: 360764 - RNA, 22 nt, Homo sapiens
uguagucauuccuuuuugcuuu

SEQ ID NO: 360765 - RNA, 22 nt, Homo sapiens
uguauacauauguauguuuugu

SEQ ID NO: 360766 - RNA, 22 nt, Homo sapiens
uguauacauguguguucacgca

SEQ ID NO: 360767 - RNA, 22 nt, Homo sapiens
uguauacugucuaauauguugu

SEQ ID NO: 360768 - RNA, 22 nt, Homo sapiens
uguaugaguuguuuauaaauuu

SEQ ID NO: 360769 - RNA, 22 nt, Homo sapiens
uguauguugggucaaaguacau

SEQ ID NO: 360770 - RNA, 22 nt, Homo sapiens
ugucaaacauuaugaugcucua

SEQ ID NO: 360771 - RNA, 22 nt, Homo sapiens
ugucaaauucuggguuaaaaca

SEQ ID NO: 360772 - RNA, 22 nt, Homo sapiens
ugucaacauuuaucaaguuauu

SEQ ID NO: 360773 - RNA, 22 nt, Homo sapiens
ugucaagaaaucaaggugugag

SEQ ID NO: 360774 - RNA, 22 nt, Homo sapiens
cuuuggguauucucccuugggg

SEQ ID NO: 360775 - RNA, 21 nt, Homo sapiens
cuuugguagaguuuuuagggu

SEQ ID NO: 360776 - RNA, 22 nt, Homo sapiens
cuuuguccuucaagguguguca

SEQ ID NO: 360777 - RNA, 22 nt, Homo sapiens
cuuugugugggccaagggcugg

SEQ ID NO: 360778 - RNA, 22 nt, Homo sapiens
cuuuuacacugguggugggaau

SEQ ID NO: 360779 - RNA, 22 nt, Homo sapiens
cuuuuacacuguuagugggaau

SEQ ID NO: 360780 - RNA, 22 nt, Homo sapiens
cuuuuguggaucuucuguugcu

SEQ ID NO: 360781 - RNA, 22 nt, Homo sapiens
cuuuuugcugcagcaauacugg

SEQ ID NO: 360782 - RNA, 22 nt, Homo sapiens
cuuuuugguagagcaggugugc

SEQ ID NO: 360783 - RNA, 22 nt, Homo sapiens
gaaacugcauuucuaacaagcu

SEQ ID NO: 360784 - RNA, 22 nt, Homo sapiens
gaaagcugguauagauacauua

SEQ ID NO: 360785 - RNA, 22 nt, Homo sapiens
gaaaguaauuaacgauuguugc

SEQ ID NO: 360786 - RNA, 22 nt, Homo sapiens
gaaauggaucagagcaagcuuu

SEQ ID NO: 360787 - RNA, 23 nt, Homo sapiens
gaaauguaagugaugccccacag

SEQ ID NO: 360788 - RNA, 22 nt, Homo sapiens
gaacugggguuggguugcgaua

SEQ ID NO: 360789 - RNA, 22 nt, Homo sapiens
gaacuuguguugcuucacaugu

SEQ ID NO: 360790 - RNA, 22 nt, Homo sapiens
gaacuuucuacauuaccucuuu

SEQ ID NO: 360791 - RNA, 22 nt, Homo sapiens
gaagaaguacaagacaaauuuu

SEQ ID NO: 360792 - RNA, 22 nt, Homo sapiens
gaagacauuugcugcacguccu

SEQ ID NO: 360793 - RNA, 22 nt, Homo sapiens
gaagcauugauccacaggcgug

SEQ ID NO: 360794 - RNA, 22 nt, Homo sapiens
gaagguauauucuguuaaugcu

SEQ ID NO: 360795 - RNA, 22 nt, Homo sapiens
gaagugguaggauugcuuuuga

SEQ ID NO: 360796 - RNA, 19 nt, Homo sapiens
gaaguguuguccuccagua

SEQ ID NO: 360797 - RNA, 22 nt, Homo sapiens
gaauagugcugcaguaaacaua

SEQ ID NO: 360798 - RNA, 22 nt, Homo sapiens
gaauagugcugcgauaaacaua

SEQ ID NO: 360799 - RNA, 22 nt, Homo sapiens
gaauucugucgcuuacuagaug

SEQ ID NO: 360800 - RNA, 22 nt, Homo sapiens
gaauugcacaaaaacugcuugu

SEQ ID NO: 360801 - RNA, 22 nt, Homo sapiens
gacaagagaacacugcuauauu

SEQ ID NO: 360802 - RNA, 22 nt, Homo sapiens
gacacagugaagucucuacuug

SEQ ID NO: 360803 - RNA, 22 nt, Homo sapiens
gacaccauuucaguacuagguu

SEQ ID NO: 360804 - RNA, 18 nt, Homo sapiens
gacaguguggcgauuccu

SEQ ID NO: 360805 - RNA, 22 nt, Homo sapiens
gacaguguggcgauuccucaag

SEQ ID NO: 360806 - RNA, 22 nt, Homo sapiens
gacaguuucucaggcuuccuua

SEQ ID NO: 360807 - RNA, 22 nt, Homo sapiens
gacauagcuagauaaccucaug

SEQ ID NO: 360808 - RNA, 21 nt, Homo sapiens
gacauggcgauacuccgucuc

SEQ ID NO: 360809 - RNA, 20 nt, Homo sapiens
gacauguugguuugcugcac

SEQ ID NO: 360810 - RNA, 22 nt, Homo sapiens
gacauguuucucucuguuuacu

SEQ ID NO: 360811 - RNA, 22 nt, Homo sapiens
gacauguuuucaagauuuauaa

SEQ ID NO: 360812 - RNA, 22 nt, Homo sapiens
gacauguuuuuuaagguuuaug

SEQ ID NO: 360813 - RNA, 22 nt, Homo sapiens
gacccucuagauggaagcacug

SEQ ID NO: 360814 - RNA, 22 nt, Homo sapiens
gacccuuagaaugugaucuuau

SEQ ID NO: 360815 - RNA, 22 nt, Homo sapiens
gaccuuguagaaucucaugauu

SEQ ID NO: 360816 - RNA, 22 nt, Homo sapiens
gacuaaugaaagagugugauau

SEQ ID NO: 360817 - RNA, 22 nt, Homo sapiens
gacugaggaagcgcucucuccu

SEQ ID NO: 360818 - RNA, 22 nt, Homo sapiens
gacuggagcuguaugugguuac

SEQ ID NO: 360819 - RNA, 16 nt, Homo sapiens
gacugggcugaggaau

SEQ ID NO: 360820 - RNA, 20 nt, Homo sapiens
gacuucagaagcuucagagu

SEQ ID NO: 360821 - RNA, 20 nt, Homo sapiens
gacuugagagugggagagua

SEQ ID NO: 360822 - RNA, 22 nt, Homo sapiens
gagaacagaagcauuccuaauu

SEQ ID NO: 360823 - RNA, 22 nt, Homo sapiens
gagaacaguguuguauuuuuuc

SEQ ID NO: 360824 - RNA, 22 nt, Homo sapiens
gagaaccuccagcaagguagua

SEQ ID NO: 360825 - RNA, 22 nt, Homo sapiens
gagacagugucagccauugaaa

SEQ ID NO: 360826 - RNA, 22 nt, Homo sapiens
gagacggagucucgcucugucg

SEQ ID NO: 360827 - RNA, 22 nt, Homo sapiens
gagacggagucuugcucuguug

SEQ ID NO: 360828 - RNA, 22 nt, Homo sapiens
gagagugaaguuugcuaccugu

SEQ ID NO: 360829 - RNA, 21 nt, Homo sapiens
gagauagguaccgaagcuuag

SEQ ID NO: 360830 - RNA, 22 nt, Homo sapiens
gagaucaaugggauggaauuga

SEQ ID NO: 360831 - RNA, 22 nt, Homo sapiens
gagaucaguuaaugaagugagc

SEQ ID NO: 360832 - RNA, 22 nt, Homo sapiens
gagaucauuaugucagggguca

SEQ ID NO: 360833 - RNA, 22 nt, Homo sapiens
gagaucuauuccucacccuucu

SEQ ID NO: 360834 - RNA, 22 nt, Homo sapiens
gagaugaaguuaaggaucuuua

SEQ ID NO: 360835 - RNA, 22 nt, Homo sapiens
gagaugaugagauguucacagu

SEQ ID NO: 360836 - RNA, 22 nt, Homo sapiens
gagaugguacacauacgauucu

SEQ ID NO: 360837 - RNA, 22 nt, Homo sapiens
gagauggugugcuguuggaagu

SEQ ID NO: 360838 - RNA, 22 nt, Homo sapiens
gagaugguguuccacugccagu

SEQ ID NO: 360839 - RNA, 22 nt, Homo sapiens
gagauguagucuugcccuguca

SEQ ID NO: 360840 - RNA, 20 nt, Homo sapiens
gagauguugaucagggcuau

SEQ ID NO: 360841 - RNA, 22 nt, Homo sapiens
gagauuaauacacaucaaaugc

SEQ ID NO: 360842 - RNA, 22 nt, Homo sapiens
gagauuuucagcuugacuggga

SEQ ID NO: 360843 - RNA, 22 nt, Homo sapiens
augcauaugucuuuauaguggc

SEQ ID NO: 360844 - RNA, 18 nt, Homo sapiens
augcauauuuuaaguugu

SEQ ID NO: 360845 - RNA, 22 nt, Homo sapiens
augcauggagucuuucacaagu

SEQ ID NO: 360846 - RNA, 22 nt, Homo sapiens
augccacuucucuaagucaugu

SEQ ID NO: 360847 - RNA, 22 nt, Homo sapiens
augccauugcacuccagccuag

SEQ ID NO: 360848 - RNA, 20 nt, Homo sapiens
auggaacugugagccaauua

SEQ ID NO: 360849 - RNA, 22 nt, Homo sapiens
auggaagaaaguuggguucuug

SEQ ID NO: 360850 - RNA, 22 nt, Homo sapiens
auggaaggagaauggucuuuga

SEQ ID NO: 360851 - RNA, 22 nt, Homo sapiens
auggaaggagaggaaugaauga

SEQ ID NO: 360852 - RNA, 22 nt, Homo sapiens
auggaaugccauuuauaaugga

SEQ ID NO: 360853 - RNA, 22 nt, Homo sapiens
auggaauguaaguuauguuugc

SEQ ID NO: 360854 - RNA, 22 nt, Homo sapiens
auggaauguauagucauguagg

SEQ ID NO: 360855 - RNA, 22 nt, Homo sapiens
auggagagaauuauucucucag

SEQ ID NO: 360856 - RNA, 22 nt, Homo sapiens
auggaggccuacagaauuuugg

SEQ ID NO: 360857 - RNA, 22 nt, Homo sapiens
auggauagucucacucacauac

SEQ ID NO: 360858 - RNA, 22 nt, Homo sapiens
auggcacuguguccugggguca

SEQ ID NO: 360859 - RNA, 22 nt, Homo sapiens
auggcagcccucuuuauccaug

SEQ ID NO: 360860 - RNA, 22 nt, Homo sapiens
auggcagugucuagggguguuu

SEQ ID NO: 360861 - RNA, 22 nt, Homo sapiens
auggccugaugcaccuguccca

SEQ ID NO: 360862 - RNA, 22 nt, Homo sapiens
auggccuuuacaauuugguaug

SEQ ID NO: 360863 - RNA, 22 nt, Homo sapiens
auggcucaauucuuucccugaa

SEQ ID NO: 360864 - RNA, 22 nt, Homo sapiens
auggcucaguguguaucuauca

SEQ ID NO: 360865 - RNA, 22 nt, Homo sapiens
auggcuuuaagagugucugaau

SEQ ID NO: 360866 - RNA, 22 nt, Homo sapiens
auggcuuugggcugcucugccc

SEQ ID NO: 360867 - RNA, 22 nt, Homo sapiens
augggacugggugccguggagc

SEQ ID NO: 360868 - RNA, 22 nt, Homo sapiens
augggagugugguuagagaccu

SEQ ID NO: 360869 - RNA, 22 nt, Homo sapiens
augguacuggggucccggaguu

SEQ ID NO: 360870 - RNA, 20 nt, Homo sapiens
augguaguagcaccuuuaca

SEQ ID NO: 360871 - RNA, 22 nt, Homo sapiens
augguauuuugugauaccuugu

SEQ ID NO: 360872 - RNA, 22 nt, Homo sapiens
auggucuuuguuucuaauucug

SEQ ID NO: 360873 - RNA, 22 nt, Homo sapiens
augguuuuacugcaaaauggga

SEQ ID NO: 360874 - RNA, 22 nt, Homo sapiens
auguaaacuacagauuuugggu

SEQ ID NO: 360875 - RNA, 22 nt, Homo sapiens
auguaacaguauuuggagaugu

SEQ ID NO: 360876 - RNA, 22 nt, Homo sapiens
auguaagugugcucaaauguua

SEQ ID NO: 360877 - RNA, 22 nt, Homo sapiens
auguauacauagauacgugugu

SEQ ID NO: 360878 - RNA, 22 nt, Homo sapiens
auguauggaguuuaggggaugg

SEQ ID NO: 360879 - RNA, 22 nt, Homo sapiens
augucacagguccuagccaagu

SEQ ID NO: 360880 - RNA, 20 nt, Homo sapiens
augucaggaagggagucagg

SEQ ID NO: 360881 - RNA, 22 nt, Homo sapiens
auguccaugagcacauguauca

SEQ ID NO: 360882 - RNA, 22 nt, Homo sapiens
augucuguuugcugagcccggc

SEQ ID NO: 360883 - RNA, 17 nt, Homo sapiens
augugaauguucaaaua

SEQ ID NO: 360884 - RNA, 22 nt, Homo sapiens
augugacuuuuuccugugccuu

SEQ ID NO: 360885 - RNA, 22 nt, Homo sapiens
augugcaagaucauuaaagcuc

SEQ ID NO: 360886 - RNA, 22 nt, Homo sapiens
augugcaugcuguucugccaga

SEQ ID NO: 360887 - RNA, 18 nt, Homo sapiens
auguggcuuuugaaggcu

SEQ ID NO: 360888 - RNA, 22 nt, Homo sapiens
augugguaguuauagugauaag

SEQ ID NO: 360889 - RNA, 22 nt, Homo sapiens
auguggugguagccaggacagg

SEQ ID NO: 360890 - RNA, 22 nt, Homo sapiens
augugucaaaucuaggccaaag

SEQ ID NO: 360891 - RNA, 22 nt, Homo sapiens
augugugaaucccagaaccugu

SEQ ID NO: 360892 - RNA, 23 nt, Homo sapiens
augugugcuuggagagcaggaug

SEQ ID NO: 360893 - RNA, 22 nt, Homo sapiens
auguuauguuaaugauaaugga

SEQ ID NO: 360894 - RNA, 18 nt, Homo sapiens
auguuauguuuguagaag

SEQ ID NO: 360895 - RNA, 22 nt, Homo sapiens
auuaagugcuugccagugcugg

SEQ ID NO: 360896 - RNA, 22 nt, Homo sapiens
auuacauagucaaggugucuca

SEQ ID NO: 360897 - RNA, 22 nt, Homo sapiens
auuacaugucuauccaugaaca

SEQ ID NO: 360898 - RNA, 22 nt, Homo sapiens
auuacuuugcaccaaccuaaua

SEQ ID NO: 360899 - RNA, 22 nt, Homo sapiens
auuagguauuuucuggacaggg

SEQ ID NO: 360900 - RNA, 22 nt, Homo sapiens
auuagguuaggcaaacuucugu

SEQ ID NO: 360901 - RNA, 22 nt, Homo sapiens
auuagugaaugugaugucuuga

SEQ ID NO: 360902 - RNA, 22 nt, Homo sapiens
auuauaguguauacuugaaauu

SEQ ID NO: 360903 - RNA, 22 nt, Homo sapiens
cuucacuggagucccuggauuc

SEQ ID NO: 360904 - RNA, 22 nt, Homo sapiens
cuucagcaauauauccccuggg

SEQ ID NO: 360905 - RNA, 22 nt, Homo sapiens
cuucaugggagaaccacaggua

SEQ ID NO: 360906 - RNA, 22 nt, Homo sapiens
cuuccagcuggguucagucagu

SEQ ID NO: 360907 - RNA, 22 nt, Homo sapiens
cuuccaguggcagccgggcaug

SEQ ID NO: 360908 - RNA, 22 nt, Homo sapiens
cuuccauauucuaggacaggcu

SEQ ID NO: 360909 - RNA, 18 nt, Homo sapiens
cuuccuuagucugguuaa

SEQ ID NO: 360910 - RNA, 22 nt, Homo sapiens
cuucuugcuguguccucacaug

SEQ ID NO: 360911 - RNA, 20 nt, Homo sapiens
cuugaagacuaugcugcuga

SEQ ID NO: 360912 - RNA, 22 nt, Homo sapiens
cuugaccaauauggugaaaccc

SEQ ID NO: 360913 - RNA, 22 nt, Homo sapiens
cuugagcaaacaaaggugguag

SEQ ID NO: 360914 - RNA, 22 nt, Homo sapiens
cuugcagagucauucuaauuuc

SEQ ID NO: 360915 - RNA, 22 nt, Homo sapiens
cuugccuuugucuucaaaggcu

SEQ ID NO: 360916 - RNA, 22 nt, Homo sapiens
cuuggcuccgacuccccuccaa

SEQ ID NO: 360917 - RNA, 22 nt, Homo sapiens
cuuggcuuguuguccccugcuc

SEQ ID NO: 360918 - RNA, 22 nt, Homo sapiens
cuugguacucugugucccagcu

SEQ ID NO: 360919 - RNA, 22 nt, Homo sapiens
cuugguuacauuuuccuagaaa

SEQ ID NO: 360920 - RNA, 22 nt, Homo sapiens
cuuguacacuguuggugggaau

SEQ ID NO: 360921 - RNA, 22 nt, Homo sapiens
cuuguggugcuuuuacgugggc

SEQ ID NO: 360922 - RNA, 22 nt, Homo sapiens
cuuguguuacauauuuaagaga

SEQ ID NO: 360923 - RNA, 22 nt, Homo sapiens
cuuugggaccgcgguuuauacu

SEQ ID NO: 360924 - RNA, 22 nt, Homo sapiens
gcugacacugggcuauagaucu

SEQ ID NO: 360925 - RNA, 22 nt, Homo sapiens
gcugagaucucuugccugaacu

SEQ ID NO: 360926 - RNA, 22 nt, Homo sapiens
gcugagcuaugccauauaugcc

SEQ ID NO: 360927 - RNA, 22 nt, Homo sapiens
gcugagguucaagaagguuaaa

SEQ ID NO: 360928 - RNA, 22 nt, Homo sapiens
gcugcuguaccagaugugguua

SEQ ID NO: 360929 - RNA, 22 nt, Homo sapiens
gcugcuguuauucaucagaacu

SEQ ID NO: 360930 - RNA, 22 nt, Homo sapiens
gcuggugacuuuaaguugaagc

SEQ ID NO: 360931 - RNA, 22 nt, Homo sapiens
gcuguaguugaggauuuuaaga

SEQ ID NO: 360932 - RNA, 22 nt, Homo sapiens
gcuguguguuaucagaaauugc

SEQ ID NO: 360933 - RNA, 22 nt, Homo sapiens
gcuguguugugcccagcaucau

SEQ ID NO: 360934 - RNA, 22 nt, Homo sapiens
gcuguuugccgccaucgcagac

SEQ ID NO: 360935 - RNA, 22 nt, Homo sapiens
gcuuuggauaaaugucaguuua

SEQ ID NO: 360936 - RNA, 22 nt, Homo sapiens
gcuuuguuguugaugggaaauc

SEQ ID NO: 360937 - RNA, 18 nt, Homo sapiens
ggaaaacuuuucuaagua

SEQ ID NO: 360938 - RNA, 22 nt, Homo sapiens
ggaaagacaccuuacuauguua

SEQ ID NO: 360939 - RNA, 22 nt, Homo sapiens
ggaaagaucagcuaaauguaag

SEQ ID NO: 360940 - RNA, 22 nt, Homo sapiens
ggaaaguaacccauucucuuac

SEQ ID NO: 360941 - RNA, 22 nt, Homo sapiens
ggaaauguuggugucaugaguu

SEQ ID NO: 360942 - RNA, 22 nt, Homo sapiens
ggaagaauaaugggccuuagag

SEQ ID NO: 360943 - RNA, 20 nt, Homo sapiens
ggaagagugacacaagguau

SEQ ID NO: 360944 - RNA, 21 nt, Homo sapiens
uagauaguugguucugaaucu

SEQ ID NO: 360945 - RNA, 20 nt, Homo sapiens
uagaugcauuuagauucauu

SEQ ID NO: 360946 - RNA, 22 nt, Homo sapiens
uagauuaucuguaugugcucuu

SEQ ID NO: 360947 - RNA, 22 nt, Homo sapiens
uagcacaucccuaaaaugcugu

SEQ ID NO: 360948 - RNA, 20 nt, Homo sapiens
uagcacaucuggcuguagag

SEQ ID NO: 360949 - RNA, 22 nt, Homo sapiens
uagcacaucuucuuggccugca

SEQ ID NO: 360950 - RNA, 22 nt, Homo sapiens
uagcaccucuuuggccuuucgu

SEQ ID NO: 360951 - RNA, 22 nt, Homo sapiens
uagcagcauuuuuguagaguau

SEQ ID NO: 360952 - RNA, 22 nt, Homo sapiens
uagcagcuuuauugagguaaau

SEQ ID NO: 360953 - RNA, 22 nt, Homo sapiens
uagcaguauugaaagaugaggg

SEQ ID NO: 360954 - RNA, 22 nt, Homo sapiens
uagcagugugaaaacagacuaa

SEQ ID NO: 360955 - RNA, 22 nt, Homo sapiens
uagcaucagauuccauauucua

SEQ ID NO: 360956 - RNA, 22 nt, Homo sapiens
uagcccauuuguuuagggaaag

SEQ ID NO: 360957 - RNA, 20 nt, Homo sapiens
uagccggguguugugucaug

SEQ ID NO: 360958 - RNA, 21 nt, Homo sapiens
uagcuacacugugauucaugg

SEQ ID NO: 360959 - RNA, 19 nt, Homo sapiens
uagcuagauuggguacuua

SEQ ID NO: 360960 - RNA, 22 nt, Homo sapiens
uagcugcaaaauauagacuucu

SEQ ID NO: 360961 - RNA, 22 nt, Homo sapiens
uagcugcacuuacaagugagaa

SEQ ID NO: 360962 - RNA, 22 nt, Homo sapiens
uagcuggaauuacuugcaccug

SEQ ID NO: 360963 - RNA, 22 nt, Homo sapiens
uagcugguucuccaggagcuag

SEQ ID NO: 360964 - RNA, 22 nt, Homo sapiens
uaggacauugcccuuguggaga

SEQ ID NO: 360965 - RNA, 20 nt, Homo sapiens
uaggagcaaugagaguagaa

SEQ ID NO: 360966 - RNA, 22 nt, Homo sapiens
uaggagugugaacccuaugaac

SEQ ID NO: 360967 - RNA, 22 nt, Homo sapiens
uaggcaaaugcaagaguagaac

SEQ ID NO: 360968 - RNA, 22 nt, Homo sapiens
uaggcaauguggcgaaacucug

SEQ ID NO: 360969 - RNA, 22 nt, Homo sapiens
uaggcacuguguuuguaggagu

SEQ ID NO: 360970 - RNA, 22 nt, Homo sapiens
uagggcauguguggaguguaug

SEQ ID NO: 360971 - RNA, 22 nt, Homo sapiens
uagggcuuuuccaagcugccac

SEQ ID NO: 360972 - RNA, 22 nt, Homo sapiens
uaggguaguaauaguuguuuca

SEQ ID NO: 360973 - RNA, 22 nt, Homo sapiens
uaggucaguuuuggcuuggcuu

SEQ ID NO: 360974 - RNA, 23 nt, Homo sapiens
uagguuauuugguaaauauaugu

SEQ ID NO: 360975 - RNA, 20 nt, Homo sapiens
uagguuuucacagaauugcc

SEQ ID NO: 360976 - RNA, 22 nt, Homo sapiens
uaguagagauggggcacaugcc

SEQ ID NO: 360977 - RNA, 22 nt, Homo sapiens
uaguagugucccugacuaucac

SEQ ID NO: 360978 - RNA, 22 nt, Homo sapiens
uagucaaaucugaaggaaauuu

SEQ ID NO: 360979 - RNA, 22 nt, Homo sapiens
uagucccuuucuauuaaugaga

SEQ ID NO: 360980 - RNA, 21 nt, Homo sapiens
uagugcagugggguaugacuu

SEQ ID NO: 360981 - RNA, 22 nt, Homo sapiens
uauaagacuagcagcugaauug

SEQ ID NO: 360982 - RNA, 22 nt, Homo sapiens
uauacaugugggcaucaggaga

SEQ ID NO: 360983 - RNA, 22 nt, Homo sapiens
uauacuguuuucuauaguggcu

SEQ ID NO: 360984 - RNA, 21 nt, Homo sapiens
uauagcagcacgauuuauaau

SEQ ID NO: 360985 - RNA, 21 nt, Homo sapiens
uauagcagcacgauuuauagu

SEQ ID NO: 360986 - RNA, 22 nt, Homo sapiens
uauagcagugugagaacagacu

SEQ ID NO: 360987 - RNA, 22 nt, Homo sapiens
uauaguguuuucaaaaguaugu

SEQ ID NO: 360988 - RNA, 22 nt, Homo sapiens
uauaguuuuuccugggaggaaa

SEQ ID NO: 360989 - RNA, 23 nt, Homo sapiens
uaucacacuuucucugugccaca

SEQ ID NO: 360990 - RNA, 22 nt, Homo sapiens
uaucacagauucuccaggguuu

SEQ ID NO: 360991 - RNA, 22 nt, Homo sapiens
uaucacagcauugucuauaaua

SEQ ID NO: 360992 - RNA, 22 nt, Homo sapiens
uaucacaguaaaucugggugca

SEQ ID NO: 360993 - RNA, 22 nt, Homo sapiens
uaucacaguagaacucuuucca

SEQ ID NO: 360994 - RNA, 20 nt, Homo sapiens
uaucacaguucaggaacucu

SEQ ID NO: 360995 - RNA, 20 nt, Homo sapiens
uaucacauggggagaaaccu

SEQ ID NO: 360996 - RNA, 19 nt, Homo sapiens
uaucacuucccuggaaaca

SEQ ID NO: 360997 - RNA, 22 nt, Homo sapiens
uaucagaguuacacugaagacu

SEQ ID NO: 360998 - RNA, 22 nt, Homo sapiens
uaucauggaaugagguuggaca

SEQ ID NO: 360999 - RNA, 22 nt, Homo sapiens
uaucccuuagagcggggugguu

SEQ ID NO: 361000 - RNA, 23 nt, Homo sapiens
uaucccuugccuuaugaugugag

SEQ ID NO: 361001 - RNA, 22 nt, Homo sapiens
uauccugaagcuuuauuuaagu

SEQ ID NO: 361002 - RNA, 22 nt, Homo sapiens
uuuuaguggacaaagguauuua

SEQ ID NO: 361003 - RNA, 22 nt, Homo sapiens
uuuuauguuuguucccugccaa

SEQ ID NO: 361004 - RNA, 22 nt, Homo sapiens
uuuugcauuggcugaggagugu

SEQ ID NO: 361005 - RNA, 22 nt, Homo sapiens
uuuugcucuucggaagagcuug

SEQ ID NO: 361006 - RNA, 22 nt, Homo sapiens
uuuugcuugugaauagccacau

SEQ ID NO: 361007 - RNA, 22 nt, Homo sapiens
uuuuggcucugucuguaucuuu

SEQ ID NO: 361008 - RNA, 20 nt, Homo sapiens
uuuuggcuuaaagcagucug

SEQ ID NO: 361009 - RNA, 22 nt, Homo sapiens
uuuugguguacaauucuaugga

SEQ ID NO: 361010 - RNA, 22 nt, Homo sapiens
uuuugguucaauuaauuugcua

SEQ ID NO: 361011 - RNA, 19 nt, Homo sapiens
uuuuguacucugugacuug

SEQ ID NO: 361012 - RNA, 22 nt, Homo sapiens
uuuugucccaugggcuguuccc

SEQ ID NO: 361013 - RNA, 22 nt, Homo sapiens
uuuuuauggccaauccucagaa

SEQ ID NO: 361014 - RNA, 21 nt, Homo sapiens
uuuuugggcuuucauaguguu

SEQ ID NO: 361015 - RNA, 22 nt, Homo sapiens
ugacuauaguaaucacuucaca

SEQ ID NO: 361016 - RNA, 22 nt, Homo sapiens
ugacuauaucucuguauaaacu

SEQ ID NO: 361017 - RNA, 22 nt, Homo sapiens
ugacucagauagguguguauuc

SEQ ID NO: 361018 - RNA, 23 nt, Homo sapiens
ugacuggagacuguugauccuuu

SEQ ID NO: 361019 - RNA, 22 nt, Homo sapiens
ugacuucauuuuuggccaugag

SEQ ID NO: 361020 - RNA, 22 nt, Homo sapiens
ugacuugaguaacuggcucagg

SEQ ID NO: 361021 - RNA, 18 nt, Homo sapiens
ugagaacauguguacaca

SEQ ID NO: 361022 - RNA, 22 nt, Homo sapiens
ugagaauguagggcucucccag

SEQ ID NO: 361023 - RNA, 19 nt, Homo sapiens
ugagaauguuaccaggucc

SEQ ID NO: 361024 - RNA, 21 nt, Homo sapiens
ugagacaauccuggucaauau

SEQ ID NO: 361025 - RNA, 22 nt, Homo sapiens
ugagacaaucucaucucaguga

SEQ ID NO: 361026 - RNA, 22 nt, Homo sapiens
ugagaccuuucauuucucagug

SEQ ID NO: 361027 - RNA, 22 nt, Homo sapiens
ugagacggagucucgcucucua

SEQ ID NO: 361028 - RNA, 22 nt, Homo sapiens
ugagacggagucucgcucuguc

SEQ ID NO: 361029 - RNA, 22 nt, Homo sapiens
ugagacggaguuucacucuugu

SEQ ID NO: 361030 - RNA, 22 nt, Homo sapiens
ugagacuguuuuggggaacuuc

SEQ ID NO: 361031 - RNA, 19 nt, Homo sapiens
ugagagcacaacugaacaa

SEQ ID NO: 361032 - RNA, 22 nt, Homo sapiens
ugagagcuuugaugcacuguuu

SEQ ID NO: 361033 - RNA, 22 nt, Homo sapiens
ugagagcuuuuuugccugguga

SEQ ID NO: 361034 - RNA, 22 nt, Homo sapiens
ugagaggugaauggcaggcuca

SEQ ID NO: 361035 - RNA, 22 nt, Homo sapiens
ugagaguauaaauugaugcagc

SEQ ID NO: 361036 - RNA, 22 nt, Homo sapiens
ugagauaacuaaaaacauuuug

SEQ ID NO: 361037 - RNA, 21 nt, Homo sapiens
ugagauaauauguuucugaug

SEQ ID NO: 361038 - RNA, 22 nt, Homo sapiens
ugagauaaucaugugguuuuug

SEQ ID NO: 361039 - RNA, 22 nt, Homo sapiens
ugagauaaugcaugugaagauc

SEQ ID NO: 361040 - RNA, 22 nt, Homo sapiens
ugagauagaaaacauaggagaa

SEQ ID NO: 361041 - RNA, 19 nt, Homo sapiens
ugagauccacugaagauuc

SEQ ID NO: 361042 - RNA, 23 nt, Homo sapiens
ugagaucuacagaucucagaucu

SEQ ID NO: 361043 - RNA, 22 nt, Homo sapiens
ugagaucuuugcuguccucacc

SEQ ID NO: 361044 - RNA, 22 nt, Homo sapiens
ugagaugaagucucacucuguc

SEQ ID NO: 361045 - RNA, 22 nt, Homo sapiens
ugagaugaagucuugcucuguu

SEQ ID NO: 361046 - RNA, 22 nt, Homo sapiens
ugagaugagaaucaguucuaau

SEQ ID NO: 361047 - RNA, 22 nt, Homo sapiens
ugagauggaguuucacuuuugu

SEQ ID NO: 361048 - RNA, 22 nt, Homo sapiens
ugagauggcugaauucagaaua

SEQ ID NO: 361049 - RNA, 22 nt, Homo sapiens
ugagauggcuuuauugcugaau

SEQ ID NO: 361050 - RNA, 23 nt, Homo sapiens
ugagaugucugauugcgaggguc

SEQ ID NO: 361051 - RNA, 21 nt, Homo sapiens
ugagaugugaccagggcauca

SEQ ID NO: 361052 - RNA, 22 nt, Homo sapiens
ugagaugugaucaccugaaggg

SEQ ID NO: 361053 - RNA, 22 nt, Homo sapiens
ugagaugugugcauucaacuca

SEQ ID NO: 361054 - RNA, 22 nt, Homo sapiens
ugagauguuuagauuguugucu

SEQ ID NO: 361055 - RNA, 22 nt, Homo sapiens
ugagauuaaucuuuaaguaaga

SEQ ID NO: 361056 - RNA, 22 nt, Homo sapiens
ugagauuaucuguacauaggag

SEQ ID NO: 361057 - RNA, 22 nt, Homo sapiens
ugagauuaucuugaucuugaaa

SEQ ID NO: 361058 - RNA, 22 nt, Homo sapiens
ugagcaagaaauagaaacagau

SEQ ID NO: 361059 - RNA, 22 nt, Homo sapiens
ugagcacagagccugggguggc

SEQ ID NO: 361060 - RNA, 22 nt, Homo sapiens
ugagcagaaagcugcaaggucg

SEQ ID NO: 361061 - RNA, 22 nt, Homo sapiens
ugagcagagaucacggcauugu

SEQ ID NO: 361062 - RNA, 22 nt, Homo sapiens
ugagccaaguucacaccauugc

SEQ ID NO: 361063 - RNA, 22 nt, Homo sapiens
ugagcugagaucaugcuauugu

SEQ ID NO: 361064 - RNA, 22 nt, Homo sapiens
ugagcugagauuaagcugcugc

SEQ ID NO: 361065 - RNA, 22 nt, Homo sapiens
ugagcugguacuaauauuauca

SEQ ID NO: 361066 - RNA, 22 nt, Homo sapiens
ugaggaaugaccccgugugguc

SEQ ID NO: 361067 - RNA, 22 nt, Homo sapiens
ugaggcacucccuagcggggug

SEQ ID NO: 361068 - RNA, 22 nt, Homo sapiens
ugaggcuaggauaggcugauuc

SEQ ID NO: 361069 - RNA, 22 nt, Homo sapiens
ugaggguauagccagcccuuag

SEQ ID NO: 361070 - RNA, 22 nt, Homo sapiens
ugagguaacaaacuaugaguua

SEQ ID NO: 361071 - RNA, 22 nt, Homo sapiens
ugagguaacagaagcgagcauu

SEQ ID NO: 361072 - RNA, 22 nt, Homo sapiens
ugagguagaaugauucuaauau

SEQ ID NO: 361073 - RNA, 22 nt, Homo sapiens
ugagguaugacuuauuauucuu

SEQ ID NO: 361074 - RNA, 22 nt, Homo sapiens
ugagguaugugaugucuuuuag

SEQ ID NO: 361075 - RNA, 19 nt, Homo sapiens
ugagguauuuguugggaga

SEQ ID NO: 361076 - RNA, 22 nt, Homo sapiens
ugaggucuuuauuuagugcuca

SEQ ID NO: 361077 - RNA, 22 nt, Homo sapiens
ugaggugagauggcuaccccaa

SEQ ID NO: 361078 - RNA, 22 nt, Homo sapiens
ugagguugguauuacugucucu

SEQ ID NO: 361079 - RNA, 22 nt, Homo sapiens
ugaguagaacuccuggagaugu

SEQ ID NO: 361080 - RNA, 22 nt, Homo sapiens
ugaguagugccacaauaagcau

SEQ ID NO: 361081 - RNA, 22 nt, Homo sapiens
ugagucaugcuggagucauggc

SEQ ID NO: 361082 - RNA, 22 nt, Homo sapiens
ugagugagguucuacucuguga

SEQ ID NO: 361083 - RNA, 22 nt, Homo sapiens
ugagugccuggagggcagggac

SEQ ID NO: 361084 - RNA, 22 nt, Homo sapiens
ugagugugaggaagaauuagaa

SEQ ID NO: 361085 - RNA, 22 nt, Homo sapiens
ugaguuaguguggugcuuggaa

SEQ ID NO: 361086 - RNA, 22 nt, Homo sapiens
ugauacuggcuucauagaauga

SEQ ID NO: 361087 - RNA, 22 nt, Homo sapiens
ugauacugugcauuagaggcua

SEQ ID NO: 361088 - RNA, 22 nt, Homo sapiens
ugauaggagauuuucaucugua

SEQ ID NO: 361089 - RNA, 22 nt, Homo sapiens
ugauauauugaaugaugaaaca

SEQ ID NO: 361090 - RNA, 18 nt, Homo sapiens
ugauaucaucacaauuga

SEQ ID NO: 361091 - RNA, 22 nt, Homo sapiens
ugauauuuuugauccuuaaguu

SEQ ID NO: 361092 - RNA, 22 nt, Homo sapiens
ugauccuguccuuaugauguua

SEQ ID NO: 361093 - RNA, 22 nt, Homo sapiens
ccagaguucuaggcauuggaaa

SEQ ID NO: 361094 - RNA, 22 nt, Homo sapiens
ccagaguugccucagguuucug

SEQ ID NO: 361095 - RNA, 22 nt, Homo sapiens
ccagaguuucugauucagcagg

SEQ ID NO: 361096 - RNA, 20 nt, Homo sapiens
ccagcaucauuagauucugg

SEQ ID NO: 361097 - RNA, 22 nt, Homo sapiens
ccaggguuccacgccuggcugu

SEQ ID NO: 361098 - RNA, 22 nt, Homo sapiens
ccagugauggcugccucauuug

SEQ ID NO: 361099 - RNA, 22 nt, Homo sapiens
ccagugcugugcaguguaugag

SEQ ID NO: 361100 - RNA, 22 nt, Homo sapiens
ccaguguauuuuugggaccugc

SEQ ID NO: 361101 - RNA, 22 nt, Homo sapiens
ccaguuuucccagcaccauuaa

SEQ ID NO: 361102 - RNA, 17 nt, Homo sapiens
ccaguuuucccucagug

SEQ ID NO: 361103 - RNA, 22 nt, Homo sapiens
ugcaaauguuaguaacaccacu

SEQ ID NO: 361104 - RNA, 22 nt, Homo sapiens
ugcaaauuauugggccccaacu

SEQ ID NO: 361105 - RNA, 22 nt, Homo sapiens
ugcaagauaggcaguuugcacu

SEQ ID NO: 361106 - RNA, 22 nt, Homo sapiens
ugcaagaugagauuuuggaugg

SEQ ID NO: 361107 - RNA, 22 nt, Homo sapiens
ugcaagaugauuucaauugaua

SEQ ID NO: 361108 - RNA, 22 nt, Homo sapiens
ugcaaugugaaauaagcacauc

SEQ ID NO: 361109 - RNA, 17 nt, Homo sapiens
ugcaauuuaagcuagau

SEQ ID NO: 361110 - RNA, 22 nt, Homo sapiens
ugcaauuuaaugugucccaauu

SEQ ID NO: 361111 - RNA, 22 nt, Homo sapiens
ugcacacucuguaugagaaucu

SEQ ID NO: 361112 - RNA, 22 nt, Homo sapiens
ugcaccacugcaccccagucug

SEQ ID NO: 361113 - RNA, 22 nt, Homo sapiens
ugcaccacugcacuccagcuug

SEQ ID NO: 361114 - RNA, 22 nt, Homo sapiens
ugcaccacugcuagccugggua

SEQ ID NO: 361115 - RNA, 22 nt, Homo sapiens
ugcaccacuguacuccagucug

SEQ ID NO: 361116 - RNA, 22 nt, Homo sapiens
ugcacuguggucugagagacag

SEQ ID NO: 361117 - RNA, 22 nt, Homo sapiens
ugcagaaucccuucagauccga

SEQ ID NO: 361118 - RNA, 19 nt, Homo sapiens
ugcagcaauguaaaagaca

SEQ ID NO: 361119 - RNA, 20 nt, Homo sapiens
ugcagcacugggaaugcagu

SEQ ID NO: 361120 - RNA, 18 nt, Homo sapiens
ugcagcaucaguacccag

SEQ ID NO: 361121 - RNA, 22 nt, Homo sapiens
ugcagcauugcacuccagccug

SEQ ID NO: 361122 - RNA, 23 nt, Homo sapiens
ugcagcuacauguggccaugugc

SEQ ID NO: 361123 - RNA, 22 nt, Homo sapiens
ugcagcucaaauuccuaacaag

SEQ ID NO: 361124 - RNA, 22 nt, Homo sapiens
ugcagugugauuuucuggcuga

SEQ ID NO: 361125 - RNA, 22 nt, Homo sapiens
ugcagugugcuggggucuccau

SEQ ID NO: 361126 - RNA, 22 nt, Homo sapiens
ugcauaggcuaaaauccuggcc

SEQ ID NO: 361127 - RNA, 22 nt, Homo sapiens
ugcauaugcagcauuuaugauu

SEQ ID NO: 361128 - RNA, 22 nt, Homo sapiens
ugcauauguugaaccaggcuug

SEQ ID NO: 361129 - RNA, 22 nt, Homo sapiens
ugcauauucuaggauuuuguau

SEQ ID NO: 361130 - RNA, 22 nt, Homo sapiens
ugcauauuuuauaaagauggaa

SEQ ID NO: 361131 - RNA, 22 nt, Homo sapiens
ugcaucacaguacuccagccug

SEQ ID NO: 361132 - RNA, 22 nt, Homo sapiens
ugcauggagauauacaguuuuu

SEQ ID NO: 361133 - RNA, 22 nt, Homo sapiens
ugcauggagcucucuuuggacu

SEQ ID NO: 361134 - RNA, 22 nt, Homo sapiens
ugcauggauguuugaacacacu

SEQ ID NO: 361135 - RNA, 22 nt, Homo sapiens
ugcauuaguaaguaauuuuaau

SEQ ID NO: 361136 - RNA, 22 nt, Homo sapiens
ugcauuguaggauguuuagcag

SEQ ID NO: 361137 - RNA, 21 nt, Homo sapiens
ugcauugucuugaguuuaaau

SEQ ID NO: 361138 - RNA, 22 nt, Homo sapiens
ugcauuguuuuugguucccagg

SEQ ID NO: 361139 - RNA, 20 nt, Homo sapiens
ugccaagaaaugaggguauu

SEQ ID NO: 361140 - RNA, 20 nt, Homo sapiens
ugccaagaugacuauagcuc

SEQ ID NO: 361141 - RNA, 22 nt, Homo sapiens
ugccagaugcaguguucaacaa

SEQ ID NO: 361142 - RNA, 22 nt, Homo sapiens
ugccagaugcuggugugagggg

SEQ ID NO: 361143 - RNA, 22 nt, Homo sapiens
ugccaggaugaggucaauguuu

SEQ ID NO: 361144 - RNA, 22 nt, Homo sapiens
ugccaguuuuuacauuuccugu

SEQ ID NO: 361145 - RNA, 22 nt, Homo sapiens
ugccaugaagagaggaagcagu

SEQ ID NO: 361146 - RNA, 19 nt, Homo sapiens
ugccauguagcacaugguc

SEQ ID NO: 361147 - RNA, 22 nt, Homo sapiens
ugcccguaauuccagcacuuug

SEQ ID NO: 361148 - RNA, 22 nt, Homo sapiens
ugccuagaaacacuauuucucc

SEQ ID NO: 361149 - RNA, 23 nt, Homo sapiens
ugccuagaugcugcccugggaca

SEQ ID NO: 361150 - RNA, 22 nt, Homo sapiens
ugccuaggcuggaaugcagugg

SEQ ID NO: 361151 - RNA, 22 nt, Homo sapiens
ugccuaggcuggaguguagugg

SEQ ID NO: 361152 - RNA, 22 nt, Homo sapiens
ugcuagaagaucacacacauca

SEQ ID NO: 361153 - RNA, 22 nt, Homo sapiens
ugcuaugucagccaggcugguc

SEQ ID NO: 361154 - RNA, 21 nt, Homo sapiens
ugcuauguuguccaggcuggc

SEQ ID NO: 361155 - RNA, 22 nt, Homo sapiens
ugcuauguuuucccuccuuauc

SEQ ID NO: 361156 - RNA, 18 nt, Homo sapiens
ugcuccccugggugagca

SEQ ID NO: 361157 - RNA, 20 nt, Homo sapiens
ugcugcacuuaagcaugggc

SEQ ID NO: 361158 - RNA, 22 nt, Homo sapiens
ugcuggugauucagauucaaau

SEQ ID NO: 361159 - RNA, 22 nt, Homo sapiens
ugcuuugguagaaaucuuuggu

SEQ ID NO: 361160 - RNA, 22 nt, Homo sapiens
uggaaaguacugagguccaccu

SEQ ID NO: 361161 - RNA, 20 nt, Homo sapiens
uggaacuuaauugauggaca

SEQ ID NO: 361162 - RNA, 22 nt, Homo sapiens
uggaagacaaguguuagcaugg

SEQ ID NO: 361163 - RNA, 22 nt, Homo sapiens
uggaagacucaagguggugaau

SEQ ID NO: 361164 - RNA, 22 nt, Homo sapiens
uggaagacuuuagaggcuuaua

SEQ ID NO: 361165 - RNA, 22 nt, Homo sapiens
uggaagguaaguuuugagcauu

SEQ ID NO: 361166 - RNA, 22 nt, Homo sapiens
uggaaguaaccaugaauggaau

SEQ ID NO: 361167 - RNA, 23 nt, Homo sapiens
uggaaguauggaggaggcagaau

SEQ ID NO: 361168 - RNA, 22 nt, Homo sapiens
uggaagucuucauuauguauag

SEQ ID NO: 361169 - RNA, 22 nt, Homo sapiens
uggaagugucugugcccagcuc

SEQ ID NO: 361170 - RNA, 22 nt, Homo sapiens
uggaaucaucaacgaaugaaau

SEQ ID NO: 361171 - RNA, 21 nt, Homo sapiens
uggaaucuauuauuccaguuu

SEQ ID NO: 361172 - RNA, 19 nt, Homo sapiens
uggaaugaaauguuagggg

SEQ ID NO: 361173 - RNA, 22 nt, Homo sapiens
uggaaugcuaagcaugugggag

SEQ ID NO: 361174 - RNA, 22 nt, Homo sapiens
uggaauguggacucuuaugggg

SEQ ID NO: 361175 - RNA, 21 nt, Homo sapiens
uggaauguucugacuucaggg

SEQ ID NO: 361176 - RNA, 21 nt, Homo sapiens
uggaauuaauggagagguguu

SEQ ID NO: 361177 - RNA, 22 nt, Homo sapiens
uggacaagugcccuccaccuca

SEQ ID NO: 361178 - RNA, 22 nt, Homo sapiens
aaucucagagauaucugugucc

SEQ ID NO: 361179 - RNA, 22 nt, Homo sapiens
aaucuguagaaggugcacauuc

SEQ ID NO: 361180 - RNA, 22 nt, Homo sapiens
aaugacugugauauuuuucuuc

SEQ ID NO: 361181 - RNA, 22 nt, Homo sapiens
aaugaucaauguuugaggugau

SEQ ID NO: 361182 - RNA, 22 nt, Homo sapiens
aaugcauaauuuguaugaggua

SEQ ID NO: 361183 - RNA, 22 nt, Homo sapiens
aaugcaucuagaaaggugaauu

SEQ ID NO: 361184 - RNA, 22 nt, Homo sapiens
aaugccaucagagaaaacucuu

SEQ ID NO: 361185 - RNA, 22 nt, Homo sapiens
aauggcacuuuauaaauguuaa

SEQ ID NO: 361186 - RNA, 22 nt, Homo sapiens
aauggcaucuacguuaaauguc

SEQ ID NO: 361187 - RNA, 22 nt, Homo sapiens
aauggcuauuucaugugguagg

SEQ ID NO: 361188 - RNA, 22 nt, Homo sapiens
aaugguguuuccguuaagcuga

SEQ ID NO: 361189 - RNA, 22 nt, Homo sapiens
aaugguuuuaucagcguccaaa

SEQ ID NO: 361190 - RNA, 22 nt, Homo sapiens
aaugucacugugguccuccagu

SEQ ID NO: 361191 - RNA, 22 nt, Homo sapiens
aaugugccuacagugggcuguu

SEQ ID NO: 361192 - RNA, 22 nt, Homo sapiens
aauuacuucuacaccaaccuaa

SEQ ID NO: 361193 - RNA, 22 nt, Homo sapiens
aauucugugagauggugcagau

SEQ ID NO: 361194 - RNA, 22 nt, Homo sapiens
aauugaaucaugugggcagacu

SEQ ID NO: 361195 - RNA, 22 nt, Homo sapiens
aauugcacuaagcauaguccag

SEQ ID NO: 361196 - RNA, 21 nt, Homo sapiens
acaaagcuggagggagacugc

SEQ ID NO: 361197 - RNA, 22 nt, Homo sapiens
acaaaguaggcagugggcugga

SEQ ID NO: 361198 - RNA, 22 nt, Homo sapiens
acaaagugccuccuuuuagagu

SEQ ID NO: 361199 - RNA, 22 nt, Homo sapiens
acaacaguuuuaucaccccaga

SEQ ID NO: 361200 - RNA, 22 nt, Homo sapiens
acaauguauauuuuacuguagg

SEQ ID NO: 361201 - RNA, 22 nt, Homo sapiens
acacauacacauaugguguaua

SEQ ID NO: 361202 - RNA, 22 nt, Homo sapiens
acacauuagcaagugcuguuau

SEQ ID NO: 361203 - RNA, 22 nt, Homo sapiens
acaccaugucuguuucugguuu

SEQ ID NO: 361204 - RNA, 22 nt, Homo sapiens
acaccuguggucccaguaacuu

SEQ ID NO: 361205 - RNA, 22 nt, Homo sapiens
acacgugcagauuuauauaaau

SEQ ID NO: 361206 - RNA, 22 nt, Homo sapiens
acacuguagcugagggcaugcg

SEQ ID NO: 361207 - RNA, 22 nt, Homo sapiens
acagccauuccagccaaauacu

SEQ ID NO: 361208 - RNA, 22 nt, Homo sapiens
acagguacaagggauuaggaug

SEQ ID NO: 361209 - RNA, 22 nt, Homo sapiens
acaggugaaguauuacacuaag

SEQ ID NO: 361210 - RNA, 22 nt, Homo sapiens
acagucacaauuuguaccuuuu

SEQ ID NO: 361211 - RNA, 22 nt, Homo sapiens
acagucauagcagccuuuguua

SEQ ID NO: 361212 - RNA, 18 nt, Homo sapiens
acagugcuggcaugagau

SEQ ID NO: 361213 - RNA, 22 nt, Homo sapiens
acagugcuucugauaugaugcc

SEQ ID NO: 361214 - RNA, 17 nt, Homo sapiens
acagugucuaugaaaug

SEQ ID NO: 361215 - RNA, 22 nt, Homo sapiens
acaguuaugugagggccaccag

SEQ ID NO: 361216 - RNA, 22 nt, Homo sapiens
acaucacuguuugauugauuga

SEQ ID NO: 361217 - RNA, 21 nt, Homo sapiens
acaucagaguugugaagguag

SEQ ID NO: 361218 - RNA, 22 nt, Homo sapiens
acaucccuuucccacccuucac

SEQ ID NO: 361219 - RNA, 22 nt, Homo sapiens
acaugcauccaugugaagagac

SEQ ID NO: 361220 - RNA, 22 nt, Homo sapiens
acaugccucccugguccgcugu

SEQ ID NO: 361221 - RNA, 22 nt, Homo sapiens
acauguauauaaugcauagcga

SEQ ID NO: 361222 - RNA, 22 nt, Homo sapiens
accacuguuucaagaagcuugu

SEQ ID NO: 361223 - RNA, 17 nt, Homo sapiens
accagugcaugugcuuu

SEQ ID NO: 361224 - RNA, 22 nt, Homo sapiens
accaugcaguccaauaugcaca

SEQ ID NO: 361225 - RNA, 22 nt, Homo sapiens
accauugcacuccagccugggc

SEQ ID NO: 361226 - RNA, 22 nt, Homo sapiens
accccugagaucgaaucaugcu

SEQ ID NO: 361227 - RNA, 22 nt, Homo sapiens
acccucaagggacugacagaau

SEQ ID NO: 361228 - RNA, 22 nt, Homo sapiens
acccucagaccaguuucccugg

SEQ ID NO: 361229 - RNA, 22 nt, Homo sapiens
acccugcuaaacagcccccugc

SEQ ID NO: 361230 - RNA, 22 nt, Homo sapiens
acccuguaggugcuggcagaga

SEQ ID NO: 361231 - RNA, 22 nt, Homo sapiens
acccugucaaaauggaccaauc

SEQ ID NO: 361232 - RNA, 22 nt, Homo sapiens
acccugucagcuggccugggca

SEQ ID NO: 361233 - RNA, 22 nt, Homo sapiens
acccugugaauauuuaaacuuc

SEQ ID NO: 361234 - RNA, 22 nt, Homo sapiens
acccugugagagaguuaauauu

SEQ ID NO: 361235 - RNA, 22 nt, Homo sapiens
acccuuagguuaaaguugaguc

SEQ ID NO: 361236 - RNA, 21 nt, Homo sapiens
accugauguuucaguuggagu

SEQ ID NO: 361237 - RNA, 22 nt, Homo sapiens
accugcacagccgaacauagac

SEQ ID NO: 361238 - RNA, 22 nt, Homo sapiens
accuggcacuuagcaaaucuga

SEQ ID NO: 361239 - RNA, 22 nt, Homo sapiens
accugggugcugaugggcuuua

SEQ ID NO: 361240 - RNA, 19 nt, Homo sapiens
accuguagaaaguacaaca

SEQ ID NO: 361241 - RNA, 22 nt, Homo sapiens
accuucauuguugccaugucca

SEQ ID NO: 361242 - RNA, 22 nt, Homo sapiens
accuugcacugagccgagauug

SEQ ID NO: 361243 - RNA, 22 nt, Homo sapiens
acuacaugugaugucaguauau

SEQ ID NO: 361244 - RNA, 22 nt, Homo sapiens
acuagaugauuauguuccauug

SEQ ID NO: 361245 - RNA, 22 nt, Homo sapiens
acucagagauuagcacauguuu

SEQ ID NO: 361246 - RNA, 22 nt, Homo sapiens
acucugucuaguuguaaaauuu

SEQ ID NO: 361247 - RNA, 22 nt, Homo sapiens
acugaauguaaacacggagugu

SEQ ID NO: 361248 - RNA, 22 nt, Homo sapiens
acugagacugagaauguuucuu

SEQ ID NO: 361249 - RNA, 22 nt, Homo sapiens
acugagaucuuuaaauaaauaa

SEQ ID NO: 361250 - RNA, 22 nt, Homo sapiens
acugagccuuuaaaugacuuca

SEQ ID NO: 361251 - RNA, 22 nt, Homo sapiens
acugagucauugaggcccucuc

SEQ ID NO: 361252 - RNA, 22 nt, Homo sapiens
acugcaaugucgaauagagaug

SEQ ID NO: 361253 - RNA, 23 nt, Homo sapiens
acugcaauuacguuugcaccaac

SEQ ID NO: 361254 - RNA, 21 nt, Homo sapiens
acugcacuccaaccucaacag

SEQ ID NO: 361255 - RNA, 18 nt, Homo sapiens
acugcacuccaccuuggg

SEQ ID NO: 361256 - RNA, 22 nt, Homo sapiens
acugcacuccagacucugucuc

SEQ ID NO: 361257 - RNA, 22 nt, Homo sapiens
ucucaugaagguggagaguagg

SEQ ID NO: 361258 - RNA, 22 nt, Homo sapiens
ucucauggcucacccugcauag

SEQ ID NO: 361259 - RNA, 20 nt, Homo sapiens
ucucccaaacagcaggcccu

SEQ ID NO: 361260 - RNA, 22 nt, Homo sapiens
ucucccauccaugaacuucugu

SEQ ID NO: 361261 - RNA, 22 nt, Homo sapiens
ucucccauccguacacggauug

SEQ ID NO: 361262 - RNA, 22 nt, Homo sapiens
ucucugagaccacuccaaacuc

SEQ ID NO: 361263 - RNA, 22 nt, Homo sapiens
ucucugguuaugucauuaagca

SEQ ID NO: 361264 - RNA, 22 nt, Homo sapiens
ucucuguuuagagccagcaauu

SEQ ID NO: 361265 - RNA, 22 nt, Homo sapiens
ucucuugguugaacaguuugga

SEQ ID NO: 361266 - RNA, 22 nt, Homo sapiens
ucugacaaugaacaaucuauag

SEQ ID NO: 361267 - RNA, 22 nt, Homo sapiens
ucugacacagugauuaguaaau

SEQ ID NO: 361268 - RNA, 22 nt, Homo sapiens
ucugacagugugaauauugacu

SEQ ID NO: 361269 - RNA, 22 nt, Homo sapiens
ucugaguggcagaaugagcuga

SEQ ID NO: 361270 - RNA, 20 nt, Homo sapiens
ucugauugcaacugcaugag

SEQ ID NO: 361271 - RNA, 22 nt, Homo sapiens
ucugcauaucaugcagaacuau

SEQ ID NO: 361272 - RNA, 22 nt, Homo sapiens
ucuggagugugaaguggauaug

SEQ ID NO: 361273 - RNA, 20 nt, Homo sapiens
ucuggccccucuaaaucuca

SEQ ID NO: 361274 - RNA, 22 nt, Homo sapiens
ucuggccccucucaaaucucau

SEQ ID NO: 361275 - RNA, 22 nt, Homo sapiens
ucuggcuucugacuuaggggac

SEQ ID NO: 361276 - RNA, 22 nt, Homo sapiens
ucuggcuuuagcaugugggaag

SEQ ID NO: 361277 - RNA, 22 nt, Homo sapiens
ucuggcuuuuaacaucuauaaa

SEQ ID NO: 361278 - RNA, 22 nt, Homo sapiens
ucuguaguuaacagcuucagcu

SEQ ID NO: 361279 - RNA, 22 nt, Homo sapiens
ucugugcauggcagaggaauga

SEQ ID NO: 361280 - RNA, 22 nt, Homo sapiens
ucugugcauuguaacaacuaaa

SEQ ID NO: 361281 - RNA, 22 nt, Homo sapiens
ucugugcugagaguugaaaguu

SEQ ID NO: 361282 - RNA, 19 nt, Homo sapiens
ucugugcuugucccccugu

SEQ ID NO: 361283 - RNA, 22 nt, Homo sapiens
ucugugguucaggcuggagugc

SEQ ID NO: 361284 - RNA, 22 nt, Homo sapiens
ucugugguuguugcauggaaug

SEQ ID NO: 361285 - RNA, 22 nt, Homo sapiens
ucuguguuugguuggcaauuuc

SEQ ID NO: 361286 - RNA, 22 nt, Homo sapiens
ucuguugguucuuugaggagga

SEQ ID NO: 361287 - RNA, 22 nt, Homo sapiens
ucuguuguuguuuuaagagaca

SEQ ID NO: 361288 - RNA, 22 nt, Homo sapiens
ucuuaggauacugaagucgguu

SEQ ID NO: 361289 - RNA, 22 nt, Homo sapiens
ucuuaguuugggguggggauag

SEQ ID NO: 361290 - RNA, 17 nt, Homo sapiens
ucuucuguuacuguggc

SEQ ID NO: 361291 - RNA, 22 nt, Homo sapiens
ucuugcaccuacaugcuuuguc

SEQ ID NO: 361292 - RNA, 22 nt, Homo sapiens
ucuugcauuuuuaaauagugcu

SEQ ID NO: 361293 - RNA, 22 nt, Homo sapiens
ucuugcuuguuguucccuucau

SEQ ID NO: 361294 - RNA, 22 nt, Homo sapiens
ucuuggcauggcugaagauucc

SEQ ID NO: 361295 - RNA, 22 nt, Homo sapiens
ucuuggguggauucauucuuuc

SEQ ID NO: 361296 - RNA, 23 nt, Homo sapiens
ucuugguuauagaaaaauaguug

SEQ ID NO: 361297 - RNA, 22 nt, Homo sapiens
ucuugguugaaaauucauaaua

SEQ ID NO: 361298 - RNA, 22 nt, Homo sapiens
ucuugguuuauugauggagagg

SEQ ID NO: 361299 - RNA, 22 nt, Homo sapiens
ucuugucacugcauccccagcu

SEQ ID NO: 361300 - RNA, 22 nt, Homo sapiens
ucuuuagguguuauaguucaag

SEQ ID NO: 361301 - RNA, 22 nt, Homo sapiens
ucuuuaguaauuucuguaaggc

SEQ ID NO: 361302 - RNA, 20 nt, Homo sapiens
ucuuucgguuaccaggcagu

SEQ ID NO: 361303 - RNA, 19 nt, Homo sapiens
ucuuugaggcaucgcccuc

SEQ ID NO: 361304 - RNA, 22 nt, Homo sapiens
ucuuugagugcccugagucccu

SEQ ID NO: 361305 - RNA, 22 nt, Homo sapiens
ucuuugauuuuguuacuaagac

SEQ ID NO: 361306 - RNA, 22 nt, Homo sapiens
ucuuuggagacaaccccagucu

SEQ ID NO: 361307 - RNA, 22 nt, Homo sapiens
ucuuugguuguuuagggugcau

SEQ ID NO: 361308 - RNA, 22 nt, Homo sapiens
ucuuuguugcauaggcuuguuc

SEQ ID NO: 361309 - RNA, 22 nt, Homo sapiens
ucuuuuugagucaguuucggua

SEQ ID NO: 361310 - RNA, 22 nt, Homo sapiens
ugaaacacacagagaagggaga

SEQ ID NO: 361311 - RNA, 22 nt, Homo sapiens
ugaaagcuacaggaaaguauuu

SEQ ID NO: 361312 - RNA, 22 nt, Homo sapiens
ugaaagcuacagucuccuagga

SEQ ID NO: 361313 - RNA, 22 nt, Homo sapiens
ugaaagguuuaauucugugaga

SEQ ID NO: 361314 - RNA, 22 nt, Homo sapiens
ugaaauguugggugauggaauc

SEQ ID NO: 361315 - RNA, 22 nt, Homo sapiens
ugaacacaucuccugguaccug

SEQ ID NO: 361316 - RNA, 22 nt, Homo sapiens
ugaacagcuaucuugucagugu

SEQ ID NO: 361317 - RNA, 22 nt, Homo sapiens
ugaacagucaucucucuuguau

SEQ ID NO: 361318 - RNA, 22 nt, Homo sapiens
ugaagacucaauuauuaugaac

SEQ ID NO: 361319 - RNA, 22 nt, Homo sapiens
ugaagagucuaaaucugucuuc

SEQ ID NO: 361320 - RNA, 19 nt, Homo sapiens
ugaaguauagggcuucuga

SEQ ID NO: 361321 - RNA, 22 nt, Homo sapiens
ugaauacugugcaaaggauuug

SEQ ID NO: 361322 - RNA, 22 nt, Homo sapiens
ugaauacuucguucaaagauaa

SEQ ID NO: 361323 - RNA, 22 nt, Homo sapiens
ugaauagugucacaauaaacau

SEQ ID NO: 361324 - RNA, 18 nt, Homo sapiens
ugaauaguguccccauga

SEQ ID NO: 361325 - RNA, 22 nt, Homo sapiens
ugaauauagacagggguagaga

SEQ ID NO: 361326 - RNA, 21 nt, Homo sapiens
ugaauauuuggguugugucca

SEQ ID NO: 361327 - RNA, 22 nt, Homo sapiens
ugaaugcuucaugucugggcug

SEQ ID NO: 361328 - RNA, 23 nt, Homo sapiens
ugacaaccucaugcuuugucaug

SEQ ID NO: 361329 - RNA, 22 nt, Homo sapiens
ugacaagaacuuuccauaguaa

SEQ ID NO: 361330 - RNA, 22 nt, Homo sapiens
ugacagagcaggacuucaucuc

SEQ ID NO: 361331 - RNA, 22 nt, Homo sapiens
ugacagcugaagauguugaacc

SEQ ID NO: 361332 - RNA, 22 nt, Homo sapiens
ugacaguguccucauucccaac

SEQ ID NO: 361333 - RNA, 22 nt, Homo sapiens
ugacagugugagacuuugucuc

SEQ ID NO: 361334 - RNA, 22 nt, Homo sapiens
ugacaguuuccagggcugucuc

SEQ ID NO: 361335 - RNA, 18 nt, Homo sapiens
ugacaucauuuagaaagg

SEQ ID NO: 361336 - RNA, 19 nt, Homo sapiens
ugacaugaaacccaagauc

SEQ ID NO: 361337 - RNA, 22 nt, Homo sapiens
ugacauggaagauguucaugau

SEQ ID NO: 361338 - RNA, 22 nt, Homo sapiens
aaagagcugagaccugguggag

SEQ ID NO: 361339 - RNA, 22 nt, Homo sapiens
aaagcugucaaggcaggaggcu

SEQ ID NO: 361340 - RNA, 22 nt, Homo sapiens
aaaggcacacacuccuuguuau

SEQ ID NO: 361341 - RNA, 22 nt, Homo sapiens
aaaggcaucugcucggcucccu

SEQ ID NO: 361342 - RNA, 20 nt, Homo sapiens
aaaggcugugagaacgagau

SEQ ID NO: 361343 - RNA, 22 nt, Homo sapiens
aaagggcuguuucuugacuugg

SEQ ID NO: 361344 - RNA, 20 nt, Homo sapiens
aaaguaggcuaauaccaaaa

SEQ ID NO: 361345 - RNA, 18 nt, Homo sapiens
aaagugaugucauucuuu

SEQ ID NO: 361346 - RNA, 22 nt, Homo sapiens
aaagugauugcgguuuuugcca

SEQ ID NO: 361347 - RNA, 22 nt, Homo sapiens
aaagugcaguauuugggcagaa

SEQ ID NO: 361348 - RNA, 22 nt, Homo sapiens
aaagugccuucuauuuuaguga

SEQ ID NO: 361349 - RNA, 22 nt, Homo sapiens
aaagugcugggaucacacugaa

SEQ ID NO: 361350 - RNA, 22 nt, Homo sapiens
aaagugcuguagacugggcgca

SEQ ID NO: 361351 - RNA, 22 nt, Homo sapiens
aaagugcuucucuuuggugggu

SEQ ID NO: 361352 - RNA, 19 nt, Homo sapiens
ggacugucauggaguaguu

SEQ ID NO: 361353 - RNA, 22 nt, Homo sapiens
ggagauaauccagggagggacu

SEQ ID NO: 361354 - RNA, 22 nt, Homo sapiens
ggagcucaucuagcauagaggu

SEQ ID NO: 361355 - RNA, 22 nt, Homo sapiens
ggagguaauaaguuccagugua

SEQ ID NO: 361356 - RNA, 22 nt, Homo sapiens
ggagguagguuugugauuugua

SEQ ID NO: 361357 - RNA, 22 nt, Homo sapiens
ggagguagucuuucccuuauca

SEQ ID NO: 361358 - RNA, 16 nt, Homo sapiens
ggaggucaucugggaa

SEQ ID NO: 361359 - RNA, 22 nt, Homo sapiens
ggaguaaaagaguaggaggaau

SEQ ID NO: 361360 - RNA, 22 nt, Homo sapiens
ggagucugaacuggacaaugac

SEQ ID NO: 361361 - RNA, 22 nt, Homo sapiens
ggagucugauuuuuauguugcu

SEQ ID NO: 361362 - RNA, 22 nt, Homo sapiens
ggagugucccaaucucagcuca

SEQ ID NO: 361363 - RNA, 22 nt, Homo sapiens
ggaucacagccagcucccagaa

SEQ ID NO: 361364 - RNA, 22 nt, Homo sapiens
ggcaaagaugaccauuacuuuu

SEQ ID NO: 361365 - RNA, 22 nt, Homo sapiens
ggcaacaauuccuacuucuuuu

SEQ ID NO: 361366 - RNA, 22 nt, Homo sapiens
ggcaagaaaaugcaauuacugu

SEQ ID NO: 361367 - RNA, 22 nt, Homo sapiens
ggcaagaaccacaauuacuuuu

SEQ ID NO: 361368 - RNA, 22 nt, Homo sapiens
ggcaagaaccagggauuugcgu

SEQ ID NO: 361369 - RNA, 21 nt, Homo sapiens
ggcaagagaauacaacauaaa

SEQ ID NO: 361370 - RNA, 22 nt, Homo sapiens
ggcaagcucaggccucaggugu

SEQ ID NO: 361371 - RNA, 22 nt, Homo sapiens
ggcaaggaggggcacuuucacu

SEQ ID NO: 361372 - RNA, 22 nt, Homo sapiens
ggcaaggugcuacagacaguga

SEQ ID NO: 361373 - RNA, 22 nt, Homo sapiens
ggcaccacagacgccaggcgug

SEQ ID NO: 361374 - RNA, 22 nt, Homo sapiens
ggcaccauuuuacuccuucccu

SEQ ID NO: 361375 - RNA, 22 nt, Homo sapiens
ggcacugugaugugagggggua

SEQ ID NO: 361376 - RNA, 22 nt, Homo sapiens
ggcacuguggcucaagccugua

SEQ ID NO: 361377 - RNA, 22 nt, Homo sapiens
ggcagcauugccuuugcaguga

SEQ ID NO: 361378 - RNA, 22 nt, Homo sapiens
ggcagcgugcacuuucgccacu

SEQ ID NO: 361379 - RNA, 22 nt, Homo sapiens
ggcagcucaggccccgcgcuga

SEQ ID NO: 361380 - RNA, 22 nt, Homo sapiens
ggcaguguggcugcauauagca

SEQ ID NO: 361381 - RNA, 22 nt, Homo sapiens
ggcaguuuggcaguuucauaaa

SEQ ID NO: 361382 - RNA, 22 nt, Homo sapiens
ggcaugaaguagcccacaggca

SEQ ID NO: 361383 - RNA, 22 nt, Homo sapiens
ggcucagugaucuguuucugua

SEQ ID NO: 361384 - RNA, 22 nt, Homo sapiens
ggcucguguuuucuguccaguu

SEQ ID NO: 361385 - RNA, 21 nt, Homo sapiens
ggcucuguggucucagguuuc

SEQ ID NO: 361386 - RNA, 22 nt, Homo sapiens
ggcucuguugcuaccaauuaag

SEQ ID NO: 361387 - RNA, 22 nt, Homo sapiens
gggaagauauaggcugggcacc

SEQ ID NO: 361388 - RNA, 22 nt, Homo sapiens
gggaauguagcaaaucugcaau

SEQ ID NO: 361389 - RNA, 22 nt, Homo sapiens
gggaggucauuguucaaugcug

SEQ ID NO: 361390 - RNA, 22 nt, Homo sapiens
gggaugaauuagguauguuuau

SEQ ID NO: 361391 - RNA, 22 nt, Homo sapiens
gggauuauugugauuucauguu

SEQ ID NO: 361392 - RNA, 22 nt, Homo sapiens
gggcagaugucuggacaccuca

SEQ ID NO: 361393 - RNA, 22 nt, Homo sapiens
gggcauaucacuugaggucagg

SEQ ID NO: 361394 - RNA, 22 nt, Homo sapiens
gggcgagaaucggcugcucagc

SEQ ID NO: 361395 - RNA, 22 nt, Homo sapiens
ggggaguguggacaucacccug

SEQ ID NO: 361396 - RNA, 22 nt, Homo sapiens
ggggucaucagagaaucuaccc

SEQ ID NO: 361397 - RNA, 22 nt, Homo sapiens
gggucaguuuugagaaagcgug

SEQ ID NO: 361398 - RNA, 22 nt, Homo sapiens
gggugguuuuauuaucagugac

SEQ ID NO: 361399 - RNA, 22 nt, Homo sapiens
gguaaguuuggggcuaauuugu

SEQ ID NO: 361400 - RNA, 22 nt, Homo sapiens
gguauguaggucuacgguacaa

SEQ ID NO: 361401 - RNA, 22 nt, Homo sapiens
gguauuuaaaguaccugucugc

SEQ ID NO: 361402 - RNA, 22 nt, Homo sapiens
ggucacauuggacuaucaaguu

SEQ ID NO: 361403 - RNA, 22 nt, Homo sapiens
ggucacccugaugcuggugguc

SEQ ID NO: 361404 - RNA, 22 nt, Homo sapiens
ggucauggauugucuuuucuug

SEQ ID NO: 361405 - RNA, 21 nt, Homo sapiens
ggugagaaaggagacauagac

SEQ ID NO: 361406 - RNA, 22 nt, Homo sapiens
ggugaucauugucucuaguaug

SEQ ID NO: 361407 - RNA, 22 nt, Homo sapiens
ggugucaguuggccccuacugg

SEQ ID NO: 361408 - RNA, 20 nt, Homo sapiens
guaaacucucagcauagaug

SEQ ID NO: 361409 - RNA, 22 nt, Homo sapiens
guaaagacacaugcacacguau

SEQ ID NO: 361410 - RNA, 22 nt, Homo sapiens
guaaaguaaagcacaucaaggu

SEQ ID NO: 361411 - RNA, 22 nt, Homo sapiens
guaaauguccugcuacagagug

SEQ ID NO: 361412 - RNA, 20 nt, Homo sapiens
guaacagcacuuucccaaag

SEQ ID NO: 361413 - RNA, 22 nt, Homo sapiens
guaagagcauguaguggcucua

SEQ ID NO: 361414 - RNA, 22 nt, Homo sapiens
guaagguuguauuucaagaaac

SEQ ID NO: 361415 - RNA, 22 nt, Homo sapiens
guaagucucaugagaucugaug

SEQ ID NO: 361416 - RNA, 22 nt, Homo sapiens
guaagugauagaauuaggauuc

SEQ ID NO: 361417 - RNA, 22 nt, Homo sapiens
guaaucucaccuacuugggagg

SEQ ID NO: 361418 - RNA, 19 nt, Homo sapiens
guaaucucaguacuuuggu

SEQ ID NO: 361419 - RNA, 22 nt, Homo sapiens
guacacauacauauaugugugu

SEQ ID NO: 361420 - RNA, 22 nt, Homo sapiens
guacaggcagcaaacaccauaa

SEQ ID NO: 361421 - RNA, 22 nt, Homo sapiens
guaccacaguugcucacggguu

SEQ ID NO: 361422 - RNA, 22 nt, Homo sapiens
guacccaguagauaguuuuuca

SEQ ID NO: 361423 - RNA, 22 nt, Homo sapiens
guaccuguauguucauuucaca

SEQ ID NO: 361424 - RNA, 22 nt, Homo sapiens
guacuuuguuauaacccacagg

SEQ ID NO: 361425 - RNA, 22 nt, Homo sapiens
guagaaagcauuucagauuugc

SEQ ID NO: 361426 - RNA, 22 nt, Homo sapiens
aauaugucugcuaauuguuucu

SEQ ID NO: 361427 - RNA, 22 nt, Homo sapiens
aaucacagccagcuuccgcuau

SEQ ID NO: 361428 - RNA, 22 nt, Homo sapiens
aaucacaguguucuugugaggg

SEQ ID NO: 361429 - RNA, 22 nt, Homo sapiens
aaucacauuaaugcucccucag

SEQ ID NO: 361430 - RNA, 22 nt, Homo sapiens
aaucacauugaaucugcuaccu

SEQ ID NO: 361431 - RNA, 17 nt, Homo sapiens
aaucagauuucugagga

SEQ ID NO: 361432 - RNA, 22 nt, Homo sapiens
aauccauuugccgucuauccau

SEQ ID NO: 361433 - RNA, 22 nt, Homo sapiens
aaucccuggacuuucggaggcu

SEQ ID NO: 361434 - RNA, 22 nt, Homo sapiens
aaucccuuuguccagucucuuu

SEQ ID NO: 361435 - RNA, 22 nt, Homo sapiens
aauccuguagauucuaauuccu

SEQ ID NO: 361436 - RNA, 22 nt, Homo sapiens
aauccugucuugccauccaaua

SEQ ID NO: 361437 - RNA, 22 nt, Homo sapiens
guauugccugugugccagccac

SEQ ID NO: 361438 - RNA, 22 nt, Homo sapiens
gucaaagugauuguaauuaggu

SEQ ID NO: 361439 - RNA, 22 nt, Homo sapiens
gucaaaugcacagaaccauuaa

SEQ ID NO: 361440 - RNA, 22 nt, Homo sapiens
gucaauguaucuagcuguauua

SEQ ID NO: 361441 - RNA, 22 nt, Homo sapiens
gucacagaggcuaagaccccac

SEQ ID NO: 361442 - RNA, 22 nt, Homo sapiens
gucacagcacuuuuaguaagug

SEQ ID NO: 361443 - RNA, 22 nt, Homo sapiens
gucacauugaugcccauggugg

SEQ ID NO: 361444 - RNA, 22 nt, Homo sapiens
gucaccagcuguguuagccccu

SEQ ID NO: 361445 - RNA, 22 nt, Homo sapiens
gucagcaaaguucuccugcaga

SEQ ID NO: 361446 - RNA, 22 nt, Homo sapiens
gucaggaugauuuggggaggug

SEQ ID NO: 361447 - RNA, 22 nt, Homo sapiens
gucagguaccugaaagcagcca

SEQ ID NO: 361448 - RNA, 22 nt, Homo sapiens
gucagugcauguaaacauaaaa

SEQ ID NO: 361449 - RNA, 22 nt, Homo sapiens
gucaguggagaaaaggacaugu

SEQ ID NO: 361450 - RNA, 22 nt, Homo sapiens
gucaguucuugugguugcauuc

SEQ ID NO: 361451 - RNA, 22 nt, Homo sapiens
gucaguuucacucagcuggaac

SEQ ID NO: 361452 - RNA, 22 nt, Homo sapiens
gucauggacaguuugcuaauug

SEQ ID NO: 361453 - RNA, 22 nt, Homo sapiens
gucauggaggaugaauggccaa

SEQ ID NO: 361454 - RNA, 22 nt, Homo sapiens
gucauggguuaaagguggauac

SEQ ID NO: 361455 - RNA, 22 nt, Homo sapiens
gucauugcuuaaggguucaugc

SEQ ID NO: 361456 - RNA, 22 nt, Homo sapiens
gucauugucaauugacaauugu

SEQ ID NO: 361457 - RNA, 22 nt, Homo sapiens
gucauuguguggacauggagaa

SEQ ID NO: 361458 - RNA, 20 nt, Homo sapiens
guccauuugcugccauugcu

SEQ ID NO: 361459 - RNA, 22 nt, Homo sapiens
guccauuuguuuccagagcacu

SEQ ID NO: 361460 - RNA, 22 nt, Homo sapiens
gucccagagauauugugucuuu

SEQ ID NO: 361461 - RNA, 22 nt, Homo sapiens
gucgguguuuccugagaacgaa

SEQ ID NO: 361462 - RNA, 22 nt, Homo sapiens
gucuaugguucaggguggagug

SEQ ID NO: 361463 - RNA, 22 nt, Homo sapiens
gucucccaaccccugugcccag

SEQ ID NO: 361464 - RNA, 22 nt, Homo sapiens
gucucugguugcuuuuguacca

SEQ ID NO: 361465 - RNA, 22 nt, Homo sapiens
gucugagcauggggccggcagg

SEQ ID NO: 361466 - RNA, 22 nt, Homo sapiens
gucugguugacagcauguggcc

SEQ ID NO: 361467 - RNA, 20 nt, Homo sapiens
gucugucuccgaguagaauu

SEQ ID NO: 361468 - RNA, 22 nt, Homo sapiens
gucuuccagccuccaucuuucu

SEQ ID NO: 361469 - RNA, 22 nt, Homo sapiens
gucuuggagaacucagcuuggc

SEQ ID NO: 361470 - RNA, 22 nt, Homo sapiens
gucuuuggaaagacaaaguuca

SEQ ID NO: 361471 - RNA, 17 nt, Homo sapiens
gucuuugguugaguuua

SEQ ID NO: 361472 - RNA, 22 nt, Homo sapiens
gucuuuguuuggucuguaucag

SEQ ID NO: 361473 - RNA, 22 nt, Homo sapiens
gugaaagacagcauuaauggcu

SEQ ID NO: 361474 - RNA, 22 nt, Homo sapiens
gugaaagacauauaugguuuga

SEQ ID NO: 361475 - RNA, 22 nt, Homo sapiens
gugaaauauuuaacguccaggu

SEQ ID NO: 361476 - RNA, 22 nt, Homo sapiens
gugaacaauguuuuauccuggg

SEQ ID NO: 361477 - RNA, 22 nt, Homo sapiens
gugaacagcagaugagugagug

SEQ ID NO: 361478 - RNA, 22 nt, Homo sapiens
gugaauguaaagucaugugacu

SEQ ID NO: 361479 - RNA, 22 nt, Homo sapiens
gugaauugagagaacuguguua

SEQ ID NO: 361480 - RNA, 22 nt, Homo sapiens
gugacacagcaagacuccgucu

SEQ ID NO: 361481 - RNA, 22 nt, Homo sapiens
gugacacuggagcuggcacaau

SEQ ID NO: 361482 - RNA, 22 nt, Homo sapiens
gugaccagaugggcaggggugu

SEQ ID NO: 361483 - RNA, 22 nt, Homo sapiens
gugaccauuugacauauccuug

SEQ ID NO: 361484 - RNA, 22 nt, Homo sapiens
gugacuggacucugaagaaaau

SEQ ID NO: 361485 - RNA, 22 nt, Homo sapiens
gugagaagaaaaauauggcugu

SEQ ID NO: 361486 - RNA, 22 nt, Homo sapiens
gugagauacuagagauauagug

SEQ ID NO: 361487 - RNA, 19 nt, Homo sapiens
gugagcaaugcauugcacu

SEQ ID NO: 361488 - RNA, 22 nt, Homo sapiens
gugagcagagaucgcgugauug

SEQ ID NO: 361489 - RNA, 22 nt, Homo sapiens
gugagcaguguccuugggggca

SEQ ID NO: 361490 - RNA, 22 nt, Homo sapiens
gugagcauaacaacagaguuua

SEQ ID NO: 361491 - RNA, 21 nt, Homo sapiens
gugaggaguuacuggcuuuga

SEQ ID NO: 361492 - RNA, 22 nt, Homo sapiens
gugaggcugguccugccuccca

SEQ ID NO: 361493 - RNA, 22 nt, Homo sapiens
gugagguagagcaugugaaaga

SEQ ID NO: 361494 - RNA, 20 nt, Homo sapiens
gugagguagaggguuaccug

SEQ ID NO: 361495 - RNA, 22 nt, Homo sapiens
gugagguauacugggaucacua

SEQ ID NO: 361496 - RNA, 22 nt, Homo sapiens
gugauaguucuuacuccaaagu

SEQ ID NO: 361497 - RNA, 22 nt, Homo sapiens
gugaucauuguauugggguuau

SEQ ID NO: 361498 - RNA, 22 nt, Homo sapiens
gugauguguuucaacagcuccu

SEQ ID NO: 361499 - RNA, 22 nt, Homo sapiens
gugauuauuaugcacugcaugc

SEQ ID NO: 361500 - RNA, 22 nt, Homo sapiens
gugcaaauguuauugagguuuu

SEQ ID NO: 361501 - RNA, 22 nt, Homo sapiens
gugcaaguguaauacagcuagg

SEQ ID NO: 361502 - RNA, 22 nt, Homo sapiens
gugcacaaaucuuaaauguaca

SEQ ID NO: 361503 - RNA, 22 nt, Homo sapiens
gugcacaacgugcagguuuguu

SEQ ID NO: 361504 - RNA, 22 nt, Homo sapiens
gugcacaacguguagguuuguu

SEQ ID NO: 361505 - RNA, 21 nt, Homo sapiens
gugcagacacacauauaggcu

SEQ ID NO: 361506 - RNA, 22 nt, Homo sapiens
gugcagugugauccuuccguau

SEQ ID NO: 361507 - RNA, 18 nt, Homo sapiens
gugcauagccauggcagc

SEQ ID NO: 361508 - RNA, 22 nt, Homo sapiens
gugcauauaaguuguuucuagu

SEQ ID NO: 361509 - RNA, 22 nt, Homo sapiens
gugcuuguguuaauauguagcu

SEQ ID NO: 361510 - RNA, 22 nt, Homo sapiens
guggaaaaguaguugcgguuuu

SEQ ID NO: 361511 - RNA, 22 nt, Homo sapiens
guggaagaccagacuuuccaac

SEQ ID NO: 361512 - RNA, 22 nt, Homo sapiens
guggacagagacuaaauguugu

SEQ ID NO: 361513 - RNA, 22 nt, Homo sapiens
guggacggagguugcagugagc

SEQ ID NO: 361514 - RNA, 22 nt, Homo sapiens
uugauuuguagaaugccccaac

SEQ ID NO: 361515 - RNA, 22 nt, Homo sapiens
uugcaaagaccucuucacuucc

SEQ ID NO: 361516 - RNA, 18 nt, Homo sapiens
uugcaaauucuucccugu

SEQ ID NO: 361517 - RNA, 22 nt, Homo sapiens
uugcacaauggaauuuaucuuu

SEQ ID NO: 361518 - RNA, 22 nt, Homo sapiens
uugcacauugauuuuguauccu

SEQ ID NO: 361519 - RNA, 22 nt, Homo sapiens
uugcacauugcaccuuuuguau

SEQ ID NO: 361520 - RNA, 22 nt, Homo sapiens
uugcaccacugcacuccacccu

SEQ ID NO: 361521 - RNA, 22 nt, Homo sapiens
uugcacuuccgccugggugaca

SEQ ID NO: 361522 - RNA, 19 nt, Homo sapiens
uugcaguauccuauauguu

SEQ ID NO: 361523 - RNA, 23 nt, Homo sapiens
uugcauagacauccucauagauu

SEQ ID NO: 361524 - RNA, 19 nt, Homo sapiens
uugcauauguugaaccagg

SEQ ID NO: 361525 - RNA, 22 nt, Homo sapiens
uugcauauucucugaggcagga

SEQ ID NO: 361526 - RNA, 22 nt, Homo sapiens
uugcaugguuuuuaucugaaau

SEQ ID NO: 361527 - RNA, 22 nt, Homo sapiens
uugcauugacacaugaagcuca

SEQ ID NO: 361528 - RNA, 22 nt, Homo sapiens
uugccaauauuuuacugagaag

SEQ ID NO: 361529 - RNA, 22 nt, Homo sapiens
uugccauagugcugccagauau

SEQ ID NO: 361530 - RNA, 22 nt, Homo sapiens
uugccauggaguagaauugaag

SEQ ID NO: 361531 - RNA, 22 nt, Homo sapiens
uugccuaggcuggagugcagug

SEQ ID NO: 361532 - RNA, 22 nt, Homo sapiens
uugccuaguuuaggucugugcu

SEQ ID NO: 361533 - RNA, 22 nt, Homo sapiens
uugcgcuuuuccuauguugccc

SEQ ID NO: 361534 - RNA, 22 nt, Homo sapiens
uugcuacauugauugccucuuu

SEQ ID NO: 361535 - RNA, 22 nt, Homo sapiens
uugcucaggcuagaguucagcu

SEQ ID NO: 361536 - RNA, 22 nt, Homo sapiens
uugcuccucugccaggaccugu

SEQ ID NO: 361537 - RNA, 22 nt, Homo sapiens
uugcugguuuucauaugagcag

SEQ ID NO: 361538 - RNA, 22 nt, Homo sapiens
uugcuucauucaacauugaggg

SEQ ID NO: 361539 - RNA, 22 nt, Homo sapiens
uuggaaaaauccaccuugaucu

SEQ ID NO: 361540 - RNA, 22 nt, Homo sapiens
uuggaaacauuuaugguaacag

SEQ ID NO: 361541 - RNA, 22 nt, Homo sapiens
uuggaaacgucaccuuuuccuu

SEQ ID NO: 361542 - RNA, 22 nt, Homo sapiens
uuggaaagagguguuuaugacu

SEQ ID NO: 361543 - RNA, 22 nt, Homo sapiens
uuggaaaguuguuguaguuauu

SEQ ID NO: 361544 - RNA, 22 nt, Homo sapiens
uuggaagacaaugcugauucuc

SEQ ID NO: 361545 - RNA, 22 nt, Homo sapiens
uuggaagguaaucaaaaguucu

SEQ ID NO: 361546 - RNA, 22 nt, Homo sapiens
uuggaauacuuguuaaagucca

SEQ ID NO: 361547 - RNA, 22 nt, Homo sapiens
uuggaauguauggcaucuugcg

SEQ ID NO: 361548 - RNA, 22 nt, Homo sapiens
uuggaaugugacugauaauauu

SEQ ID NO: 361549 - RNA, 22 nt, Homo sapiens
uuggaccacuugauuucugguc

SEQ ID NO: 361550 - RNA, 22 nt, Homo sapiens
uuggacugggauggccgaggcu

SEQ ID NO: 361551 - RNA, 22 nt, Homo sapiens
uuggacugugagguuucguggg

SEQ ID NO: 361552 - RNA, 22 nt, Homo sapiens
uuggacuucucaaggcaauaaa

SEQ ID NO: 361553 - RNA, 22 nt, Homo sapiens
uuggagagaaaggcaguuccug

SEQ ID NO: 361554 - RNA, 22 nt, Homo sapiens
uuggagugugucuuauuccauu

SEQ ID NO: 361555 - RNA, 22 nt, Homo sapiens
uuggaugauaaagaagccuaag

SEQ ID NO: 361556 - RNA, 22 nt, Homo sapiens
uuggauuuugguggcaacucau

SEQ ID NO: 361557 - RNA, 22 nt, Homo sapiens
uuggcaacauagugagaccccc

SEQ ID NO: 361558 - RNA, 22 nt, Homo sapiens
uuggcacugggaaaaugaccac

SEQ ID NO: 361559 - RNA, 22 nt, Homo sapiens
uuggcagaaaaggucggggguu

SEQ ID NO: 361560 - RNA, 22 nt, Homo sapiens
uuggcagaguuaauuuguugag

SEQ ID NO: 361561 - RNA, 22 nt, Homo sapiens
uuggcuguguuucccuacaaau

SEQ ID NO: 361562 - RNA, 22 nt, Homo sapiens
uuggcuuuuaugcagcuuaggu

SEQ ID NO: 361563 - RNA, 22 nt, Homo sapiens
uugggaaugcuaaaccucuauu

SEQ ID NO: 361564 - RNA, 23 nt, Homo sapiens
uugggcaaaucacugagggcaga

SEQ ID NO: 361565 - RNA, 22 nt, Homo sapiens
uugggcaaguggcaugaccaug

SEQ ID NO: 361566 - RNA, 22 nt, Homo sapiens
uugggccacuuuaguuuccuua

SEQ ID NO: 361567 - RNA, 22 nt, Homo sapiens
uugggcuugagggugcccaguc

SEQ ID NO: 361568 - RNA, 22 nt, Homo sapiens
uuggucaggcuaaucucgaacg

SEQ ID NO: 361569 - RNA, 22 nt, Homo sapiens
uuggucucaucaagagcagcuu

SEQ ID NO: 361570 - RNA, 22 nt, Homo sapiens
uuggucuucuaauguaccuguu

SEQ ID NO: 361571 - RNA, 22 nt, Homo sapiens
cugagagaggagcuaaaacugc

SEQ ID NO: 361572 - RNA, 22 nt, Homo sapiens
cugagaucaugggucagguggu

SEQ ID NO: 361573 - RNA, 22 nt, Homo sapiens
cugagauggagucucgcauugu

SEQ ID NO: 361574 - RNA, 22 nt, Homo sapiens
cugagcaaaaugaagacacgau

SEQ ID NO: 361575 - RNA, 22 nt, Homo sapiens
cugagcacugagauccucuagc

SEQ ID NO: 361576 - RNA, 18 nt, Homo sapiens
cugagcacugcuuuauga

SEQ ID NO: 361577 - RNA, 22 nt, Homo sapiens
cugagguacccacuucaucuca

SEQ ID NO: 361578 - RNA, 20 nt, Homo sapiens
cugagguacgaggguuaaau

SEQ ID NO: 361579 - RNA, 22 nt, Homo sapiens
cugagguaggugaucagugcuu

SEQ ID NO: 361580 - RNA, 22 nt, Homo sapiens
cugagguauuuaggugaaagaa

SEQ ID NO: 361581 - RNA, 22 nt, Homo sapiens
cugaggugauauauacauauuu

SEQ ID NO: 361582 - RNA, 22 nt, Homo sapiens
cugagguuguucuucucagugg

SEQ ID NO: 361583 - RNA, 22 nt, Homo sapiens
cugauugucaucaauauuauua

SEQ ID NO: 361584 - RNA, 22 nt, Homo sapiens
cugauugucuauuuaguucacu

SEQ ID NO: 361585 - RNA, 19 nt, Homo sapiens
cugcaagguaauaggucag

SEQ ID NO: 361586 - RNA, 22 nt, Homo sapiens
cugcaauggagaaagugagacu

SEQ ID NO: 361587 - RNA, 22 nt, Homo sapiens
cugccacugacaccucaaggac

SEQ ID NO: 361588 - RNA, 22 nt, Homo sapiens
cugcuggucuuuaaggucuagg

SEQ ID NO: 361589 - RNA, 22 nt, Homo sapiens
cuggaaagcaaagggugcauug

SEQ ID NO: 361590 - RNA, 22 nt, Homo sapiens
cuggaagcacaacgcauuuauu

SEQ ID NO: 361591 - RNA, 22 nt, Homo sapiens
cuggaaucuauggauaacaucg

SEQ ID NO: 361592 - RNA, 22 nt, Homo sapiens
cuggaguaugauguuagcguug

SEQ ID NO: 361593 - RNA, 22 nt, Homo sapiens
cuggaguuugaggcugcaguga

SEQ ID NO: 361594 - RNA, 22 nt, Homo sapiens
cuggcaccauacacuguuguug

SEQ ID NO: 361595 - RNA, 22 nt, Homo sapiens
cuggcacccuugcuuaggaaga

SEQ ID NO: 361596 - RNA, 22 nt, Homo sapiens
cuggcgagacagcuccaucacu

SEQ ID NO: 361597 - RNA, 22 nt, Homo sapiens
cuggcucuguuagaagaaccag

SEQ ID NO: 361598 - RNA, 22 nt, Homo sapiens
cuggugugugacuuuucauuau

SEQ ID NO: 361599 - RNA, 22 nt, Homo sapiens
cuguaacagaauaaauuuguuu

SEQ ID NO: 361600 - RNA, 22 nt, Homo sapiens
cugugaucuuuuuucauguggu

SEQ ID NO: 361601 - RNA, 22 nt, Homo sapiens
cugugcauaucuuggacugugu

SEQ ID NO: 361602 - RNA, 22 nt, Homo sapiens
cugugcaugcgcggagcugaaa

SEQ ID NO: 361603 - RNA, 22 nt, Homo sapiens
cugugcauuggaugucucccug

SEQ ID NO: 361604 - RNA, 19 nt, Homo sapiens
cugugcauuucuguggaag

SEQ ID NO: 361605 - RNA, 22 nt, Homo sapiens
cugugccaagcuugcgaugugc

SEQ ID NO: 361606 - RNA, 22 nt, Homo sapiens
cugugcuuggagucccccuagg

SEQ ID NO: 361607 - RNA, 23 nt, Homo sapiens
cuguggauaugaguuguaaaugg

SEQ ID NO: 361608 - RNA, 23 nt, Homo sapiens
cuguggugaggcccuagaaucug

SEQ ID NO: 361609 - RNA, 22 nt, Homo sapiens
cugugguguaacucuuggggcg

SEQ ID NO: 361610 - RNA, 22 nt, Homo sapiens
cuguucaaauuguuugugaagu

SEQ ID NO: 361611 - RNA, 22 nt, Homo sapiens
cuguugguuaaauuccaugcag

SEQ ID NO: 361612 - RNA, 18 nt, Homo sapiens
cuuaacauugggaugaua

SEQ ID NO: 361613 - RNA, 22 nt, Homo sapiens
cuuaaguaguuguggaaugaau

SEQ ID NO: 361614 - RNA, 20 nt, Homo sapiens
cuuaucaguggcaaguauaa

SEQ ID NO: 361615 - RNA, 22 nt, Homo sapiens
cuucaaguaauucugauggcua

SEQ ID NO: 361616 - RNA, 22 nt, Homo sapiens
cuucaccaguuuggcagucuca

SEQ ID NO: 361617 - RNA, 22 nt, Homo sapiens
cuucacuuuguuaaacuccaau

SEQ ID NO: 361618 - RNA, 22 nt, Homo sapiens
cuucaguucuguaaggacagca

SEQ ID NO: 361619 - RNA, 18 nt, Homo sapiens
cuucauugcuguuuugcu

SEQ ID NO: 361620 - RNA, 22 nt, Homo sapiens
cuuccauaguauuuuuacaaaa

SEQ ID NO: 361621 - RNA, 22 nt, Homo sapiens
cuucccguuauugcccuugggu

SEQ ID NO: 361622 - RNA, 22 nt, Homo sapiens
cuuccugaguccugggcucaca

SEQ ID NO: 361623 - RNA, 22 nt, Homo sapiens
cuucuguuaguucugauaacuu

SEQ ID NO: 361624 - RNA, 22 nt, Homo sapiens
cuugaauguaaauaauguacag

SEQ ID NO: 361625 - RNA, 22 nt, Homo sapiens
cuugagcuugagauccuuucug

SEQ ID NO: 361626 - RNA, 22 nt, Homo sapiens
cuugcacauuacagaucugcau

SEQ ID NO: 361627 - RNA, 22 nt, Homo sapiens
cuugcacuugaaauuccaguuu

SEQ ID NO: 361628 - RNA, 22 nt, Homo sapiens
cuugcauagaguuauugcccuu

SEQ ID NO: 361629 - RNA, 20 nt, Homo sapiens
cuugccuagcccuuugccuc

SEQ ID NO: 361630 - RNA, 22 nt, Homo sapiens
cuuggacaccucaugcccaccu

SEQ ID NO: 361631 - RNA, 22 nt, Homo sapiens
cuuggcacucuguggaguuagg

SEQ ID NO: 361632 - RNA, 22 nt, Homo sapiens
cuuggcacugcucacccuccuu

SEQ ID NO: 361633 - RNA, 22 nt, Homo sapiens
cuuggguugauugauaaugcca

SEQ ID NO: 361634 - RNA, 18 nt, Homo sapiens
cuugucaaaucuuuccuc

SEQ ID NO: 361635 - RNA, 22 nt, Homo sapiens
cuuguucuccuaagaugaaugc

SEQ ID NO: 361636 - RNA, 22 nt, Homo sapiens
cuuuaguuaaaauugggguugu

SEQ ID NO: 361637 - RNA, 22 nt, Homo sapiens
cuuuaguugucuccucaagggu

SEQ ID NO: 361638 - RNA, 22 nt, Homo sapiens
cuuuccauuguuggagcauaaa

SEQ ID NO: 361639 - RNA, 22 nt, Homo sapiens
cuuucugaggagaauagagaac

SEQ ID NO: 361640 - RNA, 18 nt, Homo sapiens
cuuugguccccgcacccu

SEQ ID NO: 361641 - RNA, 22 nt, Homo sapiens
cuuugguguauuuucagagacc

SEQ ID NO: 361642 - RNA, 22 nt, Homo sapiens
cuuugguucuguuuauaugcug

SEQ ID NO: 361643 - RNA, 22 nt, Homo sapiens
cuuuguaugucaugacaacugu

SEQ ID NO: 361644 - RNA, 22 nt, Homo sapiens
cuuuuacacuguuggcaggauu

SEQ ID NO: 361645 - RNA, 22 nt, Homo sapiens
cuuuuggcuuaagauugucuug

SEQ ID NO: 361646 - RNA, 22 nt, Homo sapiens
cuuuuggcuuagaauugucuug

SEQ ID NO: 361647 - RNA, 22 nt, Homo sapiens
cuuuuggugugaagaagcucuu

SEQ ID NO: 361648 - RNA, 22 nt, Homo sapiens
cuuuugugauuccucaguuacu

SEQ ID NO: 361649 - RNA, 22 nt, Homo sapiens
cuuuugugauucuucaguugcu

SEQ ID NO: 361650 - RNA, 20 nt, Homo sapiens
cuuuuugcugugcugggagc

SEQ ID NO: 361651 - RNA, 22 nt, Homo sapiens
gaaaacugcuucucuggguuuc

SEQ ID NO: 361652 - RNA, 22 nt, Homo sapiens
gaaagcuaaugacuuuggguga

SEQ ID NO: 361653 - RNA, 21 nt, Homo sapiens
gaaauacugccuuaggagcug

SEQ ID NO: 361654 - RNA, 18 nt, Homo sapiens
gaaaugccucuugcuuac

SEQ ID NO: 361655 - RNA, 22 nt, Homo sapiens
gaaaugcucagggguuuuccag

SEQ ID NO: 361656 - RNA, 22 nt, Homo sapiens
gaaauguugauagugggcauug

SEQ ID NO: 361657 - RNA, 22 nt, Homo sapiens
gaagagacagguucccacaaaa

SEQ ID NO: 361658 - RNA, 22 nt, Homo sapiens
gaagaucacacuguagaucuau

SEQ ID NO: 361659 - RNA, 22 nt, Homo sapiens
gucuuuguuauuaugaaucaac

SEQ ID NO: 361660 - RNA, 22 nt, Homo sapiens
gucuuuguuuugauuuaccaga

SEQ ID NO: 361661 - RNA, 22 nt, Homo sapiens
gugaaagauuaaaccagugugu

SEQ ID NO: 361662 - RNA, 22 nt, Homo sapiens
gugaaauacauaaucccaagug

SEQ ID NO: 361663 - RNA, 22 nt, Homo sapiens
gugaaaugaaucuggaaauauu

SEQ ID NO: 361664 - RNA, 22 nt, Homo sapiens
gugaaauguguagaggaucugg

SEQ ID NO: 361665 - RNA, 22 nt, Homo sapiens
gugaacaagcaaaggcaggagg

SEQ ID NO: 361666 - RNA, 22 nt, Homo sapiens
gugaauagggaauaaugggauc

SEQ ID NO: 361667 - RNA, 22 nt, Homo sapiens
gugacgucauuguuccuggcuc

SEQ ID NO: 361668 - RNA, 22 nt, Homo sapiens
gugacugggaguggugaagaua

SEQ ID NO: 361669 - RNA, 22 nt, Homo sapiens
gugagaccaauguacuaccuuc

SEQ ID NO: 361670 - RNA, 22 nt, Homo sapiens
gugagacugguccugaacccag

SEQ ID NO: 361671 - RNA, 22 nt, Homo sapiens
gugagauaaugucucauugugg

SEQ ID NO: 361672 - RNA, 22 nt, Homo sapiens
gugagaugauggguauguuaau

SEQ ID NO: 361673 - RNA, 22 nt, Homo sapiens
gugagauggaguuggugucuuu

SEQ ID NO: 361674 - RNA, 22 nt, Homo sapiens
gugagaugugacuucugccucu

SEQ ID NO: 361675 - RNA, 19 nt, Homo sapiens
gugagcacagacaauacaa

SEQ ID NO: 361676 - RNA, 22 nt, Homo sapiens
gugagcacugaaagaaggcaag

SEQ ID NO: 361677 - RNA, 22 nt, Homo sapiens
gugagcgaggaaacgacggcgc

SEQ ID NO: 361678 - RNA, 22 nt, Homo sapiens
gugagcuccucuucugcugcag

SEQ ID NO: 361679 - RNA, 22 nt, Homo sapiens
gugaggcuuuuccuguuagacu

SEQ ID NO: 361680 - RNA, 22 nt, Homo sapiens
gugagggagcuggaauauuuau

SEQ ID NO: 361681 - RNA, 20 nt, Homo sapiens
gugagucauuaguaaccaaa

SEQ ID NO: 361682 - RNA, 22 nt, Homo sapiens
gugaguggacgugaccaauaaa

SEQ ID NO: 361683 - RNA, 22 nt, Homo sapiens
gugaguuauuauuuauguaaac

SEQ ID NO: 361684 - RNA, 22 nt, Homo sapiens
gugauguguuuguucuaucucu

SEQ ID NO: 361685 - RNA, 20 nt, Homo sapiens
gugauuggucacugguuguu

SEQ ID NO: 361686 - RNA, 22 nt, Homo sapiens
gugauuuaguagaugcuaguua

SEQ ID NO: 361687 - RNA, 21 nt, Homo sapiens
gugcaaacaucauagaaugua

SEQ ID NO: 361688 - RNA, 22 nt, Homo sapiens
gugcaaaucucugaguaucuuu

SEQ ID NO: 361689 - RNA, 22 nt, Homo sapiens
gugcaagagugacugcaguuuu

SEQ ID NO: 361690 - RNA, 22 nt, Homo sapiens
gugcaagagugauugcaguuuu

SEQ ID NO: 361691 - RNA, 22 nt, Homo sapiens
gugcaaugucaggagaugcagc

SEQ ID NO: 361692 - RNA, 22 nt, Homo sapiens
gugcacauauggugcauaagug

SEQ ID NO: 361693 - RNA, 22 nt, Homo sapiens
gugcacaucgugcagguuuguu

SEQ ID NO: 361694 - RNA, 23 nt, Homo sapiens
gugcaguggcgagauuucggcuc

SEQ ID NO: 361695 - RNA, 22 nt, Homo sapiens
gugcaguuugaaaguagaaaca

SEQ ID NO: 361696 - RNA, 19 nt, Homo sapiens
gugcauaguuauuaaagag

SEQ ID NO: 361697 - RNA, 22 nt, Homo sapiens
gugcauaugcaugugcaugcac

SEQ ID NO: 361698 - RNA, 23 nt, Homo sapiens
gugcaugagucuuuauaguagca

SEQ ID NO: 361699 - RNA, 22 nt, Homo sapiens
gugcauguccacuaguccauau

SEQ ID NO: 361700 - RNA, 22 nt, Homo sapiens
gugcgggaggcgcgccuaggug

SEQ ID NO: 361701 - RNA, 16 nt, Homo sapiens
gugcuguguuguuagg

SEQ ID NO: 361702 - RNA, 22 nt, Homo sapiens
guggaaagaacacaaaauuagg

SEQ ID NO: 361703 - RNA, 22 nt, Homo sapiens
guggaagaaaucagguuauuug

SEQ ID NO: 361704 - RNA, 20 nt, Homo sapiens
guggaagauaaguagccuga

SEQ ID NO: 361705 - RNA, 22 nt, Homo sapiens
guggaagauaguguguuaaugu

SEQ ID NO: 361706 - RNA, 22 nt, Homo sapiens
guggaaguuaagugacuuucug

SEQ ID NO: 361707 - RNA, 22 nt, Homo sapiens
guggacaugaauuuuggaggca

SEQ ID NO: 361708 - RNA, 22 nt, Homo sapiens
guggaggacuggauaaagaaaa

SEQ ID NO: 361709 - RNA, 17 nt, Homo sapiens
guggauagaacaaugaa

SEQ ID NO: 361710 - RNA, 22 nt, Homo sapiens
guggcagaaaagagaagcaaug

SEQ ID NO: 361711 - RNA, 22 nt, Homo sapiens
guggcagugugaggauccugcu

SEQ ID NO: 361712 - RNA, 22 nt, Homo sapiens
guggcgagaucauagcucauug

SEQ ID NO: 361713 - RNA, 22 nt, Homo sapiens
guggcuuuaaguacgauugagg

SEQ ID NO: 361714 - RNA, 22 nt, Homo sapiens
gugggagugucccguuuuucca

SEQ ID NO: 361715 - RNA, 22 nt, Homo sapiens
gugggauggaaaugggcuucag

SEQ ID NO: 361716 - RNA, 22 nt, Homo sapiens
gugggcucguucguguuagaca

SEQ ID NO: 361717 - RNA, 22 nt, Homo sapiens
gugggguaggguaggacucaac

SEQ ID NO: 361718 - RNA, 22 nt, Homo sapiens
gugguaggaaagugcaaaugua

SEQ ID NO: 361719 - RNA, 22 nt, Homo sapiens
gugguguuugagcugccaggga

SEQ ID NO: 361720 - RNA, 22 nt, Homo sapiens
gugguucuagagggacagaaug

SEQ ID NO: 361721 - RNA, 22 nt, Homo sapiens
gugguuuuuagauuucuacagu

SEQ ID NO: 361722 - RNA, 22 nt, Homo sapiens
guguaacaacagcacuccacug

SEQ ID NO: 361723 - RNA, 22 nt, Homo sapiens
guguaugugagaaugcucaugu

SEQ ID NO: 361724 - RNA, 22 nt, Homo sapiens
guguauucaucuggcugaggua

SEQ ID NO: 361725 - RNA, 21 nt, Homo sapiens
gugucacagacaugacagaug

SEQ ID NO: 361726 - RNA, 22 nt, Homo sapiens
guguccucgaguacacaucagg

SEQ ID NO: 361727 - RNA, 22 nt, Homo sapiens
gugucucagcccagaccuauuu

SEQ ID NO: 361728 - RNA, 22 nt, Homo sapiens
gugucuccugccuucaugcagc

SEQ ID NO: 361729 - RNA, 22 nt, Homo sapiens
gugugacuagucaugccugaau

SEQ ID NO: 361730 - RNA, 22 nt, Homo sapiens
gugugcauaugucuuuauagua

SEQ ID NO: 361731 - RNA, 22 nt, Homo sapiens
gugugguauuauaacuagguau

SEQ ID NO: 361732 - RNA, 22 nt, Homo sapiens
guguguaaauggcagugagcuc

SEQ ID NO: 361733 - RNA, 22 nt, Homo sapiens
gugugucuugaccaggaucgga

SEQ ID NO: 361734 - RNA, 22 nt, Homo sapiens
guuaggcagugugguauagcag

SEQ ID NO: 361735 - RNA, 22 nt, Homo sapiens
guuauccugucuuuacauacaa

SEQ ID NO: 361736 - RNA, 22 nt, Homo sapiens
guuauuaguugauauuaaguuc

SEQ ID NO: 361737 - RNA, 22 nt, Homo sapiens
guucaaggaauguuggcuucuc

SEQ ID NO: 361738 - RNA, 22 nt, Homo sapiens
guucacacuugcaaccccagca

SEQ ID NO: 361739 - RNA, 22 nt, Homo sapiens
guucagguauucuggaacagag

SEQ ID NO: 361740 - RNA, 22 nt, Homo sapiens
guucaguuugcugaugcguuga

SEQ ID NO: 361741 - RNA, 22 nt, Homo sapiens
guucaucaggcuuucucuagag

SEQ ID NO: 361742 - RNA, 22 nt, Homo sapiens
guuccuuguagaugcuggauau

SEQ ID NO: 361743 - RNA, 22 nt, Homo sapiens
guugcaauugauguaugucuga

SEQ ID NO: 361744 - RNA, 22 nt, Homo sapiens
guugcacagucuuuccuggacu

SEQ ID NO: 361745 - RNA, 22 nt, Homo sapiens
guuggaguuaagcaguaaugaa

SEQ ID NO: 361746 - RNA, 22 nt, Homo sapiens
guuggcuguuucccccaaguga

SEQ ID NO: 361747 - RNA, 22 nt, Homo sapiens
aaggauuguaacaccaagguua

SEQ ID NO: 361748 - RNA, 22 nt, Homo sapiens
aaggcagugugcacauaacacu

SEQ ID NO: 361749 - RNA, 22 nt, Homo sapiens
aaggcaugcaaagaacauuuua

SEQ ID NO: 361750 - RNA, 22 nt, Homo sapiens
aaggcauucucaaacuaguucu

SEQ ID NO: 361751 - RNA, 22 nt, Homo sapiens
aagggaaugcgcugccuguguu

SEQ ID NO: 361752 - RNA, 22 nt, Homo sapiens
aagggaauguuguggcugguug

SEQ ID NO: 361753 - RNA, 22 nt, Homo sapiens
aagggaauguugugguugguuu

SEQ ID NO: 361754 - RNA, 23 nt, Homo sapiens
aagguaagcuagaaagauguaga

SEQ ID NO: 361755 - RNA, 22 nt, Homo sapiens
aagguauuuuugucuauaucuu

SEQ ID NO: 361756 - RNA, 17 nt, Homo sapiens
aaggugcuucgaccucc

SEQ ID NO: 361757 - RNA, 22 nt, Homo sapiens
aagguggugucagagagcuuau

SEQ ID NO: 361758 - RNA, 21 nt, Homo sapiens
aagguuuuuagugcuugacuu

SEQ ID NO: 361759 - RNA, 22 nt, Homo sapiens
aaguacuguuuaaauugcagaa

SEQ ID NO: 361760 - RNA, 19 nt, Homo sapiens
aaguacuugucuuuugaag

SEQ ID NO: 361761 - RNA, 22 nt, Homo sapiens
aaguagcagaggcaagacuuga

SEQ ID NO: 361762 - RNA, 18 nt, Homo sapiens
aaguauagagagcccuua

SEQ ID NO: 361763 - RNA, 22 nt, Homo sapiens
aaguauuagcuaauugugcuua

SEQ ID NO: 361764 - RNA, 22 nt, Homo sapiens
aaguauuaugaguccuuguuuu

SEQ ID NO: 361765 - RNA, 22 nt, Homo sapiens
aagucaaggagagaagcuucag

SEQ ID NO: 361766 - RNA, 22 nt, Homo sapiens
aagucacugagacuuguggcug

SEQ ID NO: 361767 - RNA, 22 nt, Homo sapiens
aagugacuagacuaugaaaccu

SEQ ID NO: 361768 - RNA, 22 nt, Homo sapiens
aagugagaugcaguggaguucc

SEQ ID NO: 361769 - RNA, 22 nt, Homo sapiens
aagugaguaauacgucaguugu

SEQ ID NO: 361770 - RNA, 20 nt, Homo sapiens
aagugcaucguugugucugc

SEQ ID NO: 361771 - RNA, 20 nt, Homo sapiens
aagugcuuccuuuuagaggg

SEQ ID NO: 361772 - RNA, 22 nt, Homo sapiens
aagugcuucuuuccucgagaag

SEQ ID NO: 361773 - RNA, 22 nt, Homo sapiens
aagugcuuuuuagauaugguuu

SEQ ID NO: 361774 - RNA, 22 nt, Homo sapiens
aagugguuuuuacaaagacaga

SEQ ID NO: 361775 - RNA, 22 nt, Homo sapiens
aauaaagcagcuuuuugggacu

SEQ ID NO: 361776 - RNA, 22 nt, Homo sapiens
aauaaagcuuugagcuuugcug

SEQ ID NO: 361777 - RNA, 22 nt, Homo sapiens
aauaaagucugaagugugcuua

SEQ ID NO: 361778 - RNA, 20 nt, Homo sapiens
aauaacagccccagggaggu

SEQ ID NO: 361779 - RNA, 22 nt, Homo sapiens
aauaagcugagagaauucuaca

SEQ ID NO: 361780 - RNA, 23 nt, Homo sapiens
aauaucacaguggguguacaccc

SEQ ID NO: 361781 - RNA, 22 nt, Homo sapiens
aauaugguuuuaugaagcaauu

SEQ ID NO: 361782 - RNA, 22 nt, Homo sapiens
aauauguccaguguuuugggag

SEQ ID NO: 361783 - RNA, 22 nt, Homo sapiens
aaucaacauuguuuuaagucaa

SEQ ID NO: 361784 - RNA, 22 nt, Homo sapiens
aaucacaggucuuggcugcaug

SEQ ID NO: 361785 - RNA, 21 nt, Homo sapiens
aaucacugucuguuuccccuu

SEQ ID NO: 361786 - RNA, 22 nt, Homo sapiens
aaucagcacacugugcuuucca

SEQ ID NO: 361787 - RNA, 22 nt, Homo sapiens
aaucauauugucugccaagagg

SEQ ID NO: 361788 - RNA, 16 nt, Homo sapiens
aauccauuggcccugc

SEQ ID NO: 361789 - RNA, 22 nt, Homo sapiens
aaucccauuucucuguguuuuu

SEQ ID NO: 361790 - RNA, 22 nt, Homo sapiens
aaucucaacacuuugggaggcu

SEQ ID NO: 361791 - RNA, 22 nt, Homo sapiens
aaucugucaguuuuguguuaau

SEQ ID NO: 361792 - RNA, 22 nt, Homo sapiens
aaugacacugagcaucuuucau

SEQ ID NO: 361793 - RNA, 22 nt, Homo sapiens
aaugacuaagaugguacauuuu

SEQ ID NO: 361794 - RNA, 22 nt, Homo sapiens
aaugcacuccagccugggcgac

SEQ ID NO: 361795 - RNA, 22 nt, Homo sapiens
aaugccacugugccugccaagg

SEQ ID NO: 361796 - RNA, 22 nt, Homo sapiens
aauggcaagagccacagaggcg

SEQ ID NO: 361797 - RNA, 22 nt, Homo sapiens
aauggcagaugaaauugucauu

SEQ ID NO: 361798 - RNA, 18 nt, Homo sapiens
aauggcucuggguucuaa

SEQ ID NO: 361799 - RNA, 22 nt, Homo sapiens
aaugucaucuucaguuguacag

SEQ ID NO: 361800 - RNA, 22 nt, Homo sapiens
aaugugcacuauuagggugaua

SEQ ID NO: 361801 - RNA, 22 nt, Homo sapiens
aaugugcacuuggagccuugcu

SEQ ID NO: 361802 - RNA, 22 nt, Homo sapiens
aauguguuuugaaaucaggaag

SEQ ID NO: 361803 - RNA, 22 nt, Homo sapiens
aauuaggcuagaauguuauuaa

SEQ ID NO: 361804 - RNA, 22 nt, Homo sapiens
aauuaguaaccuaauuccaucu

SEQ ID NO: 361805 - RNA, 22 nt, Homo sapiens
aauuaguugaaagucugcuuuu

SEQ ID NO: 361806 - RNA, 22 nt, Homo sapiens
aauucuguauuguuuagggacu

SEQ ID NO: 361807 - RNA, 22 nt, Homo sapiens
aauugaaugcagaugccaggga

SEQ ID NO: 361808 - RNA, 22 nt, Homo sapiens
aauugaccuaaucugauuacug

SEQ ID NO: 361809 - RNA, 22 nt, Homo sapiens
aauugcaccaucuagaucaaga

SEQ ID NO: 361810 - RNA, 23 nt, Homo sapiens
aauugcuuuugaggacuuaguug

SEQ ID NO: 361811 - RNA, 22 nt, Homo sapiens
acaaaguauggaauguuggugu

SEQ ID NO: 361812 - RNA, 20 nt, Homo sapiens
acaaaugcauucugugacau

SEQ ID NO: 361813 - RNA, 17 nt, Homo sapiens
acaaauugccagcuagg

SEQ ID NO: 361814 - RNA, 22 nt, Homo sapiens
acaagacuucuuguauucuagu

SEQ ID NO: 361815 - RNA, 22 nt, Homo sapiens
acacaguaaauauguauugaau

SEQ ID NO: 361816 - RNA, 22 nt, Homo sapiens
acacaguauaugacaaugcuuu

SEQ ID NO: 361817 - RNA, 22 nt, Homo sapiens
acacagugucuguguauuuaaa

SEQ ID NO: 361818 - RNA, 22 nt, Homo sapiens
acacaguguuuauugugguuag

SEQ ID NO: 361819 - RNA, 22 nt, Homo sapiens
acacugcugaguaaauaauuuu

SEQ ID NO: 361820 - RNA, 20 nt, Homo sapiens
acacuggaguaucaaggccc

SEQ ID NO: 361821 - RNA, 20 nt, Homo sapiens
acacuggcuuugagauuuag

SEQ ID NO: 361822 - RNA, 22 nt, Homo sapiens
acacuguaacucuuugagggca

SEQ ID NO: 361823 - RNA, 22 nt, Homo sapiens
acagaacugggcuugcuuuugg

SEQ ID NO: 361824 - RNA, 22 nt, Homo sapiens
acagaauucucagaacugggag

SEQ ID NO: 361825 - RNA, 19 nt, Homo sapiens
acagauagaauguucuaca

SEQ ID NO: 361826 - RNA, 22 nt, Homo sapiens
acagauagacauauauagcuca

SEQ ID NO: 361827 - RNA, 22 nt, Homo sapiens
acagcacugccaagugacccau

SEQ ID NO: 361828 - RNA, 19 nt, Homo sapiens
acagcugguuuugguuucu

SEQ ID NO: 361829 - RNA, 22 nt, Homo sapiens
acagguacacagaauauccaga

SEQ ID NO: 361830 - RNA, 19 nt, Homo sapiens
acaguaccuggcaugaggu

SEQ ID NO: 361831 - RNA, 23 nt, Homo sapiens
acaguauguggauguggcuaagu

SEQ ID NO: 361832 - RNA, 22 nt, Homo sapiens
acagugcuguuguguuuucacg

SEQ ID NO: 361833 - RNA, 22 nt, Homo sapiens
acagugcuuucaauguucagua

SEQ ID NO: 361834 - RNA, 17 nt, Homo sapiens
acagugcuuugcuuucc

SEQ ID NO: 361835 - RNA, 22 nt, Homo sapiens
augugcaaaguuaagaucccag

SEQ ID NO: 361836 - RNA, 22 nt, Homo sapiens
augugcaaauuuccaaacucuu

SEQ ID NO: 361837 - RNA, 22 nt, Homo sapiens
augugcaauguguacguagccc

SEQ ID NO: 361838 - RNA, 22 nt, Homo sapiens
augugcacaacgugcagguuug

SEQ ID NO: 361839 - RNA, 22 nt, Homo sapiens
augugcacaugcuuacauguga

SEQ ID NO: 361840 - RNA, 20 nt, Homo sapiens
augugcaguguggcaaccaa

SEQ ID NO: 361841 - RNA, 22 nt, Homo sapiens
augugcuagguacuguuuagca

SEQ ID NO: 361842 - RNA, 22 nt, Homo sapiens
augugcuuuuggugagagauuu

SEQ ID NO: 361843 - RNA, 22 nt, Homo sapiens
auguggaaauguauaugugucu

SEQ ID NO: 361844 - RNA, 22 nt, Homo sapiens
auguggauaucuauaucuggau

SEQ ID NO: 361845 - RNA, 22 nt, Homo sapiens
auguggcacuugacuuucucgc

SEQ ID NO: 361846 - RNA, 22 nt, Homo sapiens
auguggcauuucucauucauuu

SEQ ID NO: 361847 - RNA, 22 nt, Homo sapiens
auguggcuuuccuagaucuuag

SEQ ID NO: 361848 - RNA, 22 nt, Homo sapiens
auguguaaagcuuuucuuuguu

SEQ ID NO: 361849 - RNA, 22 nt, Homo sapiens
auguuaacaucuuaguuuucau

SEQ ID NO: 361850 - RNA, 22 nt, Homo sapiens
auguuaagauggaacaugggaa

SEQ ID NO: 361851 - RNA, 22 nt, Homo sapiens
auguuauguucuucucuguaua

SEQ ID NO: 361852 - RNA, 22 nt, Homo sapiens
auguuguaguaugagucaaaau

SEQ ID NO: 361853 - RNA, 22 nt, Homo sapiens
auuaaguuaggauuuugagaua

SEQ ID NO: 361854 - RNA, 22 nt, Homo sapiens
auuauaugucaucacagacacc

SEQ ID NO: 361855 - RNA, 22 nt, Homo sapiens
auuauguuguauuuccuugcag

SEQ ID NO: 361856 - RNA, 22 nt, Homo sapiens
auucaaggacuggauugcggga

SEQ ID NO: 361857 - RNA, 22 nt, Homo sapiens
auuccacaguuaacacagaccg

SEQ ID NO: 361858 - RNA, 22 nt, Homo sapiens
auugaacacagaguagcuuucc

SEQ ID NO: 361859 - RNA, 22 nt, Homo sapiens
auugaacacuucugugugccag

SEQ ID NO: 361860 - RNA, 23 nt, Homo sapiens
auugaacacuuucauaugugagg

SEQ ID NO: 361861 - RNA, 22 nt, Homo sapiens
auugaacaugccauauguacca

SEQ ID NO: 361862 - RNA, 22 nt, Homo sapiens
auugaacuuaaaagacuugcca

SEQ ID NO: 361863 - RNA, 22 nt, Homo sapiens
auugauaguuuaauaggaauug

SEQ ID NO: 361864 - RNA, 22 nt, Homo sapiens
auugcaaagcguagacucuaaa

SEQ ID NO: 361865 - RNA, 22 nt, Homo sapiens
auugcaaucuccgccuccgggg

SEQ ID NO: 361866 - RNA, 22 nt, Homo sapiens
auugcaaugggaaacuaugaaa

SEQ ID NO: 361867 - RNA, 22 nt, Homo sapiens
auugcaauuaguccauagaguu

SEQ ID NO: 361868 - RNA, 21 nt, Homo sapiens
auugcacuccagccugggcga

SEQ ID NO: 361869 - RNA, 22 nt, Homo sapiens
auugcacuccagccugggcgac

SEQ ID NO: 361870 - RNA, 22 nt, Homo sapiens
auugcacuccagccugggugac

SEQ ID NO: 361871 - RNA, 22 nt, Homo sapiens
auugcacucuagccugggugac

SEQ ID NO: 361872 - RNA, 22 nt, Homo sapiens
auugcacuggggguuagaauuu

SEQ ID NO: 361873 - RNA, 22 nt, Homo sapiens
auugcagcccacccugggugau

SEQ ID NO: 361874 - RNA, 22 nt, Homo sapiens
auugcaguuucaacuccagggc

SEQ ID NO: 361875 - RNA, 22 nt, Homo sapiens
auugcauuuucagguuggucug

SEQ ID NO: 361876 - RNA, 22 nt, Homo sapiens
auugccuaugauugagguacua

SEQ ID NO: 361877 - RNA, 22 nt, Homo sapiens
auugcuuacccuguauuagauc

SEQ ID NO: 361878 - RNA, 22 nt, Homo sapiens
auuggaacugaaauaauaacuu

SEQ ID NO: 361879 - RNA, 22 nt, Homo sapiens
auuggacagcauuucuagacuu

SEQ ID NO: 361880 - RNA, 22 nt, Homo sapiens
auuggcaaucgucuccauuuuu

SEQ ID NO: 361881 - RNA, 22 nt, Homo sapiens
auuggcagaaaucuuuauagua

SEQ ID NO: 361882 - RNA, 22 nt, Homo sapiens
auuggcuuuauacauaagaaua

SEQ ID NO: 361883 - RNA, 22 nt, Homo sapiens
auugucauuuucugagaaguaa

SEQ ID NO: 361884 - RNA, 22 nt, Homo sapiens
auugucccucuuaaucccagca

SEQ ID NO: 361885 - RNA, 20 nt, Homo sapiens
auuguccuugauuacacaga

SEQ ID NO: 361886 - RNA, 22 nt, Homo sapiens
auuguucuuguguccuuuuccu

SEQ ID NO: 361887 - RNA, 22 nt, Homo sapiens
auuuggcagugaagggaucaca

SEQ ID NO: 361888 - RNA, 22 nt, Homo sapiens
auuuggccuuuguaugcaguau

SEQ ID NO: 361889 - RNA, 22 nt, Homo sapiens
auuugguguuguuuggagccua

SEQ ID NO: 361890 - RNA, 22 nt, Homo sapiens
auuugguuauucaguuguucag

SEQ ID NO: 361891 - RNA, 22 nt, Homo sapiens
auuugucacuauguggcuaaua

SEQ ID NO: 361892 - RNA, 22 nt, Homo sapiens
auuugucacuuaacagccauua

SEQ ID NO: 361893 - RNA, 22 nt, Homo sapiens
auuuguccugccuuuuccuccu

SEQ ID NO: 361894 - RNA, 22 nt, Homo sapiens
caaaguaauugcuguuuugcca

SEQ ID NO: 361895 - RNA, 22 nt, Homo sapiens
caaagucuucaguugauucuga

SEQ ID NO: 361896 - RNA, 22 nt, Homo sapiens
caaagugcuggaauuggccggg

SEQ ID NO: 361897 - RNA, 22 nt, Homo sapiens
caaagugcugggacuggccggg

SEQ ID NO: 361898 - RNA, 22 nt, Homo sapiens
caaagugcugggaugggccagg

SEQ ID NO: 361899 - RNA, 22 nt, Homo sapiens
caaagugguuuauacaugauug

SEQ ID NO: 361900 - RNA, 19 nt, Homo sapiens
caaaguguucuucuuugcc

SEQ ID NO: 361901 - RNA, 22 nt, Homo sapiens
caaauugcuuguggaggauaau

SEQ ID NO: 361902 - RNA, 22 nt, Homo sapiens
caacaguaaagcauuuuuaagu

SEQ ID NO: 361903 - RNA, 22 nt, Homo sapiens
caacugcucacuccuggguuca

SEQ ID NO: 361904 - RNA, 22 nt, Homo sapiens
caacugguuuuauacaguuuag

SEQ ID NO: 361905 - RNA, 22 nt, Homo sapiens
caagagagcugaugguuuuaaa

SEQ ID NO: 361906 - RNA, 22 nt, Homo sapiens
caaggcacagccccuacuuccu

SEQ ID NO: 361907 - RNA, 22 nt, Homo sapiens
caaggugcugagacaggagccc

SEQ ID NO: 361908 - RNA, 22 nt, Homo sapiens
caagugaauaguugcucucaga

SEQ ID NO: 361909 - RNA, 21 nt, Homo sapiens
caagugaugcuucugcuuuaa

SEQ ID NO: 361910 - RNA, 22 nt, Homo sapiens
caagugcucuaggauccugagu

SEQ ID NO: 361911 - RNA, 22 nt, Homo sapiens
caagugcuugaugaaugaucaa

SEQ ID NO: 361912 - RNA, 22 nt, Homo sapiens
caaguguuggcuuguauacaaa

SEQ ID NO: 361913 - RNA, 19 nt, Homo sapiens
caauacuucuuggcauaca

SEQ ID NO: 361914 - RNA, 21 nt, Homo sapiens
caauggcacaaucucugcuca

SEQ ID NO: 361915 - RNA, 22 nt, Homo sapiens
caaugugcuuggggcacaugag

SEQ ID NO: 361916 - RNA, 22 nt, Homo sapiens
cacaaaguagauuagucuucca

SEQ ID NO: 361917 - RNA, 22 nt, Homo sapiens
cacaaugucuaagauguuucua

SEQ ID NO: 361918 - RNA, 22 nt, Homo sapiens
cacagagugagacccugucucu

SEQ ID NO: 361919 - RNA, 22 nt, Homo sapiens
cacagcuaacaacuguuucuuc

SEQ ID NO: 361920 - RNA, 22 nt, Homo sapiens
cacaggaagaggcacggucccu

SEQ ID NO: 361921 - RNA, 22 nt, Homo sapiens
cacaguagaauagagcacuagg

SEQ ID NO: 361922 - RNA, 22 nt, Homo sapiens
cacagugaacaauauccucugu

SEQ ID NO: 361923 - RNA, 22 nt, Homo sapiens
aaaagcauucagagugcugggc

SEQ ID NO: 361924 - RNA, 22 nt, Homo sapiens
aaaaggcuagcuaguaacagaa

SEQ ID NO: 361925 - RNA, 22 nt, Homo sapiens
aaaagucuguagugaaagguga

SEQ ID NO: 361926 - RNA, 22 nt, Homo sapiens
aaaaugcugauauugggcccca

SEQ ID NO: 361927 - RNA, 21 nt, Homo sapiens
aaacuggcccaauuguuccau

SEQ ID NO: 361928 - RNA, 22 nt, Homo sapiens
aaagagaucuaugggcacuaug

SEQ ID NO: 361929 - RNA, 22 nt, Homo sapiens
aaagcuaagguagcauuggaga

SEQ ID NO: 361930 - RNA, 22 nt, Homo sapiens
aaaggcacugugacuuuauagg

SEQ ID NO: 361931 - RNA, 22 nt, Homo sapiens
aaaggcaucauuaguaccaagu

SEQ ID NO: 361932 - RNA, 19 nt, Homo sapiens
aaaguacucugaugccucu

SEQ ID NO: 361933 - RNA, 22 nt, Homo sapiens
aaagugcaguauuugggcagga

SEQ ID NO: 361934 - RNA, 22 nt, Homo sapiens
aaagugccugacucauaguuag

SEQ ID NO: 361935 - RNA, 22 nt, Homo sapiens
aaagugcuuccuuuuugagggu

SEQ ID NO: 361936 - RNA, 22 nt, Homo sapiens
aaaguggacuaagugaauauga

SEQ ID NO: 361937 - RNA, 22 nt, Homo sapiens
aaagugguuuuucagacuuuga

SEQ ID NO: 361938 - RNA, 22 nt, Homo sapiens
aaaguucuguugauagugcuga

SEQ ID NO: 361939 - RNA, 22 nt, Homo sapiens
uggaauuaauuaaaauauacug

SEQ ID NO: 361940 - RNA, 22 nt, Homo sapiens
uggacauguacauauguguaug

SEQ ID NO: 361941 - RNA, 21 nt, Homo sapiens
uggaccccuuccagucaucau

SEQ ID NO: 361942 - RNA, 19 nt, Homo sapiens
uggaccccuuccuuacacc

SEQ ID NO: 361943 - RNA, 21 nt, Homo sapiens
uggaccccuuccuugcaccau

SEQ ID NO: 361944 - RNA, 22 nt, Homo sapiens
uggaccccuucuccuauuaaaa

SEQ ID NO: 361945 - RNA, 22 nt, Homo sapiens
uggacugagauuucagcugcca

SEQ ID NO: 361946 - RNA, 22 nt, Homo sapiens
uggacuguaauuuuauaggcau

SEQ ID NO: 361947 - RNA, 22 nt, Homo sapiens
uggagagugauaaguaaaugga

SEQ ID NO: 361948 - RNA, 22 nt, Homo sapiens
uggagcccuaguuccucauaac

SEQ ID NO: 361949 - RNA, 22 nt, Homo sapiens
uggagguagacauugggaagag

SEQ ID NO: 361950 - RNA, 22 nt, Homo sapiens
uggaguaggccuaagaaugaca

SEQ ID NO: 361951 - RNA, 22 nt, Homo sapiens
uggagucuugcucuguugccca

SEQ ID NO: 361952 - RNA, 21 nt, Homo sapiens
uggagugaagaguuuauugac

SEQ ID NO: 361953 - RNA, 22 nt, Homo sapiens
uggagugcaauggcaccaucuu

SEQ ID NO: 361954 - RNA, 22 nt, Homo sapiens
uggauagauacuauccaggacu

SEQ ID NO: 361955 - RNA, 22 nt, Homo sapiens
uggauaguaaagucagauuccc

SEQ ID NO: 361956 - RNA, 22 nt, Homo sapiens
uggauaguucuucuacuagagu

SEQ ID NO: 361957 - RNA, 22 nt, Homo sapiens
uggauauguuuauuacccugaa

SEQ ID NO: 361958 - RNA, 22 nt, Homo sapiens
uggaugacuguuauaugcauau

SEQ ID NO: 361959 - RNA, 21 nt, Homo sapiens
uggaugccuaggcagaaguuu

SEQ ID NO: 361960 - RNA, 22 nt, Homo sapiens
uggauguaauugauucauguug

SEQ ID NO: 361961 - RNA, 22 nt, Homo sapiens
uggcaaaucagaggcauggaca

SEQ ID NO: 361962 - RNA, 22 nt, Homo sapiens
uggcaagaccccaucucuacaa

SEQ ID NO: 361963 - RNA, 19 nt, Homo sapiens
uggcaaugucagcagagau

SEQ ID NO: 361964 - RNA, 19 nt, Homo sapiens
uggcacauguauacuuaug

SEQ ID NO: 361965 - RNA, 22 nt, Homo sapiens
uggcacuaugugacaagguuuu

SEQ ID NO: 361966 - RNA, 22 nt, Homo sapiens
uggcagaugggugagcuggaga

SEQ ID NO: 361967 - RNA, 22 nt, Homo sapiens
uggcagcugcuucaugggaugc

SEQ ID NO: 361968 - RNA, 22 nt, Homo sapiens
uggcaguuucacauggcucaac

SEQ ID NO: 361969 - RNA, 22 nt, Homo sapiens
uggcaguuuugauguggagaga

SEQ ID NO: 361970 - RNA, 22 nt, Homo sapiens
uggcaguuuuugccuucaauac

SEQ ID NO: 361971 - RNA, 19 nt, Homo sapiens
uggcaugaaugugaacuaa

SEQ ID NO: 361972 - RNA, 17 nt, Homo sapiens
uggcaugaggguguggg

SEQ ID NO: 361973 - RNA, 22 nt, Homo sapiens
uggcaugggguaguagcgcugg

SEQ ID NO: 361974 - RNA, 22 nt, Homo sapiens
uggcauguaaugcagaaguugc

SEQ ID NO: 361975 - RNA, 22 nt, Homo sapiens
uggcauuuuguuuuagaauuag

SEQ ID NO: 361976 - RNA, 23 nt, Homo sapiens
uggccagaaacuucuuuucaucc

SEQ ID NO: 361977 - RNA, 22 nt, Homo sapiens
uggccaguguuuuuccugggcu

SEQ ID NO: 361978 - RNA, 22 nt, Homo sapiens
uggcccccucccaaaucucaua

SEQ ID NO: 361979 - RNA, 22 nt, Homo sapiens
uggcgagaugcucgugugcaga

SEQ ID NO: 361980 - RNA, 22 nt, Homo sapiens
uggcuacuguacuugagcuauu

SEQ ID NO: 361981 - RNA, 22 nt, Homo sapiens
uggcuagaccugcauaacagcu

SEQ ID NO: 361982 - RNA, 22 nt, Homo sapiens
uggcuguuguuacuaacaguuc

SEQ ID NO: 361983 - RNA, 21 nt, Homo sapiens
uggcuguuuucaugcuagaac

SEQ ID NO: 361984 - RNA, 22 nt, Homo sapiens
uggcuuuguaagguuucauuuu

SEQ ID NO: 361985 - RNA, 20 nt, Homo sapiens
ugggaaauguccaggacaua

SEQ ID NO: 361986 - RNA, 18 nt, Homo sapiens
ugggaagaaauucuucuc

SEQ ID NO: 361987 - RNA, 22 nt, Homo sapiens
gugugauuguuaauuuuaggug

SEQ ID NO: 361988 - RNA, 22 nt, Homo sapiens
gugugcacaaucuggcaugugc

SEQ ID NO: 361989 - RNA, 22 nt, Homo sapiens
gugugcaugucuuuuuaguagg

SEQ ID NO: 361990 - RNA, 22 nt, Homo sapiens
guguggcaggugggggcucaga

SEQ ID NO: 361991 - RNA, 22 nt, Homo sapiens
guguuauuuugcugggaaugau

SEQ ID NO: 361992 - RNA, 22 nt, Homo sapiens
guuacagucuuguguaagguua

SEQ ID NO: 361993 - RNA, 22 nt, Homo sapiens
guuagguagaaguuuacuuuga

SEQ ID NO: 361994 - RNA, 22 nt, Homo sapiens
guuagugcuuauuaaauaguau

SEQ ID NO: 361995 - RNA, 22 nt, Homo sapiens
guuauguuaaauuguuguaugc

SEQ ID NO: 361996 - RNA, 22 nt, Homo sapiens
uacuucauucuugaccuugcau

SEQ ID NO: 361997 - RNA, 22 nt, Homo sapiens
uagaacaauugcuggauccgaa

SEQ ID NO: 361998 - RNA, 18 nt, Homo sapiens
uagaauauaggucauucu

SEQ ID NO: 361999 - RNA, 22 nt, Homo sapiens
uagaaugaaacaagcugugccu

SEQ ID NO: 362000 - RNA, 22 nt, Homo sapiens
uagacacuagauaugugacuga

SEQ ID NO: 362001 - RNA, 22 nt, Homo sapiens
uagaggaaugaauuuggccaga

SEQ ID NO: 362002 - RNA, 22 nt, Homo sapiens
uagagugcugucaaagacuugu

SEQ ID NO: 362003 - RNA, 21 nt, Homo sapiens
uagauacuguauuaaaccuag

SEQ ID NO: 362004 - RNA, 22 nt, Homo sapiens
uagauuauuggcugauuugauc

SEQ ID NO: 362005 - RNA, 22 nt, Homo sapiens
uagauucaucuguuccuuuuga

SEQ ID NO: 362006 - RNA, 22 nt, Homo sapiens
uagcaacauucagcucagguac

SEQ ID NO: 362007 - RNA, 22 nt, Homo sapiens
uagcaccaaacauauacucagu

SEQ ID NO: 362008 - RNA, 22 nt, Homo sapiens
uagcagacuauuuugugauaau

SEQ ID NO: 362009 - RNA, 20 nt, Homo sapiens
uagcagcagacagagggagg

SEQ ID NO: 362010 - RNA, 22 nt, Homo sapiens
uagcagcauaaauggacuaaga

SEQ ID NO: 362011 - RNA, 19 nt, Homo sapiens
uagcagcaugauuuauaau

SEQ ID NO: 362012 - RNA, 22 nt, Homo sapiens
uagcauaauuuguagaaaauca

SEQ ID NO: 362013 - RNA, 22 nt, Homo sapiens
uagcauccuucucuaaacagga

SEQ ID NO: 362014 - RNA, 22 nt, Homo sapiens
uagcauggagucaugcacggcu

SEQ ID NO: 362015 - RNA, 22 nt, Homo sapiens
uagcccagugagguugauuugg

SEQ ID NO: 362016 - RNA, 21 nt, Homo sapiens
uagcucagugguguugccaua

SEQ ID NO: 362017 - RNA, 22 nt, Homo sapiens
uagcugagacuacaguaggugc

SEQ ID NO: 362018 - RNA, 22 nt, Homo sapiens
uagcugaucuuuuaaagaauga

SEQ ID NO: 362019 - RNA, 21 nt, Homo sapiens
uagcugaugauguaggggaug

SEQ ID NO: 362020 - RNA, 22 nt, Homo sapiens
uagcugauguuugucuaguagc

SEQ ID NO: 362021 - RNA, 22 nt, Homo sapiens
uaggaaguuucuugauuacuua

SEQ ID NO: 362022 - RNA, 22 nt, Homo sapiens
uaggacacagaccuggauggaa

SEQ ID NO: 362023 - RNA, 22 nt, Homo sapiens
uaggacacucucuccaccagua

SEQ ID NO: 362024 - RNA, 22 nt, Homo sapiens
uaggacuuuucuugagagugac

SEQ ID NO: 362025 - RNA, 22 nt, Homo sapiens
uaggcaauguacauaucggccc

SEQ ID NO: 362026 - RNA, 22 nt, Homo sapiens
uaggcacugagaauaugaggau

SEQ ID NO: 362027 - RNA, 22 nt, Homo sapiens
uaggcaguggagaaauaaacag

SEQ ID NO: 362028 - RNA, 22 nt, Homo sapiens
uaggcaguguucucacuuguaa

SEQ ID NO: 362029 - RNA, 22 nt, Homo sapiens
uaggcaguuuuccuuucacagu

SEQ ID NO: 362030 - RNA, 22 nt, Homo sapiens
uaggcauuuuucugauaaacua

SEQ ID NO: 362031 - RNA, 22 nt, Homo sapiens
uaggcuuuuggacccugucucu

SEQ ID NO: 362032 - RNA, 22 nt, Homo sapiens
uagggaguguccuuucgggaaa

SEQ ID NO: 362033 - RNA, 19 nt, Homo sapiens
uagggcacgaggcagaguc

SEQ ID NO: 362034 - RNA, 22 nt, Homo sapiens
uagggcuugugaucagguguag

SEQ ID NO: 362035 - RNA, 22 nt, Homo sapiens
uagggcuuuaguuugcuugugu

SEQ ID NO: 362036 - RNA, 22 nt, Homo sapiens
uagguaguuagcauacuacaca

SEQ ID NO: 362037 - RNA, 22 nt, Homo sapiens
uaggugaaugcuggaagaaaug

SEQ ID NO: 362038 - RNA, 22 nt, Homo sapiens
uagguuguccaucucuagaagc

SEQ ID NO: 362039 - RNA, 22 nt, Homo sapiens
uagguugucuguucacucugau

SEQ ID NO: 362040 - RNA, 22 nt, Homo sapiens
uaguaaacagcucugccacaau

SEQ ID NO: 362041 - RNA, 22 nt, Homo sapiens
uaguaucacaagguguacaccc

SEQ ID NO: 362042 - RNA, 22 nt, Homo sapiens
uagugcuguaauucuaaugaaa

SEQ ID NO: 362043 - RNA, 22 nt, Homo sapiens
uagugcugugauauuuuuggcc

SEQ ID NO: 362044 - RNA, 22 nt, Homo sapiens
uaguucauuauguguugcucag

SEQ ID NO: 362045 - RNA, 22 nt, Homo sapiens
uauacacgugugcauauauaca

SEQ ID NO: 362046 - RNA, 22 nt, Homo sapiens
uauacugucuuuguaugccuag

SEQ ID NO: 362047 - RNA, 22 nt, Homo sapiens
uauagcagccugaacaaaguaa

SEQ ID NO: 362048 - RNA, 22 nt, Homo sapiens
uauagcuuaaaguuuagauccu

SEQ ID NO: 362049 - RNA, 22 nt, Homo sapiens
uauauagcuaugucuguccauu

SEQ ID NO: 362050 - RNA, 22 nt, Homo sapiens
uauaucacaugcacucauuuuc

SEQ ID NO: 362051 - RNA, 21 nt, Homo sapiens
uauaugacuuacuauugccuc

SEQ ID NO: 362052 - RNA, 22 nt, Homo sapiens
uauaugcaacauaguguaugug

SEQ ID NO: 362053 - RNA, 22 nt, Homo sapiens
uauaugcacucagguguaugug

SEQ ID NO: 362054 - RNA, 22 nt, Homo sapiens
uauaugcauugugggguacuga

SEQ ID NO: 362055 - RNA, 22 nt, Homo sapiens
uaucacagauauuaugggccaa

SEQ ID NO: 362056 - RNA, 22 nt, Homo sapiens
uaucacaggucaggaaccuugu

SEQ ID NO: 362057 - RNA, 22 nt, Homo sapiens
uaucacaggucaggaaucuugc

SEQ ID NO: 362058 - RNA, 22 nt, Homo sapiens
uaucacagguggacugcacacc

SEQ ID NO: 362059 - RNA, 22 nt, Homo sapiens
uaucacaguaucuagcacagug

SEQ ID NO: 362060 - RNA, 22 nt, Homo sapiens
uaucacagugcuggaguauucc

SEQ ID NO: 362061 - RNA, 22 nt, Homo sapiens
uaucacuguuguuuguuuaagg

SEQ ID NO: 362062 - RNA, 22 nt, Homo sapiens
uaucacuuugauaguuuaaaug

SEQ ID NO: 362063 - RNA, 21 nt, Homo sapiens
uaucagagacauugagaggca

SEQ ID NO: 362064 - RNA, 22 nt, Homo sapiens
uaucagagcugucagccuaccu

SEQ ID NO: 362065 - RNA, 22 nt, Homo sapiens
uaucauggaaagauguugaaau

SEQ ID NO: 362066 - RNA, 22 nt, Homo sapiens
uaucccaauguaauaucacaaa

SEQ ID NO: 362067 - RNA, 22 nt, Homo sapiens
uaucuacauguagguauguaug

SEQ ID NO: 362068 - RNA, 22 nt, Homo sapiens
uaucucauccuccuugauccca

SEQ ID NO: 362069 - RNA, 18 nt, Homo sapiens
uaucucauuucuuagguc

SEQ ID NO: 362070 - RNA, 22 nt, Homo sapiens
uaucucuuuucauguguaaaug

SEQ ID NO: 362071 - RNA, 22 nt, Homo sapiens
ugcaccacuacacuccaggcug

SEQ ID NO: 362072 - RNA, 22 nt, Homo sapiens
ugcaccacugcacuccacccug

SEQ ID NO: 362073 - RNA, 22 nt, Homo sapiens
ugcaccacugcacuucagccug

SEQ ID NO: 362074 - RNA, 22 nt, Homo sapiens
ugcaccauugcauuccagccug

SEQ ID NO: 362075 - RNA, 22 nt, Homo sapiens
ugcagagucuguccugccugcc

SEQ ID NO: 362076 - RNA, 22 nt, Homo sapiens
ugcagcacuguucacaauagcc

SEQ ID NO: 362077 - RNA, 21 nt, Homo sapiens
ugcagccauucagcccuaugc

SEQ ID NO: 362078 - RNA, 22 nt, Homo sapiens
ugcagcucagcugcggaguuuu

SEQ ID NO: 362079 - RNA, 22 nt, Homo sapiens
ugcagguacuugacaacuuggg

SEQ ID NO: 362080 - RNA, 22 nt, Homo sapiens
ugcaguacugucagacuucuua

SEQ ID NO: 362081 - RNA, 22 nt, Homo sapiens
ugcaguagugugaucuuggcuc

SEQ ID NO: 362082 - RNA, 22 nt, Homo sapiens
ugcauacacaagcauacaugua

SEQ ID NO: 362083 - RNA, 17 nt, Homo sapiens
ugcauagugggaggaga

SEQ ID NO: 362084 - RNA, 22 nt, Homo sapiens
ugcauaugucuuuauagcagca

SEQ ID NO: 362085 - RNA, 18 nt, Homo sapiens
ugcauauguugaaccagc

SEQ ID NO: 362086 - RNA, 22 nt, Homo sapiens
ugcauauguugaaccagccuug

SEQ ID NO: 362087 - RNA, 22 nt, Homo sapiens
ugcauauucaaggcaggccauu

SEQ ID NO: 362088 - RNA, 22 nt, Homo sapiens
ugcauauucgaguuauuuuggg

SEQ ID NO: 362089 - RNA, 21 nt, Homo sapiens
ugcauauuggaacuuucucuc

SEQ ID NO: 362090 - RNA, 22 nt, Homo sapiens
ugcauggaagggagggaaagag

SEQ ID NO: 362091 - RNA, 22 nt, Homo sapiens
ugcauggaggagcuccccgcag

SEQ ID NO: 362092 - RNA, 22 nt, Homo sapiens
ugcauugcacuugcaugagaua

SEQ ID NO: 362093 - RNA, 22 nt, Homo sapiens
ugcauugccgugauuacugucu

SEQ ID NO: 362094 - RNA, 22 nt, Homo sapiens
ugccaaggagucagucccuaga

SEQ ID NO: 362095 - RNA, 22 nt, Homo sapiens
ugccagagacguagggaauauu

SEQ ID NO: 362096 - RNA, 22 nt, Homo sapiens
ugccaucauuaauauuaggcau

SEQ ID NO: 362097 - RNA, 22 nt, Homo sapiens
ugccaugaagaucccugaaaug

SEQ ID NO: 362098 - RNA, 22 nt, Homo sapiens
ugccauugcacuccagccuggg

SEQ ID NO: 362099 - RNA, 22 nt, Homo sapiens
ugcccaguggacagaaagucau

SEQ ID NO: 362100 - RNA, 22 nt, Homo sapiens
ugcccuguaucccacuguuuca

SEQ ID NO: 362101 - RNA, 22 nt, Homo sapiens
ugccuaggcuggagugcagugg

SEQ ID NO: 362102 - RNA, 22 nt, Homo sapiens
ugccuaguguguugagaguuuu

SEQ ID NO: 362103 - RNA, 22 nt, Homo sapiens
ugccugagccagguuuuaggag

SEQ ID NO: 362104 - RNA, 22 nt, Homo sapiens
ugcuacccuucgucucucuggu

SEQ ID NO: 362105 - RNA, 22 nt, Homo sapiens
ugcugcaaacaggcaucugugg

SEQ ID NO: 362106 - RNA, 22 nt, Homo sapiens
ugcugcacaguucuuaagauua

SEQ ID NO: 362107 - RNA, 22 nt, Homo sapiens
ugcugcuguuaucauuuuacca

SEQ ID NO: 362108 - RNA, 22 nt, Homo sapiens
ugcuggugucaucaaggcuuug

SEQ ID NO: 362109 - RNA, 22 nt, Homo sapiens
ugcugguguggucuagccgcuu

SEQ ID NO: 362110 - RNA, 17 nt, Homo sapiens
ugcuuagagagccucag

SEQ ID NO: 362111 - RNA, 22 nt, Homo sapiens
ugcuuagucuugcuuuagcuau

SEQ ID NO: 362112 - RNA, 22 nt, Homo sapiens
ccacauuaccuugcuugcucca

SEQ ID NO: 362113 - RNA, 22 nt, Homo sapiens
ccagccgggugcaguggcucac

SEQ ID NO: 362114 - RNA, 22 nt, Homo sapiens
ccaguauugaacacaaugaaag

SEQ ID NO: 362115 - RNA, 22 nt, Homo sapiens
ccagugguucccuguggccuga

SEQ ID NO: 362116 - RNA, 21 nt, Homo sapiens
ccagugguuggaaacuauggg

SEQ ID NO: 362117 - RNA, 22 nt, Homo sapiens
ccaucacacugugauuauuauc

SEQ ID NO: 362118 - RNA, 22 nt, Homo sapiens
ccaucccuuucugagcaguucc

SEQ ID NO: 362119 - RNA, 21 nt, Homo sapiens
ccaugggacggaaugaauaca

SEQ ID NO: 362120 - RNA, 22 nt, Homo sapiens
ccauugaacaugaaggaaugug

SEQ ID NO: 362121 - RNA, 22 nt, Homo sapiens
ccauugcacuucagccuaggug

SEQ ID NO: 362122 - RNA, 22 nt, Homo sapiens
ccauuucacucuuccugaagga

SEQ ID NO: 362123 - RNA, 22 nt, Homo sapiens
cccaguagagauugccgaauug

SEQ ID NO: 362124 - RNA, 22 nt, Homo sapiens
cccaguguuacgugacagccug

SEQ ID NO: 362125 - RNA, 22 nt, Homo sapiens
cccaguguuuauuuugagccaa

SEQ ID NO: 362126 - RNA, 22 nt, Homo sapiens
cccauuguuaaguugaguaucu

SEQ ID NO: 362127 - RNA, 22 nt, Homo sapiens
ccccggguucugucugcccuug

SEQ ID NO: 362128 - RNA, 20 nt, Homo sapiens
ccccuggaguggggcugcuu

SEQ ID NO: 362129 - RNA, 23 nt, Homo sapiens
cccucagaagugcagggagagaa

SEQ ID NO: 362130 - RNA, 22 nt, Homo sapiens
cccugacauucggagauguagu

SEQ ID NO: 362131 - RNA, 22 nt, Homo sapiens
cccugagaugcuguuaaucugu

SEQ ID NO: 362132 - RNA, 22 nt, Homo sapiens
cccugagcagccugaguuuccc

SEQ ID NO: 362133 - RNA, 22 nt, Homo sapiens
cccuguagcagcauucuuaaau

SEQ ID NO: 362134 - RNA, 22 nt, Homo sapiens
cccuguguuuagcugaagguuu

SEQ ID NO: 362135 - RNA, 22 nt, Homo sapiens
cccuuagaauuuuguaguuauu

SEQ ID NO: 362136 - RNA, 22 nt, Homo sapiens
ccggguguuuuguucucucaga

SEQ ID NO: 362137 - RNA, 22 nt, Homo sapiens
ccuaggcacugggguccagccc

SEQ ID NO: 362138 - RNA, 21 nt, Homo sapiens
ccucuuugagggaagaaaggg

SEQ ID NO: 362139 - RNA, 22 nt, Homo sapiens
ccugagacgaauggagugaaca

SEQ ID NO: 362140 - RNA, 22 nt, Homo sapiens
ccugagacugauugacucacaa

SEQ ID NO: 362141 - RNA, 22 nt, Homo sapiens
ccuggaagaaaggugcuaaaua

SEQ ID NO: 362142 - RNA, 22 nt, Homo sapiens
ccuggcacugagcaguguucua

SEQ ID NO: 362143 - RNA, 22 nt, Homo sapiens
ccuguagcauccaagaagcugc

SEQ ID NO: 362144 - RNA, 22 nt, Homo sapiens
ccugucuugaagagauccuccu

SEQ ID NO: 362145 - RNA, 18 nt, Homo sapiens
ccuuaguuauagagaguc

SEQ ID NO: 362146 - RNA, 22 nt, Homo sapiens
ccuucacaggcacugguucaga

SEQ ID NO: 362147 - RNA, 22 nt, Homo sapiens
ccuuggcaauggcuggggcuga

SEQ ID NO: 362148 - RNA, 22 nt, Homo sapiens
ccuuggcacuuugccacagugc

SEQ ID NO: 362149 - RNA, 22 nt, Homo sapiens
ccuugguggccacaagacauug

SEQ ID NO: 362150 - RNA, 19 nt, Homo sapiens
ccuugguuagguauauucc

SEQ ID NO: 362151 - RNA, 22 nt, Homo sapiens
ccuuuguuuaguugaauuguau

SEQ ID NO: 362152 - RNA, 22 nt, Homo sapiens
ccuuuuuguaguggaaguagga

SEQ ID NO: 362153 - RNA, 22 nt, Homo sapiens
cgccgggggaugggcaccagcg

SEQ ID NO: 362154 - RNA, 22 nt, Homo sapiens
cgcuggugaucuagacccccaa

SEQ ID NO: 362155 - RNA, 21 nt, Homo sapiens
cgucauggagauguguuguac

SEQ ID NO: 362156 - RNA, 22 nt, Homo sapiens
cgugaggaaaacagaggguguu

SEQ ID NO: 362157 - RNA, 22 nt, Homo sapiens
cgugaggaguauuuuuaggugc

SEQ ID NO: 362158 - RNA, 22 nt, Homo sapiens
cuaaaguauugagugguaaaga

SEQ ID NO: 362159 - RNA, 22 nt, Homo sapiens
cuaaagucacgauuugugggua

SEQ ID NO: 362160 - RNA, 23 nt, Homo sapiens
cuaaagucugucacugaggacuu

SEQ ID NO: 362161 - RNA, 18 nt, Homo sapiens
cuaagacacuuggcagag

SEQ ID NO: 362162 - RNA, 17 nt, Homo sapiens
cuaaggcaagagucugc

SEQ ID NO: 362163 - RNA, 18 nt, Homo sapiens
cuaauacuauucaacaag

SEQ ID NO: 362164 - RNA, 21 nt, Homo sapiens
cuaaucucacccuuuucuggg

SEQ ID NO: 362165 - RNA, 22 nt, Homo sapiens
cuaauucuguaccuggcacaua

SEQ ID NO: 362166 - RNA, 22 nt, Homo sapiens
cuacagaguaucuaaagaggua

SEQ ID NO: 362167 - RNA, 22 nt, Homo sapiens
cuacccuuaaguuucugugggg

SEQ ID NO: 362168 - RNA, 22 nt, Homo sapiens
cuaccuggguggcucaugacuu

SEQ ID NO: 362169 - RNA, 22 nt, Homo sapiens
cuagaacuagaacugcuggggu

SEQ ID NO: 362170 - RNA, 22 nt, Homo sapiens
cuagaauguauaaaaccaagcu

SEQ ID NO: 362171 - RNA, 22 nt, Homo sapiens
cuagaggcacagccuaggcacu

SEQ ID NO: 362172 - RNA, 22 nt, Homo sapiens
cuagaguagaguuuccuuagga

SEQ ID NO: 362173 - RNA, 22 nt, Homo sapiens
cuagcaacauuucagugaguuu

SEQ ID NO: 362174 - RNA, 22 nt, Homo sapiens
cuagcacauaguuauucacuca

SEQ ID NO: 362175 - RNA, 22 nt, Homo sapiens
cuagcagcauaagaaucaccaa

SEQ ID NO: 362176 - RNA, 22 nt, Homo sapiens
cuagcccagugcuccuggauca

SEQ ID NO: 362177 - RNA, 22 nt, Homo sapiens
cuagcuccauauaaagcaggau

SEQ ID NO: 362178 - RNA, 22 nt, Homo sapiens
cuaggaaguauguguuauugcu

SEQ ID NO: 362179 - RNA, 22 nt, Homo sapiens
cuaggcacgccugggucuccag

SEQ ID NO: 362180 - RNA, 22 nt, Homo sapiens
cuagucacauuuucaucaaaua

SEQ ID NO: 362181 - RNA, 22 nt, Homo sapiens
cuauaguauaguuugaagucag

SEQ ID NO: 362182 - RNA, 22 nt, Homo sapiens
cuaugcauuuuggaggagggaa

SEQ ID NO: 362183 - RNA, 22 nt, Homo sapiens
cuaugucuuucauauuuugggg

SEQ ID NO: 362184 - RNA, 21 nt, Homo sapiens
cucaaaguacugauauuacag

SEQ ID NO: 362185 - RNA, 22 nt, Homo sapiens
cucaaaguacuuugguuauugu

SEQ ID NO: 362186 - RNA, 22 nt, Homo sapiens
cucaaagugcuaagauuaggcu

SEQ ID NO: 362187 - RNA, 22 nt, Homo sapiens
cucaaaugguccagcuaguggu

SEQ ID NO: 362188 - RNA, 18 nt, Homo sapiens
cucacaguaacuuuuaag

SEQ ID NO: 362189 - RNA, 20 nt, Homo sapiens
cucaccagguguaggcugag

SEQ ID NO: 362190 - RNA, 22 nt, Homo sapiens
cucaccuugugauccuccugcc

SEQ ID NO: 362191 - RNA, 22 nt, Homo sapiens
cucagcaguggauuuaccacca

SEQ ID NO: 362192 - RNA, 22 nt, Homo sapiens
cucagcuacuugggaagcugag

SEQ ID NO: 362193 - RNA, 22 nt, Homo sapiens
cucaguagaaaauacauggacu

SEQ ID NO: 362194 - RNA, 22 nt, Homo sapiens
cucagucuaugauacuuugcua

SEQ ID NO: 362195 - RNA, 22 nt, Homo sapiens
cucaguguuaaggccaccucug

SEQ ID NO: 362196 - RNA, 22 nt, Homo sapiens
cucaguuuugccuuguuuaagg

SEQ ID NO: 362197 - RNA, 19 nt, Homo sapiens
cucauggagaaggagaaua

SEQ ID NO: 362198 - RNA, 22 nt, Homo sapiens
cucauggagauagagaauagaa

SEQ ID NO: 362199 - RNA, 22 nt, Homo sapiens
auucaagggauuucaggaggcu

SEQ ID NO: 362200 - RNA, 22 nt, Homo sapiens
auucacagggggagaaggguau

SEQ ID NO: 362201 - RNA, 22 nt, Homo sapiens
auucacuguggguccuuuggau

SEQ ID NO: 362202 - RNA, 22 nt, Homo sapiens
auucacuuuuauagacaggucu

SEQ ID NO: 362203 - RNA, 22 nt, Homo sapiens
auucaucagggauauugguuga

SEQ ID NO: 362204 - RNA, 22 nt, Homo sapiens
auuccagauggaguugaggguu

SEQ ID NO: 362205 - RNA, 22 nt, Homo sapiens
auuccuuaggcccuuugguuag

SEQ ID NO: 362206 - RNA, 22 nt, Homo sapiens
auucuauaguccuaggauuggg

SEQ ID NO: 362207 - RNA, 22 nt, Homo sapiens
auucuugcuugaacuuggugca

SEQ ID NO: 362208 - RNA, 22 nt, Homo sapiens
auugaauuugguuugcuaagaa

SEQ ID NO: 362209 - RNA, 22 nt, Homo sapiens
auugagguauaauugcuaugca

SEQ ID NO: 362210 - RNA, 23 nt, Homo sapiens
auugauagugccuuugugcuaau

SEQ ID NO: 362211 - RNA, 22 nt, Homo sapiens
auugcaacaguguugagaggug

SEQ ID NO: 362212 - RNA, 22 nt, Homo sapiens
auugcacaaagagggaaacuga

SEQ ID NO: 362213 - RNA, 22 nt, Homo sapiens
auugcacaucugcacuacagcc

SEQ ID NO: 362214 - RNA, 22 nt, Homo sapiens
auugcaccacugcccuccagcc

SEQ ID NO: 362215 - RNA, 23 nt, Homo sapiens
auugcagucuugaacuccugggc

SEQ ID NO: 362216 - RNA, 19 nt, Homo sapiens
auugcaguguaaaacuauu

SEQ ID NO: 362217 - RNA, 22 nt, Homo sapiens
auugccacaucucagaggcaga

SEQ ID NO: 362218 - RNA, 21 nt, Homo sapiens
auugcccaaaguggaggggaa

SEQ ID NO: 362219 - RNA, 22 nt, Homo sapiens
auugcccauaaggauauuguca

SEQ ID NO: 362220 - RNA, 22 nt, Homo sapiens
auugccucaauuccaagacugc

SEQ ID NO: 362221 - RNA, 22 nt, Homo sapiens
auugcuaacugaaauaagacca

SEQ ID NO: 362222 - RNA, 22 nt, Homo sapiens
auugcucaaaucaguacuugag

SEQ ID NO: 362223 - RNA, 22 nt, Homo sapiens
auugcucacacaaagccuguuu

SEQ ID NO: 362224 - RNA, 22 nt, Homo sapiens
auuggcaagauagcauaugagg

SEQ ID NO: 362225 - RNA, 22 nt, Homo sapiens
auuggggaaugguggcuuuagu

SEQ ID NO: 362226 - RNA, 22 nt, Homo sapiens
guggcuaaagauuuggaaucug

SEQ ID NO: 362227 - RNA, 22 nt, Homo sapiens
guggcuauuguucccugguugc

SEQ ID NO: 362228 - RNA, 22 nt, Homo sapiens
gugggaagcuggaacucccucc

SEQ ID NO: 362229 - RNA, 22 nt, Homo sapiens
gugggaugaucacaguucacug

SEQ ID NO: 362230 - RNA, 22 nt, Homo sapiens
gugggauggagagaagguauga

SEQ ID NO: 362231 - RNA, 22 nt, Homo sapiens
gugguagaaauguagaugcuag

SEQ ID NO: 362232 - RNA, 22 nt, Homo sapiens
gugguguccugcaccuauaguc

SEQ ID NO: 362233 - RNA, 22 nt, Homo sapiens
guggugucuuuuuugauuagga

SEQ ID NO: 362234 - RNA, 22 nt, Homo sapiens
gugguucuaaaccuuuuuuggu

SEQ ID NO: 362235 - RNA, 22 nt, Homo sapiens
gugguuuuacaaagagaaagau

SEQ ID NO: 362236 - RNA, 22 nt, Homo sapiens
guguaaaucaaucuguugucuu

SEQ ID NO: 362237 - RNA, 20 nt, Homo sapiens
guguaagagcaagcuuccua

SEQ ID NO: 362238 - RNA, 22 nt, Homo sapiens
guguagagaaaaguaccauuuu

SEQ ID NO: 362239 - RNA, 22 nt, Homo sapiens
guguauguuguccauggaugcg

SEQ ID NO: 362240 - RNA, 22 nt, Homo sapiens
gugucacugugaggauauugua

SEQ ID NO: 362241 - RNA, 22 nt, Homo sapiens
gugucacuguugagaaguccac

SEQ ID NO: 362242 - RNA, 22 nt, Homo sapiens
gugucaugaagguuuuaugcag

SEQ ID NO: 362243 - RNA, 22 nt, Homo sapiens
gugucccagugugcauacaggu

SEQ ID NO: 362244 - RNA, 18 nt, Homo sapiens
gugucugguuaugggagu

SEQ ID NO: 362245 - RNA, 22 nt, Homo sapiens
gugugaacaucauagaguguau

SEQ ID NO: 362246 - RNA, 22 nt, Homo sapiens
gugugcaacuuucauuaauauu

SEQ ID NO: 362247 - RNA, 19 nt, Homo sapiens
gugugcauaucacagagca

SEQ ID NO: 362248 - RNA, 22 nt, Homo sapiens
gugugcauggagggggcaguga

SEQ ID NO: 362249 - RNA, 21 nt, Homo sapiens
gugugcuugaauucagcuguc

SEQ ID NO: 362250 - RNA, 23 nt, Homo sapiens
guuaagugaauguguacucuauu

SEQ ID NO: 362251 - RNA, 22 nt, Homo sapiens
guuagaugaagaccaagggcaa

SEQ ID NO: 362252 - RNA, 21 nt, Homo sapiens
ugcauuggagaauguuucuca

SEQ ID NO: 362253 - RNA, 22 nt, Homo sapiens
ugcauuguauuguugacucgcc

SEQ ID NO: 362254 - RNA, 22 nt, Homo sapiens
ugccaacaugccuggcuguuuu

SEQ ID NO: 362255 - RNA, 22 nt, Homo sapiens
ugccaagaacauuuucuguuuu

SEQ ID NO: 362256 - RNA, 22 nt, Homo sapiens
ugccauagagauuuguggaacu

SEQ ID NO: 362257 - RNA, 22 nt, Homo sapiens
ugccauagcaaugguaagcuga

SEQ ID NO: 362258 - RNA, 22 nt, Homo sapiens
ugccaugaaguaauggcaaaaa

SEQ ID NO: 362259 - RNA, 22 nt, Homo sapiens
ugccuaguagaaggugaacaug

SEQ ID NO: 362260 - RNA, 20 nt, Homo sapiens
ugccugacacucuuugcuuc

SEQ ID NO: 362261 - RNA, 22 nt, Homo sapiens
ugccugagcccagcccuguagu

SEQ ID NO: 362262 - RNA, 22 nt, Homo sapiens
ugccuggagagcuccuacauau

SEQ ID NO: 362263 - RNA, 22 nt, Homo sapiens
ugccuucuguuaaacgaggaug

SEQ ID NO: 362264 - RNA, 22 nt, Homo sapiens
ugcuagagaaauauauuugggg

SEQ ID NO: 362265 - RNA, 22 nt, Homo sapiens
ugcuauagcuauaucaucuccu

SEQ ID NO: 362266 - RNA, 22 nt, Homo sapiens
ugcuaugucuucucucacagag

SEQ ID NO: 362267 - RNA, 21 nt, Homo sapiens
ugcuccauuuucuagccugaa

SEQ ID NO: 362268 - RNA, 23 nt, Homo sapiens
ugcugagaccuagauccuaaaga

SEQ ID NO: 362269 - RNA, 22 nt, Homo sapiens
ugcugcaaucucggcacuuugg

SEQ ID NO: 362270 - RNA, 22 nt, Homo sapiens
ugcugcacuuauggcucugagg

SEQ ID NO: 362271 - RNA, 22 nt, Homo sapiens
ugcuggcguuacucuccaucag

SEQ ID NO: 362272 - RNA, 22 nt, Homo sapiens
ugcugguguuuaggaauaagaa

SEQ ID NO: 362273 - RNA, 22 nt, Homo sapiens
ugcuguguugcuggcuuaaaga

SEQ ID NO: 362274 - RNA, 22 nt, Homo sapiens
ugcuucauuggccaccaggaag

SEQ ID NO: 362275 - RNA, 22 nt, Homo sapiens
ugcuuguguucagguaaccuuu

SEQ ID NO: 362276 - RNA, 22 nt, Homo sapiens
ugcuuuguugaaaaucauuugg

SEQ ID NO: 362277 - RNA, 22 nt, Homo sapiens
uggaaaguacuugaguuuguau

SEQ ID NO: 362278 - RNA, 22 nt, Homo sapiens
uggaaauaaaugugccaagauc

SEQ ID NO: 362279 - RNA, 22 nt, Homo sapiens
uggaacugauauugauggaaaa

SEQ ID NO: 362280 - RNA, 22 nt, Homo sapiens
uggaagacacauaccugauaac

SEQ ID NO: 362281 - RNA, 22 nt, Homo sapiens
uggaagacaggcuguauuuuaa

SEQ ID NO: 362282 - RNA, 22 nt, Homo sapiens
uggaagacucuagucucuugag

SEQ ID NO: 362283 - RNA, 20 nt, Homo sapiens
uggaagccuggugcuaucuu

SEQ ID NO: 362284 - RNA, 20 nt, Homo sapiens
uggaaggcaucugcauuauu

SEQ ID NO: 362285 - RNA, 22 nt, Homo sapiens
uggaaguauagauaauugaaag

SEQ ID NO: 362286 - RNA, 22 nt, Homo sapiens
uggaaguuaaauuaguugauga

SEQ ID NO: 362287 - RNA, 22 nt, Homo sapiens
uggaauaucaugagaguuuguu

SEQ ID NO: 362288 - RNA, 22 nt, Homo sapiens
uggaaucuacuaaagcaaaauc

SEQ ID NO: 362289 - RNA, 20 nt, Homo sapiens
uggaaucugaagaucucagu

SEQ ID NO: 362290 - RNA, 22 nt, Homo sapiens
uggaauggagagagggugcacg

SEQ ID NO: 362291 - RNA, 22 nt, Homo sapiens
uggaauguagcguugacacgag

SEQ ID NO: 362292 - RNA, 22 nt, Homo sapiens
uggaauguuauggcuuuaaucu

SEQ ID NO: 362293 - RNA, 22 nt, Homo sapiens
uggaauguuuaucaaaacagua

SEQ ID NO: 362294 - RNA, 22 nt, Homo sapiens
gucacugugaggaggggccagg

SEQ ID NO: 362295 - RNA, 22 nt, Homo sapiens
gucaggugcuuacgcggagauc

SEQ ID NO: 362296 - RNA, 22 nt, Homo sapiens
gucagucugucccugccuggcg

SEQ ID NO: 362297 - RNA, 22 nt, Homo sapiens
gucagugcuuuaguucaggaug

SEQ ID NO: 362298 - RNA, 22 nt, Homo sapiens
gucaguggauacugucucuguc

SEQ ID NO: 362299 - RNA, 22 nt, Homo sapiens
gucagugugauaucugcagggg

SEQ ID NO: 362300 - RNA, 22 nt, Homo sapiens
gucauaugcucggaaaauguua

SEQ ID NO: 362301 - RNA, 22 nt, Homo sapiens
gucauccaggcuggagugaagc

SEQ ID NO: 362302 - RNA, 22 nt, Homo sapiens
gucauggaaaucuacauuguua

SEQ ID NO: 362303 - RNA, 22 nt, Homo sapiens
gucauucauucagcaagcacug

SEQ ID NO: 362304 - RNA, 22 nt, Homo sapiens
gucauugcuuaucugcugacgu

SEQ ID NO: 362305 - RNA, 22 nt, Homo sapiens
gucuagaacuucugaccuuagg

SEQ ID NO: 362306 - RNA, 18 nt, Homo sapiens
gucucacaugguggaagc

SEQ ID NO: 362307 - RNA, 22 nt, Homo sapiens
gucucagugcgaaucucaaaga

SEQ ID NO: 362308 - RNA, 22 nt, Homo sapiens
gucucccagccuacaucuuucu

SEQ ID NO: 362309 - RNA, 22 nt, Homo sapiens
gucuccgagccguguggagccg

SEQ ID NO: 362310 - RNA, 22 nt, Homo sapiens
gucucugagaugucaacaccua

SEQ ID NO: 362311 - RNA, 22 nt, Homo sapiens
gucuggcaauggcagacuggca

SEQ ID NO: 362312 - RNA, 22 nt, Homo sapiens
gucuggcacagggaaaguacaa

SEQ ID NO: 362313 - RNA, 21 nt, Homo sapiens
gucugguguuuuaaugaggac

SEQ ID NO: 362314 - RNA, 22 nt, Homo sapiens
gucuuagguuuaaucacuucua

SEQ ID NO: 362315 - RNA, 20 nt, Homo sapiens
gucuugcuccguugcccagg

SEQ ID NO: 362316 - RNA, 22 nt, Homo sapiens
gucuuuggaaaaaaugucuguu

SEQ ID NO: 362317 - RNA, 22 nt, Homo sapiens
gugaaaugaaacgcuaugucuu

SEQ ID NO: 362318 - RNA, 22 nt, Homo sapiens
gugaacagaaccugggaucgaa

SEQ ID NO: 362319 - RNA, 22 nt, Homo sapiens
gugaaguuuuuugcugagaguc

SEQ ID NO: 362320 - RNA, 22 nt, Homo sapiens
gugagaaucaaacuacauaaau

SEQ ID NO: 362321 - RNA, 22 nt, Homo sapiens
gugagauccucucuuauauggg

SEQ ID NO: 362322 - RNA, 22 nt, Homo sapiens
gugagcauaggaggcuucuguu

SEQ ID NO: 362323 - RNA, 22 nt, Homo sapiens
gugagccaugauuuuaccacug

SEQ ID NO: 362324 - RNA, 22 nt, Homo sapiens
gugagcuaagcaaauaugagcc

SEQ ID NO: 362325 - RNA, 22 nt, Homo sapiens
gugagguaauuagcucccuuag

SEQ ID NO: 362326 - RNA, 17 nt, Homo sapiens
gugagguauccucaaaa

SEQ ID NO: 362327 - RNA, 21 nt, Homo sapiens
gugaggucauugggcuuucug

SEQ ID NO: 362328 - RNA, 22 nt, Homo sapiens
gugaggucguagucauaggcaa

SEQ ID NO: 362329 - RNA, 22 nt, Homo sapiens
gugaguaaagguucauugaauu

SEQ ID NO: 362330 - RNA, 22 nt, Homo sapiens
gugauacugcuuauuaauuuaa

SEQ ID NO: 362331 - RNA, 21 nt, Homo sapiens
gugaucaugucacugcacucc

SEQ ID NO: 362332 - RNA, 23 nt, Homo sapiens
gugaucauuguuguggguugaau

SEQ ID NO: 362333 - RNA, 22 nt, Homo sapiens
gugaucuuucaggcuugaccau

SEQ ID NO: 362334 - RNA, 22 nt, Homo sapiens
gugauuauccacgucuuuguga

SEQ ID NO: 362335 - RNA, 22 nt, Homo sapiens
gugcaacaucccuccauaauuu

SEQ ID NO: 362336 - RNA, 22 nt, Homo sapiens
gugcaaccaucaccacugacuc

SEQ ID NO: 362337 - RNA, 22 nt, Homo sapiens
gugcaaugaguguggcaaagcc

SEQ ID NO: 362338 - RNA, 22 nt, Homo sapiens
gugcacaacgugcaaguuuguu

SEQ ID NO: 362339 - RNA, 22 nt, Homo sapiens
gugcacaacgugcaggcuuguu

SEQ ID NO: 362340 - RNA, 22 nt, Homo sapiens
gugcacaaugugcagguuuguu

SEQ ID NO: 362341 - RNA, 21 nt, Homo sapiens
gugcacaguaguguuuaauag

SEQ ID NO: 362342 - RNA, 22 nt, Homo sapiens
gugcaguuuuaagugaguuucu

SEQ ID NO: 362343 - RNA, 22 nt, Homo sapiens
gugcauaucugugguuggcuga

SEQ ID NO: 362344 - RNA, 22 nt, Homo sapiens
gugcaugucuaugcgagucuaa

SEQ ID NO: 362345 - RNA, 22 nt, Homo sapiens
gugcaugucugugacgacccug

SEQ ID NO: 362346 - RNA, 22 nt, Homo sapiens
gugcuauguuauccagcaagau

SEQ ID NO: 362347 - RNA, 22 nt, Homo sapiens
gugcuuuguuguggcaguggca

SEQ ID NO: 362348 - RNA, 22 nt, Homo sapiens
guggaaaauuauugcuguuuuu

SEQ ID NO: 362349 - RNA, 22 nt, Homo sapiens
guggaagugucuggggccaggg

SEQ ID NO: 362350 - RNA, 22 nt, Homo sapiens
guggaaucuagagaggcaguag

SEQ ID NO: 362351 - RNA, 22 nt, Homo sapiens
guggagucaucacucagagugg

SEQ ID NO: 362352 - RNA, 22 nt, Homo sapiens
guggcaaagaugccuucuccaa

SEQ ID NO: 362353 - RNA, 22 nt, Homo sapiens
guggcaagaauguacaaaaggu

SEQ ID NO: 362354 - RNA, 22 nt, Homo sapiens
guggcaagaugacuacucacug

SEQ ID NO: 362355 - RNA, 22 nt, Homo sapiens
guggcacaauuaaguagcuauu

SEQ ID NO: 362356 - RNA, 22 nt, Homo sapiens
guggcagaacagguaggguucu

SEQ ID NO: 362357 - RNA, 22 nt, Homo sapiens
guggcagagucagagggaaaug

SEQ ID NO: 362358 - RNA, 22 nt, Homo sapiens
uucuuaguggcaccacuuuuuu

SEQ ID NO: 362359 - RNA, 22 nt, Homo sapiens
uucuucaguuacaacaaggggg

SEQ ID NO: 362360 - RNA, 22 nt, Homo sapiens
uucuucugguuaugaaauuuga

SEQ ID NO: 362361 - RNA, 22 nt, Homo sapiens
uucuugguguaguaguugaaaa

SEQ ID NO: 362362 - RNA, 22 nt, Homo sapiens
uucuugguuuaucgcuuuaaaa

SEQ ID NO: 362363 - RNA, 22 nt, Homo sapiens
uugaaagcuaucucaaaucgcu

SEQ ID NO: 362364 - RNA, 22 nt, Homo sapiens
uugaaauguguaagcuccgaaa

SEQ ID NO: 362365 - RNA, 22 nt, Homo sapiens
uugaagacuaauuuagauaaug

SEQ ID NO: 362366 - RNA, 22 nt, Homo sapiens
uugaagacuaccuaccauacuu

SEQ ID NO: 362367 - RNA, 22 nt, Homo sapiens
uugaaguagaaagacgaaauuu

SEQ ID NO: 362368 - RNA, 22 nt, Homo sapiens
uugaauagcauguuuagugcau

SEQ ID NO: 362369 - RNA, 22 nt, Homo sapiens
uugaaugaaaugaugucauuug

SEQ ID NO: 362370 - RNA, 18 nt, Homo sapiens
uugaaugcgucccagaga

SEQ ID NO: 362371 - RNA, 22 nt, Homo sapiens
uugacagagaaaagugugacuu

SEQ ID NO: 362372 - RNA, 22 nt, Homo sapiens
uugacaguugggcagggaaguu

SEQ ID NO: 362373 - RNA, 22 nt, Homo sapiens
uugaccaaagaagagucauugc

SEQ ID NO: 362374 - RNA, 21 nt, Homo sapiens
uugagaagaauuagcucuucc

SEQ ID NO: 362375 - RNA, 21 nt, Homo sapiens
uugagacggagucucacucug

SEQ ID NO: 362376 - RNA, 22 nt, Homo sapiens
uugagaguggaggcuauaucuu

SEQ ID NO: 362377 - RNA, 22 nt, Homo sapiens
uugagauagggucuaccucugu

SEQ ID NO: 362378 - RNA, 20 nt, Homo sapiens
uugagaucuguaucugguuu

SEQ ID NO: 362379 - RNA, 22 nt, Homo sapiens
uugagauggagccucacucugc

SEQ ID NO: 362380 - RNA, 22 nt, Homo sapiens
uugagauggagucucacuccuu

SEQ ID NO: 362381 - RNA, 22 nt, Homo sapiens
uugagauggagucucacucuug

SEQ ID NO: 362382 - RNA, 22 nt, Homo sapiens
uucaauaugucauuggcaggca

SEQ ID NO: 362383 - RNA, 22 nt, Homo sapiens
uucacaauuaaaugugguuauu

SEQ ID NO: 362384 - RNA, 22 nt, Homo sapiens
uucacagagagaacucaaacca

SEQ ID NO: 362385 - RNA, 22 nt, Homo sapiens
uucacagaguuauuuuuaugcu

SEQ ID NO: 362386 - RNA, 22 nt, Homo sapiens
uucacaguguuucucacgguua

SEQ ID NO: 362387 - RNA, 22 nt, Homo sapiens
uucaccuguagcaugcccuugg

SEQ ID NO: 362388 - RNA, 22 nt, Homo sapiens
uucaccuugcccacagcagucu

SEQ ID NO: 362389 - RNA, 22 nt, Homo sapiens
uucacugcacuccagccugagc

SEQ ID NO: 362390 - RNA, 22 nt, Homo sapiens
uucacugcacuccagccugggu

SEQ ID NO: 362391 - RNA, 22 nt, Homo sapiens
uucacuguaaaaugaagagggu

SEQ ID NO: 362392 - RNA, 22 nt, Homo sapiens
uucagagcauugguuuuuugaa

SEQ ID NO: 362393 - RNA, 22 nt, Homo sapiens
uucagcaaugacagccuauaua

SEQ ID NO: 362394 - RNA, 22 nt, Homo sapiens
uucagcuacuuggaaacagcaa

SEQ ID NO: 362395 - RNA, 22 nt, Homo sapiens
uucaggcuccgugccagcuccg

SEQ ID NO: 362396 - RNA, 22 nt, Homo sapiens
uucagggcauuggaguuucuga

SEQ ID NO: 362397 - RNA, 22 nt, Homo sapiens
uucagguacugggggaguaugg

SEQ ID NO: 362398 - RNA, 22 nt, Homo sapiens
uucagguaguuuaacuguucca

SEQ ID NO: 362399 - RNA, 22 nt, Homo sapiens
uucagugccuggaagucgugcu

SEQ ID NO: 362400 - RNA, 22 nt, Homo sapiens
uucaguggacuuaguagugcuu

SEQ ID NO: 362401 - RNA, 21 nt, Homo sapiens
uucauaaggcuucucuccugu

SEQ ID NO: 362402 - RNA, 19 nt, Homo sapiens
uucauacagugagagcagc

SEQ ID NO: 362403 - RNA, 22 nt, Homo sapiens
uucauagugaaaaauucaaagu

SEQ ID NO: 362404 - RNA, 22 nt, Homo sapiens
uucauaguguuuccuuccagug

SEQ ID NO: 362405 - RNA, 23 nt, Homo sapiens
uucaucagggauauuggccugaa

SEQ ID NO: 362406 - RNA, 22 nt, Homo sapiens
uucaucagggguauuggccaau

SEQ ID NO: 362407 - RNA, 21 nt, Homo sapiens
uucaucuggccguauuccagg

SEQ ID NO: 362408 - RNA, 22 nt, Homo sapiens
uucauggaguugagaaggcuaa

SEQ ID NO: 362409 - RNA, 22 nt, Homo sapiens
uucauguaauuccauaagguaa

SEQ ID NO: 362410 - RNA, 22 nt, Homo sapiens
uucaugucuuggcuguuagagu

SEQ ID NO: 362411 - RNA, 22 nt, Homo sapiens
uuccaagugggaaacaaaaaug

SEQ ID NO: 362412 - RNA, 22 nt, Homo sapiens
uuccaauguuccguguugcagu

SEQ ID NO: 362413 - RNA, 22 nt, Homo sapiens
uuccacaauggcugaacuaguu

SEQ ID NO: 362414 - RNA, 22 nt, Homo sapiens
uuccacaaugguugaacuagcu

SEQ ID NO: 362415 - RNA, 22 nt, Homo sapiens
uuccacagggauuugcauugau

SEQ ID NO: 362416 - RNA, 22 nt, Homo sapiens
uuccacaggguugaacuaguuu

SEQ ID NO: 362417 - RNA, 22 nt, Homo sapiens
uuccacuuuuuccuugugcucc

SEQ ID NO: 362418 - RNA, 22 nt, Homo sapiens
uuccagagucaccuuucugucg

SEQ ID NO: 362419 - RNA, 22 nt, Homo sapiens
uucccagagagggacuucuaau

SEQ ID NO: 362420 - RNA, 22 nt, Homo sapiens
uucccagugguuagcucugguc

SEQ ID NO: 362421 - RNA, 22 nt, Homo sapiens
uucccgggguggaaugcaguga

SEQ ID NO: 362422 - RNA, 22 nt, Homo sapiens
uucccugagcaucuguugagcc

SEQ ID NO: 362423 - RNA, 22 nt, Homo sapiens
uucccugaguaucuuaccaugg

SEQ ID NO: 362424 - RNA, 22 nt, Homo sapiens
uucccugugggaguaggaaagu

SEQ ID NO: 362425 - RNA, 22 nt, Homo sapiens
uucccugugugcagaugggugu

SEQ ID NO: 362426 - RNA, 22 nt, Homo sapiens
uucccuuucuuaaagaguuagg

SEQ ID NO: 362427 - RNA, 22 nt, Homo sapiens
uucccuuugaauuggaaaggug

SEQ ID NO: 362428 - RNA, 22 nt, Homo sapiens
uucccuuugugcauaggauuug

SEQ ID NO: 362429 - RNA, 22 nt, Homo sapiens
uucccuuuguuaaauuggaaga

SEQ ID NO: 362430 - RNA, 22 nt, Homo sapiens
uuccuacuguucaucaggaacc

SEQ ID NO: 362431 - RNA, 22 nt, Homo sapiens
uuccugagccuuguaucuagua

SEQ ID NO: 362432 - RNA, 22 nt, Homo sapiens
uuccuugagucuuuuuccugag

SEQ ID NO: 362433 - RNA, 22 nt, Homo sapiens
uucguuuguaauccuuacagca

SEQ ID NO: 362434 - RNA, 22 nt, Homo sapiens
uucuaguacucccuggagcugg

SEQ ID NO: 362435 - RNA, 20 nt, Homo sapiens
uucuauggugaugaguccug

SEQ ID NO: 362436 - RNA, 22 nt, Homo sapiens
uucuaugguuuaauaguuuggg

SEQ ID NO: 362437 - RNA, 22 nt, Homo sapiens
uucucagugcuaucuuuuaugc

SEQ ID NO: 362438 - RNA, 22 nt, Homo sapiens
uucucaguucgguggcagugcu

SEQ ID NO: 362439 - RNA, 22 nt, Homo sapiens
uucuccugguggacccuaaacg

SEQ ID NO: 362440 - RNA, 22 nt, Homo sapiens
uucucuaguuacuuuaauggag

SEQ ID NO: 362441 - RNA, 22 nt, Homo sapiens
uucugcuugaucuaguguguug

SEQ ID NO: 362442 - RNA, 22 nt, Homo sapiens
uucuggaaaucagcagagggug

SEQ ID NO: 362443 - RNA, 22 nt, Homo sapiens
uucuggccccucccaaucucau

SEQ ID NO: 362444 - RNA, 22 nt, Homo sapiens
uucuggcucaggucaacacuuc

SEQ ID NO: 362445 - RNA, 22 nt, Homo sapiens
uucuggcuuauaaacgugacuu

SEQ ID NO: 362446 - RNA, 22 nt, Homo sapiens
uucuggcuuuuaaagaaauguu

SEQ ID NO: 362447 - RNA, 22 nt, Homo sapiens
uucuguguuuaggucacggcua

SEQ ID NO: 362448 - RNA, 22 nt, Homo sapiens
aucaggcacacauuggaguuug

SEQ ID NO: 362449 - RNA, 22 nt, Homo sapiens
ucagauacuggugacaugaaug

SEQ ID NO: 362450 - RNA, 22 nt, Homo sapiens
ucagaucauuaagguagguuua

SEQ ID NO: 362451 - RNA, 22 nt, Homo sapiens
ucagaugaugucccuguucuaa

SEQ ID NO: 362452 - RNA, 22 nt, Homo sapiens
ucagaugauuccguugacgaga

SEQ ID NO: 362453 - RNA, 22 nt, Homo sapiens
ucagaugauucuguuguugugu

SEQ ID NO: 362454 - RNA, 22 nt, Homo sapiens
ucagauguuugagaaguauacu

SEQ ID NO: 362455 - RNA, 22 nt, Homo sapiens
ucagauguuuuguuuaucugcu

SEQ ID NO: 362456 - RNA, 22 nt, Homo sapiens
ucagcacauucaaggccugccu

SEQ ID NO: 362457 - RNA, 19 nt, Homo sapiens
ucagcaguaaucaacuuca

SEQ ID NO: 362458 - RNA, 22 nt, Homo sapiens
ucaggcaugcagcaaugcagug

SEQ ID NO: 362459 - RNA, 20 nt, Homo sapiens
ucagguagggcuucaacauu

SEQ ID NO: 362460 - RNA, 22 nt, Homo sapiens
ucagguaucuucauagcaaugc

SEQ ID NO: 362461 - RNA, 22 nt, Homo sapiens
ucagguccuuacugugcucccu

SEQ ID NO: 362462 - RNA, 22 nt, Homo sapiens
ucagguugcuaaguauaauauu

SEQ ID NO: 362463 - RNA, 22 nt, Homo sapiens
ucaguagcaugaaaacagacua

SEQ ID NO: 362464 - RNA, 22 nt, Homo sapiens
ucaguagcauugcuuauacagu

SEQ ID NO: 362465 - RNA, 18 nt, Homo sapiens
ucagucacugccuggcuu

SEQ ID NO: 362466 - RNA, 22 nt, Homo sapiens
ucagugauugguuauuuuaggc

SEQ ID NO: 362467 - RNA, 20 nt, Homo sapiens
ucagugcagauuguccaagu

SEQ ID NO: 362468 - RNA, 22 nt, Homo sapiens
ucagugcaggaaucucuagcca

SEQ ID NO: 362469 - RNA, 22 nt, Homo sapiens
ucagugcuguaccaucuaagga

SEQ ID NO: 362470 - RNA, 22 nt, Homo sapiens
ucagugcuguuugcccucguuu

SEQ ID NO: 362471 - RNA, 22 nt, Homo sapiens
ucaguggacuuagucuuucccc

SEQ ID NO: 362472 - RNA, 22 nt, Homo sapiens
ucaguucauggaggugucugcu

SEQ ID NO: 362473 - RNA, 21 nt, Homo sapiens
ucauaagcucaacaucuguag

SEQ ID NO: 362474 - RNA, 20 nt, Homo sapiens
ucauacuguggaguaccagg

SEQ ID NO: 362475 - RNA, 22 nt, Homo sapiens
ucauacuguuaaaugguuuagu

SEQ ID NO: 362476 - RNA, 22 nt, Homo sapiens
ucauauguaugugcaauuuugu

SEQ ID NO: 362477 - RNA, 22 nt, Homo sapiens
ucauaugucauaguaugaucuu

SEQ ID NO: 362478 - RNA, 23 nt, Homo sapiens
ucaucacagcauuuccugguauu

SEQ ID NO: 362479 - RNA, 22 nt, Homo sapiens
ucaucagaaucccuuagggaug

SEQ ID NO: 362480 - RNA, 22 nt, Homo sapiens
ucaucagaguuuacaagcucag

SEQ ID NO: 362481 - RNA, 22 nt, Homo sapiens
ucaucagguaugucagcggagu

SEQ ID NO: 362482 - RNA, 22 nt, Homo sapiens
ucaugacacuggcaggagcuaa

SEQ ID NO: 362483 - RNA, 22 nt, Homo sapiens
ucaugcaaugagucaggaggca

SEQ ID NO: 362484 - RNA, 19 nt, Homo sapiens
ucaugugcauacauuuggg

SEQ ID NO: 362485 - RNA, 22 nt, Homo sapiens
ucauguguugcacugaggaccu

SEQ ID NO: 362486 - RNA, 22 nt, Homo sapiens
ucauucacucccuugaaguuag

SEQ ID NO: 362487 - RNA, 22 nt, Homo sapiens
ucauucauuugcucacuccaca

SEQ ID NO: 362488 - RNA, 22 nt, Homo sapiens
ucauuggcuaagcuuguuacac

SEQ ID NO: 362489 - RNA, 22 nt, Homo sapiens
uccaagaugcuggcagcuacag

SEQ ID NO: 362490 - RNA, 22 nt, Homo sapiens
uccacagugguugaacuaguaa

SEQ ID NO: 362491 - RNA, 19 nt, Homo sapiens
uccaccgcgugcaccucua

SEQ ID NO: 362492 - RNA, 22 nt, Homo sapiens
uccacugagcuagaccacuugg

SEQ ID NO: 362493 - RNA, 22 nt, Homo sapiens
uccacuuuugugcugaauugga

SEQ ID NO: 362494 - RNA, 22 nt, Homo sapiens
uccagguacucagggggcugag

SEQ ID NO: 362495 - RNA, 22 nt, Homo sapiens
uccaguguuauaauaugcgucu

SEQ ID NO: 362496 - RNA, 22 nt, Homo sapiens
uccaugagaauaguuaggcucu

SEQ ID NO: 362497 - RNA, 22 nt, Homo sapiens
uccaugugaaaaggucgugaua

SEQ ID NO: 362498 - RNA, 22 nt, Homo sapiens
uccauugucuagauguaacaca

SEQ ID NO: 362499 - RNA, 22 nt, Homo sapiens
uccauuuguagguagugagaca

SEQ ID NO: 362500 - RNA, 23 nt, Homo sapiens
ucccaagauggaccagaccaagg

SEQ ID NO: 362501 - RNA, 22 nt, Homo sapiens
ucccagugcuaugcaaaagccu

SEQ ID NO: 362502 - RNA, 22 nt, Homo sapiens
ucccaguggucuugaaacaggg

SEQ ID NO: 362503 - RNA, 22 nt, Homo sapiens
ucccaguuuuucugaauaguca

SEQ ID NO: 362504 - RNA, 22 nt, Homo sapiens
uccccgucacacgcaggcuuac

SEQ ID NO: 362505 - RNA, 22 nt, Homo sapiens
uccccugagucaccugcuucuc

SEQ ID NO: 362506 - RNA, 22 nt, Homo sapiens
uccccuuuguaagauggaaacg

SEQ ID NO: 362507 - RNA, 22 nt, Homo sapiens
ucccuacugggguacugccuag

SEQ ID NO: 362508 - RNA, 22 nt, Homo sapiens
ucccuagacuccugccuuucag

SEQ ID NO: 362509 - RNA, 22 nt, Homo sapiens
ucccugaaaauuagcauuuuaa

SEQ ID NO: 362510 - RNA, 22 nt, Homo sapiens
ucccugaagcugcagcaacaca

SEQ ID NO: 362511 - RNA, 22 nt, Homo sapiens
ucccugagcaaaguuuucugua

SEQ ID NO: 362512 - RNA, 22 nt, Homo sapiens
ucccugagguccuggauuauug

SEQ ID NO: 362513 - RNA, 16 nt, Homo sapiens
ucccugugacaugugc

SEQ ID NO: 362514 - RNA, 22 nt, Homo sapiens
ucccuguguccugggggcaccu

SEQ ID NO: 362515 - RNA, 22 nt, Homo sapiens
uccucaguggauuggauggugc

SEQ ID NO: 362516 - RNA, 22 nt, Homo sapiens
uccugcauucauccugguguug

SEQ ID NO: 362517 - RNA, 22 nt, Homo sapiens
uccuggcuccacuguuuauucc

SEQ ID NO: 362518 - RNA, 22 nt, Homo sapiens
uccuugagaggacagagccaua

SEQ ID NO: 362519 - RNA, 22 nt, Homo sapiens
uccuugagucuuugcucagaug

SEQ ID NO: 362520 - RNA, 22 nt, Homo sapiens
uccuuggucauggaagagacag

SEQ ID NO: 362521 - RNA, 23 nt, Homo sapiens
ucgguccccuuggcugcccucgg

SEQ ID NO: 362522 - RNA, 22 nt, Homo sapiens
ucguucuugucaguuuauaaag

SEQ ID NO: 362523 - RNA, 22 nt, Homo sapiens
ucuaagaauucauuuauaagcc

SEQ ID NO: 362524 - RNA, 17 nt, Homo sapiens
ucuaauaauaugcauuu

SEQ ID NO: 362525 - RNA, 22 nt, Homo sapiens
ucuaauguaaccugcaaauauu

SEQ ID NO: 362526 - RNA, 22 nt, Homo sapiens
ucuagccuaugaagcuugucca

SEQ ID NO: 362527 - RNA, 22 nt, Homo sapiens
ucuauggauaaaaugcccucau

SEQ ID NO: 362528 - RNA, 22 nt, Homo sapiens
ucucaaguggucgcaguuagau

SEQ ID NO: 362529 - RNA, 22 nt, Homo sapiens
ucucaauggguuguagacaaag

SEQ ID NO: 362530 - RNA, 22 nt, Homo sapiens
ucucacaccccucucauauacc

SEQ ID NO: 362531 - RNA, 18 nt, Homo sapiens
ucucacagcaaucuguca

SEQ ID NO: 362532 - RNA, 22 nt, Homo sapiens
ucucacaggguuauugaggggg

SEQ ID NO: 362533 - RNA, 22 nt, Homo sapiens
ucucagagccuaggguuuuuca

SEQ ID NO: 362534 - RNA, 22 nt, Homo sapiens
acugcacucuagcuugggugac

SEQ ID NO: 362535 - RNA, 20 nt, Homo sapiens
acugcauuuaguccucagga

SEQ ID NO: 362536 - RNA, 22 nt, Homo sapiens
acuggacuuaaugaugaauugu

SEQ ID NO: 362537 - RNA, 22 nt, Homo sapiens
acuggcuuauuucacuuagcau

SEQ ID NO: 362538 - RNA, 22 nt, Homo sapiens
acuggcuuuugagaaaaacacu

SEQ ID NO: 362539 - RNA, 22 nt, Homo sapiens
acugguuguuuaacugaauuga

SEQ ID NO: 362540 - RNA, 21 nt, Homo sapiens
acuuucuguggcaguccauuc

SEQ ID NO: 362541 - RNA, 22 nt, Homo sapiens
acuuuguguuacccagcaagga

SEQ ID NO: 362542 - RNA, 22 nt, Homo sapiens
acuuuguuauggcaacccuaag

SEQ ID NO: 362543 - RNA, 22 nt, Homo sapiens
acuuuuguuauacagugugaua

SEQ ID NO: 362544 - RNA, 22 nt, Homo sapiens
agaaagugcuucccuuugguga

SEQ ID NO: 362545 - RNA, 23 nt, Homo sapiens
agaaaugucuauucagggucccu

SEQ ID NO: 362546 - RNA, 22 nt, Homo sapiens
agaagaacauagggugacugaa

SEQ ID NO: 362547 - RNA, 20 nt, Homo sapiens
agaagcauugcucucuucag

SEQ ID NO: 362548 - RNA, 22 nt, Homo sapiens
agaaugugaacaucuugaaagu

SEQ ID NO: 362549 - RNA, 22 nt, Homo sapiens
agacacuguugaaaaggcccca

SEQ ID NO: 362550 - RNA, 22 nt, Homo sapiens
agacagcugguagcacuuccug

SEQ ID NO: 362551 - RNA, 22 nt, Homo sapiens
agacaguauuggcaaagugugu

SEQ ID NO: 362552 - RNA, 22 nt, Homo sapiens
agacaguguguguauauauggu

SEQ ID NO: 362553 - RNA, 22 nt, Homo sapiens
agacccuguauguguuuaguuu

SEQ ID NO: 362554 - RNA, 22 nt, Homo sapiens
agagagguggguggagccccca

SEQ ID NO: 362555 - RNA, 22 nt, Homo sapiens
agagauacauucugagaagugc

SEQ ID NO: 362556 - RNA, 22 nt, Homo sapiens
agagauaguuuccaacucauac

SEQ ID NO: 362557 - RNA, 22 nt, Homo sapiens
agagccacacucuccuaacuca

SEQ ID NO: 362558 - RNA, 22 nt, Homo sapiens
agagccacauuaaauaugggaa

SEQ ID NO: 362559 - RNA, 22 nt, Homo sapiens
agaggaguacuacuccaagucu

SEQ ID NO: 362560 - RNA, 23 nt, Homo sapiens
agagguuuaaucaggcaguugcu

SEQ ID NO: 362561 - RNA, 22 nt, Homo sapiens
agagguuuuggggcugagagcu

SEQ ID NO: 362562 - RNA, 22 nt, Homo sapiens
agaguaguuuauuaugcuaagg

SEQ ID NO: 362563 - RNA, 20 nt, Homo sapiens
agagugcugucuguccugag

SEQ ID NO: 362564 - RNA, 22 nt, Homo sapiens
agauaugucugcuauuugcugu

SEQ ID NO: 362565 - RNA, 22 nt, Homo sapiens
agaugguguuuucucaccagau

SEQ ID NO: 362566 - RNA, 22 nt, Homo sapiens
agaugguuuuguucacagcucu

SEQ ID NO: 362567 - RNA, 22 nt, Homo sapiens
agcaaaucuaugaauguauauu

SEQ ID NO: 362568 - RNA, 23 nt, Homo sapiens
agcaaaugcucuagcacuccaac

SEQ ID NO: 362569 - RNA, 22 nt, Homo sapiens
agcaacauugagacugcaguug

SEQ ID NO: 362570 - RNA, 22 nt, Homo sapiens
agcaagaugaaguugagcuagg

SEQ ID NO: 362571 - RNA, 22 nt, Homo sapiens
agcacgaaaccaaauucuguga

SEQ ID NO: 362572 - RNA, 22 nt, Homo sapiens
agcagcaccaaacagacuaaga

SEQ ID NO: 362573 - RNA, 17 nt, Homo sapiens
agcagcccauaucccca

SEQ ID NO: 362574 - RNA, 22 nt, Homo sapiens
agcagcuuugaucugaaugauu

SEQ ID NO: 362575 - RNA, 22 nt, Homo sapiens
agcagguguggcuuauccugaa

SEQ ID NO: 362576 - RNA, 22 nt, Homo sapiens
agcaucacaugggcugcuuggg

SEQ ID NO: 362577 - RNA, 18 nt, Homo sapiens
agcaucacugaucauccu

SEQ ID NO: 362578 - RNA, 22 nt, Homo sapiens
agcaucauguuuucgagguuca

SEQ ID NO: 362579 - RNA, 20 nt, Homo sapiens
agcaucauugcaauuuguca

SEQ ID NO: 362580 - RNA, 22 nt, Homo sapiens
agcccauguggcugaggcuucu

SEQ ID NO: 362581 - RNA, 22 nt, Homo sapiens
agccuagagagccacuuugaga

SEQ ID NO: 362582 - RNA, 22 nt, Homo sapiens
agcggcuguuccccuggucuau

SEQ ID NO: 362583 - RNA, 22 nt, Homo sapiens
agcgguguuaggaaggugaggg

SEQ ID NO: 362584 - RNA, 21 nt, Homo sapiens
agcuccacucguucccaaagc

SEQ ID NO: 362585 - RNA, 22 nt, Homo sapiens
agcuccaucuucagggguucag

SEQ ID NO: 362586 - RNA, 22 nt, Homo sapiens
agcuccuuucugcaggcagguc

SEQ ID NO: 362587 - RNA, 22 nt, Homo sapiens
agcucuuguuaguauuagcagu

SEQ ID NO: 362588 - RNA, 22 nt, Homo sapiens
agcugaguguuccaagagcgag

SEQ ID NO: 362589 - RNA, 22 nt, Homo sapiens
agcugcaaagggagagaugauu

SEQ ID NO: 362590 - RNA, 22 nt, Homo sapiens
agcugcacugguauaggagaaa

SEQ ID NO: 362591 - RNA, 22 nt, Homo sapiens
agcugcauucguaucauauugu

SEQ ID NO: 362592 - RNA, 22 nt, Homo sapiens
agcugcauuuacuuuugcacaa

SEQ ID NO: 362593 - RNA, 22 nt, Homo sapiens
agcuggauguauguuaagugaa

SEQ ID NO: 362594 - RNA, 22 nt, Homo sapiens
agcuggauguggaugacccugu

SEQ ID NO: 362595 - RNA, 22 nt, Homo sapiens
agcuggcuguagcugcaagucu

SEQ ID NO: 362596 - RNA, 22 nt, Homo sapiens
agcuggcuguggagaaaccccu

SEQ ID NO: 362597 - RNA, 22 nt, Homo sapiens
agcuucauuguuaugaauguca

SEQ ID NO: 362598 - RNA, 22 nt, Homo sapiens
agcuuguuuucccauaacuaga

SEQ ID NO: 362599 - RNA, 22 nt, Homo sapiens
agcuuuuugggaggccuuagga

SEQ ID NO: 362600 - RNA, 22 nt, Homo sapiens
agcuuuuugggcagcuauugac

SEQ ID NO: 362601 - RNA, 18 nt, Homo sapiens
aggaaugguaauacuuca

SEQ ID NO: 362602 - RNA, 22 nt, Homo sapiens
aggaauuuaauguaugauaaua

SEQ ID NO: 362603 - RNA, 20 nt, Homo sapiens
aggagcauuuacauuggcuc

SEQ ID NO: 362604 - RNA, 23 nt, Homo sapiens
aggagcuuagaaguugccauugc

SEQ ID NO: 362605 - RNA, 22 nt, Homo sapiens
aggagguagucugucccuuagc

SEQ ID NO: 362606 - RNA, 22 nt, Homo sapiens
aggagguugguaccaucuguuu

SEQ ID NO: 362607 - RNA, 22 nt, Homo sapiens
aggauaguaaugauagagaggc

SEQ ID NO: 362608 - RNA, 22 nt, Homo sapiens
aggcaaguugcucaaaugcaaa

SEQ ID NO: 362609 - RNA, 22 nt, Homo sapiens
aggcacggugucucaugccugu

SEQ ID NO: 362610 - RNA, 22 nt, Homo sapiens
aggcagaugagguccucagcug

SEQ ID NO: 362611 - RNA, 22 nt, Homo sapiens
aggcagucucugccggcugagg

SEQ ID NO: 362612 - RNA, 22 nt, Homo sapiens
aggcaugauggcuccagaucau

SEQ ID NO: 362613 - RNA, 22 nt, Homo sapiens
aggcauguggcucuguucugac

SEQ ID NO: 362614 - RNA, 19 nt, Homo sapiens
aggcauugugcucaucugu

SEQ ID NO: 362615 - RNA, 22 nt, Homo sapiens
aggccaguuuuuggagggaaac

SEQ ID NO: 362616 - RNA, 22 nt, Homo sapiens
aggcuuuuggagaacacugcac

SEQ ID NO: 362617 - RNA, 22 nt, Homo sapiens
agguaaacauggggacugcuac

SEQ ID NO: 362618 - RNA, 22 nt, Homo sapiens
agguagguugagaugggcauca

SEQ ID NO: 362619 - RNA, 22 nt, Homo sapiens
agguauguaugucuguacagcg

SEQ ID NO: 362620 - RNA, 22 nt, Homo sapiens
agguauuuucaacuuagaaugg

SEQ ID NO: 362621 - RNA, 22 nt, Homo sapiens
uacagguaugugucuauauaca

SEQ ID NO: 362622 - RNA, 22 nt, Homo sapiens
uacaguagaaugucuuucaaaa

SEQ ID NO: 362623 - RNA, 22 nt, Homo sapiens
uacagucacauuccugaccaua

SEQ ID NO: 362624 - RNA, 22 nt, Homo sapiens
uacagugcuuuuugguggagaa

SEQ ID NO: 362625 - RNA, 22 nt, Homo sapiens
uacaguguuuugguauuccaca

SEQ ID NO: 362626 - RNA, 22 nt, Homo sapiens
uacauacuguaugguucuguuu

SEQ ID NO: 362627 - RNA, 22 nt, Homo sapiens
uacauaguuacuuccauuucca

SEQ ID NO: 362628 - RNA, 19 nt, Homo sapiens
uacaugcagcaggcacgca

SEQ ID NO: 362629 - RNA, 22 nt, Homo sapiens
uacauguauccauuguuuuugg

SEQ ID NO: 362630 - RNA, 22 nt, Homo sapiens
uacaugugcaggucuguggggg

SEQ ID NO: 362631 - RNA, 22 nt, Homo sapiens
uaccaaguauuuucacaugaac

SEQ ID NO: 362632 - RNA, 22 nt, Homo sapiens
uaccacaggcuggguaaucuau

SEQ ID NO: 362633 - RNA, 22 nt, Homo sapiens
uaccacagucauuacacuugua

SEQ ID NO: 362634 - RNA, 22 nt, Homo sapiens
uacccugaaggaaaguauguuu

SEQ ID NO: 362635 - RNA, 22 nt, Homo sapiens
uacucaauugcagucaccuggc

SEQ ID NO: 362636 - RNA, 22 nt, Homo sapiens
uacucacauucuguuucuugcu

SEQ ID NO: 362637 - RNA, 22 nt, Homo sapiens
uacucugcagagaugcauaaca

SEQ ID NO: 362638 - RNA, 22 nt, Homo sapiens
uacucugcaguaauuccagccc

SEQ ID NO: 362639 - RNA, 19 nt, Homo sapiens
uacugcacuccagucuggg

SEQ ID NO: 362640 - RNA, 22 nt, Homo sapiens
uacugcaucgaaaugcuuuuau

SEQ ID NO: 362641 - RNA, 22 nt, Homo sapiens
uacugcugucagugccaaguag

SEQ ID NO: 362642 - RNA, 22 nt, Homo sapiens
uagaaagcaugaccuucagaua

SEQ ID NO: 362643 - RNA, 20 nt, Homo sapiens
uagaaaguagaguggugguu

SEQ ID NO: 362644 - RNA, 22 nt, Homo sapiens
uagaagcuacucuucuuguggc

SEQ ID NO: 362645 - RNA, 22 nt, Homo sapiens
uagaauguaacaguuaaaagca

SEQ ID NO: 362646 - RNA, 22 nt, Homo sapiens
uagaauguaacuuccaugucau

SEQ ID NO: 362647 - RNA, 23 nt, Homo sapiens
uagaauguuuuuccauguuucuu

SEQ ID NO: 362648 - RNA, 22 nt, Homo sapiens
uagacccauuacguaguuucca

SEQ ID NO: 362649 - RNA, 22 nt, Homo sapiens
uagagagcuguuugaaagcagg

SEQ ID NO: 362650 - RNA, 22 nt, Homo sapiens
uagagcaaugacucuggaaacc

SEQ ID NO: 362651 - RNA, 22 nt, Homo sapiens
uagagguucuaagauucucaga

SEQ ID NO: 362652 - RNA, 19 nt, Homo sapiens
uagagguuuaagaaaagaa

SEQ ID NO: 362653 - RNA, 22 nt, Homo sapiens
uagauaguaaagccauuagcuu

SEQ ID NO: 362654 - RNA, 22 nt, Homo sapiens
uagaucauauacuugccaugac

SEQ ID NO: 362655 - RNA, 21 nt, Homo sapiens
uagaugguguucuagagagaa

SEQ ID NO: 362656 - RNA, 22 nt, Homo sapiens
uagcaaaucaauggaauugaag

SEQ ID NO: 362657 - RNA, 21 nt, Homo sapiens
uagcaaauugcuauuaaggca

SEQ ID NO: 362658 - RNA, 23 nt, Homo sapiens
uagcaacaguuggaggugaggua

SEQ ID NO: 362659 - RNA, 22 nt, Homo sapiens
uagcaagaugaauuugugcaaa

SEQ ID NO: 362660 - RNA, 20 nt, Homo sapiens
uagcacacauguagaauagu

SEQ ID NO: 362661 - RNA, 22 nt, Homo sapiens
uagcacaugucagguaauuugc

SEQ ID NO: 362662 - RNA, 22 nt, Homo sapiens
uagcaccacaaucaagauacag

SEQ ID NO: 362663 - RNA, 18 nt, Homo sapiens
uagcagacaucauugggg

SEQ ID NO: 362664 - RNA, 22 nt, Homo sapiens
uagcagcaaagcaggaucugcu

SEQ ID NO: 362665 - RNA, 22 nt, Homo sapiens
uagcagcaccccacucuacugg

SEQ ID NO: 362666 - RNA, 22 nt, Homo sapiens
uagcagcaucucuggcuucuac

SEQ ID NO: 362667 - RNA, 22 nt, Homo sapiens
uagcaguagacagacuuuggcu

SEQ ID NO: 362668 - RNA, 22 nt, Homo sapiens
uagcaguauaugagagcuauug

SEQ ID NO: 362669 - RNA, 22 nt, Homo sapiens
uagcagucaagauagucauuau

SEQ ID NO: 362670 - RNA, 22 nt, Homo sapiens
uagcauggaggcggccauagug

SEQ ID NO: 362671 - RNA, 22 nt, Homo sapiens
uagcaugucagucgccacacgu

SEQ ID NO: 362672 - RNA, 21 nt, Homo sapiens
uagcugcacccaggccuccuu

SEQ ID NO: 362673 - RNA, 22 nt, Homo sapiens
uagcugcugcuaggcuaaggau

SEQ ID NO: 362674 - RNA, 17 nt, Homo sapiens
uagcuucacauuaggaa

SEQ ID NO: 362675 - RNA, 23 nt, Homo sapiens
uagcuucucccagaccugcuccc

SEQ ID NO: 362676 - RNA, 22 nt, Homo sapiens
uaggaaguacaucucagaaucu

SEQ ID NO: 362677 - RNA, 22 nt, Homo sapiens
uaggaaugaacgauuuauuggu

SEQ ID NO: 362678 - RNA, 19 nt, Homo sapiens
uaggacccugguggccccc

SEQ ID NO: 362679 - RNA, 22 nt, Homo sapiens
uaggcuuuucugggaugugggc

SEQ ID NO: 362680 - RNA, 22 nt, Homo sapiens
uagggaguuuuggggugcagaa

SEQ ID NO: 362681 - RNA, 22 nt, Homo sapiens
uagguacuuaagaucucagcua

SEQ ID NO: 362682 - RNA, 22 nt, Homo sapiens
uagguagaaucuugaagccauu

SEQ ID NO: 362683 - RNA, 22 nt, Homo sapiens
uaggugcacaguaaauauaugu

SEQ ID NO: 362684 - RNA, 22 nt, Homo sapiens
uagguugucucuucacucugau

SEQ ID NO: 362685 - RNA, 22 nt, Homo sapiens
uaguaaacauuuuucuaucauu

SEQ ID NO: 362686 - RNA, 22 nt, Homo sapiens
uaguaucacauggucuuaauua

SEQ ID NO: 362687 - RNA, 22 nt, Homo sapiens
uaguccauuuucaugcugcuau

SEQ ID NO: 362688 - RNA, 22 nt, Homo sapiens
uagugcugagauugagaagccc

SEQ ID NO: 362689 - RNA, 22 nt, Homo sapiens
uagugcugugauaaacauauau

SEQ ID NO: 362690 - RNA, 18 nt, Homo sapiens
uagugcuguucucaugau

SEQ ID NO: 362691 - RNA, 20 nt, Homo sapiens
uaguggcaugcaccuguagc

SEQ ID NO: 362692 - RNA, 22 nt, Homo sapiens
uaguuguugcagguaggaugua

SEQ ID NO: 362693 - RNA, 22 nt, Homo sapiens
uaguuuaucuucuggauggaca

SEQ ID NO: 362694 - RNA, 22 nt, Homo sapiens
uauaaaguaauuucuaggggcu

SEQ ID NO: 362695 - RNA, 22 nt, Homo sapiens
uauaacacccacauauagucuu

SEQ ID NO: 362696 - RNA, 22 nt, Homo sapiens
uauagcagugaguauugacuaa

SEQ ID NO: 362697 - RNA, 22 nt, Homo sapiens
uauagcaguguaagaaucgagu

SEQ ID NO: 362698 - RNA, 22 nt, Homo sapiens
uauaggacuugguguaguuucu

SEQ ID NO: 362699 - RNA, 21 nt, Homo sapiens
uauaguaguaugauuuacaau

SEQ ID NO: 362700 - RNA, 22 nt, Homo sapiens
uauaugucuuuguuauguugag

SEQ ID NO: 362701 - RNA, 23 nt, Homo sapiens
uauaugugucuaggagcuauggu

SEQ ID NO: 362702 - RNA, 22 nt, Homo sapiens
uauauguuuucauaaggcuaga

SEQ ID NO: 362703 - RNA, 22 nt, Homo sapiens
uaucaacaggguggccagugua

SEQ ID NO: 362704 - RNA, 22 nt, Homo sapiens
aucacuuugcucuccagugugg

SEQ ID NO: 362705 - RNA, 21 nt, Homo sapiens
aucagagacccaggcuuccuc

SEQ ID NO: 362706 - RNA, 22 nt, Homo sapiens
aucagauguuuguauaggagua

SEQ ID NO: 362707 - RNA, 22 nt, Homo sapiens
uucauaguauuuuucuccaaau

SEQ ID NO: 362708 - RNA, 22 nt, Homo sapiens
uucauaguuuauacugauauuu

SEQ ID NO: 362709 - RNA, 22 nt, Homo sapiens
uucaucaguugagcugguugcu

SEQ ID NO: 362710 - RNA, 22 nt, Homo sapiens
uucauccccuccaaaucucaug

SEQ ID NO: 362711 - RNA, 22 nt, Homo sapiens
uucauggaguuuaaauuguagu

SEQ ID NO: 362712 - RNA, 20 nt, Homo sapiens
uucaugggagcaaagaggcc

SEQ ID NO: 362713 - RNA, 22 nt, Homo sapiens
uucauguaaucaaggcagcuaa

SEQ ID NO: 362714 - RNA, 22 nt, Homo sapiens
uucaugugagucuguauuaacu

SEQ ID NO: 362715 - RNA, 22 nt, Homo sapiens
uucauugaaugauuuuuagaag

SEQ ID NO: 362716 - RNA, 22 nt, Homo sapiens
uuccacaaugguugaacuaauu

SEQ ID NO: 362717 - RNA, 22 nt, Homo sapiens
uuccacaaugguugaacuaguu

SEQ ID NO: 362718 - RNA, 22 nt, Homo sapiens
uuccaugagaugcaucaaagcu

SEQ ID NO: 362719 - RNA, 22 nt, Homo sapiens
uucccagucaaacgaaggacuu

SEQ ID NO: 362720 - RNA, 22 nt, Homo sapiens
uucccaguggaacauguaguca

SEQ ID NO: 362721 - RNA, 22 nt, Homo sapiens
uucccuagaacacauggaggga

SEQ ID NO: 362722 - RNA, 22 nt, Homo sapiens
uucccugaaauauucacuuuca

SEQ ID NO: 362723 - RNA, 22 nt, Homo sapiens
uucccuguaucuucugccaugu

SEQ ID NO: 362724 - RNA, 22 nt, Homo sapiens
uucccuugcaggaugaucugga

SEQ ID NO: 362725 - RNA, 22 nt, Homo sapiens
uucccuuucugccuugaaucuu

SEQ ID NO: 362726 - RNA, 22 nt, Homo sapiens
uucccuuuuuucuaguagguag

SEQ ID NO: 362727 - RNA, 22 nt, Homo sapiens
uuccuacugcccauuaaaaugg

SEQ ID NO: 362728 - RNA, 22 nt, Homo sapiens
uuccucuagacugucgguuucu

SEQ ID NO: 362729 - RNA, 19 nt, Homo sapiens
uuccugagaacaagggcuu

SEQ ID NO: 362730 - RNA, 22 nt, Homo sapiens
uuccugucuuccaagagagauu

SEQ ID NO: 362731 - RNA, 22 nt, Homo sapiens
uuccugugacccccaagcccac

SEQ ID NO: 362732 - RNA, 22 nt, Homo sapiens
uuccugugacuguguggcaccc

SEQ ID NO: 362733 - RNA, 20 nt, Homo sapiens
uuccuuaggcauuggaagaa

SEQ ID NO: 362734 - RNA, 22 nt, Homo sapiens
uuccuugagaaaguacaaggcu

SEQ ID NO: 362735 - RNA, 22 nt, Homo sapiens
uuccuugguucagggaaggucc

SEQ ID NO: 362736 - RNA, 22 nt, Homo sapiens
uuccuuguagcaaaugcgauga

SEQ ID NO: 362737 - RNA, 22 nt, Homo sapiens
uuccuuguuuauuuacaggagg

SEQ ID NO: 362738 - RNA, 22 nt, Homo sapiens
uucuaaacaucuuacaaugcau

SEQ ID NO: 362739 - RNA, 22 nt, Homo sapiens
uucuaaguaauuuugcaugccu

SEQ ID NO: 362740 - RNA, 22 nt, Homo sapiens
uucuagcaauggcagagugucu

SEQ ID NO: 362741 - RNA, 22 nt, Homo sapiens
aaucgcuuuugguaggcaagga

SEQ ID NO: 362742 - RNA, 20 nt, Homo sapiens
aaucuacuugcccauuuagc

SEQ ID NO: 362743 - RNA, 22 nt, Homo sapiens
aaugacagccagauucuucucu

SEQ ID NO: 362744 - RNA, 22 nt, Homo sapiens
aaugacagugcuaaagaacccu

SEQ ID NO: 362745 - RNA, 22 nt, Homo sapiens
aaugauauguuauguuuagguu

SEQ ID NO: 362746 - RNA, 22 nt, Homo sapiens
aaugcaagauguuaauuauagg

SEQ ID NO: 362747 - RNA, 22 nt, Homo sapiens
aaugcacauauauuuccuuauu

SEQ ID NO: 362748 - RNA, 22 nt, Homo sapiens
aaugcuaucuggaacauuguug

SEQ ID NO: 362749 - RNA, 22 nt, Homo sapiens
aauggagcugaguggccuuggg

SEQ ID NO: 362750 - RNA, 22 nt, Homo sapiens
aauggcaaauguuuucuguuga

SEQ ID NO: 362751 - RNA, 22 nt, Homo sapiens
aauggcacaagacaugaagaag

SEQ ID NO: 362752 - RNA, 20 nt, Homo sapiens
aauggcauguuggacaacug

SEQ ID NO: 362753 - RNA, 22 nt, Homo sapiens
aauggcauugguccuuuuggau

SEQ ID NO: 362754 - RNA, 19 nt, Homo sapiens
aauggcuuuuccuguuccc

SEQ ID NO: 362755 - RNA, 22 nt, Homo sapiens
aaugugccuacuggagcuugca

SEQ ID NO: 362756 - RNA, 22 nt, Homo sapiens
aaugugcuguucagaggagucc

SEQ ID NO: 362757 - RNA, 22 nt, Homo sapiens
aauuacauggcaauugggaaau

SEQ ID NO: 362758 - RNA, 22 nt, Homo sapiens
aauucacuuguggcagauccuu

SEQ ID NO: 362759 - RNA, 22 nt, Homo sapiens
aauugaaugauaugggacauuu

SEQ ID NO: 362760 - RNA, 22 nt, Homo sapiens
aauugcaauggacaaugcagca

SEQ ID NO: 362761 - RNA, 22 nt, Homo sapiens
aauugcauaugcaguagaucua

SEQ ID NO: 362762 - RNA, 22 nt, Homo sapiens
aauugcauugaauuuguagcuu

SEQ ID NO: 362763 - RNA, 22 nt, Homo sapiens
aauugcuucuguauuuuggaca

SEQ ID NO: 362764 - RNA, 22 nt, Homo sapiens
aauuguacucccauaauucccu

SEQ ID NO: 362765 - RNA, 22 nt, Homo sapiens
aauuugucaccucucucccuuu

SEQ ID NO: 362766 - RNA, 22 nt, Homo sapiens
acaaagcuagggaauccaucuu

SEQ ID NO: 362767 - RNA, 16 nt, Homo sapiens
acaaagcuggcuaucu

SEQ ID NO: 362768 - RNA, 22 nt, Homo sapiens
acaaaguguuuucugaaggccu

SEQ ID NO: 362769 - RNA, 23 nt, Homo sapiens
acacaguaaacuaaaagcuagcu

SEQ ID NO: 362770 - RNA, 22 nt, Homo sapiens
acacaugcuccacuguggccuc

SEQ ID NO: 362771 - RNA, 22 nt, Homo sapiens
acaccaucuccuuauuucucuu

SEQ ID NO: 362772 - RNA, 22 nt, Homo sapiens
acacuguauccuucuguccuuu

SEQ ID NO: 362773 - RNA, 20 nt, Homo sapiens
acacugugcuaaggauuuuc

SEQ ID NO: 362774 - RNA, 22 nt, Homo sapiens
acacuguuuuaguuauuauagc

SEQ ID NO: 362775 - RNA, 22 nt, Homo sapiens
acacuugcuugcaauagccucc

SEQ ID NO: 362776 - RNA, 22 nt, Homo sapiens
acagaucagagauauuuagguu

SEQ ID NO: 362777 - RNA, 22 nt, Homo sapiens
acaguacaugauaaauaaggua

SEQ ID NO: 362778 - RNA, 19 nt, Homo sapiens
acaguauugugcacagguu

SEQ ID NO: 362779 - RNA, 22 nt, Homo sapiens
acagugacagaaagcugauuau

SEQ ID NO: 362780 - RNA, 18 nt, Homo sapiens
acagugcugucacugcuu

SEQ ID NO: 362781 - RNA, 22 nt, Homo sapiens
acagugcuuggcacacaguaau

SEQ ID NO: 362782 - RNA, 19 nt, Homo sapiens
acagugcuuugucagaagc

SEQ ID NO: 362783 - RNA, 22 nt, Homo sapiens
acagugucaugucguguucccc

SEQ ID NO: 362784 - RNA, 22 nt, Homo sapiens
acaguguuacuugauaguguau

SEQ ID NO: 362785 - RNA, 22 nt, Homo sapiens
acauaaagaagcaggacauugu

SEQ ID NO: 362786 - RNA, 22 nt, Homo sapiens
acaucccaugccuggguacucc

SEQ ID NO: 362787 - RNA, 22 nt, Homo sapiens
acaugacauugggguggggaua

SEQ ID NO: 362788 - RNA, 22 nt, Homo sapiens
acauggcuuaugaauuuggaga

SEQ ID NO: 362789 - RNA, 23 nt, Homo sapiens
acauguauagacuuuuuuuccuu

SEQ ID NO: 362790 - RNA, 22 nt, Homo sapiens
accacagugcuuccugcucacg

SEQ ID NO: 362791 - RNA, 22 nt, Homo sapiens
acccaguaacauaugggaggga

SEQ ID NO: 362792 - RNA, 17 nt, Homo sapiens
accccuaccucagaagc

SEQ ID NO: 362793 - RNA, 20 nt, Homo sapiens
acccucuaggaugauuucuu

SEQ ID NO: 362794 - RNA, 22 nt, Homo sapiens
acccuggaggucuacagugcag

SEQ ID NO: 362795 - RNA, 23 nt, Homo sapiens
ugacagucucccgauggcuaggc

SEQ ID NO: 362796 - RNA, 22 nt, Homo sapiens
ugacaguguccuccuccugaga

SEQ ID NO: 362797 - RNA, 18 nt, Homo sapiens
ugacaguuucuuuauauu

SEQ ID NO: 362798 - RNA, 22 nt, Homo sapiens
ugacaucugcuugugcccagga

SEQ ID NO: 362799 - RNA, 22 nt, Homo sapiens
ugacaugaagucucccucuguu

SEQ ID NO: 362800 - RNA, 22 nt, Homo sapiens
ugacauggugcucuuucaggca

SEQ ID NO: 362801 - RNA, 22 nt, Homo sapiens
ugacauguauuagcucagugcu

SEQ ID NO: 362802 - RNA, 21 nt, Homo sapiens
ugacauguuggugugcugcac

SEQ ID NO: 362803 - RNA, 17 nt, Homo sapiens
ugaccacugauucuacu

SEQ ID NO: 362804 - RNA, 22 nt, Homo sapiens
ugaccacugucuaagauaggug

SEQ ID NO: 362805 - RNA, 22 nt, Homo sapiens
ugacuacaggucaggaagcugu

SEQ ID NO: 362806 - RNA, 22 nt, Homo sapiens
ugacuacauaaguaaucucaaa

SEQ ID NO: 362807 - RNA, 22 nt, Homo sapiens
ugacuagcagagugagaaacuc

SEQ ID NO: 362808 - RNA, 22 nt, Homo sapiens
ugacuagggcucuaaacagcuc

SEQ ID NO: 362809 - RNA, 22 nt, Homo sapiens
ugacucaguuguuagucuucau

SEQ ID NO: 362810 - RNA, 22 nt, Homo sapiens
ugacucgaggcgccuccagucc

SEQ ID NO: 362811 - RNA, 22 nt, Homo sapiens
ugacuuaugcaacucugaugug

SEQ ID NO: 362812 - RNA, 22 nt, Homo sapiens
ugacuugaaacgugaacagauc

SEQ ID NO: 362813 - RNA, 22 nt, Homo sapiens
ugacuugaaguuaccauaugca

SEQ ID NO: 362814 - RNA, 21 nt, Homo sapiens
ugagaacaacaggucaagcag

SEQ ID NO: 362815 - RNA, 19 nt, Homo sapiens
ugagaaccucuacagaguc

SEQ ID NO: 362816 - RNA, 22 nt, Homo sapiens
ugagaaccucugugugcccacu

SEQ ID NO: 362817 - RNA, 22 nt, Homo sapiens
ugagaagugacgcagcaggguu

SEQ ID NO: 362818 - RNA, 22 nt, Homo sapiens
ugagaaugacugggcaugcugc

SEQ ID NO: 362819 - RNA, 22 nt, Homo sapiens
ugagaaugaugauuuccaguuu

SEQ ID NO: 362820 - RNA, 22 nt, Homo sapiens
ugagacauauuauacugcuuuu

SEQ ID NO: 362821 - RNA, 22 nt, Homo sapiens
ugagaccaacagauuccaguuc

SEQ ID NO: 362822 - RNA, 22 nt, Homo sapiens
ugagaccugaucuugguacugc

SEQ ID NO: 362823 - RNA, 22 nt, Homo sapiens
ugagacggaguuucgcucuugu

SEQ ID NO: 362824 - RNA, 22 nt, Homo sapiens
ugagacugaaauuaggaaacug

SEQ ID NO: 362825 - RNA, 22 nt, Homo sapiens
ugagacugagucucccucuguc

SEQ ID NO: 362826 - RNA, 22 nt, Homo sapiens
ugagacugaguuucucucuugu

SEQ ID NO: 362827 - RNA, 22 nt, Homo sapiens
ugagacugauaggacauuuucu

SEQ ID NO: 362828 - RNA, 22 nt, Homo sapiens
ugagacugguaauguguagggc

SEQ ID NO: 362829 - RNA, 22 nt, Homo sapiens
ugagagaugaacucugauaugu

SEQ ID NO: 362830 - RNA, 22 nt, Homo sapiens
ugagagucacugaccugguaua

SEQ ID NO: 362831 - RNA, 22 nt, Homo sapiens
ugagagucauacaaauaaaaau

SEQ ID NO: 362832 - RNA, 22 nt, Homo sapiens
ugagauaaagcauguacugugu

SEQ ID NO: 362833 - RNA, 22 nt, Homo sapiens
ugagauaggaucuugcucuguu

SEQ ID NO: 362834 - RNA, 22 nt, Homo sapiens
ugagauagggucucacucuguc

SEQ ID NO: 362835 - RNA, 22 nt, Homo sapiens
ugagaucaagguuaauauaauc

SEQ ID NO: 362836 - RNA, 22 nt, Homo sapiens
ugagaucacuaagagguaaugg

SEQ ID NO: 362837 - RNA, 22 nt, Homo sapiens
ugagaucauguguggaccccag

SEQ ID NO: 362838 - RNA, 22 nt, Homo sapiens
auacccaguaguggaauugcua

SEQ ID NO: 362839 - RNA, 20 nt, Homo sapiens
auagaagacuagugcagcag

SEQ ID NO: 362840 - RNA, 22 nt, Homo sapiens
auagaaucaucugugcacuagu

SEQ ID NO: 362841 - RNA, 22 nt, Homo sapiens
auagacugaguggcuuaaacca

SEQ ID NO: 362842 - RNA, 22 nt, Homo sapiens
auagaggacugaggugaucuuu

SEQ ID NO: 362843 - RNA, 22 nt, Homo sapiens
auagaucauugucauuuuagau

SEQ ID NO: 362844 - RNA, 22 nt, Homo sapiens
auagcaaugccccaauccuugg

SEQ ID NO: 362845 - RNA, 22 nt, Homo sapiens
auagcaaugccccauucccagu

SEQ ID NO: 362846 - RNA, 21 nt, Homo sapiens
auagcacaucagauuuuauua

SEQ ID NO: 362847 - RNA, 22 nt, Homo sapiens
auagcacaugugcaaauggcug

SEQ ID NO: 362848 - RNA, 22 nt, Homo sapiens
auagcagcaccccacuaccuca

SEQ ID NO: 362849 - RNA, 22 nt, Homo sapiens
auagcagcuugucagggcagac

SEQ ID NO: 362850 - RNA, 22 nt, Homo sapiens
auagcaggagaauggucauggg

SEQ ID NO: 362851 - RNA, 22 nt, Homo sapiens
auagcugcucaggcuuuccuca

SEQ ID NO: 362852 - RNA, 22 nt, Homo sapiens
auagcuguccuuacuagcuagg

SEQ ID NO: 362853 - RNA, 22 nt, Homo sapiens
auaggacuauugugaggauuaa

SEQ ID NO: 362854 - RNA, 22 nt, Homo sapiens
auaggcacauuaggaacuuuug

SEQ ID NO: 362855 - RNA, 22 nt, Homo sapiens
auagggcacgagaugugagccu

SEQ ID NO: 362856 - RNA, 22 nt, Homo sapiens
auagguagcauagcaggaauau

SEQ ID NO: 362857 - RNA, 22 nt, Homo sapiens
auaguauaguugaggauggcau

SEQ ID NO: 362858 - RNA, 22 nt, Homo sapiens
auagugcagugaugaaccuagg

SEQ ID NO: 362859 - RNA, 22 nt, Homo sapiens
auagugcugcaauaaacauaca

SEQ ID NO: 362860 - RNA, 22 nt, Homo sapiens
auagugcuguauuaaacauacg

SEQ ID NO: 362861 - RNA, 22 nt, Homo sapiens
auauagcaaugaaagagaugaa

SEQ ID NO: 362862 - RNA, 23 nt, Homo sapiens
auauaguagaugugcaguaacau

SEQ ID NO: 362863 - RNA, 22 nt, Homo sapiens
auaucacucccaauaucgcagg

SEQ ID NO: 362864 - RNA, 22 nt, Homo sapiens
auaugacuuuccucuacuuccu

SEQ ID NO: 362865 - RNA, 20 nt, Homo sapiens
uugccgagagaaagguguua

SEQ ID NO: 362866 - RNA, 22 nt, Homo sapiens
uugccuaggcuggagugcagua

SEQ ID NO: 362867 - RNA, 22 nt, Homo sapiens
uugccuaggcuggauugcagug

SEQ ID NO: 362868 - RNA, 22 nt, Homo sapiens
uugccugagaagccaagaauaa

SEQ ID NO: 362869 - RNA, 22 nt, Homo sapiens
uugcuagagaugagggaugugu

SEQ ID NO: 362870 - RNA, 22 nt, Homo sapiens
uugcugagucuuucuagguugc

SEQ ID NO: 362871 - RNA, 22 nt, Homo sapiens
uugcuuagagccaaucuugauu

SEQ ID NO: 362872 - RNA, 22 nt, Homo sapiens
uuggaaauauguuaagugucau

SEQ ID NO: 362873 - RNA, 20 nt, Homo sapiens
uuggaaaugugaauugggag

SEQ ID NO: 362874 - RNA, 22 nt, Homo sapiens
uuggaacacauguuuuucuacc

SEQ ID NO: 362875 - RNA, 22 nt, Homo sapiens
uuggaacuguucguauugaaau

SEQ ID NO: 362876 - RNA, 22 nt, Homo sapiens
uuggaagagaagggagauaaac

SEQ ID NO: 362877 - RNA, 22 nt, Homo sapiens
uuggaagcacauuguuuaauua

SEQ ID NO: 362878 - RNA, 22 nt, Homo sapiens
uuggaauauaaccuguuucuaa

SEQ ID NO: 362879 - RNA, 22 nt, Homo sapiens
uuggaaugcacacugagccugc

SEQ ID NO: 362880 - RNA, 19 nt, Homo sapiens
uuggaauuuuagaguuuga

SEQ ID NO: 362881 - RNA, 22 nt, Homo sapiens
uuggacaagauugcagagaauu

SEQ ID NO: 362882 - RNA, 22 nt, Homo sapiens
uuggagugugagagcagccugg

SEQ ID NO: 362883 - RNA, 22 nt, Homo sapiens
uuggagugugcucauaacugcu

SEQ ID NO: 362884 - RNA, 22 nt, Homo sapiens
uuggauagugcaaugccuccag

SEQ ID NO: 362885 - RNA, 22 nt, Homo sapiens
uuggauggugauaugguuugga

SEQ ID NO: 362886 - RNA, 22 nt, Homo sapiens
uuggauuguuucuagauugggg

SEQ ID NO: 362887 - RNA, 22 nt, Homo sapiens
uuggcaauugcuaugauuugaa

SEQ ID NO: 362888 - RNA, 23 nt, Homo sapiens
uuggccuccuugugucuagggcu

SEQ ID NO: 362889 - RNA, 17 nt, Homo sapiens
uugggcaagguagguga

SEQ ID NO: 362890 - RNA, 22 nt, Homo sapiens
uugguaagguggaugaugaaua

SEQ ID NO: 362891 - RNA, 22 nt, Homo sapiens
uugguaggcuggccucucucag

SEQ ID NO: 362892 - RNA, 22 nt, Homo sapiens
uuggucaggagccucccucuuu

SEQ ID NO: 362893 - RNA, 22 nt, Homo sapiens
uugguccauuacauugaugaca

SEQ ID NO: 362894 - RNA, 22 nt, Homo sapiens
uuggucucuuaaucacacuuuu

SEQ ID NO: 362895 - RNA, 21 nt, Homo sapiens
uuggucuucucugugauucuu

SEQ ID NO: 362896 - RNA, 22 nt, Homo sapiens
uugguucucuuuauaugcugga

SEQ ID NO: 362897 - RNA, 22 nt, Homo sapiens
uuguaaacaucuguacauugcu

SEQ ID NO: 362898 - RNA, 22 nt, Homo sapiens
uuguaaaguucuuaggaagcuc

SEQ ID NO: 362899 - RNA, 22 nt, Homo sapiens
uuguaccacagggcaugaagug

SEQ ID NO: 362900 - RNA, 22 nt, Homo sapiens
uuguaguagcauuauuuauaau

SEQ ID NO: 362901 - RNA, 22 nt, Homo sapiens
uuguauaggcucaguaagaauc

SEQ ID NO: 362902 - RNA, 22 nt, Homo sapiens
uuguauccaucuuucaggcaac

SEQ ID NO: 362903 - RNA, 22 nt, Homo sapiens
uugucaacaugaaacuguguuu

SEQ ID NO: 362904 - RNA, 22 nt, Homo sapiens
uugucaaugggugagugcagag

SEQ ID NO: 362905 - RNA, 22 nt, Homo sapiens
uugucauuuucagaguguuacg

SEQ ID NO: 362906 - RNA, 16 nt, Homo sapiens
uugucccuucccaaau

SEQ ID NO: 362907 - RNA, 22 nt, Homo sapiens
uuguccuccacauuugaucagu

SEQ ID NO: 362908 - RNA, 22 nt, Homo sapiens
uugucuccuagacgaccaggcg

SEQ ID NO: 362909 - RNA, 22 nt, Homo sapiens
uugugagggagcuaagaugagu

SEQ ID NO: 362910 - RNA, 22 nt, Homo sapiens
uugugauggugcauacugagcu

SEQ ID NO: 362911 - RNA, 22 nt, Homo sapiens
uugugccacugaagcccuccag

SEQ ID NO: 362912 - RNA, 22 nt, Homo sapiens
uugugccugguacauggagaaa

SEQ ID NO: 362913 - RNA, 22 nt, Homo sapiens
uugugcuugcuguguucuaugc

SEQ ID NO: 362914 - RNA, 22 nt, Homo sapiens
uugugcuuuuuaaauagcuucc

SEQ ID NO: 362915 - RNA, 19 nt, Homo sapiens
uugugggaggacagagggg

SEQ ID NO: 362916 - RNA, 22 nt, Homo sapiens
uugugguaaucugugacagcag

SEQ ID NO: 362917 - RNA, 22 nt, Homo sapiens
uugugguugaugaagacugucu

SEQ ID NO: 362918 - RNA, 22 nt, Homo sapiens
uugugguuuuagcacuguggau

SEQ ID NO: 362919 - RNA, 22 nt, Homo sapiens
uugugguuuuuaaaacuaggug

SEQ ID NO: 362920 - RNA, 22 nt, Homo sapiens
uugugucaaauggcaauuagca

SEQ ID NO: 362921 - RNA, 22 nt, Homo sapiens
uuguuauguaucucaagauaaa

SEQ ID NO: 362922 - RNA, 22 nt, Homo sapiens
uuguuugguugaguauggaagu

SEQ ID NO: 362923 - RNA, 22 nt, Homo sapiens
uuuaauacugcaucuuuacucu

SEQ ID NO: 362924 - RNA, 22 nt, Homo sapiens
uuuacagucucauagguggaag

SEQ ID NO: 362925 - RNA, 22 nt, Homo sapiens
uuuacugugggguuucuuagag

SEQ ID NO: 362926 - RNA, 22 nt, Homo sapiens
agaaccauuagagggagauauu

SEQ ID NO: 362927 - RNA, 22 nt, Homo sapiens
agaagacuauucuggguugggc

SEQ ID NO: 362928 - RNA, 22 nt, Homo sapiens
agaauguuuuagaccaauacaa

SEQ ID NO: 362929 - RNA, 22 nt, Homo sapiens
agaauucugucauguuuauauu

SEQ ID NO: 362930 - RNA, 22 nt, Homo sapiens
agacacugaaauguauugaaga

SEQ ID NO: 362931 - RNA, 19 nt, Homo sapiens
agacuggcccaggcgggug

SEQ ID NO: 362932 - RNA, 22 nt, Homo sapiens
agagaacuggcuucaccauucu

SEQ ID NO: 362933 - RNA, 22 nt, Homo sapiens
agagagcuuuugguugcccuaa

SEQ ID NO: 362934 - RNA, 22 nt, Homo sapiens
agagaucaauaugaaggaaaug

SEQ ID NO: 362935 - RNA, 22 nt, Homo sapiens
agagauccucauuuuauagaca

SEQ ID NO: 362936 - RNA, 22 nt, Homo sapiens
agagcaccauuuagcaagguga

SEQ ID NO: 362937 - RNA, 22 nt, Homo sapiens
agagguauacauuugagagcca

SEQ ID NO: 362938 - RNA, 22 nt, Homo sapiens
agagguaugccugggcuggagc

SEQ ID NO: 362939 - RNA, 22 nt, Homo sapiens
agagguauuggaaggaguguca

SEQ ID NO: 362940 - RNA, 22 nt, Homo sapiens
agaggucuuaucaaacaugcuu

SEQ ID NO: 362941 - RNA, 22 nt, Homo sapiens
agagguuuaauugauucacagu

SEQ ID NO: 362942 - RNA, 22 nt, Homo sapiens
agagguuuugcacugguucuuu

SEQ ID NO: 362943 - RNA, 22 nt, Homo sapiens
agaguauacaugugagugagau

SEQ ID NO: 362944 - RNA, 22 nt, Homo sapiens
agaguauagcaacuuaguaaaa

SEQ ID NO: 362945 - RNA, 19 nt, Homo sapiens
agaguauuguuacuucucu

SEQ ID NO: 362946 - RNA, 22 nt, Homo sapiens
agagucacaugaggcccuucau

SEQ ID NO: 362947 - RNA, 22 nt, Homo sapiens
agagugcaauggcaccaucucg

SEQ ID NO: 362948 - RNA, 23 nt, Homo sapiens
agagugcaauggugccaucucgg

SEQ ID NO: 362949 - RNA, 22 nt, Homo sapiens
agauacauuggauaaugguggg

SEQ ID NO: 362950 - RNA, 22 nt, Homo sapiens
agauauguuauugauguuaaug

SEQ ID NO: 362951 - RNA, 22 nt, Homo sapiens
agaugauguuucuggcacauga

SEQ ID NO: 362952 - RNA, 22 nt, Homo sapiens
agaugccuaugaagagaaauua

SEQ ID NO: 362953 - RNA, 22 nt, Homo sapiens
agauggguuuucacauguuggc

SEQ ID NO: 362954 - RNA, 22 nt, Homo sapiens
agauggugugcuaggaaaugua

SEQ ID NO: 362955 - RNA, 22 nt, Homo sapiens
agauucauccaaguuguugcau

SEQ ID NO: 362956 - RNA, 22 nt, Homo sapiens
agcaacauuguucauaauagcu

SEQ ID NO: 362957 - RNA, 22 nt, Homo sapiens
agcaacauuuuugaccuuucuu

SEQ ID NO: 362958 - RNA, 22 nt, Homo sapiens
agcaagacauggcuuccaaaug

SEQ ID NO: 362959 - RNA, 22 nt, Homo sapiens
agcaagauuguucccauuuucu

SEQ ID NO: 362960 - RNA, 22 nt, Homo sapiens
agcaauaugacauugcuacauc

SEQ ID NO: 362961 - RNA, 22 nt, Homo sapiens
agcaccacauacuacagagaua

SEQ ID NO: 362962 - RNA, 22 nt, Homo sapiens
agcaccagaaucugaguuauuc

SEQ ID NO: 362963 - RNA, 22 nt, Homo sapiens
agcaccauuuauugaaaagaca

SEQ ID NO: 362964 - RNA, 22 nt, Homo sapiens
agcagagcauauucauucgggg

SEQ ID NO: 362965 - RNA, 22 nt, Homo sapiens
agcagcaucgggaaguuggcca

SEQ ID NO: 362966 - RNA, 20 nt, Homo sapiens
agcagccacagauuccucag

SEQ ID NO: 362967 - RNA, 22 nt, Homo sapiens
agcagcuuugcauggccugugg

SEQ ID NO: 362968 - RNA, 21 nt, Homo sapiens
agcagcuuugguugaagcaga

SEQ ID NO: 362969 - RNA, 16 nt, Homo sapiens
agcagguguuagguga

SEQ ID NO: 362970 - RNA, 22 nt, Homo sapiens
agcaguacauaaaaagcauccu

SEQ ID NO: 362971 - RNA, 22 nt, Homo sapiens
agcagugugaaaugauuuaagg

SEQ ID NO: 362972 - RNA, 20 nt, Homo sapiens
agcaucacagagccgggugu

SEQ ID NO: 362973 - RNA, 22 nt, Homo sapiens
agcaucauaccaaucugguccu

SEQ ID NO: 362974 - RNA, 17 nt, Homo sapiens
agcauguguuugagauu

SEQ ID NO: 362975 - RNA, 16 nt, Homo sapiens
agccaccauuuacuug

SEQ ID NO: 362976 - RNA, 23 nt, Homo sapiens
agccugguuucccugcuucuccc

SEQ ID NO: 362977 - RNA, 21 nt, Homo sapiens
agccugugggucauaguugcc

SEQ ID NO: 362978 - RNA, 22 nt, Homo sapiens
agcgccacugcacuccagccug

SEQ ID NO: 362979 - RNA, 21 nt, Homo sapiens
agcuaaauuggaaauuucugu

SEQ ID NO: 362980 - RNA, 23 nt, Homo sapiens
agcuagagaggcuggggauacag

SEQ ID NO: 362981 - RNA, 19 nt, Homo sapiens
agcuagugcucagcuguca

SEQ ID NO: 362982 - RNA, 20 nt, Homo sapiens
auaugcagacacauacauac

SEQ ID NO: 362983 - RNA, 22 nt, Homo sapiens
auauggcuuuuauuauguugag

SEQ ID NO: 362984 - RNA, 22 nt, Homo sapiens
auaugguacuuaugcucaaacu

SEQ ID NO: 362985 - RNA, 22 nt, Homo sapiens
auaugguuuuuggaagcauauc

SEQ ID NO: 362986 - RNA, 22 nt, Homo sapiens
auauguauuuuaacguguaagg

SEQ ID NO: 362987 - RNA, 22 nt, Homo sapiens
auaugucuauuauuagggcagg

SEQ ID NO: 362988 - RNA, 17 nt, Homo sapiens
auaugucugcuggggga

SEQ ID NO: 362989 - RNA, 22 nt, Homo sapiens
auaugucuguuuagucuguaau

SEQ ID NO: 362990 - RNA, 21 nt, Homo sapiens
auaugugcuguggaagucagc

SEQ ID NO: 362991 - RNA, 22 nt, Homo sapiens
auauguucucauucauaugugg

SEQ ID NO: 362992 - RNA, 22 nt, Homo sapiens
auauuacuggccauaucgcagg

SEQ ID NO: 362993 - RNA, 22 nt, Homo sapiens
auauucacuauaugcagaacca

SEQ ID NO: 362994 - RNA, 22 nt, Homo sapiens
aucaaagcagcauggcccaguc

SEQ ID NO: 362995 - RNA, 22 nt, Homo sapiens
aucaaagugaauuaaugagaau

SEQ ID NO: 362996 - RNA, 22 nt, Homo sapiens
aucaagccaaagaaaguccuug

SEQ ID NO: 362997 - RNA, 22 nt, Homo sapiens
aucaaguacuguacugaaagug

SEQ ID NO: 362998 - RNA, 22 nt, Homo sapiens
aucaaguaguuauacguaaagg

SEQ ID NO: 362999 - RNA, 22 nt, Homo sapiens
aucacagaguuaaaacuuucuu

SEQ ID NO: 363000 - RNA, 22 nt, Homo sapiens
aucacagcccuccucuuggaug

SEQ ID NO: 363001 - RNA, 22 nt, Homo sapiens
aucaccuuucccuuucugaauc

SEQ ID NO: 363002 - RNA, 22 nt, Homo sapiens
aucacugggcaagauaucauga

SEQ ID NO: 363003 - RNA, 22 nt, Homo sapiens
aucacugugauuucuacugugc

SEQ ID NO: 363004 - RNA, 22 nt, Homo sapiens
aucacuguuuugaugcucggac

SEQ ID NO: 363005 - RNA, 22 nt, Homo sapiens
aucacuuucuauuucugugcca

SEQ ID NO: 363006 - RNA, 22 nt, Homo sapiens
aucagagccugugugcccugaa

SEQ ID NO: 363007 - RNA, 22 nt, Homo sapiens
aucagaguugucagggagcuuu

SEQ ID NO: 363008 - RNA, 22 nt, Homo sapiens
aucagauaccuguugggaaaug

SEQ ID NO: 363009 - RNA, 22 nt, Homo sapiens
aucagauggcuaaaacagaaga

SEQ ID NO: 363010 - RNA, 22 nt, Homo sapiens
aucagauuccacauuuuaucag

SEQ ID NO: 363011 - RNA, 22 nt, Homo sapiens
aucagcacugaucauacagcuu

SEQ ID NO: 363012 - RNA, 22 nt, Homo sapiens
aucagcauucccaaaugaugug

SEQ ID NO: 363013 - RNA, 18 nt, Homo sapiens
aucagggugaagagagga

SEQ ID NO: 363014 - RNA, 22 nt, Homo sapiens
aucagugauugauuuaaagacg

SEQ ID NO: 363015 - RNA, 22 nt, Homo sapiens
aucagugcauguuuguugagcu

SEQ ID NO: 363016 - RNA, 22 nt, Homo sapiens
aucauacuguuuugauuacugu

SEQ ID NO: 363017 - RNA, 22 nt, Homo sapiens
aucauguaguaagacacauuua

SEQ ID NO: 363018 - RNA, 22 nt, Homo sapiens
aucauugugcaucuucauucca

SEQ ID NO: 363019 - RNA, 22 nt, Homo sapiens
aucauugugugaguugauggga

SEQ ID NO: 363020 - RNA, 22 nt, Homo sapiens
auccacagugucaauguuguga

SEQ ID NO: 363021 - RNA, 22 nt, Homo sapiens
auccccugcacggggugucauu

SEQ ID NO: 363022 - RNA, 22 nt, Homo sapiens
aucccugagaacuuuuaauguu

SEQ ID NO: 363023 - RNA, 22 nt, Homo sapiens
auccucugagaucuaggcagag

SEQ ID NO: 363024 - RNA, 22 nt, Homo sapiens
auccuguaggcuaguagacagu

SEQ ID NO: 363025 - RNA, 22 nt, Homo sapiens
auccuguagucucacagcccca

SEQ ID NO: 363026 - RNA, 22 nt, Homo sapiens
auccuugagaaaauaaaugacc

SEQ ID NO: 363027 - RNA, 22 nt, Homo sapiens
auccuuuagacuguccaguuga

SEQ ID NO: 363028 - RNA, 22 nt, Homo sapiens
aucgugucuggcccugaaugcu

SEQ ID NO: 363029 - RNA, 22 nt, Homo sapiens
aucuaaaucucauaugggcaca

SEQ ID NO: 363030 - RNA, 22 nt, Homo sapiens
aucucagagaaaauuacuaaga

SEQ ID NO: 363031 - RNA, 22 nt, Homo sapiens
aucucauuccuucugggcugau

SEQ ID NO: 363032 - RNA, 19 nt, Homo sapiens
aucuggaguuccuggggcu

SEQ ID NO: 363033 - RNA, 22 nt, Homo sapiens
aucugguguggcugugauccuc

SEQ ID NO: 363034 - RNA, 22 nt, Homo sapiens
aucuguagauucagcacaagcu

SEQ ID NO: 363035 - RNA, 21 nt, Homo sapiens
aucugugagaccuuggggguu

SEQ ID NO: 363036 - RNA, 22 nt, Homo sapiens
aucuucucuugaagggugggga

SEQ ID NO: 363037 - RNA, 22 nt, Homo sapiens
aucuuggauuaccugggugggu

SEQ ID NO: 363038 - RNA, 22 nt, Homo sapiens
aucuuugauuagacugauggau

SEQ ID NO: 363039 - RNA, 22 nt, Homo sapiens
augaaaacaugauuugccuguu

SEQ ID NO: 363040 - RNA, 22 nt, Homo sapiens
augaaaagcauaaacgcugaag

SEQ ID NO: 363041 - RNA, 22 nt, Homo sapiens
augaaagucaauccccaagugu

SEQ ID NO: 363042 - RNA, 22 nt, Homo sapiens
augaaaguguguggaaacuuga

SEQ ID NO: 363043 - RNA, 19 nt, Homo sapiens
augaacucaucauuucuca

SEQ ID NO: 363044 - RNA, 22 nt, Homo sapiens
augaagaucucugccuuguguc

SEQ ID NO: 363045 - RNA, 22 nt, Homo sapiens
augugacugauguaaucagaca

SEQ ID NO: 363046 - RNA, 22 nt, Homo sapiens
augugcacauucugguaaauau

SEQ ID NO: 363047 - RNA, 22 nt, Homo sapiens
augugcagauguuacaaauugu

SEQ ID NO: 363048 - RNA, 22 nt, Homo sapiens
augugccauucucauggcgcuu

SEQ ID NO: 363049 - RNA, 20 nt, Homo sapiens
augugcuaauauuaauaugu

SEQ ID NO: 363050 - RNA, 22 nt, Homo sapiens
augugcuuuuuaaacagaugcu

SEQ ID NO: 363051 - RNA, 22 nt, Homo sapiens
augugggaggacuuggcuguug

SEQ ID NO: 363052 - RNA, 22 nt, Homo sapiens
augugugcuugauguaaaaagu

SEQ ID NO: 363053 - RNA, 22 nt, Homo sapiens
auguguucaucacagcacaauu

SEQ ID NO: 363054 - RNA, 22 nt, Homo sapiens
auguuagcaucaauauucauca

SEQ ID NO: 363055 - RNA, 22 nt, Homo sapiens
auuaaauguuggacguauacau

SEQ ID NO: 363056 - RNA, 22 nt, Homo sapiens
auuaaggaguggguucauggug

SEQ ID NO: 363057 - RNA, 22 nt, Homo sapiens
auuaagugaaugaaguuguucc

SEQ ID NO: 363058 - RNA, 22 nt, Homo sapiens
auuaagugcuugcagaagucca

SEQ ID NO: 363059 - RNA, 22 nt, Homo sapiens
auuagaugguuauaggugugag

SEQ ID NO: 363060 - RNA, 22 nt, Homo sapiens
auuauauguguaugugcauacc

SEQ ID NO: 363061 - RNA, 22 nt, Homo sapiens
auuaucacaguuuugcauaugg

SEQ ID NO: 363062 - RNA, 22 nt, Homo sapiens
auucaacuaauuauugaagaug

SEQ ID NO: 363063 - RNA, 22 nt, Homo sapiens
auucaaggagucuucgucccaa

SEQ ID NO: 363064 - RNA, 22 nt, Homo sapiens
auucacagcuuuaaaaggcgug

SEQ ID NO: 363065 - RNA, 22 nt, Homo sapiens
auucaucagggauauuggucug

SEQ ID NO: 363066 - RNA, 22 nt, Homo sapiens
gaggucauguggcaggcagcca

SEQ ID NO: 363067 - RNA, 22 nt, Homo sapiens
gaguagugcugcaauaaacaua

SEQ ID NO: 363068 - RNA, 22 nt, Homo sapiens
gaguagugcuguaauaaacaua

SEQ ID NO: 363069 - RNA, 22 nt, Homo sapiens
gaguaucuuuaaggugguuugg

SEQ ID NO: 363070 - RNA, 22 nt, Homo sapiens
gagugcaagguuuuucugagug

SEQ ID NO: 363071 - RNA, 22 nt, Homo sapiens
gagugcuguuagcccuggguuu

SEQ ID NO: 363072 - RNA, 22 nt, Homo sapiens
gaguucaauuuccagcuguucu

SEQ ID NO: 363073 - RNA, 22 nt, Homo sapiens
gaguucauuuugaaaccuugau

SEQ ID NO: 363074 - RNA, 22 nt, Homo sapiens
gaguuuguaaacuauucacuaa

SEQ ID NO: 363075 - RNA, 22 nt, Homo sapiens
gaguuuguacuaauuuguugua

SEQ ID NO: 363076 - RNA, 22 nt, Homo sapiens
gauaacagauaaugucaguuau

SEQ ID NO: 363077 - RNA, 18 nt, Homo sapiens
gauaacaguggacuaugc

SEQ ID NO: 363078 - RNA, 22 nt, Homo sapiens
gauagcagccauucuuuuuauu

SEQ ID NO: 363079 - RNA, 22 nt, Homo sapiens
gauagguucuaagcagguguug

SEQ ID NO: 363080 - RNA, 22 nt, Homo sapiens
gauaguugugagaacucuuacu

SEQ ID NO: 363081 - RNA, 19 nt, Homo sapiens
gauaucuagggggagguuc

SEQ ID NO: 363082 - RNA, 22 nt, Homo sapiens
gauauguaaaaauuauaucuga

SEQ ID NO: 363083 - RNA, 22 nt, Homo sapiens
gauaugugauaagaguuaucuu

SEQ ID NO: 363084 - RNA, 22 nt, Homo sapiens
gauauguguuuuagucaggguu

SEQ ID NO: 363085 - RNA, 22 nt, Homo sapiens
gauauguucugagaaaugcauu

SEQ ID NO: 363086 - RNA, 17 nt, Homo sapiens
gaucacagucgucuccu

SEQ ID NO: 363087 - RNA, 22 nt, Homo sapiens
gaucacuuugaugccaggaacu

SEQ ID NO: 363088 - RNA, 22 nt, Homo sapiens
gaugacagugaguaaccccaac

SEQ ID NO: 363089 - RNA, 22 nt, Homo sapiens
gaugaucucuggugguaaagac

SEQ ID NO: 363090 - RNA, 22 nt, Homo sapiens
gauggaguugucgccugggcug

SEQ ID NO: 363091 - RNA, 22 nt, Homo sapiens
gauggcucugcaggugagggua

SEQ ID NO: 363092 - RNA, 22 nt, Homo sapiens
gauguguuuuaggaucucagca

SEQ ID NO: 363093 - RNA, 22 nt, Homo sapiens
gauguuguuuagccuuugaugu

SEQ ID NO: 363094 - RNA, 22 nt, Homo sapiens
gauuccacuuucaaauucaaau

SEQ ID NO: 363095 - RNA, 22 nt, Homo sapiens
gauuuguuggccugugagcuag

SEQ ID NO: 363096 - RNA, 22 nt, Homo sapiens
gauuuuccaguggcccugauca

SEQ ID NO: 363097 - RNA, 22 nt, Homo sapiens
gcaaaguguuuuuaggaagucu

SEQ ID NO: 363098 - RNA, 23 nt, Homo sapiens
gcaaauaucguagagugucccug

SEQ ID NO: 363099 - RNA, 22 nt, Homo sapiens
gcaaaugcuacaccauuuugua

SEQ ID NO: 363100 - RNA, 22 nt, Homo sapiens
gcaagaaucugggaguaaaauu

SEQ ID NO: 363101 - RNA, 22 nt, Homo sapiens
gcaagacaugucuaagguuuaa

SEQ ID NO: 363102 - RNA, 22 nt, Homo sapiens
gcaaggacucccugggucauuc

SEQ ID NO: 363103 - RNA, 22 nt, Homo sapiens
gcacaaugccugacgaguccug

SEQ ID NO: 363104 - RNA, 22 nt, Homo sapiens
gcacacguagaagcaugcauca

SEQ ID NO: 363105 - RNA, 22 nt, Homo sapiens
gcacacuuacacgaaccuagau

SEQ ID NO: 363106 - RNA, 22 nt, Homo sapiens
gcacaguguuacuugauauauu

SEQ ID NO: 363107 - RNA, 22 nt, Homo sapiens
gcacauggccccaucgugccga

SEQ ID NO: 363108 - RNA, 22 nt, Homo sapiens
gcagaauugacucuguuuuuuc

SEQ ID NO: 363109 - RNA, 19 nt, Homo sapiens
gcagagaugugguagcuug

SEQ ID NO: 363110 - RNA, 22 nt, Homo sapiens
gcagaucuucgcgguaaguguu

SEQ ID NO: 363111 - RNA, 22 nt, Homo sapiens
gcagcacaugacuguauguaua

SEQ ID NO: 363112 - RNA, 22 nt, Homo sapiens
gcagcauuaccaagacauggca

SEQ ID NO: 363113 - RNA, 22 nt, Homo sapiens
gcagugacaugugccaguuuau

SEQ ID NO: 363114 - RNA, 22 nt, Homo sapiens
gcagugaugugaucauagcuca

SEQ ID NO: 363115 - RNA, 22 nt, Homo sapiens
gcagugugauguuuuaaucuau

SEQ ID NO: 363116 - RNA, 20 nt, Homo sapiens
gcaguguucacuguauuccu

SEQ ID NO: 363117 - RNA, 22 nt, Homo sapiens
gcaugauuuuauaucuauguaa

SEQ ID NO: 363118 - RNA, 22 nt, Homo sapiens
gcauggagaaggggacugauuc

SEQ ID NO: 363119 - RNA, 22 nt, Homo sapiens
gcauggauguugauggcugcug

SEQ ID NO: 363120 - RNA, 22 nt, Homo sapiens
gcccugagauucuuggauucug

SEQ ID NO: 363121 - RNA, 22 nt, Homo sapiens
gccuagauccaaauauggugca

SEQ ID NO: 363122 - RNA, 22 nt, Homo sapiens
gccuuuggugacaggcaugugu

SEQ ID NO: 363123 - RNA, 20 nt, Homo sapiens
gcuaaggcacgggaauuacu

SEQ ID NO: 363124 - RNA, 22 nt, Homo sapiens
gcuaaggcaggagcauugcuug

SEQ ID NO: 363125 - RNA, 22 nt, Homo sapiens
gcucguccccuccugacucugc

SEQ ID NO: 363126 - RNA, 22 nt, Homo sapiens
gcucugguuacaaaggcaaauu

SEQ ID NO: 363127 - RNA, 22 nt, Homo sapiens
gcucuuuugggguaauucugag

SEQ ID NO: 363128 - RNA, 22 nt, Homo sapiens
gcugagacauugguuuucuccu

SEQ ID NO: 363129 - RNA, 22 nt, Homo sapiens
gcugcuguuucucuuucagcau

SEQ ID NO: 363130 - RNA, 22 nt, Homo sapiens
gcuggaauuaacauagaugugc

SEQ ID NO: 363131 - RNA, 22 nt, Homo sapiens
gcuggauguuucaauacaaaua

SEQ ID NO: 363132 - RNA, 22 nt, Homo sapiens
gcugguguagagugcagaaagg

SEQ ID NO: 363133 - RNA, 22 nt, Homo sapiens
gcugguguucaggcccucaguc

SEQ ID NO: 363134 - RNA, 19 nt, Homo sapiens
gcugguuguccacucucuc

SEQ ID NO: 363135 - RNA, 22 nt, Homo sapiens
gcuguauugacuuuguaucaua

SEQ ID NO: 363136 - RNA, 22 nt, Homo sapiens
gcugucaugagcaacacaugaa

SEQ ID NO: 363137 - RNA, 22 nt, Homo sapiens
gcuguguucucgaggcggggga

SEQ ID NO: 363138 - RNA, 22 nt, Homo sapiens
gcuucauggaggcugggcgcag

SEQ ID NO: 363139 - RNA, 22 nt, Homo sapiens
gcuuggugugcaagugguacua

SEQ ID NO: 363140 - RNA, 22 nt, Homo sapiens
gcuuguguauuaaaccuugcag

SEQ ID NO: 363141 - RNA, 22 nt, Homo sapiens
gcuuuguugauggugagucugu

SEQ ID NO: 363142 - RNA, 22 nt, Homo sapiens
gcuuuuggaggaacuuaagauu

SEQ ID NO: 363143 - RNA, 22 nt, Homo sapiens
ggaaagcuagguguggguguac

SEQ ID NO: 363144 - RNA, 21 nt, Homo sapiens
ggaaaguuaaggaaauacccc

SEQ ID NO: 363145 - RNA, 22 nt, Homo sapiens
ggaaaucaucauucucgguaua

SEQ ID NO: 363146 - RNA, 22 nt, Homo sapiens
ggaaggucaaagggaaagcaga

SEQ ID NO: 363147 - RNA, 22 nt, Homo sapiens
ggaauguauuaaggcauugggc

SEQ ID NO: 363148 - RNA, 22 nt, Homo sapiens
ggacaaaguauuuucaaaugua

SEQ ID NO: 363149 - RNA, 22 nt, Homo sapiens
ggacaagagacugggacacuga

SEQ ID NO: 363150 - RNA, 22 nt, Homo sapiens
ggacaucauuaccauggaccca

SEQ ID NO: 363151 - RNA, 22 nt, Homo sapiens
ggacauguauauauaugugugu

SEQ ID NO: 363152 - RNA, 22 nt, Homo sapiens
ggacugagaggacuacagugua

SEQ ID NO: 363153 - RNA, 22 nt, Homo sapiens
ggagagugacauauuucuaggc

SEQ ID NO: 363154 - RNA, 22 nt, Homo sapiens
ggagaucauuuccuauuugaag

SEQ ID NO: 363155 - RNA, 22 nt, Homo sapiens
ggagaugaaaugagcuacuuaa

SEQ ID NO: 363156 - RNA, 22 nt, Homo sapiens
ggagaugugccugcucugcucu

SEQ ID NO: 363157 - RNA, 22 nt, Homo sapiens
ggagauguuuaaccuuuuaucu

SEQ ID NO: 363158 - RNA, 20 nt, Homo sapiens
ggagguuguauaaguacauc

SEQ ID NO: 363159 - RNA, 22 nt, Homo sapiens
ggagugcuguuguuacacaagg

SEQ ID NO: 363160 - RNA, 22 nt, Homo sapiens
ggagugugauucaguauaauau

SEQ ID NO: 363161 - RNA, 22 nt, Homo sapiens
ggaucacuugagaccaggaguu

SEQ ID NO: 363162 - RNA, 22 nt, Homo sapiens
ggaugugugcacgcgcacaugc

SEQ ID NO: 363163 - RNA, 22 nt, Homo sapiens
ggauuuguuggcauuagugaug

SEQ ID NO: 363164 - RNA, 22 nt, Homo sapiens
ggcaaaaucgcaauuacuuuug

SEQ ID NO: 363165 - RNA, 22 nt, Homo sapiens
ggcaaagagacaugcaucgggg

SEQ ID NO: 363166 - RNA, 22 nt, Homo sapiens
ggcaacaugccgaaaccacguc

SEQ ID NO: 363167 - RNA, 22 nt, Homo sapiens
ggcaagaggagauucugcuccc

SEQ ID NO: 363168 - RNA, 22 nt, Homo sapiens
ggcaagauagauaucaguguca

SEQ ID NO: 363169 - RNA, 22 nt, Homo sapiens
ggcagaauugcugaggaugcua

SEQ ID NO: 363170 - RNA, 22 nt, Homo sapiens
ggcagaguggacauuuaaaugu

SEQ ID NO: 363171 - RNA, 22 nt, Homo sapiens
ggcagcaugggugccuuuguga

SEQ ID NO: 363172 - RNA, 22 nt, Homo sapiens
ggcagcgugguggauugaaaau

SEQ ID NO: 363173 - RNA, 22 nt, Homo sapiens
ggcaguguuauuauauuuuugg

SEQ ID NO: 363174 - RNA, 22 nt, Homo sapiens
ggcaguuuguuugugaggucca

SEQ ID NO: 363175 - RNA, 22 nt, Homo sapiens
ggcauguguggguuauuaaaga

SEQ ID NO: 363176 - RNA, 22 nt, Homo sapiens
ggcccaguugcgggugguaccg

SEQ ID NO: 363177 - RNA, 22 nt, Homo sapiens
ggccugaugaaauguuagagua

SEQ ID NO: 363178 - RNA, 22 nt, Homo sapiens
ggcuacauuguuacaauuagua

SEQ ID NO: 363179 - RNA, 22 nt, Homo sapiens
ggcuagagaauagugccacuaa

SEQ ID NO: 363180 - RNA, 19 nt, Homo sapiens
ggcucagucaacugacugu

SEQ ID NO: 363181 - RNA, 22 nt, Homo sapiens
ggcucaguugcaaaucaguuca

SEQ ID NO: 363182 - RNA, 22 nt, Homo sapiens
ggcucaguuuccuccgucugcu

SEQ ID NO: 363183 - RNA, 22 nt, Homo sapiens
ggcuuggaggaaugugagggcu

SEQ ID NO: 363184 - RNA, 22 nt, Homo sapiens
gggaagugugcagaguucucuu

SEQ ID NO: 363185 - RNA, 22 nt, Homo sapiens
gggagugugcacacaugguaua

SEQ ID NO: 363186 - RNA, 22 nt, Homo sapiens
gggaucaacuuauacuaaaauu

SEQ ID NO: 363187 - RNA, 22 nt, Homo sapiens
gggaugaagcccuaggguuggu

SEQ ID NO: 363188 - RNA, 22 nt, Homo sapiens
gggauguuuuauacugagccug

SEQ ID NO: 363189 - RNA, 22 nt, Homo sapiens
gggauuguaauacugaguuggu

SEQ ID NO: 363190 - RNA, 22 nt, Homo sapiens
gggcaacauugaguacccugaa

SEQ ID NO: 363191 - RNA, 22 nt, Homo sapiens
ggggaauguuaaagaauuugca

SEQ ID NO: 363192 - RNA, 22 nt, Homo sapiens
gggguaggcuacacugaguucc

SEQ ID NO: 363193 - RNA, 17 nt, Homo sapiens
gggucaccuugcaggua

SEQ ID NO: 363194 - RNA, 19 nt, Homo sapiens
gggucaguuugaaugauua

SEQ ID NO: 363195 - RNA, 22 nt, Homo sapiens
gggucauggaugugaagcuaga

SEQ ID NO: 363196 - RNA, 22 nt, Homo sapiens
gguaaacauacugcugucuucu

SEQ ID NO: 363197 - RNA, 22 nt, Homo sapiens
gguauguagugugaaguaggga

SEQ ID NO: 363198 - RNA, 22 nt, Homo sapiens
gguauugguugagauuaacuuu

SEQ ID NO: 363199 - RNA, 22 nt, Homo sapiens
ggucaacaucaucaugguaagu

SEQ ID NO: 363200 - RNA, 22 nt, Homo sapiens
ggucauggagcuuuacuuuaug

SEQ ID NO: 363201 - RNA, 22 nt, Homo sapiens
ggucuuggagaauuguccuggg

SEQ ID NO: 363202 - RNA, 22 nt, Homo sapiens
ggugaauuguaccccauaggau

SEQ ID NO: 363203 - RNA, 22 nt, Homo sapiens
ggugagguaggaaaaguuagga

SEQ ID NO: 363204 - RNA, 22 nt, Homo sapiens
ggugagguaguaagguacaaua

SEQ ID NO: 363205 - RNA, 22 nt, Homo sapiens
ggugaguggugcuuaaguucag

SEQ ID NO: 363206 - RNA, 22 nt, Homo sapiens
ggugcagcacaccaacauggca

SEQ ID NO: 363207 - RNA, 22 nt, Homo sapiens
guaaacuuccccucaugaauga

SEQ ID NO: 363208 - RNA, 22 nt, Homo sapiens
guaaauaccaguuucuggaaca

SEQ ID NO: 363209 - RNA, 22 nt, Homo sapiens
guaacguaaugucaaaaucuau

SEQ ID NO: 363210 - RNA, 22 nt, Homo sapiens
guaagugguagagcugggcuau

SEQ ID NO: 363211 - RNA, 22 nt, Homo sapiens
guaauaacuguggaaaaagguu

SEQ ID NO: 363212 - RNA, 22 nt, Homo sapiens
guaaucucagcuacuugggagg

SEQ ID NO: 363213 - RNA, 22 nt, Homo sapiens
guaaucucagcuucuugggagg

SEQ ID NO: 363214 - RNA, 22 nt, Homo sapiens
guacacaacaugcagguuuguu

SEQ ID NO: 363215 - RNA, 16 nt, Homo sapiens
guacacaguaaguaug

SEQ ID NO: 363216 - RNA, 22 nt, Homo sapiens
guacaguacugaaugaauguau

SEQ ID NO: 363217 - RNA, 22 nt, Homo sapiens
guacagugcucacaaugagagc

SEQ ID NO: 363218 - RNA, 22 nt, Homo sapiens
guacuuagagauagggucuuua

SEQ ID NO: 363219 - RNA, 22 nt, Homo sapiens
guagaaaguuugcugucacaug

SEQ ID NO: 363220 - RNA, 22 nt, Homo sapiens
guagaauguauacaguauacag

SEQ ID NO: 363221 - RNA, 22 nt, Homo sapiens
guagaauguauguauaacgcaa

SEQ ID NO: 363222 - RNA, 22 nt, Homo sapiens
guagcaugcaauauuauagaga

SEQ ID NO: 363223 - RNA, 22 nt, Homo sapiens
guaguuuaucagaaagaauagg

SEQ ID NO: 363224 - RNA, 22 nt, Homo sapiens
guauacacccugugauauuauu

SEQ ID NO: 363225 - RNA, 22 nt, Homo sapiens
guauagaucguagaccaauaaa

SEQ ID NO: 363226 - RNA, 22 nt, Homo sapiens
guaucauugccuaaugcucuca

SEQ ID NO: 363227 - RNA, 22 nt, Homo sapiens
guaugcacauauguguauguau

SEQ ID NO: 363228 - RNA, 22 nt, Homo sapiens
guauggguuuuguuucuucugg

SEQ ID NO: 363229 - RNA, 22 nt, Homo sapiens
guauuagaugguauuugaagau

SEQ ID NO: 363230 - RNA, 22 nt, Homo sapiens
guauuuuguuagggugugguau

SEQ ID NO: 363231 - RNA, 22 nt, Homo sapiens
gucaagauuuguaggacagaga

SEQ ID NO: 363232 - RNA, 22 nt, Homo sapiens
gucacaggaaacuaauaugcgc

SEQ ID NO: 363233 - RNA, 22 nt, Homo sapiens
gucacugagcaauagaaaguuu

SEQ ID NO: 363234 - RNA, 20 nt, Homo sapiens
gucacuggcccagggcuugu

SEQ ID NO: 363235 - RNA, 22 nt, Homo sapiens
gucacuggcugucuuguaugau

SEQ ID NO: 363236 - RNA, 21 nt, Homo sapiens
gucacuggggcuggauaauuc

SEQ ID NO: 363237 - RNA, 22 nt, Homo sapiens
gucagaugcagauuccaguucu

SEQ ID NO: 363238 - RNA, 22 nt, Homo sapiens
gucagcaaagaggaauaguuug

SEQ ID NO: 363239 - RNA, 22 nt, Homo sapiens
gucaggaccucgguggcauucu

SEQ ID NO: 363240 - RNA, 22 nt, Homo sapiens
gucaggcaccgauacaguuuuu

SEQ ID NO: 363241 - RNA, 22 nt, Homo sapiens
gucagguauguuccaaaggcgg

SEQ ID NO: 363242 - RNA, 22 nt, Homo sapiens
gucagugucuuaacagagauua

SEQ ID NO: 363243 - RNA, 22 nt, Homo sapiens
gucagugucuuugcagcucaga

SEQ ID NO: 363244 - RNA, 22 nt, Homo sapiens
gucaguuugguuaaucauucca

SEQ ID NO: 363245 - RNA, 22 nt, Homo sapiens
gucauggaacaacuuaaaguca

SEQ ID NO: 363246 - RNA, 22 nt, Homo sapiens
gucauggacaaggugugagcca

SEQ ID NO: 363247 - RNA, 22 nt, Homo sapiens
gucaugucugcacauaguaaaa

SEQ ID NO: 363248 - RNA, 22 nt, Homo sapiens
gucauugguucuguuuauguga

SEQ ID NO: 363249 - RNA, 22 nt, Homo sapiens
guccaguuguuuucugagguug

SEQ ID NO: 363250 - RNA, 18 nt, Homo sapiens
guccauuuguugguacac

SEQ ID NO: 363251 - RNA, 22 nt, Homo sapiens
gucccguugugacuuacaaugg

SEQ ID NO: 363252 - RNA, 22 nt, Homo sapiens
gucccugaggaacauccagggc

SEQ ID NO: 363253 - RNA, 22 nt, Homo sapiens
guccuggagaagcguggaccgg

SEQ ID NO: 363254 - RNA, 22 nt, Homo sapiens
gucucuugguuuagagcauuua

SEQ ID NO: 363255 - RNA, 22 nt, Homo sapiens
gucuggagacuugggucaucaa

SEQ ID NO: 363256 - RNA, 22 nt, Homo sapiens
gucuggcuccugucuaaucacu

SEQ ID NO: 363257 - RNA, 22 nt, Homo sapiens
gucugugguuccuaugucaccu

SEQ ID NO: 363258 - RNA, 22 nt, Homo sapiens
gucuuggagacauugccauuga

SEQ ID NO: 363259 - RNA, 22 nt, Homo sapiens
gucuuggcaugugcagcuggga

SEQ ID NO: 363260 - RNA, 22 nt, Homo sapiens
gucuuuugcuagccagagagcu

SEQ ID NO: 363261 - RNA, 22 nt, Homo sapiens
gugaaugaaugggugaauacau

SEQ ID NO: 363262 - RNA, 22 nt, Homo sapiens
gugaauguuuucuuacauggua

SEQ ID NO: 363263 - RNA, 22 nt, Homo sapiens
gugacagaguaagacccuguau

SEQ ID NO: 363264 - RNA, 22 nt, Homo sapiens
gugacagucaaagacaugacuu

SEQ ID NO: 363265 - RNA, 22 nt, Homo sapiens
gugacaguggagacuuacuuca

SEQ ID NO: 363266 - RNA, 22 nt, Homo sapiens
gugaccucuguugcugucacua

SEQ ID NO: 363267 - RNA, 22 nt, Homo sapiens
gugacuaagauucuuugauaug

SEQ ID NO: 363268 - RNA, 20 nt, Homo sapiens
gugacugagcacgggcacag

SEQ ID NO: 363269 - RNA, 22 nt, Homo sapiens
gugagacugguucugaacccag

SEQ ID NO: 363270 - RNA, 22 nt, Homo sapiens
gugagaggaggcagcuuuuaca

SEQ ID NO: 363271 - RNA, 22 nt, Homo sapiens
gugagauaucuagacuagggaa

SEQ ID NO: 363272 - RNA, 22 nt, Homo sapiens
gugagaugaggucucacucugu

SEQ ID NO: 363273 - RNA, 22 nt, Homo sapiens
gugagauggagucuugcuuugu

SEQ ID NO: 363274 - RNA, 22 nt, Homo sapiens
gugagaugguaucucauugugg

SEQ ID NO: 363275 - RNA, 22 nt, Homo sapiens
gugagcauucaaggaaggagcu

SEQ ID NO: 363276 - RNA, 22 nt, Homo sapiens
gugaggaaggaaaccugcuagc

SEQ ID NO: 363277 - RNA, 22 nt, Homo sapiens
gugaggcacugcugcuuuccag

SEQ ID NO: 363278 - RNA, 22 nt, Homo sapiens
gugagggaugugaaaaagguca

SEQ ID NO: 363279 - RNA, 22 nt, Homo sapiens
gugagguaagaguugcuuugcu

SEQ ID NO: 363280 - RNA, 22 nt, Homo sapiens
gugagguacgugucaagaacca

SEQ ID NO: 363281 - RNA, 22 nt, Homo sapiens
gugaggucagggcuguggacag

SEQ ID NO: 363282 - RNA, 17 nt, Homo sapiens
gugagguggguaguauc

SEQ ID NO: 363283 - RNA, 22 nt, Homo sapiens
gugagguguuaaccaaccugug

SEQ ID NO: 363284 - RNA, 22 nt, Homo sapiens
gugagucaugucccaucugauu

SEQ ID NO: 363285 - RNA, 22 nt, Homo sapiens
gugauaucuuacaauucucuuu

SEQ ID NO: 363286 - RNA, 22 nt, Homo sapiens
gugaucaugauccugaagcauu

SEQ ID NO: 363287 - RNA, 22 nt, Homo sapiens
gugcaaacuccaggucucuuca

SEQ ID NO: 363288 - RNA, 22 nt, Homo sapiens
gugcaaauuccagcucaacucc

SEQ ID NO: 363289 - RNA, 18 nt, Homo sapiens
gugcaaugaauagcagag

SEQ ID NO: 363290 - RNA, 22 nt, Homo sapiens
gugcaauucacuguuaugucug

SEQ ID NO: 363291 - RNA, 22 nt, Homo sapiens
gugcacaacaugcagguuuguu

SEQ ID NO: 363292 - RNA, 22 nt, Homo sapiens
gugcacaacgugcagguuaguu

SEQ ID NO: 363293 - RNA, 21 nt, Homo sapiens
gugcagaugccacagucacuc

SEQ ID NO: 363294 - RNA, 22 nt, Homo sapiens
gugcaguguuugcauggaauca

SEQ ID NO: 363295 - RNA, 22 nt, Homo sapiens
gugcaguuuugagugaguuucu

SEQ ID NO: 363296 - RNA, 22 nt, Homo sapiens
gugcauacgucuuuauaguagc

SEQ ID NO: 363297 - RNA, 22 nt, Homo sapiens
gugcccacugucuguccuguag

SEQ ID NO: 363298 - RNA, 22 nt, Homo sapiens
gugccuucuagcuaugguuggc

SEQ ID NO: 363299 - RNA, 23 nt, Homo sapiens
gugccuucugagccuagucucca

SEQ ID NO: 363300 - RNA, 22 nt, Homo sapiens
gugcucauuuagagagaagcac

SEQ ID NO: 363301 - RNA, 22 nt, Homo sapiens
guggaaaacauaugcuuguuga

SEQ ID NO: 363302 - RNA, 22 nt, Homo sapiens
guggaaaucucugugugacuua

SEQ ID NO: 363303 - RNA, 22 nt, Homo sapiens
guggaaggucaugaauguucuu

SEQ ID NO: 363304 - RNA, 20 nt, Homo sapiens
guggaaguagaaacauaugu

SEQ ID NO: 363305 - RNA, 22 nt, Homo sapiens
guggaguacugagggucacuua

SEQ ID NO: 363306 - RNA, 18 nt, Homo sapiens
guggagugucuuccugga

SEQ ID NO: 363307 - RNA, 22 nt, Homo sapiens
guggaucacuugaggucaagag

SEQ ID NO: 363308 - RNA, 22 nt, Homo sapiens
guggcagcacauauagguuguu

SEQ ID NO: 363309 - RNA, 22 nt, Homo sapiens
guggcaguuuuaaauaugaaaa

SEQ ID NO: 363310 - RNA, 21 nt, Homo sapiens
guggccuuuggagcaugucag

SEQ ID NO: 363311 - RNA, 22 nt, Homo sapiens
guggcuuguaggggucaaggga

SEQ ID NO: 363312 - RNA, 22 nt, Homo sapiens
guggcuuuauuuagaagcaggg

SEQ ID NO: 363313 - RNA, 22 nt, Homo sapiens
gugggaugcaaguaaaauuguc

SEQ ID NO: 363314 - RNA, 22 nt, Homo sapiens
gugggcaaagcuaguguguaga

SEQ ID NO: 363315 - RNA, 22 nt, Homo sapiens
gugggcaagucacuucaguucu

SEQ ID NO: 363316 - RNA, 22 nt, Homo sapiens
gugggguaggcaauuccuagug

SEQ ID NO: 363317 - RNA, 22 nt, Homo sapiens
guggggucaucucauuugugga

SEQ ID NO: 363318 - RNA, 22 nt, Homo sapiens
gugguaaaauggcauagagcua

SEQ ID NO: 363319 - RNA, 22 nt, Homo sapiens
guggugucuuguuuaauauaua

SEQ ID NO: 363320 - RNA, 22 nt, Homo sapiens
gugguucuagaauugaguaucc

SEQ ID NO: 363321 - RNA, 22 nt, Homo sapiens
gugguuuucaacuccaccugca

SEQ ID NO: 363322 - RNA, 22 nt, Homo sapiens
gugguuuuuaaaguaccugugg

SEQ ID NO: 363323 - RNA, 22 nt, Homo sapiens
guguaaaucugcugugaacauu

SEQ ID NO: 363324 - RNA, 22 nt, Homo sapiens
guguaauacacacauauaugca

SEQ ID NO: 363325 - RNA, 22 nt, Homo sapiens
guguagagaaauagccugaagg

SEQ ID NO: 363326 - RNA, 22 nt, Homo sapiens
guguauacauagaauuguguau

SEQ ID NO: 363327 - RNA, 22 nt, Homo sapiens
guguauauccuauuaguucugu

SEQ ID NO: 363328 - RNA, 22 nt, Homo sapiens
gugucacuguauaauauuuauu

SEQ ID NO: 363329 - RNA, 22 nt, Homo sapiens
gugucaguggggagugaucuuc

SEQ ID NO: 363330 - RNA, 22 nt, Homo sapiens
gugugacugcucuauuagggcg

SEQ ID NO: 363331 - RNA, 22 nt, Homo sapiens
gugugauguaaagaacugggga

SEQ ID NO: 363332 - RNA, 22 nt, Homo sapiens
uauugcaacagaagaaagaguc

SEQ ID NO: 363333 - RNA, 22 nt, Homo sapiens
uauugcaauuggggaaacuggg

SEQ ID NO: 363334 - RNA, 23 nt, Homo sapiens
uauugcacuaugguaacccuuuu

SEQ ID NO: 363335 - RNA, 22 nt, Homo sapiens
uauugcagugagauccaucugg

SEQ ID NO: 363336 - RNA, 22 nt, Homo sapiens
uauugcccugcuuuguucuaaa

SEQ ID NO: 363337 - RNA, 22 nt, Homo sapiens
uauugcuuaugaugcugaauua

SEQ ID NO: 363338 - RNA, 22 nt, Homo sapiens
uauuguacauguuauagauuuu

SEQ ID NO: 363339 - RNA, 22 nt, Homo sapiens
uauugugcauguugaauaacua

SEQ ID NO: 363340 - RNA, 22 nt, Homo sapiens
uauuguuuuucccaggagucua

SEQ ID NO: 363341 - RNA, 22 nt, Homo sapiens
uauuugauugacuuuagcagga

SEQ ID NO: 363342 - RNA, 22 nt, Homo sapiens
uauuuggauagucuggaaaaaa

SEQ ID NO: 363343 - RNA, 22 nt, Homo sapiens
uauuugguagcuauuuugcagu

SEQ ID NO: 363344 - RNA, 22 nt, Homo sapiens
ucaaaaccucagagaguagagc

SEQ ID NO: 363345 - RNA, 22 nt, Homo sapiens
ucaaacugcuugaggccauuua

SEQ ID NO: 363346 - RNA, 20 nt, Homo sapiens
ucaaagacauggcugucaga

SEQ ID NO: 363347 - RNA, 22 nt, Homo sapiens
ucaaaguauucuucugagaacc

SEQ ID NO: 363348 - RNA, 21 nt, Homo sapiens
ucaaaguguucuuuuguugaa

SEQ ID NO: 363349 - RNA, 22 nt, Homo sapiens
ucaaaugauucagaagccaccu

SEQ ID NO: 363350 - RNA, 22 nt, Homo sapiens
ucaacacaguuaaauggggaaa

SEQ ID NO: 363351 - RNA, 22 nt, Homo sapiens
ucaacauugcugucaggcaucu

SEQ ID NO: 363352 - RNA, 21 nt, Homo sapiens
ucaacccuugcgucaccaagc

SEQ ID NO: 363353 - RNA, 22 nt, Homo sapiens
ucaagaccucacauagaggaga

SEQ ID NO: 363354 - RNA, 22 nt, Homo sapiens
ucaagcaauucuccucucagcc

SEQ ID NO: 363355 - RNA, 22 nt, Homo sapiens
ucaagcaauucuccugccucag

SEQ ID NO: 363356 - RNA, 22 nt, Homo sapiens
ucaagcaauucugcugccucag

SEQ ID NO: 363357 - RNA, 19 nt, Homo sapiens
ucaagcuauucuccugccu

SEQ ID NO: 363358 - RNA, 22 nt, Homo sapiens
ucaaggcacauuugacauuuuc

SEQ ID NO: 363359 - RNA, 20 nt, Homo sapiens
ucaaggcacgaauaaaaguu

SEQ ID NO: 363360 - RNA, 22 nt, Homo sapiens
ucaaggcacuagcugagcugca

SEQ ID NO: 363361 - RNA, 20 nt, Homo sapiens
ucaaggcaggaacuguacau

SEQ ID NO: 363362 - RNA, 22 nt, Homo sapiens
ucaauguaucuccaagaauuga

SEQ ID NO: 363363 - RNA, 22 nt, Homo sapiens
ucaauugcaucaacaguguaca

SEQ ID NO: 363364 - RNA, 18 nt, Homo sapiens
ucacaaccacagugcugu

SEQ ID NO: 363365 - RNA, 22 nt, Homo sapiens
ucacacuguuuugauuauuaua

SEQ ID NO: 363366 - RNA, 23 nt, Homo sapiens
ucacacuuaagagaaaugcagcu

SEQ ID NO: 363367 - RNA, 22 nt, Homo sapiens
ucacagacauugaggggaccuu

SEQ ID NO: 363368 - RNA, 22 nt, Homo sapiens
ucacagaugcuugacccauuuc

SEQ ID NO: 363369 - RNA, 19 nt, Homo sapiens
ucacaggguugacuugagg

SEQ ID NO: 363370 - RNA, 22 nt, Homo sapiens
ucacagucugcgugaugagaca

SEQ ID NO: 363371 - RNA, 22 nt, Homo sapiens
ucacagugaguggaguggggug

SEQ ID NO: 363372 - RNA, 23 nt, Homo sapiens
ucacaguggcugcuuaauuguga

SEQ ID NO: 363373 - RNA, 23 nt, Homo sapiens
ucacaguuacuuuugcaucaacc

SEQ ID NO: 363374 - RNA, 22 nt, Homo sapiens
ucacaguuggccuggccuuuua

SEQ ID NO: 363375 - RNA, 22 nt, Homo sapiens
ucacauggauuaacucauuuau

SEQ ID NO: 363376 - RNA, 18 nt, Homo sapiens
ucacauggccgagagaga

SEQ ID NO: 363377 - RNA, 22 nt, Homo sapiens
ucacaugugaagauugggagua

SEQ ID NO: 363378 - RNA, 22 nt, Homo sapiens
ucacauuguacaaacagguaag

SEQ ID NO: 363379 - RNA, 19 nt, Homo sapiens
ucaccaguacacaauacaa

SEQ ID NO: 363380 - RNA, 22 nt, Homo sapiens
ucacccacacaggagacaggga

SEQ ID NO: 363381 - RNA, 22 nt, Homo sapiens
ucacccugacaugcggccgaac

SEQ ID NO: 363382 - RNA, 18 nt, Homo sapiens
ucaccuugcuuuuagaac

SEQ ID NO: 363383 - RNA, 22 nt, Homo sapiens
ucacuaaagaaaauggcaugga

SEQ ID NO: 363384 - RNA, 22 nt, Homo sapiens
ucacugcacuucaggcuuucuc

SEQ ID NO: 363385 - RNA, 22 nt, Homo sapiens
ucacugcgaccucugccucccg

SEQ ID NO: 363386 - RNA, 22 nt, Homo sapiens
ucacugugguuggaaggcuuaa

SEQ ID NO: 363387 - RNA, 22 nt, Homo sapiens
ucacugugguuuugaugugcau

SEQ ID NO: 363388 - RNA, 22 nt, Homo sapiens
ucacuuuguuuuuggauaaguu

SEQ ID NO: 363389 - RNA, 22 nt, Homo sapiens
ucagaaccuccuagcaguguuc

SEQ ID NO: 363390 - RNA, 22 nt, Homo sapiens
ucagaacugauacuagaacuuu

SEQ ID NO: 363391 - RNA, 21 nt, Homo sapiens
ucagaagcucccagggaggac

SEQ ID NO: 363392 - RNA, 22 nt, Homo sapiens
ucagagucuagaucacucacug

SEQ ID NO: 363393 - RNA, 22 nt, Homo sapiens
ucagaguggagucugcagccuu

SEQ ID NO: 363394 - RNA, 22 nt, Homo sapiens
ucagaucacuggcgcuggcgga

SEQ ID NO: 363395 - RNA, 22 nt, Homo sapiens
ucagaucuucagcaggggcccc

SEQ ID NO: 363396 - RNA, 22 nt, Homo sapiens
ucagaugaucugguaagaacuu

SEQ ID NO: 363397 - RNA, 22 nt, Homo sapiens
ucagcaaugcugcacucuacug

SEQ ID NO: 363398 - RNA, 22 nt, Homo sapiens
ucagcgcauggucgugcggcau

SEQ ID NO: 363399 - RNA, 21 nt, Homo sapiens
ucagcucaucacugccuggag

SEQ ID NO: 363400 - RNA, 21 nt, Homo sapiens
ucagggaccugcuguacugau

SEQ ID NO: 363401 - RNA, 22 nt, Homo sapiens
ucagguaaucuauuugucuuuu

SEQ ID NO: 363402 - RNA, 23 nt, Homo sapiens
ucagguaggccuagaguauucuu

SEQ ID NO: 363403 - RNA, 19 nt, Homo sapiens
ucugucacuggggguauuc

SEQ ID NO: 363404 - RNA, 22 nt, Homo sapiens
ucugucuuguccucacccuaga

SEQ ID NO: 363405 - RNA, 22 nt, Homo sapiens
ucugugcauuacacuuuucuca

SEQ ID NO: 363406 - RNA, 22 nt, Homo sapiens
ucuguggucagaguccuuggcc

SEQ ID NO: 363407 - RNA, 22 nt, Homo sapiens
ucuguuguuaucauaauauuga

SEQ ID NO: 363408 - RNA, 22 nt, Homo sapiens
ucuuaggugggccaucacccca

SEQ ID NO: 363409 - RNA, 19 nt, Homo sapiens
ucuugcacaugugaacuca

SEQ ID NO: 363410 - RNA, 22 nt, Homo sapiens
ucuuggccaugaauggcaaggc

SEQ ID NO: 363411 - RNA, 22 nt, Homo sapiens
ucuugguuaggggaaauaggca

SEQ ID NO: 363412 - RNA, 22 nt, Homo sapiens
ucuugguuuauugugguaugaa

SEQ ID NO: 363413 - RNA, 22 nt, Homo sapiens
ucuuuaguuaagggacauuuua

SEQ ID NO: 363414 - RNA, 15 nt, Homo sapiens
ucuuuaguuuuucuu

SEQ ID NO: 363415 - RNA, 22 nt, Homo sapiens
ucuuugauguucugaaagaugg

SEQ ID NO: 363416 - RNA, 19 nt, Homo sapiens
ucuuugcuuuucuaagagg

SEQ ID NO: 363417 - RNA, 22 nt, Homo sapiens
ucuuuggauggaaauuggaguc

SEQ ID NO: 363418 - RNA, 22 nt, Homo sapiens
ucuuuggguguauuucacagcc

SEQ ID NO: 363419 - RNA, 22 nt, Homo sapiens
ucuuugguaggaguaggaggcc

SEQ ID NO: 363420 - RNA, 22 nt, Homo sapiens
ucuuugguauugugaauagugu

SEQ ID NO: 363421 - RNA, 21 nt, Homo sapiens
ucuuuggucaccaguuuucau

SEQ ID NO: 363422 - RNA, 22 nt, Homo sapiens
ucuuugguuagguuuaguugau

SEQ ID NO: 363423 - RNA, 22 nt, Homo sapiens
ucuuugguucugugcagccuau

SEQ ID NO: 363424 - RNA, 22 nt, Homo sapiens
ucuuugguucuguuuauguaau

SEQ ID NO: 363425 - RNA, 22 nt, Homo sapiens
ucuuuguguucaggagccacgu

SEQ ID NO: 363426 - RNA, 22 nt, Homo sapiens
ugaaacacacauugcccuuuau

SEQ ID NO: 363427 - RNA, 18 nt, Homo sapiens
ugaaacacauuuuuuccu

SEQ ID NO: 363428 - RNA, 22 nt, Homo sapiens
ugaaacauacacucugaugggg

SEQ ID NO: 363429 - RNA, 22 nt, Homo sapiens
ugaaagacacagaaguugccca

SEQ ID NO: 363430 - RNA, 22 nt, Homo sapiens
ugaaaguaauugcaguuuuuac

SEQ ID NO: 363431 - RNA, 22 nt, Homo sapiens
ugaaauacuuuggcucuuuguu

SEQ ID NO: 363432 - RNA, 22 nt, Homo sapiens
ugagguguauugggggaaauuc

SEQ ID NO: 363433 - RNA, 22 nt, Homo sapiens
ugagguguuaacuuuacuuuua

SEQ ID NO: 363434 - RNA, 22 nt, Homo sapiens
ugagguuggggucagggcuagc

SEQ ID NO: 363435 - RNA, 22 nt, Homo sapiens
ugagguugucagugucauucuu

SEQ ID NO: 363436 - RNA, 22 nt, Homo sapiens
ugaguagcuaagacgauaggca

SEQ ID NO: 363437 - RNA, 22 nt, Homo sapiens
ugaguagucagugggcaggaag

SEQ ID NO: 363438 - RNA, 22 nt, Homo sapiens
ugaguauguaggaugugucuua

SEQ ID NO: 363439 - RNA, 22 nt, Homo sapiens
ugagugaaggggcucuguugug

SEQ ID NO: 363440 - RNA, 21 nt, Homo sapiens
ugagugcugagugaggguuga

SEQ ID NO: 363441 - RNA, 22 nt, Homo sapiens
ugaguguccaccccuuucacag

SEQ ID NO: 363442 - RNA, 22 nt, Homo sapiens
ugagugugacuuagcagaagga

SEQ ID NO: 363443 - RNA, 22 nt, Homo sapiens
ugaguucaugcuuguaguucua

SEQ ID NO: 363444 - RNA, 22 nt, Homo sapiens
ugaguucuuuuacauuuugaau

SEQ ID NO: 363445 - RNA, 22 nt, Homo sapiens
ugaguuguugcauucuuggugu

SEQ ID NO: 363446 - RNA, 22 nt, Homo sapiens
ugauaacauuucuucugguaca

SEQ ID NO: 363447 - RNA, 22 nt, Homo sapiens
ugauaagaaauuguucauguag

SEQ ID NO: 363448 - RNA, 22 nt, Homo sapiens
ugauaagugagauagcaaguga

SEQ ID NO: 363449 - RNA, 22 nt, Homo sapiens
ugauaauuuugucagguuuugg

SEQ ID NO: 363450 - RNA, 22 nt, Homo sapiens
ugauaucugaauagauacacaa

SEQ ID NO: 363451 - RNA, 22 nt, Homo sapiens
ugauaugaaguuagcuggcugu

SEQ ID NO: 363452 - RNA, 22 nt, Homo sapiens
ugauauguaacuacuccuuaua

SEQ ID NO: 363453 - RNA, 22 nt, Homo sapiens
ugauaugucacuugaucauggu

SEQ ID NO: 363454 - RNA, 22 nt, Homo sapiens
ugauaugugaguauaugguuau

SEQ ID NO: 363455 - RNA, 22 nt, Homo sapiens
ugauauguggauucagcucaaa

SEQ ID NO: 363456 - RNA, 22 nt, Homo sapiens
ugauauguguaaacaauguaua

SEQ ID NO: 363457 - RNA, 22 nt, Homo sapiens
ugauauguuagaaucuugcaag

SEQ ID NO: 363458 - RNA, 20 nt, Homo sapiens
ugauauuucuggaaguggag

SEQ ID NO: 363459 - RNA, 22 nt, Homo sapiens
ugaucugucacuuaucacauuu

SEQ ID NO: 363460 - RNA, 22 nt, Homo sapiens
ugaugguccauaguucauggua

SEQ ID NO: 363461 - RNA, 22 nt, Homo sapiens
ugaugguuuuauuaauaggacc

SEQ ID NO: 363462 - RNA, 21 nt, Homo sapiens
ugauguugaccuaaguaguga

SEQ ID NO: 363463 - RNA, 22 nt, Homo sapiens
ugauugacauucuuuggaguau

SEQ ID NO: 363464 - RNA, 20 nt, Homo sapiens
ugauugaccagagcaguuuu

SEQ ID NO: 363465 - RNA, 22 nt, Homo sapiens
ugauuggagaacaaacugcaua

SEQ ID NO: 363466 - RNA, 22 nt, Homo sapiens
ugauuugucugcaggaauagug

SEQ ID NO: 363467 - RNA, 22 nt, Homo sapiens
ugauuuguuucaggaguuuucu

SEQ ID NO: 363468 - RNA, 19 nt, Homo sapiens
ugcaaagucagugaagggu

SEQ ID NO: 363469 - RNA, 22 nt, Homo sapiens
ugcaaaguccucauucuuaccc

SEQ ID NO: 363470 - RNA, 19 nt, Homo sapiens
ugcaaagucuuuuccuauu

SEQ ID NO: 363471 - RNA, 22 nt, Homo sapiens
ugcaaaucuuguguaguuguga

SEQ ID NO: 363472 - RNA, 22 nt, Homo sapiens
ugcaaaugcugcuauuucucuu

SEQ ID NO: 363473 - RNA, 19 nt, Homo sapiens
ugcaaauucuaaaaacuga

SEQ ID NO: 363474 - RNA, 22 nt, Homo sapiens
ugcaacauguguaccacucugu

SEQ ID NO: 363475 - RNA, 22 nt, Homo sapiens
ugcaagaaucuuucaggcuagc

SEQ ID NO: 363476 - RNA, 22 nt, Homo sapiens
ugcaagacacuguccugggcau

SEQ ID NO: 363477 - RNA, 22 nt, Homo sapiens
ugcaagaggagacuguacucag

SEQ ID NO: 363478 - RNA, 22 nt, Homo sapiens
ugcaaguggauuuuuccccaga

SEQ ID NO: 363479 - RNA, 20 nt, Homo sapiens
ugcaaguugccuuuggaggc

SEQ ID NO: 363480 - RNA, 22 nt, Homo sapiens
ugcaaucauuuggaggagaaga

SEQ ID NO: 363481 - RNA, 18 nt, Homo sapiens
ugcaauggagaugcagcc

SEQ ID NO: 363482 - RNA, 22 nt, Homo sapiens
ugcaaugucuucugaggggagc

SEQ ID NO: 363483 - RNA, 19 nt, Homo sapiens
uuucaauguaaggauggag

SEQ ID NO: 363484 - RNA, 23 nt, Homo sapiens
uuucacagaaggauuguagggcc

SEQ ID NO: 363485 - RNA, 23 nt, Homo sapiens
uuucacaguagcuggaucagccu

SEQ ID NO: 363486 - RNA, 22 nt, Homo sapiens
uuucaccguguuggccaggcug

SEQ ID NO: 363487 - RNA, 17 nt, Homo sapiens
uuucagaguggaagugu

SEQ ID NO: 363488 - RNA, 22 nt, Homo sapiens
uuucagcguggggugcugaaga

SEQ ID NO: 363489 - RNA, 20 nt, Homo sapiens
uuucaguacuuucuacuggc

SEQ ID NO: 363490 - RNA, 22 nt, Homo sapiens
uuucauaguuugcauagggcau

SEQ ID NO: 363491 - RNA, 22 nt, Homo sapiens
uuucauggacgcaaugccuuuu

SEQ ID NO: 363492 - RNA, 22 nt, Homo sapiens
uuucauggcgaggcuucauggg

SEQ ID NO: 363493 - RNA, 22 nt, Homo sapiens
uuucauguuuuucugugaggca

SEQ ID NO: 363494 - RNA, 22 nt, Homo sapiens
uuuccacauggacuuaccuucg

SEQ ID NO: 363495 - RNA, 22 nt, Homo sapiens
uuucccagugguacaguuuaua

SEQ ID NO: 363496 - RNA, 22 nt, Homo sapiens
uuucccuuacuuaaacuuacuc

SEQ ID NO: 363497 - RNA, 22 nt, Homo sapiens
uuuccuggagaaucuuaacaaa

SEQ ID NO: 363498 - RNA, 22 nt, Homo sapiens
uuucuacagggcuugccaggua

SEQ ID NO: 363499 - RNA, 22 nt, Homo sapiens
uuucuauguugaccagucuaga

SEQ ID NO: 363500 - RNA, 22 nt, Homo sapiens
uuucugggggugcugauggaaa

SEQ ID NO: 363501 - RNA, 23 nt, Homo sapiens
uuucuugggcaugcuaugucagu

SEQ ID NO: 363502 - RNA, 22 nt, Homo sapiens
uuucuugguuguauuuagacuu

SEQ ID NO: 363503 - RNA, 22 nt, Homo sapiens
uuugacucacagccuggcugcc

SEQ ID NO: 363504 - RNA, 22 nt, Homo sapiens
uuugacuguggagucgaugcuu

SEQ ID NO: 363505 - RNA, 22 nt, Homo sapiens
uuugagaaugcuaccagagaag

SEQ ID NO: 363506 - RNA, 22 nt, Homo sapiens
uuugagaucuuuagaaucaggc

SEQ ID NO: 363507 - RNA, 22 nt, Homo sapiens
uuugagcuugacucagcuggag

SEQ ID NO: 363508 - RNA, 22 nt, Homo sapiens
uuugaguaggcuuauauuuugg

SEQ ID NO: 363509 - RNA, 23 nt, Homo sapiens
uuugcacuugcuccuucuauggc

SEQ ID NO: 363510 - RNA, 22 nt, Homo sapiens
uuugcaucuuagaaaguucucc

SEQ ID NO: 363511 - RNA, 23 nt, Homo sapiens
uuugccacuuauuagcugggagg

SEQ ID NO: 363512 - RNA, 22 nt, Homo sapiens
uuugcugagucugacuucaugg

SEQ ID NO: 363513 - RNA, 22 nt, Homo sapiens
uuugcuuaguaaauguagaaaa

SEQ ID NO: 363514 - RNA, 22 nt, Homo sapiens
uuugcuucacuguuuggcaaaa

SEQ ID NO: 363515 - RNA, 22 nt, Homo sapiens
uuuggaaugaaacagcagagcc

SEQ ID NO: 363516 - RNA, 22 nt, Homo sapiens
uuuggcauuaagaugcuguauc

SEQ ID NO: 363517 - RNA, 22 nt, Homo sapiens
uuuggcauuuaaauaugcaugg

SEQ ID NO: 363518 - RNA, 22 nt, Homo sapiens
uuuggcauuugaguuuguagga

SEQ ID NO: 363519 - RNA, 22 nt, Homo sapiens
uuuggcauuuuacuacucaaau

SEQ ID NO: 363520 - RNA, 18 nt, Homo sapiens
uuuggcuguucaugacuc

SEQ ID NO: 363521 - RNA, 22 nt, Homo sapiens
uuuggguuuuauguaacagcua

SEQ ID NO: 363522 - RNA, 18 nt, Homo sapiens
uuugguccuuuauaaaca

SEQ ID NO: 363523 - RNA, 22 nt, Homo sapiens
uuugguuauuugaaacuagcau

SEQ ID NO: 363524 - RNA, 22 nt, Homo sapiens
uuugguugccucuaugagccug

SEQ ID NO: 363525 - RNA, 22 nt, Homo sapiens
uuugguuuuuguuaucacucau

SEQ ID NO: 363526 - RNA, 22 nt, Homo sapiens
uuuguaauaccugaggcugggu

SEQ ID NO: 363527 - RNA, 22 nt, Homo sapiens
uuuguacuucauugguucuacu

SEQ ID NO: 363528 - RNA, 22 nt, Homo sapiens
uuuguacuugaaacccagggcc

SEQ ID NO: 363529 - RNA, 22 nt, Homo sapiens
uuuguacuugaagaaucuuuau

SEQ ID NO: 363530 - RNA, 22 nt, Homo sapiens
uuuguacuugguguucuggaaa

SEQ ID NO: 363531 - RNA, 21 nt, Homo sapiens
uuuguaguagcaugauuuaua

SEQ ID NO: 363532 - RNA, 23 nt, Homo sapiens
uuuguaguagcaugauuuauaau

SEQ ID NO: 363533 - RNA, 20 nt, Homo sapiens
uuuguaucucuggguacugg

SEQ ID NO: 363534 - RNA, 22 nt, Homo sapiens
uuugucccccguaguucauaua

SEQ ID NO: 363535 - RNA, 22 nt, Homo sapiens
uuuguccugccaugguuuauuu

SEQ ID NO: 363536 - RNA, 22 nt, Homo sapiens
ccaguuuucaagauaaugguuu

SEQ ID NO: 363537 - RNA, 22 nt, Homo sapiens
ccauggcuucugcauucuguca

SEQ ID NO: 363538 - RNA, 18 nt, Homo sapiens
ccauucaacagauuuguc

SEQ ID NO: 363539 - RNA, 22 nt, Homo sapiens
ccauugcacucuggccuaggug

SEQ ID NO: 363540 - RNA, 22 nt, Homo sapiens
cccacaguggccucauauccuu

SEQ ID NO: 363541 - RNA, 22 nt, Homo sapiens
cccagaguucuuaaauacugag

SEQ ID NO: 363542 - RNA, 22 nt, Homo sapiens
cccagcguucggcauggcugag

SEQ ID NO: 363543 - RNA, 22 nt, Homo sapiens
ccccagugguugcaacagcaga

SEQ ID NO: 363544 - RNA, 22 nt, Homo sapiens
ccccaguguguaaaggccuugc

SEQ ID NO: 363545 - RNA, 22 nt, Homo sapiens
ccccauuugaacuccuucaacu

SEQ ID NO: 363546 - RNA, 22 nt, Homo sapiens
ccccugaaacucacucauuauc

SEQ ID NO: 363547 - RNA, 22 nt, Homo sapiens
ccccuguaaacuggcuucccug

SEQ ID NO: 363548 - RNA, 22 nt, Homo sapiens
cccgggcugaaaucagauuugu

SEQ ID NO: 363549 - RNA, 22 nt, Homo sapiens
cccuaagacagugaggggugca

SEQ ID NO: 363550 - RNA, 22 nt, Homo sapiens
cccucgagaaaccaucugcuga

SEQ ID NO: 363551 - RNA, 22 nt, Homo sapiens
cccugagagcagggucuuucuc

SEQ ID NO: 363552 - RNA, 19 nt, Homo sapiens
cccuggcacauggaaaaug

SEQ ID NO: 363553 - RNA, 22 nt, Homo sapiens
cccugugaauauuaccuuauuu

SEQ ID NO: 363554 - RNA, 22 nt, Homo sapiens
cccuguguuguucaaggaucug

SEQ ID NO: 363555 - RNA, 22 nt, Homo sapiens
cccuucauucaaggguugugag

SEQ ID NO: 363556 - RNA, 22 nt, Homo sapiens
ccuaaguaauggcaguuuuugc

SEQ ID NO: 363557 - RNA, 22 nt, Homo sapiens
ccucauugcuaucccaggcuga

SEQ ID NO: 363558 - RNA, 22 nt, Homo sapiens
ccuccauuugugucaggaaguc

SEQ ID NO: 363559 - RNA, 22 nt, Homo sapiens
ccugagacuugagggggcuucu

SEQ ID NO: 363560 - RNA, 22 nt, Homo sapiens
ccuggaucauugucauucccaa

SEQ ID NO: 363561 - RNA, 22 nt, Homo sapiens
ccuggguuacaggugugagcca

SEQ ID NO: 363562 - RNA, 22 nt, Homo sapiens
ccugguguuuugauggucgggu

SEQ ID NO: 363563 - RNA, 22 nt, Homo sapiens
ccuuggcacuacugacauugua

SEQ ID NO: 363564 - RNA, 22 nt, Homo sapiens
ccuugguugugcuucaacuucu

SEQ ID NO: 363565 - RNA, 22 nt, Homo sapiens
ccuuuguggggcgguggguaau

SEQ ID NO: 363566 - RNA, 22 nt, Homo sapiens
ccuuuuugaguugccagaguuc

SEQ ID NO: 363567 - RNA, 22 nt, Homo sapiens
cgcuggugucuaagcgacagcu

SEQ ID NO: 363568 - RNA, 22 nt, Homo sapiens
cggucacagugauucaaggguc

SEQ ID NO: 363569 - RNA, 16 nt, Homo sapiens
cuaaaaugucuacuug

SEQ ID NO: 363570 - RNA, 22 nt, Homo sapiens
cuaaagugcuuaaaaucucauu

SEQ ID NO: 363571 - RNA, 19 nt, Homo sapiens
cuaaaugggucccuagugg

SEQ ID NO: 363572 - RNA, 22 nt, Homo sapiens
cuaacacagagguuuauuucuc

SEQ ID NO: 363573 - RNA, 22 nt, Homo sapiens
cuaacuaugucucaggaugucc

SEQ ID NO: 363574 - RNA, 22 nt, Homo sapiens
cuaagugaacugucacugagaa

SEQ ID NO: 363575 - RNA, 22 nt, Homo sapiens
cuaaugcagucaggagaaggaa

SEQ ID NO: 363576 - RNA, 22 nt, Homo sapiens
cuacagcacugagcugugugca

SEQ ID NO: 363577 - RNA, 22 nt, Homo sapiens
cuacagguaugaaagggaguau

SEQ ID NO: 363578 - RNA, 22 nt, Homo sapiens
cuacagugggucuguaguccuu

SEQ ID NO: 363579 - RNA, 23 nt, Homo sapiens
cuacuagucaagucuuuuccagu

SEQ ID NO: 363580 - RNA, 22 nt, Homo sapiens
cuagauuauccaacuuauuagc

SEQ ID NO: 363581 - RNA, 22 nt, Homo sapiens
cuagauuguuuccauaaugaca

SEQ ID NO: 363582 - RNA, 22 nt, Homo sapiens
cuagcaggcaagauaagauuca

SEQ ID NO: 363583 - RNA, 22 nt, Homo sapiens
cuagcuuuugauguaaagugag

SEQ ID NO: 363584 - RNA, 22 nt, Homo sapiens
cuaguaaugucugucuuaugga

SEQ ID NO: 363585 - RNA, 18 nt, Homo sapiens
cuaguguuucuugaauca

SEQ ID NO: 363586 - RNA, 22 nt, Homo sapiens
cuauaugucuguuuugguacca

SEQ ID NO: 363587 - RNA, 22 nt, Homo sapiens
cuauggccugcuuagaacauac

SEQ ID NO: 363588 - RNA, 22 nt, Homo sapiens
cuauggguuauaauucauuagu

SEQ ID NO: 363589 - RNA, 22 nt, Homo sapiens
cuaugguaggggcuggaggaag

SEQ ID NO: 363590 - RNA, 22 nt, Homo sapiens
cuauuugguuggugaaaaaagu

SEQ ID NO: 363591 - RNA, 19 nt, Homo sapiens
cucaaagugguauuuggag

SEQ ID NO: 363592 - RNA, 22 nt, Homo sapiens
cucacagucagaagggacuugc

SEQ ID NO: 363593 - RNA, 22 nt, Homo sapiens
cucaccuugugauccaccggcc

SEQ ID NO: 363594 - RNA, 22 nt, Homo sapiens
cucacggcccugcgcacuggca

SEQ ID NO: 363595 - RNA, 22 nt, Homo sapiens
cucagagcacaguuuaugacag

SEQ ID NO: 363596 - RNA, 22 nt, Homo sapiens
cucaggcacucugauuccagug

SEQ ID NO: 363597 - RNA, 20 nt, Homo sapiens
cucagguauuugaggcugca

SEQ ID NO: 363598 - RNA, 22 nt, Homo sapiens
cucaguguucccauucuaccuu

SEQ ID NO: 363599 - RNA, 22 nt, Homo sapiens
cucauggaauacuucacagcca

SEQ ID NO: 363600 - RNA, 22 nt, Homo sapiens
cucauugcaaucucugccuccc

SEQ ID NO: 363601 - RNA, 22 nt, Homo sapiens
cuccacugagcaggugggaggc

SEQ ID NO: 363602 - RNA, 22 nt, Homo sapiens
cuccaggugagguuaagggacu

SEQ ID NO: 363603 - RNA, 22 nt, Homo sapiens
cucccagugacccaggaacagg

SEQ ID NO: 363604 - RNA, 20 nt, Homo sapiens
cucccugacaaauguggaaa

SEQ ID NO: 363605 - RNA, 22 nt, Homo sapiens
cucccugagccagggcuuugac

SEQ ID NO: 363606 - RNA, 22 nt, Homo sapiens
cuccgggugcgucggcgcccug

SEQ ID NO: 363607 - RNA, 20 nt, Homo sapiens
cuccuucauuccuuuggacc

SEQ ID NO: 363608 - RNA, 22 nt, Homo sapiens
cucucaagaugcugggauuaca

SEQ ID NO: 363609 - RNA, 22 nt, Homo sapiens
cucugguggaagcagggggcaa

SEQ ID NO: 363610 - RNA, 22 nt, Homo sapiens
cucugguuaaggcugaacuaua

SEQ ID NO: 363611 - RNA, 22 nt, Homo sapiens
cucugguuucgcaggaaauaga

SEQ ID NO: 363612 - RNA, 22 nt, Homo sapiens
cucuuagauuagccauccuaau

SEQ ID NO: 363613 - RNA, 22 nt, Homo sapiens
cucuuuggaugccuuaggguua

SEQ ID NO: 363614 - RNA, 19 nt, Homo sapiens
cucuuuggugucucuucuu

SEQ ID NO: 363615 - RNA, 22 nt, Homo sapiens
cugaaagguauacgcuuguuau

SEQ ID NO: 363616 - RNA, 22 nt, Homo sapiens
cugaaggcagguagaauagaga

SEQ ID NO: 363617 - RNA, 22 nt, Homo sapiens
cugaaucauugguuaugaguac

SEQ ID NO: 363618 - RNA, 22 nt, Homo sapiens
cugaauguccaggcagagguuu

SEQ ID NO: 363619 - RNA, 22 nt, Homo sapiens
cugaauguucuggauggaagag

SEQ ID NO: 363620 - RNA, 22 nt, Homo sapiens
cugacauuguugaucacagcca

SEQ ID NO: 363621 - RNA, 22 nt, Homo sapiens
cugacugugcaugcccagcccc

SEQ ID NO: 363622 - RNA, 22 nt, Homo sapiens
cugacuuuagaacccaaaaagu

SEQ ID NO: 363623 - RNA, 22 nt, Homo sapiens
cugagaaugaugauuuccaguu

SEQ ID NO: 363624 - RNA, 22 nt, Homo sapiens
gcacagaugaggagaggucuca

SEQ ID NO: 363625 - RNA, 22 nt, Homo sapiens
gcacaguggcucccgucuauaa

SEQ ID NO: 363626 - RNA, 22 nt, Homo sapiens
gcaccacugcacucucagcuug

SEQ ID NO: 363627 - RNA, 22 nt, Homo sapiens
gcaccaugguagaauaauggua

SEQ ID NO: 363628 - RNA, 22 nt, Homo sapiens
gcacccugucaaaauggaccaa

SEQ ID NO: 363629 - RNA, 22 nt, Homo sapiens
gcacugagagaagccccaagua

SEQ ID NO: 363630 - RNA, 22 nt, Homo sapiens
gcacugggccacauuuauuuuc

SEQ ID NO: 363631 - RNA, 22 nt, Homo sapiens
gcagaguauagagggcugggcc

SEQ ID NO: 363632 - RNA, 22 nt, Homo sapiens
gcagcagugcccuggauggaaa

SEQ ID NO: 363633 - RNA, 22 nt, Homo sapiens
gcaggaaucuugagaaggauuc

SEQ ID NO: 363634 - RNA, 22 nt, Homo sapiens
gcagguauuagagagccugaaa

SEQ ID NO: 363635 - RNA, 22 nt, Homo sapiens
gcagugcaguggcgcgaucucg

SEQ ID NO: 363636 - RNA, 16 nt, Homo sapiens
gcaguguguuuaauag

SEQ ID NO: 363637 - RNA, 22 nt, Homo sapiens
gcauaaagcuaauaagacgaag

SEQ ID NO: 363638 - RNA, 20 nt, Homo sapiens
gcauaugucuuuauagcaga

SEQ ID NO: 363639 - RNA, 17 nt, Homo sapiens
gcauauguugaaccagc

SEQ ID NO: 363640 - RNA, 22 nt, Homo sapiens
gcauauguuuggguguguauau

SEQ ID NO: 363641 - RNA, 22 nt, Homo sapiens
gcaucacagggagacaggccuc

SEQ ID NO: 363642 - RNA, 22 nt, Homo sapiens
gcaugaugaauaauaucacaag

SEQ ID NO: 363643 - RNA, 22 nt, Homo sapiens
gcauggagcauacauuucuguu

SEQ ID NO: 363644 - RNA, 22 nt, Homo sapiens
gcauugcacuuggcauagacug

SEQ ID NO: 363645 - RNA, 22 nt, Homo sapiens
gccaaaaugcugggauuacagg

SEQ ID NO: 363646 - RNA, 22 nt, Homo sapiens
gccaagauugguuuaauauucc

SEQ ID NO: 363647 - RNA, 20 nt, Homo sapiens
gccacaguuaagcuucugcc

SEQ ID NO: 363648 - RNA, 19 nt, Homo sapiens
gccaccuggugcguguucu

SEQ ID NO: 363649 - RNA, 22 nt, Homo sapiens
gccauggugucuuauuuuugug

SEQ ID NO: 363650 - RNA, 22 nt, Homo sapiens
gcccagauguuuggggucaugg

SEQ ID NO: 363651 - RNA, 22 nt, Homo sapiens
gccccaguacaggcuccuuaga

SEQ ID NO: 363652 - RNA, 22 nt, Homo sapiens
gcccugauacauucuucugccu

SEQ ID NO: 363653 - RNA, 22 nt, Homo sapiens
gcccuguugcccaggcuggagu

SEQ ID NO: 363654 - RNA, 22 nt, Homo sapiens
gcccuuugugucuggcuggggu

SEQ ID NO: 363655 - RNA, 22 nt, Homo sapiens
gccuagagaguuaucaggcugu

SEQ ID NO: 363656 - RNA, 22 nt, Homo sapiens
gcgcagugggcugugccaucca

SEQ ID NO: 363657 - RNA, 23 nt, Homo sapiens
gcuaggagagaugaaacacaggu

SEQ ID NO: 363658 - RNA, 22 nt, Homo sapiens
gcuaguguuugccagcguagcc

SEQ ID NO: 363659 - RNA, 22 nt, Homo sapiens
gcuaugucuguugcucuugggc

SEQ ID NO: 363660 - RNA, 22 nt, Homo sapiens
gcucaguuuccucagcugcaaa

SEQ ID NO: 363661 - RNA, 22 nt, Homo sapiens
gcuccuuugaguagcuucugug

SEQ ID NO: 363662 - RNA, 22 nt, Homo sapiens
gcugaguaguauuucauuguau

SEQ ID NO: 363663 - RNA, 22 nt, Homo sapiens
gcugcuguggcagauuggauuc

SEQ ID NO: 363664 - RNA, 22 nt, Homo sapiens
gcugcuguuuaguuucuccugg

SEQ ID NO: 363665 - RNA, 22 nt, Homo sapiens
gcuggcuuucuccugaucucag

SEQ ID NO: 363666 - RNA, 22 nt, Homo sapiens
gcuggguucagagugggcugcg

SEQ ID NO: 363667 - RNA, 22 nt, Homo sapiens
gcugguauuacaggcaugagcc

SEQ ID NO: 363668 - RNA, 22 nt, Homo sapiens
gcuggugaaggcugaaaagugg

SEQ ID NO: 363669 - RNA, 22 nt, Homo sapiens
gcugguguugugaaucaggccg

SEQ ID NO: 363670 - RNA, 22 nt, Homo sapiens
gcugucuggagucuguucaaug

SEQ ID NO: 363671 - RNA, 20 nt, Homo sapiens
gcugugcuuaauacacuuuc

SEQ ID NO: 363672 - RNA, 22 nt, Homo sapiens
gcuguugcuauuauuccgagaa

SEQ ID NO: 363673 - RNA, 19 nt, Homo sapiens
gcuucuugaggacgaugac

SEQ ID NO: 363674 - RNA, 22 nt, Homo sapiens
gcuugguccccacccaaaucgc

SEQ ID NO: 363675 - RNA, 22 nt, Homo sapiens
gcuuguguuugcuccccagaau

SEQ ID NO: 363676 - RNA, 22 nt, Homo sapiens
gcuuuggcauguagauguaugg

SEQ ID NO: 363677 - RNA, 19 nt, Homo sapiens
gcuuuguggggaaggagcc

SEQ ID NO: 363678 - RNA, 21 nt, Homo sapiens
gcuuuuucggaagucuuuggc

SEQ ID NO: 363679 - RNA, 19 nt, Homo sapiens
ggaaaugucuauuaagauc

SEQ ID NO: 363680 - RNA, 22 nt, Homo sapiens
ggaagacaguguggugauuccu

SEQ ID NO: 363681 - RNA, 22 nt, Homo sapiens
ggaagguaauugucagcucaua

SEQ ID NO: 363682 - RNA, 22 nt, Homo sapiens
ggaauauaaaacuuuugacagg

SEQ ID NO: 363683 - RNA, 22 nt, Homo sapiens
ggaaugggauuugaagucuggc

SEQ ID NO: 363684 - RNA, 22 nt, Homo sapiens
ggaaugugugucaugcuuuugc

SEQ ID NO: 363685 - RNA, 22 nt, Homo sapiens
ggacacaucaugugaccaaggu

SEQ ID NO: 363686 - RNA, 22 nt, Homo sapiens
ggacagugaaugccacuccucc

SEQ ID NO: 363687 - RNA, 22 nt, Homo sapiens
ggacuagggacauggggagcug

SEQ ID NO: 363688 - RNA, 22 nt, Homo sapiens
ggagagcuaggcagagguuugu

SEQ ID NO: 363689 - RNA, 22 nt, Homo sapiens
ggagaugauuaugaaucacuua

SEQ ID NO: 363690 - RNA, 22 nt, Homo sapiens
ggaggcuaguaaaaagguagaa

SEQ ID NO: 363691 - RNA, 22 nt, Homo sapiens
ggaguaggaaggaaauguuaaa

SEQ ID NO: 363692 - RNA, 22 nt, Homo sapiens
ggaguaggcuguccggcaccca

SEQ ID NO: 363693 - RNA, 22 nt, Homo sapiens
ggagucuugcuauguugccaag

SEQ ID NO: 363694 - RNA, 22 nt, Homo sapiens
ggaguguguuuuccaacuuggu

SEQ ID NO: 363695 - RNA, 22 nt, Homo sapiens
ggaguuuaagucuugugcaucu

SEQ ID NO: 363696 - RNA, 22 nt, Homo sapiens
ggauacaucuggacagccgaau

SEQ ID NO: 363697 - RNA, 22 nt, Homo sapiens
ggaucauaugauagcucaauuu

SEQ ID NO: 363698 - RNA, 22 nt, Homo sapiens
ggaugcauuuuugguugucaca

SEQ ID NO: 363699 - RNA, 22 nt, Homo sapiens
ggauggcauuucuuuagcuuuu

SEQ ID NO: 363700 - RNA, 23 nt, Homo sapiens
ggauucaucuguuuguucgcugu

SEQ ID NO: 363701 - RNA, 22 nt, Homo sapiens
ggauugcuuaagaaguuucauu

SEQ ID NO: 363702 - RNA, 22 nt, Homo sapiens
ggcaaaauggccagugggucac

SEQ ID NO: 363703 - RNA, 21 nt, Homo sapiens
ggcaagaaacacaaucaagua

SEQ ID NO: 363704 - RNA, 22 nt, Homo sapiens
ggcaagaaagaaaucaucuguc

SEQ ID NO: 363705 - RNA, 22 nt, Homo sapiens
ggcaagaaccucaauuaccuuu

SEQ ID NO: 363706 - RNA, 17 nt, Homo sapiens
ggcaagaaguggaacuc

SEQ ID NO: 363707 - RNA, 23 nt, Homo sapiens
ggcaagaucucagcucacugcaa

SEQ ID NO: 363708 - RNA, 22 nt, Homo sapiens
ggcaaggauguuuuucuggcaa

SEQ ID NO: 363709 - RNA, 22 nt, Homo sapiens
ggcaaguucuaaugauuagaau

SEQ ID NO: 363710 - RNA, 22 nt, Homo sapiens
ggcaaguugcuauucuuuaaug

SEQ ID NO: 363711 - RNA, 22 nt, Homo sapiens
ggcaauauauucugaauucagu

SEQ ID NO: 363712 - RNA, 22 nt, Homo sapiens
ggcacaaugucagcucacugca

SEQ ID NO: 363713 - RNA, 22 nt, Homo sapiens
ggcacaauugcagcaauaaaca

SEQ ID NO: 363714 - RNA, 22 nt, Homo sapiens
ggcacgguggcucacgccugua

SEQ ID NO: 363715 - RNA, 19 nt, Homo sapiens
ggcacugugugagugagga

SEQ ID NO: 363716 - RNA, 22 nt, Homo sapiens
ggcagagucuugcaucuuuaga

SEQ ID NO: 363717 - RNA, 17 nt, Homo sapiens
ggcaggauccaggaucc

SEQ ID NO: 363718 - RNA, 22 nt, Homo sapiens
ggcagguaaggagugggagccu

SEQ ID NO: 363719 - RNA, 22 nt, Homo sapiens
ggcaguggaagugccaguuucu

SEQ ID NO: 363720 - RNA, 22 nt, Homo sapiens
ggcaguguaauaauuuauuaau

SEQ ID NO: 363721 - RNA, 22 nt, Homo sapiens
ggcaugguggugugugccuaua

SEQ ID NO: 363722 - RNA, 21 nt, Homo sapiens
ggcauugugcccuugcucuag

SEQ ID NO: 363723 - RNA, 23 nt, Homo sapiens
ggcauuguggcucacaucuguaa

SEQ ID NO: 363724 - RNA, 22 nt, Homo sapiens
ggccagaugaucuaugaaggaa

SEQ ID NO: 363725 - RNA, 22 nt, Homo sapiens
ggccggguggccauggcugccc

SEQ ID NO: 363726 - RNA, 22 nt, Homo sapiens
ggcgccauugcacuccagccug

SEQ ID NO: 363727 - RNA, 18 nt, Homo sapiens
ggcugguguuuuaguaua

SEQ ID NO: 363728 - RNA, 22 nt, Homo sapiens
gggaaaaugucuauugaaugaa

SEQ ID NO: 363729 - RNA, 22 nt, Homo sapiens
gggaagaaggagugguuuacuc

SEQ ID NO: 363730 - RNA, 22 nt, Homo sapiens
gggaauggaagacauuaugaug

SEQ ID NO: 363731 - RNA, 22 nt, Homo sapiens
gggagguuguauguaugcgggg

SEQ ID NO: 363732 - RNA, 22 nt, Homo sapiens
gggaguguguaggacccagugu

SEQ ID NO: 363733 - RNA, 22 nt, Homo sapiens
gggauguaaaagugggcacauu

SEQ ID NO: 363734 - RNA, 23 nt, Homo sapiens
gggauuguaaaauaugagggcag

SEQ ID NO: 363735 - RNA, 22 nt, Homo sapiens
gggcaaaacuguacugccaagg

SEQ ID NO: 363736 - RNA, 22 nt, Homo sapiens
gggcauugugggcagagggcag

SEQ ID NO: 363737 - RNA, 22 nt, Homo sapiens
gggccagaugcauuuguuauuu

SEQ ID NO: 363738 - RNA, 22 nt, Homo sapiens
gggcuagaauccgcgucucuug

SEQ ID NO: 363739 - RNA, 22 nt, Homo sapiens
ggggcaaaaugccacgagucuc

SEQ ID NO: 363740 - RNA, 22 nt, Homo sapiens
gguaucuuggagagagaaguga

SEQ ID NO: 363741 - RNA, 22 nt, Homo sapiens
gguauguagcaaaagaggugcu

SEQ ID NO: 363742 - RNA, 22 nt, Homo sapiens
ggucacauugcuagcauggguu

SEQ ID NO: 363743 - RNA, 19 nt, Homo sapiens
ggucagcaaagucuagcug

SEQ ID NO: 363744 - RNA, 22 nt, Homo sapiens
ggucaggagaaugguaacugag

SEQ ID NO: 363745 - RNA, 22 nt, Homo sapiens
ggucauggauaagauccagaag

SEQ ID NO: 363746 - RNA, 22 nt, Homo sapiens
ggucauggauguuuauaguaca

SEQ ID NO: 363747 - RNA, 19 nt, Homo sapiens
ggucccucucaagucauuc

SEQ ID NO: 363748 - RNA, 22 nt, Homo sapiens
ggugacugguuuaucuggcagu

SEQ ID NO: 363749 - RNA, 22 nt, Homo sapiens
ggugaggaaaguugaguuucua

SEQ ID NO: 363750 - RNA, 23 nt, Homo sapiens
ggugaggaguacagagucuucau

SEQ ID NO: 363751 - RNA, 22 nt, Homo sapiens
gguggcaaaucugaguggcgcu

SEQ ID NO: 363752 - RNA, 22 nt, Homo sapiens
gguggcuuuuugugauggcuga

SEQ ID NO: 363753 - RNA, 22 nt, Homo sapiens
gguggugguauuucagaaaaug

SEQ ID NO: 363754 - RNA, 22 nt, Homo sapiens
ggugucuuguuuaauacucauu

SEQ ID NO: 363755 - RNA, 22 nt, Homo sapiens
guaaaucucuguuuucauggac

SEQ ID NO: 363756 - RNA, 18 nt, Homo sapiens
guaaauguaucuauugcc

SEQ ID NO: 363757 - RNA, 22 nt, Homo sapiens
guaacccuguaggccuaaagua

SEQ ID NO: 363758 - RNA, 22 nt, Homo sapiens
guaaucucagcuacuugggagc

SEQ ID NO: 363759 - RNA, 22 nt, Homo sapiens
guacaguauaguaauaggauuu

SEQ ID NO: 363760 - RNA, 22 nt, Homo sapiens
guacaugcaugcaugggugugc

SEQ ID NO: 363761 - RNA, 22 nt, Homo sapiens
guacauguaugcaugcaugcau

SEQ ID NO: 363762 - RNA, 22 nt, Homo sapiens
guacccuauggauauagaugaa

SEQ ID NO: 363763 - RNA, 22 nt, Homo sapiens
guagcagaauaucagauaauuu

SEQ ID NO: 363764 - RNA, 22 nt, Homo sapiens
guagcagcuacuaaguugcugu

SEQ ID NO: 363765 - RNA, 22 nt, Homo sapiens
guagcaucauuugcaauuucau

SEQ ID NO: 363766 - RNA, 22 nt, Homo sapiens
guaggcacuggcucagcuuauc

SEQ ID NO: 363767 - RNA, 22 nt, Homo sapiens
guauaaguugacucaaucuuug

SEQ ID NO: 363768 - RNA, 22 nt, Homo sapiens
guaucccuugcuaucugaaucu

SEQ ID NO: 363769 - RNA, 22 nt, Homo sapiens
guaugacacaggaagcuuaacc

SEQ ID NO: 363770 - RNA, 22 nt, Homo sapiens
guaugucuuuauagcagugugg

SEQ ID NO: 363771 - RNA, 22 nt, Homo sapiens
guaugugacuggaacaguagga

SEQ ID NO: 363772 - RNA, 22 nt, Homo sapiens
gucaaguguuuucaaggcuucc

SEQ ID NO: 363773 - RNA, 22 nt, Homo sapiens
gucacaguggccagugauguuc

SEQ ID NO: 363774 - RNA, 22 nt, Homo sapiens
gucacaguguuuguucauccca

SEQ ID NO: 363775 - RNA, 22 nt, Homo sapiens
gucacugagauugguauuaaug

SEQ ID NO: 363776 - RNA, 22 nt, Homo sapiens
gucacugggugcugcgccuguc

SEQ ID NO: 363777 - RNA, 22 nt, Homo sapiens
gucagggagggauagaugauua

SEQ ID NO: 363778 - RNA, 22 nt, Homo sapiens
gucagggagucucuaucagugg

SEQ ID NO: 363779 - RNA, 22 nt, Homo sapiens
gucagugccugucccaggcuuu

SEQ ID NO: 363780 - RNA, 18 nt, Homo sapiens
gucauagaaugaugguuc

SEQ ID NO: 363781 - RNA, 22 nt, Homo sapiens
gucaucaggacgggucaucugc

SEQ ID NO: 363782 - RNA, 22 nt, Homo sapiens
gucauggagggacauaacuaac

SEQ ID NO: 363783 - RNA, 22 nt, Homo sapiens
gucauugaaguggaaucaucca

SEQ ID NO: 363784 - RNA, 22 nt, Homo sapiens
gucauugagucagggaguaucu

SEQ ID NO: 363785 - RNA, 21 nt, Homo sapiens
guccaaaacaguguccaaugc

SEQ ID NO: 363786 - RNA, 22 nt, Homo sapiens
guccaaagugggagaggugggg

SEQ ID NO: 363787 - RNA, 22 nt, Homo sapiens
guccagagaagucauuacuuca

SEQ ID NO: 363788 - RNA, 22 nt, Homo sapiens
gucccaguggaaccuccaagcu

SEQ ID NO: 363789 - RNA, 22 nt, Homo sapiens
gucccugcgauugugggauccu

SEQ ID NO: 363790 - RNA, 22 nt, Homo sapiens
guccugaagaccuuccucugga

SEQ ID NO: 363791 - RNA, 22 nt, Homo sapiens
gucguggagucucuggcuugua

SEQ ID NO: 363792 - RNA, 22 nt, Homo sapiens
gucucacagcuagcugcuuuau

SEQ ID NO: 363793 - RNA, 22 nt, Homo sapiens
gucucuuguuaucauuucugag

SEQ ID NO: 363794 - RNA, 22 nt, Homo sapiens
gucugcaugucauaugauagua

SEQ ID NO: 363795 - RNA, 22 nt, Homo sapiens
gucugguuuuuuauauccucac

SEQ ID NO: 363796 - RNA, 22 nt, Homo sapiens
gucugucuuuugucuuugaaau

SEQ ID NO: 363797 - RNA, 22 nt, Homo sapiens
gucuugaaggcugaguaccugu

SEQ ID NO: 363798 - RNA, 22 nt, Homo sapiens
gucuuuaguugaaacauguggu

SEQ ID NO: 363799 - RNA, 22 nt, Homo sapiens
gucuuugcauguauguucauga

SEQ ID NO: 363800 - RNA, 22 nt, Homo sapiens
uagcaccuuagcauuucuagug

SEQ ID NO: 363801 - RNA, 22 nt, Homo sapiens
uagcacuauguuaucacauacu

SEQ ID NO: 363802 - RNA, 22 nt, Homo sapiens
uagcagaauaacuugccagccu

SEQ ID NO: 363803 - RNA, 22 nt, Homo sapiens
uagcagaauauaccucuuacuu

SEQ ID NO: 363804 - RNA, 22 nt, Homo sapiens
uagcagcagugguguauuuaga

SEQ ID NO: 363805 - RNA, 22 nt, Homo sapiens
uagcagccaggaagggcuggcu

SEQ ID NO: 363806 - RNA, 21 nt, Homo sapiens
uagcagcguuguugcaaaugu

SEQ ID NO: 363807 - RNA, 22 nt, Homo sapiens
uagccgggugugguggaacucc

SEQ ID NO: 363808 - RNA, 22 nt, Homo sapiens
uagccucacaaagugcuuaaga

SEQ ID NO: 363809 - RNA, 22 nt, Homo sapiens
uagccuguggugaauguuucug

SEQ ID NO: 363810 - RNA, 22 nt, Homo sapiens
uagcucagcccagcuaagcuca

SEQ ID NO: 363811 - RNA, 22 nt, Homo sapiens
uagcuccagugggguuacugcu

SEQ ID NO: 363812 - RNA, 17 nt, Homo sapiens
uagcucuauuucuagcc

SEQ ID NO: 363813 - RNA, 22 nt, Homo sapiens
uagcugcauccugugcacucaa

SEQ ID NO: 363814 - RNA, 22 nt, Homo sapiens
uagcugcccagcacgaaguugg

SEQ ID NO: 363815 - RNA, 22 nt, Homo sapiens
uagcuggaguuuuuguuauagg

SEQ ID NO: 363816 - RNA, 22 nt, Homo sapiens
uaggaaguuuucuugcugggcc

SEQ ID NO: 363817 - RNA, 22 nt, Homo sapiens
uaggcaaguugcccaaucucuc

SEQ ID NO: 363818 - RNA, 22 nt, Homo sapiens
uaggcaauggagauagaggaug

SEQ ID NO: 363819 - RNA, 22 nt, Homo sapiens
uaggcacacaucuacuacaaau

SEQ ID NO: 363820 - RNA, 22 nt, Homo sapiens
uagggagugucuucauuuugua

SEQ ID NO: 363821 - RNA, 22 nt, Homo sapiens
uagggcaaggaacaguuaaaaa

SEQ ID NO: 363822 - RNA, 22 nt, Homo sapiens
uagggcuuuccggccugucaga

SEQ ID NO: 363823 - RNA, 22 nt, Homo sapiens
uaggggcacacuucgguuagca

SEQ ID NO: 363824 - RNA, 22 nt, Homo sapiens
uagguagugugugcaugagagg

SEQ ID NO: 363825 - RNA, 22 nt, Homo sapiens
uaggucuuuuagcauaggagcu

SEQ ID NO: 363826 - RNA, 22 nt, Homo sapiens
uaggugaauguaguaagguguu

SEQ ID NO: 363827 - RNA, 22 nt, Homo sapiens
uagguugucaucagucuccacu

SEQ ID NO: 363828 - RNA, 22 nt, Homo sapiens
uaguagcaccucucaugagcuu

SEQ ID NO: 363829 - RNA, 22 nt, Homo sapiens
uaguaguuuuguguauaauaau

SEQ ID NO: 363830 - RNA, 22 nt, Homo sapiens
uagucacacacucaacuuuuca

SEQ ID NO: 363831 - RNA, 22 nt, Homo sapiens
uagucccauaugauuuagugaa

SEQ ID NO: 363832 - RNA, 22 nt, Homo sapiens
uagugaaugucacuggcuguug

SEQ ID NO: 363833 - RNA, 22 nt, Homo sapiens
uagugcaguggcuccaucucag

SEQ ID NO: 363834 - RNA, 21 nt, Homo sapiens
uagugcugaggcaguauggga

SEQ ID NO: 363835 - RNA, 22 nt, Homo sapiens
uagugcugugauuaacauaaug

SEQ ID NO: 363836 - RNA, 20 nt, Homo sapiens
uaguggaaaucagguccucu

SEQ ID NO: 363837 - RNA, 22 nt, Homo sapiens
uaguucauuuuucuugcuuaga

SEQ ID NO: 363838 - RNA, 20 nt, Homo sapiens
uauaacaguuuggacccagu

SEQ ID NO: 363839 - RNA, 22 nt, Homo sapiens
uauacagcaaguuacugugcug

SEQ ID NO: 363840 - RNA, 22 nt, Homo sapiens
uauacaguaggcacucaguggc

SEQ ID NO: 363841 - RNA, 20 nt, Homo sapiens
uauagcaauuuuuuucuccu

SEQ ID NO: 363842 - RNA, 22 nt, Homo sapiens
uauagcacugagaauguaauuc

SEQ ID NO: 363843 - RNA, 17 nt, Homo sapiens
uauagcacuucucacau

SEQ ID NO: 363844 - RNA, 22 nt, Homo sapiens
uauagcuaugggauguauuugc

SEQ ID NO: 363845 - RNA, 22 nt, Homo sapiens
uauauguucuugcacuggaaag

SEQ ID NO: 363846 - RNA, 22 nt, Homo sapiens
uaucacagaggguauccuagag

SEQ ID NO: 363847 - RNA, 22 nt, Homo sapiens
uaucacagcgggguguacaccc

SEQ ID NO: 363848 - RNA, 21 nt, Homo sapiens
uaucacauuggugauuaaguu

SEQ ID NO: 363849 - RNA, 22 nt, Homo sapiens
uaucaccacccugggaaacaua
